United States Patent 11,369,692 (MATERIALS AND METHODS FOR TREATMENT OF DUCHENNE MUSCULAR DYSTROPHY) - sequence listing, part 29

SEQ ID NO: 957179 - DNA, 22 bp, Artificial Sequence
  chemically synthesized
tagttagcaataatatagaagt

SEQ ID NO: 957180 - DNA, 22 bp, Artificial Sequence
  chemically synthesized
tagccatttgaaacttctatat

SEQ ID NO: 957181 - DNA, 22 bp, Artificial Sequence
  chemically synthesized
ctagccatttgaaacttctata

SEQ ID NO: 957182 - DNA, 22 bp, Artificial Sequence
  chemically synthesized
cttctagccatttgaaacttct

SEQ ID NO: 957183 - DNA, 22 bp, Artificial Sequence
  chemically synthesized
gcaataatatagaagtttcaaa

SEQ ID NO: 957184 - DNA, 22 bp, Artificial Sequence
  chemically synthesized
tccttctagccatttgaaactt

SEQ ID NO: 957185 - DNA, 22 bp, Artificial Sequence
  chemically synthesized
aacgttctccttctagccattt

SEQ ID NO: 957186 - DNA, 22 bp, Artificial Sequence
  chemically synthesized
ggaacattcaacgttctccttc

SEQ ID NO: 957187 - DNA, 22 bp, Artificial Sequence
  chemically synthesized
caaatggctagaaggagaacgt

SEQ ID NO: 957188 - DNA, 22 bp, Artificial Sequence
  chemically synthesized
aaatggctagaaggagaacgtt

SEQ ID NO: 957189 - DNA, 22 bp, Artificial Sequence
  chemically synthesized
tgttgggaacattcaacgttct

SEQ ID NO: 957190 - DNA, 22 bp, Artificial Sequence
  chemically synthesized
gtgttgggaacattcaacgttc

SEQ ID NO: 957191 - DNA, 22 bp, Artificial Sequence
  chemically synthesized
tttgtgttgggaacattcaacg

SEQ ID NO: 957192 - DNA, 22 bp, Artificial Sequence
  chemically synthesized
atttgtgttgggaacattcaac

SEQ ID NO: 957193 - DNA, 22 bp, Artificial Sequence
  chemically synthesized
gaaggagaacgttgaatgttcc

SEQ ID NO: 957194 - DNA, 22 bp, Artificial Sequence
  chemically synthesized
gtcatttatttgtgttgggaac

SEQ ID NO: 957195 - DNA, 22 bp, Artificial Sequence
  chemically synthesized
aaacattggtcatttatttgtg

SEQ ID NO: 957196 - DNA, 22 bp, Artificial Sequence
  chemically synthesized
aatgttcccaacacaaataaat

SEQ ID NO: 957197 - DNA, 22 bp, Artificial Sequence
  chemically synthesized
tctcaaacattggtcatttatt

SEQ ID NO: 957198 - DNA, 22 bp, Artificial Sequence
  chemically synthesized
ccaacacaaataaatgaccaat

SEQ ID NO: 957199 - DNA, 22 bp, Artificial Sequence
  chemically synthesized
gcatatccattatctcaaacat

SEQ ID NO: 957200 - DNA, 22 bp, Artificial Sequence
  chemically synthesized
gagataatggatatgctaatta

SEQ ID NO: 957201 - DNA, 22 bp, Artificial Sequence
  chemically synthesized
agataatggatatgctaattac

SEQ ID NO: 957202 - DNA, 22 bp, Artificial Sequence
  chemically synthesized
attaccctgatctgatcactat

SEQ ID NO: 957203 - DNA, 22 bp, Artificial Sequence
  chemically synthesized
tatatgtaatgtatagtgatca

SEQ ID NO: 957204 - DNA, 22 bp, Artificial Sequence
  chemically synthesized
atatatgtaatgtatagtgatc

SEQ ID NO: 957205 - DNA, 22 bp, Artificial Sequence
  chemically synthesized
tatatatgtaatgtatagtgat

SEQ ID NO: 957206 - DNA, 22 bp, Artificial Sequence
  chemically synthesized
ttatatatgtaatgtatagtga

SEQ ID NO: 957207 - DNA, 22 bp, Artificial Sequence
  chemically synthesized
ccctgatctgatcactatacat

SEQ ID NO: 957208 - DNA, 22 bp, Artificial Sequence
  chemically synthesized
atctgatcactatacattacat

SEQ ID NO: 957209 - DNA, 22 bp, Artificial Sequence
  chemically synthesized
gtgatgtttttatatatgtaat

SEQ ID NO: 957210 - DNA, 22 bp, Artificial Sequence
  chemically synthesized
atcactatacattacatatata

SEQ ID NO: 957211 - DNA, 22 bp, Artificial Sequence
  chemically synthesized
tacattacatatataaaaacat

SEQ ID NO: 957212 - DNA, 22 bp, Artificial Sequence
  chemically synthesized
atggagaacctagtgatgtttt

SEQ ID NO: 957213 - DNA, 22 bp, Artificial Sequence
  chemically synthesized
catatataaaaacatcactagg

SEQ ID NO: 957214 - DNA, 22 bp, Artificial Sequence
  chemically synthesized
tacatattcatggagaacctag

SEQ ID NO: 957215 - DNA, 22 bp, Artificial Sequence
  chemically synthesized
acaaataataattgtacatatt

SEQ ID NO: 957216 - DNA, 22 bp, Artificial Sequence
  chemically synthesized
ggttctccatgaatatgtacaa

SEQ ID NO: 957217 - DNA, 22 bp, Artificial Sequence
  chemically synthesized
attgacaaataataattgtaca

SEQ ID NO: 957218 - DNA, 22 bp, Artificial Sequence
  chemically synthesized
aattgacaaataataattgtac

SEQ ID NO: 957219 - DNA, 22 bp, Artificial Sequence
  chemically synthesized
tccatgaatatgtacaattatt

SEQ ID NO: 957220 - DNA, 22 bp, Artificial Sequence
  chemically synthesized
taattgacaaataataattgta

SEQ ID NO: 957221 - DNA, 22 bp, Artificial Sequence
  chemically synthesized
ttaattgacaaataataattgt

SEQ ID NO: 957222 - DNA, 22 bp, Artificial Sequence
  chemically synthesized
catgaatatgtacaattattat

SEQ ID NO: 957223 - DNA, 22 bp, Artificial Sequence
  chemically synthesized
tttaattgacaaataataattg

SEQ ID NO: 957224 - DNA, 22 bp, Artificial Sequence
  chemically synthesized
ttttaattgacaaataataatt

SEQ ID NO: 957225 - DNA, 22 bp, Artificial Sequence
  chemically synthesized
aagaatttttttaattgacaaa

SEQ ID NO: 957226 - DNA, 22 bp, Artificial Sequence
  chemically synthesized
gaagaatttttttaattgacaa

SEQ ID NO: 957227 - DNA, 22 bp, Artificial Sequence
  chemically synthesized
tgaagaatttttttaattgaca

SEQ ID NO: 957228 - DNA, 22 bp, Artificial Sequence
  chemically synthesized
ttgaagaatttttttaattgac

SEQ ID NO: 957229 - DNA, 22 bp, Artificial Sequence
  chemically synthesized
cttttgaagaatttttttaatt

SEQ ID NO: 957230 - DNA, 22 bp, Artificial Sequence
  chemically synthesized
acttttgaagaatttttttaat

SEQ ID NO: 957231 - DNA, 22 bp, Artificial Sequence
  chemically synthesized
ttatttgtcaattaaaaaaatt

SEQ ID NO: 957232 - DNA, 22 bp, Artificial Sequence
  chemically synthesized
tttacttttgaagaattttttt

SEQ ID NO: 957233 - DNA, 22 bp, Artificial Sequence
  chemically synthesized
tttgtcaattaaaaaaattctt

SEQ ID NO: 957234 - DNA, 22 bp, Artificial Sequence
  chemically synthesized
gtcaattaaaaaaattcttcaa

SEQ ID NO: 957235 - DNA, 22 bp, Artificial Sequence
  chemically synthesized
cattgtttacttttgaagaatt

SEQ ID NO: 957236 - DNA, 22 bp, Artificial Sequence
  chemically synthesized
tcaattaaaaaaattcttcaaa

SEQ ID NO: 957237 - DNA, 22 bp, Artificial Sequence
  chemically synthesized
acattgtttacttttgaagaat

SEQ ID NO: 957238 - DNA, 22 bp, Artificial Sequence
  chemically synthesized
tacattgtttacttttgaagaa

SEQ ID NO: 957239 - DNA, 22 bp, Artificial Sequence
  chemically synthesized
ttttacattgtttacttttgaa

SEQ ID NO: 957240 - DNA, 22 bp, Artificial Sequence
  chemically synthesized
aaaaaattcttcaaaagtaaac

SEQ ID NO: 957241 - DNA, 22 bp, Artificial Sequence
  chemically synthesized
ctattttacattgtttactttt

SEQ ID NO: 957242 - DNA, 22 bp, Artificial Sequence
  chemically synthesized
ttcaaaagtaaacaatgtaaaa

SEQ ID NO: 957243 - DNA, 22 bp, Artificial Sequence
  chemically synthesized
caaaagtaaacaatgtaaaata

SEQ ID NO: 957244 - DNA, 22 bp, Artificial Sequence
  chemically synthesized
aaaagtaaacaatgtaaaatag

SEQ ID NO: 957245 - DNA, 22 bp, Artificial Sequence
  chemically synthesized
acatcacgtctactattttaca

SEQ ID NO: 957246 - DNA, 22 bp, Artificial Sequence
  chemically synthesized
tacctcacatcacgtctactat

SEQ ID NO: 957247 - DNA, 22 bp, Artificial Sequence
  chemically synthesized
atacctcacatcacgtctacta

SEQ ID NO: 957248 - DNA, 22 bp, Artificial Sequence
  chemically synthesized
cttatacctcacatcacgtcta

SEQ ID NO: 957249 - DNA, 22 bp, Artificial Sequence
  chemically synthesized
tccttatacctcacatcacgtc

SEQ ID NO: 957250 - DNA, 22 bp, Artificial Sequence
  chemically synthesized
ggaagttctccttatacctcac

SEQ ID NO: 957251 - DNA, 22 bp, Artificial Sequence
  chemically synthesized
attgggaagttctccttatacc

SEQ ID NO: 957252 - DNA, 22 bp, Artificial Sequence
  chemically synthesized
caaaattgattgggaagttctc

SEQ ID NO: 957253 - DNA, 22 bp, Artificial Sequence
  chemically synthesized
tgttccaaaattgattgggaag

SEQ ID NO: 957254 - DNA, 22 bp, Artificial Sequence
  chemically synthesized
atgttccaaaattgattgggaa

SEQ ID NO: 957255 - DNA, 22 bp, Artificial Sequence
  chemically synthesized
tatgttccaaaattgattggga

SEQ ID NO: 957256 - DNA, 22 bp, Artificial Sequence
  chemically synthesized
cccaatcaattttggaacataa

SEQ ID NO: 957257 - DNA, 22 bp, Artificial Sequence
  chemically synthesized
agaaatgaagttttatgttcca

SEQ ID NO: 957258 - DNA, 22 bp, Artificial Sequence
  chemically synthesized
ccaatcaattttggaacataaa

SEQ ID NO: 957259 - DNA, 22 bp, Artificial Sequence
  chemically synthesized
cctcagaaatgaagttttatgt

SEQ ID NO: 957260 - DNA, 22 bp, Artificial Sequence
  chemically synthesized
gcctcagaaatgaagttttatg

SEQ ID NO: 957261 - DNA, 22 bp, Artificial Sequence
  chemically synthesized
tgcctcagaaatgaagttttat

SEQ ID NO: 957262 - DNA, 22 bp, Artificial Sequence
  chemically synthesized
ctttgcctcagaaatgaagttt

SEQ ID NO: 957263 - DNA, 22 bp, Artificial Sequence
  chemically synthesized
cctttgcctcagaaatgaagtt

SEQ ID NO: 957264 - DNA, 22 bp, Artificial Sequence
  chemically synthesized
tggaacataaaacttcatttct

SEQ ID NO: 957265 - DNA, 22 bp, Artificial Sequence
  chemically synthesized
ttcctttgcctcagaaatgaag

SEQ ID NO: 957266 - DNA, 22 bp, Artificial Sequence
  chemically synthesized
ggaacataaaacttcatttctg

SEQ ID NO: 957267 - DNA, 22 bp, Artificial Sequence
  chemically synthesized
gaacataaaacttcatttctga

SEQ ID NO: 957268 - DNA, 22 bp, Artificial Sequence
  chemically synthesized
catttctgaggcaaaggaagaa

SEQ ID NO: 957269 - DNA, 22 bp, Artificial Sequence
  chemically synthesized
atttctgaggcaaaggaagaac

SEQ ID NO: 957270 - DNA, 22 bp, Artificial Sequence
  chemically synthesized
tataaaatgtcaagttcttcct

SEQ ID NO: 957271 - DNA, 22 bp, Artificial Sequence
  chemically synthesized
ctgaggcaaaggaagaacttga

SEQ ID NO: 957272 - DNA, 22 bp, Artificial Sequence
  chemically synthesized
tgaggcaaaggaagaacttgac

SEQ ID NO: 957273 - DNA, 22 bp, Artificial Sequence
  chemically synthesized
aggcaaaggaagaacttgacat

SEQ ID NO: 957274 - DNA, 22 bp, Artificial Sequence
  chemically synthesized
gcaaagaagttatataaaatgt

SEQ ID NO: 957275 - DNA, 22 bp, Artificial Sequence
  chemically synthesized
tggcaaagaagttatataaaat

SEQ ID NO: 957276 - DNA, 22 bp, Artificial Sequence
  chemically synthesized
gattctggcaaagaagttatat

SEQ ID NO: 957277 - DNA, 22 bp, Artificial Sequence
  chemically synthesized
gacattttatataacttctttg

SEQ ID NO: 957278 - DNA, 22 bp, Artificial Sequence
  chemically synthesized
acattttatataacttctttgc

SEQ ID NO: 957279 - DNA, 22 bp, Artificial Sequence
  chemically synthesized
tatataacttctttgccagaat

SEQ ID NO: 957280 - DNA, 22 bp, Artificial Sequence
  chemically synthesized
atataacttctttgccagaatc

SEQ ID NO: 957281 - DNA, 22 bp, Artificial Sequence
  chemically synthesized
tataacttctttgccagaatcc

SEQ ID NO: 957282 - DNA, 22 bp, Artificial Sequence
  chemically synthesized
ctttgccagaatccagtggctc

SEQ ID NO: 957283 - DNA, 22 bp, Artificial Sequence
  chemically synthesized
agaaaaatagtagagccactgg

SEQ ID NO: 957284 - DNA, 22 bp, Artificial Sequence
  chemically synthesized
tttgccagaatccagtggctct

SEQ ID NO: 957285 - DNA, 22 bp, Artificial Sequence
  chemically synthesized
cagaaaaatagtagagccactg

SEQ ID NO: 957286 - DNA, 22 bp, Artificial Sequence
  chemically synthesized
tgccagaatccagtggctctac

SEQ ID NO: 957287 - DNA, 22 bp, Artificial Sequence
  chemically synthesized
ttcagaaaaatagtagagccac

SEQ ID NO: 957288 - DNA, 22 bp, Artificial Sequence
  chemically synthesized
gccagaatccagtggctctact

SEQ ID NO: 957289 - DNA, 22 bp, Artificial Sequence
  chemically synthesized
ccagaatccagtggctctacta

SEQ ID NO: 957290 - DNA, 22 bp, Artificial Sequence
  chemically synthesized
tgcattcttcagaaaaatagta

SEQ ID NO: 957291 - DNA, 22 bp, Artificial Sequence
  chemically synthesized
atgcattcttcagaaaaatagt

SEQ ID NO: 957292 - DNA, 22 bp, Artificial Sequence
  chemically synthesized
tatgcattcttcagaaaaatag

SEQ ID NO: 957293 - DNA, 22 bp, Artificial Sequence
  chemically synthesized
tgattttatgcattcttcagaa

SEQ ID NO: 957294 - DNA, 22 bp, Artificial Sequence
  chemically synthesized
tactatttttctgaagaatgca

SEQ ID NO: 957295 - DNA, 22 bp, Artificial Sequence
  chemically synthesized
ctatttttctgaagaatgcata

SEQ ID NO: 957296 - DNA, 22 bp, Artificial Sequence
  chemically synthesized
tttttctgaagaatgcataaaa

SEQ ID NO: 957297 - DNA, 22 bp, Artificial Sequence
  chemically synthesized
ttctgaagaatgcataaaatca

SEQ ID NO: 957298 - DNA, 22 bp, Artificial Sequence
  chemically synthesized
tctgaagaatgcataaaatcac

SEQ ID NO: 957299 - DNA, 22 bp, Artificial Sequence
  chemically synthesized
ctgaagaatgcataaaatcaca

SEQ ID NO: 957300 - DNA, 22 bp, Artificial Sequence
  chemically synthesized
tgaagaatgcataaaatcacag

SEQ ID NO: 957301 - DNA, 22 bp, Artificial Sequence
  chemically synthesized
aagaatgcataaaatcacagta

SEQ ID NO: 957302 - DNA, 22 bp, Artificial Sequence
  chemically synthesized
caaagtatcatgatactgtgat

SEQ ID NO: 957303 - DNA, 22 bp, Artificial Sequence
  chemically synthesized
aattccaaagtatcatgatact

SEQ ID NO: 957304 - DNA, 22 bp, Artificial Sequence
  chemically synthesized
ctaaattccaaagtatcatgat

SEQ ID NO: 957305 - DNA, 22 bp, Artificial Sequence
  chemically synthesized
agtatagcagcctcctaaattc

SEQ ID NO: 957306 - DNA, 22 bp, Artificial Sequence
  chemically synthesized
aactcagtatagcagcctccta

SEQ ID NO: 957307 - DNA, 22 bp, Artificial Sequence
  chemically synthesized
tggaatttaggaggctgctata

SEQ ID NO: 957308 - DNA, 22 bp, Artificial Sequence
  chemically synthesized
ggaatttaggaggctgctatac

SEQ ID NO: 957309 - DNA, 22 bp, Artificial Sequence
  chemically synthesized
gaatttaggaggctgctatact

SEQ ID NO: 957310 - DNA, 22 bp, Artificial Sequence
  chemically synthesized
aggaggctgctatactgagttt

SEQ ID NO: 957311 - DNA, 22 bp, Artificial Sequence
  chemically synthesized
ggaggctgctatactgagttta

SEQ ID NO: 957312 - DNA, 22 bp, Artificial Sequence
  chemically synthesized
gatacaaacagacaggactaaa

SEQ ID NO: 957313 - DNA, 22 bp, Artificial Sequence
  chemically synthesized
ctatactgagtttagtcctgtc

SEQ ID NO: 957314 - DNA, 22 bp, Artificial Sequence
  chemically synthesized
ttagatacaaacagacaggact

SEQ ID NO: 957315 - DNA, 22 bp, Artificial Sequence
  chemically synthesized
gttagatacaaacagacaggac

SEQ ID NO: 957316 - DNA, 22 bp, Artificial Sequence
  chemically synthesized
tactgagtttagtcctgtctgt

SEQ ID NO: 957317 - DNA, 22 bp, Artificial Sequence
  chemically synthesized
tgttagatacaaacagacagga

SEQ ID NO: 957318 - DNA, 22 bp, Artificial Sequence
  chemically synthesized
tttgttagatacaaacagacag

SEQ ID NO: 957319 - DNA, 22 bp, Artificial Sequence
  chemically synthesized
ctttgttagatacaaacagaca

SEQ ID NO: 957320 - DNA, 22 bp, Artificial Sequence
  chemically synthesized
agtttagtcctgtctgtttgta

SEQ ID NO: 957321 - DNA, 22 bp, Artificial Sequence
  chemically synthesized
agtcctgtctgtttgtatctaa

SEQ ID NO: 957322 - DNA, 22 bp, Artificial Sequence
  chemically synthesized
gtcctgtctgtttgtatctaac

SEQ ID NO: 957323 - DNA, 22 bp, Artificial Sequence
  chemically synthesized
tctgtttgtatctaacaaagaa

SEQ ID NO: 957324 - DNA, 22 bp, Artificial Sequence
  chemically synthesized
gagaaaaagaaagatttctttg

SEQ ID NO: 957325 - DNA, 22 bp, Artificial Sequence
  chemically synthesized
tttgtatctaacaaagaaatct

SEQ ID NO: 957326 - DNA, 22 bp, Artificial Sequence
  chemically synthesized
gtatctaacaaagaaatctttc

SEQ ID NO: 957327 - DNA, 22 bp, Artificial Sequence
  chemically synthesized
tatctaacaaagaaatctttct

SEQ ID NO: 957328 - DNA, 22 bp, Artificial Sequence
  chemically synthesized
agggttggagaaaaagaaagat

SEQ ID NO: 957329 - DNA, 22 bp, Artificial Sequence
  chemically synthesized
acaaagaaatctttctttttct

SEQ ID NO: 957330 - DNA, 22 bp, Artificial Sequence
  chemically synthesized
caagatggagaaactgagggtt

SEQ ID NO: 957331 - DNA, 22 bp, Artificial Sequence
  chemically synthesized
tctttttctccaaccctcagtt

SEQ ID NO: 957332 - DNA, 22 bp, Artificial Sequence
  chemically synthesized
ccaagatggagaaactgagggt

SEQ ID NO: 957333 - DNA, 22 bp, Artificial Sequence
  chemically synthesized
ctttttctccaaccctcagttt

SEQ ID NO: 957334 - DNA, 22 bp, Artificial Sequence
  chemically synthesized
tttttctccaaccctcagtttc

SEQ ID NO: 957335 - DNA, 22 bp, Artificial Sequence
  chemically synthesized
tttccaagatggagaaactgag

SEQ ID NO: 957336 - DNA, 22 bp, Artificial Sequence
  chemically synthesized
tttctccaaccctcagtttctc

SEQ ID NO: 957337 - DNA, 22 bp, Artificial Sequence
  chemically synthesized
atttccaagatggagaaactga

SEQ ID NO: 957338 - DNA, 22 bp, Artificial Sequence
  chemically synthesized
ttctccaaccctcagtttctcc

SEQ ID NO: 957339 - DNA, 22 bp, Artificial Sequence
  chemically synthesized
tctccaaccctcagtttctcca

SEQ ID NO: 957340 - DNA, 22 bp, Artificial Sequence
  chemically synthesized
ttatttccaagatggagaaact

SEQ ID NO: 957341 - DNA, 22 bp, Artificial Sequence
  chemically synthesized
ctccaaccctcagtttctccat

SEQ ID NO: 957342 - DNA, 22 bp, Artificial Sequence
  chemically synthesized
cttatttccaagatggagaaac

SEQ ID NO: 957343 - DNA, 22 bp, Artificial Sequence
  chemically synthesized
tccaaccctcagtttctccatc

SEQ ID NO: 957344 - DNA, 22 bp, Artificial Sequence
  chemically synthesized
tcttatttccaagatggagaaa

SEQ ID NO: 957345 - DNA, 22 bp, Artificial Sequence
  chemically synthesized
caaccctcagtttctccatctt

SEQ ID NO: 957346 - DNA, 22 bp, Artificial Sequence
  chemically synthesized
actttcttatttccaagatgga

SEQ ID NO: 957347 - DNA, 22 bp, Artificial Sequence
  chemically synthesized
agtttctccatcttggaaataa

SEQ ID NO: 957348 - DNA, 22 bp, Artificial Sequence
  chemically synthesized
catctaactttcttatttccaa

SEQ ID NO: 957349 - DNA, 22 bp, Artificial Sequence
  chemically synthesized
ctccatcttggaaataagaaag

SEQ ID NO: 957350 - DNA, 22 bp, Artificial Sequence
  chemically synthesized
tccatcttggaaataagaaagt

SEQ ID NO: 957351 - DNA, 22 bp, Artificial Sequence
  chemically synthesized
tcattacatctaactttcttat

SEQ ID NO: 957352 - DNA, 22 bp, Artificial Sequence
  chemically synthesized
catcttggaaataagaaagtta

SEQ ID NO: 957353 - DNA, 22 bp, Artificial Sequence
  chemically synthesized
atgttatcattacatctaactt

SEQ ID NO: 957354 - DNA, 22 bp, Artificial Sequence
  chemically synthesized
ggaaataagaaagttagatgta

SEQ ID NO: 957355 - DNA, 22 bp, Artificial Sequence
  chemically synthesized
gaaataagaaagttagatgtaa

SEQ ID NO: 957356 - DNA, 22 bp, Artificial Sequence
  chemically synthesized
agaggtaaggacattcatgtta

SEQ ID NO: 957357 - DNA, 22 bp, Artificial Sequence
  chemically synthesized
gatgtaatgataacatgaatgt

SEQ ID NO: 957358 - DNA, 22 bp, Artificial Sequence
  chemically synthesized
aaagattaagaggtaaggacat

SEQ ID NO: 957359 - DNA, 22 bp, Artificial Sequence
  chemically synthesized
atatgatcacataaaactgaaa

SEQ ID NO: 957360 - DNA, 22 bp, Artificial Sequence
  chemically synthesized
acctcttaatctttcagtttta

SEQ ID NO: 957361 - DNA, 22 bp, Artificial Sequence
  chemically synthesized
cctcttaatctttcagttttat

SEQ ID NO: 957362 - DNA, 22 bp, Artificial Sequence
  chemically synthesized
ttaatctttcagttttatgtga

SEQ ID NO: 957363 - DNA, 22 bp, Artificial Sequence
  chemically synthesized
aatctttcagttttatgtgatc

SEQ ID NO: 957364 - DNA, 22 bp, Artificial Sequence
  chemically synthesized
atctttcagttttatgtgatca

SEQ ID NO: 957365 - DNA, 22 bp, Artificial Sequence
  chemically synthesized
tcagttttatgtgatcatatga

SEQ ID NO: 957366 - DNA, 22 bp, Artificial Sequence
  chemically synthesized
cagttttatgtgatcatatgag

SEQ ID NO: 957367 - DNA, 22 bp, Artificial Sequence
  chemically synthesized
agttttatgtgatcatatgagt

SEQ ID NO: 957368 - DNA, 22 bp, Artificial Sequence
  chemically synthesized
atcagagagaagatactcatat

SEQ ID NO: 957369 - DNA, 22 bp, Artificial Sequence
  chemically synthesized
gatcagagagaagatactcata

SEQ ID NO: 957370 - DNA, 22 bp, Artificial Sequence
  chemically synthesized
tatgtgatcatatgagtatctt

SEQ ID NO: 957371 - DNA, 22 bp, Artificial Sequence
  chemically synthesized
atgtgatcatatgagtatcttc

SEQ ID NO: 957372 - DNA, 22 bp, Artificial Sequence
  chemically synthesized
cttgatcagagagaagatactc

SEQ ID NO: 957373 - DNA, 22 bp, Artificial Sequence
  chemically synthesized
tgtgatcatatgagtatcttct

SEQ ID NO: 957374 - DNA, 22 bp, Artificial Sequence
  chemically synthesized
agcagactgcttgatcagagag

SEQ ID NO: 957375 - DNA, 22 bp, Artificial Sequence
  chemically synthesized
tcaaatcactaagcagactgct

SEQ ID NO: 957376 - DNA, 22 bp, Artificial Sequence
  chemically synthesized
ctctctgatcaagcagtctgct

SEQ ID NO: 957377 - DNA, 22 bp, Artificial Sequence
  chemically synthesized
atcaaatcactaagcagactgc

SEQ ID NO: 957378 - DNA, 22 bp, Artificial Sequence
  chemically synthesized
tctctgatcaagcagtctgctt

SEQ ID NO: 957379 - DNA, 22 bp, Artificial Sequence
  chemically synthesized
tctgatcaagcagtctgcttag

SEQ ID NO: 957380 - DNA, 22 bp, Artificial Sequence
  chemically synthesized
atttatcaaatcactaagcaga

SEQ ID NO: 957381 - DNA, 22 bp, Artificial Sequence
  chemically synthesized
tgatcaagcagtctgcttagtg

SEQ ID NO: 957382 - DNA, 22 bp, Artificial Sequence
  chemically synthesized
aatttatcaaatcactaagcag

SEQ ID NO: 957383 - DNA, 22 bp, Artificial Sequence
  chemically synthesized
atcaagcagtctgcttagtgat

SEQ ID NO: 957384 - DNA, 22 bp, Artificial Sequence
  chemically synthesized
tcatttaatttatcaaatcact

SEQ ID NO: 957385 - DNA, 22 bp, Artificial Sequence
  chemically synthesized
atcatttaatttatcaaatcac

SEQ ID NO: 957386 - DNA, 22 bp, Artificial Sequence
  chemically synthesized
cttagtgatttgataaattaaa

SEQ ID NO: 957387 - DNA, 22 bp, Artificial Sequence
  chemically synthesized
agtgatttgataaattaaatga

SEQ ID NO: 957388 - DNA, 22 bp, Artificial Sequence
  chemically synthesized
gtgatttgataaattaaatgat

SEQ ID NO: 957389 - DNA, 22 bp, Artificial Sequence
  chemically synthesized
aaagcaaatgaaagtttatcat

SEQ ID NO: 957390 - DNA, 22 bp, Artificial Sequence
  chemically synthesized
caaagcaaatgaaagtttatca

SEQ ID NO: 957391 - DNA, 22 bp, Artificial Sequence
  chemically synthesized
gataaattaaatgataaacttt

SEQ ID NO: 957392 - DNA, 22 bp, Artificial Sequence
  chemically synthesized
ataaattaaatgataaactttc

SEQ ID NO: 957393 - DNA, 22 bp, Artificial Sequence
  chemically synthesized
aatgataaactttcatttgctt

SEQ ID NO: 957394 - DNA, 22 bp, Artificial Sequence
  chemically synthesized
tcatttgctttgaagtgttttt

SEQ ID NO: 957395 - DNA, 22 bp, Artificial Sequence
  chemically synthesized
catttgctttgaagtgtttttt

SEQ ID NO: 957396 - DNA, 22 bp, Artificial Sequence
  chemically synthesized
atttgctttgaagtgtttttta

SEQ ID NO: 957397 - DNA, 22 bp, Artificial Sequence
  chemically synthesized
gctttgaagtgttttttatttt

SEQ ID NO: 957398 - DNA, 22 bp, Artificial Sequence
  chemically synthesized
ctttgaagtgttttttattttg

SEQ ID NO: 957399 - DNA, 22 bp, Artificial Sequence
  chemically synthesized
tagtgacaaaaacaaaataaaa

SEQ ID NO: 957400 - DNA, 22 bp, Artificial Sequence
  chemically synthesized
atagtgacaaaaacaaaataaa

SEQ ID NO: 957401 - DNA, 22 bp, Artificial Sequence
  chemically synthesized
tatagtgacaaaaacaaaataa

SEQ ID NO: 957402 - DNA, 22 bp, Artificial Sequence
  chemically synthesized
tgaagtgttttttattttgttt

SEQ ID NO: 957403 - DNA, 22 bp, Artificial Sequence
  chemically synthesized
ttatagtgacaaaaacaaaata

SEQ ID NO: 957404 - DNA, 22 bp, Artificial Sequence
  chemically synthesized
gaagtgttttttattttgtttt

SEQ ID NO: 957405 - DNA, 22 bp, Artificial Sequence
  chemically synthesized
aagtgttttttattttgttttt

SEQ ID NO: 957406 - DNA, 22 bp, Artificial Sequence
  chemically synthesized
tttttatagtgacaaaaacaaa

SEQ ID NO: 957407 - DNA, 22 bp, Artificial Sequence
  chemically synthesized
attatttttatagtgacaaaaa

SEQ ID NO: 957408 - DNA, 22 bp, Artificial Sequence
  chemically synthesized
tttattttgtttttgtcactat

SEQ ID NO: 957409 - DNA, 22 bp, Artificial Sequence
  chemically synthesized
ttattttgtttttgtcactata

SEQ ID NO: 957410 - DNA, 22 bp, Artificial Sequence
  chemically synthesized
tattttgtttttgtcactataa

SEQ ID NO: 957411 - DNA, 22 bp, Artificial Sequence
  chemically synthesized
attttgtttttgtcactataaa

SEQ ID NO: 957412 - DNA, 22 bp, Artificial Sequence
  chemically synthesized
ttttgtttttgtcactataaaa

SEQ ID NO: 957413 - DNA, 22 bp, Artificial Sequence
  chemically synthesized
aaaaattaattatttttatagt

SEQ ID NO: 957414 - DNA, 22 bp, Artificial Sequence
  chemically synthesized
tgtttttgtcactataaaaata

SEQ ID NO: 957415 - DNA, 22 bp, Artificial Sequence
  chemically synthesized
gtttttgtcactataaaaataa

SEQ ID NO: 957416 - DNA, 22 bp, Artificial Sequence
  chemically synthesized
tttttgtcactataaaaataat

SEQ ID NO: 957417 - DNA, 22 bp, Artificial Sequence
  chemically synthesized
ttgtcactataaaaataattaa

SEQ ID NO: 957418 - DNA, 22 bp, Artificial Sequence
  chemically synthesized
tgtcactataaaaataattaat

SEQ ID NO: 957419 - DNA, 22 bp, Artificial Sequence
  chemically synthesized
gtcactataaaaataattaatt

SEQ ID NO: 957420 - DNA, 22 bp, Artificial Sequence
  chemically synthesized
taaatactcaaaaattaattat

SEQ ID NO: 957421 - DNA, 22 bp, Artificial Sequence
  chemically synthesized
tcactataaaaataattaattt

SEQ ID NO: 957422 - DNA, 22 bp, Artificial Sequence
  chemically synthesized
taaaaataattaatttttgagt

SEQ ID NO: 957423 - DNA, 22 bp, Artificial Sequence
  chemically synthesized
gaaggacaatgctgtaaatact

SEQ ID NO: 957424 - DNA, 22 bp, Artificial Sequence
  chemically synthesized
atttttgagtatttacagcatt

SEQ ID NO: 957425 - DNA, 22 bp, Artificial Sequence
  chemically synthesized
gcagttggaaggacaatgctgt

SEQ ID NO: 957426 - DNA, 22 bp, Artificial Sequence
  chemically synthesized
agcagttggaaggacaatgctg

SEQ ID NO: 957427 - DNA, 22 bp, Artificial Sequence
  chemically synthesized
ttgagtatttacagcattgtcc

SEQ ID NO: 957428 - DNA, 22 bp, Artificial Sequence
  chemically synthesized
tagcagttggaaggacaatgct

SEQ ID NO: 957429 - DNA, 22 bp, Artificial Sequence
  chemically synthesized
tgagtatttacagcattgtcct

SEQ ID NO: 957430 - DNA, 22 bp, Artificial Sequence
  chemically synthesized
gagtatttacagcattgtcctt

SEQ ID NO: 957431 - DNA, 22 bp, Artificial Sequence
  chemically synthesized
tttagcagttggaaggacaatg

SEQ ID NO: 957432 - DNA, 22 bp, Artificial Sequence
  chemically synthesized
agtatttacagcattgtccttc

SEQ ID NO: 957433 - DNA, 22 bp, Artificial Sequence
  chemically synthesized
ctttagcagttggaaggacaat

SEQ ID NO: 957434 - DNA, 22 bp, Artificial Sequence
  chemically synthesized
tctttagcagttggaaggacaa

SEQ ID NO: 957435 - DNA, 22 bp, Artificial Sequence
  chemically synthesized
acagcattgtccttccaactgc

SEQ ID NO: 957436 - DNA, 22 bp, Artificial Sequence
  chemically synthesized
cagcattgtccttccaactgct

SEQ ID NO: 957437 - DNA, 22 bp, Artificial Sequence
  chemically synthesized
tccttccaactgctaaagaaag

SEQ ID NO: 957438 - DNA, 22 bp, Artificial Sequence
  chemically synthesized
ccaactgctaaagaaagtcatg

SEQ ID NO: 957439 - DNA, 22 bp, Artificial Sequence
  chemically synthesized
caactgctaaagaaagtcatgt

SEQ ID NO: 957440 - DNA, 22 bp, Artificial Sequence
  chemically synthesized
ctaaagaaagtcatgtccttgc

SEQ ID NO: 957441 - DNA, 22 bp, Artificial Sequence
  chemically synthesized
aggaagaaaatggcaaggacat

SEQ ID NO: 957442 - DNA, 22 bp, Artificial Sequence
  chemically synthesized
gaggaagaaaatggcaaggaca

SEQ ID NO: 957443 - DNA, 22 bp, Artificial Sequence
  chemically synthesized
tgaggaagaaaatggcaaggac

SEQ ID NO: 957444 - DNA, 22 bp, Artificial Sequence
  chemically synthesized
aagaaagtcatgtccttgccat

SEQ ID NO: 957445 - DNA, 22 bp, Artificial Sequence
  chemically synthesized
agtctttgaggaagaaaatggc

SEQ ID NO: 957446 - DNA, 22 bp, Artificial Sequence
  chemically synthesized
taagtctttgaggaagaaaatg

SEQ ID NO: 957447 - DNA, 22 bp, Artificial Sequence
  chemically synthesized
ctaagtctttgaggaagaaaat

SEQ ID NO: 957448 - DNA, 22 bp, Artificial Sequence
  chemically synthesized
tctaagtctttgaggaagaaaa

SEQ ID NO: 957449 - DNA, 22 bp, Artificial Sequence
  chemically synthesized
ttctaagtctttgaggaagaaa

SEQ ID NO: 957450 - DNA, 22 bp, Artificial Sequence
  chemically synthesized
tttctaagtctttgaggaagaa

SEQ ID NO: 957451 - DNA, 22 bp, Artificial Sequence
  chemically synthesized
tttttctaagtctttgaggaag

SEQ ID NO: 957452 - DNA, 22 bp, Artificial Sequence
  chemically synthesized
ctttttctaagtctttgaggaa

SEQ ID NO: 957453 - DNA, 22 bp, Artificial Sequence
  chemically synthesized
gccattttcttcctcaaagact

SEQ ID NO: 957454 - DNA, 22 bp, Artificial Sequence
  chemically synthesized
ccattttcttcctcaaagactt

SEQ ID NO: 957455 - DNA, 22 bp, Artificial Sequence
  chemically synthesized
tccttctttttctaagtctttg

SEQ ID NO: 957456 - DNA, 22 bp, Artificial Sequence
  chemically synthesized
gtccttctttttctaagtcttt

SEQ ID NO: 957457 - DNA, 22 bp, Artificial Sequence
  chemically synthesized
tcttcctcaaagacttagaaaa

SEQ ID NO: 957458 - DNA, 22 bp, Artificial Sequence
  chemically synthesized
gtttgtccttctttttctaagt

SEQ ID NO: 957459 - DNA, 22 bp, Artificial Sequence
  chemically synthesized
cttcctcaaagacttagaaaaa

SEQ ID NO: 957460 - DNA, 22 bp, Artificial Sequence
  chemically synthesized
agtttgtccttctttttctaag

SEQ ID NO: 957461 - DNA, 22 bp, Artificial Sequence
  chemically synthesized
ttcctcaaagacttagaaaaag

SEQ ID NO: 957462 - DNA, 22 bp, Artificial Sequence
  chemically synthesized
cctcaaagacttagaaaaagaa

SEQ ID NO: 957463 - DNA, 22 bp, Artificial Sequence
  chemically synthesized
ctcaaagacttagaaaaagaag

SEQ ID NO: 957464 - DNA, 22 bp, Artificial Sequence
  chemically synthesized
ggcttagtttgtccttcttttt

SEQ ID NO: 957465 - DNA, 22 bp, Artificial Sequence
  chemically synthesized
gggcttagtttgtccttctttt

SEQ ID NO: 957466 - DNA, 22 bp, Artificial Sequence
  chemically synthesized
aaagacttagaaaaagaaggac

SEQ ID NO: 957467 - DNA, 22 bp, Artificial Sequence
  chemically synthesized
tgggcttagtttgtccttcttt

SEQ ID NO: 957468 - DNA, 22 bp, Artificial Sequence
  chemically synthesized
actttgggcttagtttgtcctt

SEQ ID NO: 957469 - DNA, 22 bp, Artificial Sequence
  chemically synthesized
ctaactttgggcttagtttgtc

SEQ ID NO: 957470 - DNA, 22 bp, Artificial Sequence
  chemically synthesized
agaaaaagaaggacaaactaag

SEQ ID NO: 957471 - DNA, 22 bp, Artificial Sequence
  chemically synthesized
gaaaaagaaggacaaactaagc

SEQ ID NO: 957472 - DNA, 22 bp, Artificial Sequence
  chemically synthesized
tgctaactttgggcttagtttg

SEQ ID NO: 957473 - DNA, 22 bp, Artificial Sequence
  chemically synthesized
cctctgctaactttgggcttag

SEQ ID NO: 957474 - DNA, 22 bp, Artificial Sequence
  chemically synthesized
ccctctgctaactttgggctta

SEQ ID NO: 957475 - DNA, 22 bp, Artificial Sequence
  chemically synthesized
cttccctctgctaactttgggc

SEQ ID NO: 957476 - DNA, 22 bp, Artificial Sequence
  chemically synthesized
ccttccctctgctaactttggg

SEQ ID NO: 957477 - DNA, 22 bp, Artificial Sequence
  chemically synthesized
atatttccttccctctgctaac

SEQ ID NO: 957478 - DNA, 22 bp, Artificial Sequence
  chemically synthesized
aatatttccttccctctgctaa

SEQ ID NO: 957479 - DNA, 22 bp, Artificial Sequence
  chemically synthesized
agcccaaagttagcagagggaa

SEQ ID NO: 957480 - DNA, 22 bp, Artificial Sequence
  chemically synthesized
atcttaatatttccttccctct

SEQ ID NO: 957481 - DNA, 22 bp, Artificial Sequence
  chemically synthesized
atctaatcttaatatttccttc

SEQ ID NO: 957482 - DNA, 22 bp, Artificial Sequence
  chemically synthesized
tgatctaatcttaatatttcct

SEQ ID NO: 957483 - DNA, 22 bp, Artificial Sequence
  chemically synthesized
ctgatctaatcttaatatttcc

SEQ ID NO: 957484 - DNA, 22 bp, Artificial Sequence
  chemically synthesized
tctgatctaatcttaatatttc

SEQ ID NO: 957485 - DNA, 22 bp, Artificial Sequence
  chemically synthesized
gcagagggaaggaaatattaag

SEQ ID NO: 957486 - DNA, 22 bp, Artificial Sequence
  chemically synthesized
ttctgatctaatcttaatattt

SEQ ID NO: 957487 - DNA, 22 bp, Artificial Sequence
  chemically synthesized
tttctgatctaatcttaatatt

SEQ ID NO: 957488 - DNA, 22 bp, Artificial Sequence
  chemically synthesized
ttttctgatctaatcttaatat

SEQ ID NO: 957489 - DNA, 22 bp, Artificial Sequence
  chemically synthesized
gcttttttctgatctaatctta

SEQ ID NO: 957490 - DNA, 22 bp, Artificial Sequence
  chemically synthesized
ggcttttttctgatctaatctt

SEQ ID NO: 957491 - DNA, 22 bp, Artificial Sequence
  chemically synthesized
tggcttttttctgatctaatct

SEQ ID NO: 957492 - DNA, 22 bp, Artificial Sequence
  chemically synthesized
aattttggcttttttctgatct

SEQ ID NO: 957493 - DNA, 22 bp, Artificial Sequence
  chemically synthesized
caattttggcttttttctgatc

SEQ ID NO: 957494 - DNA, 22 bp, Artificial Sequence
  chemically synthesized
tttcaattttggcttttttctg

SEQ ID NO: 957495 - DNA, 22 bp, Artificial Sequence
  chemically synthesized
tatttcaattttggcttttttc

SEQ ID NO: 957496 - DNA, 22 bp, Artificial Sequence
  chemically synthesized
agattagatcagaaaaaagcca

SEQ ID NO: 957497 - DNA, 22 bp, Artificial Sequence
  chemically synthesized
ctatttcaattttggctttttt

SEQ ID NO: 957498 - DNA, 22 bp, Artificial Sequence
  chemically synthesized
tctatttcaattttggcttttt

SEQ ID NO: 957499 - DNA, 22 bp, Artificial Sequence
  chemically synthesized
ttttctatttcaattttggctt

SEQ ID NO: 957500 - DNA, 22 bp, Artificial Sequence
  chemically synthesized
gatcagaaaaaagccaaaattg

SEQ ID NO: 957501 - DNA, 22 bp, Artificial Sequence
  chemically synthesized
ttgttttctatttcaattttgg

SEQ ID NO: 957502 - DNA, 22 bp, Artificial Sequence
  chemically synthesized
tattgttttctatttcaatttt

SEQ ID NO: 957503 - DNA, 22 bp, Artificial Sequence
  chemically synthesized
ctattgttttctatttcaattt

SEQ ID NO: 957504 - DNA, 22 bp, Artificial Sequence
  chemically synthesized
tctattgttttctatttcaatt

SEQ ID NO: 957505 - DNA, 22 bp, Artificial Sequence
  chemically synthesized
ttctattgttttctatttcaat

SEQ ID NO: 957506 - DNA, 22 bp, Artificial Sequence
  chemically synthesized
atttttctattgttttctattt

SEQ ID NO: 957507 - DNA, 22 bp, Artificial Sequence
  chemically synthesized
ttgatttttctattgttttcta

SEQ ID NO: 957508 - DNA, 22 bp, Artificial Sequence
  chemically synthesized
gttgatttttctattgttttct

SEQ ID NO: 957509 - DNA, 22 bp, Artificial Sequence
  chemically synthesized
tgttgatttttctattgttttc

SEQ ID NO: 957510 - DNA, 22 bp, Artificial Sequence
  chemically synthesized
gctttgttgatttttctattgt

SEQ ID NO: 957511 - DNA, 22 bp, Artificial Sequence
  chemically synthesized
agctttgttgatttttctattg

SEQ ID NO: 957512 - DNA, 22 bp, Artificial Sequence
  chemically synthesized
aaatagaaaacaatagaaaaat

SEQ ID NO: 957513 - DNA, 22 bp, Artificial Sequence
  chemically synthesized
ttagctttgttgatttttctat

SEQ ID NO: 957514 - DNA, 22 bp, Artificial Sequence
  chemically synthesized
aaaaaactcttagctttgttga

SEQ ID NO: 957515 - DNA, 22 bp, Artificial Sequence
  chemically synthesized
aaaaaaactcttagctttgttg

SEQ ID NO: 957516 - DNA, 22 bp, Artificial Sequence
  chemically synthesized
taaaaaaactcttagctttgtt

SEQ ID NO: 957517 - DNA, 22 bp, Artificial Sequence
  chemically synthesized
ttaaaaaaactcttagctttgt

SEQ ID NO: 957518 - DNA, 22 bp, Artificial Sequence
  chemically synthesized
tttttaaaaaaactcttagctt

SEQ ID NO: 957519 - DNA, 22 bp, Artificial Sequence
  chemically synthesized
gtttttaaaaaaactcttagct

SEQ ID NO: 957520 - DNA, 22 bp, Artificial Sequence
  chemically synthesized
atttgtttttaaaaaaactctt

SEQ ID NO: 957521 - DNA, 22 bp, Artificial Sequence
  chemically synthesized
ttgatttgtttttaaaaaaact

SEQ ID NO: 957522 - DNA, 22 bp, Artificial Sequence
  chemically synthesized
attgatttgtttttaaaaaaac

SEQ ID NO: 957523 - DNA, 22 bp, Artificial Sequence
  chemically synthesized
tattgatttgtttttaaaaaaa

SEQ ID NO: 957524 - DNA, 22 bp, Artificial Sequence
  chemically synthesized
tcaattttattgatttgttttt

SEQ ID NO: 957525 - DNA, 22 bp, Artificial Sequence
  chemically synthesized
agagtttttttaaaaacaaatc

SEQ ID NO: 957526 - DNA, 22 bp, Artificial Sequence
  chemically synthesized
gtcaattttattgatttgtttt

SEQ ID NO: 957527 - DNA, 22 bp, Artificial Sequence
  chemically synthesized
ttttaaaaacaaatcaataaaa

SEQ ID NO: 957528 - DNA, 22 bp, Artificial Sequence
  chemically synthesized
aagatttgtcaattttattgat

SEQ ID NO: 957529 - DNA, 22 bp, Artificial Sequence
  chemically synthesized
tttaaaaacaaatcaataaaat

SEQ ID NO: 957530 - DNA, 22 bp, Artificial Sequence
  chemically synthesized
ttaaaaacaaatcaataaaatt

SEQ ID NO: 957531 - DNA, 22 bp, Artificial Sequence
  chemically synthesized
taaaaacaaatcaataaaattg

SEQ ID NO: 957532 - DNA, 22 bp, Artificial Sequence
  chemically synthesized
aaaaacaaatcaataaaattga

SEQ ID NO: 957533 - DNA, 22 bp, Artificial Sequence
  chemically synthesized
cctaaagatttgtcaattttat

SEQ ID NO: 957534 - DNA, 22 bp, Artificial Sequence
  chemically synthesized
aaaacaaatcaataaaattgac

SEQ ID NO: 957535 - DNA, 22 bp, Artificial Sequence
  chemically synthesized
atctacctaaagatttgtcaat

SEQ ID NO: 957536 - DNA, 22 bp, Artificial Sequence
  chemically synthesized
aatctacctaaagatttgtcaa

SEQ ID NO: 957537 - DNA, 22 bp, Artificial Sequence
  chemically synthesized
cttaatctacctaaagatttgt

SEQ ID NO: 957538 - DNA, 22 bp, Artificial Sequence
  chemically synthesized
acttaatctacctaaagatttg

SEQ ID NO: 957539 - DNA, 22 bp, Artificial Sequence
  chemically synthesized
tacttaatctacctaaagattt

SEQ ID NO: 957540 - DNA, 22 bp, Artificial Sequence
  chemically synthesized
ttacttaatctacctaaagatt

SEQ ID NO: 957541 - DNA, 22 bp, Artificial Sequence
  chemically synthesized
tttacttaatctacctaaagat

SEQ ID NO: 957542 - DNA, 22 bp, Artificial Sequence
  chemically synthesized
ttttacttaatctacctaaaga

SEQ ID NO: 957543 - DNA, 22 bp, Artificial Sequence
  chemically synthesized
tttttacttaatctacctaaag

SEQ ID NO: 957544 - DNA, 22 bp, Artificial Sequence
  chemically synthesized
ttttttacttaatctacctaaa

SEQ ID NO: 957545 - DNA, 22 bp, Artificial Sequence
  chemically synthesized
tttttttacttaatctacctaa

SEQ ID NO: 957546 - DNA, 22 bp, Artificial Sequence
  chemically synthesized
ttttttttacttaatctaccta

SEQ ID NO: 957547 - DNA, 22 bp, Artificial Sequence
  chemically synthesized
tttttttttacttaatctacct

SEQ ID NO: 957548 - DNA, 22 bp, Artificial Sequence
  chemically synthesized
ttttttttttacttaatctacc

SEQ ID NO: 957549 - DNA, 22 bp, Artificial Sequence
  chemically synthesized
acaaatctttaggtagattaag

SEQ ID NO: 957550 - DNA, 22 bp, Artificial Sequence
  chemically synthesized
tttttttttttacttaatctac

SEQ ID NO: 957551 - DNA, 22 bp, Artificial Sequence
  chemically synthesized
ttttttttttttacttaatcta

SEQ ID NO: 957552 - DNA, 22 bp, Artificial Sequence
  chemically synthesized
tttttttttttttacttaatct

SEQ ID NO: 957553 - DNA, 22 bp, Artificial Sequence
  chemically synthesized
ttttttttttttttacttaatc

SEQ ID NO: 957554 - DNA, 22 bp, Artificial Sequence
  chemically synthesized
tttttttttttttttacttaat

SEQ ID NO: 957555 - DNA, 22 bp, Artificial Sequence
  chemically synthesized
ttttttttttttttttacttaa

SEQ ID NO: 957556 - DNA, 22 bp, Artificial Sequence
  chemically synthesized
tttttttttttttttttactta

SEQ ID NO: 957557 - DNA, 22 bp, Artificial Sequence
  chemically synthesized
taggtagattaagtaaaaaaaa

SEQ ID NO: 957558 - DNA, 22 bp, Artificial Sequence
  chemically synthesized
ctttttttttttttttttttac

SEQ ID NO: 957559 - DNA, 22 bp, Artificial Sequence
  chemically synthesized
aggtagattaagtaaaaaaaaa

SEQ ID NO: 957560 - DNA, 22 bp, Artificial Sequence
  chemically synthesized
ccttttttttttttttttttta

SEQ ID NO: 957561 - DNA, 22 bp, Artificial Sequence
  chemically synthesized
ggtagattaagtaaaaaaaaaa

SEQ ID NO: 957562 - DNA, 22 bp, Artificial Sequence
  chemically synthesized
tccttttttttttttttttttt

SEQ ID NO: 957563 - DNA, 22 bp, Artificial Sequence
  chemically synthesized
aattttcctttttttttttttt

SEQ ID NO: 957564 - DNA, 22 bp, Artificial Sequence
  chemically synthesized
gaattttccttttttttttttt

SEQ ID NO: 957565 - DNA, 22 bp, Artificial Sequence
  chemically synthesized
agtaaaaaaaaaaaaaaaaaaa

SEQ ID NO: 957566 - DNA, 22 bp, Artificial Sequence
  chemically synthesized
tttgaattttcctttttttttt

SEQ ID NO: 957567 - DNA, 22 bp, Artificial Sequence
  chemically synthesized
atttgaattttccttttttttt

SEQ ID NO: 957568 - DNA, 22 bp, Artificial Sequence
  chemically synthesized
cttatttgaattttcctttttt

SEQ ID NO: 957569 - DNA, 22 bp, Artificial Sequence
  chemically synthesized
acttatttgaattttccttttt

SEQ ID NO: 957570 - DNA, 22 bp, Artificial Sequence
  chemically synthesized
tacttatttgaattttcctttt

SEQ ID NO: 957571 - DNA, 22 bp, Artificial Sequence
  chemically synthesized
attttacttatttgaattttcc

SEQ ID NO: 957572 - DNA, 22 bp, Artificial Sequence
  chemically synthesized
tgattttacttatttgaatttt

SEQ ID NO: 957573 - DNA, 22 bp, Artificial Sequence
  chemically synthesized
ctgattttacttatttgaattt

SEQ ID NO: 957574 - DNA, 22 bp, Artificial Sequence
  chemically synthesized
atttctgattttacttatttga

SEQ ID NO: 957575 - DNA, 22 bp, Artificial Sequence
  chemically synthesized
catttctgattttacttatttg

SEQ ID NO: 957576 - DNA, 22 bp, Artificial Sequence
  chemically synthesized
tcatttctgattttacttattt

SEQ ID NO: 957577 - DNA, 22 bp, Artificial Sequence
  chemically synthesized
tttcatttctgattttacttat

SEQ ID NO: 957578 - DNA, 22 bp, Artificial Sequence
  chemically synthesized
ctctttcatttctgattttact

SEQ ID NO: 957579 - DNA, 22 bp, Artificial Sequence
  chemically synthesized
aaataagtaaaatcagaaatga

SEQ ID NO: 957580 - DNA, 22 bp, Artificial Sequence
  chemically synthesized
taatgtctcctctttcatttct

SEQ ID NO: 957581 - DNA, 22 bp, Artificial Sequence
  chemically synthesized
gataccagttgtaatgtctcct

SEQ ID NO: 957582 - DNA, 22 bp, Artificial Sequence
  chemically synthesized
ggataccagttgtaatgtctcc

SEQ ID NO: 957583 - DNA, 22 bp, Artificial Sequence
  chemically synthesized
tggataccagttgtaatgtctc

SEQ ID NO: 957584 - DNA, 22 bp, Artificial Sequence
  chemically synthesized
ttggataccagttgtaatgtct

SEQ ID NO: 957585 - DNA, 22 bp, Artificial Sequence
  chemically synthesized
tttggataccagttgtaatgtc

SEQ ID NO: 957586 - DNA, 22 bp, Artificial Sequence
  chemically synthesized
tttttggataccagttgtaatg

SEQ ID NO: 957587 - DNA, 22 bp, Artificial Sequence
  chemically synthesized
cattctttttggataccagttg

SEQ ID NO: 957588 - DNA, 22 bp, Artificial Sequence
  chemically synthesized
gcattctttttggataccagtt

SEQ ID NO: 957589 - DNA, 22 bp, Artificial Sequence
  chemically synthesized
taatcatttgcattctttttgg

SEQ ID NO: 957590 - DNA, 22 bp, Artificial Sequence
  chemically synthesized
ataatcatttgcattctttttg

SEQ ID NO: 957591 - DNA, 22 bp, Artificial Sequence
  chemically synthesized
caactggtatccaaaaagaatg

SEQ ID NO: 957592 - DNA, 22 bp, Artificial Sequence
  chemically synthesized
gtatccaaaaagaatgcaaatg

SEQ ID NO: 957593 - DNA, 22 bp, Artificial Sequence
  chemically synthesized
cagcagtgtcttataatcattt

SEQ ID NO: 957594 - DNA, 22 bp, Artificial Sequence
  chemically synthesized
acagcagtgtcttataatcatt

SEQ ID NO: 957595 - DNA, 22 bp, Artificial Sequence
  chemically synthesized
tttacagcagtgtcttataatc

SEQ ID NO: 957596 - DNA, 22 bp, Artificial Sequence
  chemically synthesized
acatacagttgtttacagcagt

SEQ ID NO: 957597 - DNA, 22 bp, Artificial Sequence
  chemically synthesized
ggttaacatacagttgtttaca

SEQ ID NO: 957598 - DNA, 22 bp, Artificial Sequence
  chemically synthesized
taagacactgctgtaaacaact

SEQ ID NO: 957599 - DNA, 22 bp, Artificial Sequence
  chemically synthesized
taggttaacatacagttgttta

SEQ ID NO: 957600 - DNA, 22 bp, Artificial Sequence
  chemically synthesized
ctaggttaacatacagttgttt

SEQ ID NO: 957601 - DNA, 22 bp, Artificial Sequence
  chemically synthesized
tctaggttaacatacagttgtt

SEQ ID NO: 957602 - DNA, 22 bp, Artificial Sequence
  chemically synthesized
ttctaggttaacatacagttgt

SEQ ID NO: 957603 - DNA, 22 bp, Artificial Sequence
  chemically synthesized
tttctaggttaacatacagttg

SEQ ID NO: 957604 - DNA, 22 bp, Artificial Sequence
  chemically synthesized
ttttctaggttaacatacagtt

SEQ ID NO: 957605 - DNA, 22 bp, Artificial Sequence
  chemically synthesized
ctgtaaacaactgtatgttaac

SEQ ID NO: 957606 - DNA, 22 bp, Artificial Sequence
  chemically synthesized
atttttttctaggttaacatac

SEQ ID NO: 957607 - DNA, 22 bp, Artificial Sequence
  chemically synthesized
taaacaactgtatgttaaccta

SEQ ID NO: 957608 - DNA, 22 bp, Artificial Sequence
  chemically synthesized
ttcatttttttctaggttaaca

SEQ ID NO: 957609 - DNA, 22 bp, Artificial Sequence
  chemically synthesized
gttcatttttttctaggttaac

SEQ ID NO: 957610 - DNA, 22 bp, Artificial Sequence
  chemically synthesized
tatgttaacctagaaaaaaatg

SEQ ID NO: 957611 - DNA, 22 bp, Artificial Sequence
  chemically synthesized
aaggaatttgttcatttttttc

SEQ ID NO: 957612 - DNA, 22 bp, Artificial Sequence
  chemically synthesized
caaggaatttgttcattttttt

SEQ ID NO: 957613 - DNA, 22 bp, Artificial Sequence
  chemically synthesized
acctagaaaaaaatgaacaaat

SEQ ID NO: 957614 - DNA, 22 bp, Artificial Sequence
  chemically synthesized
catgtttcaaggaatttgttca

SEQ ID NO: 957615 - DNA, 22 bp, Artificial Sequence
  chemically synthesized
gaaaaaaatgaacaaattcctt

SEQ ID NO: 957616 - DNA, 22 bp, Artificial Sequence
  chemically synthesized
gtagattgcatgtttcaaggaa

SEQ ID NO: 957617 - DNA, 22 bp, Artificial Sequence
  chemically synthesized
aatattggtagattgcatgttt

SEQ ID NO: 957618 - DNA, 22 bp, Artificial Sequence
  chemically synthesized
aagattcaatattggtagattg

SEQ ID NO: 957619 - DNA, 22 bp, Artificial Sequence
  chemically synthesized
cttgaaacatgcaatctaccaa

SEQ ID NO: 957620 - DNA, 22 bp, Artificial Sequence
  chemically synthesized
caagattcaatattggtagatt

SEQ ID NO: 957621 - DNA, 22 bp, Artificial Sequence
  chemically synthesized
ttcaagattcaatattggtaga

SEQ ID NO: 957622 - DNA, 22 bp, Artificial Sequence
  chemically synthesized
gaaacatgcaatctaccaatat

SEQ ID NO: 957623 - DNA, 22 bp, Artificial Sequence
  chemically synthesized
cttcaagattcaatattggtag

SEQ ID NO: 957624 - DNA, 22 bp, Artificial Sequence
  chemically synthesized
aaacatgcaatctaccaatatt

SEQ ID NO: 957625 - DNA, 22 bp, Artificial Sequence
  chemically synthesized
tttcttcaagattcaatattgg

SEQ ID NO: 957626 - DNA, 22 bp, Artificial Sequence
  chemically synthesized
tatttcttcaagattcaatatt

SEQ ID NO: 957627 - DNA, 22 bp, Artificial Sequence
  chemically synthesized
ctatttcttcaagattcaatat

SEQ ID NO: 957628 - DNA, 22 bp, Artificial Sequence
  chemically synthesized
tctatttcttcaagattcaata

SEQ ID NO: 957629 - DNA, 22 bp, Artificial Sequence
  chemically synthesized
agattttctatttcttcaagat

SEQ ID NO: 957630 - DNA, 22 bp, Artificial Sequence
  chemically synthesized
ccaatattgaatcttgaagaaa

SEQ ID NO: 957631 - DNA, 22 bp, Artificial Sequence
  chemically synthesized
ctcagattttctatttcttcaa

SEQ ID NO: 957632 - DNA, 22 bp, Artificial Sequence
  chemically synthesized
ggcctactcagattttctattt

SEQ ID NO: 957633 - DNA, 22 bp, Artificial Sequence
  chemically synthesized
cggcctactcagattttctatt

SEQ ID NO: 957634 - DNA, 22 bp, Artificial Sequence
  chemically synthesized
aatcttgaagaaatagaaaatc

SEQ ID NO: 957635 - DNA, 22 bp, Artificial Sequence
  chemically synthesized
gtttcggcctactcagattttc

SEQ ID NO: 957636 - DNA, 22 bp, Artificial Sequence
  chemically synthesized
gaagaaatagaaaatctgagta

SEQ ID NO: 957637 - DNA, 22 bp, Artificial Sequence
  chemically synthesized
ctagtttcggcctactcagatt

SEQ ID NO: 957638 - DNA, 22 bp, Artificial Sequence
  chemically synthesized
aagaaatagaaaatctgagtag

SEQ ID NO: 957639 - DNA, 22 bp, Artificial Sequence
  chemically synthesized
actagtttcggcctactcagat

SEQ ID NO: 957640 - DNA, 22 bp, Artificial Sequence
  chemically synthesized
cttactagtttcggcctactca

SEQ ID NO: 957641 - DNA, 22 bp, Artificial Sequence
  chemically synthesized
aatctccttactagtttcggcc

SEQ ID NO: 957642 - DNA, 22 bp, Artificial Sequence
  chemically synthesized
attcaatctccttactagtttc

SEQ ID NO: 957643 - DNA, 22 bp, Artificial Sequence
  chemically synthesized
ctgattcaatctccttactagt

SEQ ID NO: 957644 - DNA, 22 bp, Artificial Sequence
  chemically synthesized
agtaggccgaaactagtaagga

SEQ ID NO: 957645 - DNA, 22 bp, Artificial Sequence
  chemically synthesized
gactactgattcaatctcctta

SEQ ID NO: 957646 - DNA, 22 bp, Artificial Sequence
  chemically synthesized
ggactactgattcaatctcctt

SEQ ID NO: 957647 - DNA, 22 bp, Artificial Sequence
  chemically synthesized
tggactactgattcaatctcct

SEQ ID NO: 957648 - DNA, 22 bp, Artificial Sequence
  chemically synthesized
gaaggttttggactactgattc

SEQ ID NO: 957649 - DNA, 22 bp, Artificial Sequence
  chemically synthesized
gtaaggagattgaatcagtagt

SEQ ID NO: 957650 - DNA, 22 bp, Artificial Sequence
  chemically synthesized
ttggaaggttttggactactga

SEQ ID NO: 957651 - DNA, 22 bp, Artificial Sequence
  chemically synthesized
gttggaaggttttggactactg

SEQ ID NO: 957652 - DNA, 22 bp, Artificial Sequence
  chemically synthesized
tgttggaaggttttggactact

SEQ ID NO: 957653 - DNA, 22 bp, Artificial Sequence
  chemically synthesized
tttgttggaaggttttggacta

SEQ ID NO: 957654 - DNA, 22 bp, Artificial Sequence
  chemically synthesized
ctttgttggaaggttttggact

SEQ ID NO: 957655 - DNA, 22 bp, Artificial Sequence
  chemically synthesized
tctttgttggaaggttttggac

SEQ ID NO: 957656 - DNA, 22 bp, Artificial Sequence
  chemically synthesized
ttctttgttggaaggttttgga

SEQ ID NO: 957657 - DNA, 22 bp, Artificial Sequence
  chemically synthesized
aatcagtagtccaaaaccttcc

SEQ ID NO: 957658 - DNA, 22 bp, Artificial Sequence
  chemically synthesized
ggcttttctttgttggaaggtt

SEQ ID NO: 957659 - DNA, 22 bp, Artificial Sequence
  chemically synthesized
gtcctgggcttttctttgttgg

SEQ ID NO: 957660 - DNA, 22 bp, Artificial Sequence
  chemically synthesized
ggtcctgggcttttctttgttg

SEQ ID NO: 957661 - DNA, 22 bp, Artificial Sequence
  chemically synthesized
ccaacaaagaaaagcccaggac

SEQ ID NO: 957662 - DNA, 22 bp, Artificial Sequence
  chemically synthesized
caacaaagaaaagcccaggacc

SEQ ID NO: 957663 - DNA, 22 bp, Artificial Sequence
  chemically synthesized
accagtgatgacatttggtcct

SEQ ID NO: 957664 - DNA, 22 bp, Artificial Sequence
  chemically synthesized
caccagtgatgacatttggtcc

SEQ ID NO: 957665 - DNA, 22 bp, Artificial Sequence
  chemically synthesized
gatttcaccagtgatgacattt

SEQ ID NO: 957666 - DNA, 22 bp, Artificial Sequence
  chemically synthesized
attagatttcaccagtgatgac

SEQ ID NO: 957667 - DNA, 22 bp, Artificial Sequence
  chemically synthesized
ttcattagatttcaccagtgat

SEQ ID NO: 957668 - DNA, 22 bp, Artificial Sequence
  chemically synthesized
actgttcattagatttcaccag

SEQ ID NO: 957669 - DNA, 22 bp, Artificial Sequence
  chemically synthesized
aactgttcattagatttcacca

SEQ ID NO: 957670 - DNA, 22 bp, Artificial Sequence
  chemically synthesized
taactgttcattagatttcacc

SEQ ID NO: 957671 - DNA, 22 bp, Artificial Sequence
  chemically synthesized
tttaactgttcattagatttca

SEQ ID NO: 957672 - DNA, 22 bp, Artificial Sequence
  chemically synthesized
ctttaactgttcattagatttc

SEQ ID NO: 957673 - DNA, 22 bp, Artificial Sequence
  chemically synthesized
ttctttaactgttcattagatt

SEQ ID NO: 957674 - DNA, 22 bp, Artificial Sequence
  chemically synthesized
attcttctttaactgttcatta

SEQ ID NO: 957675 - DNA, 22 bp, Artificial Sequence
  chemically synthesized
gtgaaatctaatgaacagttaa

SEQ ID NO: 957676 - DNA, 22 bp, Artificial Sequence
  chemically synthesized
gtgttaattcttctttaactgt

SEQ ID NO: 957677 - DNA, 22 bp, Artificial Sequence
  chemically synthesized
atgaacagttaaagaagaatta

SEQ ID NO: 957678 - DNA, 22 bp, Artificial Sequence
  chemically synthesized
agaaggattggtgttaattctt

SEQ ID NO: 957679 - DNA, 22 bp, Artificial Sequence
  chemically synthesized
gagaaggattggtgttaattct

SEQ ID NO: 957680 - DNA, 22 bp, Artificial Sequence
  chemically synthesized
aagaagaattaacaccaatcct

SEQ ID NO: 957681 - DNA, 22 bp, Artificial Sequence
  chemically synthesized
aagaatttgagaaggattggtg

SEQ ID NO: 957682 - DNA, 22 bp, Artificial Sequence
  chemically synthesized
tgaagaatttgagaaggattgg

SEQ ID NO: 957683 - DNA, 22 bp, Artificial Sequence
  chemically synthesized
ctgaagaatttgagaaggattg

SEQ ID NO: 957684 - DNA, 22 bp, Artificial Sequence
  chemically synthesized
tctgaagaatttgagaaggatt

SEQ ID NO: 957685 - DNA, 22 bp, Artificial Sequence
  chemically synthesized
ttctgaagaatttgagaaggat

SEQ ID NO: 957686 - DNA, 22 bp, Artificial Sequence
  chemically synthesized
atttttctgaagaatttgagaa

SEQ ID NO: 957687 - DNA, 22 bp, Artificial Sequence
  chemically synthesized
aatttttctgaagaatttgaga

SEQ ID NO: 957688 - DNA, 22 bp, Artificial Sequence
  chemically synthesized
acaccaatccttctcaaattct

SEQ ID NO: 957689 - DNA, 22 bp, Artificial Sequence
  chemically synthesized
taatttttctgaagaatttgag

SEQ ID NO: 957690 - DNA, 22 bp, Artificial Sequence
  chemically synthesized
tttaatttttctgaagaatttg

SEQ ID NO: 957691 - DNA, 22 bp, Artificial Sequence
  chemically synthesized
tctttaatttttctgaagaatt

SEQ ID NO: 957692 - DNA, 22 bp, Artificial Sequence
  chemically synthesized
ctctttaatttttctgaagaat

SEQ ID NO: 957693 - DNA, 22 bp, Artificial Sequence
  chemically synthesized
ttctctttaatttttctgaaga

SEQ ID NO: 957694 - DNA, 22 bp, Artificial Sequence
  chemically synthesized
tcttctctttaatttttctgaa

SEQ ID NO: 957695 - DNA, 22 bp, Artificial Sequence
  chemically synthesized
ctcaaattcttcagaaaaatta

SEQ ID NO: 957696 - DNA, 22 bp, Artificial Sequence
  chemically synthesized
tcaaattcttcagaaaaattaa

SEQ ID NO: 957697 - DNA, 22 bp, Artificial Sequence
  chemically synthesized
aaattcttcagaaaaattaaag

SEQ ID NO: 957698 - DNA, 22 bp, Artificial Sequence
  chemically synthesized
gaagtgttctcttctctttaat

SEQ ID NO: 957699 - DNA, 22 bp, Artificial Sequence
  chemically synthesized
ggaagtgttctcttctctttaa

SEQ ID NO: 957700 - DNA, 22 bp, Artificial Sequence
  chemically synthesized
ttcagaaaaattaaagagaaga

SEQ ID NO: 957701 - DNA, 22 bp, Artificial Sequence
  chemically synthesized
cagaaaaattaaagagaagaga

SEQ ID NO: 957702 - DNA, 22 bp, Artificial Sequence
  chemically synthesized
agaaaaattaaagagaagagaa

SEQ ID NO: 957703 - DNA, 22 bp, Artificial Sequence
  chemically synthesized
tagaatgagcttggaagtgttc

SEQ ID NO: 957704 - DNA, 22 bp, Artificial Sequence
  chemically synthesized
gtagaatgagcttggaagtgtt

SEQ ID NO: 957705 - DNA, 22 bp, Artificial Sequence
  chemically synthesized
aagagaagagaacacttccaag

SEQ ID NO: 957706 - DNA, 22 bp, Artificial Sequence
  chemically synthesized
atgccccttgtagaatgagctt

SEQ ID NO: 957707 - DNA, 22 bp, Artificial Sequence
  chemically synthesized
ccaagctcattctacaaggggc

SEQ ID NO: 957708 - DNA, 22 bp, Artificial Sequence
  chemically synthesized
caagctcattctacaaggggca

SEQ ID NO: 957709 - DNA, 22 bp, Artificial Sequence
  chemically synthesized
atatcaggatactgatgcccct

SEQ ID NO: 957710 - DNA, 22 bp, Artificial Sequence
  chemically synthesized
gatatcaggatactgatgcccc

SEQ ID NO: 957711 - DNA, 22 bp, Artificial Sequence
  chemically synthesized
tgatatcaggatactgatgccc

SEQ ID NO: 957712 - DNA, 22 bp, Artificial Sequence
  chemically synthesized
attctacaaggggcatcagtat

SEQ ID NO: 957713 - DNA, 22 bp, Artificial Sequence
  chemically synthesized
actttgatatcaggatactgat

SEQ ID NO: 957714 - DNA, 22 bp, Artificial Sequence
  chemically synthesized
tacaaggggcatcagtatcctg

SEQ ID NO: 957715 - DNA, 22 bp, Artificial Sequence
  chemically synthesized
ttgactttgatatcaggatact

SEQ ID NO: 957716 - DNA, 22 bp, Artificial Sequence
  chemically synthesized
caaggggcatcagtatcctgat

SEQ ID NO: 957717 - DNA, 22 bp, Artificial Sequence
  chemically synthesized
attgactttgatatcaggatac

SEQ ID NO: 957718 - DNA, 22 bp, Artificial Sequence
  chemically synthesized
tattgactttgatatcaggata

SEQ ID NO: 957719 - DNA, 22 bp, Artificial Sequence
  chemically synthesized
ttattgactttgatatcaggat

SEQ ID NO: 957720 - DNA, 22 bp, Artificial Sequence
  chemically synthesized
gtgtcttttattgactttgata

SEQ ID NO: 957721 - DNA, 22 bp, Artificial Sequence
  chemically synthesized
ctagtgtcttttattgactttg

SEQ ID NO: 957722 - DNA, 22 bp, Artificial Sequence
  chemically synthesized
tcctagtgtcttttattgactt

SEQ ID NO: 957723 - DNA, 22 bp, Artificial Sequence
  chemically synthesized
ctcctagtgtcttttattgact

SEQ ID NO: 957724 - DNA, 22 bp, Artificial Sequence
  chemically synthesized
tctcctagtgtcttttattgac

SEQ ID NO: 957725 - DNA, 22 bp, Artificial Sequence
  chemically synthesized
ttctcctagtgtcttttattga

SEQ ID NO: 957726 - DNA, 22 bp, Artificial Sequence
  chemically synthesized
atatcaaagtcaataaaagaca

SEQ ID NO: 957727 - DNA, 22 bp, Artificial Sequence
  chemically synthesized
tacttttctcctagtgtctttt

SEQ ID NO: 957728 - DNA, 22 bp, Artificial Sequence
  chemically synthesized
tgtacttttctcctagtgtctt

SEQ ID NO: 957729 - DNA, 22 bp, Artificial Sequence
  chemically synthesized
ttctgtacttttctcctagtgt

SEQ ID NO: 957730 - DNA, 22 bp, Artificial Sequence
  chemically synthesized
tcagcggtattgttctgtactt

SEQ ID NO: 957731 - DNA, 22 bp, Artificial Sequence
  chemically synthesized
atcagcggtattgttctgtact

SEQ ID NO: 957732 - DNA, 22 bp, Artificial Sequence
  chemically synthesized
ggagaaaagtacagaacaatac

SEQ ID NO: 957733 - DNA, 22 bp, Artificial Sequence
  chemically synthesized
tatttatcagcggtattgttct

SEQ ID NO: 957734 - DNA, 22 bp, Artificial Sequence
  chemically synthesized
tatatttatcagcggtattgtt

SEQ ID NO: 957735 - DNA, 22 bp, Artificial Sequence
  chemically synthesized
ctatatttatcagcggtattgt

SEQ ID NO: 957736 - DNA, 22 bp, Artificial Sequence
  chemically synthesized
cttctatatttatcagcggtat

SEQ ID NO: 957737 - DNA, 22 bp, Artificial Sequence
  chemically synthesized
gcttctatatttatcagcggta

SEQ ID NO: 957738 - DNA, 22 bp, Artificial Sequence
  chemically synthesized
tgcttctatatttatcagcggt

SEQ ID NO: 957739 - DNA, 22 bp, Artificial Sequence
  chemically synthesized
ttttgcttctatatttatcagc

SEQ ID NO: 957740 - DNA, 22 bp, Artificial Sequence
  chemically synthesized
atgagttattttgcttctatat

SEQ ID NO: 957741 - DNA, 22 bp, Artificial Sequence
  chemically synthesized
aatgagttattttgcttctata

SEQ ID NO: 957742 - DNA, 22 bp, Artificial Sequence
  chemically synthesized
taatgagttattttgcttctat

SEQ ID NO: 957743 - DNA, 22 bp, Artificial Sequence
  chemically synthesized
ataaatatagaagcaaaataac

SEQ ID NO: 957744 - DNA, 22 bp, Artificial Sequence
  chemically synthesized
gtattttaatgagttattttgc

SEQ ID NO: 957745 - DNA, 22 bp, Artificial Sequence
  chemically synthesized
ctagtattttaatgagttattt

SEQ ID NO: 957746 - DNA, 22 bp, Artificial Sequence
  chemically synthesized
gctagtattttaatgagttatt

SEQ ID NO: 957747 - DNA, 22 bp, Artificial Sequence
  chemically synthesized
agtttgctagtattttaatgag

SEQ ID NO: 957748 - DNA, 22 bp, Artificial Sequence
  chemically synthesized
agttcagtttgctagtatttta

SEQ ID NO: 957749 - DNA, 22 bp, Artificial Sequence
  chemically synthesized
ttgagttcagtttgctagtatt

SEQ ID NO: 957750 - DNA, 22 bp, Artificial Sequence
  chemically synthesized
attaaaatactagcaaactgaa

SEQ ID NO: 957751 - DNA, 22 bp, Artificial Sequence
  chemically synthesized
aatatactgttgagttcagttt

SEQ ID NO: 957752 - DNA, 22 bp, Artificial Sequence
  chemically synthesized
caatatactgttgagttcagtt

SEQ ID NO: 957753 - DNA, 22 bp, Artificial Sequence
  chemically synthesized
aaatactagcaaactgaactca

SEQ ID NO: 957754 - DNA, 22 bp, Artificial Sequence
  chemically synthesized
tcaatatactgttgagttcagt

SEQ ID NO: 957755 - DNA, 22 bp, Artificial Sequence
  chemically synthesized
gcaaactgaactcaacagtata

SEQ ID NO: 957756 - DNA, 22 bp, Artificial Sequence
  chemically synthesized
gtgtataatcctttcaatatac

SEQ ID NO: 957757 - DNA, 22 bp, Artificial Sequence
  chemically synthesized
tcgtgtataatcctttcaatat

SEQ ID NO: 957758 - DNA, 22 bp, Artificial Sequence
  chemically synthesized
aactcaacagtatattgaaagg

SEQ ID NO: 957759 - DNA, 22 bp, Artificial Sequence
  chemically synthesized
aacagtatattgaaaggattat

SEQ ID NO: 957760 - DNA, 22 bp, Artificial Sequence
  chemically synthesized
tatggctctcgtgtataatcct

SEQ ID NO: 957761 - DNA, 22 bp, Artificial Sequence
  chemically synthesized
aaaggattatacacgagagcca

SEQ ID NO: 957762 - DNA, 22 bp, Artificial Sequence
  chemically synthesized
caagaataaatcctatatggct

SEQ ID NO: 957763 - DNA, 22 bp, Artificial Sequence
  chemically synthesized
tacacgagagccatataggatt

SEQ ID NO: 957764 - DNA, 22 bp, Artificial Sequence
  chemically synthesized
cattccaagaataaatcctata

SEQ ID NO: 957765 - DNA, 22 bp, Artificial Sequence
  chemically synthesized
gcattccaagaataaatcctat

SEQ ID NO: 957766 - DNA, 22 bp, Artificial Sequence
  chemically synthesized
tgcattccaagaataaatccta

SEQ ID NO: 957767 - DNA, 22 bp, Artificial Sequence
  chemically synthesized
ttgcattccaagaataaatcct

SEQ ID NO: 957768 - DNA, 22 bp, Artificial Sequence
  chemically synthesized
aaccatttttgcattccaagaa

SEQ ID NO: 957769 - DNA, 22 bp, Artificial Sequence
  chemically synthesized
ataaattgaaccatttttgcat

SEQ ID NO: 957770 - DNA, 22 bp, Artificial Sequence
  chemically synthesized
cataaattgaaccatttttgca

SEQ ID NO: 957771 - DNA, 22 bp, Artificial Sequence
  chemically synthesized
tcataaattgaaccatttttgc

SEQ ID NO: 957772 - DNA, 22 bp, Artificial Sequence
  chemically synthesized
attcttggaatgcaaaaatggt

SEQ ID NO: 957773 - DNA, 22 bp, Artificial Sequence
  chemically synthesized
ttcttggaatgcaaaaatggtt

SEQ ID NO: 957774 - DNA, 22 bp, Artificial Sequence
  chemically synthesized
gttttcataaattgaaccattt

SEQ ID NO: 957775 - DNA, 22 bp, Artificial Sequence
  chemically synthesized
ttggaatgcaaaaatggttcaa

SEQ ID NO: 957776 - DNA, 22 bp, Artificial Sequence
  chemically synthesized
ggaatgcaaaaatggttcaatt

SEQ ID NO: 957777 - DNA, 22 bp, Artificial Sequence
  chemically synthesized
gaatgcaaaaatggttcaattt

SEQ ID NO: 957778 - DNA, 22 bp, Artificial Sequence
  chemically synthesized
attagttttcataaattgaacc

SEQ ID NO: 957779 - DNA, 22 bp, Artificial Sequence
  chemically synthesized
tgtatcacactgattagttttc

SEQ ID NO: 957780 - DNA, 22 bp, Artificial Sequence
  chemically synthesized
aatttatgaaaactaatcagtg

SEQ ID NO: 957781 - DNA, 22 bp, Artificial Sequence
  chemically synthesized
atgttgtgtatcacactgatta

SEQ ID NO: 957782 - DNA, 22 bp, Artificial Sequence
  chemically synthesized
ttaatgttgtgtatcacactga

SEQ ID NO: 957783 - DNA, 22 bp, Artificial Sequence
  chemically synthesized
atgaaaactaatcagtgtgata

SEQ ID NO: 957784 - DNA, 22 bp, Artificial Sequence
  chemically synthesized
tgaaaactaatcagtgtgatac

SEQ ID NO: 957785 - DNA, 22 bp, Artificial Sequence
  chemically synthesized
tgttaatgttgtgtatcacact

SEQ ID NO: 957786 - DNA, 22 bp, Artificial Sequence
  chemically synthesized
ttctgttaatgttgtgtatcac

SEQ ID NO: 957787 - DNA, 22 bp, Artificial Sequence
  chemically synthesized
gttctgttaatgttgtgtatca

SEQ ID NO: 957788 - DNA, 22 bp, Artificial Sequence
  chemically synthesized
tgttctgttaatgttgtgtatc

SEQ ID NO: 957789 - DNA, 22 bp, Artificial Sequence
  chemically synthesized
atcagtgtgatacacaacatta

SEQ ID NO: 957790 - DNA, 22 bp, Artificial Sequence
  chemically synthesized
gcctttgttctgttaatgttgt

SEQ ID NO: 957791 - DNA, 22 bp, Artificial Sequence
  chemically synthesized
agcctttgttctgttaatgttg

SEQ ID NO: 957792 - DNA, 22 bp, Artificial Sequence
  chemically synthesized
tagcctttgttctgttaatgtt

SEQ ID NO: 957793 - DNA, 22 bp, Artificial Sequence
  chemically synthesized
ttagcctttgttctgttaatgt

SEQ ID NO: 957794 - DNA, 22 bp, Artificial Sequence
  chemically synthesized
agatgaccatagatttttagcc

SEQ ID NO: 957795 - DNA, 22 bp, Artificial Sequence
  chemically synthesized
acagaacaaaggctaaaaatct

SEQ ID NO: 957796 - DNA, 22 bp, Artificial Sequence
  chemically synthesized
ttgagatgaccatagattttta

SEQ ID NO: 957797 - DNA, 22 bp, Artificial Sequence
  chemically synthesized
cagctattgagatgaccataga

SEQ ID NO: 957798 - DNA, 22 bp, Artificial Sequence
  chemically synthesized
tgcagctattgagatgaccata

SEQ ID NO: 957799 - DNA, 22 bp, Artificial Sequence
  chemically synthesized
ctgcagctattgagatgaccat

SEQ ID NO: 957800 - DNA, 22 bp, Artificial Sequence
  chemically synthesized
tctgcagctattgagatgacca

SEQ ID NO: 957801 - DNA, 22 bp, Artificial Sequence
  chemically synthesized
ttctgcagctattgagatgacc

SEQ ID NO: 957802 - DNA, 22 bp, Artificial Sequence
  chemically synthesized
tttctgcagctattgagatgac

SEQ ID NO: 957803 - DNA, 22 bp, Artificial Sequence
  chemically synthesized
aaaatctatggtcatctcaata

SEQ ID NO: 957804 - DNA, 22 bp, Artificial Sequence
  chemically synthesized
agcgctttttctgcagctattg

SEQ ID NO: 957805 - DNA, 22 bp, Artificial Sequence
  chemically synthesized
tggtcatctcaatagctgcaga

SEQ ID NO: 957806 - DNA, 22 bp, Artificial Sequence
  chemically synthesized
ttaagcgctttttctgcagcta

SEQ ID NO: 957807 - DNA, 22 bp, Artificial Sequence
  chemically synthesized
gttaagcgctttttctgcagct

SEQ ID NO: 957808 - DNA, 22 bp, Artificial Sequence
  chemically synthesized
aaacttgttaagcgctttttct

SEQ ID NO: 957809 - DNA, 22 bp, Artificial Sequence
  chemically synthesized
aatagctgcagaaaaagcgctt

SEQ ID NO: 957810 - DNA, 22 bp, Artificial Sequence
  chemically synthesized
cagaaaaagcgcttaacaagtt

SEQ ID NO: 957811 - DNA, 22 bp, Artificial Sequence
  chemically synthesized
tcatgaaagtgttgaaacttgt

SEQ ID NO: 957812 - DNA, 22 bp, Artificial Sequence
  chemically synthesized
atcatgaaagtgttgaaacttg

SEQ ID NO: 957813 - DNA, 22 bp, Artificial Sequence
  chemically synthesized
tatcatgaaagtgttgaaactt

SEQ ID NO: 957814 - DNA, 22 bp, Artificial Sequence
  chemically synthesized
ttatcatgaaagtgttgaaact

SEQ ID NO: 957815 - DNA, 22 bp, Artificial Sequence
  chemically synthesized
tgtgtttttatcatgaaagtgt

SEQ ID NO: 957816 - DNA, 22 bp, Artificial Sequence
  chemically synthesized
aacaagtttcaacactttcatg

SEQ ID NO: 957817 - DNA, 22 bp, Artificial Sequence
  chemically synthesized
acaagtttcaacactttcatga

SEQ ID NO: 957818 - DNA, 22 bp, Artificial Sequence
  chemically synthesized
ttgtgtgtttttatcatgaaag

SEQ ID NO: 957819 - DNA, 22 bp, Artificial Sequence
  chemically synthesized
gttgtgtgtttttatcatgaaa

SEQ ID NO: 957820 - DNA, 22 bp, Artificial Sequence
  chemically synthesized
gtttgttgtgtgtttttatcat

SEQ ID NO: 957821 - DNA, 22 bp, Artificial Sequence
  chemically synthesized
caacactttcatgataaaaaca

SEQ ID NO: 957822 - DNA, 22 bp, Artificial Sequence
  chemically synthesized
aacactttcatgataaaaacac

SEQ ID NO: 957823 - DNA, 22 bp, Artificial Sequence
  chemically synthesized
ctagtttgttgtgtgtttttat

SEQ ID NO: 957824 - DNA, 22 bp, Artificial Sequence
  chemically synthesized
ttcctagtttgttgtgtgtttt

SEQ ID NO: 957825 - DNA, 22 bp, Artificial Sequence
  chemically synthesized
tattcctagtttgttgtgtgtt

SEQ ID NO: 957826 - DNA, 22 bp, Artificial Sequence
  chemically synthesized
tcatgataaaaacacacaacaa

SEQ ID NO: 957827 - DNA, 22 bp, Artificial Sequence
  chemically synthesized
catgataaaaacacacaacaaa

SEQ ID NO: 957828 - DNA, 22 bp, Artificial Sequence
  chemically synthesized
atgataaaaacacacaacaaac

SEQ ID NO: 957829 - DNA, 22 bp, Artificial Sequence
  chemically synthesized
gttctattcctagtttgttgtg

SEQ ID NO: 957830 - DNA, 22 bp, Artificial Sequence
  chemically synthesized
cgttctattcctagtttgttgt

SEQ ID NO: 957831 - DNA, 22 bp, Artificial Sequence
  chemically synthesized
cggtaatttcgttctattccta

SEQ ID NO: 957832 - DNA, 22 bp, Artificial Sequence
  chemically synthesized
tgttgcggtaatttcgttctat

SEQ ID NO: 957833 - DNA, 22 bp, Artificial Sequence
  chemically synthesized
ttatgttgcggtaatttcgttc

SEQ ID NO: 957834 - DNA, 22 bp, Artificial Sequence
  chemically synthesized
attatgttgcggtaatttcgtt

SEQ ID NO: 957835 - DNA, 22 bp, Artificial Sequence
  chemically synthesized
tattatgttgcggtaatttcgt

SEQ ID NO: 957836 - DNA, 22 bp, Artificial Sequence
  chemically synthesized
ttattatgttgcggtaatttcg

SEQ ID NO: 957837 - DNA, 22 bp, Artificial Sequence
  chemically synthesized
ggaatagaacgaaattaccgca

SEQ ID NO: 957838 - DNA, 22 bp, Artificial Sequence
  chemically synthesized
atatacggtttttattatgttg

SEQ ID NO: 957839 - DNA, 22 bp, Artificial Sequence
  chemically synthesized
catatacggtttttattatgtt

SEQ ID NO: 957840 - DNA, 22 bp, Artificial Sequence
  chemically synthesized
tcatatacggtttttattatgt

SEQ ID NO: 957841 - DNA, 22 bp, Artificial Sequence
  chemically synthesized
ttcatatacggtttttattatg

SEQ ID NO: 957842 - DNA, 22 bp, Artificial Sequence
  chemically synthesized
ccgcaacataataaaaaccgta

SEQ ID NO: 957843 - DNA, 22 bp, Artificial Sequence
  chemically synthesized
tgggtttttcatatacggtttt

SEQ ID NO: 957844 - DNA, 22 bp, Artificial Sequence
  chemically synthesized
actgtgggtttttcatatacgg

SEQ ID NO: 957845 - DNA, 22 bp, Artificial Sequence
  chemically synthesized
aatgtgatattcactgtgggtt

SEQ ID NO: 957846 - DNA, 22 bp, Artificial Sequence
  chemically synthesized
ccattaaatgtgatattcactg

SEQ ID NO: 957847 - DNA, 22 bp, Artificial Sequence
  chemically synthesized
gccattaaatgtgatattcact

SEQ ID NO: 957848 - DNA, 22 bp, Artificial Sequence
  chemically synthesized
tgccattaaatgtgatattcac

SEQ ID NO: 957849 - DNA, 22 bp, Artificial Sequence
  chemically synthesized
ttgccattaaatgtgatattca

SEQ ID NO: 957850 - DNA, 22 bp, Artificial Sequence
  chemically synthesized
agtcttttgccattaaatgtga

SEQ ID NO: 957851 - DNA, 22 bp, Artificial Sequence
  chemically synthesized
cagtcttttgccattaaatgtg

SEQ ID NO: 957852 - DNA, 22 bp, Artificial Sequence
  chemically synthesized
tcagtcttttgccattaaatgt

SEQ ID NO: 957853 - DNA, 22 bp, Artificial Sequence
  chemically synthesized
agggaaaagattttcagtcttt

SEQ ID NO: 957854 - DNA, 22 bp, Artificial Sequence
  chemically synthesized
aagggaaaagattttcagtctt

SEQ ID NO: 957855 - DNA, 22 bp, Artificial Sequence
  chemically synthesized
aatggcaaaagactgaaaatct

SEQ ID NO: 957856 - DNA, 22 bp, Artificial Sequence
  chemically synthesized
atggcaaaagactgaaaatctt

SEQ ID NO: 957857 - DNA, 22 bp, Artificial Sequence
  chemically synthesized
atcttaagggaaaagattttca

SEQ ID NO: 957858 - DNA, 22 bp, Artificial Sequence
  chemically synthesized
tgatcttaagggaaaagatttt

SEQ ID NO: 957859 - DNA, 22 bp, Artificial Sequence
  chemically synthesized
ctgatcttaagggaaaagattt

SEQ ID NO: 957860 - DNA, 22 bp, Artificial Sequence
  chemically synthesized
tttctgatcttaagggaaaaga

SEQ ID NO: 957861 - DNA, 22 bp, Artificial Sequence
  chemically synthesized
gtttctgatcttaagggaaaag

SEQ ID NO: 957862 - DNA, 22 bp, Artificial Sequence
  chemically synthesized
tcttgtttctgatcttaaggga

SEQ ID NO: 957863 - DNA, 22 bp, Artificial Sequence
  chemically synthesized
gtcttgtttctgatcttaaggg

SEQ ID NO: 957864 - DNA, 22 bp, Artificial Sequence
  chemically synthesized
aaaatcttttcccttaagatca

SEQ ID NO: 957865 - DNA, 22 bp, Artificial Sequence
  chemically synthesized
ttgtcttgtttctgatcttaag

SEQ ID NO: 957866 - DNA, 22 bp, Artificial Sequence
  chemically synthesized
ttcccttaagatcagaaacaag

SEQ ID NO: 957867 - DNA, 22 bp, Artificial Sequence
  chemically synthesized
tcccttaagatcagaaacaaga

SEQ ID NO: 957868 - DNA, 22 bp, Artificial Sequence
  chemically synthesized
cccttaagatcagaaacaagac

SEQ ID NO: 957869 - DNA, 22 bp, Artificial Sequence
  chemically synthesized
ccttaagatcagaaacaagaca

SEQ ID NO: 957870 - DNA, 22 bp, Artificial Sequence
  chemically synthesized
aagatcagaaacaagacaagaa

SEQ ID NO: 957871 - DNA, 22 bp, Artificial Sequence
  chemically synthesized
agatcagaaacaagacaagaat

SEQ ID NO: 957872 - DNA, 22 bp, Artificial Sequence
  chemically synthesized
aaaagaagtggcaaaagtgtgc

SEQ ID NO: 957873 - DNA, 22 bp, Artificial Sequence
  chemically synthesized
gaaaagaagtggcaaaagtgtg

SEQ ID NO: 957874 - DNA, 22 bp, Artificial Sequence
  chemically synthesized
tgaaaagaagtggcaaaagtgt

SEQ ID NO: 957875 - DNA, 22 bp, Artificial Sequence
  chemically synthesized
gtacgattttgaaaagaagtgg

SEQ ID NO: 957876 - DNA, 22 bp, Artificial Sequence
  chemically synthesized
tggtacgattttgaaaagaagt

SEQ ID NO: 957877 - DNA, 22 bp, Artificial Sequence
  chemically synthesized
ctggtacgattttgaaaagaag

SEQ ID NO: 957878 - DNA, 22 bp, Artificial Sequence
  chemically synthesized
ttgccacttcttttcaaaatcg

SEQ ID NO: 957879 - DNA, 22 bp, Artificial Sequence
  chemically synthesized
gtacttctggtacgattttgaa

SEQ ID NO: 957880 - DNA, 22 bp, Artificial Sequence
  chemically synthesized
tgccacttcttttcaaaatcgt

SEQ ID NO: 957881 - DNA, 22 bp, Artificial Sequence
  chemically synthesized
gccacttcttttcaaaatcgta

SEQ ID NO: 957882 - DNA, 22 bp, Artificial Sequence
  chemically synthesized
ccacttcttttcaaaatcgtac

SEQ ID NO: 957883 - DNA, 22 bp, Artificial Sequence
  chemically synthesized
gctagtacttctggtacgattt

SEQ ID NO: 957884 - DNA, 22 bp, Artificial Sequence
  chemically synthesized
tggctagtacttctggtacgat

SEQ ID NO: 957885 - DNA, 22 bp, Artificial Sequence
  chemically synthesized
cttttcaaaatcgtaccagaag

SEQ ID NO: 957886 - DNA, 22 bp, Artificial Sequence
  chemically synthesized
ttctggctagtacttctggtac

SEQ ID NO: 957887 - DNA, 22 bp, Artificial Sequence
  chemically synthesized
ttttcaaaatcgtaccagaagt

SEQ ID NO: 957888 - DNA, 22 bp, Artificial Sequence
  chemically synthesized
ttcaaaatcgtaccagaagtac

SEQ ID NO: 957889 - DNA, 22 bp, Artificial Sequence
  chemically synthesized
tcaaaatcgtaccagaagtact

SEQ ID NO: 957890 - DNA, 22 bp, Artificial Sequence
  chemically synthesized
attgttctggctagtacttctg

SEQ ID NO: 957891 - DNA, 22 bp, Artificial Sequence
  chemically synthesized
caaaatcgtaccagaagtacta

SEQ ID NO: 957892 - DNA, 22 bp, Artificial Sequence
  chemically synthesized
aaaatcgtaccagaagtactag

SEQ ID NO: 957893 - DNA, 22 bp, Artificial Sequence
  chemically synthesized
tctaattgttctggctagtact

SEQ ID NO: 957894 - DNA, 22 bp, Artificial Sequence
  chemically synthesized
atctaattgttctggctagtac

SEQ ID NO: 957895 - DNA, 22 bp, Artificial Sequence
  chemically synthesized
ttatctaattgttctggctagt

SEQ ID NO: 957896 - DNA, 22 bp, Artificial Sequence
  chemically synthesized
cttatctaattgttctggctag

SEQ ID NO: 957897 - DNA, 22 bp, Artificial Sequence
  chemically synthesized
tcttatctaattgttctggcta

SEQ ID NO: 957898 - DNA, 22 bp, Artificial Sequence
  chemically synthesized
tttcttatctaattgttctggc

SEQ ID NO: 957899 - DNA, 22 bp, Artificial Sequence
  chemically synthesized
tctttcttatctaattgttctg

SEQ ID NO: 957900 - DNA, 22 bp, Artificial Sequence
  chemically synthesized
ctctttcttatctaattgttct

SEQ ID NO: 957901 - DNA, 22 bp, Artificial Sequence
  chemically synthesized
tttctctttcttatctaattgt

SEQ ID NO: 957902 - DNA, 22 bp, Artificial Sequence
  chemically synthesized
atttctctttcttatctaattg

SEQ ID NO: 957903 - DNA, 22 bp, Artificial Sequence
  chemically synthesized
tatttctctttcttatctaatt

SEQ ID NO: 957904 - DNA, 22 bp, Artificial Sequence
  chemically synthesized
gccagaacaattagataagaaa

SEQ ID NO: 957905 - DNA, 22 bp, Artificial Sequence
  chemically synthesized
atgtattttatttctctttctt

SEQ ID NO: 957906 - DNA, 22 bp, Artificial Sequence
  chemically synthesized
gatgtattttatttctctttct

SEQ ID NO: 957907 - DNA, 22 bp, Artificial Sequence
  chemically synthesized
caaatttgatgtattttatttc

SEQ ID NO: 957908 - DNA, 22 bp, Artificial Sequence
  chemically synthesized
gataagaaagagaaataaaata

SEQ ID NO: 957909 - DNA, 22 bp, Artificial Sequence
  chemically synthesized
ccaaatttgatgtattttattt

SEQ ID NO: 957910 - DNA, 22 bp, Artificial Sequence
  chemically synthesized
tccaaatttgatgtattttatt

SEQ ID NO: 957911 - DNA, 22 bp, Artificial Sequence
  chemically synthesized
ctttccaaatttgatgtatttt

SEQ ID NO: 957912 - DNA, 22 bp, Artificial Sequence
  chemically synthesized
cctttccaaatttgatgtattt

SEQ ID NO: 957913 - DNA, 22 bp, Artificial Sequence
  chemically synthesized
catcttcctttccaaatttgat

SEQ ID NO: 957914 - DNA, 22 bp, Artificial Sequence
  chemically synthesized
acatcttcctttccaaatttga

SEQ ID NO: 957915 - DNA, 22 bp, Artificial Sequence
  chemically synthesized
tacatcttcctttccaaatttg

SEQ ID NO: 957916 - DNA, 22 bp, Artificial Sequence
  chemically synthesized
caaacagatataattttacatc

SEQ ID NO: 957917 - DNA, 22 bp, Artificial Sequence
  chemically synthesized
gcaaacagatataattttacat

SEQ ID NO: 957918 - DNA, 22 bp, Artificial Sequence
  chemically synthesized
ggaaaggaagatgtaaaattat

SEQ ID NO: 957919 - DNA, 22 bp, Artificial Sequence
  chemically synthesized
gaaaggaagatgtaaaattata

SEQ ID NO: 957920 - DNA, 22 bp, Artificial Sequence
  chemically synthesized
atttgcaaacagatataatttt

SEQ ID NO: 957921 - DNA, 22 bp, Artificial Sequence
  chemically synthesized
cgtatcagatcatctaatttgc

SEQ ID NO: 957922 - DNA, 22 bp, Artificial Sequence
  chemically synthesized
tacgtatcagatcatctaattt

SEQ ID NO: 957923 - DNA, 22 bp, Artificial Sequence
  chemically synthesized
tatctgtttgcaaattagatga

SEQ ID NO: 957924 - DNA, 22 bp, Artificial Sequence
  chemically synthesized
ctacgtatcagatcatctaatt

SEQ ID NO: 957925 - DNA, 22 bp, Artificial Sequence
  chemically synthesized
tctacgtatcagatcatctaat

SEQ ID NO: 957926 - DNA, 22 bp, Artificial Sequence
  chemically synthesized
tttgcaaattagatgatctgat

SEQ ID NO: 957927 - DNA, 22 bp, Artificial Sequence
  chemically synthesized
agattttctacgtatcagatca

SEQ ID NO: 957928 - DNA, 22 bp, Artificial Sequence
  chemically synthesized
aagattttctacgtatcagatc

SEQ ID NO: 957929 - DNA, 22 bp, Artificial Sequence
  chemically synthesized
gcaaattagatgatctgatacg

SEQ ID NO: 957930 - DNA, 22 bp, Artificial Sequence
  chemically synthesized
caaattagatgatctgatacgt

SEQ ID NO: 957931 - DNA, 22 bp, Artificial Sequence
  chemically synthesized
ttaagattttctacgtatcaga

SEQ ID NO: 957932 - DNA, 22 bp, Artificial Sequence
  chemically synthesized
gatgatctgatacgtagaaaat

SEQ ID NO: 957933 - DNA, 22 bp, Artificial Sequence
  chemically synthesized
tgtggcgtcactcttaagattt

SEQ ID NO: 957934 - DNA, 22 bp, Artificial Sequence
  chemically synthesized
tgtgtggcgtcactcttaagat

SEQ ID NO: 957935 - DNA, 22 bp, Artificial Sequence
  chemically synthesized
atacgtagaaaatcttaagagt

SEQ ID NO: 957936 - DNA, 22 bp, Artificial Sequence
  chemically synthesized
accatgtctctgtgtggcgtca

SEQ ID NO: 957937 - DNA, 22 bp, Artificial Sequence
  chemically synthesized
taaccatgtctctgtgtggcgt

SEQ ID NO: 957938 - DNA, 22 bp, Artificial Sequence
  chemically synthesized
gttctaaccatgtctctgtgtg

SEQ ID NO: 957939 - DNA, 22 bp, Artificial Sequence
  chemically synthesized
aagagtgacgccacacagagac

SEQ ID NO: 957940 - DNA, 22 bp, Artificial Sequence
  chemically synthesized
agagtgacgccacacagagaca

SEQ ID NO: 957941 - DNA, 22 bp, Artificial Sequence
  chemically synthesized
ttggttctaaccatgtctctgt

SEQ ID NO: 957942 - DNA, 22 bp, Artificial Sequence
  chemically synthesized
attggttctaaccatgtctctg

SEQ ID NO: 957943 - DNA, 22 bp, Artificial Sequence
  chemically synthesized
tttattggttctaaccatgtct

SEQ ID NO: 957944 - DNA, 22 bp, Artificial Sequence
  chemically synthesized
gtttattggttctaaccatgtc

SEQ ID NO: 957945 - DNA, 22 bp, Artificial Sequence
  chemically synthesized
aatttgtttattggttctaacc

SEQ ID NO: 957946 - DNA, 22 bp, Artificial Sequence
  chemically synthesized
ctgaatttgtttattggttcta

SEQ ID NO: 957947 - DNA, 22 bp, Artificial Sequence
  chemically synthesized
gctgaatttgtttattggttct

SEQ ID NO: 957948 - DNA, 22 bp, Artificial Sequence
  chemically synthesized
tgctgaatttgtttattggttc

SEQ ID NO: 957949 - DNA, 22 bp, Artificial Sequence
  chemically synthesized
caactttgctgaatttgtttat

SEQ ID NO: 957950 - DNA, 22 bp, Artificial Sequence
  chemically synthesized
gaaccaataaacaaattcagca

SEQ ID NO: 957951 - DNA, 22 bp, Artificial Sequence
  chemically synthesized
tatcctgcaactttgctgaatt

SEQ ID NO: 957952 - DNA, 22 bp, Artificial Sequence
  chemically synthesized
gtatcctgcaactttgctgaat

SEQ ID NO: 957953 - DNA, 22 bp, Artificial Sequence
  chemically synthesized
tgtatcctgcaactttgctgaa

SEQ ID NO: 957954 - DNA, 22 bp, Artificial Sequence
  chemically synthesized
aatgatgactttgtatcctgca

SEQ ID NO: 957955 - DNA, 22 bp, Artificial Sequence
  chemically synthesized
ttgaatgatgactttgtatcct

SEQ ID NO: 957956 - DNA, 22 bp, Artificial Sequence
  chemically synthesized
agcaaagttgcaggatacaaag

SEQ ID NO: 957957 - DNA, 22 bp, Artificial Sequence
  chemically synthesized
caggatacaaagtcatcattca

SEQ ID NO: 957958 - DNA, 22 bp, Artificial Sequence
  chemically synthesized
gcgtatagaaacgcaactgttg

SEQ ID NO: 957959 - DNA, 22 bp, Artificial Sequence
  chemically synthesized
ctagcgtatagaaacgcaactg

SEQ ID NO: 957960 - DNA, 22 bp, Artificial Sequence
  chemically synthesized
tgttgctagcgtatagaaacgc

SEQ ID NO: 957961 - DNA, 22 bp, Artificial Sequence
  chemically synthesized
atgttgctagcgtatagaaacg

SEQ ID NO: 957962 - DNA, 22 bp, Artificial Sequence
  chemically synthesized
tatgttgctagcgtatagaaac

SEQ ID NO: 957963 - DNA, 22 bp, Artificial Sequence
  chemically synthesized
ttatgttgctagcgtatagaaa

SEQ ID NO: 957964 - DNA, 22 bp, Artificial Sequence
  chemically synthesized
aacagttgcgtttctatacgct

SEQ ID NO: 957965 - DNA, 22 bp, Artificial Sequence
  chemically synthesized
tttttatgttgctagcgtatag

SEQ ID NO: 957966 - DNA, 22 bp, Artificial Sequence
  chemically synthesized
ctgtttttatgttgctagcgta

SEQ ID NO: 957967 - DNA, 22 bp, Artificial Sequence
  chemically synthesized
cctgtttttatgttgctagcgt

SEQ ID NO: 957968 - DNA, 22 bp, Artificial Sequence
  chemically synthesized
cgtttctatacgctagcaacat

SEQ ID NO: 957969 - DNA, 22 bp, Artificial Sequence
  chemically synthesized
aatttcctgtttttatgttgct

SEQ ID NO: 957970 - DNA, 22 bp, Artificial Sequence
  chemically synthesized
taaatttcctgtttttatgttg

SEQ ID NO: 957971 - DNA, 22 bp, Artificial Sequence
  chemically synthesized
ctatacgctagcaacataaaaa

SEQ ID NO: 957972 - DNA, 22 bp, Artificial Sequence
  chemically synthesized
ctaaatttcctgtttttatgtt

SEQ ID NO: 957973 - DNA, 22 bp, Artificial Sequence
  chemically synthesized
tatacgctagcaacataaaaac

SEQ ID NO: 957974 - DNA, 22 bp, Artificial Sequence
  chemically synthesized
tctaaatttcctgtttttatgt

SEQ ID NO: 957975 - DNA, 22 bp, Artificial Sequence
  chemically synthesized
tacgctagcaacataaaaacag

SEQ ID NO: 957976 - DNA, 22 bp, Artificial Sequence
  chemically synthesized
ttttctaaatttcctgttttta

SEQ ID NO: 957977 - DNA, 22 bp, Artificial Sequence
  chemically synthesized
gcaacataaaaacaggaaattt

SEQ ID NO: 957978 - DNA, 22 bp, Artificial Sequence
  chemically synthesized
taaatgagattgttttctaaat

SEQ ID NO: 957979 - DNA, 22 bp, Artificial Sequence
  chemically synthesized
ttgtaaatgagattgttttcta

SEQ ID NO: 957980 - DNA, 22 bp, Artificial Sequence
  chemically synthesized
ctattgtaaatgagattgtttt

SEQ ID NO: 957981 - DNA, 22 bp, Artificial Sequence
  chemically synthesized
ttgctattgtaaatgagattgt

SEQ ID NO: 957982 - DNA, 22 bp, Artificial Sequence
  chemically synthesized
attgctattgtaaatgagattg

SEQ ID NO: 957983 - DNA, 22 bp, Artificial Sequence
  chemically synthesized
tattgctattgtaaatgagatt

SEQ ID NO: 957984 - DNA, 22 bp, Artificial Sequence
  chemically synthesized
ttattgctattgtaaatgagat

SEQ ID NO: 957985 - DNA, 22 bp, Artificial Sequence
  chemically synthesized
tttattgctattgtaaatgaga

SEQ ID NO: 957986 - DNA, 22 bp, Artificial Sequence
  chemically synthesized
tttttattgctattgtaaatga

SEQ ID NO: 957987 - DNA, 22 bp, Artificial Sequence
  chemically synthesized
agaaaacaatctcatttacaat

SEQ ID NO: 957988 - DNA, 22 bp, Artificial Sequence
  chemically synthesized
gaaaacaatctcatttacaata

SEQ ID NO: 957989 - DNA, 22 bp, Artificial Sequence
  chemically synthesized
ttctttttattgctattgtaaa

SEQ ID NO: 957990 - DNA, 22 bp, Artificial Sequence
  chemically synthesized
attctttttattgctattgtaa

SEQ ID NO: 957991 - DNA, 22 bp, Artificial Sequence
  chemically synthesized
tttattctttttattgctattg

SEQ ID NO: 957992 - DNA, 22 bp, Artificial Sequence
  chemically synthesized
agttatttattctttttattgc

SEQ ID NO: 957993 - DNA, 22 bp, Artificial Sequence
  chemically synthesized
atttacaatagcaataaaaaga

SEQ ID NO: 957994 - DNA, 22 bp, Artificial Sequence
  chemically synthesized
ctaagttatttattctttttat

SEQ ID NO: 957995 - DNA, 22 bp, Artificial Sequence
  chemically synthesized
actaagttatttattcttttta

SEQ ID NO: 957996 - DNA, 22 bp, Artificial Sequence
  chemically synthesized
acaatagcaataaaaagaataa

SEQ ID NO: 957997 - DNA, 22 bp, Artificial Sequence
  chemically synthesized
caatagcaataaaaagaataaa

SEQ ID NO: 957998 - DNA, 22 bp, Artificial Sequence
  chemically synthesized
ggtatttactaagttatttatt

SEQ ID NO: 957999 - DNA, 22 bp, Artificial Sequence
  chemically synthesized
gttgggtatttactaagttatt

SEQ ID NO: 958000 - DNA, 22 bp, Artificial Sequence
  chemically synthesized
ggttgggtatttactaagttat

SEQ ID NO: 958001 - DNA, 22 bp, Artificial Sequence
  chemically synthesized
ttggttgggtatttactaagtt

SEQ ID NO: 958002 - DNA, 22 bp, Artificial Sequence
  chemically synthesized
cttggttgggtatttactaagt

SEQ ID NO: 958003 - DNA, 22 bp, Artificial Sequence
  chemically synthesized
ccttcttggttgggtatttact

SEQ ID NO: 958004 - DNA, 22 bp, Artificial Sequence
  chemically synthesized
accttcttggttgggtatttac

SEQ ID NO: 958005 - DNA, 22 bp, Artificial Sequence
  chemically synthesized
taccttcttggttgggtattta

SEQ ID NO: 958006 - DNA, 22 bp, Artificial Sequence
  chemically synthesized
ttaccttcttggttgggtattt

SEQ ID NO: 958007 - DNA, 22 bp, Artificial Sequence
  chemically synthesized
agtaaatacccaaccaagaagg

SEQ ID NO: 958008 - DNA, 22 bp, Artificial Sequence
  chemically synthesized
gtaaatacccaaccaagaaggt

SEQ ID NO: 958009 - DNA, 22 bp, Artificial Sequence
  chemically synthesized
agcacacacatcttttaccttc

SEQ ID NO: 958010 - DNA, 22 bp, Artificial Sequence
  chemically synthesized
cagcacacacatcttttacctt

SEQ ID NO: 958011 - DNA, 22 bp, Artificial Sequence
  chemically synthesized
tcagcacacacatcttttacct

SEQ ID NO: 958012 - DNA, 22 bp, Artificial Sequence
  chemically synthesized
atagctttcagcacacacatct

SEQ ID NO: 958013 - DNA, 22 bp, Artificial Sequence
  chemically synthesized
catagctttcagcacacacatc

SEQ ID NO: 958014 - DNA, 22 bp, Artificial Sequence
  chemically synthesized
aacaatatttcatagctttcag

SEQ ID NO: 958015 - DNA, 22 bp, Artificial Sequence
  chemically synthesized
caacaatatttcatagctttca

SEQ ID NO: 958016 - DNA, 22 bp, Artificial Sequence
  chemically synthesized
tcaacaatatttcatagctttc

SEQ ID NO: 958017 - DNA, 22 bp, Artificial Sequence
  chemically synthesized
tttcaacaatatttcatagctt

SEQ ID NO: 958018 - DNA, 22 bp, Artificial Sequence
  chemically synthesized
ctttcaacaatatttcatagct

SEQ ID NO: 958019 - DNA, 22 bp, Artificial Sequence
  chemically synthesized
aatttctttcaacaatatttca

SEQ ID NO: 958020 - DNA, 22 bp, Artificial Sequence
  chemically synthesized
caatttctttcaacaatatttc

SEQ ID NO: 958021 - DNA, 22 bp, Artificial Sequence
  chemically synthesized
aaagctatgaaatattgttgaa

SEQ ID NO: 958022 - DNA, 22 bp, Artificial Sequence
  chemically synthesized
tcatcttcaatttctttcaaca

SEQ ID NO: 958023 - DNA, 22 bp, Artificial Sequence
  chemically synthesized
gtcatcttcaatttctttcaac

SEQ ID NO: 958024 - DNA, 22 bp, Artificial Sequence
  chemically synthesized
tgtcatcttcaatttctttcaa

SEQ ID NO: 958025 - DNA, 22 bp, Artificial Sequence
  chemically synthesized
ttgtcatcttcaatttctttca

SEQ ID NO: 958026 - DNA, 22 bp, Artificial Sequence
  chemically synthesized
tgaaatattgttgaaagaaatt

SEQ ID NO: 958027 - DNA, 22 bp, Artificial Sequence
  chemically synthesized
tttttgtcatcttcaatttctt

SEQ ID NO: 958028 - DNA, 22 bp, Artificial Sequence
  chemically synthesized
atttttgtcatcttcaatttct

SEQ ID NO: 958029 - DNA, 22 bp, Artificial Sequence
  chemically synthesized
catttatttttgtcatcttcaa

SEQ ID NO: 958030 - DNA, 22 bp, Artificial Sequence
  chemically synthesized
ccatttatttttgtcatcttca

SEQ ID NO: 958031 - DNA, 22 bp, Artificial Sequence
  chemically synthesized
ttgaaagaaattgaagatgaca

SEQ ID NO: 958032 - DNA, 22 bp, Artificial Sequence
  chemically synthesized
aaagaaattgaagatgacaaaa

SEQ ID NO: 958033 - DNA, 22 bp, Artificial Sequence
  chemically synthesized
aagatgacaaaaataaatggaa

SEQ ID NO: 958034 - DNA, 22 bp, Artificial Sequence
  chemically synthesized
aatgacacatcagatgtatttc

SEQ ID NO: 958035 - DNA, 22 bp, Artificial Sequence
  chemically synthesized
aaatgacacatcagatgtattt

SEQ ID NO: 958036 - DNA, 22 bp, Artificial Sequence
  chemically synthesized
taaatgacacatcagatgtatt

SEQ ID NO: 958037 - DNA, 22 bp, Artificial Sequence
  chemically synthesized
ttaaatgacacatcagatgtat

SEQ ID NO: 958038 - DNA, 22 bp, Artificial Sequence
  chemically synthesized
gatatatagacttttaaatgac

SEQ ID NO: 958039 - DNA, 22 bp, Artificial Sequence
  chemically synthesized
ggatatatagacttttaaatga

SEQ ID NO: 958040 - DNA, 22 bp, Artificial Sequence
  chemically synthesized
atgtgtcatttaaaagtctata

SEQ ID NO: 958041 - DNA, 22 bp, Artificial Sequence
  chemically synthesized
tagatggtttggatatatagac

SEQ ID NO: 958042 - DNA, 22 bp, Artificial Sequence
  chemically synthesized
tatctgtagatggtttggatat

SEQ ID NO: 958043 - DNA, 22 bp, Artificial Sequence
  chemically synthesized
aaaagtctatatatccaaacca

SEQ ID NO: 958044 - DNA, 22 bp, Artificial Sequence
  chemically synthesized
aaagtctatatatccaaaccat

SEQ ID NO: 958045 - DNA, 22 bp, Artificial Sequence
  chemically synthesized
cactgtatctgtagatggtttg

SEQ ID NO: 958046 - DNA, 22 bp, Artificial Sequence
  chemically synthesized
tatatccaaaccatctacagat

SEQ ID NO: 958047 - DNA, 22 bp, Artificial Sequence
  chemically synthesized
tgataggaattacactgtatct

SEQ ID NO: 958048 - DNA, 22 bp, Artificial Sequence
  chemically synthesized
ggattatgataggaattacact

SEQ ID NO: 958049 - DNA, 22 bp, Artificial Sequence
  chemically synthesized
cagatacagtgtaattcctatc

SEQ ID NO: 958050 - DNA, 22 bp, Artificial Sequence
  chemically synthesized
taaaaaatgcgattgggattat

SEQ ID NO: 958051 - DNA, 22 bp, Artificial Sequence
  chemically synthesized
tgtaaaaaatgcgattgggatt

SEQ ID NO: 958052 - DNA, 22 bp, Artificial Sequence
  chemically synthesized
ctgtaaaaaatgcgattgggat

SEQ ID NO: 958053 - DNA, 22 bp, Artificial Sequence
  chemically synthesized
tttctgtaaaaaatgcgattgg

SEQ ID NO: 958054 - DNA, 22 bp, Artificial Sequence
  chemically synthesized
ctatcataatcccaatcgcatt

SEQ ID NO: 958055 - DNA, 22 bp, Artificial Sequence
  chemically synthesized
atttctgtaaaaaatgcgattg

SEQ ID NO: 958056 - DNA, 22 bp, Artificial Sequence
  chemically synthesized
tcataatcccaatcgcattttt

SEQ ID NO: 958057 - DNA, 22 bp, Artificial Sequence
  chemically synthesized
ccttatttctgtaaaaaatgcg

SEQ ID NO: 958058 - DNA, 22 bp, Artificial Sequence
  chemically synthesized
accttatttctgtaaaaaatgc

SEQ ID NO: 958059 - DNA, 22 bp, Artificial Sequence
  chemically synthesized
ggaaatttaccttatttctgta

SEQ ID NO: 958060 - DNA, 22 bp, Artificial Sequence
  chemically synthesized
aggaaatttaccttatttctgt

SEQ ID NO: 958061 - DNA, 22 bp, Artificial Sequence
  chemically synthesized
taggaaatttaccttatttctg

SEQ ID NO: 958062 - DNA, 22 bp, Artificial Sequence
  chemically synthesized
tttacagaaataaggtaaattt

SEQ ID NO: 958063 - DNA, 22 bp, Artificial Sequence
  chemically synthesized
ttacagaaataaggtaaatttc

SEQ ID NO: 958064 - DNA, 22 bp, Artificial Sequence
  chemically synthesized
tacagaaataaggtaaatttcc

SEQ ID NO: 958065 - DNA, 22 bp, Artificial Sequence
  chemically synthesized
atatgaattttaggaaatttac

SEQ ID NO: 958066 - DNA, 22 bp, Artificial Sequence
  chemically synthesized
acagaaataaggtaaatttcct

SEQ ID NO: 958067 - DNA, 22 bp, Artificial Sequence
  chemically synthesized
catatgaattttaggaaattta

SEQ ID NO: 958068 - DNA, 22 bp, Artificial Sequence
  chemically synthesized
cagaaataaggtaaatttccta

SEQ ID NO: 958069 - DNA, 22 bp, Artificial Sequence
  chemically synthesized
tggtttcatatgaattttagga

SEQ ID NO: 958070 - DNA, 22 bp, Artificial Sequence
  chemically synthesized
gtggtttcatatgaattttagg

SEQ ID NO: 958071 - DNA, 22 bp, Artificial Sequence
  chemically synthesized
gagtcgtttgtggtttcatatg

SEQ ID NO: 958072 - DNA, 22 bp, Artificial Sequence
  chemically synthesized
ggagtcgtttgtggtttcatat

SEQ ID NO: 958073 - DNA, 22 bp, Artificial Sequence
  chemically synthesized
cctaaaattcatatgaaaccac

SEQ ID NO: 958074 - DNA, 22 bp, Artificial Sequence
  chemically synthesized
ctaaaattcatatgaaaccaca

SEQ ID NO: 958075 - DNA, 22 bp, Artificial Sequence
  chemically synthesized
tttggagtcgtttgtggtttca

SEQ ID NO: 958076 - DNA, 22 bp, Artificial Sequence
  chemically synthesized
aaattcatatgaaaccacaaac

SEQ ID NO: 958077 - DNA, 22 bp, Artificial Sequence
  chemically synthesized
gctatttggagtcgtttgtggt

SEQ ID NO: 958078 - DNA, 22 bp, Artificial Sequence
  chemically synthesized
ggctatttggagtcgtttgtgg

SEQ ID NO: 958079 - DNA, 22 bp, Artificial Sequence
  chemically synthesized
tggctatttggagtcgtttgtg

SEQ ID NO: 958080 - DNA, 22 bp, Artificial Sequence
  chemically synthesized
atatgaaaccacaaacgactcc

SEQ ID NO: 958081 - DNA, 22 bp, Artificial Sequence
  chemically synthesized
ttttggctatttggagtcgttt

SEQ ID NO: 958082 - DNA, 22 bp, Artificial Sequence
  chemically synthesized
aagactgttttggctatttgga

SEQ ID NO: 958083 - DNA, 22 bp, Artificial Sequence
  chemically synthesized
ctcaagactgttttggctattt

SEQ ID NO: 958084 - DNA, 22 bp, Artificial Sequence
  chemically synthesized
cctcaagactgttttggctatt

SEQ ID NO: 958085 - DNA, 22 bp, Artificial Sequence
  chemically synthesized
ttcctcaagactgttttggcta

SEQ ID NO: 958086 - DNA, 22 bp, Artificial Sequence
  chemically synthesized
cttcctcaagactgttttggct

SEQ ID NO: 958087 - DNA, 22 bp, Artificial Sequence
  chemically synthesized
ttcttcctcaagactgttttgg

SEQ ID NO: 958088 - DNA, 22 bp, Artificial Sequence
  chemically synthesized
ttcttcttcctcaagactgttt

SEQ ID NO: 958089 - DNA, 22 bp, Artificial Sequence
  chemically synthesized
attcttcttcctcaagactgtt

SEQ ID NO: 958090 - DNA, 22 bp, Artificial Sequence
  chemically synthesized
caaatagccaaaacagtcttga

SEQ ID NO: 958091 - DNA, 22 bp, Artificial Sequence
  chemically synthesized
cagtttattcttcttcctcaag

SEQ ID NO: 958092 - DNA, 22 bp, Artificial Sequence
  chemically synthesized
gaggaagaagaataaactggag

SEQ ID NO: 958093 - DNA, 22 bp, Artificial Sequence
  chemically synthesized
aggaagaagaataaactggagg

SEQ ID NO: 958094 - DNA, 22 bp, Artificial Sequence
  chemically synthesized
gcaagtgtgatgcctccagttt

SEQ ID NO: 958095 - DNA, 22 bp, Artificial Sequence
  chemically synthesized
aaactagcaagtgtgatgcctc

SEQ ID NO: 958096 - DNA, 22 bp, Artificial Sequence
  chemically synthesized
gaaactagcaagtgtgatgcct

SEQ ID NO: 958097 - DNA, 22 bp, Artificial Sequence
  chemically synthesized
tgaaactagcaagtgtgatgcc

SEQ ID NO: 958098 - DNA, 22 bp, Artificial Sequence
  chemically synthesized
attttgaaactagcaagtgtga

SEQ ID NO: 958099 - DNA, 22 bp, Artificial Sequence
  chemically synthesized
gaggcatcacacttgctagttt

SEQ ID NO: 958100 - DNA, 22 bp, Artificial Sequence
  chemically synthesized
gtaattcattttgaaactagca

SEQ ID NO: 958101 - DNA, 22 bp, Artificial Sequence
  chemically synthesized
ggtaattcattttgaaactagc

SEQ ID NO: 958102 - DNA, 22 bp, Artificial Sequence
  chemically synthesized
tggtaattcattttgaaactag

SEQ ID NO: 958103 - DNA, 22 bp, Artificial Sequence
  chemically synthesized
aggtagctttggtaattcattt

SEQ ID NO: 958104 - DNA, 22 bp, Artificial Sequence
  chemically synthesized
gctagtttcaaaatgaattacc

SEQ ID NO: 958105 - DNA, 22 bp, Artificial Sequence
  chemically synthesized
ctagtttcaaaatgaattacca

SEQ ID NO: 958106 - DNA, 22 bp, Artificial Sequence
  chemically synthesized
actgaggtagctttggtaattc

SEQ ID NO: 958107 - DNA, 22 bp, Artificial Sequence
  chemically synthesized
gactgaggtagctttggtaatt

SEQ ID NO: 958108 - DNA, 22 bp, Artificial Sequence
  chemically synthesized
gtttcaaaatgaattaccaaag

SEQ ID NO: 958109 - DNA, 22 bp, Artificial Sequence
  chemically synthesized
ttgactgaggtagctttggtaa

SEQ ID NO: 958110 - DNA, 22 bp, Artificial Sequence
  chemically synthesized
caaaatgaattaccaaagctac

SEQ ID NO: 958111 - DNA, 22 bp, Artificial Sequence
  chemically synthesized
aaaatgaattaccaaagctacc

SEQ ID NO: 958112 - DNA, 22 bp, Artificial Sequence
  chemically synthesized
tcgtgcgctcttgactgaggta

SEQ ID NO: 958113 - DNA, 22 bp, Artificial Sequence
  chemically synthesized
ccaaagctacctcagtcaagag

SEQ ID NO: 958114 - DNA, 22 bp, Artificial Sequence
  chemically synthesized
tgacactatcgtgcgctcttga

SEQ ID NO: 958115 - DNA, 22 bp, Artificial Sequence
  chemically synthesized
atgacactatcgtgcgctcttg

SEQ ID NO: 958116 - DNA, 22 bp, Artificial Sequence
  chemically synthesized
tatgacactatcgtgcgctctt

SEQ ID NO: 958117 - DNA, 22 bp, Artificial Sequence
  chemically synthesized
cctcagtcaagagcgcacgata

SEQ ID NO: 958118 - DNA, 22 bp, Artificial Sequence
  chemically synthesized
cctttatgacactatcgtgcgc

SEQ ID NO: 958119 - DNA, 22 bp, Artificial Sequence
  chemically synthesized
agtcaagagcgcacgatagtgt

SEQ ID NO: 958120 - DNA, 22 bp, Artificial Sequence
  chemically synthesized
tatgtctgcctttatgacacta

SEQ ID NO: 958121 - DNA, 22 bp, Artificial Sequence
  chemically synthesized
gtctatatgtctgcctttatga

SEQ ID NO: 958122 - DNA, 22 bp, Artificial Sequence
  chemically synthesized
cattggtctatatgtctgcctt

SEQ ID NO: 958123 - DNA, 22 bp, Artificial Sequence
  chemically synthesized
ttccattggtctatatgtctgc

SEQ ID NO: 958124 - DNA, 22 bp, Artificial Sequence
  chemically synthesized
tgttccattggtctatatgtct

SEQ ID NO: 958125 - DNA, 22 bp, Artificial Sequence
  chemically synthesized
ttctgttccattggtctatatg

SEQ ID NO: 958126 - DNA, 22 bp, Artificial Sequence
  chemically synthesized
tattctgttccattggtctata

SEQ ID NO: 958127 - DNA, 22 bp, Artificial Sequence
  chemically synthesized
ggatctctattctgttccattg

SEQ ID NO: 958128 - DNA, 22 bp, Artificial Sequence
  chemically synthesized
tgggatctctattctgttccat

SEQ ID NO: 958129 - DNA, 22 bp, Artificial Sequence
  chemically synthesized
ctgggatctctattctgttcca

SEQ ID NO: 958130 - DNA, 22 bp, Artificial Sequence
  chemically synthesized
tttctgggatctctattctgtt

SEQ ID NO: 958131 - DNA, 22 bp, Artificial Sequence
  chemically synthesized
atttctgggatctctattctgt

SEQ ID NO: 958132 - DNA, 22 bp, Artificial Sequence
  chemically synthesized
ggtttatttctgggatctctat

SEQ ID NO: 958133 - DNA, 22 bp, Artificial Sequence
  chemically synthesized
aaggtgatgctaggtttatttc

SEQ ID NO: 958134 - DNA, 22 bp, Artificial Sequence
  chemically synthesized
ttgaaggtgatgctaggtttat

SEQ ID NO: 958135 - DNA, 22 bp, Artificial Sequence
  chemically synthesized
gcacccctattgaaggtgatgc

SEQ ID NO: 958136 - DNA, 22 bp, Artificial Sequence
  chemically synthesized
ggcacccctattgaaggtgatg

SEQ ID NO: 958137 - DNA, 22 bp, Artificial Sequence
  chemically synthesized
ttggcacccctattgaaggtga

SEQ ID NO: 958138 - DNA, 22 bp, Artificial Sequence
  chemically synthesized
tgtattcttggcacccctattg

SEQ ID NO: 958139 - DNA, 22 bp, Artificial Sequence
  chemically synthesized
gcatcaccttcaataggggtgc

SEQ ID NO: 958140 - DNA, 22 bp, Artificial Sequence
  chemically synthesized
ccagttgtgtattcttggcacc

SEQ ID NO: 958141 - DNA, 22 bp, Artificial Sequence
  chemically synthesized
cccagttgtgtattcttggcac

SEQ ID NO: 958142 - DNA, 22 bp, Artificial Sequence
  chemically synthesized
tcccagttgtgtattcttggca

SEQ ID NO: 958143 - DNA, 22 bp, Artificial Sequence
  chemically synthesized
caataggggtgccaagaataca

SEQ ID NO: 958144 - DNA, 22 bp, Artificial Sequence
  chemically synthesized
aataggggtgccaagaatacac

SEQ ID NO: 958145 - DNA, 22 bp, Artificial Sequence
  chemically synthesized
aagaggatatcctttcccagtt

SEQ ID NO: 958146 - DNA, 22 bp, Artificial Sequence
  chemically synthesized
gttgaagaggatatcctttccc

SEQ ID NO: 958147 - DNA, 22 bp, Artificial Sequence
  chemically synthesized
ccagcaccattggttgaagagg

SEQ ID NO: 958148 - DNA, 22 bp, Artificial Sequence
  chemically synthesized
ggaaaggatatcctcttcaacc

SEQ ID NO: 958149 - DNA, 22 bp, Artificial Sequence
  chemically synthesized
cccagcaccattggttgaagag

SEQ ID NO: 958150 - DNA, 22 bp, Artificial Sequence
  chemically synthesized
tcccagcaccattggttgaaga

SEQ ID NO: 958151 - DNA, 22 bp, Artificial Sequence
  chemically synthesized
ttcaaccaatggtgctgggaaa

SEQ ID NO: 958152 - DNA, 22 bp, Artificial Sequence
  chemically synthesized
caaccaatggtgctgggaaaac

SEQ ID NO: 958153 - DNA, 22 bp, Artificial Sequence
  chemically synthesized
aaccaatggtgctgggaaaact

SEQ ID NO: 958154 - DNA, 22 bp, Artificial Sequence
  chemically synthesized
caatgtgtatatccagttttcc

SEQ ID NO: 958155 - DNA, 22 bp, Artificial Sequence
  chemically synthesized
gcaatgtgtatatccagttttc

SEQ ID NO: 958156 - DNA, 22 bp, Artificial Sequence
  chemically synthesized
tgcaatgtgtatatccagtttt

SEQ ID NO: 958157 - DNA, 22 bp, Artificial Sequence
  chemically synthesized
tttgcaatgtgtatatccagtt

SEQ ID NO: 958158 - DNA, 22 bp, Artificial Sequence
  chemically synthesized
cattctttgcaatgtgtatatc

SEQ ID NO: 958159 - DNA, 22 bp, Artificial Sequence
  chemically synthesized
ggaaaactggatatacacattg

SEQ ID NO: 958160 - DNA, 22 bp, Artificial Sequence
  chemically synthesized
gatatacacattgcaaagaatg

SEQ ID NO: 958161 - DNA, 22 bp, Artificial Sequence
  chemically synthesized
aaggtccaattccattctttgc

SEQ ID NO: 958162 - DNA, 22 bp, Artificial Sequence
  chemically synthesized
agttaaaggtccaattccattc

SEQ ID NO: 958163 - DNA, 22 bp, Artificial Sequence
  chemically synthesized
aagttaaaggtccaattccatt

SEQ ID NO: 958164 - DNA, 22 bp, Artificial Sequence
  chemically synthesized
caaagaatggaattggaccttt

SEQ ID NO: 958165 - DNA, 22 bp, Artificial Sequence
  chemically synthesized
tgtatagtttaagttaaaggtc

SEQ ID NO: 958166 - DNA, 22 bp, Artificial Sequence
  chemically synthesized
atgtatagtttaagttaaaggt

SEQ ID NO: 958167 - DNA, 22 bp, Artificial Sequence
  chemically synthesized
tatgtatagtttaagttaaagg

SEQ ID NO: 958168 - DNA, 22 bp, Artificial Sequence
  chemically synthesized
ttatgtatagtttaagttaaag

SEQ ID NO: 958169 - DNA, 22 bp, Artificial Sequence
  chemically synthesized
atttttatgtatagtttaagtt

SEQ ID NO: 958170 - DNA, 22 bp, Artificial Sequence
  chemically synthesized
gacctttaacttaaactataca

SEQ ID NO: 958171 - DNA, 22 bp, Artificial Sequence
  chemically synthesized
agttgatttttatgtatagttt

SEQ ID NO: 958172 - DNA, 22 bp, Artificial Sequence
  chemically synthesized
gagttgatttttatgtatagtt

SEQ ID NO: 958173 - DNA, 22 bp, Artificial Sequence
  chemically synthesized
tgagttgatttttatgtatagt

SEQ ID NO: 958174 - DNA, 22 bp, Artificial Sequence
  chemically synthesized
taacttaaactatacataaaaa

SEQ ID NO: 958175 - DNA, 22 bp, Artificial Sequence
  chemically synthesized
attttgagttgatttttatgta

SEQ ID NO: 958176 - DNA, 22 bp, Artificial Sequence
  chemically synthesized
aacttaaactatacataaaaat

SEQ ID NO: 958177 - DNA, 22 bp, Artificial Sequence
  chemically synthesized
cattttgagttgatttttatgt

SEQ ID NO: 958178 - DNA, 22 bp, Artificial Sequence
  chemically synthesized
acttaaactatacataaaaatc

SEQ ID NO: 958179 - DNA, 22 bp, Artificial Sequence
  chemically synthesized
aaactatacataaaaatcaact

SEQ ID NO: 958180 - DNA, 22 bp, Artificial Sequence
  chemically synthesized
catttcattttgagttgatttt

SEQ ID NO: 958181 - DNA, 22 bp, Artificial Sequence
  chemically synthesized
aactatacataaaaatcaactc

SEQ ID NO: 958182 - DNA, 22 bp, Artificial Sequence
  chemically synthesized
ctccatttcattttgagttgat

SEQ ID NO: 958183 - DNA, 22 bp, Artificial Sequence
  chemically synthesized
actccatttcattttgagttga

SEQ ID NO: 958184 - DNA, 22 bp, Artificial Sequence
  chemically synthesized
tactccatttcattttgagttg

SEQ ID NO: 958185 - DNA, 22 bp, Artificial Sequence
  chemically synthesized
tacataaaaatcaactcaaaat

SEQ ID NO: 958186 - DNA, 22 bp, Artificial Sequence
  chemically synthesized
agtctttactccatttcatttt

SEQ ID NO: 958187 - DNA, 22 bp, Artificial Sequence
  chemically synthesized
aagtctttactccatttcattt

SEQ ID NO: 958188 - DNA, 22 bp, Artificial Sequence
  chemically synthesized
taagtctttactccatttcatt

SEQ ID NO: 958189 - DNA, 22 bp, Artificial Sequence
  chemically synthesized
ttaagtctttactccatttcat

SEQ ID NO: 958190 - DNA, 22 bp, Artificial Sequence
  chemically synthesized
tttttaagtctttactccattt

SEQ ID NO: 958191 - DNA, 22 bp, Artificial Sequence
  chemically synthesized
atttttaagtctttactccatt

SEQ ID NO: 958192 - DNA, 22 bp, Artificial Sequence
  chemically synthesized
aaaatgaaatggagtaaagact

SEQ ID NO: 958193 - DNA, 22 bp, Artificial Sequence
  chemically synthesized
agatcttatttttaagtcttta

SEQ ID NO: 958194 - DNA, 22 bp, Artificial Sequence
  chemically synthesized
cagatcttatttttaagtcttt

SEQ ID NO: 958195 - DNA, 22 bp, Artificial Sequence
  chemically synthesized
atagtttcagatcttattttta

SEQ ID NO: 958196 - DNA, 22 bp, Artificial Sequence
  chemically synthesized
catagtttcagatcttattttt

SEQ ID NO: 958197 - DNA, 22 bp, Artificial Sequence
  chemically synthesized
tgagtttcatagtttcagatct

SEQ ID NO: 958198 - DNA, 22 bp, Artificial Sequence
  chemically synthesized
tatgagtttcatagtttcagat

SEQ ID NO: 958199 - DNA, 22 bp, Artificial Sequence
  chemically synthesized
ctatgagtttcatagtttcaga

SEQ ID NO: 958200 - DNA, 22 bp, Artificial Sequence
  chemically synthesized
aaaaataagatctgaaactatg

SEQ ID NO: 958201 - DNA, 22 bp, Artificial Sequence
  chemically synthesized
ttctatgagtttcatagtttca

SEQ ID NO: 958202 - DNA, 22 bp, Artificial Sequence
  chemically synthesized
aaaataagatctgaaactatga

SEQ ID NO: 958203 - DNA, 22 bp, Artificial Sequence
  chemically synthesized
cttctatgagtttcatagtttc

SEQ ID NO: 958204 - DNA, 22 bp, Artificial Sequence
  chemically synthesized
tcttctatgagtttcatagttt

SEQ ID NO: 958205 - DNA, 22 bp, Artificial Sequence
  chemically synthesized
tgttttcttctatgagtttcat

SEQ ID NO: 958206 - DNA, 22 bp, Artificial Sequence
  chemically synthesized
atgttttcttctatgagtttca

SEQ ID NO: 958207 - DNA, 22 bp, Artificial Sequence
  chemically synthesized
ccttatgttttcttctatgagt

SEQ ID NO: 958208 - DNA, 22 bp, Artificial Sequence
  chemically synthesized
cccttatgttttcttctatgag

SEQ ID NO: 958209 - DNA, 22 bp, Artificial Sequence
  chemically synthesized
aaactatgaaactcatagaaga

SEQ ID NO: 958210 - DNA, 22 bp, Artificial Sequence
  chemically synthesized
tcccttatgttttcttctatga

SEQ ID NO: 958211 - DNA, 22 bp, Artificial Sequence
  chemically synthesized
ttcccttatgttttcttctatg

SEQ ID NO: 958212 - DNA, 22 bp, Artificial Sequence
  chemically synthesized
tgaaactcatagaagaaaacat

SEQ ID NO: 958213 - DNA, 22 bp, Artificial Sequence
  chemically synthesized
atagaagaaaacataagggaaa

SEQ ID NO: 958214 - DNA, 22 bp, Artificial Sequence
  chemically synthesized
tgaagaccaatgtcaggaaatt

SEQ ID NO: 958215 - DNA, 22 bp, Artificial Sequence
  chemically synthesized
ttgtgaagaccaatgtcaggaa

SEQ ID NO: 958216 - DNA, 22 bp, Artificial Sequence
  chemically synthesized
cctgacattggtcttcacaata

SEQ ID NO: 958217 - DNA, 22 bp, Artificial Sequence
  chemically synthesized
ctgacattggtcttcacaataa

SEQ ID NO: 958218 - DNA, 22 bp, Artificial Sequence
  chemically synthesized
acattggtcttcacaataattt

SEQ ID NO: 958219 - DNA, 22 bp, Artificial Sequence
  chemically synthesized
gcgtcatatccaaaaaaaatta

SEQ ID NO: 958220 - DNA, 22 bp, Artificial Sequence
  chemically synthesized
agcgtcatatccaaaaaaaatt

SEQ ID NO: 958221 - DNA, 22 bp, Artificial Sequence
  chemically synthesized
gtcttcacaataattttttttg

SEQ ID NO: 958222 - DNA, 22 bp, Artificial Sequence
  chemically synthesized
tagcgtcatatccaaaaaaaat

SEQ ID NO: 958223 - DNA, 22 bp, Artificial Sequence
  chemically synthesized
ttagcgtcatatccaaaaaaaa

SEQ ID NO: 958224 - DNA, 22 bp, Artificial Sequence
  chemically synthesized
cacaataattttttttggatat

SEQ ID NO: 958225 - DNA, 22 bp, Artificial Sequence
  chemically synthesized
acaataattttttttggatatg

SEQ ID NO: 958226 - DNA, 22 bp, Artificial Sequence
  chemically synthesized
tccttttagcgtcatatccaaa

SEQ ID NO: 958227 - DNA, 22 bp, Artificial Sequence
  chemically synthesized
gctgtccttttagcgtcatatc

SEQ ID NO: 958228 - DNA, 22 bp, Artificial Sequence
  chemically synthesized
ttggctgtccttttagcgtcat

SEQ ID NO: 958229 - DNA, 22 bp, Artificial Sequence
  chemically synthesized
gttggctgtccttttagcgtca

SEQ ID NO: 958230 - DNA, 22 bp, Artificial Sequence
  chemically synthesized
tgttggctgtccttttagcgtc

SEQ ID NO: 958231 - DNA, 22 bp, Artificial Sequence
  chemically synthesized
tttttggatatgacgctaaaag

SEQ ID NO: 958232 - DNA, 22 bp, Artificial Sequence
  chemically synthesized
ttgttggctgtccttttagcgt

SEQ ID NO: 958233 - DNA, 22 bp, Artificial Sequence
  chemically synthesized
ttttggatatgacgctaaaagg

SEQ ID NO: 958234 - DNA, 22 bp, Artificial Sequence
  chemically synthesized
tttggatatgacgctaaaagga

SEQ ID NO: 958235 - DNA, 22 bp, Artificial Sequence
  chemically synthesized
ttggatatgacgctaaaaggac

SEQ ID NO: 958236 - DNA, 22 bp, Artificial Sequence
  chemically synthesized
tttttgttggctgtccttttag

SEQ ID NO: 958237 - DNA, 22 bp, Artificial Sequence
  chemically synthesized
tggatatgacgctaaaaggaca

SEQ ID NO: 958238 - DNA, 22 bp, Artificial Sequence
  chemically synthesized
gtttttgttggctgtcctttta

SEQ ID NO: 958239 - DNA, 22 bp, Artificial Sequence
  chemically synthesized
ggatatgacgctaaaaggacag

SEQ ID NO: 958240 - DNA, 22 bp, Artificial Sequence
  chemically synthesized
tgtttttgttggctgtcctttt

SEQ ID NO: 958241 - DNA, 22 bp, Artificial Sequence
  chemically synthesized
gatatgacgctaaaaggacagc

SEQ ID NO: 958242 - DNA, 22 bp, Artificial Sequence
  chemically synthesized
gttttgtttttgttggctgtcc

SEQ ID NO: 958243 - DNA, 22 bp, Artificial Sequence
  chemically synthesized
tctagttttgtttttgttggct

SEQ ID NO: 958244 - DNA, 22 bp, Artificial Sequence
  chemically synthesized
atctagttttgtttttgttggc

SEQ ID NO: 958245 - DNA, 22 bp, Artificial Sequence
  chemically synthesized
cttatctagttttgtttttgtt

SEQ ID NO: 958246 - DNA, 22 bp, Artificial Sequence
  chemically synthesized
aaaggacagccaacaaaaacaa

SEQ ID NO: 958247 - DNA, 22 bp, Artificial Sequence
  chemically synthesized
tgcttatctagttttgtttttg

SEQ ID NO: 958248 - DNA, 22 bp, Artificial Sequence
  chemically synthesized
ctgcttatctagttttgttttt

SEQ ID NO: 958249 - DNA, 22 bp, Artificial Sequence
  chemically synthesized
atatatttctgcttatctagtt

SEQ ID NO: 958250 - DNA, 22 bp, Artificial Sequence
  chemically synthesized
gatatatttctgcttatctagt

SEQ ID NO: 958251 - DNA, 22 bp, Artificial Sequence
  chemically synthesized
gtttgatatatttctgcttatc

SEQ ID NO: 958252 - DNA, 22 bp, Artificial Sequence
  chemically synthesized
agtttgatatatttctgcttat

SEQ ID NO: 958253 - DNA, 22 bp, Artificial Sequence
  chemically synthesized
tagtttgatatatttctgctta

SEQ ID NO: 958254 - DNA, 22 bp, Artificial Sequence
  chemically synthesized
ttagtttgatatatttctgctt

SEQ ID NO: 958255 - DNA, 22 bp, Artificial Sequence
  chemically synthesized
tttagtttgatatatttctgct

SEQ ID NO: 958256 - DNA, 22 bp, Artificial Sequence
  chemically synthesized
gataagcagaaatatatcaaac

SEQ ID NO: 958257 - DNA, 22 bp, Artificial Sequence
  chemically synthesized
tagaagctttttagtttgatat

SEQ ID NO: 958258 - DNA, 22 bp, Artificial Sequence
  chemically synthesized
gtagaagctttttagtttgata

SEQ ID NO: 958259 - DNA, 22 bp, Artificial Sequence
  chemically synthesized
tgtagaagctttttagtttgat

SEQ ID NO: 958260 - DNA, 22 bp, Artificial Sequence
  chemically synthesized
ctttgtagaagctttttagttt

SEQ ID NO: 958261 - DNA, 22 bp, Artificial Sequence
  chemically synthesized
gctttgtagaagctttttagtt

SEQ ID NO: 958262 - DNA, 22 bp, Artificial Sequence
  chemically synthesized
ccttgctttgtagaagcttttt

SEQ ID NO: 958263 - DNA, 22 bp, Artificial Sequence
  chemically synthesized
cccttgctttgtagaagctttt

SEQ ID NO: 958264 - DNA, 22 bp, Artificial Sequence
  chemically synthesized
tttcccttgctttgtagaagct

SEQ ID NO: 958265 - DNA, 22 bp, Artificial Sequence
  chemically synthesized
attgtttcccttgctttgtaga

SEQ ID NO: 958266 - DNA, 22 bp, Artificial Sequence
  chemically synthesized
ttgattgtttcccttgctttgt

SEQ ID NO: 958267 - DNA, 22 bp, Artificial Sequence
  chemically synthesized
aaaagcttctacaaagcaaggg

SEQ ID NO: 958268 - DNA, 22 bp, Artificial Sequence
  chemically synthesized
tgttgattgtttcccttgcttt

SEQ ID NO: 958269 - DNA, 22 bp, Artificial Sequence
  chemically synthesized
attctgttgattgtttcccttg

SEQ ID NO: 958270 - DNA, 22 bp, Artificial Sequence
  chemically synthesized
aattctgttgattgtttccctt

SEQ ID NO: 958271 - DNA, 22 bp, Artificial Sequence
  chemically synthesized
taattctgttgattgtttccct

SEQ ID NO: 958272 - DNA, 22 bp, Artificial Sequence
  chemically synthesized
ttaattctgttgattgtttccc

SEQ ID NO: 958273 - DNA, 22 bp, Artificial Sequence
  chemically synthesized
ctacaaagcaagggaaacaatc

SEQ ID NO: 958274 - DNA, 22 bp, Artificial Sequence
  chemically synthesized
tacaaagcaagggaaacaatca

SEQ ID NO: 958275 - DNA, 22 bp, Artificial Sequence
  chemically synthesized
cttttaattctgttgattgttt

SEQ ID NO: 958276 - DNA, 22 bp, Artificial Sequence
  chemically synthesized
caaagcaagggaaacaatcaac

SEQ ID NO: 958277 - DNA, 22 bp, Artificial Sequence
  chemically synthesized
taggttgcttttaattctgttg

SEQ ID NO: 958278 - DNA, 22 bp, Artificial Sequence
  chemically synthesized
tataggttgcttttaattctgt

SEQ ID NO: 958279 - DNA, 22 bp, Artificial Sequence
  chemically synthesized
attctataggttgcttttaatt

SEQ ID NO: 958280 - DNA, 22 bp, Artificial Sequence
  chemically synthesized
tcattctataggttgcttttaa

SEQ ID NO: 958281 - DNA, 22 bp, Artificial Sequence
  chemically synthesized
tctcattctataggttgctttt

SEQ ID NO: 958282 - DNA, 22 bp, Artificial Sequence
  chemically synthesized
ctctcattctataggttgcttt

SEQ ID NO: 958283 - DNA, 22 bp, Artificial Sequence
  chemically synthesized
tctctcattctataggttgctt

SEQ ID NO: 958284 - DNA, 22 bp, Artificial Sequence
  chemically synthesized
ttctctcattctataggttgct

SEQ ID NO: 958285 - DNA, 22 bp, Artificial Sequence
  chemically synthesized
caaaccttttctctcattctat

SEQ ID NO: 958286 - DNA, 22 bp, Artificial Sequence
  chemically synthesized
gcaaaccttttctctcattcta

SEQ ID NO: 958287 - DNA, 22 bp, Artificial Sequence
  chemically synthesized
aaagcaacctatagaatgagag

SEQ ID NO: 958288 - DNA, 22 bp, Artificial Sequence
  chemically synthesized
tagaatgagagaaaaggtttgc

SEQ ID NO: 958289 - DNA, 22 bp, Artificial Sequence
  chemically synthesized
tcagatatatggtttgcaaacc

SEQ ID NO: 958290 - DNA, 22 bp, Artificial Sequence
  chemically synthesized
atcagatatatggtttgcaaac

SEQ ID NO: 958291 - DNA, 22 bp, Artificial Sequence
  chemically synthesized
acaccttatcagatatatggtt

SEQ ID NO: 958292 - DNA, 22 bp, Artificial Sequence
  chemically synthesized
gatattgacaccttatcagata

SEQ ID NO: 958293 - DNA, 22 bp, Artificial Sequence
  chemically synthesized
agatattgacaccttatcagat

SEQ ID NO: 958294 - DNA, 22 bp, Artificial Sequence
  chemically synthesized
gcaaaccatatatctgataagg

SEQ ID NO: 958295 - DNA, 22 bp, Artificial Sequence
  chemically synthesized
tagatattgacaccttatcaga

SEQ ID NO: 958296 - DNA, 22 bp, Artificial Sequence
  chemically synthesized
caaaccatatatctgataaggt

SEQ ID NO: 958297 - DNA, 22 bp, Artificial Sequence
  chemically synthesized
atgtattttagatattgacacc

SEQ ID NO: 958298 - DNA, 22 bp, Artificial Sequence
  chemically synthesized
ctcatgtattttagatattgac

SEQ ID NO: 958299 - DNA, 22 bp, Artificial Sequence
  chemically synthesized
ataaggtgtcaatatctaaaat

SEQ ID NO: 958300 - DNA, 22 bp, Artificial Sequence
  chemically synthesized
cgttcctcatgtattttagata

SEQ ID NO: 958301 - DNA, 22 bp, Artificial Sequence
  chemically synthesized
ttacgttcctcatgtattttag

SEQ ID NO: 958302 - DNA, 22 bp, Artificial Sequence
  chemically synthesized
ttattacgttcctcatgtattt

SEQ ID NO: 958303 - DNA, 22 bp, Artificial Sequence
  chemically synthesized
ttgttattacgttcctcatgta

SEQ ID NO: 958304 - DNA, 22 bp, Artificial Sequence
  chemically synthesized
ttgttgttattacgttcctcat

SEQ ID NO: 958305 - DNA, 22 bp, Artificial Sequence
  chemically synthesized
ttgttgttgttattacgttcct

SEQ ID NO: 958306 - DNA, 22 bp, Artificial Sequence
  chemically synthesized
gttgttgttgttattacgttcc

SEQ ID NO: 958307 - DNA, 22 bp, Artificial Sequence
  chemically synthesized
tgttgttgttgttattacgttc

SEQ ID NO: 958308 - DNA, 22 bp, Artificial Sequence
  chemically synthesized
aaatacatgaggaacgtaataa

SEQ ID NO: 958309 - DNA, 22 bp, Artificial Sequence
  chemically synthesized
ttgttgttgttgttattacgtt

SEQ ID NO: 958310 - DNA, 22 bp, Artificial Sequence
  chemically synthesized
gaatttttgttgttgttgttat

SEQ ID NO: 958311 - DNA, 22 bp, Artificial Sequence
  chemically synthesized
ttcgaatttttgttgttgttgt

SEQ ID NO: 958312 - DNA, 22 bp, Artificial Sequence
  chemically synthesized
ggttgttcgaatttttgttgtt

SEQ ID NO: 958313 - DNA, 22 bp, Artificial Sequence
  chemically synthesized
aaaattgggttgttcgaatttt

SEQ ID NO: 958314 - DNA, 22 bp, Artificial Sequence
  chemically synthesized
aaaaattgggttgttcgaattt

SEQ ID NO: 958315 - DNA, 22 bp, Artificial Sequence
  chemically synthesized
taaaaattgggttgttcgaatt

SEQ ID NO: 958316 - DNA, 22 bp, Artificial Sequence
  chemically synthesized
actttaaaaattgggttgttcg

SEQ ID NO: 958317 - DNA, 22 bp, Artificial Sequence
  chemically synthesized
ttcactttaaaaattgggttgt

SEQ ID NO: 958318 - DNA, 22 bp, Artificial Sequence
  chemically synthesized
gttcactttaaaaattgggttg

SEQ ID NO: 958319 - DNA, 22 bp, Artificial Sequence
  chemically synthesized
tgttcactttaaaaattgggtt

SEQ ID NO: 958320 - DNA, 22 bp, Artificial Sequence
  chemically synthesized
ctttgttcactttaaaaattgg

SEQ ID NO: 958321 - DNA, 22 bp, Artificial Sequence
  chemically synthesized
gaacaacccaatttttaaagtg

SEQ ID NO: 958322 - DNA, 22 bp, Artificial Sequence
  chemically synthesized
aattcctttgttcactttaaaa

SEQ ID NO: 958323 - DNA, 22 bp, Artificial Sequence
  chemically synthesized
ttcaattcctttgttcacttta

SEQ ID NO: 958324 - DNA, 22 bp, Artificial Sequence
  chemically synthesized
ttaaagtgaacaaaggaattga

SEQ ID NO: 958325 - DNA, 22 bp, Artificial Sequence
  chemically synthesized
taaagtgaacaaaggaattgaa

SEQ ID NO: 958326 - DNA, 22 bp, Artificial Sequence
  chemically synthesized
gagaaatatctattcaattcct

SEQ ID NO: 958327 - DNA, 22 bp, Artificial Sequence
  chemically synthesized
aaagtgaacaaaggaattgaat

SEQ ID NO: 958328 - DNA, 22 bp, Artificial Sequence
  chemically synthesized
ggagaaatatctattcaattcc

SEQ ID NO: 958329 - DNA, 22 bp, Artificial Sequence
  chemically synthesized
aagtgaacaaaggaattgaata

SEQ ID NO: 958330 - DNA, 22 bp, Artificial Sequence
  chemically synthesized
tggagaaatatctattcaattc

SEQ ID NO: 958331 - DNA, 22 bp, Artificial Sequence
  chemically synthesized
tttggagaaatatctattcaat

SEQ ID NO: 958332 - DNA, 22 bp, Artificial Sequence
  chemically synthesized
ctttggagaaatatctattcaa

SEQ ID NO: 958333 - DNA, 22 bp, Artificial Sequence
  chemically synthesized
atgtcttctttggagaaatatc

SEQ ID NO: 958334 - DNA, 22 bp, Artificial Sequence
  chemically synthesized
aatgtcttctttggagaaatat

SEQ ID NO: 958335 - DNA, 22 bp, Artificial Sequence
  chemically synthesized
taatgtcttctttggagaaata

SEQ ID NO: 958336 - DNA, 22 bp, Artificial Sequence
  chemically synthesized
aatagatatttctccaaagaag

SEQ ID NO: 958337 - DNA, 22 bp, Artificial Sequence
  chemically synthesized
gtcattttaatgtcttctttgg

SEQ ID NO: 958338 - DNA, 22 bp, Artificial Sequence
  chemically synthesized
ttggtcattttaatgtcttctt

SEQ ID NO: 958339 - DNA, 22 bp, Artificial Sequence
  chemically synthesized
ctccaaagaagacattaaaatg

SEQ ID NO: 958340 - DNA, 22 bp, Artificial Sequence
  chemically synthesized
tccaaagaagacattaaaatga

SEQ ID NO: 958341 - DNA, 22 bp, Artificial Sequence
  chemically synthesized
atataactgttggtcattttaa

SEQ ID NO: 958342 - DNA, 22 bp, Artificial Sequence
  chemically synthesized
caaagaagacattaaaatgacc

SEQ ID NO: 958343 - DNA, 22 bp, Artificial Sequence
  chemically synthesized
catataactgttggtcatttta

SEQ ID NO: 958344 - DNA, 22 bp, Artificial Sequence
  chemically synthesized
tcatataactgttggtcatttt

SEQ ID NO: 958345 - DNA, 22 bp, Artificial Sequence
  chemically synthesized
ttcatataactgttggtcattt

SEQ ID NO: 958346 - DNA, 22 bp, Artificial Sequence
  chemically synthesized
aacatcttttcatataactgtt

SEQ ID NO: 958347 - DNA, 22 bp, Artificial Sequence
  chemically synthesized
aaatgaccaacagttatatgaa

SEQ ID NO: 958348 - DNA, 22 bp, Artificial Sequence
  chemically synthesized
gtgatgttgaacatcttttcat

SEQ ID NO: 958349 - DNA, 22 bp, Artificial Sequence
  chemically synthesized
gtagttagtgatgttgaacatc

SEQ ID NO: 958350 - DNA, 22 bp, Artificial Sequence
  chemically synthesized
tatgaaaagatgttcaacatca

SEQ ID NO: 958351 - DNA, 22 bp, Artificial Sequence
  chemically synthesized
cctggtagttagtgatgttgaa

SEQ ID NO: 958352 - DNA, 22 bp, Artificial Sequence
  chemically synthesized
ccctggtagttagtgatgttga

SEQ ID NO: 958353 - DNA, 22 bp, Artificial Sequence
  chemically synthesized
catttccctggtagttagtgat

SEQ ID NO: 958354 - DNA, 22 bp, Artificial Sequence
  chemically synthesized
gcatttccctggtagttagtga

SEQ ID NO: 958355 - DNA, 22 bp, Artificial Sequence
  chemically synthesized
atttgcatttccctggtagtta

SEQ ID NO: 958356 - DNA, 22 bp, Artificial Sequence
  chemically synthesized
gatttgcatttccctggtagtt

SEQ ID NO: 958357 - DNA, 22 bp, Artificial Sequence
  chemically synthesized
aacatcactaactaccagggaa

SEQ ID NO: 958358 - DNA, 22 bp, Artificial Sequence
  chemically synthesized
tggatttgatttgcatttccct

SEQ ID NO: 958359 - DNA, 22 bp, Artificial Sequence
  chemically synthesized
actaccagggaaatgcaaatca

SEQ ID NO: 958360 - DNA, 22 bp, Artificial Sequence
  chemically synthesized
ccagggaaatgcaaatcaaatc

SEQ ID NO: 958361 - DNA, 22 bp, Artificial Sequence
  chemically synthesized
atccgtgaggtagtatatcatt

SEQ ID NO: 958362 - DNA, 22 bp, Artificial Sequence
  chemically synthesized
tcctaatccgtgaggtagtata

SEQ ID NO: 958363 - DNA, 22 bp, Artificial Sequence
  chemically synthesized
ataatggttatcctaatccgtg

SEQ ID NO: 958364 - DNA, 22 bp, Artificial Sequence
  chemically synthesized
aataatggttatcctaatccgt

SEQ ID NO: 958365 - DNA, 22 bp, Artificial Sequence
  chemically synthesized
taataatggttatcctaatccg

SEQ ID NO: 958366 - DNA, 22 bp, Artificial Sequence
  chemically synthesized
ttaataatggttatcctaatcc

SEQ ID NO: 958367 - DNA, 22 bp, Artificial Sequence
  chemically synthesized
tttaataatggttatcctaatc

SEQ ID NO: 958368 - DNA, 22 bp, Artificial Sequence
  chemically synthesized
ttttaataatggttatcctaat

SEQ ID NO: 958369 - DNA, 22 bp, Artificial Sequence
  chemically synthesized
tttttaataatggttatcctaa

SEQ ID NO: 958370 - DNA, 22 bp, Artificial Sequence
  chemically synthesized
ttttttaataatggttatccta

SEQ ID NO: 958371 - DNA, 22 bp, Artificial Sequence
  chemically synthesized
tttttttaataatggttatcct

SEQ ID NO: 958372 - DNA, 22 bp, Artificial Sequence
  chemically synthesized
cctcacggattaggataaccat

SEQ ID NO: 958373 - DNA, 22 bp, Artificial Sequence
  chemically synthesized
ttttttttaataatggttatcc

SEQ ID NO: 958374 - DNA, 22 bp, Artificial Sequence
  chemically synthesized
tttttttttaataatggttatc

SEQ ID NO: 958375 - DNA, 22 bp, Artificial Sequence
  chemically synthesized
ttttttttttaataatggttat

SEQ ID NO: 958376 - DNA, 22 bp, Artificial Sequence
  chemically synthesized
tttttttttttaataatggtta

SEQ ID NO: 958377 - DNA, 22 bp, Artificial Sequence
  chemically synthesized
acggattaggataaccattatt

SEQ ID NO: 958378 - DNA, 22 bp, Artificial Sequence
  chemically synthesized
ttttttttttttaataatggtt

SEQ ID NO: 958379 - DNA, 22 bp, Artificial Sequence
  chemically synthesized
tttttttttttttaataatggt

SEQ ID NO: 958380 - DNA, 22 bp, Artificial Sequence
  chemically synthesized
ttttttttttttttaataatgg

SEQ ID NO: 958381 - DNA, 22 bp, Artificial Sequence
  chemically synthesized
tttttttttttttttaataatg

SEQ ID NO: 958382 - DNA, 22 bp, Artificial Sequence
  chemically synthesized
ttttttttttttttttaataat

SEQ ID NO: 958383 - DNA, 22 bp, Artificial Sequence
  chemically synthesized
tttttttttttttttttaataa

SEQ ID NO: 958384 - DNA, 22 bp, Artificial Sequence
  chemically synthesized
ggataaccattattaaaaaaaa

SEQ ID NO: 958385 - DNA, 22 bp, Artificial Sequence
  chemically synthesized
ggcttttttttttttttttttt

SEQ ID NO: 958386 - DNA, 22 bp, Artificial Sequence
  chemically synthesized
gggctttttttttttttttttt

SEQ ID NO: 958387 - DNA, 22 bp, Artificial Sequence
  chemically synthesized
ttaaaaaaaaaaaaaaaaaaag

SEQ ID NO: 958388 - DNA, 22 bp, Artificial Sequence
  chemically synthesized
aaaaaaaaaaaaaaaaaagccc

SEQ ID NO: 958389 - DNA, 22 bp, Artificial Sequence
  chemically synthesized
accaacacatgtaatgatcttg

SEQ ID NO: 958390 - DNA, 22 bp, Artificial Sequence
  chemically synthesized
caccaacacatgtaatgatctt

SEQ ID NO: 958391 - DNA, 22 bp, Artificial Sequence
  chemically synthesized
caccttcaccaacacatgtaat

SEQ ID NO: 958392 - DNA, 22 bp, Artificial Sequence
  chemically synthesized
ctacaccttcaccaacacatgt

SEQ ID NO: 958393 - DNA, 22 bp, Artificial Sequence
  chemically synthesized
cctacaccttcaccaacacatg

SEQ ID NO: 958394 - DNA, 22 bp, Artificial Sequence
  chemically synthesized
tcctacaccttcaccaacacat

SEQ ID NO: 958395 - DNA, 22 bp, Artificial Sequence
  chemically synthesized
caattttcctacaccttcacca

SEQ ID NO: 958396 - DNA, 22 bp, Artificial Sequence
  chemically synthesized
catgtgttggtgaaggtgtagg

SEQ ID NO: 958397 - DNA, 22 bp, Artificial Sequence
  chemically synthesized
catctccaattttcctacacct

SEQ ID NO: 958398 - DNA, 22 bp, Artificial Sequence
  chemically synthesized
gtgaaggtgtaggaaaattgga

SEQ ID NO: 958399 - DNA, 22 bp, Artificial Sequence
  chemically synthesized
caccagcagtctacatctccaa

SEQ ID NO: 958400 - DNA, 22 bp, Artificial Sequence
  chemically synthesized
ccaccagcagtctacatctcca

SEQ ID NO: 958401 - DNA, 22 bp, Artificial Sequence
  chemically synthesized
tatttccaccagcagtctacat

SEQ ID NO: 958402 - DNA, 22 bp, Artificial Sequence
  chemically synthesized
atatttccaccagcagtctaca

SEQ ID NO: 958403 - DNA, 22 bp, Artificial Sequence
  chemically synthesized
tatatttccaccagcagtctac

SEQ ID NO: 958404 - DNA, 22 bp, Artificial Sequence
  chemically synthesized
gagatgtagactgctggtggaa

SEQ ID NO: 958405 - DNA, 22 bp, Artificial Sequence
  chemically synthesized
cacaattttatatttccaccag

SEQ ID NO: 958406 - DNA, 22 bp, Artificial Sequence
  chemically synthesized
cacaaaagctgcacaattttat

SEQ ID NO: 958407 - DNA, 22 bp, Artificial Sequence
  chemically synthesized
ctggtggaaatataaaattgtg

SEQ ID NO: 958408 - DNA, 22 bp, Artificial Sequence
  chemically synthesized
ccacaaaagctgcacaatttta

SEQ ID NO: 958409 - DNA, 22 bp, Artificial Sequence
  chemically synthesized
tccacaaaagctgcacaatttt

SEQ ID NO: 958410 - DNA, 22 bp, Artificial Sequence
  chemically synthesized
gtggaaatataaaattgtgcag

SEQ ID NO: 958411 - DNA, 22 bp, Artificial Sequence
  chemically synthesized
ttttccacaaaagctgcacaat

SEQ ID NO: 958412 - DNA, 22 bp, Artificial Sequence
  chemically synthesized
catattgttttccacaaaagct

SEQ ID NO: 958413 - DNA, 22 bp, Artificial Sequence
  chemically synthesized
tgcagcttttgtggaaaacaat

SEQ ID NO: 958414 - DNA, 22 bp, Artificial Sequence
  chemically synthesized
aggaaactccatattgttttcc

SEQ ID NO: 958415 - DNA, 22 bp, Artificial Sequence
  chemically synthesized
gaggaaactccatattgttttc

SEQ ID NO: 958416 - DNA, 22 bp, Artificial Sequence
  chemically synthesized
tgaggaaactccatattgtttt

SEQ ID NO: 958417 - DNA, 22 bp, Artificial Sequence
  chemically synthesized
ttgaggaaactccatattgttt

SEQ ID NO: 958418 - DNA, 22 bp, Artificial Sequence
  chemically synthesized
tttgaggaaactccatattgtt

SEQ ID NO: 958419 - DNA, 22 bp, Artificial Sequence
  chemically synthesized
ttttgaggaaactccatattgt

SEQ ID NO: 958420 - DNA, 22 bp, Artificial Sequence
  chemically synthesized
ttgtggaaaacaatatggagtt

SEQ ID NO: 958421 - DNA, 22 bp, Artificial Sequence
  chemically synthesized
tttttttgaggaaactccatat

SEQ ID NO: 958422 - DNA, 22 bp, Artificial Sequence
  chemically synthesized
tgtggaaaacaatatggagttt

SEQ ID NO: 958423 - DNA, 22 bp, Artificial Sequence
  chemically synthesized
atttttttgaggaaactccata

SEQ ID NO: 958424 - DNA, 22 bp, Artificial Sequence
  chemically synthesized
gtggaaaacaatatggagtttc

SEQ ID NO: 958425 - DNA, 22 bp, Artificial Sequence
  chemically synthesized
tatttttttgaggaaactccat

SEQ ID NO: 958426 - DNA, 22 bp, Artificial Sequence
  chemically synthesized
tggaaaacaatatggagtttcc

SEQ ID NO: 958427 - DNA, 22 bp, Artificial Sequence
  chemically synthesized
ttatttttttgaggaaactcca

SEQ ID NO: 958428 - DNA, 22 bp, Artificial Sequence
  chemically synthesized
tttatttttttgaggaaactcc

SEQ ID NO: 958429 - DNA, 22 bp, Artificial Sequence
  chemically synthesized
tattttttatttttttgaggaa

SEQ ID NO: 958430 - DNA, 22 bp, Artificial Sequence
  chemically synthesized
tggtagttatattttttatttt

SEQ ID NO: 958431 - DNA, 22 bp, Artificial Sequence
  chemically synthesized
atggtagttatattttttattt

SEQ ID NO: 958432 - DNA, 22 bp, Artificial Sequence
  chemically synthesized
cctcaaaaaaataaaaaatata

SEQ ID NO: 958433 - DNA, 22 bp, Artificial Sequence
  chemically synthesized
ctcaaaaaaataaaaaatataa

SEQ ID NO: 958434 - DNA, 22 bp, Artificial Sequence
  chemically synthesized
gatcttatggtagttatatttt

SEQ ID NO: 958435 - DNA, 22 bp, Artificial Sequence
  chemically synthesized
aaaaaaataaaaaatataacta

SEQ ID NO: 958436 - DNA, 22 bp, Artificial Sequence
  chemically synthesized
ctagatcttatggtagttatat

SEQ ID NO: 958437 - DNA, 22 bp, Artificial Sequence
  chemically synthesized
ccataagatctagcaatcccgc

SEQ ID NO: 958438 - DNA, 22 bp, Artificial Sequence
  chemically synthesized
gataaatatccagatgcgggat

SEQ ID NO: 958439 - DNA, 22 bp, Artificial Sequence
  chemically synthesized
agataaatatccagatgcggga

SEQ ID NO: 958440 - DNA, 22 bp, Artificial Sequence
  chemically synthesized
gtttagataaatatccagatgc

SEQ ID NO: 958441 - DNA, 22 bp, Artificial Sequence
  chemically synthesized
gcaatcccgcatctggatattt

SEQ ID NO: 958442 - DNA, 22 bp, Artificial Sequence
  chemically synthesized
aattcgtttagataaatatcca

SEQ ID NO: 958443 - DNA, 22 bp, Artificial Sequence
  chemically synthesized
aattgaattcgtttagataaat

SEQ ID NO: 958444 - DNA, 22 bp, Artificial Sequence
  chemically synthesized
gatatttatctaaacgaattca

SEQ ID NO: 958445 - DNA, 22 bp, Artificial Sequence
  chemically synthesized
aagatcctaaattgaattcgtt

SEQ ID NO: 958446 - DNA, 22 bp, Artificial Sequence
  chemically synthesized
caagatcctaaattgaattcgt

SEQ ID NO: 958447 - DNA, 22 bp, Artificial Sequence
  chemically synthesized
ttcaagatcctaaattgaattc

SEQ ID NO: 958448 - DNA, 22 bp, Artificial Sequence
  chemically synthesized
atctaaacgaattcaatttagg

SEQ ID NO: 958449 - DNA, 22 bp, Artificial Sequence
  chemically synthesized
tctaaacgaattcaatttagga

SEQ ID NO: 958450 - DNA, 22 bp, Artificial Sequence
  chemically synthesized
aacgaattcaatttaggatctt

SEQ ID NO: 958451 - DNA, 22 bp, Artificial Sequence
  chemically synthesized
aatttaggatcttgaagagata

SEQ ID NO: 958452 - DNA, 22 bp, Artificial Sequence
  chemically synthesized
aggatcttgaagagatatctgc

SEQ ID NO: 958453 - DNA, 22 bp, Artificial Sequence
  chemically synthesized
ggatcttgaagagatatctgca

SEQ ID NO: 958454 - DNA, 22 bp, Artificial Sequence
  chemically synthesized
caataaacatgggaatgcagat

SEQ ID NO: 958455 - DNA, 22 bp, Artificial Sequence
  chemically synthesized
gaagagatatctgcattcccat

SEQ ID NO: 958456 - DNA, 22 bp, Artificial Sequence
  chemically synthesized
aagagatatctgcattcccatg

SEQ ID NO: 958457 - DNA, 22 bp, Artificial Sequence
  chemically synthesized
taaaaatgctacaataaacatg

SEQ ID NO: 958458 - DNA, 22 bp, Artificial Sequence
  chemically synthesized
ctgtaaaaatgctacaataaac

SEQ ID NO: 958459 - DNA, 22 bp, Artificial Sequence
  chemically synthesized
cattcccatgtttattgtagca

SEQ ID NO: 958460 - DNA, 22 bp, Artificial Sequence
  chemically synthesized
gctactgtaaaaatgctacaat

SEQ ID NO: 958461 - DNA, 22 bp, Artificial Sequence
  chemically synthesized
ggctactgtaaaaatgctacaa

SEQ ID NO: 958462 - DNA, 22 bp, Artificial Sequence
  chemically synthesized
ttggctactgtaaaaatgctac

SEQ ID NO: 958463 - DNA, 22 bp, Artificial Sequence
  chemically synthesized
ccatgtttattgtagcattttt

SEQ ID NO: 958464 - DNA, 22 bp, Artificial Sequence
  chemically synthesized
acacctcttggctactgtaaaa

SEQ ID NO: 958465 - DNA, 22 bp, Artificial Sequence
  chemically synthesized
attgtagcatttttacagtagc

SEQ ID NO: 958466 - DNA, 22 bp, Artificial Sequence
  chemically synthesized
ttgtagcatttttacagtagcc

SEQ ID NO: 958467 - DNA, 22 bp, Artificial Sequence
  chemically synthesized
ttcacacctcttggctactgta

SEQ ID NO: 958468 - DNA, 22 bp, Artificial Sequence
  chemically synthesized
gttcacacctcttggctactgt

SEQ ID NO: 958469 - DNA, 22 bp, Artificial Sequence
  chemically synthesized
tagcatttttacagtagccaag

SEQ ID NO: 958470 - DNA, 22 bp, Artificial Sequence
  chemically synthesized
gtttgttcacacctcttggcta

SEQ ID NO: 958471 - DNA, 22 bp, Artificial Sequence
  chemically synthesized
agtttgttcacacctcttggct

SEQ ID NO: 958472 - DNA, 22 bp, Artificial Sequence
  chemically synthesized
ttacagtagccaagaggtgtga

SEQ ID NO: 958473 - DNA, 22 bp, Artificial Sequence
  chemically synthesized
tacagtagccaagaggtgtgaa

SEQ ID NO: 958474 - DNA, 22 bp, Artificial Sequence
  chemically synthesized
acagtagccaagaggtgtgaac

SEQ ID NO: 958475 - DNA, 22 bp, Artificial Sequence
  chemically synthesized
cagtagccaagaggtgtgaaca

SEQ ID NO: 958476 - DNA, 22 bp, Artificial Sequence
  chemically synthesized
tcaatagacatttagtttgttc

SEQ ID NO: 958477 - DNA, 22 bp, Artificial Sequence
  chemically synthesized
ccctgtcaatagacatttagtt

SEQ ID NO: 958478 - DNA, 22 bp, Artificial Sequence
  chemically synthesized
tacattcccctgtcaatagaca

SEQ ID NO: 958479 - DNA, 22 bp, Artificial Sequence
  chemically synthesized
atacattcccctgtcaatagac

SEQ ID NO: 958480 - DNA, 22 bp, Artificial Sequence
  chemically synthesized
tatacattcccctgtcaataga

SEQ ID NO: 958481 - DNA, 22 bp, Artificial Sequence
  chemically synthesized
aatgtctattgacaggggaatg

SEQ ID NO: 958482 - DNA, 22 bp, Artificial Sequence
  chemically synthesized
ttgacaggggaatgtataaagc

SEQ ID NO: 958483 - DNA, 22 bp, Artificial Sequence
  chemically synthesized
acaggggaatgtataaagctat

SEQ ID NO: 958484 - DNA, 22 bp, Artificial Sequence
  chemically synthesized
tatgtatataacatagctttat

SEQ ID NO: 958485 - DNA, 22 bp, Artificial Sequence
  chemically synthesized
cattgtatgtatataacatagc

SEQ ID NO: 958486 - DNA, 22 bp, Artificial Sequence
  chemically synthesized
tgttatatacatacaatggaat

SEQ ID NO: 958487 - DNA, 22 bp, Artificial Sequence
  chemically synthesized
tggcagaatgatattccattgt

SEQ ID NO: 958488 - DNA, 22 bp, Artificial Sequence
  chemically synthesized
gtggcagaatgatattccattg

SEQ ID NO: 958489 - DNA, 22 bp, Artificial Sequence
  chemically synthesized
tgtggcagaatgatattccatt

SEQ ID NO: 958490 - DNA, 22 bp, Artificial Sequence
  chemically synthesized
ttgtggcagaatgatattccat

SEQ ID NO: 958491 - DNA, 22 bp, Artificial Sequence
  chemically synthesized
tttgtggcagaatgatattcca

SEQ ID NO: 958492 - DNA, 22 bp, Artificial Sequence
  chemically synthesized
tatacatacaatggaatatcat

SEQ ID NO: 958493 - DNA, 22 bp, Artificial Sequence
  chemically synthesized
ctttttgtggcagaatgatatt

SEQ ID NO: 958494 - DNA, 22 bp, Artificial Sequence
  chemically synthesized
cctttttgtggcagaatgatat

SEQ ID NO: 958495 - DNA, 22 bp, Artificial Sequence
  chemically synthesized
tagcatatggtaagatttcctt

SEQ ID NO: 958496 - DNA, 22 bp, Artificial Sequence
  chemically synthesized
tgccacaaaaaggaaatcttac

SEQ ID NO: 958497 - DNA, 22 bp, Artificial Sequence
  chemically synthesized
ccacaaaaaggaaatcttacca

SEQ ID NO: 958498 - DNA, 22 bp, Artificial Sequence
  chemically synthesized
atccacattgtagcatatggta

SEQ ID NO: 958499 - DNA, 22 bp, Artificial Sequence
  chemically synthesized
caagattcatccacattgtagc

SEQ ID NO: 958500 - DNA, 22 bp, Artificial Sequence
  chemically synthesized
accatatgctacaatgtggatg

SEQ ID NO: 958501 - DNA, 22 bp, Artificial Sequence
  chemically synthesized
ccatatgctacaatgtggatga

SEQ ID NO: 958502 - DNA, 22 bp, Artificial Sequence
  chemically synthesized
gcaaaatggctacaagattcat

SEQ ID NO: 958503 - DNA, 22 bp, Artificial Sequence
  chemically synthesized
agcaaaatggctacaagattca

SEQ ID NO: 958504 - DNA, 22 bp, Artificial Sequence
  chemically synthesized
caatgtggatgaatcttgtagc

SEQ ID NO: 958505 - DNA, 22 bp, Artificial Sequence
  chemically synthesized
tttagcaaaatggctacaagat

SEQ ID NO: 958506 - DNA, 22 bp, Artificial Sequence
  chemically synthesized
atttagcaaaatggctacaaga

SEQ ID NO: 958507 - DNA, 22 bp, Artificial Sequence
  chemically synthesized
tatttagcaaaatggctacaag

SEQ ID NO: 958508 - DNA, 22 bp, Artificial Sequence
  chemically synthesized
ttttatttagcaaaatggctac

SEQ ID NO: 958509 - DNA, 22 bp, Artificial Sequence
  chemically synthesized
attttatttagcaaaatggcta

SEQ ID NO: 958510 - DNA, 22 bp, Artificial Sequence
  chemically synthesized
cttattttatttagcaaaatgg

SEQ ID NO: 958511 - DNA, 22 bp, Artificial Sequence
  chemically synthesized
gcttattttatttagcaaaatg

SEQ ID NO: 958512 - DNA, 22 bp, Artificial Sequence
  chemically synthesized
cgacttgcttattttatttagc

SEQ ID NO: 958513 - DNA, 22 bp, Artificial Sequence
  chemically synthesized
gtagccattttgctaaataaaa

SEQ ID NO: 958514 - DNA, 22 bp, Artificial Sequence
  chemically synthesized
acgacttgcttattttatttag

SEQ ID NO: 958515 - DNA, 22 bp, Artificial Sequence
  chemically synthesized
tagccattttgctaaataaaat

SEQ ID NO: 958516 - DNA, 22 bp, Artificial Sequence
  chemically synthesized
tacgacttgcttattttattta

SEQ ID NO: 958517 - DNA, 22 bp, Artificial Sequence
  chemically synthesized
ttacgacttgcttattttattt

SEQ ID NO: 958518 - DNA, 22 bp, Artificial Sequence
  chemically synthesized
tccttttacgacttgcttattt

SEQ ID NO: 958519 - DNA, 22 bp, Artificial Sequence
  chemically synthesized
gtccttttacgacttgcttatt

SEQ ID NO: 958520 - DNA, 22 bp, Artificial Sequence
  chemically synthesized
tgctaaataaaataagcaagtc

SEQ ID NO: 958521 - DNA, 22 bp, Artificial Sequence
  chemically synthesized
gctaaataaaataagcaagtcg

SEQ ID NO: 958522 - DNA, 22 bp, Artificial Sequence
  chemically synthesized
ctaaataaaataagcaagtcgt

SEQ ID NO: 958523 - DNA, 22 bp, Artificial Sequence
  chemically synthesized
aataaaataagcaagtcgtaaa

SEQ ID NO: 958524 - DNA, 22 bp, Artificial Sequence
  chemically synthesized
atgtaagtggatgcgtgcagta

SEQ ID NO: 958525 - DNA, 22 bp, Artificial Sequence
  chemically synthesized
gatacctcatgtaagtggatgc

SEQ ID NO: 958526 - DNA, 22 bp, Artificial Sequence
  chemically synthesized
agatacctcatgtaagtggatg

SEQ ID NO: 958527 - DNA, 22 bp, Artificial Sequence
  chemically synthesized
tagatacctcatgtaagtggat

SEQ ID NO: 958528 - DNA, 22 bp, Artificial Sequence
  chemically synthesized
ctttagatacctcatgtaagtg

SEQ ID NO: 958529 - DNA, 22 bp, Artificial Sequence
  chemically synthesized
cacgcatccacttacatgaggt

SEQ ID NO: 958530 - DNA, 22 bp, Artificial Sequence
  chemically synthesized
actactttagatacctcatgta

SEQ ID NO: 958531 - DNA, 22 bp, Artificial Sequence
  chemically synthesized
gactactttagatacctcatgt

SEQ ID NO: 958532 - DNA, 22 bp, Artificial Sequence
  chemically synthesized
tgactactttagatacctcatg

SEQ ID NO: 958533 - DNA, 22 bp, Artificial Sequence
  chemically synthesized
taattttgactactttagatac

SEQ ID NO: 958534 - DNA, 22 bp, Artificial Sequence
  chemically synthesized
tataattttgactactttagat

SEQ ID NO: 958535 - DNA, 22 bp, Artificial Sequence
  chemically synthesized
ctataattttgactactttaga

SEQ ID NO: 958536 - DNA, 22 bp, Artificial Sequence
  chemically synthesized
acatgaggtatctaaagtagtc

SEQ ID NO: 958537 - DNA, 22 bp, Artificial Sequence
  chemically synthesized
catgaggtatctaaagtagtca

SEQ ID NO: 958538 - DNA, 22 bp, Artificial Sequence
  chemically synthesized
tttctataattttgactacttt

SEQ ID NO: 958539 - DNA, 22 bp, Artificial Sequence
  chemically synthesized
tgtttctataattttgactact

SEQ ID NO: 958540 - DNA, 22 bp, Artificial Sequence
  chemically synthesized
ctgtttctataattttgactac

SEQ ID NO: 958541 - DNA, 22 bp, Artificial Sequence
  chemically synthesized
tctgtttctataattttgacta

SEQ ID NO: 958542 - DNA, 22 bp, Artificial Sequence
  chemically synthesized
tactttctgtttctataatttt

SEQ ID NO: 958543 - DNA, 22 bp, Artificial Sequence
  chemically synthesized
aagtagtcaaaattatagaaac

SEQ ID NO: 958544 - DNA, 22 bp, Artificial Sequence
  chemically synthesized
gcaaccaccattgtactttctg

SEQ ID NO: 958545 - DNA, 22 bp, Artificial Sequence
  chemically synthesized
agcaaccaccattgtactttct

SEQ ID NO: 958546 - DNA, 22 bp, Artificial Sequence
  chemically synthesized
tagaaacagaaagtacaatggt

SEQ ID NO: 958547 - DNA, 22 bp, Artificial Sequence
  chemically synthesized
cagcccttagcaaccaccattg

SEQ ID NO: 958548 - DNA, 22 bp, Artificial Sequence
  chemically synthesized
ctccagcccttagcaaccacca

SEQ ID NO: 958549 - DNA, 22 bp, Artificial Sequence
  chemically synthesized
cctcctccagcccttagcaacc

SEQ ID NO: 958550 - DNA, 22 bp, Artificial Sequence
  chemically synthesized
ccctcctccagcccttagcaac

SEQ ID NO: 958551 - DNA, 22 bp, Artificial Sequence
  chemically synthesized
ttccctcctccagcccttagca

SEQ ID NO: 958552 - DNA, 22 bp, Artificial Sequence
  chemically synthesized
cttccctcctccagcccttagc

SEQ ID NO: 958553 - DNA, 22 bp, Artificial Sequence
  chemically synthesized
accatttcttccctcctccagc

SEQ ID NO: 958554 - DNA, 22 bp, Artificial Sequence
  chemically synthesized
ctaagggctggaggagggaaga

SEQ ID NO: 958555 - DNA, 22 bp, Artificial Sequence
  chemically synthesized
agggctggaggagggaagaaat

SEQ ID NO: 958556 - DNA, 22 bp, Artificial Sequence
  chemically synthesized
cacagcatctcaccatttcttc

SEQ ID NO: 958557 - DNA, 22 bp, Artificial Sequence
  chemically synthesized
gaggagggaagaaatggtgaga

SEQ ID NO: 958558 - DNA, 22 bp, Artificial Sequence
  chemically synthesized
tacccattgcacagcatctcac

SEQ ID NO: 958559 - DNA, 22 bp, Artificial Sequence
  chemically synthesized
atagtctatacccattgcacag

SEQ ID NO: 958560 - DNA, 22 bp, Artificial Sequence
  chemically synthesized
catgcctgatagtctataccca

SEQ ID NO: 958561 - DNA, 22 bp, Artificial Sequence
  chemically synthesized
accctacatgcctgatagtcta

SEQ ID NO: 958562 - DNA, 22 bp, Artificial Sequence
  chemically synthesized
tgcaatgggtatagactatcag

SEQ ID NO: 958563 - DNA, 22 bp, Artificial Sequence
  chemically synthesized
aaccctacatgcctgatagtct

SEQ ID NO: 958564 - DNA, 22 bp, Artificial Sequence
  chemically synthesized
taaccctacatgcctgatagtc

SEQ ID NO: 958565 - DNA, 22 bp, Artificial Sequence
  chemically synthesized
ttaaccctacatgcctgatagt

SEQ ID NO: 958566 - DNA, 22 bp, Artificial Sequence
  chemically synthesized
tttaaccctacatgcctgatag

SEQ ID NO: 958567 - DNA, 22 bp, Artificial Sequence
  chemically synthesized
ttttaaccctacatgcctgata

SEQ ID NO: 958568 - DNA, 22 bp, Artificial Sequence
  chemically synthesized
taatttttttaaccctacatgc

SEQ ID NO: 958569 - DNA, 22 bp, Artificial Sequence
  chemically synthesized
ataatttttttaaccctacatg

SEQ ID NO: 958570 - DNA, 22 bp, Artificial Sequence
  chemically synthesized
tataatttttttaaccctacat

SEQ ID NO: 958571 - DNA, 22 bp, Artificial Sequence
  chemically synthesized
tcaggcatgtagggttaaaaaa

SEQ ID NO: 958572 - DNA, 22 bp, Artificial Sequence
  chemically synthesized
catagcagatctttataatttt

SEQ ID NO: 958573 - DNA, 22 bp, Artificial Sequence
  chemically synthesized
aaaaaattataaagatctgcta

SEQ ID NO: 958574 - DNA, 22 bp, Artificial Sequence
  chemically synthesized
aatataagcaaaatgttgcata

SEQ ID NO: 958575 - DNA, 22 bp, Artificial Sequence
  chemically synthesized
taaagatctgctatgcaacatt

SEQ ID NO: 958576 - DNA, 22 bp, Artificial Sequence
  chemically synthesized
ttaaatataagcaaaatgttgc

SEQ ID NO: 958577 - DNA, 22 bp, Artificial Sequence
  chemically synthesized
ctatgcaacattttgcttatat

SEQ ID NO: 958578 - DNA, 22 bp, Artificial Sequence
  chemically synthesized
tgcaacattttgcttatattta

SEQ ID NO: 958579 - DNA, 22 bp, Artificial Sequence
  chemically synthesized
agtgcacaatacagtattgtta

SEQ ID NO: 958580 - DNA, 22 bp, Artificial Sequence
  chemically synthesized
aagtgcacaatacagtattgtt

SEQ ID NO: 958581 - DNA, 22 bp, Artificial Sequence
  chemically synthesized
tgcttatatttaacaatactgt

SEQ ID NO: 958582 - DNA, 22 bp, Artificial Sequence
  chemically synthesized
taagtgcacaatacagtattgt

SEQ ID NO: 958583 - DNA, 22 bp, Artificial Sequence
  chemically synthesized
gcttatatttaacaatactgta

SEQ ID NO: 958584 - DNA, 22 bp, Artificial Sequence
  chemically synthesized
cttatatttaacaatactgtat

SEQ ID NO: 958585 - DNA, 22 bp, Artificial Sequence
  chemically synthesized
atatttaacaatactgtattgt

SEQ ID NO: 958586 - DNA, 22 bp, Artificial Sequence
  chemically synthesized
tatttaacaatactgtattgtg

SEQ ID NO: 958587 - DNA, 22 bp, Artificial Sequence
  chemically synthesized
ataaattttaagtgcacaatac

SEQ ID NO: 958588 - DNA, 22 bp, Artificial Sequence
  chemically synthesized
aataaattttaagtgcacaata

SEQ ID NO: 958589 - DNA, 22 bp, Artificial Sequence
  chemically synthesized
aacaatactgtattgtgcactt

SEQ ID NO: 958590 - DNA, 22 bp, Artificial Sequence
  chemically synthesized
ttaataaattttaagtgcacaa

SEQ ID NO: 958591 - DNA, 22 bp, Artificial Sequence
  chemically synthesized
acaatactgtattgtgcactta

SEQ ID NO: 958592 - DNA, 22 bp, Artificial Sequence
  chemically synthesized
tattgtgcacttaaaatttatt

SEQ ID NO: 958593 - DNA, 22 bp, Artificial Sequence
  chemically synthesized
tgcacttaaaatttattaagag

SEQ ID NO: 958594 - DNA, 22 bp, Artificial Sequence
  chemically synthesized
atgaaatccaccctcttaataa

SEQ ID NO: 958595 - DNA, 22 bp, Artificial Sequence
  chemically synthesized
aatgaaatccaccctcttaata

SEQ ID NO: 958596 - DNA, 22 bp, Artificial Sequence
  chemically synthesized
taatgaaatccaccctcttaat

SEQ ID NO: 958597 - DNA, 22 bp, Artificial Sequence
  chemically synthesized
ttaatgaaatccaccctcttaa

SEQ ID NO: 958598 - DNA, 22 bp, Artificial Sequence
  chemically synthesized
tttaatgaaatccaccctctta

SEQ ID NO: 958599 - DNA, 22 bp, Artificial Sequence
  chemically synthesized
ttttaatgaaatccaccctctt

SEQ ID NO: 958600 - DNA, 22 bp, Artificial Sequence
  chemically synthesized
aaaatttattaagagggtggat

SEQ ID NO: 958601 - DNA, 22 bp, Artificial Sequence
  chemically synthesized
aaatttattaagagggtggatt

SEQ ID NO: 958602 - DNA, 22 bp, Artificial Sequence
  chemically synthesized
tttttttaatgaaatccaccct

SEQ ID NO: 958603 - DNA, 22 bp, Artificial Sequence
  chemically synthesized
atttttttaatgaaatccaccc

SEQ ID NO: 958604 - DNA, 22 bp, Artificial Sequence
  chemically synthesized
tatttttttaatgaaatccacc

SEQ ID NO: 958605 - DNA, 22 bp, Artificial Sequence
  chemically synthesized
ttatttttttaatgaaatccac

SEQ ID NO: 958606 - DNA, 22 bp, Artificial Sequence
  chemically synthesized
attaagagggtggatttcatta

SEQ ID NO: 958607 - DNA, 22 bp, Artificial Sequence
  chemically synthesized
tttttatttttttaatgaaatc

SEQ ID NO: 958608 - DNA, 22 bp, Artificial Sequence
  chemically synthesized
ttaagagggtggatttcattaa

SEQ ID NO: 958609 - DNA, 22 bp, Artificial Sequence
  chemically synthesized
gtttttatttttttaatgaaat

SEQ ID NO: 958610 - DNA, 22 bp, Artificial Sequence
  chemically synthesized
agagggtggatttcattaaaaa

SEQ ID NO: 958611 - DNA, 22 bp, Artificial Sequence
  chemically synthesized
atgaagcacttgtttttatttt

SEQ ID NO: 958612 - DNA, 22 bp, Artificial Sequence
  chemically synthesized
aatgaagcacttgtttttattt

SEQ ID NO: 958613 - DNA, 22 bp, Artificial Sequence
  chemically synthesized
ttaatgaagcacttgtttttat

SEQ ID NO: 958614 - DNA, 22 bp, Artificial Sequence
  chemically synthesized
cttaatgaagcacttgttttta

SEQ ID NO: 958615 - DNA, 22 bp, Artificial Sequence
  chemically synthesized
cattaaaaaaataaaaacaagt

SEQ ID NO: 958616 - DNA, 22 bp, Artificial Sequence
  chemically synthesized
tcttaatgaagcacttgttttt

SEQ ID NO: 958617 - DNA, 22 bp, Artificial Sequence
  chemically synthesized
attaaaaaaataaaaacaagtg

SEQ ID NO: 958618 - DNA, 22 bp, Artificial Sequence
  chemically synthesized
ttcttaatgaagcacttgtttt

SEQ ID NO: 958619 - DNA, 22 bp, Artificial Sequence
  chemically synthesized
tttcttaatgaagcacttgttt

SEQ ID NO: 958620 - DNA, 22 bp, Artificial Sequence
  chemically synthesized
ttttcttaatgaagcacttgtt

SEQ ID NO: 958621 - DNA, 22 bp, Artificial Sequence
  chemically synthesized
aaaaaataaaaacaagtgcttc

SEQ ID NO: 958622 - DNA, 22 bp, Artificial Sequence
  chemically synthesized
aaaaagatgtttttttcttaat

SEQ ID NO: 958623 - DNA, 22 bp, Artificial Sequence
  chemically synthesized
tatgtgttgaaaaagatgtttt

SEQ ID NO: 958624 - DNA, 22 bp, Artificial Sequence
  chemically synthesized
cattaagaaaaaaacatctttt

SEQ ID NO: 958625 - DNA, 22 bp, Artificial Sequence
  chemically synthesized
attaagaaaaaaacatcttttt

SEQ ID NO: 958626 - DNA, 22 bp, Artificial Sequence
  chemically synthesized
agaaaaaaacatctttttcaac

SEQ ID NO: 958627 - DNA, 22 bp, Artificial Sequence
  chemically synthesized
acaaagaattgtatgtgttgaa

SEQ ID NO: 958628 - DNA, 22 bp, Artificial Sequence
  chemically synthesized
attaacaaagaattgtatgtgt

SEQ ID NO: 958629 - DNA, 22 bp, Artificial Sequence
  chemically synthesized
agttcattaacaaagaattgta

SEQ ID NO: 958630 - DNA, 22 bp, Artificial Sequence
  chemically synthesized
tttcaacacatacaattctttg

SEQ ID NO: 958631 - DNA, 22 bp, Artificial Sequence
  chemically synthesized
ttcaacacatacaattctttgt

SEQ ID NO: 958632 - DNA, 22 bp, Artificial Sequence
  chemically synthesized
tcaacacatacaattctttgtt

SEQ ID NO: 958633 - DNA, 22 bp, Artificial Sequence
  chemically synthesized
caacacatacaattctttgtta

SEQ ID NO: 958634 - DNA, 22 bp, Artificial Sequence
  chemically synthesized
aacacatacaattctttgttaa

SEQ ID NO: 958635 - DNA, 22 bp, Artificial Sequence
  chemically synthesized
aatgattaagttcattaacaaa

SEQ ID NO: 958636 - DNA, 22 bp, Artificial Sequence
  chemically synthesized
gcattcaatgattaagttcatt

SEQ ID NO: 958637 - DNA, 22 bp, Artificial Sequence
  chemically synthesized
tttgttaatgaacttaatcatt

SEQ ID NO: 958638 - DNA, 22 bp, Artificial Sequence
  chemically synthesized
tgttaatgaacttaatcattga

SEQ ID NO: 958639 - DNA, 22 bp, Artificial Sequence
  chemically synthesized
gttaatgaacttaatcattgaa

SEQ ID NO: 958640 - DNA, 22 bp, Artificial Sequence
  chemically synthesized
ttaatgaacttaatcattgaat

SEQ ID NO: 958641 - DNA, 22 bp, Artificial Sequence
  chemically synthesized
ccaaccagttggcattcaatga

SEQ ID NO: 958642 - DNA, 22 bp, Artificial Sequence
  chemically synthesized
cccaaccagttggcattcaatg

SEQ ID NO: 958643 - DNA, 22 bp, Artificial Sequence
  chemically synthesized
atgaacttaatcattgaatgcc

SEQ ID NO: 958644 - DNA, 22 bp, Artificial Sequence
  chemically synthesized
aatcattgaatgccaactggtt

SEQ ID NO: 958645 - DNA, 22 bp, Artificial Sequence
  chemically synthesized
atcattgaatgccaactggttg

SEQ ID NO: 958646 - DNA, 22 bp, Artificial Sequence
  chemically synthesized
tcaggtataccatttcccaacc

SEQ ID NO: 958647 - DNA, 22 bp, Artificial Sequence
  chemically synthesized
aatgccaactggttgggaaatg

SEQ ID NO: 958648 - DNA, 22 bp, Artificial Sequence
  chemically synthesized
tgttgtcaggtataccatttcc

SEQ ID NO: 958649 - DNA, 22 bp, Artificial Sequence
  chemically synthesized
tatgttgtcaggtataccattt

SEQ ID NO: 958650 - DNA, 22 bp, Artificial Sequence
  chemically synthesized
ctatgttgtcaggtataccatt

SEQ ID NO: 958651 - DNA, 22 bp, Artificial Sequence
  chemically synthesized
tctatgttgtcaggtataccat

SEQ ID NO: 958652 - DNA, 22 bp, Artificial Sequence
  chemically synthesized
gttgggaaatggtatacctgac

SEQ ID NO: 958653 - DNA, 22 bp, Artificial Sequence
  chemically synthesized
atggctttctatgttgtcaggt

SEQ ID NO: 958654 - DNA, 22 bp, Artificial Sequence
  chemically synthesized
ggaaatggtatacctgacaaca

SEQ ID NO: 958655 - DNA, 22 bp, Artificial Sequence
  chemically synthesized
tctgatggctttctatgttgtc

SEQ ID NO: 958656 - DNA, 22 bp, Artificial Sequence
  chemically synthesized
gctgtctgatggctttctatgt

SEQ ID NO: 958657 - DNA, 22 bp, Artificial Sequence
  chemically synthesized
acaacatagaaagccatcagac

SEQ ID NO: 958658 - DNA, 22 bp, Artificial Sequence
  chemically synthesized
caaataccatgttagctgtctg

SEQ ID NO: 958659 - DNA, 22 bp, Artificial Sequence
  chemically synthesized
acgagaagttgcaaataccatg

SEQ ID NO: 958660 - DNA, 22 bp, Artificial Sequence
  chemically synthesized
ccaccctcacgagaagttgcaa

SEQ ID NO: 958661 - DNA, 22 bp, Artificial Sequence
  chemically synthesized
acatggtatttgcaacttctcg

SEQ ID NO: 958662 - DNA, 22 bp, Artificial Sequence
  chemically synthesized
tggtgctcccaccctcacgaga

SEQ ID NO: 958663 - DNA, 22 bp, Artificial Sequence
  chemically synthesized
atggtgctcccaccctcacgag

SEQ ID NO: 958664 - DNA, 22 bp, Artificial Sequence
  chemically synthesized
gcaacttctcgtgagggtggga

SEQ ID NO: 958665 - DNA, 22 bp, Artificial Sequence
  chemically synthesized
caacttctcgtgagggtgggag

SEQ ID NO: 958666 - DNA, 22 bp, Artificial Sequence
  chemically synthesized
ctcgtgagggtgggagcaccat

SEQ ID NO: 958667 - DNA, 22 bp, Artificial Sequence
  chemically synthesized
atatatgtgtttatggtgctcc

SEQ ID NO: 958668 - DNA, 22 bp, Artificial Sequence
  chemically synthesized
tcgtgagggtgggagcaccata

SEQ ID NO: 958669 - DNA, 22 bp, Artificial Sequence
  chemically synthesized
catatatgtgtttatggtgctc

SEQ ID NO: 958670 - DNA, 22 bp, Artificial Sequence
  chemically synthesized
gtgagggtgggagcaccataaa

SEQ ID NO: 958671 - DNA, 22 bp, Artificial Sequence
  chemically synthesized
ttcatatatgtgtttatggtgc

SEQ ID NO: 958672 - DNA, 22 bp, Artificial Sequence
  chemically synthesized
tctcttcatatatgtgtttatg

SEQ ID NO: 958673 - DNA, 22 bp, Artificial Sequence
  chemically synthesized
ttatctcttcatatatgtgttt

SEQ ID NO: 958674 - DNA, 22 bp, Artificial Sequence
  chemically synthesized
attatctcttcatatatgtgtt

SEQ ID NO: 958675 - DNA, 22 bp, Artificial Sequence
  chemically synthesized
tattatctcttcatatatgtgt

SEQ ID NO: 958676 - DNA, 22 bp, Artificial Sequence
  chemically synthesized
ttattatctcttcatatatgtg

SEQ ID NO: 958677 - DNA, 22 bp, Artificial Sequence
  chemically synthesized
gacttttattatctcttcatat

SEQ ID NO: 958678 - DNA, 22 bp, Artificial Sequence
  chemically synthesized
ggacttttattatctcttcata

SEQ ID NO: 958679 - DNA, 22 bp, Artificial Sequence
  chemically synthesized
ccttggacttttattatctctt

SEQ ID NO: 958680 - DNA, 22 bp, Artificial Sequence
  chemically synthesized
ttgccttggacttttattatct

SEQ ID NO: 958681 - DNA, 22 bp, Artificial Sequence
  chemically synthesized
tattgttgccttggacttttat

SEQ ID NO: 958682 - DNA, 22 bp, Artificial Sequence
  chemically synthesized
atattgttgccttggactttta

SEQ ID NO: 958683 - DNA, 22 bp, Artificial Sequence
  chemically synthesized
catcttatattgttgccttgga

SEQ ID NO: 958684 - DNA, 22 bp, Artificial Sequence
  chemically synthesized
tgctacatcttatattgttgcc

SEQ ID NO: 958685 - DNA, 22 bp, Artificial Sequence
  chemically synthesized
atgctacatcttatattgttgc

SEQ ID NO: 958686 - DNA, 22 bp, Artificial Sequence
  chemically synthesized
cgaggtcacttatgctacatct

SEQ ID NO: 958687 - DNA, 22 bp, Artificial Sequence
  chemically synthesized
attacgaggtcacttatgctac

SEQ ID NO: 958688 - DNA, 22 bp, Artificial Sequence
  chemically synthesized
agttcattacgaggtcacttat

SEQ ID NO: 958689 - DNA, 22 bp, Artificial Sequence
  chemically synthesized
cagttcattacgaggtcactta

SEQ ID NO: 958690 - DNA, 22 bp, Artificial Sequence
  chemically synthesized
tttcagttcattacgaggtcac

SEQ ID NO: 958691 - DNA, 22 bp, Artificial Sequence
  chemically synthesized
atatctatttcagttcattacg

SEQ ID NO: 958692 - DNA, 22 bp, Artificial Sequence
  chemically synthesized
aatatctatttcagttcattac

SEQ ID NO: 958693 - DNA, 22 bp, Artificial Sequence
  chemically synthesized
atatcaacttaatatctatttc

SEQ ID NO: 958694 - DNA, 22 bp, Artificial Sequence
  chemically synthesized
aatatcaacttaatatctattt

SEQ ID NO: 958695 - DNA, 22 bp, Artificial Sequence
  chemically synthesized
gtaatgaactgaaatagatatt

SEQ ID NO: 958696 - DNA, 22 bp, Artificial Sequence
  chemically synthesized
aaatagatattaagttgatatt

SEQ ID NO: 958697 - DNA, 22 bp, Artificial Sequence
  chemically synthesized
atacacaacatttaatatcaac

SEQ ID NO: 958698 - DNA, 22 bp, Artificial Sequence
  chemically synthesized
ccgttgatacacaacatttaat

SEQ ID NO: 958699 - DNA, 22 bp, Artificial Sequence
  chemically synthesized
agttgatattaaatgttgtgta

SEQ ID NO: 958700 - DNA, 22 bp, Artificial Sequence
  chemically synthesized
acactgccgttgatacacaaca

SEQ ID NO: 958701 - DNA, 22 bp, Artificial Sequence
  chemically synthesized
atattaaatgttgtgtatcaac

SEQ ID NO: 958702 - DNA, 22 bp, Artificial Sequence
  chemically synthesized
aatgttgtgtatcaacggcagt

SEQ ID NO: 958703 - DNA, 22 bp, Artificial Sequence
  chemically synthesized
acaatgatctcacactgccgtt

SEQ ID NO: 958704 - DNA, 22 bp, Artificial Sequence
  chemically synthesized
gttcacaatgatctcacactgc

SEQ ID NO: 958705 - DNA, 22 bp, Artificial Sequence
  chemically synthesized
tgtatcaacggcagtgtgagat

SEQ ID NO: 958706 - DNA, 22 bp, Artificial Sequence
  chemically synthesized
tagttcacaatgatctcacact

SEQ ID NO: 958707 - DNA, 22 bp, Artificial Sequence
  chemically synthesized
ttctagttcacaatgatctcac

SEQ ID NO: 958708 - DNA, 22 bp, Artificial Sequence
  chemically synthesized
cactattctagttcacaatgat

SEQ ID NO: 958709 - DNA, 22 bp, Artificial Sequence
  chemically synthesized
gtccaaaagatatgctacacta

SEQ ID NO: 958710 - DNA, 22 bp, Artificial Sequence
  chemically synthesized
agtccaaaagatatgctacact

SEQ ID NO: 958711 - DNA, 22 bp, Artificial Sequence
  chemically synthesized
tgaactagaatagtgtagcata

SEQ ID NO: 958712 - DNA, 22 bp, Artificial Sequence
  chemically synthesized
ccttagtccaaaagatatgcta

SEQ ID NO: 958713 - DNA, 22 bp, Artificial Sequence
  chemically synthesized
gaatagtgtagcatatcttttg

SEQ ID NO: 958714 - DNA, 22 bp, Artificial Sequence
  chemically synthesized
gaataatctaccttagtccaaa

SEQ ID NO: 958715 - DNA, 22 bp, Artificial Sequence
  chemically synthesized
aagcctggaataatctacctta

SEQ ID NO: 958716 - DNA, 22 bp, Artificial Sequence
  chemically synthesized
aaagcctggaataatctacctt

SEQ ID NO: 958717 - DNA, 22 bp, Artificial Sequence
  chemically synthesized
ttggactaaggtagattattcc

SEQ ID NO: 958718 - DNA, 22 bp, Artificial Sequence
  chemically synthesized
tggactaaggtagattattcca

SEQ ID NO: 958719 - DNA, 22 bp, Artificial Sequence
  chemically synthesized
ggactaaggtagattattccag

SEQ ID NO: 958720 - DNA, 22 bp, Artificial Sequence
  chemically synthesized
ggaatttaaagcctggaataat

SEQ ID NO: 958721 - DNA, 22 bp, Artificial Sequence
  chemically synthesized
gactaaggtagattattccagg

SEQ ID NO: 958722 - DNA, 22 bp, Artificial Sequence
  chemically synthesized
cggaatttaaagcctggaataa

SEQ ID NO: 958723 - DNA, 22 bp, Artificial Sequence
  chemically synthesized
aggtagattattccaggcttta

SEQ ID NO: 958724 - DNA, 22 bp, Artificial Sequence
  chemically synthesized
aatatttcggaatttaaagcct

SEQ ID NO: 958725 - DNA, 22 bp, Artificial Sequence
  chemically synthesized
taaatatttcggaatttaaagc

SEQ ID NO: 958726 - DNA, 22 bp, Artificial Sequence
  chemically synthesized
tctaaatatttcggaatttaaa

SEQ ID NO: 958727 - DNA, 22 bp, Artificial Sequence
  chemically synthesized
ctctctaaatatttcggaattt

SEQ ID NO: 958728 - DNA, 22 bp, Artificial Sequence
  chemically synthesized
ttccaggctttaaattccgaaa

SEQ ID NO: 958729 - DNA, 22 bp, Artificial Sequence
  chemically synthesized
actctctaaatatttcggaatt

SEQ ID NO: 958730 - DNA, 22 bp, Artificial Sequence
  chemically synthesized
ttactctctaaatatttcggaa

SEQ ID NO: 958731 - DNA, 22 bp, Artificial Sequence
  chemically synthesized
caggctttaaattccgaaatat

SEQ ID NO: 958732 - DNA, 22 bp, Artificial Sequence
  chemically synthesized
cttactctctaaatatttcgga

SEQ ID NO: 958733 - DNA, 22 bp, Artificial Sequence
  chemically synthesized
taaattccgaaatatttagaga

SEQ ID NO: 958734 - DNA, 22 bp, Artificial Sequence
  chemically synthesized
tgtccttcttactctctaaata

SEQ ID NO: 958735 - DNA, 22 bp, Artificial Sequence
  chemically synthesized
aaattccgaaatatttagagag

SEQ ID NO: 958736 - DNA, 22 bp, Artificial Sequence
  chemically synthesized
aattccgaaatatttagagagt

SEQ ID NO: 958737 - DNA, 22 bp, Artificial Sequence
  chemically synthesized
tatgtccttcttactctctaaa

SEQ ID NO: 958738 - DNA, 22 bp, Artificial Sequence
  chemically synthesized
tctatgtccttcttactctcta

SEQ ID NO: 958739 - DNA, 22 bp, Artificial Sequence
  chemically synthesized
cgaaatatttagagagtaagaa

SEQ ID NO: 958740 - DNA, 22 bp, Artificial Sequence
  chemically synthesized
aatggtctctctatgtccttct

SEQ ID NO: 958741 - DNA, 22 bp, Artificial Sequence
  chemically synthesized
agagagtaagaaggacatagag

SEQ ID NO: 958742 - DNA, 22 bp, Artificial Sequence
  chemically synthesized
tctgaatggtctctctatgtcc

SEQ ID NO: 958743 - DNA, 22 bp, Artificial Sequence
  chemically synthesized
gagagtaagaaggacatagaga

SEQ ID NO: 958744 - DNA, 22 bp, Artificial Sequence
  chemically synthesized
ttgtctgaatggtctctctatg

SEQ ID NO: 958745 - DNA, 22 bp, Artificial Sequence
  chemically synthesized
caactgttgtctgaatggtctc

SEQ ID NO: 958746 - DNA, 22 bp, Artificial Sequence
  chemically synthesized
cgttgcaactgttgtctgaatg

SEQ ID NO: 958747 - DNA, 22 bp, Artificial Sequence
  chemically synthesized
ccgttgcaactgttgtctgaat

SEQ ID NO: 958748 - DNA, 22 bp, Artificial Sequence
  chemically synthesized
cttccgttgcaactgttgtctg

SEQ ID NO: 958749 - DNA, 22 bp, Artificial Sequence
  chemically synthesized
aagtctacttccgttgcaactg

SEQ ID NO: 958750 - DNA, 22 bp, Artificial Sequence
  chemically synthesized
caagtctacttccgttgcaact

SEQ ID NO: 958751 - DNA, 22 bp, Artificial Sequence
  chemically synthesized
agacaacagttgcaacggaagt

SEQ ID NO: 958752 - DNA, 22 bp, Artificial Sequence
  chemically synthesized
gccttcaagtctacttccgttg

SEQ ID NO: 958753 - DNA, 22 bp, Artificial Sequence
  chemically synthesized
tggccttcaagtctacttccgt

SEQ ID NO: 958754 - DNA, 22 bp, Artificial Sequence
  chemically synthesized
ctggccttcaagtctacttccg

SEQ ID NO: 958755 - DNA, 22 bp, Artificial Sequence
  chemically synthesized
tctggccttcaagtctacttcc

SEQ ID NO: 958756 - DNA, 22 bp, Artificial Sequence
  chemically synthesized
tttctggccttcaagtctactt

SEQ ID NO: 958757 - DNA, 22 bp, Artificial Sequence
  chemically synthesized
agctctttctggccttcaagtc

SEQ ID NO: 958758 - DNA, 22 bp, Artificial Sequence
  chemically synthesized
caacggaagtagacttgaaggc

SEQ ID NO: 958759 - DNA, 22 bp, Artificial Sequence
  chemically synthesized
tgcatgctgagctctttctggc

SEQ ID NO: 958760 - DNA, 22 bp, Artificial Sequence
  chemically synthesized
tccctgtgcatgctgagctctt

SEQ ID NO: 958761 - DNA, 22 bp, Artificial Sequence
  chemically synthesized
atccctgtgcatgctgagctct

SEQ ID NO: 958762 - DNA, 22 bp, Artificial Sequence
  chemically synthesized
gaaggccagaaagagctcagca

SEQ ID NO: 958763 - DNA, 22 bp, Artificial Sequence
  chemically synthesized
tatccctgtgcatgctgagctc

SEQ ID NO: 958764 - DNA, 22 bp, Artificial Sequence
  chemically synthesized
aaggccagaaagagctcagcat

SEQ ID NO: 958765 - DNA, 22 bp, Artificial Sequence
  chemically synthesized
ttttatccctgtgcatgctgag

SEQ ID NO: 958766 - DNA, 22 bp, Artificial Sequence
  chemically synthesized
ctgttttatccctgtgcatgct

SEQ ID NO: 958767 - DNA, 22 bp, Artificial Sequence
  chemically synthesized
cctgttttatccctgtgcatgc

SEQ ID NO: 958768 - DNA, 22 bp, Artificial Sequence
  chemically synthesized
ttcctgttttatccctgtgcat

SEQ ID NO: 958769 - DNA, 22 bp, Artificial Sequence
  chemically synthesized
ggctcttcctgttttatccctg

SEQ ID NO: 958770 - DNA, 22 bp, Artificial Sequence
  chemically synthesized
agcatgcacagggataaaacag

SEQ ID NO: 958771 - DNA, 22 bp, Artificial Sequence
  chemically synthesized
gcactgggctcttcctgtttta

SEQ ID NO: 958772 - DNA, 22 bp, Artificial Sequence
  chemically synthesized
agcactgggctcttcctgtttt

SEQ ID NO: 958773 - DNA, 22 bp, Artificial Sequence
  chemically synthesized
agtgaatccttagcactgggct

SEQ ID NO: 958774 - DNA, 22 bp, Artificial Sequence
  chemically synthesized
ccctgagtgaatccttagcact

SEQ ID NO: 958775 - DNA, 22 bp, Artificial Sequence
  chemically synthesized
cccctgagtgaatccttagcac

SEQ ID NO: 958776 - DNA, 22 bp, Artificial Sequence
  chemically synthesized
tcacccacccttcccctgagtg

SEQ ID NO: 958777 - DNA, 22 bp, Artificial Sequence
  chemically synthesized
aggattcactcaggggaagggt

SEQ ID NO: 958778 - DNA, 22 bp, Artificial Sequence
  chemically synthesized
actcaggggaagggtgggtgat

SEQ ID NO: 958779 - DNA, 22 bp, Artificial Sequence
  chemically synthesized
agcatccagtattatcacccac

SEQ ID NO: 958780 - DNA, 22 bp, Artificial Sequence
  chemically synthesized
aagcatccagtattatcaccca

SEQ ID NO: 958781 - DNA, 22 bp, Artificial Sequence
  chemically synthesized
aggggaagggtgggtgataata

SEQ ID NO: 958782 - DNA, 22 bp, Artificial Sequence
  chemically synthesized
taccaacttaagcatccagtat

SEQ ID NO: 958783 - DNA, 22 bp, Artificial Sequence
  chemically synthesized
ataccaacttaagcatccagta

SEQ ID NO: 958784 - DNA, 22 bp, Artificial Sequence
  chemically synthesized
tcttataccaacttaagcatcc

SEQ ID NO: 958785 - DNA, 22 bp, Artificial Sequence
  chemically synthesized
ctatcttataccaacttaagca

SEQ ID NO: 958786 - DNA, 22 bp, Artificial Sequence
  chemically synthesized
actatcttataccaacttaagc

SEQ ID NO: 958787 - DNA, 22 bp, Artificial Sequence
  chemically synthesized
gatgcttaagttggtataagat

SEQ ID NO: 958788 - DNA, 22 bp, Artificial Sequence
  chemically synthesized
aggtatcttactatcttatacc

SEQ ID NO: 958789 - DNA, 22 bp, Artificial Sequence
  chemically synthesized
caggtatcttactatcttatac

SEQ ID NO: 958790 - DNA, 22 bp, Artificial Sequence
  chemically synthesized
aagttggtataagatagtaaga

SEQ ID NO: 958791 - DNA, 22 bp, Artificial Sequence
  chemically synthesized
atatttcaggtatcttactatc

SEQ ID NO: 958792 - DNA, 22 bp, Artificial Sequence
  chemically synthesized
agttggtataagatagtaagat

SEQ ID NO: 958793 - DNA, 22 bp, Artificial Sequence
  chemically synthesized
gtataagatagtaagatacctg

SEQ ID NO: 958794 - DNA, 22 bp, Artificial Sequence
  chemically synthesized
aaacatcagattcatatttcag

SEQ ID NO: 958795 - DNA, 22 bp, Artificial Sequence
  chemically synthesized
aaaaactaaaacatcagattca

SEQ ID NO: 958796 - DNA, 22 bp, Artificial Sequence
  chemically synthesized
aaaaaactaaaacatcagattc

SEQ ID NO: 958797 - DNA, 22 bp, Artificial Sequence
  chemically synthesized
taaaaaactaaaacatcagatt

SEQ ID NO: 958798 - DNA, 22 bp, Artificial Sequence
  chemically synthesized
tttaaaaaactaaaacatcaga

SEQ ID NO: 958799 - DNA, 22 bp, Artificial Sequence
  chemically synthesized
aaatatgaatctgatgttttag

SEQ ID NO: 958800 - DNA, 22 bp, Artificial Sequence
  chemically synthesized
taaaattctttaaaaaactaaa

SEQ ID NO: 958801 - DNA, 22 bp, Artificial Sequence
  chemically synthesized
gtaaaattctttaaaaaactaa

SEQ ID NO: 958802 - DNA, 22 bp, Artificial Sequence
  chemically synthesized
tgtaaaattctttaaaaaacta

SEQ ID NO: 958803 - DNA, 22 bp, Artificial Sequence
  chemically synthesized
ttttgtaaaattctttaaaaaa

SEQ ID NO: 958804 - DNA, 22 bp, Artificial Sequence
  chemically synthesized
atgttttagttttttaaagaat

SEQ ID NO: 958805 - DNA, 22 bp, Artificial Sequence
  chemically synthesized
aaaatctgttttgtaaaattct

SEQ ID NO: 958806 - DNA, 22 bp, Artificial Sequence
  chemically synthesized
tagttttttaaagaattttaca

SEQ ID NO: 958807 - DNA, 22 bp, Artificial Sequence
  chemically synthesized
aaaaatctgttttgtaaaattc

SEQ ID NO: 958808 - DNA, 22 bp, Artificial Sequence
  chemically synthesized
agttttttaaagaattttacaa

SEQ ID NO: 958809 - DNA, 22 bp, Artificial Sequence
  chemically synthesized
gttttttaaagaattttacaaa

SEQ ID NO: 958810 - DNA, 22 bp, Artificial Sequence
  chemically synthesized
tttaaaaatctgttttgtaaaa

SEQ ID NO: 958811 - DNA, 22 bp, Artificial Sequence
  chemically synthesized
tttaaagaattttacaaaacag

SEQ ID NO: 958812 - DNA, 22 bp, Artificial Sequence
  chemically synthesized
ttaaagaattttacaaaacaga

SEQ ID NO: 958813 - DNA, 22 bp, Artificial Sequence
  chemically synthesized
taaagaattttacaaaacagat

SEQ ID NO: 958814 - DNA, 22 bp, Artificial Sequence
  chemically synthesized
aaagaattttacaaaacagatt

SEQ ID NO: 958815 - DNA, 22 bp, Artificial Sequence
  chemically synthesized
cagctatttaaaaatctgtttt

SEQ ID NO: 958816 - DNA, 22 bp, Artificial Sequence
  chemically synthesized
aagaattttacaaaacagattt

SEQ ID NO: 958817 - DNA, 22 bp, Artificial Sequence
  chemically synthesized
tacagctatttaaaaatctgtt

SEQ ID NO: 958818 - DNA, 22 bp, Artificial Sequence
  chemically synthesized
aatctctacagctatttaaaaa

SEQ ID NO: 958819 - DNA, 22 bp, Artificial Sequence
  chemically synthesized
tacaaaacagatttttaaatag

SEQ ID NO: 958820 - DNA, 22 bp, Artificial Sequence
  chemically synthesized
gaatctctacagctatttaaaa

SEQ ID NO: 958821 - DNA, 22 bp, Artificial Sequence
  chemically synthesized
acaaaacagatttttaaatagc

SEQ ID NO: 958822 - DNA, 22 bp, Artificial Sequence
  chemically synthesized
tgaatctctacagctatttaaa

SEQ ID NO: 958823 - DNA, 22 bp, Artificial Sequence
  chemically synthesized
caaaacagatttttaaatagct

SEQ ID NO: 958824 - DNA, 22 bp, Artificial Sequence
  chemically synthesized
ttgaatctctacagctatttaa

SEQ ID NO: 958825 - DNA, 22 bp, Artificial Sequence
  chemically synthesized
ttttgaatctctacagctattt

SEQ ID NO: 958826 - DNA, 22 bp, Artificial Sequence
  chemically synthesized
tcttttgaatctctacagctat

SEQ ID NO: 958827 - DNA, 22 bp, Artificial Sequence
  chemically synthesized
ctcttttgaatctctacagcta

SEQ ID NO: 958828 - DNA, 22 bp, Artificial Sequence
  chemically synthesized
gtttctcttttgaatctctaca

SEQ ID NO: 958829 - DNA, 22 bp, Artificial Sequence
  chemically synthesized
cgtttctcttttgaatctctac

SEQ ID NO: 958830 - DNA, 22 bp, Artificial Sequence
  chemically synthesized
ttaaatagctgtagagattcaa

SEQ ID NO: 958831 - DNA, 22 bp, Artificial Sequence
  chemically synthesized
taaatagctgtagagattcaaa

SEQ ID NO: 958832 - DNA, 22 bp, Artificial Sequence
  chemically synthesized
cttcgtttctcttttgaatctc

SEQ ID NO: 958833 - DNA, 22 bp, Artificial Sequence
  chemically synthesized
aaatagctgtagagattcaaaa

SEQ ID NO: 958834 - DNA, 22 bp, Artificial Sequence
  chemically synthesized
aatagctgtagagattcaaaag

SEQ ID NO: 958835 - DNA, 22 bp, Artificial Sequence
  chemically synthesized
tagagattcaaaagagaaacga

SEQ ID NO: 958836 - DNA, 22 bp, Artificial Sequence
  chemically synthesized
ggtacaactgcttcgtttctct

SEQ ID NO: 958837 - DNA, 22 bp, Artificial Sequence
  chemically synthesized
gggtacaactgcttcgtttctc

SEQ ID NO: 958838 - DNA, 22 bp, Artificial Sequence
  chemically synthesized
tgggtacaactgcttcgtttct

SEQ ID NO: 958839 - DNA, 22 bp, Artificial Sequence
  chemically synthesized
ttgggtacaactgcttcgtttc

SEQ ID NO: 958840 - DNA, 22 bp, Artificial Sequence
  chemically synthesized
cttttgggtacaactgcttcgt

SEQ ID NO: 958841 - DNA, 22 bp, Artificial Sequence
  chemically synthesized
aaaagagaaacgaagcagttgt

SEQ ID NO: 958842 - DNA, 22 bp, Artificial Sequence
  chemically synthesized
tcctacttttgggtacaactgc

SEQ ID NO: 958843 - DNA, 22 bp, Artificial Sequence
  chemically synthesized
ttatcctacttttgggtacaac

SEQ ID NO: 958844 - DNA, 22 bp, Artificial Sequence
  chemically synthesized
attatcctacttttgggtacaa

SEQ ID NO: 958845 - DNA, 22 bp, Artificial Sequence
  chemically synthesized
tattatcctacttttgggtaca

SEQ ID NO: 958846 - DNA, 22 bp, Artificial Sequence
  chemically synthesized
tacccaaaagtaggataataaa

SEQ ID NO: 958847 - DNA, 22 bp, Artificial Sequence
  chemically synthesized
acacaatcaagagatctttatt

SEQ ID NO: 958848 - DNA, 22 bp, Artificial Sequence
  chemically synthesized
aacacaatcaagagatctttat

SEQ ID NO: 958849 - DNA, 22 bp, Artificial Sequence
  chemically synthesized
taatttaacacaatcaagagat

SEQ ID NO: 958850 - DNA, 22 bp, Artificial Sequence
  chemically synthesized
ataatttaacacaatcaagaga

SEQ ID NO: 958851 - DNA, 22 bp, Artificial Sequence
  chemically synthesized
ttgattgtgttaaattataaat

SEQ ID NO: 958852 - DNA, 22 bp, Artificial Sequence
  chemically synthesized
gattgtgttaaattataaatgc

SEQ ID NO: 958853 - DNA, 22 bp, Artificial Sequence
  chemically synthesized
tggatggagtatgcatttataa

SEQ ID NO: 958854 - DNA, 22 bp, Artificial Sequence
  chemically synthesized
attgtgttaaattataaatgca

SEQ ID NO: 958855 - DNA, 22 bp, Artificial Sequence
  chemically synthesized
tgttaaattataaatgcatact

SEQ ID NO: 958856 - DNA, 22 bp, Artificial Sequence
  chemically synthesized
aattataaatgcatactccatc

SEQ ID NO: 958857 - DNA, 22 bp, Artificial Sequence
  chemically synthesized
gcatcaccctatggatggagta

SEQ ID NO: 958858 - DNA, 22 bp, Artificial Sequence
  chemically synthesized
ggcatcaccctatggatggagt

SEQ ID NO: 958859 - DNA, 22 bp, Artificial Sequence
  chemically synthesized
tggcatcaccctatggatggag

SEQ ID NO: 958860 - DNA, 22 bp, Artificial Sequence
  chemically synthesized
taaatgcatactccatccatag

SEQ ID NO: 958861 - DNA, 22 bp, Artificial Sequence
  chemically synthesized
tttggcatcaccctatggatgg

SEQ ID NO: 958862 - DNA, 22 bp, Artificial Sequence
  chemically synthesized
ctttggcatcaccctatggatg

SEQ ID NO: 958863 - DNA, 22 bp, Artificial Sequence
  chemically synthesized
cttctttggcatcaccctatgg

SEQ ID NO: 958864 - DNA, 22 bp, Artificial Sequence
  chemically synthesized
ctccttctttggcatcacccta

SEQ ID NO: 958865 - DNA, 22 bp, Artificial Sequence
  chemically synthesized
cctccttctttggcatcaccct

SEQ ID NO: 958866 - DNA, 22 bp, Artificial Sequence
  chemically synthesized
tttcctccttctttggcatcac

SEQ ID NO: 958867 - DNA, 22 bp, Artificial Sequence
  chemically synthesized
gtttcctccttctttggcatca

SEQ ID NO: 958868 - DNA, 22 bp, Artificial Sequence
  chemically synthesized
catccatagggtgatgccaaag

SEQ ID NO: 958869 - DNA, 22 bp, Artificial Sequence
  chemically synthesized
cttgtttcctccttctttggca

SEQ ID NO: 958870 - DNA, 22 bp, Artificial Sequence
  chemically synthesized
aagacaaataacaaactacttg

SEQ ID NO: 958871 - DNA, 22 bp, Artificial Sequence
  chemically synthesized
gttatttgtcttcaatttatgc

SEQ ID NO: 958872 - DNA, 22 bp, Artificial Sequence
  chemically synthesized
ttatttgtcttcaatttatgct

SEQ ID NO: 958873 - DNA, 22 bp, Artificial Sequence
  chemically synthesized
tttgtcttcaatttatgctatg

SEQ ID NO: 958874 - DNA, 22 bp, Artificial Sequence
  chemically synthesized
aaacagagaagaagcatagcat

SEQ ID NO: 958875 - DNA, 22 bp, Artificial Sequence
  chemically synthesized
gtcttcaatttatgctatgctt

SEQ ID NO: 958876 - DNA, 22 bp, Artificial Sequence
  chemically synthesized
caaacagagaagaagcatagca

SEQ ID NO: 958877 - DNA, 22 bp, Artificial Sequence
  chemically synthesized
tcttcaatttatgctatgcttc

SEQ ID NO: 958878 - DNA, 22 bp, Artificial Sequence
  chemically synthesized
ttcaaacagagaagaagcatag

SEQ ID NO: 958879 - DNA, 22 bp, Artificial Sequence
  chemically synthesized
cttcaaacagagaagaagcata

SEQ ID NO: 958880 - DNA, 22 bp, Artificial Sequence
  chemically synthesized
caatttatgctatgcttcttct

SEQ ID NO: 958881 - DNA, 22 bp, Artificial Sequence
  chemically synthesized
aatttatgctatgcttcttctc

SEQ ID NO: 958882 - DNA, 22 bp, Artificial Sequence
  chemically synthesized
atgctatgcttcttctctgttt

SEQ ID NO: 958883 - DNA, 22 bp, Artificial Sequence
  chemically synthesized
tgctatgcttcttctctgtttg

SEQ ID NO: 958884 - DNA, 22 bp, Artificial Sequence
  chemically synthesized
tgcttcttctctgtttgaagaa

SEQ ID NO: 958885 - DNA, 22 bp, Artificial Sequence
  chemically synthesized
gagcagacaggtcaacttcttc

SEQ ID NO: 958886 - DNA, 22 bp, Artificial Sequence
  chemically synthesized
cttctctgtttgaagaagttga

SEQ ID NO: 958887 - DNA, 22 bp, Artificial Sequence
  chemically synthesized
cgagcagacaggtcaacttctt

SEQ ID NO: 958888 - DNA, 22 bp, Artificial Sequence
  chemically synthesized
ttctctgtttgaagaagttgac

SEQ ID NO: 958889 - DNA, 22 bp, Artificial Sequence
  chemically synthesized
tcgagcagacaggtcaacttct

SEQ ID NO: 958890 - DNA, 22 bp, Artificial Sequence
  chemically synthesized
ctctgtttgaagaagttgacct

SEQ ID NO: 958891 - DNA, 22 bp, Artificial Sequence
  chemically synthesized
tctgtttgaagaagttgacctg

SEQ ID NO: 958892 - DNA, 22 bp, Artificial Sequence
  chemically synthesized
tgtttgaagaagttgacctgtc

SEQ ID NO: 958893 - DNA, 22 bp, Artificial Sequence
  chemically synthesized
tttgaagaagttgacctgtctg

SEQ ID NO: 958894 - DNA, 22 bp, Artificial Sequence
  chemically synthesized
gaagaagttgacctgtctgctc

SEQ ID NO: 958895 - DNA, 22 bp, Artificial Sequence
  chemically synthesized
gatatggctttcgagcagacag

SEQ ID NO: 958896 - DNA, 22 bp, Artificial Sequence
  chemically synthesized
aagaagttgacctgtctgctcg

SEQ ID NO: 958897 - DNA, 22 bp, Artificial Sequence
  chemically synthesized
ctggatatggctttcgagcaga

SEQ ID NO: 958898 - DNA, 22 bp, Artificial Sequence
  chemically synthesized
acctgtctgctcgaaagccata

SEQ ID NO: 958899 - DNA, 22 bp, Artificial Sequence
  chemically synthesized
tctgctcgaaagccatatccag

SEQ ID NO: 958900 - DNA, 22 bp, Artificial Sequence
  chemically synthesized
ctcgaaagccatatccagcaga

SEQ ID NO: 958901 - DNA, 22 bp, Artificial Sequence
  chemically synthesized
gaaagccatatccagcagaccc

SEQ ID NO: 958902 - DNA, 22 bp, Artificial Sequence
  chemically synthesized
tgcaagtaatcggtgggtctgc

SEQ ID NO: 958903 - DNA, 22 bp, Artificial Sequence
  chemically synthesized
tcactgtgcaagtaatcggtgg

SEQ ID NO: 958904 - DNA, 22 bp, Artificial Sequence
  chemically synthesized
tgtcactgtgcaagtaatcggt

SEQ ID NO: 958905 - DNA, 22 bp, Artificial Sequence
  chemically synthesized
aattctgtcactgtgcaagtaa

SEQ ID NO: 958906 - DNA, 22 bp, Artificial Sequence
  chemically synthesized
aaattctgtcactgtgcaagta

SEQ ID NO: 958907 - DNA, 22 bp, Artificial Sequence
  chemically synthesized
acccttaaattctgtcactgtg

SEQ ID NO: 958908 - DNA, 22 bp, Artificial Sequence
  chemically synthesized
cttgcacagtgacagaatttaa

SEQ ID NO: 958909 - DNA, 22 bp, Artificial Sequence
  chemically synthesized
gcacagtgacagaatttaaggg

SEQ ID NO: 958910 - DNA, 22 bp, Artificial Sequence
  chemically synthesized
cacagtgacagaatttaagggt

SEQ ID NO: 958911 - DNA, 22 bp, Artificial Sequence
  chemically synthesized
atgaatataattgacccttaaa

SEQ ID NO: 958912 - DNA, 22 bp, Artificial Sequence
  chemically synthesized
gttcatgaatataattgaccct

SEQ ID NO: 958913 - DNA, 22 bp, Artificial Sequence
  chemically synthesized
aagggtcaattatattcatgaa

SEQ ID NO: 958914 - DNA, 22 bp, Artificial Sequence
  chemically synthesized
agggtcaattatattcatgaac

SEQ ID NO: 958915 - DNA, 22 bp, Artificial Sequence
  chemically synthesized
agtggaaataaattagttcatg

SEQ ID NO: 958916 - DNA, 22 bp, Artificial Sequence
  chemically synthesized
tattcatgaactaatttatttc

SEQ ID NO: 958917 - DNA, 22 bp, Artificial Sequence
  chemically synthesized
atgaactaatttatttccactg

SEQ ID NO: 958918 - DNA, 22 bp, Artificial Sequence
  chemically synthesized
gggtcatcagtaaactcagtgg

SEQ ID NO: 958919 - DNA, 22 bp, Artificial Sequence
  chemically synthesized
tagggtcatcagtaaactcagt

SEQ ID NO: 958920 - DNA, 22 bp, Artificial Sequence
  chemically synthesized
ctagggtcatcagtaaactcag

SEQ ID NO: 958921 - DNA, 22 bp, Artificial Sequence
  chemically synthesized
atttatttccactgagtttact

SEQ ID NO: 958922 - DNA, 22 bp, Artificial Sequence
  chemically synthesized
tctagggtcatcagtaaactca

SEQ ID NO: 958923 - DNA, 22 bp, Artificial Sequence
  chemically synthesized
atttccactgagtttactgatg

SEQ ID NO: 958924 - DNA, 22 bp, Artificial Sequence
  chemically synthesized
tttccactgagtttactgatga

SEQ ID NO: 958925 - DNA, 22 bp, Artificial Sequence
  chemically synthesized
aattttctagggtcatcagtaa

SEQ ID NO: 958926 - DNA, 22 bp, Artificial Sequence
  chemically synthesized
aaattttctagggtcatcagta

SEQ ID NO: 958927 - DNA, 22 bp, Artificial Sequence
  chemically synthesized
ccactgagtttactgatgaccc

SEQ ID NO: 958928 - DNA, 22 bp, Artificial Sequence
  chemically synthesized
cactgagtttactgatgaccct

SEQ ID NO: 958929 - DNA, 22 bp, Artificial Sequence
  chemically synthesized
agtttactgatgaccctagaaa

SEQ ID NO: 958930 - DNA, 22 bp, Artificial Sequence
  chemically synthesized
tgtcaccgcttaaattttctag

SEQ ID NO: 958931 - DNA, 22 bp, Artificial Sequence
  chemically synthesized
actgatgaccctagaaaattta

SEQ ID NO: 958932 - DNA, 22 bp, Artificial Sequence
  chemically synthesized
ctgatgaccctagaaaatttaa

SEQ ID NO: 958933 - DNA, 22 bp, Artificial Sequence
  chemically synthesized
atgaccctagaaaatttaagcg

SEQ ID NO: 958934 - DNA, 22 bp, Artificial Sequence
  chemically synthesized
cagtcctgtgtcaccgcttaaa

SEQ ID NO: 958935 - DNA, 22 bp, Artificial Sequence
  chemically synthesized
acagtcctgtgtcaccgcttaa

SEQ ID NO: 958936 - DNA, 22 bp, Artificial Sequence
  chemically synthesized
gaaaatttaagcggtgacacag

SEQ ID NO: 958937 - DNA, 22 bp, Artificial Sequence
  chemically synthesized
aagcggtgacacaggactgtaa

SEQ ID NO: 958938 - DNA, 22 bp, Artificial Sequence
  chemically synthesized
agcggtgacacaggactgtaaa

SEQ ID NO: 958939 - DNA, 22 bp, Artificial Sequence
  chemically synthesized
taatgcaacaaagaatttacag

SEQ ID NO: 958940 - DNA, 22 bp, Artificial Sequence
  chemically synthesized
ataatgcaacaaagaatttaca

SEQ ID NO: 958941 - DNA, 22 bp, Artificial Sequence
  chemically synthesized
tataatgcaacaaagaatttac

SEQ ID NO: 958942 - DNA, 22 bp, Artificial Sequence
  chemically synthesized
aaggagctttataatgcaacaa

SEQ ID NO: 958943 - DNA, 22 bp, Artificial Sequence
  chemically synthesized
gaaggagctttataatgcaaca

SEQ ID NO: 958944 - DNA, 22 bp, Artificial Sequence
  chemically synthesized
ttgaaggagctttataatgcaa

SEQ ID NO: 958945 - DNA, 22 bp, Artificial Sequence
  chemically synthesized
taaattctttgttgcattataa

SEQ ID NO: 958946 - DNA, 22 bp, Artificial Sequence
  chemically synthesized
cttgaaggagctttataatgca

SEQ ID NO: 958947 - DNA, 22 bp, Artificial Sequence
  chemically synthesized
atttcttgaaggagctttataa

SEQ ID NO: 958948 - DNA, 22 bp, Artificial Sequence
  chemically synthesized
aatttcttgaaggagctttata

SEQ ID NO: 958949 - DNA, 22 bp, Artificial Sequence
  chemically synthesized
taatttcttgaaggagctttat

SEQ ID NO: 958950 - DNA, 22 bp, Artificial Sequence
  chemically synthesized
tttgttgcattataaagctcct

SEQ ID NO: 958951 - DNA, 22 bp, Artificial Sequence
  chemically synthesized
tgttgcattataaagctccttc

SEQ ID NO: 958952 - DNA, 22 bp, Artificial Sequence
  chemically synthesized
gttgcattataaagctccttca

SEQ ID NO: 958953 - DNA, 22 bp, Artificial Sequence
  chemically synthesized
ttgcattataaagctccttcaa

SEQ ID NO: 958954 - DNA, 22 bp, Artificial Sequence
  chemically synthesized
agcattttaatttcttgaagga

SEQ ID NO: 958955 - DNA, 22 bp, Artificial Sequence
  chemically synthesized
cattataaagctccttcaagaa

SEQ ID NO: 958956 - DNA, 22 bp, Artificial Sequence
  chemically synthesized
aagcattttaatttcttgaagg

SEQ ID NO: 958957 - DNA, 22 bp, Artificial Sequence
  chemically synthesized
acttaagcattttaatttcttg

SEQ ID NO: 958958 - DNA, 22 bp, Artificial Sequence
  chemically synthesized
taaagctccttcaagaaattaa

SEQ ID NO: 958959 - DNA, 22 bp, Artificial Sequence
  chemically synthesized
cacttaagcattttaatttctt

SEQ ID NO: 958960 - DNA, 22 bp, Artificial Sequence
  chemically synthesized
tcacttaagcattttaatttct

SEQ ID NO: 958961 - DNA, 22 bp, Artificial Sequence
  chemically synthesized
ttttcacttaagcattttaatt

SEQ ID NO: 958962 - DNA, 22 bp, Artificial Sequence
  chemically synthesized
cttcaagaaattaaaatgctta

SEQ ID NO: 958963 - DNA, 22 bp, Artificial Sequence
  chemically synthesized
caagaaattaaaatgcttaagt

SEQ ID NO: 958964 - DNA, 22 bp, Artificial Sequence
  chemically synthesized
aagaaattaaaatgcttaagtg

SEQ ID NO: 958965 - DNA, 22 bp, Artificial Sequence
  chemically synthesized
gatagatcattattttcactta

SEQ ID NO: 958966 - DNA, 22 bp, Artificial Sequence
  chemically synthesized
aaatgcttaagtgaaaataatg

SEQ ID NO: 958967 - DNA, 22 bp, Artificial Sequence
  chemically synthesized
aaagttggatagatcattattt

SEQ ID NO: 958968 - DNA, 22 bp, Artificial Sequence
  chemically synthesized
aagtgaaaataatgatctatcc

SEQ ID NO: 958969 - DNA, 22 bp, Artificial Sequence
  chemically synthesized
agtgaaaataatgatctatcca

SEQ ID NO: 958970 - DNA, 22 bp, Artificial Sequence
  chemically synthesized
aaaagtgtagggaaaccactca

SEQ ID NO: 958971 - DNA, 22 bp, Artificial Sequence
  chemically synthesized
tccaactttgagtggtttccct

SEQ ID NO: 958972 - DNA, 22 bp, Artificial Sequence
  chemically synthesized
tgagtggtttccctacactttt

SEQ ID NO: 958973 - DNA, 22 bp, Artificial Sequence
  chemically synthesized
gagtggtttccctacacttttt

SEQ ID NO: 958974 - DNA, 22 bp, Artificial Sequence
  chemically synthesized
agtggtttccctacacttttta

SEQ ID NO: 958975 - DNA, 22 bp, Artificial Sequence
  chemically synthesized
ccagaaagtgatcactaaaaag

SEQ ID NO: 958976 - DNA, 22 bp, Artificial Sequence
  chemically synthesized
accagaaagtgatcactaaaaa

SEQ ID NO: 958977 - DNA, 22 bp, Artificial Sequence
  chemically synthesized
ttaccagaaagtgatcactaaa

SEQ ID NO: 958978 - DNA, 22 bp, Artificial Sequence
  chemically synthesized
ccctacactttttagtgatcac

SEQ ID NO: 958979 - DNA, 22 bp, Artificial Sequence
  chemically synthesized
cctacactttttagtgatcact

SEQ ID NO: 958980 - DNA, 22 bp, Artificial Sequence
  chemically synthesized
ggtctcttaccagaaagtgatc

SEQ ID NO: 958981 - DNA, 22 bp, Artificial Sequence
  chemically synthesized
cactttttagtgatcactttct

SEQ ID NO: 958982 - DNA, 22 bp, Artificial Sequence
  chemically synthesized
taggtctcttaccagaaagtga

SEQ ID NO: 958983 - DNA, 22 bp, Artificial Sequence
  chemically synthesized
ctaggtctcttaccagaaagtg

SEQ ID NO: 958984 - DNA, 22 bp, Artificial Sequence
  chemically synthesized
tctaggtctcttaccagaaagt

SEQ ID NO: 958985 - DNA, 22 bp, Artificial Sequence
  chemically synthesized
ttctaggtctcttaccagaaag

SEQ ID NO: 958986 - DNA, 22 bp, Artificial Sequence
  chemically synthesized
tttagtgatcactttctggtaa

SEQ ID NO: 958987 - DNA, 22 bp, Artificial Sequence
  chemically synthesized
tttctaggtctcttaccagaaa

SEQ ID NO: 958988 - DNA, 22 bp, Artificial Sequence
  chemically synthesized
ttagtgatcactttctggtaag

SEQ ID NO: 958989 - DNA, 22 bp, Artificial Sequence
  chemically synthesized
ttttctaggtctcttaccagaa

SEQ ID NO: 958990 - DNA, 22 bp, Artificial Sequence
  chemically synthesized
tagtgatcactttctggtaaga

SEQ ID NO: 958991 - DNA, 22 bp, Artificial Sequence
  chemically synthesized
agtgatcactttctggtaagag

SEQ ID NO: 958992 - DNA, 22 bp, Artificial Sequence
  chemically synthesized
gtgatcactttctggtaagaga

SEQ ID NO: 958993 - DNA, 22 bp, Artificial Sequence
  chemically synthesized
agcagtttttttctaggtctct

SEQ ID NO: 958994 - DNA, 22 bp, Artificial Sequence
  chemically synthesized
attcagcagtttttttctaggt

SEQ ID NO: 958995 - DNA, 22 bp, Artificial Sequence
  chemically synthesized
tctggtaagagacctagaaaaa

SEQ ID NO: 958996 - DNA, 22 bp, Artificial Sequence
  chemically synthesized
ctggtaagagacctagaaaaaa

SEQ ID NO: 958997 - DNA, 22 bp, Artificial Sequence
  chemically synthesized
tggtaagagacctagaaaaaaa

SEQ ID NO: 958998 - DNA, 22 bp, Artificial Sequence
  chemically synthesized
gtaagagacctagaaaaaaact

SEQ ID NO: 958999 - DNA, 22 bp, Artificial Sequence
  chemically synthesized
aggattcattcagcagtttttt

SEQ ID NO: 959000 - DNA, 22 bp, Artificial Sequence
  chemically synthesized
acaaattgaggattcattcagc

SEQ ID NO: 959001 - DNA, 22 bp, Artificial Sequence
  chemically synthesized
gaaaaaaactgctgaatgaatc

SEQ ID NO: 959002 - DNA, 22 bp, Artificial Sequence
  chemically synthesized
caaaaaattgacaaattgagga

SEQ ID NO: 959003 - DNA, 22 bp, Artificial Sequence
  chemically synthesized
ccaaaaaattgacaaattgagg

SEQ ID NO: 959004 - DNA, 22 bp, Artificial Sequence
  chemically synthesized
tccaaaaaattgacaaattgag

SEQ ID NO: 959005 - DNA, 22 bp, Artificial Sequence
  chemically synthesized
ctgaatgaatcctcaatttgtc

SEQ ID NO: 959006 - DNA, 22 bp, Artificial Sequence
  chemically synthesized
aatgaatcctcaatttgtcaat

SEQ ID NO: 959007 - DNA, 22 bp, Artificial Sequence
  chemically synthesized
gttttccaaaaaattgacaaat

SEQ ID NO: 959008 - DNA, 22 bp, Artificial Sequence
  chemically synthesized
aatttgtcaattttttggaaaa

SEQ ID NO: 959009 - DNA, 22 bp, Artificial Sequence
  chemically synthesized
tagaaggtattggttttccaaa

SEQ ID NO: 959010 - DNA, 22 bp, Artificial Sequence
  chemically synthesized
gtcaattttttggaaaaccaat

SEQ ID NO: 959011 - DNA, 22 bp, Artificial Sequence
  chemically synthesized
tcaattttttggaaaaccaata

SEQ ID NO: 959012 - DNA, 22 bp, Artificial Sequence
  chemically synthesized
aatagctgtagaaggtattggt

SEQ ID NO: 959013 - DNA, 22 bp, Artificial Sequence
  chemically synthesized
caatagctgtagaaggtattgg

SEQ ID NO: 959014 - DNA, 22 bp, Artificial Sequence
  chemically synthesized
tcaatagctgtagaaggtattg

SEQ ID NO: 959015 - DNA, 22 bp, Artificial Sequence
  chemically synthesized
tttggaaaaccaataccttcta

SEQ ID NO: 959016 - DNA, 22 bp, Artificial Sequence
  chemically synthesized
ttggaaaaccaataccttctac

SEQ ID NO: 959017 - DNA, 22 bp, Artificial Sequence
  chemically synthesized
tggaaaaccaataccttctaca

SEQ ID NO: 959018 - DNA, 22 bp, Artificial Sequence
  chemically synthesized
ggaaaaccaataccttctacag

SEQ ID NO: 959019 - DNA, 22 bp, Artificial Sequence
  chemically synthesized
aattttcaatagctgtagaagg

SEQ ID NO: 959020 - DNA, 22 bp, Artificial Sequence
  chemically synthesized
gaaaaccaataccttctacagc

SEQ ID NO: 959021 - DNA, 22 bp, Artificial Sequence
  chemically synthesized
tgaattttcaatagctgtagaa

SEQ ID NO: 959022 - DNA, 22 bp, Artificial Sequence
  chemically synthesized
ccctctgaattttcaatagctg

SEQ ID NO: 959023 - DNA, 22 bp, Artificial Sequence
  chemically synthesized
caaactgccctctgaattttca

SEQ ID NO: 959024 - DNA, 22 bp, Artificial Sequence
  chemically synthesized
gcaaactgccctctgaattttc

SEQ ID NO: 959025 - DNA, 22 bp, Artificial Sequence
  chemically synthesized
ctacagctattgaaaattcaga

SEQ ID NO: 959026 - DNA, 22 bp, Artificial Sequence
  chemically synthesized
tacagctattgaaaattcagag

SEQ ID NO: 959027 - DNA, 22 bp, Artificial Sequence
  chemically synthesized
ttgcaaactgccctctgaattt

SEQ ID NO: 959028 - DNA, 22 bp, Artificial Sequence
  chemically synthesized
cttgcaaactgccctctgaatt

SEQ ID NO: 959029 - DNA, 22 bp, Artificial Sequence
  chemically synthesized
cagctattgaaaattcagaggg

SEQ ID NO: 959030 - DNA, 22 bp, Artificial Sequence
  chemically synthesized
agtttcttgcaaactgccctct

SEQ ID NO: 959031 - DNA, 22 bp, Artificial Sequence
  chemically synthesized
ttgaaaattcagagggcagttt

SEQ ID NO: 959032 - DNA, 22 bp, Artificial Sequence
  chemically synthesized
aaaattcagagggcagtttgca

SEQ ID NO: 959033 - DNA, 22 bp, Artificial Sequence
  chemically synthesized
agagggcagtttgcaagaaact

SEQ ID NO: 959034 - DNA, 22 bp, Artificial Sequence
  chemically synthesized
caggaaggatgatatagattaa

SEQ ID NO: 959035 - DNA, 22 bp, Artificial Sequence
  chemically synthesized
gcaagaaacttaatctatatca

SEQ ID NO: 959036 - DNA, 22 bp, Artificial Sequence
  chemically synthesized
caagaaacttaatctatatcat

SEQ ID NO: 959037 - DNA, 22 bp, Artificial Sequence
  chemically synthesized
tggtaaggttgcaggaaggatg

SEQ ID NO: 959038 - DNA, 22 bp, Artificial Sequence
  chemically synthesized
aatctatatcatccttcctgca

SEQ ID NO: 959039 - DNA, 22 bp, Artificial Sequence
  chemically synthesized
atctatatcatccttcctgcaa

SEQ ID NO: 959040 - DNA, 22 bp, Artificial Sequence
  chemically synthesized
tatcatccttcctgcaacctta

SEQ ID NO: 959041 - DNA, 22 bp, Artificial Sequence
  chemically synthesized
cctgcaaccttaccacagccat

SEQ ID NO: 959042 - DNA, 22 bp, Artificial Sequence
  chemically synthesized
ctgcaaccttaccacagccatg

SEQ ID NO: 959043 - DNA, 22 bp, Artificial Sequence
  chemically synthesized
aatgaagataaaatcatggctg

SEQ ID NO: 959044 - DNA, 22 bp, Artificial Sequence
  chemically synthesized
caaccttaccacagccatgatt

SEQ ID NO: 959045 - DNA, 22 bp, Artificial Sequence
  chemically synthesized
aaatgaagataaaatcatggct

SEQ ID NO: 959046 - DNA, 22 bp, Artificial Sequence
  chemically synthesized
taaatgaagataaaatcatggc

SEQ ID NO: 959047 - DNA, 22 bp, Artificial Sequence
  chemically synthesized
accacagccatgattttatctt

SEQ ID NO: 959048 - DNA, 22 bp, Artificial Sequence
  chemically synthesized
gtgctttaaatgaagataaaat

SEQ ID NO: 959049 - DNA, 22 bp, Artificial Sequence
  chemically synthesized
ccacagccatgattttatcttc

SEQ ID NO: 959050 - DNA, 22 bp, Artificial Sequence
  chemically synthesized
aatctcgtgctttaaatgaaga

SEQ ID NO: 959051 - DNA, 22 bp, Artificial Sequence
  chemically synthesized
caatctcgtgctttaaatgaag

SEQ ID NO: 959052 - DNA, 22 bp, Artificial Sequence
  chemically synthesized
tcaatctcgtgctttaaatgaa

SEQ ID NO: 959053 - DNA, 22 bp, Artificial Sequence
  chemically synthesized
tatcttcatttaaagcacgaga

SEQ ID NO: 959054 - DNA, 22 bp, Artificial Sequence
  chemically synthesized
atcttcatttaaagcacgagat

SEQ ID NO: 959055 - DNA, 22 bp, Artificial Sequence
  chemically synthesized
tcttcatttaaagcacgagatt

SEQ ID NO: 959056 - DNA, 22 bp, Artificial Sequence
  chemically synthesized
acaatgcatctttcaatctcgt

SEQ ID NO: 959057 - DNA, 22 bp, Artificial Sequence
  chemically synthesized
catttaaagcacgagattgaaa

SEQ ID NO: 959058 - DNA, 22 bp, Artificial Sequence
  chemically synthesized
tcacaatgcatctttcaatctc

SEQ ID NO: 959059 - DNA, 22 bp, Artificial Sequence
  chemically synthesized
atttaaagcacgagattgaaag

SEQ ID NO: 959060 - DNA, 22 bp, Artificial Sequence
  chemically synthesized
tctcacaatgcatctttcaatc

SEQ ID NO: 959061 - DNA, 22 bp, Artificial Sequence
  chemically synthesized
ctctcacaatgcatctttcaat

SEQ ID NO: 959062 - DNA, 22 bp, Artificial Sequence
  chemically synthesized
aaagcacgagattgaaagatgc

SEQ ID NO: 959063 - DNA, 22 bp, Artificial Sequence
  chemically synthesized
aagcacgagattgaaagatgca

SEQ ID NO: 959064 - DNA, 22 bp, Artificial Sequence
  chemically synthesized
aaagatgcattgtgagagaagt

SEQ ID NO: 959065 - DNA, 22 bp, Artificial Sequence
  chemically synthesized
tgagagaagttccggtttgcta

SEQ ID NO: 959066 - DNA, 22 bp, Artificial Sequence
  chemically synthesized
aaaataacaatgaaggaagtag

SEQ ID NO: 959067 - DNA, 22 bp, Artificial Sequence
  chemically synthesized
cggtttgctacttccttcattg

SEQ ID NO: 959068 - DNA, 22 bp, Artificial Sequence
  chemically synthesized
aaagattaaaaataacaatgaa

SEQ ID NO: 959069 - DNA, 22 bp, Artificial Sequence
  chemically synthesized
gctacttccttcattgttattt

SEQ ID NO: 959070 - DNA, 22 bp, Artificial Sequence
  chemically synthesized
ctacttccttcattgttatttt

SEQ ID NO: 959071 - DNA, 22 bp, Artificial Sequence
  chemically synthesized
cttccttcattgttatttttaa

SEQ ID NO: 959072 - DNA, 22 bp, Artificial Sequence
  chemically synthesized
tatatctcaaagattaaaaata

SEQ ID NO: 959073 - DNA, 22 bp, Artificial Sequence
  chemically synthesized
ccttcattgttatttttaatct

SEQ ID NO: 959074 - DNA, 22 bp, Artificial Sequence
  chemically synthesized
cttcattgttatttttaatctt

SEQ ID NO: 959075 - DNA, 22 bp, Artificial Sequence
  chemically synthesized
ttgtatatctcaaagattaaaa

SEQ ID NO: 959076 - DNA, 22 bp, Artificial Sequence
  chemically synthesized
attgtatatctcaaagattaaa

SEQ ID NO: 959077 - DNA, 22 bp, Artificial Sequence
  chemically synthesized
tattgtatatctcaaagattaa

SEQ ID NO: 959078 - DNA, 22 bp, Artificial Sequence
  chemically synthesized
cattgttatttttaatctttga

SEQ ID NO: 959079 - DNA, 22 bp, Artificial Sequence
  chemically synthesized
attgttatttttaatctttgag

SEQ ID NO: 959080 - DNA, 22 bp, Artificial Sequence
  chemically synthesized
ttatttttaatctttgagatat

SEQ ID NO: 959081 - DNA, 22 bp, Artificial Sequence
  chemically synthesized
tttttaatctttgagatataca

SEQ ID NO: 959082 - DNA, 22 bp, Artificial Sequence
  chemically synthesized
atgatgctttattgtatatctc

SEQ ID NO: 959083 - DNA, 22 bp, Artificial Sequence
  chemically synthesized
ttaatctttgagatatacaata

SEQ ID NO: 959084 - DNA, 22 bp, Artificial Sequence
  chemically synthesized
taatctttgagatatacaataa

SEQ ID NO: 959085 - DNA, 22 bp, Artificial Sequence
  chemically synthesized
aatctttgagatatacaataaa

SEQ ID NO: 959086 - DNA, 22 bp, Artificial Sequence
  chemically synthesized
atctttgagatatacaataaag

SEQ ID NO: 959087 - DNA, 22 bp, Artificial Sequence
  chemically synthesized
aggttaatgatgctttattgta

SEQ ID NO: 959088 - DNA, 22 bp, Artificial Sequence
  chemically synthesized
caggttaatgatgctttattgt

SEQ ID NO: 959089 - DNA, 22 bp, Artificial Sequence
  chemically synthesized
tcaggttaatgatgctttattg

SEQ ID NO: 959090 - DNA, 22 bp, Artificial Sequence
  chemically synthesized
tttcaggttaatgatgctttat

SEQ ID NO: 959091 - DNA, 22 bp, Artificial Sequence
  chemically synthesized
tgagatatacaataaagcatca

SEQ ID NO: 959092 - DNA, 22 bp, Artificial Sequence
  chemically synthesized
ctttcaggttaatgatgcttta

SEQ ID NO: 959093 - DNA, 22 bp, Artificial Sequence
  chemically synthesized
gagatatacaataaagcatcat

SEQ ID NO: 959094 - DNA, 22 bp, Artificial Sequence
  chemically synthesized
tctttcaggttaatgatgcttt

SEQ ID NO: 959095 - DNA, 22 bp, Artificial Sequence
  chemically synthesized
agatatacaataaagcatcatt

SEQ ID NO: 959096 - DNA, 22 bp, Artificial Sequence
  chemically synthesized
tttctttcaggttaatgatgct

SEQ ID NO: 959097 - DNA, 22 bp, Artificial Sequence
  chemically synthesized
gaggggtgttctttctttcagg

SEQ ID NO: 959098 - DNA, 22 bp, Artificial Sequence
  chemically synthesized
tggaggggtgttctttctttca

SEQ ID NO: 959099 - DNA, 22 bp, Artificial Sequence
  chemically synthesized
tgtgttctggaggggtgttctt

SEQ ID NO: 959100 - DNA, 22 bp, Artificial Sequence
  chemically synthesized
acctgaaagaaagaacacccct

SEQ ID NO: 959101 - DNA, 22 bp, Artificial Sequence
  chemically synthesized
ctgtgtgttctggaggggtgtt

SEQ ID NO: 959102 - DNA, 22 bp, Artificial Sequence
  chemically synthesized
aaagaaagaacacccctccaga

SEQ ID NO: 959103 - DNA, 22 bp, Artificial Sequence
  chemically synthesized
attactgtgtgttctggagggg

SEQ ID NO: 959104 - DNA, 22 bp, Artificial Sequence
  chemically synthesized
ccattgattactgtgtgttctg

SEQ ID NO: 959105 - DNA, 22 bp, Artificial Sequence
  chemically synthesized
gccattgattactgtgtgttct

SEQ ID NO: 959106 - DNA, 22 bp, Artificial Sequence
  chemically synthesized
tgccattgattactgtgtgttc

SEQ ID NO: 959107 - DNA, 22 bp, Artificial Sequence
  chemically synthesized
actttgccattgattactgtgt

SEQ ID NO: 959108 - DNA, 22 bp, Artificial Sequence
  chemically synthesized
cagaacacacagtaatcaatgg

SEQ ID NO: 959109 - DNA, 22 bp, Artificial Sequence
  chemically synthesized
caattaactttgccattgatta

SEQ ID NO: 959110 - DNA, 22 bp, Artificial Sequence
  chemically synthesized
aattccaattaactttgccatt

SEQ ID NO: 959111 - DNA, 22 bp, Artificial Sequence
  chemically synthesized
aaagaactcaattccaattaac

SEQ ID NO: 959112 - DNA, 22 bp, Artificial Sequence
  chemically synthesized
ttaaaagaactcaattccaatt

SEQ ID NO: 959113 - DNA, 22 bp, Artificial Sequence
  chemically synthesized
aggtggaattgttaaaagaact

SEQ ID NO: 959114 - DNA, 22 bp, Artificial Sequence
  chemically synthesized
attggaattgagttcttttaac

SEQ ID NO: 959115 - DNA, 22 bp, Artificial Sequence
  chemically synthesized
ctaaggtggaattgttaaaaga

SEQ ID NO: 959116 - DNA, 22 bp, Artificial Sequence
  chemically synthesized
gaattgagttcttttaacaatt

SEQ ID NO: 959117 - DNA, 22 bp, Artificial Sequence
  chemically synthesized
tagaattgctaaggtggaattg

SEQ ID NO: 959118 - DNA, 22 bp, Artificial Sequence
  chemically synthesized
agttcttttaacaattccacct

SEQ ID NO: 959119 - DNA, 22 bp, Artificial Sequence
  chemically synthesized
ttttaacaattccaccttagca

SEQ ID NO: 959120 - DNA, 22 bp, Artificial Sequence
  chemically synthesized
ttaacaattccaccttagcaat

SEQ ID NO: 959121 - DNA, 22 bp, Artificial Sequence
  chemically synthesized
taacaattccaccttagcaatt

SEQ ID NO: 959122 - DNA, 22 bp, Artificial Sequence
  chemically synthesized
ggaacattgtagaattgctaag

SEQ ID NO: 959123 - DNA, 22 bp, Artificial Sequence
  chemically synthesized
aacaattccaccttagcaattc

SEQ ID NO: 959124 - DNA, 22 bp, Artificial Sequence
  chemically synthesized
acaattccaccttagcaattct

SEQ ID NO: 959125 - DNA, 22 bp, Artificial Sequence
  chemically synthesized
tcactaggaacattgtagaatt

SEQ ID NO: 959126 - DNA, 22 bp, Artificial Sequence
  chemically synthesized
caccttagcaattctacaatgt

SEQ ID NO: 959127 - DNA, 22 bp, Artificial Sequence
  chemically synthesized
tctatcactaggaacattgtag

SEQ ID NO: 959128 - DNA, 22 bp, Artificial Sequence
  chemically synthesized
agcaattctacaatgttcctag

SEQ ID NO: 959129 - DNA, 22 bp, Artificial Sequence
  chemically synthesized
gcaattctacaatgttcctagt

SEQ ID NO: 959130 - DNA, 22 bp, Artificial Sequence
  chemically synthesized
aaactgtctatcactaggaaca

SEQ ID NO: 959131 - DNA, 22 bp, Artificial Sequence
  chemically synthesized
attaaaactgtctatcactagg

SEQ ID NO: 959132 - DNA, 22 bp, Artificial Sequence
  chemically synthesized
gattaaaactgtctatcactag

SEQ ID NO: 959133 - DNA, 22 bp, Artificial Sequence
  chemically synthesized
tgattaaaactgtctatcacta

SEQ ID NO: 959134 - DNA, 22 bp, Artificial Sequence
  chemically synthesized
tacaatgttcctagtgatagac

SEQ ID NO: 959135 - DNA, 22 bp, Artificial Sequence
  chemically synthesized
caatgttcctagtgatagacag

SEQ ID NO: 959136 - DNA, 22 bp, Artificial Sequence
  chemically synthesized
caagctttgattaaaactgtct

SEQ ID NO: 959137 - DNA, 22 bp, Artificial Sequence
  chemically synthesized
ctagtgatagacagttttaatc

SEQ ID NO: 959138 - DNA, 22 bp, Artificial Sequence
  chemically synthesized
gtgatagacagttttaatcaaa

SEQ ID NO: 959139 - DNA, 22 bp, Artificial Sequence
  chemically synthesized
aaatactccaagctttgattaa

SEQ ID NO: 959140 - DNA, 22 bp, Artificial Sequence
  chemically synthesized
caaatactccaagctttgatta

SEQ ID NO: 959141 - DNA, 22 bp, Artificial Sequence
  chemically synthesized
tcaaatactccaagctttgatt

SEQ ID NO: 959142 - DNA, 22 bp, Artificial Sequence
  chemically synthesized
ttcaaatactccaagctttgat

SEQ ID NO: 959143 - DNA, 22 bp, Artificial Sequence
  chemically synthesized
tttcaaatactccaagctttga

SEQ ID NO: 959144 - DNA, 22 bp, Artificial Sequence
  chemically synthesized
tttttcaaatactccaagcttt

SEQ ID NO: 959145 - DNA, 22 bp, Artificial Sequence
  chemically synthesized
tctctttttcaaatactccaag

SEQ ID NO: 959146 - DNA, 22 bp, Artificial Sequence
  chemically synthesized
gtctctttttcaaatactccaa

SEQ ID NO: 959147 - DNA, 22 bp, Artificial Sequence
  chemically synthesized
taatcaaagcttggagtatttg

SEQ ID NO: 959148 - DNA, 22 bp, Artificial Sequence
  chemically synthesized
aatcaaagcttggagtatttga

SEQ ID NO: 959149 - DNA, 22 bp, Artificial Sequence
  chemically synthesized
tttgtctctttttcaaatactc

SEQ ID NO: 959150 - DNA, 22 bp, Artificial Sequence
  chemically synthesized
atcaaagcttggagtatttgaa

SEQ ID NO: 959151 - DNA, 22 bp, Artificial Sequence
  chemically synthesized
cattatttgtctctttttcaaa

SEQ ID NO: 959152 - DNA, 22 bp, Artificial Sequence
  chemically synthesized
acattatttgtctctttttcaa

SEQ ID NO: 959153 - DNA, 22 bp, Artificial Sequence
  chemically synthesized
cttacattatttgtctcttttt

SEQ ID NO: 959154 - DNA, 22 bp, Artificial Sequence
  chemically synthesized
ccttacattatttgtctctttt

SEQ ID NO: 959155 - DNA, 22 bp, Artificial Sequence
  chemically synthesized
ggagtatttgaaaaagagacaa

SEQ ID NO: 959156 - DNA, 22 bp, Artificial Sequence
  chemically synthesized
gagtatttgaaaaagagacaaa

SEQ ID NO: 959157 - DNA, 22 bp, Artificial Sequence
  chemically synthesized
cttccttacattatttgtctct

SEQ ID NO: 959158 - DNA, 22 bp, Artificial Sequence
  chemically synthesized
tctccttccttacattatttgt

SEQ ID NO: 959159 - DNA, 22 bp, Artificial Sequence
  chemically synthesized
gaaaaagagacaaataatgtaa

SEQ ID NO: 959160 - DNA, 22 bp, Artificial Sequence
  chemically synthesized
aaaaagagacaaataatgtaag

SEQ ID NO: 959161 - DNA, 22 bp, Artificial Sequence
  chemically synthesized
gtcacaaattatctccttcctt

SEQ ID NO: 959162 - DNA, 22 bp, Artificial Sequence
  chemically synthesized
agtcacaaattatctccttcct

SEQ ID NO: 959163 - DNA, 22 bp, Artificial Sequence
  chemically synthesized
tagtcacaaattatctccttcc

SEQ ID NO: 959164 - DNA, 22 bp, Artificial Sequence
  chemically synthesized
ggttttagtcacaaattatctc

SEQ ID NO: 959165 - DNA, 22 bp, Artificial Sequence
  chemically synthesized
gtggaaagactaggttttagtc

SEQ ID NO: 959166 - DNA, 22 bp, Artificial Sequence
  chemically synthesized
agtggaaagactaggttttagt

SEQ ID NO: 959167 - DNA, 22 bp, Artificial Sequence
  chemically synthesized
gtgactaaaacctagtctttcc

SEQ ID NO: 959168 - DNA, 22 bp, Artificial Sequence
  chemically synthesized
tgactaaaacctagtctttcca

SEQ ID NO: 959169 - DNA, 22 bp, Artificial Sequence
  chemically synthesized
aaacctagtctttccactaagg

SEQ ID NO: 959170 - DNA, 22 bp, Artificial Sequence
  chemically synthesized
aagaaaaggaaatccttagtgg

SEQ ID NO: 959171 - DNA, 22 bp, Artificial Sequence
  chemically synthesized
aaagaaaaggaaatccttagtg

SEQ ID NO: 959172 - DNA, 22 bp, Artificial Sequence
  chemically synthesized
taaagaaaaggaaatccttagt

SEQ ID NO: 959173 - DNA, 22 bp, Artificial Sequence
  chemically synthesized
gtctttccactaaggatttcct

SEQ ID NO: 959174 - DNA, 22 bp, Artificial Sequence
  chemically synthesized
aaactttaaagaaaaggaaatc

SEQ ID NO: 959175 - DNA, 22 bp, Artificial Sequence
  chemically synthesized
tccactaaggatttccttttct

SEQ ID NO: 959176 - DNA, 22 bp, Artificial Sequence
  chemically synthesized
ccactaaggatttccttttctt

SEQ ID NO: 959177 - DNA, 22 bp, Artificial Sequence
  chemically synthesized
cactaaggatttccttttcttt

SEQ ID NO: 959178 - DNA, 22 bp, Artificial Sequence
  chemically synthesized
caaacctgaaactttaaagaaa

SEQ ID NO: 959179 - DNA, 22 bp, Artificial Sequence
  chemically synthesized
aggatttccttttctttaaagt

SEQ ID NO: 959180 - DNA, 22 bp, Artificial Sequence
  chemically synthesized
agctccaaacctgaaactttaa

SEQ ID NO: 959181 - DNA, 22 bp, Artificial Sequence
  chemically synthesized
cagctccaaacctgaaacttta

SEQ ID NO: 959182 - DNA, 22 bp, Artificial Sequence
  chemically synthesized
ccttttctttaaagtttcaggt

SEQ ID NO: 959183 - DNA, 22 bp, Artificial Sequence
  chemically synthesized
cttttctttaaagtttcaggtt

SEQ ID NO: 959184 - DNA, 22 bp, Artificial Sequence
  chemically synthesized
ttctttaaagtttcaggtttgg

SEQ ID NO: 959185 - DNA, 22 bp, Artificial Sequence
  chemically synthesized
tctttaaagtttcaggtttgga

SEQ ID NO: 959186 - DNA, 22 bp, Artificial Sequence
  chemically synthesized
ctttaaagtttcaggtttggag

SEQ ID NO: 959187 - DNA, 22 bp, Artificial Sequence
  chemically synthesized
tttaaagtttcaggtttggagc

SEQ ID NO: 959188 - DNA, 22 bp, Artificial Sequence
  chemically synthesized
aaaaagtgtttcagctccaaac

SEQ ID NO: 959189 - DNA, 22 bp, Artificial Sequence
  chemically synthesized
taaagtttcaggtttggagctg

SEQ ID NO: 959190 - DNA, 22 bp, Artificial Sequence
  chemically synthesized
aaagtttcaggtttggagctga

SEQ ID NO: 959191 - DNA, 22 bp, Artificial Sequence
  chemically synthesized
aagtttcaggtttggagctgaa

SEQ ID NO: 959192 - DNA, 22 bp, Artificial Sequence
  chemically synthesized
ctcaaaaagtgtttcagctcca

SEQ ID NO: 959193 - DNA, 22 bp, Artificial Sequence
  chemically synthesized
tactcaaaaagtgtttcagctc

SEQ ID NO: 959194 - DNA, 22 bp, Artificial Sequence
  chemically synthesized
tctactcaaaaagtgtttcagc

SEQ ID NO: 959195 - DNA, 22 bp, Artificial Sequence
  chemically synthesized
ctctactcaaaaagtgtttcag

SEQ ID NO: 959196 - DNA, 22 bp, Artificial Sequence
  chemically synthesized
caggtttggagctgaaacactt

SEQ ID NO: 959197 - DNA, 22 bp, Artificial Sequence
  chemically synthesized
aggtttggagctgaaacacttt

SEQ ID NO: 959198 - DNA, 22 bp, Artificial Sequence
  chemically synthesized
tgtcttctctactcaaaaagtg

SEQ ID NO: 959199 - DNA, 22 bp, Artificial Sequence
  chemically synthesized
ggagctgaaacactttttgagt

SEQ ID NO: 959200 - DNA, 22 bp, Artificial Sequence
  chemically synthesized
gagctgaaacactttttgagta

SEQ ID NO: 959201 - DNA, 22 bp, Artificial Sequence
  chemically synthesized
aaacactttttgagtagagaag

SEQ ID NO: 959202 - DNA, 22 bp, Artificial Sequence
  chemically synthesized
tcccatcctgtgtcttctctac

SEQ ID NO: 959203 - DNA, 22 bp, Artificial Sequence
  chemically synthesized
tttgagtagagaagacacagga

SEQ ID NO: 959204 - DNA, 22 bp, Artificial Sequence
  chemically synthesized
ttgagtagagaagacacaggat

SEQ ID NO: 959205 - DNA, 22 bp, Artificial Sequence
  chemically synthesized
aaccactgtcccatcctgtgtc

SEQ ID NO: 959206 - DNA, 22 bp, Artificial Sequence
  chemically synthesized
tgagtagagaagacacaggatg

SEQ ID NO: 959207 - DNA, 22 bp, Artificial Sequence
  chemically synthesized
caaccactgtcccatcctgtgt

SEQ ID NO: 959208 - DNA, 22 bp, Artificial Sequence
  chemically synthesized
gagtagagaagacacaggatgg

SEQ ID NO: 959209 - DNA, 22 bp, Artificial Sequence
  chemically synthesized
tcaaccactgtcccatcctgtg

SEQ ID NO: 959210 - DNA, 22 bp, Artificial Sequence
  chemically synthesized
agtagagaagacacaggatggg

SEQ ID NO: 959211 - DNA, 22 bp, Artificial Sequence
  chemically synthesized
ttcaaccactgtcccatcctgt

SEQ ID NO: 959212 - DNA, 22 bp, Artificial Sequence
  chemically synthesized
ttttcaaccactgtcccatcct

SEQ ID NO: 959213 - DNA, 22 bp, Artificial Sequence
  chemically synthesized
cttttcaaccactgtcccatcc

SEQ ID NO: 959214 - DNA, 22 bp, Artificial Sequence
  chemically synthesized
cacccagaccaacttcttttca

SEQ ID NO: 959215 - DNA, 22 bp, Artificial Sequence
  chemically synthesized
gcacccagaccaacttcttttc

SEQ ID NO: 959216 - DNA, 22 bp, Artificial Sequence
  chemically synthesized
ggatttgcacccagaccaactt

SEQ ID NO: 959217 - DNA, 22 bp, Artificial Sequence
  chemically synthesized
cagttgggatttgcacccagac

SEQ ID NO: 959218 - DNA, 22 bp, Artificial Sequence
  chemically synthesized
aaaagaagttggtctgggtgca

SEQ ID NO: 959219 - DNA, 22 bp, Artificial Sequence
  chemically synthesized
acatgctgcagttgggatttgc

SEQ ID NO: 959220 - DNA, 22 bp, Artificial Sequence
  chemically synthesized
gtctgggtgcaaatcccaactg

SEQ ID NO: 959221 - DNA, 22 bp, Artificial Sequence
  chemically synthesized
agctaacatgctgcagttggga

SEQ ID NO: 959222 - DNA, 22 bp, Artificial Sequence
  chemically synthesized
ggtgcaaatcccaactgcagca

SEQ ID NO: 959223 - DNA, 22 bp, Artificial Sequence
  chemically synthesized
tccaggatggctcagctaacat

SEQ ID NO: 959224 - DNA, 22 bp, Artificial Sequence
  chemically synthesized
cagcatgttagctgagccatcc

SEQ ID NO: 959225 - DNA, 22 bp, Artificial Sequence
  chemically synthesized
agtgagttgtccaggatggctc

SEQ ID NO: 959226 - DNA, 22 bp, Artificial Sequence
  chemically synthesized
gctgagccatcctggacaactc

SEQ ID NO: 959227 - DNA, 22 bp, Artificial Sequence
  chemically synthesized
agccatcctggacaactcactt

SEQ ID NO: 959228 - DNA, 22 bp, Artificial Sequence
  chemically synthesized
gagcacagagaggctaagtgag

SEQ ID NO: 959229 - DNA, 22 bp, Artificial Sequence
  chemically synthesized
gacaactcacttagcctctctg

SEQ ID NO: 959230 - DNA, 22 bp, Artificial Sequence
  chemically synthesized
acttagcctctctgtgctccag

SEQ ID NO: 959231 - DNA, 22 bp, Artificial Sequence
  chemically synthesized
caggcaaagaagctggagcaca

SEQ ID NO: 959232 - DNA, 22 bp, Artificial Sequence
  chemically synthesized
ccaggcaaagaagctggagcac

SEQ ID NO: 959233 - DNA, 22 bp, Artificial Sequence
  chemically synthesized
tccaggcaaagaagctggagca

SEQ ID NO: 959234 - DNA, 22 bp, Artificial Sequence
  chemically synthesized
agcctctctgtgctccagcttc

SEQ ID NO: 959235 - DNA, 22 bp, Artificial Sequence
  chemically synthesized
gcctctctgtgctccagcttct

SEQ ID NO: 959236 - DNA, 22 bp, Artificial Sequence
  chemically synthesized
ccattttccaggcaaagaagct

SEQ ID NO: 959237 - DNA, 22 bp, Artificial Sequence
  chemically synthesized
tctgtgctccagcttctttgcc

SEQ ID NO: 959238 - DNA, 22 bp, Artificial Sequence
  chemically synthesized
tgtgctccagcttctttgcctg

SEQ ID NO: 959239 - DNA, 22 bp, Artificial Sequence
  chemically synthesized
tgctccagcttctttgcctgga

SEQ ID NO: 959240 - DNA, 22 bp, Artificial Sequence
  chemically synthesized
tcgttcccattttccaggcaaa

SEQ ID NO: 959241 - DNA, 22 bp, Artificial Sequence
  chemically synthesized
ttatcgttcccattttccaggc

SEQ ID NO: 959242 - DNA, 22 bp, Artificial Sequence
  chemically synthesized
attatcgttcccattttccagg

SEQ ID NO: 959243 - DNA, 22 bp, Artificial Sequence
  chemically synthesized
cagcttctttgcctggaaaatg

SEQ ID NO: 959244 - DNA, 22 bp, Artificial Sequence
  chemically synthesized
tattatcgttcccattttccag

SEQ ID NO: 959245 - DNA, 22 bp, Artificial Sequence
  chemically synthesized
ctttgcctggaaaatgggaacg

SEQ ID NO: 959246 - DNA, 22 bp, Artificial Sequence
  chemically synthesized
tttgcctggaaaatgggaacga

SEQ ID NO: 959247 - DNA, 22 bp, Artificial Sequence
  chemically synthesized
tgcctggaaaatgggaacgata

SEQ ID NO: 959248 - DNA, 22 bp, Artificial Sequence
  chemically synthesized
gcctggaaaatgggaacgataa

SEQ ID NO: 959249 - DNA, 22 bp, Artificial Sequence
  chemically synthesized
cctggaaaatgggaacgataat

SEQ ID NO: 959250 - DNA, 22 bp, Artificial Sequence
  chemically synthesized
gaaaatgggaacgataataaaa

SEQ ID NO: 959251 - DNA, 22 bp, Artificial Sequence
  chemically synthesized
tgtgccaggccaaagtgcgttt

SEQ ID NO: 959252 - DNA, 22 bp, Artificial Sequence
  chemically synthesized
ctatgtgccaggccaaagtgcg

SEQ ID NO: 959253 - DNA, 22 bp, Artificial Sequence
  chemically synthesized
actatgtgccaggccaaagtgc

SEQ ID NO: 959254 - DNA, 22 bp, Artificial Sequence
  chemically synthesized
aaggcttactatgtgccaggcc

SEQ ID NO: 959255 - DNA, 22 bp, Artificial Sequence
  chemically synthesized
ttgaaggcttactatgtgccag

SEQ ID NO: 959256 - DNA, 22 bp, Artificial Sequence
  chemically synthesized
attgaaggcttactatgtgcca

SEQ ID NO: 959257 - DNA, 22 bp, Artificial Sequence
  chemically synthesized
tattgaaggcttactatgtgcc

SEQ ID NO: 959258 - DNA, 22 bp, Artificial Sequence
  chemically synthesized
tggcctggcacatagtaagcct

SEQ ID NO: 959259 - DNA, 22 bp, Artificial Sequence
  chemically synthesized
ggcctggcacatagtaagcctt

SEQ ID NO: 959260 - DNA, 22 bp, Artificial Sequence
  chemically synthesized
gcctggcacatagtaagccttc

SEQ ID NO: 959261 - DNA, 22 bp, Artificial Sequence
  chemically synthesized
gcacatagtaagccttcaataa

SEQ ID NO: 959262 - DNA, 22 bp, Artificial Sequence
  chemically synthesized
ataaaaatgatagtgatagttt

SEQ ID NO: 959263 - DNA, 22 bp, Artificial Sequence
  chemically synthesized
cataaaaatgatagtgatagtt

SEQ ID NO: 959264 - DNA, 22 bp, Artificial Sequence
  chemically synthesized
cttcataaaaatgatagtgata

SEQ ID NO: 959265 - DNA, 22 bp, Artificial Sequence
  chemically synthesized
gcttcataaaaatgatagtgat

SEQ ID NO: 959266 - DNA, 22 bp, Artificial Sequence
  chemically synthesized
caataaaactatcactatcatt

SEQ ID NO: 959267 - DNA, 22 bp, Artificial Sequence
  chemically synthesized
aataaaactatcactatcattt

SEQ ID NO: 959268 - DNA, 22 bp, Artificial Sequence
  chemically synthesized
tcttgcttcataaaaatgatag

SEQ ID NO: 959269 - DNA, 22 bp, Artificial Sequence
  chemically synthesized
atcttgcttcataaaaatgata

SEQ ID NO: 959270 - DNA, 22 bp, Artificial Sequence
  chemically synthesized
tatcttgcttcataaaaatgat

SEQ ID NO: 959271 - DNA, 22 bp, Artificial Sequence
  chemically synthesized
tcactatcatttttatgaagca

SEQ ID NO: 959272 - DNA, 22 bp, Artificial Sequence
  chemically synthesized
tcatttttatgaagcaagataa

SEQ ID NO: 959273 - DNA, 22 bp, Artificial Sequence
  chemically synthesized
aagaagaatgctttatcttgct

SEQ ID NO: 959274 - DNA, 22 bp, Artificial Sequence
  chemically synthesized
ttatgaagcaagataaagcatt

SEQ ID NO: 959275 - DNA, 22 bp, Artificial Sequence
  chemically synthesized
tatgaagcaagataaagcattc

SEQ ID NO: 959276 - DNA, 22 bp, Artificial Sequence
  chemically synthesized
atgaagcaagataaagcattct

SEQ ID NO: 959277 - DNA, 22 bp, Artificial Sequence
  chemically synthesized
tgaagcaagataaagcattctt

SEQ ID NO: 959278 - DNA, 22 bp, Artificial Sequence
  chemically synthesized
agaaaaaaaatgtagagaagtg

SEQ ID NO: 959279 - DNA, 22 bp, Artificial Sequence
  chemically synthesized
cagaaaaaaaatgtagagaagt

SEQ ID NO: 959280 - DNA, 22 bp, Artificial Sequence
  chemically synthesized
tcagaaaaaaaatgtagagaag

SEQ ID NO: 959281 - DNA, 22 bp, Artificial Sequence
  chemically synthesized
ttcttgaaccacttctctacat

SEQ ID NO: 959282 - DNA, 22 bp, Artificial Sequence
  chemically synthesized
cttgaaccacttctctacattt

SEQ ID NO: 959283 - DNA, 22 bp, Artificial Sequence
  chemically synthesized
ttgaaccacttctctacatttt

SEQ ID NO: 959284 - DNA, 22 bp, Artificial Sequence
  chemically synthesized
acctttcagaaaaaaaatgtag

SEQ ID NO: 959285 - DNA, 22 bp, Artificial Sequence
  chemically synthesized
gaaccacttctctacatttttt

SEQ ID NO: 959286 - DNA, 22 bp, Artificial Sequence
  chemically synthesized
aaccacttctctacattttttt

SEQ ID NO: 959287 - DNA, 22 bp, Artificial Sequence
  chemically synthesized
taacctttcagaaaaaaaatgt

SEQ ID NO: 959288 - DNA, 22 bp, Artificial Sequence
  chemically synthesized
agctctaacctttcagaaaaaa

SEQ ID NO: 959289 - DNA, 22 bp, Artificial Sequence
  chemically synthesized
ctctacattttttttctgaaag

SEQ ID NO: 959290 - DNA, 22 bp, Artificial Sequence
  chemically synthesized
tctacattttttttctgaaagg

SEQ ID NO: 959291 - DNA, 22 bp, Artificial Sequence
  chemically synthesized
attgagctctaacctttcagaa

SEQ ID NO: 959292 - DNA, 22 bp, Artificial Sequence
  chemically synthesized
tacattttttttctgaaaggtt

SEQ ID NO: 959293 - DNA, 22 bp, Artificial Sequence
  chemically synthesized
tcattgagctctaacctttcag

SEQ ID NO: 959294 - DNA, 22 bp, Artificial Sequence
  chemically synthesized
cattttttttctgaaaggttag

SEQ ID NO: 959295 - DNA, 22 bp, Artificial Sequence
  chemically synthesized
tggttctcattgagctctaacc

SEQ ID NO: 959296 - DNA, 22 bp, Artificial Sequence
  chemically synthesized
tttttctgaaaggttagagctc

SEQ ID NO: 959297 - DNA, 22 bp, Artificial Sequence
  chemically synthesized
ttttctgaaaggttagagctca

SEQ ID NO: 959298 - DNA, 22 bp, Artificial Sequence
  chemically synthesized
tttctgaaaggttagagctcaa

SEQ ID NO: 959299 - DNA, 22 bp, Artificial Sequence
  chemically synthesized
ttctgaaaggttagagctcaat

SEQ ID NO: 959300 - DNA, 22 bp, Artificial Sequence
  chemically synthesized
tctgaaaggttagagctcaatg

SEQ ID NO: 959301 - DNA, 22 bp, Artificial Sequence
  chemically synthesized
ctgaaaggttagagctcaatga

SEQ ID NO: 959302 - DNA, 22 bp, Artificial Sequence
  chemically synthesized
gggttatggttctcattgagct

SEQ ID NO: 959303 - DNA, 22 bp, Artificial Sequence
  chemically synthesized
tgaaaggttagagctcaatgag

SEQ ID NO: 959304 - DNA, 22 bp, Artificial Sequence
  chemically synthesized
aaaggttagagctcaatgagaa

SEQ ID NO: 959305 - DNA, 22 bp, Artificial Sequence
  chemically synthesized
gcctggggttatggttctcatt

SEQ ID NO: 959306 - DNA, 22 bp, Artificial Sequence
  chemically synthesized
ccctggcctggggttatggttc

SEQ ID NO: 959307 - DNA, 22 bp, Artificial Sequence
  chemically synthesized
gagctcaatgagaaccataacc

SEQ ID NO: 959308 - DNA, 22 bp, Artificial Sequence
  chemically synthesized
tgccctggcctggggttatggt

SEQ ID NO: 959309 - DNA, 22 bp, Artificial Sequence
  chemically synthesized
ctctgccctggcctggggttat

SEQ ID NO: 959310 - DNA, 22 bp, Artificial Sequence
  chemically synthesized
actctgccctggcctggggtta

SEQ ID NO: 959311 - DNA, 22 bp, Artificial Sequence
  chemically synthesized
aatgagaaccataaccccaggc

SEQ ID NO: 959312 - DNA, 22 bp, Artificial Sequence
  chemically synthesized
tactctgccctggcctggggtt

SEQ ID NO: 959313 - DNA, 22 bp, Artificial Sequence
  chemically synthesized
tttactctgccctggcctgggg

SEQ ID NO: 959314 - DNA, 22 bp, Artificial Sequence
  chemically synthesized
ctttactctgccctggcctggg

SEQ ID NO: 959315 - DNA, 22 bp, Artificial Sequence
  chemically synthesized
tctttactctgccctggcctgg

SEQ ID NO: 959316 - DNA, 22 bp, Artificial Sequence
  chemically synthesized
tatatctttctttactctgccc

SEQ ID NO: 959317 - DNA, 22 bp, Artificial Sequence
  chemically synthesized
aagaattgtatatctttcttta

SEQ ID NO: 959318 - DNA, 22 bp, Artificial Sequence
  chemically synthesized
gatctgaagaattgtatatctt

SEQ ID NO: 959319 - DNA, 22 bp, Artificial Sequence
  chemically synthesized
agatctgaagaattgtatatct

SEQ ID NO: 959320 - DNA, 22 bp, Artificial Sequence
  chemically synthesized
cttagatctgaagaattgtata

SEQ ID NO: 959321 - DNA, 22 bp, Artificial Sequence
  chemically synthesized
aggtatccataaacaactgctt

SEQ ID NO: 959322 - DNA, 22 bp, Artificial Sequence
  chemically synthesized
gaggtatccataaacaactgct

SEQ ID NO: 959323 - DNA, 22 bp, Artificial Sequence
  chemically synthesized
tgaggtatccataaacaactgc

SEQ ID NO: 959324 - DNA, 22 bp, Artificial Sequence
  chemically synthesized
ttcagatctaagcagttgttta

SEQ ID NO: 959325 - DNA, 22 bp, Artificial Sequence
  chemically synthesized
cagatctaagcagttgtttatg

SEQ ID NO: 959326 - DNA, 22 bp, Artificial Sequence
  chemically synthesized
agatctaagcagttgtttatgg

SEQ ID NO: 959327 - DNA, 22 bp, Artificial Sequence
  chemically synthesized
caatcattttgaggtatccata

SEQ ID NO: 959328 - DNA, 22 bp, Artificial Sequence
  chemically synthesized
agcagttgtttatggatacctc

SEQ ID NO: 959329 - DNA, 22 bp, Artificial Sequence
  chemically synthesized
gtaatattacaatcattttgag

SEQ ID NO: 959330 - DNA, 22 bp, Artificial Sequence
  chemically synthesized
tttatggatacctcaaaatgat

SEQ ID NO: 959331 - DNA, 22 bp, Artificial Sequence
  chemically synthesized
atggatacctcaaaatgattgt

SEQ ID NO: 959332 - DNA, 22 bp, Artificial Sequence
  chemically synthesized
tggatacctcaaaatgattgta

SEQ ID NO: 959333 - DNA, 22 bp, Artificial Sequence
  chemically synthesized
ggtatgttggtaatattacaat

SEQ ID NO: 959334 - DNA, 22 bp, Artificial Sequence
  chemically synthesized
aggtatgttggtaatattacaa

SEQ ID NO: 959335 - DNA, 22 bp, Artificial Sequence
  chemically synthesized
taggtatgttggtaatattaca

SEQ ID NO: 959336 - DNA, 22 bp, Artificial Sequence
  chemically synthesized
ttaggtatgttggtaatattac

SEQ ID NO: 959337 - DNA, 22 bp, Artificial Sequence
  chemically synthesized
ttttaggtatgttggtaatatt

SEQ ID NO: 959338 - DNA, 22 bp, Artificial Sequence
  chemically synthesized
aaaatgattgtaatattaccaa

SEQ ID NO: 959339 - DNA, 22 bp, Artificial Sequence
  chemically synthesized
cttttaggtatgttggtaatat

SEQ ID NO: 959340 - DNA, 22 bp, Artificial Sequence
  chemically synthesized
tcttttaggtatgttggtaata

SEQ ID NO: 959341 - DNA, 22 bp, Artificial Sequence
  chemically synthesized
ttcttttaggtatgttggtaat

SEQ ID NO: 959342 - DNA, 22 bp, Artificial Sequence
  chemically synthesized
tcttttcttttaggtatgttgg

SEQ ID NO: 959343 - DNA, 22 bp, Artificial Sequence
  chemically synthesized
taatattaccaacatacctaaa

SEQ ID NO: 959344 - DNA, 22 bp, Artificial Sequence
  chemically synthesized
acccacctgtcttttcttttag

SEQ ID NO: 959345 - DNA, 22 bp, Artificial Sequence
  chemically synthesized
ccaacatacctaaaagaaaaga

SEQ ID NO: 959346 - DNA, 22 bp, Artificial Sequence
  chemically synthesized
gcctgacccacctgtcttttct

SEQ ID NO: 959347 - DNA, 22 bp, Artificial Sequence
  chemically synthesized
aaagaaaagacaggtgggtcag

SEQ ID NO: 959348 - DNA, 22 bp, Artificial Sequence
  chemically synthesized
agtgtaggaagtaaacatgtac

SEQ ID NO: 959349 - DNA, 22 bp, Artificial Sequence
  chemically synthesized
cagtgtaggaagtaaacatgta

SEQ ID NO: 959350 - DNA, 22 bp, Artificial Sequence
  chemically synthesized
tcagtgtaggaagtaaacatgt

SEQ ID NO: 959351 - DNA, 22 bp, Artificial Sequence
  chemically synthesized
gtacatgtttacttcctacact

SEQ ID NO: 959352 - DNA, 22 bp, Artificial Sequence
  chemically synthesized
acttcctacactgaaagcattt

SEQ ID NO: 959353 - DNA, 22 bp, Artificial Sequence
  chemically synthesized
cttcctacactgaaagcatttt

SEQ ID NO: 959354 - DNA, 22 bp, Artificial Sequence
  chemically synthesized
cctacactgaaagcattttgat

SEQ ID NO: 959355 - DNA, 22 bp, Artificial Sequence
  chemically synthesized
ctacactgaaagcattttgatt

SEQ ID NO: 959356 - DNA, 22 bp, Artificial Sequence
  chemically synthesized
cactgaaagcattttgattgat

SEQ ID NO: 959357 - DNA, 22 bp, Artificial Sequence
  chemically synthesized
gaagagtcagaatagcatcaat

SEQ ID NO: 959358 - DNA, 22 bp, Artificial Sequence
  chemically synthesized
aaagcattttgattgatgctat

SEQ ID NO: 959359 - DNA, 22 bp, Artificial Sequence
  chemically synthesized
ggaagagtcagaatagcatcaa

SEQ ID NO: 959360 - DNA, 22 bp, Artificial Sequence
  chemically synthesized
aaatttggaagagtcagaatag

SEQ ID NO: 959361 - DNA, 22 bp, Artificial Sequence
  chemically synthesized
tgattgatgctattctgactct

SEQ ID NO: 959362 - DNA, 22 bp, Artificial Sequence
  chemically synthesized
gattgatgctattctgactctt

SEQ ID NO: 959363 - DNA, 22 bp, Artificial Sequence
  chemically synthesized
attgatgctattctgactcttc

SEQ ID NO: 959364 - DNA, 22 bp, Artificial Sequence
  chemically synthesized
atgctattctgactcttccaaa

SEQ ID NO: 959365 - DNA, 22 bp, Artificial Sequence
  chemically synthesized
acaggagccattaaaatttgga

SEQ ID NO: 959366 - DNA, 22 bp, Artificial Sequence
  chemically synthesized
ttctgactcttccaaattttaa

SEQ ID NO: 959367 - DNA, 22 bp, Artificial Sequence
  chemically synthesized
gttaacaggagccattaaaatt

SEQ ID NO: 959368 - DNA, 22 bp, Artificial Sequence
  chemically synthesized
tgactcttccaaattttaatgg

SEQ ID NO: 959369 - DNA, 22 bp, Artificial Sequence
  chemically synthesized
actcttccaaattttaatggct

SEQ ID NO: 959370 - DNA, 22 bp, Artificial Sequence
  chemically synthesized
ttccaaattttaatggctcctg

SEQ ID NO: 959371 - DNA, 22 bp, Artificial Sequence
  chemically synthesized
ccaaattttaatggctcctgtt

SEQ ID NO: 959372 - DNA, 22 bp, Artificial Sequence
  chemically synthesized
caaattttaatggctcctgtta

SEQ ID NO: 959373 - DNA, 22 bp, Artificial Sequence
  chemically synthesized
taatggctcctgttaaccaatt

SEQ ID NO: 959374 - DNA, 22 bp, Artificial Sequence
  chemically synthesized
aatggctcctgttaaccaattt

SEQ ID NO: 959375 - DNA, 22 bp, Artificial Sequence
  chemically synthesized
atggctcctgttaaccaatttc

SEQ ID NO: 959376 - DNA, 22 bp, Artificial Sequence
  chemically synthesized
ctgttaaccaatttcacctgca

SEQ ID NO: 959377 - DNA, 22 bp, Artificial Sequence
  chemically synthesized
ttaaccaatttcacctgcacac

SEQ ID NO: 959378 - DNA, 22 bp, Artificial Sequence
  chemically synthesized
accaatttcacctgcacactgg

SEQ ID NO: 959379 - DNA, 22 bp, Artificial Sequence
  chemically synthesized
agatgaggaatacgagcccagt

SEQ ID NO: 959380 - DNA, 22 bp, Artificial Sequence
  chemically synthesized
cacctgcacactgggctcgtat

SEQ ID NO: 959381 - DNA, 22 bp, Artificial Sequence
  chemically synthesized
acctgcacactgggctcgtatt

SEQ ID NO: 959382 - DNA, 22 bp, Artificial Sequence
  chemically synthesized
ccagctgagatgaggaatacga

SEQ ID NO: 959383 - DNA, 22 bp, Artificial Sequence
  chemically synthesized
accagctgagatgaggaatacg

SEQ ID NO: 959384 - DNA, 22 bp, Artificial Sequence
  chemically synthesized
cacactgggctcgtattcctca

SEQ ID NO: 959385 - DNA, 22 bp, Artificial Sequence
  chemically synthesized
ttaccagctgagatgaggaata

SEQ ID NO: 959386 - DNA, 22 bp, Artificial Sequence
  chemically synthesized
cttaccagctgagatgaggaat

SEQ ID NO: 959387 - DNA, 22 bp, Artificial Sequence
  chemically synthesized
atttcttaccagctgagatgag

SEQ ID NO: 959388 - DNA, 22 bp, Artificial Sequence
  chemically synthesized
ggctcgtattcctcatctcagc

SEQ ID NO: 959389 - DNA, 22 bp, Artificial Sequence
  chemically synthesized
aatttcttaccagctgagatga

SEQ ID NO: 959390 - DNA, 22 bp, Artificial Sequence
  chemically synthesized
taatttcttaccagctgagatg

SEQ ID NO: 959391 - DNA, 22 bp, Artificial Sequence
  chemically synthesized
gtattcctcatctcagctggta

SEQ ID NO: 959392 - DNA, 22 bp, Artificial Sequence
  chemically synthesized
agacactttaatttcttaccag

SEQ ID NO: 959393 - DNA, 22 bp, Artificial Sequence
  chemically synthesized
ctcatctcagctggtaagaaat

SEQ ID NO: 959394 - DNA, 22 bp, Artificial Sequence
  chemically synthesized
atctcagctggtaagaaattaa

SEQ ID NO: 959395 - DNA, 22 bp, Artificial Sequence
  chemically synthesized
agctggtaagaaattaaagtgt

SEQ ID NO: 959396 - DNA, 22 bp, Artificial Sequence
  chemically synthesized
tcatcgtactgagacactttaa

SEQ ID NO: 959397 - DNA, 22 bp, Artificial Sequence
  chemically synthesized
gtcatcgtactgagacacttta

SEQ ID NO: 959398 - DNA, 22 bp, Artificial Sequence
  chemically synthesized
ttgtcatcgtactgagacactt

SEQ ID NO: 959399 - DNA, 22 bp, Artificial Sequence
  chemically synthesized
gtaagaaattaaagtgtctcag

SEQ ID NO: 959400 - DNA, 22 bp, Artificial Sequence
  chemically synthesized
cttgtcatcgtactgagacact

SEQ ID NO: 959401 - DNA, 22 bp, Artificial Sequence
  chemically synthesized
agtagtttcttgtcatcgtact

SEQ ID NO: 959402 - DNA, 22 bp, Artificial Sequence
  chemically synthesized
aagtgtctcagtacgatgacaa

SEQ ID NO: 959403 - DNA, 22 bp, Artificial Sequence
  chemically synthesized
ctcagtagtttcttgtcatcgt

SEQ ID NO: 959404 - DNA, 22 bp, Artificial Sequence
  chemically synthesized
agtacgatgacaagaaactact

SEQ ID NO: 959405 - DNA, 22 bp, Artificial Sequence
  chemically synthesized
agaacgatgaatggcctgctca

SEQ ID NO: 959406 - DNA, 22 bp, Artificial Sequence
  chemically synthesized
cagaacgatgaatggcctgctc

SEQ ID NO: 959407 - DNA, 22 bp, Artificial Sequence
  chemically synthesized
tcagaacgatgaatggcctgct

SEQ ID NO: 959408 - DNA, 22 bp, Artificial Sequence
  chemically synthesized
ttttcagaacgatgaatggcct

SEQ ID NO: 959409 - DNA, 22 bp, Artificial Sequence
  chemically synthesized
ctgagcaggccattcatcgttc

SEQ ID NO: 959410 - DNA, 22 bp, Artificial Sequence
  chemically synthesized
atactgttttcagaacgatgaa

SEQ ID NO: 959411 - DNA, 22 bp, Artificial Sequence
  chemically synthesized
catactgttttcagaacgatga

SEQ ID NO: 959412 - DNA, 22 bp, Artificial Sequence
  chemically synthesized
agcaggccattcatcgttctga

SEQ ID NO: 959413 - DNA, 22 bp, Artificial Sequence
  chemically synthesized
tttcatactgttttcagaacga

SEQ ID NO: 959414 - DNA, 22 bp, Artificial Sequence
  chemically synthesized
atcgttctgaaaacagtatgaa

SEQ ID NO: 959415 - DNA, 22 bp, Artificial Sequence
  chemically synthesized
tgaaaacagtatgaaacagcta

SEQ ID NO: 959416 - DNA, 22 bp, Artificial Sequence
  chemically synthesized
aaaacagtatgaaacagctatc

SEQ ID NO: 959417 - DNA, 22 bp, Artificial Sequence
  chemically synthesized
tagaggtatgatgatagctgtt

SEQ ID NO: 959418 - DNA, 22 bp, Artificial Sequence
  chemically synthesized
atagaggtatgatgatagctgt

SEQ ID NO: 959419 - DNA, 22 bp, Artificial Sequence
  chemically synthesized
atttatagaggtatgatgatag

SEQ ID NO: 959420 - DNA, 22 bp, Artificial Sequence
  chemically synthesized
aatttatagaggtatgatgata

SEQ ID NO: 959421 - DNA, 22 bp, Artificial Sequence
  chemically synthesized
taatttatagaggtatgatgat

SEQ ID NO: 959422 - DNA, 22 bp, Artificial Sequence
  chemically synthesized
tcatcatacctctataaattaa

SEQ ID NO: 959423 - DNA, 22 bp, Artificial Sequence
  chemically synthesized
tagaaagaaaataacattttaa

SEQ ID NO: 959424 - DNA, 22 bp, Artificial Sequence
  chemically synthesized
tataaattaaaatgttattttc

SEQ ID NO: 959425 - DNA, 22 bp, Artificial Sequence
  chemically synthesized
taaattaaaatgttattttctt

SEQ ID NO: 959426 - DNA, 22 bp, Artificial Sequence
  chemically synthesized
aaatgttattttctttctacag

SEQ ID NO: 959427 - DNA, 22 bp, Artificial Sequence
  chemically synthesized
tagtcagagcacaactgtagaa

SEQ ID NO: 959428 - DNA, 22 bp, Artificial Sequence
  chemically synthesized
gtagtcagagcacaactgtaga

SEQ ID NO: 959429 - DNA, 22 bp, Artificial Sequence
  chemically synthesized
ttttctttctacagttgtgctc

SEQ ID NO: 959430 - DNA, 22 bp, Artificial Sequence
  chemically synthesized
tctttctacagttgtgctctga

SEQ ID NO: 959431 - DNA, 22 bp, Artificial Sequence
  chemically synthesized
ctttctacagttgtgctctgac

SEQ ID NO: 959432 - DNA, 22 bp, Artificial Sequence
  chemically synthesized
tttctacagttgtgctctgact

SEQ ID NO: 959433 - DNA, 22 bp, Artificial Sequence
  chemically synthesized
tctacagttgtgctctgactac

SEQ ID NO: 959434 - DNA, 22 bp, Artificial Sequence
  chemically synthesized
ctacagttgtgctctgactaca

SEQ ID NO: 959435 - DNA, 22 bp, Artificial Sequence
  chemically synthesized
tacagttgtgctctgactacaa

SEQ ID NO: 959436 - DNA, 22 bp, Artificial Sequence
  chemically synthesized
cagttgtgctctgactacaagc

SEQ ID NO: 959437 - DNA, 22 bp, Artificial Sequence
  chemically synthesized
tgctctgactacaagcatatcg

SEQ ID NO: 959438 - DNA, 22 bp, Artificial Sequence
  chemically synthesized
tgactacaagcatatcggccat

SEQ ID NO: 959439 - DNA, 22 bp, Artificial Sequence
  chemically synthesized
gaccccaccaggaatggccgat

SEQ ID NO: 959440 - DNA, 22 bp, Artificial Sequence
  chemically synthesized
actacaagcatatcggccattc

SEQ ID NO: 959441 - DNA, 22 bp, Artificial Sequence
  chemically synthesized
caagcatatcggccattcctgg

SEQ ID NO: 959442 - DNA, 22 bp, Artificial Sequence
  chemically synthesized
aaataatgaactggaccccacc

SEQ ID NO: 959443 - DNA, 22 bp, Artificial Sequence
  chemically synthesized
ctgaaataatgaactggacccc

SEQ ID NO: 959444 - DNA, 22 bp, Artificial Sequence
  chemically synthesized
cgtctactgaaataatgaactg

SEQ ID NO: 959445 - DNA, 22 bp, Artificial Sequence
  chemically synthesized
ctggtggggtccagttcattat

SEQ ID NO: 959446 - DNA, 22 bp, Artificial Sequence
  chemically synthesized
acgtctactgaaataatgaact

SEQ ID NO: 959447 - DNA, 22 bp, Artificial Sequence
  chemically synthesized
gtggggtccagttcattatttc

SEQ ID NO: 959448 - DNA, 22 bp, Artificial Sequence
  chemically synthesized
tttacgtctactgaaataatga

SEQ ID NO: 959449 - DNA, 22 bp, Artificial Sequence
  chemically synthesized
aaaattatttacgtctactgaa

SEQ ID NO: 959450 - DNA, 22 bp, Artificial Sequence
  chemically synthesized
tgctaaaaattatttacgtcta

SEQ ID NO: 959451 - DNA, 22 bp, Artificial Sequence
  chemically synthesized
attatttcagtagacgtaaata

SEQ ID NO: 959452 - DNA, 22 bp, Artificial Sequence
  chemically synthesized
tttcagtagacgtaaataattt

SEQ ID NO: 959453 - DNA, 22 bp, Artificial Sequence
  chemically synthesized
cagtagacgtaaataattttta

SEQ ID NO: 959454 - DNA, 22 bp, Artificial Sequence
  chemically synthesized
aaatacctgtgctaaaaattat

SEQ ID NO: 959455 - DNA, 22 bp, Artificial Sequence
  chemically synthesized
agtagacgtaaataatttttag

SEQ ID NO: 959456 - DNA, 22 bp, Artificial Sequence
  chemically synthesized
caaatacctgtgctaaaaatta

SEQ ID NO: 959457 - DNA, 22 bp, Artificial Sequence
  chemically synthesized
atttcaaatacctgtgctaaaa

SEQ ID NO: 959458 - DNA, 22 bp, Artificial Sequence
  chemically synthesized
taatttcaaatacctgtgctaa

SEQ ID NO: 959459 - DNA, 22 bp, Artificial Sequence
  chemically synthesized
ctaatttcaaatacctgtgcta

SEQ ID NO: 959460 - DNA, 22 bp, Artificial Sequence
  chemically synthesized
aatcgccttctaatttcaaata

SEQ ID NO: 959461 - DNA, 22 bp, Artificial Sequence
  chemically synthesized
ttagcacaggtatttgaaatta

SEQ ID NO: 959462 - DNA, 22 bp, Artificial Sequence
  chemically synthesized
tagcacaggtatttgaaattag

SEQ ID NO: 959463 - DNA, 22 bp, Artificial Sequence
  chemically synthesized
agcacaggtatttgaaattaga

SEQ ID NO: 959464 - DNA, 22 bp, Artificial Sequence
  chemically synthesized
gcacaggtatttgaaattagaa

SEQ ID NO: 959465 - DNA, 22 bp, Artificial Sequence
  chemically synthesized
caatgctgaatcgccttctaat

SEQ ID NO: 959466 - DNA, 22 bp, Artificial Sequence
  chemically synthesized
aattccaatgctgaatcgcctt

SEQ ID NO: 959467 - DNA, 22 bp, Artificial Sequence
  chemically synthesized
tcaattccaatgctgaatcgcc

SEQ ID NO: 959468 - DNA, 22 bp, Artificial Sequence
  chemically synthesized
gaaattagaaggcgattcagca

SEQ ID NO: 959469 - DNA, 22 bp, Artificial Sequence
  chemically synthesized
aaattagaaggcgattcagcat

SEQ ID NO: 959470 - DNA, 22 bp, Artificial Sequence
  chemically synthesized
gaaggcgattcagcattggaat

SEQ ID NO: 959471 - DNA, 22 bp, Artificial Sequence
  chemically synthesized
agcattggaattgagaattgtc

SEQ ID NO: 959472 - DNA, 22 bp, Artificial Sequence
  chemically synthesized
taagcagtggtgtggacaattc

SEQ ID NO: 959473 - DNA, 22 bp, Artificial Sequence
  chemically synthesized
gaattgagaattgtccacacca

SEQ ID NO: 959474 - DNA, 22 bp, Artificial Sequence
  chemically synthesized
caaggttataagcagtggtgtg

SEQ ID NO: 959475 - DNA, 22 bp, Artificial Sequence
  chemically synthesized
agaattgtccacaccactgctt

SEQ ID NO: 959476 - DNA, 22 bp, Artificial Sequence
  chemically synthesized
attccaaggttataagcagtgg

SEQ ID NO: 959477 - DNA, 22 bp, Artificial Sequence
  chemically synthesized
aattccaaggttataagcagtg

SEQ ID NO: 959478 - DNA, 22 bp, Artificial Sequence
  chemically synthesized
ttaattccaaggttataagcag

SEQ ID NO: 959479 - DNA, 22 bp, Artificial Sequence
  chemically synthesized
cttaattccaaggttataagca

SEQ ID NO: 959480 - DNA, 22 bp, Artificial Sequence
  chemically synthesized
tccacaccactgcttataacct

SEQ ID NO: 959481 - DNA, 22 bp, Artificial Sequence
  chemically synthesized
cacatttcttaattccaaggtt

SEQ ID NO: 959482 - DNA, 22 bp, Artificial Sequence
  chemically synthesized
cttataaccttggaattaagaa

SEQ ID NO: 959483 - DNA, 22 bp, Artificial Sequence
  chemically synthesized
ataaccttggaattaagaaatg

SEQ ID NO: 959484 - DNA, 22 bp, Artificial Sequence
  chemically synthesized
taaccttggaattaagaaatgt

SEQ ID NO: 959485 - DNA, 22 bp, Artificial Sequence
  chemically synthesized
ggaattaagaaatgtggaggtg

SEQ ID NO: 959486 - DNA, 22 bp, Artificial Sequence
  chemically synthesized
gaattaagaaatgtggaggtgc

SEQ ID NO: 959487 - DNA, 22 bp, Artificial Sequence
  chemically synthesized
agaaatgtggaggtgccattgt

SEQ ID NO: 959488 - DNA, 22 bp, Artificial Sequence
  chemically synthesized
cagaatgatggaaatgacccca

SEQ ID NO: 959489 - DNA, 22 bp, Artificial Sequence
  chemically synthesized
ttacagaatgatggaaatgacc

SEQ ID NO: 959490 - DNA, 22 bp, Artificial Sequence
  chemically synthesized
ttccctggggtcatttccatca

SEQ ID NO: 959491 - DNA, 22 bp, Artificial Sequence
  chemically synthesized
cctggggtcatttccatcattc

SEQ ID NO: 959492 - DNA, 22 bp, Artificial Sequence
  chemically synthesized
gggtcatttccatcattctgta

SEQ ID NO: 959493 - DNA, 22 bp, Artificial Sequence
  chemically synthesized
ccatcattctgtaataggtctt

SEQ ID NO: 959494 - DNA, 22 bp, Artificial Sequence
  chemically synthesized
catcattctgtaataggtcttt

SEQ ID NO: 959495 - DNA, 22 bp, Artificial Sequence
  chemically synthesized
tgtaataggtcttttgtttttg

SEQ ID NO: 959496 - DNA, 22 bp, Artificial Sequence
  chemically synthesized
taataggtcttttgtttttgtt

SEQ ID NO: 959497 - DNA, 22 bp, Artificial Sequence
  chemically synthesized
ttgtttttgttgggactgttgt

SEQ ID NO: 959498 - DNA, 22 bp, Artificial Sequence
  chemically synthesized
tgtttttgttgggactgttgta

SEQ ID NO: 959499 - DNA, 22 bp, Artificial Sequence
  chemically synthesized
gtttttgttgggactgttgtat

SEQ ID NO: 959500 - DNA, 22 bp, Artificial Sequence
  chemically synthesized
tttttgttgggactgttgtatt

SEQ ID NO: 959501 - DNA, 22 bp, Artificial Sequence
  chemically synthesized
accaaaggtggcaaatacaaca

SEQ ID NO: 959502 - DNA, 22 bp, Artificial Sequence
  chemically synthesized
gaccaaaggtggcaaatacaac

SEQ ID NO: 959503 - DNA, 22 bp, Artificial Sequence
  chemically synthesized
ttgttgggactgttgtatttgc

SEQ ID NO: 959504 - DNA, 22 bp, Artificial Sequence
  chemically synthesized
tgttgggactgttgtatttgcc

SEQ ID NO: 959505 - DNA, 22 bp, Artificial Sequence
  chemically synthesized
gttgggactgttgtatttgcca

SEQ ID NO: 959506 - DNA, 22 bp, Artificial Sequence
  chemically synthesized
ttgggactgttgtatttgccac

SEQ ID NO: 959507 - DNA, 22 bp, Artificial Sequence
  chemically synthesized
atttgaccaaaggtggcaaata

SEQ ID NO: 959508 - DNA, 22 bp, Artificial Sequence
  chemically synthesized
ggactgttgtatttgccacctt

SEQ ID NO: 959509 - DNA, 22 bp, Artificial Sequence
  chemically synthesized
agattcatttgaccaaaggtgg

SEQ ID NO: 959510 - DNA, 22 bp, Artificial Sequence
  chemically synthesized
cagattcatttgaccaaaggtg

SEQ ID NO: 959511 - DNA, 22 bp, Artificial Sequence
  chemically synthesized
ttgtatttgccacctttggtca

SEQ ID NO: 959512 - DNA, 22 bp, Artificial Sequence
  chemically synthesized
tttcagattcatttgaccaaag

SEQ ID NO: 959513 - DNA, 22 bp, Artificial Sequence
  chemically synthesized
tatttgccacctttggtcaaat

SEQ ID NO: 959514 - DNA, 22 bp, Artificial Sequence
  chemically synthesized
gccacctttggtcaaatgaatc

SEQ ID NO: 959515 - DNA, 22 bp, Artificial Sequence
  chemically synthesized
ccacctttggtcaaatgaatct

SEQ ID NO: 959516 - DNA, 22 bp, Artificial Sequence
  chemically synthesized
tagaattgtttcagattcattt

SEQ ID NO: 959517 - DNA, 22 bp, Artificial Sequence
  chemically synthesized
gctatagaattgtttcagattc

SEQ ID NO: 959518 - DNA, 22 bp, Artificial Sequence
  chemically synthesized
tagctatagaattgtttcagat

SEQ ID NO: 959519 - DNA, 22 bp, Artificial Sequence
  chemically synthesized
tggtcaaatgaatctgaaacaa

SEQ ID NO: 959520 - DNA, 22 bp, Artificial Sequence
  chemically synthesized
ggtcaaatgaatctgaaacaat

SEQ ID NO: 959521 - DNA, 22 bp, Artificial Sequence
  chemically synthesized
gtcaaatgaatctgaaacaatt

SEQ ID NO: 959522 - DNA, 22 bp, Artificial Sequence
  chemically synthesized
ctctagctatagaattgtttca

SEQ ID NO: 959523 - DNA, 22 bp, Artificial Sequence
  chemically synthesized
gtggtgttgctctagctataga

SEQ ID NO: 959524 - DNA, 22 bp, Artificial Sequence
  chemically synthesized
cgtggtgttgctctagctatag

SEQ ID NO: 959525 - DNA, 22 bp, Artificial Sequence
  chemically synthesized
tcgtggtgttgctctagctata

SEQ ID NO: 959526 - DNA, 22 bp, Artificial Sequence
  chemically synthesized
aaacaattctatagctagagca

SEQ ID NO: 959527 - DNA, 22 bp, Artificial Sequence
  chemically synthesized
tatagctagagcaacaccacga

SEQ ID NO: 959528 - DNA, 22 bp, Artificial Sequence
  chemically synthesized
tagctagagcaacaccacgaaa

SEQ ID NO: 959529 - DNA, 22 bp, Artificial Sequence
  chemically synthesized
gtgacaaaacaatctttcgtgg

SEQ ID NO: 959530 - DNA, 22 bp, Artificial Sequence
  chemically synthesized
agtgacaaaacaatctttcgtg

SEQ ID NO: 959531 - DNA, 22 bp, Artificial Sequence
  chemically synthesized
tagtgacaaaacaatctttcgt

SEQ ID NO: 959532 - DNA, 22 bp, Artificial Sequence
  chemically synthesized
gagcaacaccacgaaagattgt

SEQ ID NO: 959533 - DNA, 22 bp, Artificial Sequence
  chemically synthesized
atcattttagtgacaaaacaat

SEQ ID NO: 959534 - DNA, 22 bp, Artificial Sequence
  chemically synthesized
gctcatcattttagtgacaaaa

SEQ ID NO: 959535 - DNA, 22 bp, Artificial Sequence
  chemically synthesized
tagctcatcattttagtgacaa

SEQ ID NO: 959536 - DNA, 22 bp, Artificial Sequence
  chemically synthesized
ctagctcatcattttagtgaca

SEQ ID NO: 959537 - DNA, 22 bp, Artificial Sequence
  chemically synthesized
tctagctcatcattttagtgac

SEQ ID NO: 959538 - DNA, 22 bp, Artificial Sequence
  chemically synthesized
ctttctagctcatcattttagt

SEQ ID NO: 959539 - DNA, 22 bp, Artificial Sequence
  chemically synthesized
cctttctagctcatcattttag

SEQ ID NO: 959540 - DNA, 22 bp, Artificial Sequence
  chemically synthesized
ttttgtcactaaaatgatgagc

SEQ ID NO: 959541 - DNA, 22 bp, Artificial Sequence
  chemically synthesized
tgtcactaaaatgatgagctag

SEQ ID NO: 959542 - DNA, 22 bp, Artificial Sequence
  chemically synthesized
tgcgtttcctttctagctcatc

SEQ ID NO: 959543 - DNA, 22 bp, Artificial Sequence
  chemically synthesized
gtcactaaaatgatgagctaga

SEQ ID NO: 959544 - DNA, 22 bp, Artificial Sequence
  chemically synthesized
tcactaaaatgatgagctagaa

SEQ ID NO: 959545 - DNA, 22 bp, Artificial Sequence
  chemically synthesized
ctatgcgtttcctttctagctc

SEQ ID NO: 959546 - DNA, 22 bp, Artificial Sequence
  chemically synthesized
cctatgcgtttcctttctagct

SEQ ID NO: 959547 - DNA, 22 bp, Artificial Sequence
  chemically synthesized
tcctatgcgtttcctttctagc

SEQ ID NO: 959548 - DNA, 22 bp, Artificial Sequence
  chemically synthesized
ttcctatgcgtttcctttctag

SEQ ID NO: 959549 - DNA, 22 bp, Artificial Sequence
  chemically synthesized
aaatgatgagctagaaaggaaa

SEQ ID NO: 959550 - DNA, 22 bp, Artificial Sequence
  chemically synthesized
agcatgtttttcctatgcgttt

SEQ ID NO: 959551 - DNA, 22 bp, Artificial Sequence
  chemically synthesized
gaaaggaaacgcataggaaaaa

SEQ ID NO: 959552 - DNA, 22 bp, Artificial Sequence
  chemically synthesized
taggaaggctgagcatgttttt

SEQ ID NO: 959553 - DNA, 22 bp, Artificial Sequence
  chemically synthesized
gctataggaaggctgagcatgt

SEQ ID NO: 959554 - DNA, 22 bp, Artificial Sequence
  chemically synthesized
agctataggaaggctgagcatg

SEQ ID NO: 959555 - DNA, 22 bp, Artificial Sequence
  chemically synthesized
ttagctataggaaggctgagca

SEQ ID NO: 959556 - DNA, 22 bp, Artificial Sequence
  chemically synthesized
cttagctataggaaggctgagc

SEQ ID NO: 959557 - DNA, 22 bp, Artificial Sequence
  chemically synthesized
gtttcttagctataggaaggct

SEQ ID NO: 959558 - DNA, 22 bp, Artificial Sequence
  chemically synthesized
cgtacattggtttcttagctat

SEQ ID NO: 959559 - DNA, 22 bp, Artificial Sequence
  chemically synthesized
agccttcctatagctaagaaac

SEQ ID NO: 959560 - DNA, 22 bp, Artificial Sequence
  chemically synthesized
gcctccgtacattggtttctta

SEQ ID NO: 959561 - DNA, 22 bp, Artificial Sequence
  chemically synthesized
tggcctccgtacattggtttct

SEQ ID NO: 959562 - DNA, 22 bp, Artificial Sequence
  chemically synthesized
ctggcctccgtacattggtttc

SEQ ID NO: 959563 - DNA, 22 bp, Artificial Sequence
  chemically synthesized
cctatagctaagaaaccaatgt

SEQ ID NO: 959564 - DNA, 22 bp, Artificial Sequence
  chemically synthesized
ctatagctaagaaaccaatgta

SEQ ID NO: 959565 - DNA, 22 bp, Artificial Sequence
  chemically synthesized
ttctggcctccgtacattggtt

SEQ ID NO: 959566 - DNA, 22 bp, Artificial Sequence
  chemically synthesized
tagctaagaaaccaatgtacgg

SEQ ID NO: 959567 - DNA, 22 bp, Artificial Sequence
  chemically synthesized
ctcttctggcctccgtacattg

SEQ ID NO: 959568 - DNA, 22 bp, Artificial Sequence
  chemically synthesized
aactactcttctggcctccgta

SEQ ID NO: 959569 - DNA, 22 bp, Artificial Sequence
  chemically synthesized
agaaaccaatgtacggaggcca

SEQ ID NO: 959570 - DNA, 22 bp, Artificial Sequence
  chemically synthesized
gaactactcttctggcctccgt

SEQ ID NO: 959571 - DNA, 22 bp, Artificial Sequence
  chemically synthesized
aagaacttgaactactcttctg

SEQ ID NO: 959572 - DNA, 22 bp, Artificial Sequence
  chemically synthesized
tgaagaacttgaactactcttc

SEQ ID NO: 959573 - DNA, 22 bp, Artificial Sequence
  chemically synthesized
ctgaagaacttgaactactctt

SEQ ID NO: 959574 - DNA, 22 bp, Artificial Sequence
  chemically synthesized
atgtgcttctgaagaacttgaa

SEQ ID NO: 959575 - DNA, 22 bp, Artificial Sequence
  chemically synthesized
gaataaagagttcatgtgcttc

SEQ ID NO: 959576 - DNA, 22 bp, Artificial Sequence
  chemically synthesized
aagttcttcagaagcacatgaa

SEQ ID NO: 959577 - DNA, 22 bp, Artificial Sequence
  chemically synthesized
ttagaataaagagttcatgtgc

SEQ ID NO: 959578 - DNA, 22 bp, Artificial Sequence
  chemically synthesized
attagaataaagagttcatgtg

SEQ ID NO: 959579 - DNA, 22 bp, Artificial Sequence
  chemically synthesized
ttcagaagcacatgaactcttt

SEQ ID NO: 959580 - DNA, 22 bp, Artificial Sequence
  chemically synthesized
cagaagcacatgaactctttat

SEQ ID NO: 959581 - DNA, 22 bp, Artificial Sequence
  chemically synthesized
taatttattagaataaagagtt

SEQ ID NO: 959582 - DNA, 22 bp, Artificial Sequence
  chemically synthesized
agaagcacatgaactctttatt

SEQ ID NO: 959583 - DNA, 22 bp, Artificial Sequence
  chemically synthesized
tgtaatttattagaataaagag

SEQ ID NO: 959584 - DNA, 22 bp, Artificial Sequence
  chemically synthesized
ccacatgtggactctgtaattt

SEQ ID NO: 959585 - DNA, 22 bp, Artificial Sequence
  chemically synthesized
tttattctaataaattacagag

SEQ ID NO: 959586 - DNA, 22 bp, Artificial Sequence
  chemically synthesized
tattctaataaattacagagtc

SEQ ID NO: 959587 - DNA, 22 bp, Artificial Sequence
  chemically synthesized
attctaataaattacagagtcc

SEQ ID NO: 959588 - DNA, 22 bp, Artificial Sequence
  chemically synthesized
ttctaataaattacagagtcca

SEQ ID NO: 959589 - DNA, 22 bp, Artificial Sequence
  chemically synthesized
taataaattacagagtccacat

SEQ ID NO: 959590 - DNA, 22 bp, Artificial Sequence
  chemically synthesized
ataaattacagagtccacatgt

SEQ ID NO: 959591 - DNA, 22 bp, Artificial Sequence
  chemically synthesized
aatagtgaagcatctcccacat

SEQ ID NO: 959592 - DNA, 22 bp, Artificial Sequence
  chemically synthesized
cagagtccacatgtgggagatg

SEQ ID NO: 959593 - DNA, 22 bp, Artificial Sequence
  chemically synthesized
actaaatagtgaagcatctccc

SEQ ID NO: 959594 - DNA, 22 bp, Artificial Sequence
  chemically synthesized
cactaaatagtgaagcatctcc

SEQ ID NO: 959595 - DNA, 22 bp, Artificial Sequence
  chemically synthesized
cgtgaaatgatttcactaaata

SEQ ID NO: 959596 - DNA, 22 bp, Artificial Sequence
  chemically synthesized
ttccgtgaaatgatttcactaa

SEQ ID NO: 959597 - DNA, 22 bp, Artificial Sequence
  chemically synthesized
tattattccgtgaaatgatttc

SEQ ID NO: 959598 - DNA, 22 bp, Artificial Sequence
  chemically synthesized
cactatttagtgaaatcatttc

SEQ ID NO: 959599 - DNA, 22 bp, Artificial Sequence
  chemically synthesized
actatttagtgaaatcatttca

SEQ ID NO: 959600 - DNA, 22 bp, Artificial Sequence
  chemically synthesized
atctatattattccgtgaaatg

SEQ ID NO: 959601 - DNA, 22 bp, Artificial Sequence
  chemically synthesized
tttagtgaaatcatttcacgga

SEQ ID NO: 959602 - DNA, 22 bp, Artificial Sequence
  chemically synthesized
agtgaaatcatttcacggaata

SEQ ID NO: 959603 - DNA, 22 bp, Artificial Sequence
  chemically synthesized
gtgaaatcatttcacggaataa

SEQ ID NO: 959604 - DNA, 22 bp, Artificial Sequence
  chemically synthesized
cacggaataatatagatcaatg

SEQ ID NO: 959605 - DNA, 22 bp, Artificial Sequence
  chemically synthesized
acggaataatatagatcaatgt

SEQ ID NO: 959606 - DNA, 22 bp, Artificial Sequence
  chemically synthesized
gagaaatcagcatgagaaacat

SEQ ID NO: 959607 - DNA, 22 bp, Artificial Sequence
  chemically synthesized
agacctggagaaatcagcatga

SEQ ID NO: 959608 - DNA, 22 bp, Artificial Sequence
  chemically synthesized
taagacctggagaaatcagcat

SEQ ID NO: 959609 - DNA, 22 bp, Artificial Sequence
  chemically synthesized
ctaagacctggagaaatcagca

SEQ ID NO: 959610 - DNA, 22 bp, Artificial Sequence
  chemically synthesized
agatttctaagacctggagaaa

SEQ ID NO: 959611 - DNA, 22 bp, Artificial Sequence
  chemically synthesized
ctcatgctgatttctccaggtc

SEQ ID NO: 959612 - DNA, 22 bp, Artificial Sequence
  chemically synthesized
tcatgctgatttctccaggtct

SEQ ID NO: 959613 - DNA, 22 bp, Artificial Sequence
  chemically synthesized
atgctgatttctccaggtctta

SEQ ID NO: 959614 - DNA, 22 bp, Artificial Sequence
  chemically synthesized
acacctcagatttctaagacct

SEQ ID NO: 959615 - DNA, 22 bp, Artificial Sequence
  chemically synthesized
atttctccaggtcttagaaatc

SEQ ID NO: 959616 - DNA, 22 bp, Artificial Sequence
  chemically synthesized
aaactgacacctcagatttcta

SEQ ID NO: 959617 - DNA, 22 bp, Artificial Sequence
  chemically synthesized
aaaactgacacctcagatttct

SEQ ID NO: 959618 - DNA, 22 bp, Artificial Sequence
  chemically synthesized
ctccaggtcttagaaatctgag

SEQ ID NO: 959619 - DNA, 22 bp, Artificial Sequence
  chemically synthesized
taaaactgacacctcagatttc

SEQ ID NO: 959620 - DNA, 22 bp, Artificial Sequence
  chemically synthesized
tccaggtcttagaaatctgagg

SEQ ID NO: 959621 - DNA, 22 bp, Artificial Sequence
  chemically synthesized
caggtcttagaaatctgaggtg

SEQ ID NO: 959622 - DNA, 22 bp, Artificial Sequence
  chemically synthesized
caggagattttaaaactgacac

SEQ ID NO: 959623 - DNA, 22 bp, Artificial Sequence
  chemically synthesized
agaaatctgaggtgtcagtttt

SEQ ID NO: 959624 - DNA, 22 bp, Artificial Sequence
  chemically synthesized
ccaggagattttaaaactgaca

SEQ ID NO: 959625 - DNA, 22 bp, Artificial Sequence
  chemically synthesized
gaaatctgaggtgtcagtttta

SEQ ID NO: 959626 - DNA, 22 bp, Artificial Sequence
  chemically synthesized
tccaggagattttaaaactgac

SEQ ID NO: 959627 - DNA, 22 bp, Artificial Sequence
  chemically synthesized
aggtgtcagttttaaaatctcc

SEQ ID NO: 959628 - DNA, 22 bp, Artificial Sequence
  chemically synthesized
aatatgtgtacacatattttcc

SEQ ID NO: 959629 - DNA, 22 bp, Artificial Sequence
  chemically synthesized
taaaatctcctggaaaatatgt

SEQ ID NO: 959630 - DNA, 22 bp, Artificial Sequence
  chemically synthesized
aaaatctcctggaaaatatgtg

SEQ ID NO: 959631 - DNA, 22 bp, Artificial Sequence
  chemically synthesized
aaatctcctggaaaatatgtgt

SEQ ID NO: 959632 - DNA, 22 bp, Artificial Sequence
  chemically synthesized
ctggaaaatatgtgtacacata

SEQ ID NO: 959633 - DNA, 22 bp, Artificial Sequence
  chemically synthesized
aatgaccctgaatatgtgtaca

SEQ ID NO: 959634 - DNA, 22 bp, Artificial Sequence
  chemically synthesized
gaaaatatgtgtacacatattc

SEQ ID NO: 959635 - DNA, 22 bp, Artificial Sequence
  chemically synthesized
agctgaatgaccctgaatatgt

SEQ ID NO: 959636 - DNA, 22 bp, Artificial Sequence
  chemically synthesized
agttgagctgaatgaccctgaa

SEQ ID NO: 959637 - DNA, 22 bp, Artificial Sequence
  chemically synthesized
cagttgagctgaatgaccctga

SEQ ID NO: 959638 - DNA, 22 bp, Artificial Sequence
  chemically synthesized
tcagtttcagttgagctgaatg

SEQ ID NO: 959639 - DNA, 22 bp, Artificial Sequence
  chemically synthesized
agggtcattcagctcaactgaa

SEQ ID NO: 959640 - DNA, 22 bp, Artificial Sequence
  chemically synthesized
taatcagctatcagtttcagtt

SEQ ID NO: 959641 - DNA, 22 bp, Artificial Sequence
  chemically synthesized
agctcaactgaaactgatagct

SEQ ID NO: 959642 - DNA, 22 bp, Artificial Sequence
  chemically synthesized
aactgaaactgatagctgatta

SEQ ID NO: 959643 - DNA, 22 bp, Artificial Sequence
  chemically synthesized
aaactgatagctgattacagtg

SEQ ID NO: 959644 - DNA, 22 bp, Artificial Sequence
  chemically synthesized
atagctgattacagtgttcctg

SEQ ID NO: 959645 - DNA, 22 bp, Artificial Sequence
  chemically synthesized
taaatatcaacaaagcaggaac

SEQ ID NO: 959646 - DNA, 22 bp, Artificial Sequence
  chemically synthesized
ataaatatcaacaaagcaggaa

SEQ ID NO: 959647 - DNA, 22 bp, Artificial Sequence
  chemically synthesized
attacagtgttcctgctttgtt

SEQ ID NO: 959648 - DNA, 22 bp, Artificial Sequence
  chemically synthesized
cagtgttcctgctttgttgata

SEQ ID NO: 959649 - DNA, 22 bp, Artificial Sequence
  chemically synthesized
ctgctttgttgatatttataag

SEQ ID NO: 959650 - DNA, 22 bp, Artificial Sequence
  chemically synthesized
atacgaagccagaccttataaa

SEQ ID NO: 959651 - DNA, 22 bp, Artificial Sequence
  chemically synthesized
ctttgttgatatttataaggtc

SEQ ID NO: 959652 - DNA, 22 bp, Artificial Sequence
  chemically synthesized
gatacgaagccagaccttataa

SEQ ID NO: 959653 - DNA, 22 bp, Artificial Sequence
  chemically synthesized
tgttgatatttataaggtctgg

SEQ ID NO: 959654 - DNA, 22 bp, Artificial Sequence
  chemically synthesized
cttgatacgaagccagacctta

SEQ ID NO: 959655 - DNA, 22 bp, Artificial Sequence
  chemically synthesized
gttgatatttataaggtctggc

SEQ ID NO: 959656 - DNA, 22 bp, Artificial Sequence
  chemically synthesized
ttgatatttataaggtctggct

SEQ ID NO: 959657 - DNA, 22 bp, Artificial Sequence
  chemically synthesized
atatttataaggtctggcttcg

SEQ ID NO: 959658 - DNA, 22 bp, Artificial Sequence
  chemically synthesized
cataactgcttgatacgaagcc

SEQ ID NO: 959659 - DNA, 22 bp, Artificial Sequence
  chemically synthesized
acataactgcttgatacgaagc

SEQ ID NO: 959660 - DNA, 22 bp, Artificial Sequence
  chemically synthesized
tacataactgcttgatacgaag

SEQ ID NO: 959661 - DNA, 22 bp, Artificial Sequence
  chemically synthesized
ataaggtctggcttcgtatcaa

SEQ ID NO: 959662 - DNA, 22 bp, Artificial Sequence
  chemically synthesized
taaggtctggcttcgtatcaag

SEQ ID NO: 959663 - DNA, 22 bp, Artificial Sequence
  chemically synthesized
cactttacataactgcttgata

SEQ ID NO: 959664 - DNA, 22 bp, Artificial Sequence
  chemically synthesized
acactttacataactgcttgat

SEQ ID NO: 959665 - DNA, 22 bp, Artificial Sequence
  chemically synthesized
tacactttacataactgcttga

SEQ ID NO: 959666 - DNA, 22 bp, Artificial Sequence
  chemically synthesized
tttacactttacataactgctt

SEQ ID NO: 959667 - DNA, 22 bp, Artificial Sequence
  chemically synthesized
gcttcgtatcaagcagttatgt

SEQ ID NO: 959668 - DNA, 22 bp, Artificial Sequence
  chemically synthesized
cgtatcaagcagttatgtaaag

SEQ ID NO: 959669 - DNA, 22 bp, Artificial Sequence
  chemically synthesized
gtatcaagcagttatgtaaagt

SEQ ID NO: 959670 - DNA, 22 bp, Artificial Sequence
  chemically synthesized
accaattctttacactttacat

SEQ ID NO: 959671 - DNA, 22 bp, Artificial Sequence
  chemically synthesized
tcaccaattctttacactttac

SEQ ID NO: 959672 - DNA, 22 bp, Artificial Sequence
  chemically synthesized
attctcaccaattctttacact

SEQ ID NO: 959673 - DNA, 22 bp, Artificial Sequence
  chemically synthesized
tgtaaagtgtaaagaattggtg

SEQ ID NO: 959674 - DNA, 22 bp, Artificial Sequence
  chemically synthesized
atggagggtgcataatgttcat

SEQ ID NO: 959675 - DNA, 22 bp, Artificial Sequence
  chemically synthesized
catggagggtgcataatgttca

SEQ ID NO: 959676 - DNA, 22 bp, Artificial Sequence
  chemically synthesized
tcatggagggtgcataatgttc

SEQ ID NO: 959677 - DNA, 22 bp, Artificial Sequence
  chemically synthesized
tttcatggagggtgcataatgt

SEQ ID NO: 959678 - DNA, 22 bp, Artificial Sequence
  chemically synthesized
ctttcatggagggtgcataatg

SEQ ID NO: 959679 - DNA, 22 bp, Artificial Sequence
  chemically synthesized
gtgagaatgaacattatgcacc

SEQ ID NO: 959680 - DNA, 22 bp, Artificial Sequence
  chemically synthesized
gtcttctttcatggagggtgca

SEQ ID NO: 959681 - DNA, 22 bp, Artificial Sequence
  chemically synthesized
ggtcttctttcatggagggtgc

SEQ ID NO: 959682 - DNA, 22 bp, Artificial Sequence
  chemically synthesized
tcatttggtcttctttcatgga

SEQ ID NO: 959683 - DNA, 22 bp, Artificial Sequence
  chemically synthesized
gttgtcatttggtcttctttca

SEQ ID NO: 959684 - DNA, 22 bp, Artificial Sequence
  chemically synthesized
tgcaccctccatgaaagaagac

SEQ ID NO: 959685 - DNA, 22 bp, Artificial Sequence
  chemically synthesized
atacaattggttgtcatttggt

SEQ ID NO: 959686 - DNA, 22 bp, Artificial Sequence
  chemically synthesized
catgaaagaagaccaaatgaca

SEQ ID NO: 959687 - DNA, 22 bp, Artificial Sequence
  chemically synthesized
catacaattggttgtcatttgg

SEQ ID NO: 959688 - DNA, 22 bp, Artificial Sequence
  chemically synthesized
ttcatacaattggttgtcattt

SEQ ID NO: 959689 - DNA, 22 bp, Artificial Sequence
  chemically synthesized
cttcatacaattggttgtcatt

SEQ ID NO: 959690 - DNA, 22 bp, Artificial Sequence
  chemically synthesized
acatttcttcatacaattggtt

SEQ ID NO: 959691 - DNA, 22 bp, Artificial Sequence
  chemically synthesized
aacatttcttcatacaattggt

SEQ ID NO: 959692 - DNA, 22 bp, Artificial Sequence
  chemically synthesized
tgtttaacatttcttcatacaa

SEQ ID NO: 959693 - DNA, 22 bp, Artificial Sequence
  chemically synthesized
attgtgtttaacatttcttcat

SEQ ID NO: 959694 - DNA, 22 bp, Artificial Sequence
  chemically synthesized
taattgtgtttaacatttcttc

SEQ ID NO: 959695 - DNA, 22 bp, Artificial Sequence
  chemically synthesized
cattctaattgtgtttaacatt

SEQ ID NO: 959696 - DNA, 22 bp, Artificial Sequence
  chemically synthesized
ccattctaattgtgtttaacat

SEQ ID NO: 959697 - DNA, 22 bp, Artificial Sequence
  chemically synthesized
ttccattctaattgtgtttaac

SEQ ID NO: 959698 - DNA, 22 bp, Artificial Sequence
  chemically synthesized
tatgaagaaatgttaaacacaa

SEQ ID NO: 959699 - DNA, 22 bp, Artificial Sequence
  chemically synthesized
cttccattctaattgtgtttaa

SEQ ID NO: 959700 - DNA, 22 bp, Artificial Sequence
  chemically synthesized
tcttccattctaattgtgttta

SEQ ID NO: 959701 - DNA, 22 bp, Artificial Sequence
  chemically synthesized
ttttcttccattctaattgtgt

SEQ ID NO: 959702 - DNA, 22 bp, Artificial Sequence
  chemically synthesized
gttttcttccattctaattgtg

SEQ ID NO: 959703 - DNA, 22 bp, Artificial Sequence
  chemically synthesized
cttgttttcttccattctaatt

SEQ ID NO: 959704 - DNA, 22 bp, Artificial Sequence
  chemically synthesized
atctacttgttttcttccattc

SEQ ID NO: 959705 - DNA, 22 bp, Artificial Sequence
  chemically synthesized
aacacaattagaatggaagaaa

SEQ ID NO: 959706 - DNA, 22 bp, Artificial Sequence
  chemically synthesized
ctcatctacttgttttcttcca

SEQ ID NO: 959707 - DNA, 22 bp, Artificial Sequence
  chemically synthesized
actcctcatctacttgttttct

SEQ ID NO: 959708 - DNA, 22 bp, Artificial Sequence
  chemically synthesized
actaactcctcatctacttgtt

SEQ ID NO: 959709 - DNA, 22 bp, Artificial Sequence
  chemically synthesized
gaatggaagaaaacaagtagat

SEQ ID NO: 959710 - DNA, 22 bp, Artificial Sequence
  chemically synthesized
ggtagcattcactaactcctca

SEQ ID NO: 959711 - DNA, 22 bp, Artificial Sequence
  chemically synthesized
aggtagcattcactaactcctc

SEQ ID NO: 959712 - DNA, 22 bp, Artificial Sequence
  chemically synthesized
ttaggtagcattcactaactcc

SEQ ID NO: 959713 - DNA, 22 bp, Artificial Sequence
  chemically synthesized
tattcttaggtagcattcacta

SEQ ID NO: 959714 - DNA, 22 bp, Artificial Sequence
  chemically synthesized
atatctgtattcttaggtagca

SEQ ID NO: 959715 - DNA, 22 bp, Artificial Sequence
  chemically synthesized
ggttaatatctgtattcttagg

SEQ ID NO: 959716 - DNA, 22 bp, Artificial Sequence
  chemically synthesized
gtgaatgctacctaagaataca

SEQ ID NO: 959717 - DNA, 22 bp, Artificial Sequence
  chemically synthesized
taggttaatatctgtattctta

SEQ ID NO: 959718 - DNA, 22 bp, Artificial Sequence
  chemically synthesized
ctaggttaatatctgtattctt

SEQ ID NO: 959719 - DNA, 22 bp, Artificial Sequence
  chemically synthesized
cctaagaatacagatattaacc

SEQ ID NO: 959720 - DNA, 22 bp, Artificial Sequence
  chemically synthesized
aagaacatatttctaggttaat

SEQ ID NO: 959721 - DNA, 22 bp, Artificial Sequence
  chemically synthesized
agaatacagatattaacctaga

SEQ ID NO: 959722 - DNA, 22 bp, Artificial Sequence
  chemically synthesized
ttcaagaacatatttctaggtt

SEQ ID NO: 959723 - DNA, 22 bp, Artificial Sequence
  chemically synthesized
tcacgtaattattcaagaacat

SEQ ID NO: 959724 - DNA, 22 bp, Artificial Sequence
  chemically synthesized
gtcacgtaattattcaagaaca

SEQ ID NO: 959725 - DNA, 22 bp, Artificial Sequence
  chemically synthesized
acctagaaatatgttcttgaat

SEQ ID NO: 959726 - DNA, 22 bp, Artificial Sequence
  chemically synthesized
ttgtcacgtaattattcaagaa

SEQ ID NO: 959727 - DNA, 22 bp, Artificial Sequence
  chemically synthesized
gaaatatgttcttgaataatta

SEQ ID NO: 959728 - DNA, 22 bp, Artificial Sequence
  chemically synthesized
gctcttgtcacgtaattattca

SEQ ID NO: 959729 - DNA, 22 bp, Artificial Sequence
  chemically synthesized
tgtctagctcttgtcacgtaat

SEQ ID NO: 959730 - DNA, 22 bp, Artificial Sequence
  chemically synthesized
tgtgtctagctcttgtcacgta

SEQ ID NO: 959731 - DNA, 22 bp, Artificial Sequence
  chemically synthesized
ttgaataattacgtgacaagag

SEQ ID NO: 959732 - DNA, 22 bp, Artificial Sequence
  chemically synthesized
ttctgtgtctagctcttgtcac

SEQ ID NO: 959733 - DNA, 22 bp, Artificial Sequence
  chemically synthesized
attctgtgtctagctcttgtca

SEQ ID NO: 959734 - DNA, 22 bp, Artificial Sequence
  chemically synthesized
gaataattacgtgacaagagct

SEQ ID NO: 959735 - DNA, 22 bp, Artificial Sequence
  chemically synthesized
aataattacgtgacaagagcta

SEQ ID NO: 959736 - DNA, 22 bp, Artificial Sequence
  chemically synthesized
cgtgacaagagctagacacaga

SEQ ID NO: 959737 - DNA, 22 bp, Artificial Sequence
  chemically synthesized
tatgatatatttattctgtgtc

SEQ ID NO: 959738 - DNA, 22 bp, Artificial Sequence
  chemically synthesized
gacacagaataaatatatcata

SEQ ID NO: 959739 - DNA, 22 bp, Artificial Sequence
  chemically synthesized
aaatagaaatgaaattatatga

SEQ ID NO: 959740 - DNA, 22 bp, Artificial Sequence
  chemically synthesized
aaaatagaaatgaaattatatg

SEQ ID NO: 959741 - DNA, 22 bp, Artificial Sequence
  chemically synthesized
taaaatagaaatgaaattatat

SEQ ID NO: 959742 - DNA, 22 bp, Artificial Sequence
  chemically synthesized
ttaaaatagaaatgaaattata

SEQ ID NO: 959743 - DNA, 22 bp, Artificial Sequence
  chemically synthesized
cttttaaaatagaaatgaaatt

SEQ ID NO: 959744 - DNA, 22 bp, Artificial Sequence
  chemically synthesized
ccttttaaaatagaaatgaaat

SEQ ID NO: 959745 - DNA, 22 bp, Artificial Sequence
  chemically synthesized
tccttttaaaatagaaatgaaa

SEQ ID NO: 959746 - DNA, 22 bp, Artificial Sequence
  chemically synthesized
tataaactttccttttaaaata

SEQ ID NO: 959747 - DNA, 22 bp, Artificial Sequence
  chemically synthesized
atataaactttccttttaaaat

SEQ ID NO: 959748 - DNA, 22 bp, Artificial Sequence
  chemically synthesized
tatataaactttccttttaaaa

SEQ ID NO: 959749 - DNA, 22 bp, Artificial Sequence
  chemically synthesized
catttctattttaaaaggaaag

SEQ ID NO: 959750 - DNA, 22 bp, Artificial Sequence
  chemically synthesized
atttctattttaaaaggaaagt

SEQ ID NO: 959751 - DNA, 22 bp, Artificial Sequence
  chemically synthesized
ctattttaaaaggaaagtttat

SEQ ID NO: 959752 - DNA, 22 bp, Artificial Sequence
  chemically synthesized
tattttaaaaggaaagtttata

SEQ ID NO: 959753 - DNA, 22 bp, Artificial Sequence
  chemically synthesized
ttttaaaaggaaagtttatata

SEQ ID NO: 959754 - DNA, 22 bp, Artificial Sequence
  chemically synthesized
taaaaggaaagtttatataaaa

SEQ ID NO: 959755 - DNA, 22 bp, Artificial Sequence
  chemically synthesized
aaaaggaaagtttatataaaat

SEQ ID NO: 959756 - DNA, 22 bp, Artificial Sequence
  chemically synthesized
aaaggaaagtttatataaaatt

SEQ ID NO: 959757 - DNA, 22 bp, Artificial Sequence
  chemically synthesized
atatatataacatatatagaat

SEQ ID NO: 959758 - DNA, 22 bp, Artificial Sequence
  chemically synthesized
aatatatataacatatatagaa

SEQ ID NO: 959759 - DNA, 22 bp, Artificial Sequence
  chemically synthesized
taatatatataacatatataga

SEQ ID NO: 959760 - DNA, 22 bp, Artificial Sequence
  chemically synthesized
atataaaattctatatatgtta

SEQ ID NO: 959761 - DNA, 22 bp, Artificial Sequence
  chemically synthesized
tataaaattctatatatgttat

SEQ ID NO: 959762 - DNA, 22 bp, Artificial Sequence
  chemically synthesized
tatatatgttatatatattaaa

SEQ ID NO: 959763 - DNA, 22 bp, Artificial Sequence
  chemically synthesized
atatgaacgtgttttaatatat

SEQ ID NO: 959764 - DNA, 22 bp, Artificial Sequence
  chemically synthesized
tatatgttatatatattaaaac

SEQ ID NO: 959765 - DNA, 22 bp, Artificial Sequence
  chemically synthesized
tattcatatgaacgtgttttaa

SEQ ID NO: 959766 - DNA, 22 bp, Artificial Sequence
  chemically synthesized
tctgtattcatatgaacgtgtt

SEQ ID NO: 959767 - DNA, 22 bp, Artificial Sequence
  chemically synthesized
atctgtattcatatgaacgtgt

SEQ ID NO: 959768 - DNA, 22 bp, Artificial Sequence
  chemically synthesized
tatatattaaaacacgttcata

SEQ ID NO: 959769 - DNA, 22 bp, Artificial Sequence
  chemically synthesized
aaacacgttcatatgaatacag

SEQ ID NO: 959770 - DNA, 22 bp, Artificial Sequence
  chemically synthesized
acatcaagacatttatctgtat

SEQ ID NO: 959771 - DNA, 22 bp, Artificial Sequence
  chemically synthesized
atatgaatacagataaatgtct

SEQ ID NO: 959772 - DNA, 22 bp, Artificial Sequence
  chemically synthesized
atgtgaatcatccattcacatc

SEQ ID NO: 959773 - DNA, 22 bp, Artificial Sequence
  chemically synthesized
agtgttcatgtgaatcatccat

SEQ ID NO: 959774 - DNA, 22 bp, Artificial Sequence
  chemically synthesized
aagtgttcatgtgaatcatcca

SEQ ID NO: 959775 - DNA, 22 bp, Artificial Sequence
  chemically synthesized
ttaagtgttcatgtgaatcatc

SEQ ID NO: 959776 - DNA, 22 bp, Artificial Sequence
  chemically synthesized
cttaagtgttcatgtgaatcat

SEQ ID NO: 959777 - DNA, 22 bp, Artificial Sequence
  chemically synthesized
gatgtgaatggatgattcacat

SEQ ID NO: 959778 - DNA, 22 bp, Artificial Sequence
  chemically synthesized
tcttaagtgttcatgtgaatca

SEQ ID NO: 959779 - DNA, 22 bp, Artificial Sequence
  chemically synthesized
atgtgaatggatgattcacatg

SEQ ID NO: 959780 - DNA, 22 bp, Artificial Sequence
  chemically synthesized
actttcttaagtgttcatgtga

SEQ ID NO: 959781 - DNA, 22 bp, Artificial Sequence
  chemically synthesized
aactttcttaagtgttcatgtg

SEQ ID NO: 959782 - DNA, 22 bp, Artificial Sequence
  chemically synthesized
ccccatttaactttcttaagtg

SEQ ID NO: 959783 - DNA, 22 bp, Artificial Sequence
  chemically synthesized
gccccatttaactttcttaagt

SEQ ID NO: 959784 - DNA, 22 bp, Artificial Sequence
  chemically synthesized
acatgaacacttaagaaagtta

SEQ ID NO: 959785 - DNA, 22 bp, Artificial Sequence
  chemically synthesized
ccttgccccatttaactttctt

SEQ ID NO: 959786 - DNA, 22 bp, Artificial Sequence
  chemically synthesized
tgccttgccccatttaactttc

SEQ ID NO: 959787 - DNA, 22 bp, Artificial Sequence
  chemically synthesized
ctgccttgccccatttaacttt

SEQ ID NO: 959788 - DNA, 22 bp, Artificial Sequence
  chemically synthesized
atacatttctgccttgccccat

SEQ ID NO: 959789 - DNA, 22 bp, Artificial Sequence
  chemically synthesized
aagaaagttaaatggggcaagg

SEQ ID NO: 959790 - DNA, 22 bp, Artificial Sequence
  chemically synthesized
agaaagttaaatggggcaaggc

SEQ ID NO: 959791 - DNA, 22 bp, Artificial Sequence
  chemically synthesized
aatggggcaaggcagaaatgta

SEQ ID NO: 959792 - DNA, 22 bp, Artificial Sequence
  chemically synthesized
tataaagagctgatacatttct

SEQ ID NO: 959793 - DNA, 22 bp, Artificial Sequence
  chemically synthesized
aaaatagtattgtataaagagc

SEQ ID NO: 959794 - DNA, 22 bp, Artificial Sequence
  chemically synthesized
aaacaaattaaaaatagtattg

SEQ ID NO: 959795 - DNA, 22 bp, Artificial Sequence
  chemically synthesized
attaaaacaaattaaaaatagt

SEQ ID NO: 959796 - DNA, 22 bp, Artificial Sequence
  chemically synthesized
tttatacaatactatttttaat

SEQ ID NO: 959797 - DNA, 22 bp, Artificial Sequence
  chemically synthesized
tatacaatactatttttaattt

SEQ ID NO: 959798 - DNA, 22 bp, Artificial Sequence
  chemically synthesized
atacaatactatttttaatttg

SEQ ID NO: 959799 - DNA, 22 bp, Artificial Sequence
  chemically synthesized
tacaatactatttttaatttgt

SEQ ID NO: 959800 - DNA, 22 bp, Artificial Sequence
  chemically synthesized
tttttaatttgttttaatgagc

SEQ ID NO: 959801 - DNA, 22 bp, Artificial Sequence
  chemically synthesized
ttaatttgttttaatgagcatg

SEQ ID NO: 959802 - DNA, 22 bp, Artificial Sequence
  chemically synthesized
taatttgttttaatgagcatgt

SEQ ID NO: 959803 - DNA, 22 bp, Artificial Sequence
  chemically synthesized
aatttgttttaatgagcatgtg

SEQ ID NO: 959804 - DNA, 22 bp, Artificial Sequence
  chemically synthesized
atttgttttaatgagcatgtgt

SEQ ID NO: 959805 - DNA, 22 bp, Artificial Sequence
  chemically synthesized
gttttaatgagcatgtgttact

SEQ ID NO: 959806 - DNA, 22 bp, Artificial Sequence
  chemically synthesized
ccgatatacaaaagtaacacat

SEQ ID NO: 959807 - DNA, 22 bp, Artificial Sequence
  chemically synthesized
ttttaatgagcatgtgttactt

SEQ ID NO: 959808 - DNA, 22 bp, Artificial Sequence
  chemically synthesized
taatgagcatgtgttacttttg

SEQ ID NO: 959809 - DNA, 22 bp, Artificial Sequence
  chemically synthesized
aatgagcatgtgttacttttgt

SEQ ID NO: 959810 - DNA, 22 bp, Artificial Sequence
  chemically synthesized
atgagcatgtgttacttttgta

SEQ ID NO: 959811 - DNA, 22 bp, Artificial Sequence
  chemically synthesized
agaaacgtattcccgatataca

SEQ ID NO: 959812 - DNA, 22 bp, Artificial Sequence
  chemically synthesized
aagaaacgtattcccgatatac

SEQ ID NO: 959813 - DNA, 22 bp, Artificial Sequence
  chemically synthesized
taagaaacgtattcccgatata

SEQ ID NO: 959814 - DNA, 22 bp, Artificial Sequence
  chemically synthesized
ttaagaaacgtattcccgatat

SEQ ID NO: 959815 - DNA, 22 bp, Artificial Sequence
  chemically synthesized
tttaagaaacgtattcccgata

SEQ ID NO: 959816 - DNA, 22 bp, Artificial Sequence
  chemically synthesized
cttttgtatatcgggaatacgt

SEQ ID NO: 959817 - DNA, 22 bp, Artificial Sequence
  chemically synthesized
tactttttaagaaacgtattcc

SEQ ID NO: 959818 - DNA, 22 bp, Artificial Sequence
  chemically synthesized
atactttttaagaaacgtattc

SEQ ID NO: 959819 - DNA, 22 bp, Artificial Sequence
  chemically synthesized
ttgtatatcgggaatacgtttc

SEQ ID NO: 959820 - DNA, 22 bp, Artificial Sequence
  chemically synthesized
tgtatatcgggaatacgtttct

SEQ ID NO: 959821 - DNA, 22 bp, Artificial Sequence
  chemically synthesized
gtatatcgggaatacgtttctt

SEQ ID NO: 959822 - DNA, 22 bp, Artificial Sequence
  chemically synthesized
cttatactttttaagaaacgta

SEQ ID NO: 959823 - DNA, 22 bp, Artificial Sequence
  chemically synthesized
tatatcgggaatacgtttctta

SEQ ID NO: 959824 - DNA, 22 bp, Artificial Sequence
  chemically synthesized
acttatactttttaagaaacgt

SEQ ID NO: 959825 - DNA, 22 bp, Artificial Sequence
  chemically synthesized
tacttatactttttaagaaacg

SEQ ID NO: 959826 - DNA, 22 bp, Artificial Sequence
  chemically synthesized
ttacttatactttttaagaaac

SEQ ID NO: 959827 - DNA, 22 bp, Artificial Sequence
  chemically synthesized
tttacttatactttttaagaaa

SEQ ID NO: 959828 - DNA, 22 bp, Artificial Sequence
  chemically synthesized
aaatcctttttacttatacttt

SEQ ID NO: 959829 - DNA, 22 bp, Artificial Sequence
  chemically synthesized
taaaatcctttttacttatact

SEQ ID NO: 959830 - DNA, 22 bp, Artificial Sequence
  chemically synthesized
ttctaaaatcctttttacttat

SEQ ID NO: 959831 - DNA, 22 bp, Artificial Sequence
  chemically synthesized
attctaaaatcctttttactta

SEQ ID NO: 959832 - DNA, 22 bp, Artificial Sequence
  chemically synthesized
cttaaaaagtataagtaaaaag

SEQ ID NO: 959833 - DNA, 22 bp, Artificial Sequence
  chemically synthesized
ttaaaaagtataagtaaaaagg

SEQ ID NO: 959834 - DNA, 22 bp, Artificial Sequence
  chemically synthesized
aaaaagtataagtaaaaaggat

SEQ ID NO: 959835 - DNA, 22 bp, Artificial Sequence
  chemically synthesized
aaaagtataagtaaaaaggatt

SEQ ID NO: 959836 - DNA, 22 bp, Artificial Sequence
  chemically synthesized
catttattctaaaatccttttt

SEQ ID NO: 959837 - DNA, 22 bp, Artificial Sequence
  chemically synthesized
ccatttattctaaaatcctttt

SEQ ID NO: 959838 - DNA, 22 bp, Artificial Sequence
  chemically synthesized
aaacttccatttattctaaaat

SEQ ID NO: 959839 - DNA, 22 bp, Artificial Sequence
  chemically synthesized
aaaacttccatttattctaaaa

SEQ ID NO: 959840 - DNA, 22 bp, Artificial Sequence
  chemically synthesized
taaaacttccatttattctaaa

SEQ ID NO: 959841 - DNA, 22 bp, Artificial Sequence
  chemically synthesized
ttttaaaacttccatttattct

SEQ ID NO: 959842 - DNA, 22 bp, Artificial Sequence
  chemically synthesized
gttttaaaacttccatttattc

SEQ ID NO: 959843 - DNA, 22 bp, Artificial Sequence
  chemically synthesized
cttgttttaaaacttccattta

SEQ ID NO: 959844 - DNA, 22 bp, Artificial Sequence
  chemically synthesized
tagaataaatggaagttttaaa

SEQ ID NO: 959845 - DNA, 22 bp, Artificial Sequence
  chemically synthesized
agaataaatggaagttttaaaa

SEQ ID NO: 959846 - DNA, 22 bp, Artificial Sequence
  chemically synthesized
gaataaatggaagttttaaaac

SEQ ID NO: 959847 - DNA, 22 bp, Artificial Sequence
  chemically synthesized
atatggcaagctgcttgtttta

SEQ ID NO: 959848 - DNA, 22 bp, Artificial Sequence
  chemically synthesized
catatggcaagctgcttgtttt

SEQ ID NO: 959849 - DNA, 22 bp, Artificial Sequence
  chemically synthesized
ttcatatggcaagctgcttgtt

SEQ ID NO: 959850 - DNA, 22 bp, Artificial Sequence
  chemically synthesized
taaaacaagcagcttgccatat

SEQ ID NO: 959851 - DNA, 22 bp, Artificial Sequence
  chemically synthesized
aaaacaagcagcttgccatatg

SEQ ID NO: 959852 - DNA, 22 bp, Artificial Sequence
  chemically synthesized
gtatgaattcttcatatggcaa

SEQ ID NO: 959853 - DNA, 22 bp, Artificial Sequence
  chemically synthesized
aaacaagcagcttgccatatga

SEQ ID NO: 959854 - DNA, 22 bp, Artificial Sequence
  chemically synthesized
gccatatgaagaattcatacta

SEQ ID NO: 959855 - DNA, 22 bp, Artificial Sequence
  chemically synthesized
atccaaaaagactagtatgaat

SEQ ID NO: 959856 - DNA, 22 bp, Artificial Sequence
  chemically synthesized
ccatatgaagaattcatactag

SEQ ID NO: 959857 - DNA, 22 bp, Artificial Sequence
  chemically synthesized
aaacattcatccaaaaagacta

SEQ ID NO: 959858 - DNA, 22 bp, Artificial Sequence
  chemically synthesized
aaaacattcatccaaaaagact

SEQ ID NO: 959859 - DNA, 22 bp, Artificial Sequence
  chemically synthesized
tttaaaacattcatccaaaaag

SEQ ID NO: 959860 - DNA, 22 bp, Artificial Sequence
  chemically synthesized
atactagtctttttggatgaat

SEQ ID NO: 959861 - DNA, 22 bp, Artificial Sequence
  chemically synthesized
acctatttaaaacattcatcca

SEQ ID NO: 959862 - DNA, 22 bp, Artificial Sequence
  chemically synthesized
gtctttttggatgaatgtttta

SEQ ID NO: 959863 - DNA, 22 bp, Artificial Sequence
  chemically synthesized
agcgtgttaacctatttaaaac

SEQ ID NO: 959864 - DNA, 22 bp, Artificial Sequence
  chemically synthesized
tttggatgaatgttttaaatag

SEQ ID NO: 959865 - DNA, 22 bp, Artificial Sequence
  chemically synthesized
ttggatgaatgttttaaatagg

SEQ ID NO: 959866 - DNA, 22 bp, Artificial Sequence
  chemically synthesized
tggatgaatgttttaaataggt

SEQ ID NO: 959867 - DNA, 22 bp, Artificial Sequence
  chemically synthesized
ctgagcgtgttaacctatttaa

SEQ ID NO: 959868 - DNA, 22 bp, Artificial Sequence
  chemically synthesized
ggatgaatgttttaaataggtt

SEQ ID NO: 959869 - DNA, 22 bp, Artificial Sequence
  chemically synthesized
actgagcgtgttaacctattta

SEQ ID NO: 959870 - DNA, 22 bp, Artificial Sequence
  chemically synthesized
gatgaatgttttaaataggtta

SEQ ID NO: 959871 - DNA, 22 bp, Artificial Sequence
  chemically synthesized
tactgagcgtgttaacctattt

SEQ ID NO: 959872 - DNA, 22 bp, Artificial Sequence
  chemically synthesized
aattttactgagcgtgttaacc

SEQ ID NO: 959873 - DNA, 22 bp, Artificial Sequence
  chemically synthesized
taaataggttaacacgctcagt

SEQ ID NO: 959874 - DNA, 22 bp, Artificial Sequence
  chemically synthesized
aaataggttaacacgctcagta

SEQ ID NO: 959875 - DNA, 22 bp, Artificial Sequence
  chemically synthesized
aataggttaacacgctcagtaa

SEQ ID NO: 959876 - DNA, 22 bp, Artificial Sequence
  chemically synthesized
tgcagattaaattttactgagc

SEQ ID NO: 959877 - DNA, 22 bp, Artificial Sequence
  chemically synthesized
gtgcagattaaattttactgag

SEQ ID NO: 959878 - DNA, 22 bp, Artificial Sequence
  chemically synthesized
acacgctcagtaaaatttaatc

SEQ ID NO: 959879 - DNA, 22 bp, Artificial Sequence
  chemically synthesized
agtaaaatttaatctgcacaaa

SEQ ID NO: 959880 - DNA, 22 bp, Artificial Sequence
  chemically synthesized
tgtaagacaaagccatttgtgc

SEQ ID NO: 959881 - DNA, 22 bp, Artificial Sequence
  chemically synthesized
tgtgtaagacaaagccatttgt

SEQ ID NO: 959882 - DNA, 22 bp, Artificial Sequence
  chemically synthesized
tctgtgtaagacaaagccattt

SEQ ID NO: 959883 - DNA, 22 bp, Artificial Sequence
  chemically synthesized
aatctgcacaaatggctttgtc

SEQ ID NO: 959884 - DNA, 22 bp, Artificial Sequence
  chemically synthesized
atctgcacaaatggctttgtct

SEQ ID NO: 959885 - DNA, 22 bp, Artificial Sequence
  chemically synthesized
cacaaatggctttgtcttacac

SEQ ID NO: 959886 - DNA, 22 bp, Artificial Sequence
  chemically synthesized
cacatagatcctctctgtgtaa

SEQ ID NO: 959887 - DNA, 22 bp, Artificial Sequence
  chemically synthesized
ccacatagatcctctctgtgta

SEQ ID NO: 959888 - DNA, 22 bp, Artificial Sequence
  chemically synthesized
tccacatagatcctctctgtgt

SEQ ID NO: 959889 - DNA, 22 bp, Artificial Sequence
  chemically synthesized
ttttccacatagatcctctctg

SEQ ID NO: 959890 - DNA, 22 bp, Artificial Sequence
  chemically synthesized
tgttttccacatagatcctctc

SEQ ID NO: 959891 - DNA, 22 bp, Artificial Sequence
  chemically synthesized
tgtcttacacagagaggatcta

SEQ ID NO: 959892 - DNA, 22 bp, Artificial Sequence
  chemically synthesized
gtcttacacagagaggatctat

SEQ ID NO: 959893 - DNA, 22 bp, Artificial Sequence
  chemically synthesized
tcttacacagagaggatctatg

SEQ ID NO: 959894 - DNA, 22 bp, Artificial Sequence
  chemically synthesized
gttctgttttccacatagatcc

SEQ ID NO: 959895 - DNA, 22 bp, Artificial Sequence
  chemically synthesized
ggttctgttttccacatagatc

SEQ ID NO: 959896 - DNA, 22 bp, Artificial Sequence
  chemically synthesized
tggttctgttttccacatagat

SEQ ID NO: 959897 - DNA, 22 bp, Artificial Sequence
  chemically synthesized
acacagagaggatctatgtgga

SEQ ID NO: 959898 - DNA, 22 bp, Artificial Sequence
  chemically synthesized
ttggttctgttttccacataga

SEQ ID NO: 959899 - DNA, 22 bp, Artificial Sequence
  chemically synthesized
cacagagaggatctatgtggaa

SEQ ID NO: 959900 - DNA, 22 bp, Artificial Sequence
  chemically synthesized
gcttttggttctgttttccaca

SEQ ID NO: 959901 - DNA, 22 bp, Artificial Sequence
  chemically synthesized
gactggcttttggttctgtttt

SEQ ID NO: 959902 - DNA, 22 bp, Artificial Sequence
  chemically synthesized
ggactggcttttggttctgttt

SEQ ID NO: 959903 - DNA, 22 bp, Artificial Sequence
  chemically synthesized
tttggactggcttttggttctg

SEQ ID NO: 959904 - DNA, 22 bp, Artificial Sequence
  chemically synthesized
gtttggactggcttttggttct

SEQ ID NO: 959905 - DNA, 22 bp, Artificial Sequence
  chemically synthesized
tgtggaaaacagaaccaaaagc

SEQ ID NO: 959906 - DNA, 22 bp, Artificial Sequence
  chemically synthesized
cttgtttggactggcttttggt

SEQ ID NO: 959907 - DNA, 22 bp, Artificial Sequence
  chemically synthesized
acttgtttggactggcttttgg

SEQ ID NO: 959908 - DNA, 22 bp, Artificial Sequence
  chemically synthesized
tacttgtttggactggcttttg

SEQ ID NO: 959909 - DNA, 22 bp, Artificial Sequence
  chemically synthesized
ttttacttgtttggactggctt

SEQ ID NO: 959910 - DNA, 22 bp, Artificial Sequence
  chemically synthesized
tgttttacttgtttggactggc

SEQ ID NO: 959911 - DNA, 22 bp, Artificial Sequence
  chemically synthesized
ctgttttacttgtttggactgg

SEQ ID NO: 959912 - DNA, 22 bp, Artificial Sequence
  chemically synthesized
agtttctgttttacttgtttgg

SEQ ID NO: 959913 - DNA, 22 bp, Artificial Sequence
  chemically synthesized
cattcagtttctgttttacttg

SEQ ID NO: 959914 - DNA, 22 bp, Artificial Sequence
  chemically synthesized
tacattcagtttctgttttact

SEQ ID NO: 959915 - DNA, 22 bp, Artificial Sequence
  chemically synthesized
caactctacattcagtttctgt

SEQ ID NO: 959916 - DNA, 22 bp, Artificial Sequence
  chemically synthesized
aatatcagttccaactctacat

SEQ ID NO: 959917 - DNA, 22 bp, Artificial Sequence
  chemically synthesized
aatgtagagttggaactgatat

SEQ ID NO: 959918 - DNA, 22 bp, Artificial Sequence
  chemically synthesized
atccaaaattgaatatcagttc

SEQ ID NO: 959919 - DNA, 22 bp, Artificial Sequence
  chemically synthesized
taatccaaaattgaatatcagt

SEQ ID NO: 959920 - DNA, 22 bp, Artificial Sequence
  chemically synthesized
ctaatccaaaattgaatatcag

SEQ ID NO: 959921 - DNA, 22 bp, Artificial Sequence
  chemically synthesized
gaactgatattcaattttggat

SEQ ID NO: 959922 - DNA, 22 bp, Artificial Sequence
  chemically synthesized
aataatcagtttctaatccaaa

SEQ ID NO: 959923 - DNA, 22 bp, Artificial Sequence
  chemically synthesized
caataatcagtttctaatccaa

SEQ ID NO: 959924 - DNA, 22 bp, Artificial Sequence
  chemically synthesized
tcaataatcagtttctaatcca

SEQ ID NO: 959925 - DNA, 22 bp, Artificial Sequence
  chemically synthesized
atattcaattttggattagaaa

SEQ ID NO: 959926 - DNA, 22 bp, Artificial Sequence
  chemically synthesized
ctttcaataatcagtttctaat

SEQ ID NO: 959927 - DNA, 22 bp, Artificial Sequence
  chemically synthesized
cctttcaataatcagtttctaa

SEQ ID NO: 959928 - DNA, 22 bp, Artificial Sequence
  chemically synthesized
tcctttcaataatcagtttcta

SEQ ID NO: 959929 - DNA, 22 bp, Artificial Sequence
  chemically synthesized
ttcctttcaataatcagtttct

SEQ ID NO: 959930 - DNA, 22 bp, Artificial Sequence
  chemically synthesized
aattttggattagaaactgatt

SEQ ID NO: 959931 - DNA, 22 bp, Artificial Sequence
  chemically synthesized
tttcctttcaataatcagtttc

SEQ ID NO: 959932 - DNA, 22 bp, Artificial Sequence
  chemically synthesized
ttttcctttcaataatcagttt

SEQ ID NO: 959933 - DNA, 22 bp, Artificial Sequence
  chemically synthesized
tttttcctttcaataatcagtt

SEQ ID NO: 959934 - DNA, 22 bp, Artificial Sequence
  chemically synthesized
ttttttcctttcaataatcagt

SEQ ID NO: 959935 - DNA, 22 bp, Artificial Sequence
  chemically synthesized
tggattagaaactgattattga

SEQ ID NO: 959936 - DNA, 22 bp, Artificial Sequence
  chemically synthesized
ggattagaaactgattattgaa

SEQ ID NO: 959937 - DNA, 22 bp, Artificial Sequence
  chemically synthesized
gattagaaactgattattgaaa

SEQ ID NO: 959938 - DNA, 22 bp, Artificial Sequence
  chemically synthesized
tgtttttttttcctttcaataa

SEQ ID NO: 959939 - DNA, 22 bp, Artificial Sequence
  chemically synthesized
ctgtgtttttttttcctttcaa

SEQ ID NO: 959940 - DNA, 22 bp, Artificial Sequence
  chemically synthesized
gaaactgattattgaaaggaaa

SEQ ID NO: 959941 - DNA, 22 bp, Artificial Sequence
  chemically synthesized
aaattactgtgtttttttttcc

SEQ ID NO: 959942 - DNA, 22 bp, Artificial Sequence
  chemically synthesized
attattgaaaggaaaaaaaaac

SEQ ID NO: 959943 - DNA, 22 bp, Artificial Sequence
  chemically synthesized
ttgaaaggaaaaaaaaacacag

SEQ ID NO: 959944 - DNA, 22 bp, Artificial Sequence
  chemically synthesized
aaaggaaaaaaaaacacagtaa

SEQ ID NO: 959945 - DNA, 22 bp, Artificial Sequence
  chemically synthesized
aaacagcagatctgaaattact

SEQ ID NO: 959946 - DNA, 22 bp, Artificial Sequence
  chemically synthesized
ctgaaacagcagatctgaaatt

SEQ ID NO: 959947 - DNA, 22 bp, Artificial Sequence
  chemically synthesized
actgaaacagcagatctgaaat

SEQ ID NO: 959948 - DNA, 22 bp, Artificial Sequence
  chemically synthesized
gtgtcaggtttactgaaacagc

SEQ ID NO: 959949 - DNA, 22 bp, Artificial Sequence
  chemically synthesized
cagatctgctgtttcagtaaac

SEQ ID NO: 959950 - DNA, 22 bp, Artificial Sequence
  chemically synthesized
agatctgctgtttcagtaaacc

SEQ ID NO: 959951 - DNA, 22 bp, Artificial Sequence
  chemically synthesized
agattagtgtcaggtttactga

SEQ ID NO: 959952 - DNA, 22 bp, Artificial Sequence
  chemically synthesized
ctgtttcagtaaacctgacact

SEQ ID NO: 959953 - DNA, 22 bp, Artificial Sequence
  chemically synthesized
aaaaactcagattagtgtcagg

SEQ ID NO: 959954 - DNA, 22 bp, Artificial Sequence
  chemically synthesized
aaaaaactcagattagtgtcag

SEQ ID NO: 959955 - DNA, 22 bp, Artificial Sequence
  chemically synthesized
tttcagtaaacctgacactaat

SEQ ID NO: 959956 - DNA, 22 bp, Artificial Sequence
  chemically synthesized
taaaaaactcagattagtgtca

SEQ ID NO: 959957 - DNA, 22 bp, Artificial Sequence
  chemically synthesized
ttaaaaaactcagattagtgtc

SEQ ID NO: 959958 - DNA, 22 bp, Artificial Sequence
  chemically synthesized
tttaaaaaactcagattagtgt

SEQ ID NO: 959959 - DNA, 22 bp, Artificial Sequence
  chemically synthesized
cagtaaacctgacactaatctg

SEQ ID NO: 959960 - DNA, 22 bp, Artificial Sequence
  chemically synthesized
ttttaaaaaactcagattagtg

SEQ ID NO: 959961 - DNA, 22 bp, Artificial Sequence
  chemically synthesized
agtaaacctgacactaatctga

SEQ ID NO: 959962 - DNA, 22 bp, Artificial Sequence
  chemically synthesized
atttttttaaaaaactcagatt

SEQ ID NO: 959963 - DNA, 22 bp, Artificial Sequence
  chemically synthesized
acactaatctgagttttttaaa

SEQ ID NO: 959964 - DNA, 22 bp, Artificial Sequence
  chemically synthesized
tcagaattaatttttttaaaaa

SEQ ID NO: 959965 - DNA, 22 bp, Artificial Sequence
  chemically synthesized
gtcagaattaatttttttaaaa

SEQ ID NO: 959966 - DNA, 22 bp, Artificial Sequence
  chemically synthesized
tgtcagaattaatttttttaaa

SEQ ID NO: 959967 - DNA, 22 bp, Artificial Sequence
  chemically synthesized
atctgagttttttaaaaaaatt

SEQ ID NO: 959968 - DNA, 22 bp, Artificial Sequence
  chemically synthesized
aagctttgtcagaattaatttt

SEQ ID NO: 959969 - DNA, 22 bp, Artificial Sequence
  chemically synthesized
agttttttaaaaaaattaattc

SEQ ID NO: 959970 - DNA, 22 bp, Artificial Sequence
  chemically synthesized
tctcaagctttgtcagaattaa

SEQ ID NO: 959971 - DNA, 22 bp, Artificial Sequence
  chemically synthesized
tttaaaaaaattaattctgaca

SEQ ID NO: 959972 - DNA, 22 bp, Artificial Sequence
  chemically synthesized
ttaaaaaaattaattctgacaa

SEQ ID NO: 959973 - DNA, 22 bp, Artificial Sequence
  chemically synthesized
taaaaaaattaattctgacaaa

SEQ ID NO: 959974 - DNA, 22 bp, Artificial Sequence
  chemically synthesized
aaaaaaattaattctgacaaag

SEQ ID NO: 959975 - DNA, 22 bp, Artificial Sequence
  chemically synthesized
aaaaaattaattctgacaaagc

SEQ ID NO: 959976 - DNA, 22 bp, Artificial Sequence
  chemically synthesized
aaacattatctcaagctttgtc

SEQ ID NO: 959977 - DNA, 22 bp, Artificial Sequence
  chemically synthesized
ttaaaacattatctcaagcttt

SEQ ID NO: 959978 - DNA, 22 bp, Artificial Sequence
  chemically synthesized
attctgacaaagcttgagataa

SEQ ID NO: 959979 - DNA, 22 bp, Artificial Sequence
  chemically synthesized
actattaaaacattatctcaag

SEQ ID NO: 959980 - DNA, 22 bp, Artificial Sequence
  chemically synthesized
tgacaaagcttgagataatgtt

SEQ ID NO: 959981 - DNA, 22 bp, Artificial Sequence
  chemically synthesized
acaaagcttgagataatgtttt

SEQ ID NO: 959982 - DNA, 22 bp, Artificial Sequence
  chemically synthesized
tagtgactcactattaaaacat

SEQ ID NO: 959983 - DNA, 22 bp, Artificial Sequence
  chemically synthesized
gtagtgactcactattaaaaca

SEQ ID NO: 959984 - DNA, 22 bp, Artificial Sequence
  chemically synthesized
tgtagtgactcactattaaaac

SEQ ID NO: 959985 - DNA, 22 bp, Artificial Sequence
  chemically synthesized
ctttgtagtgactcactattaa

SEQ ID NO: 959986 - DNA, 22 bp, Artificial Sequence
  chemically synthesized
gagataatgttttaatagtgag

SEQ ID NO: 959987 - DNA, 22 bp, Artificial Sequence
  chemically synthesized
agataatgttttaatagtgagt

SEQ ID NO: 959988 - DNA, 22 bp, Artificial Sequence
  chemically synthesized
atagttactttgtagtgactca

SEQ ID NO: 959989 - DNA, 22 bp, Artificial Sequence
  chemically synthesized
aatagttactttgtagtgactc

SEQ ID NO: 959990 - DNA, 22 bp, Artificial Sequence
  chemically synthesized
taatagtgagtcactacaaagt

SEQ ID NO: 959991 - DNA, 22 bp, Artificial Sequence
  chemically synthesized
aatagtgagtcactacaaagta

SEQ ID NO: 959992 - DNA, 22 bp, Artificial Sequence
  chemically synthesized
atagtgagtcactacaaagtaa

SEQ ID NO: 959993 - DNA, 22 bp, Artificial Sequence
  chemically synthesized
aatacttaatagttactttgta

SEQ ID NO: 959994 - DNA, 22 bp, Artificial Sequence
  chemically synthesized
aatgttgaatacttaatagtta

SEQ ID NO: 959995 - DNA, 22 bp, Artificial Sequence
  chemically synthesized
attgaatgttgaatacttaata

SEQ ID NO: 959996 - DNA, 22 bp, Artificial Sequence
  chemically synthesized
aattgaatgttgaatacttaat

SEQ ID NO: 959997 - DNA, 22 bp, Artificial Sequence
  chemically synthesized
caaagtaactattaagtattca

SEQ ID NO: 959998 - DNA, 22 bp, Artificial Sequence
  chemically synthesized
acttaattgaatgttgaatact

SEQ ID NO: 959999 - DNA, 22 bp, Artificial Sequence
  chemically synthesized
aattgacttaattgaatgttga

SEQ ID NO: 960000 - DNA, 22 bp, Artificial Sequence
  chemically synthesized
ttaagtattcaacattcaatta

SEQ ID NO: 960001 - DNA, 22 bp, Artificial Sequence
  chemically synthesized
agtattcaacattcaattaagt

SEQ ID NO: 960002 - DNA, 22 bp, Artificial Sequence
  chemically synthesized
aacattcaattaagtcaattca

SEQ ID NO: 960003 - DNA, 22 bp, Artificial Sequence
  chemically synthesized
aaacatcaaaagctgaattgac

SEQ ID NO: 960004 - DNA, 22 bp, Artificial Sequence
  chemically synthesized
gctgaaacatcaaaagctgaat

SEQ ID NO: 960005 - DNA, 22 bp, Artificial Sequence
  chemically synthesized
aattaagtcaattcagcttttg

SEQ ID NO: 960006 - DNA, 22 bp, Artificial Sequence
  chemically synthesized
cctggctgaaacatcaaaagct

SEQ ID NO: 960007 - DNA, 22 bp, Artificial Sequence
  chemically synthesized
acctggctgaaacatcaaaagc

SEQ ID NO: 960008 - DNA, 22 bp, Artificial Sequence
  chemically synthesized
agtcaattcagcttttgatgtt

SEQ ID NO: 960009 - DNA, 22 bp, Artificial Sequence
  chemically synthesized
agcatttacctggctgaaacat

SEQ ID NO: 960010 - DNA, 22 bp, Artificial Sequence
  chemically synthesized
agcttttgatgtttcagccagg

SEQ ID NO: 960011 - DNA, 22 bp, Artificial Sequence
  chemically synthesized
ttgatgtttcagccaggtaaat

SEQ ID NO: 960012 - DNA, 22 bp, Artificial Sequence
  chemically synthesized
tgatgtttcagccaggtaaatg

SEQ ID NO: 960013 - DNA, 22 bp, Artificial Sequence
  chemically synthesized
gatgtttcagccaggtaaatgc

SEQ ID NO: 960014 - DNA, 22 bp, Artificial Sequence
  chemically synthesized
atgtttcagccaggtaaatgct

SEQ ID NO: 960015 - DNA, 22 bp, Artificial Sequence
  chemically synthesized
tatccacacatgttgagcattt

SEQ ID NO: 960016 - DNA, 22 bp, Artificial Sequence
  chemically synthesized
cagccaggtaaatgctcaacat

SEQ ID NO: 960017 - DNA, 22 bp, Artificial Sequence
  chemically synthesized
agccaggtaaatgctcaacatg

SEQ ID NO: 960018 - DNA, 22 bp, Artificial Sequence
  chemically synthesized
aacatgtgtggatataacacat

SEQ ID NO: 960019 - DNA, 22 bp, Artificial Sequence
  chemically synthesized
cacaaatggaaaagtataacat

SEQ ID NO: 960020 - DNA, 22 bp, Artificial Sequence
  chemically synthesized
tgcacaaatggaaaagtataac

SEQ ID NO: 960021 - DNA, 22 bp, Artificial Sequence
  chemically synthesized
agtagaaaattctgcacaaatg

SEQ ID NO: 960022 - DNA, 22 bp, Artificial Sequence
  chemically synthesized
gagtagaaaattctgcacaaat

SEQ ID NO: 960023 - DNA, 22 bp, Artificial Sequence
  chemically synthesized
tacttttccatttgtgcagaat

SEQ ID NO: 960024 - DNA, 22 bp, Artificial Sequence
  chemically synthesized
tttgagtagaaaattctgcaca

SEQ ID NO: 960025 - DNA, 22 bp, Artificial Sequence
  chemically synthesized
ttccatttgtgcagaattttct

SEQ ID NO: 960026 - DNA, 22 bp, Artificial Sequence
  chemically synthesized
tccatttgtgcagaattttcta

SEQ ID NO: 960027 - DNA, 22 bp, Artificial Sequence
  chemically synthesized
ccatttgtgcagaattttctac

SEQ ID NO: 960028 - DNA, 22 bp, Artificial Sequence
  chemically synthesized
catttgtgcagaattttctact

SEQ ID NO: 960029 - DNA, 22 bp, Artificial Sequence
  chemically synthesized
aaacattatttgagtagaaaat

SEQ ID NO: 960030 - DNA, 22 bp, Artificial Sequence
  chemically synthesized
aaaacattatttgagtagaaaa

SEQ ID NO: 960031 - DNA, 22 bp, Artificial Sequence
  chemically synthesized
gtgcagaattttctactcaaat

SEQ ID NO: 960032 - DNA, 22 bp, Artificial Sequence
  chemically synthesized
tgcagaattttctactcaaata

SEQ ID NO: 960033 - DNA, 22 bp, Artificial Sequence
  chemically synthesized
gacatacttaaaacattatttg

SEQ ID NO: 960034 - DNA, 22 bp, Artificial Sequence
  chemically synthesized
tctactcaaataatgttttaag

SEQ ID NO: 960035 - DNA, 22 bp, Artificial Sequence
  chemically synthesized
ctactcaaataatgttttaagt

SEQ ID NO: 960036 - DNA, 22 bp, Artificial Sequence
  chemically synthesized
tactcaaataatgttttaagta

SEQ ID NO: 960037 - DNA, 22 bp, Artificial Sequence
  chemically synthesized
ctcaaataatgttttaagtatg

SEQ ID NO: 960038 - DNA, 22 bp, Artificial Sequence
  chemically synthesized
aaataatgttttaagtatgtct

SEQ ID NO: 960039 - DNA, 22 bp, Artificial Sequence
  chemically synthesized
taagtatgtctaacacacacac

SEQ ID NO: 960040 - DNA, 22 bp, Artificial Sequence
  chemically synthesized
aagtatgtctaacacacacaca

SEQ ID NO: 960041 - DNA, 22 bp, Artificial Sequence
  chemically synthesized
agtatgtctaacacacacacac

SEQ ID NO: 960042 - DNA, 22 bp, Artificial Sequence
  chemically synthesized
acacacacacacacacacacac

SEQ ID NO: 960043 - DNA, 22 bp, Artificial Sequence
  chemically synthesized
aaggatatggatatataatcat

SEQ ID NO: 960044 - DNA, 22 bp, Artificial Sequence
  chemically synthesized
ttgaaggatatggatatataat

SEQ ID NO: 960045 - DNA, 22 bp, Artificial Sequence
  chemically synthesized
gttgaaggatatggatatataa

SEQ ID NO: 960046 - DNA, 22 bp, Artificial Sequence
  chemically synthesized
tgttgaaggatatggatatata

SEQ ID NO: 960047 - DNA, 22 bp, Artificial Sequence
  chemically synthesized
agattttgttgaaggatatgga

SEQ ID NO: 960048 - DNA, 22 bp, Artificial Sequence
  chemically synthesized
tatatccatatccttcaacaaa

SEQ ID NO: 960049 - DNA, 22 bp, Artificial Sequence
  chemically synthesized
tagtgaaggcatattcagattt

SEQ ID NO: 960050 - DNA, 22 bp, Artificial Sequence
  chemically synthesized
atagtgaaggcatattcagatt

SEQ ID NO: 960051 - DNA, 22 bp, Artificial Sequence
  chemically synthesized
caacaaaatctgaatatgcctt

SEQ ID NO: 960052 - DNA, 22 bp, Artificial Sequence
  chemically synthesized
aacaaaatctgaatatgccttc

SEQ ID NO: 960053 - DNA, 22 bp, Artificial Sequence
  chemically synthesized
atcaaaagatttatagtgaagg

SEQ ID NO: 960054 - DNA, 22 bp, Artificial Sequence
  chemically synthesized
acctaatcaaaagatttatagt

SEQ ID NO: 960055 - DNA, 22 bp, Artificial Sequence
  chemically synthesized
aatatgccttcactataaatct

SEQ ID NO: 960056 - DNA, 22 bp, Artificial Sequence
  chemically synthesized
taacctaatcaaaagatttata

SEQ ID NO: 960057 - DNA, 22 bp, Artificial Sequence
  chemically synthesized
ctaacctaatcaaaagatttat

SEQ ID NO: 960058 - DNA, 22 bp, Artificial Sequence
  chemically synthesized
tctaacctaatcaaaagattta

SEQ ID NO: 960059 - DNA, 22 bp, Artificial Sequence
  chemically synthesized
ttctaacctaatcaaaagattt

SEQ ID NO: 960060 - DNA, 22 bp, Artificial Sequence
  chemically synthesized
tcttttctaacctaatcaaaag

SEQ ID NO: 960061 - DNA, 22 bp, Artificial Sequence
  chemically synthesized
cactataaatcttttgattagg

SEQ ID NO: 960062 - DNA, 22 bp, Artificial Sequence
  chemically synthesized
actataaatcttttgattaggt

SEQ ID NO: 960063 - DNA, 22 bp, Artificial Sequence
  chemically synthesized
taaatcttttgattaggttaga

SEQ ID NO: 960064 - DNA, 22 bp, Artificial Sequence
  chemically synthesized
caaaggatagattgtcttttct

SEQ ID NO: 960065 - DNA, 22 bp, Artificial Sequence
  chemically synthesized
ttgattaggttagaaaagacaa

SEQ ID NO: 960066 - DNA, 22 bp, Artificial Sequence
  chemically synthesized
tgattaggttagaaaagacaat

SEQ ID NO: 960067 - DNA, 22 bp, Artificial Sequence
  chemically synthesized
gattaggttagaaaagacaatc

SEQ ID NO: 960068 - DNA, 22 bp, Artificial Sequence
  chemically synthesized
attaggttagaaaagacaatct

SEQ ID NO: 960069 - DNA, 22 bp, Artificial Sequence
  chemically synthesized
atcactccaaaggatagattgt

SEQ ID NO: 960070 - DNA, 22 bp, Artificial Sequence
  chemically synthesized
ggttagaaaagacaatctatcc

SEQ ID NO: 960071 - DNA, 22 bp, Artificial Sequence
  chemically synthesized
gaaaagacaatctatcctttgg

SEQ ID NO: 960072 - DNA, 22 bp, Artificial Sequence
  chemically synthesized
ataggcaattgatcactccaaa

SEQ ID NO: 960073 - DNA, 22 bp, Artificial Sequence
  chemically synthesized
tcctttggagtgatcaattgcc

SEQ ID NO: 960074 - DNA, 22 bp, Artificial Sequence
  chemically synthesized
tggagtgatcaattgcctatga

SEQ ID NO: 960075 - DNA, 22 bp, Artificial Sequence
  chemically synthesized
ggagtgatcaattgcctatgag

SEQ ID NO: 960076 - DNA, 22 bp, Artificial Sequence
  chemically synthesized
agggggacaaaactcataggca

SEQ ID NO: 960077 - DNA, 22 bp, Artificial Sequence
  chemically synthesized
gagtgatcaattgcctatgagt

SEQ ID NO: 960078 - DNA, 22 bp, Artificial Sequence
  chemically synthesized
agcagcagttgagggggacaaa

SEQ ID NO: 960079 - DNA, 22 bp, Artificial Sequence
  chemically synthesized
cctatgagttttgtccccctca

SEQ ID NO: 960080 - DNA, 22 bp, Artificial Sequence
  chemically synthesized
tgagttttgtccccctcaactg

SEQ ID NO: 960081 - DNA, 22 bp, Artificial Sequence
  chemically synthesized
tggactaagcagcagttgaggg

SEQ ID NO: 960082 - DNA, 22 bp, Artificial Sequence
  chemically synthesized
atggactaagcagcagttgagg

SEQ ID NO: 960083 - DNA, 22 bp, Artificial Sequence
  chemically synthesized
cgtttatggactaagcagcagt

SEQ ID NO: 960084 - DNA, 22 bp, Artificial Sequence
  chemically synthesized
tgtccccctcaactgctgctta

SEQ ID NO: 960085 - DNA, 22 bp, Artificial Sequence
  chemically synthesized
gtccccctcaactgctgcttag

SEQ ID NO: 960086 - DNA, 22 bp, Artificial Sequence
  chemically synthesized
tccccctcaactgctgcttagt

SEQ ID NO: 960087 - DNA, 22 bp, Artificial Sequence
  chemically synthesized
aggttccgtttatggactaagc

SEQ ID NO: 960088 - DNA, 22 bp, Artificial Sequence
  chemically synthesized
tgaggttccgtttatggactaa

SEQ ID NO: 960089 - DNA, 22 bp, Artificial Sequence
  chemically synthesized
ctgaggttccgtttatggacta

SEQ ID NO: 960090 - DNA, 22 bp, Artificial Sequence
  chemically synthesized
aactgctgcttagtccataaac

SEQ ID NO: 960091 - DNA, 22 bp, Artificial Sequence
  chemically synthesized
ctgcttagtccataaacggaac

SEQ ID NO: 960092 - DNA, 22 bp, Artificial Sequence
  chemically synthesized
cttagtccataaacggaacctc

SEQ ID NO: 960093 - DNA, 22 bp, Artificial Sequence
  chemically synthesized
cagcagaacttctgaggttccg

SEQ ID NO: 960094 - DNA, 22 bp, Artificial Sequence
  chemically synthesized
ccagcagaacttctgaggttcc

SEQ ID NO: 960095 - DNA, 22 bp, Artificial Sequence
  chemically synthesized
agtccataaacggaacctcaga

SEQ ID NO: 960096 - DNA, 22 bp, Artificial Sequence
  chemically synthesized
gtccataaacggaacctcagaa

SEQ ID NO: 960097 - DNA, 22 bp, Artificial Sequence
  chemically synthesized
tagcttccagcagaacttctga

SEQ ID NO: 960098 - DNA, 22 bp, Artificial Sequence
  chemically synthesized
aactgtagcttccagcagaact

SEQ ID NO: 960099 - DNA, 22 bp, Artificial Sequence
  chemically synthesized
caactgtagcttccagcagaac

SEQ ID NO: 960100 - DNA, 22 bp, Artificial Sequence
  chemically synthesized
agaagttctgctggaagctaca

SEQ ID NO: 960101 - DNA, 22 bp, Artificial Sequence
  chemically synthesized
tagaaagacttcaactgtagct

SEQ ID NO: 960102 - DNA, 22 bp, Artificial Sequence
  chemically synthesized
tgctggaagctacagttgaagt

SEQ ID NO: 960103 - DNA, 22 bp, Artificial Sequence
  chemically synthesized
ctggaagctacagttgaagtct

SEQ ID NO: 960104 - DNA, 22 bp, Artificial Sequence
  chemically synthesized
gaagctacagttgaagtctttc

SEQ ID NO: 960105 - DNA, 22 bp, Artificial Sequence
  chemically synthesized
gcaacgagaacattatagaaag

SEQ ID NO: 960106 - DNA, 22 bp, Artificial Sequence
  chemically synthesized
agcaacgagaacattatagaaa

SEQ ID NO: 960107 - DNA, 22 bp, Artificial Sequence
  chemically synthesized
cagttgaagtctttctataatg

SEQ ID NO: 960108 - DNA, 22 bp, Artificial Sequence
  chemically synthesized
aagtctttctataatgttctcg

SEQ ID NO: 960109 - DNA, 22 bp, Artificial Sequence
  chemically synthesized
aagtcttagcaacgagaacatt

SEQ ID NO: 960110 - DNA, 22 bp, Artificial Sequence
  chemically synthesized
taaagtcttagcaacgagaaca

SEQ ID NO: 960111 - DNA, 22 bp, Artificial Sequence
  chemically synthesized
gctctaaagtcttagcaacgag

SEQ ID NO: 960112 - DNA, 22 bp, Artificial Sequence
  chemically synthesized
tctataatgttctcgttgctaa

SEQ ID NO: 960113 - DNA, 22 bp, Artificial Sequence
  chemically synthesized
ctataatgttctcgttgctaag

SEQ ID NO: 960114 - DNA, 22 bp, Artificial Sequence
  chemically synthesized
tataatgttctcgttgctaaga

SEQ ID NO: 960115 - DNA, 22 bp, Artificial Sequence
  chemically synthesized
taatgttctcgttgctaagact

SEQ ID NO: 960116 - DNA, 22 bp, Artificial Sequence
  chemically synthesized
tggctagctctaaagtcttagc

SEQ ID NO: 960117 - DNA, 22 bp, Artificial Sequence
  chemically synthesized
tatggctagctctaaagtctta

SEQ ID NO: 960118 - DNA, 22 bp, Artificial Sequence
  chemically synthesized
ctatggctagctctaaagtctt

SEQ ID NO: 960119 - DNA, 22 bp, Artificial Sequence
  chemically synthesized
tttctatggctagctctaaagt

SEQ ID NO: 960120 - DNA, 22 bp, Artificial Sequence
  chemically synthesized
tcgttgctaagactttagagct

SEQ ID NO: 960121 - DNA, 22 bp, Artificial Sequence
  chemically synthesized
gtttctatggctagctctaaag

SEQ ID NO: 960122 - DNA, 22 bp, Artificial Sequence
  chemically synthesized
gttgctaagactttagagctag

SEQ ID NO: 960123 - DNA, 22 bp, Artificial Sequence
  chemically synthesized
ctaagactttagagctagccat

SEQ ID NO: 960124 - DNA, 22 bp, Artificial Sequence
  chemically synthesized
cagtttgtttctatggctagct

SEQ ID NO: 960125 - DNA, 22 bp, Artificial Sequence
  chemically synthesized
gcagtttgtttctatggctagc

SEQ ID NO: 960126 - DNA, 22 bp, Artificial Sequence
  chemically synthesized
agactttagagctagccataga

SEQ ID NO: 960127 - DNA, 22 bp, Artificial Sequence
  chemically synthesized
tagagctagccatagaaacaaa

SEQ ID NO: 960128 - DNA, 22 bp, Artificial Sequence
  chemically synthesized
agagctagccatagaaacaaac

SEQ ID NO: 960129 - DNA, 22 bp, Artificial Sequence
  chemically synthesized
gagctagccatagaaacaaact

SEQ ID NO: 960130 - DNA, 22 bp, Artificial Sequence
  chemically synthesized
gccatagaaacaaactgcaaat

SEQ ID NO: 960131 - DNA, 22 bp, Artificial Sequence
  chemically synthesized
cataaagcataaataacatttg

SEQ ID NO: 960132 - DNA, 22 bp, Artificial Sequence
  chemically synthesized
ctacataaagcataaataacat

SEQ ID NO: 960133 - DNA, 22 bp, Artificial Sequence
  chemically synthesized
actacataaagcataaataaca

SEQ ID NO: 960134 - DNA, 22 bp, Artificial Sequence
  chemically synthesized
tactacataaagcataaataac

SEQ ID NO: 960135 - DNA, 22 bp, Artificial Sequence
  chemically synthesized
tcattttactacataaagcata

SEQ ID NO: 960136 - DNA, 22 bp, Artificial Sequence
  chemically synthesized
caaatgttatttatgctttatg

SEQ ID NO: 960137 - DNA, 22 bp, Artificial Sequence
  chemically synthesized
aggttatcattttactacataa

SEQ ID NO: 960138 - DNA, 22 bp, Artificial Sequence
  chemically synthesized
tttatgctttatgtagtaaaat

SEQ ID NO: 960139 - DNA, 22 bp, Artificial Sequence
  chemically synthesized
tattcaggttatcattttacta

SEQ ID NO: 960140 - DNA, 22 bp, Artificial Sequence
  chemically synthesized
atattcaggttatcattttact

SEQ ID NO: 960141 - DNA, 22 bp, Artificial Sequence
  chemically synthesized
atgctttatgtagtaaaatgat

SEQ ID NO: 960142 - DNA, 22 bp, Artificial Sequence
  chemically synthesized
tgctttatgtagtaaaatgata

SEQ ID NO: 960143 - DNA, 22 bp, Artificial Sequence
  chemically synthesized
tatgtagtaaaatgataacctg

SEQ ID NO: 960144 - DNA, 22 bp, Artificial Sequence
  chemically synthesized
atgtagtaaaatgataacctga

SEQ ID NO: 960145 - DNA, 22 bp, Artificial Sequence
  chemically synthesized
tgtagtaaaatgataacctgaa

SEQ ID NO: 960146 - DNA, 22 bp, Artificial Sequence
  chemically synthesized
aatataagactgggtctcgatt

SEQ ID NO: 960147 - DNA, 22 bp, Artificial Sequence
  chemically synthesized
ggtctcgattatttgtttcatt

SEQ ID NO: 960148 - DNA, 22 bp, Artificial Sequence
  chemically synthesized
gagtgtggaaataaatgaaaca

SEQ ID NO: 960149 - DNA, 22 bp, Artificial Sequence
  chemically synthesized
ggagtgtggaaataaatgaaac

SEQ ID NO: 960150 - DNA, 22 bp, Artificial Sequence
  chemically synthesized
tggagtgtggaaataaatgaaa

SEQ ID NO: 960151 - DNA, 22 bp, Artificial Sequence
  chemically synthesized
ttggagtgtggaaataaatgaa

SEQ ID NO: 960152 - DNA, 22 bp, Artificial Sequence
  chemically synthesized
tttggagtgtggaaataaatga

SEQ ID NO: 960153 - DNA, 22 bp, Artificial Sequence
  chemically synthesized
gattatttgtttcatttatttc

SEQ ID NO: 960154 - DNA, 22 bp, Artificial Sequence
  chemically synthesized
gactttttggagtgtggaaata

SEQ ID NO: 960155 - DNA, 22 bp, Artificial Sequence
  chemically synthesized
tttgtttcatttatttccacac

SEQ ID NO: 960156 - DNA, 22 bp, Artificial Sequence
  chemically synthesized
gtttcatttatttccacactcc

SEQ ID NO: 960157 - DNA, 22 bp, Artificial Sequence
  chemically synthesized
tttcatttatttccacactcca

SEQ ID NO: 960158 - DNA, 22 bp, Artificial Sequence
  chemically synthesized
catttatttccacactccaaaa

SEQ ID NO: 960159 - DNA, 22 bp, Artificial Sequence
  chemically synthesized
tggatctagactttttggagtg

SEQ ID NO: 960160 - DNA, 22 bp, Artificial Sequence
  chemically synthesized
atttatttccacactccaaaaa

SEQ ID NO: 960161 - DNA, 22 bp, Artificial Sequence
  chemically synthesized
gtggatctagactttttggagt

SEQ ID NO: 960162 - DNA, 22 bp, Artificial Sequence
  chemically synthesized
tgtggatctagactttttggag

SEQ ID NO: 960163 - DNA, 22 bp, Artificial Sequence
  chemically synthesized
atttccacactccaaaaagtct

SEQ ID NO: 960164 - DNA, 22 bp, Artificial Sequence
  chemically synthesized
tttccacactccaaaaagtcta

SEQ ID NO: 960165 - DNA, 22 bp, Artificial Sequence
  chemically synthesized
cattttgtggatctagactttt

SEQ ID NO: 960166 - DNA, 22 bp, Artificial Sequence
  chemically synthesized
gcattttgtggatctagacttt

SEQ ID NO: 960167 - DNA, 22 bp, Artificial Sequence
  chemically synthesized
ccacactccaaaaagtctagat

SEQ ID NO: 960168 - DNA, 22 bp, Artificial Sequence
  chemically synthesized
cacactccaaaaagtctagatc

SEQ ID NO: 960169 - DNA, 22 bp, Artificial Sequence
  chemically synthesized
ggtttgcattttgtggatctag

SEQ ID NO: 960170 - DNA, 22 bp, Artificial Sequence
  chemically synthesized
caaaaagtctagatccacaaaa

SEQ ID NO: 960171 - DNA, 22 bp, Artificial Sequence
  chemically synthesized
tgcgtggaatcctaggtttgca

SEQ ID NO: 960172 - DNA, 22 bp, Artificial Sequence
  chemically synthesized
gatccacaaaatgcaaacctag

SEQ ID NO: 960173 - DNA, 22 bp, Artificial Sequence
  chemically synthesized
gtgcgtggaatcctaggtttgc

SEQ ID NO: 960174 - DNA, 22 bp, Artificial Sequence
  chemically synthesized
tgtgcgtggaatcctaggtttg

SEQ ID NO: 960175 - DNA, 22 bp, Artificial Sequence
  chemically synthesized
ttgtgcgtggaatcctaggttt

SEQ ID NO: 960176 - DNA, 22 bp, Artificial Sequence
  chemically synthesized
cacccttttgtgcgtggaatcc

SEQ ID NO: 960177 - DNA, 22 bp, Artificial Sequence
  chemically synthesized
gcacccttttgtgcgtggaatc

SEQ ID NO: 960178 - DNA, 22 bp, Artificial Sequence
  chemically synthesized
gtgtttgcacccttttgtgcgt

SEQ ID NO: 960179 - DNA, 22 bp, Artificial Sequence
  chemically synthesized
ggattccacgcacaaaagggtg

SEQ ID NO: 960180 - DNA, 22 bp, Artificial Sequence
  chemically synthesized
cacgcacaaaagggtgcaaaca

SEQ ID NO: 960181 - DNA, 22 bp, Artificial Sequence
  chemically synthesized
aaagatatgagaatcataaaag

SEQ ID NO: 960182 - DNA, 22 bp, Artificial Sequence
  chemically synthesized
gaaagatatgagaatcataaaa

SEQ ID NO: 960183 - DNA, 22 bp, Artificial Sequence
  chemically synthesized
ataagtatatttgaaagatatg

SEQ ID NO: 960184 - DNA, 22 bp, Artificial Sequence
  chemically synthesized
ttatgattctcatatctttcaa

SEQ ID NO: 960185 - DNA, 22 bp, Artificial Sequence
  chemically synthesized
tatgattctcatatctttcaaa

SEQ ID NO: 960186 - DNA, 22 bp, Artificial Sequence
  chemically synthesized
ttcataagtatatttgaaagat

SEQ ID NO: 960187 - DNA, 22 bp, Artificial Sequence
  chemically synthesized
atgattctcatatctttcaaat

SEQ ID NO: 960188 - DNA, 22 bp, Artificial Sequence
  chemically synthesized
tgattctcatatctttcaaata

SEQ ID NO: 960189 - DNA, 22 bp, Artificial Sequence
  chemically synthesized
tcatatctttcaaatatactta

SEQ ID NO: 960190 - DNA, 22 bp, Artificial Sequence
  chemically synthesized
atatctttcaaatatacttatg

SEQ ID NO: 960191 - DNA, 22 bp, Artificial Sequence
  chemically synthesized
tcaaatatacttatgaatagtt

SEQ ID NO: 960192 - DNA, 22 bp, Artificial Sequence
  chemically synthesized
caaatatacttatgaatagttt

SEQ ID NO: 960193 - DNA, 22 bp, Artificial Sequence
  chemically synthesized
tcccatagtaataaactattca

SEQ ID NO: 960194 - DNA, 22 bp, Artificial Sequence
  chemically synthesized
aaatatacttatgaatagttta

SEQ ID NO: 960195 - DNA, 22 bp, Artificial Sequence
  chemically synthesized
tccatacctgtcccatagtaat

SEQ ID NO: 960196 - DNA, 22 bp, Artificial Sequence
  chemically synthesized
atgaatagtttattactatggg

SEQ ID NO: 960197 - DNA, 22 bp, Artificial Sequence
  chemically synthesized
atccatacctgtcccatagtaa

SEQ ID NO: 960198 - DNA, 22 bp, Artificial Sequence
  chemically synthesized
tgaatagtttattactatggga

SEQ ID NO: 960199 - DNA, 22 bp, Artificial Sequence
  chemically synthesized
attactatgggacaggtatgga

SEQ ID NO: 960200 - DNA, 22 bp, Artificial Sequence
  chemically synthesized
ttactatgggacaggtatggat

SEQ ID NO: 960201 - DNA, 22 bp, Artificial Sequence
  chemically synthesized
ctatgggacaggtatggataag

SEQ ID NO: 960202 - DNA, 22 bp, Artificial Sequence
  chemically synthesized
tgggacaggtatggataagtgt

SEQ ID NO: 960203 - DNA, 22 bp, Artificial Sequence
  chemically synthesized
caaaaaataataaaaagtaaag

SEQ ID NO: 960204 - DNA, 22 bp, Artificial Sequence
  chemically synthesized
tgtacctacaaaaaataataaa

SEQ ID NO: 960205 - DNA, 22 bp, Artificial Sequence
  chemically synthesized
ctttactttttattattttttg

SEQ ID NO: 960206 - DNA, 22 bp, Artificial Sequence
  chemically synthesized
tttactttttattattttttgt

SEQ ID NO: 960207 - DNA, 22 bp, Artificial Sequence
  chemically synthesized
tactttttattattttttgtag

SEQ ID NO: 960208 - DNA, 22 bp, Artificial Sequence
  chemically synthesized
actttttattattttttgtagg

SEQ ID NO: 960209 - DNA, 22 bp, Artificial Sequence
  chemically synthesized
ctttttattattttttgtaggt

SEQ ID NO: 960210 - DNA, 22 bp, Artificial Sequence
  chemically synthesized
tttattattttttgtaggtaca

SEQ ID NO: 960211 - DNA, 22 bp, Artificial Sequence
  chemically synthesized
ttattattttttgtaggtacat

SEQ ID NO: 960212 - DNA, 22 bp, Artificial Sequence
  chemically synthesized
tattattttttgtaggtacata

SEQ ID NO: 960213 - DNA, 22 bp, Artificial Sequence
  chemically synthesized
attattttttgtaggtacatag

SEQ ID NO: 960214 - DNA, 22 bp, Artificial Sequence
  chemically synthesized
ttattttttgtaggtacatagt

SEQ ID NO: 960215 - DNA, 22 bp, Artificial Sequence
  chemically synthesized
ttttttgtaggtacatagtatg

SEQ ID NO: 960216 - DNA, 22 bp, Artificial Sequence
  chemically synthesized
tttgtaggtacatagtatgtat

SEQ ID NO: 960217 - DNA, 22 bp, Artificial Sequence
  chemically synthesized
ttgtaggtacatagtatgtata

SEQ ID NO: 960218 - DNA, 22 bp, Artificial Sequence
  chemically synthesized
tgtaggtacatagtatgtatat

SEQ ID NO: 960219 - DNA, 22 bp, Artificial Sequence
  chemically synthesized
gtaggtacatagtatgtatata

SEQ ID NO: 960220 - DNA, 22 bp, Artificial Sequence
  chemically synthesized
taggtacatagtatgtatatat

SEQ ID NO: 960221 - DNA, 22 bp, Artificial Sequence
  chemically synthesized
aataagtaacccacaaatatat

SEQ ID NO: 960222 - DNA, 22 bp, Artificial Sequence
  chemically synthesized
tcaataagtaacccacaaatat

SEQ ID NO: 960223 - DNA, 22 bp, Artificial Sequence
  chemically synthesized
aatggattctcaataagtaacc

SEQ ID NO: 960224 - DNA, 22 bp, Artificial Sequence
  chemically synthesized
gttgaatggattctcaataagt

SEQ ID NO: 960225 - DNA, 22 bp, Artificial Sequence
  chemically synthesized
gtgggttacttattgagaatcc

SEQ ID NO: 960226 - DNA, 22 bp, Artificial Sequence
  chemically synthesized
tgggttacttattgagaatcca

SEQ ID NO: 960227 - DNA, 22 bp, Artificial Sequence
  chemically synthesized
tatactcgttgaatggattctc

SEQ ID NO: 960228 - DNA, 22 bp, Artificial Sequence
  chemically synthesized
gtatactcgttgaatggattct

SEQ ID NO: 960229 - DNA, 22 bp, Artificial Sequence
  chemically synthesized
tgtatactcgttgaatggattc

SEQ ID NO: 960230 - DNA, 22 bp, Artificial Sequence
  chemically synthesized
cttattgagaatccattcaacg

SEQ ID NO: 960231 - DNA, 22 bp, Artificial Sequence
  chemically synthesized
attgagaatccattcaacgagt

SEQ ID NO: 960232 - DNA, 22 bp, Artificial Sequence
  chemically synthesized
ttgagaatccattcaacgagta

SEQ ID NO: 960233 - DNA, 22 bp, Artificial Sequence
  chemically synthesized
agaatccattcaacgagtatac

SEQ ID NO: 960234 - DNA, 22 bp, Artificial Sequence
  chemically synthesized
atatccgcgatctttgtatact

SEQ ID NO: 960235 - DNA, 22 bp, Artificial Sequence
  chemically synthesized
aatatccgcgatctttgtatac

SEQ ID NO: 960236 - DNA, 22 bp, Artificial Sequence
  chemically synthesized
taatatccgcgatctttgtata

SEQ ID NO: 960237 - DNA, 22 bp, Artificial Sequence
  chemically synthesized
agttttaatatccgcgatcttt

SEQ ID NO: 960238 - DNA, 22 bp, Artificial Sequence
  chemically synthesized
aacgagtatacaaagatcgcgg

SEQ ID NO: 960239 - DNA, 22 bp, Artificial Sequence
  chemically synthesized
cagttttaatatccgcgatctt

SEQ ID NO: 960240 - DNA, 22 bp, Artificial Sequence
  chemically synthesized
tcagttttaatatccgcgatct

SEQ ID NO: 960241 - DNA, 22 bp, Artificial Sequence
  chemically synthesized
ttcagttttaatatccgcgatc

SEQ ID NO: 960242 - DNA, 22 bp, Artificial Sequence
  chemically synthesized
ttttcagttttaatatccgcga

SEQ ID NO: 960243 - DNA, 22 bp, Artificial Sequence
  chemically synthesized
cttttcagttttaatatccgcg

SEQ ID NO: 960244 - DNA, 22 bp, Artificial Sequence
  chemically synthesized
tcttttcagttttaatatccgc

SEQ ID NO: 960245 - DNA, 22 bp, Artificial Sequence
  chemically synthesized
tctttcttttcagttttaatat

SEQ ID NO: 960246 - DNA, 22 bp, Artificial Sequence
  chemically synthesized
caggttgtctttcttttcagtt

SEQ ID NO: 960247 - DNA, 22 bp, Artificial Sequence
  chemically synthesized
ccaggttgtctttcttttcagt

SEQ ID NO: 960248 - DNA, 22 bp, Artificial Sequence
  chemically synthesized
acttccaggttgtctttctttt

SEQ ID NO: 960249 - DNA, 22 bp, Artificial Sequence
  chemically synthesized
aacttccaggttgtctttcttt

SEQ ID NO: 960250 - DNA, 22 bp, Artificial Sequence
  chemically synthesized
taacttccaggttgtctttctt

SEQ ID NO: 960251 - DNA, 22 bp, Artificial Sequence
  chemically synthesized
aaactgaaaagaaagacaacct

SEQ ID NO: 960252 - DNA, 22 bp, Artificial Sequence
  chemically synthesized
aaaagaaagacaacctggaagt

SEQ ID NO: 960253 - DNA, 22 bp, Artificial Sequence
  chemically synthesized
atgtcaaacattttaacttcca

SEQ ID NO: 960254 - DNA, 22 bp, Artificial Sequence
  chemically synthesized
aatgtcaaacattttaacttcc

SEQ ID NO: 960255 - DNA, 22 bp, Artificial Sequence
  chemically synthesized
gtaaatcttaatgtcaaacatt

SEQ ID NO: 960256 - DNA, 22 bp, Artificial Sequence
  chemically synthesized
agtaaatcttaatgtcaaacat

SEQ ID NO: 960257 - DNA, 22 bp, Artificial Sequence
  chemically synthesized
gaagttaaaatgtttgacatta

SEQ ID NO: 960258 - DNA, 22 bp, Artificial Sequence
  chemically synthesized
tttagtaaatcttaatgtcaaa

SEQ ID NO: 960259 - DNA, 22 bp, Artificial Sequence
  chemically synthesized
tgtttagtaaatcttaatgtca

SEQ ID NO: 960260 - DNA, 22 bp, Artificial Sequence
  chemically synthesized
ctgtttagtaaatcttaatgtc

SEQ ID NO: 960261 - DNA, 22 bp, Artificial Sequence
  chemically synthesized
tctgtttagtaaatcttaatgt

SEQ ID NO: 960262 - DNA, 22 bp, Artificial Sequence
  chemically synthesized
aaatgtttgacattaagattta

SEQ ID NO: 960263 - DNA, 22 bp, Artificial Sequence
  chemically synthesized
caaactttctgtttagtaaatc

SEQ ID NO: 960264 - DNA, 22 bp, Artificial Sequence
  chemically synthesized
gcaaactttctgtttagtaaat

SEQ ID NO: 960265 - DNA, 22 bp, Artificial Sequence
  chemically synthesized
tgcaaactttctgtttagtaaa

SEQ ID NO: 960266 - DNA, 22 bp, Artificial Sequence
  chemically synthesized
gacattaagatttactaaacag

SEQ ID NO: 960267 - DNA, 22 bp, Artificial Sequence
  chemically synthesized
acattaagatttactaaacaga

SEQ ID NO: 960268 - DNA, 22 bp, Artificial Sequence
  chemically synthesized
tgaaattttgcaaactttctgt

SEQ ID NO: 960269 - DNA, 22 bp, Artificial Sequence
  chemically synthesized
agatttactaaacagaaagttt

SEQ ID NO: 960270 - DNA, 22 bp, Artificial Sequence
  chemically synthesized
gtgaaattttgcaaactttctg

SEQ ID NO: 960271 - DNA, 22 bp, Artificial Sequence
  chemically synthesized
actaaacagaaagtttgcaaaa

SEQ ID NO: 960272 - DNA, 22 bp, Artificial Sequence
  chemically synthesized
ctaaacagaaagtttgcaaaat

SEQ ID NO: 960273 - DNA, 22 bp, Artificial Sequence
  chemically synthesized
tatagtttgtgaaattttgcaa

SEQ ID NO: 960274 - DNA, 22 bp, Artificial Sequence
  chemically synthesized
atatagtttgtgaaattttgca

SEQ ID NO: 960275 - DNA, 22 bp, Artificial Sequence
  chemically synthesized
aacagaaagtttgcaaaatttc

SEQ ID NO: 960276 - DNA, 22 bp, Artificial Sequence
  chemically synthesized
gcaaaatttcacaaactatata

SEQ ID NO: 960277 - DNA, 22 bp, Artificial Sequence
  chemically synthesized
caaaatttcacaaactatataa

SEQ ID NO: 960278 - DNA, 22 bp, Artificial Sequence
  chemically synthesized
cacaaactatataagttcatct

SEQ ID NO: 960279 - DNA, 22 bp, Artificial Sequence
  chemically synthesized
acaaactatataagttcatctg

SEQ ID NO: 960280 - DNA, 22 bp, Artificial Sequence
  chemically synthesized
gaagcatccatcatatcagatg

SEQ ID NO: 960281 - DNA, 22 bp, Artificial Sequence
  chemically synthesized
tataagttcatctgatatgatg

SEQ ID NO: 960282 - DNA, 22 bp, Artificial Sequence
  chemically synthesized
caattggaagcatccatcatat

SEQ ID NO: 960283 - DNA, 22 bp, Artificial Sequence
  chemically synthesized
tacaattggaagcatccatcat

SEQ ID NO: 960284 - DNA, 22 bp, Artificial Sequence
  chemically synthesized
atctgatatgatggatgcttcc

SEQ ID NO: 960285 - DNA, 22 bp, Artificial Sequence
  chemically synthesized
tattctacaattggaagcatcc

SEQ ID NO: 960286 - DNA, 22 bp, Artificial Sequence
  chemically synthesized
tgtattctacaattggaagcat

SEQ ID NO: 960287 - DNA, 22 bp, Artificial Sequence
  chemically synthesized
ctgtattctacaattggaagca

SEQ ID NO: 960288 - DNA, 22 bp, Artificial Sequence
  chemically synthesized
atatgatggatgcttccaattg

SEQ ID NO: 960289 - DNA, 22 bp, Artificial Sequence
  chemically synthesized
aagaatataatttctgtattct

SEQ ID NO: 960290 - DNA, 22 bp, Artificial Sequence
  chemically synthesized
ccaattgtagaatacagaaatt

SEQ ID NO: 960291 - DNA, 22 bp, Artificial Sequence
  chemically synthesized
caattgtagaatacagaaatta

SEQ ID NO: 960292 - DNA, 22 bp, Artificial Sequence
  chemically synthesized
tagaatacagaaattatattct

SEQ ID NO: 960293 - DNA, 22 bp, Artificial Sequence
  chemically synthesized
aaatgtaaactcaagaatataa

SEQ ID NO: 960294 - DNA, 22 bp, Artificial Sequence
  chemically synthesized
aaaatgtaaactcaagaatata

SEQ ID NO: 960295 - DNA, 22 bp, Artificial Sequence
  chemically synthesized
acaagtttaaaatgtaaactca

SEQ ID NO: 960296 - DNA, 22 bp, Artificial Sequence
  chemically synthesized
tattcttgagtttacattttaa

SEQ ID NO: 960297 - DNA, 22 bp, Artificial Sequence
  chemically synthesized
ttgagtttacattttaaacttg

SEQ ID NO: 960298 - DNA, 22 bp, Artificial Sequence
  chemically synthesized
gagtttacattttaaacttgtg

SEQ ID NO: 960299 - DNA, 22 bp, Artificial Sequence
  chemically synthesized
agtttacattttaaacttgtga

SEQ ID NO: 960300 - DNA, 22 bp, Artificial Sequence
  chemically synthesized
agtccaaacatctcacaagttt

SEQ ID NO: 960301 - DNA, 22 bp, Artificial Sequence
  chemically synthesized
acattttaaacttgtgagatgt

SEQ ID NO: 960302 - DNA, 22 bp, Artificial Sequence
  chemically synthesized
cattttaaacttgtgagatgtt

SEQ ID NO: 960303 - DNA, 22 bp, Artificial Sequence
  chemically synthesized
tatattcagtccaaacatctca

SEQ ID NO: 960304 - DNA, 22 bp, Artificial Sequence
  chemically synthesized
atatattcagtccaaacatctc

SEQ ID NO: 960305 - DNA, 22 bp, Artificial Sequence
  chemically synthesized
taaacttgtgagatgtttggac

SEQ ID NO: 960306 - DNA, 22 bp, Artificial Sequence
  chemically synthesized
tttatatattcagtccaaacat

SEQ ID NO: 960307 - DNA, 22 bp, Artificial Sequence
  chemically synthesized
aaacttgtgagatgtttggact

SEQ ID NO: 960308 - DNA, 22 bp, Artificial Sequence
  chemically synthesized
aacttgtgagatgtttggactg

SEQ ID NO: 960309 - DNA, 22 bp, Artificial Sequence
  chemically synthesized
tatttatatattcagtccaaac

SEQ ID NO: 960310 - DNA, 22 bp, Artificial Sequence
  chemically synthesized
ctatttatatattcagtccaaa

SEQ ID NO: 960311 - DNA, 22 bp, Artificial Sequence
  chemically synthesized
gtgagatgtttggactgaatat

SEQ ID NO: 960312 - DNA, 22 bp, Artificial Sequence
  chemically synthesized
tgagatgtttggactgaatata

SEQ ID NO: 960313 - DNA, 22 bp, Artificial Sequence
  chemically synthesized
agtcatttctatttatatattc

SEQ ID NO: 960314 - DNA, 22 bp, Artificial Sequence
  chemically synthesized
aagtcatttctatttatatatt

SEQ ID NO: 960315 - DNA, 22 bp, Artificial Sequence
  chemically synthesized
taagtcatttctatttatatat

SEQ ID NO: 960316 - DNA, 22 bp, Artificial Sequence
  chemically synthesized
ttaagtcatttctatttatata

SEQ ID NO: 960317 - DNA, 22 bp, Artificial Sequence
  chemically synthesized
ggactgaatatataaatagaaa

SEQ ID NO: 960318 - DNA, 22 bp, Artificial Sequence
  chemically synthesized
gactgaatatataaatagaaat

SEQ ID NO: 960319 - DNA, 22 bp, Artificial Sequence
  chemically synthesized
aatatataaatagaaatgactt

SEQ ID NO: 960320 - DNA, 22 bp, Artificial Sequence
  chemically synthesized
atgaaaatttttaagtcatttc

SEQ ID NO: 960321 - DNA, 22 bp, Artificial Sequence
  chemically synthesized
aaaatattcatgaaaattttta

SEQ ID NO: 960322 - DNA, 22 bp, Artificial Sequence
  chemically synthesized
aaaaattttcatgaatattttc

SEQ ID NO: 960323 - DNA, 22 bp, Artificial Sequence
  chemically synthesized
aaaattttcatgaatattttca

SEQ ID NO: 960324 - DNA, 22 bp, Artificial Sequence
  chemically synthesized
taatagtatccactgaaaatat

SEQ ID NO: 960325 - DNA, 22 bp, Artificial Sequence
  chemically synthesized
gtaatagtatccactgaaaata

SEQ ID NO: 960326 - DNA, 22 bp, Artificial Sequence
  chemically synthesized
tgtaatagtatccactgaaaat

SEQ ID NO: 960327 - DNA, 22 bp, Artificial Sequence
  chemically synthesized
tcatgaatattttcagtggata

SEQ ID NO: 960328 - DNA, 22 bp, Artificial Sequence
  chemically synthesized
catgaatattttcagtggatac

SEQ ID NO: 960329 - DNA, 22 bp, Artificial Sequence
  chemically synthesized
agctttgtaatagtatccactg

SEQ ID NO: 960330 - DNA, 22 bp, Artificial Sequence
  chemically synthesized
atgaatattttcagtggatact

SEQ ID NO: 960331 - DNA, 22 bp, Artificial Sequence
  chemically synthesized
gagctttgtaatagtatccact

SEQ ID NO: 960332 - DNA, 22 bp, Artificial Sequence
  chemically synthesized
tgagctttgtaatagtatccac

SEQ ID NO: 960333 - DNA, 22 bp, Artificial Sequence
  chemically synthesized
cactttgagctttgtaatagta

SEQ ID NO: 960334 - DNA, 22 bp, Artificial Sequence
  chemically synthesized
tcagtggatactattacaaagc

SEQ ID NO: 960335 - DNA, 22 bp, Artificial Sequence
  chemically synthesized
cagtggatactattacaaagct

SEQ ID NO: 960336 - DNA, 22 bp, Artificial Sequence
  chemically synthesized
acctccactttgagctttgtaa

SEQ ID NO: 960337 - DNA, 22 bp, Artificial Sequence
  chemically synthesized
agtggatactattacaaagctc

SEQ ID NO: 960338 - DNA, 22 bp, Artificial Sequence
  chemically synthesized
aacctccactttgagctttgta

SEQ ID NO: 960339 - DNA, 22 bp, Artificial Sequence
  chemically synthesized
taacctccactttgagctttgt

SEQ ID NO: 960340 - DNA, 22 bp, Artificial Sequence
  chemically synthesized
ttaacctccactttgagctttg

SEQ ID NO: 960341 - DNA, 22 bp, Artificial Sequence
  chemically synthesized
ttacaaagctcaaagtggaggt

SEQ ID NO: 960342 - DNA, 22 bp, Artificial Sequence
  chemically synthesized
caaagctcaaagtggaggttaa

SEQ ID NO: 960343 - DNA, 22 bp, Artificial Sequence
  chemically synthesized
aaagtggaggttaaaagttttg

SEQ ID NO: 960344 - DNA, 22 bp, Artificial Sequence
  chemically synthesized
agaataaatcgaatgagtcaaa

SEQ ID NO: 960345 - DNA, 22 bp, Artificial Sequence
  chemically synthesized
gttgagaataaatcgaatgagt

SEQ ID NO: 960346 - DNA, 22 bp, Artificial Sequence
  chemically synthesized
aaagttttgactcattcgattt

SEQ ID NO: 960347 - DNA, 22 bp, Artificial Sequence
  chemically synthesized
attcgttgagaataaatcgaat

SEQ ID NO: 960348 - DNA, 22 bp, Artificial Sequence
  chemically synthesized
tgactcattcgatttattctca

SEQ ID NO: 960349 - DNA, 22 bp, Artificial Sequence
  chemically synthesized
gactcattcgatttattctcaa

SEQ ID NO: 960350 - DNA, 22 bp, Artificial Sequence
  chemically synthesized
actcattcgatttattctcaac

SEQ ID NO: 960351 - DNA, 22 bp, Artificial Sequence
  chemically synthesized
gataattcattcgttgagaata

SEQ ID NO: 960352 - DNA, 22 bp, Artificial Sequence
  chemically synthesized
attcgatttattctcaacgaat

SEQ ID NO: 960353 - DNA, 22 bp, Artificial Sequence
  chemically synthesized
gatttattctcaacgaatgaat

SEQ ID NO: 960354 - DNA, 22 bp, Artificial Sequence
  chemically synthesized
aaatattagataattcattcgt

SEQ ID NO: 960355 - DNA, 22 bp, Artificial Sequence
  chemically synthesized
attctcaacgaatgaattatct

SEQ ID NO: 960356 - DNA, 22 bp, Artificial Sequence
  chemically synthesized
ttctcaacgaatgaattatcta

SEQ ID NO: 960357 - DNA, 22 bp, Artificial Sequence
  chemically synthesized
tcaacgaatgaattatctaata

SEQ ID NO: 960358 - DNA, 22 bp, Artificial Sequence
  chemically synthesized
atatacattgaaatattagata

SEQ ID NO: 960359 - DNA, 22 bp, Artificial Sequence
  chemically synthesized
aacgaatgaattatctaatatt

SEQ ID NO: 960360 - DNA, 22 bp, Artificial Sequence
  chemically synthesized
tctcatatacattgaaatatta

SEQ ID NO: 960361 - DNA, 22 bp, Artificial Sequence
  chemically synthesized
atctcatatacattgaaatatt

SEQ ID NO: 960362 - DNA, 22 bp, Artificial Sequence
  chemically synthesized
tctaatatttcaatgtatatga

SEQ ID NO: 960363 - DNA, 22 bp, Artificial Sequence
  chemically synthesized
atatttcaatgtatatgagata

SEQ ID NO: 960364 - DNA, 22 bp, Artificial Sequence
  chemically synthesized
atataaacatgtttatctcata

SEQ ID NO: 960365 - DNA, 22 bp, Artificial Sequence
  chemically synthesized
taatataaacatgtttatctca

SEQ ID NO: 960366 - DNA, 22 bp, Artificial Sequence
  chemically synthesized
caatgtatatgagataaacatg

SEQ ID NO: 960367 - DNA, 22 bp, Artificial Sequence
  chemically synthesized
aatgtatatgagataaacatgt

SEQ ID NO: 960368 - DNA, 22 bp, Artificial Sequence
  chemically synthesized
gtgacattctaatataaacatg

SEQ ID NO: 960369 - DNA, 22 bp, Artificial Sequence
  chemically synthesized
aagagtcaattggtgacattct

SEQ ID NO: 960370 - DNA, 22 bp, Artificial Sequence
  chemically synthesized
atattagaatgtcaccaattga

SEQ ID NO: 960371 - DNA, 22 bp, Artificial Sequence
  chemically synthesized
tatattaaagagtcaattggtg

SEQ ID NO: 960372 - DNA, 22 bp, Artificial Sequence
  chemically synthesized
tattagaatgtcaccaattgac

SEQ ID NO: 960373 - DNA, 22 bp, Artificial Sequence
  chemically synthesized
atatattaaagagtcaattggt

SEQ ID NO: 960374 - DNA, 22 bp, Artificial Sequence
  chemically synthesized
tatatattaaagagtcaattgg

SEQ ID NO: 960375 - DNA, 22 bp, Artificial Sequence
  chemically synthesized
gaatgtcaccaattgactcttt

SEQ ID NO: 960376 - DNA, 22 bp, Artificial Sequence
  chemically synthesized
aggctttatatattaaagagtc

SEQ ID NO: 960377 - DNA, 22 bp, Artificial Sequence
  chemically synthesized
aacataattaaggctttatata

SEQ ID NO: 960378 - DNA, 22 bp, Artificial Sequence
  chemically synthesized
actctttaatatataaagcctt

SEQ ID NO: 960379 - DNA, 22 bp, Artificial Sequence
  chemically synthesized
tttaatatataaagccttaatt

SEQ ID NO: 960380 - DNA, 22 bp, Artificial Sequence
  chemically synthesized
tagattaaacataattaaggct

SEQ ID NO: 960381 - DNA, 22 bp, Artificial Sequence
  chemically synthesized
atagattaaacataattaaggc

SEQ ID NO: 960382 - DNA, 22 bp, Artificial Sequence
  chemically synthesized
taatatataaagccttaattat

SEQ ID NO: 960383 - DNA, 22 bp, Artificial Sequence
  chemically synthesized
tatagattaaacataattaagg

SEQ ID NO: 960384 - DNA, 22 bp, Artificial Sequence
  chemically synthesized
aatatataaagccttaattatg

SEQ ID NO: 960385 - DNA, 22 bp, Artificial Sequence
  chemically synthesized
atatataaagccttaattatgt

SEQ ID NO: 960386 - DNA, 22 bp, Artificial Sequence
  chemically synthesized
gtggttttatagattaaacata

SEQ ID NO: 960387 - DNA, 22 bp, Artificial Sequence
  chemically synthesized
acattagtggttttatagatta

SEQ ID NO: 960388 - DNA, 22 bp, Artificial Sequence
  chemically synthesized
taacattagtggttttatagat

SEQ ID NO: 960389 - DNA, 22 bp, Artificial Sequence
  chemically synthesized
aattatgtttaatctataaaac

SEQ ID NO: 960390 - DNA, 22 bp, Artificial Sequence
  chemically synthesized
attatgtttaatctataaaacc

SEQ ID NO: 960391 - DNA, 22 bp, Artificial Sequence
  chemically synthesized
tgtttaatctataaaaccacta

SEQ ID NO: 960392 - DNA, 22 bp, Artificial Sequence
  chemically synthesized
aatctataaaaccactaatgtt

SEQ ID NO: 960393 - DNA, 22 bp, Artificial Sequence
  chemically synthesized
atctataaaaccactaatgtta

SEQ ID NO: 960394 - DNA, 22 bp, Artificial Sequence
  chemically synthesized
taaaaccactaatgttagagac

SEQ ID NO: 960395 - DNA, 22 bp, Artificial Sequence
  chemically synthesized
tagtgaatatgtgatgaatagt

SEQ ID NO: 960396 - DNA, 22 bp, Artificial Sequence
  chemically synthesized
atagtgaatatgtgatgaatag

SEQ ID NO: 960397 - DNA, 22 bp, Artificial Sequence
  chemically synthesized
atgttagagactattcatcaca

SEQ ID NO: 960398 - DNA, 22 bp, Artificial Sequence
  chemically synthesized
tcttatagtgaatatgtgatga

SEQ ID NO: 960399 - DNA, 22 bp, Artificial Sequence
  chemically synthesized
atcttatagtgaatatgtgatg

SEQ ID NO: 960400 - DNA, 22 bp, Artificial Sequence
  chemically synthesized
gagactattcatcacatattca

SEQ ID NO: 960401 - DNA, 22 bp, Artificial Sequence
  chemically synthesized
ttcatcacatattcactataag

SEQ ID NO: 960402 - DNA, 22 bp, Artificial Sequence
  chemically synthesized
catagtgtttatcttatagtga

SEQ ID NO: 960403 - DNA, 22 bp, Artificial Sequence
  chemically synthesized
tccatagtgtttatcttatagt

SEQ ID NO: 960404 - DNA, 22 bp, Artificial Sequence
  chemically synthesized
atcacatattcactataagata

SEQ ID NO: 960405 - DNA, 22 bp, Artificial Sequence
  chemically synthesized
ctccatagtgtttatcttatag

SEQ ID NO: 960406 - DNA, 22 bp, Artificial Sequence
  chemically synthesized
tgcataatttctccatagtgtt

SEQ ID NO: 960407 - DNA, 22 bp, Artificial Sequence
  chemically synthesized
actataagataaacactatgga

SEQ ID NO: 960408 - DNA, 22 bp, Artificial Sequence
  chemically synthesized
atgcataatttctccatagtgt

SEQ ID NO: 960409 - DNA, 22 bp, Artificial Sequence
  chemically synthesized
taagataaacactatggagaaa

SEQ ID NO: 960410 - DNA, 22 bp, Artificial Sequence
  chemically synthesized
atgtaacacatttatgcataat

SEQ ID NO: 960411 - DNA, 22 bp, Artificial Sequence
  chemically synthesized
aatgtaacacatttatgcataa

SEQ ID NO: 960412 - DNA, 22 bp, Artificial Sequence
  chemically synthesized
taatgtaacacatttatgcata

SEQ ID NO: 960413 - DNA, 22 bp, Artificial Sequence
  chemically synthesized
tggagaaattatgcataaatgt

SEQ ID NO: 960414 - DNA, 22 bp, Artificial Sequence
  chemically synthesized
atagtattttaatgtaacacat

SEQ ID NO: 960415 - DNA, 22 bp, Artificial Sequence
  chemically synthesized
aatagtattttaatgtaacaca

SEQ ID NO: 960416 - DNA, 22 bp, Artificial Sequence
  chemically synthesized
taatagtattttaatgtaacac

SEQ ID NO: 960417 - DNA, 22 bp, Artificial Sequence
  chemically synthesized
ttaatagtattttaatgtaaca

SEQ ID NO: 960418 - DNA, 22 bp, Artificial Sequence
  chemically synthesized
tttaatagtattttaatgtaac

SEQ ID NO: 960419 - DNA, 22 bp, Artificial Sequence
  chemically synthesized
tgcataaatgtgttacattaaa

SEQ ID NO: 960420 - DNA, 22 bp, Artificial Sequence
  chemically synthesized
tctttttaatagtattttaatg

SEQ ID NO: 960421 - DNA, 22 bp, Artificial Sequence
  chemically synthesized
cattaaaatactattaaaaaga

SEQ ID NO: 960422 - DNA, 22 bp, Artificial Sequence
  chemically synthesized
aaatactattaaaaagacaatt

SEQ ID NO: 960423 - DNA, 22 bp, Artificial Sequence
  chemically synthesized
ttaaaaagacaatttctatgtg

SEQ ID NO: 960424 - DNA, 22 bp, Artificial Sequence
  chemically synthesized
acacatgcacacacacatagaa

SEQ ID NO: 960425 - DNA, 22 bp, Artificial Sequence
  chemically synthesized
cacacatgcacacacacataga

SEQ ID NO: 960426 - DNA, 22 bp, Artificial Sequence
  chemically synthesized
aaaagacaatttctatgtgtgt

SEQ ID NO: 960427 - DNA, 22 bp, Artificial Sequence
  chemically synthesized
ttcacacatgcacacacacata

SEQ ID NO: 960428 - DNA, 22 bp, Artificial Sequence
  chemically synthesized
ctatgtgtgtgtgcatgtgtga

SEQ ID NO: 960429 - DNA, 22 bp, Artificial Sequence
  chemically synthesized
tatgtgtgtgtgcatgtgtgaa

SEQ ID NO: 960430 - DNA, 22 bp, Artificial Sequence
  chemically synthesized
tgtgtgtgtgcatgtgtgaaga

SEQ ID NO: 960431 - DNA, 22 bp, Artificial Sequence
  chemically synthesized
gtttctctatccacttgactac

SEQ ID NO: 960432 - DNA, 22 bp, Artificial Sequence
  chemically synthesized
ctctatccacttgactacttgt

SEQ ID NO: 960433 - DNA, 22 bp, Artificial Sequence
  chemically synthesized
tctatccacttgactacttgtc

SEQ ID NO: 960434 - DNA, 22 bp, Artificial Sequence
  chemically synthesized
tatccacttgactacttgtcat

SEQ ID NO: 960435 - DNA, 22 bp, Artificial Sequence
  chemically synthesized
tccacttgactacttgtcattt

SEQ ID NO: 960436 - DNA, 22 bp, Artificial Sequence
  chemically synthesized
gatataacagagaaatgacaag

SEQ ID NO: 960437 - DNA, 22 bp, Artificial Sequence
  chemically synthesized
agatataacagagaaatgacaa

SEQ ID NO: 960438 - DNA, 22 bp, Artificial Sequence
  chemically synthesized
cacttagatataacagagaaat

SEQ ID NO: 960439 - DNA, 22 bp, Artificial Sequence
  chemically synthesized
gactacttgtcatttctctgtt

SEQ ID NO: 960440 - DNA, 22 bp, Artificial Sequence
  chemically synthesized
acacttagatataacagagaaa

SEQ ID NO: 960441 - DNA, 22 bp, Artificial Sequence
  chemically synthesized
actacttgtcatttctctgtta

SEQ ID NO: 960442 - DNA, 22 bp, Artificial Sequence
  chemically synthesized
tacacttagatataacagagaa

SEQ ID NO: 960443 - DNA, 22 bp, Artificial Sequence
  chemically synthesized
cttgtcatttctctgttatatc

SEQ ID NO: 960444 - DNA, 22 bp, Artificial Sequence
  chemically synthesized
cattttacacttagatataaca

SEQ ID NO: 960445 - DNA, 22 bp, Artificial Sequence
  chemically synthesized
gtcatttctctgttatatctaa

SEQ ID NO: 960446 - DNA, 22 bp, Artificial Sequence
  chemically synthesized
tcatttctctgttatatctaag

SEQ ID NO: 960447 - DNA, 22 bp, Artificial Sequence
  chemically synthesized
ctctgttatatctaagtgtaaa

SEQ ID NO: 960448 - DNA, 22 bp, Artificial Sequence
  chemically synthesized
gtatgtctgcattttacactta

SEQ ID NO: 960449 - DNA, 22 bp, Artificial Sequence
  chemically synthesized
tctgttatatctaagtgtaaaa

SEQ ID NO: 960450 - DNA, 22 bp, Artificial Sequence
  chemically synthesized
tggtatgtctgcattttacact

SEQ ID NO: 960451 - DNA, 22 bp, Artificial Sequence
  chemically synthesized
tgttatatctaagtgtaaaatg

SEQ ID NO: 960452 - DNA, 22 bp, Artificial Sequence
  chemically synthesized
ttatatctaagtgtaaaatgca

SEQ ID NO: 960453 - DNA, 22 bp, Artificial Sequence
  chemically synthesized
tatctaagtgtaaaatgcagac

SEQ ID NO: 960454 - DNA, 22 bp, Artificial Sequence
  chemically synthesized
agtgtaaaatgcagacatacca

SEQ ID NO: 960455 - DNA, 22 bp, Artificial Sequence
  chemically synthesized
gaaagcccagaaacccagcatg

SEQ ID NO: 960456 - DNA, 22 bp, Artificial Sequence
  chemically synthesized
tcacctagaaagcccagaaacc

SEQ ID NO: 960457 - DNA, 22 bp, Artificial Sequence
  chemically synthesized
atcacctagaaagcccagaaac

SEQ ID NO: 960458 - DNA, 22 bp, Artificial Sequence
  chemically synthesized
ttgcatgctgggtttctgggct

SEQ ID NO: 960459 - DNA, 22 bp, Artificial Sequence
  chemically synthesized
tatcacctagaaagcccagaaa

SEQ ID NO: 960460 - DNA, 22 bp, Artificial Sequence
  chemically synthesized
tgcatgctgggtttctgggctt

SEQ ID NO: 960461 - DNA, 22 bp, Artificial Sequence
  chemically synthesized
ttatcacctagaaagcccagaa

SEQ ID NO: 960462 - DNA, 22 bp, Artificial Sequence
  chemically synthesized
gcatgctgggtttctgggcttt

SEQ ID NO: 960463 - DNA, 22 bp, Artificial Sequence
  chemically synthesized
catgctgggtttctgggctttc

SEQ ID NO: 960464 - DNA, 22 bp, Artificial Sequence
  chemically synthesized
ggcacttttatcacctagaaag

SEQ ID NO: 960465 - DNA, 22 bp, Artificial Sequence
  chemically synthesized
ggtttctgggctttctaggtga

SEQ ID NO: 960466 - DNA, 22 bp, Artificial Sequence
  chemically synthesized
ctgggctttctaggtgataaaa

SEQ ID NO: 960467 - DNA, 22 bp, Artificial Sequence
  chemically synthesized
tgggctttctaggtgataaaag

SEQ ID NO: 960468 - DNA, 22 bp, Artificial Sequence
  chemically synthesized
gaataattaggcacttttatca

SEQ ID NO: 960469 - DNA, 22 bp, Artificial Sequence
  chemically synthesized
ggctttctaggtgataaaagtg

SEQ ID NO: 960470 - DNA, 22 bp, Artificial Sequence
  chemically synthesized
ggaataattaggcacttttatc

SEQ ID NO: 960471 - DNA, 22 bp, Artificial Sequence
  chemically synthesized
tctaggtgataaaagtgcctaa

SEQ ID NO: 960472 - DNA, 22 bp, Artificial Sequence
  chemically synthesized
ctaggtgataaaagtgcctaat

SEQ ID NO: 960473 - DNA, 22 bp, Artificial Sequence
  chemically synthesized
taggtgataaaagtgcctaatt

SEQ ID NO: 960474 - DNA, 22 bp, Artificial Sequence
  chemically synthesized
acagtttggaataattaggcac

SEQ ID NO: 960475 - DNA, 22 bp, Artificial Sequence
  chemically synthesized
ggtgataaaagtgcctaattat

SEQ ID NO: 960476 - DNA, 22 bp, Artificial Sequence
  chemically synthesized
atgatctaacagtttggaataa

SEQ ID NO: 960477 - DNA, 22 bp, Artificial Sequence
  chemically synthesized
ggattaatgatctaacagtttg

SEQ ID NO: 960478 - DNA, 22 bp, Artificial Sequence
  chemically synthesized
attattccaaactgttagatca

SEQ ID NO: 960479 - DNA, 22 bp, Artificial Sequence
  chemically synthesized
tggctaggattaatgatctaac

SEQ ID NO: 960480 - DNA, 22 bp, Artificial Sequence
  chemically synthesized
gtggctaggattaatgatctaa

SEQ ID NO: 960481 - DNA, 22 bp, Artificial Sequence
  chemically synthesized
tgtggctaggattaatgatcta

SEQ ID NO: 960482 - DNA, 22 bp, Artificial Sequence
  chemically synthesized
ttccaaactgttagatcattaa

SEQ ID NO: 960483 - DNA, 22 bp, Artificial Sequence
  chemically synthesized
ttgtggctaggattaatgatct

SEQ ID NO: 960484 - DNA, 22 bp, Artificial Sequence
  chemically synthesized
caaactgttagatcattaatcc

SEQ ID NO: 960485 - DNA, 22 bp, Artificial Sequence
  chemically synthesized
ttagatcattaatcctagccac

SEQ ID NO: 960486 - DNA, 22 bp, Artificial Sequence
  chemically synthesized
atgtagatgtttttgtggctag

SEQ ID NO: 960487 - DNA, 22 bp, Artificial Sequence
  chemically synthesized
gatcattaatcctagccacaaa

SEQ ID NO: 960488 - DNA, 22 bp, Artificial Sequence
  chemically synthesized
aattaatgtagatgtttttgtg

SEQ ID NO: 960489 - DNA, 22 bp, Artificial Sequence
  chemically synthesized
aaattaatgtagatgtttttgt

SEQ ID NO: 960490 - DNA, 22 bp, Artificial Sequence
  chemically synthesized
atcctagccacaaaaacatcta

SEQ ID NO: 960491 - DNA, 22 bp, Artificial Sequence
  chemically synthesized
gccacaaaaacatctacattaa

SEQ ID NO: 960492 - DNA, 22 bp, Artificial Sequence
  chemically synthesized
ccaaggtttaaattaatgtaga

SEQ ID NO: 960493 - DNA, 22 bp, Artificial Sequence
  chemically synthesized
gccaaggtttaaattaatgtag

SEQ ID NO: 960494 - DNA, 22 bp, Artificial Sequence
  chemically synthesized
acgtttgccaaggtttaaatta

SEQ ID NO: 960495 - DNA, 22 bp, Artificial Sequence
  chemically synthesized
aacgtttgccaaggtttaaatt

SEQ ID NO: 960496 - DNA, 22 bp, Artificial Sequence
  chemically synthesized
tttaacgtttgccaaggtttaa

SEQ ID NO: 960497 - DNA, 22 bp, Artificial Sequence
  chemically synthesized
gtttaacgtttgccaaggttta

SEQ ID NO: 960498 - DNA, 22 bp, Artificial Sequence
  chemically synthesized
cttgtttaacgtttgccaaggt

SEQ ID NO: 960499 - DNA, 22 bp, Artificial Sequence
  chemically synthesized
cattaatttaaaccttggcaaa

SEQ ID NO: 960500 - DNA, 22 bp, Artificial Sequence
  chemically synthesized
acttgtttaacgtttgccaagg

SEQ ID NO: 960501 - DNA, 22 bp, Artificial Sequence
  chemically synthesized
atttaaaccttggcaaacgtta

SEQ ID NO: 960502 - DNA, 22 bp, Artificial Sequence
  chemically synthesized
gtaatttacttgtttaacgttt

SEQ ID NO: 960503 - DNA, 22 bp, Artificial Sequence
  chemically synthesized
cgtaatttacttgtttaacgtt

SEQ ID NO: 960504 - DNA, 22 bp, Artificial Sequence
  chemically synthesized
aaaccttggcaaacgttaaaca

SEQ ID NO: 960505 - DNA, 22 bp, Artificial Sequence
  chemically synthesized
tcgtaatttacttgtttaacgt

SEQ ID NO: 960506 - DNA, 22 bp, Artificial Sequence
  chemically synthesized
aaccttggcaaacgttaaacaa

SEQ ID NO: 960507 - DNA, 22 bp, Artificial Sequence
  chemically synthesized
atactttcgtaatttacttgtt

SEQ ID NO: 960508 - DNA, 22 bp, Artificial Sequence
  chemically synthesized
ggcaaacgttaaacaagtaaat

SEQ ID NO: 960509 - DNA, 22 bp, Artificial Sequence
  chemically synthesized
gcaaacgttaaacaagtaaatt

SEQ ID NO: 960510 - DNA, 22 bp, Artificial Sequence
  chemically synthesized
aacaagtaaattacgaaagtat

SEQ ID NO: 960511 - DNA, 22 bp, Artificial Sequence
  chemically synthesized
cgaaagtatgagccatcatgtc

SEQ ID NO: 960512 - DNA, 22 bp, Artificial Sequence
  chemically synthesized
agaaacaatggaagagaagtag

SEQ ID NO: 960513 - DNA, 22 bp, Artificial Sequence
  chemically synthesized
agatgctgagaaacaatggaag

SEQ ID NO: 960514 - DNA, 22 bp, Artificial Sequence
  chemically synthesized
aagatgctgagaaacaatggaa

SEQ ID NO: 960515 - DNA, 22 bp, Artificial Sequence
  chemically synthesized
taagatgctgagaaacaatgga

SEQ ID NO: 960516 - DNA, 22 bp, Artificial Sequence
  chemically synthesized
cttctcttccattgtttctcag

SEQ ID NO: 960517 - DNA, 22 bp, Artificial Sequence
  chemically synthesized
ctcttccattgtttctcagcat

SEQ ID NO: 960518 - DNA, 22 bp, Artificial Sequence
  chemically synthesized
tcttccattgtttctcagcatc

SEQ ID NO: 960519 - DNA, 22 bp, Artificial Sequence
  chemically synthesized
ttccattgtttctcagcatctt

SEQ ID NO: 960520 - DNA, 22 bp, Artificial Sequence
  chemically synthesized
ccattgtttctcagcatcttaa

SEQ ID NO: 960521 - DNA, 22 bp, Artificial Sequence
  chemically synthesized
cattgtttctcagcatcttaaa

SEQ ID NO: 960522 - DNA, 22 bp, Artificial Sequence
  chemically synthesized
taaataaaatcctttaagatgc

SEQ ID NO: 960523 - DNA, 22 bp, Artificial Sequence
  chemically synthesized
gtaaataaaatcctttaagatg

SEQ ID NO: 960524 - DNA, 22 bp, Artificial Sequence
  chemically synthesized
tgtaaataaaatcctttaagat

SEQ ID NO: 960525 - DNA, 22 bp, Artificial Sequence
  chemically synthesized
ttgtaaataaaatcctttaaga

SEQ ID NO: 960526 - DNA, 22 bp, Artificial Sequence
  chemically synthesized
tttctcagcatcttaaaggatt

SEQ ID NO: 960527 - DNA, 22 bp, Artificial Sequence
  chemically synthesized
ctcagcatcttaaaggatttta

SEQ ID NO: 960528 - DNA, 22 bp, Artificial Sequence
  chemically synthesized
agtttttgtaaataaaatcctt

SEQ ID NO: 960529 - DNA, 22 bp, Artificial Sequence
  chemically synthesized
tcagcatcttaaaggattttat

SEQ ID NO: 960530 - DNA, 22 bp, Artificial Sequence
  chemically synthesized
agcatcttaaaggattttattt

SEQ ID NO: 960531 - DNA, 22 bp, Artificial Sequence
  chemically synthesized
ctaagtttttgtaaataaaatc

SEQ ID NO: 960532 - DNA, 22 bp, Artificial Sequence
  chemically synthesized
aaaggattttatttacaaaaac

SEQ ID NO: 960533 - DNA, 22 bp, Artificial Sequence
  chemically synthesized
agggattactaagtttttgtaa

SEQ ID NO: 960534 - DNA, 22 bp, Artificial Sequence
  chemically synthesized
aaggattttatttacaaaaact

SEQ ID NO: 960535 - DNA, 22 bp, Artificial Sequence
  chemically synthesized
aagggattactaagtttttgta

SEQ ID NO: 960536 - DNA, 22 bp, Artificial Sequence
  chemically synthesized
tatttacaaaaacttagtaatc

SEQ ID NO: 960537 - DNA, 22 bp, Artificial Sequence
  chemically synthesized
atttacaaaaacttagtaatcc

SEQ ID NO: 960538 - DNA, 22 bp, Artificial Sequence
  chemically synthesized
tttacaaaaacttagtaatccc

SEQ ID NO: 960539 - DNA, 22 bp, Artificial Sequence
  chemically synthesized
acaaaaacttagtaatccctta

SEQ ID NO: 960540 - DNA, 22 bp, Artificial Sequence
  chemically synthesized
aagaaatgtatttaagggatta

SEQ ID NO: 960541 - DNA, 22 bp, Artificial Sequence
  chemically synthesized
caaaaacttagtaatcccttaa

SEQ ID NO: 960542 - DNA, 22 bp, Artificial Sequence
  chemically synthesized
agtaatcccttaaatacatttc

SEQ ID NO: 960543 - DNA, 22 bp, Artificial Sequence
  chemically synthesized
agatatactgaagaaatgtatt

SEQ ID NO: 960544 - DNA, 22 bp, Artificial Sequence
  chemically synthesized
gtaatcccttaaatacatttct

SEQ ID NO: 960545 - DNA, 22 bp, Artificial Sequence
  chemically synthesized
aaatacatttcttcagtatatc

SEQ ID NO: 960546 - DNA, 22 bp, Artificial Sequence
  chemically synthesized
aatacatttcttcagtatatct

SEQ ID NO: 960547 - DNA, 22 bp, Artificial Sequence
  chemically synthesized
cttcagtatatctgaatttcct

SEQ ID NO: 960548 - DNA, 22 bp, Artificial Sequence
  chemically synthesized
ttcagtatatctgaatttcctg

SEQ ID NO: 960549 - DNA, 22 bp, Artificial Sequence
  chemically synthesized
cagtatatctgaatttcctgtt

SEQ ID NO: 960550 - DNA, 22 bp, Artificial Sequence
  chemically synthesized
agtatatctgaatttcctgttt

SEQ ID NO: 960551 - DNA, 22 bp, Artificial Sequence
  chemically synthesized
aatttcctgtttgttgtgtgta

SEQ ID NO: 960552 - DNA, 22 bp, Artificial Sequence
  chemically synthesized
cctgtttgttgtgtgtattgta

SEQ ID NO: 960553 - DNA, 22 bp, Artificial Sequence
  chemically synthesized
ctgtttgttgtgtgtattgtat

SEQ ID NO: 960554 - DNA, 22 bp, Artificial Sequence
  chemically synthesized
tttgttgtgtgtattgtatgtg

SEQ ID NO: 960555 - DNA, 22 bp, Artificial Sequence
  chemically synthesized
gttgtgtgtattgtatgtgtct

SEQ ID NO: 960556 - DNA, 22 bp, Artificial Sequence
  chemically synthesized
ttgtgtgtattgtatgtgtctg

SEQ ID NO: 960557 - DNA, 22 bp, Artificial Sequence
  chemically synthesized
tgtgtattgtatgtgtctgtct

SEQ ID NO: 960558 - DNA, 22 bp, Artificial Sequence
  chemically synthesized
tatgtgtctgtctgtatgcatg

SEQ ID NO: 960559 - DNA, 22 bp, Artificial Sequence
  chemically synthesized
tctgtatgcatgcatgcccatg

SEQ ID NO: 960560 - DNA, 22 bp, Artificial Sequence
  chemically synthesized
tatgcatgcatgcccatgtgtg

SEQ ID NO: 960561 - DNA, 22 bp, Artificial Sequence
  chemically synthesized
accatatacccacacacatggg

SEQ ID NO: 960562 - DNA, 22 bp, Artificial Sequence
  chemically synthesized
gctcaccatatacccacacaca

SEQ ID NO: 960563 - DNA, 22 bp, Artificial Sequence
  chemically synthesized
agctcaccatatacccacacac

SEQ ID NO: 960564 - DNA, 22 bp, Artificial Sequence
  chemically synthesized
tagctcaccatatacccacaca

SEQ ID NO: 960565 - DNA, 22 bp, Artificial Sequence
  chemically synthesized
tttagctcaccatatacccaca

SEQ ID NO: 960566 - DNA, 22 bp, Artificial Sequence
  chemically synthesized
cctctttagctcaccatatacc

SEQ ID NO: 960567 - DNA, 22 bp, Artificial Sequence
  chemically synthesized
gcctctttagctcaccatatac

SEQ ID NO: 960568 - DNA, 22 bp, Artificial Sequence
  chemically synthesized
tttgcctctttagctcaccata

SEQ ID NO: 960569 - DNA, 22 bp, Artificial Sequence
  chemically synthesized
atgtatatactgtttgcctctt

SEQ ID NO: 960570 - DNA, 22 bp, Artificial Sequence
  chemically synthesized
gctaatgtatatactgtttgcc

SEQ ID NO: 960571 - DNA, 22 bp, Artificial Sequence
  chemically synthesized
tagttagctaatgtatatactg

SEQ ID NO: 960572 - DNA, 22 bp, Artificial Sequence
  chemically synthesized
gtagttagctaatgtatatact

SEQ ID NO: 960573 - DNA, 22 bp, Artificial Sequence
  chemically synthesized
aagaggcaaacagtatatacat

SEQ ID NO: 960574 - DNA, 22 bp, Artificial Sequence
  chemically synthesized
ggtagaaaacttgtagttagct

SEQ ID NO: 960575 - DNA, 22 bp, Artificial Sequence
  chemically synthesized
gggtagaaaacttgtagttagc

SEQ ID NO: 960576 - DNA, 22 bp, Artificial Sequence
  chemically synthesized
tgggaaaatttgggtagaaaac

SEQ ID NO: 960577 - DNA, 22 bp, Artificial Sequence
  chemically synthesized
gctaactacaagttttctaccc

SEQ ID NO: 960578 - DNA, 22 bp, Artificial Sequence
  chemically synthesized
actacaagttttctacccaaat

SEQ ID NO: 960579 - DNA, 22 bp, Artificial Sequence
  chemically synthesized
caagttttctacccaaattttc

SEQ ID NO: 960580 - DNA, 22 bp, Artificial Sequence
  chemically synthesized
agtgtggcctgtgggaaaattt

SEQ ID NO: 960581 - DNA, 22 bp, Artificial Sequence
  chemically synthesized
tctacccaaattttcccacagg

SEQ ID NO: 960582 - DNA, 22 bp, Artificial Sequence
  chemically synthesized
ctacccaaattttcccacaggc

SEQ ID NO: 960583 - DNA, 22 bp, Artificial Sequence
  chemically synthesized
tacccaaattttcccacaggcc

SEQ ID NO: 960584 - DNA, 22 bp, Artificial Sequence
  chemically synthesized
cccaaattttcccacaggccac

SEQ ID NO: 960585 - DNA, 22 bp, Artificial Sequence
  chemically synthesized
agaatgggttgagtgtggcctg

SEQ ID NO: 960586 - DNA, 22 bp, Artificial Sequence
  chemically synthesized
aagaatgggttgagtgtggcct

SEQ ID NO: 960587 - DNA, 22 bp, Artificial Sequence
  chemically synthesized
taagaatgggttgagtgtggcc

SEQ ID NO: 960588 - DNA, 22 bp, Artificial Sequence
  chemically synthesized
tcccacaggccacactcaaccc

SEQ ID NO: 960589 - DNA, 22 bp, Artificial Sequence
  chemically synthesized
cccacaggccacactcaaccca

SEQ ID NO: 960590 - DNA, 22 bp, Artificial Sequence
  chemically synthesized
ccacaggccacactcaacccat

SEQ ID NO: 960591 - DNA, 22 bp, Artificial Sequence
  chemically synthesized
agcaacattttaagaatgggtt

SEQ ID NO: 960592 - DNA, 22 bp, Artificial Sequence
  chemically synthesized
aacccattcttaaaatgttgct

SEQ ID NO: 960593 - DNA, 22 bp, Artificial Sequence
  chemically synthesized
aaggagaagatgaatgcctaag

SEQ ID NO: 960594 - DNA, 22 bp, Artificial Sequence
  chemically synthesized
ttaaaatgttgcttaggcattc

SEQ ID NO: 960595 - DNA, 22 bp, Artificial Sequence
  chemically synthesized
aaaatgttgcttaggcattcat

SEQ ID NO: 960596 - DNA, 22 bp, Artificial Sequence
  chemically synthesized
aaatgttgcttaggcattcatc

SEQ ID NO: 960597 - DNA, 22 bp, Artificial Sequence
  chemically synthesized
tcctgaaggagaagatgaatgc

SEQ ID NO: 960598 - DNA, 22 bp, Artificial Sequence
  chemically synthesized
cttaggcattcatcttctcctt

SEQ ID NO: 960599 - DNA, 22 bp, Artificial Sequence
  chemically synthesized
ccccattatcctgaaggagaag

SEQ ID NO: 960600 - DNA, 22 bp, Artificial Sequence
  chemically synthesized
cccccattatcctgaaggagaa

SEQ ID NO: 960601 - DNA, 22 bp, Artificial Sequence
  chemically synthesized
aggcattcatcttctccttcag

SEQ ID NO: 960602 - DNA, 22 bp, Artificial Sequence
  chemically synthesized
tcccccattatcctgaaggaga

SEQ ID NO: 960603 - DNA, 22 bp, Artificial Sequence
  chemically synthesized
ggcattcatcttctccttcagg

SEQ ID NO: 960604 - DNA, 22 bp, Artificial Sequence
  chemically synthesized
atcttctccttcaggataatgg

SEQ ID NO: 960605 - DNA, 22 bp, Artificial Sequence
  chemically synthesized
ctccttcaggataatgggggaa

SEQ ID NO: 960606 - DNA, 22 bp, Artificial Sequence
  chemically synthesized
tccttcaggataatgggggaaa

SEQ ID NO: 960607 - DNA, 22 bp, Artificial Sequence
  chemically synthesized
cttcaggataatgggggaaaat

SEQ ID NO: 960608 - DNA, 22 bp, Artificial Sequence
  chemically synthesized
caggataatgggggaaaatgct

SEQ ID NO: 960609 - DNA, 22 bp, Artificial Sequence
  chemically synthesized
aggataatgggggaaaatgctt

SEQ ID NO: 960610 - DNA, 22 bp, Artificial Sequence
  chemically synthesized
caagaagcaaataaaaagcata

SEQ ID NO: 960611 - DNA, 22 bp, Artificial Sequence
  chemically synthesized
tctacaagaagcaaataaaaag

SEQ ID NO: 960612 - DNA, 22 bp, Artificial Sequence
  chemically synthesized
attatctacaagaagcaaataa

SEQ ID NO: 960613 - DNA, 22 bp, Artificial Sequence
  chemically synthesized
cattatctacaagaagcaaata

SEQ ID NO: 960614 - DNA, 22 bp, Artificial Sequence
  chemically synthesized
tcattatctacaagaagcaaat

SEQ ID NO: 960615 - DNA, 22 bp, Artificial Sequence
  chemically synthesized
atgctttttatttgcttcttgt

SEQ ID NO: 960616 - DNA, 22 bp, Artificial Sequence
  chemically synthesized
tgctttttatttgcttcttgta

SEQ ID NO: 960617 - DNA, 22 bp, Artificial Sequence
  chemically synthesized
tttatttgcttcttgtagataa

SEQ ID NO: 960618 - DNA, 22 bp, Artificial Sequence
  chemically synthesized
ttatttgcttcttgtagataat

SEQ ID NO: 960619 - DNA, 22 bp, Artificial Sequence
  chemically synthesized
tatttgcttcttgtagataatg

SEQ ID NO: 960620 - DNA, 22 bp, Artificial Sequence
  chemically synthesized
atttgcttcttgtagataatga

SEQ ID NO: 960621 - DNA, 22 bp, Artificial Sequence
  chemically synthesized
tttgcttcttgtagataatgaa

SEQ ID NO: 960622 - DNA, 22 bp, Artificial Sequence
  chemically synthesized
gcttcttgtagataatgaaaat

SEQ ID NO: 960623 - DNA, 22 bp, Artificial Sequence
  chemically synthesized
cttcttgtagataatgaaaatt

SEQ ID NO: 960624 - DNA, 22 bp, Artificial Sequence
  chemically synthesized
gggtgaataataaaattttcat

SEQ ID NO: 960625 - DNA, 22 bp, Artificial Sequence
  chemically synthesized
cttgtagataatgaaaatttta

SEQ ID NO: 960626 - DNA, 22 bp, Artificial Sequence
  chemically synthesized
ttgtagataatgaaaattttat

SEQ ID NO: 960627 - DNA, 22 bp, Artificial Sequence
  chemically synthesized
gtagataatgaaaattttatta

SEQ ID NO: 960628 - DNA, 22 bp, Artificial Sequence
  chemically synthesized
tagataatgaaaattttattat

SEQ ID NO: 960629 - DNA, 22 bp, Artificial Sequence
  chemically synthesized
aagcatcgatagcatgctaggg

SEQ ID NO: 960630 - DNA, 22 bp, Artificial Sequence
  chemically synthesized
tattattcaccctagcatgcta

SEQ ID NO: 960631 - DNA, 22 bp, Artificial Sequence
  chemically synthesized
attattcaccctagcatgctat

SEQ ID NO: 960632 - DNA, 22 bp, Artificial Sequence
  chemically synthesized
ttattcaccctagcatgctatc

SEQ ID NO: 960633 - DNA, 22 bp, Artificial Sequence
  chemically synthesized
ttcaccctagcatgctatcgat

SEQ ID NO: 960634 - DNA, 22 bp, Artificial Sequence
  chemically synthesized
accctagcatgctatcgatgct

SEQ ID NO: 960635 - DNA, 22 bp, Artificial Sequence
  chemically synthesized
aaggatcagctgaagcatcgat

SEQ ID NO: 960636 - DNA, 22 bp, Artificial Sequence
  chemically synthesized
aaaggatcagctgaagcatcga

SEQ ID NO: 960637 - DNA, 22 bp, Artificial Sequence
  chemically synthesized
gcatgctatcgatgcttcagct

SEQ ID NO: 960638 - DNA, 22 bp, Artificial Sequence
  chemically synthesized
tcgatgcttcagctgatccttt

SEQ ID NO: 960639 - DNA, 22 bp, Artificial Sequence
  chemically synthesized
aacagtaggccagatgtttaaa

SEQ ID NO: 960640 - DNA, 22 bp, Artificial Sequence
  chemically synthesized
aaacagtaggccagatgtttaa

SEQ ID NO: 960641 - DNA, 22 bp, Artificial Sequence
  chemically synthesized
cagctgatcctttaaacatctg

SEQ ID NO: 960642 - DNA, 22 bp, Artificial Sequence
  chemically synthesized
taaacagtaggccagatgttta

SEQ ID NO: 960643 - DNA, 22 bp, Artificial Sequence
  chemically synthesized
agctgatcctttaaacatctgg

SEQ ID NO: 960644 - DNA, 22 bp, Artificial Sequence
  chemically synthesized
atcctttaaacatctggcctac

SEQ ID NO: 960645 - DNA, 22 bp, Artificial Sequence
  chemically synthesized
catgcattttaaacagtaggcc

SEQ ID NO: 960646 - DNA, 22 bp, Artificial Sequence
  chemically synthesized
taaacatctggcctactgttta

SEQ ID NO: 960647 - DNA, 22 bp, Artificial Sequence
  chemically synthesized
aaacatctggcctactgtttaa

SEQ ID NO: 960648 - DNA, 22 bp, Artificial Sequence
  chemically synthesized
actccatgcattttaaacagta

SEQ ID NO: 960649 - DNA, 22 bp, Artificial Sequence
  chemically synthesized
aacatctggcctactgtttaaa

SEQ ID NO: 960650 - DNA, 22 bp, Artificial Sequence
  chemically synthesized
gcctactgtttaaaatgcatgg

SEQ ID NO: 960651 - DNA, 22 bp, Artificial Sequence
  chemically synthesized
acatcagttcactccatgcatt

SEQ ID NO: 960652 - DNA, 22 bp, Artificial Sequence
  chemically synthesized
ctgtttaaaatgcatggagtga

SEQ ID NO: 960653 - DNA, 22 bp, Artificial Sequence
  chemically synthesized
tttaaaatgcatggagtgaact

SEQ ID NO: 960654 - DNA, 22 bp, Artificial Sequence
  chemically synthesized
aaaatgcatggagtgaactgat

SEQ ID NO: 960655 - DNA, 22 bp, Artificial Sequence
  chemically synthesized
aaatgcatggagtgaactgatg

SEQ ID NO: 960656 - DNA, 22 bp, Artificial Sequence
  chemically synthesized
tcagcacgggctgacatcagtt

SEQ ID NO: 960657 - DNA, 22 bp, Artificial Sequence
  chemically synthesized
attatcagcacgggctgacatc

SEQ ID NO: 960658 - DNA, 22 bp, Artificial Sequence
  chemically synthesized
tgattatcagcacgggctgaca

SEQ ID NO: 960659 - DNA, 22 bp, Artificial Sequence
  chemically synthesized
aaggtcctctgattatcagcac

SEQ ID NO: 960660 - DNA, 22 bp, Artificial Sequence
  chemically synthesized
atgtcagcccgtgctgataatc

SEQ ID NO: 960661 - DNA, 22 bp, Artificial Sequence
  chemically synthesized
attgaaggtcctctgattatca

SEQ ID NO: 960662 - DNA, 22 bp, Artificial Sequence
  chemically synthesized
aattgaaggtcctctgattatc

SEQ ID NO: 960663 - DNA, 22 bp, Artificial Sequence
  chemically synthesized
gtaggtacttaattgaaggtcc

SEQ ID NO: 960664 - DNA, 22 bp, Artificial Sequence
  chemically synthesized
cgtaggtacttaattgaaggtc

SEQ ID NO: 960665 - DNA, 22 bp, Artificial Sequence
  chemically synthesized
ataatcagaggaccttcaatta

SEQ ID NO: 960666 - DNA, 22 bp, Artificial Sequence
  chemically synthesized
cttcgtaggtacttaattgaag

SEQ ID NO: 960667 - DNA, 22 bp, Artificial Sequence
  chemically synthesized
gttgcttcgtaggtacttaatt

SEQ ID NO: 960668 - DNA, 22 bp, Artificial Sequence
  chemically synthesized
tcattggttgcttcgtaggtac

SEQ ID NO: 960669 - DNA, 22 bp, Artificial Sequence
  chemically synthesized
atcattggttgcttcgtaggta

SEQ ID NO: 960670 - DNA, 22 bp, Artificial Sequence
  chemically synthesized
tatcattggttgcttcgtaggt

SEQ ID NO: 960671 - DNA, 22 bp, Artificial Sequence
  chemically synthesized
ttatcattggttgcttcgtagg

SEQ ID NO: 960672 - DNA, 22 bp, Artificial Sequence
  chemically synthesized
caattaagtacctacgaagcaa

SEQ ID NO: 960673 - DNA, 22 bp, Artificial Sequence
  chemically synthesized
ttttatcattggttgcttcgta

SEQ ID NO: 960674 - DNA, 22 bp, Artificial Sequence
  chemically synthesized
aattaagtacctacgaagcaac

SEQ ID NO: 960675 - DNA, 22 bp, Artificial Sequence
  chemically synthesized
tcttttatcattggttgcttcg

SEQ ID NO: 960676 - DNA, 22 bp, Artificial Sequence
  chemically synthesized
ctcttttatcattggttgcttc

SEQ ID NO: 960677 - DNA, 22 bp, Artificial Sequence
  chemically synthesized
tctcttttatcattggttgctt

SEQ ID NO: 960678 - DNA, 22 bp, Artificial Sequence
  chemically synthesized
ttctcttttatcattggttgct

SEQ ID NO: 960679 - DNA, 22 bp, Artificial Sequence
  chemically synthesized
agtacctacgaagcaaccaatg

SEQ ID NO: 960680 - DNA, 22 bp, Artificial Sequence
  chemically synthesized
tcttttctcttttatcattggt

SEQ ID NO: 960681 - DNA, 22 bp, Artificial Sequence
  chemically synthesized
cgaagcaaccaatgataaaaga

SEQ ID NO: 960682 - DNA, 22 bp, Artificial Sequence
  chemically synthesized
cactgtcttttctcttttatca

SEQ ID NO: 960683 - DNA, 22 bp, Artificial Sequence
  chemically synthesized
gcactgtcttttctcttttatc

SEQ ID NO: 960684 - DNA, 22 bp, Artificial Sequence
  chemically synthesized
gcaaacttgcactgtcttttct

SEQ ID NO: 960685 - DNA, 22 bp, Artificial Sequence
  chemically synthesized
ggcaaacttgcactgtcttttc

SEQ ID NO: 960686 - DNA, 22 bp, Artificial Sequence
  chemically synthesized
tggcaaacttgcactgtctttt

SEQ ID NO: 960687 - DNA, 22 bp, Artificial Sequence
  chemically synthesized
tttggcaaacttgcactgtctt

SEQ ID NO: 960688 - DNA, 22 bp, Artificial Sequence
  chemically synthesized
tgaaagaattctttggcaaact

SEQ ID NO: 960689 - DNA, 22 bp, Artificial Sequence
  chemically synthesized
agaatcagactatgaaagaatt

SEQ ID NO: 960690 - DNA, 22 bp, Artificial Sequence
  chemically synthesized
gagaatcagactatgaaagaat

SEQ ID NO: 960691 - DNA, 22 bp, Artificial Sequence
  chemically synthesized
tgagaatcagactatgaaagaa

SEQ ID NO: 960692 - DNA, 22 bp, Artificial Sequence
  chemically synthesized
ttgagaatcagactatgaaaga

SEQ ID NO: 960693 - DNA, 22 bp, Artificial Sequence
  chemically synthesized
gccaaagaattctttcatagtc

SEQ ID NO: 960694 - DNA, 22 bp, Artificial Sequence
  chemically synthesized
ccaaagaattctttcatagtct

SEQ ID NO: 960695 - DNA, 22 bp, Artificial Sequence
  chemically synthesized
cttttgagaatcagactatgaa

SEQ ID NO: 960696 - DNA, 22 bp, Artificial Sequence
  chemically synthesized
attgcttttgagaatcagacta

SEQ ID NO: 960697 - DNA, 22 bp, Artificial Sequence
  chemically synthesized
taattgcttttgagaatcagac

SEQ ID NO: 960698 - DNA, 22 bp, Artificial Sequence
  chemically synthesized
tttcatagtctgattctcaaaa

SEQ ID NO: 960699 - DNA, 22 bp, Artificial Sequence
  chemically synthesized
tcatagtctgattctcaaaagc

SEQ ID NO: 960700 - DNA, 22 bp, Artificial Sequence
  chemically synthesized
catagtctgattctcaaaagca

SEQ ID NO: 960701 - DNA, 22 bp, Artificial Sequence
  chemically synthesized
atagtctgattctcaaaagcaa

SEQ ID NO: 960702 - DNA, 22 bp, Artificial Sequence
  chemically synthesized
attctcaaaagcaattagaatc

SEQ ID NO: 960703 - DNA, 22 bp, Artificial Sequence
  chemically synthesized
tcaaaagcaattagaatcactt

SEQ ID NO: 960704 - DNA, 22 bp, Artificial Sequence
  chemically synthesized
caaggccaaaagaagtgattct

SEQ ID NO: 960705 - DNA, 22 bp, Artificial Sequence
  chemically synthesized
aaaagcaattagaatcacttct

SEQ ID NO: 960706 - DNA, 22 bp, Artificial Sequence
  chemically synthesized
attccaaggccaaaagaagtga

SEQ ID NO: 960707 - DNA, 22 bp, Artificial Sequence
  chemically synthesized
attaattccaaggccaaaagaa

SEQ ID NO: 960708 - DNA, 22 bp, Artificial Sequence
  chemically synthesized
gaatcacttcttttggccttgg

SEQ ID NO: 960709 - DNA, 22 bp, Artificial Sequence
  chemically synthesized
atgaaaattcattaattccaag

SEQ ID NO: 960710 - DNA, 22 bp, Artificial Sequence
  chemically synthesized
aatgaaaattcattaattccaa

SEQ ID NO: 960711 - DNA, 22 bp, Artificial Sequence
  chemically synthesized
taatgaaaattcattaattcca

SEQ ID NO: 960712 - DNA, 22 bp, Artificial Sequence
  chemically synthesized
cttttggccttggaattaatga

SEQ ID NO: 960713 - DNA, 22 bp, Artificial Sequence
  chemically synthesized
ttttggccttggaattaatgaa

SEQ ID NO: 960714 - DNA, 22 bp, Artificial Sequence
  chemically synthesized
ttggccttggaattaatgaatt

SEQ ID NO: 960715 - DNA, 22 bp, Artificial Sequence
  chemically synthesized
aattttaatgaaaattcattaa

SEQ ID NO: 960716 - DNA, 22 bp, Artificial Sequence
  chemically synthesized
tggccttggaattaatgaattt

SEQ ID NO: 960717 - DNA, 22 bp, Artificial Sequence
  chemically synthesized
aaattttaatgaaaattcatta

SEQ ID NO: 960718 - DNA, 22 bp, Artificial Sequence
  chemically synthesized
ggccttggaattaatgaatttt

SEQ ID NO: 960719 - DNA, 22 bp, Artificial Sequence
  chemically synthesized
gccttggaattaatgaattttc

SEQ ID NO: 960720 - DNA, 22 bp, Artificial Sequence
  chemically synthesized
aaatttaaattttaatgaaaat

SEQ ID NO: 960721 - DNA, 22 bp, Artificial Sequence
  chemically synthesized
ggaattaatgaattttcattaa

SEQ ID NO: 960722 - DNA, 22 bp, Artificial Sequence
  chemically synthesized
gaaatttaaattttaatgaaaa

SEQ ID NO: 960723 - DNA, 22 bp, Artificial Sequence
  chemically synthesized
gaattaatgaattttcattaaa

SEQ ID NO: 960724 - DNA, 22 bp, Artificial Sequence
  chemically synthesized
atgaattttcattaaaatttaa

SEQ ID NO: 960725 - DNA, 22 bp, Artificial Sequence
  chemically synthesized
gaatcatttgaaatttaaattt

SEQ ID NO: 960726 - DNA, 22 bp, Artificial Sequence
  chemically synthesized
ggaatcatttgaaatttaaatt

SEQ ID NO: 960727 - DNA, 22 bp, Artificial Sequence
  chemically synthesized
tcattaaaatttaaatttcaaa

SEQ ID NO: 960728 - DNA, 22 bp, Artificial Sequence
  chemically synthesized
cattaaaatttaaatttcaaat

SEQ ID NO: 960729 - DNA, 22 bp, Artificial Sequence
  chemically synthesized
attaaaatttaaatttcaaatg

SEQ ID NO: 960730 - DNA, 22 bp, Artificial Sequence
  chemically synthesized
atatccttggaatcatttgaaa

SEQ ID NO: 960731 - DNA, 22 bp, Artificial Sequence
  chemically synthesized
gatatccttggaatcatttgaa

SEQ ID NO: 960732 - DNA, 22 bp, Artificial Sequence
  chemically synthesized
aaatttaaatttcaaatgattc

SEQ ID NO: 960733 - DNA, 22 bp, Artificial Sequence
  chemically synthesized
aagtttgatatccttggaatca

SEQ ID NO: 960734 - DNA, 22 bp, Artificial Sequence
  chemically synthesized
aaatttcaaatgattccaagga

SEQ ID NO: 960735 - DNA, 22 bp, Artificial Sequence
  chemically synthesized
tcaagtttgatatccttggaat

SEQ ID NO: 960736 - DNA, 22 bp, Artificial Sequence
  chemically synthesized
aatttcaaatgattccaaggat

SEQ ID NO: 960737 - DNA, 22 bp, Artificial Sequence
  chemically synthesized
ctcaagtttgatatccttggaa

SEQ ID NO: 960738 - DNA, 22 bp, Artificial Sequence
  chemically synthesized
caaatgattccaaggatatcaa

SEQ ID NO: 960739 - DNA, 22 bp, Artificial Sequence
  chemically synthesized
aacttctcaagtttgatatcct

SEQ ID NO: 960740 - DNA, 22 bp, Artificial Sequence
  chemically synthesized
aaatgattccaaggatatcaaa

SEQ ID NO: 960741 - DNA, 22 bp, Artificial Sequence
  chemically synthesized
caaggatatcaaacttgagaag

SEQ ID NO: 960742 - DNA, 22 bp, Artificial Sequence
  chemically synthesized
cgtagacaatcagctcaacttc

SEQ ID NO: 960743 - DNA, 22 bp, Artificial Sequence
  chemically synthesized
ttacgtagacaatcagctcaac

SEQ ID NO: 960744 - DNA, 22 bp, Artificial Sequence
  chemically synthesized
attacgtagacaatcagctcaa

SEQ ID NO: 960745 - DNA, 22 bp, Artificial Sequence
  chemically synthesized
gagaagttgagctgattgtcta

SEQ ID NO: 960746 - DNA, 22 bp, Artificial Sequence
  chemically synthesized
agaagttgagctgattgtctac

SEQ ID NO: 960747 - DNA, 22 bp, Artificial Sequence
  chemically synthesized
tggtgtgatttattacgtagac

SEQ ID NO: 960748 - DNA, 22 bp, Artificial Sequence
  chemically synthesized
ctgtggtgtgatttattacgta

SEQ ID NO: 960749 - DNA, 22 bp, Artificial Sequence
  chemically synthesized
agctgattgtctacgtaataaa

SEQ ID NO: 960750 - DNA, 22 bp, Artificial Sequence
  chemically synthesized
attgtctacgtaataaatcaca

SEQ ID NO: 960751 - DNA, 22 bp, Artificial Sequence
  chemically synthesized
acatgttcctgtggtgtgattt

SEQ ID NO: 960752 - DNA, 22 bp, Artificial Sequence
  chemically synthesized
gacatgttcctgtggtgtgatt

SEQ ID NO: 960753 - DNA, 22 bp, Artificial Sequence
  chemically synthesized
tctacgtaataaatcacaccac

SEQ ID NO: 960754 - DNA, 22 bp, Artificial Sequence
  chemically synthesized
tgacatgttcctgtggtgtgat

SEQ ID NO: 960755 - DNA, 22 bp, Artificial Sequence
  chemically synthesized
ttgacatgttcctgtggtgtga

SEQ ID NO: 960756 - DNA, 22 bp, Artificial Sequence
  chemically synthesized
tttgacatgttcctgtggtgtg

SEQ ID NO: 960757 - DNA, 22 bp, Artificial Sequence
  chemically synthesized
cgtaataaatcacaccacagga

SEQ ID NO: 960758 - DNA, 22 bp, Artificial Sequence
  chemically synthesized
gtctttttgacatgttcctgtg

SEQ ID NO: 960759 - DNA, 22 bp, Artificial Sequence
  chemically synthesized
cattagtctttttgacatgttc

SEQ ID NO: 960760 - DNA, 22 bp, Artificial Sequence
  chemically synthesized
gcattagtctttttgacatgtt

SEQ ID NO: 960761 - DNA, 22 bp, Artificial Sequence
  chemically synthesized
gacggcaaagaacttgcattag

SEQ ID NO: 960762 - DNA, 22 bp, Artificial Sequence
  chemically synthesized
ggacggcaaagaacttgcatta

SEQ ID NO: 960763 - DNA, 22 bp, Artificial Sequence
  chemically synthesized
tggacggcaaagaacttgcatt

SEQ ID NO: 960764 - DNA, 22 bp, Artificial Sequence
  chemically synthesized
atgcaagttctttgccgtccaa

SEQ ID NO: 960765 - DNA, 22 bp, Artificial Sequence
  chemically synthesized
acaaggagaaacaaaactttgg

SEQ ID NO: 960766 - DNA, 22 bp, Artificial Sequence
  chemically synthesized
tttgccgtccaaagttttgttt

SEQ ID NO: 960767 - DNA, 22 bp, Artificial Sequence
  chemically synthesized
tgccgtccaaagttttgtttct

SEQ ID NO: 960768 - DNA, 22 bp, Artificial Sequence
  chemically synthesized
gccgtccaaagttttgtttctc

SEQ ID NO: 960769 - DNA, 22 bp, Artificial Sequence
  chemically synthesized
ccgtccaaagttttgtttctcc

SEQ ID NO: 960770 - DNA, 22 bp, Artificial Sequence
  chemically synthesized
acatagcactgacaaggagaaa

SEQ ID NO: 960771 - DNA, 22 bp, Artificial Sequence
  chemically synthesized
tatatgttcacatagcactgac

SEQ ID NO: 960772 - DNA, 22 bp, Artificial Sequence
  chemically synthesized
tgtttctccttgtcagtgctat

SEQ ID NO: 960773 - DNA, 22 bp, Artificial Sequence
  chemically synthesized
gtttctccttgtcagtgctatg

SEQ ID NO: 960774 - DNA, 22 bp, Artificial Sequence
  chemically synthesized
tttctccttgtcagtgctatgt

SEQ ID NO: 960775 - DNA, 22 bp, Artificial Sequence
  chemically synthesized
ctccttgtcagtgctatgtgaa

SEQ ID NO: 960776 - DNA, 22 bp, Artificial Sequence
  chemically synthesized
tccttgtcagtgctatgtgaac

SEQ ID NO: 960777 - DNA, 22 bp, Artificial Sequence
  chemically synthesized
cttgtcagtgctatgtgaacat

SEQ ID NO: 960778 - DNA, 22 bp, Artificial Sequence
  chemically synthesized
gtcagtgctatgtgaacatata

SEQ ID NO: 960779 - DNA, 22 bp, Artificial Sequence
  chemically synthesized
tcagtgctatgtgaacatatat

SEQ ID NO: 960780 - DNA, 22 bp, Artificial Sequence
  chemically synthesized
caggaaaagaaagcaattatat

SEQ ID NO: 960781 - DNA, 22 bp, Artificial Sequence
  chemically synthesized
ccaggaaaagaaagcaattata

SEQ ID NO: 960782 - DNA, 22 bp, Artificial Sequence
  chemically synthesized
tgtgaacatatataattgcttt

SEQ ID NO: 960783 - DNA, 22 bp, Artificial Sequence
  chemically synthesized
cttccaggaaaagaaagcaatt

SEQ ID NO: 960784 - DNA, 22 bp, Artificial Sequence
  chemically synthesized
ggtaagctgcttccaggaaaag

SEQ ID NO: 960785 - DNA, 22 bp, Artificial Sequence
  chemically synthesized
gggtaagctgcttccaggaaaa

SEQ ID NO: 960786 - DNA, 22 bp, Artificial Sequence
  chemically synthesized
tgggtaagctgcttccaggaaa

SEQ ID NO: 960787 - DNA, 22 bp, Artificial Sequence
  chemically synthesized
ctttcttttcctggaagcagct

SEQ ID NO: 960788 - DNA, 22 bp, Artificial Sequence
  chemically synthesized
tcttttcctggaagcagcttac

SEQ ID NO: 960789 - DNA, 22 bp, Artificial Sequence
  chemically synthesized
cttttcctggaagcagcttacc

SEQ ID NO: 960790 - DNA, 22 bp, Artificial Sequence
  chemically synthesized
ttttcctggaagcagcttaccc

SEQ ID NO: 960791 - DNA, 22 bp, Artificial Sequence
  chemically synthesized
ttcctggaagcagcttacccaa

SEQ ID NO: 960792 - DNA, 22 bp, Artificial Sequence
  chemically synthesized
tcctggaagcagcttacccaaa

SEQ ID NO: 960793 - DNA, 22 bp, Artificial Sequence
  chemically synthesized
cctggaagcagcttacccaaag

SEQ ID NO: 960794 - DNA, 22 bp, Artificial Sequence
  chemically synthesized
ctggaagcagcttacccaaaga

SEQ ID NO: 960795 - DNA, 22 bp, Artificial Sequence
  chemically synthesized
gaagcagcttacccaaagacct

SEQ ID NO: 960796 - DNA, 22 bp, Artificial Sequence
  chemically synthesized
acccaaagacctaccattatta

SEQ ID NO: 960797 - DNA, 22 bp, Artificial Sequence
  chemically synthesized
cccaaagacctaccattattac

SEQ ID NO: 960798 - DNA, 22 bp, Artificial Sequence
  chemically synthesized
aacagagagaaatacggagtgt

SEQ ID NO: 960799 - DNA, 22 bp, Artificial Sequence
  chemically synthesized
taaacagagagaaatacggagt

SEQ ID NO: 960800 - DNA, 22 bp, Artificial Sequence
  chemically synthesized
ccattattacactccgtatttc

SEQ ID NO: 960801 - DNA, 22 bp, Artificial Sequence
  chemically synthesized
ttacactccgtatttctctctg

SEQ ID NO: 960802 - DNA, 22 bp, Artificial Sequence
  chemically synthesized
aaaaattctaaacagagagaaa

SEQ ID NO: 960803 - DNA, 22 bp, Artificial Sequence
  chemically synthesized
caaaaattctaaacagagagaa

SEQ ID NO: 960804 - DNA, 22 bp, Artificial Sequence
  chemically synthesized
cactccgtatttctctctgttt

SEQ ID NO: 960805 - DNA, 22 bp, Artificial Sequence
  chemically synthesized
tcatttcaaaaattctaaacag

SEQ ID NO: 960806 - DNA, 22 bp, Artificial Sequence
  chemically synthesized
cgtatttctctctgtttagaat

SEQ ID NO: 960807 - DNA, 22 bp, Artificial Sequence
  chemically synthesized
gagttatcatttcaaaaattct

SEQ ID NO: 960808 - DNA, 22 bp, Artificial Sequence
  chemically synthesized
ggagttatcatttcaaaaattc

SEQ ID NO: 960809 - DNA, 22 bp, Artificial Sequence
  chemically synthesized
ctctctgtttagaatttttgaa

SEQ ID NO: 960810 - DNA, 22 bp, Artificial Sequence
  chemically synthesized
tctctgtttagaatttttgaaa

SEQ ID NO: 960811 - DNA, 22 bp, Artificial Sequence
  chemically synthesized
tctgtttagaatttttgaaatg

SEQ ID NO: 960812 - DNA, 22 bp, Artificial Sequence
  chemically synthesized
atcttggagttatcatttcaaa

SEQ ID NO: 960813 - DNA, 22 bp, Artificial Sequence
  chemically synthesized
tgtttagaatttttgaaatgat

SEQ ID NO: 960814 - DNA, 22 bp, Artificial Sequence
  chemically synthesized
tttagaatttttgaaatgataa

SEQ ID NO: 960815 - DNA, 22 bp, Artificial Sequence
  chemically synthesized
aattaatcttggagttatcatt

SEQ ID NO: 960816 - DNA, 22 bp, Artificial Sequence
  chemically synthesized
agaatttttgaaatgataactc

SEQ ID NO: 960817 - DNA, 22 bp, Artificial Sequence
  chemically synthesized
caattaatcttggagttatcat

SEQ ID NO: 960818 - DNA, 22 bp, Artificial Sequence
  chemically synthesized
gaatttttgaaatgataactcc

SEQ ID NO: 960819 - DNA, 22 bp, Artificial Sequence
  chemically synthesized
gtttcaattaatcttggagtta

SEQ ID NO: 960820 - DNA, 22 bp, Artificial Sequence
  chemically synthesized
ttgaaatgataactccaagatt

SEQ ID NO: 960821 - DNA, 22 bp, Artificial Sequence
  chemically synthesized
tgaaatgataactccaagatta

SEQ ID NO: 960822 - DNA, 22 bp, Artificial Sequence
  chemically synthesized
gaaatgataactccaagattaa

SEQ ID NO: 960823 - DNA, 22 bp, Artificial Sequence
  chemically synthesized
aactagtttcaattaatcttgg

SEQ ID NO: 960824 - DNA, 22 bp, Artificial Sequence
  chemically synthesized
aaatgataactccaagattaat

SEQ ID NO: 960825 - DNA, 22 bp, Artificial Sequence
  chemically synthesized
gaactagtttcaattaatcttg

SEQ ID NO: 960826 - DNA, 22 bp, Artificial Sequence
  chemically synthesized
tagacttgaactagtttcaatt

SEQ ID NO: 960827 - DNA, 22 bp, Artificial Sequence
  chemically synthesized
gtagacttgaactagtttcaat

SEQ ID NO: 960828 - DNA, 22 bp, Artificial Sequence
  chemically synthesized
tgtagacttgaactagtttcaa

SEQ ID NO: 960829 - DNA, 22 bp, Artificial Sequence
  chemically synthesized
caagattaattgaaactagttc

SEQ ID NO: 960830 - DNA, 22 bp, Artificial Sequence
  chemically synthesized
ttttgtagacttgaactagttt

SEQ ID NO: 960831 - DNA, 22 bp, Artificial Sequence
  chemically synthesized
gttttgtagacttgaactagtt

SEQ ID NO: 960832 - DNA, 22 bp, Artificial Sequence
  chemically synthesized
attgaaactagttcaagtctac

SEQ ID NO: 960833 - DNA, 22 bp, Artificial Sequence
  chemically synthesized
aaactagttcaagtctacaaaa

SEQ ID NO: 960834 - DNA, 22 bp, Artificial Sequence
  chemically synthesized
tgagagcaaacttgttttgtag

SEQ ID NO: 960835 - DNA, 22 bp, Artificial Sequence
  chemically synthesized
gttcaagtctacaaaacaagtt

SEQ ID NO: 960836 - DNA, 22 bp, Artificial Sequence
  chemically synthesized
aattatgagagcaaacttgttt

SEQ ID NO: 960837 - DNA, 22 bp, Artificial Sequence
  chemically synthesized
aagtctacaaaacaagtttgct

SEQ ID NO: 960838 - DNA, 22 bp, Artificial Sequence
  chemically synthesized
caaaacaagtttgctctcataa

SEQ ID NO: 960839 - DNA, 22 bp, Artificial Sequence
  chemically synthesized
taaaaatcatatcacattcaat

SEQ ID NO: 960840 - DNA, 22 bp, Artificial Sequence
  chemically synthesized
ataaaaatcatatcacattcaa

SEQ ID NO: 960841 - DNA, 22 bp, Artificial Sequence
  chemically synthesized
gctctcataattgaatgtgata

SEQ ID NO: 960842 - DNA, 22 bp, Artificial Sequence
  chemically synthesized
ctctcataattgaatgtgatat

SEQ ID NO: 960843 - DNA, 22 bp, Artificial Sequence
  chemically synthesized
tcataattgaatgtgatatgat

SEQ ID NO: 960844 - DNA, 22 bp, Artificial Sequence
  chemically synthesized
ataattgaatgtgatatgattt

SEQ ID NO: 960845 - DNA, 22 bp, Artificial Sequence
  chemically synthesized
cagcaatttataaaaatcatat

SEQ ID NO: 960846 - DNA, 22 bp, Artificial Sequence
  chemically synthesized
aatgtgatatgatttttataaa

SEQ ID NO: 960847 - DNA, 22 bp, Artificial Sequence
  chemically synthesized
cagtgtgaagaatgtaactgca

SEQ ID NO: 960848 - DNA, 22 bp, Artificial Sequence
  chemically synthesized
ttataaattgctgcagttacat

SEQ ID NO: 960849 - DNA, 22 bp, Artificial Sequence
  chemically synthesized
tataaattgctgcagttacatt

SEQ ID NO: 960850 - DNA, 22 bp, Artificial Sequence
  chemically synthesized
ataaattgctgcagttacattc

SEQ ID NO: 960851 - DNA, 22 bp, Artificial Sequence
  chemically synthesized
taaattgctgcagttacattct

SEQ ID NO: 960852 - DNA, 22 bp, Artificial Sequence
  chemically synthesized
agcaaattacagtgtgaagaat

SEQ ID NO: 960853 - DNA, 22 bp, Artificial Sequence
  chemically synthesized
aagcaaattacagtgtgaagaa

SEQ ID NO: 960854 - DNA, 22 bp, Artificial Sequence
  chemically synthesized
ctgcagttacattcttcacact

SEQ ID NO: 960855 - DNA, 22 bp, Artificial Sequence
  chemically synthesized
cagttacattcttcacactgta

SEQ ID NO: 960856 - DNA, 22 bp, Artificial Sequence
  chemically synthesized
atttaagcaaattacagtgtga

SEQ ID NO: 960857 - DNA, 22 bp, Artificial Sequence
  chemically synthesized
ctcatttaagcaaattacagtg

SEQ ID NO: 960858 - DNA, 22 bp, Artificial Sequence
  chemically synthesized
cctcatttaagcaaattacagt

SEQ ID NO: 960859 - DNA, 22 bp, Artificial Sequence
  chemically synthesized
cattcttcacactgtaatttgc

SEQ ID NO: 960860 - DNA, 22 bp, Artificial Sequence
  chemically synthesized
tttcctcatttaagcaaattac

SEQ ID NO: 960861 - DNA, 22 bp, Artificial Sequence
  chemically synthesized
atttcctcatttaagcaaatta

SEQ ID NO: 960862 - DNA, 22 bp, Artificial Sequence
  chemically synthesized
tatttcctcatttaagcaaatt

SEQ ID NO: 960863 - DNA, 22 bp, Artificial Sequence
  chemically synthesized
ttcacactgtaatttgcttaaa

SEQ ID NO: 960864 - DNA, 22 bp, Artificial Sequence
  chemically synthesized
cacactgtaatttgcttaaatg

SEQ ID NO: 960865 - DNA, 22 bp, Artificial Sequence
  chemically synthesized
acactgtaatttgcttaaatga

SEQ ID NO: 960866 - DNA, 22 bp, Artificial Sequence
  chemically synthesized
aactttatttcctcatttaagc

SEQ ID NO: 960867 - DNA, 22 bp, Artificial Sequence
  chemically synthesized
taatttgcttaaatgaggaaat

SEQ ID NO: 960868 - DNA, 22 bp, Artificial Sequence
  chemically synthesized
gaatgttcaactttatttcctc

SEQ ID NO: 960869 - DNA, 22 bp, Artificial Sequence
  chemically synthesized
gcttaaatgaggaaataaagtt

SEQ ID NO: 960870 - DNA, 22 bp, Artificial Sequence
  chemically synthesized
cttaaatgaggaaataaagttg

SEQ ID NO: 960871 - DNA, 22 bp, Artificial Sequence
  chemically synthesized
atattagaatgttcaactttat

SEQ ID NO: 960872 - DNA, 22 bp, Artificial Sequence
  chemically synthesized
aaatgaggaaataaagttgaac

SEQ ID NO: 960873 - DNA, 22 bp, Artificial Sequence
  chemically synthesized
aatgaggaaataaagttgaaca

SEQ ID NO: 960874 - DNA, 22 bp, Artificial Sequence
  chemically synthesized
aaatacaggatatgttgatatt

SEQ ID NO: 960875 - DNA, 22 bp, Artificial Sequence
  chemically synthesized
caaatacaggatatgttgatat

SEQ ID NO: 960876 - DNA, 22 bp, Artificial Sequence
  chemically synthesized
tcaaatacaggatatgttgata

SEQ ID NO: 960877 - DNA, 22 bp, Artificial Sequence
  chemically synthesized
aacattctaatatcaacatatc

SEQ ID NO: 960878 - DNA, 22 bp, Artificial Sequence
  chemically synthesized
taatatcaacatatcctgtatt

SEQ ID NO: 960879 - DNA, 22 bp, Artificial Sequence
  chemically synthesized
aatgtcactttcaaatacagga

SEQ ID NO: 960880 - DNA, 22 bp, Artificial Sequence
  chemically synthesized
atatcaacatatcctgtatttg

SEQ ID NO: 960881 - DNA, 22 bp, Artificial Sequence
  chemically synthesized
agttaaatgtcactttcaaata

SEQ ID NO: 960882 - DNA, 22 bp, Artificial Sequence
  chemically synthesized
ttaagttaaatgtcactttcaa

SEQ ID NO: 960883 - DNA, 22 bp, Artificial Sequence
  chemically synthesized
tgttattaagttaaatgtcact

SEQ ID NO: 960884 - DNA, 22 bp, Artificial Sequence
  chemically synthesized
tatttgaaagtgacatttaact

SEQ ID NO: 960885 - DNA, 22 bp, Artificial Sequence
  chemically synthesized
gaaagtgacatttaacttaata

SEQ ID NO: 960886 - DNA, 22 bp, Artificial Sequence
  chemically synthesized
aaagtgacatttaacttaataa

SEQ ID NO: 960887 - DNA, 22 bp, Artificial Sequence
  chemically synthesized
tcaagtaaagacaatgtctgtg

SEQ ID NO: 960888 - DNA, 22 bp, Artificial Sequence
  chemically synthesized
aacttaataacacagacattgt

SEQ ID NO: 960889 - DNA, 22 bp, Artificial Sequence
  chemically synthesized
tgtcaagtaaagacaatgtctg

SEQ ID NO: 960890 - DNA, 22 bp, Artificial Sequence
  chemically synthesized
acttaataacacagacattgtc

SEQ ID NO: 960891 - DNA, 22 bp, Artificial Sequence
  chemically synthesized
ctgtcaagtaaagacaatgtct

SEQ ID NO: 960892 - DNA, 22 bp, Artificial Sequence
  chemically synthesized
tctgtcaagtaaagacaatgtc

SEQ ID NO: 960893 - DNA, 22 bp, Artificial Sequence
  chemically synthesized
aataacacagacattgtcttta

SEQ ID NO: 960894 - DNA, 22 bp, Artificial Sequence
  chemically synthesized
ttttctgtcaagtaaagacaat

SEQ ID NO: 960895 - DNA, 22 bp, Artificial Sequence
  chemically synthesized
ataacacagacattgtctttac

SEQ ID NO: 960896 - DNA, 22 bp, Artificial Sequence
  chemically synthesized
gttttctgtcaagtaaagacaa

SEQ ID NO: 960897 - DNA, 22 bp, Artificial Sequence
  chemically synthesized
tgttttctgtcaagtaaagaca

SEQ ID NO: 960898 - DNA, 22 bp, Artificial Sequence
  chemically synthesized
tctttacttgacagaaaacaaa

SEQ ID NO: 960899 - DNA, 22 bp, Artificial Sequence
  chemically synthesized
tacttgacagaaaacaaaatac

SEQ ID NO: 960900 - DNA, 22 bp, Artificial Sequence
  chemically synthesized
acttgacagaaaacaaaataca

SEQ ID NO: 960901 - DNA, 22 bp, Artificial Sequence
  chemically synthesized
cttgacagaaaacaaaatacat

SEQ ID NO: 960902 - DNA, 22 bp, Artificial Sequence
  chemically synthesized
gacagaaaacaaaatacattgg

SEQ ID NO: 960903 - DNA, 22 bp, Artificial Sequence
  chemically synthesized
acagaaaacaaaatacattgga

SEQ ID NO: 960904 - DNA, 22 bp, Artificial Sequence
  chemically synthesized
cacatacacaaacatccaatgt

SEQ ID NO: 960905 - DNA, 22 bp, Artificial Sequence
  chemically synthesized
acacatacacaaacatccaatg

SEQ ID NO: 960906 - DNA, 22 bp, Artificial Sequence
  chemically synthesized
tacacatacacaaacatccaat

SEQ ID NO: 960907 - DNA, 22 bp, Artificial Sequence
  chemically synthesized
ctttacacatacacaaacatcc

SEQ ID NO: 960908 - DNA, 22 bp, Artificial Sequence
  chemically synthesized
actttacacatacacaaacatc

SEQ ID NO: 960909 - DNA, 22 bp, Artificial Sequence
  chemically synthesized
gatgtttgtgtatgtgtaaagt

SEQ ID NO: 960910 - DNA, 22 bp, Artificial Sequence
  chemically synthesized
gtgtatgtgtaaagtaagtgtt

SEQ ID NO: 960911 - DNA, 22 bp, Artificial Sequence
  chemically synthesized
tgtatgtgtaaagtaagtgttg

SEQ ID NO: 960912 - DNA, 22 bp, Artificial Sequence
  chemically synthesized
tacagtccaaaatacaacactt

SEQ ID NO: 960913 - DNA, 22 bp, Artificial Sequence
  chemically synthesized
tgtacagtccaaaatacaacac

SEQ ID NO: 960914 - DNA, 22 bp, Artificial Sequence
  chemically synthesized
ctgtacagtccaaaatacaaca

SEQ ID NO: 960915 - DNA, 22 bp, Artificial Sequence
  chemically synthesized
tacttctgtacagtccaaaata

SEQ ID NO: 960916 - DNA, 22 bp, Artificial Sequence
  chemically synthesized
atggttatacttctgtacagtc

SEQ ID NO: 960917 - DNA, 22 bp, Artificial Sequence
  chemically synthesized
catggttatacttctgtacagt

SEQ ID NO: 960918 - DNA, 22 bp, Artificial Sequence
  chemically synthesized
tcatggttatacttctgtacag

SEQ ID NO: 960919 - DNA, 22 bp, Artificial Sequence
  chemically synthesized
ttcatggttatacttctgtaca

SEQ ID NO: 960920 - DNA, 22 bp, Artificial Sequence
  chemically synthesized
tattttggactgtacagaagta

SEQ ID NO: 960921 - DNA, 22 bp, Artificial Sequence
  chemically synthesized
gcacttttcatggttatacttc

SEQ ID NO: 960922 - DNA, 22 bp, Artificial Sequence
  chemically synthesized
tggactgtacagaagtataacc

SEQ ID NO: 960923 - DNA, 22 bp, Artificial Sequence
  chemically synthesized
agcacttttcatggttatactt

SEQ ID NO: 960924 - DNA, 22 bp, Artificial Sequence
  chemically synthesized
ggactgtacagaagtataacca

SEQ ID NO: 960925 - DNA, 22 bp, Artificial Sequence
  chemically synthesized
gactgtacagaagtataaccat

SEQ ID NO: 960926 - DNA, 22 bp, Artificial Sequence
  chemically synthesized
tacagaagtataaccatgaaaa

SEQ ID NO: 960927 - DNA, 22 bp, Artificial Sequence
  chemically synthesized
tggccaaagatgtttagcactt

SEQ ID NO: 960928 - DNA, 22 bp, Artificial Sequence
  chemically synthesized
tatggccaaagatgtttagcac

SEQ ID NO: 960929 - DNA, 22 bp, Artificial Sequence
  chemically synthesized
ctatggccaaagatgtttagca

SEQ ID NO: 960930 - DNA, 22 bp, Artificial Sequence
  chemically synthesized
tctatggccaaagatgtttagc

SEQ ID NO: 960931 - DNA, 22 bp, Artificial Sequence
  chemically synthesized
ctttctatggccaaagatgttt

SEQ ID NO: 960932 - DNA, 22 bp, Artificial Sequence
  chemically synthesized
aacatctttggccatagaaagc

SEQ ID NO: 960933 - DNA, 22 bp, Artificial Sequence
  chemically synthesized
aaaacacccgtgttgctttcta

SEQ ID NO: 960934 - DNA, 22 bp, Artificial Sequence
  chemically synthesized
caaaacacccgtgttgctttct

SEQ ID NO: 960935 - DNA, 22 bp, Artificial Sequence
  chemically synthesized
tggccatagaaagcaacacggg

SEQ ID NO: 960936 - DNA, 22 bp, Artificial Sequence
  chemically synthesized
ggccatagaaagcaacacgggt

SEQ ID NO: 960937 - DNA, 22 bp, Artificial Sequence
  chemically synthesized
ccatttcaaaacacccgtgttg

SEQ ID NO: 960938 - DNA, 22 bp, Artificial Sequence
  chemically synthesized
gccatagaaagcaacacgggtg

SEQ ID NO: 960939 - DNA, 22 bp, Artificial Sequence
  chemically synthesized
ttaccatttcaaaacacccgtg

SEQ ID NO: 960940 - DNA, 22 bp, Artificial Sequence
  chemically synthesized
attaccatttcaaaacacccgt

SEQ ID NO: 960941 - DNA, 22 bp, Artificial Sequence
  chemically synthesized
tattaccatttcaaaacacccg

SEQ ID NO: 960942 - DNA, 22 bp, Artificial Sequence
  chemically synthesized
aattttattaccatttcaaaac

SEQ ID NO: 960943 - DNA, 22 bp, Artificial Sequence
  chemically synthesized
ctcaattttattaccatttcaa

SEQ ID NO: 960944 - DNA, 22 bp, Artificial Sequence
  chemically synthesized
ttgctcaattttattaccattt

SEQ ID NO: 960945 - DNA, 22 bp, Artificial Sequence
  chemically synthesized
attgctcaattttattaccatt

SEQ ID NO: 960946 - DNA, 22 bp, Artificial Sequence
  chemically synthesized
tattgctcaattttattaccat

SEQ ID NO: 960947 - DNA, 22 bp, Artificial Sequence
  chemically synthesized
ctttattgctcaattttattac

SEQ ID NO: 960948 - DNA, 22 bp, Artificial Sequence
  chemically synthesized
tgctttattgctcaattttatt

SEQ ID NO: 960949 - DNA, 22 bp, Artificial Sequence
  chemically synthesized
ctgctttattgctcaattttat

SEQ ID NO: 960950 - DNA, 22 bp, Artificial Sequence
  chemically synthesized
tctgctttattgctcaatttta

SEQ ID NO: 960951 - DNA, 22 bp, Artificial Sequence
  chemically synthesized
tgaaatggtaataaaattgagc

SEQ ID NO: 960952 - DNA, 22 bp, Artificial Sequence
  chemically synthesized
ttctgctttattgctcaatttt

SEQ ID NO: 960953 - DNA, 22 bp, Artificial Sequence
  chemically synthesized
gaaatggtaataaaattgagca

SEQ ID NO: 960954 - DNA, 22 bp, Artificial Sequence
  chemically synthesized
aaatggtaataaaattgagcaa

SEQ ID NO: 960955 - DNA, 22 bp, Artificial Sequence
  chemically synthesized
tttttctgctttattgctcaat

SEQ ID NO: 960956 - DNA, 22 bp, Artificial Sequence
  chemically synthesized
tatgaatattatttttctgctt

SEQ ID NO: 960957 - DNA, 22 bp, Artificial Sequence
  chemically synthesized
atatgaatattatttttctgct

SEQ ID NO: 960958 - DNA, 22 bp, Artificial Sequence
  chemically synthesized
tatatgaatattatttttctgc

SEQ ID NO: 960959 - DNA, 22 bp, Artificial Sequence
  chemically synthesized
ttatatgaatattatttttctg

SEQ ID NO: 960960 - DNA, 22 bp, Artificial Sequence
  chemically synthesized
agcaataaagcagaaaaataat

SEQ ID NO: 960961 - DNA, 22 bp, Artificial Sequence
  chemically synthesized
acgtccacagacaagaccactt

SEQ ID NO: 960962 - DNA, 22 bp, Artificial Sequence
  chemically synthesized
aacgtccacagacaagaccact

SEQ ID NO: 960963 - DNA, 22 bp, Artificial Sequence
  chemically synthesized
atataaaagtggtcttgtctgt

SEQ ID NO: 960964 - DNA, 22 bp, Artificial Sequence
  chemically synthesized
aaatatttaacgtccacagaca

SEQ ID NO: 960965 - DNA, 22 bp, Artificial Sequence
  chemically synthesized
aagattaaaatatttaacgtcc

SEQ ID NO: 960966 - DNA, 22 bp, Artificial Sequence
  chemically synthesized
attcaagattaaaatatttaac

SEQ ID NO: 960967 - DNA, 22 bp, Artificial Sequence
  chemically synthesized
aattcaagattaaaatatttaa

SEQ ID NO: 960968 - DNA, 22 bp, Artificial Sequence
  chemically synthesized
gtctgtggacgttaaatatttt

SEQ ID NO: 960969 - DNA, 22 bp, Artificial Sequence
  chemically synthesized
taattcaagattaaaatattta

SEQ ID NO: 960970 - DNA, 22 bp, Artificial Sequence
  chemically synthesized
tctgtggacgttaaatatttta

SEQ ID NO: 960971 - DNA, 22 bp, Artificial Sequence
  chemically synthesized
ttttaattcaagattaaaatat

SEQ ID NO: 960972 - DNA, 22 bp, Artificial Sequence
  chemically synthesized
tggacgttaaatattttaatct

SEQ ID NO: 960973 - DNA, 22 bp, Artificial Sequence
  chemically synthesized
tgctgttttaattcaagattaa

SEQ ID NO: 960974 - DNA, 22 bp, Artificial Sequence
  chemically synthesized
aatattttaatcttgaattaaa

SEQ ID NO: 960975 - DNA, 22 bp, Artificial Sequence
  chemically synthesized
cgtgttgtgctgttttaattca

SEQ ID NO: 960976 - DNA, 22 bp, Artificial Sequence
  chemically synthesized
acgtgttgtgctgttttaattc

SEQ ID NO: 960977 - DNA, 22 bp, Artificial Sequence
  chemically synthesized
cttacgtgttgtgctgttttaa

SEQ ID NO: 960978 - DNA, 22 bp, Artificial Sequence
  chemically synthesized
taatcttgaattaaaacagcac

SEQ ID NO: 960979 - DNA, 22 bp, Artificial Sequence
  chemically synthesized
aatcttgaattaaaacagcaca

SEQ ID NO: 960980 - DNA, 22 bp, Artificial Sequence
  chemically synthesized
ttacttacgtgttgtgctgttt

SEQ ID NO: 960981 - DNA, 22 bp, Artificial Sequence
  chemically synthesized
atcttgaattaaaacagcacaa

SEQ ID NO: 960982 - DNA, 22 bp, Artificial Sequence
  chemically synthesized
gaattaaaacagcacaacacgt

SEQ ID NO: 960983 - DNA, 22 bp, Artificial Sequence
  chemically synthesized
aattaaaacagcacaacacgta

SEQ ID NO: 960984 - DNA, 22 bp, Artificial Sequence
  chemically synthesized
aaacagcacaacacgtaagtaa

SEQ ID NO: 960985 - DNA, 22 bp, Artificial Sequence
  chemically synthesized
aagagtgaacaaaatgtgccta

SEQ ID NO: 960986 - DNA, 22 bp, Artificial Sequence
  chemically synthesized
tcagaatgagttaaagagtgaa

SEQ ID NO: 960987 - DNA, 22 bp, Artificial Sequence
  chemically synthesized
gtcagaatgagttaaagagtga

SEQ ID NO: 960988 - DNA, 22 bp, Artificial Sequence
  chemically synthesized
tgtcagaatgagttaaagagtg

SEQ ID NO: 960989 - DNA, 22 bp, Artificial Sequence
  chemically synthesized
ttgtcagaatgagttaaagagt

SEQ ID NO: 960990 - DNA, 22 bp, Artificial Sequence
  chemically synthesized
tgttcactctttaactcattct

SEQ ID NO: 960991 - DNA, 22 bp, Artificial Sequence
  chemically synthesized
gttcactctttaactcattctg

SEQ ID NO: 960992 - DNA, 22 bp, Artificial Sequence
  chemically synthesized
ttcactctttaactcattctga

SEQ ID NO: 960993 - DNA, 22 bp, Artificial Sequence
  chemically synthesized
actctttaactcattctgacaa

SEQ ID NO: 960994 - DNA, 22 bp, Artificial Sequence
  chemically synthesized
tttaactcattctgacaaaagt

SEQ ID NO: 960995 - DNA, 22 bp, Artificial Sequence
  chemically synthesized
aaaacatgcacatacttttgtc

SEQ ID NO: 960996 - DNA, 22 bp, Artificial Sequence
  chemically synthesized
taactcattctgacaaaagtat

SEQ ID NO: 960997 - DNA, 22 bp, Artificial Sequence
  chemically synthesized
aactcattctgacaaaagtatg

SEQ ID NO: 960998 - DNA, 22 bp, Artificial Sequence
  chemically synthesized
actcattctgacaaaagtatgt

SEQ ID NO: 960999 - DNA, 22 bp, Artificial Sequence
  chemically synthesized
ttgaaaacatgcacatactttt

SEQ ID NO: 961000 - DNA, 22 bp, Artificial Sequence
  chemically synthesized
ttattgaaaacatgcacatact

SEQ ID NO: 961001 - DNA, 22 bp, Artificial Sequence
  chemically synthesized
attctgacaaaagtatgtgcat

SEQ ID NO: 961002 - DNA, 22 bp, Artificial Sequence
  chemically synthesized
gttattgaaaacatgcacatac

SEQ ID NO: 961003 - DNA, 22 bp, Artificial Sequence
  chemically synthesized
tgacaaaagtatgtgcatgttt

SEQ ID NO: 961004 - DNA, 22 bp, Artificial Sequence
  chemically synthesized
acaaaagtatgtgcatgttttc

SEQ ID NO: 961005 - DNA, 22 bp, Artificial Sequence
  chemically synthesized
tgaaatttgttattgaaaacat

SEQ ID NO: 961006 - DNA, 22 bp, Artificial Sequence
  chemically synthesized
tcaataacaaatttcacagtac

SEQ ID NO: 961007 - DNA, 22 bp, Artificial Sequence
  chemically synthesized
caataacaaatttcacagtacc

SEQ ID NO: 961008 - DNA, 22 bp, Artificial Sequence
  chemically synthesized
aataacaaatttcacagtacct

SEQ ID NO: 961009 - DNA, 22 bp, Artificial Sequence
  chemically synthesized
tcgaggaaagaaagaggtactg

SEQ ID NO: 961010 - DNA, 22 bp, Artificial Sequence
  chemically synthesized
actgtcgaggaaagaaagaggt

SEQ ID NO: 961011 - DNA, 22 bp, Artificial Sequence
  chemically synthesized
cacagtacctctttctttcctc

SEQ ID NO: 961012 - DNA, 22 bp, Artificial Sequence
  chemically synthesized
acagtacctctttctttcctcg

SEQ ID NO: 961013 - DNA, 22 bp, Artificial Sequence
  chemically synthesized
acaaagaagattcactgtcgag

SEQ ID NO: 961014 - DNA, 22 bp, Artificial Sequence
  chemically synthesized
ctgacaaagaagattcactgtc

SEQ ID NO: 961015 - DNA, 22 bp, Artificial Sequence
  chemically synthesized
tttctttcctcgacagtgaatc

SEQ ID NO: 961016 - DNA, 22 bp, Artificial Sequence
  chemically synthesized
cctgacaaagaagattcactgt

SEQ ID NO: 961017 - DNA, 22 bp, Artificial Sequence
  chemically synthesized
tcctgacaaagaagattcactg

SEQ ID NO: 961018 - DNA, 22 bp, Artificial Sequence
  chemically synthesized
tctttcctcgacagtgaatctt

SEQ ID NO: 961019 - DNA, 22 bp, Artificial Sequence
  chemically synthesized
ttcctgacaaagaagattcact

SEQ ID NO: 961020 - DNA, 22 bp, Artificial Sequence
  chemically synthesized
ctttcctcgacagtgaatcttc

SEQ ID NO: 961021 - DNA, 22 bp, Artificial Sequence
  chemically synthesized
tttcctgacaaagaagattcac

SEQ ID NO: 961022 - DNA, 22 bp, Artificial Sequence
  chemically synthesized
tttcctcgacagtgaatcttct

SEQ ID NO: 961023 - DNA, 22 bp, Artificial Sequence
  chemically synthesized
ttttcctgacaaagaagattca

SEQ ID NO: 961024 - DNA, 22 bp, Artificial Sequence
  chemically synthesized
tttttcctgacaaagaagattc

SEQ ID NO: 961025 - DNA, 22 bp, Artificial Sequence
  chemically synthesized
tcctcgacagtgaatcttcttt

SEQ ID NO: 961026 - DNA, 22 bp, Artificial Sequence
  chemically synthesized
cctcgacagtgaatcttctttg

SEQ ID NO: 961027 - DNA, 22 bp, Artificial Sequence
  chemically synthesized
ctcgacagtgaatcttctttgt

SEQ ID NO: 961028 - DNA, 22 bp, Artificial Sequence
  chemically synthesized
gacagtgaatcttctttgtcag

SEQ ID NO: 961029 - DNA, 22 bp, Artificial Sequence
  chemically synthesized
agattttttttcctgacaaaga

SEQ ID NO: 961030 - DNA, 22 bp, Artificial Sequence
  chemically synthesized
ttgagattttttttcctgacaa

SEQ ID NO: 961031 - DNA, 22 bp, Artificial Sequence
  chemically synthesized
gactgttgagattttttttcct

SEQ ID NO: 961032 - DNA, 22 bp, Artificial Sequence
  chemically synthesized
agactgttgagattttttttcc

SEQ ID NO: 961033 - DNA, 22 bp, Artificial Sequence
  chemically synthesized
tagactgttgagattttttttc

SEQ ID NO: 961034 - DNA, 22 bp, Artificial Sequence
  chemically synthesized
tttagactgttgagattttttt

SEQ ID NO: 961035 - DNA, 22 bp, Artificial Sequence
  chemically synthesized
ctttgtcaggaaaaaaaatctc

SEQ ID NO: 961036 - DNA, 22 bp, Artificial Sequence
  chemically synthesized
ctttagactgttgagatttttt

SEQ ID NO: 961037 - DNA, 22 bp, Artificial Sequence
  chemically synthesized
tttgtcaggaaaaaaaatctca

SEQ ID NO: 961038 - DNA, 22 bp, Artificial Sequence
  chemically synthesized
ttctttagactgttgagatttt

SEQ ID NO: 961039 - DNA, 22 bp, Artificial Sequence
  chemically synthesized
tgtcaggaaaaaaaatctcaac

SEQ ID NO: 961040 - DNA, 22 bp, Artificial Sequence
  chemically synthesized
gtcaggaaaaaaaatctcaaca

SEQ ID NO: 961041 - DNA, 22 bp, Artificial Sequence
  chemically synthesized
tcaggaaaaaaaatctcaacag

SEQ ID NO: 961042 - DNA, 22 bp, Artificial Sequence
  chemically synthesized
agaaaattcttctttagactgt

SEQ ID NO: 961043 - DNA, 22 bp, Artificial Sequence
  chemically synthesized
aagaaaattcttctttagactg

SEQ ID NO: 961044 - DNA, 22 bp, Artificial Sequence
  chemically synthesized
aacagtctaaagaagaattttc

SEQ ID NO: 961045 - DNA, 22 bp, Artificial Sequence
  chemically synthesized
aagaagaattttcttaaacatg

SEQ ID NO: 961046 - DNA, 22 bp, Artificial Sequence
  chemically synthesized
atatggatatgtcatgtttaag

SEQ ID NO: 961047 - DNA, 22 bp, Artificial Sequence
  chemically synthesized
gatatggatatgtcatgtttaa

SEQ ID NO: 961048 - DNA, 22 bp, Artificial Sequence
  chemically synthesized
cttgatatggatatgtcatgtt

SEQ ID NO: 961049 - DNA, 22 bp, Artificial Sequence
  chemically synthesized
tcttaaacatgacatatccata

SEQ ID NO: 961050 - DNA, 22 bp, Artificial Sequence
  chemically synthesized
atggctgcttgatatggatatg

SEQ ID NO: 961051 - DNA, 22 bp, Artificial Sequence
  chemically synthesized
cttaaacatgacatatccatat

SEQ ID NO: 961052 - DNA, 22 bp, Artificial Sequence
  chemically synthesized
catggctgcttgatatggatat

SEQ ID NO: 961053 - DNA, 22 bp, Artificial Sequence
  chemically synthesized
ttaaacatgacatatccatatc

SEQ ID NO: 961054 - DNA, 22 bp, Artificial Sequence
  chemically synthesized
aaacatgacatatccatatcaa

SEQ ID NO: 961055 - DNA, 22 bp, Artificial Sequence
  chemically synthesized
cttcatggctgcttgatatgga

SEQ ID NO: 961056 - DNA, 22 bp, Artificial Sequence
  chemically synthesized
aacatgacatatccatatcaag

SEQ ID NO: 961057 - DNA, 22 bp, Artificial Sequence
  chemically synthesized
gaaacattccttcatggctgct

SEQ ID NO: 961058 - DNA, 22 bp, Artificial Sequence
  chemically synthesized
cagtaagaactagaaacattcc

SEQ ID NO: 961059 - DNA, 22 bp, Artificial Sequence
  chemically synthesized
ctagttcttactgtaatatttt

SEQ ID NO: 961060 - DNA, 22 bp, Artificial Sequence
  chemically synthesized
tagttcttactgtaatattttt

SEQ ID NO: 961061 - DNA, 22 bp, Artificial Sequence
  chemically synthesized
gttcttactgtaatatttttct

SEQ ID NO: 961062 - DNA, 22 bp, Artificial Sequence
  chemically synthesized
ttactgtaatatttttcttgcc

SEQ ID NO: 961063 - DNA, 22 bp, Artificial Sequence
  chemically synthesized
tgaagagggacatggcaagaaa

SEQ ID NO: 961064 - DNA, 22 bp, Artificial Sequence
  chemically synthesized
actgtaatatttttcttgccat

SEQ ID NO: 961065 - DNA, 22 bp, Artificial Sequence
  chemically synthesized
ctgtaatatttttcttgccatg

SEQ ID NO: 961066 - DNA, 22 bp, Artificial Sequence
  chemically synthesized
taatatttttcttgccatgtcc

SEQ ID NO: 961067 - DNA, 22 bp, Artificial Sequence
  chemically synthesized
aaagtacacctgtgaagaggga

SEQ ID NO: 961068 - DNA, 22 bp, Artificial Sequence
  chemically synthesized
ttcttgccatgtccctcttcac

SEQ ID NO: 961069 - DNA, 22 bp, Artificial Sequence
  chemically synthesized
tcttgccatgtccctcttcaca

SEQ ID NO: 961070 - DNA, 22 bp, Artificial Sequence
  chemically synthesized
cttgccatgtccctcttcacag

SEQ ID NO: 961071 - DNA, 22 bp, Artificial Sequence
  chemically synthesized
ttgccatgtccctcttcacagg

SEQ ID NO: 961072 - DNA, 22 bp, Artificial Sequence
  chemically synthesized
attcaaagtacacctgtgaaga

SEQ ID NO: 961073 - DNA, 22 bp, Artificial Sequence
  chemically synthesized
gccatgtccctcttcacaggtg

SEQ ID NO: 961074 - DNA, 22 bp, Artificial Sequence
  chemically synthesized
ccatgtccctcttcacaggtgt

SEQ ID NO: 961075 - DNA, 22 bp, Artificial Sequence
  chemically synthesized
atcaatctgattcaaagtacac

SEQ ID NO: 961076 - DNA, 22 bp, Artificial Sequence
  chemically synthesized
ttcacaggtgtactttgaatca

SEQ ID NO: 961077 - DNA, 22 bp, Artificial Sequence
  chemically synthesized
cacaggtgtactttgaatcaga

SEQ ID NO: 961078 - DNA, 22 bp, Artificial Sequence
  chemically synthesized
acaggtgtactttgaatcagat

SEQ ID NO: 961079 - DNA, 22 bp, Artificial Sequence
  chemically synthesized
ataagttaatcaatctgattca

SEQ ID NO: 961080 - DNA, 22 bp, Artificial Sequence
  chemically synthesized
aaccactgataagttaatcaat

SEQ ID NO: 961081 - DNA, 22 bp, Artificial Sequence
  chemically synthesized
tgaatcagattgattaacttat

SEQ ID NO: 961082 - DNA, 22 bp, Artificial Sequence
  chemically synthesized
gaatcagattgattaacttatc

SEQ ID NO: 961083 - DNA, 22 bp, Artificial Sequence
  chemically synthesized
aatcagattgattaacttatca

SEQ ID NO: 961084 - DNA, 22 bp, Artificial Sequence
  chemically synthesized
aacaattaaaccactgataagt

SEQ ID NO: 961085 - DNA, 22 bp, Artificial Sequence
  chemically synthesized
attaacttatcagtggtttaat

SEQ ID NO: 961086 - DNA, 22 bp, Artificial Sequence
  chemically synthesized
acttatcagtggtttaattgtt

SEQ ID NO: 961087 - DNA, 22 bp, Artificial Sequence
  chemically synthesized
atcagtggtttaattgttcaat

SEQ ID NO: 961088 - DNA, 22 bp, Artificial Sequence
  chemically synthesized
tcagtggtttaattgttcaata

SEQ ID NO: 961089 - DNA, 22 bp, Artificial Sequence
  chemically synthesized
atacatggaacaaatattgaac

SEQ ID NO: 961090 - DNA, 22 bp, Artificial Sequence
  chemically synthesized
aattgttcaatatttgttccat

SEQ ID NO: 961091 - DNA, 22 bp, Artificial Sequence
  chemically synthesized
attgttcaatatttgttccatg

SEQ ID NO: 961092 - DNA, 22 bp, Artificial Sequence
  chemically synthesized
taaaatattaatacatggaaca

SEQ ID NO: 961093 - DNA, 22 bp, Artificial Sequence
  chemically synthesized
ataaaatattaatacatggaac

SEQ ID NO: 961094 - DNA, 22 bp, Artificial Sequence
  chemically synthesized
tataaaatattaatacatggaa

SEQ ID NO: 961095 - DNA, 22 bp, Artificial Sequence
  chemically synthesized
ttcaatatttgttccatgtatt

SEQ ID NO: 961096 - DNA, 22 bp, Artificial Sequence
  chemically synthesized
aatatttgttccatgtattaat

SEQ ID NO: 961097 - DNA, 22 bp, Artificial Sequence
  chemically synthesized
aaaatcctttataaaatattaa

SEQ ID NO: 961098 - DNA, 22 bp, Artificial Sequence
  chemically synthesized
gttccatgtattaatattttat

SEQ ID NO: 961099 - DNA, 22 bp, Artificial Sequence
  chemically synthesized
ttccatgtattaatattttata

SEQ ID NO: 961100 - DNA, 22 bp, Artificial Sequence
  chemically synthesized
catgtattaatattttataaag

SEQ ID NO: 961101 - DNA, 22 bp, Artificial Sequence
  chemically synthesized
ccccaggttcaaaatcctttat

SEQ ID NO: 961102 - DNA, 22 bp, Artificial Sequence
  chemically synthesized
gccccaggttcaaaatccttta

SEQ ID NO: 961103 - DNA, 22 bp, Artificial Sequence
  chemically synthesized
tgccccaggttcaaaatccttt

SEQ ID NO: 961104 - DNA, 22 bp, Artificial Sequence
  chemically synthesized
atattttataaaggattttgaa

SEQ ID NO: 961105 - DNA, 22 bp, Artificial Sequence
  chemically synthesized
tataaaggattttgaacctggg

SEQ ID NO: 961106 - DNA, 22 bp, Artificial Sequence
  chemically synthesized
ataaaggattttgaacctgggg

SEQ ID NO: 961107 - DNA, 22 bp, Artificial Sequence
  chemically synthesized
taaaggattttgaacctggggc

SEQ ID NO: 961108 - DNA, 22 bp, Artificial Sequence
  chemically synthesized
gtgcagaggttttgccccaggt

SEQ ID NO: 961109 - DNA, 22 bp, Artificial Sequence
  chemically synthesized
agtgcagaggttttgccccagg

SEQ ID NO: 961110 - DNA, 22 bp, Artificial Sequence
  chemically synthesized
tgaacctggggcaaaacctctg

SEQ ID NO: 961111 - DNA, 22 bp, Artificial Sequence
  chemically synthesized
gaacctggggcaaaacctctgc

SEQ ID NO: 961112 - DNA, 22 bp, Artificial Sequence
  chemically synthesized
aacctggggcaaaacctctgca

SEQ ID NO: 961113 - DNA, 22 bp, Artificial Sequence
  chemically synthesized
gggcaaaacctctgcactaaat

SEQ ID NO: 961114 - DNA, 22 bp, Artificial Sequence
  chemically synthesized
gaaaagatcgatggatggggga

SEQ ID NO: 961115 - DNA, 22 bp, Artificial Sequence
  chemically synthesized
tgcactaaatttcccccatcca

SEQ ID NO: 961116 - DNA, 22 bp, Artificial Sequence
  chemically synthesized
cactaaatttcccccatccatc

SEQ ID NO: 961117 - DNA, 22 bp, Artificial Sequence
  chemically synthesized
agttggaaaagatcgatggatg

SEQ ID NO: 961118 - DNA, 22 bp, Artificial Sequence
  chemically synthesized
aatttcccccatccatcgatct

SEQ ID NO: 961119 - DNA, 22 bp, Artificial Sequence
  chemically synthesized
cccccatccatcgatcttttcc

SEQ ID NO: 961120 - DNA, 22 bp, Artificial Sequence
  chemically synthesized
aaatgctgagttggaaaagatc

SEQ ID NO: 961121 - DNA, 22 bp, Artificial Sequence
  chemically synthesized
ccccatccatcgatcttttcca

SEQ ID NO: 961122 - DNA, 22 bp, Artificial Sequence
  chemically synthesized
ttgaaatgctgagttggaaaag

SEQ ID NO: 961123 - DNA, 22 bp, Artificial Sequence
  chemically synthesized
tgttgaaatgctgagttggaaa

SEQ ID NO: 961124 - DNA, 22 bp, Artificial Sequence
  chemically synthesized
agttctgttgaaatgctgagtt

SEQ ID NO: 961125 - DNA, 22 bp, Artificial Sequence
  chemically synthesized
aagttctgttgaaatgctgagt

SEQ ID NO: 961126 - DNA, 22 bp, Artificial Sequence
  chemically synthesized
tgatttaagttctgttgaaatg

SEQ ID NO: 961127 - DNA, 22 bp, Artificial Sequence
  chemically synthesized
ttccaactcagcatttcaacag

SEQ ID NO: 961128 - DNA, 22 bp, Artificial Sequence
  chemically synthesized
tccaactcagcatttcaacaga

SEQ ID NO: 961129 - DNA, 22 bp, Artificial Sequence
  chemically synthesized
ccaactcagcatttcaacagaa

SEQ ID NO: 961130 - DNA, 22 bp, Artificial Sequence
  chemically synthesized
caactcagcatttcaacagaac

SEQ ID NO: 961131 - DNA, 22 bp, Artificial Sequence
  chemically synthesized
agcatttcaacagaacttaaat

SEQ ID NO: 961132 - DNA, 22 bp, Artificial Sequence
  chemically synthesized
taagccagcacccctgtgattt

SEQ ID NO: 961133 - DNA, 22 bp, Artificial Sequence
  chemically synthesized
caacagaacttaaatcacaggg

SEQ ID NO: 961134 - DNA, 22 bp, Artificial Sequence
  chemically synthesized
ataagccagcacccctgtgatt

SEQ ID NO: 961135 - DNA, 22 bp, Artificial Sequence
  chemically synthesized
aacagaacttaaatcacagggg

SEQ ID NO: 961136 - DNA, 22 bp, Artificial Sequence
  chemically synthesized
tttataagccagcacccctgtg

SEQ ID NO: 961137 - DNA, 22 bp, Artificial Sequence
  chemically synthesized
atttataagccagcacccctgt

SEQ ID NO: 961138 - DNA, 22 bp, Artificial Sequence
  chemically synthesized
aaatcacaggggtgctggctta

SEQ ID NO: 961139 - DNA, 22 bp, Artificial Sequence
  chemically synthesized
tacatttatttataagccagca

SEQ ID NO: 961140 - DNA, 22 bp, Artificial Sequence
  chemically synthesized
aatcacaggggtgctggcttat

SEQ ID NO: 961141 - DNA, 22 bp, Artificial Sequence
  chemically synthesized
ttatacatttatttataagcca

SEQ ID NO: 961142 - DNA, 22 bp, Artificial Sequence
  chemically synthesized
ttgttatacatttatttataag

SEQ ID NO: 961143 - DNA, 22 bp, Artificial Sequence
  chemically synthesized
attgttatacatttatttataa

SEQ ID NO: 961144 - DNA, 22 bp, Artificial Sequence
  chemically synthesized
tttattgttatacatttattta

SEQ ID NO: 961145 - DNA, 22 bp, Artificial Sequence
  chemically synthesized
atttattgttatacatttattt

SEQ ID NO: 961146 - DNA, 22 bp, Artificial Sequence
  chemically synthesized
tatttattgttatacatttatt

SEQ ID NO: 961147 - DNA, 22 bp, Artificial Sequence
  chemically synthesized
ttatttattgttatacatttat

SEQ ID NO: 961148 - DNA, 22 bp, Artificial Sequence
  chemically synthesized
tttttatttattgttatacatt

SEQ ID NO: 961149 - DNA, 22 bp, Artificial Sequence
  chemically synthesized
gcttataaataaatgtataaca

SEQ ID NO: 961150 - DNA, 22 bp, Artificial Sequence
  chemically synthesized
ataaataaatgtataacaataa

SEQ ID NO: 961151 - DNA, 22 bp, Artificial Sequence
  chemically synthesized
taaataaatgtataacaataaa

SEQ ID NO: 961152 - DNA, 22 bp, Artificial Sequence
  chemically synthesized
aagccacaatcatctattttta

SEQ ID NO: 961153 - DNA, 22 bp, Artificial Sequence
  chemically synthesized
aaagccacaatcatctattttt

SEQ ID NO: 961154 - DNA, 22 bp, Artificial Sequence
  chemically synthesized
aacatatcttaaagccacaatc

SEQ ID NO: 961155 - DNA, 22 bp, Artificial Sequence
  chemically synthesized
tgaacatatcttaaagccacaa

SEQ ID NO: 961156 - DNA, 22 bp, Artificial Sequence
  chemically synthesized
cagtctctgaacatatcttaaa

SEQ ID NO: 961157 - DNA, 22 bp, Artificial Sequence
  chemically synthesized
ccagtctctgaacatatcttaa

SEQ ID NO: 961158 - DNA, 22 bp, Artificial Sequence
  chemically synthesized
ttccagtctctgaacatatctt

SEQ ID NO: 961159 - DNA, 22 bp, Artificial Sequence
  chemically synthesized
cttccagtctctgaacatatct

SEQ ID NO: 961160 - DNA, 22 bp, Artificial Sequence
  chemically synthesized
tcttccagtctctgaacatatc

SEQ ID NO: 961161 - DNA, 22 bp, Artificial Sequence
  chemically synthesized
tttcttccagtctctgaacata

SEQ ID NO: 961162 - DNA, 22 bp, Artificial Sequence
  chemically synthesized
tggctttaagatatgttcagag

SEQ ID NO: 961163 - DNA, 22 bp, Artificial Sequence
  chemically synthesized
ctctttcttccagtctctgaac

SEQ ID NO: 961164 - DNA, 22 bp, Artificial Sequence
  chemically synthesized
tgctctttcttccagtctctga

SEQ ID NO: 961165 - DNA, 22 bp, Artificial Sequence
  chemically synthesized
ctgctctttcttccagtctctg

SEQ ID NO: 961166 - DNA, 22 bp, Artificial Sequence
  chemically synthesized
taagatatgttcagagactgga

SEQ ID NO: 961167 - DNA, 22 bp, Artificial Sequence
  chemically synthesized
aagatatgttcagagactggaa

SEQ ID NO: 961168 - DNA, 22 bp, Artificial Sequence
  chemically synthesized
agatatgttcagagactggaag

SEQ ID NO: 961169 - DNA, 22 bp, Artificial Sequence
  chemically synthesized
gggacttctgctctttcttcca

SEQ ID NO: 961170 - DNA, 22 bp, Artificial Sequence
  chemically synthesized
agagactggaagaaagagcaga

SEQ ID NO: 961171 - DNA, 22 bp, Artificial Sequence
  chemically synthesized
gatggtcagttggggacttctg

SEQ ID NO: 961172 - DNA, 22 bp, Artificial Sequence
  chemically synthesized
gaagaaagagcagaagtcccca

SEQ ID NO: 961173 - DNA, 22 bp, Artificial Sequence
  chemically synthesized
gaacagttcgatggtcagttgg

SEQ ID NO: 961174 - DNA, 22 bp, Artificial Sequence
  chemically synthesized
accatcgaactgttctaatgtc

SEQ ID NO: 961175 - DNA, 22 bp, Artificial Sequence
  chemically synthesized
tgtggggcaaataaaatggaca

SEQ ID NO: 961176 - DNA, 22 bp, Artificial Sequence
  chemically synthesized
ttctaatgtccattttatttgc

SEQ ID NO: 961177 - DNA, 22 bp, Artificial Sequence
  chemically synthesized
aacactatgtggggcaaataaa

SEQ ID NO: 961178 - DNA, 22 bp, Artificial Sequence
  chemically synthesized
aaacactatgtggggcaaataa

SEQ ID NO: 961179 - DNA, 22 bp, Artificial Sequence
  chemically synthesized
taatgtccattttatttgcccc

SEQ ID NO: 961180 - DNA, 22 bp, Artificial Sequence
  chemically synthesized
atgtccattttatttgccccac

SEQ ID NO: 961181 - DNA, 22 bp, Artificial Sequence
  chemically synthesized
aaatatttaaacactatgtggg

SEQ ID NO: 961182 - DNA, 22 bp, Artificial Sequence
  chemically synthesized
tatttgccccacatagtgttta

SEQ ID NO: 961183 - DNA, 22 bp, Artificial Sequence
  chemically synthesized
atttgccccacatagtgtttaa

SEQ ID NO: 961184 - DNA, 22 bp, Artificial Sequence
  chemically synthesized
tttgccccacatagtgtttaaa

SEQ ID NO: 961185 - DNA, 22 bp, Artificial Sequence
  chemically synthesized
tatactgaaatatttaaacact

SEQ ID NO: 961186 - DNA, 22 bp, Artificial Sequence
  chemically synthesized
gccccacatagtgtttaaatat

SEQ ID NO: 961187 - DNA, 22 bp, Artificial Sequence
  chemically synthesized
ccccacatagtgtttaaatatt

SEQ ID NO: 961188 - DNA, 22 bp, Artificial Sequence
  chemically synthesized
actatatactgaaatatttaaa

SEQ ID NO: 961189 - DNA, 22 bp, Artificial Sequence
  chemically synthesized
caagctgactatatactgaaat

SEQ ID NO: 961190 - DNA, 22 bp, Artificial Sequence
  chemically synthesized
aaatatttcagtatatagtcag

SEQ ID NO: 961191 - DNA, 22 bp, Artificial Sequence
  chemically synthesized
aatatttcagtatatagtcagc

SEQ ID NO: 961192 - DNA, 22 bp, Artificial Sequence
  chemically synthesized
tgcaagaggttccaagctgact

SEQ ID NO: 961193 - DNA, 22 bp, Artificial Sequence
  chemically synthesized
cagtatatagtcagcttggaac

SEQ ID NO: 961194 - DNA, 22 bp, Artificial Sequence
  chemically synthesized
tctatgcaagaggttccaagct

SEQ ID NO: 961195 - DNA, 22 bp, Artificial Sequence
  chemically synthesized
agtatatagtcagcttggaacc

SEQ ID NO: 961196 - DNA, 22 bp, Artificial Sequence
  chemically synthesized
ggaacctcttgcatagatagcc

SEQ ID NO: 961197 - DNA, 22 bp, Artificial Sequence
  chemically synthesized
gaacctcttgcatagatagccc

SEQ ID NO: 961198 - DNA, 22 bp, Artificial Sequence
  chemically synthesized
ttgcatagatagcccttactac

SEQ ID NO: 961199 - DNA, 22 bp, Artificial Sequence
  chemically synthesized
gcatagatagcccttactactt

SEQ ID NO: 961200 - DNA, 22 bp, Artificial Sequence
  chemically synthesized
catagatagcccttactacttc

SEQ ID NO: 961201 - DNA, 22 bp, Artificial Sequence
  chemically synthesized
actacttcatgcttttctgtta

SEQ ID NO: 961202 - DNA, 22 bp, Artificial Sequence
  chemically synthesized
ctacttcatgcttttctgttac

SEQ ID NO: 961203 - DNA, 22 bp, Artificial Sequence
  chemically synthesized
cttcatgcttttctgttacctg

SEQ ID NO: 961204 - DNA, 22 bp, Artificial Sequence
  chemically synthesized
catgcttttctgttacctgact

SEQ ID NO: 961205 - DNA, 22 bp, Artificial Sequence
  chemically synthesized
atgcttttctgttacctgacta

SEQ ID NO: 961206 - DNA, 22 bp, Artificial Sequence
  chemically synthesized
ttctgttacctgactacccatg

SEQ ID NO: 961207 - DNA, 22 bp, Artificial Sequence
  chemically synthesized
tctgttacctgactacccatgt

SEQ ID NO: 961208 - DNA, 22 bp, Artificial Sequence
  chemically synthesized
ctgttacctgactacccatgtg

SEQ ID NO: 961209 - DNA, 22 bp, Artificial Sequence
  chemically synthesized
tgttacctgactacccatgtgt

SEQ ID NO: 961210 - DNA, 22 bp, Artificial Sequence
  chemically synthesized
caaaacaaaatgtacacatggg

SEQ ID NO: 961211 - DNA, 22 bp, Artificial Sequence
  chemically synthesized
ttacctgactacccatgtgtac

SEQ ID NO: 961212 - DNA, 22 bp, Artificial Sequence
  chemically synthesized
cctgactacccatgtgtacatt

SEQ ID NO: 961213 - DNA, 22 bp, Artificial Sequence
  chemically synthesized
actacccatgtgtacattttgt

SEQ ID NO: 961214 - DNA, 22 bp, Artificial Sequence
  chemically synthesized
cccatgtgtacattttgttttg

SEQ ID NO: 961215 - DNA, 22 bp, Artificial Sequence
  chemically synthesized
atgcaggtgttgcaaaacaaaa

SEQ ID NO: 961216 - DNA, 22 bp, Artificial Sequence
  chemically synthesized
tgttttgcaacacctgcattag

SEQ ID NO: 961217 - DNA, 22 bp, Artificial Sequence
  chemically synthesized
gttttgcaacacctgcattaga

SEQ ID NO: 961218 - DNA, 22 bp, Artificial Sequence
  chemically synthesized
ttttgcaacacctgcattagat

SEQ ID NO: 961219 - DNA, 22 bp, Artificial Sequence
  chemically synthesized
tgcaacacctgcattagatgct

SEQ ID NO: 961220 - DNA, 22 bp, Artificial Sequence
  chemically synthesized
gcaacacctgcattagatgctg

SEQ ID NO: 961221 - DNA, 22 bp, Artificial Sequence
  chemically synthesized
caacacctgcattagatgctga

SEQ ID NO: 961222 - DNA, 22 bp, Artificial Sequence
  chemically synthesized
cattagatgctgacatgttgat

SEQ ID NO: 961223 - DNA, 22 bp, Artificial Sequence
  chemically synthesized
gatgctgacatgttgattatat

SEQ ID NO: 961224 - DNA, 22 bp, Artificial Sequence
  chemically synthesized
acatgttgattatattgtatta

SEQ ID NO: 961225 - DNA, 22 bp, Artificial Sequence
  chemically synthesized
ggcatgcagtgtcagtataata

SEQ ID NO: 961226 - DNA, 22 bp, Artificial Sequence
  chemically synthesized
attatattgtattatactgaca

SEQ ID NO: 961227 - DNA, 22 bp, Artificial Sequence
  chemically synthesized
tattgtattatactgacactgc

SEQ ID NO: 961228 - DNA, 22 bp, Artificial Sequence
  chemically synthesized
tattatactgacactgcatgcc

SEQ ID NO: 961229 - DNA, 22 bp, Artificial Sequence
  chemically synthesized
tactgacactgcatgcctagcc

SEQ ID NO: 961230 - DNA, 22 bp, Artificial Sequence
  chemically synthesized
acactgcatgcctagcctcatc

SEQ ID NO: 961231 - DNA, 22 bp, Artificial Sequence
  chemically synthesized
tgaaagtagggacgagatgagg

SEQ ID NO: 961232 - DNA, 22 bp, Artificial Sequence
  chemically synthesized
catgcctagcctcatctcgtcc

SEQ ID NO: 961233 - DNA, 22 bp, Artificial Sequence
  chemically synthesized
agctgtgaaagtagggacgaga

SEQ ID NO: 961234 - DNA, 22 bp, Artificial Sequence
  chemically synthesized
gcctcatctcgtccctactttc

SEQ ID NO: 961235 - DNA, 22 bp, Artificial Sequence
  chemically synthesized
gatctcagctgtgaaagtaggg

SEQ ID NO: 961236 - DNA, 22 bp, Artificial Sequence
  chemically synthesized
tagatctcagctgtgaaagtag

SEQ ID NO: 961237 - DNA, 22 bp, Artificial Sequence
  chemically synthesized
atctcgtccctactttcacagc

SEQ ID NO: 961238 - DNA, 22 bp, Artificial Sequence
  chemically synthesized
gtccctactttcacagctgaga

SEQ ID NO: 961239 - DNA, 22 bp, Artificial Sequence
  chemically synthesized
caacagggctctagatctcagc

SEQ ID NO: 961240 - DNA, 22 bp, Artificial Sequence
  chemically synthesized
gcaacagggctctagatctcag

SEQ ID NO: 961241 - DNA, 22 bp, Artificial Sequence
  chemically synthesized
tgcaacagggctctagatctca

SEQ ID NO: 961242 - DNA, 22 bp, Artificial Sequence
  chemically synthesized
ttgcaacagggctctagatctc

SEQ ID NO: 961243 - DNA, 22 bp, Artificial Sequence
  chemically synthesized
ctttcacagctgagatctagag

SEQ ID NO: 961244 - DNA, 22 bp, Artificial Sequence
  chemically synthesized
tcacagctgagatctagagccc

SEQ ID NO: 961245 - DNA, 22 bp, Artificial Sequence
  chemically synthesized
cacagctgagatctagagccct

SEQ ID NO: 961246 - DNA, 22 bp, Artificial Sequence
  chemically synthesized
acagctgagatctagagccctg

SEQ ID NO: 961247 - DNA, 22 bp, Artificial Sequence
  chemically synthesized
aaatgtttttgcaacagggctc

SEQ ID NO: 961248 - DNA, 22 bp, Artificial Sequence
  chemically synthesized
agatctagagccctgttgcaaa

SEQ ID NO: 961249 - DNA, 22 bp, Artificial Sequence
  chemically synthesized
cagaggttaaaatgtttttgca

SEQ ID NO: 961250 - DNA, 22 bp, Artificial Sequence
  chemically synthesized
tacagaggttaaaatgtttttg

SEQ ID NO: 961251 - DNA, 22 bp, Artificial Sequence
  chemically synthesized
gagccctgttgcaaaaacattt

SEQ ID NO: 961252 - DNA, 22 bp, Artificial Sequence
  chemically synthesized
tctacagaggttaaaatgtttt

SEQ ID NO: 961253 - DNA, 22 bp, Artificial Sequence
  chemically synthesized
ctctctacagaggttaaaatgt

SEQ ID NO: 961254 - DNA, 22 bp, Artificial Sequence
  chemically synthesized
ttgcaaaaacattttaacctct

SEQ ID NO: 961255 - DNA, 22 bp, Artificial Sequence
  chemically synthesized
caaaaacattttaacctctgta

SEQ ID NO: 961256 - DNA, 22 bp, Artificial Sequence
  chemically synthesized
taacctctgtagagagcagggc

SEQ ID NO: 961257 - DNA, 22 bp, Artificial Sequence
  chemically synthesized
aacctctgtagagagcagggcg

SEQ ID NO: 961258 - DNA, 22 bp, Artificial Sequence
  chemically synthesized
acctctgtagagagcagggcgt

SEQ ID NO: 961259 - DNA, 22 bp, Artificial Sequence
  chemically synthesized
tgtagagagcagggcgtttttg

SEQ ID NO: 961260 - DNA, 22 bp, Artificial Sequence
  chemically synthesized
tagagagcagggcgtttttgtc

SEQ ID NO: 961261 - DNA, 22 bp, Artificial Sequence
  chemically synthesized
caagtaaaaacggaagacaaaa

SEQ ID NO: 961262 - DNA, 22 bp, Artificial Sequence
  chemically synthesized
atgatacctacaagtaaaaacg

SEQ ID NO: 961263 - DNA, 22 bp, Artificial Sequence
  chemically synthesized
aatgatacctacaagtaaaaac

SEQ ID NO: 961264 - DNA, 22 bp, Artificial Sequence
  chemically synthesized
ttgtcttccgtttttacttgta

SEQ ID NO: 961265 - DNA, 22 bp, Artificial Sequence
  chemically synthesized
tgtcttccgtttttacttgtag

SEQ ID NO: 961266 - DNA, 22 bp, Artificial Sequence
  chemically synthesized
gtcttccgtttttacttgtagg

SEQ ID NO: 961267 - DNA, 22 bp, Artificial Sequence
  chemically synthesized
tcttccgtttttacttgtaggt

SEQ ID NO: 961268 - DNA, 22 bp, Artificial Sequence
  chemically synthesized
ccgtttttacttgtaggtatca

SEQ ID NO: 961269 - DNA, 22 bp, Artificial Sequence
  chemically synthesized
cgtttttacttgtaggtatcat

SEQ ID NO: 961270 - DNA, 22 bp, Artificial Sequence
  chemically synthesized
ttacttgtaggtatcattaagt

SEQ ID NO: 961271 - DNA, 22 bp, Artificial Sequence
  chemically synthesized
tacttgtaggtatcattaagtc

SEQ ID NO: 961272 - DNA, 22 bp, Artificial Sequence
  chemically synthesized
acttgtaggtatcattaagtcc

SEQ ID NO: 961273 - DNA, 22 bp, Artificial Sequence
  chemically synthesized
cttgtaggtatcattaagtccc

SEQ ID NO: 961274 - DNA, 22 bp, Artificial Sequence
  chemically synthesized
gtaggtatcattaagtccccta

SEQ ID NO: 961275 - DNA, 22 bp, Artificial Sequence
  chemically synthesized
taggtatcattaagtcccctat

SEQ ID NO: 961276 - DNA, 22 bp, Artificial Sequence
  chemically synthesized
agcacccaaatatataggggac

SEQ ID NO: 961277 - DNA, 22 bp, Artificial Sequence
  chemically synthesized
cagcacccaaatatatagggga

SEQ ID NO: 961278 - DNA, 22 bp, Artificial Sequence
  chemically synthesized
ttcagcacccaaatatataggg

SEQ ID NO: 961279 - DNA, 22 bp, Artificial Sequence
  chemically synthesized
tctcttcagcacccaaatatat

SEQ ID NO: 961280 - DNA, 22 bp, Artificial Sequence
  chemically synthesized
ttatctcttcagcacccaaata

SEQ ID NO: 961281 - DNA, 22 bp, Artificial Sequence
  chemically synthesized
agtcccctatatatttgggtgc

SEQ ID NO: 961282 - DNA, 22 bp, Artificial Sequence
  chemically synthesized
ttattatctcttcagcacccaa

SEQ ID NO: 961283 - DNA, 22 bp, Artificial Sequence
  chemically synthesized
attattattatctcttcagcac

SEQ ID NO: 961284 - DNA, 22 bp, Artificial Sequence
  chemically synthesized
tatatttgggtgctgaagagat

SEQ ID NO: 961285 - DNA, 22 bp, Artificial Sequence
  chemically synthesized
gggtgctgaagagataataata

SEQ ID NO: 961286 - DNA, 22 bp, Artificial Sequence
  chemically synthesized
ggtgctgaagagataataataa

SEQ ID NO: 961287 - DNA, 22 bp, Artificial Sequence
  chemically synthesized
gtaagtgtgttcattattatta

SEQ ID NO: 961288 - DNA, 22 bp, Artificial Sequence
  chemically synthesized
cgtaagtgtgttcattattatt

SEQ ID NO: 961289 - DNA, 22 bp, Artificial Sequence
  chemically synthesized
tttcgtaagtgtgttcattatt

SEQ ID NO: 961290 - DNA, 22 bp, Artificial Sequence
  chemically synthesized
atttcgtaagtgtgttcattat

SEQ ID NO: 961291 - DNA, 22 bp, Artificial Sequence
  chemically synthesized
aagagataataataatgaacac

SEQ ID NO: 961292 - DNA, 22 bp, Artificial Sequence
  chemically synthesized
tttatttcgtaagtgtgttcat

SEQ ID NO: 961293 - DNA, 22 bp, Artificial Sequence
  chemically synthesized
atttatttcgtaagtgtgttca

SEQ ID NO: 961294 - DNA, 22 bp, Artificial Sequence
  chemically synthesized
atttatttatttcgtaagtgtg

SEQ ID NO: 961295 - DNA, 22 bp, Artificial Sequence
  chemically synthesized
acgaaataaataaatcagctca

SEQ ID NO: 961296 - DNA, 22 bp, Artificial Sequence
  chemically synthesized
cgaaataaataaatcagctcat

SEQ ID NO: 961297 - DNA, 22 bp, Artificial Sequence
  chemically synthesized
cagtcaccatatgatgagctga

SEQ ID NO: 961298 - DNA, 22 bp, Artificial Sequence
  chemically synthesized
tgcgcacagaagtaattccagt

SEQ ID NO: 961299 - DNA, 22 bp, Artificial Sequence
  chemically synthesized
atcatatggtgactggaattac

SEQ ID NO: 961300 - DNA, 22 bp, Artificial Sequence
  chemically synthesized
gtgcgcacagaagtaattccag

SEQ ID NO: 961301 - DNA, 22 bp, Artificial Sequence
  chemically synthesized
gtttgtgcgcacagaagtaatt

SEQ ID NO: 961302 - DNA, 22 bp, Artificial Sequence
  chemically synthesized
gcattagtttgtgcgcacagaa

SEQ ID NO: 961303 - DNA, 22 bp, Artificial Sequence
  chemically synthesized
gaattacttctgtgcgcacaaa

SEQ ID NO: 961304 - DNA, 22 bp, Artificial Sequence
  chemically synthesized
cttctgtgcgcacaaactaatg

SEQ ID NO: 961305 - DNA, 22 bp, Artificial Sequence
  chemically synthesized
ctgtgcgcacaaactaatgcta

SEQ ID NO: 961306 - DNA, 22 bp, Artificial Sequence
  chemically synthesized
tgtgcgcacaaactaatgctaa

SEQ ID NO: 961307 - DNA, 22 bp, Artificial Sequence
  chemically synthesized
tgcgcacaaactaatgctaaca

SEQ ID NO: 961308 - DNA, 22 bp, Artificial Sequence
  chemically synthesized
tgcatccgaaaaatgttagcat

SEQ ID NO: 961309 - DNA, 22 bp, Artificial Sequence
  chemically synthesized
gtgcatccgaaaaatgttagca

SEQ ID NO: 961310 - DNA, 22 bp, Artificial Sequence
  chemically synthesized
tgtgcatccgaaaaatgttagc

SEQ ID NO: 961311 - DNA, 22 bp, Artificial Sequence
  chemically synthesized
acatgttttgtgcatccgaaaa

SEQ ID NO: 961312 - DNA, 22 bp, Artificial Sequence
  chemically synthesized
atgctaacatttttcggatgca

SEQ ID NO: 961313 - DNA, 22 bp, Artificial Sequence
  chemically synthesized
tgtactgacatgttttgtgcat

SEQ ID NO: 961314 - DNA, 22 bp, Artificial Sequence
  chemically synthesized
acatttttcggatgcacaaaac

SEQ ID NO: 961315 - DNA, 22 bp, Artificial Sequence
  chemically synthesized
ttcggatgcacaaaacatgtca

SEQ ID NO: 961316 - DNA, 22 bp, Artificial Sequence
  chemically synthesized
gtaactatgtactgacatgttt

SEQ ID NO: 961317 - DNA, 22 bp, Artificial Sequence
  chemically synthesized
tcggatgcacaaaacatgtcag

SEQ ID NO: 961318 - DNA, 22 bp, Artificial Sequence
  chemically synthesized
cggatgcacaaaacatgtcagt

SEQ ID NO: 961319 - DNA, 22 bp, Artificial Sequence
  chemically synthesized
ggatgcacaaaacatgtcagta

SEQ ID NO: 961320 - DNA, 22 bp, Artificial Sequence
  chemically synthesized
tccatccatcgttggtaactat

SEQ ID NO: 961321 - DNA, 22 bp, Artificial Sequence
  chemically synthesized
tatccatccatcgttggtaact

SEQ ID NO: 961322 - DNA, 22 bp, Artificial Sequence
  chemically synthesized
ctatccatccatcgttggtaac

SEQ ID NO: 961323 - DNA, 22 bp, Artificial Sequence
  chemically synthesized
aaacaatatttctatccatcca

SEQ ID NO: 961324 - DNA, 22 bp, Artificial Sequence
  chemically synthesized
taaaacaatatttctatccatc

SEQ ID NO: 961325 - DNA, 22 bp, Artificial Sequence
  chemically synthesized
ctaaaacaatatttctatccat

SEQ ID NO: 961326 - DNA, 22 bp, Artificial Sequence
  chemically synthesized
tctaaaacaatatttctatcca

SEQ ID NO: 961327 - DNA, 22 bp, Artificial Sequence
  chemically synthesized
ccaacgatggatggatagaaat

SEQ ID NO: 961328 - DNA, 22 bp, Artificial Sequence
  chemically synthesized
agactttctaaaacaatatttc

SEQ ID NO: 961329 - DNA, 22 bp, Artificial Sequence
  chemically synthesized
aaactcagactttctaaaacaa

SEQ ID NO: 961330 - DNA, 22 bp, Artificial Sequence
  chemically synthesized
tattaaaactcagactttctaa

SEQ ID NO: 961331 - DNA, 22 bp, Artificial Sequence
  chemically synthesized
atattaaaactcagactttcta

SEQ ID NO: 961332 - DNA, 22 bp, Artificial Sequence
  chemically synthesized
tatattaaaactcagactttct

SEQ ID NO: 961333 - DNA, 22 bp, Artificial Sequence
  chemically synthesized
ttatattaaaactcagactttc

SEQ ID NO: 961334 - DNA, 22 bp, Artificial Sequence
  chemically synthesized
ttttagaaagtctgagttttaa

SEQ ID NO: 961335 - DNA, 22 bp, Artificial Sequence
  chemically synthesized
atccatttttatattaaaactc

SEQ ID NO: 961336 - DNA, 22 bp, Artificial Sequence
  chemically synthesized
tagaaagtctgagttttaatat

SEQ ID NO: 961337 - DNA, 22 bp, Artificial Sequence
  chemically synthesized
tcatccatttttatattaaaac

SEQ ID NO: 961338 - DNA, 22 bp, Artificial Sequence
  chemically synthesized
agaaagtctgagttttaatata

SEQ ID NO: 961339 - DNA, 22 bp, Artificial Sequence
  chemically synthesized
gaaagtctgagttttaatataa

SEQ ID NO: 961340 - DNA, 22 bp, Artificial Sequence
  chemically synthesized
tctcatccatttttatattaaa

SEQ ID NO: 961341 - DNA, 22 bp, Artificial Sequence
  chemically synthesized
ctctcatccatttttatattaa

SEQ ID NO: 961342 - DNA, 22 bp, Artificial Sequence
  chemically synthesized
cttctctcatccatttttatat

SEQ ID NO: 961343 - DNA, 22 bp, Artificial Sequence
  chemically synthesized
ccttctctcatccatttttata

SEQ ID NO: 961344 - DNA, 22 bp, Artificial Sequence
  chemically synthesized
agttttaatataaaaatggatg

SEQ ID NO: 961345 - DNA, 22 bp, Artificial Sequence
  chemically synthesized
ggaacttccttctctcatccat

SEQ ID NO: 961346 - DNA, 22 bp, Artificial Sequence
  chemically synthesized
aggaacttccttctctcatcca

SEQ ID NO: 961347 - DNA, 22 bp, Artificial Sequence
  chemically synthesized
taatataaaaatggatgagaga

SEQ ID NO: 961348 - DNA, 22 bp, Artificial Sequence
  chemically synthesized
aatataaaaatggatgagagaa

SEQ ID NO: 961349 - DNA, 22 bp, Artificial Sequence
  chemically synthesized
atataaaaatggatgagagaag

SEQ ID NO: 961350 - DNA, 22 bp, Artificial Sequence
  chemically synthesized
tatgaatttaggaacttccttc

SEQ ID NO: 961351 - DNA, 22 bp, Artificial Sequence
  chemically synthesized
gtatgaatttaggaacttcctt

SEQ ID NO: 961352 - DNA, 22 bp, Artificial Sequence
  chemically synthesized
taggtgatttgtatgaatttag

SEQ ID NO: 961353 - DNA, 22 bp, Artificial Sequence
  chemically synthesized
cactataggtgatttgtatgaa

SEQ ID NO: 961354 - DNA, 22 bp, Artificial Sequence
  chemically synthesized
ccactataggtgatttgtatga

SEQ ID NO: 961355 - DNA, 22 bp, Artificial Sequence
  chemically synthesized
ctaaattcatacaaatcaccta

SEQ ID NO: 961356 - DNA, 22 bp, Artificial Sequence
  chemically synthesized
aattcatacaaatcacctatag

SEQ ID NO: 961357 - DNA, 22 bp, Artificial Sequence
  chemically synthesized
catatccccatttccactatag

SEQ ID NO: 961358 - DNA, 22 bp, Artificial Sequence
  chemically synthesized
atacaaatcacctatagtggaa

SEQ ID NO: 961359 - DNA, 22 bp, Artificial Sequence
  chemically synthesized
tacatatccccatttccactat

SEQ ID NO: 961360 - DNA, 22 bp, Artificial Sequence
  chemically synthesized
ctacatatccccatttccacta

SEQ ID NO: 961361 - DNA, 22 bp, Artificial Sequence
  chemically synthesized
tttctacatatccccatttcca

SEQ ID NO: 961362 - DNA, 22 bp, Artificial Sequence
  chemically synthesized
atttctacatatccccatttcc

SEQ ID NO: 961363 - DNA, 22 bp, Artificial Sequence
  chemically synthesized
tatttctacatatccccatttc

SEQ ID NO: 961364 - DNA, 22 bp, Artificial Sequence
  chemically synthesized
ttttatttctacatatccccat

SEQ ID NO: 961365 - DNA, 22 bp, Artificial Sequence
  chemically synthesized
attttatttctacatatcccca

SEQ ID NO: 961366 - DNA, 22 bp, Artificial Sequence
  chemically synthesized
tagtggaaatggggatatgtag

SEQ ID NO: 961367 - DNA, 22 bp, Artificial Sequence
  chemically synthesized
atttattttatttctacatatc

SEQ ID NO: 961368 - DNA, 22 bp, Artificial Sequence
  chemically synthesized
aatttattttatttctacatat

SEQ ID NO: 961369 - DNA, 22 bp, Artificial Sequence
  chemically synthesized
agcttaatttattttatttcta

SEQ ID NO: 961370 - DNA, 22 bp, Artificial Sequence
  chemically synthesized
aatattaagcttaatttatttt

SEQ ID NO: 961371 - DNA, 22 bp, Artificial Sequence
  chemically synthesized
ctaaatattaagcttaatttat

SEQ ID NO: 961372 - DNA, 22 bp, Artificial Sequence
  chemically synthesized
tattactaaatattaagcttaa

SEQ ID NO: 961373 - DNA, 22 bp, Artificial Sequence
  chemically synthesized
actgtattactaaatattaagc

SEQ ID NO: 961374 - DNA, 22 bp, Artificial Sequence
  chemically synthesized
aactgtattactaaatattaag

SEQ ID NO: 961375 - DNA, 22 bp, Artificial Sequence
  chemically synthesized
taactgtattactaaatattaa

SEQ ID NO: 961376 - DNA, 22 bp, Artificial Sequence
  chemically synthesized
ttaactgtattactaaatatta

SEQ ID NO: 961377 - DNA, 22 bp, Artificial Sequence
  chemically synthesized
cttttaactgtattactaaata

SEQ ID NO: 961378 - DNA, 22 bp, Artificial Sequence
  chemically synthesized
agcttaatatttagtaatacag

SEQ ID NO: 961379 - DNA, 22 bp, Artificial Sequence
  chemically synthesized
aattgcttttaactgtattact

SEQ ID NO: 961380 - DNA, 22 bp, Artificial Sequence
  chemically synthesized
aatatttagtaatacagttaaa

SEQ ID NO: 961381 - DNA, 22 bp, Artificial Sequence
  chemically synthesized
atatttagtaatacagttaaaa

SEQ ID NO: 961382 - DNA, 22 bp, Artificial Sequence
  chemically synthesized
tatattgaattgcttttaactg

SEQ ID NO: 961383 - DNA, 22 bp, Artificial Sequence
  chemically synthesized
agtaatacagttaaaagcaatt

SEQ ID NO: 961384 - DNA, 22 bp, Artificial Sequence
  chemically synthesized
gtaatacagttaaaagcaattc

SEQ ID NO: 961385 - DNA, 22 bp, Artificial Sequence
  chemically synthesized
aaagcaattcaatatataaccc

SEQ ID NO: 961386 - DNA, 22 bp, Artificial Sequence
  chemically synthesized
aaaaatcatcccaatccatggg

SEQ ID NO: 961387 - DNA, 22 bp, Artificial Sequence
  chemically synthesized
aatatataacccatggattggg

SEQ ID NO: 961388 - DNA, 22 bp, Artificial Sequence
  chemically synthesized
taagcagtagactgaaaaatca

SEQ ID NO: 961389 - DNA, 22 bp, Artificial Sequence
  chemically synthesized
aaattgtaagcagtagactgaa

SEQ ID NO: 961390 - DNA, 22 bp, Artificial Sequence
  chemically synthesized
ggatgatttttcagtctactgc

SEQ ID NO: 961391 - DNA, 22 bp, Artificial Sequence
  chemically synthesized
atactgaaattgtaagcagtag

SEQ ID NO: 961392 - DNA, 22 bp, Artificial Sequence
  chemically synthesized
ttcagtctactgcttacaattt

SEQ ID NO: 961393 - DNA, 22 bp, Artificial Sequence
  chemically synthesized
tcagtctactgcttacaatttc

SEQ ID NO: 961394 - DNA, 22 bp, Artificial Sequence
  chemically synthesized
cagtctactgcttacaatttca

SEQ ID NO: 961395 - DNA, 22 bp, Artificial Sequence
  chemically synthesized
agtctactgcttacaatttcag

SEQ ID NO: 961396 - DNA, 22 bp, Artificial Sequence
  chemically synthesized
ctgcttacaatttcagtattaa

SEQ ID NO: 961397 - DNA, 22 bp, Artificial Sequence
  chemically synthesized
cttacaatttcagtattaacat

SEQ ID NO: 961398 - DNA, 22 bp, Artificial Sequence
  chemically synthesized
agtgagaagagcatgttaatac

SEQ ID NO: 961399 - DNA, 22 bp, Artificial Sequence
  chemically synthesized
aagtgagaagagcatgttaata

SEQ ID NO: 961400 - DNA, 22 bp, Artificial Sequence
  chemically synthesized
taagtgagaagagcatgttaat

SEQ ID NO: 961401 - DNA, 22 bp, Artificial Sequence
  chemically synthesized
acaatttcagtattaacatgct

SEQ ID NO: 961402 - DNA, 22 bp, Artificial Sequence
  chemically synthesized
caatttcagtattaacatgctc

SEQ ID NO: 961403 - DNA, 22 bp, Artificial Sequence
  chemically synthesized
atgttttaagtgagaagagcat

SEQ ID NO: 961404 - DNA, 22 bp, Artificial Sequence
  chemically synthesized
cagtattaacatgctcttctca

SEQ ID NO: 961405 - DNA, 22 bp, Artificial Sequence
  chemically synthesized
taatgttttaagtgagaagagc

SEQ ID NO: 961406 - DNA, 22 bp, Artificial Sequence
  chemically synthesized
agtattaacatgctcttctcac

SEQ ID NO: 961407 - DNA, 22 bp, Artificial Sequence
  chemically synthesized
ctaatgttttaagtgagaagag

SEQ ID NO: 961408 - DNA, 22 bp, Artificial Sequence
  chemically synthesized
tctaatgttttaagtgagaaga

SEQ ID NO: 961409 - DNA, 22 bp, Artificial Sequence
  chemically synthesized
ttctaatgttttaagtgagaag

SEQ ID NO: 961410 - DNA, 22 bp, Artificial Sequence
  chemically synthesized
tttttctaatgttttaagtgag

SEQ ID NO: 961411 - DNA, 22 bp, Artificial Sequence
  chemically synthesized
acatgctcttctcacttaaaac

SEQ ID NO: 961412 - DNA, 22 bp, Artificial Sequence
  chemically synthesized
acctatttttctaatgttttaa

SEQ ID NO: 961413 - DNA, 22 bp, Artificial Sequence
  chemically synthesized
aacctatttttctaatgtttta

SEQ ID NO: 961414 - DNA, 22 bp, Artificial Sequence
  chemically synthesized
taacctatttttctaatgtttt

SEQ ID NO: 961415 - DNA, 22 bp, Artificial Sequence
  chemically synthesized
ttaacctatttttctaatgttt

SEQ ID NO: 961416 - DNA, 22 bp, Artificial Sequence
  chemically synthesized
ttctcacttaaaacattagaaa

SEQ ID NO: 961417 - DNA, 22 bp, Artificial Sequence
  chemically synthesized
ctcacttaaaacattagaaaaa

SEQ ID NO: 961418 - DNA, 22 bp, Artificial Sequence
  chemically synthesized
tcacttaaaacattagaaaaat

SEQ ID NO: 961419 - DNA, 22 bp, Artificial Sequence
  chemically synthesized
acttaaaacattagaaaaatag

SEQ ID NO: 961420 - DNA, 22 bp, Artificial Sequence
  chemically synthesized
aaaatttttaacctatttttct

SEQ ID NO: 961421 - DNA, 22 bp, Artificial Sequence
  chemically synthesized
aaaacattagaaaaataggtta

SEQ ID NO: 961422 - DNA, 22 bp, Artificial Sequence
  chemically synthesized
aaacattagaaaaataggttaa

SEQ ID NO: 961423 - DNA, 22 bp, Artificial Sequence
  chemically synthesized
tccatgtgtctgaaaattttta

SEQ ID NO: 961424 - DNA, 22 bp, Artificial Sequence
  chemically synthesized
gaaaaataggttaaaaattttc

SEQ ID NO: 961425 - DNA, 22 bp, Artificial Sequence
  chemically synthesized
gtccatgtgtctgaaaattttt

SEQ ID NO: 961426 - DNA, 22 bp, Artificial Sequence
  chemically synthesized
tgtccatgtgtctgaaaatttt

SEQ ID NO: 961427 - DNA, 22 bp, Artificial Sequence
  chemically synthesized
tttgtccatgtgtctgaaaatt

SEQ ID NO: 961428 - DNA, 22 bp, Artificial Sequence
  chemically synthesized
aaaattttcagacacatggaca

SEQ ID NO: 961429 - DNA, 22 bp, Artificial Sequence
  chemically synthesized
tcagacacatggacaaagaatg

SEQ ID NO: 961430 - DNA, 22 bp, Artificial Sequence
  chemically synthesized
cagacacatggacaaagaatgt

SEQ ID NO: 961431 - DNA, 22 bp, Artificial Sequence
  chemically synthesized
agacacatggacaaagaatgtt

SEQ ID NO: 961432 - DNA, 22 bp, Artificial Sequence
  chemically synthesized
tcagaaagataaaaacattctt

SEQ ID NO: 961433 - DNA, 22 bp, Artificial Sequence
  chemically synthesized
ataatctgtcagaaagataaaa

SEQ ID NO: 961434 - DNA, 22 bp, Artificial Sequence
  chemically synthesized
tgataatctgtcagaaagataa

SEQ ID NO: 961435 - DNA, 22 bp, Artificial Sequence
  chemically synthesized
catattctgataatctgtcaga

SEQ ID NO: 961436 - DNA, 22 bp, Artificial Sequence
  chemically synthesized
ttatctttctgacagattatca

SEQ ID NO: 961437 - DNA, 22 bp, Artificial Sequence
  chemically synthesized
tatctttctgacagattatcag

SEQ ID NO: 961438 - DNA, 22 bp, Artificial Sequence
  chemically synthesized
atctttctgacagattatcaga

SEQ ID NO: 961439 - DNA, 22 bp, Artificial Sequence
  chemically synthesized
ataattacatattctgataatc

SEQ ID NO: 961440 - DNA, 22 bp, Artificial Sequence
  chemically synthesized
tctttctgacagattatcagaa

SEQ ID NO: 961441 - DNA, 22 bp, Artificial Sequence
  chemically synthesized
tctgacagattatcagaatatg

SEQ ID NO: 961442 - DNA, 22 bp, Artificial Sequence
  chemically synthesized
aactaataattacatattctga

SEQ ID NO: 961443 - DNA, 22 bp, Artificial Sequence
  chemically synthesized
ctgacagattatcagaatatgt

SEQ ID NO: 961444 - DNA, 22 bp, Artificial Sequence
  chemically synthesized
tgacagattatcagaatatgta

SEQ ID NO: 961445 - DNA, 22 bp, Artificial Sequence
  chemically synthesized
ttgaactaataattacatattc

SEQ ID NO: 961446 - DNA, 22 bp, Artificial Sequence
  chemically synthesized
acagattatcagaatatgtaat

SEQ ID NO: 961447 - DNA, 22 bp, Artificial Sequence
  chemically synthesized
attgaactaataattacatatt

SEQ ID NO: 961448 - DNA, 22 bp, Artificial Sequence
  chemically synthesized
tttattgaactaataattacat

SEQ ID NO: 961449 - DNA, 22 bp, Artificial Sequence
  chemically synthesized
atttattgaactaataattaca

SEQ ID NO: 961450 - DNA, 22 bp, Artificial Sequence
  chemically synthesized
tatttattgaactaataattac

SEQ ID NO: 961451 - DNA, 22 bp, Artificial Sequence
  chemically synthesized
tttatttattgaactaataatt

SEQ ID NO: 961452 - DNA, 22 bp, Artificial Sequence
  chemically synthesized
tcagaatatgtaattattagtt

SEQ ID NO: 961453 - DNA, 22 bp, Artificial Sequence
  chemically synthesized
ctttatttattgaactaataat

SEQ ID NO: 961454 - DNA, 22 bp, Artificial Sequence
  chemically synthesized
ccagtcacttctttatttattg

SEQ ID NO: 961455 - DNA, 22 bp, Artificial Sequence
  chemically synthesized
ttaccagtcacttctttattta

SEQ ID NO: 961456 - DNA, 22 bp, Artificial Sequence
  chemically synthesized
gttaccagtcacttctttattt

SEQ ID NO: 961457 - DNA, 22 bp, Artificial Sequence
  chemically synthesized
tgttaccagtcacttctttatt

SEQ ID NO: 961458 - DNA, 22 bp, Artificial Sequence
  chemically synthesized
ttagttcaataaataaagaagt

SEQ ID NO: 961459 - DNA, 22 bp, Artificial Sequence
  chemically synthesized
ttgttaccagtcacttctttat

SEQ ID NO: 961460 - DNA, 22 bp, Artificial Sequence
  chemically synthesized
gttcaataaataaagaagtgac

SEQ ID NO: 961461 - DNA, 22 bp, Artificial Sequence
  chemically synthesized
catttttgttaccagtcacttc

SEQ ID NO: 961462 - DNA, 22 bp, Artificial Sequence
  chemically synthesized
gcatttttgttaccagtcactt

SEQ ID NO: 961463 - DNA, 22 bp, Artificial Sequence
  chemically synthesized
aataaataaagaagtgactggt

SEQ ID NO: 961464 - DNA, 22 bp, Artificial Sequence
  chemically synthesized
tgcatttttgttaccagtcact

SEQ ID NO: 961465 - DNA, 22 bp, Artificial Sequence
  chemically synthesized
ttgcatttttgttaccagtcac

SEQ ID NO: 961466 - DNA, 22 bp, Artificial Sequence
  chemically synthesized
ttttgcatttttgttaccagtc

SEQ ID NO: 961467 - DNA, 22 bp, Artificial Sequence
  chemically synthesized
atcacagtgtgaattcttttgc

SEQ ID NO: 961468 - DNA, 22 bp, Artificial Sequence
  chemically synthesized
gtaacaaaaatgcaaaagaatt

SEQ ID NO: 961469 - DNA, 22 bp, Artificial Sequence
  chemically synthesized
gatcacagtgtgaattcttttg

SEQ ID NO: 961470 - DNA, 22 bp, Artificial Sequence
  chemically synthesized
tgatcacagtgtgaattctttt

SEQ ID NO: 961471 - DNA, 22 bp, Artificial Sequence
  chemically synthesized
ctttgatcacagtgtgaattct

SEQ ID NO: 961472 - DNA, 22 bp, Artificial Sequence
  chemically synthesized
tgctttgatcacagtgtgaatt

SEQ ID NO: 961473 - DNA, 22 bp, Artificial Sequence
  chemically synthesized
ttctgctttgatcacagtgtga

SEQ ID NO: 961474 - DNA, 22 bp, Artificial Sequence
  chemically synthesized
acactgtgatcaaagcagaata

SEQ ID NO: 961475 - DNA, 22 bp, Artificial Sequence
  chemically synthesized
tgatcaaagcagaataggatct

SEQ ID NO: 961476 - DNA, 22 bp, Artificial Sequence
  chemically synthesized
tatcaagtcatgtcggagatcc

SEQ ID NO: 961477 - DNA, 22 bp, Artificial Sequence
  chemically synthesized
gtatcaagtcatgtcggagatc

SEQ ID NO: 961478 - DNA, 22 bp, Artificial Sequence
  chemically synthesized
tgtatcaagtcatgtcggagat

SEQ ID NO: 961479 - DNA, 22 bp, Artificial Sequence
  chemically synthesized
tttgtatcaagtcatgtcggag

SEQ ID NO: 961480 - DNA, 22 bp, Artificial Sequence
  chemically synthesized
gaagtgtattctttgtatcaag

SEQ ID NO: 961481 - DNA, 22 bp, Artificial Sequence
  chemically synthesized
cgacatgacttgatacaaagaa

SEQ ID NO: 961482 - DNA, 22 bp, Artificial Sequence
  chemically synthesized
ggtgaattggaagtgtattctt

SEQ ID NO: 961483 - DNA, 22 bp, Artificial Sequence
  chemically synthesized
gatacaaagaatacacttccaa

SEQ ID NO: 961484 - DNA, 22 bp, Artificial Sequence
  chemically synthesized
atacaaagaatacacttccaat

SEQ ID NO: 961485 - DNA, 22 bp, Artificial Sequence
  chemically synthesized
tacataaaaataaaaattgggt

SEQ ID NO: 961486 - DNA, 22 bp, Artificial Sequence
  chemically synthesized
ccaattcacccaatttttattt

SEQ ID NO: 961487 - DNA, 22 bp, Artificial Sequence
  chemically synthesized
caattcacccaatttttatttt

SEQ ID NO: 961488 - DNA, 22 bp, Artificial Sequence
  chemically synthesized
atgtattatacataaaaataaa

SEQ ID NO: 961489 - DNA, 22 bp, Artificial Sequence
  chemically synthesized
acccaatttttatttttatgta

SEQ ID NO: 961490 - DNA, 22 bp, Artificial Sequence
  chemically synthesized
aaagtatctaatgtattataca

SEQ ID NO: 961491 - DNA, 22 bp, Artificial Sequence
  chemically synthesized
ttatttttatgtataatacatt

SEQ ID NO: 961492 - DNA, 22 bp, Artificial Sequence
  chemically synthesized
tatttttatgtataatacatta

SEQ ID NO: 961493 - DNA, 22 bp, Artificial Sequence
  chemically synthesized
atttttatgtataatacattag

SEQ ID NO: 961494 - DNA, 22 bp, Artificial Sequence
  chemically synthesized
tttttatgtataatacattaga

SEQ ID NO: 961495 - DNA, 22 bp, Artificial Sequence
  chemically synthesized
ttatgtataatacattagatac

SEQ ID NO: 961496 - DNA, 22 bp, Artificial Sequence
  chemically synthesized
tatgtataatacattagatact

SEQ ID NO: 961497 - DNA, 22 bp, Artificial Sequence
  chemically synthesized
gtggtcactaaaagtatctaat

SEQ ID NO: 961498 - DNA, 22 bp, Artificial Sequence
  chemically synthesized
atgtataatacattagatactt

SEQ ID NO: 961499 - DNA, 22 bp, Artificial Sequence
  chemically synthesized
tgtataatacattagatacttt

SEQ ID NO: 961500 - DNA, 22 bp, Artificial Sequence
  chemically synthesized
gatacttttagtgaccacgaat

SEQ ID NO: 961501 - DNA, 22 bp, Artificial Sequence
  chemically synthesized
ttagtgaccacgaatatttata

SEQ ID NO: 961502 - DNA, 22 bp, Artificial Sequence
  chemically synthesized
tagtgaccacgaatatttatat

SEQ ID NO: 961503 - DNA, 22 bp, Artificial Sequence
  chemically synthesized
agtgaccacgaatatttatatg

SEQ ID NO: 961504 - DNA, 22 bp, Artificial Sequence
  chemically synthesized
gtgaccacgaatatttatatga

SEQ ID NO: 961505 - DNA, 22 bp, Artificial Sequence
  chemically synthesized
aaaaaaaaagatgtcatataaa

SEQ ID NO: 961506 - DNA, 22 bp, Artificial Sequence
  chemically synthesized
aaagttgaaaaaaaaagatgtc

SEQ ID NO: 961507 - DNA, 22 bp, Artificial Sequence
  chemically synthesized
aaaagttgaaaaaaaaagatgt

SEQ ID NO: 961508 - DNA, 22 bp, Artificial Sequence
  chemically synthesized
gatcttaaaagttgaaaaaaaa

SEQ ID NO: 961509 - DNA, 22 bp, Artificial Sequence
  chemically synthesized
atatgacatctttttttttcaa

SEQ ID NO: 961510 - DNA, 22 bp, Artificial Sequence
  chemically synthesized
tatgacatctttttttttcaac

SEQ ID NO: 961511 - DNA, 22 bp, Artificial Sequence
  chemically synthesized
tggatcttaaaagttgaaaaaa

SEQ ID NO: 961512 - DNA, 22 bp, Artificial Sequence
  chemically synthesized
tttttttcaacttttaagatcc

SEQ ID NO: 961513 - DNA, 22 bp, Artificial Sequence
  chemically synthesized
ttttttcaacttttaagatcca

SEQ ID NO: 961514 - DNA, 22 bp, Artificial Sequence
  chemically synthesized
tttttcaacttttaagatccag

SEQ ID NO: 961515 - DNA, 22 bp, Artificial Sequence
  chemically synthesized
aacatgtaccctctggatctta

SEQ ID NO: 961516 - DNA, 22 bp, Artificial Sequence
  chemically synthesized
ttttcaacttttaagatccaga

SEQ ID NO: 961517 - DNA, 22 bp, Artificial Sequence
  chemically synthesized
tttcaacttttaagatccagag

SEQ ID NO: 961518 - DNA, 22 bp, Artificial Sequence
  chemically synthesized
ttcaacttttaagatccagagg

SEQ ID NO: 961519 - DNA, 22 bp, Artificial Sequence
  chemically synthesized
tcaacttttaagatccagaggg

SEQ ID NO: 961520 - DNA, 22 bp, Artificial Sequence
  chemically synthesized
caacttttaagatccagagggt

SEQ ID NO: 961521 - DNA, 22 bp, Artificial Sequence
  chemically synthesized
aacttttaagatccagagggta

SEQ ID NO: 961522 - DNA, 22 bp, Artificial Sequence
  chemically synthesized
ttaagatccagagggtacatgt

SEQ ID NO: 961523 - DNA, 22 bp, Artificial Sequence
  chemically synthesized
taagatccagagggtacatgtt

SEQ ID NO: 961524 - DNA, 22 bp, Artificial Sequence
  chemically synthesized
aagatccagagggtacatgttc

SEQ ID NO: 961525 - DNA, 22 bp, Artificial Sequence
  chemically synthesized
agatccagagggtacatgttca

SEQ ID NO: 961526 - DNA, 22 bp, Artificial Sequence
  chemically synthesized
agcatcacgccatatatccagg

SEQ ID NO: 961527 - DNA, 22 bp, Artificial Sequence
  chemically synthesized
aggtttgttacctggatatatg

SEQ ID NO: 961528 - DNA, 22 bp, Artificial Sequence
  chemically synthesized
gttacctggatatatggcgtga

SEQ ID NO: 961529 - DNA, 22 bp, Artificial Sequence
  chemically synthesized
ttacctggatatatggcgtgat

SEQ ID NO: 961530 - DNA, 22 bp, Artificial Sequence
  chemically synthesized
cctggatatatggcgtgatgct

SEQ ID NO: 961531 - DNA, 22 bp, Artificial Sequence
  chemically synthesized
tatcccaaacctcagcatcacg

SEQ ID NO: 961532 - DNA, 22 bp, Artificial Sequence
  chemically synthesized
gtatcccaaacctcagcatcac

SEQ ID NO: 961533 - DNA, 22 bp, Artificial Sequence
  chemically synthesized
gatatatggcgtgatgctgagg

SEQ ID NO: 961534 - DNA, 22 bp, Artificial Sequence
  chemically synthesized
atgggatcatttgtatcccaaa

SEQ ID NO: 961535 - DNA, 22 bp, Artificial Sequence
  chemically synthesized
gttaatgggatcatttgtatcc

SEQ ID NO: 961536 - DNA, 22 bp, Artificial Sequence
  chemically synthesized
cctggttaatgggatcatttgt

SEQ ID NO: 961537 - DNA, 22 bp, Artificial Sequence
  chemically synthesized
aggtttgggatacaaatgatcc

SEQ ID NO: 961538 - DNA, 22 bp, Artificial Sequence
  chemically synthesized
ctacctggttaatgggatcatt

SEQ ID NO: 961539 - DNA, 22 bp, Artificial Sequence
  chemically synthesized
actacctggttaatgggatcat

SEQ ID NO: 961540 - DNA, 22 bp, Artificial Sequence
  chemically synthesized
gggatacaaatgatcccattaa

SEQ ID NO: 961541 - DNA, 22 bp, Artificial Sequence
  chemically synthesized
ggatacaaatgatcccattaac

SEQ ID NO: 961542 - DNA, 22 bp, Artificial Sequence
  chemically synthesized
tgcttactacctggttaatggg

SEQ ID NO: 961543 - DNA, 22 bp, Artificial Sequence
  chemically synthesized
tgtactatgcttactacctggt

SEQ ID NO: 961544 - DNA, 22 bp, Artificial Sequence
  chemically synthesized
ttgtgtactatgcttactacct

SEQ ID NO: 961545 - DNA, 22 bp, Artificial Sequence
  chemically synthesized
cctattgtgtactatgcttact

SEQ ID NO: 961546 - DNA, 22 bp, Artificial Sequence
  chemically synthesized
accaggtagtaagcatagtaca

SEQ ID NO: 961547 - DNA, 22 bp, Artificial Sequence
  chemically synthesized
aaaagctgcctattgtgtacta

SEQ ID NO: 961548 - DNA, 22 bp, Artificial Sequence
  chemically synthesized
ttcaacccttgtctcccccttt

SEQ ID NO: 961549 - DNA, 22 bp, Artificial Sequence
  chemically synthesized
tcaacccttgtctccccctttc

SEQ ID NO: 961550 - DNA, 22 bp, Artificial Sequence
  chemically synthesized
caacccttgtctccccctttcc

SEQ ID NO: 961551 - DNA, 22 bp, Artificial Sequence
  chemically synthesized
aacccttgtctccccctttcct

SEQ ID NO: 961552 - DNA, 22 bp, Artificial Sequence
  chemically synthesized
atagaaggggaaaggaaagggg

SEQ ID NO: 961553 - DNA, 22 bp, Artificial Sequence
  chemically synthesized
gtctccccctttcctttcccct

SEQ ID NO: 961554 - DNA, 22 bp, Artificial Sequence
  chemically synthesized
gggactaatagaaggggaaagg

SEQ ID NO: 961555 - DNA, 22 bp, Artificial Sequence
  chemically synthesized
tctccccctttcctttcccctt

SEQ ID NO: 961556 - DNA, 22 bp, Artificial Sequence
  chemically synthesized
cccctttcctttccccttctat

SEQ ID NO: 961557 - DNA, 22 bp, Artificial Sequence
  chemically synthesized
tcctttccccttctattagtcc

SEQ ID NO: 961558 - DNA, 22 bp, Artificial Sequence
  chemically synthesized
cctttccccttctattagtccc

SEQ ID NO: 961559 - DNA, 22 bp, Artificial Sequence
  chemically synthesized
ctttccccttctattagtccct

SEQ ID NO: 961560 - DNA, 22 bp, Artificial Sequence
  chemically synthesized
tccccttctattagtccctagt

SEQ ID NO: 961561 - DNA, 22 bp, Artificial Sequence
  chemically synthesized
ccccttctattagtccctagtt

SEQ ID NO: 961562 - DNA, 22 bp, Artificial Sequence
  chemically synthesized
cccttctattagtccctagttt

SEQ ID NO: 961563 - DNA, 22 bp, Artificial Sequence
  chemically synthesized
aagatggcaacagtagaaacta

SEQ ID NO: 961564 - DNA, 22 bp, Artificial Sequence
  chemically synthesized
ctattagtccctagtttctact

SEQ ID NO: 961565 - DNA, 22 bp, Artificial Sequence
  chemically synthesized
tattagtccctagtttctactg

SEQ ID NO: 961566 - DNA, 22 bp, Artificial Sequence
  chemically synthesized
ttagtccctagtttctactgtt

SEQ ID NO: 961567 - DNA, 22 bp, Artificial Sequence
  chemically synthesized
gtccctagtttctactgttgcc

SEQ ID NO: 961568 - DNA, 22 bp, Artificial Sequence
  chemically synthesized
tagaattgaagatggcaacagt

SEQ ID NO: 961569 - DNA, 22 bp, Artificial Sequence
  chemically synthesized
atagaattgaagatggcaacag

SEQ ID NO: 961570 - DNA, 22 bp, Artificial Sequence
  chemically synthesized
gtttctactgttgccatcttca

SEQ ID NO: 961571 - DNA, 22 bp, Artificial Sequence
  chemically synthesized
ggtacttatagaattgaagatg

SEQ ID NO: 961572 - DNA, 22 bp, Artificial Sequence
  chemically synthesized
ctactgttgccatcttcaattc

SEQ ID NO: 961573 - DNA, 22 bp, Artificial Sequence
  chemically synthesized
tactgttgccatcttcaattct

SEQ ID NO: 961574 - DNA, 22 bp, Artificial Sequence
  chemically synthesized
ctgttgccatcttcaattctat

SEQ ID NO: 961575 - DNA, 22 bp, Artificial Sequence
  chemically synthesized
aatgttaggtacttatagaatt

SEQ ID NO: 961576 - DNA, 22 bp, Artificial Sequence
  chemically synthesized
ttgccatcttcaattctataag

SEQ ID NO: 961577 - DNA, 22 bp, Artificial Sequence
  chemically synthesized
ccatcttcaattctataagtac

SEQ ID NO: 961578 - DNA, 22 bp, Artificial Sequence
  chemically synthesized
gagctaaatgttaggtacttat

SEQ ID NO: 961579 - DNA, 22 bp, Artificial Sequence
  chemically synthesized
caattctataagtacctaacat

SEQ ID NO: 961580 - DNA, 22 bp, Artificial Sequence
  chemically synthesized
aattctataagtacctaacatt

SEQ ID NO: 961581 - DNA, 22 bp, Artificial Sequence
  chemically synthesized
tgagttggagctaaatgttagg

SEQ ID NO: 961582 - DNA, 22 bp, Artificial Sequence
  chemically synthesized
tataagtacctaacatttagct

SEQ ID NO: 961583 - DNA, 22 bp, Artificial Sequence
  chemically synthesized
agttatgagttggagctaaatg

SEQ ID NO: 961584 - DNA, 22 bp, Artificial Sequence
  chemically synthesized
taagtacctaacatttagctcc

SEQ ID NO: 961585 - DNA, 22 bp, Artificial Sequence
  chemically synthesized
tatgtactcagttatgagttgg

SEQ ID NO: 961586 - DNA, 22 bp, Artificial Sequence
  chemically synthesized
acatttagctccaactcataac

SEQ ID NO: 961587 - DNA, 22 bp, Artificial Sequence
  chemically synthesized
agctccaactcataactgagta

SEQ ID NO: 961588 - DNA, 22 bp, Artificial Sequence
  chemically synthesized
gctccaactcataactgagtac

SEQ ID NO: 961589 - DNA, 22 bp, Artificial Sequence
  chemically synthesized
caactcataactgagtacatat

SEQ ID NO: 961590 - DNA, 22 bp, Artificial Sequence
  chemically synthesized
ataactgagtacatatagtatt

SEQ ID NO: 961591 - DNA, 22 bp, Artificial Sequence
  chemically synthesized
agtacatatagtatttggtttt

SEQ ID NO: 961592 - DNA, 22 bp, Artificial Sequence
  chemically synthesized
acataagaacagaaaaccaaat

SEQ ID NO: 961593 - DNA, 22 bp, Artificial Sequence
  chemically synthesized
agcaaattaacataagaacaga

SEQ ID NO: 961594 - DNA, 22 bp, Artificial Sequence
  chemically synthesized
tcctaagcaaattaacataaga

SEQ ID NO: 961595 - DNA, 22 bp, Artificial Sequence
  chemically synthesized
ggttttctgttcttatgttaat

SEQ ID NO: 961596 - DNA, 22 bp, Artificial Sequence
  chemically synthesized
gttttctgttcttatgttaatt

SEQ ID NO: 961597 - DNA, 22 bp, Artificial Sequence
  chemically synthesized
tctgttcttatgttaatttgct

SEQ ID NO: 961598 - DNA, 22 bp, Artificial Sequence
  chemically synthesized
ctgttcttatgttaatttgctt

SEQ ID NO: 961599 - DNA, 22 bp, Artificial Sequence
  chemically synthesized
tgttcttatgttaatttgctta

SEQ ID NO: 961600 - DNA, 22 bp, Artificial Sequence
  chemically synthesized
gaggccattatcctaagcaaat

SEQ ID NO: 961601 - DNA, 22 bp, Artificial Sequence
  chemically synthesized
ttcttatgttaatttgcttagg

SEQ ID NO: 961602 - DNA, 22 bp, Artificial Sequence
  chemically synthesized
ttatgttaatttgcttaggata

SEQ ID NO: 961603 - DNA, 22 bp, Artificial Sequence
  chemically synthesized
atgttaatttgcttaggataat

SEQ ID NO: 961604 - DNA, 22 bp, Artificial Sequence
  chemically synthesized
tgttaatttgcttaggataatg

SEQ ID NO: 961605 - DNA, 22 bp, Artificial Sequence
  chemically synthesized
atttgcttaggataatggcctc

SEQ ID NO: 961606 - DNA, 22 bp, Artificial Sequence
  chemically synthesized
gcttaggataatggcctctagc

SEQ ID NO: 961607 - DNA, 22 bp, Artificial Sequence
  chemically synthesized
cttaggataatggcctctagct

SEQ ID NO: 961608 - DNA, 22 bp, Artificial Sequence
  chemically synthesized
aggataatggcctctagctgca

SEQ ID NO: 961609 - DNA, 22 bp, Artificial Sequence
  chemically synthesized
cagcaacatagatgcagctaga

SEQ ID NO: 961610 - DNA, 22 bp, Artificial Sequence
  chemically synthesized
ggataatggcctctagctgcat

SEQ ID NO: 961611 - DNA, 22 bp, Artificial Sequence
  chemically synthesized
gcagcaacatagatgcagctag

SEQ ID NO: 961612 - DNA, 22 bp, Artificial Sequence
  chemically synthesized
tgcagcaacatagatgcagcta

SEQ ID NO: 961613 - DNA, 22 bp, Artificial Sequence
  chemically synthesized
tagctgcatctatgttgctgca

SEQ ID NO: 961614 - DNA, 22 bp, Artificial Sequence
  chemically synthesized
gctgcatctatgttgctgcaaa

SEQ ID NO: 961615 - DNA, 22 bp, Artificial Sequence
  chemically synthesized
catctatgttgctgcaaaggat

SEQ ID NO: 961616 - DNA, 22 bp, Artificial Sequence
  chemically synthesized
tgttgctgcaaaggatatgatt

SEQ ID NO: 961617 - DNA, 22 bp, Artificial Sequence
  chemically synthesized
ctgcaaaggatatgattttctt

SEQ ID NO: 961618 - DNA, 22 bp, Artificial Sequence
  chemically synthesized
caaaggatatgattttcttctt

SEQ ID NO: 961619 - DNA, 22 bp, Artificial Sequence
  chemically synthesized
tacagccacgaaaagaagaaaa

SEQ ID NO: 961620 - DNA, 22 bp, Artificial Sequence
  chemically synthesized
tcttcttttcgtggctgtatag

SEQ ID NO: 961621 - DNA, 22 bp, Artificial Sequence
  chemically synthesized
cttcttttcgtggctgtatagt

SEQ ID NO: 961622 - DNA, 22 bp, Artificial Sequence
  chemically synthesized
ttcttttcgtggctgtatagta

SEQ ID NO: 961623 - DNA, 22 bp, Artificial Sequence
  chemically synthesized
cttttcgtggctgtatagtatt

SEQ ID NO: 961624 - DNA, 22 bp, Artificial Sequence
  chemically synthesized
ttttcgtggctgtatagtattt

SEQ ID NO: 961625 - DNA, 22 bp, Artificial Sequence
  chemically synthesized
ttcgtggctgtatagtatttta

SEQ ID NO: 961626 - DNA, 22 bp, Artificial Sequence
  chemically synthesized
tcgtggctgtatagtattttat

SEQ ID NO: 961627 - DNA, 22 bp, Artificial Sequence
  chemically synthesized
tacacatacaccataaaatact

SEQ ID NO: 961628 - DNA, 22 bp, Artificial Sequence
  chemically synthesized
cgtggctgtatagtattttatg

SEQ ID NO: 961629 - DNA, 22 bp, Artificial Sequence
  chemically synthesized
gtggctgtatagtattttatgg

SEQ ID NO: 961630 - DNA, 22 bp, Artificial Sequence
  chemically synthesized
tatagtattttatggtgtatgt

SEQ ID NO: 961631 - DNA, 22 bp, Artificial Sequence
  chemically synthesized
gataaagtaaatgttgtacaca

SEQ ID NO: 961632 - DNA, 22 bp, Artificial Sequence
  chemically synthesized
tatggtgtatgtgtacaacatt

SEQ ID NO: 961633 - DNA, 22 bp, Artificial Sequence
  chemically synthesized
atggtgtatgtgtacaacattt

SEQ ID NO: 961634 - DNA, 22 bp, Artificial Sequence
  chemically synthesized
tggtgtatgtgtacaacattta

SEQ ID NO: 961635 - DNA, 22 bp, Artificial Sequence
  chemically synthesized
gattggataaagtaaatgttgt

SEQ ID NO: 961636 - DNA, 22 bp, Artificial Sequence
  chemically synthesized
actttatccaatccaacgttga

SEQ ID NO: 961637 - DNA, 22 bp, Artificial Sequence
  chemically synthesized
ctttatccaatccaacgttgac

SEQ ID NO: 961638 - DNA, 22 bp, Artificial Sequence
  chemically synthesized
tatccaatccaacgttgacgga

SEQ ID NO: 961639 - DNA, 22 bp, Artificial Sequence
  chemically synthesized
atccaatccaacgttgacggac

SEQ ID NO: 961640 - DNA, 22 bp, Artificial Sequence
  chemically synthesized
tccaatccaacgttgacggaca

SEQ ID NO: 961641 - DNA, 22 bp, Artificial Sequence
  chemically synthesized
acggacacctatgttgatccca

SEQ ID NO: 961642 - DNA, 22 bp, Artificial Sequence
  chemically synthesized
tgcacaatagcaaagtaatggg

SEQ ID NO: 961643 - DNA, 22 bp, Artificial Sequence
  chemically synthesized
tgttgatcccattactttgcta

SEQ ID NO: 961644 - DNA, 22 bp, Artificial Sequence
  chemically synthesized
atcccattactttgctattgtg

SEQ ID NO: 961645 - DNA, 22 bp, Artificial Sequence
  chemically synthesized
tcacagcactatgcacaatagc

SEQ ID NO: 961646 - DNA, 22 bp, Artificial Sequence
  chemically synthesized
gtcacagcactatgcacaatag

SEQ ID NO: 961647 - DNA, 22 bp, Artificial Sequence
  chemically synthesized
ctttgctattgtgcatagtgct

SEQ ID NO: 961648 - DNA, 22 bp, Artificial Sequence
  chemically synthesized
acatgtttgtcacagcactatg

SEQ ID NO: 961649 - DNA, 22 bp, Artificial Sequence
  chemically synthesized
tgctattgtgcatagtgctgtg

SEQ ID NO: 961650 - DNA, 22 bp, Artificial Sequence
  chemically synthesized
gctattgtgcatagtgctgtga

SEQ ID NO: 961651 - DNA, 22 bp, Artificial Sequence
  chemically synthesized
ctattgtgcatagtgctgtgac

SEQ ID NO: 961652 - DNA, 22 bp, Artificial Sequence
  chemically synthesized
ttgtgcatagtgctgtgacaaa

SEQ ID NO: 961653 - DNA, 22 bp, Artificial Sequence
  chemically synthesized
tgcatagtgctgtgacaaacat

SEQ ID NO: 961654 - DNA, 22 bp, Artificial Sequence
  chemically synthesized
ccaaaaagacacatgcactcac

SEQ ID NO: 961655 - DNA, 22 bp, Artificial Sequence
  chemically synthesized
tgacaaacatgtgagtgcatgt

SEQ ID NO: 961656 - DNA, 22 bp, Artificial Sequence
  chemically synthesized
taccaaaaagacacatgcactc

SEQ ID NO: 961657 - DNA, 22 bp, Artificial Sequence
  chemically synthesized
tttggtagaaccatttgttttc

SEQ ID NO: 961658 - DNA, 22 bp, Artificial Sequence
  chemically synthesized
ttggtagaaccatttgttttct

SEQ ID NO: 961659 - DNA, 22 bp, Artificial Sequence
  chemically synthesized
tggtagaaccatttgttttctt

SEQ ID NO: 961660 - DNA, 22 bp, Artificial Sequence
  chemically synthesized
ggtagaaccatttgttttcttt

SEQ ID NO: 961661 - DNA, 22 bp, Artificial Sequence
  chemically synthesized
agtagatatccaaaagaaaaca

SEQ ID NO: 961662 - DNA, 22 bp, Artificial Sequence
  chemically synthesized
gtagaaccatttgttttctttt

SEQ ID NO: 961663 - DNA, 22 bp, Artificial Sequence
  chemically synthesized
ctgagtagatatccaaaagaaa

SEQ ID NO: 961664 - DNA, 22 bp, Artificial Sequence
  chemically synthesized
gttttcttttggatatctactc

SEQ ID NO: 961665 - DNA, 22 bp, Artificial Sequence
  chemically synthesized
ttttcttttggatatctactca

SEQ ID NO: 961666 - DNA, 22 bp, Artificial Sequence
  chemically synthesized
tcttttggatatctactcagta

SEQ ID NO: 961667 - DNA, 22 bp, Artificial Sequence
  chemically synthesized
cttttggatatctactcagtaa

SEQ ID NO: 961668 - DNA, 22 bp, Artificial Sequence
  chemically synthesized
ttttggatatctactcagtaat

SEQ ID NO: 961669 - DNA, 22 bp, Artificial Sequence
  chemically synthesized
acccatcaatcccattactgag

SEQ ID NO: 961670 - DNA, 22 bp, Artificial Sequence
  chemically synthesized
ttggatatctactcagtaatgg

SEQ ID NO: 961671 - DNA, 22 bp, Artificial Sequence
  chemically synthesized
gacccatcaatcccattactga

SEQ ID NO: 961672 - DNA, 22 bp, Artificial Sequence
  chemically synthesized
tggatatctactcagtaatggg

SEQ ID NO: 961673 - DNA, 22 bp, Artificial Sequence
  chemically synthesized
ggatatctactcagtaatggga

SEQ ID NO: 961674 - DNA, 22 bp, Artificial Sequence
  chemically synthesized
gatatctactcagtaatgggat

SEQ ID NO: 961675 - DNA, 22 bp, Artificial Sequence
  chemically synthesized
tcatttgacccatcaatcccat

SEQ ID NO: 961676 - DNA, 22 bp, Artificial Sequence
  chemically synthesized
ctcagtaatgggattgatgggt

SEQ ID NO: 961677 - DNA, 22 bp, Artificial Sequence
  chemically synthesized
agtaatgggattgatgggtcaa

SEQ ID NO: 961678 - DNA, 22 bp, Artificial Sequence
  chemically synthesized
aaatagaactatcatttgaccc

SEQ ID NO: 961679 - DNA, 22 bp, Artificial Sequence
  chemically synthesized
aaaatagaactatcatttgacc

SEQ ID NO: 961680 - DNA, 22 bp, Artificial Sequence
  chemically synthesized
atgggtcaaatgatagttctat

SEQ ID NO: 961681 - DNA, 22 bp, Artificial Sequence
  chemically synthesized
aaagaacttaaaatagaactat

SEQ ID NO: 961682 - DNA, 22 bp, Artificial Sequence
  chemically synthesized
tcaaagaacttaaaatagaact

SEQ ID NO: 961683 - DNA, 22 bp, Artificial Sequence
  chemically synthesized
ctcaaagaacttaaaatagaac

SEQ ID NO: 961684 - DNA, 22 bp, Artificial Sequence
  chemically synthesized
gacatttctcaaagaacttaaa

SEQ ID NO: 961685 - DNA, 22 bp, Artificial Sequence
  chemically synthesized
ggacatttctcaaagaacttaa

SEQ ID NO: 961686 - DNA, 22 bp, Artificial Sequence
  chemically synthesized
tattttaagttctttgagaaat

SEQ ID NO: 961687 - DNA, 22 bp, Artificial Sequence
  chemically synthesized
ttttaagttctttgagaaatgt

SEQ ID NO: 961688 - DNA, 22 bp, Artificial Sequence
  chemically synthesized
taagttctttgagaaatgtcca

SEQ ID NO: 961689 - DNA, 22 bp, Artificial Sequence
  chemically synthesized
tagaaagcagtttggacatttc

SEQ ID NO: 961690 - DNA, 22 bp, Artificial Sequence
  chemically synthesized
aagttctttgagaaatgtccaa

SEQ ID NO: 961691 - DNA, 22 bp, Artificial Sequence
  chemically synthesized
agttctttgagaaatgtccaaa

SEQ ID NO: 961692 - DNA, 22 bp, Artificial Sequence
  chemically synthesized
tttgagaaatgtccaaactgct

SEQ ID NO: 961693 - DNA, 22 bp, Artificial Sequence
  chemically synthesized
agccactgtagaaagcagtttg

SEQ ID NO: 961694 - DNA, 22 bp, Artificial Sequence
  chemically synthesized
tgagaaatgtccaaactgcttt

SEQ ID NO: 961695 - DNA, 22 bp, Artificial Sequence
  chemically synthesized
gagaaatgtccaaactgctttc

SEQ ID NO: 961696 - DNA, 22 bp, Artificial Sequence
  chemically synthesized
agaaatgtccaaactgctttct

SEQ ID NO: 961697 - DNA, 22 bp, Artificial Sequence
  chemically synthesized
gttcagccactgtagaaagcag

SEQ ID NO: 961698 - DNA, 22 bp, Artificial Sequence
  chemically synthesized
attagttcagccactgtagaaa

SEQ ID NO: 961699 - DNA, 22 bp, Artificial Sequence
  chemically synthesized
ggaatgttaattagttcagcca

SEQ ID NO: 961700 - DNA, 22 bp, Artificial Sequence
  chemically synthesized
ctttctacagtggctgaactaa

SEQ ID NO: 961701 - DNA, 22 bp, Artificial Sequence
  chemically synthesized
ttgggaatgttaattagttcag

SEQ ID NO: 961702 - DNA, 22 bp, Artificial Sequence
  chemically synthesized
tctacagtggctgaactaatta

SEQ ID NO: 961703 - DNA, 22 bp, Artificial Sequence
  chemically synthesized
ctacagtggctgaactaattaa

SEQ ID NO: 961704 - DNA, 22 bp, Artificial Sequence
  chemically synthesized
ttgttgggaatgttaattagtt

SEQ ID NO: 961705 - DNA, 22 bp, Artificial Sequence
  chemically synthesized
tacagtggctgaactaattaac

SEQ ID NO: 961706 - DNA, 22 bp, Artificial Sequence
  chemically synthesized
cagtggctgaactaattaacat

SEQ ID NO: 961707 - DNA, 22 bp, Artificial Sequence
  chemically synthesized
tacactgttgttgggaatgtta

SEQ ID NO: 961708 - DNA, 22 bp, Artificial Sequence
  chemically synthesized
atacactgttgttgggaatgtt

SEQ ID NO: 961709 - DNA, 22 bp, Artificial Sequence
  chemically synthesized
aactaattaacattcccaacaa

SEQ ID NO: 961710 - DNA, 22 bp, Artificial Sequence
  chemically synthesized
attaacattcccaacaacagtg

SEQ ID NO: 961711 - DNA, 22 bp, Artificial Sequence
  chemically synthesized
acattcccaacaacagtgtata

SEQ ID NO: 961712 - DNA, 22 bp, Artificial Sequence
  chemically synthesized
ccaacaacagtgtataagcatc

SEQ ID NO: 961713 - DNA, 22 bp, Artificial Sequence
  chemically synthesized
gcaaggccgcagagacaagggg

SEQ ID NO: 961714 - DNA, 22 bp, Artificial Sequence
  chemically synthesized
gtctctgcggccttgccagcat

SEQ ID NO: 961715 - DNA, 22 bp, Artificial Sequence
  chemically synthesized
tctctgcggccttgccagcatt

SEQ ID NO: 961716 - DNA, 22 bp, Artificial Sequence
  chemically synthesized
tgcggccttgccagcattgggt

SEQ ID NO: 961717 - DNA, 22 bp, Artificial Sequence
  chemically synthesized
cggccttgccagcattgggtgt

SEQ ID NO: 961718 - DNA, 22 bp, Artificial Sequence
  chemically synthesized
aaaagtcaaaagacacccaatg

SEQ ID NO: 961719 - DNA, 22 bp, Artificial Sequence
  chemically synthesized
ttaaaaagtcaaaagacaccca

SEQ ID NO: 961720 - DNA, 22 bp, Artificial Sequence
  chemically synthesized
gttaaaaagtcaaaagacaccc

SEQ ID NO: 961721 - DNA, 22 bp, Artificial Sequence
  chemically synthesized
tgttaaaaagtcaaaagacacc

SEQ ID NO: 961722 - DNA, 22 bp, Artificial Sequence
  chemically synthesized
gccagcattgggtgtcttttga

SEQ ID NO: 961723 - DNA, 22 bp, Artificial Sequence
  chemically synthesized
ccagcattgggtgtcttttgac

SEQ ID NO: 961724 - DNA, 22 bp, Artificial Sequence
  chemically synthesized
gctttgttaaaaagtcaaaaga

SEQ ID NO: 961725 - DNA, 22 bp, Artificial Sequence
  chemically synthesized
ggtgtcttttgactttttaaca

SEQ ID NO: 961726 - DNA, 22 bp, Artificial Sequence
  chemically synthesized
acacccgtcagactggctttgt

SEQ ID NO: 961727 - DNA, 22 bp, Artificial Sequence
  chemically synthesized
ttgactttttaacaaagccagt

SEQ ID NO: 961728 - DNA, 22 bp, Artificial Sequence
  chemically synthesized
tgactttttaacaaagccagtc

SEQ ID NO: 961729 - DNA, 22 bp, Artificial Sequence
  chemically synthesized
gactttttaacaaagccagtct

SEQ ID NO: 961730 - DNA, 22 bp, Artificial Sequence
  chemically synthesized
actttttaacaaagccagtctg

SEQ ID NO: 961731 - DNA, 22 bp, Artificial Sequence
  chemically synthesized
tttaacaaagccagtctgacgg

SEQ ID NO: 961732 - DNA, 22 bp, Artificial Sequence
  chemically synthesized
ttaacaaagccagtctgacggg

SEQ ID NO: 961733 - DNA, 22 bp, Artificial Sequence
  chemically synthesized
taacaaagccagtctgacgggt

SEQ ID NO: 961734 - DNA, 22 bp, Artificial Sequence
  chemically synthesized
aacaaagccagtctgacgggtg

SEQ ID NO: 961735 - DNA, 22 bp, Artificial Sequence
  chemically synthesized
acaaagccagtctgacgggtgt

SEQ ID NO: 961736 - DNA, 22 bp, Artificial Sequence
  chemically synthesized
acgggtgtgagatggtatctcc

SEQ ID NO: 961737 - DNA, 22 bp, Artificial Sequence
  chemically synthesized
atcatcagagaaatgcaaatca

SEQ ID NO: 961738 - DNA, 22 bp, Artificial Sequence
  chemically synthesized
cttgcggttttgatttgcattt

SEQ ID NO: 961739 - DNA, 22 bp, Artificial Sequence
  chemically synthesized
gcggttttgatttgcatttctc

SEQ ID NO: 961740 - DNA, 22 bp, Artificial Sequence
  chemically synthesized
cggttttgatttgcatttctct

SEQ ID NO: 961741 - DNA, 22 bp, Artificial Sequence
  chemically synthesized
tgatttgcatttctctgatgat

SEQ ID NO: 961742 - DNA, 22 bp, Artificial Sequence
  chemically synthesized
gatttgcatttctctgatgatg

SEQ ID NO: 961743 - DNA, 22 bp, Artificial Sequence
  chemically synthesized
atttgcatttctctgatgatga

SEQ ID NO: 961744 - DNA, 22 bp, Artificial Sequence
  chemically synthesized
gcatttctctgatgatgagtga

SEQ ID NO: 961745 - DNA, 22 bp, Artificial Sequence
  chemically synthesized
catttctctgatgatgagtgat

SEQ ID NO: 961746 - DNA, 22 bp, Artificial Sequence
  chemically synthesized
ctctgatgatgagtgatgtgac

SEQ ID NO: 961747 - DNA, 22 bp, Artificial Sequence
  chemically synthesized
tctgatgatgagtgatgtgacg

SEQ ID NO: 961748 - DNA, 22 bp, Artificial Sequence
  chemically synthesized
tgatgatgagtgatgtgacgca

SEQ ID NO: 961749 - DNA, 22 bp, Artificial Sequence
  chemically synthesized
atgatgagtgatgtgacgcatt

SEQ ID NO: 961750 - DNA, 22 bp, Artificial Sequence
  chemically synthesized
ttcatgtttattggctgcgtgt

SEQ ID NO: 961751 - DNA, 22 bp, Artificial Sequence
  chemically synthesized
aaaagaagatatacacgcagcc

SEQ ID NO: 961752 - DNA, 22 bp, Artificial Sequence
  chemically synthesized
tcatgtttattggctgcgtgta

SEQ ID NO: 961753 - DNA, 22 bp, Artificial Sequence
  chemically synthesized
catgtttattggctgcgtgtat

SEQ ID NO: 961754 - DNA, 22 bp, Artificial Sequence
  chemically synthesized
tcaaaagaagatatacacgcag

SEQ ID NO: 961755 - DNA, 22 bp, Artificial Sequence
  chemically synthesized
atgtttattggctgcgtgtata

SEQ ID NO: 961756 - DNA, 22 bp, Artificial Sequence
  chemically synthesized
ctcaaaagaagatatacacgca

SEQ ID NO: 961757 - DNA, 22 bp, Artificial Sequence
  chemically synthesized
attggctgcgtgtatatcttct

SEQ ID NO: 961758 - DNA, 22 bp, Artificial Sequence
  chemically synthesized
ttggctgcgtgtatatcttctt

SEQ ID NO: 961759 - DNA, 22 bp, Artificial Sequence
  chemically synthesized
gctgcgtgtatatcttcttttg

SEQ ID NO: 961760 - DNA, 22 bp, Artificial Sequence
  chemically synthesized
cgtgtatatcttcttttgagaa

SEQ ID NO: 961761 - DNA, 22 bp, Artificial Sequence
  chemically synthesized
cttttgagaaatgtctgttcat

SEQ ID NO: 961762 - DNA, 22 bp, Artificial Sequence
  chemically synthesized
ttttgagaaatgtctgttcatg

SEQ ID NO: 961763 - DNA, 22 bp, Artificial Sequence
  chemically synthesized
ttgagaaatgtctgttcatgtc

SEQ ID NO: 961764 - DNA, 22 bp, Artificial Sequence
  chemically synthesized
tgagaaatgtctgttcatgtct

SEQ ID NO: 961765 - DNA, 22 bp, Artificial Sequence
  chemically synthesized
gagaaatgtctgttcatgtctt

SEQ ID NO: 961766 - DNA, 22 bp, Artificial Sequence
  chemically synthesized
aaaaatgggcaaaagacatgaa

SEQ ID NO: 961767 - DNA, 22 bp, Artificial Sequence
  chemically synthesized
agaaatgtctgttcatgtcttt

SEQ ID NO: 961768 - DNA, 22 bp, Artificial Sequence
  chemically synthesized
aaaaaatgggcaaaagacatga

SEQ ID NO: 961769 - DNA, 22 bp, Artificial Sequence
  chemically synthesized
ttcatgtcttttgcccattttt

SEQ ID NO: 961770 - DNA, 22 bp, Artificial Sequence
  chemically synthesized
atgtcttttgcccattttttaa

SEQ ID NO: 961771 - DNA, 22 bp, Artificial Sequence
  chemically synthesized
ttgcccattttttaaatgatgt

SEQ ID NO: 961772 - DNA, 22 bp, Artificial Sequence
  chemically synthesized
tgcccattttttaaatgatgtt

SEQ ID NO: 961773 - DNA, 22 bp, Artificial Sequence
  chemically synthesized
gcccattttttaaatgatgttt

SEQ ID NO: 961774 - DNA, 22 bp, Artificial Sequence
  chemically synthesized
cccattttttaaatgatgtttt

SEQ ID NO: 961775 - DNA, 22 bp, Artificial Sequence
  chemically synthesized
aacaaacaaaaatcataaaaca

SEQ ID NO: 961776 - DNA, 22 bp, Artificial Sequence
  chemically synthesized
tttaaatgatgttttatgattt

SEQ ID NO: 961777 - DNA, 22 bp, Artificial Sequence
  chemically synthesized
ttaaatgatgttttatgatttt

SEQ ID NO: 961778 - DNA, 22 bp, Artificial Sequence
  chemically synthesized
taaatgatgttttatgattttt

SEQ ID NO: 961779 - DNA, 22 bp, Artificial Sequence
  chemically synthesized
aaatgatgttttatgatttttg

SEQ ID NO: 961780 - DNA, 22 bp, Artificial Sequence
  chemically synthesized
aatgatgttttatgatttttgt

SEQ ID NO: 961781 - DNA, 22 bp, Artificial Sequence
  chemically synthesized
aacaattgaacaaacaaaaatc

SEQ ID NO: 961782 - DNA, 22 bp, Artificial Sequence
  chemically synthesized
tatgatttttgtttgttcaatt

SEQ ID NO: 961783 - DNA, 22 bp, Artificial Sequence
  chemically synthesized
atgatttttgtttgttcaattg

SEQ ID NO: 961784 - DNA, 22 bp, Artificial Sequence
  chemically synthesized
tgatttttgtttgttcaattgt

SEQ ID NO: 961785 - DNA, 22 bp, Artificial Sequence
  chemically synthesized
tgaggaacctaaacaattgaac

SEQ ID NO: 961786 - DNA, 22 bp, Artificial Sequence
  chemically synthesized
ttgtttgttcaattgtttaggt

SEQ ID NO: 961787 - DNA, 22 bp, Artificial Sequence
  chemically synthesized
tgtttgttcaattgtttaggtt

SEQ ID NO: 961788 - DNA, 22 bp, Artificial Sequence
  chemically synthesized
gtttgttcaattgtttaggttc

SEQ ID NO: 961789 - DNA, 22 bp, Artificial Sequence
  chemically synthesized
tttgttcaattgtttaggttcc

SEQ ID NO: 961790 - DNA, 22 bp, Artificial Sequence
  chemically synthesized
gttcaattgtttaggttcctca

SEQ ID NO: 961791 - DNA, 22 bp, Artificial Sequence
  chemically synthesized
ttcaattgtttaggttcctcat

SEQ ID NO: 961792 - DNA, 22 bp, Artificial Sequence
  chemically synthesized
aattgtttaggttcctcataga

SEQ ID NO: 961793 - DNA, 22 bp, Artificial Sequence
  chemically synthesized
tttaggttcctcatagattctg

SEQ ID NO: 961794 - DNA, 22 bp, Artificial Sequence
  chemically synthesized
aggttcctcatagattctggat

SEQ ID NO: 961795 - DNA, 22 bp, Artificial Sequence
  chemically synthesized
ggttcctcatagattctggata

SEQ ID NO: 961796 - DNA, 22 bp, Artificial Sequence
  chemically synthesized
acggtggtgtaatatccagaat

SEQ ID NO: 961797 - DNA, 22 bp, Artificial Sequence
  chemically synthesized
ctcatagattctggatattaca

SEQ ID NO: 961798 - DNA, 22 bp, Artificial Sequence
  chemically synthesized
atagattctggatattacacca

SEQ ID NO: 961799 - DNA, 22 bp, Artificial Sequence
  chemically synthesized
tgcatctgacggtggtgtaata

SEQ ID NO: 961800 - DNA, 22 bp, Artificial Sequence
  chemically synthesized
caagttatgcatctgacggtgg

SEQ ID NO: 961801 - DNA, 22 bp, Artificial Sequence
  chemically synthesized
tggatattacaccaccgtcaga

SEQ ID NO: 961802 - DNA, 22 bp, Artificial Sequence
  chemically synthesized
gcaagttatgcatctgacggtg

SEQ ID NO: 961803 - DNA, 22 bp, Artificial Sequence
  chemically synthesized
tgcaagttatgcatctgacggt

SEQ ID NO: 961804 - DNA, 22 bp, Artificial Sequence
  chemically synthesized
gatattacaccaccgtcagatg

SEQ ID NO: 961805 - DNA, 22 bp, Artificial Sequence
  chemically synthesized
ttgcaagttatgcatctgacgg

SEQ ID NO: 961806 - DNA, 22 bp, Artificial Sequence
  chemically synthesized
caccaccgtcagatgcataact

SEQ ID NO: 961807 - DNA, 22 bp, Artificial Sequence
  chemically synthesized
gcaaaagttttctcccatttgg

SEQ ID NO: 961808 - DNA, 22 bp, Artificial Sequence
  chemically synthesized
caaaagttttctcccatttggt

SEQ ID NO: 961809 - DNA, 22 bp, Artificial Sequence
  chemically synthesized
tctcccatttggtgtttgtctg

SEQ ID NO: 961810 - DNA, 22 bp, Artificial Sequence
  chemically synthesized
ctcccatttggtgtttgtctgt

SEQ ID NO: 961811 - DNA, 22 bp, Artificial Sequence
  chemically synthesized
tcccatttggtgtttgtctgtt

SEQ ID NO: 961812 - DNA, 22 bp, Artificial Sequence
  chemically synthesized
ccatttggtgtttgtctgttta

SEQ ID NO: 961813 - DNA, 22 bp, Artificial Sequence
  chemically synthesized
ggtgtttgtctgtttactctgt

SEQ ID NO: 961814 - DNA, 22 bp, Artificial Sequence
  chemically synthesized
gtgtttgtctgtttactctgtt

SEQ ID NO: 961815 - DNA, 22 bp, Artificial Sequence
  chemically synthesized
gtctgtttactctgttgatcat

SEQ ID NO: 961816 - DNA, 22 bp, Artificial Sequence
  chemically synthesized
tctgtttactctgttgatcatt

SEQ ID NO: 961817 - DNA, 22 bp, Artificial Sequence
  chemically synthesized
catggcaaaataaatgatcaac

SEQ ID NO: 961818 - DNA, 22 bp, Artificial Sequence
  chemically synthesized
tgcatggcaaaataaatgatca

SEQ ID NO: 961819 - DNA, 22 bp, Artificial Sequence
  chemically synthesized
ctgcatggcaaaataaatgatc

SEQ ID NO: 961820 - DNA, 22 bp, Artificial Sequence
  chemically synthesized
tttactctgttgatcatttatt

SEQ ID NO: 961821 - DNA, 22 bp, Artificial Sequence
  chemically synthesized
actctgttgatcatttattttg

SEQ ID NO: 961822 - DNA, 22 bp, Artificial Sequence
  chemically synthesized
ctctgttgatcatttattttgc

SEQ ID NO: 961823 - DNA, 22 bp, Artificial Sequence
  chemically synthesized
tgttgatcatttattttgccat

SEQ ID NO: 961824 - DNA, 22 bp, Artificial Sequence
  chemically synthesized
ttgatcatttattttgccatgc

SEQ ID NO: 961825 - DNA, 22 bp, Artificial Sequence
  chemically synthesized
atcatttattttgccatgcaga

SEQ ID NO: 961826 - DNA, 22 bp, Artificial Sequence
  chemically synthesized
aaataaagagcttctgcatggc

SEQ ID NO: 961827 - DNA, 22 bp, Artificial Sequence
  chemically synthesized
ctaaaataaagagcttctgcat

SEQ ID NO: 961828 - DNA, 22 bp, Artificial Sequence
  chemically synthesized
actaaaataaagagcttctgca

SEQ ID NO: 961829 - DNA, 22 bp, Artificial Sequence
  chemically synthesized
attttgccatgcagaagctctt

SEQ ID NO: 961830 - DNA, 22 bp, Artificial Sequence
  chemically synthesized
ttttgccatgcagaagctcttt

SEQ ID NO: 961831 - DNA, 22 bp, Artificial Sequence
  chemically synthesized
tgccatgcagaagctctttatt

SEQ ID NO: 961832 - DNA, 22 bp, Artificial Sequence
  chemically synthesized
gccatgcagaagctctttattt

SEQ ID NO: 961833 - DNA, 22 bp, Artificial Sequence
  chemically synthesized
ccatgcagaagctctttatttt

SEQ ID NO: 961834 - DNA, 22 bp, Artificial Sequence
  chemically synthesized
tttattttagtaagtccttgct

SEQ ID NO: 961835 - DNA, 22 bp, Artificial Sequence
  chemically synthesized
tattttagtaagtccttgcttg

SEQ ID NO: 961836 - DNA, 22 bp, Artificial Sequence
  chemically synthesized
attttagtaagtccttgcttgt

SEQ ID NO: 961837 - DNA, 22 bp, Artificial Sequence
  chemically synthesized
ttttagtaagtccttgcttgtc

SEQ ID NO: 961838 - DNA, 22 bp, Artificial Sequence
  chemically synthesized
tagtaagtccttgcttgtcatt

SEQ ID NO: 961839 - DNA, 22 bp, Artificial Sequence
  chemically synthesized
agtaagtccttgcttgtcattt

SEQ ID NO: 961840 - DNA, 22 bp, Artificial Sequence
  chemically synthesized
gtaagtccttgcttgtcatttt

SEQ ID NO: 961841 - DNA, 22 bp, Artificial Sequence
  chemically synthesized
caaaaaaaaaaaaaaaaaaaaa

SEQ ID NO: 961842 - DNA, 22 bp, Artificial Sequence
  chemically synthesized
gcttgtcatttttttttttttt

SEQ ID NO: 961843 - DNA, 22 bp, Artificial Sequence
  chemically synthesized
cttgtcattttttttttttttt

SEQ ID NO: 961844 - DNA, 22 bp, Artificial Sequence
  chemically synthesized
gtcatttttttttttttttttt

SEQ ID NO: 961845 - DNA, 22 bp, Artificial Sequence
  chemically synthesized
tcattttttttttttttttttt

SEQ ID NO: 961846 - DNA, 22 bp, Artificial Sequence
  chemically synthesized
aaagcaattgcaaaaaaaaaaa

SEQ ID NO: 961847 - DNA, 22 bp, Artificial Sequence
  chemically synthesized
aaaagcaattgcaaaaaaaaaa

SEQ ID NO: 961848 - DNA, 22 bp, Artificial Sequence
  chemically synthesized
tttttttttttttttttttgca

SEQ ID NO: 961849 - DNA, 22 bp, Artificial Sequence
  chemically synthesized
ttttttttttttttttttgcaa

SEQ ID NO: 961850 - DNA, 22 bp, Artificial Sequence
  chemically synthesized
tttttttttttttttttgcaat

SEQ ID NO: 961851 - DNA, 22 bp, Artificial Sequence
  chemically synthesized
ttttttttttttttttgcaatt

SEQ ID NO: 961852 - DNA, 22 bp, Artificial Sequence
  chemically synthesized
tttttttttttttttgcaattg

SEQ ID NO: 961853 - DNA, 22 bp, Artificial Sequence
  chemically synthesized
agtccttaaaagcaattgcaaa

SEQ ID NO: 961854 - DNA, 22 bp, Artificial Sequence
  chemically synthesized
ttttttttttttttgcaattgc

SEQ ID NO: 961855 - DNA, 22 bp, Artificial Sequence
  chemically synthesized
tttttttttttttgcaattgct

SEQ ID NO: 961856 - DNA, 22 bp, Artificial Sequence
  chemically synthesized
ttttttttttttgcaattgctt

SEQ ID NO: 961857 - DNA, 22 bp, Artificial Sequence
  chemically synthesized
tttttttttttgcaattgcttt

SEQ ID NO: 961858 - DNA, 22 bp, Artificial Sequence
  chemically synthesized
actaagtccttaaaagcaattg

SEQ ID NO: 961859 - DNA, 22 bp, Artificial Sequence
  chemically synthesized
ttttttttttgcaattgctttt

SEQ ID NO: 961860 - DNA, 22 bp, Artificial Sequence
  chemically synthesized
gactaagtccttaaaagcaatt

SEQ ID NO: 961861 - DNA, 22 bp, Artificial Sequence
  chemically synthesized
tttttttttgcaattgctttta

SEQ ID NO: 961862 - DNA, 22 bp, Artificial Sequence
  chemically synthesized
tgactaagtccttaaaagcaat

SEQ ID NO: 961863 - DNA, 22 bp, Artificial Sequence
  chemically synthesized
ttttttttgcaattgcttttaa

SEQ ID NO: 961864 - DNA, 22 bp, Artificial Sequence
  chemically synthesized
ttgactaagtccttaaaagcaa

SEQ ID NO: 961865 - DNA, 22 bp, Artificial Sequence
  chemically synthesized
tttttttgcaattgcttttaag

SEQ ID NO: 961866 - DNA, 22 bp, Artificial Sequence
  chemically synthesized
ttttttgcaattgcttttaagg

SEQ ID NO: 961867 - DNA, 22 bp, Artificial Sequence
  chemically synthesized
tttttgcaattgcttttaagga

SEQ ID NO: 961868 - DNA, 22 bp, Artificial Sequence
  chemically synthesized
ttttgcaattgcttttaaggac

SEQ ID NO: 961869 - DNA, 22 bp, Artificial Sequence
  chemically synthesized
tttgcaattgcttttaaggact

SEQ ID NO: 961870 - DNA, 22 bp, Artificial Sequence
  chemically synthesized
ttgcaattgcttttaaggactt

SEQ ID NO: 961871 - DNA, 22 bp, Artificial Sequence
  chemically synthesized
tgcaattgcttttaaggactta

SEQ ID NO: 961872 - DNA, 22 bp, Artificial Sequence
  chemically synthesized
gcaattgcttttaaggacttag

SEQ ID NO: 961873 - DNA, 22 bp, Artificial Sequence
  chemically synthesized
caattgcttttaaggacttagt

SEQ ID NO: 961874 - DNA, 22 bp, Artificial Sequence
  chemically synthesized
ggaaagaatttttgactaagtc

SEQ ID NO: 961875 - DNA, 22 bp, Artificial Sequence
  chemically synthesized
gggaaagaatttttgactaagt

SEQ ID NO: 961876 - DNA, 22 bp, Artificial Sequence
  chemically synthesized
cttttaaggacttagtcaaaaa

SEQ ID NO: 961877 - DNA, 22 bp, Artificial Sequence
  chemically synthesized
gcttgggaaagaatttttgact

SEQ ID NO: 961878 - DNA, 22 bp, Artificial Sequence
  chemically synthesized
ttaaggacttagtcaaaaattc

SEQ ID NO: 961879 - DNA, 22 bp, Artificial Sequence
  chemically synthesized
taaggacttagtcaaaaattct

SEQ ID NO: 961880 - DNA, 22 bp, Artificial Sequence
  chemically synthesized
aaggacttagtcaaaaattctt

SEQ ID NO: 961881 - DNA, 22 bp, Artificial Sequence
  chemically synthesized
aggacttagtcaaaaattcttt

SEQ ID NO: 961882 - DNA, 22 bp, Artificial Sequence
  chemically synthesized
gacattggcttgggaaagaatt

SEQ ID NO: 961883 - DNA, 22 bp, Artificial Sequence
  chemically synthesized
tggacattggcttgggaaagaa

SEQ ID NO: 961884 - DNA, 22 bp, Artificial Sequence
  chemically synthesized
agtcaaaaattctttcccaagc

SEQ ID NO: 961885 - DNA, 22 bp, Artificial Sequence
  chemically synthesized
gtcaaaaattctttcccaagcc

SEQ ID NO: 961886 - DNA, 22 bp, Artificial Sequence
  chemically synthesized
ggaaataccattctggacattg

SEQ ID NO: 961887 - DNA, 22 bp, Artificial Sequence
  chemically synthesized
tttcccaagccaatgtccagaa

SEQ ID NO: 961888 - DNA, 22 bp, Artificial Sequence
  chemically synthesized
tcccaagccaatgtccagaatg

SEQ ID NO: 961889 - DNA, 22 bp, Artificial Sequence
  chemically synthesized
cccaagccaatgtccagaatgg

SEQ ID NO: 961890 - DNA, 22 bp, Artificial Sequence
  chemically synthesized
ccaagccaatgtccagaatggt

SEQ ID NO: 961891 - DNA, 22 bp, Artificial Sequence
  chemically synthesized
gaataaaatctgggaaatacca

SEQ ID NO: 961892 - DNA, 22 bp, Artificial Sequence
  chemically synthesized
taagaatcctagaataaaatct

SEQ ID NO: 961893 - DNA, 22 bp, Artificial Sequence
  chemically synthesized
aagctataagaatcctagaata

SEQ ID NO: 961894 - DNA, 22 bp, Artificial Sequence
  chemically synthesized
caagctataagaatcctagaat

SEQ ID NO: 961895 - DNA, 22 bp, Artificial Sequence
  chemically synthesized
cccagattttattctaggattc

SEQ ID NO: 961896 - DNA, 22 bp, Artificial Sequence
  chemically synthesized
ccagattttattctaggattct

SEQ ID NO: 961897 - DNA, 22 bp, Artificial Sequence
  chemically synthesized
tattctaggattcttatagctt

SEQ ID NO: 961898 - DNA, 22 bp, Artificial Sequence
  chemically synthesized
attctaggattcttatagcttg

SEQ ID NO: 961899 - DNA, 22 bp, Artificial Sequence
  chemically synthesized
aatgtaagacttcaagctataa

SEQ ID NO: 961900 - DNA, 22 bp, Artificial Sequence
  chemically synthesized
ttctaggattcttatagcttga

SEQ ID NO: 961901 - DNA, 22 bp, Artificial Sequence
  chemically synthesized
aaatgtaagacttcaagctata

SEQ ID NO: 961902 - DNA, 22 bp, Artificial Sequence
  chemically synthesized
taggattcttatagcttgaagt

SEQ ID NO: 961903 - DNA, 22 bp, Artificial Sequence
  chemically synthesized
ggattcttatagcttgaagtct

SEQ ID NO: 961904 - DNA, 22 bp, Artificial Sequence
  chemically synthesized
aagatttaaatgtaagacttca

SEQ ID NO: 961905 - DNA, 22 bp, Artificial Sequence
  chemically synthesized
ttatagcttgaagtcttacatt

SEQ ID NO: 961906 - DNA, 22 bp, Artificial Sequence
  chemically synthesized
atagcttgaagtcttacattta

SEQ ID NO: 961907 - DNA, 22 bp, Artificial Sequence
  chemically synthesized
tagcttgaagtcttacatttaa

SEQ ID NO: 961908 - DNA, 22 bp, Artificial Sequence
  chemically synthesized
ggaaatggattaaagatttaaa

SEQ ID NO: 961909 - DNA, 22 bp, Artificial Sequence
  chemically synthesized
gaagtcttacatttaaatcttt

SEQ ID NO: 961910 - DNA, 22 bp, Artificial Sequence
  chemically synthesized
aagtcttacatttaaatcttta

SEQ ID NO: 961911 - DNA, 22 bp, Artificial Sequence
  chemically synthesized
acatttaaatctttaatccatt

SEQ ID NO: 961912 - DNA, 22 bp, Artificial Sequence
  chemically synthesized
catttaaatctttaatccattt

SEQ ID NO: 961913 - DNA, 22 bp, Artificial Sequence
  chemically synthesized
aaatctttaatccatttcccaa

SEQ ID NO: 961914 - DNA, 22 bp, Artificial Sequence
  chemically synthesized
aatctttaatccatttcccaat

SEQ ID NO: 961915 - DNA, 22 bp, Artificial Sequence
  chemically synthesized
taatccatttcccaatgcttat

SEQ ID NO: 961916 - DNA, 22 bp, Artificial Sequence
  chemically synthesized
aatccatttcccaatgcttatt

SEQ ID NO: 961917 - DNA, 22 bp, Artificial Sequence
  chemically synthesized
atccatttcccaatgcttattt

SEQ ID NO: 961918 - DNA, 22 bp, Artificial Sequence
  chemically synthesized
gtcgacaaagtcaacaaaaaaa

SEQ ID NO: 961919 - DNA, 22 bp, Artificial Sequence
  chemically synthesized
cccaatgcttatttttttgttg

SEQ ID NO: 961920 - DNA, 22 bp, Artificial Sequence
  chemically synthesized
ccaatgcttatttttttgttga

SEQ ID NO: 961921 - DNA, 22 bp, Artificial Sequence
  chemically synthesized
ttcgtcgacaaagtcaacaaaa

SEQ ID NO: 961922 - DNA, 22 bp, Artificial Sequence
  chemically synthesized
atttttttgttgactttgtcga

SEQ ID NO: 961923 - DNA, 22 bp, Artificial Sequence
  chemically synthesized
tttttttgttgactttgtcgac

SEQ ID NO: 961924 - DNA, 22 bp, Artificial Sequence
  chemically synthesized
cagccaactgttcgtcgacaaa

SEQ ID NO: 961925 - DNA, 22 bp, Artificial Sequence
  chemically synthesized
ttttgttgactttgtcgacgaa

SEQ ID NO: 961926 - DNA, 22 bp, Artificial Sequence
  chemically synthesized
tttgttgactttgtcgacgaac

SEQ ID NO: 961927 - DNA, 22 bp, Artificial Sequence
  chemically synthesized
ttgttgactttgtcgacgaaca

SEQ ID NO: 961928 - DNA, 22 bp, Artificial Sequence
  chemically synthesized
tgttgactttgtcgacgaacag

SEQ ID NO: 961929 - DNA, 22 bp, Artificial Sequence
  chemically synthesized
gttgactttgtcgacgaacagt

SEQ ID NO: 961930 - DNA, 22 bp, Artificial Sequence
  chemically synthesized
ttgactttgtcgacgaacagtt

SEQ ID NO: 961931 - DNA, 22 bp, Artificial Sequence
  chemically synthesized
cacagctacagccaactgttcg

SEQ ID NO: 961932 - DNA, 22 bp, Artificial Sequence
  chemically synthesized
actttgtcgacgaacagttggc

SEQ ID NO: 961933 - DNA, 22 bp, Artificial Sequence
  chemically synthesized
tgtcgacgaacagttggctgta

SEQ ID NO: 961934 - DNA, 22 bp, Artificial Sequence
  chemically synthesized
gtcgacgaacagttggctgtag

SEQ ID NO: 961935 - DNA, 22 bp, Artificial Sequence
  chemically synthesized
tcgacgaacagttggctgtagc

SEQ ID NO: 961936 - DNA, 22 bp, Artificial Sequence
  chemically synthesized
gctgtagctgtgcagttttatt

SEQ ID NO: 961937 - DNA, 22 bp, Artificial Sequence
  chemically synthesized
tagctgtgcagttttatttatg

SEQ ID NO: 961938 - DNA, 22 bp, Artificial Sequence
  chemically synthesized
tgcagttttatttatgtgttct

SEQ ID NO: 961939 - DNA, 22 bp, Artificial Sequence
  chemically synthesized
tatttatgtgttctctattctg

SEQ ID NO: 961940 - DNA, 22 bp, Artificial Sequence
  chemically synthesized
atttatgtgttctctattctgt

SEQ ID NO: 961941 - DNA, 22 bp, Artificial Sequence
  chemically synthesized
tttatgtgttctctattctgtt

SEQ ID NO: 961942 - DNA, 22 bp, Artificial Sequence
  chemically synthesized
atgtgttctctattctgttcta

SEQ ID NO: 961943 - DNA, 22 bp, Artificial Sequence
  chemically synthesized
tgtgttctctattctgttctat

SEQ ID NO: 961944 - DNA, 22 bp, Artificial Sequence
  chemically synthesized
tctattctgttctattggtcta

SEQ ID NO: 961945 - DNA, 22 bp, Artificial Sequence
  chemically synthesized
tattctgttctattggtctatg

SEQ ID NO: 961946 - DNA, 22 bp, Artificial Sequence
  chemically synthesized
ttctgttctattggtctatgtg

SEQ ID NO: 961947 - DNA, 22 bp, Artificial Sequence
  chemically synthesized
tgttctattggtctatgtgtac

SEQ ID NO: 961948 - DNA, 22 bp, Artificial Sequence
  chemically synthesized
ccaagatgtcatgtacacatag

SEQ ID NO: 961949 - DNA, 22 bp, Artificial Sequence
  chemically synthesized
ttctattggtctatgtgtacat

SEQ ID NO: 961950 - DNA, 22 bp, Artificial Sequence
  chemically synthesized
tattggtctatgtgtacatgac

SEQ ID NO: 961951 - DNA, 22 bp, Artificial Sequence
  chemically synthesized
ttggtctatgtgtacatgacat

SEQ ID NO: 961952 - DNA, 22 bp, Artificial Sequence
  chemically synthesized
aaatcctaccaagatgtcatgt

SEQ ID NO: 961953 - DNA, 22 bp, Artificial Sequence
  chemically synthesized
gaaatcctaccaagatgtcatg

SEQ ID NO: 961954 - DNA, 22 bp, Artificial Sequence
  chemically synthesized
gtctatgtgtacatgacatctt

SEQ ID NO: 961955 - DNA, 22 bp, Artificial Sequence
  chemically synthesized
tgtgtacatgacatcttggtag

SEQ ID NO: 961956 - DNA, 22 bp, Artificial Sequence
  chemically synthesized
aacaggtttgaaatcctaccaa

SEQ ID NO: 961957 - DNA, 22 bp, Artificial Sequence
  chemically synthesized
gggcattgaacaggtttgaaat

SEQ ID NO: 961958 - DNA, 22 bp, Artificial Sequence
  chemically synthesized
agggcattgaacaggtttgaaa

SEQ ID NO: 961959 - DNA, 22 bp, Artificial Sequence
  chemically synthesized
tagggcattgaacaggtttgaa

SEQ ID NO: 961960 - DNA, 22 bp, Artificial Sequence
  chemically synthesized
ttagggcattgaacaggtttga

SEQ ID NO: 961961 - DNA, 22 bp, Artificial Sequence
  chemically synthesized
tttagggcattgaacaggtttg

SEQ ID NO: 961962 - DNA, 22 bp, Artificial Sequence
  chemically synthesized
ttttagggcattgaacaggttt

SEQ ID NO: 961963 - DNA, 22 bp, Artificial Sequence
  chemically synthesized
ggtaggatttcaaacctgttca

SEQ ID NO: 961964 - DNA, 22 bp, Artificial Sequence
  chemically synthesized
gtaggatttcaaacctgttcaa

SEQ ID NO: 961965 - DNA, 22 bp, Artificial Sequence
  chemically synthesized
tatttttttagggcattgaaca

SEQ ID NO: 961966 - DNA, 22 bp, Artificial Sequence
  chemically synthesized
caaacctgttcaatgccctaaa

SEQ ID NO: 961967 - DNA, 22 bp, Artificial Sequence
  chemically synthesized
aaacctgttcaatgccctaaaa

SEQ ID NO: 961968 - DNA, 22 bp, Artificial Sequence
  chemically synthesized
aaagttatatttttttagggca

SEQ ID NO: 961969 - DNA, 22 bp, Artificial Sequence
  chemically synthesized
aaaagttatatttttttagggc

SEQ ID NO: 961970 - DNA, 22 bp, Artificial Sequence
  chemically synthesized
ttcaatgccctaaaaaaatata

SEQ ID NO: 961971 - DNA, 22 bp, Artificial Sequence
  chemically synthesized
aatgccctaaaaaaatataact

SEQ ID NO: 961972 - DNA, 22 bp, Artificial Sequence
  chemically synthesized
aaatcacttaaaagttatattt

SEQ ID NO: 961973 - DNA, 22 bp, Artificial Sequence
  chemically synthesized
caaatcacttaaaagttatatt

SEQ ID NO: 961974 - DNA, 22 bp, Artificial Sequence
  chemically synthesized
tcaaatcacttaaaagttatat

SEQ ID NO: 961975 - DNA, 22 bp, Artificial Sequence
  chemically synthesized
ttcaaatcacttaaaagttata

SEQ ID NO: 961976 - DNA, 22 bp, Artificial Sequence
  chemically synthesized
tttcaaatcacttaaaagttat

SEQ ID NO: 961977 - DNA, 22 bp, Artificial Sequence
  chemically synthesized
ttttcaaatcacttaaaagtta

SEQ ID NO: 961978 - DNA, 22 bp, Artificial Sequence
  chemically synthesized
aaaaaatataacttttaagtga

SEQ ID NO: 961979 - DNA, 22 bp, Artificial Sequence
  chemically synthesized
gcaggcagtttttttcaaatca

SEQ ID NO: 961980 - DNA, 22 bp, Artificial Sequence
  chemically synthesized
agcaggcagtttttttcaaatc

SEQ ID NO: 961981 - DNA, 22 bp, Artificial Sequence
  chemically synthesized
gatttagcaggcagtttttttc

SEQ ID NO: 961982 - DNA, 22 bp, Artificial Sequence
  chemically synthesized
ttaagtgatttgaaaaaaactg

SEQ ID NO: 961983 - DNA, 22 bp, Artificial Sequence
  chemically synthesized
agatttagcaggcagttttttt

SEQ ID NO: 961984 - DNA, 22 bp, Artificial Sequence
  chemically synthesized
taagtgatttgaaaaaaactgc

SEQ ID NO: 961985 - DNA, 22 bp, Artificial Sequence
  chemically synthesized
aagtgatttgaaaaaaactgcc

SEQ ID NO: 961986 - DNA, 22 bp, Artificial Sequence
  chemically synthesized
agtgatttgaaaaaaactgcct

SEQ ID NO: 961987 - DNA, 22 bp, Artificial Sequence
  chemically synthesized
caagtttagatttagcaggcag

SEQ ID NO: 961988 - DNA, 22 bp, Artificial Sequence
  chemically synthesized
ccaagtttagatttagcaggca

SEQ ID NO: 961989 - DNA, 22 bp, Artificial Sequence
  chemically synthesized
gaaaaaaactgcctgctaaatc

SEQ ID NO: 961990 - DNA, 22 bp, Artificial Sequence
  chemically synthesized
aaaaaaactgcctgctaaatct

SEQ ID NO: 961991 - DNA, 22 bp, Artificial Sequence
  chemically synthesized
agtaggcagtttccaagtttag

SEQ ID NO: 961992 - DNA, 22 bp, Artificial Sequence
  chemically synthesized
cctgctaaatctaaacttggaa

SEQ ID NO: 961993 - DNA, 22 bp, Artificial Sequence
  chemically synthesized
ctaaatctaaacttggaaactg

SEQ ID NO: 961994 - DNA, 22 bp, Artificial Sequence
  chemically synthesized
tagaattaagtaggcagtttcc

SEQ ID NO: 961995 - DNA, 22 bp, Artificial Sequence
  chemically synthesized
aatctaaacttggaaactgcct

SEQ ID NO: 961996 - DNA, 22 bp, Artificial Sequence
  chemically synthesized
attatagaattaagtaggcagt

SEQ ID NO: 961997 - DNA, 22 bp, Artificial Sequence
  chemically synthesized
tcattatagaattaagtaggca

SEQ ID NO: 961998 - DNA, 22 bp, Artificial Sequence
  chemically synthesized
aacttggaaactgcctacttaa

SEQ ID NO: 961999 - DNA, 22 bp, Artificial Sequence
  chemically synthesized
ctcattatagaattaagtaggc

SEQ ID NO: 962000 - DNA, 22 bp, Artificial Sequence
  chemically synthesized
ggaaactgcctacttaattcta

SEQ ID NO: 962001 - DNA, 22 bp, Artificial Sequence
  chemically synthesized
cccttctcattatagaattaag

SEQ ID NO: 962002 - DNA, 22 bp, Artificial Sequence
  chemically synthesized
gaaactgcctacttaattctat

SEQ ID NO: 962003 - DNA, 22 bp, Artificial Sequence
  chemically synthesized
agattacccttctcattataga

SEQ ID NO: 962004 - DNA, 22 bp, Artificial Sequence
  chemically synthesized
cctacttaattctataatgaga

SEQ ID NO: 962005 - DNA, 22 bp, Artificial Sequence
  chemically synthesized
tgctgagattacccttctcatt

SEQ ID NO: 962006 - DNA, 22 bp, Artificial Sequence
  chemically synthesized
cttaattctataatgagaaggg

SEQ ID NO: 962007 - DNA, 22 bp, Artificial Sequence
  chemically synthesized
atgctgagattacccttctcat

SEQ ID NO: 962008 - DNA, 22 bp, Artificial Sequence
  chemically synthesized
aattctataatgagaagggtaa

SEQ ID NO: 962009 - DNA, 22 bp, Artificial Sequence
  chemically synthesized
attctataatgagaagggtaat

SEQ ID NO: 962010 - DNA, 22 bp, Artificial Sequence
  chemically synthesized
aaatttatgctgagattaccct

SEQ ID NO: 962011 - DNA, 22 bp, Artificial Sequence
  chemically synthesized
gaaatttatgctgagattaccc

SEQ ID NO: 962012 - DNA, 22 bp, Artificial Sequence
  chemically synthesized
tataatgagaagggtaatctca

SEQ ID NO: 962013 - DNA, 22 bp, Artificial Sequence
  chemically synthesized
tgaaatttatgctgagattacc

SEQ ID NO: 962014 - DNA, 22 bp, Artificial Sequence
  chemically synthesized
ttgaaatttatgctgagattac

SEQ ID NO: 962015 - DNA, 22 bp, Artificial Sequence
  chemically synthesized
taatgagaagggtaatctcagc

SEQ ID NO: 962016 - DNA, 22 bp, Artificial Sequence
  chemically synthesized
acttttgaaatttatgctgaga

SEQ ID NO: 962017 - DNA, 22 bp, Artificial Sequence
  chemically synthesized
gcctaacttttgaaatttatgc

SEQ ID NO: 962018 - DNA, 22 bp, Artificial Sequence
  chemically synthesized
agcctaacttttgaaatttatg

SEQ ID NO: 962019 - DNA, 22 bp, Artificial Sequence
  chemically synthesized
agcataaatttcaaaagttagg

SEQ ID NO: 962020 - DNA, 22 bp, Artificial Sequence
  chemically synthesized
tcaagtagatatggagtttagc

SEQ ID NO: 962021 - DNA, 22 bp, Artificial Sequence
  chemically synthesized
gtcaagtagatatggagtttag

SEQ ID NO: 962022 - DNA, 22 bp, Artificial Sequence
  chemically synthesized
caaaagttaggctaaactccat

SEQ ID NO: 962023 - DNA, 22 bp, Artificial Sequence
  chemically synthesized
aaaagttaggctaaactccata

SEQ ID NO: 962024 - DNA, 22 bp, Artificial Sequence
  chemically synthesized
cttgtcaagtagatatggagtt

SEQ ID NO: 962025 - DNA, 22 bp, Artificial Sequence
  chemically synthesized
ggctaaactccatatctacttg

SEQ ID NO: 962026 - DNA, 22 bp, Artificial Sequence
  chemically synthesized
atggttacttgtcaagtagata

SEQ ID NO: 962027 - DNA, 22 bp, Artificial Sequence
  chemically synthesized
aactccatatctacttgacaag

SEQ ID NO: 962028 - DNA, 22 bp, Artificial Sequence
  chemically synthesized
agctcatggttacttgtcaagt

SEQ ID NO: 962029 - DNA, 22 bp, Artificial Sequence
  chemically synthesized
aagctcatggttacttgtcaag

SEQ ID NO: 962030 - DNA, 22 bp, Artificial Sequence
  chemically synthesized
catatctacttgacaagtaacc

SEQ ID NO: 962031 - DNA, 22 bp, Artificial Sequence
  chemically synthesized
tatttaagctcatggttacttg

SEQ ID NO: 962032 - DNA, 22 bp, Artificial Sequence
  chemically synthesized
agattatatttaagctcatggt

SEQ ID NO: 962033 - DNA, 22 bp, Artificial Sequence
  chemically synthesized
cttgacaagtaaccatgagctt

SEQ ID NO: 962034 - DNA, 22 bp, Artificial Sequence
  chemically synthesized
gacaagtaaccatgagcttaaa

SEQ ID NO: 962035 - DNA, 22 bp, Artificial Sequence
  chemically synthesized
acaagtaaccatgagcttaaat

SEQ ID NO: 962036 - DNA, 22 bp, Artificial Sequence
  chemically synthesized
tggtgggtgatctcagattata

SEQ ID NO: 962037 - DNA, 22 bp, Artificial Sequence
  chemically synthesized
catattatggtgggtgatctca

SEQ ID NO: 962038 - DNA, 22 bp, Artificial Sequence
  chemically synthesized
ccatattatggtgggtgatctc

SEQ ID NO: 962039 - DNA, 22 bp, Artificial Sequence
  chemically synthesized
aaatataatctgagatcaccca

SEQ ID NO: 962040 - DNA, 22 bp, Artificial Sequence
  chemically synthesized
aatataatctgagatcacccac

SEQ ID NO: 962041 - DNA, 22 bp, Artificial Sequence
  chemically synthesized
acttccatattatggtgggtga

SEQ ID NO: 962042 - DNA, 22 bp, Artificial Sequence
  chemically synthesized
cctcacttccatattatggtgg

SEQ ID NO: 962043 - DNA, 22 bp, Artificial Sequence
  chemically synthesized
agatcacccaccataatatgga

SEQ ID NO: 962044 - DNA, 22 bp, Artificial Sequence
  chemically synthesized
acctacctcacttccatattat

SEQ ID NO: 962045 - DNA, 22 bp, Artificial Sequence
  chemically synthesized
ccaaaccatccaatctcaccta

SEQ ID NO: 962046 - DNA, 22 bp, Artificial Sequence
  chemically synthesized
ctcccaaaccatccaatctcac

SEQ ID NO: 962047 - DNA, 22 bp, Artificial Sequence
  chemically synthesized
tactcccaaaccatccaatctc

SEQ ID NO: 962048 - DNA, 22 bp, Artificial Sequence
  chemically synthesized
tatctctactcccaaaccatcc

SEQ ID NO: 962049 - DNA, 22 bp, Artificial Sequence
  chemically synthesized
taacattgtatctctactccca

SEQ ID NO: 962050 - DNA, 22 bp, Artificial Sequence
  chemically synthesized
ataacattgtatctctactccc

SEQ ID NO: 962051 - DNA, 22 bp, Artificial Sequence
  chemically synthesized
gatggtttgggagtagagatac

SEQ ID NO: 962052 - DNA, 22 bp, Artificial Sequence
  chemically synthesized
ggaatttataacattgtatctc

SEQ ID NO: 962053 - DNA, 22 bp, Artificial Sequence
  chemically synthesized
gggagtagagatacaatgttat

SEQ ID NO: 962054 - DNA, 22 bp, Artificial Sequence
  chemically synthesized
ggagtagagatacaatgttata

SEQ ID NO: 962055 - DNA, 22 bp, Artificial Sequence
  chemically synthesized
caattcggaatttataacattg

SEQ ID NO: 962056 - DNA, 22 bp, Artificial Sequence
  chemically synthesized
tcaggtcaatatgttccaattc

SEQ ID NO: 962057 - DNA, 22 bp, Artificial Sequence
  chemically synthesized
taaattccgaattggaacatat

SEQ ID NO: 962058 - DNA, 22 bp, Artificial Sequence
  chemically synthesized
cccagttgtcaggtcaatatgt

SEQ ID NO: 962059 - DNA, 22 bp, Artificial Sequence
  chemically synthesized
tacccagttgtcaggtcaatat

SEQ ID NO: 962060 - DNA, 22 bp, Artificial Sequence
  chemically synthesized
cgaattggaacatattgacctg

SEQ ID NO: 962061 - DNA, 22 bp, Artificial Sequence
  chemically synthesized
gaacatattgacctgacaactg

SEQ ID NO: 962062 - DNA, 22 bp, Artificial Sequence
  chemically synthesized
caaatattctacccagttgtca

SEQ ID NO: 962063 - DNA, 22 bp, Artificial Sequence
  chemically synthesized
attgcaaatattctacccagtt

SEQ ID NO: 962064 - DNA, 22 bp, Artificial Sequence
  chemically synthesized
acctgacaactgggtagaatat

SEQ ID NO: 962065 - DNA, 22 bp, Artificial Sequence
  chemically synthesized
acaactgggtagaatatttgca

SEQ ID NO: 962066 - DNA, 22 bp, Artificial Sequence
  chemically synthesized
aacaatattgattgcaaatatt

SEQ ID NO: 962067 - DNA, 22 bp, Artificial Sequence
  chemically synthesized
tgaacaatattgattgcaaata

SEQ ID NO: 962068 - DNA, 22 bp, Artificial Sequence
  chemically synthesized
ggtagaatatttgcaatcaata

SEQ ID NO: 962069 - DNA, 22 bp, Artificial Sequence
  chemically synthesized
aaatgtctctgaacaatattga

SEQ ID NO: 962070 - DNA, 22 bp, Artificial Sequence
  chemically synthesized
gcaatcaatattgttcagagac

SEQ ID NO: 962071 - DNA, 22 bp, Artificial Sequence
  chemically synthesized
caatcaatattgttcagagaca

SEQ ID NO: 962072 - DNA, 22 bp, Artificial Sequence
  chemically synthesized
cagaagggccaaatgactaaaa

SEQ ID NO: 962073 - DNA, 22 bp, Artificial Sequence
  chemically synthesized
ttcagagacattttagtcattt

SEQ ID NO: 962074 - DNA, 22 bp, Artificial Sequence
  chemically synthesized
ttacagaagggccaaatgacta

SEQ ID NO: 962075 - DNA, 22 bp, Artificial Sequence
  chemically synthesized
agagacattttagtcatttggc

SEQ ID NO: 962076 - DNA, 22 bp, Artificial Sequence
  chemically synthesized
tgttacagaagggccaaatgac

SEQ ID NO: 962077 - DNA, 22 bp, Artificial Sequence
  chemically synthesized
tgactctgttacagaagggcca

SEQ ID NO: 962078 - DNA, 22 bp, Artificial Sequence
  chemically synthesized
tagtcatttggcccttctgtaa

SEQ ID NO: 962079 - DNA, 22 bp, Artificial Sequence
  chemically synthesized
agtcatttggcccttctgtaac

SEQ ID NO: 962080 - DNA, 22 bp, Artificial Sequence
  chemically synthesized
ggctatgactctgttacagaag

SEQ ID NO: 962081 - DNA, 22 bp, Artificial Sequence
  chemically synthesized
gtcatttggcccttctgtaaca

SEQ ID NO: 962082 - DNA, 22 bp, Artificial Sequence
  chemically synthesized
ggcccttctgtaacagagtcat

SEQ ID NO: 962083 - DNA, 22 bp, Artificial Sequence
  chemically synthesized
gcccttctgtaacagagtcata

SEQ ID NO: 962084 - DNA, 22 bp, Artificial Sequence
  chemically synthesized
atgataaggattgggctatgac

SEQ ID NO: 962085 - DNA, 22 bp, Artificial Sequence
  chemically synthesized
catgataaggattgggctatga

SEQ ID NO: 962086 - DNA, 22 bp, Artificial Sequence
  chemically synthesized
ctgtaacagagtcatagcccaa

SEQ ID NO: 962087 - DNA, 22 bp, Artificial Sequence
  chemically synthesized
tgtaacagagtcatagcccaat

SEQ ID NO: 962088 - DNA, 22 bp, Artificial Sequence
  chemically synthesized
taacagagtcatagcccaatcc

SEQ ID NO: 962089 - DNA, 22 bp, Artificial Sequence
  chemically synthesized
tcccaggtatttcatgataagg

SEQ ID NO: 962090 - DNA, 22 bp, Artificial Sequence
  chemically synthesized
gtcccaggtatttcatgataag

SEQ ID NO: 962091 - DNA, 22 bp, Artificial Sequence
  chemically synthesized
tgtcccaggtatttcatgataa

SEQ ID NO: 962092 - DNA, 22 bp, Artificial Sequence
  chemically synthesized
agatactttgtcccaggtattt

SEQ ID NO: 962093 - DNA, 22 bp, Artificial Sequence
  chemically synthesized
cagatactttgtcccaggtatt

SEQ ID NO: 962094 - DNA, 22 bp, Artificial Sequence
  chemically synthesized
atcatgaaatacctgggacaaa

SEQ ID NO: 962095 - DNA, 22 bp, Artificial Sequence
  chemically synthesized
tcatgaaatacctgggacaaag

SEQ ID NO: 962096 - DNA, 22 bp, Artificial Sequence
  chemically synthesized
acatttcagatactttgtccca

SEQ ID NO: 962097 - DNA, 22 bp, Artificial Sequence
  chemically synthesized
aacatttcagatactttgtccc

SEQ ID NO: 962098 - DNA, 22 bp, Artificial Sequence
  chemically synthesized
taacatttcagatactttgtcc

SEQ ID NO: 962099 - DNA, 22 bp, Artificial Sequence
  chemically synthesized
ttaacatttcagatactttgtc

SEQ ID NO: 962100 - DNA, 22 bp, Artificial Sequence
  chemically synthesized
ggacaaagtatctgaaatgtta

SEQ ID NO: 962101 - DNA, 22 bp, Artificial Sequence
  chemically synthesized
cgtcccccaaacttttaacatt

SEQ ID NO: 962102 - DNA, 22 bp, Artificial Sequence
  chemically synthesized
aaatgttaaaagtttgggggac

SEQ ID NO: 962103 - DNA, 22 bp, Artificial Sequence
  chemically synthesized
caccacaaaccataattacgtc

SEQ ID NO: 962104 - DNA, 22 bp, Artificial Sequence
  chemically synthesized
aaagtttgggggacgtaattat

SEQ ID NO: 962105 - DNA, 22 bp, Artificial Sequence
  chemically synthesized
cgattccaccacaaaccataat

SEQ ID NO: 962106 - DNA, 22 bp, Artificial Sequence
  chemically synthesized
gggggacgtaattatggtttgt

SEQ ID NO: 962107 - DNA, 22 bp, Artificial Sequence
  chemically synthesized
ggggacgtaattatggtttgtg

SEQ ID NO: 962108 - DNA, 22 bp, Artificial Sequence
  chemically synthesized
catacatgcctacgattccacc

SEQ ID NO: 962109 - DNA, 22 bp, Artificial Sequence
  chemically synthesized
acatacatgcctacgattccac

SEQ ID NO: 962110 - DNA, 22 bp, Artificial Sequence
  chemically synthesized
tacatacatgcctacgattcca

SEQ ID NO: 962111 - DNA, 22 bp, Artificial Sequence
  chemically synthesized
tggtttgtggtggaatcgtagg

SEQ ID NO: 962112 - DNA, 22 bp, Artificial Sequence
  chemically synthesized
gtggtggaatcgtaggcatgta

SEQ ID NO: 962113 - DNA, 22 bp, Artificial Sequence
  chemically synthesized
tggtggaatcgtaggcatgtat

SEQ ID NO: 962114 - DNA, 22 bp, Artificial Sequence
  chemically synthesized
aaatataaggacagccatgatt

SEQ ID NO: 962115 - DNA, 22 bp, Artificial Sequence
  chemically synthesized
caaatataaggacagccatgat

SEQ ID NO: 962116 - DNA, 22 bp, Artificial Sequence
  chemically synthesized
tccttatatttgaaattctatt

SEQ ID NO: 962117 - DNA, 22 bp, Artificial Sequence
  chemically synthesized
atatttgaaattctatttactt

SEQ ID NO: 962118 - DNA, 22 bp, Artificial Sequence
  chemically synthesized
tatttgaaattctatttacttc

SEQ ID NO: 962119 - DNA, 22 bp, Artificial Sequence
  chemically synthesized
gaaattctatttacttcctttt

SEQ ID NO: 962120 - DNA, 22 bp, Artificial Sequence
  chemically synthesized
aaattctatttacttccttttg

SEQ ID NO: 962121 - DNA, 22 bp, Artificial Sequence
  chemically synthesized
aatgccatcataccaaaaggaa

SEQ ID NO: 962122 - DNA, 22 bp, Artificial Sequence
  chemically synthesized
caatgccatcataccaaaagga

SEQ ID NO: 962123 - DNA, 22 bp, Artificial Sequence
  chemically synthesized
tcaatgccatcataccaaaagg

SEQ ID NO: 962124 - DNA, 22 bp, Artificial Sequence
  chemically synthesized
ttcaatgccatcataccaaaag

SEQ ID NO: 962125 - DNA, 22 bp, Artificial Sequence
  chemically synthesized
tatttacttccttttggtatga

SEQ ID NO: 962126 - DNA, 22 bp, Artificial Sequence
  chemically synthesized
ttttcaatgccatcataccaaa

SEQ ID NO: 962127 - DNA, 22 bp, Artificial Sequence
  chemically synthesized
cttttcaatgccatcataccaa

SEQ ID NO: 962128 - DNA, 22 bp, Artificial Sequence
  chemically synthesized
tttacttccttttggtatgatg

SEQ ID NO: 962129 - DNA, 22 bp, Artificial Sequence
  chemically synthesized
ttcttttcaatgccatcatacc

SEQ ID NO: 962130 - DNA, 22 bp, Artificial Sequence
  chemically synthesized
cttcttttcaatgccatcatac

SEQ ID NO: 962131 - DNA, 22 bp, Artificial Sequence
  chemically synthesized
acttccttttggtatgatggca

SEQ ID NO: 962132 - DNA, 22 bp, Artificial Sequence
  chemically synthesized
cttccttttggtatgatggcat

SEQ ID NO: 962133 - DNA, 22 bp, Artificial Sequence
  chemically synthesized
ccttttggtatgatggcattga

SEQ ID NO: 962134 - DNA, 22 bp, Artificial Sequence
  chemically synthesized
cttttggtatgatggcattgaa

SEQ ID NO: 962135 - DNA, 22 bp, Artificial Sequence
  chemically synthesized
tcatttcttcttttcaatgcca

SEQ ID NO: 962136 - DNA, 22 bp, Artificial Sequence
  chemically synthesized
atcatttcttcttttcaatgcc

SEQ ID NO: 962137 - DNA, 22 bp, Artificial Sequence
  chemically synthesized
ttggtatgatggcattgaaaag

SEQ ID NO: 962138 - DNA, 22 bp, Artificial Sequence
  chemically synthesized
tggtatgatggcattgaaaaga

SEQ ID NO: 962139 - DNA, 22 bp, Artificial Sequence
  chemically synthesized
ggtatgatggcattgaaaagaa

SEQ ID NO: 962140 - DNA, 22 bp, Artificial Sequence
  chemically synthesized
gtatgatggcattgaaaagaag

SEQ ID NO: 962141 - DNA, 22 bp, Artificial Sequence
  chemically synthesized
aaacacttatcatttcttcttt

SEQ ID NO: 962142 - DNA, 22 bp, Artificial Sequence
  chemically synthesized
aaaagaagaaatgataagtgtt

SEQ ID NO: 962143 - DNA, 22 bp, Artificial Sequence
  chemically synthesized
ggatatccaccatctgaaacac

SEQ ID NO: 962144 - DNA, 22 bp, Artificial Sequence
  chemically synthesized
cagatggtggatatcccaatta

SEQ ID NO: 962145 - DNA, 22 bp, Artificial Sequence
  chemically synthesized
agatggtggatatcccaattac

SEQ ID NO: 962146 - DNA, 22 bp, Artificial Sequence
  chemically synthesized
ccctgatttgatcattacacat

SEQ ID NO: 962147 - DNA, 22 bp, Artificial Sequence
  chemically synthesized
atacaagcgtataatgtgtaat

SEQ ID NO: 962148 - DNA, 22 bp, Artificial Sequence
  chemically synthesized
gatacaagcgtataatgtgtaa

SEQ ID NO: 962149 - DNA, 22 bp, Artificial Sequence
  chemically synthesized
tgatacaagcgtataatgtgta

SEQ ID NO: 962150 - DNA, 22 bp, Artificial Sequence
  chemically synthesized
atttgatcattacacattatac

SEQ ID NO: 962151 - DNA, 22 bp, Artificial Sequence
  chemically synthesized
gatcattacacattatacgctt

SEQ ID NO: 962152 - DNA, 22 bp, Artificial Sequence
  chemically synthesized
atcattacacattatacgcttg

SEQ ID NO: 962153 - DNA, 22 bp, Artificial Sequence
  chemically synthesized
gtgatattttgatacaagcgta

SEQ ID NO: 962154 - DNA, 22 bp, Artificial Sequence
  chemically synthesized
tagtgatattttgatacaagcg

SEQ ID NO: 962155 - DNA, 22 bp, Artificial Sequence
  chemically synthesized
cacattatacgcttgtatcaaa

SEQ ID NO: 962156 - DNA, 22 bp, Artificial Sequence
  chemically synthesized
agattctagtgatattttgata

SEQ ID NO: 962157 - DNA, 22 bp, Artificial Sequence
  chemically synthesized
taagattctagtgatattttga

SEQ ID NO: 962158 - DNA, 22 bp, Artificial Sequence
  chemically synthesized
ctaagattctagtgatattttg

SEQ ID NO: 962159 - DNA, 22 bp, Artificial Sequence
  chemically synthesized
tacgcttgtatcaaaatatcac

SEQ ID NO: 962160 - DNA, 22 bp, Artificial Sequence
  chemically synthesized
gtatcaaaatatcactagaatc

SEQ ID NO: 962161 - DNA, 22 bp, Artificial Sequence
  chemically synthesized
tatcaaaatatcactagaatct

SEQ ID NO: 962162 - DNA, 22 bp, Artificial Sequence
  chemically synthesized
tacatatttctaagattctagt

SEQ ID NO: 962163 - DNA, 22 bp, Artificial Sequence
  chemically synthesized
atacatagagattgtacatatt

SEQ ID NO: 962164 - DNA, 22 bp, Artificial Sequence
  chemically synthesized
gaatcttagaaatatgtacaat

SEQ ID NO: 962165 - DNA, 22 bp, Artificial Sequence
  chemically synthesized
tgttgatacatagagattgtac

SEQ ID NO: 962166 - DNA, 22 bp, Artificial Sequence
  chemically synthesized
gtgttgatacatagagattgta

SEQ ID NO: 962167 - DNA, 22 bp, Artificial Sequence
  chemically synthesized
tgtgttgatacatagagattgt

SEQ ID NO: 962168 - DNA, 22 bp, Artificial Sequence
  chemically synthesized
ttgtgttgatacatagagattg

SEQ ID NO: 962169 - DNA, 22 bp, Artificial Sequence
  chemically synthesized
agaaatatgtacaatctctatg

SEQ ID NO: 962170 - DNA, 22 bp, Artificial Sequence
  chemically synthesized
gaaatatgtacaatctctatgt

SEQ ID NO: 962171 - DNA, 22 bp, Artificial Sequence
  chemically synthesized
tttttgtgttgatacatagaga

SEQ ID NO: 962172 - DNA, 22 bp, Artificial Sequence
  chemically synthesized
atttttgtgttgatacatagag

SEQ ID NO: 962173 - DNA, 22 bp, Artificial Sequence
  chemically synthesized
tatttttgtgttgatacataga

SEQ ID NO: 962174 - DNA, 22 bp, Artificial Sequence
  chemically synthesized
ttttatttttgtgttgatacat

SEQ ID NO: 962175 - DNA, 22 bp, Artificial Sequence
  chemically synthesized
attttatttttgtgttgataca

SEQ ID NO: 962176 - DNA, 22 bp, Artificial Sequence
  chemically synthesized
tattttatttttgtgttgatac

SEQ ID NO: 962177 - DNA, 22 bp, Artificial Sequence
  chemically synthesized
ttattttatttttgtgttgata

SEQ ID NO: 962178 - DNA, 22 bp, Artificial Sequence
  chemically synthesized
gcttttattttatttttgtgtt

SEQ ID NO: 962179 - DNA, 22 bp, Artificial Sequence
  chemically synthesized
agcttttattttatttttgtgt

SEQ ID NO: 962180 - DNA, 22 bp, Artificial Sequence
  chemically synthesized
tatgtatcaacacaaaaataaa

SEQ ID NO: 962181 - DNA, 22 bp, Artificial Sequence
  chemically synthesized
tgtatcaacacaaaaataaaat

SEQ ID NO: 962182 - DNA, 22 bp, Artificial Sequence
  chemically synthesized
gatttagcttttattttatttt

SEQ ID NO: 962183 - DNA, 22 bp, Artificial Sequence
  chemically synthesized
agatttagcttttattttattt

SEQ ID NO: 962184 - DNA, 22 bp, Artificial Sequence
  chemically synthesized
aagaaacatatttagatttagc

SEQ ID NO: 962185 - DNA, 22 bp, Artificial Sequence
  chemically synthesized
taaagaaacatatttagattta

SEQ ID NO: 962186 - DNA, 22 bp, Artificial Sequence
  chemically synthesized
ctaaagaaacatatttagattt

SEQ ID NO: 962187 - DNA, 22 bp, Artificial Sequence
  chemically synthesized
tctaaagaaacatatttagatt

SEQ ID NO: 962188 - DNA, 22 bp, Artificial Sequence
  chemically synthesized
ttctaaagaaacatatttagat

SEQ ID NO: 962189 - DNA, 22 bp, Artificial Sequence
  chemically synthesized
tttctaaagaaacatatttaga

SEQ ID NO: 962190 - DNA, 22 bp, Artificial Sequence
  chemically synthesized
ttttctaaagaaacatatttag

SEQ ID NO: 962191 - DNA, 22 bp, Artificial Sequence
  chemically synthesized
cttttttctaaagaaacatatt

SEQ ID NO: 962192 - DNA, 22 bp, Artificial Sequence
  chemically synthesized
ccttttttctaaagaaacatat

SEQ ID NO: 962193 - DNA, 22 bp, Artificial Sequence
  chemically synthesized
ttccttttttctaaagaaacat

SEQ ID NO: 962194 - DNA, 22 bp, Artificial Sequence
  chemically synthesized
aatctaaatatgtttctttaga

SEQ ID NO: 962195 - DNA, 22 bp, Artificial Sequence
  chemically synthesized
acattcttccttttttctaaag

SEQ ID NO: 962196 - DNA, 22 bp, Artificial Sequence
  chemically synthesized
aatatgtttctttagaaaaaag

SEQ ID NO: 962197 - DNA, 22 bp, Artificial Sequence
  chemically synthesized
aaaatctgacattcttcctttt

SEQ ID NO: 962198 - DNA, 22 bp, Artificial Sequence
  chemically synthesized
aaaaatctgacattcttccttt

SEQ ID NO: 962199 - DNA, 22 bp, Artificial Sequence
  chemically synthesized
taaaaatctgacattcttcctt

SEQ ID NO: 962200 - DNA, 22 bp, Artificial Sequence
  chemically synthesized
ttaaaaatctgacattcttcct

SEQ ID NO: 962201 - DNA, 22 bp, Artificial Sequence
  chemically synthesized
ctttagaaaaaaggaagaatgt

SEQ ID NO: 962202 - DNA, 22 bp, Artificial Sequence
  chemically synthesized
tttagaaaaaaggaagaatgtc

SEQ ID NO: 962203 - DNA, 22 bp, Artificial Sequence
  chemically synthesized
tagaaaaaaggaagaatgtcag

SEQ ID NO: 962204 - DNA, 22 bp, Artificial Sequence
  chemically synthesized
ccttttaaaaatctgacattct

SEQ ID NO: 962205 - DNA, 22 bp, Artificial Sequence
  chemically synthesized
agaaaaaaggaagaatgtcaga

SEQ ID NO: 962206 - DNA, 22 bp, Artificial Sequence
  chemically synthesized
gaaaaaaggaagaatgtcagat

SEQ ID NO: 962207 - DNA, 22 bp, Artificial Sequence
  chemically synthesized
ttaccttttaaaaatctgacat

SEQ ID NO: 962208 - DNA, 22 bp, Artificial Sequence
  chemically synthesized
ttattaccttttaaaaatctga

SEQ ID NO: 962209 - DNA, 22 bp, Artificial Sequence
  chemically synthesized
taaaataattattattaccttt

SEQ ID NO: 962210 - DNA, 22 bp, Artificial Sequence
  chemically synthesized
cctataaaataattattattac

SEQ ID NO: 962211 - DNA, 22 bp, Artificial Sequence
  chemically synthesized
acctataaaataattattatta

SEQ ID NO: 962212 - DNA, 22 bp, Artificial Sequence
  chemically synthesized
tacctataaaataattattatt

SEQ ID NO: 962213 - DNA, 22 bp, Artificial Sequence
  chemically synthesized
ttacctataaaataattattat

SEQ ID NO: 962214 - DNA, 22 bp, Artificial Sequence
  chemically synthesized
ttaaaaggtaataataattatt

SEQ ID NO: 962215 - DNA, 22 bp, Artificial Sequence
  chemically synthesized
taaaaggtaataataattattt

SEQ ID NO: 962216 - DNA, 22 bp, Artificial Sequence
  chemically synthesized
aaaaggtaataataattatttt

SEQ ID NO: 962217 - DNA, 22 bp, Artificial Sequence
  chemically synthesized
aaaggtaataataattatttta

SEQ ID NO: 962218 - DNA, 22 bp, Artificial Sequence
  chemically synthesized
tgtatatgagaaaaatattttt

SEQ ID NO: 962219 - DNA, 22 bp, Artificial Sequence
  chemically synthesized
ttttataggtaaaaatattttt

SEQ ID NO: 962220 - DNA, 22 bp, Artificial Sequence
  chemically synthesized
tataggtaaaaatatttttctc

SEQ ID NO: 962221 - DNA, 22 bp, Artificial Sequence
  chemically synthesized
ataggtaaaaatatttttctca

SEQ ID NO: 962222 - DNA, 22 bp, Artificial Sequence
  chemically synthesized
taggtaaaaatatttttctcat

SEQ ID NO: 962223 - DNA, 22 bp, Artificial Sequence
  chemically synthesized
ccataattatgtatatgagaaa

SEQ ID NO: 962224 - DNA, 22 bp, Artificial Sequence
  chemically synthesized
taccataattatgtatatgaga

SEQ ID NO: 962225 - DNA, 22 bp, Artificial Sequence
  chemically synthesized
aattctaccataattatgtata

SEQ ID NO: 962226 - DNA, 22 bp, Artificial Sequence
  chemically synthesized
ttctcatatacataattatggt

SEQ ID NO: 962227 - DNA, 22 bp, Artificial Sequence
  chemically synthesized
tctcatatacataattatggta

SEQ ID NO: 962228 - DNA, 22 bp, Artificial Sequence
  chemically synthesized
aacactcaattctaccataatt

SEQ ID NO: 962229 - DNA, 22 bp, Artificial Sequence
  chemically synthesized
ctcatatacataattatggtag

SEQ ID NO: 962230 - DNA, 22 bp, Artificial Sequence
  chemically synthesized
tcatatacataattatggtaga

SEQ ID NO: 962231 - DNA, 22 bp, Artificial Sequence
  chemically synthesized
atatacataattatggtagaat

SEQ ID NO: 962232 - DNA, 22 bp, Artificial Sequence
  chemically synthesized
tattcaacactcaattctacca

SEQ ID NO: 962233 - DNA, 22 bp, Artificial Sequence
  chemically synthesized
ttgtattcaacactcaattcta

SEQ ID NO: 962234 - DNA, 22 bp, Artificial Sequence
  chemically synthesized
attgtattcaacactcaattct

SEQ ID NO: 962235 - DNA, 22 bp, Artificial Sequence
  chemically synthesized
tattgtattcaacactcaattc

SEQ ID NO: 962236 - DNA, 22 bp, Artificial Sequence
  chemically synthesized
tggtagaattgagtgttgaata

SEQ ID NO: 962237 - DNA, 22 bp, Artificial Sequence
  chemically synthesized
gaatattttattgtattcaaca

SEQ ID NO: 962238 - DNA, 22 bp, Artificial Sequence
  chemically synthesized
ttagaatattttattgtattca

SEQ ID NO: 962239 - DNA, 22 bp, Artificial Sequence
  chemically synthesized
ctattagaatattttattgtat

SEQ ID NO: 962240 - DNA, 22 bp, Artificial Sequence
  chemically synthesized
ttgctattagaatattttattg

SEQ ID NO: 962241 - DNA, 22 bp, Artificial Sequence
  chemically synthesized
agtgttgaatacaataaaatat

SEQ ID NO: 962242 - DNA, 22 bp, Artificial Sequence
  chemically synthesized
aatacaataaaatattctaata

SEQ ID NO: 962243 - DNA, 22 bp, Artificial Sequence
  chemically synthesized
cagtgcccacaaatctattgct

SEQ ID NO: 962244 - DNA, 22 bp, Artificial Sequence
  chemically synthesized
taatagcaatagatttgtgggc

SEQ ID NO: 962245 - DNA, 22 bp, Artificial Sequence
  chemically synthesized
atagcaatagatttgtgggcac

SEQ ID NO: 962246 - DNA, 22 bp, Artificial Sequence
  chemically synthesized
gagaaagttacagtgcccacaa

SEQ ID NO: 962247 - DNA, 22 bp, Artificial Sequence
  chemically synthesized
cgagaaagttacagtgcccaca

SEQ ID NO: 962248 - DNA, 22 bp, Artificial Sequence
  chemically synthesized
cttcgagaaagttacagtgccc

SEQ ID NO: 962249 - DNA, 22 bp, Artificial Sequence
  chemically synthesized
ctgcttcgagaaagttacagtg

SEQ ID NO: 962250 - DNA, 22 bp, Artificial Sequence
  chemically synthesized
tgctgcttcgagaaagttacag

SEQ ID NO: 962251 - DNA, 22 bp, Artificial Sequence
  chemically synthesized
tctgctgcttcgagaaagttac

SEQ ID NO: 962252 - DNA, 22 bp, Artificial Sequence
  chemically synthesized
ctctgctgcttcgagaaagtta

SEQ ID NO: 962253 - DNA, 22 bp, Artificial Sequence
  chemically synthesized
tctctgctgcttcgagaaagtt

SEQ ID NO: 962254 - DNA, 22 bp, Artificial Sequence
  chemically synthesized
gtgggcactgtaactttctcga

SEQ ID NO: 962255 - DNA, 22 bp, Artificial Sequence
  chemically synthesized
tgggcactgtaactttctcgaa

SEQ ID NO: 962256 - DNA, 22 bp, Artificial Sequence
  chemically synthesized
cagaactttctctgctgcttcg

SEQ ID NO: 962257 - DNA, 22 bp, Artificial Sequence
  chemically synthesized
acagaactttctctgctgcttc

SEQ ID NO: 962258 - DNA, 22 bp, Artificial Sequence
  chemically synthesized
taactttctcgaagcagcagag

SEQ ID NO: 962259 - DNA, 22 bp, Artificial Sequence
  chemically synthesized
gagacttacagaactttctctg

SEQ ID NO: 962260 - DNA, 22 bp, Artificial Sequence
  chemically synthesized
tctcgaagcagcagagaaagtt

SEQ ID NO: 962261 - DNA, 22 bp, Artificial Sequence
  chemically synthesized
ctcgaagcagcagagaaagttc

SEQ ID NO: 962262 - DNA, 22 bp, Artificial Sequence
  chemically synthesized
tcgaagcagcagagaaagttct

SEQ ID NO: 962263 - DNA, 22 bp, Artificial Sequence
  chemically synthesized
gttggagacttacagaactttc

SEQ ID NO: 962264 - DNA, 22 bp, Artificial Sequence
  chemically synthesized
gaagcagcagagaaagttctgt

SEQ ID NO: 962265 - DNA, 22 bp, Artificial Sequence
  chemically synthesized
ggttggagacttacagaacttt

SEQ ID NO: 962266 - DNA, 22 bp, Artificial Sequence
  chemically synthesized
tgtaagtctccaaccaagtttt

SEQ ID NO: 962267 - DNA, 22 bp, Artificial Sequence
  chemically synthesized
cataacatagataaaacttggt

SEQ ID NO: 962268 - DNA, 22 bp, Artificial Sequence
  chemically synthesized
acataacatagataaaacttgg

SEQ ID NO: 962269 - DNA, 22 bp, Artificial Sequence
  chemically synthesized
taagtctccaaccaagttttat

SEQ ID NO: 962270 - DNA, 22 bp, Artificial Sequence
  chemically synthesized
caaccaagttttatctatgtta

SEQ ID NO: 962271 - DNA, 22 bp, Artificial Sequence
  chemically synthesized
aaaacccttacataacatagat

SEQ ID NO: 962272 - DNA, 22 bp, Artificial Sequence
  chemically synthesized
tatctatgttatgtaagggttt

SEQ ID NO: 962273 - DNA, 22 bp, Artificial Sequence
  chemically synthesized
atctatgttatgtaagggtttt

SEQ ID NO: 962274 - DNA, 22 bp, Artificial Sequence
  chemically synthesized
tctatgttatgtaagggttttg

SEQ ID NO: 962275 - DNA, 22 bp, Artificial Sequence
  chemically synthesized
tagaaaagcattcaaaaccctt

SEQ ID NO: 962276 - DNA, 22 bp, Artificial Sequence
  chemically synthesized
tgttatgtaagggttttgaatg

SEQ ID NO: 962277 - DNA, 22 bp, Artificial Sequence
  chemically synthesized
tgttatagaaaagcattcaaaa

SEQ ID NO: 962278 - DNA, 22 bp, Artificial Sequence
  chemically synthesized
tgtaagggttttgaatgctttt

SEQ ID NO: 962279 - DNA, 22 bp, Artificial Sequence
  chemically synthesized
tgaatgcttttctataacatag

SEQ ID NO: 962280 - DNA, 22 bp, Artificial Sequence
  chemically synthesized
gaatgcttttctataacatagt

SEQ ID NO: 962281 - DNA, 22 bp, Artificial Sequence
  chemically synthesized
aatgcttttctataacatagtt

SEQ ID NO: 962282 - DNA, 22 bp, Artificial Sequence
  chemically synthesized
aaatgaaaaaagatcaaactat

SEQ ID NO: 962283 - DNA, 22 bp, Artificial Sequence
  chemically synthesized
caaatgaaaaaagatcaaacta

SEQ ID NO: 962284 - DNA, 22 bp, Artificial Sequence
  chemically synthesized
ttctataacatagtttgatctt

SEQ ID NO: 962285 - DNA, 22 bp, Artificial Sequence
  chemically synthesized
tctataacatagtttgatcttt

SEQ ID NO: 962286 - DNA, 22 bp, Artificial Sequence
  chemically synthesized
cttcaaatgaaaaaagatcaaa

SEQ ID NO: 962287 - DNA, 22 bp, Artificial Sequence
  chemically synthesized
ctataacatagtttgatctttt

SEQ ID NO: 962288 - DNA, 22 bp, Artificial Sequence
  chemically synthesized
tataacatagtttgatcttttt

SEQ ID NO: 962289 - DNA, 22 bp, Artificial Sequence
  chemically synthesized
ctgcttcaaatgaaaaaagatc

SEQ ID NO: 962290 - DNA, 22 bp, Artificial Sequence
  chemically synthesized
taacatagtttgatcttttttc

SEQ ID NO: 962291 - DNA, 22 bp, Artificial Sequence
  chemically synthesized
actgcttcaaatgaaaaaagat

SEQ ID NO: 962292 - DNA, 22 bp, Artificial Sequence
  chemically synthesized
tactgcttcaaatgaaaaaaga

SEQ ID NO: 962293 - DNA, 22 bp, Artificial Sequence
  chemically synthesized
ttactgcttcaaatgaaaaaag

SEQ ID NO: 962294 - DNA, 22 bp, Artificial Sequence
  chemically synthesized
ttttactgcttcaaatgaaaaa

SEQ ID NO: 962295 - DNA, 22 bp, Artificial Sequence
  chemically synthesized
cttttactgcttcaaatgaaaa

SEQ ID NO: 962296 - DNA, 22 bp, Artificial Sequence
  chemically synthesized
gatcttttttcatttgaagcag

SEQ ID NO: 962297 - DNA, 22 bp, Artificial Sequence
  chemically synthesized
aaatttcttttactgcttcaaa

SEQ ID NO: 962298 - DNA, 22 bp, Artificial Sequence
  chemically synthesized
atcttttttcatttgaagcagt

SEQ ID NO: 962299 - DNA, 22 bp, Artificial Sequence
  chemically synthesized
attgaaatttcttttactgctt

SEQ ID NO: 962300 - DNA, 22 bp, Artificial Sequence
  chemically synthesized
cattgaaatttcttttactgct

SEQ ID NO: 962301 - DNA, 22 bp, Artificial Sequence
  chemically synthesized
ttttcatttgaagcagtaaaag

SEQ ID NO: 962302 - DNA, 22 bp, Artificial Sequence
  chemically synthesized
tttcatttgaagcagtaaaaga

SEQ ID NO: 962303 - DNA, 22 bp, Artificial Sequence
  chemically synthesized
ttcatttgaagcagtaaaagaa

SEQ ID NO: 962304 - DNA, 22 bp, Artificial Sequence
  chemically synthesized
tcatttgaagcagtaaaagaaa

SEQ ID NO: 962305 - DNA, 22 bp, Artificial Sequence
  chemically synthesized
catttgaagcagtaaaagaaat

SEQ ID NO: 962306 - DNA, 22 bp, Artificial Sequence
  chemically synthesized
atttgaagcagtaaaagaaatt

SEQ ID NO: 962307 - DNA, 22 bp, Artificial Sequence
  chemically synthesized
aaatgcttcattgaaatttctt

SEQ ID NO: 962308 - DNA, 22 bp, Artificial Sequence
  chemically synthesized
aaaatgcttcattgaaatttct

SEQ ID NO: 962309 - DNA, 22 bp, Artificial Sequence
  chemically synthesized
gaagcagtaaaagaaatttcaa

SEQ ID NO: 962310 - DNA, 22 bp, Artificial Sequence
  chemically synthesized
aagcagtaaaagaaatttcaat

SEQ ID NO: 962311 - DNA, 22 bp, Artificial Sequence
  chemically synthesized
tcaccatacttaaaatgcttca

SEQ ID NO: 962312 - DNA, 22 bp, Artificial Sequence
  chemically synthesized
atctatcaccatacttaaaatg

SEQ ID NO: 962313 - DNA, 22 bp, Artificial Sequence
  chemically synthesized
caatgaagcattttaagtatgg

SEQ ID NO: 962314 - DNA, 22 bp, Artificial Sequence
  chemically synthesized
aatgaagcattttaagtatggt

SEQ ID NO: 962315 - DNA, 22 bp, Artificial Sequence
  chemically synthesized
tatgcagtcattaatctatcac

SEQ ID NO: 962316 - DNA, 22 bp, Artificial Sequence
  chemically synthesized
taagtatggtgatagattaatg

SEQ ID NO: 962317 - DNA, 22 bp, Artificial Sequence
  chemically synthesized
aagtatggtgatagattaatga

SEQ ID NO: 962318 - DNA, 22 bp, Artificial Sequence
  chemically synthesized
agtatggtgatagattaatgac

SEQ ID NO: 962319 - DNA, 22 bp, Artificial Sequence
  chemically synthesized
aatgagtgaaattgtatgcagt

SEQ ID NO: 962320 - DNA, 22 bp, Artificial Sequence
  chemically synthesized
atgactgcatacaatttcactc

SEQ ID NO: 962321 - DNA, 22 bp, Artificial Sequence
  chemically synthesized
gtgaaataaaattaaatgagtg

SEQ ID NO: 962322 - DNA, 22 bp, Artificial Sequence
  chemically synthesized
ggtgaaataaaattaaatgagt

SEQ ID NO: 962323 - DNA, 22 bp, Artificial Sequence
  chemically synthesized
catacaatttcactcatttaat

SEQ ID NO: 962324 - DNA, 22 bp, Artificial Sequence
  chemically synthesized
atttggtgaaataaaattaaat

SEQ ID NO: 962325 - DNA, 22 bp, Artificial Sequence
  chemically synthesized
cactcatttaattttatttcac

SEQ ID NO: 962326 - DNA, 22 bp, Artificial Sequence
  chemically synthesized
aagcctaatttggtgaaataaa

SEQ ID NO: 962327 - DNA, 22 bp, Artificial Sequence
  chemically synthesized
actcatttaattttatttcacc

SEQ ID NO: 962328 - DNA, 22 bp, Artificial Sequence
  chemically synthesized
gaagcctaatttggtgaaataa

SEQ ID NO: 962329 - DNA, 22 bp, Artificial Sequence
  chemically synthesized
atttaattttatttcaccaaat

SEQ ID NO: 962330 - DNA, 22 bp, Artificial Sequence
  chemically synthesized
aattttatttcaccaaattagg

SEQ ID NO: 962331 - DNA, 22 bp, Artificial Sequence
  chemically synthesized
gaggatttgaagcctaatttgg

SEQ ID NO: 962332 - DNA, 22 bp, Artificial Sequence
  chemically synthesized
attttatttcaccaaattaggc

SEQ ID NO: 962333 - DNA, 22 bp, Artificial Sequence
  chemically synthesized
tatttcaccaaattaggcttca

SEQ ID NO: 962334 - DNA, 22 bp, Artificial Sequence
  chemically synthesized
atttcaccaaattaggcttcaa

SEQ ID NO: 962335 - DNA, 22 bp, Artificial Sequence
  chemically synthesized
tttcaccaaattaggcttcaaa

SEQ ID NO: 962336 - DNA, 22 bp, Artificial Sequence
  chemically synthesized
caccaaattaggcttcaaatcc

SEQ ID NO: 962337 - DNA, 22 bp, Artificial Sequence
  chemically synthesized
accaaattaggcttcaaatcct

SEQ ID NO: 962338 - DNA, 22 bp, Artificial Sequence
  chemically synthesized
acagatggtctggaggatttga

SEQ ID NO: 962339 - DNA, 22 bp, Artificial Sequence
  chemically synthesized
ggcttcaaatcctccagaccat

SEQ ID NO: 962340 - DNA, 22 bp, Artificial Sequence
  chemically synthesized
caaatcctccagaccatctgtg

SEQ ID NO: 962341 - DNA, 22 bp, Artificial Sequence
  chemically synthesized
aaatcctccagaccatctgtga

SEQ ID NO: 962342 - DNA, 22 bp, Artificial Sequence
  chemically synthesized
acaagtcaaccagatattcaca

SEQ ID NO: 962343 - DNA, 22 bp, Artificial Sequence
  chemically synthesized
tgacaagtcaaccagatattca

SEQ ID NO: 962344 - DNA, 22 bp, Artificial Sequence
  chemically synthesized
cagaccatctgtgaatatctgg

SEQ ID NO: 962345 - DNA, 22 bp, Artificial Sequence
  chemically synthesized
tgaatatctggttgacttgtca

SEQ ID NO: 962346 - DNA, 22 bp, Artificial Sequence
  chemically synthesized
aggcaaaatgcactctgacaag

SEQ ID NO: 962347 - DNA, 22 bp, Artificial Sequence
  chemically synthesized
aactcaggcaaaatgcactctg

SEQ ID NO: 962348 - DNA, 22 bp, Artificial Sequence
  chemically synthesized
gttgacttgtcagagtgcattt

SEQ ID NO: 962349 - DNA, 22 bp, Artificial Sequence
  chemically synthesized
acttgtcagagtgcattttgcc

SEQ ID NO: 962350 - DNA, 22 bp, Artificial Sequence
  chemically synthesized
gtcagagtgcattttgcctgag

SEQ ID NO: 962351 - DNA, 22 bp, Artificial Sequence
  chemically synthesized
tcagagtgcattttgcctgagt

SEQ ID NO: 962352 - DNA, 22 bp, Artificial Sequence
  chemically synthesized
acagcgcccctgaactcaggca

SEQ ID NO: 962353 - DNA, 22 bp, Artificial Sequence
  chemically synthesized
tgcctgagttcaggggcgctgt

SEQ ID NO: 962354 - DNA, 22 bp, Artificial Sequence
  chemically synthesized
gcctgagttcaggggcgctgtg

SEQ ID NO: 962355 - DNA, 22 bp, Artificial Sequence
  chemically synthesized
gagtgagaaattcacagcgccc

SEQ ID NO: 962356 - DNA, 22 bp, Artificial Sequence
  chemically synthesized
cctgagttcaggggcgctgtga

SEQ ID NO: 962357 - DNA, 22 bp, Artificial Sequence
  chemically synthesized
agttcaggggcgctgtgaattt

SEQ ID NO: 962358 - DNA, 22 bp, Artificial Sequence
  chemically synthesized
aattggagtgagaaattcacag

SEQ ID NO: 962359 - DNA, 22 bp, Artificial Sequence
  chemically synthesized
aaattggagtgagaaattcaca

SEQ ID NO: 962360 - DNA, 22 bp, Artificial Sequence
  chemically synthesized
aggggcgctgtgaatttctcac

SEQ ID NO: 962361 - DNA, 22 bp, Artificial Sequence
  chemically synthesized
aatttaaattggagtgagaaat

SEQ ID NO: 962362 - DNA, 22 bp, Artificial Sequence
  chemically synthesized
tgaatttctcactccaatttaa

SEQ ID NO: 962363 - DNA, 22 bp, Artificial Sequence
  chemically synthesized
agaggtcctaaatttaaattgg

SEQ ID NO: 962364 - DNA, 22 bp, Artificial Sequence
  chemically synthesized
ctcactccaatttaaatttagg

SEQ ID NO: 962365 - DNA, 22 bp, Artificial Sequence
  chemically synthesized
tcactccaatttaaatttagga

SEQ ID NO: 962366 - DNA, 22 bp, Artificial Sequence
  chemically synthesized
actccaatttaaatttaggacc

SEQ ID NO: 962367 - DNA, 22 bp, Artificial Sequence
  chemically synthesized
caatttaaatttaggacctctg

SEQ ID NO: 962368 - DNA, 22 bp, Artificial Sequence
  chemically synthesized
aaatttaggacctctgaacact

SEQ ID NO: 962369 - DNA, 22 bp, Artificial Sequence
  chemically synthesized
aatttaggacctctgaacactg

SEQ ID NO: 962370 - DNA, 22 bp, Artificial Sequence
  chemically synthesized
aggacctctgaacactgttctt

SEQ ID NO: 962371 - DNA, 22 bp, Artificial Sequence
  chemically synthesized
ggacctctgaacactgttcttc

SEQ ID NO: 962372 - DNA, 22 bp, Artificial Sequence
  chemically synthesized
tgaacactgttcttctatattt

SEQ ID NO: 962373 - DNA, 22 bp, Artificial Sequence
  chemically synthesized
ccatcagatgtcaaatatagaa

SEQ ID NO: 962374 - DNA, 22 bp, Artificial Sequence
  chemically synthesized
cccatcagatgtcaaatataga

SEQ ID NO: 962375 - DNA, 22 bp, Artificial Sequence
  chemically synthesized
aacactgttcttctatatttga

SEQ ID NO: 962376 - DNA, 22 bp, Artificial Sequence
  chemically synthesized
ttcttctatatttgacatctga

SEQ ID NO: 962377 - DNA, 22 bp, Artificial Sequence
  chemically synthesized
tccaagtcttcccatcagatgt

SEQ ID NO: 962378 - DNA, 22 bp, Artificial Sequence
  chemically synthesized
ttctatatttgacatctgatgg

SEQ ID NO: 962379 - DNA, 22 bp, Artificial Sequence
  chemically synthesized
atccaagtcttcccatcagatg

SEQ ID NO: 962380 - DNA, 22 bp, Artificial Sequence
  chemically synthesized
ctatatttgacatctgatggga

SEQ ID NO: 962381 - DNA, 22 bp, Artificial Sequence
  chemically synthesized
tatatttgacatctgatgggaa

SEQ ID NO: 962382 - DNA, 22 bp, Artificial Sequence
  chemically synthesized
cttatccaagtcttcccatcag

SEQ ID NO: 962383 - DNA, 22 bp, Artificial Sequence
  chemically synthesized
gcttatccaagtcttcccatca

SEQ ID NO: 962384 - DNA, 22 bp, Artificial Sequence
  chemically synthesized
tatttgacatctgatgggaaga

SEQ ID NO: 962385 - DNA, 22 bp, Artificial Sequence
  chemically synthesized
tgcttatccaagtcttcccatc

SEQ ID NO: 962386 - DNA, 22 bp, Artificial Sequence
  chemically synthesized
ttgcttatccaagtcttcccat

SEQ ID NO: 962387 - DNA, 22 bp, Artificial Sequence
  chemically synthesized
gacatctgatgggaagacttgg

SEQ ID NO: 962388 - DNA, 22 bp, Artificial Sequence
  chemically synthesized
acatctgatgggaagacttgga

SEQ ID NO: 962389 - DNA, 22 bp, Artificial Sequence
  chemically synthesized
atgggaagacttggataagcaa

SEQ ID NO: 962390 - DNA, 22 bp, Artificial Sequence
  chemically synthesized
gaatgcaggtaatgaatgtgtt

SEQ ID NO: 962391 - DNA, 22 bp, Artificial Sequence
  chemically synthesized
ggataagcaaaaacacattcat

SEQ ID NO: 962392 - DNA, 22 bp, Artificial Sequence
  chemically synthesized
gataagcaaaaacacattcatt

SEQ ID NO: 962393 - DNA, 22 bp, Artificial Sequence
  chemically synthesized
tggaatgcaggtaatgaatgtg

SEQ ID NO: 962394 - DNA, 22 bp, Artificial Sequence
  chemically synthesized
ctggaatgcaggtaatgaatgt

SEQ ID NO: 962395 - DNA, 22 bp, Artificial Sequence
  chemically synthesized
atttctggaatgcaggtaatga

SEQ ID NO: 962396 - DNA, 22 bp, Artificial Sequence
  chemically synthesized
aatttctggaatgcaggtaatg

SEQ ID NO: 962397 - DNA, 22 bp, Artificial Sequence
  chemically synthesized
atggtttaatttctggaatgca

SEQ ID NO: 962398 - DNA, 22 bp, Artificial Sequence
  chemically synthesized
ctgatggtttaatttctggaat

SEQ ID NO: 962399 - DNA, 22 bp, Artificial Sequence
  chemically synthesized
attacctgcattccagaaatta

SEQ ID NO: 962400 - DNA, 22 bp, Artificial Sequence
  chemically synthesized
cctgcattccagaaattaaacc

SEQ ID NO: 962401 - DNA, 22 bp, Artificial Sequence
  chemically synthesized
cattccagaaattaaaccatca

SEQ ID NO: 962402 - DNA, 22 bp, Artificial Sequence
  chemically synthesized
cagaaattaaaccatcagcaac

SEQ ID NO: 962403 - DNA, 22 bp, Artificial Sequence
  chemically synthesized
gggtgaaaatgtagcaacacgt

SEQ ID NO: 962404 - DNA, 22 bp, Artificial Sequence
  chemically synthesized
aaccatcagcaacgtgttgcta

SEQ ID NO: 962405 - DNA, 22 bp, Artificial Sequence
  chemically synthesized
agggtgaaaatgtagcaacacg

SEQ ID NO: 962406 - DNA, 22 bp, Artificial Sequence
  chemically synthesized
tcaatttagggtgaaaatgtag

SEQ ID NO: 962407 - DNA, 22 bp, Artificial Sequence
  chemically synthesized
gtcaatttagggtgaaaatgta

SEQ ID NO: 962408 - DNA, 22 bp, Artificial Sequence
  chemically synthesized
cttgtcaatttagggtgaaaat

SEQ ID NO: 962409 - DNA, 22 bp, Artificial Sequence
  chemically synthesized
ctacattttcaccctaaattga

SEQ ID NO: 962410 - DNA, 22 bp, Artificial Sequence
  chemically synthesized
cattttcaccctaaattgacaa

SEQ ID NO: 962411 - DNA, 22 bp, Artificial Sequence
  chemically synthesized
tcaccctaaattgacaaggagg

SEQ ID NO: 962412 - DNA, 22 bp, Artificial Sequence
  chemically synthesized
caccctaaattgacaaggagga

SEQ ID NO: 962413 - DNA, 22 bp, Artificial Sequence
  chemically synthesized
accctaaattgacaaggaggac

SEQ ID NO: 962414 - DNA, 22 bp, Artificial Sequence
  chemically synthesized
catcgtggtataatgtcctcct

SEQ ID NO: 962415 - DNA, 22 bp, Artificial Sequence
  chemically synthesized
ccatcgtggtataatgtcctcc

SEQ ID NO: 962416 - DNA, 22 bp, Artificial Sequence
  chemically synthesized
tccatcgtggtataatgtcctc

SEQ ID NO: 962417 - DNA, 22 bp, Artificial Sequence
  chemically synthesized
ttccatcgtggtataatgtcct

SEQ ID NO: 962418 - DNA, 22 bp, Artificial Sequence
  chemically synthesized
aattgacaaggaggacattata

SEQ ID NO: 962419 - DNA, 22 bp, Artificial Sequence
  chemically synthesized
tttccatcgtggtataatgtcc

SEQ ID NO: 962420 - DNA, 22 bp, Artificial Sequence
  chemically synthesized
acaaggaggacattataccacg

SEQ ID NO: 962421 - DNA, 22 bp, Artificial Sequence
  chemically synthesized
atgtgttttttccatcgtggta

SEQ ID NO: 962422 - DNA, 22 bp, Artificial Sequence
  chemically synthesized
ctcatgtgttttttccatcgtg

SEQ ID NO: 962423 - DNA, 22 bp, Artificial Sequence
  chemically synthesized
gctcatgtgttttttccatcgt

SEQ ID NO: 962424 - DNA, 22 bp, Artificial Sequence
  chemically synthesized
tttgctcatgtgttttttccat

SEQ ID NO: 962425 - DNA, 22 bp, Artificial Sequence
  chemically synthesized
taccacgatggaaaaaacacat

SEQ ID NO: 962426 - DNA, 22 bp, Artificial Sequence
  chemically synthesized
gcctatttgctcatgtgttttt

SEQ ID NO: 962427 - DNA, 22 bp, Artificial Sequence
  chemically synthesized
attagcctatttgctcatgtgt

SEQ ID NO: 962428 - DNA, 22 bp, Artificial Sequence
  chemically synthesized
aaccaatagcacctaattagcc

SEQ ID NO: 962429 - DNA, 22 bp, Artificial Sequence
  chemically synthesized
acagataatctaaaccaatagc

SEQ ID NO: 962430 - DNA, 22 bp, Artificial Sequence
  chemically synthesized
ctgacagataatctaaaccaat

SEQ ID NO: 962431 - DNA, 22 bp, Artificial Sequence
  chemically synthesized
attaggtgctattggtttagat

SEQ ID NO: 962432 - DNA, 22 bp, Artificial Sequence
  chemically synthesized
ctgctgacagataatctaaacc

SEQ ID NO: 962433 - DNA, 22 bp, Artificial Sequence
  chemically synthesized
ggtgctattggtttagattatc

SEQ ID NO: 962434 - DNA, 22 bp, Artificial Sequence
  chemically synthesized
cagtcctgctgctgacagataa

SEQ ID NO: 962435 - DNA, 22 bp, Artificial Sequence
  chemically synthesized
ttggtttagattatctgtcagc

SEQ ID NO: 962436 - DNA, 22 bp, Artificial Sequence
  chemically synthesized
cctacagtcctgctgctgacag

SEQ ID NO: 962437 - DNA, 22 bp, Artificial Sequence
  chemically synthesized
gtttagattatctgtcagcagc

SEQ ID NO: 962438 - DNA, 22 bp, Artificial Sequence
  chemically synthesized
agattatctgtcagcagcagga

SEQ ID NO: 962439 - DNA, 22 bp, Artificial Sequence
  chemically synthesized
gattatctgtcagcagcaggac

SEQ ID NO: 962440 - DNA, 22 bp, Artificial Sequence
  chemically synthesized
tggctacctacagtcctgctgc

SEQ ID NO: 962441 - DNA, 22 bp, Artificial Sequence
  chemically synthesized
cctgtggctacctacagtcctg

SEQ ID NO: 962442 - DNA, 22 bp, Artificial Sequence
  chemically synthesized
tctgtcagcagcaggactgtag

SEQ ID NO: 962443 - DNA, 22 bp, Artificial Sequence
  chemically synthesized
tcagcagcaggactgtaggtag

SEQ ID NO: 962444 - DNA, 22 bp, Artificial Sequence
  chemically synthesized
tactccctgtggctacctacag

SEQ ID NO: 962445 - DNA, 22 bp, Artificial Sequence
  chemically synthesized
cctgtactccctgtggctacct

SEQ ID NO: 962446 - DNA, 22 bp, Artificial Sequence
  chemically synthesized
ccctgcctgtactccctgtggc

SEQ ID NO: 962447 - DNA, 22 bp, Artificial Sequence
  chemically synthesized
ctcccctgcctgtactccctgt

SEQ ID NO: 962448 - DNA, 22 bp, Artificial Sequence
  chemically synthesized
cctcccctgcctgtactccctg

SEQ ID NO: 962449 - DNA, 22 bp, Artificial Sequence
  chemically synthesized
tcctcccctgcctgtactccct

SEQ ID NO: 962450 - DNA, 22 bp, Artificial Sequence
  chemically synthesized
taggtagccacagggagtacag

SEQ ID NO: 962451 - DNA, 22 bp, Artificial Sequence
  chemically synthesized
ctttcctcccctgcctgtactc

SEQ ID NO: 962452 - DNA, 22 bp, Artificial Sequence
  chemically synthesized
gatcaagcctgctttcctcccc

SEQ ID NO: 962453 - DNA, 22 bp, Artificial Sequence
  chemically synthesized
aatctagatcaagcctgctttc

SEQ ID NO: 962454 - DNA, 22 bp, Artificial Sequence
  chemically synthesized
gaatctagatcaagcctgcttt

SEQ ID NO: 962455 - DNA, 22 bp, Artificial Sequence
  chemically synthesized
atgcttgaatctagatcaagcc

SEQ ID NO: 962456 - DNA, 22 bp, Artificial Sequence
  chemically synthesized
catgcttgaatctagatcaagc

SEQ ID NO: 962457 - DNA, 22 bp, Artificial Sequence
  chemically synthesized
gtttcatgcttgaatctagatc

SEQ ID NO: 962458 - DNA, 22 bp, Artificial Sequence
  chemically synthesized
gagtgctggtttcatgcttgaa

SEQ ID NO: 962459 - DNA, 22 bp, Artificial Sequence
  chemically synthesized
tagagtgctggtttcatgcttg

SEQ ID NO: 962460 - DNA, 22 bp, Artificial Sequence
  chemically synthesized
gatctagattcaagcatgaaac

SEQ ID NO: 962461 - DNA, 22 bp, Artificial Sequence
  chemically synthesized
atctagattcaagcatgaaacc

SEQ ID NO: 962462 - DNA, 22 bp, Artificial Sequence
  chemically synthesized
gattcaagcatgaaaccagcac

SEQ ID NO: 962463 - DNA, 22 bp, Artificial Sequence
  chemically synthesized
aagcatgaaaccagcactctag

SEQ ID NO: 962464 - DNA, 22 bp, Artificial Sequence
  chemically synthesized
cacccatcatgttctagagtgc

SEQ ID NO: 962465 - DNA, 22 bp, Artificial Sequence
  chemically synthesized
cagattacacccatcatgttct

SEQ ID NO: 962466 - DNA, 22 bp, Artificial Sequence
  chemically synthesized
ctccagattacacccatcatgt

SEQ ID NO: 962467 - DNA, 22 bp, Artificial Sequence
  chemically synthesized
tctgctccagattacacccatc

SEQ ID NO: 962468 - DNA, 22 bp, Artificial Sequence
  chemically synthesized
atctgctccagattacacccat

SEQ ID NO: 962469 - DNA, 22 bp, Artificial Sequence
  chemically synthesized
tagaacatgatgggtgtaatct

SEQ ID NO: 962470 - DNA, 22 bp, Artificial Sequence
  chemically synthesized
tttatctgctccagattacacc

SEQ ID NO: 962471 - DNA, 22 bp, Artificial Sequence
  chemically synthesized
gaacatgatgggtgtaatctgg

SEQ ID NO: 962472 - DNA, 22 bp, Artificial Sequence
  chemically synthesized
tgtttatctgctccagattaca

SEQ ID NO: 962473 - DNA, 22 bp, Artificial Sequence
  chemically synthesized
tcatgaaacaggttctgtttat

SEQ ID NO: 962474 - DNA, 22 bp, Artificial Sequence
  chemically synthesized
gagcagataaacagaacctgtt

SEQ ID NO: 962475 - DNA, 22 bp, Artificial Sequence
  chemically synthesized
aatcatcaaaaatgctatcatg

SEQ ID NO: 962476 - DNA, 22 bp, Artificial Sequence
  chemically synthesized
gcctgaatcatcaaaaatgcta

SEQ ID NO: 962477 - DNA, 22 bp, Artificial Sequence
  chemically synthesized
tttcatgatagcatttttgatg

SEQ ID NO: 962478 - DNA, 22 bp, Artificial Sequence
  chemically synthesized
catgatagcatttttgatgatt

SEQ ID NO: 962479 - DNA, 22 bp, Artificial Sequence
  chemically synthesized
atgatagcatttttgatgattc

SEQ ID NO: 962480 - DNA, 22 bp, Artificial Sequence
  chemically synthesized
gccatccgattggcctgaatca

SEQ ID NO: 962481 - DNA, 22 bp, Artificial Sequence
  chemically synthesized
ctagccatccgattggcctgaa

SEQ ID NO: 962482 - DNA, 22 bp, Artificial Sequence
  chemically synthesized
cctagccatccgattggcctga

SEQ ID NO: 962483 - DNA, 22 bp, Artificial Sequence
  chemically synthesized
cttcctagccatccgattggcc

SEQ ID NO: 962484 - DNA, 22 bp, Artificial Sequence
  chemically synthesized
ttgatgattcaggccaatcgga

SEQ ID NO: 962485 - DNA, 22 bp, Artificial Sequence
  chemically synthesized
tgatgattcaggccaatcggat

SEQ ID NO: 962486 - DNA, 22 bp, Artificial Sequence
  chemically synthesized
gatgattcaggccaatcggatg

SEQ ID NO: 962487 - DNA, 22 bp, Artificial Sequence
  chemically synthesized
atgattcaggccaatcggatgg

SEQ ID NO: 962488 - DNA, 22 bp, Artificial Sequence
  chemically synthesized
aggccaatcggatggctaggaa

SEQ ID NO: 962489 - DNA, 22 bp, Artificial Sequence
  chemically synthesized
agcggggtggggagagcgcctg

SEQ ID NO: 962490 - DNA, 22 bp, Artificial Sequence
  chemically synthesized
gagcggggtggggagagcgcct

SEQ ID NO: 962491 - DNA, 22 bp, Artificial Sequence
  chemically synthesized
ggaagcaggcgctctccccacc

SEQ ID NO: 962492 - DNA, 22 bp, Artificial Sequence
  chemically synthesized
agcagtttgagcggggtgggga

SEQ ID NO: 962493 - DNA, 22 bp, Artificial Sequence
  chemically synthesized
ctcagcagtttgagcggggtgg

SEQ ID NO: 962494 - DNA, 22 bp, Artificial Sequence
  chemically synthesized
cctcagcagtttgagcggggtg

SEQ ID NO: 962495 - DNA, 22 bp, Artificial Sequence
  chemically synthesized
accttcctcagcagtttgagcg

SEQ ID NO: 962496 - DNA, 22 bp, Artificial Sequence
  chemically synthesized
tccccaccccgctcaaactgct

SEQ ID NO: 962497 - DNA, 22 bp, Artificial Sequence
  chemically synthesized
cccaccccgctcaaactgctga

SEQ ID NO: 962498 - DNA, 22 bp, Artificial Sequence
  chemically synthesized
catggttcaccttcctcagcag

SEQ ID NO: 962499 - DNA, 22 bp, Artificial Sequence
  chemically synthesized
atgaactgcatggttcaccttc

SEQ ID NO: 962500 - DNA, 22 bp, Artificial Sequence
  chemically synthesized
aaactgctgaggaaggtgaacc

SEQ ID NO: 962501 - DNA, 22 bp, Artificial Sequence
  chemically synthesized
tgatgaactgcatggttcacct

SEQ ID NO: 962502 - DNA, 22 bp, Artificial Sequence
  chemically synthesized
ctgaggaaggtgaaccatgcag

SEQ ID NO: 962503 - DNA, 22 bp, Artificial Sequence
  chemically synthesized
aggaaggtgaaccatgcagttc

SEQ ID NO: 962504 - DNA, 22 bp, Artificial Sequence
  chemically synthesized
tagccctctgatgaactgcatg

SEQ ID NO: 962505 - DNA, 22 bp, Artificial Sequence
  chemically synthesized
gtagccctctgatgaactgcat

SEQ ID NO: 962506 - DNA, 22 bp, Artificial Sequence
  chemically synthesized
tgtagccctctgatgaactgca

SEQ ID NO: 962507 - DNA, 22 bp, Artificial Sequence
  chemically synthesized
tttgtagccctctgatgaactg

SEQ ID NO: 962508 - DNA, 22 bp, Artificial Sequence
  chemically synthesized
atacctctttgtagccctctga

SEQ ID NO: 962509 - DNA, 22 bp, Artificial Sequence
  chemically synthesized
aagtgttgatacctctttgtag

SEQ ID NO: 962510 - DNA, 22 bp, Artificial Sequence
  chemically synthesized
atcagagggctacaaagaggta

SEQ ID NO: 962511 - DNA, 22 bp, Artificial Sequence
  chemically synthesized
caaagaggtatcaacacttcag

SEQ ID NO: 962512 - DNA, 22 bp, Artificial Sequence
  chemically synthesized
tgagccccagatgcccatatgg

SEQ ID NO: 962513 - DNA, 22 bp, Artificial Sequence
  chemically synthesized
gtgagccccagatgcccatatg

SEQ ID NO: 962514 - DNA, 22 bp, Artificial Sequence
  chemically synthesized
tgtgagccccagatgcccatat

SEQ ID NO: 962515 - DNA, 22 bp, Artificial Sequence
  chemically synthesized
cagttttccatatgggcatctg

SEQ ID NO: 962516 - DNA, 22 bp, Artificial Sequence
  chemically synthesized
agttttccatatgggcatctgg

SEQ ID NO: 962517 - DNA, 22 bp, Artificial Sequence
  chemically synthesized
gttttgtgagccccagatgccc

SEQ ID NO: 962518 - DNA, 22 bp, Artificial Sequence
  chemically synthesized
ggttttgtgagccccagatgcc

SEQ ID NO: 962519 - DNA, 22 bp, Artificial Sequence
  chemically synthesized
tttggttttgtgagccccagat

SEQ ID NO: 962520 - DNA, 22 bp, Artificial Sequence
  chemically synthesized
tccatatgggcatctggggctc

SEQ ID NO: 962521 - DNA, 22 bp, Artificial Sequence
  chemically synthesized
ccatatgggcatctggggctca

SEQ ID NO: 962522 - DNA, 22 bp, Artificial Sequence
  chemically synthesized
catatgggcatctggggctcac

SEQ ID NO: 962523 - DNA, 22 bp, Artificial Sequence
  chemically synthesized
ataccaaaaatctgtttggttt

SEQ ID NO: 962524 - DNA, 22 bp, Artificial Sequence
  chemically synthesized
gataccaaaaatctgtttggtt

SEQ ID NO: 962525 - DNA, 22 bp, Artificial Sequence
  chemically synthesized
tgataccaaaaatctgtttggt

SEQ ID NO: 962526 - DNA, 22 bp, Artificial Sequence
  chemically synthesized
gggctcacaaaaccaaacagat

SEQ ID NO: 962527 - DNA, 22 bp, Artificial Sequence
  chemically synthesized
ttgataccaaaaatctgtttgg

SEQ ID NO: 962528 - DNA, 22 bp, Artificial Sequence
  chemically synthesized
tttttgataccaaaaatctgtt

SEQ ID NO: 962529 - DNA, 22 bp, Artificial Sequence
  chemically synthesized
acaaaaccaaacagatttttgg

SEQ ID NO: 962530 - DNA, 22 bp, Artificial Sequence
  chemically synthesized
caatactatttttgataccaaa

SEQ ID NO: 962531 - DNA, 22 bp, Artificial Sequence
  chemically synthesized
cacagaggctgcaatactattt

SEQ ID NO: 962532 - DNA, 22 bp, Artificial Sequence
  chemically synthesized
ccacagaggctgcaatactatt

SEQ ID NO: 962533 - DNA, 22 bp, Artificial Sequence
  chemically synthesized
ttggtatcaaaaatagtattgc

SEQ ID NO: 962534 - DNA, 22 bp, Artificial Sequence
  chemically synthesized
tggtatcaaaaatagtattgca

SEQ ID NO: 962535 - DNA, 22 bp, Artificial Sequence
  chemically synthesized
ggtatcaaaaatagtattgcag

SEQ ID NO: 962536 - DNA, 22 bp, Artificial Sequence
  chemically synthesized
gtatcaaaaatagtattgcagc

SEQ ID NO: 962537 - DNA, 22 bp, Artificial Sequence
  chemically synthesized
cagcctctgtggaaaccaccca

SEQ ID NO: 962538 - DNA, 22 bp, Artificial Sequence
  chemically synthesized
catagatgagaaaccccatggg

SEQ ID NO: 962539 - DNA, 22 bp, Artificial Sequence
  chemically synthesized
tgtggaaaccacccatggggtt

SEQ ID NO: 962540 - DNA, 22 bp, Artificial Sequence
  chemically synthesized
tggaaaccacccatggggtttc

SEQ ID NO: 962541 - DNA, 22 bp, Artificial Sequence
  chemically synthesized
tgtcagtgttacatagatgaga

SEQ ID NO: 962542 - DNA, 22 bp, Artificial Sequence
  chemically synthesized
ctatgtcagtgttacatagatg

SEQ ID NO: 962543 - DNA, 22 bp, Artificial Sequence
  chemically synthesized
tactatgtcagtgttacataga

SEQ ID NO: 962544 - DNA, 22 bp, Artificial Sequence
  chemically synthesized
ctactatgtcagtgttacatag

SEQ ID NO: 962545 - DNA, 22 bp, Artificial Sequence
  chemically synthesized
agtttctactatgtcagtgtta

SEQ ID NO: 962546 - DNA, 22 bp, Artificial Sequence
  chemically synthesized
ctcatctatgtaacactgacat

SEQ ID NO: 962547 - DNA, 22 bp, Artificial Sequence
  chemically synthesized
tcatctatgtaacactgacata

SEQ ID NO: 962548 - DNA, 22 bp, Artificial Sequence
  chemically synthesized
atctatgtaacactgacatagt

SEQ ID NO: 962549 - DNA, 22 bp, Artificial Sequence
  chemically synthesized
ggcagcctgagtttctactatg

SEQ ID NO: 962550 - DNA, 22 bp, Artificial Sequence
  chemically synthesized
tgtaacactgacatagtagaaa

SEQ ID NO: 962551 - DNA, 22 bp, Artificial Sequence
  chemically synthesized
taggcagcctgagtttctacta

SEQ ID NO: 962552 - DNA, 22 bp, Artificial Sequence
  chemically synthesized
acatagtagaaactcaggctgc

SEQ ID NO: 962553 - DNA, 22 bp, Artificial Sequence
  chemically synthesized
aatgtgctctaggcagcctgag

SEQ ID NO: 962554 - DNA, 22 bp, Artificial Sequence
  chemically synthesized
tgaatgtgctctaggcagcctg

SEQ ID NO: 962555 - DNA, 22 bp, Artificial Sequence
  chemically synthesized
tctgaatgtgctctaggcagcc

SEQ ID NO: 962556 - DNA, 22 bp, Artificial Sequence
  chemically synthesized
ttctctgaatgtgctctaggca

SEQ ID NO: 962557 - DNA, 22 bp, Artificial Sequence
  chemically synthesized
gttctctgaatgtgctctaggc

SEQ ID NO: 962558 - DNA, 22 bp, Artificial Sequence
  chemically synthesized
acttgttctctgaatgtgctct

SEQ ID NO: 962559 - DNA, 22 bp, Artificial Sequence
  chemically synthesized
aggctgcctagagcacattcag

SEQ ID NO: 962560 - DNA, 22 bp, Artificial Sequence
  chemically synthesized
attcacttgttctctgaatgtg

SEQ ID NO: 962561 - DNA, 22 bp, Artificial Sequence
  chemically synthesized
cctagagcacattcagagaaca

SEQ ID NO: 962562 - DNA, 22 bp, Artificial Sequence
  chemically synthesized
cactcattcacttgttctctga

SEQ ID NO: 962563 - DNA, 22 bp, Artificial Sequence
  chemically synthesized
gagcacattcagagaacaagtg

SEQ ID NO: 962564 - DNA, 22 bp, Artificial Sequence
  chemically synthesized
tagactgcactcattcacttgt

SEQ ID NO: 962565 - DNA, 22 bp, Artificial Sequence
  chemically synthesized
gtagactgcactcattcacttg

SEQ ID NO: 962566 - DNA, 22 bp, Artificial Sequence
  chemically synthesized
tgtagactgcactcattcactt

SEQ ID NO: 962567 - DNA, 22 bp, Artificial Sequence
  chemically synthesized
ctttgtagactgcactcattca

SEQ ID NO: 962568 - DNA, 22 bp, Artificial Sequence
  chemically synthesized
actttgtagactgcactcattc

SEQ ID NO: 962569 - DNA, 22 bp, Artificial Sequence
  chemically synthesized
agagaacaagtgaatgagtgca

SEQ ID NO: 962570 - DNA, 22 bp, Artificial Sequence
  chemically synthesized
caaagtaagtctctgtcactta

SEQ ID NO: 962571 - DNA, 22 bp, Artificial Sequence
  chemically synthesized
aggaagcatgatgtaagtgaca

SEQ ID NO: 962572 - DNA, 22 bp, Artificial Sequence
  chemically synthesized
tcaggaagcatgatgtaagtga

SEQ ID NO: 962573 - DNA, 22 bp, Artificial Sequence
  chemically synthesized
tgtcacttacatcatgcttcct

SEQ ID NO: 962574 - DNA, 22 bp, Artificial Sequence
  chemically synthesized
tcacttacatcatgcttcctga

SEQ ID NO: 962575 - DNA, 22 bp, Artificial Sequence
  chemically synthesized
caagtgatattctcaggaagca

SEQ ID NO: 962576 - DNA, 22 bp, Artificial Sequence
  chemically synthesized
acatcatgcttcctgagaatat

SEQ ID NO: 962577 - DNA, 22 bp, Artificial Sequence
  chemically synthesized
catcatgcttcctgagaatatc

SEQ ID NO: 962578 - DNA, 22 bp, Artificial Sequence
  chemically synthesized
acaattgcaagtgatattctca

SEQ ID NO: 962579 - DNA, 22 bp, Artificial Sequence
  chemically synthesized
cctgagaatatcacttgcaatt

SEQ ID NO: 962580 - DNA, 22 bp, Artificial Sequence
  chemically synthesized
ctgagaatatcacttgcaattg

SEQ ID NO: 962581 - DNA, 22 bp, Artificial Sequence
  chemically synthesized
agaatatcacttgcaattgtga

SEQ ID NO: 962582 - DNA, 22 bp, Artificial Sequence
  chemically synthesized
tagcagcataattcacaattgc

SEQ ID NO: 962583 - DNA, 22 bp, Artificial Sequence
  chemically synthesized
atagcagcataattcacaattg

SEQ ID NO: 962584 - DNA, 22 bp, Artificial Sequence
  chemically synthesized
gcaattgtgaattatgctgcta

SEQ ID NO: 962585 - DNA, 22 bp, Artificial Sequence
  chemically synthesized
caattgtgaattatgctgctat

SEQ ID NO: 962586 - DNA, 22 bp, Artificial Sequence
  chemically synthesized
cacacacatgtttatagcagca

SEQ ID NO: 962587 - DNA, 22 bp, Artificial Sequence
  chemically synthesized
gcacacacatgtttatagcagc

SEQ ID NO: 962588 - DNA, 22 bp, Artificial Sequence
  chemically synthesized
tgaattatgctgctataaacat

SEQ ID NO: 962589 - DNA, 22 bp, Artificial Sequence
  chemically synthesized
atacttgcacacacatgtttat

SEQ ID NO: 962590 - DNA, 22 bp, Artificial Sequence
  chemically synthesized
tgctgctataaacatgtgtgtg

SEQ ID NO: 962591 - DNA, 22 bp, Artificial Sequence
  chemically synthesized
ggttgatacttgcacacacatg

SEQ ID NO: 962592 - DNA, 22 bp, Artificial Sequence
  chemically synthesized
gggttgatacttgcacacacat

SEQ ID NO: 962593 - DNA, 22 bp, Artificial Sequence
  chemically synthesized
ctataaacatgtgtgtgcaagt

SEQ ID NO: 962594 - DNA, 22 bp, Artificial Sequence
  chemically synthesized
taaacatgtgtgtgcaagtatc

SEQ ID NO: 962595 - DNA, 22 bp, Artificial Sequence
  chemically synthesized
atgggcatttgggttgatactt

SEQ ID NO: 962596 - DNA, 22 bp, Artificial Sequence
  chemically synthesized
tcgattgatgggcatttgggtt

SEQ ID NO: 962597 - DNA, 22 bp, Artificial Sequence
  chemically synthesized
gtcgattgatgggcatttgggt

SEQ ID NO: 962598 - DNA, 22 bp, Artificial Sequence
  chemically synthesized
cttgtcgattgatgggcatttg

SEQ ID NO: 962599 - DNA, 22 bp, Artificial Sequence
  chemically synthesized
tctacttgtcgattgatgggca

SEQ ID NO: 962600 - DNA, 22 bp, Artificial Sequence
  chemically synthesized
atctacttgtcgattgatgggc

SEQ ID NO: 962601 - DNA, 22 bp, Artificial Sequence
  chemically synthesized
tatctacttgtcgattgatggg

SEQ ID NO: 962602 - DNA, 22 bp, Artificial Sequence
  chemically synthesized
tttatctacttgtcgattgatg

SEQ ID NO: 962603 - DNA, 22 bp, Artificial Sequence
  chemically synthesized
ctttatctacttgtcgattgat

SEQ ID NO: 962604 - DNA, 22 bp, Artificial Sequence
  chemically synthesized
cggtatatatacatatgtatgt

SEQ ID NO: 962605 - DNA, 22 bp, Artificial Sequence
  chemically synthesized
atatatatatatatagacacac

SEQ ID NO: 962606 - DNA, 22 bp, Artificial Sequence
  chemically synthesized
agtagtattcatatatatatat

SEQ ID NO: 962607 - DNA, 22 bp, Artificial Sequence
  chemically synthesized
tggctgagtagtattcatatat

SEQ ID NO: 962608 - DNA, 22 bp, Artificial Sequence
  chemically synthesized
atggctgagtagtattcatata

SEQ ID NO: 962609 - DNA, 22 bp, Artificial Sequence
  chemically synthesized
tatggctgagtagtattcatat

SEQ ID NO: 962610 - DNA, 22 bp, Artificial Sequence
  chemically synthesized
ttatggctgagtagtattcata

SEQ ID NO: 962611 - DNA, 22 bp, Artificial Sequence
  chemically synthesized
tttatggctgagtagtattcat

SEQ ID NO: 962612 - DNA, 22 bp, Artificial Sequence
  chemically synthesized
tatatatatatatgaatactac

SEQ ID NO: 962613 - DNA, 22 bp, Artificial Sequence
  chemically synthesized
ctttttatggctgagtagtatt

SEQ ID NO: 962614 - DNA, 22 bp, Artificial Sequence
  chemically synthesized
attcctttttatggctgagtag

SEQ ID NO: 962615 - DNA, 22 bp, Artificial Sequence
  chemically synthesized
attcattcctttttatggctga

SEQ ID NO: 962616 - DNA, 22 bp, Artificial Sequence
  chemically synthesized
ttaattcattcctttttatggc

SEQ ID NO: 962617 - DNA, 22 bp, Artificial Sequence
  chemically synthesized
ctcagccataaaaaggaatgaa

SEQ ID NO: 962618 - DNA, 22 bp, Artificial Sequence
  chemically synthesized
caaatgctgttaattcattcct

SEQ ID NO: 962619 - DNA, 22 bp, Artificial Sequence
  chemically synthesized
agccataaaaaggaatgaatta

SEQ ID NO: 962620 - DNA, 22 bp, Artificial Sequence
  chemically synthesized
caatcgcatccaggtcattgca

SEQ ID NO: 962621 - DNA, 22 bp, Artificial Sequence
  chemically synthesized
acagcatttgcaatgacctgga

SEQ ID NO: 962622 - DNA, 22 bp, Artificial Sequence
  chemically synthesized
gcaatgacctggatgcgattgg

SEQ ID NO: 962623 - DNA, 22 bp, Artificial Sequence
  chemically synthesized
caatgatagtctccaatcgcat

SEQ ID NO: 962624 - DNA, 22 bp, Artificial Sequence
  chemically synthesized
caatgacctggatgcgattgga

SEQ ID NO: 962625 - DNA, 22 bp, Artificial Sequence
  chemically synthesized
acaatgatagtctccaatcgca

SEQ ID NO: 962626 - DNA, 22 bp, Artificial Sequence
  chemically synthesized
acttacaatgatagtctccaat

SEQ ID NO: 962627 - DNA, 22 bp, Artificial Sequence
  chemically synthesized
cacttacaatgatagtctccaa

SEQ ID NO: 962628 - DNA, 22 bp, Artificial Sequence
  chemically synthesized
cttcacttacaatgatagtctc

SEQ ID NO: 962629 - DNA, 22 bp, Artificial Sequence
  chemically synthesized
gatgcgattggagactatcatt

SEQ ID NO: 962630 - DNA, 22 bp, Artificial Sequence
  chemically synthesized
agttacttcacttacaatgata

SEQ ID NO: 962631 - DNA, 22 bp, Artificial Sequence
  chemically synthesized
ctgagttacttcacttacaatg

SEQ ID NO: 962632 - DNA, 22 bp, Artificial Sequence
  chemically synthesized
gagactatcattgtaagtgaag

SEQ ID NO: 962633 - DNA, 22 bp, Artificial Sequence
  chemically synthesized
cattcctgagttacttcactta

SEQ ID NO: 962634 - DNA, 22 bp, Artificial Sequence
  chemically synthesized
ccattcctgagttacttcactt

SEQ ID NO: 962635 - DNA, 22 bp, Artificial Sequence
  chemically synthesized
tccattcctgagttacttcact

SEQ ID NO: 962636 - DNA, 22 bp, Artificial Sequence
  chemically synthesized
tcattgtaagtgaagtaactca

SEQ ID NO: 962637 - DNA, 22 bp, Artificial Sequence
  chemically synthesized
gttttccattcctgagttactt

SEQ ID NO: 962638 - DNA, 22 bp, Artificial Sequence
  chemically synthesized
ggttttccattcctgagttact

SEQ ID NO: 962639 - DNA, 22 bp, Artificial Sequence
  chemically synthesized
tttggttttccattcctgagtt

SEQ ID NO: 962640 - DNA, 22 bp, Artificial Sequence
  chemically synthesized
taagtgaagtaactcaggaatg

SEQ ID NO: 962641 - DNA, 22 bp, Artificial Sequence
  chemically synthesized
aggaatggaaaaccaaacagca

SEQ ID NO: 962642 - DNA, 22 bp, Artificial Sequence
  chemically synthesized
ccacgtatcagtgagaacatat

SEQ ID NO: 962643 - DNA, 22 bp, Artificial Sequence
  chemically synthesized
gctcccacgtatcagtgagaac

SEQ ID NO: 962644 - DNA, 22 bp, Artificial Sequence
  chemically synthesized
agctcccacgtatcagtgagaa

SEQ ID NO: 962645 - DNA, 22 bp, Artificial Sequence
  chemically synthesized
atagcttagctcccacgtatca

SEQ ID NO: 962646 - DNA, 22 bp, Artificial Sequence
  chemically synthesized
catcctcatagcttagctccca

SEQ ID NO: 962647 - DNA, 22 bp, Artificial Sequence
  chemically synthesized
tcactgatacgtgggagctaag

SEQ ID NO: 962648 - DNA, 22 bp, Artificial Sequence
  chemically synthesized
gcatcctcatagcttagctccc

SEQ ID NO: 962649 - DNA, 22 bp, Artificial Sequence
  chemically synthesized
tgcatcctcatagcttagctcc

SEQ ID NO: 962650 - DNA, 22 bp, Artificial Sequence
  chemically synthesized
actgatacgtgggagctaagct

SEQ ID NO: 962651 - DNA, 22 bp, Artificial Sequence
  chemically synthesized
atacgtgggagctaagctatga

SEQ ID NO: 962652 - DNA, 22 bp, Artificial Sequence
  chemically synthesized
tgcctttgcatcctcatagctt

SEQ ID NO: 962653 - DNA, 22 bp, Artificial Sequence
  chemically synthesized
atgcctttgcatcctcatagct

SEQ ID NO: 962654 - DNA, 22 bp, Artificial Sequence
  chemically synthesized
ttatgcctttgcatcctcatag

SEQ ID NO: 962655 - DNA, 22 bp, Artificial Sequence
  chemically synthesized
tatcattcttatgcctttgcat

SEQ ID NO: 962656 - DNA, 22 bp, Artificial Sequence
  chemically synthesized
agctatgaggatgcaaaggcat

SEQ ID NO: 962657 - DNA, 22 bp, Artificial Sequence
  chemically synthesized
tgaggatgcaaaggcataagaa

SEQ ID NO: 962658 - DNA, 22 bp, Artificial Sequence
  chemically synthesized
caaagcccattgtatcattctt

SEQ ID NO: 962659 - DNA, 22 bp, Artificial Sequence
  chemically synthesized
ccccccaagtctccaaagccca

SEQ ID NO: 962660 - DNA, 22 bp, Artificial Sequence
  chemically synthesized
taccccccaagtctccaaagcc

SEQ ID NO: 962661 - DNA, 22 bp, Artificial Sequence
  chemically synthesized
ctaccccccaagtctccaaagc

SEQ ID NO: 962662 - DNA, 22 bp, Artificial Sequence
  chemically synthesized
tctaccccccaagtctccaaag

SEQ ID NO: 962663 - DNA, 22 bp, Artificial Sequence
  chemically synthesized
ttctaccccccaagtctccaaa

SEQ ID NO: 962664 - DNA, 22 bp, Artificial Sequence
  chemically synthesized
ggcaccccttttctacccccca

SEQ ID NO: 962665 - DNA, 22 bp, Artificial Sequence
  chemically synthesized
tggagacttggggggtagaaaa

SEQ ID NO: 962666 - DNA, 22 bp, Artificial Sequence
  chemically synthesized
ggagacttggggggtagaaaag

SEQ ID NO: 962667 - DNA, 22 bp, Artificial Sequence
  chemically synthesized
gagacttggggggtagaaaagg

SEQ ID NO: 962668 - DNA, 22 bp, Artificial Sequence
  chemically synthesized
tccctcggcaccccttttctac

SEQ ID NO: 962669 - DNA, 22 bp, Artificial Sequence
  chemically synthesized
gtccctcggcaccccttttcta

SEQ ID NO: 962670 - DNA, 22 bp, Artificial Sequence
  chemically synthesized
tgtccctcggcaccccttttct

SEQ ID NO: 962671 - DNA, 22 bp, Artificial Sequence
  chemically synthesized
ttgtccctcggcaccccttttc

SEQ ID NO: 962672 - DNA, 22 bp, Artificial Sequence
  chemically synthesized
ggggggtagaaaaggggtgccg

SEQ ID NO: 962673 - DNA, 22 bp, Artificial Sequence
  chemically synthesized
tcttttgtccctcggcacccct

SEQ ID NO: 962674 - DNA, 22 bp, Artificial Sequence
  chemically synthesized
gggggtagaaaaggggtgccga

SEQ ID NO: 962675 - DNA, 22 bp, Artificial Sequence
  chemically synthesized
caccatatatgttatcttttgt

SEQ ID NO: 962676 - DNA, 22 bp, Artificial Sequence
  chemically synthesized
gtgcacccatcacacgagtagt

SEQ ID NO: 962677 - DNA, 22 bp, Artificial Sequence
  chemically synthesized
tgagatcctggtgcacccatca

SEQ ID NO: 962678 - DNA, 22 bp, Artificial Sequence
  chemically synthesized
gtgagatcctggtgcacccatc

SEQ ID NO: 962679 - DNA, 22 bp, Artificial Sequence
  chemically synthesized
ctcgtgtgatgggtgcaccagg

SEQ ID NO: 962680 - DNA, 22 bp, Artificial Sequence
  chemically synthesized
gtgtgatgggtgcaccaggatc

SEQ ID NO: 962681 - DNA, 22 bp, Artificial Sequence
  chemically synthesized
gtggtaatttgtgagatcctgg

SEQ ID NO: 962682 - DNA, 22 bp, Artificial Sequence
  chemically synthesized
agtggtaatttgtgagatcctg

SEQ ID NO: 962683 - DNA, 22 bp, Artificial Sequence
  chemically synthesized
tagtggtaatttgtgagatcct

SEQ ID NO: 962684 - DNA, 22 bp, Artificial Sequence
  chemically synthesized
tttagtggtaatttgtgagatc

SEQ ID NO: 962685 - DNA, 22 bp, Artificial Sequence
  chemically synthesized
caatgagtaagttctttagtgg

SEQ ID NO: 962686 - DNA, 22 bp, Artificial Sequence
  chemically synthesized
ttgcaatgagtaagttctttag

SEQ ID NO: 962687 - DNA, 22 bp, Artificial Sequence
  chemically synthesized
acaaattaccactaaagaactt

SEQ ID NO: 962688 - DNA, 22 bp, Artificial Sequence
  chemically synthesized
ccactaaagaacttactcattg

SEQ ID NO: 962689 - DNA, 22 bp, Artificial Sequence
  chemically synthesized
agcaaactattgcaatgagtaa

SEQ ID NO: 962690 - DNA, 22 bp, Artificial Sequence
  chemically synthesized
tcagcaaactattgcaatgagt

SEQ ID NO: 962691 - DNA, 22 bp, Artificial Sequence
  chemically synthesized
aagaacttactcattgcaatag

SEQ ID NO: 962692 - DNA, 22 bp, Artificial Sequence
  chemically synthesized
actcattgcaatagtttgctga

SEQ ID NO: 962693 - DNA, 22 bp, Artificial Sequence
  chemically synthesized
ctcattgcaatagtttgctgag

SEQ ID NO: 962694 - DNA, 22 bp, Artificial Sequence
  chemically synthesized
gaaaccatcattctcagcaaac

SEQ ID NO: 962695 - DNA, 22 bp, Artificial Sequence
  chemically synthesized
attgcaatagtttgctgagaat

SEQ ID NO: 962696 - DNA, 22 bp, Artificial Sequence
  chemically synthesized
caatagtttgctgagaatgatg

SEQ ID NO: 962697 - DNA, 22 bp, Artificial Sequence
  chemically synthesized
gctgagaatgatggtttccagc

SEQ ID NO: 962698 - DNA, 22 bp, Artificial Sequence
  chemically synthesized
ctgagaatgatggtttccagct

SEQ ID NO: 962699 - DNA, 22 bp, Artificial Sequence
  chemically synthesized
agaatgatggtttccagcttca

SEQ ID NO: 962700 - DNA, 22 bp, Artificial Sequence
  chemically synthesized
tagggacatggatgaagctgga

SEQ ID NO: 962701 - DNA, 22 bp, Artificial Sequence
  chemically synthesized
gtagggacatggatgaagctgg

SEQ ID NO: 962702 - DNA, 22 bp, Artificial Sequence
  chemically synthesized
tgtagggacatggatgaagctg

SEQ ID NO: 962703 - DNA, 22 bp, Artificial Sequence
  chemically synthesized
acgtcctttgtagggacatgga

SEQ ID NO: 962704 - DNA, 22 bp, Artificial Sequence
  chemically synthesized
ccagcttcatccatgtccctac

SEQ ID NO: 962705 - DNA, 22 bp, Artificial Sequence
  chemically synthesized
cagcttcatccatgtccctaca

SEQ ID NO: 962706 - DNA, 22 bp, Artificial Sequence
  chemically synthesized
catccatgtccctacaaaggac

SEQ ID NO: 962707 - DNA, 22 bp, Artificial Sequence
  chemically synthesized
atccatgtccctacaaaggacg

SEQ ID NO: 962708 - DNA, 22 bp, Artificial Sequence
  chemically synthesized
caaaggacgtgaactcatcctt

SEQ ID NO: 962709 - DNA, 22 bp, Artificial Sequence
  chemically synthesized
tgcagccataaaaaaggatgag

SEQ ID NO: 962710 - DNA, 22 bp, Artificial Sequence
  chemically synthesized
atccttttttatggctgcacag

SEQ ID NO: 962711 - DNA, 22 bp, Artificial Sequence
  chemically synthesized
ttttatggctgcacagtattcc

SEQ ID NO: 962712 - DNA, 22 bp, Artificial Sequence
  chemically synthesized
tttatggctgcacagtattcca

SEQ ID NO: 962713 - DNA, 22 bp, Artificial Sequence
  chemically synthesized
ttatggctgcacagtattccat

SEQ ID NO: 962714 - DNA, 22 bp, Artificial Sequence
  chemically synthesized
tatggctgcacagtattccatg

SEQ ID NO: 962715 - DNA, 22 bp, Artificial Sequence
  chemically synthesized
atggctgcacagtattccatgg

SEQ ID NO: 962716 - DNA, 22 bp, Artificial Sequence
  chemically synthesized
tggctgcacagtattccatggt

SEQ ID NO: 962717 - DNA, 22 bp, Artificial Sequence
  chemically synthesized
cacagtattccatggtgtatat

SEQ ID NO: 962718 - DNA, 22 bp, Artificial Sequence
  chemically synthesized
agaaaatgtggcacatatacac

SEQ ID NO: 962719 - DNA, 22 bp, Artificial Sequence
  chemically synthesized
gattaagaaaatgtggcacata

SEQ ID NO: 962720 - DNA, 22 bp, Artificial Sequence
  chemically synthesized
catggtgtatatgtgccacatt

SEQ ID NO: 962721 - DNA, 22 bp, Artificial Sequence
  chemically synthesized
tcttaatccagtctatcattgt

SEQ ID NO: 962722 - DNA, 22 bp, Artificial Sequence
  chemically synthesized
cttaatccagtctatcattgtc

SEQ ID NO: 962723 - DNA, 22 bp, Artificial Sequence
  chemically synthesized
ttaatccagtctatcattgtcg

SEQ ID NO: 962724 - DNA, 22 bp, Artificial Sequence
  chemically synthesized
aatccagtctatcattgtcgga

SEQ ID NO: 962725 - DNA, 22 bp, Artificial Sequence
  chemically synthesized
atccagtctatcattgtcggac

SEQ ID NO: 962726 - DNA, 22 bp, Artificial Sequence
  chemically synthesized
gaaccaacccaaatgtccgaca

SEQ ID NO: 962727 - DNA, 22 bp, Artificial Sequence
  chemically synthesized
ggaaccaacccaaatgtccgac

SEQ ID NO: 962728 - DNA, 22 bp, Artificial Sequence
  chemically synthesized
tcattgtcggacatttgggttg

SEQ ID NO: 962729 - DNA, 22 bp, Artificial Sequence
  chemically synthesized
tcggacatttgggttggttcca

SEQ ID NO: 962730 - DNA, 22 bp, Artificial Sequence
  chemically synthesized
acaatagcaaagacttggaacc

SEQ ID NO: 962731 - DNA, 22 bp, Artificial Sequence
  chemically synthesized
ttcacaatagcaaagacttgga

SEQ ID NO: 962732 - DNA, 22 bp, Artificial Sequence
  chemically synthesized
gggttggttccaagtctttgct

SEQ ID NO: 962733 - DNA, 22 bp, Artificial Sequence
  chemically synthesized
ggttggttccaagtctttgcta

SEQ ID NO: 962734 - DNA, 22 bp, Artificial Sequence
  chemically synthesized
cggcactattcacaatagcaaa

SEQ ID NO: 962735 - DNA, 22 bp, Artificial Sequence
  chemically synthesized
gttccaagtctttgctattgtg

SEQ ID NO: 962736 - DNA, 22 bp, Artificial Sequence
  chemically synthesized
ttgcggcactattcacaatagc

SEQ ID NO: 962737 - DNA, 22 bp, Artificial Sequence
  chemically synthesized
attgcggcactattcacaatag

SEQ ID NO: 962738 - DNA, 22 bp, Artificial Sequence
  chemically synthesized
caagtctttgctattgtgaata

SEQ ID NO: 962739 - DNA, 22 bp, Artificial Sequence
  chemically synthesized
tgctattgtgaatagtgccgca

SEQ ID NO: 962740 - DNA, 22 bp, Artificial Sequence
  chemically synthesized
gctattgtgaatagtgccgcaa

SEQ ID NO: 962741 - DNA, 22 bp, Artificial Sequence
  chemically synthesized
ctattgtgaatagtgccgcaat

SEQ ID NO: 962742 - DNA, 22 bp, Artificial Sequence
  chemically synthesized
ttgtgaatagtgccgcaataaa

SEQ ID NO: 962743 - DNA, 22 bp, Artificial Sequence
  chemically synthesized
tgaatagtgccgcaataaacat

SEQ ID NO: 962744 - DNA, 22 bp, Artificial Sequence
  chemically synthesized
taaagacacatgcacatgtatg

SEQ ID NO: 962745 - DNA, 22 bp, Artificial Sequence
  chemically synthesized
ctgtaaagacacatgcacatgt

SEQ ID NO: 962746 - DNA, 22 bp, Artificial Sequence
  chemically synthesized
taaatcatgctgctgtaaagac

SEQ ID NO: 962747 - DNA, 22 bp, Artificial Sequence
  chemically synthesized
tacagcagcatgatttataatc

SEQ ID NO: 962748 - DNA, 22 bp, Artificial Sequence
  chemically synthesized
acagcagcatgatttataatcc

SEQ ID NO: 962749 - DNA, 22 bp, Artificial Sequence
  chemically synthesized
cagcagcatgatttataatcct

SEQ ID NO: 962750 - DNA, 22 bp, Artificial Sequence
  chemically synthesized
ggtatatacccaaaggattata

SEQ ID NO: 962751 - DNA, 22 bp, Artificial Sequence
  chemically synthesized
ctgggtatatacccaaaggatt

SEQ ID NO: 962752 - DNA, 22 bp, Artificial Sequence
  chemically synthesized
ataatcctttgggtatataccc

SEQ ID NO: 962753 - DNA, 22 bp, Artificial Sequence
  chemically synthesized
taatcctttgggtatataccca

SEQ ID NO: 962754 - DNA, 22 bp, Artificial Sequence
  chemically synthesized
acccagccatcccattactggg

SEQ ID NO: 962755 - DNA, 22 bp, Artificial Sequence
  chemically synthesized
gacccagccatcccattactgg

SEQ ID NO: 962756 - DNA, 22 bp, Artificial Sequence
  chemically synthesized
tgggtatatacccagtaatggg

SEQ ID NO: 962757 - DNA, 22 bp, Artificial Sequence
  chemically synthesized
gggtatatacccagtaatggga

SEQ ID NO: 962758 - DNA, 22 bp, Artificial Sequence
  chemically synthesized
ggtatatacccagtaatgggat

SEQ ID NO: 962759 - DNA, 22 bp, Artificial Sequence
  chemically synthesized
ccatttgacccagccatcccat

SEQ ID NO: 962760 - DNA, 22 bp, Artificial Sequence
  chemically synthesized
gaattaccatttgacccagcca

SEQ ID NO: 962761 - DNA, 22 bp, Artificial Sequence
  chemically synthesized
gaactagaattaccatttgacc

SEQ ID NO: 962762 - DNA, 22 bp, Artificial Sequence
  chemically synthesized
aggcatctagaactagaattac

SEQ ID NO: 962763 - DNA, 22 bp, Artificial Sequence
  chemically synthesized
ggtcaaatggtaattctagttc

SEQ ID NO: 962764 - DNA, 22 bp, Artificial Sequence
  chemically synthesized
ctcaggcatctagaactagaat

SEQ ID NO: 962765 - DNA, 22 bp, Artificial Sequence
  chemically synthesized
tagttctagatgcctgaggaat

SEQ ID NO: 962766 - DNA, 22 bp, Artificial Sequence
  chemically synthesized
gttctagatgcctgaggaatcg

SEQ ID NO: 962767 - DNA, 22 bp, Artificial Sequence
  chemically synthesized
tggaagtcagtgtggcgattcc

SEQ ID NO: 962768 - DNA, 22 bp, Artificial Sequence
  chemically synthesized
tagatgcctgaggaatcgccac

SEQ ID NO: 962769 - DNA, 22 bp, Artificial Sequence
  chemically synthesized
gatgcctgaggaatcgccacac

SEQ ID NO: 962770 - DNA, 22 bp, Artificial Sequence
  chemically synthesized
aaccattgtggaagtcagtgtg

SEQ ID NO: 962771 - DNA, 22 bp, Artificial Sequence
  chemically synthesized
aggaatcgccacactgacttcc

SEQ ID NO: 962772 - DNA, 22 bp, Artificial Sequence
  chemically synthesized
gttcaaccattgtggaagtcag

SEQ ID NO: 962773 - DNA, 22 bp, Artificial Sequence
  chemically synthesized
taaactagttcaaccattgtgg

SEQ ID NO: 962774 - DNA, 22 bp, Artificial Sequence
  chemically synthesized
acttccacaatggttgaactag

SEQ ID NO: 962775 - DNA, 22 bp, Artificial Sequence
  chemically synthesized
gtgggactgtaaactagttcaa

SEQ ID NO: 962776 - DNA, 22 bp, Artificial Sequence
  chemically synthesized
ccacaatggttgaactagttta

SEQ ID NO: 962777 - DNA, 22 bp, Artificial Sequence
  chemically synthesized
ttggtgggactgtaaactagtt

SEQ ID NO: 962778 - DNA, 22 bp, Artificial Sequence
  chemically synthesized
cacaatggttgaactagtttac

SEQ ID NO: 962779 - DNA, 22 bp, Artificial Sequence
  chemically synthesized
cactgttggtgggactgtaaac

SEQ ID NO: 962780 - DNA, 22 bp, Artificial Sequence
  chemically synthesized
acactgttggtgggactgtaaa

SEQ ID NO: 962781 - DNA, 22 bp, Artificial Sequence
  chemically synthesized
tacactgttggtgggactgtaa

SEQ ID NO: 962782 - DNA, 22 bp, Artificial Sequence
  chemically synthesized
ttacactgttggtgggactgta

SEQ ID NO: 962783 - DNA, 22 bp, Artificial Sequence
  chemically synthesized
aactagtttacagtcccaccaa

SEQ ID NO: 962784 - DNA, 22 bp, Artificial Sequence
  chemically synthesized
gtttacagtcccaccaacagtg

SEQ ID NO: 962785 - DNA, 22 bp, Artificial Sequence
  chemically synthesized
acagtcccaccaacagtgtaaa

SEQ ID NO: 962786 - DNA, 22 bp, Artificial Sequence
  chemically synthesized
cagtcccaccaacagtgtaaaa

SEQ ID NO: 962787 - DNA, 22 bp, Artificial Sequence
  chemically synthesized
gtgaggatgtggagaaacagga

SEQ ID NO: 962788 - DNA, 22 bp, Artificial Sequence
  chemically synthesized
ctgtttctccacatcctcacca

SEQ ID NO: 962789 - DNA, 22 bp, Artificial Sequence
  chemically synthesized
tttctccacatcctcaccagca

SEQ ID NO: 962790 - DNA, 22 bp, Artificial Sequence
  chemically synthesized
ctccacatcctcaccagcacct

SEQ ID NO: 962791 - DNA, 22 bp, Artificial Sequence
  chemically synthesized
tccacatcctcaccagcacctg

SEQ ID NO: 962792 - DNA, 22 bp, Artificial Sequence
  chemically synthesized
cacatcctcaccagcacctgtt

SEQ ID NO: 962793 - DNA, 22 bp, Artificial Sequence
  chemically synthesized
aaaatcaggaaacaacaggtgc

SEQ ID NO: 962794 - DNA, 22 bp, Artificial Sequence
  chemically synthesized
accagcacctgttgtttcctga

SEQ ID NO: 962795 - DNA, 22 bp, Artificial Sequence
  chemically synthesized
gaatggcgatcattaaaaatca

SEQ ID NO: 962796 - DNA, 22 bp, Artificial Sequence
  chemically synthesized
ttgtttcctgatttttaatgat

SEQ ID NO: 962797 - DNA, 22 bp, Artificial Sequence
  chemically synthesized
tttcctgatttttaatgatcgc

SEQ ID NO: 962798 - DNA, 22 bp, Artificial Sequence
  chemically synthesized
cctgatttttaatgatcgccat

SEQ ID NO: 962799 - DNA, 22 bp, Artificial Sequence
  chemically synthesized
acgccagttagaatggcgatca

SEQ ID NO: 962800 - DNA, 22 bp, Artificial Sequence
  chemically synthesized
ctgatttttaatgatcgccatt

SEQ ID NO: 962801 - DNA, 22 bp, Artificial Sequence
  chemically synthesized
atttttaatgatcgccattcta

SEQ ID NO: 962802 - DNA, 22 bp, Artificial Sequence
  chemically synthesized
ttaatgatcgccattctaactg

SEQ ID NO: 962803 - DNA, 22 bp, Artificial Sequence
  chemically synthesized
taatgatcgccattctaactgg

SEQ ID NO: 962804 - DNA, 22 bp, Artificial Sequence
  chemically synthesized
aatgatcgccattctaactggc

SEQ ID NO: 962805 - DNA, 22 bp, Artificial Sequence
  chemically synthesized
atgatcgccattctaactggcg

SEQ ID NO: 962806 - DNA, 22 bp, Artificial Sequence
  chemically synthesized
agaaaaccacgaggtaccatct

SEQ ID NO: 962807 - DNA, 22 bp, Artificial Sequence
  chemically synthesized
taactggcgtgagatggtacct

SEQ ID NO: 962808 - DNA, 22 bp, Artificial Sequence
  chemically synthesized
actggcgtgagatggtacctcg

SEQ ID NO: 962809 - DNA, 22 bp, Artificial Sequence
  chemically synthesized
ctgagaaaaccacgaggtacca

SEQ ID NO: 962810 - DNA, 22 bp, Artificial Sequence
  chemically synthesized
gctgagaaaaccacgaggtacc

SEQ ID NO: 962811 - DNA, 22 bp, Artificial Sequence
  chemically synthesized
gcgtgagatggtacctcgtggt

SEQ ID NO: 962812 - DNA, 22 bp, Artificial Sequence
  chemically synthesized
cgatagtttgctgagaaaacca

SEQ ID NO: 962813 - DNA, 22 bp, Artificial Sequence
  chemically synthesized
gcgatagtttgctgagaaaacc

SEQ ID NO: 962814 - DNA, 22 bp, Artificial Sequence
  chemically synthesized
tccttgcgatagtttgctgaga

SEQ ID NO: 962815 - DNA, 22 bp, Artificial Sequence
  chemically synthesized
gtccttgcgatagtttgctgag

SEQ ID NO: 962816 - DNA, 22 bp, Artificial Sequence
  chemically synthesized
tgtccttgcgatagtttgctga

SEQ ID NO: 962817 - DNA, 22 bp, Artificial Sequence
  chemically synthesized
ttgtccttgcgatagtttgctg

SEQ ID NO: 962818 - DNA, 22 bp, Artificial Sequence
  chemically synthesized
tttgtccttgcgatagtttgct

SEQ ID NO: 962819 - DNA, 22 bp, Artificial Sequence
  chemically synthesized
gtggttttctcagcaaactatc

SEQ ID NO: 962820 - DNA, 22 bp, Artificial Sequence
  chemically synthesized
gttttttgtccttgcgatagtt

SEQ ID NO: 962821 - DNA, 22 bp, Artificial Sequence
  chemically synthesized
ggttttttgtccttgcgatagt

SEQ ID NO: 962822 - DNA, 22 bp, Artificial Sequence
  chemically synthesized
tctcagcaaactatcgcaagga

SEQ ID NO: 962823 - DNA, 22 bp, Artificial Sequence
  chemically synthesized
ctcagcaaactatcgcaaggac

SEQ ID NO: 962824 - DNA, 22 bp, Artificial Sequence
  chemically synthesized
tcagcaaactatcgcaaggaca

SEQ ID NO: 962825 - DNA, 22 bp, Artificial Sequence
  chemically synthesized
agcaaactatcgcaaggacaaa

SEQ ID NO: 962826 - DNA, 22 bp, Artificial Sequence
  chemically synthesized
tcgcaaggacaaaaaaccaaac

SEQ ID NO: 962827 - DNA, 22 bp, Artificial Sequence
  chemically synthesized
tgagcgagaacatgcggtgttt

SEQ ID NO: 962828 - DNA, 22 bp, Artificial Sequence
  chemically synthesized
ccacctatgagcgagaacatgc

SEQ ID NO: 962829 - DNA, 22 bp, Artificial Sequence
  chemically synthesized
aattcccacctatgagcgagaa

SEQ ID NO: 962830 - DNA, 22 bp, Artificial Sequence
  chemically synthesized
ttcaattcccacctatgagcga

SEQ ID NO: 962831 - DNA, 22 bp, Artificial Sequence
  chemically synthesized
attgttcaattcccacctatga

SEQ ID NO: 962832 - DNA, 22 bp, Artificial Sequence
  chemically synthesized
tcattgttcaattcccacctat

SEQ ID NO: 962833 - DNA, 22 bp, Artificial Sequence
  chemically synthesized
tcgctcataggtgggaattgaa

SEQ ID NO: 962834 - DNA, 22 bp, Artificial Sequence
  chemically synthesized
gctcataggtgggaattgaaca

SEQ ID NO: 962835 - DNA, 22 bp, Artificial Sequence
  chemically synthesized
ataggtgggaattgaacaatga

SEQ ID NO: 962836 - DNA, 22 bp, Artificial Sequence
  chemically synthesized
tgtccatgtgttctcattgttc

SEQ ID NO: 962837 - DNA, 22 bp, Artificial Sequence
  chemically synthesized
ctgtgtccatgtgttctcattg

SEQ ID NO: 962838 - DNA, 22 bp, Artificial Sequence
  chemically synthesized
cctgtgtccatgtgttctcatt

SEQ ID NO: 962839 - DNA, 22 bp, Artificial Sequence
  chemically synthesized
cccttcctgtgtccatgtgttc

SEQ ID NO: 962840 - DNA, 22 bp, Artificial Sequence
  chemically synthesized
aacaatgagaacacatggacac

SEQ ID NO: 962841 - DNA, 22 bp, Artificial Sequence
  chemically synthesized
cccccaccccacaacaggcccc

SEQ ID NO: 962842 - DNA, 22 bp, Artificial Sequence
  chemically synthesized
ccccctccccccaccccacaac

SEQ ID NO: 962843 - DNA, 22 bp, Artificial Sequence
  chemically synthesized
tccctcccccctccccccaccc

SEQ ID NO: 962844 - DNA, 22 bp, Artificial Sequence
  chemically synthesized
atgctatccctcccccctcccc

SEQ ID NO: 962845 - DNA, 22 bp, Artificial Sequence
  chemically synthesized
ttgtggggtggggggagggggg

SEQ ID NO: 962846 - DNA, 22 bp, Artificial Sequence
  chemically synthesized
ctaatgctatccctcccccctc

SEQ ID NO: 962847 - DNA, 22 bp, Artificial Sequence
  chemically synthesized
tggggtggggggaggggggagg

SEQ ID NO: 962848 - DNA, 22 bp, Artificial Sequence
  chemically synthesized
ggtatatctcctaatgctatcc

SEQ ID NO: 962849 - DNA, 22 bp, Artificial Sequence
  chemically synthesized
gcattaggtatatctcctaatg

SEQ ID NO: 962850 - DNA, 22 bp, Artificial Sequence
  chemically synthesized
agcattaggtatatctcctaat

SEQ ID NO: 962851 - DNA, 22 bp, Artificial Sequence
  chemically synthesized
gtcatttagcattaggtatatc

SEQ ID NO: 962852 - DNA, 22 bp, Artificial Sequence
  chemically synthesized
actcgtcatttagcattaggta

SEQ ID NO: 962853 - DNA, 22 bp, Artificial Sequence
  chemically synthesized
ggagatatacctaatgctaaat

SEQ ID NO: 962854 - DNA, 22 bp, Artificial Sequence
  chemically synthesized
cacccattaactcgtcatttag

SEQ ID NO: 962855 - DNA, 22 bp, Artificial Sequence
  chemically synthesized
gtgtgctgcacccattaactcg

SEQ ID NO: 962856 - DNA, 22 bp, Artificial Sequence
  chemically synthesized
atgctaaatgacgagttaatgg

SEQ ID NO: 962857 - DNA, 22 bp, Artificial Sequence
  chemically synthesized
aatgacgagttaatgggtgcag

SEQ ID NO: 962858 - DNA, 22 bp, Artificial Sequence
  chemically synthesized
atgggtgcagcacaccaacatg

SEQ ID NO: 962859 - DNA, 22 bp, Artificial Sequence
  chemically synthesized
cgtatgtatacatgtgccatgt

SEQ ID NO: 962860 - DNA, 22 bp, Artificial Sequence
  chemically synthesized
ttacgtatgtatacatgtgcca

SEQ ID NO: 962861 - DNA, 22 bp, Artificial Sequence
  chemically synthesized
gttacgtatgtatacatgtgcc

SEQ ID NO: 962862 - DNA, 22 bp, Artificial Sequence
  chemically synthesized
gggtacatgtgcacaacgtgca

SEQ ID NO: 962863 - DNA, 22 bp, Artificial Sequence
  chemically synthesized
agggtacatgtgcacaacgtgc

SEQ ID NO: 962864 - DNA, 22 bp, Artificial Sequence
  chemically synthesized
tagggtacatgtgcacaacgtg

SEQ ID NO: 962865 - DNA, 22 bp, Artificial Sequence
  chemically synthesized
agttttagggtacatgtgcaca

SEQ ID NO: 962866 - DNA, 22 bp, Artificial Sequence
  chemically synthesized
aagttttagggtacatgtgcac

SEQ ID NO: 962867 - DNA, 22 bp, Artificial Sequence
  chemically synthesized
taagttttagggtacatgtgca

SEQ ID NO: 962868 - DNA, 22 bp, Artificial Sequence
  chemically synthesized
ctttaagttttagggtacatgt

SEQ ID NO: 962869 - DNA, 22 bp, Artificial Sequence
  chemically synthesized
cacgttgtgcacatgtacccta

SEQ ID NO: 962870 - DNA, 22 bp, Artificial Sequence
  chemically synthesized
tactttaagttttagggtacat

SEQ ID NO: 962871 - DNA, 22 bp, Artificial Sequence
  chemically synthesized
ttctactttaagttttagggta

SEQ ID NO: 962872 - DNA, 22 bp, Artificial Sequence
  chemically synthesized
attctactttaagttttagggt

SEQ ID NO: 962873 - DNA, 22 bp, Artificial Sequence
  chemically synthesized
tattctactttaagttttaggg

SEQ ID NO: 962874 - DNA, 22 bp, Artificial Sequence
  chemically synthesized
ttattctactttaagttttagg

SEQ ID NO: 962875 - DNA, 22 bp, Artificial Sequence
  chemically synthesized
tgcacatgtaccctaaaactta

SEQ ID NO: 962876 - DNA, 22 bp, Artificial Sequence
  chemically synthesized
tttattctactttaagttttag

SEQ ID NO: 962877 - DNA, 22 bp, Artificial Sequence
  chemically synthesized
ttttattctactttaagtttta

SEQ ID NO: 962878 - DNA, 22 bp, Artificial Sequence
  chemically synthesized
tttttattctactttaagtttt

SEQ ID NO: 962879 - DNA, 22 bp, Artificial Sequence
  chemically synthesized
ttttttattctactttaagttt

SEQ ID NO: 962880 - DNA, 22 bp, Artificial Sequence
  chemically synthesized
tttttttattctactttaagtt

SEQ ID NO: 962881 - DNA, 22 bp, Artificial Sequence
  chemically synthesized
agattttttttttattctactt

SEQ ID NO: 962882 - DNA, 22 bp, Artificial Sequence
  chemically synthesized
tgagattttttttttattctac

SEQ ID NO: 962883 - DNA, 22 bp, Artificial Sequence
  chemically synthesized
ctgagattttttttttattcta

SEQ ID NO: 962884 - DNA, 22 bp, Artificial Sequence
  chemically synthesized
aaacttaaagtagaataaaaaa

SEQ ID NO: 962885 - DNA, 22 bp, Artificial Sequence
  chemically synthesized
atatttctgagatttttttttt

SEQ ID NO: 962886 - DNA, 22 bp, Artificial Sequence
  chemically synthesized
gatatttctgagattttttttt

SEQ ID NO: 962887 - DNA, 22 bp, Artificial Sequence
  chemically synthesized
aaagtagaataaaaaaaaaatc

SEQ ID NO: 962888 - DNA, 22 bp, Artificial Sequence
  chemically synthesized
tgatatttctgagatttttttt

SEQ ID NO: 962889 - DNA, 22 bp, Artificial Sequence
  chemically synthesized
aagtagaataaaaaaaaaatct

SEQ ID NO: 962890 - DNA, 22 bp, Artificial Sequence
  chemically synthesized
ttgatatttctgagattttttt

SEQ ID NO: 962891 - DNA, 22 bp, Artificial Sequence
  chemically synthesized
tttgatatttctgagatttttt

SEQ ID NO: 962892 - DNA, 22 bp, Artificial Sequence
  chemically synthesized
ttttgatatttctgagattttt

SEQ ID NO: 962893 - DNA, 22 bp, Artificial Sequence
  chemically synthesized
tttttgatatttctgagatttt

SEQ ID NO: 962894 - DNA, 22 bp, Artificial Sequence
  chemically synthesized
ttttttgatatttctgagattt

SEQ ID NO: 962895 - DNA, 22 bp, Artificial Sequence
  chemically synthesized
ttttttttgatatttctgagat

SEQ ID NO: 962896 - DNA, 22 bp, Artificial Sequence
  chemically synthesized
catgagtaagttcttttttttg

SEQ ID NO: 962897 - DNA, 22 bp, Artificial Sequence
  chemically synthesized
agaaatatcaaaaaaaagaact

SEQ ID NO: 962898 - DNA, 22 bp, Artificial Sequence
  chemically synthesized
gttacatgagtaagttcttttt

SEQ ID NO: 962899 - DNA, 22 bp, Artificial Sequence
  chemically synthesized
ggttacatgagtaagttctttt

SEQ ID NO: 962900 - DNA, 22 bp, Artificial Sequence
  chemically synthesized
gggtacaggtggtatttggtta

SEQ ID NO: 962901 - DNA, 22 bp, Artificial Sequence
  chemically synthesized
ttggggtacaggtggtatttgg

SEQ ID NO: 962902 - DNA, 22 bp, Artificial Sequence
  chemically synthesized
actcatgtaaccaaataccacc

SEQ ID NO: 962903 - DNA, 22 bp, Artificial Sequence
  chemically synthesized
ctcatgtaaccaaataccacct

SEQ ID NO: 962904 - DNA, 22 bp, Artificial Sequence
  chemically synthesized
atgtaaccaaataccacctgta

SEQ ID NO: 962905 - DNA, 22 bp, Artificial Sequence
  chemically synthesized
taaattattggggtacaggtgg

SEQ ID NO: 962906 - DNA, 22 bp, Artificial Sequence
  chemically synthesized
tgtaaattattggggtacaggt

SEQ ID NO: 962907 - DNA, 22 bp, Artificial Sequence
  chemically synthesized
ctgtaaattattggggtacagg

SEQ ID NO: 962908 - DNA, 22 bp, Artificial Sequence
  chemically synthesized
tctgtaaattattggggtacag

SEQ ID NO: 962909 - DNA, 22 bp, Artificial Sequence
  chemically synthesized
ttctgtaaattattggggtaca

SEQ ID NO: 962910 - DNA, 22 bp, Artificial Sequence
  chemically synthesized
tttttctgtaaattattggggt

SEQ ID NO: 962911 - DNA, 22 bp, Artificial Sequence
  chemically synthesized
atttttctgtaaattattgggg

SEQ ID NO: 962912 - DNA, 22 bp, Artificial Sequence
  chemically synthesized
tatttttctgtaaattattggg

SEQ ID NO: 962913 - DNA, 22 bp, Artificial Sequence
  chemically synthesized
ttttatttttctgtaaattatt

SEQ ID NO: 962914 - DNA, 22 bp, Artificial Sequence
  chemically synthesized
ttattttatttttctgtaaatt

SEQ ID NO: 962915 - DNA, 22 bp, Artificial Sequence
  chemically synthesized
attattttatttttctgtaaat

SEQ ID NO: 962916 - DNA, 22 bp, Artificial Sequence
  chemically synthesized
tattattttatttttctgtaaa

SEQ ID NO: 962917 - DNA, 22 bp, Artificial Sequence
  chemically synthesized
taccccaataatttacagaaaa

SEQ ID NO: 962918 - DNA, 22 bp, Artificial Sequence
  chemically synthesized
ttattattttatttttctgtaa

SEQ ID NO: 962919 - DNA, 22 bp, Artificial Sequence
  chemically synthesized
gtttttattattttatttttct

SEQ ID NO: 962920 - DNA, 22 bp, Artificial Sequence
  chemically synthesized
agtttttattattttatttttc

SEQ ID NO: 962921 - DNA, 22 bp, Artificial Sequence
  chemically synthesized
tagtttttattattttattttt

SEQ ID NO: 962922 - DNA, 22 bp, Artificial Sequence
  chemically synthesized
ttttagtttttattattttatt

SEQ ID NO: 962923 - DNA, 22 bp, Artificial Sequence
  chemically synthesized
attttagtttttattattttat

SEQ ID NO: 962924 - DNA, 22 bp, Artificial Sequence
  chemically synthesized
tattttagtttttattatttta

SEQ ID NO: 962925 - DNA, 22 bp, Artificial Sequence
  chemically synthesized
ttattttagtttttattatttt

SEQ ID NO: 962926 - DNA, 22 bp, Artificial Sequence
  chemically synthesized
tttattttagtttttattattt

SEQ ID NO: 962927 - DNA, 22 bp, Artificial Sequence
  chemically synthesized
acagaaaaataaaataataaaa

SEQ ID NO: 962928 - DNA, 22 bp, Artificial Sequence
  chemically synthesized
ttttattttagtttttattatt

SEQ ID NO: 962929 - DNA, 22 bp, Artificial Sequence
  chemically synthesized
cagaaaaataaaataataaaaa

SEQ ID NO: 962930 - DNA, 22 bp, Artificial Sequence
  chemically synthesized
ttttttattttagtttttatta

SEQ ID NO: 962931 - DNA, 22 bp, Artificial Sequence
  chemically synthesized
gcaaatgatattcttttttatt

SEQ ID NO: 962932 - DNA, 22 bp, Artificial Sequence
  chemically synthesized
ctagcaaatgatattctttttt

SEQ ID NO: 962933 - DNA, 22 bp, Artificial Sequence
  chemically synthesized
ctcctagcaaatgatattcttt

SEQ ID NO: 962934 - DNA, 22 bp, Artificial Sequence
  chemically synthesized
actcctagcaaatgatattctt

SEQ ID NO: 962935 - DNA, 22 bp, Artificial Sequence
  chemically synthesized
tactcctagcaaatgatattct

SEQ ID NO: 962936 - DNA, 22 bp, Artificial Sequence
  chemically synthesized
ttactcctagcaaatgatattc

SEQ ID NO: 962937 - DNA, 22 bp, Artificial Sequence
  chemically synthesized
tttactcctagcaaatgatatt

SEQ ID NO: 962938 - DNA, 22 bp, Artificial Sequence
  chemically synthesized
aaataaaaaagaatatcatttg

SEQ ID NO: 962939 - DNA, 22 bp, Artificial Sequence
  chemically synthesized
ttttttactcctagcaaatgat

SEQ ID NO: 962940 - DNA, 22 bp, Artificial Sequence
  chemically synthesized
attttttactcctagcaaatga

SEQ ID NO: 962941 - DNA, 22 bp, Artificial Sequence
  chemically synthesized
tattttttactcctagcaaatg

SEQ ID NO: 962942 - DNA, 22 bp, Artificial Sequence
  chemically synthesized
aagatgaagttttattttttac

SEQ ID NO: 962943 - DNA, 22 bp, Artificial Sequence
  chemically synthesized
caagatgaagttttatttttta

SEQ ID NO: 962944 - DNA, 22 bp, Artificial Sequence
  chemically synthesized
gctaggagtaaaaaataaaact

SEQ ID NO: 962945 - DNA, 22 bp, Artificial Sequence
  chemically synthesized
ctaggagtaaaaaataaaactt

SEQ ID NO: 962946 - DNA, 22 bp, Artificial Sequence
  chemically synthesized
tgatcttcaagatgaagtttta

SEQ ID NO: 962947 - DNA, 22 bp, Artificial Sequence
  chemically synthesized
ggagtaaaaaataaaacttcat

SEQ ID NO: 962948 - DNA, 22 bp, Artificial Sequence
  chemically synthesized
ttatgatcttcaagatgaagtt

SEQ ID NO: 962949 - DNA, 22 bp, Artificial Sequence
  chemically synthesized
gggttgttatgatcttcaagat

SEQ ID NO: 962950 - DNA, 22 bp, Artificial Sequence
  chemically synthesized
atctagggttgttatgatcttc

SEQ ID NO: 962951 - DNA, 22 bp, Artificial Sequence
  chemically synthesized
tcatctagggttgttatgatct

SEQ ID NO: 962952 - DNA, 22 bp, Artificial Sequence
  chemically synthesized
ctcatctagggttgttatgatc

SEQ ID NO: 962953 - DNA, 22 bp, Artificial Sequence
  chemically synthesized
tctcatctagggttgttatgat

SEQ ID NO: 962954 - DNA, 22 bp, Artificial Sequence
  chemically synthesized
catcttgaagatcataacaacc

SEQ ID NO: 962955 - DNA, 22 bp, Artificial Sequence
  chemically synthesized
atcttgaagatcataacaaccc

SEQ ID NO: 962956 - DNA, 22 bp, Artificial Sequence
  chemically synthesized
ctttctcatctagggttgttat

SEQ ID NO: 962957 - DNA, 22 bp, Artificial Sequence
  chemically synthesized
gctttctcatctagggttgtta

SEQ ID NO: 962958 - DNA, 22 bp, Artificial Sequence
  chemically synthesized
gaagatcataacaaccctagat

SEQ ID NO: 962959 - DNA, 22 bp, Artificial Sequence
  chemically synthesized
aagatcataacaaccctagatg

SEQ ID NO: 962960 - DNA, 22 bp, Artificial Sequence
  chemically synthesized
gatgagaaagcaaatatattac

SEQ ID NO: 962961 - DNA, 22 bp, Artificial Sequence
  chemically synthesized
cctgatctttttattttccatc

SEQ ID NO: 962962 - DNA, 22 bp, Artificial Sequence
  chemically synthesized
aagagaaaatgaggatggaaaa

SEQ ID NO: 962963 - DNA, 22 bp, Artificial Sequence
  chemically synthesized
atctttttattttccatcctca

SEQ ID NO: 962964 - DNA, 22 bp, Artificial Sequence
  chemically synthesized
tttattttccatcctcattttc

SEQ ID NO: 962965 - DNA, 22 bp, Artificial Sequence
  chemically synthesized
ttattttccatcctcattttct

SEQ ID NO: 962966 - DNA, 22 bp, Artificial Sequence
  chemically synthesized
tattttccatcctcattttctc

SEQ ID NO: 962967 - DNA, 22 bp, Artificial Sequence
  chemically synthesized
attttccatcctcattttctct

SEQ ID NO: 962968 - DNA, 22 bp, Artificial Sequence
  chemically synthesized
ttttccatcctcattttctctt

SEQ ID NO: 962969 - DNA, 22 bp, Artificial Sequence
  chemically synthesized
atacatatcattgaagagaaaa

SEQ ID NO: 962970 - DNA, 22 bp, Artificial Sequence
  chemically synthesized
catacatatcattgaagagaaa

SEQ ID NO: 962971 - DNA, 22 bp, Artificial Sequence
  chemically synthesized
tccatcctcattttctcttcaa

SEQ ID NO: 962972 - DNA, 22 bp, Artificial Sequence
  chemically synthesized
ccatcctcattttctcttcaat

SEQ ID NO: 962973 - DNA, 22 bp, Artificial Sequence
  chemically synthesized
ttcatacatatcattgaagaga

SEQ ID NO: 962974 - DNA, 22 bp, Artificial Sequence
  chemically synthesized
catcctcattttctcttcaatg

SEQ ID NO: 962975 - DNA, 22 bp, Artificial Sequence
  chemically synthesized
tcttcatacatatcattgaaga

SEQ ID NO: 962976 - DNA, 22 bp, Artificial Sequence
  chemically synthesized
ctcttcatacatatcattgaag

SEQ ID NO: 962977 - DNA, 22 bp, Artificial Sequence
  chemically synthesized
attttctcttcaatgatatgta

SEQ ID NO: 962978 - DNA, 22 bp, Artificial Sequence
  chemically synthesized
atatttctcttcatacatatca

SEQ ID NO: 962979 - DNA, 22 bp, Artificial Sequence
  chemically synthesized
tctcttcaatgatatgtatgaa

SEQ ID NO: 962980 - DNA, 22 bp, Artificial Sequence
  chemically synthesized
ctcttcaatgatatgtatgaag

SEQ ID NO: 962981 - DNA, 22 bp, Artificial Sequence
  chemically synthesized
tcttcaatgatatgtatgaaga

SEQ ID NO: 962982 - DNA, 22 bp, Artificial Sequence
  chemically synthesized
acattaatatttctcttcatac

SEQ ID NO: 962983 - DNA, 22 bp, Artificial Sequence
  chemically synthesized
ttcaatgatatgtatgaagaga

SEQ ID NO: 962984 - DNA, 22 bp, Artificial Sequence
  chemically synthesized
taacattaatatttctcttcat

SEQ ID NO: 962985 - DNA, 22 bp, Artificial Sequence
  chemically synthesized
caatgatatgtatgaagagaaa

SEQ ID NO: 962986 - DNA, 22 bp, Artificial Sequence
  chemically synthesized
ctaacattaatatttctcttca

SEQ ID NO: 962987 - DNA, 22 bp, Artificial Sequence
  chemically synthesized
aatgatatgtatgaagagaaat

SEQ ID NO: 962988 - DNA, 22 bp, Artificial Sequence
  chemically synthesized
tctaacattaatatttctcttc

SEQ ID NO: 962989 - DNA, 22 bp, Artificial Sequence
  chemically synthesized
cctttctaacattaatatttct

SEQ ID NO: 962990 - DNA, 22 bp, Artificial Sequence
  chemically synthesized
cattacctttctaacattaata

SEQ ID NO: 962991 - DNA, 22 bp, Artificial Sequence
  chemically synthesized
acacgttgcattacctttctaa

SEQ ID NO: 962992 - DNA, 22 bp, Artificial Sequence
  chemically synthesized
ctaacacgttgcattacctttc

SEQ ID NO: 962993 - DNA, 22 bp, Artificial Sequence
  chemically synthesized
atgttagaaaggtaatgcaacg

SEQ ID NO: 962994 - DNA, 22 bp, Artificial Sequence
  chemically synthesized
cagagcaattactaacacgttg

SEQ ID NO: 962995 - DNA, 22 bp, Artificial Sequence
  chemically synthesized
gaaaggtaatgcaacgtgttag

SEQ ID NO: 962996 - DNA, 22 bp, Artificial Sequence
  chemically synthesized
gtaattgctctggaattgattt

SEQ ID NO: 962997 - DNA, 22 bp, Artificial Sequence
  chemically synthesized
ctctggaattgatttctctatt

SEQ ID NO: 962998 - DNA, 22 bp, Artificial Sequence
  chemically synthesized
ataaatgccaacagaatagaga

SEQ ID NO: 962999 - DNA, 22 bp, Artificial Sequence
  chemically synthesized
tggaattgatttctctattctg

SEQ ID NO: 963000 - DNA, 22 bp, Artificial Sequence
  chemically synthesized
tgataaatgccaacagaataga

SEQ ID NO: 963001 - DNA, 22 bp, Artificial Sequence
  chemically synthesized
gaattgatttctctattctgtt

SEQ ID NO: 963002 - DNA, 22 bp, Artificial Sequence
  chemically synthesized
atttctctattctgttggcatt

SEQ ID NO: 963003 - DNA, 22 bp, Artificial Sequence
  chemically synthesized
aataattctgataaatgccaac

SEQ ID NO: 963004 - DNA, 22 bp, Artificial Sequence
  chemically synthesized
aaataattctgataaatgccaa

SEQ ID NO: 963005 - DNA, 22 bp, Artificial Sequence
  chemically synthesized
ctctattctgttggcatttatc

SEQ ID NO: 963006 - DNA, 22 bp, Artificial Sequence
  chemically synthesized
tctattctgttggcatttatca

SEQ ID NO: 963007 - DNA, 22 bp, Artificial Sequence
  chemically synthesized
tattctgttggcatttatcaga

SEQ ID NO: 963008 - DNA, 22 bp, Artificial Sequence
  chemically synthesized
aaatttaaataattctgataaa

SEQ ID NO: 963009 - DNA, 22 bp, Artificial Sequence
  chemically synthesized
ttctgttggcatttatcagaat

SEQ ID NO: 963010 - DNA, 22 bp, Artificial Sequence
  chemically synthesized
gaaatttaaataattctgataa

SEQ ID NO: 963011 - DNA, 22 bp, Artificial Sequence
  chemically synthesized
tgaaatttaaataattctgata

SEQ ID NO: 963012 - DNA, 22 bp, Artificial Sequence
  chemically synthesized
tgttggcatttatcagaattat

SEQ ID NO: 963013 - DNA, 22 bp, Artificial Sequence
  chemically synthesized
ttggcatttatcagaattattt

SEQ ID NO: 963014 - DNA, 22 bp, Artificial Sequence
  chemically synthesized
tgctttgaaatttaaataattc

SEQ ID NO: 963015 - DNA, 22 bp, Artificial Sequence
  chemically synthesized
gcatttatcagaattatttaaa

SEQ ID NO: 963016 - DNA, 22 bp, Artificial Sequence
  chemically synthesized
gactgtgctttgaaatttaaat

SEQ ID NO: 963017 - DNA, 22 bp, Artificial Sequence
  chemically synthesized
agactgtgctttgaaatttaaa

SEQ ID NO: 963018 - DNA, 22 bp, Artificial Sequence
  chemically synthesized
atcagaattatttaaatttcaa

SEQ ID NO: 963019 - DNA, 22 bp, Artificial Sequence
  chemically synthesized
ttagactgtgctttgaaattta

SEQ ID NO: 963020 - DNA, 22 bp, Artificial Sequence
  chemically synthesized
tcagaattatttaaatttcaaa

SEQ ID NO: 963021 - DNA, 22 bp, Artificial Sequence
  chemically synthesized
atggaattcttagactgtgctt

SEQ ID NO: 963022 - DNA, 22 bp, Artificial Sequence
  chemically synthesized
tttaaatttcaaagcacagtct

SEQ ID NO: 963023 - DNA, 22 bp, Artificial Sequence
  chemically synthesized
aaatttcaaagcacagtctaag

SEQ ID NO: 963024 - DNA, 22 bp, Artificial Sequence
  chemically synthesized
tctcatggaattcttagactgt

SEQ ID NO: 963025 - DNA, 22 bp, Artificial Sequence
  chemically synthesized
aatttcaaagcacagtctaaga

SEQ ID NO: 963026 - DNA, 22 bp, Artificial Sequence
  chemically synthesized
atctcatggaattcttagactg

SEQ ID NO: 963027 - DNA, 22 bp, Artificial Sequence
  chemically synthesized
caaagcacagtctaagaattcc

SEQ ID NO: 963028 - DNA, 22 bp, Artificial Sequence
  chemically synthesized
aaagcacagtctaagaattcca

SEQ ID NO: 963029 - DNA, 22 bp, Artificial Sequence
  chemically synthesized
caataagatttatctcatggaa

SEQ ID NO: 963030 - DNA, 22 bp, Artificial Sequence
  chemically synthesized
acaataagatttatctcatgga

SEQ ID NO: 963031 - DNA, 22 bp, Artificial Sequence
  chemically synthesized
atttacaataagatttatctca

SEQ ID NO: 963032 - DNA, 22 bp, Artificial Sequence
  chemically synthesized
agaattccatgagataaatctt

SEQ ID NO: 963033 - DNA, 22 bp, Artificial Sequence
  chemically synthesized
catgagataaatcttattgtaa

SEQ ID NO: 963034 - DNA, 22 bp, Artificial Sequence
  chemically synthesized
attgtaaatgaattatattacc

SEQ ID NO: 963035 - DNA, 22 bp, Artificial Sequence
  chemically synthesized
ttgtaaatgaattatattacca

SEQ ID NO: 963036 - DNA, 22 bp, Artificial Sequence
  chemically synthesized
taaatgaattatattaccatgg

SEQ ID NO: 963037 - DNA, 22 bp, Artificial Sequence
  chemically synthesized
acaaataatgagcaagcccatg

SEQ ID NO: 963038 - DNA, 22 bp, Artificial Sequence
  chemically synthesized
cacaaataatgagcaagcccat

SEQ ID NO: 963039 - DNA, 22 bp, Artificial Sequence
  chemically synthesized
tcacaaataatgagcaagccca

SEQ ID NO: 963040 - DNA, 22 bp, Artificial Sequence
  chemically synthesized
tattaccatgggcttgctcatt

SEQ ID NO: 963041 - DNA, 22 bp, Artificial Sequence
  chemically synthesized
ccatgggcttgctcattatttg

SEQ ID NO: 963042 - DNA, 22 bp, Artificial Sequence
  chemically synthesized
gctcattatttgtgaaagtgac

SEQ ID NO: 963043 - DNA, 22 bp, Artificial Sequence
  chemically synthesized
ctcattatttgtgaaagtgact

SEQ ID NO: 963044 - DNA, 22 bp, Artificial Sequence
  chemically synthesized
attatttgtgaaagtgacttta

SEQ ID NO: 963045 - DNA, 22 bp, Artificial Sequence
  chemically synthesized
tttgtgaaagtgactttatctg

SEQ ID NO: 963046 - DNA, 22 bp, Artificial Sequence
  chemically synthesized
ataataagccaggcagataaag

SEQ ID NO: 963047 - DNA, 22 bp, Artificial Sequence
  chemically synthesized
aataataagccaggcagataaa

SEQ ID NO: 963048 - DNA, 22 bp, Artificial Sequence
  chemically synthesized
gtgaaagtgactttatctgcct

SEQ ID NO: 963049 - DNA, 22 bp, Artificial Sequence
  chemically synthesized
tgaaagtgactttatctgcctg

SEQ ID NO: 963050 - DNA, 22 bp, Artificial Sequence
  chemically synthesized
tatttaataataagccaggcag

SEQ ID NO: 963051 - DNA, 22 bp, Artificial Sequence
  chemically synthesized
ataaactatatttaataataag

SEQ ID NO: 963052 - DNA, 22 bp, Artificial Sequence
  chemically synthesized
tatctgcctggcttattattaa

SEQ ID NO: 963053 - DNA, 22 bp, Artificial Sequence
  chemically synthesized
atctgcctggcttattattaaa

SEQ ID NO: 963054 - DNA, 22 bp, Artificial Sequence
  chemically synthesized
tctgcctggcttattattaaat

SEQ ID NO: 963055 - DNA, 22 bp, Artificial Sequence
  chemically synthesized
ttcataaactatatttaataat

SEQ ID NO: 963056 - DNA, 22 bp, Artificial Sequence
  chemically synthesized
gttcataaactatatttaataa

SEQ ID NO: 963057 - DNA, 22 bp, Artificial Sequence
  chemically synthesized
cctggcttattattaaatatag

SEQ ID NO: 963058 - DNA, 22 bp, Artificial Sequence
  chemically synthesized
gcttattattaaatatagttta

SEQ ID NO: 963059 - DNA, 22 bp, Artificial Sequence
  chemically synthesized
attattaaatatagtttatgaa

SEQ ID NO: 963060 - DNA, 22 bp, Artificial Sequence
  chemically synthesized
ttattaaatatagtttatgaac

SEQ ID NO: 963061 - DNA, 22 bp, Artificial Sequence
  chemically synthesized
ttaaatatagtttatgaacaag

SEQ ID NO: 963062 - DNA, 22 bp, Artificial Sequence
  chemically synthesized
aatatagtttatgaacaaggtg

SEQ ID NO: 963063 - DNA, 22 bp, Artificial Sequence
  chemically synthesized
atgaacaaggtggcacatttcc

SEQ ID NO: 963064 - DNA, 22 bp, Artificial Sequence
  chemically synthesized
tgaacaaggtggcacatttcct

SEQ ID NO: 963065 - DNA, 22 bp, Artificial Sequence
  chemically synthesized
caaaaatcaaacagaaggaaat

SEQ ID NO: 963066 - DNA, 22 bp, Artificial Sequence
  chemically synthesized
acaaaaatcaaacagaaggaaa

SEQ ID NO: 963067 - DNA, 22 bp, Artificial Sequence
  chemically synthesized
tacaaaaatcaaacagaaggaa

SEQ ID NO: 963068 - DNA, 22 bp, Artificial Sequence
  chemically synthesized
tttacaaaaatcaaacagaagg

SEQ ID NO: 963069 - DNA, 22 bp, Artificial Sequence
  chemically synthesized
ccttctgtttgatttttgtaaa

SEQ ID NO: 963070 - DNA, 22 bp, Artificial Sequence
  chemically synthesized
cttctgtttgatttttgtaaag

SEQ ID NO: 963071 - DNA, 22 bp, Artificial Sequence
  chemically synthesized
aagatacagagttctttacaaa

SEQ ID NO: 963072 - DNA, 22 bp, Artificial Sequence
  chemically synthesized
ctgtttgatttttgtaaagaac

SEQ ID NO: 963073 - DNA, 22 bp, Artificial Sequence
  chemically synthesized
tgtttgatttttgtaaagaact

SEQ ID NO: 963074 - DNA, 22 bp, Artificial Sequence
  chemically synthesized
tttgatttttgtaaagaactct

SEQ ID NO: 963075 - DNA, 22 bp, Artificial Sequence
  chemically synthesized
gatttttgtaaagaactctgta

SEQ ID NO: 963076 - DNA, 22 bp, Artificial Sequence
  chemically synthesized
atttttgtaaagaactctgtat

SEQ ID NO: 963077 - DNA, 22 bp, Artificial Sequence
  chemically synthesized
ttgtaaagaactctgtatcttg

SEQ ID NO: 963078 - DNA, 22 bp, Artificial Sequence
  chemically synthesized
tgtaaagaactctgtatcttga

SEQ ID NO: 963079 - DNA, 22 bp, Artificial Sequence
  chemically synthesized
gtaaagaactctgtatcttgag

SEQ ID NO: 963080 - DNA, 22 bp, Artificial Sequence
  chemically synthesized
taaagaactctgtatcttgagc

SEQ ID NO: 963081 - DNA, 22 bp, Artificial Sequence
  chemically synthesized
tgtatcttgagcggttgggtgc

SEQ ID NO: 963082 - DNA, 22 bp, Artificial Sequence
  chemically synthesized
tatcttgagcggttgggtgctg

SEQ ID NO: 963083 - DNA, 22 bp, Artificial Sequence
  chemically synthesized
gagcggttgggtgctgatatac

SEQ ID NO: 963084 - DNA, 22 bp, Artificial Sequence
  chemically synthesized
agcggttgggtgctgatatacg

SEQ ID NO: 963085 - DNA, 22 bp, Artificial Sequence
  chemically synthesized
catatcgtggcacgtatatcag

SEQ ID NO: 963086 - DNA, 22 bp, Artificial Sequence
  chemically synthesized
atattacatatcgtggcacgta

SEQ ID NO: 963087 - DNA, 22 bp, Artificial Sequence
  chemically synthesized
aatattacatatcgtggcacgt

SEQ ID NO: 963088 - DNA, 22 bp, Artificial Sequence
  chemically synthesized
ggtgctgatatacgtgccacga

SEQ ID NO: 963089 - DNA, 22 bp, Artificial Sequence
  chemically synthesized
taatattacatatcgtggcacg

SEQ ID NO: 963090 - DNA, 22 bp, Artificial Sequence
  chemically synthesized
ttaatattacatatcgtggcac

SEQ ID NO: 963091 - DNA, 22 bp, Artificial Sequence
  chemically synthesized
atatacgtgccacgatatgtaa

SEQ ID NO: 963092 - DNA, 22 bp, Artificial Sequence
  chemically synthesized
gagagcaaagggtttttaatat

SEQ ID NO: 963093 - DNA, 22 bp, Artificial Sequence
  chemically synthesized
aaaaccctttgctctccaatga

SEQ ID NO: 963094 - DNA, 22 bp, Artificial Sequence
  chemically synthesized
aaatgataagaatgtcattgga

SEQ ID NO: 963095 - DNA, 22 bp, Artificial Sequence
  chemically synthesized
caaatgataagaatgtcattgg

SEQ ID NO: 963096 - DNA, 22 bp, Artificial Sequence
  chemically synthesized
tgctctccaatgacattcttat

SEQ ID NO: 963097 - DNA, 22 bp, Artificial Sequence
  chemically synthesized
gctctccaatgacattcttatc

SEQ ID NO: 963098 - DNA, 22 bp, Artificial Sequence
  chemically synthesized
ctctccaatgacattcttatca

SEQ ID NO: 963099 - DNA, 22 bp, Artificial Sequence
  chemically synthesized
tccaatgacattcttatcattt

SEQ ID NO: 963100 - DNA, 22 bp, Artificial Sequence
  chemically synthesized
agaaatgacttcaaatgataag

SEQ ID NO: 963101 - DNA, 22 bp, Artificial Sequence
  chemically synthesized
caatgacattcttatcatttga

SEQ ID NO: 963102 - DNA, 22 bp, Artificial Sequence
  chemically synthesized
ttatcatttgaagtcatttctt

SEQ ID NO: 963103 - DNA, 22 bp, Artificial Sequence
  chemically synthesized
atcatttgaagtcatttcttaa

SEQ ID NO: 963104 - DNA, 22 bp, Artificial Sequence
  chemically synthesized
tcatttgaagtcatttcttaat

SEQ ID NO: 963105 - DNA, 22 bp, Artificial Sequence
  chemically synthesized
aaaataatgtagaaacattaag

SEQ ID NO: 963106 - DNA, 22 bp, Artificial Sequence
  chemically synthesized
aaaaataatgtagaaacattaa

SEQ ID NO: 963107 - DNA, 22 bp, Artificial Sequence
  chemically synthesized
gaagtcatttcttaatgtttct

SEQ ID NO: 963108 - DNA, 22 bp, Artificial Sequence
  chemically synthesized
taaaaataatgtagaaacatta

SEQ ID NO: 963109 - DNA, 22 bp, Artificial Sequence
  chemically synthesized
aagtcatttcttaatgtttcta

SEQ ID NO: 963110 - DNA, 22 bp, Artificial Sequence
  chemically synthesized
cttaatgtttctacattatttt

SEQ ID NO: 963111 - DNA, 22 bp, Artificial Sequence
  chemically synthesized
ttaatgtttctacattattttt

SEQ ID NO: 963112 - DNA, 22 bp, Artificial Sequence
  chemically synthesized
aatgtttctacattatttttaa

SEQ ID NO: 963113 - DNA, 22 bp, Artificial Sequence
  chemically synthesized
atgtttctacattatttttaaa

SEQ ID NO: 963114 - DNA, 22 bp, Artificial Sequence
  chemically synthesized
aaaagagcagtgttttaaaaat

SEQ ID NO: 963115 - DNA, 22 bp, Artificial Sequence
  chemically synthesized
ctacattatttttaaaacactg

SEQ ID NO: 963116 - DNA, 22 bp, Artificial Sequence
  chemically synthesized
tacattatttttaaaacactgc

SEQ ID NO: 963117 - DNA, 22 bp, Artificial Sequence
  chemically synthesized
aaatctcaaaagagcagtgttt

SEQ ID NO: 963118 - DNA, 22 bp, Artificial Sequence
  chemically synthesized
cattatttttaaaacactgctc

SEQ ID NO: 963119 - DNA, 22 bp, Artificial Sequence
  chemically synthesized
aaaatctcaaaagagcagtgtt

SEQ ID NO: 963120 - DNA, 22 bp, Artificial Sequence
  chemically synthesized
taaaatctcaaaagagcagtgt

SEQ ID NO: 963121 - DNA, 22 bp, Artificial Sequence
  chemically synthesized
tttttaaaacactgctcttttg

SEQ ID NO: 963122 - DNA, 22 bp, Artificial Sequence
  chemically synthesized
ttaaaacactgctcttttgaga

SEQ ID NO: 963123 - DNA, 22 bp, Artificial Sequence
  chemically synthesized
taaaacactgctcttttgagat

SEQ ID NO: 963124 - DNA, 22 bp, Artificial Sequence
  chemically synthesized
aaaacactgctcttttgagatt

SEQ ID NO: 963125 - DNA, 22 bp, Artificial Sequence
  chemically synthesized
aaacactgctcttttgagattt

SEQ ID NO: 963126 - DNA, 22 bp, Artificial Sequence
  chemically synthesized
ctcttttgagattttaaaattg

SEQ ID NO: 963127 - DNA, 22 bp, Artificial Sequence
  chemically synthesized
caatataaataacaattttaaa

SEQ ID NO: 963128 - DNA, 22 bp, Artificial Sequence
  chemically synthesized
ttttgagattttaaaattgtta

SEQ ID NO: 963129 - DNA, 22 bp, Artificial Sequence
  chemically synthesized
ttgagattttaaaattgttatt

SEQ ID NO: 963130 - DNA, 22 bp, Artificial Sequence
  chemically synthesized
tgagattttaaaattgttattt

SEQ ID NO: 963131 - DNA, 22 bp, Artificial Sequence
  chemically synthesized
gagattttaaaattgttattta

SEQ ID NO: 963132 - DNA, 22 bp, Artificial Sequence
  chemically synthesized
agattttaaaattgttatttat

SEQ ID NO: 963133 - DNA, 22 bp, Artificial Sequence
  chemically synthesized
tataaaatattgcaatataaat

SEQ ID NO: 963134 - DNA, 22 bp, Artificial Sequence
  chemically synthesized
atataaaatattgcaatataaa

SEQ ID NO: 963135 - DNA, 22 bp, Artificial Sequence
  chemically synthesized
taaaattgttatttatattgca

SEQ ID NO: 963136 - DNA, 22 bp, Artificial Sequence
  chemically synthesized
aaaattgttatttatattgcaa

SEQ ID NO: 963137 - DNA, 22 bp, Artificial Sequence
  chemically synthesized
aaattgttatttatattgcaat

SEQ ID NO: 963138 - DNA, 22 bp, Artificial Sequence
  chemically synthesized
atttatataaaatattgcaata

SEQ ID NO: 963139 - DNA, 22 bp, Artificial Sequence
  chemically synthesized
ttatttatattgcaatatttta

SEQ ID NO: 963140 - DNA, 22 bp, Artificial Sequence
  chemically synthesized
tttatattgcaatattttatat

SEQ ID NO: 963141 - DNA, 22 bp, Artificial Sequence
  chemically synthesized
atattgcaatattttatataaa

SEQ ID NO: 963142 - DNA, 22 bp, Artificial Sequence
  chemically synthesized
tattgcaatattttatataaat

SEQ ID NO: 963143 - DNA, 22 bp, Artificial Sequence
  chemically synthesized
aggagtaaattaatttatataa

SEQ ID NO: 963144 - DNA, 22 bp, Artificial Sequence
  chemically synthesized
ctaaggagtaaattaatttata

SEQ ID NO: 963145 - DNA, 22 bp, Artificial Sequence
  chemically synthesized
caatattttatataaattaatt

SEQ ID NO: 963146 - DNA, 22 bp, Artificial Sequence
  chemically synthesized
ctcctaaggagtaaattaattt

SEQ ID NO: 963147 - DNA, 22 bp, Artificial Sequence
  chemically synthesized
cctcctaaggagtaaattaatt

SEQ ID NO: 963148 - DNA, 22 bp, Artificial Sequence
  chemically synthesized
tatataaattaatttactcctt

SEQ ID NO: 963149 - DNA, 22 bp, Artificial Sequence
  chemically synthesized
atataaattaatttactcctta

SEQ ID NO: 963150 - DNA, 22 bp, Artificial Sequence
  chemically synthesized
tataaattaatttactccttag

SEQ ID NO: 963151 - DNA, 22 bp, Artificial Sequence
  chemically synthesized
tatagtttcctcctaaggagta

SEQ ID NO: 963152 - DNA, 22 bp, Artificial Sequence
  chemically synthesized
actatatagtttcctcctaagg

SEQ ID NO: 963153 - DNA, 22 bp, Artificial Sequence
  chemically synthesized
ttcactatatagtttcctccta

SEQ ID NO: 963154 - DNA, 22 bp, Artificial Sequence
  chemically synthesized
gttcactatatagtttcctcct

SEQ ID NO: 963155 - DNA, 22 bp, Artificial Sequence
  chemically synthesized
atttactccttaggaggaaact

SEQ ID NO: 963156 - DNA, 22 bp, Artificial Sequence
  chemically synthesized
tgttcactatatagtttcctcc

SEQ ID NO: 963157 - DNA, 22 bp, Artificial Sequence
  chemically synthesized
actccttaggaggaaactatat

SEQ ID NO: 963158 - DNA, 22 bp, Artificial Sequence
  chemically synthesized
ctccttaggaggaaactatata

SEQ ID NO: 963159 - DNA, 22 bp, Artificial Sequence
  chemically synthesized
cttaggaggaaactatatagtg

SEQ ID NO: 963160 - DNA, 22 bp, Artificial Sequence
  chemically synthesized
aggaggaaactatatagtgaac

SEQ ID NO: 963161 - DNA, 22 bp, Artificial Sequence
  chemically synthesized
ggaggaaactatatagtgaaca

SEQ ID NO: 963162 - DNA, 22 bp, Artificial Sequence
  chemically synthesized
aataaaaaatctttgttcacta

SEQ ID NO: 963163 - DNA, 22 bp, Artificial Sequence
  chemically synthesized
aaaaggttaaataaaaaatctt

SEQ ID NO: 963164 - DNA, 22 bp, Artificial Sequence
  chemically synthesized
tatagtgaacaaagatttttta

SEQ ID NO: 963165 - DNA, 22 bp, Artificial Sequence
  chemically synthesized
gaaaaggttaaataaaaaatct

SEQ ID NO: 963166 - DNA, 22 bp, Artificial Sequence
  chemically synthesized
tgaaaaggttaaataaaaaatc

SEQ ID NO: 963167 - DNA, 22 bp, Artificial Sequence
  chemically synthesized
ttgaaaaggttaaataaaaaat

SEQ ID NO: 963168 - DNA, 22 bp, Artificial Sequence
  chemically synthesized
tttttgaaaaggttaaataaaa

SEQ ID NO: 963169 - DNA, 22 bp, Artificial Sequence
  chemically synthesized
tttatttaaccttttcaaaaat

SEQ ID NO: 963170 - DNA, 22 bp, Artificial Sequence
  chemically synthesized
ttatttaaccttttcaaaaata

SEQ ID NO: 963171 - DNA, 22 bp, Artificial Sequence
  chemically synthesized
tatttaaccttttcaaaaataa

SEQ ID NO: 963172 - DNA, 22 bp, Artificial Sequence
  chemically synthesized
atttaaccttttcaaaaataat

SEQ ID NO: 963173 - DNA, 22 bp, Artificial Sequence
  chemically synthesized
tttaaccttttcaaaaataata

SEQ ID NO: 963174 - DNA, 22 bp, Artificial Sequence
  chemically synthesized
ccaaatagaagatattattttt

SEQ ID NO: 963175 - DNA, 22 bp, Artificial Sequence
  chemically synthesized
cccaaatagaagatattatttt

SEQ ID NO: 963176 - DNA, 22 bp, Artificial Sequence
  chemically synthesized
tcccaaatagaagatattattt

SEQ ID NO: 963177 - DNA, 22 bp, Artificial Sequence
  chemically synthesized
aaccttttcaaaaataatatct

SEQ ID NO: 963178 - DNA, 22 bp, Artificial Sequence
  chemically synthesized
ttcccaaatagaagatattatt

SEQ ID NO: 963179 - DNA, 22 bp, Artificial Sequence
  chemically synthesized
accttttcaaaaataatatctt

SEQ ID NO: 963180 - DNA, 22 bp, Artificial Sequence
  chemically synthesized
tttcccaaatagaagatattat

SEQ ID NO: 963181 - DNA, 22 bp, Artificial Sequence
  chemically synthesized
ttttcccaaatagaagatatta

SEQ ID NO: 963182 - DNA, 22 bp, Artificial Sequence
  chemically synthesized
tttttcccaaatagaagatatt

SEQ ID NO: 963183 - DNA, 22 bp, Artificial Sequence
  chemically synthesized
ttttttcccaaatagaagatat

SEQ ID NO: 963184 - DNA, 22 bp, Artificial Sequence
  chemically synthesized
tttttttcccaaatagaagata

SEQ ID NO: 963185 - DNA, 22 bp, Artificial Sequence
  chemically synthesized
ttcaaaaataatatcttctatt

SEQ ID NO: 963186 - DNA, 22 bp, Artificial Sequence
  chemically synthesized
ttttttttcccaaatagaagat

SEQ ID NO: 963187 - DNA, 22 bp, Artificial Sequence
  chemically synthesized
tcaaaaataatatcttctattt

SEQ ID NO: 963188 - DNA, 22 bp, Artificial Sequence
  chemically synthesized
caaaaataatatcttctatttg

SEQ ID NO: 963189 - DNA, 22 bp, Artificial Sequence
  chemically synthesized
aaaaataatatcttctatttgg

SEQ ID NO: 963190 - DNA, 22 bp, Artificial Sequence
  chemically synthesized
taaagcatttttttttttccca

SEQ ID NO: 963191 - DNA, 22 bp, Artificial Sequence
  chemically synthesized
gtaaagcatttttttttttccc

SEQ ID NO: 963192 - DNA, 22 bp, Artificial Sequence
  chemically synthesized
tgtaaagcatttttttttttcc

SEQ ID NO: 963193 - DNA, 22 bp, Artificial Sequence
  chemically synthesized
ttgtaaagcatttttttttttc

SEQ ID NO: 963194 - DNA, 22 bp, Artificial Sequence
  chemically synthesized
ttttgtaaagcatttttttttt

SEQ ID NO: 963195 - DNA, 22 bp, Artificial Sequence
  chemically synthesized
ctatttgggaaaaaaaaaaatg

SEQ ID NO: 963196 - DNA, 22 bp, Artificial Sequence
  chemically synthesized
tatttgggaaaaaaaaaaatgc

SEQ ID NO: 963197 - DNA, 22 bp, Artificial Sequence
  chemically synthesized
tttgggaaaaaaaaaaatgctt

SEQ ID NO: 963198 - DNA, 22 bp, Artificial Sequence
  chemically synthesized
gaacctcttttgtaaagcattt

SEQ ID NO: 963199 - DNA, 22 bp, Artificial Sequence
  chemically synthesized
gggaaaaaaaaaaatgctttac

SEQ ID NO: 963200 - DNA, 22 bp, Artificial Sequence
  chemically synthesized
ggaacctcttttgtaaagcatt

SEQ ID NO: 963201 - DNA, 22 bp, Artificial Sequence
  chemically synthesized
ggaaaaaaaaaaatgctttaca

SEQ ID NO: 963202 - DNA, 22 bp, Artificial Sequence
  chemically synthesized
tggaacctcttttgtaaagcat

SEQ ID NO: 963203 - DNA, 22 bp, Artificial Sequence
  chemically synthesized
ggttttggaacctcttttgtaa

SEQ ID NO: 963204 - DNA, 22 bp, Artificial Sequence
  chemically synthesized
tgggttttggaacctcttttgt

SEQ ID NO: 963205 - DNA, 22 bp, Artificial Sequence
  chemically synthesized
tgggcccctctgggttttggaa

SEQ ID NO: 963206 - DNA, 22 bp, Artificial Sequence
  chemically synthesized
tacaaaagaggttccaaaaccc

SEQ ID NO: 963207 - DNA, 22 bp, Artificial Sequence
  chemically synthesized
acaaaagaggttccaaaaccca

SEQ ID NO: 963208 - DNA, 22 bp, Artificial Sequence
  chemically synthesized
caaaagaggttccaaaacccag

SEQ ID NO: 963209 - DNA, 22 bp, Artificial Sequence
  chemically synthesized
caaaacccagaggggcccacag

SEQ ID NO: 963210 - DNA, 22 bp, Artificial Sequence
  chemically synthesized
gtcaagaaagaacacaatgact

SEQ ID NO: 963211 - DNA, 22 bp, Artificial Sequence
  chemically synthesized
gttagtcaagaaagaacacaat

SEQ ID NO: 963212 - DNA, 22 bp, Artificial Sequence
  chemically synthesized
aaggaattcgttagtcaagaaa

SEQ ID NO: 963213 - DNA, 22 bp, Artificial Sequence
  chemically synthesized
cactcaaggaattcgttagtca

SEQ ID NO: 963214 - DNA, 22 bp, Artificial Sequence
  chemically synthesized
tgttctttcttgactaacgaat

SEQ ID NO: 963215 - DNA, 22 bp, Artificial Sequence
  chemically synthesized
aaactgcactcaaggaattcgt

SEQ ID NO: 963216 - DNA, 22 bp, Artificial Sequence
  chemically synthesized
tttcttgactaacgaattcctt

SEQ ID NO: 963217 - DNA, 22 bp, Artificial Sequence
  chemically synthesized
gaaactgcactcaaggaattcg

SEQ ID NO: 963218 - DNA, 22 bp, Artificial Sequence
  chemically synthesized
tcttgactaacgaattccttga

SEQ ID NO: 963219 - DNA, 22 bp, Artificial Sequence
  chemically synthesized
cttgactaacgaattccttgag

SEQ ID NO: 963220 - DNA, 22 bp, Artificial Sequence
  chemically synthesized
ttgactaacgaattccttgagt

SEQ ID NO: 963221 - DNA, 22 bp, Artificial Sequence
  chemically synthesized
tacttgaaactgcactcaagga

SEQ ID NO: 963222 - DNA, 22 bp, Artificial Sequence
  chemically synthesized
gactaacgaattccttgagtgc

SEQ ID NO: 963223 - DNA, 22 bp, Artificial Sequence
  chemically synthesized
actaacgaattccttgagtgca

SEQ ID NO: 963224 - DNA, 22 bp, Artificial Sequence
  chemically synthesized
acgaattccttgagtgcagttt

SEQ ID NO: 963225 - DNA, 22 bp, Artificial Sequence
  chemically synthesized
caatctgtacttgaaactgcac

SEQ ID NO: 963226 - DNA, 22 bp, Artificial Sequence
  chemically synthesized
cttgagtgcagtttcaagtaca

SEQ ID NO: 963227 - DNA, 22 bp, Artificial Sequence
  chemically synthesized
gagtgcagtttcaagtacagat

SEQ ID NO: 963228 - DNA, 22 bp, Artificial Sequence
  chemically synthesized
atagatactacaatctgtactt

SEQ ID NO: 963229 - DNA, 22 bp, Artificial Sequence
  chemically synthesized
agtgcagtttcaagtacagatt

SEQ ID NO: 963230 - DNA, 22 bp, Artificial Sequence
  chemically synthesized
caagtacagattgtagtatcta

SEQ ID NO: 963231 - DNA, 22 bp, Artificial Sequence
  chemically synthesized
aagtacagattgtagtatctat

SEQ ID NO: 963232 - DNA, 22 bp, Artificial Sequence
  chemically synthesized
ggtaagacattgatagatacta

SEQ ID NO: 963233 - DNA, 22 bp, Artificial Sequence
  chemically synthesized
tagtatctatcaatgtcttacc

SEQ ID NO: 963234 - DNA, 22 bp, Artificial Sequence
  chemically synthesized
acagggaaaattgggtaagaca

SEQ ID NO: 963235 - DNA, 22 bp, Artificial Sequence
  chemically synthesized
tcaatgtcttacccaattttcc

SEQ ID NO: 963236 - DNA, 22 bp, Artificial Sequence
  chemically synthesized
aaacactgacagggaaaattgg

SEQ ID NO: 963237 - DNA, 22 bp, Artificial Sequence
  chemically synthesized
gaaacactgacagggaaaattg

SEQ ID NO: 963238 - DNA, 22 bp, Artificial Sequence
  chemically synthesized
acccaattttccctgtcagtgt

SEQ ID NO: 963239 - DNA, 22 bp, Artificial Sequence
  chemically synthesized
cccaattttccctgtcagtgtt

SEQ ID NO: 963240 - DNA, 22 bp, Artificial Sequence
  chemically synthesized
aaatatatttgaaacactgaca

SEQ ID NO: 963241 - DNA, 22 bp, Artificial Sequence
  chemically synthesized
tccctgtcagtgtttcaaatat

SEQ ID NO: 963242 - DNA, 22 bp, Artificial Sequence
  chemically synthesized
ccctgtcagtgtttcaaatata

SEQ ID NO: 963243 - DNA, 22 bp, Artificial Sequence
  chemically synthesized
caggaattaaaatatatttgaa

SEQ ID NO: 963244 - DNA, 22 bp, Artificial Sequence
  chemically synthesized
cctgtcagtgtttcaaatatat

SEQ ID NO: 963245 - DNA, 22 bp, Artificial Sequence
  chemically synthesized
acaggaattaaaatatatttga

SEQ ID NO: 963246 - DNA, 22 bp, Artificial Sequence
  chemically synthesized
tacaggaattaaaatatatttg

SEQ ID NO: 963247 - DNA, 22 bp, Artificial Sequence
  chemically synthesized
tcagtgtttcaaatatatttta

SEQ ID NO: 963248 - DNA, 22 bp, Artificial Sequence
  chemically synthesized
ttttacaggaattaaaatatat

SEQ ID NO: 963249 - DNA, 22 bp, Artificial Sequence
  chemically synthesized
caaatatattttaattcctgta

SEQ ID NO: 963250 - DNA, 22 bp, Artificial Sequence
  chemically synthesized
aaatatattttaattcctgtaa

SEQ ID NO: 963251 - DNA, 22 bp, Artificial Sequence
  chemically synthesized
ccacatcccagattattttaca

SEQ ID NO: 963252 - DNA, 22 bp, Artificial Sequence
  chemically synthesized
ttaccacatcccagattatttt

SEQ ID NO: 963253 - DNA, 22 bp, Artificial Sequence
  chemically synthesized
gttaccacatcccagattattt

SEQ ID NO: 963254 - DNA, 22 bp, Artificial Sequence
  chemically synthesized
taattcctgtaaaataatctgg

SEQ ID NO: 963255 - DNA, 22 bp, Artificial Sequence
  chemically synthesized
aattcctgtaaaataatctggg

SEQ ID NO: 963256 - DNA, 22 bp, Artificial Sequence
  chemically synthesized
attcctgtaaaataatctggga

SEQ ID NO: 963257 - DNA, 22 bp, Artificial Sequence
  chemically synthesized
ctgtaaaataatctgggatgtg

SEQ ID NO: 963258 - DNA, 22 bp, Artificial Sequence
  chemically synthesized
taaaataatctgggatgtggta

SEQ ID NO: 963259 - DNA, 22 bp, Artificial Sequence
  chemically synthesized
atgtatatatgataatttgtta

SEQ ID NO: 963260 - DNA, 22 bp, Artificial Sequence
  chemically synthesized
aatgtatatatgataatttgtt

SEQ ID NO: 963261 - DNA, 22 bp, Artificial Sequence
  chemically synthesized
ttaatgtatatatgataatttg

SEQ ID NO: 963262 - DNA, 22 bp, Artificial Sequence
  chemically synthesized
ggatgtggtaacaaattatcat

SEQ ID NO: 963263 - DNA, 22 bp, Artificial Sequence
  chemically synthesized
cttaatgtatatatgataattt

SEQ ID NO: 963264 - DNA, 22 bp, Artificial Sequence
  chemically synthesized
tcttaatgtatatatgataatt

SEQ ID NO: 963265 - DNA, 22 bp, Artificial Sequence
  chemically synthesized
aaccaaattttcttaatgtata

SEQ ID NO: 963266 - DNA, 22 bp, Artificial Sequence
  chemically synthesized
tcctgaaccaaattttcttaat

SEQ ID NO: 963267 - DNA, 22 bp, Artificial Sequence
  chemically synthesized
tcatatatacattaagaaaatt

SEQ ID NO: 963268 - DNA, 22 bp, Artificial Sequence
  chemically synthesized
tcagtggacctgtcctgaacca

SEQ ID NO: 963269 - DNA, 22 bp, Artificial Sequence
  chemically synthesized
atcagtggacctgtcctgaacc

SEQ ID NO: 963270 - DNA, 22 bp, Artificial Sequence
  chemically synthesized
tatcagtggacctgtcctgaac

SEQ ID NO: 963271 - DNA, 22 bp, Artificial Sequence
  chemically synthesized
agaaaatttggttcaggacagg

SEQ ID NO: 963272 - DNA, 22 bp, Artificial Sequence
  chemically synthesized
ggttcaggacaggtccactgat

SEQ ID NO: 963273 - DNA, 22 bp, Artificial Sequence
  chemically synthesized
gttcaggacaggtccactgata

SEQ ID NO: 963274 - DNA, 22 bp, Artificial Sequence
  chemically synthesized
aggacaggtccactgataaagt

SEQ ID NO: 963275 - DNA, 22 bp, Artificial Sequence
  chemically synthesized
gaatatcgggcacaccaggaaa

SEQ ID NO: 963276 - DNA, 22 bp, Artificial Sequence
  chemically synthesized
ctagaatatcgggcacaccagg

SEQ ID NO: 963277 - DNA, 22 bp, Artificial Sequence
  chemically synthesized
ataaagtttcctggtgtgcccg

SEQ ID NO: 963278 - DNA, 22 bp, Artificial Sequence
  chemically synthesized
aggaattactagaatatcgggc

SEQ ID NO: 963279 - DNA, 22 bp, Artificial Sequence
  chemically synthesized
ttaaggaattactagaatatcg

SEQ ID NO: 963280 - DNA, 22 bp, Artificial Sequence
  chemically synthesized
cctggtgtgcccgatattctag

SEQ ID NO: 963281 - DNA, 22 bp, Artificial Sequence
  chemically synthesized
ctggtgtgcccgatattctagt

SEQ ID NO: 963282 - DNA, 22 bp, Artificial Sequence
  chemically synthesized
tattaaggaattactagaatat

SEQ ID NO: 963283 - DNA, 22 bp, Artificial Sequence
  chemically synthesized
ctattaaggaattactagaata

SEQ ID NO: 963284 - DNA, 22 bp, Artificial Sequence
  chemically synthesized
gtgtgcccgatattctagtaat

SEQ ID NO: 963285 - DNA, 22 bp, Artificial Sequence
  chemically synthesized
ggtttctattaaggaattacta

SEQ ID NO: 963286 - DNA, 22 bp, Artificial Sequence
  chemically synthesized
aggtttctattaaggaattact

SEQ ID NO: 963287 - DNA, 22 bp, Artificial Sequence
  chemically synthesized
ttaggtttctattaaggaatta

SEQ ID NO: 963288 - DNA, 22 bp, Artificial Sequence
  chemically synthesized
tcttaggtttctattaaggaat

SEQ ID NO: 963289 - DNA, 22 bp, Artificial Sequence
  chemically synthesized
ctcttaggtttctattaaggaa

SEQ ID NO: 963290 - DNA, 22 bp, Artificial Sequence
  chemically synthesized
atttctcttaggtttctattaa

SEQ ID NO: 963291 - DNA, 22 bp, Artificial Sequence
  chemically synthesized
tagtaattccttaatagaaacc

SEQ ID NO: 963292 - DNA, 22 bp, Artificial Sequence
  chemically synthesized
gtaattccttaatagaaaccta

SEQ ID NO: 963293 - DNA, 22 bp, Artificial Sequence
  chemically synthesized
cttaatagaaacctaagagaaa

SEQ ID NO: 963294 - DNA, 22 bp, Artificial Sequence
  chemically synthesized
aatagaaacctaagagaaatta

SEQ ID NO: 963295 - DNA, 22 bp, Artificial Sequence
  chemically synthesized
atagaaacctaagagaaattag

SEQ ID NO: 963296 - DNA, 22 bp, Artificial Sequence
  chemically synthesized
agatgatcaaaaaagagctaat

SEQ ID NO: 963297 - DNA, 22 bp, Artificial Sequence
  chemically synthesized
cctaagatgatcaaaaaagagc

SEQ ID NO: 963298 - DNA, 22 bp, Artificial Sequence
  chemically synthesized
agagaaattagctcttttttga

SEQ ID NO: 963299 - DNA, 22 bp, Artificial Sequence
  chemically synthesized
cccaggctacctaagatgatca

SEQ ID NO: 963300 - DNA, 22 bp, Artificial Sequence
  chemically synthesized
ccccaggctacctaagatgatc

SEQ ID NO: 963301 - DNA, 22 bp, Artificial Sequence
  chemically synthesized
tccccaggctacctaagatgat

SEQ ID NO: 963302 - DNA, 22 bp, Artificial Sequence
  chemically synthesized
gctcttttttgatcatcttagg

SEQ ID NO: 963303 - DNA, 22 bp, Artificial Sequence
  chemically synthesized
ttccccaggctacctaagatga

SEQ ID NO: 963304 - DNA, 22 bp, Artificial Sequence
  chemically synthesized
tttccccaggctacctaagatg

SEQ ID NO: 963305 - DNA, 22 bp, Artificial Sequence
  chemically synthesized
ttttccccaggctacctaagat

SEQ ID NO: 963306 - DNA, 22 bp, Artificial Sequence
  chemically synthesized
tttttccccaggctacctaaga

SEQ ID NO: 963307 - DNA, 22 bp, Artificial Sequence
  chemically synthesized
ttttttgatcatcttaggtagc

SEQ ID NO: 963308 - DNA, 22 bp, Artificial Sequence
  chemically synthesized
ttttgatcatcttaggtagcct

SEQ ID NO: 963309 - DNA, 22 bp, Artificial Sequence
  chemically synthesized
tttgatcatcttaggtagcctg

SEQ ID NO: 963310 - DNA, 22 bp, Artificial Sequence
  chemically synthesized
ttgatcatcttaggtagcctgg

SEQ ID NO: 963311 - DNA, 22 bp, Artificial Sequence
  chemically synthesized
tgatcatcttaggtagcctggg

SEQ ID NO: 963312 - DNA, 22 bp, Artificial Sequence
  chemically synthesized
gatcatcttaggtagcctgggg

SEQ ID NO: 963313 - DNA, 22 bp, Artificial Sequence
  chemically synthesized
atcatcttaggtagcctgggga

SEQ ID NO: 963314 - DNA, 22 bp, Artificial Sequence
  chemically synthesized
gagtgattttttttccccaggc

SEQ ID NO: 963315 - DNA, 22 bp, Artificial Sequence
  chemically synthesized
tacctggagtgattttttttcc

SEQ ID NO: 963316 - DNA, 22 bp, Artificial Sequence
  chemically synthesized
aggtagcctggggaaaaaaaat

SEQ ID NO: 963317 - DNA, 22 bp, Artificial Sequence
  chemically synthesized
ggtagcctggggaaaaaaaatc

SEQ ID NO: 963318 - DNA, 22 bp, Artificial Sequence
  chemically synthesized
gggaaaaaaaatcactccaggt

SEQ ID NO: 963319 - DNA, 22 bp, Artificial Sequence
  chemically synthesized
caggtacagcatcctttcctat

SEQ ID NO: 963320 - DNA, 22 bp, Artificial Sequence
  chemically synthesized
aaggaaatgagaaaataggaaa

SEQ ID NO: 963321 - DNA, 22 bp, Artificial Sequence
  chemically synthesized
gatgttaaaggaaatgagaaaa

SEQ ID NO: 963322 - DNA, 22 bp, Artificial Sequence
  chemically synthesized
tcctattttctcatttccttta

SEQ ID NO: 963323 - DNA, 22 bp, Artificial Sequence
  chemically synthesized
cctattttctcatttcctttaa

SEQ ID NO: 963324 - DNA, 22 bp, Artificial Sequence
  chemically synthesized
ctattttctcatttcctttaac

SEQ ID NO: 963325 - DNA, 22 bp, Artificial Sequence
  chemically synthesized
ttttctcatttcctttaacatc

SEQ ID NO: 963326 - DNA, 22 bp, Artificial Sequence
  chemically synthesized
agaaaataaaactagatgttaa

SEQ ID NO: 963327 - DNA, 22 bp, Artificial Sequence
  chemically synthesized
tctcatttcctttaacatctag

SEQ ID NO: 963328 - DNA, 22 bp, Artificial Sequence
  chemically synthesized
ctcatttcctttaacatctagt

SEQ ID NO: 963329 - DNA, 22 bp, Artificial Sequence
  chemically synthesized
tcatttcctttaacatctagtt

SEQ ID NO: 963330 - DNA, 22 bp, Artificial Sequence
  chemically synthesized
atttcctttaacatctagtttt

SEQ ID NO: 963331 - DNA, 22 bp, Artificial Sequence
  chemically synthesized
cctttaacatctagttttattt

SEQ ID NO: 963332 - DNA, 22 bp, Artificial Sequence
  chemically synthesized
ctttaacatctagttttatttt

SEQ ID NO: 963333 - DNA, 22 bp, Artificial Sequence
  chemically synthesized
taacatctagttttattttctt

SEQ ID NO: 963334 - DNA, 22 bp, Artificial Sequence
  chemically synthesized
aacatctagttttattttctta

SEQ ID NO: 963335 - DNA, 22 bp, Artificial Sequence
  chemically synthesized
acatctagttttattttcttaa

SEQ ID NO: 963336 - DNA, 22 bp, Artificial Sequence
  chemically synthesized
acaaaatgacaaagcattaaga

SEQ ID NO: 963337 - DNA, 22 bp, Artificial Sequence
  chemically synthesized
gttttattttcttaatgctttg

SEQ ID NO: 963338 - DNA, 22 bp, Artificial Sequence
  chemically synthesized
tattttcttaatgctttgtcat

SEQ ID NO: 963339 - DNA, 22 bp, Artificial Sequence
  chemically synthesized
attttcttaatgctttgtcatt

SEQ ID NO: 963340 - DNA, 22 bp, Artificial Sequence
  chemically synthesized
ttttcttaatgctttgtcattt

SEQ ID NO: 963341 - DNA, 22 bp, Artificial Sequence
  chemically synthesized
agaaaatactaacaaaatgaca

SEQ ID NO: 963342 - DNA, 22 bp, Artificial Sequence
  chemically synthesized
tcttaatgctttgtcattttgt

SEQ ID NO: 963343 - DNA, 22 bp, Artificial Sequence
  chemically synthesized
cttaatgctttgtcattttgtt

SEQ ID NO: 963344 - DNA, 22 bp, Artificial Sequence
  chemically synthesized
ttaatgctttgtcattttgtta

SEQ ID NO: 963345 - DNA, 22 bp, Artificial Sequence
  chemically synthesized
aatgctttgtcattttgttagt

SEQ ID NO: 963346 - DNA, 22 bp, Artificial Sequence
  chemically synthesized
atgctttgtcattttgttagta

SEQ ID NO: 963347 - DNA, 22 bp, Artificial Sequence
  chemically synthesized
aaaaaaaattaagaaaatacta

SEQ ID NO: 963348 - DNA, 22 bp, Artificial Sequence
  chemically synthesized
tgtcattttgttagtattttct

SEQ ID NO: 963349 - DNA, 22 bp, Artificial Sequence
  chemically synthesized
gtcattttgttagtattttctt

SEQ ID NO: 963350 - DNA, 22 bp, Artificial Sequence
  chemically synthesized
tcattttgttagtattttctta

SEQ ID NO: 963351 - DNA, 22 bp, Artificial Sequence
  chemically synthesized
aacactaaaaaaaaattaagaa

SEQ ID NO: 963352 - DNA, 22 bp, Artificial Sequence
  chemically synthesized
tgttagtattttcttaattttt

SEQ ID NO: 963353 - DNA, 22 bp, Artificial Sequence
  chemically synthesized
gttagtattttcttaatttttt

SEQ ID NO: 963354 - DNA, 22 bp, Artificial Sequence
  chemically synthesized
ttagtattttcttaattttttt

SEQ ID NO: 963355 - DNA, 22 bp, Artificial Sequence
  chemically synthesized
gtattttcttaattttttttta

SEQ ID NO: 963356 - DNA, 22 bp, Artificial Sequence
  chemically synthesized
ccgagtattaaacactaaaaaa

SEQ ID NO: 963357 - DNA, 22 bp, Artificial Sequence
  chemically synthesized
gccgagtattaaacactaaaaa

SEQ ID NO: 963358 - DNA, 22 bp, Artificial Sequence
  chemically synthesized
tgccgagtattaaacactaaaa

SEQ ID NO: 963359 - DNA, 22 bp, Artificial Sequence
  chemically synthesized
tcttaatttttttttagtgttt

SEQ ID NO: 963360 - DNA, 22 bp, Artificial Sequence
  chemically synthesized
cttaatttttttttagtgttta

SEQ ID NO: 963361 - DNA, 22 bp, Artificial Sequence
  chemically synthesized
ttaatttttttttagtgtttaa

SEQ ID NO: 963362 - DNA, 22 bp, Artificial Sequence
  chemically synthesized
aatttttttttagtgtttaata

SEQ ID NO: 963363 - DNA, 22 bp, Artificial Sequence
  chemically synthesized
tcctttgccgagtattaaacac

SEQ ID NO: 963364 - DNA, 22 bp, Artificial Sequence
  chemically synthesized
atttttttttagtgtttaatac

SEQ ID NO: 963365 - DNA, 22 bp, Artificial Sequence
  chemically synthesized
ttttttagtgtttaatactcgg

SEQ ID NO: 963366 - DNA, 22 bp, Artificial Sequence
  chemically synthesized
tttttagtgtttaatactcggc

SEQ ID NO: 963367 - DNA, 22 bp, Artificial Sequence
  chemically synthesized
tgtctgtcctttgccgagtatt

SEQ ID NO: 963368 - DNA, 22 bp, Artificial Sequence
  chemically synthesized
ttttagtgtttaatactcggca

SEQ ID NO: 963369 - DNA, 22 bp, Artificial Sequence
  chemically synthesized
tttagtgtttaatactcggcaa

SEQ ID NO: 963370 - DNA, 22 bp, Artificial Sequence
  chemically synthesized
ttagtgtttaatactcggcaaa

SEQ ID NO: 963371 - DNA, 22 bp, Artificial Sequence
  chemically synthesized
tagtgtttaatactcggcaaag

SEQ ID NO: 963372 - DNA, 22 bp, Artificial Sequence
  chemically synthesized
agtgtttaatactcggcaaagg

SEQ ID NO: 963373 - DNA, 22 bp, Artificial Sequence
  chemically synthesized
gtgtttaatactcggcaaagga

SEQ ID NO: 963374 - DNA, 22 bp, Artificial Sequence
  chemically synthesized
aatactcggcaaaggacagaca

SEQ ID NO: 963375 - DNA, 22 bp, Artificial Sequence
  chemically synthesized
catcgcaggctatgtctgtcct

SEQ ID NO: 963376 - DNA, 22 bp, Artificial Sequence
  chemically synthesized
atactcggcaaaggacagacat

SEQ ID NO: 963377 - DNA, 22 bp, Artificial Sequence
  chemically synthesized
cctgcatcgcaggctatgtctg

SEQ ID NO: 963378 - DNA, 22 bp, Artificial Sequence
  chemically synthesized
ggcaaaggacagacatagcctg

SEQ ID NO: 963379 - DNA, 22 bp, Artificial Sequence
  chemically synthesized
agagaagcagccctgcctgcat

SEQ ID NO: 963380 - DNA, 22 bp, Artificial Sequence
  chemically synthesized
cgatgcaggcagggctgcttct

SEQ ID NO: 963381 - DNA, 22 bp, Artificial Sequence
  chemically synthesized
tcaaaagaacattaagagaagc

SEQ ID NO: 963382 - DNA, 22 bp, Artificial Sequence
  chemically synthesized
ctgtcaaaagaacattaagaga

SEQ ID NO: 963383 - DNA, 22 bp, Artificial Sequence
  chemically synthesized
actgtcaaaagaacattaagag

SEQ ID NO: 963384 - DNA, 22 bp, Artificial Sequence
  chemically synthesized
tactgtcaaaagaacattaaga

SEQ ID NO: 963385 - DNA, 22 bp, Artificial Sequence
  chemically synthesized
aatctttactgtcaaaagaaca

SEQ ID NO: 963386 - DNA, 22 bp, Artificial Sequence
  chemically synthesized
gaatctttactgtcaaaagaac

SEQ ID NO: 963387 - DNA, 22 bp, Artificial Sequence
  chemically synthesized
cttctcttaatgttcttttgac

SEQ ID NO: 963388 - DNA, 22 bp, Artificial Sequence
  chemically synthesized
tgaatctttactgtcaaaagaa

SEQ ID NO: 963389 - DNA, 22 bp, Artificial Sequence
  chemically synthesized
ctcttaatgttcttttgacagt

SEQ ID NO: 963390 - DNA, 22 bp, Artificial Sequence
  chemically synthesized
tcttaatgttcttttgacagta

SEQ ID NO: 963391 - DNA, 22 bp, Artificial Sequence
  chemically synthesized
attttgaatctttactgtcaaa

SEQ ID NO: 963392 - DNA, 22 bp, Artificial Sequence
  chemically synthesized
ttaatgttcttttgacagtaaa

SEQ ID NO: 963393 - DNA, 22 bp, Artificial Sequence
  chemically synthesized
aatgttcttttgacagtaaaga

SEQ ID NO: 963394 - DNA, 22 bp, Artificial Sequence
  chemically synthesized
atgttcttttgacagtaaagat

SEQ ID NO: 963395 - DNA, 22 bp, Artificial Sequence
  chemically synthesized
ttttgacagtaaagattcaaaa

SEQ ID NO: 963396 - DNA, 22 bp, Artificial Sequence
  chemically synthesized
ataatgggctaattttgaatct

SEQ ID NO: 963397 - DNA, 22 bp, Artificial Sequence
  chemically synthesized
ttgacagtaaagattcaaaatt

SEQ ID NO: 963398 - DNA, 22 bp, Artificial Sequence
  chemically synthesized
tgacagtaaagattcaaaatta

SEQ ID NO: 963399 - DNA, 22 bp, Artificial Sequence
  chemically synthesized
gacagtaaagattcaaaattag

SEQ ID NO: 963400 - DNA, 22 bp, Artificial Sequence
  chemically synthesized
gttgataatgggctaattttga

SEQ ID NO: 963401 - DNA, 22 bp, Artificial Sequence
  chemically synthesized
acagtaaagattcaaaattagc

SEQ ID NO: 963402 - DNA, 22 bp, Artificial Sequence
  chemically synthesized
ttggttgataatgggctaattt

SEQ ID NO: 963403 - DNA, 22 bp, Artificial Sequence
  chemically synthesized
gttggttgataatgggctaatt

SEQ ID NO: 963404 - DNA, 22 bp, Artificial Sequence
  chemically synthesized
tttgttggttgataatgggcta

SEQ ID NO: 963405 - DNA, 22 bp, Artificial Sequence
  chemically synthesized
atttgttggttgataatgggct

SEQ ID NO: 963406 - DNA, 22 bp, Artificial Sequence
  chemically synthesized
tatttgttggttgataatgggc

SEQ ID NO: 963407 - DNA, 22 bp, Artificial Sequence
  chemically synthesized
ctttatttgttggttgataatg

SEQ ID NO: 963408 - DNA, 22 bp, Artificial Sequence
  chemically synthesized
aaaattagcccattatcaacca

SEQ ID NO: 963409 - DNA, 22 bp, Artificial Sequence
  chemically synthesized
tcctttatttgttggttgataa

SEQ ID NO: 963410 - DNA, 22 bp, Artificial Sequence
  chemically synthesized
gcccattatcaaccaacaaata

SEQ ID NO: 963411 - DNA, 22 bp, Artificial Sequence
  chemically synthesized
caaccctctcctttatttgttg

SEQ ID NO: 963412 - DNA, 22 bp, Artificial Sequence
  chemically synthesized
ccaaccctctcctttatttgtt

SEQ ID NO: 963413 - DNA, 22 bp, Artificial Sequence
  chemically synthesized
tttccaaccctctcctttattt

SEQ ID NO: 963414 - DNA, 22 bp, Artificial Sequence
  chemically synthesized
atttccaaccctctcctttatt

SEQ ID NO: 963415 - DNA, 22 bp, Artificial Sequence
  chemically synthesized
tcaaccaacaaataaaggagag

SEQ ID NO: 963416 - DNA, 22 bp, Artificial Sequence
  chemically synthesized
cacttatttccaaccctctcct

SEQ ID NO: 963417 - DNA, 22 bp, Artificial Sequence
  chemically synthesized
gccggaaccattacacttattt

SEQ ID NO: 963418 - DNA, 22 bp, Artificial Sequence
  chemically synthesized
ggccggaaccattacacttatt

SEQ ID NO: 963419 - DNA, 22 bp, Artificial Sequence
  chemically synthesized
tggccggaaccattacacttat

SEQ ID NO: 963420 - DNA, 22 bp, Artificial Sequence
  chemically synthesized
ttggccggaaccattacactta

SEQ ID NO: 963421 - DNA, 22 bp, Artificial Sequence
  chemically synthesized
tttttggccggaaccattacac

SEQ ID NO: 963422 - DNA, 22 bp, Artificial Sequence
  chemically synthesized
atttttggccggaaccattaca

SEQ ID NO: 963423 - DNA, 22 bp, Artificial Sequence
  chemically synthesized
gaaataagtgtaatggttccgg

SEQ ID NO: 963424 - DNA, 22 bp, Artificial Sequence
  chemically synthesized
tgtttatttttggccggaacca

SEQ ID NO: 963425 - DNA, 22 bp, Artificial Sequence
  chemically synthesized
gtgtttatttttggccggaacc

SEQ ID NO: 963426 - DNA, 22 bp, Artificial Sequence
  chemically synthesized
gccttgtgtttatttttggccg

SEQ ID NO: 963427 - DNA, 22 bp, Artificial Sequence
  chemically synthesized
gcagactggccttgtgtttatt

SEQ ID NO: 963428 - DNA, 22 bp, Artificial Sequence
  chemically synthesized
agcagactggccttgtgtttat

SEQ ID NO: 963429 - DNA, 22 bp, Artificial Sequence
  chemically synthesized
cggccaaaaataaacacaaggc

SEQ ID NO: 963430 - DNA, 22 bp, Artificial Sequence
  chemically synthesized
caacatacgaatttagcagact

SEQ ID NO: 963431 - DNA, 22 bp, Artificial Sequence
  chemically synthesized
gcaacatacgaatttagcagac

SEQ ID NO: 963432 - DNA, 22 bp, Artificial Sequence
  chemically synthesized
tgcaacatacgaatttagcaga

SEQ ID NO: 963433 - DNA, 22 bp, Artificial Sequence
  chemically synthesized
ttgcaacatacgaatttagcag

SEQ ID NO: 963434 - DNA, 22 bp, Artificial Sequence
  chemically synthesized
ctaaattcgtatgttgcaaaaa

SEQ ID NO: 963435 - DNA, 22 bp, Artificial Sequence
  chemically synthesized
aattcgtatgttgcaaaaacgt

SEQ ID NO: 963436 - DNA, 22 bp, Artificial Sequence
  chemically synthesized
agtgaagtagtaagtacgtttt

SEQ ID NO: 963437 - DNA, 22 bp, Artificial Sequence
  chemically synthesized
gtatgttgcaaaaacgtactta

SEQ ID NO: 963438 - DNA, 22 bp, Artificial Sequence
  chemically synthesized
aaggctaagtgaagtagtaagt

SEQ ID NO: 963439 - DNA, 22 bp, Artificial Sequence
  chemically synthesized
aaaggctaagtgaagtagtaag

SEQ ID NO: 963440 - DNA, 22 bp, Artificial Sequence
  chemically synthesized
caaaaacgtacttactacttca

SEQ ID NO: 963441 - DNA, 22 bp, Artificial Sequence
  chemically synthesized
ttaaaggctaagtgaagtagta

SEQ ID NO: 963442 - DNA, 22 bp, Artificial Sequence
  chemically synthesized
cttaaaggctaagtgaagtagt

SEQ ID NO: 963443 - DNA, 22 bp, Artificial Sequence
  chemically synthesized
tcttaaaggctaagtgaagtag

SEQ ID NO: 963444 - DNA, 22 bp, Artificial Sequence
  chemically synthesized
actacttcacttagcctttaag

SEQ ID NO: 963445 - DNA, 22 bp, Artificial Sequence
  chemically synthesized
ctacttcacttagcctttaaga

SEQ ID NO: 963446 - DNA, 22 bp, Artificial Sequence
  chemically synthesized
atcccatgtctttcttaaaggc

SEQ ID NO: 963447 - DNA, 22 bp, Artificial Sequence
  chemically synthesized
cttcacttagcctttaagaaag

SEQ ID NO: 963448 - DNA, 22 bp, Artificial Sequence
  chemically synthesized
cacttagcctttaagaaagaca

SEQ ID NO: 963449 - DNA, 22 bp, Artificial Sequence
  chemically synthesized
acttagcctttaagaaagacat

SEQ ID NO: 963450 - DNA, 22 bp, Artificial Sequence
  chemically synthesized
agcctttaagaaagacatggga

SEQ ID NO: 963451 - DNA, 22 bp, Artificial Sequence
  chemically synthesized
gcctttaagaaagacatgggat

SEQ ID NO: 963452 - DNA, 22 bp, Artificial Sequence
  chemically synthesized
aaaatcccaattcatcccatgt

SEQ ID NO: 963453 - DNA, 22 bp, Artificial Sequence
  chemically synthesized
aaaaatcccaattcatcccatg

SEQ ID NO: 963454 - DNA, 22 bp, Artificial Sequence
  chemically synthesized
taaaaatcccaattcatcccat

SEQ ID NO: 963455 - DNA, 22 bp, Artificial Sequence
  chemically synthesized
taagaaagacatgggatgaatt

SEQ ID NO: 963456 - DNA, 22 bp, Artificial Sequence
  chemically synthesized
aagaaagacatgggatgaattg

SEQ ID NO: 963457 - DNA, 22 bp, Artificial Sequence
  chemically synthesized
ctttaaaaatcccaattcatcc

SEQ ID NO: 963458 - DNA, 22 bp, Artificial Sequence
  chemically synthesized
agaaagacatgggatgaattgg

SEQ ID NO: 963459 - DNA, 22 bp, Artificial Sequence
  chemically synthesized
actttaaaaatcccaattcatc

SEQ ID NO: 963460 - DNA, 22 bp, Artificial Sequence
  chemically synthesized
ttactttaaaaatcccaattca

SEQ ID NO: 963461 - DNA, 22 bp, Artificial Sequence
  chemically synthesized
cttactttaaaaatcccaattc

SEQ ID NO: 963462 - DNA, 22 bp, Artificial Sequence
  chemically synthesized
cccttcttactttaaaaatccc

SEQ ID NO: 963463 - DNA, 22 bp, Artificial Sequence
  chemically synthesized
ccccttcttactttaaaaatcc

SEQ ID NO: 963464 - DNA, 22 bp, Artificial Sequence
  chemically synthesized
tccccttcttactttaaaaatc

SEQ ID NO: 963465 - DNA, 22 bp, Artificial Sequence
  chemically synthesized
ttccccttcttactttaaaaat

SEQ ID NO: 963466 - DNA, 22 bp, Artificial Sequence
  chemically synthesized
tttccccttcttactttaaaaa

SEQ ID NO: 963467 - DNA, 22 bp, Artificial Sequence
  chemically synthesized
ttttccccttcttactttaaaa

SEQ ID NO: 963468 - DNA, 22 bp, Artificial Sequence
  chemically synthesized
tttttccccttcttactttaaa

SEQ ID NO: 963469 - DNA, 22 bp, Artificial Sequence
  chemically synthesized
ctttttttccccttcttacttt

SEQ ID NO: 963470 - DNA, 22 bp, Artificial Sequence
  chemically synthesized
ggatttttaaagtaagaagggg

SEQ ID NO: 963471 - DNA, 22 bp, Artificial Sequence
  chemically synthesized
agagtgttgctttttttcccct

SEQ ID NO: 963472 - DNA, 22 bp, Artificial Sequence
  chemically synthesized
ttaaagtaagaaggggaaaaaa

SEQ ID NO: 963473 - DNA, 22 bp, Artificial Sequence
  chemically synthesized
taaagtaagaaggggaaaaaaa

SEQ ID NO: 963474 - DNA, 22 bp, Artificial Sequence
  chemically synthesized
aaagtaagaaggggaaaaaaag

SEQ ID NO: 963475 - DNA, 22 bp, Artificial Sequence
  chemically synthesized
aagtaagaaggggaaaaaaagc

SEQ ID NO: 963476 - DNA, 22 bp, Artificial Sequence
  chemically synthesized
gataaaggagctaagagtgttg

SEQ ID NO: 963477 - DNA, 22 bp, Artificial Sequence
  chemically synthesized
cagagtcaggagtactggataa

SEQ ID NO: 963478 - DNA, 22 bp, Artificial Sequence
  chemically synthesized
gcagagtcaggagtactggata

SEQ ID NO: 963479 - DNA, 22 bp, Artificial Sequence
  chemically synthesized
ttagctcctttatccagtactc

SEQ ID NO: 963480 - DNA, 22 bp, Artificial Sequence
  chemically synthesized
agctcctttatccagtactcct

SEQ ID NO: 963481 - DNA, 22 bp, Artificial Sequence
  chemically synthesized
ccttgcagagtcaggagtactg

SEQ ID NO: 963482 - DNA, 22 bp, Artificial Sequence
  chemically synthesized
gctcctttatccagtactcctg

SEQ ID NO: 963483 - DNA, 22 bp, Artificial Sequence
  chemically synthesized
ctttatccagtactcctgactc

SEQ ID NO: 963484 - DNA, 22 bp, Artificial Sequence
  chemically synthesized
tatccagtactcctgactctgc

SEQ ID NO: 963485 - DNA, 22 bp, Artificial Sequence
  chemically synthesized
atccagtactcctgactctgca

SEQ ID NO: 963486 - DNA, 22 bp, Artificial Sequence
  chemically synthesized
tccagtactcctgactctgcaa

SEQ ID NO: 963487 - DNA, 22 bp, Artificial Sequence
  chemically synthesized
gaggaggaaacaatctaccttg

SEQ ID NO: 963488 - DNA, 22 bp, Artificial Sequence
  chemically synthesized
ctgactctgcaaggtagattgt

SEQ ID NO: 963489 - DNA, 22 bp, Artificial Sequence
  chemically synthesized
actctgcaaggtagattgtttc

SEQ ID NO: 963490 - DNA, 22 bp, Artificial Sequence
  chemically synthesized
ccaattagaggaggaaacaatc

SEQ ID NO: 963491 - DNA, 22 bp, Artificial Sequence
  chemically synthesized
gccaattagaggaggaaacaat

SEQ ID NO: 963492 - DNA, 22 bp, Artificial Sequence
  chemically synthesized
tgccaattagaggaggaaacaa

SEQ ID NO: 963493 - DNA, 22 bp, Artificial Sequence
  chemically synthesized
tgcaaggtagattgtttcctcc

SEQ ID NO: 963494 - DNA, 22 bp, Artificial Sequence
  chemically synthesized
caaggtagattgtttcctcctc

SEQ ID NO: 963495 - DNA, 22 bp, Artificial Sequence
  chemically synthesized
cagcattttgccaattagagga

SEQ ID NO: 963496 - DNA, 22 bp, Artificial Sequence
  chemically synthesized
tttcctcctctaattggcaaaa

SEQ ID NO: 963497 - DNA, 22 bp, Artificial Sequence
  chemically synthesized
aaaacctgcagcattttgccaa

SEQ ID NO: 963498 - DNA, 22 bp, Artificial Sequence
  chemically synthesized
cctcctctaattggcaaaatgc

SEQ ID NO: 963499 - DNA, 22 bp, Artificial Sequence
  chemically synthesized
ctcctctaattggcaaaatgct

SEQ ID NO: 963500 - DNA, 22 bp, Artificial Sequence
  chemically synthesized
ctctaattggcaaaatgctgca

SEQ ID NO: 963501 - DNA, 22 bp, Artificial Sequence
  chemically synthesized
taattggcaaaatgctgcaggt

SEQ ID NO: 963502 - DNA, 22 bp, Artificial Sequence
  chemically synthesized
attggcaaaatgctgcaggttt

SEQ ID NO: 963503 - DNA, 22 bp, Artificial Sequence
  chemically synthesized
accgagggactgaaaacctgca

SEQ ID NO: 963504 - DNA, 22 bp, Artificial Sequence
  chemically synthesized
caccgagggactgaaaacctgc

SEQ ID NO: 963505 - DNA, 22 bp, Artificial Sequence
  chemically synthesized
tcaccgagggactgaaaacctg

SEQ ID NO: 963506 - DNA, 22 bp, Artificial Sequence
  chemically synthesized
gcaaaatgctgcaggttttcag

SEQ ID NO: 963507 - DNA, 22 bp, Artificial Sequence
  chemically synthesized
agtcactttcaccgagggactg

SEQ ID NO: 963508 - DNA, 22 bp, Artificial Sequence
  chemically synthesized
caggttttcagtccctcggtga

SEQ ID NO: 963509 - DNA, 22 bp, Artificial Sequence
  chemically synthesized
tcagtccctcggtgaaagtgac

SEQ ID NO: 963510 - DNA, 22 bp, Artificial Sequence
  chemically synthesized
cagtccctcggtgaaagtgact

SEQ ID NO: 963511 - DNA, 22 bp, Artificial Sequence
  chemically synthesized
agtccctcggtgaaagtgactt

SEQ ID NO: 963512 - DNA, 22 bp, Artificial Sequence
  chemically synthesized
atgccccgtcctaagtcacttt

SEQ ID NO: 963513 - DNA, 22 bp, Artificial Sequence
  chemically synthesized
ggtgaaagtgacttaggacggg

SEQ ID NO: 963514 - DNA, 22 bp, Artificial Sequence
  chemically synthesized
aaagaattaatgccccgtccta

SEQ ID NO: 963515 - DNA, 22 bp, Artificial Sequence
  chemically synthesized
gtgaactgaaagaattaatgcc

SEQ ID NO: 963516 - DNA, 22 bp, Artificial Sequence
  chemically synthesized
aggacggggcattaattctttc

SEQ ID NO: 963517 - DNA, 22 bp, Artificial Sequence
  chemically synthesized
ggacggggcattaattctttca

SEQ ID NO: 963518 - DNA, 22 bp, Artificial Sequence
  chemically synthesized
ccaaatgacgccctagtgaact

SEQ ID NO: 963519 - DNA, 22 bp, Artificial Sequence
  chemically synthesized
gccaaatgacgccctagtgaac

SEQ ID NO: 963520 - DNA, 22 bp, Artificial Sequence
  chemically synthesized
attctttcagttcactagggcg

SEQ ID NO: 963521 - DNA, 22 bp, Artificial Sequence
  chemically synthesized
tttcagttcactagggcgtcat

SEQ ID NO: 963522 - DNA, 22 bp, Artificial Sequence
  chemically synthesized
tcagttcactagggcgtcattt

SEQ ID NO: 963523 - DNA, 22 bp, Artificial Sequence
  chemically synthesized
cagttcactagggcgtcatttg

SEQ ID NO: 963524 - DNA, 22 bp, Artificial Sequence
  chemically synthesized
agttcactagggcgtcatttgg

SEQ ID NO: 963525 - DNA, 22 bp, Artificial Sequence
  chemically synthesized
acatatagtaatttgccaaatg

SEQ ID NO: 963526 - DNA, 22 bp, Artificial Sequence
  chemically synthesized
actagggcgtcatttggcaaat

SEQ ID NO: 963527 - DNA, 22 bp, Artificial Sequence
  chemically synthesized
ctcacatatagtaatttgccaa

SEQ ID NO: 963528 - DNA, 22 bp, Artificial Sequence
  chemically synthesized
gggcgtcatttggcaaattact

SEQ ID NO: 963529 - DNA, 22 bp, Artificial Sequence
  chemically synthesized
ttgctcacatatagtaatttgc

SEQ ID NO: 963530 - DNA, 22 bp, Artificial Sequence
  chemically synthesized
attgctcacatatagtaatttg

SEQ ID NO: 963531 - DNA, 22 bp, Artificial Sequence
  chemically synthesized
atttattgctcacatatagtaa

SEQ ID NO: 963532 - DNA, 22 bp, Artificial Sequence
  chemically synthesized
gatttattgctcacatatagta

SEQ ID NO: 963533 - DNA, 22 bp, Artificial Sequence
  chemically synthesized
tgatttattgctcacatatagt

SEQ ID NO: 963534 - DNA, 22 bp, Artificial Sequence
  chemically synthesized
tttgatttattgctcacatata

SEQ ID NO: 963535 - DNA, 22 bp, Artificial Sequence
  chemically synthesized
ggcaaattactatatgtgagca

SEQ ID NO: 963536 - DNA, 22 bp, Artificial Sequence
  chemically synthesized
gcaaattactatatgtgagcaa

SEQ ID NO: 963537 - DNA, 22 bp, Artificial Sequence
  chemically synthesized
gaactctttgatttattgctca

SEQ ID NO: 963538 - DNA, 22 bp, Artificial Sequence
  chemically synthesized
cgaactctttgatttattgctc

SEQ ID NO: 963539 - DNA, 22 bp, Artificial Sequence
  chemically synthesized
ctatatgtgagcaataaatcaa

SEQ ID NO: 963540 - DNA, 22 bp, Artificial Sequence
  chemically synthesized
tatgtgagcaataaatcaaaga

SEQ ID NO: 963541 - DNA, 22 bp, Artificial Sequence
  chemically synthesized
aaggcatcttcgaactctttga

SEQ ID NO: 963542 - DNA, 22 bp, Artificial Sequence
  chemically synthesized
tcaaggcatcttcgaactcttt

SEQ ID NO: 963543 - DNA, 22 bp, Artificial Sequence
  chemically synthesized
ctcaaggcatcttcgaactctt

SEQ ID NO: 963544 - DNA, 22 bp, Artificial Sequence
  chemically synthesized
gagaatttctcaaggcatcttc

SEQ ID NO: 963545 - DNA, 22 bp, Artificial Sequence
  chemically synthesized
gaagatgccttgagaaattctc

SEQ ID NO: 963546 - DNA, 22 bp, Artificial Sequence
  chemically synthesized
gagaaattctccaggattattc

SEQ ID NO: 963547 - DNA, 22 bp, Artificial Sequence
  chemically synthesized
agaaattctccaggattattct

SEQ ID NO: 963548 - DNA, 22 bp, Artificial Sequence
  chemically synthesized
ccagaaggcaagagaataatcc

SEQ ID NO: 963549 - DNA, 22 bp, Artificial Sequence
  chemically synthesized
accagaaggcaagagaataatc

SEQ ID NO: 963550 - DNA, 22 bp, Artificial Sequence
  chemically synthesized
atttaccagaaggcaagagaat

SEQ ID NO: 963551 - DNA, 22 bp, Artificial Sequence
  chemically synthesized
taatttaccagaaggcaagaga

SEQ ID NO: 963552 - DNA, 22 bp, Artificial Sequence
  chemically synthesized
tccaggattattctcttgcctt

SEQ ID NO: 963553 - DNA, 22 bp, Artificial Sequence
  chemically synthesized
ctaatttaccagaaggcaagag

SEQ ID NO: 963554 - DNA, 22 bp, Artificial Sequence
  chemically synthesized
caggattattctcttgccttct

SEQ ID NO: 963555 - DNA, 22 bp, Artificial Sequence
  chemically synthesized
ttctcttgccttctggtaaatt

SEQ ID NO: 963556 - DNA, 22 bp, Artificial Sequence
  chemically synthesized
tcttgccttctggtaaattaga

SEQ ID NO: 963557 - DNA, 22 bp, Artificial Sequence
  chemically synthesized
aatgtagtatgtttctaattta

SEQ ID NO: 963558 - DNA, 22 bp, Artificial Sequence
  chemically synthesized
ttgccttctggtaaattagaaa

SEQ ID NO: 963559 - DNA, 22 bp, Artificial Sequence
  chemically synthesized
gccttctggtaaattagaaaca

SEQ ID NO: 963560 - DNA, 22 bp, Artificial Sequence
  chemically synthesized
ttgaatgtagtatgtttctaat

SEQ ID NO: 963561 - DNA, 22 bp, Artificial Sequence
  chemically synthesized
ccttctggtaaattagaaacat

SEQ ID NO: 963562 - DNA, 22 bp, Artificial Sequence
  chemically synthesized
ttattgaatgtagtatgtttct

SEQ ID NO: 963563 - DNA, 22 bp, Artificial Sequence
  chemically synthesized
gttattgaatgtagtatgtttc

SEQ ID NO: 963564 - DNA, 22 bp, Artificial Sequence
  chemically synthesized
ctggtaaattagaaacatacta

SEQ ID NO: 963565 - DNA, 22 bp, Artificial Sequence
  chemically synthesized
tggtaaattagaaacatactac

SEQ ID NO: 963566 - DNA, 22 bp, Artificial Sequence
  chemically synthesized
ttgttattgaatgtagtatgtt

SEQ ID NO: 963567 - DNA, 22 bp, Artificial Sequence
  chemically synthesized
gtaaattagaaacatactacat

SEQ ID NO: 963568 - DNA, 22 bp, Artificial Sequence
  chemically synthesized
gaaacatactacattcaataac

SEQ ID NO: 963569 - DNA, 22 bp, Artificial Sequence
  chemically synthesized
cattcaataacaagagtataca

SEQ ID NO: 963570 - DNA, 22 bp, Artificial Sequence
  chemically synthesized
taatataaaatatgtatactct

SEQ ID NO: 963571 - DNA, 22 bp, Artificial Sequence
  chemically synthesized
ataatataaaatatgtatactc

SEQ ID NO: 963572 - DNA, 22 bp, Artificial Sequence
  chemically synthesized
aataacaagagtatacatattt

SEQ ID NO: 963573 - DNA, 22 bp, Artificial Sequence
  chemically synthesized
gccataatgtttataatataaa

SEQ ID NO: 963574 - DNA, 22 bp, Artificial Sequence
  chemically synthesized
agccataatgtttataatataa

SEQ ID NO: 963575 - DNA, 22 bp, Artificial Sequence
  chemically synthesized
tagccataatgtttataatata

SEQ ID NO: 963576 - DNA, 22 bp, Artificial Sequence
  chemically synthesized
ttagccataatgtttataatat

SEQ ID NO: 963577 - DNA, 22 bp, Artificial Sequence
  chemically synthesized
tttagccataatgtttataata

SEQ ID NO: 963578 - DNA, 22 bp, Artificial Sequence
  chemically synthesized
catgattttttagccataatgt

SEQ ID NO: 963579 - DNA, 22 bp, Artificial Sequence
  chemically synthesized
ccatgattttttagccataatg

SEQ ID NO: 963580 - DNA, 22 bp, Artificial Sequence
  chemically synthesized
tatattataaacattatggcta

SEQ ID NO: 963581 - DNA, 22 bp, Artificial Sequence
  chemically synthesized
atattataaacattatggctaa

SEQ ID NO: 963582 - DNA, 22 bp, Artificial Sequence
  chemically synthesized
ttccatgattttttagccataa

SEQ ID NO: 963583 - DNA, 22 bp, Artificial Sequence
  chemically synthesized
tattataaacattatggctaaa

SEQ ID NO: 963584 - DNA, 22 bp, Artificial Sequence
  chemically synthesized
taaacattatggctaaaaaatc

SEQ ID NO: 963585 - DNA, 22 bp, Artificial Sequence
  chemically synthesized
tggctaaaaaatcatggaagaa

SEQ ID NO: 963586 - DNA, 22 bp, Artificial Sequence
  chemically synthesized
taaaataataatagttcttcca

SEQ ID NO: 963587 - DNA, 22 bp, Artificial Sequence
  chemically synthesized
aaaaatcatggaagaactatta

SEQ ID NO: 963588 - DNA, 22 bp, Artificial Sequence
  chemically synthesized
aaaagagggggttgtaaaataa

SEQ ID NO: 963589 - DNA, 22 bp, Artificial Sequence
  chemically synthesized
aaaaagagggggttgtaaaata

SEQ ID NO: 963590 - DNA, 22 bp, Artificial Sequence
  chemically synthesized
ttattattttacaaccccctct

SEQ ID NO: 963591 - DNA, 22 bp, Artificial Sequence
  chemically synthesized
ttattttacaaccccctctttt

SEQ ID NO: 963592 - DNA, 22 bp, Artificial Sequence
  chemically synthesized
ggaaaacatttaaaaagagggg

SEQ ID NO: 963593 - DNA, 22 bp, Artificial Sequence
  chemically synthesized
aggaaaacatttaaaaagaggg

SEQ ID NO: 963594 - DNA, 22 bp, Artificial Sequence
  chemically synthesized
ttttacaaccccctctttttaa

SEQ ID NO: 963595 - DNA, 22 bp, Artificial Sequence
  chemically synthesized
tacaaccccctctttttaaatg

SEQ ID NO: 963596 - DNA, 22 bp, Artificial Sequence
  chemically synthesized
acaaccccctctttttaaatgt

SEQ ID NO: 963597 - DNA, 22 bp, Artificial Sequence
  chemically synthesized
caaccccctctttttaaatgtt

SEQ ID NO: 963598 - DNA, 22 bp, Artificial Sequence
  chemically synthesized
tttttaaatgttttcctaaaca

SEQ ID NO: 963599 - DNA, 22 bp, Artificial Sequence
  chemically synthesized
tttaaatgttttcctaaacata

SEQ ID NO: 963600 - DNA, 22 bp, Artificial Sequence
  chemically synthesized
ttaaatgttttcctaaacatac

SEQ ID NO: 963601 - DNA, 22 bp, Artificial Sequence
  chemically synthesized
taaatgttttcctaaacataca

SEQ ID NO: 963602 - DNA, 22 bp, Artificial Sequence
  chemically synthesized
aaatgttttcctaaacatacat

SEQ ID NO: 963603 - DNA, 22 bp, Artificial Sequence
  chemically synthesized
aatgttttcctaaacatacatg

SEQ ID NO: 963604 - DNA, 22 bp, Artificial Sequence
  chemically synthesized
aaatatacatacataccatgta

SEQ ID NO: 963605 - DNA, 22 bp, Artificial Sequence
  chemically synthesized
gaaatatacatacataccatgt

SEQ ID NO: 963606 - DNA, 22 bp, Artificial Sequence
  chemically synthesized
tcctaaacatacatggtatgta

SEQ ID NO: 963607 - DNA, 22 bp, Artificial Sequence
  chemically synthesized
cctaaacatacatggtatgtat

SEQ ID NO: 963608 - DNA, 22 bp, Artificial Sequence
  chemically synthesized
ctaaacatacatggtatgtatg

SEQ ID NO: 963609 - DNA, 22 bp, Artificial Sequence
  chemically synthesized
aacatacatggtatgtatgtat

SEQ ID NO: 963610 - DNA, 22 bp, Artificial Sequence
  chemically synthesized
acagtttgaaatatacatacat

SEQ ID NO: 963611 - DNA, 22 bp, Artificial Sequence
  chemically synthesized
gacagtttgaaatatacataca

SEQ ID NO: 963612 - DNA, 22 bp, Artificial Sequence
  chemically synthesized
tgacagtttgaaatatacatac

SEQ ID NO: 963613 - DNA, 22 bp, Artificial Sequence
  chemically synthesized
ttgacagtttgaaatatacata

SEQ ID NO: 963614 - DNA, 22 bp, Artificial Sequence
  chemically synthesized
caatccagggatttttgacagt

SEQ ID NO: 963615 - DNA, 22 bp, Artificial Sequence
  chemically synthesized
gcaatccagggatttttgacag

SEQ ID NO: 963616 - DNA, 22 bp, Artificial Sequence
  chemically synthesized
cttgcaatccagggatttttga

SEQ ID NO: 963617 - DNA, 22 bp, Artificial Sequence
  chemically synthesized
acttgcaatccagggatttttg

SEQ ID NO: 963618 - DNA, 22 bp, Artificial Sequence
  chemically synthesized
tacttgcaatccagggattttt

SEQ ID NO: 963619 - DNA, 22 bp, Artificial Sequence
  chemically synthesized
caaactgtcaaaaatccctgga

SEQ ID NO: 963620 - DNA, 22 bp, Artificial Sequence
  chemically synthesized
aaactgtcaaaaatccctggat

SEQ ID NO: 963621 - DNA, 22 bp, Artificial Sequence
  chemically synthesized
aattttacttgcaatccaggga

SEQ ID NO: 963622 - DNA, 22 bp, Artificial Sequence
  chemically synthesized
tcaaaaatccctggattgcaag

SEQ ID NO: 963623 - DNA, 22 bp, Artificial Sequence
  chemically synthesized
caagtgggatagttgaatttta

SEQ ID NO: 963624 - DNA, 22 bp, Artificial Sequence
  chemically synthesized
gcaagtgggatagttgaatttt

SEQ ID NO: 963625 - DNA, 22 bp, Artificial Sequence
  chemically synthesized
tgcaagtgggatagttgaattt

SEQ ID NO: 963626 - DNA, 22 bp, Artificial Sequence
  chemically synthesized
gattgcaagtaaaattcaacta

SEQ ID NO: 963627 - DNA, 22 bp, Artificial Sequence
  chemically synthesized
attttgcaagtgggatagttga

SEQ ID NO: 963628 - DNA, 22 bp, Artificial Sequence
  chemically synthesized
caagtaaaattcaactatccca

SEQ ID NO: 963629 - DNA, 22 bp, Artificial Sequence
  chemically synthesized
acccattcattttgcaagtggg

SEQ ID NO: 963630 - DNA, 22 bp, Artificial Sequence
  chemically synthesized
aactatcccacttgcaaaatga

SEQ ID NO: 963631 - DNA, 22 bp, Artificial Sequence
  chemically synthesized
tcccacttgcaaaatgaatggg

SEQ ID NO: 963632 - DNA, 22 bp, Artificial Sequence
  chemically synthesized
aagtaagaacaattaacccatt

SEQ ID NO: 963633 - DNA, 22 bp, Artificial Sequence
  chemically synthesized
gcaaaatgaatgggttaattgt

SEQ ID NO: 963634 - DNA, 22 bp, Artificial Sequence
  chemically synthesized
caaaatgaatgggttaattgtt

SEQ ID NO: 963635 - DNA, 22 bp, Artificial Sequence
  chemically synthesized
tgagtctaaagtaagaacaatt

SEQ ID NO: 963636 - DNA, 22 bp, Artificial Sequence
  chemically synthesized
atgagtctaaagtaagaacaat

SEQ ID NO: 963637 - DNA, 22 bp, Artificial Sequence
  chemically synthesized
aaaacttatgagtctaaagtaa

SEQ ID NO: 963638 - DNA, 22 bp, Artificial Sequence
  chemically synthesized
gaaaacttatgagtctaaagta

SEQ ID NO: 963639 - DNA, 22 bp, Artificial Sequence
  chemically synthesized
tgaaaacttatgagtctaaagt

SEQ ID NO: 963640 - DNA, 22 bp, Artificial Sequence
  chemically synthesized
tttgaaaacttatgagtctaaa

SEQ ID NO: 963641 - DNA, 22 bp, Artificial Sequence
  chemically synthesized
attgttcttactttagactcat

SEQ ID NO: 963642 - DNA, 22 bp, Artificial Sequence
  chemically synthesized
ttctttgaaaacttatgagtct

SEQ ID NO: 963643 - DNA, 22 bp, Artificial Sequence
  chemically synthesized
ttcttactttagactcataagt

SEQ ID NO: 963644 - DNA, 22 bp, Artificial Sequence
  chemically synthesized
ttactttagactcataagtttt

SEQ ID NO: 963645 - DNA, 22 bp, Artificial Sequence
  chemically synthesized
aattattctttgaaaacttatg

SEQ ID NO: 963646 - DNA, 22 bp, Artificial Sequence
  chemically synthesized
aaattattctttgaaaacttat

SEQ ID NO: 963647 - DNA, 22 bp, Artificial Sequence
  chemically synthesized
actttagactcataagttttca

SEQ ID NO: 963648 - DNA, 22 bp, Artificial Sequence
  chemically synthesized
ctttagactcataagttttcaa

SEQ ID NO: 963649 - DNA, 22 bp, Artificial Sequence
  chemically synthesized
tagactcataagttttcaaaga

SEQ ID NO: 963650 - DNA, 22 bp, Artificial Sequence
  chemically synthesized
agactcataagttttcaaagaa

SEQ ID NO: 963651 - DNA, 22 bp, Artificial Sequence
  chemically synthesized
gactcataagttttcaaagaat

SEQ ID NO: 963652 - DNA, 22 bp, Artificial Sequence
  chemically synthesized
acagtttaaattattctttgaa

SEQ ID NO: 963653 - DNA, 22 bp, Artificial Sequence
  chemically synthesized
aacagtttaaattattctttga

SEQ ID NO: 963654 - DNA, 22 bp, Artificial Sequence
  chemically synthesized
ataagttttcaaagaataattt

SEQ ID NO: 963655 - DNA, 22 bp, Artificial Sequence
  chemically synthesized
aatatttaacagtttaaattat

SEQ ID NO: 963656 - DNA, 22 bp, Artificial Sequence
  chemically synthesized
aaatatttaacagtttaaatta

SEQ ID NO: 963657 - DNA, 22 bp, Artificial Sequence
  chemically synthesized
taaatatttaacagtttaaatt

SEQ ID NO: 963658 - DNA, 22 bp, Artificial Sequence
  chemically synthesized
tcaaagaataatttaaactgtt

SEQ ID NO: 963659 - DNA, 22 bp, Artificial Sequence
  chemically synthesized
ttttaaatatttaacagtttaa

SEQ ID NO: 963660 - DNA, 22 bp, Artificial Sequence
  chemically synthesized
caaagaataatttaaactgtta

SEQ ID NO: 963661 - DNA, 22 bp, Artificial Sequence
  chemically synthesized
gttttaaatatttaacagttta

SEQ ID NO: 963662 - DNA, 22 bp, Artificial Sequence
  chemically synthesized
aaagaataatttaaactgttaa

SEQ ID NO: 963663 - DNA, 22 bp, Artificial Sequence
  chemically synthesized
aaactgttaaatatttaaaaca

SEQ ID NO: 963664 - DNA, 22 bp, Artificial Sequence
  chemically synthesized
aactgttaaatatttaaaacaa

SEQ ID NO: 963665 - DNA, 22 bp, Artificial Sequence
  chemically synthesized
ttaaatatttaaaacaaatata

SEQ ID NO: 963666 - DNA, 22 bp, Artificial Sequence
  chemically synthesized
aatatttaaaacaaatatactt

SEQ ID NO: 963667 - DNA, 22 bp, Artificial Sequence
  chemically synthesized
agtcaccaaataaagtatattt

SEQ ID NO: 963668 - DNA, 22 bp, Artificial Sequence
  chemically synthesized
ttaagtcaccaaataaagtata

SEQ ID NO: 963669 - DNA, 22 bp, Artificial Sequence
  chemically synthesized
aaaacaaatatactttatttgg

SEQ ID NO: 963670 - DNA, 22 bp, Artificial Sequence
  chemically synthesized
tctattaagtcaccaaataaag

SEQ ID NO: 963671 - DNA, 22 bp, Artificial Sequence
  chemically synthesized
aaacaaatatactttatttggt

SEQ ID NO: 963672 - DNA, 22 bp, Artificial Sequence
  chemically synthesized
atctattaagtcaccaaataaa

SEQ ID NO: 963673 - DNA, 22 bp, Artificial Sequence
  chemically synthesized
ttatctattaagtcaccaaata

SEQ ID NO: 963674 - DNA, 22 bp, Artificial Sequence
  chemically synthesized
tcttatctattaagtcaccaaa

SEQ ID NO: 963675 - DNA, 22 bp, Artificial Sequence
  chemically synthesized
ttctcttatctattaagtcacc

SEQ ID NO: 963676 - DNA, 22 bp, Artificial Sequence
  chemically synthesized
tattctcttatctattaagtca

SEQ ID NO: 963677 - DNA, 22 bp, Artificial Sequence
  chemically synthesized
attctattctcttatctattaa

SEQ ID NO: 963678 - DNA, 22 bp, Artificial Sequence
  chemically synthesized
tatttggtgacttaatagataa

SEQ ID NO: 963679 - DNA, 22 bp, Artificial Sequence
  chemically synthesized
atttggtgacttaatagataag

SEQ ID NO: 963680 - DNA, 22 bp, Artificial Sequence
  chemically synthesized
tttggtgacttaatagataaga

SEQ ID NO: 963681 - DNA, 22 bp, Artificial Sequence
  chemically synthesized
ggtgacttaatagataagagaa

SEQ ID NO: 963682 - DNA, 22 bp, Artificial Sequence
  chemically synthesized
gtgacttaatagataagagaat

SEQ ID NO: 963683 - DNA, 22 bp, Artificial Sequence
  chemically synthesized
acaactaattctattctcttat

SEQ ID NO: 963684 - DNA, 22 bp, Artificial Sequence
  chemically synthesized
aatagataagagaatagaatta

SEQ ID NO: 963685 - DNA, 22 bp, Artificial Sequence
  chemically synthesized
atagataagagaatagaattag

SEQ ID NO: 963686 - DNA, 22 bp, Artificial Sequence
  chemically synthesized
gtataaatgttcacaactaatt

SEQ ID NO: 963687 - DNA, 22 bp, Artificial Sequence
  chemically synthesized
attagtataaatgttcacaact

SEQ ID NO: 963688 - DNA, 22 bp, Artificial Sequence
  chemically synthesized
gattagtataaatgttcacaac

SEQ ID NO: 963689 - DNA, 22 bp, Artificial Sequence
  chemically synthesized
tgattagtataaatgttcacaa

SEQ ID NO: 963690 - DNA, 22 bp, Artificial Sequence
  chemically synthesized
ttttgattagtataaatgttca

SEQ ID NO: 963691 - DNA, 22 bp, Artificial Sequence
  chemically synthesized
attattttgattagtataaatg

SEQ ID NO: 963692 - DNA, 22 bp, Artificial Sequence
  chemically synthesized
gttgtgaacatttatactaatc

SEQ ID NO: 963693 - DNA, 22 bp, Artificial Sequence
  chemically synthesized
tgaacatttatactaatcaaaa

SEQ ID NO: 963694 - DNA, 22 bp, Artificial Sequence
  chemically synthesized
aaaatgacagtagttcattatt

SEQ ID NO: 963695 - DNA, 22 bp, Artificial Sequence
  chemically synthesized
atactaatcaaaataatgaact

SEQ ID NO: 963696 - DNA, 22 bp, Artificial Sequence
  chemically synthesized
tactaatcaaaataatgaacta

SEQ ID NO: 963697 - DNA, 22 bp, Artificial Sequence
  chemically synthesized
atcaaaataatgaactactgtc

SEQ ID NO: 963698 - DNA, 22 bp, Artificial Sequence
  chemically synthesized
tataggtgtcaattcaaaatga

SEQ ID NO: 963699 - DNA, 22 bp, Artificial Sequence
  chemically synthesized
atataggtgtcaattcaaaatg

SEQ ID NO: 963700 - DNA, 22 bp, Artificial Sequence
  chemically synthesized
ctgtcattttgaattgacacct

SEQ ID NO: 963701 - DNA, 22 bp, Artificial Sequence
  chemically synthesized
tcattttgaattgacacctata

SEQ ID NO: 963702 - DNA, 22 bp, Artificial Sequence
  chemically synthesized
aatcagaatttatataggtgtc

SEQ ID NO: 963703 - DNA, 22 bp, Artificial Sequence
  chemically synthesized
aaatcagaatttatataggtgt

SEQ ID NO: 963704 - DNA, 22 bp, Artificial Sequence
  chemically synthesized
tgaattgacacctatataaatt

SEQ ID NO: 963705 - DNA, 22 bp, Artificial Sequence
  chemically synthesized
gaattgacacctatataaattc

SEQ ID NO: 963706 - DNA, 22 bp, Artificial Sequence
  chemically synthesized
aattgacacctatataaattct

SEQ ID NO: 963707 - DNA, 22 bp, Artificial Sequence
  chemically synthesized
acacctatataaattctgattt

SEQ ID NO: 963708 - DNA, 22 bp, Artificial Sequence
  chemically synthesized
agatgtaaaaatatgtttaaat

SEQ ID NO: 963709 - DNA, 22 bp, Artificial Sequence
  chemically synthesized
tataaattctgatttaaacata

SEQ ID NO: 963710 - DNA, 22 bp, Artificial Sequence
  chemically synthesized
tgagatgtaaaaatatgtttaa

SEQ ID NO: 963711 - DNA, 22 bp, Artificial Sequence
  chemically synthesized
ctgagatgtaaaaatatgttta

SEQ ID NO: 963712 - DNA, 22 bp, Artificial Sequence
  chemically synthesized
ttctgagatgtaaaaatatgtt

SEQ ID NO: 963713 - DNA, 22 bp, Artificial Sequence
  chemically synthesized
cttctgagatgtaaaaatatgt

SEQ ID NO: 963714 - DNA, 22 bp, Artificial Sequence
  chemically synthesized
tcttctgagatgtaaaaatatg

SEQ ID NO: 963715 - DNA, 22 bp, Artificial Sequence
  chemically synthesized
tttcttctgagatgtaaaaata

SEQ ID NO: 963716 - DNA, 22 bp, Artificial Sequence
  chemically synthesized
tgatttaaacatatttttacat

SEQ ID NO: 963717 - DNA, 22 bp, Artificial Sequence
  chemically synthesized
atttaaacatatttttacatct

SEQ ID NO: 963718 - DNA, 22 bp, Artificial Sequence
  chemically synthesized
tgctctttcttctgagatgtaa

SEQ ID NO: 963719 - DNA, 22 bp, Artificial Sequence
  chemically synthesized
aaacatatttttacatctcaga

SEQ ID NO: 963720 - DNA, 22 bp, Artificial Sequence
  chemically synthesized
aacatatttttacatctcagaa

SEQ ID NO: 963721 - DNA, 22 bp, Artificial Sequence
  chemically synthesized
acgctatgctctttcttctgag

SEQ ID NO: 963722 - DNA, 22 bp, Artificial Sequence
  chemically synthesized
aacgctatgctctttcttctga

SEQ ID NO: 963723 - DNA, 22 bp, Artificial Sequence
  chemically synthesized
ttacatctcagaagaaagagca

SEQ ID NO: 963724 - DNA, 22 bp, Artificial Sequence
  chemically synthesized
tacttaacgctatgctctttct

SEQ ID NO: 963725 - DNA, 22 bp, Artificial Sequence
  chemically synthesized
tacatctcagaagaaagagcat

SEQ ID NO: 963726 - DNA, 22 bp, Artificial Sequence
  chemically synthesized
atacttaacgctatgctctttc

SEQ ID NO: 963727 - DNA, 22 bp, Artificial Sequence
  chemically synthesized
acatctcagaagaaagagcata

SEQ ID NO: 963728 - DNA, 22 bp, Artificial Sequence
  chemically synthesized
catctcagaagaaagagcatag

SEQ ID NO: 963729 - DNA, 22 bp, Artificial Sequence
  chemically synthesized
ttatacttaacgctatgctctt

SEQ ID NO: 963730 - DNA, 22 bp, Artificial Sequence
  chemically synthesized
agaagaaagagcatagcgttaa

SEQ ID NO: 963731 - DNA, 22 bp, Artificial Sequence
  chemically synthesized
aaatgggttcttatacttaacg

SEQ ID NO: 963732 - DNA, 22 bp, Artificial Sequence
  chemically synthesized
tggttgaaatgggttcttatac

SEQ ID NO: 963733 - DNA, 22 bp, Artificial Sequence
  chemically synthesized
tgccaatctatggttgaaatgg

SEQ ID NO: 963734 - DNA, 22 bp, Artificial Sequence
  chemically synthesized
agtataagaacccatttcaacc

SEQ ID NO: 963735 - DNA, 22 bp, Artificial Sequence
  chemically synthesized
ctatgccaatctatggttgaaa

SEQ ID NO: 963736 - DNA, 22 bp, Artificial Sequence
  chemically synthesized
caaccatagattggcatagcaa

SEQ ID NO: 963737 - DNA, 22 bp, Artificial Sequence
  chemically synthesized
aaccatagattggcatagcaat

SEQ ID NO: 963738 - DNA, 22 bp, Artificial Sequence
  chemically synthesized
taagatcagataattgctatgc

SEQ ID NO: 963739 - DNA, 22 bp, Artificial Sequence
  chemically synthesized
ataagatcagataattgctatg

SEQ ID NO: 963740 - DNA, 22 bp, Artificial Sequence
  chemically synthesized
accttataagatcagataattg

SEQ ID NO: 963741 - DNA, 22 bp, Artificial Sequence
  chemically synthesized
aaccttataagatcagataatt

SEQ ID NO: 963742 - DNA, 22 bp, Artificial Sequence
  chemically synthesized
taaccttataagatcagataat

SEQ ID NO: 963743 - DNA, 22 bp, Artificial Sequence
  chemically synthesized
ttaaccttataagatcagataa

SEQ ID NO: 963744 - DNA, 22 bp, Artificial Sequence
  chemically synthesized
gcatagcaattatctgatctta

SEQ ID NO: 963745 - DNA, 22 bp, Artificial Sequence
  chemically synthesized
atatttttaaccttataagatc

SEQ ID NO: 963746 - DNA, 22 bp, Artificial Sequence
  chemically synthesized
tcatatttttaaccttataaga

SEQ ID NO: 963747 - DNA, 22 bp, Artificial Sequence
  chemically synthesized
tctgatcttataaggttaaaaa

SEQ ID NO: 963748 - DNA, 22 bp, Artificial Sequence
  chemically synthesized
atcttataaggttaaaaatatg

SEQ ID NO: 963749 - DNA, 22 bp, Artificial Sequence
  chemically synthesized
tgaaaatgttctcatattttta

SEQ ID NO: 963750 - DNA, 22 bp, Artificial Sequence
  chemically synthesized
ataaggttaaaaatatgagaac

SEQ ID NO: 963751 - DNA, 22 bp, Artificial Sequence
  chemically synthesized
taaggttaaaaatatgagaaca

SEQ ID NO: 963752 - DNA, 22 bp, Artificial Sequence
  chemically synthesized
atatcattatgaaaatgttctc

SEQ ID NO: 963753 - DNA, 22 bp, Artificial Sequence
  chemically synthesized
aatatcattatgaaaatgttct

SEQ ID NO: 963754 - DNA, 22 bp, Artificial Sequence
  chemically synthesized
taatatcattatgaaaatgttc

SEQ ID NO: 963755 - DNA, 22 bp, Artificial Sequence
  chemically synthesized
aaaatatgagaacattttcata

SEQ ID NO: 963756 - DNA, 22 bp, Artificial Sequence
  chemically synthesized
atactttaatatcattatgaaa

SEQ ID NO: 963757 - DNA, 22 bp, Artificial Sequence
  chemically synthesized
attaatactttaatatcattat

SEQ ID NO: 963758 - DNA, 22 bp, Artificial Sequence
  chemically synthesized
ctaattaatactttaatatcat

SEQ ID NO: 963759 - DNA, 22 bp, Artificial Sequence
  chemically synthesized
actaattaatactttaatatca

SEQ ID NO: 963760 - DNA, 22 bp, Artificial Sequence
  chemically synthesized
tactaattaatactttaatatc

SEQ ID NO: 963761 - DNA, 22 bp, Artificial Sequence
  chemically synthesized
ttttactaattaatactttaat

SEQ ID NO: 963762 - DNA, 22 bp, Artificial Sequence
  chemically synthesized
tcataatgatattaaagtatta

SEQ ID NO: 963763 - DNA, 22 bp, Artificial Sequence
  chemically synthesized
cataatgatattaaagtattaa

SEQ ID NO: 963764 - DNA, 22 bp, Artificial Sequence
  chemically synthesized
ataatgatattaaagtattaat

SEQ ID NO: 963765 - DNA, 22 bp, Artificial Sequence
  chemically synthesized
aagtattaattagtaaaatagt

SEQ ID NO: 963766 - DNA, 22 bp, Artificial Sequence
  chemically synthesized
tggaatataatcgagcaactat

SEQ ID NO: 963767 - DNA, 22 bp, Artificial Sequence
  chemically synthesized
atggaatataatcgagcaacta

SEQ ID NO: 963768 - DNA, 22 bp, Artificial Sequence
  chemically synthesized
tatggaatataatcgagcaact

SEQ ID NO: 963769 - DNA, 22 bp, Artificial Sequence
  chemically synthesized
attagtaaaatagttgctcgat

SEQ ID NO: 963770 - DNA, 22 bp, Artificial Sequence
  chemically synthesized
ttatggaatataatcgagcaac

SEQ ID NO: 963771 - DNA, 22 bp, Artificial Sequence
  chemically synthesized
tttttatggaatataatcgagc

SEQ ID NO: 963772 - DNA, 22 bp, Artificial Sequence
  chemically synthesized
gtaaaatagttgctcgattata

SEQ ID NO: 963773 - DNA, 22 bp, Artificial Sequence
  chemically synthesized
tctatttttatggaatataatc

SEQ ID NO: 963774 - DNA, 22 bp, Artificial Sequence
  chemically synthesized
tctatctatttttatggaatat

SEQ ID NO: 963775 - DNA, 22 bp, Artificial Sequence
  chemically synthesized
gtctatctatttttatggaata

SEQ ID NO: 963776 - DNA, 22 bp, Artificial Sequence
  chemically synthesized
tgtctatctatttttatggaat

SEQ ID NO: 963777 - DNA, 22 bp, Artificial Sequence
  chemically synthesized
tttgtctatctatttttatgga

SEQ ID NO: 963778 - DNA, 22 bp, Artificial Sequence
  chemically synthesized
ctcgattatattccataaaaat

SEQ ID NO: 963779 - DNA, 22 bp, Artificial Sequence
  chemically synthesized
ctttgtctatctatttttatgg

SEQ ID NO: 963780 - DNA, 22 bp, Artificial Sequence
  chemically synthesized
tctttgtctatctatttttatg

SEQ ID NO: 963781 - DNA, 22 bp, Artificial Sequence
  chemically synthesized
gattatattccataaaaataga

SEQ ID NO: 963782 - DNA, 22 bp, Artificial Sequence
  chemically synthesized
aaattttctttgtctatctatt

SEQ ID NO: 963783 - DNA, 22 bp, Artificial Sequence
  chemically synthesized
tattccataaaaatagatagac

SEQ ID NO: 963784 - DNA, 22 bp, Artificial Sequence
  chemically synthesized
aaaattttctttgtctatctat

SEQ ID NO: 963785 - DNA, 22 bp, Artificial Sequence
  chemically synthesized
tcttaaaattttctttgtctat

SEQ ID NO: 963786 - DNA, 22 bp, Artificial Sequence
  chemically synthesized
cataaaaatagatagacaaaga

SEQ ID NO: 963787 - DNA, 22 bp, Artificial Sequence
  chemically synthesized
atcttaaaattttctttgtcta

SEQ ID NO: 963788 - DNA, 22 bp, Artificial Sequence
  chemically synthesized
cataggaatttatcttaaaatt

SEQ ID NO: 963789 - DNA, 22 bp, Artificial Sequence
  chemically synthesized
ctacataggaatttatcttaaa

SEQ ID NO: 963790 - DNA, 22 bp, Artificial Sequence
  chemically synthesized
cctactacataggaatttatct

SEQ ID NO: 963791 - DNA, 22 bp, Artificial Sequence
  chemically synthesized
acctactacataggaatttatc

SEQ ID NO: 963792 - DNA, 22 bp, Artificial Sequence
  chemically synthesized
taagataaattcctatgtagta

SEQ ID NO: 963793 - DNA, 22 bp, Artificial Sequence
  chemically synthesized
aagataaattcctatgtagtag

SEQ ID NO: 963794 - DNA, 22 bp, Artificial Sequence
  chemically synthesized
agataaattcctatgtagtagg

SEQ ID NO: 963795 - DNA, 22 bp, Artificial Sequence
  chemically synthesized
agggaaaagtatttacctacta

SEQ ID NO: 963796 - DNA, 22 bp, Artificial Sequence
  chemically synthesized
gagggaaaagtatttacctact

SEQ ID NO: 963797 - DNA, 22 bp, Artificial Sequence
  chemically synthesized
tttgagggaaaagtatttacct

SEQ ID NO: 963798 - DNA, 22 bp, Artificial Sequence
  chemically synthesized
atttgagggaaaagtatttacc

SEQ ID NO: 963799 - DNA, 22 bp, Artificial Sequence
  chemically synthesized
ctatgtagtaggtaaatacttt

SEQ ID NO: 963800 - DNA, 22 bp, Artificial Sequence
  chemically synthesized
ccttatttgagggaaaagtatt

SEQ ID NO: 963801 - DNA, 22 bp, Artificial Sequence
  chemically synthesized
tgtagtaggtaaatacttttcc

SEQ ID NO: 963802 - DNA, 22 bp, Artificial Sequence
  chemically synthesized
atgtattcccttatttgaggga

SEQ ID NO: 963803 - DNA, 22 bp, Artificial Sequence
  chemically synthesized
aatgtattcccttatttgaggg

SEQ ID NO: 963804 - DNA, 22 bp, Artificial Sequence
  chemically synthesized
cttaatgtattcccttatttga

SEQ ID NO: 963805 - DNA, 22 bp, Artificial Sequence
  chemically synthesized
atctccttaatgtattccctta

SEQ ID NO: 963806 - DNA, 22 bp, Artificial Sequence
  chemically synthesized
catctccttaatgtattccctt

SEQ ID NO: 963807 - DNA, 22 bp, Artificial Sequence
  chemically synthesized
ttccctcaaataagggaataca

SEQ ID NO: 963808 - DNA, 22 bp, Artificial Sequence
  chemically synthesized
tcatctccttaatgtattccct

SEQ ID NO: 963809 - DNA, 22 bp, Artificial Sequence
  chemically synthesized
tccctcaaataagggaatacat

SEQ ID NO: 963810 - DNA, 22 bp, Artificial Sequence
  chemically synthesized
ttcatctccttaatgtattccc

SEQ ID NO: 963811 - DNA, 22 bp, Artificial Sequence
  chemically synthesized
ccctcaaataagggaatacatt

SEQ ID NO: 963812 - DNA, 22 bp, Artificial Sequence
  chemically synthesized
cctcaaataagggaatacatta

SEQ ID NO: 963813 - DNA, 22 bp, Artificial Sequence
  chemically synthesized
aaataagggaatacattaagga

SEQ ID NO: 963814 - DNA, 22 bp, Artificial Sequence
  chemically synthesized
agaatttttcatctccttaatg

SEQ ID NO: 963815 - DNA, 22 bp, Artificial Sequence
  chemically synthesized
gagaatttttcatctccttaat

SEQ ID NO: 963816 - DNA, 22 bp, Artificial Sequence
  chemically synthesized
aggagatgaaaaattctcaaac

SEQ ID NO: 963817 - DNA, 22 bp, Artificial Sequence
  chemically synthesized
taaaatgaaaaagtttgagaat

SEQ ID NO: 963818 - DNA, 22 bp, Artificial Sequence
  chemically synthesized
ataaaatgaaaaagtttgagaa

SEQ ID NO: 963819 - DNA, 22 bp, Artificial Sequence
  chemically synthesized
tttataaaatgaaaaagtttga

SEQ ID NO: 963820 - DNA, 22 bp, Artificial Sequence
  chemically synthesized
atttataaaatgaaaaagtttg

SEQ ID NO: 963821 - DNA, 22 bp, Artificial Sequence
  chemically synthesized
ttatttataaaatgaaaaagtt

SEQ ID NO: 963822 - DNA, 22 bp, Artificial Sequence
  chemically synthesized
cttatttataaaatgaaaaagt

SEQ ID NO: 963823 - DNA, 22 bp, Artificial Sequence
  chemically synthesized
tcttatttataaaatgaaaaag

SEQ ID NO: 963824 - DNA, 22 bp, Artificial Sequence
  chemically synthesized
ttcttatttataaaatgaaaaa

SEQ ID NO: 963825 - DNA, 22 bp, Artificial Sequence
  chemically synthesized
tttcttatttataaaatgaaaa

SEQ ID NO: 963826 - DNA, 22 bp, Artificial Sequence
  chemically synthesized
ttttcttatttataaaatgaaa

SEQ ID NO: 963827 - DNA, 22 bp, Artificial Sequence
  chemically synthesized
tttttttcttatttataaaatg

SEQ ID NO: 963828 - DNA, 22 bp, Artificial Sequence
  chemically synthesized
tcaaactttttcattttataaa

SEQ ID NO: 963829 - DNA, 22 bp, Artificial Sequence
  chemically synthesized
aaactttttcattttataaata

SEQ ID NO: 963830 - DNA, 22 bp, Artificial Sequence
  chemically synthesized
attatttttttcttatttataa

SEQ ID NO: 963831 - DNA, 22 bp, Artificial Sequence
  chemically synthesized
tttcattttataaataagaaaa

SEQ ID NO: 963832 - DNA, 22 bp, Artificial Sequence
  chemically synthesized
ttcattttataaataagaaaaa

SEQ ID NO: 963833 - DNA, 22 bp, Artificial Sequence
  chemically synthesized
tcattttataaataagaaaaaa

SEQ ID NO: 963834 - DNA, 22 bp, Artificial Sequence
  chemically synthesized
cattttataaataagaaaaaaa

SEQ ID NO: 963835 - DNA, 22 bp, Artificial Sequence
  chemically synthesized
tatggttgattatttttttctt

SEQ ID NO: 963836 - DNA, 22 bp, Artificial Sequence
  chemically synthesized
attttataaataagaaaaaaat

SEQ ID NO: 963837 - DNA, 22 bp, Artificial Sequence
  chemically synthesized
atatggttgattatttttttct

SEQ ID NO: 963838 - DNA, 22 bp, Artificial Sequence
  chemically synthesized
tatatggttgattatttttttc

SEQ ID NO: 963839 - DNA, 22 bp, Artificial Sequence
  chemically synthesized
ttatatggttgattattttttt

SEQ ID NO: 963840 - DNA, 22 bp, Artificial Sequence
  chemically synthesized
tataaataagaaaaaaataatc

SEQ ID NO: 963841 - DNA, 22 bp, Artificial Sequence
  chemically synthesized
ataaataagaaaaaaataatca

SEQ ID NO: 963842 - DNA, 22 bp, Artificial Sequence
  chemically synthesized
taaataagaaaaaaataatcaa

SEQ ID NO: 963843 - DNA, 22 bp, Artificial Sequence
  chemically synthesized
atgtcatgtggtttttatatgg

SEQ ID NO: 963844 - DNA, 22 bp, Artificial Sequence
  chemically synthesized
gatgtcatgtggtttttatatg

SEQ ID NO: 963845 - DNA, 22 bp, Artificial Sequence
  chemically synthesized
tgatgtcatgtggtttttatat

SEQ ID NO: 963846 - DNA, 22 bp, Artificial Sequence
  chemically synthesized
ttgatgtcatgtggtttttata

SEQ ID NO: 963847 - DNA, 22 bp, Artificial Sequence
  chemically synthesized
tagcttttgatgtcatgtggtt

SEQ ID NO: 963848 - DNA, 22 bp, Artificial Sequence
  chemically synthesized
gaactatagcttttgatgtcat

SEQ ID NO: 963849 - DNA, 22 bp, Artificial Sequence
  chemically synthesized
agaactatagcttttgatgtca

SEQ ID NO: 963850 - DNA, 22 bp, Artificial Sequence
  chemically synthesized
gcatttagaactatagcttttg

SEQ ID NO: 963851 - DNA, 22 bp, Artificial Sequence
  chemically synthesized
tggctagcatttagaactatag

SEQ ID NO: 963852 - DNA, 22 bp, Artificial Sequence
  chemically synthesized
tatggctagcatttagaactat

SEQ ID NO: 963853 - DNA, 22 bp, Artificial Sequence
  chemically synthesized
ctatggctagcatttagaacta

SEQ ID NO: 963854 - DNA, 22 bp, Artificial Sequence
  chemically synthesized
tagttctaaatgctagccatag

SEQ ID NO: 963855 - DNA, 22 bp, Artificial Sequence
  chemically synthesized
taaatgctagccatagaaatgc

SEQ ID NO: 963856 - DNA, 22 bp, Artificial Sequence
  chemically synthesized
aatgctagccatagaaatgcat

SEQ ID NO: 963857 - DNA, 22 bp, Artificial Sequence
  chemically synthesized
gccatagaaatgcatgattata

SEQ ID NO: 963858 - DNA, 22 bp, Artificial Sequence
  chemically synthesized
tgaacagataaatagtatcata

SEQ ID NO: 963859 - DNA, 22 bp, Artificial Sequence
  chemically synthesized
atgaacagataaatagtatcat

SEQ ID NO: 963860 - DNA, 22 bp, Artificial Sequence
  chemically synthesized
tattatgatactatttatctgt

SEQ ID NO: 963861 - DNA, 22 bp, Artificial Sequence
  chemically synthesized
tgatactatttatctgttcata

SEQ ID NO: 963862 - DNA, 22 bp, Artificial Sequence
  chemically synthesized
gggaggcaggtcatgtttatga

SEQ ID NO: 963863 - DNA, 22 bp, Artificial Sequence
  chemically synthesized
tttatctgttcataaacatgac

SEQ ID NO: 963864 - DNA, 22 bp, Artificial Sequence
  chemically synthesized
cactggggaggcaggtcatgtt

SEQ ID NO: 963865 - DNA, 22 bp, Artificial Sequence
  chemically synthesized
atctgttcataaacatgacctg

SEQ ID NO: 963866 - DNA, 22 bp, Artificial Sequence
  chemically synthesized
tctgttcataaacatgacctgc

SEQ ID NO: 963867 - DNA, 22 bp, Artificial Sequence
  chemically synthesized
ttcataaacatgacctgcctcc

SEQ ID NO: 963868 - DNA, 22 bp, Artificial Sequence
  chemically synthesized
aaattgcactggggaggcaggt

SEQ ID NO: 963869 - DNA, 22 bp, Artificial Sequence
  chemically synthesized
ataaacatgacctgcctcccca

SEQ ID NO: 963870 - DNA, 22 bp, Artificial Sequence
  chemically synthesized
gtcctaaaattgcactggggag

SEQ ID NO: 963871 - DNA, 22 bp, Artificial Sequence
  chemically synthesized
attggtcctaaaattgcactgg

SEQ ID NO: 963872 - DNA, 22 bp, Artificial Sequence
  chemically synthesized
cattggtcctaaaattgcactg

SEQ ID NO: 963873 - DNA, 22 bp, Artificial Sequence
  chemically synthesized
tcattggtcctaaaattgcact

SEQ ID NO: 963874 - DNA, 22 bp, Artificial Sequence
  chemically synthesized
ttcattggtcctaaaattgcac

SEQ ID NO: 963875 - DNA, 22 bp, Artificial Sequence
  chemically synthesized
cttttcattggtcctaaaattg

SEQ ID NO: 963876 - DNA, 22 bp, Artificial Sequence
  chemically synthesized
cctccccagtgcaattttagga

SEQ ID NO: 963877 - DNA, 22 bp, Artificial Sequence
  chemically synthesized
cccagtgcaattttaggaccaa

SEQ ID NO: 963878 - DNA, 22 bp, Artificial Sequence
  chemically synthesized
aaaggatgtaggatctcctttt

SEQ ID NO: 963879 - DNA, 22 bp, Artificial Sequence
  chemically synthesized
taggaccaatgaaaaggagatc

SEQ ID NO: 963880 - DNA, 22 bp, Artificial Sequence
  chemically synthesized
aaaaggatgtaggatctccttt

SEQ ID NO: 963881 - DNA, 22 bp, Artificial Sequence
  chemically synthesized
aggaccaatgaaaaggagatcc

SEQ ID NO: 963882 - DNA, 22 bp, Artificial Sequence
  chemically synthesized
ggaccaatgaaaaggagatcct

SEQ ID NO: 963883 - DNA, 22 bp, Artificial Sequence
  chemically synthesized
ggggaaatttaaaaggatgtag

SEQ ID NO: 963884 - DNA, 22 bp, Artificial Sequence
  chemically synthesized
gggttcggggaaatttaaaagg

SEQ ID NO: 963885 - DNA, 22 bp, Artificial Sequence
  chemically synthesized
catccttttaaatttccccgaa

SEQ ID NO: 963886 - DNA, 22 bp, Artificial Sequence
  chemically synthesized
ccatgcactagggttcggggaa

SEQ ID NO: 963887 - DNA, 22 bp, Artificial Sequence
  chemically synthesized
ttcccatgcactagggttcggg

SEQ ID NO: 963888 - DNA, 22 bp, Artificial Sequence
  chemically synthesized
ttaaatttccccgaaccctagt

SEQ ID NO: 963889 - DNA, 22 bp, Artificial Sequence
  chemically synthesized
taaatttccccgaaccctagtg

SEQ ID NO: 963890 - DNA, 22 bp, Artificial Sequence
  chemically synthesized
aaatttccccgaaccctagtgc

SEQ ID NO: 963891 - DNA, 22 bp, Artificial Sequence
  chemically synthesized
aatttccccgaaccctagtgca

SEQ ID NO: 963892 - DNA, 22 bp, Artificial Sequence
  chemically synthesized
tatattgttcccatgcactagg

SEQ ID NO: 963893 - DNA, 22 bp, Artificial Sequence
  chemically synthesized
ccccgaaccctagtgcatggga

SEQ ID NO: 963894 - DNA, 22 bp, Artificial Sequence
  chemically synthesized
cccgaaccctagtgcatgggaa

SEQ ID NO: 963895 - DNA, 22 bp, Artificial Sequence
  chemically synthesized
agaaaatactgtatattgttcc

SEQ ID NO: 963896 - DNA, 22 bp, Artificial Sequence
  chemically synthesized
tgagaaaatactgtatattgtt

SEQ ID NO: 963897 - DNA, 22 bp, Artificial Sequence
  chemically synthesized
gtgcatgggaacaatatacagt

SEQ ID NO: 963898 - DNA, 22 bp, Artificial Sequence
  chemically synthesized
ttctgagaaaatactgtatatt

SEQ ID NO: 963899 - DNA, 22 bp, Artificial Sequence
  chemically synthesized
attctgagaaaatactgtatat

SEQ ID NO: 963900 - DNA, 22 bp, Artificial Sequence
  chemically synthesized
tattctgagaaaatactgtata

SEQ ID NO: 963901 - DNA, 22 bp, Artificial Sequence
  chemically synthesized
ttattctgagaaaatactgtat

SEQ ID NO: 963902 - DNA, 22 bp, Artificial Sequence
  chemically synthesized
atttttattctgagaaaatact

SEQ ID NO: 963903 - DNA, 22 bp, Artificial Sequence
  chemically synthesized
atcatcctgatttttattctga

SEQ ID NO: 963904 - DNA, 22 bp, Artificial Sequence
  chemically synthesized
catcatcctgatttttattctg

SEQ ID NO: 963905 - DNA, 22 bp, Artificial Sequence
  chemically synthesized
ttcatcatcctgatttttattc

SEQ ID NO: 963906 - DNA, 22 bp, Artificial Sequence
  chemically synthesized
cttcatcatcctgatttttatt

SEQ ID NO: 963907 - DNA, 22 bp, Artificial Sequence
  chemically synthesized
tctcagaataaaaatcaggatg

SEQ ID NO: 963908 - DNA, 22 bp, Artificial Sequence
  chemically synthesized
ctcagaataaaaatcaggatga

SEQ ID NO: 963909 - DNA, 22 bp, Artificial Sequence
  chemically synthesized
tcagaataaaaatcaggatgat

SEQ ID NO: 963910 - DNA, 22 bp, Artificial Sequence
  chemically synthesized
agaataaaaatcaggatgatga

SEQ ID NO: 963911 - DNA, 22 bp, Artificial Sequence
  chemically synthesized
catagtaaacgccgtttcttca

SEQ ID NO: 963912 - DNA, 22 bp, Artificial Sequence
  chemically synthesized
gcatagtaaacgccgtttcttc

SEQ ID NO: 963913 - DNA, 22 bp, Artificial Sequence
  chemically synthesized
agcccttgcatagtaaacgccg

SEQ ID NO: 963914 - DNA, 22 bp, Artificial Sequence
  chemically synthesized
tattcagcccttgcatagtaaa

SEQ ID NO: 963915 - DNA, 22 bp, Artificial Sequence
  chemically synthesized
gtattcagcccttgcatagtaa

SEQ ID NO: 963916 - DNA, 22 bp, Artificial Sequence
  chemically synthesized
tgtattcagcccttgcatagta

SEQ ID NO: 963917 - DNA, 22 bp, Artificial Sequence
  chemically synthesized
cctttgtattcagcccttgcat

SEQ ID NO: 963918 - DNA, 22 bp, Artificial Sequence
  chemically synthesized
atctccctttgtattcagccct

SEQ ID NO: 963919 - DNA, 22 bp, Artificial Sequence
  chemically synthesized
actatgcaagggctgaatacaa

SEQ ID NO: 963920 - DNA, 22 bp, Artificial Sequence
  chemically synthesized
ctatgcaagggctgaatacaaa

SEQ ID NO: 963921 - DNA, 22 bp, Artificial Sequence
  chemically synthesized
tgcaagggctgaatacaaaggg

SEQ ID NO: 963922 - DNA, 22 bp, Artificial Sequence
  chemically synthesized
caaacagtccactaatctccct

SEQ ID NO: 963923 - DNA, 22 bp, Artificial Sequence
  chemically synthesized
ccaaacagtccactaatctccc

SEQ ID NO: 963924 - DNA, 22 bp, Artificial Sequence
  chemically synthesized
tccaaacagtccactaatctcc

SEQ ID NO: 963925 - DNA, 22 bp, Artificial Sequence
  chemically synthesized
ttccaaacagtccactaatctc

SEQ ID NO: 963926 - DNA, 22 bp, Artificial Sequence
  chemically synthesized
tttccaaacagtccactaatct

SEQ ID NO: 963927 - DNA, 22 bp, Artificial Sequence
  chemically synthesized
aatacaaagggagattagtgga

SEQ ID NO: 963928 - DNA, 22 bp, Artificial Sequence
  chemically synthesized
tttttccaaacagtccactaat

SEQ ID NO: 963929 - DNA, 22 bp, Artificial Sequence
  chemically synthesized
tctttttccaaacagtccacta

SEQ ID NO: 963930 - DNA, 22 bp, Artificial Sequence
  chemically synthesized
gtggactgtttggaaaaagaga

SEQ ID NO: 963931 - DNA, 22 bp, Artificial Sequence
  chemically synthesized
tttggaaaaagagaatgattat

SEQ ID NO: 963932 - DNA, 22 bp, Artificial Sequence
  chemically synthesized
aagtaaacagtaataatcattc

SEQ ID NO: 963933 - DNA, 22 bp, Artificial Sequence
  chemically synthesized
aaagtaaacagtaataatcatt

SEQ ID NO: 963934 - DNA, 22 bp, Artificial Sequence
  chemically synthesized
ggaaaaagagaatgattattac

SEQ ID NO: 963935 - DNA, 22 bp, Artificial Sequence
  chemically synthesized
gaaaaagagaatgattattact

SEQ ID NO: 963936 - DNA, 22 bp, Artificial Sequence
  chemically synthesized
tgtcttaaagtaaacagtaata

SEQ ID NO: 963937 - DNA, 22 bp, Artificial Sequence
  chemically synthesized
atgtcttaaagtaaacagtaat

SEQ ID NO: 963938 - DNA, 22 bp, Artificial Sequence
  chemically synthesized
tatgtcttaaagtaaacagtaa

SEQ ID NO: 963939 - DNA, 22 bp, Artificial Sequence
  chemically synthesized
actttatgtcttaaagtaaaca

SEQ ID NO: 963940 - DNA, 22 bp, Artificial Sequence
  chemically synthesized
tgactttatgtcttaaagtaaa

SEQ ID NO: 963941 - DNA, 22 bp, Artificial Sequence
  chemically synthesized
ctgactttatgtcttaaagtaa

SEQ ID NO: 963942 - DNA, 22 bp, Artificial Sequence
  chemically synthesized
ttactgtttactttaagacata

SEQ ID NO: 963943 - DNA, 22 bp, Artificial Sequence
  chemically synthesized
tagtttctgactttatgtctta

SEQ ID NO: 963944 - DNA, 22 bp, Artificial Sequence
  chemically synthesized
ctgtttactttaagacataaag

SEQ ID NO: 963945 - DNA, 22 bp, Artificial Sequence
  chemically synthesized
tttactttaagacataaagtca

SEQ ID NO: 963946 - DNA, 22 bp, Artificial Sequence
  chemically synthesized
actttaagacataaagtcagaa

SEQ ID NO: 963947 - DNA, 22 bp, Artificial Sequence
  chemically synthesized
ctttaagacataaagtcagaaa

SEQ ID NO: 963948 - DNA, 22 bp, Artificial Sequence
  chemically synthesized
taagacataaagtcagaaacta

SEQ ID NO: 963949 - DNA, 22 bp, Artificial Sequence
  chemically synthesized
tcacacaggctatagtttctga

SEQ ID NO: 963950 - DNA, 22 bp, Artificial Sequence
  chemically synthesized
aagacataaagtcagaaactat

SEQ ID NO: 963951 - DNA, 22 bp, Artificial Sequence
  chemically synthesized
agacataaagtcagaaactata

SEQ ID NO: 963952 - DNA, 22 bp, Artificial Sequence
  chemically synthesized
tagcctgtgtgacaactcgcat

SEQ ID NO: 963953 - DNA, 22 bp, Artificial Sequence
  chemically synthesized
tgtgacaactcgcatttgctgc

SEQ ID NO: 963954 - DNA, 22 bp, Artificial Sequence
  chemically synthesized
tgtgccatacgcacacaggcag

SEQ ID NO: 963955 - DNA, 22 bp, Artificial Sequence
  chemically synthesized
gtgtgccatacgcacacaggca

SEQ ID NO: 963956 - DNA, 22 bp, Artificial Sequence
  chemically synthesized
gcatttgctgcctgtgtgcgta

SEQ ID NO: 963957 - DNA, 22 bp, Artificial Sequence
  chemically synthesized
gcttgtgtgccatacgcacaca

SEQ ID NO: 963958 - DNA, 22 bp, Artificial Sequence
  chemically synthesized
agcttgtgtgccatacgcacac

SEQ ID NO: 963959 - DNA, 22 bp, Artificial Sequence
  chemically synthesized
ttagcttgtgtgccatacgcac

SEQ ID NO: 963960 - DNA, 22 bp, Artificial Sequence
  chemically synthesized
gctgcctgtgtgcgtatggcac

SEQ ID NO: 963961 - DNA, 22 bp, Artificial Sequence
  chemically synthesized
ctgcctgtgtgcgtatggcaca

SEQ ID NO: 963962 - DNA, 22 bp, Artificial Sequence
  chemically synthesized
cctgtgtgcgtatggcacacaa

SEQ ID NO: 963963 - DNA, 22 bp, Artificial Sequence
  chemically synthesized
tgtgcgtatggcacacaagcta

SEQ ID NO: 963964 - DNA, 22 bp, Artificial Sequence
  chemically synthesized
atatgtaaatcccattcttagc

SEQ ID NO: 963965 - DNA, 22 bp, Artificial Sequence
  chemically synthesized
aatatgtaaatcccattcttag

SEQ ID NO: 963966 - DNA, 22 bp, Artificial Sequence
  chemically synthesized
cccaaccatttaatatgtaaat

SEQ ID NO: 963967 - DNA, 22 bp, Artificial Sequence
  chemically synthesized
tccccaaccatttaatatgtaa

SEQ ID NO: 963968 - DNA, 22 bp, Artificial Sequence
  chemically synthesized
ctccccaaccatttaatatgta

SEQ ID NO: 963969 - DNA, 22 bp, Artificial Sequence
  chemically synthesized
agaatgggatttacatattaaa

SEQ ID NO: 963970 - DNA, 22 bp, Artificial Sequence
  chemically synthesized
atttctccccaaccatttaata

SEQ ID NO: 963971 - DNA, 22 bp, Artificial Sequence
  chemically synthesized
gatttctccccaaccatttaat

SEQ ID NO: 963972 - DNA, 22 bp, Artificial Sequence
  chemically synthesized
tgatttctccccaaccatttaa

SEQ ID NO: 963973 - DNA, 22 bp, Artificial Sequence
  chemically synthesized
ttgatttctccccaaccattta

SEQ ID NO: 963974 - DNA, 22 bp, Artificial Sequence
  chemically synthesized
ttttgatttctccccaaccatt

SEQ ID NO: 963975 - DNA, 22 bp, Artificial Sequence
  chemically synthesized
ttcttttgatttctccccaacc

SEQ ID NO: 963976 - DNA, 22 bp, Artificial Sequence
  chemically synthesized
acatattaaatggttggggaga

SEQ ID NO: 963977 - DNA, 22 bp, Artificial Sequence
  chemically synthesized
catattaaatggttggggagaa

SEQ ID NO: 963978 - DNA, 22 bp, Artificial Sequence
  chemically synthesized
tattattcttttgatttctccc

SEQ ID NO: 963979 - DNA, 22 bp, Artificial Sequence
  chemically synthesized
aatggttggggagaaatcaaaa

SEQ ID NO: 963980 - DNA, 22 bp, Artificial Sequence
  chemically synthesized
caaagttgtattattcttttga

SEQ ID NO: 963981 - DNA, 22 bp, Artificial Sequence
  chemically synthesized
gggagaaatcaaaagaataata

SEQ ID NO: 963982 - DNA, 22 bp, Artificial Sequence
  chemically synthesized
tgtgttgcaaagttgtattatt

SEQ ID NO: 963983 - DNA, 22 bp, Artificial Sequence
  chemically synthesized
atgtgttgcaaagttgtattat

SEQ ID NO: 963984 - DNA, 22 bp, Artificial Sequence
  chemically synthesized
tatgtgttgcaaagttgtatta

SEQ ID NO: 963985 - DNA, 22 bp, Artificial Sequence
  chemically synthesized
ttatgtgttgcaaagttgtatt

SEQ ID NO: 963986 - DNA, 22 bp, Artificial Sequence
  chemically synthesized
gatatcgtataatttttatgtg

SEQ ID NO: 963987 - DNA, 22 bp, Artificial Sequence
  chemically synthesized
ggatatcgtataatttttatgt

SEQ ID NO: 963988 - DNA, 22 bp, Artificial Sequence
  chemically synthesized
tgcaacacataaaaattatacg

SEQ ID NO: 963989 - DNA, 22 bp, Artificial Sequence
  chemically synthesized
gcaacacataaaaattatacga

SEQ ID NO: 963990 - DNA, 22 bp, Artificial Sequence
  chemically synthesized
caacacataaaaattatacgat

SEQ ID NO: 963991 - DNA, 22 bp, Artificial Sequence
  chemically synthesized
cgcacagagaaatttggatatc

SEQ ID NO: 963992 - DNA, 22 bp, Artificial Sequence
  chemically synthesized
acgcacagagaaatttggatat

SEQ ID NO: 963993 - DNA, 22 bp, Artificial Sequence
  chemically synthesized
tacgcacagagaaatttggata

SEQ ID NO: 963994 - DNA, 22 bp, Artificial Sequence
  chemically synthesized
tacgatatccaaatttctctgt

SEQ ID NO: 963995 - DNA, 22 bp, Artificial Sequence
  chemically synthesized
gcaaactttacgcacagagaaa

SEQ ID NO: 963996 - DNA, 22 bp, Artificial Sequence
  chemically synthesized
ctagcaaactttacgcacagag

SEQ ID NO: 963997 - DNA, 22 bp, Artificial Sequence
  chemically synthesized
ttcctagcaaactttacgcaca

SEQ ID NO: 963998 - DNA, 22 bp, Artificial Sequence
  chemically synthesized
gttcctagcaaactttacgcac

SEQ ID NO: 963999 - DNA, 22 bp, Artificial Sequence
  chemically synthesized
tgttcctagcaaactttacgca

SEQ ID NO: 964000 - DNA, 22 bp, Artificial Sequence
  chemically synthesized
ctctgtgcgtaaagtttgctag

SEQ ID NO: 964001 - DNA, 22 bp, Artificial Sequence
  chemically synthesized
tctgtgcgtaaagtttgctagg

SEQ ID NO: 964002 - DNA, 22 bp, Artificial Sequence
  chemically synthesized
tgtgcgtaaagtttgctaggaa

SEQ ID NO: 964003 - DNA, 22 bp, Artificial Sequence
  chemically synthesized
tgcgtaaagtttgctaggaaca

SEQ ID NO: 964004 - DNA, 22 bp, Artificial Sequence
  chemically synthesized
aatgagcatggttttgttccta

SEQ ID NO: 964005 - DNA, 22 bp, Artificial Sequence
  chemically synthesized
gctaggaacaaaaccatgctca

SEQ ID NO: 964006 - DNA, 22 bp, Artificial Sequence
  chemically synthesized
ctaggaacaaaaccatgctcat

SEQ ID NO: 964007 - DNA, 22 bp, Artificial Sequence
  chemically synthesized
ggaacaaaaccatgctcattca

SEQ ID NO: 964008 - DNA, 22 bp, Artificial Sequence
  chemically synthesized
tagtatgaaagcagacaataca

SEQ ID NO: 964009 - DNA, 22 bp, Artificial Sequence
  chemically synthesized
attcaggtatgtattgtctgct

SEQ ID NO: 964010 - DNA, 22 bp, Artificial Sequence
  chemically synthesized
ttgtagtatgaaagcagacaat

SEQ ID NO: 964011 - DNA, 22 bp, Artificial Sequence
  chemically synthesized
aggtatgtattgtctgctttca

SEQ ID NO: 964012 - DNA, 22 bp, Artificial Sequence
  chemically synthesized
cgctgttgtagtatgaaagcag

SEQ ID NO: 964013 - DNA, 22 bp, Artificial Sequence
  chemically synthesized
aactacgctgttgtagtatgaa

SEQ ID NO: 964014 - DNA, 22 bp, Artificial Sequence
  chemically synthesized
ctcaactacgctgttgtagtat

SEQ ID NO: 964015 - DNA, 22 bp, Artificial Sequence
  chemically synthesized
tctgctttcatactacaacagc

SEQ ID NO: 964016 - DNA, 22 bp, Artificial Sequence
  chemically synthesized
ctttcatactacaacagcgtag

SEQ ID NO: 964017 - DNA, 22 bp, Artificial Sequence
  chemically synthesized
tcgcaattactcaactacgctg

SEQ ID NO: 964018 - DNA, 22 bp, Artificial Sequence
  chemically synthesized
tcatactacaacagcgtagttg

SEQ ID NO: 964019 - DNA, 22 bp, Artificial Sequence
  chemically synthesized
gtcgcaattactcaactacgct

SEQ ID NO: 964020 - DNA, 22 bp, Artificial Sequence
  chemically synthesized
catactacaacagcgtagttga

SEQ ID NO: 964021 - DNA, 22 bp, Artificial Sequence
  chemically synthesized
tgtcgcaattactcaactacgc

SEQ ID NO: 964022 - DNA, 22 bp, Artificial Sequence
  chemically synthesized
atactacaacagcgtagttgag

SEQ ID NO: 964023 - DNA, 22 bp, Artificial Sequence
  chemically synthesized
caacagcgtagttgagtaattg

SEQ ID NO: 964024 - DNA, 22 bp, Artificial Sequence
  chemically synthesized
tcgtctttgtcgcaattactca

SEQ ID NO: 964025 - DNA, 22 bp, Artificial Sequence
  chemically synthesized
gtcgtctttgtcgcaattactc

SEQ ID NO: 964026 - DNA, 22 bp, Artificial Sequence
  chemically synthesized
ggcttgtcgtctttgtcgcaat

SEQ ID NO: 964027 - DNA, 22 bp, Artificial Sequence
  chemically synthesized
aggcttgtcgtctttgtcgcaa

SEQ ID NO: 964028 - DNA, 22 bp, Artificial Sequence
  chemically synthesized
taggcttgtcgtctttgtcgca

SEQ ID NO: 964029 - DNA, 22 bp, Artificial Sequence
  chemically synthesized
agtaattgcgacaaagacgaca

SEQ ID NO: 964030 - DNA, 22 bp, Artificial Sequence
  chemically synthesized
gtaaatattttaggcttgtcgt

SEQ ID NO: 964031 - DNA, 22 bp, Artificial Sequence
  chemically synthesized
cgacaaagacgacaagcctaaa

SEQ ID NO: 964032 - DNA, 22 bp, Artificial Sequence
  chemically synthesized
gttagtaaatattttaggcttg

SEQ ID NO: 964033 - DNA, 22 bp, Artificial Sequence
  chemically synthesized
aagggctagttagtaaatattt

SEQ ID NO: 964034 - DNA, 22 bp, Artificial Sequence
  chemically synthesized
gaagggctagttagtaaatatt

SEQ ID NO: 964035 - DNA, 22 bp, Artificial Sequence
  chemically synthesized
tgaagggctagttagtaaatat

SEQ ID NO: 964036 - DNA, 22 bp, Artificial Sequence
  chemically synthesized
tttgaagggctagttagtaaat

SEQ ID NO: 964037 - DNA, 22 bp, Artificial Sequence
  chemically synthesized
ctttgaagggctagttagtaaa

SEQ ID NO: 964038 - DNA, 22 bp, Artificial Sequence
  chemically synthesized
tctttgaagggctagttagtaa

SEQ ID NO: 964039 - DNA, 22 bp, Artificial Sequence
  chemically synthesized
ttctttgaagggctagttagta

SEQ ID NO: 964040 - DNA, 22 bp, Artificial Sequence
  chemically synthesized
tttctttgaagggctagttagt

SEQ ID NO: 964041 - DNA, 22 bp, Artificial Sequence
  chemically synthesized
ttttctttgaagggctagttag

SEQ ID NO: 964042 - DNA, 22 bp, Artificial Sequence
  chemically synthesized
aaatatttactaactagccctt

SEQ ID NO: 964043 - DNA, 22 bp, Artificial Sequence
  chemically synthesized
actaactagcccttcaaagaaa

SEQ ID NO: 964044 - DNA, 22 bp, Artificial Sequence
  chemically synthesized
ctaactagcccttcaaagaaaa

SEQ ID NO: 964045 - DNA, 22 bp, Artificial Sequence
  chemically synthesized
actagcccttcaaagaaaaaag

SEQ ID NO: 964046 - DNA, 22 bp, Artificial Sequence
  chemically synthesized
gcccttcaaagaaaaaaggctt

SEQ ID NO: 964047 - DNA, 22 bp, Artificial Sequence
  chemically synthesized
aagcaggagtcagaagcctttt

SEQ ID NO: 964048 - DNA, 22 bp, Artificial Sequence
  chemically synthesized
ctaaagcaggagtcagaagcct

SEQ ID NO: 964049 - DNA, 22 bp, Artificial Sequence
  chemically synthesized
caaagaaaaaaggcttctgact

SEQ ID NO: 964050 - DNA, 22 bp, Artificial Sequence
  chemically synthesized
tcctaaagcaggagtcagaagc

SEQ ID NO: 964051 - DNA, 22 bp, Artificial Sequence
  chemically synthesized
aaagaaaaaaggcttctgactc

SEQ ID NO: 964052 - DNA, 22 bp, Artificial Sequence
  chemically synthesized
ctcctaaagcaggagtcagaag

SEQ ID NO: 964053 - DNA, 22 bp, Artificial Sequence
  chemically synthesized
tctcctaaagcaggagtcagaa

SEQ ID NO: 964054 - DNA, 22 bp, Artificial Sequence
  chemically synthesized
tacgtgctttctcctaaagcag

SEQ ID NO: 964055 - DNA, 22 bp, Artificial Sequence
  chemically synthesized
gtacgtgctttctcctaaagca

SEQ ID NO: 964056 - DNA, 22 bp, Artificial Sequence
  chemically synthesized
cttgtacgtgctttctcctaaa

SEQ ID NO: 964057 - DNA, 22 bp, Artificial Sequence
  chemically synthesized
ctgactcctgctttaggagaaa

SEQ ID NO: 964058 - DNA, 22 bp, Artificial Sequence
  chemically synthesized
tgactcctgctttaggagaaag

SEQ ID NO: 964059 - DNA, 22 bp, Artificial Sequence
  chemically synthesized
actcctgctttaggagaaagca

SEQ ID NO: 964060 - DNA, 22 bp, Artificial Sequence
  chemically synthesized
cctccttgtacgtgctttctcc

SEQ ID NO: 964061 - DNA, 22 bp, Artificial Sequence
  chemically synthesized
acctccttgtacgtgctttctc

SEQ ID NO: 964062 - DNA, 22 bp, Artificial Sequence
  chemically synthesized
tacctccttgtacgtgctttct

SEQ ID NO: 964063 - DNA, 22 bp, Artificial Sequence
  chemically synthesized
ttacctccttgtacgtgctttc

SEQ ID NO: 964064 - DNA, 22 bp, Artificial Sequence
  chemically synthesized
ctgctttaggagaaagcacgta

SEQ ID NO: 964065 - DNA, 22 bp, Artificial Sequence
  chemically synthesized
tttttacctccttgtacgtgct

SEQ ID NO: 964066 - DNA, 22 bp, Artificial Sequence
  chemically synthesized
ctttaggagaaagcacgtacaa

SEQ ID NO: 964067 - DNA, 22 bp, Artificial Sequence
  chemically synthesized
atttttacctccttgtacgtgc

SEQ ID NO: 964068 - DNA, 22 bp, Artificial Sequence
  chemically synthesized
taggagaaagcacgtacaagga

SEQ ID NO: 964069 - DNA, 22 bp, Artificial Sequence
  chemically synthesized
aggagaaagcacgtacaaggag

SEQ ID NO: 964070 - DNA, 22 bp, Artificial Sequence
  chemically synthesized
ggagaaagcacgtacaaggagg

SEQ ID NO: 964071 - DNA, 22 bp, Artificial Sequence
  chemically synthesized
aaaaaaaaaaagtttattttta

SEQ ID NO: 964072 - DNA, 22 bp, Artificial Sequence
  chemically synthesized
caattaaaaaaaaaaaagttta

SEQ ID NO: 964073 - DNA, 22 bp, Artificial Sequence
  chemically synthesized
attgcaattaaaaaaaaaaaag

SEQ ID NO: 964074 - DNA, 22 bp, Artificial Sequence
  chemically synthesized
gaatctgattgcaattaaaaaa

SEQ ID NO: 964075 - DNA, 22 bp, Artificial Sequence
  chemically synthesized
ttttttttttaattgcaatcag

SEQ ID NO: 964076 - DNA, 22 bp, Artificial Sequence
  chemically synthesized
tttttttttaattgcaatcaga

SEQ ID NO: 964077 - DNA, 22 bp, Artificial Sequence
  chemically synthesized
ttttttttaattgcaatcagat

SEQ ID NO: 964078 - DNA, 22 bp, Artificial Sequence
  chemically synthesized
tttttttaattgcaatcagatt

SEQ ID NO: 964079 - DNA, 22 bp, Artificial Sequence
  chemically synthesized
gggtccatctggaatctgattg

SEQ ID NO: 964080 - DNA, 22 bp, Artificial Sequence
  chemically synthesized
ttttttaattgcaatcagattc

SEQ ID NO: 964081 - DNA, 22 bp, Artificial Sequence
  chemically synthesized
agggtccatctggaatctgatt

SEQ ID NO: 964082 - DNA, 22 bp, Artificial Sequence
  chemically synthesized
tttttaattgcaatcagattcc

SEQ ID NO: 964083 - DNA, 22 bp, Artificial Sequence
  chemically synthesized
ttttaattgcaatcagattcca

SEQ ID NO: 964084 - DNA, 22 bp, Artificial Sequence
  chemically synthesized
ttagggtccatctggaatctga

SEQ ID NO: 964085 - DNA, 22 bp, Artificial Sequence
  chemically synthesized
tttaattgcaatcagattccag

SEQ ID NO: 964086 - DNA, 22 bp, Artificial Sequence
  chemically synthesized
ttaattgcaatcagattccaga

SEQ ID NO: 964087 - DNA, 22 bp, Artificial Sequence
  chemically synthesized
taattgcaatcagattccagat

SEQ ID NO: 964088 - DNA, 22 bp, Artificial Sequence
  chemically synthesized
aattgcaatcagattccagatg

SEQ ID NO: 964089 - DNA, 22 bp, Artificial Sequence
  chemically synthesized
attgcaatcagattccagatgg

SEQ ID NO: 964090 - DNA, 22 bp, Artificial Sequence
  chemically synthesized
agctcttagggtccatctggaa

SEQ ID NO: 964091 - DNA, 22 bp, Artificial Sequence
  chemically synthesized
caatcagattccagatggaccc

SEQ ID NO: 964092 - DNA, 22 bp, Artificial Sequence
  chemically synthesized
cgtaactgagctcttagggtcc

SEQ ID NO: 964093 - DNA, 22 bp, Artificial Sequence
  chemically synthesized
ccgtaactgagctcttagggtc

SEQ ID NO: 964094 - DNA, 22 bp, Artificial Sequence
  chemically synthesized
cacttccgtaactgagctctta

SEQ ID NO: 964095 - DNA, 22 bp, Artificial Sequence
  chemically synthesized
cagatggaccctaagagctcag

SEQ ID NO: 964096 - DNA, 22 bp, Artificial Sequence
  chemically synthesized
ccacttccgtaactgagctctt

SEQ ID NO: 964097 - DNA, 22 bp, Artificial Sequence
  chemically synthesized
cccttccacttccgtaactgag

SEQ ID NO: 964098 - DNA, 22 bp, Artificial Sequence
  chemically synthesized
ccccttccacttccgtaactga

SEQ ID NO: 964099 - DNA, 22 bp, Artificial Sequence
  chemically synthesized
tccccttccacttccgtaactg

SEQ ID NO: 964100 - DNA, 22 bp, Artificial Sequence
  chemically synthesized
ttccccttccacttccgtaact

SEQ ID NO: 964101 - DNA, 22 bp, Artificial Sequence
  chemically synthesized
tttttccccttccacttccgta

SEQ ID NO: 964102 - DNA, 22 bp, Artificial Sequence
  chemically synthesized
agagctcagttacggaagtgga

SEQ ID NO: 964103 - DNA, 22 bp, Artificial Sequence
  chemically synthesized
ctgtttttccccttccacttcc

SEQ ID NO: 964104 - DNA, 22 bp, Artificial Sequence
  chemically synthesized
ctgctgtttttccccttccact

SEQ ID NO: 964105 - DNA, 22 bp, Artificial Sequence
  chemically synthesized
agttacggaagtggaaggggaa

SEQ ID NO: 964106 - DNA, 22 bp, Artificial Sequence
  chemically synthesized
ctgctgctgtttttccccttcc

SEQ ID NO: 964107 - DNA, 22 bp, Artificial Sequence
  chemically synthesized
ctgctgctgctgtttttcccct

SEQ ID NO: 964108 - DNA, 22 bp, Artificial Sequence
  chemically synthesized
cggaagtggaaggggaaaaaca

SEQ ID NO: 964109 - DNA, 22 bp, Artificial Sequence
  chemically synthesized
ctgctgctgctgctgtttttcc

SEQ ID NO: 964110 - DNA, 22 bp, Artificial Sequence
  chemically synthesized
ttgctgctgctgctgctgtttt

SEQ ID NO: 964111 - DNA, 22 bp, Artificial Sequence
  chemically synthesized
ttgttgctgctgctgctgctgt

SEQ ID NO: 964112 - DNA, 22 bp, Artificial Sequence
  chemically synthesized
ttgttgttgctgctgctgctgc

SEQ ID NO: 964113 - DNA, 22 bp, Artificial Sequence
  chemically synthesized
tcgttgttgttgttgctgctgc

SEQ ID NO: 964114 - DNA, 22 bp, Artificial Sequence
  chemically synthesized
ttgtcgttgttgttgttgctgc

SEQ ID NO: 964115 - DNA, 22 bp, Artificial Sequence
  chemically synthesized
ttgttgtcgttgttgttgttgc

SEQ ID NO: 964116 - DNA, 22 bp, Artificial Sequence
  chemically synthesized
ttgttgttgtcgttgttgttgt

SEQ ID NO: 964117 - DNA, 22 bp, Artificial Sequence
  chemically synthesized
tcgttgttgttgttgtcgttgt

SEQ ID NO: 964118 - DNA, 22 bp, Artificial Sequence
  chemically synthesized
ttgtcgttgttgttgttgtcgt

SEQ ID NO: 964119 - DNA, 22 bp, Artificial Sequence
  chemically synthesized
ttgttgtcgttgttgttgttgt

SEQ ID NO: 964120 - DNA, 22 bp, Artificial Sequence
  chemically synthesized
gttgttgtcgttgttgttgttg

SEQ ID NO: 964121 - DNA, 22 bp, Artificial Sequence
  chemically synthesized
ggtttgttgttgtcgttgttgt

SEQ ID NO: 964122 - DNA, 22 bp, Artificial Sequence
  chemically synthesized
cggtttgttgttgtcgttgttg

SEQ ID NO: 964123 - DNA, 22 bp, Artificial Sequence
  chemically synthesized
ttcggtttgttgttgtcgttgt

SEQ ID NO: 964124 - DNA, 22 bp, Artificial Sequence
  chemically synthesized
ctcttcggtttgttgttgtcgt

SEQ ID NO: 964125 - DNA, 22 bp, Artificial Sequence
  chemically synthesized
cctcttcggtttgttgttgtcg

SEQ ID NO: 964126 - DNA, 22 bp, Artificial Sequence
  chemically synthesized
tcctcttcggtttgttgttgtc

SEQ ID NO: 964127 - DNA, 22 bp, Artificial Sequence
  chemically synthesized
ttcctcttcggtttgttgttgt

SEQ ID NO: 964128 - DNA, 22 bp, Artificial Sequence
  chemically synthesized
ttttcctcttcggtttgttgtt

SEQ ID NO: 964129 - DNA, 22 bp, Artificial Sequence
  chemically synthesized
tcttttcctcttcggtttgttg

SEQ ID NO: 964130 - DNA, 22 bp, Artificial Sequence
  chemically synthesized
agctctcttttcctcttcggtt

SEQ ID NO: 964131 - DNA, 22 bp, Artificial Sequence
  chemically synthesized
cactcagctctcttttcctctt

SEQ ID NO: 964132 - DNA, 22 bp, Artificial Sequence
  chemically synthesized
ccactcagctctcttttcctct

SEQ ID NO: 964133 - DNA, 22 bp, Artificial Sequence
  chemically synthesized
tccactcagctctcttttcctc

SEQ ID NO: 964134 - DNA, 22 bp, Artificial Sequence
  chemically synthesized
ttccactcagctctcttttcct

SEQ ID NO: 964135 - DNA, 22 bp, Artificial Sequence
  chemically synthesized
tttccactcagctctcttttcc

SEQ ID NO: 964136 - DNA, 22 bp, Artificial Sequence
  chemically synthesized
aaagactttttccactcagctc

SEQ ID NO: 964137 - DNA, 22 bp, Artificial Sequence
  chemically synthesized
caaagactttttccactcagct

SEQ ID NO: 964138 - DNA, 22 bp, Artificial Sequence
  chemically synthesized
tcaaagactttttccactcagc

SEQ ID NO: 964139 - DNA, 22 bp, Artificial Sequence
  chemically synthesized
aattttcaaagactttttccac

SEQ ID NO: 964140 - DNA, 22 bp, Artificial Sequence
  chemically synthesized
ggactaaattttcaaagacttt

SEQ ID NO: 964141 - DNA, 22 bp, Artificial Sequence
  chemically synthesized
aggactaaattttcaaagactt

SEQ ID NO: 964142 - DNA, 22 bp, Artificial Sequence
  chemically synthesized
taggactaaattttcaaagact

SEQ ID NO: 964143 - DNA, 22 bp, Artificial Sequence
  chemically synthesized
agtggaaaaagtctttgaaaat

SEQ ID NO: 964144 - DNA, 22 bp, Artificial Sequence
  chemically synthesized
tgaaaatttagtcctaaaactt

SEQ ID NO: 964145 - DNA, 22 bp, Artificial Sequence
  chemically synthesized
gaaaatttagtcctaaaactta

SEQ ID NO: 964146 - DNA, 22 bp, Artificial Sequence
  chemically synthesized
aaaatttagtcctaaaacttat

SEQ ID NO: 964147 - DNA, 22 bp, Artificial Sequence
  chemically synthesized
agtcctaaaacttatatttaca

SEQ ID NO: 964148 - DNA, 22 bp, Artificial Sequence
  chemically synthesized
gtcctaaaacttatatttacat

SEQ ID NO: 964149 - DNA, 22 bp, Artificial Sequence
  chemically synthesized
aggagagcatgagaatgtaaat

SEQ ID NO: 964150 - DNA, 22 bp, Artificial Sequence
  chemically synthesized
caggagagcatgagaatgtaaa

SEQ ID NO: 964151 - DNA, 22 bp, Artificial Sequence
  chemically synthesized
aaacttatatttacattctcat

SEQ ID NO: 964152 - DNA, 22 bp, Artificial Sequence
  chemically synthesized
tgacttcaggagagcatgagaa

SEQ ID NO: 964153 - DNA, 22 bp, Artificial Sequence
  chemically synthesized
tgtgacttcaggagagcatgag

SEQ ID NO: 964154 - DNA, 22 bp, Artificial Sequence
  chemically synthesized
atatttacattctcatgctctc

SEQ ID NO: 964155 - DNA, 22 bp, Artificial Sequence
  chemically synthesized
ctgtgacttcaggagagcatga

SEQ ID NO: 964156 - DNA, 22 bp, Artificial Sequence
  chemically synthesized
tatttacattctcatgctctcc

SEQ ID NO: 964157 - DNA, 22 bp, Artificial Sequence
  chemically synthesized
tctgtgacttcaggagagcatg

SEQ ID NO: 964158 - DNA, 22 bp, Artificial Sequence
  chemically synthesized
tttctgtgacttcaggagagca

SEQ ID NO: 964159 - DNA, 22 bp, Artificial Sequence
  chemically synthesized
acattctcatgctctcctgaag

SEQ ID NO: 964160 - DNA, 22 bp, Artificial Sequence
  chemically synthesized
cattctcatgctctcctgaagt

SEQ ID NO: 964161 - DNA, 22 bp, Artificial Sequence
  chemically synthesized
cgaacctctttctgtgacttca

SEQ ID NO: 964162 - DNA, 22 bp, Artificial Sequence
  chemically synthesized
tcatgctctcctgaagtcacag

SEQ ID NO: 964163 - DNA, 22 bp, Artificial Sequence
  chemically synthesized
atgctctcctgaagtcacagaa

SEQ ID NO: 964164 - DNA, 22 bp, Artificial Sequence
  chemically synthesized
tcctgaagtcacagaaagaggt

SEQ ID NO: 964165 - DNA, 22 bp, Artificial Sequence
  chemically synthesized
ctgaagtcacagaaagaggttc

SEQ ID NO: 964166 - DNA, 22 bp, Artificial Sequence
  chemically synthesized
aagcagaagttccgaacctctt

SEQ ID NO: 964167 - DNA, 22 bp, Artificial Sequence
  chemically synthesized
aaagcagaagttccgaacctct

SEQ ID NO: 964168 - DNA, 22 bp, Artificial Sequence
  chemically synthesized
aagtcacagaaagaggttcgga

SEQ ID NO: 964169 - DNA, 22 bp, Artificial Sequence
  chemically synthesized
ttaaagcagaagttccgaacct

SEQ ID NO: 964170 - DNA, 22 bp, Artificial Sequence
  chemically synthesized
aaatgtcctcttaaagcagaag

SEQ ID NO: 964171 - DNA, 22 bp, Artificial Sequence
  chemically synthesized
ggaacttctgctttaagaggac

SEQ ID NO: 964172 - DNA, 22 bp, Artificial Sequence
  chemically synthesized
cagtcgattcaaatgtcctctt

SEQ ID NO: 964173 - DNA, 22 bp, Artificial Sequence
  chemically synthesized
tccagtcgattcaaatgtcctc

SEQ ID NO: 964174 - DNA, 22 bp, Artificial Sequence
  chemically synthesized
ctgctttaagaggacatttgaa

SEQ ID NO: 964175 - DNA, 22 bp, Artificial Sequence
  chemically synthesized
ctctccagtcgattcaaatgtc

SEQ ID NO: 964176 - DNA, 22 bp, Artificial Sequence
  chemically synthesized
tgctttaagaggacatttgaat

SEQ ID NO: 964177 - DNA, 22 bp, Artificial Sequence
  chemically synthesized
ctttaagaggacatttgaatcg

SEQ ID NO: 964178 - DNA, 22 bp, Artificial Sequence
  chemically synthesized
ttcctctccagtcgattcaaat

SEQ ID NO: 964179 - DNA, 22 bp, Artificial Sequence
  chemically synthesized
gttcctctccagtcgattcaaa

SEQ ID NO: 964180 - DNA, 22 bp, Artificial Sequence
  chemically synthesized
tgttcctctccagtcgattcaa

SEQ ID NO: 964181 - DNA, 22 bp, Artificial Sequence
  chemically synthesized
taagaggacatttgaatcgact

SEQ ID NO: 964182 - DNA, 22 bp, Artificial Sequence
  chemically synthesized
aagaggacatttgaatcgactg

SEQ ID NO: 964183 - DNA, 22 bp, Artificial Sequence
  chemically synthesized
agaggacatttgaatcgactgg

SEQ ID NO: 964184 - DNA, 22 bp, Artificial Sequence
  chemically synthesized
aatgctttgttcctctccagtc

SEQ ID NO: 964185 - DNA, 22 bp, Artificial Sequence
  chemically synthesized
caatgctttgttcctctccagt

SEQ ID NO: 964186 - DNA, 22 bp, Artificial Sequence
  chemically synthesized
ttcaatgctttgttcctctcca

SEQ ID NO: 964187 - DNA, 22 bp, Artificial Sequence
  chemically synthesized
tcttcaatgctttgttcctctc

SEQ ID NO: 964188 - DNA, 22 bp, Artificial Sequence
  chemically synthesized
gaatcgactggagaggaacaaa

SEQ ID NO: 964189 - DNA, 22 bp, Artificial Sequence
  chemically synthesized
tctcttcaatgctttgttcctc

SEQ ID NO: 964190 - DNA, 22 bp, Artificial Sequence
  chemically synthesized
aatcgactggagaggaacaaag

SEQ ID NO: 964191 - DNA, 22 bp, Artificial Sequence
  chemically synthesized
ctctctcttcaatgctttgttc

SEQ ID NO: 964192 - DNA, 22 bp, Artificial Sequence
  chemically synthesized
cctctctcttcaatgctttgtt

SEQ ID NO: 964193 - DNA, 22 bp, Artificial Sequence
  chemically synthesized
acttcctctctcttcaatgctt

SEQ ID NO: 964194 - DNA, 22 bp, Artificial Sequence
  chemically synthesized
gagaggaacaaagcattgaaga

SEQ ID NO: 964195 - DNA, 22 bp, Artificial Sequence
  chemically synthesized
aggagttcacttcctctctctt

SEQ ID NO: 964196 - DNA, 22 bp, Artificial Sequence
  chemically synthesized
tctgaggagttcacttcctctc

SEQ ID NO: 964197 - DNA, 22 bp, Artificial Sequence
  chemically synthesized
atctgaggagttcacttcctct

SEQ ID NO: 964198 - DNA, 22 bp, Artificial Sequence
  chemically synthesized
tatctgaggagttcacttcctc

SEQ ID NO: 964199 - DNA, 22 bp, Artificial Sequence
  chemically synthesized
aagagagaggaagtgaactcct

SEQ ID NO: 964200 - DNA, 22 bp, Artificial Sequence
  chemically synthesized
gagctttatctgaggagttcac

SEQ ID NO: 964201 - DNA, 22 bp, Artificial Sequence
  chemically synthesized
atattagagctttatctgagga

SEQ ID NO: 964202 - DNA, 22 bp, Artificial Sequence
  chemically synthesized
tcatattagagctttatctgag

SEQ ID NO: 964203 - DNA, 22 bp, Artificial Sequence
  chemically synthesized
ctcatattagagctttatctga

SEQ ID NO: 964204 - DNA, 22 bp, Artificial Sequence
  chemically synthesized
tgtttctcatattagagcttta

SEQ ID NO: 964205 - DNA, 22 bp, Artificial Sequence
  chemically synthesized
ctcagataaagctctaatatga

SEQ ID NO: 964206 - DNA, 22 bp, Artificial Sequence
  chemically synthesized
gaactatgtttctcatattaga

SEQ ID NO: 964207 - DNA, 22 bp, Artificial Sequence
  chemically synthesized
tggaactatgtttctcatatta

SEQ ID NO: 964208 - DNA, 22 bp, Artificial Sequence
  chemically synthesized
agataaagctctaatatgagaa

SEQ ID NO: 964209 - DNA, 22 bp, Artificial Sequence
  chemically synthesized
tctggaactatgtttctcatat

SEQ ID NO: 964210 - DNA, 22 bp, Artificial Sequence
  chemically synthesized
tctctggaactatgtttctcat

SEQ ID NO: 964211 - DNA, 22 bp, Artificial Sequence
  chemically synthesized
ctctctggaactatgtttctca

SEQ ID NO: 964212 - DNA, 22 bp, Artificial Sequence
  chemically synthesized
acttctctctggaactatgttt

SEQ ID NO: 964213 - DNA, 22 bp, Artificial Sequence
  chemically synthesized
taatatgagaaacatagttcca

SEQ ID NO: 964214 - DNA, 22 bp, Artificial Sequence
  chemically synthesized
atatgagaaacatagttccaga

SEQ ID NO: 964215 - DNA, 22 bp, Artificial Sequence
  chemically synthesized
cagagagaagttaatgttactt

SEQ ID NO: 964216 - DNA, 22 bp, Artificial Sequence
  chemically synthesized
aaggaaatgagacagaaaaatg

SEQ ID NO: 964217 - DNA, 22 bp, Artificial Sequence
  chemically synthesized
gaaggaaatgagacagaaaaat

SEQ ID NO: 964218 - DNA, 22 bp, Artificial Sequence
  chemically synthesized
atgttacttcatttttctgtct

SEQ ID NO: 964219 - DNA, 22 bp, Artificial Sequence
  chemically synthesized
agcttgaaggaaatgagacaga

SEQ ID NO: 964220 - DNA, 22 bp, Artificial Sequence
  chemically synthesized
gagcttgaaggaaatgagacag

SEQ ID NO: 964221 - DNA, 22 bp, Artificial Sequence
  chemically synthesized
tgagcttgaaggaaatgagaca

SEQ ID NO: 964222 - DNA, 22 bp, Artificial Sequence
  chemically synthesized
cttcatttttctgtctcatttc

SEQ ID NO: 964223 - DNA, 22 bp, Artificial Sequence
  chemically synthesized
catttttctgtctcatttcctt

SEQ ID NO: 964224 - DNA, 22 bp, Artificial Sequence
  chemically synthesized
atttttctgtctcatttccttc

SEQ ID NO: 964225 - DNA, 22 bp, Artificial Sequence
  chemically synthesized
atgctttgagcttgaaggaaat

SEQ ID NO: 964226 - DNA, 22 bp, Artificial Sequence
  chemically synthesized
ttctgtctcatttccttcaagc

SEQ ID NO: 964227 - DNA, 22 bp, Artificial Sequence
  chemically synthesized
ctcatgctttgagcttgaagga

SEQ ID NO: 964228 - DNA, 22 bp, Artificial Sequence
  chemically synthesized
tctgtctcatttccttcaagct

SEQ ID NO: 964229 - DNA, 22 bp, Artificial Sequence
  chemically synthesized
actcatgctttgagcttgaagg

SEQ ID NO: 964230 - DNA, 22 bp, Artificial Sequence
  chemically synthesized
ctgtctcatttccttcaagctc

SEQ ID NO: 964231 - DNA, 22 bp, Artificial Sequence
  chemically synthesized
tgtctcatttccttcaagctca

SEQ ID NO: 964232 - DNA, 22 bp, Artificial Sequence
  chemically synthesized
tctcatttccttcaagctcaaa

SEQ ID NO: 964233 - DNA, 22 bp, Artificial Sequence
  chemically synthesized
tcacttactcatgctttgagct

SEQ ID NO: 964234 - DNA, 22 bp, Artificial Sequence
  chemically synthesized
atttccttcaagctcaaagcat

SEQ ID NO: 964235 - DNA, 22 bp, Artificial Sequence
  chemically synthesized
ccttcaagctcaaagcatgagt

SEQ ID NO: 964236 - DNA, 22 bp, Artificial Sequence
  chemically synthesized
ccattatcacttactcatgctt

SEQ ID NO: 964237 - DNA, 22 bp, Artificial Sequence
  chemically synthesized
cttcaagctcaaagcatgagta

SEQ ID NO: 964238 - DNA, 22 bp, Artificial Sequence
  chemically synthesized
accattatcacttactcatgct

SEQ ID NO: 964239 - DNA, 22 bp, Artificial Sequence
  chemically synthesized
caagctcaaagcatgagtaagt

SEQ ID NO: 964240 - DNA, 22 bp, Artificial Sequence
  chemically synthesized
cttaccattatcacttactcat

SEQ ID NO: 964241 - DNA, 22 bp, Artificial Sequence
  chemically synthesized
aagctcaaagcatgagtaagtg

SEQ ID NO: 964242 - DNA, 22 bp, Artificial Sequence
  chemically synthesized
acttaccattatcacttactca

SEQ ID NO: 964243 - DNA, 22 bp, Artificial Sequence
  chemically synthesized
aaagcatgagtaagtgataatg

SEQ ID NO: 964244 - DNA, 22 bp, Artificial Sequence
  chemically synthesized
ggatggcagagagaatacatat

SEQ ID NO: 964245 - DNA, 22 bp, Artificial Sequence
  chemically synthesized
aggatggcagagagaatacata

SEQ ID NO: 964246 - DNA, 22 bp, Artificial Sequence
  chemically synthesized
taggatggcagagagaatacat

SEQ ID NO: 964247 - DNA, 22 bp, Artificial Sequence
  chemically synthesized
ttaggatggcagagagaataca

SEQ ID NO: 964248 - DNA, 22 bp, Artificial Sequence
  chemically synthesized
tttttaggatggcagagagaat

SEQ ID NO: 964249 - DNA, 22 bp, Artificial Sequence
  chemically synthesized
tgtttttaggatggcagagaga

SEQ ID NO: 964250 - DNA, 22 bp, Artificial Sequence
  chemically synthesized
ctgtttttaggatggcagagag

SEQ ID NO: 964251 - DNA, 22 bp, Artificial Sequence
  chemically synthesized
cttctgtttttaggatggcaga

SEQ ID NO: 964252 - DNA, 22 bp, Artificial Sequence
  chemically synthesized
tctctgccatcctaaaaacaga

SEQ ID NO: 964253 - DNA, 22 bp, Artificial Sequence
  chemically synthesized
tctgccatcctaaaaacagaag

SEQ ID NO: 964254 - DNA, 22 bp, Artificial Sequence
  chemically synthesized
tgccatcctaaaaacagaagga

SEQ ID NO: 964255 - DNA, 22 bp, Artificial Sequence
  chemically synthesized
caagtggtccccctccttctgt

SEQ ID NO: 964256 - DNA, 22 bp, Artificial Sequence
  chemically synthesized
ccatcctaaaaacagaaggagg

SEQ ID NO: 964257 - DNA, 22 bp, Artificial Sequence
  chemically synthesized
acaagtggtccccctccttctg

SEQ ID NO: 964258 - DNA, 22 bp, Artificial Sequence
  chemically synthesized
tacaagtggtccccctccttct

SEQ ID NO: 964259 - DNA, 22 bp, Artificial Sequence
  chemically synthesized
attttacaagtggtccccctcc

SEQ ID NO: 964260 - DNA, 22 bp, Artificial Sequence
  chemically synthesized
aattttacaagtggtccccctc

SEQ ID NO: 964261 - DNA, 22 bp, Artificial Sequence
  chemically synthesized
aaaacagaaggagggggaccac

SEQ ID NO: 964262 - DNA, 22 bp, Artificial Sequence
  chemically synthesized
cagccagtgtttaattttacaa

SEQ ID NO: 964263 - DNA, 22 bp, Artificial Sequence
  chemically synthesized
acagccagtgtttaattttaca

SEQ ID NO: 964264 - DNA, 22 bp, Artificial Sequence
  chemically synthesized
tacagccagtgtttaattttac

SEQ ID NO: 964265 - DNA, 22 bp, Artificial Sequence
  chemically synthesized
ttacagccagtgtttaatttta

SEQ ID NO: 964266 - DNA, 22 bp, Artificial Sequence
  chemically synthesized
tttttacagccagtgtttaatt

SEQ ID NO: 964267 - DNA, 22 bp, Artificial Sequence
  chemically synthesized
gtaaaattaaacactggctgta

SEQ ID NO: 964268 - DNA, 22 bp, Artificial Sequence
  chemically synthesized
taaaattaaacactggctgtaa

SEQ ID NO: 964269 - DNA, 22 bp, Artificial Sequence
  chemically synthesized
catatggataaattatttttac

SEQ ID NO: 964270 - DNA, 22 bp, Artificial Sequence
  chemically synthesized
aacactggctgtaaaaataatt

SEQ ID NO: 964271 - DNA, 22 bp, Artificial Sequence
  chemically synthesized
gctgtaaaaataatttatccat

SEQ ID NO: 964272 - DNA, 22 bp, Artificial Sequence
  chemically synthesized
aaaaaaatcctacatatggata

SEQ ID NO: 964273 - DNA, 22 bp, Artificial Sequence
  chemically synthesized
taaaaataatttatccatatgt

SEQ ID NO: 964274 - DNA, 22 bp, Artificial Sequence
  chemically synthesized
caactgaaaaaaatcctacata

SEQ ID NO: 964275 - DNA, 22 bp, Artificial Sequence
  chemically synthesized
tccaactgaaaaaaatcctaca

SEQ ID NO: 964276 - DNA, 22 bp, Artificial Sequence
  chemically synthesized
ctccaactgaaaaaaatcctac

SEQ ID NO: 964277 - DNA, 22 bp, Artificial Sequence
  chemically synthesized
tctccaactgaaaaaaatccta

SEQ ID NO: 964278 - DNA, 22 bp, Artificial Sequence
  chemically synthesized
atccatatgtaggatttttttc

SEQ ID NO: 964279 - DNA, 22 bp, Artificial Sequence
  chemically synthesized
tccatatgtaggatttttttca

SEQ ID NO: 964280 - DNA, 22 bp, Artificial Sequence
  chemically synthesized
ggtgctttctccaactgaaaaa

SEQ ID NO: 964281 - DNA, 22 bp, Artificial Sequence
  chemically synthesized
gggtgctttctccaactgaaaa

SEQ ID NO: 964282 - DNA, 22 bp, Artificial Sequence
  chemically synthesized
taggcttgggtgctttctccaa

SEQ ID NO: 964283 - DNA, 22 bp, Artificial Sequence
  chemically synthesized
tgtaggcttgggtgctttctcc

SEQ ID NO: 964284 - DNA, 22 bp, Artificial Sequence
  chemically synthesized
ttttcagttggagaaagcaccc

SEQ ID NO: 964285 - DNA, 22 bp, Artificial Sequence
  chemically synthesized
tttcagttggagaaagcaccca

SEQ ID NO: 964286 - DNA, 22 bp, Artificial Sequence
  chemically synthesized
ttcagttggagaaagcacccaa

SEQ ID NO: 964287 - DNA, 22 bp, Artificial Sequence
  chemically synthesized
tcagttggagaaagcacccaag

SEQ ID NO: 964288 - DNA, 22 bp, Artificial Sequence
  chemically synthesized
cagttggagaaagcacccaagc

SEQ ID NO: 964289 - DNA, 22 bp, Artificial Sequence
  chemically synthesized
agttggagaaagcacccaagcc

SEQ ID NO: 964290 - DNA, 22 bp, Artificial Sequence
  chemically synthesized
ggcacgcactctgtaggcttgg

SEQ ID NO: 964291 - DNA, 22 bp, Artificial Sequence
  chemically synthesized
gagaaagcacccaagcctacag

SEQ ID NO: 964292 - DNA, 22 bp, Artificial Sequence
  chemically synthesized
cagaacctaggcacgcactctg

SEQ ID NO: 964293 - DNA, 22 bp, Artificial Sequence
  chemically synthesized
ttgcagaacctaggcacgcact

SEQ ID NO: 964294 - DNA, 22 bp, Artificial Sequence
  chemically synthesized
ttattgcagaacctaggcacgc

SEQ ID NO: 964295 - DNA, 22 bp, Artificial Sequence
  chemically synthesized
cattgttattgcagaacctagg

SEQ ID NO: 964296 - DNA, 22 bp, Artificial Sequence
  chemically synthesized
cagagtgcgtgcctaggttctg

SEQ ID NO: 964297 - DNA, 22 bp, Artificial Sequence
  chemically synthesized
ttgcattgttattgcagaacct

SEQ ID NO: 964298 - DNA, 22 bp, Artificial Sequence
  chemically synthesized
tattgcattgttattgcagaac

SEQ ID NO: 964299 - DNA, 22 bp, Artificial Sequence
  chemically synthesized
ctattgcattgttattgcagaa

SEQ ID NO: 964300 - DNA, 22 bp, Artificial Sequence
  chemically synthesized
tttctattgcattgttattgca

SEQ ID NO: 964301 - DNA, 22 bp, Artificial Sequence
  chemically synthesized
tgactgtttctattgcattgtt

SEQ ID NO: 964302 - DNA, 22 bp, Artificial Sequence
  chemically synthesized
ggttctgcaataacaatgcaat

SEQ ID NO: 964303 - DNA, 22 bp, Artificial Sequence
  chemically synthesized
attgtgactgtttctattgcat

SEQ ID NO: 964304 - DNA, 22 bp, Artificial Sequence
  chemically synthesized
tgcaataacaatgcaatagaaa

SEQ ID NO: 964305 - DNA, 22 bp, Artificial Sequence
  chemically synthesized
caataacaatgcaatagaaaca

SEQ ID NO: 964306 - DNA, 22 bp, Artificial Sequence
  chemically synthesized
tatgttaattgtgactgtttct

SEQ ID NO: 964307 - DNA, 22 bp, Artificial Sequence
  chemically synthesized
tgtgcctgtatgttaattgtga

SEQ ID NO: 964308 - DNA, 22 bp, Artificial Sequence
  chemically synthesized
gtgtgcctgtatgttaattgtg

SEQ ID NO: 964309 - DNA, 22 bp, Artificial Sequence
  chemically synthesized
tgtttgtgtgcctgtatgttaa

SEQ ID NO: 964310 - DNA, 22 bp, Artificial Sequence
  chemically synthesized
tgtgtttgtgtgcctgtatgtt

SEQ ID NO: 964311 - DNA, 22 bp, Artificial Sequence
  chemically synthesized
ctgtgtttgtgtgcctgtatgt

SEQ ID NO: 964312 - DNA, 22 bp, Artificial Sequence
  chemically synthesized
acatacaggcacacaaacacag

SEQ ID NO: 964313 - DNA, 22 bp, Artificial Sequence
  chemically synthesized
tagtgaaagcacgaaaatgtgt

SEQ ID NO: 964314 - DNA, 22 bp, Artificial Sequence
  chemically synthesized
ccataagtaactatagtgaaag

SEQ ID NO: 964315 - DNA, 22 bp, Artificial Sequence
  chemically synthesized
cccataagtaactatagtgaaa

SEQ ID NO: 964316 - DNA, 22 bp, Artificial Sequence
  chemically synthesized
tcccataagtaactatagtgaa

SEQ ID NO: 964317 - DNA, 22 bp, Artificial Sequence
  chemically synthesized
ttcccataagtaactatagtga

SEQ ID NO: 964318 - DNA, 22 bp, Artificial Sequence
  chemically synthesized
tttcccataagtaactatagtg

SEQ ID NO: 964319 - DNA, 22 bp, Artificial Sequence
  chemically synthesized
tcgtgctttcactatagttact

SEQ ID NO: 964320 - DNA, 22 bp, Artificial Sequence
  chemically synthesized
cgtgctttcactatagttactt

SEQ ID NO: 964321 - DNA, 22 bp, Artificial Sequence
  chemically synthesized
attttttcccataagtaactat

SEQ ID NO: 964322 - DNA, 22 bp, Artificial Sequence
  chemically synthesized
gtgctttcactatagttactta

SEQ ID NO: 964323 - DNA, 22 bp, Artificial Sequence
  chemically synthesized
gattttttcccataagtaacta

SEQ ID NO: 964324 - DNA, 22 bp, Artificial Sequence
  chemically synthesized
tttgattttttcccataagtaa

SEQ ID NO: 964325 - DNA, 22 bp, Artificial Sequence
  chemically synthesized
atttgattttttcccataagta

SEQ ID NO: 964326 - DNA, 22 bp, Artificial Sequence
  chemically synthesized
tatttgattttttcccataagt

SEQ ID NO: 964327 - DNA, 22 bp, Artificial Sequence
  chemically synthesized
tcactatagttacttatgggaa

SEQ ID NO: 964328 - DNA, 22 bp, Artificial Sequence
  chemically synthesized
cactatagttacttatgggaaa

SEQ ID NO: 964329 - DNA, 22 bp, Artificial Sequence
  chemically synthesized
actatagttacttatgggaaaa

SEQ ID NO: 964330 - DNA, 22 bp, Artificial Sequence
  chemically synthesized
attttatttgattttttcccat

SEQ ID NO: 964331 - DNA, 22 bp, Artificial Sequence
  chemically synthesized
tagttacttatgggaaaaaatc

SEQ ID NO: 964332 - DNA, 22 bp, Artificial Sequence
  chemically synthesized
cttatgggaaaaaatcaaataa

SEQ ID NO: 964333 - DNA, 22 bp, Artificial Sequence
  chemically synthesized
caatgccctcattttatttgat

SEQ ID NO: 964334 - DNA, 22 bp, Artificial Sequence
  chemically synthesized
ccaatgccctcattttatttga

SEQ ID NO: 964335 - DNA, 22 bp, Artificial Sequence
  chemically synthesized
atgggaaaaaatcaaataaaat

SEQ ID NO: 964336 - DNA, 22 bp, Artificial Sequence
  chemically synthesized
tgggaaaaaatcaaataaaatg

SEQ ID NO: 964337 - DNA, 22 bp, Artificial Sequence
  chemically synthesized
ccttccaatgccctcattttat

SEQ ID NO: 964338 - DNA, 22 bp, Artificial Sequence
  chemically synthesized
gccttccaatgccctcatttta

SEQ ID NO: 964339 - DNA, 22 bp, Artificial Sequence
  chemically synthesized
tttgccttccaatgccctcatt

SEQ ID NO: 964340 - DNA, 22 bp, Artificial Sequence
  chemically synthesized
gtttgccttccaatgccctcat

SEQ ID NO: 964341 - DNA, 22 bp, Artificial Sequence
  chemically synthesized
tgtttgccttccaatgccctca

SEQ ID NO: 964342 - DNA, 22 bp, Artificial Sequence
  chemically synthesized
catgttttgtttgccttccaat

SEQ ID NO: 964343 - DNA, 22 bp, Artificial Sequence
  chemically synthesized
gaaggcaaacaaaacatgcaga

SEQ ID NO: 964344 - DNA, 22 bp, Artificial Sequence
  chemically synthesized
tcaaaaaataagtatctgcatg

SEQ ID NO: 964345 - DNA, 22 bp, Artificial Sequence
  chemically synthesized
gtcaaaaaataagtatctgcat

SEQ ID NO: 964346 - DNA, 22 bp, Artificial Sequence
  chemically synthesized
tgtcaaaaaataagtatctgca

SEQ ID NO: 964347 - DNA, 22 bp, Artificial Sequence
  chemically synthesized
aagttttgtcaaaaaataagta

SEQ ID NO: 964348 - DNA, 22 bp, Artificial Sequence
  chemically synthesized
acattaaagttttgtcaaaaaa

SEQ ID NO: 964349 - DNA, 22 bp, Artificial Sequence
  chemically synthesized
cacattaaagttttgtcaaaaa

SEQ ID NO: 964350 - DNA, 22 bp, Artificial Sequence
  chemically synthesized
taataacttcacattaaagttt

SEQ ID NO: 964351 - DNA, 22 bp, Artificial Sequence
  chemically synthesized
attttttgacaaaactttaatg

SEQ ID NO: 964352 - DNA, 22 bp, Artificial Sequence
  chemically synthesized
ttttttgacaaaactttaatgt

SEQ ID NO: 964353 - DNA, 22 bp, Artificial Sequence
  chemically synthesized
tttgacaaaactttaatgtgaa

SEQ ID NO: 964354 - DNA, 22 bp, Artificial Sequence
  chemically synthesized
ttgacaaaactttaatgtgaag

SEQ ID NO: 964355 - DNA, 22 bp, Artificial Sequence
  chemically synthesized
tgacaaaactttaatgtgaagt

SEQ ID NO: 964356 - DNA, 22 bp, Artificial Sequence
  chemically synthesized
gacaaaactttaatgtgaagtt

SEQ ID NO: 964357 - DNA, 22 bp, Artificial Sequence
  chemically synthesized
acaaaactttaatgtgaagtta

SEQ ID NO: 964358 - DNA, 22 bp, Artificial Sequence
  chemically synthesized
agacagttgtaataacttcaca

SEQ ID NO: 964359 - DNA, 22 bp, Artificial Sequence
  chemically synthesized
cagacagttgtaataacttcac

SEQ ID NO: 964360 - DNA, 22 bp, Artificial Sequence
  chemically synthesized
tcagacagttgtaataacttca

SEQ ID NO: 964361 - DNA, 22 bp, Artificial Sequence
  chemically synthesized
aattttcagacagttgtaataa

SEQ ID NO: 964362 - DNA, 22 bp, Artificial Sequence
  chemically synthesized
taatgtgaagttattacaactg

SEQ ID NO: 964363 - DNA, 22 bp, Artificial Sequence
  chemically synthesized
aatgtgaagttattacaactgt

SEQ ID NO: 964364 - DNA, 22 bp, Artificial Sequence
  chemically synthesized
atgtgaagttattacaactgtc

SEQ ID NO: 964365 - DNA, 22 bp, Artificial Sequence
  chemically synthesized
gagagttaaattttcagacagt

SEQ ID NO: 964366 - DNA, 22 bp, Artificial Sequence
  chemically synthesized
ttggagagttaaattttcagac

SEQ ID NO: 964367 - DNA, 22 bp, Artificial Sequence
  chemically synthesized
gttggagagttaaattttcaga

SEQ ID NO: 964368 - DNA, 22 bp, Artificial Sequence
  chemically synthesized
ttacaactgtctgaaaatttaa

SEQ ID NO: 964369 - DNA, 22 bp, Artificial Sequence
  chemically synthesized
caactgtctgaaaatttaactc

SEQ ID NO: 964370 - DNA, 22 bp, Artificial Sequence
  chemically synthesized
tctgaaaatttaactctccaac

SEQ ID NO: 964371 - DNA, 22 bp, Artificial Sequence
  chemically synthesized
acaagaaagaccttgttggaga

SEQ ID NO: 964372 - DNA, 22 bp, Artificial Sequence
  chemically synthesized
cacaagaaagaccttgttggag

SEQ ID NO: 964373 - DNA, 22 bp, Artificial Sequence
  chemically synthesized
aaaatttaactctccaacaagg

SEQ ID NO: 964374 - DNA, 22 bp, Artificial Sequence
  chemically synthesized
aactctccaacaaggtctttct

SEQ ID NO: 964375 - DNA, 22 bp, Artificial Sequence
  chemically synthesized
actctccaacaaggtctttctt

SEQ ID NO: 964376 - DNA, 22 bp, Artificial Sequence
  chemically synthesized
tccaacaaggtctttcttgtga

SEQ ID NO: 964377 - DNA, 22 bp, Artificial Sequence
  chemically synthesized
caacaaggtctttcttgtgaaa

SEQ ID NO: 964378 - DNA, 22 bp, Artificial Sequence
  chemically synthesized
caagataaacaacggtttcaca

SEQ ID NO: 964379 - DNA, 22 bp, Artificial Sequence
  chemically synthesized
gcaagataaacaacggtttcac

SEQ ID NO: 964380 - DNA, 22 bp, Artificial Sequence
  chemically synthesized
tcttgtgaaaccgttgtttatc

SEQ ID NO: 964381 - DNA, 22 bp, Artificial Sequence
  chemically synthesized
cttgtgaaaccgttgtttatct

SEQ ID NO: 964382 - DNA, 22 bp, Artificial Sequence
  chemically synthesized
taggaacttgcaagataaacaa

SEQ ID NO: 964383 - DNA, 22 bp, Artificial Sequence
  chemically synthesized
ttgtgaaaccgttgtttatctt

SEQ ID NO: 964384 - DNA, 22 bp, Artificial Sequence
  chemically synthesized
gtgaaaccgttgtttatcttgc

SEQ ID NO: 964385 - DNA, 22 bp, Artificial Sequence
  chemically synthesized
tgaaaccgttgtttatcttgca

SEQ ID NO: 964386 - DNA, 22 bp, Artificial Sequence
  chemically synthesized
agaatctgtaggaacttgcaag

SEQ ID NO: 964387 - DNA, 22 bp, Artificial Sequence
  chemically synthesized
tttatcttgcaagttcctacag

SEQ ID NO: 964388 - DNA, 22 bp, Artificial Sequence
  chemically synthesized
atcttgcaagttcctacagatt

SEQ ID NO: 964389 - DNA, 22 bp, Artificial Sequence
  chemically synthesized
tcttgcaagttcctacagattc

SEQ ID NO: 964390 - DNA, 22 bp, Artificial Sequence
  chemically synthesized
tgggtacagaattgagaatctg

SEQ ID NO: 964391 - DNA, 22 bp, Artificial Sequence
  chemically synthesized
gcaagttcctacagattctcaa

SEQ ID NO: 964392 - DNA, 22 bp, Artificial Sequence
  chemically synthesized
caagttcctacagattctcaat

SEQ ID NO: 964393 - DNA, 22 bp, Artificial Sequence
  chemically synthesized
ctacagattctcaattctgtac

SEQ ID NO: 964394 - DNA, 22 bp, Artificial Sequence
  chemically synthesized
cagattctcaattctgtaccca

SEQ ID NO: 964395 - DNA, 22 bp, Artificial Sequence
  chemically synthesized
aagggataggaaaattatgggt

SEQ ID NO: 964396 - DNA, 22 bp, Artificial Sequence
  chemically synthesized
tcaattctgtacccataatttt

SEQ ID NO: 964397 - DNA, 22 bp, Artificial Sequence
  chemically synthesized
aattctgtacccataattttcc

SEQ ID NO: 964398 - DNA, 22 bp, Artificial Sequence
  chemically synthesized
tgtacccataattttcctatcc

SEQ ID NO: 964399 - DNA, 22 bp, Artificial Sequence
  chemically synthesized
ccaggcctcaagggataggaaa

SEQ ID NO: 964400 - DNA, 22 bp, Artificial Sequence
  chemically synthesized
accaggcctcaagggataggaa

SEQ ID NO: 964401 - DNA, 22 bp, Artificial Sequence
  chemically synthesized
tacccataattttcctatccct

SEQ ID NO: 964402 - DNA, 22 bp, Artificial Sequence
  chemically synthesized
taccaggcctcaagggatagga

SEQ ID NO: 964403 - DNA, 22 bp, Artificial Sequence
  chemically synthesized
catgaaaactttaccaggcctc

SEQ ID NO: 964404 - DNA, 22 bp, Artificial Sequence
  chemically synthesized
tcctatcccttgaggcctggta

SEQ ID NO: 964405 - DNA, 22 bp, Artificial Sequence
  chemically synthesized
ccatgaaaactttaccaggcct

SEQ ID NO: 964406 - DNA, 22 bp, Artificial Sequence
  chemically synthesized
cctatcccttgaggcctggtaa

SEQ ID NO: 964407 - DNA, 22 bp, Artificial Sequence
  chemically synthesized
tccatgaaaactttaccaggcc

SEQ ID NO: 964408 - DNA, 22 bp, Artificial Sequence
  chemically synthesized
ctatcccttgaggcctggtaaa

SEQ ID NO: 964409 - DNA, 22 bp, Artificial Sequence
  chemically synthesized
ttccatgaaaactttaccaggc

SEQ ID NO: 964410 - DNA, 22 bp, Artificial Sequence
  chemically synthesized
tttccatgaaaactttaccagg

SEQ ID NO: 964411 - DNA, 22 bp, Artificial Sequence
  chemically synthesized
ttttccatgaaaactttaccag

SEQ ID NO: 964412 - DNA, 22 bp, Artificial Sequence
  chemically synthesized
tcccttgaggcctggtaaagtt

SEQ ID NO: 964413 - DNA, 22 bp, Artificial Sequence
  chemically synthesized
atttttttccatgaaaacttta

SEQ ID NO: 964414 - DNA, 22 bp, Artificial Sequence
  chemically synthesized
gaggcctggtaaagttttcatg

SEQ ID NO: 964415 - DNA, 22 bp, Artificial Sequence
  chemically synthesized
aggcctggtaaagttttcatgg

SEQ ID NO: 964416 - DNA, 22 bp, Artificial Sequence
  chemically synthesized
aaaaacattcatttttttccat

SEQ ID NO: 964417 - DNA, 22 bp, Artificial Sequence
  chemically synthesized
gtaaagttttcatggaaaaaaa

SEQ ID NO: 964418 - DNA, 22 bp, Artificial Sequence
  chemically synthesized
tcatggaaaaaaatgaatgttt

SEQ ID NO: 964419 - DNA, 22 bp, Artificial Sequence
  chemically synthesized
catggaaaaaaatgaatgtttt

SEQ ID NO: 964420 - DNA, 22 bp, Artificial Sequence
  chemically synthesized
atggaaaaaaatgaatgttttt

SEQ ID NO: 964421 - DNA, 22 bp, Artificial Sequence
  chemically synthesized
aatgtagaatctcaaaaacatt

SEQ ID NO: 964422 - DNA, 22 bp, Artificial Sequence
  chemically synthesized
agagattaaatgtagaatctca

SEQ ID NO: 964423 - DNA, 22 bp, Artificial Sequence
  chemically synthesized
gaataattaagagattaaatgt

SEQ ID NO: 964424 - DNA, 22 bp, Artificial Sequence
  chemically synthesized
agaataattaagagattaaatg

SEQ ID NO: 964425 - DNA, 22 bp, Artificial Sequence
  chemically synthesized
ttgagattctacatttaatctc

SEQ ID NO: 964426 - DNA, 22 bp, Artificial Sequence
  chemically synthesized
tgagattctacatttaatctct

SEQ ID NO: 964427 - DNA, 22 bp, Artificial Sequence
  chemically synthesized
gagattctacatttaatctctt

SEQ ID NO: 964428 - DNA, 22 bp, Artificial Sequence
  chemically synthesized
agattctacatttaatctctta

SEQ ID NO: 964429 - DNA, 22 bp, Artificial Sequence
  chemically synthesized
ccttagaataattaagagatta

SEQ ID NO: 964430 - DNA, 22 bp, Artificial Sequence
  chemically synthesized
ttgccttagaataattaagaga

SEQ ID NO: 964431 - DNA, 22 bp, Artificial Sequence
  chemically synthesized
tacatttaatctcttaattatt

SEQ ID NO: 964432 - DNA, 22 bp, Artificial Sequence
  chemically synthesized
catttaatctcttaattattct

SEQ ID NO: 964433 - DNA, 22 bp, Artificial Sequence
  chemically synthesized
aatctcttaattattctaaggc

SEQ ID NO: 964434 - DNA, 22 bp, Artificial Sequence
  chemically synthesized
atctcttaattattctaaggca

SEQ ID NO: 964435 - DNA, 22 bp, Artificial Sequence
  chemically synthesized
gaaagatgttattgccttagaa

SEQ ID NO: 964436 - DNA, 22 bp, Artificial Sequence
  chemically synthesized
ttaattattctaaggcaataac

SEQ ID NO: 964437 - DNA, 22 bp, Artificial Sequence
  chemically synthesized
aattattctaaggcaataacat

SEQ ID NO: 964438 - DNA, 22 bp, Artificial Sequence
  chemically synthesized
attattctaaggcaataacatc

SEQ ID NO: 964439 - DNA, 22 bp, Artificial Sequence
  chemically synthesized
taacactggaaagatgttattg

SEQ ID NO: 964440 - DNA, 22 bp, Artificial Sequence
  chemically synthesized
ttctaaggcaataacatctttc

SEQ ID NO: 964441 - DNA, 22 bp, Artificial Sequence
  chemically synthesized
taaggcaataacatctttccag

SEQ ID NO: 964442 - DNA, 22 bp, Artificial Sequence
  chemically synthesized
aggcaataacatctttccagtg

SEQ ID NO: 964443 - DNA, 22 bp, Artificial Sequence
  chemically synthesized
gcatgaaatctgtaacactgga

SEQ ID NO: 964444 - DNA, 22 bp, Artificial Sequence
  chemically synthesized
ggcatgaaatctgtaacactgg

SEQ ID NO: 964445 - DNA, 22 bp, Artificial Sequence
  chemically synthesized
tggcatgaaatctgtaacactg

SEQ ID NO: 964446 - DNA, 22 bp, Artificial Sequence
  chemically synthesized
ttggcatgaaatctgtaacact

SEQ ID NO: 964447 - DNA, 22 bp, Artificial Sequence
  chemically synthesized
tttggcatgaaatctgtaacac

SEQ ID NO: 964448 - DNA, 22 bp, Artificial Sequence
  chemically synthesized
ttttggcatgaaatctgtaaca

SEQ ID NO: 964449 - DNA, 22 bp, Artificial Sequence
  chemically synthesized
tttttggcatgaaatctgtaac

SEQ ID NO: 964450 - DNA, 22 bp, Artificial Sequence
  chemically synthesized
ttttttggcatgaaatctgtaa

SEQ ID NO: 964451 - DNA, 22 bp, Artificial Sequence
  chemically synthesized
tttttttggcatgaaatctgta

SEQ ID NO: 964452 - DNA, 22 bp, Artificial Sequence
  chemically synthesized
ttttttttggcatgaaatctgt

SEQ ID NO: 964453 - DNA, 22 bp, Artificial Sequence
  chemically synthesized
tttttttttggcatgaaatctg

SEQ ID NO: 964454 - DNA, 22 bp, Artificial Sequence
  chemically synthesized
ttttttttttggcatgaaatct

SEQ ID NO: 964455 - DNA, 22 bp, Artificial Sequence
  chemically synthesized
tccagtgttacagatttcatgc

SEQ ID NO: 964456 - DNA, 22 bp, Artificial Sequence
  chemically synthesized
ccagtgttacagatttcatgcc

SEQ ID NO: 964457 - DNA, 22 bp, Artificial Sequence
  chemically synthesized
cagtgttacagatttcatgcca

SEQ ID NO: 964458 - DNA, 22 bp, Artificial Sequence
  chemically synthesized
aataaacttttttttttttggc

SEQ ID NO: 964459 - DNA, 22 bp, Artificial Sequence
  chemically synthesized
cagatttcatgccaaaaaaaaa

SEQ ID NO: 964460 - DNA, 22 bp, Artificial Sequence
  chemically synthesized
catgccaaaaaaaaaaaagttt

SEQ ID NO: 964461 - DNA, 22 bp, Artificial Sequence
  chemically synthesized
atgccaaaaaaaaaaaagttta

SEQ ID NO: 964462 - DNA, 22 bp, Artificial Sequence
  chemically synthesized
cgcgcatccctaaataaacttt

SEQ ID NO: 964463 - DNA, 22 bp, Artificial Sequence
  chemically synthesized
ctgcgcgcatccctaaataaac

SEQ ID NO: 964464 - DNA, 22 bp, Artificial Sequence
  chemically synthesized
caggcgtcagctgctgcgcgca

SEQ ID NO: 964465 - DNA, 22 bp, Artificial Sequence
  chemically synthesized
atttagggatgcgcgcagcagc

SEQ ID NO: 964466 - DNA, 22 bp, Artificial Sequence
  chemically synthesized
tttagggatgcgcgcagcagct

SEQ ID NO: 964467 - DNA, 22 bp, Artificial Sequence
  chemically synthesized
agattacaggcgtcagctgctg

SEQ ID NO: 964468 - DNA, 22 bp, Artificial Sequence
  chemically synthesized
agggatgcgcgcagcagctgac

SEQ ID NO: 964469 - DNA, 22 bp, Artificial Sequence
  chemically synthesized
gggatgcgcgcagcagctgacg

SEQ ID NO: 964470 - DNA, 22 bp, Artificial Sequence
  chemically synthesized
ccaaagtgctgagattacaggc

SEQ ID NO: 964471 - DNA, 22 bp, Artificial Sequence
  chemically synthesized
ggcctcccaaagtgctgagatt

SEQ ID NO: 964472 - DNA, 22 bp, Artificial Sequence
  chemically synthesized
ctcggcctcccaaagtgctgag

SEQ ID NO: 964473 - DNA, 22 bp, Artificial Sequence
  chemically synthesized
acgcctgtaatctcagcacttt

SEQ ID NO: 964474 - DNA, 22 bp, Artificial Sequence
  chemically synthesized
ccctactcggcctcccaaagtg

SEQ ID NO: 964475 - DNA, 22 bp, Artificial Sequence
  chemically synthesized
taatctcagcactttgggaggc

SEQ ID NO: 964476 - DNA, 22 bp, Artificial Sequence
  chemically synthesized
agcactttgggaggccgagtag

SEQ ID NO: 964477 - DNA, 22 bp, Artificial Sequence
  chemically synthesized
aagcagtctgccctactcggcc

SEQ ID NO: 964478 - DNA, 22 bp, Artificial Sequence
  chemically synthesized
gtctcaagcagtctgccctact

SEQ ID NO: 964479 - DNA, 22 bp, Artificial Sequence
  chemically synthesized
tgggaggccgagtagggcagac

SEQ ID NO: 964480 - DNA, 22 bp, Artificial Sequence
  chemically synthesized
gggaggccgagtagggcagact

SEQ ID NO: 964481 - DNA, 22 bp, Artificial Sequence
  chemically synthesized
ctggtctcaagcagtctgccct

SEQ ID NO: 964482 - DNA, 22 bp, Artificial Sequence
  chemically synthesized
ggaggccgagtagggcagactg

SEQ ID NO: 964483 - DNA, 22 bp, Artificial Sequence
  chemically synthesized
gaactcctggtctcaagcagtc

SEQ ID NO: 964484 - DNA, 22 bp, Artificial Sequence
  chemically synthesized
gtctcgaactcctggtctcaag

SEQ ID NO: 964485 - DNA, 22 bp, Artificial Sequence
  chemically synthesized
cccaggctggtctcgaactcct

SEQ ID NO: 964486 - DNA, 22 bp, Artificial Sequence
  chemically synthesized
cttgagaccaggagttcgagac

SEQ ID NO: 964487 - DNA, 22 bp, Artificial Sequence
  chemically synthesized
gagaccaggagttcgagaccag

SEQ ID NO: 964488 - DNA, 22 bp, Artificial Sequence
  chemically synthesized
agaccaggagttcgagaccagc

SEQ ID NO: 964489 - DNA, 22 bp, Artificial Sequence
  chemically synthesized
accatgttgcccaggctggtct

SEQ ID NO: 964490 - DNA, 22 bp, Artificial Sequence
  chemically synthesized
caccatgttgcccaggctggtc

SEQ ID NO: 964491 - DNA, 22 bp, Artificial Sequence
  chemically synthesized
gagaccagcctgggcaacatgg

SEQ ID NO: 964492 - DNA, 22 bp, Artificial Sequence
  chemically synthesized
gtggagacggggtttcaccatg

SEQ ID NO: 964493 - DNA, 22 bp, Artificial Sequence
  chemically synthesized
agtggagacggggtttcaccat

SEQ ID NO: 964494 - DNA, 22 bp, Artificial Sequence
  chemically synthesized
tagtggagacggggtttcacca

SEQ ID NO: 964495 - DNA, 22 bp, Artificial Sequence
  chemically synthesized
ggcaacatggtgaaaccccgtc

SEQ ID NO: 964496 - DNA, 22 bp, Artificial Sequence
  chemically synthesized
tatctttagtggagacggggtt

SEQ ID NO: 964497 - DNA, 22 bp, Artificial Sequence
  chemically synthesized
gtatctttagtggagacggggt

SEQ ID NO: 964498 - DNA, 22 bp, Artificial Sequence
  chemically synthesized
tgtatctttagtggagacgggg

SEQ ID NO: 964499 - DNA, 22 bp, Artificial Sequence
  chemically synthesized
ttgtatctttagtggagacggg

SEQ ID NO: 964500 - DNA, 22 bp, Artificial Sequence
  chemically synthesized
atttttgtatctttagtggaga

SEQ ID NO: 964501 - DNA, 22 bp, Artificial Sequence
  chemically synthesized
gctaatttttgtatctttagtg

SEQ ID NO: 964502 - DNA, 22 bp, Artificial Sequence
  chemically synthesized
cactaaagatacaaaaattagc

SEQ ID NO: 964503 - DNA, 22 bp, Artificial Sequence
  chemically synthesized
ccaccacgcctggctaattttt

SEQ ID NO: 964504 - DNA, 22 bp, Artificial Sequence
  chemically synthesized
aagatacaaaaattagccaggc

SEQ ID NO: 964505 - DNA, 22 bp, Artificial Sequence
  chemically synthesized
taagtgtctgccaccacgcctg

SEQ ID NO: 964506 - DNA, 22 bp, Artificial Sequence
  chemically synthesized
ggattataagtgtctgccacca

SEQ ID NO: 964507 - DNA, 22 bp, Artificial Sequence
  chemically synthesized
gccaggcgtggtggcagacact

SEQ ID NO: 964508 - DNA, 22 bp, Artificial Sequence
  chemically synthesized
cagtagctgggattataagtgt

SEQ ID NO: 964509 - DNA, 22 bp, Artificial Sequence
  chemically synthesized
ccagtagctgggattataagtg

SEQ ID NO: 964510 - DNA, 22 bp, Artificial Sequence
  chemically synthesized
tcttccagtagctgggattata

SEQ ID NO: 964511 - DNA, 22 bp, Artificial Sequence
  chemically synthesized
tgtcttccagtagctgggatta

SEQ ID NO: 964512 - DNA, 22 bp, Artificial Sequence
  chemically synthesized
cctctgtcttccagtagctggg

SEQ ID NO: 964513 - DNA, 22 bp, Artificial Sequence
  chemically synthesized
ctgcctctgtcttccagtagct

SEQ ID NO: 964514 - DNA, 22 bp, Artificial Sequence
  chemically synthesized
tcctgcctctgtcttccagtag

SEQ ID NO: 964515 - DNA, 22 bp, Artificial Sequence
  chemically synthesized
ataatcccagctactggaagac

SEQ ID NO: 964516 - DNA, 22 bp, Artificial Sequence
  chemically synthesized
taatcccagctactggaagaca

SEQ ID NO: 964517 - DNA, 22 bp, Artificial Sequence
  chemically synthesized
aaatgattctcctgcctctgtc

SEQ ID NO: 964518 - DNA, 22 bp, Artificial Sequence
  chemically synthesized
ctggaagacagaggcaggagaa

SEQ ID NO: 964519 - DNA, 22 bp, Artificial Sequence
  chemically synthesized
gaagacagaggcaggagaatca

SEQ ID NO: 964520 - DNA, 22 bp, Artificial Sequence
  chemically synthesized
cccatcgtgggctcaaatgatt

SEQ ID NO: 964521 - DNA, 22 bp, Artificial Sequence
  chemically synthesized
caacctccccatcgtgggctca

SEQ ID NO: 964522 - DNA, 22 bp, Artificial Sequence
  chemically synthesized
actgcaacctccccatcgtggg

SEQ ID NO: 964523 - DNA, 22 bp, Artificial Sequence
  chemically synthesized
gagcccacgatggggaggttgc

SEQ ID NO: 964524 - DNA, 22 bp, Artificial Sequence
  chemically synthesized
agcccacgatggggaggttgca

SEQ ID NO: 964525 - DNA, 22 bp, Artificial Sequence
  chemically synthesized
cagtgagctgtgaccatgccat

SEQ ID NO: 964526 - DNA, 22 bp, Artificial Sequence
  chemically synthesized
gagtgcagtgcaatggcatggt

SEQ ID NO: 964527 - DNA, 22 bp, Artificial Sequence
  chemically synthesized
tgaccatgccattgcactgcac

SEQ ID NO: 964528 - DNA, 22 bp, Artificial Sequence
  chemically synthesized
tcacccaggctggagtgcagtg

SEQ ID NO: 964529 - DNA, 22 bp, Artificial Sequence
  chemically synthesized
tgtcacccaggctggagtgcag

SEQ ID NO: 964530 - DNA, 22 bp, Artificial Sequence
  chemically synthesized
gttctgtcacccaggctggagt

SEQ ID NO: 964531 - DNA, 22 bp, Artificial Sequence
  chemically synthesized
cactgcactccagcctgggtga

SEQ ID NO: 964532 - DNA, 22 bp, Artificial Sequence
  chemically synthesized
cactccagcctgggtgacagaa

SEQ ID NO: 964533 - DNA, 22 bp, Artificial Sequence
  chemically synthesized
agacagagtctcgttctgtcac

SEQ ID NO: 964534 - DNA, 22 bp, Artificial Sequence
  chemically synthesized
gagacagagtctcgttctgtca

SEQ ID NO: 964535 - DNA, 22 bp, Artificial Sequence
  chemically synthesized
tgagacagagtctcgttctgtc

SEQ ID NO: 964536 - DNA, 22 bp, Artificial Sequence
  chemically synthesized
ttgagacagagtctcgttctgt

SEQ ID NO: 964537 - DNA, 22 bp, Artificial Sequence
  chemically synthesized
cagcctgggtgacagaacgaga

SEQ ID NO: 964538 - DNA, 22 bp, Artificial Sequence
  chemically synthesized
tttgagacagagtctcgttctg

SEQ ID NO: 964539 - DNA, 22 bp, Artificial Sequence
  chemically synthesized
ttttgagacagagtctcgttct

SEQ ID NO: 964540 - DNA, 22 bp, Artificial Sequence
  chemically synthesized
tttttgagacagagtctcgttc

SEQ ID NO: 964541 - DNA, 22 bp, Artificial Sequence
  chemically synthesized
ttttttgagacagagtctcgtt

SEQ ID NO: 964542 - DNA, 22 bp, Artificial Sequence
  chemically synthesized
tttttttgagacagagtctcgt

SEQ ID NO: 964543 - DNA, 22 bp, Artificial Sequence
  chemically synthesized
ttttttttgagacagagtctcg

SEQ ID NO: 964544 - DNA, 22 bp, Artificial Sequence
  chemically synthesized
tttttttttgagacagagtctc

SEQ ID NO: 964545 - DNA, 22 bp, Artificial Sequence
  chemically synthesized
ggtgacagaacgagactctgtc

SEQ ID NO: 964546 - DNA, 22 bp, Artificial Sequence
  chemically synthesized
ttttttttttgagacagagtct

SEQ ID NO: 964547 - DNA, 22 bp, Artificial Sequence
  chemically synthesized
tttttttttttgagacagagtc

SEQ ID NO: 964548 - DNA, 22 bp, Artificial Sequence
  chemically synthesized
ttttttttttttgagacagagt

SEQ ID NO: 964549 - DNA, 22 bp, Artificial Sequence
  chemically synthesized
tttttttttttttgagacagag

SEQ ID NO: 964550 - DNA, 22 bp, Artificial Sequence
  chemically synthesized
ttttttttttttttgagacaga

SEQ ID NO: 964551 - DNA, 22 bp, Artificial Sequence
  chemically synthesized
tttttttttttttttgagacag

SEQ ID NO: 964552 - DNA, 22 bp, Artificial Sequence
  chemically synthesized
ttttttttttttttttgagaca

SEQ ID NO: 964553 - DNA, 22 bp, Artificial Sequence
  chemically synthesized
tttttttttttttttttgagac

SEQ ID NO: 964554 - DNA, 22 bp, Artificial Sequence
  chemically synthesized
ttttttttttttttttttgaga

SEQ ID NO: 964555 - DNA, 22 bp, Artificial Sequence
  chemically synthesized
tttttttttttttttttttgag

SEQ ID NO: 964556 - DNA, 22 bp, Artificial Sequence
  chemically synthesized
ttttttttttttttttttttga

SEQ ID NO: 964557 - DNA, 22 bp, Artificial Sequence
  chemically synthesized
tttttttttttttttttttttg

SEQ ID NO: 964558 - DNA, 22 bp, Artificial Sequence
  chemically synthesized
tttttttttttttttttttttt

SEQ ID NO: 964559 - DNA, 22 bp, Artificial Sequence
  chemically synthesized
tttttttttttttttttttttt

SEQ ID NO: 964560 - DNA, 22 bp, Artificial Sequence
  chemically synthesized
tttttttttttttttttttttt

SEQ ID NO: 964561 - DNA, 22 bp, Artificial Sequence
  chemically synthesized
tttttttttttttttttttttt

SEQ ID NO: 964562 - DNA, 22 bp, Artificial Sequence
  chemically synthesized
tttttttttttttttttttttt

SEQ ID NO: 964563 - DNA, 22 bp, Artificial Sequence
  chemically synthesized
tttttttttttttttttttttt

SEQ ID NO: 964564 - DNA, 22 bp, Artificial Sequence
  chemically synthesized
tgtctcaaaaaaaaaaaaaaaa

SEQ ID NO: 964565 - DNA, 22 bp, Artificial Sequence
  chemically synthesized
tttttttttttttttttttttt

SEQ ID NO: 964566 - DNA, 22 bp, Artificial Sequence
  chemically synthesized
tttttttttttttttttttttt

SEQ ID NO: 964567 - DNA, 22 bp, Artificial Sequence
  chemically synthesized
tctcaaaaaaaaaaaaaaaaaa

SEQ ID NO: 964568 - DNA, 22 bp, Artificial Sequence
  chemically synthesized
tttttttttttttttttttttt

SEQ ID NO: 964569 - DNA, 22 bp, Artificial Sequence
  chemically synthesized
tttttttttttttttttttttt

SEQ ID NO: 964570 - DNA, 22 bp, Artificial Sequence
  chemically synthesized
tttttttttttttttttttttt

SEQ ID NO: 964571 - DNA, 22 bp, Artificial Sequence
  chemically synthesized
tttttttttttttttttttttt

SEQ ID NO: 964572 - DNA, 22 bp, Artificial Sequence
  chemically synthesized
aaaaaaaaaaaaaaaaaaaaaa

SEQ ID NO: 964573 - DNA, 22 bp, Artificial Sequence
  chemically synthesized
tttttttttttttttttttttt

SEQ ID NO: 964574 - DNA, 22 bp, Artificial Sequence
  chemically synthesized
tctttttttttttttttttttt

SEQ ID NO: 964575 - DNA, 22 bp, Artificial Sequence
  chemically synthesized
tctctttttttttttttttttt

SEQ ID NO: 964576 - DNA, 22 bp, Artificial Sequence
  chemically synthesized
tctctctttttttttttttttt

SEQ ID NO: 964577 - DNA, 22 bp, Artificial Sequence
  chemically synthesized
tctctctctttttttttttttt

SEQ ID NO: 964578 - DNA, 22 bp, Artificial Sequence
  chemically synthesized
tctctctctctttttttttttt

SEQ ID NO: 964579 - DNA, 22 bp, Artificial Sequence
  chemically synthesized
tctctctctctctttttttttt

SEQ ID NO: 964580 - DNA, 22 bp, Artificial Sequence
  chemically synthesized
tctctctctctctctttttttt

SEQ ID NO: 964581 - DNA, 22 bp, Artificial Sequence
  chemically synthesized
tctctctctctctctctttttt

SEQ ID NO: 964582 - DNA, 22 bp, Artificial Sequence
  chemically synthesized
tctctctctctctctctctttt

SEQ ID NO: 964583 - DNA, 22 bp, Artificial Sequence
  chemically synthesized
ctctctctctctctctctcttt

SEQ ID NO: 964584 - DNA, 22 bp, Artificial Sequence
  chemically synthesized
aataacttctctctctctctct

SEQ ID NO: 964585 - DNA, 22 bp, Artificial Sequence
  chemically synthesized
taaataacttctctctctctct

SEQ ID NO: 964586 - DNA, 22 bp, Artificial Sequence
  chemically synthesized
gttctaaataacttctctctct

SEQ ID NO: 964587 - DNA, 22 bp, Artificial Sequence
  chemically synthesized
ttagttctaaataacttctctc

SEQ ID NO: 964588 - DNA, 22 bp, Artificial Sequence
  chemically synthesized
catactgttagttctaaataac

SEQ ID NO: 964589 - DNA, 22 bp, Artificial Sequence
  chemically synthesized
gcatactgttagttctaaataa

SEQ ID NO: 964590 - DNA, 22 bp, Artificial Sequence
  chemically synthesized
tttagaactaacagtatgcaag

SEQ ID NO: 964591 - DNA, 22 bp, Artificial Sequence
  chemically synthesized
agaactaacagtatgcaaggca

SEQ ID NO: 964592 - DNA, 22 bp, Artificial Sequence
  chemically synthesized
gaactaacagtatgcaaggcac

SEQ ID NO: 964593 - DNA, 22 bp, Artificial Sequence
  chemically synthesized
gcagccagcacagtgccttgca

SEQ ID NO: 964594 - DNA, 22 bp, Artificial Sequence
  chemically synthesized
acagtatgcaaggcactgtgct

SEQ ID NO: 964595 - DNA, 22 bp, Artificial Sequence
  chemically synthesized
ccattagcagccagcacagtgc

SEQ ID NO: 964596 - DNA, 22 bp, Artificial Sequence
  chemically synthesized
tgtctcccattagcagccagca

SEQ ID NO: 964597 - DNA, 22 bp, Artificial Sequence
  chemically synthesized
gtgtctcccattagcagccagc

SEQ ID NO: 964598 - DNA, 22 bp, Artificial Sequence
  chemically synthesized
tgtgtctcccattagcagccag

SEQ ID NO: 964599 - DNA, 22 bp, Artificial Sequence
  chemically synthesized
ctttgtgtctcccattagcagc

SEQ ID NO: 964600 - DNA, 22 bp, Artificial Sequence
  chemically synthesized
cattcctttgtgtctcccatta

SEQ ID NO: 964601 - DNA, 22 bp, Artificial Sequence
  chemically synthesized
gcattcctttgtgtctcccatt

SEQ ID NO: 964602 - DNA, 22 bp, Artificial Sequence
  chemically synthesized
tgctggctgctaatgggagaca

SEQ ID NO: 964603 - DNA, 22 bp, Artificial Sequence
  chemically synthesized
tgcattcctttgtgtctcccat

SEQ ID NO: 964604 - DNA, 22 bp, Artificial Sequence
  chemically synthesized
gctgctaatgggagacacaaag

SEQ ID NO: 964605 - DNA, 22 bp, Artificial Sequence
  chemically synthesized
ctaatgggagacacaaaggaat

SEQ ID NO: 964606 - DNA, 22 bp, Artificial Sequence
  chemically synthesized
atgggagacacaaaggaatgca

SEQ ID NO: 964607 - DNA, 22 bp, Artificial Sequence
  chemically synthesized
gagggtcatgactttgcattcc

SEQ ID NO: 964608 - DNA, 22 bp, Artificial Sequence
  chemically synthesized
tggagggtcatgactttgcatt

SEQ ID NO: 964609 - DNA, 22 bp, Artificial Sequence
  chemically synthesized
taatcctctggagggtcatgac

SEQ ID NO: 964610 - DNA, 22 bp, Artificial Sequence
  chemically synthesized
aggttataatcctctggagggt

SEQ ID NO: 964611 - DNA, 22 bp, Artificial Sequence
  chemically synthesized
cgctgaggttataatcctctgg

SEQ ID NO: 964612 - DNA, 22 bp, Artificial Sequence
  chemically synthesized
ccgctgaggttataatcctctg

SEQ ID NO: 964613 - DNA, 22 bp, Artificial Sequence
  chemically synthesized
tccgctgaggttataatcctct

SEQ ID NO: 964614 - DNA, 22 bp, Artificial Sequence
  chemically synthesized
tctttccgctgaggttataatc

SEQ ID NO: 964615 - DNA, 22 bp, Artificial Sequence
  chemically synthesized
tctgtctttccgctgaggttat

SEQ ID NO: 964616 - DNA, 22 bp, Artificial Sequence
  chemically synthesized
cagaggattataacctcagcgg

SEQ ID NO: 964617 - DNA, 22 bp, Artificial Sequence
  chemically synthesized
tacacctgtctgtctttccgct

SEQ ID NO: 964618 - DNA, 22 bp, Artificial Sequence
  chemically synthesized
gtacacctgtctgtctttccgc

SEQ ID NO: 964619 - DNA, 22 bp, Artificial Sequence
  chemically synthesized
cttgtacacctgtctgtctttc

SEQ ID NO: 964620 - DNA, 22 bp, Artificial Sequence
  chemically synthesized
taacctcagcggaaagacagac

SEQ ID NO: 964621 - DNA, 22 bp, Artificial Sequence
  chemically synthesized
agcggaaagacagacaggtgta

SEQ ID NO: 964622 - DNA, 22 bp, Artificial Sequence
  chemically synthesized
tatcatagctgcttgtacacct

SEQ ID NO: 964623 - DNA, 22 bp, Artificial Sequence
  chemically synthesized
gtatcatagctgcttgtacacc

SEQ ID NO: 964624 - DNA, 22 bp, Artificial Sequence
  chemically synthesized
ccttgtatcatagctgcttgta

SEQ ID NO: 964625 - DNA, 22 bp, Artificial Sequence
  chemically synthesized
gccttgtatcatagctgcttgt

SEQ ID NO: 964626 - DNA, 22 bp, Artificial Sequence
  chemically synthesized
catttgccttgtatcatagctg

SEQ ID NO: 964627 - DNA, 22 bp, Artificial Sequence
  chemically synthesized
cctccatttgccttgtatcata

SEQ ID NO: 964628 - DNA, 22 bp, Artificial Sequence
  chemically synthesized
aagcattacctccatttgcctt

SEQ ID NO: 964629 - DNA, 22 bp, Artificial Sequence
  chemically synthesized
aaagcattacctccatttgcct

SEQ ID NO: 964630 - DNA, 22 bp, Artificial Sequence
  chemically synthesized
taaagcattacctccatttgcc

SEQ ID NO: 964631 - DNA, 22 bp, Artificial Sequence
  chemically synthesized
ttaaagcattacctccatttgc

SEQ ID NO: 964632 - DNA, 22 bp, Artificial Sequence
  chemically synthesized
ttttaaagcattacctccattt

SEQ ID NO: 964633 - DNA, 22 bp, Artificial Sequence
  chemically synthesized
tgatacaaggcaaatggaggta

SEQ ID NO: 964634 - DNA, 22 bp, Artificial Sequence
  chemically synthesized
gctcttttaaagcattacctcc

SEQ ID NO: 964635 - DNA, 22 bp, Artificial Sequence
  chemically synthesized
tctagctcttttaaagcattac

SEQ ID NO: 964636 - DNA, 22 bp, Artificial Sequence
  chemically synthesized
ccctgtctagctcttttaaagc

SEQ ID NO: 964637 - DNA, 22 bp, Artificial Sequence
  chemically synthesized
cccctgtctagctcttttaaag

SEQ ID NO: 964638 - DNA, 22 bp, Artificial Sequence
  chemically synthesized
cttcccctgtctagctctttta

SEQ ID NO: 964639 - DNA, 22 bp, Artificial Sequence
  chemically synthesized
taaaagagctagacaggggaag

SEQ ID NO: 964640 - DNA, 22 bp, Artificial Sequence
  chemically synthesized
aaaagagctagacaggggaagg

SEQ ID NO: 964641 - DNA, 22 bp, Artificial Sequence
  chemically synthesized
gaggtaacatctccttcccctg

SEQ ID NO: 964642 - DNA, 22 bp, Artificial Sequence
  chemically synthesized
aaagagctagacaggggaagga

SEQ ID NO: 964643 - DNA, 22 bp, Artificial Sequence
  chemically synthesized
ccactagaggtaacatctcctt

SEQ ID NO: 964644 - DNA, 22 bp, Artificial Sequence
  chemically synthesized
cccactagaggtaacatctcct

SEQ ID NO: 964645 - DNA, 22 bp, Artificial Sequence
  chemically synthesized
gacaggggaaggagatgttacc

SEQ ID NO: 964646 - DNA, 22 bp, Artificial Sequence
  chemically synthesized
aaatttcccactagaggtaaca

SEQ ID NO: 964647 - DNA, 22 bp, Artificial Sequence
  chemically synthesized
tcatgaagtcatctaaaatttc

SEQ ID NO: 964648 - DNA, 22 bp, Artificial Sequence
  chemically synthesized
cctctagtgggaaattttagat

SEQ ID NO: 964649 - DNA, 22 bp, Artificial Sequence
  chemically synthesized
tagtgggaaattttagatgact

SEQ ID NO: 964650 - DNA, 22 bp, Artificial Sequence
  chemically synthesized
gtgggaaattttagatgacttc

SEQ ID NO: 964651 - DNA, 22 bp, Artificial Sequence
  chemically synthesized
tagatgacttcatgacaatgtt

SEQ ID NO: 964652 - DNA, 22 bp, Artificial Sequence
  chemically synthesized
tggccagagcacaacattgtca

SEQ ID NO: 964653 - DNA, 22 bp, Artificial Sequence
  chemically synthesized
agatgacttcatgacaatgttg

SEQ ID NO: 964654 - DNA, 22 bp, Artificial Sequence
  chemically synthesized
atggccagagcacaacattgtc

SEQ ID NO: 964655 - DNA, 22 bp, Artificial Sequence
  chemically synthesized
gatgacttcatgacaatgttgt

SEQ ID NO: 964656 - DNA, 22 bp, Artificial Sequence
  chemically synthesized
tatggccagagcacaacattgt

SEQ ID NO: 964657 - DNA, 22 bp, Artificial Sequence
  chemically synthesized
ctttatggccagagcacaacat

SEQ ID NO: 964658 - DNA, 22 bp, Artificial Sequence
  chemically synthesized
cctttatggccagagcacaaca

SEQ ID NO: 964659 - DNA, 22 bp, Artificial Sequence
  chemically synthesized
catgacaatgttgtgctctggc

SEQ ID NO: 964660 - DNA, 22 bp, Artificial Sequence
  chemically synthesized
atgacaatgttgtgctctggcc

SEQ ID NO: 964661 - DNA, 22 bp, Artificial Sequence
  chemically synthesized
tgtttcctttatggccagagca

SEQ ID NO: 964662 - DNA, 22 bp, Artificial Sequence
  chemically synthesized
atgtttcctttatggccagagc

SEQ ID NO: 964663 - DNA, 22 bp, Artificial Sequence
  chemically synthesized
tgctctggccataaaggaaaca

SEQ ID NO: 964664 - DNA, 22 bp, Artificial Sequence
  chemically synthesized
tggccataaaggaaacataaga

SEQ ID NO: 964665 - DNA, 22 bp, Artificial Sequence
  chemically synthesized
gccataaaggaaacataagact

SEQ ID NO: 964666 - DNA, 22 bp, Artificial Sequence
  chemically synthesized
aaaaaaaaaaaaaagaaagaaa

SEQ ID NO: 964667 - DNA, 22 bp, Artificial Sequence
  chemically synthesized
ctttttttctttctttcttttt

SEQ ID NO: 964668 - DNA, 22 bp, Artificial Sequence
  chemically synthesized
tttttttctttctttctttttt

SEQ ID NO: 964669 - DNA, 22 bp, Artificial Sequence
  chemically synthesized
tctcaaaaaaaaaaaaaagaaa

SEQ ID NO: 964670 - DNA, 22 bp, Artificial Sequence
  chemically synthesized
tttttctttctttctttttttt

SEQ ID NO: 964671 - DNA, 22 bp, Artificial Sequence
  chemically synthesized
tgtctcaaaaaaaaaaaaaaga

SEQ ID NO: 964672 - DNA, 22 bp, Artificial Sequence
  chemically synthesized
ttttctttctttcttttttttt

SEQ ID NO: 964673 - DNA, 22 bp, Artificial Sequence
  chemically synthesized
tttctttctttctttttttttt

SEQ ID NO: 964674 - DNA, 22 bp, Artificial Sequence
  chemically synthesized
ttctttctttcttttttttttt

SEQ ID NO: 964675 - DNA, 22 bp, Artificial Sequence
  chemically synthesized
tctttctttctttttttttttt

SEQ ID NO: 964676 - DNA, 22 bp, Artificial Sequence
  chemically synthesized
ctttctttcttttttttttttt

SEQ ID NO: 964677 - DNA, 22 bp, Artificial Sequence
  chemically synthesized
tttctttctttttttttttttt

SEQ ID NO: 964678 - DNA, 22 bp, Artificial Sequence
  chemically synthesized
tctttcttttttttttttttga

SEQ ID NO: 964679 - DNA, 22 bp, Artificial Sequence
  chemically synthesized
ctttcttttttttttttttgag

SEQ ID NO: 964680 - DNA, 22 bp, Artificial Sequence
  chemically synthesized
tttcttttttttttttttgaga

SEQ ID NO: 964681 - DNA, 22 bp, Artificial Sequence
  chemically synthesized
tcttttttttttttttgagaca

SEQ ID NO: 964682 - DNA, 22 bp, Artificial Sequence
  chemically synthesized
cttttttttttttttgagacag

SEQ ID NO: 964683 - DNA, 22 bp, Artificial Sequence
  chemically synthesized
ttttttttttttttgagacaga

SEQ ID NO: 964684 - DNA, 22 bp, Artificial Sequence
  chemically synthesized
ttttttttttttgagacagagt

SEQ ID NO: 964685 - DNA, 22 bp, Artificial Sequence
  chemically synthesized
tttttttttttgagacagagtc

SEQ ID NO: 964686 - DNA, 22 bp, Artificial Sequence
  chemically synthesized
ttttttttttgagacagagtct

SEQ ID NO: 964687 - DNA, 22 bp, Artificial Sequence
  chemically synthesized
ggtgacagagcgagactctgtc

SEQ ID NO: 964688 - DNA, 22 bp, Artificial Sequence
  chemically synthesized
tttttttttgagacagagtctc

SEQ ID NO: 964689 - DNA, 22 bp, Artificial Sequence
  chemically synthesized
ttttttttgagacagagtctcg

SEQ ID NO: 964690 - DNA, 22 bp, Artificial Sequence
  chemically synthesized
tttttttgagacagagtctcgc

SEQ ID NO: 964691 - DNA, 22 bp, Artificial Sequence
  chemically synthesized
ttttttgagacagagtctcgct

SEQ ID NO: 964692 - DNA, 22 bp, Artificial Sequence
  chemically synthesized
tttttgagacagagtctcgctc

SEQ ID NO: 964693 - DNA, 22 bp, Artificial Sequence
  chemically synthesized
ttttgagacagagtctcgctct

SEQ ID NO: 964694 - DNA, 22 bp, Artificial Sequence
  chemically synthesized
tttgagacagagtctcgctctg

SEQ ID NO: 964695 - DNA, 22 bp, Artificial Sequence
  chemically synthesized
cagcctgggtgacagagcgaga

SEQ ID NO: 964696 - DNA, 22 bp, Artificial Sequence
  chemically synthesized
ttgagacagagtctcgctctgt

SEQ ID NO: 964697 - DNA, 22 bp, Artificial Sequence
  chemically synthesized
tgagacagagtctcgctctgtc

SEQ ID NO: 964698 - DNA, 22 bp, Artificial Sequence
  chemically synthesized
gagacagagtctcgctctgtca

SEQ ID NO: 964699 - DNA, 22 bp, Artificial Sequence
  chemically synthesized
agacagagtctcgctctgtcac

SEQ ID NO: 964700 - DNA, 22 bp, Artificial Sequence
  chemically synthesized
cactccagcctgggtgacagag

SEQ ID NO: 964701 - DNA, 22 bp, Artificial Sequence
  chemically synthesized
gctctgtcacccaggctggagt

SEQ ID NO: 964702 - DNA, 22 bp, Artificial Sequence
  chemically synthesized
agatcacgacactccactccag

SEQ ID NO: 964703 - DNA, 22 bp, Artificial Sequence
  chemically synthesized
tgtcacccaggctggagtggag

SEQ ID NO: 964704 - DNA, 22 bp, Artificial Sequence
  chemically synthesized
tcacccaggctggagtggagtg

SEQ ID NO: 964705 - DNA, 22 bp, Artificial Sequence
  chemically synthesized
cagtgagctgagatcacgacac

SEQ ID NO: 964706 - DNA, 22 bp, Artificial Sequence
  chemically synthesized
gcagtgagctgagatcacgaca

SEQ ID NO: 964707 - DNA, 22 bp, Artificial Sequence
  chemically synthesized
gagtggagtgtcgtgatctcag

SEQ ID NO: 964708 - DNA, 22 bp, Artificial Sequence
  chemically synthesized
agctcactgcaagctccacctc

SEQ ID NO: 964709 - DNA, 22 bp, Artificial Sequence
  chemically synthesized
actgcaagctccacctcccggg

SEQ ID NO: 964710 - DNA, 22 bp, Artificial Sequence
  chemically synthesized
caagctccacctcccgggttca

SEQ ID NO: 964711 - DNA, 22 bp, Artificial Sequence
  chemically synthesized
aggcaggaaaatggtgtgaacc

SEQ ID NO: 964712 - DNA, 22 bp, Artificial Sequence
  chemically synthesized
cacctcccgggttcacaccatt

SEQ ID NO: 964713 - DNA, 22 bp, Artificial Sequence
  chemically synthesized
ccgggttcacaccattttcctg

SEQ ID NO: 964714 - DNA, 22 bp, Artificial Sequence
  chemically synthesized
gggaggctgaggcaggaaaatg

SEQ ID NO: 964715 - DNA, 22 bp, Artificial Sequence
  chemically synthesized
ctcgggaggctgaggcaggaaa

SEQ ID NO: 964716 - DNA, 22 bp, Artificial Sequence
  chemically synthesized
acaccattttcctgcctcagcc

SEQ ID NO: 964717 - DNA, 22 bp, Artificial Sequence
  chemically synthesized
tagtcccagctactcgggaggc

SEQ ID NO: 964718 - DNA, 22 bp, Artificial Sequence
  chemically synthesized
tcctgcctcagcctcccgagta

SEQ ID NO: 964719 - DNA, 22 bp, Artificial Sequence
  chemically synthesized
cctgcctcagcctcccgagtag

SEQ ID NO: 964720 - DNA, 22 bp, Artificial Sequence
  chemically synthesized
ctgcctcagcctcccgagtagc

SEQ ID NO: 964721 - DNA, 22 bp, Artificial Sequence
  chemically synthesized
cctcagcctcccgagtagctgg

SEQ ID NO: 964722 - DNA, 22 bp, Artificial Sequence
  chemically synthesized
agcctcccgagtagctgggact

SEQ ID NO: 964723 - DNA, 22 bp, Artificial Sequence
  chemically synthesized
gcaggcgcctgtagtcccagct

SEQ ID NO: 964724 - DNA, 22 bp, Artificial Sequence
  chemically synthesized
ccgagtagctgggactacaggc

SEQ ID NO: 964725 - DNA, 22 bp, Artificial Sequence
  chemically synthesized
gccgggcgtgctggcaggcgcc

SEQ ID NO: 964726 - DNA, 22 bp, Artificial Sequence
  chemically synthesized
ggactacaggcgcctgccagca

SEQ ID NO: 964727 - DNA, 22 bp, Artificial Sequence
  chemically synthesized
caggcgcctgccagcacgcccg

SEQ ID NO: 964728 - DNA, 22 bp, Artificial Sequence
  chemically synthesized
aaaatataaaaaattagccggg

SEQ ID NO: 964729 - DNA, 22 bp, Artificial Sequence
  chemically synthesized
ctaaaaatataaaaaattagcc

SEQ ID NO: 964730 - DNA, 22 bp, Artificial Sequence
  chemically synthesized
ccagcacgcccggctaattttt

SEQ ID NO: 964731 - DNA, 22 bp, Artificial Sequence
  chemically synthesized
tactaaaaatataaaaaattag

SEQ ID NO: 964732 - DNA, 22 bp, Artificial Sequence
  chemically synthesized
attttttatatttttagtagag

SEQ ID NO: 964733 - DNA, 22 bp, Artificial Sequence
  chemically synthesized
tttatatttttagtagagatgg

SEQ ID NO: 964734 - DNA, 22 bp, Artificial Sequence
  chemically synthesized
ttatatttttagtagagatggg

SEQ ID NO: 964735 - DNA, 22 bp, Artificial Sequence
  chemically synthesized
acacggtgaaaccccatctcta

SEQ ID NO: 964736 - DNA, 22 bp, Artificial Sequence
  chemically synthesized
tatatttttagtagagatgggg

SEQ ID NO: 964737 - DNA, 22 bp, Artificial Sequence
  chemically synthesized
atatttttagtagagatggggt

SEQ ID NO: 964738 - DNA, 22 bp, Artificial Sequence
  chemically synthesized
tatttttagtagagatggggtt

SEQ ID NO: 964739 - DNA, 22 bp, Artificial Sequence
  chemically synthesized
gctaacacggtgaaaccccatc

SEQ ID NO: 964740 - DNA, 22 bp, Artificial Sequence
  chemically synthesized
ttagtagagatggggtttcacc

SEQ ID NO: 964741 - DNA, 22 bp, Artificial Sequence
  chemically synthesized
tagtagagatggggtttcaccg

SEQ ID NO: 964742 - DNA, 22 bp, Artificial Sequence
  chemically synthesized
agtagagatggggtttcaccgt

SEQ ID NO: 964743 - DNA, 22 bp, Artificial Sequence
  chemically synthesized
gtagagatggggtttcaccgtg

SEQ ID NO: 964744 - DNA, 22 bp, Artificial Sequence
  chemically synthesized
caccgtgttagccaggatggtc

SEQ ID NO: 964745 - DNA, 22 bp, Artificial Sequence
  chemically synthesized
accgtgttagccaggatggtct

SEQ ID NO: 964746 - DNA, 22 bp, Artificial Sequence
  chemically synthesized
gccaggatggtctcgatctctt

SEQ ID NO: 964747 - DNA, 22 bp, Artificial Sequence
  chemically synthesized
aggcgggcggatcacatggtca

SEQ ID NO: 964748 - DNA, 22 bp, Artificial Sequence
  chemically synthesized
gatctcttgaccatgtgatccg

SEQ ID NO: 964749 - DNA, 22 bp, Artificial Sequence
  chemically synthesized
ggagcctgaggcgggcggatca

SEQ ID NO: 964750 - DNA, 22 bp, Artificial Sequence
  chemically synthesized
gggagcctgaggcgggcggatc

SEQ ID NO: 964751 - DNA, 22 bp, Artificial Sequence
  chemically synthesized
tgggagcctgaggcgggcggat

SEQ ID NO: 964752 - DNA, 22 bp, Artificial Sequence
  chemically synthesized
ttgaccatgtgatccgcccgcc

SEQ ID NO: 964753 - DNA, 22 bp, Artificial Sequence
  chemically synthesized
gaccatgtgatccgcccgcctc

SEQ ID NO: 964754 - DNA, 22 bp, Artificial Sequence
  chemically synthesized
accatgtgatccgcccgcctca

SEQ ID NO: 964755 - DNA, 22 bp, Artificial Sequence
  chemically synthesized
taatcccagcactttgggagcc

SEQ ID NO: 964756 - DNA, 22 bp, Artificial Sequence
  chemically synthesized
acgcctgtaatcccagcacttt

SEQ ID NO: 964757 - DNA, 22 bp, Artificial Sequence
  chemically synthesized
aggctcccaaagtgctgggatt

SEQ ID NO: 964758 - DNA, 22 bp, Artificial Sequence
  chemically synthesized
ccaaagtgctgggattacaggc

SEQ ID NO: 964759 - DNA, 22 bp, Artificial Sequence
  chemically synthesized
tgggccgggcagggtggctcac

SEQ ID NO: 964760 - DNA, 22 bp, Artificial Sequence
  chemically synthesized
ggattacaggcgtgagccaccc

SEQ ID NO: 964761 - DNA, 22 bp, Artificial Sequence
  chemically synthesized
atgggccgggcagggtggctca

SEQ ID NO: 964762 - DNA, 22 bp, Artificial Sequence
  chemically synthesized
caggcgtgagccaccctgcccg

SEQ ID NO: 964763 - DNA, 22 bp, Artificial Sequence
  chemically synthesized
aagaaatcttatgggccgggca

SEQ ID NO: 964764 - DNA, 22 bp, Artificial Sequence
  chemically synthesized
ttaaagaaatcttatgggccgg

SEQ ID NO: 964765 - DNA, 22 bp, Artificial Sequence
  chemically synthesized
attaaagaaatcttatgggccg

SEQ ID NO: 964766 - DNA, 22 bp, Artificial Sequence
  chemically synthesized
ttattaaagaaatcttatgggc

SEQ ID NO: 964767 - DNA, 22 bp, Artificial Sequence
  chemically synthesized
catctcttattaaagaaatctt

SEQ ID NO: 964768 - DNA, 22 bp, Artificial Sequence
  chemically synthesized
cccggcccataagatttcttta

SEQ ID NO: 964769 - DNA, 22 bp, Artificial Sequence
  chemically synthesized
ctgcatctcttattaaagaaat

SEQ ID NO: 964770 - DNA, 22 bp, Artificial Sequence
  chemically synthesized
gctgcatctcttattaaagaaa

SEQ ID NO: 964771 - DNA, 22 bp, Artificial Sequence
  chemically synthesized
tgctgcatctcttattaaagaa

SEQ ID NO: 964772 - DNA, 22 bp, Artificial Sequence
  chemically synthesized
tttgctgcatctcttattaaag

SEQ ID NO: 964773 - DNA, 22 bp, Artificial Sequence
  chemically synthesized
gaatgttctttgctgcatctct

SEQ ID NO: 964774 - DNA, 22 bp, Artificial Sequence
  chemically synthesized
ctagaatgttctttgctgcatc

SEQ ID NO: 964775 - DNA, 22 bp, Artificial Sequence
  chemically synthesized
ctttaataagagatgcagcaaa

SEQ ID NO: 964776 - DNA, 22 bp, Artificial Sequence
  chemically synthesized
cctagaatgttctttgctgcat

SEQ ID NO: 964777 - DNA, 22 bp, Artificial Sequence
  chemically synthesized
tttaataagagatgcagcaaag

SEQ ID NO: 964778 - DNA, 22 bp, Artificial Sequence
  chemically synthesized
taataagagatgcagcaaagaa

SEQ ID NO: 964779 - DNA, 22 bp, Artificial Sequence
  chemically synthesized
aataagagatgcagcaaagaac

SEQ ID NO: 964780 - DNA, 22 bp, Artificial Sequence
  chemically synthesized
ataagagatgcagcaaagaaca

SEQ ID NO: 964781 - DNA, 22 bp, Artificial Sequence
  chemically synthesized
taatgtaataatgtcttcctag

SEQ ID NO: 964782 - DNA, 22 bp, Artificial Sequence
  chemically synthesized
tataatgtaataatgtcttcct

SEQ ID NO: 964783 - DNA, 22 bp, Artificial Sequence
  chemically synthesized
atgcctctataatgtaataatg

SEQ ID NO: 964784 - DNA, 22 bp, Artificial Sequence
  chemically synthesized
tcatgcctctataatgtaataa

SEQ ID NO: 964785 - DNA, 22 bp, Artificial Sequence
  chemically synthesized
taggaagacattattacattat

SEQ ID NO: 964786 - DNA, 22 bp, Artificial Sequence
  chemically synthesized
ggaagacattattacattatag

SEQ ID NO: 964787 - DNA, 22 bp, Artificial Sequence
  chemically synthesized
taccctctcatgcctctataat

SEQ ID NO: 964788 - DNA, 22 bp, Artificial Sequence
  chemically synthesized
ttacattatagaggcatgagag

SEQ ID NO: 964789 - DNA, 22 bp, Artificial Sequence
  chemically synthesized
cattatagaggcatgagagggt

SEQ ID NO: 964790 - DNA, 22 bp, Artificial Sequence
  chemically synthesized
tagaggcatgagagggtatagt

SEQ ID NO: 964791 - DNA, 22 bp, Artificial Sequence
  chemically synthesized
agagtgaggcagacaagactat

SEQ ID NO: 964792 - DNA, 22 bp, Artificial Sequence
  chemically synthesized
tgaatctgagagtgaggcagac

SEQ ID NO: 964793 - DNA, 22 bp, Artificial Sequence
  chemically synthesized
atgaatctgagagtgaggcaga

SEQ ID NO: 964794 - DNA, 22 bp, Artificial Sequence
  chemically synthesized
ccatggtttatgaatctgagag

SEQ ID NO: 964795 - DNA, 22 bp, Artificial Sequence
  chemically synthesized
gtctgcctcactctcagattca

SEQ ID NO: 964796 - DNA, 22 bp, Artificial Sequence
  chemically synthesized
tctgcctcactctcagattcat

SEQ ID NO: 964797 - DNA, 22 bp, Artificial Sequence
  chemically synthesized
cctcactctcagattcataaac

SEQ ID NO: 964798 - DNA, 22 bp, Artificial Sequence
  chemically synthesized
ggcccctcccatggtttatgaa

SEQ ID NO: 964799 - DNA, 22 bp, Artificial Sequence
  chemically synthesized
actctcagattcataaaccatg

SEQ ID NO: 964800 - DNA, 22 bp, Artificial Sequence
  chemically synthesized
ctaggcccctcccatggtttat

SEQ ID NO: 964801 - DNA, 22 bp, Artificial Sequence
  chemically synthesized
tcagattcataaaccatgggag

SEQ ID NO: 964802 - DNA, 22 bp, Artificial Sequence
  chemically synthesized
agattcataaaccatgggaggg

SEQ ID NO: 964803 - DNA, 22 bp, Artificial Sequence
  chemically synthesized
ataaaccatgggaggggcctag

SEQ ID NO: 964804 - DNA, 22 bp, Artificial Sequence
  chemically synthesized
ataatgcagattcctaggcccc

SEQ ID NO: 964805 - DNA, 22 bp, Artificial Sequence
  chemically synthesized
ttaataatgcagattcctaggc

SEQ ID NO: 964806 - DNA, 22 bp, Artificial Sequence
  chemically synthesized
gttaataatgcagattcctagg

SEQ ID NO: 964807 - DNA, 22 bp, Artificial Sequence
  chemically synthesized
gggagcttgttaataatgcaga

SEQ ID NO: 964808 - DNA, 22 bp, Artificial Sequence
  chemically synthesized
ctagggagcttgttaataatgc

SEQ ID NO: 964809 - DNA, 22 bp, Artificial Sequence
  chemically synthesized
ggaatctgcattattaacaagc

SEQ ID NO: 964810 - DNA, 22 bp, Artificial Sequence
  chemically synthesized
catcagaatctcctagggagct

SEQ ID NO: 964811 - DNA, 22 bp, Artificial Sequence
  chemically synthesized
cattattaacaagctccctagg

SEQ ID NO: 964812 - DNA, 22 bp, Artificial Sequence
  chemically synthesized
ttaacaagctccctaggagatt

SEQ ID NO: 964813 - DNA, 22 bp, Artificial Sequence
  chemically synthesized
acaagctccctaggagattctg

SEQ ID NO: 964814 - DNA, 22 bp, Artificial Sequence
  chemically synthesized
cagaacccctccatcagaatct

SEQ ID NO: 964815 - DNA, 22 bp, Artificial Sequence
  chemically synthesized
gcagaacccctccatcagaatc

SEQ ID NO: 964816 - DNA, 22 bp, Artificial Sequence
  chemically synthesized
cctaggagattctgatggaggg

SEQ ID NO: 964817 - DNA, 22 bp, Artificial Sequence
  chemically synthesized
ggagattctgatggaggggttc

SEQ ID NO: 964818 - DNA, 22 bp, Artificial Sequence
  chemically synthesized
gagtgcagtttgcagaacccct

SEQ ID NO: 964819 - DNA, 22 bp, Artificial Sequence
  chemically synthesized
agagtgcagtttgcagaacccc

SEQ ID NO: 964820 - DNA, 22 bp, Artificial Sequence
  chemically synthesized
tgatggaggggttctgcaaact

SEQ ID NO: 964821 - DNA, 22 bp, Artificial Sequence
  chemically synthesized
atggaggggttctgcaaactgc

SEQ ID NO: 964822 - DNA, 22 bp, Artificial Sequence
  chemically synthesized
tatcagtcttagagtgcagttt

SEQ ID NO: 964823 - DNA, 22 bp, Artificial Sequence
  chemically synthesized
tatatcagtcttagagtgcagt

SEQ ID NO: 964824 - DNA, 22 bp, Artificial Sequence
  chemically synthesized
tgcaaactgcactctaagactg

SEQ ID NO: 964825 - DNA, 22 bp, Artificial Sequence
  chemically synthesized
caaactgcactctaagactgat

SEQ ID NO: 964826 - DNA, 22 bp, Artificial Sequence
  chemically synthesized
gtagatattctatatcagtctt

SEQ ID NO: 964827 - DNA, 22 bp, Artificial Sequence
  chemically synthesized
ggtagatattctatatcagtct

SEQ ID NO: 964828 - DNA, 22 bp, Artificial Sequence
  chemically synthesized
ttggtagatattctatatcagt

SEQ ID NO: 964829 - DNA, 22 bp, Artificial Sequence
  chemically synthesized
cttggtagatattctatatcag

SEQ ID NO: 964830 - DNA, 22 bp, Artificial Sequence
  chemically synthesized
cactctaagactgatatagaat

SEQ ID NO: 964831 - DNA, 22 bp, Artificial Sequence
  chemically synthesized
tttcttggtagatattctatat

SEQ ID NO: 964832 - DNA, 22 bp, Artificial Sequence
  chemically synthesized
tatttcttggtagatattctat

SEQ ID NO: 964833 - DNA, 22 bp, Artificial Sequence
  chemically synthesized
taagactgatatagaatatcta

SEQ ID NO: 964834 - DNA, 22 bp, Artificial Sequence
  chemically synthesized
ctctatttcttggtagatattc

SEQ ID NO: 964835 - DNA, 22 bp, Artificial Sequence
  chemically synthesized
agactgatatagaatatctacc

SEQ ID NO: 964836 - DNA, 22 bp, Artificial Sequence
  chemically synthesized
cctactctatttcttggtagat

SEQ ID NO: 964837 - DNA, 22 bp, Artificial Sequence
  chemically synthesized
ccctactctatttcttggtaga

SEQ ID NO: 964838 - DNA, 22 bp, Artificial Sequence
  chemically synthesized
atatagaatatctaccaagaaa

SEQ ID NO: 964839 - DNA, 22 bp, Artificial Sequence
  chemically synthesized
ttccctactctatttcttggta

SEQ ID NO: 964840 - DNA, 22 bp, Artificial Sequence
  chemically synthesized
ctcttccctactctatttcttg

SEQ ID NO: 964841 - DNA, 22 bp, Artificial Sequence
  chemically synthesized
ctgctcttccctactctatttc

SEQ ID NO: 964842 - DNA, 22 bp, Artificial Sequence
  chemically synthesized
ttcctgctcttccctactctat

SEQ ID NO: 964843 - DNA, 22 bp, Artificial Sequence
  chemically synthesized
gttcctgctcttccctactcta

SEQ ID NO: 964844 - DNA, 22 bp, Artificial Sequence
  chemically synthesized
ccaagaaatagagtagggaaga

SEQ ID NO: 964845 - DNA, 22 bp, Artificial Sequence
  chemically synthesized
taccttgttcctgctcttccct

SEQ ID NO: 964846 - DNA, 22 bp, Artificial Sequence
  chemically synthesized
acactataccttgttcctgctc

SEQ ID NO: 964847 - DNA, 22 bp, Artificial Sequence
  chemically synthesized
cacactataccttgttcctgct

SEQ ID NO: 964848 - DNA, 22 bp, Artificial Sequence
  chemically synthesized
tcacactataccttgttcctgc

SEQ ID NO: 964849 - DNA, 22 bp, Artificial Sequence
  chemically synthesized
tagctttcacactataccttgt

SEQ ID NO: 964850 - DNA, 22 bp, Artificial Sequence
  chemically synthesized
tcatcaagcctatagctttcac

SEQ ID NO: 964851 - DNA, 22 bp, Artificial Sequence
  chemically synthesized
ttatcatcaagcctatagcttt

SEQ ID NO: 964852 - DNA, 22 bp, Artificial Sequence
  chemically synthesized
attatcatcaagcctatagctt

SEQ ID NO: 964853 - DNA, 22 bp, Artificial Sequence
  chemically synthesized
tattatcatcaagcctatagct

SEQ ID NO: 964854 - DNA, 22 bp, Artificial Sequence
  chemically synthesized
attttattatcatcaagcctat

SEQ ID NO: 964855 - DNA, 22 bp, Artificial Sequence
  chemically synthesized
tcattttattatcatcaagcct

SEQ ID NO: 964856 - DNA, 22 bp, Artificial Sequence
  chemically synthesized
ctcattttattatcatcaagcc

SEQ ID NO: 964857 - DNA, 22 bp, Artificial Sequence
  chemically synthesized
tctcattttattatcatcaagc

SEQ ID NO: 964858 - DNA, 22 bp, Artificial Sequence
  chemically synthesized
ctttctcattttattatcatca

SEQ ID NO: 964859 - DNA, 22 bp, Artificial Sequence
  chemically synthesized
gctttctcattttattatcatc

SEQ ID NO: 964860 - DNA, 22 bp, Artificial Sequence
  chemically synthesized
taggcttgatgataataaaatg

SEQ ID NO: 964861 - DNA, 22 bp, Artificial Sequence
  chemically synthesized
gacttgctttctcattttatta

SEQ ID NO: 964862 - DNA, 22 bp, Artificial Sequence
  chemically synthesized
agacttgctttctcattttatt

SEQ ID NO: 964863 - DNA, 22 bp, Artificial Sequence
  chemically synthesized
gatgataataaaatgagaaagc

SEQ ID NO: 964864 - DNA, 22 bp, Artificial Sequence
  chemically synthesized
atgataataaaatgagaaagca

SEQ ID NO: 964865 - DNA, 22 bp, Artificial Sequence
  chemically synthesized
ccacaagcttagacttgctttc

SEQ ID NO: 964866 - DNA, 22 bp, Artificial Sequence
  chemically synthesized
gccacaagcttagacttgcttt

SEQ ID NO: 964867 - DNA, 22 bp, Artificial Sequence
  chemically synthesized
tgccacaagcttagacttgctt

SEQ ID NO: 964868 - DNA, 22 bp, Artificial Sequence
  chemically synthesized
tttgccacaagcttagacttgc

SEQ ID NO: 964869 - DNA, 22 bp, Artificial Sequence
  chemically synthesized
actctttgccacaagcttagac

SEQ ID NO: 964870 - DNA, 22 bp, Artificial Sequence
  chemically synthesized
cattgactctttgccacaagct

SEQ ID NO: 964871 - DNA, 22 bp, Artificial Sequence
  chemically synthesized
aaaattacattgactctttgcc

SEQ ID NO: 964872 - DNA, 22 bp, Artificial Sequence
  chemically synthesized
agcttgtggcaaagagtcaatg

SEQ ID NO: 964873 - DNA, 22 bp, Artificial Sequence
  chemically synthesized
cactgaaaattacattgactct

SEQ ID NO: 964874 - DNA, 22 bp, Artificial Sequence
  chemically synthesized
acactgaaaattacattgactc

SEQ ID NO: 964875 - DNA, 22 bp, Artificial Sequence
  chemically synthesized
gtggcaaagagtcaatgtaatt

SEQ ID NO: 964876 - DNA, 22 bp, Artificial Sequence
  chemically synthesized
ccttacactgaaaattacattg

SEQ ID NO: 964877 - DNA, 22 bp, Artificial Sequence
  chemically synthesized
tggcaaagagtcaatgtaattt

SEQ ID NO: 964878 - DNA, 22 bp, Artificial Sequence
  chemically synthesized
attgccttacactgaaaattac

SEQ ID NO: 964879 - DNA, 22 bp, Artificial Sequence
  chemically synthesized
tcatagcaaggcactcattgcc

SEQ ID NO: 964880 - DNA, 22 bp, Artificial Sequence
  chemically synthesized
tcagtgtaaggcaatgagtgcc

SEQ ID NO: 964881 - DNA, 22 bp, Artificial Sequence
  chemically synthesized
cagtgtaaggcaatgagtgcct

SEQ ID NO: 964882 - DNA, 22 bp, Artificial Sequence
  chemically synthesized
agtgtaaggcaatgagtgcctt

SEQ ID NO: 964883 - DNA, 22 bp, Artificial Sequence
  chemically synthesized
taaatatataacattgtcatag

SEQ ID NO: 964884 - DNA, 22 bp, Artificial Sequence
  chemically synthesized
attgtaaatatataacattgtc

SEQ ID NO: 964885 - DNA, 22 bp, Artificial Sequence
  chemically synthesized
acctaattgtaaatatataaca

SEQ ID NO: 964886 - DNA, 22 bp, Artificial Sequence
  chemically synthesized
cacctaattgtaaatatataac

SEQ ID NO: 964887 - DNA, 22 bp, Artificial Sequence
  chemically synthesized
gctatgacaatgttatatattt

SEQ ID NO: 964888 - DNA, 22 bp, Artificial Sequence
  chemically synthesized
ctatgacaatgttatatattta

SEQ ID NO: 964889 - DNA, 22 bp, Artificial Sequence
  chemically synthesized
tttcacctaattgtaaatatat

SEQ ID NO: 964890 - DNA, 22 bp, Artificial Sequence
  chemically synthesized
tgacaatgttatatatttacaa

SEQ ID NO: 964891 - DNA, 22 bp, Artificial Sequence
  chemically synthesized
tatatttacaattaggtgaaat

SEQ ID NO: 964892 - DNA, 22 bp, Artificial Sequence
  chemically synthesized
tgcaaatggatctatttcacct

SEQ ID NO: 964893 - DNA, 22 bp, Artificial Sequence
  chemically synthesized
atgcaaatggatctatttcacc

SEQ ID NO: 964894 - DNA, 22 bp, Artificial Sequence
  chemically synthesized
tatgcaaatggatctatttcac

SEQ ID NO: 964895 - DNA, 22 bp, Artificial Sequence
  chemically synthesized
acaattaggtgaaatagatcca

SEQ ID NO: 964896 - DNA, 22 bp, Artificial Sequence
  chemically synthesized
caattaggtgaaatagatccat

SEQ ID NO: 964897 - DNA, 22 bp, Artificial Sequence
  chemically synthesized
aattttatgcaaatggatctat

SEQ ID NO: 964898 - DNA, 22 bp, Artificial Sequence
  chemically synthesized
gaattttatgcaaatggatcta

SEQ ID NO: 964899 - DNA, 22 bp, Artificial Sequence
  chemically synthesized
tgaattttatgcaaatggatct

SEQ ID NO: 964900 - DNA, 22 bp, Artificial Sequence
  chemically synthesized
ttgaattttatgcaaatggatc

SEQ ID NO: 964901 - DNA, 22 bp, Artificial Sequence
  chemically synthesized
ggtgaaatagatccatttgcat

SEQ ID NO: 964902 - DNA, 22 bp, Artificial Sequence
  chemically synthesized
ccagtttttgaattttatgcaa

SEQ ID NO: 964903 - DNA, 22 bp, Artificial Sequence
  chemically synthesized
gccagtttttgaattttatgca

SEQ ID NO: 964904 - DNA, 22 bp, Artificial Sequence
  chemically synthesized
tgccagtttttgaattttatgc

SEQ ID NO: 964905 - DNA, 22 bp, Artificial Sequence
  chemically synthesized
attttgccagtttttgaatttt

SEQ ID NO: 964906 - DNA, 22 bp, Artificial Sequence
  chemically synthesized
gcataaaattcaaaaactggca

SEQ ID NO: 964907 - DNA, 22 bp, Artificial Sequence
  chemically synthesized
cataaaattcaaaaactggcaa

SEQ ID NO: 964908 - DNA, 22 bp, Artificial Sequence
  chemically synthesized
ataccatagattaattttgcca

SEQ ID NO: 964909 - DNA, 22 bp, Artificial Sequence
  chemically synthesized
taataccatagattaattttgc

SEQ ID NO: 964910 - DNA, 22 bp, Artificial Sequence
  chemically synthesized
ctaataccatagattaattttg

SEQ ID NO: 964911 - DNA, 22 bp, Artificial Sequence
  chemically synthesized
aaaaactggcaaaattaatcta

SEQ ID NO: 964912 - DNA, 22 bp, Artificial Sequence
  chemically synthesized
tcgtgatttctaataccataga

SEQ ID NO: 964913 - DNA, 22 bp, Artificial Sequence
  chemically synthesized
gcaaaattaatctatggtatta

SEQ ID NO: 964914 - DNA, 22 bp, Artificial Sequence
  chemically synthesized
atctatggtattagaaatcacg

SEQ ID NO: 964915 - DNA, 22 bp, Artificial Sequence
  chemically synthesized
tggtattagaaatcacgataat

SEQ ID NO: 964916 - DNA, 22 bp, Artificial Sequence
  chemically synthesized
cccccatggataagcattatcg

SEQ ID NO: 964917 - DNA, 22 bp, Artificial Sequence
  chemically synthesized
gaaatcacgataatgcttatcc

SEQ ID NO: 964918 - DNA, 22 bp, Artificial Sequence
  chemically synthesized
cgtgctacccccatggataagc

SEQ ID NO: 964919 - DNA, 22 bp, Artificial Sequence
  chemically synthesized
tccgtgctacccccatggataa

SEQ ID NO: 964920 - DNA, 22 bp, Artificial Sequence
  chemically synthesized
agtctctccgtgctacccccat

SEQ ID NO: 964921 - DNA, 22 bp, Artificial Sequence
  chemically synthesized
cagtctctccgtgctaccccca

SEQ ID NO: 964922 - DNA, 22 bp, Artificial Sequence
  chemically synthesized
tcagtctctccgtgctaccccc

SEQ ID NO: 964923 - DNA, 22 bp, Artificial Sequence
  chemically synthesized
ttcagtctctccgtgctacccc

SEQ ID NO: 964924 - DNA, 22 bp, Artificial Sequence
  chemically synthesized
atccatgggggtagcacggaga

SEQ ID NO: 964925 - DNA, 22 bp, Artificial Sequence
  chemically synthesized
tccatgggggtagcacggagag

SEQ ID NO: 964926 - DNA, 22 bp, Artificial Sequence
  chemically synthesized
ccccttttcagtctctccgtgc

SEQ ID NO: 964927 - DNA, 22 bp, Artificial Sequence
  chemically synthesized
tgccccttttcagtctctccgt

SEQ ID NO: 964928 - DNA, 22 bp, Artificial Sequence
  chemically synthesized
ctgccccttttcagtctctccg

SEQ ID NO: 964929 - DNA, 22 bp, Artificial Sequence
  chemically synthesized
agaggcccccttctgccccttt

SEQ ID NO: 964930 - DNA, 22 bp, Artificial Sequence
  chemically synthesized
atgatacctcagaggccccctt

SEQ ID NO: 964931 - DNA, 22 bp, Artificial Sequence
  chemically synthesized
aaaaggggcagaagggggcctc

SEQ ID NO: 964932 - DNA, 22 bp, Artificial Sequence
  chemically synthesized
gatgatacctcagaggccccct

SEQ ID NO: 964933 - DNA, 22 bp, Artificial Sequence
  chemically synthesized
aaaacagaaccttgatgatacc

SEQ ID NO: 964934 - DNA, 22 bp, Artificial Sequence
  chemically synthesized
gattaaaaacagaaccttgatg

SEQ ID NO: 964935 - DNA, 22 bp, Artificial Sequence
  chemically synthesized
agattaaaaacagaaccttgat

SEQ ID NO: 964936 - DNA, 22 bp, Artificial Sequence
  chemically synthesized
tgaggtatcatcaaggttctgt

SEQ ID NO: 964937 - DNA, 22 bp, Artificial Sequence
  chemically synthesized
aggtatcatcaaggttctgttt

SEQ ID NO: 964938 - DNA, 22 bp, Artificial Sequence
  chemically synthesized
accagcacttagattaaaaaca

SEQ ID NO: 964939 - DNA, 22 bp, Artificial Sequence
  chemically synthesized
aaccagcacttagattaaaaac

SEQ ID NO: 964940 - DNA, 22 bp, Artificial Sequence
  chemically synthesized
taaccagcacttagattaaaaa

SEQ ID NO: 964941 - DNA, 22 bp, Artificial Sequence
  chemically synthesized
tgtttttaatctaagtgctggt

SEQ ID NO: 964942 - DNA, 22 bp, Artificial Sequence
  chemically synthesized
tttttaatctaagtgctggtta

SEQ ID NO: 964943 - DNA, 22 bp, Artificial Sequence
  chemically synthesized
aacacatccctttaaccagcac

SEQ ID NO: 964944 - DNA, 22 bp, Artificial Sequence
  chemically synthesized
ttaatctaagtgctggttaaag

SEQ ID NO: 964945 - DNA, 22 bp, Artificial Sequence
  chemically synthesized
taatctaagtgctggttaaagg

SEQ ID NO: 964946 - DNA, 22 bp, Artificial Sequence
  chemically synthesized
aatctaagtgctggttaaaggg

SEQ ID NO: 964947 - DNA, 22 bp, Artificial Sequence
  chemically synthesized
atctaagtgctggttaaaggga

SEQ ID NO: 964948 - DNA, 22 bp, Artificial Sequence
  chemically synthesized
cacaaactgaacacatcccttt

SEQ ID NO: 964949 - DNA, 22 bp, Artificial Sequence
  chemically synthesized
gcacaaactgaacacatccctt

SEQ ID NO: 964950 - DNA, 22 bp, Artificial Sequence
  chemically synthesized
agtgctggttaaagggatgtgt

SEQ ID NO: 964951 - DNA, 22 bp, Artificial Sequence
  chemically synthesized
gttaaagggatgtgttcagttt

SEQ ID NO: 964952 - DNA, 22 bp, Artificial Sequence
  chemically synthesized
gatgaatttgcacaaactgaac

SEQ ID NO: 964953 - DNA, 22 bp, Artificial Sequence
  chemically synthesized
aagggatgtgttcagtttgtgc

SEQ ID NO: 964954 - DNA, 22 bp, Artificial Sequence
  chemically synthesized
agtttgtgcaaattcatctagc

SEQ ID NO: 964955 - DNA, 22 bp, Artificial Sequence
  chemically synthesized
atataaaggtgcagctagatga

SEQ ID NO: 964956 - DNA, 22 bp, Artificial Sequence
  chemically synthesized
gtgcaaattcatctagctgcac

SEQ ID NO: 964957 - DNA, 22 bp, Artificial Sequence
  chemically synthesized
tgcaaattcatctagctgcacc

SEQ ID NO: 964958 - DNA, 22 bp, Artificial Sequence
  chemically synthesized
atctagctgcacctttatatta

SEQ ID NO: 964959 - DNA, 22 bp, Artificial Sequence
  chemically synthesized
agtagaaaagcatgcctaatat

SEQ ID NO: 964960 - DNA, 22 bp, Artificial Sequence
  chemically synthesized
gctgcacctttatattaggcat

SEQ ID NO: 964961 - DNA, 22 bp, Artificial Sequence
  chemically synthesized
cagtagaaaagcatgcctaata

SEQ ID NO: 964962 - DNA, 22 bp, Artificial Sequence
  chemically synthesized
cacctttatattaggcatgctt

SEQ ID NO: 964963 - DNA, 22 bp, Artificial Sequence
  chemically synthesized
tatattaggcatgcttttctac

SEQ ID NO: 964964 - DNA, 22 bp, Artificial Sequence
  chemically synthesized
atattaggcatgcttttctact

SEQ ID NO: 964965 - DNA, 22 bp, Artificial Sequence
  chemically synthesized
tattaggcatgcttttctactg

SEQ ID NO: 964966 - DNA, 22 bp, Artificial Sequence
  chemically synthesized
aagtataatatacttcagtaga

SEQ ID NO: 964967 - DNA, 22 bp, Artificial Sequence
  chemically synthesized
ggcatgcttttctactgaagta

SEQ ID NO: 964968 - DNA, 22 bp, Artificial Sequence
  chemically synthesized
ctgaagtataatatacttcagt

SEQ ID NO: 964969 - DNA, 22 bp, Artificial Sequence
  chemically synthesized
actgaagtataatatacttcag

SEQ ID NO: 964970 - DNA, 22 bp, Artificial Sequence
  chemically synthesized
ttactgaagtataatatacttc

SEQ ID NO: 964971 - DNA, 22 bp, Artificial Sequence
  chemically synthesized
cttactgaagtataatatactt

SEQ ID NO: 964972 - DNA, 22 bp, Artificial Sequence
  chemically synthesized
ttctactgaagtatattatact

SEQ ID NO: 964973 - DNA, 22 bp, Artificial Sequence
  chemically synthesized
tctactgaagtatattatactt

SEQ ID NO: 964974 - DNA, 22 bp, Artificial Sequence
  chemically synthesized
ctactgaagtatattatacttc

SEQ ID NO: 964975 - DNA, 22 bp, Artificial Sequence
  chemically synthesized
taacttcttactgaagtataat

SEQ ID NO: 964976 - DNA, 22 bp, Artificial Sequence
  chemically synthesized
tactgaagtatattatacttca

SEQ ID NO: 964977 - DNA, 22 bp, Artificial Sequence
  chemically synthesized
ataacttcttactgaagtataa

SEQ ID NO: 964978 - DNA, 22 bp, Artificial Sequence
  chemically synthesized
tataacttcttactgaagtata

SEQ ID NO: 964979 - DNA, 22 bp, Artificial Sequence
  chemically synthesized
ctgaagtatattatacttcagt

SEQ ID NO: 964980 - DNA, 22 bp, Artificial Sequence
  chemically synthesized
ttataacttcttactgaagtat

SEQ ID NO: 964981 - DNA, 22 bp, Artificial Sequence
  chemically synthesized
aagtatattatacttcagtaag

SEQ ID NO: 964982 - DNA, 22 bp, Artificial Sequence
  chemically synthesized
atttttataacttcttactgaa

SEQ ID NO: 964983 - DNA, 22 bp, Artificial Sequence
  chemically synthesized
agcctaatttttataacttctt

SEQ ID NO: 964984 - DNA, 22 bp, Artificial Sequence
  chemically synthesized
tacttcagtaagaagttataaa

SEQ ID NO: 964985 - DNA, 22 bp, Artificial Sequence
  chemically synthesized
ctcagcctaatttttataactt

SEQ ID NO: 964986 - DNA, 22 bp, Artificial Sequence
  chemically synthesized
cagtaagaagttataaaaatta

SEQ ID NO: 964987 - DNA, 22 bp, Artificial Sequence
  chemically synthesized
agtaagaagttataaaaattag

SEQ ID NO: 964988 - DNA, 22 bp, Artificial Sequence
  chemically synthesized
aaatacacctactcagcctaat

SEQ ID NO: 964989 - DNA, 22 bp, Artificial Sequence
  chemically synthesized
gttgaaatacacctactcagcc

SEQ ID NO: 964990 - DNA, 22 bp, Artificial Sequence
  chemically synthesized
agttgaaatacacctactcagc

SEQ ID NO: 964991 - DNA, 22 bp, Artificial Sequence
  chemically synthesized
tagttgaaatacacctactcag

SEQ ID NO: 964992 - DNA, 22 bp, Artificial Sequence
  chemically synthesized
taaaaattaggctgagtaggtg

SEQ ID NO: 964993 - DNA, 22 bp, Artificial Sequence
  chemically synthesized
ttagttgaaatacacctactca

SEQ ID NO: 964994 - DNA, 22 bp, Artificial Sequence
  chemically synthesized
ttttagttgaaatacacctact

SEQ ID NO: 964995 - DNA, 22 bp, Artificial Sequence
  chemically synthesized
cttttagttgaaatacacctac

SEQ ID NO: 964996 - DNA, 22 bp, Artificial Sequence
  chemically synthesized
tcttttagttgaaatacaccta

SEQ ID NO: 964997 - DNA, 22 bp, Artificial Sequence
  chemically synthesized
ggctgagtaggtgtatttcaac

SEQ ID NO: 964998 - DNA, 22 bp, Artificial Sequence
  chemically synthesized
agtaggtgtatttcaactaaaa

SEQ ID NO: 964999 - DNA, 22 bp, Artificial Sequence
  chemically synthesized
taggatgttttcttttagttga

SEQ ID NO: 965000 - DNA, 22 bp, Artificial Sequence
  chemically synthesized
caactaaaagaaaacatcctat

SEQ ID NO: 965001 - DNA, 22 bp, Artificial Sequence
  chemically synthesized
aactaaaagaaaacatcctata

SEQ ID NO: 965002 - DNA, 22 bp, Artificial Sequence
  chemically synthesized
ataagataacaattataggatg

SEQ ID NO: 965003 - DNA, 22 bp, Artificial Sequence
  chemically synthesized
aaagaaaacatcctataattgt

SEQ ID NO: 965004 - DNA, 22 bp, Artificial Sequence
  chemically synthesized
agattaataagataacaattat

SEQ ID NO: 965005 - DNA, 22 bp, Artificial Sequence
  chemically synthesized
tgagattaataagataacaatt

SEQ ID NO: 965006 - DNA, 22 bp, Artificial Sequence
  chemically synthesized
ctgagattaataagataacaat

SEQ ID NO: 965007 - DNA, 22 bp, Artificial Sequence
  chemically synthesized
tctgagattaataagataacaa

SEQ ID NO: 965008 - DNA, 22 bp, Artificial Sequence
  chemically synthesized
tgaaattttctgagattaataa

SEQ ID NO: 965009 - DNA, 22 bp, Artificial Sequence
  chemically synthesized
taattgttatcttattaatctc

SEQ ID NO: 965010 - DNA, 22 bp, Artificial Sequence
  chemically synthesized
ttatgaaattttctgagattaa

SEQ ID NO: 965011 - DNA, 22 bp, Artificial Sequence
  chemically synthesized
ttatcttattaatctcagaaaa

SEQ ID NO: 965012 - DNA, 22 bp, Artificial Sequence
  chemically synthesized
agttattatgaaattttctgag

SEQ ID NO: 965013 - DNA, 22 bp, Artificial Sequence
  chemically synthesized
tcttattaatctcagaaaattt

SEQ ID NO: 965014 - DNA, 22 bp, Artificial Sequence
  chemically synthesized
attaatctcagaaaatttcata

SEQ ID NO: 965015 - DNA, 22 bp, Artificial Sequence
  chemically synthesized
ttaatctcagaaaatttcataa

SEQ ID NO: 965016 - DNA, 22 bp, Artificial Sequence
  chemically synthesized
atctcagaaaatttcataataa

SEQ ID NO: 965017 - DNA, 22 bp, Artificial Sequence
  chemically synthesized
aaagaggtattaagttattatg

SEQ ID NO: 965018 - DNA, 22 bp, Artificial Sequence
  chemically synthesized
agaaaatttcataataacttaa

SEQ ID NO: 965019 - DNA, 22 bp, Artificial Sequence
  chemically synthesized
agagaattgaaagaggtattaa

SEQ ID NO: 965020 - DNA, 22 bp, Artificial Sequence
  chemically synthesized
cagagaattgaaagaggtatta

SEQ ID NO: 965021 - DNA, 22 bp, Artificial Sequence
  chemically synthesized
tcagagaattgaaagaggtatt

SEQ ID NO: 965022 - DNA, 22 bp, Artificial Sequence
  chemically synthesized
cataataacttaatacctcttt

SEQ ID NO: 965023 - DNA, 22 bp, Artificial Sequence
  chemically synthesized
ataataacttaatacctctttc

SEQ ID NO: 965024 - DNA, 22 bp, Artificial Sequence
  chemically synthesized
tataactttcagagaattgaaa

SEQ ID NO: 965025 - DNA, 22 bp, Artificial Sequence
  chemically synthesized
atataactttcagagaattgaa

SEQ ID NO: 965026 - DNA, 22 bp, Artificial Sequence
  chemically synthesized
aatacctctttcaattctctga

SEQ ID NO: 965027 - DNA, 22 bp, Artificial Sequence
  chemically synthesized
atacctctttcaattctctgaa

SEQ ID NO: 965028 - DNA, 22 bp, Artificial Sequence
  chemically synthesized
tcacatttatataactttcaga

SEQ ID NO: 965029 - DNA, 22 bp, Artificial Sequence
  chemically synthesized
atcacatttatataactttcag

SEQ ID NO: 965030 - DNA, 22 bp, Artificial Sequence
  chemically synthesized
tatcacatttatataactttca

SEQ ID NO: 965031 - DNA, 22 bp, Artificial Sequence
  chemically synthesized
tttcaattctctgaaagttata

SEQ ID NO: 965032 - DNA, 22 bp, Artificial Sequence
  chemically synthesized
tcaattctctgaaagttatata

SEQ ID NO: 965033 - DNA, 22 bp, Artificial Sequence
  chemically synthesized
ttttatcacatttatataactt

SEQ ID NO: 965034 - DNA, 22 bp, Artificial Sequence
  chemically synthesized
caattctctgaaagttatataa

SEQ ID NO: 965035 - DNA, 22 bp, Artificial Sequence
  chemically synthesized
aattctctgaaagttatataaa

SEQ ID NO: 965036 - DNA, 22 bp, Artificial Sequence
  chemically synthesized
tattttatcacatttatataac

SEQ ID NO: 965037 - DNA, 22 bp, Artificial Sequence
  chemically synthesized
tctgaaagttatataaatgtga

SEQ ID NO: 965038 - DNA, 22 bp, Artificial Sequence
  chemically synthesized
tattctattttatcacatttat

SEQ ID NO: 965039 - DNA, 22 bp, Artificial Sequence
  chemically synthesized
atattctattttatcacattta

SEQ ID NO: 965040 - DNA, 22 bp, Artificial Sequence
  chemically synthesized
tgaaagttatataaatgtgata

SEQ ID NO: 965041 - DNA, 22 bp, Artificial Sequence
  chemically synthesized
ttatattctattttatcacatt

SEQ ID NO: 965042 - DNA, 22 bp, Artificial Sequence
  chemically synthesized
aaagttatataaatgtgataaa

SEQ ID NO: 965043 - DNA, 22 bp, Artificial Sequence
  chemically synthesized
ctcttatattctattttatcac

SEQ ID NO: 965044 - DNA, 22 bp, Artificial Sequence
  chemically synthesized
tataaatgtgataaaatagaat

SEQ ID NO: 965045 - DNA, 22 bp, Artificial Sequence
  chemically synthesized
gaacattcctcttatattctat

SEQ ID NO: 965046 - DNA, 22 bp, Artificial Sequence
  chemically synthesized
agaacattcctcttatattcta

SEQ ID NO: 965047 - DNA, 22 bp, Artificial Sequence
  chemically synthesized
tagaacattcctcttatattct

SEQ ID NO: 965048 - DNA, 22 bp, Artificial Sequence
  chemically synthesized
aaaaatgttttagaacattcct

SEQ ID NO: 965049 - DNA, 22 bp, Artificial Sequence
  chemically synthesized
gaatgatctgaaaaatgtttta

SEQ ID NO: 965050 - DNA, 22 bp, Artificial Sequence
  chemically synthesized
cccattagaatgatctgaaaaa

SEQ ID NO: 965051 - DNA, 22 bp, Artificial Sequence
  chemically synthesized
ccccattagaatgatctgaaaa

SEQ ID NO: 965052 - DNA, 22 bp, Artificial Sequence
  chemically synthesized
tccccattagaatgatctgaaa

SEQ ID NO: 965053 - DNA, 22 bp, Artificial Sequence
  chemically synthesized
taaaacatttttcagatcattc

SEQ ID NO: 965054 - DNA, 22 bp, Artificial Sequence
  chemically synthesized
ttttccccattagaatgatctg

SEQ ID NO: 965055 - DNA, 22 bp, Artificial Sequence
  chemically synthesized
aaacatttttcagatcattcta

SEQ ID NO: 965056 - DNA, 22 bp, Artificial Sequence
  chemically synthesized
agaagttattttccccattaga

SEQ ID NO: 965057 - DNA, 22 bp, Artificial Sequence
  chemically synthesized
aagaagttattttccccattag

SEQ ID NO: 965058 - DNA, 22 bp, Artificial Sequence
  chemically synthesized
ttcagatcattctaatggggaa

SEQ ID NO: 965059 - DNA, 22 bp, Artificial Sequence
  chemically synthesized
taagaagttattttccccatta

SEQ ID NO: 965060 - DNA, 22 bp, Artificial Sequence
  chemically synthesized
tcagatcattctaatggggaaa

SEQ ID NO: 965061 - DNA, 22 bp, Artificial Sequence
  chemically synthesized
cagatcattctaatggggaaaa

SEQ ID NO: 965062 - DNA, 22 bp, Artificial Sequence
  chemically synthesized
agatcattctaatggggaaaat

SEQ ID NO: 965063 - DNA, 22 bp, Artificial Sequence
  chemically synthesized
taatggggaaaataacttctta

SEQ ID NO: 965064 - DNA, 22 bp, Artificial Sequence
  chemically synthesized
gcaaggaagctttaagaagtta

SEQ ID NO: 965065 - DNA, 22 bp, Artificial Sequence
  chemically synthesized
atggggaaaataacttcttaaa

SEQ ID NO: 965066 - DNA, 22 bp, Artificial Sequence
  chemically synthesized
agtgttagcaaggaagctttaa

SEQ ID NO: 965067 - DNA, 22 bp, Artificial Sequence
  chemically synthesized
aagtgttagcaaggaagcttta

SEQ ID NO: 965068 - DNA, 22 bp, Artificial Sequence
  chemically synthesized
atgggatttaagtgttagcaag

SEQ ID NO: 965069 - DNA, 22 bp, Artificial Sequence
  chemically synthesized
cttaaagcttccttgctaacac

SEQ ID NO: 965070 - DNA, 22 bp, Artificial Sequence
  chemically synthesized
ttaaagcttccttgctaacact

SEQ ID NO: 965071 - DNA, 22 bp, Artificial Sequence
  chemically synthesized
aaagcttccttgctaacactta

SEQ ID NO: 965072 - DNA, 22 bp, Artificial Sequence
  chemically synthesized
aagcttccttgctaacacttaa

SEQ ID NO: 965073 - DNA, 22 bp, Artificial Sequence
  chemically synthesized
aatctgatgggatttaagtgtt

SEQ ID NO: 965074 - DNA, 22 bp, Artificial Sequence
  chemically synthesized
caatctgatgggatttaagtgt

SEQ ID NO: 965075 - DNA, 22 bp, Artificial Sequence
  chemically synthesized
ccttgctaacacttaaatccca

SEQ ID NO: 965076 - DNA, 22 bp, Artificial Sequence
  chemically synthesized
cttgctaacacttaaatcccat

SEQ ID NO: 965077 - DNA, 22 bp, Artificial Sequence
  chemically synthesized
gctaacacttaaatcccatcag

SEQ ID NO: 965078 - DNA, 22 bp, Artificial Sequence
  chemically synthesized
ctaacacttaaatcccatcaga

SEQ ID NO: 965079 - DNA, 22 bp, Artificial Sequence
  chemically synthesized
acacttaaatcccatcagattg

SEQ ID NO: 965080 - DNA, 22 bp, Artificial Sequence
  chemically synthesized
gaataagaaatttcaatctgat

SEQ ID NO: 965081 - DNA, 22 bp, Artificial Sequence
  chemically synthesized
agaataagaaatttcaatctga

SEQ ID NO: 965082 - DNA, 22 bp, Artificial Sequence
  chemically synthesized
tagaataagaaatttcaatctg

SEQ ID NO: 965083 - DNA, 22 bp, Artificial Sequence
  chemically synthesized
aaatcccatcagattgaaattt

SEQ ID NO: 965084 - DNA, 22 bp, Artificial Sequence
  chemically synthesized
aatcccatcagattgaaatttc

SEQ ID NO: 965085 - DNA, 22 bp, Artificial Sequence
  chemically synthesized
aaggatggtaactttagaataa

SEQ ID NO: 965086 - DNA, 22 bp, Artificial Sequence
  chemically synthesized
aaatttcttattctaaagttac

SEQ ID NO: 965087 - DNA, 22 bp, Artificial Sequence
  chemically synthesized
cttattctaaagttaccatcct

SEQ ID NO: 965088 - DNA, 22 bp, Artificial Sequence
  chemically synthesized
ttattctaaagttaccatcctt

SEQ ID NO: 965089 - DNA, 22 bp, Artificial Sequence
  chemically synthesized
attctaaagttaccatccttga

SEQ ID NO: 965090 - DNA, 22 bp, Artificial Sequence
  chemically synthesized
ttctaaagttaccatccttgag

SEQ ID NO: 965091 - DNA, 22 bp, Artificial Sequence
  chemically synthesized
taaagttaccatccttgagtct

SEQ ID NO: 965092 - DNA, 22 bp, Artificial Sequence
  chemically synthesized
aagttaccatccttgagtctat

SEQ ID NO: 965093 - DNA, 22 bp, Artificial Sequence
  chemically synthesized
ccatccttgagtctattattta

SEQ ID NO: 965094 - DNA, 22 bp, Artificial Sequence
  chemically synthesized
agacagtgaggataaataatag

SEQ ID NO: 965095 - DNA, 22 bp, Artificial Sequence
  chemically synthesized
gagtctattatttatcctcact

SEQ ID NO: 965096 - DNA, 22 bp, Artificial Sequence
  chemically synthesized
agtctattatttatcctcactg

SEQ ID NO: 965097 - DNA, 22 bp, Artificial Sequence
  chemically synthesized
ttatttatcctcactgtctcag

SEQ ID NO: 965098 - DNA, 22 bp, Artificial Sequence
  chemically synthesized
tttatcctcactgtctcagctt

SEQ ID NO: 965099 - DNA, 22 bp, Artificial Sequence
  chemically synthesized
tgaaggggcacagcaagctgag

SEQ ID NO: 965100 - DNA, 22 bp, Artificial Sequence
  chemically synthesized
atcctcactgtctcagcttgct

SEQ ID NO: 965101 - DNA, 22 bp, Artificial Sequence
  chemically synthesized
tcctcactgtctcagcttgctg

SEQ ID NO: 965102 - DNA, 22 bp, Artificial Sequence
  chemically synthesized
ctgtgaaggggcacagcaagct

SEQ ID NO: 965103 - DNA, 22 bp, Artificial Sequence
  chemically synthesized
actgtgaaggggcacagcaagc

SEQ ID NO: 965104 - DNA, 22 bp, Artificial Sequence
  chemically synthesized
tactgtgaaggggcacagcaag

SEQ ID NO: 965105 - DNA, 22 bp, Artificial Sequence
  chemically synthesized
actgtctcagcttgctgtgccc

SEQ ID NO: 965106 - DNA, 22 bp, Artificial Sequence
  chemically synthesized
tctcagcttgctgtgccccttc

SEQ ID NO: 965107 - DNA, 22 bp, Artificial Sequence
  chemically synthesized
aagaagttttactgtgaagggg

SEQ ID NO: 965108 - DNA, 22 bp, Artificial Sequence
  chemically synthesized
agcttgctgtgccccttcacag

SEQ ID NO: 965109 - DNA, 22 bp, Artificial Sequence
  chemically synthesized
caagaagttttactgtgaaggg

SEQ ID NO: 965110 - DNA, 22 bp, Artificial Sequence
  chemically synthesized
tcaagaagttttactgtgaagg

SEQ ID NO: 965111 - DNA, 22 bp, Artificial Sequence
  chemically synthesized
ttcaagaagttttactgtgaag

SEQ ID NO: 965112 - DNA, 22 bp, Artificial Sequence
  chemically synthesized
tttcaagaagttttactgtgaa

SEQ ID NO: 965113 - DNA, 22 bp, Artificial Sequence
  chemically synthesized
gctgtgccccttcacagtaaaa

SEQ ID NO: 965114 - DNA, 22 bp, Artificial Sequence
  chemically synthesized
ctgtgccccttcacagtaaaac

SEQ ID NO: 965115 - DNA, 22 bp, Artificial Sequence
  chemically synthesized
tgccccttcacagtaaaacttc

SEQ ID NO: 965116 - DNA, 22 bp, Artificial Sequence
  chemically synthesized
tagacaactttttcaagaagtt

SEQ ID NO: 965117 - DNA, 22 bp, Artificial Sequence
  chemically synthesized
cacagtaaaacttcttgaaaaa

SEQ ID NO: 965118 - DNA, 22 bp, Artificial Sequence
  chemically synthesized
acagtaaaacttcttgaaaaag

SEQ ID NO: 965119 - DNA, 22 bp, Artificial Sequence
  chemically synthesized
cttgaaaaagttgtctataatc

SEQ ID NO: 965120 - DNA, 22 bp, Artificial Sequence
  chemically synthesized
ttgaaaaagttgtctataatct

SEQ ID NO: 965121 - DNA, 22 bp, Artificial Sequence
  chemically synthesized
gaaaaagttgtctataatcttt

SEQ ID NO: 965122 - DNA, 22 bp, Artificial Sequence
  chemically synthesized
aaaaagttgtctataatctttg

SEQ ID NO: 965123 - DNA, 22 bp, Artificial Sequence
  chemically synthesized
tctataatctttgtatctattt

SEQ ID NO: 965124 - DNA, 22 bp, Artificial Sequence
  chemically synthesized
taatctttgtatctattttccc

SEQ ID NO: 965125 - DNA, 22 bp, Artificial Sequence
  chemically synthesized
agtaaataatataaggtgggaa

SEQ ID NO: 965126 - DNA, 22 bp, Artificial Sequence
  chemically synthesized
tgtatctattttcccaccttat

SEQ ID NO: 965127 - DNA, 22 bp, Artificial Sequence
  chemically synthesized
gtatctattttcccaccttata

SEQ ID NO: 965128 - DNA, 22 bp, Artificial Sequence
  chemically synthesized
tatctattttcccaccttatat

SEQ ID NO: 965129 - DNA, 22 bp, Artificial Sequence
  chemically synthesized
ttttcccaccttatattattta

SEQ ID NO: 965130 - DNA, 22 bp, Artificial Sequence
  chemically synthesized
tcccaccttatattatttactc

SEQ ID NO: 965131 - DNA, 22 bp, Artificial Sequence
  chemically synthesized
cccaccttatattatttactca

SEQ ID NO: 965132 - DNA, 22 bp, Artificial Sequence
  chemically synthesized
ccaccttatattatttactcag

SEQ ID NO: 965133 - DNA, 22 bp, Artificial Sequence
  chemically synthesized
atattatttactcagcctactc

SEQ ID NO: 965134 - DNA, 22 bp, Artificial Sequence
  chemically synthesized
tattatttactcagcctactcc

SEQ ID NO: 965135 - DNA, 22 bp, Artificial Sequence
  chemically synthesized
tttactcagcctactcctctgg

SEQ ID NO: 965136 - DNA, 22 bp, Artificial Sequence
  chemically synthesized
actcagcctactcctctggacc

SEQ ID NO: 965137 - DNA, 22 bp, Artificial Sequence
  chemically synthesized
ctcagcctactcctctggacct

SEQ ID NO: 965138 - DNA, 22 bp, Artificial Sequence
  chemically synthesized
agcctactcctctggaccttcc

SEQ ID NO: 965139 - DNA, 22 bp, Artificial Sequence
  chemically synthesized
aacagaatgatggatatggaag

SEQ ID NO: 965140 - DNA, 22 bp, Artificial Sequence
  chemically synthesized
ctcctctggaccttccatatcc

SEQ ID NO: 965141 - DNA, 22 bp, Artificial Sequence
  chemically synthesized
gaacagaatgatggatatggaa

SEQ ID NO: 965142 - DNA, 22 bp, Artificial Sequence
  chemically synthesized
ctctggaccttccatatccatc

SEQ ID NO: 965143 - DNA, 22 bp, Artificial Sequence
  chemically synthesized
tggaccttccatatccatcatt

SEQ ID NO: 965144 - DNA, 22 bp, Artificial Sequence
  chemically synthesized
gaccttccatatccatcattct

SEQ ID NO: 965145 - DNA, 22 bp, Artificial Sequence
  chemically synthesized
ccatatccatcattctgttcaa

SEQ ID NO: 965146 - DNA, 22 bp, Artificial Sequence
  chemically synthesized
gacaagagcaatttgaacagaa

SEQ ID NO: 965147 - DNA, 22 bp, Artificial Sequence
  chemically synthesized
catatccatcattctgttcaaa

SEQ ID NO: 965148 - DNA, 22 bp, Artificial Sequence
  chemically synthesized
gtgatctggacaagagcaattt

SEQ ID NO: 965149 - DNA, 22 bp, Artificial Sequence
  chemically synthesized
ggtgatctggacaagagcaatt

SEQ ID NO: 965150 - DNA, 22 bp, Artificial Sequence
  chemically synthesized
tggtgatctggacaagagcaat

SEQ ID NO: 965151 - DNA, 22 bp, Artificial Sequence
  chemically synthesized
ttggtgatctggacaagagcaa

SEQ ID NO: 965152 - DNA, 22 bp, Artificial Sequence
  chemically synthesized
tttggtgatctggacaagagca

SEQ ID NO: 965153 - DNA, 22 bp, Artificial Sequence
  chemically synthesized
tgttcaaattgctcttgtccag

SEQ ID NO: 965154 - DNA, 22 bp, Artificial Sequence
  chemically synthesized
ttcaaattgctcttgtccagat

SEQ ID NO: 965155 - DNA, 22 bp, Artificial Sequence
  chemically synthesized
aaattgctcttgtccagatcac

SEQ ID NO: 965156 - DNA, 22 bp, Artificial Sequence
  chemically synthesized
ctcttgtccagatcaccaaaaa

SEQ ID NO: 965157 - DNA, 22 bp, Artificial Sequence
  chemically synthesized
gcaacatataattttttggtga

SEQ ID NO: 965158 - DNA, 22 bp, Artificial Sequence
  chemically synthesized
ggcaacatataattttttggtg

SEQ ID NO: 965159 - DNA, 22 bp, Artificial Sequence
  chemically synthesized
ttgtccagatcaccaaaaaatt

SEQ ID NO: 965160 - DNA, 22 bp, Artificial Sequence
  chemically synthesized
gtccagatcaccaaaaaattat

SEQ ID NO: 965161 - DNA, 22 bp, Artificial Sequence
  chemically synthesized
tccagatcaccaaaaaattata

SEQ ID NO: 965162 - DNA, 22 bp, Artificial Sequence
  chemically synthesized
gatttggcaacatataattttt

SEQ ID NO: 965163 - DNA, 22 bp, Artificial Sequence
  chemically synthesized
ttggatttggcaacatataatt

SEQ ID NO: 965164 - DNA, 22 bp, Artificial Sequence
  chemically synthesized
tatgttgccaaatccaatagtc

SEQ ID NO: 965165 - DNA, 22 bp, Artificial Sequence
  chemically synthesized
ccaaatccaatagtcacttatc

SEQ ID NO: 965166 - DNA, 22 bp, Artificial Sequence
  chemically synthesized
agtataatgaaaagataagtga

SEQ ID NO: 965167 - DNA, 22 bp, Artificial Sequence
  chemically synthesized
tgaggggctcagtataatgaaa

SEQ ID NO: 965168 - DNA, 22 bp, Artificial Sequence
  chemically synthesized
atcttttcattatactgagccc

SEQ ID NO: 965169 - DNA, 22 bp, Artificial Sequence
  chemically synthesized
tcttttcattatactgagcccc

SEQ ID NO: 965170 - DNA, 22 bp, Artificial Sequence
  chemically synthesized
ttcattatactgagcccctcat

SEQ ID NO: 965171 - DNA, 22 bp, Artificial Sequence
  chemically synthesized
tcattatactgagcccctcata

SEQ ID NO: 965172 - DNA, 22 bp, Artificial Sequence
  chemically synthesized
cattatactgagcccctcataa

SEQ ID NO: 965173 - DNA, 22 bp, Artificial Sequence
  chemically synthesized
ataaccagcatgttatgagggg

SEQ ID NO: 965174 - DNA, 22 bp, Artificial Sequence
  chemically synthesized
attatactgagcccctcataac

SEQ ID NO: 965175 - DNA, 22 bp, Artificial Sequence
  chemically synthesized
tactgagcccctcataacatgc

SEQ ID NO: 965176 - DNA, 22 bp, Artificial Sequence
  chemically synthesized
agcccctcataacatgctggtt

SEQ ID NO: 965177 - DNA, 22 bp, Artificial Sequence
  chemically synthesized
aagggagggagtaattaataac

SEQ ID NO: 965178 - DNA, 22 bp, Artificial Sequence
  chemically synthesized
ataacatgctggttattaatta

SEQ ID NO: 965179 - DNA, 22 bp, Artificial Sequence
  chemically synthesized
gttattaattactccctccctt

SEQ ID NO: 965180 - DNA, 22 bp, Artificial Sequence
  chemically synthesized
ttaattactccctcccttcaac

SEQ ID NO: 965181 - DNA, 22 bp, Artificial Sequence
  chemically synthesized
attactccctcccttcaacact

SEQ ID NO: 965182 - DNA, 22 bp, Artificial Sequence
  chemically synthesized
ctccctcccttcaacactcttt

SEQ ID NO: 965183 - DNA, 22 bp, Artificial Sequence
  chemically synthesized
cctcccttcaacactctttttg

SEQ ID NO: 965184 - DNA, 22 bp, Artificial Sequence
  chemically synthesized
ccttcaacactctttttgtatc

SEQ ID NO: 965185 - DNA, 22 bp, Artificial Sequence
  chemically synthesized
caacactctttttgtatctttc

SEQ ID NO: 965186 - DNA, 22 bp, Artificial Sequence
  chemically synthesized
aacactctttttgtatctttca

SEQ ID NO: 965187 - DNA, 22 bp, Artificial Sequence
  chemically synthesized
tttttgtatctttcatattgcc

SEQ ID NO: 965188 - DNA, 22 bp, Artificial Sequence
  chemically synthesized
tttgtatctttcatattgccac

SEQ ID NO: 965189 - DNA, 22 bp, Artificial Sequence
  chemically synthesized
ttgtatctttcatattgccaca

SEQ ID NO: 965190 - DNA, 22 bp, Artificial Sequence
  chemically synthesized
tgtatctttcatattgccacac

SEQ ID NO: 965191 - DNA, 22 bp, Artificial Sequence
  chemically synthesized
gtatctttcatattgccacact

SEQ ID NO: 965192 - DNA, 22 bp, Artificial Sequence
  chemically synthesized
tatctttcatattgccacactc

SEQ ID NO: 965193 - DNA, 22 bp, Artificial Sequence
  chemically synthesized
ggaggggaatcaagagagtgtg

SEQ ID NO: 965194 - DNA, 22 bp, Artificial Sequence
  chemically synthesized
tcatattgccacactctcttga

SEQ ID NO: 965195 - DNA, 22 bp, Artificial Sequence
  chemically synthesized
catattgccacactctcttgat

SEQ ID NO: 965196 - DNA, 22 bp, Artificial Sequence
  chemically synthesized
atattgccacactctcttgatt

SEQ ID NO: 965197 - DNA, 22 bp, Artificial Sequence
  chemically synthesized
ccacactctcttgattcccctc

SEQ ID NO: 965198 - DNA, 22 bp, Artificial Sequence
  chemically synthesized
tcttgattcccctcctaattct

SEQ ID NO: 965199 - DNA, 22 bp, Artificial Sequence
  chemically synthesized
ttgattcccctcctaattcttg

SEQ ID NO: 965200 - DNA, 22 bp, Artificial Sequence
  chemically synthesized
gattcccctcctaattcttggt

SEQ ID NO: 965201 - DNA, 22 bp, Artificial Sequence
  chemically synthesized
attcccctcctaattcttggta

SEQ ID NO: 965202 - DNA, 22 bp, Artificial Sequence
  chemically synthesized
ccctcctaattcttggtattct

SEQ ID NO: 965203 - DNA, 22 bp, Artificial Sequence
  chemically synthesized
ctaattcttggtattctatatt

SEQ ID NO: 965204 - DNA, 22 bp, Artificial Sequence
  chemically synthesized
attcttggtattctatattgga

SEQ ID NO: 965205 - DNA, 22 bp, Artificial Sequence
  chemically synthesized
ttggtattctatattggatgtc

SEQ ID NO: 965206 - DNA, 22 bp, Artificial Sequence
  chemically synthesized
ggtattctatattggatgtccc

SEQ ID NO: 965207 - DNA, 22 bp, Artificial Sequence
  chemically synthesized
gtattctatattggatgtccct

SEQ ID NO: 965208 - DNA, 22 bp, Artificial Sequence
  chemically synthesized
gaagtggaacagaagagggaca

SEQ ID NO: 965209 - DNA, 22 bp, Artificial Sequence
  chemically synthesized
agaagtggaacagaagagggac

SEQ ID NO: 965210 - DNA, 22 bp, Artificial Sequence
  chemically synthesized
tatattggatgtccctcttctg

SEQ ID NO: 965211 - DNA, 22 bp, Artificial Sequence
  chemically synthesized
tattggatgtccctcttctgtt

SEQ ID NO: 965212 - DNA, 22 bp, Artificial Sequence
  chemically synthesized
agatgtttagaagtggaacaga

SEQ ID NO: 965213 - DNA, 22 bp, Artificial Sequence
  chemically synthesized
gatgtccctcttctgttccact

SEQ ID NO: 965214 - DNA, 22 bp, Artificial Sequence
  chemically synthesized
agacactcagatgtttagaagt

SEQ ID NO: 965215 - DNA, 22 bp, Artificial Sequence
  chemically synthesized
ttctgttccacttctaaacatc

SEQ ID NO: 965216 - DNA, 22 bp, Artificial Sequence
  chemically synthesized
ctgttccacttctaaacatctg

SEQ ID NO: 965217 - DNA, 22 bp, Artificial Sequence
  chemically synthesized
tgttccacttctaaacatctga

SEQ ID NO: 965218 - DNA, 22 bp, Artificial Sequence
  chemically synthesized
ttccacttctaaacatctgagt

SEQ ID NO: 965219 - DNA, 22 bp, Artificial Sequence
  chemically synthesized
cacttctaaacatctgagtgtc

SEQ ID NO: 965220 - DNA, 22 bp, Artificial Sequence
  chemically synthesized
aagatcaagccctgagacactc

SEQ ID NO: 965221 - DNA, 22 bp, Artificial Sequence
  chemically synthesized
ctaaacatctgagtgtctcagg

SEQ ID NO: 965222 - DNA, 22 bp, Artificial Sequence
  chemically synthesized
taaacatctgagtgtctcaggg

SEQ ID NO: 965223 - DNA, 22 bp, Artificial Sequence
  chemically synthesized
aacatctgagtgtctcagggct

SEQ ID NO: 965224 - DNA, 22 bp, Artificial Sequence
  chemically synthesized
agtgtctcagggcttgatcttg

SEQ ID NO: 965225 - DNA, 22 bp, Artificial Sequence
  chemically synthesized
agggcttgatcttgagactatt

SEQ ID NO: 965226 - DNA, 22 bp, Artificial Sequence
  chemically synthesized
caggagaacataaatagtctca

SEQ ID NO: 965227 - DNA, 22 bp, Artificial Sequence
  chemically synthesized
gatcttgagactatttatgttc

SEQ ID NO: 965228 - DNA, 22 bp, Artificial Sequence
  chemically synthesized
atcttgagactatttatgttct

SEQ ID NO: 965229 - DNA, 22 bp, Artificial Sequence
  chemically synthesized
gagacctccaggagaacataaa

SEQ ID NO: 965230 - DNA, 22 bp, Artificial Sequence
  chemically synthesized
gagactatttatgttctcctgg

SEQ ID NO: 965231 - DNA, 22 bp, Artificial Sequence
  chemically synthesized
agactatttatgttctcctgga

SEQ ID NO: 965232 - DNA, 22 bp, Artificial Sequence
  chemically synthesized
tttatgttctcctggaggtctc

SEQ ID NO: 965233 - DNA, 22 bp, Artificial Sequence
  chemically synthesized
gagccatggcgctagagacctc

SEQ ID NO: 965234 - DNA, 22 bp, Artificial Sequence
  chemically synthesized
atgttctcctggaggtctctag

SEQ ID NO: 965235 - DNA, 22 bp, Artificial Sequence
  chemically synthesized
tgttctcctggaggtctctagc

SEQ ID NO: 965236 - DNA, 22 bp, Artificial Sequence
  chemically synthesized
tctagagccatggcgctagaga

SEQ ID NO: 965237 - DNA, 22 bp, Artificial Sequence
  chemically synthesized
tcctggaggtctctagcgccat

SEQ ID NO: 965238 - DNA, 22 bp, Artificial Sequence
  chemically synthesized
ctggaggtctctagcgccatgg

SEQ ID NO: 965239 - DNA, 22 bp, Artificial Sequence
  chemically synthesized
gaggtctctagcgccatggctc

SEQ ID NO: 965240 - DNA, 22 bp, Artificial Sequence
  chemically synthesized
aggatctgtctagagccatggc

SEQ ID NO: 965241 - DNA, 22 bp, Artificial Sequence
  chemically synthesized
tagcgccatggctctagacaga

SEQ ID NO: 965242 - DNA, 22 bp, Artificial Sequence
  chemically synthesized
gcgccatggctctagacagatc

SEQ ID NO: 965243 - DNA, 22 bp, Artificial Sequence
  chemically synthesized
gcagatgcacattaaggatctg

SEQ ID NO: 965244 - DNA, 22 bp, Artificial Sequence
  chemically synthesized
gggctggcagatgcacattaag

SEQ ID NO: 965245 - DNA, 22 bp, Artificial Sequence
  chemically synthesized
agggctggcagatgcacattaa

SEQ ID NO: 965246 - DNA, 22 bp, Artificial Sequence
  chemically synthesized
tagacagatccttaatgtgcat

SEQ ID NO: 965247 - DNA, 22 bp, Artificial Sequence
  chemically synthesized
gacagatccttaatgtgcatct

SEQ ID NO: 965248 - DNA, 22 bp, Artificial Sequence
  chemically synthesized
gagaagagcttagggctggcag

SEQ ID NO: 965249 - DNA, 22 bp, Artificial Sequence
  chemically synthesized
agagaagagcttagggctggca

SEQ ID NO: 965250 - DNA, 22 bp, Artificial Sequence
  chemically synthesized
tagagaagagcttagggctggc

SEQ ID NO: 965251 - DNA, 22 bp, Artificial Sequence
  chemically synthesized
aatgtgcatctgccagccctaa

SEQ ID NO: 965252 - DNA, 22 bp, Artificial Sequence
  chemically synthesized
atgtgcatctgccagccctaag

SEQ ID NO: 965253 - DNA, 22 bp, Artificial Sequence
  chemically synthesized
ccagccctaagctcttctctaa

SEQ ID NO: 965254 - DNA, 22 bp, Artificial Sequence
  chemically synthesized
aatataaatgtggattttagag

SEQ ID NO: 965255 - DNA, 22 bp, Artificial Sequence
  chemically synthesized
agctcttctctaaaatccacat

SEQ ID NO: 965256 - DNA, 22 bp, Artificial Sequence
  chemically synthesized
ggaaactgaatataaatgtgga

SEQ ID NO: 965257 - DNA, 22 bp, Artificial Sequence
  chemically synthesized
ttctctaaaatccacatttata

SEQ ID NO: 965258 - DNA, 22 bp, Artificial Sequence
  chemically synthesized
ctctaaaatccacatttatatt

SEQ ID NO: 965259 - DNA, 22 bp, Artificial Sequence
  chemically synthesized
tctaaaatccacatttatattc

SEQ ID NO: 965260 - DNA, 22 bp, Artificial Sequence
  chemically synthesized
taaaatccacatttatattcag

SEQ ID NO: 965261 - DNA, 22 bp, Artificial Sequence
  chemically synthesized
aaatccacatttatattcagtt

SEQ ID NO: 965262 - DNA, 22 bp, Artificial Sequence
  chemically synthesized
gagaccctaggaaactgaatat

SEQ ID NO: 965263 - DNA, 22 bp, Artificial Sequence
  chemically synthesized
ttagagaccctaggaaactgaa

SEQ ID NO: 965264 - DNA, 22 bp, Artificial Sequence
  chemically synthesized
attagagaccctaggaaactga

SEQ ID NO: 965265 - DNA, 22 bp, Artificial Sequence
  chemically synthesized
atattcagtttcctagggtctc

SEQ ID NO: 965266 - DNA, 22 bp, Artificial Sequence
  chemically synthesized
tattcagtttcctagggtctct

SEQ ID NO: 965267 - DNA, 22 bp, Artificial Sequence
  chemically synthesized
gggatgcttattagagacccta

SEQ ID NO: 965268 - DNA, 22 bp, Artificial Sequence
  chemically synthesized
ggggatgcttattagagaccct

SEQ ID NO: 965269 - DNA, 22 bp, Artificial Sequence
  chemically synthesized
agtttcctagggtctctaataa

SEQ ID NO: 965270 - DNA, 22 bp, Artificial Sequence
  chemically synthesized
gtttggggatgcttattagaga

SEQ ID NO: 965271 - DNA, 22 bp, Artificial Sequence
  chemically synthesized
cctagggtctctaataagcatc

SEQ ID NO: 965272 - DNA, 22 bp, Artificial Sequence
  chemically synthesized
ctagggtctctaataagcatcc

SEQ ID NO: 965273 - DNA, 22 bp, Artificial Sequence
  chemically synthesized
gggtctctaataagcatcccca

SEQ ID NO: 965274 - DNA, 22 bp, Artificial Sequence
  chemically synthesized
gacatgctagtttggggatgct

SEQ ID NO: 965275 - DNA, 22 bp, Artificial Sequence
  chemically synthesized
ggacatgctagtttggggatgc

SEQ ID NO: 965276 - DNA, 22 bp, Artificial Sequence
  chemically synthesized
tttggacatgctagtttgggga

SEQ ID NO: 965277 - DNA, 22 bp, Artificial Sequence
  chemically synthesized
atttggacatgctagtttgggg

SEQ ID NO: 965278 - DNA, 22 bp, Artificial Sequence
  chemically synthesized
tatttggacatgctagtttggg

SEQ ID NO: 965279 - DNA, 22 bp, Artificial Sequence
  chemically synthesized
taataagcatccccaaactagc

SEQ ID NO: 965280 - DNA, 22 bp, Artificial Sequence
  chemically synthesized
ataagcatccccaaactagcat

SEQ ID NO: 965281 - DNA, 22 bp, Artificial Sequence
  chemically synthesized
aaaaagtatcaagaatctttat

SEQ ID NO: 965282 - DNA, 22 bp, Artificial Sequence
  chemically synthesized
gcatgtccaaataaagattctt

SEQ ID NO: 965283 - DNA, 22 bp, Artificial Sequence
  chemically synthesized
ttcaaaaagtatcaagaatctt

SEQ ID NO: 965284 - DNA, 22 bp, Artificial Sequence
  chemically synthesized
gttcaaaaagtatcaagaatct

SEQ ID NO: 965285 - DNA, 22 bp, Artificial Sequence
  chemically synthesized
ttgatactttttgaacaaatct

SEQ ID NO: 965286 - DNA, 22 bp, Artificial Sequence
  chemically synthesized
taaagtaagagcagatttgttc

SEQ ID NO: 965287 - DNA, 22 bp, Artificial Sequence
  chemically synthesized
gatactttttgaacaaatctgc

SEQ ID NO: 965288 - DNA, 22 bp, Artificial Sequence
  chemically synthesized
atactttttgaacaaatctgct

SEQ ID NO: 965289 - DNA, 22 bp, Artificial Sequence
  chemically synthesized
tttgaacaaatctgctcttact

SEQ ID NO: 965290 - DNA, 22 bp, Artificial Sequence
  chemically synthesized
ttgaacaaatctgctcttactt

SEQ ID NO: 965291 - DNA, 22 bp, Artificial Sequence
  chemically synthesized
tgaacaaatctgctcttacttt

SEQ ID NO: 965292 - DNA, 22 bp, Artificial Sequence
  chemically synthesized
gaacaaatctgctcttacttta

SEQ ID NO: 965293 - DNA, 22 bp, Artificial Sequence
  chemically synthesized
aacaaatctgctcttactttat

SEQ ID NO: 965294 - DNA, 22 bp, Artificial Sequence
  chemically synthesized
agatgtagaatattataaagta

SEQ ID NO: 965295 - DNA, 22 bp, Artificial Sequence
  chemically synthesized
ttgagatgtagaatattataaa

SEQ ID NO: 965296 - DNA, 22 bp, Artificial Sequence
  chemically synthesized
attgagatgtagaatattataa

SEQ ID NO: 965297 - DNA, 22 bp, Artificial Sequence
  chemically synthesized
ctcttactttataatattctac

SEQ ID NO: 965298 - DNA, 22 bp, Artificial Sequence
  chemically synthesized
ccatttattgagatgtagaata

SEQ ID NO: 965299 - DNA, 22 bp, Artificial Sequence
  chemically synthesized
ttactttataatattctacatc

SEQ ID NO: 965300 - DNA, 22 bp, Artificial Sequence
  chemically synthesized
actttataatattctacatctc

SEQ ID NO: 965301 - DNA, 22 bp, Artificial Sequence
  chemically synthesized
ctttataatattctacatctca

SEQ ID NO: 965302 - DNA, 22 bp, Artificial Sequence
  chemically synthesized
tataatattctacatctcaata

SEQ ID NO: 965303 - DNA, 22 bp, Artificial Sequence
  chemically synthesized
ataatattctacatctcaataa

SEQ ID NO: 965304 - DNA, 22 bp, Artificial Sequence
  chemically synthesized
taatattctacatctcaataaa

SEQ ID NO: 965305 - DNA, 22 bp, Artificial Sequence
  chemically synthesized
tgatgagggtattaccatttat

SEQ ID NO: 965306 - DNA, 22 bp, Artificial Sequence
  chemically synthesized
tacatctcaataaatggtaata

SEQ ID NO: 965307 - DNA, 22 bp, Artificial Sequence
  chemically synthesized
catctcaataaatggtaatacc

SEQ ID NO: 965308 - DNA, 22 bp, Artificial Sequence
  chemically synthesized
aataattatgatgagggtatta

SEQ ID NO: 965309 - DNA, 22 bp, Artificial Sequence
  chemically synthesized
gaataattatgatgagggtatt

SEQ ID NO: 965310 - DNA, 22 bp, Artificial Sequence
  chemically synthesized
aataaatggtaataccctcatc

SEQ ID NO: 965311 - DNA, 22 bp, Artificial Sequence
  chemically synthesized
acttgaataattatgatgaggg

SEQ ID NO: 965312 - DNA, 22 bp, Artificial Sequence
  chemically synthesized
aacttgaataattatgatgagg

SEQ ID NO: 965313 - DNA, 22 bp, Artificial Sequence
  chemically synthesized
atgtttaacttgaataattatg

SEQ ID NO: 965314 - DNA, 22 bp, Artificial Sequence
  chemically synthesized
aatgtttaacttgaataattat

SEQ ID NO: 965315 - DNA, 22 bp, Artificial Sequence
  chemically synthesized
taatgtttaacttgaataatta

SEQ ID NO: 965316 - DNA, 22 bp, Artificial Sequence
  chemically synthesized
tttaatgtttaacttgaataat

SEQ ID NO: 965317 - DNA, 22 bp, Artificial Sequence
  chemically synthesized
actctttaatgtttaacttgaa

SEQ ID NO: 965318 - DNA, 22 bp, Artificial Sequence
  chemically synthesized
atcataattattcaagttaaac

SEQ ID NO: 965319 - DNA, 22 bp, Artificial Sequence
  chemically synthesized
ttcaagttaaacattaaagagt

SEQ ID NO: 965320 - DNA, 22 bp, Artificial Sequence
  chemically synthesized
aagttaaacattaaagagttaa

SEQ ID NO: 965321 - DNA, 22 bp, Artificial Sequence
  chemically synthesized
aacattaaagagttaacactga

SEQ ID NO: 965322 - DNA, 22 bp, Artificial Sequence
  chemically synthesized
gtaggagaaaaaaataaatcag

SEQ ID NO: 965323 - DNA, 22 bp, Artificial Sequence
  chemically synthesized
aagagttaacactgatttattt

SEQ ID NO: 965324 - DNA, 22 bp, Artificial Sequence
  chemically synthesized
attggtaggagaaaaaaataaa

SEQ ID NO: 965325 - DNA, 22 bp, Artificial Sequence
  chemically synthesized
aattggtaggagaaaaaaataa

SEQ ID NO: 965326 - DNA, 22 bp, Artificial Sequence
  chemically synthesized
acactgatttatttttttctcc

SEQ ID NO: 965327 - DNA, 22 bp, Artificial Sequence
  chemically synthesized
atttatttttttctcctaccaa

SEQ ID NO: 965328 - DNA, 22 bp, Artificial Sequence
  chemically synthesized
atttttttctcctaccaattaa

SEQ ID NO: 965329 - DNA, 22 bp, Artificial Sequence
  chemically synthesized
tttttttctcctaccaattaag

SEQ ID NO: 965330 - DNA, 22 bp, Artificial Sequence
  chemically synthesized
tagtcaacaaggcttaattggt

SEQ ID NO: 965331 - DNA, 22 bp, Artificial Sequence
  chemically synthesized
gtagtcaacaaggcttaattgg

SEQ ID NO: 965332 - DNA, 22 bp, Artificial Sequence
  chemically synthesized
ttttctcctaccaattaagcct

SEQ ID NO: 965333 - DNA, 22 bp, Artificial Sequence
  chemically synthesized
tttctcctaccaattaagcctt

SEQ ID NO: 965334 - DNA, 22 bp, Artificial Sequence
  chemically synthesized
ttctcctaccaattaagccttg

SEQ ID NO: 965335 - DNA, 22 bp, Artificial Sequence
  chemically synthesized
tctcctaccaattaagccttgt

SEQ ID NO: 965336 - DNA, 22 bp, Artificial Sequence
  chemically synthesized
ctcctaccaattaagccttgtt

SEQ ID NO: 965337 - DNA, 22 bp, Artificial Sequence
  chemically synthesized
agatttgtagtcaacaaggctt

SEQ ID NO: 965338 - DNA, 22 bp, Artificial Sequence
  chemically synthesized
tcctaccaattaagccttgttg

SEQ ID NO: 965339 - DNA, 22 bp, Artificial Sequence
  chemically synthesized
cagatttgtagtcaacaaggct

SEQ ID NO: 965340 - DNA, 22 bp, Artificial Sequence
  chemically synthesized
ctaccaattaagccttgttgac

SEQ ID NO: 965341 - DNA, 22 bp, Artificial Sequence
  chemically synthesized
atttcagatttgtagtcaacaa

SEQ ID NO: 965342 - DNA, 22 bp, Artificial Sequence
  chemically synthesized
ccaattaagccttgttgactac

SEQ ID NO: 965343 - DNA, 22 bp, Artificial Sequence
  chemically synthesized
agccttgttgactacaaatctg

SEQ ID NO: 965344 - DNA, 22 bp, Artificial Sequence
  chemically synthesized
aagcgactgatttcagatttgt

SEQ ID NO: 965345 - DNA, 22 bp, Artificial Sequence
  chemically synthesized
gttgactacaaatctgaaatca

SEQ ID NO: 965346 - DNA, 22 bp, Artificial Sequence
  chemically synthesized
ttgactacaaatctgaaatcag

SEQ ID NO: 965347 - DNA, 22 bp, Artificial Sequence
  chemically synthesized
actacaaatctgaaatcagtcg

SEQ ID NO: 965348 - DNA, 22 bp, Artificial Sequence
  chemically synthesized
gagagattgaagcgactgattt

SEQ ID NO: 965349 - DNA, 22 bp, Artificial Sequence
  chemically synthesized
caaatctgaaatcagtcgcttc

SEQ ID NO: 965350 - DNA, 22 bp, Artificial Sequence
  chemically synthesized
tactggagagattgaagcgact

SEQ ID NO: 965351 - DNA, 22 bp, Artificial Sequence
  chemically synthesized
aaatcagtcgcttcaatctctc

SEQ ID NO: 965352 - DNA, 22 bp, Artificial Sequence
  chemically synthesized
gacaaggacgattgtactggag

SEQ ID NO: 965353 - DNA, 22 bp, Artificial Sequence
  chemically synthesized
ggacaaggacgattgtactgga

SEQ ID NO: 965354 - DNA, 22 bp, Artificial Sequence
  chemically synthesized
caatctctccagtacaatcgtc

SEQ ID NO: 965355 - DNA, 22 bp, Artificial Sequence
  chemically synthesized
aatctctccagtacaatcgtcc

SEQ ID NO: 965356 - DNA, 22 bp, Artificial Sequence
  chemically synthesized
tccagtacaatcgtccttgtcc

SEQ ID NO: 965357 - DNA, 22 bp, Artificial Sequence
  chemically synthesized
cagtacaatcgtccttgtccaa

SEQ ID NO: 965358 - DNA, 22 bp, Artificial Sequence
  chemically synthesized
gtccaagccactatcatctctc

SEQ ID NO: 965359 - DNA, 22 bp, Artificial Sequence
  chemically synthesized
agtagtccgtgtgagagatgat

SEQ ID NO: 965360 - DNA, 22 bp, Artificial Sequence
  chemically synthesized
tccaagccactatcatctctca

SEQ ID NO: 965361 - DNA, 22 bp, Artificial Sequence
  chemically synthesized
attgagtagtccgtgtgagaga

SEQ ID NO: 965362 - DNA, 22 bp, Artificial Sequence
  chemically synthesized
tcatctctcacacggactactc

SEQ ID NO: 965363 - DNA, 22 bp, Artificial Sequence
  chemically synthesized
tcacacggactactcaattaat

SEQ ID NO: 965364 - DNA, 22 bp, Artificial Sequence
  chemically synthesized
acacggactactcaattaatga

SEQ ID NO: 965365 - DNA, 22 bp, Artificial Sequence
  chemically synthesized
ctcaattaatgactggtctttt

SEQ ID NO: 965366 - DNA, 22 bp, Artificial Sequence
  chemically synthesized
aattaatgactggtctttttat

SEQ ID NO: 965367 - DNA, 22 bp, Artificial Sequence
  chemically synthesized
atgactggtctttttattccac

SEQ ID NO: 965368 - DNA, 22 bp, Artificial Sequence
  chemically synthesized
gtctttttattccactttcacc

SEQ ID NO: 965369 - DNA, 22 bp, Artificial Sequence
  chemically synthesized
tttattccactttcacccccta

SEQ ID NO: 965370 - DNA, 22 bp, Artificial Sequence
  chemically synthesized
ttattccactttcaccccctac

SEQ ID NO: 965371 - DNA, 22 bp, Artificial Sequence
  chemically synthesized
tattccactttcaccccctaca

SEQ ID NO: 965372 - DNA, 22 bp, Artificial Sequence
  chemically synthesized
tcgaaaacggaatgtagggggt

SEQ ID NO: 965373 - DNA, 22 bp, Artificial Sequence
  chemically synthesized
attccactttcaccccctacat

SEQ ID NO: 965374 - DNA, 22 bp, Artificial Sequence
  chemically synthesized
atcgaaaacggaatgtaggggg

SEQ ID NO: 965375 - DNA, 22 bp, Artificial Sequence
  chemically synthesized
ttccactttcaccccctacatt

SEQ ID NO: 965376 - DNA, 22 bp, Artificial Sequence
  chemically synthesized
cactttcaccccctacattccg

SEQ ID NO: 965377 - DNA, 22 bp, Artificial Sequence
  chemically synthesized
gcttatcgaaaacggaatgtag

SEQ ID NO: 965378 - DNA, 22 bp, Artificial Sequence
  chemically synthesized
actggcttatcgaaaacggaat

SEQ ID NO: 965379 - DNA, 22 bp, Artificial Sequence
  chemically synthesized
tcaccccctacattccgttttc

SEQ ID NO: 965380 - DNA, 22 bp, Artificial Sequence
  chemically synthesized
gactggcttatcgaaaacggaa

SEQ ID NO: 965381 - DNA, 22 bp, Artificial Sequence
  chemically synthesized
caccccctacattccgttttcg

SEQ ID NO: 965382 - DNA, 22 bp, Artificial Sequence
  chemically synthesized
tgactggcttatcgaaaacgga

SEQ ID NO: 965383 - DNA, 22 bp, Artificial Sequence
  chemically synthesized
accccctacattccgttttcga

SEQ ID NO: 965384 - DNA, 22 bp, Artificial Sequence
  chemically synthesized
actttgactggcttatcgaaaa

SEQ ID NO: 965385 - DNA, 22 bp, Artificial Sequence
  chemically synthesized
cactttgactggcttatcgaaa

SEQ ID NO: 965386 - DNA, 22 bp, Artificial Sequence
  chemically synthesized
cattccgttttcgataagccag

SEQ ID NO: 965387 - DNA, 22 bp, Artificial Sequence
  chemically synthesized
gcttcactttgactggcttatc

SEQ ID NO: 965388 - DNA, 22 bp, Artificial Sequence
  chemically synthesized
cgttttcgataagccagtcaaa

SEQ ID NO: 965389 - DNA, 22 bp, Artificial Sequence
  chemically synthesized
tcgataagccagtcaaagtgaa

SEQ ID NO: 965390 - DNA, 22 bp, Artificial Sequence
  chemically synthesized
gagagtattagcttcactttga

SEQ ID NO: 965391 - DNA, 22 bp, Artificial Sequence
  chemically synthesized
cgataagccagtcaaagtgaag

SEQ ID NO: 965392 - DNA, 22 bp, Artificial Sequence
  chemically synthesized
gataagccagtcaaagtgaagc

SEQ ID NO: 965393 - DNA, 22 bp, Artificial Sequence
  chemically synthesized
tggtggcaagtgattggagagt

SEQ ID NO: 965394 - DNA, 22 bp, Artificial Sequence
  chemically synthesized
taattatggtggcaagtgattg

SEQ ID NO: 965395 - DNA, 22 bp, Artificial Sequence
  chemically synthesized
ttgtaattatggtggcaagtga

SEQ ID NO: 965396 - DNA, 22 bp, Artificial Sequence
  chemically synthesized
atactctccaatcacttgccac

SEQ ID NO: 965397 - DNA, 22 bp, Artificial Sequence
  chemically synthesized
attgtaattatggtggcaagtg

SEQ ID NO: 965398 - DNA, 22 bp, Artificial Sequence
  chemically synthesized
tattgtaattatggtggcaagt

SEQ ID NO: 965399 - DNA, 22 bp, Artificial Sequence
  chemically synthesized
tccaatcacttgccaccataat

SEQ ID NO: 965400 - DNA, 22 bp, Artificial Sequence
  chemically synthesized
gattttattgtaattatggtgg

SEQ ID NO: 965401 - DNA, 22 bp, Artificial Sequence
  chemically synthesized
agattttattgtaattatggtg

SEQ ID NO: 965402 - DNA, 22 bp, Artificial Sequence
  chemically synthesized
caatcacttgccaccataatta

SEQ ID NO: 965403 - DNA, 22 bp, Artificial Sequence
  chemically synthesized
tttagattttattgtaattatg

SEQ ID NO: 965404 - DNA, 22 bp, Artificial Sequence
  chemically synthesized
gccaccataattacaataaaat

SEQ ID NO: 965405 - DNA, 22 bp, Artificial Sequence
  chemically synthesized
taaattgtttagattttattgt

SEQ ID NO: 965406 - DNA, 22 bp, Artificial Sequence
  chemically synthesized
ccaccataattacaataaaatc

SEQ ID NO: 965407 - DNA, 22 bp, Artificial Sequence
  chemically synthesized
ataaattgtttagattttattg

SEQ ID NO: 965408 - DNA, 22 bp, Artificial Sequence
  chemically synthesized
tataaattgtttagattttatt

SEQ ID NO: 965409 - DNA, 22 bp, Artificial Sequence
  chemically synthesized
ttataaattgtttagattttat

SEQ ID NO: 965410 - DNA, 22 bp, Artificial Sequence
  chemically synthesized
gtttttataaattgtttagatt

SEQ ID NO: 965411 - DNA, 22 bp, Artificial Sequence
  chemically synthesized
ttcgtttttataaattgtttag

SEQ ID NO: 965412 - DNA, 22 bp, Artificial Sequence
  chemically synthesized
gttcgtttttataaattgttta

SEQ ID NO: 965413 - DNA, 22 bp, Artificial Sequence
  chemically synthesized
caataaaatctaaacaatttat

SEQ ID NO: 965414 - DNA, 22 bp, Artificial Sequence
  chemically synthesized
atataaagacttgttcgttttt

SEQ ID NO: 965415 - DNA, 22 bp, Artificial Sequence
  chemically synthesized
aacaatttataaaaacgaacaa

SEQ ID NO: 965416 - DNA, 22 bp, Artificial Sequence
  chemically synthesized
ataaaaacgaacaagtctttat

SEQ ID NO: 965417 - DNA, 22 bp, Artificial Sequence
  chemically synthesized
taaaaacgaacaagtctttata

SEQ ID NO: 965418 - DNA, 22 bp, Artificial Sequence
  chemically synthesized
gagaagtaggcaatggccagct

SEQ ID NO: 965419 - DNA, 22 bp, Artificial Sequence
  chemically synthesized
tatatgagctggccattgccta

SEQ ID NO: 965420 - DNA, 22 bp, Artificial Sequence
  chemically synthesized
atatgagctggccattgcctac

SEQ ID NO: 965421 - DNA, 22 bp, Artificial Sequence
  chemically synthesized
tatgagctggccattgcctact

SEQ ID NO: 965422 - DNA, 22 bp, Artificial Sequence
  chemically synthesized
aggatgagtgagttggagaagt

SEQ ID NO: 965423 - DNA, 22 bp, Artificial Sequence
  chemically synthesized
gccattgcctacttctccaact

SEQ ID NO: 965424 - DNA, 22 bp, Artificial Sequence
  chemically synthesized
agacattgaggatgagtgagtt

SEQ ID NO: 965425 - DNA, 22 bp, Artificial Sequence
  chemically synthesized
cctacttctccaactcactcat

SEQ ID NO: 965426 - DNA, 22 bp, Artificial Sequence
  chemically synthesized
cttctccaactcactcatcctc

SEQ ID NO: 965427 - DNA, 22 bp, Artificial Sequence
  chemically synthesized
ctccaactcactcatcctcaat

SEQ ID NO: 965428 - DNA, 22 bp, Artificial Sequence
  chemically synthesized
tccaactcactcatcctcaatg

SEQ ID NO: 965429 - DNA, 22 bp, Artificial Sequence
  chemically synthesized
caactcactcatcctcaatgtc

SEQ ID NO: 965430 - DNA, 22 bp, Artificial Sequence
  chemically synthesized
actcatcctcaatgtcttagcc

SEQ ID NO: 965431 - DNA, 22 bp, Artificial Sequence
  chemically synthesized
atcctcaatgtcttagccatat

SEQ ID NO: 965432 - DNA, 22 bp, Artificial Sequence
  chemically synthesized
aatgtcttagccatattggctt

SEQ ID NO: 965433 - DNA, 22 bp, Artificial Sequence
  chemically synthesized
atggggcaacaacaacaataag

SEQ ID NO: 965434 - DNA, 22 bp, Artificial Sequence
  chemically synthesized
agccatattggcttattgttgt

SEQ ID NO: 965435 - DNA, 22 bp, Artificial Sequence
  chemically synthesized
gccatattggcttattgttgtt

SEQ ID NO: 965436 - DNA, 22 bp, Artificial Sequence
  chemically synthesized
acatattcatggggcaacaaca

SEQ ID NO: 965437 - DNA, 22 bp, Artificial Sequence
  chemically synthesized
gcttattgttgttgttgcccca

SEQ ID NO: 965438 - DNA, 22 bp, Artificial Sequence
  chemically synthesized
attgttgttgttgccccatgaa

SEQ ID NO: 965439 - DNA, 22 bp, Artificial Sequence
  chemically synthesized
ttgttgttgttgccccatgaat

SEQ ID NO: 965440 - DNA, 22 bp, Artificial Sequence
  chemically synthesized
ttgttgttgccccatgaatatg

SEQ ID NO: 965441 - DNA, 22 bp, Artificial Sequence
  chemically synthesized
ttgttgccccatgaatatgtta

SEQ ID NO: 965442 - DNA, 22 bp, Artificial Sequence
  chemically synthesized
gtgtaaagacaagttaacatat

SEQ ID NO: 965443 - DNA, 22 bp, Artificial Sequence
  chemically synthesized
ttgccccatgaatatgttaact

SEQ ID NO: 965444 - DNA, 22 bp, Artificial Sequence
  chemically synthesized
ggtgtaaagacaagttaacata

SEQ ID NO: 965445 - DNA, 22 bp, Artificial Sequence
  chemically synthesized
ccccatgaatatgttaacttgt

SEQ ID NO: 965446 - DNA, 22 bp, Artificial Sequence
  chemically synthesized
atgcatagtgtttggtgtaaag

SEQ ID NO: 965447 - DNA, 22 bp, Artificial Sequence
  chemically synthesized
acttgtctttacaccaaacact

SEQ ID NO: 965448 - DNA, 22 bp, Artificial Sequence
  chemically synthesized
gtctttacaccaaacactatgc

SEQ ID NO: 965449 - DNA, 22 bp, Artificial Sequence
  chemically synthesized
tctttacaccaaacactatgca

SEQ ID NO: 965450 - DNA, 22 bp, Artificial Sequence
  chemically synthesized
tacaccaaacactatgcattag

SEQ ID NO: 965451 - DNA, 22 bp, Artificial Sequence
  chemically synthesized
acaccaaacactatgcattagt

SEQ ID NO: 965452 - DNA, 22 bp, Artificial Sequence
  chemically synthesized
ggcaggagtaccactaatgcat

SEQ ID NO: 965453 - DNA, 22 bp, Artificial Sequence
  chemically synthesized
caccaaacactatgcattagtg

SEQ ID NO: 965454 - DNA, 22 bp, Artificial Sequence
  chemically synthesized
taggcaggagtaccactaatgc

SEQ ID NO: 965455 - DNA, 22 bp, Artificial Sequence
  chemically synthesized
tgcattagtggtactcctgcct

SEQ ID NO: 965456 - DNA, 22 bp, Artificial Sequence
  chemically synthesized
gtggtactcctgcctagaatac

SEQ ID NO: 965457 - DNA, 22 bp, Artificial Sequence
  chemically synthesized
ctgcctagaatactgttccttt

SEQ ID NO: 965458 - DNA, 22 bp, Artificial Sequence
  chemically synthesized
taataacaatcaaaaggaacag

SEQ ID NO: 965459 - DNA, 22 bp, Artificial Sequence
  chemically synthesized
cctagaatactgttccttttga

SEQ ID NO: 965460 - DNA, 22 bp, Artificial Sequence
  chemically synthesized
ctataataacaatcaaaaggaa

SEQ ID NO: 965461 - DNA, 22 bp, Artificial Sequence
  chemically synthesized
gaatactgttccttttgattgt

SEQ ID NO: 965462 - DNA, 22 bp, Artificial Sequence
  chemically synthesized
atctcctataataacaatcaaa

SEQ ID NO: 965463 - DNA, 22 bp, Artificial Sequence
  chemically synthesized
ttccttttgattgttattatag

SEQ ID NO: 965464 - DNA, 22 bp, Artificial Sequence
  chemically synthesized
cttttgattgttattataggag

SEQ ID NO: 965465 - DNA, 22 bp, Artificial Sequence
  chemically synthesized
ttgattgttattataggagatc

SEQ ID NO: 965466 - DNA, 22 bp, Artificial Sequence
  chemically synthesized
tgattgttattataggagatca

SEQ ID NO: 965467 - DNA, 22 bp, Artificial Sequence
  chemically synthesized
gattgttattataggagatcaa

SEQ ID NO: 965468 - DNA, 22 bp, Artificial Sequence
  chemically synthesized
gagtggtatatattgatctcct

SEQ ID NO: 965469 - DNA, 22 bp, Artificial Sequence
  chemically synthesized
attgttattataggagatcaat

SEQ ID NO: 965470 - DNA, 22 bp, Artificial Sequence
  chemically synthesized
ggagtggtatatattgatctcc

SEQ ID NO: 965471 - DNA, 22 bp, Artificial Sequence
  chemically synthesized
tggagtggtatatattgatctc

SEQ ID NO: 965472 - DNA, 22 bp, Artificial Sequence
  chemically synthesized
ttattataggagatcaatatat

SEQ ID NO: 965473 - DNA, 22 bp, Artificial Sequence
  chemically synthesized
ttataggagatcaatatatacc

SEQ ID NO: 965474 - DNA, 22 bp, Artificial Sequence
  chemically synthesized
taggagatcaatatataccact

SEQ ID NO: 965475 - DNA, 22 bp, Artificial Sequence
  chemically synthesized
tgtcaaagtgccatattttgga

SEQ ID NO: 965476 - DNA, 22 bp, Artificial Sequence
  chemically synthesized
atgtcaaagtgccatattttgg

SEQ ID NO: 965477 - DNA, 22 bp, Artificial Sequence
  chemically synthesized
tatgtcaaagtgccatattttg

SEQ ID NO: 965478 - DNA, 22 bp, Artificial Sequence
  chemically synthesized
aaagtaatctttatgtcaaagt

SEQ ID NO: 965479 - DNA, 22 bp, Artificial Sequence
  chemically synthesized
caaaatatggcactttgacata

SEQ ID NO: 965480 - DNA, 22 bp, Artificial Sequence
  chemically synthesized
actaaaagtaatctttatgtca

SEQ ID NO: 965481 - DNA, 22 bp, Artificial Sequence
  chemically synthesized
taactaaaagtaatctttatgt

SEQ ID NO: 965482 - DNA, 22 bp, Artificial Sequence
  chemically synthesized
cctctaactaaaagtaatcttt

SEQ ID NO: 965483 - DNA, 22 bp, Artificial Sequence
  chemically synthesized
gcctctaactaaaagtaatctt

SEQ ID NO: 965484 - DNA, 22 bp, Artificial Sequence
  chemically synthesized
cttgcctctaactaaaagtaat

SEQ ID NO: 965485 - DNA, 22 bp, Artificial Sequence
  chemically synthesized
acttgcctctaactaaaagtaa

SEQ ID NO: 965486 - DNA, 22 bp, Artificial Sequence
  chemically synthesized
tgacataaagattacttttagt

SEQ ID NO: 965487 - DNA, 22 bp, Artificial Sequence
  chemically synthesized
gacataaagattacttttagtt

SEQ ID NO: 965488 - DNA, 22 bp, Artificial Sequence
  chemically synthesized
ttacttgcctctaactaaaagt

SEQ ID NO: 965489 - DNA, 22 bp, Artificial Sequence
  chemically synthesized
acataaagattacttttagtta

SEQ ID NO: 965490 - DNA, 22 bp, Artificial Sequence
  chemically synthesized
attcttacttgcctctaactaa

SEQ ID NO: 965491 - DNA, 22 bp, Artificial Sequence
  chemically synthesized
tattgattcttacttgcctcta

SEQ ID NO: 965492 - DNA, 22 bp, Artificial Sequence
  chemically synthesized
atattgattcttacttgcctct

SEQ ID NO: 965493 - DNA, 22 bp, Artificial Sequence
  chemically synthesized
cttttagttagaggcaagtaag

SEQ ID NO: 965494 - DNA, 22 bp, Artificial Sequence
  chemically synthesized
cttatattgattcttacttgcc

SEQ ID NO: 965495 - DNA, 22 bp, Artificial Sequence
  chemically synthesized
gcttatattgattcttacttgc

SEQ ID NO: 965496 - DNA, 22 bp, Artificial Sequence
  chemically synthesized
tgcttatattgattcttacttg

SEQ ID NO: 965497 - DNA, 22 bp, Artificial Sequence
  chemically synthesized
ttagttagaggcaagtaagaat

SEQ ID NO: 965498 - DNA, 22 bp, Artificial Sequence
  chemically synthesized
ttgcttatattgattcttactt

SEQ ID NO: 965499 - DNA, 22 bp, Artificial Sequence
  chemically synthesized
tagttagaggcaagtaagaatc

SEQ ID NO: 965500 - DNA, 22 bp, Artificial Sequence
  chemically synthesized
tttgcttatattgattcttact

SEQ ID NO: 965501 - DNA, 22 bp, Artificial Sequence
  chemically synthesized
agttagaggcaagtaagaatca

SEQ ID NO: 965502 - DNA, 22 bp, Artificial Sequence
  chemically synthesized
gttagaggcaagtaagaatcaa

SEQ ID NO: 965503 - DNA, 22 bp, Artificial Sequence
  chemically synthesized
tttttgcttatattgattctta

SEQ ID NO: 965504 - DNA, 22 bp, Artificial Sequence
  chemically synthesized
ctttttgcttatattgattctt

SEQ ID NO: 965505 - DNA, 22 bp, Artificial Sequence
  chemically synthesized
gaggcaagtaagaatcaatata

SEQ ID NO: 965506 - DNA, 22 bp, Artificial Sequence
  chemically synthesized
ggaaggcttctttttgcttata

SEQ ID NO: 965507 - DNA, 22 bp, Artificial Sequence
  chemically synthesized
gacaagggaagcactgggaagg

SEQ ID NO: 965508 - DNA, 22 bp, Artificial Sequence
  chemically synthesized
agacaagggaagcactgggaag

SEQ ID NO: 965509 - DNA, 22 bp, Artificial Sequence
  chemically synthesized
tttagacaagggaagcactggg

SEQ ID NO: 965510 - DNA, 22 bp, Artificial Sequence
  chemically synthesized
atttagacaagggaagcactgg

SEQ ID NO: 965511 - DNA, 22 bp, Artificial Sequence
  chemically synthesized
tatttagacaagggaagcactg

SEQ ID NO: 965512 - DNA, 22 bp, Artificial Sequence
  chemically synthesized
ttatttagacaagggaagcact

SEQ ID NO: 965513 - DNA, 22 bp, Artificial Sequence
  chemically synthesized
cttttatttagacaagggaagc

SEQ ID NO: 965514 - DNA, 22 bp, Artificial Sequence
  chemically synthesized
tgcttttatttagacaagggaa

SEQ ID NO: 965515 - DNA, 22 bp, Artificial Sequence
  chemically synthesized
ctgcttttatttagacaaggga

SEQ ID NO: 965516 - DNA, 22 bp, Artificial Sequence
  chemically synthesized
cccagtgcttcccttgtctaaa

SEQ ID NO: 965517 - DNA, 22 bp, Artificial Sequence
  chemically synthesized
ccagtgcttcccttgtctaaat

SEQ ID NO: 965518 - DNA, 22 bp, Artificial Sequence
  chemically synthesized
agaagtttctgcttttatttag

SEQ ID NO: 965519 - DNA, 22 bp, Artificial Sequence
  chemically synthesized
tcagaagtttctgcttttattt

SEQ ID NO: 965520 - DNA, 22 bp, Artificial Sequence
  chemically synthesized
ctcagaagtttctgcttttatt

SEQ ID NO: 965521 - DNA, 22 bp, Artificial Sequence
  chemically synthesized
cccttgtctaaataaaagcaga

SEQ ID NO: 965522 - DNA, 22 bp, Artificial Sequence
  chemically synthesized
ccttgtctaaataaaagcagaa

SEQ ID NO: 965523 - DNA, 22 bp, Artificial Sequence
  chemically synthesized
tcatttctcagaagtttctgct

SEQ ID NO: 965524 - DNA, 22 bp, Artificial Sequence
  chemically synthesized
gtctaaataaaagcagaaactt

SEQ ID NO: 965525 - DNA, 22 bp, Artificial Sequence
  chemically synthesized
tctaaataaaagcagaaacttc

SEQ ID NO: 965526 - DNA, 22 bp, Artificial Sequence
  chemically synthesized
aataaaagcagaaacttctgag

SEQ ID NO: 965527 - DNA, 22 bp, Artificial Sequence
  chemically synthesized
tagcagttatcatttctcagaa

SEQ ID NO: 965528 - DNA, 22 bp, Artificial Sequence
  chemically synthesized
atagcagttatcatttctcaga

SEQ ID NO: 965529 - DNA, 22 bp, Artificial Sequence
  chemically synthesized
ctgagaaatgataactgctata

SEQ ID NO: 965530 - DNA, 22 bp, Artificial Sequence
  chemically synthesized
tgagaaatgataactgctataa

SEQ ID NO: 965531 - DNA, 22 bp, Artificial Sequence
  chemically synthesized
agaaatgataactgctataagc

SEQ ID NO: 965532 - DNA, 22 bp, Artificial Sequence
  chemically synthesized
ccaggagagagggcttatagca

SEQ ID NO: 965533 - DNA, 22 bp, Artificial Sequence
  chemically synthesized
cccaggagagagggcttatagc

SEQ ID NO: 965534 - DNA, 22 bp, Artificial Sequence
  chemically synthesized
ctataagccctctctcctggga

SEQ ID NO: 965535 - DNA, 22 bp, Artificial Sequence
  chemically synthesized
taagccctctctcctgggaaat

SEQ ID NO: 965536 - DNA, 22 bp, Artificial Sequence
  chemically synthesized
atggccataacaatttcccagg

SEQ ID NO: 965537 - DNA, 22 bp, Artificial Sequence
  chemically synthesized
catggccataacaatttcccag

SEQ ID NO: 965538 - DNA, 22 bp, Artificial Sequence
  chemically synthesized
ttcatggccataacaatttccc

SEQ ID NO: 965539 - DNA, 22 bp, Artificial Sequence
  chemically synthesized
tctcctgggaaattgttatggc

SEQ ID NO: 965540 - DNA, 22 bp, Artificial Sequence
  chemically synthesized
gtattcttcatggccataacaa

SEQ ID NO: 965541 - DNA, 22 bp, Artificial Sequence
  chemically synthesized
cgtattcttcatggccataaca

SEQ ID NO: 965542 - DNA, 22 bp, Artificial Sequence
  chemically synthesized
tcctgggaaattgttatggcca

SEQ ID NO: 965543 - DNA, 22 bp, Artificial Sequence
  chemically synthesized
tcgtattcttcatggccataac

SEQ ID NO: 965544 - DNA, 22 bp, Artificial Sequence
  chemically synthesized
ttcgtattcttcatggccataa

SEQ ID NO: 965545 - DNA, 22 bp, Artificial Sequence
  chemically synthesized
ctgggaaattgttatggccatg

SEQ ID NO: 965546 - DNA, 22 bp, Artificial Sequence
  chemically synthesized
ggaaattgttatggccatgaag

SEQ ID NO: 965547 - DNA, 22 bp, Artificial Sequence
  chemically synthesized
agatcaacttttcgtattcttc

SEQ ID NO: 965548 - DNA, 22 bp, Artificial Sequence
  chemically synthesized
gagatcaacttttcgtattctt

SEQ ID NO: 965549 - DNA, 22 bp, Artificial Sequence
  chemically synthesized
ttatggccatgaagaatacgaa

SEQ ID NO: 965550 - DNA, 22 bp, Artificial Sequence
  chemically synthesized
tggccatgaagaatacgaaaag

SEQ ID NO: 965551 - DNA, 22 bp, Artificial Sequence
  chemically synthesized
tcttgagatcaacttttcgtat

SEQ ID NO: 965552 - DNA, 22 bp, Artificial Sequence
  chemically synthesized
tgccaagtctatcttgagatca

SEQ ID NO: 965553 - DNA, 22 bp, Artificial Sequence
  chemically synthesized
atgccaagtctatcttgagatc

SEQ ID NO: 965554 - DNA, 22 bp, Artificial Sequence
  chemically synthesized
tttatgccaagtctatcttgag

SEQ ID NO: 965555 - DNA, 22 bp, Artificial Sequence
  chemically synthesized
gtttatgccaagtctatcttga

SEQ ID NO: 965556 - DNA, 22 bp, Artificial Sequence
  chemically synthesized
atctcaagatagacttggcata

SEQ ID NO: 965557 - DNA, 22 bp, Artificial Sequence
  chemically synthesized
aagatagacttggcataaacaa

SEQ ID NO: 965558 - DNA, 22 bp, Artificial Sequence
  chemically synthesized
ggcataaacaaactatactcca

SEQ ID NO: 965559 - DNA, 22 bp, Artificial Sequence
  chemically synthesized
gcataaacaaactatactccat

SEQ ID NO: 965560 - DNA, 22 bp, Artificial Sequence
  chemically synthesized
tactccatgtttctcccatata

SEQ ID NO: 965561 - DNA, 22 bp, Artificial Sequence
  chemically synthesized
taggaaggtaaatatatgggag

SEQ ID NO: 965562 - DNA, 22 bp, Artificial Sequence
  chemically synthesized
catgtttctcccatatatttac

SEQ ID NO: 965563 - DNA, 22 bp, Artificial Sequence
  chemically synthesized
ccaaactgtaggaaggtaaata

SEQ ID NO: 965564 - DNA, 22 bp, Artificial Sequence
  chemically synthesized
ctcccatatatttaccttccta

SEQ ID NO: 965565 - DNA, 22 bp, Artificial Sequence
  chemically synthesized
tcccatatatttaccttcctac

SEQ ID NO: 965566 - DNA, 22 bp, Artificial Sequence
  chemically synthesized
gggttgccaaactgtaggaagg

SEQ ID NO: 965567 - DNA, 22 bp, Artificial Sequence
  chemically synthesized
ccatatatttaccttcctacag

SEQ ID NO: 965568 - DNA, 22 bp, Artificial Sequence
  chemically synthesized
agggttgccaaactgtaggaag

SEQ ID NO: 965569 - DNA, 22 bp, Artificial Sequence
  chemically synthesized
ggtatttagggttgccaaactg

SEQ ID NO: 965570 - DNA, 22 bp, Artificial Sequence
  chemically synthesized
aggtatttagggttgccaaact

SEQ ID NO: 965571 - DNA, 22 bp, Artificial Sequence
  chemically synthesized
accttcctacagtttggcaacc

SEQ ID NO: 965572 - DNA, 22 bp, Artificial Sequence
  chemically synthesized
ccttcctacagtttggcaaccc

SEQ ID NO: 965573 - DNA, 22 bp, Artificial Sequence
  chemically synthesized
cctacagtttggcaaccctaaa

SEQ ID NO: 965574 - DNA, 22 bp, Artificial Sequence
  chemically synthesized
ctacagtttggcaaccctaaat

SEQ ID NO: 965575 - DNA, 22 bp, Artificial Sequence
  chemically synthesized
cagtttggcaaccctaaatacc

SEQ ID NO: 965576 - DNA, 22 bp, Artificial Sequence
  chemically synthesized
ggcaaccctaaatacctaaacc

SEQ ID NO: 965577 - DNA, 22 bp, Artificial Sequence
  chemically synthesized
gcaaccctaaatacctaaaccc

SEQ ID NO: 965578 - DNA, 22 bp, Artificial Sequence
  chemically synthesized
aatacctaaaccccttttttct

SEQ ID NO: 965579 - DNA, 22 bp, Artificial Sequence
  chemically synthesized
tagagaaatgacaaaacaaaga

SEQ ID NO: 965580 - DNA, 22 bp, Artificial Sequence
  chemically synthesized
aaccccttttttctttgttttg

SEQ ID NO: 965581 - DNA, 22 bp, Artificial Sequence
  chemically synthesized
gtagagaaatgacaaaacaaag

SEQ ID NO: 965582 - DNA, 22 bp, Artificial Sequence
  chemically synthesized
ttttctttgttttgtcatttct

SEQ ID NO: 965583 - DNA, 22 bp, Artificial Sequence
  chemically synthesized
tttctttgttttgtcatttctc

SEQ ID NO: 965584 - DNA, 22 bp, Artificial Sequence
  chemically synthesized
ttctttgttttgtcatttctct

SEQ ID NO: 965585 - DNA, 22 bp, Artificial Sequence
  chemically synthesized
tctttgttttgtcatttctcta

SEQ ID NO: 965586 - DNA, 22 bp, Artificial Sequence
  chemically synthesized
ctttgttttgtcatttctctac

SEQ ID NO: 965587 - DNA, 22 bp, Artificial Sequence
  chemically synthesized
tttgttttgtcatttctctaca

SEQ ID NO: 965588 - DNA, 22 bp, Artificial Sequence
  chemically synthesized
tgttttgtcatttctctacaag

SEQ ID NO: 965589 - DNA, 22 bp, Artificial Sequence
  chemically synthesized
gttttgtcatttctctacaagt

SEQ ID NO: 965590 - DNA, 22 bp, Artificial Sequence
  chemically synthesized
ttttgtcatttctctacaagtt

SEQ ID NO: 965591 - DNA, 22 bp, Artificial Sequence
  chemically synthesized
aacaaagaacagtaaacttgta

SEQ ID NO: 965592 - DNA, 22 bp, Artificial Sequence
  chemically synthesized
tgtcatttctctacaagtttac

SEQ ID NO: 965593 - DNA, 22 bp, Artificial Sequence
  chemically synthesized
gtcatttctctacaagtttact

SEQ ID NO: 965594 - DNA, 22 bp, Artificial Sequence
  chemically synthesized
tcatttctctacaagtttactg

SEQ ID NO: 965595 - DNA, 22 bp, Artificial Sequence
  chemically synthesized
ctctacaagtttactgttcttt

SEQ ID NO: 965596 - DNA, 22 bp, Artificial Sequence
  chemically synthesized
tctacaagtttactgttctttg

SEQ ID NO: 965597 - DNA, 22 bp, Artificial Sequence
  chemically synthesized
tatagcatctgaacaaagaaca

SEQ ID NO: 965598 - DNA, 22 bp, Artificial Sequence
  chemically synthesized
tacaagtttactgttctttgtt

SEQ ID NO: 965599 - DNA, 22 bp, Artificial Sequence
  chemically synthesized
atatagcatctgaacaaagaac

SEQ ID NO: 965600 - DNA, 22 bp, Artificial Sequence
  chemically synthesized
caagtttactgttctttgttca

SEQ ID NO: 965601 - DNA, 22 bp, Artificial Sequence
  chemically synthesized
ggtttatatagcatctgaacaa

SEQ ID NO: 965602 - DNA, 22 bp, Artificial Sequence
  chemically synthesized
actgttctttgttcagatgcta

SEQ ID NO: 965603 - DNA, 22 bp, Artificial Sequence
  chemically synthesized
ctgttctttgttcagatgctat

SEQ ID NO: 965604 - DNA, 22 bp, Artificial Sequence
  chemically synthesized
ttctttgttcagatgctatata

SEQ ID NO: 965605 - DNA, 22 bp, Artificial Sequence
  chemically synthesized
gaatgttgggtttatatagcat

SEQ ID NO: 965606 - DNA, 22 bp, Artificial Sequence
  chemically synthesized
tttgttcagatgctatataaac

SEQ ID NO: 965607 - DNA, 22 bp, Artificial Sequence
  chemically synthesized
tgttcagatgctatataaaccc

SEQ ID NO: 965608 - DNA, 22 bp, Artificial Sequence
  chemically synthesized
gttcagatgctatataaaccca

SEQ ID NO: 965609 - DNA, 22 bp, Artificial Sequence
  chemically synthesized
ttcagatgctatataaacccaa

SEQ ID NO: 965610 - DNA, 22 bp, Artificial Sequence
  chemically synthesized
agatgctatataaacccaacat

SEQ ID NO: 965611 - DNA, 22 bp, Artificial Sequence
  chemically synthesized
aaaggggtggttagaatgttgg

SEQ ID NO: 965612 - DNA, 22 bp, Artificial Sequence
  chemically synthesized
tataaacccaacattctaacca

SEQ ID NO: 965613 - DNA, 22 bp, Artificial Sequence
  chemically synthesized
agtgatgagtaactcaaagggg

SEQ ID NO: 965614 - DNA, 22 bp, Artificial Sequence
  chemically synthesized
taaccacccctttgagttactc

SEQ ID NO: 965615 - DNA, 22 bp, Artificial Sequence
  chemically synthesized
accacccctttgagttactcat

SEQ ID NO: 965616 - DNA, 22 bp, Artificial Sequence
  chemically synthesized
gtagaaactcagtgatgagtaa

SEQ ID NO: 965617 - DNA, 22 bp, Artificial Sequence
  chemically synthesized
tgagttactcatcactgagttt

SEQ ID NO: 965618 - DNA, 22 bp, Artificial Sequence
  chemically synthesized
gagttactcatcactgagtttc

SEQ ID NO: 965619 - DNA, 22 bp, Artificial Sequence
  chemically synthesized
agttactcatcactgagtttct

SEQ ID NO: 965620 - DNA, 22 bp, Artificial Sequence
  chemically synthesized
ctcatcactgagtttctaccag

SEQ ID NO: 965621 - DNA, 22 bp, Artificial Sequence
  chemically synthesized
agtgcacatacacctggtagaa

SEQ ID NO: 965622 - DNA, 22 bp, Artificial Sequence
  chemically synthesized
atcactgagtttctaccaggtg

SEQ ID NO: 965623 - DNA, 22 bp, Artificial Sequence
  chemically synthesized
aaatattcagtgcacatacacc

SEQ ID NO: 965624 - DNA, 22 bp, Artificial Sequence
  chemically synthesized
agtttctaccaggtgtatgtgc

SEQ ID NO: 965625 - DNA, 22 bp, Artificial Sequence
  chemically synthesized
ttaaaatattcagtgcacatac

SEQ ID NO: 965626 - DNA, 22 bp, Artificial Sequence
  chemically synthesized
attaaaatattcagtgcacata

SEQ ID NO: 965627 - DNA, 22 bp, Artificial Sequence
  chemically synthesized
ctaccaggtgtatgtgcactga

SEQ ID NO: 965628 - DNA, 22 bp, Artificial Sequence
  chemically synthesized
taccaggtgtatgtgcactgaa

SEQ ID NO: 965629 - DNA, 22 bp, Artificial Sequence
  chemically synthesized
ccaggtgtatgtgcactgaata

SEQ ID NO: 965630 - DNA, 22 bp, Artificial Sequence
  chemically synthesized
gaagtttattaaaatattcagt

SEQ ID NO: 965631 - DNA, 22 bp, Artificial Sequence
  chemically synthesized
aatattttaataaacttctagg

SEQ ID NO: 965632 - DNA, 22 bp, Artificial Sequence
  chemically synthesized
acaagaggaaaagcctagaagt

SEQ ID NO: 965633 - DNA, 22 bp, Artificial Sequence
  chemically synthesized
taataaacttctaggcttttcc

SEQ ID NO: 965634 - DNA, 22 bp, Artificial Sequence
  chemically synthesized
aataaacttctaggcttttcct

SEQ ID NO: 965635 - DNA, 22 bp, Artificial Sequence
  chemically synthesized
ataaacttctaggcttttcctc

SEQ ID NO: 965636 - DNA, 22 bp, Artificial Sequence
  chemically synthesized
ctaggcttttcctcttgttaat

SEQ ID NO: 965637 - DNA, 22 bp, Artificial Sequence
  chemically synthesized
taggcttttcctcttgttaatc

SEQ ID NO: 965638 - DNA, 22 bp, Artificial Sequence
  chemically synthesized
ggcttttcctcttgttaatctg

SEQ ID NO: 965639 - DNA, 22 bp, Artificial Sequence
  chemically synthesized
gagtgacaaaagacagattaac

SEQ ID NO: 965640 - DNA, 22 bp, Artificial Sequence
  chemically synthesized
ttcctcttgttaatctgtcttt

SEQ ID NO: 965641 - DNA, 22 bp, Artificial Sequence
  chemically synthesized
tcctcttgttaatctgtctttt

SEQ ID NO: 965642 - DNA, 22 bp, Artificial Sequence
  chemically synthesized
cctcttgttaatctgtcttttg

SEQ ID NO: 965643 - DNA, 22 bp, Artificial Sequence
  chemically synthesized
ctcttgttaatctgtcttttgt

SEQ ID NO: 965644 - DNA, 22 bp, Artificial Sequence
  chemically synthesized
caaagttagagtgacaaaagac

SEQ ID NO: 965645 - DNA, 22 bp, Artificial Sequence
  chemically synthesized
ttgttaatctgtcttttgtcac

SEQ ID NO: 965646 - DNA, 22 bp, Artificial Sequence
  chemically synthesized
gttaatctgtcttttgtcactc

SEQ ID NO: 965647 - DNA, 22 bp, Artificial Sequence
  chemically synthesized
ttaatctgtcttttgtcactct

SEQ ID NO: 965648 - DNA, 22 bp, Artificial Sequence
  chemically synthesized
atctgtcttttgtcactctaac

SEQ ID NO: 965649 - DNA, 22 bp, Artificial Sequence
  chemically synthesized
gagtcctacaaagttagagtga

SEQ ID NO: 965650 - DNA, 22 bp, Artificial Sequence
  chemically synthesized
tcttttgtcactctaactttgt

SEQ ID NO: 965651 - DNA, 22 bp, Artificial Sequence
  chemically synthesized
cccagctggagtcctacaaagt

SEQ ID NO: 965652 - DNA, 22 bp, Artificial Sequence
  chemically synthesized
ttgtcactctaactttgtagga

SEQ ID NO: 965653 - DNA, 22 bp, Artificial Sequence
  chemically synthesized
tgtcactctaactttgtaggac

SEQ ID NO: 965654 - DNA, 22 bp, Artificial Sequence
  chemically synthesized
gtcactctaactttgtaggact

SEQ ID NO: 965655 - DNA, 22 bp, Artificial Sequence
  chemically synthesized
tcactctaactttgtaggactc

SEQ ID NO: 965656 - DNA, 22 bp, Artificial Sequence
  chemically synthesized
ggctgcccagctggagtcctac

SEQ ID NO: 965657 - DNA, 22 bp, Artificial Sequence
  chemically synthesized
taggctgcccagctggagtcct

SEQ ID NO: 965658 - DNA, 22 bp, Artificial Sequence
  chemically synthesized
ctaggctgcccagctggagtcc

SEQ ID NO: 965659 - DNA, 22 bp, Artificial Sequence
  chemically synthesized
taactttgtaggactccagctg

SEQ ID NO: 965660 - DNA, 22 bp, Artificial Sequence
  chemically synthesized
actttgtaggactccagctggg

SEQ ID NO: 965661 - DNA, 22 bp, Artificial Sequence
  chemically synthesized
cccttctaggctgcccagctgg

SEQ ID NO: 965662 - DNA, 22 bp, Artificial Sequence
  chemically synthesized
tacccttctaggctgcccagct

SEQ ID NO: 965663 - DNA, 22 bp, Artificial Sequence
  chemically synthesized
tgtaggactccagctgggcagc

SEQ ID NO: 965664 - DNA, 22 bp, Artificial Sequence
  chemically synthesized
ctacccttctaggctgcccagc

SEQ ID NO: 965665 - DNA, 22 bp, Artificial Sequence
  chemically synthesized
gtaggactccagctgggcagcc

SEQ ID NO: 965666 - DNA, 22 bp, Artificial Sequence
  chemically synthesized
taggactccagctgggcagcct

SEQ ID NO: 965667 - DNA, 22 bp, Artificial Sequence
  chemically synthesized
cttctacccttctaggctgccc

SEQ ID NO: 965668 - DNA, 22 bp, Artificial Sequence
  chemically synthesized
cagctgggcagcctagaagggt

SEQ ID NO: 965669 - DNA, 22 bp, Artificial Sequence
  chemically synthesized
ggcagcctagaagggtagaagg

SEQ ID NO: 965670 - DNA, 22 bp, Artificial Sequence
  chemically synthesized
gaagggtagaaggaacatattt

SEQ ID NO: 965671 - DNA, 22 bp, Artificial Sequence
  chemically synthesized
tgatgtaggggaagaaaaatat

SEQ ID NO: 965672 - DNA, 22 bp, Artificial Sequence
  chemically synthesized
tgtgatgtaggggaagaaaaat

SEQ ID NO: 965673 - DNA, 22 bp, Artificial Sequence
  chemically synthesized
ttcttcccctacatcacagagc

SEQ ID NO: 965674 - DNA, 22 bp, Artificial Sequence
  chemically synthesized
tcttcccctacatcacagagct

SEQ ID NO: 965675 - DNA, 22 bp, Artificial Sequence
  chemically synthesized
cttcccctacatcacagagctg

SEQ ID NO: 965676 - DNA, 22 bp, Artificial Sequence
  chemically synthesized
ttcccctacatcacagagctgg

SEQ ID NO: 965677 - DNA, 22 bp, Artificial Sequence
  chemically synthesized
cccctacatcacagagctggcc

SEQ ID NO: 965678 - DNA, 22 bp, Artificial Sequence
  chemically synthesized
ccctacatcacagagctggccc

SEQ ID NO: 965679 - DNA, 22 bp, Artificial Sequence
  chemically synthesized
aatgacaagaaggggccagctc

SEQ ID NO: 965680 - DNA, 22 bp, Artificial Sequence
  chemically synthesized
catcacagagctggccccttct

SEQ ID NO: 965681 - DNA, 22 bp, Artificial Sequence
  chemically synthesized
aacagagatctgaatgacaaga

SEQ ID NO: 965682 - DNA, 22 bp, Artificial Sequence
  chemically synthesized
aaacagagatctgaatgacaag

SEQ ID NO: 965683 - DNA, 22 bp, Artificial Sequence
  chemically synthesized
tttaaacagagatctgaatgac

SEQ ID NO: 965684 - DNA, 22 bp, Artificial Sequence
  chemically synthesized
gccccttcttgtcattcagatc

SEQ ID NO: 965685 - DNA, 22 bp, Artificial Sequence
  chemically synthesized
cttgtcattcagatctctgttt

SEQ ID NO: 965686 - DNA, 22 bp, Artificial Sequence
  chemically synthesized
ttgtcattcagatctctgttta

SEQ ID NO: 965687 - DNA, 22 bp, Artificial Sequence
  chemically synthesized
agccatgttatttaaacagaga

SEQ ID NO: 965688 - DNA, 22 bp, Artificial Sequence
  chemically synthesized
gtcattcagatctctgtttaaa

SEQ ID NO: 965689 - DNA, 22 bp, Artificial Sequence
  chemically synthesized
tgagccatgttatttaaacaga

SEQ ID NO: 965690 - DNA, 22 bp, Artificial Sequence
  chemically synthesized
tcattcagatctctgtttaaat

SEQ ID NO: 965691 - DNA, 22 bp, Artificial Sequence
  chemically synthesized
ctgagccatgttatttaaacag

SEQ ID NO: 965692 - DNA, 22 bp, Artificial Sequence
  chemically synthesized
tctgagccatgttatttaaaca

SEQ ID NO: 965693 - DNA, 22 bp, Artificial Sequence
  chemically synthesized
ttctgagccatgttatttaaac

SEQ ID NO: 965694 - DNA, 22 bp, Artificial Sequence
  chemically synthesized
tttctgagccatgttatttaaa

SEQ ID NO: 965695 - DNA, 22 bp, Artificial Sequence
  chemically synthesized
ttttctgagccatgttatttaa

SEQ ID NO: 965696 - DNA, 22 bp, Artificial Sequence
  chemically synthesized
agatctctgtttaaataacatg

SEQ ID NO: 965697 - DNA, 22 bp, Artificial Sequence
  chemically synthesized
tgtttaaataacatggctcaga

SEQ ID NO: 965698 - DNA, 22 bp, Artificial Sequence
  chemically synthesized
tttaaataacatggctcagaaa

SEQ ID NO: 965699 - DNA, 22 bp, Artificial Sequence
  chemically synthesized
aaataacatggctcagaaaaaa

SEQ ID NO: 965700 - DNA, 22 bp, Artificial Sequence
  chemically synthesized
aataacatggctcagaaaaaaa

SEQ ID NO: 965701 - DNA, 22 bp, Artificial Sequence
  chemically synthesized
agaaaaaaatgtccttgcttgg

SEQ ID NO: 965702 - DNA, 22 bp, Artificial Sequence
  chemically synthesized
caggcgtgacccaccaggccca

SEQ ID NO: 965703 - DNA, 22 bp, Artificial Sequence
  chemically synthesized
acaggcgtgacccaccaggccc

SEQ ID NO: 965704 - DNA, 22 bp, Artificial Sequence
  chemically synthesized
ggatttacaggcgtgacccacc

SEQ ID NO: 965705 - DNA, 22 bp, Artificial Sequence
  chemically synthesized
gcttgggcctggtgggtcacgc

SEQ ID NO: 965706 - DNA, 22 bp, Artificial Sequence
  chemically synthesized
cttgggcctggtgggtcacgcc

SEQ ID NO: 965707 - DNA, 22 bp, Artificial Sequence
  chemically synthesized
gggcctggtgggtcacgcctgt

SEQ ID NO: 965708 - DNA, 22 bp, Artificial Sequence
  chemically synthesized
ggcctggtgggtcacgcctgta

SEQ ID NO: 965709 - DNA, 22 bp, Artificial Sequence
  chemically synthesized
ccaaagtgctgggatttacagg

SEQ ID NO: 965710 - DNA, 22 bp, Artificial Sequence
  chemically synthesized
gtgggtcacgcctgtaaatccc

SEQ ID NO: 965711 - DNA, 22 bp, Artificial Sequence
  chemically synthesized
agcctcccaaagtgctgggatt

SEQ ID NO: 965712 - DNA, 22 bp, Artificial Sequence
  chemically synthesized
taaatcccagcactttgggagg

SEQ ID NO: 965713 - DNA, 22 bp, Artificial Sequence
  chemically synthesized
aagcgatccacccgcctcagcc

SEQ ID NO: 965714 - DNA, 22 bp, Artificial Sequence
  chemically synthesized
acctcaagcgatccacccgcct

SEQ ID NO: 965715 - DNA, 22 bp, Artificial Sequence
  chemically synthesized
tgggaggctgaggcgggtggat

SEQ ID NO: 965716 - DNA, 22 bp, Artificial Sequence
  chemically synthesized
tgacctcaagcgatccacccgc

SEQ ID NO: 965717 - DNA, 22 bp, Artificial Sequence
  chemically synthesized
gggaggctgaggcgggtggatc

SEQ ID NO: 965718 - DNA, 22 bp, Artificial Sequence
  chemically synthesized
ctgacctcaagcgatccacccg

SEQ ID NO: 965719 - DNA, 22 bp, Artificial Sequence
  chemically synthesized
ggaggctgaggcgggtggatcg

SEQ ID NO: 965720 - DNA, 22 bp, Artificial Sequence
  chemically synthesized
aaacttctgacctcaagcgatc

SEQ ID NO: 965721 - DNA, 22 bp, Artificial Sequence
  chemically synthesized
aggcgggtggatcgcttgaggt

SEQ ID NO: 965722 - DNA, 22 bp, Artificial Sequence
  chemically synthesized
gtctcaaacttctgacctcaag

SEQ ID NO: 965723 - DNA, 22 bp, Artificial Sequence
  chemically synthesized
cccaggctggtctcaaacttct

SEQ ID NO: 965724 - DNA, 22 bp, Artificial Sequence
  chemically synthesized
gaggtcagaagtttgagaccag

SEQ ID NO: 965725 - DNA, 22 bp, Artificial Sequence
  chemically synthesized
aggtcagaagtttgagaccagc

SEQ ID NO: 965726 - DNA, 22 bp, Artificial Sequence
  chemically synthesized
accatgttgcccaggctggtct

SEQ ID NO: 965727 - DNA, 22 bp, Artificial Sequence
  chemically synthesized
gaccatgttgcccaggctggtc

SEQ ID NO: 965728 - DNA, 22 bp, Artificial Sequence
  chemically synthesized
gagaccagcctgggcaacatgg

SEQ ID NO: 965729 - DNA, 22 bp, Artificial Sequence
  chemically synthesized
agaccagcctgggcaacatggt

SEQ ID NO: 965730 - DNA, 22 bp, Artificial Sequence
  chemically synthesized
gtagagatggggtttgaccatg

SEQ ID NO: 965731 - DNA, 22 bp, Artificial Sequence
  chemically synthesized
agtagagatggggtttgaccat

SEQ ID NO: 965732 - DNA, 22 bp, Artificial Sequence
  chemically synthesized
tagtagagatggggtttgacca

SEQ ID NO: 965733 - DNA, 22 bp, Artificial Sequence
  chemically synthesized
ttagtagagatggggtttgacc

SEQ ID NO: 965734 - DNA, 22 bp, Artificial Sequence
  chemically synthesized
ggcaacatggtcaaaccccatc

SEQ ID NO: 965735 - DNA, 22 bp, Artificial Sequence
  chemically synthesized
tatttttagtagagatggggtt

SEQ ID NO: 965736 - DNA, 22 bp, Artificial Sequence
  chemically synthesized
gtatttttagtagagatggggt

SEQ ID NO: 965737 - DNA, 22 bp, Artificial Sequence
  chemically synthesized
tgtatttttagtagagatgggg

SEQ ID NO: 965738 - DNA, 22 bp, Artificial Sequence
  chemically synthesized
ttgtatttttagtagagatggg

SEQ ID NO: 965739 - DNA, 22 bp, Artificial Sequence
  chemically synthesized
atttttgtatttttagtagaga

SEQ ID NO: 965740 - DNA, 22 bp, Artificial Sequence
  chemically synthesized
tactaaaaatacaaaaatcagc

SEQ ID NO: 965741 - DNA, 22 bp, Artificial Sequence
  chemically synthesized
ctaaaaatacaaaaatcagctg

SEQ ID NO: 965742 - DNA, 22 bp, Artificial Sequence
  chemically synthesized
aaaatacaaaaatcagctgggc

SEQ ID NO: 965743 - DNA, 22 bp, Artificial Sequence
  chemically synthesized
gaggcatgcaccaccaggccca

SEQ ID NO: 965744 - DNA, 22 bp, Artificial Sequence
  chemically synthesized
ggactagaggcatgcaccacca

SEQ ID NO: 965745 - DNA, 22 bp, Artificial Sequence
  chemically synthesized
ggcctggtggtgcatgcctcta

SEQ ID NO: 965746 - DNA, 22 bp, Artificial Sequence
  chemically synthesized
ccaaataactgggactagaggc

SEQ ID NO: 965747 - DNA, 22 bp, Artificial Sequence
  chemically synthesized
gtggtgcatgcctctagtccca

SEQ ID NO: 965748 - DNA, 22 bp, Artificial Sequence
  chemically synthesized
cgcctcccaaataactgggact

SEQ ID NO: 965749 - DNA, 22 bp, Artificial Sequence
  chemically synthesized
gtgtgcctccgcctcccaaata

SEQ ID NO: 965750 - DNA, 22 bp, Artificial Sequence
  chemically synthesized
cgtgtgcctccgcctcccaaat

SEQ ID NO: 965751 - DNA, 22 bp, Artificial Sequence
  chemically synthesized
tagtcccagttatttgggaggc

SEQ ID NO: 965752 - DNA, 22 bp, Artificial Sequence
  chemically synthesized
tcgtgtgcctccgcctcccaaa

SEQ ID NO: 965753 - DNA, 22 bp, Artificial Sequence
  chemically synthesized
ttcgtgtgcctccgcctcccaa

SEQ ID NO: 965754 - DNA, 22 bp, Artificial Sequence
  chemically synthesized
gtcccagttatttgggaggcgg

SEQ ID NO: 965755 - DNA, 22 bp, Artificial Sequence
  chemically synthesized
aagcttttcgtgtgcctccgcc

SEQ ID NO: 965756 - DNA, 22 bp, Artificial Sequence
  chemically synthesized
tttgggaggcggaggcacacga

SEQ ID NO: 965757 - DNA, 22 bp, Artificial Sequence
  chemically synthesized
gggaggcggaggcacacgaaaa

SEQ ID NO: 965758 - DNA, 22 bp, Artificial Sequence
  chemically synthesized
ccatgttcaagcttttcgtgtg

SEQ ID NO: 965759 - DNA, 22 bp, Artificial Sequence
  chemically synthesized
ggaggcggaggcacacgaaaag

SEQ ID NO: 965760 - DNA, 22 bp, Artificial Sequence
  chemically synthesized
cctcccatgttcaagcttttcg

SEQ ID NO: 965761 - DNA, 22 bp, Artificial Sequence
  chemically synthesized
tgcctcccatgttcaagctttt

SEQ ID NO: 965762 - DNA, 22 bp, Artificial Sequence
  chemically synthesized
caacctctgcctcccatgttca

SEQ ID NO: 965763 - DNA, 22 bp, Artificial Sequence
  chemically synthesized
actgcaacctctgcctcccatg

SEQ ID NO: 965764 - DNA, 22 bp, Artificial Sequence
  chemically synthesized
agctcactgcaacctctgcctc

SEQ ID NO: 965765 - DNA, 22 bp, Artificial Sequence
  chemically synthesized
gaacatgggaggcagaggttgc

SEQ ID NO: 965766 - DNA, 22 bp, Artificial Sequence
  chemically synthesized
aacatgggaggcagaggttgca

SEQ ID NO: 965767 - DNA, 22 bp, Artificial Sequence
  chemically synthesized
gagcgcagtggtgcaatctcag

SEQ ID NO: 965768 - DNA, 22 bp, Artificial Sequence
  chemically synthesized
cagtgagctgagattgcaccac

SEQ ID NO: 965769 - DNA, 22 bp, Artificial Sequence
  chemically synthesized
cccaggctggagcgcagtggtg

SEQ ID NO: 965770 - DNA, 22 bp, Artificial Sequence
  chemically synthesized
ttgcccaggctggagcgcagtg

SEQ ID NO: 965771 - DNA, 22 bp, Artificial Sequence
  chemically synthesized
tgttgcccaggctggagcgcag

SEQ ID NO: 965772 - DNA, 22 bp, Artificial Sequence
  chemically synthesized
agattgcaccactgcgctccag

SEQ ID NO: 965773 - DNA, 22 bp, Artificial Sequence
  chemically synthesized
ctctgttgcccaggctggagcg

SEQ ID NO: 965774 - DNA, 22 bp, Artificial Sequence
  chemically synthesized
gctctgttgcccaggctggagc

SEQ ID NO: 965775 - DNA, 22 bp, Artificial Sequence
  chemically synthesized
caccactgcgctccagcctggg

SEQ ID NO: 965776 - DNA, 22 bp, Artificial Sequence
  chemically synthesized
ggagtcttgctctgttgcccag

SEQ ID NO: 965777 - DNA, 22 bp, Artificial Sequence
  chemically synthesized
cggagtcttgctctgttgccca

SEQ ID NO: 965778 - DNA, 22 bp, Artificial Sequence
  chemically synthesized
tcggagtcttgctctgttgccc

SEQ ID NO: 965779 - DNA, 22 bp, Artificial Sequence
  chemically synthesized
cgctccagcctgggcaacagag

SEQ ID NO: 965780 - DNA, 22 bp, Artificial Sequence
  chemically synthesized
cctttcggagtcttgctctgtt

SEQ ID NO: 965781 - DNA, 22 bp, Artificial Sequence
  chemically synthesized
cagcctgggcaacagagcaaga

SEQ ID NO: 965782 - DNA, 22 bp, Artificial Sequence
  chemically synthesized
tgcctttcggagtcttgctctg

SEQ ID NO: 965783 - DNA, 22 bp, Artificial Sequence
  chemically synthesized
ctgcctttcggagtcttgctct

SEQ ID NO: 965784 - DNA, 22 bp, Artificial Sequence
  chemically synthesized
tctgcctttcggagtcttgctc

SEQ ID NO: 965785 - DNA, 22 bp, Artificial Sequence
  chemically synthesized
tttctgcctttcggagtcttgc

SEQ ID NO: 965786 - DNA, 22 bp, Artificial Sequence
  chemically synthesized
ctttctgcctttcggagtcttg

SEQ ID NO: 965787 - DNA, 22 bp, Artificial Sequence
  chemically synthesized
tctttctgcctttcggagtctt

SEQ ID NO: 965788 - DNA, 22 bp, Artificial Sequence
  chemically synthesized
ggcaacagagcaagactccgaa

SEQ ID NO: 965789 - DNA, 22 bp, Artificial Sequence
  chemically synthesized
ttctttctgcctttcggagtct

SEQ ID NO: 965790 - DNA, 22 bp, Artificial Sequence
  chemically synthesized
tttctttctgcctttcggagtc

SEQ ID NO: 965791 - DNA, 22 bp, Artificial Sequence
  chemically synthesized
tttttctttctgcctttcggag

SEQ ID NO: 965792 - DNA, 22 bp, Artificial Sequence
  chemically synthesized
ctttttctttctgcctttcgga

SEQ ID NO: 965793 - DNA, 22 bp, Artificial Sequence
  chemically synthesized
tctttttctttctgcctttcgg

SEQ ID NO: 965794 - DNA, 22 bp, Artificial Sequence
  chemically synthesized
tttctttttctttctgcctttc

SEQ ID NO: 965795 - DNA, 22 bp, Artificial Sequence
  chemically synthesized
ctttctttttctttctgccttt

SEQ ID NO: 965796 - DNA, 22 bp, Artificial Sequence
  chemically synthesized
tctttctttttctttctgcctt

SEQ ID NO: 965797 - DNA, 22 bp, Artificial Sequence
  chemically synthesized
ttctttctttttctttctgcct

SEQ ID NO: 965798 - DNA, 22 bp, Artificial Sequence
  chemically synthesized
ttttctttctttttctttctgc

SEQ ID NO: 965799 - DNA, 22 bp, Artificial Sequence
  chemically synthesized
cttttctttctttttctttctg

SEQ ID NO: 965800 - DNA, 22 bp, Artificial Sequence
  chemically synthesized
tcttttctttctttttctttct

SEQ ID NO: 965801 - DNA, 22 bp, Artificial Sequence
  chemically synthesized
tttcttttctttctttttcttt

SEQ ID NO: 965802 - DNA, 22 bp, Artificial Sequence
  chemically synthesized
ctttcttttctttctttttctt

SEQ ID NO: 965803 - DNA, 22 bp, Artificial Sequence
  chemically synthesized
cgaaaggcagaaagaaaaagaa

SEQ ID NO: 965804 - DNA, 22 bp, Artificial Sequence
  chemically synthesized
tctttcttttctttctttttct

SEQ ID NO: 965805 - DNA, 22 bp, Artificial Sequence
  chemically synthesized
ttctttcttttctttctttttc

SEQ ID NO: 965806 - DNA, 22 bp, Artificial Sequence
  chemically synthesized
tttctttcttttctttcttttt

SEQ ID NO: 965807 - DNA, 22 bp, Artificial Sequence
  chemically synthesized
tttttctttcttttctttcttt

SEQ ID NO: 965808 - DNA, 22 bp, Artificial Sequence
  chemically synthesized
ctttttctttcttttctttctt

SEQ ID NO: 965809 - DNA, 22 bp, Artificial Sequence
  chemically synthesized
tctttttctttcttttctttct

SEQ ID NO: 965810 - DNA, 22 bp, Artificial Sequence
  chemically synthesized
ttctttttctttcttttctttc

SEQ ID NO: 965811 - DNA, 22 bp, Artificial Sequence
  chemically synthesized
tttctttttctttcttttcttt

SEQ ID NO: 965812 - DNA, 22 bp, Artificial Sequence
  chemically synthesized
tttttctttttctttcttttct

SEQ ID NO: 965813 - DNA, 22 bp, Artificial Sequence
  chemically synthesized
ctttttctttttctttcttttc

SEQ ID NO: 965814 - DNA, 22 bp, Artificial Sequence
  chemically synthesized
tctttttctttttctttctttt

SEQ ID NO: 965815 - DNA, 22 bp, Artificial Sequence
  chemically synthesized
ttctttttctttttctttcttt

SEQ ID NO: 965816 - DNA, 22 bp, Artificial Sequence
  chemically synthesized
tttctttttctttttctttctt

SEQ ID NO: 965817 - DNA, 22 bp, Artificial Sequence
  chemically synthesized
ttttctttttctttttctttct

SEQ ID NO: 965818 - DNA, 22 bp, Artificial Sequence
  chemically synthesized
tttttctttttctttttctttc

SEQ ID NO: 965819 - DNA, 22 bp, Artificial Sequence
  chemically synthesized
ttttttctttttctttttcttt

SEQ ID NO: 965820 - DNA, 22 bp, Artificial Sequence
  chemically synthesized
ttttttttctttttctttttct

SEQ ID NO: 965821 - DNA, 22 bp, Artificial Sequence
  chemically synthesized
cttttttttctttttctttttc

SEQ ID NO: 965822 - DNA, 22 bp, Artificial Sequence
  chemically synthesized
tcttttttttctttttcttttt

SEQ ID NO: 965823 - DNA, 22 bp, Artificial Sequence
  chemically synthesized
tttcttttttttctttttcttt

SEQ ID NO: 965824 - DNA, 22 bp, Artificial Sequence
  chemically synthesized
cctctttcttttttttcttttt

SEQ ID NO: 965825 - DNA, 22 bp, Artificial Sequence
  chemically synthesized
cctccctctttcttttttttct

SEQ ID NO: 965826 - DNA, 22 bp, Artificial Sequence
  chemically synthesized
ccctccctccctctttcttttt

SEQ ID NO: 965827 - DNA, 22 bp, Artificial Sequence
  chemically synthesized
cccctccctccctctttctttt

SEQ ID NO: 965828 - DNA, 22 bp, Artificial Sequence
  chemically synthesized
tcccctccctccctctttcttt

SEQ ID NO: 965829 - DNA, 22 bp, Artificial Sequence
  chemically synthesized
ttcccctccctccctctttctt

SEQ ID NO: 965830 - DNA, 22 bp, Artificial Sequence
  chemically synthesized
tttcccctccctccctctttct

SEQ ID NO: 965831 - DNA, 22 bp, Artificial Sequence
  chemically synthesized
ttttcccctccctccctctttc

SEQ ID NO: 965832 - DNA, 22 bp, Artificial Sequence
  chemically synthesized
tttttcccctccctccctcttt

SEQ ID NO: 965833 - DNA, 22 bp, Artificial Sequence
  chemically synthesized
ttttttcccctccctccctctt

SEQ ID NO: 965834 - DNA, 22 bp, Artificial Sequence
  chemically synthesized
tttttttcccctccctccctct

SEQ ID NO: 965835 - DNA, 22 bp, Artificial Sequence
  chemically synthesized
tttttttttcccctccctccct

SEQ ID NO: 965836 - DNA, 22 bp, Artificial Sequence
  chemically synthesized
ctttttttttcccctccctccc

SEQ ID NO: 965837 - DNA, 22 bp, Artificial Sequence
  chemically synthesized
tctttttttttcccctccctcc

SEQ ID NO: 965838 - DNA, 22 bp, Artificial Sequence
  chemically synthesized
ttctttttttttcccctccctc

SEQ ID NO: 965839 - DNA, 22 bp, Artificial Sequence
  chemically synthesized
tttctttttttttcccctccct

SEQ ID NO: 965840 - DNA, 22 bp, Artificial Sequence
  chemically synthesized
ttttctttttttttcccctccc

SEQ ID NO: 965841 - DNA, 22 bp, Artificial Sequence
  chemically synthesized
ggacatttttttcttttttttt

SEQ ID NO: 965842 - DNA, 22 bp, Artificial Sequence
  chemically synthesized
agaatatctaggacattttttt

SEQ ID NO: 965843 - DNA, 22 bp, Artificial Sequence
  chemically synthesized
gttcagaatatctaggacattt

SEQ ID NO: 965844 - DNA, 22 bp, Artificial Sequence
  chemically synthesized
ggttcagaatatctaggacatt

SEQ ID NO: 965845 - DNA, 22 bp, Artificial Sequence
  chemically synthesized
tggttcagaatatctaggacat

SEQ ID NO: 965846 - DNA, 22 bp, Artificial Sequence
  chemically synthesized
tgacaggatgaccactttggtt

SEQ ID NO: 965847 - DNA, 22 bp, Artificial Sequence
  chemically synthesized
gatattctgaaccaaagtggtc

SEQ ID NO: 965848 - DNA, 22 bp, Artificial Sequence
  chemically synthesized
cagattgtgacaggatgaccac

SEQ ID NO: 965849 - DNA, 22 bp, Artificial Sequence
  chemically synthesized
tgaaccaaagtggtcatcctgt

SEQ ID NO: 965850 - DNA, 22 bp, Artificial Sequence
  chemically synthesized
aaccaaagtggtcatcctgtca

SEQ ID NO: 965851 - DNA, 22 bp, Artificial Sequence
  chemically synthesized
aaatggggtaaaattacagatt

SEQ ID NO: 965852 - DNA, 22 bp, Artificial Sequence
  chemically synthesized
aaaatggggtaaaattacagat

SEQ ID NO: 965853 - DNA, 22 bp, Artificial Sequence
  chemically synthesized
taaaatggggtaaaattacaga

SEQ ID NO: 965854 - DNA, 22 bp, Artificial Sequence
  chemically synthesized
tcacaatctgtaattttacccc

SEQ ID NO: 965855 - DNA, 22 bp, Artificial Sequence
  chemically synthesized
taattttaccccattttaaagt

SEQ ID NO: 965856 - DNA, 22 bp, Artificial Sequence
  chemically synthesized
taccccattttaaagtctcttt

SEQ ID NO: 965857 - DNA, 22 bp, Artificial Sequence
  chemically synthesized
gaaaatatacataaagagactt

SEQ ID NO: 965858 - DNA, 22 bp, Artificial Sequence
  chemically synthesized
accccattttaaagtctcttta

SEQ ID NO: 965859 - DNA, 22 bp, Artificial Sequence
  chemically synthesized
ccccattttaaagtctctttat

SEQ ID NO: 965860 - DNA, 22 bp, Artificial Sequence
  chemically synthesized
taaagtctctttatgtatattt

SEQ ID NO: 965861 - DNA, 22 bp, Artificial Sequence
  chemically synthesized
aaagtctctttatgtatatttt

SEQ ID NO: 965862 - DNA, 22 bp, Artificial Sequence
  chemically synthesized
aagtctctttatgtatattttc

SEQ ID NO: 965863 - DNA, 22 bp, Artificial Sequence
  chemically synthesized
tttatgtatattttctagttat

SEQ ID NO: 965864 - DNA, 22 bp, Artificial Sequence
  chemically synthesized
tatgtatattttctagttattt

SEQ ID NO: 965865 - DNA, 22 bp, Artificial Sequence
  chemically synthesized
atgtatattttctagttatttt

SEQ ID NO: 965866 - DNA, 22 bp, Artificial Sequence
  chemically synthesized
tgtatattttctagttattttg

SEQ ID NO: 965867 - DNA, 22 bp, Artificial Sequence
  chemically synthesized
acaggagacagaaaacaaaata

SEQ ID NO: 965868 - DNA, 22 bp, Artificial Sequence
  chemically synthesized
tcacaggagacagaaaacaaaa

SEQ ID NO: 965869 - DNA, 22 bp, Artificial Sequence
  chemically synthesized
tctcacaggagacagaaaacaa

SEQ ID NO: 965870 - DNA, 22 bp, Artificial Sequence
  chemically synthesized
tctagttattttgttttctgtc

SEQ ID NO: 965871 - DNA, 22 bp, Artificial Sequence
  chemically synthesized
ctagttattttgttttctgtct

SEQ ID NO: 965872 - DNA, 22 bp, Artificial Sequence
  chemically synthesized
tagttattttgttttctgtctc

SEQ ID NO: 965873 - DNA, 22 bp, Artificial Sequence
  chemically synthesized
cattctctcacaggagacagaa

SEQ ID NO: 965874 - DNA, 22 bp, Artificial Sequence
  chemically synthesized
gttattttgttttctgtctcct

SEQ ID NO: 965875 - DNA, 22 bp, Artificial Sequence
  chemically synthesized
ttttgttttctgtctcctgtga

SEQ ID NO: 965876 - DNA, 22 bp, Artificial Sequence
  chemically synthesized
tgttttctgtctcctgtgagag

SEQ ID NO: 965877 - DNA, 22 bp, Artificial Sequence
  chemically synthesized
gttttctgtctcctgtgagaga

SEQ ID NO: 965878 - DNA, 22 bp, Artificial Sequence
  chemically synthesized
ttttctgtctcctgtgagagaa

SEQ ID NO: 965879 - DNA, 22 bp, Artificial Sequence
  chemically synthesized
tctgtctcctgtgagagaatgt

SEQ ID NO: 965880 - DNA, 22 bp, Artificial Sequence
  chemically synthesized
ctgtctcctgtgagagaatgta

SEQ ID NO: 965881 - DNA, 22 bp, Artificial Sequence
  chemically synthesized
tgtctcctgtgagagaatgtaa

SEQ ID NO: 965882 - DNA, 22 bp, Artificial Sequence
  chemically synthesized
tctcctgtgagagaatgtaata

SEQ ID NO: 965883 - DNA, 22 bp, Artificial Sequence
  chemically synthesized
tatcgacatggatattacattc

SEQ ID NO: 965884 - DNA, 22 bp, Artificial Sequence
  chemically synthesized
gtatcgacatggatattacatt

SEQ ID NO: 965885 - DNA, 22 bp, Artificial Sequence
  chemically synthesized
ctgtgagagaatgtaatatcca

SEQ ID NO: 965886 - DNA, 22 bp, Artificial Sequence
  chemically synthesized
tgagagaatgtaatatccatgt

SEQ ID NO: 965887 - DNA, 22 bp, Artificial Sequence
  chemically synthesized
acaatcaagatatgatttgtat

SEQ ID NO: 965888 - DNA, 22 bp, Artificial Sequence
  chemically synthesized
agcaattaacaatcaagatatg

SEQ ID NO: 965889 - DNA, 22 bp, Artificial Sequence
  chemically synthesized
cagcaattaacaatcaagatat

SEQ ID NO: 965890 - DNA, 22 bp, Artificial Sequence
  chemically synthesized
ggatttcagcaattaacaatca

SEQ ID NO: 965891 - DNA, 22 bp, Artificial Sequence
  chemically synthesized
ggcgcactgggatttcagcaat

SEQ ID NO: 965892 - DNA, 22 bp, Artificial Sequence
  chemically synthesized
gggcgcactgggatttcagcaa

SEQ ID NO: 965893 - DNA, 22 bp, Artificial Sequence
  chemically synthesized
tgggcgcactgggatttcagca

SEQ ID NO: 965894 - DNA, 22 bp, Artificial Sequence
  chemically synthesized
gattgttaattgctgaaatccc

SEQ ID NO: 965895 - DNA, 22 bp, Artificial Sequence
  chemically synthesized
attgttaattgctgaaatccca

SEQ ID NO: 965896 - DNA, 22 bp, Artificial Sequence
  chemically synthesized
ttaattgctgaaatcccagtgc

SEQ ID NO: 965897 - DNA, 22 bp, Artificial Sequence
  chemically synthesized
attgctgaaatcccagtgcgcc

SEQ ID NO: 965898 - DNA, 22 bp, Artificial Sequence
  chemically synthesized
ctgaaatcccagtgcgcccaaa

SEQ ID NO: 965899 - DNA, 22 bp, Artificial Sequence
  chemically synthesized
caggacgtgcaattttgggcgc

SEQ ID NO: 965900 - DNA, 22 bp, Artificial Sequence
  chemically synthesized
aaatcccagtgcgcccaaaatt

SEQ ID NO: 965901 - DNA, 22 bp, Artificial Sequence
  chemically synthesized
ttacaggacgtgcaattttggg

SEQ ID NO: 965902 - DNA, 22 bp, Artificial Sequence
  chemically synthesized
tcaaacacctattacaggacgt

SEQ ID NO: 965903 - DNA, 22 bp, Artificial Sequence
  chemically synthesized
atcaaacacctattacaggacg

SEQ ID NO: 965904 - DNA, 22 bp, Artificial Sequence
  chemically synthesized
cacgtcctgtaataggtgtttg

SEQ ID NO: 965905 - DNA, 22 bp, Artificial Sequence
  chemically synthesized
aacaaaagtttatcaaacacct

SEQ ID NO: 965906 - DNA, 22 bp, Artificial Sequence
  chemically synthesized
agaattcaacaaaagtttatca

SEQ ID NO: 965907 - DNA, 22 bp, Artificial Sequence
  chemically synthesized
taataggtgtttgataaacttt

SEQ ID NO: 965908 - DNA, 22 bp, Artificial Sequence
  chemically synthesized
acattcagaattcaacaaaagt

SEQ ID NO: 965909 - DNA, 22 bp, Artificial Sequence
  chemically synthesized
aacattcagaattcaacaaaag

SEQ ID NO: 965910 - DNA, 22 bp, Artificial Sequence
  chemically synthesized
gataaacttttgttgaattctg

SEQ ID NO: 965911 - DNA, 22 bp, Artificial Sequence
  chemically synthesized
ataaacttttgttgaattctga

SEQ ID NO: 965912 - DNA, 22 bp, Artificial Sequence
  chemically synthesized
tcaaagggtttaacattcagaa

SEQ ID NO: 965913 - DNA, 22 bp, Artificial Sequence
  chemically synthesized
gtcaaagggtttaacattcaga

SEQ ID NO: 965914 - DNA, 22 bp, Artificial Sequence
  chemically synthesized
ttgttgaattctgaatgttaaa

SEQ ID NO: 965915 - DNA, 22 bp, Artificial Sequence
  chemically synthesized
tgttgaattctgaatgttaaac

SEQ ID NO: 965916 - DNA, 22 bp, Artificial Sequence
  chemically synthesized
gttgaattctgaatgttaaacc

SEQ ID NO: 965917 - DNA, 22 bp, Artificial Sequence
  chemically synthesized
ttgaattctgaatgttaaaccc

SEQ ID NO: 965918 - DNA, 22 bp, Artificial Sequence
  chemically synthesized
aattctgaatgttaaacccttt

SEQ ID NO: 965919 - DNA, 22 bp, Artificial Sequence
  chemically synthesized
tgaatgttaaaccctttgacaa

SEQ ID NO: 965920 - DNA, 22 bp, Artificial Sequence
  chemically synthesized
aatgttaaaccctttgacaagt

SEQ ID NO: 965921 - DNA, 22 bp, Artificial Sequence
  chemically synthesized
atcatgtcaggtcacttgtcaa

SEQ ID NO: 965922 - DNA, 22 bp, Artificial Sequence
  chemically synthesized
ttcatcatgtcaggtcacttgt

SEQ ID NO: 965923 - DNA, 22 bp, Artificial Sequence
  chemically synthesized
attcatcatgtcaggtcacttg

SEQ ID NO: 965924 - DNA, 22 bp, Artificial Sequence
  chemically synthesized
tattcatcatgtcaggtcactt

SEQ ID NO: 965925 - DNA, 22 bp, Artificial Sequence
  chemically synthesized
aaccctttgacaagtgacctga

SEQ ID NO: 965926 - DNA, 22 bp, Artificial Sequence
  chemically synthesized
ttattcatcatgtcaggtcact

SEQ ID NO: 965927 - DNA, 22 bp, Artificial Sequence
  chemically synthesized
tgacaagtgacctgacatgatg

SEQ ID NO: 965928 - DNA, 22 bp, Artificial Sequence
  chemically synthesized
taagtttttattcatcatgtca

SEQ ID NO: 965929 - DNA, 22 bp, Artificial Sequence
  chemically synthesized
gacaagtgacctgacatgatga

SEQ ID NO: 965930 - DNA, 22 bp, Artificial Sequence
  chemically synthesized
acaagtgacctgacatgatgaa

SEQ ID NO: 965931 - DNA, 22 bp, Artificial Sequence
  chemically synthesized
aaccctataagtttttattcat

SEQ ID NO: 965932 - DNA, 22 bp, Artificial Sequence
  chemically synthesized
aaaccctataagtttttattca

SEQ ID NO: 965933 - DNA, 22 bp, Artificial Sequence
  chemically synthesized
acatgatgaataaaaacttata

SEQ ID NO: 965934 - DNA, 22 bp, Artificial Sequence
  chemically synthesized
atccttaaaccctataagtttt

SEQ ID NO: 965935 - DNA, 22 bp, Artificial Sequence
  chemically synthesized
aatccttaaaccctataagttt

SEQ ID NO: 965936 - DNA, 22 bp, Artificial Sequence
  chemically synthesized
taatccttaaaccctataagtt

SEQ ID NO: 965937 - DNA, 22 bp, Artificial Sequence
  chemically synthesized
ttaatccttaaaccctataagt

SEQ ID NO: 965938 - DNA, 22 bp, Artificial Sequence
  chemically synthesized
tttaatccttaaaccctataag

SEQ ID NO: 965939 - DNA, 22 bp, Artificial Sequence
  chemically synthesized
tggaaattttttaatccttaaa

SEQ ID NO: 965940 - DNA, 22 bp, Artificial Sequence
  chemically synthesized
atggaaattttttaatccttaa

SEQ ID NO: 965941 - DNA, 22 bp, Artificial Sequence
  chemically synthesized
tatggaaattttttaatcctta

SEQ ID NO: 965942 - DNA, 22 bp, Artificial Sequence
  chemically synthesized
tttatggaaattttttaatcct

SEQ ID NO: 965943 - DNA, 22 bp, Artificial Sequence
  chemically synthesized
atagggtttaaggattaaaaaa

SEQ ID NO: 965944 - DNA, 22 bp, Artificial Sequence
  chemically synthesized
tagggtttaaggattaaaaaat

SEQ ID NO: 965945 - DNA, 22 bp, Artificial Sequence
  chemically synthesized
aaggattaaaaaatttccataa

SEQ ID NO: 965946 - DNA, 22 bp, Artificial Sequence
  chemically synthesized
aggattaaaaaatttccataaa

SEQ ID NO: 965947 - DNA, 22 bp, Artificial Sequence
  chemically synthesized
agtaaacaattctttatggaaa

SEQ ID NO: 965948 - DNA, 22 bp, Artificial Sequence
  chemically synthesized
aaaaatttccataaagaattgt

SEQ ID NO: 965949 - DNA, 22 bp, Artificial Sequence
  chemically synthesized
tgaattaagtaaacaattcttt

SEQ ID NO: 965950 - DNA, 22 bp, Artificial Sequence
  chemically synthesized
gccattgtgaattaagtaaaca

SEQ ID NO: 965951 - DNA, 22 bp, Artificial Sequence
  chemically synthesized
ccataaagaattgtttacttaa

SEQ ID NO: 965952 - DNA, 22 bp, Artificial Sequence
  chemically synthesized
cataaagaattgtttacttaat

SEQ ID NO: 965953 - DNA, 22 bp, Artificial Sequence
  chemically synthesized
gcaagtcctagccattgtgaat

SEQ ID NO: 965954 - DNA, 22 bp, Artificial Sequence
  chemically synthesized
tttacttaattcacaatggcta

SEQ ID NO: 965955 - DNA, 22 bp, Artificial Sequence
  chemically synthesized
acttaattcacaatggctagga

SEQ ID NO: 965956 - DNA, 22 bp, Artificial Sequence
  chemically synthesized
cttaattcacaatggctaggac

SEQ ID NO: 965957 - DNA, 22 bp, Artificial Sequence
  chemically synthesized
tacccattggcaagtcctagcc

SEQ ID NO: 965958 - DNA, 22 bp, Artificial Sequence
  chemically synthesized
aattcacaatggctaggacttg

SEQ ID NO: 965959 - DNA, 22 bp, Artificial Sequence
  chemically synthesized
tatacccattggcaagtcctag

SEQ ID NO: 965960 - DNA, 22 bp, Artificial Sequence
  chemically synthesized
attcacaatggctaggacttgc

SEQ ID NO: 965961 - DNA, 22 bp, Artificial Sequence
  chemically synthesized
acaatggctaggacttgccaat

SEQ ID NO: 965962 - DNA, 22 bp, Artificial Sequence
  chemically synthesized
gtggcctctatacccattggca

SEQ ID NO: 965963 - DNA, 22 bp, Artificial Sequence
  chemically synthesized
tggtggcctctatacccattgg

SEQ ID NO: 965964 - DNA, 22 bp, Artificial Sequence
  chemically synthesized
ctggtggcctctatacccattg

SEQ ID NO: 965965 - DNA, 22 bp, Artificial Sequence
  chemically synthesized
ggacttgccaatgggtatagag

SEQ ID NO: 965966 - DNA, 22 bp, Artificial Sequence
  chemically synthesized
accagtttctggtggcctctat

SEQ ID NO: 965967 - DNA, 22 bp, Artificial Sequence
  chemically synthesized
gccaatgggtatagaggccacc

SEQ ID NO: 965968 - DNA, 22 bp, Artificial Sequence
  chemically synthesized
ccaatgggtatagaggccacca

SEQ ID NO: 965969 - DNA, 22 bp, Artificial Sequence
  chemically synthesized
aaaaatagttcaccagtttctg

SEQ ID NO: 965970 - DNA, 22 bp, Artificial Sequence
  chemically synthesized
aaaaaatagttcaccagtttct

SEQ ID NO: 965971 - DNA, 22 bp, Artificial Sequence
  chemically synthesized
taaaaaatagttcaccagtttc

SEQ ID NO: 965972 - DNA, 22 bp, Artificial Sequence
  chemically synthesized
tgagattttaaaaaatagttca

SEQ ID NO: 965973 - DNA, 22 bp, Artificial Sequence
  chemically synthesized
tattatgagattttaaaaaata

SEQ ID NO: 965974 - DNA, 22 bp, Artificial Sequence
  chemically synthesized
atattatgagattttaaaaaat

SEQ ID NO: 965975 - DNA, 22 bp, Artificial Sequence
  chemically synthesized
ttatattatgagattttaaaaa

SEQ ID NO: 965976 - DNA, 22 bp, Artificial Sequence
  chemically synthesized
gtgaactattttttaaaatctc

SEQ ID NO: 965977 - DNA, 22 bp, Artificial Sequence
  chemically synthesized
ctcttatattatgagattttaa

SEQ ID NO: 965978 - DNA, 22 bp, Artificial Sequence
  chemically synthesized
ttttttaaaatctcataatata

SEQ ID NO: 965979 - DNA, 22 bp, Artificial Sequence
  chemically synthesized
tttaaaatctcataatataaga

SEQ ID NO: 965980 - DNA, 22 bp, Artificial Sequence
  chemically synthesized
ttaaaatctcataatataagag

SEQ ID NO: 965981 - DNA, 22 bp, Artificial Sequence
  chemically synthesized
ataatatgattcctcttatatt

SEQ ID NO: 965982 - DNA, 22 bp, Artificial Sequence
  chemically synthesized
taaaatctcataatataagagg

SEQ ID NO: 965983 - DNA, 22 bp, Artificial Sequence
  chemically synthesized
aaaatctcataatataagagga

SEQ ID NO: 965984 - DNA, 22 bp, Artificial Sequence
  chemically synthesized
aaatctcataatataagaggaa

SEQ ID NO: 965985 - DNA, 22 bp, Artificial Sequence
  chemically synthesized
ataatataagaggaatcatatt

SEQ ID NO: 965986 - DNA, 22 bp, Artificial Sequence
  chemically synthesized
agaatagtggccagttaataat

SEQ ID NO: 965987 - DNA, 22 bp, Artificial Sequence
  chemically synthesized
aaaactcagaatagtggccagt

SEQ ID NO: 965988 - DNA, 22 bp, Artificial Sequence
  chemically synthesized
caaaactcagaatagtggccag

SEQ ID NO: 965989 - DNA, 22 bp, Artificial Sequence
  chemically synthesized
tcaaaactcagaatagtggcca

SEQ ID NO: 965990 - DNA, 22 bp, Artificial Sequence
  chemically synthesized
ttcaaaactcagaatagtggcc

SEQ ID NO: 965991 - DNA, 22 bp, Artificial Sequence
  chemically synthesized
ttaactggccactattctgagt

SEQ ID NO: 965992 - DNA, 22 bp, Artificial Sequence
  chemically synthesized
actggccactattctgagtttt

SEQ ID NO: 965993 - DNA, 22 bp, Artificial Sequence
  chemically synthesized
taaaatgtttttcaaaactcag

SEQ ID NO: 965994 - DNA, 22 bp, Artificial Sequence
  chemically synthesized
gccactattctgagttttgaaa

SEQ ID NO: 965995 - DNA, 22 bp, Artificial Sequence
  chemically synthesized
aagttgtaaaatgtttttcaaa

SEQ ID NO: 965996 - DNA, 22 bp, Artificial Sequence
  chemically synthesized
aaagttgtaaaatgtttttcaa

SEQ ID NO: 965997 - DNA, 22 bp, Artificial Sequence
  chemically synthesized
taaagttgtaaaatgtttttca

SEQ ID NO: 965998 - DNA, 22 bp, Artificial Sequence
  chemically synthesized
ttaaagttgtaaaatgtttttc

SEQ ID NO: 965999 - DNA, 22 bp, Artificial Sequence
  chemically synthesized
ttctgagttttgaaaaacattt

SEQ ID NO: 966000 - DNA, 22 bp, Artificial Sequence
  chemically synthesized
tttaaagttgtaaaatgttttt

SEQ ID NO: 966001 - DNA, 22 bp, Artificial Sequence
  chemically synthesized
tgagttttgaaaaacattttac

SEQ ID NO: 966002 - DNA, 22 bp, Artificial Sequence
  chemically synthesized
agttttgaaaaacattttacaa

SEQ ID NO: 966003 - DNA, 22 bp, Artificial Sequence
  chemically synthesized
aatcattttttaaagttgtaaa

SEQ ID NO: 966004 - DNA, 22 bp, Artificial Sequence
  chemically synthesized
gaatcattttttaaagttgtaa

SEQ ID NO: 966005 - DNA, 22 bp, Artificial Sequence
  chemically synthesized
tgaaaaacattttacaacttta

SEQ ID NO: 966006 - DNA, 22 bp, Artificial Sequence
  chemically synthesized
gaaaaacattttacaactttaa

SEQ ID NO: 966007 - DNA, 22 bp, Artificial Sequence
  chemically synthesized
aaaaacattttacaactttaaa

SEQ ID NO: 966008 - DNA, 22 bp, Artificial Sequence
  chemically synthesized
tttgaatcattttttaaagttg

SEQ ID NO: 966009 - DNA, 22 bp, Artificial Sequence
  chemically synthesized
atttgaatcattttttaaagtt

SEQ ID NO: 966010 - DNA, 22 bp, Artificial Sequence
  chemically synthesized
tatttgaatcattttttaaagt

SEQ ID NO: 966011 - DNA, 22 bp, Artificial Sequence
  chemically synthesized
ctttatttgaatcattttttaa

SEQ ID NO: 966012 - DNA, 22 bp, Artificial Sequence
  chemically synthesized
gctttatttgaatcatttttta

SEQ ID NO: 966013 - DNA, 22 bp, Artificial Sequence
  chemically synthesized
cttgctttatttgaatcatttt

SEQ ID NO: 966014 - DNA, 22 bp, Artificial Sequence
  chemically synthesized
tacaactttaaaaaatgattca

SEQ ID NO: 966015 - DNA, 22 bp, Artificial Sequence
  chemically synthesized
acaactttaaaaaatgattcaa

SEQ ID NO: 966016 - DNA, 22 bp, Artificial Sequence
  chemically synthesized
caactttaaaaaatgattcaaa

SEQ ID NO: 966017 - DNA, 22 bp, Artificial Sequence
  chemically synthesized
gtctccttgctttatttgaatc

SEQ ID NO: 966018 - DNA, 22 bp, Artificial Sequence
  chemically synthesized
ctcgtctccttgctttatttga

SEQ ID NO: 966019 - DNA, 22 bp, Artificial Sequence
  chemically synthesized
taaaaaatgattcaaataaagc

SEQ ID NO: 966020 - DNA, 22 bp, Artificial Sequence
  chemically synthesized
aaaaaatgattcaaataaagca

SEQ ID NO: 966021 - DNA, 22 bp, Artificial Sequence
  chemically synthesized
aaaaatgattcaaataaagcaa

SEQ ID NO: 966022 - DNA, 22 bp, Artificial Sequence
  chemically synthesized
cattactcgtctccttgcttta

SEQ ID NO: 966023 - DNA, 22 bp, Artificial Sequence
  chemically synthesized
gcattactcgtctccttgcttt

SEQ ID NO: 966024 - DNA, 22 bp, Artificial Sequence
  chemically synthesized
cttgcattactcgtctccttgc

SEQ ID NO: 966025 - DNA, 22 bp, Artificial Sequence
  chemically synthesized
aaataaagcaaggagacgagta

SEQ ID NO: 966026 - DNA, 22 bp, Artificial Sequence
  chemically synthesized
gcattacttgcattactcgtct

SEQ ID NO: 966027 - DNA, 22 bp, Artificial Sequence
  chemically synthesized
ggcattacttgcattactcgtc

SEQ ID NO: 966028 - DNA, 22 bp, Artificial Sequence
  chemically synthesized
gataaacacaagtcatacttgg

SEQ ID NO: 966029 - DNA, 22 bp, Artificial Sequence
  chemically synthesized
ttagataaacacaagtcatact

SEQ ID NO: 966030 - DNA, 22 bp, Artificial Sequence
  chemically synthesized
taagtaacaaagtccattatta

SEQ ID NO: 966031 - DNA, 22 bp, Artificial Sequence
  chemically synthesized
gtgtttatctaataatggactt

SEQ ID NO: 966032 - DNA, 22 bp, Artificial Sequence
  chemically synthesized
tgtttatctaataatggacttt

SEQ ID NO: 966033 - DNA, 22 bp, Artificial Sequence
  chemically synthesized
atctaataatggactttgttac

SEQ ID NO: 966034 - DNA, 22 bp, Artificial Sequence
  chemically synthesized
tctaataatggactttgttact

SEQ ID NO: 966035 - DNA, 22 bp, Artificial Sequence
  chemically synthesized
catgtggctataagtaacaaag

SEQ ID NO: 966036 - DNA, 22 bp, Artificial Sequence
  chemically synthesized
ataatggactttgttacttata

SEQ ID NO: 966037 - DNA, 22 bp, Artificial Sequence
  chemically synthesized
aaattccatgtggctataagta

SEQ ID NO: 966038 - DNA, 22 bp, Artificial Sequence
  chemically synthesized
cagccctaaaattccatgtggc

SEQ ID NO: 966039 - DNA, 22 bp, Artificial Sequence
  chemically synthesized
tgttacttatagccacatggaa

SEQ ID NO: 966040 - DNA, 22 bp, Artificial Sequence
  chemically synthesized
gcagccctaaaattccatgtgg

SEQ ID NO: 966041 - DNA, 22 bp, Artificial Sequence
  chemically synthesized
gttacttatagccacatggaat

SEQ ID NO: 966042 - DNA, 22 bp, Artificial Sequence
  chemically synthesized
ttacttatagccacatggaatt

SEQ ID NO: 966043 - DNA, 22 bp, Artificial Sequence
  chemically synthesized
tttgcagccctaaaattccatg

SEQ ID NO: 966044 - DNA, 22 bp, Artificial Sequence
  chemically synthesized
cttatagccacatggaatttta

SEQ ID NO: 966045 - DNA, 22 bp, Artificial Sequence
  chemically synthesized
ttgtttgcagccctaaaattcc

SEQ ID NO: 966046 - DNA, 22 bp, Artificial Sequence
  chemically synthesized
gttgtttgcagccctaaaattc

SEQ ID NO: 966047 - DNA, 22 bp, Artificial Sequence
  chemically synthesized
atagccacatggaattttaggg

SEQ ID NO: 966048 - DNA, 22 bp, Artificial Sequence
  chemically synthesized
tagccacatggaattttagggc

SEQ ID NO: 966049 - DNA, 22 bp, Artificial Sequence
  chemically synthesized
cttgttgtttgcagccctaaaa

SEQ ID NO: 966050 - DNA, 22 bp, Artificial Sequence
  chemically synthesized
tccttgttgtttgcagccctaa

SEQ ID NO: 966051 - DNA, 22 bp, Artificial Sequence
  chemically synthesized
tagggctgcaaacaacaaggag

SEQ ID NO: 966052 - DNA, 22 bp, Artificial Sequence
  chemically synthesized
agggctgcaaacaacaaggaga

SEQ ID NO: 966053 - DNA, 22 bp, Artificial Sequence
  chemically synthesized
gggctgcaaacaacaaggagag

SEQ ID NO: 966054 - DNA, 22 bp, Artificial Sequence
  chemically synthesized
cagaaggaggtgcctctccttg

SEQ ID NO: 966055 - DNA, 22 bp, Artificial Sequence
  chemically synthesized
caaacaacaaggagaggcacct

SEQ ID NO: 966056 - DNA, 22 bp, Artificial Sequence
  chemically synthesized
tgattacagaaggaggtgcctc

SEQ ID NO: 966057 - DNA, 22 bp, Artificial Sequence
  chemically synthesized
tagcaacactgtgattacagaa

SEQ ID NO: 966058 - DNA, 22 bp, Artificial Sequence
  chemically synthesized
taattatagcaacactgtgatt

SEQ ID NO: 966059 - DNA, 22 bp, Artificial Sequence
  chemically synthesized
tctgtaattatagcaacactgt

SEQ ID NO: 966060 - DNA, 22 bp, Artificial Sequence
  chemically synthesized
cttctgtaatcacagtgttgct

SEQ ID NO: 966061 - DNA, 22 bp, Artificial Sequence
  chemically synthesized
gtctgtaattatagcaacactg

SEQ ID NO: 966062 - DNA, 22 bp, Artificial Sequence
  chemically synthesized
tgtctgtaattatagcaacact

SEQ ID NO: 966063 - DNA, 22 bp, Artificial Sequence
  chemically synthesized
ctgtaatcacagtgttgctata

SEQ ID NO: 966064 - DNA, 22 bp, Artificial Sequence
  chemically synthesized
tgtaatcacagtgttgctataa

SEQ ID NO: 966065 - DNA, 22 bp, Artificial Sequence
  chemically synthesized
taatcacagtgttgctataatt

SEQ ID NO: 966066 - DNA, 22 bp, Artificial Sequence
  chemically synthesized
acaaacctttgtctgtaattat

SEQ ID NO: 966067 - DNA, 22 bp, Artificial Sequence
  chemically synthesized
ctataattacagacaaaggttt

SEQ ID NO: 966068 - DNA, 22 bp, Artificial Sequence
  chemically synthesized
atggaaatgctgacaaaccttt

SEQ ID NO: 966069 - DNA, 22 bp, Artificial Sequence
  chemically synthesized
taattacagacaaaggtttgtc

SEQ ID NO: 966070 - DNA, 22 bp, Artificial Sequence
  chemically synthesized
aatggaaatgctgacaaacctt

SEQ ID NO: 966071 - DNA, 22 bp, Artificial Sequence
  chemically synthesized
taatggaaatgctgacaaacct

SEQ ID NO: 966072 - DNA, 22 bp, Artificial Sequence
  chemically synthesized
ttaatggaaatgctgacaaacc

SEQ ID NO: 966073 - DNA, 22 bp, Artificial Sequence
  chemically synthesized
ttttaatggaaatgctgacaaa

SEQ ID NO: 966074 - DNA, 22 bp, Artificial Sequence
  chemically synthesized
cagacaaaggtttgtcagcatt

SEQ ID NO: 966075 - DNA, 22 bp, Artificial Sequence
  chemically synthesized
agttcttttaatggaaatgctg

SEQ ID NO: 966076 - DNA, 22 bp, Artificial Sequence
  chemically synthesized
gttaagttcttttaatggaaat

SEQ ID NO: 966077 - DNA, 22 bp, Artificial Sequence
  chemically synthesized
agttaagttcttttaatggaaa

SEQ ID NO: 966078 - DNA, 22 bp, Artificial Sequence
  chemically synthesized
gtcagcatttccattaaaagaa

SEQ ID NO: 966079 - DNA, 22 bp, Artificial Sequence
  chemically synthesized
tcagcatttccattaaaagaac

SEQ ID NO: 966080 - DNA, 22 bp, Artificial Sequence
  chemically synthesized
acagcttagttaagttctttta

SEQ ID NO: 966081 - DNA, 22 bp, Artificial Sequence
  chemically synthesized
aacagcttagttaagttctttt

SEQ ID NO: 966082 - DNA, 22 bp, Artificial Sequence
  chemically synthesized
ccattaaaagaacttaactaag

SEQ ID NO: 966083 - DNA, 22 bp, Artificial Sequence
  chemically synthesized
cattaaaagaacttaactaagc

SEQ ID NO: 966084 - DNA, 22 bp, Artificial Sequence
  chemically synthesized
atggacatttaacagcttagtt

SEQ ID NO: 966085 - DNA, 22 bp, Artificial Sequence
  chemically synthesized
aaagaacttaactaagctgtta

SEQ ID NO: 966086 - DNA, 22 bp, Artificial Sequence
  chemically synthesized
ggctaatggacatttaacagct

SEQ ID NO: 966087 - DNA, 22 bp, Artificial Sequence
  chemically synthesized
aactaagctgttaaatgtccat

SEQ ID NO: 966088 - DNA, 22 bp, Artificial Sequence
  chemically synthesized
actaagctgttaaatgtccatt

SEQ ID NO: 966089 - DNA, 22 bp, Artificial Sequence
  chemically synthesized
agctgttaaatgtccattagcc

SEQ ID NO: 966090 - DNA, 22 bp, Artificial Sequence
  chemically synthesized
taagccatatattaggctaatg

SEQ ID NO: 966091 - DNA, 22 bp, Artificial Sequence
  chemically synthesized
ttaaatgtccattagcctaata

SEQ ID NO: 966092 - DNA, 22 bp, Artificial Sequence
  chemically synthesized
aatgtccattagcctaatatat

SEQ ID NO: 966093 - DNA, 22 bp, Artificial Sequence
  chemically synthesized
agatattataagccatatatta

SEQ ID NO: 966094 - DNA, 22 bp, Artificial Sequence
  chemically synthesized
gctaagatattataagccatat

SEQ ID NO: 966095 - DNA, 22 bp, Artificial Sequence
  chemically synthesized
gcctaatatatggcttataata

SEQ ID NO: 966096 - DNA, 22 bp, Artificial Sequence
  chemically synthesized
atatatggcttataatatctta

SEQ ID NO: 966097 - DNA, 22 bp, Artificial Sequence
  chemically synthesized
atatgcagttagctaagatatt

SEQ ID NO: 966098 - DNA, 22 bp, Artificial Sequence
  chemically synthesized
aatatgcagttagctaagatat

SEQ ID NO: 966099 - DNA, 22 bp, Artificial Sequence
  chemically synthesized
taatatgcagttagctaagata

SEQ ID NO: 966100 - DNA, 22 bp, Artificial Sequence
  chemically synthesized
ttaatatgcagttagctaagat

SEQ ID NO: 966101 - DNA, 22 bp, Artificial Sequence
  chemically synthesized
tttttaatatgcagttagctaa

SEQ ID NO: 966102 - DNA, 22 bp, Artificial Sequence
  chemically synthesized
ataatatcttagctaactgcat

SEQ ID NO: 966103 - DNA, 22 bp, Artificial Sequence
  chemically synthesized
gctgtttttaatatgcagttag

SEQ ID NO: 966104 - DNA, 22 bp, Artificial Sequence
  chemically synthesized
taatatcttagctaactgcata

SEQ ID NO: 966105 - DNA, 22 bp, Artificial Sequence
  chemically synthesized
attagctgtttttaatatgcag

SEQ ID NO: 966106 - DNA, 22 bp, Artificial Sequence
  chemically synthesized
aattagctgtttttaatatgca

SEQ ID NO: 966107 - DNA, 22 bp, Artificial Sequence
  chemically synthesized
taattagctgtttttaatatgc

SEQ ID NO: 966108 - DNA, 22 bp, Artificial Sequence
  chemically synthesized
ttaattagctgtttttaatatg

SEQ ID NO: 966109 - DNA, 22 bp, Artificial Sequence
  chemically synthesized
agctaactgcatattaaaaaca

SEQ ID NO: 966110 - DNA, 22 bp, Artificial Sequence
  chemically synthesized
gctaactgcatattaaaaacag

SEQ ID NO: 966111 - DNA, 22 bp, Artificial Sequence
  chemically synthesized
actgcatattaaaaacagctaa

SEQ ID NO: 966112 - DNA, 22 bp, Artificial Sequence
  chemically synthesized
catattaaaaacagctaattaa

SEQ ID NO: 966113 - DNA, 22 bp, Artificial Sequence
  chemically synthesized
aaaatccatccatttttaatta

SEQ ID NO: 966114 - DNA, 22 bp, Artificial Sequence
  chemically synthesized
aaaaatccatccatttttaatt

SEQ ID NO: 966115 - DNA, 22 bp, Artificial Sequence
  chemically synthesized
aaaacagctaattaaaaatgga

SEQ ID NO: 966116 - DNA, 22 bp, Artificial Sequence
  chemically synthesized
tttaaaaatccatccattttta

SEQ ID NO: 966117 - DNA, 22 bp, Artificial Sequence
  chemically synthesized
atttaaaaatccatccattttt

SEQ ID NO: 966118 - DNA, 22 bp, Artificial Sequence
  chemically synthesized
tatttaaaaatccatccatttt

SEQ ID NO: 966119 - DNA, 22 bp, Artificial Sequence
  chemically synthesized
attaaaaatggatggattttta

SEQ ID NO: 966120 - DNA, 22 bp, Artificial Sequence
  chemically synthesized
cataactttatttaaaaatcca

SEQ ID NO: 966121 - DNA, 22 bp, Artificial Sequence
  chemically synthesized
acataactttatttaaaaatcc

SEQ ID NO: 966122 - DNA, 22 bp, Artificial Sequence
  chemically synthesized
aaaatggatggatttttaaata

SEQ ID NO: 966123 - DNA, 22 bp, Artificial Sequence
  chemically synthesized
ggtatttacataactttattta

SEQ ID NO: 966124 - DNA, 22 bp, Artificial Sequence
  chemically synthesized
tgggtatttacataactttatt

SEQ ID NO: 966125 - DNA, 22 bp, Artificial Sequence
  chemically synthesized
ctgggtatttacataactttat

SEQ ID NO: 966126 - DNA, 22 bp, Artificial Sequence
  chemically synthesized
ttctgggtatttacataacttt

SEQ ID NO: 966127 - DNA, 22 bp, Artificial Sequence
  chemically synthesized
cttctgggtatttacataactt

SEQ ID NO: 966128 - DNA, 22 bp, Artificial Sequence
  chemically synthesized
atttcttctgggtatttacata

SEQ ID NO: 966129 - DNA, 22 bp, Artificial Sequence
  chemically synthesized
ttaaataaagttatgtaaatac

SEQ ID NO: 966130 - DNA, 22 bp, Artificial Sequence
  chemically synthesized
taaataaagttatgtaaatacc

SEQ ID NO: 966131 - DNA, 22 bp, Artificial Sequence
  chemically synthesized
aaataaagttatgtaaataccc

SEQ ID NO: 966132 - DNA, 22 bp, Artificial Sequence
  chemically synthesized
aataaagttatgtaaataccca

SEQ ID NO: 966133 - DNA, 22 bp, Artificial Sequence
  chemically synthesized
aagagctgatttcttctgggta

SEQ ID NO: 966134 - DNA, 22 bp, Artificial Sequence
  chemically synthesized
aaagagctgatttcttctgggt

SEQ ID NO: 966135 - DNA, 22 bp, Artificial Sequence
  chemically synthesized
tgtaaatacccagaagaaatca

SEQ ID NO: 966136 - DNA, 22 bp, Artificial Sequence
  chemically synthesized
tagaaatgtgcacacttaaaga

SEQ ID NO: 966137 - DNA, 22 bp, Artificial Sequence
  chemically synthesized
ttatagaaatgtgcacacttaa

SEQ ID NO: 966138 - DNA, 22 bp, Artificial Sequence
  chemically synthesized
tattgttatagaaatgtgcaca

SEQ ID NO: 966139 - DNA, 22 bp, Artificial Sequence
  chemically synthesized
atattgttatagaaatgtgcac

SEQ ID NO: 966140 - DNA, 22 bp, Artificial Sequence
  chemically synthesized
tttaagtgtgcacatttctata

SEQ ID NO: 966141 - DNA, 22 bp, Artificial Sequence
  chemically synthesized
cacttatattgttatagaaatg

SEQ ID NO: 966142 - DNA, 22 bp, Artificial Sequence
  chemically synthesized
gcacttatattgttatagaaat

SEQ ID NO: 966143 - DNA, 22 bp, Artificial Sequence
  chemically synthesized
taagtgtgcacatttctataac

SEQ ID NO: 966144 - DNA, 22 bp, Artificial Sequence
  chemically synthesized
aagtgtgcacatttctataaca

SEQ ID NO: 966145 - DNA, 22 bp, Artificial Sequence
  chemically synthesized
agtgtgcacatttctataacaa

SEQ ID NO: 966146 - DNA, 22 bp, Artificial Sequence
  chemically synthesized
gggaaaaaaagcttgcacttat

SEQ ID NO: 966147 - DNA, 22 bp, Artificial Sequence
  chemically synthesized
ctataacaatataagtgcaagc

SEQ ID NO: 966148 - DNA, 22 bp, Artificial Sequence
  chemically synthesized
tataacaatataagtgcaagct

SEQ ID NO: 966149 - DNA, 22 bp, Artificial Sequence
  chemically synthesized
taacaatataagtgcaagcttt

SEQ ID NO: 966150 - DNA, 22 bp, Artificial Sequence
  chemically synthesized
aaatactggggaaaaaaagctt

SEQ ID NO: 966151 - DNA, 22 bp, Artificial Sequence
  chemically synthesized
tttttccccagtatttgaattg

SEQ ID NO: 966152 - DNA, 22 bp, Artificial Sequence
  chemically synthesized
ttttccccagtatttgaattgt

SEQ ID NO: 966153 - DNA, 22 bp, Artificial Sequence
  chemically synthesized
tttccccagtatttgaattgtc

SEQ ID NO: 966154 - DNA, 22 bp, Artificial Sequence
  chemically synthesized
ttccccagtatttgaattgtct

SEQ ID NO: 966155 - DNA, 22 bp, Artificial Sequence
  chemically synthesized
tccccagtatttgaattgtcta

SEQ ID NO: 966156 - DNA, 22 bp, Artificial Sequence
  chemically synthesized
ccccagtatttgaattgtctat

SEQ ID NO: 966157 - DNA, 22 bp, Artificial Sequence
  chemically synthesized
cccagtatttgaattgtctatt

SEQ ID NO: 966158 - DNA, 22 bp, Artificial Sequence
  chemically synthesized
aaaataatgcatataaatagac

SEQ ID NO: 966159 - DNA, 22 bp, Artificial Sequence
  chemically synthesized
aaaaataatgcatataaataga

SEQ ID NO: 966160 - DNA, 22 bp, Artificial Sequence
  chemically synthesized
taaaaataatgcatataaatag

SEQ ID NO: 966161 - DNA, 22 bp, Artificial Sequence
  chemically synthesized
gaattgtctatttatatgcatt

SEQ ID NO: 966162 - DNA, 22 bp, Artificial Sequence
  chemically synthesized
agttttaaaaataatgcatata

SEQ ID NO: 966163 - DNA, 22 bp, Artificial Sequence
  chemically synthesized
aattgtctatttatatgcatta

SEQ ID NO: 966164 - DNA, 22 bp, Artificial Sequence
  chemically synthesized
ggttaagttttaaaaataatgc

SEQ ID NO: 966165 - DNA, 22 bp, Artificial Sequence
  chemically synthesized
tctatttatatgcattattttt

SEQ ID NO: 966166 - DNA, 22 bp, Artificial Sequence
  chemically synthesized
aggttaagttttaaaaataatg

SEQ ID NO: 966167 - DNA, 22 bp, Artificial Sequence
  chemically synthesized
taggttaagttttaaaaataat

SEQ ID NO: 966168 - DNA, 22 bp, Artificial Sequence
  chemically synthesized
tttatatgcattatttttaaaa

SEQ ID NO: 966169 - DNA, 22 bp, Artificial Sequence
  chemically synthesized
atatgcattatttttaaaactt

SEQ ID NO: 966170 - DNA, 22 bp, Artificial Sequence
  chemically synthesized
tatgcattatttttaaaactta

SEQ ID NO: 966171 - DNA, 22 bp, Artificial Sequence
  chemically synthesized
cagaacattttaggttaagttt

SEQ ID NO: 966172 - DNA, 22 bp, Artificial Sequence
  chemically synthesized
ccagaacattttaggttaagtt

SEQ ID NO: 966173 - DNA, 22 bp, Artificial Sequence
  chemically synthesized
tccagaacattttaggttaagt

SEQ ID NO: 966174 - DNA, 22 bp, Artificial Sequence
  chemically synthesized
tttttaaaacttaacctaaaat

SEQ ID NO: 966175 - DNA, 22 bp, Artificial Sequence
  chemically synthesized
ttaaaacttaacctaaaatgtt

SEQ ID NO: 966176 - DNA, 22 bp, Artificial Sequence
  chemically synthesized
taaaacttaacctaaaatgttc

SEQ ID NO: 966177 - DNA, 22 bp, Artificial Sequence
  chemically synthesized
aaaacttaacctaaaatgttct

SEQ ID NO: 966178 - DNA, 22 bp, Artificial Sequence
  chemically synthesized
aaacttaacctaaaatgttctg

SEQ ID NO: 966179 - DNA, 22 bp, Artificial Sequence
  chemically synthesized
tgtaatccctttccagaacatt

SEQ ID NO: 966180 - DNA, 22 bp, Artificial Sequence
  chemically synthesized
ttatgtaatccctttccagaac

SEQ ID NO: 966181 - DNA, 22 bp, Artificial Sequence
  chemically synthesized
aacctaaaatgttctggaaagg

SEQ ID NO: 966182 - DNA, 22 bp, Artificial Sequence
  chemically synthesized
acctaaaatgttctggaaaggg

SEQ ID NO: 966183 - DNA, 22 bp, Artificial Sequence
  chemically synthesized
ttgttatgtaatccctttccag

SEQ ID NO: 966184 - DNA, 22 bp, Artificial Sequence
  chemically synthesized
attgttatgtaatccctttcca

SEQ ID NO: 966185 - DNA, 22 bp, Artificial Sequence
  chemically synthesized
aaatgttctggaaagggattac

SEQ ID NO: 966186 - DNA, 22 bp, Artificial Sequence
  chemically synthesized
tgcttattgttatgtaatccct

SEQ ID NO: 966187 - DNA, 22 bp, Artificial Sequence
  chemically synthesized
tggaaagggattacataacaat

SEQ ID NO: 966188 - DNA, 22 bp, Artificial Sequence
  chemically synthesized
gaaagggattacataacaataa

SEQ ID NO: 966189 - DNA, 22 bp, Artificial Sequence
  chemically synthesized
tgacaacattgtgcttattgtt

SEQ ID NO: 966190 - DNA, 22 bp, Artificial Sequence
  chemically synthesized
atgacaacattgtgcttattgt

SEQ ID NO: 966191 - DNA, 22 bp, Artificial Sequence
  chemically synthesized
ttatgacaacattgtgcttatt

SEQ ID NO: 966192 - DNA, 22 bp, Artificial Sequence
  chemically synthesized
cttatgacaacattgtgcttat

SEQ ID NO: 966193 - DNA, 22 bp, Artificial Sequence
  chemically synthesized
cttcttatgacaacattgtgct

SEQ ID NO: 966194 - DNA, 22 bp, Artificial Sequence
  chemically synthesized
ccttcttatgacaacattgtgc

SEQ ID NO: 966195 - DNA, 22 bp, Artificial Sequence
  chemically synthesized
cataacaataagcacaatgttg

SEQ ID NO: 966196 - DNA, 22 bp, Artificial Sequence
  chemically synthesized
ttccttcttatgacaacattgt

SEQ ID NO: 966197 - DNA, 22 bp, Artificial Sequence
  chemically synthesized
attcttccttcttatgacaaca

SEQ ID NO: 966198 - DNA, 22 bp, Artificial Sequence
  chemically synthesized
tcataagaaggaagaatgaacg

SEQ ID NO: 966199 - DNA, 22 bp, Artificial Sequence
  chemically synthesized
atcagcgtccatcacagtagtc

SEQ ID NO: 966200 - DNA, 22 bp, Artificial Sequence
  chemically synthesized
agtagttcatcagcgtccatca

SEQ ID NO: 966201 - DNA, 22 bp, Artificial Sequence
  chemically synthesized
gactactgtgatggacgctgat

SEQ ID NO: 966202 - DNA, 22 bp, Artificial Sequence
  chemically synthesized
actactgtgatggacgctgatg

SEQ ID NO: 966203 - DNA, 22 bp, Artificial Sequence
  chemically synthesized
ctgtgatggacgctgatgaact

SEQ ID NO: 966204 - DNA, 22 bp, Artificial Sequence
  chemically synthesized
tgatggacgctgatgaactact

SEQ ID NO: 966205 - DNA, 22 bp, Artificial Sequence
  chemically synthesized
aagggaaatctgagtagttcat

SEQ ID NO: 966206 - DNA, 22 bp, Artificial Sequence
  chemically synthesized
ttgaagggaaatctgagtagtt

SEQ ID NO: 966207 - DNA, 22 bp, Artificial Sequence
  chemically synthesized
attgaagggaaatctgagtagt

SEQ ID NO: 966208 - DNA, 22 bp, Artificial Sequence
  chemically synthesized
tattgaagggaaatctgagtag

SEQ ID NO: 966209 - DNA, 22 bp, Artificial Sequence
  chemically synthesized
tttattgaagggaaatctgagt

SEQ ID NO: 966210 - DNA, 22 bp, Artificial Sequence
  chemically synthesized
atgaactactcagatttccctt

SEQ ID NO: 966211 - DNA, 22 bp, Artificial Sequence
  chemically synthesized
ggacaagttctttattgaaggg

SEQ ID NO: 966212 - DNA, 22 bp, Artificial Sequence
  chemically synthesized
ctcagatttcccttcaataaag

SEQ ID NO: 966213 - DNA, 22 bp, Artificial Sequence
  chemically synthesized
ctgggacaagttctttattgaa

SEQ ID NO: 966214 - DNA, 22 bp, Artificial Sequence
  chemically synthesized
agatttcccttcaataaagaac

SEQ ID NO: 966215 - DNA, 22 bp, Artificial Sequence
  chemically synthesized
cacctgctgggacaagttcttt

SEQ ID NO: 966216 - DNA, 22 bp, Artificial Sequence
  chemically synthesized
ccacctgctgggacaagttctt

SEQ ID NO: 966217 - DNA, 22 bp, Artificial Sequence
  chemically synthesized
cccttcaataaagaacttgtcc

SEQ ID NO: 966218 - DNA, 22 bp, Artificial Sequence
  chemically synthesized
ccttcaataaagaacttgtccc

SEQ ID NO: 966219 - DNA, 22 bp, Artificial Sequence
  chemically synthesized
caataaagaacttgtcccagca

SEQ ID NO: 966220 - DNA, 22 bp, Artificial Sequence
  chemically synthesized
aataaagaacttgtcccagcag

SEQ ID NO: 966221 - DNA, 22 bp, Artificial Sequence
  chemically synthesized
ccaccagcccttccacctgctg

SEQ ID NO: 966222 - DNA, 22 bp, Artificial Sequence
  chemically synthesized
tctgccaccagcccttccacct

SEQ ID NO: 966223 - DNA, 22 bp, Artificial Sequence
  chemically synthesized
gtcccagcaggtggaagggctg

SEQ ID NO: 966224 - DNA, 22 bp, Artificial Sequence
  chemically synthesized
tcccagcaggtggaagggctgg

SEQ ID NO: 966225 - DNA, 22 bp, Artificial Sequence
  chemically synthesized
aaggctgtctgccaccagccct

SEQ ID NO: 966226 - DNA, 22 bp, Artificial Sequence
  chemically synthesized
agagctgaaggctgtctgccac

SEQ ID NO: 966227 - DNA, 22 bp, Artificial Sequence
  chemically synthesized
aaactgagagctgaaggctgtc

SEQ ID NO: 966228 - DNA, 22 bp, Artificial Sequence
  chemically synthesized
gtggcagacagccttcagctct

SEQ ID NO: 966229 - DNA, 22 bp, Artificial Sequence
  chemically synthesized
ggaccacccctaaaactgagag

SEQ ID NO: 966230 - DNA, 22 bp, Artificial Sequence
  chemically synthesized
atggctgggaccacccctaaaa

SEQ ID NO: 966231 - DNA, 22 bp, Artificial Sequence
  chemically synthesized
catggctgggaccacccctaaa

SEQ ID NO: 966232 - DNA, 22 bp, Artificial Sequence
  chemically synthesized
cagctctcagttttaggggtgg

SEQ ID NO: 966233 - DNA, 22 bp, Artificial Sequence
  chemically synthesized
agctctcagttttaggggtggt

SEQ ID NO: 966234 - DNA, 22 bp, Artificial Sequence
  chemically synthesized
ttcatggctgggaccaccccta

SEQ ID NO: 966235 - DNA, 22 bp, Artificial Sequence
  chemically synthesized
tcagttttaggggtggtcccag

SEQ ID NO: 966236 - DNA, 22 bp, Artificial Sequence
  chemically synthesized
agttttaggggtggtcccagcc

SEQ ID NO: 966237 - DNA, 22 bp, Artificial Sequence
  chemically synthesized
taggggtggtcccagccatgaa

SEQ ID NO: 966238 - DNA, 22 bp, Artificial Sequence
  chemically synthesized
aggggtggtcccagccatgaag

SEQ ID NO: 966239 - DNA, 22 bp, Artificial Sequence
  chemically synthesized
tgcaagggggctcttcatggct

SEQ ID NO: 966240 - DNA, 22 bp, Artificial Sequence
  chemically synthesized
ggggtggtcccagccatgaaga

SEQ ID NO: 966241 - DNA, 22 bp, Artificial Sequence
  chemically synthesized
gtgcaagggggctcttcatggc

SEQ ID NO: 966242 - DNA, 22 bp, Artificial Sequence
  chemically synthesized
agaaataagtcatgaccttgtg

SEQ ID NO: 966243 - DNA, 22 bp, Artificial Sequence
  chemically synthesized
tcagaaataagtcatgaccttg

SEQ ID NO: 966244 - DNA, 22 bp, Artificial Sequence
  chemically synthesized
ctcagaaataagtcatgacctt

SEQ ID NO: 966245 - DNA, 22 bp, Artificial Sequence
  chemically synthesized
gcacaaggtcatgacttatttc

SEQ ID NO: 966246 - DNA, 22 bp, Artificial Sequence
  chemically synthesized
cacaaggtcatgacttatttct

SEQ ID NO: 966247 - DNA, 22 bp, Artificial Sequence
  chemically synthesized
gatgatagccttctcagaaata

SEQ ID NO: 966248 - DNA, 22 bp, Artificial Sequence
  chemically synthesized
atcagtcattggatgatagcct

SEQ ID NO: 966249 - DNA, 22 bp, Artificial Sequence
  chemically synthesized
atttctgagaaggctatcatcc

SEQ ID NO: 966250 - DNA, 22 bp, Artificial Sequence
  chemically synthesized
tttctgagaaggctatcatcca

SEQ ID NO: 966251 - DNA, 22 bp, Artificial Sequence
  chemically synthesized
cattaatcagtcattggatgat

SEQ ID NO: 966252 - DNA, 22 bp, Artificial Sequence
  chemically synthesized
ctgagaaggctatcatccaatg

SEQ ID NO: 966253 - DNA, 22 bp, Artificial Sequence
  chemically synthesized
tgagaaggctatcatccaatga

SEQ ID NO: 966254 - DNA, 22 bp, Artificial Sequence
  chemically synthesized
ctgcattaatcagtcattggat

SEQ ID NO: 966255 - DNA, 22 bp, Artificial Sequence
  chemically synthesized
agaaggctatcatccaatgact

SEQ ID NO: 966256 - DNA, 22 bp, Artificial Sequence
  chemically synthesized
ctcctgcattaatcagtcattg

SEQ ID NO: 966257 - DNA, 22 bp, Artificial Sequence
  chemically synthesized
ctactcctgcattaatcagtca

SEQ ID NO: 966258 - DNA, 22 bp, Artificial Sequence
  chemically synthesized
actactcctgcattaatcagtc

SEQ ID NO: 966259 - DNA, 22 bp, Artificial Sequence
  chemically synthesized
tcatccaatgactgattaatgc

SEQ ID NO: 966260 - DNA, 22 bp, Artificial Sequence
  chemically synthesized
agaacagtgagccttactactc

SEQ ID NO: 966261 - DNA, 22 bp, Artificial Sequence
  chemically synthesized
attaatgcaggagtagtaaggc

SEQ ID NO: 966262 - DNA, 22 bp, Artificial Sequence
  chemically synthesized
atgcaggagtagtaaggctcac

SEQ ID NO: 966263 - DNA, 22 bp, Artificial Sequence
  chemically synthesized
agagtagtcctgagaacagtga

SEQ ID NO: 966264 - DNA, 22 bp, Artificial Sequence
  chemically synthesized
cagagtagtcctgagaacagtg

SEQ ID NO: 966265 - DNA, 22 bp, Artificial Sequence
  chemically synthesized
gaatgacccttcagagtagtcc

SEQ ID NO: 966266 - DNA, 22 bp, Artificial Sequence
  chemically synthesized
cgaatgacccttcagagtagtc

SEQ ID NO: 966267 - DNA, 22 bp, Artificial Sequence
  chemically synthesized
actgttctcaggactactctga

SEQ ID NO: 966268 - DNA, 22 bp, Artificial Sequence
  chemically synthesized
ttctcaggactactctgaaggg

SEQ ID NO: 966269 - DNA, 22 bp, Artificial Sequence
  chemically synthesized
agagcttcgaatgacccttcag

SEQ ID NO: 966270 - DNA, 22 bp, Artificial Sequence
  chemically synthesized
tcaggactactctgaagggtca

SEQ ID NO: 966271 - DNA, 22 bp, Artificial Sequence
  chemically synthesized
cagagcttcgaatgacccttca

SEQ ID NO: 966272 - DNA, 22 bp, Artificial Sequence
  chemically synthesized
aggactactctgaagggtcatt

SEQ ID NO: 966273 - DNA, 22 bp, Artificial Sequence
  chemically synthesized
ctctgaagggtcattcgaagct

SEQ ID NO: 966274 - DNA, 22 bp, Artificial Sequence
  chemically synthesized
tgaagggtcattcgaagctctg

SEQ ID NO: 966275 - DNA, 22 bp, Artificial Sequence
  chemically synthesized
aagggtcattcgaagctctgaa

SEQ ID NO: 966276 - DNA, 22 bp, Artificial Sequence
  chemically synthesized
accaaacatatgggaagcttca

SEQ ID NO: 966277 - DNA, 22 bp, Artificial Sequence
  chemically synthesized
gaagctctgaagcttcccatat

SEQ ID NO: 966278 - DNA, 22 bp, Artificial Sequence
  chemically synthesized
ccaattgaccaaacatatggga

SEQ ID NO: 966279 - DNA, 22 bp, Artificial Sequence
  chemically synthesized
cccaattgaccaaacatatggg

SEQ ID NO: 966280 - DNA, 22 bp, Artificial Sequence
  chemically synthesized
tttcccaattgaccaaacatat

SEQ ID NO: 966281 - DNA, 22 bp, Artificial Sequence
  chemically synthesized
tgaagcttcccatatgtttggt

SEQ ID NO: 966282 - DNA, 22 bp, Artificial Sequence
  chemically synthesized
aagcttcccatatgtttggtca

SEQ ID NO: 966283 - DNA, 22 bp, Artificial Sequence
  chemically synthesized
cccatatgtttggtcaattggg

SEQ ID NO: 966284 - DNA, 22 bp, Artificial Sequence
  chemically synthesized
ccatatgtttggtcaattggga

SEQ ID NO: 966285 - DNA, 22 bp, Artificial Sequence
  chemically synthesized
catagagctgtttcccaattga

SEQ ID NO: 966286 - DNA, 22 bp, Artificial Sequence
  chemically synthesized
ggcacctccatagagctgtttc

SEQ ID NO: 966287 - DNA, 22 bp, Artificial Sequence
  chemically synthesized
ggtcaattgggaaacagctcta

SEQ ID NO: 966288 - DNA, 22 bp, Artificial Sequence
  chemically synthesized
gtcaattgggaaacagctctat

SEQ ID NO: 966289 - DNA, 22 bp, Artificial Sequence
  chemically synthesized
ggaaacagctctatggaggtgc

SEQ ID NO: 966290 - DNA, 22 bp, Artificial Sequence
  chemically synthesized
taatatcattgggcacctccat

SEQ ID NO: 966291 - DNA, 22 bp, Artificial Sequence
  chemically synthesized
ataatatcattgggcacctcca

SEQ ID NO: 966292 - DNA, 22 bp, Artificial Sequence
  chemically synthesized
tatggaggtgcccaatgatatt

SEQ ID NO: 966293 - DNA, 22 bp, Artificial Sequence
  chemically synthesized
tgtggatacttataatatcatt

SEQ ID NO: 966294 - DNA, 22 bp, Artificial Sequence
  chemically synthesized
tggaggtgcccaatgatattat

SEQ ID NO: 966295 - DNA, 22 bp, Artificial Sequence
  chemically synthesized
tgtatgtggcctatgtggatac

SEQ ID NO: 966296 - DNA, 22 bp, Artificial Sequence
  chemically synthesized
gtgtatgtggcctatgtggata

SEQ ID NO: 966297 - DNA, 22 bp, Artificial Sequence
  chemically synthesized
tgtgtatgtggcctatgtggat

SEQ ID NO: 966298 - DNA, 22 bp, Artificial Sequence
  chemically synthesized
aactttgtgtatgtggcctatg

SEQ ID NO: 966299 - DNA, 22 bp, Artificial Sequence
  chemically synthesized
taagtatccacataggccacat

SEQ ID NO: 966300 - DNA, 22 bp, Artificial Sequence
  chemically synthesized
cagttgaactttgtgtatgtgg

SEQ ID NO: 966301 - DNA, 22 bp, Artificial Sequence
  chemically synthesized
tcaagacgtgggtcaatctgca

SEQ ID NO: 966302 - DNA, 22 bp, Artificial Sequence
  chemically synthesized
gtcaagacgtgggtcaatctgc

SEQ ID NO: 966303 - DNA, 22 bp, Artificial Sequence
  chemically synthesized
aactgcagattgacccacgtct

SEQ ID NO: 966304 - DNA, 22 bp, Artificial Sequence
  chemically synthesized
cagattgacccacgtcttgaca

SEQ ID NO: 966305 - DNA, 22 bp, Artificial Sequence
  chemically synthesized
gaaggatcacagagcatttgtc

SEQ ID NO: 966306 - DNA, 22 bp, Artificial Sequence
  chemically synthesized
acccacgtcttgacaaatgctc

SEQ ID NO: 966307 - DNA, 22 bp, Artificial Sequence
  chemically synthesized
ccatgttggaaggatcacagag

SEQ ID NO: 966308 - DNA, 22 bp, Artificial Sequence
  chemically synthesized
cccatgttggaaggatcacaga

SEQ ID NO: 966309 - DNA, 22 bp, Artificial Sequence
  chemically synthesized
gacaaatgctctgtgatccttc

SEQ ID NO: 966310 - DNA, 22 bp, Artificial Sequence
  chemically synthesized
acaaatgctctgtgatccttcc

SEQ ID NO: 966311 - DNA, 22 bp, Artificial Sequence
  chemically synthesized
tcttcccatgttggaaggatca

SEQ ID NO: 966312 - DNA, 22 bp, Artificial Sequence
  chemically synthesized
cctatcttcccatgttggaagg

SEQ ID NO: 966313 - DNA, 22 bp, Artificial Sequence
  chemically synthesized
tgtgatccttccaacatgggaa

SEQ ID NO: 966314 - DNA, 22 bp, Artificial Sequence
  chemically synthesized
aagactgcctatcttcccatgt

SEQ ID NO: 966315 - DNA, 22 bp, Artificial Sequence
  chemically synthesized
tgatccttccaacatgggaaga

SEQ ID NO: 966316 - DNA, 22 bp, Artificial Sequence
  chemically synthesized
tcaagactgcctatcttcccat

SEQ ID NO: 966317 - DNA, 22 bp, Artificial Sequence
  chemically synthesized
ctctcaagactgcctatcttcc

SEQ ID NO: 966318 - DNA, 22 bp, Artificial Sequence
  chemically synthesized
cctctcaagactgcctatcttc

SEQ ID NO: 966319 - DNA, 22 bp, Artificial Sequence
  chemically synthesized
ccaacatgggaagataggcagt

SEQ ID NO: 966320 - DNA, 22 bp, Artificial Sequence
  chemically synthesized
caacatgggaagataggcagtc

SEQ ID NO: 966321 - DNA, 22 bp, Artificial Sequence
  chemically synthesized
gtagacttcctctcaagactgc

SEQ ID NO: 966322 - DNA, 22 bp, Artificial Sequence
  chemically synthesized
ggtagacttcctctcaagactg

SEQ ID NO: 966323 - DNA, 22 bp, Artificial Sequence
  chemically synthesized
ccttggtagacttcctctcaag

SEQ ID NO: 966324 - DNA, 22 bp, Artificial Sequence
  chemically synthesized
gagaggaagtctaccaaggcaa

SEQ ID NO: 966325 - DNA, 22 bp, Artificial Sequence
  chemically synthesized
agaggaagtctaccaaggcaat

SEQ ID NO: 966326 - DNA, 22 bp, Artificial Sequence
  chemically synthesized
aagatacagaggtgggtggaat

SEQ ID NO: 966327 - DNA, 22 bp, Artificial Sequence
  chemically synthesized
ccaaggcaatattccacccacc

SEQ ID NO: 966328 - DNA, 22 bp, Artificial Sequence
  chemically synthesized
cctaaagatacagaggtgggtg

SEQ ID NO: 966329 - DNA, 22 bp, Artificial Sequence
  chemically synthesized
ccctaaagatacagaggtgggt

SEQ ID NO: 966330 - DNA, 22 bp, Artificial Sequence
  chemically synthesized
cacccacctctgtatctttagg

SEQ ID NO: 966331 - DNA, 22 bp, Artificial Sequence
  chemically synthesized
ccacaaggtaagggacttccct

SEQ ID NO: 966332 - DNA, 22 bp, Artificial Sequence
  chemically synthesized
tgtatctttagggaagtccctt

SEQ ID NO: 966333 - DNA, 22 bp, Artificial Sequence
  chemically synthesized
tatctttagggaagtcccttac

SEQ ID NO: 966334 - DNA, 22 bp, Artificial Sequence
  chemically synthesized
tcgccacctcccacaaggtaag

SEQ ID NO: 966335 - DNA, 22 bp, Artificial Sequence
  chemically synthesized
tagggaagtcccttaccttgtg

SEQ ID NO: 966336 - DNA, 22 bp, Artificial Sequence
  chemically synthesized
agggaagtcccttaccttgtgg

SEQ ID NO: 966337 - DNA, 22 bp, Artificial Sequence
  chemically synthesized
tatcgccacctcccacaaggta

SEQ ID NO: 966338 - DNA, 22 bp, Artificial Sequence
  chemically synthesized
gggaagtcccttaccttgtggg

SEQ ID NO: 966339 - DNA, 22 bp, Artificial Sequence
  chemically synthesized
accttgtgggaggtggcgatag

SEQ ID NO: 966340 - DNA, 22 bp, Artificial Sequence
  chemically synthesized
ccttgtgggaggtggcgataga

SEQ ID NO: 966341 - DNA, 22 bp, Artificial Sequence
  chemically synthesized
gtgggaggtggcgatagaacat

SEQ ID NO: 966342 - DNA, 22 bp, Artificial Sequence
  chemically synthesized
tgggaggtggcgatagaacatt

SEQ ID NO: 966343 - DNA, 22 bp, Artificial Sequence
  chemically synthesized
accataaccagaaaggcagatg

SEQ ID NO: 966344 - DNA, 22 bp, Artificial Sequence
  chemically synthesized
ctcatctgcctttctggttatg

SEQ ID NO: 966345 - DNA, 22 bp, Artificial Sequence
  chemically synthesized
tcatctgcctttctggttatgg

SEQ ID NO: 966346 - DNA, 22 bp, Artificial Sequence
  chemically synthesized
atctgcctttctggttatggtg

SEQ ID NO: 966347 - DNA, 22 bp, Artificial Sequence
  chemically synthesized
cctttctggttatggtgagaca

SEQ ID NO: 966348 - DNA, 22 bp, Artificial Sequence
  chemically synthesized
agatggaacatcatatgtctca

SEQ ID NO: 966349 - DNA, 22 bp, Artificial Sequence
  chemically synthesized
tctggttatggtgagacatatg

SEQ ID NO: 966350 - DNA, 22 bp, Artificial Sequence
  chemically synthesized
ctggttatggtgagacatatga

SEQ ID NO: 966351 - DNA, 22 bp, Artificial Sequence
  chemically synthesized
tggttatggtgagacatatgat

SEQ ID NO: 966352 - DNA, 22 bp, Artificial Sequence
  chemically synthesized
gttatggtgagacatatgatgt

SEQ ID NO: 966353 - DNA, 22 bp, Artificial Sequence
  chemically synthesized
tggtgagacatatgatgttcca

SEQ ID NO: 966354 - DNA, 22 bp, Artificial Sequence
  chemically synthesized
aggggagctgagatggaacatc

SEQ ID NO: 966355 - DNA, 22 bp, Artificial Sequence
  chemically synthesized
aaggggagctgagatggaacat

SEQ ID NO: 966356 - DNA, 22 bp, Artificial Sequence
  chemically synthesized
taaggggagctgagatggaaca

SEQ ID NO: 966357 - DNA, 22 bp, Artificial Sequence
  chemically synthesized
tactttaaggggagctgagatg

SEQ ID NO: 966358 - DNA, 22 bp, Artificial Sequence
  chemically synthesized
cagctgtactttaaggggagct

SEQ ID NO: 966359 - DNA, 22 bp, Artificial Sequence
  chemically synthesized
tgcagctgtactttaaggggag

SEQ ID NO: 966360 - DNA, 22 bp, Artificial Sequence
  chemically synthesized
catctcagctccccttaaagta

SEQ ID NO: 966361 - DNA, 22 bp, Artificial Sequence
  chemically synthesized
tactctgcagctgtactttaag

SEQ ID NO: 966362 - DNA, 22 bp, Artificial Sequence
  chemically synthesized
atactctgcagctgtactttaa

SEQ ID NO: 966363 - DNA, 22 bp, Artificial Sequence
  chemically synthesized
tatactctgcagctgtacttta

SEQ ID NO: 966364 - DNA, 22 bp, Artificial Sequence
  chemically synthesized
agctccccttaaagtacagctg

SEQ ID NO: 966365 - DNA, 22 bp, Artificial Sequence
  chemically synthesized
cccttaaagtacagctgcagag

SEQ ID NO: 966366 - DNA, 22 bp, Artificial Sequence
  chemically synthesized
agcagttttatactctgcagct

SEQ ID NO: 966367 - DNA, 22 bp, Artificial Sequence
  chemically synthesized
aaagtacagctgcagagtataa

SEQ ID NO: 966368 - DNA, 22 bp, Artificial Sequence
  chemically synthesized
aagtacagctgcagagtataaa

SEQ ID NO: 966369 - DNA, 22 bp, Artificial Sequence
  chemically synthesized
gtcatgcaattaagcagtttta

SEQ ID NO: 966370 - DNA, 22 bp, Artificial Sequence
  chemically synthesized
cgtcatgcaattaagcagtttt

SEQ ID NO: 966371 - DNA, 22 bp, Artificial Sequence
  chemically synthesized
cagagtataaaactgcttaatt

SEQ ID NO: 966372 - DNA, 22 bp, Artificial Sequence
  chemically synthesized
agaagccaatttcgtcatgcaa

SEQ ID NO: 966373 - DNA, 22 bp, Artificial Sequence
  chemically synthesized
ttgagaagccaatttcgtcatg

SEQ ID NO: 966374 - DNA, 22 bp, Artificial Sequence
  chemically synthesized
ttgttgagaagccaatttcgtc

SEQ ID NO: 966375 - DNA, 22 bp, Artificial Sequence
  chemically synthesized
cttaattgcatgacgaaattgg

SEQ ID NO: 966376 - DNA, 22 bp, Artificial Sequence
  chemically synthesized
tgttgttgagaagccaatttcg

SEQ ID NO: 966377 - DNA, 22 bp, Artificial Sequence
  chemically synthesized
aattgcatgacgaaattggctt

SEQ ID NO: 966378 - DNA, 22 bp, Artificial Sequence
  chemically synthesized
attgcatgacgaaattggcttc

SEQ ID NO: 966379 - DNA, 22 bp, Artificial Sequence
  chemically synthesized
catgacgaaattggcttctcaa

SEQ ID NO: 966380 - DNA, 22 bp, Artificial Sequence
  chemically synthesized
gcttctcaacaacagagtgcac

SEQ ID NO: 966381 - DNA, 22 bp, Artificial Sequence
  chemically synthesized
ctcaacaacagagtgcacactg

SEQ ID NO: 966382 - DNA, 22 bp, Artificial Sequence
  chemically synthesized
tcaacaacagagtgcacactgc

SEQ ID NO: 966383 - DNA, 22 bp, Artificial Sequence
  chemically synthesized
aacaacagagtgcacactgctt

SEQ ID NO: 966384 - DNA, 22 bp, Artificial Sequence
  chemically synthesized
aagagaccagatgacatgcaac

SEQ ID NO: 966385 - DNA, 22 bp, Artificial Sequence
  chemically synthesized
cttgtgttgcatgtcatctggt

SEQ ID NO: 966386 - DNA, 22 bp, Artificial Sequence
  chemically synthesized
gtgttgcatgtcatctggtctc

SEQ ID NO: 966387 - DNA, 22 bp, Artificial Sequence
  chemically synthesized
tgttgcatgtcatctggtctct

SEQ ID NO: 966388 - DNA, 22 bp, Artificial Sequence
  chemically synthesized
catgtcatctggtctctttaat

SEQ ID NO: 966389 - DNA, 22 bp, Artificial Sequence
  chemically synthesized
tcccacagtatgataccaaaat

SEQ ID NO: 966390 - DNA, 22 bp, Artificial Sequence
  chemically synthesized
gtcccacagtatgataccaaaa

SEQ ID NO: 966391 - DNA, 22 bp, Artificial Sequence
  chemically synthesized
gtctctttaattttggtatcat

SEQ ID NO: 966392 - DNA, 22 bp, Artificial Sequence
  chemically synthesized
tttaattttggtatcatactgt

SEQ ID NO: 966393 - DNA, 22 bp, Artificial Sequence
  chemically synthesized
tgtcacttgtcccacagtatga

SEQ ID NO: 966394 - DNA, 22 bp, Artificial Sequence
  chemically synthesized
taattttggtatcatactgtgg

SEQ ID NO: 966395 - DNA, 22 bp, Artificial Sequence
  chemically synthesized
aattttggtatcatactgtggg

SEQ ID NO: 966396 - DNA, 22 bp, Artificial Sequence
  chemically synthesized
attttggtatcatactgtggga

SEQ ID NO: 966397 - DNA, 22 bp, Artificial Sequence
  chemically synthesized
ctgtgtcacttgtcccacagta

SEQ ID NO: 966398 - DNA, 22 bp, Artificial Sequence
  chemically synthesized
cctgtgtcacttgtcccacagt

SEQ ID NO: 966399 - DNA, 22 bp, Artificial Sequence
  chemically synthesized
tggtatcatactgtgggacaag

SEQ ID NO: 966400 - DNA, 22 bp, Artificial Sequence
  chemically synthesized
ggtatcatactgtgggacaagt

SEQ ID NO: 966401 - DNA, 22 bp, Artificial Sequence
  chemically synthesized
gtatcatactgtgggacaagtg

SEQ ID NO: 966402 - DNA, 22 bp, Artificial Sequence
  chemically synthesized
tgggacaagtgacacaggaaac

SEQ ID NO: 966403 - DNA, 22 bp, Artificial Sequence
  chemically synthesized
taggcatcaaaagtatgatcag

SEQ ID NO: 966404 - DNA, 22 bp, Artificial Sequence
  chemically synthesized
ataggcatcaaaagtatgatca

SEQ ID NO: 966405 - DNA, 22 bp, Artificial Sequence
  chemically synthesized
tataggcatcaaaagtatgatc

SEQ ID NO: 966406 - DNA, 22 bp, Artificial Sequence
  chemically synthesized
acaccatgctgatcatactttt

SEQ ID NO: 966407 - DNA, 22 bp, Artificial Sequence
  chemically synthesized
atcatacttttgatgcctataa

SEQ ID NO: 966408 - DNA, 22 bp, Artificial Sequence
  chemically synthesized
ttgatgcctataaaactgtttg

SEQ ID NO: 966409 - DNA, 22 bp, Artificial Sequence
  chemically synthesized
tgatgcctataaaactgtttgg

SEQ ID NO: 966410 - DNA, 22 bp, Artificial Sequence
  chemically synthesized
gatgcctataaaactgtttggg

SEQ ID NO: 966411 - DNA, 22 bp, Artificial Sequence
  chemically synthesized
atgcctataaaactgtttgggt

SEQ ID NO: 966412 - DNA, 22 bp, Artificial Sequence
  chemically synthesized
atgagacagtcaacccaaacag

SEQ ID NO: 966413 - DNA, 22 bp, Artificial Sequence
  chemically synthesized
taaaactgtttgggttgactgt

SEQ ID NO: 966414 - DNA, 22 bp, Artificial Sequence
  chemically synthesized
agcagttaatgagacagtcaac

SEQ ID NO: 966415 - DNA, 22 bp, Artificial Sequence
  chemically synthesized
tttgggttgactgtctcattaa

SEQ ID NO: 966416 - DNA, 22 bp, Artificial Sequence
  chemically synthesized
agagattcagcagttaatgaga

SEQ ID NO: 966417 - DNA, 22 bp, Artificial Sequence
  chemically synthesized
gggttgactgtctcattaactg

SEQ ID NO: 966418 - DNA, 22 bp, Artificial Sequence
  chemically synthesized
ggttgactgtctcattaactgc

SEQ ID NO: 966419 - DNA, 22 bp, Artificial Sequence
  chemically synthesized
actgtctcattaactgctgaat

SEQ ID NO: 966420 - DNA, 22 bp, Artificial Sequence
  chemically synthesized
agcaggctgagagattcagcag

SEQ ID NO: 966421 - DNA, 22 bp, Artificial Sequence
  chemically synthesized
tctcattaactgctgaatctct

SEQ ID NO: 966422 - DNA, 22 bp, Artificial Sequence
  chemically synthesized
gtgttaagcaggctgagagatt

SEQ ID NO: 966423 - DNA, 22 bp, Artificial Sequence
  chemically synthesized
attaactgctgaatctctcagc

SEQ ID NO: 966424 - DNA, 22 bp, Artificial Sequence
  chemically synthesized
agtgttaagcaggctgagagat

SEQ ID NO: 966425 - DNA, 22 bp, Artificial Sequence
  chemically synthesized
actgctgaatctctcagcctgc

SEQ ID NO: 966426 - DNA, 22 bp, Artificial Sequence
  chemically synthesized
ctgaatctctcagcctgcttaa

SEQ ID NO: 966427 - DNA, 22 bp, Artificial Sequence
  chemically synthesized
aatctctcagcctgcttaacac

SEQ ID NO: 966428 - DNA, 22 bp, Artificial Sequence
  chemically synthesized
tcagcctgcttaacactaaggc

SEQ ID NO: 966429 - DNA, 22 bp, Artificial Sequence
  chemically synthesized
agcctgcttaacactaaggctg

SEQ ID NO: 966430 - DNA, 22 bp, Artificial Sequence
  chemically synthesized
taatgcaggcccaataacagcc

SEQ ID NO: 966431 - DNA, 22 bp, Artificial Sequence
  chemically synthesized
cttaacactaaggctgttattg

SEQ ID NO: 966432 - DNA, 22 bp, Artificial Sequence
  chemically synthesized
aacactaaggctgttattgggc

SEQ ID NO: 966433 - DNA, 22 bp, Artificial Sequence
  chemically synthesized
acactaaggctgttattgggcc

SEQ ID NO: 966434 - DNA, 22 bp, Artificial Sequence
  chemically synthesized
agctgtaatgcaggcccaataa

SEQ ID NO: 966435 - DNA, 22 bp, Artificial Sequence
  chemically synthesized
aggctgttattgggcctgcatt

SEQ ID NO: 966436 - DNA, 22 bp, Artificial Sequence
  chemically synthesized
ttattgggcctgcattacagct

SEQ ID NO: 966437 - DNA, 22 bp, Artificial Sequence
  chemically synthesized
ttgggcctgcattacagctcaa

SEQ ID NO: 966438 - DNA, 22 bp, Artificial Sequence
  chemically synthesized
gacagaaagagaagttgagctg

SEQ ID NO: 966439 - DNA, 22 bp, Artificial Sequence
  chemically synthesized
ggcctgcattacagctcaactt

SEQ ID NO: 966440 - DNA, 22 bp, Artificial Sequence
  chemically synthesized
cattacagctcaacttctcttt

SEQ ID NO: 966441 - DNA, 22 bp, Artificial Sequence
  chemically synthesized
cagctcaacttctctttctgtc

SEQ ID NO: 966442 - DNA, 22 bp, Artificial Sequence
  chemically synthesized
gaagcaggattggacagaaaga

SEQ ID NO: 966443 - DNA, 22 bp, Artificial Sequence
  chemically synthesized
agaagcaggattggacagaaag

SEQ ID NO: 966444 - DNA, 22 bp, Artificial Sequence
  chemically synthesized
aacttctctttctgtccaatcc

SEQ ID NO: 966445 - DNA, 22 bp, Artificial Sequence
  chemically synthesized
ctctttctgtccaatcctgctt

SEQ ID NO: 966446 - DNA, 22 bp, Artificial Sequence
  chemically synthesized
tctttctgtccaatcctgcttc

SEQ ID NO: 966447 - DNA, 22 bp, Artificial Sequence
  chemically synthesized
aagagagggcttagaagcagga

SEQ ID NO: 966448 - DNA, 22 bp, Artificial Sequence
  chemically synthesized
tttctgtccaatcctgcttcta

SEQ ID NO: 966449 - DNA, 22 bp, Artificial Sequence
  chemically synthesized
tctgtccaatcctgcttctaag

SEQ ID NO: 966450 - DNA, 22 bp, Artificial Sequence
  chemically synthesized
ctgtccaatcctgcttctaagc

SEQ ID NO: 966451 - DNA, 22 bp, Artificial Sequence
  chemically synthesized
tgtccaatcctgcttctaagcc

SEQ ID NO: 966452 - DNA, 22 bp, Artificial Sequence
  chemically synthesized
tccaatcctgcttctaagccct

SEQ ID NO: 966453 - DNA, 22 bp, Artificial Sequence
  chemically synthesized
gaccaatacatattcaagagag

SEQ ID NO: 966454 - DNA, 22 bp, Artificial Sequence
  chemically synthesized
cttctaagccctctcttgaata

SEQ ID NO: 966455 - DNA, 22 bp, Artificial Sequence
  chemically synthesized
ctaagccctctcttgaatatgt

SEQ ID NO: 966456 - DNA, 22 bp, Artificial Sequence
  chemically synthesized
taagccctctcttgaatatgta

SEQ ID NO: 966457 - DNA, 22 bp, Artificial Sequence
  chemically synthesized
agccctctcttgaatatgtatt

SEQ ID NO: 966458 - DNA, 22 bp, Artificial Sequence
  chemically synthesized
tcttgaatatgtattggtccag

SEQ ID NO: 966459 - DNA, 22 bp, Artificial Sequence
  chemically synthesized
ttgaatatgtattggtccagtg

SEQ ID NO: 966460 - DNA, 22 bp, Artificial Sequence
  chemically synthesized
tcagggaatgcccactggacca

SEQ ID NO: 966461 - DNA, 22 bp, Artificial Sequence
  chemically synthesized
atcagggaatgcccactggacc

SEQ ID NO: 966462 - DNA, 22 bp, Artificial Sequence
  chemically synthesized
gaatatgtattggtccagtggg

SEQ ID NO: 966463 - DNA, 22 bp, Artificial Sequence
  chemically synthesized
aatatgtattggtccagtgggc

SEQ ID NO: 966464 - DNA, 22 bp, Artificial Sequence
  chemically synthesized
gtccagtgggcattccctgata

SEQ ID NO: 966465 - DNA, 22 bp, Artificial Sequence
  chemically synthesized
atatgcagaatacttatcaggg

SEQ ID NO: 966466 - DNA, 22 bp, Artificial Sequence
  chemically synthesized
aatatgcagaatacttatcagg

SEQ ID NO: 966467 - DNA, 22 bp, Artificial Sequence
  chemically synthesized
aaataaagtttaatatgcagaa

SEQ ID NO: 966468 - DNA, 22 bp, Artificial Sequence
  chemically synthesized
cctgataagtattctgcatatt

SEQ ID NO: 966469 - DNA, 22 bp, Artificial Sequence
  chemically synthesized
taaaataaagtttaatatgcag

SEQ ID NO: 966470 - DNA, 22 bp, Artificial Sequence
  chemically synthesized
ataagtattctgcatattaaac

SEQ ID NO: 966471 - DNA, 22 bp, Artificial Sequence
  chemically synthesized
tgcatattaaactttattttag

SEQ ID NO: 966472 - DNA, 22 bp, Artificial Sequence
  chemically synthesized
catattaaactttattttagag

SEQ ID NO: 966473 - DNA, 22 bp, Artificial Sequence
  chemically synthesized
cgcccggccagactctaaaata

SEQ ID NO: 966474 - DNA, 22 bp, Artificial Sequence
  chemically synthesized
aactttattttagagtctggcc

SEQ ID NO: 966475 - DNA, 22 bp, Artificial Sequence
  chemically synthesized
tattttagagtctggccgggcg

SEQ ID NO: 966476 - DNA, 22 bp, Artificial Sequence
  chemically synthesized
attttagagtctggccgggcgt

SEQ ID NO: 966477 - DNA, 22 bp, Artificial Sequence
  chemically synthesized
ttttagagtctggccgggcgta

SEQ ID NO: 966478 - DNA, 22 bp, Artificial Sequence
  chemically synthesized
caggcgtgagccactacgcccg

SEQ ID NO: 966479 - DNA, 22 bp, Artificial Sequence
  chemically synthesized
tagagtctggccgggcgtagtg

SEQ ID NO: 966480 - DNA, 22 bp, Artificial Sequence
  chemically synthesized
agagtctggccgggcgtagtgg

SEQ ID NO: 966481 - DNA, 22 bp, Artificial Sequence
  chemically synthesized
gagtctggccgggcgtagtggc

SEQ ID NO: 966482 - DNA, 22 bp, Artificial Sequence
  chemically synthesized
ggattacaggcgtgagccacta

SEQ ID NO: 966483 - DNA, 22 bp, Artificial Sequence
  chemically synthesized
gccgggcgtagtggctcacgcc

SEQ ID NO: 966484 - DNA, 22 bp, Artificial Sequence
  chemically synthesized
ccaaagtgctgggattacaggc

SEQ ID NO: 966485 - DNA, 22 bp, Artificial Sequence
  chemically synthesized
cctcccaaagtgctgggattac

SEQ ID NO: 966486 - DNA, 22 bp, Artificial Sequence
  chemically synthesized
tgcctcccaaagtgctgggatt

SEQ ID NO: 966487 - DNA, 22 bp, Artificial Sequence
  chemically synthesized
ctgcctcccaaagtgctgggat

SEQ ID NO: 966488 - DNA, 22 bp, Artificial Sequence
  chemically synthesized
acgcctgtaatcccagcacttt

SEQ ID NO: 966489 - DNA, 22 bp, Artificial Sequence
  chemically synthesized
taatcccagcactttgggaggc

SEQ ID NO: 966490 - DNA, 22 bp, Artificial Sequence
  chemically synthesized
aggtgatccacccacttctgcc

SEQ ID NO: 966491 - DNA, 22 bp, Artificial Sequence
  chemically synthesized
tgggaggcagaagtgggtggat

SEQ ID NO: 966492 - DNA, 22 bp, Artificial Sequence
  chemically synthesized
gggaggcagaagtgggtggatc

SEQ ID NO: 966493 - DNA, 22 bp, Artificial Sequence
  chemically synthesized
ggaggcagaagtgggtggatca

SEQ ID NO: 966494 - DNA, 22 bp, Artificial Sequence
  chemically synthesized
aaacacccgacctcaggtgatc

SEQ ID NO: 966495 - DNA, 22 bp, Artificial Sequence
  chemically synthesized
gtctcaaacacccgacctcagg

SEQ ID NO: 966496 - DNA, 22 bp, Artificial Sequence
  chemically synthesized
gtcaggctggtctcaaacaccc

SEQ ID NO: 966497 - DNA, 22 bp, Artificial Sequence
  chemically synthesized
aggtcgggtgtttgagaccagc

SEQ ID NO: 966498 - DNA, 22 bp, Artificial Sequence
  chemically synthesized
atcatgttggtcaggctggtct

SEQ ID NO: 966499 - DNA, 22 bp, Artificial Sequence
  chemically synthesized
catcatgttggtcaggctggtc

SEQ ID NO: 966500 - DNA, 22 bp, Artificial Sequence
  chemically synthesized
gagaccagcctgaccaacatga

SEQ ID NO: 966501 - DNA, 22 bp, Artificial Sequence
  chemically synthesized
agaccagcctgaccaacatgat

SEQ ID NO: 966502 - DNA, 22 bp, Artificial Sequence
  chemically synthesized
gtagagacggggtttcatcatg

SEQ ID NO: 966503 - DNA, 22 bp, Artificial Sequence
  chemically synthesized
agtagagacggggtttcatcat

SEQ ID NO: 966504 - DNA, 22 bp, Artificial Sequence
  chemically synthesized
tagtagagacggggtttcatca

SEQ ID NO: 966505 - DNA, 22 bp, Artificial Sequence
  chemically synthesized
ttagtagagacggggtttcatc

SEQ ID NO: 966506 - DNA, 22 bp, Artificial Sequence
  chemically synthesized
accaacatgatgaaaccccgtc

SEQ ID NO: 966507 - DNA, 22 bp, Artificial Sequence
  chemically synthesized
tatttttagtagagacggggtt

SEQ ID NO: 966508 - DNA, 22 bp, Artificial Sequence
  chemically synthesized
gtatttttagtagagacggggt

SEQ ID NO: 966509 - DNA, 22 bp, Artificial Sequence
  chemically synthesized
tgtatttttagtagagacgggg

SEQ ID NO: 966510 - DNA, 22 bp, Artificial Sequence
  chemically synthesized
attttgtatttttagtagagac

SEQ ID NO: 966511 - DNA, 22 bp, Artificial Sequence
  chemically synthesized
gctaattttgtatttttagtag

SEQ ID NO: 966512 - DNA, 22 bp, Artificial Sequence
  chemically synthesized
ccacgcctggctaattttgtat

SEQ ID NO: 966513 - DNA, 22 bp, Artificial Sequence
  chemically synthesized
tactaaaaatacaaaattagcc

SEQ ID NO: 966514 - DNA, 22 bp, Artificial Sequence
  chemically synthesized
ctaaaaatacaaaattagccag

SEQ ID NO: 966515 - DNA, 22 bp, Artificial Sequence
  chemically synthesized
aaaatacaaaattagccaggcg

SEQ ID NO: 966516 - DNA, 22 bp, Artificial Sequence
  chemically synthesized
caggcaagtactaccacgcctg

SEQ ID NO: 966517 - DNA, 22 bp, Artificial Sequence
  chemically synthesized
ggattacaggcaagtactacca

SEQ ID NO: 966518 - DNA, 22 bp, Artificial Sequence
  chemically synthesized
gccaggcgtggtagtacttgcc

SEQ ID NO: 966519 - DNA, 22 bp, Artificial Sequence
  chemically synthesized
ccaagtatctgggattacaggc

SEQ ID NO: 966520 - DNA, 22 bp, Artificial Sequence
  chemically synthesized
aaactcccaagtatctgggatt

SEQ ID NO: 966521 - DNA, 22 bp, Artificial Sequence
  chemically synthesized
cctcaaactcccaagtatctgg

SEQ ID NO: 966522 - DNA, 22 bp, Artificial Sequence
  chemically synthesized
gcctgtaatcccagatacttgg

SEQ ID NO: 966523 - DNA, 22 bp, Artificial Sequence
  chemically synthesized
tgcctcaaactcccaagtatct

SEQ ID NO: 966524 - DNA, 22 bp, Artificial Sequence
  chemically synthesized
cctgtaatcccagatacttggg

SEQ ID NO: 966525 - DNA, 22 bp, Artificial Sequence
  chemically synthesized
ctgcctcaaactcccaagtatc

SEQ ID NO: 966526 - DNA, 22 bp, Artificial Sequence
  chemically synthesized
ttctgcctcaaactcccaagta

SEQ ID NO: 966527 - DNA, 22 bp, Artificial Sequence
  chemically synthesized
taatcccagatacttgggagtt

SEQ ID NO: 966528 - DNA, 22 bp, Artificial Sequence
  chemically synthesized
aagtgattcttctgcctcaaac

SEQ ID NO: 966529 - DNA, 22 bp, Artificial Sequence
  chemically synthesized
tgggttcaagtgattcttctgc

SEQ ID NO: 966530 - DNA, 22 bp, Artificial Sequence
  chemically synthesized
gggagtttgaggcagaagaatc

SEQ ID NO: 966531 - DNA, 22 bp, Artificial Sequence
  chemically synthesized
atgggttcaagtgattcttctg

SEQ ID NO: 966532 - DNA, 22 bp, Artificial Sequence
  chemically synthesized
ggagtttgaggcagaagaatca

SEQ ID NO: 966533 - DNA, 22 bp, Artificial Sequence
  chemically synthesized
cgccttatgggttcaagtgatt

SEQ ID NO: 966534 - DNA, 22 bp, Artificial Sequence
  chemically synthesized
ccgccttatgggttcaagtgat

SEQ ID NO: 966535 - DNA, 22 bp, Artificial Sequence
  chemically synthesized
gaggcagaagaatcacttgaac

SEQ ID NO: 966536 - DNA, 22 bp, Artificial Sequence
  chemically synthesized
aggcagaagaatcacttgaacc

SEQ ID NO: 966537 - DNA, 22 bp, Artificial Sequence
  chemically synthesized
taatttccgccttatgggttca

SEQ ID NO: 966538 - DNA, 22 bp, Artificial Sequence
  chemically synthesized
actgtaatttccgccttatggg

SEQ ID NO: 966539 - DNA, 22 bp, Artificial Sequence
  chemically synthesized
gtctcactgtaatttccgcctt

SEQ ID NO: 966540 - DNA, 22 bp, Artificial Sequence
  chemically synthesized
gaacccataaggcggaaattac

SEQ ID NO: 966541 - DNA, 22 bp, Artificial Sequence
  chemically synthesized
aacccataaggcggaaattaca

SEQ ID NO: 966542 - DNA, 22 bp, Artificial Sequence
  chemically synthesized
gagtgtaatggcacaatctcgt

SEQ ID NO: 966543 - DNA, 22 bp, Artificial Sequence
  chemically synthesized
cagtgagacgagattgtgccat

SEQ ID NO: 966544 - DNA, 22 bp, Artificial Sequence
  chemically synthesized
tccatgttggagtgtaatggca

SEQ ID NO: 966545 - DNA, 22 bp, Artificial Sequence
  chemically synthesized
gttgtccatgttggagtgtaat

SEQ ID NO: 966546 - DNA, 22 bp, Artificial Sequence
  chemically synthesized
tcgttgtccatgttggagtgta

SEQ ID NO: 966547 - DNA, 22 bp, Artificial Sequence
  chemically synthesized
ctctcgttgtccatgttggagt

SEQ ID NO: 966548 - DNA, 22 bp, Artificial Sequence
  chemically synthesized
gctctcgttgtccatgttggag

SEQ ID NO: 966549 - DNA, 22 bp, Artificial Sequence
  chemically synthesized
tgctctcgttgtccatgttgga

SEQ ID NO: 966550 - DNA, 22 bp, Artificial Sequence
  chemically synthesized
tgccattacactccaacatgga

SEQ ID NO: 966551 - DNA, 22 bp, Artificial Sequence
  chemically synthesized
cactccaacatggacaacgaga

SEQ ID NO: 966552 - DNA, 22 bp, Artificial Sequence
  chemically synthesized
gacagaattttgctctcgttgt

SEQ ID NO: 966553 - DNA, 22 bp, Artificial Sequence
  chemically synthesized
agacagaattttgctctcgttg

SEQ ID NO: 966554 - DNA, 22 bp, Artificial Sequence
  chemically synthesized
tagacagaattttgctctcgtt

SEQ ID NO: 966555 - DNA, 22 bp, Artificial Sequence
  chemically synthesized
caacatggacaacgagagcaaa

SEQ ID NO: 966556 - DNA, 22 bp, Artificial Sequence
  chemically synthesized
ttttagacagaattttgctctc

SEQ ID NO: 966557 - DNA, 22 bp, Artificial Sequence
  chemically synthesized
ttattttagacagaattttgct

SEQ ID NO: 966558 - DNA, 22 bp, Artificial Sequence
  chemically synthesized
ttattattttagacagaatttt

SEQ ID NO: 966559 - DNA, 22 bp, Artificial Sequence
  chemically synthesized
ttattattattttagacagaat

SEQ ID NO: 966560 - DNA, 22 bp, Artificial Sequence
  chemically synthesized
ttattattattattttagacag

SEQ ID NO: 966561 - DNA, 22 bp, Artificial Sequence
  chemically synthesized
ttattattattattattttaga

SEQ ID NO: 966562 - DNA, 22 bp, Artificial Sequence
  chemically synthesized
ttattattattattattatttt

SEQ ID NO: 966563 - DNA, 22 bp, Artificial Sequence
  chemically synthesized
ttattattattattattattat

SEQ ID NO: 966564 - DNA, 22 bp, Artificial Sequence
  chemically synthesized
ttgttattattattattattat

SEQ ID NO: 966565 - DNA, 22 bp, Artificial Sequence
  chemically synthesized
tgtctaaaataataataataat

SEQ ID NO: 966566 - DNA, 22 bp, Artificial Sequence
  chemically synthesized
gttgttattattattattatta

SEQ ID NO: 966567 - DNA, 22 bp, Artificial Sequence
  chemically synthesized
tctaaaataataataataataa

SEQ ID NO: 966568 - DNA, 22 bp, Artificial Sequence
  chemically synthesized
tttgttgttattattattatta

SEQ ID NO: 966569 - DNA, 22 bp, Artificial Sequence
  chemically synthesized
atttgttgttattattattatt

SEQ ID NO: 966570 - DNA, 22 bp, Artificial Sequence
  chemically synthesized
tatttgttgttattattattat

SEQ ID NO: 966571 - DNA, 22 bp, Artificial Sequence
  chemically synthesized
aaataataataataataataat

SEQ ID NO: 966572 - DNA, 22 bp, Artificial Sequence
  chemically synthesized
ctttatttgttgttattattat

SEQ ID NO: 966573 - DNA, 22 bp, Artificial Sequence
  chemically synthesized
actttatttgttgttattatta

SEQ ID NO: 966574 - DNA, 22 bp, Artificial Sequence
  chemically synthesized
tactttatttgttgttattatt

SEQ ID NO: 966575 - DNA, 22 bp, Artificial Sequence
  chemically synthesized
ttactttatttgttgttattat

SEQ ID NO: 966576 - DNA, 22 bp, Artificial Sequence
  chemically synthesized
tttttactttatttgttgttat

SEQ ID NO: 966577 - DNA, 22 bp, Artificial Sequence
  chemically synthesized
atttttactttatttgttgtta

SEQ ID NO: 966578 - DNA, 22 bp, Artificial Sequence
  chemically synthesized
tatttttactttatttgttgtt

SEQ ID NO: 966579 - DNA, 22 bp, Artificial Sequence
  chemically synthesized
ttatttttactttatttgttgt

SEQ ID NO: 966580 - DNA, 22 bp, Artificial Sequence
  chemically synthesized
aaacatttttatttttacttta

SEQ ID NO: 966581 - DNA, 22 bp, Artificial Sequence
  chemically synthesized
taaaacatttttatttttactt

SEQ ID NO: 966582 - DNA, 22 bp, Artificial Sequence
  chemically synthesized
ggaaacagactctaaaacattt

SEQ ID NO: 966583 - DNA, 22 bp, Artificial Sequence
  chemically synthesized
tgggaaacagactctaaaacat

SEQ ID NO: 966584 - DNA, 22 bp, Artificial Sequence
  chemically synthesized
tctgggaaacagactctaaaac

SEQ ID NO: 966585 - DNA, 22 bp, Artificial Sequence
  chemically synthesized
ggttctctgggaaacagactct

SEQ ID NO: 966586 - DNA, 22 bp, Artificial Sequence
  chemically synthesized
caggttgggttctctgggaaac

SEQ ID NO: 966587 - DNA, 22 bp, Artificial Sequence
  chemically synthesized
tagagtctgtttcccagagaac

SEQ ID NO: 966588 - DNA, 22 bp, Artificial Sequence
  chemically synthesized
agagtctgtttcccagagaacc

SEQ ID NO: 966589 - DNA, 22 bp, Artificial Sequence
  chemically synthesized
gagtctgtttcccagagaaccc

SEQ ID NO: 966590 - DNA, 22 bp, Artificial Sequence
  chemically synthesized
agtaggtgttacaggttgggtt

SEQ ID NO: 966591 - DNA, 22 bp, Artificial Sequence
  chemically synthesized
tttcccagagaacccaacctgt

SEQ ID NO: 966592 - DNA, 22 bp, Artificial Sequence
  chemically synthesized
cccagagaacccaacctgtaac

SEQ ID NO: 966593 - DNA, 22 bp, Artificial Sequence
  chemically synthesized
ccagagaacccaacctgtaaca

SEQ ID NO: 966594 - DNA, 22 bp, Artificial Sequence
  chemically synthesized
acatactaagtaggtgttacag

SEQ ID NO: 966595 - DNA, 22 bp, Artificial Sequence
  chemically synthesized
gacatactaagtaggtgttaca

SEQ ID NO: 966596 - DNA, 22 bp, Artificial Sequence
  chemically synthesized
tgacatactaagtaggtgttac

SEQ ID NO: 966597 - DNA, 22 bp, Artificial Sequence
  chemically synthesized
ctttgacatactaagtaggtgt

SEQ ID NO: 966598 - DNA, 22 bp, Artificial Sequence
  chemically synthesized
gttgctttgacatactaagtag

SEQ ID NO: 966599 - DNA, 22 bp, Artificial Sequence
  chemically synthesized
ggttgctttgacatactaagta

SEQ ID NO: 966600 - DNA, 22 bp, Artificial Sequence
  chemically synthesized
cttggttgctttgacatactaa

SEQ ID NO: 966601 - DNA, 22 bp, Artificial Sequence
  chemically synthesized
ccttggttgctttgacatacta

SEQ ID NO: 966602 - DNA, 22 bp, Artificial Sequence
  chemically synthesized
taacacctacttagtatgtcaa

SEQ ID NO: 966603 - DNA, 22 bp, Artificial Sequence
  chemically synthesized
acttccttggttgctttgacat

SEQ ID NO: 966604 - DNA, 22 bp, Artificial Sequence
  chemically synthesized
gacttccttggttgctttgaca

SEQ ID NO: 966605 - DNA, 22 bp, Artificial Sequence
  chemically synthesized
cttagtatgtcaaagcaaccaa

SEQ ID NO: 966606 - DNA, 22 bp, Artificial Sequence
  chemically synthesized
agtatgtcaaagcaaccaagga

SEQ ID NO: 966607 - DNA, 22 bp, Artificial Sequence
  chemically synthesized
gtatgtcaaagcaaccaaggaa

SEQ ID NO: 966608 - DNA, 22 bp, Artificial Sequence
  chemically synthesized
acagccaaataaaaagagaaat

SEQ ID NO: 966609 - DNA, 22 bp, Artificial Sequence
  chemically synthesized
ctgacagccaaataaaaagaga

SEQ ID NO: 966610 - DNA, 22 bp, Artificial Sequence
  chemically synthesized
tattatttctctttttatttgg

SEQ ID NO: 966611 - DNA, 22 bp, Artificial Sequence
  chemically synthesized
tttctctttttatttggctgtc

SEQ ID NO: 966612 - DNA, 22 bp, Artificial Sequence
  chemically synthesized
ctctttttatttggctgtcagg

SEQ ID NO: 966613 - DNA, 22 bp, Artificial Sequence
  chemically synthesized
tctttttatttggctgtcagga

SEQ ID NO: 966614 - DNA, 22 bp, Artificial Sequence
  chemically synthesized
tttttatttggctgtcaggagt

SEQ ID NO: 966615 - DNA, 22 bp, Artificial Sequence
  chemically synthesized
tttatttggctgtcaggagttg

SEQ ID NO: 966616 - DNA, 22 bp, Artificial Sequence
  chemically synthesized
ttatttggctgtcaggagttgt

SEQ ID NO: 966617 - DNA, 22 bp, Artificial Sequence
  chemically synthesized
tatttggctgtcaggagttgtg

SEQ ID NO: 966618 - DNA, 22 bp, Artificial Sequence
  chemically synthesized
atttggctgtcaggagttgtgt

SEQ ID NO: 966619 - DNA, 22 bp, Artificial Sequence
  chemically synthesized
tttggctgtcaggagttgtgtt

SEQ ID NO: 966620 - DNA, 22 bp, Artificial Sequence
  chemically synthesized
agatagagtaataaacacaact

SEQ ID NO: 966621 - DNA, 22 bp, Artificial Sequence
  chemically synthesized
ggctgtcaggagttgtgtttat

SEQ ID NO: 966622 - DNA, 22 bp, Artificial Sequence
  chemically synthesized
gctgtcaggagttgtgtttatt

SEQ ID NO: 966623 - DNA, 22 bp, Artificial Sequence
  chemically synthesized
ctcagatagagtaataaacaca

SEQ ID NO: 966624 - DNA, 22 bp, Artificial Sequence
  chemically synthesized
tcaggagttgtgtttattactc

SEQ ID NO: 966625 - DNA, 22 bp, Artificial Sequence
  chemically synthesized
ggctcctcagatagagtaataa

SEQ ID NO: 966626 - DNA, 22 bp, Artificial Sequence
  chemically synthesized
tgggctcctcagatagagtaat

SEQ ID NO: 966627 - DNA, 22 bp, Artificial Sequence
  chemically synthesized
tgtttattactctatctgagga

SEQ ID NO: 966628 - DNA, 22 bp, Artificial Sequence
  chemically synthesized
attactctatctgaggagccca

SEQ ID NO: 966629 - DNA, 22 bp, Artificial Sequence
  chemically synthesized
ttactctatctgaggagcccag

SEQ ID NO: 966630 - DNA, 22 bp, Artificial Sequence
  chemically synthesized
ctctatctgaggagcccagagt

SEQ ID NO: 966631 - DNA, 22 bp, Artificial Sequence
  chemically synthesized
tatctgaggagcccagagtgat

SEQ ID NO: 966632 - DNA, 22 bp, Artificial Sequence
  chemically synthesized
tctgaggagcccagagtgattt

SEQ ID NO: 966633 - DNA, 22 bp, Artificial Sequence
  chemically synthesized
aggagcccagagtgattttacg

SEQ ID NO: 966634 - DNA, 22 bp, Artificial Sequence
  chemically synthesized
caaaaagagatcgtgtacgtaa

SEQ ID NO: 966635 - DNA, 22 bp, Artificial Sequence
  chemically synthesized
tacgtacacgatctctttttgc

SEQ ID NO: 966636 - DNA, 22 bp, Artificial Sequence
  chemically synthesized
acgtacacgatctctttttgca

SEQ ID NO: 966637 - DNA, 22 bp, Artificial Sequence
  chemically synthesized
cgtacacgatctctttttgcag

SEQ ID NO: 966638 - DNA, 22 bp, Artificial Sequence
  chemically synthesized
agaacatgtaatatgaaactgc

SEQ ID NO: 966639 - DNA, 22 bp, Artificial Sequence
  chemically synthesized
tttttgcagtttcatattacat

SEQ ID NO: 966640 - DNA, 22 bp, Artificial Sequence
  chemically synthesized
tttgcagtttcatattacatgt

SEQ ID NO: 966641 - DNA, 22 bp, Artificial Sequence
  chemically synthesized
aagcaactaagaacatgtaata

SEQ ID NO: 966642 - DNA, 22 bp, Artificial Sequence
  chemically synthesized
ttgcagtttcatattacatgtt

SEQ ID NO: 966643 - DNA, 22 bp, Artificial Sequence
  chemically synthesized
tgcagtttcatattacatgttc

SEQ ID NO: 966644 - DNA, 22 bp, Artificial Sequence
  chemically synthesized
gcagtttcatattacatgttct

SEQ ID NO: 966645 - DNA, 22 bp, Artificial Sequence
  chemically synthesized
cagtttcatattacatgttctt

SEQ ID NO: 966646 - DNA, 22 bp, Artificial Sequence
  chemically synthesized
gttaaagcaactaagaacatgt

SEQ ID NO: 966647 - DNA, 22 bp, Artificial Sequence
  chemically synthesized
catattacatgttcttagttgc

SEQ ID NO: 966648 - DNA, 22 bp, Artificial Sequence
  chemically synthesized
atattacatgttcttagttgct

SEQ ID NO: 966649 - DNA, 22 bp, Artificial Sequence
  chemically synthesized
agcagtcatctagttaaagcaa

SEQ ID NO: 966650 - DNA, 22 bp, Artificial Sequence
  chemically synthesized
catgttcttagttgctttaact

SEQ ID NO: 966651 - DNA, 22 bp, Artificial Sequence
  chemically synthesized
ctcagcagtcatctagttaaag

SEQ ID NO: 966652 - DNA, 22 bp, Artificial Sequence
  chemically synthesized
ttagttgctttaactagatgac

SEQ ID NO: 966653 - DNA, 22 bp, Artificial Sequence
  chemically synthesized
agttgctttaactagatgactg

SEQ ID NO: 966654 - DNA, 22 bp, Artificial Sequence
  chemically synthesized
gttgctttaactagatgactgc

SEQ ID NO: 966655 - DNA, 22 bp, Artificial Sequence
  chemically synthesized
gatgcctgctcagcagtcatct

SEQ ID NO: 966656 - DNA, 22 bp, Artificial Sequence
  chemically synthesized
ctttaactagatgactgctgag

SEQ ID NO: 966657 - DNA, 22 bp, Artificial Sequence
  chemically synthesized
taactagatgactgctgagcag

SEQ ID NO: 966658 - DNA, 22 bp, Artificial Sequence
  chemically synthesized
aactagatgactgctgagcagg

SEQ ID NO: 966659 - DNA, 22 bp, Artificial Sequence
  chemically synthesized
actagatgactgctgagcaggc

SEQ ID NO: 966660 - DNA, 22 bp, Artificial Sequence
  chemically synthesized
gatgactgctgagcaggcatct

SEQ ID NO: 966661 - DNA, 22 bp, Artificial Sequence
  chemically synthesized
agtggagatggcctagatgcct

SEQ ID NO: 966662 - DNA, 22 bp, Artificial Sequence
  chemically synthesized
cagtggagatggcctagatgcc

SEQ ID NO: 966663 - DNA, 22 bp, Artificial Sequence
  chemically synthesized
ctgagcaggcatctaggccatc

SEQ ID NO: 966664 - DNA, 22 bp, Artificial Sequence
  chemically synthesized
agcaggcatctaggccatctcc

SEQ ID NO: 966665 - DNA, 22 bp, Artificial Sequence
  chemically synthesized
cacgacttcagtggagatggcc

SEQ ID NO: 966666 - DNA, 22 bp, Artificial Sequence
  chemically synthesized
gaagaggttgcacgacttcagt

SEQ ID NO: 966667 - DNA, 22 bp, Artificial Sequence
  chemically synthesized
ggccatctccactgaagtcgtg

SEQ ID NO: 966668 - DNA, 22 bp, Artificial Sequence
  chemically synthesized
tattggaagaggttgcacgact

SEQ ID NO: 966669 - DNA, 22 bp, Artificial Sequence
  chemically synthesized
cactgaagtcgtgcaacctctt

SEQ ID NO: 966670 - DNA, 22 bp, Artificial Sequence
  chemically synthesized
gagttgtattggaagaggttgc

SEQ ID NO: 966671 - DNA, 22 bp, Artificial Sequence
  chemically synthesized
ctggagttgtattggaagaggt

SEQ ID NO: 966672 - DNA, 22 bp, Artificial Sequence
  chemically synthesized
aagtcgtgcaacctcttccaat

SEQ ID NO: 966673 - DNA, 22 bp, Artificial Sequence
  chemically synthesized
cctgctggagttgtattggaag

SEQ ID NO: 966674 - DNA, 22 bp, Artificial Sequence
  chemically synthesized
gctgcctgctggagttgtattg

SEQ ID NO: 966675 - DNA, 22 bp, Artificial Sequence
  chemically synthesized
caaacctggctgcctgctggag

SEQ ID NO: 966676 - DNA, 22 bp, Artificial Sequence
  chemically synthesized
ttccaatacaactccagcaggc

SEQ ID NO: 966677 - DNA, 22 bp, Artificial Sequence
  chemically synthesized
ccaaacctggctgcctgctgga

SEQ ID NO: 966678 - DNA, 22 bp, Artificial Sequence
  chemically synthesized
ccaatacaactccagcaggcag

SEQ ID NO: 966679 - DNA, 22 bp, Artificial Sequence
  chemically synthesized
caatacaactccagcaggcagc

SEQ ID NO: 966680 - DNA, 22 bp, Artificial Sequence
  chemically synthesized
cagcaggcagccaggtttggaa

SEQ ID NO: 966681 - DNA, 22 bp, Artificial Sequence
  chemically synthesized
gatgtaatggaatagagtactt

SEQ ID NO: 966682 - DNA, 22 bp, Artificial Sequence
  chemically synthesized
agatgtaatggaatagagtact

SEQ ID NO: 966683 - DNA, 22 bp, Artificial Sequence
  chemically synthesized
tagatgtaatggaatagagtac

SEQ ID NO: 966684 - DNA, 22 bp, Artificial Sequence
  chemically synthesized
ttagatgtaatggaatagagta

SEQ ID NO: 966685 - DNA, 22 bp, Artificial Sequence
  chemically synthesized
tttagatgtaatggaatagagt

SEQ ID NO: 966686 - DNA, 22 bp, Artificial Sequence
  chemically synthesized
ggaagtactctattccattaca

SEQ ID NO: 966687 - DNA, 22 bp, Artificial Sequence
  chemically synthesized
gaagtactctattccattacat

SEQ ID NO: 966688 - DNA, 22 bp, Artificial Sequence
  chemically synthesized
tattccattacatctaaaaagt

SEQ ID NO: 966689 - DNA, 22 bp, Artificial Sequence
  chemically synthesized
ttccattacatctaaaaagtat

SEQ ID NO: 966690 - DNA, 22 bp, Artificial Sequence
  chemically synthesized
gaaaacaaaaggcatacttttt

SEQ ID NO: 966691 - DNA, 22 bp, Artificial Sequence
  chemically synthesized
cattacatctaaaaagtatgcc

SEQ ID NO: 966692 - DNA, 22 bp, Artificial Sequence
  chemically synthesized
tctcgaaaacaaaaggcatact

SEQ ID NO: 966693 - DNA, 22 bp, Artificial Sequence
  chemically synthesized
catctaaaaagtatgccttttg

SEQ ID NO: 966694 - DNA, 22 bp, Artificial Sequence
  chemically synthesized
aaaagtatgccttttgttttcg

SEQ ID NO: 966695 - DNA, 22 bp, Artificial Sequence
  chemically synthesized
ggtgacagagtgagatcctgtc

SEQ ID NO: 966696 - DNA, 22 bp, Artificial Sequence
  chemically synthesized
ttgttttcgagacaggatctca

SEQ ID NO: 966697 - DNA, 22 bp, Artificial Sequence
  chemically synthesized
tgttttcgagacaggatctcac

SEQ ID NO: 966698 - DNA, 22 bp, Artificial Sequence
  chemically synthesized
gttttcgagacaggatctcact

SEQ ID NO: 966699 - DNA, 22 bp, Artificial Sequence
  chemically synthesized
ttttcgagacaggatctcactc

SEQ ID NO: 966700 - DNA, 22 bp, Artificial Sequence
  chemically synthesized
cagcctgggtgacagagtgaga

SEQ ID NO: 966701 - DNA, 22 bp, Artificial Sequence
  chemically synthesized
tcgagacaggatctcactctgt

SEQ ID NO: 966702 - DNA, 22 bp, Artificial Sequence
  chemically synthesized
cgagacaggatctcactctgtc

SEQ ID NO: 966703 - DNA, 22 bp, Artificial Sequence
  chemically synthesized
gagacaggatctcactctgtca

SEQ ID NO: 966704 - DNA, 22 bp, Artificial Sequence
  chemically synthesized
cactccagcctgggtgacagag

SEQ ID NO: 966705 - DNA, 22 bp, Artificial Sequence
  chemically synthesized
ccactgcactccagcctgggtg

SEQ ID NO: 966706 - DNA, 22 bp, Artificial Sequence
  chemically synthesized
ctgccactgcactccagcctgg

SEQ ID NO: 966707 - DNA, 22 bp, Artificial Sequence
  chemically synthesized
actctgtcacccaggctggagt

SEQ ID NO: 966708 - DNA, 22 bp, Artificial Sequence
  chemically synthesized
cctcctgccactgcactccagc

SEQ ID NO: 966709 - DNA, 22 bp, Artificial Sequence
  chemically synthesized
tgtcacccaggctggagtgcag

SEQ ID NO: 966710 - DNA, 22 bp, Artificial Sequence
  chemically synthesized
tcacccaggctggagtgcagtg

SEQ ID NO: 966711 - DNA, 22 bp, Artificial Sequence
  chemically synthesized
tgctccctcctgccactgcact

SEQ ID NO: 966712 - DNA, 22 bp, Artificial Sequence
  chemically synthesized
tggtgagctgtgctccctcctg

SEQ ID NO: 966713 - DNA, 22 bp, Artificial Sequence
  chemically synthesized
gagtgcagtggcaggagggagc

SEQ ID NO: 966714 - DNA, 22 bp, Artificial Sequence
  chemically synthesized
agcccatgaggtcaagtctatg

SEQ ID NO: 966715 - DNA, 22 bp, Artificial Sequence
  chemically synthesized
gagcccatgaggtcaagtctat

SEQ ID NO: 966716 - DNA, 22 bp, Artificial Sequence
  chemically synthesized
accatagacttgacctcatggg

SEQ ID NO: 966717 - DNA, 22 bp, Artificial Sequence
  chemically synthesized
agatgggagaatcgtttgagcc

SEQ ID NO: 966718 - DNA, 22 bp, Artificial Sequence
  chemically synthesized
gacctcatgggctcaaacgatt

SEQ ID NO: 966719 - DNA, 22 bp, Artificial Sequence
  chemically synthesized
acctcatgggctcaaacgattc

SEQ ID NO: 966720 - DNA, 22 bp, Artificial Sequence
  chemically synthesized
atgggctcaaacgattctccca

SEQ ID NO: 966721 - DNA, 22 bp, Artificial Sequence
  chemically synthesized
aggaggctgagatgggagaatc

SEQ ID NO: 966722 - DNA, 22 bp, Artificial Sequence
  chemically synthesized
ctcaggaggctgagatgggaga

SEQ ID NO: 966723 - DNA, 22 bp, Artificial Sequence
  chemically synthesized
aaacgattctcccatctcagcc

SEQ ID NO: 966724 - DNA, 22 bp, Artificial Sequence
  chemically synthesized
tagccccagctactcaggaggc

SEQ ID NO: 966725 - DNA, 22 bp, Artificial Sequence
  chemically synthesized
tcccatctcagcctcctgagta

SEQ ID NO: 966726 - DNA, 22 bp, Artificial Sequence
  chemically synthesized
ccatctcagcctcctgagtagc

SEQ ID NO: 966727 - DNA, 22 bp, Artificial Sequence
  chemically synthesized
agcctcctgagtagctggggct

SEQ ID NO: 966728 - DNA, 22 bp, Artificial Sequence
  chemically synthesized
ctgagtagctggggctacaggg

SEQ ID NO: 966729 - DNA, 22 bp, Artificial Sequence
  chemically synthesized
agtagctggggctacaggggca

SEQ ID NO: 966730 - DNA, 22 bp, Artificial Sequence
  chemically synthesized
gggctacaggggcacactacct

SEQ ID NO: 966731 - DNA, 22 bp, Artificial Sequence
  chemically synthesized
caggggcacactacctcgcccg

SEQ ID NO: 966732 - DNA, 22 bp, Artificial Sequence
  chemically synthesized
cctcgcccggctatctatctat

SEQ ID NO: 966733 - DNA, 22 bp, Artificial Sequence
  chemically synthesized
gcccggctatctatctatctat

SEQ ID NO: 966734 - DNA, 22 bp, Artificial Sequence
  chemically synthesized
tctatctatctatctatctatc

SEQ ID NO: 966735 - DNA, 22 bp, Artificial Sequence
  chemically synthesized
tctatctatctatctatctatc

SEQ ID NO: 966736 - DNA, 22 bp, Artificial Sequence
  chemically synthesized
tctatctatctatctatctatc

SEQ ID NO: 966737 - DNA, 22 bp, Artificial Sequence
  chemically synthesized
tctatctatctatctatctatc

SEQ ID NO: 966738 - DNA, 22 bp, Artificial Sequence
  chemically synthesized
caaaatagatagatagatagat

SEQ ID NO: 966739 - DNA, 22 bp, Artificial Sequence
  chemically synthesized
tctatctatctatctatctatc

SEQ ID NO: 966740 - DNA, 22 bp, Artificial Sequence
  chemically synthesized
tacaaaatagatagatagatag

SEQ ID NO: 966741 - DNA, 22 bp, Artificial Sequence
  chemically synthesized
tctatctatctatctatctatc

SEQ ID NO: 966742 - DNA, 22 bp, Artificial Sequence
  chemically synthesized
atctctacaaaatagatagata

SEQ ID NO: 966743 - DNA, 22 bp, Artificial Sequence
  chemically synthesized
tctatctatctatctatctatt

SEQ ID NO: 966744 - DNA, 22 bp, Artificial Sequence
  chemically synthesized
tctatctatctatctattttgt

SEQ ID NO: 966745 - DNA, 22 bp, Artificial Sequence
  chemically synthesized
tctatctatctattttgtagag

SEQ ID NO: 966746 - DNA, 22 bp, Artificial Sequence
  chemically synthesized
tctatctattttgtagagatga

SEQ ID NO: 966747 - DNA, 22 bp, Artificial Sequence
  chemically synthesized
agtaaaataggcctcatctcta

SEQ ID NO: 966748 - DNA, 22 bp, Artificial Sequence
  chemically synthesized
tctattttgtagagatgaggcc

SEQ ID NO: 966749 - DNA, 22 bp, Artificial Sequence
  chemically synthesized
ttttgtagagatgaggcctatt

SEQ ID NO: 966750 - DNA, 22 bp, Artificial Sequence
  chemically synthesized
tgtagagatgaggcctatttta

SEQ ID NO: 966751 - DNA, 22 bp, Artificial Sequence
  chemically synthesized
gtagagatgaggcctattttac

SEQ ID NO: 966752 - DNA, 22 bp, Artificial Sequence
  chemically synthesized
tagagatgaggcctattttact

SEQ ID NO: 966753 - DNA, 22 bp, Artificial Sequence
  chemically synthesized
aagaccagcctgagtaaaatag

SEQ ID NO: 966754 - DNA, 22 bp, Artificial Sequence
  chemically synthesized
gcagttcaagaccagcctgagt

SEQ ID NO: 966755 - DNA, 22 bp, Artificial Sequence
  chemically synthesized
aggctagcagttcaagaccagc

SEQ ID NO: 966756 - DNA, 22 bp, Artificial Sequence
  chemically synthesized
gaggctagcagttcaagaccag

SEQ ID NO: 966757 - DNA, 22 bp, Artificial Sequence
  chemically synthesized
ttttactcaggctggtcttgaa

SEQ ID NO: 966758 - DNA, 22 bp, Artificial Sequence
  chemically synthesized
tactcaggctggtcttgaactg

SEQ ID NO: 966759 - DNA, 22 bp, Artificial Sequence
  chemically synthesized
actcaggctggtcttgaactgc

SEQ ID NO: 966760 - DNA, 22 bp, Artificial Sequence
  chemically synthesized
ctcaggctggtcttgaactgct

SEQ ID NO: 966761 - DNA, 22 bp, Artificial Sequence
  chemically synthesized
aggctggtcttgaactgctagc

SEQ ID NO: 966762 - DNA, 22 bp, Artificial Sequence
  chemically synthesized
gtcttgaactgctagcctcaag

SEQ ID NO: 966763 - DNA, 22 bp, Artificial Sequence
  chemically synthesized
tggtgtaaggatcgcttgaggc

SEQ ID NO: 966764 - DNA, 22 bp, Artificial Sequence
  chemically synthesized
gaactgctagcctcaagcgatc

SEQ ID NO: 966765 - DNA, 22 bp, Artificial Sequence
  chemically synthesized
aactgctagcctcaagcgatcc

SEQ ID NO: 966766 - DNA, 22 bp, Artificial Sequence
  chemically synthesized
gggggctgtggtgtaaggatcg

SEQ ID NO: 966767 - DNA, 22 bp, Artificial Sequence
  chemically synthesized
ctagcctcaagcgatccttaca

SEQ ID NO: 966768 - DNA, 22 bp, Artificial Sequence
  chemically synthesized
gcctcaagcgatccttacacca

SEQ ID NO: 966769 - DNA, 22 bp, Artificial Sequence
  chemically synthesized
aagcgatccttacaccacagcc

SEQ ID NO: 966770 - DNA, 22 bp, Artificial Sequence
  chemically synthesized
gtaatcccaacactggggggct

SEQ ID NO: 966771 - DNA, 22 bp, Artificial Sequence
  chemically synthesized
acaccacagccccccagtgttg

SEQ ID NO: 966772 - DNA, 22 bp, Artificial Sequence
  chemically synthesized
caccacagccccccagtgttgg

SEQ ID NO: 966773 - DNA, 22 bp, Artificial Sequence
  chemically synthesized
acactagtaatcccaacactgg

SEQ ID NO: 966774 - DNA, 22 bp, Artificial Sequence
  chemically synthesized
ggattactagtgtgaggcactg

SEQ ID NO: 966775 - DNA, 22 bp, Artificial Sequence
  chemically synthesized
ctagtgtgaggcactgcacctg

SEQ ID NO: 966776 - DNA, 22 bp, Artificial Sequence
  chemically synthesized
gtgtgaggcactgcacctggcc

SEQ ID NO: 966777 - DNA, 22 bp, Artificial Sequence
  chemically synthesized
cacctggccattatttcctttt

SEQ ID NO: 966778 - DNA, 22 bp, Artificial Sequence
  chemically synthesized
gccattatttccttttgttatt

SEQ ID NO: 966779 - DNA, 22 bp, Artificial Sequence
  chemically synthesized
tttccttttgttatttccactc

SEQ ID NO: 966780 - DNA, 22 bp, Artificial Sequence
  chemically synthesized
ccttttgttatttccactcatt

SEQ ID NO: 966781 - DNA, 22 bp, Artificial Sequence
  chemically synthesized
cttttgttatttccactcattt

SEQ ID NO: 966782 - DNA, 22 bp, Artificial Sequence
  chemically synthesized
ttgttatttccactcatttgtt

SEQ ID NO: 966783 - DNA, 22 bp, Artificial Sequence
  chemically synthesized
tgttatttccactcatttgttt

SEQ ID NO: 966784 - DNA, 22 bp, Artificial Sequence
  chemically synthesized
gttatttccactcatttgtttt

SEQ ID NO: 966785 - DNA, 22 bp, Artificial Sequence
  chemically synthesized
ttatttccactcatttgtttta

SEQ ID NO: 966786 - DNA, 22 bp, Artificial Sequence
  chemically synthesized
agaaagggagcaataaaacaaa

SEQ ID NO: 966787 - DNA, 22 bp, Artificial Sequence
  chemically synthesized
tttccactcatttgttttattg

SEQ ID NO: 966788 - DNA, 22 bp, Artificial Sequence
  chemically synthesized
ctcagaaagggagcaataaaac

SEQ ID NO: 966789 - DNA, 22 bp, Artificial Sequence
  chemically synthesized
gctcagaaagggagcaataaaa

SEQ ID NO: 966790 - DNA, 22 bp, Artificial Sequence
  chemically synthesized
ccactcatttgttttattgctc

SEQ ID NO: 966791 - DNA, 22 bp, Artificial Sequence
  chemically synthesized
tgctcagaaagggagcaataaa

SEQ ID NO: 966792 - DNA, 22 bp, Artificial Sequence
  chemically synthesized
cactcatttgttttattgctcc

SEQ ID NO: 966793 - DNA, 22 bp, Artificial Sequence
  chemically synthesized
atttgttttattgctccctttc

SEQ ID NO: 966794 - DNA, 22 bp, Artificial Sequence
  chemically synthesized
gttttattgctccctttctgag

SEQ ID NO: 966795 - DNA, 22 bp, Artificial Sequence
  chemically synthesized
ttttattgctccctttctgagc

SEQ ID NO: 966796 - DNA, 22 bp, Artificial Sequence
  chemically synthesized
aagcatcatctttgctcagaaa

SEQ ID NO: 966797 - DNA, 22 bp, Artificial Sequence
  chemically synthesized
tattgctccctttctgagcaaa

SEQ ID NO: 966798 - DNA, 22 bp, Artificial Sequence
  chemically synthesized
attgctccctttctgagcaaag

SEQ ID NO: 966799 - DNA, 22 bp, Artificial Sequence
  chemically synthesized
ttgctccctttctgagcaaaga

SEQ ID NO: 966800 - DNA, 22 bp, Artificial Sequence
  chemically synthesized
ctccctttctgagcaaagatga

SEQ ID NO: 966801 - DNA, 22 bp, Artificial Sequence
  chemically synthesized
cctttctgagcaaagatgatgc

SEQ ID NO: 966802 - DNA, 22 bp, Artificial Sequence
  chemically synthesized
caaaggatgttaaagcatcatc

SEQ ID NO: 966803 - DNA, 22 bp, Artificial Sequence
  chemically synthesized
acaaaggatgttaaagcatcat

SEQ ID NO: 966804 - DNA, 22 bp, Artificial Sequence
  chemically synthesized
tctgagcaaagatgatgcttta

SEQ ID NO: 966805 - DNA, 22 bp, Artificial Sequence
  chemically synthesized
tacaaaggatgttaaagcatca

SEQ ID NO: 966806 - DNA, 22 bp, Artificial Sequence
  chemically synthesized
ctgagcaaagatgatgctttaa

SEQ ID NO: 966807 - DNA, 22 bp, Artificial Sequence
  chemically synthesized
ttacaaaggatgttaaagcatc

SEQ ID NO: 966808 - DNA, 22 bp, Artificial Sequence
  chemically synthesized
tgagcaaagatgatgctttaac

SEQ ID NO: 966809 - DNA, 22 bp, Artificial Sequence
  chemically synthesized
tttacaaaggatgttaaagcat

SEQ ID NO: 966810 - DNA, 22 bp, Artificial Sequence
  chemically synthesized
agcaaagatgatgctttaacat

SEQ ID NO: 966811 - DNA, 22 bp, Artificial Sequence
  chemically synthesized
ttttttacaaaggatgttaaag

SEQ ID NO: 966812 - DNA, 22 bp, Artificial Sequence
  chemically synthesized
aaaggctgttttttacaaagga

SEQ ID NO: 966813 - DNA, 22 bp, Artificial Sequence
  chemically synthesized
acctcaaaggctgttttttaca

SEQ ID NO: 966814 - DNA, 22 bp, Artificial Sequence
  chemically synthesized
taacatcctttgtaaaaaacag

SEQ ID NO: 966815 - DNA, 22 bp, Artificial Sequence
  chemically synthesized
aacatcctttgtaaaaaacagc

SEQ ID NO: 966816 - DNA, 22 bp, Artificial Sequence
  chemically synthesized
acatcctttgtaaaaaacagcc

SEQ ID NO: 966817 - DNA, 22 bp, Artificial Sequence
  chemically synthesized
tgtaaaaaacagcctttgaggt

SEQ ID NO: 966818 - DNA, 22 bp, Artificial Sequence
  chemically synthesized
gtaaaaaacagcctttgaggtt

SEQ ID NO: 966819 - DNA, 22 bp, Artificial Sequence
  chemically synthesized
taaaaaacagcctttgaggtta

SEQ ID NO: 966820 - DNA, 22 bp, Artificial Sequence
  chemically synthesized
agaagtagatgtatgttaacct

SEQ ID NO: 966821 - DNA, 22 bp, Artificial Sequence
  chemically synthesized
tgaggttaacatacatctactt

SEQ ID NO: 966822 - DNA, 22 bp, Artificial Sequence
  chemically synthesized
gaggttaacatacatctacttc

SEQ ID NO: 966823 - DNA, 22 bp, Artificial Sequence
  chemically synthesized
taggaaaactgagaagtagatg

SEQ ID NO: 966824 - DNA, 22 bp, Artificial Sequence
  chemically synthesized
aggttaacatacatctacttct

SEQ ID NO: 966825 - DNA, 22 bp, Artificial Sequence
  chemically synthesized
gttgtaggaaaactgagaagta

SEQ ID NO: 966826 - DNA, 22 bp, Artificial Sequence
  chemically synthesized
acatacatctacttctcagttt

SEQ ID NO: 966827 - DNA, 22 bp, Artificial Sequence
  chemically synthesized
cttctcagttttcctacaacta

SEQ ID NO: 966828 - DNA, 22 bp, Artificial Sequence
  chemically synthesized
ctcagttttcctacaactagat

SEQ ID NO: 966829 - DNA, 22 bp, Artificial Sequence
  chemically synthesized
tcagttttcctacaactagatt

SEQ ID NO: 966830 - DNA, 22 bp, Artificial Sequence
  chemically synthesized
catggggtagaaaaatctagtt

SEQ ID NO: 966831 - DNA, 22 bp, Artificial Sequence
  chemically synthesized
agttttcctacaactagatttt

SEQ ID NO: 966832 - DNA, 22 bp, Artificial Sequence
  chemically synthesized
tccatggggtagaaaaatctag

SEQ ID NO: 966833 - DNA, 22 bp, Artificial Sequence
  chemically synthesized
ctccatggggtagaaaaatcta

SEQ ID NO: 966834 - DNA, 22 bp, Artificial Sequence
  chemically synthesized
tcctacaactagatttttctac

SEQ ID NO: 966835 - DNA, 22 bp, Artificial Sequence
  chemically synthesized
tttctccatggggtagaaaaat

SEQ ID NO: 966836 - DNA, 22 bp, Artificial Sequence
  chemically synthesized
cctacaactagatttttctacc

SEQ ID NO: 966837 - DNA, 22 bp, Artificial Sequence
  chemically synthesized
ctacaactagatttttctaccc

SEQ ID NO: 966838 - DNA, 22 bp, Artificial Sequence
  chemically synthesized
caactagatttttctaccccat

SEQ ID NO: 966839 - DNA, 22 bp, Artificial Sequence
  chemically synthesized
agactatttctccatggggtag

SEQ ID NO: 966840 - DNA, 22 bp, Artificial Sequence
  chemically synthesized
gatttttctaccccatggagaa

SEQ ID NO: 966841 - DNA, 22 bp, Artificial Sequence
  chemically synthesized
taattgagactatttctccatg

SEQ ID NO: 966842 - DNA, 22 bp, Artificial Sequence
  chemically synthesized
ttctaccccatggagaaatagt

SEQ ID NO: 966843 - DNA, 22 bp, Artificial Sequence
  chemically synthesized
gttgtaattgagactatttctc

SEQ ID NO: 966844 - DNA, 22 bp, Artificial Sequence
  chemically synthesized
tctaccccatggagaaatagtc

SEQ ID NO: 966845 - DNA, 22 bp, Artificial Sequence
  chemically synthesized
ctaccccatggagaaatagtct

SEQ ID NO: 966846 - DNA, 22 bp, Artificial Sequence
  chemically synthesized
taccccatggagaaatagtctc

SEQ ID NO: 966847 - DNA, 22 bp, Artificial Sequence
  chemically synthesized
ccccatggagaaatagtctcaa

SEQ ID NO: 966848 - DNA, 22 bp, Artificial Sequence
  chemically synthesized
ggactagttgtaattgagacta

SEQ ID NO: 966849 - DNA, 22 bp, Artificial Sequence
  chemically synthesized
aggactagttgtaattgagact

SEQ ID NO: 966850 - DNA, 22 bp, Artificial Sequence
  chemically synthesized
atcttaggactagttgtaattg

SEQ ID NO: 966851 - DNA, 22 bp, Artificial Sequence
  chemically synthesized
aattacaactagtcctaagatc

SEQ ID NO: 966852 - DNA, 22 bp, Artificial Sequence
  chemically synthesized
caactagtcctaagatcagctc

SEQ ID NO: 966853 - DNA, 22 bp, Artificial Sequence
  chemically synthesized
gtcctaagatcagctctttggg

SEQ ID NO: 966854 - DNA, 22 bp, Artificial Sequence
  chemically synthesized
aataatcaaatagccccaaaga

SEQ ID NO: 966855 - DNA, 22 bp, Artificial Sequence
  chemically synthesized
gaataatcaaatagccccaaag

SEQ ID NO: 966856 - DNA, 22 bp, Artificial Sequence
  chemically synthesized
tgaataatcaaatagccccaaa

SEQ ID NO: 966857 - DNA, 22 bp, Artificial Sequence
  chemically synthesized
ttgaataatcaaatagccccaa

SEQ ID NO: 966858 - DNA, 22 bp, Artificial Sequence
  chemically synthesized
agatcagctctttggggctatt

SEQ ID NO: 966859 - DNA, 22 bp, Artificial Sequence
  chemically synthesized
cataggacttttgaataatcaa

SEQ ID NO: 966860 - DNA, 22 bp, Artificial Sequence
  chemically synthesized
tttggggctatttgattattca

SEQ ID NO: 966861 - DNA, 22 bp, Artificial Sequence
  chemically synthesized
acataggacttttgaataatca

SEQ ID NO: 966862 - DNA, 22 bp, Artificial Sequence
  chemically synthesized
tggggctatttgattattcaaa

SEQ ID NO: 966863 - DNA, 22 bp, Artificial Sequence
  chemically synthesized
ggggctatttgattattcaaaa

SEQ ID NO: 966864 - DNA, 22 bp, Artificial Sequence
  chemically synthesized
gggctatttgattattcaaaag

SEQ ID NO: 966865 - DNA, 22 bp, Artificial Sequence
  chemically synthesized
aatttacataggacttttgaat

SEQ ID NO: 966866 - DNA, 22 bp, Artificial Sequence
  chemically synthesized
caatttacataggacttttgaa

SEQ ID NO: 966867 - DNA, 22 bp, Artificial Sequence
  chemically synthesized
tttgattattcaaaagtcctat

SEQ ID NO: 966868 - DNA, 22 bp, Artificial Sequence
  chemically synthesized
ggtcttcaatttacataggact

SEQ ID NO: 966869 - DNA, 22 bp, Artificial Sequence
  chemically synthesized
gattattcaaaagtcctatgta

SEQ ID NO: 966870 - DNA, 22 bp, Artificial Sequence
  chemically synthesized
aggtcttcaatttacataggac

SEQ ID NO: 966871 - DNA, 22 bp, Artificial Sequence
  chemically synthesized
attattcaaaagtcctatgtaa

SEQ ID NO: 966872 - DNA, 22 bp, Artificial Sequence
  chemically synthesized
taggtcttcaatttacatagga

SEQ ID NO: 966873 - DNA, 22 bp, Artificial Sequence
  chemically synthesized
ttcaaaagtcctatgtaaattg

SEQ ID NO: 966874 - DNA, 22 bp, Artificial Sequence
  chemically synthesized
tcctttaggtcttcaatttaca

SEQ ID NO: 966875 - DNA, 22 bp, Artificial Sequence
  chemically synthesized
atcctttaggtcttcaatttac

SEQ ID NO: 966876 - DNA, 22 bp, Artificial Sequence
  chemically synthesized
aaaagtcctatgtaaattgaag

SEQ ID NO: 966877 - DNA, 22 bp, Artificial Sequence
  chemically synthesized
tatcctttaggtcttcaattta

SEQ ID NO: 966878 - DNA, 22 bp, Artificial Sequence
  chemically synthesized
ttatcctttaggtcttcaattt

SEQ ID NO: 966879 - DNA, 22 bp, Artificial Sequence
  chemically synthesized
tttatcctttaggtcttcaatt

SEQ ID NO: 966880 - DNA, 22 bp, Artificial Sequence
  chemically synthesized
tgtaaattgaagacctaaagga

SEQ ID NO: 966881 - DNA, 22 bp, Artificial Sequence
  chemically synthesized
ggagggatctttttatccttta

SEQ ID NO: 966882 - DNA, 22 bp, Artificial Sequence
  chemically synthesized
aagacctaaaggataaaaagat

SEQ ID NO: 966883 - DNA, 22 bp, Artificial Sequence
  chemically synthesized
aaggataaaaagatccctccca

SEQ ID NO: 966884 - DNA, 22 bp, Artificial Sequence
  chemically synthesized
atcacacatgtaggggaggtat

SEQ ID NO: 966885 - DNA, 22 bp, Artificial Sequence
  chemically synthesized
catcacacatgtaggggaggta

SEQ ID NO: 966886 - DNA, 22 bp, Artificial Sequence
  chemically synthesized
tcatcacacatgtaggggaggt

SEQ ID NO: 966887 - DNA, 22 bp, Artificial Sequence
  chemically synthesized
ccaaccatacctcccctacatg

SEQ ID NO: 966888 - DNA, 22 bp, Artificial Sequence
  chemically synthesized
aagctttcatcacacatgtagg

SEQ ID NO: 966889 - DNA, 22 bp, Artificial Sequence
  chemically synthesized
agctgaagctttcatcacacat

SEQ ID NO: 966890 - DNA, 22 bp, Artificial Sequence
  chemically synthesized
gctcagctgaagctttcatcac

SEQ ID NO: 966891 - DNA, 22 bp, Artificial Sequence
  chemically synthesized
ccctacatgtgtgatgaaagct

SEQ ID NO: 966892 - DNA, 22 bp, Artificial Sequence
  chemically synthesized
catgtgtgatgaaagcttcagc

SEQ ID NO: 966893 - DNA, 22 bp, Artificial Sequence
  chemically synthesized
aaggggccatctagctcagctg

SEQ ID NO: 966894 - DNA, 22 bp, Artificial Sequence
  chemically synthesized
cagctgagctagatggcccctt

SEQ ID NO: 966895 - DNA, 22 bp, Artificial Sequence
  chemically synthesized
aaaacaccattaaaggggccat

SEQ ID NO: 966896 - DNA, 22 bp, Artificial Sequence
  chemically synthesized
agctgagctagatggccccttt

SEQ ID NO: 966897 - DNA, 22 bp, Artificial Sequence
  chemically synthesized
agctagatggcccctttaatgg

SEQ ID NO: 966898 - DNA, 22 bp, Artificial Sequence
  chemically synthesized
gatggcccctttaatggtgttt

SEQ ID NO: 966899 - DNA, 22 bp, Artificial Sequence
  chemically synthesized
taatggtgtttttaatttatac

SEQ ID NO: 966900 - DNA, 22 bp, Artificial Sequence
  chemically synthesized
catcaagagcaggtataaatta

SEQ ID NO: 966901 - DNA, 22 bp, Artificial Sequence
  chemically synthesized
aatggtgtttttaatttatacc

SEQ ID NO: 966902 - DNA, 22 bp, Artificial Sequence
  chemically synthesized
ccatcaagagcaggtataaatt

SEQ ID NO: 966903 - DNA, 22 bp, Artificial Sequence
  chemically synthesized
atggtgtttttaatttatacct

SEQ ID NO: 966904 - DNA, 22 bp, Artificial Sequence
  chemically synthesized
ttccatcaagagcaggtataaa

SEQ ID NO: 966905 - DNA, 22 bp, Artificial Sequence
  chemically synthesized
tcttccatcaagagcaggtata

SEQ ID NO: 966906 - DNA, 22 bp, Artificial Sequence
  chemically synthesized
ctcttccatcaagagcaggtat

SEQ ID NO: 966907 - DNA, 22 bp, Artificial Sequence
  chemically synthesized
tctcttccatcaagagcaggta

SEQ ID NO: 966908 - DNA, 22 bp, Artificial Sequence
  chemically synthesized
ttttctcttccatcaagagcag

SEQ ID NO: 966909 - DNA, 22 bp, Artificial Sequence
  chemically synthesized
ttaatttatacctgctcttgat

SEQ ID NO: 966910 - DNA, 22 bp, Artificial Sequence
  chemically synthesized
attttctcttccatcaagagca

SEQ ID NO: 966911 - DNA, 22 bp, Artificial Sequence
  chemically synthesized
taatttatacctgctcttgatg

SEQ ID NO: 966912 - DNA, 22 bp, Artificial Sequence
  chemically synthesized
tattttctcttccatcaagagc

SEQ ID NO: 966913 - DNA, 22 bp, Artificial Sequence
  chemically synthesized
aatttatacctgctcttgatgg

SEQ ID NO: 966914 - DNA, 22 bp, Artificial Sequence
  chemically synthesized
atttatacctgctcttgatgga

SEQ ID NO: 966915 - DNA, 22 bp, Artificial Sequence
  chemically synthesized
ctttattttctcttccatcaag

SEQ ID NO: 966916 - DNA, 22 bp, Artificial Sequence
  chemically synthesized
atacctgctcttgatggaagag

SEQ ID NO: 966917 - DNA, 22 bp, Artificial Sequence
  chemically synthesized
tacctgctcttgatggaagaga

SEQ ID NO: 966918 - DNA, 22 bp, Artificial Sequence
  chemically synthesized
gagaactcctttattttctctt

SEQ ID NO: 966919 - DNA, 22 bp, Artificial Sequence
  chemically synthesized
ggagaactcctttattttctct

SEQ ID NO: 966920 - DNA, 22 bp, Artificial Sequence
  chemically synthesized
ctcttgatggaagagaaaataa

SEQ ID NO: 966921 - DNA, 22 bp, Artificial Sequence
  chemically synthesized
tggagaactcctttattttctc

SEQ ID NO: 966922 - DNA, 22 bp, Artificial Sequence
  chemically synthesized
ttgatggaagagaaaataaagg

SEQ ID NO: 966923 - DNA, 22 bp, Artificial Sequence
  chemically synthesized
gatggaagagaaaataaaggag

SEQ ID NO: 966924 - DNA, 22 bp, Artificial Sequence
  chemically synthesized
atggaagagaaaataaaggagt

SEQ ID NO: 966925 - DNA, 22 bp, Artificial Sequence
  chemically synthesized
aatccctttggagaactccttt

SEQ ID NO: 966926 - DNA, 22 bp, Artificial Sequence
  chemically synthesized
ccacgcctaaatccctttggag

SEQ ID NO: 966927 - DNA, 22 bp, Artificial Sequence
  chemically synthesized
actcccacgcctaaatcccttt

SEQ ID NO: 966928 - DNA, 22 bp, Artificial Sequence
  chemically synthesized
atattgactcccacgcctaaat

SEQ ID NO: 966929 - DNA, 22 bp, Artificial Sequence
  chemically synthesized
tccaaagggatttaggcgtggg

SEQ ID NO: 966930 - DNA, 22 bp, Artificial Sequence
  chemically synthesized
caaagggatttaggcgtgggag

SEQ ID NO: 966931 - DNA, 22 bp, Artificial Sequence
  chemically synthesized
gatctaatattgactcccacgc

SEQ ID NO: 966932 - DNA, 22 bp, Artificial Sequence
  chemically synthesized
ggatctaatattgactcccacg

SEQ ID NO: 966933 - DNA, 22 bp, Artificial Sequence
  chemically synthesized
tggatctaatattgactcccac

SEQ ID NO: 966934 - DNA, 22 bp, Artificial Sequence
  chemically synthesized
ctttggatctaatattgactcc

SEQ ID NO: 966935 - DNA, 22 bp, Artificial Sequence
  chemically synthesized
gctttggatctaatattgactc

SEQ ID NO: 966936 - DNA, 22 bp, Artificial Sequence
  chemically synthesized
aggcgtgggagtcaatattaga

SEQ ID NO: 966937 - DNA, 22 bp, Artificial Sequence
  chemically synthesized
ggcgtgggagtcaatattagat

SEQ ID NO: 966938 - DNA, 22 bp, Artificial Sequence
  chemically synthesized
gatccaaagcaagggtcattct

SEQ ID NO: 966939 - DNA, 22 bp, Artificial Sequence
  chemically synthesized
gaaacataggaacagaatgacc

SEQ ID NO: 966940 - DNA, 22 bp, Artificial Sequence
  chemically synthesized
agaaacataggaacagaatgac

SEQ ID NO: 966941 - DNA, 22 bp, Artificial Sequence
  chemically synthesized
tgttcctatgtttctaagggct

SEQ ID NO: 966942 - DNA, 22 bp, Artificial Sequence
  chemically synthesized
agtaaatgagaaagcccttaga

SEQ ID NO: 966943 - DNA, 22 bp, Artificial Sequence
  chemically synthesized
ttcctatgtttctaagggcttt

SEQ ID NO: 966944 - DNA, 22 bp, Artificial Sequence
  chemically synthesized
ctatgtttctaagggctttctc

SEQ ID NO: 966945 - DNA, 22 bp, Artificial Sequence
  chemically synthesized
gattgagtaaatgagaaagccc

SEQ ID NO: 966946 - DNA, 22 bp, Artificial Sequence
  chemically synthesized
tgtttctaagggctttctcatt

SEQ ID NO: 966947 - DNA, 22 bp, Artificial Sequence
  chemically synthesized
ttagattgagtaaatgagaaag

SEQ ID NO: 966948 - DNA, 22 bp, Artificial Sequence
  chemically synthesized
ctaagggctttctcatttactc

SEQ ID NO: 966949 - DNA, 22 bp, Artificial Sequence
  chemically synthesized
taagggctttctcatttactca

SEQ ID NO: 966950 - DNA, 22 bp, Artificial Sequence
  chemically synthesized
aaaattattagattgagtaaat

SEQ ID NO: 966951 - DNA, 22 bp, Artificial Sequence
  chemically synthesized
agggctttctcatttactcaat

SEQ ID NO: 966952 - DNA, 22 bp, Artificial Sequence
  chemically synthesized
aaaaattattagattgagtaaa

SEQ ID NO: 966953 - DNA, 22 bp, Artificial Sequence
  chemically synthesized
tctcatttactcaatctaataa

SEQ ID NO: 966954 - DNA, 22 bp, Artificial Sequence
  chemically synthesized
ctcatttactcaatctaataat

SEQ ID NO: 966955 - DNA, 22 bp, Artificial Sequence
  chemically synthesized
tcatttactcaatctaataatt

SEQ ID NO: 966956 - DNA, 22 bp, Artificial Sequence
  chemically synthesized
atttactcaatctaataatttt

SEQ ID NO: 966957 - DNA, 22 bp, Artificial Sequence
  chemically synthesized
actcaatctaataatttttaag

SEQ ID NO: 966958 - DNA, 22 bp, Artificial Sequence
  chemically synthesized
ctcaatctaataatttttaagc

SEQ ID NO: 966959 - DNA, 22 bp, Artificial Sequence
  chemically synthesized
ggacaataagaggtgcttaaaa

SEQ ID NO: 966960 - DNA, 22 bp, Artificial Sequence
  chemically synthesized
aatctaataatttttaagcacc

SEQ ID NO: 966961 - DNA, 22 bp, Artificial Sequence
  chemically synthesized
gctaggacaataagaggtgctt

SEQ ID NO: 966962 - DNA, 22 bp, Artificial Sequence
  chemically synthesized
ataatttttaagcacctcttat

SEQ ID NO: 966963 - DNA, 22 bp, Artificial Sequence
  chemically synthesized
ttaagcacctcttattgtccta

SEQ ID NO: 966964 - DNA, 22 bp, Artificial Sequence
  chemically synthesized
taagcacctcttattgtcctag

SEQ ID NO: 966965 - DNA, 22 bp, Artificial Sequence
  chemically synthesized
aagcacctcttattgtcctagc

SEQ ID NO: 966966 - DNA, 22 bp, Artificial Sequence
  chemically synthesized
agcacctcttattgtcctagct

SEQ ID NO: 966967 - DNA, 22 bp, Artificial Sequence
  chemically synthesized
atccagggtgttagctaggaca

SEQ ID NO: 966968 - DNA, 22 bp, Artificial Sequence
  chemically synthesized
catccagggtgttagctaggac

SEQ ID NO: 966969 - DNA, 22 bp, Artificial Sequence
  chemically synthesized
ttattgtcctagctaacaccct

SEQ ID NO: 966970 - DNA, 22 bp, Artificial Sequence
  chemically synthesized
accatttcatccagggtgttag

SEQ ID NO: 966971 - DNA, 22 bp, Artificial Sequence
  chemically synthesized
attgtcctagctaacaccctgg

SEQ ID NO: 966972 - DNA, 22 bp, Artificial Sequence
  chemically synthesized
tgaccatttcatccagggtgtt

SEQ ID NO: 966973 - DNA, 22 bp, Artificial Sequence
  chemically synthesized
ttgtcctagctaacaccctgga

SEQ ID NO: 966974 - DNA, 22 bp, Artificial Sequence
  chemically synthesized
ctgaccatttcatccagggtgt

SEQ ID NO: 966975 - DNA, 22 bp, Artificial Sequence
  chemically synthesized
tctgaccatttcatccagggtg

SEQ ID NO: 966976 - DNA, 22 bp, Artificial Sequence
  chemically synthesized
tcctagctaacaccctggatga

SEQ ID NO: 966977 - DNA, 22 bp, Artificial Sequence
  chemically synthesized
gctaacaccctggatgaaatgg

SEQ ID NO: 966978 - DNA, 22 bp, Artificial Sequence
  chemically synthesized
acaccctggatgaaatggtcag

SEQ ID NO: 966979 - DNA, 22 bp, Artificial Sequence
  chemically synthesized
gatgaaatggtcagaaagcact

SEQ ID NO: 966980 - DNA, 22 bp, Artificial Sequence
  chemically synthesized
aggtcaaatacatgtagtgctt

SEQ ID NO: 966981 - DNA, 22 bp, Artificial Sequence
  chemically synthesized
tctgaggtcaaatacatgtagt

SEQ ID NO: 966982 - DNA, 22 bp, Artificial Sequence
  chemically synthesized
gtctgaggtcaaatacatgtag

SEQ ID NO: 966983 - DNA, 22 bp, Artificial Sequence
  chemically synthesized
cttgtctgaggtcaaatacatg

SEQ ID NO: 966984 - DNA, 22 bp, Artificial Sequence
  chemically synthesized
ttacttgtctgaggtcaaatac

SEQ ID NO: 966985 - DNA, 22 bp, Artificial Sequence
  chemically synthesized
tattacttgtctgaggtcaaat

SEQ ID NO: 966986 - DNA, 22 bp, Artificial Sequence
  chemically synthesized
ctattacttgtctgaggtcaaa

SEQ ID NO: 966987 - DNA, 22 bp, Artificial Sequence
  chemically synthesized
tctattacttgtctgaggtcaa

SEQ ID NO: 966988 - DNA, 22 bp, Artificial Sequence
  chemically synthesized
catgtatttgacctcagacaag

SEQ ID NO: 966989 - DNA, 22 bp, Artificial Sequence
  chemically synthesized
gacctcagacaagtaatagaaa

SEQ ID NO: 966990 - DNA, 22 bp, Artificial Sequence
  chemically synthesized
acctcagacaagtaatagaaag

SEQ ID NO: 966991 - DNA, 22 bp, Artificial Sequence
  chemically synthesized
aaaagtcagaataggctttcta

SEQ ID NO: 966992 - DNA, 22 bp, Artificial Sequence
  chemically synthesized
aaaaagtcagaataggctttct

SEQ ID NO: 966993 - DNA, 22 bp, Artificial Sequence
  chemically synthesized
agacaagtaatagaaagcctat

SEQ ID NO: 966994 - DNA, 22 bp, Artificial Sequence
  chemically synthesized
tttaaaaagtcagaataggctt

SEQ ID NO: 966995 - DNA, 22 bp, Artificial Sequence
  chemically synthesized
aaatgttatttaaaaagtcaga

SEQ ID NO: 966996 - DNA, 22 bp, Artificial Sequence
  chemically synthesized
gaaatgttatttaaaaagtcag

SEQ ID NO: 966997 - DNA, 22 bp, Artificial Sequence
  chemically synthesized
ttgaaatgttatttaaaaagtc

SEQ ID NO: 966998 - DNA, 22 bp, Artificial Sequence
  chemically synthesized
cttgaaatgttatttaaaaagt

SEQ ID NO: 966999 - DNA, 22 bp, Artificial Sequence
  chemically synthesized
ttctgactttttaaataacatt

SEQ ID NO: 967000 - DNA, 22 bp, Artificial Sequence
  chemically synthesized
tgactttttaaataacatttca

SEQ ID NO: 967001 - DNA, 22 bp, Artificial Sequence
  chemically synthesized
tgcaggacttcttgaaatgtta

SEQ ID NO: 967002 - DNA, 22 bp, Artificial Sequence
  chemically synthesized
actttttaaataacatttcaag

SEQ ID NO: 967003 - DNA, 22 bp, Artificial Sequence
  chemically synthesized
tttaaataacatttcaagaagt

SEQ ID NO: 967004 - DNA, 22 bp, Artificial Sequence
  chemically synthesized
ttaaataacatttcaagaagtc

SEQ ID NO: 967005 - DNA, 22 bp, Artificial Sequence
  chemically synthesized
taaataacatttcaagaagtcc

SEQ ID NO: 967006 - DNA, 22 bp, Artificial Sequence
  chemically synthesized
aaataacatttcaagaagtcct

SEQ ID NO: 967007 - DNA, 22 bp, Artificial Sequence
  chemically synthesized
aataacatttcaagaagtcctg

SEQ ID NO: 967008 - DNA, 22 bp, Artificial Sequence
  chemically synthesized
caagaagtcctgcataactcct

SEQ ID NO: 967009 - DNA, 22 bp, Artificial Sequence
  chemically synthesized
aagaagtcctgcataactcctt

SEQ ID NO: 967010 - DNA, 22 bp, Artificial Sequence
  chemically synthesized
ataaaataatagaaaggagtta

SEQ ID NO: 967011 - DNA, 22 bp, Artificial Sequence
  chemically synthesized
tgttcataaaataatagaaagg

SEQ ID NO: 967012 - DNA, 22 bp, Artificial Sequence
  chemically synthesized
cataactcctttctattatttt

SEQ ID NO: 967013 - DNA, 22 bp, Artificial Sequence
  chemically synthesized
catggactatgttcataaaata

SEQ ID NO: 967014 - DNA, 22 bp, Artificial Sequence
  chemically synthesized
ctttctattattttatgaacat

SEQ ID NO: 967015 - DNA, 22 bp, Artificial Sequence
  chemically synthesized
tctattattttatgaacatagt

SEQ ID NO: 967016 - DNA, 22 bp, Artificial Sequence
  chemically synthesized
ctattattttatgaacatagtc

SEQ ID NO: 967017 - DNA, 22 bp, Artificial Sequence
  chemically synthesized
gaagcctccatggactatgttc

SEQ ID NO: 967018 - DNA, 22 bp, Artificial Sequence
  chemically synthesized
tattattttatgaacatagtcc

SEQ ID NO: 967019 - DNA, 22 bp, Artificial Sequence
  chemically synthesized
ttattttatgaacatagtccat

SEQ ID NO: 967020 - DNA, 22 bp, Artificial Sequence
  chemically synthesized
gttggaagcctccatggactat

SEQ ID NO: 967021 - DNA, 22 bp, Artificial Sequence
  chemically synthesized
ttttatgaacatagtccatgga

SEQ ID NO: 967022 - DNA, 22 bp, Artificial Sequence
  chemically synthesized
ctagttggaagcctccatggac

SEQ ID NO: 967023 - DNA, 22 bp, Artificial Sequence
  chemically synthesized
tatgaacatagtccatggaggc

SEQ ID NO: 967024 - DNA, 22 bp, Artificial Sequence
  chemically synthesized
atgaacatagtccatggaggct

SEQ ID NO: 967025 - DNA, 22 bp, Artificial Sequence
  chemically synthesized
tgaacatagtccatggaggctt

SEQ ID NO: 967026 - DNA, 22 bp, Artificial Sequence
  chemically synthesized
acgggttgctagttggaagcct

SEQ ID NO: 967027 - DNA, 22 bp, Artificial Sequence
  chemically synthesized
agttcacgggttgctagttgga

SEQ ID NO: 967028 - DNA, 22 bp, Artificial Sequence
  chemically synthesized
ggttaagttcacgggttgctag

SEQ ID NO: 967029 - DNA, 22 bp, Artificial Sequence
  chemically synthesized
aggttaagttcacgggttgcta

SEQ ID NO: 967030 - DNA, 22 bp, Artificial Sequence
  chemically synthesized
ccaactagcaacccgtgaactt

SEQ ID NO: 967031 - DNA, 22 bp, Artificial Sequence
  chemically synthesized
caactagcaacccgtgaactta

SEQ ID NO: 967032 - DNA, 22 bp, Artificial Sequence
  chemically synthesized
aatagaagccttaggttaagtt

SEQ ID NO: 967033 - DNA, 22 bp, Artificial Sequence
  chemically synthesized
gcaacccgtgaacttaacctaa

SEQ ID NO: 967034 - DNA, 22 bp, Artificial Sequence
  chemically synthesized
attaaatagaagccttaggtta

SEQ ID NO: 967035 - DNA, 22 bp, Artificial Sequence
  chemically synthesized
tcagactcattaaatagaagcc

SEQ ID NO: 967036 - DNA, 22 bp, Artificial Sequence
  chemically synthesized
aacctaaggcttctatttaatg

SEQ ID NO: 967037 - DNA, 22 bp, Artificial Sequence
  chemically synthesized
acctaaggcttctatttaatga

SEQ ID NO: 967038 - DNA, 22 bp, Artificial Sequence
  chemically synthesized
aggtggctatcagactcattaa

SEQ ID NO: 967039 - DNA, 22 bp, Artificial Sequence
  chemically synthesized
aggcttctatttaatgagtctg

SEQ ID NO: 967040 - DNA, 22 bp, Artificial Sequence
  chemically synthesized
ttcaggtggctatcagactcat

SEQ ID NO: 967041 - DNA, 22 bp, Artificial Sequence
  chemically synthesized
attcaggtggctatcagactca

SEQ ID NO: 967042 - DNA, 22 bp, Artificial Sequence
  chemically synthesized
tattcaggtggctatcagactc

SEQ ID NO: 967043 - DNA, 22 bp, Artificial Sequence
  chemically synthesized
ttattcaggtggctatcagact

SEQ ID NO: 967044 - DNA, 22 bp, Artificial Sequence
  chemically synthesized
tttattcaggtggctatcagac

SEQ ID NO: 967045 - DNA, 22 bp, Artificial Sequence
  chemically synthesized
ctatttaatgagtctgatagcc

SEQ ID NO: 967046 - DNA, 22 bp, Artificial Sequence
  chemically synthesized
tatttaatgagtctgatagcca

SEQ ID NO: 967047 - DNA, 22 bp, Artificial Sequence
  chemically synthesized
tttaatgagtctgatagccacc

SEQ ID NO: 967048 - DNA, 22 bp, Artificial Sequence
  chemically synthesized
aatgagtctgatagccacctga

SEQ ID NO: 967049 - DNA, 22 bp, Artificial Sequence
  chemically synthesized
atgagtctgatagccacctgaa

SEQ ID NO: 967050 - DNA, 22 bp, Artificial Sequence
  chemically synthesized
atagccacctgaataaaaaatc

SEQ ID NO: 967051 - DNA, 22 bp, Artificial Sequence
  chemically synthesized
aaaaaaagaaaaaaaaaaaaga

SEQ ID NO: 967052 - DNA, 22 bp, Artificial Sequence
  chemically synthesized
aataaaaaatcttttttttttt

SEQ ID NO: 967053 - DNA, 22 bp, Artificial Sequence
  chemically synthesized
catctcaaaaaaagaaaaaaaa

SEQ ID NO: 967054 - DNA, 22 bp, Artificial Sequence
  chemically synthesized
ttttttttttctttttttgaga

SEQ ID NO: 967055 - DNA, 22 bp, Artificial Sequence
  chemically synthesized
tttttttttctttttttgagat

SEQ ID NO: 967056 - DNA, 22 bp, Artificial Sequence
  chemically synthesized
ttttttttctttttttgagatg

SEQ ID NO: 967057 - DNA, 22 bp, Artificial Sequence
  chemically synthesized
tttttttctttttttgagatgg

SEQ ID NO: 967058 - DNA, 22 bp, Artificial Sequence
  chemically synthesized
ttttttctttttttgagatgga

SEQ ID NO: 967059 - DNA, 22 bp, Artificial Sequence
  chemically synthesized
tttttctttttttgagatggag

SEQ ID NO: 967060 - DNA, 22 bp, Artificial Sequence
  chemically synthesized
ttttctttttttgagatggagt

SEQ ID NO: 967061 - DNA, 22 bp, Artificial Sequence
  chemically synthesized
tttctttttttgagatggagtc

SEQ ID NO: 967062 - DNA, 22 bp, Artificial Sequence
  chemically synthesized
ttctttttttgagatggagtct

SEQ ID NO: 967063 - DNA, 22 bp, Artificial Sequence
  chemically synthesized
ggcgacagagccagactccatc

SEQ ID NO: 967064 - DNA, 22 bp, Artificial Sequence
  chemically synthesized
tctttttttgagatggagtctg

SEQ ID NO: 967065 - DNA, 22 bp, Artificial Sequence
  chemically synthesized
ctttttttgagatggagtctgg

SEQ ID NO: 967066 - DNA, 22 bp, Artificial Sequence
  chemically synthesized
tttttttgagatggagtctggc

SEQ ID NO: 967067 - DNA, 22 bp, Artificial Sequence
  chemically synthesized
tttttgagatggagtctggctc

SEQ ID NO: 967068 - DNA, 22 bp, Artificial Sequence
  chemically synthesized
ttttgagatggagtctggctct

SEQ ID NO: 967069 - DNA, 22 bp, Artificial Sequence
  chemically synthesized
tttgagatggagtctggctctg

SEQ ID NO: 967070 - DNA, 22 bp, Artificial Sequence
  chemically synthesized
cagcctgggcgacagagccaga

SEQ ID NO: 967071 - DNA, 22 bp, Artificial Sequence
  chemically synthesized
ttgagatggagtctggctctgt

SEQ ID NO: 967072 - DNA, 22 bp, Artificial Sequence
  chemically synthesized
tgagatggagtctggctctgtc

SEQ ID NO: 967073 - DNA, 22 bp, Artificial Sequence
  chemically synthesized
gagatggagtctggctctgtcg

SEQ ID NO: 967074 - DNA, 22 bp, Artificial Sequence
  chemically synthesized
agatggagtctggctctgtcgc

SEQ ID NO: 967075 - DNA, 22 bp, Artificial Sequence
  chemically synthesized
cactccagcctgggcgacagag

SEQ ID NO: 967076 - DNA, 22 bp, Artificial Sequence
  chemically synthesized
ccactccactccagcctgggcg

SEQ ID NO: 967077 - DNA, 22 bp, Artificial Sequence
  chemically synthesized
gctctgtcgcccaggctggagt

SEQ ID NO: 967078 - DNA, 22 bp, Artificial Sequence
  chemically synthesized
tgtcgcccaggctggagtggag

SEQ ID NO: 967079 - DNA, 22 bp, Artificial Sequence
  chemically synthesized
tcgcccaggctggagtggagtg

SEQ ID NO: 967080 - DNA, 22 bp, Artificial Sequence
  chemically synthesized
aacccggtagccgagatcctgc

SEQ ID NO: 967081 - DNA, 22 bp, Artificial Sequence
  chemically synthesized
gaacccggtagccgagatcctg

SEQ ID NO: 967082 - DNA, 22 bp, Artificial Sequence
  chemically synthesized
gagtggagtggcaggatctcgg

SEQ ID NO: 967083 - DNA, 22 bp, Artificial Sequence
  chemically synthesized
aggcaggagaatcacttgaacc

SEQ ID NO: 967084 - DNA, 22 bp, Artificial Sequence
  chemically synthesized
ggctaccgggttcaagtgattc

SEQ ID NO: 967085 - DNA, 22 bp, Artificial Sequence
  chemically synthesized
ccgggttcaagtgattctcctg

SEQ ID NO: 967086 - DNA, 22 bp, Artificial Sequence
  chemically synthesized
gggaggctgaggcaggagaatc

SEQ ID NO: 967087 - DNA, 22 bp, Artificial Sequence
  chemically synthesized
ctcgggaggctgaggcaggaga

SEQ ID NO: 967088 - DNA, 22 bp, Artificial Sequence
  chemically synthesized
aagtgattctcctgcctcagcc

SEQ ID NO: 967089 - DNA, 22 bp, Artificial Sequence
  chemically synthesized
tcctgcctcagcctcccgagta

SEQ ID NO: 967090 - DNA, 22 bp, Artificial Sequence
  chemically synthesized
ctgcctcagcctcccgagtagc

SEQ ID NO: 967091 - DNA, 22 bp, Artificial Sequence
  chemically synthesized
cctcagcctcccgagtagctgg

SEQ ID NO: 967092 - DNA, 22 bp, Artificial Sequence
  chemically synthesized
agcctcccgagtagctgggact

SEQ ID NO: 967093 - DNA, 22 bp, Artificial Sequence
  chemically synthesized
ccgagtagctgggactaccggc

SEQ ID NO: 967094 - DNA, 22 bp, Artificial Sequence
  chemically synthesized
ggactaccggcacatgccacta

SEQ ID NO: 967095 - DNA, 22 bp, Artificial Sequence
  chemically synthesized
ccggcacatgccactacgcccg

SEQ ID NO: 967096 - DNA, 22 bp, Artificial Sequence
  chemically synthesized
caaatacaaaaaatcagccggg

SEQ ID NO: 967097 - DNA, 22 bp, Artificial Sequence
  chemically synthesized
ctacaaatacaaaaaatcagcc

SEQ ID NO: 967098 - DNA, 22 bp, Artificial Sequence
  chemically synthesized
tactacaaatacaaaaaatcag

SEQ ID NO: 967099 - DNA, 22 bp, Artificial Sequence
  chemically synthesized
cgcccggctgattttttgtatt

SEQ ID NO: 967100 - DNA, 22 bp, Artificial Sequence
  chemically synthesized
attttttgtatttgtagtagag

SEQ ID NO: 967101 - DNA, 22 bp, Artificial Sequence
  chemically synthesized
tttgtatttgtagtagaggtgg

SEQ ID NO: 967102 - DNA, 22 bp, Artificial Sequence
  chemically synthesized
ttgtatttgtagtagaggtggg

SEQ ID NO: 967103 - DNA, 22 bp, Artificial Sequence
  chemically synthesized
acacggtgaaaacccacctcta

SEQ ID NO: 967104 - DNA, 22 bp, Artificial Sequence
  chemically synthesized
tgtatttgtagtagaggtgggt

SEQ ID NO: 967105 - DNA, 22 bp, Artificial Sequence
  chemically synthesized
gtatttgtagtagaggtgggtt

SEQ ID NO: 967106 - DNA, 22 bp, Artificial Sequence
  chemically synthesized
tatttgtagtagaggtgggttt

SEQ ID NO: 967107 - DNA, 22 bp, Artificial Sequence
  chemically synthesized
gctaacacggtgaaaacccacc

SEQ ID NO: 967108 - DNA, 22 bp, Artificial Sequence
  chemically synthesized
gtagtagaggtgggttttcacc

SEQ ID NO: 967109 - DNA, 22 bp, Artificial Sequence
  chemically synthesized
tagtagaggtgggttttcaccg

SEQ ID NO: 967110 - DNA, 22 bp, Artificial Sequence
  chemically synthesized
tcaccgtgttagccaggatggt

SEQ ID NO: 967111 - DNA, 22 bp, Artificial Sequence
  chemically synthesized
caccgtgttagccaggatggtc

SEQ ID NO: 967112 - DNA, 22 bp, Artificial Sequence
  chemically synthesized
accgtgttagccaggatggtct

SEQ ID NO: 967113 - DNA, 22 bp, Artificial Sequence
  chemically synthesized
gccaggatggtctctatctcct

SEQ ID NO: 967114 - DNA, 22 bp, Artificial Sequence
  chemically synthesized
tatctcctgacctcatgatccg

SEQ ID NO: 967115 - DNA, 22 bp, Artificial Sequence
  chemically synthesized
tctcctgacctcatgatccgcc

SEQ ID NO: 967116 - DNA, 22 bp, Artificial Sequence
  chemically synthesized
ggaggccgaggcaggcggatca

SEQ ID NO: 967117 - DNA, 22 bp, Artificial Sequence
  chemically synthesized
gggaggccgaggcaggcggatc

SEQ ID NO: 967118 - DNA, 22 bp, Artificial Sequence
  chemically synthesized
tgggaggccgaggcaggcggat

SEQ ID NO: 967119 - DNA, 22 bp, Artificial Sequence
  chemically synthesized
ctgacctcatgatccgcctgcc

SEQ ID NO: 967120 - DNA, 22 bp, Artificial Sequence
  chemically synthesized
acctcatgatccgcctgcctcg

SEQ ID NO: 967121 - DNA, 22 bp, Artificial Sequence
  chemically synthesized
atgatccgcctgcctcggcctc

SEQ ID NO: 967122 - DNA, 22 bp, Artificial Sequence
  chemically synthesized
taatcccagcactttgggaggc

SEQ ID NO: 967123 - DNA, 22 bp, Artificial Sequence
  chemically synthesized
cctcggcctcccaaagtgctgg

SEQ ID NO: 967124 - DNA, 22 bp, Artificial Sequence
  chemically synthesized
acgcctgtaatcccagcacttt

SEQ ID NO: 967125 - DNA, 22 bp, Artificial Sequence
  chemically synthesized
ggcctcccaaagtgctgggatt

SEQ ID NO: 967126 - DNA, 22 bp, Artificial Sequence
  chemically synthesized
ccaaagtgctgggattacaggc

SEQ ID NO: 967127 - DNA, 22 bp, Artificial Sequence
  chemically synthesized
agggccaggcatggtggctcac

SEQ ID NO: 967128 - DNA, 22 bp, Artificial Sequence
  chemically synthesized
ggattacaggcgtgagccacca

SEQ ID NO: 967129 - DNA, 22 bp, Artificial Sequence
  chemically synthesized
attcagggccaggcatggtggc

SEQ ID NO: 967130 - DNA, 22 bp, Artificial Sequence
  chemically synthesized
gattcagggccaggcatggtgg

SEQ ID NO: 967131 - DNA, 22 bp, Artificial Sequence
  chemically synthesized
tgattcagggccaggcatggtg

SEQ ID NO: 967132 - DNA, 22 bp, Artificial Sequence
  chemically synthesized
caggcgtgagccaccatgcctg

SEQ ID NO: 967133 - DNA, 22 bp, Artificial Sequence
  chemically synthesized
ttgattcagggccaggcatggt

SEQ ID NO: 967134 - DNA, 22 bp, Artificial Sequence
  chemically synthesized
cgcaaaagatttttgattcagg

SEQ ID NO: 967135 - DNA, 22 bp, Artificial Sequence
  chemically synthesized
tctacgcaaaagatttttgatt

SEQ ID NO: 967136 - DNA, 22 bp, Artificial Sequence
  chemically synthesized
atctacgcaaaagatttttgat

SEQ ID NO: 967137 - DNA, 22 bp, Artificial Sequence
  chemically synthesized
cttatctacgcaaaagattttt

SEQ ID NO: 967138 - DNA, 22 bp, Artificial Sequence
  chemically synthesized
ccttatctacgcaaaagatttt

SEQ ID NO: 967139 - DNA, 22 bp, Artificial Sequence
  chemically synthesized
gccctgaatcaaaaatcttttg

SEQ ID NO: 967140 - DNA, 22 bp, Artificial Sequence
  chemically synthesized
tccttatctacgcaaaagattt

SEQ ID NO: 967141 - DNA, 22 bp, Artificial Sequence
  chemically synthesized
ttccttatctacgcaaaagatt

SEQ ID NO: 967142 - DNA, 22 bp, Artificial Sequence
  chemically synthesized
tttccttatctacgcaaaagat

SEQ ID NO: 967143 - DNA, 22 bp, Artificial Sequence
  chemically synthesized
ttttccttatctacgcaaaaga

SEQ ID NO: 967144 - DNA, 22 bp, Artificial Sequence
  chemically synthesized
tttttccttatctacgcaaaag

SEQ ID NO: 967145 - DNA, 22 bp, Artificial Sequence
  chemically synthesized
ttttttccttatctacgcaaaa

SEQ ID NO: 967146 - DNA, 22 bp, Artificial Sequence
  chemically synthesized
aatcaaaaatcttttgcgtaga

SEQ ID NO: 967147 - DNA, 22 bp, Artificial Sequence
  chemically synthesized
atttttttttccttatctacgc

SEQ ID NO: 967148 - DNA, 22 bp, Artificial Sequence
  chemically synthesized
ttgatttttttttccttatcta

SEQ ID NO: 967149 - DNA, 22 bp, Artificial Sequence
  chemically synthesized
ttgcgtagataaggaaaaaaaa

SEQ ID NO: 967150 - DNA, 22 bp, Artificial Sequence
  chemically synthesized
tgcgtagataaggaaaaaaaaa

SEQ ID NO: 967151 - DNA, 22 bp, Artificial Sequence
  chemically synthesized
gcgtagataaggaaaaaaaaat

SEQ ID NO: 967152 - DNA, 22 bp, Artificial Sequence
  chemically synthesized
cgtagataaggaaaaaaaaatc

SEQ ID NO: 967153 - DNA, 22 bp, Artificial Sequence
  chemically synthesized
tacaacactgttgatttttttt

SEQ ID NO: 967154 - DNA, 22 bp, Artificial Sequence
  chemically synthesized
atacaacactgttgattttttt

SEQ ID NO: 967155 - DNA, 22 bp, Artificial Sequence
  chemically synthesized
tgagccccttatacaacactgt

SEQ ID NO: 967156 - DNA, 22 bp, Artificial Sequence
  chemically synthesized
aatccatgaagtggctatgagc

SEQ ID NO: 967157 - DNA, 22 bp, Artificial Sequence
  chemically synthesized
tataaggggctcatagccactt

SEQ ID NO: 967158 - DNA, 22 bp, Artificial Sequence
  chemically synthesized
cctcaatccatgaagtggctat

SEQ ID NO: 967159 - DNA, 22 bp, Artificial Sequence
  chemically synthesized
taagctacctcaatccatgaag

SEQ ID NO: 967160 - DNA, 22 bp, Artificial Sequence
  chemically synthesized
gtaagctacctcaatccatgaa

SEQ ID NO: 967161 - DNA, 22 bp, Artificial Sequence
  chemically synthesized
tgtaagctacctcaatccatga

SEQ ID NO: 967162 - DNA, 22 bp, Artificial Sequence
  chemically synthesized
atagccacttcatggattgagg

SEQ ID NO: 967163 - DNA, 22 bp, Artificial Sequence
  chemically synthesized
ctttgtaagctacctcaatcca

SEQ ID NO: 967164 - DNA, 22 bp, Artificial Sequence
  chemically synthesized
gctttgtaagctacctcaatcc

SEQ ID NO: 967165 - DNA, 22 bp, Artificial Sequence
  chemically synthesized
tgctttgtaagctacctcaatc

SEQ ID NO: 967166 - DNA, 22 bp, Artificial Sequence
  chemically synthesized
ttttgctttgtaagctacctca

SEQ ID NO: 967167 - DNA, 22 bp, Artificial Sequence
  chemically synthesized
ttattttgctttgtaagctacc

SEQ ID NO: 967168 - DNA, 22 bp, Artificial Sequence
  chemically synthesized
catggattgaggtagcttacaa

SEQ ID NO: 967169 - DNA, 22 bp, Artificial Sequence
  chemically synthesized
atggattgaggtagcttacaaa

SEQ ID NO: 967170 - DNA, 22 bp, Artificial Sequence
  chemically synthesized
cctgttattttgctttgtaagc

SEQ ID NO: 967171 - DNA, 22 bp, Artificial Sequence
  chemically synthesized
ccctgttattttgctttgtaag

SEQ ID NO: 967172 - DNA, 22 bp, Artificial Sequence
  chemically synthesized
aggtagcttacaaagcaaaata

SEQ ID NO: 967173 - DNA, 22 bp, Artificial Sequence
  chemically synthesized
tggcacttccctgttattttgc

SEQ ID NO: 967174 - DNA, 22 bp, Artificial Sequence
  chemically synthesized
gtggcacttccctgttattttg

SEQ ID NO: 967175 - DNA, 22 bp, Artificial Sequence
  chemically synthesized
tgtggcacttccctgttatttt

SEQ ID NO: 967176 - DNA, 22 bp, Artificial Sequence
  chemically synthesized
ttttgtggcacttccctgttat

SEQ ID NO: 967177 - DNA, 22 bp, Artificial Sequence
  chemically synthesized
acaaagcaaaataacagggaag

SEQ ID NO: 967178 - DNA, 22 bp, Artificial Sequence
  chemically synthesized
caaagcaaaataacagggaagt

SEQ ID NO: 967179 - DNA, 22 bp, Artificial Sequence
  chemically synthesized
aattgttttgtggcacttccct

SEQ ID NO: 967180 - DNA, 22 bp, Artificial Sequence
  chemically synthesized
aaagaatccagtagtgtattga

SEQ ID NO: 967181 - DNA, 22 bp, Artificial Sequence
  chemically synthesized
gttcaaagaatccagtagtgta

SEQ ID NO: 967182 - DNA, 22 bp, Artificial Sequence
  chemically synthesized
ggttcaaagaatccagtagtgt

SEQ ID NO: 967183 - DNA, 22 bp, Artificial Sequence
  chemically synthesized
tggttcaaagaatccagtagtg

SEQ ID NO: 967184 - DNA, 22 bp, Artificial Sequence
  chemically synthesized
aaggttttggttcaaagaatcc

SEQ ID NO: 967185 - DNA, 22 bp, Artificial Sequence
  chemically synthesized
aatacactactggattctttga

SEQ ID NO: 967186 - DNA, 22 bp, Artificial Sequence
  chemically synthesized
caaggttttggttcaaagaatc

SEQ ID NO: 967187 - DNA, 22 bp, Artificial Sequence
  chemically synthesized
tcaaggttttggttcaaagaat

SEQ ID NO: 967188 - DNA, 22 bp, Artificial Sequence
  chemically synthesized
ttttcaaggttttggttcaaag

SEQ ID NO: 967189 - DNA, 22 bp, Artificial Sequence
  chemically synthesized
ctggattctttgaaccaaaacc

SEQ ID NO: 967190 - DNA, 22 bp, Artificial Sequence
  chemically synthesized
tgctgttttcaaggttttggtt

SEQ ID NO: 967191 - DNA, 22 bp, Artificial Sequence
  chemically synthesized
gtgctgttttcaaggttttggt

SEQ ID NO: 967192 - DNA, 22 bp, Artificial Sequence
  chemically synthesized
gattctttgaaccaaaaccttg

SEQ ID NO: 967193 - DNA, 22 bp, Artificial Sequence
  chemically synthesized
tttgaaccaaaaccttgaaaac

SEQ ID NO: 967194 - DNA, 22 bp, Artificial Sequence
  chemically synthesized
tgaaccaaaaccttgaaaacag

SEQ ID NO: 967195 - DNA, 22 bp, Artificial Sequence
  chemically synthesized
gaaccaaaaccttgaaaacagc

SEQ ID NO: 967196 - DNA, 22 bp, Artificial Sequence
  chemically synthesized
gaacagatttgtgctgttttca

SEQ ID NO: 967197 - DNA, 22 bp, Artificial Sequence
  chemically synthesized
aaccaaaaccttgaaaacagca

SEQ ID NO: 967198 - DNA, 22 bp, Artificial Sequence
  chemically synthesized
ccaagtactggaacagatttgt

SEQ ID NO: 967199 - DNA, 22 bp, Artificial Sequence
  chemically synthesized
gaaaacagcacaaatctgttcc

SEQ ID NO: 967200 - DNA, 22 bp, Artificial Sequence
  chemically synthesized
aaaacagcacaaatctgttcca

SEQ ID NO: 967201 - DNA, 22 bp, Artificial Sequence
  chemically synthesized
atctcccaagtactggaacaga

SEQ ID NO: 967202 - DNA, 22 bp, Artificial Sequence
  chemically synthesized
aatggttgatctcccaagtact

SEQ ID NO: 967203 - DNA, 22 bp, Artificial Sequence
  chemically synthesized
caatggttgatctcccaagtac

SEQ ID NO: 967204 - DNA, 22 bp, Artificial Sequence
  chemically synthesized
tcaatggttgatctcccaagta

SEQ ID NO: 967205 - DNA, 22 bp, Artificial Sequence
  chemically synthesized
attttcaatggttgatctccca

SEQ ID NO: 967206 - DNA, 22 bp, Artificial Sequence
  chemically synthesized
ttccagtacttgggagatcaac

SEQ ID NO: 967207 - DNA, 22 bp, Artificial Sequence
  chemically synthesized
cagtacttgggagatcaaccat

SEQ ID NO: 967208 - DNA, 22 bp, Artificial Sequence
  chemically synthesized
gggagatcaaccattgaaaatt

SEQ ID NO: 967209 - DNA, 22 bp, Artificial Sequence
  chemically synthesized
ggagatcaaccattgaaaatta

SEQ ID NO: 967210 - DNA, 22 bp, Artificial Sequence
  chemically synthesized
taaatgaaatgttaattttcaa

SEQ ID NO: 967211 - DNA, 22 bp, Artificial Sequence
  chemically synthesized
aaaattaacatttcatttacaa

SEQ ID NO: 967212 - DNA, 22 bp, Artificial Sequence
  chemically synthesized
acatttcatttacaacttctgc

SEQ ID NO: 967213 - DNA, 22 bp, Artificial Sequence
  chemically synthesized
gaacagaagagcaggcagaagt

SEQ ID NO: 967214 - DNA, 22 bp, Artificial Sequence
  chemically synthesized
catttacaacttctgcctgctc

SEQ ID NO: 967215 - DNA, 22 bp, Artificial Sequence
  chemically synthesized
atttacaacttctgcctgctct

SEQ ID NO: 967216 - DNA, 22 bp, Artificial Sequence
  chemically synthesized
acaacttctgcctgctcttctg

SEQ ID NO: 967217 - DNA, 22 bp, Artificial Sequence
  chemically synthesized
caacttctgcctgctcttctgt

SEQ ID NO: 967218 - DNA, 22 bp, Artificial Sequence
  chemically synthesized
ctgcctgctcttctgttctagc

SEQ ID NO: 967219 - DNA, 22 bp, Artificial Sequence
  chemically synthesized
tgcctgctcttctgttctagcc

SEQ ID NO: 967220 - DNA, 22 bp, Artificial Sequence
  chemically synthesized
gaacagaagaggaggctagaac

SEQ ID NO: 967221 - DNA, 22 bp, Artificial Sequence
  chemically synthesized
cctgctcttctgttctagcctc

SEQ ID NO: 967222 - DNA, 22 bp, Artificial Sequence
  chemically synthesized
ctcttctgttctagcctcctct

SEQ ID NO: 967223 - DNA, 22 bp, Artificial Sequence
  chemically synthesized
ttctgttctagcctcctcttct

SEQ ID NO: 967224 - DNA, 22 bp, Artificial Sequence
  chemically synthesized
ctgttctagcctcctcttctgt

SEQ ID NO: 967225 - DNA, 22 bp, Artificial Sequence
  chemically synthesized
tgttctagcctcctcttctgtt

SEQ ID NO: 967226 - DNA, 22 bp, Artificial Sequence
  chemically synthesized
ttctagcctcctcttctgttct

SEQ ID NO: 967227 - DNA, 22 bp, Artificial Sequence
  chemically synthesized
tagcctcctcttctgttctagc

SEQ ID NO: 967228 - DNA, 22 bp, Artificial Sequence
  chemically synthesized
gcctcctcttctgttctagcct

SEQ ID NO: 967229 - DNA, 22 bp, Artificial Sequence
  chemically synthesized
ctcttctgttctagcctgctct

SEQ ID NO: 967230 - DNA, 22 bp, Artificial Sequence
  chemically synthesized
ttctgttctagcctgctcttct

SEQ ID NO: 967231 - DNA, 22 bp, Artificial Sequence
  chemically synthesized
ctgttctagcctgctcttctgt

SEQ ID NO: 967232 - DNA, 22 bp, Artificial Sequence
  chemically synthesized
cgatgaacagccacagaagagc

SEQ ID NO: 967233 - DNA, 22 bp, Artificial Sequence
  chemically synthesized
tgttctagcctgctcttctgtg

SEQ ID NO: 967234 - DNA, 22 bp, Artificial Sequence
  chemically synthesized
ttctagcctgctcttctgtggc

SEQ ID NO: 967235 - DNA, 22 bp, Artificial Sequence
  chemically synthesized
tagcctgctcttctgtggctgt

SEQ ID NO: 967236 - DNA, 22 bp, Artificial Sequence
  chemically synthesized
gcctgctcttctgtggctgttc

SEQ ID NO: 967237 - DNA, 22 bp, Artificial Sequence
  chemically synthesized
caaatgtggctgcgatgaacag

SEQ ID NO: 967238 - DNA, 22 bp, Artificial Sequence
  chemically synthesized
ctcttctgtggctgttcatcgc

SEQ ID NO: 967239 - DNA, 22 bp, Artificial Sequence
  chemically synthesized
ttctgtggctgttcatcgcagc

SEQ ID NO: 967240 - DNA, 22 bp, Artificial Sequence
  chemically synthesized
ctgtggctgttcatcgcagcca

SEQ ID NO: 967241 - DNA, 22 bp, Artificial Sequence
  chemically synthesized
aacctacaaatgtggctgcgat

SEQ ID NO: 967242 - DNA, 22 bp, Artificial Sequence
  chemically synthesized
tgtggctgttcatcgcagccac

SEQ ID NO: 967243 - DNA, 22 bp, Artificial Sequence
  chemically synthesized
aaacctacaaatgtggctgcga

SEQ ID NO: 967244 - DNA, 22 bp, Artificial Sequence
  chemically synthesized
tggctgttcatcgcagccacat

SEQ ID NO: 967245 - DNA, 22 bp, Artificial Sequence
  chemically synthesized
aacatttaaacctacaaatgtg

SEQ ID NO: 967246 - DNA, 22 bp, Artificial Sequence
  chemically synthesized
ttcatcgcagccacatttgtag

SEQ ID NO: 967247 - DNA, 22 bp, Artificial Sequence
  chemically synthesized
atcgcagccacatttgtaggtt

SEQ ID NO: 967248 - DNA, 22 bp, Artificial Sequence
  chemically synthesized
ggcaatctgaacatttaaacct

SEQ ID NO: 967249 - DNA, 22 bp, Artificial Sequence
  chemically synthesized
taggcaatctgaacatttaaac

SEQ ID NO: 967250 - DNA, 22 bp, Artificial Sequence
  chemically synthesized
ctaggcaatctgaacatttaaa

SEQ ID NO: 967251 - DNA, 22 bp, Artificial Sequence
  chemically synthesized
tctaggcaatctgaacatttaa

SEQ ID NO: 967252 - DNA, 22 bp, Artificial Sequence
  chemically synthesized
gtaggtttaaatgttcagattg

SEQ ID NO: 967253 - DNA, 22 bp, Artificial Sequence
  chemically synthesized
taggtttaaatgttcagattgc

SEQ ID NO: 967254 - DNA, 22 bp, Artificial Sequence
  chemically synthesized
aaatgttcagattgcctagaaa

SEQ ID NO: 967255 - DNA, 22 bp, Artificial Sequence
  chemically synthesized
catatgcaaagctttctaggca

SEQ ID NO: 967256 - DNA, 22 bp, Artificial Sequence
  chemically synthesized
aatgttcagattgcctagaaag

SEQ ID NO: 967257 - DNA, 22 bp, Artificial Sequence
  chemically synthesized
gcatatgcaaagctttctaggc

SEQ ID NO: 967258 - DNA, 22 bp, Artificial Sequence
  chemically synthesized
agattgcctagaaagctttgca

SEQ ID NO: 967259 - DNA, 22 bp, Artificial Sequence
  chemically synthesized
tgcatatatttgcatatgcaaa

SEQ ID NO: 967260 - DNA, 22 bp, Artificial Sequence
  chemically synthesized
cctagaaagctttgcatatgca

SEQ ID NO: 967261 - DNA, 22 bp, Artificial Sequence
  chemically synthesized
gaaagctttgcatatgcaaata

SEQ ID NO: 967262 - DNA, 22 bp, Artificial Sequence
  chemically synthesized
tgcatatgcaaatatatgcata

SEQ ID NO: 967263 - DNA, 22 bp, Artificial Sequence
  chemically synthesized
gcatatgcaaatatatgcataa

SEQ ID NO: 967264 - DNA, 22 bp, Artificial Sequence
  chemically synthesized
catatgcaaatatatgcataat

SEQ ID NO: 967265 - DNA, 22 bp, Artificial Sequence
  chemically synthesized
atagaaagcataaccagatgat

SEQ ID NO: 967266 - DNA, 22 bp, Artificial Sequence
  chemically synthesized
tgagtctgatagaaagcataac

SEQ ID NO: 967267 - DNA, 22 bp, Artificial Sequence
  chemically synthesized
atgagtctgatagaaagcataa

SEQ ID NO: 967268 - DNA, 22 bp, Artificial Sequence
  chemically synthesized
gttatgctttctatcagactca

SEQ ID NO: 967269 - DNA, 22 bp, Artificial Sequence
  chemically synthesized
tgctttctatcagactcataaa

SEQ ID NO: 967270 - DNA, 22 bp, Artificial Sequence
  chemically synthesized
gagagaataaagcaggtttatg

SEQ ID NO: 967271 - DNA, 22 bp, Artificial Sequence
  chemically synthesized
tctatcagactcataaacctgc

SEQ ID NO: 967272 - DNA, 22 bp, Artificial Sequence
  chemically synthesized
ctatcagactcataaacctgct

SEQ ID NO: 967273 - DNA, 22 bp, Artificial Sequence
  chemically synthesized
tatcagactcataaacctgctt

SEQ ID NO: 967274 - DNA, 22 bp, Artificial Sequence
  chemically synthesized
tcagactcataaacctgcttta

SEQ ID NO: 967275 - DNA, 22 bp, Artificial Sequence
  chemically synthesized
ataaacctgctttattctctcc

SEQ ID NO: 967276 - DNA, 22 bp, Artificial Sequence
  chemically synthesized
gaagaaaaatgctggagagaat

SEQ ID NO: 967277 - DNA, 22 bp, Artificial Sequence
  chemically synthesized
ctttattctctccagcattttt

SEQ ID NO: 967278 - DNA, 22 bp, Artificial Sequence
  chemically synthesized
tgaaatattagaagaaaaatgc

SEQ ID NO: 967279 - DNA, 22 bp, Artificial Sequence
  chemically synthesized
tattctctccagcatttttctt

SEQ ID NO: 967280 - DNA, 22 bp, Artificial Sequence
  chemically synthesized
atgaaatattagaagaaaaatg

SEQ ID NO: 967281 - DNA, 22 bp, Artificial Sequence
  chemically synthesized
attctctccagcatttttcttc

SEQ ID NO: 967282 - DNA, 22 bp, Artificial Sequence
  chemically synthesized
ttctctccagcatttttcttct

SEQ ID NO: 967283 - DNA, 22 bp, Artificial Sequence
  chemically synthesized
tttatgaaatattagaagaaaa

SEQ ID NO: 967284 - DNA, 22 bp, Artificial Sequence
  chemically synthesized
tctccagcatttttcttctaat

SEQ ID NO: 967285 - DNA, 22 bp, Artificial Sequence
  chemically synthesized
tccagcatttttcttctaatat

SEQ ID NO: 967286 - DNA, 22 bp, Artificial Sequence
  chemically synthesized
cagcatttttcttctaatattt

SEQ ID NO: 967287 - DNA, 22 bp, Artificial Sequence
  chemically synthesized
cagccctatttatgaaatatta

SEQ ID NO: 967288 - DNA, 22 bp, Artificial Sequence
  chemically synthesized
ttcttctaatatttcataaata

SEQ ID NO: 967289 - DNA, 22 bp, Artificial Sequence
  chemically synthesized
aggttacagccctatttatgaa

SEQ ID NO: 967290 - DNA, 22 bp, Artificial Sequence
  chemically synthesized
tcttctaatatttcataaatag

SEQ ID NO: 967291 - DNA, 22 bp, Artificial Sequence
  chemically synthesized
cttctaatatttcataaatagg

SEQ ID NO: 967292 - DNA, 22 bp, Artificial Sequence
  chemically synthesized
ttctaatatttcataaataggg

SEQ ID NO: 967293 - DNA, 22 bp, Artificial Sequence
  chemically synthesized
ctaatatttcataaatagggct

SEQ ID NO: 967294 - DNA, 22 bp, Artificial Sequence
  chemically synthesized
taatatttcataaatagggctg

SEQ ID NO: 967295 - DNA, 22 bp, Artificial Sequence
  chemically synthesized
aggttgaggttacagccctatt

SEQ ID NO: 967296 - DNA, 22 bp, Artificial Sequence
  chemically synthesized
aaggttgaggttacagccctat

SEQ ID NO: 967297 - DNA, 22 bp, Artificial Sequence
  chemically synthesized
atatttcataaatagggctgta

SEQ ID NO: 967298 - DNA, 22 bp, Artificial Sequence
  chemically synthesized
gaatttaaggttgaggttacag

SEQ ID NO: 967299 - DNA, 22 bp, Artificial Sequence
  chemically synthesized
cataaatagggctgtaacctca

SEQ ID NO: 967300 - DNA, 22 bp, Artificial Sequence
  chemically synthesized
ggaatttaaggttgaggttaca

SEQ ID NO: 967301 - DNA, 22 bp, Artificial Sequence
  chemically synthesized
ataaatagggctgtaacctcaa

SEQ ID NO: 967302 - DNA, 22 bp, Artificial Sequence
  chemically synthesized
agaatatttggaatttaaggtt

SEQ ID NO: 967303 - DNA, 22 bp, Artificial Sequence
  chemically synthesized
taacctcaaccttaaattccaa

SEQ ID NO: 967304 - DNA, 22 bp, Artificial Sequence
  chemically synthesized
aaccttaaattccaaatattct

SEQ ID NO: 967305 - DNA, 22 bp, Artificial Sequence
  chemically synthesized
aaattccaaatattctgaattt

SEQ ID NO: 967306 - DNA, 22 bp, Artificial Sequence
  chemically synthesized
tagacaaaaagaaaattcagaa

SEQ ID NO: 967307 - DNA, 22 bp, Artificial Sequence
  chemically synthesized
aattccaaatattctgaatttt

SEQ ID NO: 967308 - DNA, 22 bp, Artificial Sequence
  chemically synthesized
caaatattctgaattttctttt

SEQ ID NO: 967309 - DNA, 22 bp, Artificial Sequence
  chemically synthesized
acaaaatacaattatagacaaa

SEQ ID NO: 967310 - DNA, 22 bp, Artificial Sequence
  chemically synthesized
tgaattttctttttgtctataa

SEQ ID NO: 967311 - DNA, 22 bp, Artificial Sequence
  chemically synthesized
gacaaaatacaattatagacaa

SEQ ID NO: 967312 - DNA, 22 bp, Artificial Sequence
  chemically synthesized
aattttctttttgtctataatt

SEQ ID NO: 967313 - DNA, 22 bp, Artificial Sequence
  chemically synthesized
tctttttgtctataattgtatt

SEQ ID NO: 967314 - DNA, 22 bp, Artificial Sequence
  chemically synthesized
ctttttgtctataattgtattt

SEQ ID NO: 967315 - DNA, 22 bp, Artificial Sequence
  chemically synthesized
tttttgtctataattgtatttt

SEQ ID NO: 967316 - DNA, 22 bp, Artificial Sequence
  chemically synthesized
tttgtctataattgtattttgt

SEQ ID NO: 967317 - DNA, 22 bp, Artificial Sequence
  chemically synthesized
ttgtctataattgtattttgtc

SEQ ID NO: 967318 - DNA, 22 bp, Artificial Sequence
  chemically synthesized
tgtctataattgtattttgtca

SEQ ID NO: 967319 - DNA, 22 bp, Artificial Sequence
  chemically synthesized
gtctataattgtattttgtcaa

SEQ ID NO: 967320 - DNA, 22 bp, Artificial Sequence
  chemically synthesized
tctataattgtattttgtcaag

SEQ ID NO: 967321 - DNA, 22 bp, Artificial Sequence
  chemically synthesized
gtaaaaaaaaatcttgacaaaa

SEQ ID NO: 967322 - DNA, 22 bp, Artificial Sequence
  chemically synthesized
taattgtattttgtcaagattt

SEQ ID NO: 967323 - DNA, 22 bp, Artificial Sequence
  chemically synthesized
aatattagtaaaaaaaaatctt

SEQ ID NO: 967324 - DNA, 22 bp, Artificial Sequence
  chemically synthesized
aaatattagtaaaaaaaaatct

SEQ ID NO: 967325 - DNA, 22 bp, Artificial Sequence
  chemically synthesized
taaatattagtaaaaaaaaatc

SEQ ID NO: 967326 - DNA, 22 bp, Artificial Sequence
  chemically synthesized
tattttgtcaagattttttttt

SEQ ID NO: 967327 - DNA, 22 bp, Artificial Sequence
  chemically synthesized
attttaaatattagtaaaaaaa

SEQ ID NO: 967328 - DNA, 22 bp, Artificial Sequence
  chemically synthesized
tgtcaagatttttttttactaa

SEQ ID NO: 967329 - DNA, 22 bp, Artificial Sequence
  chemically synthesized
gtcaagatttttttttactaat

SEQ ID NO: 967330 - DNA, 22 bp, Artificial Sequence
  chemically synthesized
tcaagatttttttttactaata

SEQ ID NO: 967331 - DNA, 22 bp, Artificial Sequence
  chemically synthesized
aagttcattttaaatattagta

SEQ ID NO: 967332 - DNA, 22 bp, Artificial Sequence
  chemically synthesized
aaagttcattttaaatattagt

SEQ ID NO: 967333 - DNA, 22 bp, Artificial Sequence
  chemically synthesized
ttttttactaatatttaaaatg

SEQ ID NO: 967334 - DNA, 22 bp, Artificial Sequence
  chemically synthesized
tttttactaatatttaaaatga

SEQ ID NO: 967335 - DNA, 22 bp, Artificial Sequence
  chemically synthesized
ttttactaatatttaaaatgaa

SEQ ID NO: 967336 - DNA, 22 bp, Artificial Sequence
  chemically synthesized
tttactaatatttaaaatgaac

SEQ ID NO: 967337 - DNA, 22 bp, Artificial Sequence
  chemically synthesized
ttactaatatttaaaatgaact

SEQ ID NO: 967338 - DNA, 22 bp, Artificial Sequence
  chemically synthesized
agaaacatttaaagttcatttt

SEQ ID NO: 967339 - DNA, 22 bp, Artificial Sequence
  chemically synthesized
tactaatatttaaaatgaactt

SEQ ID NO: 967340 - DNA, 22 bp, Artificial Sequence
  chemically synthesized
actaatatttaaaatgaacttt

SEQ ID NO: 967341 - DNA, 22 bp, Artificial Sequence
  chemically synthesized
ctaatatttaaaatgaacttta

SEQ ID NO: 967342 - DNA, 22 bp, Artificial Sequence
  chemically synthesized
atatttaaaatgaactttaaat

SEQ ID NO: 967343 - DNA, 22 bp, Artificial Sequence
  chemically synthesized
aaattcagaaacatttaaagtt

SEQ ID NO: 967344 - DNA, 22 bp, Artificial Sequence
  chemically synthesized
aaaatgaactttaaatgtttct

SEQ ID NO: 967345 - DNA, 22 bp, Artificial Sequence
  chemically synthesized
aaatgaactttaaatgtttctg

SEQ ID NO: 967346 - DNA, 22 bp, Artificial Sequence
  chemically synthesized
aatattaaaattcagaaacatt

SEQ ID NO: 967347 - DNA, 22 bp, Artificial Sequence
  chemically synthesized
caatattaaaattcagaaacat

SEQ ID NO: 967348 - DNA, 22 bp, Artificial Sequence
  chemically synthesized
aggtttcaatattaaaattcag

SEQ ID NO: 967349 - DNA, 22 bp, Artificial Sequence
  chemically synthesized
gaggtttcaatattaaaattca

SEQ ID NO: 967350 - DNA, 22 bp, Artificial Sequence
  chemically synthesized
taaatgtttctgaattttaata

SEQ ID NO: 967351 - DNA, 22 bp, Artificial Sequence
  chemically synthesized
aaatgtttctgaattttaatat

SEQ ID NO: 967352 - DNA, 22 bp, Artificial Sequence
  chemically synthesized
aatgtttctgaattttaatatt

SEQ ID NO: 967353 - DNA, 22 bp, Artificial Sequence
  chemically synthesized
ctgaattttaatattgaaacct

SEQ ID NO: 967354 - DNA, 22 bp, Artificial Sequence
  chemically synthesized
tgaattttaatattgaaacctc

SEQ ID NO: 967355 - DNA, 22 bp, Artificial Sequence
  chemically synthesized
aattttaatattgaaacctcaa

SEQ ID NO: 967356 - DNA, 22 bp, Artificial Sequence
  chemically synthesized
taatattgaaacctcaaatcct

SEQ ID NO: 967357 - DNA, 22 bp, Artificial Sequence
  chemically synthesized
aatattgaaacctcaaatcctc

SEQ ID NO: 967358 - DNA, 22 bp, Artificial Sequence
  chemically synthesized
aggtgagtgtgtgaggatttga

SEQ ID NO: 967359 - DNA, 22 bp, Artificial Sequence
  chemically synthesized
atattgaaacctcaaatcctca

SEQ ID NO: 967360 - DNA, 22 bp, Artificial Sequence
  chemically synthesized
cctaaggtgagtgtgtgaggat

SEQ ID NO: 967361 - DNA, 22 bp, Artificial Sequence
  chemically synthesized
acctaaggtgagtgtgtgagga

SEQ ID NO: 967362 - DNA, 22 bp, Artificial Sequence
  chemically synthesized
aaacctcaaatcctcacacact

SEQ ID NO: 967363 - DNA, 22 bp, Artificial Sequence
  chemically synthesized
cttacctaaggtgagtgtgtga

SEQ ID NO: 967364 - DNA, 22 bp, Artificial Sequence
  chemically synthesized
acttacctaaggtgagtgtgtg

SEQ ID NO: 967365 - DNA, 22 bp, Artificial Sequence
  chemically synthesized
tacttacctaaggtgagtgtgt

SEQ ID NO: 967366 - DNA, 22 bp, Artificial Sequence
  chemically synthesized
ttacttacctaaggtgagtgtg

SEQ ID NO: 967367 - DNA, 22 bp, Artificial Sequence
  chemically synthesized
tttacttacctaaggtgagtgt

SEQ ID NO: 967368 - DNA, 22 bp, Artificial Sequence
  chemically synthesized
ttttacttacctaaggtgagtg

SEQ ID NO: 967369 - DNA, 22 bp, Artificial Sequence
  chemically synthesized
aaatcctcacacactcacctta

SEQ ID NO: 967370 - DNA, 22 bp, Artificial Sequence
  chemically synthesized
aagcttttttacttacctaagg

SEQ ID NO: 967371 - DNA, 22 bp, Artificial Sequence
  chemically synthesized
taaagcttttttacttacctaa

SEQ ID NO: 967372 - DNA, 22 bp, Artificial Sequence
  chemically synthesized
acacactcaccttaggtaagta

SEQ ID NO: 967373 - DNA, 22 bp, Artificial Sequence
  chemically synthesized
aagctctaaagcttttttactt

SEQ ID NO: 967374 - DNA, 22 bp, Artificial Sequence
  chemically synthesized
accttaggtaagtaaaaaagct

SEQ ID NO: 967375 - DNA, 22 bp, Artificial Sequence
  chemically synthesized
actcaagctctaaagctttttt

SEQ ID NO: 967376 - DNA, 22 bp, Artificial Sequence
  chemically synthesized
ctaactcaagctctaaagcttt

SEQ ID NO: 967377 - DNA, 22 bp, Artificial Sequence
  chemically synthesized
aggtaagtaaaaaagctttaga

SEQ ID NO: 967378 - DNA, 22 bp, Artificial Sequence
  chemically synthesized
actaactcaagctctaaagctt

SEQ ID NO: 967379 - DNA, 22 bp, Artificial Sequence
  chemically synthesized
ggtaagtaaaaaagctttagag

SEQ ID NO: 967380 - DNA, 22 bp, Artificial Sequence
  chemically synthesized
ttactaactcaagctctaaagc

SEQ ID NO: 967381 - DNA, 22 bp, Artificial Sequence
  chemically synthesized
cttactaactcaagctctaaag

SEQ ID NO: 967382 - DNA, 22 bp, Artificial Sequence
  chemically synthesized
agtccttcttactaactcaagc

SEQ ID NO: 967383 - DNA, 22 bp, Artificial Sequence
  chemically synthesized
actaagtccttcttactaactc

SEQ ID NO: 967384 - DNA, 22 bp, Artificial Sequence
  chemically synthesized
gactaagtccttcttactaact

SEQ ID NO: 967385 - DNA, 22 bp, Artificial Sequence
  chemically synthesized
tagagcttgagttagtaagaag

SEQ ID NO: 967386 - DNA, 22 bp, Artificial Sequence
  chemically synthesized
cttgactaagtccttcttacta

SEQ ID NO: 967387 - DNA, 22 bp, Artificial Sequence
  chemically synthesized
agagcttgagttagtaagaagg

SEQ ID NO: 967388 - DNA, 22 bp, Artificial Sequence
  chemically synthesized
ccttgactaagtccttcttact

SEQ ID NO: 967389 - DNA, 22 bp, Artificial Sequence
  chemically synthesized
gagcttgagttagtaagaagga

SEQ ID NO: 967390 - DNA, 22 bp, Artificial Sequence
  chemically synthesized
tccttgactaagtccttcttac

SEQ ID NO: 967391 - DNA, 22 bp, Artificial Sequence
  chemically synthesized
tttccttgactaagtccttctt

SEQ ID NO: 967392 - DNA, 22 bp, Artificial Sequence
  chemically synthesized
gagttagtaagaaggacttagt

SEQ ID NO: 967393 - DNA, 22 bp, Artificial Sequence
  chemically synthesized
tctctttccttgactaagtcct

SEQ ID NO: 967394 - DNA, 22 bp, Artificial Sequence
  chemically synthesized
agttagtaagaaggacttagtc

SEQ ID NO: 967395 - DNA, 22 bp, Artificial Sequence
  chemically synthesized
tattgtctctttccttgactaa

SEQ ID NO: 967396 - DNA, 22 bp, Artificial Sequence
  chemically synthesized
gtaagaaggacttagtcaagga

SEQ ID NO: 967397 - DNA, 22 bp, Artificial Sequence
  chemically synthesized
actgtattgtctctttccttga

SEQ ID NO: 967398 - DNA, 22 bp, Artificial Sequence
  chemically synthesized
actcactgtattgtctctttcc

SEQ ID NO: 967399 - DNA, 22 bp, Artificial Sequence
  chemically synthesized
actcactcactgtattgtctct

SEQ ID NO: 967400 - DNA, 22 bp, Artificial Sequence
  chemically synthesized
agtcaaggaaagagacaataca

SEQ ID NO: 967401 - DNA, 22 bp, Artificial Sequence
  chemically synthesized
gtcaaggaaagagacaatacag

SEQ ID NO: 967402 - DNA, 22 bp, Artificial Sequence
  chemically synthesized
aacacacacacaggcacataca

SEQ ID NO: 967403 - DNA, 22 bp, Artificial Sequence
  chemically synthesized
gtgtatgtgcctgtgtgtgtgt

SEQ ID NO: 967404 - DNA, 22 bp, Artificial Sequence
  chemically synthesized
tgtatgtgcctgtgtgtgtgtt

SEQ ID NO: 967405 - DNA, 22 bp, Artificial Sequence
  chemically synthesized
tgtgtgtgttgaggggtcattt

SEQ ID NO: 967406 - DNA, 22 bp, Artificial Sequence
  chemically synthesized
gatgtcatgtgcaatacacaaa

SEQ ID NO: 967407 - DNA, 22 bp, Artificial Sequence
  chemically synthesized
tcgatgtcatgtgcaatacaca

SEQ ID NO: 967408 - DNA, 22 bp, Artificial Sequence
  chemically synthesized
ctcgatgtcatgtgcaatacac

SEQ ID NO: 967409 - DNA, 22 bp, Artificial Sequence
  chemically synthesized
aggggtcatttgtgtattgcac

SEQ ID NO: 967410 - DNA, 22 bp, Artificial Sequence
  chemically synthesized
acttctcgatgtcatgtgcaat

SEQ ID NO: 967411 - DNA, 22 bp, Artificial Sequence
  chemically synthesized
gtgtattgcacatgacatcgag

SEQ ID NO: 967412 - DNA, 22 bp, Artificial Sequence
  chemically synthesized
tgtattgcacatgacatcgaga

SEQ ID NO: 967413 - DNA, 22 bp, Artificial Sequence
  chemically synthesized
acatccctcacttctcgatgtc

SEQ ID NO: 967414 - DNA, 22 bp, Artificial Sequence
  chemically synthesized
cacatccctcacttctcgatgt

SEQ ID NO: 967415 - DNA, 22 bp, Artificial Sequence
  chemically synthesized
tcacatccctcacttctcgatg

SEQ ID NO: 967416 - DNA, 22 bp, Artificial Sequence
  chemically synthesized
gttttcacatccctcacttctc

SEQ ID NO: 967417 - DNA, 22 bp, Artificial Sequence
  chemically synthesized
cacatgacatcgagaagtgagg

SEQ ID NO: 967418 - DNA, 22 bp, Artificial Sequence
  chemically synthesized
ggttttcacatccctcacttct

SEQ ID NO: 967419 - DNA, 22 bp, Artificial Sequence
  chemically synthesized
aggaaggaaacatcttggtttt

SEQ ID NO: 967420 - DNA, 22 bp, Artificial Sequence
  chemically synthesized
aatcaggtcacacggcctcagg

SEQ ID NO: 967421 - DNA, 22 bp, Artificial Sequence
  chemically synthesized
tgaatcaggtcacacggcctca

SEQ ID NO: 967422 - DNA, 22 bp, Artificial Sequence
  chemically synthesized
ccttcctgaggccgtgtgacct

SEQ ID NO: 967423 - DNA, 22 bp, Artificial Sequence
  chemically synthesized
cttcctgaggccgtgtgacctg

SEQ ID NO: 967424 - DNA, 22 bp, Artificial Sequence
  chemically synthesized
cctgaggccgtgtgacctgatt

SEQ ID NO: 967425 - DNA, 22 bp, Artificial Sequence
  chemically synthesized
ctgaggccgtgtgacctgattc

SEQ ID NO: 967426 - DNA, 22 bp, Artificial Sequence
  chemically synthesized
aggccgtgtgacctgattcaga

SEQ ID NO: 967427 - DNA, 22 bp, Artificial Sequence
  chemically synthesized
agaggtgaatgagatgcagctc

SEQ ID NO: 967428 - DNA, 22 bp, Artificial Sequence
  chemically synthesized
attcagagctgcatctcattca

SEQ ID NO: 967429 - DNA, 22 bp, Artificial Sequence
  chemically synthesized
agagctgcatctcattcacctc

SEQ ID NO: 967430 - DNA, 22 bp, Artificial Sequence
  chemically synthesized
caaccagggacctaagaggtga

SEQ ID NO: 967431 - DNA, 22 bp, Artificial Sequence
  chemically synthesized
catctcattcacctcttaggtc

SEQ ID NO: 967432 - DNA, 22 bp, Artificial Sequence
  chemically synthesized
attcacctcttaggtccctggt

SEQ ID NO: 967433 - DNA, 22 bp, Artificial Sequence
  chemically synthesized
aaaaaggcactccaaccaggga

SEQ ID NO: 967434 - DNA, 22 bp, Artificial Sequence
  chemically synthesized
gaaaaaggcactccaaccaggg

SEQ ID NO: 967435 - DNA, 22 bp, Artificial Sequence
  chemically synthesized
acctcttaggtccctggttgga

SEQ ID NO: 967436 - DNA, 22 bp, Artificial Sequence
  chemically synthesized
ttaggtccctggttggagtgcc

SEQ ID NO: 967437 - DNA, 22 bp, Artificial Sequence
  chemically synthesized
aggtccctggttggagtgcctt

SEQ ID NO: 967438 - DNA, 22 bp, Artificial Sequence
  chemically synthesized
ggtccctggttggagtgccttt

SEQ ID NO: 967439 - DNA, 22 bp, Artificial Sequence
  chemically synthesized
ggcagagacatttgaaaaaggc

SEQ ID NO: 967440 - DNA, 22 bp, Artificial Sequence
  chemically synthesized
gggcagagacatttgaaaaagg

SEQ ID NO: 967441 - DNA, 22 bp, Artificial Sequence
  chemically synthesized
tgggcagagacatttgaaaaag

SEQ ID NO: 967442 - DNA, 22 bp, Artificial Sequence
  chemically synthesized
gttggagtgcctttttcaaatg

SEQ ID NO: 967443 - DNA, 22 bp, Artificial Sequence
  chemically synthesized
actttgggcagagacatttgaa

SEQ ID NO: 967444 - DNA, 22 bp, Artificial Sequence
  chemically synthesized
gagtgcctttttcaaatgtctc

SEQ ID NO: 967445 - DNA, 22 bp, Artificial Sequence
  chemically synthesized
tttcaaatgtctctgcccaaag

SEQ ID NO: 967446 - DNA, 22 bp, Artificial Sequence
  chemically synthesized
ttcaaatgtctctgcccaaagt

SEQ ID NO: 967447 - DNA, 22 bp, Artificial Sequence
  chemically synthesized
tcaaatgtctctgcccaaagtg

SEQ ID NO: 967448 - DNA, 22 bp, Artificial Sequence
  chemically synthesized
caaatgtctctgcccaaagtga

SEQ ID NO: 967449 - DNA, 22 bp, Artificial Sequence
  chemically synthesized
aaatgtctctgcccaaagtgag

SEQ ID NO: 967450 - DNA, 22 bp, Artificial Sequence
  chemically synthesized
ataaaagatgtccctcactttg

SEQ ID NO: 967451 - DNA, 22 bp, Artificial Sequence
  chemically synthesized
aataaaagatgtccctcacttt

SEQ ID NO: 967452 - DNA, 22 bp, Artificial Sequence
  chemically synthesized
tgcccaaagtgagggacatctt

SEQ ID NO: 967453 - DNA, 22 bp, Artificial Sequence
  chemically synthesized
atggtttaataaaagatgtccc

SEQ ID NO: 967454 - DNA, 22 bp, Artificial Sequence
  chemically synthesized
gatggtttaataaaagatgtcc

SEQ ID NO: 967455 - DNA, 22 bp, Artificial Sequence
  chemically synthesized
cccaaagtgagggacatctttt

SEQ ID NO: 967456 - DNA, 22 bp, Artificial Sequence
  chemically synthesized
acttgatggtttaataaaagat

SEQ ID NO: 967457 - DNA, 22 bp, Artificial Sequence
  chemically synthesized
gacttgatggtttaataaaaga

SEQ ID NO: 967458 - DNA, 22 bp, Artificial Sequence
  chemically synthesized
tgacttgatggtttaataaaag

SEQ ID NO: 967459 - DNA, 22 bp, Artificial Sequence
  chemically synthesized
gttttgacttgatggtttaata

SEQ ID NO: 967460 - DNA, 22 bp, Artificial Sequence
  chemically synthesized
ttattaaaccatcaagtcaaaa

SEQ ID NO: 967461 - DNA, 22 bp, Artificial Sequence
  chemically synthesized
tattaaaccatcaagtcaaaac

SEQ ID NO: 967462 - DNA, 22 bp, Artificial Sequence
  chemically synthesized
gaaagatcactcgttttgactt

SEQ ID NO: 967463 - DNA, 22 bp, Artificial Sequence
  chemically synthesized
attaaaccatcaagtcaaaacg

SEQ ID NO: 967464 - DNA, 22 bp, Artificial Sequence
  chemically synthesized
ttaaaccatcaagtcaaaacga

SEQ ID NO: 967465 - DNA, 22 bp, Artificial Sequence
  chemically synthesized
aaccatcaagtcaaaacgagtg

SEQ ID NO: 967466 - DNA, 22 bp, Artificial Sequence
  chemically synthesized
tatgtattagaaagatcactcg

SEQ ID NO: 967467 - DNA, 22 bp, Artificial Sequence
  chemically synthesized
gtatgtattagaaagatcactc

SEQ ID NO: 967468 - DNA, 22 bp, Artificial Sequence
  chemically synthesized
tgtatgtattagaaagatcact

SEQ ID NO: 967469 - DNA, 22 bp, Artificial Sequence
  chemically synthesized
agtctttgtatgtattagaaag

SEQ ID NO: 967470 - DNA, 22 bp, Artificial Sequence
  chemically synthesized
tctaatacatacaaagactcag

SEQ ID NO: 967471 - DNA, 22 bp, Artificial Sequence
  chemically synthesized
ctaatacatacaaagactcagg

SEQ ID NO: 967472 - DNA, 22 bp, Artificial Sequence
  chemically synthesized
tatatggcatatcctgagtctt

SEQ ID NO: 967473 - DNA, 22 bp, Artificial Sequence
  chemically synthesized
taatacatacaaagactcagga

SEQ ID NO: 967474 - DNA, 22 bp, Artificial Sequence
  chemically synthesized
atacatacaaagactcaggata

SEQ ID NO: 967475 - DNA, 22 bp, Artificial Sequence
  chemically synthesized
catgtctgtatatggcatatcc

SEQ ID NO: 967476 - DNA, 22 bp, Artificial Sequence
  chemically synthesized
gcatgtctgtatatggcatatc

SEQ ID NO: 967477 - DNA, 22 bp, Artificial Sequence
  chemically synthesized
gtcatttgcatgtctgtatatg

SEQ ID NO: 967478 - DNA, 22 bp, Artificial Sequence
  chemically synthesized
ggtcatttgcatgtctgtatat

SEQ ID NO: 967479 - DNA, 22 bp, Artificial Sequence
  chemically synthesized
aggatatgccatatacagacat

SEQ ID NO: 967480 - DNA, 22 bp, Artificial Sequence
  chemically synthesized
aaaataggccttggtcatttgc

SEQ ID NO: 967481 - DNA, 22 bp, Artificial Sequence
  chemically synthesized
gaaaataggccttggtcatttg

SEQ ID NO: 967482 - DNA, 22 bp, Artificial Sequence
  chemically synthesized
gtaataatgcttgaaaataggc

SEQ ID NO: 967483 - DNA, 22 bp, Artificial Sequence
  chemically synthesized
agtaataatgcttgaaaatagg

SEQ ID NO: 967484 - DNA, 22 bp, Artificial Sequence
  chemically synthesized
tagtaataatgcttgaaaatag

SEQ ID NO: 967485 - DNA, 22 bp, Artificial Sequence
  chemically synthesized
ttttagtaataatgcttgaaaa

SEQ ID NO: 967486 - DNA, 22 bp, Artificial Sequence
  chemically synthesized
ttttcaagcattattactaaaa

SEQ ID NO: 967487 - DNA, 22 bp, Artificial Sequence
  chemically synthesized
tcccaaataattattttagtaa

SEQ ID NO: 967488 - DNA, 22 bp, Artificial Sequence
  chemically synthesized
atcccaaataattattttagta

SEQ ID NO: 967489 - DNA, 22 bp, Artificial Sequence
  chemically synthesized
tcaagcattattactaaaataa

SEQ ID NO: 967490 - DNA, 22 bp, Artificial Sequence
  chemically synthesized
tatcccaaataattattttagt

SEQ ID NO: 967491 - DNA, 22 bp, Artificial Sequence
  chemically synthesized
caagcattattactaaaataat

SEQ ID NO: 967492 - DNA, 22 bp, Artificial Sequence
  chemically synthesized
aagcattattactaaaataatt

SEQ ID NO: 967493 - DNA, 22 bp, Artificial Sequence
  chemically synthesized
agttttatcccaaataattatt

SEQ ID NO: 967494 - DNA, 22 bp, Artificial Sequence
  chemically synthesized
ttaagttttatcccaaataatt

SEQ ID NO: 967495 - DNA, 22 bp, Artificial Sequence
  chemically synthesized
attaagttttatcccaaataat

SEQ ID NO: 967496 - DNA, 22 bp, Artificial Sequence
  chemically synthesized
ttactaaaataattatttggga

SEQ ID NO: 967497 - DNA, 22 bp, Artificial Sequence
  chemically synthesized
ctaaaataattatttgggataa

SEQ ID NO: 967498 - DNA, 22 bp, Artificial Sequence
  chemically synthesized
tgtttattaagttttatcccaa

SEQ ID NO: 967499 - DNA, 22 bp, Artificial Sequence
  chemically synthesized
gtgtttattaagttttatccca

SEQ ID NO: 967500 - DNA, 22 bp, Artificial Sequence
  chemically synthesized
aaataattatttgggataaaac

SEQ ID NO: 967501 - DNA, 22 bp, Artificial Sequence
  chemically synthesized
cttgtgtttattaagttttatc

SEQ ID NO: 967502 - DNA, 22 bp, Artificial Sequence
  chemically synthesized
tttgggataaaacttaataaac

SEQ ID NO: 967503 - DNA, 22 bp, Artificial Sequence
  chemically synthesized
gggataaaacttaataaacaca

SEQ ID NO: 967504 - DNA, 22 bp, Artificial Sequence
  chemically synthesized
ggataaaacttaataaacacaa

SEQ ID NO: 967505 - DNA, 22 bp, Artificial Sequence
  chemically synthesized
taaagcagatactacttgtgtt

SEQ ID NO: 967506 - DNA, 22 bp, Artificial Sequence
  chemically synthesized
tctataaagcagatactacttg

SEQ ID NO: 967507 - DNA, 22 bp, Artificial Sequence
  chemically synthesized
aataaacacaagtagtatctgc

SEQ ID NO: 967508 - DNA, 22 bp, Artificial Sequence
  chemically synthesized
ataaacacaagtagtatctgct

SEQ ID NO: 967509 - DNA, 22 bp, Artificial Sequence
  chemically synthesized
gcaccatcatctatctataaag

SEQ ID NO: 967510 - DNA, 22 bp, Artificial Sequence
  chemically synthesized
ggcaccatcatctatctataaa

SEQ ID NO: 967511 - DNA, 22 bp, Artificial Sequence
  chemically synthesized
aatttggcaccatcatctatct

SEQ ID NO: 967512 - DNA, 22 bp, Artificial Sequence
  chemically synthesized
ctttatagatagatgatggtgc

SEQ ID NO: 967513 - DNA, 22 bp, Artificial Sequence
  chemically synthesized
atattcaatttggcaccatcat

SEQ ID NO: 967514 - DNA, 22 bp, Artificial Sequence
  chemically synthesized
tatagatagatgatggtgccaa

SEQ ID NO: 967515 - DNA, 22 bp, Artificial Sequence
  chemically synthesized
atagatagatgatggtgccaaa

SEQ ID NO: 967516 - DNA, 22 bp, Artificial Sequence
  chemically synthesized
tagatagatgatggtgccaaat

SEQ ID NO: 967517 - DNA, 22 bp, Artificial Sequence
  chemically synthesized
atattcatattcaatttggcac

SEQ ID NO: 967518 - DNA, 22 bp, Artificial Sequence
  chemically synthesized
caaacaactgatattcatattc

SEQ ID NO: 967519 - DNA, 22 bp, Artificial Sequence
  chemically synthesized
ttgcaaacaactgatattcata

SEQ ID NO: 967520 - DNA, 22 bp, Artificial Sequence
  chemically synthesized
cctattgcaaacaactgatatt

SEQ ID NO: 967521 - DNA, 22 bp, Artificial Sequence
  chemically synthesized
aatatgaatatcagttgtttgc

SEQ ID NO: 967522 - DNA, 22 bp, Artificial Sequence
  chemically synthesized
tgtggaaaatatgttccctatt

SEQ ID NO: 967523 - DNA, 22 bp, Artificial Sequence
  chemically synthesized
atgtggaaaatatgttccctat

SEQ ID NO: 967524 - DNA, 22 bp, Artificial Sequence
  chemically synthesized
tttgcaatagggaacatatttt

SEQ ID NO: 967525 - DNA, 22 bp, Artificial Sequence
  chemically synthesized
gcaatagggaacatattttcca

SEQ ID NO: 967526 - DNA, 22 bp, Artificial Sequence
  chemically synthesized
caatagggaacatattttccac

SEQ ID NO: 967527 - DNA, 22 bp, Artificial Sequence
  chemically synthesized
agtatccaatgcttatgtggaa

SEQ ID NO: 967528 - DNA, 22 bp, Artificial Sequence
  chemically synthesized
ctaagtatccaatgcttatgtg

SEQ ID NO: 967529 - DNA, 22 bp, Artificial Sequence
  chemically synthesized
agctactaagtatccaatgctt

SEQ ID NO: 967530 - DNA, 22 bp, Artificial Sequence
  chemically synthesized
tccacataagcattggatactt

SEQ ID NO: 967531 - DNA, 22 bp, Artificial Sequence
  chemically synthesized
ccacataagcattggatactta

SEQ ID NO: 967532 - DNA, 22 bp, Artificial Sequence
  chemically synthesized
cacataagcattggatacttag

SEQ ID NO: 967533 - DNA, 22 bp, Artificial Sequence
  chemically synthesized
gcaactgagctactaagtatcc

SEQ ID NO: 967534 - DNA, 22 bp, Artificial Sequence
  chemically synthesized
gatacttagtagctcagttgcc

SEQ ID NO: 967535 - DNA, 22 bp, Artificial Sequence
  chemically synthesized
gagtcggcagtgtaattggcaa

SEQ ID NO: 967536 - DNA, 22 bp, Artificial Sequence
  chemically synthesized
agtagctcagttgccaattaca

SEQ ID NO: 967537 - DNA, 22 bp, Artificial Sequence
  chemically synthesized
gtagctcagttgccaattacac

SEQ ID NO: 967538 - DNA, 22 bp, Artificial Sequence
  chemically synthesized
agttagagtcggcagtgtaatt

SEQ ID NO: 967539 - DNA, 22 bp, Artificial Sequence
  chemically synthesized
aagttagagtcggcagtgtaat

SEQ ID NO: 967540 - DNA, 22 bp, Artificial Sequence
  chemically synthesized
agttgccaattacactgccgac

SEQ ID NO: 967541 - DNA, 22 bp, Artificial Sequence
  chemically synthesized
gatagcttaagttagagtcggc

SEQ ID NO: 967542 - DNA, 22 bp, Artificial Sequence
  chemically synthesized
ccaattacactgccgactctaa

SEQ ID NO: 967543 - DNA, 22 bp, Artificial Sequence
  chemically synthesized
attagatagcttaagttagagt

SEQ ID NO: 967544 - DNA, 22 bp, Artificial Sequence
  chemically synthesized
cactgccgactctaacttaagc

SEQ ID NO: 967545 - DNA, 22 bp, Artificial Sequence
  chemically synthesized
tcctcattagatagcttaagtt

SEQ ID NO: 967546 - DNA, 22 bp, Artificial Sequence
  chemically synthesized
ttgtcctcattagatagcttaa

SEQ ID NO: 967547 - DNA, 22 bp, Artificial Sequence
  chemically synthesized
ccgactctaacttaagctatct

SEQ ID NO: 967548 - DNA, 22 bp, Artificial Sequence
  chemically synthesized
taacttaagctatctaatgagg

SEQ ID NO: 967549 - DNA, 22 bp, Artificial Sequence
  chemically synthesized
acttaagctatctaatgaggac

SEQ ID NO: 967550 - DNA, 22 bp, Artificial Sequence
  chemically synthesized
aagctatctaatgaggacaaca

SEQ ID NO: 967551 - DNA, 22 bp, Artificial Sequence
  chemically synthesized
agctatctaatgaggacaacag

SEQ ID NO: 967552 - DNA, 22 bp, Artificial Sequence
  chemically synthesized
tctaatgaggacaacagacctg

SEQ ID NO: 967553 - DNA, 22 bp, Artificial Sequence
  chemically synthesized
cgtaatcccaatagcaggtctg

SEQ ID NO: 967554 - DNA, 22 bp, Artificial Sequence
  chemically synthesized
atgaggacaacagacctgctat

SEQ ID NO: 967555 - DNA, 22 bp, Artificial Sequence
  chemically synthesized
aattccgtaatcccaatagcag

SEQ ID NO: 967556 - DNA, 22 bp, Artificial Sequence
  chemically synthesized
ctgaattccgtaatcccaatag

SEQ ID NO: 967557 - DNA, 22 bp, Artificial Sequence
  chemically synthesized
cctgaattccgtaatcccaata

SEQ ID NO: 967558 - DNA, 22 bp, Artificial Sequence
  chemically synthesized
tttcctgaattccgtaatccca

SEQ ID NO: 967559 - DNA, 22 bp, Artificial Sequence
  chemically synthesized
ctgtttcctgaattccgtaatc

SEQ ID NO: 967560 - DNA, 22 bp, Artificial Sequence
  chemically synthesized
actgtttcctgaattccgtaat

SEQ ID NO: 967561 - DNA, 22 bp, Artificial Sequence
  chemically synthesized
ctattgggattacggaattcag

SEQ ID NO: 967562 - DNA, 22 bp, Artificial Sequence
  chemically synthesized
ttgggattacggaattcaggaa

SEQ ID NO: 967563 - DNA, 22 bp, Artificial Sequence
  chemically synthesized
ggattacggaattcaggaaaca

SEQ ID NO: 967564 - DNA, 22 bp, Artificial Sequence
  chemically synthesized
agagtgaatttactgtttcctg

SEQ ID NO: 967565 - DNA, 22 bp, Artificial Sequence
  chemically synthesized
tcagagtgaatttactgtttcc

SEQ ID NO: 967566 - DNA, 22 bp, Artificial Sequence
  chemically synthesized
cggaattcaggaaacagtaaat

SEQ ID NO: 967567 - DNA, 22 bp, Artificial Sequence
  chemically synthesized
ctctcagagtgaatttactgtt

SEQ ID NO: 967568 - DNA, 22 bp, Artificial Sequence
  chemically synthesized
aattgctctcagagtgaattta

SEQ ID NO: 967569 - DNA, 22 bp, Artificial Sequence
  chemically synthesized
aggaaacagtaaattcactctg

SEQ ID NO: 967570 - DNA, 22 bp, Artificial Sequence
  chemically synthesized
agaggatctcaattgctctcag

SEQ ID NO: 967571 - DNA, 22 bp, Artificial Sequence
  chemically synthesized
cagaggatctcaattgctctca

SEQ ID NO: 967572 - DNA, 22 bp, Artificial Sequence
  chemically synthesized
actctgagagcaattgagatcc

SEQ ID NO: 967573 - DNA, 22 bp, Artificial Sequence
  chemically synthesized
tgagagcaattgagatcctctg

SEQ ID NO: 967574 - DNA, 22 bp, Artificial Sequence
  chemically synthesized
cgagaccccatttcagaggatc

SEQ ID NO: 967575 - DNA, 22 bp, Artificial Sequence
  chemically synthesized
agagcaattgagatcctctgaa

SEQ ID NO: 967576 - DNA, 22 bp, Artificial Sequence
  chemically synthesized
ccgagaccccatttcagaggat

SEQ ID NO: 967577 - DNA, 22 bp, Artificial Sequence
  chemically synthesized
cccgccttccgagaccccattt

SEQ ID NO: 967578 - DNA, 22 bp, Artificial Sequence
  chemically synthesized
agatcctctgaaatggggtctc

SEQ ID NO: 967579 - DNA, 22 bp, Artificial Sequence
  chemically synthesized
attccccgccttccgagacccc

SEQ ID NO: 967580 - DNA, 22 bp, Artificial Sequence
  chemically synthesized
ttaattccccgccttccgagac

SEQ ID NO: 967581 - DNA, 22 bp, Artificial Sequence
  chemically synthesized
tgaaatggggtctcggaaggcg

SEQ ID NO: 967582 - DNA, 22 bp, Artificial Sequence
  chemically synthesized
ttattaattccccgccttccga

SEQ ID NO: 967583 - DNA, 22 bp, Artificial Sequence
  chemically synthesized
aaatggggtctcggaaggcggg

SEQ ID NO: 967584 - DNA, 22 bp, Artificial Sequence
  chemically synthesized
aaaggccctgttattaattccc

SEQ ID NO: 967585 - DNA, 22 bp, Artificial Sequence
  chemically synthesized
ggaaggcggggaattaataaca

SEQ ID NO: 967586 - DNA, 22 bp, Artificial Sequence
  chemically synthesized
tgaggccatactcaaaggccct

SEQ ID NO: 967587 - DNA, 22 bp, Artificial Sequence
  chemically synthesized
gtgaggccatactcaaaggccc

SEQ ID NO: 967588 - DNA, 22 bp, Artificial Sequence
  chemically synthesized
ataacagggcctttgagtatgg

SEQ ID NO: 967589 - DNA, 22 bp, Artificial Sequence
  chemically synthesized
caacttgtgaggccatactcaa

SEQ ID NO: 967590 - DNA, 22 bp, Artificial Sequence
  chemically synthesized
acaacttgtgaggccatactca

SEQ ID NO: 967591 - DNA, 22 bp, Artificial Sequence
  chemically synthesized
gaagcaatttacaacttgtgag

SEQ ID NO: 967592 - DNA, 22 bp, Artificial Sequence
  chemically synthesized
tgagtatggcctcacaagttgt

SEQ ID NO: 967593 - DNA, 22 bp, Artificial Sequence
  chemically synthesized
tggaagcaatttacaacttgtg

SEQ ID NO: 967594 - DNA, 22 bp, Artificial Sequence
  chemically synthesized
gagtatggcctcacaagttgta

SEQ ID NO: 967595 - DNA, 22 bp, Artificial Sequence
  chemically synthesized
agtatggcctcacaagttgtaa

SEQ ID NO: 967596 - DNA, 22 bp, Artificial Sequence
  chemically synthesized
agtgcctctggaagcaatttac

SEQ ID NO: 967597 - DNA, 22 bp, Artificial Sequence
  chemically synthesized
acaagttgtaaattgcttccag

SEQ ID NO: 967598 - DNA, 22 bp, Artificial Sequence
  chemically synthesized
agctcagtgcctctggaagcaa

SEQ ID NO: 967599 - DNA, 22 bp, Artificial Sequence
  chemically synthesized
tcagctcagtgcctctggaagc

SEQ ID NO: 967600 - DNA, 22 bp, Artificial Sequence
  chemically synthesized
taaattgcttccagaggcactg

SEQ ID NO: 967601 - DNA, 22 bp, Artificial Sequence
  chemically synthesized
cgcctctcagctcagtgcctct

SEQ ID NO: 967602 - DNA, 22 bp, Artificial Sequence
  chemically synthesized
tgcgcctctcagctcagtgcct

SEQ ID NO: 967603 - DNA, 22 bp, Artificial Sequence
  chemically synthesized
tctgcgcctctcagctcagtgc

SEQ ID NO: 967604 - DNA, 22 bp, Artificial Sequence
  chemically synthesized
ctctgcgcctctcagctcagtg

SEQ ID NO: 967605 - DNA, 22 bp, Artificial Sequence
  chemically synthesized
cttccagaggcactgagctgag

SEQ ID NO: 967606 - DNA, 22 bp, Artificial Sequence
  chemically synthesized
ccagaggcactgagctgagagg

SEQ ID NO: 967607 - DNA, 22 bp, Artificial Sequence
  chemically synthesized
agcttctctgcgcctctcagct

SEQ ID NO: 967608 - DNA, 22 bp, Artificial Sequence
  chemically synthesized
cagaggcactgagctgagaggc

SEQ ID NO: 967609 - DNA, 22 bp, Artificial Sequence
  chemically synthesized
cagcttctctgcgcctctcagc

SEQ ID NO: 967610 - DNA, 22 bp, Artificial Sequence
  chemically synthesized
aagatttcagcttctctgcgcc

SEQ ID NO: 967611 - DNA, 22 bp, Artificial Sequence
  chemically synthesized
gaagatttcagcttctctgcgc

SEQ ID NO: 967612 - DNA, 22 bp, Artificial Sequence
  chemically synthesized
agctgagaggcgcagagaagct

SEQ ID NO: 967613 - DNA, 22 bp, Artificial Sequence
  chemically synthesized
gtggcttgaagatttcagcttc

SEQ ID NO: 967614 - DNA, 22 bp, Artificial Sequence
  chemically synthesized
agaggcgcagagaagctgaaat

SEQ ID NO: 967615 - DNA, 22 bp, Artificial Sequence
  chemically synthesized
cgtggcttgaagatttcagctt

SEQ ID NO: 967616 - DNA, 22 bp, Artificial Sequence
  chemically synthesized
aaatcttcaagccacgaaacct

SEQ ID NO: 967617 - DNA, 22 bp, Artificial Sequence
  chemically synthesized
caagccacgaaacctggccccg

SEQ ID NO: 967618 - DNA, 22 bp, Artificial Sequence
  chemically synthesized
aagccacgaaacctggccccgg

SEQ ID NO: 967619 - DNA, 22 bp, Artificial Sequence
  chemically synthesized
ggcagatagagcccggggccag

SEQ ID NO: 967620 - DNA, 22 bp, Artificial Sequence
  chemically synthesized
ctgggcagatagagcccggggc

SEQ ID NO: 967621 - DNA, 22 bp, Artificial Sequence
  chemically synthesized
actgggcagatagagcccgggg

SEQ ID NO: 967622 - DNA, 22 bp, Artificial Sequence
  chemically synthesized
tactgggcagatagagcccggg

SEQ ID NO: 967623 - DNA, 22 bp, Artificial Sequence
  chemically synthesized
ttactgggcagatagagcccgg

SEQ ID NO: 967624 - DNA, 22 bp, Artificial Sequence
  chemically synthesized
gccccgggctctatctgcccag

SEQ ID NO: 967625 - DNA, 22 bp, Artificial Sequence
  chemically synthesized
tatctgcccagtaaaaggacca

SEQ ID NO: 967626 - DNA, 22 bp, Artificial Sequence
  chemically synthesized
tctgcccagtaaaaggaccact

SEQ ID NO: 967627 - DNA, 22 bp, Artificial Sequence
  chemically synthesized
agagaaggaaaacagtggtcct

SEQ ID NO: 967628 - DNA, 22 bp, Artificial Sequence
  chemically synthesized
gagagaaggaaaacagtggtcc

SEQ ID NO: 967629 - DNA, 22 bp, Artificial Sequence
  chemically synthesized
cccagtaaaaggaccactgttt

SEQ ID NO: 967630 - DNA, 22 bp, Artificial Sequence
  chemically synthesized
acccatgtggatcccttgagag

SEQ ID NO: 967631 - DNA, 22 bp, Artificial Sequence
  chemically synthesized
ttttccttctctcaagggatcc

SEQ ID NO: 967632 - DNA, 22 bp, Artificial Sequence
  chemically synthesized
tccttctctcaagggatccaca

SEQ ID NO: 967633 - DNA, 22 bp, Artificial Sequence
  chemically synthesized
ccttctctcaagggatccacat

SEQ ID NO: 967634 - DNA, 22 bp, Artificial Sequence
  chemically synthesized
cttctctcaagggatccacatg

SEQ ID NO: 967635 - DNA, 22 bp, Artificial Sequence
  chemically synthesized
ctctcaagggatccacatgggt

SEQ ID NO: 967636 - DNA, 22 bp, Artificial Sequence
  chemically synthesized
agacacgtgctaacccatgtgg

SEQ ID NO: 967637 - DNA, 22 bp, Artificial Sequence
  chemically synthesized
tctcaagggatccacatgggtt

SEQ ID NO: 967638 - DNA, 22 bp, Artificial Sequence
  chemically synthesized
aagacacgtgctaacccatgtg

SEQ ID NO: 967639 - DNA, 22 bp, Artificial Sequence
  chemically synthesized
tcaagggatccacatgggttag

SEQ ID NO: 967640 - DNA, 22 bp, Artificial Sequence
  chemically synthesized
aagggatccacatgggttagca

SEQ ID NO: 967641 - DNA, 22 bp, Artificial Sequence
  chemically synthesized
gcacgtgtcttaagtgtttggg

SEQ ID NO: 967642 - DNA, 22 bp, Artificial Sequence
  chemically synthesized
aagtgtttgggttatcatgctg

SEQ ID NO: 967643 - DNA, 22 bp, Artificial Sequence
  chemically synthesized
agtgtttgggttatcatgctga

SEQ ID NO: 967644 - DNA, 22 bp, Artificial Sequence
  chemically synthesized
aagagtgtacagtcagcatgat

SEQ ID NO: 967645 - DNA, 22 bp, Artificial Sequence
  chemically synthesized
caagagtgtacagtcagcatga

SEQ ID NO: 967646 - DNA, 22 bp, Artificial Sequence
  chemically synthesized
tcaagagtgtacagtcagcatg

SEQ ID NO: 967647 - DNA, 22 bp, Artificial Sequence
  chemically synthesized
cctttcaagagtgtacagtcag

SEQ ID NO: 967648 - DNA, 22 bp, Artificial Sequence
  chemically synthesized
gggttatcatgctgactgtaca

SEQ ID NO: 967649 - DNA, 22 bp, Artificial Sequence
  chemically synthesized
gcctttcaagagtgtacagtca

SEQ ID NO: 967650 - DNA, 22 bp, Artificial Sequence
  chemically synthesized
ggttatcatgctgactgtacac

SEQ ID NO: 967651 - DNA, 22 bp, Artificial Sequence
  chemically synthesized
gcttgcctttcaagagtgtaca

SEQ ID NO: 967652 - DNA, 22 bp, Artificial Sequence
  chemically synthesized
ggcttgcctttcaagagtgtac

SEQ ID NO: 967653 - DNA, 22 bp, Artificial Sequence
  chemically synthesized
tcatgctgactgtacactcttg

SEQ ID NO: 967654 - DNA, 22 bp, Artificial Sequence
  chemically synthesized
actgtacactcttgaaaggcaa

SEQ ID NO: 967655 - DNA, 22 bp, Artificial Sequence
  chemically synthesized
tacactcttgaaaggcaagcca

SEQ ID NO: 967656 - DNA, 22 bp, Artificial Sequence
  chemically synthesized
ggaaggaataatttggcttgcc

SEQ ID NO: 967657 - DNA, 22 bp, Artificial Sequence
  chemically synthesized
tctaggaaggaataatttggct

SEQ ID NO: 967658 - DNA, 22 bp, Artificial Sequence
  chemically synthesized
gtctaggaaggaataatttggc

SEQ ID NO: 967659 - DNA, 22 bp, Artificial Sequence
  chemically synthesized
ttgaaaggcaagccaaattatt

SEQ ID NO: 967660 - DNA, 22 bp, Artificial Sequence
  chemically synthesized
tgtctaggaaggaataatttgg

SEQ ID NO: 967661 - DNA, 22 bp, Artificial Sequence
  chemically synthesized
ttgtctaggaaggaataatttg

SEQ ID NO: 967662 - DNA, 22 bp, Artificial Sequence
  chemically synthesized
gaaaggcaagccaaattattcc

SEQ ID NO: 967663 - DNA, 22 bp, Artificial Sequence
  chemically synthesized
aaaggcaagccaaattattcct

SEQ ID NO: 967664 - DNA, 22 bp, Artificial Sequence
  chemically synthesized
cttttgtctaggaaggaataat

SEQ ID NO: 967665 - DNA, 22 bp, Artificial Sequence
  chemically synthesized
gcttttgtctaggaaggaataa

SEQ ID NO: 967666 - DNA, 22 bp, Artificial Sequence
  chemically synthesized
ttgcttttgtctaggaaggaat

SEQ ID NO: 967667 - DNA, 22 bp, Artificial Sequence
  chemically synthesized
cttgcttttgtctaggaaggaa

SEQ ID NO: 967668 - DNA, 22 bp, Artificial Sequence
  chemically synthesized
atatatttcttgcttttgtcta

SEQ ID NO: 967669 - DNA, 22 bp, Artificial Sequence
  chemically synthesized
catatatttcttgcttttgtct

SEQ ID NO: 967670 - DNA, 22 bp, Artificial Sequence
  chemically synthesized
ttcatatatttcttgcttttgt

SEQ ID NO: 967671 - DNA, 22 bp, Artificial Sequence
  chemically synthesized
ttccttcctagacaaaagcaag

SEQ ID NO: 967672 - DNA, 22 bp, Artificial Sequence
  chemically synthesized
cttcatatatttcttgcttttg

SEQ ID NO: 967673 - DNA, 22 bp, Artificial Sequence
  chemically synthesized
tcttcatatatttcttgctttt

SEQ ID NO: 967674 - DNA, 22 bp, Artificial Sequence
  chemically synthesized
ttcttcatatatttcttgcttt

SEQ ID NO: 967675 - DNA, 22 bp, Artificial Sequence
  chemically synthesized
cttcctagacaaaagcaagaaa

SEQ ID NO: 967676 - DNA, 22 bp, Artificial Sequence
  chemically synthesized
tttcttcatatatttcttgctt

SEQ ID NO: 967677 - DNA, 22 bp, Artificial Sequence
  chemically synthesized
ttttcttcatatatttcttgct

SEQ ID NO: 967678 - DNA, 22 bp, Artificial Sequence
  chemically synthesized
cctagacaaaagcaagaaatat

SEQ ID NO: 967679 - DNA, 22 bp, Artificial Sequence
  chemically synthesized
ttttttcttcatatatttcttg

SEQ ID NO: 967680 - DNA, 22 bp, Artificial Sequence
  chemically synthesized
ctagacaaaagcaagaaatata

SEQ ID NO: 967681 - DNA, 22 bp, Artificial Sequence
  chemically synthesized
cttttttcttcatatatttctt

SEQ ID NO: 967682 - DNA, 22 bp, Artificial Sequence
  chemically synthesized
tcttttttcttcatatatttct

SEQ ID NO: 967683 - DNA, 22 bp, Artificial Sequence
  chemically synthesized
gacaaaagcaagaaatatatga

SEQ ID NO: 967684 - DNA, 22 bp, Artificial Sequence
  chemically synthesized
ttttcttttttcttcatatatt

SEQ ID NO: 967685 - DNA, 22 bp, Artificial Sequence
  chemically synthesized
aagttgttttcttttttcttca

SEQ ID NO: 967686 - DNA, 22 bp, Artificial Sequence
  chemically synthesized
tcaagttgttttcttttttctt

SEQ ID NO: 967687 - DNA, 22 bp, Artificial Sequence
  chemically synthesized
acctctcaagttgttttctttt

SEQ ID NO: 967688 - DNA, 22 bp, Artificial Sequence
  chemically synthesized
tggcaagtatctcacctctcaa

SEQ ID NO: 967689 - DNA, 22 bp, Artificial Sequence
  chemically synthesized
gtggcaagtatctcacctctca

SEQ ID NO: 967690 - DNA, 22 bp, Artificial Sequence
  chemically synthesized
gagaggtgagatacttgccaca

SEQ ID NO: 967691 - DNA, 22 bp, Artificial Sequence
  chemically synthesized
tccatccaaacttgtggcaagt

SEQ ID NO: 967692 - DNA, 22 bp, Artificial Sequence
  chemically synthesized
agaggtgagatacttgccacaa

SEQ ID NO: 967693 - DNA, 22 bp, Artificial Sequence
  chemically synthesized
caagggttgtccatccaaactt

SEQ ID NO: 967694 - DNA, 22 bp, Artificial Sequence
  chemically synthesized
acaagggttgtccatccaaact

SEQ ID NO: 967695 - DNA, 22 bp, Artificial Sequence
  chemically synthesized
aatttacaagggttgtccatcc

SEQ ID NO: 967696 - DNA, 22 bp, Artificial Sequence
  chemically synthesized
gccacaagtttggatggacaac

SEQ ID NO: 967697 - DNA, 22 bp, Artificial Sequence
  chemically synthesized
ccacaagtttggatggacaacc

SEQ ID NO: 967698 - DNA, 22 bp, Artificial Sequence
  chemically synthesized
ggatggacaacccttgtaaatt

SEQ ID NO: 967699 - DNA, 22 bp, Artificial Sequence
  chemically synthesized
caatgaatgctcaatttacaag

SEQ ID NO: 967700 - DNA, 22 bp, Artificial Sequence
  chemically synthesized
gatggacaacccttgtaaattg

SEQ ID NO: 967701 - DNA, 22 bp, Artificial Sequence
  chemically synthesized
gtaaattgagcattcattgcag

SEQ ID NO: 967702 - DNA, 22 bp, Artificial Sequence
  chemically synthesized
taaattgagcattcattgcagc

SEQ ID NO: 967703 - DNA, 22 bp, Artificial Sequence
  chemically synthesized
aaataagcatggatgctgcaat

SEQ ID NO: 967704 - DNA, 22 bp, Artificial Sequence
  chemically synthesized
aaaataagcatggatgctgcaa

SEQ ID NO: 967705 - DNA, 22 bp, Artificial Sequence
  chemically synthesized
agcattcattgcagcatccatg

SEQ ID NO: 967706 - DNA, 22 bp, Artificial Sequence
  chemically synthesized
cacttaaaataagcatggatgc

SEQ ID NO: 967707 - DNA, 22 bp, Artificial Sequence
  chemically synthesized
acacttaaaataagcatggatg

SEQ ID NO: 967708 - DNA, 22 bp, Artificial Sequence
  chemically synthesized
attgcagcatccatgcttattt

SEQ ID NO: 967709 - DNA, 22 bp, Artificial Sequence
  chemically synthesized
cagcatccatgcttattttaag

SEQ ID NO: 967710 - DNA, 22 bp, Artificial Sequence
  chemically synthesized
tgtgtgtgtatataacttacac

SEQ ID NO: 967711 - DNA, 22 bp, Artificial Sequence
  chemically synthesized
gtgtgtgtgtatataacttaca

SEQ ID NO: 967712 - DNA, 22 bp, Artificial Sequence
  chemically synthesized
attttaagtgtaagttatatac

SEQ ID NO: 967713 - DNA, 22 bp, Artificial Sequence
  chemically synthesized
ttttaagtgtaagttatataca

SEQ ID NO: 967714 - DNA, 22 bp, Artificial Sequence
  chemically synthesized
taagtgtaagttatatacacac

SEQ ID NO: 967715 - DNA, 22 bp, Artificial Sequence
  chemically synthesized
aagtgtaagttatatacacaca

SEQ ID NO: 967716 - DNA, 22 bp, Artificial Sequence
  chemically synthesized
agtgtaagttatatacacacac

SEQ ID NO: 967717 - DNA, 22 bp, Artificial Sequence
  chemically synthesized
tatacacacacacaaacacata

SEQ ID NO: 967718 - DNA, 22 bp, Artificial Sequence
  chemically synthesized
aataaaaataaatatgtgtata

SEQ ID NO: 967719 - DNA, 22 bp, Artificial Sequence
  chemically synthesized
aaataaaaataaatatgtgtat

SEQ ID NO: 967720 - DNA, 22 bp, Artificial Sequence
  chemically synthesized
tttaaataaaaataaatatgtg

SEQ ID NO: 967721 - DNA, 22 bp, Artificial Sequence
  chemically synthesized
atacaaataaaaaattatttaa

SEQ ID NO: 967722 - DNA, 22 bp, Artificial Sequence
  chemically synthesized
atttttatttaaataatttttt

SEQ ID NO: 967723 - DNA, 22 bp, Artificial Sequence
  chemically synthesized
tttttatttaaataatttttta

SEQ ID NO: 967724 - DNA, 22 bp, Artificial Sequence
  chemically synthesized
cattcatacaaataaaaaatta

SEQ ID NO: 967725 - DNA, 22 bp, Artificial Sequence
  chemically synthesized
acattcatacaaataaaaaatt

SEQ ID NO: 967726 - DNA, 22 bp, Artificial Sequence
  chemically synthesized
ttatttaaataattttttattt

SEQ ID NO: 967727 - DNA, 22 bp, Artificial Sequence
  chemically synthesized
tatttaaataattttttatttg

SEQ ID NO: 967728 - DNA, 22 bp, Artificial Sequence
  chemically synthesized
atttaaataattttttatttgt

SEQ ID NO: 967729 - DNA, 22 bp, Artificial Sequence
  chemically synthesized
tttaaataattttttatttgta

SEQ ID NO: 967730 - DNA, 22 bp, Artificial Sequence
  chemically synthesized
aaataattttttatttgtatga

SEQ ID NO: 967731 - DNA, 22 bp, Artificial Sequence
  chemically synthesized
taccccttacattcatacaaat

SEQ ID NO: 967732 - DNA, 22 bp, Artificial Sequence
  chemically synthesized
aataattttttatttgtatgaa

SEQ ID NO: 967733 - DNA, 22 bp, Artificial Sequence
  chemically synthesized
gtaccccttacattcatacaaa

SEQ ID NO: 967734 - DNA, 22 bp, Artificial Sequence
  chemically synthesized
cacttgtaccccttacattcat

SEQ ID NO: 967735 - DNA, 22 bp, Artificial Sequence
  chemically synthesized
tttatttgtatgaatgtaaggg

SEQ ID NO: 967736 - DNA, 22 bp, Artificial Sequence
  chemically synthesized
ttatttgtatgaatgtaagggg

SEQ ID NO: 967737 - DNA, 22 bp, Artificial Sequence
  chemically synthesized
tatttgtatgaatgtaaggggt

SEQ ID NO: 967738 - DNA, 22 bp, Artificial Sequence
  chemically synthesized
atttgtatgaatgtaaggggta

SEQ ID NO: 967739 - DNA, 22 bp, Artificial Sequence
  chemically synthesized
tttgtatgaatgtaaggggtac

SEQ ID NO: 967740 - DNA, 22 bp, Artificial Sequence
  chemically synthesized
gtatgaatgtaaggggtacaag

SEQ ID NO: 967741 - DNA, 22 bp, Artificial Sequence
  chemically synthesized
tatgaatgtaaggggtacaagt

SEQ ID NO: 967742 - DNA, 22 bp, Artificial Sequence
  chemically synthesized
acataataaaattgcacttgta

SEQ ID NO: 967743 - DNA, 22 bp, Artificial Sequence
  chemically synthesized
tccaacatactcacataataaa

SEQ ID NO: 967744 - DNA, 22 bp, Artificial Sequence
  chemically synthesized
accactatccaacatactcaca

SEQ ID NO: 967745 - DNA, 22 bp, Artificial Sequence
  chemically synthesized
tattatgtgagtatgttggata

SEQ ID NO: 967746 - DNA, 22 bp, Artificial Sequence
  chemically synthesized
attatgtgagtatgttggatag

SEQ ID NO: 967747 - DNA, 22 bp, Artificial Sequence
  chemically synthesized
ttatgtgagtatgttggatagt

SEQ ID NO: 967748 - DNA, 22 bp, Artificial Sequence
  chemically synthesized
tgtgagtatgttggatagtggt

SEQ ID NO: 967749 - DNA, 22 bp, Artificial Sequence
  chemically synthesized
aaaatccaaagttcaccactat

SEQ ID NO: 967750 - DNA, 22 bp, Artificial Sequence
  chemically synthesized
gatagtggtgaactttggattt

SEQ ID NO: 967751 - DNA, 22 bp, Artificial Sequence
  chemically synthesized
ggtgatggatacactaaaaatc

SEQ ID NO: 967752 - DNA, 22 bp, Artificial Sequence
  chemically synthesized
gggtgatggatacactaaaaat

SEQ ID NO: 967753 - DNA, 22 bp, Artificial Sequence
  chemically synthesized
tggatttttagtgtatccatca

SEQ ID NO: 967754 - DNA, 22 bp, Artificial Sequence
  chemically synthesized
ggatttttagtgtatccatcac

SEQ ID NO: 967755 - DNA, 22 bp, Artificial Sequence
  chemically synthesized
gatttttagtgtatccatcacc

SEQ ID NO: 967756 - DNA, 22 bp, Artificial Sequence
  chemically synthesized
caatgtacataatttgggtgat

SEQ ID NO: 967757 - DNA, 22 bp, Artificial Sequence
  chemically synthesized
ttagtgtatccatcacccaaat

SEQ ID NO: 967758 - DNA, 22 bp, Artificial Sequence
  chemically synthesized
tagtgtatccatcacccaaatt

SEQ ID NO: 967759 - DNA, 22 bp, Artificial Sequence
  chemically synthesized
agtgtatccatcacccaaatta

SEQ ID NO: 967760 - DNA, 22 bp, Artificial Sequence
  chemically synthesized
gtgtatccatcacccaaattat

SEQ ID NO: 967761 - DNA, 22 bp, Artificial Sequence
  chemically synthesized
atggctacaatgtacataattt

SEQ ID NO: 967762 - DNA, 22 bp, Artificial Sequence
  chemically synthesized
tgtacattgtagccattaattt

SEQ ID NO: 967763 - DNA, 22 bp, Artificial Sequence
  chemically synthesized
tagccattaatttatcactgat

SEQ ID NO: 967764 - DNA, 22 bp, Artificial Sequence
  chemically synthesized
atttatcactgattcccttgca

SEQ ID NO: 967765 - DNA, 22 bp, Artificial Sequence
  chemically synthesized
aagtgtgggggtgtgcaaggga

SEQ ID NO: 967766 - DNA, 22 bp, Artificial Sequence
  chemically synthesized
atcactgattcccttgcacacc

SEQ ID NO: 967767 - DNA, 22 bp, Artificial Sequence
  chemically synthesized
tcactgattcccttgcacaccc

SEQ ID NO: 967768 - DNA, 22 bp, Artificial Sequence
  chemically synthesized
gagactgaagtgtgggggtgtg

SEQ ID NO: 967769 - DNA, 22 bp, Artificial Sequence
  chemically synthesized
attcccttgcacacccccacac

SEQ ID NO: 967770 - DNA, 22 bp, Artificial Sequence
  chemically synthesized
ccttgcacacccccacacttca

SEQ ID NO: 967771 - DNA, 22 bp, Artificial Sequence
  chemically synthesized
gcacacccccacacttcagtct

SEQ ID NO: 967772 - DNA, 22 bp, Artificial Sequence
  chemically synthesized
cacacccccacacttcagtctc

SEQ ID NO: 967773 - DNA, 22 bp, Artificial Sequence
  chemically synthesized
cagtctccaatgcttatcacta

SEQ ID NO: 967774 - DNA, 22 bp, Artificial Sequence
  chemically synthesized
agtctccaatgcttatcactac

SEQ ID NO: 967775 - DNA, 22 bp, Artificial Sequence
  chemically synthesized
caatgcttatcactacacactc

SEQ ID NO: 967776 - DNA, 22 bp, Artificial Sequence
  chemically synthesized
atcactacacactctatgtcca

SEQ ID NO: 967777 - DNA, 22 bp, Artificial Sequence
  chemically synthesized
tcactacacactctatgtccat

SEQ ID NO: 967778 - DNA, 22 bp, Artificial Sequence
  chemically synthesized
cacactctatgtccatgtgtac

SEQ ID NO: 967779 - DNA, 22 bp, Artificial Sequence
  chemically synthesized
tatgtccatgtgtacatgttta

SEQ ID NO: 967780 - DNA, 22 bp, Artificial Sequence
  chemically synthesized
tgtccatgtgtacatgtttata

SEQ ID NO: 967781 - DNA, 22 bp, Artificial Sequence
  chemically synthesized
taagtgaaagacaaataatgta

SEQ ID NO: 967782 - DNA, 22 bp, Artificial Sequence
  chemically synthesized
ataagtgaaagacaaataatgt

SEQ ID NO: 967783 - DNA, 22 bp, Artificial Sequence
  chemically synthesized
acttataagtgaaagacaaata

SEQ ID NO: 967784 - DNA, 22 bp, Artificial Sequence
  chemically synthesized
tcacttataagtgaaagacaaa

SEQ ID NO: 967785 - DNA, 22 bp, Artificial Sequence
  chemically synthesized
atacattatttgtctttcactt

SEQ ID NO: 967786 - DNA, 22 bp, Artificial Sequence
  chemically synthesized
tacattatttgtctttcactta

SEQ ID NO: 967787 - DNA, 22 bp, Artificial Sequence
  chemically synthesized
tttgtctttcacttataagtga

SEQ ID NO: 967788 - DNA, 22 bp, Artificial Sequence
  chemically synthesized
gtctttcacttataagtgagaa

SEQ ID NO: 967789 - DNA, 22 bp, Artificial Sequence
  chemically synthesized
tctttcacttataagtgagaac

SEQ ID NO: 967790 - DNA, 22 bp, Artificial Sequence
  chemically synthesized
tcacttataagtgagaacatgg

SEQ ID NO: 967791 - DNA, 22 bp, Artificial Sequence
  chemically synthesized
cacttataagtgagaacatggg

SEQ ID NO: 967792 - DNA, 22 bp, Artificial Sequence
  chemically synthesized
acttataagtgagaacatgggg

SEQ ID NO: 967793 - DNA, 22 bp, Artificial Sequence
  chemically synthesized
agaagcagaaagataccccatg

SEQ ID NO: 967794 - DNA, 22 bp, Artificial Sequence
  chemically synthesized
ataagtgagaacatggggtatc

SEQ ID NO: 967795 - DNA, 22 bp, Artificial Sequence
  chemically synthesized
taagtgagaacatggggtatct

SEQ ID NO: 967796 - DNA, 22 bp, Artificial Sequence
  chemically synthesized
tctgcttctgagttgtttcata

SEQ ID NO: 967797 - DNA, 22 bp, Artificial Sequence
  chemically synthesized
ctgcttctgagttgtttcatat

SEQ ID NO: 967798 - DNA, 22 bp, Artificial Sequence
  chemically synthesized
tgcttctgagttgtttcatata

SEQ ID NO: 967799 - DNA, 22 bp, Artificial Sequence
  chemically synthesized
cttctgagttgtttcatatata

SEQ ID NO: 967800 - DNA, 22 bp, Artificial Sequence
  chemically synthesized
ctgagttgtttcatatatatat

SEQ ID NO: 967801 - DNA, 22 bp, Artificial Sequence
  chemically synthesized
tgagttgtttcatatatatata

SEQ ID NO: 967802 - DNA, 22 bp, Artificial Sequence
  chemically synthesized
agttgtttcatatatatatata

SEQ ID NO: 967803 - DNA, 22 bp, Artificial Sequence
  chemically synthesized
tttcatatatatatatacacac

SEQ ID NO: 967804 - DNA, 22 bp, Artificial Sequence
  chemically synthesized
catatatatatatacacacaca

SEQ ID NO: 967805 - DNA, 22 bp, Artificial Sequence
  chemically synthesized
atatatatatatacacacacac

SEQ ID NO: 967806 - DNA, 22 bp, Artificial Sequence
  chemically synthesized
gagaaaagccatcaatatcagt

SEQ ID NO: 967807 - DNA, 22 bp, Artificial Sequence
  chemically synthesized
tagagaaaagccatcaatatca

SEQ ID NO: 967808 - DNA, 22 bp, Artificial Sequence
  chemically synthesized
ctagagaaaagccatcaatatc

SEQ ID NO: 967809 - DNA, 22 bp, Artificial Sequence
  chemically synthesized
tctagagaaaagccatcaatat

SEQ ID NO: 967810 - DNA, 22 bp, Artificial Sequence
  chemically synthesized
ttctagagaaaagccatcaata

SEQ ID NO: 967811 - DNA, 22 bp, Artificial Sequence
  chemically synthesized
tttctagagaaaagccatcaat

SEQ ID NO: 967812 - DNA, 22 bp, Artificial Sequence
  chemically synthesized
tactttttctagagaaaagcca

SEQ ID NO: 967813 - DNA, 22 bp, Artificial Sequence
  chemically synthesized
atactttttctagagaaaagcc

SEQ ID NO: 967814 - DNA, 22 bp, Artificial Sequence
  chemically synthesized
atattgatggcttttctctaga

SEQ ID NO: 967815 - DNA, 22 bp, Artificial Sequence
  chemically synthesized
atggcttttctctagaaaaagt

SEQ ID NO: 967816 - DNA, 22 bp, Artificial Sequence
  chemically synthesized
ataaatatagagatttatactt

SEQ ID NO: 967817 - DNA, 22 bp, Artificial Sequence
  chemically synthesized
ttctctagaaaaagtataaatc

SEQ ID NO: 967818 - DNA, 22 bp, Artificial Sequence
  chemically synthesized
gataaatatagagatttatact

SEQ ID NO: 967819 - DNA, 22 bp, Artificial Sequence
  chemically synthesized
tctctagaaaaagtataaatct

SEQ ID NO: 967820 - DNA, 22 bp, Artificial Sequence
  chemically synthesized
ctctagaaaaagtataaatctc

SEQ ID NO: 967821 - DNA, 22 bp, Artificial Sequence
  chemically synthesized
tctagaaaaagtataaatctct

SEQ ID NO: 967822 - DNA, 22 bp, Artificial Sequence
  chemically synthesized
tagaaaaagtataaatctctat

SEQ ID NO: 967823 - DNA, 22 bp, Artificial Sequence
  chemically synthesized
gaaaaagtataaatctctatat

SEQ ID NO: 967824 - DNA, 22 bp, Artificial Sequence
  chemically synthesized
tatatttatcaaactgtgcatt

SEQ ID NO: 967825 - DNA, 22 bp, Artificial Sequence
  chemically synthesized
ccagatatcgtaaatgcacagt

SEQ ID NO: 967826 - DNA, 22 bp, Artificial Sequence
  chemically synthesized
tatttatcaaactgtgcattta

SEQ ID NO: 967827 - DNA, 22 bp, Artificial Sequence
  chemically synthesized
atcaaactgtgcatttacgata

SEQ ID NO: 967828 - DNA, 22 bp, Artificial Sequence
  chemically synthesized
tcaaactgtgcatttacgatat

SEQ ID NO: 967829 - DNA, 22 bp, Artificial Sequence
  chemically synthesized
gtagataagatattgccagata

SEQ ID NO: 967830 - DNA, 22 bp, Artificial Sequence
  chemically synthesized
tgcatttacgatatctggcaat

SEQ ID NO: 967831 - DNA, 22 bp, Artificial Sequence
  chemically synthesized
agtagataagatattgccagat

SEQ ID NO: 967832 - DNA, 22 bp, Artificial Sequence
  chemically synthesized
atttagtagataagatattgcc

SEQ ID NO: 967833 - DNA, 22 bp, Artificial Sequence
  chemically synthesized
gatttagtagataagatattgc

SEQ ID NO: 967834 - DNA, 22 bp, Artificial Sequence
  chemically synthesized
tgatttagtagataagatattg

SEQ ID NO: 967835 - DNA, 22 bp, Artificial Sequence
  chemically synthesized
acgatatctggcaatatcttat

SEQ ID NO: 967836 - DNA, 22 bp, Artificial Sequence
  chemically synthesized
cgatatctggcaatatcttatc

SEQ ID NO: 967837 - DNA, 22 bp, Artificial Sequence
  chemically synthesized
tatacattttgatttagtagat

SEQ ID NO: 967838 - DNA, 22 bp, Artificial Sequence
  chemically synthesized
gcaatatcttatctactaaatc

SEQ ID NO: 967839 - DNA, 22 bp, Artificial Sequence
  chemically synthesized
gggcacattgtatacattttga

SEQ ID NO: 967840 - DNA, 22 bp, Artificial Sequence
  chemically synthesized
atctactaaatcaaaatgtata

SEQ ID NO: 967841 - DNA, 22 bp, Artificial Sequence
  chemically synthesized
tctactaaatcaaaatgtatac

SEQ ID NO: 967842 - DNA, 22 bp, Artificial Sequence
  chemically synthesized
ctaaatcaaaatgtatacaatg

SEQ ID NO: 967843 - DNA, 22 bp, Artificial Sequence
  chemically synthesized
aatattggggcacattgtatac

SEQ ID NO: 967844 - DNA, 22 bp, Artificial Sequence
  chemically synthesized
aatcaaaatgtatacaatgtgc

SEQ ID NO: 967845 - DNA, 22 bp, Artificial Sequence
  chemically synthesized
ctaaatattggggcacattgta

SEQ ID NO: 967846 - DNA, 22 bp, Artificial Sequence
  chemically synthesized
agattgctaaatattggggcac

SEQ ID NO: 967847 - DNA, 22 bp, Artificial Sequence
  chemically synthesized
acatgggtgtatacccagaact

SEQ ID NO: 967848 - DNA, 22 bp, Artificial Sequence
  chemically synthesized
cacatgggtgtatacccagaac

SEQ ID NO: 967849 - DNA, 22 bp, Artificial Sequence
  chemically synthesized
agcaatctcagttctgggtata

SEQ ID NO: 967850 - DNA, 22 bp, Artificial Sequence
  chemically synthesized
gcaatctcagttctgggtatac

SEQ ID NO: 967851 - DNA, 22 bp, Artificial Sequence
  chemically synthesized
cacatttcacatgggtgtatac

SEQ ID NO: 967852 - DNA, 22 bp, Artificial Sequence
  chemically synthesized
acacatttcacatgggtgtata

SEQ ID NO: 967853 - DNA, 22 bp, Artificial Sequence
  chemically synthesized
agttctgggtatacacccatgt

SEQ ID NO: 967854 - DNA, 22 bp, Artificial Sequence
  chemically synthesized
tgggtatacacccatgtgaaat

SEQ ID NO: 967855 - DNA, 22 bp, Artificial Sequence
  chemically synthesized
ggtatacacccatgtgaaatgt

SEQ ID NO: 967856 - DNA, 22 bp, Artificial Sequence
  chemically synthesized
gtataagaatttacacatttca

SEQ ID NO: 967857 - DNA, 22 bp, Artificial Sequence
  chemically synthesized
ggtataagaatttacacatttc

SEQ ID NO: 967858 - DNA, 22 bp, Artificial Sequence
  chemically synthesized
tggtataagaatttacacattt

SEQ ID NO: 967859 - DNA, 22 bp, Artificial Sequence
  chemically synthesized
ttggtataagaatttacacatt

SEQ ID NO: 967860 - DNA, 22 bp, Artificial Sequence
  chemically synthesized
catgtcttttggtataagaatt

SEQ ID NO: 967861 - DNA, 22 bp, Artificial Sequence
  chemically synthesized
ttacatgtcttttggtataaga

SEQ ID NO: 967862 - DNA, 22 bp, Artificial Sequence
  chemically synthesized
tattacatgtcttttggtataa

SEQ ID NO: 967863 - DNA, 22 bp, Artificial Sequence
  chemically synthesized
ttataccaaaagacatgtaata

SEQ ID NO: 967864 - DNA, 22 bp, Artificial Sequence
  chemically synthesized
cagacatatattctattacatg

SEQ ID NO: 967865 - DNA, 22 bp, Artificial Sequence
  chemically synthesized
ataccaaaagacatgtaataga

SEQ ID NO: 967866 - DNA, 22 bp, Artificial Sequence
  chemically synthesized
taccaaaagacatgtaatagaa

SEQ ID NO: 967867 - DNA, 22 bp, Artificial Sequence
  chemically synthesized
ttgcagacatatattctattac

SEQ ID NO: 967868 - DNA, 22 bp, Artificial Sequence
  chemically synthesized
caaatagtgctgttgcagacat

SEQ ID NO: 967869 - DNA, 22 bp, Artificial Sequence
  chemically synthesized
ttacaaatagtgctgttgcaga

SEQ ID NO: 967870 - DNA, 22 bp, Artificial Sequence
  chemically synthesized
gctattacaaatagtgctgttg

SEQ ID NO: 967871 - DNA, 22 bp, Artificial Sequence
  chemically synthesized
agctattacaaatagtgctgtt

SEQ ID NO: 967872 - DNA, 22 bp, Artificial Sequence
  chemically synthesized
ataacttagctattacaaatag

SEQ ID NO: 967873 - DNA, 22 bp, Artificial Sequence
  chemically synthesized
ttgataacttagctattacaaa

SEQ ID NO: 967874 - DNA, 22 bp, Artificial Sequence
  chemically synthesized
caacagcactatttgtaatagc

SEQ ID NO: 967875 - DNA, 22 bp, Artificial Sequence
  chemically synthesized
attgataacttagctattacaa

SEQ ID NO: 967876 - DNA, 22 bp, Artificial Sequence
  chemically synthesized
tattgataacttagctattaca

SEQ ID NO: 967877 - DNA, 22 bp, Artificial Sequence
  chemically synthesized
tttgtaatagctaagttatcaa

SEQ ID NO: 967878 - DNA, 22 bp, Artificial Sequence
  chemically synthesized
gtaatagctaagttatcaataa

SEQ ID NO: 967879 - DNA, 22 bp, Artificial Sequence
  chemically synthesized
taatagctaagttatcaataaa

SEQ ID NO: 967880 - DNA, 22 bp, Artificial Sequence
  chemically synthesized
catagggtaaatataacagttt

SEQ ID NO: 967881 - DNA, 22 bp, Artificial Sequence
  chemically synthesized
agttatcaataaaactgttata

SEQ ID NO: 967882 - DNA, 22 bp, Artificial Sequence
  chemically synthesized
tcaataaaactgttatatttac

SEQ ID NO: 967883 - DNA, 22 bp, Artificial Sequence
  chemically synthesized
cataatattccatagggtaaat

SEQ ID NO: 967884 - DNA, 22 bp, Artificial Sequence
  chemically synthesized
tgggctgcataatattccatag

SEQ ID NO: 967885 - DNA, 22 bp, Artificial Sequence
  chemically synthesized
ttatatttaccctatggaatat

SEQ ID NO: 967886 - DNA, 22 bp, Artificial Sequence
  chemically synthesized
atgggctgcataatattccata

SEQ ID NO: 967887 - DNA, 22 bp, Artificial Sequence
  chemically synthesized
tatgggctgcataatattccat

SEQ ID NO: 967888 - DNA, 22 bp, Artificial Sequence
  chemically synthesized
tatttaccctatggaatattat

SEQ ID NO: 967889 - DNA, 22 bp, Artificial Sequence
  chemically synthesized
accctatggaatattatgcagc

SEQ ID NO: 967890 - DNA, 22 bp, Artificial Sequence
  chemically synthesized
ccctatggaatattatgcagcc

SEQ ID NO: 967891 - DNA, 22 bp, Artificial Sequence
  chemically synthesized
aacaatcattttatgggctgca

SEQ ID NO: 967892 - DNA, 22 bp, Artificial Sequence
  chemically synthesized
tggaatattatgcagcccataa

SEQ ID NO: 967893 - DNA, 22 bp, Artificial Sequence
  chemically synthesized
ttaaacaatcattttatgggct

SEQ ID NO: 967894 - DNA, 22 bp, Artificial Sequence
  chemically synthesized
tgcagcccataaaatgattgtt

SEQ ID NO: 967895 - DNA, 22 bp, Artificial Sequence
  chemically synthesized
tgtgtagttattaaacaatcat

SEQ ID NO: 967896 - DNA, 22 bp, Artificial Sequence
  chemically synthesized
gtgtgtagttattaaacaatca

SEQ ID NO: 967897 - DNA, 22 bp, Artificial Sequence
  chemically synthesized
ttgtgtgtagttattaaacaat

SEQ ID NO: 967898 - DNA, 22 bp, Artificial Sequence
  chemically synthesized
tcttgtgtgtagttattaaaca

SEQ ID NO: 967899 - DNA, 22 bp, Artificial Sequence
  chemically synthesized
ttctcttgtgtgtagttattaa

SEQ ID NO: 967900 - DNA, 22 bp, Artificial Sequence
  chemically synthesized
tttaataactacacacaagaga

SEQ ID NO: 967901 - DNA, 22 bp, Artificial Sequence
  chemically synthesized
tgtatcagctattctcttgtgt

SEQ ID NO: 967902 - DNA, 22 bp, Artificial Sequence
  chemically synthesized
gtgtatcagctattctcttgtg

SEQ ID NO: 967903 - DNA, 22 bp, Artificial Sequence
  chemically synthesized
aataactacacacaagagaata

SEQ ID NO: 967904 - DNA, 22 bp, Artificial Sequence
  chemically synthesized
ataactacacacaagagaatag

SEQ ID NO: 967905 - DNA, 22 bp, Artificial Sequence
  chemically synthesized
tatttgtgtatcagctattctc

SEQ ID NO: 967906 - DNA, 22 bp, Artificial Sequence
  chemically synthesized
cacacaagagaatagctgatac

SEQ ID NO: 967907 - DNA, 22 bp, Artificial Sequence
  chemically synthesized
gtgcattgtatttgtgtatcag

SEQ ID NO: 967908 - DNA, 22 bp, Artificial Sequence
  chemically synthesized
agtgcattgtatttgtgtatca

SEQ ID NO: 967909 - DNA, 22 bp, Artificial Sequence
  chemically synthesized
ttagtgcattgtatttgtgtat

SEQ ID NO: 967910 - DNA, 22 bp, Artificial Sequence
  chemically synthesized
cttagtgcattgtatttgtgta

SEQ ID NO: 967911 - DNA, 22 bp, Artificial Sequence
  chemically synthesized
gcttcttagtgcattgtatttg

SEQ ID NO: 967912 - DNA, 22 bp, Artificial Sequence
  chemically synthesized
atacacaaatacaatgcactaa

SEQ ID NO: 967913 - DNA, 22 bp, Artificial Sequence
  chemically synthesized
atgtctggcttcttagtgcatt

SEQ ID NO: 967914 - DNA, 22 bp, Artificial Sequence
  chemically synthesized
aatgtctggcttcttagtgcat

SEQ ID NO: 967915 - DNA, 22 bp, Artificial Sequence
  chemically synthesized
taatgtctggcttcttagtgca

SEQ ID NO: 967916 - DNA, 22 bp, Artificial Sequence
  chemically synthesized
tttaatgtctggcttcttagtg

SEQ ID NO: 967917 - DNA, 22 bp, Artificial Sequence
  chemically synthesized
tacaatatatgctctttaatgt

SEQ ID NO: 967918 - DNA, 22 bp, Artificial Sequence
  chemically synthesized
agaagccagacattaaagagca

SEQ ID NO: 967919 - DNA, 22 bp, Artificial Sequence
  chemically synthesized
aattatacaatatatgctcttt

SEQ ID NO: 967920 - DNA, 22 bp, Artificial Sequence
  chemically synthesized
ctgaattatacaatatatgctc

SEQ ID NO: 967921 - DNA, 22 bp, Artificial Sequence
  chemically synthesized
gctgaattatacaatatatgct

SEQ ID NO: 967922 - DNA, 22 bp, Artificial Sequence
  chemically synthesized
tgctgaattatacaatatatgc

SEQ ID NO: 967923 - DNA, 22 bp, Artificial Sequence
  chemically synthesized
ttgctgaattatacaatatatg

SEQ ID NO: 967924 - DNA, 22 bp, Artificial Sequence
  chemically synthesized
tatttttgctgaattatacaat

SEQ ID NO: 967925 - DNA, 22 bp, Artificial Sequence
  chemically synthesized
aagagcatatattgtataattc

SEQ ID NO: 967926 - DNA, 22 bp, Artificial Sequence
  chemically synthesized
ctatatttttgctgaattatac

SEQ ID NO: 967927 - DNA, 22 bp, Artificial Sequence
  chemically synthesized
ccctactatatttttgctgaat

SEQ ID NO: 967928 - DNA, 22 bp, Artificial Sequence
  chemically synthesized
gccctactatatttttgctgaa

SEQ ID NO: 967929 - DNA, 22 bp, Artificial Sequence
  chemically synthesized
tgccctactatatttttgctga

SEQ ID NO: 967930 - DNA, 22 bp, Artificial Sequence
  chemically synthesized
gttttgccctactatatttttg

SEQ ID NO: 967931 - DNA, 22 bp, Artificial Sequence
  chemically synthesized
tataattcagcaaaaatatagt

SEQ ID NO: 967932 - DNA, 22 bp, Artificial Sequence
  chemically synthesized
agcaaaaatatagtagggcaaa

SEQ ID NO: 967933 - DNA, 22 bp, Artificial Sequence
  chemically synthesized
tgacagcatagattggttttgc

SEQ ID NO: 967934 - DNA, 22 bp, Artificial Sequence
  chemically synthesized
atctgtgacagcatagattggt

SEQ ID NO: 967935 - DNA, 22 bp, Artificial Sequence
  chemically synthesized
tgctgtcacagatcagatcggt

SEQ ID NO: 967936 - DNA, 22 bp, Artificial Sequence
  chemically synthesized
ccaagagtaatcaccgatctga

SEQ ID NO: 967937 - DNA, 22 bp, Artificial Sequence
  chemically synthesized
tcacagatcagatcggtgatta

SEQ ID NO: 967938 - DNA, 22 bp, Artificial Sequence
  chemically synthesized
gtctcccaagagtaatcaccga

SEQ ID NO: 967939 - DNA, 22 bp, Artificial Sequence
  chemically synthesized
caatcattagtctcccaagagt

SEQ ID NO: 967940 - DNA, 22 bp, Artificial Sequence
  chemically synthesized
gcaatcattagtctcccaagag

SEQ ID NO: 967941 - DNA, 22 bp, Artificial Sequence
  chemically synthesized
tgcaatcattagtctcccaaga

SEQ ID NO: 967942 - DNA, 22 bp, Artificial Sequence
  chemically synthesized
tttgcaatcattagtctcccaa

SEQ ID NO: 967943 - DNA, 22 bp, Artificial Sequence
  chemically synthesized
ctctttgcaatcattagtctcc

SEQ ID NO: 967944 - DNA, 22 bp, Artificial Sequence
  chemically synthesized
gttcctctttgcaatcattagt

SEQ ID NO: 967945 - DNA, 22 bp, Artificial Sequence
  chemically synthesized
ctcttgggagactaatgattgc

SEQ ID NO: 967946 - DNA, 22 bp, Artificial Sequence
  chemically synthesized
ttgggagactaatgattgcaaa

SEQ ID NO: 967947 - DNA, 22 bp, Artificial Sequence
  chemically synthesized
gggagactaatgattgcaaaga

SEQ ID NO: 967948 - DNA, 22 bp, Artificial Sequence
  chemically synthesized
ggagactaatgattgcaaagag

SEQ ID NO: 967949 - DNA, 22 bp, Artificial Sequence
  chemically synthesized
atgattgcaaagaggaaccagg

SEQ ID NO: 967950 - DNA, 22 bp, Artificial Sequence
  chemically synthesized
caaagaggaaccaggggtactg

SEQ ID NO: 967951 - DNA, 22 bp, Artificial Sequence
  chemically synthesized
aagaaagaaaacaaaacagtac

SEQ ID NO: 967952 - DNA, 22 bp, Artificial Sequence
  chemically synthesized
caagaaagaaaacaaaacagta

SEQ ID NO: 967953 - DNA, 22 bp, Artificial Sequence
  chemically synthesized
ttttgttttctttcttgaagtg

SEQ ID NO: 967954 - DNA, 22 bp, Artificial Sequence
  chemically synthesized
tgttttctttcttgaagtggat

SEQ ID NO: 967955 - DNA, 22 bp, Artificial Sequence
  chemically synthesized
gttttctttcttgaagtggatg

SEQ ID NO: 967956 - DNA, 22 bp, Artificial Sequence
  chemically synthesized
ttttctttcttgaagtggatgc

SEQ ID NO: 967957 - DNA, 22 bp, Artificial Sequence
  chemically synthesized
tctttcttgaagtggatgctga

SEQ ID NO: 967958 - DNA, 22 bp, Artificial Sequence
  chemically synthesized
ctttcttgaagtggatgctgat

SEQ ID NO: 967959 - DNA, 22 bp, Artificial Sequence
  chemically synthesized
tttcttgaagtggatgctgatt

SEQ ID NO: 967960 - DNA, 22 bp, Artificial Sequence
  chemically synthesized
aagccagtcatgtaatcagcat

SEQ ID NO: 967961 - DNA, 22 bp, Artificial Sequence
  chemically synthesized
tcttgaagtggatgctgattac

SEQ ID NO: 967962 - DNA, 22 bp, Artificial Sequence
  chemically synthesized
cttgaagtggatgctgattaca

SEQ ID NO: 967963 - DNA, 22 bp, Artificial Sequence
  chemically synthesized
ttgaagtggatgctgattacat

SEQ ID NO: 967964 - DNA, 22 bp, Artificial Sequence
  chemically synthesized
gaagtggatgctgattacatga

SEQ ID NO: 967965 - DNA, 22 bp, Artificial Sequence
  chemically synthesized
aagtggatgctgattacatgac

SEQ ID NO: 967966 - DNA, 22 bp, Artificial Sequence
  chemically synthesized
aaaatctaaagccagtcatgta

SEQ ID NO: 967967 - DNA, 22 bp, Artificial Sequence
  chemically synthesized
attacatgactggctttagatt

SEQ ID NO: 967968 - DNA, 22 bp, Artificial Sequence
  chemically synthesized
catgactggctttagattttga

SEQ ID NO: 967969 - DNA, 22 bp, Artificial Sequence
  chemically synthesized
gctttagattttgaggcatata

SEQ ID NO: 967970 - DNA, 22 bp, Artificial Sequence
  chemically synthesized
tagattttgaggcatatacttg

SEQ ID NO: 967971 - DNA, 22 bp, Artificial Sequence
  chemically synthesized
agattttgaggcatatacttgt

SEQ ID NO: 967972 - DNA, 22 bp, Artificial Sequence
  chemically synthesized
gattttgaggcatatacttgtg

SEQ ID NO: 967973 - DNA, 22 bp, Artificial Sequence
  chemically synthesized
tgaggcatatacttgtgatacg

SEQ ID NO: 967974 - DNA, 22 bp, Artificial Sequence
  chemically synthesized
gaggcatatacttgtgatacgt

SEQ ID NO: 967975 - DNA, 22 bp, Artificial Sequence
  chemically synthesized
aggcatatacttgtgatacgtg

SEQ ID NO: 967976 - DNA, 22 bp, Artificial Sequence
  chemically synthesized
gtgatacgtgcactttttattg

SEQ ID NO: 967977 - DNA, 22 bp, Artificial Sequence
  chemically synthesized
tgatacgtgcactttttattgt

SEQ ID NO: 967978 - DNA, 22 bp, Artificial Sequence
  chemically synthesized
taaaagtgcatatacaataaaa

SEQ ID NO: 967979 - DNA, 22 bp, Artificial Sequence
  chemically synthesized
ataaaagtgcatatacaataaa

SEQ ID NO: 967980 - DNA, 22 bp, Artificial Sequence
  chemically synthesized
tataaaagtgcatatacaataa

SEQ ID NO: 967981 - DNA, 22 bp, Artificial Sequence
  chemically synthesized
aataattttataaaagtgcata

SEQ ID NO: 967982 - DNA, 22 bp, Artificial Sequence
  chemically synthesized
aaataattttataaaagtgcat

SEQ ID NO: 967983 - DNA, 22 bp, Artificial Sequence
  chemically synthesized
taaataattttataaaagtgca

SEQ ID NO: 967984 - DNA, 22 bp, Artificial Sequence
  chemically synthesized
tttattgtatatgcacttttat

SEQ ID NO: 967985 - DNA, 22 bp, Artificial Sequence
  chemically synthesized
ttattgtatatgcacttttata

SEQ ID NO: 967986 - DNA, 22 bp, Artificial Sequence
  chemically synthesized
tattgtatatgcacttttataa

SEQ ID NO: 967987 - DNA, 22 bp, Artificial Sequence
  chemically synthesized
ttttaaataattttataaaagt

SEQ ID NO: 967988 - DNA, 22 bp, Artificial Sequence
  chemically synthesized
attgtatatgcacttttataaa

SEQ ID NO: 967989 - DNA, 22 bp, Artificial Sequence
  chemically synthesized
ttgtatatgcacttttataaaa

SEQ ID NO: 967990 - DNA, 22 bp, Artificial Sequence
  chemically synthesized
tattttaaataattttataaaa

SEQ ID NO: 967991 - DNA, 22 bp, Artificial Sequence
  chemically synthesized
tatatgcacttttataaaatta

SEQ ID NO: 967992 - DNA, 22 bp, Artificial Sequence
  chemically synthesized
tactctattttaaataatttta

SEQ ID NO: 967993 - DNA, 22 bp, Artificial Sequence
  chemically synthesized
gagatctgtactctattttaaa

SEQ ID NO: 967994 - DNA, 22 bp, Artificial Sequence
  chemically synthesized
ttataaaattatttaaaataga

SEQ ID NO: 967995 - DNA, 22 bp, Artificial Sequence
  chemically synthesized
agagatctgtactctattttaa

SEQ ID NO: 967996 - DNA, 22 bp, Artificial Sequence
  chemically synthesized
tataaaattatttaaaatagag

SEQ ID NO: 967997 - DNA, 22 bp, Artificial Sequence
  chemically synthesized
tagagatctgtactctatttta

SEQ ID NO: 967998 - DNA, 22 bp, Artificial Sequence
  chemically synthesized
ataaaattatttaaaatagagt

SEQ ID NO: 967999 - DNA, 22 bp, Artificial Sequence
  chemically synthesized
taaaattatttaaaatagagta

SEQ ID NO: 968000 - DNA, 22 bp, Artificial Sequence
  chemically synthesized
acattttagagatctgtactct

SEQ ID NO: 968001 - DNA, 22 bp, Artificial Sequence
  chemically synthesized
tttaaaatagagtacagatctc

SEQ ID NO: 968002 - DNA, 22 bp, Artificial Sequence
  chemically synthesized
aaaatagagtacagatctctaa

SEQ ID NO: 968003 - DNA, 22 bp, Artificial Sequence
  chemically synthesized
aaatagagtacagatctctaaa

SEQ ID NO: 968004 - DNA, 22 bp, Artificial Sequence
  chemically synthesized
tggtatgctaacattttagaga

SEQ ID NO: 968005 - DNA, 22 bp, Artificial Sequence
  chemically synthesized
taaaatgttagcataccatagt

SEQ ID NO: 968006 - DNA, 22 bp, Artificial Sequence
  chemically synthesized
aaatgttagcataccatagttt

SEQ ID NO: 968007 - DNA, 22 bp, Artificial Sequence
  chemically synthesized
gcataccatagttttcatcttt

SEQ ID NO: 968008 - DNA, 22 bp, Artificial Sequence
  chemically synthesized
atagcagtagcaaaaagatgaa

SEQ ID NO: 968009 - DNA, 22 bp, Artificial Sequence
  chemically synthesized
gatgtggttcatagcagtagca

SEQ ID NO: 968010 - DNA, 22 bp, Artificial Sequence
  chemically synthesized
tggatgtggttcatagcagtag

SEQ ID NO: 968011 - DNA, 22 bp, Artificial Sequence
  chemically synthesized
tcatctttttgctactgctatg

SEQ ID NO: 968012 - DNA, 22 bp, Artificial Sequence
  chemically synthesized
catctttttgctactgctatga

SEQ ID NO: 968013 - DNA, 22 bp, Artificial Sequence
  chemically synthesized
atctttttgctactgctatgaa

SEQ ID NO: 968014 - DNA, 22 bp, Artificial Sequence
  chemically synthesized
ctctggatgtggttcatagcag

SEQ ID NO: 968015 - DNA, 22 bp, Artificial Sequence
  chemically synthesized
actctggatgtggttcatagca

SEQ ID NO: 968016 - DNA, 22 bp, Artificial Sequence
  chemically synthesized
tttgctactgctatgaaccaca

SEQ ID NO: 968017 - DNA, 22 bp, Artificial Sequence
  chemically synthesized
ttgctactgctatgaaccacat

SEQ ID NO: 968018 - DNA, 22 bp, Artificial Sequence
  chemically synthesized
tgctactgctatgaaccacatc

SEQ ID NO: 968019 - DNA, 22 bp, Artificial Sequence
  chemically synthesized
gctactgctatgaaccacatcc

SEQ ID NO: 968020 - DNA, 22 bp, Artificial Sequence
  chemically synthesized
ctactgctatgaaccacatcca

SEQ ID NO: 968021 - DNA, 22 bp, Artificial Sequence
  chemically synthesized
ctgctatgaaccacatccagag

SEQ ID NO: 968022 - DNA, 22 bp, Artificial Sequence
  chemically synthesized
ctatgaaccacatccagagtaa

SEQ ID NO: 968023 - DNA, 22 bp, Artificial Sequence
  chemically synthesized
tgaaccacatccagagtaaggt

SEQ ID NO: 968024 - DNA, 22 bp, Artificial Sequence
  chemically synthesized
aagataatatgcgtgaaacacc

SEQ ID NO: 968025 - DNA, 22 bp, Artificial Sequence
  chemically synthesized
tgtgaattaaagataatatgcg

SEQ ID NO: 968026 - DNA, 22 bp, Artificial Sequence
  chemically synthesized
cacgcatattatctttaattca

SEQ ID NO: 968027 - DNA, 22 bp, Artificial Sequence
  chemically synthesized
acgcatattatctttaattcac

SEQ ID NO: 968028 - DNA, 22 bp, Artificial Sequence
  chemically synthesized
tctttaattcacacaatatgga

SEQ ID NO: 968029 - DNA, 22 bp, Artificial Sequence
  chemically synthesized
taattcacacaatatggattgt

SEQ ID NO: 968030 - DNA, 22 bp, Artificial Sequence
  chemically synthesized
aattcacacaatatggattgta

SEQ ID NO: 968031 - DNA, 22 bp, Artificial Sequence
  chemically synthesized
attcacacaatatggattgtat

SEQ ID NO: 968032 - DNA, 22 bp, Artificial Sequence
  chemically synthesized
accagacaggccatacaatcca

SEQ ID NO: 968033 - DNA, 22 bp, Artificial Sequence
  chemically synthesized
acacaatatggattgtatggcc

SEQ ID NO: 968034 - DNA, 22 bp, Artificial Sequence
  chemically synthesized
tatggcctgtctggtcaggatg

SEQ ID NO: 968035 - DNA, 22 bp, Artificial Sequence
  chemically synthesized
tgcaatgagggtaatcatcctg

SEQ ID NO: 968036 - DNA, 22 bp, Artificial Sequence
  chemically synthesized
gtgcaatgagggtaatcatcct

SEQ ID NO: 968037 - DNA, 22 bp, Artificial Sequence
  chemically synthesized
tctggtcaggatgattaccctc

SEQ ID NO: 968038 - DNA, 22 bp, Artificial Sequence
  chemically synthesized
gatcacttgtgcaatgagggta

SEQ ID NO: 968039 - DNA, 22 bp, Artificial Sequence
  chemically synthesized
gtcaggatgattaccctcattg

SEQ ID NO: 968040 - DNA, 22 bp, Artificial Sequence
  chemically synthesized
cgtcaaaggctggatcacttgt

SEQ ID NO: 968041 - DNA, 22 bp, Artificial Sequence
  chemically synthesized
gcgtcaaaggctggatcacttg

SEQ ID NO: 968042 - DNA, 22 bp, Artificial Sequence
  chemically synthesized
ccctcattgcacaagtgatcca

SEQ ID NO: 968043 - DNA, 22 bp, Artificial Sequence
  chemically synthesized
tgcgtcaaaggctggatcactt

SEQ ID NO: 968044 - DNA, 22 bp, Artificial Sequence
  chemically synthesized
ttgcgtcaaaggctggatcact

SEQ ID NO: 968045 - DNA, 22 bp, Artificial Sequence
  chemically synthesized
tttgcgtcaaaggctggatcac

SEQ ID NO: 968046 - DNA, 22 bp, Artificial Sequence
  chemically synthesized
attgcacaagtgatccagcctt

SEQ ID NO: 968047 - DNA, 22 bp, Artificial Sequence
  chemically synthesized
agttttttgcgtcaaaggctgg

SEQ ID NO: 968048 - DNA, 22 bp, Artificial Sequence
  chemically synthesized
cacaagtgatccagcctttgac

SEQ ID NO: 968049 - DNA, 22 bp, Artificial Sequence
  chemically synthesized
atgtattcagttttttgcgtca

SEQ ID NO: 968050 - DNA, 22 bp, Artificial Sequence
  chemically synthesized
tgacgcaaaaaactgaatacat

SEQ ID NO: 968051 - DNA, 22 bp, Artificial Sequence
  chemically synthesized
gacgcaaaaaactgaatacatt

SEQ ID NO: 968052 - DNA, 22 bp, Artificial Sequence
  chemically synthesized
acgcaaaaaactgaatacatta

SEQ ID NO: 968053 - DNA, 22 bp, Artificial Sequence
  chemically synthesized
aatacattaattggcattcatc

SEQ ID NO: 968054 - DNA, 22 bp, Artificial Sequence
  chemically synthesized
ccccccacccaacaacaaagga

SEQ ID NO: 968055 - DNA, 22 bp, Artificial Sequence
  chemically synthesized
attggcattcatcctttgttgt

SEQ ID NO: 968056 - DNA, 22 bp, Artificial Sequence
  chemically synthesized
cccccccacccaacaacaaagg

SEQ ID NO: 968057 - DNA, 22 bp, Artificial Sequence
  chemically synthesized
ttcccccccacccaacaacaaa

SEQ ID NO: 968058 - DNA, 22 bp, Artificial Sequence
  chemically synthesized
cttcccccccacccaacaacaa

SEQ ID NO: 968059 - DNA, 22 bp, Artificial Sequence
  chemically synthesized
gcattcatcctttgttgttggg

SEQ ID NO: 968060 - DNA, 22 bp, Artificial Sequence
  chemically synthesized
tgcttcttcccccccacccaac

SEQ ID NO: 968061 - DNA, 22 bp, Artificial Sequence
  chemically synthesized
atcctttgttgttgggtggggg

SEQ ID NO: 968062 - DNA, 22 bp, Artificial Sequence
  chemically synthesized
tgttgttgggtgggggggaaga

SEQ ID NO: 968063 - DNA, 22 bp, Artificial Sequence
  chemically synthesized
gttgttgggtgggggggaagaa

SEQ ID NO: 968064 - DNA, 22 bp, Artificial Sequence
  chemically synthesized
ttgttgggtgggggggaagaag

SEQ ID NO: 968065 - DNA, 22 bp, Artificial Sequence
  chemically synthesized
ttgggtgggggggaagaagcac

SEQ ID NO: 968066 - DNA, 22 bp, Artificial Sequence
  chemically synthesized
ggtgggggggaagaagcacaat

SEQ ID NO: 968067 - DNA, 22 bp, Artificial Sequence
  chemically synthesized
atatcatgaacacatccacagt

SEQ ID NO: 968068 - DNA, 22 bp, Artificial Sequence
  chemically synthesized
gagtgacaattcatatcatgaa

SEQ ID NO: 968069 - DNA, 22 bp, Artificial Sequence
  chemically synthesized
ggagtgacaattcatatcatga

SEQ ID NO: 968070 - DNA, 22 bp, Artificial Sequence
  chemically synthesized
tggatgtgttcatgatatgaat

SEQ ID NO: 968071 - DNA, 22 bp, Artificial Sequence
  chemically synthesized
atgatatgaattgtcactccaa

SEQ ID NO: 968072 - DNA, 22 bp, Artificial Sequence
  chemically synthesized
aagcatcaaggaaacttggagt

SEQ ID NO: 968073 - DNA, 22 bp, Artificial Sequence
  chemically synthesized
ctaaagcatcaaggaaacttgg

SEQ ID NO: 968074 - DNA, 22 bp, Artificial Sequence
  chemically synthesized
tactcctaaagcatcaaggaaa

SEQ ID NO: 968075 - DNA, 22 bp, Artificial Sequence
  chemically synthesized
atactcctaaagcatcaaggaa

SEQ ID NO: 968076 - DNA, 22 bp, Artificial Sequence
  chemically synthesized
tcactccaagtttccttgatgc

SEQ ID NO: 968077 - DNA, 22 bp, Artificial Sequence
  chemically synthesized
tatactcctaaagcatcaagga

SEQ ID NO: 968078 - DNA, 22 bp, Artificial Sequence
  chemically synthesized
caagtttccttgatgctttagg

SEQ ID NO: 968079 - DNA, 22 bp, Artificial Sequence
  chemically synthesized
catcatctttatactcctaaag

SEQ ID NO: 968080 - DNA, 22 bp, Artificial Sequence
  chemically synthesized
ccttgatgctttaggagtataa

SEQ ID NO: 968081 - DNA, 22 bp, Artificial Sequence
  chemically synthesized
cttgatgctttaggagtataaa

SEQ ID NO: 968082 - DNA, 22 bp, Artificial Sequence
  chemically synthesized
gatgctttaggagtataaagat

SEQ ID NO: 968083 - DNA, 22 bp, Artificial Sequence
  chemically synthesized
atgctttaggagtataaagatg

SEQ ID NO: 968084 - DNA, 22 bp, Artificial Sequence
  chemically synthesized
aagcagctacatcatctttata

SEQ ID NO: 968085 - DNA, 22 bp, Artificial Sequence
  chemically synthesized
taggagtataaagatgatgtag

SEQ ID NO: 968086 - DNA, 22 bp, Artificial Sequence
  chemically synthesized
aggagtataaagatgatgtagc

SEQ ID NO: 968087 - DNA, 22 bp, Artificial Sequence
  chemically synthesized
ggagtataaagatgatgtagct

SEQ ID NO: 968088 - DNA, 22 bp, Artificial Sequence
  chemically synthesized
ggatgagtggcctcaagcagct

SEQ ID NO: 968089 - DNA, 22 bp, Artificial Sequence
  chemically synthesized
taggatgagtggcctcaagcag

SEQ ID NO: 968090 - DNA, 22 bp, Artificial Sequence
  chemically synthesized
ctaggatgagtggcctcaagca

SEQ ID NO: 968091 - DNA, 22 bp, Artificial Sequence
  chemically synthesized
cttctaggatgagtggcctcaa

SEQ ID NO: 968092 - DNA, 22 bp, Artificial Sequence
  chemically synthesized
cagactgcttctaggatgagtg

SEQ ID NO: 968093 - DNA, 22 bp, Artificial Sequence
  chemically synthesized
tccagactgcttctaggatgag

SEQ ID NO: 968094 - DNA, 22 bp, Artificial Sequence
  chemically synthesized
cttgaggccactcatcctagaa

SEQ ID NO: 968095 - DNA, 22 bp, Artificial Sequence
  chemically synthesized
gaggccactcatcctagaagca

SEQ ID NO: 968096 - DNA, 22 bp, Artificial Sequence
  chemically synthesized
aggccactcatcctagaagcag

SEQ ID NO: 968097 - DNA, 22 bp, Artificial Sequence
  chemically synthesized
tcacatgcctctccagactgct

SEQ ID NO: 968098 - DNA, 22 bp, Artificial Sequence
  chemically synthesized
ctgtcacatgcctctccagact

SEQ ID NO: 968099 - DNA, 22 bp, Artificial Sequence
  chemically synthesized
atcctagaagcagtctggagag

SEQ ID NO: 968100 - DNA, 22 bp, Artificial Sequence
  chemically synthesized
gaagcagtctggagaggcatgt

SEQ ID NO: 968101 - DNA, 22 bp, Artificial Sequence
  chemically synthesized
gcatctactgtcacatgcctct

SEQ ID NO: 968102 - DNA, 22 bp, Artificial Sequence
  chemically synthesized
gagaggcatgtgacagtagatg

SEQ ID NO: 968103 - DNA, 22 bp, Artificial Sequence
  chemically synthesized
acacagacaaataagaatgtca

SEQ ID NO: 968104 - DNA, 22 bp, Artificial Sequence
  chemically synthesized
ttgacacagacaaataagaatg

SEQ ID NO: 968105 - DNA, 22 bp, Artificial Sequence
  chemically synthesized
gattgttgacacagacaaataa

SEQ ID NO: 968106 - DNA, 22 bp, Artificial Sequence
  chemically synthesized
attgacattcttatttgtctgt

SEQ ID NO: 968107 - DNA, 22 bp, Artificial Sequence
  chemically synthesized
attagattgttgacacagacaa

SEQ ID NO: 968108 - DNA, 22 bp, Artificial Sequence
  chemically synthesized
aattagattgttgacacagaca

SEQ ID NO: 968109 - DNA, 22 bp, Artificial Sequence
  chemically synthesized
acattcttatttgtctgtgtca

SEQ ID NO: 968110 - DNA, 22 bp, Artificial Sequence
  chemically synthesized
ttatttgtctgtgtcaacaatc

SEQ ID NO: 968111 - DNA, 22 bp, Artificial Sequence
  chemically synthesized
atttgtctgtgtcaacaatcta

SEQ ID NO: 968112 - DNA, 22 bp, Artificial Sequence
  chemically synthesized
tttgtctgtgtcaacaatctaa

SEQ ID NO: 968113 - DNA, 22 bp, Artificial Sequence
  chemically synthesized
gtctgtgtcaacaatctaatta

SEQ ID NO: 968114 - DNA, 22 bp, Artificial Sequence
  chemically synthesized
tctgtgtcaacaatctaattaa

SEQ ID NO: 968115 - DNA, 22 bp, Artificial Sequence
  chemically synthesized
ggcaggaaaaaaccttaattag

SEQ ID NO: 968116 - DNA, 22 bp, Artificial Sequence
  chemically synthesized
tgtcaacaatctaattaaggtt

SEQ ID NO: 968117 - DNA, 22 bp, Artificial Sequence
  chemically synthesized
ctaggcaggaaaaaaccttaat

SEQ ID NO: 968118 - DNA, 22 bp, Artificial Sequence
  chemically synthesized
attaaggttttttcctgcctag

SEQ ID NO: 968119 - DNA, 22 bp, Artificial Sequence
  chemically synthesized
aggttttttcctgcctagtaga

SEQ ID NO: 968120 - DNA, 22 bp, Artificial Sequence
  chemically synthesized
aaatgagaccaatctactaggc

SEQ ID NO: 968121 - DNA, 22 bp, Artificial Sequence
  chemically synthesized
tttcctgcctagtagattggtc

SEQ ID NO: 968122 - DNA, 22 bp, Artificial Sequence
  chemically synthesized
ttcctgcctagtagattggtct

SEQ ID NO: 968123 - DNA, 22 bp, Artificial Sequence
  chemically synthesized
tgaattaaaatgagaccaatct

SEQ ID NO: 968124 - DNA, 22 bp, Artificial Sequence
  chemically synthesized
tcctgcctagtagattggtctc

SEQ ID NO: 968125 - DNA, 22 bp, Artificial Sequence
  chemically synthesized
cctgcctagtagattggtctca

SEQ ID NO: 968126 - DNA, 22 bp, Artificial Sequence
  chemically synthesized
ctgcctagtagattggtctcat

SEQ ID NO: 968127 - DNA, 22 bp, Artificial Sequence
  chemically synthesized
cctagtagattggtctcatttt

SEQ ID NO: 968128 - DNA, 22 bp, Artificial Sequence
  chemically synthesized
gtactgtgaattaaaatgagac

SEQ ID NO: 968129 - DNA, 22 bp, Artificial Sequence
  chemically synthesized
ggtactgtgaattaaaatgaga

SEQ ID NO: 968130 - DNA, 22 bp, Artificial Sequence
  chemically synthesized
tggtactgtgaattaaaatgag

SEQ ID NO: 968131 - DNA, 22 bp, Artificial Sequence
  chemically synthesized
ttggtactgtgaattaaaatga

SEQ ID NO: 968132 - DNA, 22 bp, Artificial Sequence
  chemically synthesized
gtagattggtctcattttaatt

SEQ ID NO: 968133 - DNA, 22 bp, Artificial Sequence
  chemically synthesized
tttggtactgtgaattaaaatg

SEQ ID NO: 968134 - DNA, 22 bp, Artificial Sequence
  chemically synthesized
ttttggtactgtgaattaaaat

SEQ ID NO: 968135 - DNA, 22 bp, Artificial Sequence
  chemically synthesized
ttttttggtactgtgaattaaa

SEQ ID NO: 968136 - DNA, 22 bp, Artificial Sequence
  chemically synthesized
cttttttggtactgtgaattaa

SEQ ID NO: 968137 - DNA, 22 bp, Artificial Sequence
  chemically synthesized
gtctcattttaattcacagtac

SEQ ID NO: 968138 - DNA, 22 bp, Artificial Sequence
  chemically synthesized
attttaattcacagtaccaaaa

SEQ ID NO: 968139 - DNA, 22 bp, Artificial Sequence
  chemically synthesized
gaagtgtttcttttttggtact

SEQ ID NO: 968140 - DNA, 22 bp, Artificial Sequence
  chemically synthesized
taattcacagtaccaaaaaaga

SEQ ID NO: 968141 - DNA, 22 bp, Artificial Sequence
  chemically synthesized
cctggaagtgtttcttttttgg

SEQ ID NO: 968142 - DNA, 22 bp, Artificial Sequence
  chemically synthesized
aattcacagtaccaaaaaagaa

SEQ ID NO: 968143 - DNA, 22 bp, Artificial Sequence
  chemically synthesized
acctggaagtgtttcttttttg

SEQ ID NO: 968144 - DNA, 22 bp, Artificial Sequence
  chemically synthesized
attcacagtaccaaaaaagaaa

SEQ ID NO: 968145 - DNA, 22 bp, Artificial Sequence
  chemically synthesized
tttacctggaagtgtttctttt

SEQ ID NO: 968146 - DNA, 22 bp, Artificial Sequence
  chemically synthesized
acagtaccaaaaaagaaacact

SEQ ID NO: 968147 - DNA, 22 bp, Artificial Sequence
  chemically synthesized
tatttacctggaagtgtttctt

SEQ ID NO: 968148 - DNA, 22 bp, Artificial Sequence
  chemically synthesized
ttctatttacctggaagtgttt

SEQ ID NO: 968149 - DNA, 22 bp, Artificial Sequence
  chemically synthesized
gttctatttacctggaagtgtt

SEQ ID NO: 968150 - DNA, 22 bp, Artificial Sequence
  chemically synthesized
tgttctatttacctggaagtgt

SEQ ID NO: 968151 - DNA, 22 bp, Artificial Sequence
  chemically synthesized
ttgttctatttacctggaagtg

SEQ ID NO: 968152 - DNA, 22 bp, Artificial Sequence
  chemically synthesized
tttgttctatttacctggaagt

SEQ ID NO: 968153 - DNA, 22 bp, Artificial Sequence
  chemically synthesized
ttttgttctatttacctggaag

SEQ ID NO: 968154 - DNA, 22 bp, Artificial Sequence
  chemically synthesized
tttttgttctatttacctggaa

SEQ ID NO: 968155 - DNA, 22 bp, Artificial Sequence
  chemically synthesized
ggaagactttttttgttctatt

SEQ ID NO: 968156 - DNA, 22 bp, Artificial Sequence
  chemically synthesized
cggaagactttttttgttctat

SEQ ID NO: 968157 - DNA, 22 bp, Artificial Sequence
  chemically synthesized
ttcggaagactttttttgttct

SEQ ID NO: 968158 - DNA, 22 bp, Artificial Sequence
  chemically synthesized
cttcggaagactttttttgttc

SEQ ID NO: 968159 - DNA, 22 bp, Artificial Sequence
  chemically synthesized
ccaggtaaatagaacaaaaaaa

SEQ ID NO: 968160 - DNA, 22 bp, Artificial Sequence
  chemically synthesized
tcttcggaagactttttttgtt

SEQ ID NO: 968161 - DNA, 22 bp, Artificial Sequence
  chemically synthesized
caggtaaatagaacaaaaaaag

SEQ ID NO: 968162 - DNA, 22 bp, Artificial Sequence
  chemically synthesized
ttcttcggaagactttttttgt

SEQ ID NO: 968163 - DNA, 22 bp, Artificial Sequence
  chemically synthesized
tttcttcggaagactttttttg

SEQ ID NO: 968164 - DNA, 22 bp, Artificial Sequence
  chemically synthesized
tttttcttcggaagactttttt

SEQ ID NO: 968165 - DNA, 22 bp, Artificial Sequence
  chemically synthesized
ctttttcttcggaagacttttt

SEQ ID NO: 968166 - DNA, 22 bp, Artificial Sequence
  chemically synthesized
tctttttcttcggaagactttt

SEQ ID NO: 968167 - DNA, 22 bp, Artificial Sequence
  chemically synthesized
ttctttttcttcggaagacttt

SEQ ID NO: 968168 - DNA, 22 bp, Artificial Sequence
  chemically synthesized
tttctttttcttcggaagactt

SEQ ID NO: 968169 - DNA, 22 bp, Artificial Sequence
  chemically synthesized
tactttttctttttcttcggaa

SEQ ID NO: 968170 - DNA, 22 bp, Artificial Sequence
  chemically synthesized
gtactttttctttttcttcgga

SEQ ID NO: 968171 - DNA, 22 bp, Artificial Sequence
  chemically synthesized
tgtactttttctttttcttcgg

SEQ ID NO: 968172 - DNA, 22 bp, Artificial Sequence
  chemically synthesized
ttgtactttttctttttcttcg

SEQ ID NO: 968173 - DNA, 22 bp, Artificial Sequence
  chemically synthesized
gtttttgtactttttctttttc

SEQ ID NO: 968174 - DNA, 22 bp, Artificial Sequence
  chemically synthesized
agttggtttttgtactttttct

SEQ ID NO: 968175 - DNA, 22 bp, Artificial Sequence
  chemically synthesized
aagttggtttttgtactttttc

SEQ ID NO: 968176 - DNA, 22 bp, Artificial Sequence
  chemically synthesized
ccgaagaaaaagaaaaagtaca

SEQ ID NO: 968177 - DNA, 22 bp, Artificial Sequence
  chemically synthesized
cgaagaaaaagaaaaagtacaa

SEQ ID NO: 968178 - DNA, 22 bp, Artificial Sequence
  chemically synthesized
caggccatttaagttggttttt

SEQ ID NO: 968179 - DNA, 22 bp, Artificial Sequence
  chemically synthesized
gagctccaggccatttaagttg

SEQ ID NO: 968180 - DNA, 22 bp, Artificial Sequence
  chemically synthesized
ggagctccaggccatttaagtt

SEQ ID NO: 968181 - DNA, 22 bp, Artificial Sequence
  chemically synthesized
tggagctccaggccatttaagt

SEQ ID NO: 968182 - DNA, 22 bp, Artificial Sequence
  chemically synthesized
ttggagctccaggccatttaag

SEQ ID NO: 968183 - DNA, 22 bp, Artificial Sequence
  chemically synthesized
tcaacaaagtacttttggagct

SEQ ID NO: 968184 - DNA, 22 bp, Artificial Sequence
  chemically synthesized
aaatggcctggagctccaaaag

SEQ ID NO: 968185 - DNA, 22 bp, Artificial Sequence
  chemically synthesized
gtcaacaaagtacttttggagc

SEQ ID NO: 968186 - DNA, 22 bp, Artificial Sequence
  chemically synthesized
aatggcctggagctccaaaagt

SEQ ID NO: 968187 - DNA, 22 bp, Artificial Sequence
  chemically synthesized
tgtcaacaaagtacttttggag

SEQ ID NO: 968188 - DNA, 22 bp, Artificial Sequence
  chemically synthesized
tttgtcaacaaagtacttttgg

SEQ ID NO: 968189 - DNA, 22 bp, Artificial Sequence
  chemically synthesized
gagctccaaaagtactttgttg

SEQ ID NO: 968190 - DNA, 22 bp, Artificial Sequence
  chemically synthesized
acagaattctttgtcaacaaag

SEQ ID NO: 968191 - DNA, 22 bp, Artificial Sequence
  chemically synthesized
caaaagtactttgttgacaaag

SEQ ID NO: 968192 - DNA, 22 bp, Artificial Sequence
  chemically synthesized
tgttgacaaagaattctgtgaa

SEQ ID NO: 968193 - DNA, 22 bp, Artificial Sequence
  chemically synthesized
gttgacaaagaattctgtgaac

SEQ ID NO: 968194 - DNA, 22 bp, Artificial Sequence
  chemically synthesized
ttgacaaagaattctgtgaaca

SEQ ID NO: 968195 - DNA, 22 bp, Artificial Sequence
  chemically synthesized
acaaagaattctgtgaacacgt

SEQ ID NO: 968196 - DNA, 22 bp, Artificial Sequence
  chemically synthesized
gtcaataatatatatgacgtgt

SEQ ID NO: 968197 - DNA, 22 bp, Artificial Sequence
  chemically synthesized
agtcaataatatatatgacgtg

SEQ ID NO: 968198 - DNA, 22 bp, Artificial Sequence
  chemically synthesized
tagtcaataatatatatgacgt

SEQ ID NO: 968199 - DNA, 22 bp, Artificial Sequence
  chemically synthesized
ttagtcaataatatatatgacg

SEQ ID NO: 968200 - DNA, 22 bp, Artificial Sequence
  chemically synthesized
tttagtcaataatatatatgac

SEQ ID NO: 968201 - DNA, 22 bp, Artificial Sequence
  chemically synthesized
tgtgaacacgtcatatatatta

SEQ ID NO: 968202 - DNA, 22 bp, Artificial Sequence
  chemically synthesized
tgaacacgtcatatatattatt

SEQ ID NO: 968203 - DNA, 22 bp, Artificial Sequence
  chemically synthesized
caggttttttagtcaataatat

SEQ ID NO: 968204 - DNA, 22 bp, Artificial Sequence
  chemically synthesized
gcaggttttttagtcaataata

SEQ ID NO: 968205 - DNA, 22 bp, Artificial Sequence
  chemically synthesized
tgcaggttttttagtcaataat

SEQ ID NO: 968206 - DNA, 22 bp, Artificial Sequence
  chemically synthesized
aactttgcaggttttttagtca

SEQ ID NO: 968207 - DNA, 22 bp, Artificial Sequence
  chemically synthesized
tgctgaactttgcaggtttttt

SEQ ID NO: 968208 - DNA, 22 bp, Artificial Sequence
  chemically synthesized
ttgactaaaaaacctgcaaagt

SEQ ID NO: 968209 - DNA, 22 bp, Artificial Sequence
  chemically synthesized
actaaaaaacctgcaaagttca

SEQ ID NO: 968210 - DNA, 22 bp, Artificial Sequence
  chemically synthesized
aaaaacctgcaaagttcagcac

SEQ ID NO: 968211 - DNA, 22 bp, Artificial Sequence
  chemically synthesized
gggatcagagcattgtgctgaa

SEQ ID NO: 968212 - DNA, 22 bp, Artificial Sequence
  chemically synthesized
caaagttcagcacaatgctctg

SEQ ID NO: 968213 - DNA, 22 bp, Artificial Sequence
  chemically synthesized
agcacaatgctctgatccctag

SEQ ID NO: 968214 - DNA, 22 bp, Artificial Sequence
  chemically synthesized
taaaataaaatatctagggatc

SEQ ID NO: 968215 - DNA, 22 bp, Artificial Sequence
  chemically synthesized
tgatccctagatattttatttt

SEQ ID NO: 968216 - DNA, 22 bp, Artificial Sequence
  chemically synthesized
atccctagatattttattttat

SEQ ID NO: 968217 - DNA, 22 bp, Artificial Sequence
  chemically synthesized
acagtgtgtagactataaaata

SEQ ID NO: 968218 - DNA, 22 bp, Artificial Sequence
  chemically synthesized
aacagtgtgtagactataaaat

SEQ ID NO: 968219 - DNA, 22 bp, Artificial Sequence
  chemically synthesized
gatattttattttatagtctac

SEQ ID NO: 968220 - DNA, 22 bp, Artificial Sequence
  chemically synthesized
tattttatagtctacacactgt

SEQ ID NO: 968221 - DNA, 22 bp, Artificial Sequence
  chemically synthesized
attttatagtctacacactgtt

SEQ ID NO: 968222 - DNA, 22 bp, Artificial Sequence
  chemically synthesized
ttttatagtctacacactgtta

SEQ ID NO: 968223 - DNA, 22 bp, Artificial Sequence
  chemically synthesized
acatcaaaaaccttaacagtgt

SEQ ID NO: 968224 - DNA, 22 bp, Artificial Sequence
  chemically synthesized
aacatcaaaaaccttaacagtg

SEQ ID NO: 968225 - DNA, 22 bp, Artificial Sequence
  chemically synthesized
tatagtctacacactgttaagg

SEQ ID NO: 968226 - DNA, 22 bp, Artificial Sequence
  chemically synthesized
atagtctacacactgttaaggt

SEQ ID NO: 968227 - DNA, 22 bp, Artificial Sequence
  chemically synthesized
ttaacatcaaaaaccttaacag

SEQ ID NO: 968228 - DNA, 22 bp, Artificial Sequence
  chemically synthesized
tagtctacacactgttaaggtt

SEQ ID NO: 968229 - DNA, 22 bp, Artificial Sequence
  chemically synthesized
aattcttaacatcaaaaacctt

SEQ ID NO: 968230 - DNA, 22 bp, Artificial Sequence
  chemically synthesized
caattcttaacatcaaaaacct

SEQ ID NO: 968231 - DNA, 22 bp, Artificial Sequence
  chemically synthesized
cacactgttaaggtttttgatg

SEQ ID NO: 968232 - DNA, 22 bp, Artificial Sequence
  chemically synthesized
gtttcaattcttaacatcaaaa

SEQ ID NO: 968233 - DNA, 22 bp, Artificial Sequence
  chemically synthesized
tcgtttcaattcttaacatcaa

SEQ ID NO: 968234 - DNA, 22 bp, Artificial Sequence
  chemically synthesized
ttaaggtttttgatgttaagaa

SEQ ID NO: 968235 - DNA, 22 bp, Artificial Sequence
  chemically synthesized
ctctcgtttcaattcttaacat

SEQ ID NO: 968236 - DNA, 22 bp, Artificial Sequence
  chemically synthesized
aggtttttgatgttaagaattg

SEQ ID NO: 968237 - DNA, 22 bp, Artificial Sequence
  chemically synthesized
ttgatgttaagaattgaaacga

SEQ ID NO: 968238 - DNA, 22 bp, Artificial Sequence
  chemically synthesized
tgatgttaagaattgaaacgag

SEQ ID NO: 968239 - DNA, 22 bp, Artificial Sequence
  chemically synthesized
gatgttaagaattgaaacgaga

SEQ ID NO: 968240 - DNA, 22 bp, Artificial Sequence
  chemically synthesized
taaggatactactctcgtttca

SEQ ID NO: 968241 - DNA, 22 bp, Artificial Sequence
  chemically synthesized
atgttaagaattgaaacgagag

SEQ ID NO: 968242 - DNA, 22 bp, Artificial Sequence
  chemically synthesized
ataaggatactactctcgtttc

SEQ ID NO: 968243 - DNA, 22 bp, Artificial Sequence
  chemically synthesized
tataaggatactactctcgttt

SEQ ID NO: 968244 - DNA, 22 bp, Artificial Sequence
  chemically synthesized
agaattgaaacgagagtagtat

SEQ ID NO: 968245 - DNA, 22 bp, Artificial Sequence
  chemically synthesized
aaacgagagtagtatccttata

SEQ ID NO: 968246 - DNA, 22 bp, Artificial Sequence
  chemically synthesized
agataggcaagaatgctttata

SEQ ID NO: 968247 - DNA, 22 bp, Artificial Sequence
  chemically synthesized
ataaagcattcttgcctatctt

SEQ ID NO: 968248 - DNA, 22 bp, Artificial Sequence
  chemically synthesized
taaagcattcttgcctatctta

SEQ ID NO: 968249 - DNA, 22 bp, Artificial Sequence
  chemically synthesized
gaaagggagtggtggttaagat

SEQ ID NO: 968250 - DNA, 22 bp, Artificial Sequence
  chemically synthesized
ttgcctatcttaaccaccactc

SEQ ID NO: 968251 - DNA, 22 bp, Artificial Sequence
  chemically synthesized
gtcattagaaagggagtggtgg

SEQ ID NO: 968252 - DNA, 22 bp, Artificial Sequence
  chemically synthesized
gcctatcttaaccaccactccc

SEQ ID NO: 968253 - DNA, 22 bp, Artificial Sequence
  chemically synthesized
cctatcttaaccaccactccct

SEQ ID NO: 968254 - DNA, 22 bp, Artificial Sequence
  chemically synthesized
ctagtcattagaaagggagtgg

SEQ ID NO: 968255 - DNA, 22 bp, Artificial Sequence
  chemically synthesized
cctagtcattagaaagggagtg

SEQ ID NO: 968256 - DNA, 22 bp, Artificial Sequence
  chemically synthesized
tcctagtcattagaaagggagt

SEQ ID NO: 968257 - DNA, 22 bp, Artificial Sequence
  chemically synthesized
tcttaaccaccactccctttct

SEQ ID NO: 968258 - DNA, 22 bp, Artificial Sequence
  chemically synthesized
tttcctagtcattagaaaggga

SEQ ID NO: 968259 - DNA, 22 bp, Artificial Sequence
  chemically synthesized
aaccaccactccctttctaatg

SEQ ID NO: 968260 - DNA, 22 bp, Artificial Sequence
  chemically synthesized
accaccactccctttctaatga

SEQ ID NO: 968261 - DNA, 22 bp, Artificial Sequence
  chemically synthesized
tactctttcctagtcattagaa

SEQ ID NO: 968262 - DNA, 22 bp, Artificial Sequence
  chemically synthesized
cattatactctttcctagtcat

SEQ ID NO: 968263 - DNA, 22 bp, Artificial Sequence
  chemically synthesized
acattatactctttcctagtca

SEQ ID NO: 968264 - DNA, 22 bp, Artificial Sequence
  chemically synthesized
tacattatactctttcctagtc

SEQ ID NO: 968265 - DNA, 22 bp, Artificial Sequence
  chemically synthesized
cctttctaatgactaggaaaga

SEQ ID NO: 968266 - DNA, 22 bp, Artificial Sequence
  chemically synthesized
ttttacattatactctttccta

SEQ ID NO: 968267 - DNA, 22 bp, Artificial Sequence
  chemically synthesized
attttacattatactctttcct

SEQ ID NO: 968268 - DNA, 22 bp, Artificial Sequence
  chemically synthesized
tattttacattatactctttcc

SEQ ID NO: 968269 - DNA, 22 bp, Artificial Sequence
  chemically synthesized
tctaatgactaggaaagagtat

SEQ ID NO: 968270 - DNA, 22 bp, Artificial Sequence
  chemically synthesized
ttattttacattatactctttc

SEQ ID NO: 968271 - DNA, 22 bp, Artificial Sequence
  chemically synthesized
ctaatgactaggaaagagtata

SEQ ID NO: 968272 - DNA, 22 bp, Artificial Sequence
  chemically synthesized
tttattttacattatactcttt

SEQ ID NO: 968273 - DNA, 22 bp, Artificial Sequence
  chemically synthesized
taatgactaggaaagagtataa

SEQ ID NO: 968274 - DNA, 22 bp, Artificial Sequence
  chemically synthesized
atgactaggaaagagtataatg

SEQ ID NO: 968275 - DNA, 22 bp, Artificial Sequence
  chemically synthesized
aatcaattttttattttacatt

SEQ ID NO: 968276 - DNA, 22 bp, Artificial Sequence
  chemically synthesized
ggaaagagtataatgtaaaata

SEQ ID NO: 968277 - DNA, 22 bp, Artificial Sequence
  chemically synthesized
gaatcaattttttattttacat

SEQ ID NO: 968278 - DNA, 22 bp, Artificial Sequence
  chemically synthesized
tgaatcaattttttattttaca

SEQ ID NO: 968279 - DNA, 22 bp, Artificial Sequence
  chemically synthesized
gaaaattttgaatcaatttttt

SEQ ID NO: 968280 - DNA, 22 bp, Artificial Sequence
  chemically synthesized
atgctcgaaaattttgaatcaa

SEQ ID NO: 968281 - DNA, 22 bp, Artificial Sequence
  chemically synthesized
catgctcgaaaattttgaatca

SEQ ID NO: 968282 - DNA, 22 bp, Artificial Sequence
  chemically synthesized
tcatgctcgaaaattttgaatc

SEQ ID NO: 968283 - DNA, 22 bp, Artificial Sequence
  chemically synthesized
ttcatgctcgaaaattttgaat

SEQ ID NO: 968284 - DNA, 22 bp, Artificial Sequence
  chemically synthesized
tttcatgctcgaaaattttgaa

SEQ ID NO: 968285 - DNA, 22 bp, Artificial Sequence
  chemically synthesized
atgataattttttcatgctcga

SEQ ID NO: 968286 - DNA, 22 bp, Artificial Sequence
  chemically synthesized
attcaaaattttcgagcatgaa

SEQ ID NO: 968287 - DNA, 22 bp, Artificial Sequence
  chemically synthesized
cctcatgataattttttcatgc

SEQ ID NO: 968288 - DNA, 22 bp, Artificial Sequence
  chemically synthesized
aaaattttcgagcatgaaaaaa

SEQ ID NO: 968289 - DNA, 22 bp, Artificial Sequence
  chemically synthesized
tcgagcatgaaaaaattatcat

SEQ ID NO: 968290 - DNA, 22 bp, Artificial Sequence
  chemically synthesized
cgagcatgaaaaaattatcatg

SEQ ID NO: 968291 - DNA, 22 bp, Artificial Sequence
  chemically synthesized
gagcatgaaaaaattatcatga

SEQ ID NO: 968292 - DNA, 22 bp, Artificial Sequence
  chemically synthesized
aggagaagaattccctcatgat

SEQ ID NO: 968293 - DNA, 22 bp, Artificial Sequence
  chemically synthesized
tcatgagggaattcttctcctt

SEQ ID NO: 968294 - DNA, 22 bp, Artificial Sequence
  chemically synthesized
catcagtggataagttaaggag

SEQ ID NO: 968295 - DNA, 22 bp, Artificial Sequence
  chemically synthesized
tacatcagtggataagttaagg

SEQ ID NO: 968296 - DNA, 22 bp, Artificial Sequence
  chemically synthesized
ctacatcagtggataagttaag

SEQ ID NO: 968297 - DNA, 22 bp, Artificial Sequence
  chemically synthesized
ttctccttaacttatccactga

SEQ ID NO: 968298 - DNA, 22 bp, Artificial Sequence
  chemically synthesized
ctccttaacttatccactgatg

SEQ ID NO: 968299 - DNA, 22 bp, Artificial Sequence
  chemically synthesized
tccttaacttatccactgatgt

SEQ ID NO: 968300 - DNA, 22 bp, Artificial Sequence
  chemically synthesized
catgtacgtttctacatcagtg

SEQ ID NO: 968301 - DNA, 22 bp, Artificial Sequence
  chemically synthesized
cttaacttatccactgatgtag

SEQ ID NO: 968302 - DNA, 22 bp, Artificial Sequence
  chemically synthesized
aacttatccactgatgtagaaa

SEQ ID NO: 968303 - DNA, 22 bp, Artificial Sequence
  chemically synthesized
acttatccactgatgtagaaac

SEQ ID NO: 968304 - DNA, 22 bp, Artificial Sequence
  chemically synthesized
aattacatgtacgtttctacat

SEQ ID NO: 968305 - DNA, 22 bp, Artificial Sequence
  chemically synthesized
tcaattacatgtacgtttctac

SEQ ID NO: 968306 - DNA, 22 bp, Artificial Sequence
  chemically synthesized
ctcaattacatgtacgtttcta

SEQ ID NO: 968307 - DNA, 22 bp, Artificial Sequence
  chemically synthesized
atccactgatgtagaaacgtac

SEQ ID NO: 968308 - DNA, 22 bp, Artificial Sequence
  chemically synthesized
tctcaattacatgtacgtttct

SEQ ID NO: 968309 - DNA, 22 bp, Artificial Sequence
  chemically synthesized
tccactgatgtagaaacgtaca

SEQ ID NO: 968310 - DNA, 22 bp, Artificial Sequence
  chemically synthesized
ttctcaattacatgtacgtttc

SEQ ID NO: 968311 - DNA, 22 bp, Artificial Sequence
  chemically synthesized
tttttctcaattacatgtacgt

SEQ ID NO: 968312 - DNA, 22 bp, Artificial Sequence
  chemically synthesized
ttatttttctcaattacatgta

SEQ ID NO: 968313 - DNA, 22 bp, Artificial Sequence
  chemically synthesized
atgtagaaacgtacatgtaatt

SEQ ID NO: 968314 - DNA, 22 bp, Artificial Sequence
  chemically synthesized
attatttttctcaattacatgt

SEQ ID NO: 968315 - DNA, 22 bp, Artificial Sequence
  chemically synthesized
tattatttttctcaattacatg

SEQ ID NO: 968316 - DNA, 22 bp, Artificial Sequence
  chemically synthesized
agaaaaataataaaatggatgt

SEQ ID NO: 968317 - DNA, 22 bp, Artificial Sequence
  chemically synthesized
ggaaataccgtcaacatccatt

SEQ ID NO: 968318 - DNA, 22 bp, Artificial Sequence
  chemically synthesized
tgggaaataccgtcaacatcca

SEQ ID NO: 968319 - DNA, 22 bp, Artificial Sequence
  chemically synthesized
ctgggaaataccgtcaacatcc

SEQ ID NO: 968320 - DNA, 22 bp, Artificial Sequence
  chemically synthesized
ttctgggaaataccgtcaacat

SEQ ID NO: 968321 - DNA, 22 bp, Artificial Sequence
  chemically synthesized
attcttctgggaaataccgtca

SEQ ID NO: 968322 - DNA, 22 bp, Artificial Sequence
  chemically synthesized
ttaattcttctgggaaataccg

SEQ ID NO: 968323 - DNA, 22 bp, Artificial Sequence
  chemically synthesized
gttaattcttctgggaaatacc

SEQ ID NO: 968324 - DNA, 22 bp, Artificial Sequence
  chemically synthesized
aaatttgttaattcttctggga

SEQ ID NO: 968325 - DNA, 22 bp, Artificial Sequence
  chemically synthesized
caaatttgttaattcttctggg

SEQ ID NO: 968326 - DNA, 22 bp, Artificial Sequence
  chemically synthesized
acggtatttcccagaagaatta

SEQ ID NO: 968327 - DNA, 22 bp, Artificial Sequence
  chemically synthesized
atttcaaatttgttaattcttc

SEQ ID NO: 968328 - DNA, 22 bp, Artificial Sequence
  chemically synthesized
aatttcaaatttgttaattctt

SEQ ID NO: 968329 - DNA, 22 bp, Artificial Sequence
  chemically synthesized
acttaatttcaaatttgttaat

SEQ ID NO: 968330 - DNA, 22 bp, Artificial Sequence
  chemically synthesized
cccagaagaattaacaaatttg

SEQ ID NO: 968331 - DNA, 22 bp, Artificial Sequence
  chemically synthesized
ctcacttaatttcaaatttgtt

SEQ ID NO: 968332 - DNA, 22 bp, Artificial Sequence
  chemically synthesized
ccagaagaattaacaaatttga

SEQ ID NO: 968333 - DNA, 22 bp, Artificial Sequence
  chemically synthesized
actcacttaatttcaaatttgt

SEQ ID NO: 968334 - DNA, 22 bp, Artificial Sequence
  chemically synthesized
tactcacttaatttcaaatttg

SEQ ID NO: 968335 - DNA, 22 bp, Artificial Sequence
  chemically synthesized
acaaatttgaaattaagtgagt

SEQ ID NO: 968336 - DNA, 22 bp, Artificial Sequence
  chemically synthesized
aataacagctttactcacttaa

SEQ ID NO: 968337 - DNA, 22 bp, Artificial Sequence
  chemically synthesized
gaaattaagtgagtaaagctgt

SEQ ID NO: 968338 - DNA, 22 bp, Artificial Sequence
  chemically synthesized
aaattaagtgagtaaagctgtt

SEQ ID NO: 968339 - DNA, 22 bp, Artificial Sequence
  chemically synthesized
aaataatgactgaataacagct

SEQ ID NO: 968340 - DNA, 22 bp, Artificial Sequence
  chemically synthesized
agtgagtaaagctgttattcag

SEQ ID NO: 968341 - DNA, 22 bp, Artificial Sequence
  chemically synthesized
agaaaagaccctgaaataatga

SEQ ID NO: 968342 - DNA, 22 bp, Artificial Sequence
  chemically synthesized
gagaaaagaccctgaaataatg

SEQ ID NO: 968343 - DNA, 22 bp, Artificial Sequence
  chemically synthesized
ttattcagtcattatttcaggg

SEQ ID NO: 968344 - DNA, 22 bp, Artificial Sequence
  chemically synthesized
ttcagtcattatttcagggtct

SEQ ID NO: 968345 - DNA, 22 bp, Artificial Sequence
  chemically synthesized
agaggcttgagaaaagaccctg

SEQ ID NO: 968346 - DNA, 22 bp, Artificial Sequence
  chemically synthesized
agtcattatttcagggtctttt

SEQ ID NO: 968347 - DNA, 22 bp, Artificial Sequence
  chemically synthesized
cagaggcttgagaaaagaccct

SEQ ID NO: 968348 - DNA, 22 bp, Artificial Sequence
  chemically synthesized
tttcagggtcttttctcaagcc

SEQ ID NO: 968349 - DNA, 22 bp, Artificial Sequence
  chemically synthesized
cagggtcttttctcaagcctct

SEQ ID NO: 968350 - DNA, 22 bp, Artificial Sequence
  chemically synthesized
agggtcttttctcaagcctctg

SEQ ID NO: 968351 - DNA, 22 bp, Artificial Sequence
  chemically synthesized
ccacatgtacttcagaggcttg

SEQ ID NO: 968352 - DNA, 22 bp, Artificial Sequence
  chemically synthesized
cccacatgtacttcagaggctt

SEQ ID NO: 968353 - DNA, 22 bp, Artificial Sequence
  chemically synthesized
tcccacatgtacttcagaggct

SEQ ID NO: 968354 - DNA, 22 bp, Artificial Sequence
  chemically synthesized
ttctcaagcctctgaagtacat

SEQ ID NO: 968355 - DNA, 22 bp, Artificial Sequence
  chemically synthesized
tctcaagcctctgaagtacatg

SEQ ID NO: 968356 - DNA, 22 bp, Artificial Sequence
  chemically synthesized
ctcaagcctctgaagtacatgt

SEQ ID NO: 968357 - DNA, 22 bp, Artificial Sequence
  chemically synthesized
tcaagcctctgaagtacatgtg

SEQ ID NO: 968358 - DNA, 22 bp, Artificial Sequence
  chemically synthesized
tgtagcattttcccacatgtac

SEQ ID NO: 968359 - DNA, 22 bp, Artificial Sequence
  chemically synthesized
aagcctctgaagtacatgtggg

SEQ ID NO: 968360 - DNA, 22 bp, Artificial Sequence
  chemically synthesized
atgtagcattttcccacatgta

SEQ ID NO: 968361 - DNA, 22 bp, Artificial Sequence
  chemically synthesized
cgtttatgtagcattttcccac

SEQ ID NO: 968362 - DNA, 22 bp, Artificial Sequence
  chemically synthesized
tgaagtacatgtgggaaaatgc

SEQ ID NO: 968363 - DNA, 22 bp, Artificial Sequence
  chemically synthesized
ctacgtttatgtagcattttcc

SEQ ID NO: 968364 - DNA, 22 bp, Artificial Sequence
  chemically synthesized
aagtacatgtgggaaaatgcta

SEQ ID NO: 968365 - DNA, 22 bp, Artificial Sequence
  chemically synthesized
tgctacgtttatgtagcatttt

SEQ ID NO: 968366 - DNA, 22 bp, Artificial Sequence
  chemically synthesized
ctgctacgtttatgtagcattt

SEQ ID NO: 968367 - DNA, 22 bp, Artificial Sequence
  chemically synthesized
acatttctgctacgtttatgta

SEQ ID NO: 968368 - DNA, 22 bp, Artificial Sequence
  chemically synthesized
cagaaattaacatttctgctac

SEQ ID NO: 968369 - DNA, 22 bp, Artificial Sequence
  chemically synthesized
cataaacgtagcagaaatgtta

SEQ ID NO: 968370 - DNA, 22 bp, Artificial Sequence
  chemically synthesized
ataagctgcagaaattaacatt

SEQ ID NO: 968371 - DNA, 22 bp, Artificial Sequence
  chemically synthesized
aataagctgcagaaattaacat

SEQ ID NO: 968372 - DNA, 22 bp, Artificial Sequence
  chemically synthesized
acttaataagctgcagaaatta

SEQ ID NO: 968373 - DNA, 22 bp, Artificial Sequence
  chemically synthesized
ataactaacttaataagctgca

SEQ ID NO: 968374 - DNA, 22 bp, Artificial Sequence
  chemically synthesized
atttctgcagcttattaagtta

SEQ ID NO: 968375 - DNA, 22 bp, Artificial Sequence
  chemically synthesized
taggctaataactaacttaata

SEQ ID NO: 968376 - DNA, 22 bp, Artificial Sequence
  chemically synthesized
ctgcagcttattaagttagtta

SEQ ID NO: 968377 - DNA, 22 bp, Artificial Sequence
  chemically synthesized
tgcagcttattaagttagttat

SEQ ID NO: 968378 - DNA, 22 bp, Artificial Sequence
  chemically synthesized
aattataggctaataactaact

SEQ ID NO: 968379 - DNA, 22 bp, Artificial Sequence
  chemically synthesized
gaattataggctaataactaac

SEQ ID NO: 968380 - DNA, 22 bp, Artificial Sequence
  chemically synthesized
cagcttattaagttagttatta

SEQ ID NO: 968381 - DNA, 22 bp, Artificial Sequence
  chemically synthesized
attaagttagttattagcctat

SEQ ID NO: 968382 - DNA, 22 bp, Artificial Sequence
  chemically synthesized
ttaagttagttattagcctata

SEQ ID NO: 968383 - DNA, 22 bp, Artificial Sequence
  chemically synthesized
aaagatcttgaattataggcta

SEQ ID NO: 968384 - DNA, 22 bp, Artificial Sequence
  chemically synthesized
agttagttattagcctataatt

SEQ ID NO: 968385 - DNA, 22 bp, Artificial Sequence
  chemically synthesized
gttattagcctataattcaaga

SEQ ID NO: 968386 - DNA, 22 bp, Artificial Sequence
  chemically synthesized
atgatactcaaagatcttgaat

SEQ ID NO: 968387 - DNA, 22 bp, Artificial Sequence
  chemically synthesized
aatgatactcaaagatcttgaa

SEQ ID NO: 968388 - DNA, 22 bp, Artificial Sequence
  chemically synthesized
ttagcctataattcaagatctt

SEQ ID NO: 968389 - DNA, 22 bp, Artificial Sequence
  chemically synthesized
taatgatactcaaagatcttga

SEQ ID NO: 968390 - DNA, 22 bp, Artificial Sequence
  chemically synthesized
gcctataattcaagatctttga

SEQ ID NO: 968391 - DNA, 22 bp, Artificial Sequence
  chemically synthesized
taattcaagatctttgagtatc

SEQ ID NO: 968392 - DNA, 22 bp, Artificial Sequence
  chemically synthesized
tgcgggtcctttaatgatactc

SEQ ID NO: 968393 - DNA, 22 bp, Artificial Sequence
  chemically synthesized
aagatctttgagtatcattaaa

SEQ ID NO: 968394 - DNA, 22 bp, Artificial Sequence
  chemically synthesized
tgagtatcattaaaggacccgc

SEQ ID NO: 968395 - DNA, 22 bp, Artificial Sequence
  chemically synthesized
gagtatcattaaaggacccgca

SEQ ID NO: 968396 - DNA, 22 bp, Artificial Sequence
  chemically synthesized
agtatcattaaaggacccgcac

SEQ ID NO: 968397 - DNA, 22 bp, Artificial Sequence
  chemically synthesized
aaatgatgtacctgtgcgggtc

SEQ ID NO: 968398 - DNA, 22 bp, Artificial Sequence
  chemically synthesized
aaggacccgcacaggtacatca

SEQ ID NO: 968399 - DNA, 22 bp, Artificial Sequence
  chemically synthesized
acataagtcattaaaatgatgt

SEQ ID NO: 968400 - DNA, 22 bp, Artificial Sequence
  chemically synthesized
tcacataagtcattaaaatgat

SEQ ID NO: 968401 - DNA, 22 bp, Artificial Sequence
  chemically synthesized
ctcacataagtcattaaaatga

SEQ ID NO: 968402 - DNA, 22 bp, Artificial Sequence
  chemically synthesized
tctcacataagtcattaaaatg

SEQ ID NO: 968403 - DNA, 22 bp, Artificial Sequence
  chemically synthesized
ttttctcacataagtcattaaa

SEQ ID NO: 968404 - DNA, 22 bp, Artificial Sequence
  chemically synthesized
tatatctattttctcacataag

SEQ ID NO: 968405 - DNA, 22 bp, Artificial Sequence
  chemically synthesized
atatatctattttctcacataa

SEQ ID NO: 968406 - DNA, 22 bp, Artificial Sequence
  chemically synthesized
tatatatctattttctcacata

SEQ ID NO: 968407 - DNA, 22 bp, Artificial Sequence
  chemically synthesized
ttatatatctattttctcacat

SEQ ID NO: 968408 - DNA, 22 bp, Artificial Sequence
  chemically synthesized
taatgacttatgtgagaaaata

SEQ ID NO: 968409 - DNA, 22 bp, Artificial Sequence
  chemically synthesized
tttttatatatctattttctca

SEQ ID NO: 968410 - DNA, 22 bp, Artificial Sequence
  chemically synthesized
aatgacttatgtgagaaaatag

SEQ ID NO: 968411 - DNA, 22 bp, Artificial Sequence
  chemically synthesized
atgacttatgtgagaaaataga

SEQ ID NO: 968412 - DNA, 22 bp, Artificial Sequence
  chemically synthesized
ctatttttatatatctattttc

SEQ ID NO: 968413 - DNA, 22 bp, Artificial Sequence
  chemically synthesized
atgtgagaaaatagatatataa

SEQ ID NO: 968414 - DNA, 22 bp, Artificial Sequence
  chemically synthesized
tgtgagaaaatagatatataaa

SEQ ID NO: 968415 - DNA, 22 bp, Artificial Sequence
  chemically synthesized
acgtccagatcatgttcctatt

SEQ ID NO: 968416 - DNA, 22 bp, Artificial Sequence
  chemically synthesized
aacgtccagatcatgttcctat

SEQ ID NO: 968417 - DNA, 22 bp, Artificial Sequence
  chemically synthesized
ttaacgtccagatcatgttcct

SEQ ID NO: 968418 - DNA, 22 bp, Artificial Sequence
  chemically synthesized
cttaacgtccagatcatgttcc

SEQ ID NO: 968419 - DNA, 22 bp, Artificial Sequence
  chemically synthesized
tttcttaacgtccagatcatgt

SEQ ID NO: 968420 - DNA, 22 bp, Artificial Sequence
  chemically synthesized
aaaattatttcttaacgtccag

SEQ ID NO: 968421 - DNA, 22 bp, Artificial Sequence
  chemically synthesized
gacgttaagaaataattttgag

SEQ ID NO: 968422 - DNA, 22 bp, Artificial Sequence
  chemically synthesized
agaaataattttgaggttctcc

SEQ ID NO: 968423 - DNA, 22 bp, Artificial Sequence
  chemically synthesized
tgaggttctccttactgataca

SEQ ID NO: 968424 - DNA, 22 bp, Artificial Sequence
  chemically synthesized
gaggttctccttactgatacat

SEQ ID NO: 968425 - DNA, 22 bp, Artificial Sequence
  chemically synthesized
aggttctccttactgatacatc

SEQ ID NO: 968426 - DNA, 22 bp, Artificial Sequence
  chemically synthesized
caacgcacaacacgatgtatca

SEQ ID NO: 968427 - DNA, 22 bp, Artificial Sequence
  chemically synthesized
tccttactgatacatcgtgttg

SEQ ID NO: 968428 - DNA, 22 bp, Artificial Sequence
  chemically synthesized
cttactgatacatcgtgttgtg

SEQ ID NO: 968429 - DNA, 22 bp, Artificial Sequence
  chemically synthesized
actgatacatcgtgttgtgcgt

SEQ ID NO: 968430 - DNA, 22 bp, Artificial Sequence
  chemically synthesized
ctgatacatcgtgttgtgcgtt

SEQ ID NO: 968431 - DNA, 22 bp, Artificial Sequence
  chemically synthesized
atacatcgtgttgtgcgttgga

SEQ ID NO: 968432 - DNA, 22 bp, Artificial Sequence
  chemically synthesized
gcgggtcaatatcagggcaaaa

SEQ ID NO: 968433 - DNA, 22 bp, Artificial Sequence
  chemically synthesized
tgcgttggaatttttgccctga

SEQ ID NO: 968434 - DNA, 22 bp, Artificial Sequence
  chemically synthesized
ggactagcgggtcaatatcagg

SEQ ID NO: 968435 - DNA, 22 bp, Artificial Sequence
  chemically synthesized
gaatttttgccctgatattgac

SEQ ID NO: 968436 - DNA, 22 bp, Artificial Sequence
  chemically synthesized
actcggactagcgggtcaatat

SEQ ID NO: 968437 - DNA, 22 bp, Artificial Sequence
  chemically synthesized
ttgccctgatattgacccgcta

SEQ ID NO: 968438 - DNA, 22 bp, Artificial Sequence
  chemically synthesized
attgactcggactagcgggtca

SEQ ID NO: 968439 - DNA, 22 bp, Artificial Sequence
  chemically synthesized
tgccctgatattgacccgctag

SEQ ID NO: 968440 - DNA, 22 bp, Artificial Sequence
  chemically synthesized
gccctgatattgacccgctagt

SEQ ID NO: 968441 - DNA, 22 bp, Artificial Sequence
  chemically synthesized
ccctgatattgacccgctagtc

SEQ ID NO: 968442 - DNA, 22 bp, Artificial Sequence
  chemically synthesized
atattgacccgctagtccgagt

SEQ ID NO: 968443 - DNA, 22 bp, Artificial Sequence
  chemically synthesized
caggtctgattgactcggacta

SEQ ID NO: 968444 - DNA, 22 bp, Artificial Sequence
  chemically synthesized
acccgctagtccgagtcaatca

SEQ ID NO: 968445 - DNA, 22 bp, Artificial Sequence
  chemically synthesized
gtccgagtcaatcagacctgga

SEQ ID NO: 968446 - DNA, 22 bp, Artificial Sequence
  chemically synthesized
gaaccagtcatcaggagaattc

SEQ ID NO: 968447 - DNA, 22 bp, Artificial Sequence
  chemically synthesized
gtctagaaccagtcatcaggag

SEQ ID NO: 968448 - DNA, 22 bp, Artificial Sequence
  chemically synthesized
agtctagaaccagtcatcagga

SEQ ID NO: 968449 - DNA, 22 bp, Artificial Sequence
  chemically synthesized
ttagtctagaaccagtcatcag

SEQ ID NO: 968450 - DNA, 22 bp, Artificial Sequence
  chemically synthesized
ctcttagtctagaaccagtcat

SEQ ID NO: 968451 - DNA, 22 bp, Artificial Sequence
  chemically synthesized
gaattctcctgatgactggttc

SEQ ID NO: 968452 - DNA, 22 bp, Artificial Sequence
  chemically synthesized
tcctgatgactggttctagact

SEQ ID NO: 968453 - DNA, 22 bp, Artificial Sequence
  chemically synthesized
ctgatgactggttctagactaa

SEQ ID NO: 968454 - DNA, 22 bp, Artificial Sequence
  chemically synthesized
atgactggttctagactaagag

SEQ ID NO: 968455 - DNA, 22 bp, Artificial Sequence
  chemically synthesized
ggacatgagactgctcttagtc

SEQ ID NO: 968456 - DNA, 22 bp, Artificial Sequence
  chemically synthesized
aggacatgagactgctcttagt

SEQ ID NO: 968457 - DNA, 22 bp, Artificial Sequence
  chemically synthesized
gttctagactaagagcagtctc

SEQ ID NO: 968458 - DNA, 22 bp, Artificial Sequence
  chemically synthesized
tagactaagagcagtctcatgt

SEQ ID NO: 968459 - DNA, 22 bp, Artificial Sequence
  chemically synthesized
agccaatttaggacatgagact

SEQ ID NO: 968460 - DNA, 22 bp, Artificial Sequence
  chemically synthesized
gagccaatttaggacatgagac

SEQ ID NO: 968461 - DNA, 22 bp, Artificial Sequence
  chemically synthesized
gactaagagcagtctcatgtcc

SEQ ID NO: 968462 - DNA, 22 bp, Artificial Sequence
  chemically synthesized
agagcagtctcatgtcctaaat

SEQ ID NO: 968463 - DNA, 22 bp, Artificial Sequence
  chemically synthesized
aatccatttgagccaatttagg

SEQ ID NO: 968464 - DNA, 22 bp, Artificial Sequence
  chemically synthesized
caatccatttgagccaatttag

SEQ ID NO: 968465 - DNA, 22 bp, Artificial Sequence
  chemically synthesized
ttcaatccatttgagccaattt

SEQ ID NO: 968466 - DNA, 22 bp, Artificial Sequence
  chemically synthesized
atgtcctaaattggctcaaatg

SEQ ID NO: 968467 - DNA, 22 bp, Artificial Sequence
  chemically synthesized
gaatatgtctcttcaatccatt

SEQ ID NO: 968468 - DNA, 22 bp, Artificial Sequence
  chemically synthesized
aattggctcaaatggattgaag

SEQ ID NO: 968469 - DNA, 22 bp, Artificial Sequence
  chemically synthesized
gttggaatatgtctcttcaatc

SEQ ID NO: 968470 - DNA, 22 bp, Artificial Sequence
  chemically synthesized
gctcaaatggattgaagagaca

SEQ ID NO: 968471 - DNA, 22 bp, Artificial Sequence
  chemically synthesized
cacctcgttggaatatgtctct

SEQ ID NO: 968472 - DNA, 22 bp, Artificial Sequence
  chemically synthesized
aaatggattgaagagacatatt

SEQ ID NO: 968473 - DNA, 22 bp, Artificial Sequence
  chemically synthesized
ccacctcgttggaatatgtctc

SEQ ID NO: 968474 - DNA, 22 bp, Artificial Sequence
  chemically synthesized
ttccacctcgttggaatatgtc

SEQ ID NO: 968475 - DNA, 22 bp, Artificial Sequence
  chemically synthesized
aagagacatattccaacgaggt

SEQ ID NO: 968476 - DNA, 22 bp, Artificial Sequence
  chemically synthesized
aagagagagaaaacctcttcca

SEQ ID NO: 968477 - DNA, 22 bp, Artificial Sequence
  chemically synthesized
caacgaggtggaagaggttttc

SEQ ID NO: 968478 - DNA, 22 bp, Artificial Sequence
  chemically synthesized
caagctgaagagagagaaaacc

SEQ ID NO: 968479 - DNA, 22 bp, Artificial Sequence
  chemically synthesized
agctacaagctgaagagagaga

SEQ ID NO: 968480 - DNA, 22 bp, Artificial Sequence
  chemically synthesized
aagctacaagctgaagagagag

SEQ ID NO: 968481 - DNA, 22 bp, Artificial Sequence
  chemically synthesized
taagctacaagctgaagagaga

SEQ ID NO: 968482 - DNA, 22 bp, Artificial Sequence
  chemically synthesized
ttaagctacaagctgaagagag

SEQ ID NO: 968483 - DNA, 22 bp, Artificial Sequence
  chemically synthesized
gcttttaagctacaagctgaag

SEQ ID NO: 968484 - DNA, 22 bp, Artificial Sequence
  chemically synthesized
tctctctcttcagcttgtagct

SEQ ID NO: 968485 - DNA, 22 bp, Artificial Sequence
  chemically synthesized
ctctctcttcagcttgtagctt

SEQ ID NO: 968486 - DNA, 22 bp, Artificial Sequence
  chemically synthesized
tctctcttcagcttgtagctta

SEQ ID NO: 968487 - DNA, 22 bp, Artificial Sequence
  chemically synthesized
tctcttcagcttgtagcttaaa

SEQ ID NO: 968488 - DNA, 22 bp, Artificial Sequence
  chemically synthesized
tcttcagcttgtagcttaaaag

SEQ ID NO: 968489 - DNA, 22 bp, Artificial Sequence
  chemically synthesized
ttcagcttgtagcttaaaagcc

SEQ ID NO: 968490 - DNA, 22 bp, Artificial Sequence
  chemically synthesized
tagtcatagattggcttttaag

SEQ ID NO: 968491 - DNA, 22 bp, Artificial Sequence
  chemically synthesized
cagcttgtagcttaaaagccaa

SEQ ID NO: 968492 - DNA, 22 bp, Artificial Sequence
  chemically synthesized
agcttgtagcttaaaagccaat

SEQ ID NO: 968493 - DNA, 22 bp, Artificial Sequence
  chemically synthesized
ctgtagtcatagattggctttt

SEQ ID NO: 968494 - DNA, 22 bp, Artificial Sequence
  chemically synthesized
ctcctgtagtcatagattggct

SEQ ID NO: 968495 - DNA, 22 bp, Artificial Sequence
  chemically synthesized
gtagcttaaaagccaatctatg

SEQ ID NO: 968496 - DNA, 22 bp, Artificial Sequence
  chemically synthesized
tagcttaaaagccaatctatga

SEQ ID NO: 968497 - DNA, 22 bp, Artificial Sequence
  chemically synthesized
ttcctcctgtagtcatagattg

SEQ ID NO: 968498 - DNA, 22 bp, Artificial Sequence
  chemically synthesized
attcctcctgtagtcatagatt

SEQ ID NO: 968499 - DNA, 22 bp, Artificial Sequence
  chemically synthesized
tattcctcctgtagtcatagat

SEQ ID NO: 968500 - DNA, 22 bp, Artificial Sequence
  chemically synthesized
aaaagccaatctatgactacag

SEQ ID NO: 968501 - DNA, 22 bp, Artificial Sequence
  chemically synthesized
aaagccaatctatgactacagg

SEQ ID NO: 968502 - DNA, 22 bp, Artificial Sequence
  chemically synthesized
agttttattcctcctgtagtca

SEQ ID NO: 968503 - DNA, 22 bp, Artificial Sequence
  chemically synthesized
ctaagttttattcctcctgtag

SEQ ID NO: 968504 - DNA, 22 bp, Artificial Sequence
  chemically synthesized
gtgaattcctaagttttattcc

SEQ ID NO: 968505 - DNA, 22 bp, Artificial Sequence
  chemically synthesized
tgactacaggaggaataaaact

SEQ ID NO: 968506 - DNA, 22 bp, Artificial Sequence
  chemically synthesized
tgctcgtgaattcctaagtttt

SEQ ID NO: 968507 - DNA, 22 bp, Artificial Sequence
  chemically synthesized
atgctcgtgaattcctaagttt

SEQ ID NO: 968508 - DNA, 22 bp, Artificial Sequence
  chemically synthesized
caggaggaataaaacttaggaa

SEQ ID NO: 968509 - DNA, 22 bp, Artificial Sequence
  chemically synthesized
tatgctcgtgaattcctaagtt

SEQ ID NO: 968510 - DNA, 22 bp, Artificial Sequence
  chemically synthesized
tttatgctcgtgaattcctaag

SEQ ID NO: 968511 - DNA, 22 bp, Artificial Sequence
  chemically synthesized
ctctttatgctcgtgaattcct

SEQ ID NO: 968512 - DNA, 22 bp, Artificial Sequence
  chemically synthesized
actctttatgctcgtgaattcc

SEQ ID NO: 968513 - DNA, 22 bp, Artificial Sequence
  chemically synthesized
gccttactctttatgctcgtga

SEQ ID NO: 968514 - DNA, 22 bp, Artificial Sequence
  chemically synthesized
ctggccttactctttatgctcg

SEQ ID NO: 968515 - DNA, 22 bp, Artificial Sequence
  chemically synthesized
aggaattcacgagcataaagag

SEQ ID NO: 968516 - DNA, 22 bp, Artificial Sequence
  chemically synthesized
ggaattcacgagcataaagagt

SEQ ID NO: 968517 - DNA, 22 bp, Artificial Sequence
  chemically synthesized
attactggccttactctttatg

SEQ ID NO: 968518 - DNA, 22 bp, Artificial Sequence
  chemically synthesized
gattactggccttactctttat

SEQ ID NO: 968519 - DNA, 22 bp, Artificial Sequence
  chemically synthesized
acgagcataaagagtaaggcca

SEQ ID NO: 968520 - DNA, 22 bp, Artificial Sequence
  chemically synthesized
ccaagtatagggatgccttgat

SEQ ID NO: 968521 - DNA, 22 bp, Artificial Sequence
  chemically synthesized
gccaagtatagggatgccttga

SEQ ID NO: 968522 - DNA, 22 bp, Artificial Sequence
  chemically synthesized
agagtggccaggtttgccaagt

SEQ ID NO: 968523 - DNA, 22 bp, Artificial Sequence
  chemically synthesized
tacttggcaaacctggccactc

SEQ ID NO: 968524 - DNA, 22 bp, Artificial Sequence
  chemically synthesized
caaagagaagcctcagagtggc

SEQ ID NO: 968525 - DNA, 22 bp, Artificial Sequence
  chemically synthesized
ggcaaacctggccactctgagg

SEQ ID NO: 968526 - DNA, 22 bp, Artificial Sequence
  chemically synthesized
gcaaacctggccactctgaggc

SEQ ID NO: 968527 - DNA, 22 bp, Artificial Sequence
  chemically synthesized
gccactctgaggcttctctttg

SEQ ID NO: 968528 - DNA, 22 bp, Artificial Sequence
  chemically synthesized
tgaggcttctctttggaggatt

SEQ ID NO: 968529 - DNA, 22 bp, Artificial Sequence
  chemically synthesized
aggcttctctttggaggattcc

SEQ ID NO: 968530 - DNA, 22 bp, Artificial Sequence
  chemically synthesized
gatgtagcagaggtggaatcct

SEQ ID NO: 968531 - DNA, 22 bp, Artificial Sequence
  chemically synthesized
ctctttggaggattccacctct

SEQ ID NO: 968532 - DNA, 22 bp, Artificial Sequence
  chemically synthesized
tctagatgtagcagaggtggaa

SEQ ID NO: 968533 - DNA, 22 bp, Artificial Sequence
  chemically synthesized
tctttggaggattccacctctg

SEQ ID NO: 968534 - DNA, 22 bp, Artificial Sequence
  chemically synthesized
tttggaggattccacctctgct

SEQ ID NO: 968535 - DNA, 22 bp, Artificial Sequence
  chemically synthesized
tggaggattccacctctgctac

SEQ ID NO: 968536 - DNA, 22 bp, Artificial Sequence
  chemically synthesized
ggaggattccacctctgctaca

SEQ ID NO: 968537 - DNA, 22 bp, Artificial Sequence
  chemically synthesized
gaggattccacctctgctacat

SEQ ID NO: 968538 - DNA, 22 bp, Artificial Sequence
  chemically synthesized
agtcattgtctagatgtagcag

SEQ ID NO: 968539 - DNA, 22 bp, Artificial Sequence
  chemically synthesized
cacctctgctacatctagacaa

SEQ ID NO: 968540 - DNA, 22 bp, Artificial Sequence
  chemically synthesized
tgctacatctagacaatgactc

SEQ ID NO: 968541 - DNA, 22 bp, Artificial Sequence
  chemically synthesized
ctacatctagacaatgactcag

SEQ ID NO: 968542 - DNA, 22 bp, Artificial Sequence
  chemically synthesized
catctagacaatgactcagtgt

SEQ ID NO: 968543 - DNA, 22 bp, Artificial Sequence
  chemically synthesized
tatccagaaataacactgagtc

SEQ ID NO: 968544 - DNA, 22 bp, Artificial Sequence
  chemically synthesized
atatccagaaataacactgagt

SEQ ID NO: 968545 - DNA, 22 bp, Artificial Sequence
  chemically synthesized
gacaatgactcagtgttatttc

SEQ ID NO: 968546 - DNA, 22 bp, Artificial Sequence
  chemically synthesized
ccagcagtgccttatatccaga

SEQ ID NO: 968547 - DNA, 22 bp, Artificial Sequence
  chemically synthesized
agtgttatttctggatataagg

SEQ ID NO: 968548 - DNA, 22 bp, Artificial Sequence
  chemically synthesized
tgtgttcccagcagtgccttat

SEQ ID NO: 968549 - DNA, 22 bp, Artificial Sequence
  chemically synthesized
tttctggatataaggcactgct

SEQ ID NO: 968550 - DNA, 22 bp, Artificial Sequence
  chemically synthesized
atctgtgtgttcccagcagtgc

SEQ ID NO: 968551 - DNA, 22 bp, Artificial Sequence
  chemically synthesized
ctggatataaggcactgctggg

SEQ ID NO: 968552 - DNA, 22 bp, Artificial Sequence
  chemically synthesized
tggatataaggcactgctggga

SEQ ID NO: 968553 - DNA, 22 bp, Artificial Sequence
  chemically synthesized
gatataaggcactgctgggaac

SEQ ID NO: 968554 - DNA, 22 bp, Artificial Sequence
  chemically synthesized
atgtcagattcatctgtgtgtt

SEQ ID NO: 968555 - DNA, 22 bp, Artificial Sequence
  chemically synthesized
ctgggaacacacagatgaatct

SEQ ID NO: 968556 - DNA, 22 bp, Artificial Sequence
  chemically synthesized
tagaattcatgtcagattcatc

SEQ ID NO: 968557 - DNA, 22 bp, Artificial Sequence
  chemically synthesized
ggaacacacagatgaatctgac

SEQ ID NO: 968558 - DNA, 22 bp, Artificial Sequence
  chemically synthesized
attatagaattcatgtcagatt

SEQ ID NO: 968559 - DNA, 22 bp, Artificial Sequence
  chemically synthesized
agaaactcattatagaattcat

SEQ ID NO: 968560 - DNA, 22 bp, Artificial Sequence
  chemically synthesized
ctgagaaactcattatagaatt

SEQ ID NO: 968561 - DNA, 22 bp, Artificial Sequence
  chemically synthesized
tcctgagaaactcattatagaa

SEQ ID NO: 968562 - DNA, 22 bp, Artificial Sequence
  chemically synthesized
ttctcctgagaaactcattata

SEQ ID NO: 968563 - DNA, 22 bp, Artificial Sequence
  chemically synthesized
acatgaattctataatgagttt

SEQ ID NO: 968564 - DNA, 22 bp, Artificial Sequence
  chemically synthesized
attattctcctgagaaactcat

SEQ ID NO: 968565 - DNA, 22 bp, Artificial Sequence
  chemically synthesized
tataatgagtttctcaggagaa

SEQ ID NO: 968566 - DNA, 22 bp, Artificial Sequence
  chemically synthesized
ccaaaattcattattctcctga

SEQ ID NO: 968567 - DNA, 22 bp, Artificial Sequence
  chemically synthesized
taatgagtttctcaggagaata

SEQ ID NO: 968568 - DNA, 22 bp, Artificial Sequence
  chemically synthesized
ccattaccaaaattcattattc

SEQ ID NO: 968569 - DNA, 22 bp, Artificial Sequence
  chemically synthesized
cccattaccaaaattcattatt

SEQ ID NO: 968570 - DNA, 22 bp, Artificial Sequence
  chemically synthesized
ctcaggagaataatgaattttg

SEQ ID NO: 968571 - DNA, 22 bp, Artificial Sequence
  chemically synthesized
atttcccattaccaaaattcat

SEQ ID NO: 968572 - DNA, 22 bp, Artificial Sequence
  chemically synthesized
tcaggagaataatgaattttgg

SEQ ID NO: 968573 - DNA, 22 bp, Artificial Sequence
  chemically synthesized
catttcccattaccaaaattca

SEQ ID NO: 968574 - DNA, 22 bp, Artificial Sequence
  chemically synthesized
tcatttcccattaccaaaattc

SEQ ID NO: 968575 - DNA, 22 bp, Artificial Sequence
  chemically synthesized
aggagaataatgaattttggta

SEQ ID NO: 968576 - DNA, 22 bp, Artificial Sequence
  chemically synthesized
cccactttcatttcccattacc

SEQ ID NO: 968577 - DNA, 22 bp, Artificial Sequence
  chemically synthesized
ccccactttcatttcccattac

SEQ ID NO: 968578 - DNA, 22 bp, Artificial Sequence
  chemically synthesized
tggtaatgggaaatgaaagtgg

SEQ ID NO: 968579 - DNA, 22 bp, Artificial Sequence
  chemically synthesized
ggtaatgggaaatgaaagtggg

SEQ ID NO: 968580 - DNA, 22 bp, Artificial Sequence
  chemically synthesized
gtaatgggaaatgaaagtgggg

SEQ ID NO: 968581 - DNA, 22 bp, Artificial Sequence
  chemically synthesized
tagacgaaggtcaagtccataa

SEQ ID NO: 968582 - DNA, 22 bp, Artificial Sequence
  chemically synthesized
tatgttatggacttgaccttcg

SEQ ID NO: 968583 - DNA, 22 bp, Artificial Sequence
  chemically synthesized
tggacttgaccttcgtctataa

SEQ ID NO: 968584 - DNA, 22 bp, Artificial Sequence
  chemically synthesized
gaccttcgtctataatatgggt

SEQ ID NO: 968585 - DNA, 22 bp, Artificial Sequence
  chemically synthesized
accttcgtctataatatgggtg

SEQ ID NO: 968586 - DNA, 22 bp, Artificial Sequence
  chemically synthesized
aacgagtggcagacacccatat

SEQ ID NO: 968587 - DNA, 22 bp, Artificial Sequence
  chemically synthesized
ttgaacgagtggcagacaccca

SEQ ID NO: 968588 - DNA, 22 bp, Artificial Sequence
  chemically synthesized
cgtctataatatgggtgtctgc

SEQ ID NO: 968589 - DNA, 22 bp, Artificial Sequence
  chemically synthesized
gtctataatatgggtgtctgcc

SEQ ID NO: 968590 - DNA, 22 bp, Artificial Sequence
  chemically synthesized
taatatgggtgtctgccactcg

SEQ ID NO: 968591 - DNA, 22 bp, Artificial Sequence
  chemically synthesized
atggattgttgaacgagtggca

SEQ ID NO: 968592 - DNA, 22 bp, Artificial Sequence
  chemically synthesized
ctaatggattgttgaacgagtg

SEQ ID NO: 968593 - DNA, 22 bp, Artificial Sequence
  chemically synthesized
gctaatggattgttgaacgagt

SEQ ID NO: 968594 - DNA, 22 bp, Artificial Sequence
  chemically synthesized
aatgatttgctaatggattgtt

SEQ ID NO: 968595 - DNA, 22 bp, Artificial Sequence
  chemically synthesized
ccactcgttcaacaatccatta

SEQ ID NO: 968596 - DNA, 22 bp, Artificial Sequence
  chemically synthesized
agttaaatgatttgctaatgga

SEQ ID NO: 968597 - DNA, 22 bp, Artificial Sequence
  chemically synthesized
aagttaaatgatttgctaatgg

SEQ ID NO: 968598 - DNA, 22 bp, Artificial Sequence
  chemically synthesized
taagttaaatgatttgctaatg

SEQ ID NO: 968599 - DNA, 22 bp, Artificial Sequence
  chemically synthesized
gttcaacaatccattagcaaat

SEQ ID NO: 968600 - DNA, 22 bp, Artificial Sequence
  chemically synthesized
ttaagttaaatgatttgctaat

SEQ ID NO: 968601 - DNA, 22 bp, Artificial Sequence
  chemically synthesized
aacaatccattagcaaatcatt

SEQ ID NO: 968602 - DNA, 22 bp, Artificial Sequence
  chemically synthesized
gcaaatcatttaacttaaaaat

SEQ ID NO: 968603 - DNA, 22 bp, Artificial Sequence
  chemically synthesized
acatatggataaaatattttta

SEQ ID NO: 968604 - DNA, 22 bp, Artificial Sequence
  chemically synthesized
aacatatggataaaatattttt

SEQ ID NO: 968605 - DNA, 22 bp, Artificial Sequence
  chemically synthesized
aacttaaaaatattttatccat

SEQ ID NO: 968606 - DNA, 22 bp, Artificial Sequence
  chemically synthesized
acttaaaaatattttatccata

SEQ ID NO: 968607 - DNA, 22 bp, Artificial Sequence
  chemically synthesized
aaaaatattttatccatatgtt

SEQ ID NO: 968608 - DNA, 22 bp, Artificial Sequence
  chemically synthesized
gtagcccaatttaacatatgga

SEQ ID NO: 968609 - DNA, 22 bp, Artificial Sequence
  chemically synthesized
aaaatattttatccatatgtta

SEQ ID NO: 968610 - DNA, 22 bp, Artificial Sequence
  chemically synthesized
agtagcccaatttaacatatgg

SEQ ID NO: 968611 - DNA, 22 bp, Artificial Sequence
  chemically synthesized
tagtagcccaatttaacatatg

SEQ ID NO: 968612 - DNA, 22 bp, Artificial Sequence
  chemically synthesized
tatgttttagtagcccaattta

SEQ ID NO: 968613 - DNA, 22 bp, Artificial Sequence
  chemically synthesized
tatccatatgttaaattgggct

SEQ ID NO: 968614 - DNA, 22 bp, Artificial Sequence
  chemically synthesized
atccatatgttaaattgggcta

SEQ ID NO: 968615 - DNA, 22 bp, Artificial Sequence
  chemically synthesized
tccatatgttaaattgggctac

SEQ ID NO: 968616 - DNA, 22 bp, Artificial Sequence
  chemically synthesized
attatatgttttagtagcccaa

SEQ ID NO: 968617 - DNA, 22 bp, Artificial Sequence
  chemically synthesized
cattatatgttttagtagccca

SEQ ID NO: 968618 - DNA, 22 bp, Artificial Sequence
  chemically synthesized
tcattatatgttttagtagccc

SEQ ID NO: 968619 - DNA, 22 bp, Artificial Sequence
  chemically synthesized
aattgggctactaaaacatata

SEQ ID NO: 968620 - DNA, 22 bp, Artificial Sequence
  chemically synthesized
tatgccctttcattatatgttt

SEQ ID NO: 968621 - DNA, 22 bp, Artificial Sequence
  chemically synthesized
tatatgccctttcattatatgt

SEQ ID NO: 968622 - DNA, 22 bp, Artificial Sequence
  chemically synthesized
ggctactaaaacatataatgaa

SEQ ID NO: 968623 - DNA, 22 bp, Artificial Sequence
  chemically synthesized
ctaaaacatataatgaaagggc

SEQ ID NO: 968624 - DNA, 22 bp, Artificial Sequence
  chemically synthesized
aaacatataatgaaagggcata

SEQ ID NO: 968625 - DNA, 22 bp, Artificial Sequence
  chemically synthesized
aagaagcccatagctctatatg

SEQ ID NO: 968626 - DNA, 22 bp, Artificial Sequence
  chemically synthesized
aaagaagcccatagctctatat

SEQ ID NO: 968627 - DNA, 22 bp, Artificial Sequence
  chemically synthesized
cttaaagaagcccatagctcta

SEQ ID NO: 968628 - DNA, 22 bp, Artificial Sequence
  chemically synthesized
ccttaaagaagcccatagctct

SEQ ID NO: 968629 - DNA, 22 bp, Artificial Sequence
  chemically synthesized
tatttccttaaagaagcccata

SEQ ID NO: 968630 - DNA, 22 bp, Artificial Sequence
  chemically synthesized
ttgtatttccttaaagaagccc

SEQ ID NO: 968631 - DNA, 22 bp, Artificial Sequence
  chemically synthesized
ttattgtatttccttaaagaag

SEQ ID NO: 968632 - DNA, 22 bp, Artificial Sequence
  chemically synthesized
gctgttattgtatttccttaaa

SEQ ID NO: 968633 - DNA, 22 bp, Artificial Sequence
  chemically synthesized
tgggcttctttaaggaaataca

SEQ ID NO: 968634 - DNA, 22 bp, Artificial Sequence
  chemically synthesized
ggaatattagctgttattgtat

SEQ ID NO: 968635 - DNA, 22 bp, Artificial Sequence
  chemically synthesized
ctttaaggaaatacaataacag

SEQ ID NO: 968636 - DNA, 22 bp, Artificial Sequence
  chemically synthesized
tttaaggaaatacaataacagc

SEQ ID NO: 968637 - DNA, 22 bp, Artificial Sequence
  chemically synthesized
ctaggaatattagctgttattg

SEQ ID NO: 968638 - DNA, 22 bp, Artificial Sequence
  chemically synthesized
taaggaaatacaataacagcta

SEQ ID NO: 968639 - DNA, 22 bp, Artificial Sequence
  chemically synthesized
aaggaaatacaataacagctaa

SEQ ID NO: 968640 - DNA, 22 bp, Artificial Sequence
  chemically synthesized
aggaaatacaataacagctaat

SEQ ID NO: 968641 - DNA, 22 bp, Artificial Sequence
  chemically synthesized
atatgcataaagctcctaggaa

SEQ ID NO: 968642 - DNA, 22 bp, Artificial Sequence
  chemically synthesized
atattcctaggagctttatgca

SEQ ID NO: 968643 - DNA, 22 bp, Artificial Sequence
  chemically synthesized
gcacagtgcctgatatgcataa

SEQ ID NO: 968644 - DNA, 22 bp, Artificial Sequence
  chemically synthesized
agcacagtgcctgatatgcata

SEQ ID NO: 968645 - DNA, 22 bp, Artificial Sequence
  chemically synthesized
ctaggagctttatgcatatcag

SEQ ID NO: 968646 - DNA, 22 bp, Artificial Sequence
  chemically synthesized
ggagctttatgcatatcaggca

SEQ ID NO: 968647 - DNA, 22 bp, Artificial Sequence
  chemically synthesized
agtgtttagcacagtgcctgat

SEQ ID NO: 968648 - DNA, 22 bp, Artificial Sequence
  chemically synthesized
ttcagtgtttagcacagtgcct

SEQ ID NO: 968649 - DNA, 22 bp, Artificial Sequence
  chemically synthesized
attcagtgtttagcacagtgcc

SEQ ID NO: 968650 - DNA, 22 bp, Artificial Sequence
  chemically synthesized
tatgcatatcaggcactgtgct

SEQ ID NO: 968651 - DNA, 22 bp, Artificial Sequence
  chemically synthesized
atgcatatcaggcactgtgcta

SEQ ID NO: 968652 - DNA, 22 bp, Artificial Sequence
  chemically synthesized
tgcatatcaggcactgtgctaa

SEQ ID NO: 968653 - DNA, 22 bp, Artificial Sequence
  chemically synthesized
cttattcagtgtttagcacagt

SEQ ID NO: 968654 - DNA, 22 bp, Artificial Sequence
  chemically synthesized
agaaattgcttattcagtgttt

SEQ ID NO: 968655 - DNA, 22 bp, Artificial Sequence
  chemically synthesized
tgctaaacactgaataagcaat

SEQ ID NO: 968656 - DNA, 22 bp, Artificial Sequence
  chemically synthesized
atgtgaaggttaagaaattgct

SEQ ID NO: 968657 - DNA, 22 bp, Artificial Sequence
  chemically synthesized
aacactgaataagcaatttctt

SEQ ID NO: 968658 - DNA, 22 bp, Artificial Sequence
  chemically synthesized
aataagcaatttcttaaccttc

SEQ ID NO: 968659 - DNA, 22 bp, Artificial Sequence
  chemically synthesized
atggggttcatgtgaaggttaa

SEQ ID NO: 968660 - DNA, 22 bp, Artificial Sequence
  chemically synthesized
tctcatggggttcatgtgaagg

SEQ ID NO: 968661 - DNA, 22 bp, Artificial Sequence
  chemically synthesized
cttaaccttcacatgaacccca

SEQ ID NO: 968662 - DNA, 22 bp, Artificial Sequence
  chemically synthesized
ttaaccttcacatgaaccccat

SEQ ID NO: 968663 - DNA, 22 bp, Artificial Sequence
  chemically synthesized
aaccttcacatgaaccccatga

SEQ ID NO: 968664 - DNA, 22 bp, Artificial Sequence
  chemically synthesized
accttcacatgaaccccatgag

SEQ ID NO: 968665 - DNA, 22 bp, Artificial Sequence
  chemically synthesized
cacatgaaccccatgagataga

SEQ ID NO: 968666 - DNA, 22 bp, Artificial Sequence
  chemically synthesized
acatgaaccccatgagatagac

SEQ ID NO: 968667 - DNA, 22 bp, Artificial Sequence
  chemically synthesized
taaaatgggggaaaaccatgtc

SEQ ID NO: 968668 - DNA, 22 bp, Artificial Sequence
  chemically synthesized
gtcaactgtaaaatgggggaaa

SEQ ID NO: 968669 - DNA, 22 bp, Artificial Sequence
  chemically synthesized
cgtcaactgtaaaatgggggaa

SEQ ID NO: 968670 - DNA, 22 bp, Artificial Sequence
  chemically synthesized
tttcgtcaactgtaaaatgggg

SEQ ID NO: 968671 - DNA, 22 bp, Artificial Sequence
  chemically synthesized
tatttcgtcaactgtaaaatgg

SEQ ID NO: 968672 - DNA, 22 bp, Artificial Sequence
  chemically synthesized
ctatttcgtcaactgtaaaatg

SEQ ID NO: 968673 - DNA, 22 bp, Artificial Sequence
  chemically synthesized
ttctatttcgtcaactgtaaaa

SEQ ID NO: 968674 - DNA, 22 bp, Artificial Sequence
  chemically synthesized
tcccccattttacagttgacga

SEQ ID NO: 968675 - DNA, 22 bp, Artificial Sequence
  chemically synthesized
cccccattttacagttgacgaa

SEQ ID NO: 968676 - DNA, 22 bp, Artificial Sequence
  chemically synthesized
ccccattttacagttgacgaaa

SEQ ID NO: 968677 - DNA, 22 bp, Artificial Sequence
  chemically synthesized
aaatctcttctatttcgtcaac

SEQ ID NO: 968678 - DNA, 22 bp, Artificial Sequence
  chemically synthesized
tacagttgacgaaatagaagag

SEQ ID NO: 968679 - DNA, 22 bp, Artificial Sequence
  chemically synthesized
acagttgacgaaatagaagaga

SEQ ID NO: 968680 - DNA, 22 bp, Artificial Sequence
  chemically synthesized
cagttgacgaaatagaagagat

SEQ ID NO: 968681 - DNA, 22 bp, Artificial Sequence
  chemically synthesized
gaacaagtggctgaaatctctt

SEQ ID NO: 968682 - DNA, 22 bp, Artificial Sequence
  chemically synthesized
acgaaatagaagagatttcagc

SEQ ID NO: 968683 - DNA, 22 bp, Artificial Sequence
  chemically synthesized
aacaaatgacctcgaacaagtg

SEQ ID NO: 968684 - DNA, 22 bp, Artificial Sequence
  chemically synthesized
gaacaaatgacctcgaacaagt

SEQ ID NO: 968685 - DNA, 22 bp, Artificial Sequence
  chemically synthesized
accttgaacaaatgacctcgaa

SEQ ID NO: 968686 - DNA, 22 bp, Artificial Sequence
  chemically synthesized
cagccacttgttcgaggtcatt

SEQ ID NO: 968687 - DNA, 22 bp, Artificial Sequence
  chemically synthesized
agccacttgttcgaggtcattt

SEQ ID NO: 968688 - DNA, 22 bp, Artificial Sequence
  chemically synthesized
tctgaccttgaacaaatgacct

SEQ ID NO: 968689 - DNA, 22 bp, Artificial Sequence
  chemically synthesized
gttcgaggtcatttgttcaagg

SEQ ID NO: 968690 - DNA, 22 bp, Artificial Sequence
  chemically synthesized
ttcgaggtcatttgttcaaggt

SEQ ID NO: 968691 - DNA, 22 bp, Artificial Sequence
  chemically synthesized
gaggtcatttgttcaaggtcag

SEQ ID NO: 968692 - DNA, 22 bp, Artificial Sequence
  chemically synthesized
caccgtggaacctgtctgacct

SEQ ID NO: 968693 - DNA, 22 bp, Artificial Sequence
  chemically synthesized
gttcaaggtcagacaggttcca

SEQ ID NO: 968694 - DNA, 22 bp, Artificial Sequence
  chemically synthesized
caggttccaccgtggaacctgt

SEQ ID NO: 968695 - DNA, 22 bp, Artificial Sequence
  chemically synthesized
ttcaaggtcagacaggttccac

SEQ ID NO: 968696 - DNA, 22 bp, Artificial Sequence
  chemically synthesized
ccaggttccaccgtggaacctg

SEQ ID NO: 968697 - DNA, 22 bp, Artificial Sequence
  chemically synthesized
tccaggttccaccgtggaacct

SEQ ID NO: 968698 - DNA, 22 bp, Artificial Sequence
  chemically synthesized
aaggtcagacaggttccacggt

SEQ ID NO: 968699 - DNA, 22 bp, Artificial Sequence
  chemically synthesized
ctttccaggttccaccgtggaa

SEQ ID NO: 968700 - DNA, 22 bp, Artificial Sequence
  chemically synthesized
agattactttccaggttccacc

SEQ ID NO: 968701 - DNA, 22 bp, Artificial Sequence
  chemically synthesized
tctgagattactttccaggttc

SEQ ID NO: 968702 - DNA, 22 bp, Artificial Sequence
  chemically synthesized
cacggtggaacctggaaagtaa

SEQ ID NO: 968703 - DNA, 22 bp, Artificial Sequence
  chemically synthesized
agaaactatctgagattacttt

SEQ ID NO: 968704 - DNA, 22 bp, Artificial Sequence
  chemically synthesized
gagaaactatctgagattactt

SEQ ID NO: 968705 - DNA, 22 bp, Artificial Sequence
  chemically synthesized
aatttgagaaactatctgagat

SEQ ID NO: 968706 - DNA, 22 bp, Artificial Sequence
  chemically synthesized
caatttgagaaactatctgaga

SEQ ID NO: 968707 - DNA, 22 bp, Artificial Sequence
  chemically synthesized
gaaagtaatctcagatagtttc

SEQ ID NO: 968708 - DNA, 22 bp, Artificial Sequence
  chemically synthesized
agagcttcaatttgagaaacta

SEQ ID NO: 968709 - DNA, 22 bp, Artificial Sequence
  chemically synthesized
gttgagagcttcaatttgagaa

SEQ ID NO: 968710 - DNA, 22 bp, Artificial Sequence
  chemically synthesized
ctggttgagagcttcaatttga

SEQ ID NO: 968711 - DNA, 22 bp, Artificial Sequence
  chemically synthesized
agatagtttctcaaattgaagc

SEQ ID NO: 968712 - DNA, 22 bp, Artificial Sequence
  chemically synthesized
ctcaaattgaagctctcaacca

SEQ ID NO: 968713 - DNA, 22 bp, Artificial Sequence
  chemically synthesized
tcaaattgaagctctcaaccag

SEQ ID NO: 968714 - DNA, 22 bp, Artificial Sequence
  chemically synthesized
aaattgaagctctcaaccagga

SEQ ID NO: 968715 - DNA, 22 bp, Artificial Sequence
  chemically synthesized
gaggtaaaaagagttcctggtt

SEQ ID NO: 968716 - DNA, 22 bp, Artificial Sequence
  chemically synthesized
aagctctcaaccaggaactctt

SEQ ID NO: 968717 - DNA, 22 bp, Artificial Sequence
  chemically synthesized
tcaaccaggaactctttttacc

SEQ ID NO: 968718 - DNA, 22 bp, Artificial Sequence
  chemically synthesized
aatatatgctggaggtaaaaag

SEQ ID NO: 968719 - DNA, 22 bp, Artificial Sequence
  chemically synthesized
aaccaggaactctttttacctc

SEQ ID NO: 968720 - DNA, 22 bp, Artificial Sequence
  chemically synthesized
tgccatgtctgaatatatgctg

SEQ ID NO: 968721 - DNA, 22 bp, Artificial Sequence
  chemically synthesized
atgccatgtctgaatatatgct

SEQ ID NO: 968722 - DNA, 22 bp, Artificial Sequence
  chemically synthesized
tttttacctccagcatatattc

SEQ ID NO: 968723 - DNA, 22 bp, Artificial Sequence
  chemically synthesized
tttacctccagcatatattcag

SEQ ID NO: 968724 - DNA, 22 bp, Artificial Sequence
  chemically synthesized
cttatgccatgtctgaatatat

SEQ ID NO: 968725 - DNA, 22 bp, Artificial Sequence
  chemically synthesized
ttacctccagcatatattcaga

SEQ ID NO: 968726 - DNA, 22 bp, Artificial Sequence
  chemically synthesized
tacctccagcatatattcagac

SEQ ID NO: 968727 - DNA, 22 bp, Artificial Sequence
  chemically synthesized
tgcttatgccatgtctgaatat

SEQ ID NO: 968728 - DNA, 22 bp, Artificial Sequence
  chemically synthesized
acctccagcatatattcagaca

SEQ ID NO: 968729 - DNA, 22 bp, Artificial Sequence
  chemically synthesized
cctccagcatatattcagacat

SEQ ID NO: 968730 - DNA, 22 bp, Artificial Sequence
  chemically synthesized
tcctctgcttatgccatgtctg

SEQ ID NO: 968731 - DNA, 22 bp, Artificial Sequence
  chemically synthesized
cagcatatattcagacatggca

SEQ ID NO: 968732 - DNA, 22 bp, Artificial Sequence
  chemically synthesized
tgtcctctgcttatgccatgtc

SEQ ID NO: 968733 - DNA, 22 bp, Artificial Sequence
  chemically synthesized
agacatggcataagcagaggac

SEQ ID NO: 968734 - DNA, 22 bp, Artificial Sequence
  chemically synthesized
atagaacagcctctgtcctctg

SEQ ID NO: 968735 - DNA, 22 bp, Artificial Sequence
  chemically synthesized
catagaacagcctctgtcctct

SEQ ID NO: 968736 - DNA, 22 bp, Artificial Sequence
  chemically synthesized
gtcatcgcttcatagaacagcc

SEQ ID NO: 968737 - DNA, 22 bp, Artificial Sequence
  chemically synthesized
agtcatcgcttcatagaacagc

SEQ ID NO: 968738 - DNA, 22 bp, Artificial Sequence
  chemically synthesized
tagtcatcgcttcatagaacag

SEQ ID NO: 968739 - DNA, 22 bp, Artificial Sequence
  chemically synthesized
ttagtcatcgcttcatagaaca

SEQ ID NO: 968740 - DNA, 22 bp, Artificial Sequence
  chemically synthesized
tttagtcatcgcttcatagaac

SEQ ID NO: 968741 - DNA, 22 bp, Artificial Sequence
  chemically synthesized
ttttagtcatcgcttcatagaa

SEQ ID NO: 968742 - DNA, 22 bp, Artificial Sequence
  chemically synthesized
tttttagtcatcgcttcataga

SEQ ID NO: 968743 - DNA, 22 bp, Artificial Sequence
  chemically synthesized
ttttttagtcatcgcttcatag

SEQ ID NO: 968744 - DNA, 22 bp, Artificial Sequence
  chemically synthesized
tttttttagtcatcgcttcata

SEQ ID NO: 968745 - DNA, 22 bp, Artificial Sequence
  chemically synthesized
ttttttttagtcatcgcttcat

SEQ ID NO: 968746 - DNA, 22 bp, Artificial Sequence
  chemically synthesized
tttttttttagtcatcgcttca

SEQ ID NO: 968747 - DNA, 22 bp, Artificial Sequence
  chemically synthesized
ttttttttttagtcatcgcttc

SEQ ID NO: 968748 - DNA, 22 bp, Artificial Sequence
  chemically synthesized
tttttttttttagtcatcgctt

SEQ ID NO: 968749 - DNA, 22 bp, Artificial Sequence
  chemically synthesized
ttttttttttttagtcatcgct

SEQ ID NO: 968750 - DNA, 22 bp, Artificial Sequence
  chemically synthesized
tttttttttttttagtcatcgc

SEQ ID NO: 968751 - DNA, 22 bp, Artificial Sequence
  chemically synthesized
ttttttttttttttagtcatcg

SEQ ID NO: 968752 - DNA, 22 bp, Artificial Sequence
  chemically synthesized
ttctatgaagcgatgactaaaa

SEQ ID NO: 968753 - DNA, 22 bp, Artificial Sequence
  chemically synthesized
tatgaagcgatgactaaaaaaa

SEQ ID NO: 968754 - DNA, 22 bp, Artificial Sequence
  chemically synthesized
tacttttttttttttttttagt

SEQ ID NO: 968755 - DNA, 22 bp, Artificial Sequence
  chemically synthesized
gtacttttttttttttttttag

SEQ ID NO: 968756 - DNA, 22 bp, Artificial Sequence
  chemically synthesized
tgaagcgatgactaaaaaaaaa

SEQ ID NO: 968757 - DNA, 22 bp, Artificial Sequence
  chemically synthesized
aaaaaaaaaaaaaaagtacaaa

SEQ ID NO: 968758 - DNA, 22 bp, Artificial Sequence
  chemically synthesized
tgatggcaaaaataaatatttg

SEQ ID NO: 968759 - DNA, 22 bp, Artificial Sequence
  chemically synthesized
atgatggcaaaaataaatattt

SEQ ID NO: 968760 - DNA, 22 bp, Artificial Sequence
  chemically synthesized
gcttatgatggcaaaaataaat

SEQ ID NO: 968761 - DNA, 22 bp, Artificial Sequence
  chemically synthesized
agcttatgatggcaaaaataaa

SEQ ID NO: 968762 - DNA, 22 bp, Artificial Sequence
  chemically synthesized
tttagcttatgatggcaaaaat

SEQ ID NO: 968763 - DNA, 22 bp, Artificial Sequence
  chemically synthesized
atttagcttatgatggcaaaaa

SEQ ID NO: 968764 - DNA, 22 bp, Artificial Sequence
  chemically synthesized
atttttgccatcataagctaaa

SEQ ID NO: 968765 - DNA, 22 bp, Artificial Sequence
  chemically synthesized
tttttgccatcataagctaaat

SEQ ID NO: 968766 - DNA, 22 bp, Artificial Sequence
  chemically synthesized
ggaaagcccacttatttagctt

SEQ ID NO: 968767 - DNA, 22 bp, Artificial Sequence
  chemically synthesized
aggaaagcccacttatttagct

SEQ ID NO: 968768 - DNA, 22 bp, Artificial Sequence
  chemically synthesized
ttgccatcataagctaaataag

SEQ ID NO: 968769 - DNA, 22 bp, Artificial Sequence
  chemically synthesized
tgccatcataagctaaataagt

SEQ ID NO: 968770 - DNA, 22 bp, Artificial Sequence
  chemically synthesized
gccatcataagctaaataagtg

SEQ ID NO: 968771 - DNA, 22 bp, Artificial Sequence
  chemically synthesized
cttaggaaagcccacttattta

SEQ ID NO: 968772 - DNA, 22 bp, Artificial Sequence
  chemically synthesized
ccatcataagctaaataagtgg

SEQ ID NO: 968773 - DNA, 22 bp, Artificial Sequence
  chemically synthesized
cgaaactacttaggaaagccca

SEQ ID NO: 968774 - DNA, 22 bp, Artificial Sequence
  chemically synthesized
ttacgaaactacttaggaaagc

SEQ ID NO: 968775 - DNA, 22 bp, Artificial Sequence
  chemically synthesized
aataagtgggctttcctaagta

SEQ ID NO: 968776 - DNA, 22 bp, Artificial Sequence
  chemically synthesized
ctattacgaaactacttaggaa

SEQ ID NO: 968777 - DNA, 22 bp, Artificial Sequence
  chemically synthesized
tcctattacgaaactacttagg

SEQ ID NO: 968778 - DNA, 22 bp, Artificial Sequence
  chemically synthesized
ctcctattacgaaactacttag

SEQ ID NO: 968779 - DNA, 22 bp, Artificial Sequence
  chemically synthesized
tctcctattacgaaactactta

SEQ ID NO: 968780 - DNA, 22 bp, Artificial Sequence
  chemically synthesized
ttctcctattacgaaactactt

SEQ ID NO: 968781 - DNA, 22 bp, Artificial Sequence
  chemically synthesized
tcctaagtagtttcgtaatagg

SEQ ID NO: 968782 - DNA, 22 bp, Artificial Sequence
  chemically synthesized
atcagcttttctcctattacga

SEQ ID NO: 968783 - DNA, 22 bp, Artificial Sequence
  chemically synthesized
cctaagtagtttcgtaatagga

SEQ ID NO: 968784 - DNA, 22 bp, Artificial Sequence
  chemically synthesized
ctaagtagtttcgtaataggag

SEQ ID NO: 968785 - DNA, 22 bp, Artificial Sequence
  chemically synthesized
ttcatcagcttttctcctatta

SEQ ID NO: 968786 - DNA, 22 bp, Artificial Sequence
  chemically synthesized
agtagtttcgtaataggagaaa

SEQ ID NO: 968787 - DNA, 22 bp, Artificial Sequence
  chemically synthesized
attattcatcagcttttctcct

SEQ ID NO: 968788 - DNA, 22 bp, Artificial Sequence
  chemically synthesized
tctcattattcatcagcttttc

SEQ ID NO: 968789 - DNA, 22 bp, Artificial Sequence
  chemically synthesized
cgtaataggagaaaagctgatg

SEQ ID NO: 968790 - DNA, 22 bp, Artificial Sequence
  chemically synthesized
tatctcattattcatcagcttt

SEQ ID NO: 968791 - DNA, 22 bp, Artificial Sequence
  chemically synthesized
gtaataggagaaaagctgatga

SEQ ID NO: 968792 - DNA, 22 bp, Artificial Sequence
  chemically synthesized
ctatctcattattcatcagctt

SEQ ID NO: 968793 - DNA, 22 bp, Artificial Sequence
  chemically synthesized
aacaccaacccttctatctcat

SEQ ID NO: 968794 - DNA, 22 bp, Artificial Sequence
  chemically synthesized
cctcaacaccaacccttctatc

SEQ ID NO: 968795 - DNA, 22 bp, Artificial Sequence
  chemically synthesized
atgaataatgagatagaagggt

SEQ ID NO: 968796 - DNA, 22 bp, Artificial Sequence
  chemically synthesized
tgcctcaacaccaacccttcta

SEQ ID NO: 968797 - DNA, 22 bp, Artificial Sequence
  chemically synthesized
caaagcccctctgcctcaacac

SEQ ID NO: 968798 - DNA, 22 bp, Artificial Sequence
  chemically synthesized
gtctccaaagcccctctgcctc

SEQ ID NO: 968799 - DNA, 22 bp, Artificial Sequence
  chemically synthesized
agtctccaaagcccctctgcct

SEQ ID NO: 968800 - DNA, 22 bp, Artificial Sequence
  chemically synthesized
tagtctccaaagcccctctgcc

SEQ ID NO: 968801 - DNA, 22 bp, Artificial Sequence
  chemically synthesized
ctttagtctccaaagcccctct

SEQ ID NO: 968802 - DNA, 22 bp, Artificial Sequence
  chemically synthesized
gctttagtctccaaagcccctc

SEQ ID NO: 968803 - DNA, 22 bp, Artificial Sequence
  chemically synthesized
gtgttgaggcagaggggctttg

SEQ ID NO: 968804 - DNA, 22 bp, Artificial Sequence
  chemically synthesized
aggcagaggggctttggagact

SEQ ID NO: 968805 - DNA, 22 bp, Artificial Sequence
  chemically synthesized
aatatttgctttagtctccaaa

SEQ ID NO: 968806 - DNA, 22 bp, Artificial Sequence
  chemically synthesized
aaatatttgctttagtctccaa

SEQ ID NO: 968807 - DNA, 22 bp, Artificial Sequence
  chemically synthesized
atttaaatatttgctttagtct

SEQ ID NO: 968808 - DNA, 22 bp, Artificial Sequence
  chemically synthesized
catttaaatatttgctttagtc

SEQ ID NO: 968809 - DNA, 22 bp, Artificial Sequence
  chemically synthesized
tcatttaaatatttgctttagt

SEQ ID NO: 968810 - DNA, 22 bp, Artificial Sequence
  chemically synthesized
ttttcatttaaatatttgcttt

SEQ ID NO: 968811 - DNA, 22 bp, Artificial Sequence
  chemically synthesized
tggagactaaagcaaatattta

SEQ ID NO: 968812 - DNA, 22 bp, Artificial Sequence
  chemically synthesized
ggagactaaagcaaatatttaa

SEQ ID NO: 968813 - DNA, 22 bp, Artificial Sequence
  chemically synthesized
gagactaaagcaaatatttaaa

SEQ ID NO: 968814 - DNA, 22 bp, Artificial Sequence
  chemically synthesized
agagctattttcatttaaatat

SEQ ID NO: 968815 - DNA, 22 bp, Artificial Sequence
  chemically synthesized
cagagctattttcatttaaata

SEQ ID NO: 968816 - DNA, 22 bp, Artificial Sequence
  chemically synthesized
aagcaaatatttaaatgaaaat

SEQ ID NO: 968817 - DNA, 22 bp, Artificial Sequence
  chemically synthesized
aaatgaaaatagctctgaagtg

SEQ ID NO: 968818 - DNA, 22 bp, Artificial Sequence
  chemically synthesized
aatgaaaatagctctgaagtgt

SEQ ID NO: 968819 - DNA, 22 bp, Artificial Sequence
  chemically synthesized
tgaagtgtgtgtgtgtgtgtgt

SEQ ID NO: 968820 - DNA, 22 bp, Artificial Sequence
  chemically synthesized
aagtgtgtgtgtgtgtgtgtgt

SEQ ID NO: 968821 - DNA, 22 bp, Artificial Sequence
  chemically synthesized
acacacacacacacacacacac

SEQ ID NO: 968822 - DNA, 22 bp, Artificial Sequence
  chemically synthesized
cacacacacacacacacacaca

SEQ ID NO: 968823 - DNA, 22 bp, Artificial Sequence
  chemically synthesized
tcacacacacacacacacacac

SEQ ID NO: 968824 - DNA, 22 bp, Artificial Sequence
  chemically synthesized
ttttcacacacacacacacaca

SEQ ID NO: 968825 - DNA, 22 bp, Artificial Sequence
  chemically synthesized
tgttttcacacacacacacaca

SEQ ID NO: 968826 - DNA, 22 bp, Artificial Sequence
  chemically synthesized
ctgttttcacacacacacacac

SEQ ID NO: 968827 - DNA, 22 bp, Artificial Sequence
  chemically synthesized
tggaacttctgttttcacacac

SEQ ID NO: 968828 - DNA, 22 bp, Artificial Sequence
  chemically synthesized
attatggaacttctgttttcac

SEQ ID NO: 968829 - DNA, 22 bp, Artificial Sequence
  chemically synthesized
ttaattatggaacttctgtttt

SEQ ID NO: 968830 - DNA, 22 bp, Artificial Sequence
  chemically synthesized
gcacatagtagattattaatta

SEQ ID NO: 968831 - DNA, 22 bp, Artificial Sequence
  chemically synthesized
ggcacatagtagattattaatt

SEQ ID NO: 968832 - DNA, 22 bp, Artificial Sequence
  chemically synthesized
cataattaataatctactatgt

SEQ ID NO: 968833 - DNA, 22 bp, Artificial Sequence
  chemically synthesized
tgcatggcagtatttggcacat

SEQ ID NO: 968834 - DNA, 22 bp, Artificial Sequence
  chemically synthesized
ataatctactatgtgccaaata

SEQ ID NO: 968835 - DNA, 22 bp, Artificial Sequence
  chemically synthesized
tagtgattgtgcatggcagtat

SEQ ID NO: 968836 - DNA, 22 bp, Artificial Sequence
  chemically synthesized
ctatgtgccaaatactgccatg

SEQ ID NO: 968837 - DNA, 22 bp, Artificial Sequence
  chemically synthesized
gtagtgattgtgcatggcagta

SEQ ID NO: 968838 - DNA, 22 bp, Artificial Sequence
  chemically synthesized
tgtagtgattgtgcatggcagt

SEQ ID NO: 968839 - DNA, 22 bp, Artificial Sequence
  chemically synthesized
ttgtagtgattgtgcatggcag

SEQ ID NO: 968840 - DNA, 22 bp, Artificial Sequence
  chemically synthesized
tgtgccaaatactgccatgcac

SEQ ID NO: 968841 - DNA, 22 bp, Artificial Sequence
  chemically synthesized
acttttgtagtgattgtgcatg

SEQ ID NO: 968842 - DNA, 22 bp, Artificial Sequence
  chemically synthesized
ccatgcacaatcactacaaaag

SEQ ID NO: 968843 - DNA, 22 bp, Artificial Sequence
  chemically synthesized
caaaagtgaatggccttgatcc

SEQ ID NO: 968844 - DNA, 22 bp, Artificial Sequence
  chemically synthesized
tagtaaaaggaaaggatcaagg

SEQ ID NO: 968845 - DNA, 22 bp, Artificial Sequence
  chemically synthesized
tgtagtaaaaggaaaggatcaa

SEQ ID NO: 968846 - DNA, 22 bp, Artificial Sequence
  chemically synthesized
tctgtagtaaaaggaaaggatc

SEQ ID NO: 968847 - DNA, 22 bp, Artificial Sequence
  chemically synthesized
gatcctttccttttactacaga

SEQ ID NO: 968848 - DNA, 22 bp, Artificial Sequence
  chemically synthesized
tatgtgtcattctctgtagtaa

SEQ ID NO: 968849 - DNA, 22 bp, Artificial Sequence
  chemically synthesized
atcctttccttttactacagag

SEQ ID NO: 968850 - DNA, 22 bp, Artificial Sequence
  chemically synthesized
atatgtgtcattctctgtagta

SEQ ID NO: 968851 - DNA, 22 bp, Artificial Sequence
  chemically synthesized
tttatatgtgtcattctctgta

SEQ ID NO: 968852 - DNA, 22 bp, Artificial Sequence
  chemically synthesized
atttatatgtgtcattctctgt

SEQ ID NO: 968853 - DNA, 22 bp, Artificial Sequence
  chemically synthesized
tccttttactacagagaatgac

SEQ ID NO: 968854 - DNA, 22 bp, Artificial Sequence
  chemically synthesized
ccttttactacagagaatgaca

SEQ ID NO: 968855 - DNA, 22 bp, Artificial Sequence
  chemically synthesized
cttttactacagagaatgacac

SEQ ID NO: 968856 - DNA, 22 bp, Artificial Sequence
  chemically synthesized
ttactacagagaatgacacata

SEQ ID NO: 968857 - DNA, 22 bp, Artificial Sequence
  chemically synthesized
tactacagagaatgacacatat

SEQ ID NO: 968858 - DNA, 22 bp, Artificial Sequence
  chemically synthesized
actacagagaatgacacatata

SEQ ID NO: 968859 - DNA, 22 bp, Artificial Sequence
  chemically synthesized
acatggtttatttatatgtgtc

SEQ ID NO: 968860 - DNA, 22 bp, Artificial Sequence
  chemically synthesized
ctacagagaatgacacatataa

SEQ ID NO: 968861 - DNA, 22 bp, Artificial Sequence
  chemically synthesized
cagagaatgacacatataaata

SEQ ID NO: 968862 - DNA, 22 bp, Artificial Sequence
  chemically synthesized
tcgtagcagattgacatggttt

SEQ ID NO: 968863 - DNA, 22 bp, Artificial Sequence
  chemically synthesized
gtcgtagcagattgacatggtt

SEQ ID NO: 968864 - DNA, 22 bp, Artificial Sequence
  chemically synthesized
gcgcttgtcgtagcagattgac

SEQ ID NO: 968865 - DNA, 22 bp, Artificial Sequence
  chemically synthesized
agcgcttgtcgtagcagattga

SEQ ID NO: 968866 - DNA, 22 bp, Artificial Sequence
  chemically synthesized
aatcttagcgcttgtcgtagca

SEQ ID NO: 968867 - DNA, 22 bp, Artificial Sequence
  chemically synthesized
caatcttagcgcttgtcgtagc

SEQ ID NO: 968868 - DNA, 22 bp, Artificial Sequence
  chemically synthesized
aatgaacttcaatcttagcgct

SEQ ID NO: 968869 - DNA, 22 bp, Artificial Sequence
  chemically synthesized
ctacgacaagcgctaagattga

SEQ ID NO: 968870 - DNA, 22 bp, Artificial Sequence
  chemically synthesized
cgacaagcgctaagattgaagt

SEQ ID NO: 968871 - DNA, 22 bp, Artificial Sequence
  chemically synthesized
aacactcaatgaacttcaatct

SEQ ID NO: 968872 - DNA, 22 bp, Artificial Sequence
  chemically synthesized
ggactgaacactcaatgaactt

SEQ ID NO: 968873 - DNA, 22 bp, Artificial Sequence
  chemically synthesized
agattgaagttcattgagtgtt

SEQ ID NO: 968874 - DNA, 22 bp, Artificial Sequence
  chemically synthesized
gggctcggactgaacactcaat

SEQ ID NO: 968875 - DNA, 22 bp, Artificial Sequence
  chemically synthesized
agggctcggactgaacactcaa

SEQ ID NO: 968876 - DNA, 22 bp, Artificial Sequence
  chemically synthesized
tagggctcggactgaacactca

SEQ ID NO: 968877 - DNA, 22 bp, Artificial Sequence
  chemically synthesized
ttagggctcggactgaacactc

SEQ ID NO: 968878 - DNA, 22 bp, Artificial Sequence
  chemically synthesized
ttttagggctcggactgaacac

SEQ ID NO: 968879 - DNA, 22 bp, Artificial Sequence
  chemically synthesized
aagttcattgagtgttcagtcc

SEQ ID NO: 968880 - DNA, 22 bp, Artificial Sequence
  chemically synthesized
cttttagggctcggactgaaca

SEQ ID NO: 968881 - DNA, 22 bp, Artificial Sequence
  chemically synthesized
attgagtgttcagtccgagccc

SEQ ID NO: 968882 - DNA, 22 bp, Artificial Sequence
  chemically synthesized
agtgttcagtccgagccctaaa

SEQ ID NO: 968883 - DNA, 22 bp, Artificial Sequence
  chemically synthesized
agtccgagccctaaaagaaact

SEQ ID NO: 968884 - DNA, 22 bp, Artificial Sequence
  chemically synthesized
catacatgtggcaatcagtagt

SEQ ID NO: 968885 - DNA, 22 bp, Artificial Sequence
  chemically synthesized
acatacatgtggcaatcagtag

SEQ ID NO: 968886 - DNA, 22 bp, Artificial Sequence
  chemically synthesized
tacatacatgtggcaatcagta

SEQ ID NO: 968887 - DNA, 22 bp, Artificial Sequence
  chemically synthesized
aaagaaactactgattgccaca

SEQ ID NO: 968888 - DNA, 22 bp, Artificial Sequence
  chemically synthesized
cctttacatacatgtggcaatc

SEQ ID NO: 968889 - DNA, 22 bp, Artificial Sequence
  chemically synthesized
gcctttacatacatgtggcaat

SEQ ID NO: 968890 - DNA, 22 bp, Artificial Sequence
  chemically synthesized
cttgcctttacatacatgtggc

SEQ ID NO: 968891 - DNA, 22 bp, Artificial Sequence
  chemically synthesized
gcttgcctttacatacatgtgg

SEQ ID NO: 968892 - DNA, 22 bp, Artificial Sequence
  chemically synthesized
tcttgcttgcctttacatacat

SEQ ID NO: 968893 - DNA, 22 bp, Artificial Sequence
  chemically synthesized
ctgattgccacatgtatgtaaa

SEQ ID NO: 968894 - DNA, 22 bp, Artificial Sequence
  chemically synthesized
gtcttgcttgcctttacataca

SEQ ID NO: 968895 - DNA, 22 bp, Artificial Sequence
  chemically synthesized
attgccacatgtatgtaaaggc

SEQ ID NO: 968896 - DNA, 22 bp, Artificial Sequence
  chemically synthesized
ccacatgtatgtaaaggcaagc

SEQ ID NO: 968897 - DNA, 22 bp, Artificial Sequence
  chemically synthesized
atccaggaaaccttgtcttgct

SEQ ID NO: 968898 - DNA, 22 bp, Artificial Sequence
  chemically synthesized
atctcatccaggaaaccttgtc

SEQ ID NO: 968899 - DNA, 22 bp, Artificial Sequence
  chemically synthesized
ggcctcatctcatccaggaaac

SEQ ID NO: 968900 - DNA, 22 bp, Artificial Sequence
  chemically synthesized
agcctaggcctcatctcatcca

SEQ ID NO: 968901 - DNA, 22 bp, Artificial Sequence
  chemically synthesized
cagcctaggcctcatctcatcc

SEQ ID NO: 968902 - DNA, 22 bp, Artificial Sequence
  chemically synthesized
atgtttcagcctaggcctcatc

SEQ ID NO: 968903 - DNA, 22 bp, Artificial Sequence
  chemically synthesized
cctggatgagatgaggcctagg

SEQ ID NO: 968904 - DNA, 22 bp, Artificial Sequence
  chemically synthesized
ctggatgagatgaggcctaggc

SEQ ID NO: 968905 - DNA, 22 bp, Artificial Sequence
  chemically synthesized
agttcatgtttcagcctaggcc

SEQ ID NO: 968906 - DNA, 22 bp, Artificial Sequence
  chemically synthesized
cagttcatgtttcagcctaggc

SEQ ID NO: 968907 - DNA, 22 bp, Artificial Sequence
  chemically synthesized
gatgagatgaggcctaggctga

SEQ ID NO: 968908 - DNA, 22 bp, Artificial Sequence
  chemically synthesized
tcagttcatgtttcagcctagg

SEQ ID NO: 968909 - DNA, 22 bp, Artificial Sequence
  chemically synthesized
ttcagttcatgtttcagcctag

SEQ ID NO: 968910 - DNA, 22 bp, Artificial Sequence
  chemically synthesized
ggctgaaacatgaactgaaaaa

SEQ ID NO: 968911 - DNA, 22 bp, Artificial Sequence
  chemically synthesized
cagaaaaacacatttttcagtt

SEQ ID NO: 968912 - DNA, 22 bp, Artificial Sequence
  chemically synthesized
aaacatgaactgaaaaatgtgt

SEQ ID NO: 968913 - DNA, 22 bp, Artificial Sequence
  chemically synthesized
aatggatctccagaaaaacaca

SEQ ID NO: 968914 - DNA, 22 bp, Artificial Sequence
  chemically synthesized
aaaaatgtgtttttctggagat

SEQ ID NO: 968915 - DNA, 22 bp, Artificial Sequence
  chemically synthesized
aatatagcgtattgaatggatc

SEQ ID NO: 968916 - DNA, 22 bp, Artificial Sequence
  chemically synthesized
ttctggagatccattcaatacg

SEQ ID NO: 968917 - DNA, 22 bp, Artificial Sequence
  chemically synthesized
tctggagatccattcaatacgc

SEQ ID NO: 968918 - DNA, 22 bp, Artificial Sequence
  chemically synthesized
ctggagatccattcaatacgct

SEQ ID NO: 968919 - DNA, 22 bp, Artificial Sequence
  chemically synthesized
tggagatccattcaatacgcta

SEQ ID NO: 968920 - DNA, 22 bp, Artificial Sequence
  chemically synthesized
gagatccattcaatacgctata

SEQ ID NO: 968921 - DNA, 22 bp, Artificial Sequence
  chemically synthesized
agcaaagggatacctaaatata

SEQ ID NO: 968922 - DNA, 22 bp, Artificial Sequence
  chemically synthesized
aagcaaagggatacctaaatat

SEQ ID NO: 968923 - DNA, 22 bp, Artificial Sequence
  chemically synthesized
taagcaaagggatacctaaata

SEQ ID NO: 968924 - DNA, 22 bp, Artificial Sequence
  chemically synthesized
aatacgctatatttaggtatcc

SEQ ID NO: 968925 - DNA, 22 bp, Artificial Sequence
  chemically synthesized
tctttaagcaaagggataccta

SEQ ID NO: 968926 - DNA, 22 bp, Artificial Sequence
  chemically synthesized
gtctttaagcaaagggatacct

SEQ ID NO: 968927 - DNA, 22 bp, Artificial Sequence
  chemically synthesized
tgtctttaagcaaagggatacc

SEQ ID NO: 968928 - DNA, 22 bp, Artificial Sequence
  chemically synthesized
tatttaggtatccctttgctta

SEQ ID NO: 968929 - DNA, 22 bp, Artificial Sequence
  chemically synthesized
aggtatccctttgcttaaagac

SEQ ID NO: 968930 - DNA, 22 bp, Artificial Sequence
  chemically synthesized
ggtatccctttgcttaaagaca

SEQ ID NO: 968931 - DNA, 22 bp, Artificial Sequence
  chemically synthesized
caataacaaatactttgtcttt

SEQ ID NO: 968932 - DNA, 22 bp, Artificial Sequence
  chemically synthesized
tgcttaaagacaaagtatttgt

SEQ ID NO: 968933 - DNA, 22 bp, Artificial Sequence
  chemically synthesized
gcttaaagacaaagtatttgtt

SEQ ID NO: 968934 - DNA, 22 bp, Artificial Sequence
  chemically synthesized
cttaaagacaaagtatttgtta

SEQ ID NO: 968935 - DNA, 22 bp, Artificial Sequence
  chemically synthesized
cacatcaattccaataacaaat

SEQ ID NO: 968936 - DNA, 22 bp, Artificial Sequence
  chemically synthesized
aaagacaaagtatttgttattg

SEQ ID NO: 968937 - DNA, 22 bp, Artificial Sequence
  chemically synthesized
aagacaaagtatttgttattgg

SEQ ID NO: 968938 - DNA, 22 bp, Artificial Sequence
  chemically synthesized
ctacacatcaattccaataaca

SEQ ID NO: 968939 - DNA, 22 bp, Artificial Sequence
  chemically synthesized
actacacatcaattccaataac

SEQ ID NO: 968940 - DNA, 22 bp, Artificial Sequence
  chemically synthesized
tactacacatcaattccaataa

SEQ ID NO: 968941 - DNA, 22 bp, Artificial Sequence
  chemically synthesized
gttattggaattgatgtgtagt

SEQ ID NO: 968942 - DNA, 22 bp, Artificial Sequence
  chemically synthesized
ttattggaattgatgtgtagta

SEQ ID NO: 968943 - DNA, 22 bp, Artificial Sequence
  chemically synthesized
ttggaattgatgtgtagtaaaa

SEQ ID NO: 968944 - DNA, 22 bp, Artificial Sequence
  chemically synthesized
aaaaggagcggattttactaca

SEQ ID NO: 968945 - DNA, 22 bp, Artificial Sequence
  chemically synthesized
caaaaggagcggattttactac

SEQ ID NO: 968946 - DNA, 22 bp, Artificial Sequence
  chemically synthesized
gaattgatgtgtagtaaaatcc

SEQ ID NO: 968947 - DNA, 22 bp, Artificial Sequence
  chemically synthesized
cttcaaaaggagcggattttac

SEQ ID NO: 968948 - DNA, 22 bp, Artificial Sequence
  chemically synthesized
acttcaaaaggagcggatttta

SEQ ID NO: 968949 - DNA, 22 bp, Artificial Sequence
  chemically synthesized
tacttcaaaaggagcggatttt

SEQ ID NO: 968950 - DNA, 22 bp, Artificial Sequence
  chemically synthesized
atgtgtagtaaaatccgctcct

SEQ ID NO: 968951 - DNA, 22 bp, Artificial Sequence
  chemically synthesized
acagaactttacttcaaaagga

SEQ ID NO: 968952 - DNA, 22 bp, Artificial Sequence
  chemically synthesized
tcagaactcacagaactttact

SEQ ID NO: 968953 - DNA, 22 bp, Artificial Sequence
  chemically synthesized
gtcagaactcacagaactttac

SEQ ID NO: 968954 - DNA, 22 bp, Artificial Sequence
  chemically synthesized
cttttgaagtaaagttctgtga

SEQ ID NO: 968955 - DNA, 22 bp, Artificial Sequence
  chemically synthesized
ttgaagtaaagttctgtgagtt

SEQ ID NO: 968956 - DNA, 22 bp, Artificial Sequence
  chemically synthesized
agcccttgtcagaactcacaga

SEQ ID NO: 968957 - DNA, 22 bp, Artificial Sequence
  chemically synthesized
tgaagtaaagttctgtgagttc

SEQ ID NO: 968958 - DNA, 22 bp, Artificial Sequence
  chemically synthesized
gaagtaaagttctgtgagttct

SEQ ID NO: 968959 - DNA, 22 bp, Artificial Sequence
  chemically synthesized
aagtaaagttctgtgagttctg

SEQ ID NO: 968960 - DNA, 22 bp, Artificial Sequence
  chemically synthesized
cacgactaagcccttgtcagaa

SEQ ID NO: 968961 - DNA, 22 bp, Artificial Sequence
  chemically synthesized
tgtgagttctgacaagggctta

SEQ ID NO: 968962 - DNA, 22 bp, Artificial Sequence
  chemically synthesized
tgagttctgacaagggcttagt

SEQ ID NO: 968963 - DNA, 22 bp, Artificial Sequence
  chemically synthesized
cgatgatggctacacgactaag

SEQ ID NO: 968964 - DNA, 22 bp, Artificial Sequence
  chemically synthesized
tgacaagggcttagtcgtgtag

SEQ ID NO: 968965 - DNA, 22 bp, Artificial Sequence
  chemically synthesized
cctgcgatgatggctacacgac

SEQ ID NO: 968966 - DNA, 22 bp, Artificial Sequence
  chemically synthesized
acaagggcttagtcgtgtagcc

SEQ ID NO: 968967 - DNA, 22 bp, Artificial Sequence
  chemically synthesized
gcctgcgatgatggctacacga

SEQ ID NO: 968968 - DNA, 22 bp, Artificial Sequence
  chemically synthesized
tgtcttgcctgcgatgatggct

SEQ ID NO: 968969 - DNA, 22 bp, Artificial Sequence
  chemically synthesized
tgtgtcttgcctgcgatgatgg

SEQ ID NO: 968970 - DNA, 22 bp, Artificial Sequence
  chemically synthesized
agtcgtgtagccatcatcgcag

SEQ ID NO: 968971 - DNA, 22 bp, Artificial Sequence
  chemically synthesized
gtcgtgtagccatcatcgcagg

SEQ ID NO: 968972 - DNA, 22 bp, Artificial Sequence
  chemically synthesized
ttctgtgtcttgcctgcgatga

SEQ ID NO: 968973 - DNA, 22 bp, Artificial Sequence
  chemically synthesized
gggggtgatgaagctgttctgt

SEQ ID NO: 968974 - DNA, 22 bp, Artificial Sequence
  chemically synthesized
ggggggtgatgaagctgttctg

SEQ ID NO: 968975 - DNA, 22 bp, Artificial Sequence
  chemically synthesized
tggggggtgatgaagctgttct

SEQ ID NO: 968976 - DNA, 22 bp, Artificial Sequence
  chemically synthesized
catcaccccccaaaatgctctt

SEQ ID NO: 968977 - DNA, 22 bp, Artificial Sequence
  chemically synthesized
atcaccccccaaaatgctcttg

SEQ ID NO: 968978 - DNA, 22 bp, Artificial Sequence
  chemically synthesized
aggaggtgagatgggggtaagg

SEQ ID NO: 968979 - DNA, 22 bp, Artificial Sequence
  chemically synthesized
tgaggaggtgagatgggggtaa

SEQ ID NO: 968980 - DNA, 22 bp, Artificial Sequence
  chemically synthesized
ttgtgctgtccttacccccatc

SEQ ID NO: 968981 - DNA, 22 bp, Artificial Sequence
  chemically synthesized
ctgaggaggtgagatgggggta

SEQ ID NO: 968982 - DNA, 22 bp, Artificial Sequence
  chemically synthesized
gtgctgtccttacccccatctc

SEQ ID NO: 968983 - DNA, 22 bp, Artificial Sequence
  chemically synthesized
tgctgtccttacccccatctca

SEQ ID NO: 968984 - DNA, 22 bp, Artificial Sequence
  chemically synthesized
cttctgaggaggtgagatgggg

SEQ ID NO: 968985 - DNA, 22 bp, Artificial Sequence
  chemically synthesized
tccttacccccatctcacctcc

SEQ ID NO: 968986 - DNA, 22 bp, Artificial Sequence
  chemically synthesized
acccccatctcacctcctcaga

SEQ ID NO: 968987 - DNA, 22 bp, Artificial Sequence
  chemically synthesized
aaagagattgcttctgaggagg

SEQ ID NO: 968988 - DNA, 22 bp, Artificial Sequence
  chemically synthesized
cccccatctcacctcctcagaa

SEQ ID NO: 968989 - DNA, 22 bp, Artificial Sequence
  chemically synthesized
acctcctcagaagcaatctctt

SEQ ID NO: 968990 - DNA, 22 bp, Artificial Sequence
  chemically synthesized
ctcagaagcaatctcttttaac

SEQ ID NO: 968991 - DNA, 22 bp, Artificial Sequence
  chemically synthesized
agaagcaatctcttttaaccct

SEQ ID NO: 968992 - DNA, 22 bp, Artificial Sequence
  chemically synthesized
agtacaatacaccacagagtag

SEQ ID NO: 968993 - DNA, 22 bp, Artificial Sequence
  chemically synthesized
ttttaacccttctactctgtgg

SEQ ID NO: 968994 - DNA, 22 bp, Artificial Sequence
  chemically synthesized
cagtacaatacaccacagagta

SEQ ID NO: 968995 - DNA, 22 bp, Artificial Sequence
  chemically synthesized
tcagtacaatacaccacagagt

SEQ ID NO: 968996 - DNA, 22 bp, Artificial Sequence
  chemically synthesized
ttaacccttctactctgtggtg

SEQ ID NO: 968997 - DNA, 22 bp, Artificial Sequence
  chemically synthesized
taacccttctactctgtggtgt

SEQ ID NO: 968998 - DNA, 22 bp, Artificial Sequence
  chemically synthesized
aacccttctactctgtggtgta

SEQ ID NO: 968999 - DNA, 22 bp, Artificial Sequence
  chemically synthesized
ttttcagtacaatacaccacag

SEQ ID NO: 969000 - DNA, 22 bp, Artificial Sequence
  chemically synthesized
acccttctactctgtggtgtat

SEQ ID NO: 969001 - DNA, 22 bp, Artificial Sequence
  chemically synthesized
attttcagtacaatacaccaca

SEQ ID NO: 969002 - DNA, 22 bp, Artificial Sequence
  chemically synthesized
ctactctgtggtgtattgtact

SEQ ID NO: 969003 - DNA, 22 bp, Artificial Sequence
  chemically synthesized
tactctgtggtgtattgtactg

SEQ ID NO: 969004 - DNA, 22 bp, Artificial Sequence
  chemically synthesized
ctctgtggtgtattgtactgaa

SEQ ID NO: 969005 - DNA, 22 bp, Artificial Sequence
  chemically synthesized
tgtggtgtattgtactgaaaat

SEQ ID NO: 969006 - DNA, 22 bp, Artificial Sequence
  chemically synthesized
tggtgtattgtactgaaaataa

SEQ ID NO: 969007 - DNA, 22 bp, Artificial Sequence
  chemically synthesized
taaaataaacgtatcttatttt

SEQ ID NO: 969008 - DNA, 22 bp, Artificial Sequence
  chemically synthesized
tactgaaaataagatacgttta

SEQ ID NO: 969009 - DNA, 22 bp, Artificial Sequence
  chemically synthesized
aaagttataaaataaacgtatc

SEQ ID NO: 969010 - DNA, 22 bp, Artificial Sequence
  chemically synthesized
aaaagttataaaataaacgtat

SEQ ID NO: 969011 - DNA, 22 bp, Artificial Sequence
  chemically synthesized
aaaataagatacgtttatttta

SEQ ID NO: 969012 - DNA, 22 bp, Artificial Sequence
  chemically synthesized
atttaaaagttataaaataaac

SEQ ID NO: 969013 - DNA, 22 bp, Artificial Sequence
  chemically synthesized
aacctaatttaaaagttataaa

SEQ ID NO: 969014 - DNA, 22 bp, Artificial Sequence
  chemically synthesized
attttataacttttaaattagg

SEQ ID NO: 969015 - DNA, 22 bp, Artificial Sequence
  chemically synthesized
ttttataacttttaaattaggt

SEQ ID NO: 969016 - DNA, 22 bp, Artificial Sequence
  chemically synthesized
tataacttttaaattaggttca

SEQ ID NO: 969017 - DNA, 22 bp, Artificial Sequence
  chemically synthesized
cacgtgtacccctgaacctaat

SEQ ID NO: 969018 - DNA, 22 bp, Artificial Sequence
  chemically synthesized
ataacttttaaattaggttcag

SEQ ID NO: 969019 - DNA, 22 bp, Artificial Sequence
  chemically synthesized
taacttttaaattaggttcagg

SEQ ID NO: 969020 - DNA, 22 bp, Artificial Sequence
  chemically synthesized
ttaaattaggttcaggggtaca

SEQ ID NO: 969021 - DNA, 22 bp, Artificial Sequence
  chemically synthesized
taaattaggttcaggggtacac

SEQ ID NO: 969022 - DNA, 22 bp, Artificial Sequence
  chemically synthesized
aaattaggttcaggggtacacg

SEQ ID NO: 969023 - DNA, 22 bp, Artificial Sequence
  chemically synthesized
aattaggttcaggggtacacgt

SEQ ID NO: 969024 - DNA, 22 bp, Artificial Sequence
  chemically synthesized
tatagcaaacctgcacgtgtac

SEQ ID NO: 969025 - DNA, 22 bp, Artificial Sequence
  chemically synthesized
ggttcaggggtacacgtgcagg

SEQ ID NO: 969026 - DNA, 22 bp, Artificial Sequence
  chemically synthesized
acctgtatagcaaacctgcacg

SEQ ID NO: 969027 - DNA, 22 bp, Artificial Sequence
  chemically synthesized
aggggtacacgtgcaggtttgc

SEQ ID NO: 969028 - DNA, 22 bp, Artificial Sequence
  chemically synthesized
gctatacaggtgaactgcattt

SEQ ID NO: 969029 - DNA, 22 bp, Artificial Sequence
  chemically synthesized
ctatacaggtgaactgcatttt

SEQ ID NO: 969030 - DNA, 22 bp, Artificial Sequence
  chemically synthesized
caccaaacccccgcaaaatgca

SEQ ID NO: 969031 - DNA, 22 bp, Artificial Sequence
  chemically synthesized
tacaggtgaactgcattttgcg

SEQ ID NO: 969032 - DNA, 22 bp, Artificial Sequence
  chemically synthesized
acaccaaacccccgcaaaatgc

SEQ ID NO: 969033 - DNA, 22 bp, Artificial Sequence
  chemically synthesized
tacaccaaacccccgcaaaatg

SEQ ID NO: 969034 - DNA, 22 bp, Artificial Sequence
  chemically synthesized
cattttgcgggggtttggtgta

SEQ ID NO: 969035 - DNA, 22 bp, Artificial Sequence
  chemically synthesized
tgcgggggtttggtgtaaagat

SEQ ID NO: 969036 - DNA, 22 bp, Artificial Sequence
  chemically synthesized
cgtgagaaaataatctttacac

SEQ ID NO: 969037 - DNA, 22 bp, Artificial Sequence
  chemically synthesized
gcgggggtttggtgtaaagatt

SEQ ID NO: 969038 - DNA, 22 bp, Artificial Sequence
  chemically synthesized
cgggggtttggtgtaaagatta

SEQ ID NO: 969039 - DNA, 22 bp, Artificial Sequence
  chemically synthesized
gtacctgcgtgagaaaataatc

SEQ ID NO: 969040 - DNA, 22 bp, Artificial Sequence
  chemically synthesized
agtacctgcgtgagaaaataat

SEQ ID NO: 969041 - DNA, 22 bp, Artificial Sequence
  chemically synthesized
ggtgtaaagattattttctcac

SEQ ID NO: 969042 - DNA, 22 bp, Artificial Sequence
  chemically synthesized
gtgtaaagattattttctcacg

SEQ ID NO: 969043 - DNA, 22 bp, Artificial Sequence
  chemically synthesized
tgtttagtacctgcgtgagaaa

SEQ ID NO: 969044 - DNA, 22 bp, Artificial Sequence
  chemically synthesized
ggtactatgtttagtacctgcg

SEQ ID NO: 969045 - DNA, 22 bp, Artificial Sequence
  chemically synthesized
ttgggtactatgtttagtacct

SEQ ID NO: 969046 - DNA, 22 bp, Artificial Sequence
  chemically synthesized
ttttctcacgcaggtactaaac

SEQ ID NO: 969047 - DNA, 22 bp, Artificial Sequence
  chemically synthesized
tctcacgcaggtactaaacata

SEQ ID NO: 969048 - DNA, 22 bp, Artificial Sequence
  chemically synthesized
ctcacgcaggtactaaacatag

SEQ ID NO: 969049 - DNA, 22 bp, Artificial Sequence
  chemically synthesized
tcacgcaggtactaaacatagt

SEQ ID NO: 969050 - DNA, 22 bp, Artificial Sequence
  chemically synthesized
acgcaggtactaaacatagtac

SEQ ID NO: 969051 - DNA, 22 bp, Artificial Sequence
  chemically synthesized
aacatagtacccaataattatt

SEQ ID NO: 969052 - DNA, 22 bp, Artificial Sequence
  chemically synthesized
tttttcctgatcttctccctcc

SEQ ID NO: 969053 - DNA, 22 bp, Artificial Sequence
  chemically synthesized
ttcctgatcttctccctccact

SEQ ID NO: 969054 - DNA, 22 bp, Artificial Sequence
  chemically synthesized
tcctgatcttctccctccactt

SEQ ID NO: 969055 - DNA, 22 bp, Artificial Sequence
  chemically synthesized
cctgatcttctccctccacttg

SEQ ID NO: 969056 - DNA, 22 bp, Artificial Sequence
  chemically synthesized
gagggtggaacacaagtggagg

SEQ ID NO: 969057 - DNA, 22 bp, Artificial Sequence
  chemically synthesized
ctgatcttctccctccacttgt

SEQ ID NO: 969058 - DNA, 22 bp, Artificial Sequence
  chemically synthesized
ctggagggtggaacacaagtgg

SEQ ID NO: 969059 - DNA, 22 bp, Artificial Sequence
  chemically synthesized
atcttctccctccacttgtgtt

SEQ ID NO: 969060 - DNA, 22 bp, Artificial Sequence
  chemically synthesized
ctccctccacttgtgttccacc

SEQ ID NO: 969061 - DNA, 22 bp, Artificial Sequence
  chemically synthesized
tccctccacttgtgttccaccc

SEQ ID NO: 969062 - DNA, 22 bp, Artificial Sequence
  chemically synthesized
gggcctactggagggtggaaca

SEQ ID NO: 969063 - DNA, 22 bp, Artificial Sequence
  chemically synthesized
cctccacttgtgttccaccctc

SEQ ID NO: 969064 - DNA, 22 bp, Artificial Sequence
  chemically synthesized
cacttgtgttccaccctccagt

SEQ ID NO: 969065 - DNA, 22 bp, Artificial Sequence
  chemically synthesized
gtgttccaccctccagtaggcc

SEQ ID NO: 969066 - DNA, 22 bp, Artificial Sequence
  chemically synthesized
tgttccaccctccagtaggccc

SEQ ID NO: 969067 - DNA, 22 bp, Artificial Sequence
  chemically synthesized
caccctccagtaggccccagtg

SEQ ID NO: 969068 - DNA, 22 bp, Artificial Sequence
  chemically synthesized
cagtaggccccagtgtgtgtta

SEQ ID NO: 969069 - DNA, 22 bp, Artificial Sequence
  chemically synthesized
aatgatgagaacatatggacac

SEQ ID NO: 969070 - DNA, 22 bp, Artificial Sequence
  chemically synthesized
ttcccctctttgtgtccatatg

SEQ ID NO: 969071 - DNA, 22 bp, Artificial Sequence
  chemically synthesized
ccctctttgtgtccatatgttc

SEQ ID NO: 969072 - DNA, 22 bp, Artificial Sequence
  chemically synthesized
tttgtgtccatatgttctcatc

SEQ ID NO: 969073 - DNA, 22 bp, Artificial Sequence
  chemically synthesized
tgtgtccatatgttctcatcat

SEQ ID NO: 969074 - DNA, 22 bp, Artificial Sequence
  chemically synthesized
gtgtccatatgttctcatcatt

SEQ ID NO: 969075 - DNA, 22 bp, Artificial Sequence
  chemically synthesized
tgtccatatgttctcatcattt

SEQ ID NO: 969076 - DNA, 22 bp, Artificial Sequence
  chemically synthesized
taaatggaagctaaatgatgag

SEQ ID NO: 969077 - DNA, 22 bp, Artificial Sequence
  chemically synthesized
ataaatggaagctaaatgatga

SEQ ID NO: 969078 - DNA, 22 bp, Artificial Sequence
  chemically synthesized
acttataaatggaagctaaatg

SEQ ID NO: 969079 - DNA, 22 bp, Artificial Sequence
  chemically synthesized
tcacttataaatggaagctaaa

SEQ ID NO: 969080 - DNA, 22 bp, Artificial Sequence
  chemically synthesized
tcatcatttagcttccatttat

SEQ ID NO: 969081 - DNA, 22 bp, Artificial Sequence
  chemically synthesized
cgtgttctcacttataaatgga

SEQ ID NO: 969082 - DNA, 22 bp, Artificial Sequence
  chemically synthesized
atcatttagcttccatttataa

SEQ ID NO: 969083 - DNA, 22 bp, Artificial Sequence
  chemically synthesized
agcttccatttataagtgagaa

SEQ ID NO: 969084 - DNA, 22 bp, Artificial Sequence
  chemically synthesized
gcttccatttataagtgagaac

SEQ ID NO: 969085 - DNA, 22 bp, Artificial Sequence
  chemically synthesized
ccatttataagtgagaacacgc

SEQ ID NO: 969086 - DNA, 22 bp, Artificial Sequence
  chemically synthesized
catttataagtgagaacacgca

SEQ ID NO: 969087 - DNA, 22 bp, Artificial Sequence
  chemically synthesized
ataagtgagaacacgcagtatt

SEQ ID NO: 969088 - DNA, 22 bp, Artificial Sequence
  chemically synthesized
taagtgagaacacgcagtattt

SEQ ID NO: 969089 - DNA, 22 bp, Artificial Sequence
  chemically synthesized
tatggaaacagaaaaccaaata

SEQ ID NO: 969090 - DNA, 22 bp, Artificial Sequence
  chemically synthesized
atatggaaacagaaaaccaaat

SEQ ID NO: 969091 - DNA, 22 bp, Artificial Sequence
  chemically synthesized
gcaaacttatatggaaacagaa

SEQ ID NO: 969092 - DNA, 22 bp, Artificial Sequence
  chemically synthesized
agcaaacttatatggaaacaga

SEQ ID NO: 969093 - DNA, 22 bp, Artificial Sequence
  chemically synthesized
tccttagcaaacttatatggaa

SEQ ID NO: 969094 - DNA, 22 bp, Artificial Sequence
  chemically synthesized
ggttttctgtttccatataagt

SEQ ID NO: 969095 - DNA, 22 bp, Artificial Sequence
  chemically synthesized
gttttctgtttccatataagtt

SEQ ID NO: 969096 - DNA, 22 bp, Artificial Sequence
  chemically synthesized
tctgtttccatataagtttgct

SEQ ID NO: 969097 - DNA, 22 bp, Artificial Sequence
  chemically synthesized
ctgtttccatataagtttgcta

SEQ ID NO: 969098 - DNA, 22 bp, Artificial Sequence
  chemically synthesized
tgtttccatataagtttgctaa

SEQ ID NO: 969099 - DNA, 22 bp, Artificial Sequence
  chemically synthesized
tttccatataagtttgctaagg

SEQ ID NO: 969100 - DNA, 22 bp, Artificial Sequence
  chemically synthesized
ccatataagtttgctaaggata

SEQ ID NO: 969101 - DNA, 22 bp, Artificial Sequence
  chemically synthesized
catataagtttgctaaggataa

SEQ ID NO: 969102 - DNA, 22 bp, Artificial Sequence
  chemically synthesized
gctaaggataatggccactggc

SEQ ID NO: 969103 - DNA, 22 bp, Artificial Sequence
  chemically synthesized
ctaaggataatggccactggct

SEQ ID NO: 969104 - DNA, 22 bp, Artificial Sequence
  chemically synthesized
aggataatggccactggctcca

SEQ ID NO: 969105 - DNA, 22 bp, Artificial Sequence
  chemically synthesized
cagcgacatggatggagccagt

SEQ ID NO: 969106 - DNA, 22 bp, Artificial Sequence
  chemically synthesized
gcagcgacatggatggagccag

SEQ ID NO: 969107 - DNA, 22 bp, Artificial Sequence
  chemically synthesized
tgcagcgacatggatggagcca

SEQ ID NO: 969108 - DNA, 22 bp, Artificial Sequence
  chemically synthesized
gctccatccatgtcgctgcaaa

SEQ ID NO: 969109 - DNA, 22 bp, Artificial Sequence
  chemically synthesized
catccatgtcgctgcaaaggac

SEQ ID NO: 969110 - DNA, 22 bp, Artificial Sequence
  chemically synthesized
caaaggacatgatctcattctt

SEQ ID NO: 969111 - DNA, 22 bp, Artificial Sequence
  chemically synthesized
tgtggccatgaaaaagaatgag

SEQ ID NO: 969112 - DNA, 22 bp, Artificial Sequence
  chemically synthesized
attctttttcatggccacatag

SEQ ID NO: 969113 - DNA, 22 bp, Artificial Sequence
  chemically synthesized
tttttcatggccacatagtatt

SEQ ID NO: 969114 - DNA, 22 bp, Artificial Sequence
  chemically synthesized
tttcatggccacatagtattcc

SEQ ID NO: 969115 - DNA, 22 bp, Artificial Sequence
  chemically synthesized
ttcatggccacatagtattcca

SEQ ID NO: 969116 - DNA, 22 bp, Artificial Sequence
  chemically synthesized
tcatggccacatagtattccat

SEQ ID NO: 969117 - DNA, 22 bp, Artificial Sequence
  chemically synthesized
catggccacatagtattccatg

SEQ ID NO: 969118 - DNA, 22 bp, Artificial Sequence
  chemically synthesized
atggccacatagtattccatgg

SEQ ID NO: 969119 - DNA, 22 bp, Artificial Sequence
  chemically synthesized
aataaagaaaatgtggtacata

SEQ ID NO: 969120 - DNA, 22 bp, Artificial Sequence
  chemically synthesized
catggtgtatatgtaccacatt

SEQ ID NO: 969121 - DNA, 22 bp, Artificial Sequence
  chemically synthesized
tcaatgaacagactgaataaag

SEQ ID NO: 969122 - DNA, 22 bp, Artificial Sequence
  chemically synthesized
aatgcctatcaatgaacagact

SEQ ID NO: 969123 - DNA, 22 bp, Artificial Sequence
  chemically synthesized
aaatgcctatcaatgaacagac

SEQ ID NO: 969124 - DNA, 22 bp, Artificial Sequence
  chemically synthesized
tctttattcagtctgttcattg

SEQ ID NO: 969125 - DNA, 22 bp, Artificial Sequence
  chemically synthesized
ctttattcagtctgttcattga

SEQ ID NO: 969126 - DNA, 22 bp, Artificial Sequence
  chemically synthesized
tttattcagtctgttcattgat

SEQ ID NO: 969127 - DNA, 22 bp, Artificial Sequence
  chemically synthesized
aacttaaatgcctatcaatgaa

SEQ ID NO: 969128 - DNA, 22 bp, Artificial Sequence
  chemically synthesized
tattcagtctgttcattgatag

SEQ ID NO: 969129 - DNA, 22 bp, Artificial Sequence
  chemically synthesized
attcagtctgttcattgatagg

SEQ ID NO: 969130 - DNA, 22 bp, Artificial Sequence
  chemically synthesized
ttcagtctgttcattgataggc

SEQ ID NO: 969131 - DNA, 22 bp, Artificial Sequence
  chemically synthesized
agtctgttcattgataggcatt

SEQ ID NO: 969132 - DNA, 22 bp, Artificial Sequence
  chemically synthesized
ttcattgataggcatttaagtt

SEQ ID NO: 969133 - DNA, 22 bp, Artificial Sequence
  chemically synthesized
attgataggcatttaagttgaa

SEQ ID NO: 969134 - DNA, 22 bp, Artificial Sequence
  chemically synthesized
ataggcatttaagttgaatcca

SEQ ID NO: 969135 - DNA, 22 bp, Artificial Sequence
  chemically synthesized
acaatagcaaagacatggattc

SEQ ID NO: 969136 - DNA, 22 bp, Artificial Sequence
  chemically synthesized
ctcacaatagcaaagacatgga

SEQ ID NO: 969137 - DNA, 22 bp, Artificial Sequence
  chemically synthesized
aagttgaatccatgtctttgct

SEQ ID NO: 969138 - DNA, 22 bp, Artificial Sequence
  chemically synthesized
agttgaatccatgtctttgcta

SEQ ID NO: 969139 - DNA, 22 bp, Artificial Sequence
  chemically synthesized
caacactactcacaatagcaaa

SEQ ID NO: 969140 - DNA, 22 bp, Artificial Sequence
  chemically synthesized
aatccatgtctttgctattgtg

SEQ ID NO: 969141 - DNA, 22 bp, Artificial Sequence
  chemically synthesized
attgcaacactactcacaatag

SEQ ID NO: 969142 - DNA, 22 bp, Artificial Sequence
  chemically synthesized
tgtatgttcattgcaacactac

SEQ ID NO: 969143 - DNA, 22 bp, Artificial Sequence
  chemically synthesized
tgctattgtgagtagtgttgca

SEQ ID NO: 969144 - DNA, 22 bp, Artificial Sequence
  chemically synthesized
gctattgtgagtagtgttgcaa

SEQ ID NO: 969145 - DNA, 22 bp, Artificial Sequence
  chemically synthesized
ctattgtgagtagtgttgcaat

SEQ ID NO: 969146 - DNA, 22 bp, Artificial Sequence
  chemically synthesized
ttgtgagtagtgttgcaatgaa

SEQ ID NO: 969147 - DNA, 22 bp, Artificial Sequence
  chemically synthesized
tgagtagtgttgcaatgaacat

SEQ ID NO: 969148 - DNA, 22 bp, Artificial Sequence
  chemically synthesized
caatgaacatacacaacgtgca

SEQ ID NO: 969149 - DNA, 22 bp, Artificial Sequence
  chemically synthesized
ccataaagacatatgcacgttg

SEQ ID NO: 969150 - DNA, 22 bp, Artificial Sequence
  chemically synthesized
taccataaagacatatgcacgt

SEQ ID NO: 969151 - DNA, 22 bp, Artificial Sequence
  chemically synthesized
tatggtagaatgatttctattc

SEQ ID NO: 969152 - DNA, 22 bp, Artificial Sequence
  chemically synthesized
atggtagaatgatttctattcc

SEQ ID NO: 969153 - DNA, 22 bp, Artificial Sequence
  chemically synthesized
tggtagaatgatttctattcct

SEQ ID NO: 969154 - DNA, 22 bp, Artificial Sequence
  chemically synthesized
ggcatatacccagaggaataga

SEQ ID NO: 969155 - DNA, 22 bp, Artificial Sequence
  chemically synthesized
ttgggcatatacccagaggaat

SEQ ID NO: 969156 - DNA, 22 bp, Artificial Sequence
  chemically synthesized
ctattcctctgggtatatgccc

SEQ ID NO: 969157 - DNA, 22 bp, Artificial Sequence
  chemically synthesized
tattcctctgggtatatgccca

SEQ ID NO: 969158 - DNA, 22 bp, Artificial Sequence
  chemically synthesized
ttcctctgggtatatgcccaat

SEQ ID NO: 969159 - DNA, 22 bp, Artificial Sequence
  chemically synthesized
ctctgggtatatgcccaataat

SEQ ID NO: 969160 - DNA, 22 bp, Artificial Sequence
  chemically synthesized
acccagcaatcccattattggg

SEQ ID NO: 969161 - DNA, 22 bp, Artificial Sequence
  chemically synthesized
gacccagcaatcccattattgg

SEQ ID NO: 969162 - DNA, 22 bp, Artificial Sequence
  chemically synthesized
tgggtatatgcccaataatggg

SEQ ID NO: 969163 - DNA, 22 bp, Artificial Sequence
  chemically synthesized
ggtatatgcccaataatgggat

SEQ ID NO: 969164 - DNA, 22 bp, Artificial Sequence
  chemically synthesized
ccatttgacccagcaatcccat

SEQ ID NO: 969165 - DNA, 22 bp, Artificial Sequence
  chemically synthesized
caaaagaattaccatttgaccc

SEQ ID NO: 969166 - DNA, 22 bp, Artificial Sequence
  chemically synthesized
acaaaagaattaccatttgacc

SEQ ID NO: 969167 - DNA, 22 bp, Artificial Sequence
  chemically synthesized
ctgggtcaaatggtaattcttt

SEQ ID NO: 969168 - DNA, 22 bp, Artificial Sequence
  chemically synthesized
aaataacttacaaaagaattac

SEQ ID NO: 969169 - DNA, 22 bp, Artificial Sequence
  chemically synthesized
tcaaataacttacaaaagaatt

SEQ ID NO: 969170 - DNA, 22 bp, Artificial Sequence
  chemically synthesized
ggtcaaatggtaattcttttgt

SEQ ID NO: 969171 - DNA, 22 bp, Artificial Sequence
  chemically synthesized
ctcaaataacttacaaaagaat

SEQ ID NO: 969172 - DNA, 22 bp, Artificial Sequence
  chemically synthesized
ttttgtaagttatttgagaaat

SEQ ID NO: 969173 - DNA, 22 bp, Artificial Sequence
  chemically synthesized
ttgtaagttatttgagaaatca

SEQ ID NO: 969174 - DNA, 22 bp, Artificial Sequence
  chemically synthesized
aaagcagtgtggtgatttctca

SEQ ID NO: 969175 - DNA, 22 bp, Artificial Sequence
  chemically synthesized
tgtaagttatttgagaaatcac

SEQ ID NO: 969176 - DNA, 22 bp, Artificial Sequence
  chemically synthesized
gtaagttatttgagaaatcacc

SEQ ID NO: 969177 - DNA, 22 bp, Artificial Sequence
  chemically synthesized
taagttatttgagaaatcacca

SEQ ID NO: 969178 - DNA, 22 bp, Artificial Sequence
  chemically synthesized
ggtcgttgaaagcagtgtggtg

SEQ ID NO: 969179 - DNA, 22 bp, Artificial Sequence
  chemically synthesized
tttgagaaatcaccacactgct

SEQ ID NO: 969180 - DNA, 22 bp, Artificial Sequence
  chemically synthesized
gttcggtcgttgaaagcagtgt

SEQ ID NO: 969181 - DNA, 22 bp, Artificial Sequence
  chemically synthesized
gagaaatcaccacactgctttc

SEQ ID NO: 969182 - DNA, 22 bp, Artificial Sequence
  chemically synthesized
agaaatcaccacactgctttca

SEQ ID NO: 969183 - DNA, 22 bp, Artificial Sequence
  chemically synthesized
gtgggaacgtaaattagttcgg

SEQ ID NO: 969184 - DNA, 22 bp, Artificial Sequence
  chemically synthesized
ctttcaacgaccgaactaattt

SEQ ID NO: 969185 - DNA, 22 bp, Artificial Sequence
  chemically synthesized
ctggtgggaacgtaaattagtt

SEQ ID NO: 969186 - DNA, 22 bp, Artificial Sequence
  chemically synthesized
tcaacgaccgaactaatttacg

SEQ ID NO: 969187 - DNA, 22 bp, Artificial Sequence
  chemically synthesized
caacgaccgaactaatttacgt

SEQ ID NO: 969188 - DNA, 22 bp, Artificial Sequence
  chemically synthesized
aacgaccgaactaatttacgtt

SEQ ID NO: 969189 - DNA, 22 bp, Artificial Sequence
  chemically synthesized
acacactgctggtgggaacgta

SEQ ID NO: 969190 - DNA, 22 bp, Artificial Sequence
  chemically synthesized
aacacactgctggtgggaacgt

SEQ ID NO: 969191 - DNA, 22 bp, Artificial Sequence
  chemically synthesized
atttacgttcccaccagcagtg

SEQ ID NO: 969192 - DNA, 22 bp, Artificial Sequence
  chemically synthesized
acgttcccaccagcagtgtgtt

SEQ ID NO: 969193 - DNA, 22 bp, Artificial Sequence
  chemically synthesized
ataggaacacttaacacactgc

SEQ ID NO: 969194 - DNA, 22 bp, Artificial Sequence
  chemically synthesized
cgttcccaccagcagtgtgtta

SEQ ID NO: 969195 - DNA, 22 bp, Artificial Sequence
  chemically synthesized
aataggaacacttaacacactg

SEQ ID NO: 969196 - DNA, 22 bp, Artificial Sequence
  chemically synthesized
ttaataggaacacttaacacac

SEQ ID NO: 969197 - DNA, 22 bp, Artificial Sequence
  chemically synthesized
ccaccagcagtgtgttaagtgt

SEQ ID NO: 969198 - DNA, 22 bp, Artificial Sequence
  chemically synthesized
ataatctcttaataggaacact

SEQ ID NO: 969199 - DNA, 22 bp, Artificial Sequence
  chemically synthesized
aataatctcttaataggaacac

SEQ ID NO: 969200 - DNA, 22 bp, Artificial Sequence
  chemically synthesized
agtgttcctattaagagattat

SEQ ID NO: 969201 - DNA, 22 bp, Artificial Sequence
  chemically synthesized
gaaggatagggatttaataatc

SEQ ID NO: 969202 - DNA, 22 bp, Artificial Sequence
  chemically synthesized
ctattaagagattattaaatcc

SEQ ID NO: 969203 - DNA, 22 bp, Artificial Sequence
  chemically synthesized
ctagaaggatagggatttaata

SEQ ID NO: 969204 - DNA, 22 bp, Artificial Sequence
  chemically synthesized
cctagaaggatagggatttaat

SEQ ID NO: 969205 - DNA, 22 bp, Artificial Sequence
  chemically synthesized
ttaagagattattaaatcccta

SEQ ID NO: 969206 - DNA, 22 bp, Artificial Sequence
  chemically synthesized
agagattattaaatccctatcc

SEQ ID NO: 969207 - DNA, 22 bp, Artificial Sequence
  chemically synthesized
aaataacttcctagaaggatag

SEQ ID NO: 969208 - DNA, 22 bp, Artificial Sequence
  chemically synthesized
caaataacttcctagaaggata

SEQ ID NO: 969209 - DNA, 22 bp, Artificial Sequence
  chemically synthesized
ttaaatccctatccttctagga

SEQ ID NO: 969210 - DNA, 22 bp, Artificial Sequence
  chemically synthesized
cttcaaataacttcctagaagg

SEQ ID NO: 969211 - DNA, 22 bp, Artificial Sequence
  chemically synthesized
aatccctatccttctaggaagt

SEQ ID NO: 969212 - DNA, 22 bp, Artificial Sequence
  chemically synthesized
actacttcaaataacttcctag

SEQ ID NO: 969213 - DNA, 22 bp, Artificial Sequence
  chemically synthesized
gactacttcaaataacttccta

SEQ ID NO: 969214 - DNA, 22 bp, Artificial Sequence
  chemically synthesized
ttgactacttcaaataacttcc

SEQ ID NO: 969215 - DNA, 22 bp, Artificial Sequence
  chemically synthesized
tccttctaggaagttatttgaa

SEQ ID NO: 969216 - DNA, 22 bp, Artificial Sequence
  chemically synthesized
tgtagttcttgactacttcaaa

SEQ ID NO: 969217 - DNA, 22 bp, Artificial Sequence
  chemically synthesized
ctaggaagttatttgaagtagt

SEQ ID NO: 969218 - DNA, 22 bp, Artificial Sequence
  chemically synthesized
taggaagttatttgaagtagtc

SEQ ID NO: 969219 - DNA, 22 bp, Artificial Sequence
  chemically synthesized
tgtgtagttcttgactacttca

SEQ ID NO: 969220 - DNA, 22 bp, Artificial Sequence
  chemically synthesized
ggaagttatttgaagtagtcaa

SEQ ID NO: 969221 - DNA, 22 bp, Artificial Sequence
  chemically synthesized
agtgatctctgtgtagttcttg

SEQ ID NO: 969222 - DNA, 22 bp, Artificial Sequence
  chemically synthesized
tttgaagtagtcaagaactaca

SEQ ID NO: 969223 - DNA, 22 bp, Artificial Sequence
  chemically synthesized
gaagtagtcaagaactacacag

SEQ ID NO: 969224 - DNA, 22 bp, Artificial Sequence
  chemically synthesized
tctcagtgatctctgtgtagtt

SEQ ID NO: 969225 - DNA, 22 bp, Artificial Sequence
  chemically synthesized
aagtagtcaagaactacacaga

SEQ ID NO: 969226 - DNA, 22 bp, Artificial Sequence
  chemically synthesized
gtctcagtgatctctgtgtagt

SEQ ID NO: 969227 - DNA, 22 bp, Artificial Sequence
  chemically synthesized
tgtctcagtgatctctgtgtag

SEQ ID NO: 969228 - DNA, 22 bp, Artificial Sequence
  chemically synthesized
aaatctttgtctcagtgatctc

SEQ ID NO: 969229 - DNA, 22 bp, Artificial Sequence
  chemically synthesized
caaatctttgtctcagtgatct

SEQ ID NO: 969230 - DNA, 22 bp, Artificial Sequence
  chemically synthesized
ttcaaatctttgtctcagtgat

SEQ ID NO: 969231 - DNA, 22 bp, Artificial Sequence
  chemically synthesized
ttcttcaaatctttgtctcagt

SEQ ID NO: 969232 - DNA, 22 bp, Artificial Sequence
  chemically synthesized
cacagagatcactgagacaaag

SEQ ID NO: 969233 - DNA, 22 bp, Artificial Sequence
  chemically synthesized
caattgttcttcaaatctttgt

SEQ ID NO: 969234 - DNA, 22 bp, Artificial Sequence
  chemically synthesized
taagattccaattgttcttcaa

SEQ ID NO: 969235 - DNA, 22 bp, Artificial Sequence
  chemically synthesized
agacaaagatttgaagaacaat

SEQ ID NO: 969236 - DNA, 22 bp, Artificial Sequence
  chemically synthesized
gctgtaagattccaattgttct

SEQ ID NO: 969237 - DNA, 22 bp, Artificial Sequence
  chemically synthesized
gaagaacaattggaatcttaca

SEQ ID NO: 969238 - DNA, 22 bp, Artificial Sequence
  chemically synthesized
atagtagctagctgtaagattc

SEQ ID NO: 969239 - DNA, 22 bp, Artificial Sequence
  chemically synthesized
aagaacaattggaatcttacag

SEQ ID NO: 969240 - DNA, 22 bp, Artificial Sequence
  chemically synthesized
tgatagtagctagctgtaagat

SEQ ID NO: 969241 - DNA, 22 bp, Artificial Sequence
  chemically synthesized
ctgatagtagctagctgtaaga

SEQ ID NO: 969242 - DNA, 22 bp, Artificial Sequence
  chemically synthesized
tttctgatagtagctagctgta

SEQ ID NO: 969243 - DNA, 22 bp, Artificial Sequence
  chemically synthesized
ttatttctgatagtagctagct

SEQ ID NO: 969244 - DNA, 22 bp, Artificial Sequence
  chemically synthesized
gaatcttacagctagctactat

SEQ ID NO: 969245 - DNA, 22 bp, Artificial Sequence
  chemically synthesized
cgggttgttatttctgatagta

SEQ ID NO: 969246 - DNA, 22 bp, Artificial Sequence
  chemically synthesized
acagctagctactatcagaaat

SEQ ID NO: 969247 - DNA, 22 bp, Artificial Sequence
  chemically synthesized
ctacgggttgttatttctgata

SEQ ID NO: 969248 - DNA, 22 bp, Artificial Sequence
  chemically synthesized
cagctagctactatcagaaata

SEQ ID NO: 969249 - DNA, 22 bp, Artificial Sequence
  chemically synthesized
actacgggttgttatttctgat

SEQ ID NO: 969250 - DNA, 22 bp, Artificial Sequence
  chemically synthesized
gctactatcagaaataacaacc

SEQ ID NO: 969251 - DNA, 22 bp, Artificial Sequence
  chemically synthesized
ctatcagaaataacaacccgta

SEQ ID NO: 969252 - DNA, 22 bp, Artificial Sequence
  chemically synthesized
cataatatttactacgggttgt

SEQ ID NO: 969253 - DNA, 22 bp, Artificial Sequence
  chemically synthesized
tcagaaataacaacccgtagta

SEQ ID NO: 969254 - DNA, 22 bp, Artificial Sequence
  chemically synthesized
actacataatatttactacggg

SEQ ID NO: 969255 - DNA, 22 bp, Artificial Sequence
  chemically synthesized
ttaactacataatatttactac

SEQ ID NO: 969256 - DNA, 22 bp, Artificial Sequence
  chemically synthesized
aacataatgtaagtagaaaatt

SEQ ID NO: 969257 - DNA, 22 bp, Artificial Sequence
  chemically synthesized
tgtagttaataattttctactt

SEQ ID NO: 969258 - DNA, 22 bp, Artificial Sequence
  chemically synthesized
attaaacataatgtaagtagaa

SEQ ID NO: 969259 - DNA, 22 bp, Artificial Sequence
  chemically synthesized
ataattttctacttacattatg

SEQ ID NO: 969260 - DNA, 22 bp, Artificial Sequence
  chemically synthesized
atgaggactcattaaacataat

SEQ ID NO: 969261 - DNA, 22 bp, Artificial Sequence
  chemically synthesized
gatgaggactcattaaacataa

SEQ ID NO: 969262 - DNA, 22 bp, Artificial Sequence
  chemically synthesized
tctacttacattatgtttaatg

SEQ ID NO: 969263 - DNA, 22 bp, Artificial Sequence
  chemically synthesized
ttgatgaggactcattaaacat

SEQ ID NO: 969264 - DNA, 22 bp, Artificial Sequence
  chemically synthesized
ctacttacattatgtttaatga

SEQ ID NO: 969265 - DNA, 22 bp, Artificial Sequence
  chemically synthesized
cttgatgaggactcattaaaca

SEQ ID NO: 969266 - DNA, 22 bp, Artificial Sequence
  chemically synthesized
tacttacattatgtttaatgag

SEQ ID NO: 969267 - DNA, 22 bp, Artificial Sequence
  chemically synthesized
cttacattatgtttaatgagtc

SEQ ID NO: 969268 - DNA, 22 bp, Artificial Sequence
  chemically synthesized
acattatgtttaatgagtcctc

SEQ ID NO: 969269 - DNA, 22 bp, Artificial Sequence
  chemically synthesized
cattatgtttaatgagtcctca

SEQ ID NO: 969270 - DNA, 22 bp, Artificial Sequence
  chemically synthesized
atggtttcttgatgaggactca

SEQ ID NO: 969271 - DNA, 22 bp, Artificial Sequence
  chemically synthesized
ctcatggtttcttgatgaggac

SEQ ID NO: 969272 - DNA, 22 bp, Artificial Sequence
  chemically synthesized
tgtttaatgagtcctcatcaag

SEQ ID NO: 969273 - DNA, 22 bp, Artificial Sequence
  chemically synthesized
tgttactcatggtttcttgatg

SEQ ID NO: 969274 - DNA, 22 bp, Artificial Sequence
  chemically synthesized
atgttactcatggtttcttgat

SEQ ID NO: 969275 - DNA, 22 bp, Artificial Sequence
  chemically synthesized
aatgagtcctcatcaagaaacc

SEQ ID NO: 969276 - DNA, 22 bp, Artificial Sequence
  chemically synthesized
tatgttactcatggtttcttga

SEQ ID NO: 969277 - DNA, 22 bp, Artificial Sequence
  chemically synthesized
atgagtcctcatcaagaaacca

SEQ ID NO: 969278 - DNA, 22 bp, Artificial Sequence
  chemically synthesized
actttatgttactcatggtttc

SEQ ID NO: 969279 - DNA, 22 bp, Artificial Sequence
  chemically synthesized
ttaactttatgttactcatggt

SEQ ID NO: 969280 - DNA, 22 bp, Artificial Sequence
  chemically synthesized
attaactttatgttactcatgg

SEQ ID NO: 969281 - DNA, 22 bp, Artificial Sequence
  chemically synthesized
atcaagaaaccatgagtaacat

SEQ ID NO: 969282 - DNA, 22 bp, Artificial Sequence
  chemically synthesized
tttattaactttatgttactca

SEQ ID NO: 969283 - DNA, 22 bp, Artificial Sequence
  chemically synthesized
tgtttattaactttatgttact

SEQ ID NO: 969284 - DNA, 22 bp, Artificial Sequence
  chemically synthesized
tcatgtcatctctgtttattaa

SEQ ID NO: 969285 - DNA, 22 bp, Artificial Sequence
  chemically synthesized
tatcatgtcatctctgtttatt

SEQ ID NO: 969286 - DNA, 22 bp, Artificial Sequence
  chemically synthesized
gagattctatcatgtcatctct

SEQ ID NO: 969287 - DNA, 22 bp, Artificial Sequence
  chemically synthesized
ggagattctatcatgtcatctc

SEQ ID NO: 969288 - DNA, 22 bp, Artificial Sequence
  chemically synthesized
ttggagattctatcatgtcatc

SEQ ID NO: 969289 - DNA, 22 bp, Artificial Sequence
  chemically synthesized
cttggagattctatcatgtcat

SEQ ID NO: 969290 - DNA, 22 bp, Artificial Sequence
  chemically synthesized
ataaacagagatgacatgatag

SEQ ID NO: 969291 - DNA, 22 bp, Artificial Sequence
  chemically synthesized
aacttcttggagattctatcat

SEQ ID NO: 969292 - DNA, 22 bp, Artificial Sequence
  chemically synthesized
attcaacttcttggagattcta

SEQ ID NO: 969293 - DNA, 22 bp, Artificial Sequence
  chemically synthesized
tgattcaacttcttggagattc

SEQ ID NO: 969294 - DNA, 22 bp, Artificial Sequence
  chemically synthesized
aaggtaatctctgattcaactt

SEQ ID NO: 969295 - DNA, 22 bp, Artificial Sequence
  chemically synthesized
gaaggtaatctctgattcaact

SEQ ID NO: 969296 - DNA, 22 bp, Artificial Sequence
  chemically synthesized
tgaaggtaatctctgattcaac

SEQ ID NO: 969297 - DNA, 22 bp, Artificial Sequence
  chemically synthesized
caagaagttgaatcagagatta

SEQ ID NO: 969298 - DNA, 22 bp, Artificial Sequence
  chemically synthesized
gtaaactttgaaggtaatctct

SEQ ID NO: 969299 - DNA, 22 bp, Artificial Sequence
  chemically synthesized
tggtaaactttgaaggtaatct

SEQ ID NO: 969300 - DNA, 22 bp, Artificial Sequence
  chemically synthesized
ttctggtaaactttgaaggtaa

SEQ ID NO: 969301 - DNA, 22 bp, Artificial Sequence
  chemically synthesized
gttctggtaaactttgaaggta

SEQ ID NO: 969302 - DNA, 22 bp, Artificial Sequence
  chemically synthesized
aatcagagattaccttcaaagt

SEQ ID NO: 969303 - DNA, 22 bp, Artificial Sequence
  chemically synthesized
atttgttctggtaaactttgaa

SEQ ID NO: 969304 - DNA, 22 bp, Artificial Sequence
  chemically synthesized
ttgatttgttctggtaaacttt

SEQ ID NO: 969305 - DNA, 22 bp, Artificial Sequence
  chemically synthesized
tgttgatttgttctggtaaact

SEQ ID NO: 969306 - DNA, 22 bp, Artificial Sequence
  chemically synthesized
ctgttgatttgttctggtaaac

SEQ ID NO: 969307 - DNA, 22 bp, Artificial Sequence
  chemically synthesized
ccttcaaagtttaccagaacaa

SEQ ID NO: 969308 - DNA, 22 bp, Artificial Sequence
  chemically synthesized
caaagtttaccagaacaaatca

SEQ ID NO: 969309 - DNA, 22 bp, Artificial Sequence
  chemically synthesized
tgcaatttctgttgatttgttc

SEQ ID NO: 969310 - DNA, 22 bp, Artificial Sequence
  chemically synthesized
aaagtttaccagaacaaatcaa

SEQ ID NO: 969311 - DNA, 22 bp, Artificial Sequence
  chemically synthesized
tatgcaatttctgttgatttgt

SEQ ID NO: 969312 - DNA, 22 bp, Artificial Sequence
  chemically synthesized
attctatgcaatttctgttgat

SEQ ID NO: 969313 - DNA, 22 bp, Artificial Sequence
  chemically synthesized
accagaacaaatcaacagaaat

SEQ ID NO: 969314 - DNA, 22 bp, Artificial Sequence
  chemically synthesized
taattctatgcaatttctgttg

SEQ ID NO: 969315 - DNA, 22 bp, Artificial Sequence
  chemically synthesized
ccagaacaaatcaacagaaatt

SEQ ID NO: 969316 - DNA, 22 bp, Artificial Sequence
  chemically synthesized
ctaattctatgcaatttctgtt

SEQ ID NO: 969317 - DNA, 22 bp, Artificial Sequence
  chemically synthesized
tctaattctatgcaatttctgt

SEQ ID NO: 969318 - DNA, 22 bp, Artificial Sequence
  chemically synthesized
gagctttctaattctatgcaat

SEQ ID NO: 969319 - DNA, 22 bp, Artificial Sequence
  chemically synthesized
tagagctttctaattctatgca

SEQ ID NO: 969320 - DNA, 22 bp, Artificial Sequence
  chemically synthesized
ctagagctttctaattctatgc

SEQ ID NO: 969321 - DNA, 22 bp, Artificial Sequence
  chemically synthesized
atggacttctagagctttctaa

SEQ ID NO: 969322 - DNA, 22 bp, Artificial Sequence
  chemically synthesized
ctaatggacttctagagctttc

SEQ ID NO: 969323 - DNA, 22 bp, Artificial Sequence
  chemically synthesized
catagaattagaaagctctaga

SEQ ID NO: 969324 - DNA, 22 bp, Artificial Sequence
  chemically synthesized
ccctcctaatggacttctagag

SEQ ID NO: 969325 - DNA, 22 bp, Artificial Sequence
  chemically synthesized
actcccctcctaatggacttct

SEQ ID NO: 969326 - DNA, 22 bp, Artificial Sequence
  chemically synthesized
taactcccctcctaatggactt

SEQ ID NO: 969327 - DNA, 22 bp, Artificial Sequence
  chemically synthesized
gaaagctctagaagtccattag

SEQ ID NO: 969328 - DNA, 22 bp, Artificial Sequence
  chemically synthesized
tagaagtccattaggaggggag

SEQ ID NO: 969329 - DNA, 22 bp, Artificial Sequence
  chemically synthesized
aaggtattctaactcccctcct

SEQ ID NO: 969330 - DNA, 22 bp, Artificial Sequence
  chemically synthesized
gaagtccattaggaggggagtt

SEQ ID NO: 969331 - DNA, 22 bp, Artificial Sequence
  chemically synthesized
tgaaggtattctaactcccctc

SEQ ID NO: 969332 - DNA, 22 bp, Artificial Sequence
  chemically synthesized
tctgaaggtattctaactcccc

SEQ ID NO: 969333 - DNA, 22 bp, Artificial Sequence
  chemically synthesized
ctctgaaggtattctaactccc

SEQ ID NO: 969334 - DNA, 22 bp, Artificial Sequence
  chemically synthesized
tctctgaaggtattctaactcc

SEQ ID NO: 969335 - DNA, 22 bp, Artificial Sequence
  chemically synthesized
ttctctgaaggtattctaactc

SEQ ID NO: 969336 - DNA, 22 bp, Artificial Sequence
  chemically synthesized
tttttctctgaaggtattctaa

SEQ ID NO: 969337 - DNA, 22 bp, Artificial Sequence
  chemically synthesized
gtttttctctgaaggtattcta

SEQ ID NO: 969338 - DNA, 22 bp, Artificial Sequence
  chemically synthesized
ggaggggagttagaataccttc

SEQ ID NO: 969339 - DNA, 22 bp, Artificial Sequence
  chemically synthesized
tttgtttttctctgaaggtatt

SEQ ID NO: 969340 - DNA, 22 bp, Artificial Sequence
  chemically synthesized
ctgtttgtttttctctgaaggt

SEQ ID NO: 969341 - DNA, 22 bp, Artificial Sequence
  chemically synthesized
cctgtttgtttttctctgaagg

SEQ ID NO: 969342 - DNA, 22 bp, Artificial Sequence
  chemically synthesized
tcctgtttgtttttctctgaag

SEQ ID NO: 969343 - DNA, 22 bp, Artificial Sequence
  chemically synthesized
ttcctgtttgtttttctctgaa

SEQ ID NO: 969344 - DNA, 22 bp, Artificial Sequence
  chemically synthesized
acttttcctgtttgtttttctc

SEQ ID NO: 969345 - DNA, 22 bp, Artificial Sequence
  chemically synthesized
gaataccttcagagaaaaacaa

SEQ ID NO: 969346 - DNA, 22 bp, Artificial Sequence
  chemically synthesized
cacttttcctgtttgtttttct

SEQ ID NO: 969347 - DNA, 22 bp, Artificial Sequence
  chemically synthesized
aatttcacttttcctgtttgtt

SEQ ID NO: 969348 - DNA, 22 bp, Artificial Sequence
  chemically synthesized
cagagaaaaacaaacaggaaaa

SEQ ID NO: 969349 - DNA, 22 bp, Artificial Sequence
  chemically synthesized
agagaaaaacaaacaggaaaag

SEQ ID NO: 969350 - DNA, 22 bp, Artificial Sequence
  chemically synthesized
gatagttaaatttcacttttcc

SEQ ID NO: 969351 - DNA, 22 bp, Artificial Sequence
  chemically synthesized
agatagttaaatttcacttttc

SEQ ID NO: 969352 - DNA, 22 bp, Artificial Sequence
  chemically synthesized
cttagatagttaaatttcactt

SEQ ID NO: 969353 - DNA, 22 bp, Artificial Sequence
  chemically synthesized
ccttagatagttaaatttcact

SEQ ID NO: 969354 - DNA, 22 bp, Artificial Sequence
  chemically synthesized
tccttagatagttaaatttcac

SEQ ID NO: 969355 - DNA, 22 bp, Artificial Sequence
  chemically synthesized
acacattttccttagatagtta

SEQ ID NO: 969356 - DNA, 22 bp, Artificial Sequence
  chemically synthesized
cacacattttccttagatagtt

SEQ ID NO: 969357 - DNA, 22 bp, Artificial Sequence
  chemically synthesized
tcacacattttccttagatagt

SEQ ID NO: 969358 - DNA, 22 bp, Artificial Sequence
  chemically synthesized
aatatgtctttcacacattttc

SEQ ID NO: 969359 - DNA, 22 bp, Artificial Sequence
  chemically synthesized
aactatctaaggaaaatgtgtg

SEQ ID NO: 969360 - DNA, 22 bp, Artificial Sequence
  chemically synthesized
aaatatgtctttcacacatttt

SEQ ID NO: 969361 - DNA, 22 bp, Artificial Sequence
  chemically synthesized
actatctaaggaaaatgtgtga

SEQ ID NO: 969362 - DNA, 22 bp, Artificial Sequence
  chemically synthesized
tctaaggaaaatgtgtgaaaga

SEQ ID NO: 969363 - DNA, 22 bp, Artificial Sequence
  chemically synthesized
aggaaaatgtgtgaaagacata

SEQ ID NO: 969364 - DNA, 22 bp, Artificial Sequence
  chemically synthesized
gtgacagggatttaaatatgtc

SEQ ID NO: 969365 - DNA, 22 bp, Artificial Sequence
  chemically synthesized
ttagtgacagggatttaaatat

SEQ ID NO: 969366 - DNA, 22 bp, Artificial Sequence
  chemically synthesized
gttagtgacagggatttaaata

SEQ ID NO: 969367 - DNA, 22 bp, Artificial Sequence
  chemically synthesized
tgttagtgacagggatttaaat

SEQ ID NO: 969368 - DNA, 22 bp, Artificial Sequence
  chemically synthesized
agctttgttagtgacagggatt

SEQ ID NO: 969369 - DNA, 22 bp, Artificial Sequence
  chemically synthesized
cagctttgttagtgacagggat

SEQ ID NO: 969370 - DNA, 22 bp, Artificial Sequence
  chemically synthesized
cttcagctttgttagtgacagg

SEQ ID NO: 969371 - DNA, 22 bp, Artificial Sequence
  chemically synthesized
ccttcagctttgttagtgacag

SEQ ID NO: 969372 - DNA, 22 bp, Artificial Sequence
  chemically synthesized
ttccttcagctttgttagtgac

SEQ ID NO: 969373 - DNA, 22 bp, Artificial Sequence
  chemically synthesized
aaatccctgtcactaacaaagc

SEQ ID NO: 969374 - DNA, 22 bp, Artificial Sequence
  chemically synthesized
aatccctgtcactaacaaagct

SEQ ID NO: 969375 - DNA, 22 bp, Artificial Sequence
  chemically synthesized
aagacactcttccttcagcttt

SEQ ID NO: 969376 - DNA, 22 bp, Artificial Sequence
  chemically synthesized
tcactaacaaagctgaaggaag

SEQ ID NO: 969377 - DNA, 22 bp, Artificial Sequence
  chemically synthesized
taatctgaagacactcttcctt

SEQ ID NO: 969378 - DNA, 22 bp, Artificial Sequence
  chemically synthesized
acaaagctgaaggaagagtgtc

SEQ ID NO: 969379 - DNA, 22 bp, Artificial Sequence
  chemically synthesized
aaggaagagtgtcttcagatta

SEQ ID NO: 969380 - DNA, 22 bp, Artificial Sequence
  chemically synthesized
atgtaggtagaagaaacacctg

SEQ ID NO: 969381 - DNA, 22 bp, Artificial Sequence
  chemically synthesized
catgtaggtagaagaaacacct

SEQ ID NO: 969382 - DNA, 22 bp, Artificial Sequence
  chemically synthesized
tcatgtaggtagaagaaacacc

SEQ ID NO: 969383 - DNA, 22 bp, Artificial Sequence
  chemically synthesized
cagattacaggtgtttcttcta

SEQ ID NO: 969384 - DNA, 22 bp, Artificial Sequence
  chemically synthesized
agattacaggtgtttcttctac

SEQ ID NO: 969385 - DNA, 22 bp, Artificial Sequence
  chemically synthesized
ccaggttttcatgtaggtagaa

SEQ ID NO: 969386 - DNA, 22 bp, Artificial Sequence
  chemically synthesized
cccaggttttcatgtaggtaga

SEQ ID NO: 969387 - DNA, 22 bp, Artificial Sequence
  chemically synthesized
caggtgtttcttctacctacat

SEQ ID NO: 969388 - DNA, 22 bp, Artificial Sequence
  chemically synthesized
cccatttcccaggttttcatgt

SEQ ID NO: 969389 - DNA, 22 bp, Artificial Sequence
  chemically synthesized
gcccatttcccaggttttcatg

SEQ ID NO: 969390 - DNA, 22 bp, Artificial Sequence
  chemically synthesized
cttctacctacatgaaaacctg

SEQ ID NO: 969391 - DNA, 22 bp, Artificial Sequence
  chemically synthesized
ttctacctacatgaaaacctgg

SEQ ID NO: 969392 - DNA, 22 bp, Artificial Sequence
  chemically synthesized
acttgcccatttcccaggtttt

SEQ ID NO: 969393 - DNA, 22 bp, Artificial Sequence
  chemically synthesized
ctacctacatgaaaacctggga

SEQ ID NO: 969394 - DNA, 22 bp, Artificial Sequence
  chemically synthesized
cacttgcccatttcccaggttt

SEQ ID NO: 969395 - DNA, 22 bp, Artificial Sequence
  chemically synthesized
tacctacatgaaaacctgggaa

SEQ ID NO: 969396 - DNA, 22 bp, Artificial Sequence
  chemically synthesized
ttcacttgcccatttcccaggt

SEQ ID NO: 969397 - DNA, 22 bp, Artificial Sequence
  chemically synthesized
cctacatgaaaacctgggaaat

SEQ ID NO: 969398 - DNA, 22 bp, Artificial Sequence
  chemically synthesized
catgaaaacctgggaaatgggc

SEQ ID NO: 969399 - DNA, 22 bp, Artificial Sequence
  chemically synthesized
tgctcttcacttgcccatttcc

SEQ ID NO: 969400 - DNA, 22 bp, Artificial Sequence
  chemically synthesized
ggaaatgggcaagtgaagagca

SEQ ID NO: 969401 - DNA, 22 bp, Artificial Sequence
  chemically synthesized
agagataaatctgtgctcttca

SEQ ID NO: 969402 - DNA, 22 bp, Artificial Sequence
  chemically synthesized
cagagataaatctgtgctcttc

SEQ ID NO: 969403 - DNA, 22 bp, Artificial Sequence
  chemically synthesized
ttcagagataaatctgtgctct

SEQ ID NO: 969404 - DNA, 22 bp, Artificial Sequence
  chemically synthesized
cttcagagataaatctgtgctc

SEQ ID NO: 969405 - DNA, 22 bp, Artificial Sequence
  chemically synthesized
tcttcagagataaatctgtgct

SEQ ID NO: 969406 - DNA, 22 bp, Artificial Sequence
  chemically synthesized
tttcttcagagataaatctgtg

SEQ ID NO: 969407 - DNA, 22 bp, Artificial Sequence
  chemically synthesized
taaggtgggagggttctttctt

SEQ ID NO: 969408 - DNA, 22 bp, Artificial Sequence
  chemically synthesized
atctctgaagaaagaaccctcc

SEQ ID NO: 969409 - DNA, 22 bp, Artificial Sequence
  chemically synthesized
tctctgaagaaagaaccctccc

SEQ ID NO: 969410 - DNA, 22 bp, Artificial Sequence
  chemically synthesized
gtagctgtaaggtgggagggtt

SEQ ID NO: 969411 - DNA, 22 bp, Artificial Sequence
  chemically synthesized
tagtagctgtaaggtgggaggg

SEQ ID NO: 969412 - DNA, 22 bp, Artificial Sequence
  chemically synthesized
tgaagaaagaaccctcccacct

SEQ ID NO: 969413 - DNA, 22 bp, Artificial Sequence
  chemically synthesized
aagaaagaaccctcccacctta

SEQ ID NO: 969414 - DNA, 22 bp, Artificial Sequence
  chemically synthesized
accactctagtagctgtaaggt

SEQ ID NO: 969415 - DNA, 22 bp, Artificial Sequence
  chemically synthesized
ccaccttacagctactagagtg

SEQ ID NO: 969416 - DNA, 22 bp, Artificial Sequence
  chemically synthesized
aaagtgggttgaccactctagt

SEQ ID NO: 969417 - DNA, 22 bp, Artificial Sequence
  chemically synthesized
aaaagtgggttgaccactctag

SEQ ID NO: 969418 - DNA, 22 bp, Artificial Sequence
  chemically synthesized
acagctactagagtggtcaacc

SEQ ID NO: 969419 - DNA, 22 bp, Artificial Sequence
  chemically synthesized
cagctactagagtggtcaaccc

SEQ ID NO: 969420 - DNA, 22 bp, Artificial Sequence
  chemically synthesized
ctagagtggtcaacccactttt

SEQ ID NO: 969421 - DNA, 22 bp, Artificial Sequence
  chemically synthesized
gagtggtcaacccacttttaag

SEQ ID NO: 969422 - DNA, 22 bp, Artificial Sequence
  chemically synthesized
acgaataatccccaccttaaaa

SEQ ID NO: 969423 - DNA, 22 bp, Artificial Sequence
  chemically synthesized
tggataacgctgacgaataatc

SEQ ID NO: 969424 - DNA, 22 bp, Artificial Sequence
  chemically synthesized
ttaaggtggggattattcgtca

SEQ ID NO: 969425 - DNA, 22 bp, Artificial Sequence
  chemically synthesized
taaggtggggattattcgtcag

SEQ ID NO: 969426 - DNA, 22 bp, Artificial Sequence
  chemically synthesized
aaggtggggattattcgtcagc

SEQ ID NO: 969427 - DNA, 22 bp, Artificial Sequence
  chemically synthesized
aggtggggattattcgtcagcg

SEQ ID NO: 969428 - DNA, 22 bp, Artificial Sequence
  chemically synthesized
aggctgtggataacgctgacga

SEQ ID NO: 969429 - DNA, 22 bp, Artificial Sequence
  chemically synthesized
cctgaggctgtggataacgctg

SEQ ID NO: 969430 - DNA, 22 bp, Artificial Sequence
  chemically synthesized
ccctgaggctgtggataacgct

SEQ ID NO: 969431 - DNA, 22 bp, Artificial Sequence
  chemically synthesized
ttcgtcagcgttatccacagcc

SEQ ID NO: 969432 - DNA, 22 bp, Artificial Sequence
  chemically synthesized
gtcagcgttatccacagcctca

SEQ ID NO: 969433 - DNA, 22 bp, Artificial Sequence
  chemically synthesized
aggagtatttccctgaggctgt

SEQ ID NO: 969434 - DNA, 22 bp, Artificial Sequence
  chemically synthesized
gaggagtatttccctgaggctg

SEQ ID NO: 969435 - DNA, 22 bp, Artificial Sequence
  chemically synthesized
tgaggagtatttccctgaggct

SEQ ID NO: 969436 - DNA, 22 bp, Artificial Sequence
  chemically synthesized
tccacagcctcagggaaatact

SEQ ID NO: 969437 - DNA, 22 bp, Artificial Sequence
  chemically synthesized
agggaaatactcctcaaagaca

SEQ ID NO: 969438 - DNA, 22 bp, Artificial Sequence
  chemically synthesized
ctcaaagacatctcattccttg

SEQ ID NO: 969439 - DNA, 22 bp, Artificial Sequence
  chemically synthesized
aaagacatctcattccttgctc

SEQ ID NO: 969440 - DNA, 22 bp, Artificial Sequence
  chemically synthesized
atgatcagaagcaatggagcaa

SEQ ID NO: 969441 - DNA, 22 bp, Artificial Sequence
  chemically synthesized
catgatcagaagcaatggagca

SEQ ID NO: 969442 - DNA, 22 bp, Artificial Sequence
  chemically synthesized
attccttgctccattgcttctg

SEQ ID NO: 969443 - DNA, 22 bp, Artificial Sequence
  chemically synthesized
cttgctccattgcttctgatca

SEQ ID NO: 969444 - DNA, 22 bp, Artificial Sequence
  chemically synthesized
gctccattgcttctgatcatga

SEQ ID NO: 969445 - DNA, 22 bp, Artificial Sequence
  chemically synthesized
ctccattgcttctgatcatgaa

SEQ ID NO: 969446 - DNA, 22 bp, Artificial Sequence
  chemically synthesized
cattgcttctgatcatgaagtc

SEQ ID NO: 969447 - DNA, 22 bp, Artificial Sequence
  chemically synthesized
cttctgatcatgaagtccgttt

SEQ ID NO: 969448 - DNA, 22 bp, Artificial Sequence
  chemically synthesized
ctgatcatgaagtccgtttcat

SEQ ID NO: 969449 - DNA, 22 bp, Artificial Sequence
  chemically synthesized
tgatcatgaagtccgtttcatg

SEQ ID NO: 969450 - DNA, 22 bp, Artificial Sequence
  chemically synthesized
gagagcgatgatcatgaaacgg

SEQ ID NO: 969451 - DNA, 22 bp, Artificial Sequence
  chemically synthesized
atcatgaagtccgtttcatgat

SEQ ID NO: 969452 - DNA, 22 bp, Artificial Sequence
  chemically synthesized
gaattagagagcgatgatcatg

SEQ ID NO: 969453 - DNA, 22 bp, Artificial Sequence
  chemically synthesized
agaattagagagcgatgatcat

SEQ ID NO: 969454 - DNA, 22 bp, Artificial Sequence
  chemically synthesized
tagaattagagagcgatgatca

SEQ ID NO: 969455 - DNA, 22 bp, Artificial Sequence
  chemically synthesized
gaagttttagaattagagagcg

SEQ ID NO: 969456 - DNA, 22 bp, Artificial Sequence
  chemically synthesized
catgatcatcgctctctaattc

SEQ ID NO: 969457 - DNA, 22 bp, Artificial Sequence
  chemically synthesized
atgatcatcgctctctaattct

SEQ ID NO: 969458 - DNA, 22 bp, Artificial Sequence
  chemically synthesized
atggttagaagttttagaatta

SEQ ID NO: 969459 - DNA, 22 bp, Artificial Sequence
  chemically synthesized
tctcatggttagaagttttaga

SEQ ID NO: 969460 - DNA, 22 bp, Artificial Sequence
  chemically synthesized
atctcatggttagaagttttag

SEQ ID NO: 969461 - DNA, 22 bp, Artificial Sequence
  chemically synthesized
tctaattctaaaacttctaacc

SEQ ID NO: 969462 - DNA, 22 bp, Artificial Sequence
  chemically synthesized
taattctaaaacttctaaccat

SEQ ID NO: 969463 - DNA, 22 bp, Artificial Sequence
  chemically synthesized
gaaacttatctcatggttagaa

SEQ ID NO: 969464 - DNA, 22 bp, Artificial Sequence
  chemically synthesized
agaaacttatctcatggttaga

SEQ ID NO: 969465 - DNA, 22 bp, Artificial Sequence
  chemically synthesized
attctaaaacttctaaccatga

SEQ ID NO: 969466 - DNA, 22 bp, Artificial Sequence
  chemically synthesized
taaaacttctaaccatgagata

SEQ ID NO: 969467 - DNA, 22 bp, Artificial Sequence
  chemically synthesized
aaacttctaaccatgagataag

SEQ ID NO: 969468 - DNA, 22 bp, Artificial Sequence
  chemically synthesized
ctaaccatgagataagtttcta

SEQ ID NO: 969469 - DNA, 22 bp, Artificial Sequence
  chemically synthesized
taaccatgagataagtttctaa

SEQ ID NO: 969470 - DNA, 22 bp, Artificial Sequence
  chemically synthesized
accatgagataagtttctaagt

SEQ ID NO: 969471 - DNA, 22 bp, Artificial Sequence
  chemically synthesized
agtgtgtgagggtaacttagaa

SEQ ID NO: 969472 - DNA, 22 bp, Artificial Sequence
  chemically synthesized
gatacctgagtgtgtgagggta

SEQ ID NO: 969473 - DNA, 22 bp, Artificial Sequence
  chemically synthesized
ctaagttaccctcacacactca

SEQ ID NO: 969474 - DNA, 22 bp, Artificial Sequence
  chemically synthesized
taagttaccctcacacactcag

SEQ ID NO: 969475 - DNA, 22 bp, Artificial Sequence
  chemically synthesized
agaaactggatacctgagtgtg

SEQ ID NO: 969476 - DNA, 22 bp, Artificial Sequence
  chemically synthesized
agttaccctcacacactcaggt

SEQ ID NO: 969477 - DNA, 22 bp, Artificial Sequence
  chemically synthesized
cagaaactggatacctgagtgt

SEQ ID NO: 969478 - DNA, 22 bp, Artificial Sequence
  chemically synthesized
tcagaaactggatacctgagtg

SEQ ID NO: 969479 - DNA, 22 bp, Artificial Sequence
  chemically synthesized
ttcagaaactggatacctgagt

SEQ ID NO: 969480 - DNA, 22 bp, Artificial Sequence
  chemically synthesized
ccctcacacactcaggtatcca

SEQ ID NO: 969481 - DNA, 22 bp, Artificial Sequence
  chemically synthesized
ccttttcagaaactggatacct

SEQ ID NO: 969482 - DNA, 22 bp, Artificial Sequence
  chemically synthesized
acacactcaggtatccagtttc

SEQ ID NO: 969483 - DNA, 22 bp, Artificial Sequence
  chemically synthesized
tactaccttttcagaaactgga

SEQ ID NO: 969484 - DNA, 22 bp, Artificial Sequence
  chemically synthesized
gtactaccttttcagaaactgg

SEQ ID NO: 969485 - DNA, 22 bp, Artificial Sequence
  chemically synthesized
cttgtactaccttttcagaaac

SEQ ID NO: 969486 - DNA, 22 bp, Artificial Sequence
  chemically synthesized
aggtatccagtttctgaaaagg

SEQ ID NO: 969487 - DNA, 22 bp, Artificial Sequence
  chemically synthesized
acattacttgtactaccttttc

SEQ ID NO: 969488 - DNA, 22 bp, Artificial Sequence
  chemically synthesized
attcacattacttgtactacct

SEQ ID NO: 969489 - DNA, 22 bp, Artificial Sequence
  chemically synthesized
cattcacattacttgtactacc

SEQ ID NO: 969490 - DNA, 22 bp, Artificial Sequence
  chemically synthesized
tcattcacattacttgtactac

SEQ ID NO: 969491 - DNA, 22 bp, Artificial Sequence
  chemically synthesized
tttcattcacattacttgtact

SEQ ID NO: 969492 - DNA, 22 bp, Artificial Sequence
  chemically synthesized
ctgaaaaggtagtacaagtaat

SEQ ID NO: 969493 - DNA, 22 bp, Artificial Sequence
  chemically synthesized
tgaaaaggtagtacaagtaatg

SEQ ID NO: 969494 - DNA, 22 bp, Artificial Sequence
  chemically synthesized
aaaaggtagtacaagtaatgtg

SEQ ID NO: 969495 - DNA, 22 bp, Artificial Sequence
  chemically synthesized
agaatcatatccaaaccggaat

SEQ ID NO: 969496 - DNA, 22 bp, Artificial Sequence
  chemically synthesized
cggtttggatatgattctgaat

SEQ ID NO: 969497 - DNA, 22 bp, Artificial Sequence
  chemically synthesized
ggatatgattctgaattttggg

SEQ ID NO: 969498 - DNA, 22 bp, Artificial Sequence
  chemically synthesized
gatatgattctgaattttgggt

SEQ ID NO: 969499 - DNA, 22 bp, Artificial Sequence
  chemically synthesized
tcccagcagaaaaaaaaaaccc

SEQ ID NO: 969500 - DNA, 22 bp, Artificial Sequence
  chemically synthesized
tgaattttgggttttttttttc

SEQ ID NO: 969501 - DNA, 22 bp, Artificial Sequence
  chemically synthesized
gattgtcccagcagaaaaaaaa

SEQ ID NO: 969502 - DNA, 22 bp, Artificial Sequence
  chemically synthesized
aattttgggttttttttttctg

SEQ ID NO: 969503 - DNA, 22 bp, Artificial Sequence
  chemically synthesized
gattggattgtcccagcagaaa

SEQ ID NO: 969504 - DNA, 22 bp, Artificial Sequence
  chemically synthesized
tgggttttttttttctgctggg

SEQ ID NO: 969505 - DNA, 22 bp, Artificial Sequence
  chemically synthesized
gggttttttttttctgctggga

SEQ ID NO: 969506 - DNA, 22 bp, Artificial Sequence
  chemically synthesized
ggttttttttttctgctgggac

SEQ ID NO: 969507 - DNA, 22 bp, Artificial Sequence
  chemically synthesized
acctagattggattgtcccagc

SEQ ID NO: 969508 - DNA, 22 bp, Artificial Sequence
  chemically synthesized
tttttttctgctgggacaatcc

SEQ ID NO: 969509 - DNA, 22 bp, Artificial Sequence
  chemically synthesized
ttttttctgctgggacaatcca

SEQ ID NO: 969510 - DNA, 22 bp, Artificial Sequence
  chemically synthesized
gctcacctagattggattgtcc

SEQ ID NO: 969511 - DNA, 22 bp, Artificial Sequence
  chemically synthesized
tttttctgctgggacaatccaa

SEQ ID NO: 969512 - DNA, 22 bp, Artificial Sequence
  chemically synthesized
ttttctgctgggacaatccaat

SEQ ID NO: 969513 - DNA, 22 bp, Artificial Sequence
  chemically synthesized
tttctgctgggacaatccaatc

SEQ ID NO: 969514 - DNA, 22 bp, Artificial Sequence
  chemically synthesized
ttctgctgggacaatccaatct

SEQ ID NO: 969515 - DNA, 22 bp, Artificial Sequence
  chemically synthesized
tctgctgggacaatccaatcta

SEQ ID NO: 969516 - DNA, 22 bp, Artificial Sequence
  chemically synthesized
ggttggctcacctagattggat

SEQ ID NO: 969517 - DNA, 22 bp, Artificial Sequence
  chemically synthesized
ctgctgggacaatccaatctag

SEQ ID NO: 969518 - DNA, 22 bp, Artificial Sequence
  chemically synthesized
tgctgggacaatccaatctagg

SEQ ID NO: 969519 - DNA, 22 bp, Artificial Sequence
  chemically synthesized
ctgggacaatccaatctaggtg

SEQ ID NO: 969520 - DNA, 22 bp, Artificial Sequence
  chemically synthesized
ggacaatccaatctaggtgagc

SEQ ID NO: 969521 - DNA, 22 bp, Artificial Sequence
  chemically synthesized
agcattgggttggctcacctag

SEQ ID NO: 969522 - DNA, 22 bp, Artificial Sequence
  chemically synthesized
tccctcagcattgggttggctc

SEQ ID NO: 969523 - DNA, 22 bp, Artificial Sequence
  chemically synthesized
ggtgagccaacccaatgctgag

SEQ ID NO: 969524 - DNA, 22 bp, Artificial Sequence
  chemically synthesized
accagggtctgtccctcagcat

SEQ ID NO: 969525 - DNA, 22 bp, Artificial Sequence
  chemically synthesized
aaccagggtctgtccctcagca

SEQ ID NO: 969526 - DNA, 22 bp, Artificial Sequence
  chemically synthesized
taaccagggtctgtccctcagc

SEQ ID NO: 969527 - DNA, 22 bp, Artificial Sequence
  chemically synthesized
ctttaaccagggtctgtccctc

SEQ ID NO: 969528 - DNA, 22 bp, Artificial Sequence
  chemically synthesized
aagcatctcctttaaccagggt

SEQ ID NO: 969529 - DNA, 22 bp, Artificial Sequence
  chemically synthesized
agggacagaccctggttaaagg

SEQ ID NO: 969530 - DNA, 22 bp, Artificial Sequence
  chemically synthesized
tgttgaagcatctcctttaacc

SEQ ID NO: 969531 - DNA, 22 bp, Artificial Sequence
  chemically synthesized
gttaaaggagatgcttcaacac

SEQ ID NO: 969532 - DNA, 22 bp, Artificial Sequence
  chemically synthesized
ataggatggcctgtgttgaagc

SEQ ID NO: 969533 - DNA, 22 bp, Artificial Sequence
  chemically synthesized
aaggagatgcttcaacacaggc

SEQ ID NO: 969534 - DNA, 22 bp, Artificial Sequence
  chemically synthesized
agacagcacctcataggatggc

SEQ ID NO: 969535 - DNA, 22 bp, Artificial Sequence
  chemically synthesized
tcagacagcacctcataggatg

SEQ ID NO: 969536 - DNA, 22 bp, Artificial Sequence
  chemically synthesized
caacacaggccatcctatgagg

SEQ ID NO: 969537 - DNA, 22 bp, Artificial Sequence
  chemically synthesized
aacacaggccatcctatgaggt

SEQ ID NO: 969538 - DNA, 22 bp, Artificial Sequence
  chemically synthesized
gcctctcagacagcacctcata

SEQ ID NO: 969539 - DNA, 22 bp, Artificial Sequence
  chemically synthesized
actggcctctcagacagcacct

SEQ ID NO: 969540 - DNA, 22 bp, Artificial Sequence
  chemically synthesized
tgaggtgctgtctgagaggcca

SEQ ID NO: 969541 - DNA, 22 bp, Artificial Sequence
  chemically synthesized
agagaggttgactggcctctca

SEQ ID NO: 969542 - DNA, 22 bp, Artificial Sequence
  chemically synthesized
cagagaggttgactggcctctc

SEQ ID NO: 969543 - DNA, 22 bp, Artificial Sequence
  chemically synthesized
tcagagaggttgactggcctct

SEQ ID NO: 969544 - DNA, 22 bp, Artificial Sequence
  chemically synthesized
tctgagaggccagtcaacctct

SEQ ID NO: 969545 - DNA, 22 bp, Artificial Sequence
  chemically synthesized
agaggccagtcaacctctctga

SEQ ID NO: 969546 - DNA, 22 bp, Artificial Sequence
  chemically synthesized
aacacatgagcagagctttcag

SEQ ID NO: 969547 - DNA, 22 bp, Artificial Sequence
  chemically synthesized
aaaattaaacacatgagcagag

SEQ ID NO: 969548 - DNA, 22 bp, Artificial Sequence
  chemically synthesized
ctgaaaattaaacacatgagca

SEQ ID NO: 969549 - DNA, 22 bp, Artificial Sequence
  chemically synthesized
tctgaaagctctgctcatgtgt

SEQ ID NO: 969550 - DNA, 22 bp, Artificial Sequence
  chemically synthesized
tgaaagctctgctcatgtgttt

SEQ ID NO: 969551 - DNA, 22 bp, Artificial Sequence
  chemically synthesized
aaagctctgctcatgtgtttaa

SEQ ID NO: 969552 - DNA, 22 bp, Artificial Sequence
  chemically synthesized
tgctcatgtgtttaattttcag

SEQ ID NO: 969553 - DNA, 22 bp, Artificial Sequence
  chemically synthesized
caatatccgttgctgaaaatta

SEQ ID NO: 969554 - DNA, 22 bp, Artificial Sequence
  chemically synthesized
gcaatatccgttgctgaaaatt

SEQ ID NO: 969555 - DNA, 22 bp, Artificial Sequence
  chemically synthesized
ctcatgtgtttaattttcagca

SEQ ID NO: 969556 - DNA, 22 bp, Artificial Sequence
  chemically synthesized
ttgcaatatccgttgctgaaaa

SEQ ID NO: 969557 - DNA, 22 bp, Artificial Sequence
  chemically synthesized
atgtgtttaattttcagcaacg

SEQ ID NO: 969558 - DNA, 22 bp, Artificial Sequence
  chemically synthesized
tcttgcaatatccgttgctgaa

SEQ ID NO: 969559 - DNA, 22 bp, Artificial Sequence
  chemically synthesized
ctcttgcaatatccgttgctga

SEQ ID NO: 969560 - DNA, 22 bp, Artificial Sequence
  chemically synthesized
tctcttgcaatatccgttgctg

SEQ ID NO: 969561 - DNA, 22 bp, Artificial Sequence
  chemically synthesized
ttctcttgcaatatccgttgct

SEQ ID NO: 969562 - DNA, 22 bp, Artificial Sequence
  chemically synthesized
aattttcagcaacggatattgc

SEQ ID NO: 969563 - DNA, 22 bp, Artificial Sequence
  chemically synthesized
attttcagcaacggatattgca

SEQ ID NO: 969564 - DNA, 22 bp, Artificial Sequence
  chemically synthesized
tcagcaacggatattgcaagag

SEQ ID NO: 969565 - DNA, 22 bp, Artificial Sequence
  chemically synthesized
cagcaacggatattgcaagaga

SEQ ID NO: 969566 - DNA, 22 bp, Artificial Sequence
  chemically synthesized
agcaacggatattgcaagagaa

SEQ ID NO: 969567 - DNA, 22 bp, Artificial Sequence
  chemically synthesized
caagagaaaagcatgctctgtc

SEQ ID NO: 969568 - DNA, 22 bp, Artificial Sequence
  chemically synthesized
atcataggaaaatgacagagca

SEQ ID NO: 969569 - DNA, 22 bp, Artificial Sequence
  chemically synthesized
tctaatcataggaaaatgacag

SEQ ID NO: 969570 - DNA, 22 bp, Artificial Sequence
  chemically synthesized
gttgtctaatcataggaaaatg

SEQ ID NO: 969571 - DNA, 22 bp, Artificial Sequence
  chemically synthesized
ttagttgtctaatcataggaaa

SEQ ID NO: 969572 - DNA, 22 bp, Artificial Sequence
  chemically synthesized
attagttgtctaatcataggaa

SEQ ID NO: 969573 - DNA, 22 bp, Artificial Sequence
  chemically synthesized
tttattagttgtctaatcatag

SEQ ID NO: 969574 - DNA, 22 bp, Artificial Sequence
  chemically synthesized
atttattagttgtctaatcata

SEQ ID NO: 969575 - DNA, 22 bp, Artificial Sequence
  chemically synthesized
tgtcattttcctatgattagac

SEQ ID NO: 969576 - DNA, 22 bp, Artificial Sequence
  chemically synthesized
tcattttcctatgattagacaa

SEQ ID NO: 969577 - DNA, 22 bp, Artificial Sequence
  chemically synthesized
gcttatttattagttgtctaat

SEQ ID NO: 969578 - DNA, 22 bp, Artificial Sequence
  chemically synthesized
tcctatgattagacaactaata

SEQ ID NO: 969579 - DNA, 22 bp, Artificial Sequence
  chemically synthesized
cctatgattagacaactaataa

SEQ ID NO: 969580 - DNA, 22 bp, Artificial Sequence
  chemically synthesized
ctatgattagacaactaataaa

SEQ ID NO: 969581 - DNA, 22 bp, Artificial Sequence
  chemically synthesized
tgattagacaactaataaataa

SEQ ID NO: 969582 - DNA, 22 bp, Artificial Sequence
  chemically synthesized
agccagagctggcttatttatt

SEQ ID NO: 969583 - DNA, 22 bp, Artificial Sequence
  chemically synthesized
aagccagagctggcttatttat

SEQ ID NO: 969584 - DNA, 22 bp, Artificial Sequence
  chemically synthesized
gacaactaataaataagccagc

SEQ ID NO: 969585 - DNA, 22 bp, Artificial Sequence
  chemically synthesized
catttaagccagagctggctta

SEQ ID NO: 969586 - DNA, 22 bp, Artificial Sequence
  chemically synthesized
ataaataagccagctctggctt

SEQ ID NO: 969587 - DNA, 22 bp, Artificial Sequence
  chemically synthesized
aaagtgctacatttaagccaga

SEQ ID NO: 969588 - DNA, 22 bp, Artificial Sequence
  chemically synthesized
agttaaaagtgctacatttaag

SEQ ID NO: 969589 - DNA, 22 bp, Artificial Sequence
  chemically synthesized
tggcttaaatgtagcactttta

SEQ ID NO: 969590 - DNA, 22 bp, Artificial Sequence
  chemically synthesized
gcttaaatgtagcacttttaac

SEQ ID NO: 969591 - DNA, 22 bp, Artificial Sequence
  chemically synthesized
aaatgtagcacttttaactcag

SEQ ID NO: 969592 - DNA, 22 bp, Artificial Sequence
  chemically synthesized
aatgtagcacttttaactcagg

SEQ ID NO: 969593 - DNA, 22 bp, Artificial Sequence
  chemically synthesized
ttaactcaggccatgcccattt

SEQ ID NO: 969594 - DNA, 22 bp, Artificial Sequence
  chemically synthesized
taactcaggccatgcccatttt

SEQ ID NO: 969595 - DNA, 22 bp, Artificial Sequence
  chemically synthesized
aactcaggccatgcccattttt

SEQ ID NO: 969596 - DNA, 22 bp, Artificial Sequence
  chemically synthesized
actcaggccatgcccatttttt

SEQ ID NO: 969597 - DNA, 22 bp, Artificial Sequence
  chemically synthesized
aggccatgcccatttttttatg

SEQ ID NO: 969598 - DNA, 22 bp, Artificial Sequence
  chemically synthesized
agaagatgtgtggcataaaaaa

SEQ ID NO: 969599 - DNA, 22 bp, Artificial Sequence
  chemically synthesized
tgcctgagaagatgtgtggcat

SEQ ID NO: 969600 - DNA, 22 bp, Artificial Sequence
  chemically synthesized
ccgctgtgcctgagaagatgtg

SEQ ID NO: 969601 - DNA, 22 bp, Artificial Sequence
  chemically synthesized
ttttatgccacacatcttctca

SEQ ID NO: 969602 - DNA, 22 bp, Artificial Sequence
  chemically synthesized
tttatgccacacatcttctcag

SEQ ID NO: 969603 - DNA, 22 bp, Artificial Sequence
  chemically synthesized
ttatgccacacatcttctcagg

SEQ ID NO: 969604 - DNA, 22 bp, Artificial Sequence
  chemically synthesized
tatgccacacatcttctcaggc

SEQ ID NO: 969605 - DNA, 22 bp, Artificial Sequence
  chemically synthesized
atgccacacatcttctcaggca

SEQ ID NO: 969606 - DNA, 22 bp, Artificial Sequence
  chemically synthesized
tgccacacatcttctcaggcac

SEQ ID NO: 969607 - DNA, 22 bp, Artificial Sequence
  chemically synthesized
cgccgcaagtgtgttcccgctg

SEQ ID NO: 969608 - DNA, 22 bp, Artificial Sequence
  chemically synthesized
ctacgccgcaagtgtgttcccg

SEQ ID NO: 969609 - DNA, 22 bp, Artificial Sequence
  chemically synthesized
ctcaggcacagcgggaacacac

SEQ ID NO: 969610 - DNA, 22 bp, Artificial Sequence
  chemically synthesized
tcaggcacagcgggaacacact

SEQ ID NO: 969611 - DNA, 22 bp, Artificial Sequence
  chemically synthesized
ctgctacgccgcaagtgtgttc

SEQ ID NO: 969612 - DNA, 22 bp, Artificial Sequence
  chemically synthesized
aggcacagcgggaacacacttg

SEQ ID NO: 969613 - DNA, 22 bp, Artificial Sequence
  chemically synthesized
ctgctgctacgccgcaagtgtg

SEQ ID NO: 969614 - DNA, 22 bp, Artificial Sequence
  chemically synthesized
aaaaaaatcatctgctgctgct

SEQ ID NO: 969615 - DNA, 22 bp, Artificial Sequence
  chemically synthesized
gaaaaaaatcatctgctgctgc

SEQ ID NO: 969616 - DNA, 22 bp, Artificial Sequence
  chemically synthesized
tgaaaaaaatcatctgctgctg

SEQ ID NO: 969617 - DNA, 22 bp, Artificial Sequence
  chemically synthesized
tttgaaaaaaatcatctgctgc

SEQ ID NO: 969618 - DNA, 22 bp, Artificial Sequence
  chemically synthesized
gcggcgtagcagcagcagatga

SEQ ID NO: 969619 - DNA, 22 bp, Artificial Sequence
  chemically synthesized
ctttgaaaaaaatcatctgctg

SEQ ID NO: 969620 - DNA, 22 bp, Artificial Sequence
  chemically synthesized
cggcgtagcagcagcagatgat

SEQ ID NO: 969621 - DNA, 22 bp, Artificial Sequence
  chemically synthesized
ttctttgaaaaaaatcatctgc

SEQ ID NO: 969622 - DNA, 22 bp, Artificial Sequence
  chemically synthesized
tcttctttgaaaaaaatcatct

SEQ ID NO: 969623 - DNA, 22 bp, Artificial Sequence
  chemically synthesized
ctcttctttgaaaaaaatcatc

SEQ ID NO: 969624 - DNA, 22 bp, Artificial Sequence
  chemically synthesized
ttctcttctttgaaaaaaatca

SEQ ID NO: 969625 - DNA, 22 bp, Artificial Sequence
  chemically synthesized
tcttctcttctttgaaaaaaat

SEQ ID NO: 969626 - DNA, 22 bp, Artificial Sequence
  chemically synthesized
ctcttctcttctttgaaaaaaa

SEQ ID NO: 969627 - DNA, 22 bp, Artificial Sequence
  chemically synthesized
ccaaaggtgtcttctcttctct

SEQ ID NO: 969628 - DNA, 22 bp, Artificial Sequence
  chemically synthesized
gccaaaggtgtcttctcttctc

SEQ ID NO: 969629 - DNA, 22 bp, Artificial Sequence
  chemically synthesized
ttttcaaagaagagaagagaag

SEQ ID NO: 969630 - DNA, 22 bp, Artificial Sequence
  chemically synthesized
tgccaaaggtgtcttctcttct

SEQ ID NO: 969631 - DNA, 22 bp, Artificial Sequence
  chemically synthesized
tttcaaagaagagaagagaaga

SEQ ID NO: 969632 - DNA, 22 bp, Artificial Sequence
  chemically synthesized
ttcaaagaagagaagagaagac

SEQ ID NO: 969633 - DNA, 22 bp, Artificial Sequence
  chemically synthesized
tcaaagaagagaagagaagaca

SEQ ID NO: 969634 - DNA, 22 bp, Artificial Sequence
  chemically synthesized
ttttgccaaaggtgtcttctct

SEQ ID NO: 969635 - DNA, 22 bp, Artificial Sequence
  chemically synthesized
caaagaagagaagagaagacac

SEQ ID NO: 969636 - DNA, 22 bp, Artificial Sequence
  chemically synthesized
aaagaagagaagagaagacacc

SEQ ID NO: 969637 - DNA, 22 bp, Artificial Sequence
  chemically synthesized
tcagcactgttttgccaaaggt

SEQ ID NO: 969638 - DNA, 22 bp, Artificial Sequence
  chemically synthesized
atcagcactgttttgccaaagg

SEQ ID NO: 969639 - DNA, 22 bp, Artificial Sequence
  chemically synthesized
gtttatcagcactgttttgcca

SEQ ID NO: 969640 - DNA, 22 bp, Artificial Sequence
  chemically synthesized
ttagtttatcagcactgttttg

SEQ ID NO: 969641 - DNA, 22 bp, Artificial Sequence
  chemically synthesized
actattagtttatcagcactgt

SEQ ID NO: 969642 - DNA, 22 bp, Artificial Sequence
  chemically synthesized
ctgactattagtttatcagcac

SEQ ID NO: 969643 - DNA, 22 bp, Artificial Sequence
  chemically synthesized
tggcaaaacagtgctgataaac

SEQ ID NO: 969644 - DNA, 22 bp, Artificial Sequence
  chemically synthesized
ggcaaaacagtgctgataaact

SEQ ID NO: 969645 - DNA, 22 bp, Artificial Sequence
  chemically synthesized
gcaaaacagtgctgataaacta

SEQ ID NO: 969646 - DNA, 22 bp, Artificial Sequence
  chemically synthesized
tcaaagctcctgactattagtt

SEQ ID NO: 969647 - DNA, 22 bp, Artificial Sequence
  chemically synthesized
tgtcaaagctcctgactattag

SEQ ID NO: 969648 - DNA, 22 bp, Artificial Sequence
  chemically synthesized
acattctgtcaaagctcctgac

SEQ ID NO: 969649 - DNA, 22 bp, Artificial Sequence
  chemically synthesized
ataaactaatagtcaggagctt

SEQ ID NO: 969650 - DNA, 22 bp, Artificial Sequence
  chemically synthesized
aacattctgtcaaagctcctga

SEQ ID NO: 969651 - DNA, 22 bp, Artificial Sequence
  chemically synthesized
taacattctgtcaaagctcctg

SEQ ID NO: 969652 - DNA, 22 bp, Artificial Sequence
  chemically synthesized
tttaacattctgtcaaagctcc

SEQ ID NO: 969653 - DNA, 22 bp, Artificial Sequence
  chemically synthesized
ctttaacattctgtcaaagctc

SEQ ID NO: 969654 - DNA, 22 bp, Artificial Sequence
  chemically synthesized
tctttaacattctgtcaaagct

SEQ ID NO: 969655 - DNA, 22 bp, Artificial Sequence
  chemically synthesized
ttctttaacattctgtcaaagc

SEQ ID NO: 969656 - DNA, 22 bp, Artificial Sequence
  chemically synthesized
atagtcaggagctttgacagaa

SEQ ID NO: 969657 - DNA, 22 bp, Artificial Sequence
  chemically synthesized
tgacagaatgttaaagaaaagc

SEQ ID NO: 969658 - DNA, 22 bp, Artificial Sequence
  chemically synthesized
gacagaatgttaaagaaaagct

SEQ ID NO: 969659 - DNA, 22 bp, Artificial Sequence
  chemically synthesized
acagaatgttaaagaaaagctg

SEQ ID NO: 969660 - DNA, 22 bp, Artificial Sequence
  chemically synthesized
aaaaaaatcgaagaaaatcagc

SEQ ID NO: 969661 - DNA, 22 bp, Artificial Sequence
  chemically synthesized
aagaaaagctgattttcttcga

SEQ ID NO: 969662 - DNA, 22 bp, Artificial Sequence
  chemically synthesized
tcctgaaaaaaatcgaagaaaa

SEQ ID NO: 969663 - DNA, 22 bp, Artificial Sequence
  chemically synthesized
attttcttcgatttttttcagg

SEQ ID NO: 969664 - DNA, 22 bp, Artificial Sequence
  chemically synthesized
tcttcgatttttttcaggacaa

SEQ ID NO: 969665 - DNA, 22 bp, Artificial Sequence
  chemically synthesized
cttcgatttttttcaggacaac

SEQ ID NO: 969666 - DNA, 22 bp, Artificial Sequence
  chemically synthesized
ttcgatttttttcaggacaaca

SEQ ID NO: 969667 - DNA, 22 bp, Artificial Sequence
  chemically synthesized
cgatttttttcaggacaacatc

SEQ ID NO: 969668 - DNA, 22 bp, Artificial Sequence
  chemically synthesized
aaggataacagagatgttgtcc

SEQ ID NO: 969669 - DNA, 22 bp, Artificial Sequence
  chemically synthesized
gatttttttcaggacaacatct

SEQ ID NO: 969670 - DNA, 22 bp, Artificial Sequence
  chemically synthesized
aattcaaggataacagagatgt

SEQ ID NO: 969671 - DNA, 22 bp, Artificial Sequence
  chemically synthesized
ttttcaggacaacatctctgtt

SEQ ID NO: 969672 - DNA, 22 bp, Artificial Sequence
  chemically synthesized
tttcaggacaacatctctgtta

SEQ ID NO: 969673 - DNA, 22 bp, Artificial Sequence
  chemically synthesized
ttcaggacaacatctctgttat

SEQ ID NO: 969674 - DNA, 22 bp, Artificial Sequence
  chemically synthesized
tcaggacaacatctctgttatc

SEQ ID NO: 969675 - DNA, 22 bp, Artificial Sequence
  chemically synthesized
caggacaacatctctgttatcc

SEQ ID NO: 969676 - DNA, 22 bp, Artificial Sequence
  chemically synthesized
aggacaacatctctgttatcct

SEQ ID NO: 969677 - DNA, 22 bp, Artificial Sequence
  chemically synthesized
tgttatccttgaattgaattct

SEQ ID NO: 969678 - DNA, 22 bp, Artificial Sequence
  chemically synthesized
atgtgtggaataagaattcaat

SEQ ID NO: 969679 - DNA, 22 bp, Artificial Sequence
  chemically synthesized
gatgtgtggaataagaattcaa

SEQ ID NO: 969680 - DNA, 22 bp, Artificial Sequence
  chemically synthesized
ttatccttgaattgaattctta

SEQ ID NO: 969681 - DNA, 22 bp, Artificial Sequence
  chemically synthesized
tgatgtgtggaataagaattca

SEQ ID NO: 969682 - DNA, 22 bp, Artificial Sequence
  chemically synthesized
tccttgaattgaattcttattc

SEQ ID NO: 969683 - DNA, 22 bp, Artificial Sequence
  chemically synthesized
gaattgaattcttattccacac

SEQ ID NO: 969684 - DNA, 22 bp, Artificial Sequence
  chemically synthesized
aattgaattcttattccacaca

SEQ ID NO: 969685 - DNA, 22 bp, Artificial Sequence
  chemically synthesized
gatatggattttgatgtgtgga

SEQ ID NO: 969686 - DNA, 22 bp, Artificial Sequence
  chemically synthesized
agatatggattttgatgtgtgg

SEQ ID NO: 969687 - DNA, 22 bp, Artificial Sequence
  chemically synthesized
aattcttattccacacatcaaa

SEQ ID NO: 969688 - DNA, 22 bp, Artificial Sequence
  chemically synthesized
ttagatatggattttgatgtgt

SEQ ID NO: 969689 - DNA, 22 bp, Artificial Sequence
  chemically synthesized
cttagatatggattttgatgtg

SEQ ID NO: 969690 - DNA, 22 bp, Artificial Sequence
  chemically synthesized
ttattccacacatcaaaatcca

SEQ ID NO: 969691 - DNA, 22 bp, Artificial Sequence
  chemically synthesized
attccacacatcaaaatccata

SEQ ID NO: 969692 - DNA, 22 bp, Artificial Sequence
  chemically synthesized
gtgtttcttagatatggatttt

SEQ ID NO: 969693 - DNA, 22 bp, Artificial Sequence
  chemically synthesized
ttccacacatcaaaatccatat

SEQ ID NO: 969694 - DNA, 22 bp, Artificial Sequence
  chemically synthesized
tggtgtttcttagatatggatt

SEQ ID NO: 969695 - DNA, 22 bp, Artificial Sequence
  chemically synthesized
cacacatcaaaatccatatcta

SEQ ID NO: 969696 - DNA, 22 bp, Artificial Sequence
  chemically synthesized
tctggtgtttcttagatatgga

SEQ ID NO: 969697 - DNA, 22 bp, Artificial Sequence
  chemically synthesized
gaagaattctctggtgtttctt

SEQ ID NO: 969698 - DNA, 22 bp, Artificial Sequence
  chemically synthesized
tgtatctggaagaattctctgg

SEQ ID NO: 969699 - DNA, 22 bp, Artificial Sequence
  chemically synthesized
tatgtatctggaagaattctct

SEQ ID NO: 969700 - DNA, 22 bp, Artificial Sequence
  chemically synthesized
ctatgtatctggaagaattctc

SEQ ID NO: 969701 - DNA, 22 bp, Artificial Sequence
  chemically synthesized
agaaacaccagagaattcttcc

SEQ ID NO: 969702 - DNA, 22 bp, Artificial Sequence
  chemically synthesized
aaaaaaatatataagtttctat

SEQ ID NO: 969703 - DNA, 22 bp, Artificial Sequence
  chemically synthesized
ttccagatacatagaaacttat

SEQ ID NO: 969704 - DNA, 22 bp, Artificial Sequence
  chemically synthesized
ccagatacatagaaacttatat

SEQ ID NO: 969705 - DNA, 22 bp, Artificial Sequence
  chemically synthesized
cagatacatagaaacttatata

SEQ ID NO: 969706 - DNA, 22 bp, Artificial Sequence
  chemically synthesized
tcactgaaaaaaatatataagt

SEQ ID NO: 969707 - DNA, 22 bp, Artificial Sequence
  chemically synthesized
atcactgaaaaaaatatataag

SEQ ID NO: 969708 - DNA, 22 bp, Artificial Sequence
  chemically synthesized
cttatcactgaaaaaaatatat

SEQ ID NO: 969709 - DNA, 22 bp, Artificial Sequence
  chemically synthesized
taatcaaactgcttatcactga

SEQ ID NO: 969710 - DNA, 22 bp, Artificial Sequence
  chemically synthesized
atatatttttttcagtgataag

SEQ ID NO: 969711 - DNA, 22 bp, Artificial Sequence
  chemically synthesized
ataatcaaactgcttatcactg

SEQ ID NO: 969712 - DNA, 22 bp, Artificial Sequence
  chemically synthesized
tatatttttttcagtgataagc

SEQ ID NO: 969713 - DNA, 22 bp, Artificial Sequence
  chemically synthesized
tataatcaaactgcttatcact

SEQ ID NO: 969714 - DNA, 22 bp, Artificial Sequence
  chemically synthesized
ttataatcaaactgcttatcac

SEQ ID NO: 969715 - DNA, 22 bp, Artificial Sequence
  chemically synthesized
ttttcagtgataagcagtttga

SEQ ID NO: 969716 - DNA, 22 bp, Artificial Sequence
  chemically synthesized
tatcttttataatcaaactgct

SEQ ID NO: 969717 - DNA, 22 bp, Artificial Sequence
  chemically synthesized
tttcagtgataagcagtttgat

SEQ ID NO: 969718 - DNA, 22 bp, Artificial Sequence
  chemically synthesized
atatcttttataatcaaactgc

SEQ ID NO: 969719 - DNA, 22 bp, Artificial Sequence
  chemically synthesized
ttcagtgataagcagtttgatt

SEQ ID NO: 969720 - DNA, 22 bp, Artificial Sequence
  chemically synthesized
tatatcttttataatcaaactg

SEQ ID NO: 969721 - DNA, 22 bp, Artificial Sequence
  chemically synthesized
tcagtgataagcagtttgatta

SEQ ID NO: 969722 - DNA, 22 bp, Artificial Sequence
  chemically synthesized
cagtgataagcagtttgattat

SEQ ID NO: 969723 - DNA, 22 bp, Artificial Sequence
  chemically synthesized
agtgataagcagtttgattata

SEQ ID NO: 969724 - DNA, 22 bp, Artificial Sequence
  chemically synthesized
tcagtcatgttttatatctttt

SEQ ID NO: 969725 - DNA, 22 bp, Artificial Sequence
  chemically synthesized
atcagtcatgttttatatcttt

SEQ ID NO: 969726 - DNA, 22 bp, Artificial Sequence
  chemically synthesized
tatcagtcatgttttatatctt

SEQ ID NO: 969727 - DNA, 22 bp, Artificial Sequence
  chemically synthesized
ttatcagtcatgttttatatct

SEQ ID NO: 969728 - DNA, 22 bp, Artificial Sequence
  chemically synthesized
tttatcagtcatgttttatatc

SEQ ID NO: 969729 - DNA, 22 bp, Artificial Sequence
  chemically synthesized
ttttatcagtcatgttttatat

SEQ ID NO: 969730 - DNA, 22 bp, Artificial Sequence
  chemically synthesized
gattataaaagatataaaacat

SEQ ID NO: 969731 - DNA, 22 bp, Artificial Sequence
  chemically synthesized
attataaaagatataaaacatg

SEQ ID NO: 969732 - DNA, 22 bp, Artificial Sequence
  chemically synthesized
taaaagatataaaacatgactg

SEQ ID NO: 969733 - DNA, 22 bp, Artificial Sequence
  chemically synthesized
agccatgcttttttatcagtca

SEQ ID NO: 969734 - DNA, 22 bp, Artificial Sequence
  chemically synthesized
aacatctaagccatgctttttt

SEQ ID NO: 969735 - DNA, 22 bp, Artificial Sequence
  chemically synthesized
ctcaacatctaagccatgcttt

SEQ ID NO: 969736 - DNA, 22 bp, Artificial Sequence
  chemically synthesized
actcaacatctaagccatgctt

SEQ ID NO: 969737 - DNA, 22 bp, Artificial Sequence
  chemically synthesized
ataaaaaagcatggcttagatg

SEQ ID NO: 969738 - DNA, 22 bp, Artificial Sequence
  chemically synthesized
caatatttactcaacatctaag

SEQ ID NO: 969739 - DNA, 22 bp, Artificial Sequence
  chemically synthesized
gctacaatatttactcaacatc

SEQ ID NO: 969740 - DNA, 22 bp, Artificial Sequence
  chemically synthesized
agctacaatatttactcaacat

SEQ ID NO: 969741 - DNA, 22 bp, Artificial Sequence
  chemically synthesized
aggatttagctacaatatttac

SEQ ID NO: 969742 - DNA, 22 bp, Artificial Sequence
  chemically synthesized
caggatttagctacaatattta

SEQ ID NO: 969743 - DNA, 22 bp, Artificial Sequence
  chemically synthesized
tcaggatttagctacaatattt

SEQ ID NO: 969744 - DNA, 22 bp, Artificial Sequence
  chemically synthesized
agatgttgagtaaatattgtag

SEQ ID NO: 969745 - DNA, 22 bp, Artificial Sequence
  chemically synthesized
gatgttgagtaaatattgtagc

SEQ ID NO: 969746 - DNA, 22 bp, Artificial Sequence
  chemically synthesized
agctttcaggatttagctacaa

SEQ ID NO: 969747 - DNA, 22 bp, Artificial Sequence
  chemically synthesized
agtaaatattgtagctaaatcc

SEQ ID NO: 969748 - DNA, 22 bp, Artificial Sequence
  chemically synthesized
atgttgagctttcaggatttag

SEQ ID NO: 969749 - DNA, 22 bp, Artificial Sequence
  chemically synthesized
ttgatgttgagctttcaggatt

SEQ ID NO: 969750 - DNA, 22 bp, Artificial Sequence
  chemically synthesized
attgatgttgagctttcaggat

SEQ ID NO: 969751 - DNA, 22 bp, Artificial Sequence
  chemically synthesized
tttattgatgttgagctttcag

SEQ ID NO: 969752 - DNA, 22 bp, Artificial Sequence
  chemically synthesized
tagctaaatcctgaaagctcaa

SEQ ID NO: 969753 - DNA, 22 bp, Artificial Sequence
  chemically synthesized
cattatttattgatgttgagct

SEQ ID NO: 969754 - DNA, 22 bp, Artificial Sequence
  chemically synthesized
ccattatttattgatgttgagc

SEQ ID NO: 969755 - DNA, 22 bp, Artificial Sequence
  chemically synthesized
aatcctgaaagctcaacatcaa

SEQ ID NO: 969756 - DNA, 22 bp, Artificial Sequence
  chemically synthesized
aagcttccattatttattgatg

SEQ ID NO: 969757 - DNA, 22 bp, Artificial Sequence
  chemically synthesized
taaagcttccattatttattga

SEQ ID NO: 969758 - DNA, 22 bp, Artificial Sequence
  chemically synthesized
aaagctcaacatcaataaataa

SEQ ID NO: 969759 - DNA, 22 bp, Artificial Sequence
  chemically synthesized
ctaaagcttccattatttattg

SEQ ID NO: 969760 - DNA, 22 bp, Artificial Sequence
  chemically synthesized
gtttctaaagcttccattattt

SEQ ID NO: 969761 - DNA, 22 bp, Artificial Sequence
  chemically synthesized
aacatcaataaataatggaagc

SEQ ID NO: 969762 - DNA, 22 bp, Artificial Sequence
  chemically synthesized
tccagagcattggtttctaaag

SEQ ID NO: 969763 - DNA, 22 bp, Artificial Sequence
  chemically synthesized
aaatagggatgttatccagagc

SEQ ID NO: 969764 - DNA, 22 bp, Artificial Sequence
  chemically synthesized
tagaaaccaatgctctggataa

SEQ ID NO: 969765 - DNA, 22 bp, Artificial Sequence
  chemically synthesized
agaaaccaatgctctggataac

SEQ ID NO: 969766 - DNA, 22 bp, Artificial Sequence
  chemically synthesized
taaaatagggatgttatccaga

SEQ ID NO: 969767 - DNA, 22 bp, Artificial Sequence
  chemically synthesized
gaaaccaatgctctggataaca

SEQ ID NO: 969768 - DNA, 22 bp, Artificial Sequence
  chemically synthesized
agtattctaaaatagggatgtt

SEQ ID NO: 969769 - DNA, 22 bp, Artificial Sequence
  chemically synthesized
gagtattctaaaatagggatgt

SEQ ID NO: 969770 - DNA, 22 bp, Artificial Sequence
  chemically synthesized
tgagtattctaaaatagggatg

SEQ ID NO: 969771 - DNA, 22 bp, Artificial Sequence
  chemically synthesized
tggataacatccctattttaga

SEQ ID NO: 969772 - DNA, 22 bp, Artificial Sequence
  chemically synthesized
gataacatccctattttagaat

SEQ ID NO: 969773 - DNA, 22 bp, Artificial Sequence
  chemically synthesized
tagcagccctttgagtattcta

SEQ ID NO: 969774 - DNA, 22 bp, Artificial Sequence
  chemically synthesized
ttttagaatactcaaagggctg

SEQ ID NO: 969775 - DNA, 22 bp, Artificial Sequence
  chemically synthesized
tagaatactcaaagggctgcta

SEQ ID NO: 969776 - DNA, 22 bp, Artificial Sequence
  chemically synthesized
agaatactcaaagggctgctac

SEQ ID NO: 969777 - DNA, 22 bp, Artificial Sequence
  chemically synthesized
gaatactcaaagggctgctaca

SEQ ID NO: 969778 - DNA, 22 bp, Artificial Sequence
  chemically synthesized
ccaaaaaaaaaaatagctgtag

SEQ ID NO: 969779 - DNA, 22 bp, Artificial Sequence
  chemically synthesized
aaagggctgctacagctatttt

SEQ ID NO: 969780 - DNA, 22 bp, Artificial Sequence
  chemically synthesized
ctacagctatttttttttttgg

SEQ ID NO: 969781 - DNA, 22 bp, Artificial Sequence
  chemically synthesized
cagctatttttttttttggcag

SEQ ID NO: 969782 - DNA, 22 bp, Artificial Sequence
  chemically synthesized
tggagaatggaactgccaaaaa

SEQ ID NO: 969783 - DNA, 22 bp, Artificial Sequence
  chemically synthesized
tttttttttttggcagttccat

SEQ ID NO: 969784 - DNA, 22 bp, Artificial Sequence
  chemically synthesized
ttttttttggcagttccattct

SEQ ID NO: 969785 - DNA, 22 bp, Artificial Sequence
  chemically synthesized
tttttttggcagttccattctc

SEQ ID NO: 969786 - DNA, 22 bp, Artificial Sequence
  chemically synthesized
ttttttggcagttccattctcc

SEQ ID NO: 969787 - DNA, 22 bp, Artificial Sequence
  chemically synthesized
tagatcacctgtggagaatgga

SEQ ID NO: 969788 - DNA, 22 bp, Artificial Sequence
  chemically synthesized
tttttggcagttccattctcca

SEQ ID NO: 969789 - DNA, 22 bp, Artificial Sequence
  chemically synthesized
ttttggcagttccattctccac

SEQ ID NO: 969790 - DNA, 22 bp, Artificial Sequence
  chemically synthesized
tttggcagttccattctccaca

SEQ ID NO: 969791 - DNA, 22 bp, Artificial Sequence
  chemically synthesized
ttggcagttccattctccacag

SEQ ID NO: 969792 - DNA, 22 bp, Artificial Sequence
  chemically synthesized
tggcagttccattctccacagg

SEQ ID NO: 969793 - DNA, 22 bp, Artificial Sequence
  chemically synthesized
ggcagttccattctccacaggt

SEQ ID NO: 969794 - DNA, 22 bp, Artificial Sequence
  chemically synthesized
aagctatagatcacctgtggag

SEQ ID NO: 969795 - DNA, 22 bp, Artificial Sequence
  chemically synthesized
gcagttccattctccacaggtg

SEQ ID NO: 969796 - DNA, 22 bp, Artificial Sequence
  chemically synthesized
gttcaagctatagatcacctgt

SEQ ID NO: 969797 - DNA, 22 bp, Artificial Sequence
  chemically synthesized
agttcaagctatagatcacctg

SEQ ID NO: 969798 - DNA, 22 bp, Artificial Sequence
  chemically synthesized
cattctccacaggtgatctata

SEQ ID NO: 969799 - DNA, 22 bp, Artificial Sequence
  chemically synthesized
ggtttagttcaagctatagatc

SEQ ID NO: 969800 - DNA, 22 bp, Artificial Sequence
  chemically synthesized
aggtttagttcaagctatagat

SEQ ID NO: 969801 - DNA, 22 bp, Artificial Sequence
  chemically synthesized
taggtttagttcaagctataga

SEQ ID NO: 969802 - DNA, 22 bp, Artificial Sequence
  chemically synthesized
tccacaggtgatctatagcttg

SEQ ID NO: 969803 - DNA, 22 bp, Artificial Sequence
  chemically synthesized
cacaggtgatctatagcttgaa

SEQ ID NO: 969804 - DNA, 22 bp, Artificial Sequence
  chemically synthesized
atggctttaggtttagttcaag

SEQ ID NO: 969805 - DNA, 22 bp, Artificial Sequence
  chemically synthesized
tagcttgaactaaacctaaagc

SEQ ID NO: 969806 - DNA, 22 bp, Artificial Sequence
  chemically synthesized
gaaaatctgatggctttaggtt

SEQ ID NO: 969807 - DNA, 22 bp, Artificial Sequence
  chemically synthesized
gaactaaacctaaagccatcag

SEQ ID NO: 969808 - DNA, 22 bp, Artificial Sequence
  chemically synthesized
aacctggaaaatctgatggctt

SEQ ID NO: 969809 - DNA, 22 bp, Artificial Sequence
  chemically synthesized
aactaaacctaaagccatcaga

SEQ ID NO: 969810 - DNA, 22 bp, Artificial Sequence
  chemically synthesized
aaacctggaaaatctgatggct

SEQ ID NO: 969811 - DNA, 22 bp, Artificial Sequence
  chemically synthesized
taaacctggaaaatctgatggc

SEQ ID NO: 969812 - DNA, 22 bp, Artificial Sequence
  chemically synthesized
aacctaaagccatcagattttc

SEQ ID NO: 969813 - DNA, 22 bp, Artificial Sequence
  chemically synthesized
aaatgttttaaacctggaaaat

SEQ ID NO: 969814 - DNA, 22 bp, Artificial Sequence
  chemically synthesized
aaaatgttttaaacctggaaaa

SEQ ID NO: 969815 - DNA, 22 bp, Artificial Sequence
  chemically synthesized
aagccatcagattttccaggtt

SEQ ID NO: 969816 - DNA, 22 bp, Artificial Sequence
  chemically synthesized
taaaatgttttaaacctggaaa

SEQ ID NO: 969817 - DNA, 22 bp, Artificial Sequence
  chemically synthesized
gatgggaccattttaaaatgtt

SEQ ID NO: 969818 - DNA, 22 bp, Artificial Sequence
  chemically synthesized
tccaggtttaaaacattttaaa

SEQ ID NO: 969819 - DNA, 22 bp, Artificial Sequence
  chemically synthesized
ccaggtttaaaacattttaaaa

SEQ ID NO: 969820 - DNA, 22 bp, Artificial Sequence
  chemically synthesized
caggtttaaaacattttaaaat

SEQ ID NO: 969821 - DNA, 22 bp, Artificial Sequence
  chemically synthesized
tggattagatgggaccatttta

SEQ ID NO: 969822 - DNA, 22 bp, Artificial Sequence
  chemically synthesized
aaaacattttaaaatggtccca

SEQ ID NO: 969823 - DNA, 22 bp, Artificial Sequence
  chemically synthesized
aaacattttaaaatggtcccat

SEQ ID NO: 969824 - DNA, 22 bp, Artificial Sequence
  chemically synthesized
aaaacctgtggattagatggga

SEQ ID NO: 969825 - DNA, 22 bp, Artificial Sequence
  chemically synthesized
aaaaacctgtggattagatggg

SEQ ID NO: 969826 - DNA, 22 bp, Artificial Sequence
  chemically synthesized
taaaaacctgtggattagatgg

SEQ ID NO: 969827 - DNA, 22 bp, Artificial Sequence
  chemically synthesized
taaaatggtcccatctaatcca

SEQ ID NO: 969828 - DNA, 22 bp, Artificial Sequence
  chemically synthesized
aaaatggtcccatctaatccac

SEQ ID NO: 969829 - DNA, 22 bp, Artificial Sequence
  chemically synthesized
aaatggtcccatctaatccaca

SEQ ID NO: 969830 - DNA, 22 bp, Artificial Sequence
  chemically synthesized
taactttaaaaacctgtggatt

SEQ ID NO: 969831 - DNA, 22 bp, Artificial Sequence
  chemically synthesized
actgtaactttaaaaacctgtg

SEQ ID NO: 969832 - DNA, 22 bp, Artificial Sequence
  chemically synthesized
ttaactgtaactttaaaaacct

SEQ ID NO: 969833 - DNA, 22 bp, Artificial Sequence
  chemically synthesized
atccacaggtttttaaagttac

SEQ ID NO: 969834 - DNA, 22 bp, Artificial Sequence
  chemically synthesized
agtaacatgattattaactgta

SEQ ID NO: 969835 - DNA, 22 bp, Artificial Sequence
  chemically synthesized
cagtaacatgattattaactgt

SEQ ID NO: 969836 - DNA, 22 bp, Artificial Sequence
  chemically synthesized
tcagtaacatgattattaactg

SEQ ID NO: 969837 - DNA, 22 bp, Artificial Sequence
  chemically synthesized
ttaaagttacagttaataatca

SEQ ID NO: 969838 - DNA, 22 bp, Artificial Sequence
  chemically synthesized
taaagttacagttaataatcat

SEQ ID NO: 969839 - DNA, 22 bp, Artificial Sequence
  chemically synthesized
aaagttacagttaataatcatg

SEQ ID NO: 969840 - DNA, 22 bp, Artificial Sequence
  chemically synthesized
aagttacagttaataatcatgt

SEQ ID NO: 969841 - DNA, 22 bp, Artificial Sequence
  chemically synthesized
gtgtatgttttcagtaacatga

SEQ ID NO: 969842 - DNA, 22 bp, Artificial Sequence
  chemically synthesized
cagttaataatcatgttactga

SEQ ID NO: 969843 - DNA, 22 bp, Artificial Sequence
  chemically synthesized
tagtgtatgttttcagtaacat

SEQ ID NO: 969844 - DNA, 22 bp, Artificial Sequence
  chemically synthesized
ctagtgtatgttttcagtaaca

SEQ ID NO: 969845 - DNA, 22 bp, Artificial Sequence
  chemically synthesized
ttctagtgtatgttttcagtaa

SEQ ID NO: 969846 - DNA, 22 bp, Artificial Sequence
  chemically synthesized
cttctagtgtatgttttcagta

SEQ ID NO: 969847 - DNA, 22 bp, Artificial Sequence
  chemically synthesized
ataatcatgttactgaaaacat

SEQ ID NO: 969848 - DNA, 22 bp, Artificial Sequence
  chemically synthesized
ataacatttcttctagtgtatg

SEQ ID NO: 969849 - DNA, 22 bp, Artificial Sequence
  chemically synthesized
gataacatttcttctagtgtat

SEQ ID NO: 969850 - DNA, 22 bp, Artificial Sequence
  chemically synthesized
ctgaaaacatacactagaagaa

SEQ ID NO: 969851 - DNA, 22 bp, Artificial Sequence
  chemically synthesized
aaaacatacactagaagaaatg

SEQ ID NO: 969852 - DNA, 22 bp, Artificial Sequence
  chemically synthesized
atgtcttgataacatttcttct

SEQ ID NO: 969853 - DNA, 22 bp, Artificial Sequence
  chemically synthesized
attaatgtcttgataacatttc

SEQ ID NO: 969854 - DNA, 22 bp, Artificial Sequence
  chemically synthesized
aattaatgtcttgataacattt

SEQ ID NO: 969855 - DNA, 22 bp, Artificial Sequence
  chemically synthesized
taattaatgtcttgataacatt

SEQ ID NO: 969856 - DNA, 22 bp, Artificial Sequence
  chemically synthesized
ttaattaatgtcttgataacat

SEQ ID NO: 969857 - DNA, 22 bp, Artificial Sequence
  chemically synthesized
gaagaaatgttatcaagacatt

SEQ ID NO: 969858 - DNA, 22 bp, Artificial Sequence
  chemically synthesized
acaacatgacttttaattaatg

SEQ ID NO: 969859 - DNA, 22 bp, Artificial Sequence
  chemically synthesized
aacaacatgacttttaattaat

SEQ ID NO: 969860 - DNA, 22 bp, Artificial Sequence
  chemically synthesized
taacaacatgacttttaattaa

SEQ ID NO: 969861 - DNA, 22 bp, Artificial Sequence
  chemically synthesized
tcaagacattaattaaaagtca

SEQ ID NO: 969862 - DNA, 22 bp, Artificial Sequence
  chemically synthesized
tatatattttaacaacatgact

SEQ ID NO: 969863 - DNA, 22 bp, Artificial Sequence
  chemically synthesized
gtatatattttaacaacatgac

SEQ ID NO: 969864 - DNA, 22 bp, Artificial Sequence
  chemically synthesized
attaaaagtcatgttgttaaaa

SEQ ID NO: 969865 - DNA, 22 bp, Artificial Sequence
  chemically synthesized
aaagtcatgttgttaaaatata

SEQ ID NO: 969866 - DNA, 22 bp, Artificial Sequence
  chemically synthesized
gtgtatgtcttgtatatatttt

SEQ ID NO: 969867 - DNA, 22 bp, Artificial Sequence
  chemically synthesized
tagtgtatgtcttgtatatatt

SEQ ID NO: 969868 - DNA, 22 bp, Artificial Sequence
  chemically synthesized
aaaattctagtgtatgtcttgt

SEQ ID NO: 969869 - DNA, 22 bp, Artificial Sequence
  chemically synthesized
ttaaaatatatacaagacatac

SEQ ID NO: 969870 - DNA, 22 bp, Artificial Sequence
  chemically synthesized
aaaaattctagtgtatgtcttg

SEQ ID NO: 969871 - DNA, 22 bp, Artificial Sequence
  chemically synthesized
taaaaattctagtgtatgtctt

SEQ ID NO: 969872 - DNA, 22 bp, Artificial Sequence
  chemically synthesized
ttaaaaattctagtgtatgtct

SEQ ID NO: 969873 - DNA, 22 bp, Artificial Sequence
  chemically synthesized
aaatatatacaagacatacact

SEQ ID NO: 969874 - DNA, 22 bp, Artificial Sequence
  chemically synthesized
gtatgtgaataatatttttaaa

SEQ ID NO: 969875 - DNA, 22 bp, Artificial Sequence
  chemically synthesized
ttagtatgtgaataatattttt

SEQ ID NO: 969876 - DNA, 22 bp, Artificial Sequence
  chemically synthesized
attagtatgtgaataatatttt

SEQ ID NO: 969877 - DNA, 22 bp, Artificial Sequence
  chemically synthesized
tattagtatgtgaataatattt

SEQ ID NO: 969878 - DNA, 22 bp, Artificial Sequence
  chemically synthesized
gaatttttaaaaatattattca

SEQ ID NO: 969879 - DNA, 22 bp, Artificial Sequence
  chemically synthesized
attttattagtatgtgaataat

SEQ ID NO: 969880 - DNA, 22 bp, Artificial Sequence
  chemically synthesized
cattttattagtatgtgaataa

SEQ ID NO: 969881 - DNA, 22 bp, Artificial Sequence
  chemically synthesized
tcattttattagtatgtgaata

SEQ ID NO: 969882 - DNA, 22 bp, Artificial Sequence
  chemically synthesized
ttaaaaatattattcacatact

SEQ ID NO: 969883 - DNA, 22 bp, Artificial Sequence
  chemically synthesized
taaaaatattattcacatacta

SEQ ID NO: 969884 - DNA, 22 bp, Artificial Sequence
  chemically synthesized
ctttcattttattagtatgtga

SEQ ID NO: 969885 - DNA, 22 bp, Artificial Sequence
  chemically synthesized
aaaaatattattcacatactaa

SEQ ID NO: 969886 - DNA, 22 bp, Artificial Sequence
  chemically synthesized
actttcattttattagtatgtg

SEQ ID NO: 969887 - DNA, 22 bp, Artificial Sequence
  chemically synthesized
aaaatattattcacatactaat

SEQ ID NO: 969888 - DNA, 22 bp, Artificial Sequence
  chemically synthesized
cttactttcattttattagtat

SEQ ID NO: 969889 - DNA, 22 bp, Artificial Sequence
  chemically synthesized
ccttactttcattttattagta

SEQ ID NO: 969890 - DNA, 22 bp, Artificial Sequence
  chemically synthesized
tttccttactttcattttatta

SEQ ID NO: 969891 - DNA, 22 bp, Artificial Sequence
  chemically synthesized
ttcacatactaataaaatgaaa

SEQ ID NO: 969892 - DNA, 22 bp, Artificial Sequence
  chemically synthesized
tattatttccttactttcattt

SEQ ID NO: 969893 - DNA, 22 bp, Artificial Sequence
  chemically synthesized
acatactaataaaatgaaagta

SEQ ID NO: 969894 - DNA, 22 bp, Artificial Sequence
  chemically synthesized
ttgtattatttccttactttca

SEQ ID NO: 969895 - DNA, 22 bp, Artificial Sequence
  chemically synthesized
ataaaatgaaagtaaggaaata

SEQ ID NO: 969896 - DNA, 22 bp, Artificial Sequence
  chemically synthesized
taattattgtattatttcctta

SEQ ID NO: 969897 - DNA, 22 bp, Artificial Sequence
  chemically synthesized
gtaattattgtattatttcctt

SEQ ID NO: 969898 - DNA, 22 bp, Artificial Sequence
  chemically synthesized
ttgtaattattgtattatttcc

SEQ ID NO: 969899 - DNA, 22 bp, Artificial Sequence
  chemically synthesized
aagttcttgtaattattgtatt

SEQ ID NO: 969900 - DNA, 22 bp, Artificial Sequence
  chemically synthesized
gaagttcttgtaattattgtat

SEQ ID NO: 969901 - DNA, 22 bp, Artificial Sequence
  chemically synthesized
ttgaagttcttgtaattattgt

SEQ ID NO: 969902 - DNA, 22 bp, Artificial Sequence
  chemically synthesized
tgagaaattcttgaagttcttg

SEQ ID NO: 969903 - DNA, 22 bp, Artificial Sequence
  chemically synthesized
gctatgagaaattcttgaagtt

SEQ ID NO: 969904 - DNA, 22 bp, Artificial Sequence
  chemically synthesized
ctagctatgagaaattcttgaa

SEQ ID NO: 969905 - DNA, 22 bp, Artificial Sequence
  chemically synthesized
actactagctatgagaaattct

SEQ ID NO: 969906 - DNA, 22 bp, Artificial Sequence
  chemically synthesized
caagaacttcaagaatttctca

SEQ ID NO: 969907 - DNA, 22 bp, Artificial Sequence
  chemically synthesized
caagaatttctcatagctagta

SEQ ID NO: 969908 - DNA, 22 bp, Artificial Sequence
  chemically synthesized
aagaatttctcatagctagtag

SEQ ID NO: 969909 - DNA, 22 bp, Artificial Sequence
  chemically synthesized
atcagtatgttcactactagct

SEQ ID NO: 969910 - DNA, 22 bp, Artificial Sequence
  chemically synthesized
tactgatcagtatgttcactac

SEQ ID NO: 969911 - DNA, 22 bp, Artificial Sequence
  chemically synthesized
atactgatcagtatgttcacta

SEQ ID NO: 969912 - DNA, 22 bp, Artificial Sequence
  chemically synthesized
ctcatagctagtagtgaacata

SEQ ID NO: 969913 - DNA, 22 bp, Artificial Sequence
  chemically synthesized
tcatagctagtagtgaacatac

SEQ ID NO: 969914 - DNA, 22 bp, Artificial Sequence
  chemically synthesized
atagctagtagtgaacatactg

SEQ ID NO: 969915 - DNA, 22 bp, Artificial Sequence
  chemically synthesized
gtagtgaacatactgatcagta

SEQ ID NO: 969916 - DNA, 22 bp, Artificial Sequence
  chemically synthesized
ataaacccccaagcccttatac

SEQ ID NO: 969917 - DNA, 22 bp, Artificial Sequence
  chemically synthesized
atcagtataagggcttgggggt

SEQ ID NO: 969918 - DNA, 22 bp, Artificial Sequence
  chemically synthesized
agaaatattaataaacccccaa

SEQ ID NO: 969919 - DNA, 22 bp, Artificial Sequence
  chemically synthesized
tgcctcagaaatattaataaac

SEQ ID NO: 969920 - DNA, 22 bp, Artificial Sequence
  chemically synthesized
gggggtttattaatatttctga

SEQ ID NO: 969921 - DNA, 22 bp, Artificial Sequence
  chemically synthesized
ggggtttattaatatttctgag

SEQ ID NO: 969922 - DNA, 22 bp, Artificial Sequence
  chemically synthesized
agacagttatgcctcagaaata

SEQ ID NO: 969923 - DNA, 22 bp, Artificial Sequence
  chemically synthesized
aagacagttatgcctcagaaat

SEQ ID NO: 969924 - DNA, 22 bp, Artificial Sequence
  chemically synthesized
taagacagttatgcctcagaaa

SEQ ID NO: 969925 - DNA, 22 bp, Artificial Sequence
  chemically synthesized
ttaagacagttatgcctcagaa

SEQ ID NO: 969926 - DNA, 22 bp, Artificial Sequence
  chemically synthesized
tttaagacagttatgcctcaga

SEQ ID NO: 969927 - DNA, 22 bp, Artificial Sequence
  chemically synthesized
tttttaagacagttatgcctca

SEQ ID NO: 969928 - DNA, 22 bp, Artificial Sequence
  chemically synthesized
attaatatttctgaggcataac

SEQ ID NO: 969929 - DNA, 22 bp, Artificial Sequence
  chemically synthesized
ttaatatttctgaggcataact

SEQ ID NO: 969930 - DNA, 22 bp, Artificial Sequence
  chemically synthesized
gctctttttaagacagttatgc

SEQ ID NO: 969931 - DNA, 22 bp, Artificial Sequence
  chemically synthesized
atatttctgaggcataactgtc

SEQ ID NO: 969932 - DNA, 22 bp, Artificial Sequence
  chemically synthesized
ggctctttttaagacagttatg

SEQ ID NO: 969933 - DNA, 22 bp, Artificial Sequence
  chemically synthesized
tggctctttttaagacagttat

SEQ ID NO: 969934 - DNA, 22 bp, Artificial Sequence
  chemically synthesized
ttggctctttttaagacagtta

SEQ ID NO: 969935 - DNA, 22 bp, Artificial Sequence
  chemically synthesized
ctgaggcataactgtcttaaaa

SEQ ID NO: 969936 - DNA, 22 bp, Artificial Sequence
  chemically synthesized
acttttggctctttttaagaca

SEQ ID NO: 969937 - DNA, 22 bp, Artificial Sequence
  chemically synthesized
tgaggcataactgtcttaaaaa

SEQ ID NO: 969938 - DNA, 22 bp, Artificial Sequence
  chemically synthesized
aggcataactgtcttaaaaaga

SEQ ID NO: 969939 - DNA, 22 bp, Artificial Sequence
  chemically synthesized
tcagatctcacttttggctctt

SEQ ID NO: 969940 - DNA, 22 bp, Artificial Sequence
  chemically synthesized
tcttaaaaagagccaaaagtga

SEQ ID NO: 969941 - DNA, 22 bp, Artificial Sequence
  chemically synthesized
ataaattatcagatctcacttt

SEQ ID NO: 969942 - DNA, 22 bp, Artificial Sequence
  chemically synthesized
aaaaagagccaaaagtgagatc

SEQ ID NO: 969943 - DNA, 22 bp, Artificial Sequence
  chemically synthesized
aaaagagccaaaagtgagatct

SEQ ID NO: 969944 - DNA, 22 bp, Artificial Sequence
  chemically synthesized
gacaatctgataaattatcaga

SEQ ID NO: 969945 - DNA, 22 bp, Artificial Sequence
  chemically synthesized
agacaatctgataaattatcag

SEQ ID NO: 969946 - DNA, 22 bp, Artificial Sequence
  chemically synthesized
ttagacaatctgataaattatc

SEQ ID NO: 969947 - DNA, 22 bp, Artificial Sequence
  chemically synthesized
cttagacaatctgataaattat

SEQ ID NO: 969948 - DNA, 22 bp, Artificial Sequence
  chemically synthesized
tcttagacaatctgataaatta

SEQ ID NO: 969949 - DNA, 22 bp, Artificial Sequence
  chemically synthesized
acattttcttagacaatctgat

SEQ ID NO: 969950 - DNA, 22 bp, Artificial Sequence
  chemically synthesized
ataatttatcagattgtctaag

SEQ ID NO: 969951 - DNA, 22 bp, Artificial Sequence
  chemically synthesized
atcagattgtctaagaaaatgt

SEQ ID NO: 969952 - DNA, 22 bp, Artificial Sequence
  chemically synthesized
tcagattgtctaagaaaatgtt

SEQ ID NO: 969953 - DNA, 22 bp, Artificial Sequence
  chemically synthesized
tagatgatgaatattaacattt

SEQ ID NO: 969954 - DNA, 22 bp, Artificial Sequence
  chemically synthesized
atagatgatgaatattaacatt

SEQ ID NO: 969955 - DNA, 22 bp, Artificial Sequence
  chemically synthesized
tatagatgatgaatattaacat

SEQ ID NO: 969956 - DNA, 22 bp, Artificial Sequence
  chemically synthesized
tctaagaaaatgttaatattca

SEQ ID NO: 969957 - DNA, 22 bp, Artificial Sequence
  chemically synthesized
agaaaatgttaatattcatcat

SEQ ID NO: 969958 - DNA, 22 bp, Artificial Sequence
  chemically synthesized
gtcattttatagatgatgaata

SEQ ID NO: 969959 - DNA, 22 bp, Artificial Sequence
  chemically synthesized
atattcatcatctataaaatga

SEQ ID NO: 969960 - DNA, 22 bp, Artificial Sequence
  chemically synthesized
atcatctataaaatgactaact

SEQ ID NO: 969961 - DNA, 22 bp, Artificial Sequence
  chemically synthesized
taaaatgactaacttttctttg

SEQ ID NO: 969962 - DNA, 22 bp, Artificial Sequence
  chemically synthesized
aaaaccatgtacaccaaagaaa

SEQ ID NO: 969963 - DNA, 22 bp, Artificial Sequence
  chemically synthesized
gaaaaccatgtacaccaaagaa

SEQ ID NO: 969964 - DNA, 22 bp, Artificial Sequence
  chemically synthesized
ttgaaaaccatgtacaccaaag

SEQ ID NO: 969965 - DNA, 22 bp, Artificial Sequence
  chemically synthesized
cttgaaaaccatgtacaccaaa

SEQ ID NO: 969966 - DNA, 22 bp, Artificial Sequence
  chemically synthesized
tcttgaaaaccatgtacaccaa

SEQ ID NO: 969967 - DNA, 22 bp, Artificial Sequence
  chemically synthesized
acttttctttggtgtacatggt

SEQ ID NO: 969968 - DNA, 22 bp, Artificial Sequence
  chemically synthesized
ttctttggtgtacatggttttc

SEQ ID NO: 969969 - DNA, 22 bp, Artificial Sequence
  chemically synthesized
tctttggtgtacatggttttca

SEQ ID NO: 969970 - DNA, 22 bp, Artificial Sequence
  chemically synthesized
ctttggtgtacatggttttcaa

SEQ ID NO: 969971 - DNA, 22 bp, Artificial Sequence
  chemically synthesized
tttggtgtacatggttttcaag

SEQ ID NO: 969972 - DNA, 22 bp, Artificial Sequence
  chemically synthesized
tggtgtacatggttttcaagaa

SEQ ID NO: 969973 - DNA, 22 bp, Artificial Sequence
  chemically synthesized
ggtgtacatggttttcaagaaa

SEQ ID NO: 969974 - DNA, 22 bp, Artificial Sequence
  chemically synthesized
gtgtacatggttttcaagaaaa

SEQ ID NO: 969975 - DNA, 22 bp, Artificial Sequence
  chemically synthesized
aaataatgaatcatgttttctt

SEQ ID NO: 969976 - DNA, 22 bp, Artificial Sequence
  chemically synthesized
aatgttgaaataatgaatcatg

SEQ ID NO: 969977 - DNA, 22 bp, Artificial Sequence
  chemically synthesized
aaatgttgaaataatgaatcat

SEQ ID NO: 969978 - DNA, 22 bp, Artificial Sequence
  chemically synthesized
taaatgttgaaataatgaatca

SEQ ID NO: 969979 - DNA, 22 bp, Artificial Sequence
  chemically synthesized
tcaagaaaacatgattcattat

SEQ ID NO: 969980 - DNA, 22 bp, Artificial Sequence
  chemically synthesized
caagaaaacatgattcattatt

SEQ ID NO: 969981 - DNA, 22 bp, Artificial Sequence
  chemically synthesized
aagaaaacatgattcattattt

SEQ ID NO: 969982 - DNA, 22 bp, Artificial Sequence
  chemically synthesized
ggcaaattttaaatgttgaaat

SEQ ID NO: 969983 - DNA, 22 bp, Artificial Sequence
  chemically synthesized
taggcaaattttaaatgttgaa

SEQ ID NO: 969984 - DNA, 22 bp, Artificial Sequence
  chemically synthesized
tctaggcaaattttaaatgttg

SEQ ID NO: 969985 - DNA, 22 bp, Artificial Sequence
  chemically synthesized
ctctctaggcaaattttaaatg

SEQ ID NO: 969986 - DNA, 22 bp, Artificial Sequence
  chemically synthesized
attatttcaacatttaaaattt

SEQ ID NO: 969987 - DNA, 22 bp, Artificial Sequence
  chemically synthesized
ctgctctctaggcaaattttaa

SEQ ID NO: 969988 - DNA, 22 bp, Artificial Sequence
  chemically synthesized
tttcaacatttaaaatttgcct

SEQ ID NO: 969989 - DNA, 22 bp, Artificial Sequence
  chemically synthesized
caacatttaaaatttgcctaga

SEQ ID NO: 969990 - DNA, 22 bp, Artificial Sequence
  chemically synthesized
aacatttaaaatttgcctagag

SEQ ID NO: 969991 - DNA, 22 bp, Artificial Sequence
  chemically synthesized
tcagggatgctgctgctctcta

SEQ ID NO: 969992 - DNA, 22 bp, Artificial Sequence
  chemically synthesized
aaaatttgcctagagagcagca

SEQ ID NO: 969993 - DNA, 22 bp, Artificial Sequence
  chemically synthesized
aaatttgcctagagagcagcag

SEQ ID NO: 969994 - DNA, 22 bp, Artificial Sequence
  chemically synthesized
gcctagagagcagcagcatccc

SEQ ID NO: 969995 - DNA, 22 bp, Artificial Sequence
  chemically synthesized
cctagagagcagcagcatccct

SEQ ID NO: 969996 - DNA, 22 bp, Artificial Sequence
  chemically synthesized
gagagcagcagcatccctgaca

SEQ ID NO: 969997 - DNA, 22 bp, Artificial Sequence
  chemically synthesized
acaccgaatcatagcatgagcc

SEQ ID NO: 969998 - DNA, 22 bp, Artificial Sequence
  chemically synthesized
acagactggctcatgctatgat

SEQ ID NO: 969999 - DNA, 22 bp, Artificial Sequence
  chemically synthesized
atcctgacaccgaatcatagca

SEQ ID NO: 970000 - DNA, 22 bp, Artificial Sequence
  chemically synthesized
catcctgacaccgaatcatagc

SEQ ID NO: 970001 - DNA, 22 bp, Artificial Sequence
  chemically synthesized
tcatcctgacaccgaatcatag

SEQ ID NO: 970002 - DNA, 22 bp, Artificial Sequence
  chemically synthesized
ttcatcctgacaccgaatcata

SEQ ID NO: 970003 - DNA, 22 bp, Artificial Sequence
  chemically synthesized
gctcatgctatgattcggtgtc

SEQ ID NO: 970004 - DNA, 22 bp, Artificial Sequence
  chemically synthesized
atgctatgattcggtgtcagga

SEQ ID NO: 970005 - DNA, 22 bp, Artificial Sequence
  chemically synthesized
agccagccttttcatcctgaca

SEQ ID NO: 970006 - DNA, 22 bp, Artificial Sequence
  chemically synthesized
taagccagccttttcatcctga

SEQ ID NO: 970007 - DNA, 22 bp, Artificial Sequence
  chemically synthesized
tgattcggtgtcaggatgaaaa

SEQ ID NO: 970008 - DNA, 22 bp, Artificial Sequence
  chemically synthesized
ggtgtcaggatgaaaaggctgg

SEQ ID NO: 970009 - DNA, 22 bp, Artificial Sequence
  chemically synthesized
aacccagaacatgtctctaagc

SEQ ID NO: 970010 - DNA, 22 bp, Artificial Sequence
  chemically synthesized
gaaattgaacccagaacatgtc

SEQ ID NO: 970011 - DNA, 22 bp, Artificial Sequence
  chemically synthesized
gcttagagacatgttctgggtt

SEQ ID NO: 970012 - DNA, 22 bp, Artificial Sequence
  chemically synthesized
aaccactggaaattgaacccag

SEQ ID NO: 970013 - DNA, 22 bp, Artificial Sequence
  chemically synthesized
agagacatgttctgggttcaat

SEQ ID NO: 970014 - DNA, 22 bp, Artificial Sequence
  chemically synthesized
aaaccactggaaattgaaccca

SEQ ID NO: 970015 - DNA, 22 bp, Artificial Sequence
  chemically synthesized
gagacatgttctgggttcaatt

SEQ ID NO: 970016 - DNA, 22 bp, Artificial Sequence
  chemically synthesized
taaaccactggaaattgaaccc

SEQ ID NO: 970017 - DNA, 22 bp, Artificial Sequence
  chemically synthesized
ttaaaccactggaaattgaacc

SEQ ID NO: 970018 - DNA, 22 bp, Artificial Sequence
  chemically synthesized
tgggttcaatttccagtggttt

SEQ ID NO: 970019 - DNA, 22 bp, Artificial Sequence
  chemically synthesized
caagaaatcttttaaaccactg

SEQ ID NO: 970020 - DNA, 22 bp, Artificial Sequence
  chemically synthesized
ggttcaatttccagtggtttaa

SEQ ID NO: 970021 - DNA, 22 bp, Artificial Sequence
  chemically synthesized
actccaagaaatcttttaaacc

SEQ ID NO: 970022 - DNA, 22 bp, Artificial Sequence
  chemically synthesized
aatttccagtggtttaaaagat

SEQ ID NO: 970023 - DNA, 22 bp, Artificial Sequence
  chemically synthesized
ccagtggtttaaaagatttctt

SEQ ID NO: 970024 - DNA, 22 bp, Artificial Sequence
  chemically synthesized
cagtggtttaaaagatttcttg

SEQ ID NO: 970025 - DNA, 22 bp, Artificial Sequence
  chemically synthesized
tcatgcacaacctaactccaag

SEQ ID NO: 970026 - DNA, 22 bp, Artificial Sequence
  chemically synthesized
aaaagatttcttggagttaggt

SEQ ID NO: 970027 - DNA, 22 bp, Artificial Sequence
  chemically synthesized
aaagatttcttggagttaggtt

SEQ ID NO: 970028 - DNA, 22 bp, Artificial Sequence
  chemically synthesized
aggcacattatcatgcacaacc

SEQ ID NO: 970029 - DNA, 22 bp, Artificial Sequence
  chemically synthesized
cttggagttaggttgtgcatga

SEQ ID NO: 970030 - DNA, 22 bp, Artificial Sequence
  chemically synthesized
ttggagttaggttgtgcatgat

SEQ ID NO: 970031 - DNA, 22 bp, Artificial Sequence
  chemically synthesized
ggagttaggttgtgcatgataa

SEQ ID NO: 970032 - DNA, 22 bp, Artificial Sequence
  chemically synthesized
gattgaggcacattatcatgca

SEQ ID NO: 970033 - DNA, 22 bp, Artificial Sequence
  chemically synthesized
gagttaggttgtgcatgataat

SEQ ID NO: 970034 - DNA, 22 bp, Artificial Sequence
  chemically synthesized
tagattgaggcacattatcatg

SEQ ID NO: 970035 - DNA, 22 bp, Artificial Sequence
  chemically synthesized
ctagattgaggcacattatcat

SEQ ID NO: 970036 - DNA, 22 bp, Artificial Sequence
  chemically synthesized
ttctagattgaggcacattatc

SEQ ID NO: 970037 - DNA, 22 bp, Artificial Sequence
  chemically synthesized
ggttgtgcatgataatgtgcct

SEQ ID NO: 970038 - DNA, 22 bp, Artificial Sequence
  chemically synthesized
tgcatgataatgtgcctcaatc

SEQ ID NO: 970039 - DNA, 22 bp, Artificial Sequence
  chemically synthesized
cccatgcctcttctagattgag

SEQ ID NO: 970040 - DNA, 22 bp, Artificial Sequence
  chemically synthesized
ggagttgcccatgcctcttcta

SEQ ID NO: 970041 - DNA, 22 bp, Artificial Sequence
  chemically synthesized
catgctgggagttgcccatgcc

SEQ ID NO: 970042 - DNA, 22 bp, Artificial Sequence
  chemically synthesized
aatctagaagaggcatgggcaa

SEQ ID NO: 970043 - DNA, 22 bp, Artificial Sequence
  chemically synthesized
gcatgctgggagttgcccatgc

SEQ ID NO: 970044 - DNA, 22 bp, Artificial Sequence
  chemically synthesized
cttgcatgctgggagttgccca

SEQ ID NO: 970045 - DNA, 22 bp, Artificial Sequence
  chemically synthesized
tgcttgcatgctgggagttgcc

SEQ ID NO: 970046 - DNA, 22 bp, Artificial Sequence
  chemically synthesized
gaagaggcatgggcaactccca

SEQ ID NO: 970047 - DNA, 22 bp, Artificial Sequence
  chemically synthesized
accaggagctctgcttgcatgc

SEQ ID NO: 970048 - DNA, 22 bp, Artificial Sequence
  chemically synthesized
agatgttaaccaggagctctgc

SEQ ID NO: 970049 - DNA, 22 bp, Artificial Sequence
  chemically synthesized
ccagcatgcaagcagagctcct

SEQ ID NO: 970050 - DNA, 22 bp, Artificial Sequence
  chemically synthesized
cagatgttaaccaggagctctg

SEQ ID NO: 970051 - DNA, 22 bp, Artificial Sequence
  chemically synthesized
tcagatgttaaccaggagctct

SEQ ID NO: 970052 - DNA, 22 bp, Artificial Sequence
  chemically synthesized
cggtgtgggtgaatactttcag

SEQ ID NO: 970053 - DNA, 22 bp, Artificial Sequence
  chemically synthesized
ctggttaacatctgaaagtatt

SEQ ID NO: 970054 - DNA, 22 bp, Artificial Sequence
  chemically synthesized
gttaacatctgaaagtattcac

SEQ ID NO: 970055 - DNA, 22 bp, Artificial Sequence
  chemically synthesized
acatctgaaagtattcacccac

SEQ ID NO: 970056 - DNA, 22 bp, Artificial Sequence
  chemically synthesized
aaagtattcacccacaccgtaa

SEQ ID NO: 970057 - DNA, 22 bp, Artificial Sequence
  chemically synthesized
acccacaccgtaatccgctggt

SEQ ID NO: 970058 - DNA, 22 bp, Artificial Sequence
  chemically synthesized
ataaaggtggaataaaccagcg

SEQ ID NO: 970059 - DNA, 22 bp, Artificial Sequence
  chemically synthesized
cataaaggtggaataaaccagc

SEQ ID NO: 970060 - DNA, 22 bp, Artificial Sequence
  chemically synthesized
gtttattccacctttatgaaac

SEQ ID NO: 970061 - DNA, 22 bp, Artificial Sequence
  chemically synthesized
attccacctttatgaaactcct

SEQ ID NO: 970062 - DNA, 22 bp, Artificial Sequence
  chemically synthesized
ttccacctttatgaaactccta

SEQ ID NO: 970063 - DNA, 22 bp, Artificial Sequence
  chemically synthesized
cacctttatgaaactcctatta

SEQ ID NO: 970064 - DNA, 22 bp, Artificial Sequence
  chemically synthesized
tatgaaactcctattacatttg

SEQ ID NO: 970065 - DNA, 22 bp, Artificial Sequence
  chemically synthesized
atgaaactcctattacatttgt

SEQ ID NO: 970066 - DNA, 22 bp, Artificial Sequence
  chemically synthesized
agcacagggtggacaaatgtaa

SEQ ID NO: 970067 - DNA, 22 bp, Artificial Sequence
  chemically synthesized
tgaaactcctattacatttgtc

SEQ ID NO: 970068 - DNA, 22 bp, Artificial Sequence
  chemically synthesized
aagcacagggtggacaaatgta

SEQ ID NO: 970069 - DNA, 22 bp, Artificial Sequence
  chemically synthesized
taagcacagggtggacaaatgt

SEQ ID NO: 970070 - DNA, 22 bp, Artificial Sequence
  chemically synthesized
ctttaagcacagggtggacaaa

SEQ ID NO: 970071 - DNA, 22 bp, Artificial Sequence
  chemically synthesized
ctgctttaagcacagggtggac

SEQ ID NO: 970072 - DNA, 22 bp, Artificial Sequence
  chemically synthesized
ctattacatttgtccaccctgt

SEQ ID NO: 970073 - DNA, 22 bp, Artificial Sequence
  chemically synthesized
ttgctgctttaagcacagggtg

SEQ ID NO: 970074 - DNA, 22 bp, Artificial Sequence
  chemically synthesized
ttacatttgtccaccctgtgct

SEQ ID NO: 970075 - DNA, 22 bp, Artificial Sequence
  chemically synthesized
catttgtccaccctgtgcttaa

SEQ ID NO: 970076 - DNA, 22 bp, Artificial Sequence
  chemically synthesized
agctgttgctgctttaagcaca

SEQ ID NO: 970077 - DNA, 22 bp, Artificial Sequence
  chemically synthesized
aagctgttgctgctttaagcac

SEQ ID NO: 970078 - DNA, 22 bp, Artificial Sequence
  chemically synthesized
taagctgttgctgctttaagca

SEQ ID NO: 970079 - DNA, 22 bp, Artificial Sequence
  chemically synthesized
ttaagctgttgctgctttaagc

SEQ ID NO: 970080 - DNA, 22 bp, Artificial Sequence
  chemically synthesized
gtccaccctgtgcttaaagcag

SEQ ID NO: 970081 - DNA, 22 bp, Artificial Sequence
  chemically synthesized
tccaccctgtgcttaaagcagc

SEQ ID NO: 970082 - DNA, 22 bp, Artificial Sequence
  chemically synthesized
ttttaagctgttgctgctttaa

SEQ ID NO: 970083 - DNA, 22 bp, Artificial Sequence
  chemically synthesized
tgcttaaagcagcaacagctta

SEQ ID NO: 970084 - DNA, 22 bp, Artificial Sequence
  chemically synthesized
aagtgtccctcttttaagctgt

SEQ ID NO: 970085 - DNA, 22 bp, Artificial Sequence
  chemically synthesized
aaagcagcaacagcttaaaaga

SEQ ID NO: 970086 - DNA, 22 bp, Artificial Sequence
  chemically synthesized
aagcagcaacagcttaaaagag

SEQ ID NO: 970087 - DNA, 22 bp, Artificial Sequence
  chemically synthesized
tctgaagtgtccctcttttaag

SEQ ID NO: 970088 - DNA, 22 bp, Artificial Sequence
  chemically synthesized
gtctgaagtgtccctcttttaa

SEQ ID NO: 970089 - DNA, 22 bp, Artificial Sequence
  chemically synthesized
aaaagagggacacttcagacaa

SEQ ID NO: 970090 - DNA, 22 bp, Artificial Sequence
  chemically synthesized
aaagagggacacttcagacaag

SEQ ID NO: 970091 - DNA, 22 bp, Artificial Sequence
  chemically synthesized
aaagagaaagagacccagaagg

SEQ ID NO: 970092 - DNA, 22 bp, Artificial Sequence
  chemically synthesized
cagacaaggccccttctgggtc

SEQ ID NO: 970093 - DNA, 22 bp, Artificial Sequence
  chemically synthesized
agacaaggccccttctgggtct

SEQ ID NO: 970094 - DNA, 22 bp, Artificial Sequence
  chemically synthesized
cggtactgaaagagaaagagac

SEQ ID NO: 970095 - DNA, 22 bp, Artificial Sequence
  chemically synthesized
tgcggtactgaaagagaaagag

SEQ ID NO: 970096 - DNA, 22 bp, Artificial Sequence
  chemically synthesized
tctgcggtactgaaagagaaag

SEQ ID NO: 970097 - DNA, 22 bp, Artificial Sequence
  chemically synthesized
ctctgcggtactgaaagagaaa

SEQ ID NO: 970098 - DNA, 22 bp, Artificial Sequence
  chemically synthesized
tctctgcggtactgaaagagaa

SEQ ID NO: 970099 - DNA, 22 bp, Artificial Sequence
  chemically synthesized
ttctctgcggtactgaaagaga

SEQ ID NO: 970100 - DNA, 22 bp, Artificial Sequence
  chemically synthesized
ctgggtctctttctctttcagt

SEQ ID NO: 970101 - DNA, 22 bp, Artificial Sequence
  chemically synthesized
tttctctgcggtactgaaagag

SEQ ID NO: 970102 - DNA, 22 bp, Artificial Sequence
  chemically synthesized
tgggtctctttctctttcagta

SEQ ID NO: 970103 - DNA, 22 bp, Artificial Sequence
  chemically synthesized
ggtctctttctctttcagtacc

SEQ ID NO: 970104 - DNA, 22 bp, Artificial Sequence
  chemically synthesized
tatctttttctctgcggtactg

SEQ ID NO: 970105 - DNA, 22 bp, Artificial Sequence
  chemically synthesized
tttctctttcagtaccgcagag

SEQ ID NO: 970106 - DNA, 22 bp, Artificial Sequence
  chemically synthesized
tctctttcagtaccgcagagaa

SEQ ID NO: 970107 - DNA, 22 bp, Artificial Sequence
  chemically synthesized
cattgtatctttttctctgcgg

SEQ ID NO: 970108 - DNA, 22 bp, Artificial Sequence
  chemically synthesized
ctctttcagtaccgcagagaaa

SEQ ID NO: 970109 - DNA, 22 bp, Artificial Sequence
  chemically synthesized
ccattgtatctttttctctgcg

SEQ ID NO: 970110 - DNA, 22 bp, Artificial Sequence
  chemically synthesized
tctttcagtaccgcagagaaaa

SEQ ID NO: 970111 - DNA, 22 bp, Artificial Sequence
  chemically synthesized
tttcagtaccgcagagaaaaag

SEQ ID NO: 970112 - DNA, 22 bp, Artificial Sequence
  chemically synthesized
cttccattgtatctttttctct

SEQ ID NO: 970113 - DNA, 22 bp, Artificial Sequence
  chemically synthesized
tcagtaccgcagagaaaaagat

SEQ ID NO: 970114 - DNA, 22 bp, Artificial Sequence
  chemically synthesized
cagtaccgcagagaaaaagata

SEQ ID NO: 970115 - DNA, 22 bp, Artificial Sequence
  chemically synthesized
ttgcttccattgtatctttttc

SEQ ID NO: 970116 - DNA, 22 bp, Artificial Sequence
  chemically synthesized
agtaccgcagagaaaaagatac

SEQ ID NO: 970117 - DNA, 22 bp, Artificial Sequence
  chemically synthesized
ctgttgcttccattgtatcttt

SEQ ID NO: 970118 - DNA, 22 bp, Artificial Sequence
  chemically synthesized
ctgctgttgcttccattgtatc

SEQ ID NO: 970119 - DNA, 22 bp, Artificial Sequence
  chemically synthesized
catctactgctgttgcttccat

SEQ ID NO: 970120 - DNA, 22 bp, Artificial Sequence
  chemically synthesized
aaataaaaattccatctactgc

SEQ ID NO: 970121 - DNA, 22 bp, Artificial Sequence
  chemically synthesized
caaataaaaattccatctactg

SEQ ID NO: 970122 - DNA, 22 bp, Artificial Sequence
  chemically synthesized
gtggtggtgtttcaaataaaaa

SEQ ID NO: 970123 - DNA, 22 bp, Artificial Sequence
  chemically synthesized
agtggtggtgtttcaaataaaa

SEQ ID NO: 970124 - DNA, 22 bp, Artificial Sequence
  chemically synthesized
tttagtggtggtgtttcaaata

SEQ ID NO: 970125 - DNA, 22 bp, Artificial Sequence
  chemically synthesized
aaagctatttagtggtggtgtt

SEQ ID NO: 970126 - DNA, 22 bp, Artificial Sequence
  chemically synthesized
ttatttgaaacaccaccactaa

SEQ ID NO: 970127 - DNA, 22 bp, Artificial Sequence
  chemically synthesized
tatttgaaacaccaccactaaa

SEQ ID NO: 970128 - DNA, 22 bp, Artificial Sequence
  chemically synthesized
atctgaaagctatttagtggtg

SEQ ID NO: 970129 - DNA, 22 bp, Artificial Sequence
  chemically synthesized
atttgaaacaccaccactaaat

SEQ ID NO: 970130 - DNA, 22 bp, Artificial Sequence
  chemically synthesized
tttgaaacaccaccactaaata

SEQ ID NO: 970131 - DNA, 22 bp, Artificial Sequence
  chemically synthesized
ctcatctgaaagctatttagtg

SEQ ID NO: 970132 - DNA, 22 bp, Artificial Sequence
  chemically synthesized
gaaacaccaccactaaatagct

SEQ ID NO: 970133 - DNA, 22 bp, Artificial Sequence
  chemically synthesized
aaacaccaccactaaatagctt

SEQ ID NO: 970134 - DNA, 22 bp, Artificial Sequence
  chemically synthesized
tattcctcatctgaaagctatt

SEQ ID NO: 970135 - DNA, 22 bp, Artificial Sequence
  chemically synthesized
aatagctttcagatgaggaata

SEQ ID NO: 970136 - DNA, 22 bp, Artificial Sequence
  chemically synthesized
tcagatgaggaatacaattctt

SEQ ID NO: 970137 - DNA, 22 bp, Artificial Sequence
  chemically synthesized
cagatgaggaatacaattcttt

SEQ ID NO: 970138 - DNA, 22 bp, Artificial Sequence
  chemically synthesized
agatgaggaatacaattctttg

SEQ ID NO: 970139 - DNA, 22 bp, Artificial Sequence
  chemically synthesized
aaatagaaataccaaagaattg

SEQ ID NO: 970140 - DNA, 22 bp, Artificial Sequence
  chemically synthesized
aaaatagaaataccaaagaatt

SEQ ID NO: 970141 - DNA, 22 bp, Artificial Sequence
  chemically synthesized
tttaaaatagaaataccaaaga

SEQ ID NO: 970142 - DNA, 22 bp, Artificial Sequence
  chemically synthesized
cactatttaaaatagaaatacc

SEQ ID NO: 970143 - DNA, 22 bp, Artificial Sequence
  chemically synthesized
tttggtatttctattttaaata

SEQ ID NO: 970144 - DNA, 22 bp, Artificial Sequence
  chemically synthesized
tggtatttctattttaaatagt

SEQ ID NO: 970145 - DNA, 22 bp, Artificial Sequence
  chemically synthesized
ggtatttctattttaaatagtg

SEQ ID NO: 970146 - DNA, 22 bp, Artificial Sequence
  chemically synthesized
gtatttctattttaaatagtgc

SEQ ID NO: 970147 - DNA, 22 bp, Artificial Sequence
  chemically synthesized
atagcccagcccctgcactatt

SEQ ID NO: 970148 - DNA, 22 bp, Artificial Sequence
  chemically synthesized
ctattttaaatagtgcaggggc

SEQ ID NO: 970149 - DNA, 22 bp, Artificial Sequence
  chemically synthesized
tattttaaatagtgcaggggct

SEQ ID NO: 970150 - DNA, 22 bp, Artificial Sequence
  chemically synthesized
ttttaaatagtgcaggggctgg

SEQ ID NO: 970151 - DNA, 22 bp, Artificial Sequence
  chemically synthesized
taaatagtgcaggggctgggct

SEQ ID NO: 970152 - DNA, 22 bp, Artificial Sequence
  chemically synthesized
aaatagtgcaggggctgggcta

SEQ ID NO: 970153 - DNA, 22 bp, Artificial Sequence
  chemically synthesized
aatagtgcaggggctgggctat

SEQ ID NO: 970154 - DNA, 22 bp, Artificial Sequence
  chemically synthesized
ggctatgagattttcatatgct

SEQ ID NO: 970155 - DNA, 22 bp, Artificial Sequence
  chemically synthesized
tgagattttcatatgctatctc

SEQ ID NO: 970156 - DNA, 22 bp, Artificial Sequence
  chemically synthesized
tcatatgctatctcatttattt

SEQ ID NO: 970157 - DNA, 22 bp, Artificial Sequence
  chemically synthesized
catatgctatctcatttatttc

SEQ ID NO: 970158 - DNA, 22 bp, Artificial Sequence
  chemically synthesized
atatgctatctcatttatttca

SEQ ID NO: 970159 - DNA, 22 bp, Artificial Sequence
  chemically synthesized
aacatgtatagataaatgaaat

SEQ ID NO: 970160 - DNA, 22 bp, Artificial Sequence
  chemically synthesized
tctcatttatttcatttatcta

SEQ ID NO: 970161 - DNA, 22 bp, Artificial Sequence
  chemically synthesized
aattaaacatgtatagataaat

SEQ ID NO: 970162 - DNA, 22 bp, Artificial Sequence
  chemically synthesized
taaattaaacatgtatagataa

SEQ ID NO: 970163 - DNA, 22 bp, Artificial Sequence
  chemically synthesized
atttatttcatttatctataca

SEQ ID NO: 970164 - DNA, 22 bp, Artificial Sequence
  chemically synthesized
atttcatttatctatacatgtt

SEQ ID NO: 970165 - DNA, 22 bp, Artificial Sequence
  chemically synthesized
tttcatttatctatacatgttt

SEQ ID NO: 970166 - DNA, 22 bp, Artificial Sequence
  chemically synthesized
catttatctatacatgtttaat

SEQ ID NO: 970167 - DNA, 22 bp, Artificial Sequence
  chemically synthesized
atttatctatacatgtttaatt

SEQ ID NO: 970168 - DNA, 22 bp, Artificial Sequence
  chemically synthesized
catcatcactctaaattaaaca

SEQ ID NO: 970169 - DNA, 22 bp, Artificial Sequence
  chemically synthesized
atctatacatgtttaatttaga

SEQ ID NO: 970170 - DNA, 22 bp, Artificial Sequence
  chemically synthesized
tctatacatgtttaatttagag

SEQ ID NO: 970171 - DNA, 22 bp, Artificial Sequence
  chemically synthesized
tacatgtttaatttagagtgat

SEQ ID NO: 970172 - DNA, 22 bp, Artificial Sequence
  chemically synthesized
cacatccaatgttacatcatca

SEQ ID NO: 970173 - DNA, 22 bp, Artificial Sequence
  chemically synthesized
aatttagagtgatgatgtaaca

SEQ ID NO: 970174 - DNA, 22 bp, Artificial Sequence
  chemically synthesized
atttagagtgatgatgtaacat

SEQ ID NO: 970175 - DNA, 22 bp, Artificial Sequence
  chemically synthesized
gagtctccacatccaatgttac

SEQ ID NO: 970176 - DNA, 22 bp, Artificial Sequence
  chemically synthesized
agagtgatgatgtaacattgga

SEQ ID NO: 970177 - DNA, 22 bp, Artificial Sequence
  chemically synthesized
ggagtctccacatccaatgtta

SEQ ID NO: 970178 - DNA, 22 bp, Artificial Sequence
  chemically synthesized
gagtgatgatgtaacattggat

SEQ ID NO: 970179 - DNA, 22 bp, Artificial Sequence
  chemically synthesized
tggagtctccacatccaatgtt

SEQ ID NO: 970180 - DNA, 22 bp, Artificial Sequence
  chemically synthesized
agctttggagtctccacatcca

SEQ ID NO: 970181 - DNA, 22 bp, Artificial Sequence
  chemically synthesized
ttcagctttggagtctccacat

SEQ ID NO: 970182 - DNA, 22 bp, Artificial Sequence
  chemically synthesized
cattattcagctttggagtctc

SEQ ID NO: 970183 - DNA, 22 bp, Artificial Sequence
  chemically synthesized
gatgtggagactccaaagctga

SEQ ID NO: 970184 - DNA, 22 bp, Artificial Sequence
  chemically synthesized
atatattacattattcagcttt

SEQ ID NO: 970185 - DNA, 22 bp, Artificial Sequence
  chemically synthesized
tattgatatattacattattca

SEQ ID NO: 970186 - DNA, 22 bp, Artificial Sequence
  chemically synthesized
caaagctgaataatgtaatata

SEQ ID NO: 970187 - DNA, 22 bp, Artificial Sequence
  chemically synthesized
caggtattgtattgatatatta

SEQ ID NO: 970188 - DNA, 22 bp, Artificial Sequence
  chemically synthesized
tgcaggtattgtattgatatat

SEQ ID NO: 970189 - DNA, 22 bp, Artificial Sequence
  chemically synthesized
ctgcaggtattgtattgatata

SEQ ID NO: 970190 - DNA, 22 bp, Artificial Sequence
  chemically synthesized
aataatgtaatatatcaataca

SEQ ID NO: 970191 - DNA, 22 bp, Artificial Sequence
  chemically synthesized
tttctgcaggtattgtattgat

SEQ ID NO: 970192 - DNA, 22 bp, Artificial Sequence
  chemically synthesized
catagctgtttctgcaggtatt

SEQ ID NO: 970193 - DNA, 22 bp, Artificial Sequence
  chemically synthesized
cactgcatagctgtttctgcag

SEQ ID NO: 970194 - DNA, 22 bp, Artificial Sequence
  chemically synthesized
cagaaacagctatgcagtggag

SEQ ID NO: 970195 - DNA, 22 bp, Artificial Sequence
  chemically synthesized
aggaagtataaaaccaaaatac

SEQ ID NO: 970196 - DNA, 22 bp, Artificial Sequence
  chemically synthesized
gaggaagtataaaaccaaaata

SEQ ID NO: 970197 - DNA, 22 bp, Artificial Sequence
  chemically synthesized
tgaggaagtataaaaccaaaat

SEQ ID NO: 970198 - DNA, 22 bp, Artificial Sequence
  chemically synthesized
tgcagtggagtattttggtttt

SEQ ID NO: 970199 - DNA, 22 bp, Artificial Sequence
  chemically synthesized
ttgaggaagtataaaaccaaaa

SEQ ID NO: 970200 - DNA, 22 bp, Artificial Sequence
  chemically synthesized
tggttttatacttcctcaaaaa

SEQ ID NO: 970201 - DNA, 22 bp, Artificial Sequence
  chemically synthesized
ggttttatacttcctcaaaaat

SEQ ID NO: 970202 - DNA, 22 bp, Artificial Sequence
  chemically synthesized
gttttatacttcctcaaaaatg

SEQ ID NO: 970203 - DNA, 22 bp, Artificial Sequence
  chemically synthesized
tatacttcctcaaaaatgttca

SEQ ID NO: 970204 - DNA, 22 bp, Artificial Sequence
  chemically synthesized
atacttcctcaaaaatgttcat

SEQ ID NO: 970205 - DNA, 22 bp, Artificial Sequence
  chemically synthesized
tacttcctcaaaaatgttcatc

SEQ ID NO: 970206 - DNA, 22 bp, Artificial Sequence
  chemically synthesized
cctcaaaaatgttcatcacgtt

SEQ ID NO: 970207 - DNA, 22 bp, Artificial Sequence
  chemically synthesized
ctcaaaaatgttcatcacgtta

SEQ ID NO: 970208 - DNA, 22 bp, Artificial Sequence
  chemically synthesized
aaaaatgttcatcacgttattt

SEQ ID NO: 970209 - DNA, 22 bp, Artificial Sequence
  chemically synthesized
atcacgttattttcactttttt

SEQ ID NO: 970210 - DNA, 22 bp, Artificial Sequence
  chemically synthesized
ttttcacttttttttttttttt

SEQ ID NO: 970211 - DNA, 22 bp, Artificial Sequence
  chemically synthesized
tcactttttttttttttttttt

SEQ ID NO: 970212 - DNA, 22 bp, Artificial Sequence
  chemically synthesized
cacttttttttttttttttttt

SEQ ID NO: 970213 - DNA, 22 bp, Artificial Sequence
  chemically synthesized
actttttttttttttttttttt

SEQ ID NO: 970214 - DNA, 22 bp, Artificial Sequence
  chemically synthesized
taaaaaaaaaaaaaaaaaaaaa

SEQ ID NO: 970215 - DNA, 22 bp, Artificial Sequence
  chemically synthesized
tttttttttttttttttttttt

SEQ ID NO: 970216 - DNA, 22 bp, Artificial Sequence
  chemically synthesized
tataaaaaaaaaaaaaaaaaaa

SEQ ID NO: 970217 - DNA, 22 bp, Artificial Sequence
  chemically synthesized
tttttttttttttttttttttt

SEQ ID NO: 970218 - DNA, 22 bp, Artificial Sequence
  chemically synthesized
ctataaaaaaaaaaaaaaaaaa

SEQ ID NO: 970219 - DNA, 22 bp, Artificial Sequence
  chemically synthesized
tttttttttttttttttttttt

SEQ ID NO: 970220 - DNA, 22 bp, Artificial Sequence
  chemically synthesized
tttttttttttttttttttttt

SEQ ID NO: 970221 - DNA, 22 bp, Artificial Sequence
  chemically synthesized
tttttttttttttttttttttt

SEQ ID NO: 970222 - DNA, 22 bp, Artificial Sequence
  chemically synthesized
tttttttttttttttttttttt

SEQ ID NO: 970223 - DNA, 22 bp, Artificial Sequence
  chemically synthesized
tttttttttttttttttttttt

SEQ ID NO: 970224 - DNA, 22 bp, Artificial Sequence
  chemically synthesized
tgtttctataaaaaaaaaaaaa

SEQ ID NO: 970225 - DNA, 22 bp, Artificial Sequence
  chemically synthesized
tttttttttttttttttttttt

SEQ ID NO: 970226 - DNA, 22 bp, Artificial Sequence
  chemically synthesized
tttttttttttttttttttttt

SEQ ID NO: 970227 - DNA, 22 bp, Artificial Sequence
  chemically synthesized
tttttttttttttttttttttt

SEQ ID NO: 970228 - DNA, 22 bp, Artificial Sequence
  chemically synthesized
ttttttttttttttttttttta

SEQ ID NO: 970229 - DNA, 22 bp, Artificial Sequence
  chemically synthesized
ttttttttttttttttttttat

SEQ ID NO: 970230 - DNA, 22 bp, Artificial Sequence
  chemically synthesized
tttttttttttttttttttata

SEQ ID NO: 970231 - DNA, 22 bp, Artificial Sequence
  chemically synthesized
ttttttttttttttttttatag

SEQ ID NO: 970232 - DNA, 22 bp, Artificial Sequence
  chemically synthesized
tttttttttttttttttataga

SEQ ID NO: 970233 - DNA, 22 bp, Artificial Sequence
  chemically synthesized
ttttttttttttttttatagaa

SEQ ID NO: 970234 - DNA, 22 bp, Artificial Sequence
  chemically synthesized
tttttttttttttttatagaaa

SEQ ID NO: 970235 - DNA, 22 bp, Artificial Sequence
  chemically synthesized
ttttttttttttttatagaaac

SEQ ID NO: 970236 - DNA, 22 bp, Artificial Sequence
  chemically synthesized
tttttttttttttatagaaaca

SEQ ID NO: 970237 - DNA, 22 bp, Artificial Sequence
  chemically synthesized
ttttttttttttatagaaacac

SEQ ID NO: 970238 - DNA, 22 bp, Artificial Sequence
  chemically synthesized
tttttttttttatagaaacaca

SEQ ID NO: 970239 - DNA, 22 bp, Artificial Sequence
  chemically synthesized
caaagccagtcctgtgtttcta

SEQ ID NO: 970240 - DNA, 22 bp, Artificial Sequence
  chemically synthesized
ttttttttttatagaaacacag

SEQ ID NO: 970241 - DNA, 22 bp, Artificial Sequence
  chemically synthesized
tttttttttatagaaacacagg

SEQ ID NO: 970242 - DNA, 22 bp, Artificial Sequence
  chemically synthesized
ttttttttatagaaacacagga

SEQ ID NO: 970243 - DNA, 22 bp, Artificial Sequence
  chemically synthesized
tttttttatagaaacacaggac

SEQ ID NO: 970244 - DNA, 22 bp, Artificial Sequence
  chemically synthesized
ttttttatagaaacacaggact

SEQ ID NO: 970245 - DNA, 22 bp, Artificial Sequence
  chemically synthesized
tttttatagaaacacaggactg

SEQ ID NO: 970246 - DNA, 22 bp, Artificial Sequence
  chemically synthesized
ttttatagaaacacaggactgg

SEQ ID NO: 970247 - DNA, 22 bp, Artificial Sequence
  chemically synthesized
tttatagaaacacaggactggc

SEQ ID NO: 970248 - DNA, 22 bp, Artificial Sequence
  chemically synthesized
aataactccaaagccagtcctg

SEQ ID NO: 970249 - DNA, 22 bp, Artificial Sequence
  chemically synthesized
ttatagaaacacaggactggct

SEQ ID NO: 970250 - DNA, 22 bp, Artificial Sequence
  chemically synthesized
tatagaaacacaggactggctt

SEQ ID NO: 970251 - DNA, 22 bp, Artificial Sequence
  chemically synthesized
atagaaacacaggactggcttt

SEQ ID NO: 970252 - DNA, 22 bp, Artificial Sequence
  chemically synthesized
tagaaacacaggactggctttg

SEQ ID NO: 970253 - DNA, 22 bp, Artificial Sequence
  chemically synthesized
ccctaaataactccaaagccag

SEQ ID NO: 970254 - DNA, 22 bp, Artificial Sequence
  chemically synthesized
cccctaaataactccaaagcca

SEQ ID NO: 970255 - DNA, 22 bp, Artificial Sequence
  chemically synthesized
ttcccctaaataactccaaagc

SEQ ID NO: 970256 - DNA, 22 bp, Artificial Sequence
  chemically synthesized
gctttggagttatttaggggaa

SEQ ID NO: 970257 - DNA, 22 bp, Artificial Sequence
  chemically synthesized
tggagttatttaggggaagagt

SEQ ID NO: 970258 - DNA, 22 bp, Artificial Sequence
  chemically synthesized
aagaccaaaggcactcttcccc

SEQ ID NO: 970259 - DNA, 22 bp, Artificial Sequence
  chemically synthesized
ggagttatttaggggaagagtg

SEQ ID NO: 970260 - DNA, 22 bp, Artificial Sequence
  chemically synthesized
gagttatttaggggaagagtgc

SEQ ID NO: 970261 - DNA, 22 bp, Artificial Sequence
  chemically synthesized
taaagaccaaaggcactcttcc

SEQ ID NO: 970262 - DNA, 22 bp, Artificial Sequence
  chemically synthesized
tctaaagaccaaaggcactctt

SEQ ID NO: 970263 - DNA, 22 bp, Artificial Sequence
  chemically synthesized
ctctaaagaccaaaggcactct

SEQ ID NO: 970264 - DNA, 22 bp, Artificial Sequence
  chemically synthesized
tttaggggaagagtgcctttgg

SEQ ID NO: 970265 - DNA, 22 bp, Artificial Sequence
  chemically synthesized
aggggaagagtgcctttggtct

SEQ ID NO: 970266 - DNA, 22 bp, Artificial Sequence
  chemically synthesized
ggggaagagtgcctttggtctt

SEQ ID NO: 970267 - DNA, 22 bp, Artificial Sequence
  chemically synthesized
tccaggaagatttctctaaaga

SEQ ID NO: 970268 - DNA, 22 bp, Artificial Sequence
  chemically synthesized
tggtctttagagaaatcttcct

SEQ ID NO: 970269 - DNA, 22 bp, Artificial Sequence
  chemically synthesized
caagaattgtccaggaagattt

SEQ ID NO: 970270 - DNA, 22 bp, Artificial Sequence
  chemically synthesized
ggtctttagagaaatcttcctg

SEQ ID NO: 970271 - DNA, 22 bp, Artificial Sequence
  chemically synthesized
gtctttagagaaatcttcctgg

SEQ ID NO: 970272 - DNA, 22 bp, Artificial Sequence
  chemically synthesized
ttacaagaattgtccaggaaga

SEQ ID NO: 970273 - DNA, 22 bp, Artificial Sequence
  chemically synthesized
gttacaagaattgtccaggaag

SEQ ID NO: 970274 - DNA, 22 bp, Artificial Sequence
  chemically synthesized
tagagaaatcttcctggacaat

SEQ ID NO: 970275 - DNA, 22 bp, Artificial Sequence
  chemically synthesized
tttgttacaagaattgtccagg

SEQ ID NO: 970276 - DNA, 22 bp, Artificial Sequence
  chemically synthesized
agagaaatcttcctggacaatt

SEQ ID NO: 970277 - DNA, 22 bp, Artificial Sequence
  chemically synthesized
atttgttacaagaattgtccag

SEQ ID NO: 970278 - DNA, 22 bp, Artificial Sequence
  chemically synthesized
gagaaatcttcctggacaattc

SEQ ID NO: 970279 - DNA, 22 bp, Artificial Sequence
  chemically synthesized
tatttgttacaagaattgtcca

SEQ ID NO: 970280 - DNA, 22 bp, Artificial Sequence
  chemically synthesized
atgttttatttgttacaagaat

SEQ ID NO: 970281 - DNA, 22 bp, Artificial Sequence
  chemically synthesized
gatgttttatttgttacaagaa

SEQ ID NO: 970282 - DNA, 22 bp, Artificial Sequence
  chemically synthesized
cctggacaattcttgtaacaaa

SEQ ID NO: 970283 - DNA, 22 bp, Artificial Sequence
  chemically synthesized
ctggacaattcttgtaacaaat

SEQ ID NO: 970284 - DNA, 22 bp, Artificial Sequence
  chemically synthesized
caccttgatgttttatttgtta

SEQ ID NO: 970285 - DNA, 22 bp, Artificial Sequence
  chemically synthesized
gacaattcttgtaacaaataaa

SEQ ID NO: 970286 - DNA, 22 bp, Artificial Sequence
  chemically synthesized
tataattacaccttgatgtttt

SEQ ID NO: 970287 - DNA, 22 bp, Artificial Sequence
  chemically synthesized
ttgtaacaaataaaacatcaag

SEQ ID NO: 970288 - DNA, 22 bp, Artificial Sequence
  chemically synthesized
atataattacaccttgatgttt

SEQ ID NO: 970289 - DNA, 22 bp, Artificial Sequence
  chemically synthesized
tatataattacaccttgatgtt

SEQ ID NO: 970290 - DNA, 22 bp, Artificial Sequence
  chemically synthesized
gtaacaaataaaacatcaaggt

SEQ ID NO: 970291 - DNA, 22 bp, Artificial Sequence
  chemically synthesized
taacaaataaaacatcaaggtg

SEQ ID NO: 970292 - DNA, 22 bp, Artificial Sequence
  chemically synthesized
atagtgattttatataattaca

SEQ ID NO: 970293 - DNA, 22 bp, Artificial Sequence
  chemically synthesized
aatagtgattttatataattac

SEQ ID NO: 970294 - DNA, 22 bp, Artificial Sequence
  chemically synthesized
taatagtgattttatataatta

SEQ ID NO: 970295 - DNA, 22 bp, Artificial Sequence
  chemically synthesized
cgttttaatagtgattttatat

SEQ ID NO: 970296 - DNA, 22 bp, Artificial Sequence
  chemically synthesized
tataaaatcactattaaaacgc

SEQ ID NO: 970297 - DNA, 22 bp, Artificial Sequence
  chemically synthesized
aaatatagtacaaataagttgc

SEQ ID NO: 970298 - DNA, 22 bp, Artificial Sequence
  chemically synthesized
ttaaaacgcaacttatttgtac

SEQ ID NO: 970299 - DNA, 22 bp, Artificial Sequence
  chemically synthesized
aaacgcaacttatttgtactat

SEQ ID NO: 970300 - DNA, 22 bp, Artificial Sequence
  chemically synthesized
aaacagctaaaatatagtacaa

SEQ ID NO: 970301 - DNA, 22 bp, Artificial Sequence
  chemically synthesized
gtgttaaaacagctaaaatata

SEQ ID NO: 970302 - DNA, 22 bp, Artificial Sequence
  chemically synthesized
agtgttaaaacagctaaaatat

SEQ ID NO: 970303 - DNA, 22 bp, Artificial Sequence
  chemically synthesized
atttgtactatattttagctgt

SEQ ID NO: 970304 - DNA, 22 bp, Artificial Sequence
  chemically synthesized
tttgtactatattttagctgtt

SEQ ID NO: 970305 - DNA, 22 bp, Artificial Sequence
  chemically synthesized
gtactatattttagctgtttta

SEQ ID NO: 970306 - DNA, 22 bp, Artificial Sequence
  chemically synthesized
tactatattttagctgttttaa

SEQ ID NO: 970307 - DNA, 22 bp, Artificial Sequence
  chemically synthesized
tattttagctgttttaacacta

SEQ ID NO: 970308 - DNA, 22 bp, Artificial Sequence
  chemically synthesized
tagctgttttaacactaagtga

SEQ ID NO: 970309 - DNA, 22 bp, Artificial Sequence
  chemically synthesized
agctgttttaacactaagtgac

SEQ ID NO: 970310 - DNA, 22 bp, Artificial Sequence
  chemically synthesized
gctgttttaacactaagtgacc

SEQ ID NO: 970311 - DNA, 22 bp, Artificial Sequence
  chemically synthesized
ttttaacactaagtgaccttac

SEQ ID NO: 970312 - DNA, 22 bp, Artificial Sequence
  chemically synthesized
taacactaagtgaccttacact

SEQ ID NO: 970313 - DNA, 22 bp, Artificial Sequence
  chemically synthesized
aacactaagtgaccttacactc

SEQ ID NO: 970314 - DNA, 22 bp, Artificial Sequence
  chemically synthesized
acactaagtgaccttacactca

SEQ ID NO: 970315 - DNA, 22 bp, Artificial Sequence
  chemically synthesized
agtgaccttacactcattcatt

SEQ ID NO: 970316 - DNA, 22 bp, Artificial Sequence
  chemically synthesized
acactcattcattgtttctatt

SEQ ID NO: 970317 - DNA, 22 bp, Artificial Sequence
  chemically synthesized
cactcattcattgtttctattg

SEQ ID NO: 970318 - DNA, 22 bp, Artificial Sequence
  chemically synthesized
attcattgtttctattgctccc

SEQ ID NO: 970319 - DNA, 22 bp, Artificial Sequence
  chemically synthesized
attgtttctattgctccctgtt

SEQ ID NO: 970320 - DNA, 22 bp, Artificial Sequence
  chemically synthesized
gaaaggaacaataacagggagc

SEQ ID NO: 970321 - DNA, 22 bp, Artificial Sequence
  chemically synthesized
agaaaggaacaataacagggag

SEQ ID NO: 970322 - DNA, 22 bp, Artificial Sequence
  chemically synthesized
tagaaaggaacaataacaggga

SEQ ID NO: 970323 - DNA, 22 bp, Artificial Sequence
  chemically synthesized
ttagaaaggaacaataacaggg

SEQ ID NO: 970324 - DNA, 22 bp, Artificial Sequence
  chemically synthesized
tttctattgctccctgttattg

SEQ ID NO: 970325 - DNA, 22 bp, Artificial Sequence
  chemically synthesized
ttttagaaaggaacaataacag

SEQ ID NO: 970326 - DNA, 22 bp, Artificial Sequence
  chemically synthesized
ctattgctccctgttattgttc

SEQ ID NO: 970327 - DNA, 22 bp, Artificial Sequence
  chemically synthesized
tattgctccctgttattgttcc

SEQ ID NO: 970328 - DNA, 22 bp, Artificial Sequence
  chemically synthesized
ttgctccctgttattgttcctt

SEQ ID NO: 970329 - DNA, 22 bp, Artificial Sequence
  chemically synthesized
ctccctgttattgttcctttct

SEQ ID NO: 970330 - DNA, 22 bp, Artificial Sequence
  chemically synthesized
cctgttattgttcctttctaaa

SEQ ID NO: 970331 - DNA, 22 bp, Artificial Sequence
  chemically synthesized
ttattgttcctttctaaaagaa

SEQ ID NO: 970332 - DNA, 22 bp, Artificial Sequence
  chemically synthesized
ttgttcctttctaaaagaatgt

SEQ ID NO: 970333 - DNA, 22 bp, Artificial Sequence
  chemically synthesized
ttcctttctaaaagaatgttct

SEQ ID NO: 970334 - DNA, 22 bp, Artificial Sequence
  chemically synthesized
ctttctaaaagaatgttctccc

SEQ ID NO: 970335 - DNA, 22 bp, Artificial Sequence
  chemically synthesized
tctaaaagaatgttctccctta

SEQ ID NO: 970336 - DNA, 22 bp, Artificial Sequence
  chemically synthesized
ctaaaagaatgttctcccttat

SEQ ID NO: 970337 - DNA, 22 bp, Artificial Sequence
  chemically synthesized
taaaagaatgttctcccttata

SEQ ID NO: 970338 - DNA, 22 bp, Artificial Sequence
  chemically synthesized
aaagaatgttctcccttatata

SEQ ID NO: 970339 - DNA, 22 bp, Artificial Sequence
  chemically synthesized
agtagtggtgatagtacagtat

SEQ ID NO: 970340 - DNA, 22 bp, Artificial Sequence
  chemically synthesized
tcccttatatactgtactatca

SEQ ID NO: 970341 - DNA, 22 bp, Artificial Sequence
  chemically synthesized
attaagtagtggtgatagtaca

SEQ ID NO: 970342 - DNA, 22 bp, Artificial Sequence
  chemically synthesized
ccttatatactgtactatcacc

SEQ ID NO: 970343 - DNA, 22 bp, Artificial Sequence
  chemically synthesized
atatactgtactatcaccacta

SEQ ID NO: 970344 - DNA, 22 bp, Artificial Sequence
  chemically synthesized
tatactgtactatcaccactac

SEQ ID NO: 970345 - DNA, 22 bp, Artificial Sequence
  chemically synthesized
aatacaaaaactaattaagtag

SEQ ID NO: 970346 - DNA, 22 bp, Artificial Sequence
  chemically synthesized
tactatcaccactacttaatta

SEQ ID NO: 970347 - DNA, 22 bp, Artificial Sequence
  chemically synthesized
ttgaatacaaaaactaattaag

SEQ ID NO: 970348 - DNA, 22 bp, Artificial Sequence
  chemically synthesized
tcaccactacttaattagtttt

SEQ ID NO: 970349 - DNA, 22 bp, Artificial Sequence
  chemically synthesized
cttaattagtttttgtattcaa

SEQ ID NO: 970350 - DNA, 22 bp, Artificial Sequence
  chemically synthesized
aattagtttttgtattcaatag

SEQ ID NO: 970351 - DNA, 22 bp, Artificial Sequence
  chemically synthesized
attagtttttgtattcaatagt

SEQ ID NO: 970352 - DNA, 22 bp, Artificial Sequence
  chemically synthesized
gcgccaatgagcaagactattg

SEQ ID NO: 970353 - DNA, 22 bp, Artificial Sequence
  chemically synthesized
gtttttgtattcaatagtcttg

SEQ ID NO: 970354 - DNA, 22 bp, Artificial Sequence
  chemically synthesized
ttgtattcaatagtcttgctca

SEQ ID NO: 970355 - DNA, 22 bp, Artificial Sequence
  chemically synthesized
tgtattcaatagtcttgctcat

SEQ ID NO: 970356 - DNA, 22 bp, Artificial Sequence
  chemically synthesized
atgttagcgccaatgagcaaga

SEQ ID NO: 970357 - DNA, 22 bp, Artificial Sequence
  chemically synthesized
gtattcaatagtcttgctcatt

SEQ ID NO: 970358 - DNA, 22 bp, Artificial Sequence
  chemically synthesized
aatgttagcgccaatgagcaag

SEQ ID NO: 970359 - DNA, 22 bp, Artificial Sequence
  chemically synthesized
tattcaatagtcttgctcattg

SEQ ID NO: 970360 - DNA, 22 bp, Artificial Sequence
  chemically synthesized
taatgttagcgccaatgagcaa

SEQ ID NO: 970361 - DNA, 22 bp, Artificial Sequence
  chemically synthesized
aatagtcttgctcattggcgct

SEQ ID NO: 970362 - DNA, 22 bp, Artificial Sequence
  chemically synthesized
atactttaatgttagcgccaat

SEQ ID NO: 970363 - DNA, 22 bp, Artificial Sequence
  chemically synthesized
catactttaatgttagcgccaa

SEQ ID NO: 970364 - DNA, 22 bp, Artificial Sequence
  chemically synthesized
tttcatactttaatgttagcgc

SEQ ID NO: 970365 - DNA, 22 bp, Artificial Sequence
  chemically synthesized
atttcatactttaatgttagcg

SEQ ID NO: 970366 - DNA, 22 bp, Artificial Sequence
  chemically synthesized
gctcattggcgctaacattaaa

SEQ ID NO: 970367 - DNA, 22 bp, Artificial Sequence
  chemically synthesized
ctcattggcgctaacattaaag

SEQ ID NO: 970368 - DNA, 22 bp, Artificial Sequence
  chemically synthesized
acttatttcatactttaatgtt

SEQ ID NO: 970369 - DNA, 22 bp, Artificial Sequence
  chemically synthesized
aacttatttcatactttaatgt

SEQ ID NO: 970370 - DNA, 22 bp, Artificial Sequence
  chemically synthesized
attggcgctaacattaaagtat

SEQ ID NO: 970371 - DNA, 22 bp, Artificial Sequence
  chemically synthesized
tatttaacttatttcatacttt

SEQ ID NO: 970372 - DNA, 22 bp, Artificial Sequence
  chemically synthesized
gcgctaacattaaagtatgaaa

SEQ ID NO: 970373 - DNA, 22 bp, Artificial Sequence
  chemically synthesized
cattatatttaacttatttcat

SEQ ID NO: 970374 - DNA, 22 bp, Artificial Sequence
  chemically synthesized
ccattatatttaacttatttca

SEQ ID NO: 970375 - DNA, 22 bp, Artificial Sequence
  chemically synthesized
acattaaagtatgaaataagtt

SEQ ID NO: 970376 - DNA, 22 bp, Artificial Sequence
  chemically synthesized
tccattatatttaacttatttc

SEQ ID NO: 970377 - DNA, 22 bp, Artificial Sequence
  chemically synthesized
ttccattatatttaacttattt

SEQ ID NO: 970378 - DNA, 22 bp, Artificial Sequence
  chemically synthesized
tttccattatatttaacttatt

SEQ ID NO: 970379 - DNA, 22 bp, Artificial Sequence
  chemically synthesized
ttttttccattatatttaactt

SEQ ID NO: 970380 - DNA, 22 bp, Artificial Sequence
  chemically synthesized
aagtatgaaataagttaaatat

SEQ ID NO: 970381 - DNA, 22 bp, Artificial Sequence
  chemically synthesized
aagtaagaaattattttttcca

SEQ ID NO: 970382 - DNA, 22 bp, Artificial Sequence
  chemically synthesized
ttaaagtaagaaattatttttt

SEQ ID NO: 970383 - DNA, 22 bp, Artificial Sequence
  chemically synthesized
aatataatggaaaaaataattt

SEQ ID NO: 970384 - DNA, 22 bp, Artificial Sequence
  chemically synthesized
aagtgactattaaagtaagaaa

SEQ ID NO: 970385 - DNA, 22 bp, Artificial Sequence
  chemically synthesized
tgaagactaaagtgactattaa

SEQ ID NO: 970386 - DNA, 22 bp, Artificial Sequence
  chemically synthesized
ttgtgaagactaaagtgactat

SEQ ID NO: 970387 - DNA, 22 bp, Artificial Sequence
  chemically synthesized
tattgtgaagactaaagtgact

SEQ ID NO: 970388 - DNA, 22 bp, Artificial Sequence
  chemically synthesized
cttactttaatagtcactttag

SEQ ID NO: 970389 - DNA, 22 bp, Artificial Sequence
  chemically synthesized
ttactttaatagtcactttagt

SEQ ID NO: 970390 - DNA, 22 bp, Artificial Sequence
  chemically synthesized
actttaatagtcactttagtct

SEQ ID NO: 970391 - DNA, 22 bp, Artificial Sequence
  chemically synthesized
ctttaatagtcactttagtctt

SEQ ID NO: 970392 - DNA, 22 bp, Artificial Sequence
  chemically synthesized
taatagtcactttagtcttcac

SEQ ID NO: 970393 - DNA, 22 bp, Artificial Sequence
  chemically synthesized
aagaattctattgtgaagacta

SEQ ID NO: 970394 - DNA, 22 bp, Artificial Sequence
  chemically synthesized
aatagtcactttagtcttcaca

SEQ ID NO: 970395 - DNA, 22 bp, Artificial Sequence
  chemically synthesized
aaagaattctattgtgaagact

SEQ ID NO: 970396 - DNA, 22 bp, Artificial Sequence
  chemically synthesized
atagtcactttagtcttcacaa

SEQ ID NO: 970397 - DNA, 22 bp, Artificial Sequence
  chemically synthesized
tagatttaaagaattctattgt

SEQ ID NO: 970398 - DNA, 22 bp, Artificial Sequence
  chemically synthesized
tagtcttcacaatagaattctt

SEQ ID NO: 970399 - DNA, 22 bp, Artificial Sequence
  chemically synthesized
agtcttcacaatagaattcttt

SEQ ID NO: 970400 - DNA, 22 bp, Artificial Sequence
  chemically synthesized
agttatagatttaaagaattct

SEQ ID NO: 970401 - DNA, 22 bp, Artificial Sequence
  chemically synthesized
gtcttcacaatagaattcttta

SEQ ID NO: 970402 - DNA, 22 bp, Artificial Sequence
  chemically synthesized
cacaatagaattctttaaatct

SEQ ID NO: 970403 - DNA, 22 bp, Artificial Sequence
  chemically synthesized
acaatagaattctttaaatcta

SEQ ID NO: 970404 - DNA, 22 bp, Artificial Sequence
  chemically synthesized
agtattgagttatagatttaaa

SEQ ID NO: 970405 - DNA, 22 bp, Artificial Sequence
  chemically synthesized
ttaagtattgagttatagattt

SEQ ID NO: 970406 - DNA, 22 bp, Artificial Sequence
  chemically synthesized
agctgttaagtattgagttata

SEQ ID NO: 970407 - DNA, 22 bp, Artificial Sequence
  chemically synthesized
tcagctgttaagtattgagtta

SEQ ID NO: 970408 - DNA, 22 bp, Artificial Sequence
  chemically synthesized
ctcagctgttaagtattgagtt

SEQ ID NO: 970409 - DNA, 22 bp, Artificial Sequence
  chemically synthesized
tttaaatctataactcaatact

SEQ ID NO: 970410 - DNA, 22 bp, Artificial Sequence
  chemically synthesized
ttctcagctgttaagtattgag

SEQ ID NO: 970411 - DNA, 22 bp, Artificial Sequence
  chemically synthesized
taaatctataactcaatactta

SEQ ID NO: 970412 - DNA, 22 bp, Artificial Sequence
  chemically synthesized
aaatctataactcaatacttaa

SEQ ID NO: 970413 - DNA, 22 bp, Artificial Sequence
  chemically synthesized
aatctataactcaatacttaac

SEQ ID NO: 970414 - DNA, 22 bp, Artificial Sequence
  chemically synthesized
atattcttctcagctgttaagt

SEQ ID NO: 970415 - DNA, 22 bp, Artificial Sequence
  chemically synthesized
taactcaatacttaacagctga

SEQ ID NO: 970416 - DNA, 22 bp, Artificial Sequence
  chemically synthesized
aatacttaacagctgagaagaa

SEQ ID NO: 970417 - DNA, 22 bp, Artificial Sequence
  chemically synthesized
aacacactcatattcttctcag

SEQ ID NO: 970418 - DNA, 22 bp, Artificial Sequence
  chemically synthesized
tattaaacacactcatattctt

SEQ ID NO: 970419 - DNA, 22 bp, Artificial Sequence
  chemically synthesized
atattaaacacactcatattct

SEQ ID NO: 970420 - DNA, 22 bp, Artificial Sequence
  chemically synthesized
aacagctgagaagaatatgagt

SEQ ID NO: 970421 - DNA, 22 bp, Artificial Sequence
  chemically synthesized
acagctgagaagaatatgagtg

SEQ ID NO: 970422 - DNA, 22 bp, Artificial Sequence
  chemically synthesized
atttatattaaacacactcata

SEQ ID NO: 970423 - DNA, 22 bp, Artificial Sequence
  chemically synthesized
aatttatattaaacacactcat

SEQ ID NO: 970424 - DNA, 22 bp, Artificial Sequence
  chemically synthesized
taatttatattaaacacactca

SEQ ID NO: 970425 - DNA, 22 bp, Artificial Sequence
  chemically synthesized
agaagaatatgagtgtgtttaa

SEQ ID NO: 970426 - DNA, 22 bp, Artificial Sequence
  chemically synthesized
ctttaatttatattaaacacac

SEQ ID NO: 970427 - DNA, 22 bp, Artificial Sequence
  chemically synthesized
ctgctttaatttatattaaaca

SEQ ID NO: 970428 - DNA, 22 bp, Artificial Sequence
  chemically synthesized
aatataaattaaagcagcaatt

SEQ ID NO: 970429 - DNA, 22 bp, Artificial Sequence
  chemically synthesized
atataaattaaagcagcaattt

SEQ ID NO: 970430 - DNA, 22 bp, Artificial Sequence
  chemically synthesized
aagcagcaatttctgtttcata

SEQ ID NO: 970431 - DNA, 22 bp, Artificial Sequence
  chemically synthesized
aaaagaaaatgtggtatgaaac

SEQ ID NO: 970432 - DNA, 22 bp, Artificial Sequence
  chemically synthesized
ctgtttcataccacattttctt

SEQ ID NO: 970433 - DNA, 22 bp, Artificial Sequence
  chemically synthesized
tgtttcataccacattttcttt

SEQ ID NO: 970434 - DNA, 22 bp, Artificial Sequence
  chemically synthesized
tttcataccacattttcttttc

SEQ ID NO: 970435 - DNA, 22 bp, Artificial Sequence
  chemically synthesized
cataccacattttcttttcaat

SEQ ID NO: 970436 - DNA, 22 bp, Artificial Sequence
  chemically synthesized
ataccacattttcttttcaatt

SEQ ID NO: 970437 - DNA, 22 bp, Artificial Sequence
  chemically synthesized
aacgtccatcagtggatgaatt

SEQ ID NO: 970438 - DNA, 22 bp, Artificial Sequence
  chemically synthesized
tcttttcaattcatccactgat

SEQ ID NO: 970439 - DNA, 22 bp, Artificial Sequence
  chemically synthesized
cttttcaattcatccactgatg

SEQ ID NO: 970440 - DNA, 22 bp, Artificial Sequence
  chemically synthesized
ttttcaattcatccactgatgg

SEQ ID NO: 970441 - DNA, 22 bp, Artificial Sequence
  chemically synthesized
ttcaattcatccactgatggac

SEQ ID NO: 970442 - DNA, 22 bp, Artificial Sequence
  chemically synthesized
tcaattcatccactgatggacg

SEQ ID NO: 970443 - DNA, 22 bp, Artificial Sequence
  chemically synthesized
caattcatccactgatggacgt

SEQ ID NO: 970444 - DNA, 22 bp, Artificial Sequence
  chemically synthesized
aattcatccactgatggacgtt

SEQ ID NO: 970445 - DNA, 22 bp, Artificial Sequence
  chemically synthesized
atccactgatggacgtttaggt

SEQ ID NO: 970446 - DNA, 22 bp, Artificial Sequence
  chemically synthesized
gccatgatatggaatcaaccta

SEQ ID NO: 970447 - DNA, 22 bp, Artificial Sequence
  chemically synthesized
atggacgtttaggttgattcca

SEQ ID NO: 970448 - DNA, 22 bp, Artificial Sequence
  chemically synthesized
atactagccatgatatggaatc

SEQ ID NO: 970449 - DNA, 22 bp, Artificial Sequence
  chemically synthesized
catactagccatgatatggaat

SEQ ID NO: 970450 - DNA, 22 bp, Artificial Sequence
  chemically synthesized
tcatactagccatgatatggaa

SEQ ID NO: 970451 - DNA, 22 bp, Artificial Sequence
  chemically synthesized
ttcatactagccatgatatgga

SEQ ID NO: 970452 - DNA, 22 bp, Artificial Sequence
  chemically synthesized
aggttgattccatatcatggct

SEQ ID NO: 970453 - DNA, 22 bp, Artificial Sequence
  chemically synthesized
ggttgattccatatcatggcta

SEQ ID NO: 970454 - DNA, 22 bp, Artificial Sequence
  chemically synthesized
cagcacttttcatactagccat

SEQ ID NO: 970455 - DNA, 22 bp, Artificial Sequence
  chemically synthesized
attccatatcatggctagtatg

SEQ ID NO: 970456 - DNA, 22 bp, Artificial Sequence
  chemically synthesized
ctgcagcacttttcatactagc

SEQ ID NO: 970457 - DNA, 22 bp, Artificial Sequence
  chemically synthesized
actgcagcacttttcatactag

SEQ ID NO: 970458 - DNA, 22 bp, Artificial Sequence
  chemically synthesized
catatcatggctagtatgaaaa

SEQ ID NO: 970459 - DNA, 22 bp, Artificial Sequence
  chemically synthesized
ccatgtttactgcagcactttt

SEQ ID NO: 970460 - DNA, 22 bp, Artificial Sequence
  chemically synthesized
ttcccatgtttactgcagcact

SEQ ID NO: 970461 - DNA, 22 bp, Artificial Sequence
  chemically synthesized
gttcccatgtttactgcagcac

SEQ ID NO: 970462 - DNA, 22 bp, Artificial Sequence
  chemically synthesized
tgttcccatgtttactgcagca

SEQ ID NO: 970463 - DNA, 22 bp, Artificial Sequence
  chemically synthesized
gtatgaaaagtgctgcagtaaa

SEQ ID NO: 970464 - DNA, 22 bp, Artificial Sequence
  chemically synthesized
aagagatagctttgttcccatg

SEQ ID NO: 970465 - DNA, 22 bp, Artificial Sequence
  chemically synthesized
gaagagatagctttgttcccat

SEQ ID NO: 970466 - DNA, 22 bp, Artificial Sequence
  chemically synthesized
tgaagagatagctttgttccca

SEQ ID NO: 970467 - DNA, 22 bp, Artificial Sequence
  chemically synthesized
cagtaaacatgggaacaaagct

SEQ ID NO: 970468 - DNA, 22 bp, Artificial Sequence
  chemically synthesized
tctcttcaaagatactgatttc

SEQ ID NO: 970469 - DNA, 22 bp, Artificial Sequence
  chemically synthesized
tccaaagaaaaggaaatcagta

SEQ ID NO: 970470 - DNA, 22 bp, Artificial Sequence
  chemically synthesized
atccaaagaaaaggaaatcagt

SEQ ID NO: 970471 - DNA, 22 bp, Artificial Sequence
  chemically synthesized
ttcaaagatactgatttccttt

SEQ ID NO: 970472 - DNA, 22 bp, Artificial Sequence
  chemically synthesized
caaagatactgatttccttttc

SEQ ID NO: 970473 - DNA, 22 bp, Artificial Sequence
  chemically synthesized
aaagatactgatttccttttct

SEQ ID NO: 970474 - DNA, 22 bp, Artificial Sequence
  chemically synthesized
ggcatttatccaaagaaaagga

SEQ ID NO: 970475 - DNA, 22 bp, Artificial Sequence
  chemically synthesized
ctgggcatttatccaaagaaaa

SEQ ID NO: 970476 - DNA, 22 bp, Artificial Sequence
  chemically synthesized
atttccttttctttggataaat

SEQ ID NO: 970477 - DNA, 22 bp, Artificial Sequence
  chemically synthesized
ccttttctttggataaatgccc

SEQ ID NO: 970478 - DNA, 22 bp, Artificial Sequence
  chemically synthesized
cttttctttggataaatgccca

SEQ ID NO: 970479 - DNA, 22 bp, Artificial Sequence
  chemically synthesized
ttctttggataaatgcccagta

SEQ ID NO: 970480 - DNA, 22 bp, Artificial Sequence
  chemically synthesized
tctttggataaatgcccagtag

SEQ ID NO: 970481 - DNA, 22 bp, Artificial Sequence
  chemically synthesized
ctttggataaatgcccagtagt

SEQ ID NO: 970482 - DNA, 22 bp, Artificial Sequence
  chemically synthesized
tttggataaatgcccagtagtg

SEQ ID NO: 970483 - DNA, 22 bp, Artificial Sequence
  chemically synthesized
tggataaatgcccagtagtggg

SEQ ID NO: 970484 - DNA, 22 bp, Artificial Sequence
  chemically synthesized
ggataaatgcccagtagtggga

SEQ ID NO: 970485 - DNA, 22 bp, Artificial Sequence
  chemically synthesized
gataaatgcccagtagtgggat

SEQ ID NO: 970486 - DNA, 22 bp, Artificial Sequence
  chemically synthesized
ccagatgatccagcaatcccac

SEQ ID NO: 970487 - DNA, 22 bp, Artificial Sequence
  chemically synthesized
ctaccagatgatccagcaatcc

SEQ ID NO: 970488 - DNA, 22 bp, Artificial Sequence
  chemically synthesized
ataaaacatgaattgctaccag

SEQ ID NO: 970489 - DNA, 22 bp, Artificial Sequence
  chemically synthesized
aataaaacatgaattgctacca

SEQ ID NO: 970490 - DNA, 22 bp, Artificial Sequence
  chemically synthesized
ctggatcatctggtagcaattc

SEQ ID NO: 970491 - DNA, 22 bp, Artificial Sequence
  chemically synthesized
ttaataaaacatgaattgctac

SEQ ID NO: 970492 - DNA, 22 bp, Artificial Sequence
  chemically synthesized
cttaataaaacatgaattgcta

SEQ ID NO: 970493 - DNA, 22 bp, Artificial Sequence
  chemically synthesized
tcttaataaaacatgaattgct

SEQ ID NO: 970494 - DNA, 22 bp, Artificial Sequence
  chemically synthesized
gatcatctggtagcaattcatg

SEQ ID NO: 970495 - DNA, 22 bp, Artificial Sequence
  chemically synthesized
taaacactttcttaataaaaca

SEQ ID NO: 970496 - DNA, 22 bp, Artificial Sequence
  chemically synthesized
gtagcaattcatgttttattaa

SEQ ID NO: 970497 - DNA, 22 bp, Artificial Sequence
  chemically synthesized
tgttgtaaacactttcttaata

SEQ ID NO: 970498 - DNA, 22 bp, Artificial Sequence
  chemically synthesized
tgtgttgtaaacactttcttaa

SEQ ID NO: 970499 - DNA, 22 bp, Artificial Sequence
  chemically synthesized
ctgtgttgtaaacactttctta

SEQ ID NO: 970500 - DNA, 22 bp, Artificial Sequence
  chemically synthesized
atgttttattaagaaagtgttt

SEQ ID NO: 970501 - DNA, 22 bp, Artificial Sequence
  chemically synthesized
agcttctgtgttgtaaacactt

SEQ ID NO: 970502 - DNA, 22 bp, Artificial Sequence
  chemically synthesized
gagcttctgtgttgtaaacact

SEQ ID NO: 970503 - DNA, 22 bp, Artificial Sequence
  chemically synthesized
tgagcttctgtgttgtaaacac

SEQ ID NO: 970504 - DNA, 22 bp, Artificial Sequence
  chemically synthesized
ttgagcttctgtgttgtaaaca

SEQ ID NO: 970505 - DNA, 22 bp, Artificial Sequence
  chemically synthesized
tattaagaaagtgtttacaaca

SEQ ID NO: 970506 - DNA, 22 bp, Artificial Sequence
  chemically synthesized
attaagaaagtgtttacaacac

SEQ ID NO: 970507 - DNA, 22 bp, Artificial Sequence
  chemically synthesized
ttaagaaagtgtttacaacaca

SEQ ID NO: 970508 - DNA, 22 bp, Artificial Sequence
  chemically synthesized
agaaagtgtttacaacacagaa

SEQ ID NO: 970509 - DNA, 22 bp, Artificial Sequence
  chemically synthesized
aaggcttttgagcttctgtgtt

SEQ ID NO: 970510 - DNA, 22 bp, Artificial Sequence
  chemically synthesized
acaacacagaagctcaaaagcc

SEQ ID NO: 970511 - DNA, 22 bp, Artificial Sequence
  chemically synthesized
caacacagaagctcaaaagcct

SEQ ID NO: 970512 - DNA, 22 bp, Artificial Sequence
  chemically synthesized
tatagagatagctgaaggcttt

SEQ ID NO: 970513 - DNA, 22 bp, Artificial Sequence
  chemically synthesized
aaaagccttcagctatctctat

SEQ ID NO: 970514 - DNA, 22 bp, Artificial Sequence
  chemically synthesized
aaatggcattgtatagagatag

SEQ ID NO: 970515 - DNA, 22 bp, Artificial Sequence
  chemically synthesized
aaaatggcattgtatagagata

SEQ ID NO: 970516 - DNA, 22 bp, Artificial Sequence
  chemically synthesized
cagctatctctatacaatgcca

SEQ ID NO: 970517 - DNA, 22 bp, Artificial Sequence
  chemically synthesized
agctatctctatacaatgccat

SEQ ID NO: 970518 - DNA, 22 bp, Artificial Sequence
  chemically synthesized
caaaggtgtttaaaatggcatt

SEQ ID NO: 970519 - DNA, 22 bp, Artificial Sequence
  chemically synthesized
ccaaaggtgtttaaaatggcat

SEQ ID NO: 970520 - DNA, 22 bp, Artificial Sequence
  chemically synthesized
tctctatacaatgccattttaa

SEQ ID NO: 970521 - DNA, 22 bp, Artificial Sequence
  chemically synthesized
tatacaatgccattttaaacac

SEQ ID NO: 970522 - DNA, 22 bp, Artificial Sequence
  chemically synthesized
tacaatgccattttaaacacct

SEQ ID NO: 970523 - DNA, 22 bp, Artificial Sequence
  chemically synthesized
ataatcttccaaaggtgtttaa

SEQ ID NO: 970524 - DNA, 22 bp, Artificial Sequence
  chemically synthesized
aataatcttccaaaggtgttta

SEQ ID NO: 970525 - DNA, 22 bp, Artificial Sequence
  chemically synthesized
taataatcttccaaaggtgttt

SEQ ID NO: 970526 - DNA, 22 bp, Artificial Sequence
  chemically synthesized
acatattttaataatcttccaa

SEQ ID NO: 970527 - DNA, 22 bp, Artificial Sequence
  chemically synthesized
taaacacctttggaagattatt

SEQ ID NO: 970528 - DNA, 22 bp, Artificial Sequence
  chemically synthesized
aaacacctttggaagattatta

SEQ ID NO: 970529 - DNA, 22 bp, Artificial Sequence
  chemically synthesized
aacacctttggaagattattaa

SEQ ID NO: 970530 - DNA, 22 bp, Artificial Sequence
  chemically synthesized
tggaagattattaaaatatgtt

SEQ ID NO: 970531 - DNA, 22 bp, Artificial Sequence
  chemically synthesized
gacaaaataattaacatatttt

SEQ ID NO: 970532 - DNA, 22 bp, Artificial Sequence
  chemically synthesized
ggaagattattaaaatatgtta

SEQ ID NO: 970533 - DNA, 22 bp, Artificial Sequence
  chemically synthesized
cgacaaaataattaacatattt

SEQ ID NO: 970534 - DNA, 22 bp, Artificial Sequence
  chemically synthesized
gaagattattaaaatatgttaa

SEQ ID NO: 970535 - DNA, 22 bp, Artificial Sequence
  chemically synthesized
tcgacaaaataattaacatatt

SEQ ID NO: 970536 - DNA, 22 bp, Artificial Sequence
  chemically synthesized
ttcgacaaaataattaacatat

SEQ ID NO: 970537 - DNA, 22 bp, Artificial Sequence
  chemically synthesized
gtttttcgacaaaataattaac

SEQ ID NO: 970538 - DNA, 22 bp, Artificial Sequence
  chemically synthesized
agtttttcgacaaaataattaa

SEQ ID NO: 970539 - DNA, 22 bp, Artificial Sequence
  chemically synthesized
tagtttttcgacaaaataatta

SEQ ID NO: 970540 - DNA, 22 bp, Artificial Sequence
  chemically synthesized
ttaaaatatgttaattattttg

SEQ ID NO: 970541 - DNA, 22 bp, Artificial Sequence
  chemically synthesized
ttagtttttcgacaaaataatt

SEQ ID NO: 970542 - DNA, 22 bp, Artificial Sequence
  chemically synthesized
aaatatgttaattattttgtcg

SEQ ID NO: 970543 - DNA, 22 bp, Artificial Sequence
  chemically synthesized
aatttttagtttttcgacaaaa

SEQ ID NO: 970544 - DNA, 22 bp, Artificial Sequence
  chemically synthesized
aaatttttagtttttcgacaaa

SEQ ID NO: 970545 - DNA, 22 bp, Artificial Sequence
  chemically synthesized
taaatttttagtttttcgacaa

SEQ ID NO: 970546 - DNA, 22 bp, Artificial Sequence
  chemically synthesized
ttaaatttttagtttttcgaca

SEQ ID NO: 970547 - DNA, 22 bp, Artificial Sequence
  chemically synthesized
tttaaatttttagtttttcgac

SEQ ID NO: 970548 - DNA, 22 bp, Artificial Sequence
  chemically synthesized
ctttttaaatttttagtttttc

SEQ ID NO: 970549 - DNA, 22 bp, Artificial Sequence
  chemically synthesized
attattttgtcgaaaaactaaa

SEQ ID NO: 970550 - DNA, 22 bp, Artificial Sequence
  chemically synthesized
gctttttaaatttttagttttt

SEQ ID NO: 970551 - DNA, 22 bp, Artificial Sequence
  chemically synthesized
ttttgtcgaaaaactaaaaatt

SEQ ID NO: 970552 - DNA, 22 bp, Artificial Sequence
  chemically synthesized
tcttgctttttaaatttttagt

SEQ ID NO: 970553 - DNA, 22 bp, Artificial Sequence
  chemically synthesized
tgtcgaaaaactaaaaatttaa

SEQ ID NO: 970554 - DNA, 22 bp, Artificial Sequence
  chemically synthesized
gtcgaaaaactaaaaatttaaa

SEQ ID NO: 970555 - DNA, 22 bp, Artificial Sequence
  chemically synthesized
tcgaaaaactaaaaatttaaaa

SEQ ID NO: 970556 - DNA, 22 bp, Artificial Sequence
  chemically synthesized
acctgtcttgctttttaaattt

SEQ ID NO: 970557 - DNA, 22 bp, Artificial Sequence
  chemically synthesized
ttgacctgtcttgctttttaaa

SEQ ID NO: 970558 - DNA, 22 bp, Artificial Sequence
  chemically synthesized
gttgacctgtcttgctttttaa

SEQ ID NO: 970559 - DNA, 22 bp, Artificial Sequence
  chemically synthesized
tgttgacctgtcttgcttttta

SEQ ID NO: 970560 - DNA, 22 bp, Artificial Sequence
  chemically synthesized
gcctttgttgacctgtcttgct

SEQ ID NO: 970561 - DNA, 22 bp, Artificial Sequence
  chemically synthesized
aaaatttaaaaagcaagacagg

SEQ ID NO: 970562 - DNA, 22 bp, Artificial Sequence
  chemically synthesized
atctggcctttgttgacctgtc

SEQ ID NO: 970563 - DNA, 22 bp, Artificial Sequence
  chemically synthesized
taatctggcctttgttgacctg

SEQ ID NO: 970564 - DNA, 22 bp, Artificial Sequence
  chemically synthesized
aaaaagcaagacaggtcaacaa

SEQ ID NO: 970565 - DNA, 22 bp, Artificial Sequence
  chemically synthesized
ctaatctggcctttgttgacct

SEQ ID NO: 970566 - DNA, 22 bp, Artificial Sequence
  chemically synthesized
aaaagcaagacaggtcaacaaa

SEQ ID NO: 970567 - DNA, 22 bp, Artificial Sequence
  chemically synthesized
tggtaatttctaatctggcctt

SEQ ID NO: 970568 - DNA, 22 bp, Artificial Sequence
  chemically synthesized
atggtaatttctaatctggcct

SEQ ID NO: 970569 - DNA, 22 bp, Artificial Sequence
  chemically synthesized
ataatttatggtaatttctaat

SEQ ID NO: 970570 - DNA, 22 bp, Artificial Sequence
  chemically synthesized
aataatttatggtaatttctaa

SEQ ID NO: 970571 - DNA, 22 bp, Artificial Sequence
  chemically synthesized
taataatttatggtaatttcta

SEQ ID NO: 970572 - DNA, 22 bp, Artificial Sequence
  chemically synthesized
tgactttaataatttatggtaa

SEQ ID NO: 970573 - DNA, 22 bp, Artificial Sequence
  chemically synthesized
atgactttaataatttatggta

SEQ ID NO: 970574 - DNA, 22 bp, Artificial Sequence
  chemically synthesized
tatgactttaataatttatggt

SEQ ID NO: 970575 - DNA, 22 bp, Artificial Sequence
  chemically synthesized
gaaattaccataaattattaaa

SEQ ID NO: 970576 - DNA, 22 bp, Artificial Sequence
  chemically synthesized
agtatgttttatgactttaata

SEQ ID NO: 970577 - DNA, 22 bp, Artificial Sequence
  chemically synthesized
cagtatgttttatgactttaat

SEQ ID NO: 970578 - DNA, 22 bp, Artificial Sequence
  chemically synthesized
ccataaattattaaagtcataa

SEQ ID NO: 970579 - DNA, 22 bp, Artificial Sequence
  chemically synthesized
ttaaagtcataaaacatactga

SEQ ID NO: 970580 - DNA, 22 bp, Artificial Sequence
  chemically synthesized
catcccaaagatttcagtatgt

SEQ ID NO: 970581 - DNA, 22 bp, Artificial Sequence
  chemically synthesized
aagtcataaaacatactgaaat

SEQ ID NO: 970582 - DNA, 22 bp, Artificial Sequence
  chemically synthesized
aattacatcccaaagatttcag

SEQ ID NO: 970583 - DNA, 22 bp, Artificial Sequence
  chemically synthesized
atgtgttaaattacatcccaaa

SEQ ID NO: 970584 - DNA, 22 bp, Artificial Sequence
  chemically synthesized
aaatctttgggatgtaatttaa

SEQ ID NO: 970585 - DNA, 22 bp, Artificial Sequence
  chemically synthesized
tgggatgtaatttaacacatga

SEQ ID NO: 970586 - DNA, 22 bp, Artificial Sequence
  chemically synthesized
gggatgtaatttaacacatgag

SEQ ID NO: 970587 - DNA, 22 bp, Artificial Sequence
  chemically synthesized
ggatgtaatttaacacatgaga

SEQ ID NO: 970588 - DNA, 22 bp, Artificial Sequence
  chemically synthesized
agtagtcgtaaatctcatgtgt

SEQ ID NO: 970589 - DNA, 22 bp, Artificial Sequence
  chemically synthesized
gagtagtcgtaaatctcatgtg

SEQ ID NO: 970590 - DNA, 22 bp, Artificial Sequence
  chemically synthesized
ttgagtagtcgtaaatctcatg

SEQ ID NO: 970591 - DNA, 22 bp, Artificial Sequence
  chemically synthesized
cttgagtagtcgtaaatctcat

SEQ ID NO: 970592 - DNA, 22 bp, Artificial Sequence
  chemically synthesized
aacacatgagatttacgactac

SEQ ID NO: 970593 - DNA, 22 bp, Artificial Sequence
  chemically synthesized
acacatgagatttacgactact

SEQ ID NO: 970594 - DNA, 22 bp, Artificial Sequence
  chemically synthesized
catagtatgcttcttgagtagt

SEQ ID NO: 970595 - DNA, 22 bp, Artificial Sequence
  chemically synthesized
acgactactcaagaagcatact

SEQ ID NO: 970596 - DNA, 22 bp, Artificial Sequence
  chemically synthesized
cgactactcaagaagcatacta

SEQ ID NO: 970597 - DNA, 22 bp, Artificial Sequence
  chemically synthesized
ctcaagaagcatactatgtagt

SEQ ID NO: 970598 - DNA, 22 bp, Artificial Sequence
  chemically synthesized
aagaagcatactatgtagtatg

SEQ ID NO: 970599 - DNA, 22 bp, Artificial Sequence
  chemically synthesized
aaagcacaaaagtgacatacta

SEQ ID NO: 970600 - DNA, 22 bp, Artificial Sequence
  chemically synthesized
ctcaaagcacaaaagtgacata

SEQ ID NO: 970601 - DNA, 22 bp, Artificial Sequence
  chemically synthesized
gctcaaagcacaaaagtgacat

SEQ ID NO: 970602 - DNA, 22 bp, Artificial Sequence
  chemically synthesized
cttgctcaaagcacaaaagtga

SEQ ID NO: 970603 - DNA, 22 bp, Artificial Sequence
  chemically synthesized
tgtagtatgtcacttttgtgct

SEQ ID NO: 970604 - DNA, 22 bp, Artificial Sequence
  chemically synthesized
ttgtgctttgagcaaggaacat

SEQ ID NO: 970605 - DNA, 22 bp, Artificial Sequence
  chemically synthesized
tgtgctttgagcaaggaacata

SEQ ID NO: 970606 - DNA, 22 bp, Artificial Sequence
  chemically synthesized
gtgctttgagcaaggaacatac

SEQ ID NO: 970607 - DNA, 22 bp, Artificial Sequence
  chemically synthesized
tgctttgagcaaggaacatact

SEQ ID NO: 970608 - DNA, 22 bp, Artificial Sequence
  chemically synthesized
aaatagaggaatcaaagtatgt

SEQ ID NO: 970609 - DNA, 22 bp, Artificial Sequence
  chemically synthesized
tgagcaaggaacatactttgat

SEQ ID NO: 970610 - DNA, 22 bp, Artificial Sequence
  chemically synthesized
gagcaaggaacatactttgatt

SEQ ID NO: 970611 - DNA, 22 bp, Artificial Sequence
  chemically synthesized
agcaaggaacatactttgattc

SEQ ID NO: 970612 - DNA, 22 bp, Artificial Sequence
  chemically synthesized
atcccactgaaatagaggaatc

SEQ ID NO: 970613 - DNA, 22 bp, Artificial Sequence
  chemically synthesized
catcccactgaaatagaggaat

SEQ ID NO: 970614 - DNA, 22 bp, Artificial Sequence
  chemically synthesized
tcatcccactgaaatagaggaa

SEQ ID NO: 970615 - DNA, 22 bp, Artificial Sequence
  chemically synthesized
ttttcatcccactgaaatagag

SEQ ID NO: 970616 - DNA, 22 bp, Artificial Sequence
  chemically synthesized
tgattcctctatttcagtggga

SEQ ID NO: 970617 - DNA, 22 bp, Artificial Sequence
  chemically synthesized
gattcctctatttcagtgggat

SEQ ID NO: 970618 - DNA, 22 bp, Artificial Sequence
  chemically synthesized
attcctctatttcagtgggatg

SEQ ID NO: 970619 - DNA, 22 bp, Artificial Sequence
  chemically synthesized
ctctatttcagtgggatgaaaa

SEQ ID NO: 970620 - DNA, 22 bp, Artificial Sequence
  chemically synthesized
gaggcacaagctgttttcatcc

SEQ ID NO: 970621 - DNA, 22 bp, Artificial Sequence
  chemically synthesized
tatttcagtgggatgaaaacag

SEQ ID NO: 970622 - DNA, 22 bp, Artificial Sequence
  chemically synthesized
tagaggcacaagctgttttcat

SEQ ID NO: 970623 - DNA, 22 bp, Artificial Sequence
  chemically synthesized
tttcagtgggatgaaaacagct

SEQ ID NO: 970624 - DNA, 22 bp, Artificial Sequence
  chemically synthesized
attctagaggcacaagctgttt

SEQ ID NO: 970625 - DNA, 22 bp, Artificial Sequence
  chemically synthesized
cagtgggatgaaaacagcttgt

SEQ ID NO: 970626 - DNA, 22 bp, Artificial Sequence
  chemically synthesized
aattctagaggcacaagctgtt

SEQ ID NO: 970627 - DNA, 22 bp, Artificial Sequence
  chemically synthesized
agtgggatgaaaacagcttgtg

SEQ ID NO: 970628 - DNA, 22 bp, Artificial Sequence
  chemically synthesized
tcttaattctagaggcacaagc

SEQ ID NO: 970629 - DNA, 22 bp, Artificial Sequence
  chemically synthesized
tgggccattgtcttaattctag

SEQ ID NO: 970630 - DNA, 22 bp, Artificial Sequence
  chemically synthesized
tgtgggccattgtcttaattct

SEQ ID NO: 970631 - DNA, 22 bp, Artificial Sequence
  chemically synthesized
gtgcctctagaattaagacaat

SEQ ID NO: 970632 - DNA, 22 bp, Artificial Sequence
  chemically synthesized
attctgtgggccattgtcttaa

SEQ ID NO: 970633 - DNA, 22 bp, Artificial Sequence
  chemically synthesized
tgcctctagaattaagacaatg

SEQ ID NO: 970634 - DNA, 22 bp, Artificial Sequence
  chemically synthesized
ttaattctgtgggccattgtct

SEQ ID NO: 970635 - DNA, 22 bp, Artificial Sequence
  chemically synthesized
tagaattaagacaatggcccac

SEQ ID NO: 970636 - DNA, 22 bp, Artificial Sequence
  chemically synthesized
gaattaagacaatggcccacag

SEQ ID NO: 970637 - DNA, 22 bp, Artificial Sequence
  chemically synthesized
tcatattattaattctgtgggc

SEQ ID NO: 970638 - DNA, 22 bp, Artificial Sequence
  chemically synthesized
agacaatggcccacagaattaa

SEQ ID NO: 970639 - DNA, 22 bp, Artificial Sequence
  chemically synthesized
attatcatattattaattctgt

SEQ ID NO: 970640 - DNA, 22 bp, Artificial Sequence
  chemically synthesized
attcattatcatattattaatt

SEQ ID NO: 970641 - DNA, 22 bp, Artificial Sequence
  chemically synthesized
aattcattatcatattattaat

SEQ ID NO: 970642 - DNA, 22 bp, Artificial Sequence
  chemically synthesized
ataatatgataatgaattaaat

SEQ ID NO: 970643 - DNA, 22 bp, Artificial Sequence
  chemically synthesized
tgaaatatagagaatttaattc

SEQ ID NO: 970644 - DNA, 22 bp, Artificial Sequence
  chemically synthesized
tgtgaaatatagagaatttaat

SEQ ID NO: 970645 - DNA, 22 bp, Artificial Sequence
  chemically synthesized
ctgtgaaatatagagaatttaa

SEQ ID NO: 970646 - DNA, 22 bp, Artificial Sequence
  chemically synthesized
tctgtgaaatatagagaattta

SEQ ID NO: 970647 - DNA, 22 bp, Artificial Sequence
  chemically synthesized
ttttctgtgaaatatagagaat

SEQ ID NO: 970648 - DNA, 22 bp, Artificial Sequence
  chemically synthesized
ttattttctgtgaaatatagag

SEQ ID NO: 970649 - DNA, 22 bp, Artificial Sequence
  chemically synthesized
gttattttctgtgaaatataga

SEQ ID NO: 970650 - DNA, 22 bp, Artificial Sequence
  chemically synthesized
aattctctatatttcacagaaa

SEQ ID NO: 970651 - DNA, 22 bp, Artificial Sequence
  chemically synthesized
tctatatttcacagaaaataac

SEQ ID NO: 970652 - DNA, 22 bp, Artificial Sequence
  chemically synthesized
tatatttcacagaaaataacaa

SEQ ID NO: 970653 - DNA, 22 bp, Artificial Sequence
  chemically synthesized
tatttcacagaaaataacaaat

SEQ ID NO: 970654 - DNA, 22 bp, Artificial Sequence
  chemically synthesized
acagtcataaaaaatttgttat

SEQ ID NO: 970655 - DNA, 22 bp, Artificial Sequence
  chemically synthesized
ttgacagtcataaaaaatttgt

SEQ ID NO: 970656 - DNA, 22 bp, Artificial Sequence
  chemically synthesized
cacagaaaataacaaatttttt

SEQ ID NO: 970657 - DNA, 22 bp, Artificial Sequence
  chemically synthesized
attgacagtcataaaaaatttg

SEQ ID NO: 970658 - DNA, 22 bp, Artificial Sequence
  chemically synthesized
acagaaaataacaaatttttta

SEQ ID NO: 970659 - DNA, 22 bp, Artificial Sequence
  chemically synthesized
tattgacagtcataaaaaattt

SEQ ID NO: 970660 - DNA, 22 bp, Artificial Sequence
  chemically synthesized
agggttttattgacagtcataa

SEQ ID NO: 970661 - DNA, 22 bp, Artificial Sequence
  chemically synthesized
tctgagggttttattgacagtc

SEQ ID NO: 970662 - DNA, 22 bp, Artificial Sequence
  chemically synthesized
aactatctgagggttttattga

SEQ ID NO: 970663 - DNA, 22 bp, Artificial Sequence
  chemically synthesized
tttatgactgtcaataaaaccc

SEQ ID NO: 970664 - DNA, 22 bp, Artificial Sequence
  chemically synthesized
ttatgactgtcaataaaaccct

SEQ ID NO: 970665 - DNA, 22 bp, Artificial Sequence
  chemically synthesized
tatgactgtcaataaaaccctc

SEQ ID NO: 970666 - DNA, 22 bp, Artificial Sequence
  chemically synthesized
atgactgtcaataaaaccctca

SEQ ID NO: 970667 - DNA, 22 bp, Artificial Sequence
  chemically synthesized
tgactgtcaataaaaccctcag

SEQ ID NO: 970668 - DNA, 22 bp, Artificial Sequence
  chemically synthesized
tacagagttgaactatctgagg

SEQ ID NO: 970669 - DNA, 22 bp, Artificial Sequence
  chemically synthesized
tcaataaaaccctcagatagtt

SEQ ID NO: 970670 - DNA, 22 bp, Artificial Sequence
  chemically synthesized
gttatacagagttgaactatct

SEQ ID NO: 970671 - DNA, 22 bp, Artificial Sequence
  chemically synthesized
ttagttatacagagttgaacta

SEQ ID NO: 970672 - DNA, 22 bp, Artificial Sequence
  chemically synthesized
gttagttatacagagttgaact

SEQ ID NO: 970673 - DNA, 22 bp, Artificial Sequence
  chemically synthesized
ttgttagttatacagagttgaa

SEQ ID NO: 970674 - DNA, 22 bp, Artificial Sequence
  chemically synthesized
cttgttagttatacagagttga

SEQ ID NO: 970675 - DNA, 22 bp, Artificial Sequence
  chemically synthesized
tcttgttagttatacagagttg

SEQ ID NO: 970676 - DNA, 22 bp, Artificial Sequence
  chemically synthesized
ttcttgttagttatacagagtt

SEQ ID NO: 970677 - DNA, 22 bp, Artificial Sequence
  chemically synthesized
agatagttcaactctgtataac

SEQ ID NO: 970678 - DNA, 22 bp, Artificial Sequence
  chemically synthesized
atttttcttgttagttatacag

SEQ ID NO: 970679 - DNA, 22 bp, Artificial Sequence
  chemically synthesized
aactaatttttcttgttagtta

SEQ ID NO: 970680 - DNA, 22 bp, Artificial Sequence
  chemically synthesized
aaactaatttttcttgttagtt

SEQ ID NO: 970681 - DNA, 22 bp, Artificial Sequence
  chemically synthesized
taaactaatttttcttgttagt

SEQ ID NO: 970682 - DNA, 22 bp, Artificial Sequence
  chemically synthesized
aactctgtataactaacaagaa

SEQ ID NO: 970683 - DNA, 22 bp, Artificial Sequence
  chemically synthesized
tgtataactaacaagaaaaatt

SEQ ID NO: 970684 - DNA, 22 bp, Artificial Sequence
  chemically synthesized
tataactaacaagaaaaattag

SEQ ID NO: 970685 - DNA, 22 bp, Artificial Sequence
  chemically synthesized
aaatgacattttaaactaattt

SEQ ID NO: 970686 - DNA, 22 bp, Artificial Sequence
  chemically synthesized
acaagaaaaattagtttaaaat

SEQ ID NO: 970687 - DNA, 22 bp, Artificial Sequence
  chemically synthesized
aaggagggttaaaatgacattt

SEQ ID NO: 970688 - DNA, 22 bp, Artificial Sequence
  chemically synthesized
aaaggagggttaaaatgacatt

SEQ ID NO: 970689 - DNA, 22 bp, Artificial Sequence
  chemically synthesized
taaaggagggttaaaatgacat

SEQ ID NO: 970690 - DNA, 22 bp, Artificial Sequence
  chemically synthesized
ttaaaggagggttaaaatgaca

SEQ ID NO: 970691 - DNA, 22 bp, Artificial Sequence
  chemically synthesized
tttaaaggagggttaaaatgac

SEQ ID NO: 970692 - DNA, 22 bp, Artificial Sequence
  chemically synthesized
ttttaaaggagggttaaaatga

SEQ ID NO: 970693 - DNA, 22 bp, Artificial Sequence
  chemically synthesized
tttttaaaggagggttaaaatg

SEQ ID NO: 970694 - DNA, 22 bp, Artificial Sequence
  chemically synthesized
gtttaaaatgtcattttaaccc

SEQ ID NO: 970695 - DNA, 22 bp, Artificial Sequence
  chemically synthesized
ttttttaaaggagggttaaaat

SEQ ID NO: 970696 - DNA, 22 bp, Artificial Sequence
  chemically synthesized
tttttttaaaggagggttaaaa

SEQ ID NO: 970697 - DNA, 22 bp, Artificial Sequence
  chemically synthesized
ttttttttaaaggagggttaaa

SEQ ID NO: 970698 - DNA, 22 bp, Artificial Sequence
  chemically synthesized
aaaatgtcattttaaccctcct

SEQ ID NO: 970699 - DNA, 22 bp, Artificial Sequence
  chemically synthesized
aaatgtcattttaaccctcctt

SEQ ID NO: 970700 - DNA, 22 bp, Artificial Sequence
  chemically synthesized
gataagcttttttttttaaagg

SEQ ID NO: 970701 - DNA, 22 bp, Artificial Sequence
  chemically synthesized
agataagcttttttttttaaag

SEQ ID NO: 970702 - DNA, 22 bp, Artificial Sequence
  chemically synthesized
taaccctcctttaaaaaaaaaa

SEQ ID NO: 970703 - DNA, 22 bp, Artificial Sequence
  chemically synthesized
aaccctcctttaaaaaaaaaag

SEQ ID NO: 970704 - DNA, 22 bp, Artificial Sequence
  chemically synthesized
accctcctttaaaaaaaaaagc

SEQ ID NO: 970705 - DNA, 22 bp, Artificial Sequence
  chemically synthesized
cagtaaatttagataagctttt

SEQ ID NO: 970706 - DNA, 22 bp, Artificial Sequence
  chemically synthesized
ctttaaaaaaaaaagcttatct

SEQ ID NO: 970707 - DNA, 22 bp, Artificial Sequence
  chemically synthesized
taaaaaaaaaagcttatctaaa

SEQ ID NO: 970708 - DNA, 22 bp, Artificial Sequence
  chemically synthesized
aaaaaaaaaagcttatctaaat

SEQ ID NO: 970709 - DNA, 22 bp, Artificial Sequence
  chemically synthesized
aaaaaaaaagcttatctaaatt

SEQ ID NO: 970710 - DNA, 22 bp, Artificial Sequence
  chemically synthesized
atatctccagtaaatttagata

SEQ ID NO: 970711 - DNA, 22 bp, Artificial Sequence
  chemically synthesized
attgatatctccagtaaattta

SEQ ID NO: 970712 - DNA, 22 bp, Artificial Sequence
  chemically synthesized
atctaaatttactggagatatc

SEQ ID NO: 970713 - DNA, 22 bp, Artificial Sequence
  chemically synthesized
cgtaacctcattgatatctcca

SEQ ID NO: 970714 - DNA, 22 bp, Artificial Sequence
  chemically synthesized
tctaaatttactggagatatca

SEQ ID NO: 970715 - DNA, 22 bp, Artificial Sequence
  chemically synthesized
tccgtaacctcattgatatctc

SEQ ID NO: 970716 - DNA, 22 bp, Artificial Sequence
  chemically synthesized
aatttactggagatatcaatga

SEQ ID NO: 970717 - DNA, 22 bp, Artificial Sequence
  chemically synthesized
actggagatatcaatgaggtta

SEQ ID NO: 970718 - DNA, 22 bp, Artificial Sequence
  chemically synthesized
ctggagatatcaatgaggttac

SEQ ID NO: 970719 - DNA, 22 bp, Artificial Sequence
  chemically synthesized
aaataattctccgtaacctcat

SEQ ID NO: 970720 - DNA, 22 bp, Artificial Sequence
  chemically synthesized
aaaataattctccgtaacctca

SEQ ID NO: 970721 - DNA, 22 bp, Artificial Sequence
  chemically synthesized
gagatatcaatgaggttacgga

SEQ ID NO: 970722 - DNA, 22 bp, Artificial Sequence
  chemically synthesized
ttaaaataattctccgtaacct

SEQ ID NO: 970723 - DNA, 22 bp, Artificial Sequence
  chemically synthesized
cttaaaataattctccgtaacc

SEQ ID NO: 970724 - DNA, 22 bp, Artificial Sequence
  chemically synthesized
catttcttaaaataattctccg

SEQ ID NO: 970725 - DNA, 22 bp, Artificial Sequence
  chemically synthesized
acatttcttaaaataattctcc

SEQ ID NO: 970726 - DNA, 22 bp, Artificial Sequence
  chemically synthesized
tacatttcttaaaataattctc

SEQ ID NO: 970727 - DNA, 22 bp, Artificial Sequence
  chemically synthesized
ttacatttcttaaaataattct

SEQ ID NO: 970728 - DNA, 22 bp, Artificial Sequence
  chemically synthesized
tttacatttcttaaaataattc

SEQ ID NO: 970729 - DNA, 22 bp, Artificial Sequence
  chemically synthesized
ctttttacatttcttaaaataa

SEQ ID NO: 970730 - DNA, 22 bp, Artificial Sequence
  chemically synthesized
cggagaattattttaagaaatg

SEQ ID NO: 970731 - DNA, 22 bp, Artificial Sequence
  chemically synthesized
tggttcctttttacatttctta

SEQ ID NO: 970732 - DNA, 22 bp, Artificial Sequence
  chemically synthesized
ttttaagaaatgtaaaaaggaa

SEQ ID NO: 970733 - DNA, 22 bp, Artificial Sequence
  chemically synthesized
taagaaatgtaaaaaggaacca

SEQ ID NO: 970734 - DNA, 22 bp, Artificial Sequence
  chemically synthesized
aagaaatgtaaaaaggaaccac

SEQ ID NO: 970735 - DNA, 22 bp, Artificial Sequence
  chemically synthesized
agaaatgtaaaaaggaaccaca

SEQ ID NO: 970736 - DNA, 22 bp, Artificial Sequence
  chemically synthesized
atgagcaaagaaccattgtggt

SEQ ID NO: 970737 - DNA, 22 bp, Artificial Sequence
  chemically synthesized
ttaatgagcaaagaaccattgt

SEQ ID NO: 970738 - DNA, 22 bp, Artificial Sequence
  chemically synthesized
gttaatgagcaaagaaccattg

SEQ ID NO: 970739 - DNA, 22 bp, Artificial Sequence
  chemically synthesized
tgttaatgagcaaagaaccatt

SEQ ID NO: 970740 - DNA, 22 bp, Artificial Sequence
  chemically synthesized
tgtagcattttgttaatgagca

SEQ ID NO: 970741 - DNA, 22 bp, Artificial Sequence
  chemically synthesized
tagttatgtagcattttgttaa

SEQ ID NO: 970742 - DNA, 22 bp, Artificial Sequence
  chemically synthesized
gtagttatgtagcattttgtta

SEQ ID NO: 970743 - DNA, 22 bp, Artificial Sequence
  chemically synthesized
ttgtagttatgtagcattttgt

SEQ ID NO: 970744 - DNA, 22 bp, Artificial Sequence
  chemically synthesized
tttgctcattaacaaaatgcta

SEQ ID NO: 970745 - DNA, 22 bp, Artificial Sequence
  chemically synthesized
tgctcattaacaaaatgctaca

SEQ ID NO: 970746 - DNA, 22 bp, Artificial Sequence
  chemically synthesized
gctcattaacaaaatgctacat

SEQ ID NO: 970747 - DNA, 22 bp, Artificial Sequence
  chemically synthesized
ctcattaacaaaatgctacata

SEQ ID NO: 970748 - DNA, 22 bp, Artificial Sequence
  chemically synthesized
attaacaaaatgctacataact

SEQ ID NO: 970749 - DNA, 22 bp, Artificial Sequence
  chemically synthesized
taaaccatctcttgtagttatg

SEQ ID NO: 970750 - DNA, 22 bp, Artificial Sequence
  chemically synthesized
acaaaatgctacataactacaa

SEQ ID NO: 970751 - DNA, 22 bp, Artificial Sequence
  chemically synthesized
taattataaaccatctcttgta

SEQ ID NO: 970752 - DNA, 22 bp, Artificial Sequence
  chemically synthesized
gtaattataaaccatctcttgt

SEQ ID NO: 970753 - DNA, 22 bp, Artificial Sequence
  chemically synthesized
ttgtaattataaaccatctctt

SEQ ID NO: 970754 - DNA, 22 bp, Artificial Sequence
  chemically synthesized
cataactacaagagatggttta

SEQ ID NO: 970755 - DNA, 22 bp, Artificial Sequence
  chemically synthesized
acctcttgtaattataaaccat

SEQ ID NO: 970756 - DNA, 22 bp, Artificial Sequence
  chemically synthesized
caagagatggtttataattaca

SEQ ID NO: 970757 - DNA, 22 bp, Artificial Sequence
  chemically synthesized
caaagcatgattaacctcttgt

SEQ ID NO: 970758 - DNA, 22 bp, Artificial Sequence
  chemically synthesized
gcaaagcatgattaacctcttg

SEQ ID NO: 970759 - DNA, 22 bp, Artificial Sequence
  chemically synthesized
ataattacaagaggttaatcat

SEQ ID NO: 970760 - DNA, 22 bp, Artificial Sequence
  chemically synthesized
taattacaagaggttaatcatg

SEQ ID NO: 970761 - DNA, 22 bp, Artificial Sequence
  chemically synthesized
caacttgcaaagcatgattaac

SEQ ID NO: 970762 - DNA, 22 bp, Artificial Sequence
  chemically synthesized
acaacttgcaaagcatgattaa

SEQ ID NO: 970763 - DNA, 22 bp, Artificial Sequence
  chemically synthesized
tacaacttgcaaagcatgatta

SEQ ID NO: 970764 - DNA, 22 bp, Artificial Sequence
  chemically synthesized
caagaggttaatcatgctttgc

SEQ ID NO: 970765 - DNA, 22 bp, Artificial Sequence
  chemically synthesized
agagagtaaattttacaacttg

SEQ ID NO: 970766 - DNA, 22 bp, Artificial Sequence
  chemically synthesized
atcatgctttgcaagttgtaaa

SEQ ID NO: 970767 - DNA, 22 bp, Artificial Sequence
  chemically synthesized
ctaagagagtaaattttacaac

SEQ ID NO: 970768 - DNA, 22 bp, Artificial Sequence
  chemically synthesized
cctaagagagtaaattttacaa

SEQ ID NO: 970769 - DNA, 22 bp, Artificial Sequence
  chemically synthesized
tttcctaagagagtaaatttta

SEQ ID NO: 970770 - DNA, 22 bp, Artificial Sequence
  chemically synthesized
tgcaagttgtaaaatttactct

SEQ ID NO: 970771 - DNA, 22 bp, Artificial Sequence
  chemically synthesized
gcaagttgtaaaatttactctc

SEQ ID NO: 970772 - DNA, 22 bp, Artificial Sequence
  chemically synthesized
caagttgtaaaatttactctct

SEQ ID NO: 970773 - DNA, 22 bp, Artificial Sequence
  chemically synthesized
aaattatttcctaagagagtaa

SEQ ID NO: 970774 - DNA, 22 bp, Artificial Sequence
  chemically synthesized
gaaattatttcctaagagagta

SEQ ID NO: 970775 - DNA, 22 bp, Artificial Sequence
  chemically synthesized
ttgaaattatttcctaagagag

SEQ ID NO: 970776 - DNA, 22 bp, Artificial Sequence
  chemically synthesized
taaaatttactctcttaggaaa

SEQ ID NO: 970777 - DNA, 22 bp, Artificial Sequence
  chemically synthesized
actctcttaggaaataatttca

SEQ ID NO: 970778 - DNA, 22 bp, Artificial Sequence
  chemically synthesized
ctctcttaggaaataatttcaa

SEQ ID NO: 970779 - DNA, 22 bp, Artificial Sequence
  chemically synthesized
tcttaggaaataatttcaagag

SEQ ID NO: 970780 - DNA, 22 bp, Artificial Sequence
  chemically synthesized
acaatcagtaggactcttgaaa

SEQ ID NO: 970781 - DNA, 22 bp, Artificial Sequence
  chemically synthesized
ttaggaaataatttcaagagtc

SEQ ID NO: 970782 - DNA, 22 bp, Artificial Sequence
  chemically synthesized
aggaaataatttcaagagtcct

SEQ ID NO: 970783 - DNA, 22 bp, Artificial Sequence
  chemically synthesized
ttaacaatcagtaggactcttg

SEQ ID NO: 970784 - DNA, 22 bp, Artificial Sequence
  chemically synthesized
ggaaataatttcaagagtccta

SEQ ID NO: 970785 - DNA, 22 bp, Artificial Sequence
  chemically synthesized
acctgttaacaatcagtaggac

SEQ ID NO: 970786 - DNA, 22 bp, Artificial Sequence
  chemically synthesized
aacctgttaacaatcagtagga

SEQ ID NO: 970787 - DNA, 22 bp, Artificial Sequence
  chemically synthesized
taacctgttaacaatcagtagg

SEQ ID NO: 970788 - DNA, 22 bp, Artificial Sequence
  chemically synthesized
ttaacctgttaacaatcagtag

SEQ ID NO: 970789 - DNA, 22 bp, Artificial Sequence
  chemically synthesized
tttaacctgttaacaatcagta

SEQ ID NO: 970790 - DNA, 22 bp, Artificial Sequence
  chemically synthesized
caagagtcctactgattgttaa

SEQ ID NO: 970791 - DNA, 22 bp, Artificial Sequence
  chemically synthesized
aagagtcctactgattgttaac

SEQ ID NO: 970792 - DNA, 22 bp, Artificial Sequence
  chemically synthesized
aaggttttttaacctgttaaca

SEQ ID NO: 970793 - DNA, 22 bp, Artificial Sequence
  chemically synthesized
ctgattgttaacaggttaaaaa

SEQ ID NO: 970794 - DNA, 22 bp, Artificial Sequence
  chemically synthesized
attgttaacaggttaaaaaacc

SEQ ID NO: 970795 - DNA, 22 bp, Artificial Sequence
  chemically synthesized
acaaacgttgaaggttttttaa

SEQ ID NO: 970796 - DNA, 22 bp, Artificial Sequence
  chemically synthesized
ttaacaggttaaaaaaccttca

SEQ ID NO: 970797 - DNA, 22 bp, Artificial Sequence
  chemically synthesized
acaggttaaaaaaccttcaacg

SEQ ID NO: 970798 - DNA, 22 bp, Artificial Sequence
  chemically synthesized
atgtgttaacaaacgttgaagg

SEQ ID NO: 970799 - DNA, 22 bp, Artificial Sequence
  chemically synthesized
aatgtgttaacaaacgttgaag

SEQ ID NO: 970800 - DNA, 22 bp, Artificial Sequence
  chemically synthesized
taatgtgttaacaaacgttgaa

SEQ ID NO: 970801 - DNA, 22 bp, Artificial Sequence
  chemically synthesized
ttaatgtgttaacaaacgttga

SEQ ID NO: 970802 - DNA, 22 bp, Artificial Sequence
  chemically synthesized
tttaatgtgttaacaaacgttg

SEQ ID NO: 970803 - DNA, 22 bp, Artificial Sequence
  chemically synthesized
aaaaaccttcaacgtttgttaa

SEQ ID NO: 970804 - DNA, 22 bp, Artificial Sequence
  chemically synthesized
caacgtttgttaacacattaaa

SEQ ID NO: 970805 - DNA, 22 bp, Artificial Sequence
  chemically synthesized
aacgtttgttaacacattaaaa

SEQ ID NO: 970806 - DNA, 22 bp, Artificial Sequence
  chemically synthesized
gttaacacattaaaaagtcttc

SEQ ID NO: 970807 - DNA, 22 bp, Artificial Sequence
  chemically synthesized
ttaacacattaaaaagtcttca

SEQ ID NO: 970808 - DNA, 22 bp, Artificial Sequence
  chemically synthesized
acacattaaaaagtcttcacat

SEQ ID NO: 970809 - DNA, 22 bp, Artificial Sequence
  chemically synthesized
gtaaaggccaaatatgtgaaga

SEQ ID NO: 970810 - DNA, 22 bp, Artificial Sequence
  chemically synthesized
ggtaaaggccaaatatgtgaag

SEQ ID NO: 970811 - DNA, 22 bp, Artificial Sequence
  chemically synthesized
tggtaaaggccaaatatgtgaa

SEQ ID NO: 970812 - DNA, 22 bp, Artificial Sequence
  chemically synthesized
ctttggtaaaggccaaatatgt

SEQ ID NO: 970813 - DNA, 22 bp, Artificial Sequence
  chemically synthesized
aaaagtcttcacatatttggcc

SEQ ID NO: 970814 - DNA, 22 bp, Artificial Sequence
  chemically synthesized
cctactttggtaaaggccaaat

SEQ ID NO: 970815 - DNA, 22 bp, Artificial Sequence
  chemically synthesized
ctgcctactttggtaaaggcca

SEQ ID NO: 970816 - DNA, 22 bp, Artificial Sequence
  chemically synthesized
cacatatttggcctttaccaaa

SEQ ID NO: 970817 - DNA, 22 bp, Artificial Sequence
  chemically synthesized
acatatttggcctttaccaaag

SEQ ID NO: 970818 - DNA, 22 bp, Artificial Sequence
  chemically synthesized
ggcctttaccaaagtaggcagt

SEQ ID NO: 970819 - DNA, 22 bp, Artificial Sequence
  chemically synthesized
gcctttaccaaagtaggcagta

SEQ ID NO: 970820 - DNA, 22 bp, Artificial Sequence
  chemically synthesized
taccaaagtaggcagtagtgac

SEQ ID NO: 970821 - DNA, 22 bp, Artificial Sequence
  chemically synthesized
accaaagtaggcagtagtgacc

SEQ ID NO: 970822 - DNA, 22 bp, Artificial Sequence
  chemically synthesized
ccaaagtaggcagtagtgacca

SEQ ID NO: 970823 - DNA, 22 bp, Artificial Sequence
  chemically synthesized
aagtataggtgaccatggtcac

SEQ ID NO: 970824 - DNA, 22 bp, Artificial Sequence
  chemically synthesized
ttaaagtataggtgaccatggt

SEQ ID NO: 970825 - DNA, 22 bp, Artificial Sequence
  chemically synthesized
aaaactattaaagtataggtga

SEQ ID NO: 970826 - DNA, 22 bp, Artificial Sequence
  chemically synthesized
taaaaactattaaagtataggt

SEQ ID NO: 970827 - DNA, 22 bp, Artificial Sequence
  chemically synthesized
ttctaaaaactattaaagtata

SEQ ID NO: 970828 - DNA, 22 bp, Artificial Sequence
  chemically synthesized
tgtataagttgttctaaaaact

SEQ ID NO: 970829 - DNA, 22 bp, Artificial Sequence
  chemically synthesized
tactttaatagtttttagaaca

SEQ ID NO: 970830 - DNA, 22 bp, Artificial Sequence
  chemically synthesized
taatagtttttagaacaactta

SEQ ID NO: 970831 - DNA, 22 bp, Artificial Sequence
  chemically synthesized
aagaactatgtataagttgttc

SEQ ID NO: 970832 - DNA, 22 bp, Artificial Sequence
  chemically synthesized
aatagtttttagaacaacttat

SEQ ID NO: 970833 - DNA, 22 bp, Artificial Sequence
  chemically synthesized
caagaactatgtataagttgtt

SEQ ID NO: 970834 - DNA, 22 bp, Artificial Sequence
  chemically synthesized
atagtttttagaacaacttata

SEQ ID NO: 970835 - DNA, 22 bp, Artificial Sequence
  chemically synthesized
ccatttcaagaactatgtataa

SEQ ID NO: 970836 - DNA, 22 bp, Artificial Sequence
  chemically synthesized
ttagaacaacttatacatagtt

SEQ ID NO: 970837 - DNA, 22 bp, Artificial Sequence
  chemically synthesized
tagaacaacttatacatagttc

SEQ ID NO: 970838 - DNA, 22 bp, Artificial Sequence
  chemically synthesized
ttgccatttcaagaactatgta

SEQ ID NO: 970839 - DNA, 22 bp, Artificial Sequence
  chemically synthesized
agaacaacttatacatagttct

SEQ ID NO: 970840 - DNA, 22 bp, Artificial Sequence
  chemically synthesized
attgccatttcaagaactatgt

SEQ ID NO: 970841 - DNA, 22 bp, Artificial Sequence
  chemically synthesized
gaacaacttatacatagttctt

SEQ ID NO: 970842 - DNA, 22 bp, Artificial Sequence
  chemically synthesized
ttattgccatttcaagaactat

SEQ ID NO: 970843 - DNA, 22 bp, Artificial Sequence
  chemically synthesized
attcttattgccatttcaagaa

SEQ ID NO: 970844 - DNA, 22 bp, Artificial Sequence
  chemically synthesized
atacatagttcttgaaatggca

SEQ ID NO: 970845 - DNA, 22 bp, Artificial Sequence
  chemically synthesized
tacatagttcttgaaatggcaa

SEQ ID NO: 970846 - DNA, 22 bp, Artificial Sequence
  chemically synthesized
ccactaattcttattgccattt

SEQ ID NO: 970847 - DNA, 22 bp, Artificial Sequence
  chemically synthesized
ttgccactaattcttattgcca

SEQ ID NO: 970848 - DNA, 22 bp, Artificial Sequence
  chemically synthesized
ttattgccactaattcttattg

SEQ ID NO: 970849 - DNA, 22 bp, Artificial Sequence
  chemically synthesized
attattgccactaattcttatt

SEQ ID NO: 970850 - DNA, 22 bp, Artificial Sequence
  chemically synthesized
ttgaaatggcaataagaattag

SEQ ID NO: 970851 - DNA, 22 bp, Artificial Sequence
  chemically synthesized
tttattattgccactaattctt

SEQ ID NO: 970852 - DNA, 22 bp, Artificial Sequence
  chemically synthesized
gaaatggcaataagaattagtg

SEQ ID NO: 970853 - DNA, 22 bp, Artificial Sequence
  chemically synthesized
atttattattgccactaattct

SEQ ID NO: 970854 - DNA, 22 bp, Artificial Sequence
  chemically synthesized
aaatggcaataagaattagtgg

SEQ ID NO: 970855 - DNA, 22 bp, Artificial Sequence
  chemically synthesized
tatttattattgccactaattc

SEQ ID NO: 970856 - DNA, 22 bp, Artificial Sequence
  chemically synthesized
ataaatgttttatttattattg

SEQ ID NO: 970857 - DNA, 22 bp, Artificial Sequence
  chemically synthesized
tgtgttcataaatgttttattt

SEQ ID NO: 970858 - DNA, 22 bp, Artificial Sequence
  chemically synthesized
gtggcaataataaataaaacat

SEQ ID NO: 970859 - DNA, 22 bp, Artificial Sequence
  chemically synthesized
acaatattgtgtgttcataaat

SEQ ID NO: 970860 - DNA, 22 bp, Artificial Sequence
  chemically synthesized
aacaatattgtgtgttcataaa

SEQ ID NO: 970861 - DNA, 22 bp, Artificial Sequence
  chemically synthesized
taacaatattgtgtgttcataa

SEQ ID NO: 970862 - DNA, 22 bp, Artificial Sequence
  chemically synthesized
gagttttaacaatattgtgtgt

SEQ ID NO: 970863 - DNA, 22 bp, Artificial Sequence
  chemically synthesized
atgaacacacaatattgttaaa

SEQ ID NO: 970864 - DNA, 22 bp, Artificial Sequence
  chemically synthesized
tgaacacacaatattgttaaaa

SEQ ID NO: 970865 - DNA, 22 bp, Artificial Sequence
  chemically synthesized
agtgaacactggagttttaaca

SEQ ID NO: 970866 - DNA, 22 bp, Artificial Sequence
  chemically synthesized
catatctaagtgaacactggag

SEQ ID NO: 970867 - DNA, 22 bp, Artificial Sequence
  chemically synthesized
ttaaaactccagtgttcactta

SEQ ID NO: 970868 - DNA, 22 bp, Artificial Sequence
  chemically synthesized
aaactccagtgttcacttagat

SEQ ID NO: 970869 - DNA, 22 bp, Artificial Sequence
  chemically synthesized
catagattacatatctaagtga

SEQ ID NO: 970870 - DNA, 22 bp, Artificial Sequence
  chemically synthesized
ttacatagattacatatctaag

SEQ ID NO: 970871 - DNA, 22 bp, Artificial Sequence
  chemically synthesized
cagtgttcacttagatatgtaa

SEQ ID NO: 970872 - DNA, 22 bp, Artificial Sequence
  chemically synthesized
tgcaatattgttacatagatta

SEQ ID NO: 970873 - DNA, 22 bp, Artificial Sequence
  chemically synthesized
acttagatatgtaatctatgta

SEQ ID NO: 970874 - DNA, 22 bp, Artificial Sequence
  chemically synthesized
agatatgtaatctatgtaacaa

SEQ ID NO: 970875 - DNA, 22 bp, Artificial Sequence
  chemically synthesized
aattatgcaatattgttacata

SEQ ID NO: 970876 - DNA, 22 bp, Artificial Sequence
  chemically synthesized
gatatgtaatctatgtaacaat

SEQ ID NO: 970877 - DNA, 22 bp, Artificial Sequence
  chemically synthesized
caattatgcaatattgttacat

SEQ ID NO: 970878 - DNA, 22 bp, Artificial Sequence
  chemically synthesized
ttcaattatgcaatattgttac

SEQ ID NO: 970879 - DNA, 22 bp, Artificial Sequence
  chemically synthesized
gcaaactcttcaattatgcaat

SEQ ID NO: 970880 - DNA, 22 bp, Artificial Sequence
  chemically synthesized
ggcaaactcttcaattatgcaa

SEQ ID NO: 970881 - DNA, 22 bp, Artificial Sequence
  chemically synthesized
tgtaacaatattgcataattga

SEQ ID NO: 970882 - DNA, 22 bp, Artificial Sequence
  chemically synthesized
tcttggcaaactcttcaattat

SEQ ID NO: 970883 - DNA, 22 bp, Artificial Sequence
  chemically synthesized
cataattgaagagtttgccaag

SEQ ID NO: 970884 - DNA, 22 bp, Artificial Sequence
  chemically synthesized
aagagtttgccaagataattac

SEQ ID NO: 970885 - DNA, 22 bp, Artificial Sequence
  chemically synthesized
gccaagataattactgatgtat

SEQ ID NO: 970886 - DNA, 22 bp, Artificial Sequence
  chemically synthesized
ccaagataattactgatgtata

SEQ ID NO: 970887 - DNA, 22 bp, Artificial Sequence
  chemically synthesized
taaatgaagaaaaatatatata

SEQ ID NO: 970888 - DNA, 22 bp, Artificial Sequence
  chemically synthesized
gtaaatgaagaaaaatatatat

SEQ ID NO: 970889 - DNA, 22 bp, Artificial Sequence
  chemically synthesized
ctgatgtatatatatttttctt

SEQ ID NO: 970890 - DNA, 22 bp, Artificial Sequence
  chemically synthesized
atgtatatatatttttcttcat

SEQ ID NO: 970891 - DNA, 22 bp, Artificial Sequence
  chemically synthesized
ccatgaatatttgtaaatgaag

SEQ ID NO: 970892 - DNA, 22 bp, Artificial Sequence
  chemically synthesized
gccatgaatatttgtaaatgaa

SEQ ID NO: 970893 - DNA, 22 bp, Artificial Sequence
  chemically synthesized
catatttgccatgaatatttgt

SEQ ID NO: 970894 - DNA, 22 bp, Artificial Sequence
  chemically synthesized
ttcttcatttacaaatattcat

SEQ ID NO: 970895 - DNA, 22 bp, Artificial Sequence
  chemically synthesized
tcttcatttacaaatattcatg

SEQ ID NO: 970896 - DNA, 22 bp, Artificial Sequence
  chemically synthesized
cttcatttacaaatattcatgg

SEQ ID NO: 970897 - DNA, 22 bp, Artificial Sequence
  chemically synthesized
ttcatttacaaatattcatggc

SEQ ID NO: 970898 - DNA, 22 bp, Artificial Sequence
  chemically synthesized
atattacatatttgccatgaat

SEQ ID NO: 970899 - DNA, 22 bp, Artificial Sequence
  chemically synthesized
catttacaaatattcatggcaa

SEQ ID NO: 970900 - DNA, 22 bp, Artificial Sequence
  chemically synthesized
atttacaaatattcatggcaaa

SEQ ID NO: 970901 - DNA, 22 bp, Artificial Sequence
  chemically synthesized
ttgatattacatatttgccatg

SEQ ID NO: 970902 - DNA, 22 bp, Artificial Sequence
  chemically synthesized
acaaatattcatggcaaatatg

SEQ ID NO: 970903 - DNA, 22 bp, Artificial Sequence
  chemically synthesized
caaatattcatggcaaatatgt

SEQ ID NO: 970904 - DNA, 22 bp, Artificial Sequence
  chemically synthesized
gcattattgatattacatattt

SEQ ID NO: 970905 - DNA, 22 bp, Artificial Sequence
  chemically synthesized
ggcattattgatattacatatt

SEQ ID NO: 970906 - DNA, 22 bp, Artificial Sequence
  chemically synthesized
tggcattattgatattacatat

SEQ ID NO: 970907 - DNA, 22 bp, Artificial Sequence
  chemically synthesized
atggcaaatatgtaatatcaat

SEQ ID NO: 970908 - DNA, 22 bp, Artificial Sequence
  chemically synthesized
aacattttggcattattgatat

SEQ ID NO: 970909 - DNA, 22 bp, Artificial Sequence
  chemically synthesized
acaaaaataactaaacattttg

SEQ ID NO: 970910 - DNA, 22 bp, Artificial Sequence
  chemically synthesized
agatatctcacaaaaataacta

SEQ ID NO: 970911 - DNA, 22 bp, Artificial Sequence
  chemically synthesized
tgtattgagatatctcacaaaa

SEQ ID NO: 970912 - DNA, 22 bp, Artificial Sequence
  chemically synthesized
gtgtattgagatatctcacaaa

SEQ ID NO: 970913 - DNA, 22 bp, Artificial Sequence
  chemically synthesized
tgtgtattgagatatctcacaa

SEQ ID NO: 970914 - DNA, 22 bp, Artificial Sequence
  chemically synthesized
ttttgtgtattgagatatctca

SEQ ID NO: 970915 - DNA, 22 bp, Artificial Sequence
  chemically synthesized
agttatttttgtgagatatctc

SEQ ID NO: 970916 - DNA, 22 bp, Artificial Sequence
  chemically synthesized
gttatttttgtgagatatctca

SEQ ID NO: 970917 - DNA, 22 bp, Artificial Sequence
  chemically synthesized
tctgttttgtgtattgagatat

SEQ ID NO: 970918 - DNA, 22 bp, Artificial Sequence
  chemically synthesized
tttttgtgagatatctcaatac

SEQ ID NO: 970919 - DNA, 22 bp, Artificial Sequence
  chemically synthesized
ttatctgttttgtgtattgaga

SEQ ID NO: 970920 - DNA, 22 bp, Artificial Sequence
  chemically synthesized
ttgtgagatatctcaatacaca

SEQ ID NO: 970921 - DNA, 22 bp, Artificial Sequence
  chemically synthesized
tattatctgttttgtgtattga

SEQ ID NO: 970922 - DNA, 22 bp, Artificial Sequence
  chemically synthesized
tgtgagatatctcaatacacaa

SEQ ID NO: 970923 - DNA, 22 bp, Artificial Sequence
  chemically synthesized
ctattatctgttttgtgtattg

SEQ ID NO: 970924 - DNA, 22 bp, Artificial Sequence
  chemically synthesized
gtgagatatctcaatacacaaa

SEQ ID NO: 970925 - DNA, 22 bp, Artificial Sequence
  chemically synthesized
tgagatatctcaatacacaaaa

SEQ ID NO: 970926 - DNA, 22 bp, Artificial Sequence
  chemically synthesized
tatttctattatctgttttgtg

SEQ ID NO: 970927 - DNA, 22 bp, Artificial Sequence
  chemically synthesized
atatttctattatctgttttgt

SEQ ID NO: 970928 - DNA, 22 bp, Artificial Sequence
  chemically synthesized
atttatatttctattatctgtt

SEQ ID NO: 970929 - DNA, 22 bp, Artificial Sequence
  chemically synthesized
aatacacaaaacagataataga

SEQ ID NO: 970930 - DNA, 22 bp, Artificial Sequence
  chemically synthesized
acaaacattaatttatatttct

SEQ ID NO: 970931 - DNA, 22 bp, Artificial Sequence
  chemically synthesized
taacaaacattaatttatattt

SEQ ID NO: 970932 - DNA, 22 bp, Artificial Sequence
  chemically synthesized
aaataaatagactctaacaaac

SEQ ID NO: 970933 - DNA, 22 bp, Artificial Sequence
  chemically synthesized
atgtttgttagagtctatttat

SEQ ID NO: 970934 - DNA, 22 bp, Artificial Sequence
  chemically synthesized
gttagagtctatttattttaga

SEQ ID NO: 970935 - DNA, 22 bp, Artificial Sequence
  chemically synthesized
ttagagtctatttattttagat

SEQ ID NO: 970936 - DNA, 22 bp, Artificial Sequence
  chemically synthesized
gagtctatttattttagataca

SEQ ID NO: 970937 - DNA, 22 bp, Artificial Sequence
  chemically synthesized
aaggaagagatgtgtatctaaa

SEQ ID NO: 970938 - DNA, 22 bp, Artificial Sequence
  chemically synthesized
ttgaaggaagagatgtgtatct

SEQ ID NO: 970939 - DNA, 22 bp, Artificial Sequence
  chemically synthesized
tttattttagatacacatctct

SEQ ID NO: 970940 - DNA, 22 bp, Artificial Sequence
  chemically synthesized
atgctgttgaaggaagagatgt

SEQ ID NO: 970941 - DNA, 22 bp, Artificial Sequence
  chemically synthesized
attttagatacacatctcttcc

SEQ ID NO: 970942 - DNA, 22 bp, Artificial Sequence
  chemically synthesized
aatgctgttgaaggaagagatg

SEQ ID NO: 970943 - DNA, 22 bp, Artificial Sequence
  chemically synthesized
ttttagatacacatctcttcct

SEQ ID NO: 970944 - DNA, 22 bp, Artificial Sequence
  chemically synthesized
ttaatgctgttgaaggaagaga

SEQ ID NO: 970945 - DNA, 22 bp, Artificial Sequence
  chemically synthesized
cttaatgctgttgaaggaagag

SEQ ID NO: 970946 - DNA, 22 bp, Artificial Sequence
  chemically synthesized
tagatacacatctcttccttca

SEQ ID NO: 970947 - DNA, 22 bp, Artificial Sequence
  chemically synthesized
agatacacatctcttccttcaa

SEQ ID NO: 970948 - DNA, 22 bp, Artificial Sequence
  chemically synthesized
gatacacatctcttccttcaac

SEQ ID NO: 970949 - DNA, 22 bp, Artificial Sequence
  chemically synthesized
tgtatttcttaatgctgttgaa

SEQ ID NO: 970950 - DNA, 22 bp, Artificial Sequence
  chemically synthesized
gagattgtgtatttcttaatgc

SEQ ID NO: 970951 - DNA, 22 bp, Artificial Sequence
  chemically synthesized
ttccttcaacagcattaagaaa

SEQ ID NO: 970952 - DNA, 22 bp, Artificial Sequence
  chemically synthesized
ccttcaacagcattaagaaata

SEQ ID NO: 970953 - DNA, 22 bp, Artificial Sequence
  chemically synthesized
cttcaacagcattaagaaatac

SEQ ID NO: 970954 - DNA, 22 bp, Artificial Sequence
  chemically synthesized
cactggagattgtgtatttctt

SEQ ID NO: 970955 - DNA, 22 bp, Artificial Sequence
  chemically synthesized
caacagcattaagaaatacaca

SEQ ID NO: 970956 - DNA, 22 bp, Artificial Sequence
  chemically synthesized
aacagcattaagaaatacacaa

SEQ ID NO: 970957 - DNA, 22 bp, Artificial Sequence
  chemically synthesized
agaaatacacaatctccagtgt

SEQ ID NO: 970958 - DNA, 22 bp, Artificial Sequence
  chemically synthesized
taaggaggtcctacactggaga

SEQ ID NO: 970959 - DNA, 22 bp, Artificial Sequence
  chemically synthesized
tataaggaggtcctacactgga

SEQ ID NO: 970960 - DNA, 22 bp, Artificial Sequence
  chemically synthesized
ctataaggaggtcctacactgg

SEQ ID NO: 970961 - DNA, 22 bp, Artificial Sequence
  chemically synthesized
tctataaggaggtcctacactg

SEQ ID NO: 970962 - DNA, 22 bp, Artificial Sequence
  chemically synthesized
ttctataaggaggtcctacact

SEQ ID NO: 970963 - DNA, 22 bp, Artificial Sequence
  chemically synthesized
cagtgtaggacctccttataga

SEQ ID NO: 970964 - DNA, 22 bp, Artificial Sequence
  chemically synthesized
tgcaaagtgatagaatgttttt

SEQ ID NO: 970965 - DNA, 22 bp, Artificial Sequence
  chemically synthesized
cttatagaaaaacattctatca

SEQ ID NO: 970966 - DNA, 22 bp, Artificial Sequence
  chemically synthesized
atagaaaaacattctatcactt

SEQ ID NO: 970967 - DNA, 22 bp, Artificial Sequence
  chemically synthesized
tagaaaaacattctatcacttt

SEQ ID NO: 970968 - DNA, 22 bp, Artificial Sequence
  chemically synthesized
aataaccctatgcaaagtgata

SEQ ID NO: 970969 - DNA, 22 bp, Artificial Sequence
  chemically synthesized
cacatctgaataaccctatgca

SEQ ID NO: 970970 - DNA, 22 bp, Artificial Sequence
  chemically synthesized
ctgcacatctgaataaccctat

SEQ ID NO: 970971 - DNA, 22 bp, Artificial Sequence
  chemically synthesized
tatcactttgcatagggttatt

SEQ ID NO: 970972 - DNA, 22 bp, Artificial Sequence
  chemically synthesized
cctgcacatctgaataacccta

SEQ ID NO: 970973 - DNA, 22 bp, Artificial Sequence
  chemically synthesized
tcctgcacatctgaataaccct

SEQ ID NO: 970974 - DNA, 22 bp, Artificial Sequence
  chemically synthesized
tcactttgcatagggttattca

SEQ ID NO: 970975 - DNA, 22 bp, Artificial Sequence
  chemically synthesized
tttcctgcacatctgaataacc

SEQ ID NO: 970976 - DNA, 22 bp, Artificial Sequence
  chemically synthesized
gttctttcctgcacatctgaat

SEQ ID NO: 970977 - DNA, 22 bp, Artificial Sequence
  chemically synthesized
tgcatagggttattcagatgtg

SEQ ID NO: 970978 - DNA, 22 bp, Artificial Sequence
  chemically synthesized
ggttctttcctgcacatctgaa

SEQ ID NO: 970979 - DNA, 22 bp, Artificial Sequence
  chemically synthesized
gcatagggttattcagatgtgc

SEQ ID NO: 970980 - DNA, 22 bp, Artificial Sequence
  chemically synthesized
catagggttattcagatgtgca

SEQ ID NO: 970981 - DNA, 22 bp, Artificial Sequence
  chemically synthesized
ttggttctttcctgcacatctg

SEQ ID NO: 970982 - DNA, 22 bp, Artificial Sequence
  chemically synthesized
cttggttctttcctgcacatct

SEQ ID NO: 970983 - DNA, 22 bp, Artificial Sequence
  chemically synthesized
tttcttggttctttcctgcaca

SEQ ID NO: 970984 - DNA, 22 bp, Artificial Sequence
  chemically synthesized
ttcagatgtgcaggaaagaacc

SEQ ID NO: 970985 - DNA, 22 bp, Artificial Sequence
  chemically synthesized
agatgtgcaggaaagaaccaag

SEQ ID NO: 970986 - DNA, 22 bp, Artificial Sequence
  chemically synthesized
gtataatagataaccaataatt

SEQ ID NO: 970987 - DNA, 22 bp, Artificial Sequence
  chemically synthesized
agtataatagataaccaataat

SEQ ID NO: 970988 - DNA, 22 bp, Artificial Sequence
  chemically synthesized
tagtataatagataaccaataa

SEQ ID NO: 970989 - DNA, 22 bp, Artificial Sequence
  chemically synthesized
tgaattttagtataatagataa

SEQ ID NO: 970990 - DNA, 22 bp, Artificial Sequence
  chemically synthesized
aggcctatgaattttagtataa

SEQ ID NO: 970991 - DNA, 22 bp, Artificial Sequence
  chemically synthesized
ttggttatctattatactaaaa

SEQ ID NO: 970992 - DNA, 22 bp, Artificial Sequence
  chemically synthesized
caggcctatgaattttagtata

SEQ ID NO: 970993 - DNA, 22 bp, Artificial Sequence
  chemically synthesized
gttatctattatactaaaattc

SEQ ID NO: 970994 - DNA, 22 bp, Artificial Sequence
  chemically synthesized
tctattatactaaaattcatag

SEQ ID NO: 970995 - DNA, 22 bp, Artificial Sequence
  chemically synthesized
atgtacccttcaggcctatgaa

SEQ ID NO: 970996 - DNA, 22 bp, Artificial Sequence
  chemically synthesized
ttatactaaaattcataggcct

SEQ ID NO: 970997 - DNA, 22 bp, Artificial Sequence
  chemically synthesized
gatgtacccttcaggcctatga

SEQ ID NO: 970998 - DNA, 22 bp, Artificial Sequence
  chemically synthesized
tgatgtacccttcaggcctatg

SEQ ID NO: 970999 - DNA, 22 bp, Artificial Sequence
  chemically synthesized
tactaaaattcataggcctgaa

SEQ ID NO: 971000 - DNA, 22 bp, Artificial Sequence
  chemically synthesized
ttttgatgtacccttcaggcct

SEQ ID NO: 971001 - DNA, 22 bp, Artificial Sequence
  chemically synthesized
ctattttgatgtacccttcagg

SEQ ID NO: 971002 - DNA, 22 bp, Artificial Sequence
  chemically synthesized
aaattcataggcctgaagggta

SEQ ID NO: 971003 - DNA, 22 bp, Artificial Sequence
  chemically synthesized
cctattttgatgtacccttcag

SEQ ID NO: 971004 - DNA, 22 bp, Artificial Sequence
  chemically synthesized
tcttcctattttgatgtaccct

SEQ ID NO: 971005 - DNA, 22 bp, Artificial Sequence
  chemically synthesized
ataggcctgaagggtacatcaa

SEQ ID NO: 971006 - DNA, 22 bp, Artificial Sequence
  chemically synthesized
gctatcttcctattttgatgta

SEQ ID NO: 971007 - DNA, 22 bp, Artificial Sequence
  chemically synthesized
ggctatcttcctattttgatgt

SEQ ID NO: 971008 - DNA, 22 bp, Artificial Sequence
  chemically synthesized
ttggctatcttcctattttgat

SEQ ID NO: 971009 - DNA, 22 bp, Artificial Sequence
  chemically synthesized
cttggctatcttcctattttga

SEQ ID NO: 971010 - DNA, 22 bp, Artificial Sequence
  chemically synthesized
aagggtacatcaaaataggaag

SEQ ID NO: 971011 - DNA, 22 bp, Artificial Sequence
  chemically synthesized
aaaatgaacaccatttcttggc

SEQ ID NO: 971012 - DNA, 22 bp, Artificial Sequence
  chemically synthesized
gaaaatgaacaccatttcttgg

SEQ ID NO: 971013 - DNA, 22 bp, Artificial Sequence
  chemically synthesized
agtaaagatacttgaaaatgaa

SEQ ID NO: 971014 - DNA, 22 bp, Artificial Sequence
  chemically synthesized
gagtaaagatacttgaaaatga

SEQ ID NO: 971015 - DNA, 22 bp, Artificial Sequence
  chemically synthesized
gcttgagtaaagatacttgaaa

SEQ ID NO: 971016 - DNA, 22 bp, Artificial Sequence
  chemically synthesized
agcttgagtaaagatacttgaa

SEQ ID NO: 971017 - DNA, 22 bp, Artificial Sequence
  chemically synthesized
cagacttagcttgagtaaagat

SEQ ID NO: 971018 - DNA, 22 bp, Artificial Sequence
  chemically synthesized
acagacttagcttgagtaaaga

SEQ ID NO: 971019 - DNA, 22 bp, Artificial Sequence
  chemically synthesized
attttcaagtatctttactcaa

SEQ ID NO: 971020 - DNA, 22 bp, Artificial Sequence
  chemically synthesized
tcaagtatctttactcaagcta

SEQ ID NO: 971021 - DNA, 22 bp, Artificial Sequence
  chemically synthesized
caagtatctttactcaagctaa

SEQ ID NO: 971022 - DNA, 22 bp, Artificial Sequence
  chemically synthesized
aagtatctttactcaagctaag

SEQ ID NO: 971023 - DNA, 22 bp, Artificial Sequence
  chemically synthesized
tgaatacatgacttacagactt

SEQ ID NO: 971024 - DNA, 22 bp, Artificial Sequence
  chemically synthesized
gtgaatacatgacttacagact

SEQ ID NO: 971025 - DNA, 22 bp, Artificial Sequence
  chemically synthesized
tactcaagctaagtctgtaagt

SEQ ID NO: 971026 - DNA, 22 bp, Artificial Sequence
  chemically synthesized
tgtgaatacatgacttacagac

SEQ ID NO: 971027 - DNA, 22 bp, Artificial Sequence
  chemically synthesized
actcaagctaagtctgtaagtc

SEQ ID NO: 971028 - DNA, 22 bp, Artificial Sequence
  chemically synthesized
ctcaagctaagtctgtaagtca

SEQ ID NO: 971029 - DNA, 22 bp, Artificial Sequence
  chemically synthesized
aagctaagtctgtaagtcatgt

SEQ ID NO: 971030 - DNA, 22 bp, Artificial Sequence
  chemically synthesized
agcatcgttttgtgaatacatg

SEQ ID NO: 971031 - DNA, 22 bp, Artificial Sequence
  chemically synthesized
agtctgtaagtcatgtattcac

SEQ ID NO: 971032 - DNA, 22 bp, Artificial Sequence
  chemically synthesized
taagtcatgtattcacaaaacg

SEQ ID NO: 971033 - DNA, 22 bp, Artificial Sequence
  chemically synthesized
ccacaagccactaagcatcgtt

SEQ ID NO: 971034 - DNA, 22 bp, Artificial Sequence
  chemically synthesized
acaaaacgatgcttagtggctt

SEQ ID NO: 971035 - DNA, 22 bp, Artificial Sequence
  chemically synthesized
cagtgtactgccacaagccact

SEQ ID NO: 971036 - DNA, 22 bp, Artificial Sequence
  chemically synthesized
acagtgtactgccacaagccac

SEQ ID NO: 971037 - DNA, 22 bp, Artificial Sequence
  chemically synthesized
gtatttacagtgtactgccaca

SEQ ID NO: 971038 - DNA, 22 bp, Artificial Sequence
  chemically synthesized
ggtatttacagtgtactgccac

SEQ ID NO: 971039 - DNA, 22 bp, Artificial Sequence
  chemically synthesized
agtggcttgtggcagtacactg

SEQ ID NO: 971040 - DNA, 22 bp, Artificial Sequence
  chemically synthesized
atttggtatttacagtgtactg

SEQ ID NO: 971041 - DNA, 22 bp, Artificial Sequence
  chemically synthesized
gtggcttgtggcagtacactgt

SEQ ID NO: 971042 - DNA, 22 bp, Artificial Sequence
  chemically synthesized
gtggcagtacactgtaaatacc

SEQ ID NO: 971043 - DNA, 22 bp, Artificial Sequence
  chemically synthesized
tacagctcatttggtatttaca

SEQ ID NO: 971044 - DNA, 22 bp, Artificial Sequence
  chemically synthesized
tggcagtacactgtaaatacca

SEQ ID NO: 971045 - DNA, 22 bp, Artificial Sequence
  chemically synthesized
aaagtcctatacagctcatttg

SEQ ID NO: 971046 - DNA, 22 bp, Artificial Sequence
  chemically synthesized
ctgaaagtcctatacagctcat

SEQ ID NO: 971047 - DNA, 22 bp, Artificial Sequence
  chemically synthesized
cctgaaagtcctatacagctca

SEQ ID NO: 971048 - DNA, 22 bp, Artificial Sequence
  chemically synthesized
taaataccaaatgagctgtata

SEQ ID NO: 971049 - DNA, 22 bp, Artificial Sequence
  chemically synthesized
aaaaaccatcatttcctgaaag

SEQ ID NO: 971050 - DNA, 22 bp, Artificial Sequence
  chemically synthesized
tcaaaaaccatcatttcctgaa

SEQ ID NO: 971051 - DNA, 22 bp, Artificial Sequence
  chemically synthesized
tctcaaaaaccatcatttcctg

SEQ ID NO: 971052 - DNA, 22 bp, Artificial Sequence
  chemically synthesized
tataggactttcaggaaatgat

SEQ ID NO: 971053 - DNA, 22 bp, Artificial Sequence
  chemically synthesized
ctctctcaaaaaccatcatttc

SEQ ID NO: 971054 - DNA, 22 bp, Artificial Sequence
  chemically synthesized
tcaggaaatgatggtttttgag

SEQ ID NO: 971055 - DNA, 22 bp, Artificial Sequence
  chemically synthesized
caggaaatgatggtttttgaga

SEQ ID NO: 971056 - DNA, 22 bp, Artificial Sequence
  chemically synthesized
ccacacctactctctcaaaaac

SEQ ID NO: 971057 - DNA, 22 bp, Artificial Sequence
  chemically synthesized
aggaaatgatggtttttgagag

SEQ ID NO: 971058 - DNA, 22 bp, Artificial Sequence
  chemically synthesized
aagacctgccacacctactctc

SEQ ID NO: 971059 - DNA, 22 bp, Artificial Sequence
  chemically synthesized
gaagacctgccacacctactct

SEQ ID NO: 971060 - DNA, 22 bp, Artificial Sequence
  chemically synthesized
ttgagagagtaggtgtggcagg

SEQ ID NO: 971061 - DNA, 22 bp, Artificial Sequence
  chemically synthesized
cccccttgaagacctgccacac

SEQ ID NO: 971062 - DNA, 22 bp, Artificial Sequence
  chemically synthesized
tgagagagtaggtgtggcaggt

SEQ ID NO: 971063 - DNA, 22 bp, Artificial Sequence
  chemically synthesized
gagagagtaggtgtggcaggtc

SEQ ID NO: 971064 - DNA, 22 bp, Artificial Sequence
  chemically synthesized
agagagtaggtgtggcaggtct

SEQ ID NO: 971065 - DNA, 22 bp, Artificial Sequence
  chemically synthesized
aagtcccattgcccccttgaag

SEQ ID NO: 971066 - DNA, 22 bp, Artificial Sequence
  chemically synthesized
ctcaagtcccattgcccccttg

SEQ ID NO: 971067 - DNA, 22 bp, Artificial Sequence
  chemically synthesized
gctcaagtcccattgccccctt

SEQ ID NO: 971068 - DNA, 22 bp, Artificial Sequence
  chemically synthesized
caagggggcaatgggacttgag

SEQ ID NO: 971069 - DNA, 22 bp, Artificial Sequence
  chemically synthesized
aagggggcaatgggacttgagc

SEQ ID NO: 971070 - DNA, 22 bp, Artificial Sequence
  chemically synthesized
cacccatcatcacaagacactt

SEQ ID NO: 971071 - DNA, 22 bp, Artificial Sequence
  chemically synthesized
gagcaagtgtcttgtgatgatg

SEQ ID NO: 971072 - DNA, 22 bp, Artificial Sequence
  chemically synthesized
agcaagtgtcttgtgatgatgg

SEQ ID NO: 971073 - DNA, 22 bp, Artificial Sequence
  chemically synthesized
atgcaaggtacaaattacaccc

SEQ ID NO: 971074 - DNA, 22 bp, Artificial Sequence
  chemically synthesized
gtgatgatgggtgtaatttgta

SEQ ID NO: 971075 - DNA, 22 bp, Artificial Sequence
  chemically synthesized
tgatgatgggtgtaatttgtac

SEQ ID NO: 971076 - DNA, 22 bp, Artificial Sequence
  chemically synthesized
ccctcatgcaaggtacaaatta

SEQ ID NO: 971077 - DNA, 22 bp, Artificial Sequence
  chemically synthesized
accctcatgcaaggtacaaatt

SEQ ID NO: 971078 - DNA, 22 bp, Artificial Sequence
  chemically synthesized
gccatttaccctcatgcaaggt

SEQ ID NO: 971079 - DNA, 22 bp, Artificial Sequence
  chemically synthesized
ttcgccatttaccctcatgcaa

SEQ ID NO: 971080 - DNA, 22 bp, Artificial Sequence
  chemically synthesized
ctgttcgccatttaccctcatg

SEQ ID NO: 971081 - DNA, 22 bp, Artificial Sequence
  chemically synthesized
tcctgttcgccatttaccctca

SEQ ID NO: 971082 - DNA, 22 bp, Artificial Sequence
  chemically synthesized
gtaccttgcatgagggtaaatg

SEQ ID NO: 971083 - DNA, 22 bp, Artificial Sequence
  chemically synthesized
taccttgcatgagggtaaatgg

SEQ ID NO: 971084 - DNA, 22 bp, Artificial Sequence
  chemically synthesized
gcatgagggtaaatggcgaaca

SEQ ID NO: 971085 - DNA, 22 bp, Artificial Sequence
  chemically synthesized
catgagggtaaatggcgaacag

SEQ ID NO: 971086 - DNA, 22 bp, Artificial Sequence
  chemically synthesized
gccccatgctctcctgttcgcc

SEQ ID NO: 971087 - DNA, 22 bp, Artificial Sequence
  chemically synthesized
tagccccatgctctcctgttcg

SEQ ID NO: 971088 - DNA, 22 bp, Artificial Sequence
  chemically synthesized
ctagccccatgctctcctgttc

SEQ ID NO: 971089 - DNA, 22 bp, Artificial Sequence
  chemically synthesized
tctagccccatgctctcctgtt

SEQ ID NO: 971090 - DNA, 22 bp, Artificial Sequence
  chemically synthesized
ttctagccccatgctctcctgt

SEQ ID NO: 971091 - DNA, 22 bp, Artificial Sequence
  chemically synthesized
atgtttttctagccccatgctc

SEQ ID NO: 971092 - DNA, 22 bp, Artificial Sequence
  chemically synthesized
tctcatgtttttctagccccat

SEQ ID NO: 971093 - DNA, 22 bp, Artificial Sequence
  chemically synthesized
gtctcatgtttttctagcccca

SEQ ID NO: 971094 - DNA, 22 bp, Artificial Sequence
  chemically synthesized
atttgtctcatgtttttctagc

SEQ ID NO: 971095 - DNA, 22 bp, Artificial Sequence
  chemically synthesized
tgatttgtctcatgtttttcta

SEQ ID NO: 971096 - DNA, 22 bp, Artificial Sequence
  chemically synthesized
tcctctgatttgtctcatgttt

SEQ ID NO: 971097 - DNA, 22 bp, Artificial Sequence
  chemically synthesized
actgtcctctgatttgtctcat

SEQ ID NO: 971098 - DNA, 22 bp, Artificial Sequence
  chemically synthesized
gaaaaacatgagacaaatcaga

SEQ ID NO: 971099 - DNA, 22 bp, Artificial Sequence
  chemically synthesized
aatgccagcattaactgtcctc

SEQ ID NO: 971100 - DNA, 22 bp, Artificial Sequence
  chemically synthesized
taaatgccagcattaactgtcc

SEQ ID NO: 971101 - DNA, 22 bp, Artificial Sequence
  chemically synthesized
ctaaatgccagcattaactgtc

SEQ ID NO: 971102 - DNA, 22 bp, Artificial Sequence
  chemically synthesized
cagcacatcttctaaatgccag

SEQ ID NO: 971103 - DNA, 22 bp, Artificial Sequence
  chemically synthesized
acctccagcacatcttctaaat

SEQ ID NO: 971104 - DNA, 22 bp, Artificial Sequence
  chemically synthesized
atgctggcatttagaagatgtg

SEQ ID NO: 971105 - DNA, 22 bp, Artificial Sequence
  chemically synthesized
gtaattcacctccagcacatct

SEQ ID NO: 971106 - DNA, 22 bp, Artificial Sequence
  chemically synthesized
ggtaattcacctccagcacatc

SEQ ID NO: 971107 - DNA, 22 bp, Artificial Sequence
  chemically synthesized
tggtaattcacctccagcacat

SEQ ID NO: 971108 - DNA, 22 bp, Artificial Sequence
  chemically synthesized
gcatttagaagatgtgctggag

SEQ ID NO: 971109 - DNA, 22 bp, Artificial Sequence
  chemically synthesized
ttggtaattcacctccagcaca

SEQ ID NO: 971110 - DNA, 22 bp, Artificial Sequence
  chemically synthesized
ttttggtaattcacctccagca

SEQ ID NO: 971111 - DNA, 22 bp, Artificial Sequence
  chemically synthesized
agaagatgtgctggaggtgaat

SEQ ID NO: 971112 - DNA, 22 bp, Artificial Sequence
  chemically synthesized
gaagatgtgctggaggtgaatt

SEQ ID NO: 971113 - DNA, 22 bp, Artificial Sequence
  chemically synthesized
agactcttttggtaattcacct

SEQ ID NO: 971114 - DNA, 22 bp, Artificial Sequence
  chemically synthesized
cagactcttttggtaattcacc

SEQ ID NO: 971115 - DNA, 22 bp, Artificial Sequence
  chemically synthesized
tcagactcttttggtaattcac

SEQ ID NO: 971116 - DNA, 22 bp, Artificial Sequence
  chemically synthesized
gaggtgaattaccaaaagagtc

SEQ ID NO: 971117 - DNA, 22 bp, Artificial Sequence
  chemically synthesized
caagccctttcagactcttttg

SEQ ID NO: 971118 - DNA, 22 bp, Artificial Sequence
  chemically synthesized
ccaaaagagtctgaaagggctt

SEQ ID NO: 971119 - DNA, 22 bp, Artificial Sequence
  chemically synthesized
gaaggaggaataatctccaagc

SEQ ID NO: 971120 - DNA, 22 bp, Artificial Sequence
  chemically synthesized
tggaaggaggaataatctccaa

SEQ ID NO: 971121 - DNA, 22 bp, Artificial Sequence
  chemically synthesized
aaagggcttggagattattcct

SEQ ID NO: 971122 - DNA, 22 bp, Artificial Sequence
  chemically synthesized
acctctggaaggaggaataatc

SEQ ID NO: 971123 - DNA, 22 bp, Artificial Sequence
  chemically synthesized
cacctctggaaggaggaataat

SEQ ID NO: 971124 - DNA, 22 bp, Artificial Sequence
  chemically synthesized
ttcacctctggaaggaggaata

SEQ ID NO: 971125 - DNA, 22 bp, Artificial Sequence
  chemically synthesized
cttcacctctggaaggaggaat

SEQ ID NO: 971126 - DNA, 22 bp, Artificial Sequence
  chemically synthesized
tttcttcacctctggaaggagg

SEQ ID NO: 971127 - DNA, 22 bp, Artificial Sequence
  chemically synthesized
ggagattattcctccttccaga

SEQ ID NO: 971128 - DNA, 22 bp, Artificial Sequence
  chemically synthesized
gagattattcctccttccagag

SEQ ID NO: 971129 - DNA, 22 bp, Artificial Sequence
  chemically synthesized
ggcctgtttcttcacctctgga

SEQ ID NO: 971130 - DNA, 22 bp, Artificial Sequence
  chemically synthesized
tgggcctgtttcttcacctctg

SEQ ID NO: 971131 - DNA, 22 bp, Artificial Sequence
  chemically synthesized
ttcctccttccagaggtgaaga

SEQ ID NO: 971132 - DNA, 22 bp, Artificial Sequence
  chemically synthesized
ctccttccagaggtgaagaaac

SEQ ID NO: 971133 - DNA, 22 bp, Artificial Sequence
  chemically synthesized
cttccagaggtgaagaaacagg

SEQ ID NO: 971134 - DNA, 22 bp, Artificial Sequence
  chemically synthesized
ccagaggtgaagaaacaggccc

SEQ ID NO: 971135 - DNA, 22 bp, Artificial Sequence
  chemically synthesized
tgcaacgactctgggcctgttt

SEQ ID NO: 971136 - DNA, 22 bp, Artificial Sequence
  chemically synthesized
cagaggtgaagaaacaggccca

SEQ ID NO: 971137 - DNA, 22 bp, Artificial Sequence
  chemically synthesized
atcaagttatgcaacgactctg

SEQ ID NO: 971138 - DNA, 22 bp, Artificial Sequence
  chemically synthesized
gatcaagttatgcaacgactct

SEQ ID NO: 971139 - DNA, 22 bp, Artificial Sequence
  chemically synthesized
tttgatcaagttatgcaacgac

SEQ ID NO: 971140 - DNA, 22 bp, Artificial Sequence
  chemically synthesized
ttatttgatcaagttatgcaac

SEQ ID NO: 971141 - DNA, 22 bp, Artificial Sequence
  chemically synthesized
cataacttgatcaaataatagg

SEQ ID NO: 971142 - DNA, 22 bp, Artificial Sequence
  chemically synthesized
aaaaagacagggccctattatt

SEQ ID NO: 971143 - DNA, 22 bp, Artificial Sequence
  chemically synthesized
gatcaaataatagggccctgtc

SEQ ID NO: 971144 - DNA, 22 bp, Artificial Sequence
  chemically synthesized
atcaaataatagggccctgtct

SEQ ID NO: 971145 - DNA, 22 bp, Artificial Sequence
  chemically synthesized
gaggcagtggacgatgattcaa

SEQ ID NO: 971146 - DNA, 22 bp, Artificial Sequence
  chemically synthesized
tctttttgaatcatcgtccact

SEQ ID NO: 971147 - DNA, 22 bp, Artificial Sequence
  chemically synthesized
tttgaatcatcgtccactgcct

SEQ ID NO: 971148 - DNA, 22 bp, Artificial Sequence
  chemically synthesized
ttgaatcatcgtccactgcctc

SEQ ID NO: 971149 - DNA, 22 bp, Artificial Sequence
  chemically synthesized
tgaatcatcgtccactgcctcg

SEQ ID NO: 971150 - DNA, 22 bp, Artificial Sequence
  chemically synthesized
gaatcatcgtccactgcctcga

SEQ ID NO: 971151 - DNA, 22 bp, Artificial Sequence
  chemically synthesized
aatcatcgtccactgcctcgag

SEQ ID NO: 971152 - DNA, 22 bp, Artificial Sequence
  chemically synthesized
cctcgagctacttccatttcct

SEQ ID NO: 971153 - DNA, 22 bp, Artificial Sequence
  chemically synthesized
gtgaaagaatagaggaaatgga

SEQ ID NO: 971154 - DNA, 22 bp, Artificial Sequence
  chemically synthesized
gagctacttccatttcctctat

SEQ ID NO: 971155 - DNA, 22 bp, Artificial Sequence
  chemically synthesized
actagtgaaagaatagaggaaa

SEQ ID NO: 971156 - DNA, 22 bp, Artificial Sequence
  chemically synthesized
aactagtgaaagaatagaggaa

SEQ ID NO: 971157 - DNA, 22 bp, Artificial Sequence
  chemically synthesized
taactagtgaaagaatagagga

SEQ ID NO: 971158 - DNA, 22 bp, Artificial Sequence
  chemically synthesized
cttccatttcctctattctttc

SEQ ID NO: 971159 - DNA, 22 bp, Artificial Sequence
  chemically synthesized
ccatttcctctattctttcact

SEQ ID NO: 971160 - DNA, 22 bp, Artificial Sequence
  chemically synthesized
catttcctctattctttcacta

SEQ ID NO: 971161 - DNA, 22 bp, Artificial Sequence
  chemically synthesized
cctctattctttcactagttaa

SEQ ID NO: 971162 - DNA, 22 bp, Artificial Sequence
  chemically synthesized
ctctattctttcactagttaaa

SEQ ID NO: 971163 - DNA, 22 bp, Artificial Sequence
  chemically synthesized
tattctttcactagttaaaatg

SEQ ID NO: 971164 - DNA, 22 bp, Artificial Sequence
  chemically synthesized
ttctttcactagttaaaatgta

SEQ ID NO: 971165 - DNA, 22 bp, Artificial Sequence
  chemically synthesized
acaaagtgaaaaggtacatttt

SEQ ID NO: 971166 - DNA, 22 bp, Artificial Sequence
  chemically synthesized
tttcactagttaaaatgtacct

SEQ ID NO: 971167 - DNA, 22 bp, Artificial Sequence
  chemically synthesized
cacaaagtgaaaaggtacattt

SEQ ID NO: 971168 - DNA, 22 bp, Artificial Sequence
  chemically synthesized
tcacaaagtgaaaaggtacatt

SEQ ID NO: 971169 - DNA, 22 bp, Artificial Sequence
  chemically synthesized
tcactagttaaaatgtaccttt

SEQ ID NO: 971170 - DNA, 22 bp, Artificial Sequence
  chemically synthesized
cactagttaaaatgtacctttt

SEQ ID NO: 971171 - DNA, 22 bp, Artificial Sequence
  chemically synthesized
actagttaaaatgtaccttttc

SEQ ID NO: 971172 - DNA, 22 bp, Artificial Sequence
  chemically synthesized
gttaaaatgtaccttttcactt

SEQ ID NO: 971173 - DNA, 22 bp, Artificial Sequence
  chemically synthesized
acgtcattttcacaaagtgaaa

SEQ ID NO: 971174 - DNA, 22 bp, Artificial Sequence
  chemically synthesized
aaatgtaccttttcactttgtg

SEQ ID NO: 971175 - DNA, 22 bp, Artificial Sequence
  chemically synthesized
actcacgtcattttcacaaagt

SEQ ID NO: 971176 - DNA, 22 bp, Artificial Sequence
  chemically synthesized
tcactcacgtcattttcacaaa

SEQ ID NO: 971177 - DNA, 22 bp, Artificial Sequence
  chemically synthesized
ctctcactcacgtcattttcac

SEQ ID NO: 971178 - DNA, 22 bp, Artificial Sequence
  chemically synthesized
ttactctcactcacgtcatttt

SEQ ID NO: 971179 - DNA, 22 bp, Artificial Sequence
  chemically synthesized
ttcactttgtgaaaatgacgtg

SEQ ID NO: 971180 - DNA, 22 bp, Artificial Sequence
  chemically synthesized
tcactttgtgaaaatgacgtga

SEQ ID NO: 971181 - DNA, 22 bp, Artificial Sequence
  chemically synthesized
tattactctcactcacgtcatt

SEQ ID NO: 971182 - DNA, 22 bp, Artificial Sequence
  chemically synthesized
cactttgtgaaaatgacgtgag

SEQ ID NO: 971183 - DNA, 22 bp, Artificial Sequence
  chemically synthesized
ctattactctcactcacgtcat

SEQ ID NO: 971184 - DNA, 22 bp, Artificial Sequence
  chemically synthesized
actttgtgaaaatgacgtgagt

SEQ ID NO: 971185 - DNA, 22 bp, Artificial Sequence
  chemically synthesized
tctattactctcactcacgtca

SEQ ID NO: 971186 - DNA, 22 bp, Artificial Sequence
  chemically synthesized
tgtgaaaatgacgtgagtgaga

SEQ ID NO: 971187 - DNA, 22 bp, Artificial Sequence
  chemically synthesized
gtgaaaatgacgtgagtgagag

SEQ ID NO: 971188 - DNA, 22 bp, Artificial Sequence
  chemically synthesized
tgaaaatgacgtgagtgagagt

SEQ ID NO: 971189 - DNA, 22 bp, Artificial Sequence
  chemically synthesized
tggataacgagatattttctat

SEQ ID NO: 971190 - DNA, 22 bp, Artificial Sequence
  chemically synthesized
aaactatggataacgagatatt

SEQ ID NO: 971191 - DNA, 22 bp, Artificial Sequence
  chemically synthesized
gaaactatggataacgagatat

SEQ ID NO: 971192 - DNA, 22 bp, Artificial Sequence
  chemically synthesized
ggcttgaaactatggataacga

SEQ ID NO: 971193 - DNA, 22 bp, Artificial Sequence
  chemically synthesized
cacaaatctaggcttgaaacta

SEQ ID NO: 971194 - DNA, 22 bp, Artificial Sequence
  chemically synthesized
ccacaaatctaggcttgaaact

SEQ ID NO: 971195 - DNA, 22 bp, Artificial Sequence
  chemically synthesized
gttatccatagtttcaagccta

SEQ ID NO: 971196 - DNA, 22 bp, Artificial Sequence
  chemically synthesized
acttccacaaatctaggcttga

SEQ ID NO: 971197 - DNA, 22 bp, Artificial Sequence
  chemically synthesized
tgacttccacaaatctaggctt

SEQ ID NO: 971198 - DNA, 22 bp, Artificial Sequence
  chemically synthesized
tccatagtttcaagcctagatt

SEQ ID NO: 971199 - DNA, 22 bp, Artificial Sequence
  chemically synthesized
tcattctgacttccacaaatct

SEQ ID NO: 971200 - DNA, 22 bp, Artificial Sequence
  chemically synthesized
caagcctagatttgtggaagtc

SEQ ID NO: 971201 - DNA, 22 bp, Artificial Sequence
  chemically synthesized
aagcctagatttgtggaagtca

SEQ ID NO: 971202 - DNA, 22 bp, Artificial Sequence
  chemically synthesized
aaagaaactgtcattctgactt

SEQ ID NO: 971203 - DNA, 22 bp, Artificial Sequence
  chemically synthesized
gatttgtggaagtcagaatgac

SEQ ID NO: 971204 - DNA, 22 bp, Artificial Sequence
  chemically synthesized
tattaaaagaaactgtcattct

SEQ ID NO: 971205 - DNA, 22 bp, Artificial Sequence
  chemically synthesized
gtggaagtcagaatgacagttt

SEQ ID NO: 971206 - DNA, 22 bp, Artificial Sequence
  chemically synthesized
ttatattaaaagaaactgtcat

SEQ ID NO: 971207 - DNA, 22 bp, Artificial Sequence
  chemically synthesized
tggaagtcagaatgacagtttc

SEQ ID NO: 971208 - DNA, 22 bp, Artificial Sequence
  chemically synthesized
gttatattaaaagaaactgtca

SEQ ID NO: 971209 - DNA, 22 bp, Artificial Sequence
  chemically synthesized
tcaatgaaaacttgttatatta

SEQ ID NO: 971210 - DNA, 22 bp, Artificial Sequence
  chemically synthesized
atcaatgaaaacttgttatatt

SEQ ID NO: 971211 - DNA, 22 bp, Artificial Sequence
  chemically synthesized
tatcaatgaaaacttgttatat

SEQ ID NO: 971212 - DNA, 22 bp, Artificial Sequence
  chemically synthesized
cttttaatataacaagttttca

SEQ ID NO: 971213 - DNA, 22 bp, Artificial Sequence
  chemically synthesized
ttttaatataacaagttttcat

SEQ ID NO: 971214 - DNA, 22 bp, Artificial Sequence
  chemically synthesized
ttaatataacaagttttcattg

SEQ ID NO: 971215 - DNA, 22 bp, Artificial Sequence
  chemically synthesized
taatataacaagttttcattga

SEQ ID NO: 971216 - DNA, 22 bp, Artificial Sequence
  chemically synthesized
aaaataattttatcaatgaaaa

SEQ ID NO: 971217 - DNA, 22 bp, Artificial Sequence
  chemically synthesized
aatataacaagttttcattgat

SEQ ID NO: 971218 - DNA, 22 bp, Artificial Sequence
  chemically synthesized
atataacaagttttcattgata

SEQ ID NO: 971219 - DNA, 22 bp, Artificial Sequence
  chemically synthesized
tgaaaataattttatcaatgaa

SEQ ID NO: 971220 - DNA, 22 bp, Artificial Sequence
  chemically synthesized
ctgaaaataattttatcaatga

SEQ ID NO: 971221 - DNA, 22 bp, Artificial Sequence
  chemically synthesized
tctgaaaataattttatcaatg

SEQ ID NO: 971222 - DNA, 22 bp, Artificial Sequence
  chemically synthesized
gagaattttctgaaaataattt

SEQ ID NO: 971223 - DNA, 22 bp, Artificial Sequence
  chemically synthesized
agagaattttctgaaaataatt

SEQ ID NO: 971224 - DNA, 22 bp, Artificial Sequence
  chemically synthesized
tcattgataaaattattttcag

SEQ ID NO: 971225 - DNA, 22 bp, Artificial Sequence
  chemically synthesized
cattgataaaattattttcaga

SEQ ID NO: 971226 - DNA, 22 bp, Artificial Sequence
  chemically synthesized
attgataaaattattttcagaa

SEQ ID NO: 971227 - DNA, 22 bp, Artificial Sequence
  chemically synthesized
ataaaattattttcagaaaatt

SEQ ID NO: 971228 - DNA, 22 bp, Artificial Sequence
  chemically synthesized
aagagtacttagagaattttct

SEQ ID NO: 971229 - DNA, 22 bp, Artificial Sequence
  chemically synthesized
ttttcagaaaattctctaagta

SEQ ID NO: 971230 - DNA, 22 bp, Artificial Sequence
  chemically synthesized
accaactcaagagtacttagag

SEQ ID NO: 971231 - DNA, 22 bp, Artificial Sequence
  chemically synthesized
aaccaactcaagagtacttaga

SEQ ID NO: 971232 - DNA, 22 bp, Artificial Sequence
  chemically synthesized
tcagaaaattctctaagtactc

SEQ ID NO: 971233 - DNA, 22 bp, Artificial Sequence
  chemically synthesized
taaccaactcaagagtacttag

SEQ ID NO: 971234 - DNA, 22 bp, Artificial Sequence
  chemically synthesized
cagaaaattctctaagtactct

SEQ ID NO: 971235 - DNA, 22 bp, Artificial Sequence
  chemically synthesized
agaaaattctctaagtactctt

SEQ ID NO: 971236 - DNA, 22 bp, Artificial Sequence
  chemically synthesized
tctaagtactcttgagttggtt

SEQ ID NO: 971237 - DNA, 22 bp, Artificial Sequence
  chemically synthesized
taagtactcttgagttggttaa

SEQ ID NO: 971238 - DNA, 22 bp, Artificial Sequence
  chemically synthesized
agtactcttgagttggttaaag

SEQ ID NO: 971239 - DNA, 22 bp, Artificial Sequence
  chemically synthesized
gggagggaaataaggactttaa

SEQ ID NO: 971240 - DNA, 22 bp, Artificial Sequence
  chemically synthesized
ggggagggaaataaggacttta

SEQ ID NO: 971241 - DNA, 22 bp, Artificial Sequence
  chemically synthesized
tggggagggaaataaggacttt

SEQ ID NO: 971242 - DNA, 22 bp, Artificial Sequence
  chemically synthesized
ttgagttggttaaagtccttat

SEQ ID NO: 971243 - DNA, 22 bp, Artificial Sequence
  chemically synthesized
tttggggagggaaataaggact

SEQ ID NO: 971244 - DNA, 22 bp, Artificial Sequence
  chemically synthesized
gagttggttaaagtccttattt

SEQ ID NO: 971245 - DNA, 22 bp, Artificial Sequence
  chemically synthesized
ctttggggagggaaataaggac

SEQ ID NO: 971246 - DNA, 22 bp, Artificial Sequence
  chemically synthesized
agttggttaaagtccttatttc

SEQ ID NO: 971247 - DNA, 22 bp, Artificial Sequence
  chemically synthesized
tctttggggagggaaataagga

SEQ ID NO: 971248 - DNA, 22 bp, Artificial Sequence
  chemically synthesized
gttaaagtccttatttccctcc

SEQ ID NO: 971249 - DNA, 22 bp, Artificial Sequence
  chemically synthesized
agattttctttggggagggaaa

SEQ ID NO: 971250 - DNA, 22 bp, Artificial Sequence
  chemically synthesized
aagattttctttggggagggaa

SEQ ID NO: 971251 - DNA, 22 bp, Artificial Sequence
  chemically synthesized
aagtccttatttccctccccaa

SEQ ID NO: 971252 - DNA, 22 bp, Artificial Sequence
  chemically synthesized
gaggaatttaagattttctttg

SEQ ID NO: 971253 - DNA, 22 bp, Artificial Sequence
  chemically synthesized
atttccctccccaaagaaaatc

SEQ ID NO: 971254 - DNA, 22 bp, Artificial Sequence
  chemically synthesized
tttccctccccaaagaaaatct

SEQ ID NO: 971255 - DNA, 22 bp, Artificial Sequence
  chemically synthesized
ccctccccaaagaaaatcttaa

SEQ ID NO: 971256 - DNA, 22 bp, Artificial Sequence
  chemically synthesized
gtctcgaggaatttaagatttt

SEQ ID NO: 971257 - DNA, 22 bp, Artificial Sequence
  chemically synthesized
cctccccaaagaaaatcttaaa

SEQ ID NO: 971258 - DNA, 22 bp, Artificial Sequence
  chemically synthesized
cccaaagaaaatcttaaattcc

SEQ ID NO: 971259 - DNA, 22 bp, Artificial Sequence
  chemically synthesized
atacacagacctggtctcgagg

SEQ ID NO: 971260 - DNA, 22 bp, Artificial Sequence
  chemically synthesized
aaattcctcgagaccaggtctg

SEQ ID NO: 971261 - DNA, 22 bp, Artificial Sequence
  chemically synthesized
aattcctcgagaccaggtctgt

SEQ ID NO: 971262 - DNA, 22 bp, Artificial Sequence
  chemically synthesized
agatgattcatacacagacctg

SEQ ID NO: 971263 - DNA, 22 bp, Artificial Sequence
  chemically synthesized
cagatgattcatacacagacct

SEQ ID NO: 971264 - DNA, 22 bp, Artificial Sequence
  chemically synthesized
ctcgagaccaggtctgtgtatg

SEQ ID NO: 971265 - DNA, 22 bp, Artificial Sequence
  chemically synthesized
gagaccaggtctgtgtatgaat

SEQ ID NO: 971266 - DNA, 22 bp, Artificial Sequence
  chemically synthesized
gggaggatttcagatgattcat

SEQ ID NO: 971267 - DNA, 22 bp, Artificial Sequence
  chemically synthesized
ggggaggatttcagatgattca

SEQ ID NO: 971268 - DNA, 22 bp, Artificial Sequence
  chemically synthesized
tggggaggatttcagatgattc

SEQ ID NO: 971269 - DNA, 22 bp, Artificial Sequence
  chemically synthesized
tgtatgaatcatctgaaatcct

SEQ ID NO: 971270 - DNA, 22 bp, Artificial Sequence
  chemically synthesized
tccatccctttggggaggattt

SEQ ID NO: 971271 - DNA, 22 bp, Artificial Sequence
  chemically synthesized
aaatcctccccaaagggatgga

SEQ ID NO: 971272 - DNA, 22 bp, Artificial Sequence
  chemically synthesized
gacaaaggcattatccatccct

SEQ ID NO: 971273 - DNA, 22 bp, Artificial Sequence
  chemically synthesized
agacaaaggcattatccatccc

SEQ ID NO: 971274 - DNA, 22 bp, Artificial Sequence
  chemically synthesized
catttagacaaaggcattatcc

SEQ ID NO: 971275 - DNA, 22 bp, Artificial Sequence
  chemically synthesized
cccaaagggatggataatgcct

SEQ ID NO: 971276 - DNA, 22 bp, Artificial Sequence
  chemically synthesized
agcacctacatttagacaaagg

SEQ ID NO: 971277 - DNA, 22 bp, Artificial Sequence
  chemically synthesized
ctaagcacctacatttagacaa

SEQ ID NO: 971278 - DNA, 22 bp, Artificial Sequence
  chemically synthesized
actaagcacctacatttagaca

SEQ ID NO: 971279 - DNA, 22 bp, Artificial Sequence
  chemically synthesized
tccataatttactaagcaccta

SEQ ID NO: 971280 - DNA, 22 bp, Artificial Sequence
  chemically synthesized
atccataatttactaagcacct

SEQ ID NO: 971281 - DNA, 22 bp, Artificial Sequence
  chemically synthesized
tgtctaaatgtaggtgcttagt

SEQ ID NO: 971282 - DNA, 22 bp, Artificial Sequence
  chemically synthesized
tatccataatttactaagcacc

SEQ ID NO: 971283 - DNA, 22 bp, Artificial Sequence
  chemically synthesized
gtctaaatgtaggtgcttagta

SEQ ID NO: 971284 - DNA, 22 bp, Artificial Sequence
  chemically synthesized
ttatccataatttactaagcac

SEQ ID NO: 971285 - DNA, 22 bp, Artificial Sequence
  chemically synthesized
tctaaatgtaggtgcttagtaa

SEQ ID NO: 971286 - DNA, 22 bp, Artificial Sequence
  chemically synthesized
aatgtaggtgcttagtaaatta

SEQ ID NO: 971287 - DNA, 22 bp, Artificial Sequence
  chemically synthesized
aacttttatccataatttacta

SEQ ID NO: 971288 - DNA, 22 bp, Artificial Sequence
  chemically synthesized
ttcaacttttatccataattta

SEQ ID NO: 971289 - DNA, 22 bp, Artificial Sequence
  chemically synthesized
ccagtgctgttcaacttttatc

SEQ ID NO: 971290 - DNA, 22 bp, Artificial Sequence
  chemically synthesized
agtaaattatggataaaagttg

SEQ ID NO: 971291 - DNA, 22 bp, Artificial Sequence
  chemically synthesized
gtaaattatggataaaagttga

SEQ ID NO: 971292 - DNA, 22 bp, Artificial Sequence
  chemically synthesized
ttgccagtgctgttcaactttt

SEQ ID NO: 971293 - DNA, 22 bp, Artificial Sequence
  chemically synthesized
ttgttgccagtgctgttcaact

SEQ ID NO: 971294 - DNA, 22 bp, Artificial Sequence
  chemically synthesized
tggataaaagttgaacagcact

SEQ ID NO: 971295 - DNA, 22 bp, Artificial Sequence
  chemically synthesized
atgtgaattattgttgccagtg

SEQ ID NO: 971296 - DNA, 22 bp, Artificial Sequence
  chemically synthesized
gatgtgaattattgttgccagt

SEQ ID NO: 971297 - DNA, 22 bp, Artificial Sequence
  chemically synthesized
tgatgtgaattattgttgccag

SEQ ID NO: 971298 - DNA, 22 bp, Artificial Sequence
  chemically synthesized
aacagcactggcaacaataatt

SEQ ID NO: 971299 - DNA, 22 bp, Artificial Sequence
  chemically synthesized
gaatgtactttgatgtgaatta

SEQ ID NO: 971300 - DNA, 22 bp, Artificial Sequence
  chemically synthesized
gcaacaataattcacatcaaag

SEQ ID NO: 971301 - DNA, 22 bp, Artificial Sequence
  chemically synthesized
tgtgatataaagaactagaatg

SEQ ID NO: 971302 - DNA, 22 bp, Artificial Sequence
  chemically synthesized
acatcaaagtacattctagttc

SEQ ID NO: 971303 - DNA, 22 bp, Artificial Sequence
  chemically synthesized
tatgtgatataaagaactagaa

SEQ ID NO: 971304 - DNA, 22 bp, Artificial Sequence
  chemically synthesized
ctatgtgatataaagaactaga

SEQ ID NO: 971305 - DNA, 22 bp, Artificial Sequence
  chemically synthesized
tttctatgtgatataaagaact

SEQ ID NO: 971306 - DNA, 22 bp, Artificial Sequence
  chemically synthesized
atttctatgtgatataaagaac

SEQ ID NO: 971307 - DNA, 22 bp, Artificial Sequence
  chemically synthesized
tatttctatgtgatataaagaa

SEQ ID NO: 971308 - DNA, 22 bp, Artificial Sequence
  chemically synthesized
tttatttctatgtgatataaag

SEQ ID NO: 971309 - DNA, 22 bp, Artificial Sequence
  chemically synthesized
tagttctttatatcacatagaa

SEQ ID NO: 971310 - DNA, 22 bp, Artificial Sequence
  chemically synthesized
gttctttatatcacatagaaat

SEQ ID NO: 971311 - DNA, 22 bp, Artificial Sequence
  chemically synthesized
taagaaaattctttatttctat

SEQ ID NO: 971312 - DNA, 22 bp, Artificial Sequence
  chemically synthesized
ataagaaaattctttatttcta

SEQ ID NO: 971313 - DNA, 22 bp, Artificial Sequence
  chemically synthesized
tttatatcacatagaaataaag

SEQ ID NO: 971314 - DNA, 22 bp, Artificial Sequence
  chemically synthesized
tatatcacatagaaataaagaa

SEQ ID NO: 971315 - DNA, 22 bp, Artificial Sequence
  chemically synthesized
atatcacatagaaataaagaat

SEQ ID NO: 971316 - DNA, 22 bp, Artificial Sequence
  chemically synthesized
tatcacatagaaataaagaatt

SEQ ID NO: 971317 - DNA, 22 bp, Artificial Sequence
  chemically synthesized
caaaatttataagaaaattctt

SEQ ID NO: 971318 - DNA, 22 bp, Artificial Sequence
  chemically synthesized
acaaaatttataagaaaattct

SEQ ID NO: 971319 - DNA, 22 bp, Artificial Sequence
  chemically synthesized
acatttacaaaatttataagaa

SEQ ID NO: 971320 - DNA, 22 bp, Artificial Sequence
  chemically synthesized
cacatttacaaaatttataaga

SEQ ID NO: 971321 - DNA, 22 bp, Artificial Sequence
  chemically synthesized
tcacatttacaaaatttataag

SEQ ID NO: 971322 - DNA, 22 bp, Artificial Sequence
  chemically synthesized
tttcacatttacaaaatttata

SEQ ID NO: 971323 - DNA, 22 bp, Artificial Sequence
  chemically synthesized
ctttcacatttacaaaatttat

SEQ ID NO: 971324 - DNA, 22 bp, Artificial Sequence
  chemically synthesized
tctttcacatttacaaaattta

SEQ ID NO: 971325 - DNA, 22 bp, Artificial Sequence
  chemically synthesized
ttttctttcacatttacaaaat

SEQ ID NO: 971326 - DNA, 22 bp, Artificial Sequence
  chemically synthesized
tattttctttcacatttacaaa

SEQ ID NO: 971327 - DNA, 22 bp, Artificial Sequence
  chemically synthesized
tcttataaattttgtaaatgtg

SEQ ID NO: 971328 - DNA, 22 bp, Artificial Sequence
  chemically synthesized
cttataaattttgtaaatgtga

SEQ ID NO: 971329 - DNA, 22 bp, Artificial Sequence
  chemically synthesized
ttataaattttgtaaatgtgaa

SEQ ID NO: 971330 - DNA, 22 bp, Artificial Sequence
  chemically synthesized
gttctattttctttcacattta

SEQ ID NO: 971331 - DNA, 22 bp, Artificial Sequence
  chemically synthesized
ataaattttgtaaatgtgaaag

SEQ ID NO: 971332 - DNA, 22 bp, Artificial Sequence
  chemically synthesized
taaattttgtaaatgtgaaaga

SEQ ID NO: 971333 - DNA, 22 bp, Artificial Sequence
  chemically synthesized
aattggttctattttctttcac

SEQ ID NO: 971334 - DNA, 22 bp, Artificial Sequence
  chemically synthesized
taaattggttctattttctttc

SEQ ID NO: 971335 - DNA, 22 bp, Artificial Sequence
  chemically synthesized
ctaaattggttctattttcttt

SEQ ID NO: 971336 - DNA, 22 bp, Artificial Sequence
  chemically synthesized
tctaaattggttctattttctt

SEQ ID NO: 971337 - DNA, 22 bp, Artificial Sequence
  chemically synthesized
tgtaaatgtgaaagaaaataga

SEQ ID NO: 971338 - DNA, 22 bp, Artificial Sequence
  chemically synthesized
gtaaatgtgaaagaaaatagaa

SEQ ID NO: 971339 - DNA, 22 bp, Artificial Sequence
  chemically synthesized
taaatgtgaaagaaaatagaac

SEQ ID NO: 971340 - DNA, 22 bp, Artificial Sequence
  chemically synthesized
ttttctaaattggttctatttt

SEQ ID NO: 971341 - DNA, 22 bp, Artificial Sequence
  chemically synthesized
attttctaaattggttctattt

SEQ ID NO: 971342 - DNA, 22 bp, Artificial Sequence
  chemically synthesized
acatttattttctaaattggtt

SEQ ID NO: 971343 - DNA, 22 bp, Artificial Sequence
  chemically synthesized
aaatgcaagattgacatttatt

SEQ ID NO: 971344 - DNA, 22 bp, Artificial Sequence
  chemically synthesized
agaaaataaatgtcaatcttgc

SEQ ID NO: 971345 - DNA, 22 bp, Artificial Sequence
  chemically synthesized
gaaaataaatgtcaatcttgca

SEQ ID NO: 971346 - DNA, 22 bp, Artificial Sequence
  chemically synthesized
atgtgaaaggagcaacaattaa

SEQ ID NO: 971347 - DNA, 22 bp, Artificial Sequence
  chemically synthesized
gcattttaattgttgctccttt

SEQ ID NO: 971348 - DNA, 22 bp, Artificial Sequence
  chemically synthesized
cattttaattgttgctcctttc

SEQ ID NO: 971349 - DNA, 22 bp, Artificial Sequence
  chemically synthesized
taaaattaatgtgaaaggagca

SEQ ID NO: 971350 - DNA, 22 bp, Artificial Sequence
  chemically synthesized
gtaaaattaatgtgaaaggagc

SEQ ID NO: 971351 - DNA, 22 bp, Artificial Sequence
  chemically synthesized
tgtaaaattaatgtgaaaggag

SEQ ID NO: 971352 - DNA, 22 bp, Artificial Sequence
  chemically synthesized
ttgtaaaattaatgtgaaagga

SEQ ID NO: 971353 - DNA, 22 bp, Artificial Sequence
  chemically synthesized
taattgttgctcctttcacatt

SEQ ID NO: 971354 - DNA, 22 bp, Artificial Sequence
  chemically synthesized
aattgttgctcctttcacatta

SEQ ID NO: 971355 - DNA, 22 bp, Artificial Sequence
  chemically synthesized
attgttgctcctttcacattaa

SEQ ID NO: 971356 - DNA, 22 bp, Artificial Sequence
  chemically synthesized
ttgctcctttcacattaatttt

SEQ ID NO: 971357 - DNA, 22 bp, Artificial Sequence
  chemically synthesized
ctcctttcacattaattttaca

SEQ ID NO: 971358 - DNA, 22 bp, Artificial Sequence
  chemically synthesized
ctttcacattaattttacaaaa

SEQ ID NO: 971359 - DNA, 22 bp, Artificial Sequence
  chemically synthesized
tcacattaattttacaaaaact

SEQ ID NO: 971360 - DNA, 22 bp, Artificial Sequence
  chemically synthesized
cacattaattttacaaaaactt

SEQ ID NO: 971361 - DNA, 22 bp, Artificial Sequence
  chemically synthesized
acattaattttacaaaaacttg

SEQ ID NO: 971362 - DNA, 22 bp, Artificial Sequence
  chemically synthesized
attttacaaaaacttgtttctg

SEQ ID NO: 971363 - DNA, 22 bp, Artificial Sequence
  chemically synthesized
tacaaaaacttgtttctgattt

SEQ ID NO: 971364 - DNA, 22 bp, Artificial Sequence
  chemically synthesized
acaaaaacttgtttctgatttg

SEQ ID NO: 971365 - DNA, 22 bp, Artificial Sequence
  chemically synthesized
caaaaacttgtttctgatttga

SEQ ID NO: 971366 - DNA, 22 bp, Artificial Sequence
  chemically synthesized
atccatagaaaatcaaatcaga

SEQ ID NO: 971367 - DNA, 22 bp, Artificial Sequence
  chemically synthesized
aatccatagaaaatcaaatcag

SEQ ID NO: 971368 - DNA, 22 bp, Artificial Sequence
  chemically synthesized
taatccatagaaaatcaaatca

SEQ ID NO: 971369 - DNA, 22 bp, Artificial Sequence
  chemically synthesized
ttaatccatagaaaatcaaatc

SEQ ID NO: 971370 - DNA, 22 bp, Artificial Sequence
  chemically synthesized
gtttctgatttgattttctatg

SEQ ID NO: 971371 - DNA, 22 bp, Artificial Sequence
  chemically synthesized
tttctgatttgattttctatgg

SEQ ID NO: 971372 - DNA, 22 bp, Artificial Sequence
  chemically synthesized
ctgatttgattttctatggatt

SEQ ID NO: 971373 - DNA, 22 bp, Artificial Sequence
  chemically synthesized
tgatttgattttctatggatta

SEQ ID NO: 971374 - DNA, 22 bp, Artificial Sequence
  chemically synthesized
cacagaatgcttttaatccata

SEQ ID NO: 971375 - DNA, 22 bp, Artificial Sequence
  chemically synthesized
atttgattttctatggattaaa

SEQ ID NO: 971376 - DNA, 22 bp, Artificial Sequence
  chemically synthesized
gattttctatggattaaaagca

SEQ ID NO: 971377 - DNA, 22 bp, Artificial Sequence
  chemically synthesized
attttctatggattaaaagcat

SEQ ID NO: 971378 - DNA, 22 bp, Artificial Sequence
  chemically synthesized
caactgcacagaatgcttttaa

SEQ ID NO: 971379 - DNA, 22 bp, Artificial Sequence
  chemically synthesized
ccaactgcacagaatgctttta

SEQ ID NO: 971380 - DNA, 22 bp, Artificial Sequence
  chemically synthesized
tctatggattaaaagcattctg

SEQ ID NO: 971381 - DNA, 22 bp, Artificial Sequence
  chemically synthesized
ctatggattaaaagcattctgt

SEQ ID NO: 971382 - DNA, 22 bp, Artificial Sequence
  chemically synthesized
tatggattaaaagcattctgtg

SEQ ID NO: 971383 - DNA, 22 bp, Artificial Sequence
  chemically synthesized
tggattaaaagcattctgtgca

SEQ ID NO: 971384 - DNA, 22 bp, Artificial Sequence
  chemically synthesized
ataatgagcttccaactgcaca

SEQ ID NO: 971385 - DNA, 22 bp, Artificial Sequence
  chemically synthesized
aaagcattctgtgcagttggaa

SEQ ID NO: 971386 - DNA, 22 bp, Artificial Sequence
  chemically synthesized
tcatgattaataatgagcttcc

SEQ ID NO: 971387 - DNA, 22 bp, Artificial Sequence
  chemically synthesized
tgtgcagttggaagctcattat

SEQ ID NO: 971388 - DNA, 22 bp, Artificial Sequence
  chemically synthesized
tgcagttggaagctcattatta

SEQ ID NO: 971389 - DNA, 22 bp, Artificial Sequence
  chemically synthesized
cagttgtcatgattaataatga

SEQ ID NO: 971390 - DNA, 22 bp, Artificial Sequence
  chemically synthesized
gaagctcattattaatcatgac

SEQ ID NO: 971391 - DNA, 22 bp, Artificial Sequence
  chemically synthesized
gcagccactacagttgtcatga

SEQ ID NO: 971392 - DNA, 22 bp, Artificial Sequence
  chemically synthesized
attattaatcatgacaactgta

SEQ ID NO: 971393 - DNA, 22 bp, Artificial Sequence
  chemically synthesized
atactagcagccactacagttg

SEQ ID NO: 971394 - DNA, 22 bp, Artificial Sequence
  chemically synthesized
ttaatcatgacaactgtagtgg

SEQ ID NO: 971395 - DNA, 22 bp, Artificial Sequence
  chemically synthesized
attcatactagcagccactaca

SEQ ID NO: 971396 - DNA, 22 bp, Artificial Sequence
  chemically synthesized
atcatgacaactgtagtggctg

SEQ ID NO: 971397 - DNA, 22 bp, Artificial Sequence
  chemically synthesized
aattcatactagcagccactac

SEQ ID NO: 971398 - DNA, 22 bp, Artificial Sequence
  chemically synthesized
tagtggctgctagtatgaatta

SEQ ID NO: 971399 - DNA, 22 bp, Artificial Sequence
  chemically synthesized
ggcacatggtatatgtgcttaa

SEQ ID NO: 971400 - DNA, 22 bp, Artificial Sequence
  chemically synthesized
ctagtatgaattaagcacatat

SEQ ID NO: 971401 - DNA, 22 bp, Artificial Sequence
  chemically synthesized
gctaggcacatggtatatgtgc

SEQ ID NO: 971402 - DNA, 22 bp, Artificial Sequence
  chemically synthesized
gtatgaattaagcacatatacc

SEQ ID NO: 971403 - DNA, 22 bp, Artificial Sequence
  chemically synthesized
agctaggcacatggtatatgtg

SEQ ID NO: 971404 - DNA, 22 bp, Artificial Sequence
  chemically synthesized
ccatttagctaggcacatggta

SEQ ID NO: 971405 - DNA, 22 bp, Artificial Sequence
  chemically synthesized
gccatttagctaggcacatggt

SEQ ID NO: 971406 - DNA, 22 bp, Artificial Sequence
  chemically synthesized
agcacatataccatgtgcctag

SEQ ID NO: 971407 - DNA, 22 bp, Artificial Sequence
  chemically synthesized
aatggcttgccatttagctagg

SEQ ID NO: 971408 - DNA, 22 bp, Artificial Sequence
  chemically synthesized
gctaaatggcaagccattcaga

SEQ ID NO: 971409 - DNA, 22 bp, Artificial Sequence
  chemically synthesized
tagtagaaagagatctgaatgg

SEQ ID NO: 971410 - DNA, 22 bp, Artificial Sequence
  chemically synthesized
aatggcaagccattcagatctc

SEQ ID NO: 971411 - DNA, 22 bp, Artificial Sequence
  chemically synthesized
taatcaactgtagtagaaagag

SEQ ID NO: 971412 - DNA, 22 bp, Artificial Sequence
  chemically synthesized
ataatcaactgtagtagaaaga

SEQ ID NO: 971413 - DNA, 22 bp, Artificial Sequence
  chemically synthesized
agatctctttctactacagttg

SEQ ID NO: 971414 - DNA, 22 bp, Artificial Sequence
  chemically synthesized
tttctactacagttgattataa

SEQ ID NO: 971415 - DNA, 22 bp, Artificial Sequence
  chemically synthesized
tctactacagttgattataagt

SEQ ID NO: 971416 - DNA, 22 bp, Artificial Sequence
  chemically synthesized
ctactacagttgattataagtt

SEQ ID NO: 971417 - DNA, 22 bp, Artificial Sequence
  chemically synthesized
tactacagttgattataagttt

SEQ ID NO: 971418 - DNA, 22 bp, Artificial Sequence
  chemically synthesized
ctacagttgattataagttttt

SEQ ID NO: 971419 - DNA, 22 bp, Artificial Sequence
  chemically synthesized
cagttgattataagtttttttt

SEQ ID NO: 971420 - DNA, 22 bp, Artificial Sequence
  chemically synthesized
aagtataataaaaaaaaaaact

SEQ ID NO: 971421 - DNA, 22 bp, Artificial Sequence
  chemically synthesized
aaagtataataaaaaaaaaaac

SEQ ID NO: 971422 - DNA, 22 bp, Artificial Sequence
  chemically synthesized
attataagtttttttttttatt

SEQ ID NO: 971423 - DNA, 22 bp, Artificial Sequence
  chemically synthesized
aaacttaaagtataataaaaaa

SEQ ID NO: 971424 - DNA, 22 bp, Artificial Sequence
  chemically synthesized
taagtttttttttttattatac

SEQ ID NO: 971425 - DNA, 22 bp, Artificial Sequence
  chemically synthesized
ttttttttattatactttaagt

SEQ ID NO: 971426 - DNA, 22 bp, Artificial Sequence
  chemically synthesized
tttttttattatactttaagtt

SEQ ID NO: 971427 - DNA, 22 bp, Artificial Sequence
  chemically synthesized
ttttttattatactttaagttt

SEQ ID NO: 971428 - DNA, 22 bp, Artificial Sequence
  chemically synthesized
tttttattatactttaagtttt

SEQ ID NO: 971429 - DNA, 22 bp, Artificial Sequence
  chemically synthesized
ttttattatactttaagtttta

SEQ ID NO: 971430 - DNA, 22 bp, Artificial Sequence
  chemically synthesized
tttattatactttaagttttag

SEQ ID NO: 971431 - DNA, 22 bp, Artificial Sequence
  chemically synthesized
tgcacatgaaccctaaaactta

SEQ ID NO: 971432 - DNA, 22 bp, Artificial Sequence
  chemically synthesized
ttattatactttaagttttagg

SEQ ID NO: 971433 - DNA, 22 bp, Artificial Sequence
  chemically synthesized
tattatactttaagttttaggg

SEQ ID NO: 971434 - DNA, 22 bp, Artificial Sequence
  chemically synthesized
attatactttaagttttagggt

SEQ ID NO: 971435 - DNA, 22 bp, Artificial Sequence
  chemically synthesized
ttatactttaagttttagggtt

SEQ ID NO: 971436 - DNA, 22 bp, Artificial Sequence
  chemically synthesized
tactttaagttttagggttcat

SEQ ID NO: 971437 - DNA, 22 bp, Artificial Sequence
  chemically synthesized
catgttgtgcacatgaacccta

SEQ ID NO: 971438 - DNA, 22 bp, Artificial Sequence
  chemically synthesized
taagttttagggttcatgtgca

SEQ ID NO: 971439 - DNA, 22 bp, Artificial Sequence
  chemically synthesized
acctgcatgttgtgcacatgaa

SEQ ID NO: 971440 - DNA, 22 bp, Artificial Sequence
  chemically synthesized
aagttttagggttcatgtgcac

SEQ ID NO: 971441 - DNA, 22 bp, Artificial Sequence
  chemically synthesized
agttttagggttcatgtgcaca

SEQ ID NO: 971442 - DNA, 22 bp, Artificial Sequence
  chemically synthesized
tagggttcatgtgcacaacatg

SEQ ID NO: 971443 - DNA, 22 bp, Artificial Sequence
  chemically synthesized
agggttcatgtgcacaacatgc

SEQ ID NO: 971444 - DNA, 22 bp, Artificial Sequence
  chemically synthesized
gggttcatgtgcacaacatgca

SEQ ID NO: 971445 - DNA, 22 bp, Artificial Sequence
  chemically synthesized
atgtgcacaacatgcaggttag

SEQ ID NO: 971446 - DNA, 22 bp, Artificial Sequence
  chemically synthesized
gttacacacgtatacatgtgcc

SEQ ID NO: 971447 - DNA, 22 bp, Artificial Sequence
  chemically synthesized
cacacgtatacatgtgccatgt

SEQ ID NO: 971448 - DNA, 22 bp, Artificial Sequence
  chemically synthesized
atgggtgcagcacaccaacatg

SEQ ID NO: 971449 - DNA, 22 bp, Artificial Sequence
  chemically synthesized
atggtaaatgacgagttaatgg

SEQ ID NO: 971450 - DNA, 22 bp, Artificial Sequence
  chemically synthesized
gtgtgctgcacccattaactcg

SEQ ID NO: 971451 - DNA, 22 bp, Artificial Sequence
  chemically synthesized
cctaatggtaaatgacgagtta

SEQ ID NO: 971452 - DNA, 22 bp, Artificial Sequence
  chemically synthesized
acctaatggtaaatgacgagtt

SEQ ID NO: 971453 - DNA, 22 bp, Artificial Sequence
  chemically synthesized
cacccattaactcgtcatttac

SEQ ID NO: 971454 - DNA, 22 bp, Artificial Sequence
  chemically synthesized
aaaacttacctaatggtaaatg

SEQ ID NO: 971455 - DNA, 22 bp, Artificial Sequence
  chemically synthesized
aaaaacttacctaatggtaaat

SEQ ID NO: 971456 - DNA, 22 bp, Artificial Sequence
  chemically synthesized
ttaaaaacttacctaatggtaa

SEQ ID NO: 971457 - DNA, 22 bp, Artificial Sequence
  chemically synthesized
actcgtcatttaccattaggta

SEQ ID NO: 971458 - DNA, 22 bp, Artificial Sequence
  chemically synthesized
actcttaaaaacttacctaatg

SEQ ID NO: 971459 - DNA, 22 bp, Artificial Sequence
  chemically synthesized
gtcatttaccattaggtaagtt

SEQ ID NO: 971460 - DNA, 22 bp, Artificial Sequence
  chemically synthesized
accattaggtaagtttttaaga

SEQ ID NO: 971461 - DNA, 22 bp, Artificial Sequence
  chemically synthesized
ccattaggtaagtttttaagag

SEQ ID NO: 971462 - DNA, 22 bp, Artificial Sequence
  chemically synthesized
agatatcatgcctgactcttaa

SEQ ID NO: 971463 - DNA, 22 bp, Artificial Sequence
  chemically synthesized
ggtaagtttttaagagtcaggc

SEQ ID NO: 971464 - DNA, 22 bp, Artificial Sequence
  chemically synthesized
ttaagagtcaggcatgatatct

SEQ ID NO: 971465 - DNA, 22 bp, Artificial Sequence
  chemically synthesized
taagagtcaggcatgatatctt

SEQ ID NO: 971466 - DNA, 22 bp, Artificial Sequence
  chemically synthesized
aagagtcaggcatgatatctta

SEQ ID NO: 971467 - DNA, 22 bp, Artificial Sequence
  chemically synthesized
agagtcaggcatgatatcttag

SEQ ID NO: 971468 - DNA, 22 bp, Artificial Sequence
  chemically synthesized
gatagaaagatggctaagatat

SEQ ID NO: 971469 - DNA, 22 bp, Artificial Sequence
  chemically synthesized
ggatagaaagatggctaagata

SEQ ID NO: 971470 - DNA, 22 bp, Artificial Sequence
  chemically synthesized
tggatagaaagatggctaagat

SEQ ID NO: 971471 - DNA, 22 bp, Artificial Sequence
  chemically synthesized
tgcattttggatagaaagatgg

SEQ ID NO: 971472 - DNA, 22 bp, Artificial Sequence
  chemically synthesized
agccatctttctatccaaaatg

SEQ ID NO: 971473 - DNA, 22 bp, Artificial Sequence
  chemically synthesized
gccatctttctatccaaaatgc

SEQ ID NO: 971474 - DNA, 22 bp, Artificial Sequence
  chemically synthesized
tctatccaaaatgcatagcatg

SEQ ID NO: 971475 - DNA, 22 bp, Artificial Sequence
  chemically synthesized
ctatccaaaatgcatagcatga

SEQ ID NO: 971476 - DNA, 22 bp, Artificial Sequence
  chemically synthesized
tatccaaaatgcatagcatgat

SEQ ID NO: 971477 - DNA, 22 bp, Artificial Sequence
  chemically synthesized
tccaaaatgcatagcatgatcc

SEQ ID NO: 971478 - DNA, 22 bp, Artificial Sequence
  chemically synthesized
cacatgacacatgtcagggatc

SEQ ID NO: 971479 - DNA, 22 bp, Artificial Sequence
  chemically synthesized
gattgcacatgacacatgtcag

SEQ ID NO: 971480 - DNA, 22 bp, Artificial Sequence
  chemically synthesized
ggattgcacatgacacatgtca

SEQ ID NO: 971481 - DNA, 22 bp, Artificial Sequence
  chemically synthesized
aatttggattgcacatgacaca

SEQ ID NO: 971482 - DNA, 22 bp, Artificial Sequence
  chemically synthesized
aaatttggattgcacatgacac

SEQ ID NO: 971483 - DNA, 22 bp, Artificial Sequence
  chemically synthesized
taaatttggattgcacatgaca

SEQ ID NO: 971484 - DNA, 22 bp, Artificial Sequence
  chemically synthesized
ttaaatttggattgcacatgac

SEQ ID NO: 971485 - DNA, 22 bp, Artificial Sequence
  chemically synthesized
tttttaaatttggattgcacat

SEQ ID NO: 971486 - DNA, 22 bp, Artificial Sequence
  chemically synthesized
acatgtgtcatgtgcaatccaa

SEQ ID NO: 971487 - DNA, 22 bp, Artificial Sequence
  chemically synthesized
ttatttttaaatttggattgca

SEQ ID NO: 971488 - DNA, 22 bp, Artificial Sequence
  chemically synthesized
attatttttaaatttggattgc

SEQ ID NO: 971489 - DNA, 22 bp, Artificial Sequence
  chemically synthesized
gtaggggatttattatttttaa

SEQ ID NO: 971490 - DNA, 22 bp, Artificial Sequence
  chemically synthesized
ggtaggggatttattattttta

SEQ ID NO: 971491 - DNA, 22 bp, Artificial Sequence
  chemically synthesized
aaaaataataaatcccctacca

SEQ ID NO: 971492 - DNA, 22 bp, Artificial Sequence
  chemically synthesized
aaaataataaatcccctaccaa

SEQ ID NO: 971493 - DNA, 22 bp, Artificial Sequence
  chemically synthesized
atggaaatgtatttggtagggg

SEQ ID NO: 971494 - DNA, 22 bp, Artificial Sequence
  chemically synthesized
aatggaaatgtatttggtaggg

SEQ ID NO: 971495 - DNA, 22 bp, Artificial Sequence
  chemically synthesized
atgtgaaatatttaatggaaat

SEQ ID NO: 971496 - DNA, 22 bp, Artificial Sequence
  chemically synthesized
ccaaatacatttccattaaata

SEQ ID NO: 971497 - DNA, 22 bp, Artificial Sequence
  chemically synthesized
aaccagataactcatgtgaaat

SEQ ID NO: 971498 - DNA, 22 bp, Artificial Sequence
  chemically synthesized
ccattaaatatttcacatgagt

SEQ ID NO: 971499 - DNA, 22 bp, Artificial Sequence
  chemically synthesized
cattaaatatttcacatgagtt

SEQ ID NO: 971500 - DNA, 22 bp, Artificial Sequence
  chemically synthesized
aatatttcacatgagttatctg

SEQ ID NO: 971501 - DNA, 22 bp, Artificial Sequence
  chemically synthesized
ggggatgattaaaccagataac

SEQ ID NO: 971502 - DNA, 22 bp, Artificial Sequence
  chemically synthesized
gggggatgattaaaccagataa

SEQ ID NO: 971503 - DNA, 22 bp, Artificial Sequence
  chemically synthesized
cacatgagttatctggtttaat

SEQ ID NO: 971504 - DNA, 22 bp, Artificial Sequence
  chemically synthesized
acatgagttatctggtttaatc

SEQ ID NO: 971505 - DNA, 22 bp, Artificial Sequence
  chemically synthesized
taaagtgaggtttgggggatga

SEQ ID NO: 971506 - DNA, 22 bp, Artificial Sequence
  chemically synthesized
gtaaagtgaggtttgggggatg

SEQ ID NO: 971507 - DNA, 22 bp, Artificial Sequence
  chemically synthesized
tctggtttaatcatcccccaaa

SEQ ID NO: 971508 - DNA, 22 bp, Artificial Sequence
  chemically synthesized
gtttaatcatcccccaaacctc

SEQ ID NO: 971509 - DNA, 22 bp, Artificial Sequence
  chemically synthesized
catttgtaaagtgaggtttggg

SEQ ID NO: 971510 - DNA, 22 bp, Artificial Sequence
  chemically synthesized
tccatttgtaaagtgaggtttg

SEQ ID NO: 971511 - DNA, 22 bp, Artificial Sequence
  chemically synthesized
ctccatttgtaaagtgaggttt

SEQ ID NO: 971512 - DNA, 22 bp, Artificial Sequence
  chemically synthesized
aatcatcccccaaacctcactt

SEQ ID NO: 971513 - DNA, 22 bp, Artificial Sequence
  chemically synthesized
atcatcccccaaacctcacttt

SEQ ID NO: 971514 - DNA, 22 bp, Artificial Sequence
  chemically synthesized
tttctccatttgtaaagtgagg

SEQ ID NO: 971515 - DNA, 22 bp, Artificial Sequence
  chemically synthesized
gtttctccatttgtaaagtgag

SEQ ID NO: 971516 - DNA, 22 bp, Artificial Sequence
  chemically synthesized
tgtttctccatttgtaaagtga

SEQ ID NO: 971517 - DNA, 22 bp, Artificial Sequence
  chemically synthesized
ttgtttctccatttgtaaagtg

SEQ ID NO: 971518 - DNA, 22 bp, Artificial Sequence
  chemically synthesized
tgaaacttttgtttctccattt

SEQ ID NO: 971519 - DNA, 22 bp, Artificial Sequence
  chemically synthesized
gtgaaacttttgtttctccatt

SEQ ID NO: 971520 - DNA, 22 bp, Artificial Sequence
  chemically synthesized
actttacaaatggagaaacaaa

SEQ ID NO: 971521 - DNA, 22 bp, Artificial Sequence
  chemically synthesized
catttgtgaaacttttgtttct

SEQ ID NO: 971522 - DNA, 22 bp, Artificial Sequence
  chemically synthesized
tacaaatggagaaacaaaagtt

SEQ ID NO: 971523 - DNA, 22 bp, Artificial Sequence
  chemically synthesized
acaaatggagaaacaaaagttt

SEQ ID NO: 971524 - DNA, 22 bp, Artificial Sequence
  chemically synthesized
caaatggagaaacaaaagtttc

SEQ ID NO: 971525 - DNA, 22 bp, Artificial Sequence
  chemically synthesized
ggcgtgttacatttgtgaaact

SEQ ID NO: 971526 - DNA, 22 bp, Artificial Sequence
  chemically synthesized
tggggcattgggcgtgttacat

SEQ ID NO: 971527 - DNA, 22 bp, Artificial Sequence
  chemically synthesized
tctgtggggcattgggcgtgtt

SEQ ID NO: 971528 - DNA, 22 bp, Artificial Sequence
  chemically synthesized
tatctgtggggcattgggcgtg

SEQ ID NO: 971529 - DNA, 22 bp, Artificial Sequence
  chemically synthesized
cacaaatgtaacacgcccaatg

SEQ ID NO: 971530 - DNA, 22 bp, Artificial Sequence
  chemically synthesized
ctatctgtggggcattgggcgt

SEQ ID NO: 971531 - DNA, 22 bp, Artificial Sequence
  chemically synthesized
acaaatgtaacacgcccaatgc

SEQ ID NO: 971532 - DNA, 22 bp, Artificial Sequence
  chemically synthesized
tctatctgtggggcattgggcg

SEQ ID NO: 971533 - DNA, 22 bp, Artificial Sequence
  chemically synthesized
caccactttctatctgtggggc

SEQ ID NO: 971534 - DNA, 22 bp, Artificial Sequence
  chemically synthesized
gctccaccactttctatctgtg

SEQ ID NO: 971535 - DNA, 22 bp, Artificial Sequence
  chemically synthesized
ggctccaccactttctatctgt

SEQ ID NO: 971536 - DNA, 22 bp, Artificial Sequence
  chemically synthesized
aaaccttggctccaccactttc

SEQ ID NO: 971537 - DNA, 22 bp, Artificial Sequence
  chemically synthesized
ggttcaaaccttggctccacca

SEQ ID NO: 971538 - DNA, 22 bp, Artificial Sequence
  chemically synthesized
gagtcaaagagcctgggttcaa

SEQ ID NO: 971539 - DNA, 22 bp, Artificial Sequence
  chemically synthesized
tggagtcaaagagcctgggttc

SEQ ID NO: 971540 - DNA, 22 bp, Artificial Sequence
  chemically synthesized
caggggctctggagtcaaagag

SEQ ID NO: 971541 - DNA, 22 bp, Artificial Sequence
  chemically synthesized
gcaggggctctggagtcaaaga

SEQ ID NO: 971542 - DNA, 22 bp, Artificial Sequence
  chemically synthesized
gaacccaggctctttgactcca

SEQ ID NO: 971543 - DNA, 22 bp, Artificial Sequence
  chemically synthesized
ttgcaggggctctggagtcaaa

SEQ ID NO: 971544 - DNA, 22 bp, Artificial Sequence
  chemically synthesized
aacccaggctctttgactccag

SEQ ID NO: 971545 - DNA, 22 bp, Artificial Sequence
  chemically synthesized
cttgcaggggctctggagtcaa

SEQ ID NO: 971546 - DNA, 22 bp, Artificial Sequence
  chemically synthesized
tcttgcaggggctctggagtca

SEQ ID NO: 971547 - DNA, 22 bp, Artificial Sequence
  chemically synthesized
tattttcttgcaggggctctgg

SEQ ID NO: 971548 - DNA, 22 bp, Artificial Sequence
  chemically synthesized
tttgactccagagcccctgcaa

SEQ ID NO: 971549 - DNA, 22 bp, Artificial Sequence
  chemically synthesized
tgactccagagcccctgcaaga

SEQ ID NO: 971550 - DNA, 22 bp, Artificial Sequence
  chemically synthesized
gactccagagcccctgcaagaa

SEQ ID NO: 971551 - DNA, 22 bp, Artificial Sequence
  chemically synthesized
actccagagcccctgcaagaaa

SEQ ID NO: 971552 - DNA, 22 bp, Artificial Sequence
  chemically synthesized
cagagcccctgcaagaaaatac

SEQ ID NO: 971553 - DNA, 22 bp, Artificial Sequence
  chemically synthesized
tgtcaaggcagcatagagttgt

SEQ ID NO: 971554 - DNA, 22 bp, Artificial Sequence
  chemically synthesized
caagaaaatacaactctatgct

SEQ ID NO: 971555 - DNA, 22 bp, Artificial Sequence
  chemically synthesized
aagagctatgtcaaggcagcat

SEQ ID NO: 971556 - DNA, 22 bp, Artificial Sequence
  chemically synthesized
gaagagctatgtcaaggcagca

SEQ ID NO: 971557 - DNA, 22 bp, Artificial Sequence
  chemically synthesized
tttgaagagctatgtcaaggca

SEQ ID NO: 971558 - DNA, 22 bp, Artificial Sequence
  chemically synthesized
atttgaagagctatgtcaaggc

SEQ ID NO: 971559 - DNA, 22 bp, Artificial Sequence
  chemically synthesized
tttatttgaagagctatgtcaa

SEQ ID NO: 971560 - DNA, 22 bp, Artificial Sequence
  chemically synthesized
tatgctgccttgacatagctct

SEQ ID NO: 971561 - DNA, 22 bp, Artificial Sequence
  chemically synthesized
tgctgccttgacatagctcttc

SEQ ID NO: 971562 - DNA, 22 bp, Artificial Sequence
  chemically synthesized
aatggctgtttatttgaagagc

SEQ ID NO: 971563 - DNA, 22 bp, Artificial Sequence
  chemically synthesized
ccttgacatagctcttcaaata

SEQ ID NO: 971564 - DNA, 22 bp, Artificial Sequence
  chemically synthesized
gacatagctcttcaaataaaca

SEQ ID NO: 971565 - DNA, 22 bp, Artificial Sequence
  chemically synthesized
acatagctcttcaaataaacag

SEQ ID NO: 971566 - DNA, 22 bp, Artificial Sequence
  chemically synthesized
agcataattgaatggctgttta

SEQ ID NO: 971567 - DNA, 22 bp, Artificial Sequence
  chemically synthesized
ttcaaataaacagccattcaat

SEQ ID NO: 971568 - DNA, 22 bp, Artificial Sequence
  chemically synthesized
caaataaacagccattcaatta

SEQ ID NO: 971569 - DNA, 22 bp, Artificial Sequence
  chemically synthesized
aaataaacagccattcaattat

SEQ ID NO: 971570 - DNA, 22 bp, Artificial Sequence
  chemically synthesized
ggaaatcactgagcataattga

SEQ ID NO: 971571 - DNA, 22 bp, Artificial Sequence
  chemically synthesized
ttaggaaatcactgagcataat

SEQ ID NO: 971572 - DNA, 22 bp, Artificial Sequence
  chemically synthesized
gaaactattaggaaatcactga

SEQ ID NO: 971573 - DNA, 22 bp, Artificial Sequence
  chemically synthesized
tggaaactattaggaaatcact

SEQ ID NO: 971574 - DNA, 22 bp, Artificial Sequence
  chemically synthesized
aattatgctcagtgatttccta

SEQ ID NO: 971575 - DNA, 22 bp, Artificial Sequence
  chemically synthesized
gaattctggaaactattaggaa

SEQ ID NO: 971576 - DNA, 22 bp, Artificial Sequence
  chemically synthesized
tgctcagtgatttcctaatagt

SEQ ID NO: 971577 - DNA, 22 bp, Artificial Sequence
  chemically synthesized
agtgatttcctaatagtttcca

SEQ ID NO: 971578 - DNA, 22 bp, Artificial Sequence
  chemically synthesized
atggctagaattctggaaacta

SEQ ID NO: 971579 - DNA, 22 bp, Artificial Sequence
  chemically synthesized
tcatggctagaattctggaaac

SEQ ID NO: 971580 - DNA, 22 bp, Artificial Sequence
  chemically synthesized
ctcatggctagaattctggaaa

SEQ ID NO: 971581 - DNA, 22 bp, Artificial Sequence
  chemically synthesized
tctcatggctagaattctggaa

SEQ ID NO: 971582 - DNA, 22 bp, Artificial Sequence
  chemically synthesized
ttctcatggctagaattctgga

SEQ ID NO: 971583 - DNA, 22 bp, Artificial Sequence
  chemically synthesized
cctaatagtttccagaattcta

SEQ ID NO: 971584 - DNA, 22 bp, Artificial Sequence
  chemically synthesized
ctaatagtttccagaattctag

SEQ ID NO: 971585 - DNA, 22 bp, Artificial Sequence
  chemically synthesized
tttttctcatggctagaattct

SEQ ID NO: 971586 - DNA, 22 bp, Artificial Sequence
  chemically synthesized
atagtttccagaattctagcca

SEQ ID NO: 971587 - DNA, 22 bp, Artificial Sequence
  chemically synthesized
ccagaattctagccatgagaaa

SEQ ID NO: 971588 - DNA, 22 bp, Artificial Sequence
  chemically synthesized
gtaaccattatttttctcatgg

SEQ ID NO: 971589 - DNA, 22 bp, Artificial Sequence
  chemically synthesized
cagaattctagccatgagaaaa

SEQ ID NO: 971590 - DNA, 22 bp, Artificial Sequence
  chemically synthesized
aaattagtaaccattatttttc

SEQ ID NO: 971591 - DNA, 22 bp, Artificial Sequence
  chemically synthesized
tagccatgagaaaaataatggt

SEQ ID NO: 971592 - DNA, 22 bp, Artificial Sequence
  chemically synthesized
ttcaaattagtaaccattattt

SEQ ID NO: 971593 - DNA, 22 bp, Artificial Sequence
  chemically synthesized
gccatgagaaaaataatggtta

SEQ ID NO: 971594 - DNA, 22 bp, Artificial Sequence
  chemically synthesized
cgttattcaaattagtaaccat

SEQ ID NO: 971595 - DNA, 22 bp, Artificial Sequence
  chemically synthesized
acgttattcaaattagtaacca

SEQ ID NO: 971596 - DNA, 22 bp, Artificial Sequence
  chemically synthesized
ttacgttattcaaattagtaac

SEQ ID NO: 971597 - DNA, 22 bp, Artificial Sequence
  chemically synthesized
gtaatataattcttacgttatt

SEQ ID NO: 971598 - DNA, 22 bp, Artificial Sequence
  chemically synthesized
ttggtaatataattcttacgtt

SEQ ID NO: 971599 - DNA, 22 bp, Artificial Sequence
  chemically synthesized
ctaatttgaataacgtaagaat

SEQ ID NO: 971600 - DNA, 22 bp, Artificial Sequence
  chemically synthesized
gttggtaatataattcttacgt

SEQ ID NO: 971601 - DNA, 22 bp, Artificial Sequence
  chemically synthesized
tgttggtaatataattcttacg

SEQ ID NO: 971602 - DNA, 22 bp, Artificial Sequence
  chemically synthesized
ttgttggtaatataattcttac

SEQ ID NO: 971603 - DNA, 22 bp, Artificial Sequence
  chemically synthesized
atttgaataacgtaagaattat

SEQ ID NO: 971604 - DNA, 22 bp, Artificial Sequence
  chemically synthesized
tttgttggtaatataattctta

SEQ ID NO: 971605 - DNA, 22 bp, Artificial Sequence
  chemically synthesized
gaataacgtaagaattatatta

SEQ ID NO: 971606 - DNA, 22 bp, Artificial Sequence
  chemically synthesized
aataacgtaagaattatattac

SEQ ID NO: 971607 - DNA, 22 bp, Artificial Sequence
  chemically synthesized
ccgttttttgttggtaatataa

SEQ ID NO: 971608 - DNA, 22 bp, Artificial Sequence
  chemically synthesized
agcatggcctcccgttttttgt

SEQ ID NO: 971609 - DNA, 22 bp, Artificial Sequence
  chemically synthesized
ctaagcatggcctcccgttttt

SEQ ID NO: 971610 - DNA, 22 bp, Artificial Sequence
  chemically synthesized
tattaccaacaaaaaacgggag

SEQ ID NO: 971611 - DNA, 22 bp, Artificial Sequence
  chemically synthesized
ccaacaaaaaacgggaggccat

SEQ ID NO: 971612 - DNA, 22 bp, Artificial Sequence
  chemically synthesized
tcacagtgtctcctaagcatgg

SEQ ID NO: 971613 - DNA, 22 bp, Artificial Sequence
  chemically synthesized
ttatcacagtgtctcctaagca

SEQ ID NO: 971614 - DNA, 22 bp, Artificial Sequence
  chemically synthesized
ctgttatcacagtgtctcctaa

SEQ ID NO: 971615 - DNA, 22 bp, Artificial Sequence
  chemically synthesized
tactgttatcacagtgtctcct

SEQ ID NO: 971616 - DNA, 22 bp, Artificial Sequence
  chemically synthesized
ctactgttatcacagtgtctcc

SEQ ID NO: 971617 - DNA, 22 bp, Artificial Sequence
  chemically synthesized
tctactgttatcacagtgtctc

SEQ ID NO: 971618 - DNA, 22 bp, Artificial Sequence
  chemically synthesized
agctttctactgttatcacagt

SEQ ID NO: 971619 - DNA, 22 bp, Artificial Sequence
  chemically synthesized
gagctttctactgttatcacag

SEQ ID NO: 971620 - DNA, 22 bp, Artificial Sequence
  chemically synthesized
tttgagctttctactgttatca

SEQ ID NO: 971621 - DNA, 22 bp, Artificial Sequence
  chemically synthesized
aggagacactgtgataacagta

SEQ ID NO: 971622 - DNA, 22 bp, Artificial Sequence
  chemically synthesized
atttgagctttctactgttatc

SEQ ID NO: 971623 - DNA, 22 bp, Artificial Sequence
  chemically synthesized
ggagacactgtgataacagtag

SEQ ID NO: 971624 - DNA, 22 bp, Artificial Sequence
  chemically synthesized
tttatttgagctttctactgtt

SEQ ID NO: 971625 - DNA, 22 bp, Artificial Sequence
  chemically synthesized
tgataacagtagaaagctcaaa

SEQ ID NO: 971626 - DNA, 22 bp, Artificial Sequence
  chemically synthesized
aaaaaattatttatttgagctt

SEQ ID NO: 971627 - DNA, 22 bp, Artificial Sequence
  chemically synthesized
aaaaaaattatttatttgagct

SEQ ID NO: 971628 - DNA, 22 bp, Artificial Sequence
  chemically synthesized
taaaaaaattatttatttgagc

SEQ ID NO: 971629 - DNA, 22 bp, Artificial Sequence
  chemically synthesized
gaactttaaaaaaattatttat

SEQ ID NO: 971630 - DNA, 22 bp, Artificial Sequence
  chemically synthesized
ggaactttaaaaaaattattta

SEQ ID NO: 971631 - DNA, 22 bp, Artificial Sequence
  chemically synthesized
aaataaataatttttttaaagt

SEQ ID NO: 971632 - DNA, 22 bp, Artificial Sequence
  chemically synthesized
atggatcccttggaactttaaa

SEQ ID NO: 971633 - DNA, 22 bp, Artificial Sequence
  chemically synthesized
aatggatcccttggaactttaa

SEQ ID NO: 971634 - DNA, 22 bp, Artificial Sequence
  chemically synthesized
taatggatcccttggaacttta

SEQ ID NO: 971635 - DNA, 22 bp, Artificial Sequence
  chemically synthesized
ttaatggatcccttggaacttt

SEQ ID NO: 971636 - DNA, 22 bp, Artificial Sequence
  chemically synthesized
tttaatggatcccttggaactt

SEQ ID NO: 971637 - DNA, 22 bp, Artificial Sequence
  chemically synthesized
ttttaatggatcccttggaact

SEQ ID NO: 971638 - DNA, 22 bp, Artificial Sequence
  chemically synthesized
tatttttttaatggatcccttg

SEQ ID NO: 971639 - DNA, 22 bp, Artificial Sequence
  chemically synthesized
ttttaaagttccaagggatcca

SEQ ID NO: 971640 - DNA, 22 bp, Artificial Sequence
  chemically synthesized
gtatttttttaatggatccctt

SEQ ID NO: 971641 - DNA, 22 bp, Artificial Sequence
  chemically synthesized
tttaaagttccaagggatccat

SEQ ID NO: 971642 - DNA, 22 bp, Artificial Sequence
  chemically synthesized
tgtatttttttaatggatccct

SEQ ID NO: 971643 - DNA, 22 bp, Artificial Sequence
  chemically synthesized
ttaaagttccaagggatccatt

SEQ ID NO: 971644 - DNA, 22 bp, Artificial Sequence
  chemically synthesized
ttgtatttttttaatggatccc

SEQ ID NO: 971645 - DNA, 22 bp, Artificial Sequence
  chemically synthesized
taaagttccaagggatccatta

SEQ ID NO: 971646 - DNA, 22 bp, Artificial Sequence
  chemically synthesized
tttgtatttttttaatggatcc

SEQ ID NO: 971647 - DNA, 22 bp, Artificial Sequence
  chemically synthesized
aaagttccaagggatccattaa

SEQ ID NO: 971648 - DNA, 22 bp, Artificial Sequence
  chemically synthesized
ttttgtatttttttaatggatc

SEQ ID NO: 971649 - DNA, 22 bp, Artificial Sequence
  chemically synthesized
aagttccaagggatccattaaa

SEQ ID NO: 971650 - DNA, 22 bp, Artificial Sequence
  chemically synthesized
tttttgtatttttttaatggat

SEQ ID NO: 971651 - DNA, 22 bp, Artificial Sequence
  chemically synthesized
ttttttgtatttttttaatgga

SEQ ID NO: 971652 - DNA, 22 bp, Artificial Sequence
  chemically synthesized
tttttttgtatttttttaatgg

SEQ ID NO: 971653 - DNA, 22 bp, Artificial Sequence
  chemically synthesized
ttttttttgtatttttttaatg

SEQ ID NO: 971654 - DNA, 22 bp, Artificial Sequence
  chemically synthesized
tttttttttgtatttttttaat

SEQ ID NO: 971655 - DNA, 22 bp, Artificial Sequence
  chemically synthesized
caagggatccattaaaaaaata

SEQ ID NO: 971656 - DNA, 22 bp, Artificial Sequence
  chemically synthesized
gaaatggactttttttttttgt

SEQ ID NO: 971657 - DNA, 22 bp, Artificial Sequence
  chemically synthesized
aaaaaatacaaaaaaaaaaagt

SEQ ID NO: 971658 - DNA, 22 bp, Artificial Sequence
  chemically synthesized
tgaataaaatattagaaatgga

SEQ ID NO: 971659 - DNA, 22 bp, Artificial Sequence
  chemically synthesized
aggcccgtcactgtgaataaaa

SEQ ID NO: 971660 - DNA, 22 bp, Artificial Sequence
  chemically synthesized
tgctcaggcccgtcactgtgaa

SEQ ID NO: 971661 - DNA, 22 bp, Artificial Sequence
  chemically synthesized
ctaatattttattcacagtgac

SEQ ID NO: 971662 - DNA, 22 bp, Artificial Sequence
  chemically synthesized
taatattttattcacagtgacg

SEQ ID NO: 971663 - DNA, 22 bp, Artificial Sequence
  chemically synthesized
atattttattcacagtgacggg

SEQ ID NO: 971664 - DNA, 22 bp, Artificial Sequence
  chemically synthesized
tgttatgctcaggcccgtcact

SEQ ID NO: 971665 - DNA, 22 bp, Artificial Sequence
  chemically synthesized
atgttatgctcaggcccgtcac

SEQ ID NO: 971666 - DNA, 22 bp, Artificial Sequence
  chemically synthesized
tattcacagtgacgggcctgag

SEQ ID NO: 971667 - DNA, 22 bp, Artificial Sequence
  chemically synthesized
attcacagtgacgggcctgagc

SEQ ID NO: 971668 - DNA, 22 bp, Artificial Sequence
  chemically synthesized
agtttatgttatgctcaggccc

SEQ ID NO: 971669 - DNA, 22 bp, Artificial Sequence
  chemically synthesized
ttcacagtgacgggcctgagca

SEQ ID NO: 971670 - DNA, 22 bp, Artificial Sequence
  chemically synthesized
cagtttatgttatgctcaggcc

SEQ ID NO: 971671 - DNA, 22 bp, Artificial Sequence
  chemically synthesized
acagtgacgggcctgagcataa

SEQ ID NO: 971672 - DNA, 22 bp, Artificial Sequence
  chemically synthesized
acatggtaagagccttcagttt

SEQ ID NO: 971673 - DNA, 22 bp, Artificial Sequence
  chemically synthesized
agcataacataaactgaaggct

SEQ ID NO: 971674 - DNA, 22 bp, Artificial Sequence
  chemically synthesized
taacatggtaagagccttcagt

SEQ ID NO: 971675 - DNA, 22 bp, Artificial Sequence
  chemically synthesized
ctaacatggtaagagccttcag

SEQ ID NO: 971676 - DNA, 22 bp, Artificial Sequence
  chemically synthesized
tctaacatggtaagagccttca

SEQ ID NO: 971677 - DNA, 22 bp, Artificial Sequence
  chemically synthesized
ttttctaacatggtaagagcct

SEQ ID NO: 971678 - DNA, 22 bp, Artificial Sequence
  chemically synthesized
attttctaacatggtaagagcc

SEQ ID NO: 971679 - DNA, 22 bp, Artificial Sequence
  chemically synthesized
agtttattttctaacatggtaa

SEQ ID NO: 971680 - DNA, 22 bp, Artificial Sequence
  chemically synthesized
aagtttattttctaacatggta

SEQ ID NO: 971681 - DNA, 22 bp, Artificial Sequence
  chemically synthesized
taagtttattttctaacatggt

SEQ ID NO: 971682 - DNA, 22 bp, Artificial Sequence
  chemically synthesized
aaggctcttaccatgttagaaa

SEQ ID NO: 971683 - DNA, 22 bp, Artificial Sequence
  chemically synthesized
ctttaagtttattttctaacat

SEQ ID NO: 971684 - DNA, 22 bp, Artificial Sequence
  chemically synthesized
tactttaagtttattttctaac

SEQ ID NO: 971685 - DNA, 22 bp, Artificial Sequence
  chemically synthesized
ttaccatgttagaaaataaact

SEQ ID NO: 971686 - DNA, 22 bp, Artificial Sequence
  chemically synthesized
accatgttagaaaataaactta

SEQ ID NO: 971687 - DNA, 22 bp, Artificial Sequence
  chemically synthesized
ccatgttagaaaataaacttaa

SEQ ID NO: 971688 - DNA, 22 bp, Artificial Sequence
  chemically synthesized
cagtgaaatctctactttaagt

SEQ ID NO: 971689 - DNA, 22 bp, Artificial Sequence
  chemically synthesized
tccagtgaaatctctactttaa

SEQ ID NO: 971690 - DNA, 22 bp, Artificial Sequence
  chemically synthesized
gaaaataaacttaaagtagaga

SEQ ID NO: 971691 - DNA, 22 bp, Artificial Sequence
  chemically synthesized
agctctccagtgaaatctctac

SEQ ID NO: 971692 - DNA, 22 bp, Artificial Sequence
  chemically synthesized
ggtcctcagctctccagtgaaa

SEQ ID NO: 971693 - DNA, 22 bp, Artificial Sequence
  chemically synthesized
aaagtagagatttcactggaga

SEQ ID NO: 971694 - DNA, 22 bp, Artificial Sequence
  chemically synthesized
aagtagagatttcactggagag

SEQ ID NO: 971695 - DNA, 22 bp, Artificial Sequence
  chemically synthesized
cctgggtcctcagctctccagt

SEQ ID NO: 971696 - DNA, 22 bp, Artificial Sequence
  chemically synthesized
acctacctgggtcctcagctct

SEQ ID NO: 971697 - DNA, 22 bp, Artificial Sequence
  chemically synthesized
cactggagagctgaggacccag

SEQ ID NO: 971698 - DNA, 22 bp, Artificial Sequence
  chemically synthesized
actggagagctgaggacccagg

SEQ ID NO: 971699 - DNA, 22 bp, Artificial Sequence
  chemically synthesized
agaacctcacctacctgggtcc

SEQ ID NO: 971700 - DNA, 22 bp, Artificial Sequence
  chemically synthesized
gagagctgaggacccaggtagg

SEQ ID NO: 971701 - DNA, 22 bp, Artificial Sequence
  chemically synthesized
gatgcactcagaacctcaccta

SEQ ID NO: 971702 - DNA, 22 bp, Artificial Sequence
  chemically synthesized
aggacccaggtaggtgaggttc

SEQ ID NO: 971703 - DNA, 22 bp, Artificial Sequence
  chemically synthesized
ttagatgcactcagaacctcac

SEQ ID NO: 971704 - DNA, 22 bp, Artificial Sequence
  chemically synthesized
tgttagatgcactcagaacctc

SEQ ID NO: 971705 - DNA, 22 bp, Artificial Sequence
  chemically synthesized
ataacccctctgttagatgcac

SEQ ID NO: 971706 - DNA, 22 bp, Artificial Sequence
  chemically synthesized
tgagtgcatctaacagaggggt

SEQ ID NO: 971707 - DNA, 22 bp, Artificial Sequence
  chemically synthesized
agtgcatctaacagaggggtta

SEQ ID NO: 971708 - DNA, 22 bp, Artificial Sequence
  chemically synthesized
aatgatgtggctaataacccct

SEQ ID NO: 971709 - DNA, 22 bp, Artificial Sequence
  chemically synthesized
acagaggggttattagccacat

SEQ ID NO: 971710 - DNA, 22 bp, Artificial Sequence
  chemically synthesized
agtgattgaatgatgtggctaa

SEQ ID NO: 971711 - DNA, 22 bp, Artificial Sequence
  chemically synthesized
aagtgattgaatgatgtggcta

SEQ ID NO: 971712 - DNA, 22 bp, Artificial Sequence
  chemically synthesized
taagtgattgaatgatgtggct

SEQ ID NO: 971713 - DNA, 22 bp, Artificial Sequence
  chemically synthesized
ttttaagtgattgaatgatgtg

SEQ ID NO: 971714 - DNA, 22 bp, Artificial Sequence
  chemically synthesized
attttaagtgattgaatgatgt

SEQ ID NO: 971715 - DNA, 22 bp, Artificial Sequence
  chemically synthesized
ttagccacatcattcaatcact

SEQ ID NO: 971716 - DNA, 22 bp, Artificial Sequence
  chemically synthesized
gccacatcattcaatcacttaa

SEQ ID NO: 971717 - DNA, 22 bp, Artificial Sequence
  chemically synthesized
tgcgtatatagtcttattttaa

SEQ ID NO: 971718 - DNA, 22 bp, Artificial Sequence
  chemically synthesized
aatcacttaaaataagactata

SEQ ID NO: 971719 - DNA, 22 bp, Artificial Sequence
  chemically synthesized
atgctatgcgtatatagtctta

SEQ ID NO: 971720 - DNA, 22 bp, Artificial Sequence
  chemically synthesized
gctaatgctatgcgtatatagt

SEQ ID NO: 971721 - DNA, 22 bp, Artificial Sequence
  chemically synthesized
aaaataagactatatacgcata

SEQ ID NO: 971722 - DNA, 22 bp, Artificial Sequence
  chemically synthesized
actcgctaatgctatgcgtata

SEQ ID NO: 971723 - DNA, 22 bp, Artificial Sequence
  chemically synthesized
aaataagactatatacgcatag

SEQ ID NO: 971724 - DNA, 22 bp, Artificial Sequence
  chemically synthesized
atgatggttgactcgctaatgc

SEQ ID NO: 971725 - DNA, 22 bp, Artificial Sequence
  chemically synthesized
aatgatggttgactcgctaatg

SEQ ID NO: 971726 - DNA, 22 bp, Artificial Sequence
  chemically synthesized
tatacgcatagcattagcgagt

SEQ ID NO: 971727 - DNA, 22 bp, Artificial Sequence
  chemically synthesized
tcttaatgatggttgactcgct

SEQ ID NO: 971728 - DNA, 22 bp, Artificial Sequence
  chemically synthesized
gtcttaatgatggttgactcgc

SEQ ID NO: 971729 - DNA, 22 bp, Artificial Sequence
  chemically synthesized
gcgagtcaaccatcattaagac

SEQ ID NO: 971730 - DNA, 22 bp, Artificial Sequence
  chemically synthesized
cgaaaaatccgcttgtcttaat

SEQ ID NO: 971731 - DNA, 22 bp, Artificial Sequence
  chemically synthesized
aagtctccgaaaaatccgcttg

SEQ ID NO: 971732 - DNA, 22 bp, Artificial Sequence
  chemically synthesized
atgctaaagtctccgaaaaatc

SEQ ID NO: 971733 - DNA, 22 bp, Artificial Sequence
  chemically synthesized
agacaagcggatttttcggaga

SEQ ID NO: 971734 - DNA, 22 bp, Artificial Sequence
  chemically synthesized
gactcatgctaaagtctccgaa

SEQ ID NO: 971735 - DNA, 22 bp, Artificial Sequence
  chemically synthesized
gtcatctggactcatgctaaag

SEQ ID NO: 971736 - DNA, 22 bp, Artificial Sequence
  chemically synthesized
ggtcatctggactcatgctaaa

SEQ ID NO: 971737 - DNA, 22 bp, Artificial Sequence
  chemically synthesized
ttcggagactttagcatgagtc

SEQ ID NO: 971738 - DNA, 22 bp, Artificial Sequence
  chemically synthesized
tcggagactttagcatgagtcc

SEQ ID NO: 971739 - DNA, 22 bp, Artificial Sequence
  chemically synthesized
cggagactttagcatgagtcca

SEQ ID NO: 971740 - DNA, 22 bp, Artificial Sequence
  chemically synthesized
ggagactttagcatgagtccag

SEQ ID NO: 971741 - DNA, 22 bp, Artificial Sequence
  chemically synthesized
tagcatgagtccagatgaccaa

SEQ ID NO: 971742 - DNA, 22 bp, Artificial Sequence
  chemically synthesized
agcatgagtccagatgaccaaa

SEQ ID NO: 971743 - DNA, 22 bp, Artificial Sequence
  chemically synthesized
gcatgagtccagatgaccaaac

SEQ ID NO: 971744 - DNA, 22 bp, Artificial Sequence
  chemically synthesized
cagagcagaggagtttggtcat

SEQ ID NO: 971745 - DNA, 22 bp, Artificial Sequence
  chemically synthesized
catatggcatctgcagagcaga

SEQ ID NO: 971746 - DNA, 22 bp, Artificial Sequence
  chemically synthesized
cattacatatggcatctgcaga

SEQ ID NO: 971747 - DNA, 22 bp, Artificial Sequence
  chemically synthesized
ctctgctctgcagatgccatat

SEQ ID NO: 971748 - DNA, 22 bp, Artificial Sequence
  chemically synthesized
tgctctgcagatgccatatgta

SEQ ID NO: 971749 - DNA, 22 bp, Artificial Sequence
  chemically synthesized
ctctgcagatgccatatgtaat

SEQ ID NO: 971750 - DNA, 22 bp, Artificial Sequence
  chemically synthesized
tgcagatgccatatgtaatgca

SEQ ID NO: 971751 - DNA, 22 bp, Artificial Sequence
  chemically synthesized
cagatgccatatgtaatgcaga

SEQ ID NO: 971752 - DNA, 22 bp, Artificial Sequence
  chemically synthesized
gaaatatgcaaatctgcattac

SEQ ID NO: 971753 - DNA, 22 bp, Artificial Sequence
  chemically synthesized
aatacattagaaatatgcaaat

SEQ ID NO: 971754 - DNA, 22 bp, Artificial Sequence
  chemically synthesized
aacagtaatacctgaatacatt

SEQ ID NO: 971755 - DNA, 22 bp, Artificial Sequence
  chemically synthesized
aaacagtaatacctgaatacat

SEQ ID NO: 971756 - DNA, 22 bp, Artificial Sequence
  chemically synthesized
gcatatttctaatgtattcagg

SEQ ID NO: 971757 - DNA, 22 bp, Artificial Sequence
  chemically synthesized
taaacagtaatacctgaataca

SEQ ID NO: 971758 - DNA, 22 bp, Artificial Sequence
  chemically synthesized
catatttctaatgtattcaggt

SEQ ID NO: 971759 - DNA, 22 bp, Artificial Sequence
  chemically synthesized
ctaatgtattcaggtattactg

SEQ ID NO: 971760 - DNA, 22 bp, Artificial Sequence
  chemically synthesized
gtagattttaaacagtaatacc

SEQ ID NO: 971761 - DNA, 22 bp, Artificial Sequence
  chemically synthesized
taatgtattcaggtattactgt

SEQ ID NO: 971762 - DNA, 22 bp, Artificial Sequence
  chemically synthesized
tagtagattttaaacagtaata

SEQ ID NO: 971763 - DNA, 22 bp, Artificial Sequence
  chemically synthesized
atgtattcaggtattactgttt

SEQ ID NO: 971764 - DNA, 22 bp, Artificial Sequence
  chemically synthesized
ttctagtagattttaaacagta

SEQ ID NO: 971765 - DNA, 22 bp, Artificial Sequence
  chemically synthesized
aggtattactgtttaaaatcta

SEQ ID NO: 971766 - DNA, 22 bp, Artificial Sequence
  chemically synthesized
tcgttattctagtagattttaa

SEQ ID NO: 971767 - DNA, 22 bp, Artificial Sequence
  chemically synthesized
aagctgtcgttattctagtaga

SEQ ID NO: 971768 - DNA, 22 bp, Artificial Sequence
  chemically synthesized
ctgtttaaaatctactagaata

SEQ ID NO: 971769 - DNA, 22 bp, Artificial Sequence
  chemically synthesized
ttaaagctgtcgttattctagt

SEQ ID NO: 971770 - DNA, 22 bp, Artificial Sequence
  chemically synthesized
attaaagctgtcgttattctag

SEQ ID NO: 971771 - DNA, 22 bp, Artificial Sequence
  chemically synthesized
tttaaaatctactagaataacg

SEQ ID NO: 971772 - DNA, 22 bp, Artificial Sequence
  chemically synthesized
tattaaagctgtcgttattcta

SEQ ID NO: 971773 - DNA, 22 bp, Artificial Sequence
  chemically synthesized
aaaatctactagaataacgaca

SEQ ID NO: 971774 - DNA, 22 bp, Artificial Sequence
  chemically synthesized
ttttattaaagctgtcgttatt

SEQ ID NO: 971775 - DNA, 22 bp, Artificial Sequence
  chemically synthesized
aaatctactagaataacgacag

SEQ ID NO: 971776 - DNA, 22 bp, Artificial Sequence
  chemically synthesized
tattttattaaagctgtcgtta

SEQ ID NO: 971777 - DNA, 22 bp, Artificial Sequence
  chemically synthesized
ctagaataacgacagctttaat

SEQ ID NO: 971778 - DNA, 22 bp, Artificial Sequence
  chemically synthesized
aaactctattttattaaagctg

SEQ ID NO: 971779 - DNA, 22 bp, Artificial Sequence
  chemically synthesized
gaataacgacagctttaataaa

SEQ ID NO: 971780 - DNA, 22 bp, Artificial Sequence
  chemically synthesized
aagccattcaaactctatttta

SEQ ID NO: 971781 - DNA, 22 bp, Artificial Sequence
  chemically synthesized
ttgaagccattcaaactctatt

SEQ ID NO: 971782 - DNA, 22 bp, Artificial Sequence
  chemically synthesized
ctattgaagccattcaaactct

SEQ ID NO: 971783 - DNA, 22 bp, Artificial Sequence
  chemically synthesized
gctattgaagccattcaaactc

SEQ ID NO: 971784 - DNA, 22 bp, Artificial Sequence
  chemically synthesized
tgctattgaagccattcaaact

SEQ ID NO: 971785 - DNA, 22 bp, Artificial Sequence
  chemically synthesized
taataaaatagagtttgaatgg

SEQ ID NO: 971786 - DNA, 22 bp, Artificial Sequence
  chemically synthesized
aataaaatagagtttgaatggc

SEQ ID NO: 971787 - DNA, 22 bp, Artificial Sequence
  chemically synthesized
tttgctattgaagccattcaaa

SEQ ID NO: 971788 - DNA, 22 bp, Artificial Sequence
  chemically synthesized
ataaaatagagtttgaatggct

SEQ ID NO: 971789 - DNA, 22 bp, Artificial Sequence
  chemically synthesized
ctttgctattgaagccattcaa

SEQ ID NO: 971790 - DNA, 22 bp, Artificial Sequence
  chemically synthesized
tctttgctattgaagccattca

SEQ ID NO: 971791 - DNA, 22 bp, Artificial Sequence
  chemically synthesized
agaattttctttgctattgaag

SEQ ID NO: 971792 - DNA, 22 bp, Artificial Sequence
  chemically synthesized
aagaattttctttgctattgaa

SEQ ID NO: 971793 - DNA, 22 bp, Artificial Sequence
  chemically synthesized
taagaattttctttgctattga

SEQ ID NO: 971794 - DNA, 22 bp, Artificial Sequence
  chemically synthesized
gaatggcttcaatagcaaagaa

SEQ ID NO: 971795 - DNA, 22 bp, Artificial Sequence
  chemically synthesized
aatggcttcaatagcaaagaaa

SEQ ID NO: 971796 - DNA, 22 bp, Artificial Sequence
  chemically synthesized
aatctttaagaattttctttgc

SEQ ID NO: 971797 - DNA, 22 bp, Artificial Sequence
  chemically synthesized
gaatctttaagaattttctttg

SEQ ID NO: 971798 - DNA, 22 bp, Artificial Sequence
  chemically synthesized
caatagcaaagaaaattcttaa

SEQ ID NO: 971799 - DNA, 22 bp, Artificial Sequence
  chemically synthesized
aatagcaaagaaaattcttaaa

SEQ ID NO: 971800 - DNA, 22 bp, Artificial Sequence
  chemically synthesized
aacccttgaatctttaagaatt

SEQ ID NO: 971801 - DNA, 22 bp, Artificial Sequence
  chemically synthesized
gaacccttgaatctttaagaat

SEQ ID NO: 971802 - DNA, 22 bp, Artificial Sequence
  chemically synthesized
ttgaacccttgaatctttaaga

SEQ ID NO: 971803 - DNA, 22 bp, Artificial Sequence
  chemically synthesized
ctcttgaacccttgaatcttta

SEQ ID NO: 971804 - DNA, 22 bp, Artificial Sequence
  chemically synthesized
agtagactactcttgaaccctt

SEQ ID NO: 971805 - DNA, 22 bp, Artificial Sequence
  chemically synthesized
ttaaagattcaagggttcaaga

SEQ ID NO: 971806 - DNA, 22 bp, Artificial Sequence
  chemically synthesized
taagtagactactcttgaaccc

SEQ ID NO: 971807 - DNA, 22 bp, Artificial Sequence
  chemically synthesized
ctaagtagactactcttgaacc

SEQ ID NO: 971808 - DNA, 22 bp, Artificial Sequence
  chemically synthesized
aaagattcaagggttcaagagt

SEQ ID NO: 971809 - DNA, 22 bp, Artificial Sequence
  chemically synthesized
aagattcaagggttcaagagta

SEQ ID NO: 971810 - DNA, 22 bp, Artificial Sequence
  chemically synthesized
tttctaagtagactactcttga

SEQ ID NO: 971811 - DNA, 22 bp, Artificial Sequence
  chemically synthesized
aagggttcaagagtagtctact

SEQ ID NO: 971812 - DNA, 22 bp, Artificial Sequence
  chemically synthesized
aatgattatttctaagtagact

SEQ ID NO: 971813 - DNA, 22 bp, Artificial Sequence
  chemically synthesized
aagagtagtctacttagaaata

SEQ ID NO: 971814 - DNA, 22 bp, Artificial Sequence
  chemically synthesized
atgggggttaaatgattatttc

SEQ ID NO: 971815 - DNA, 22 bp, Artificial Sequence
  chemically synthesized
attaatgggggttaaatgatta

SEQ ID NO: 971816 - DNA, 22 bp, Artificial Sequence
  chemically synthesized
cttagaaataatcatttaaccc

SEQ ID NO: 971817 - DNA, 22 bp, Artificial Sequence
  chemically synthesized
agaaataatcatttaaccccca

SEQ ID NO: 971818 - DNA, 22 bp, Artificial Sequence
  chemically synthesized
gaaataatcatttaacccccat

SEQ ID NO: 971819 - DNA, 22 bp, Artificial Sequence
  chemically synthesized
atccaaaaaaaatgttcattaa

SEQ ID NO: 971820 - DNA, 22 bp, Artificial Sequence
  chemically synthesized
aacccccattaatgaacatttt

SEQ ID NO: 971821 - DNA, 22 bp, Artificial Sequence
  chemically synthesized
acccccattaatgaacattttt

SEQ ID NO: 971822 - DNA, 22 bp, Artificial Sequence
  chemically synthesized
tagatactgatccaaaaaaaat

SEQ ID NO: 971823 - DNA, 22 bp, Artificial Sequence
  chemically synthesized
atgaacattttttttggatcag

SEQ ID NO: 971824 - DNA, 22 bp, Artificial Sequence
  chemically synthesized
aaaaaagaactgtagatactga

SEQ ID NO: 971825 - DNA, 22 bp, Artificial Sequence
  chemically synthesized
aaaaaaagaactgtagatactg

SEQ ID NO: 971826 - DNA, 22 bp, Artificial Sequence
  chemically synthesized
taaaaaaagaactgtagatact

SEQ ID NO: 971827 - DNA, 22 bp, Artificial Sequence
  chemically synthesized
tttttggatcagtatctacagt

SEQ ID NO: 971828 - DNA, 22 bp, Artificial Sequence
  chemically synthesized
ttttggatcagtatctacagtt

SEQ ID NO: 971829 - DNA, 22 bp, Artificial Sequence
  chemically synthesized
tttggatcagtatctacagttc

SEQ ID NO: 971830 - DNA, 22 bp, Artificial Sequence
  chemically synthesized
ttggatcagtatctacagttct

SEQ ID NO: 971831 - DNA, 22 bp, Artificial Sequence
  chemically synthesized
tggatcagtatctacagttctt

SEQ ID NO: 971832 - DNA, 22 bp, Artificial Sequence
  chemically synthesized
ggatcagtatctacagttcttt

SEQ ID NO: 971833 - DNA, 22 bp, Artificial Sequence
  chemically synthesized
gatcagtatctacagttctttt

SEQ ID NO: 971834 - DNA, 22 bp, Artificial Sequence
  chemically synthesized
aaaaactttaaaaaaagaactg

SEQ ID NO: 971835 - DNA, 22 bp, Artificial Sequence
  chemically synthesized
aaaaaactttaaaaaaagaact

SEQ ID NO: 971836 - DNA, 22 bp, Artificial Sequence
  chemically synthesized
aaatttaaaaaactttaaaaaa

SEQ ID NO: 971837 - DNA, 22 bp, Artificial Sequence
  chemically synthesized
aaaatttaaaaaactttaaaaa

SEQ ID NO: 971838 - DNA, 22 bp, Artificial Sequence
  chemically synthesized
cagttctttttttaaagttttt

SEQ ID NO: 971839 - DNA, 22 bp, Artificial Sequence
  chemically synthesized
ccagaacttaaaatttaaaaaa

SEQ ID NO: 971840 - DNA, 22 bp, Artificial Sequence
  chemically synthesized
tttttttaaagttttttaaatt

SEQ ID NO: 971841 - DNA, 22 bp, Artificial Sequence
  chemically synthesized
cccagaacttaaaatttaaaaa

SEQ ID NO: 971842 - DNA, 22 bp, Artificial Sequence
  chemically synthesized
tttttaaagttttttaaatttt

SEQ ID NO: 971843 - DNA, 22 bp, Artificial Sequence
  chemically synthesized
ttttaaagttttttaaatttta

SEQ ID NO: 971844 - DNA, 22 bp, Artificial Sequence
  chemically synthesized
tttaaagttttttaaattttaa

SEQ ID NO: 971845 - DNA, 22 bp, Artificial Sequence
  chemically synthesized
ttaaagttttttaaattttaag

SEQ ID NO: 971846 - DNA, 22 bp, Artificial Sequence
  chemically synthesized
taaagttttttaaattttaagt

SEQ ID NO: 971847 - DNA, 22 bp, Artificial Sequence
  chemically synthesized
aaagttttttaaattttaagtt

SEQ ID NO: 971848 - DNA, 22 bp, Artificial Sequence
  chemically synthesized
aagttttttaaattttaagttc

SEQ ID NO: 971849 - DNA, 22 bp, Artificial Sequence
  chemically synthesized
cacatgtttcccagaacttaaa

SEQ ID NO: 971850 - DNA, 22 bp, Artificial Sequence
  chemically synthesized
tgcacatgtttcccagaactta

SEQ ID NO: 971851 - DNA, 22 bp, Artificial Sequence
  chemically synthesized
tttaaattttaagttctgggaa

SEQ ID NO: 971852 - DNA, 22 bp, Artificial Sequence
  chemically synthesized
ttaaattttaagttctgggaaa

SEQ ID NO: 971853 - DNA, 22 bp, Artificial Sequence
  chemically synthesized
taaattttaagttctgggaaac

SEQ ID NO: 971854 - DNA, 22 bp, Artificial Sequence
  chemically synthesized
aaattttaagttctgggaaaca

SEQ ID NO: 971855 - DNA, 22 bp, Artificial Sequence
  chemically synthesized
aattttaagttctgggaaacat

SEQ ID NO: 971856 - DNA, 22 bp, Artificial Sequence
  chemically synthesized
cacgttctgcacatgtttccca

SEQ ID NO: 971857 - DNA, 22 bp, Artificial Sequence
  chemically synthesized
taagttctgggaaacatgtgca

SEQ ID NO: 971858 - DNA, 22 bp, Artificial Sequence
  chemically synthesized
aagttctgggaaacatgtgcag

SEQ ID NO: 971859 - DNA, 22 bp, Artificial Sequence
  chemically synthesized
agttctgggaaacatgtgcaga

SEQ ID NO: 971860 - DNA, 22 bp, Artificial Sequence
  chemically synthesized
tgggaaacatgtgcagaacgtg

SEQ ID NO: 971861 - DNA, 22 bp, Artificial Sequence
  chemically synthesized
tgtaacaaatctgcacgttctg

SEQ ID NO: 971862 - DNA, 22 bp, Artificial Sequence
  chemically synthesized
ggaaacatgtgcagaacgtgca

SEQ ID NO: 971863 - DNA, 22 bp, Artificial Sequence
  chemically synthesized
tggcacatgtgtacctatgtaa

SEQ ID NO: 971864 - DNA, 22 bp, Artificial Sequence
  chemically synthesized
gttacataggtacacatgtgcc

SEQ ID NO: 971865 - DNA, 22 bp, Artificial Sequence
  chemically synthesized
ttacataggtacacatgtgcca

SEQ ID NO: 971866 - DNA, 22 bp, Artificial Sequence
  chemically synthesized
cataggtacacatgtgccatag

SEQ ID NO: 971867 - DNA, 22 bp, Artificial Sequence
  chemically synthesized
ataggtgcagcaaaccactatg

SEQ ID NO: 971868 - DNA, 22 bp, Artificial Sequence
  chemically synthesized
aatgacgggttcataggtgcag

SEQ ID NO: 971869 - DNA, 22 bp, Artificial Sequence
  chemically synthesized
aaacctaaatgacgggttcata

SEQ ID NO: 971870 - DNA, 22 bp, Artificial Sequence
  chemically synthesized
aaaacctaaatgacgggttcat

SEQ ID NO: 971871 - DNA, 22 bp, Artificial Sequence
  chemically synthesized
gctgcacctatgaacccgtcat

SEQ ID NO: 971872 - DNA, 22 bp, Artificial Sequence
  chemically synthesized
ctgcacctatgaacccgtcatt

SEQ ID NO: 971873 - DNA, 22 bp, Artificial Sequence
  chemically synthesized
cacctatgaacccgtcatttag

SEQ ID NO: 971874 - DNA, 22 bp, Artificial Sequence
  chemically synthesized
tgaacccgtcatttaggtttta

SEQ ID NO: 971875 - DNA, 22 bp, Artificial Sequence
  chemically synthesized
atgcatgcggggcttaaaacct

SEQ ID NO: 971876 - DNA, 22 bp, Artificial Sequence
  chemically synthesized
aggttttaagccccgcatgcat

SEQ ID NO: 971877 - DNA, 22 bp, Artificial Sequence
  chemically synthesized
ggttttaagccccgcatgcatt

SEQ ID NO: 971878 - DNA, 22 bp, Artificial Sequence
  chemically synthesized
ggacaaatacctaatgcatgcg

SEQ ID NO: 971879 - DNA, 22 bp, Artificial Sequence
  chemically synthesized
taagccccgcatgcattaggta

SEQ ID NO: 971880 - DNA, 22 bp, Artificial Sequence
  chemically synthesized
aagccccgcatgcattaggtat

SEQ ID NO: 971881 - DNA, 22 bp, Artificial Sequence
  chemically synthesized
agccccgcatgcattaggtatt

SEQ ID NO: 971882 - DNA, 22 bp, Artificial Sequence
  chemically synthesized
ggtatttgtcctaatgctctcc

SEQ ID NO: 971883 - DNA, 22 bp, Artificial Sequence
  chemically synthesized
gtcctaatgctctccctcccct

SEQ ID NO: 971884 - DNA, 22 bp, Artificial Sequence
  chemically synthesized
tcctaatgctctccctcccctt

SEQ ID NO: 971885 - DNA, 22 bp, Artificial Sequence
  chemically synthesized
tcgcgaggtggggggcaagggg

SEQ ID NO: 971886 - DNA, 22 bp, Artificial Sequence
  chemically synthesized
atgctctccctccccttgcccc

SEQ ID NO: 971887 - DNA, 22 bp, Artificial Sequence
  chemically synthesized
tccctccccttgccccccacct

SEQ ID NO: 971888 - DNA, 22 bp, Artificial Sequence
  chemically synthesized
cctccccttgccccccacctcg

SEQ ID NO: 971889 - DNA, 22 bp, Artificial Sequence
  chemically synthesized
cccttgccccccacctcgcgac

SEQ ID NO: 971890 - DNA, 22 bp, Artificial Sequence
  chemically synthesized
gccccccacctcgcgacaggcc

SEQ ID NO: 971891 - DNA, 22 bp, Artificial Sequence
  chemically synthesized
ccccccacctcgcgacaggcct

SEQ ID NO: 971892 - DNA, 22 bp, Artificial Sequence
  chemically synthesized
gcgacaggcctcggtgtgtgat

SEQ ID NO: 971893 - DNA, 22 bp, Artificial Sequence
  chemically synthesized
ggtgtgtgatgttcccctcccg

SEQ ID NO: 971894 - DNA, 22 bp, Artificial Sequence
  chemically synthesized
agcaatgagaacacatggacac

SEQ ID NO: 971895 - DNA, 22 bp, Artificial Sequence
  chemically synthesized
ccctcccggtgtccatgtgttc

SEQ ID NO: 971896 - DNA, 22 bp, Artificial Sequence
  chemically synthesized
ggagttgagcaatgagaacaca

SEQ ID NO: 971897 - DNA, 22 bp, Artificial Sequence
  chemically synthesized
ccggtgtccatgtgttctcatt

SEQ ID NO: 971898 - DNA, 22 bp, Artificial Sequence
  chemically synthesized
ataattgggagttgagcaatga

SEQ ID NO: 971899 - DNA, 22 bp, Artificial Sequence
  chemically synthesized
actcataattgggagttgagca

SEQ ID NO: 971900 - DNA, 22 bp, Artificial Sequence
  chemically synthesized
tcactcataattgggagttgag

SEQ ID NO: 971901 - DNA, 22 bp, Artificial Sequence
  chemically synthesized
ctcactcataattgggagttga

SEQ ID NO: 971902 - DNA, 22 bp, Artificial Sequence
  chemically synthesized
tctcactcataattgggagttg

SEQ ID NO: 971903 - DNA, 22 bp, Artificial Sequence
  chemically synthesized
tcattgctcaactcccaattat

SEQ ID NO: 971904 - DNA, 22 bp, Artificial Sequence
  chemically synthesized
attgctcaactcccaattatga

SEQ ID NO: 971905 - DNA, 22 bp, Artificial Sequence
  chemically synthesized
ctcaactcccaattatgagtga

SEQ ID NO: 971906 - DNA, 22 bp, Artificial Sequence
  chemically synthesized
aactcccaattatgagtgagaa

SEQ ID NO: 971907 - DNA, 22 bp, Artificial Sequence
  chemically synthesized
ccaattatgagtgagaaaatgc

SEQ ID NO: 971908 - DNA, 22 bp, Artificial Sequence
  chemically synthesized
tgagtgagaaaatgcggtgtct

SEQ ID NO: 971909 - DNA, 22 bp, Artificial Sequence
  chemically synthesized
acacaggaatggaaaaacagac

SEQ ID NO: 971910 - DNA, 22 bp, Artificial Sequence
  chemically synthesized
agcaaactaacacaggaatgga

SEQ ID NO: 971911 - DNA, 22 bp, Artificial Sequence
  chemically synthesized
tttttccattcctgtgttagtt

SEQ ID NO: 971912 - DNA, 22 bp, Artificial Sequence
  chemically synthesized
ttccattcctgtgttagtttgc

SEQ ID NO: 971913 - DNA, 22 bp, Artificial Sequence
  chemically synthesized
tccattcctgtgttagtttgct

SEQ ID NO: 971914 - DNA, 22 bp, Artificial Sequence
  chemically synthesized
ccattcctgtgttagtttgctg

SEQ ID NO: 971915 - DNA, 22 bp, Artificial Sequence
  chemically synthesized
cattcctgtgttagtttgctga

SEQ ID NO: 971916 - DNA, 22 bp, Artificial Sequence
  chemically synthesized
gaagccatcatcctcagcaaac

SEQ ID NO: 971917 - DNA, 22 bp, Artificial Sequence
  chemically synthesized
ctgtgttagtttgctgaggatg

SEQ ID NO: 971918 - DNA, 22 bp, Artificial Sequence
  chemically synthesized
tgttagtttgctgaggatgatg

SEQ ID NO: 971919 - DNA, 22 bp, Artificial Sequence
  chemically synthesized
gtttgctgaggatgatggcttc

SEQ ID NO: 971920 - DNA, 22 bp, Artificial Sequence
  chemically synthesized
gctgaggatgatggcttccagc

SEQ ID NO: 971921 - DNA, 22 bp, Artificial Sequence
  chemically synthesized
ctgaggatgatggcttccagct

SEQ ID NO: 971922 - DNA, 22 bp, Artificial Sequence
  chemically synthesized
aggatgatggcttccagcttta

SEQ ID NO: 971923 - DNA, 22 bp, Artificial Sequence
  chemically synthesized
aagggacatggataaagctgga

SEQ ID NO: 971924 - DNA, 22 bp, Artificial Sequence
  chemically synthesized
gaagggacatggataaagctgg

SEQ ID NO: 971925 - DNA, 22 bp, Artificial Sequence
  chemically synthesized
tgaagggacatggataaagctg

SEQ ID NO: 971926 - DNA, 22 bp, Artificial Sequence
  chemically synthesized
atgtcctttgaagggacatgga

SEQ ID NO: 971927 - DNA, 22 bp, Artificial Sequence
  chemically synthesized
ccagctttatccatgtcccttc

SEQ ID NO: 971928 - DNA, 22 bp, Artificial Sequence
  chemically synthesized
cagctttatccatgtcccttca

SEQ ID NO: 971929 - DNA, 22 bp, Artificial Sequence
  chemically synthesized
tatccatgtcccttcaaaggac

SEQ ID NO: 971930 - DNA, 22 bp, Artificial Sequence
  chemically synthesized
atccatgtcccttcaaaggaca

SEQ ID NO: 971931 - DNA, 22 bp, Artificial Sequence
  chemically synthesized
tccatgtcccttcaaaggacat

SEQ ID NO: 971932 - DNA, 22 bp, Artificial Sequence
  chemically synthesized
caaaggacatgaactcgttctt

SEQ ID NO: 971933 - DNA, 22 bp, Artificial Sequence
  chemically synthesized
aaaggacatgaactcgttcttt

SEQ ID NO: 971934 - DNA, 22 bp, Artificial Sequence
  chemically synthesized
tgaatccataaaaaagaacgag

SEQ ID NO: 971935 - DNA, 22 bp, Artificial Sequence
  chemically synthesized
gttcttttttatggattcatag

SEQ ID NO: 971936 - DNA, 22 bp, Artificial Sequence
  chemically synthesized
ttttttatggattcatagtatt

SEQ ID NO: 971937 - DNA, 22 bp, Artificial Sequence
  chemically synthesized
ttttatggattcatagtattcc

SEQ ID NO: 971938 - DNA, 22 bp, Artificial Sequence
  chemically synthesized
tttatggattcatagtattcca

SEQ ID NO: 971939 - DNA, 22 bp, Artificial Sequence
  chemically synthesized
ttatggattcatagtattccat

SEQ ID NO: 971940 - DNA, 22 bp, Artificial Sequence
  chemically synthesized
tatggattcatagtattccatg

SEQ ID NO: 971941 - DNA, 22 bp, Artificial Sequence
  chemically synthesized
atggattcatagtattccatgg

SEQ ID NO: 971942 - DNA, 22 bp, Artificial Sequence
  chemically synthesized
tggattcatagtattccatggt

SEQ ID NO: 971943 - DNA, 22 bp, Artificial Sequence
  chemically synthesized
atagtattccatggtgtgtatg

SEQ ID NO: 971944 - DNA, 22 bp, Artificial Sequence
  chemically synthesized
gataaagaaaaggtggcacata

SEQ ID NO: 971945 - DNA, 22 bp, Artificial Sequence
  chemically synthesized
catggtgtgtatgtgccacctt

SEQ ID NO: 971946 - DNA, 22 bp, Artificial Sequence
  chemically synthesized
ttctttatccagtccatcactg

SEQ ID NO: 971947 - DNA, 22 bp, Artificial Sequence
  chemically synthesized
tctttatccagtccatcactga

SEQ ID NO: 971948 - DNA, 22 bp, Artificial Sequence
  chemically synthesized
ctttatccagtccatcactgat

SEQ ID NO: 971949 - DNA, 22 bp, Artificial Sequence
  chemically synthesized
tttatccagtccatcactgatg

SEQ ID NO: 971950 - DNA, 22 bp, Artificial Sequence
  chemically synthesized
tatccagtccatcactgatggg

SEQ ID NO: 971951 - DNA, 22 bp, Artificial Sequence
  chemically synthesized
tcaacccaaatgcccatcagtg

SEQ ID NO: 971952 - DNA, 22 bp, Artificial Sequence
  chemically synthesized
atccagtccatcactgatgggc

SEQ ID NO: 971953 - DNA, 22 bp, Artificial Sequence
  chemically synthesized
atcaacccaaatgcccatcagt

SEQ ID NO: 971954 - DNA, 22 bp, Artificial Sequence
  chemically synthesized
tccagtccatcactgatgggca

SEQ ID NO: 971955 - DNA, 22 bp, Artificial Sequence
  chemically synthesized
tatatgtttatcaacccaaatg

SEQ ID NO: 971956 - DNA, 22 bp, Artificial Sequence
  chemically synthesized
atatatgtttatcaacccaaat

SEQ ID NO: 971957 - DNA, 22 bp, Artificial Sequence
  chemically synthesized
tatatatgtttatcaacccaaa

SEQ ID NO: 971958 - DNA, 22 bp, Artificial Sequence
  chemically synthesized
atgggcatttgggttgataaac

SEQ ID NO: 971959 - DNA, 22 bp, Artificial Sequence
  chemically synthesized
gggttgataaacatatataaag

SEQ ID NO: 971960 - DNA, 22 bp, Artificial Sequence
  chemically synthesized
ggttgataaacatatataaaga

SEQ ID NO: 971961 - DNA, 22 bp, Artificial Sequence
  chemically synthesized
ggataagaaagtgatctttata

SEQ ID NO: 971962 - DNA, 22 bp, Artificial Sequence
  chemically synthesized
aggataagaaagtgatctttat

SEQ ID NO: 971963 - DNA, 22 bp, Artificial Sequence
  chemically synthesized
ataaacatatataaagatcact

SEQ ID NO: 971964 - DNA, 22 bp, Artificial Sequence
  chemically synthesized
cttaggataagaaagtgatctt

SEQ ID NO: 971965 - DNA, 22 bp, Artificial Sequence
  chemically synthesized
ccttaggataagaaagtgatct

SEQ ID NO: 971966 - DNA, 22 bp, Artificial Sequence
  chemically synthesized
tccttaggataagaaagtgatc

SEQ ID NO: 971967 - DNA, 22 bp, Artificial Sequence
  chemically synthesized
ttccttaggataagaaagtgat

SEQ ID NO: 971968 - DNA, 22 bp, Artificial Sequence
  chemically synthesized
tacaagtatacttttccttagg

SEQ ID NO: 971969 - DNA, 22 bp, Artificial Sequence
  chemically synthesized
tcttatcctaaggaaaagtata

SEQ ID NO: 971970 - DNA, 22 bp, Artificial Sequence
  chemically synthesized
cttatcctaaggaaaagtatac

SEQ ID NO: 971971 - DNA, 22 bp, Artificial Sequence
  chemically synthesized
ttatcctaaggaaaagtatact

SEQ ID NO: 971972 - DNA, 22 bp, Artificial Sequence
  chemically synthesized
gtcccattatacaagtatactt

SEQ ID NO: 971973 - DNA, 22 bp, Artificial Sequence
  chemically synthesized
atcctaaggaaaagtatacttg

SEQ ID NO: 971974 - DNA, 22 bp, Artificial Sequence
  chemically synthesized
tcctaaggaaaagtatacttgt

SEQ ID NO: 971975 - DNA, 22 bp, Artificial Sequence
  chemically synthesized
aggaaaagtatacttgtataat

SEQ ID NO: 971976 - DNA, 22 bp, Artificial Sequence
  chemically synthesized
tatatctggtcccattatacaa

SEQ ID NO: 971977 - DNA, 22 bp, Artificial Sequence
  chemically synthesized
atatatctggtcccattataca

SEQ ID NO: 971978 - DNA, 22 bp, Artificial Sequence
  chemically synthesized
tatatatctggtcccattatac

SEQ ID NO: 971979 - DNA, 22 bp, Artificial Sequence
  chemically synthesized
agtcactttatatatctggtcc

SEQ ID NO: 971980 - DNA, 22 bp, Artificial Sequence
  chemically synthesized
gtataatgggaccagatatata

SEQ ID NO: 971981 - DNA, 22 bp, Artificial Sequence
  chemically synthesized
actaagtcactttatatatctg

SEQ ID NO: 971982 - DNA, 22 bp, Artificial Sequence
  chemically synthesized
tataatgggaccagatatataa

SEQ ID NO: 971983 - DNA, 22 bp, Artificial Sequence
  chemically synthesized
aactaagtcactttatatatct

SEQ ID NO: 971984 - DNA, 22 bp, Artificial Sequence
  chemically synthesized
taactaagtcactttatatatc

SEQ ID NO: 971985 - DNA, 22 bp, Artificial Sequence
  chemically synthesized
tattttaactaagtcactttat

SEQ ID NO: 971986 - DNA, 22 bp, Artificial Sequence
  chemically synthesized
gtattttaactaagtcacttta

SEQ ID NO: 971987 - DNA, 22 bp, Artificial Sequence
  chemically synthesized
atttgtattttaactaagtcac

SEQ ID NO: 971988 - DNA, 22 bp, Artificial Sequence
  chemically synthesized
gggttgatttgtattttaacta

SEQ ID NO: 971989 - DNA, 22 bp, Artificial Sequence
  chemically synthesized
agggttgatttgtattttaact

SEQ ID NO: 971990 - DNA, 22 bp, Artificial Sequence
  chemically synthesized
tacttagggttgatttgtattt

SEQ ID NO: 971991 - DNA, 22 bp, Artificial Sequence
  chemically synthesized
atacttagggttgatttgtatt

SEQ ID NO: 971992 - DNA, 22 bp, Artificial Sequence
  chemically synthesized
tatacttagggttgatttgtat

SEQ ID NO: 971993 - DNA, 22 bp, Artificial Sequence
  chemically synthesized
attttatacttagggttgattt

SEQ ID NO: 971994 - DNA, 22 bp, Artificial Sequence
  chemically synthesized
agttaaaatacaaatcaaccct

SEQ ID NO: 971995 - DNA, 22 bp, Artificial Sequence
  chemically synthesized
aattttatacttagggttgatt

SEQ ID NO: 971996 - DNA, 22 bp, Artificial Sequence
  chemically synthesized
gttaaaatacaaatcaacccta

SEQ ID NO: 971997 - DNA, 22 bp, Artificial Sequence
  chemically synthesized
taattttatacttagggttgat

SEQ ID NO: 971998 - DNA, 22 bp, Artificial Sequence
  chemically synthesized
aaatacaaatcaaccctaagta

SEQ ID NO: 971999 - DNA, 22 bp, Artificial Sequence
  chemically synthesized
cctttaattttatacttagggt

SEQ ID NO: 972000 - DNA, 22 bp, Artificial Sequence
  chemically synthesized
gaattccctttaattttatact

SEQ ID NO: 972001 - DNA, 22 bp, Artificial Sequence
  chemically synthesized
agaattccctttaattttatac

SEQ ID NO: 972002 - DNA, 22 bp, Artificial Sequence
  chemically synthesized
tatttagaattccctttaattt

SEQ ID NO: 972003 - DNA, 22 bp, Artificial Sequence
  chemically synthesized
agtataaaattaaagggaattc

SEQ ID NO: 972004 - DNA, 22 bp, Artificial Sequence
  chemically synthesized
catatacatgttgtatttagaa

SEQ ID NO: 972005 - DNA, 22 bp, Artificial Sequence
  chemically synthesized
ccatatacatgttgtatttaga

SEQ ID NO: 972006 - DNA, 22 bp, Artificial Sequence
  chemically synthesized
aagggaattctaaatacaacat

SEQ ID NO: 972007 - DNA, 22 bp, Artificial Sequence
  chemically synthesized
taggtatttccatatacatgtt

SEQ ID NO: 972008 - DNA, 22 bp, Artificial Sequence
  chemically synthesized
ttataggtatttccatatacat

SEQ ID NO: 972009 - DNA, 22 bp, Artificial Sequence
  chemically synthesized
taaatacaacatgtatatggaa

SEQ ID NO: 972010 - DNA, 22 bp, Artificial Sequence
  chemically synthesized
aatacaacatgtatatggaaat

SEQ ID NO: 972011 - DNA, 22 bp, Artificial Sequence
  chemically synthesized
gttattataggtatttccatat

SEQ ID NO: 972012 - DNA, 22 bp, Artificial Sequence
  chemically synthesized
agttattataggtatttccata

SEQ ID NO: 972013 - DNA, 22 bp, Artificial Sequence
  chemically synthesized
ggaatttagttattataggtat

SEQ ID NO: 972014 - DNA, 22 bp, Artificial Sequence
  chemically synthesized
tcaacattaggaatttagttat

SEQ ID NO: 972015 - DNA, 22 bp, Artificial Sequence
  chemically synthesized
gtcaacattaggaatttagtta

SEQ ID NO: 972016 - DNA, 22 bp, Artificial Sequence
  chemically synthesized
tgtcaacattaggaatttagtt

SEQ ID NO: 972017 - DNA, 22 bp, Artificial Sequence
  chemically synthesized
taataactaaattcctaatgtt

SEQ ID NO: 972018 - DNA, 22 bp, Artificial Sequence
  chemically synthesized
tcaagtgctttgtcaacattag

SEQ ID NO: 972019 - DNA, 22 bp, Artificial Sequence
  chemically synthesized
aattcctaatgttgacaaagca

SEQ ID NO: 972020 - DNA, 22 bp, Artificial Sequence
  chemically synthesized
taaactgtcaagtgctttgtca

SEQ ID NO: 972021 - DNA, 22 bp, Artificial Sequence
  chemically synthesized
gtaaactgtcaagtgctttgtc

SEQ ID NO: 972022 - DNA, 22 bp, Artificial Sequence
  chemically synthesized
ctaatgttgacaaagcacttga

SEQ ID NO: 972023 - DNA, 22 bp, Artificial Sequence
  chemically synthesized
atgttgacaaagcacttgacag

SEQ ID NO: 972024 - DNA, 22 bp, Artificial Sequence
  chemically synthesized
acaaagcacttgacagtttaca

SEQ ID NO: 972025 - DNA, 22 bp, Artificial Sequence
  chemically synthesized
tgatatagtaaaagaatttgta

SEQ ID NO: 972026 - DNA, 22 bp, Artificial Sequence
  chemically synthesized
gacagtttacaaattcttttac

SEQ ID NO: 972027 - DNA, 22 bp, Artificial Sequence
  chemically synthesized
acagtttacaaattcttttact

SEQ ID NO: 972028 - DNA, 22 bp, Artificial Sequence
  chemically synthesized
aatgctatgatatagtaaaaga

SEQ ID NO: 972029 - DNA, 22 bp, Artificial Sequence
  chemically synthesized
ttaaatgctatgatatagtaaa

SEQ ID NO: 972030 - DNA, 22 bp, Artificial Sequence
  chemically synthesized
acaaattcttttactatatcat

SEQ ID NO: 972031 - DNA, 22 bp, Artificial Sequence
  chemically synthesized
caaattcttttactatatcata

SEQ ID NO: 972032 - DNA, 22 bp, Artificial Sequence
  chemically synthesized
acattattaaatgctatgatat

SEQ ID NO: 972033 - DNA, 22 bp, Artificial Sequence
  chemically synthesized
attaacattattaaatgctatg

SEQ ID NO: 972034 - DNA, 22 bp, Artificial Sequence
  chemically synthesized
ttttactatatcatagcattta

SEQ ID NO: 972035 - DNA, 22 bp, Artificial Sequence
  chemically synthesized
cattaacattattaaatgctat

SEQ ID NO: 972036 - DNA, 22 bp, Artificial Sequence
  chemically synthesized
ttactatatcatagcatttaat

SEQ ID NO: 972037 - DNA, 22 bp, Artificial Sequence
  chemically synthesized
tactatatcatagcatttaata

SEQ ID NO: 972038 - DNA, 22 bp, Artificial Sequence
  chemically synthesized
actatatcatagcatttaataa

SEQ ID NO: 972039 - DNA, 22 bp, Artificial Sequence
  chemically synthesized
ctatatcatagcatttaataat

SEQ ID NO: 972040 - DNA, 22 bp, Artificial Sequence
  chemically synthesized
tatcatagcatttaataatgtt

SEQ ID NO: 972041 - DNA, 22 bp, Artificial Sequence
  chemically synthesized
cgtgacagacttcattaacatt

SEQ ID NO: 972042 - DNA, 22 bp, Artificial Sequence
  chemically synthesized
aataatgttaatgaagtctgtc

SEQ ID NO: 972043 - DNA, 22 bp, Artificial Sequence
  chemically synthesized
ataatgttaatgaagtctgtca

SEQ ID NO: 972044 - DNA, 22 bp, Artificial Sequence
  chemically synthesized
atgaagtctgtcacgtaggcat

SEQ ID NO: 972045 - DNA, 22 bp, Artificial Sequence
  chemically synthesized
taaaacatgcaaaatgcctacg

SEQ ID NO: 972046 - DNA, 22 bp, Artificial Sequence
  chemically synthesized
aactgtaaaacatgcaaaatgc

SEQ ID NO: 972047 - DNA, 22 bp, Artificial Sequence
  chemically synthesized
tgaactgtaaaacatgcaaaat

SEQ ID NO: 972048 - DNA, 22 bp, Artificial Sequence
  chemically synthesized
ctgaactgtaaaacatgcaaaa

SEQ ID NO: 972049 - DNA, 22 bp, Artificial Sequence
  chemically synthesized
tcacgtaggcattttgcatgtt

SEQ ID NO: 972050 - DNA, 22 bp, Artificial Sequence
  chemically synthesized
tctgaactgtaaaacatgcaaa

SEQ ID NO: 972051 - DNA, 22 bp, Artificial Sequence
  chemically synthesized
gaagaaaacattttctgaactg

SEQ ID NO: 972052 - DNA, 22 bp, Artificial Sequence
  chemically synthesized
tgcatgttttacagttcagaaa

SEQ ID NO: 972053 - DNA, 22 bp, Artificial Sequence
  chemically synthesized
gcatgttttacagttcagaaaa

SEQ ID NO: 972054 - DNA, 22 bp, Artificial Sequence
  chemically synthesized
catgttttacagttcagaaaat

SEQ ID NO: 972055 - DNA, 22 bp, Artificial Sequence
  chemically synthesized
ctggaagaaaacattttctgaa

SEQ ID NO: 972056 - DNA, 22 bp, Artificial Sequence
  chemically synthesized
actggaagaaaacattttctga

SEQ ID NO: 972057 - DNA, 22 bp, Artificial Sequence
  chemically synthesized
tacagttcagaaaatgttttct

SEQ ID NO: 972058 - DNA, 22 bp, Artificial Sequence
  chemically synthesized
agatttactggaagaaaacatt

SEQ ID NO: 972059 - DNA, 22 bp, Artificial Sequence
  chemically synthesized
acagttcagaaaatgttttctt

SEQ ID NO: 972060 - DNA, 22 bp, Artificial Sequence
  chemically synthesized
cagttcagaaaatgttttcttc

SEQ ID NO: 972061 - DNA, 22 bp, Artificial Sequence
  chemically synthesized
gctgagatttactggaagaaaa

SEQ ID NO: 972062 - DNA, 22 bp, Artificial Sequence
  chemically synthesized
agctgagatttactggaagaaa

SEQ ID NO: 972063 - DNA, 22 bp, Artificial Sequence
  chemically synthesized
tagctgagatttactggaagaa

SEQ ID NO: 972064 - DNA, 22 bp, Artificial Sequence
  chemically synthesized
ttagctgagatttactggaaga

SEQ ID NO: 972065 - DNA, 22 bp, Artificial Sequence
  chemically synthesized
agaaaatgttttcttccagtaa

SEQ ID NO: 972066 - DNA, 22 bp, Artificial Sequence
  chemically synthesized
agcagtttttagctgagattta

SEQ ID NO: 972067 - DNA, 22 bp, Artificial Sequence
  chemically synthesized
cagcagtttttagctgagattt

SEQ ID NO: 972068 - DNA, 22 bp, Artificial Sequence
  chemically synthesized
tcttccagtaaatctcagctaa

SEQ ID NO: 972069 - DNA, 22 bp, Artificial Sequence
  chemically synthesized
cttccagtaaatctcagctaaa

SEQ ID NO: 972070 - DNA, 22 bp, Artificial Sequence
  chemically synthesized
gcttcagcagtttttagctgag

SEQ ID NO: 972071 - DNA, 22 bp, Artificial Sequence
  chemically synthesized
ttccagtaaatctcagctaaaa

SEQ ID NO: 972072 - DNA, 22 bp, Artificial Sequence
  chemically synthesized
ccagtaaatctcagctaaaaac

SEQ ID NO: 972073 - DNA, 22 bp, Artificial Sequence
  chemically synthesized
cagtaaatctcagctaaaaact

SEQ ID NO: 972074 - DNA, 22 bp, Artificial Sequence
  chemically synthesized
aagccctagcttcagcagtttt

SEQ ID NO: 972075 - DNA, 22 bp, Artificial Sequence
  chemically synthesized
agctaaaaactgctgaagctag

SEQ ID NO: 972076 - DNA, 22 bp, Artificial Sequence
  chemically synthesized
aaaactgctgaagctagggctt

SEQ ID NO: 972077 - DNA, 22 bp, Artificial Sequence
  chemically synthesized
ctgaagctagggcttgaacatc

SEQ ID NO: 972078 - DNA, 22 bp, Artificial Sequence
  chemically synthesized
aagctagggcttgaacatctgt

SEQ ID NO: 972079 - DNA, 22 bp, Artificial Sequence
  chemically synthesized
aaaatgggaataagacagatgt

SEQ ID NO: 972080 - DNA, 22 bp, Artificial Sequence
  chemically synthesized
gggcttgaacatctgtcttatt

SEQ ID NO: 972081 - DNA, 22 bp, Artificial Sequence
  chemically synthesized
gaacatctgtcttattcccatt

SEQ ID NO: 972082 - DNA, 22 bp, Artificial Sequence
  chemically synthesized
aacatctgtcttattcccattt

SEQ ID NO: 972083 - DNA, 22 bp, Artificial Sequence
  chemically synthesized
tcttattcccatttttaacacg

SEQ ID NO: 972084 - DNA, 22 bp, Artificial Sequence
  chemically synthesized
attcccatttttaacacggact

SEQ ID NO: 972085 - DNA, 22 bp, Artificial Sequence
  chemically synthesized
ttcccatttttaacacggactg

SEQ ID NO: 972086 - DNA, 22 bp, Artificial Sequence
  chemically synthesized
ccatttttaacacggactgtta

SEQ ID NO: 972087 - DNA, 22 bp, Artificial Sequence
  chemically synthesized
ttaacacggactgttacatttt

SEQ ID NO: 972088 - DNA, 22 bp, Artificial Sequence
  chemically synthesized
taacacggactgttacattttc

SEQ ID NO: 972089 - DNA, 22 bp, Artificial Sequence
  chemically synthesized
aacacggactgttacattttca

SEQ ID NO: 972090 - DNA, 22 bp, Artificial Sequence
  chemically synthesized
acacggactgttacattttcat

SEQ ID NO: 972091 - DNA, 22 bp, Artificial Sequence
  chemically synthesized
gtcaaaaaaagtagatgaaaat

SEQ ID NO: 972092 - DNA, 22 bp, Artificial Sequence
  chemically synthesized
ttagtcaaaaaaagtagatgaa

SEQ ID NO: 972093 - DNA, 22 bp, Artificial Sequence
  chemically synthesized
attagtcaaaaaaagtagatga

SEQ ID NO: 972094 - DNA, 22 bp, Artificial Sequence
  chemically synthesized
tattagtcaaaaaaagtagatg

SEQ ID NO: 972095 - DNA, 22 bp, Artificial Sequence
  chemically synthesized
ttacattttcatctactttttt

SEQ ID NO: 972096 - DNA, 22 bp, Artificial Sequence
  chemically synthesized
actttattagtcaaaaaaagta

SEQ ID NO: 972097 - DNA, 22 bp, Artificial Sequence
  chemically synthesized
cattttcatctactttttttga

SEQ ID NO: 972098 - DNA, 22 bp, Artificial Sequence
  chemically synthesized
atattgactttattagtcaaaa

SEQ ID NO: 972099 - DNA, 22 bp, Artificial Sequence
  chemically synthesized
tcatctactttttttgactaat

SEQ ID NO: 972100 - DNA, 22 bp, Artificial Sequence
  chemically synthesized
catattgactttattagtcaaa

SEQ ID NO: 972101 - DNA, 22 bp, Artificial Sequence
  chemically synthesized
catctactttttttgactaata

SEQ ID NO: 972102 - DNA, 22 bp, Artificial Sequence
  chemically synthesized
tcatattgactttattagtcaa

SEQ ID NO: 972103 - DNA, 22 bp, Artificial Sequence
  chemically synthesized
atctactttttttgactaataa

SEQ ID NO: 972104 - DNA, 22 bp, Artificial Sequence
  chemically synthesized
actttcatattgactttattag

SEQ ID NO: 972105 - DNA, 22 bp, Artificial Sequence
  chemically synthesized
ctttttttgactaataaagtca

SEQ ID NO: 972106 - DNA, 22 bp, Artificial Sequence
  chemically synthesized
tttttgactaataaagtcaata

SEQ ID NO: 972107 - DNA, 22 bp, Artificial Sequence
  chemically synthesized
gactgactttcatattgacttt

SEQ ID NO: 972108 - DNA, 22 bp, Artificial Sequence
  chemically synthesized
ttttgactaataaagtcaatat

SEQ ID NO: 972109 - DNA, 22 bp, Artificial Sequence
  chemically synthesized
tttgactaataaagtcaatatg

SEQ ID NO: 972110 - DNA, 22 bp, Artificial Sequence
  chemically synthesized
ttgactaataaagtcaatatga

SEQ ID NO: 972111 - DNA, 22 bp, Artificial Sequence
  chemically synthesized
tgactaataaagtcaatatgaa

SEQ ID NO: 972112 - DNA, 22 bp, Artificial Sequence
  chemically synthesized
gactaataaagtcaatatgaaa

SEQ ID NO: 972113 - DNA, 22 bp, Artificial Sequence
  chemically synthesized
actaataaagtcaatatgaaag

SEQ ID NO: 972114 - DNA, 22 bp, Artificial Sequence
  chemically synthesized
aatctagactgactttcatatt

SEQ ID NO: 972115 - DNA, 22 bp, Artificial Sequence
  chemically synthesized
ataaagtcaatatgaaagtcag

SEQ ID NO: 972116 - DNA, 22 bp, Artificial Sequence
  chemically synthesized
taaagaagatgtgcaaagcctg

SEQ ID NO: 972117 - DNA, 22 bp, Artificial Sequence
  chemically synthesized
gcattgtaaagaagatgtgcaa

SEQ ID NO: 972118 - DNA, 22 bp, Artificial Sequence
  chemically synthesized
gattcaggctttgcacatcttc

SEQ ID NO: 972119 - DNA, 22 bp, Artificial Sequence
  chemically synthesized
gctagcattgtaaagaagatgt

SEQ ID NO: 972120 - DNA, 22 bp, Artificial Sequence
  chemically synthesized
aggctttgcacatcttctttac

SEQ ID NO: 972121 - DNA, 22 bp, Artificial Sequence
  chemically synthesized
tgcacatcttctttacaatgct

SEQ ID NO: 972122 - DNA, 22 bp, Artificial Sequence
  chemically synthesized
gcacatcttctttacaatgcta

SEQ ID NO: 972123 - DNA, 22 bp, Artificial Sequence
  chemically synthesized
ccccaaactcgctagcattgta

SEQ ID NO: 972124 - DNA, 22 bp, Artificial Sequence
  chemically synthesized
cacatcttctttacaatgctag

SEQ ID NO: 972125 - DNA, 22 bp, Artificial Sequence
  chemically synthesized
gttgccccaaactcgctagcat

SEQ ID NO: 972126 - DNA, 22 bp, Artificial Sequence
  chemically synthesized
tctggttgccccaaactcgcta

SEQ ID NO: 972127 - DNA, 22 bp, Artificial Sequence
  chemically synthesized
ctttacaatgctagcgagtttg

SEQ ID NO: 972128 - DNA, 22 bp, Artificial Sequence
  chemically synthesized
atctggttgccccaaactcgct

SEQ ID NO: 972129 - DNA, 22 bp, Artificial Sequence
  chemically synthesized
tttacaatgctagcgagtttgg

SEQ ID NO: 972130 - DNA, 22 bp, Artificial Sequence
  chemically synthesized
tacaatgctagcgagtttgggg

SEQ ID NO: 972131 - DNA, 22 bp, Artificial Sequence
  chemically synthesized
acaatgctagcgagtttggggc

SEQ ID NO: 972132 - DNA, 22 bp, Artificial Sequence
  chemically synthesized
caatgctagcgagtttggggca

SEQ ID NO: 972133 - DNA, 22 bp, Artificial Sequence
  chemically synthesized
gtgtttatctggttgccccaaa

SEQ ID NO: 972134 - DNA, 22 bp, Artificial Sequence
  chemically synthesized
ggtgtttatctggttgccccaa

SEQ ID NO: 972135 - DNA, 22 bp, Artificial Sequence
  chemically synthesized
tggtgtttatctggttgcccca

SEQ ID NO: 972136 - DNA, 22 bp, Artificial Sequence
  chemically synthesized
ttggtgtttatctggttgcccc

SEQ ID NO: 972137 - DNA, 22 bp, Artificial Sequence
  chemically synthesized
gcgagtttggggcaaccagata

SEQ ID NO: 972138 - DNA, 22 bp, Artificial Sequence
  chemically synthesized
agtgcttttggtgtttatctgg

SEQ ID NO: 972139 - DNA, 22 bp, Artificial Sequence
  chemically synthesized
gagtgcttttggtgtttatctg

SEQ ID NO: 972140 - DNA, 22 bp, Artificial Sequence
  chemically synthesized
tgagtgcttttggtgtttatct

SEQ ID NO: 972141 - DNA, 22 bp, Artificial Sequence
  chemically synthesized
tttgagtgcttttggtgtttat

SEQ ID NO: 972142 - DNA, 22 bp, Artificial Sequence
  chemically synthesized
ggggcaaccagataaacaccaa

SEQ ID NO: 972143 - DNA, 22 bp, Artificial Sequence
  chemically synthesized
gggcaaccagataaacaccaaa

SEQ ID NO: 972144 - DNA, 22 bp, Artificial Sequence
  chemically synthesized
tggtcatgttctttgagtgctt

SEQ ID NO: 972145 - DNA, 22 bp, Artificial Sequence
  chemically synthesized
atggtcatgttctttgagtgct

SEQ ID NO: 972146 - DNA, 22 bp, Artificial Sequence
  chemically synthesized
atttatggtcatgttctttgag

SEQ ID NO: 972147 - DNA, 22 bp, Artificial Sequence
  chemically synthesized
aatttatggtcatgttctttga

SEQ ID NO: 972148 - DNA, 22 bp, Artificial Sequence
  chemically synthesized
taatttatggtcatgttctttg

SEQ ID NO: 972149 - DNA, 22 bp, Artificial Sequence
  chemically synthesized
ttaatttatggtcatgttcttt

SEQ ID NO: 972150 - DNA, 22 bp, Artificial Sequence
  chemically synthesized
tttttaatttatggtcatgttc

SEQ ID NO: 972151 - DNA, 22 bp, Artificial Sequence
  chemically synthesized
atttttaatttatggtcatgtt

SEQ ID NO: 972152 - DNA, 22 bp, Artificial Sequence
  chemically synthesized
tggatttatttttaatttatgg

SEQ ID NO: 972153 - DNA, 22 bp, Artificial Sequence
  chemically synthesized
aaagaacatgaccataaattaa

SEQ ID NO: 972154 - DNA, 22 bp, Artificial Sequence
  chemically synthesized
ttatggatttatttttaattta

SEQ ID NO: 972155 - DNA, 22 bp, Artificial Sequence
  chemically synthesized
attatggatttatttttaattt

SEQ ID NO: 972156 - DNA, 22 bp, Artificial Sequence
  chemically synthesized
aatttattatggatttattttt

SEQ ID NO: 972157 - DNA, 22 bp, Artificial Sequence
  chemically synthesized
aaaataaatccataataaattc

SEQ ID NO: 972158 - DNA, 22 bp, Artificial Sequence
  chemically synthesized
aagagcatagcatctgaattta

SEQ ID NO: 972159 - DNA, 22 bp, Artificial Sequence
  chemically synthesized
gaagagcatagcatctgaattt

SEQ ID NO: 972160 - DNA, 22 bp, Artificial Sequence
  chemically synthesized
cttgaagagcatagcatctgaa

SEQ ID NO: 972161 - DNA, 22 bp, Artificial Sequence
  chemically synthesized
ccttgaagagcatagcatctga

SEQ ID NO: 972162 - DNA, 22 bp, Artificial Sequence
  chemically synthesized
tccttgaagagcatagcatctg

SEQ ID NO: 972163 - DNA, 22 bp, Artificial Sequence
  chemically synthesized
ttccttgaagagcatagcatct

SEQ ID NO: 972164 - DNA, 22 bp, Artificial Sequence
  chemically synthesized
tttccttgaagagcatagcatc

SEQ ID NO: 972165 - DNA, 22 bp, Artificial Sequence
  chemically synthesized
ttttccttgaagagcatagcat

SEQ ID NO: 972166 - DNA, 22 bp, Artificial Sequence
  chemically synthesized
atttttttccttgaagagcata

SEQ ID NO: 972167 - DNA, 22 bp, Artificial Sequence
  chemically synthesized
gatttttttccttgaagagcat

SEQ ID NO: 972168 - DNA, 22 bp, Artificial Sequence
  chemically synthesized
tgatttttttccttgaagagca

SEQ ID NO: 972169 - DNA, 22 bp, Artificial Sequence
  chemically synthesized
ttgatttttttccttgaagagc

SEQ ID NO: 972170 - DNA, 22 bp, Artificial Sequence
  chemically synthesized
tttgatttttttccttgaagag

SEQ ID NO: 972171 - DNA, 22 bp, Artificial Sequence
  chemically synthesized
agatgctatgctcttcaaggaa

SEQ ID NO: 972172 - DNA, 22 bp, Artificial Sequence
  chemically synthesized
tgctcttcaaggaaaaaaatca

SEQ ID NO: 972173 - DNA, 22 bp, Artificial Sequence
  chemically synthesized
aatacccctttttgattttttt

SEQ ID NO: 972174 - DNA, 22 bp, Artificial Sequence
  chemically synthesized
caatacccctttttgatttttt

SEQ ID NO: 972175 - DNA, 22 bp, Artificial Sequence
  chemically synthesized
tcaatacccctttttgattttt

SEQ ID NO: 972176 - DNA, 22 bp, Artificial Sequence
  chemically synthesized
ttcaaggaaaaaaatcaaaaag

SEQ ID NO: 972177 - DNA, 22 bp, Artificial Sequence
  chemically synthesized
caaggaaaaaaatcaaaaaggg

SEQ ID NO: 972178 - DNA, 22 bp, Artificial Sequence
  chemically synthesized
aaggaaaaaaatcaaaaagggg

SEQ ID NO: 972179 - DNA, 22 bp, Artificial Sequence
  chemically synthesized
aaaatgtgcctgtatttgcgtg

SEQ ID NO: 972180 - DNA, 22 bp, Artificial Sequence
  chemically synthesized
cgtacatatatatgcatatatc

SEQ ID NO: 972181 - DNA, 22 bp, Artificial Sequence
  chemically synthesized
tatttgcgtgatatatgcatat

SEQ ID NO: 972182 - DNA, 22 bp, Artificial Sequence
  chemically synthesized
gcgtgatatatgcatatatatg

SEQ ID NO: 972183 - DNA, 22 bp, Artificial Sequence
  chemically synthesized
cgtgatatatgcatatatatgt

SEQ ID NO: 972184 - DNA, 22 bp, Artificial Sequence
  chemically synthesized
caaatatgtgtacctacgtaca

SEQ ID NO: 972185 - DNA, 22 bp, Artificial Sequence
  chemically synthesized
tatacatatatacacataaatt

SEQ ID NO: 972186 - DNA, 22 bp, Artificial Sequence
  chemically synthesized
gtaatttatgtgtatatatgta

SEQ ID NO: 972187 - DNA, 22 bp, Artificial Sequence
  chemically synthesized
taatttatgtgtatatatgtat

SEQ ID NO: 972188 - DNA, 22 bp, Artificial Sequence
  chemically synthesized
atgtgtatatatgtatatagtt

SEQ ID NO: 972189 - DNA, 22 bp, Artificial Sequence
  chemically synthesized
tgtgtatatatgtatatagttt

SEQ ID NO: 972190 - DNA, 22 bp, Artificial Sequence
  chemically synthesized
catgtatatacatccataaact

SEQ ID NO: 972191 - DNA, 22 bp, Artificial Sequence
  chemically synthesized
acatgtatatacatccataaac

SEQ ID NO: 972192 - DNA, 22 bp, Artificial Sequence
  chemically synthesized
catatatgtgcatttacatgta

SEQ ID NO: 972193 - DNA, 22 bp, Artificial Sequence
  chemically synthesized
atggatgtatatacatgtaaat

SEQ ID NO: 972194 - DNA, 22 bp, Artificial Sequence
  chemically synthesized
acatatatgtgcatttacatgt

SEQ ID NO: 972195 - DNA, 22 bp, Artificial Sequence
  chemically synthesized
tggatgtatatacatgtaaatg

SEQ ID NO: 972196 - DNA, 22 bp, Artificial Sequence
  chemically synthesized
tacatatatgtgcatttacatg

SEQ ID NO: 972197 - DNA, 22 bp, Artificial Sequence
  chemically synthesized
ttacatatatgtgcatttacat

SEQ ID NO: 972198 - DNA, 22 bp, Artificial Sequence
  chemically synthesized
tatgatttttacatatatgtgc

SEQ ID NO: 972199 - DNA, 22 bp, Artificial Sequence
  chemically synthesized
atatgatttttacatatatgtg

SEQ ID NO: 972200 - DNA, 22 bp, Artificial Sequence
  chemically synthesized
tatatttatatgatttttacat

SEQ ID NO: 972201 - DNA, 22 bp, Artificial Sequence
  chemically synthesized
tatatatttatatgatttttac

SEQ ID NO: 972202 - DNA, 22 bp, Artificial Sequence
  chemically synthesized
ctatatatttatatgattttta

SEQ ID NO: 972203 - DNA, 22 bp, Artificial Sequence
  chemically synthesized
tttctatatatttatatgattt

SEQ ID NO: 972204 - DNA, 22 bp, Artificial Sequence
  chemically synthesized
atttctatatatttatatgatt

SEQ ID NO: 972205 - DNA, 22 bp, Artificial Sequence
  chemically synthesized
tttatttctatatatttatatg

SEQ ID NO: 972206 - DNA, 22 bp, Artificial Sequence
  chemically synthesized
atttatttctatatatttatat

SEQ ID NO: 972207 - DNA, 22 bp, Artificial Sequence
  chemically synthesized
tatttatttctatatatttata

SEQ ID NO: 972208 - DNA, 22 bp, Artificial Sequence
  chemically synthesized
tagatctttatttatttctata

SEQ ID NO: 972209 - DNA, 22 bp, Artificial Sequence
  chemically synthesized
aaatggtactatagatctttat

SEQ ID NO: 972210 - DNA, 22 bp, Artificial Sequence
  chemically synthesized
taaaatggtactatagatcttt

SEQ ID NO: 972211 - DNA, 22 bp, Artificial Sequence
  chemically synthesized
tctaaaatggtactatagatct

SEQ ID NO: 972212 - DNA, 22 bp, Artificial Sequence
  chemically synthesized
ctctaaaatggtactatagatc

SEQ ID NO: 972213 - DNA, 22 bp, Artificial Sequence
  chemically synthesized
tttctctaaaatggtactatag

SEQ ID NO: 972214 - DNA, 22 bp, Artificial Sequence
  chemically synthesized
ttgtttctctaaaatggtacta

SEQ ID NO: 972215 - DNA, 22 bp, Artificial Sequence
  chemically synthesized
attgtttctctaaaatggtact

SEQ ID NO: 972216 - DNA, 22 bp, Artificial Sequence
  chemically synthesized
tattgtttctctaaaatggtac

SEQ ID NO: 972217 - DNA, 22 bp, Artificial Sequence
  chemically synthesized
tgctttattgtttctctaaaat

SEQ ID NO: 972218 - DNA, 22 bp, Artificial Sequence
  chemically synthesized
tagtaccattttagagaaacaa

SEQ ID NO: 972219 - DNA, 22 bp, Artificial Sequence
  chemically synthesized
ccagaaattatgctttattgtt

SEQ ID NO: 972220 - DNA, 22 bp, Artificial Sequence
  chemically synthesized
gccagaaattatgctttattgt

SEQ ID NO: 972221 - DNA, 22 bp, Artificial Sequence
  chemically synthesized
tgccagaaattatgctttattg

SEQ ID NO: 972222 - DNA, 22 bp, Artificial Sequence
  chemically synthesized
ttgccagaaattatgctttatt

SEQ ID NO: 972223 - DNA, 22 bp, Artificial Sequence
  chemically synthesized
tttgccagaaattatgctttat

SEQ ID NO: 972224 - DNA, 22 bp, Artificial Sequence
  chemically synthesized
tagagaaacaataaagcataat

SEQ ID NO: 972225 - DNA, 22 bp, Artificial Sequence
  chemically synthesized
agagaaacaataaagcataatt

SEQ ID NO: 972226 - DNA, 22 bp, Artificial Sequence
  chemically synthesized
gagaaacaataaagcataattt

SEQ ID NO: 972227 - DNA, 22 bp, Artificial Sequence
  chemically synthesized
attttttgccagaaattatgct

SEQ ID NO: 972228 - DNA, 22 bp, Artificial Sequence
  chemically synthesized
aattttttgccagaaattatgc

SEQ ID NO: 972229 - DNA, 22 bp, Artificial Sequence
  chemically synthesized
taattttttgccagaaattatg

SEQ ID NO: 972230 - DNA, 22 bp, Artificial Sequence
  chemically synthesized
tacccaactttaattttttgcc

SEQ ID NO: 972231 - DNA, 22 bp, Artificial Sequence
  chemically synthesized
aattatacccaactttaatttt

SEQ ID NO: 972232 - DNA, 22 bp, Artificial Sequence
  chemically synthesized
gaattatacccaactttaattt

SEQ ID NO: 972233 - DNA, 22 bp, Artificial Sequence
  chemically synthesized
ctggcaaaaaattaaagttggg

SEQ ID NO: 972234 - DNA, 22 bp, Artificial Sequence
  chemically synthesized
tggcaaaaaattaaagttgggt

SEQ ID NO: 972235 - DNA, 22 bp, Artificial Sequence
  chemically synthesized
atatttgaattatacccaactt

SEQ ID NO: 972236 - DNA, 22 bp, Artificial Sequence
  chemically synthesized
gcaaaaaattaaagttgggtat

SEQ ID NO: 972237 - DNA, 22 bp, Artificial Sequence
  chemically synthesized
aagttgggtataattcaaatat

SEQ ID NO: 972238 - DNA, 22 bp, Artificial Sequence
  chemically synthesized
tataatggactgatatttgaat

SEQ ID NO: 972239 - DNA, 22 bp, Artificial Sequence
  chemically synthesized
tgtataatggactgatatttga

SEQ ID NO: 972240 - DNA, 22 bp, Artificial Sequence
  chemically synthesized
ctgtataatggactgatatttg

SEQ ID NO: 972241 - DNA, 22 bp, Artificial Sequence
  chemically synthesized
tctgtataatggactgatattt

SEQ ID NO: 972242 - DNA, 22 bp, Artificial Sequence
  chemically synthesized
ttctgtataatggactgatatt

SEQ ID NO: 972243 - DNA, 22 bp, Artificial Sequence
  chemically synthesized
ggtataattcaaatatcagtcc

SEQ ID NO: 972244 - DNA, 22 bp, Artificial Sequence
  chemically synthesized
tttctgtataatggactgatat

SEQ ID NO: 972245 - DNA, 22 bp, Artificial Sequence
  chemically synthesized
ctttttctgtataatggactga

SEQ ID NO: 972246 - DNA, 22 bp, Artificial Sequence
  chemically synthesized
actttttctgtataatggactg

SEQ ID NO: 972247 - DNA, 22 bp, Artificial Sequence
  chemically synthesized
tactttttctgtataatggact

SEQ ID NO: 972248 - DNA, 22 bp, Artificial Sequence
  chemically synthesized
ttactttttctgtataatggac

SEQ ID NO: 972249 - DNA, 22 bp, Artificial Sequence
  chemically synthesized
aaatatcagtccattatacaga

SEQ ID NO: 972250 - DNA, 22 bp, Artificial Sequence
  chemically synthesized
tacagaaaaagtaaaagtttgt

SEQ ID NO: 972251 - DNA, 22 bp, Artificial Sequence
  chemically synthesized
taatcagtaaaatccaaggtag

SEQ ID NO: 972252 - DNA, 22 bp, Artificial Sequence
  chemically synthesized
ataatcagtaaaatccaaggta

SEQ ID NO: 972253 - DNA, 22 bp, Artificial Sequence
  chemically synthesized
tataatcagtaaaatccaaggt

SEQ ID NO: 972254 - DNA, 22 bp, Artificial Sequence
  chemically synthesized
attttataatcagtaaaatcca

SEQ ID NO: 972255 - DNA, 22 bp, Artificial Sequence
  chemically synthesized
cattttataatcagtaaaatcc

SEQ ID NO: 972256 - DNA, 22 bp, Artificial Sequence
  chemically synthesized
tcattttataatcagtaaaatc

SEQ ID NO: 972257 - DNA, 22 bp, Artificial Sequence
  chemically synthesized
gtcctaccttggattttactga

SEQ ID NO: 972258 - DNA, 22 bp, Artificial Sequence
  chemically synthesized
tcctaccttggattttactgat

SEQ ID NO: 972259 - DNA, 22 bp, Artificial Sequence
  chemically synthesized
tgctttcattttataatcagta

SEQ ID NO: 972260 - DNA, 22 bp, Artificial Sequence
  chemically synthesized
gtgctttcattttataatcagt

SEQ ID NO: 972261 - DNA, 22 bp, Artificial Sequence
  chemically synthesized
ccttggattttactgattataa

SEQ ID NO: 972262 - DNA, 22 bp, Artificial Sequence
  chemically synthesized
ggattttactgattataaaatg

SEQ ID NO: 972263 - DNA, 22 bp, Artificial Sequence
  chemically synthesized
gattttactgattataaaatga

SEQ ID NO: 972264 - DNA, 22 bp, Artificial Sequence
  chemically synthesized
atcatttgtgctttcattttat

SEQ ID NO: 972265 - DNA, 22 bp, Artificial Sequence
  chemically synthesized
aatcatttgtgctttcatttta

SEQ ID NO: 972266 - DNA, 22 bp, Artificial Sequence
  chemically synthesized
taatcatttgtgctttcatttt

SEQ ID NO: 972267 - DNA, 22 bp, Artificial Sequence
  chemically synthesized
tactgattataaaatgaaagca

SEQ ID NO: 972268 - DNA, 22 bp, Artificial Sequence
  chemically synthesized
actgattataaaatgaaagcac

SEQ ID NO: 972269 - DNA, 22 bp, Artificial Sequence
  chemically synthesized
ctgattataaaatgaaagcaca

SEQ ID NO: 972270 - DNA, 22 bp, Artificial Sequence
  chemically synthesized
attataaaatgaaagcacaaat

SEQ ID NO: 972271 - DNA, 22 bp, Artificial Sequence
  chemically synthesized
gaaattttaatcatttgtgctt

SEQ ID NO: 972272 - DNA, 22 bp, Artificial Sequence
  chemically synthesized
taaaatgaaagcacaaatgatt

SEQ ID NO: 972273 - DNA, 22 bp, Artificial Sequence
  chemically synthesized
gtgtaaaactagaaattttaat

SEQ ID NO: 972274 - DNA, 22 bp, Artificial Sequence
  chemically synthesized
aaatttctagttttacaccagg

SEQ ID NO: 972275 - DNA, 22 bp, Artificial Sequence
  chemically synthesized
ctagttttacaccaggtactat

SEQ ID NO: 972276 - DNA, 22 bp, Artificial Sequence
  chemically synthesized
tagttttacaccaggtactata

SEQ ID NO: 972277 - DNA, 22 bp, Artificial Sequence
  chemically synthesized
gttttacaccaggtactatact

SEQ ID NO: 972278 - DNA, 22 bp, Artificial Sequence
  chemically synthesized
tacaccaggtactatactgatg

SEQ ID NO: 972279 - DNA, 22 bp, Artificial Sequence
  chemically synthesized
acaccaggtactatactgatgg

SEQ ID NO: 972280 - DNA, 22 bp, Artificial Sequence
  chemically synthesized
caccaggtactatactgatggc

SEQ ID NO: 972281 - DNA, 22 bp, Artificial Sequence
  chemically synthesized
gcaagacagggtgggcatgcca

SEQ ID NO: 972282 - DNA, 22 bp, Artificial Sequence
  chemically synthesized
ttagcaagacagggtgggcatg

SEQ ID NO: 972283 - DNA, 22 bp, Artificial Sequence
  chemically synthesized
tactgatggcatgcccaccctg

SEQ ID NO: 972284 - DNA, 22 bp, Artificial Sequence
  chemically synthesized
gactattagcaagacagggtgg

SEQ ID NO: 972285 - DNA, 22 bp, Artificial Sequence
  chemically synthesized
atggcatgcccaccctgtcttg

SEQ ID NO: 972286 - DNA, 22 bp, Artificial Sequence
  chemically synthesized
tgaaaactggactattagcaag

SEQ ID NO: 972287 - DNA, 22 bp, Artificial Sequence
  chemically synthesized
atgaaaactggactattagcaa

SEQ ID NO: 972288 - DNA, 22 bp, Artificial Sequence
  chemically synthesized
tcttgctaatagtccagttttc

SEQ ID NO: 972289 - DNA, 22 bp, Artificial Sequence
  chemically synthesized
gctaatagtccagttttcataa

SEQ ID NO: 972290 - DNA, 22 bp, Artificial Sequence
  chemically synthesized
aaacaaggtagtttatgaaaac

SEQ ID NO: 972291 - DNA, 22 bp, Artificial Sequence
  chemically synthesized
ctaatagtccagttttcataaa

SEQ ID NO: 972292 - DNA, 22 bp, Artificial Sequence
  chemically synthesized
caaacaaggtagtttatgaaaa

SEQ ID NO: 972293 - DNA, 22 bp, Artificial Sequence
  chemically synthesized
tcaaacaaggtagtttatgaaa

SEQ ID NO: 972294 - DNA, 22 bp, Artificial Sequence
  chemically synthesized
atagtccagttttcataaacta

SEQ ID NO: 972295 - DNA, 22 bp, Artificial Sequence
  chemically synthesized
attttcaaacaaggtagtttat

SEQ ID NO: 972296 - DNA, 22 bp, Artificial Sequence
  chemically synthesized
tcattttcaaacaaggtagttt

SEQ ID NO: 972297 - DNA, 22 bp, Artificial Sequence
  chemically synthesized
tcataaactaccttgtttgaaa

SEQ ID NO: 972298 - DNA, 22 bp, Artificial Sequence
  chemically synthesized
cataaactaccttgtttgaaaa

SEQ ID NO: 972299 - DNA, 22 bp, Artificial Sequence
  chemically synthesized
ataaactaccttgtttgaaaat

SEQ ID NO: 972300 - DNA, 22 bp, Artificial Sequence
  chemically synthesized
acatgaaaattctcattttcaa

SEQ ID NO: 972301 - DNA, 22 bp, Artificial Sequence
  chemically synthesized
cacatgaaaattctcattttca

SEQ ID NO: 972302 - DNA, 22 bp, Artificial Sequence
  chemically synthesized
acttcacatgaaaattctcatt

SEQ ID NO: 972303 - DNA, 22 bp, Artificial Sequence
  chemically synthesized
ccttgtttgaaaatgagaattt

SEQ ID NO: 972304 - DNA, 22 bp, Artificial Sequence
  chemically synthesized
gtttgaaaatgagaattttcat

SEQ ID NO: 972305 - DNA, 22 bp, Artificial Sequence
  chemically synthesized
tttgaaaatgagaattttcatg

SEQ ID NO: 972306 - DNA, 22 bp, Artificial Sequence
  chemically synthesized
gaaaatgagaattttcatgtga

SEQ ID NO: 972307 - DNA, 22 bp, Artificial Sequence
  chemically synthesized
aaaatgagaattttcatgtgaa

SEQ ID NO: 972308 - DNA, 22 bp, Artificial Sequence
  chemically synthesized
caatgtggagccctgacttcac

SEQ ID NO: 972309 - DNA, 22 bp, Artificial Sequence
  chemically synthesized
ccaatgtggagccctgacttca

SEQ ID NO: 972310 - DNA, 22 bp, Artificial Sequence
  chemically synthesized
tccaatgtggagccctgacttc

SEQ ID NO: 972311 - DNA, 22 bp, Artificial Sequence
  chemically synthesized
tcatgtgaagtcagggctccac

SEQ ID NO: 972312 - DNA, 22 bp, Artificial Sequence
  chemically synthesized
catgtgaagtcagggctccaca

SEQ ID NO: 972313 - DNA, 22 bp, Artificial Sequence
  chemically synthesized
atgtgaagtcagggctccacat

SEQ ID NO: 972314 - DNA, 22 bp, Artificial Sequence
  chemically synthesized
gaaacatcagtgttttccaatg

SEQ ID NO: 972315 - DNA, 22 bp, Artificial Sequence
  chemically synthesized
cacattggaaaacactgatgtt

SEQ ID NO: 972316 - DNA, 22 bp, Artificial Sequence
  chemically synthesized
gaatgagttagaaacatcagtg

SEQ ID NO: 972317 - DNA, 22 bp, Artificial Sequence
  chemically synthesized
gaaaacactgatgtttctaact

SEQ ID NO: 972318 - DNA, 22 bp, Artificial Sequence
  chemically synthesized
atgtttctaactcattctagat

SEQ ID NO: 972319 - DNA, 22 bp, Artificial Sequence
  chemically synthesized
ctaactcattctagatatttca

SEQ ID NO: 972320 - DNA, 22 bp, Artificial Sequence
  chemically synthesized
taactcattctagatatttcat

SEQ ID NO: 972321 - DNA, 22 bp, Artificial Sequence
  chemically synthesized
actcattctagatatttcattc

SEQ ID NO: 972322 - DNA, 22 bp, Artificial Sequence
  chemically synthesized
attctagatatttcattctctc

SEQ ID NO: 972323 - DNA, 22 bp, Artificial Sequence
  chemically synthesized
catgggtagaaagagagaatga

SEQ ID NO: 972324 - DNA, 22 bp, Artificial Sequence
  chemically synthesized
tagatatttcattctctctttc

SEQ ID NO: 972325 - DNA, 22 bp, Artificial Sequence
  chemically synthesized
gatatttcattctctctttcta

SEQ ID NO: 972326 - DNA, 22 bp, Artificial Sequence
  chemically synthesized
aaattacatgggtagaaagaga

SEQ ID NO: 972327 - DNA, 22 bp, Artificial Sequence
  chemically synthesized
cattctctctttctacccatgt

SEQ ID NO: 972328 - DNA, 22 bp, Artificial Sequence
  chemically synthesized
attctctctttctacccatgta

SEQ ID NO: 972329 - DNA, 22 bp, Artificial Sequence
  chemically synthesized
tctctttctacccatgtaattt

SEQ ID NO: 972330 - DNA, 22 bp, Artificial Sequence
  chemically synthesized
tctttctacccatgtaatttta

SEQ ID NO: 972331 - DNA, 22 bp, Artificial Sequence
  chemically synthesized
tttctacccatgtaattttagc

SEQ ID NO: 972332 - DNA, 22 bp, Artificial Sequence
  chemically synthesized
ggagcaagcaatgctaaaatta

SEQ ID NO: 972333 - DNA, 22 bp, Artificial Sequence
  chemically synthesized
tctacccatgtaattttagcat

SEQ ID NO: 972334 - DNA, 22 bp, Artificial Sequence
  chemically synthesized
ctacccatgtaattttagcatt

SEQ ID NO: 972335 - DNA, 22 bp, Artificial Sequence
  chemically synthesized
tacccatgtaattttagcattg

SEQ ID NO: 972336 - DNA, 22 bp, Artificial Sequence
  chemically synthesized
tgctaggagcaagcaatgctaa

SEQ ID NO: 972337 - DNA, 22 bp, Artificial Sequence
  chemically synthesized
cccatgtaattttagcattgct

SEQ ID NO: 972338 - DNA, 22 bp, Artificial Sequence
  chemically synthesized
tagcattgcttgctcctagcac

SEQ ID NO: 972339 - DNA, 22 bp, Artificial Sequence
  chemically synthesized
agcattgcttgctcctagcaca

SEQ ID NO: 972340 - DNA, 22 bp, Artificial Sequence
  chemically synthesized
gcattgcttgctcctagcacaa

SEQ ID NO: 972341 - DNA, 22 bp, Artificial Sequence
  chemically synthesized
cttgctcctagcacaatgtttg

SEQ ID NO: 972342 - DNA, 22 bp, Artificial Sequence
  chemically synthesized
gctcctagcacaatgtttggca

SEQ ID NO: 972343 - DNA, 22 bp, Artificial Sequence
  chemically synthesized
ctcctagcacaatgtttggcac

SEQ ID NO: 972344 - DNA, 22 bp, Artificial Sequence
  chemically synthesized
agaaacaagtatgtgccaaaca

SEQ ID NO: 972345 - DNA, 22 bp, Artificial Sequence
  chemically synthesized
ctagcacaatgtttggcacata

SEQ ID NO: 972346 - DNA, 22 bp, Artificial Sequence
  chemically synthesized
tattaagaaacaagtatgtgcc

SEQ ID NO: 972347 - DNA, 22 bp, Artificial Sequence
  chemically synthesized
gcacaatgtttggcacatactt

SEQ ID NO: 972348 - DNA, 22 bp, Artificial Sequence
  chemically synthesized
gtattaagaaacaagtatgtgc

SEQ ID NO: 972349 - DNA, 22 bp, Artificial Sequence
  chemically synthesized
aagaacttgtattaagaaacaa

SEQ ID NO: 972350 - DNA, 22 bp, Artificial Sequence
  chemically synthesized
ggcacatacttgtttcttaata

SEQ ID NO: 972351 - DNA, 22 bp, Artificial Sequence
  chemically synthesized
gcacatacttgtttcttaatac

SEQ ID NO: 972352 - DNA, 22 bp, Artificial Sequence
  chemically synthesized
agttaaagaacttgtattaaga

SEQ ID NO: 972353 - DNA, 22 bp, Artificial Sequence
  chemically synthesized
gagttaaagaacttgtattaag

SEQ ID NO: 972354 - DNA, 22 bp, Artificial Sequence
  chemically synthesized
tttgagttaaagaacttgtatt

SEQ ID NO: 972355 - DNA, 22 bp, Artificial Sequence
  chemically synthesized
gtttcttaatacaagttcttta

SEQ ID NO: 972356 - DNA, 22 bp, Artificial Sequence
  chemically synthesized
tattgtttgagttaaagaactt

SEQ ID NO: 972357 - DNA, 22 bp, Artificial Sequence
  chemically synthesized
tttcttaatacaagttctttaa

SEQ ID NO: 972358 - DNA, 22 bp, Artificial Sequence
  chemically synthesized
cttaatacaagttctttaactc

SEQ ID NO: 972359 - DNA, 22 bp, Artificial Sequence
  chemically synthesized
ttaatacaagttctttaactca

SEQ ID NO: 972360 - DNA, 22 bp, Artificial Sequence
  chemically synthesized
aatacaagttctttaactcaaa

SEQ ID NO: 972361 - DNA, 22 bp, Artificial Sequence
  chemically synthesized
atacaagttctttaactcaaac

SEQ ID NO: 972362 - DNA, 22 bp, Artificial Sequence
  chemically synthesized
agatgattatattgtttgagtt

SEQ ID NO: 972363 - DNA, 22 bp, Artificial Sequence
  chemically synthesized
ctgagatgattatattgtttga

SEQ ID NO: 972364 - DNA, 22 bp, Artificial Sequence
  chemically synthesized
actgagatgattatattgtttg

SEQ ID NO: 972365 - DNA, 22 bp, Artificial Sequence
  chemically synthesized
tttaactcaaacaatataatca

SEQ ID NO: 972366 - DNA, 22 bp, Artificial Sequence
  chemically synthesized
aatttactgagatgattatatt

SEQ ID NO: 972367 - DNA, 22 bp, Artificial Sequence
  chemically synthesized
taactcaaacaatataatcatc

SEQ ID NO: 972368 - DNA, 22 bp, Artificial Sequence
  chemically synthesized
aactcaaacaatataatcatct

SEQ ID NO: 972369 - DNA, 22 bp, Artificial Sequence
  chemically synthesized
actcaaacaatataatcatctc

SEQ ID NO: 972370 - DNA, 22 bp, Artificial Sequence
  chemically synthesized
aaacaatataatcatctcagta

SEQ ID NO: 972371 - DNA, 22 bp, Artificial Sequence
  chemically synthesized
agtaaattcagtgccataccca

SEQ ID NO: 972372 - DNA, 22 bp, Artificial Sequence
  chemically synthesized
agtgccatacccatactttacc

SEQ ID NO: 972373 - DNA, 22 bp, Artificial Sequence
  chemically synthesized
gccccgggagaataagagaagg

SEQ ID NO: 972374 - DNA, 22 bp, Artificial Sequence
  chemically synthesized
agccccgggagaataagagaag

SEQ ID NO: 972375 - DNA, 22 bp, Artificial Sequence
  chemically synthesized
taccttctcttattctcccggg

SEQ ID NO: 972376 - DNA, 22 bp, Artificial Sequence
  chemically synthesized
accttctcttattctcccgggg

SEQ ID NO: 972377 - DNA, 22 bp, Artificial Sequence
  chemically synthesized
ccttctcttattctcccggggc

SEQ ID NO: 972378 - DNA, 22 bp, Artificial Sequence
  chemically synthesized
aagtgatcatatttagccccgg

SEQ ID NO: 972379 - DNA, 22 bp, Artificial Sequence
  chemically synthesized
ctcttattctcccggggctaaa

SEQ ID NO: 972380 - DNA, 22 bp, Artificial Sequence
  chemically synthesized
tcttattctcccggggctaaat

SEQ ID NO: 972381 - DNA, 22 bp, Artificial Sequence
  chemically synthesized
ttattctcccggggctaaatat

SEQ ID NO: 972382 - DNA, 22 bp, Artificial Sequence
  chemically synthesized
attgaagtgatcatatttagcc

SEQ ID NO: 972383 - DNA, 22 bp, Artificial Sequence
  chemically synthesized
attctcccggggctaaatatga

SEQ ID NO: 972384 - DNA, 22 bp, Artificial Sequence
  chemically synthesized
tgattgaagtgatcatatttag

SEQ ID NO: 972385 - DNA, 22 bp, Artificial Sequence
  chemically synthesized
ttctcccggggctaaatatgat

SEQ ID NO: 972386 - DNA, 22 bp, Artificial Sequence
  chemically synthesized
tcccggggctaaatatgatcac

SEQ ID NO: 972387 - DNA, 22 bp, Artificial Sequence
  chemically synthesized
ccggggctaaatatgatcactt

SEQ ID NO: 972388 - DNA, 22 bp, Artificial Sequence
  chemically synthesized
tgagcattctgattgaagtgat

SEQ ID NO: 972389 - DNA, 22 bp, Artificial Sequence
  chemically synthesized
atgagcattctgattgaagtga

SEQ ID NO: 972390 - DNA, 22 bp, Artificial Sequence
  chemically synthesized
tatgagcattctgattgaagtg

SEQ ID NO: 972391 - DNA, 22 bp, Artificial Sequence
  chemically synthesized
ttttatgagcattctgattgaa

SEQ ID NO: 972392 - DNA, 22 bp, Artificial Sequence
  chemically synthesized
aatatgatcacttcaatcagaa

SEQ ID NO: 972393 - DNA, 22 bp, Artificial Sequence
  chemically synthesized
gttttatgagcattctgattga

SEQ ID NO: 972394 - DNA, 22 bp, Artificial Sequence
  chemically synthesized
tgttttatgagcattctgattg

SEQ ID NO: 972395 - DNA, 22 bp, Artificial Sequence
  chemically synthesized
caatcagaatgctcataaaaca

SEQ ID NO: 972396 - DNA, 22 bp, Artificial Sequence
  chemically synthesized
atcaggtgattttgttttatga

SEQ ID NO: 972397 - DNA, 22 bp, Artificial Sequence
  chemically synthesized
aatcagaatgctcataaaacaa

SEQ ID NO: 972398 - DNA, 22 bp, Artificial Sequence
  chemically synthesized
cattaatcaggtgattttgttt

SEQ ID NO: 972399 - DNA, 22 bp, Artificial Sequence
  chemically synthesized
ataaaacaaaatcacctgatta

SEQ ID NO: 972400 - DNA, 22 bp, Artificial Sequence
  chemically synthesized
atgaaaacataagttgcattaa

SEQ ID NO: 972401 - DNA, 22 bp, Artificial Sequence
  chemically synthesized
catgaaaacataagttgcatta

SEQ ID NO: 972402 - DNA, 22 bp, Artificial Sequence
  chemically synthesized
aacttcatgaaaacataagttg

SEQ ID NO: 972403 - DNA, 22 bp, Artificial Sequence
  chemically synthesized
aaacttcatgaaaacataagtt

SEQ ID NO: 972404 - DNA, 22 bp, Artificial Sequence
  chemically synthesized
attaatgcaacttatgttttca

SEQ ID NO: 972405 - DNA, 22 bp, Artificial Sequence
  chemically synthesized
atttaaacttcatgaaaacata

SEQ ID NO: 972406 - DNA, 22 bp, Artificial Sequence
  chemically synthesized
gatttaaacttcatgaaaacat

SEQ ID NO: 972407 - DNA, 22 bp, Artificial Sequence
  chemically synthesized
tgatttaaacttcatgaaaaca

SEQ ID NO: 972408 - DNA, 22 bp, Artificial Sequence
  chemically synthesized
atgcaacttatgttttcatgaa

SEQ ID NO: 972409 - DNA, 22 bp, Artificial Sequence
  chemically synthesized
atgttttcatgaagtttaaatc

SEQ ID NO: 972410 - DNA, 22 bp, Artificial Sequence
  chemically synthesized
tgttttcatgaagtttaaatca

SEQ ID NO: 972411 - DNA, 22 bp, Artificial Sequence
  chemically synthesized
tcatgaagtttaaatcaaaatc

SEQ ID NO: 972412 - DNA, 22 bp, Artificial Sequence
  chemically synthesized
catgaagtttaaatcaaaatca

SEQ ID NO: 972413 - DNA, 22 bp, Artificial Sequence
  chemically synthesized
atgaagtttaaatcaaaatcat

SEQ ID NO: 972414 - DNA, 22 bp, Artificial Sequence
  chemically synthesized
aaatcaaaatcatttggtttgt

SEQ ID NO: 972415 - DNA, 22 bp, Artificial Sequence
  chemically synthesized
aatcaaaatcatttggtttgtt

SEQ ID NO: 972416 - DNA, 22 bp, Artificial Sequence
  chemically synthesized
aaatgaagagatgaaacaaacc

SEQ ID NO: 972417 - DNA, 22 bp, Artificial Sequence
  chemically synthesized
aaaatgaagagatgaaacaaac

SEQ ID NO: 972418 - DNA, 22 bp, Artificial Sequence
  chemically synthesized
taaaatgaagagatgaaacaaa

SEQ ID NO: 972419 - DNA, 22 bp, Artificial Sequence
  chemically synthesized
aaagggttttaaaatgaagaga

SEQ ID NO: 972420 - DNA, 22 bp, Artificial Sequence
  chemically synthesized
ggtttgtttcatctcttcattt

SEQ ID NO: 972421 - DNA, 22 bp, Artificial Sequence
  chemically synthesized
aaaagggttttaaaatgaagag

SEQ ID NO: 972422 - DNA, 22 bp, Artificial Sequence
  chemically synthesized
gtttgtttcatctcttcatttt

SEQ ID NO: 972423 - DNA, 22 bp, Artificial Sequence
  chemically synthesized
taaaagggttttaaaatgaaga

SEQ ID NO: 972424 - DNA, 22 bp, Artificial Sequence
  chemically synthesized
ttttaaaagggttttaaaatga

SEQ ID NO: 972425 - DNA, 22 bp, Artificial Sequence
  chemically synthesized
gtttcatctcttcattttaaaa

SEQ ID NO: 972426 - DNA, 22 bp, Artificial Sequence
  chemically synthesized
tttcatctcttcattttaaaac

SEQ ID NO: 972427 - DNA, 22 bp, Artificial Sequence
  chemically synthesized
catctcttcattttaaaaccct

SEQ ID NO: 972428 - DNA, 22 bp, Artificial Sequence
  chemically synthesized
atctattttaaaagggttttaa

SEQ ID NO: 972429 - DNA, 22 bp, Artificial Sequence
  chemically synthesized
atctcttcattttaaaaccctt

SEQ ID NO: 972430 - DNA, 22 bp, Artificial Sequence
  chemically synthesized
ttcattttaaaacccttttaaa

SEQ ID NO: 972431 - DNA, 22 bp, Artificial Sequence
  chemically synthesized
cattttaaaacccttttaaaat

SEQ ID NO: 972432 - DNA, 22 bp, Artificial Sequence
  chemically synthesized
attttaaaacccttttaaaata

SEQ ID NO: 972433 - DNA, 22 bp, Artificial Sequence
  chemically synthesized
taaaacccttttaaaatagatt

SEQ ID NO: 972434 - DNA, 22 bp, Artificial Sequence
  chemically synthesized
aaaacccttttaaaatagatta

SEQ ID NO: 972435 - DNA, 22 bp, Artificial Sequence
  chemically synthesized
aaacccttttaaaatagattag

SEQ ID NO: 972436 - DNA, 22 bp, Artificial Sequence
  chemically synthesized
ccaaggcaataaagtagactaa

SEQ ID NO: 972437 - DNA, 22 bp, Artificial Sequence
  chemically synthesized
accaaggcaataaagtagacta

SEQ ID NO: 972438 - DNA, 22 bp, Artificial Sequence
  chemically synthesized
ttaaaatagattagtctacttt

SEQ ID NO: 972439 - DNA, 22 bp, Artificial Sequence
  chemically synthesized
taaaatagattagtctacttta

SEQ ID NO: 972440 - DNA, 22 bp, Artificial Sequence
  chemically synthesized
aaaatagattagtctactttat

SEQ ID NO: 972441 - DNA, 22 bp, Artificial Sequence
  chemically synthesized
aaatagattagtctactttatt

SEQ ID NO: 972442 - DNA, 22 bp, Artificial Sequence
  chemically synthesized
tatttaccaaggcaataaagta

SEQ ID NO: 972443 - DNA, 22 bp, Artificial Sequence
  chemically synthesized
tatatttaccaaggcaataaag

SEQ ID NO: 972444 - DNA, 22 bp, Artificial Sequence
  chemically synthesized
gtctactttattgccttggtaa

SEQ ID NO: 972445 - DNA, 22 bp, Artificial Sequence
  chemically synthesized
aacattctatatttaccaaggc

SEQ ID NO: 972446 - DNA, 22 bp, Artificial Sequence
  chemically synthesized
ctttattgccttggtaaatata

SEQ ID NO: 972447 - DNA, 22 bp, Artificial Sequence
  chemically synthesized
atattcaacattctatatttac

SEQ ID NO: 972448 - DNA, 22 bp, Artificial Sequence
  chemically synthesized
tattgccttggtaaatatagaa

SEQ ID NO: 972449 - DNA, 22 bp, Artificial Sequence
  chemically synthesized
attgccttggtaaatatagaat

SEQ ID NO: 972450 - DNA, 22 bp, Artificial Sequence
  chemically synthesized
ttgccttggtaaatatagaatg

SEQ ID NO: 972451 - DNA, 22 bp, Artificial Sequence
  chemically synthesized
aaattaatattcaacattctat

SEQ ID NO: 972452 - DNA, 22 bp, Artificial Sequence
  chemically synthesized
ccttggtaaatatagaatgttg

SEQ ID NO: 972453 - DNA, 22 bp, Artificial Sequence
  chemically synthesized
ggtaaatatagaatgttgaata

SEQ ID NO: 972454 - DNA, 22 bp, Artificial Sequence
  chemically synthesized
gtaaatatagaatgttgaatat

SEQ ID NO: 972455 - DNA, 22 bp, Artificial Sequence
  chemically synthesized
gcaatgattaaaattaatattc

SEQ ID NO: 972456 - DNA, 22 bp, Artificial Sequence
  chemically synthesized
aatattaattttaatcattgct

SEQ ID NO: 972457 - DNA, 22 bp, Artificial Sequence
  chemically synthesized
atgaccccaatcattagcaatg

SEQ ID NO: 972458 - DNA, 22 bp, Artificial Sequence
  chemically synthesized
aatgaccccaatcattagcaat

SEQ ID NO: 972459 - DNA, 22 bp, Artificial Sequence
  chemically synthesized
taatgaccccaatcattagcaa

SEQ ID NO: 972460 - DNA, 22 bp, Artificial Sequence
  chemically synthesized
ttaatgaccccaatcattagca

SEQ ID NO: 972461 - DNA, 22 bp, Artificial Sequence
  chemically synthesized
attttaatcattgctaatgatt

SEQ ID NO: 972462 - DNA, 22 bp, Artificial Sequence
  chemically synthesized
tttaatgaccccaatcattagc

SEQ ID NO: 972463 - DNA, 22 bp, Artificial Sequence
  chemically synthesized
taatcattgctaatgattgggg

SEQ ID NO: 972464 - DNA, 22 bp, Artificial Sequence
  chemically synthesized
aatcattgctaatgattggggt

SEQ ID NO: 972465 - DNA, 22 bp, Artificial Sequence
  chemically synthesized
atcattgctaatgattggggtc

SEQ ID NO: 972466 - DNA, 22 bp, Artificial Sequence
  chemically synthesized
gaactttttaatgaccccaatc

SEQ ID NO: 972467 - DNA, 22 bp, Artificial Sequence
  chemically synthesized
tggaactttttaatgaccccaa

SEQ ID NO: 972468 - DNA, 22 bp, Artificial Sequence
  chemically synthesized
ctaatgattggggtcattaaaa

SEQ ID NO: 972469 - DNA, 22 bp, Artificial Sequence
  chemically synthesized
atgattggggtcattaaaaagt

SEQ ID NO: 972470 - DNA, 22 bp, Artificial Sequence
  chemically synthesized
gggtcattaaaaagttccagaa

SEQ ID NO: 972471 - DNA, 22 bp, Artificial Sequence
  chemically synthesized
taaagatgacgattctggaact

SEQ ID NO: 972472 - DNA, 22 bp, Artificial Sequence
  chemically synthesized
gtaaagatgacgattctggaac

SEQ ID NO: 972473 - DNA, 22 bp, Artificial Sequence
  chemically synthesized
tttgtaaagatgacgattctgg

SEQ ID NO: 972474 - DNA, 22 bp, Artificial Sequence
  chemically synthesized
aaaagttccagaatcgtcatct

SEQ ID NO: 972475 - DNA, 22 bp, Artificial Sequence
  chemically synthesized
agagactatttgtaaagatgac

SEQ ID NO: 972476 - DNA, 22 bp, Artificial Sequence
  chemically synthesized
cagaatcgtcatctttacaaat

SEQ ID NO: 972477 - DNA, 22 bp, Artificial Sequence
  chemically synthesized
tacaaatagtctctgagtatac

SEQ ID NO: 972478 - DNA, 22 bp, Artificial Sequence
  chemically synthesized
acaaatagtctctgagtatact

SEQ ID NO: 972479 - DNA, 22 bp, Artificial Sequence
  chemically synthesized
aacatgcacagcagtatactca

SEQ ID NO: 972480 - DNA, 22 bp, Artificial Sequence
  chemically synthesized
caaatagtctctgagtatactg

SEQ ID NO: 972481 - DNA, 22 bp, Artificial Sequence
  chemically synthesized
agccctcaacatgcacagcagt

SEQ ID NO: 972482 - DNA, 22 bp, Artificial Sequence
  chemically synthesized
tgagtatactgctgtgcatgtt

SEQ ID NO: 972483 - DNA, 22 bp, Artificial Sequence
  chemically synthesized
agtatactgctgtgcatgttga

SEQ ID NO: 972484 - DNA, 22 bp, Artificial Sequence
  chemically synthesized
aaggcctaagccctcaacatgc

SEQ ID NO: 972485 - DNA, 22 bp, Artificial Sequence
  chemically synthesized
aaaggcctaagccctcaacatg

SEQ ID NO: 972486 - DNA, 22 bp, Artificial Sequence
  chemically synthesized
ctgtgcatgttgagggcttagg

SEQ ID NO: 972487 - DNA, 22 bp, Artificial Sequence
  chemically synthesized
acaaatttaaaggcctaagccc

SEQ ID NO: 972488 - DNA, 22 bp, Artificial Sequence
  chemically synthesized
tgcatgttgagggcttaggcct

SEQ ID NO: 972489 - DNA, 22 bp, Artificial Sequence
  chemically synthesized
cctcacaaatttaaaggcctaa

SEQ ID NO: 972490 - DNA, 22 bp, Artificial Sequence
  chemically synthesized
gcctcacaaatttaaaggccta

SEQ ID NO: 972491 - DNA, 22 bp, Artificial Sequence
  chemically synthesized
agggcttaggcctttaaatttg

SEQ ID NO: 972492 - DNA, 22 bp, Artificial Sequence
  chemically synthesized
aggcctttaaatttgtgaggca

SEQ ID NO: 972493 - DNA, 22 bp, Artificial Sequence
  chemically synthesized
ggcctttaaatttgtgaggcaa

SEQ ID NO: 972494 - DNA, 22 bp, Artificial Sequence
  chemically synthesized
taggccatagatttgcctcaca

SEQ ID NO: 972495 - DNA, 22 bp, Artificial Sequence
  chemically synthesized
taaatttgtgaggcaaatctat

SEQ ID NO: 972496 - DNA, 22 bp, Artificial Sequence
  chemically synthesized
aaatttgtgaggcaaatctatg

SEQ ID NO: 972497 - DNA, 22 bp, Artificial Sequence
  chemically synthesized
aatttgtgaggcaaatctatgg

SEQ ID NO: 972498 - DNA, 22 bp, Artificial Sequence
  chemically synthesized
gtgaggcaaatctatggcctac

SEQ ID NO: 972499 - DNA, 22 bp, Artificial Sequence
  chemically synthesized
atagggcacactgtaggccata

SEQ ID NO: 972500 - DNA, 22 bp, Artificial Sequence
  chemically synthesized
tgaggcaaatctatggcctaca

SEQ ID NO: 972501 - DNA, 22 bp, Artificial Sequence
  chemically synthesized
aaagcaatgttcatagggcaca

SEQ ID NO: 972502 - DNA, 22 bp, Artificial Sequence
  chemically synthesized
tggcctacagtgtgccctatga

SEQ ID NO: 972503 - DNA, 22 bp, Artificial Sequence
  chemically synthesized
ctaaaagcaatgttcatagggc

SEQ ID NO: 972504 - DNA, 22 bp, Artificial Sequence
  chemically synthesized
ttcctaaaagcaatgttcatag

SEQ ID NO: 972505 - DNA, 22 bp, Artificial Sequence
  chemically synthesized
attcctaaaagcaatgttcata

SEQ ID NO: 972506 - DNA, 22 bp, Artificial Sequence
  chemically synthesized
cagtgtgccctatgaacattgc

SEQ ID NO: 972507 - DNA, 22 bp, Artificial Sequence
  chemically synthesized
acatcaatttattcctaaaagc

SEQ ID NO: 972508 - DNA, 22 bp, Artificial Sequence
  chemically synthesized
aacatcaatttattcctaaaag

SEQ ID NO: 972509 - DNA, 22 bp, Artificial Sequence
  chemically synthesized
ttaacatcaatttattcctaaa

SEQ ID NO: 972510 - DNA, 22 bp, Artificial Sequence
  chemically synthesized
tgaacattgcttttaggaataa

SEQ ID NO: 972511 - DNA, 22 bp, Artificial Sequence
  chemically synthesized
gtacattcttaacatcaattta

SEQ ID NO: 972512 - DNA, 22 bp, Artificial Sequence
  chemically synthesized
cttttaggaataaattgatgtt

SEQ ID NO: 972513 - DNA, 22 bp, Artificial Sequence
  chemically synthesized
ttaggaataaattgatgttaag

SEQ ID NO: 972514 - DNA, 22 bp, Artificial Sequence
  chemically synthesized
taggaataaattgatgttaaga

SEQ ID NO: 972515 - DNA, 22 bp, Artificial Sequence
  chemically synthesized
aggaataaattgatgttaagaa

SEQ ID NO: 972516 - DNA, 22 bp, Artificial Sequence
  chemically synthesized
taaactagtacattcttaacat

SEQ ID NO: 972517 - DNA, 22 bp, Artificial Sequence
  chemically synthesized
ggaataaattgatgttaagaat

SEQ ID NO: 972518 - DNA, 22 bp, Artificial Sequence
  chemically synthesized
gtgggattgtaaactagtacat

SEQ ID NO: 972519 - DNA, 22 bp, Artificial Sequence
  chemically synthesized
atgttaagaatgtactagttta

SEQ ID NO: 972520 - DNA, 22 bp, Artificial Sequence
  chemically synthesized
ttggtgggattgtaaactagta

SEQ ID NO: 972521 - DNA, 22 bp, Artificial Sequence
  chemically synthesized
cactgttggtgggattgtaaac

SEQ ID NO: 972522 - DNA, 22 bp, Artificial Sequence
  chemically synthesized
agaatgtactagtttacaatcc

SEQ ID NO: 972523 - DNA, 22 bp, Artificial Sequence
  chemically synthesized
acactgttggtgggattgtaaa

SEQ ID NO: 972524 - DNA, 22 bp, Artificial Sequence
  chemically synthesized
tacactgttggtgggattgtaa

SEQ ID NO: 972525 - DNA, 22 bp, Artificial Sequence
  chemically synthesized
ttacactgttggtgggattgta

SEQ ID NO: 972526 - DNA, 22 bp, Artificial Sequence
  chemically synthesized
gtttacaatcccaccaacagtg

SEQ ID NO: 972527 - DNA, 22 bp, Artificial Sequence
  chemically synthesized
acaatcccaccaacagtgtaaa

SEQ ID NO: 972528 - DNA, 22 bp, Artificial Sequence
  chemically synthesized
caatcccaccaacagtgtaaaa

SEQ ID NO: 972529 - DNA, 22 bp, Artificial Sequence
  chemically synthesized
gagaggatggggagaaatagga

SEQ ID NO: 972530 - DNA, 22 bp, Artificial Sequence
  chemically synthesized
ctatttctccccatcctctcca

SEQ ID NO: 972531 - DNA, 22 bp, Artificial Sequence
  chemically synthesized
tttctccccatcctctccagca

SEQ ID NO: 972532 - DNA, 22 bp, Artificial Sequence
  chemically synthesized
ctccccatcctctccagcacct

SEQ ID NO: 972533 - DNA, 22 bp, Artificial Sequence
  chemically synthesized
tccccatcctctccagcacctg

SEQ ID NO: 972534 - DNA, 22 bp, Artificial Sequence
  chemically synthesized
cccatcctctccagcacctgtt

SEQ ID NO: 972535 - DNA, 22 bp, Artificial Sequence
  chemically synthesized
aaaagtcaggaaacaacaggtg

SEQ ID NO: 972536 - DNA, 22 bp, Artificial Sequence
  chemically synthesized
tccagcacctgttgtttcctga

SEQ ID NO: 972537 - DNA, 22 bp, Artificial Sequence
  chemically synthesized
cagcacctgttgtttcctgact

SEQ ID NO: 972538 - DNA, 22 bp, Artificial Sequence
  chemically synthesized
gaatggcaatcattaaaaagtc

SEQ ID NO: 972539 - DNA, 22 bp, Artificial Sequence
  chemically synthesized
ttgtttcctgactttttaatga

SEQ ID NO: 972540 - DNA, 22 bp, Artificial Sequence
  chemically synthesized
tttcctgactttttaatgattg

SEQ ID NO: 972541 - DNA, 22 bp, Artificial Sequence
  chemically synthesized
cctgactttttaatgattgcca

SEQ ID NO: 972542 - DNA, 22 bp, Artificial Sequence
  chemically synthesized
ctgactttttaatgattgccat

SEQ ID NO: 972543 - DNA, 22 bp, Artificial Sequence
  chemically synthesized
acaccagttagaatggcaatca

SEQ ID NO: 972544 - DNA, 22 bp, Artificial Sequence
  chemically synthesized
actttttaatgattgccattct

SEQ ID NO: 972545 - DNA, 22 bp, Artificial Sequence
  chemically synthesized
tttaatgattgccattctaact

SEQ ID NO: 972546 - DNA, 22 bp, Artificial Sequence
  chemically synthesized
ttaatgattgccattctaactg

SEQ ID NO: 972547 - DNA, 22 bp, Artificial Sequence
  chemically synthesized
taatgattgccattctaactgg

SEQ ID NO: 972548 - DNA, 22 bp, Artificial Sequence
  chemically synthesized
aatgattgccattctaactggt

SEQ ID NO: 972549 - DNA, 22 bp, Artificial Sequence
  chemically synthesized
atgattgccattctaactggtg

SEQ ID NO: 972550 - DNA, 22 bp, Artificial Sequence
  chemically synthesized
ccattctaactggtgtgagatg

SEQ ID NO: 972551 - DNA, 22 bp, Artificial Sequence
  chemically synthesized
taactggtgtgagatggtatct

SEQ ID NO: 972552 - DNA, 22 bp, Artificial Sequence
  chemically synthesized
actggtgtgagatggtatctca

SEQ ID NO: 972553 - DNA, 22 bp, Artificial Sequence
  chemically synthesized
gtgtgagatggtatctcattgt

SEQ ID NO: 972554 - DNA, 22 bp, Artificial Sequence
  chemically synthesized
gccatcagagacatgcaaatca

SEQ ID NO: 972555 - DNA, 22 bp, Artificial Sequence
  chemically synthesized
attgtggttttgatttgcatgt

SEQ ID NO: 972556 - DNA, 22 bp, Artificial Sequence
  chemically synthesized
tggttttgatttgcatgtctct

SEQ ID NO: 972557 - DNA, 22 bp, Artificial Sequence
  chemically synthesized
accatcactggccatcagagac

SEQ ID NO: 972558 - DNA, 22 bp, Artificial Sequence
  chemically synthesized
tgatttgcatgtctctgatggc

SEQ ID NO: 972559 - DNA, 22 bp, Artificial Sequence
  chemically synthesized
gatttgcatgtctctgatggcc

SEQ ID NO: 972560 - DNA, 22 bp, Artificial Sequence
  chemically synthesized
atttgcatgtctctgatggcca

SEQ ID NO: 972561 - DNA, 22 bp, Artificial Sequence
  chemically synthesized
gcatgtctctgatggccagtga

SEQ ID NO: 972562 - DNA, 22 bp, Artificial Sequence
  chemically synthesized
catgtctctgatggccagtgat

SEQ ID NO: 972563 - DNA, 22 bp, Artificial Sequence
  chemically synthesized
tgatggccagtgatggtgagca

SEQ ID NO: 972564 - DNA, 22 bp, Artificial Sequence
  chemically synthesized
atggccagtgatggtgagcatt

SEQ ID NO: 972565 - DNA, 22 bp, Artificial Sequence
  chemically synthesized
tgcagccaaaaaacacatgaaa

SEQ ID NO: 972566 - DNA, 22 bp, Artificial Sequence
  chemically synthesized
atgcagccaaaaaacacatgaa

SEQ ID NO: 972567 - DNA, 22 bp, Artificial Sequence
  chemically synthesized
tttcatgtgttttttggctgca

SEQ ID NO: 972568 - DNA, 22 bp, Artificial Sequence
  chemically synthesized
ttcatgtgttttttggctgcat

SEQ ID NO: 972569 - DNA, 22 bp, Artificial Sequence
  chemically synthesized
tcatgtgttttttggctgcata

SEQ ID NO: 972570 - DNA, 22 bp, Artificial Sequence
  chemically synthesized
catgtgttttttggctgcataa

SEQ ID NO: 972571 - DNA, 22 bp, Artificial Sequence
  chemically synthesized
aaaagaagacatttatgcagcc

SEQ ID NO: 972572 - DNA, 22 bp, Artificial Sequence
  chemically synthesized
atgtgttttttggctgcataaa

SEQ ID NO: 972573 - DNA, 22 bp, Artificial Sequence
  chemically synthesized
tcaaaagaagacatttatgcag

SEQ ID NO: 972574 - DNA, 22 bp, Artificial Sequence
  chemically synthesized
ctcaaaagaagacatttatgca

SEQ ID NO: 972575 - DNA, 22 bp, Artificial Sequence
  chemically synthesized
tttggctgcataaatgtcttct

SEQ ID NO: 972576 - DNA, 22 bp, Artificial Sequence
  chemically synthesized
ttggctgcataaatgtcttctt

SEQ ID NO: 972577 - DNA, 22 bp, Artificial Sequence
  chemically synthesized
tggctgcataaatgtcttcttt

SEQ ID NO: 972578 - DNA, 22 bp, Artificial Sequence
  chemically synthesized
ggctgcataaatgtcttctttt

SEQ ID NO: 972579 - DNA, 22 bp, Artificial Sequence
  chemically synthesized
gctgcataaatgtcttcttttg

SEQ ID NO: 972580 - DNA, 22 bp, Artificial Sequence
  chemically synthesized
cataaatgtcttcttttgagaa

SEQ ID NO: 972581 - DNA, 22 bp, Artificial Sequence
  chemically synthesized
cacaatgaacagacacttctca

SEQ ID NO: 972582 - DNA, 22 bp, Artificial Sequence
  chemically synthesized
ccacaatgaacagacacttctc

SEQ ID NO: 972583 - DNA, 22 bp, Artificial Sequence
  chemically synthesized
ccttccacaatgaacagacact

SEQ ID NO: 972584 - DNA, 22 bp, Artificial Sequence
  chemically synthesized
cttttgagaagtgtctgttcat

SEQ ID NO: 972585 - DNA, 22 bp, Artificial Sequence
  chemically synthesized
ttttgagaagtgtctgttcatt

SEQ ID NO: 972586 - DNA, 22 bp, Artificial Sequence
  chemically synthesized
ttgagaagtgtctgttcattgt

SEQ ID NO: 972587 - DNA, 22 bp, Artificial Sequence
  chemically synthesized
tgagaagtgtctgttcattgtg

SEQ ID NO: 972588 - DNA, 22 bp, Artificial Sequence
  chemically synthesized
gagaagtgtctgttcattgtgg

SEQ ID NO: 972589 - DNA, 22 bp, Artificial Sequence
  chemically synthesized
agaagtgtctgttcattgtgga

SEQ ID NO: 972590 - DNA, 22 bp, Artificial Sequence
  chemically synthesized
aggaatcgccacactgccttcc

SEQ ID NO: 972591 - DNA, 22 bp, Artificial Sequence
  chemically synthesized
ttcattgtggaaggcagtgtgg

SEQ ID NO: 972592 - DNA, 22 bp, Artificial Sequence
  chemically synthesized
attgtggaaggcagtgtggcga

SEQ ID NO: 972593 - DNA, 22 bp, Artificial Sequence
  chemically synthesized
ggcccctgaggaatcgccacac

SEQ ID NO: 972594 - DNA, 22 bp, Artificial Sequence
  chemically synthesized
taggcccctgaggaatcgccac

SEQ ID NO: 972595 - DNA, 22 bp, Artificial Sequence
  chemically synthesized
tggaaggcagtgtggcgattcc

SEQ ID NO: 972596 - DNA, 22 bp, Artificial Sequence
  chemically synthesized
gttctaggcccctgaggaatcg

SEQ ID NO: 972597 - DNA, 22 bp, Artificial Sequence
  chemically synthesized
tagttctaggcccctgaggaat

SEQ ID NO: 972598 - DNA, 22 bp, Artificial Sequence
  chemically synthesized
ctagttctaggcccctgaggaa

SEQ ID NO: 972599 - DNA, 22 bp, Artificial Sequence
  chemically synthesized
ctcaggggcctagaactagaaa

SEQ ID NO: 972600 - DNA, 22 bp, Artificial Sequence
  chemically synthesized
ggtcaaatggtatttctagttc

SEQ ID NO: 972601 - DNA, 22 bp, Artificial Sequence
  chemically synthesized
aggggcctagaactagaaatac

SEQ ID NO: 972602 - DNA, 22 bp, Artificial Sequence
  chemically synthesized
gaactagaaataccatttgacc

SEQ ID NO: 972603 - DNA, 22 bp, Artificial Sequence
  chemically synthesized
gaaataccatttgacccagcca

SEQ ID NO: 972604 - DNA, 22 bp, Artificial Sequence
  chemically synthesized
ggtatatacccagtaatgggat

SEQ ID NO: 972605 - DNA, 22 bp, Artificial Sequence
  chemically synthesized
gggtatatacccagtaatggga

SEQ ID NO: 972606 - DNA, 22 bp, Artificial Sequence
  chemically synthesized
tgggtatatacccagtaatggg

SEQ ID NO: 972607 - DNA, 22 bp, Artificial Sequence
  chemically synthesized
gacccagccatcccattactgg

SEQ ID NO: 972608 - DNA, 22 bp, Artificial Sequence
  chemically synthesized
acccagccatcccattactggg

SEQ ID NO: 972609 - DNA, 22 bp, Artificial Sequence
  chemically synthesized
tagtcctttgggtatataccca

SEQ ID NO: 972610 - DNA, 22 bp, Artificial Sequence
  chemically synthesized
atagtcctttgggtatataccc

SEQ ID NO: 972611 - DNA, 22 bp, Artificial Sequence
  chemically synthesized
ctgggtatatacccaaaggact

SEQ ID NO: 972612 - DNA, 22 bp, Artificial Sequence
  chemically synthesized
ggtatatacccaaaggactata

SEQ ID NO: 972613 - DNA, 22 bp, Artificial Sequence
  chemically synthesized
tagcagcatgatttatagtcct

SEQ ID NO: 972614 - DNA, 22 bp, Artificial Sequence
  chemically synthesized
atagcagcatgatttatagtcc

SEQ ID NO: 972615 - DNA, 22 bp, Artificial Sequence
  chemically synthesized
tatagcagcatgatttatagtc

SEQ ID NO: 972616 - DNA, 22 bp, Artificial Sequence
  chemically synthesized
taaatcatgctgctataaagac

SEQ ID NO: 972617 - DNA, 22 bp, Artificial Sequence
  chemically synthesized
ctataaagacacgtgcacacat

SEQ ID NO: 972618 - DNA, 22 bp, Artificial Sequence
  chemically synthesized
taaagacacgtgcacacatatg

SEQ ID NO: 972619 - DNA, 22 bp, Artificial Sequence
  chemically synthesized
tgaatagagccgcaataaacat

SEQ ID NO: 972620 - DNA, 22 bp, Artificial Sequence
  chemically synthesized
ttgtgaatagagccgcaataaa

SEQ ID NO: 972621 - DNA, 22 bp, Artificial Sequence
  chemically synthesized
ctattgtgaatagagccgcaat

SEQ ID NO: 972622 - DNA, 22 bp, Artificial Sequence
  chemically synthesized
gctattgtgaatagagccgcaa

SEQ ID NO: 972623 - DNA, 22 bp, Artificial Sequence
  chemically synthesized
tgctattgtgaatagagccgca

SEQ ID NO: 972624 - DNA, 22 bp, Artificial Sequence
  chemically synthesized
caagtctttgctattgtgaata

SEQ ID NO: 972625 - DNA, 22 bp, Artificial Sequence
  chemically synthesized
attgcggctctattcacaatag

SEQ ID NO: 972626 - DNA, 22 bp, Artificial Sequence
  chemically synthesized
ttgcggctctattcacaatagc

SEQ ID NO: 972627 - DNA, 22 bp, Artificial Sequence
  chemically synthesized
gttccaagtctttgctattgtg

SEQ ID NO: 972628 - DNA, 22 bp, Artificial Sequence
  chemically synthesized
cggctctattcacaatagcaaa

SEQ ID NO: 972629 - DNA, 22 bp, Artificial Sequence
  chemically synthesized
ggttggttccaagtctttgcta

SEQ ID NO: 972630 - DNA, 22 bp, Artificial Sequence
  chemically synthesized
gggttggttccaagtctttgct

SEQ ID NO: 972631 - DNA, 22 bp, Artificial Sequence
  chemically synthesized
tattcacaatagcaaagacttg

SEQ ID NO: 972632 - DNA, 22 bp, Artificial Sequence
  chemically synthesized
ttcacaatagcaaagacttgga

SEQ ID NO: 972633 - DNA, 22 bp, Artificial Sequence
  chemically synthesized
acaatagcaaagacttggaacc

SEQ ID NO: 972634 - DNA, 22 bp, Artificial Sequence
  chemically synthesized
gacatttgggttggttccaagt

SEQ ID NO: 972635 - DNA, 22 bp, Artificial Sequence
  chemically synthesized
ttggacatttgggttggttcca

SEQ ID NO: 972636 - DNA, 22 bp, Artificial Sequence
  chemically synthesized
tcattgttggacatttgggttg

SEQ ID NO: 972637 - DNA, 22 bp, Artificial Sequence
  chemically synthesized
ggaaccaacccaaatgtccaac

SEQ ID NO: 972638 - DNA, 22 bp, Artificial Sequence
  chemically synthesized
gaaccaacccaaatgtccaaca

SEQ ID NO: 972639 - DNA, 22 bp, Artificial Sequence
  chemically synthesized
atccagtctatcattgttggac

SEQ ID NO: 972640 - DNA, 22 bp, Artificial Sequence
  chemically synthesized
aatccagtctatcattgttgga

SEQ ID NO: 972641 - DNA, 22 bp, Artificial Sequence
  chemically synthesized
ttaatccagtctatcattgttg

SEQ ID NO: 972642 - DNA, 22 bp, Artificial Sequence
  chemically synthesized
cttaatccagtctatcattgtt

SEQ ID NO: 972643 - DNA, 22 bp, Artificial Sequence
  chemically synthesized
tcttaatccagtctatcattgt

SEQ ID NO: 972644 - DNA, 22 bp, Artificial Sequence
  chemically synthesized
catggtgtatatgtgccacatt

SEQ ID NO: 972645 - DNA, 22 bp, Artificial Sequence
  chemically synthesized
gattaagaaaatgtggcacata

SEQ ID NO: 972646 - DNA, 22 bp, Artificial Sequence
  chemically synthesized
agaaaatgtggcacatatacac

SEQ ID NO: 972647 - DNA, 22 bp, Artificial Sequence
  chemically synthesized
catagtattccatggtgtatat

SEQ ID NO: 972648 - DNA, 22 bp, Artificial Sequence
  chemically synthesized
gctgcatagtattccatggtgt

SEQ ID NO: 972649 - DNA, 22 bp, Artificial Sequence
  chemically synthesized
tggctgcatagtattccatggt

SEQ ID NO: 972650 - DNA, 22 bp, Artificial Sequence
  chemically synthesized
ctggctgcatagtattccatgg

SEQ ID NO: 972651 - DNA, 22 bp, Artificial Sequence
  chemically synthesized
tctggctgcatagtattccatg

SEQ ID NO: 972652 - DNA, 22 bp, Artificial Sequence
  chemically synthesized
ttctggctgcatagtattccat

SEQ ID NO: 972653 - DNA, 22 bp, Artificial Sequence
  chemically synthesized
tttctggctgcatagtattcca

SEQ ID NO: 972654 - DNA, 22 bp, Artificial Sequence
  chemically synthesized
atcattttttctggctgcatag

SEQ ID NO: 972655 - DNA, 22 bp, Artificial Sequence
  chemically synthesized
tgcagccagaaaaaatgatgag

SEQ ID NO: 972656 - DNA, 22 bp, Artificial Sequence
  chemically synthesized
caaaggacatgaactcatcatt

SEQ ID NO: 972657 - DNA, 22 bp, Artificial Sequence
  chemically synthesized
atccatgtccctacaaaggaca

SEQ ID NO: 972658 - DNA, 22 bp, Artificial Sequence
  chemically synthesized
catccatgtccctacaaaggac

SEQ ID NO: 972659 - DNA, 22 bp, Artificial Sequence
  chemically synthesized
cagtttcatccatgtccctaca

SEQ ID NO: 972660 - DNA, 22 bp, Artificial Sequence
  chemically synthesized
atgtcctttgtagggacatgga

SEQ ID NO: 972661 - DNA, 22 bp, Artificial Sequence
  chemically synthesized
tgtagggacatggatgaaactg

SEQ ID NO: 972662 - DNA, 22 bp, Artificial Sequence
  chemically synthesized
gtagggacatggatgaaactgg

SEQ ID NO: 972663 - DNA, 22 bp, Artificial Sequence
  chemically synthesized
tagggacatggatgaaactgga

SEQ ID NO: 972664 - DNA, 22 bp, Artificial Sequence
  chemically synthesized
agaatgatgtattccagtttca

SEQ ID NO: 972665 - DNA, 22 bp, Artificial Sequence
  chemically synthesized
ctgagaatgatgtattccagtt

SEQ ID NO: 972666 - DNA, 22 bp, Artificial Sequence
  chemically synthesized
actgagaatgatgtattccagt

SEQ ID NO: 972667 - DNA, 22 bp, Artificial Sequence
  chemically synthesized
cgatagtttactgagaatgatg

SEQ ID NO: 972668 - DNA, 22 bp, Artificial Sequence
  chemically synthesized
gcgatagtttactgagaatgat

SEQ ID NO: 972669 - DNA, 22 bp, Artificial Sequence
  chemically synthesized
tccttgcgatagtttactgaga

SEQ ID NO: 972670 - DNA, 22 bp, Artificial Sequence
  chemically synthesized
gaatacatcattctcagtaaac

SEQ ID NO: 972671 - DNA, 22 bp, Artificial Sequence
  chemically synthesized
gtccttgcgatagtttactgag

SEQ ID NO: 972672 - DNA, 22 bp, Artificial Sequence
  chemically synthesized
tgtccttgcgatagtttactga

SEQ ID NO: 972673 - DNA, 22 bp, Artificial Sequence
  chemically synthesized
ttgtccttgcgatagtttactg

SEQ ID NO: 972674 - DNA, 22 bp, Artificial Sequence
  chemically synthesized
tttgtccttgcgatagtttact

SEQ ID NO: 972675 - DNA, 22 bp, Artificial Sequence
  chemically synthesized
gttttttgtccttgcgatagtt

SEQ ID NO: 972676 - DNA, 22 bp, Artificial Sequence
  chemically synthesized
ggttttttgtccttgcgatagt

SEQ ID NO: 972677 - DNA, 22 bp, Artificial Sequence
  chemically synthesized
tttggttttttgtccttgcgat

SEQ ID NO: 972678 - DNA, 22 bp, Artificial Sequence
  chemically synthesized
tcagtaaactatcgcaaggaca

SEQ ID NO: 972679 - DNA, 22 bp, Artificial Sequence
  chemically synthesized
agtaaactatcgcaaggacaaa

SEQ ID NO: 972680 - DNA, 22 bp, Artificial Sequence
  chemically synthesized
tcgcaaggacaaaaaaccaaac

SEQ ID NO: 972681 - DNA, 22 bp, Artificial Sequence
  chemically synthesized
agagtgagaacatgcgctgttt

SEQ ID NO: 972682 - DNA, 22 bp, Artificial Sequence
  chemically synthesized
ccacctaagagtgagaacatgc

SEQ ID NO: 972683 - DNA, 22 bp, Artificial Sequence
  chemically synthesized
cattcccacctaagagtgagaa

SEQ ID NO: 972684 - DNA, 22 bp, Artificial Sequence
  chemically synthesized
ttccattcccacctaagagtga

SEQ ID NO: 972685 - DNA, 22 bp, Artificial Sequence
  chemically synthesized
attgttccattcccacctaaga

SEQ ID NO: 972686 - DNA, 22 bp, Artificial Sequence
  chemically synthesized
tcattgttccattcccacctaa

SEQ ID NO: 972687 - DNA, 22 bp, Artificial Sequence
  chemically synthesized
tcactcttaggtgggaatggaa

SEQ ID NO: 972688 - DNA, 22 bp, Artificial Sequence
  chemically synthesized
actcttaggtgggaatggaaca

SEQ ID NO: 972689 - DNA, 22 bp, Artificial Sequence
  chemically synthesized
ttaggtgggaatggaacaatga

SEQ ID NO: 972690 - DNA, 22 bp, Artificial Sequence
  chemically synthesized
tgtccatgtgttctcattgttc

SEQ ID NO: 972691 - DNA, 22 bp, Artificial Sequence
  chemically synthesized
aggtgggaatggaacaatgaga

SEQ ID NO: 972692 - DNA, 22 bp, Artificial Sequence
  chemically synthesized
ggtgggaatggaacaatgagaa

SEQ ID NO: 972693 - DNA, 22 bp, Artificial Sequence
  chemically synthesized
ctgtgtccatgtgttctcattg

SEQ ID NO: 972694 - DNA, 22 bp, Artificial Sequence
  chemically synthesized
cctgtgtccatgtgttctcatt

SEQ ID NO: 972695 - DNA, 22 bp, Artificial Sequence
  chemically synthesized
cccttcctgtgtccatgtgttc

SEQ ID NO: 972696 - DNA, 22 bp, Artificial Sequence
  chemically synthesized
ccagggtgtgatgttccccttc

SEQ ID NO: 972697 - DNA, 22 bp, Artificial Sequence
  chemically synthesized
cccccaccccacaacagttccc

SEQ ID NO: 972698 - DNA, 22 bp, Artificial Sequence
  chemically synthesized
ccccctccccccaccccacaac

SEQ ID NO: 972699 - DNA, 22 bp, Artificial Sequence
  chemically synthesized
ggaactgttgtggggtgggggg

SEQ ID NO: 972700 - DNA, 22 bp, Artificial Sequence
  chemically synthesized
tccctcccccctccccccaccc

SEQ ID NO: 972701 - DNA, 22 bp, Artificial Sequence
  chemically synthesized
atgctgtccctcccccctcccc

SEQ ID NO: 972702 - DNA, 22 bp, Artificial Sequence
  chemically synthesized
ttgtggggtggggggagggggg

SEQ ID NO: 972703 - DNA, 22 bp, Artificial Sequence
  chemically synthesized
ctaatgctgtccctcccccctc

SEQ ID NO: 972704 - DNA, 22 bp, Artificial Sequence
  chemically synthesized
tggggtggggggaggggggagg

SEQ ID NO: 972705 - DNA, 22 bp, Artificial Sequence
  chemically synthesized
ggtatatctcctaatgctgtcc

SEQ ID NO: 972706 - DNA, 22 bp, Artificial Sequence
  chemically synthesized
acattaggtatatctcctaatg

SEQ ID NO: 972707 - DNA, 22 bp, Artificial Sequence
  chemically synthesized
aacattaggtatatctcctaat

SEQ ID NO: 972708 - DNA, 22 bp, Artificial Sequence
  chemically synthesized
atttaacattaggtatatctcc

SEQ ID NO: 972709 - DNA, 22 bp, Artificial Sequence
  chemically synthesized
catttaacattaggtatatctc

SEQ ID NO: 972710 - DNA, 22 bp, Artificial Sequence
  chemically synthesized
ttcatttaacattaggtatatc

SEQ ID NO: 972711 - DNA, 22 bp, Artificial Sequence
  chemically synthesized
actcttcatttaacattaggta

SEQ ID NO: 972712 - DNA, 22 bp, Artificial Sequence
  chemically synthesized
ggagatatacctaatgttaaat

SEQ ID NO: 972713 - DNA, 22 bp, Artificial Sequence
  chemically synthesized
cacccattaactcttcatttaa

SEQ ID NO: 972714 - DNA, 22 bp, Artificial Sequence
  chemically synthesized
gagtgctgcacccattaactct

SEQ ID NO: 972715 - DNA, 22 bp, Artificial Sequence
  chemically synthesized
atgttaaatgaagagttaatgg

SEQ ID NO: 972716 - DNA, 22 bp, Artificial Sequence
  chemically synthesized
aatgaagagttaatgggtgcag

SEQ ID NO: 972717 - DNA, 22 bp, Artificial Sequence
  chemically synthesized
tgccatgttggagtgctgcacc

SEQ ID NO: 972718 - DNA, 22 bp, Artificial Sequence
  chemically synthesized
atgggtgcagcactccaacatg

SEQ ID NO: 972719 - DNA, 22 bp, Artificial Sequence
  chemically synthesized
catatgtatacctgtgccatgt

SEQ ID NO: 972720 - DNA, 22 bp, Artificial Sequence
  chemically synthesized
gttacatatgtatacctgtgcc

SEQ ID NO: 972721 - DNA, 22 bp, Artificial Sequence
  chemically synthesized
caacatggcacaggtatacata

SEQ ID NO: 972722 - DNA, 22 bp, Artificial Sequence
  chemically synthesized
gggtacatgtgcacagtgtgca

SEQ ID NO: 972723 - DNA, 22 bp, Artificial Sequence
  chemically synthesized
agggtacatgtgcacagtgtgc

SEQ ID NO: 972724 - DNA, 22 bp, Artificial Sequence
  chemically synthesized
tagggtacatgtgcacagtgtg

SEQ ID NO: 972725 - DNA, 22 bp, Artificial Sequence
  chemically synthesized
agttttagggtacatgtgcaca

SEQ ID NO: 972726 - DNA, 22 bp, Artificial Sequence
  chemically synthesized
aagttttagggtacatgtgcac

SEQ ID NO: 972727 - DNA, 22 bp, Artificial Sequence
  chemically synthesized
acttgcacactgtgcacatgta

SEQ ID NO: 972728 - DNA, 22 bp, Artificial Sequence
  chemically synthesized
taagttttagggtacatgtgca

SEQ ID NO: 972729 - DNA, 22 bp, Artificial Sequence
  chemically synthesized
gcacactgtgcacatgtaccct

SEQ ID NO: 972730 - DNA, 22 bp, Artificial Sequence
  chemically synthesized
cacactgtgcacatgtacccta

SEQ ID NO: 972731 - DNA, 22 bp, Artificial Sequence
  chemically synthesized
tactttaagttttagggtacat

SEQ ID NO: 972732 - DNA, 22 bp, Artificial Sequence
  chemically synthesized
attatactttaagttttagggt

SEQ ID NO: 972733 - DNA, 22 bp, Artificial Sequence
  chemically synthesized
aattatactttaagttttaggg

SEQ ID NO: 972734 - DNA, 22 bp, Artificial Sequence
  chemically synthesized
taattatactttaagttttagg

SEQ ID NO: 972735 - DNA, 22 bp, Artificial Sequence
  chemically synthesized
tgcacatgtaccctaaaactta

SEQ ID NO: 972736 - DNA, 22 bp, Artificial Sequence
  chemically synthesized
ttaattatactttaagttttag

SEQ ID NO: 972737 - DNA, 22 bp, Artificial Sequence
  chemically synthesized
tttaattatactttaagtttta

SEQ ID NO: 972738 - DNA, 22 bp, Artificial Sequence
  chemically synthesized
ttttaattatactttaagtttt

SEQ ID NO: 972739 - DNA, 22 bp, Artificial Sequence
  chemically synthesized
tttttaattatactttaagttt

SEQ ID NO: 972740 - DNA, 22 bp, Artificial Sequence
  chemically synthesized
ttttttaattatactttaagtt

SEQ ID NO: 972741 - DNA, 22 bp, Artificial Sequence
  chemically synthesized
tttttttaattatactttaagt

SEQ ID NO: 972742 - DNA, 22 bp, Artificial Sequence
  chemically synthesized
ttttttttaattatactttaag

SEQ ID NO: 972743 - DNA, 22 bp, Artificial Sequence
  chemically synthesized
tttttttttaattatactttaa

SEQ ID NO: 972744 - DNA, 22 bp, Artificial Sequence
  chemically synthesized
aaacttaaagtataattaaaaa

SEQ ID NO: 972745 - DNA, 22 bp, Artificial Sequence
  chemically synthesized
aaagtataattaaaaaaaaaaa

SEQ ID NO: 972746 - DNA, 22 bp, Artificial Sequence
  chemically synthesized
aagtataattaaaaaaaaaaag

SEQ ID NO: 972747 - DNA, 22 bp, Artificial Sequence
  chemically synthesized
aaaaaaaaaaggatgtatccta

SEQ ID NO: 972748 - DNA, 22 bp, Artificial Sequence
  chemically synthesized
ggaaaaagacacatcatggtag

SEQ ID NO: 972749 - DNA, 22 bp, Artificial Sequence
  chemically synthesized
tgccagtcctaggaaaaagaca

SEQ ID NO: 972750 - DNA, 22 bp, Artificial Sequence
  chemically synthesized
atgccagtcctaggaaaaagac

SEQ ID NO: 972751 - DNA, 22 bp, Artificial Sequence
  chemically synthesized
tatgccagtcctaggaaaaaga

SEQ ID NO: 972752 - DNA, 22 bp, Artificial Sequence
  chemically synthesized
ccatgatgtgtctttttcctag

SEQ ID NO: 972753 - DNA, 22 bp, Artificial Sequence
  chemically synthesized
ttttatgccagtcctaggaaaa

SEQ ID NO: 972754 - DNA, 22 bp, Artificial Sequence
  chemically synthesized
attttatgccagtcctaggaaa

SEQ ID NO: 972755 - DNA, 22 bp, Artificial Sequence
  chemically synthesized
gtttattttatgccagtcctag

SEQ ID NO: 972756 - DNA, 22 bp, Artificial Sequence
  chemically synthesized
tttcctaggactggcataaaat

SEQ ID NO: 972757 - DNA, 22 bp, Artificial Sequence
  chemically synthesized
ttcctaggactggcataaaata

SEQ ID NO: 972758 - DNA, 22 bp, Artificial Sequence
  chemically synthesized
tcctaggactggcataaaataa

SEQ ID NO: 972759 - DNA, 22 bp, Artificial Sequence
  chemically synthesized
cctaggactggcataaaataaa

SEQ ID NO: 972760 - DNA, 22 bp, Artificial Sequence
  chemically synthesized
ctaggactggcataaaataaac

SEQ ID NO: 972761 - DNA, 22 bp, Artificial Sequence
  chemically synthesized
tgagccagattagtttatttta

SEQ ID NO: 972762 - DNA, 22 bp, Artificial Sequence
  chemically synthesized
ggactggcataaaataaactaa

SEQ ID NO: 972763 - DNA, 22 bp, Artificial Sequence
  chemically synthesized
tctgtgagccagattagtttat

SEQ ID NO: 972764 - DNA, 22 bp, Artificial Sequence
  chemically synthesized
gcataaaataaactaatctggc

SEQ ID NO: 972765 - DNA, 22 bp, Artificial Sequence
  chemically synthesized
aaattgtctgtgagccagatta

SEQ ID NO: 972766 - DNA, 22 bp, Artificial Sequence
  chemically synthesized
atctggctcacagacaatttca

SEQ ID NO: 972767 - DNA, 22 bp, Artificial Sequence
  chemically synthesized
gctcacagacaatttcagttta

SEQ ID NO: 972768 - DNA, 22 bp, Artificial Sequence
  chemically synthesized
acagacaatttcagtttatcct

SEQ ID NO: 972769 - DNA, 22 bp, Artificial Sequence
  chemically synthesized
cagtttatcctcatttttatca

SEQ ID NO: 972770 - DNA, 22 bp, Artificial Sequence
  chemically synthesized
agtttatcctcatttttatcac

SEQ ID NO: 972771 - DNA, 22 bp, Artificial Sequence
  chemically synthesized
tgcccgaggtcacatggtgata

SEQ ID NO: 972772 - DNA, 22 bp, Artificial Sequence
  chemically synthesized
atcctcatttttatcaccatgt

SEQ ID NO: 972773 - DNA, 22 bp, Artificial Sequence
  chemically synthesized
tcctcatttttatcaccatgtg

SEQ ID NO: 972774 - DNA, 22 bp, Artificial Sequence
  chemically synthesized
gttatgcccgaggtcacatggt

SEQ ID NO: 972775 - DNA, 22 bp, Artificial Sequence
  chemically synthesized
agttatgcccgaggtcacatgg

SEQ ID NO: 972776 - DNA, 22 bp, Artificial Sequence
  chemically synthesized
atttttatcaccatgtgacctc

SEQ ID NO: 972777 - DNA, 22 bp, Artificial Sequence
  chemically synthesized
ttatcaccatgtgacctcgggc

SEQ ID NO: 972778 - DNA, 22 bp, Artificial Sequence
  chemically synthesized
tatcaccatgtgacctcgggca

SEQ ID NO: 972779 - DNA, 22 bp, Artificial Sequence
  chemically synthesized
atcaccatgtgacctcgggcat

SEQ ID NO: 972780 - DNA, 22 bp, Artificial Sequence
  chemically synthesized
tcaccatgtgacctcgggcata

SEQ ID NO: 972781 - DNA, 22 bp, Artificial Sequence
  chemically synthesized
gatcatgtttagttatgcccga

SEQ ID NO: 972782 - DNA, 22 bp, Artificial Sequence
  chemically synthesized
gggcataactaaacatgatcta

SEQ ID NO: 972783 - DNA, 22 bp, Artificial Sequence
  chemically synthesized
aatccagaagtaacataaaatt

SEQ ID NO: 972784 - DNA, 22 bp, Artificial Sequence
  chemically synthesized
aacatgatctaattttatgtta

SEQ ID NO: 972785 - DNA, 22 bp, Artificial Sequence
  chemically synthesized
attttatgttacttctggattc

SEQ ID NO: 972786 - DNA, 22 bp, Artificial Sequence
  chemically synthesized
tatgttacttctggattcaatg

SEQ ID NO: 972787 - DNA, 22 bp, Artificial Sequence
  chemically synthesized
atgttacttctggattcaatgc

SEQ ID NO: 972788 - DNA, 22 bp, Artificial Sequence
  chemically synthesized
tgttacttctggattcaatgca

SEQ ID NO: 972789 - DNA, 22 bp, Artificial Sequence
  chemically synthesized
agagagaggcaaatgcattgaa

SEQ ID NO: 972790 - DNA, 22 bp, Artificial Sequence
  chemically synthesized
cttctggattcaatgcatttgc

SEQ ID NO: 972791 - DNA, 22 bp, Artificial Sequence
  chemically synthesized
ctggattcaatgcatttgcctc

SEQ ID NO: 972792 - DNA, 22 bp, Artificial Sequence
  chemically synthesized
tggattcaatgcatttgcctct

SEQ ID NO: 972793 - DNA, 22 bp, Artificial Sequence
  chemically synthesized
gattcaatgcatttgcctctct

SEQ ID NO: 972794 - DNA, 22 bp, Artificial Sequence
  chemically synthesized
caaatagatctcagagagaggc

SEQ ID NO: 972795 - DNA, 22 bp, Artificial Sequence
  chemically synthesized
aatgcatttgcctctctctgag

SEQ ID NO: 972796 - DNA, 22 bp, Artificial Sequence
  chemically synthesized
attacaaatagatctcagagag

SEQ ID NO: 972797 - DNA, 22 bp, Artificial Sequence
  chemically synthesized
gattacaaatagatctcagaga

SEQ ID NO: 972798 - DNA, 22 bp, Artificial Sequence
  chemically synthesized
gcctctctctgagatctatttg

SEQ ID NO: 972799 - DNA, 22 bp, Artificial Sequence
  chemically synthesized
cctctctctgagatctatttgt

SEQ ID NO: 972800 - DNA, 22 bp, Artificial Sequence
  chemically synthesized
acaaatttgattacaaatagat

SEQ ID NO: 972801 - DNA, 22 bp, Artificial Sequence
  chemically synthesized
tctctgagatctatttgtaatc

SEQ ID NO: 972802 - DNA, 22 bp, Artificial Sequence
  chemically synthesized
tctgagatctatttgtaatcaa

SEQ ID NO: 972803 - DNA, 22 bp, Artificial Sequence
  chemically synthesized
tgagatctatttgtaatcaaat

SEQ ID NO: 972804 - DNA, 22 bp, Artificial Sequence
  chemically synthesized
agatctatttgtaatcaaattt

SEQ ID NO: 972805 - DNA, 22 bp, Artificial Sequence
  chemically synthesized
aggatggaattaacaaatttga

SEQ ID NO: 972806 - DNA, 22 bp, Artificial Sequence
  chemically synthesized
caggatggaattaacaaatttg

SEQ ID NO: 972807 - DNA, 22 bp, Artificial Sequence
  chemically synthesized
tcaggatggaattaacaaattt

SEQ ID NO: 972808 - DNA, 22 bp, Artificial Sequence
  chemically synthesized
tttgtaatcaaatttgttaatt

SEQ ID NO: 972809 - DNA, 22 bp, Artificial Sequence
  chemically synthesized
cctttcaggatggaattaacaa

SEQ ID NO: 972810 - DNA, 22 bp, Artificial Sequence
  chemically synthesized
gtaatcaaatttgttaattcca

SEQ ID NO: 972811 - DNA, 22 bp, Artificial Sequence
  chemically synthesized
tccctttcaggatggaattaac

SEQ ID NO: 972812 - DNA, 22 bp, Artificial Sequence
  chemically synthesized
taatcaaatttgttaattccat

SEQ ID NO: 972813 - DNA, 22 bp, Artificial Sequence
  chemically synthesized
ctccctttcaggatggaattaa

SEQ ID NO: 972814 - DNA, 22 bp, Artificial Sequence
  chemically synthesized
cttctccctttcaggatggaat

SEQ ID NO: 972815 - DNA, 22 bp, Artificial Sequence
  chemically synthesized
acttctccctttcaggatggaa

SEQ ID NO: 972816 - DNA, 22 bp, Artificial Sequence
  chemically synthesized
tacttctccctttcaggatgga

SEQ ID NO: 972817 - DNA, 22 bp, Artificial Sequence
  chemically synthesized
ttacttctccctttcaggatgg

SEQ ID NO: 972818 - DNA, 22 bp, Artificial Sequence
  chemically synthesized
tttacttctccctttcaggatg

SEQ ID NO: 972819 - DNA, 22 bp, Artificial Sequence
  chemically synthesized
ctttttacttctccctttcagg

SEQ ID NO: 972820 - DNA, 22 bp, Artificial Sequence
  chemically synthesized
gttaattccatcctgaaaggga

SEQ ID NO: 972821 - DNA, 22 bp, Artificial Sequence
  chemically synthesized
cctttttacttctccctttcag

SEQ ID NO: 972822 - DNA, 22 bp, Artificial Sequence
  chemically synthesized
ttaattccatcctgaaagggag

SEQ ID NO: 972823 - DNA, 22 bp, Artificial Sequence
  chemically synthesized
tcctttttacttctccctttca

SEQ ID NO: 972824 - DNA, 22 bp, Artificial Sequence
  chemically synthesized
ttcctttttacttctccctttc

SEQ ID NO: 972825 - DNA, 22 bp, Artificial Sequence
  chemically synthesized
tttcctttttacttctcccttt

SEQ ID NO: 972826 - DNA, 22 bp, Artificial Sequence
  chemically synthesized
attccatcctgaaagggagaag

SEQ ID NO: 972827 - DNA, 22 bp, Artificial Sequence
  chemically synthesized
ttttcctttttacttctccctt

SEQ ID NO: 972828 - DNA, 22 bp, Artificial Sequence
  chemically synthesized
tttttcctttttacttctccct

SEQ ID NO: 972829 - DNA, 22 bp, Artificial Sequence
  chemically synthesized
catcctgaaagggagaagtaaa

SEQ ID NO: 972830 - DNA, 22 bp, Artificial Sequence
  chemically synthesized
actttttttcctttttacttct

SEQ ID NO: 972831 - DNA, 22 bp, Artificial Sequence
  chemically synthesized
aaagggagaagtaaaaaggaaa

SEQ ID NO: 972832 - DNA, 22 bp, Artificial Sequence
  chemically synthesized
gaaagatgttaactttttttcc

SEQ ID NO: 972833 - DNA, 22 bp, Artificial Sequence
  chemically synthesized
aaatgttagaaagatgttaact

SEQ ID NO: 972834 - DNA, 22 bp, Artificial Sequence
  chemically synthesized
aaagttgaaatgttagaaagat

SEQ ID NO: 972835 - DNA, 22 bp, Artificial Sequence
  chemically synthesized
acatctttctaacatttcaact

SEQ ID NO: 972836 - DNA, 22 bp, Artificial Sequence
  chemically synthesized
gggatggggtagttcaaagttg

SEQ ID NO: 972837 - DNA, 22 bp, Artificial Sequence
  chemically synthesized
tctaacatttcaactttgaact

SEQ ID NO: 972838 - DNA, 22 bp, Artificial Sequence
  chemically synthesized
tggggatggggtagttcaaagt

SEQ ID NO: 972839 - DNA, 22 bp, Artificial Sequence
  chemically synthesized
ctaacatttcaactttgaacta

SEQ ID NO: 972840 - DNA, 22 bp, Artificial Sequence
  chemically synthesized
ctggggatggggtagttcaaag

SEQ ID NO: 972841 - DNA, 22 bp, Artificial Sequence
  chemically synthesized
taacatttcaactttgaactac

SEQ ID NO: 972842 - DNA, 22 bp, Artificial Sequence
  chemically synthesized
ttctggggatggggtagttcaa

SEQ ID NO: 972843 - DNA, 22 bp, Artificial Sequence
  chemically synthesized
acatttcaactttgaactaccc

SEQ ID NO: 972844 - DNA, 22 bp, Artificial Sequence
  chemically synthesized
cttctggggatggggtagttca

SEQ ID NO: 972845 - DNA, 22 bp, Artificial Sequence
  chemically synthesized
caactttgaactaccccatccc

SEQ ID NO: 972846 - DNA, 22 bp, Artificial Sequence
  chemically synthesized
aactttgaactaccccatcccc

SEQ ID NO: 972847 - DNA, 22 bp, Artificial Sequence
  chemically synthesized
atagcagtttcttctggggatg

SEQ ID NO: 972848 - DNA, 22 bp, Artificial Sequence
  chemically synthesized
aatagcagtttcttctggggat

SEQ ID NO: 972849 - DNA, 22 bp, Artificial Sequence
  chemically synthesized
tgaactaccccatccccagaag

SEQ ID NO: 972850 - DNA, 22 bp, Artificial Sequence
  chemically synthesized
taatagcagtttcttctgggga

SEQ ID NO: 972851 - DNA, 22 bp, Artificial Sequence
  chemically synthesized
gaactaccccatccccagaaga

SEQ ID NO: 972852 - DNA, 22 bp, Artificial Sequence
  chemically synthesized
aactaccccatccccagaagaa

SEQ ID NO: 972853 - DNA, 22 bp, Artificial Sequence
  chemically synthesized
tctttaatagcagtttcttctg

SEQ ID NO: 972854 - DNA, 22 bp, Artificial Sequence
  chemically synthesized
atctttaatagcagtttcttct

SEQ ID NO: 972855 - DNA, 22 bp, Artificial Sequence
  chemically synthesized
ccccatccccagaagaaactgc

SEQ ID NO: 972856 - DNA, 22 bp, Artificial Sequence
  chemically synthesized
aaaacttatctttaatagcagt

SEQ ID NO: 972857 - DNA, 22 bp, Artificial Sequence
  chemically synthesized
caaaacttatctttaatagcag

SEQ ID NO: 972858 - DNA, 22 bp, Artificial Sequence
  chemically synthesized
tcaaaacttatctttaatagca

SEQ ID NO: 972859 - DNA, 22 bp, Artificial Sequence
  chemically synthesized
tgtagttttcaaaacttatctt

SEQ ID NO: 972860 - DNA, 22 bp, Artificial Sequence
  chemically synthesized
gtgtagttttcaaaacttatct

SEQ ID NO: 972861 - DNA, 22 bp, Artificial Sequence
  chemically synthesized
ctattaaagataagttttgaaa

SEQ ID NO: 972862 - DNA, 22 bp, Artificial Sequence
  chemically synthesized
ttaaagataagttttgaaaact

SEQ ID NO: 972863 - DNA, 22 bp, Artificial Sequence
  chemically synthesized
aagataagttttgaaaactaca

SEQ ID NO: 972864 - DNA, 22 bp, Artificial Sequence
  chemically synthesized
aagataatgtaaggcccttgtg

SEQ ID NO: 972865 - DNA, 22 bp, Artificial Sequence
  chemically synthesized
tgaaaactacacaagggcctta

SEQ ID NO: 972866 - DNA, 22 bp, Artificial Sequence
  chemically synthesized
gaaaactacacaagggccttac

SEQ ID NO: 972867 - DNA, 22 bp, Artificial Sequence
  chemically synthesized
aaaactacacaagggccttaca

SEQ ID NO: 972868 - DNA, 22 bp, Artificial Sequence
  chemically synthesized
cacaagggccttacattatctt

SEQ ID NO: 972869 - DNA, 22 bp, Artificial Sequence
  chemically synthesized
taaataatatatatgttcaaga

SEQ ID NO: 972870 - DNA, 22 bp, Artificial Sequence
  chemically synthesized
gtaaataatatatatgttcaag

SEQ ID NO: 972871 - DNA, 22 bp, Artificial Sequence
  chemically synthesized
acattatcttgaacatatatat

SEQ ID NO: 972872 - DNA, 22 bp, Artificial Sequence
  chemically synthesized
cattatcttgaacatatatatt

SEQ ID NO: 972873 - DNA, 22 bp, Artificial Sequence
  chemically synthesized
ggtgatcttgtaaataatatat

SEQ ID NO: 972874 - DNA, 22 bp, Artificial Sequence
  chemically synthesized
tcttgaacatatatattattta

SEQ ID NO: 972875 - DNA, 22 bp, Artificial Sequence
  chemically synthesized
gaacatatatattatttacaag

SEQ ID NO: 972876 - DNA, 22 bp, Artificial Sequence
  chemically synthesized
aacatatatattatttacaaga

SEQ ID NO: 972877 - DNA, 22 bp, Artificial Sequence
  chemically synthesized
aatgaggaagaaagttaggtga

SEQ ID NO: 972878 - DNA, 22 bp, Artificial Sequence
  chemically synthesized
tttacaagatcacctaactttc

SEQ ID NO: 972879 - DNA, 22 bp, Artificial Sequence
  chemically synthesized
agttaaatgaggaagaaagtta

SEQ ID NO: 972880 - DNA, 22 bp, Artificial Sequence
  chemically synthesized
acaagatcacctaactttcttc

SEQ ID NO: 972881 - DNA, 22 bp, Artificial Sequence
  chemically synthesized
cagttaaatgaggaagaaagtt

SEQ ID NO: 972882 - DNA, 22 bp, Artificial Sequence
  chemically synthesized
caagatcacctaactttcttcc

SEQ ID NO: 972883 - DNA, 22 bp, Artificial Sequence
  chemically synthesized
tcagttaaatgaggaagaaagt

SEQ ID NO: 972884 - DNA, 22 bp, Artificial Sequence
  chemically synthesized
ttcagttaaatgaggaagaaag

SEQ ID NO: 972885 - DNA, 22 bp, Artificial Sequence
  chemically synthesized
aaagcttttcagttaaatgagg

SEQ ID NO: 972886 - DNA, 22 bp, Artificial Sequence
  chemically synthesized
actttcttcctcatttaactga

SEQ ID NO: 972887 - DNA, 22 bp, Artificial Sequence
  chemically synthesized
tctgaaagcttttcagttaaat

SEQ ID NO: 972888 - DNA, 22 bp, Artificial Sequence
  chemically synthesized
tcttcctcatttaactgaaaag

SEQ ID NO: 972889 - DNA, 22 bp, Artificial Sequence
  chemically synthesized
cttcctcatttaactgaaaagc

SEQ ID NO: 972890 - DNA, 22 bp, Artificial Sequence
  chemically synthesized
ttcctcatttaactgaaaagct

SEQ ID NO: 972891 - DNA, 22 bp, Artificial Sequence
  chemically synthesized
cctcatttaactgaaaagcttt

SEQ ID NO: 972892 - DNA, 22 bp, Artificial Sequence
  chemically synthesized
ctcatttaactgaaaagctttc

SEQ ID NO: 972893 - DNA, 22 bp, Artificial Sequence
  chemically synthesized
atttaactgaaaagctttcaga

SEQ ID NO: 972894 - DNA, 22 bp, Artificial Sequence
  chemically synthesized
aactgaaaagctttcagatagc

SEQ ID NO: 972895 - DNA, 22 bp, Artificial Sequence
  chemically synthesized
actgaaaagctttcagatagcc

SEQ ID NO: 972896 - DNA, 22 bp, Artificial Sequence
  chemically synthesized
tgtgagaaaaaagtaggctatc

SEQ ID NO: 972897 - DNA, 22 bp, Artificial Sequence
  chemically synthesized
aaaagctttcagatagcctact

SEQ ID NO: 972898 - DNA, 22 bp, Artificial Sequence
  chemically synthesized
atgtgagaaaaaagtaggctat

SEQ ID NO: 972899 - DNA, 22 bp, Artificial Sequence
  chemically synthesized
cttatgtgagaaaaaagtaggc

SEQ ID NO: 972900 - DNA, 22 bp, Artificial Sequence
  chemically synthesized
tcagatagcctacttttttctc

SEQ ID NO: 972901 - DNA, 22 bp, Artificial Sequence
  chemically synthesized
atctacttatgtgagaaaaaag

SEQ ID NO: 972902 - DNA, 22 bp, Artificial Sequence
  chemically synthesized
cagatagcctacttttttctca

SEQ ID NO: 972903 - DNA, 22 bp, Artificial Sequence
  chemically synthesized
catctacttatgtgagaaaaaa

SEQ ID NO: 972904 - DNA, 22 bp, Artificial Sequence
  chemically synthesized
agatagcctacttttttctcac

SEQ ID NO: 972905 - DNA, 22 bp, Artificial Sequence
  chemically synthesized
tcatctacttatgtgagaaaaa

SEQ ID NO: 972906 - DNA, 22 bp, Artificial Sequence
  chemically synthesized
ttcatctacttatgtgagaaaa

SEQ ID NO: 972907 - DNA, 22 bp, Artificial Sequence
  chemically synthesized
tttcatctacttatgtgagaaa

SEQ ID NO: 972908 - DNA, 22 bp, Artificial Sequence
  chemically synthesized
ttttcatctacttatgtgagaa

SEQ ID NO: 972909 - DNA, 22 bp, Artificial Sequence
  chemically synthesized
tttttcatctacttatgtgaga

SEQ ID NO: 972910 - DNA, 22 bp, Artificial Sequence
  chemically synthesized
tttttttcatctacttatgtga

SEQ ID NO: 972911 - DNA, 22 bp, Artificial Sequence
  chemically synthesized
ctttttttcatctacttatgtg

SEQ ID NO: 972912 - DNA, 22 bp, Artificial Sequence
  chemically synthesized
tctttttttcatctacttatgt

SEQ ID NO: 972913 - DNA, 22 bp, Artificial Sequence
  chemically synthesized
cttttttctcacataagtagat

SEQ ID NO: 972914 - DNA, 22 bp, Artificial Sequence
  chemically synthesized
tttctttttttcatctacttat

SEQ ID NO: 972915 - DNA, 22 bp, Artificial Sequence
  chemically synthesized
ctttctttttttcatctactta

SEQ ID NO: 972916 - DNA, 22 bp, Artificial Sequence
  chemically synthesized
tctttctttttttcatctactt

SEQ ID NO: 972917 - DNA, 22 bp, Artificial Sequence
  chemically synthesized
ttttctcacataagtagatgaa

SEQ ID NO: 972918 - DNA, 22 bp, Artificial Sequence
  chemically synthesized
tttctcacataagtagatgaaa

SEQ ID NO: 972919 - DNA, 22 bp, Artificial Sequence
  chemically synthesized
ttctcacataagtagatgaaaa

SEQ ID NO: 972920 - DNA, 22 bp, Artificial Sequence
  chemically synthesized
tctcacataagtagatgaaaaa

SEQ ID NO: 972921 - DNA, 22 bp, Artificial Sequence
  chemically synthesized
ctcacataagtagatgaaaaaa

SEQ ID NO: 972922 - DNA, 22 bp, Artificial Sequence
  chemically synthesized
tcacataagtagatgaaaaaaa

SEQ ID NO: 972923 - DNA, 22 bp, Artificial Sequence
  chemically synthesized
acataagtagatgaaaaaaaga

SEQ ID NO: 972924 - DNA, 22 bp, Artificial Sequence
  chemically synthesized
ggaaaataatacacagtgattt

SEQ ID NO: 972925 - DNA, 22 bp, Artificial Sequence
  chemically synthesized
tgtattattttcccagatatat

SEQ ID NO: 972926 - DNA, 22 bp, Artificial Sequence
  chemically synthesized
ttttcccagatatatatatata

SEQ ID NO: 972927 - DNA, 22 bp, Artificial Sequence
  chemically synthesized
tcccagatatatatatatatat

SEQ ID NO: 972928 - DNA, 22 bp, Artificial Sequence
  chemically synthesized
cccagatatatatatatatatg

SEQ ID NO: 972929 - DNA, 22 bp, Artificial Sequence
  chemically synthesized
ccagatatatatatatatatgt

SEQ ID NO: 972930 - DNA, 22 bp, Artificial Sequence
  chemically synthesized
atatatatatatatacatatat

SEQ ID NO: 972931 - DNA, 22 bp, Artificial Sequence
  chemically synthesized
cgtagtagctaatatatatata

SEQ ID NO: 972932 - DNA, 22 bp, Artificial Sequence
  chemically synthesized
ccgtagtagctaatatatatat

SEQ ID NO: 972933 - DNA, 22 bp, Artificial Sequence
  chemically synthesized
tccgtagtagctaatatatata

SEQ ID NO: 972934 - DNA, 22 bp, Artificial Sequence
  chemically synthesized
cattttccgtagtagctaatat

SEQ ID NO: 972935 - DNA, 22 bp, Artificial Sequence
  chemically synthesized
acattttccgtagtagctaata

SEQ ID NO: 972936 - DNA, 22 bp, Artificial Sequence
  chemically synthesized
tgagataaatgcatttacattt

SEQ ID NO: 972937 - DNA, 22 bp, Artificial Sequence
  chemically synthesized
gctactacggaaaatgtaaatg

SEQ ID NO: 972938 - DNA, 22 bp, Artificial Sequence
  chemically synthesized
gtgagataaatgcatttacatt

SEQ ID NO: 972939 - DNA, 22 bp, Artificial Sequence
  chemically synthesized
cttgtgagataaatgcatttac

SEQ ID NO: 972940 - DNA, 22 bp, Artificial Sequence
  chemically synthesized
ctacggaaaatgtaaatgcatt

SEQ ID NO: 972941 - DNA, 22 bp, Artificial Sequence
  chemically synthesized
ccttgtgagataaatgcattta

SEQ ID NO: 972942 - DNA, 22 bp, Artificial Sequence
  chemically synthesized
cggaaaatgtaaatgcatttat

SEQ ID NO: 972943 - DNA, 22 bp, Artificial Sequence
  chemically synthesized
aacttccttgtgagataaatgc

SEQ ID NO: 972944 - DNA, 22 bp, Artificial Sequence
  chemically synthesized
aaacttccttgtgagataaatg

SEQ ID NO: 972945 - DNA, 22 bp, Artificial Sequence
  chemically synthesized
taaacttccttgtgagataaat

SEQ ID NO: 972946 - DNA, 22 bp, Artificial Sequence
  chemically synthesized
caaggctttaaacttccttgtg

SEQ ID NO: 972947 - DNA, 22 bp, Artificial Sequence
  chemically synthesized
atctcacaaggaagtttaaagc

SEQ ID NO: 972948 - DNA, 22 bp, Artificial Sequence
  chemically synthesized
tctcacaaggaagtttaaagcc

SEQ ID NO: 972949 - DNA, 22 bp, Artificial Sequence
  chemically synthesized
acaaggaagtttaaagccttgg

SEQ ID NO: 972950 - DNA, 22 bp, Artificial Sequence
  chemically synthesized
atacagaaaacatggctccaag

SEQ ID NO: 972951 - DNA, 22 bp, Artificial Sequence
  chemically synthesized
aaagccttggagccatgttttc

SEQ ID NO: 972952 - DNA, 22 bp, Artificial Sequence
  chemically synthesized
aagccttggagccatgttttct

SEQ ID NO: 972953 - DNA, 22 bp, Artificial Sequence
  chemically synthesized
ggagccatgttttctgtattaa

SEQ ID NO: 972954 - DNA, 22 bp, Artificial Sequence
  chemically synthesized
gagccatgttttctgtattaac

SEQ ID NO: 972955 - DNA, 22 bp, Artificial Sequence
  chemically synthesized
tctgtattaacacgtgttttca

SEQ ID NO: 972956 - DNA, 22 bp, Artificial Sequence
  chemically synthesized
ctgtattaacacgtgttttcat

SEQ ID NO: 972957 - DNA, 22 bp, Artificial Sequence
  chemically synthesized
tgtattaacacgtgttttcatc

SEQ ID NO: 972958 - DNA, 22 bp, Artificial Sequence
  chemically synthesized
tggaggaagaagcgatgaaaac

SEQ ID NO: 972959 - DNA, 22 bp, Artificial Sequence
  chemically synthesized
tattaacacgtgttttcatcgc

SEQ ID NO: 972960 - DNA, 22 bp, Artificial Sequence
  chemically synthesized
acacgtgttttcatcgcttctt

SEQ ID NO: 972961 - DNA, 22 bp, Artificial Sequence
  chemically synthesized
aaaaacaattgtggaggaagaa

SEQ ID NO: 972962 - DNA, 22 bp, Artificial Sequence
  chemically synthesized
tcatcgcttcttcctccacaat

SEQ ID NO: 972963 - DNA, 22 bp, Artificial Sequence
  chemically synthesized
catcgcttcttcctccacaatt

SEQ ID NO: 972964 - DNA, 22 bp, Artificial Sequence
  chemically synthesized
atcgcttcttcctccacaattg

SEQ ID NO: 972965 - DNA, 22 bp, Artificial Sequence
  chemically synthesized
cttcctccacaattgtttttta

SEQ ID NO: 972966 - DNA, 22 bp, Artificial Sequence
  chemically synthesized
ttcctccacaattgttttttag

SEQ ID NO: 972967 - DNA, 22 bp, Artificial Sequence
  chemically synthesized
aaaaagcgtaaatctaaaaaac

SEQ ID NO: 972968 - DNA, 22 bp, Artificial Sequence
  chemically synthesized
cctccacaattgttttttagat

SEQ ID NO: 972969 - DNA, 22 bp, Artificial Sequence
  chemically synthesized
gaaaaagcgtaaatctaaaaaa

SEQ ID NO: 972970 - DNA, 22 bp, Artificial Sequence
  chemically synthesized
ctccacaattgttttttagatt

SEQ ID NO: 972971 - DNA, 22 bp, Artificial Sequence
  chemically synthesized
tgaaaaagcgtaaatctaaaaa

SEQ ID NO: 972972 - DNA, 22 bp, Artificial Sequence
  chemically synthesized
cacaattgttttttagatttac

SEQ ID NO: 972973 - DNA, 22 bp, Artificial Sequence
  chemically synthesized
tgctttgaaaaagcgtaaatct

SEQ ID NO: 972974 - DNA, 22 bp, Artificial Sequence
  chemically synthesized
atgctttgaaaaagcgtaaatc

SEQ ID NO: 972975 - DNA, 22 bp, Artificial Sequence
  chemically synthesized
tttatgctttgaaaaagcgtaa

SEQ ID NO: 972976 - DNA, 22 bp, Artificial Sequence
  chemically synthesized
ttttttagatttacgctttttc

SEQ ID NO: 972977 - DNA, 22 bp, Artificial Sequence
  chemically synthesized
tttagatttacgctttttcaaa

SEQ ID NO: 972978 - DNA, 22 bp, Artificial Sequence
  chemically synthesized
ttagatttacgctttttcaaag

SEQ ID NO: 972979 - DNA, 22 bp, Artificial Sequence
  chemically synthesized
gggttatttatgctttgaaaaa

SEQ ID NO: 972980 - DNA, 22 bp, Artificial Sequence
  chemically synthesized
tagatttacgctttttcaaagc

SEQ ID NO: 972981 - DNA, 22 bp, Artificial Sequence
  chemically synthesized
agatttacgctttttcaaagca

SEQ ID NO: 972982 - DNA, 22 bp, Artificial Sequence
  chemically synthesized
gatttacgctttttcaaagcat

SEQ ID NO: 972983 - DNA, 22 bp, Artificial Sequence
  chemically synthesized
acgctttttcaaagcataaata

SEQ ID NO: 972984 - DNA, 22 bp, Artificial Sequence
  chemically synthesized
cgctttttcaaagcataaataa

SEQ ID NO: 972985 - DNA, 22 bp, Artificial Sequence
  chemically synthesized
aagacaaactggggttatttat

SEQ ID NO: 972986 - DNA, 22 bp, Artificial Sequence
  chemically synthesized
tttcaaagcataaataacccca

SEQ ID NO: 972987 - DNA, 22 bp, Artificial Sequence
  chemically synthesized
ttcaaagcataaataaccccag

SEQ ID NO: 972988 - DNA, 22 bp, Artificial Sequence
  chemically synthesized
tcaaagcataaataaccccagt

SEQ ID NO: 972989 - DNA, 22 bp, Artificial Sequence
  chemically synthesized
caaagcataaataaccccagtt

SEQ ID NO: 972990 - DNA, 22 bp, Artificial Sequence
  chemically synthesized
cagctgaagacaaactggggtt

SEQ ID NO: 972991 - DNA, 22 bp, Artificial Sequence
  chemically synthesized
aaagcataaataaccccagttt

SEQ ID NO: 972992 - DNA, 22 bp, Artificial Sequence
  chemically synthesized
attgcagctgaagacaaactgg

SEQ ID NO: 972993 - DNA, 22 bp, Artificial Sequence
  chemically synthesized
tcattgcagctgaagacaaact

SEQ ID NO: 972994 - DNA, 22 bp, Artificial Sequence
  chemically synthesized
ctcattgcagctgaagacaaac

SEQ ID NO: 972995 - DNA, 22 bp, Artificial Sequence
  chemically synthesized
tctcattgcagctgaagacaaa

SEQ ID NO: 972996 - DNA, 22 bp, Artificial Sequence
  chemically synthesized
tgttttctcattgcagctgaag

SEQ ID NO: 972997 - DNA, 22 bp, Artificial Sequence
  chemically synthesized
gtcttcagctgcaatgagaaaa

SEQ ID NO: 972998 - DNA, 22 bp, Artificial Sequence
  chemically synthesized
tcttcagctgcaatgagaaaac

SEQ ID NO: 972999 - DNA, 22 bp, Artificial Sequence
  chemically synthesized
cagctgcaatgagaaaacatag

SEQ ID NO: 973000 - DNA, 22 bp, Artificial Sequence
  chemically synthesized
agctgcaatgagaaaacatagc

SEQ ID NO: 973001 - DNA, 22 bp, Artificial Sequence
  chemically synthesized
caatgagaaaacatagcatggt

SEQ ID NO: 973002 - DNA, 22 bp, Artificial Sequence
  chemically synthesized
acagatagcaagagatatatac

SEQ ID NO: 973003 - DNA, 22 bp, Artificial Sequence
  chemically synthesized
ataggcaaattgacagatagca

SEQ ID NO: 973004 - DNA, 22 bp, Artificial Sequence
  chemically synthesized
aataggcaaattgacagatagc

SEQ ID NO: 973005 - DNA, 22 bp, Artificial Sequence
  chemically synthesized
taataggcaaattgacagatag

SEQ ID NO: 973006 - DNA, 22 bp, Artificial Sequence
  chemically synthesized
ttgctatctgtcaatttgccta

SEQ ID NO: 973007 - DNA, 22 bp, Artificial Sequence
  chemically synthesized
gctatctgtcaatttgcctatt

SEQ ID NO: 973008 - DNA, 22 bp, Artificial Sequence
  chemically synthesized
ctatctgtcaatttgcctatta

SEQ ID NO: 973009 - DNA, 22 bp, Artificial Sequence
  chemically synthesized
tctgtcaatttgcctattaaaa

SEQ ID NO: 973010 - DNA, 22 bp, Artificial Sequence
  chemically synthesized
tcaatttgcctattaaaatatt

SEQ ID NO: 973011 - DNA, 22 bp, Artificial Sequence
  chemically synthesized
caaagaaaaggtgaacaatatt

SEQ ID NO: 973012 - DNA, 22 bp, Artificial Sequence
  chemically synthesized
gcctattaaaatattgttcacc

SEQ ID NO: 973013 - DNA, 22 bp, Artificial Sequence
  chemically synthesized
cctattaaaatattgttcacct

SEQ ID NO: 973014 - DNA, 22 bp, Artificial Sequence
  chemically synthesized
ttaaaatattgttcaccttttc

SEQ ID NO: 973015 - DNA, 22 bp, Artificial Sequence
  chemically synthesized
aaatattgttcaccttttcttt

SEQ ID NO: 973016 - DNA, 22 bp, Artificial Sequence
  chemically synthesized
ttcaccttttctttggagggtt

SEQ ID NO: 973017 - DNA, 22 bp, Artificial Sequence
  chemically synthesized
accttttctttggagggttttt

SEQ ID NO: 973018 - DNA, 22 bp, Artificial Sequence
  chemically synthesized
ttctttggagggtttttcttcg

SEQ ID NO: 973019 - DNA, 22 bp, Artificial Sequence
  chemically synthesized
tctttggagggtttttcttcgc

SEQ ID NO: 973020 - DNA, 22 bp, Artificial Sequence
  chemically synthesized
ctttggagggtttttcttcgcc

SEQ ID NO: 973021 - DNA, 22 bp, Artificial Sequence
  chemically synthesized
tttggagggtttttcttcgcct

SEQ ID NO: 973022 - DNA, 22 bp, Artificial Sequence
  chemically synthesized
gtcaggaaagaggaggcgaaga

SEQ ID NO: 973023 - DNA, 22 bp, Artificial Sequence
  chemically synthesized
tggagggtttttcttcgcctcc

SEQ ID NO: 973024 - DNA, 22 bp, Artificial Sequence
  chemically synthesized
agtcaggaaagaggaggcgaag

SEQ ID NO: 973025 - DNA, 22 bp, Artificial Sequence
  chemically synthesized
ggagggtttttcttcgcctcct

SEQ ID NO: 973026 - DNA, 22 bp, Artificial Sequence
  chemically synthesized
tagtcaggaaagaggaggcgaa

SEQ ID NO: 973027 - DNA, 22 bp, Artificial Sequence
  chemically synthesized
gagggtttttcttcgcctcctc

SEQ ID NO: 973028 - DNA, 22 bp, Artificial Sequence
  chemically synthesized
ttcttcgcctcctctttcctga

SEQ ID NO: 973029 - DNA, 22 bp, Artificial Sequence
  chemically synthesized
tcttcgcctcctctttcctgac

SEQ ID NO: 973030 - DNA, 22 bp, Artificial Sequence
  chemically synthesized
cttcgcctcctctttcctgact

SEQ ID NO: 973031 - DNA, 22 bp, Artificial Sequence
  chemically synthesized
ttcgcctcctctttcctgacta

SEQ ID NO: 973032 - DNA, 22 bp, Artificial Sequence
  chemically synthesized
cgcctcctctttcctgactaaa

SEQ ID NO: 973033 - DNA, 22 bp, Artificial Sequence
  chemically synthesized
gcctcctctttcctgactaaag

SEQ ID NO: 973034 - DNA, 22 bp, Artificial Sequence
  chemically synthesized
ctctttcctgactaaagtttct

SEQ ID NO: 973035 - DNA, 22 bp, Artificial Sequence
  chemically synthesized
tttcctgactaaagtttcttgc

SEQ ID NO: 973036 - DNA, 22 bp, Artificial Sequence
  chemically synthesized
tcctgactaaagtttcttgcat

SEQ ID NO: 973037 - DNA, 22 bp, Artificial Sequence
  chemically synthesized
cctgactaaagtttcttgcatc

SEQ ID NO: 973038 - DNA, 22 bp, Artificial Sequence
  chemically synthesized
acggatgcacgggatgcaagaa

SEQ ID NO: 973039 - DNA, 22 bp, Artificial Sequence
  chemically synthesized
ctgactaaagtttcttgcatcc

SEQ ID NO: 973040 - DNA, 22 bp, Artificial Sequence
  chemically synthesized
gacggatgcacgggatgcaaga

SEQ ID NO: 973041 - DNA, 22 bp, Artificial Sequence
  chemically synthesized
tgacggatgcacgggatgcaag

SEQ ID NO: 973042 - DNA, 22 bp, Artificial Sequence
  chemically synthesized
actaaagtttcttgcatcccgt

SEQ ID NO: 973043 - DNA, 22 bp, Artificial Sequence
  chemically synthesized
aagtttcttgcatcccgtgcat

SEQ ID NO: 973044 - DNA, 22 bp, Artificial Sequence
  chemically synthesized
agcctttgacggatgcacggga

SEQ ID NO: 973045 - DNA, 22 bp, Artificial Sequence
  chemically synthesized
cttgcatcccgtgcatccgtca

SEQ ID NO: 973046 - DNA, 22 bp, Artificial Sequence
  chemically synthesized
ttgcatcccgtgcatccgtcaa

SEQ ID NO: 973047 - DNA, 22 bp, Artificial Sequence
  chemically synthesized
gcatcccgtgcatccgtcaaag

SEQ ID NO: 973048 - DNA, 22 bp, Artificial Sequence
  chemically synthesized
catcccgtgcatccgtcaaagg

SEQ ID NO: 973049 - DNA, 22 bp, Artificial Sequence
  chemically synthesized
aacaaacaaaacagaaagctaa

SEQ ID NO: 973050 - DNA, 22 bp, Artificial Sequence
  chemically synthesized
gaacaaacaaaacagaaagcta

SEQ ID NO: 973051 - DNA, 22 bp, Artificial Sequence
  chemically synthesized
tgaacaaacaaaacagaaagct

SEQ ID NO: 973052 - DNA, 22 bp, Artificial Sequence
  chemically synthesized
agctttctgttttgtttgttca

SEQ ID NO: 973053 - DNA, 22 bp, Artificial Sequence
  chemically synthesized
gctttctgttttgtttgttcaa

SEQ ID NO: 973054 - DNA, 22 bp, Artificial Sequence
  chemically synthesized
ccaaaaggcgggctttgaacaa

SEQ ID NO: 973055 - DNA, 22 bp, Artificial Sequence
  chemically synthesized
tctgttttgtttgttcaaagcc

SEQ ID NO: 973056 - DNA, 22 bp, Artificial Sequence
  chemically synthesized
ctgttttgtttgttcaaagccc

SEQ ID NO: 973057 - DNA, 22 bp, Artificial Sequence
  chemically synthesized
tgttttgtttgttcaaagcccg

SEQ ID NO: 973058 - DNA, 22 bp, Artificial Sequence
  chemically synthesized
ttttgtttgttcaaagcccgcc

SEQ ID NO: 973059 - DNA, 22 bp, Artificial Sequence
  chemically synthesized
tgtttgttcaaagcccgccttt

SEQ ID NO: 973060 - DNA, 22 bp, Artificial Sequence
  chemically synthesized
gtttgttcaaagcccgcctttt

SEQ ID NO: 973061 - DNA, 22 bp, Artificial Sequence
  chemically synthesized
tttgttcaaagcccgccttttg

SEQ ID NO: 973062 - DNA, 22 bp, Artificial Sequence
  chemically synthesized
gttcaaagcccgccttttggga

SEQ ID NO: 973063 - DNA, 22 bp, Artificial Sequence
  chemically synthesized
ttcaaagcccgccttttgggag

SEQ ID NO: 973064 - DNA, 22 bp, Artificial Sequence
  chemically synthesized
aaagcccgccttttgggagctt

SEQ ID NO: 973065 - DNA, 22 bp, Artificial Sequence
  chemically synthesized
ttgggagcttggtcccatcttt

SEQ ID NO: 973066 - DNA, 22 bp, Artificial Sequence
  chemically synthesized
tgggagcttggtcccatctttg

SEQ ID NO: 973067 - DNA, 22 bp, Artificial Sequence
  chemically synthesized
gggagcttggtcccatctttgc

SEQ ID NO: 973068 - DNA, 22 bp, Artificial Sequence
  chemically synthesized
ggagcttggtcccatctttgct

SEQ ID NO: 973069 - DNA, 22 bp, Artificial Sequence
  chemically synthesized
ggtcccatctttgcttccctcc

SEQ ID NO: 973070 - DNA, 22 bp, Artificial Sequence
  chemically synthesized
gtcccatctttgcttccctcct

SEQ ID NO: 973071 - DNA, 22 bp, Artificial Sequence
  chemically synthesized
gaaggagatgatagcaggaggg

SEQ ID NO: 973072 - DNA, 22 bp, Artificial Sequence
  chemically synthesized
agaaggagatgatagcaggagg

SEQ ID NO: 973073 - DNA, 22 bp, Artificial Sequence
  chemically synthesized
tgcttccctcctgctatcatct

SEQ ID NO: 973074 - DNA, 22 bp, Artificial Sequence
  chemically synthesized
gcttccctcctgctatcatctc

SEQ ID NO: 973075 - DNA, 22 bp, Artificial Sequence
  chemically synthesized
cttccctcctgctatcatctcc

SEQ ID NO: 973076 - DNA, 22 bp, Artificial Sequence
  chemically synthesized
ccctcctgctatcatctccttc

SEQ ID NO: 973077 - DNA, 22 bp, Artificial Sequence
  chemically synthesized
cctcctgctatcatctccttct

SEQ ID NO: 973078 - DNA, 22 bp, Artificial Sequence
  chemically synthesized
aaaacagaatgcttagaaggag

SEQ ID NO: 973079 - DNA, 22 bp, Artificial Sequence
  chemically synthesized
ctgctatcatctccttctaagc

SEQ ID NO: 973080 - DNA, 22 bp, Artificial Sequence
  chemically synthesized
ctatcatctccttctaagcatt

SEQ ID NO: 973081 - DNA, 22 bp, Artificial Sequence
  chemically synthesized
tcatctccttctaagcattctg

SEQ ID NO: 973082 - DNA, 22 bp, Artificial Sequence
  chemically synthesized
cttctaagcattctgtttttag

SEQ ID NO: 973083 - DNA, 22 bp, Artificial Sequence
  chemically synthesized
ctaagcattctgtttttagctt

SEQ ID NO: 973084 - DNA, 22 bp, Artificial Sequence
  chemically synthesized
taagcattctgtttttagcttc

SEQ ID NO: 973085 - DNA, 22 bp, Artificial Sequence
  chemically synthesized
agcattctgtttttagcttcac

SEQ ID NO: 973086 - DNA, 22 bp, Artificial Sequence
  chemically synthesized
tgtttttagcttcacatctccc

SEQ ID NO: 973087 - DNA, 22 bp, Artificial Sequence
  chemically synthesized
tttttagcttcacatctccctt

SEQ ID NO: 973088 - DNA, 22 bp, Artificial Sequence
  chemically synthesized
ttagcttcacatctcccttcgc

SEQ ID NO: 973089 - DNA, 22 bp, Artificial Sequence
  chemically synthesized
tagcttcacatctcccttcgcc

SEQ ID NO: 973090 - DNA, 22 bp, Artificial Sequence
  chemically synthesized
agcttcacatctcccttcgcca

SEQ ID NO: 973091 - DNA, 22 bp, Artificial Sequence
  chemically synthesized
gcttcacatctcccttcgccat

SEQ ID NO: 973092 - DNA, 22 bp, Artificial Sequence
  chemically synthesized
agcaaaagaagcatggcgaagg

SEQ ID NO: 973093 - DNA, 22 bp, Artificial Sequence
  chemically synthesized
taagcaaaagaagcatggcgaa

SEQ ID NO: 973094 - DNA, 22 bp, Artificial Sequence
  chemically synthesized
cacatctcccttcgccatgctt

SEQ ID NO: 973095 - DNA, 22 bp, Artificial Sequence
  chemically synthesized
acatctcccttcgccatgcttc

SEQ ID NO: 973096 - DNA, 22 bp, Artificial Sequence
  chemically synthesized
ttctaagcaaaagaagcatggc

SEQ ID NO: 973097 - DNA, 22 bp, Artificial Sequence
  chemically synthesized
ttgttctaagcaaaagaagcat

SEQ ID NO: 973098 - DNA, 22 bp, Artificial Sequence
  chemically synthesized
ccttcgccatgcttcttttgct

SEQ ID NO: 973099 - DNA, 22 bp, Artificial Sequence
  chemically synthesized
cgttattgttctaagcaaaaga

SEQ ID NO: 973100 - DNA, 22 bp, Artificial Sequence
  chemically synthesized
cgccatgcttcttttgcttaga

SEQ ID NO: 973101 - DNA, 22 bp, Artificial Sequence
  chemically synthesized
ctgcgttattgttctaagcaaa

SEQ ID NO: 973102 - DNA, 22 bp, Artificial Sequence
  chemically synthesized
gccatgcttcttttgcttagaa

SEQ ID NO: 973103 - DNA, 22 bp, Artificial Sequence
  chemically synthesized
ctgctgcgttattgttctaagc

SEQ ID NO: 973104 - DNA, 22 bp, Artificial Sequence
  chemically synthesized
gctgctgcgttattgttctaag

SEQ ID NO: 973105 - DNA, 22 bp, Artificial Sequence
  chemically synthesized
cttttgcttagaacaataacgc

SEQ ID NO: 973106 - DNA, 22 bp, Artificial Sequence
  chemically synthesized
ttttgcttagaacaataacgca

SEQ ID NO: 973107 - DNA, 22 bp, Artificial Sequence
  chemically synthesized
ttgcttagaacaataacgcagc

SEQ ID NO: 973108 - DNA, 22 bp, Artificial Sequence
  chemically synthesized
tgcttagaacaataacgcagca

SEQ ID NO: 973109 - DNA, 22 bp, Artificial Sequence
  chemically synthesized
gcttagaacaataacgcagcag

SEQ ID NO: 973110 - DNA, 22 bp, Artificial Sequence
  chemically synthesized
cttagaacaataacgcagcagc

SEQ ID NO: 973111 - DNA, 22 bp, Artificial Sequence
  chemically synthesized
agaacaataacgcagcagcaag

SEQ ID NO: 973112 - DNA, 22 bp, Artificial Sequence
  chemically synthesized
gaacaataacgcagcagcaagt

SEQ ID NO: 973113 - DNA, 22 bp, Artificial Sequence
  chemically synthesized
aagcaatcgatgtacttgctgc

SEQ ID NO: 973114 - DNA, 22 bp, Artificial Sequence
  chemically synthesized
ctaaagcaatcgatgtacttgc

SEQ ID NO: 973115 - DNA, 22 bp, Artificial Sequence
  chemically synthesized
agtacaagataaaatcctccta

SEQ ID NO: 973116 - DNA, 22 bp, Artificial Sequence
  chemically synthesized
ctttaggaggattttatcttgt

SEQ ID NO: 973117 - DNA, 22 bp, Artificial Sequence
  chemically synthesized
taggaggattttatcttgtact

SEQ ID NO: 973118 - DNA, 22 bp, Artificial Sequence
  chemically synthesized
aggaggattttatcttgtactc

SEQ ID NO: 973119 - DNA, 22 bp, Artificial Sequence
  chemically synthesized
ggaggattttatcttgtactca

SEQ ID NO: 973120 - DNA, 22 bp, Artificial Sequence
  chemically synthesized
tatcttgtactcagttccatgt

SEQ ID NO: 973121 - DNA, 22 bp, Artificial Sequence
  chemically synthesized
atcttgtactcagttccatgtt

SEQ ID NO: 973122 - DNA, 22 bp, Artificial Sequence
  chemically synthesized
tcttgtactcagttccatgttc

SEQ ID NO: 973123 - DNA, 22 bp, Artificial Sequence
  chemically synthesized
gtactcagttccatgttcctat

SEQ ID NO: 973124 - DNA, 22 bp, Artificial Sequence
  chemically synthesized
tactcagttccatgttcctatt

SEQ ID NO: 973125 - DNA, 22 bp, Artificial Sequence
  chemically synthesized
agttccatgttcctattcattc

SEQ ID NO: 973126 - DNA, 22 bp, Artificial Sequence
  chemically synthesized
catgttcctattcattcatttg

SEQ ID NO: 973127 - DNA, 22 bp, Artificial Sequence
  chemically synthesized
aagaaataaagacaaatgaatg

SEQ ID NO: 973128 - DNA, 22 bp, Artificial Sequence
  chemically synthesized
aaagaaataaagacaaatgaat

SEQ ID NO: 973129 - DNA, 22 bp, Artificial Sequence
  chemically synthesized
ctattcattcatttgtctttat

SEQ ID NO: 973130 - DNA, 22 bp, Artificial Sequence
  chemically synthesized
ttcattcatttgtctttatttc

SEQ ID NO: 973131 - DNA, 22 bp, Artificial Sequence
  chemically synthesized
gagaaacttaaagaaataaaga

SEQ ID NO: 973132 - DNA, 22 bp, Artificial Sequence
  chemically synthesized
attcatttgtctttatttcttt

SEQ ID NO: 973133 - DNA, 22 bp, Artificial Sequence
  chemically synthesized
cctcgagaaacttaaagaaata

SEQ ID NO: 973134 - DNA, 22 bp, Artificial Sequence
  chemically synthesized
gcctcgagaaacttaaagaaat

SEQ ID NO: 973135 - DNA, 22 bp, Artificial Sequence
  chemically synthesized
atttgtctttatttctttaagt

SEQ ID NO: 973136 - DNA, 22 bp, Artificial Sequence
  chemically synthesized
gtctttatttctttaagtttct

SEQ ID NO: 973137 - DNA, 22 bp, Artificial Sequence
  chemically synthesized
tctttatttctttaagtttctc

SEQ ID NO: 973138 - DNA, 22 bp, Artificial Sequence
  chemically synthesized
aatatttgcctcgagaaactta

SEQ ID NO: 973139 - DNA, 22 bp, Artificial Sequence
  chemically synthesized
tatttctttaagtttctcgagg

SEQ ID NO: 973140 - DNA, 22 bp, Artificial Sequence
  chemically synthesized
atttctttaagtttctcgaggc

SEQ ID NO: 973141 - DNA, 22 bp, Artificial Sequence
  chemically synthesized
tttctttaagtttctcgaggca

SEQ ID NO: 973142 - DNA, 22 bp, Artificial Sequence
  chemically synthesized
taacactaaatatttgcctcga

SEQ ID NO: 973143 - DNA, 22 bp, Artificial Sequence
  chemically synthesized
ctttaagtttctcgaggcaaat

SEQ ID NO: 973144 - DNA, 22 bp, Artificial Sequence
  chemically synthesized
tttaagtttctcgaggcaaata

SEQ ID NO: 973145 - DNA, 22 bp, Artificial Sequence
  chemically synthesized
taagtttctcgaggcaaatatt

SEQ ID NO: 973146 - DNA, 22 bp, Artificial Sequence
  chemically synthesized
aagtttctcgaggcaaatattt

SEQ ID NO: 973147 - DNA, 22 bp, Artificial Sequence
  chemically synthesized
agtttctcgaggcaaatattta

SEQ ID NO: 973148 - DNA, 22 bp, Artificial Sequence
  chemically synthesized
ctcgaggcaaatatttagtgtt

SEQ ID NO: 973149 - DNA, 22 bp, Artificial Sequence
  chemically synthesized
tcgaggcaaatatttagtgtta

SEQ ID NO: 973150 - DNA, 22 bp, Artificial Sequence
  chemically synthesized
gaggcaaatatttagtgttaca

SEQ ID NO: 973151 - DNA, 22 bp, Artificial Sequence
  chemically synthesized
gtaggcatagatctgtaacact

SEQ ID NO: 973152 - DNA, 22 bp, Artificial Sequence
  chemically synthesized
agtgttacagatctatgcctac

SEQ ID NO: 973153 - DNA, 22 bp, Artificial Sequence
  chemically synthesized
gtgttacagatctatgcctacg

SEQ ID NO: 973154 - DNA, 22 bp, Artificial Sequence
  chemically synthesized
gcaaccagacatcaactcgtag

SEQ ID NO: 973155 - DNA, 22 bp, Artificial Sequence
  chemically synthesized
cagatctatgcctacgagttga

SEQ ID NO: 973156 - DNA, 22 bp, Artificial Sequence
  chemically synthesized
tggcaaccagacatcaactcgt

SEQ ID NO: 973157 - DNA, 22 bp, Artificial Sequence
  chemically synthesized
tgcctacgagttgatgtctggt

SEQ ID NO: 973158 - DNA, 22 bp, Artificial Sequence
  chemically synthesized
ataaaattctggcaaccagaca

SEQ ID NO: 973159 - DNA, 22 bp, Artificial Sequence
  chemically synthesized
cgagttgatgtctggttgccag

SEQ ID NO: 973160 - DNA, 22 bp, Artificial Sequence
  chemically synthesized
atgtctggttgccagaatttta

SEQ ID NO: 973161 - DNA, 22 bp, Artificial Sequence
  chemically synthesized
tgtatgtatctgataaaattct

SEQ ID NO: 973162 - DNA, 22 bp, Artificial Sequence
  chemically synthesized
gttgccagaattttatcagata

SEQ ID NO: 973163 - DNA, 22 bp, Artificial Sequence
  chemically synthesized
ccagaattttatcagatacata

SEQ ID NO: 973164 - DNA, 22 bp, Artificial Sequence
  chemically synthesized
tgatgagctgtgtatgtatctg

SEQ ID NO: 973165 - DNA, 22 bp, Artificial Sequence
  chemically synthesized
tctgtgatgagctgtgtatgta

SEQ ID NO: 973166 - DNA, 22 bp, Artificial Sequence
  chemically synthesized
tatcagatacatacacagctca

SEQ ID NO: 973167 - DNA, 22 bp, Artificial Sequence
  chemically synthesized
atcagatacatacacagctcat

SEQ ID NO: 973168 - DNA, 22 bp, Artificial Sequence
  chemically synthesized
tcagatacatacacagctcatc

SEQ ID NO: 973169 - DNA, 22 bp, Artificial Sequence
  chemically synthesized
atcacattgtctgtgatgagct

SEQ ID NO: 973170 - DNA, 22 bp, Artificial Sequence
  chemically synthesized
atgcagaagtgttaatcacatt

SEQ ID NO: 973171 - DNA, 22 bp, Artificial Sequence
  chemically synthesized
atcacagacaatgtgattaaca

SEQ ID NO: 973172 - DNA, 22 bp, Artificial Sequence
  chemically synthesized
cataattcatgcagaagtgtta

SEQ ID NO: 973173 - DNA, 22 bp, Artificial Sequence
  chemically synthesized
acataattcatgcagaagtgtt

SEQ ID NO: 973174 - DNA, 22 bp, Artificial Sequence
  chemically synthesized
tacataattcatgcagaagtgt

SEQ ID NO: 973175 - DNA, 22 bp, Artificial Sequence
  chemically synthesized
acacttctgcatgaattatgta

SEQ ID NO: 973176 - DNA, 22 bp, Artificial Sequence
  chemically synthesized
atacgaacattttacataattc

SEQ ID NO: 973177 - DNA, 22 bp, Artificial Sequence
  chemically synthesized
tgatacgaacattttacataat

SEQ ID NO: 973178 - DNA, 22 bp, Artificial Sequence
  chemically synthesized
ctgcatgaattatgtaaaatgt

SEQ ID NO: 973179 - DNA, 22 bp, Artificial Sequence
  chemically synthesized
tgcatgaattatgtaaaatgtt

SEQ ID NO: 973180 - DNA, 22 bp, Artificial Sequence
  chemically synthesized
catgaattatgtaaaatgttcg

SEQ ID NO: 973181 - DNA, 22 bp, Artificial Sequence
  chemically synthesized
tgaaaagactctgatacgaaca

SEQ ID NO: 973182 - DNA, 22 bp, Artificial Sequence
  chemically synthesized
ctatgaaaagactctgatacga

SEQ ID NO: 973183 - DNA, 22 bp, Artificial Sequence
  chemically synthesized
actatgaaaagactctgatacg

SEQ ID NO: 973184 - DNA, 22 bp, Artificial Sequence
  chemically synthesized
tgtaaaatgttcgtatcagagt

SEQ ID NO: 973185 - DNA, 22 bp, Artificial Sequence
  chemically synthesized
tactatgaaaagactctgatac

SEQ ID NO: 973186 - DNA, 22 bp, Artificial Sequence
  chemically synthesized
atatctttactatgaaaagact

SEQ ID NO: 973187 - DNA, 22 bp, Artificial Sequence
  chemically synthesized
gtatcagagtcttttcatagta

SEQ ID NO: 973188 - DNA, 22 bp, Artificial Sequence
  chemically synthesized
tacataatatcactaatatctt

SEQ ID NO: 973189 - DNA, 22 bp, Artificial Sequence
  chemically synthesized
atacataatatcactaatatct

SEQ ID NO: 973190 - DNA, 22 bp, Artificial Sequence
  chemically synthesized
ttcatagtaaagatattagtga

SEQ ID NO: 973191 - DNA, 22 bp, Artificial Sequence
  chemically synthesized
tcatagtaaagatattagtgat

SEQ ID NO: 973192 - DNA, 22 bp, Artificial Sequence
  chemically synthesized
catagtaaagatattagtgata

SEQ ID NO: 973193 - DNA, 22 bp, Artificial Sequence
  chemically synthesized
atagtaaagatattagtgatat

SEQ ID NO: 973194 - DNA, 22 bp, Artificial Sequence
  chemically synthesized
gtgatattatgtataagtgttt

SEQ ID NO: 973195 - DNA, 22 bp, Artificial Sequence
  chemically synthesized
tgtataagtgtttatatacatt

SEQ ID NO: 973196 - DNA, 22 bp, Artificial Sequence
  chemically synthesized
caacaaaatataacaaaatata

SEQ ID NO: 973197 - DNA, 22 bp, Artificial Sequence
  chemically synthesized
tgcaacaaaatataacaaaata

SEQ ID NO: 973198 - DNA, 22 bp, Artificial Sequence
  chemically synthesized
atatacattatattttgttata

SEQ ID NO: 973199 - DNA, 22 bp, Artificial Sequence
  chemically synthesized
tatacattatattttgttatat

SEQ ID NO: 973200 - DNA, 22 bp, Artificial Sequence
  chemically synthesized
agaacatgttctgcaacaaaat

SEQ ID NO: 973201 - DNA, 22 bp, Artificial Sequence
  chemically synthesized
tattttgttatattttgttgca

SEQ ID NO: 973202 - DNA, 22 bp, Artificial Sequence
  chemically synthesized
tgttatattttgttgcagaaca

SEQ ID NO: 973203 - DNA, 22 bp, Artificial Sequence
  chemically synthesized
gttatattttgttgcagaacat

SEQ ID NO: 973204 - DNA, 22 bp, Artificial Sequence
  chemically synthesized
ttatattttgttgcagaacatg

SEQ ID NO: 973205 - DNA, 22 bp, Artificial Sequence
  chemically synthesized
tattttgttgcagaacatgttc

SEQ ID NO: 973206 - DNA, 22 bp, Artificial Sequence
  chemically synthesized
tgttgcagaacatgttctgagt

SEQ ID NO: 973207 - DNA, 22 bp, Artificial Sequence
  chemically synthesized
gttgcagaacatgttctgagtt

SEQ ID NO: 973208 - DNA, 22 bp, Artificial Sequence
  chemically synthesized
ttgcagaacatgttctgagttt

SEQ ID NO: 973209 - DNA, 22 bp, Artificial Sequence
  chemically synthesized
ggtgaaaagaagaaaactcaga

SEQ ID NO: 973210 - DNA, 22 bp, Artificial Sequence
  chemically synthesized
cagaacatgttctgagttttct

SEQ ID NO: 973211 - DNA, 22 bp, Artificial Sequence
  chemically synthesized
caaatctaggtgaaaagaagaa

SEQ ID NO: 973212 - DNA, 22 bp, Artificial Sequence
  chemically synthesized
tgagttttcttcttttcaccta

SEQ ID NO: 973213 - DNA, 22 bp, Artificial Sequence
  chemically synthesized
aaactccaaatctaggtgaaaa

SEQ ID NO: 973214 - DNA, 22 bp, Artificial Sequence
  chemically synthesized
agttttcttcttttcacctaga

SEQ ID NO: 973215 - DNA, 22 bp, Artificial Sequence
  chemically synthesized
tcttcttttcacctagatttgg

SEQ ID NO: 973216 - DNA, 22 bp, Artificial Sequence
  chemically synthesized
catattaaaactccaaatctag

SEQ ID NO: 973217 - DNA, 22 bp, Artificial Sequence
  chemically synthesized
cttcttttcacctagatttgga

SEQ ID NO: 973218 - DNA, 22 bp, Artificial Sequence
  chemically synthesized
ttcttttcacctagatttggag

SEQ ID NO: 973219 - DNA, 22 bp, Artificial Sequence
  chemically synthesized
tccatattaaaactccaaatct

SEQ ID NO: 973220 - DNA, 22 bp, Artificial Sequence
  chemically synthesized
ctccatattaaaactccaaatc

SEQ ID NO: 973221 - DNA, 22 bp, Artificial Sequence
  chemically synthesized
cttttcacctagatttggagtt

SEQ ID NO: 973222 - DNA, 22 bp, Artificial Sequence
  chemically synthesized
ttttcacctagatttggagttt

SEQ ID NO: 973223 - DNA, 22 bp, Artificial Sequence
  chemically synthesized
cttctccatattaaaactccaa

SEQ ID NO: 973224 - DNA, 22 bp, Artificial Sequence
  chemically synthesized
ttcacctagatttggagtttta

SEQ ID NO: 973225 - DNA, 22 bp, Artificial Sequence
  chemically synthesized
tcacctagatttggagttttaa

SEQ ID NO: 973226 - DNA, 22 bp, Artificial Sequence
  chemically synthesized
cacctagatttggagttttaat

SEQ ID NO: 973227 - DNA, 22 bp, Artificial Sequence
  chemically synthesized
acctagatttggagttttaata

SEQ ID NO: 973228 - DNA, 22 bp, Artificial Sequence
  chemically synthesized
gatttggagttttaatatggag

SEQ ID NO: 973229 - DNA, 22 bp, Artificial Sequence
  chemically synthesized
aaccaccactgcttctccatat

SEQ ID NO: 973230 - DNA, 22 bp, Artificial Sequence
  chemically synthesized
aaaccaccactgcttctccata

SEQ ID NO: 973231 - DNA, 22 bp, Artificial Sequence
  chemically synthesized
taaaccaccactgcttctccat

SEQ ID NO: 973232 - DNA, 22 bp, Artificial Sequence
  chemically synthesized
ggagttttaatatggagaagca

SEQ ID NO: 973233 - DNA, 22 bp, Artificial Sequence
  chemically synthesized
ttaaaccaccactgcttctcca

SEQ ID NO: 973234 - DNA, 22 bp, Artificial Sequence
  chemically synthesized
gagttttaatatggagaagcag

SEQ ID NO: 973235 - DNA, 22 bp, Artificial Sequence
  chemically synthesized
taatatggagaagcagtggtgg

SEQ ID NO: 973236 - DNA, 22 bp, Artificial Sequence
  chemically synthesized
tggtcttttaaaccaccactgc

SEQ ID NO: 973237 - DNA, 22 bp, Artificial Sequence
  chemically synthesized
aatatggagaagcagtggtggt

SEQ ID NO: 973238 - DNA, 22 bp, Artificial Sequence
  chemically synthesized
atatggagaagcagtggtggtt

SEQ ID NO: 973239 - DNA, 22 bp, Artificial Sequence
  chemically synthesized
tgtggtcttttaaaccaccact

SEQ ID NO: 973240 - DNA, 22 bp, Artificial Sequence
  chemically synthesized
acatcattctgtggtcttttaa

SEQ ID NO: 973241 - DNA, 22 bp, Artificial Sequence
  chemically synthesized
tctgacatcattctgtggtctt

SEQ ID NO: 973242 - DNA, 22 bp, Artificial Sequence
  chemically synthesized
gcctgtctgacatcattctgtg

SEQ ID NO: 973243 - DNA, 22 bp, Artificial Sequence
  chemically synthesized
tggcctgtctgacatcattctg

SEQ ID NO: 973244 - DNA, 22 bp, Artificial Sequence
  chemically synthesized
aaaagaccacagaatgatgtca

SEQ ID NO: 973245 - DNA, 22 bp, Artificial Sequence
  chemically synthesized
aaagaccacagaatgatgtcag

SEQ ID NO: 973246 - DNA, 22 bp, Artificial Sequence
  chemically synthesized
aactctggcctgtctgacatca

SEQ ID NO: 973247 - DNA, 22 bp, Artificial Sequence
  chemically synthesized
gaactctggcctgtctgacatc

SEQ ID NO: 973248 - DNA, 22 bp, Artificial Sequence
  chemically synthesized
tatttgaactctggcctgtctg

SEQ ID NO: 973249 - DNA, 22 bp, Artificial Sequence
  chemically synthesized
atagagccatagagtagtaaaa

SEQ ID NO: 973250 - DNA, 22 bp, Artificial Sequence
  chemically synthesized
aaatacaggttttactactcta

SEQ ID NO: 973251 - DNA, 22 bp, Artificial Sequence
  chemically synthesized
acgctcatagagccatagagta

SEQ ID NO: 973252 - DNA, 22 bp, Artificial Sequence
  chemically synthesized
ctcacgctcatagagccataga

SEQ ID NO: 973253 - DNA, 22 bp, Artificial Sequence
  chemically synthesized
actcacgctcatagagccatag

SEQ ID NO: 973254 - DNA, 22 bp, Artificial Sequence
  chemically synthesized
tactactctatggctctatgag

SEQ ID NO: 973255 - DNA, 22 bp, Artificial Sequence
  chemically synthesized
actactctatggctctatgagc

SEQ ID NO: 973256 - DNA, 22 bp, Artificial Sequence
  chemically synthesized
ctactctatggctctatgagcg

SEQ ID NO: 973257 - DNA, 22 bp, Artificial Sequence
  chemically synthesized
gggtaacttactcacgctcata

SEQ ID NO: 973258 - DNA, 22 bp, Artificial Sequence
  chemically synthesized
ctctatggctctatgagcgtga

SEQ ID NO: 973259 - DNA, 22 bp, Artificial Sequence
  chemically synthesized
tatggctctatgagcgtgagta

SEQ ID NO: 973260 - DNA, 22 bp, Artificial Sequence
  chemically synthesized
tggctctatgagcgtgagtaag

SEQ ID NO: 973261 - DNA, 22 bp, Artificial Sequence
  chemically synthesized
gagagaggctagggtaacttac

SEQ ID NO: 973262 - DNA, 22 bp, Artificial Sequence
  chemically synthesized
tatgagcgtgagtaagttaccc

SEQ ID NO: 973263 - DNA, 22 bp, Artificial Sequence
  chemically synthesized
tgagcgtgagtaagttacccta

SEQ ID NO: 973264 - DNA, 22 bp, Artificial Sequence
  chemically synthesized
agctggagagaggctagggtaa

SEQ ID NO: 973265 - DNA, 22 bp, Artificial Sequence
  chemically synthesized
aattgagctggagagaggctag

SEQ ID NO: 973266 - DNA, 22 bp, Artificial Sequence
  chemically synthesized
ccctagcctctctccagctcaa

SEQ ID NO: 973267 - DNA, 22 bp, Artificial Sequence
  chemically synthesized
gtagtaatcctaaattgagctg

SEQ ID NO: 973268 - DNA, 22 bp, Artificial Sequence
  chemically synthesized
cgtagtaatcctaaattgagct

SEQ ID NO: 973269 - DNA, 22 bp, Artificial Sequence
  chemically synthesized
gcctctctccagctcaatttag

SEQ ID NO: 973270 - DNA, 22 bp, Artificial Sequence
  chemically synthesized
ttcgtagtaatcctaaattgag

SEQ ID NO: 973271 - DNA, 22 bp, Artificial Sequence
  chemically synthesized
cttcgtagtaatcctaaattga

SEQ ID NO: 973272 - DNA, 22 bp, Artificial Sequence
  chemically synthesized
tctccagctcaatttaggatta

SEQ ID NO: 973273 - DNA, 22 bp, Artificial Sequence
  chemically synthesized
tccagctcaatttaggattact

SEQ ID NO: 973274 - DNA, 22 bp, Artificial Sequence
  chemically synthesized
cgagcttcttcgtagtaatcct

SEQ ID NO: 973275 - DNA, 22 bp, Artificial Sequence
  chemically synthesized
cagctcaatttaggattactac

SEQ ID NO: 973276 - DNA, 22 bp, Artificial Sequence
  chemically synthesized
ccgagcttcttcgtagtaatcc

SEQ ID NO: 973277 - DNA, 22 bp, Artificial Sequence
  chemically synthesized
aatttaggattactacgaagaa

SEQ ID NO: 973278 - DNA, 22 bp, Artificial Sequence
  chemically synthesized
tgtgaggtttccgagcttcttc

SEQ ID NO: 973279 - DNA, 22 bp, Artificial Sequence
  chemically synthesized
aggattactacgaagaagctcg

SEQ ID NO: 973280 - DNA, 22 bp, Artificial Sequence
  chemically synthesized
ggattactacgaagaagctcgg

SEQ ID NO: 973281 - DNA, 22 bp, Artificial Sequence
  chemically synthesized
cctgtgtgaggtttccgagctt

SEQ ID NO: 973282 - DNA, 22 bp, Artificial Sequence
  chemically synthesized
ccctgtgtgaggtttccgagct

SEQ ID NO: 973283 - DNA, 22 bp, Artificial Sequence
  chemically synthesized
tccctgtgtgaggtttccgagc

SEQ ID NO: 973284 - DNA, 22 bp, Artificial Sequence
  chemically synthesized
ttccctgtgtgaggtttccgag

SEQ ID NO: 973285 - DNA, 22 bp, Artificial Sequence
  chemically synthesized
ctacgaagaagctcggaaacct

SEQ ID NO: 973286 - DNA, 22 bp, Artificial Sequence
  chemically synthesized
cgaagaagctcggaaacctcac

SEQ ID NO: 973287 - DNA, 22 bp, Artificial Sequence
  chemically synthesized
catgacttttccctgtgtgagg

SEQ ID NO: 973288 - DNA, 22 bp, Artificial Sequence
  chemically synthesized
ggaaacctcacacagggaaaag

SEQ ID NO: 973289 - DNA, 22 bp, Artificial Sequence
  chemically synthesized
tgcccactacatgacttttccc

SEQ ID NO: 973290 - DNA, 22 bp, Artificial Sequence
  chemically synthesized
acacagggaaaagtcatgtagt

SEQ ID NO: 973291 - DNA, 22 bp, Artificial Sequence
  chemically synthesized
atcgtgctatgcccactacatg

SEQ ID NO: 973292 - DNA, 22 bp, Artificial Sequence
  chemically synthesized
taatcgtgctatgcccactaca

SEQ ID NO: 973293 - DNA, 22 bp, Artificial Sequence
  chemically synthesized
tagttctaatcgtgctatgccc

SEQ ID NO: 973294 - DNA, 22 bp, Artificial Sequence
  chemically synthesized
agggtgtgttatagttctaatc

SEQ ID NO: 973295 - DNA, 22 bp, Artificial Sequence
  chemically synthesized
attgagggtgtgttatagttct

SEQ ID NO: 973296 - DNA, 22 bp, Artificial Sequence
  chemically synthesized
gaactataacacaccctcaatt

SEQ ID NO: 973297 - DNA, 22 bp, Artificial Sequence
  chemically synthesized
taacacaccctcaattaacgtt

SEQ ID NO: 973298 - DNA, 22 bp, Artificial Sequence
  chemically synthesized
aattaacgttgatacctgctct

SEQ ID NO: 973299 - DNA, 22 bp, Artificial Sequence
  chemically synthesized
acgttgatacctgctcttattc

SEQ ID NO: 973300 - DNA, 22 bp, Artificial Sequence
  chemically synthesized
atacctgctcttattctcatcc

SEQ ID NO: 973301 - DNA, 22 bp, Artificial Sequence
  chemically synthesized
caatagcaatggtgaggatgag

SEQ ID NO: 973302 - DNA, 22 bp, Artificial Sequence
  chemically synthesized
ctcttattctcatcctcaccat

SEQ ID NO: 973303 - DNA, 22 bp, Artificial Sequence
  chemically synthesized
ttattctcatcctcaccattgc

SEQ ID NO: 973304 - DNA, 22 bp, Artificial Sequence
  chemically synthesized
attctcatcctcaccattgcta

SEQ ID NO: 973305 - DNA, 22 bp, Artificial Sequence
  chemically synthesized
ttctcatcctcaccattgctat

SEQ ID NO: 973306 - DNA, 22 bp, Artificial Sequence
  chemically synthesized
tcatcctcaccattgctattgt

SEQ ID NO: 973307 - DNA, 22 bp, Artificial Sequence
  chemically synthesized
atcctcaccattgctattgtaa

SEQ ID NO: 973308 - DNA, 22 bp, Artificial Sequence
  chemically synthesized
caaggggagaaaatagttacaa

SEQ ID NO: 973309 - DNA, 22 bp, Artificial Sequence
  chemically synthesized
accattgctattgtaactattt

SEQ ID NO: 973310 - DNA, 22 bp, Artificial Sequence
  chemically synthesized
ctattgtaactattttctcccc

SEQ ID NO: 973311 - DNA, 22 bp, Artificial Sequence
  chemically synthesized
ggaaccaattgcaaggggagaa

SEQ ID NO: 973312 - DNA, 22 bp, Artificial Sequence
  chemically synthesized
ttgtaactattttctccccttg

SEQ ID NO: 973313 - DNA, 22 bp, Artificial Sequence
  chemically synthesized
tgggaaccaattgcaaggggag

SEQ ID NO: 973314 - DNA, 22 bp, Artificial Sequence
  chemically synthesized
taactattttctccccttgcaa

SEQ ID NO: 973315 - DNA, 22 bp, Artificial Sequence
  chemically synthesized
ttttctccccttgcaattggtt

SEQ ID NO: 973316 - DNA, 22 bp, Artificial Sequence
  chemically synthesized
tgtgaaattctgggaaccaatt

SEQ ID NO: 973317 - DNA, 22 bp, Artificial Sequence
  chemically synthesized
tctccccttgcaattggttccc

SEQ ID NO: 973318 - DNA, 22 bp, Artificial Sequence
  chemically synthesized
atgtgaaattctgggaaccaat

SEQ ID NO: 973319 - DNA, 22 bp, Artificial Sequence
  chemically synthesized
ctccccttgcaattggttccca

SEQ ID NO: 973320 - DNA, 22 bp, Artificial Sequence
  chemically synthesized
tccccttgcaattggttcccag

SEQ ID NO: 973321 - DNA, 22 bp, Artificial Sequence
  chemically synthesized
cccttgcaattggttcccagaa

SEQ ID NO: 973322 - DNA, 22 bp, Artificial Sequence
  chemically synthesized
atagtttatgtgaaattctggg

SEQ ID NO: 973323 - DNA, 22 bp, Artificial Sequence
  chemically synthesized
gcaattggttcccagaatttca

SEQ ID NO: 973324 - DNA, 22 bp, Artificial Sequence
  chemically synthesized
caattggttcccagaatttcac

SEQ ID NO: 973325 - DNA, 22 bp, Artificial Sequence
  chemically synthesized
gattcatagtttatgtgaaatt

SEQ ID NO: 973326 - DNA, 22 bp, Artificial Sequence
  chemically synthesized
gttcccagaatttcacataaac

SEQ ID NO: 973327 - DNA, 22 bp, Artificial Sequence
  chemically synthesized
aaactggattcatagtttatgt

SEQ ID NO: 973328 - DNA, 22 bp, Artificial Sequence
  chemically synthesized
ccagaatttcacataaactatg

SEQ ID NO: 973329 - DNA, 22 bp, Artificial Sequence
  chemically synthesized
agttcaaactggattcatagtt

SEQ ID NO: 973330 - DNA, 22 bp, Artificial Sequence
  chemically synthesized
cacataaactatgaatccagtt

SEQ ID NO: 973331 - DNA, 22 bp, Artificial Sequence
  chemically synthesized
acataaactatgaatccagttt

SEQ ID NO: 973332 - DNA, 22 bp, Artificial Sequence
  chemically synthesized
aataaatattaagttcaaactg

SEQ ID NO: 973333 - DNA, 22 bp, Artificial Sequence
  chemically synthesized
tgaatccagtttgaacttaata

SEQ ID NO: 973334 - DNA, 22 bp, Artificial Sequence
  chemically synthesized
gaagaaaataattcaataaata

SEQ ID NO: 973335 - DNA, 22 bp, Artificial Sequence
  chemically synthesized
agaagaaaataattcaataaat

SEQ ID NO: 973336 - DNA, 22 bp, Artificial Sequence
  chemically synthesized
gaacttaatatttattgaatta

SEQ ID NO: 973337 - DNA, 22 bp, Artificial Sequence
  chemically synthesized
aacttaatatttattgaattat

SEQ ID NO: 973338 - DNA, 22 bp, Artificial Sequence
  chemically synthesized
aatatttattgaattattttct

SEQ ID NO: 973339 - DNA, 22 bp, Artificial Sequence
  chemically synthesized
gaaatgtttagaagaaaataat

SEQ ID NO: 973340 - DNA, 22 bp, Artificial Sequence
  chemically synthesized
atatttattgaattattttctt

SEQ ID NO: 973341 - DNA, 22 bp, Artificial Sequence
  chemically synthesized
attgaattattttcttctaaac

SEQ ID NO: 973342 - DNA, 22 bp, Artificial Sequence
  chemically synthesized
ttgaattattttcttctaaaca

SEQ ID NO: 973343 - DNA, 22 bp, Artificial Sequence
  chemically synthesized
aattattttcttctaaacattt

SEQ ID NO: 973344 - DNA, 22 bp, Artificial Sequence
  chemically synthesized
ttttcttctaaacatttctaat

SEQ ID NO: 973345 - DNA, 22 bp, Artificial Sequence
  chemically synthesized
aagaaatgggaaaattagaaat

SEQ ID NO: 973346 - DNA, 22 bp, Artificial Sequence
  chemically synthesized
caagaaatgggaaaattagaaa

SEQ ID NO: 973347 - DNA, 22 bp, Artificial Sequence
  chemically synthesized
tcttctaaacatttctaatttt

SEQ ID NO: 973348 - DNA, 22 bp, Artificial Sequence
  chemically synthesized
tcaagaaatgggaaaattagaa

SEQ ID NO: 973349 - DNA, 22 bp, Artificial Sequence
  chemically synthesized
cttctaaacatttctaattttc

SEQ ID NO: 973350 - DNA, 22 bp, Artificial Sequence
  chemically synthesized
ttcaagaaatgggaaaattaga

SEQ ID NO: 973351 - DNA, 22 bp, Artificial Sequence
  chemically synthesized
ttctaaacatttctaattttcc

SEQ ID NO: 973352 - DNA, 22 bp, Artificial Sequence
  chemically synthesized
ttttcaagaaatgggaaaatta

SEQ ID NO: 973353 - DNA, 22 bp, Artificial Sequence
  chemically synthesized
ctaaacatttctaattttccca

SEQ ID NO: 973354 - DNA, 22 bp, Artificial Sequence
  chemically synthesized
taaacatttctaattttcccat

SEQ ID NO: 973355 - DNA, 22 bp, Artificial Sequence
  chemically synthesized
aacatttctaattttcccattt

SEQ ID NO: 973356 - DNA, 22 bp, Artificial Sequence
  chemically synthesized
gtaaaagttcttttcaagaaat

SEQ ID NO: 973357 - DNA, 22 bp, Artificial Sequence
  chemically synthesized
ctaattttcccatttcttgaaa

SEQ ID NO: 973358 - DNA, 22 bp, Artificial Sequence
  chemically synthesized
taattttcccatttcttgaaaa

SEQ ID NO: 973359 - DNA, 22 bp, Artificial Sequence
  chemically synthesized
attttcccatttcttgaaaaga

SEQ ID NO: 973360 - DNA, 22 bp, Artificial Sequence
  chemically synthesized
tcccatttcttgaaaagaactt

SEQ ID NO: 973361 - DNA, 22 bp, Artificial Sequence
  chemically synthesized
cccatttcttgaaaagaacttt

SEQ ID NO: 973362 - DNA, 22 bp, Artificial Sequence
  chemically synthesized
ccatttcttgaaaagaactttt

SEQ ID NO: 973363 - DNA, 22 bp, Artificial Sequence
  chemically synthesized
cttgaaaagaacttttaccaga

SEQ ID NO: 973364 - DNA, 22 bp, Artificial Sequence
  chemically synthesized
ttgaaaagaacttttaccagat

SEQ ID NO: 973365 - DNA, 22 bp, Artificial Sequence
  chemically synthesized
aatatgaataacatctggtaaa

SEQ ID NO: 973366 - DNA, 22 bp, Artificial Sequence
  chemically synthesized
gaaaagaacttttaccagatgt

SEQ ID NO: 973367 - DNA, 22 bp, Artificial Sequence
  chemically synthesized
aaaagaacttttaccagatgtt

SEQ ID NO: 973368 - DNA, 22 bp, Artificial Sequence
  chemically synthesized
caattcaatatgaataacatct

SEQ ID NO: 973369 - DNA, 22 bp, Artificial Sequence
  chemically synthesized
acaattcaatatgaataacatc

SEQ ID NO: 973370 - DNA, 22 bp, Artificial Sequence
  chemically synthesized
aatttacaattcaatatgaata

SEQ ID NO: 973371 - DNA, 22 bp, Artificial Sequence
  chemically synthesized
ttaccagatgttattcatattg

SEQ ID NO: 973372 - DNA, 22 bp, Artificial Sequence
  chemically synthesized
aaatttacaattcaatatgaat

SEQ ID NO: 973373 - DNA, 22 bp, Artificial Sequence
  chemically synthesized
taccagatgttattcatattga

SEQ ID NO: 973374 - DNA, 22 bp, Artificial Sequence
  chemically synthesized
taaatttacaattcaatatgaa

SEQ ID NO: 973375 - DNA, 22 bp, Artificial Sequence
  chemically synthesized
accagatgttattcatattgaa

SEQ ID NO: 973376 - DNA, 22 bp, Artificial Sequence
  chemically synthesized
ccagatgttattcatattgaat

SEQ ID NO: 973377 - DNA, 22 bp, Artificial Sequence
  chemically synthesized
taatagttttaaatttacaatt

SEQ ID NO: 973378 - DNA, 22 bp, Artificial Sequence
  chemically synthesized
ttcatattgaattgtaaattta

SEQ ID NO: 973379 - DNA, 22 bp, Artificial Sequence
  chemically synthesized
ttataatagttttaaatttaca

SEQ ID NO: 973380 - DNA, 22 bp, Artificial Sequence
  chemically synthesized
attataatagttttaaatttac

SEQ ID NO: 973381 - DNA, 22 bp, Artificial Sequence
  chemically synthesized
atattgaattgtaaatttaaaa

SEQ ID NO: 973382 - DNA, 22 bp, Artificial Sequence
  chemically synthesized
agcttattataatagttttaaa

SEQ ID NO: 973383 - DNA, 22 bp, Artificial Sequence
  chemically synthesized
cagcttattataatagttttaa

SEQ ID NO: 973384 - DNA, 22 bp, Artificial Sequence
  chemically synthesized
aattgtaaatttaaaactatta

SEQ ID NO: 973385 - DNA, 22 bp, Artificial Sequence
  chemically synthesized
taaatttaaaactattataata

SEQ ID NO: 973386 - DNA, 22 bp, Artificial Sequence
  chemically synthesized
aaaactattataataagctgaa

SEQ ID NO: 973387 - DNA, 22 bp, Artificial Sequence
  chemically synthesized
aaactattataataagctgaaa

SEQ ID NO: 973388 - DNA, 22 bp, Artificial Sequence
  chemically synthesized
accaagggatatatttcagctt

SEQ ID NO: 973389 - DNA, 22 bp, Artificial Sequence
  chemically synthesized
taaccaagggatatatttcagc

SEQ ID NO: 973390 - DNA, 22 bp, Artificial Sequence
  chemically synthesized
ttataataagctgaaatatatc

SEQ ID NO: 973391 - DNA, 22 bp, Artificial Sequence
  chemically synthesized
taataagctgaaatatatccct

SEQ ID NO: 973392 - DNA, 22 bp, Artificial Sequence
  chemically synthesized
agtcctctaaccaagggatata

SEQ ID NO: 973393 - DNA, 22 bp, Artificial Sequence
  chemically synthesized
aaatatatcccttggttagagg

SEQ ID NO: 973394 - DNA, 22 bp, Artificial Sequence
  chemically synthesized
gtaaagtgttaagtcctctaac

SEQ ID NO: 973395 - DNA, 22 bp, Artificial Sequence
  chemically synthesized
tattggtaaagtgttaagtcct

SEQ ID NO: 973396 - DNA, 22 bp, Artificial Sequence
  chemically synthesized
ttatattggtaaagtgttaagt

SEQ ID NO: 973397 - DNA, 22 bp, Artificial Sequence
  chemically synthesized
ggttagaggacttaacacttta

SEQ ID NO: 973398 - DNA, 22 bp, Artificial Sequence
  chemically synthesized
gttagaggacttaacactttac

SEQ ID NO: 973399 - DNA, 22 bp, Artificial Sequence
  chemically synthesized
taattgttatattggtaaagtg

SEQ ID NO: 973400 - DNA, 22 bp, Artificial Sequence
  chemically synthesized
gaggacttaacactttaccaat

SEQ ID NO: 973401 - DNA, 22 bp, Artificial Sequence
  chemically synthesized
attataattgttatattggtaa

SEQ ID NO: 973402 - DNA, 22 bp, Artificial Sequence
  chemically synthesized
ctgattataattgttatattgg

SEQ ID NO: 973403 - DNA, 22 bp, Artificial Sequence
  chemically synthesized
actgattataattgttatattg

SEQ ID NO: 973404 - DNA, 22 bp, Artificial Sequence
  chemically synthesized
aacactttaccaatataacaat

SEQ ID NO: 973405 - DNA, 22 bp, Artificial Sequence
  chemically synthesized
ttactgattataattgttatat

SEQ ID NO: 973406 - DNA, 22 bp, Artificial Sequence
  chemically synthesized
acactttaccaatataacaatt

SEQ ID NO: 973407 - DNA, 22 bp, Artificial Sequence
  chemically synthesized
taccaatataacaattataatc

SEQ ID NO: 973408 - DNA, 22 bp, Artificial Sequence
  chemically synthesized
accaatataacaattataatca

SEQ ID NO: 973409 - DNA, 22 bp, Artificial Sequence
  chemically synthesized
ccaatataacaattataatcag

SEQ ID NO: 973410 - DNA, 22 bp, Artificial Sequence
  chemically synthesized
tatagaagcaatgttcttactg

SEQ ID NO: 973411 - DNA, 22 bp, Artificial Sequence
  chemically synthesized
taatcagtaagaacattgcttc

SEQ ID NO: 973412 - DNA, 22 bp, Artificial Sequence
  chemically synthesized
taataaaatgttatatagaagc

SEQ ID NO: 973413 - DNA, 22 bp, Artificial Sequence
  chemically synthesized
tagcaaaattgtaataaaatgt

SEQ ID NO: 973414 - DNA, 22 bp, Artificial Sequence
  chemically synthesized
cttctatataacattttattac

SEQ ID NO: 973415 - DNA, 22 bp, Artificial Sequence
  chemically synthesized
ctatataacattttattacaat

SEQ ID NO: 973416 - DNA, 22 bp, Artificial Sequence
  chemically synthesized
aactatagcaaaattgtaataa

SEQ ID NO: 973417 - DNA, 22 bp, Artificial Sequence
  chemically synthesized
tatataacattttattacaatt

SEQ ID NO: 973418 - DNA, 22 bp, Artificial Sequence
  chemically synthesized
aaactatagcaaaattgtaata

SEQ ID NO: 973419 - DNA, 22 bp, Artificial Sequence
  chemically synthesized
tataacattttattacaatttt

SEQ ID NO: 973420 - DNA, 22 bp, Artificial Sequence
  chemically synthesized
tattacaattttgctatagttt

SEQ ID NO: 973421 - DNA, 22 bp, Artificial Sequence
  chemically synthesized
ggggacacatttaaactatagc

SEQ ID NO: 973422 - DNA, 22 bp, Artificial Sequence
  chemically synthesized
attacaattttgctatagttta

SEQ ID NO: 973423 - DNA, 22 bp, Artificial Sequence
  chemically synthesized
gggggacacatttaaactatag

SEQ ID NO: 973424 - DNA, 22 bp, Artificial Sequence
  chemically synthesized
ttacaattttgctatagtttaa

SEQ ID NO: 973425 - DNA, 22 bp, Artificial Sequence
  chemically synthesized
caattttgctatagtttaaatg

SEQ ID NO: 973426 - DNA, 22 bp, Artificial Sequence
  chemically synthesized
tgctatagtttaaatgtgtccc

SEQ ID NO: 973427 - DNA, 22 bp, Artificial Sequence
  chemically synthesized
gctatagtttaaatgtgtcccc

SEQ ID NO: 973428 - DNA, 22 bp, Artificial Sequence
  chemically synthesized
ctatagtttaaatgtgtccccc

SEQ ID NO: 973429 - DNA, 22 bp, Artificial Sequence
  chemically synthesized
tagtttaaatgtgtcccccaaa

SEQ ID NO: 973430 - DNA, 22 bp, Artificial Sequence
  chemically synthesized
caacacatgaaatttgggggac

SEQ ID NO: 973431 - DNA, 22 bp, Artificial Sequence
  chemically synthesized
ccaacacatgaaatttggggga

SEQ ID NO: 973432 - DNA, 22 bp, Artificial Sequence
  chemically synthesized
aaatgtgtcccccaaatttcat

SEQ ID NO: 973433 - DNA, 22 bp, Artificial Sequence
  chemically synthesized
agtttccaacacatgaaatttg

SEQ ID NO: 973434 - DNA, 22 bp, Artificial Sequence
  chemically synthesized
aatgtgtcccccaaatttcatg

SEQ ID NO: 973435 - DNA, 22 bp, Artificial Sequence
  chemically synthesized
gggattaagtttccaacacatg

SEQ ID NO: 973436 - DNA, 22 bp, Artificial Sequence
  chemically synthesized
ccacgttggggattaagtttcc

SEQ ID NO: 973437 - DNA, 22 bp, Artificial Sequence
  chemically synthesized
catgtgttggaaacttaatccc

SEQ ID NO: 973438 - DNA, 22 bp, Artificial Sequence
  chemically synthesized
atgtgttggaaacttaatcccc

SEQ ID NO: 973439 - DNA, 22 bp, Artificial Sequence
  chemically synthesized
ccggtgctgccacgttggggat

SEQ ID NO: 973440 - DNA, 22 bp, Artificial Sequence
  chemically synthesized
gaaacttaatccccaacgtggc

SEQ ID NO: 973441 - DNA, 22 bp, Artificial Sequence
  chemically synthesized
aatccccaacgtggcagcaccg

SEQ ID NO: 973442 - DNA, 22 bp, Artificial Sequence
  chemically synthesized
atccccaacgtggcagcaccgg

SEQ ID NO: 973443 - DNA, 22 bp, Artificial Sequence
  chemically synthesized
aaggcacaatctcccggtgctg

SEQ ID NO: 973444 - DNA, 22 bp, Artificial Sequence
  chemically synthesized
aaaggcacaatctcccggtgct

SEQ ID NO: 973445 - DNA, 22 bp, Artificial Sequence
  chemically synthesized
ttaaaggcacaatctcccggtg

SEQ ID NO: 973446 - DNA, 22 bp, Artificial Sequence
  chemically synthesized
atgatgcaatcacctcttaaag

SEQ ID NO: 973447 - DNA, 22 bp, Artificial Sequence
  chemically synthesized
tgcctttaagaggtgattgcat

SEQ ID NO: 973448 - DNA, 22 bp, Artificial Sequence
  chemically synthesized
taagaggtgattgcatcatgag

SEQ ID NO: 973449 - DNA, 22 bp, Artificial Sequence
  chemically synthesized
aagaggtgattgcatcatgagg

SEQ ID NO: 973450 - DNA, 22 bp, Artificial Sequence
  chemically synthesized
agaggtgattgcatcatgaggg

SEQ ID NO: 973451 - DNA, 22 bp, Artificial Sequence
  chemically synthesized
ataagggcagagccctcatgat

SEQ ID NO: 973452 - DNA, 22 bp, Artificial Sequence
  chemically synthesized
catcatgagggctctgccctta

SEQ ID NO: 973453 - DNA, 22 bp, Artificial Sequence
  chemically synthesized
tgaatggatgaatccattcata

SEQ ID NO: 973454 - DNA, 22 bp, Artificial Sequence
  chemically synthesized
atgaatggatgaatccattcat

SEQ ID NO: 973455 - DNA, 22 bp, Artificial Sequence
  chemically synthesized
atttatgaatggatgaatccat

SEQ ID NO: 973456 - DNA, 22 bp, Artificial Sequence
  chemically synthesized
tgcccttatgaatggattcatc

SEQ ID NO: 973457 - DNA, 22 bp, Artificial Sequence
  chemically synthesized
cccttatgaatggattcatcca

SEQ ID NO: 973458 - DNA, 22 bp, Artificial Sequence
  chemically synthesized
ttaatttatgaatggatgaatc

SEQ ID NO: 973459 - DNA, 22 bp, Artificial Sequence
  chemically synthesized
atgaatggattcatccattcat

SEQ ID NO: 973460 - DNA, 22 bp, Artificial Sequence
  chemically synthesized
acctattaatttatgaatggat

SEQ ID NO: 973461 - DNA, 22 bp, Artificial Sequence
  chemically synthesized
tgaatggattcatccattcata

SEQ ID NO: 973462 - DNA, 22 bp, Artificial Sequence
  chemically synthesized
atccattcataaattaataggt

SEQ ID NO: 973463 - DNA, 22 bp, Artificial Sequence
  chemically synthesized
ccatgataacccattaacctat

SEQ ID NO: 973464 - DNA, 22 bp, Artificial Sequence
  chemically synthesized
ctcccatgataacccattaacc

SEQ ID NO: 973465 - DNA, 22 bp, Artificial Sequence
  chemically synthesized
ataaattaataggttaatgggt

SEQ ID NO: 973466 - DNA, 22 bp, Artificial Sequence
  chemically synthesized
ataggttaatgggttatcatgg

SEQ ID NO: 973467 - DNA, 22 bp, Artificial Sequence
  chemically synthesized
atgggttatcatgggagtagga

SEQ ID NO: 973468 - DNA, 22 bp, Artificial Sequence
  chemically synthesized
taaaatcatgaatcctactccc

SEQ ID NO: 973469 - DNA, 22 bp, Artificial Sequence
  chemically synthesized
ataaaatcatgaatcctactcc

SEQ ID NO: 973470 - DNA, 22 bp, Artificial Sequence
  chemically synthesized
ttataaaatcatgaatcctact

SEQ ID NO: 973471 - DNA, 22 bp, Artificial Sequence
  chemically synthesized
ttcttataaaatcatgaatcct

SEQ ID NO: 973472 - DNA, 22 bp, Artificial Sequence
  chemically synthesized
tcatgggagtaggattcatgat

SEQ ID NO: 973473 - DNA, 22 bp, Artificial Sequence
  chemically synthesized
ctgttcttataaaatcatgaat

SEQ ID NO: 973474 - DNA, 22 bp, Artificial Sequence
  chemically synthesized
cctgttcttataaaatcatgaa

SEQ ID NO: 973475 - DNA, 22 bp, Artificial Sequence
  chemically synthesized
ttcctgttcttataaaatcatg

SEQ ID NO: 973476 - DNA, 22 bp, Artificial Sequence
  chemically synthesized
tcttcctgttcttataaaatca

SEQ ID NO: 973477 - DNA, 22 bp, Artificial Sequence
  chemically synthesized
atgtctctcttcctgttcttat

SEQ ID NO: 973478 - DNA, 22 bp, Artificial Sequence
  chemically synthesized
atgattttataagaacaggaag

SEQ ID NO: 973479 - DNA, 22 bp, Artificial Sequence
  chemically synthesized
atgtgttcatgtctctcttcct

SEQ ID NO: 973480 - DNA, 22 bp, Artificial Sequence
  chemically synthesized
taatgtgttcatgtctctcttc

SEQ ID NO: 973481 - DNA, 22 bp, Artificial Sequence
  chemically synthesized
tataagaacaggaagagagaca

SEQ ID NO: 973482 - DNA, 22 bp, Artificial Sequence
  chemically synthesized
ataagaacaggaagagagacat

SEQ ID NO: 973483 - DNA, 22 bp, Artificial Sequence
  chemically synthesized
taagaacaggaagagagacatg

SEQ ID NO: 973484 - DNA, 22 bp, Artificial Sequence
  chemically synthesized
agtattctaatgtgttcatgtc

SEQ ID NO: 973485 - DNA, 22 bp, Artificial Sequence
  chemically synthesized
catggcaagaaggctgagtatt

SEQ ID NO: 973486 - DNA, 22 bp, Artificial Sequence
  chemically synthesized
gaatactcagccttcttgccat

SEQ ID NO: 973487 - DNA, 22 bp, Artificial Sequence
  chemically synthesized
aggcagtgcaggacattacatg

SEQ ID NO: 973488 - DNA, 22 bp, Artificial Sequence
  chemically synthesized
agccttcttgccatgtaatgtc

SEQ ID NO: 973489 - DNA, 22 bp, Artificial Sequence
  chemically synthesized
cttgccatgtaatgtcctgcac

SEQ ID NO: 973490 - DNA, 22 bp, Artificial Sequence
  chemically synthesized
ttgccatgtaatgtcctgcact

SEQ ID NO: 973491 - DNA, 22 bp, Artificial Sequence
  chemically synthesized
gccatgtaatgtcctgcactgc

SEQ ID NO: 973492 - DNA, 22 bp, Artificial Sequence
  chemically synthesized
ccatgtaatgtcctgcactgcc

SEQ ID NO: 973493 - DNA, 22 bp, Artificial Sequence
  chemically synthesized
atggggacacagcagagccctg

SEQ ID NO: 973494 - DNA, 22 bp, Artificial Sequence
  chemically synthesized
ctcatggggacacagcagagcc

SEQ ID NO: 973495 - DNA, 22 bp, Artificial Sequence
  chemically synthesized
cactgcctcagggctctgctgt

SEQ ID NO: 973496 - DNA, 22 bp, Artificial Sequence
  chemically synthesized
gctcatggggacacagcagagc

SEQ ID NO: 973497 - DNA, 22 bp, Artificial Sequence
  chemically synthesized
tgctcatggggacacagcagag

SEQ ID NO: 973498 - DNA, 22 bp, Artificial Sequence
  chemically synthesized
ttgctcatggggacacagcaga

SEQ ID NO: 973499 - DNA, 22 bp, Artificial Sequence
  chemically synthesized
tttgctcatggggacacagcag

SEQ ID NO: 973500 - DNA, 22 bp, Artificial Sequence
  chemically synthesized
cctcagggctctgctgtgtccc

SEQ ID NO: 973501 - DNA, 22 bp, Artificial Sequence
  chemically synthesized
agggctctgctgtgtccccatg

SEQ ID NO: 973502 - DNA, 22 bp, Artificial Sequence
  chemically synthesized
gagcctttttgctcatggggac

SEQ ID NO: 973503 - DNA, 22 bp, Artificial Sequence
  chemically synthesized
ttagagcctttttgctcatggg

SEQ ID NO: 973504 - DNA, 22 bp, Artificial Sequence
  chemically synthesized
gttagagcctttttgctcatgg

SEQ ID NO: 973505 - DNA, 22 bp, Artificial Sequence
  chemically synthesized
tgctgtgtccccatgagcaaaa

SEQ ID NO: 973506 - DNA, 22 bp, Artificial Sequence
  chemically synthesized
ctgtgtccccatgagcaaaaag

SEQ ID NO: 973507 - DNA, 22 bp, Artificial Sequence
  chemically synthesized
tgtccccatgagcaaaaaggct

SEQ ID NO: 973508 - DNA, 22 bp, Artificial Sequence
  chemically synthesized
tagacttgttagagcctttttg

SEQ ID NO: 973509 - DNA, 22 bp, Artificial Sequence
  chemically synthesized
gtgtggctgtagacttgttaga

SEQ ID NO: 973510 - DNA, 22 bp, Artificial Sequence
  chemically synthesized
ggctggtgtggctgtagacttg

SEQ ID NO: 973511 - DNA, 22 bp, Artificial Sequence
  chemically synthesized
aggctggtgtggctgtagactt

SEQ ID NO: 973512 - DNA, 22 bp, Artificial Sequence
  chemically synthesized
taacaagtctacagccacacca

SEQ ID NO: 973513 - DNA, 22 bp, Artificial Sequence
  chemically synthesized
acaagtctacagccacaccagc

SEQ ID NO: 973514 - DNA, 22 bp, Artificial Sequence
  chemically synthesized
cagccacaccagcctaaacgcg

SEQ ID NO: 973515 - DNA, 22 bp, Artificial Sequence
  chemically synthesized
caagatcagataagagtgggcg

SEQ ID NO: 973516 - DNA, 22 bp, Artificial Sequence
  chemically synthesized
ccaagatcagataagagtgggc

SEQ ID NO: 973517 - DNA, 22 bp, Artificial Sequence
  chemically synthesized
gcttccaagatcagataagagt

SEQ ID NO: 973518 - DNA, 22 bp, Artificial Sequence
  chemically synthesized
agcttccaagatcagataagag

SEQ ID NO: 973519 - DNA, 22 bp, Artificial Sequence
  chemically synthesized
aacgcgcccactcttatctgat

SEQ ID NO: 973520 - DNA, 22 bp, Artificial Sequence
  chemically synthesized
acttagcttccaagatcagata

SEQ ID NO: 973521 - DNA, 22 bp, Artificial Sequence
  chemically synthesized
ttatctgatcttggaagctaag

SEQ ID NO: 973522 - DNA, 22 bp, Artificial Sequence
  chemically synthesized
atctgatcttggaagctaagtg

SEQ ID NO: 973523 - DNA, 22 bp, Artificial Sequence
  chemically synthesized
tctgatcttggaagctaagtga

SEQ ID NO: 973524 - DNA, 22 bp, Artificial Sequence
  chemically synthesized
accaggtcgaacctcacttagc

SEQ ID NO: 973525 - DNA, 22 bp, Artificial Sequence
  chemically synthesized
atcttggaagctaagtgaggtt

SEQ ID NO: 973526 - DNA, 22 bp, Artificial Sequence
  chemically synthesized
ggaagctaagtgaggttcgacc

SEQ ID NO: 973527 - DNA, 22 bp, Artificial Sequence
  chemically synthesized
gaagctaagtgaggttcgacct

SEQ ID NO: 973528 - DNA, 22 bp, Artificial Sequence
  chemically synthesized
ccatccaagtactaaccaggtc

SEQ ID NO: 973529 - DNA, 22 bp, Artificial Sequence
  chemically synthesized
agtgaggttcgacctggttagt

SEQ ID NO: 973530 - DNA, 22 bp, Artificial Sequence
  chemically synthesized
tcccatccaagtactaaccagg

SEQ ID NO: 973531 - DNA, 22 bp, Artificial Sequence
  chemically synthesized
ctcccatccaagtactaaccag

SEQ ID NO: 973532 - DNA, 22 bp, Artificial Sequence
  chemically synthesized
gacctggttagtacttggatgg

SEQ ID NO: 973533 - DNA, 22 bp, Artificial Sequence
  chemically synthesized
gtcagagccttctcccatccaa

SEQ ID NO: 973534 - DNA, 22 bp, Artificial Sequence
  chemically synthesized
gttagtacttggatgggagaag

SEQ ID NO: 973535 - DNA, 22 bp, Artificial Sequence
  chemically synthesized
gtacttggatgggagaaggctc

SEQ ID NO: 973536 - DNA, 22 bp, Artificial Sequence
  chemically synthesized
ggatgggagaaggctctgacca

SEQ ID NO: 973537 - DNA, 22 bp, Artificial Sequence
  chemically synthesized
aggggccacatctggtcagagc

SEQ ID NO: 973538 - DNA, 22 bp, Artificial Sequence
  chemically synthesized
gatgggagaaggctctgaccag

SEQ ID NO: 973539 - DNA, 22 bp, Artificial Sequence
  chemically synthesized
agaagtccaaggttgaggggcc

SEQ ID NO: 973540 - DNA, 22 bp, Artificial Sequence
  chemically synthesized
tgaccagatgtggcccctcaac

SEQ ID NO: 973541 - DNA, 22 bp, Artificial Sequence
  chemically synthesized
accagatgtggcccctcaacct

SEQ ID NO: 973542 - DNA, 22 bp, Artificial Sequence
  chemically synthesized
cggaggctgagaagtccaaggt

SEQ ID NO: 973543 - DNA, 22 bp, Artificial Sequence
  chemically synthesized
cagttacggaggctgagaagtc

SEQ ID NO: 973544 - DNA, 22 bp, Artificial Sequence
  chemically synthesized
acagttacggaggctgagaagt

SEQ ID NO: 973545 - DNA, 22 bp, Artificial Sequence
  chemically synthesized
ttacagttacggaggctgagaa

SEQ ID NO: 973546 - DNA, 22 bp, Artificial Sequence
  chemically synthesized
cttacagttacggaggctgaga

SEQ ID NO: 973547 - DNA, 22 bp, Artificial Sequence
  chemically synthesized
aaccttggacttctcagcctcc

SEQ ID NO: 973548 - DNA, 22 bp, Artificial Sequence
  chemically synthesized
cttcttacagttacggaggctg

SEQ ID NO: 973549 - DNA, 22 bp, Artificial Sequence
  chemically synthesized
acttcttacagttacggaggct

SEQ ID NO: 973550 - DNA, 22 bp, Artificial Sequence
  chemically synthesized
ggacttctcagcctccgtaact

SEQ ID NO: 973551 - DNA, 22 bp, Artificial Sequence
  chemically synthesized
gacttctcagcctccgtaactg

SEQ ID NO: 973552 - DNA, 22 bp, Artificial Sequence
  chemically synthesized
ctcagcctccgtaactgtaaga

SEQ ID NO: 973553 - DNA, 22 bp, Artificial Sequence
  chemically synthesized
tcagcctccgtaactgtaagaa

SEQ ID NO: 973554 - DNA, 22 bp, Artificial Sequence
  chemically synthesized
agcctccgtaactgtaagaagt

SEQ ID NO: 973555 - DNA, 22 bp, Artificial Sequence
  chemically synthesized
caaagaaaaggagtttacttct

SEQ ID NO: 973556 - DNA, 22 bp, Artificial Sequence
  chemically synthesized
acaaagaaaaggagtttacttc

SEQ ID NO: 973557 - DNA, 22 bp, Artificial Sequence
  chemically synthesized
cgtaactgtaagaagtaaactc

SEQ ID NO: 973558 - DNA, 22 bp, Artificial Sequence
  chemically synthesized
taagaagtaaactccttttctt

SEQ ID NO: 973559 - DNA, 22 bp, Artificial Sequence
  chemically synthesized
aaaatgggtaatttacaaagaa

SEQ ID NO: 973560 - DNA, 22 bp, Artificial Sequence
  chemically synthesized
cttttctttgtaaattacccat

SEQ ID NO: 973561 - DNA, 22 bp, Artificial Sequence
  chemically synthesized
ttctttgtaaattacccatttt

SEQ ID NO: 973562 - DNA, 22 bp, Artificial Sequence
  chemically synthesized
tctttgtaaattacccattttc

SEQ ID NO: 973563 - DNA, 22 bp, Artificial Sequence
  chemically synthesized
ctttgtaaattacccattttca

SEQ ID NO: 973564 - DNA, 22 bp, Artificial Sequence
  chemically synthesized
taacagaatacctgaaaatggg

SEQ ID NO: 973565 - DNA, 22 bp, Artificial Sequence
  chemically synthesized
tttgtaaattacccattttcag

SEQ ID NO: 973566 - DNA, 22 bp, Artificial Sequence
  chemically synthesized
gtaacagaatacctgaaaatgg

SEQ ID NO: 973567 - DNA, 22 bp, Artificial Sequence
  chemically synthesized
tgtaaattacccattttcaggt

SEQ ID NO: 973568 - DNA, 22 bp, Artificial Sequence
  chemically synthesized
gtaaattacccattttcaggta

SEQ ID NO: 973569 - DNA, 22 bp, Artificial Sequence
  chemically synthesized
cttgtaacagaatacctgaaaa

SEQ ID NO: 973570 - DNA, 22 bp, Artificial Sequence
  chemically synthesized
taaattacccattttcaggtat

SEQ ID NO: 973571 - DNA, 22 bp, Artificial Sequence
  chemically synthesized
ttgcttgtaacagaatacctga

SEQ ID NO: 973572 - DNA, 22 bp, Artificial Sequence
  chemically synthesized
ctgttgcttgtaacagaatacc

SEQ ID NO: 973573 - DNA, 22 bp, Artificial Sequence
  chemically synthesized
gctgttgcttgtaacagaatac

SEQ ID NO: 973574 - DNA, 22 bp, Artificial Sequence
  chemically synthesized
cccattttcaggtattctgtta

SEQ ID NO: 973575 - DNA, 22 bp, Artificial Sequence
  chemically synthesized
tcaggtattctgttacaagcaa

SEQ ID NO: 973576 - DNA, 22 bp, Artificial Sequence
  chemically synthesized
caggtattctgttacaagcaac

SEQ ID NO: 973577 - DNA, 22 bp, Artificial Sequence
  chemically synthesized
agtccatttgctgttgcttgta

SEQ ID NO: 973578 - DNA, 22 bp, Artificial Sequence
  chemically synthesized
aggtattctgttacaagcaaca

SEQ ID NO: 973579 - DNA, 22 bp, Artificial Sequence
  chemically synthesized
gtctaagtccatttgctgttgc

SEQ ID NO: 973580 - DNA, 22 bp, Artificial Sequence
  chemically synthesized
tgttacaagcaacagcaaatgg

SEQ ID NO: 973581 - DNA, 22 bp, Artificial Sequence
  chemically synthesized
ttacaagcaacagcaaatggac

SEQ ID NO: 973582 - DNA, 22 bp, Artificial Sequence
  chemically synthesized
caagcaacagcaaatggactta

SEQ ID NO: 973583 - DNA, 22 bp, Artificial Sequence
  chemically synthesized
tgaaagaattcgtctaagtcca

SEQ ID NO: 973584 - DNA, 22 bp, Artificial Sequence
  chemically synthesized
tactgtgaaagaattcgtctaa

SEQ ID NO: 973585 - DNA, 22 bp, Artificial Sequence
  chemically synthesized
atactgtgaaagaattcgtcta

SEQ ID NO: 973586 - DNA, 22 bp, Artificial Sequence
  chemically synthesized
agacgaattctttcacagtata

SEQ ID NO: 973587 - DNA, 22 bp, Artificial Sequence
  chemically synthesized
gacgaattctttcacagtataa

SEQ ID NO: 973588 - DNA, 22 bp, Artificial Sequence
  chemically synthesized
tgtgtcaataaaatcttatact

SEQ ID NO: 973589 - DNA, 22 bp, Artificial Sequence
  chemically synthesized
tttcacagtataagattttatt

SEQ ID NO: 973590 - DNA, 22 bp, Artificial Sequence
  chemically synthesized
tcacagtataagattttattga

SEQ ID NO: 973591 - DNA, 22 bp, Artificial Sequence
  chemically synthesized
cacagtataagattttattgac

SEQ ID NO: 973592 - DNA, 22 bp, Artificial Sequence
  chemically synthesized
aacacactatgtgtcaataaaa

SEQ ID NO: 973593 - DNA, 22 bp, Artificial Sequence
  chemically synthesized
acagtataagattttattgaca

SEQ ID NO: 973594 - DNA, 22 bp, Artificial Sequence
  chemically synthesized
ttcaacacactatgtgtcaata

SEQ ID NO: 973595 - DNA, 22 bp, Artificial Sequence
  chemically synthesized
attcaacacactatgtgtcaat

SEQ ID NO: 973596 - DNA, 22 bp, Artificial Sequence
  chemically synthesized
tttattcaacacactatgtgtc

SEQ ID NO: 973597 - DNA, 22 bp, Artificial Sequence
  chemically synthesized
ttatttattcaacacactatgt

SEQ ID NO: 973598 - DNA, 22 bp, Artificial Sequence
  chemically synthesized
tgttatttattcaacacactat

SEQ ID NO: 973599 - DNA, 22 bp, Artificial Sequence
  chemically synthesized
tattgacacatagtgtgttgaa

SEQ ID NO: 973600 - DNA, 22 bp, Artificial Sequence
  chemically synthesized
attgacacatagtgtgttgaat

SEQ ID NO: 973601 - DNA, 22 bp, Artificial Sequence
  chemically synthesized
ttgacacatagtgtgttgaata

SEQ ID NO: 973602 - DNA, 22 bp, Artificial Sequence
  chemically synthesized
acacatagtgtgttgaataaat

SEQ ID NO: 973603 - DNA, 22 bp, Artificial Sequence
  chemically synthesized
caaaagatgaaatcattctgtt

SEQ ID NO: 973604 - DNA, 22 bp, Artificial Sequence
  chemically synthesized
attacaaaagatgaaatcattc

SEQ ID NO: 973605 - DNA, 22 bp, Artificial Sequence
  chemically synthesized
aataaataacagaatgatttca

SEQ ID NO: 973606 - DNA, 22 bp, Artificial Sequence
  chemically synthesized
gattacaaaagatgaaatcatt

SEQ ID NO: 973607 - DNA, 22 bp, Artificial Sequence
  chemically synthesized
tgattacaaaagatgaaatcat

SEQ ID NO: 973608 - DNA, 22 bp, Artificial Sequence
  chemically synthesized
attttgattacaaaagatgaaa

SEQ ID NO: 973609 - DNA, 22 bp, Artificial Sequence
  chemically synthesized
aattttgattacaaaagatgaa

SEQ ID NO: 973610 - DNA, 22 bp, Artificial Sequence
  chemically synthesized
atacaaacttaattttgattac

SEQ ID NO: 973611 - DNA, 22 bp, Artificial Sequence
  chemically synthesized
catcttttgtaatcaaaattaa

SEQ ID NO: 973612 - DNA, 22 bp, Artificial Sequence
  chemically synthesized
atcttttgtaatcaaaattaag

SEQ ID NO: 973613 - DNA, 22 bp, Artificial Sequence
  chemically synthesized
ttgtaatcaaaattaagtttgt

SEQ ID NO: 973614 - DNA, 22 bp, Artificial Sequence
  chemically synthesized
tgtaatcaaaattaagtttgta

SEQ ID NO: 973615 - DNA, 22 bp, Artificial Sequence
  chemically synthesized
gtaatcaaaattaagtttgtat

SEQ ID NO: 973616 - DNA, 22 bp, Artificial Sequence
  chemically synthesized
taatcaaaattaagtttgtatt

SEQ ID NO: 973617 - DNA, 22 bp, Artificial Sequence
  chemically synthesized
ggaacaatacaggaaactaata

SEQ ID NO: 973618 - DNA, 22 bp, Artificial Sequence
  chemically synthesized
agtttgtattagtttcctgtat

SEQ ID NO: 973619 - DNA, 22 bp, Artificial Sequence
  chemically synthesized
aatgagttaggaacaatacagg

SEQ ID NO: 973620 - DNA, 22 bp, Artificial Sequence
  chemically synthesized
gaatgagttaggaacaatacag

SEQ ID NO: 973621 - DNA, 22 bp, Artificial Sequence
  chemically synthesized
gtattagtttcctgtattgttc

SEQ ID NO: 973622 - DNA, 22 bp, Artificial Sequence
  chemically synthesized
tgaatgagttaggaacaataca

SEQ ID NO: 973623 - DNA, 22 bp, Artificial Sequence
  chemically synthesized
tattagtttcctgtattgttcc

SEQ ID NO: 973624 - DNA, 22 bp, Artificial Sequence
  chemically synthesized
atctttgaatgagttaggaaca

SEQ ID NO: 973625 - DNA, 22 bp, Artificial Sequence
  chemically synthesized
gtttcctgtattgttcctaact

SEQ ID NO: 973626 - DNA, 22 bp, Artificial Sequence
  chemically synthesized
cctgtattgttcctaactcatt

SEQ ID NO: 973627 - DNA, 22 bp, Artificial Sequence
  chemically synthesized
ctgtattgttcctaactcattc

SEQ ID NO: 973628 - DNA, 22 bp, Artificial Sequence
  chemically synthesized
tattgttcctaactcattcaaa

SEQ ID NO: 973629 - DNA, 22 bp, Artificial Sequence
  chemically synthesized
atccacctgatctttgaatgag

SEQ ID NO: 973630 - DNA, 22 bp, Artificial Sequence
  chemically synthesized
catccacctgatctttgaatga

SEQ ID NO: 973631 - DNA, 22 bp, Artificial Sequence
  chemically synthesized
ttcctaactcattcaaagatca

SEQ ID NO: 973632 - DNA, 22 bp, Artificial Sequence
  chemically synthesized
tccttcatccacctgatctttg

SEQ ID NO: 973633 - DNA, 22 bp, Artificial Sequence
  chemically synthesized
ctaactcattcaaagatcaggt

SEQ ID NO: 973634 - DNA, 22 bp, Artificial Sequence
  chemically synthesized
actcattcaaagatcaggtgga

SEQ ID NO: 973635 - DNA, 22 bp, Artificial Sequence
  chemically synthesized
cagtctgtccttcatccacctg

SEQ ID NO: 973636 - DNA, 22 bp, Artificial Sequence
  chemically synthesized
ccagtctgtccttcatccacct

SEQ ID NO: 973637 - DNA, 22 bp, Artificial Sequence
  chemically synthesized
attcaaagatcaggtggatgaa

SEQ ID NO: 973638 - DNA, 22 bp, Artificial Sequence
  chemically synthesized
tccagtctgtccttcatccacc

SEQ ID NO: 973639 - DNA, 22 bp, Artificial Sequence
  chemically synthesized
aaagatcaggtggatgaaggac

SEQ ID NO: 973640 - DNA, 22 bp, Artificial Sequence
  chemically synthesized
aaattttccagtctgtccttca

SEQ ID NO: 973641 - DNA, 22 bp, Artificial Sequence
  chemically synthesized
agtaaagtcattaaaattttcc

SEQ ID NO: 973642 - DNA, 22 bp, Artificial Sequence
  chemically synthesized
aagtaaagtcattaaaattttc

SEQ ID NO: 973643 - DNA, 22 bp, Artificial Sequence
  chemically synthesized
tttaagtaaagtcattaaaatt

SEQ ID NO: 973644 - DNA, 22 bp, Artificial Sequence
  chemically synthesized
atttaagtaaagtcattaaaat

SEQ ID NO: 973645 - DNA, 22 bp, Artificial Sequence
  chemically synthesized
gaaaattttaatgactttactt

SEQ ID NO: 973646 - DNA, 22 bp, Artificial Sequence
  chemically synthesized
taatgactttacttaaataagt

SEQ ID NO: 973647 - DNA, 22 bp, Artificial Sequence
  chemically synthesized
aataagtaaatgacttatttaa

SEQ ID NO: 973648 - DNA, 22 bp, Artificial Sequence
  chemically synthesized
aatgactttacttaaataagtc

SEQ ID NO: 973649 - DNA, 22 bp, Artificial Sequence
  chemically synthesized
aaataagtaaatgacttattta

SEQ ID NO: 973650 - DNA, 22 bp, Artificial Sequence
  chemically synthesized
atgactttacttaaataagtca

SEQ ID NO: 973651 - DNA, 22 bp, Artificial Sequence
  chemically synthesized
taaataagtaaatgacttattt

SEQ ID NO: 973652 - DNA, 22 bp, Artificial Sequence
  chemically synthesized
ttaaataagtaaatgacttatt

SEQ ID NO: 973653 - DNA, 22 bp, Artificial Sequence
  chemically synthesized
tttaaataagtaaatgacttat

SEQ ID NO: 973654 - DNA, 22 bp, Artificial Sequence
  chemically synthesized
tacttaaataagtcatttactt

SEQ ID NO: 973655 - DNA, 22 bp, Artificial Sequence
  chemically synthesized
acttaaataagtcatttactta

SEQ ID NO: 973656 - DNA, 22 bp, Artificial Sequence
  chemically synthesized
cttaaataagtcatttacttat

SEQ ID NO: 973657 - DNA, 22 bp, Artificial Sequence
  chemically synthesized
aaataagtcatttacttattta

SEQ ID NO: 973658 - DNA, 22 bp, Artificial Sequence
  chemically synthesized
aataagtcatttacttatttaa

SEQ ID NO: 973659 - DNA, 22 bp, Artificial Sequence
  chemically synthesized
aatatgtgactttttaaataag

SEQ ID NO: 973660 - DNA, 22 bp, Artificial Sequence
  chemically synthesized
aaatatgtgactttttaaataa

SEQ ID NO: 973661 - DNA, 22 bp, Artificial Sequence
  chemically synthesized
atttaaatatgtgactttttaa

SEQ ID NO: 973662 - DNA, 22 bp, Artificial Sequence
  chemically synthesized
ttcatttaaatatgtgactttt

SEQ ID NO: 973663 - DNA, 22 bp, Artificial Sequence
  chemically synthesized
acttatttaaaaagtcacatat

SEQ ID NO: 973664 - DNA, 22 bp, Artificial Sequence
  chemically synthesized
cttatttaaaaagtcacatatt

SEQ ID NO: 973665 - DNA, 22 bp, Artificial Sequence
  chemically synthesized
atttaaaaagtcacatatttaa

SEQ ID NO: 973666 - DNA, 22 bp, Artificial Sequence
  chemically synthesized
tttaaaaagtcacatatttaaa

SEQ ID NO: 973667 - DNA, 22 bp, Artificial Sequence
  chemically synthesized
aaaaagtcacatatttaaatga

SEQ ID NO: 973668 - DNA, 22 bp, Artificial Sequence
  chemically synthesized
aaaagtcacatatttaaatgaa

SEQ ID NO: 973669 - DNA, 22 bp, Artificial Sequence
  chemically synthesized
tacaaccaaattattcatttaa

SEQ ID NO: 973670 - DNA, 22 bp, Artificial Sequence
  chemically synthesized
tgttatacaaccaaattattca

SEQ ID NO: 973671 - DNA, 22 bp, Artificial Sequence
  chemically synthesized
aaatgaataatttggttgtata

SEQ ID NO: 973672 - DNA, 22 bp, Artificial Sequence
  chemically synthesized
aagtaactgtgttatacaacca

SEQ ID NO: 973673 - DNA, 22 bp, Artificial Sequence
  chemically synthesized
aatgaataatttggttgtataa

SEQ ID NO: 973674 - DNA, 22 bp, Artificial Sequence
  chemically synthesized
taaagtaactgtgttatacaac

SEQ ID NO: 973675 - DNA, 22 bp, Artificial Sequence
  chemically synthesized
ttctaaagtaactgtgttatac

SEQ ID NO: 973676 - DNA, 22 bp, Artificial Sequence
  chemically synthesized
attctaaagtaactgtgttata

SEQ ID NO: 973677 - DNA, 22 bp, Artificial Sequence
  chemically synthesized
tattctaaagtaactgtgttat

SEQ ID NO: 973678 - DNA, 22 bp, Artificial Sequence
  chemically synthesized
ttattctaaagtaactgtgtta

SEQ ID NO: 973679 - DNA, 22 bp, Artificial Sequence
  chemically synthesized
ggttgtataacacagttacttt

SEQ ID NO: 973680 - DNA, 22 bp, Artificial Sequence
  chemically synthesized
gttgtataacacagttacttta

SEQ ID NO: 973681 - DNA, 22 bp, Artificial Sequence
  chemically synthesized
tataacacagttactttagaat

SEQ ID NO: 973682 - DNA, 22 bp, Artificial Sequence
  chemically synthesized
tagatataatatttttattcta

SEQ ID NO: 973683 - DNA, 22 bp, Artificial Sequence
  chemically synthesized
aaatattatagatataatattt

SEQ ID NO: 973684 - DNA, 22 bp, Artificial Sequence
  chemically synthesized
ctttagaataaaaatattatat

SEQ ID NO: 973685 - DNA, 22 bp, Artificial Sequence
  chemically synthesized
aaaatattatagatataatatt

SEQ ID NO: 973686 - DNA, 22 bp, Artificial Sequence
  chemically synthesized
taaaatattatagatataatat

SEQ ID NO: 973687 - DNA, 22 bp, Artificial Sequence
  chemically synthesized
tagaataaaaatattatatcta

SEQ ID NO: 973688 - DNA, 22 bp, Artificial Sequence
  chemically synthesized
agaataaaaatattatatctat

SEQ ID NO: 973689 - DNA, 22 bp, Artificial Sequence
  chemically synthesized
ctttaaaatattatagatataa

SEQ ID NO: 973690 - DNA, 22 bp, Artificial Sequence
  chemically synthesized
gaataaaaatattatatctata

SEQ ID NO: 973691 - DNA, 22 bp, Artificial Sequence
  chemically synthesized
ttactttaaaatattatagata

SEQ ID NO: 973692 - DNA, 22 bp, Artificial Sequence
  chemically synthesized
attactttaaaatattatagat

SEQ ID NO: 973693 - DNA, 22 bp, Artificial Sequence
  chemically synthesized
tttattactttaaaatattata

SEQ ID NO: 973694 - DNA, 22 bp, Artificial Sequence
  chemically synthesized
tatctataatattttaaagtaa

SEQ ID NO: 973695 - DNA, 22 bp, Artificial Sequence
  chemically synthesized
tggtcctatttattactttaaa

SEQ ID NO: 973696 - DNA, 22 bp, Artificial Sequence
  chemically synthesized
taatattttaaagtaataaata

SEQ ID NO: 973697 - DNA, 22 bp, Artificial Sequence
  chemically synthesized
ataaatagcctatggtcctatt

SEQ ID NO: 973698 - DNA, 22 bp, Artificial Sequence
  chemically synthesized
cataaatagcctatggtcctat

SEQ ID NO: 973699 - DNA, 22 bp, Artificial Sequence
  chemically synthesized
taaagtaataaataggaccata

SEQ ID NO: 973700 - DNA, 22 bp, Artificial Sequence
  chemically synthesized
aaagtaataaataggaccatag

SEQ ID NO: 973701 - DNA, 22 bp, Artificial Sequence
  chemically synthesized
aagtaataaataggaccatagg

SEQ ID NO: 973702 - DNA, 22 bp, Artificial Sequence
  chemically synthesized
atgtcatatttcataaatagcc

SEQ ID NO: 973703 - DNA, 22 bp, Artificial Sequence
  chemically synthesized
aattcatgtcatatttcataaa

SEQ ID NO: 973704 - DNA, 22 bp, Artificial Sequence
  chemically synthesized
taaattcatgtcatatttcata

SEQ ID NO: 973705 - DNA, 22 bp, Artificial Sequence
  chemically synthesized
gaaattctaaattcatgtcata

SEQ ID NO: 973706 - DNA, 22 bp, Artificial Sequence
  chemically synthesized
tttatgaaatatgacatgaatt

SEQ ID NO: 973707 - DNA, 22 bp, Artificial Sequence
  chemically synthesized
tctcgaaattctaaattcatgt

SEQ ID NO: 973708 - DNA, 22 bp, Artificial Sequence
  chemically synthesized
gtctcgaaattctaaattcatg

SEQ ID NO: 973709 - DNA, 22 bp, Artificial Sequence
  chemically synthesized
atgaaatatgacatgaatttag

SEQ ID NO: 973710 - DNA, 22 bp, Artificial Sequence
  chemically synthesized
tgaaatatgacatgaatttaga

SEQ ID NO: 973711 - DNA, 22 bp, Artificial Sequence
  chemically synthesized
aataaatatagatttgtctcga

SEQ ID NO: 973712 - DNA, 22 bp, Artificial Sequence
  chemically synthesized
aaataaatatagatttgtctcg

SEQ ID NO: 973713 - DNA, 22 bp, Artificial Sequence
  chemically synthesized
agaatttcgagacaaatctata

SEQ ID NO: 973714 - DNA, 22 bp, Artificial Sequence
  chemically synthesized
gaatttcgagacaaatctatat

SEQ ID NO: 973715 - DNA, 22 bp, Artificial Sequence
  chemically synthesized
cccatttaaataaatatagatt

SEQ ID NO: 973716 - DNA, 22 bp, Artificial Sequence
  chemically synthesized
cgagacaaatctatatttattt

SEQ ID NO: 973717 - DNA, 22 bp, Artificial Sequence
  chemically synthesized
gagacaaatctatatttattta

SEQ ID NO: 973718 - DNA, 22 bp, Artificial Sequence
  chemically synthesized
aaaccatattgcccatttaaat

SEQ ID NO: 973719 - DNA, 22 bp, Artificial Sequence
  chemically synthesized
tcaaaccatattgcccatttaa

SEQ ID NO: 973720 - DNA, 22 bp, Artificial Sequence
  chemically synthesized
ttctcaaaccatattgcccatt

SEQ ID NO: 973721 - DNA, 22 bp, Artificial Sequence
  chemically synthesized
tatttatttaaatgggcaatat

SEQ ID NO: 973722 - DNA, 22 bp, Artificial Sequence
  chemically synthesized
atttaaatgggcaatatggttt

SEQ ID NO: 973723 - DNA, 22 bp, Artificial Sequence
  chemically synthesized
tttaaatgggcaatatggtttg

SEQ ID NO: 973724 - DNA, 22 bp, Artificial Sequence
  chemically synthesized
atatcaactgttctcaaaccat

SEQ ID NO: 973725 - DNA, 22 bp, Artificial Sequence
  chemically synthesized
aaatgggcaatatggtttgaga

SEQ ID NO: 973726 - DNA, 22 bp, Artificial Sequence
  chemically synthesized
catatcaactgttctcaaacca

SEQ ID NO: 973727 - DNA, 22 bp, Artificial Sequence
  chemically synthesized
aatgggcaatatggtttgagaa

SEQ ID NO: 973728 - DNA, 22 bp, Artificial Sequence
  chemically synthesized
atcatcgtgtttcatatcaact

SEQ ID NO: 973729 - DNA, 22 bp, Artificial Sequence
  chemically synthesized
gagaacagttgatatgaaacac

SEQ ID NO: 973730 - DNA, 22 bp, Artificial Sequence
  chemically synthesized
agaacagttgatatgaaacacg

SEQ ID NO: 973731 - DNA, 22 bp, Artificial Sequence
  chemically synthesized
atcagaagatgggttcatcatc

SEQ ID NO: 973732 - DNA, 22 bp, Artificial Sequence
  chemically synthesized
atatgaaacacgatgatgaacc

SEQ ID NO: 973733 - DNA, 22 bp, Artificial Sequence
  chemically synthesized
ttcatcagaagatgggttcatc

SEQ ID NO: 973734 - DNA, 22 bp, Artificial Sequence
  chemically synthesized
attcatcagaagatgggttcat

SEQ ID NO: 973735 - DNA, 22 bp, Artificial Sequence
  chemically synthesized
ttattcatcagaagatgggttc

SEQ ID NO: 973736 - DNA, 22 bp, Artificial Sequence
  chemically synthesized
cttattcatcagaagatgggtt

SEQ ID NO: 973737 - DNA, 22 bp, Artificial Sequence
  chemically synthesized
tcttattcatcagaagatgggt

SEQ ID NO: 973738 - DNA, 22 bp, Artificial Sequence
  chemically synthesized
ttcttattcatcagaagatggg

SEQ ID NO: 973739 - DNA, 22 bp, Artificial Sequence
  chemically synthesized
agtgtttttcttattcatcaga

SEQ ID NO: 973740 - DNA, 22 bp, Artificial Sequence
  chemically synthesized
ccaattgagtgtttttcttatt

SEQ ID NO: 973741 - DNA, 22 bp, Artificial Sequence
  chemically synthesized
cattgccaattgagtgtttttc

SEQ ID NO: 973742 - DNA, 22 bp, Artificial Sequence
  chemically synthesized
ctgatgaataagaaaaacactc

SEQ ID NO: 973743 - DNA, 22 bp, Artificial Sequence
  chemically synthesized
tgatgaataagaaaaacactca

SEQ ID NO: 973744 - DNA, 22 bp, Artificial Sequence
  chemically synthesized
atgaataagaaaaacactcaat

SEQ ID NO: 973745 - DNA, 22 bp, Artificial Sequence
  chemically synthesized
aatgaatgcatgatcagctcca

SEQ ID NO: 973746 - DNA, 22 bp, Artificial Sequence
  chemically synthesized
caatgaatgcatgatcagctcc

SEQ ID NO: 973747 - DNA, 22 bp, Artificial Sequence
  chemically synthesized
aattggcaatggagctgatcat

SEQ ID NO: 973748 - DNA, 22 bp, Artificial Sequence
  chemically synthesized
atttcaatgaatgcatgatcag

SEQ ID NO: 973749 - DNA, 22 bp, Artificial Sequence
  chemically synthesized
aatttcaatgaatgcatgatca

SEQ ID NO: 973750 - DNA, 22 bp, Artificial Sequence
  chemically synthesized
gcaatggagctgatcatgcatt

SEQ ID NO: 973751 - DNA, 22 bp, Artificial Sequence
  chemically synthesized
aagccaatttaatttcaatgaa

SEQ ID NO: 973752 - DNA, 22 bp, Artificial Sequence
  chemically synthesized
aaagccaatttaatttcaatga

SEQ ID NO: 973753 - DNA, 22 bp, Artificial Sequence
  chemically synthesized
atcatgcattcattgaaattaa

SEQ ID NO: 973754 - DNA, 22 bp, Artificial Sequence
  chemically synthesized
gtacaacttaaagccaatttaa

SEQ ID NO: 973755 - DNA, 22 bp, Artificial Sequence
  chemically synthesized
attgaaattaaattggctttaa

SEQ ID NO: 973756 - DNA, 22 bp, Artificial Sequence
  chemically synthesized
aaattaaattggctttaagttg

SEQ ID NO: 973757 - DNA, 22 bp, Artificial Sequence
  chemically synthesized
cataagaagactagtacaactt

SEQ ID NO: 973758 - DNA, 22 bp, Artificial Sequence
  chemically synthesized
aattggctttaagttgtactag

SEQ ID NO: 973759 - DNA, 22 bp, Artificial Sequence
  chemically synthesized
gttgcataagaagactagtaca

SEQ ID NO: 973760 - DNA, 22 bp, Artificial Sequence
  chemically synthesized
gctttaagttgtactagtcttc

SEQ ID NO: 973761 - DNA, 22 bp, Artificial Sequence
  chemically synthesized
ctcgttgcataagaagactagt

SEQ ID NO: 973762 - DNA, 22 bp, Artificial Sequence
  chemically synthesized
taagttgtactagtcttcttat

SEQ ID NO: 973763 - DNA, 22 bp, Artificial Sequence
  chemically synthesized
aagttgtactagtcttcttatg

SEQ ID NO: 973764 - DNA, 22 bp, Artificial Sequence
  chemically synthesized
agttgtactagtcttcttatgc

SEQ ID NO: 973765 - DNA, 22 bp, Artificial Sequence
  chemically synthesized
tactagtcttcttatgcaacga

SEQ ID NO: 973766 - DNA, 22 bp, Artificial Sequence
  chemically synthesized
gtcttcttatgcaacgagtagc

SEQ ID NO: 973767 - DNA, 22 bp, Artificial Sequence
  chemically synthesized
atcaaaataaggagctactcgt

SEQ ID NO: 973768 - DNA, 22 bp, Artificial Sequence
  chemically synthesized
catcaaaataaggagctactcg

SEQ ID NO: 973769 - DNA, 22 bp, Artificial Sequence
  chemically synthesized
tcatcaaaataaggagctactc

SEQ ID NO: 973770 - DNA, 22 bp, Artificial Sequence
  chemically synthesized
cttatgcaacgagtagctcctt

SEQ ID NO: 973771 - DNA, 22 bp, Artificial Sequence
  chemically synthesized
ttatgcaacgagtagctcctta

SEQ ID NO: 973772 - DNA, 22 bp, Artificial Sequence
  chemically synthesized
atgcaacgagtagctccttatt

SEQ ID NO: 973773 - DNA, 22 bp, Artificial Sequence
  chemically synthesized
tgcaacgagtagctccttattt

SEQ ID NO: 973774 - DNA, 22 bp, Artificial Sequence
  chemically synthesized
gggaattttcatcaaaataagg

SEQ ID NO: 973775 - DNA, 22 bp, Artificial Sequence
  chemically synthesized
taaattggggaattttcatcaa

SEQ ID NO: 973776 - DNA, 22 bp, Artificial Sequence
  chemically synthesized
gttataaattggggaattttca

SEQ ID NO: 973777 - DNA, 22 bp, Artificial Sequence
  chemically synthesized
agttataaattggggaattttc

SEQ ID NO: 973778 - DNA, 22 bp, Artificial Sequence
  chemically synthesized
cttattttgatgaaaattcccc

SEQ ID NO: 973779 - DNA, 22 bp, Artificial Sequence
  chemically synthesized
attttgatgaaaattccccaat

SEQ ID NO: 973780 - DNA, 22 bp, Artificial Sequence
  chemically synthesized
ttttgatgaaaattccccaatt

SEQ ID NO: 973781 - DNA, 22 bp, Artificial Sequence
  chemically synthesized
tgatgaaaattccccaatttat

SEQ ID NO: 973782 - DNA, 22 bp, Artificial Sequence
  chemically synthesized
gatgaaaattccccaatttata

SEQ ID NO: 973783 - DNA, 22 bp, Artificial Sequence
  chemically synthesized
atgaaaattccccaatttataa

SEQ ID NO: 973784 - DNA, 22 bp, Artificial Sequence
  chemically synthesized
cccaatttataactaagactgg

SEQ ID NO: 973785 - DNA, 22 bp, Artificial Sequence
  chemically synthesized
atcaaaataacaagatccagtc

SEQ ID NO: 973786 - DNA, 22 bp, Artificial Sequence
  chemically synthesized
tgatcaaaataacaagatccag

SEQ ID NO: 973787 - DNA, 22 bp, Artificial Sequence
  chemically synthesized
ataactaagactggatcttgtt

SEQ ID NO: 973788 - DNA, 22 bp, Artificial Sequence
  chemically synthesized
taactaagactggatcttgtta

SEQ ID NO: 973789 - DNA, 22 bp, Artificial Sequence
  chemically synthesized
catctctgatcaaaataacaag

SEQ ID NO: 973790 - DNA, 22 bp, Artificial Sequence
  chemically synthesized
gcatctctgatcaaaataacaa

SEQ ID NO: 973791 - DNA, 22 bp, Artificial Sequence
  chemically synthesized
agactggatcttgttattttga

SEQ ID NO: 973792 - DNA, 22 bp, Artificial Sequence
  chemically synthesized
gatcttgttattttgatcagag

SEQ ID NO: 973793 - DNA, 22 bp, Artificial Sequence
  chemically synthesized
caaagacatttgcatctctgat

SEQ ID NO: 973794 - DNA, 22 bp, Artificial Sequence
  chemically synthesized
ccaaagacatttgcatctctga

SEQ ID NO: 973795 - DNA, 22 bp, Artificial Sequence
  chemically synthesized
tccaaagacatttgcatctctg

SEQ ID NO: 973796 - DNA, 22 bp, Artificial Sequence
  chemically synthesized
gttattttgatcagagatgcaa

SEQ ID NO: 973797 - DNA, 22 bp, Artificial Sequence
  chemically synthesized
ttccaaagacatttgcatctct

SEQ ID NO: 973798 - DNA, 22 bp, Artificial Sequence
  chemically synthesized
ttattttgatcagagatgcaaa

SEQ ID NO: 973799 - DNA, 22 bp, Artificial Sequence
  chemically synthesized
tttccaaagacatttgcatctc

SEQ ID NO: 973800 - DNA, 22 bp, Artificial Sequence
  chemically synthesized
ttttccaaagacatttgcatct

SEQ ID NO: 973801 - DNA, 22 bp, Artificial Sequence
  chemically synthesized
tttttccaaagacatttgcatc

SEQ ID NO: 973802 - DNA, 22 bp, Artificial Sequence
  chemically synthesized
ttttgatcagagatgcaaatgt

SEQ ID NO: 973803 - DNA, 22 bp, Artificial Sequence
  chemically synthesized
tgatcagagatgcaaatgtctt

SEQ ID NO: 973804 - DNA, 22 bp, Artificial Sequence
  chemically synthesized
gatcagagatgcaaatgtcttt

SEQ ID NO: 973805 - DNA, 22 bp, Artificial Sequence
  chemically synthesized
atcagagatgcaaatgtctttg

SEQ ID NO: 973806 - DNA, 22 bp, Artificial Sequence
  chemically synthesized
agaacccccaactttttttcca

SEQ ID NO: 973807 - DNA, 22 bp, Artificial Sequence
  chemically synthesized
tggaaaaaaagttgggggttct

SEQ ID NO: 973808 - DNA, 22 bp, Artificial Sequence
  chemically synthesized
ggaaaaaaagttgggggttctt

SEQ ID NO: 973809 - DNA, 22 bp, Artificial Sequence
  chemically synthesized
gaaaaaaagttgggggttctta

SEQ ID NO: 973810 - DNA, 22 bp, Artificial Sequence
  chemically synthesized
agtgataagtcatgtgattaag

SEQ ID NO: 973811 - DNA, 22 bp, Artificial Sequence
  chemically synthesized
tcagtgataagtcatgtgatta

SEQ ID NO: 973812 - DNA, 22 bp, Artificial Sequence
  chemically synthesized
ggggttcttaatcacatgactt

SEQ ID NO: 973813 - DNA, 22 bp, Artificial Sequence
  chemically synthesized
taaattctcagtgataagtcat

SEQ ID NO: 973814 - DNA, 22 bp, Artificial Sequence
  chemically synthesized
ataaattctcagtgataagtca

SEQ ID NO: 973815 - DNA, 22 bp, Artificial Sequence
  chemically synthesized
tataaattctcagtgataagtc

SEQ ID NO: 973816 - DNA, 22 bp, Artificial Sequence
  chemically synthesized
ttataaattctcagtgataagt

SEQ ID NO: 973817 - DNA, 22 bp, Artificial Sequence
  chemically synthesized
ttaatcacatgacttatcactg

SEQ ID NO: 973818 - DNA, 22 bp, Artificial Sequence
  chemically synthesized
aatcacatgacttatcactgag

SEQ ID NO: 973819 - DNA, 22 bp, Artificial Sequence
  chemically synthesized
atcacatgacttatcactgaga

SEQ ID NO: 973820 - DNA, 22 bp, Artificial Sequence
  chemically synthesized
atcactgagaatttataaaaac

SEQ ID NO: 973821 - DNA, 22 bp, Artificial Sequence
  chemically synthesized
tcactgagaatttataaaaaca

SEQ ID NO: 973822 - DNA, 22 bp, Artificial Sequence
  chemically synthesized
caaggggataaaatgtttttat

SEQ ID NO: 973823 - DNA, 22 bp, Artificial Sequence
  chemically synthesized
tacaaggggataaaatgttttt

SEQ ID NO: 973824 - DNA, 22 bp, Artificial Sequence
  chemically synthesized
ctacaaggggataaaatgtttt

SEQ ID NO: 973825 - DNA, 22 bp, Artificial Sequence
  chemically synthesized
agaatttataaaaacattttat

SEQ ID NO: 973826 - DNA, 22 bp, Artificial Sequence
  chemically synthesized
ataaaaacattttatccccttg

SEQ ID NO: 973827 - DNA, 22 bp, Artificial Sequence
  chemically synthesized
taaaaacattttatccccttgt

SEQ ID NO: 973828 - DNA, 22 bp, Artificial Sequence
  chemically synthesized
agatcgatttctacaaggggat

SEQ ID NO: 973829 - DNA, 22 bp, Artificial Sequence
  chemically synthesized
gagatcgatttctacaagggga

SEQ ID NO: 973830 - DNA, 22 bp, Artificial Sequence
  chemically synthesized
agtttgagatcgatttctacaa

SEQ ID NO: 973831 - DNA, 22 bp, Artificial Sequence
  chemically synthesized
cctaagtttgagatcgatttct

SEQ ID NO: 973832 - DNA, 22 bp, Artificial Sequence
  chemically synthesized
tatccccttgtagaaatcgatc

SEQ ID NO: 973833 - DNA, 22 bp, Artificial Sequence
  chemically synthesized
atccccttgtagaaatcgatct

SEQ ID NO: 973834 - DNA, 22 bp, Artificial Sequence
  chemically synthesized
tccccttgtagaaatcgatctc

SEQ ID NO: 973835 - DNA, 22 bp, Artificial Sequence
  chemically synthesized
tatgttccctaagtttgagatc

SEQ ID NO: 973836 - DNA, 22 bp, Artificial Sequence
  chemically synthesized
gtagaaatcgatctcaaactta

SEQ ID NO: 973837 - DNA, 22 bp, Artificial Sequence
  chemically synthesized
tagaaatcgatctcaaacttag

SEQ ID NO: 973838 - DNA, 22 bp, Artificial Sequence
  chemically synthesized
aattatatgttccctaagtttg

SEQ ID NO: 973839 - DNA, 22 bp, Artificial Sequence
  chemically synthesized
taaattatatgttccctaagtt

SEQ ID NO: 973840 - DNA, 22 bp, Artificial Sequence
  chemically synthesized
tctaaattatatgttccctaag

SEQ ID NO: 973841 - DNA, 22 bp, Artificial Sequence
  chemically synthesized
ctctaaattatatgttccctaa

SEQ ID NO: 973842 - DNA, 22 bp, Artificial Sequence
  chemically synthesized
aaacttagggaacatataattt

SEQ ID NO: 973843 - DNA, 22 bp, Artificial Sequence
  chemically synthesized
aaaatagtttctctaaattata

SEQ ID NO: 973844 - DNA, 22 bp, Artificial Sequence
  chemically synthesized
agggaacatataatttagagaa

SEQ ID NO: 973845 - DNA, 22 bp, Artificial Sequence
  chemically synthesized
gggaacatataatttagagaaa

SEQ ID NO: 973846 - DNA, 22 bp, Artificial Sequence
  chemically synthesized
ggttaaaaatagtttctctaaa

SEQ ID NO: 973847 - DNA, 22 bp, Artificial Sequence
  chemically synthesized
cgttgggttaaaaatagtttct

SEQ ID NO: 973848 - DNA, 22 bp, Artificial Sequence
  chemically synthesized
agagaaactatttttaacccaa

SEQ ID NO: 973849 - DNA, 22 bp, Artificial Sequence
  chemically synthesized
aatgcagctccgttgggttaaa

SEQ ID NO: 973850 - DNA, 22 bp, Artificial Sequence
  chemically synthesized
gagaaactatttttaacccaac

SEQ ID NO: 973851 - DNA, 22 bp, Artificial Sequence
  chemically synthesized
tttttaacccaacggagctgca

SEQ ID NO: 973852 - DNA, 22 bp, Artificial Sequence
  chemically synthesized
ttaacccaacggagctgcattt

SEQ ID NO: 973853 - DNA, 22 bp, Artificial Sequence
  chemically synthesized
taacccaacggagctgcattta

SEQ ID NO: 973854 - DNA, 22 bp, Artificial Sequence
  chemically synthesized
aacccaacggagctgcatttag

SEQ ID NO: 973855 - DNA, 22 bp, Artificial Sequence
  chemically synthesized
acccaacggagctgcatttagg

SEQ ID NO: 973856 - DNA, 22 bp, Artificial Sequence
  chemically synthesized
aaaagtaatcacagggagtaac

SEQ ID NO: 973857 - DNA, 22 bp, Artificial Sequence
  chemically synthesized
catttaggttactccctgtgat

SEQ ID NO: 973858 - DNA, 22 bp, Artificial Sequence
  chemically synthesized
ccaagttcaaaagtaatcacag

SEQ ID NO: 973859 - DNA, 22 bp, Artificial Sequence
  chemically synthesized
aggttactccctgtgattactt

SEQ ID NO: 973860 - DNA, 22 bp, Artificial Sequence
  chemically synthesized
ggttactccctgtgattacttt

SEQ ID NO: 973861 - DNA, 22 bp, Artificial Sequence
  chemically synthesized
ctccctgtgattacttttgaac

SEQ ID NO: 973862 - DNA, 22 bp, Artificial Sequence
  chemically synthesized
cctgtgattacttttgaacttg

SEQ ID NO: 973863 - DNA, 22 bp, Artificial Sequence
  chemically synthesized
tgattacttttgaacttggtag

SEQ ID NO: 973864 - DNA, 22 bp, Artificial Sequence
  chemically synthesized
accaagaagagtgctaccaagt

SEQ ID NO: 973865 - DNA, 22 bp, Artificial Sequence
  chemically synthesized
cttttgaacttggtagcactct

SEQ ID NO: 973866 - DNA, 22 bp, Artificial Sequence
  chemically synthesized
ttgaacttggtagcactcttct

SEQ ID NO: 973867 - DNA, 22 bp, Artificial Sequence
  chemically synthesized
tgaacttggtagcactcttctt

SEQ ID NO: 973868 - DNA, 22 bp, Artificial Sequence
  chemically synthesized
gaacttggtagcactcttcttg

SEQ ID NO: 973869 - DNA, 22 bp, Artificial Sequence
  chemically synthesized
aacttggtagcactcttcttgg

SEQ ID NO: 973870 - DNA, 22 bp, Artificial Sequence
  chemically synthesized
caaataacagtgctaaccaaga

SEQ ID NO: 973871 - DNA, 22 bp, Artificial Sequence
  chemically synthesized
ggtagcactcttcttggttagc

SEQ ID NO: 973872 - DNA, 22 bp, Artificial Sequence
  chemically synthesized
gtagcactcttcttggttagca

SEQ ID NO: 973873 - DNA, 22 bp, Artificial Sequence
  chemically synthesized
tctccaaataacagtgctaacc

SEQ ID NO: 973874 - DNA, 22 bp, Artificial Sequence
  chemically synthesized
ttcttggttagcactgttattt

SEQ ID NO: 973875 - DNA, 22 bp, Artificial Sequence
  chemically synthesized
cttggttagcactgttatttgg

SEQ ID NO: 973876 - DNA, 22 bp, Artificial Sequence
  chemically synthesized
ttggttagcactgttatttgga

SEQ ID NO: 973877 - DNA, 22 bp, Artificial Sequence
  chemically synthesized
gtatgatattgtctccaaataa

SEQ ID NO: 973878 - DNA, 22 bp, Artificial Sequence
  chemically synthesized
ggttagcactgttatttggaga

SEQ ID NO: 973879 - DNA, 22 bp, Artificial Sequence
  chemically synthesized
gttagcactgttatttggagac

SEQ ID NO: 973880 - DNA, 22 bp, Artificial Sequence
  chemically synthesized
gcactgttatttggagacaata

SEQ ID NO: 973881 - DNA, 22 bp, Artificial Sequence
  chemically synthesized
ttatttggagacaatatcatac

SEQ ID NO: 973882 - DNA, 22 bp, Artificial Sequence
  chemically synthesized
caagataaacctcgtatgatat

SEQ ID NO: 973883 - DNA, 22 bp, Artificial Sequence
  chemically synthesized
tttggagacaatatcatacgag

SEQ ID NO: 973884 - DNA, 22 bp, Artificial Sequence
  chemically synthesized
ggagacaatatcatacgaggtt

SEQ ID NO: 973885 - DNA, 22 bp, Artificial Sequence
  chemically synthesized
gagacaatatcatacgaggttt

SEQ ID NO: 973886 - DNA, 22 bp, Artificial Sequence
  chemically synthesized
aacatgtcctacaagataaacc

SEQ ID NO: 973887 - DNA, 22 bp, Artificial Sequence
  chemically synthesized
ctgaacatgtcctacaagataa

SEQ ID NO: 973888 - DNA, 22 bp, Artificial Sequence
  chemically synthesized
tccaggaaattactgaacatgt

SEQ ID NO: 973889 - DNA, 22 bp, Artificial Sequence
  chemically synthesized
atcttgtaggacatgttcagta

SEQ ID NO: 973890 - DNA, 22 bp, Artificial Sequence
  chemically synthesized
tcttgtaggacatgttcagtaa

SEQ ID NO: 973891 - DNA, 22 bp, Artificial Sequence
  chemically synthesized
gtaggacatgttcagtaatttc

SEQ ID NO: 973892 - DNA, 22 bp, Artificial Sequence
  chemically synthesized
aacactatccaggaaattactg

SEQ ID NO: 973893 - DNA, 22 bp, Artificial Sequence
  chemically synthesized
taggacatgttcagtaatttcc

SEQ ID NO: 973894 - DNA, 22 bp, Artificial Sequence
  chemically synthesized
gaacactatccaggaaattact

SEQ ID NO: 973895 - DNA, 22 bp, Artificial Sequence
  chemically synthesized
ataatttgaacactatccagga

SEQ ID NO: 973896 - DNA, 22 bp, Artificial Sequence
  chemically synthesized
ttaataatttgaacactatcca

SEQ ID NO: 973897 - DNA, 22 bp, Artificial Sequence
  chemically synthesized
agtaatttcctggatagtgttc

SEQ ID NO: 973898 - DNA, 22 bp, Artificial Sequence
  chemically synthesized
gctattaataatttgaacacta

SEQ ID NO: 973899 - DNA, 22 bp, Artificial Sequence
  chemically synthesized
cctggatagtgttcaaattatt

SEQ ID NO: 973900 - DNA, 22 bp, Artificial Sequence
  chemically synthesized
ctggatagtgttcaaattatta

SEQ ID NO: 973901 - DNA, 22 bp, Artificial Sequence
  chemically synthesized
gatagtgttcaaattattaata

SEQ ID NO: 973902 - DNA, 22 bp, Artificial Sequence
  chemically synthesized
gaataatgattagctattaata

SEQ ID NO: 973903 - DNA, 22 bp, Artificial Sequence
  chemically synthesized
actggaataatgattagctatt

SEQ ID NO: 973904 - DNA, 22 bp, Artificial Sequence
  chemically synthesized
aaattattaatagctaatcatt

SEQ ID NO: 973905 - DNA, 22 bp, Artificial Sequence
  chemically synthesized
tattcactggaataatgattag

SEQ ID NO: 973906 - DNA, 22 bp, Artificial Sequence
  chemically synthesized
ttaatagctaatcattattcca

SEQ ID NO: 973907 - DNA, 22 bp, Artificial Sequence
  chemically synthesized
tattatattcactggaataatg

SEQ ID NO: 973908 - DNA, 22 bp, Artificial Sequence
  chemically synthesized
atagctaatcattattccagtg

SEQ ID NO: 973909 - DNA, 22 bp, Artificial Sequence
  chemically synthesized
atcattattccagtgaatataa

SEQ ID NO: 973910 - DNA, 22 bp, Artificial Sequence
  chemically synthesized
aagtacactgtattatattcac

SEQ ID NO: 973911 - DNA, 22 bp, Artificial Sequence
  chemically synthesized
aaagtacactgtattatattca

SEQ ID NO: 973912 - DNA, 22 bp, Artificial Sequence
  chemically synthesized
taaagtacactgtattatattc

SEQ ID NO: 973913 - DNA, 22 bp, Artificial Sequence
  chemically synthesized
ttaaagtacactgtattatatt

SEQ ID NO: 973914 - DNA, 22 bp, Artificial Sequence
  chemically synthesized
ttccagtgaatataatacagtg

SEQ ID NO: 973915 - DNA, 22 bp, Artificial Sequence
  chemically synthesized
cagtgaatataatacagtgtac

SEQ ID NO: 973916 - DNA, 22 bp, Artificial Sequence
  chemically synthesized
gcatatatataatgatgacttt

SEQ ID NO: 973917 - DNA, 22 bp, Artificial Sequence
  chemically synthesized
tcgttagcatatatataatgat

SEQ ID NO: 973918 - DNA, 22 bp, Artificial Sequence
  chemically synthesized
atcgttagcatatatataatga

SEQ ID NO: 973919 - DNA, 22 bp, Artificial Sequence
  chemically synthesized
taaaagtcatcattatatatat

SEQ ID NO: 973920 - DNA, 22 bp, Artificial Sequence
  chemically synthesized
aaaagtcatcattatatatatg

SEQ ID NO: 973921 - DNA, 22 bp, Artificial Sequence
  chemically synthesized
atttatcgttagcatatatata

SEQ ID NO: 973922 - DNA, 22 bp, Artificial Sequence
  chemically synthesized
aaagtcatcattatatatatgc

SEQ ID NO: 973923 - DNA, 22 bp, Artificial Sequence
  chemically synthesized
catttatcgttagcatatatat

SEQ ID NO: 973924 - DNA, 22 bp, Artificial Sequence
  chemically synthesized
tcatttatcgttagcatatata

SEQ ID NO: 973925 - DNA, 22 bp, Artificial Sequence
  chemically synthesized
ttcatttatcgttagcatatat

SEQ ID NO: 973926 - DNA, 22 bp, Artificial Sequence
  chemically synthesized
tttttcatttatcgttagcata

SEQ ID NO: 973927 - DNA, 22 bp, Artificial Sequence
  chemically synthesized
tatatatgctaacgataaatga

SEQ ID NO: 973928 - DNA, 22 bp, Artificial Sequence
  chemically synthesized
cgtatgattatttttcatttat

SEQ ID NO: 973929 - DNA, 22 bp, Artificial Sequence
  chemically synthesized
atatctgcgtatgattattttt

SEQ ID NO: 973930 - DNA, 22 bp, Artificial Sequence
  chemically synthesized
acgataaatgaaaaataatcat

SEQ ID NO: 973931 - DNA, 22 bp, Artificial Sequence
  chemically synthesized
tcatatctgcgtatgattattt

SEQ ID NO: 973932 - DNA, 22 bp, Artificial Sequence
  chemically synthesized
tagttctcatatctgcgtatga

SEQ ID NO: 973933 - DNA, 22 bp, Artificial Sequence
  chemically synthesized
caacattatagttctcatatct

SEQ ID NO: 973934 - DNA, 22 bp, Artificial Sequence
  chemically synthesized
ttccaacattatagttctcata

SEQ ID NO: 973935 - DNA, 22 bp, Artificial Sequence
  chemically synthesized
attccaacattatagttctcat

SEQ ID NO: 973936 - DNA, 22 bp, Artificial Sequence
  chemically synthesized
tattccaacattatagttctca

SEQ ID NO: 973937 - DNA, 22 bp, Artificial Sequence
  chemically synthesized
taatgttggaataaagtgcttc

SEQ ID NO: 973938 - DNA, 22 bp, Artificial Sequence
  chemically synthesized
acgcgtgtggggcagcaatgaa

SEQ ID NO: 973939 - DNA, 22 bp, Artificial Sequence
  chemically synthesized
gaataaagtgcttcattgctgc

SEQ ID NO: 973940 - DNA, 22 bp, Artificial Sequence
  chemically synthesized
aagtgctaacgcgtgtggggca

SEQ ID NO: 973941 - DNA, 22 bp, Artificial Sequence
  chemically synthesized
ttcaagtgctaacgcgtgtggg

SEQ ID NO: 973942 - DNA, 22 bp, Artificial Sequence
  chemically synthesized
attcaagtgctaacgcgtgtgg

SEQ ID NO: 973943 - DNA, 22 bp, Artificial Sequence
  chemically synthesized
cattgctgccccacacgcgtta

SEQ ID NO: 973944 - DNA, 22 bp, Artificial Sequence
  chemically synthesized
attgctgccccacacgcgttag

SEQ ID NO: 973945 - DNA, 22 bp, Artificial Sequence
  chemically synthesized
ctgccccacacgcgttagcact

SEQ ID NO: 973946 - DNA, 22 bp, Artificial Sequence
  chemically synthesized
ccccacacgcgttagcacttga

SEQ ID NO: 973947 - DNA, 22 bp, Artificial Sequence
  chemically synthesized
tatccacatttattcaagtgct

SEQ ID NO: 973948 - DNA, 22 bp, Artificial Sequence
  chemically synthesized
atatccacatttattcaagtgc

SEQ ID NO: 973949 - DNA, 22 bp, Artificial Sequence
  chemically synthesized
tatatccacatttattcaagtg

SEQ ID NO: 973950 - DNA, 22 bp, Artificial Sequence
  chemically synthesized
ctttatatccacatttattcaa

SEQ ID NO: 973951 - DNA, 22 bp, Artificial Sequence
  chemically synthesized
tactttatatccacatttattc

SEQ ID NO: 973952 - DNA, 22 bp, Artificial Sequence
  chemically synthesized
ctactttatatccacatttatt

SEQ ID NO: 973953 - DNA, 22 bp, Artificial Sequence
  chemically synthesized
tctactttatatccacatttat

SEQ ID NO: 973954 - DNA, 22 bp, Artificial Sequence
  chemically synthesized
tttctactttatatccacattt

SEQ ID NO: 973955 - DNA, 22 bp, Artificial Sequence
  chemically synthesized
ctttctactttatatccacatt

SEQ ID NO: 973956 - DNA, 22 bp, Artificial Sequence
  chemically synthesized
gcacttgaataaatgtggatat

SEQ ID NO: 973957 - DNA, 22 bp, Artificial Sequence
  chemically synthesized
atatttctttctactttatatc

SEQ ID NO: 973958 - DNA, 22 bp, Artificial Sequence
  chemically synthesized
gaataaatgtggatataaagta

SEQ ID NO: 973959 - DNA, 22 bp, Artificial Sequence
  chemically synthesized
aatatttctttctactttatat

SEQ ID NO: 973960 - DNA, 22 bp, Artificial Sequence
  chemically synthesized
aataaatgtggatataaagtag

SEQ ID NO: 973961 - DNA, 22 bp, Artificial Sequence
  chemically synthesized
atatttaatatttctttctact

SEQ ID NO: 973962 - DNA, 22 bp, Artificial Sequence
  chemically synthesized
gatatttaatatttctttctac

SEQ ID NO: 973963 - DNA, 22 bp, Artificial Sequence
  chemically synthesized
gaataacacttgatatttaata

SEQ ID NO: 973964 - DNA, 22 bp, Artificial Sequence
  chemically synthesized
atggttggaataacacttgata

SEQ ID NO: 973965 - DNA, 22 bp, Artificial Sequence
  chemically synthesized
aatggttggaataacacttgat

SEQ ID NO: 973966 - DNA, 22 bp, Artificial Sequence
  chemically synthesized
taatggttggaataacacttga

SEQ ID NO: 973967 - DNA, 22 bp, Artificial Sequence
  chemically synthesized
aatatcaagtgttattccaacc

SEQ ID NO: 973968 - DNA, 22 bp, Artificial Sequence
  chemically synthesized
gtaaaaatcctttaatggttgg

SEQ ID NO: 973969 - DNA, 22 bp, Artificial Sequence
  chemically synthesized
agtaaaaatcctttaatggttg

SEQ ID NO: 973970 - DNA, 22 bp, Artificial Sequence
  chemically synthesized
ttagtaaaaatcctttaatggt

SEQ ID NO: 973971 - DNA, 22 bp, Artificial Sequence
  chemically synthesized
tcttagtaaaaatcctttaatg

SEQ ID NO: 973972 - DNA, 22 bp, Artificial Sequence
  chemically synthesized
ctcttagtaaaaatcctttaat

SEQ ID NO: 973973 - DNA, 22 bp, Artificial Sequence
  chemically synthesized
ttctcttagtaaaaatccttta

SEQ ID NO: 973974 - DNA, 22 bp, Artificial Sequence
  chemically synthesized
ttccaaccattaaaggattttt

SEQ ID NO: 973975 - DNA, 22 bp, Artificial Sequence
  chemically synthesized
caaccattaaaggatttttact

SEQ ID NO: 973976 - DNA, 22 bp, Artificial Sequence
  chemically synthesized
aaggatttttactaagagaaga

SEQ ID NO: 973977 - DNA, 22 bp, Artificial Sequence
  chemically synthesized
ttactaagagaagaatctttct

SEQ ID NO: 973978 - DNA, 22 bp, Artificial Sequence
  chemically synthesized
tactaagagaagaatctttctt

SEQ ID NO: 973979 - DNA, 22 bp, Artificial Sequence
  chemically synthesized
actaagagaagaatctttcttc

SEQ ID NO: 973980 - DNA, 22 bp, Artificial Sequence
  chemically synthesized
ctaagagaagaatctttcttca

SEQ ID NO: 973981 - DNA, 22 bp, Artificial Sequence
  chemically synthesized
tagagtcatcatgtgaagaaag

SEQ ID NO: 973982 - DNA, 22 bp, Artificial Sequence
  chemically synthesized
agagaagaatctttcttcacat

SEQ ID NO: 973983 - DNA, 22 bp, Artificial Sequence
  chemically synthesized
agttatagagtcatcatgtgaa

SEQ ID NO: 973984 - DNA, 22 bp, Artificial Sequence
  chemically synthesized
agctaagttatagagtcatcat

SEQ ID NO: 973985 - DNA, 22 bp, Artificial Sequence
  chemically synthesized
cagctaagttatagagtcatca

SEQ ID NO: 973986 - DNA, 22 bp, Artificial Sequence
  chemically synthesized
tcagctaagttatagagtcatc

SEQ ID NO: 973987 - DNA, 22 bp, Artificial Sequence
  chemically synthesized
tcttcacatgatgactctataa

SEQ ID NO: 973988 - DNA, 22 bp, Artificial Sequence
  chemically synthesized
ttttcagctaagttatagagtc

SEQ ID NO: 973989 - DNA, 22 bp, Artificial Sequence
  chemically synthesized
cttcacatgatgactctataac

SEQ ID NO: 973990 - DNA, 22 bp, Artificial Sequence
  chemically synthesized
gttttcagctaagttatagagt

SEQ ID NO: 973991 - DNA, 22 bp, Artificial Sequence
  chemically synthesized
ttcacatgatgactctataact

SEQ ID NO: 973992 - DNA, 22 bp, Artificial Sequence
  chemically synthesized
tgttttcagctaagttatagag

SEQ ID NO: 973993 - DNA, 22 bp, Artificial Sequence
  chemically synthesized
ttgttttcagctaagttataga

SEQ ID NO: 973994 - DNA, 22 bp, Artificial Sequence
  chemically synthesized
cacatgatgactctataactta

SEQ ID NO: 973995 - DNA, 22 bp, Artificial Sequence
  chemically synthesized
acatgatgactctataacttag

SEQ ID NO: 973996 - DNA, 22 bp, Artificial Sequence
  chemically synthesized
tgcgcttttgttttcagctaag

SEQ ID NO: 973997 - DNA, 22 bp, Artificial Sequence
  chemically synthesized
atgcgcttttgttttcagctaa

SEQ ID NO: 973998 - DNA, 22 bp, Artificial Sequence
  chemically synthesized
tataacttagctgaaaacaaaa

SEQ ID NO: 973999 - DNA, 22 bp, Artificial Sequence
  chemically synthesized
taacttagctgaaaacaaaagc

SEQ ID NO: 974000 - DNA, 22 bp, Artificial Sequence
  chemically synthesized
agctgaaaacaaaagcgcataa

SEQ ID NO: 974001 - DNA, 22 bp, Artificial Sequence
  chemically synthesized
aggagaggccatttatgcgctt

SEQ ID NO: 974002 - DNA, 22 bp, Artificial Sequence
  chemically synthesized
gctgaaaacaaaagcgcataaa

SEQ ID NO: 974003 - DNA, 22 bp, Artificial Sequence
  chemically synthesized
caggagaggccatttatgcgct

SEQ ID NO: 974004 - DNA, 22 bp, Artificial Sequence
  chemically synthesized
aaaacaaaagcgcataaatggc

SEQ ID NO: 974005 - DNA, 22 bp, Artificial Sequence
  chemically synthesized
tcctgaagctatgtcttacact

SEQ ID NO: 974006 - DNA, 22 bp, Artificial Sequence
  chemically synthesized
ctgaagctatgtcttacactcc

SEQ ID NO: 974007 - DNA, 22 bp, Artificial Sequence
  chemically synthesized
aaatgtcatcagaaggagtgta

SEQ ID NO: 974008 - DNA, 22 bp, Artificial Sequence
  chemically synthesized
aagctatgtcttacactccttc

SEQ ID NO: 974009 - DNA, 22 bp, Artificial Sequence
  chemically synthesized
taattgaaatgtcatcagaagg

SEQ ID NO: 974010 - DNA, 22 bp, Artificial Sequence
  chemically synthesized
tgtcttacactccttctgatga

SEQ ID NO: 974011 - DNA, 22 bp, Artificial Sequence
  chemically synthesized
ataattgaaatgtcatcagaag

SEQ ID NO: 974012 - DNA, 22 bp, Artificial Sequence
  chemically synthesized
ggcttataattgaaatgtcatc

SEQ ID NO: 974013 - DNA, 22 bp, Artificial Sequence
  chemically synthesized
acactccttctgatgacatttc

SEQ ID NO: 974014 - DNA, 22 bp, Artificial Sequence
  chemically synthesized
cggcttataattgaaatgtcat

SEQ ID NO: 974015 - DNA, 22 bp, Artificial Sequence
  chemically synthesized
cactccttctgatgacatttca

SEQ ID NO: 974016 - DNA, 22 bp, Artificial Sequence
  chemically synthesized
cttctgatgacatttcaattat

SEQ ID NO: 974017 - DNA, 22 bp, Artificial Sequence
  chemically synthesized
ctgatgacatttcaattataag

SEQ ID NO: 974018 - DNA, 22 bp, Artificial Sequence
  chemically synthesized
gtggagcttcggcttataattg

SEQ ID NO: 974019 - DNA, 22 bp, Artificial Sequence
  chemically synthesized
tgatgacatttcaattataagc

SEQ ID NO: 974020 - DNA, 22 bp, Artificial Sequence
  chemically synthesized
cgtggagcttcggcttataatt

SEQ ID NO: 974021 - DNA, 22 bp, Artificial Sequence
  chemically synthesized
atgacatttcaattataagccg

SEQ ID NO: 974022 - DNA, 22 bp, Artificial Sequence
  chemically synthesized
tttcgtggagcttcggcttata

SEQ ID NO: 974023 - DNA, 22 bp, Artificial Sequence
  chemically synthesized
caattataagccgaagctccac

SEQ ID NO: 974024 - DNA, 22 bp, Artificial Sequence
  chemically synthesized
aattataagccgaagctccacg

SEQ ID NO: 974025 - DNA, 22 bp, Artificial Sequence
  chemically synthesized
ggaatcgattgtttcgtggagc

SEQ ID NO: 974026 - DNA, 22 bp, Artificial Sequence
  chemically synthesized
aggaatcgattgtttcgtggag

SEQ ID NO: 974027 - DNA, 22 bp, Artificial Sequence
  chemically synthesized
taggaatcgattgtttcgtgga

SEQ ID NO: 974028 - DNA, 22 bp, Artificial Sequence
  chemically synthesized
taagccgaagctccacgaaaca

SEQ ID NO: 974029 - DNA, 22 bp, Artificial Sequence
  chemically synthesized
gacctttaggaatcgattgttt

SEQ ID NO: 974030 - DNA, 22 bp, Artificial Sequence
  chemically synthesized
ttagacctttaggaatcgattg

SEQ ID NO: 974031 - DNA, 22 bp, Artificial Sequence
  chemically synthesized
cacgaaacaatcgattcctaaa

SEQ ID NO: 974032 - DNA, 22 bp, Artificial Sequence
  chemically synthesized
agtgtacggagtgatcaattgt

SEQ ID NO: 974033 - DNA, 22 bp, Artificial Sequence
  chemically synthesized
ctaaaggtctaacaattgatca

SEQ ID NO: 974034 - DNA, 22 bp, Artificial Sequence
  chemically synthesized
cagtgtacggagtgatcaattg

SEQ ID NO: 974035 - DNA, 22 bp, Artificial Sequence
  chemically synthesized
aaggtctaacaattgatcactc

SEQ ID NO: 974036 - DNA, 22 bp, Artificial Sequence
  chemically synthesized
caggcacttcagtgtacggagt

SEQ ID NO: 974037 - DNA, 22 bp, Artificial Sequence
  chemically synthesized
acaattgatcactccgtacact

SEQ ID NO: 974038 - DNA, 22 bp, Artificial Sequence
  chemically synthesized
atcactccgtacactgaagtgc

SEQ ID NO: 974039 - DNA, 22 bp, Artificial Sequence
  chemically synthesized
cgtacactgaagtgcctgtaat

SEQ ID NO: 974040 - DNA, 22 bp, Artificial Sequence
  chemically synthesized
taaacagtagtcattacaggca

SEQ ID NO: 974041 - DNA, 22 bp, Artificial Sequence
  chemically synthesized
ataaacagtagtcattacaggc

SEQ ID NO: 974042 - DNA, 22 bp, Artificial Sequence
  chemically synthesized
aagtgcctgtaatgactactgt

SEQ ID NO: 974043 - DNA, 22 bp, Artificial Sequence
  chemically synthesized
aagcaaaacatttataaacagt

SEQ ID NO: 974044 - DNA, 22 bp, Artificial Sequence
  chemically synthesized
aaagcaaaacatttataaacag

SEQ ID NO: 974045 - DNA, 22 bp, Artificial Sequence
  chemically synthesized
taaagcaaaacatttataaaca

SEQ ID NO: 974046 - DNA, 22 bp, Artificial Sequence
  chemically synthesized
ttaaagcaaaacatttataaac

SEQ ID NO: 974047 - DNA, 22 bp, Artificial Sequence
  chemically synthesized
taatgactactgtttataaatg

SEQ ID NO: 974048 - DNA, 22 bp, Artificial Sequence
  chemically synthesized
tttaaagcaaaacatttataaa

SEQ ID NO: 974049 - DNA, 22 bp, Artificial Sequence
  chemically synthesized
ttttttaaagcaaaacatttat

SEQ ID NO: 974050 - DNA, 22 bp, Artificial Sequence
  chemically synthesized
attttttaaagcaaaacattta

SEQ ID NO: 974051 - DNA, 22 bp, Artificial Sequence
  chemically synthesized
ctgtttataaatgttttgcttt

SEQ ID NO: 974052 - DNA, 22 bp, Artificial Sequence
  chemically synthesized
tttataaatgttttgctttaaa

SEQ ID NO: 974053 - DNA, 22 bp, Artificial Sequence
  chemically synthesized
ataaatgttttgctttaaaaaa

SEQ ID NO: 974054 - DNA, 22 bp, Artificial Sequence
  chemically synthesized
taaatgttttgctttaaaaaat

SEQ ID NO: 974055 - DNA, 22 bp, Artificial Sequence
  chemically synthesized
atagtgtgccttattttttaaa

SEQ ID NO: 974056 - DNA, 22 bp, Artificial Sequence
  chemically synthesized
ttaatagtgtgccttatttttt

SEQ ID NO: 974057 - DNA, 22 bp, Artificial Sequence
  chemically synthesized
attaatagtgtgccttattttt

SEQ ID NO: 974058 - DNA, 22 bp, Artificial Sequence
  chemically synthesized
tttattaatagtgtgccttatt

SEQ ID NO: 974059 - DNA, 22 bp, Artificial Sequence
  chemically synthesized
tgctttaaaaaataaggcacac

SEQ ID NO: 974060 - DNA, 22 bp, Artificial Sequence
  chemically synthesized
gctttaaaaaataaggcacact

SEQ ID NO: 974061 - DNA, 22 bp, Artificial Sequence
  chemically synthesized
ctttaaaaaataaggcacacta

SEQ ID NO: 974062 - DNA, 22 bp, Artificial Sequence
  chemically synthesized
taaaaaataaggcacactatta

SEQ ID NO: 974063 - DNA, 22 bp, Artificial Sequence
  chemically synthesized
aaaaaataaggcacactattaa

SEQ ID NO: 974064 - DNA, 22 bp, Artificial Sequence
  chemically synthesized
aaaaataaggcacactattaat

SEQ ID NO: 974065 - DNA, 22 bp, Artificial Sequence
  chemically synthesized
aagcaaactgtttattaatagt

SEQ ID NO: 974066 - DNA, 22 bp, Artificial Sequence
  chemically synthesized
ttaaagcaaactgtttattaat

SEQ ID NO: 974067 - DNA, 22 bp, Artificial Sequence
  chemically synthesized
tattaaagcaaactgtttatta

SEQ ID NO: 974068 - DNA, 22 bp, Artificial Sequence
  chemically synthesized
ttctattaaagcaaactgttta

SEQ ID NO: 974069 - DNA, 22 bp, Artificial Sequence
  chemically synthesized
gttctattaaagcaaactgttt

SEQ ID NO: 974070 - DNA, 22 bp, Artificial Sequence
  chemically synthesized
catttgttctattaaagcaaac

SEQ ID NO: 974071 - DNA, 22 bp, Artificial Sequence
  chemically synthesized
gcatttgttctattaaagcaaa

SEQ ID NO: 974072 - DNA, 22 bp, Artificial Sequence
  chemically synthesized
ttaataaacagtttgctttaat

SEQ ID NO: 974073 - DNA, 22 bp, Artificial Sequence
  chemically synthesized
ataaacagtttgctttaataga

SEQ ID NO: 974074 - DNA, 22 bp, Artificial Sequence
  chemically synthesized
aaaacttgcatttgttctatta

SEQ ID NO: 974075 - DNA, 22 bp, Artificial Sequence
  chemically synthesized
gaaaacttgcatttgttctatt

SEQ ID NO: 974076 - DNA, 22 bp, Artificial Sequence
  chemically synthesized
tgaaaacttgcatttgttctat

SEQ ID NO: 974077 - DNA, 22 bp, Artificial Sequence
  chemically synthesized
gctttaatagaacaaatgcaag

SEQ ID NO: 974078 - DNA, 22 bp, Artificial Sequence
  chemically synthesized
ctttaatagaacaaatgcaagt

SEQ ID NO: 974079 - DNA, 22 bp, Artificial Sequence
  chemically synthesized
taatagaacaaatgcaagtttt

SEQ ID NO: 974080 - DNA, 22 bp, Artificial Sequence
  chemically synthesized
ataaatattttgaaaacttgca

SEQ ID NO: 974081 - DNA, 22 bp, Artificial Sequence
  chemically synthesized
aatagaacaaatgcaagttttc

SEQ ID NO: 974082 - DNA, 22 bp, Artificial Sequence
  chemically synthesized
atagaacaaatgcaagttttca

SEQ ID NO: 974083 - DNA, 22 bp, Artificial Sequence
  chemically synthesized
tcaaaatatttatcagaccacg

SEQ ID NO: 974084 - DNA, 22 bp, Artificial Sequence
  chemically synthesized
caaaatatttatcagaccacga

SEQ ID NO: 974085 - DNA, 22 bp, Artificial Sequence
  chemically synthesized
agtcaggaagagtcgtggtctg

SEQ ID NO: 974086 - DNA, 22 bp, Artificial Sequence
  chemically synthesized
aaaatatttatcagaccacgac

SEQ ID NO: 974087 - DNA, 22 bp, Artificial Sequence
  chemically synthesized
atcagaccacgactcttcctga

SEQ ID NO: 974088 - DNA, 22 bp, Artificial Sequence
  chemically synthesized
tcagaccacgactcttcctgac

SEQ ID NO: 974089 - DNA, 22 bp, Artificial Sequence
  chemically synthesized
aagccaatctgagtcaggaaga

SEQ ID NO: 974090 - DNA, 22 bp, Artificial Sequence
  chemically synthesized
tacatacatctgaagccaatct

SEQ ID NO: 974091 - DNA, 22 bp, Artificial Sequence
  chemically synthesized
atacatacatctgaagccaatc

SEQ ID NO: 974092 - DNA, 22 bp, Artificial Sequence
  chemically synthesized
ttcctgactcagattggcttca

SEQ ID NO: 974093 - DNA, 22 bp, Artificial Sequence
  chemically synthesized
cctgactcagattggcttcaga

SEQ ID NO: 974094 - DNA, 22 bp, Artificial Sequence
  chemically synthesized
cttatacatacatctgaagcca

SEQ ID NO: 974095 - DNA, 22 bp, Artificial Sequence
  chemically synthesized
ctgactcagattggcttcagat

SEQ ID NO: 974096 - DNA, 22 bp, Artificial Sequence
  chemically synthesized
ccttatacatacatctgaagcc

SEQ ID NO: 974097 - DNA, 22 bp, Artificial Sequence
  chemically synthesized
actcagattggcttcagatgta

SEQ ID NO: 974098 - DNA, 22 bp, Artificial Sequence
  chemically synthesized
agattggcttcagatgtatgta

SEQ ID NO: 974099 - DNA, 22 bp, Artificial Sequence
  chemically synthesized
gcttcagatgtatgtataagga

SEQ ID NO: 974100 - DNA, 22 bp, Artificial Sequence
  chemically synthesized
cagatgtatgtataaggaaggc

SEQ ID NO: 974101 - DNA, 22 bp, Artificial Sequence
  chemically synthesized
cgaatataataggccttcctta

SEQ ID NO: 974102 - DNA, 22 bp, Artificial Sequence
  chemically synthesized
agatgtatgtataaggaaggcc

SEQ ID NO: 974103 - DNA, 22 bp, Artificial Sequence
  chemically synthesized
acgaatataataggccttcctt

SEQ ID NO: 974104 - DNA, 22 bp, Artificial Sequence
  chemically synthesized
gcagtgtttacgaatataatag

SEQ ID NO: 974105 - DNA, 22 bp, Artificial Sequence
  chemically synthesized
agcagtgtttacgaatataata

SEQ ID NO: 974106 - DNA, 22 bp, Artificial Sequence
  chemically synthesized
aacttagcagtgtttacgaata

SEQ ID NO: 974107 - DNA, 22 bp, Artificial Sequence
  chemically synthesized
tcaacttagcagtgtttacgaa

SEQ ID NO: 974108 - DNA, 22 bp, Artificial Sequence
  chemically synthesized
ttatattcgtaaacactgctaa

SEQ ID NO: 974109 - DNA, 22 bp, Artificial Sequence
  chemically synthesized
tattcgtaaacactgctaagtt

SEQ ID NO: 974110 - DNA, 22 bp, Artificial Sequence
  chemically synthesized
gaaacaggtctctcaacttagc

SEQ ID NO: 974111 - DNA, 22 bp, Artificial Sequence
  chemically synthesized
gtaaacactgctaagttgagag

SEQ ID NO: 974112 - DNA, 22 bp, Artificial Sequence
  chemically synthesized
ggatctagaaacaggtctctca

SEQ ID NO: 974113 - DNA, 22 bp, Artificial Sequence
  chemically synthesized
ctgggatctagaaacaggtctc

SEQ ID NO: 974114 - DNA, 22 bp, Artificial Sequence
  chemically synthesized
actgggatctagaaacaggtct

SEQ ID NO: 974115 - DNA, 22 bp, Artificial Sequence
  chemically synthesized
ctaagttgagagacctgtttct

SEQ ID NO: 974116 - DNA, 22 bp, Artificial Sequence
  chemically synthesized
tttactgggatctagaaacagg

SEQ ID NO: 974117 - DNA, 22 bp, Artificial Sequence
  chemically synthesized
agttgagagacctgtttctaga

SEQ ID NO: 974118 - DNA, 22 bp, Artificial Sequence
  chemically synthesized
actatttactgggatctagaaa

SEQ ID NO: 974119 - DNA, 22 bp, Artificial Sequence
  chemically synthesized
aactatttactgggatctagaa

SEQ ID NO: 974120 - DNA, 22 bp, Artificial Sequence
  chemically synthesized
agagacctgtttctagatccca

SEQ ID NO: 974121 - DNA, 22 bp, Artificial Sequence
  chemically synthesized
ttaactatttactgggatctag

SEQ ID NO: 974122 - DNA, 22 bp, Artificial Sequence
  chemically synthesized
tcttaactatttactgggatct

SEQ ID NO: 974123 - DNA, 22 bp, Artificial Sequence
  chemically synthesized
ctcttaactatttactgggatc

SEQ ID NO: 974124 - DNA, 22 bp, Artificial Sequence
  chemically synthesized
tttctagatcccagtaaatagt

SEQ ID NO: 974125 - DNA, 22 bp, Artificial Sequence
  chemically synthesized
ctagatcccagtaaatagttaa

SEQ ID NO: 974126 - DNA, 22 bp, Artificial Sequence
  chemically synthesized
tagatcccagtaaatagttaag

SEQ ID NO: 974127 - DNA, 22 bp, Artificial Sequence
  chemically synthesized
gatcccagtaaatagttaagag

SEQ ID NO: 974128 - DNA, 22 bp, Artificial Sequence
  chemically synthesized
atgcaaccagatcaatgatgtg

SEQ ID NO: 974129 - DNA, 22 bp, Artificial Sequence
  chemically synthesized
agagaaattcacatcattgatc

SEQ ID NO: 974130 - DNA, 22 bp, Artificial Sequence
  chemically synthesized
tgtgaaactgatgcaaccagat

SEQ ID NO: 974131 - DNA, 22 bp, Artificial Sequence
  chemically synthesized
acatcattgatctggttgcatc

SEQ ID NO: 974132 - DNA, 22 bp, Artificial Sequence
  chemically synthesized
tgcactgtgtgaaactgatgca

SEQ ID NO: 974133 - DNA, 22 bp, Artificial Sequence
  chemically synthesized
atctggttgcatcagtttcaca

SEQ ID NO: 974134 - DNA, 22 bp, Artificial Sequence
  chemically synthesized
gttgcatcagtttcacacagtg

SEQ ID NO: 974135 - DNA, 22 bp, Artificial Sequence
  chemically synthesized
tataagattgtgcactgtgtga

SEQ ID NO: 974136 - DNA, 22 bp, Artificial Sequence
  chemically synthesized
catcagtttcacacagtgcaca

SEQ ID NO: 974137 - DNA, 22 bp, Artificial Sequence
  chemically synthesized
cacacagtgcacaatcttatat

SEQ ID NO: 974138 - DNA, 22 bp, Artificial Sequence
  chemically synthesized
acacagtgcacaatcttatata

SEQ ID NO: 974139 - DNA, 22 bp, Artificial Sequence
  chemically synthesized
gggggaaaaaaggttatataag

SEQ ID NO: 974140 - DNA, 22 bp, Artificial Sequence
  chemically synthesized
atataaccttttttccccccag

SEQ ID NO: 974141 - DNA, 22 bp, Artificial Sequence
  chemically synthesized
aatgaatagccactggggggaa

SEQ ID NO: 974142 - DNA, 22 bp, Artificial Sequence
  chemically synthesized
tataaccttttttccccccagt

SEQ ID NO: 974143 - DNA, 22 bp, Artificial Sequence
  chemically synthesized
ttttccccccagtggctattca

SEQ ID NO: 974144 - DNA, 22 bp, Artificial Sequence
  chemically synthesized
tttccccccagtggctattcat

SEQ ID NO: 974145 - DNA, 22 bp, Artificial Sequence
  chemically synthesized
ttccccccagtggctattcatt

SEQ ID NO: 974146 - DNA, 22 bp, Artificial Sequence
  chemically synthesized
aaggatatcctaaatgaatagc

SEQ ID NO: 974147 - DNA, 22 bp, Artificial Sequence
  chemically synthesized
tccccccagtggctattcattt

SEQ ID NO: 974148 - DNA, 22 bp, Artificial Sequence
  chemically synthesized
ccccccagtggctattcattta

SEQ ID NO: 974149 - DNA, 22 bp, Artificial Sequence
  chemically synthesized
taaaggatatcctaaatgaata

SEQ ID NO: 974150 - DNA, 22 bp, Artificial Sequence
  chemically synthesized
cccccagtggctattcatttag

SEQ ID NO: 974151 - DNA, 22 bp, Artificial Sequence
  chemically synthesized
ttctaaaggatatcctaaatga

SEQ ID NO: 974152 - DNA, 22 bp, Artificial Sequence
  chemically synthesized
gttctaaaggatatcctaaatg

SEQ ID NO: 974153 - DNA, 22 bp, Artificial Sequence
  chemically synthesized
tgttctaaaggatatcctaaat

SEQ ID NO: 974154 - DNA, 22 bp, Artificial Sequence
  chemically synthesized
ttgttctaaaggatatcctaaa

SEQ ID NO: 974155 - DNA, 22 bp, Artificial Sequence
  chemically synthesized
ttttgttctaaaggatatccta

SEQ ID NO: 974156 - DNA, 22 bp, Artificial Sequence
  chemically synthesized
ttcttttgttctaaaggatatc

SEQ ID NO: 974157 - DNA, 22 bp, Artificial Sequence
  chemically synthesized
ttcatttaggatatcctttaga

SEQ ID NO: 974158 - DNA, 22 bp, Artificial Sequence
  chemically synthesized
atttaggatatcctttagaaca

SEQ ID NO: 974159 - DNA, 22 bp, Artificial Sequence
  chemically synthesized
aatcctattcttttgttctaaa

SEQ ID NO: 974160 - DNA, 22 bp, Artificial Sequence
  chemically synthesized
aggatatcctttagaacaaaag

SEQ ID NO: 974161 - DNA, 22 bp, Artificial Sequence
  chemically synthesized
ggatatcctttagaacaaaaga

SEQ ID NO: 974162 - DNA, 22 bp, Artificial Sequence
  chemically synthesized
aatgacactcaatcctattctt

SEQ ID NO: 974163 - DNA, 22 bp, Artificial Sequence
  chemically synthesized
ctaaatgacactcaatcctatt

SEQ ID NO: 974164 - DNA, 22 bp, Artificial Sequence
  chemically synthesized
tagaacaaaagaataggattga

SEQ ID NO: 974165 - DNA, 22 bp, Artificial Sequence
  chemically synthesized
agaacaaaagaataggattgag

SEQ ID NO: 974166 - DNA, 22 bp, Artificial Sequence
  chemically synthesized
tgctaaatgacactcaatccta

SEQ ID NO: 974167 - DNA, 22 bp, Artificial Sequence
  chemically synthesized
gaacaaaagaataggattgagt

SEQ ID NO: 974168 - DNA, 22 bp, Artificial Sequence
  chemically synthesized
ctgctaaatgacactcaatcct

SEQ ID NO: 974169 - DNA, 22 bp, Artificial Sequence
  chemically synthesized
tctgctaaatgacactcaatcc

SEQ ID NO: 974170 - DNA, 22 bp, Artificial Sequence
  chemically synthesized
tttctgctaaatgacactcaat

SEQ ID NO: 974171 - DNA, 22 bp, Artificial Sequence
  chemically synthesized
ctttctgctaaatgacactcaa

SEQ ID NO: 974172 - DNA, 22 bp, Artificial Sequence
  chemically synthesized
ccttctttctgctaaatgacac

SEQ ID NO: 974173 - DNA, 22 bp, Artificial Sequence
  chemically synthesized
gctcccttctttctgctaaatg

SEQ ID NO: 974174 - DNA, 22 bp, Artificial Sequence
  chemically synthesized
agctcccttctttctgctaaat

SEQ ID NO: 974175 - DNA, 22 bp, Artificial Sequence
  chemically synthesized
agtgtcatttagcagaaagaag

SEQ ID NO: 974176 - DNA, 22 bp, Artificial Sequence
  chemically synthesized
tcagcttagctcccttctttct

SEQ ID NO: 974177 - DNA, 22 bp, Artificial Sequence
  chemically synthesized
tgcctgtcagcttagctccctt

SEQ ID NO: 974178 - DNA, 22 bp, Artificial Sequence
  chemically synthesized
agcagaaagaagggagctaagc

SEQ ID NO: 974179 - DNA, 22 bp, Artificial Sequence
  chemically synthesized
gcagaaagaagggagctaagct

SEQ ID NO: 974180 - DNA, 22 bp, Artificial Sequence
  chemically synthesized
caacagaacactatgcctgtca

SEQ ID NO: 974181 - DNA, 22 bp, Artificial Sequence
  chemically synthesized
agctgacaggcatagtgttctg

SEQ ID NO: 974182 - DNA, 22 bp, Artificial Sequence
  chemically synthesized
acaggcatagtgttctgttgca

SEQ ID NO: 974183 - DNA, 22 bp, Artificial Sequence
  chemically synthesized
tccaatgatgaaaacacaaaat

SEQ ID NO: 974184 - DNA, 22 bp, Artificial Sequence
  chemically synthesized
tgttgcagtattttgtgttttc

SEQ ID NO: 974185 - DNA, 22 bp, Artificial Sequence
  chemically synthesized
ctgtccaatgatgaaaacacaa

SEQ ID NO: 974186 - DNA, 22 bp, Artificial Sequence
  chemically synthesized
ttgcagtattttgtgttttcat

SEQ ID NO: 974187 - DNA, 22 bp, Artificial Sequence
  chemically synthesized
cagtattttgtgttttcatcat

SEQ ID NO: 974188 - DNA, 22 bp, Artificial Sequence
  chemically synthesized
tagtcattgctgtccaatgatg

SEQ ID NO: 974189 - DNA, 22 bp, Artificial Sequence
  chemically synthesized
tgtagtcattgctgtccaatga

SEQ ID NO: 974190 - DNA, 22 bp, Artificial Sequence
  chemically synthesized
tgtgttttcatcattggacagc

SEQ ID NO: 974191 - DNA, 22 bp, Artificial Sequence
  chemically synthesized
gtgttttcatcattggacagca

SEQ ID NO: 974192 - DNA, 22 bp, Artificial Sequence
  chemically synthesized
tgttttcatcattggacagcaa

SEQ ID NO: 974193 - DNA, 22 bp, Artificial Sequence
  chemically synthesized
tcatcattggacagcaatgact

SEQ ID NO: 974194 - DNA, 22 bp, Artificial Sequence
  chemically synthesized
catcattggacagcaatgacta

SEQ ID NO: 974195 - DNA, 22 bp, Artificial Sequence
  chemically synthesized
atcattggacagcaatgactac

SEQ ID NO: 974196 - DNA, 22 bp, Artificial Sequence
  chemically synthesized
ccgtggccggttctgtagtcat

SEQ ID NO: 974197 - DNA, 22 bp, Artificial Sequence
  chemically synthesized
ctgccgtggccggttctgtagt

SEQ ID NO: 974198 - DNA, 22 bp, Artificial Sequence
  chemically synthesized
gctgccgtggccggttctgtag

SEQ ID NO: 974199 - DNA, 22 bp, Artificial Sequence
  chemically synthesized
gacagcaatgactacagaaccg

SEQ ID NO: 974200 - DNA, 22 bp, Artificial Sequence
  chemically synthesized
aggggtttgctgccgtggccgg

SEQ ID NO: 974201 - DNA, 22 bp, Artificial Sequence
  chemically synthesized
tgaggggtttgctgccgtggcc

SEQ ID NO: 974202 - DNA, 22 bp, Artificial Sequence
  chemically synthesized
cagaaccggccacggcagcaaa

SEQ ID NO: 974203 - DNA, 22 bp, Artificial Sequence
  chemically synthesized
aactctgaggggtttgctgccg

SEQ ID NO: 974204 - DNA, 22 bp, Artificial Sequence
  chemically synthesized
ccaagccctgaactctgagggg

SEQ ID NO: 974205 - DNA, 22 bp, Artificial Sequence
  chemically synthesized
ccccactcccaagccctgaact

SEQ ID NO: 974206 - DNA, 22 bp, Artificial Sequence
  chemically synthesized
agagttcagggcttgggagtgg

SEQ ID NO: 974207 - DNA, 22 bp, Artificial Sequence
  chemically synthesized
tccatcccactcccccactccc

SEQ ID NO: 974208 - DNA, 22 bp, Artificial Sequence
  chemically synthesized
ttgtccatcccactcccccact

SEQ ID NO: 974209 - DNA, 22 bp, Artificial Sequence
  chemically synthesized
agggcttgggagtgggggagtg

SEQ ID NO: 974210 - DNA, 22 bp, Artificial Sequence
  chemically synthesized
agttgttgtccatcccactccc

SEQ ID NO: 974211 - DNA, 22 bp, Artificial Sequence
  chemically synthesized
ctcagttgttgtccatcccact

SEQ ID NO: 974212 - DNA, 22 bp, Artificial Sequence
  chemically synthesized
gggagtgggggagtgggatgga

SEQ ID NO: 974213 - DNA, 22 bp, Artificial Sequence
  chemically synthesized
ggagtgggggagtgggatggac

SEQ ID NO: 974214 - DNA, 22 bp, Artificial Sequence
  chemically synthesized
cctcctcagttgttgtccatcc

SEQ ID NO: 974215 - DNA, 22 bp, Artificial Sequence
  chemically synthesized
tgcctcctcagttgttgtccat

SEQ ID NO: 974216 - DNA, 22 bp, Artificial Sequence
  chemically synthesized
tctctgcctcctcagttgttgt

SEQ ID NO: 974217 - DNA, 22 bp, Artificial Sequence
  chemically synthesized
tgtctctgcctcctcagttgtt

SEQ ID NO: 974218 - DNA, 22 bp, Artificial Sequence
  chemically synthesized
tctgtctctgcctcctcagttg

SEQ ID NO: 974219 - DNA, 22 bp, Artificial Sequence
  chemically synthesized
agcagttctctgtctctgcctc

SEQ ID NO: 974220 - DNA, 22 bp, Artificial Sequence
  chemically synthesized
ctaagcagttctctgtctctgc

SEQ ID NO: 974221 - DNA, 22 bp, Artificial Sequence
  chemically synthesized
gctaagcagttctctgtctctg

SEQ ID NO: 974222 - DNA, 22 bp, Artificial Sequence
  chemically synthesized
tgctaagcagttctctgtctct

SEQ ID NO: 974223 - DNA, 22 bp, Artificial Sequence
  chemically synthesized
ttgctaagcagttctctgtctc

SEQ ID NO: 974224 - DNA, 22 bp, Artificial Sequence
  chemically synthesized
tttgctaagcagttctctgtct

SEQ ID NO: 974225 - DNA, 22 bp, Artificial Sequence
  chemically synthesized
aggaggcagagacagagaactg

SEQ ID NO: 974226 - DNA, 22 bp, Artificial Sequence
  chemically synthesized
ctttttgctaagcagttctctg

SEQ ID NO: 974227 - DNA, 22 bp, Artificial Sequence
  chemically synthesized
cctttttgctaagcagttctct

SEQ ID NO: 974228 - DNA, 22 bp, Artificial Sequence
  chemically synthesized
ttcctttttgctaagcagttct

SEQ ID NO: 974229 - DNA, 22 bp, Artificial Sequence
  chemically synthesized
cttcctttttgctaagcagttc

SEQ ID NO: 974230 - DNA, 22 bp, Artificial Sequence
  chemically synthesized
ttcttcctttttgctaagcagt

SEQ ID NO: 974231 - DNA, 22 bp, Artificial Sequence
  chemically synthesized
cttcttcctttttgctaagcag

SEQ ID NO: 974232 - DNA, 22 bp, Artificial Sequence
  chemically synthesized
atttcttcttcctttttgctaa

SEQ ID NO: 974233 - DNA, 22 bp, Artificial Sequence
  chemically synthesized
ttgatttcttcttcctttttgc

SEQ ID NO: 974234 - DNA, 22 bp, Artificial Sequence
  chemically synthesized
cttagcaaaaaggaagaagaaa

SEQ ID NO: 974235 - DNA, 22 bp, Artificial Sequence
  chemically synthesized
agcaaaaaggaagaagaaatca

SEQ ID NO: 974236 - DNA, 22 bp, Artificial Sequence
  chemically synthesized
gcaaaaaggaagaagaaatcaa

SEQ ID NO: 974237 - DNA, 22 bp, Artificial Sequence
  chemically synthesized
cagtagcccaaggagagaagat

SEQ ID NO: 974238 - DNA, 22 bp, Artificial Sequence
  chemically synthesized
acagagttgcagtagcccaagg

SEQ ID NO: 974239 - DNA, 22 bp, Artificial Sequence
  chemically synthesized
tcttctctccttgggctactgc

SEQ ID NO: 974240 - DNA, 22 bp, Artificial Sequence
  chemically synthesized
aattaacagagttgcagtagcc

SEQ ID NO: 974241 - DNA, 22 bp, Artificial Sequence
  chemically synthesized
ctctccttgggctactgcaact

SEQ ID NO: 974242 - DNA, 22 bp, Artificial Sequence
  chemically synthesized
tctccttgggctactgcaactc

SEQ ID NO: 974243 - DNA, 22 bp, Artificial Sequence
  chemically synthesized
tccttgggctactgcaactctg

SEQ ID NO: 974244 - DNA, 22 bp, Artificial Sequence
  chemically synthesized
cttgggctactgcaactctgtt

SEQ ID NO: 974245 - DNA, 22 bp, Artificial Sequence
  chemically synthesized
gggctactgcaactctgttaat

SEQ ID NO: 974246 - DNA, 22 bp, Artificial Sequence
  chemically synthesized
ggctactgcaactctgttaatt

SEQ ID NO: 974247 - DNA, 22 bp, Artificial Sequence
  chemically synthesized
ctgcaactctgttaatttaggc

SEQ ID NO: 974248 - DNA, 22 bp, Artificial Sequence
  chemically synthesized
caactctgttaatttaggcatg

SEQ ID NO: 974249 - DNA, 22 bp, Artificial Sequence
  chemically synthesized
tgttaatttaggcatgattttt

SEQ ID NO: 974250 - DNA, 22 bp, Artificial Sequence
  chemically synthesized
ttaatttaggcatgatttttgt

SEQ ID NO: 974251 - DNA, 22 bp, Artificial Sequence
  chemically synthesized
aaagaatatgtagtacaaaaat

SEQ ID NO: 974252 - DNA, 22 bp, Artificial Sequence
  chemically synthesized
atttaggcatgatttttgtact

SEQ ID NO: 974253 - DNA, 22 bp, Artificial Sequence
  chemically synthesized
aggcatgatttttgtactacat

SEQ ID NO: 974254 - DNA, 22 bp, Artificial Sequence
  chemically synthesized
ggcatgatttttgtactacata

SEQ ID NO: 974255 - DNA, 22 bp, Artificial Sequence
  chemically synthesized
caattcaaagaatatgtagtac

SEQ ID NO: 974256 - DNA, 22 bp, Artificial Sequence
  chemically synthesized
ccaattcaaagaatatgtagta

SEQ ID NO: 974257 - DNA, 22 bp, Artificial Sequence
  chemically synthesized
tccaattcaaagaatatgtagt

SEQ ID NO: 974258 - DNA, 22 bp, Artificial Sequence
  chemically synthesized
ttgtactacatattctttgaat

SEQ ID NO: 974259 - DNA, 22 bp, Artificial Sequence
  chemically synthesized
tgtactacatattctttgaatt

SEQ ID NO: 974260 - DNA, 22 bp, Artificial Sequence
  chemically synthesized
gtactacatattctttgaattg

SEQ ID NO: 974261 - DNA, 22 bp, Artificial Sequence
  chemically synthesized
tactacatattctttgaattgg

SEQ ID NO: 974262 - DNA, 22 bp, Artificial Sequence
  chemically synthesized
catattctttgaattggaaaat

SEQ ID NO: 974263 - DNA, 22 bp, Artificial Sequence
  chemically synthesized
tttgaattggaaaatatatttt

SEQ ID NO: 974264 - DNA, 22 bp, Artificial Sequence
  chemically synthesized
ccgaaatacatcaaaaatatat

SEQ ID NO: 974265 - DNA, 22 bp, Artificial Sequence
  chemically synthesized
tgaattggaaaatatatttttg

SEQ ID NO: 974266 - DNA, 22 bp, Artificial Sequence
  chemically synthesized
gaattggaaaatatatttttga

SEQ ID NO: 974267 - DNA, 22 bp, Artificial Sequence
  chemically synthesized
aattggaaaatatatttttgat

SEQ ID NO: 974268 - DNA, 22 bp, Artificial Sequence
  chemically synthesized
cctcccgaaatacatcaaaaat

SEQ ID NO: 974269 - DNA, 22 bp, Artificial Sequence
  chemically synthesized
gaaaatatatttttgatgtatt

SEQ ID NO: 974270 - DNA, 22 bp, Artificial Sequence
  chemically synthesized
tgtattacctcccgaaatacat

SEQ ID NO: 974271 - DNA, 22 bp, Artificial Sequence
  chemically synthesized
ttgatgtatttcgggaggtaat

SEQ ID NO: 974272 - DNA, 22 bp, Artificial Sequence
  chemically synthesized
tgatgtatttcgggaggtaata

SEQ ID NO: 974273 - DNA, 22 bp, Artificial Sequence
  chemically synthesized
gatgtatttcgggaggtaatac

SEQ ID NO: 974274 - DNA, 22 bp, Artificial Sequence
  chemically synthesized
atgtatttcgggaggtaataca

SEQ ID NO: 974275 - DNA, 22 bp, Artificial Sequence
  chemically synthesized
tcagaaggattatgtattacct

SEQ ID NO: 974276 - DNA, 22 bp, Artificial Sequence
  chemically synthesized
atcagaaggattatgtattacc

SEQ ID NO: 974277 - DNA, 22 bp, Artificial Sequence
  chemically synthesized
cttatcagaaggattatgtatt

SEQ ID NO: 974278 - DNA, 22 bp, Artificial Sequence
  chemically synthesized
cgggaggtaatacataatcctt

SEQ ID NO: 974279 - DNA, 22 bp, Artificial Sequence
  chemically synthesized
gggaggtaatacataatccttc

SEQ ID NO: 974280 - DNA, 22 bp, Artificial Sequence
  chemically synthesized
aacaaatattgcttatcagaag

SEQ ID NO: 974281 - DNA, 22 bp, Artificial Sequence
  chemically synthesized
ctgataagcaatatttgttgag

SEQ ID NO: 974282 - DNA, 22 bp, Artificial Sequence
  chemically synthesized
tgataagcaatatttgttgagc

SEQ ID NO: 974283 - DNA, 22 bp, Artificial Sequence
  chemically synthesized
gagcagataaaatgctcaacaa

SEQ ID NO: 974284 - DNA, 22 bp, Artificial Sequence
  chemically synthesized
ataagcaatatttgttgagcat

SEQ ID NO: 974285 - DNA, 22 bp, Artificial Sequence
  chemically synthesized
acataattagagcagataaaat

SEQ ID NO: 974286 - DNA, 22 bp, Artificial Sequence
  chemically synthesized
gttgagcattttatctgctcta

SEQ ID NO: 974287 - DNA, 22 bp, Artificial Sequence
  chemically synthesized
ttgagcattttatctgctctaa

SEQ ID NO: 974288 - DNA, 22 bp, Artificial Sequence
  chemically synthesized
agcattttatctgctctaatta

SEQ ID NO: 974289 - DNA, 22 bp, Artificial Sequence
  chemically synthesized
tatctgctctaattatgtcagg

SEQ ID NO: 974290 - DNA, 22 bp, Artificial Sequence
  chemically synthesized
atctgctctaattatgtcaggt

SEQ ID NO: 974291 - DNA, 22 bp, Artificial Sequence
  chemically synthesized
tctgctctaattatgtcaggtg

SEQ ID NO: 974292 - DNA, 22 bp, Artificial Sequence
  chemically synthesized
tgaagtagcaaagcacctgaca

SEQ ID NO: 974293 - DNA, 22 bp, Artificial Sequence
  chemically synthesized
ctctaattatgtcaggtgcttt

SEQ ID NO: 974294 - DNA, 22 bp, Artificial Sequence
  chemically synthesized
ctgtgaagtagcaaagcacctg

SEQ ID NO: 974295 - DNA, 22 bp, Artificial Sequence
  chemically synthesized
taattatgtcaggtgctttgct

SEQ ID NO: 974296 - DNA, 22 bp, Artificial Sequence
  chemically synthesized
attatgtcaggtgctttgctac

SEQ ID NO: 974297 - DNA, 22 bp, Artificial Sequence
  chemically synthesized
tgtcaggtgctttgctacttca

SEQ ID NO: 974298 - DNA, 22 bp, Artificial Sequence
  chemically synthesized
tcatgtggttactgtgaagtag

SEQ ID NO: 974299 - DNA, 22 bp, Artificial Sequence
  chemically synthesized
atcatgtggttactgtgaagta

SEQ ID NO: 974300 - DNA, 22 bp, Artificial Sequence
  chemically synthesized
tatcatgtggttactgtgaagt

SEQ ID NO: 974301 - DNA, 22 bp, Artificial Sequence
  chemically synthesized
tttatcatgtggttactgtgaa

SEQ ID NO: 974302 - DNA, 22 bp, Artificial Sequence
  chemically synthesized
tgctacttcacagtaaccacat

SEQ ID NO: 974303 - DNA, 22 bp, Artificial Sequence
  chemically synthesized
gctacttcacagtaaccacatg

SEQ ID NO: 974304 - DNA, 22 bp, Artificial Sequence
  chemically synthesized
atagttctttatcatgtggtta

SEQ ID NO: 974305 - DNA, 22 bp, Artificial Sequence
  chemically synthesized
ctacttcacagtaaccacatga

SEQ ID NO: 974306 - DNA, 22 bp, Artificial Sequence
  chemically synthesized
ttcatagttctttatcatgtgg

SEQ ID NO: 974307 - DNA, 22 bp, Artificial Sequence
  chemically synthesized
cttcacagtaaccacatgataa

SEQ ID NO: 974308 - DNA, 22 bp, Artificial Sequence
  chemically synthesized
cacagtaaccacatgataaaga

SEQ ID NO: 974309 - DNA, 22 bp, Artificial Sequence
  chemically synthesized
acagtaaccacatgataaagaa

SEQ ID NO: 974310 - DNA, 22 bp, Artificial Sequence
  chemically synthesized
gggctattcatagttctttatc

SEQ ID NO: 974311 - DNA, 22 bp, Artificial Sequence
  chemically synthesized
agctagggctattcatagttct

SEQ ID NO: 974312 - DNA, 22 bp, Artificial Sequence
  chemically synthesized
taagctagggctattcatagtt

SEQ ID NO: 974313 - DNA, 22 bp, Artificial Sequence
  chemically synthesized
ctaagctagggctattcatagt

SEQ ID NO: 974314 - DNA, 22 bp, Artificial Sequence
  chemically synthesized
tttctaagctagggctattcat

SEQ ID NO: 974315 - DNA, 22 bp, Artificial Sequence
  chemically synthesized
atttctaagctagggctattca

SEQ ID NO: 974316 - DNA, 22 bp, Artificial Sequence
  chemically synthesized
tatttctaagctagggctattc

SEQ ID NO: 974317 - DNA, 22 bp, Artificial Sequence
  chemically synthesized
ttatttctaagctagggctatt

SEQ ID NO: 974318 - DNA, 22 bp, Artificial Sequence
  chemically synthesized
cttttatttctaagctagggct

SEQ ID NO: 974319 - DNA, 22 bp, Artificial Sequence
  chemically synthesized
acttttatttctaagctagggc

SEQ ID NO: 974320 - DNA, 22 bp, Artificial Sequence
  chemically synthesized
tacttttatttctaagctaggg

SEQ ID NO: 974321 - DNA, 22 bp, Artificial Sequence
  chemically synthesized
ttacttttatttctaagctagg

SEQ ID NO: 974322 - DNA, 22 bp, Artificial Sequence
  chemically synthesized
tgaatagccctagcttagaaat

SEQ ID NO: 974323 - DNA, 22 bp, Artificial Sequence
  chemically synthesized
gtttttacttttatttctaagc

SEQ ID NO: 974324 - DNA, 22 bp, Artificial Sequence
  chemically synthesized
tagtttttacttttatttctaa

SEQ ID NO: 974325 - DNA, 22 bp, Artificial Sequence
  chemically synthesized
tctagtttttacttttatttct

SEQ ID NO: 974326 - DNA, 22 bp, Artificial Sequence
  chemically synthesized
cctctctagtttttacttttat

SEQ ID NO: 974327 - DNA, 22 bp, Artificial Sequence
  chemically synthesized
acctctctagtttttactttta

SEQ ID NO: 974328 - DNA, 22 bp, Artificial Sequence
  chemically synthesized
tacctctctagtttttactttt

SEQ ID NO: 974329 - DNA, 22 bp, Artificial Sequence
  chemically synthesized
gcttagaaataaaagtaaaaac

SEQ ID NO: 974330 - DNA, 22 bp, Artificial Sequence
  chemically synthesized
ctttacctctctagtttttact

SEQ ID NO: 974331 - DNA, 22 bp, Artificial Sequence
  chemically synthesized
agaaataaaagtaaaaactaga

SEQ ID NO: 974332 - DNA, 22 bp, Artificial Sequence
  chemically synthesized
gaaataaaagtaaaaactagag

SEQ ID NO: 974333 - DNA, 22 bp, Artificial Sequence
  chemically synthesized
ggtgggttgctttacctctcta

SEQ ID NO: 974334 - DNA, 22 bp, Artificial Sequence
  chemically synthesized
gagaggtaaagcaacccaccca

SEQ ID NO: 974335 - DNA, 22 bp, Artificial Sequence
  chemically synthesized
tgtatatgatgttgggtgggtt

SEQ ID NO: 974336 - DNA, 22 bp, Artificial Sequence
  chemically synthesized
actatgtatatgatgttgggtg

SEQ ID NO: 974337 - DNA, 22 bp, Artificial Sequence
  chemically synthesized
cactatgtatatgatgttgggt

SEQ ID NO: 974338 - DNA, 22 bp, Artificial Sequence
  chemically synthesized
ttcactatgtatatgatgttgg

SEQ ID NO: 974339 - DNA, 22 bp, Artificial Sequence
  chemically synthesized
cttcactatgtatatgatgttg

SEQ ID NO: 974340 - DNA, 22 bp, Artificial Sequence
  chemically synthesized
gcagcttcttcactatgtatat

SEQ ID NO: 974341 - DNA, 22 bp, Artificial Sequence
  chemically synthesized
cagtcctggcagcttcttcact

SEQ ID NO: 974342 - DNA, 22 bp, Artificial Sequence
  chemically synthesized
gcctccagtcctggcagcttct

SEQ ID NO: 974343 - DNA, 22 bp, Artificial Sequence
  chemically synthesized
gaggacacaggcaaatctggcc

SEQ ID NO: 974344 - DNA, 22 bp, Artificial Sequence
  chemically synthesized
ccaggactggaggccagatttg

SEQ ID NO: 974345 - DNA, 22 bp, Artificial Sequence
  chemically synthesized
gcattagaggacacaggcaaat

SEQ ID NO: 974346 - DNA, 22 bp, Artificial Sequence
  chemically synthesized
agcattagaggacacaggcaaa

SEQ ID NO: 974347 - DNA, 22 bp, Artificial Sequence
  chemically synthesized
gaggccagatttgcctgtgtcc

SEQ ID NO: 974348 - DNA, 22 bp, Artificial Sequence
  chemically synthesized
tgcacatttagcattagaggac

SEQ ID NO: 974349 - DNA, 22 bp, Artificial Sequence
  chemically synthesized
gcctgtgtcctctaatgctaaa

SEQ ID NO: 974350 - DNA, 22 bp, Artificial Sequence
  chemically synthesized
cctgtgtcctctaatgctaaat

SEQ ID NO: 974351 - DNA, 22 bp, Artificial Sequence
  chemically synthesized
agccctgtgcacatttagcatt

SEQ ID NO: 974352 - DNA, 22 bp, Artificial Sequence
  chemically synthesized
taagccctgtgcacatttagca

SEQ ID NO: 974353 - DNA, 22 bp, Artificial Sequence
  chemically synthesized
tgtcctctaatgctaaatgtgc

SEQ ID NO: 974354 - DNA, 22 bp, Artificial Sequence
  chemically synthesized
taatgctaaatgtgcacagggc

SEQ ID NO: 974355 - DNA, 22 bp, Artificial Sequence
  chemically synthesized
agaacagctctaagccctgtgc

SEQ ID NO: 974356 - DNA, 22 bp, Artificial Sequence
  chemically synthesized
atgctaaatgtgcacagggctt

SEQ ID NO: 974357 - DNA, 22 bp, Artificial Sequence
  chemically synthesized
aatgtgcacagggcttagagct

SEQ ID NO: 974358 - DNA, 22 bp, Artificial Sequence
  chemically synthesized
cagaattcagaacagctctaag

SEQ ID NO: 974359 - DNA, 22 bp, Artificial Sequence
  chemically synthesized
ggtattacagaattcagaacag

SEQ ID NO: 974360 - DNA, 22 bp, Artificial Sequence
  chemically synthesized
agagctgttctgaattctgtaa

SEQ ID NO: 974361 - DNA, 22 bp, Artificial Sequence
  chemically synthesized
gagctgttctgaattctgtaat

SEQ ID NO: 974362 - DNA, 22 bp, Artificial Sequence
  chemically synthesized
ttctgaattctgtaatacccaa

SEQ ID NO: 974363 - DNA, 22 bp, Artificial Sequence
  chemically synthesized
aaaagggagacattgggtatta

SEQ ID NO: 974364 - DNA, 22 bp, Artificial Sequence
  chemically synthesized
taaaaagggagacattgggtat

SEQ ID NO: 974365 - DNA, 22 bp, Artificial Sequence
  chemically synthesized
tgaattctgtaatacccaatgt

SEQ ID NO: 974366 - DNA, 22 bp, Artificial Sequence
  chemically synthesized
aattctgtaatacccaatgtct

SEQ ID NO: 974367 - DNA, 22 bp, Artificial Sequence
  chemically synthesized
gttctaaaaagggagacattgg

SEQ ID NO: 974368 - DNA, 22 bp, Artificial Sequence
  chemically synthesized
tgtaatacccaatgtctccctt

SEQ ID NO: 974369 - DNA, 22 bp, Artificial Sequence
  chemically synthesized
taatacccaatgtctccctttt

SEQ ID NO: 974370 - DNA, 22 bp, Artificial Sequence
  chemically synthesized
aatgttggttctaaaaagggag

SEQ ID NO: 974371 - DNA, 22 bp, Artificial Sequence
  chemically synthesized
ctaaatgttggttctaaaaagg

SEQ ID NO: 974372 - DNA, 22 bp, Artificial Sequence
  chemically synthesized
cctttttagaaccaacatttag

SEQ ID NO: 974373 - DNA, 22 bp, Artificial Sequence
  chemically synthesized
tttagaaccaacatttagtaac

SEQ ID NO: 974374 - DNA, 22 bp, Artificial Sequence
  chemically synthesized
ttagaaccaacatttagtaaca

SEQ ID NO: 974375 - DNA, 22 bp, Artificial Sequence
  chemically synthesized
tagaaccaacatttagtaacac

SEQ ID NO: 974376 - DNA, 22 bp, Artificial Sequence
  chemically synthesized
agaaccaacatttagtaacacc

SEQ ID NO: 974377 - DNA, 22 bp, Artificial Sequence
  chemically synthesized
gaaccaacatttagtaacaccc

SEQ ID NO: 974378 - DNA, 22 bp, Artificial Sequence
  chemically synthesized
agggtggtaaatgagggtgtta

SEQ ID NO: 974379 - DNA, 22 bp, Artificial Sequence
  chemically synthesized
cagggtggtaaatgagggtgtt

SEQ ID NO: 974380 - DNA, 22 bp, Artificial Sequence
  chemically synthesized
atttcagggtggtaaatgaggg

SEQ ID NO: 974381 - DNA, 22 bp, Artificial Sequence
  chemically synthesized
catttcagggtggtaaatgagg

SEQ ID NO: 974382 - DNA, 22 bp, Artificial Sequence
  chemically synthesized
agtaacaccctcatttaccacc

SEQ ID NO: 974383 - DNA, 22 bp, Artificial Sequence
  chemically synthesized
atttcatttcagggtggtaaat

SEQ ID NO: 974384 - DNA, 22 bp, Artificial Sequence
  chemically synthesized
gtaacaccctcatttaccaccc

SEQ ID NO: 974385 - DNA, 22 bp, Artificial Sequence
  chemically synthesized
ttcatttcatttcagggtggta

SEQ ID NO: 974386 - DNA, 22 bp, Artificial Sequence
  chemically synthesized
atttaccaccctgaaatgaaat

SEQ ID NO: 974387 - DNA, 22 bp, Artificial Sequence
  chemically synthesized
tgagatctattcatttcatttc

SEQ ID NO: 974388 - DNA, 22 bp, Artificial Sequence
  chemically synthesized
atgagatctattcatttcattt

SEQ ID NO: 974389 - DNA, 22 bp, Artificial Sequence
  chemically synthesized
accaccctgaaatgaaatgaat

SEQ ID NO: 974390 - DNA, 22 bp, Artificial Sequence
  chemically synthesized
ccaccctgaaatgaaatgaata

SEQ ID NO: 974391 - DNA, 22 bp, Artificial Sequence
  chemically synthesized
aaatgaaatgaatagatctcat

SEQ ID NO: 974392 - DNA, 22 bp, Artificial Sequence
  chemically synthesized
tgcagacaagtttatgagatct

SEQ ID NO: 974393 - DNA, 22 bp, Artificial Sequence
  chemically synthesized
gatcactgtgcagacaagttta

SEQ ID NO: 974394 - DNA, 22 bp, Artificial Sequence
  chemically synthesized
ataaacttgtctgcacagtgat

SEQ ID NO: 974395 - DNA, 22 bp, Artificial Sequence
  chemically synthesized
tatgatggttagatcactgtgc

SEQ ID NO: 974396 - DNA, 22 bp, Artificial Sequence
  chemically synthesized
atatgatggttagatcactgtg

SEQ ID NO: 974397 - DNA, 22 bp, Artificial Sequence
  chemically synthesized
tatatgatggttagatcactgt

SEQ ID NO: 974398 - DNA, 22 bp, Artificial Sequence
  chemically synthesized
ttatatgatggttagatcactg

SEQ ID NO: 974399 - DNA, 22 bp, Artificial Sequence
  chemically synthesized
tttatatgatggttagatcact

SEQ ID NO: 974400 - DNA, 22 bp, Artificial Sequence
  chemically synthesized
ttttatatgatggttagatcac

SEQ ID NO: 974401 - DNA, 22 bp, Artificial Sequence
  chemically synthesized
ttttttatatgatggttagatc

SEQ ID NO: 974402 - DNA, 22 bp, Artificial Sequence
  chemically synthesized
gtctgcacagtgatctaaccat

SEQ ID NO: 974403 - DNA, 22 bp, Artificial Sequence
  chemically synthesized
cttttttatatgatggttagat

SEQ ID NO: 974404 - DNA, 22 bp, Artificial Sequence
  chemically synthesized
tctgcacagtgatctaaccatc

SEQ ID NO: 974405 - DNA, 22 bp, Artificial Sequence
  chemically synthesized
tcttttttatatgatggttaga

SEQ ID NO: 974406 - DNA, 22 bp, Artificial Sequence
  chemically synthesized
tttcttttttatatgatggtta

SEQ ID NO: 974407 - DNA, 22 bp, Artificial Sequence
  chemically synthesized
ctttcttttttatatgatggtt

SEQ ID NO: 974408 - DNA, 22 bp, Artificial Sequence
  chemically synthesized
cacagtgatctaaccatcatat

SEQ ID NO: 974409 - DNA, 22 bp, Artificial Sequence
  chemically synthesized
tctttcttttttatatgatggt

SEQ ID NO: 974410 - DNA, 22 bp, Artificial Sequence
  chemically synthesized
ttttctttcttttttatatgat

SEQ ID NO: 974411 - DNA, 22 bp, Artificial Sequence
  chemically synthesized
tgaattattttctttctttttt

SEQ ID NO: 974412 - DNA, 22 bp, Artificial Sequence
  chemically synthesized
accatcatataaaaaagaaaga

SEQ ID NO: 974413 - DNA, 22 bp, Artificial Sequence
  chemically synthesized
tgttatgaattattttctttct

SEQ ID NO: 974414 - DNA, 22 bp, Artificial Sequence
  chemically synthesized
ttgtgttatgaattattttctt

SEQ ID NO: 974415 - DNA, 22 bp, Artificial Sequence
  chemically synthesized
aaataaaataaaacatatattg

SEQ ID NO: 974416 - DNA, 22 bp, Artificial Sequence
  chemically synthesized
aaaataaaataaaacatatatt

SEQ ID NO: 974417 - DNA, 22 bp, Artificial Sequence
  chemically synthesized
taaaataaaataaaacatatat

SEQ ID NO: 974418 - DNA, 22 bp, Artificial Sequence
  chemically synthesized
ataacacaacaatatatgtttt

SEQ ID NO: 974419 - DNA, 22 bp, Artificial Sequence
  chemically synthesized
aaagtattttaaaataaaataa

SEQ ID NO: 974420 - DNA, 22 bp, Artificial Sequence
  chemically synthesized
caaagtattttaaaataaaata

SEQ ID NO: 974421 - DNA, 22 bp, Artificial Sequence
  chemically synthesized
acacgtttcaaagtattttaaa

SEQ ID NO: 974422 - DNA, 22 bp, Artificial Sequence
  chemically synthesized
tattttattttaaaatactttg

SEQ ID NO: 974423 - DNA, 22 bp, Artificial Sequence
  chemically synthesized
attttattttaaaatactttga

SEQ ID NO: 974424 - DNA, 22 bp, Artificial Sequence
  chemically synthesized
ttttattttaaaatactttgaa

SEQ ID NO: 974425 - DNA, 22 bp, Artificial Sequence
  chemically synthesized
tattttaaaatactttgaaacg

SEQ ID NO: 974426 - DNA, 22 bp, Artificial Sequence
  chemically synthesized
attttaaaatactttgaaacgt

SEQ ID NO: 974427 - DNA, 22 bp, Artificial Sequence
  chemically synthesized
ttttaaaatactttgaaacgtg

SEQ ID NO: 974428 - DNA, 22 bp, Artificial Sequence
  chemically synthesized
taaaatactttgaaacgtgtga

SEQ ID NO: 974429 - DNA, 22 bp, Artificial Sequence
  chemically synthesized
aaaatactttgaaacgtgtgaa

SEQ ID NO: 974430 - DNA, 22 bp, Artificial Sequence
  chemically synthesized
aaatactttgaaacgtgtgaat

SEQ ID NO: 974431 - DNA, 22 bp, Artificial Sequence
  chemically synthesized
gtgtggccatgaaaacattcac

SEQ ID NO: 974432 - DNA, 22 bp, Artificial Sequence
  chemically synthesized
tggtgtggccatgaaaacattc

SEQ ID NO: 974433 - DNA, 22 bp, Artificial Sequence
  chemically synthesized
ctggtgtggccatgaaaacatt

SEQ ID NO: 974434 - DNA, 22 bp, Artificial Sequence
  chemically synthesized
tgaaacgtgtgaatgttttcat

SEQ ID NO: 974435 - DNA, 22 bp, Artificial Sequence
  chemically synthesized
gaaacgtgtgaatgttttcatg

SEQ ID NO: 974436 - DNA, 22 bp, Artificial Sequence
  chemically synthesized
aaacgtgtgaatgttttcatgg

SEQ ID NO: 974437 - DNA, 22 bp, Artificial Sequence
  chemically synthesized
aataggtcttctggtgtggcca

SEQ ID NO: 974438 - DNA, 22 bp, Artificial Sequence
  chemically synthesized
caataggtcttctggtgtggcc

SEQ ID NO: 974439 - DNA, 22 bp, Artificial Sequence
  chemically synthesized
gcatcttcaataggtcttctgg

SEQ ID NO: 974440 - DNA, 22 bp, Artificial Sequence
  chemically synthesized
tcatggccacaccagaagacct

SEQ ID NO: 974441 - DNA, 22 bp, Artificial Sequence
  chemically synthesized
catggccacaccagaagaccta

SEQ ID NO: 974442 - DNA, 22 bp, Artificial Sequence
  chemically synthesized
atggccacaccagaagacctat

SEQ ID NO: 974443 - DNA, 22 bp, Artificial Sequence
  chemically synthesized
acataggcgcaagtgtctggca

SEQ ID NO: 974444 - DNA, 22 bp, Artificial Sequence
  chemically synthesized
aacataggcgcaagtgtctggc

SEQ ID NO: 974445 - DNA, 22 bp, Artificial Sequence
  chemically synthesized
ttaacataggcgcaagtgtctg

SEQ ID NO: 974446 - DNA, 22 bp, Artificial Sequence
  chemically synthesized
ttgaagatgccagacacttgcg

SEQ ID NO: 974447 - DNA, 22 bp, Artificial Sequence
  chemically synthesized
aagatgccagacacttgcgcct

SEQ ID NO: 974448 - DNA, 22 bp, Artificial Sequence
  chemically synthesized
aaggggattcttaacataggcg

SEQ ID NO: 974449 - DNA, 22 bp, Artificial Sequence
  chemically synthesized
cattaaaggggattcttaacat

SEQ ID NO: 974450 - DNA, 22 bp, Artificial Sequence
  chemically synthesized
tacattaaaggggattcttaac

SEQ ID NO: 974451 - DNA, 22 bp, Artificial Sequence
  chemically synthesized
gcgcctatgttaagaatcccct

SEQ ID NO: 974452 - DNA, 22 bp, Artificial Sequence
  chemically synthesized
cgcctatgttaagaatcccctt

SEQ ID NO: 974453 - DNA, 22 bp, Artificial Sequence
  chemically synthesized
aaaaattctacattaaagggga

SEQ ID NO: 974454 - DNA, 22 bp, Artificial Sequence
  chemically synthesized
gaaaaattctacattaaagggg

SEQ ID NO: 974455 - DNA, 22 bp, Artificial Sequence
  chemically synthesized
tgttaagaatcccctttaatgt

SEQ ID NO: 974456 - DNA, 22 bp, Artificial Sequence
  chemically synthesized
agaatcccctttaatgtagaat

SEQ ID NO: 974457 - DNA, 22 bp, Artificial Sequence
  chemically synthesized
aggggacatttgaaaaattcta

SEQ ID NO: 974458 - DNA, 22 bp, Artificial Sequence
  chemically synthesized
tattcaggggacatttgaaaaa

SEQ ID NO: 974459 - DNA, 22 bp, Artificial Sequence
  chemically synthesized
taatgtagaatttttcaaatgt

SEQ ID NO: 974460 - DNA, 22 bp, Artificial Sequence
  chemically synthesized
aatgtagaatttttcaaatgtc

SEQ ID NO: 974461 - DNA, 22 bp, Artificial Sequence
  chemically synthesized
atgtagaatttttcaaatgtcc

SEQ ID NO: 974462 - DNA, 22 bp, Artificial Sequence
  chemically synthesized
acctatattcaggggacatttg

SEQ ID NO: 974463 - DNA, 22 bp, Artificial Sequence
  chemically synthesized
ttcaaatgtcccctgaatatag

SEQ ID NO: 974464 - DNA, 22 bp, Artificial Sequence
  chemically synthesized
catacaactcacctatattcag

SEQ ID NO: 974465 - DNA, 22 bp, Artificial Sequence
  chemically synthesized
tcaaatgtcccctgaatatagg

SEQ ID NO: 974466 - DNA, 22 bp, Artificial Sequence
  chemically synthesized
caaatgtcccctgaatataggt

SEQ ID NO: 974467 - DNA, 22 bp, Artificial Sequence
  chemically synthesized
aaatgtcccctgaatataggtg

SEQ ID NO: 974468 - DNA, 22 bp, Artificial Sequence
  chemically synthesized
agtgttccatacaactcaccta

SEQ ID NO: 974469 - DNA, 22 bp, Artificial Sequence
  chemically synthesized
gagtgttccatacaactcacct

SEQ ID NO: 974470 - DNA, 22 bp, Artificial Sequence
  chemically synthesized
aatataggtgagttgtatggaa

SEQ ID NO: 974471 - DNA, 22 bp, Artificial Sequence
  chemically synthesized
atggtacttgagtgttccatac

SEQ ID NO: 974472 - DNA, 22 bp, Artificial Sequence
  chemically synthesized
cgactcatggtacttgagtgtt

SEQ ID NO: 974473 - DNA, 22 bp, Artificial Sequence
  chemically synthesized
gcgactcatggtacttgagtgt

SEQ ID NO: 974474 - DNA, 22 bp, Artificial Sequence
  chemically synthesized
tatggaacactcaagtaccatg

SEQ ID NO: 974475 - DNA, 22 bp, Artificial Sequence
  chemically synthesized
atagccttgcgactcatggtac

SEQ ID NO: 974476 - DNA, 22 bp, Artificial Sequence
  chemically synthesized
aatagccttgcgactcatggta

SEQ ID NO: 974477 - DNA, 22 bp, Artificial Sequence
  chemically synthesized
ggacttaatagccttgcgactc

SEQ ID NO: 974478 - DNA, 22 bp, Artificial Sequence
  chemically synthesized
aagtaccatgagtcgcaaggct

SEQ ID NO: 974479 - DNA, 22 bp, Artificial Sequence
  chemically synthesized
catagcagaaaactaggactta

SEQ ID NO: 974480 - DNA, 22 bp, Artificial Sequence
  chemically synthesized
ccatagcagaaaactaggactt

SEQ ID NO: 974481 - DNA, 22 bp, Artificial Sequence
  chemically synthesized
tccatagcagaaaactaggact

SEQ ID NO: 974482 - DNA, 22 bp, Artificial Sequence
  chemically synthesized
ttccatagcagaaaactaggac

SEQ ID NO: 974483 - DNA, 22 bp, Artificial Sequence
  chemically synthesized
ttttccatagcagaaaactagg

SEQ ID NO: 974484 - DNA, 22 bp, Artificial Sequence
  chemically synthesized
ttaagtcctagttttctgctat

SEQ ID NO: 974485 - DNA, 22 bp, Artificial Sequence
  chemically synthesized
ggagctcttttccatagcagaa

SEQ ID NO: 974486 - DNA, 22 bp, Artificial Sequence
  chemically synthesized
agtcctagttttctgctatgga

SEQ ID NO: 974487 - DNA, 22 bp, Artificial Sequence
  chemically synthesized
ctaggagctcttttccatagca

SEQ ID NO: 974488 - DNA, 22 bp, Artificial Sequence
  chemically synthesized
cctaggagctcttttccatagc

SEQ ID NO: 974489 - DNA, 22 bp, Artificial Sequence
  chemically synthesized
gttttctgctatggaaaagagc

SEQ ID NO: 974490 - DNA, 22 bp, Artificial Sequence
  chemically synthesized
gaagtttcctaggagctctttt

SEQ ID NO: 974491 - DNA, 22 bp, Artificial Sequence
  chemically synthesized
tctgctatggaaaagagctcct

SEQ ID NO: 974492 - DNA, 22 bp, Artificial Sequence
  chemically synthesized
tagaagtttcctaggagctctt

SEQ ID NO: 974493 - DNA, 22 bp, Artificial Sequence
  chemically synthesized
ctgctatggaaaagagctccta

SEQ ID NO: 974494 - DNA, 22 bp, Artificial Sequence
  chemically synthesized
ctagaagtttcctaggagctct

SEQ ID NO: 974495 - DNA, 22 bp, Artificial Sequence
  chemically synthesized
tgctatggaaaagagctcctag

SEQ ID NO: 974496 - DNA, 22 bp, Artificial Sequence
  chemically synthesized
ctatggaaaagagctcctagga

SEQ ID NO: 974497 - DNA, 22 bp, Artificial Sequence
  chemically synthesized
tggaaaagagctcctaggaaac

SEQ ID NO: 974498 - DNA, 22 bp, Artificial Sequence
  chemically synthesized
tagaacaatttctagaagtttc

SEQ ID NO: 974499 - DNA, 22 bp, Artificial Sequence
  chemically synthesized
ctaggaaacttctagaaattgt

SEQ ID NO: 974500 - DNA, 22 bp, Artificial Sequence
  chemically synthesized
ggaaacttctagaaattgttct

SEQ ID NO: 974501 - DNA, 22 bp, Artificial Sequence
  chemically synthesized
aagaatgcagcaattatagaac

SEQ ID NO: 974502 - DNA, 22 bp, Artificial Sequence
  chemically synthesized
caagaatgcagcaattatagaa

SEQ ID NO: 974503 - DNA, 22 bp, Artificial Sequence
  chemically synthesized
tcaagaatgcagcaattataga

SEQ ID NO: 974504 - DNA, 22 bp, Artificial Sequence
  chemically synthesized
ctagaaattgttctataattgc

SEQ ID NO: 974505 - DNA, 22 bp, Artificial Sequence
  chemically synthesized
ttcaagaatgcagcaattatag

SEQ ID NO: 974506 - DNA, 22 bp, Artificial Sequence
  chemically synthesized
tagaaattgttctataattgct

SEQ ID NO: 974507 - DNA, 22 bp, Artificial Sequence
  chemically synthesized
gaaattgttctataattgctgc

SEQ ID NO: 974508 - DNA, 22 bp, Artificial Sequence
  chemically synthesized
aatttttcaagaatgcagcaat

SEQ ID NO: 974509 - DNA, 22 bp, Artificial Sequence
  chemically synthesized
ctgaatttttcaagaatgcagc

SEQ ID NO: 974510 - DNA, 22 bp, Artificial Sequence
  chemically synthesized
ttctataattgctgcattcttg

SEQ ID NO: 974511 - DNA, 22 bp, Artificial Sequence
  chemically synthesized
tataattgctgcattcttgaaa

SEQ ID NO: 974512 - DNA, 22 bp, Artificial Sequence
  chemically synthesized
taattgctgcattcttgaaaaa

SEQ ID NO: 974513 - DNA, 22 bp, Artificial Sequence
  chemically synthesized
atagttgctgaatttttcaaga

SEQ ID NO: 974514 - DNA, 22 bp, Artificial Sequence
  chemically synthesized
gatagttgctgaatttttcaag

SEQ ID NO: 974515 - DNA, 22 bp, Artificial Sequence
  chemically synthesized
tgatagttgctgaatttttcaa

SEQ ID NO: 974516 - DNA, 22 bp, Artificial Sequence
  chemically synthesized
ctgcattcttgaaaaattcagc

SEQ ID NO: 974517 - DNA, 22 bp, Artificial Sequence
  chemically synthesized
cattcttgaaaaattcagcaac

SEQ ID NO: 974518 - DNA, 22 bp, Artificial Sequence
  chemically synthesized
ttgaaaaattcagcaactatca

SEQ ID NO: 974519 - DNA, 22 bp, Artificial Sequence
  chemically synthesized
gaaaaattcagcaactatcaaa

SEQ ID NO: 974520 - DNA, 22 bp, Artificial Sequence
  chemically synthesized
aaaaattcagcaactatcaaaa

SEQ ID NO: 974521 - DNA, 22 bp, Artificial Sequence
  chemically synthesized
agcaactatcaaaactgcattt

SEQ ID NO: 974522 - DNA, 22 bp, Artificial Sequence
  chemically synthesized
tcaaaactgcatttcctctcct

SEQ ID NO: 974523 - DNA, 22 bp, Artificial Sequence
  chemically synthesized
gagcagggagacaggagaggaa

SEQ ID NO: 974524 - DNA, 22 bp, Artificial Sequence
  chemically synthesized
ctggagcagggagacaggagag

SEQ ID NO: 974525 - DNA, 22 bp, Artificial Sequence
  chemically synthesized
actggagcagggagacaggaga

SEQ ID NO: 974526 - DNA, 22 bp, Artificial Sequence
  chemically synthesized
tactggagcagggagacaggag

SEQ ID NO: 974527 - DNA, 22 bp, Artificial Sequence
  chemically synthesized
ttactggagcagggagacagga

SEQ ID NO: 974528 - DNA, 22 bp, Artificial Sequence
  chemically synthesized
tttactggagcagggagacagg

SEQ ID NO: 974529 - DNA, 22 bp, Artificial Sequence
  chemically synthesized
catttcctctcctgtctccctg

SEQ ID NO: 974530 - DNA, 22 bp, Artificial Sequence
  chemically synthesized
cctctcctgtctccctgctcca

SEQ ID NO: 974531 - DNA, 22 bp, Artificial Sequence
  chemically synthesized
ctctcctgtctccctgctccag

SEQ ID NO: 974532 - DNA, 22 bp, Artificial Sequence
  chemically synthesized
tcctgtctccctgctccagtaa

SEQ ID NO: 974533 - DNA, 22 bp, Artificial Sequence
  chemically synthesized
tgtggatgttttttactggagc

SEQ ID NO: 974534 - DNA, 22 bp, Artificial Sequence
  chemically synthesized
gtgtggatgttttttactggag

SEQ ID NO: 974535 - DNA, 22 bp, Artificial Sequence
  chemically synthesized
ctgtctccctgctccagtaaaa

SEQ ID NO: 974536 - DNA, 22 bp, Artificial Sequence
  chemically synthesized
tgtgtggatgttttttactgga

SEQ ID NO: 974537 - DNA, 22 bp, Artificial Sequence
  chemically synthesized
tctccctgctccagtaaaaaac

SEQ ID NO: 974538 - DNA, 22 bp, Artificial Sequence
  chemically synthesized
cctgctccagtaaaaaacatcc

SEQ ID NO: 974539 - DNA, 22 bp, Artificial Sequence
  chemically synthesized
ctccagtaaaaaacatccacac

SEQ ID NO: 974540 - DNA, 22 bp, Artificial Sequence
  chemically synthesized
cagtaaaaaacatccacacaaa

SEQ ID NO: 974541 - DNA, 22 bp, Artificial Sequence
  chemically synthesized
acatataaacacaaagcgtgtt

SEQ ID NO: 974542 - DNA, 22 bp, Artificial Sequence
  chemically synthesized
aacatataaacacaaagcgtgt

SEQ ID NO: 974543 - DNA, 22 bp, Artificial Sequence
  chemically synthesized
gaatgtaaatccatttaacata

SEQ ID NO: 974544 - DNA, 22 bp, Artificial Sequence
  chemically synthesized
tgtgtttatatgttaaatggat

SEQ ID NO: 974545 - DNA, 22 bp, Artificial Sequence
  chemically synthesized
gtgtttatatgttaaatggatt

SEQ ID NO: 974546 - DNA, 22 bp, Artificial Sequence
  chemically synthesized
ccctagaatgtaaatccattta

SEQ ID NO: 974547 - DNA, 22 bp, Artificial Sequence
  chemically synthesized
tgtttatatgttaaatggattt

SEQ ID NO: 974548 - DNA, 22 bp, Artificial Sequence
  chemically synthesized
cccctagaatgtaaatccattt

SEQ ID NO: 974549 - DNA, 22 bp, Artificial Sequence
  chemically synthesized
atttcccctagaatgtaaatcc

SEQ ID NO: 974550 - DNA, 22 bp, Artificial Sequence
  chemically synthesized
atatgttaaatggatttacatt

SEQ ID NO: 974551 - DNA, 22 bp, Artificial Sequence
  chemically synthesized
tatgttaaatggatttacattc

SEQ ID NO: 974552 - DNA, 22 bp, Artificial Sequence
  chemically synthesized
tagttaatttcccctagaatgt

SEQ ID NO: 974553 - DNA, 22 bp, Artificial Sequence
  chemically synthesized
atagttaatttcccctagaatg

SEQ ID NO: 974554 - DNA, 22 bp, Artificial Sequence
  chemically synthesized
aatggatttacattctagggga

SEQ ID NO: 974555 - DNA, 22 bp, Artificial Sequence
  chemically synthesized
tttatagttaatttcccctaga

SEQ ID NO: 974556 - DNA, 22 bp, Artificial Sequence
  chemically synthesized
gtttatagttaatttcccctag

SEQ ID NO: 974557 - DNA, 22 bp, Artificial Sequence
  chemically synthesized
acattctaggggaaattaacta

SEQ ID NO: 974558 - DNA, 22 bp, Artificial Sequence
  chemically synthesized
cattctaggggaaattaactat

SEQ ID NO: 974559 - DNA, 22 bp, Artificial Sequence
  chemically synthesized
taggggaaattaactataaaca

SEQ ID NO: 974560 - DNA, 22 bp, Artificial Sequence
  chemically synthesized
ggggaaattaactataaacaag

SEQ ID NO: 974561 - DNA, 22 bp, Artificial Sequence
  chemically synthesized
aaatagaggaaaaccttgttta

SEQ ID NO: 974562 - DNA, 22 bp, Artificial Sequence
  chemically synthesized
cacattcaaatagaggaaaacc

SEQ ID NO: 974563 - DNA, 22 bp, Artificial Sequence
  chemically synthesized
actataaacaaggttttcctct

SEQ ID NO: 974564 - DNA, 22 bp, Artificial Sequence
  chemically synthesized
taaacaaggttttcctctattt

SEQ ID NO: 974565 - DNA, 22 bp, Artificial Sequence
  chemically synthesized
atacccctgcacattcaaatag

SEQ ID NO: 974566 - DNA, 22 bp, Artificial Sequence
  chemically synthesized
ctcatacccctgcacattcaaa

SEQ ID NO: 974567 - DNA, 22 bp, Artificial Sequence
  chemically synthesized
cctcatacccctgcacattcaa

SEQ ID NO: 974568 - DNA, 22 bp, Artificial Sequence
  chemically synthesized
tcctctatttgaatgtgcaggg

SEQ ID NO: 974569 - DNA, 22 bp, Artificial Sequence
  chemically synthesized
cctctatttgaatgtgcagggg

SEQ ID NO: 974570 - DNA, 22 bp, Artificial Sequence
  chemically synthesized
ctctatttgaatgtgcaggggt

SEQ ID NO: 974571 - DNA, 22 bp, Artificial Sequence
  chemically synthesized
tatttgaatgtgcaggggtatg

SEQ ID NO: 974572 - DNA, 22 bp, Artificial Sequence
  chemically synthesized
tttgaatgtgcaggggtatgag

SEQ ID NO: 974573 - DNA, 22 bp, Artificial Sequence
  chemically synthesized
gaatgtgcaggggtatgaggaa

SEQ ID NO: 974574 - DNA, 22 bp, Artificial Sequence
  chemically synthesized
aatgtgcaggggtatgaggaaa

SEQ ID NO: 974575 - DNA, 22 bp, Artificial Sequence
  chemically synthesized
atgatgcgtaaacagtgtttcc

SEQ ID NO: 974576 - DNA, 22 bp, Artificial Sequence
  chemically synthesized
catgatgcgtaaacagtgtttc

SEQ ID NO: 974577 - DNA, 22 bp, Artificial Sequence
  chemically synthesized
ttcatgatgcgtaaacagtgtt

SEQ ID NO: 974578 - DNA, 22 bp, Artificial Sequence
  chemically synthesized
gactcttcatgatgcgtaaaca

SEQ ID NO: 974579 - DNA, 22 bp, Artificial Sequence
  chemically synthesized
gtaagcgactagactcttcatg

SEQ ID NO: 974580 - DNA, 22 bp, Artificial Sequence
  chemically synthesized
tttacgcatcatgaagagtcta

SEQ ID NO: 974581 - DNA, 22 bp, Artificial Sequence
  chemically synthesized
acgcatcatgaagagtctagtc

SEQ ID NO: 974582 - DNA, 22 bp, Artificial Sequence
  chemically synthesized
cgcatcatgaagagtctagtcg

SEQ ID NO: 974583 - DNA, 22 bp, Artificial Sequence
  chemically synthesized
acgtgtgttggtaagcgactag

SEQ ID NO: 974584 - DNA, 22 bp, Artificial Sequence
  chemically synthesized
gcactaacgtgtgttggtaagc

SEQ ID NO: 974585 - DNA, 22 bp, Artificial Sequence
  chemically synthesized
ctggcactaacgtgtgttggta

SEQ ID NO: 974586 - DNA, 22 bp, Artificial Sequence
  chemically synthesized
gtcgcttaccaacacacgttag

SEQ ID NO: 974587 - DNA, 22 bp, Artificial Sequence
  chemically synthesized
accaacacacgttagtgccagc

SEQ ID NO: 974588 - DNA, 22 bp, Artificial Sequence
  chemically synthesized
ccaacacacgttagtgccagca

SEQ ID NO: 974589 - DNA, 22 bp, Artificial Sequence
  chemically synthesized
tgatgaaaggtggacactgctg

SEQ ID NO: 974590 - DNA, 22 bp, Artificial Sequence
  chemically synthesized
ttatgatgaaaggtggacactg

SEQ ID NO: 974591 - DNA, 22 bp, Artificial Sequence
  chemically synthesized
gttgttatgatgaaaggtggac

SEQ ID NO: 974592 - DNA, 22 bp, Artificial Sequence
  chemically synthesized
gtgccagcagtgtccacctttc

SEQ ID NO: 974593 - DNA, 22 bp, Artificial Sequence
  chemically synthesized
ggttgttatgatgaaaggtgga

SEQ ID NO: 974594 - DNA, 22 bp, Artificial Sequence
  chemically synthesized
tggttgttatgatgaaaggtgg

SEQ ID NO: 974595 - DNA, 22 bp, Artificial Sequence
  chemically synthesized
ttggttgttatgatgaaaggtg

SEQ ID NO: 974596 - DNA, 22 bp, Artificial Sequence
  chemically synthesized
aacaagggaggcatttttggtt

SEQ ID NO: 974597 - DNA, 22 bp, Artificial Sequence
  chemically synthesized
tcatcataacaaccaaaaatgc

SEQ ID NO: 974598 - DNA, 22 bp, Artificial Sequence
  chemically synthesized
catcataacaaccaaaaatgcc

SEQ ID NO: 974599 - DNA, 22 bp, Artificial Sequence
  chemically synthesized
atcataacaaccaaaaatgcct

SEQ ID NO: 974600 - DNA, 22 bp, Artificial Sequence
  chemically synthesized
aattgaacaagggaggcatttt

SEQ ID NO: 974601 - DNA, 22 bp, Artificial Sequence
  chemically synthesized
tgaattgaacaagggaggcatt

SEQ ID NO: 974602 - DNA, 22 bp, Artificial Sequence
  chemically synthesized
tctgaattgaacaagggaggca

SEQ ID NO: 974603 - DNA, 22 bp, Artificial Sequence
  chemically synthesized
gaatatggtctctctgaattga

SEQ ID NO: 974604 - DNA, 22 bp, Artificial Sequence
  chemically synthesized
ctggaatatggtctctctgaat

SEQ ID NO: 974605 - DNA, 22 bp, Artificial Sequence
  chemically synthesized
tgctggaatatggtctctctga

SEQ ID NO: 974606 - DNA, 22 bp, Artificial Sequence
  chemically synthesized
ccttgttcaattcagagagacc

SEQ ID NO: 974607 - DNA, 22 bp, Artificial Sequence
  chemically synthesized
ctgctggaatatggtctctctg

SEQ ID NO: 974608 - DNA, 22 bp, Artificial Sequence
  chemically synthesized
tttctgctggaatatggtctct

SEQ ID NO: 974609 - DNA, 22 bp, Artificial Sequence
  chemically synthesized
gttcaattcagagagaccatat

SEQ ID NO: 974610 - DNA, 22 bp, Artificial Sequence
  chemically synthesized
ttcaattcagagagaccatatt

SEQ ID NO: 974611 - DNA, 22 bp, Artificial Sequence
  chemically synthesized
tgtttctgctggaatatggtct

SEQ ID NO: 974612 - DNA, 22 bp, Artificial Sequence
  chemically synthesized
ctgtttctgctggaatatggtc

SEQ ID NO: 974613 - DNA, 22 bp, Artificial Sequence
  chemically synthesized
aattcagagagaccatattcca

SEQ ID NO: 974614 - DNA, 22 bp, Artificial Sequence
  chemically synthesized
agagagaccatattccagcaga

SEQ ID NO: 974615 - DNA, 22 bp, Artificial Sequence
  chemically synthesized
aggcatttctgtttctgctgga

SEQ ID NO: 974616 - DNA, 22 bp, Artificial Sequence
  chemically synthesized
cctgaggcatttctgtttctgc

SEQ ID NO: 974617 - DNA, 22 bp, Artificial Sequence
  chemically synthesized
acctgaggcatttctgtttctg

SEQ ID NO: 974618 - DNA, 22 bp, Artificial Sequence
  chemically synthesized
ttacctgaggcatttctgtttc

SEQ ID NO: 974619 - DNA, 22 bp, Artificial Sequence
  chemically synthesized
caattcttacctgaggcatttc

SEQ ID NO: 974620 - DNA, 22 bp, Artificial Sequence
  chemically synthesized
cagcagaaacagaaatgcctca

SEQ ID NO: 974621 - DNA, 22 bp, Artificial Sequence
  chemically synthesized
atgttacaattcttacctgagg

SEQ ID NO: 974622 - DNA, 22 bp, Artificial Sequence
  chemically synthesized
aatgttacaattcttacctgag

SEQ ID NO: 974623 - DNA, 22 bp, Artificial Sequence
  chemically synthesized
ttaatgttacaattcttacctg

SEQ ID NO: 974624 - DNA, 22 bp, Artificial Sequence
  chemically synthesized
tcttaatgttacaattcttacc

SEQ ID NO: 974625 - DNA, 22 bp, Artificial Sequence
  chemically synthesized
catatgttctcttaatgttaca

SEQ ID NO: 974626 - DNA, 22 bp, Artificial Sequence
  chemically synthesized
gcatatgttctcttaatgttac

SEQ ID NO: 974627 - DNA, 22 bp, Artificial Sequence
  chemically synthesized
aggtaagaattgtaacattaag

SEQ ID NO: 974628 - DNA, 22 bp, Artificial Sequence
  chemically synthesized
tgcatatgttctcttaatgtta

SEQ ID NO: 974629 - DNA, 22 bp, Artificial Sequence
  chemically synthesized
agatctttgcatatgttctctt

SEQ ID NO: 974630 - DNA, 22 bp, Artificial Sequence
  chemically synthesized
taacattaagagaacatatgca

SEQ ID NO: 974631 - DNA, 22 bp, Artificial Sequence
  chemically synthesized
cactgagatctttgcatatgtt

SEQ ID NO: 974632 - DNA, 22 bp, Artificial Sequence
  chemically synthesized
agagaacatatgcaaagatctc

SEQ ID NO: 974633 - DNA, 22 bp, Artificial Sequence
  chemically synthesized
agtgcaaaagtactgcactgag

SEQ ID NO: 974634 - DNA, 22 bp, Artificial Sequence
  chemically synthesized
ttgagtgcaaaagtactgcact

SEQ ID NO: 974635 - DNA, 22 bp, Artificial Sequence
  chemically synthesized
gttgagtgcaaaagtactgcac

SEQ ID NO: 974636 - DNA, 22 bp, Artificial Sequence
  chemically synthesized
gtgcttgttgagtgcaaaagta

SEQ ID NO: 974637 - DNA, 22 bp, Artificial Sequence
  chemically synthesized
agtgcttgttgagtgcaaaagt

SEQ ID NO: 974638 - DNA, 22 bp, Artificial Sequence
  chemically synthesized
tttagtgcttgttgagtgcaaa

SEQ ID NO: 974639 - DNA, 22 bp, Artificial Sequence
  chemically synthesized
agtgcagtacttttgcactcaa

SEQ ID NO: 974640 - DNA, 22 bp, Artificial Sequence
  chemically synthesized
atttagtgcttgttgagtgcaa

SEQ ID NO: 974641 - DNA, 22 bp, Artificial Sequence
  chemically synthesized
ccatttatttagtgcttgttga

SEQ ID NO: 974642 - DNA, 22 bp, Artificial Sequence
  chemically synthesized
ttgcactcaacaagcactaaat

SEQ ID NO: 974643 - DNA, 22 bp, Artificial Sequence
  chemically synthesized
tgcactcaacaagcactaaata

SEQ ID NO: 974644 - DNA, 22 bp, Artificial Sequence
  chemically synthesized
atagctaccatttatttagtgc

SEQ ID NO: 974645 - DNA, 22 bp, Artificial Sequence
  chemically synthesized
gcactcaacaagcactaaataa

SEQ ID NO: 974646 - DNA, 22 bp, Artificial Sequence
  chemically synthesized
cactcaacaagcactaaataaa

SEQ ID NO: 974647 - DNA, 22 bp, Artificial Sequence
  chemically synthesized
actaatagctaccatttattta

SEQ ID NO: 974648 - DNA, 22 bp, Artificial Sequence
  chemically synthesized
aacaagcactaaataaatggta

SEQ ID NO: 974649 - DNA, 22 bp, Artificial Sequence
  chemically synthesized
ttcactaatagctaccatttat

SEQ ID NO: 974650 - DNA, 22 bp, Artificial Sequence
  chemically synthesized
tcattattcactaatagctacc

SEQ ID NO: 974651 - DNA, 22 bp, Artificial Sequence
  chemically synthesized
aataaatggtagctattagtga

SEQ ID NO: 974652 - DNA, 22 bp, Artificial Sequence
  chemically synthesized
tataaatatagaattgtcatta

SEQ ID NO: 974653 - DNA, 22 bp, Artificial Sequence
  chemically synthesized
tgtataaatatagaattgtcat

SEQ ID NO: 974654 - DNA, 22 bp, Artificial Sequence
  chemically synthesized
ttagtgaataatgacaattcta

SEQ ID NO: 974655 - DNA, 22 bp, Artificial Sequence
  chemically synthesized
gtgaataatgacaattctatat

SEQ ID NO: 974656 - DNA, 22 bp, Artificial Sequence
  chemically synthesized
taagagcaattctgtataaata

SEQ ID NO: 974657 - DNA, 22 bp, Artificial Sequence
  chemically synthesized
gtaagagcaattctgtataaat

SEQ ID NO: 974658 - DNA, 22 bp, Artificial Sequence
  chemically synthesized
tgtaagagcaattctgtataaa

SEQ ID NO: 974659 - DNA, 22 bp, Artificial Sequence
  chemically synthesized
tatatttatacagaattgctct

SEQ ID NO: 974660 - DNA, 22 bp, Artificial Sequence
  chemically synthesized
tatttatacagaattgctctta

SEQ ID NO: 974661 - DNA, 22 bp, Artificial Sequence
  chemically synthesized
atataagctttgtaagagcaat

SEQ ID NO: 974662 - DNA, 22 bp, Artificial Sequence
  chemically synthesized
ttaatataagctttgtaagagc

SEQ ID NO: 974663 - DNA, 22 bp, Artificial Sequence
  chemically synthesized
atacagaattgctcttacaaag

SEQ ID NO: 974664 - DNA, 22 bp, Artificial Sequence
  chemically synthesized
tacagaattgctcttacaaagc

SEQ ID NO: 974665 - DNA, 22 bp, Artificial Sequence
  chemically synthesized
agctgttaatataagctttgta

SEQ ID NO: 974666 - DNA, 22 bp, Artificial Sequence
  chemically synthesized
aagctgttaatataagctttgt

SEQ ID NO: 974667 - DNA, 22 bp, Artificial Sequence
  chemically synthesized
tttaagctgttaatataagctt

SEQ ID NO: 974668 - DNA, 22 bp, Artificial Sequence
  chemically synthesized
tgtttaagctgttaatataagc

SEQ ID NO: 974669 - DNA, 22 bp, Artificial Sequence
  chemically synthesized
ctgtttaagctgttaatataag

SEQ ID NO: 974670 - DNA, 22 bp, Artificial Sequence
  chemically synthesized
ctcttacaaagcttatattaac

SEQ ID NO: 974671 - DNA, 22 bp, Artificial Sequence
  chemically synthesized
ttacaaagcttatattaacagc

SEQ ID NO: 974672 - DNA, 22 bp, Artificial Sequence
  chemically synthesized
acaaagcttatattaacagctt

SEQ ID NO: 974673 - DNA, 22 bp, Artificial Sequence
  chemically synthesized
caatttctgtttaagctgttaa

SEQ ID NO: 974674 - DNA, 22 bp, Artificial Sequence
  chemically synthesized
caaagcttatattaacagctta

SEQ ID NO: 974675 - DNA, 22 bp, Artificial Sequence
  chemically synthesized
atattaacagcttaaacagaaa

SEQ ID NO: 974676 - DNA, 22 bp, Artificial Sequence
  chemically synthesized
taaatgttacaatttctgttta

SEQ ID NO: 974677 - DNA, 22 bp, Artificial Sequence
  chemically synthesized
tattaacagcttaaacagaaat

SEQ ID NO: 974678 - DNA, 22 bp, Artificial Sequence
  chemically synthesized
agctataaatgttacaatttct

SEQ ID NO: 974679 - DNA, 22 bp, Artificial Sequence
  chemically synthesized
acagcttaaacagaaattgtaa

SEQ ID NO: 974680 - DNA, 22 bp, Artificial Sequence
  chemically synthesized
aagctataaatgttacaatttc

SEQ ID NO: 974681 - DNA, 22 bp, Artificial Sequence
  chemically synthesized
taagctataaatgttacaattt

SEQ ID NO: 974682 - DNA, 22 bp, Artificial Sequence
  chemically synthesized
attttaagctataaatgttaca

SEQ ID NO: 974683 - DNA, 22 bp, Artificial Sequence
  chemically synthesized
aaacagaaattgtaacatttat

SEQ ID NO: 974684 - DNA, 22 bp, Artificial Sequence
  chemically synthesized
aacagaaattgtaacatttata

SEQ ID NO: 974685 - DNA, 22 bp, Artificial Sequence
  chemically synthesized
ttcattttaagctataaatgtt

SEQ ID NO: 974686 - DNA, 22 bp, Artificial Sequence
  chemically synthesized
attcattttaagctataaatgt

SEQ ID NO: 974687 - DNA, 22 bp, Artificial Sequence
  chemically synthesized
tattcattttaagctataaatg

SEQ ID NO: 974688 - DNA, 22 bp, Artificial Sequence
  chemically synthesized
taacatttatagcttaaaatga

SEQ ID NO: 974689 - DNA, 22 bp, Artificial Sequence
  chemically synthesized
atagcttaaaatgaataaagct

SEQ ID NO: 974690 - DNA, 22 bp, Artificial Sequence
  chemically synthesized
tagcttaaaatgaataaagcta

SEQ ID NO: 974691 - DNA, 22 bp, Artificial Sequence
  chemically synthesized
atgtatcacacatagctttatt

SEQ ID NO: 974692 - DNA, 22 bp, Artificial Sequence
  chemically synthesized
aatgtatcacacatagctttat

SEQ ID NO: 974693 - DNA, 22 bp, Artificial Sequence
  chemically synthesized
aaaatgaataaagctatgtgtg

SEQ ID NO: 974694 - DNA, 22 bp, Artificial Sequence
  chemically synthesized
aaatgaataaagctatgtgtga

SEQ ID NO: 974695 - DNA, 22 bp, Artificial Sequence
  chemically synthesized
aatcatttaatgtatcacacat

SEQ ID NO: 974696 - DNA, 22 bp, Artificial Sequence
  chemically synthesized
aaatcatttaatgtatcacaca

SEQ ID NO: 974697 - DNA, 22 bp, Artificial Sequence
  chemically synthesized
aaatttaaatcatttaatgtat

SEQ ID NO: 974698 - DNA, 22 bp, Artificial Sequence
  chemically synthesized
aaaatttaaatcatttaatgta

SEQ ID NO: 974699 - DNA, 22 bp, Artificial Sequence
  chemically synthesized
taaaatttaaatcatttaatgt

SEQ ID NO: 974700 - DNA, 22 bp, Artificial Sequence
  chemically synthesized
ttaaaatttaaatcatttaatg

SEQ ID NO: 974701 - DNA, 22 bp, Artificial Sequence
  chemically synthesized
tgtgtgatacattaaatgattt

SEQ ID NO: 974702 - DNA, 22 bp, Artificial Sequence
  chemically synthesized
cagtttttaaaatttaaatcat

SEQ ID NO: 974703 - DNA, 22 bp, Artificial Sequence
  chemically synthesized
acagtttttaaaatttaaatca

SEQ ID NO: 974704 - DNA, 22 bp, Artificial Sequence
  chemically synthesized
ttacagtttttaaaatttaaat

SEQ ID NO: 974705 - DNA, 22 bp, Artificial Sequence
  chemically synthesized
attcttacagtttttaaaattt

SEQ ID NO: 974706 - DNA, 22 bp, Artificial Sequence
  chemically synthesized
aatgatttaaattttaaaaact

SEQ ID NO: 974707 - DNA, 22 bp, Artificial Sequence
  chemically synthesized
cacattaattcttacagttttt

SEQ ID NO: 974708 - DNA, 22 bp, Artificial Sequence
  chemically synthesized
ccacattaattcttacagtttt

SEQ ID NO: 974709 - DNA, 22 bp, Artificial Sequence
  chemically synthesized
tccacattaattcttacagttt

SEQ ID NO: 974710 - DNA, 22 bp, Artificial Sequence
  chemically synthesized
aaattttaaaaactgtaagaat

SEQ ID NO: 974711 - DNA, 22 bp, Artificial Sequence
  chemically synthesized
aattttaaaaactgtaagaatt

SEQ ID NO: 974712 - DNA, 22 bp, Artificial Sequence
  chemically synthesized
taaaaactgtaagaattaatgt

SEQ ID NO: 974713 - DNA, 22 bp, Artificial Sequence
  chemically synthesized
aaaaactgtaagaattaatgtg

SEQ ID NO: 974714 - DNA, 22 bp, Artificial Sequence
  chemically synthesized
aaaccagttttccacattaatt

SEQ ID NO: 974715 - DNA, 22 bp, Artificial Sequence
  chemically synthesized
aaaactgtaagaattaatgtgg

SEQ ID NO: 974716 - DNA, 22 bp, Artificial Sequence
  chemically synthesized
aaattaaaaccagttttccaca

SEQ ID NO: 974717 - DNA, 22 bp, Artificial Sequence
  chemically synthesized
taagaattaatgtggaaaactg

SEQ ID NO: 974718 - DNA, 22 bp, Artificial Sequence
  chemically synthesized
atgtggaaaactggttttaatt

SEQ ID NO: 974719 - DNA, 22 bp, Artificial Sequence
  chemically synthesized
tgtatgtgaaataactcaaatt

SEQ ID NO: 974720 - DNA, 22 bp, Artificial Sequence
  chemically synthesized
gtgtatgtgaaataactcaaat

SEQ ID NO: 974721 - DNA, 22 bp, Artificial Sequence
  chemically synthesized
gttttaatttgagttatttcac

SEQ ID NO: 974722 - DNA, 22 bp, Artificial Sequence
  chemically synthesized
taatttgagttatttcacatac

SEQ ID NO: 974723 - DNA, 22 bp, Artificial Sequence
  chemically synthesized
aatttgagttatttcacataca

SEQ ID NO: 974724 - DNA, 22 bp, Artificial Sequence
  chemically synthesized
atttgagttatttcacatacac

SEQ ID NO: 974725 - DNA, 22 bp, Artificial Sequence
  chemically synthesized
gagttatttcacatacacaaat

SEQ ID NO: 974726 - DNA, 22 bp, Artificial Sequence
  chemically synthesized
agttatttcacatacacaaatg

SEQ ID NO: 974727 - DNA, 22 bp, Artificial Sequence
  chemically synthesized
tttcacatacacaaatgtttgc

SEQ ID NO: 974728 - DNA, 22 bp, Artificial Sequence
  chemically synthesized
cacatacacaaatgtttgctct

SEQ ID NO: 974729 - DNA, 22 bp, Artificial Sequence
  chemically synthesized
acatacacaaatgtttgctctt

SEQ ID NO: 974730 - DNA, 22 bp, Artificial Sequence
  chemically synthesized
tcatatgggcaataaaatgtgt

SEQ ID NO: 974731 - DNA, 22 bp, Artificial Sequence
  chemically synthesized
tatcatatgggcaataaaatgt

SEQ ID NO: 974732 - DNA, 22 bp, Artificial Sequence
  chemically synthesized
gctcttatacacattttattgc

SEQ ID NO: 974733 - DNA, 22 bp, Artificial Sequence
  chemically synthesized
ctcttatacacattttattgcc

SEQ ID NO: 974734 - DNA, 22 bp, Artificial Sequence
  chemically synthesized
cctctatcatatgggcaataaa

SEQ ID NO: 974735 - DNA, 22 bp, Artificial Sequence
  chemically synthesized
ttatacacattttattgcccat

SEQ ID NO: 974736 - DNA, 22 bp, Artificial Sequence
  chemically synthesized
atacacattttattgcccatat

SEQ ID NO: 974737 - DNA, 22 bp, Artificial Sequence
  chemically synthesized
tacacattttattgcccatatg

SEQ ID NO: 974738 - DNA, 22 bp, Artificial Sequence
  chemically synthesized
gaagaaagtctacctctatcat

SEQ ID NO: 974739 - DNA, 22 bp, Artificial Sequence
  chemically synthesized
agaagaaagtctacctctatca

SEQ ID NO: 974740 - DNA, 22 bp, Artificial Sequence
  chemically synthesized
tattgcccatatgatagaggta

SEQ ID NO: 974741 - DNA, 22 bp, Artificial Sequence
  chemically synthesized
tagaagaaagtctacctctatc

SEQ ID NO: 974742 - DNA, 22 bp, Artificial Sequence
  chemically synthesized
attgcccatatgatagaggtag

SEQ ID NO: 974743 - DNA, 22 bp, Artificial Sequence
  chemically synthesized
ttgcccatatgatagaggtaga

SEQ ID NO: 974744 - DNA, 22 bp, Artificial Sequence
  chemically synthesized
ttttagaagaaagtctacctct

SEQ ID NO: 974745 - DNA, 22 bp, Artificial Sequence
  chemically synthesized
cccatatgatagaggtagactt

SEQ ID NO: 974746 - DNA, 22 bp, Artificial Sequence
  chemically synthesized
atatgattgttttagaagaaag

SEQ ID NO: 974747 - DNA, 22 bp, Artificial Sequence
  chemically synthesized
aatcattaatatgattgtttta

SEQ ID NO: 974748 - DNA, 22 bp, Artificial Sequence
  chemically synthesized
aaatcattaatatgattgtttt

SEQ ID NO: 974749 - DNA, 22 bp, Artificial Sequence
  chemically synthesized
tttaaatcattaatatgattgt

SEQ ID NO: 974750 - DNA, 22 bp, Artificial Sequence
  chemically synthesized
gtttaaatcattaatatgattg

SEQ ID NO: 974751 - DNA, 22 bp, Artificial Sequence
  chemically synthesized
tgtttaaatcattaatatgatt

SEQ ID NO: 974752 - DNA, 22 bp, Artificial Sequence
  chemically synthesized
tcttctaaaacaatcatattaa

SEQ ID NO: 974753 - DNA, 22 bp, Artificial Sequence
  chemically synthesized
ttgtttaaatcattaatatgat

SEQ ID NO: 974754 - DNA, 22 bp, Artificial Sequence
  chemically synthesized
cttctaaaacaatcatattaat

SEQ ID NO: 974755 - DNA, 22 bp, Artificial Sequence
  chemically synthesized
ttctaaaacaatcatattaatg

SEQ ID NO: 974756 - DNA, 22 bp, Artificial Sequence
  chemically synthesized
ctaaaacaatcatattaatgat

SEQ ID NO: 974757 - DNA, 22 bp, Artificial Sequence
  chemically synthesized
taaaacaatcatattaatgatt

SEQ ID NO: 974758 - DNA, 22 bp, Artificial Sequence
  chemically synthesized
acgtttttgtttaaatcattaa

SEQ ID NO: 974759 - DNA, 22 bp, Artificial Sequence
  chemically synthesized
aaacaatcatattaatgattta

SEQ ID NO: 974760 - DNA, 22 bp, Artificial Sequence
  chemically synthesized
aactcacgtttttgtttaaatc

SEQ ID NO: 974761 - DNA, 22 bp, Artificial Sequence
  chemically synthesized
atgatttaaacaaaaacgtgag

SEQ ID NO: 974762 - DNA, 22 bp, Artificial Sequence
  chemically synthesized
aaacaaaaacgtgagtttaata

SEQ ID NO: 974763 - DNA, 22 bp, Artificial Sequence
  chemically synthesized
aacaaaaacgtgagtttaatat

SEQ ID NO: 974764 - DNA, 22 bp, Artificial Sequence
  chemically synthesized
tgaagcatgaataataatgcat

SEQ ID NO: 974765 - DNA, 22 bp, Artificial Sequence
  chemically synthesized
ttatgaagcatgaataataatg

SEQ ID NO: 974766 - DNA, 22 bp, Artificial Sequence
  chemically synthesized
aatatgcattattattcatgct

SEQ ID NO: 974767 - DNA, 22 bp, Artificial Sequence
  chemically synthesized
atatgcattattattcatgctt

SEQ ID NO: 974768 - DNA, 22 bp, Artificial Sequence
  chemically synthesized
ttattcatgcttcataataatc

SEQ ID NO: 974769 - DNA, 22 bp, Artificial Sequence
  chemically synthesized
aagagatcaggtgattattatg

SEQ ID NO: 974770 - DNA, 22 bp, Artificial Sequence
  chemically synthesized
gaagagatcaggtgattattat

SEQ ID NO: 974771 - DNA, 22 bp, Artificial Sequence
  chemically synthesized
ttcatgcttcataataatcacc

SEQ ID NO: 974772 - DNA, 22 bp, Artificial Sequence
  chemically synthesized
atgcttcataataatcacctga

SEQ ID NO: 974773 - DNA, 22 bp, Artificial Sequence
  chemically synthesized
aatttgaagagatcaggtgatt

SEQ ID NO: 974774 - DNA, 22 bp, Artificial Sequence
  chemically synthesized
cataataatcacctgatctctt

SEQ ID NO: 974775 - DNA, 22 bp, Artificial Sequence
  chemically synthesized
ataataatcacctgatctcttc

SEQ ID NO: 974776 - DNA, 22 bp, Artificial Sequence
  chemically synthesized
tgtgacagttaaatttgaagag

SEQ ID NO: 974777 - DNA, 22 bp, Artificial Sequence
  chemically synthesized
gtgtgacagttaaatttgaaga

SEQ ID NO: 974778 - DNA, 22 bp, Artificial Sequence
  chemically synthesized
tgtgtgacagttaaatttgaag

SEQ ID NO: 974779 - DNA, 22 bp, Artificial Sequence
  chemically synthesized
agctttgtgtgacagttaaatt

SEQ ID NO: 974780 - DNA, 22 bp, Artificial Sequence
  chemically synthesized
atctcttcaaatttaactgtca

SEQ ID NO: 974781 - DNA, 22 bp, Artificial Sequence
  chemically synthesized
ttcaaatttaactgtcacacaa

SEQ ID NO: 974782 - DNA, 22 bp, Artificial Sequence
  chemically synthesized
caaatttaactgtcacacaaag

SEQ ID NO: 974783 - DNA, 22 bp, Artificial Sequence
  chemically synthesized
aaatttaactgtcacacaaagc

SEQ ID NO: 974784 - DNA, 22 bp, Artificial Sequence
  chemically synthesized
aactgtcacacaaagctcagtt

SEQ ID NO: 974785 - DNA, 22 bp, Artificial Sequence
  chemically synthesized
actgtcacacaaagctcagttc

SEQ ID NO: 974786 - DNA, 22 bp, Artificial Sequence
  chemically synthesized
tagccatgaaaaggaactgagc

SEQ ID NO: 974787 - DNA, 22 bp, Artificial Sequence
  chemically synthesized
atagccatgaaaaggaactgag

SEQ ID NO: 974788 - DNA, 22 bp, Artificial Sequence
  chemically synthesized
tcacacaaagctcagttccttt

SEQ ID NO: 974789 - DNA, 22 bp, Artificial Sequence
  chemically synthesized
aaatgtaatttatagccatgaa

SEQ ID NO: 974790 - DNA, 22 bp, Artificial Sequence
  chemically synthesized
tgaaatgtaatttatagccatg

SEQ ID NO: 974791 - DNA, 22 bp, Artificial Sequence
  chemically synthesized
agttccttttcatggctataaa

SEQ ID NO: 974792 - DNA, 22 bp, Artificial Sequence
  chemically synthesized
cttttcatggctataaattaca

SEQ ID NO: 974793 - DNA, 22 bp, Artificial Sequence
  chemically synthesized
ttcatggctataaattacattt

SEQ ID NO: 974794 - DNA, 22 bp, Artificial Sequence
  chemically synthesized
tcatggctataaattacatttc

SEQ ID NO: 974795 - DNA, 22 bp, Artificial Sequence
  chemically synthesized
catggctataaattacatttca

SEQ ID NO: 974796 - DNA, 22 bp, Artificial Sequence
  chemically synthesized
atggctataaattacatttcag

SEQ ID NO: 974797 - DNA, 22 bp, Artificial Sequence
  chemically synthesized
taaattacatttcagaactttg

SEQ ID NO: 974798 - DNA, 22 bp, Artificial Sequence
  chemically synthesized
gcagtataaagacacaaagttc

SEQ ID NO: 974799 - DNA, 22 bp, Artificial Sequence
  chemically synthesized
ttagcagtataaagacacaaag

SEQ ID NO: 974800 - DNA, 22 bp, Artificial Sequence
  chemically synthesized
attagcagtataaagacacaaa

SEQ ID NO: 974801 - DNA, 22 bp, Artificial Sequence
  chemically synthesized
catttcagaactttgtgtcttt

SEQ ID NO: 974802 - DNA, 22 bp, Artificial Sequence
  chemically synthesized
cagaactttgtgtctttatact

SEQ ID NO: 974803 - DNA, 22 bp, Artificial Sequence
  chemically synthesized
agaactttgtgtctttatactg

SEQ ID NO: 974804 - DNA, 22 bp, Artificial Sequence
  chemically synthesized
tcaaatatgacttattagcagt

SEQ ID NO: 974805 - DNA, 22 bp, Artificial Sequence
  chemically synthesized
tgtgtctttatactgctaataa

SEQ ID NO: 974806 - DNA, 22 bp, Artificial Sequence
  chemically synthesized
gtgtctttatactgctaataag

SEQ ID NO: 974807 - DNA, 22 bp, Artificial Sequence
  chemically synthesized
tgtctttatactgctaataagt

SEQ ID NO: 974808 - DNA, 22 bp, Artificial Sequence
  chemically synthesized
gattatcaaatatgacttatta

SEQ ID NO: 974809 - DNA, 22 bp, Artificial Sequence
  chemically synthesized
tatactgctaataagtcatatt

SEQ ID NO: 974810 - DNA, 22 bp, Artificial Sequence
  chemically synthesized
atactgctaataagtcatattt

SEQ ID NO: 974811 - DNA, 22 bp, Artificial Sequence
  chemically synthesized
tactgctaataagtcatatttg

SEQ ID NO: 974812 - DNA, 22 bp, Artificial Sequence
  chemically synthesized
tatgctggattatcaaatatga

SEQ ID NO: 974813 - DNA, 22 bp, Artificial Sequence
  chemically synthesized
ttatatgctggattatcaaata

SEQ ID NO: 974814 - DNA, 22 bp, Artificial Sequence
  chemically synthesized
ctaataagtcatatttgataat

SEQ ID NO: 974815 - DNA, 22 bp, Artificial Sequence
  chemically synthesized
attatatgctggattatcaaat

SEQ ID NO: 974816 - DNA, 22 bp, Artificial Sequence
  chemically synthesized
tattatatgctggattatcaaa

SEQ ID NO: 974817 - DNA, 22 bp, Artificial Sequence
  chemically synthesized
ttattatatgctggattatcaa

SEQ ID NO: 974818 - DNA, 22 bp, Artificial Sequence
  chemically synthesized
ataagtcatatttgataatcca

SEQ ID NO: 974819 - DNA, 22 bp, Artificial Sequence
  chemically synthesized
tacacgatccttttattatatg

SEQ ID NO: 974820 - DNA, 22 bp, Artificial Sequence
  chemically synthesized
gataatccagcatataataaaa

SEQ ID NO: 974821 - DNA, 22 bp, Artificial Sequence
  chemically synthesized
ataatccagcatataataaaag

SEQ ID NO: 974822 - DNA, 22 bp, Artificial Sequence
  chemically synthesized
atgttgtacacgatccttttat

SEQ ID NO: 974823 - DNA, 22 bp, Artificial Sequence
  chemically synthesized
taattaatgttgtacacgatcc

SEQ ID NO: 974824 - DNA, 22 bp, Artificial Sequence
  chemically synthesized
gtaattaatgttgtacacgatc

SEQ ID NO: 974825 - DNA, 22 bp, Artificial Sequence
  chemically synthesized
accttgtaattaatgttgtaca

SEQ ID NO: 974826 - DNA, 22 bp, Artificial Sequence
  chemically synthesized
actgaccttgtaattaatgttg

SEQ ID NO: 974827 - DNA, 22 bp, Artificial Sequence
  chemically synthesized
acatctaactgaccttgtaatt

SEQ ID NO: 974828 - DNA, 22 bp, Artificial Sequence
  chemically synthesized
cattgacatctaactgaccttg

SEQ ID NO: 974829 - DNA, 22 bp, Artificial Sequence
  chemically synthesized
tacattgacatctaactgacct

SEQ ID NO: 974830 - DNA, 22 bp, Artificial Sequence
  chemically synthesized
ctacattgacatctaactgacc

SEQ ID NO: 974831 - DNA, 22 bp, Artificial Sequence
  chemically synthesized
attacaaggtcagttagatgtc

SEQ ID NO: 974832 - DNA, 22 bp, Artificial Sequence
  chemically synthesized
caaggtcagttagatgtcaatg

SEQ ID NO: 974833 - DNA, 22 bp, Artificial Sequence
  chemically synthesized
aatgagtttctacattgacatc

SEQ ID NO: 974834 - DNA, 22 bp, Artificial Sequence
  chemically synthesized
ttcaatgagtttctacattgac

SEQ ID NO: 974835 - DNA, 22 bp, Artificial Sequence
  chemically synthesized
gatgtcaatgtagaaactcatt

SEQ ID NO: 974836 - DNA, 22 bp, Artificial Sequence
  chemically synthesized
cacaaaaatactattcaatgag

SEQ ID NO: 974837 - DNA, 22 bp, Artificial Sequence
  chemically synthesized
ccacaaaaatactattcaatga

SEQ ID NO: 974838 - DNA, 22 bp, Artificial Sequence
  chemically synthesized
cttccacaaaaatactattcaa

SEQ ID NO: 974839 - DNA, 22 bp, Artificial Sequence
  chemically synthesized
gctacttccacaaaaatactat

SEQ ID NO: 974840 - DNA, 22 bp, Artificial Sequence
  chemically synthesized
attgaatagtatttttgtggaa

SEQ ID NO: 974841 - DNA, 22 bp, Artificial Sequence
  chemically synthesized
aatagtatttttgtggaagtag

SEQ ID NO: 974842 - DNA, 22 bp, Artificial Sequence
  chemically synthesized
aacataatagagtctagctact

SEQ ID NO: 974843 - DNA, 22 bp, Artificial Sequence
  chemically synthesized
aaacataatagagtctagctac

SEQ ID NO: 974844 - DNA, 22 bp, Artificial Sequence
  chemically synthesized
ttgtggaagtagctagactcta

SEQ ID NO: 974845 - DNA, 22 bp, Artificial Sequence
  chemically synthesized
tgtggaagtagctagactctat

SEQ ID NO: 974846 - DNA, 22 bp, Artificial Sequence
  chemically synthesized
gtggaagtagctagactctatt

SEQ ID NO: 974847 - DNA, 22 bp, Artificial Sequence
  chemically synthesized
tggaagtagctagactctatta

SEQ ID NO: 974848 - DNA, 22 bp, Artificial Sequence
  chemically synthesized
tggtgaagtttaaacataatag

SEQ ID NO: 974849 - DNA, 22 bp, Artificial Sequence
  chemically synthesized
attatggtgaagtttaaacata

SEQ ID NO: 974850 - DNA, 22 bp, Artificial Sequence
  chemically synthesized
ttcattatggtgaagtttaaac

SEQ ID NO: 974851 - DNA, 22 bp, Artificial Sequence
  chemically synthesized
gactctattatgtttaaacttc

SEQ ID NO: 974852 - DNA, 22 bp, Artificial Sequence
  chemically synthesized
tattatgtttaaacttcaccat

SEQ ID NO: 974853 - DNA, 22 bp, Artificial Sequence
  chemically synthesized
ttatgtttaaacttcaccataa

SEQ ID NO: 974854 - DNA, 22 bp, Artificial Sequence
  chemically synthesized
atacaaattattcattatggtg

SEQ ID NO: 974855 - DNA, 22 bp, Artificial Sequence
  chemically synthesized
tgtttaaacttcaccataatga

SEQ ID NO: 974856 - DNA, 22 bp, Artificial Sequence
  chemically synthesized
aaacttcaccataatgaataat

SEQ ID NO: 974857 - DNA, 22 bp, Artificial Sequence
  chemically synthesized
agtctgatacaaattattcatt

SEQ ID NO: 974858 - DNA, 22 bp, Artificial Sequence
  chemically synthesized
aacttcaccataatgaataatt

SEQ ID NO: 974859 - DNA, 22 bp, Artificial Sequence
  chemically synthesized
caccataatgaataatttgtat

SEQ ID NO: 974860 - DNA, 22 bp, Artificial Sequence
  chemically synthesized
accataatgaataatttgtatc

SEQ ID NO: 974861 - DNA, 22 bp, Artificial Sequence
  chemically synthesized
gtgaattaagtctgatacaaat

SEQ ID NO: 974862 - DNA, 22 bp, Artificial Sequence
  chemically synthesized
tcgtgaattaagtctgatacaa

SEQ ID NO: 974863 - DNA, 22 bp, Artificial Sequence
  chemically synthesized
tctcgtgaattaagtctgatac

SEQ ID NO: 974864 - DNA, 22 bp, Artificial Sequence
  chemically synthesized
ctctcgtgaattaagtctgata

SEQ ID NO: 974865 - DNA, 22 bp, Artificial Sequence
  chemically synthesized
tctctcgtgaattaagtctgat

SEQ ID NO: 974866 - DNA, 22 bp, Artificial Sequence
  chemically synthesized
ttctctcgtgaattaagtctga

SEQ ID NO: 974867 - DNA, 22 bp, Artificial Sequence
  chemically synthesized
acttttctctcgtgaattaagt

SEQ ID NO: 974868 - DNA, 22 bp, Artificial Sequence
  chemically synthesized
cacttttctctcgtgaattaag

SEQ ID NO: 974869 - DNA, 22 bp, Artificial Sequence
  chemically synthesized
tcacttttctctcgtgaattaa

SEQ ID NO: 974870 - DNA, 22 bp, Artificial Sequence
  chemically synthesized
gtatcagacttaattcacgaga

SEQ ID NO: 974871 - DNA, 22 bp, Artificial Sequence
  chemically synthesized
tatcagacttaattcacgagag

SEQ ID NO: 974872 - DNA, 22 bp, Artificial Sequence
  chemically synthesized
ccgcagaactttcacttttctc

SEQ ID NO: 974873 - DNA, 22 bp, Artificial Sequence
  chemically synthesized
gccgcagaactttcacttttct

SEQ ID NO: 974874 - DNA, 22 bp, Artificial Sequence
  chemically synthesized
tgccgcagaactttcacttttc

SEQ ID NO: 974875 - DNA, 22 bp, Artificial Sequence
  chemically synthesized
aattcacgagagaaaagtgaaa

SEQ ID NO: 974876 - DNA, 22 bp, Artificial Sequence
  chemically synthesized
attcacgagagaaaagtgaaag

SEQ ID NO: 974877 - DNA, 22 bp, Artificial Sequence
  chemically synthesized
acgagagaaaagtgaaagttct

SEQ ID NO: 974878 - DNA, 22 bp, Artificial Sequence
  chemically synthesized
gggagaaaaagccactttgccg

SEQ ID NO: 974879 - DNA, 22 bp, Artificial Sequence
  chemically synthesized
cgggagaaaaagccactttgcc

SEQ ID NO: 974880 - DNA, 22 bp, Artificial Sequence
  chemically synthesized
tttcgggagaaaaagccacttt

SEQ ID NO: 974881 - DNA, 22 bp, Artificial Sequence
  chemically synthesized
tgcggcaaagtggctttttctc

SEQ ID NO: 974882 - DNA, 22 bp, Artificial Sequence
  chemically synthesized
acattatttcgggagaaaaagc

SEQ ID NO: 974883 - DNA, 22 bp, Artificial Sequence
  chemically synthesized
cggcaaagtggctttttctccc

SEQ ID NO: 974884 - DNA, 22 bp, Artificial Sequence
  chemically synthesized
ttaacattatttcgggagaaaa

SEQ ID NO: 974885 - DNA, 22 bp, Artificial Sequence
  chemically synthesized
aattattaacattatttcggga

SEQ ID NO: 974886 - DNA, 22 bp, Artificial Sequence
  chemically synthesized
caattattaacattatttcggg

SEQ ID NO: 974887 - DNA, 22 bp, Artificial Sequence
  chemically synthesized
tttctcccgaaataatgttaat

SEQ ID NO: 974888 - DNA, 22 bp, Artificial Sequence
  chemically synthesized
ttctcccgaaataatgttaata

SEQ ID NO: 974889 - DNA, 22 bp, Artificial Sequence
  chemically synthesized
aaagccttcaattattaacatt

SEQ ID NO: 974890 - DNA, 22 bp, Artificial Sequence
  chemically synthesized
tctcccgaaataatgttaataa

SEQ ID NO: 974891 - DNA, 22 bp, Artificial Sequence
  chemically synthesized
gaaagccttcaattattaacat

SEQ ID NO: 974892 - DNA, 22 bp, Artificial Sequence
  chemically synthesized
ctcccgaaataatgttaataat

SEQ ID NO: 974893 - DNA, 22 bp, Artificial Sequence
  chemically synthesized
tgaaagccttcaattattaaca

SEQ ID NO: 974894 - DNA, 22 bp, Artificial Sequence
  chemically synthesized
tcccgaaataatgttaataatt

SEQ ID NO: 974895 - DNA, 22 bp, Artificial Sequence
  chemically synthesized
ccgaaataatgttaataattga

SEQ ID NO: 974896 - DNA, 22 bp, Artificial Sequence
  chemically synthesized
caggaaaaaattttgaaagcct

SEQ ID NO: 974897 - DNA, 22 bp, Artificial Sequence
  chemically synthesized
gcaggaaaaaattttgaaagcc

SEQ ID NO: 974898 - DNA, 22 bp, Artificial Sequence
  chemically synthesized
ataattgaaggctttcaaaatt

SEQ ID NO: 974899 - DNA, 22 bp, Artificial Sequence
  chemically synthesized
aaatttgcaggaaaaaattttg

SEQ ID NO: 974900 - DNA, 22 bp, Artificial Sequence
  chemically synthesized
aaggctttcaaaattttttcct

SEQ ID NO: 974901 - DNA, 22 bp, Artificial Sequence
  chemically synthesized
atcacatctgaaatttgcagga

SEQ ID NO: 974902 - DNA, 22 bp, Artificial Sequence
  chemically synthesized
tcaaaattttttcctgcaaatt

SEQ ID NO: 974903 - DNA, 22 bp, Artificial Sequence
  chemically synthesized
aatcacatctgaaatttgcagg

SEQ ID NO: 974904 - DNA, 22 bp, Artificial Sequence
  chemically synthesized
caaaattttttcctgcaaattt

SEQ ID NO: 974905 - DNA, 22 bp, Artificial Sequence
  chemically synthesized
aaaattttttcctgcaaatttc

SEQ ID NO: 974906 - DNA, 22 bp, Artificial Sequence
  chemically synthesized
tttcctgcaaatttcagatgtg

SEQ ID NO: 974907 - DNA, 22 bp, Artificial Sequence
  chemically synthesized
ttcctgcaaatttcagatgtga

SEQ ID NO: 974908 - DNA, 22 bp, Artificial Sequence
  chemically synthesized
tcctgcaaatttcagatgtgat

SEQ ID NO: 974909 - DNA, 22 bp, Artificial Sequence
  chemically synthesized
cctgcaaatttcagatgtgatt

SEQ ID NO: 974910 - DNA, 22 bp, Artificial Sequence
  chemically synthesized
ctgcaaatttcagatgtgatta

SEQ ID NO: 974911 - DNA, 22 bp, Artificial Sequence
  chemically synthesized
taaagtcaacacttaatcacat

SEQ ID NO: 974912 - DNA, 22 bp, Artificial Sequence
  chemically synthesized
ataaagtcaacacttaatcaca

SEQ ID NO: 974913 - DNA, 22 bp, Artificial Sequence
  chemically synthesized
caaatttcagatgtgattaagt

SEQ ID NO: 974914 - DNA, 22 bp, Artificial Sequence
  chemically synthesized
tataaagtcaacacttaatcac

SEQ ID NO: 974915 - DNA, 22 bp, Artificial Sequence
  chemically synthesized
cagatgtgattaagtgttgact

SEQ ID NO: 974916 - DNA, 22 bp, Artificial Sequence
  chemically synthesized
cagcctttataaagtcaacact

SEQ ID NO: 974917 - DNA, 22 bp, Artificial Sequence
  chemically synthesized
agatgtgattaagtgttgactt

SEQ ID NO: 974918 - DNA, 22 bp, Artificial Sequence
  chemically synthesized
ccagcctttataaagtcaacac

SEQ ID NO: 974919 - DNA, 22 bp, Artificial Sequence
  chemically synthesized
acgtttccagcctttataaagt

SEQ ID NO: 974920 - DNA, 22 bp, Artificial Sequence
  chemically synthesized
gacgtttccagcctttataaag

SEQ ID NO: 974921 - DNA, 22 bp, Artificial Sequence
  chemically synthesized
agtgttgactttataaaggctg

SEQ ID NO: 974922 - DNA, 22 bp, Artificial Sequence
  chemically synthesized
aagtgtttgacgtttccagcct

SEQ ID NO: 974923 - DNA, 22 bp, Artificial Sequence
  chemically synthesized
aaagtgtttgacgtttccagcc

SEQ ID NO: 974924 - DNA, 22 bp, Artificial Sequence
  chemically synthesized
taaagtgtttgacgtttccagc

SEQ ID NO: 974925 - DNA, 22 bp, Artificial Sequence
  chemically synthesized
actttataaaggctggaaacgt

SEQ ID NO: 974926 - DNA, 22 bp, Artificial Sequence
  chemically synthesized
ctttaaagtgtttgacgtttcc

SEQ ID NO: 974927 - DNA, 22 bp, Artificial Sequence
  chemically synthesized
actttaaagtgtttgacgtttc

SEQ ID NO: 974928 - DNA, 22 bp, Artificial Sequence
  chemically synthesized
tataaaggctggaaacgtcaaa

SEQ ID NO: 974929 - DNA, 22 bp, Artificial Sequence
  chemically synthesized
tactttaaagtgtttgacgttt

SEQ ID NO: 974930 - DNA, 22 bp, Artificial Sequence
  chemically synthesized
ataaaggctggaaacgtcaaac

SEQ ID NO: 974931 - DNA, 22 bp, Artificial Sequence
  chemically synthesized
taaaggctggaaacgtcaaaca

SEQ ID NO: 974932 - DNA, 22 bp, Artificial Sequence
  chemically synthesized
gaaacgtcaaacactttaaagt

SEQ ID NO: 974933 - DNA, 22 bp, Artificial Sequence
  chemically synthesized
agatgaaaacacaattttactt

SEQ ID NO: 974934 - DNA, 22 bp, Artificial Sequence
  chemically synthesized
aattaagatgaaaacacaattt

SEQ ID NO: 974935 - DNA, 22 bp, Artificial Sequence
  chemically synthesized
taaagtaaaattgtgttttcat

SEQ ID NO: 974936 - DNA, 22 bp, Artificial Sequence
  chemically synthesized
aaagtaaaattgtgttttcatc

SEQ ID NO: 974937 - DNA, 22 bp, Artificial Sequence
  chemically synthesized
aagtaaaattgtgttttcatct

SEQ ID NO: 974938 - DNA, 22 bp, Artificial Sequence
  chemically synthesized
atcattaaattaagatgaaaac

SEQ ID NO: 974939 - DNA, 22 bp, Artificial Sequence
  chemically synthesized
catcattaaattaagatgaaaa

SEQ ID NO: 974940 - DNA, 22 bp, Artificial Sequence
  chemically synthesized
tcatcattaaattaagatgaaa

SEQ ID NO: 974941 - DNA, 22 bp, Artificial Sequence
  chemically synthesized
ttcatcattaaattaagatgaa

SEQ ID NO: 974942 - DNA, 22 bp, Artificial Sequence
  chemically synthesized
tgttttcatcttaatttaatga

SEQ ID NO: 974943 - DNA, 22 bp, Artificial Sequence
  chemically synthesized
tcatcttaatttaatgatgaaa

SEQ ID NO: 974944 - DNA, 22 bp, Artificial Sequence
  chemically synthesized
catcttaatttaatgatgaaaa

SEQ ID NO: 974945 - DNA, 22 bp, Artificial Sequence
  chemically synthesized
atcttaatttaatgatgaaaaa

SEQ ID NO: 974946 - DNA, 22 bp, Artificial Sequence
  chemically synthesized
gacagcataagtatgtttttca

SEQ ID NO: 974947 - DNA, 22 bp, Artificial Sequence
  chemically synthesized
aatttaatgatgaaaaacatac

SEQ ID NO: 974948 - DNA, 22 bp, Artificial Sequence
  chemically synthesized
atttaatgatgaaaaacatact

SEQ ID NO: 974949 - DNA, 22 bp, Artificial Sequence
  chemically synthesized
ttagacagcataagtatgtttt

SEQ ID NO: 974950 - DNA, 22 bp, Artificial Sequence
  chemically synthesized
aatgatgaaaaacatacttatg

SEQ ID NO: 974951 - DNA, 22 bp, Artificial Sequence
  chemically synthesized
atgatgaaaaacatacttatgc

SEQ ID NO: 974952 - DNA, 22 bp, Artificial Sequence
  chemically synthesized
gatctattagacagcataagta

SEQ ID NO: 974953 - DNA, 22 bp, Artificial Sequence
  chemically synthesized
gttagatctattagacagcata

SEQ ID NO: 974954 - DNA, 22 bp, Artificial Sequence
  chemically synthesized
ggttagatctattagacagcat

SEQ ID NO: 974955 - DNA, 22 bp, Artificial Sequence
  chemically synthesized
ttggttagatctattagacagc

SEQ ID NO: 974956 - DNA, 22 bp, Artificial Sequence
  chemically synthesized
atgctgtctaatagatctaacc

SEQ ID NO: 974957 - DNA, 22 bp, Artificial Sequence
  chemically synthesized
tgctgtctaatagatctaacca

SEQ ID NO: 974958 - DNA, 22 bp, Artificial Sequence
  chemically synthesized
tctaatagatctaaccaagaat

SEQ ID NO: 974959 - DNA, 22 bp, Artificial Sequence
  chemically synthesized
atagatctaaccaagaatttct

SEQ ID NO: 974960 - DNA, 22 bp, Artificial Sequence
  chemically synthesized
accaagaatttctgattcattt

SEQ ID NO: 974961 - DNA, 22 bp, Artificial Sequence
  chemically synthesized
caggtagaccaatcaaatgaat

SEQ ID NO: 974962 - DNA, 22 bp, Artificial Sequence
  chemically synthesized
ccaggtagaccaatcaaatgaa

SEQ ID NO: 974963 - DNA, 22 bp, Artificial Sequence
  chemically synthesized
tccaggtagaccaatcaaatga

SEQ ID NO: 974964 - DNA, 22 bp, Artificial Sequence
  chemically synthesized
ttttccaggtagaccaatcaaa

SEQ ID NO: 974965 - DNA, 22 bp, Artificial Sequence
  chemically synthesized
ttattttccaggtagaccaatc

SEQ ID NO: 974966 - DNA, 22 bp, Artificial Sequence
  chemically synthesized
ctgattcatttgattggtctac

SEQ ID NO: 974967 - DNA, 22 bp, Artificial Sequence
  chemically synthesized
attattttccaggtagaccaat

SEQ ID NO: 974968 - DNA, 22 bp, Artificial Sequence
  chemically synthesized
tgattcatttgattggtctacc

SEQ ID NO: 974969 - DNA, 22 bp, Artificial Sequence
  chemically synthesized
tattattttccaggtagaccaa

SEQ ID NO: 974970 - DNA, 22 bp, Artificial Sequence
  chemically synthesized
attcatttgattggtctacctg

SEQ ID NO: 974971 - DNA, 22 bp, Artificial Sequence
  chemically synthesized
attttattattttccaggtaga

SEQ ID NO: 974972 - DNA, 22 bp, Artificial Sequence
  chemically synthesized
atttgattggtctacctggaaa

SEQ ID NO: 974973 - DNA, 22 bp, Artificial Sequence
  chemically synthesized
ttaattttattattttccaggt

SEQ ID NO: 974974 - DNA, 22 bp, Artificial Sequence
  chemically synthesized
attaattttattattttccagg

SEQ ID NO: 974975 - DNA, 22 bp, Artificial Sequence
  chemically synthesized
tattaattttattattttccag

SEQ ID NO: 974976 - DNA, 22 bp, Artificial Sequence
  chemically synthesized
gattggtctacctggaaaataa

SEQ ID NO: 974977 - DNA, 22 bp, Artificial Sequence
  chemically synthesized
attggtctacctggaaaataat

SEQ ID NO: 974978 - DNA, 22 bp, Artificial Sequence
  chemically synthesized
ctttattaattttattattttc

SEQ ID NO: 974979 - DNA, 22 bp, Artificial Sequence
  chemically synthesized
tcctttattaattttattattt

SEQ ID NO: 974980 - DNA, 22 bp, Artificial Sequence
  chemically synthesized
gtctacctggaaaataataaaa

SEQ ID NO: 974981 - DNA, 22 bp, Artificial Sequence
  chemically synthesized
tactctcctttattaattttat

SEQ ID NO: 974982 - DNA, 22 bp, Artificial Sequence
  chemically synthesized
cctggaaaataataaaattaat

SEQ ID NO: 974983 - DNA, 22 bp, Artificial Sequence
  chemically synthesized
atactctcctttattaatttta

SEQ ID NO: 974984 - DNA, 22 bp, Artificial Sequence
  chemically synthesized
tatactctcctttattaatttt

SEQ ID NO: 974985 - DNA, 22 bp, Artificial Sequence
  chemically synthesized
gaaaataataaaattaataaag

SEQ ID NO: 974986 - DNA, 22 bp, Artificial Sequence
  chemically synthesized
cagaatatgcattttatactct

SEQ ID NO: 974987 - DNA, 22 bp, Artificial Sequence
  chemically synthesized
ataaaggagagtataaaatgca

SEQ ID NO: 974988 - DNA, 22 bp, Artificial Sequence
  chemically synthesized
tgtactacagaatatgcatttt

SEQ ID NO: 974989 - DNA, 22 bp, Artificial Sequence
  chemically synthesized
atgtactacagaatatgcattt

SEQ ID NO: 974990 - DNA, 22 bp, Artificial Sequence
  chemically synthesized
aaagacacatcatttatgtact

SEQ ID NO: 974991 - DNA, 22 bp, Artificial Sequence
  chemically synthesized
aaaagacacatcatttatgtac

SEQ ID NO: 974992 - DNA, 22 bp, Artificial Sequence
  chemically synthesized
taaaagacacatcatttatgta

SEQ ID NO: 974993 - DNA, 22 bp, Artificial Sequence
  chemically synthesized
acattttaaaagacacatcatt

SEQ ID NO: 974994 - DNA, 22 bp, Artificial Sequence
  chemically synthesized
tgtagtacataaatgatgtgtc

SEQ ID NO: 974995 - DNA, 22 bp, Artificial Sequence
  chemically synthesized
tagtacataaatgatgtgtctt

SEQ ID NO: 974996 - DNA, 22 bp, Artificial Sequence
  chemically synthesized
agttgacattttaaaagacaca

SEQ ID NO: 974997 - DNA, 22 bp, Artificial Sequence
  chemically synthesized
cagttgacattttaaaagacac

SEQ ID NO: 974998 - DNA, 22 bp, Artificial Sequence
  chemically synthesized
tttcagttgacattttaaaaga

SEQ ID NO: 974999 - DNA, 22 bp, Artificial Sequence
  chemically synthesized
aaaaatattatttcagttgaca

SEQ ID NO: 975000 - DNA, 22 bp, Artificial Sequence
  chemically synthesized
aaaaaatattatttcagttgac

SEQ ID NO: 975001 - DNA, 22 bp, Artificial Sequence
  chemically synthesized
taaaaaatattatttcagttga

SEQ ID NO: 975002 - DNA, 22 bp, Artificial Sequence
  chemically synthesized
ttaaaatgtcaactgaaataat

SEQ ID NO: 975003 - DNA, 22 bp, Artificial Sequence
  chemically synthesized
attttaaaaaatattatttcag

SEQ ID NO: 975004 - DNA, 22 bp, Artificial Sequence
  chemically synthesized
taaaatgtcaactgaaataata

SEQ ID NO: 975005 - DNA, 22 bp, Artificial Sequence
  chemically synthesized
cattttaaaaaatattatttca

SEQ ID NO: 975006 - DNA, 22 bp, Artificial Sequence
  chemically synthesized
aaaatgtcaactgaaataatat

SEQ ID NO: 975007 - DNA, 22 bp, Artificial Sequence
  chemically synthesized
aaatgtcaactgaaataatatt

SEQ ID NO: 975008 - DNA, 22 bp, Artificial Sequence
  chemically synthesized
aatggcttcattttaaaaaata

SEQ ID NO: 975009 - DNA, 22 bp, Artificial Sequence
  chemically synthesized
aaatggcttcattttaaaaaat

SEQ ID NO: 975010 - DNA, 22 bp, Artificial Sequence
  chemically synthesized
taaatggcttcattttaaaaaa

SEQ ID NO: 975011 - DNA, 22 bp, Artificial Sequence
  chemically synthesized
ttaaatggcttcattttaaaaa

SEQ ID NO: 975012 - DNA, 22 bp, Artificial Sequence
  chemically synthesized
aaataatattttttaaaatgaa

SEQ ID NO: 975013 - DNA, 22 bp, Artificial Sequence
  chemically synthesized
aaaatcatttttaaatggcttc

SEQ ID NO: 975014 - DNA, 22 bp, Artificial Sequence
  chemically synthesized
tttaaaatgaagccatttaaaa

SEQ ID NO: 975015 - DNA, 22 bp, Artificial Sequence
  chemically synthesized
ttaaaatgaagccatttaaaaa

SEQ ID NO: 975016 - DNA, 22 bp, Artificial Sequence
  chemically synthesized
cactaaaaatcatttttaaatg

SEQ ID NO: 975017 - DNA, 22 bp, Artificial Sequence
  chemically synthesized
taaaatgaagccatttaaaaat

SEQ ID NO: 975018 - DNA, 22 bp, Artificial Sequence
  chemically synthesized
acactaaaaatcatttttaaat

SEQ ID NO: 975019 - DNA, 22 bp, Artificial Sequence
  chemically synthesized
aaaatgaagccatttaaaaatg

SEQ ID NO: 975020 - DNA, 22 bp, Artificial Sequence
  chemically synthesized
aaatgaagccatttaaaaatga

SEQ ID NO: 975021 - DNA, 22 bp, Artificial Sequence
  chemically synthesized
tttacactaaaaatcattttta

SEQ ID NO: 975022 - DNA, 22 bp, Artificial Sequence
  chemically synthesized
atttacactaaaaatcattttt

SEQ ID NO: 975023 - DNA, 22 bp, Artificial Sequence
  chemically synthesized
gcatcttatttacactaaaaat

SEQ ID NO: 975024 - DNA, 22 bp, Artificial Sequence
  chemically synthesized
tggcatcttatttacactaaaa

SEQ ID NO: 975025 - DNA, 22 bp, Artificial Sequence
  chemically synthesized
ctggcatcttatttacactaaa

SEQ ID NO: 975026 - DNA, 22 bp, Artificial Sequence
  chemically synthesized
aaaaatgatttttagtgtaaat

SEQ ID NO: 975027 - DNA, 22 bp, Artificial Sequence
  chemically synthesized
aaaatgatttttagtgtaaata

SEQ ID NO: 975028 - DNA, 22 bp, Artificial Sequence
  chemically synthesized
tccatcttctggcatcttattt

SEQ ID NO: 975029 - DNA, 22 bp, Artificial Sequence
  chemically synthesized
ttagtgtaaataagatgccaga

SEQ ID NO: 975030 - DNA, 22 bp, Artificial Sequence
  chemically synthesized
tagtgtaaataagatgccagaa

SEQ ID NO: 975031 - DNA, 22 bp, Artificial Sequence
  chemically synthesized
tacctgtccatcttctggcatc

SEQ ID NO: 975032 - DNA, 22 bp, Artificial Sequence
  chemically synthesized
agtgtaaataagatgccagaag

SEQ ID NO: 975033 - DNA, 22 bp, Artificial Sequence
  chemically synthesized
atacctgtccatcttctggcat

SEQ ID NO: 975034 - DNA, 22 bp, Artificial Sequence
  chemically synthesized
gtgtaaataagatgccagaaga

SEQ ID NO: 975035 - DNA, 22 bp, Artificial Sequence
  chemically synthesized
tatacctgtccatcttctggca

SEQ ID NO: 975036 - DNA, 22 bp, Artificial Sequence
  chemically synthesized
attttatacctgtccatcttct

SEQ ID NO: 975037 - DNA, 22 bp, Artificial Sequence
  chemically synthesized
tgggtagaggttaattttatac

SEQ ID NO: 975038 - DNA, 22 bp, Artificial Sequence
  chemically synthesized
tggttatgggtagaggttaatt

SEQ ID NO: 975039 - DNA, 22 bp, Artificial Sequence
  chemically synthesized
tgaaattatggttatgggtaga

SEQ ID NO: 975040 - DNA, 22 bp, Artificial Sequence
  chemically synthesized
ctatgaaattatggttatgggt

SEQ ID NO: 975041 - DNA, 22 bp, Artificial Sequence
  chemically synthesized
actactatgaaattatggttat

SEQ ID NO: 975042 - DNA, 22 bp, Artificial Sequence
  chemically synthesized
acctctacccataaccataatt

SEQ ID NO: 975043 - DNA, 22 bp, Artificial Sequence
  chemically synthesized
attaactactatgaaattatgg

SEQ ID NO: 975044 - DNA, 22 bp, Artificial Sequence
  chemically synthesized
tacccataaccataatttcata

SEQ ID NO: 975045 - DNA, 22 bp, Artificial Sequence
  chemically synthesized
cccataaccataatttcatagt

SEQ ID NO: 975046 - DNA, 22 bp, Artificial Sequence
  chemically synthesized
agctcattaactactatgaaat

SEQ ID NO: 975047 - DNA, 22 bp, Artificial Sequence
  chemically synthesized
agttgagctcattaactactat

SEQ ID NO: 975048 - DNA, 22 bp, Artificial Sequence
  chemically synthesized
gagttgagctcattaactacta

SEQ ID NO: 975049 - DNA, 22 bp, Artificial Sequence
  chemically synthesized
ttgagttgagctcattaactac

SEQ ID NO: 975050 - DNA, 22 bp, Artificial Sequence
  chemically synthesized
cttgagttgagctcattaacta

SEQ ID NO: 975051 - DNA, 22 bp, Artificial Sequence
  chemically synthesized
tcttgagttgagctcattaact

SEQ ID NO: 975052 - DNA, 22 bp, Artificial Sequence
  chemically synthesized
ttcttgagttgagctcattaac

SEQ ID NO: 975053 - DNA, 22 bp, Artificial Sequence
  chemically synthesized
catagtagttaatgagctcaac

SEQ ID NO: 975054 - DNA, 22 bp, Artificial Sequence
  chemically synthesized
tccttttcttgagttgagctca

SEQ ID NO: 975055 - DNA, 22 bp, Artificial Sequence
  chemically synthesized
atagtagttaatgagctcaact

SEQ ID NO: 975056 - DNA, 22 bp, Artificial Sequence
  chemically synthesized
tatccttttcttgagttgagct

SEQ ID NO: 975057 - DNA, 22 bp, Artificial Sequence
  chemically synthesized
ctatccttttcttgagttgagc

SEQ ID NO: 975058 - DNA, 22 bp, Artificial Sequence
  chemically synthesized
gacttctatccttttcttgagt

SEQ ID NO: 975059 - DNA, 22 bp, Artificial Sequence
  chemically synthesized
atgagctcaactcaagaaaagg

SEQ ID NO: 975060 - DNA, 22 bp, Artificial Sequence
  chemically synthesized
actagacttctatccttttctt

SEQ ID NO: 975061 - DNA, 22 bp, Artificial Sequence
  chemically synthesized
ctgactagacttctatcctttt

SEQ ID NO: 975062 - DNA, 22 bp, Artificial Sequence
  chemically synthesized
cctgactagacttctatccttt

SEQ ID NO: 975063 - DNA, 22 bp, Artificial Sequence
  chemically synthesized
tcctgactagacttctatcctt

SEQ ID NO: 975064 - DNA, 22 bp, Artificial Sequence
  chemically synthesized
ttcctgactagacttctatcct

SEQ ID NO: 975065 - DNA, 22 bp, Artificial Sequence
  chemically synthesized
aactcaagaaaaggatagaagt

SEQ ID NO: 975066 - DNA, 22 bp, Artificial Sequence
  chemically synthesized
cccttttcctgactagacttct

SEQ ID NO: 975067 - DNA, 22 bp, Artificial Sequence
  chemically synthesized
aagaaaaggatagaagtctagt

SEQ ID NO: 975068 - DNA, 22 bp, Artificial Sequence
  chemically synthesized
cattacccttttcctgactaga

SEQ ID NO: 975069 - DNA, 22 bp, Artificial Sequence
  chemically synthesized
gcattacccttttcctgactag

SEQ ID NO: 975070 - DNA, 22 bp, Artificial Sequence
  chemically synthesized
tgcattacccttttcctgacta

SEQ ID NO: 975071 - DNA, 22 bp, Artificial Sequence
  chemically synthesized
actttgcattacccttttcctg

SEQ ID NO: 975072 - DNA, 22 bp, Artificial Sequence
  chemically synthesized
cactttgcattacccttttcct

SEQ ID NO: 975073 - DNA, 22 bp, Artificial Sequence
  chemically synthesized
atgtttcactttgcattaccct

SEQ ID NO: 975074 - DNA, 22 bp, Artificial Sequence
  chemically synthesized
aatgtttcactttgcattaccc

SEQ ID NO: 975075 - DNA, 22 bp, Artificial Sequence
  chemically synthesized
taatgtttcactttgcattacc

SEQ ID NO: 975076 - DNA, 22 bp, Artificial Sequence
  chemically synthesized
gtcaggaaaagggtaatgcaaa

SEQ ID NO: 975077 - DNA, 22 bp, Artificial Sequence
  chemically synthesized
actttaatgtttcactttgcat

SEQ ID NO: 975078 - DNA, 22 bp, Artificial Sequence
  chemically synthesized
aactttaatgtttcactttgca

SEQ ID NO: 975079 - DNA, 22 bp, Artificial Sequence
  chemically synthesized
ccaaaaatgagggaaataattt

SEQ ID NO: 975080 - DNA, 22 bp, Artificial Sequence
  chemically synthesized
ttaccaaaaatgagggaaataa

SEQ ID NO: 975081 - DNA, 22 bp, Artificial Sequence
  chemically synthesized
aagttaaattatttccctcatt

SEQ ID NO: 975082 - DNA, 22 bp, Artificial Sequence
  chemically synthesized
ataacctgttaccaaaaatgag

SEQ ID NO: 975083 - DNA, 22 bp, Artificial Sequence
  chemically synthesized
aataacctgttaccaaaaatga

SEQ ID NO: 975084 - DNA, 22 bp, Artificial Sequence
  chemically synthesized
aattatttccctcatttttggt

SEQ ID NO: 975085 - DNA, 22 bp, Artificial Sequence
  chemically synthesized
taataacctgttaccaaaaatg

SEQ ID NO: 975086 - DNA, 22 bp, Artificial Sequence
  chemically synthesized
ttttaataacctgttaccaaaa

SEQ ID NO: 975087 - DNA, 22 bp, Artificial Sequence
  chemically synthesized
tttccctcatttttggtaacag

SEQ ID NO: 975088 - DNA, 22 bp, Artificial Sequence
  chemically synthesized
ccctcatttttggtaacaggtt

SEQ ID NO: 975089 - DNA, 22 bp, Artificial Sequence
  chemically synthesized
cctcatttttggtaacaggtta

SEQ ID NO: 975090 - DNA, 22 bp, Artificial Sequence
  chemically synthesized
aagtctattttaataacctgtt

SEQ ID NO: 975091 - DNA, 22 bp, Artificial Sequence
  chemically synthesized
atttttggtaacaggttattaa

SEQ ID NO: 975092 - DNA, 22 bp, Artificial Sequence
  chemically synthesized
ttggtaacaggttattaaaata

SEQ ID NO: 975093 - DNA, 22 bp, Artificial Sequence
  chemically synthesized
tggtaacaggttattaaaatag

SEQ ID NO: 975094 - DNA, 22 bp, Artificial Sequence
  chemically synthesized
ggtaacaggttattaaaataga

SEQ ID NO: 975095 - DNA, 22 bp, Artificial Sequence
  chemically synthesized
gtaacaggttattaaaatagac

SEQ ID NO: 975096 - DNA, 22 bp, Artificial Sequence
  chemically synthesized
aaaaacccattcaagtctattt

SEQ ID NO: 975097 - DNA, 22 bp, Artificial Sequence
  chemically synthesized
atattgaaaaacccattcaagt

SEQ ID NO: 975098 - DNA, 22 bp, Artificial Sequence
  chemically synthesized
catattgaaaaacccattcaag

SEQ ID NO: 975099 - DNA, 22 bp, Artificial Sequence
  chemically synthesized
ttaaaatagacttgaatgggtt

SEQ ID NO: 975100 - DNA, 22 bp, Artificial Sequence
  chemically synthesized
aaatagacttgaatgggttttt

SEQ ID NO: 975101 - DNA, 22 bp, Artificial Sequence
  chemically synthesized
gtgtttcatattgaaaaaccca

SEQ ID NO: 975102 - DNA, 22 bp, Artificial Sequence
  chemically synthesized
atcctagtgtttcatattgaaa

SEQ ID NO: 975103 - DNA, 22 bp, Artificial Sequence
  chemically synthesized
gaatgggtttttcaatatgaaa

SEQ ID NO: 975104 - DNA, 22 bp, Artificial Sequence
  chemically synthesized
aatgggtttttcaatatgaaac

SEQ ID NO: 975105 - DNA, 22 bp, Artificial Sequence
  chemically synthesized
ttcaatatgaaacactaggatg

SEQ ID NO: 975106 - DNA, 22 bp, Artificial Sequence
  chemically synthesized
tcaatatgaaacactaggatga

SEQ ID NO: 975107 - DNA, 22 bp, Artificial Sequence
  chemically synthesized
caatatgaaacactaggatgag

SEQ ID NO: 975108 - DNA, 22 bp, Artificial Sequence
  chemically synthesized
aagcacagaaagctcatcctag

SEQ ID NO: 975109 - DNA, 22 bp, Artificial Sequence
  chemically synthesized
aatatgaaacactaggatgagc

SEQ ID NO: 975110 - DNA, 22 bp, Artificial Sequence
  chemically synthesized
agatgaagaaactgaagcacag

SEQ ID NO: 975111 - DNA, 22 bp, Artificial Sequence
  chemically synthesized
ggatgagctttctgtgcttcag

SEQ ID NO: 975112 - DNA, 22 bp, Artificial Sequence
  chemically synthesized
cagatgaagaaactgaagcaca

SEQ ID NO: 975113 - DNA, 22 bp, Artificial Sequence
  chemically synthesized
cttcagatgaagaaactgaagc

SEQ ID NO: 975114 - DNA, 22 bp, Artificial Sequence
  chemically synthesized
tccttcagatgaagaaactgaa

SEQ ID NO: 975115 - DNA, 22 bp, Artificial Sequence
  chemically synthesized
tctgtgcttcagtttcttcatc

SEQ ID NO: 975116 - DNA, 22 bp, Artificial Sequence
  chemically synthesized
ctgtgcttcagtttcttcatct

SEQ ID NO: 975117 - DNA, 22 bp, Artificial Sequence
  chemically synthesized
tgtgcttcagtttcttcatctg

SEQ ID NO: 975118 - DNA, 22 bp, Artificial Sequence
  chemically synthesized
tgcttcagtttcttcatctgaa

SEQ ID NO: 975119 - DNA, 22 bp, Artificial Sequence
  chemically synthesized
agacagcctctccttcagatga

SEQ ID NO: 975120 - DNA, 22 bp, Artificial Sequence
  chemically synthesized
ctcagacagcctctccttcaga

SEQ ID NO: 975121 - DNA, 22 bp, Artificial Sequence
  chemically synthesized
cagtttcttcatctgaaggaga

SEQ ID NO: 975122 - DNA, 22 bp, Artificial Sequence
  chemically synthesized
agtttcttcatctgaaggagag

SEQ ID NO: 975123 - DNA, 22 bp, Artificial Sequence
  chemically synthesized
cttcatctgaaggagaggctgt

SEQ ID NO: 975124 - DNA, 22 bp, Artificial Sequence
  chemically synthesized
ttcatctgaaggagaggctgtc

SEQ ID NO: 975125 - DNA, 22 bp, Artificial Sequence
  chemically synthesized
catctgaaggagaggctgtctg

SEQ ID NO: 975126 - DNA, 22 bp, Artificial Sequence
  chemically synthesized
tggtcccctactcagacagcct

SEQ ID NO: 975127 - DNA, 22 bp, Artificial Sequence
  chemically synthesized
atctgaaggagaggctgtctga

SEQ ID NO: 975128 - DNA, 22 bp, Artificial Sequence
  chemically synthesized
atggtcccctactcagacagcc

SEQ ID NO: 975129 - DNA, 22 bp, Artificial Sequence
  chemically synthesized
ttatggtcccctactcagacag

SEQ ID NO: 975130 - DNA, 22 bp, Artificial Sequence
  chemically synthesized
aaggagaggctgtctgagtagg

SEQ ID NO: 975131 - DNA, 22 bp, Artificial Sequence
  chemically synthesized
aagtggattcttatggtcccct

SEQ ID NO: 975132 - DNA, 22 bp, Artificial Sequence
  chemically synthesized
tctgagtaggggaccataagaa

SEQ ID NO: 975133 - DNA, 22 bp, Artificial Sequence
  chemically synthesized
agtaggggaccataagaatcca

SEQ ID NO: 975134 - DNA, 22 bp, Artificial Sequence
  chemically synthesized
cagaagctgaagtggattctta

SEQ ID NO: 975135 - DNA, 22 bp, Artificial Sequence
  chemically synthesized
cagcttctgtagtctatgatat

SEQ ID NO: 975136 - DNA, 22 bp, Artificial Sequence
  chemically synthesized
agcttctgtagtctatgatata

SEQ ID NO: 975137 - DNA, 22 bp, Artificial Sequence
  chemically synthesized
ataaaaatgcagatatatcata

SEQ ID NO: 975138 - DNA, 22 bp, Artificial Sequence
  chemically synthesized
ctgtagtctatgatatatctgc

SEQ ID NO: 975139 - DNA, 22 bp, Artificial Sequence
  chemically synthesized
tgtagtctatgatatatctgca

SEQ ID NO: 975140 - DNA, 22 bp, Artificial Sequence
  chemically synthesized
tagtctatgatatatctgcatt

SEQ ID NO: 975141 - DNA, 22 bp, Artificial Sequence
  chemically synthesized
tgatatatctgcatttttatca

SEQ ID NO: 975142 - DNA, 22 bp, Artificial Sequence
  chemically synthesized
catgggaataataataaatgcc

SEQ ID NO: 975143 - DNA, 22 bp, Artificial Sequence
  chemically synthesized
catttttatcaggcatttatta

SEQ ID NO: 975144 - DNA, 22 bp, Artificial Sequence
  chemically synthesized
ctacatgggaataataataaat

SEQ ID NO: 975145 - DNA, 22 bp, Artificial Sequence
  chemically synthesized
ttatcaggcatttattattatt

SEQ ID NO: 975146 - DNA, 22 bp, Artificial Sequence
  chemically synthesized
tatcaggcatttattattattc

SEQ ID NO: 975147 - DNA, 22 bp, Artificial Sequence
  chemically synthesized
cctgctacatgggaataataat

SEQ ID NO: 975148 - DNA, 22 bp, Artificial Sequence
  chemically synthesized
atcaggcatttattattattcc

SEQ ID NO: 975149 - DNA, 22 bp, Artificial Sequence
  chemically synthesized
tcaggcatttattattattccc

SEQ ID NO: 975150 - DNA, 22 bp, Artificial Sequence
  chemically synthesized
attattattcccatgtagcagg

SEQ ID NO: 975151 - DNA, 22 bp, Artificial Sequence
  chemically synthesized
ttattattcccatgtagcaggg

SEQ ID NO: 975152 - DNA, 22 bp, Artificial Sequence
  chemically synthesized
ttattcccatgtagcagggaat

SEQ ID NO: 975153 - DNA, 22 bp, Artificial Sequence
  chemically synthesized
ttcccatgtagcagggaatgtt

SEQ ID NO: 975154 - DNA, 22 bp, Artificial Sequence
  chemically synthesized
aagggagggagcagaacattcc

SEQ ID NO: 975155 - DNA, 22 bp, Artificial Sequence
  chemically synthesized
ccatgtagcagggaatgttctg

SEQ ID NO: 975156 - DNA, 22 bp, Artificial Sequence
  chemically synthesized
gctcaagggagggagcagaaca

SEQ ID NO: 975157 - DNA, 22 bp, Artificial Sequence
  chemically synthesized
ctggctcaagggagggagcaga

SEQ ID NO: 975158 - DNA, 22 bp, Artificial Sequence
  chemically synthesized
cctggctcaagggagggagcag

SEQ ID NO: 975159 - DNA, 22 bp, Artificial Sequence
  chemically synthesized
tacttcctggctcaagggaggg

SEQ ID NO: 975160 - DNA, 22 bp, Artificial Sequence
  chemically synthesized
tgctccctcccttgagccagga

SEQ ID NO: 975161 - DNA, 22 bp, Artificial Sequence
  chemically synthesized
ctccctcccttgagccaggaag

SEQ ID NO: 975162 - DNA, 22 bp, Artificial Sequence
  chemically synthesized
atacaaattgtacttcctggct

SEQ ID NO: 975163 - DNA, 22 bp, Artificial Sequence
  chemically synthesized
cctcccttgagccaggaagtac

SEQ ID NO: 975164 - DNA, 22 bp, Artificial Sequence
  chemically synthesized
ccttgagccaggaagtacaatt

SEQ ID NO: 975165 - DNA, 22 bp, Artificial Sequence
  chemically synthesized
gagatcctgatacaaattgtac

SEQ ID NO: 975166 - DNA, 22 bp, Artificial Sequence
  chemically synthesized
gagccaggaagtacaatttgta

SEQ ID NO: 975167 - DNA, 22 bp, Artificial Sequence
  chemically synthesized
agccaggaagtacaatttgtat

SEQ ID NO: 975168 - DNA, 22 bp, Artificial Sequence
  chemically synthesized
gatggagcaaaacataattcga

SEQ ID NO: 975169 - DNA, 22 bp, Artificial Sequence
  chemically synthesized
gtatcaggatctcgaattatgt

SEQ ID NO: 975170 - DNA, 22 bp, Artificial Sequence
  chemically synthesized
tatcaggatctcgaattatgtt

SEQ ID NO: 975171 - DNA, 22 bp, Artificial Sequence
  chemically synthesized
ggattagatggagcaaaacata

SEQ ID NO: 975172 - DNA, 22 bp, Artificial Sequence
  chemically synthesized
gaattatgttttgctccatcta

SEQ ID NO: 975173 - DNA, 22 bp, Artificial Sequence
  chemically synthesized
tgttttgctccatctaatccca

SEQ ID NO: 975174 - DNA, 22 bp, Artificial Sequence
  chemically synthesized
tgctccatctaatcccagtcat

SEQ ID NO: 975175 - DNA, 22 bp, Artificial Sequence
  chemically synthesized
gctccatctaatcccagtcatt

SEQ ID NO: 975176 - DNA, 22 bp, Artificial Sequence
  chemically synthesized
ctccatctaatcccagtcattt

SEQ ID NO: 975177 - DNA, 22 bp, Artificial Sequence
  chemically synthesized
catctaatcccagtcatttctc

SEQ ID NO: 975178 - DNA, 22 bp, Artificial Sequence
  chemically synthesized
atcccagtcatttctctacata

SEQ ID NO: 975179 - DNA, 22 bp, Artificial Sequence
  chemically synthesized
agtatggtgaaaaatacagata

SEQ ID NO: 975180 - DNA, 22 bp, Artificial Sequence
  chemically synthesized
ttaagtatggtgaaaaatacag

SEQ ID NO: 975181 - DNA, 22 bp, Artificial Sequence
  chemically synthesized
attaagtatggtgaaaaataca

SEQ ID NO: 975182 - DNA, 22 bp, Artificial Sequence
  chemically synthesized
ctctacatatctgtatttttca

SEQ ID NO: 975183 - DNA, 22 bp, Artificial Sequence
  chemically synthesized
tattaagtatggtgaaaaatac

SEQ ID NO: 975184 - DNA, 22 bp, Artificial Sequence
  chemically synthesized
tctacatatctgtatttttcac

SEQ ID NO: 975185 - DNA, 22 bp, Artificial Sequence
  chemically synthesized
tacatatctgtatttttcacca

SEQ ID NO: 975186 - DNA, 22 bp, Artificial Sequence
  chemically synthesized
catatctgtatttttcaccata

SEQ ID NO: 975187 - DNA, 22 bp, Artificial Sequence
  chemically synthesized
taattttattaagtatggtgaa

SEQ ID NO: 975188 - DNA, 22 bp, Artificial Sequence
  chemically synthesized
tatttttcaccatacttaataa

SEQ ID NO: 975189 - DNA, 22 bp, Artificial Sequence
  chemically synthesized
ttcaccatacttaataaaatta

SEQ ID NO: 975190 - DNA, 22 bp, Artificial Sequence
  chemically synthesized
tcaccatacttaataaaattat

SEQ ID NO: 975191 - DNA, 22 bp, Artificial Sequence
  chemically synthesized
caccatacttaataaaattata

SEQ ID NO: 975192 - DNA, 22 bp, Artificial Sequence
  chemically synthesized
accatacttaataaaattatag

SEQ ID NO: 975193 - DNA, 22 bp, Artificial Sequence
  chemically synthesized
aataaaattatagggatttctt

SEQ ID NO: 975194 - DNA, 22 bp, Artificial Sequence
  chemically synthesized
ataaaattatagggatttcttc

SEQ ID NO: 975195 - DNA, 22 bp, Artificial Sequence
  chemically synthesized
tagggatttcttcttgttctac

SEQ ID NO: 975196 - DNA, 22 bp, Artificial Sequence
  chemically synthesized
cttcttgttctaccacttcact

SEQ ID NO: 975197 - DNA, 22 bp, Artificial Sequence
  chemically synthesized
ttcttgttctaccacttcactt

SEQ ID NO: 975198 - DNA, 22 bp, Artificial Sequence
  chemically synthesized
cttgttctaccacttcacttca

SEQ ID NO: 975199 - DNA, 22 bp, Artificial Sequence
  chemically synthesized
aagtggagaccatgaagtgaag

SEQ ID NO: 975200 - DNA, 22 bp, Artificial Sequence
  chemically synthesized
ttgttctaccacttcacttcat

SEQ ID NO: 975201 - DNA, 22 bp, Artificial Sequence
  chemically synthesized
gttctaccacttcacttcatgg

SEQ ID NO: 975202 - DNA, 22 bp, Artificial Sequence
  chemically synthesized
ctcaagtggagaccatgaagtg

SEQ ID NO: 975203 - DNA, 22 bp, Artificial Sequence
  chemically synthesized
ttctaccacttcacttcatggt

SEQ ID NO: 975204 - DNA, 22 bp, Artificial Sequence
  chemically synthesized
taccacttcacttcatggtctc

SEQ ID NO: 975205 - DNA, 22 bp, Artificial Sequence
  chemically synthesized
cattactcaagtggagaccatg

SEQ ID NO: 975206 - DNA, 22 bp, Artificial Sequence
  chemically synthesized
ccacttcacttcatggtctcca

SEQ ID NO: 975207 - DNA, 22 bp, Artificial Sequence
  chemically synthesized
attgcattactcaagtggagac

SEQ ID NO: 975208 - DNA, 22 bp, Artificial Sequence
  chemically synthesized
cacttcatggtctccacttgag

SEQ ID NO: 975209 - DNA, 22 bp, Artificial Sequence
  chemically synthesized
acttcatggtctccacttgagt

SEQ ID NO: 975210 - DNA, 22 bp, Artificial Sequence
  chemically synthesized
ccagttgattgcattactcaag

SEQ ID NO: 975211 - DNA, 22 bp, Artificial Sequence
  chemically synthesized
catggtctccacttgagtaatg

SEQ ID NO: 975212 - DNA, 22 bp, Artificial Sequence
  chemically synthesized
atggtctccacttgagtaatgc

SEQ ID NO: 975213 - DNA, 22 bp, Artificial Sequence
  chemically synthesized
tacctgccagttgattgcatta

SEQ ID NO: 975214 - DNA, 22 bp, Artificial Sequence
  chemically synthesized
cacttgagtaatgcaatcaact

SEQ ID NO: 975215 - DNA, 22 bp, Artificial Sequence
  chemically synthesized
gagtaatgcaatcaactggcag

SEQ ID NO: 975216 - DNA, 22 bp, Artificial Sequence
  chemically synthesized
agtaatgcaatcaactggcagg

SEQ ID NO: 975217 - DNA, 22 bp, Artificial Sequence
  chemically synthesized
atggtaattgtacctgccagtt

SEQ ID NO: 975218 - DNA, 22 bp, Artificial Sequence
  chemically synthesized
cctcatggtaattgtacctgcc

SEQ ID NO: 975219 - DNA, 22 bp, Artificial Sequence
  chemically synthesized
tgcctcatggtaattgtacctg

SEQ ID NO: 975220 - DNA, 22 bp, Artificial Sequence
  chemically synthesized
cctctgcctcatggtaattgta

SEQ ID NO: 975221 - DNA, 22 bp, Artificial Sequence
  chemically synthesized
ccctctgcctcatggtaattgt

SEQ ID NO: 975222 - DNA, 22 bp, Artificial Sequence
  chemically synthesized
gcaggtacaattaccatgaggc

SEQ ID NO: 975223 - DNA, 22 bp, Artificial Sequence
  chemically synthesized
agaaacatttccctctgcctca

SEQ ID NO: 975224 - DNA, 22 bp, Artificial Sequence
  chemically synthesized
ggtcctaagaaacatttccctc

SEQ ID NO: 975225 - DNA, 22 bp, Artificial Sequence
  chemically synthesized
ccatgaggcagagggaaatgtt

SEQ ID NO: 975226 - DNA, 22 bp, Artificial Sequence
  chemically synthesized
cctgggtcctaagaaacatttc

SEQ ID NO: 975227 - DNA, 22 bp, Artificial Sequence
  chemically synthesized
gcctgggtcctaagaaacattt

SEQ ID NO: 975228 - DNA, 22 bp, Artificial Sequence
  chemically synthesized
tgcctgggtcctaagaaacatt

SEQ ID NO: 975229 - DNA, 22 bp, Artificial Sequence
  chemically synthesized
cttaggacccaggcaaaactga

SEQ ID NO: 975230 - DNA, 22 bp, Artificial Sequence
  chemically synthesized
ttaggacccaggcaaaactgat

SEQ ID NO: 975231 - DNA, 22 bp, Artificial Sequence
  chemically synthesized
aggacccaggcaaaactgattt

SEQ ID NO: 975232 - DNA, 22 bp, Artificial Sequence
  chemically synthesized
ggacccaggcaaaactgattta

SEQ ID NO: 975233 - DNA, 22 bp, Artificial Sequence
  chemically synthesized
gcacaaaggaaaataaatcagt

SEQ ID NO: 975234 - DNA, 22 bp, Artificial Sequence
  chemically synthesized
ggcacaaaggaaaataaatcag

SEQ ID NO: 975235 - DNA, 22 bp, Artificial Sequence
  chemically synthesized
atttattttcctttgtgccaaa

SEQ ID NO: 975236 - DNA, 22 bp, Artificial Sequence
  chemically synthesized
attttcctttgtgccaaatctt

SEQ ID NO: 975237 - DNA, 22 bp, Artificial Sequence
  chemically synthesized
ttttcctttgtgccaaatctta

SEQ ID NO: 975238 - DNA, 22 bp, Artificial Sequence
  chemically synthesized
tcctttgtgccaaatcttacat

SEQ ID NO: 975239 - DNA, 22 bp, Artificial Sequence
  chemically synthesized
gtgtaaaagtacatgtaagatt

SEQ ID NO: 975240 - DNA, 22 bp, Artificial Sequence
  chemically synthesized
cctttgtgccaaatcttacatg

SEQ ID NO: 975241 - DNA, 22 bp, Artificial Sequence
  chemically synthesized
ggtgtaaaagtacatgtaagat

SEQ ID NO: 975242 - DNA, 22 bp, Artificial Sequence
  chemically synthesized
ctttgtgccaaatcttacatgt

SEQ ID NO: 975243 - DNA, 22 bp, Artificial Sequence
  chemically synthesized
tgtgccaaatcttacatgtact

SEQ ID NO: 975244 - DNA, 22 bp, Artificial Sequence
  chemically synthesized
acttggtgtaaaagtacatgta

SEQ ID NO: 975245 - DNA, 22 bp, Artificial Sequence
  chemically synthesized
gtgccaaatcttacatgtactt

SEQ ID NO: 975246 - DNA, 22 bp, Artificial Sequence
  chemically synthesized
tgccaaatcttacatgtacttt

SEQ ID NO: 975247 - DNA, 22 bp, Artificial Sequence
  chemically synthesized
agcaggttaacttggtgtaaaa

SEQ ID NO: 975248 - DNA, 22 bp, Artificial Sequence
  chemically synthesized
acatgtacttttacaccaagtt

SEQ ID NO: 975249 - DNA, 22 bp, Artificial Sequence
  chemically synthesized
cctaagcaggttaacttggtgt

SEQ ID NO: 975250 - DNA, 22 bp, Artificial Sequence
  chemically synthesized
catgtacttttacaccaagtta

SEQ ID NO: 975251 - DNA, 22 bp, Artificial Sequence
  chemically synthesized
gcctaagcaggttaacttggtg

SEQ ID NO: 975252 - DNA, 22 bp, Artificial Sequence
  chemically synthesized
tgcctaagcaggttaacttggt

SEQ ID NO: 975253 - DNA, 22 bp, Artificial Sequence
  chemically synthesized
cctttgcctaagcaggttaact

SEQ ID NO: 975254 - DNA, 22 bp, Artificial Sequence
  chemically synthesized
ctccctttgcctaagcaggtta

SEQ ID NO: 975255 - DNA, 22 bp, Artificial Sequence
  chemically synthesized
ttacaccaagttaacctgctta

SEQ ID NO: 975256 - DNA, 22 bp, Artificial Sequence
  chemically synthesized
tacaccaagttaacctgcttag

SEQ ID NO: 975257 - DNA, 22 bp, Artificial Sequence
  chemically synthesized
acaccaagttaacctgcttagg

SEQ ID NO: 975258 - DNA, 22 bp, Artificial Sequence
  chemically synthesized
caccaagttaacctgcttaggc

SEQ ID NO: 975259 - DNA, 22 bp, Artificial Sequence
  chemically synthesized
aaaaagatggctcctccctttg

SEQ ID NO: 975260 - DNA, 22 bp, Artificial Sequence
  chemically synthesized
acctgcttaggcaaagggagga

SEQ ID NO: 975261 - DNA, 22 bp, Artificial Sequence
  chemically synthesized
gaaaaagatggctcctcccttt

SEQ ID NO: 975262 - DNA, 22 bp, Artificial Sequence
  chemically synthesized
cttaggcaaagggaggagccat

SEQ ID NO: 975263 - DNA, 22 bp, Artificial Sequence
  chemically synthesized
aggcaaagggaggagccatctt

SEQ ID NO: 975264 - DNA, 22 bp, Artificial Sequence
  chemically synthesized
cagagcttgaaaaagatggctc

SEQ ID NO: 975265 - DNA, 22 bp, Artificial Sequence
  chemically synthesized
ggcaaagggaggagccatcttt

SEQ ID NO: 975266 - DNA, 22 bp, Artificial Sequence
  chemically synthesized
aaggatcattgcagagcttgaa

SEQ ID NO: 975267 - DNA, 22 bp, Artificial Sequence
  chemically synthesized
tcaaggatcattgcagagcttg

SEQ ID NO: 975268 - DNA, 22 bp, Artificial Sequence
  chemically synthesized
ctcaaggatcattgcagagctt

SEQ ID NO: 975269 - DNA, 22 bp, Artificial Sequence
  chemically synthesized
tctcaaggatcattgcagagct

SEQ ID NO: 975270 - DNA, 22 bp, Artificial Sequence
  chemically synthesized
ctttctcaaggatcattgcaga

SEQ ID NO: 975271 - DNA, 22 bp, Artificial Sequence
  chemically synthesized
tgctttctcaaggatcattgca

SEQ ID NO: 975272 - DNA, 22 bp, Artificial Sequence
  chemically synthesized
ctgctttctcaaggatcattgc

SEQ ID NO: 975273 - DNA, 22 bp, Artificial Sequence
  chemically synthesized
tttcaagctctgcaatgatcct

SEQ ID NO: 975274 - DNA, 22 bp, Artificial Sequence
  chemically synthesized
tctgctttctcaaggatcattg

SEQ ID NO: 975275 - DNA, 22 bp, Artificial Sequence
  chemically synthesized
ttcaagctctgcaatgatcctt

SEQ ID NO: 975276 - DNA, 22 bp, Artificial Sequence
  chemically synthesized
ttctgctttctcaaggatcatt

SEQ ID NO: 975277 - DNA, 22 bp, Artificial Sequence
  chemically synthesized
tcaagctctgcaatgatccttg

SEQ ID NO: 975278 - DNA, 22 bp, Artificial Sequence
  chemically synthesized
caagctctgcaatgatccttga

SEQ ID NO: 975279 - DNA, 22 bp, Artificial Sequence
  chemically synthesized
aagctctgcaatgatccttgag

SEQ ID NO: 975280 - DNA, 22 bp, Artificial Sequence
  chemically synthesized
acttttctgctttctcaaggat

SEQ ID NO: 975281 - DNA, 22 bp, Artificial Sequence
  chemically synthesized
tgcaatgatccttgagaaagca

SEQ ID NO: 975282 - DNA, 22 bp, Artificial Sequence
  chemically synthesized
caatgatccttgagaaagcaga

SEQ ID NO: 975283 - DNA, 22 bp, Artificial Sequence
  chemically synthesized
gatcccattgacttttctgctt

SEQ ID NO: 975284 - DNA, 22 bp, Artificial Sequence
  chemically synthesized
gagaaagcagaaaagtcaatgg

SEQ ID NO: 975285 - DNA, 22 bp, Artificial Sequence
  chemically synthesized
agaaagcagaaaagtcaatggg

SEQ ID NO: 975286 - DNA, 22 bp, Artificial Sequence
  chemically synthesized
acaccataaaaatattagatcc

SEQ ID NO: 975287 - DNA, 22 bp, Artificial Sequence
  chemically synthesized
atatttttatggtgtgagttcc

SEQ ID NO: 975288 - DNA, 22 bp, Artificial Sequence
  chemically synthesized
ttatggtgtgagttccatctgg

SEQ ID NO: 975289 - DNA, 22 bp, Artificial Sequence
  chemically synthesized
tatggtgtgagttccatctggg

SEQ ID NO: 975290 - DNA, 22 bp, Artificial Sequence
  chemically synthesized
atggtgtgagttccatctgggg

SEQ ID NO: 975291 - DNA, 22 bp, Artificial Sequence
  chemically synthesized
tggtgtgagttccatctgggga

SEQ ID NO: 975292 - DNA, 22 bp, Artificial Sequence
  chemically synthesized
aaccccatacaaatgtccccag

SEQ ID NO: 975293 - DNA, 22 bp, Artificial Sequence
  chemically synthesized
caaccccatacaaatgtcccca

SEQ ID NO: 975294 - DNA, 22 bp, Artificial Sequence
  chemically synthesized
ttcaaccccatacaaatgtccc

SEQ ID NO: 975295 - DNA, 22 bp, Artificial Sequence
  chemically synthesized
ctcttcaaccccatacaaatgt

SEQ ID NO: 975296 - DNA, 22 bp, Artificial Sequence
  chemically synthesized
catctggggacatttgtatggg

SEQ ID NO: 975297 - DNA, 22 bp, Artificial Sequence
  chemically synthesized
gggacatttgtatggggttgaa

SEQ ID NO: 975298 - DNA, 22 bp, Artificial Sequence
  chemically synthesized
atcaaatgcattcctcttcaac

SEQ ID NO: 975299 - DNA, 22 bp, Artificial Sequence
  chemically synthesized
cctcatcaaatgcattcctctt

SEQ ID NO: 975300 - DNA, 22 bp, Artificial Sequence
  chemically synthesized
gtatggggttgaagaggaatgc

SEQ ID NO: 975301 - DNA, 22 bp, Artificial Sequence
  chemically synthesized
tatggggttgaagaggaatgca

SEQ ID NO: 975302 - DNA, 22 bp, Artificial Sequence
  chemically synthesized
aagaggaatgcatttgatgagg

SEQ ID NO: 975303 - DNA, 22 bp, Artificial Sequence
  chemically synthesized
agatcaaacagtcactgcctca

SEQ ID NO: 975304 - DNA, 22 bp, Artificial Sequence
  chemically synthesized
gatgaggcagtgactgtttgat

SEQ ID NO: 975305 - DNA, 22 bp, Artificial Sequence
  chemically synthesized
atgaggcagtgactgtttgatc

SEQ ID NO: 975306 - DNA, 22 bp, Artificial Sequence
  chemically synthesized
aggaacgtggtacctaagatca

SEQ ID NO: 975307 - DNA, 22 bp, Artificial Sequence
  chemically synthesized
tttgatcttaggtaccacgttc

SEQ ID NO: 975308 - DNA, 22 bp, Artificial Sequence
  chemically synthesized
ccacatactgaggaacgtggta

SEQ ID NO: 975309 - DNA, 22 bp, Artificial Sequence
  chemically synthesized
gatcttaggtaccacgttcctc

SEQ ID NO: 975310 - DNA, 22 bp, Artificial Sequence
  chemically synthesized
atcttaggtaccacgttcctca

SEQ ID NO: 975311 - DNA, 22 bp, Artificial Sequence
  chemically synthesized
cactcccacatactgaggaacg

SEQ ID NO: 975312 - DNA, 22 bp, Artificial Sequence
  chemically synthesized
acactcccacatactgaggaac

SEQ ID NO: 975313 - DNA, 22 bp, Artificial Sequence
  chemically synthesized
tacactcccacatactgaggaa

SEQ ID NO: 975314 - DNA, 22 bp, Artificial Sequence
  chemically synthesized
aggtaccacgttcctcagtatg

SEQ ID NO: 975315 - DNA, 22 bp, Artificial Sequence
  chemically synthesized
ggtaccacgttcctcagtatgt

SEQ ID NO: 975316 - DNA, 22 bp, Artificial Sequence
  chemically synthesized
atgaagctttacactcccacat

SEQ ID NO: 975317 - DNA, 22 bp, Artificial Sequence
  chemically synthesized
ttcatgaagctttacactccca

SEQ ID NO: 975318 - DNA, 22 bp, Artificial Sequence
  chemically synthesized
gttcatgaagctttacactccc

SEQ ID NO: 975319 - DNA, 22 bp, Artificial Sequence
  chemically synthesized
ctcagtatgtgggagtgtaaag

SEQ ID NO: 975320 - DNA, 22 bp, Artificial Sequence
  chemically synthesized
agtatgtgggagtgtaaagctt

SEQ ID NO: 975321 - DNA, 22 bp, Artificial Sequence
  chemically synthesized
aaaataatttgttcatgaagct

SEQ ID NO: 975322 - DNA, 22 bp, Artificial Sequence
  chemically synthesized
aactaaaaataatttgttcatg

SEQ ID NO: 975323 - DNA, 22 bp, Artificial Sequence
  chemically synthesized
gctcaactaaaaataatttgtt

SEQ ID NO: 975324 - DNA, 22 bp, Artificial Sequence
  chemically synthesized
agctcaactaaaaataatttgt

SEQ ID NO: 975325 - DNA, 22 bp, Artificial Sequence
  chemically synthesized
catgaacaaattatttttagtt

SEQ ID NO: 975326 - DNA, 22 bp, Artificial Sequence
  chemically synthesized
atgaacaaattatttttagttg

SEQ ID NO: 975327 - DNA, 22 bp, Artificial Sequence
  chemically synthesized
atagccatttagctcaactaaa

SEQ ID NO: 975328 - DNA, 22 bp, Artificial Sequence
  chemically synthesized
tttttagttgagctaaatggct

SEQ ID NO: 975329 - DNA, 22 bp, Artificial Sequence
  chemically synthesized
atgatcaactcatagccattta

SEQ ID NO: 975330 - DNA, 22 bp, Artificial Sequence
  chemically synthesized
ttagttgagctaaatggctatg

SEQ ID NO: 975331 - DNA, 22 bp, Artificial Sequence
  chemically synthesized
tagttgagctaaatggctatga

SEQ ID NO: 975332 - DNA, 22 bp, Artificial Sequence
  chemically synthesized
agttgagctaaatggctatgag

SEQ ID NO: 975333 - DNA, 22 bp, Artificial Sequence
  chemically synthesized
gttgagctaaatggctatgagt

SEQ ID NO: 975334 - DNA, 22 bp, Artificial Sequence
  chemically synthesized
atcattaatgatcaactcatag

SEQ ID NO: 975335 - DNA, 22 bp, Artificial Sequence
  chemically synthesized
agctaaatggctatgagttgat

SEQ ID NO: 975336 - DNA, 22 bp, Artificial Sequence
  chemically synthesized
ctaatcattaatgatcaactca

SEQ ID NO: 975337 - DNA, 22 bp, Artificial Sequence
  chemically synthesized
cctaatcattaatgatcaactc

SEQ ID NO: 975338 - DNA, 22 bp, Artificial Sequence
  chemically synthesized
tcctaatcattaatgatcaact

SEQ ID NO: 975339 - DNA, 22 bp, Artificial Sequence
  chemically synthesized
ttcctaatcattaatgatcaac

SEQ ID NO: 975340 - DNA, 22 bp, Artificial Sequence
  chemically synthesized
aatggctatgagttgatcatta

SEQ ID NO: 975341 - DNA, 22 bp, Artificial Sequence
  chemically synthesized
tttcctaatcattaatgatcaa

SEQ ID NO: 975342 - DNA, 22 bp, Artificial Sequence
  chemically synthesized
tttttcctaatcattaatgatc

SEQ ID NO: 975343 - DNA, 22 bp, Artificial Sequence
  chemically synthesized
gctctttttcctaatcattaat

SEQ ID NO: 975344 - DNA, 22 bp, Artificial Sequence
  chemically synthesized
tgagttgatcattaatgattag

SEQ ID NO: 975345 - DNA, 22 bp, Artificial Sequence
  chemically synthesized
catcctggctctttttcctaat

SEQ ID NO: 975346 - DNA, 22 bp, Artificial Sequence
  chemically synthesized
atcattaatgattaggaaaaag

SEQ ID NO: 975347 - DNA, 22 bp, Artificial Sequence
  chemically synthesized
atgattaggaaaaagagccagg

SEQ ID NO: 975348 - DNA, 22 bp, Artificial Sequence
  chemically synthesized
ggaaaaagagccaggatggagg

SEQ ID NO: 975349 - DNA, 22 bp, Artificial Sequence
  chemically synthesized
aaggccaagagcgtaatcctcc

SEQ ID NO: 975350 - DNA, 22 bp, Artificial Sequence
  chemically synthesized
caaggccaagagcgtaatcctc

SEQ ID NO: 975351 - DNA, 22 bp, Artificial Sequence
  chemically synthesized
gagatcttcaaggccaagagcg

SEQ ID NO: 975352 - DNA, 22 bp, Artificial Sequence
  chemically synthesized
agagatcttcaaggccaagagc

SEQ ID NO: 975353 - DNA, 22 bp, Artificial Sequence
  chemically synthesized
ccttagagatcttcaaggccaa

SEQ ID NO: 975354 - DNA, 22 bp, Artificial Sequence
  chemically synthesized
ctgccttagagatcttcaaggc

SEQ ID NO: 975355 - DNA, 22 bp, Artificial Sequence
  chemically synthesized
tactgccttagagatcttcaag

SEQ ID NO: 975356 - DNA, 22 bp, Artificial Sequence
  chemically synthesized
ctactgccttagagatcttcaa

SEQ ID NO: 975357 - DNA, 22 bp, Artificial Sequence
  chemically synthesized
cgctcttggccttgaagatctc

SEQ ID NO: 975358 - DNA, 22 bp, Artificial Sequence
  chemically synthesized
tctactgccttagagatcttca

SEQ ID NO: 975359 - DNA, 22 bp, Artificial Sequence
  chemically synthesized
tttctactgccttagagatctt

SEQ ID NO: 975360 - DNA, 22 bp, Artificial Sequence
  chemically synthesized
ttggccttgaagatctctaagg

SEQ ID NO: 975361 - DNA, 22 bp, Artificial Sequence
  chemically synthesized
ctctttctactgccttagagat

SEQ ID NO: 975362 - DNA, 22 bp, Artificial Sequence
  chemically synthesized
ggccttgaagatctctaaggca

SEQ ID NO: 975363 - DNA, 22 bp, Artificial Sequence
  chemically synthesized
gccttgaagatctctaaggcag

SEQ ID NO: 975364 - DNA, 22 bp, Artificial Sequence
  chemically synthesized
ttactctttctactgccttaga

SEQ ID NO: 975365 - DNA, 22 bp, Artificial Sequence
  chemically synthesized
attactctttctactgccttag

SEQ ID NO: 975366 - DNA, 22 bp, Artificial Sequence
  chemically synthesized
cttattactctttctactgcct

SEQ ID NO: 975367 - DNA, 22 bp, Artificial Sequence
  chemically synthesized
gaagatctctaaggcagtagaa

SEQ ID NO: 975368 - DNA, 22 bp, Artificial Sequence
  chemically synthesized
aagatctctaaggcagtagaaa

SEQ ID NO: 975369 - DNA, 22 bp, Artificial Sequence
  chemically synthesized
atatactccttattactctttc

SEQ ID NO: 975370 - DNA, 22 bp, Artificial Sequence
  chemically synthesized
taaggcagtagaaagagtaata

SEQ ID NO: 975371 - DNA, 22 bp, Artificial Sequence
  chemically synthesized
aggcagtagaaagagtaataag

SEQ ID NO: 975372 - DNA, 22 bp, Artificial Sequence
  chemically synthesized
aggaaccctaatatactcctta

SEQ ID NO: 975373 - DNA, 22 bp, Artificial Sequence
  chemically synthesized
taaggaaccctaatatactcct

SEQ ID NO: 975374 - DNA, 22 bp, Artificial Sequence
  chemically synthesized
tctaaggaaccctaatatactc

SEQ ID NO: 975375 - DNA, 22 bp, Artificial Sequence
  chemically synthesized
ctctaaggaaccctaatatact

SEQ ID NO: 975376 - DNA, 22 bp, Artificial Sequence
  chemically synthesized
tttctctaaggaaccctaatat

SEQ ID NO: 975377 - DNA, 22 bp, Artificial Sequence
  chemically synthesized
gtttctctaaggaaccctaata

SEQ ID NO: 975378 - DNA, 22 bp, Artificial Sequence
  chemically synthesized
tgtttctctaaggaaccctaat

SEQ ID NO: 975379 - DNA, 22 bp, Artificial Sequence
  chemically synthesized
ttgtttctctaaggaaccctaa

SEQ ID NO: 975380 - DNA, 22 bp, Artificial Sequence
  chemically synthesized
cttttgtttctctaaggaaccc

SEQ ID NO: 975381 - DNA, 22 bp, Artificial Sequence
  chemically synthesized
ttccttttgtttctctaaggaa

SEQ ID NO: 975382 - DNA, 22 bp, Artificial Sequence
  chemically synthesized
attccttttgtttctctaagga

SEQ ID NO: 975383 - DNA, 22 bp, Artificial Sequence
  chemically synthesized
ttattccttttgtttctctaag

SEQ ID NO: 975384 - DNA, 22 bp, Artificial Sequence
  chemically synthesized
tcttattccttttgtttctcta

SEQ ID NO: 975385 - DNA, 22 bp, Artificial Sequence
  chemically synthesized
gggttccttagagaaacaaaag

SEQ ID NO: 975386 - DNA, 22 bp, Artificial Sequence
  chemically synthesized
cttagagaaacaaaaggaataa

SEQ ID NO: 975387 - DNA, 22 bp, Artificial Sequence
  chemically synthesized
agagaaacaaaaggaataagag

SEQ ID NO: 975388 - DNA, 22 bp, Artificial Sequence
  chemically synthesized
gagaaacaaaaggaataagaga

SEQ ID NO: 975389 - DNA, 22 bp, Artificial Sequence
  chemically synthesized
tatatgtgtgtgtatacatatt

SEQ ID NO: 975390 - DNA, 22 bp, Artificial Sequence
  chemically synthesized
tatgtgtgtgtgtgtgtgtgtg

SEQ ID NO: 975391 - DNA, 22 bp, Artificial Sequence
  chemically synthesized
ccacatacaaacacacacagag

SEQ ID NO: 975392 - DNA, 22 bp, Artificial Sequence
  chemically synthesized
accacatacaaacacacacaga

SEQ ID NO: 975393 - DNA, 22 bp, Artificial Sequence
  chemically synthesized
ttaccacatacaaacacacaca

SEQ ID NO: 975394 - DNA, 22 bp, Artificial Sequence
  chemically synthesized
cttaccacatacaaacacacac

SEQ ID NO: 975395 - DNA, 22 bp, Artificial Sequence
  chemically synthesized
tgtgtgtgtttgtatgtggtaa

SEQ ID NO: 975396 - DNA, 22 bp, Artificial Sequence
  chemically synthesized
tgtgtgtttgtatgtggtaaga

SEQ ID NO: 975397 - DNA, 22 bp, Artificial Sequence
  chemically synthesized
catgagccaatttcttaccaca

SEQ ID NO: 975398 - DNA, 22 bp, Artificial Sequence
  chemically synthesized
cataattgcatgagccaatttc

SEQ ID NO: 975399 - DNA, 22 bp, Artificial Sequence
  chemically synthesized
gtatgtggtaagaaattggctc

SEQ ID NO: 975400 - DNA, 22 bp, Artificial Sequence
  chemically synthesized
tatgtggtaagaaattggctca

SEQ ID NO: 975401 - DNA, 22 bp, Artificial Sequence
  chemically synthesized
cctccataattgcatgagccaa

SEQ ID NO: 975402 - DNA, 22 bp, Artificial Sequence
  chemically synthesized
catagttgcctccataattgca

SEQ ID NO: 975403 - DNA, 22 bp, Artificial Sequence
  chemically synthesized
gctcatgcaattatggaggcaa

SEQ ID NO: 975404 - DNA, 22 bp, Artificial Sequence
  chemically synthesized
tcagtctccatagttgcctcca

SEQ ID NO: 975405 - DNA, 22 bp, Artificial Sequence
  chemically synthesized
atgcaattatggaggcaactat

SEQ ID NO: 975406 - DNA, 22 bp, Artificial Sequence
  chemically synthesized
ggagttgtcagtctccatagtt

SEQ ID NO: 975407 - DNA, 22 bp, Artificial Sequence
  chemically synthesized
gggagttgtcagtctccatagt

SEQ ID NO: 975408 - DNA, 22 bp, Artificial Sequence
  chemically synthesized
tggaggcaactatggagactga

SEQ ID NO: 975409 - DNA, 22 bp, Artificial Sequence
  chemically synthesized
tataccttgggagttgtcagtc

SEQ ID NO: 975410 - DNA, 22 bp, Artificial Sequence
  chemically synthesized
accctgtataccttgggagttg

SEQ ID NO: 975411 - DNA, 22 bp, Artificial Sequence
  chemically synthesized
tggagactgacaactcccaagg

SEQ ID NO: 975412 - DNA, 22 bp, Artificial Sequence
  chemically synthesized
ttcaccctgtataccttgggag

SEQ ID NO: 975413 - DNA, 22 bp, Artificial Sequence
  chemically synthesized
gttcaccctgtataccttggga

SEQ ID NO: 975414 - DNA, 22 bp, Artificial Sequence
  chemically synthesized
cttgttcaccctgtataccttg

SEQ ID NO: 975415 - DNA, 22 bp, Artificial Sequence
  chemically synthesized
gcttgttcaccctgtatacctt

SEQ ID NO: 975416 - DNA, 22 bp, Artificial Sequence
  chemically synthesized
acaactcccaaggtatacaggg

SEQ ID NO: 975417 - DNA, 22 bp, Artificial Sequence
  chemically synthesized
cagcttgcttgttcaccctgta

SEQ ID NO: 975418 - DNA, 22 bp, Artificial Sequence
  chemically synthesized
ccaaggtatacagggtgaacaa

SEQ ID NO: 975419 - DNA, 22 bp, Artificial Sequence
  chemically synthesized
gggtctccagcttgcttgttca

SEQ ID NO: 975420 - DNA, 22 bp, Artificial Sequence
  chemically synthesized
tcgggtctccagcttgcttgtt

SEQ ID NO: 975421 - DNA, 22 bp, Artificial Sequence
  chemically synthesized
tctcgggtctccagcttgcttg

SEQ ID NO: 975422 - DNA, 22 bp, Artificial Sequence
  chemically synthesized
tcagctctctcgggtctccagc

SEQ ID NO: 975423 - DNA, 22 bp, Artificial Sequence
  chemically synthesized
cactatcagctctctcgggtct

SEQ ID NO: 975424 - DNA, 22 bp, Artificial Sequence
  chemically synthesized
gaactacactatcagctctctc

SEQ ID NO: 975425 - DNA, 22 bp, Artificial Sequence
  chemically synthesized
gagacccgagagagctgatagt

SEQ ID NO: 975426 - DNA, 22 bp, Artificial Sequence
  chemically synthesized
gattggaactacactatcagct

SEQ ID NO: 975427 - DNA, 22 bp, Artificial Sequence
  chemically synthesized
cgattggaactacactatcagc

SEQ ID NO: 975428 - DNA, 22 bp, Artificial Sequence
  chemically synthesized
cttcgattggaactacactatc

SEQ ID NO: 975429 - DNA, 22 bp, Artificial Sequence
  chemically synthesized
tacttcgattggaactacacta

SEQ ID NO: 975430 - DNA, 22 bp, Artificial Sequence
  chemically synthesized
ctctacttcgattggaactaca

SEQ ID NO: 975431 - DNA, 22 bp, Artificial Sequence
  chemically synthesized
aagtctgctctacttcgattgg

SEQ ID NO: 975432 - DNA, 22 bp, Artificial Sequence
  chemically synthesized
atagtgtagttccaatcgaagt

SEQ ID NO: 975433 - DNA, 22 bp, Artificial Sequence
  chemically synthesized
tatctcaagtctgctctacttc

SEQ ID NO: 975434 - DNA, 22 bp, Artificial Sequence
  chemically synthesized
gtatctcaagtctgctctactt

SEQ ID NO: 975435 - DNA, 22 bp, Artificial Sequence
  chemically synthesized
ttgtatctcaagtctgctctac

SEQ ID NO: 975436 - DNA, 22 bp, Artificial Sequence
  chemically synthesized
ttcttgtatctcaagtctgctc

SEQ ID NO: 975437 - DNA, 22 bp, Artificial Sequence
  chemically synthesized
caatcgaagtagagcagacttg

SEQ ID NO: 975438 - DNA, 22 bp, Artificial Sequence
  chemically synthesized
gctgttcttgtatctcaagtct

SEQ ID NO: 975439 - DNA, 22 bp, Artificial Sequence
  chemically synthesized
accacaatattagctgttcttg

SEQ ID NO: 975440 - DNA, 22 bp, Artificial Sequence
  chemically synthesized
aaccacaatattagctgttctt

SEQ ID NO: 975441 - DNA, 22 bp, Artificial Sequence
  chemically synthesized
taaccacaatattagctgttct

SEQ ID NO: 975442 - DNA, 22 bp, Artificial Sequence
  chemically synthesized
gagatacaagaacagctaatat

SEQ ID NO: 975443 - DNA, 22 bp, Artificial Sequence
  chemically synthesized
agatacaagaacagctaatatt

SEQ ID NO: 975444 - DNA, 22 bp, Artificial Sequence
  chemically synthesized
agactttaaccacaatattagc

SEQ ID NO: 975445 - DNA, 22 bp, Artificial Sequence
  chemically synthesized
cagactttaaccacaatattag

SEQ ID NO: 975446 - DNA, 22 bp, Artificial Sequence
  chemically synthesized
ccttcagactttaaccacaata

SEQ ID NO: 975447 - DNA, 22 bp, Artificial Sequence
  chemically synthesized
ctgccttcagactttaaccaca

SEQ ID NO: 975448 - DNA, 22 bp, Artificial Sequence
  chemically synthesized
cctgccttcagactttaaccac

SEQ ID NO: 975449 - DNA, 22 bp, Artificial Sequence
  chemically synthesized
tcctgccttcagactttaacca

SEQ ID NO: 975450 - DNA, 22 bp, Artificial Sequence
  chemically synthesized
ttcctgccttcagactttaacc

SEQ ID NO: 975451 - DNA, 22 bp, Artificial Sequence
  chemically synthesized
tttcctgccttcagactttaac

SEQ ID NO: 975452 - DNA, 22 bp, Artificial Sequence
  chemically synthesized
atattgtggttaaagtctgaag

SEQ ID NO: 975453 - DNA, 22 bp, Artificial Sequence
  chemically synthesized
tggttaaagtctgaaggcagga

SEQ ID NO: 975454 - DNA, 22 bp, Artificial Sequence
  chemically synthesized
ggacatgggctttttcctgcct

SEQ ID NO: 975455 - DNA, 22 bp, Artificial Sequence
  chemically synthesized
aagtctgaaggcaggaaaaagc

SEQ ID NO: 975456 - DNA, 22 bp, Artificial Sequence
  chemically synthesized
aaactgggacatgggctttttc

SEQ ID NO: 975457 - DNA, 22 bp, Artificial Sequence
  chemically synthesized
caaactgggacatgggcttttt

SEQ ID NO: 975458 - DNA, 22 bp, Artificial Sequence
  chemically synthesized
aaggcaggaaaaagcccatgtc

SEQ ID NO: 975459 - DNA, 22 bp, Artificial Sequence
  chemically synthesized
ccttcaaactgggacatgggct

SEQ ID NO: 975460 - DNA, 22 bp, Artificial Sequence
  chemically synthesized
cccgactgccttcaaactggga

SEQ ID NO: 975461 - DNA, 22 bp, Artificial Sequence
  chemically synthesized
tgcccgactgccttcaaactgg

SEQ ID NO: 975462 - DNA, 22 bp, Artificial Sequence
  chemically synthesized
agcaaaagggaatcgttctgcc

SEQ ID NO: 975463 - DNA, 22 bp, Artificial Sequence
  chemically synthesized
gaaggcagtcgggcagaacgat

SEQ ID NO: 975464 - DNA, 22 bp, Artificial Sequence
  chemically synthesized
aaggcagtcgggcagaacgatt

SEQ ID NO: 975465 - DNA, 22 bp, Artificial Sequence
  chemically synthesized
ccctgagcaaaagggaatcgtt

SEQ ID NO: 975466 - DNA, 22 bp, Artificial Sequence
  chemically synthesized
accctcccctgagcaaaaggga

SEQ ID NO: 975467 - DNA, 22 bp, Artificial Sequence
  chemically synthesized
ccttttgctcaggggagggtca

SEQ ID NO: 975468 - DNA, 22 bp, Artificial Sequence
  chemically synthesized
ttgctcaggggagggtcagtgt

SEQ ID NO: 975469 - DNA, 22 bp, Artificial Sequence
  chemically synthesized
aatagaagaaaaacactgaccc

SEQ ID NO: 975470 - DNA, 22 bp, Artificial Sequence
  chemically synthesized
tgctcaggggagggtcagtgtt

SEQ ID NO: 975471 - DNA, 22 bp, Artificial Sequence
  chemically synthesized
gctcaggggagggtcagtgttt

SEQ ID NO: 975472 - DNA, 22 bp, Artificial Sequence
  chemically synthesized
ctcaggggagggtcagtgtttt

SEQ ID NO: 975473 - DNA, 22 bp, Artificial Sequence
  chemically synthesized
aggggagggtcagtgtttttct

SEQ ID NO: 975474 - DNA, 22 bp, Artificial Sequence
  chemically synthesized
aaggcctgaatagaagaaaaac

SEQ ID NO: 975475 - DNA, 22 bp, Artificial Sequence
  chemically synthesized
attaaaggcctgaatagaagaa

SEQ ID NO: 975476 - DNA, 22 bp, Artificial Sequence
  chemically synthesized
atgtaattaattaaaggcctga

SEQ ID NO: 975477 - DNA, 22 bp, Artificial Sequence
  chemically synthesized
catgtaattaattaaaggcctg

SEQ ID NO: 975478 - DNA, 22 bp, Artificial Sequence
  chemically synthesized
ttcttctattcaggcctttaat

SEQ ID NO: 975479 - DNA, 22 bp, Artificial Sequence
  chemically synthesized
tcttctattcaggcctttaatt

SEQ ID NO: 975480 - DNA, 22 bp, Artificial Sequence
  chemically synthesized
cttctattcaggcctttaatta

SEQ ID NO: 975481 - DNA, 22 bp, Artificial Sequence
  chemically synthesized
ttctattcaggcctttaattaa

SEQ ID NO: 975482 - DNA, 22 bp, Artificial Sequence
  chemically synthesized
ctattcaggcctttaattaatt

SEQ ID NO: 975483 - DNA, 22 bp, Artificial Sequence
  chemically synthesized
tattcaggcctttaattaatta

SEQ ID NO: 975484 - DNA, 22 bp, Artificial Sequence
  chemically synthesized
ttcaggcctttaattaattaca

SEQ ID NO: 975485 - DNA, 22 bp, Artificial Sequence
  chemically synthesized
aggcctttaattaattacatga

SEQ ID NO: 975486 - DNA, 22 bp, Artificial Sequence
  chemically synthesized
atgtgagcagacttcatgtaat

SEQ ID NO: 975487 - DNA, 22 bp, Artificial Sequence
  chemically synthesized
ctaatgtgagcagacttcatgt

SEQ ID NO: 975488 - DNA, 22 bp, Artificial Sequence
  chemically synthesized
cctaatgtgagcagacttcatg

SEQ ID NO: 975489 - DNA, 22 bp, Artificial Sequence
  chemically synthesized
taattaattacatgaagtctgc

SEQ ID NO: 975490 - DNA, 22 bp, Artificial Sequence
  chemically synthesized
aattaattacatgaagtctgct

SEQ ID NO: 975491 - DNA, 22 bp, Artificial Sequence
  chemically synthesized
attaattacatgaagtctgctc

SEQ ID NO: 975492 - DNA, 22 bp, Artificial Sequence
  chemically synthesized
cccttcctaatgtgagcagact

SEQ ID NO: 975493 - DNA, 22 bp, Artificial Sequence
  chemically synthesized
attacatgaagtctgctcacat

SEQ ID NO: 975494 - DNA, 22 bp, Artificial Sequence
  chemically synthesized
catgaagtctgctcacattagg

SEQ ID NO: 975495 - DNA, 22 bp, Artificial Sequence
  chemically synthesized
agtaaagtagattgcccttcct

SEQ ID NO: 975496 - DNA, 22 bp, Artificial Sequence
  chemically synthesized
ctcacattaggaagggcaatct

SEQ ID NO: 975497 - DNA, 22 bp, Artificial Sequence
  chemically synthesized
acattaggaagggcaatctact

SEQ ID NO: 975498 - DNA, 22 bp, Artificial Sequence
  chemically synthesized
gtagactgagtaaagtagattg

SEQ ID NO: 975499 - DNA, 22 bp, Artificial Sequence
  chemically synthesized
ggaagggcaatctactttactc

SEQ ID NO: 975500 - DNA, 22 bp, Artificial Sequence
  chemically synthesized
aattggtagactgagtaaagta

SEQ ID NO: 975501 - DNA, 22 bp, Artificial Sequence
  chemically synthesized
aaattggtagactgagtaaagt

SEQ ID NO: 975502 - DNA, 22 bp, Artificial Sequence
  chemically synthesized
acatttaaattggtagactgag

SEQ ID NO: 975503 - DNA, 22 bp, Artificial Sequence
  chemically synthesized
ctttactcagtctaccaattta

SEQ ID NO: 975504 - DNA, 22 bp, Artificial Sequence
  chemically synthesized
tactcagtctaccaatttaaat

SEQ ID NO: 975505 - DNA, 22 bp, Artificial Sequence
  chemically synthesized
actcagtctaccaatttaaatg

SEQ ID NO: 975506 - DNA, 22 bp, Artificial Sequence
  chemically synthesized
ctcagtctaccaatttaaatgt

SEQ ID NO: 975507 - DNA, 22 bp, Artificial Sequence
  chemically synthesized
tcagatgagattaacatttaaa

SEQ ID NO: 975508 - DNA, 22 bp, Artificial Sequence
  chemically synthesized
agtctaccaatttaaatgttaa

SEQ ID NO: 975509 - DNA, 22 bp, Artificial Sequence
  chemically synthesized
ccaatttaaatgttaatctcat

SEQ ID NO: 975510 - DNA, 22 bp, Artificial Sequence
  chemically synthesized
tgcaagtgttatcagatgagat

SEQ ID NO: 975511 - DNA, 22 bp, Artificial Sequence
  chemically synthesized
tgtgcaagtgttatcagatgag

SEQ ID NO: 975512 - DNA, 22 bp, Artificial Sequence
  chemically synthesized
aaatgttaatctcatctgataa

SEQ ID NO: 975513 - DNA, 22 bp, Artificial Sequence
  chemically synthesized
aatgttaatctcatctgataac

SEQ ID NO: 975514 - DNA, 22 bp, Artificial Sequence
  chemically synthesized
ggtgattctgtgcaagtgttat

SEQ ID NO: 975515 - DNA, 22 bp, Artificial Sequence
  chemically synthesized
atctcatctgataacacttgca

SEQ ID NO: 975516 - DNA, 22 bp, Artificial Sequence
  chemically synthesized
tgggtgattctgtgcaagtgtt

SEQ ID NO: 975517 - DNA, 22 bp, Artificial Sequence
  chemically synthesized
ttctgggtgattctgtgcaagt

SEQ ID NO: 975518 - DNA, 22 bp, Artificial Sequence
  chemically synthesized
atctgataacacttgcacagaa

SEQ ID NO: 975519 - DNA, 22 bp, Artificial Sequence
  chemically synthesized
ataacacttgcacagaatcacc

SEQ ID NO: 975520 - DNA, 22 bp, Artificial Sequence
  chemically synthesized
gtcaaacattattctgggtgat

SEQ ID NO: 975521 - DNA, 22 bp, Artificial Sequence
  chemically synthesized
ggtcaaacattattctgggtga

SEQ ID NO: 975522 - DNA, 22 bp, Artificial Sequence
  chemically synthesized
gcacagaatcacccagaataat

SEQ ID NO: 975523 - DNA, 22 bp, Artificial Sequence
  chemically synthesized
cacagaatcacccagaataatg

SEQ ID NO: 975524 - DNA, 22 bp, Artificial Sequence
  chemically synthesized
caaggtgcccagatatttggtc

SEQ ID NO: 975525 - DNA, 22 bp, Artificial Sequence
  chemically synthesized
ggctacaaggtgcccagatatt

SEQ ID NO: 975526 - DNA, 22 bp, Artificial Sequence
  chemically synthesized
actgggctacaaggtgcccaga

SEQ ID NO: 975527 - DNA, 22 bp, Artificial Sequence
  chemically synthesized
gactgggctacaaggtgcccag

SEQ ID NO: 975528 - DNA, 22 bp, Artificial Sequence
  chemically synthesized
gaccaaatatctgggcaccttg

SEQ ID NO: 975529 - DNA, 22 bp, Artificial Sequence
  chemically synthesized
accaaatatctgggcaccttgt

SEQ ID NO: 975530 - DNA, 22 bp, Artificial Sequence
  chemically synthesized
tgcatcaacttgactgggctac

SEQ ID NO: 975531 - DNA, 22 bp, Artificial Sequence
  chemically synthesized
gtgcatcaacttgactgggcta

SEQ ID NO: 975532 - DNA, 22 bp, Artificial Sequence
  chemically synthesized
tgtgcatcaacttgactgggct

SEQ ID NO: 975533 - DNA, 22 bp, Artificial Sequence
  chemically synthesized
ggcaccttgtagcccagtcaag

SEQ ID NO: 975534 - DNA, 22 bp, Artificial Sequence
  chemically synthesized
attttgtgcatcaacttgactg

SEQ ID NO: 975535 - DNA, 22 bp, Artificial Sequence
  chemically synthesized
gtagcccagtcaagttgatgca

SEQ ID NO: 975536 - DNA, 22 bp, Artificial Sequence
  chemically synthesized
tagcccagtcaagttgatgcac

SEQ ID NO: 975537 - DNA, 22 bp, Artificial Sequence
  chemically synthesized
cccgtaatggttaattttgtgc

SEQ ID NO: 975538 - DNA, 22 bp, Artificial Sequence
  chemically synthesized
tcaacactgcccgtaatggtta

SEQ ID NO: 975539 - DNA, 22 bp, Artificial Sequence
  chemically synthesized
atgcacaaaattaaccattacg

SEQ ID NO: 975540 - DNA, 22 bp, Artificial Sequence
  chemically synthesized
atctgtcaacactgcccgtaat

SEQ ID NO: 975541 - DNA, 22 bp, Artificial Sequence
  chemically synthesized
gatctgtcaacactgcccgtaa

SEQ ID NO: 975542 - DNA, 22 bp, Artificial Sequence
  chemically synthesized
tgatctgtcaacactgcccgta

SEQ ID NO: 975543 - DNA, 22 bp, Artificial Sequence
  chemically synthesized
ctttgatctgtcaacactgccc

SEQ ID NO: 975544 - DNA, 22 bp, Artificial Sequence
  chemically synthesized
accattacgggcagtgttgaca

SEQ ID NO: 975545 - DNA, 22 bp, Artificial Sequence
  chemically synthesized
ccactactttgatctgtcaaca

SEQ ID NO: 975546 - DNA, 22 bp, Artificial Sequence
  chemically synthesized
ttaccactactttgatctgtca

SEQ ID NO: 975547 - DNA, 22 bp, Artificial Sequence
  chemically synthesized
cgggcagtgttgacagatcaaa

SEQ ID NO: 975548 - DNA, 22 bp, Artificial Sequence
  chemically synthesized
ctgttaccactactttgatctg

SEQ ID NO: 975549 - DNA, 22 bp, Artificial Sequence
  chemically synthesized
cacctactgttaccactacttt

SEQ ID NO: 975550 - DNA, 22 bp, Artificial Sequence
  chemically synthesized
gcacctactgttaccactactt

SEQ ID NO: 975551 - DNA, 22 bp, Artificial Sequence
  chemically synthesized
tgcacctactgttaccactact

SEQ ID NO: 975552 - DNA, 22 bp, Artificial Sequence
  chemically synthesized
acagatcaaagtagtggtaaca

SEQ ID NO: 975553 - DNA, 22 bp, Artificial Sequence
  chemically synthesized
actttgcacctactgttaccac

SEQ ID NO: 975554 - DNA, 22 bp, Artificial Sequence
  chemically synthesized
ttcactttgcacctactgttac

SEQ ID NO: 975555 - DNA, 22 bp, Artificial Sequence
  chemically synthesized
ttgttcactttgcacctactgt

SEQ ID NO: 975556 - DNA, 22 bp, Artificial Sequence
  chemically synthesized
atgatactgttgttcactttgc

SEQ ID NO: 975557 - DNA, 22 bp, Artificial Sequence
  chemically synthesized
taatgatactgttgttcacttt

SEQ ID NO: 975558 - DNA, 22 bp, Artificial Sequence
  chemically synthesized
gacattctaatgatactgttgt

SEQ ID NO: 975559 - DNA, 22 bp, Artificial Sequence
  chemically synthesized
aaaaagtccctggacattctaa

SEQ ID NO: 975560 - DNA, 22 bp, Artificial Sequence
  chemically synthesized
gaattgaaaaagtccctggaca

SEQ ID NO: 975561 - DNA, 22 bp, Artificial Sequence
  chemically synthesized
tggaattgaaaaagtccctgga

SEQ ID NO: 975562 - DNA, 22 bp, Artificial Sequence
  chemically synthesized
ctggaattgaaaaagtccctgg

SEQ ID NO: 975563 - DNA, 22 bp, Artificial Sequence
  chemically synthesized
gaatgtccagggactttttcaa

SEQ ID NO: 975564 - DNA, 22 bp, Artificial Sequence
  chemically synthesized
tttcaattccagaaacatattg

SEQ ID NO: 975565 - DNA, 22 bp, Artificial Sequence
  chemically synthesized
ttcaattccagaaacatattga

SEQ ID NO: 975566 - DNA, 22 bp, Artificial Sequence
  chemically synthesized
tcaattccagaaacatattgac

SEQ ID NO: 975567 - DNA, 22 bp, Artificial Sequence
  chemically synthesized
caattccagaaacatattgact

SEQ ID NO: 975568 - DNA, 22 bp, Artificial Sequence
  chemically synthesized
aattccagaaacatattgactg

SEQ ID NO: 975569 - DNA, 22 bp, Artificial Sequence
  chemically synthesized
tggggcatcaaacccagtcaat

SEQ ID NO: 975570 - DNA, 22 bp, Artificial Sequence
  chemically synthesized
cagaaacatattgactgggttt

SEQ ID NO: 975571 - DNA, 22 bp, Artificial Sequence
  chemically synthesized
taaagttatggggcatcaaacc

SEQ ID NO: 975572 - DNA, 22 bp, Artificial Sequence
  chemically synthesized
gtaaagttatggggcatcaaac

SEQ ID NO: 975573 - DNA, 22 bp, Artificial Sequence
  chemically synthesized
cttgtaaagttatggggcatca

SEQ ID NO: 975574 - DNA, 22 bp, Artificial Sequence
  chemically synthesized
ttacttgtaaagttatggggca

SEQ ID NO: 975575 - DNA, 22 bp, Artificial Sequence
  chemically synthesized
actgggtttgatgccccataac

SEQ ID NO: 975576 - DNA, 22 bp, Artificial Sequence
  chemically synthesized
ggtttgatgccccataacttta

SEQ ID NO: 975577 - DNA, 22 bp, Artificial Sequence
  chemically synthesized
gatgccccataactttacaagt

SEQ ID NO: 975578 - DNA, 22 bp, Artificial Sequence
  chemically synthesized
atgccccataactttacaagta

SEQ ID NO: 975579 - DNA, 22 bp, Artificial Sequence
  chemically synthesized
agtatcatgtggaatagttgtt

SEQ ID NO: 975580 - DNA, 22 bp, Artificial Sequence
  chemically synthesized
tacaagtaacaactattccaca

SEQ ID NO: 975581 - DNA, 22 bp, Artificial Sequence
  chemically synthesized
acaagtaacaactattccacat

SEQ ID NO: 975582 - DNA, 22 bp, Artificial Sequence
  chemically synthesized
caagtaacaactattccacatg

SEQ ID NO: 975583 - DNA, 22 bp, Artificial Sequence
  chemically synthesized
ttccacatgatactcaatgctc

SEQ ID NO: 975584 - DNA, 22 bp, Artificial Sequence
  chemically synthesized
caaggcagtcatatgagcattg

SEQ ID NO: 975585 - DNA, 22 bp, Artificial Sequence
  chemically synthesized
cacatgatactcaatgctcata

SEQ ID NO: 975586 - DNA, 22 bp, Artificial Sequence
  chemically synthesized
ctccaaggcagtcatatgagca

SEQ ID NO: 975587 - DNA, 22 bp, Artificial Sequence
  chemically synthesized
ttcctccaaggcagtcatatga

SEQ ID NO: 975588 - DNA, 22 bp, Artificial Sequence
  chemically synthesized
aatgctcatatgactgccttgg

SEQ ID NO: 975589 - DNA, 22 bp, Artificial Sequence
  chemically synthesized
atatgactgccttggaggaata

SEQ ID NO: 975590 - DNA, 22 bp, Artificial Sequence
  chemically synthesized
ccttggaggaataattgacatt

SEQ ID NO: 975591 - DNA, 22 bp, Artificial Sequence
  chemically synthesized
ggacagggggtagagaatgtca

SEQ ID NO: 975592 - DNA, 22 bp, Artificial Sequence
  chemically synthesized
ggaggaataattgacattctct

SEQ ID NO: 975593 - DNA, 22 bp, Artificial Sequence
  chemically synthesized
gggacagggggtagagaatgtc

SEQ ID NO: 975594 - DNA, 22 bp, Artificial Sequence
  chemically synthesized
gaggaataattgacattctcta

SEQ ID NO: 975595 - DNA, 22 bp, Artificial Sequence
  chemically synthesized
aagtttgggacagggggtagag

SEQ ID NO: 975596 - DNA, 22 bp, Artificial Sequence
  chemically synthesized
aaagtttgggacagggggtaga

SEQ ID NO: 975597 - DNA, 22 bp, Artificial Sequence
  chemically synthesized
taaagtttgggacagggggtag

SEQ ID NO: 975598 - DNA, 22 bp, Artificial Sequence
  chemically synthesized
ttaaagtttgggacagggggta

SEQ ID NO: 975599 - DNA, 22 bp, Artificial Sequence
  chemically synthesized
tttaaagtttgggacagggggt

SEQ ID NO: 975600 - DNA, 22 bp, Artificial Sequence
  chemically synthesized
acattctctaccccctgtccca

SEQ ID NO: 975601 - DNA, 22 bp, Artificial Sequence
  chemically synthesized
tctaccccctgtcccaaacttt

SEQ ID NO: 975602 - DNA, 22 bp, Artificial Sequence
  chemically synthesized
taccccctgtcccaaactttaa

SEQ ID NO: 975603 - DNA, 22 bp, Artificial Sequence
  chemically synthesized
ccccctgtcccaaactttaaaa

SEQ ID NO: 975604 - DNA, 22 bp, Artificial Sequence
  chemically synthesized
agtacacaaaatgttttttaaa

SEQ ID NO: 975605 - DNA, 22 bp, Artificial Sequence
  chemically synthesized
cagtacacaaaatgttttttaa

SEQ ID NO: 975606 - DNA, 22 bp, Artificial Sequence
  chemically synthesized
tcccaaactttaaaaaacattt

SEQ ID NO: 975607 - DNA, 22 bp, Artificial Sequence
  chemically synthesized
aatcatttcagtacacaaaatg

SEQ ID NO: 975608 - DNA, 22 bp, Artificial Sequence
  chemically synthesized
taaaaaacattttgtgtactga

SEQ ID NO: 975609 - DNA, 22 bp, Artificial Sequence
  chemically synthesized
aaaaaacattttgtgtactgaa

SEQ ID NO: 975610 - DNA, 22 bp, Artificial Sequence
  chemically synthesized
atcctaaatcatttcagtacac

SEQ ID NO: 975611 - DNA, 22 bp, Artificial Sequence
  chemically synthesized
aaaaacattttgtgtactgaaa

SEQ ID NO: 975612 - DNA, 22 bp, Artificial Sequence
  chemically synthesized
tgtgtactgaaatgatttagga

SEQ ID NO: 975613 - DNA, 22 bp, Artificial Sequence
  chemically synthesized
gtgtactgaaatgatttaggat

SEQ ID NO: 975614 - DNA, 22 bp, Artificial Sequence
  chemically synthesized
cggtcacagttcatcctaaatc

SEQ ID NO: 975615 - DNA, 22 bp, Artificial Sequence
  chemically synthesized
tgtactgaaatgatttaggatg

SEQ ID NO: 975616 - DNA, 22 bp, Artificial Sequence
  chemically synthesized
ccggtcacagttcatcctaaat

SEQ ID NO: 975617 - DNA, 22 bp, Artificial Sequence
  chemically synthesized
tttccggtcacagttcatccta

SEQ ID NO: 975618 - DNA, 22 bp, Artificial Sequence
  chemically synthesized
gtttccggtcacagttcatcct

SEQ ID NO: 975619 - DNA, 22 bp, Artificial Sequence
  chemically synthesized
ttgtttccggtcacagttcatc

SEQ ID NO: 975620 - DNA, 22 bp, Artificial Sequence
  chemically synthesized
aaatgatttaggatgaactgtg

SEQ ID NO: 975621 - DNA, 22 bp, Artificial Sequence
  chemically synthesized
cttgtttccggtcacagttcat

SEQ ID NO: 975622 - DNA, 22 bp, Artificial Sequence
  chemically synthesized
tcttgtttccggtcacagttca

SEQ ID NO: 975623 - DNA, 22 bp, Artificial Sequence
  chemically synthesized
ttttcttgtttccggtcacagt

SEQ ID NO: 975624 - DNA, 22 bp, Artificial Sequence
  chemically synthesized
ctattttcttgtttccggtcac

SEQ ID NO: 975625 - DNA, 22 bp, Artificial Sequence
  chemically synthesized
aggatgaactgtgaccggaaac

SEQ ID NO: 975626 - DNA, 22 bp, Artificial Sequence
  chemically synthesized
ggatgaactgtgaccggaaaca

SEQ ID NO: 975627 - DNA, 22 bp, Artificial Sequence
  chemically synthesized
tgaccggaaacaagaaaatagt

SEQ ID NO: 975628 - DNA, 22 bp, Artificial Sequence
  chemically synthesized
gaccaccccgtgagttactatt

SEQ ID NO: 975629 - DNA, 22 bp, Artificial Sequence
  chemically synthesized
ggaccaccccgtgagttactat

SEQ ID NO: 975630 - DNA, 22 bp, Artificial Sequence
  chemically synthesized
cttggaccaccccgtgagttac

SEQ ID NO: 975631 - DNA, 22 bp, Artificial Sequence
  chemically synthesized
gcttggaccaccccgtgagtta

SEQ ID NO: 975632 - DNA, 22 bp, Artificial Sequence
  chemically synthesized
tcatcttgcttggaccaccccg

SEQ ID NO: 975633 - DNA, 22 bp, Artificial Sequence
  chemically synthesized
gctgtcatcttgcttggaccac

SEQ ID NO: 975634 - DNA, 22 bp, Artificial Sequence
  chemically synthesized
acggggtggtccaagcaagatg

SEQ ID NO: 975635 - DNA, 22 bp, Artificial Sequence
  chemically synthesized
aaacaaaacaaagaacaaaaag

SEQ ID NO: 975636 - DNA, 22 bp, Artificial Sequence
  chemically synthesized
agaatctaaaacaaaacaaaga

SEQ ID NO: 975637 - DNA, 22 bp, Artificial Sequence
  chemically synthesized
tttgttctttgttttgttttag

SEQ ID NO: 975638 - DNA, 22 bp, Artificial Sequence
  chemically synthesized
ttgttctttgttttgttttaga

SEQ ID NO: 975639 - DNA, 22 bp, Artificial Sequence
  chemically synthesized
aagcgttaagaatctaaaacaa

SEQ ID NO: 975640 - DNA, 22 bp, Artificial Sequence
  chemically synthesized
tgttctttgttttgttttagat

SEQ ID NO: 975641 - DNA, 22 bp, Artificial Sequence
  chemically synthesized
gttctttgttttgttttagatt

SEQ ID NO: 975642 - DNA, 22 bp, Artificial Sequence
  chemically synthesized
ttctttgttttgttttagattc

SEQ ID NO: 975643 - DNA, 22 bp, Artificial Sequence
  chemically synthesized
actaaagcgttaagaatctaaa

SEQ ID NO: 975644 - DNA, 22 bp, Artificial Sequence
  chemically synthesized
cactaaagcgttaagaatctaa

SEQ ID NO: 975645 - DNA, 22 bp, Artificial Sequence
  chemically synthesized
tttgttttgttttagattctta

SEQ ID NO: 975646 - DNA, 22 bp, Artificial Sequence
  chemically synthesized
tgttttgttttagattcttaac

SEQ ID NO: 975647 - DNA, 22 bp, Artificial Sequence
  chemically synthesized
gttttgttttagattcttaacg

SEQ ID NO: 975648 - DNA, 22 bp, Artificial Sequence
  chemically synthesized
ttttgttttagattcttaacgc

SEQ ID NO: 975649 - DNA, 22 bp, Artificial Sequence
  chemically synthesized
tgttttagattcttaacgcttt

SEQ ID NO: 975650 - DNA, 22 bp, Artificial Sequence
  chemically synthesized
gttttagattcttaacgcttta

SEQ ID NO: 975651 - DNA, 22 bp, Artificial Sequence
  chemically synthesized
ttttagattcttaacgctttag

SEQ ID NO: 975652 - DNA, 22 bp, Artificial Sequence
  chemically synthesized
tagattcttaacgctttagtga

SEQ ID NO: 975653 - DNA, 22 bp, Artificial Sequence
  chemically synthesized
agattcttaacgctttagtgaa

SEQ ID NO: 975654 - DNA, 22 bp, Artificial Sequence
  chemically synthesized
gattcttaacgctttagtgaag

SEQ ID NO: 975655 - DNA, 22 bp, Artificial Sequence
  chemically synthesized
ttaacgctttagtgaagttgga

SEQ ID NO: 975656 - DNA, 22 bp, Artificial Sequence
  chemically synthesized
aacgctttagtgaagttggatc

SEQ ID NO: 975657 - DNA, 22 bp, Artificial Sequence
  chemically synthesized
acgctttagtgaagttggatcc

SEQ ID NO: 975658 - DNA, 22 bp, Artificial Sequence
  chemically synthesized
caatgatcaaaatgtggatcca

SEQ ID NO: 975659 - DNA, 22 bp, Artificial Sequence
  chemically synthesized
gcaatgatcaaaatgtggatcc

SEQ ID NO: 975660 - DNA, 22 bp, Artificial Sequence
  chemically synthesized
tagtgaagttggatccacattt

SEQ ID NO: 975661 - DNA, 22 bp, Artificial Sequence
  chemically synthesized
agtgaagttggatccacatttt

SEQ ID NO: 975662 - DNA, 22 bp, Artificial Sequence
  chemically synthesized
gtgaagttggatccacattttg

SEQ ID NO: 975663 - DNA, 22 bp, Artificial Sequence
  chemically synthesized
atatttgcaatgatcaaaatgt

SEQ ID NO: 975664 - DNA, 22 bp, Artificial Sequence
  chemically synthesized
taatatttgcaatgatcaaaat

SEQ ID NO: 975665 - DNA, 22 bp, Artificial Sequence
  chemically synthesized
ctaatatttgcaatgatcaaaa

SEQ ID NO: 975666 - DNA, 22 bp, Artificial Sequence
  chemically synthesized
tttctaatatttgcaatgatca

SEQ ID NO: 975667 - DNA, 22 bp, Artificial Sequence
  chemically synthesized
gatccacattttgatcattgca

SEQ ID NO: 975668 - DNA, 22 bp, Artificial Sequence
  chemically synthesized
tgatcattgcaaatattagaaa

SEQ ID NO: 975669 - DNA, 22 bp, Artificial Sequence
  chemically synthesized
gatcattgcaaatattagaaac

SEQ ID NO: 975670 - DNA, 22 bp, Artificial Sequence
  chemically synthesized
aacatgtaagttgtttctaata

SEQ ID NO: 975671 - DNA, 22 bp, Artificial Sequence
  chemically synthesized
atcattgcaaatattagaaaca

SEQ ID NO: 975672 - DNA, 22 bp, Artificial Sequence
  chemically synthesized
ttgaacatgtaagttgtttcta

SEQ ID NO: 975673 - DNA, 22 bp, Artificial Sequence
  chemically synthesized
gttgaacatgtaagttgtttct

SEQ ID NO: 975674 - DNA, 22 bp, Artificial Sequence
  chemically synthesized
caaatattagaaacaacttaca

SEQ ID NO: 975675 - DNA, 22 bp, Artificial Sequence
  chemically synthesized
ccttgttgaacatgtaagttgt

SEQ ID NO: 975676 - DNA, 22 bp, Artificial Sequence
  chemically synthesized
accttgttgaacatgtaagttg

SEQ ID NO: 975677 - DNA, 22 bp, Artificial Sequence
  chemically synthesized
gaaacaacttacatgttcaaca

SEQ ID NO: 975678 - DNA, 22 bp, Artificial Sequence
  chemically synthesized
accaatcttaccttgttgaaca

SEQ ID NO: 975679 - DNA, 22 bp, Artificial Sequence
  chemically synthesized
aaccaatcttaccttgttgaac

SEQ ID NO: 975680 - DNA, 22 bp, Artificial Sequence
  chemically synthesized
taaccaatcttaccttgttgaa

SEQ ID NO: 975681 - DNA, 22 bp, Artificial Sequence
  chemically synthesized
ttaaccaatcttaccttgttga

SEQ ID NO: 975682 - DNA, 22 bp, Artificial Sequence
  chemically synthesized
tttaaccaatcttaccttgttg

SEQ ID NO: 975683 - DNA, 22 bp, Artificial Sequence
  chemically synthesized
ttttaaccaatcttaccttgtt

SEQ ID NO: 975684 - DNA, 22 bp, Artificial Sequence
  chemically synthesized
tttttaaccaatcttaccttgt

SEQ ID NO: 975685 - DNA, 22 bp, Artificial Sequence
  chemically synthesized
acatgttcaacaaggtaagatt

SEQ ID NO: 975686 - DNA, 22 bp, Artificial Sequence
  chemically synthesized
catgttcaacaaggtaagattg

SEQ ID NO: 975687 - DNA, 22 bp, Artificial Sequence
  chemically synthesized
attttttttaaccaatcttacc

SEQ ID NO: 975688 - DNA, 22 bp, Artificial Sequence
  chemically synthesized
tgctgattttttttaaccaatc

SEQ ID NO: 975689 - DNA, 22 bp, Artificial Sequence
  chemically synthesized
gtgctgattttttttaaccaat

SEQ ID NO: 975690 - DNA, 22 bp, Artificial Sequence
  chemically synthesized
aacaaggtaagattggttaaaa

SEQ ID NO: 975691 - DNA, 22 bp, Artificial Sequence
  chemically synthesized
tatttgtgctgattttttttaa

SEQ ID NO: 975692 - DNA, 22 bp, Artificial Sequence
  chemically synthesized
ttgtatttgtgctgattttttt

SEQ ID NO: 975693 - DNA, 22 bp, Artificial Sequence
  chemically synthesized
gttgtatttgtgctgatttttt

SEQ ID NO: 975694 - DNA, 22 bp, Artificial Sequence
  chemically synthesized
tgttgtatttgtgctgattttt

SEQ ID NO: 975695 - DNA, 22 bp, Artificial Sequence
  chemically synthesized
gttaaaaaaaatcagcacaaat

SEQ ID NO: 975696 - DNA, 22 bp, Artificial Sequence
  chemically synthesized
atagtattttgttgtatttgtg

SEQ ID NO: 975697 - DNA, 22 bp, Artificial Sequence
  chemically synthesized
aaaaaaatcagcacaaatacaa

SEQ ID NO: 975698 - DNA, 22 bp, Artificial Sequence
  chemically synthesized
aatgacctgatagtattttgtt

SEQ ID NO: 975699 - DNA, 22 bp, Artificial Sequence
  chemically synthesized
aaatgacctgatagtattttgt

SEQ ID NO: 975700 - DNA, 22 bp, Artificial Sequence
  chemically synthesized
taaatgacctgatagtattttg

SEQ ID NO: 975701 - DNA, 22 bp, Artificial Sequence
  chemically synthesized
ttaaatgacctgatagtatttt

SEQ ID NO: 975702 - DNA, 22 bp, Artificial Sequence
  chemically synthesized
acatttttaaatgacctgatag

SEQ ID NO: 975703 - DNA, 22 bp, Artificial Sequence
  chemically synthesized
cacatttttaaatgacctgata

SEQ ID NO: 975704 - DNA, 22 bp, Artificial Sequence
  chemically synthesized
tcacatttttaaatgacctgat

SEQ ID NO: 975705 - DNA, 22 bp, Artificial Sequence
  chemically synthesized
tttcacatttttaaatgacctg

SEQ ID NO: 975706 - DNA, 22 bp, Artificial Sequence
  chemically synthesized
attctttcacatttttaaatga

SEQ ID NO: 975707 - DNA, 22 bp, Artificial Sequence
  chemically synthesized
cattctttcacatttttaaatg

SEQ ID NO: 975708 - DNA, 22 bp, Artificial Sequence
  chemically synthesized
aatttcattctttcacattttt

SEQ ID NO: 975709 - DNA, 22 bp, Artificial Sequence
  chemically synthesized
tcaggtcatttaaaaatgtgaa

SEQ ID NO: 975710 - DNA, 22 bp, Artificial Sequence
  chemically synthesized
aaatttcattctttcacatttt

SEQ ID NO: 975711 - DNA, 22 bp, Artificial Sequence
  chemically synthesized
ttaaatttcattctttcacatt

SEQ ID NO: 975712 - DNA, 22 bp, Artificial Sequence
  chemically synthesized
ctcttaaatttcattctttcac

SEQ ID NO: 975713 - DNA, 22 bp, Artificial Sequence
  chemically synthesized
gctcttaaatttcattctttca

SEQ ID NO: 975714 - DNA, 22 bp, Artificial Sequence
  chemically synthesized
tgctcttaaatttcattctttc

SEQ ID NO: 975715 - DNA, 22 bp, Artificial Sequence
  chemically synthesized
tttgctcttaaatttcattctt

SEQ ID NO: 975716 - DNA, 22 bp, Artificial Sequence
  chemically synthesized
ctttgctcttaaatttcattct

SEQ ID NO: 975717 - DNA, 22 bp, Artificial Sequence
  chemically synthesized
aaaaatgtgaaagaatgaaatt

SEQ ID NO: 975718 - DNA, 22 bp, Artificial Sequence
  chemically synthesized
aaaatgtgaaagaatgaaattt

SEQ ID NO: 975719 - DNA, 22 bp, Artificial Sequence
  chemically synthesized
ttctttgctcttaaatttcatt

SEQ ID NO: 975720 - DNA, 22 bp, Artificial Sequence
  chemically synthesized
tagcatgagattcttctttgct

SEQ ID NO: 975721 - DNA, 22 bp, Artificial Sequence
  chemically synthesized
tgtagcatgagattcttctttg

SEQ ID NO: 975722 - DNA, 22 bp, Artificial Sequence
  chemically synthesized
aagagcaaagaagaatctcatg

SEQ ID NO: 975723 - DNA, 22 bp, Artificial Sequence
  chemically synthesized
agagcaaagaagaatctcatgc

SEQ ID NO: 975724 - DNA, 22 bp, Artificial Sequence
  chemically synthesized
taagagaaatctctgtagcatg

SEQ ID NO: 975725 - DNA, 22 bp, Artificial Sequence
  chemically synthesized
gtaagagaaatctctgtagcat

SEQ ID NO: 975726 - DNA, 22 bp, Artificial Sequence
  chemically synthesized
tgtaagagaaatctctgtagca

SEQ ID NO: 975727 - DNA, 22 bp, Artificial Sequence
  chemically synthesized
tttgtaagagaaatctctgtag

SEQ ID NO: 975728 - DNA, 22 bp, Artificial Sequence
  chemically synthesized
ctttgtaagagaaatctctgta

SEQ ID NO: 975729 - DNA, 22 bp, Artificial Sequence
  chemically synthesized
tctttgtaagagaaatctctgt

SEQ ID NO: 975730 - DNA, 22 bp, Artificial Sequence
  chemically synthesized
atgctacagagatttctcttac

SEQ ID NO: 975731 - DNA, 22 bp, Artificial Sequence
  chemically synthesized
gatgactttctttgtaagagaa

SEQ ID NO: 975732 - DNA, 22 bp, Artificial Sequence
  chemically synthesized
agatgactttctttgtaagaga

SEQ ID NO: 975733 - DNA, 22 bp, Artificial Sequence
  chemically synthesized
cagagatttctcttacaaagaa

SEQ ID NO: 975734 - DNA, 22 bp, Artificial Sequence
  chemically synthesized
ctcttacaaagaaagtcatcta

SEQ ID NO: 975735 - DNA, 22 bp, Artificial Sequence
  chemically synthesized
tccatgagaatttagatgactt

SEQ ID NO: 975736 - DNA, 22 bp, Artificial Sequence
  chemically synthesized
tcttacaaagaaagtcatctaa

SEQ ID NO: 975737 - DNA, 22 bp, Artificial Sequence
  chemically synthesized
tatccatgagaatttagatgac

SEQ ID NO: 975738 - DNA, 22 bp, Artificial Sequence
  chemically synthesized
ttacaaagaaagtcatctaaat

SEQ ID NO: 975739 - DNA, 22 bp, Artificial Sequence
  chemically synthesized
acaaagaaagtcatctaaattc

SEQ ID NO: 975740 - DNA, 22 bp, Artificial Sequence
  chemically synthesized
caaagaaagtcatctaaattct

SEQ ID NO: 975741 - DNA, 22 bp, Artificial Sequence
  chemically synthesized
cattctatccatgagaatttag

SEQ ID NO: 975742 - DNA, 22 bp, Artificial Sequence
  chemically synthesized
ttgcattctatccatgagaatt

SEQ ID NO: 975743 - DNA, 22 bp, Artificial Sequence
  chemically synthesized
atctattgcattctatccatga

SEQ ID NO: 975744 - DNA, 22 bp, Artificial Sequence
  chemically synthesized
attaatctattgcattctatcc

SEQ ID NO: 975745 - DNA, 22 bp, Artificial Sequence
  chemically synthesized
aattctcatggatagaatgcaa

SEQ ID NO: 975746 - DNA, 22 bp, Artificial Sequence
  chemically synthesized
ctaattaatctattgcattcta

SEQ ID NO: 975747 - DNA, 22 bp, Artificial Sequence
  chemically synthesized
cctaattaatctattgcattct

SEQ ID NO: 975748 - DNA, 22 bp, Artificial Sequence
  chemically synthesized
tttcctaattaatctattgcat

SEQ ID NO: 975749 - DNA, 22 bp, Artificial Sequence
  chemically synthesized
tcatggatagaatgcaatagat

SEQ ID NO: 975750 - DNA, 22 bp, Artificial Sequence
  chemically synthesized
atggatagaatgcaatagatta

SEQ ID NO: 975751 - DNA, 22 bp, Artificial Sequence
  chemically synthesized
taaatactgtttcctaattaat

SEQ ID NO: 975752 - DNA, 22 bp, Artificial Sequence
  chemically synthesized
tataaatactgtttcctaatta

SEQ ID NO: 975753 - DNA, 22 bp, Artificial Sequence
  chemically synthesized
ctataaatactgtttcctaatt

SEQ ID NO: 975754 - DNA, 22 bp, Artificial Sequence
  chemically synthesized
tttctataaatactgtttccta

SEQ ID NO: 975755 - DNA, 22 bp, Artificial Sequence
  chemically synthesized
attaggaaacagtatttataga

SEQ ID NO: 975756 - DNA, 22 bp, Artificial Sequence
  chemically synthesized
ggaaacagtatttatagaaaca

SEQ ID NO: 975757 - DNA, 22 bp, Artificial Sequence
  chemically synthesized
acgagtaacaatcctgtttcta

SEQ ID NO: 975758 - DNA, 22 bp, Artificial Sequence
  chemically synthesized
aacgagtaacaatcctgtttct

SEQ ID NO: 975759 - DNA, 22 bp, Artificial Sequence
  chemically synthesized
tggcaatttaacgagtaacaat

SEQ ID NO: 975760 - DNA, 22 bp, Artificial Sequence
  chemically synthesized
atagaaacaggattgttactcg

SEQ ID NO: 975761 - DNA, 22 bp, Artificial Sequence
  chemically synthesized
atggcaatttaacgagtaacaa

SEQ ID NO: 975762 - DNA, 22 bp, Artificial Sequence
  chemically synthesized
tagaaacaggattgttactcgt

SEQ ID NO: 975763 - DNA, 22 bp, Artificial Sequence
  chemically synthesized
tatggcaatttaacgagtaaca

SEQ ID NO: 975764 - DNA, 22 bp, Artificial Sequence
  chemically synthesized
attttatggcaatttaacgagt

SEQ ID NO: 975765 - DNA, 22 bp, Artificial Sequence
  chemically synthesized
taattttatggcaatttaacga

SEQ ID NO: 975766 - DNA, 22 bp, Artificial Sequence
  chemically synthesized
ttctaattttatggcaatttaa

SEQ ID NO: 975767 - DNA, 22 bp, Artificial Sequence
  chemically synthesized
gttctaattttatggcaattta

SEQ ID NO: 975768 - DNA, 22 bp, Artificial Sequence
  chemically synthesized
ttgttctaattttatggcaatt

SEQ ID NO: 975769 - DNA, 22 bp, Artificial Sequence
  chemically synthesized
ttactcgttaaattgccataaa

SEQ ID NO: 975770 - DNA, 22 bp, Artificial Sequence
  chemically synthesized
ttcttgttctaattttatggca

SEQ ID NO: 975771 - DNA, 22 bp, Artificial Sequence
  chemically synthesized
gttcttgttctaattttatggc

SEQ ID NO: 975772 - DNA, 22 bp, Artificial Sequence
  chemically synthesized
ctcgttaaattgccataaaatt

SEQ ID NO: 975773 - DNA, 22 bp, Artificial Sequence
  chemically synthesized
gttaaattgccataaaattaga

SEQ ID NO: 975774 - DNA, 22 bp, Artificial Sequence
  chemically synthesized
gtgtttgttcttgttctaattt

SEQ ID NO: 975775 - DNA, 22 bp, Artificial Sequence
  chemically synthesized
aattgccataaaattagaacaa

SEQ ID NO: 975776 - DNA, 22 bp, Artificial Sequence
  chemically synthesized
agctagtgtttgttcttgttct

SEQ ID NO: 975777 - DNA, 22 bp, Artificial Sequence
  chemically synthesized
aagctagtgtttgttcttgttc

SEQ ID NO: 975778 - DNA, 22 bp, Artificial Sequence
  chemically synthesized
ccataaaattagaacaagaaca

SEQ ID NO: 975779 - DNA, 22 bp, Artificial Sequence
  chemically synthesized
taagctagtgtttgttcttgtt

SEQ ID NO: 975780 - DNA, 22 bp, Artificial Sequence
  chemically synthesized
ttaagctagtgtttgttcttgt

SEQ ID NO: 975781 - DNA, 22 bp, Artificial Sequence
  chemically synthesized
ttttaagctagtgtttgttctt

SEQ ID NO: 975782 - DNA, 22 bp, Artificial Sequence
  chemically synthesized
tcttttaagctagtgtttgttc

SEQ ID NO: 975783 - DNA, 22 bp, Artificial Sequence
  chemically synthesized
ctcttttaagctagtgtttgtt

SEQ ID NO: 975784 - DNA, 22 bp, Artificial Sequence
  chemically synthesized
tctcttttaagctagtgtttgt

SEQ ID NO: 975785 - DNA, 22 bp, Artificial Sequence
  chemically synthesized
ttctcttttaagctagtgtttg

SEQ ID NO: 975786 - DNA, 22 bp, Artificial Sequence
  chemically synthesized
gaacaagaacaaacactagctt

SEQ ID NO: 975787 - DNA, 22 bp, Artificial Sequence
  chemically synthesized
aggaaaaggcacttttctcttt

SEQ ID NO: 975788 - DNA, 22 bp, Artificial Sequence
  chemically synthesized
gcttaaaagagaaaagtgcctt

SEQ ID NO: 975789 - DNA, 22 bp, Artificial Sequence
  chemically synthesized
aaaagagaaaagtgccttttcc

SEQ ID NO: 975790 - DNA, 22 bp, Artificial Sequence
  chemically synthesized
aaagagaaaagtgccttttcct

SEQ ID NO: 975791 - DNA, 22 bp, Artificial Sequence
  chemically synthesized
tatcacatgtcctcaggaaaag

SEQ ID NO: 975792 - DNA, 22 bp, Artificial Sequence
  chemically synthesized
ttcctgaggacatgtgatacaa

SEQ ID NO: 975793 - DNA, 22 bp, Artificial Sequence
  chemically synthesized
taaatgccatcattgtatcaca

SEQ ID NO: 975794 - DNA, 22 bp, Artificial Sequence
  chemically synthesized
tcctgaggacatgtgatacaat

SEQ ID NO: 975795 - DNA, 22 bp, Artificial Sequence
  chemically synthesized
cctgaggacatgtgatacaatg

SEQ ID NO: 975796 - DNA, 22 bp, Artificial Sequence
  chemically synthesized
tgtaaatgccatcattgtatca

SEQ ID NO: 975797 - DNA, 22 bp, Artificial Sequence
  chemically synthesized
ctgaggacatgtgatacaatga

SEQ ID NO: 975798 - DNA, 22 bp, Artificial Sequence
  chemically synthesized
ctgtaaatgccatcattgtatc

SEQ ID NO: 975799 - DNA, 22 bp, Artificial Sequence
  chemically synthesized
tctgtaaatgccatcattgtat

SEQ ID NO: 975800 - DNA, 22 bp, Artificial Sequence
  chemically synthesized
ttctgtaaatgccatcattgta

SEQ ID NO: 975801 - DNA, 22 bp, Artificial Sequence
  chemically synthesized
aggacatgtgatacaatgatgg

SEQ ID NO: 975802 - DNA, 22 bp, Artificial Sequence
  chemically synthesized
atttttctgtaaatgccatcat

SEQ ID NO: 975803 - DNA, 22 bp, Artificial Sequence
  chemically synthesized
actcatttttctgtaaatgcca

SEQ ID NO: 975804 - DNA, 22 bp, Artificial Sequence
  chemically synthesized
agtatcattaactcatttttct

SEQ ID NO: 975805 - DNA, 22 bp, Artificial Sequence
  chemically synthesized
acagaaaaatgagttaatgata

SEQ ID NO: 975806 - DNA, 22 bp, Artificial Sequence
  chemically synthesized
ccagtccctcagtatcattaac

SEQ ID NO: 975807 - DNA, 22 bp, Artificial Sequence
  chemically synthesized
cagaaaaatgagttaatgatac

SEQ ID NO: 975808 - DNA, 22 bp, Artificial Sequence
  chemically synthesized
gccagtccctcagtatcattaa

SEQ ID NO: 975809 - DNA, 22 bp, Artificial Sequence
  chemically synthesized
tgccagtccctcagtatcatta

SEQ ID NO: 975810 - DNA, 22 bp, Artificial Sequence
  chemically synthesized
ttgccagtccctcagtatcatt

SEQ ID NO: 975811 - DNA, 22 bp, Artificial Sequence
  chemically synthesized
tttgccagtccctcagtatcat

SEQ ID NO: 975812 - DNA, 22 bp, Artificial Sequence
  chemically synthesized
tttttgccagtccctcagtatc

SEQ ID NO: 975813 - DNA, 22 bp, Artificial Sequence
  chemically synthesized
ctttttgccagtccctcagtat

SEQ ID NO: 975814 - DNA, 22 bp, Artificial Sequence
  chemically synthesized
tctttttgccagtccctcagta

SEQ ID NO: 975815 - DNA, 22 bp, Artificial Sequence
  chemically synthesized
ctttctttttgccagtccctca

SEQ ID NO: 975816 - DNA, 22 bp, Artificial Sequence
  chemically synthesized
atgatactgagggactggcaaa

SEQ ID NO: 975817 - DNA, 22 bp, Artificial Sequence
  chemically synthesized
agggactggcaaaaagaaagga

SEQ ID NO: 975818 - DNA, 22 bp, Artificial Sequence
  chemically synthesized
catgaaaatggcctcctttctt

SEQ ID NO: 975819 - DNA, 22 bp, Artificial Sequence
  chemically synthesized
gttccatgaaaatggcctcctt

SEQ ID NO: 975820 - DNA, 22 bp, Artificial Sequence
  chemically synthesized
ggttccatgaaaatggcctcct

SEQ ID NO: 975821 - DNA, 22 bp, Artificial Sequence
  chemically synthesized
gcaaaaagaaaggaggccattt

SEQ ID NO: 975822 - DNA, 22 bp, Artificial Sequence
  chemically synthesized
cttggttccatgaaaatggcct

SEQ ID NO: 975823 - DNA, 22 bp, Artificial Sequence
  chemically synthesized
ccttggttccatgaaaatggcc

SEQ ID NO: 975824 - DNA, 22 bp, Artificial Sequence
  chemically synthesized
tccttggttccatgaaaatggc

SEQ ID NO: 975825 - DNA, 22 bp, Artificial Sequence
  chemically synthesized
aatatagttttccttggttcca

SEQ ID NO: 975826 - DNA, 22 bp, Artificial Sequence
  chemically synthesized
gaatatagttttccttggttcc

SEQ ID NO: 975827 - DNA, 22 bp, Artificial Sequence
  chemically synthesized
tgaatatagttttccttggttc

SEQ ID NO: 975828 - DNA, 22 bp, Artificial Sequence
  chemically synthesized
tcatggaaccaaggaaaactat

SEQ ID NO: 975829 - DNA, 22 bp, Artificial Sequence
  chemically synthesized
catggaaccaaggaaaactata

SEQ ID NO: 975830 - DNA, 22 bp, Artificial Sequence
  chemically synthesized
atggaaccaaggaaaactatat

SEQ ID NO: 975831 - DNA, 22 bp, Artificial Sequence
  chemically synthesized
tattcaaaggtggtatcttttc

SEQ ID NO: 975832 - DNA, 22 bp, Artificial Sequence
  chemically synthesized
taaaaccaatagcagagaaaag

SEQ ID NO: 975833 - DNA, 22 bp, Artificial Sequence
  chemically synthesized
aaaggtggtatcttttctctgc

SEQ ID NO: 975834 - DNA, 22 bp, Artificial Sequence
  chemically synthesized
taggtatatgattataaaacca

SEQ ID NO: 975835 - DNA, 22 bp, Artificial Sequence
  chemically synthesized
ttctctgctattggttttataa

SEQ ID NO: 975836 - DNA, 22 bp, Artificial Sequence
  chemically synthesized
tctctgctattggttttataat

SEQ ID NO: 975837 - DNA, 22 bp, Artificial Sequence
  chemically synthesized
ctctgctattggttttataatc

SEQ ID NO: 975838 - DNA, 22 bp, Artificial Sequence
  chemically synthesized
tctgctattggttttataatca

SEQ ID NO: 975839 - DNA, 22 bp, Artificial Sequence
  chemically synthesized
tgctattggttttataatcata

SEQ ID NO: 975840 - DNA, 22 bp, Artificial Sequence
  chemically synthesized
ctattggttttataatcatata

SEQ ID NO: 975841 - DNA, 22 bp, Artificial Sequence
  chemically synthesized
agtgtagctataggtatatgat

SEQ ID NO: 975842 - DNA, 22 bp, Artificial Sequence
  chemically synthesized
ttggttttataatcatatacct

SEQ ID NO: 975843 - DNA, 22 bp, Artificial Sequence
  chemically synthesized
aagtgtagctataggtatatga

SEQ ID NO: 975844 - DNA, 22 bp, Artificial Sequence
  chemically synthesized
taagtgtagctataggtatatg

SEQ ID NO: 975845 - DNA, 22 bp, Artificial Sequence
  chemically synthesized
ttaagtgtagctataggtatat

SEQ ID NO: 975846 - DNA, 22 bp, Artificial Sequence
  chemically synthesized
gttttataatcatatacctata

SEQ ID NO: 975847 - DNA, 22 bp, Artificial Sequence
  chemically synthesized
atttttaagtgtagctataggt

SEQ ID NO: 975848 - DNA, 22 bp, Artificial Sequence
  chemically synthesized
tataatcatatacctatagcta

SEQ ID NO: 975849 - DNA, 22 bp, Artificial Sequence
  chemically synthesized
aatttttaagtgtagctatagg

SEQ ID NO: 975850 - DNA, 22 bp, Artificial Sequence
  chemically synthesized
ataatcatatacctatagctac

SEQ ID NO: 975851 - DNA, 22 bp, Artificial Sequence
  chemically synthesized
taatttttaagtgtagctatag

SEQ ID NO: 975852 - DNA, 22 bp, Artificial Sequence
  chemically synthesized
taatcatatacctatagctaca

SEQ ID NO: 975853 - DNA, 22 bp, Artificial Sequence
  chemically synthesized
taagtattttaatttttaagtg

SEQ ID NO: 975854 - DNA, 22 bp, Artificial Sequence
  chemically synthesized
tgtaagtattttaatttttaag

SEQ ID NO: 975855 - DNA, 22 bp, Artificial Sequence
  chemically synthesized
ctgtaagtattttaatttttaa

SEQ ID NO: 975856 - DNA, 22 bp, Artificial Sequence
  chemically synthesized
tctgtaagtattttaattttta

SEQ ID NO: 975857 - DNA, 22 bp, Artificial Sequence
  chemically synthesized
tagctacacttaaaaattaaaa

SEQ ID NO: 975858 - DNA, 22 bp, Artificial Sequence
  chemically synthesized
tattttctgtaagtattttaat

SEQ ID NO: 975859 - DNA, 22 bp, Artificial Sequence
  chemically synthesized
cacttaaaaattaaaatactta

SEQ ID NO: 975860 - DNA, 22 bp, Artificial Sequence
  chemically synthesized
aaaaattaaaatacttacagaa

SEQ ID NO: 975861 - DNA, 22 bp, Artificial Sequence
  chemically synthesized
aaaattaaaatacttacagaaa

SEQ ID NO: 975862 - DNA, 22 bp, Artificial Sequence
  chemically synthesized
tcaatatcaaagttatattttc

SEQ ID NO: 975863 - DNA, 22 bp, Artificial Sequence
  chemically synthesized
aaatacttacagaaaatataac

SEQ ID NO: 975864 - DNA, 22 bp, Artificial Sequence
  chemically synthesized
agactatcaatatcaaagttat

SEQ ID NO: 975865 - DNA, 22 bp, Artificial Sequence
  chemically synthesized
cagactatcaatatcaaagtta

SEQ ID NO: 975866 - DNA, 22 bp, Artificial Sequence
  chemically synthesized
acagaaaatataactttgatat

SEQ ID NO: 975867 - DNA, 22 bp, Artificial Sequence
  chemically synthesized
cagaaaatataactttgatatt

SEQ ID NO: 975868 - DNA, 22 bp, Artificial Sequence
  chemically synthesized
gggtagagagtttcagactatc

SEQ ID NO: 975869 - DNA, 22 bp, Artificial Sequence
  chemically synthesized
tgatattgatagtctgaaactc

SEQ ID NO: 975870 - DNA, 22 bp, Artificial Sequence
  chemically synthesized
gatattgatagtctgaaactct

SEQ ID NO: 975871 - DNA, 22 bp, Artificial Sequence
  chemically synthesized
atattgatagtctgaaactctc

SEQ ID NO: 975872 - DNA, 22 bp, Artificial Sequence
  chemically synthesized
atagtctgaaactctctacccc

SEQ ID NO: 975873 - DNA, 22 bp, Artificial Sequence
  chemically synthesized
agagaagaggttggggtagaga

SEQ ID NO: 975874 - DNA, 22 bp, Artificial Sequence
  chemically synthesized
tccattaagagaagaggttggg

SEQ ID NO: 975875 - DNA, 22 bp, Artificial Sequence
  chemically synthesized
aaactctctaccccaacctctt

SEQ ID NO: 975876 - DNA, 22 bp, Artificial Sequence
  chemically synthesized
tctaccccaacctcttctctta

SEQ ID NO: 975877 - DNA, 22 bp, Artificial Sequence
  chemically synthesized
taccccaacctcttctcttaat

SEQ ID NO: 975878 - DNA, 22 bp, Artificial Sequence
  chemically synthesized
aacataattatccattaagaga

SEQ ID NO: 975879 - DNA, 22 bp, Artificial Sequence
  chemically synthesized
ccccaacctcttctcttaatgg

SEQ ID NO: 975880 - DNA, 22 bp, Artificial Sequence
  chemically synthesized
aaacataattatccattaagag

SEQ ID NO: 975881 - DNA, 22 bp, Artificial Sequence
  chemically synthesized
ttctcttaatggataattatgt

SEQ ID NO: 975882 - DNA, 22 bp, Artificial Sequence
  chemically synthesized
ctcttaatggataattatgttt

SEQ ID NO: 975883 - DNA, 22 bp, Artificial Sequence
  chemically synthesized
aaaaaccatcttaaacataatt

SEQ ID NO: 975884 - DNA, 22 bp, Artificial Sequence
  chemically synthesized
tcttaatggataattatgttta

SEQ ID NO: 975885 - DNA, 22 bp, Artificial Sequence
  chemically synthesized
aaaaaaccatcttaaacataat

SEQ ID NO: 975886 - DNA, 22 bp, Artificial Sequence
  chemically synthesized
ttaatggataattatgtttaag

SEQ ID NO: 975887 - DNA, 22 bp, Artificial Sequence
  chemically synthesized
tttaaaaaaccatcttaaacat

SEQ ID NO: 975888 - DNA, 22 bp, Artificial Sequence
  chemically synthesized
aatggataattatgtttaagat

SEQ ID NO: 975889 - DNA, 22 bp, Artificial Sequence
  chemically synthesized
atggataattatgtttaagatg

SEQ ID NO: 975890 - DNA, 22 bp, Artificial Sequence
  chemically synthesized
acgttatttaaaaaaccatctt

SEQ ID NO: 975891 - DNA, 22 bp, Artificial Sequence
  chemically synthesized
tgtttaagatggttttttaaat

SEQ ID NO: 975892 - DNA, 22 bp, Artificial Sequence
  chemically synthesized
aagatggttttttaaataacgt

SEQ ID NO: 975893 - DNA, 22 bp, Artificial Sequence
  chemically synthesized
ataaaaaacctcacgttattta

SEQ ID NO: 975894 - DNA, 22 bp, Artificial Sequence
  chemically synthesized
agatggttttttaaataacgtg

SEQ ID NO: 975895 - DNA, 22 bp, Artificial Sequence
  chemically synthesized
actaataaaaaacctcacgtta

SEQ ID NO: 975896 - DNA, 22 bp, Artificial Sequence
  chemically synthesized
aactaataaaaaacctcacgtt

SEQ ID NO: 975897 - DNA, 22 bp, Artificial Sequence
  chemically synthesized
ttaactaataaaaaacctcacg

SEQ ID NO: 975898 - DNA, 22 bp, Artificial Sequence
  chemically synthesized
tttaaataacgtgaggtttttt

SEQ ID NO: 975899 - DNA, 22 bp, Artificial Sequence
  chemically synthesized
ttaaataacgtgaggtttttta

SEQ ID NO: 975900 - DNA, 22 bp, Artificial Sequence
  chemically synthesized
taaataacgtgaggttttttat

SEQ ID NO: 975901 - DNA, 22 bp, Artificial Sequence
  chemically synthesized
tgttcttaactaataaaaaacc

SEQ ID NO: 975902 - DNA, 22 bp, Artificial Sequence
  chemically synthesized
aaataacgtgaggttttttatt

SEQ ID NO: 975903 - DNA, 22 bp, Artificial Sequence
  chemically synthesized
gtgttcttaactaataaaaaac

SEQ ID NO: 975904 - DNA, 22 bp, Artificial Sequence
  chemically synthesized
aataacgtgaggttttttatta

SEQ ID NO: 975905 - DNA, 22 bp, Artificial Sequence
  chemically synthesized
cttgtgttcttaactaataaaa

SEQ ID NO: 975906 - DNA, 22 bp, Artificial Sequence
  chemically synthesized
acatgctccttgtgttcttaac

SEQ ID NO: 975907 - DNA, 22 bp, Artificial Sequence
  chemically synthesized
taacatgctccttgtgttctta

SEQ ID NO: 975908 - DNA, 22 bp, Artificial Sequence
  chemically synthesized
tttattagttaagaacacaagg

SEQ ID NO: 975909 - DNA, 22 bp, Artificial Sequence
  chemically synthesized
ttattagttaagaacacaagga

SEQ ID NO: 975910 - DNA, 22 bp, Artificial Sequence
  chemically synthesized
tattagttaagaacacaaggag

SEQ ID NO: 975911 - DNA, 22 bp, Artificial Sequence
  chemically synthesized
attagttaagaacacaaggagc

SEQ ID NO: 975912 - DNA, 22 bp, Artificial Sequence
  chemically synthesized
ttagttaagaacacaaggagca

SEQ ID NO: 975913 - DNA, 22 bp, Artificial Sequence
  chemically synthesized
gttaagaacacaaggagcatgt

SEQ ID NO: 975914 - DNA, 22 bp, Artificial Sequence
  chemically synthesized
agaacacaaggagcatgttaga

SEQ ID NO: 975915 - DNA, 22 bp, Artificial Sequence
  chemically synthesized
acaacatgcagtgtattctaac

SEQ ID NO: 975916 - DNA, 22 bp, Artificial Sequence
  chemically synthesized
cacaacatgcagtgtattctaa

SEQ ID NO: 975917 - DNA, 22 bp, Artificial Sequence
  chemically synthesized
aacttcacaacatgcagtgtat

SEQ ID NO: 975918 - DNA, 22 bp, Artificial Sequence
  chemically synthesized
tgaacttcacaacatgcagtgt

SEQ ID NO: 975919 - DNA, 22 bp, Artificial Sequence
  chemically synthesized
ctgaacttcacaacatgcagtg

SEQ ID NO: 975920 - DNA, 22 bp, Artificial Sequence
  chemically synthesized
tctgaacttcacaacatgcagt

SEQ ID NO: 975921 - DNA, 22 bp, Artificial Sequence
  chemically synthesized
gaatacactgcatgttgtgaag

SEQ ID NO: 975922 - DNA, 22 bp, Artificial Sequence
  chemically synthesized
taacaggctttctgaacttcac

SEQ ID NO: 975923 - DNA, 22 bp, Artificial Sequence
  chemically synthesized
ataacaggctttctgaacttca

SEQ ID NO: 975924 - DNA, 22 bp, Artificial Sequence
  chemically synthesized
tataacaggctttctgaacttc

SEQ ID NO: 975925 - DNA, 22 bp, Artificial Sequence
  chemically synthesized
ttataacaggctttctgaactt

SEQ ID NO: 975926 - DNA, 22 bp, Artificial Sequence
  chemically synthesized
ttttataacaggctttctgaac

SEQ ID NO: 975927 - DNA, 22 bp, Artificial Sequence
  chemically synthesized
catgttgtgaagttcagaaagc

SEQ ID NO: 975928 - DNA, 22 bp, Artificial Sequence
  chemically synthesized
ctcttttataacaggctttctg

SEQ ID NO: 975929 - DNA, 22 bp, Artificial Sequence
  chemically synthesized
tgaagttcagaaagcctgttat

SEQ ID NO: 975930 - DNA, 22 bp, Artificial Sequence
  chemically synthesized
agaaagcctgttataaaagagc

SEQ ID NO: 975931 - DNA, 22 bp, Artificial Sequence
  chemically synthesized
tgaaaaggcaataagatactgc

SEQ ID NO: 975932 - DNA, 22 bp, Artificial Sequence
  chemically synthesized
atgaaaaggcaataagatactg

SEQ ID NO: 975933 - DNA, 22 bp, Artificial Sequence
  chemically synthesized
ttataaaagagcagtatcttat

SEQ ID NO: 975934 - DNA, 22 bp, Artificial Sequence
  chemically synthesized
taaaagagcagtatcttattgc

SEQ ID NO: 975935 - DNA, 22 bp, Artificial Sequence
  chemically synthesized
gtatgtttatgaaaaggcaata

SEQ ID NO: 975936 - DNA, 22 bp, Artificial Sequence
  chemically synthesized
aacattcgtatgtttatgaaaa

SEQ ID NO: 975937 - DNA, 22 bp, Artificial Sequence
  chemically synthesized
aaacattcgtatgtttatgaaa

SEQ ID NO: 975938 - DNA, 22 bp, Artificial Sequence
  chemically synthesized
taaacattcgtatgtttatgaa

SEQ ID NO: 975939 - DNA, 22 bp, Artificial Sequence
  chemically synthesized
attgccttttcataaacatacg

SEQ ID NO: 975940 - DNA, 22 bp, Artificial Sequence
  chemically synthesized
ttgccttttcataaacatacga

SEQ ID NO: 975941 - DNA, 22 bp, Artificial Sequence
  chemically synthesized
ccttttcataaacatacgaatg

SEQ ID NO: 975942 - DNA, 22 bp, Artificial Sequence
  chemically synthesized
ttcataaacatacgaatgttta

SEQ ID NO: 975943 - DNA, 22 bp, Artificial Sequence
  chemically synthesized
tcataaacatacgaatgtttaa

SEQ ID NO: 975944 - DNA, 22 bp, Artificial Sequence
  chemically synthesized
cataaacatacgaatgtttaaa

SEQ ID NO: 975945 - DNA, 22 bp, Artificial Sequence
  chemically synthesized
ataaacatacgaatgtttaaaa

SEQ ID NO: 975946 - DNA, 22 bp, Artificial Sequence
  chemically synthesized
tataaatatgaattttaaacat

SEQ ID NO: 975947 - DNA, 22 bp, Artificial Sequence
  chemically synthesized
ttatataaatatgaattttaaa

SEQ ID NO: 975948 - DNA, 22 bp, Artificial Sequence
  chemically synthesized
ctgttatataaatatgaatttt

SEQ ID NO: 975949 - DNA, 22 bp, Artificial Sequence
  chemically synthesized
cctgttatataaatatgaattt

SEQ ID NO: 975950 - DNA, 22 bp, Artificial Sequence
  chemically synthesized
tcctgttatataaatatgaatt

SEQ ID NO: 975951 - DNA, 22 bp, Artificial Sequence
  chemically synthesized
ttcctgttatataaatatgaat

SEQ ID NO: 975952 - DNA, 22 bp, Artificial Sequence
  chemically synthesized
tttcctgttatataaatatgaa

SEQ ID NO: 975953 - DNA, 22 bp, Artificial Sequence
  chemically synthesized
ttttcctgttatataaatatga

SEQ ID NO: 975954 - DNA, 22 bp, Artificial Sequence
  chemically synthesized
aaaattcatatttatataacag

SEQ ID NO: 975955 - DNA, 22 bp, Artificial Sequence
  chemically synthesized
aaattcatatttatataacagg

SEQ ID NO: 975956 - DNA, 22 bp, Artificial Sequence
  chemically synthesized
atagtcttttttcctgttatat

SEQ ID NO: 975957 - DNA, 22 bp, Artificial Sequence
  chemically synthesized
ctaatagtcttttttcctgtta

SEQ ID NO: 975958 - DNA, 22 bp, Artificial Sequence
  chemically synthesized
cctaatagtcttttttcctgtt

SEQ ID NO: 975959 - DNA, 22 bp, Artificial Sequence
  chemically synthesized
atatttatataacaggaaaaaa

SEQ ID NO: 975960 - DNA, 22 bp, Artificial Sequence
  chemically synthesized
atataacaggaaaaaagactat

SEQ ID NO: 975961 - DNA, 22 bp, Artificial Sequence
  chemically synthesized
aaacatttcctaatagtctttt

SEQ ID NO: 975962 - DNA, 22 bp, Artificial Sequence
  chemically synthesized
tataacaggaaaaaagactatt

SEQ ID NO: 975963 - DNA, 22 bp, Artificial Sequence
  chemically synthesized
atgttcaaacatttcctaatag

SEQ ID NO: 975964 - DNA, 22 bp, Artificial Sequence
  chemically synthesized
catgttcaaacatttcctaata

SEQ ID NO: 975965 - DNA, 22 bp, Artificial Sequence
  chemically synthesized
tcatgttcaaacatttcctaat

SEQ ID NO: 975966 - DNA, 22 bp, Artificial Sequence
  chemically synthesized
atacattttcatgttcaaacat

SEQ ID NO: 975967 - DNA, 22 bp, Artificial Sequence
  chemically synthesized
gatacattttcatgttcaaaca

SEQ ID NO: 975968 - DNA, 22 bp, Artificial Sequence
  chemically synthesized
tgatacattttcatgttcaaac

SEQ ID NO: 975969 - DNA, 22 bp, Artificial Sequence
  chemically synthesized
ttaggaaatgtttgaacatgaa

SEQ ID NO: 975970 - DNA, 22 bp, Artificial Sequence
  chemically synthesized
ggaaatgtttgaacatgaaaat

SEQ ID NO: 975971 - DNA, 22 bp, Artificial Sequence
  chemically synthesized
acattttgatacattttcatgt

SEQ ID NO: 975972 - DNA, 22 bp, Artificial Sequence
  chemically synthesized
aacattttgatacattttcatg

SEQ ID NO: 975973 - DNA, 22 bp, Artificial Sequence
  chemically synthesized
taacattttgatacattttcat

SEQ ID NO: 975974 - DNA, 22 bp, Artificial Sequence
  chemically synthesized
ttaacattttgatacattttca

SEQ ID NO: 975975 - DNA, 22 bp, Artificial Sequence
  chemically synthesized
gaacatgaaaatgtatcaaaat

SEQ ID NO: 975976 - DNA, 22 bp, Artificial Sequence
  chemically synthesized
aacatgaaaatgtatcaaaatg

SEQ ID NO: 975977 - DNA, 22 bp, Artificial Sequence
  chemically synthesized
cccagcaaaccacttttaacat

SEQ ID NO: 975978 - DNA, 22 bp, Artificial Sequence
  chemically synthesized
ccccagcaaaccacttttaaca

SEQ ID NO: 975979 - DNA, 22 bp, Artificial Sequence
  chemically synthesized
tccccagcaaaccacttttaac

SEQ ID NO: 975980 - DNA, 22 bp, Artificial Sequence
  chemically synthesized
atatcactttccccagcaaacc

SEQ ID NO: 975981 - DNA, 22 bp, Artificial Sequence
  chemically synthesized
aatatcactttccccagcaaac

SEQ ID NO: 975982 - DNA, 22 bp, Artificial Sequence
  chemically synthesized
taatatcactttccccagcaaa

SEQ ID NO: 975983 - DNA, 22 bp, Artificial Sequence
  chemically synthesized
tttaatatcactttccccagca

SEQ ID NO: 975984 - DNA, 22 bp, Artificial Sequence
  chemically synthesized
ctttaatatcactttccccagc

SEQ ID NO: 975985 - DNA, 22 bp, Artificial Sequence
  chemically synthesized
aaagtggtttgctggggaaagt

SEQ ID NO: 975986 - DNA, 22 bp, Artificial Sequence
  chemically synthesized
taaatatcttctttaatatcac

SEQ ID NO: 975987 - DNA, 22 bp, Artificial Sequence
  chemically synthesized
gctggggaaagtgatattaaag

SEQ ID NO: 975988 - DNA, 22 bp, Artificial Sequence
  chemically synthesized
ctggggaaagtgatattaaaga

SEQ ID NO: 975989 - DNA, 22 bp, Artificial Sequence
  chemically synthesized
gggaaagtgatattaaagaaga

SEQ ID NO: 975990 - DNA, 22 bp, Artificial Sequence
  chemically synthesized
aagaagatatttataatttttt

SEQ ID NO: 975991 - DNA, 22 bp, Artificial Sequence
  chemically synthesized
atagatgagcatagagaaaaaa

SEQ ID NO: 975992 - DNA, 22 bp, Artificial Sequence
  chemically synthesized
ataattttttctctatgctcat

SEQ ID NO: 975993 - DNA, 22 bp, Artificial Sequence
  chemically synthesized
taattttttctctatgctcatc

SEQ ID NO: 975994 - DNA, 22 bp, Artificial Sequence
  chemically synthesized
tttctctatgctcatctatcag

SEQ ID NO: 975995 - DNA, 22 bp, Artificial Sequence
  chemically synthesized
ttctctatgctcatctatcagc

SEQ ID NO: 975996 - DNA, 22 bp, Artificial Sequence
  chemically synthesized
tctctatgctcatctatcagcc

SEQ ID NO: 975997 - DNA, 22 bp, Artificial Sequence
  chemically synthesized
ctctatgctcatctatcagcct

SEQ ID NO: 975998 - DNA, 22 bp, Artificial Sequence
  chemically synthesized
tgaaaaatgtataggctgatag

SEQ ID NO: 975999 - DNA, 22 bp, Artificial Sequence
  chemically synthesized
tctatgctcatctatcagccta

SEQ ID NO: 976000 - DNA, 22 bp, Artificial Sequence
  chemically synthesized
tatgctcatctatcagcctata

SEQ ID NO: 976001 - DNA, 22 bp, Artificial Sequence
  chemically synthesized
ttatgaaaaatgtataggctga

SEQ ID NO: 976002 - DNA, 22 bp, Artificial Sequence
  chemically synthesized
attatgaaaaatgtataggctg

SEQ ID NO: 976003 - DNA, 22 bp, Artificial Sequence
  chemically synthesized
tgctcatctatcagcctataca

SEQ ID NO: 976004 - DNA, 22 bp, Artificial Sequence
  chemically synthesized
gtttattatgaaaaatgtatag

SEQ ID NO: 976005 - DNA, 22 bp, Artificial Sequence
  chemically synthesized
atctatcagcctatacattttt

SEQ ID NO: 976006 - DNA, 22 bp, Artificial Sequence
  chemically synthesized
tcagcctatacatttttcataa

SEQ ID NO: 976007 - DNA, 22 bp, Artificial Sequence
  chemically synthesized
tacatttttcataataaaccaa

SEQ ID NO: 976008 - DNA, 22 bp, Artificial Sequence
  chemically synthesized
agaatatgcaaataatattggt

SEQ ID NO: 976009 - DNA, 22 bp, Artificial Sequence
  chemically synthesized
cagaatatgcaaataatattgg

SEQ ID NO: 976010 - DNA, 22 bp, Artificial Sequence
  chemically synthesized
ttcataataaaccaatattatt

SEQ ID NO: 976011 - DNA, 22 bp, Artificial Sequence
  chemically synthesized
tcagaatatgcaaataatattg

SEQ ID NO: 976012 - DNA, 22 bp, Artificial Sequence
  chemically synthesized
tcataataaaccaatattattt

SEQ ID NO: 976013 - DNA, 22 bp, Artificial Sequence
  chemically synthesized
ttcagaatatgcaaataatatt

SEQ ID NO: 976014 - DNA, 22 bp, Artificial Sequence
  chemically synthesized
cataataaaccaatattatttg

SEQ ID NO: 976015 - DNA, 22 bp, Artificial Sequence
  chemically synthesized
tttcagaatatgcaaataatat

SEQ ID NO: 976016 - DNA, 22 bp, Artificial Sequence
  chemically synthesized
ataataaaccaatattatttgc

SEQ ID NO: 976017 - DNA, 22 bp, Artificial Sequence
  chemically synthesized
ttttcagaatatgcaaataata

SEQ ID NO: 976018 - DNA, 22 bp, Artificial Sequence
  chemically synthesized
tttgcatattctgaaaaaagtg

SEQ ID NO: 976019 - DNA, 22 bp, Artificial Sequence
  chemically synthesized
acaagtaaataacacttttttc

SEQ ID NO: 976020 - DNA, 22 bp, Artificial Sequence
  chemically synthesized
gcatattctgaaaaaagtgtta

SEQ ID NO: 976021 - DNA, 22 bp, Artificial Sequence
  chemically synthesized
catattctgaaaaaagtgttat

SEQ ID NO: 976022 - DNA, 22 bp, Artificial Sequence
  chemically synthesized
gctaacaagtaaataacacttt

SEQ ID NO: 976023 - DNA, 22 bp, Artificial Sequence
  chemically synthesized
agctaacaagtaaataacactt

SEQ ID NO: 976024 - DNA, 22 bp, Artificial Sequence
  chemically synthesized
tagctaacaagtaaataacact

SEQ ID NO: 976025 - DNA, 22 bp, Artificial Sequence
  chemically synthesized
tgaaaaaagtgttatttacttg

SEQ ID NO: 976026 - DNA, 22 bp, Artificial Sequence
  chemically synthesized
aaaaaagtgttatttacttgtt

SEQ ID NO: 976027 - DNA, 22 bp, Artificial Sequence
  chemically synthesized
tttacttgttagctaaaatttc

SEQ ID NO: 976028 - DNA, 22 bp, Artificial Sequence
  chemically synthesized
aatcaaataacatgaaatttta

SEQ ID NO: 976029 - DNA, 22 bp, Artificial Sequence
  chemically synthesized
acttgttagctaaaatttcatg

SEQ ID NO: 976030 - DNA, 22 bp, Artificial Sequence
  chemically synthesized
cttgttagctaaaatttcatgt

SEQ ID NO: 976031 - DNA, 22 bp, Artificial Sequence
  chemically synthesized
gttagctaaaatttcatgttat

SEQ ID NO: 976032 - DNA, 22 bp, Artificial Sequence
  chemically synthesized
ttagctaaaatttcatgttatt

SEQ ID NO: 976033 - DNA, 22 bp, Artificial Sequence
  chemically synthesized
gctaaaatttcatgttatttga

SEQ ID NO: 976034 - DNA, 22 bp, Artificial Sequence
  chemically synthesized
aaatttcatgttatttgattca

SEQ ID NO: 976035 - DNA, 22 bp, Artificial Sequence
  chemically synthesized
catgttatttgattcagactgt

SEQ ID NO: 976036 - DNA, 22 bp, Artificial Sequence
  chemically synthesized
agcagaagaaacacagtctgaa

SEQ ID NO: 976037 - DNA, 22 bp, Artificial Sequence
  chemically synthesized
atgttatttgattcagactgtg

SEQ ID NO: 976038 - DNA, 22 bp, Artificial Sequence
  chemically synthesized
tttgattcagactgtgtttctt

SEQ ID NO: 976039 - DNA, 22 bp, Artificial Sequence
  chemically synthesized
caaaaactgagcagaagaaaca

SEQ ID NO: 976040 - DNA, 22 bp, Artificial Sequence
  chemically synthesized
gattcagactgtgtttcttctg

SEQ ID NO: 976041 - DNA, 22 bp, Artificial Sequence
  chemically synthesized
attcagactgtgtttcttctgc

SEQ ID NO: 976042 - DNA, 22 bp, Artificial Sequence
  chemically synthesized
agactgtgtttcttctgctcag

SEQ ID NO: 976043 - DNA, 22 bp, Artificial Sequence
  chemically synthesized
tgtttcttctgctcagtttttg

SEQ ID NO: 976044 - DNA, 22 bp, Artificial Sequence
  chemically synthesized
cttctgctcagtttttggaatg

SEQ ID NO: 976045 - DNA, 22 bp, Artificial Sequence
  chemically synthesized
ttctgctcagtttttggaatgc

SEQ ID NO: 976046 - DNA, 22 bp, Artificial Sequence
  chemically synthesized
ctgctcagtttttggaatgctc

SEQ ID NO: 976047 - DNA, 22 bp, Artificial Sequence
  chemically synthesized
agtgtagagagagagcattcca

SEQ ID NO: 976048 - DNA, 22 bp, Artificial Sequence
  chemically synthesized
tgctcagtttttggaatgctct

SEQ ID NO: 976049 - DNA, 22 bp, Artificial Sequence
  chemically synthesized
ctcagtttttggaatgctctct

SEQ ID NO: 976050 - DNA, 22 bp, Artificial Sequence
  chemically synthesized
agtttttggaatgctctctctc

SEQ ID NO: 976051 - DNA, 22 bp, Artificial Sequence
  chemically synthesized
agatagattgagtgtagagaga

SEQ ID NO: 976052 - DNA, 22 bp, Artificial Sequence
  chemically synthesized
ttggaatgctctctctctacac

SEQ ID NO: 976053 - DNA, 22 bp, Artificial Sequence
  chemically synthesized
tggaatgctctctctctacact

SEQ ID NO: 976054 - DNA, 22 bp, Artificial Sequence
  chemically synthesized
tcagatagattgagtgtagaga

SEQ ID NO: 976055 - DNA, 22 bp, Artificial Sequence
  chemically synthesized
ggaatgctctctctctacactc

SEQ ID NO: 976056 - DNA, 22 bp, Artificial Sequence
  chemically synthesized
ctcagatagattgagtgtagag

SEQ ID NO: 976057 - DNA, 22 bp, Artificial Sequence
  chemically synthesized
gaatgctctctctctacactca

SEQ ID NO: 976058 - DNA, 22 bp, Artificial Sequence
  chemically synthesized
ttctcagatagattgagtgtag

SEQ ID NO: 976059 - DNA, 22 bp, Artificial Sequence
  chemically synthesized
attcttctcagatagattgagt

SEQ ID NO: 976060 - DNA, 22 bp, Artificial Sequence
  chemically synthesized
tctctctacactcaatctatct

SEQ ID NO: 976061 - DNA, 22 bp, Artificial Sequence
  chemically synthesized
ttgattcttctcagatagattg

SEQ ID NO: 976062 - DNA, 22 bp, Artificial Sequence
  chemically synthesized
tctctacactcaatctatctga

SEQ ID NO: 976063 - DNA, 22 bp, Artificial Sequence
  chemically synthesized
tctacactcaatctatctgaga

SEQ ID NO: 976064 - DNA, 22 bp, Artificial Sequence
  chemically synthesized
tacactcaatctatctgagaag

SEQ ID NO: 976065 - DNA, 22 bp, Artificial Sequence
  chemically synthesized
tagctgttgattcttctcagat

SEQ ID NO: 976066 - DNA, 22 bp, Artificial Sequence
  chemically synthesized
cactcaatctatctgagaagaa

SEQ ID NO: 976067 - DNA, 22 bp, Artificial Sequence
  chemically synthesized
tattgtagctgttgattcttct

SEQ ID NO: 976068 - DNA, 22 bp, Artificial Sequence
  chemically synthesized
aatctatctgagaagaatcaac

SEQ ID NO: 976069 - DNA, 22 bp, Artificial Sequence
  chemically synthesized
tctgagaagaatcaacagctac

SEQ ID NO: 976070 - DNA, 22 bp, Artificial Sequence
  chemically synthesized
agaagaatcaacagctacaata

SEQ ID NO: 976071 - DNA, 22 bp, Artificial Sequence
  chemically synthesized
aatgcaaaaaaaaaattgtatt

SEQ ID NO: 976072 - DNA, 22 bp, Artificial Sequence
  chemically synthesized
taaatgcaaaaaaaaaattgta

SEQ ID NO: 976073 - DNA, 22 bp, Artificial Sequence
  chemically synthesized
caatacaattttttttttgcat

SEQ ID NO: 976074 - DNA, 22 bp, Artificial Sequence
  chemically synthesized
ggcgcatagagtctctaaatgc

SEQ ID NO: 976075 - DNA, 22 bp, Artificial Sequence
  chemically synthesized
tgggcgcatagagtctctaaat

SEQ ID NO: 976076 - DNA, 22 bp, Artificial Sequence
  chemically synthesized
tttttttgcatttagagactct

SEQ ID NO: 976077 - DNA, 22 bp, Artificial Sequence
  chemically synthesized
ttctgggcgcatagagtctcta

SEQ ID NO: 976078 - DNA, 22 bp, Artificial Sequence
  chemically synthesized
ttttttgcatttagagactcta

SEQ ID NO: 976079 - DNA, 22 bp, Artificial Sequence
  chemically synthesized
tttttgcatttagagactctat

SEQ ID NO: 976080 - DNA, 22 bp, Artificial Sequence
  chemically synthesized
ttttgcatttagagactctatg

SEQ ID NO: 976081 - DNA, 22 bp, Artificial Sequence
  chemically synthesized
tttgcatttagagactctatgc

SEQ ID NO: 976082 - DNA, 22 bp, Artificial Sequence
  chemically synthesized
ttgcatttagagactctatgcg

SEQ ID NO: 976083 - DNA, 22 bp, Artificial Sequence
  chemically synthesized
tgcatttagagactctatgcgc

SEQ ID NO: 976084 - DNA, 22 bp, Artificial Sequence
  chemically synthesized
gcatttagagactctatgcgcc

SEQ ID NO: 976085 - DNA, 22 bp, Artificial Sequence
  chemically synthesized
catttagagactctatgcgccc

SEQ ID NO: 976086 - DNA, 22 bp, Artificial Sequence
  chemically synthesized
agagactctatgcgcccagaat

SEQ ID NO: 976087 - DNA, 22 bp, Artificial Sequence
  chemically synthesized
gagactctatgcgcccagaata

SEQ ID NO: 976088 - DNA, 22 bp, Artificial Sequence
  chemically synthesized
tatgcgcccagaataattctgt

SEQ ID NO: 976089 - DNA, 22 bp, Artificial Sequence
  chemically synthesized
tgcgcccagaataattctgtga

SEQ ID NO: 976090 - DNA, 22 bp, Artificial Sequence
  chemically synthesized
gataaagagaaatacatatcac

SEQ ID NO: 976091 - DNA, 22 bp, Artificial Sequence
  chemically synthesized
agataaagagaaatacatatca

SEQ ID NO: 976092 - DNA, 22 bp, Artificial Sequence
  chemically synthesized
tagataaagagaaatacatatc

SEQ ID NO: 976093 - DNA, 22 bp, Artificial Sequence
  chemically synthesized
ttagataaagagaaatacatat

SEQ ID NO: 976094 - DNA, 22 bp, Artificial Sequence
  chemically synthesized
tgtgatatgtatttctctttat

SEQ ID NO: 976095 - DNA, 22 bp, Artificial Sequence
  chemically synthesized
tatagacttttagataaagaga

SEQ ID NO: 976096 - DNA, 22 bp, Artificial Sequence
  chemically synthesized
tgatatgtatttctctttatct

SEQ ID NO: 976097 - DNA, 22 bp, Artificial Sequence
  chemically synthesized
tctatatagacttttagataaa

SEQ ID NO: 976098 - DNA, 22 bp, Artificial Sequence
  chemically synthesized
gtctatatagacttttagataa

SEQ ID NO: 976099 - DNA, 22 bp, Artificial Sequence
  chemically synthesized
ctctttatctaaaagtctatat

SEQ ID NO: 976100 - DNA, 22 bp, Artificial Sequence
  chemically synthesized
tctttatctaaaagtctatata

SEQ ID NO: 976101 - DNA, 22 bp, Artificial Sequence
  chemically synthesized
tttatctaaaagtctatataga

SEQ ID NO: 976102 - DNA, 22 bp, Artificial Sequence
  chemically synthesized
tatctaaaagtctatatagaca

SEQ ID NO: 976103 - DNA, 22 bp, Artificial Sequence
  chemically synthesized
atctaaaagtctatatagacaa

SEQ ID NO: 976104 - DNA, 22 bp, Artificial Sequence
  chemically synthesized
tctaaaagtctatatagacaag

SEQ ID NO: 976105 - DNA, 22 bp, Artificial Sequence
  chemically synthesized
aaagtctatatagacaaggggc

SEQ ID NO: 976106 - DNA, 22 bp, Artificial Sequence
  chemically synthesized
tatagacaaggggctctgatac

SEQ ID NO: 976107 - DNA, 22 bp, Artificial Sequence
  chemically synthesized
aagaagaaaccatgtatcagag

SEQ ID NO: 976108 - DNA, 22 bp, Artificial Sequence
  chemically synthesized
aaagaagaaaccatgtatcaga

SEQ ID NO: 976109 - DNA, 22 bp, Artificial Sequence
  chemically synthesized
gatggtggcttaaagaagaaac

SEQ ID NO: 976110 - DNA, 22 bp, Artificial Sequence
  chemically synthesized
tgatacatggtttcttctttaa

SEQ ID NO: 976111 - DNA, 22 bp, Artificial Sequence
  chemically synthesized
atacatggtttcttctttaagc

SEQ ID NO: 976112 - DNA, 22 bp, Artificial Sequence
  chemically synthesized
cagcatgttcgatggtggctta

SEQ ID NO: 976113 - DNA, 22 bp, Artificial Sequence
  chemically synthesized
ctgcagcatgttcgatggtggc

SEQ ID NO: 976114 - DNA, 22 bp, Artificial Sequence
  chemically synthesized
cctgcagcatgttcgatggtgg

SEQ ID NO: 976115 - DNA, 22 bp, Artificial Sequence
  chemically synthesized
tcctgcagcatgttcgatggtg

SEQ ID NO: 976116 - DNA, 22 bp, Artificial Sequence
  chemically synthesized
cttctttaagccaccatcgaac

SEQ ID NO: 976117 - DNA, 22 bp, Artificial Sequence
  chemically synthesized
ttctttaagccaccatcgaaca

SEQ ID NO: 976118 - DNA, 22 bp, Artificial Sequence
  chemically synthesized
ctttaagccaccatcgaacatg

SEQ ID NO: 976119 - DNA, 22 bp, Artificial Sequence
  chemically synthesized
actttcctgcagcatgttcgat

SEQ ID NO: 976120 - DNA, 22 bp, Artificial Sequence
  chemically synthesized
tttaagccaccatcgaacatgc

SEQ ID NO: 976121 - DNA, 22 bp, Artificial Sequence
  chemically synthesized
taagccaccatcgaacatgctg

SEQ ID NO: 976122 - DNA, 22 bp, Artificial Sequence
  chemically synthesized
aagccaccatcgaacatgctgc

SEQ ID NO: 976123 - DNA, 22 bp, Artificial Sequence
  chemically synthesized
agccaccatcgaacatgctgca

SEQ ID NO: 976124 - DNA, 22 bp, Artificial Sequence
  chemically synthesized
gatatccccacgattaactttc

SEQ ID NO: 976125 - DNA, 22 bp, Artificial Sequence
  chemically synthesized
ttggatatccccacgattaact

SEQ ID NO: 976126 - DNA, 22 bp, Artificial Sequence
  chemically synthesized
tgttggatatccccacgattaa

SEQ ID NO: 976127 - DNA, 22 bp, Artificial Sequence
  chemically synthesized
caggaaagttaatcgtggggat

SEQ ID NO: 976128 - DNA, 22 bp, Artificial Sequence
  chemically synthesized
atacaggtctctgttggatatc

SEQ ID NO: 976129 - DNA, 22 bp, Artificial Sequence
  chemically synthesized
ttgatacaggtctctgttggat

SEQ ID NO: 976130 - DNA, 22 bp, Artificial Sequence
  chemically synthesized
atcgtggggatatccaacagag

SEQ ID NO: 976131 - DNA, 22 bp, Artificial Sequence
  chemically synthesized
tgttattgatacaggtctctgt

SEQ ID NO: 976132 - DNA, 22 bp, Artificial Sequence
  chemically synthesized
atgttattgatacaggtctctg

SEQ ID NO: 976133 - DNA, 22 bp, Artificial Sequence
  chemically synthesized
ttatgttattgatacaggtctc

SEQ ID NO: 976134 - DNA, 22 bp, Artificial Sequence
  chemically synthesized
cttatgttattgatacaggtct

SEQ ID NO: 976135 - DNA, 22 bp, Artificial Sequence
  chemically synthesized
tcttatgttattgatacaggtc

SEQ ID NO: 976136 - DNA, 22 bp, Artificial Sequence
  chemically synthesized
ccattttcttatgttattgata

SEQ ID NO: 976137 - DNA, 22 bp, Artificial Sequence
  chemically synthesized
cccattttcttatgttattgat

SEQ ID NO: 976138 - DNA, 22 bp, Artificial Sequence
  chemically synthesized
tatcaataacataagaaaatgg

SEQ ID NO: 976139 - DNA, 22 bp, Artificial Sequence
  chemically synthesized
ggaaataaaagtatcgggtgaa

SEQ ID NO: 976140 - DNA, 22 bp, Artificial Sequence
  chemically synthesized
accctaggaaataaaagtatcg

SEQ ID NO: 976141 - DNA, 22 bp, Artificial Sequence
  chemically synthesized
caccctaggaaataaaagtatc

SEQ ID NO: 976142 - DNA, 22 bp, Artificial Sequence
  chemically synthesized
tcaccctaggaaataaaagtat

SEQ ID NO: 976143 - DNA, 22 bp, Artificial Sequence
  chemically synthesized
ttcaccctaggaaataaaagta

SEQ ID NO: 976144 - DNA, 22 bp, Artificial Sequence
  chemically synthesized
tttcaccctaggaaataaaagt

SEQ ID NO: 976145 - DNA, 22 bp, Artificial Sequence
  chemically synthesized
tttttcaccctaggaaataaaa

SEQ ID NO: 976146 - DNA, 22 bp, Artificial Sequence
  chemically synthesized
ctttttcaccctaggaaataaa

SEQ ID NO: 976147 - DNA, 22 bp, Artificial Sequence
  chemically synthesized
acccgatacttttatttcctag

SEQ ID NO: 976148 - DNA, 22 bp, Artificial Sequence
  chemically synthesized
atttctttttcaccctaggaaa

SEQ ID NO: 976149 - DNA, 22 bp, Artificial Sequence
  chemically synthesized
taatttctttttcaccctagga

SEQ ID NO: 976150 - DNA, 22 bp, Artificial Sequence
  chemically synthesized
gctctaatttctttttcaccct

SEQ ID NO: 976151 - DNA, 22 bp, Artificial Sequence
  chemically synthesized
ttatttcctagggtgaaaaaga

SEQ ID NO: 976152 - DNA, 22 bp, Artificial Sequence
  chemically synthesized
tatttcctagggtgaaaaagaa

SEQ ID NO: 976153 - DNA, 22 bp, Artificial Sequence
  chemically synthesized
cctggctctaatttctttttca

SEQ ID NO: 976154 - DNA, 22 bp, Artificial Sequence
  chemically synthesized
atttcctagggtgaaaaagaaa

SEQ ID NO: 976155 - DNA, 22 bp, Artificial Sequence
  chemically synthesized
tttcctagggtgaaaaagaaat

SEQ ID NO: 976156 - DNA, 22 bp, Artificial Sequence
  chemically synthesized
cctagggtgaaaaagaaattag

SEQ ID NO: 976157 - DNA, 22 bp, Artificial Sequence
  chemically synthesized
ctagggtgaaaaagaaattaga

SEQ ID NO: 976158 - DNA, 22 bp, Artificial Sequence
  chemically synthesized
gggtgaaaaagaaattagagcc

SEQ ID NO: 976159 - DNA, 22 bp, Artificial Sequence
  chemically synthesized
taccagatattacctggctcta

SEQ ID NO: 976160 - DNA, 22 bp, Artificial Sequence
  chemically synthesized
ataccagatattacctggctct

SEQ ID NO: 976161 - DNA, 22 bp, Artificial Sequence
  chemically synthesized
tataccagatattacctggctc

SEQ ID NO: 976162 - DNA, 22 bp, Artificial Sequence
  chemically synthesized
ttataccagatattacctggct

SEQ ID NO: 976163 - DNA, 22 bp, Artificial Sequence
  chemically synthesized
tttttataccagatattacctg

SEQ ID NO: 976164 - DNA, 22 bp, Artificial Sequence
  chemically synthesized
cctatttttataccagatatta

SEQ ID NO: 976165 - DNA, 22 bp, Artificial Sequence
  chemically synthesized
gagccaggtaatatctggtata

SEQ ID NO: 976166 - DNA, 22 bp, Artificial Sequence
  chemically synthesized
tatgatattacctatttttata

SEQ ID NO: 976167 - DNA, 22 bp, Artificial Sequence
  chemically synthesized
gtatgatattacctatttttat

SEQ ID NO: 976168 - DNA, 22 bp, Artificial Sequence
  chemically synthesized
tgtatgatattacctattttta

SEQ ID NO: 976169 - DNA, 22 bp, Artificial Sequence
  chemically synthesized
atgaattttgtatgatattacc

SEQ ID NO: 976170 - DNA, 22 bp, Artificial Sequence
  chemically synthesized
gtataaaaataggtaatatcat

SEQ ID NO: 976171 - DNA, 22 bp, Artificial Sequence
  chemically synthesized
aatgaattttgtatgatattac

SEQ ID NO: 976172 - DNA, 22 bp, Artificial Sequence
  chemically synthesized
taatgaattttgtatgatatta

SEQ ID NO: 976173 - DNA, 22 bp, Artificial Sequence
  chemically synthesized
tttaatgaattttgtatgatat

SEQ ID NO: 976174 - DNA, 22 bp, Artificial Sequence
  chemically synthesized
ctttaatgaattttgtatgata

SEQ ID NO: 976175 - DNA, 22 bp, Artificial Sequence
  chemically synthesized
tctttaatgaattttgtatgat

SEQ ID NO: 976176 - DNA, 22 bp, Artificial Sequence
  chemically synthesized
agattttctttaatgaattttg

SEQ ID NO: 976177 - DNA, 22 bp, Artificial Sequence
  chemically synthesized
cgcactcagattttctttaatg

SEQ ID NO: 976178 - DNA, 22 bp, Artificial Sequence
  chemically synthesized
ccgcactcagattttctttaat

SEQ ID NO: 976179 - DNA, 22 bp, Artificial Sequence
  chemically synthesized
gtaatttccgcactcagatttt

SEQ ID NO: 976180 - DNA, 22 bp, Artificial Sequence
  chemically synthesized
ggtaatttccgcactcagattt

SEQ ID NO: 976181 - DNA, 22 bp, Artificial Sequence
  chemically synthesized
attaaagaaaatctgagtgcgg

SEQ ID NO: 976182 - DNA, 22 bp, Artificial Sequence
  chemically synthesized
tgatttggtaatttccgcactc

SEQ ID NO: 976183 - DNA, 22 bp, Artificial Sequence
  chemically synthesized
aagaaaatctgagtgcggaaat

SEQ ID NO: 976184 - DNA, 22 bp, Artificial Sequence
  chemically synthesized
tgtgatttggtaatttccgcac

SEQ ID NO: 976185 - DNA, 22 bp, Artificial Sequence
  chemically synthesized
atattctgtgatttggtaattt

SEQ ID NO: 976186 - DNA, 22 bp, Artificial Sequence
  chemically synthesized
taatattctgtgatttggtaat

SEQ ID NO: 976187 - DNA, 22 bp, Artificial Sequence
  chemically synthesized
agtgcggaaattaccaaatcac

SEQ ID NO: 976188 - DNA, 22 bp, Artificial Sequence
  chemically synthesized
cagctctaatattctgtgattt

SEQ ID NO: 976189 - DNA, 22 bp, Artificial Sequence
  chemically synthesized
ccagctctaatattctgtgatt

SEQ ID NO: 976190 - DNA, 22 bp, Artificial Sequence
  chemically synthesized
tccagctctaatattctgtgat

SEQ ID NO: 976191 - DNA, 22 bp, Artificial Sequence
  chemically synthesized
ttccagctctaatattctgtga

SEQ ID NO: 976192 - DNA, 22 bp, Artificial Sequence
  chemically synthesized
ccaaatcacagaatattagagc

SEQ ID NO: 976193 - DNA, 22 bp, Artificial Sequence
  chemically synthesized
tacaatgtcttttccagctcta

SEQ ID NO: 976194 - DNA, 22 bp, Artificial Sequence
  chemically synthesized
tatctgtacaatgtcttttcca

SEQ ID NO: 976195 - DNA, 22 bp, Artificial Sequence
  chemically synthesized
tgtatctgtacaatgtcttttc

SEQ ID NO: 976196 - DNA, 22 bp, Artificial Sequence
  chemically synthesized
ctgtatctgtacaatgtctttt

SEQ ID NO: 976197 - DNA, 22 bp, Artificial Sequence
  chemically synthesized
gagctggaaaagacattgtaca

SEQ ID NO: 976198 - DNA, 22 bp, Artificial Sequence
  chemically synthesized
aaatttctgtatctgtacaatg

SEQ ID NO: 976199 - DNA, 22 bp, Artificial Sequence
  chemically synthesized
caaatttctgtatctgtacaat

SEQ ID NO: 976200 - DNA, 22 bp, Artificial Sequence
  chemically synthesized
tcaaatttctgtatctgtacaa

SEQ ID NO: 976201 - DNA, 22 bp, Artificial Sequence
  chemically synthesized
ttcaaatttctgtatctgtaca

SEQ ID NO: 976202 - DNA, 22 bp, Artificial Sequence
  chemically synthesized
tttcaaatttctgtatctgtac

SEQ ID NO: 976203 - DNA, 22 bp, Artificial Sequence
  chemically synthesized
gaaaagacattgtacagataca

SEQ ID NO: 976204 - DNA, 22 bp, Artificial Sequence
  chemically synthesized
ttttcaaatttctgtatctgta

SEQ ID NO: 976205 - DNA, 22 bp, Artificial Sequence
  chemically synthesized
tttttcaaatttctgtatctgt

SEQ ID NO: 976206 - DNA, 22 bp, Artificial Sequence
  chemically synthesized
ttttttcaaatttctgtatctg

SEQ ID NO: 976207 - DNA, 22 bp, Artificial Sequence
  chemically synthesized
tttttttcaaatttctgtatct

SEQ ID NO: 976208 - DNA, 22 bp, Artificial Sequence
  chemically synthesized
ttttttttcaaatttctgtatc

SEQ ID NO: 976209 - DNA, 22 bp, Artificial Sequence
  chemically synthesized
tttttttttcaaatttctgtat

SEQ ID NO: 976210 - DNA, 22 bp, Artificial Sequence
  chemically synthesized
tattttttttttttcaaatttc

SEQ ID NO: 976211 - DNA, 22 bp, Artificial Sequence
  chemically synthesized
tacagatacagaaatttgaaaa

SEQ ID NO: 976212 - DNA, 22 bp, Artificial Sequence
  chemically synthesized
tgtattttttttttttcaaatt

SEQ ID NO: 976213 - DNA, 22 bp, Artificial Sequence
  chemically synthesized
atctctgtattttttttttttc

SEQ ID NO: 976214 - DNA, 22 bp, Artificial Sequence
  chemically synthesized
catctctgtatttttttttttt

SEQ ID NO: 976215 - DNA, 22 bp, Artificial Sequence
  chemically synthesized
gaaaaaaaaaaaatacagagat

SEQ ID NO: 976216 - DNA, 22 bp, Artificial Sequence
  chemically synthesized
aaaaaaaaaaaatacagagatg

SEQ ID NO: 976217 - DNA, 22 bp, Artificial Sequence
  chemically synthesized
tgaggacagcagaatgatcact

SEQ ID NO: 976218 - DNA, 22 bp, Artificial Sequence
  chemically synthesized
tgtgaggacagcagaatgatca

SEQ ID NO: 976219 - DNA, 22 bp, Artificial Sequence
  chemically synthesized
ctgtgaggacagcagaatgatc

SEQ ID NO: 976220 - DNA, 22 bp, Artificial Sequence
  chemically synthesized
tgctgtcctcacagaaatgcct

SEQ ID NO: 976221 - DNA, 22 bp, Artificial Sequence
  chemically synthesized
aatagaagtagcaggcatttct

SEQ ID NO: 976222 - DNA, 22 bp, Artificial Sequence
  chemically synthesized
ctgtcctcacagaaatgcctgc

SEQ ID NO: 976223 - DNA, 22 bp, Artificial Sequence
  chemically synthesized
tcctcacagaaatgcctgctac

SEQ ID NO: 976224 - DNA, 22 bp, Artificial Sequence
  chemically synthesized
acagaaatgcctgctacttcta

SEQ ID NO: 976225 - DNA, 22 bp, Artificial Sequence
  chemically synthesized
aaggaagatgagaggaaaattc

SEQ ID NO: 976226 - DNA, 22 bp, Artificial Sequence
  chemically synthesized
ctacttctattgaattttcctc

SEQ ID NO: 976227 - DNA, 22 bp, Artificial Sequence
  chemically synthesized
aaaggaagatgagaggaaaatt

SEQ ID NO: 976228 - DNA, 22 bp, Artificial Sequence
  chemically synthesized
cttctattgaattttcctctca

SEQ ID NO: 976229 - DNA, 22 bp, Artificial Sequence
  chemically synthesized
ctattgaattttcctctcatct

SEQ ID NO: 976230 - DNA, 22 bp, Artificial Sequence
  chemically synthesized
tattgaattttcctctcatctt

SEQ ID NO: 976231 - DNA, 22 bp, Artificial Sequence
  chemically synthesized
ttgaattttcctctcatcttcc

SEQ ID NO: 976232 - DNA, 22 bp, Artificial Sequence
  chemically synthesized
cagaaatgcttaaaggaagatg

SEQ ID NO: 976233 - DNA, 22 bp, Artificial Sequence
  chemically synthesized
aattttcctctcatcttccttt

SEQ ID NO: 976234 - DNA, 22 bp, Artificial Sequence
  chemically synthesized
tcctctcatcttcctttaagca

SEQ ID NO: 976235 - DNA, 22 bp, Artificial Sequence
  chemically synthesized
cctctcatcttcctttaagcat

SEQ ID NO: 976236 - DNA, 22 bp, Artificial Sequence
  chemically synthesized
ctctcatcttcctttaagcatt

SEQ ID NO: 976237 - DNA, 22 bp, Artificial Sequence
  chemically synthesized
tcatcttcctttaagcatttct

SEQ ID NO: 976238 - DNA, 22 bp, Artificial Sequence
  chemically synthesized
atcttcctttaagcatttctgg

SEQ ID NO: 976239 - DNA, 22 bp, Artificial Sequence
  chemically synthesized
cacacaccacgcactccagaaa

SEQ ID NO: 976240 - DNA, 22 bp, Artificial Sequence
  chemically synthesized
cctttaagcatttctggagtgc

SEQ ID NO: 976241 - DNA, 22 bp, Artificial Sequence
  chemically synthesized
ctttaagcatttctggagtgcg

SEQ ID NO: 976242 - DNA, 22 bp, Artificial Sequence
  chemically synthesized
taagcatttctggagtgcgtgg

SEQ ID NO: 976243 - DNA, 22 bp, Artificial Sequence
  chemically synthesized
tgattacacacaccacgcactc

SEQ ID NO: 976244 - DNA, 22 bp, Artificial Sequence
  chemically synthesized
aagcatttctggagtgcgtggt

SEQ ID NO: 976245 - DNA, 22 bp, Artificial Sequence
  chemically synthesized
atgattacacacaccacgcact

SEQ ID NO: 976246 - DNA, 22 bp, Artificial Sequence
  chemically synthesized
agcatttctggagtgcgtggtg

SEQ ID NO: 976247 - DNA, 22 bp, Artificial Sequence
  chemically synthesized
tatgattacacacaccacgcac

SEQ ID NO: 976248 - DNA, 22 bp, Artificial Sequence
  chemically synthesized
ctggagtgcgtggtgtgtgtaa

SEQ ID NO: 976249 - DNA, 22 bp, Artificial Sequence
  chemically synthesized
tggagtgcgtggtgtgtgtaat

SEQ ID NO: 976250 - DNA, 22 bp, Artificial Sequence
  chemically synthesized
gagtgcgtggtgtgtgtaatca

SEQ ID NO: 976251 - DNA, 22 bp, Artificial Sequence
  chemically synthesized
acacaaaactttatgattacac

SEQ ID NO: 976252 - DNA, 22 bp, Artificial Sequence
  chemically synthesized
aacacaaaactttatgattaca

SEQ ID NO: 976253 - DNA, 22 bp, Artificial Sequence
  chemically synthesized
gcatttaacacaaaactttatg

SEQ ID NO: 976254 - DNA, 22 bp, Artificial Sequence
  chemically synthesized
ggcatttaacacaaaactttat

SEQ ID NO: 976255 - DNA, 22 bp, Artificial Sequence
  chemically synthesized
tggcatttaacacaaaacttta

SEQ ID NO: 976256 - DNA, 22 bp, Artificial Sequence
  chemically synthesized
ttggcatttaacacaaaacttt

SEQ ID NO: 976257 - DNA, 22 bp, Artificial Sequence
  chemically synthesized
tttggcatttaacacaaaactt

SEQ ID NO: 976258 - DNA, 22 bp, Artificial Sequence
  chemically synthesized
ctttttggcatttaacacaaaa

SEQ ID NO: 976259 - DNA, 22 bp, Artificial Sequence
  chemically synthesized
ctcctttttggcatttaacaca

SEQ ID NO: 976260 - DNA, 22 bp, Artificial Sequence
  chemically synthesized
cctcctttttggcatttaacac

SEQ ID NO: 976261 - DNA, 22 bp, Artificial Sequence
  chemically synthesized
tgatttcctcctttttggcatt

SEQ ID NO: 976262 - DNA, 22 bp, Artificial Sequence
  chemically synthesized
atgatttcctcctttttggcat

SEQ ID NO: 976263 - DNA, 22 bp, Artificial Sequence
  chemically synthesized
tatgatttcctcctttttggca

SEQ ID NO: 976264 - DNA, 22 bp, Artificial Sequence
  chemically synthesized
ttatgatttcctcctttttggc

SEQ ID NO: 976265 - DNA, 22 bp, Artificial Sequence
  chemically synthesized
tgtgttaaatgccaaaaaggag

SEQ ID NO: 976266 - DNA, 22 bp, Artificial Sequence
  chemically synthesized
ttttatgatttcctcctttttg

SEQ ID NO: 976267 - DNA, 22 bp, Artificial Sequence
  chemically synthesized
gtgttaaatgccaaaaaggagg

SEQ ID NO: 976268 - DNA, 22 bp, Artificial Sequence
  chemically synthesized
tgttaaatgccaaaaaggagga

SEQ ID NO: 976269 - DNA, 22 bp, Artificial Sequence
  chemically synthesized
aatgccaaaaaggaggaaatca

SEQ ID NO: 976270 - DNA, 22 bp, Artificial Sequence
  chemically synthesized
caccgctcttttatgatttcct

SEQ ID NO: 976271 - DNA, 22 bp, Artificial Sequence
  chemically synthesized
tcaaaatataatagaaaaatta

SEQ ID NO: 976272 - DNA, 22 bp, Artificial Sequence
  chemically synthesized
tgcagagggcaggactatcaaa

SEQ ID NO: 976273 - DNA, 22 bp, Artificial Sequence
  chemically synthesized
ttctattatattttgatagtcc

SEQ ID NO: 976274 - DNA, 22 bp, Artificial Sequence
  chemically synthesized
tctattatattttgatagtcct

SEQ ID NO: 976275 - DNA, 22 bp, Artificial Sequence
  chemically synthesized
ctattatattttgatagtcctg

SEQ ID NO: 976276 - DNA, 22 bp, Artificial Sequence
  chemically synthesized
tattatattttgatagtcctgc

SEQ ID NO: 976277 - DNA, 22 bp, Artificial Sequence
  chemically synthesized
ttatattttgatagtcctgccc

SEQ ID NO: 976278 - DNA, 22 bp, Artificial Sequence
  chemically synthesized
tattttgatagtcctgccctct

SEQ ID NO: 976279 - DNA, 22 bp, Artificial Sequence
  chemically synthesized
tgatagtcctgccctctgcata

SEQ ID NO: 976280 - DNA, 22 bp, Artificial Sequence
  chemically synthesized
gatagtcctgccctctgcataa

SEQ ID NO: 976281 - DNA, 22 bp, Artificial Sequence
  chemically synthesized
gaaacaaaataattatgcagag

SEQ ID NO: 976282 - DNA, 22 bp, Artificial Sequence
  chemically synthesized
atagtcctgccctctgcataat

SEQ ID NO: 976283 - DNA, 22 bp, Artificial Sequence
  chemically synthesized
gagacattagaaacaaaataat

SEQ ID NO: 976284 - DNA, 22 bp, Artificial Sequence
  chemically synthesized
ccctctgcataattattttgtt

SEQ ID NO: 976285 - DNA, 22 bp, Artificial Sequence
  chemically synthesized
tgttggagacattagaaacaaa

SEQ ID NO: 976286 - DNA, 22 bp, Artificial Sequence
  chemically synthesized
tgcataattattttgtttctaa

SEQ ID NO: 976287 - DNA, 22 bp, Artificial Sequence
  chemically synthesized
cataattattttgtttctaatg

SEQ ID NO: 976288 - DNA, 22 bp, Artificial Sequence
  chemically synthesized
agagattatgttggagacatta

SEQ ID NO: 976289 - DNA, 22 bp, Artificial Sequence
  chemically synthesized
aagagattatgttggagacatt

SEQ ID NO: 976290 - DNA, 22 bp, Artificial Sequence
  chemically synthesized
ttttgtttctaatgtctccaac

SEQ ID NO: 976291 - DNA, 22 bp, Artificial Sequence
  chemically synthesized
tgtttctaatgtctccaacata

SEQ ID NO: 976292 - DNA, 22 bp, Artificial Sequence
  chemically synthesized
gtttctaatgtctccaacataa

SEQ ID NO: 976293 - DNA, 22 bp, Artificial Sequence
  chemically synthesized
tttctaatgtctccaacataat

SEQ ID NO: 976294 - DNA, 22 bp, Artificial Sequence
  chemically synthesized
ctaatgtctccaacataatctc

SEQ ID NO: 976295 - DNA, 22 bp, Artificial Sequence
  chemically synthesized
agaaatgtttaagagattatgt

SEQ ID NO: 976296 - DNA, 22 bp, Artificial Sequence
  chemically synthesized
taatgtctccaacataatctct

SEQ ID NO: 976297 - DNA, 22 bp, Artificial Sequence
  chemically synthesized
aagaaatgtttaagagattatg

SEQ ID NO: 976298 - DNA, 22 bp, Artificial Sequence
  chemically synthesized
taagaaatgtttaagagattat

SEQ ID NO: 976299 - DNA, 22 bp, Artificial Sequence
  chemically synthesized
atgtctccaacataatctctta

SEQ ID NO: 976300 - DNA, 22 bp, Artificial Sequence
  chemically synthesized
caacataatctcttaaacattt

SEQ ID NO: 976301 - DNA, 22 bp, Artificial Sequence
  chemically synthesized
ggataaaaaaaatattttaaga

SEQ ID NO: 976302 - DNA, 22 bp, Artificial Sequence
  chemically synthesized
aggataaaaaaaatattttaag

SEQ ID NO: 976303 - DNA, 22 bp, Artificial Sequence
  chemically synthesized
ttaaacatttcttaaaatattt

SEQ ID NO: 976304 - DNA, 22 bp, Artificial Sequence
  chemically synthesized
aaacatttcttaaaatattttt

SEQ ID NO: 976305 - DNA, 22 bp, Artificial Sequence
  chemically synthesized
aacatttcttaaaatatttttt

SEQ ID NO: 976306 - DNA, 22 bp, Artificial Sequence
  chemically synthesized
gcatttaggataaaaaaaatat

SEQ ID NO: 976307 - DNA, 22 bp, Artificial Sequence
  chemically synthesized
cttaaaatattttttttatcct

SEQ ID NO: 976308 - DNA, 22 bp, Artificial Sequence
  chemically synthesized
ttaaaatattttttttatccta

SEQ ID NO: 976309 - DNA, 22 bp, Artificial Sequence
  chemically synthesized
gtcggctcgcatttaggataaa

SEQ ID NO: 976310 - DNA, 22 bp, Artificial Sequence
  chemically synthesized
aaaatattttttttatcctaaa

SEQ ID NO: 976311 - DNA, 22 bp, Artificial Sequence
  chemically synthesized
agtcggctcgcatttaggataa

SEQ ID NO: 976312 - DNA, 22 bp, Artificial Sequence
  chemically synthesized
aaatattttttttatcctaaat

SEQ ID NO: 976313 - DNA, 22 bp, Artificial Sequence
  chemically synthesized
ccttagtcggctcgcatttagg

SEQ ID NO: 976314 - DNA, 22 bp, Artificial Sequence
  chemically synthesized
tttttatcctaaatgcgagccg

SEQ ID NO: 976315 - DNA, 22 bp, Artificial Sequence
  chemically synthesized
ttttatcctaaatgcgagccga

SEQ ID NO: 976316 - DNA, 22 bp, Artificial Sequence
  chemically synthesized
tttatcctaaatgcgagccgac

SEQ ID NO: 976317 - DNA, 22 bp, Artificial Sequence
  chemically synthesized
ttatcctaaatgcgagccgact

SEQ ID NO: 976318 - DNA, 22 bp, Artificial Sequence
  chemically synthesized
tatcctaaatgcgagccgacta

SEQ ID NO: 976319 - DNA, 22 bp, Artificial Sequence
  chemically synthesized
atcctaaatgcgagccgactaa

SEQ ID NO: 976320 - DNA, 22 bp, Artificial Sequence
  chemically synthesized
tcctaaatgcgagccgactaag

SEQ ID NO: 976321 - DNA, 22 bp, Artificial Sequence
  chemically synthesized
tcaagaagttgccttagtcggc

SEQ ID NO: 976322 - DNA, 22 bp, Artificial Sequence
  chemically synthesized
gtcaagaagttgccttagtcgg

SEQ ID NO: 976323 - DNA, 22 bp, Artificial Sequence
  chemically synthesized
aatgcgagccgactaaggcaac

SEQ ID NO: 976324 - DNA, 22 bp, Artificial Sequence
  chemically synthesized
acgtgtgtttgtcaagaagttg

SEQ ID NO: 976325 - DNA, 22 bp, Artificial Sequence
  chemically synthesized
gacgtgtgtttgtcaagaagtt

SEQ ID NO: 976326 - DNA, 22 bp, Artificial Sequence
  chemically synthesized
tttgacgtgtgtttgtcaagaa

SEQ ID NO: 976327 - DNA, 22 bp, Artificial Sequence
  chemically synthesized
aggcaacttcttgacaaacaca

SEQ ID NO: 976328 - DNA, 22 bp, Artificial Sequence
  chemically synthesized
gtgttatttgacgtgtgtttgt

SEQ ID NO: 976329 - DNA, 22 bp, Artificial Sequence
  chemically synthesized
atgttggtgttatttgacgtgt

SEQ ID NO: 976330 - DNA, 22 bp, Artificial Sequence
  chemically synthesized
gatgttggtgttatttgacgtg

SEQ ID NO: 976331 - DNA, 22 bp, Artificial Sequence
  chemically synthesized
cttgacaaacacacgtcaaata

SEQ ID NO: 976332 - DNA, 22 bp, Artificial Sequence
  chemically synthesized
tgatgttggtgttatttgacgt

SEQ ID NO: 976333 - DNA, 22 bp, Artificial Sequence
  chemically synthesized
ttgacaaacacacgtcaaataa

SEQ ID NO: 976334 - DNA, 22 bp, Artificial Sequence
  chemically synthesized
gacaaacacacgtcaaataaca

SEQ ID NO: 976335 - DNA, 22 bp, Artificial Sequence
  chemically synthesized
acaaacacacgtcaaataacac

SEQ ID NO: 976336 - DNA, 22 bp, Artificial Sequence
  chemically synthesized
gattttgatgttggtgttattt

SEQ ID NO: 976337 - DNA, 22 bp, Artificial Sequence
  chemically synthesized
atggatgtgaatggttagattt

SEQ ID NO: 976338 - DNA, 22 bp, Artificial Sequence
  chemically synthesized
cctcatggatgtgaatggttag

SEQ ID NO: 976339 - DNA, 22 bp, Artificial Sequence
  chemically synthesized
acctcatggatgtgaatggtta

SEQ ID NO: 976340 - DNA, 22 bp, Artificial Sequence
  chemically synthesized
tacctcatggatgtgaatggtt

SEQ ID NO: 976341 - DNA, 22 bp, Artificial Sequence
  chemically synthesized
tttacctcatggatgtgaatgg

SEQ ID NO: 976342 - DNA, 22 bp, Artificial Sequence
  chemically synthesized
ctttacctcatggatgtgaatg

SEQ ID NO: 976343 - DNA, 22 bp, Artificial Sequence
  chemically synthesized
tctttacctcatggatgtgaat

SEQ ID NO: 976344 - DNA, 22 bp, Artificial Sequence
  chemically synthesized
gttttctttacctcatggatgt

SEQ ID NO: 976345 - DNA, 22 bp, Artificial Sequence
  chemically synthesized
ggttttctttacctcatggatg

SEQ ID NO: 976346 - DNA, 22 bp, Artificial Sequence
  chemically synthesized
accattcacatccatgaggtaa

SEQ ID NO: 976347 - DNA, 22 bp, Artificial Sequence
  chemically synthesized
atttggttttctttacctcatg

SEQ ID NO: 976348 - DNA, 22 bp, Artificial Sequence
  chemically synthesized
gttaatttggttttctttacct

SEQ ID NO: 976349 - DNA, 22 bp, Artificial Sequence
  chemically synthesized
acatccatgaggtaaagaaaac

SEQ ID NO: 976350 - DNA, 22 bp, Artificial Sequence
  chemically synthesized
aaaaataatgactggttaattt

SEQ ID NO: 976351 - DNA, 22 bp, Artificial Sequence
  chemically synthesized
accagtcattatttttcaatgg

SEQ ID NO: 976352 - DNA, 22 bp, Artificial Sequence
  chemically synthesized
taaaagtcatagccattgaaaa

SEQ ID NO: 976353 - DNA, 22 bp, Artificial Sequence
  chemically synthesized
ttataaaagtcatagccattga

SEQ ID NO: 976354 - DNA, 22 bp, Artificial Sequence
  chemically synthesized
tactattataaaagtcatagcc

SEQ ID NO: 976355 - DNA, 22 bp, Artificial Sequence
  chemically synthesized
tttttcaatggctatgactttt

SEQ ID NO: 976356 - DNA, 22 bp, Artificial Sequence
  chemically synthesized
agctgtactattataaaagtca

SEQ ID NO: 976357 - DNA, 22 bp, Artificial Sequence
  chemically synthesized
ttcaatggctatgacttttata

SEQ ID NO: 976358 - DNA, 22 bp, Artificial Sequence
  chemically synthesized
tcaatggctatgacttttataa

SEQ ID NO: 976359 - DNA, 22 bp, Artificial Sequence
  chemically synthesized
caatggctatgacttttataat

SEQ ID NO: 976360 - DNA, 22 bp, Artificial Sequence
  chemically synthesized
aatggctatgacttttataata

SEQ ID NO: 976361 - DNA, 22 bp, Artificial Sequence
  chemically synthesized
tgacttttataatagtacagct

SEQ ID NO: 976362 - DNA, 22 bp, Artificial Sequence
  chemically synthesized
ttataatagtacagcttagttt

SEQ ID NO: 976363 - DNA, 22 bp, Artificial Sequence
  chemically synthesized
tataatagtacagcttagtttc

SEQ ID NO: 976364 - DNA, 22 bp, Artificial Sequence
  chemically synthesized
ataatagtacagcttagtttct

SEQ ID NO: 976365 - DNA, 22 bp, Artificial Sequence
  chemically synthesized
taatagtacagcttagtttcta

SEQ ID NO: 976366 - DNA, 22 bp, Artificial Sequence
  chemically synthesized
agaatataggaggatgcataga

SEQ ID NO: 976367 - DNA, 22 bp, Artificial Sequence
  chemically synthesized
aatctcagaatataggaggatg

SEQ ID NO: 976368 - DNA, 22 bp, Artificial Sequence
  chemically synthesized
agtttctatgcatcctcctata

SEQ ID NO: 976369 - DNA, 22 bp, Artificial Sequence
  chemically synthesized
gtttctatgcatcctcctatat

SEQ ID NO: 976370 - DNA, 22 bp, Artificial Sequence
  chemically synthesized
ctatgcatcctcctatattctg

SEQ ID NO: 976371 - DNA, 22 bp, Artificial Sequence
  chemically synthesized
tatgcatcctcctatattctga

SEQ ID NO: 976372 - DNA, 22 bp, Artificial Sequence
  chemically synthesized
tgcatcctcctatattctgaga

SEQ ID NO: 976373 - DNA, 22 bp, Artificial Sequence
  chemically synthesized
aaaatgtataacgctgaatctc

SEQ ID NO: 976374 - DNA, 22 bp, Artificial Sequence
  chemically synthesized
ctatattctgagattcagcgtt

SEQ ID NO: 976375 - DNA, 22 bp, Artificial Sequence
  chemically synthesized
tattctgagattcagcgttata

SEQ ID NO: 976376 - DNA, 22 bp, Artificial Sequence
  chemically synthesized
tgagattcagcgttatacattt

SEQ ID NO: 976377 - DNA, 22 bp, Artificial Sequence
  chemically synthesized
agattcagcgttatacattttc

SEQ ID NO: 976378 - DNA, 22 bp, Artificial Sequence
  chemically synthesized
gcaaaatcaaattgaaaatgta

SEQ ID NO: 976379 - DNA, 22 bp, Artificial Sequence
  chemically synthesized
actggcaaaatcaaattgaaaa

SEQ ID NO: 976380 - DNA, 22 bp, Artificial Sequence
  chemically synthesized
agcgttatacattttcaatttg

SEQ ID NO: 976381 - DNA, 22 bp, Artificial Sequence
  chemically synthesized
gactggcaaaatcaaattgaaa

SEQ ID NO: 976382 - DNA, 22 bp, Artificial Sequence
  chemically synthesized
tacattttcaatttgattttgc

SEQ ID NO: 976383 - DNA, 22 bp, Artificial Sequence
  chemically synthesized
tcaatttgattttgccagtcaa

SEQ ID NO: 976384 - DNA, 22 bp, Artificial Sequence
  chemically synthesized
caatttgattttgccagtcaaa

SEQ ID NO: 976385 - DNA, 22 bp, Artificial Sequence
  chemically synthesized
aatttgattttgccagtcaaat

SEQ ID NO: 976386 - DNA, 22 bp, Artificial Sequence
  chemically synthesized
gattttgccagtcaaatttcat

SEQ ID NO: 976387 - DNA, 22 bp, Artificial Sequence
  chemically synthesized
attttgccagtcaaatttcatt

SEQ ID NO: 976388 - DNA, 22 bp, Artificial Sequence
  chemically synthesized
tgccagtcaaatttcatttgtt

SEQ ID NO: 976389 - DNA, 22 bp, Artificial Sequence
  chemically synthesized
gccagtcaaatttcatttgttc

SEQ ID NO: 976390 - DNA, 22 bp, Artificial Sequence
  chemically synthesized
ccagtcaaatttcatttgttct

SEQ ID NO: 976391 - DNA, 22 bp, Artificial Sequence
  chemically synthesized
catttgttcttgtttgattggc

SEQ ID NO: 976392 - DNA, 22 bp, Artificial Sequence
  chemically synthesized
atttgttcttgtttgattggct

SEQ ID NO: 976393 - DNA, 22 bp, Artificial Sequence
  chemically synthesized
ataggtaaacgacagccaatca

SEQ ID NO: 976394 - DNA, 22 bp, Artificial Sequence
  chemically synthesized
gttcttgtttgattggctgtcg

SEQ ID NO: 976395 - DNA, 22 bp, Artificial Sequence
  chemically synthesized
ttcttgtttgattggctgtcgt

SEQ ID NO: 976396 - DNA, 22 bp, Artificial Sequence
  chemically synthesized
ttgtttgattggctgtcgttta

SEQ ID NO: 976397 - DNA, 22 bp, Artificial Sequence
  chemically synthesized
gtttgattggctgtcgtttacc

SEQ ID NO: 976398 - DNA, 22 bp, Artificial Sequence
  chemically synthesized
tttgattggctgtcgtttacct

SEQ ID NO: 976399 - DNA, 22 bp, Artificial Sequence
  chemically synthesized
gattggctgtcgtttacctatt

SEQ ID NO: 976400 - DNA, 22 bp, Artificial Sequence
  chemically synthesized
aaggcagcacctaataggtaaa

SEQ ID NO: 976401 - DNA, 22 bp, Artificial Sequence
  chemically synthesized
attggctgtcgtttacctatta

SEQ ID NO: 976402 - DNA, 22 bp, Artificial Sequence
  chemically synthesized
gctgtcgtttacctattaggtg

SEQ ID NO: 976403 - DNA, 22 bp, Artificial Sequence
  chemically synthesized
tcgtttacctattaggtgctgc

SEQ ID NO: 976404 - DNA, 22 bp, Artificial Sequence
  chemically synthesized
acctattaggtgctgccttcaa

SEQ ID NO: 976405 - DNA, 22 bp, Artificial Sequence
  chemically synthesized
cctattaggtgctgccttcaat

SEQ ID NO: 976406 - DNA, 22 bp, Artificial Sequence
  chemically synthesized
ttaggtgctgccttcaattcat

SEQ ID NO: 976407 - DNA, 22 bp, Artificial Sequence
  chemically synthesized
ggtgctgccttcaattcatttt

SEQ ID NO: 976408 - DNA, 22 bp, Artificial Sequence
  chemically synthesized
cccagagaatgtaaaaatgaat

SEQ ID NO: 976409 - DNA, 22 bp, Artificial Sequence
  chemically synthesized
tctccccagagaatgtaaaaat

SEQ ID NO: 976410 - DNA, 22 bp, Artificial Sequence
  chemically synthesized
ccttcaattcatttttacattc

SEQ ID NO: 976411 - DNA, 22 bp, Artificial Sequence
  chemically synthesized
caattcatttttacattctctg

SEQ ID NO: 976412 - DNA, 22 bp, Artificial Sequence
  chemically synthesized
aattcatttttacattctctgg

SEQ ID NO: 976413 - DNA, 22 bp, Artificial Sequence
  chemically synthesized
atttttacattctctggggaga

SEQ ID NO: 976414 - DNA, 22 bp, Artificial Sequence
  chemically synthesized
gtgtgtaggttgtctccccaga

SEQ ID NO: 976415 - DNA, 22 bp, Artificial Sequence
  chemically synthesized
cgtgtgtaggttgtctccccag

SEQ ID NO: 976416 - DNA, 22 bp, Artificial Sequence
  chemically synthesized
ttacattctctggggagacaac

SEQ ID NO: 976417 - DNA, 22 bp, Artificial Sequence
  chemically synthesized
tacattctctggggagacaacc

SEQ ID NO: 976418 - DNA, 22 bp, Artificial Sequence
  chemically synthesized
acattctctggggagacaacct

SEQ ID NO: 976419 - DNA, 22 bp, Artificial Sequence
  chemically synthesized
cattctctggggagacaaccta

SEQ ID NO: 976420 - DNA, 22 bp, Artificial Sequence
  chemically synthesized
tctggggagacaacctacacac

SEQ ID NO: 976421 - DNA, 22 bp, Artificial Sequence
  chemically synthesized
tggggagacaacctacacacga

SEQ ID NO: 976422 - DNA, 22 bp, Artificial Sequence
  chemically synthesized
gggagacaacctacacacgaag

SEQ ID NO: 976423 - DNA, 22 bp, Artificial Sequence
  chemically synthesized
aagtggcaaaaccttcgtgtgt

SEQ ID NO: 976424 - DNA, 22 bp, Artificial Sequence
  chemically synthesized
aaagtggcaaaaccttcgtgtg

SEQ ID NO: 976425 - DNA, 22 bp, Artificial Sequence
  chemically synthesized
aacatttaaagtggcaaaacct

SEQ ID NO: 976426 - DNA, 22 bp, Artificial Sequence
  chemically synthesized
cacacgaaggttttgccacttt

SEQ ID NO: 976427 - DNA, 22 bp, Artificial Sequence
  chemically synthesized
cagaattaaacatttaaagtgg

SEQ ID NO: 976428 - DNA, 22 bp, Artificial Sequence
  chemically synthesized
tgccactttaaatgtttaattc

SEQ ID NO: 976429 - DNA, 22 bp, Artificial Sequence
  chemically synthesized
caacgtgttgcagaattaaaca

SEQ ID NO: 976430 - DNA, 22 bp, Artificial Sequence
  chemically synthesized
gccactttaaatgtttaattct

SEQ ID NO: 976431 - DNA, 22 bp, Artificial Sequence
  chemically synthesized
ccactttaaatgtttaattctg

SEQ ID NO: 976432 - DNA, 22 bp, Artificial Sequence
  chemically synthesized
tgcaacgtgttgcagaattaaa

SEQ ID NO: 976433 - DNA, 22 bp, Artificial Sequence
  chemically synthesized
ctctgcaacgtgttgcagaatt

SEQ ID NO: 976434 - DNA, 22 bp, Artificial Sequence
  chemically synthesized
actctgcaacgtgttgcagaat

SEQ ID NO: 976435 - DNA, 22 bp, Artificial Sequence
  chemically synthesized
tactctgcaacgtgttgcagaa

SEQ ID NO: 976436 - DNA, 22 bp, Artificial Sequence
  chemically synthesized
taaatgtttaattctgcaacac

SEQ ID NO: 976437 - DNA, 22 bp, Artificial Sequence
  chemically synthesized
aaatgtttaattctgcaacacg

SEQ ID NO: 976438 - DNA, 22 bp, Artificial Sequence
  chemically synthesized
aatgtttaattctgcaacacgt

SEQ ID NO: 976439 - DNA, 22 bp, Artificial Sequence
  chemically synthesized
aattctgcaacacgttgcagag

SEQ ID NO: 976440 - DNA, 22 bp, Artificial Sequence
  chemically synthesized
attctgcaacacgttgcagagt

SEQ ID NO: 976441 - DNA, 22 bp, Artificial Sequence
  chemically synthesized
tgcaacacgttgcagagtaaaa

SEQ ID NO: 976442 - DNA, 22 bp, Artificial Sequence
  chemically synthesized
caacacgttgcagagtaaaatc

SEQ ID NO: 976443 - DNA, 22 bp, Artificial Sequence
  chemically synthesized
taggataaatcgaggaagattt

SEQ ID NO: 976444 - DNA, 22 bp, Artificial Sequence
  chemically synthesized
tataggataaatcgaggaagat

SEQ ID NO: 976445 - DNA, 22 bp, Artificial Sequence
  chemically synthesized
ctataggataaatcgaggaaga

SEQ ID NO: 976446 - DNA, 22 bp, Artificial Sequence
  chemically synthesized
cagagtaaaatcttcctcgatt

SEQ ID NO: 976447 - DNA, 22 bp, Artificial Sequence
  chemically synthesized
tcacaggaaacttctataggat

SEQ ID NO: 976448 - DNA, 22 bp, Artificial Sequence
  chemically synthesized
cctcgatttatcctatagaagt

SEQ ID NO: 976449 - DNA, 22 bp, Artificial Sequence
  chemically synthesized
ctcgatttatcctatagaagtt

SEQ ID NO: 976450 - DNA, 22 bp, Artificial Sequence
  chemically synthesized
cattgtcacaggaaacttctat

SEQ ID NO: 976451 - DNA, 22 bp, Artificial Sequence
  chemically synthesized
gcattgtcacaggaaacttcta

SEQ ID NO: 976452 - DNA, 22 bp, Artificial Sequence
  chemically synthesized
gatttatcctatagaagtttcc

SEQ ID NO: 976453 - DNA, 22 bp, Artificial Sequence
  chemically synthesized
acttgcattgtcacaggaaact

SEQ ID NO: 976454 - DNA, 22 bp, Artificial Sequence
  chemically synthesized
cacttgcattgtcacaggaaac

SEQ ID NO: 976455 - DNA, 22 bp, Artificial Sequence
  chemically synthesized
atcctatagaagtttcctgtga

SEQ ID NO: 976456 - DNA, 22 bp, Artificial Sequence
  chemically synthesized
tcacttgcattgtcacaggaaa

SEQ ID NO: 976457 - DNA, 22 bp, Artificial Sequence
  chemically synthesized
tcctatagaagtttcctgtgac

SEQ ID NO: 976458 - DNA, 22 bp, Artificial Sequence
  chemically synthesized
ttcacttgcattgtcacaggaa

SEQ ID NO: 976459 - DNA, 22 bp, Artificial Sequence
  chemically synthesized
gtttttcacttgcattgtcaca

SEQ ID NO: 976460 - DNA, 22 bp, Artificial Sequence
  chemically synthesized
tagaagtttcctgtgacaatgc

SEQ ID NO: 976461 - DNA, 22 bp, Artificial Sequence
  chemically synthesized
ggtttttcacttgcattgtcac

SEQ ID NO: 976462 - DNA, 22 bp, Artificial Sequence
  chemically synthesized
tggtttttcacttgcattgtca

SEQ ID NO: 976463 - DNA, 22 bp, Artificial Sequence
  chemically synthesized
agttttggtttttcacttgcat

SEQ ID NO: 976464 - DNA, 22 bp, Artificial Sequence
  chemically synthesized
gagttttggtttttcacttgca

SEQ ID NO: 976465 - DNA, 22 bp, Artificial Sequence
  chemically synthesized
tgagttttggtttttcacttgc

SEQ ID NO: 976466 - DNA, 22 bp, Artificial Sequence
  chemically synthesized
cctgtgacaatgcaagtgaaaa

SEQ ID NO: 976467 - DNA, 22 bp, Artificial Sequence
  chemically synthesized
ctgtgacaatgcaagtgaaaaa

SEQ ID NO: 976468 - DNA, 22 bp, Artificial Sequence
  chemically synthesized
tgacaatgcaagtgaaaaacca

SEQ ID NO: 976469 - DNA, 22 bp, Artificial Sequence
  chemically synthesized
ccacactttgagttttggtttt

SEQ ID NO: 976470 - DNA, 22 bp, Artificial Sequence
  chemically synthesized
gccacactttgagttttggttt

SEQ ID NO: 976471 - DNA, 22 bp, Artificial Sequence
  chemically synthesized
caacttgccacactttgagttt

SEQ ID NO: 976472 - DNA, 22 bp, Artificial Sequence
  chemically synthesized
gctccaacttgccacactttga

SEQ ID NO: 976473 - DNA, 22 bp, Artificial Sequence
  chemically synthesized
agctccaacttgccacactttg

SEQ ID NO: 976474 - DNA, 22 bp, Artificial Sequence
  chemically synthesized
aaagtgtggcaagttggagcta

SEQ ID NO: 976475 - DNA, 22 bp, Artificial Sequence
  chemically synthesized
caggatcagccttagctccaac

SEQ ID NO: 976476 - DNA, 22 bp, Artificial Sequence
  chemically synthesized
attccaggatcagccttagctc

SEQ ID NO: 976477 - DNA, 22 bp, Artificial Sequence
  chemically synthesized
gttgattccaggatcagcctta

SEQ ID NO: 976478 - DNA, 22 bp, Artificial Sequence
  chemically synthesized
gagctaaggctgatcctggaat

SEQ ID NO: 976479 - DNA, 22 bp, Artificial Sequence
  chemically synthesized
tggaaactagttgattccagga

SEQ ID NO: 976480 - DNA, 22 bp, Artificial Sequence
  chemically synthesized
ctgtggaaactagttgattcca

SEQ ID NO: 976481 - DNA, 22 bp, Artificial Sequence
  chemically synthesized
actgtggaaactagttgattcc

SEQ ID NO: 976482 - DNA, 22 bp, Artificial Sequence
  chemically synthesized
aggctgatcctggaatcaacta

SEQ ID NO: 976483 - DNA, 22 bp, Artificial Sequence
  chemically synthesized
tactgtggaaactagttgattc

SEQ ID NO: 976484 - DNA, 22 bp, Artificial Sequence
  chemically synthesized
ttactgtggaaactagttgatt

SEQ ID NO: 976485 - DNA, 22 bp, Artificial Sequence
  chemically synthesized
tttactgtggaaactagttgat

SEQ ID NO: 976486 - DNA, 22 bp, Artificial Sequence
  chemically synthesized
ttttactgtggaaactagttga

SEQ ID NO: 976487 - DNA, 22 bp, Artificial Sequence
  chemically synthesized
tttttactgtggaaactagttg

SEQ ID NO: 976488 - DNA, 22 bp, Artificial Sequence
  chemically synthesized
atcctggaatcaactagtttcc

SEQ ID NO: 976489 - DNA, 22 bp, Artificial Sequence
  chemically synthesized
tttttttactgtggaaactagt

SEQ ID NO: 976490 - DNA, 22 bp, Artificial Sequence
  chemically synthesized
attctttttttactgtggaaac

SEQ ID NO: 976491 - DNA, 22 bp, Artificial Sequence
  chemically synthesized
gaatcaactagtttccacagta

SEQ ID NO: 976492 - DNA, 22 bp, Artificial Sequence
  chemically synthesized
tcattctttttttactgtggaa

SEQ ID NO: 976493 - DNA, 22 bp, Artificial Sequence
  chemically synthesized
attctcattctttttttactgt

SEQ ID NO: 976494 - DNA, 22 bp, Artificial Sequence
  chemically synthesized
gtttccacagtaaaaaaagaat

SEQ ID NO: 976495 - DNA, 22 bp, Artificial Sequence
  chemically synthesized
tgtctcattctcattctttttt

SEQ ID NO: 976496 - DNA, 22 bp, Artificial Sequence
  chemically synthesized
ccacagtaaaaaaagaatgaga

SEQ ID NO: 976497 - DNA, 22 bp, Artificial Sequence
  chemically synthesized
cacagtaaaaaaagaatgagaa

SEQ ID NO: 976498 - DNA, 22 bp, Artificial Sequence
  chemically synthesized
agtggggaatctatgtctcatt

SEQ ID NO: 976499 - DNA, 22 bp, Artificial Sequence
  chemically synthesized
aagtggggaatctatgtctcat

SEQ ID NO: 976500 - DNA, 22 bp, Artificial Sequence
  chemically synthesized
gatttaagtggggaatctatgt

SEQ ID NO: 976501 - DNA, 22 bp, Artificial Sequence
  chemically synthesized
ttggatttaagtggggaatcta

SEQ ID NO: 976502 - DNA, 22 bp, Artificial Sequence
  chemically synthesized
tattggatttaagtggggaatc

SEQ ID NO: 976503 - DNA, 22 bp, Artificial Sequence
  chemically synthesized
cctctattggatttaagtgggg

SEQ ID NO: 976504 - DNA, 22 bp, Artificial Sequence
  chemically synthesized
cccacttaaatccaatagaggt

SEQ ID NO: 976505 - DNA, 22 bp, Artificial Sequence
  chemically synthesized
aaatccaatagaggtagttttc

SEQ ID NO: 976506 - DNA, 22 bp, Artificial Sequence
  chemically synthesized
aatccaatagaggtagttttca

SEQ ID NO: 976507 - DNA, 22 bp, Artificial Sequence
  chemically synthesized
catgataacagagtgaaaacta

SEQ ID NO: 976508 - DNA, 22 bp, Artificial Sequence
  chemically synthesized
ttgcatgataacagagtgaaaa

SEQ ID NO: 976509 - DNA, 22 bp, Artificial Sequence
  chemically synthesized
tcacacactgttgcatgataac

SEQ ID NO: 976510 - DNA, 22 bp, Artificial Sequence
  chemically synthesized
actatcacacactgttgcatga

SEQ ID NO: 976511 - DNA, 22 bp, Artificial Sequence
  chemically synthesized
tcactctgttatcatgcaacag

SEQ ID NO: 976512 - DNA, 22 bp, Artificial Sequence
  chemically synthesized
cactctgttatcatgcaacagt

SEQ ID NO: 976513 - DNA, 22 bp, Artificial Sequence
  chemically synthesized
actctgttatcatgcaacagtg

SEQ ID NO: 976514 - DNA, 22 bp, Artificial Sequence
  chemically synthesized
tgttatcatgcaacagtgtgtg

SEQ ID NO: 976515 - DNA, 22 bp, Artificial Sequence
  chemically synthesized
aacattgactatcacacactgt

SEQ ID NO: 976516 - DNA, 22 bp, Artificial Sequence
  chemically synthesized
caacattgactatcacacactg

SEQ ID NO: 976517 - DNA, 22 bp, Artificial Sequence
  chemically synthesized
ttatcatgcaacagtgtgtgat

SEQ ID NO: 976518 - DNA, 22 bp, Artificial Sequence
  chemically synthesized
tcatgcaacagtgtgtgatagt

SEQ ID NO: 976519 - DNA, 22 bp, Artificial Sequence
  chemically synthesized
tatgacttcaacattgactatc

SEQ ID NO: 976520 - DNA, 22 bp, Artificial Sequence
  chemically synthesized
atatgacttcaacattgactat

SEQ ID NO: 976521 - DNA, 22 bp, Artificial Sequence
  chemically synthesized
tttatatgacttcaacattgac

SEQ ID NO: 976522 - DNA, 22 bp, Artificial Sequence
  chemically synthesized
gtttatatgacttcaacattga

SEQ ID NO: 976523 - DNA, 22 bp, Artificial Sequence
  chemically synthesized
aaaccaaataacttgtttatat

SEQ ID NO: 976524 - DNA, 22 bp, Artificial Sequence
  chemically synthesized
aagtcatataaacaagttattt

SEQ ID NO: 976525 - DNA, 22 bp, Artificial Sequence
  chemically synthesized
aatgctaaaaccaaataacttg

SEQ ID NO: 976526 - DNA, 22 bp, Artificial Sequence
  chemically synthesized
aaatgctaaaaccaaataactt

SEQ ID NO: 976527 - DNA, 22 bp, Artificial Sequence
  chemically synthesized
taaatgctaaaaccaaataact

SEQ ID NO: 976528 - DNA, 22 bp, Artificial Sequence
  chemically synthesized
ttttaaatgctaaaaccaaata

SEQ ID NO: 976529 - DNA, 22 bp, Artificial Sequence
  chemically synthesized
attttaaatgctaaaaccaaat

SEQ ID NO: 976530 - DNA, 22 bp, Artificial Sequence
  chemically synthesized
tattttaaatgctaaaaccaaa

SEQ ID NO: 976531 - DNA, 22 bp, Artificial Sequence
  chemically synthesized
ctttattttaaatgctaaaacc

SEQ ID NO: 976532 - DNA, 22 bp, Artificial Sequence
  chemically synthesized
tttggttttagcatttaaaata

SEQ ID NO: 976533 - DNA, 22 bp, Artificial Sequence
  chemically synthesized
atagaactcctttattttaaat

SEQ ID NO: 976534 - DNA, 22 bp, Artificial Sequence
  chemically synthesized
ggttttagcatttaaaataaag

SEQ ID NO: 976535 - DNA, 22 bp, Artificial Sequence
  chemically synthesized
gttttagcatttaaaataaagg

SEQ ID NO: 976536 - DNA, 22 bp, Artificial Sequence
  chemically synthesized
tagcatttaaaataaaggagtt

SEQ ID NO: 976537 - DNA, 22 bp, Artificial Sequence
  chemically synthesized
agcatttaaaataaaggagttc

SEQ ID NO: 976538 - DNA, 22 bp, Artificial Sequence
  chemically synthesized
gcatttaaaataaaggagttct

SEQ ID NO: 976539 - DNA, 22 bp, Artificial Sequence
  chemically synthesized
ccacaaattgatagaactcctt

SEQ ID NO: 976540 - DNA, 22 bp, Artificial Sequence
  chemically synthesized
accacaaattgatagaactcct

SEQ ID NO: 976541 - DNA, 22 bp, Artificial Sequence
  chemically synthesized
aaaataaaggagttctatcaat

SEQ ID NO: 976542 - DNA, 22 bp, Artificial Sequence
  chemically synthesized
tgtttaccacaaattgatagaa

SEQ ID NO: 976543 - DNA, 22 bp, Artificial Sequence
  chemically synthesized
aaataaaggagttctatcaatt

SEQ ID NO: 976544 - DNA, 22 bp, Artificial Sequence
  chemically synthesized
tatcaatttgtggtaaacacaa

SEQ ID NO: 976545 - DNA, 22 bp, Artificial Sequence
  chemically synthesized
tcaatttgtggtaaacacaact

SEQ ID NO: 976546 - DNA, 22 bp, Artificial Sequence
  chemically synthesized
gtggtaaacacaactacccata

SEQ ID NO: 976547 - DNA, 22 bp, Artificial Sequence
  chemically synthesized
tggtaaacacaactacccatat

SEQ ID NO: 976548 - DNA, 22 bp, Artificial Sequence
  chemically synthesized
aaggaagagaacaatatgggta

SEQ ID NO: 976549 - DNA, 22 bp, Artificial Sequence
  chemically synthesized
gagtctaaaggaagagaacaat

SEQ ID NO: 976550 - DNA, 22 bp, Artificial Sequence
  chemically synthesized
cagttagagtctaaaggaagag

SEQ ID NO: 976551 - DNA, 22 bp, Artificial Sequence
  chemically synthesized
cccatattgttctcttccttta

SEQ ID NO: 976552 - DNA, 22 bp, Artificial Sequence
  chemically synthesized
tccagttagagtctaaaggaag

SEQ ID NO: 976553 - DNA, 22 bp, Artificial Sequence
  chemically synthesized
ctccagttagagtctaaaggaa

SEQ ID NO: 976554 - DNA, 22 bp, Artificial Sequence
  chemically synthesized
ttctccagttagagtctaaagg

SEQ ID NO: 976555 - DNA, 22 bp, Artificial Sequence
  chemically synthesized
tcttctccagttagagtctaaa

SEQ ID NO: 976556 - DNA, 22 bp, Artificial Sequence
  chemically synthesized
ttctcttcctttagactctaac

SEQ ID NO: 976557 - DNA, 22 bp, Artificial Sequence
  chemically synthesized
tcttcctttagactctaactgg

SEQ ID NO: 976558 - DNA, 22 bp, Artificial Sequence
  chemically synthesized
ttcctttagactctaactggag

SEQ ID NO: 976559 - DNA, 22 bp, Artificial Sequence
  chemically synthesized
cctttagactctaactggagaa

SEQ ID NO: 976560 - DNA, 22 bp, Artificial Sequence
  chemically synthesized
ctttagactctaactggagaag

SEQ ID NO: 976561 - DNA, 22 bp, Artificial Sequence
  chemically synthesized
tagactctaactggagaagaga

SEQ ID NO: 976562 - DNA, 22 bp, Artificial Sequence
  chemically synthesized
agactctaactggagaagagag

SEQ ID NO: 976563 - DNA, 22 bp, Artificial Sequence
  chemically synthesized
gactctaactggagaagagagt

SEQ ID NO: 976564 - DNA, 22 bp, Artificial Sequence
  chemically synthesized
taactggagaagagagtatatt

SEQ ID NO: 976565 - DNA, 22 bp, Artificial Sequence
  chemically synthesized
actggagaagagagtatatttt

SEQ ID NO: 976566 - DNA, 22 bp, Artificial Sequence
  chemically synthesized
ggaaaagaggcagaaaatatac

SEQ ID NO: 976567 - DNA, 22 bp, Artificial Sequence
  chemically synthesized
gagaagagagtatattttctgc

SEQ ID NO: 976568 - DNA, 22 bp, Artificial Sequence
  chemically synthesized
cctgggaaaagaggcagaaaat

SEQ ID NO: 976569 - DNA, 22 bp, Artificial Sequence
  chemically synthesized
ttacctgggaaaagaggcagaa

SEQ ID NO: 976570 - DNA, 22 bp, Artificial Sequence
  chemically synthesized
taaatgctattacctgggaaaa

SEQ ID NO: 976571 - DNA, 22 bp, Artificial Sequence
  chemically synthesized
tctgcctcttttcccaggtaat

SEQ ID NO: 976572 - DNA, 22 bp, Artificial Sequence
  chemically synthesized
ctgcctcttttcccaggtaata

SEQ ID NO: 976573 - DNA, 22 bp, Artificial Sequence
  chemically synthesized
tgcctcttttcccaggtaatag

SEQ ID NO: 976574 - DNA, 22 bp, Artificial Sequence
  chemically synthesized
atcctataaatgctattacctg

SEQ ID NO: 976575 - DNA, 22 bp, Artificial Sequence
  chemically synthesized
cctcttttcccaggtaatagca

SEQ ID NO: 976576 - DNA, 22 bp, Artificial Sequence
  chemically synthesized
ctcatcctataaatgctattac

SEQ ID NO: 976577 - DNA, 22 bp, Artificial Sequence
  chemically synthesized
ttttcccaggtaatagcattta

SEQ ID NO: 976578 - DNA, 22 bp, Artificial Sequence
  chemically synthesized
ttcccaggtaatagcatttata

SEQ ID NO: 976579 - DNA, 22 bp, Artificial Sequence
  chemically synthesized
tcccaggtaatagcatttatag

SEQ ID NO: 976580 - DNA, 22 bp, Artificial Sequence
  chemically synthesized
cccaggtaatagcatttatagg

SEQ ID NO: 976581 - DNA, 22 bp, Artificial Sequence
  chemically synthesized
ccaggtaatagcatttatagga

SEQ ID NO: 976582 - DNA, 22 bp, Artificial Sequence
  chemically synthesized
gccagctcctcatcctataaat

SEQ ID NO: 976583 - DNA, 22 bp, Artificial Sequence
  chemically synthesized
aagccattagccagctcctcat

SEQ ID NO: 976584 - DNA, 22 bp, Artificial Sequence
  chemically synthesized
ataggatgaggagctggctaat

SEQ ID NO: 976585 - DNA, 22 bp, Artificial Sequence
  chemically synthesized
taggatgaggagctggctaatg

SEQ ID NO: 976586 - DNA, 22 bp, Artificial Sequence
  chemically synthesized
gccatgtggaactgaagccatt

SEQ ID NO: 976587 - DNA, 22 bp, Artificial Sequence
  chemically synthesized
gctaatggcttcagttccacat

SEQ ID NO: 976588 - DNA, 22 bp, Artificial Sequence
  chemically synthesized
gtgtagctagccatgtggaact

SEQ ID NO: 976589 - DNA, 22 bp, Artificial Sequence
  chemically synthesized
atggcttcagttccacatggct

SEQ ID NO: 976590 - DNA, 22 bp, Artificial Sequence
  chemically synthesized
cccctagtgtagctagccatgt

SEQ ID NO: 976591 - DNA, 22 bp, Artificial Sequence
  chemically synthesized
ccccctagtgtagctagccatg

SEQ ID NO: 976592 - DNA, 22 bp, Artificial Sequence
  chemically synthesized
tccccctagtgtagctagccat

SEQ ID NO: 976593 - DNA, 22 bp, Artificial Sequence
  chemically synthesized
ttccccctagtgtagctagcca

SEQ ID NO: 976594 - DNA, 22 bp, Artificial Sequence
  chemically synthesized
tttccccctagtgtagctagcc

SEQ ID NO: 976595 - DNA, 22 bp, Artificial Sequence
  chemically synthesized
cagttccacatggctagctaca

SEQ ID NO: 976596 - DNA, 22 bp, Artificial Sequence
  chemically synthesized
ttttccccctagtgtagctagc

SEQ ID NO: 976597 - DNA, 22 bp, Artificial Sequence
  chemically synthesized
agttccacatggctagctacac

SEQ ID NO: 976598 - DNA, 22 bp, Artificial Sequence
  chemically synthesized
tttttccccctagtgtagctag

SEQ ID NO: 976599 - DNA, 22 bp, Artificial Sequence
  chemically synthesized
ttttttccccctagtgtagcta

SEQ ID NO: 976600 - DNA, 22 bp, Artificial Sequence
  chemically synthesized
tttttttccccctagtgtagct

SEQ ID NO: 976601 - DNA, 22 bp, Artificial Sequence
  chemically synthesized
cacatggctagctacactaggg

SEQ ID NO: 976602 - DNA, 22 bp, Artificial Sequence
  chemically synthesized
tgctttttttttccccctagtg

SEQ ID NO: 976603 - DNA, 22 bp, Artificial Sequence
  chemically synthesized
gctacactagggggaaaaaaaa

SEQ ID NO: 976604 - DNA, 22 bp, Artificial Sequence
  chemically synthesized
cagcattatgctttttttttcc

SEQ ID NO: 976605 - DNA, 22 bp, Artificial Sequence
  chemically synthesized
gcagcattatgctttttttttc

SEQ ID NO: 976606 - DNA, 22 bp, Artificial Sequence
  chemically synthesized
cactagggggaaaaaaaaagca

SEQ ID NO: 976607 - DNA, 22 bp, Artificial Sequence
  chemically synthesized
cttgcagcattatgcttttttt

SEQ ID NO: 976608 - DNA, 22 bp, Artificial Sequence
  chemically synthesized
gcttgcagcattatgctttttt

SEQ ID NO: 976609 - DNA, 22 bp, Artificial Sequence
  chemically synthesized
tgcttgcagcattatgcttttt

SEQ ID NO: 976610 - DNA, 22 bp, Artificial Sequence
  chemically synthesized
gggggaaaaaaaaagcataatg

SEQ ID NO: 976611 - DNA, 22 bp, Artificial Sequence
  chemically synthesized
catcggaattttgcttgcagca

SEQ ID NO: 976612 - DNA, 22 bp, Artificial Sequence
  chemically synthesized
tgactacatcggaattttgctt

SEQ ID NO: 976613 - DNA, 22 bp, Artificial Sequence
  chemically synthesized
gtgactacatcggaattttgct

SEQ ID NO: 976614 - DNA, 22 bp, Artificial Sequence
  chemically synthesized
ttgtgactacatcggaattttg

SEQ ID NO: 976615 - DNA, 22 bp, Artificial Sequence
  chemically synthesized
cttgtgactacatcggaatttt

SEQ ID NO: 976616 - DNA, 22 bp, Artificial Sequence
  chemically synthesized
caagcaaaattccgatgtagtc

SEQ ID NO: 976617 - DNA, 22 bp, Artificial Sequence
  chemically synthesized
cgatgtagtcacaagaaggaca

SEQ ID NO: 976618 - DNA, 22 bp, Artificial Sequence
  chemically synthesized
aaaaggaaatagaatgtccttc

SEQ ID NO: 976619 - DNA, 22 bp, Artificial Sequence
  chemically synthesized
caaaaggaaatagaatgtcctt

SEQ ID NO: 976620 - DNA, 22 bp, Artificial Sequence
  chemically synthesized
tcaaaaggaaatagaatgtcct

SEQ ID NO: 976621 - DNA, 22 bp, Artificial Sequence
  chemically synthesized
ttcaaaaggaaatagaatgtcc

SEQ ID NO: 976622 - DNA, 22 bp, Artificial Sequence
  chemically synthesized
tttcaaaaggaaatagaatgtc

SEQ ID NO: 976623 - DNA, 22 bp, Artificial Sequence
  chemically synthesized
aaacacattttttcaaaaggaa

SEQ ID NO: 976624 - DNA, 22 bp, Artificial Sequence
  chemically synthesized
tatttccttttgaaaaaatgtg

SEQ ID NO: 976625 - DNA, 22 bp, Artificial Sequence
  chemically synthesized
tttccttttgaaaaaatgtgtt

SEQ ID NO: 976626 - DNA, 22 bp, Artificial Sequence
  chemically synthesized
cccaagaacctgaaacacattt

SEQ ID NO: 976627 - DNA, 22 bp, Artificial Sequence
  chemically synthesized
acccaagaacctgaaacacatt

SEQ ID NO: 976628 - DNA, 22 bp, Artificial Sequence
  chemically synthesized
ccttttgaaaaaatgtgtttca

SEQ ID NO: 976629 - DNA, 22 bp, Artificial Sequence
  chemically synthesized
cttttgaaaaaatgtgtttcag

SEQ ID NO: 976630 - DNA, 22 bp, Artificial Sequence
  chemically synthesized
ttgaaaaaatgtgtttcaggtt

SEQ ID NO: 976631 - DNA, 22 bp, Artificial Sequence
  chemically synthesized
tgaaaaaatgtgtttcaggttc

SEQ ID NO: 976632 - DNA, 22 bp, Artificial Sequence
  chemically synthesized
gaaaaaatgtgtttcaggttct

SEQ ID NO: 976633 - DNA, 22 bp, Artificial Sequence
  chemically synthesized
aaaaaatgtgtttcaggttctt

SEQ ID NO: 976634 - DNA, 22 bp, Artificial Sequence
  chemically synthesized
ccaccagatttacccaagaacc

SEQ ID NO: 976635 - DNA, 22 bp, Artificial Sequence
  chemically synthesized
taccaccagatttacccaagaa

SEQ ID NO: 976636 - DNA, 22 bp, Artificial Sequence
  chemically synthesized
ctaccaccagatttacccaaga

SEQ ID NO: 976637 - DNA, 22 bp, Artificial Sequence
  chemically synthesized
tctaccaccagatttacccaag

SEQ ID NO: 976638 - DNA, 22 bp, Artificial Sequence
  chemically synthesized
caggttcttgggtaaatctggt

SEQ ID NO: 976639 - DNA, 22 bp, Artificial Sequence
  chemically synthesized
aggttcttgggtaaatctggtg

SEQ ID NO: 976640 - DNA, 22 bp, Artificial Sequence
  chemically synthesized
ttgggtaaatctggtggtagaa

SEQ ID NO: 976641 - DNA, 22 bp, Artificial Sequence
  chemically synthesized
taggtggtaaactttctaccac

SEQ ID NO: 976642 - DNA, 22 bp, Artificial Sequence
  chemically synthesized
gggtaaatctggtggtagaaag

SEQ ID NO: 976643 - DNA, 22 bp, Artificial Sequence
  chemically synthesized
ggtaaatctggtggtagaaagt

SEQ ID NO: 976644 - DNA, 22 bp, Artificial Sequence
  chemically synthesized
cagaattataggtggtaaactt

SEQ ID NO: 976645 - DNA, 22 bp, Artificial Sequence
  chemically synthesized
gtggtagaaagtttaccaccta

SEQ ID NO: 976646 - DNA, 22 bp, Artificial Sequence
  chemically synthesized
accacctataattctgtaatgt

SEQ ID NO: 976647 - DNA, 22 bp, Artificial Sequence
  chemically synthesized
taaaggaggatcacattacaga

SEQ ID NO: 976648 - DNA, 22 bp, Artificial Sequence
  chemically synthesized
ccacctataattctgtaatgtg

SEQ ID NO: 976649 - DNA, 22 bp, Artificial Sequence
  chemically synthesized
ataaaggaggatcacattacag

SEQ ID NO: 976650 - DNA, 22 bp, Artificial Sequence
  chemically synthesized
tataaaggaggatcacattaca

SEQ ID NO: 976651 - DNA, 22 bp, Artificial Sequence
  chemically synthesized
taattctgtaatgtgatcctcc

SEQ ID NO: 976652 - DNA, 22 bp, Artificial Sequence
  chemically synthesized
tgtaatgtgatcctcctttata

SEQ ID NO: 976653 - DNA, 22 bp, Artificial Sequence
  chemically synthesized
taatgtgatcctcctttataaa

SEQ ID NO: 976654 - DNA, 22 bp, Artificial Sequence
  chemically synthesized
ccacaagtaataacaattttat

SEQ ID NO: 976655 - DNA, 22 bp, Artificial Sequence
  chemically synthesized
gccacaagtaataacaatttta

SEQ ID NO: 976656 - DNA, 22 bp, Artificial Sequence
  chemically synthesized
ttgccacaagtaataacaattt

SEQ ID NO: 976657 - DNA, 22 bp, Artificial Sequence
  chemically synthesized
cttgccacaagtaataacaatt

SEQ ID NO: 976658 - DNA, 22 bp, Artificial Sequence
  chemically synthesized
tcttgccacaagtaataacaat

SEQ ID NO: 976659 - DNA, 22 bp, Artificial Sequence
  chemically synthesized
ttcttgccacaagtaataacaa

SEQ ID NO: 976660 - DNA, 22 bp, Artificial Sequence
  chemically synthesized
ctttataaaattgttattactt

SEQ ID NO: 976661 - DNA, 22 bp, Artificial Sequence
  chemically synthesized
ttttcttgccacaagtaataac

SEQ ID NO: 976662 - DNA, 22 bp, Artificial Sequence
  chemically synthesized
tataaaattgttattacttgtg

SEQ ID NO: 976663 - DNA, 22 bp, Artificial Sequence
  chemically synthesized
ctcttttcttgccacaagtaat

SEQ ID NO: 976664 - DNA, 22 bp, Artificial Sequence
  chemically synthesized
ataaaattgttattacttgtgg

SEQ ID NO: 976665 - DNA, 22 bp, Artificial Sequence
  chemically synthesized
taaaattgttattacttgtggc

SEQ ID NO: 976666 - DNA, 22 bp, Artificial Sequence
  chemically synthesized
cctcctcttttcttgccacaag

SEQ ID NO: 976667 - DNA, 22 bp, Artificial Sequence
  chemically synthesized
ttattacttgtggcaagaaaag

SEQ ID NO: 976668 - DNA, 22 bp, Artificial Sequence
  chemically synthesized
ttacttgtggcaagaaaagagg

SEQ ID NO: 976669 - DNA, 22 bp, Artificial Sequence
  chemically synthesized
cttgtggcaagaaaagaggagg

SEQ ID NO: 976670 - DNA, 22 bp, Artificial Sequence
  chemically synthesized
gtggcaagaaaagaggaggcag

SEQ ID NO: 976671 - DNA, 22 bp, Artificial Sequence
  chemically synthesized
acacagtaccatctgcctcctc

SEQ ID NO: 976672 - DNA, 22 bp, Artificial Sequence
  chemically synthesized
tggcaagaaaagaggaggcaga

SEQ ID NO: 976673 - DNA, 22 bp, Artificial Sequence
  chemically synthesized
agcatctgacacagtaccatct

SEQ ID NO: 976674 - DNA, 22 bp, Artificial Sequence
  chemically synthesized
cagcatctgacacagtaccatc

SEQ ID NO: 976675 - DNA, 22 bp, Artificial Sequence
  chemically synthesized
tcagcatctgacacagtaccat

SEQ ID NO: 976676 - DNA, 22 bp, Artificial Sequence
  chemically synthesized
ttcagcatctgacacagtacca

SEQ ID NO: 976677 - DNA, 22 bp, Artificial Sequence
  chemically synthesized
tttcagcatctgacacagtacc

SEQ ID NO: 976678 - DNA, 22 bp, Artificial Sequence
  chemically synthesized
tttttcagcatctgacacagta

SEQ ID NO: 976679 - DNA, 22 bp, Artificial Sequence
  chemically synthesized
ctttttcagcatctgacacagt

SEQ ID NO: 976680 - DNA, 22 bp, Artificial Sequence
  chemically synthesized
tctttttcagcatctgacacag

SEQ ID NO: 976681 - DNA, 22 bp, Artificial Sequence
  chemically synthesized
actttctttttcagcatctgac

SEQ ID NO: 976682 - DNA, 22 bp, Artificial Sequence
  chemically synthesized
ggagatgctcactttctttttc

SEQ ID NO: 976683 - DNA, 22 bp, Artificial Sequence
  chemically synthesized
tgtcagatgctgaaaaagaaag

SEQ ID NO: 976684 - DNA, 22 bp, Artificial Sequence
  chemically synthesized
taggagatgctcactttctttt

SEQ ID NO: 976685 - DNA, 22 bp, Artificial Sequence
  chemically synthesized
taatattctaggagatgctcac

SEQ ID NO: 976686 - DNA, 22 bp, Artificial Sequence
  chemically synthesized
aaaaagaaagtgagcatctcct

SEQ ID NO: 976687 - DNA, 22 bp, Artificial Sequence
  chemically synthesized
cactgtaatattctaggagatg

SEQ ID NO: 976688 - DNA, 22 bp, Artificial Sequence
  chemically synthesized
ccactgtaatattctaggagat

SEQ ID NO: 976689 - DNA, 22 bp, Artificial Sequence
  chemically synthesized
gatacttccactgtaatattct

SEQ ID NO: 976690 - DNA, 22 bp, Artificial Sequence
  chemically synthesized
aatgttggatacttccactgta

SEQ ID NO: 976691 - DNA, 22 bp, Artificial Sequence
  chemically synthesized
caatgttggatacttccactgt

SEQ ID NO: 976692 - DNA, 22 bp, Artificial Sequence
  chemically synthesized
ctagaatattacagtggaagta

SEQ ID NO: 976693 - DNA, 22 bp, Artificial Sequence
  chemically synthesized
ccttcaatgttggatacttcca

SEQ ID NO: 976694 - DNA, 22 bp, Artificial Sequence
  chemically synthesized
gaatattacagtggaagtatcc

SEQ ID NO: 976695 - DNA, 22 bp, Artificial Sequence
  chemically synthesized
cagtggaagtatccaacattga

SEQ ID NO: 976696 - DNA, 22 bp, Artificial Sequence
  chemically synthesized
cagagatctgccttcaatgttg

SEQ ID NO: 976697 - DNA, 22 bp, Artificial Sequence
  chemically synthesized
tattccagagatctgccttcaa

SEQ ID NO: 976698 - DNA, 22 bp, Artificial Sequence
  chemically synthesized
gtattccagagatctgccttca

SEQ ID NO: 976699 - DNA, 22 bp, Artificial Sequence
  chemically synthesized
aatttgtattccagagatctgc

SEQ ID NO: 976700 - DNA, 22 bp, Artificial Sequence
  chemically synthesized
tgaatttgtattccagagatct

SEQ ID NO: 976701 - DNA, 22 bp, Artificial Sequence
  chemically synthesized
ctgaatttgtattccagagatc

SEQ ID NO: 976702 - DNA, 22 bp, Artificial Sequence
  chemically synthesized
cttctgaatttgtattccagag

SEQ ID NO: 976703 - DNA, 22 bp, Artificial Sequence
  chemically synthesized
acttctgaatttgtattccaga

SEQ ID NO: 976704 - DNA, 22 bp, Artificial Sequence
  chemically synthesized
aaggcagatctctggaatacaa

SEQ ID NO: 976705 - DNA, 22 bp, Artificial Sequence
  chemically synthesized
tttacttctgaatttgtattcc

SEQ ID NO: 976706 - DNA, 22 bp, Artificial Sequence
  chemically synthesized
atttacttctgaatttgtattc

SEQ ID NO: 976707 - DNA, 22 bp, Artificial Sequence
  chemically synthesized
tatttacttctgaatttgtatt

SEQ ID NO: 976708 - DNA, 22 bp, Artificial Sequence
  chemically synthesized
ttttatttacttctgaatttgt

SEQ ID NO: 976709 - DNA, 22 bp, Artificial Sequence
  chemically synthesized
tggaatacaaattcagaagtaa

SEQ ID NO: 976710 - DNA, 22 bp, Artificial Sequence
  chemically synthesized
gaatacaaattcagaagtaaat

SEQ ID NO: 976711 - DNA, 22 bp, Artificial Sequence
  chemically synthesized
tagaatgtctattttatttact

SEQ ID NO: 976712 - DNA, 22 bp, Artificial Sequence
  chemically synthesized
gtagaatgtctattttatttac

SEQ ID NO: 976713 - DNA, 22 bp, Artificial Sequence
  chemically synthesized
tttgtagaatgtctattttatt

SEQ ID NO: 976714 - DNA, 22 bp, Artificial Sequence
  chemically synthesized
agaagtaaataaaatagacatt

SEQ ID NO: 976715 - DNA, 22 bp, Artificial Sequence
  chemically synthesized
gtcactgtttgtagaatgtcta

SEQ ID NO: 976716 - DNA, 22 bp, Artificial Sequence
  chemically synthesized
ggtcactgtttgtagaatgtct

SEQ ID NO: 976717 - DNA, 22 bp, Artificial Sequence
  chemically synthesized
tttggtcactgtttgtagaatg

SEQ ID NO: 976718 - DNA, 22 bp, Artificial Sequence
  chemically synthesized
atttggtcactgtttgtagaat

SEQ ID NO: 976719 - DNA, 22 bp, Artificial Sequence
  chemically synthesized
acagtccagacatttatttggt

SEQ ID NO: 976720 - DNA, 22 bp, Artificial Sequence
  chemically synthesized
tacaaacagtgaccaaataaat

SEQ ID NO: 976721 - DNA, 22 bp, Artificial Sequence
  chemically synthesized
cacagtccagacatttatttgg

SEQ ID NO: 976722 - DNA, 22 bp, Artificial Sequence
  chemically synthesized
caaacagtgaccaaataaatgt

SEQ ID NO: 976723 - DNA, 22 bp, Artificial Sequence
  chemically synthesized
tttcacagtccagacatttatt

SEQ ID NO: 976724 - DNA, 22 bp, Artificial Sequence
  chemically synthesized
tgtaaacaatggataaactgtt

SEQ ID NO: 976725 - DNA, 22 bp, Artificial Sequence
  chemically synthesized
atgtaaacaatggataaactgt

SEQ ID NO: 976726 - DNA, 22 bp, Artificial Sequence
  chemically synthesized
ttatgtaaacaatggataaact

SEQ ID NO: 976727 - DNA, 22 bp, Artificial Sequence
  chemically synthesized
gactgtgaaacagtttatccat

SEQ ID NO: 976728 - DNA, 22 bp, Artificial Sequence
  chemically synthesized
cttatgtaaacaatggataaac

SEQ ID NO: 976729 - DNA, 22 bp, Artificial Sequence
  chemically synthesized
tttcttatgtaaacaatggata

SEQ ID NO: 976730 - DNA, 22 bp, Artificial Sequence
  chemically synthesized
tgaaacagtttatccattgttt

SEQ ID NO: 976731 - DNA, 22 bp, Artificial Sequence
  chemically synthesized
atccattgtttacataagaaat

SEQ ID NO: 976732 - DNA, 22 bp, Artificial Sequence
  chemically synthesized
tccattgtttacataagaaata

SEQ ID NO: 976733 - DNA, 22 bp, Artificial Sequence
  chemically synthesized
tgcaatataatccgcattattt

SEQ ID NO: 976734 - DNA, 22 bp, Artificial Sequence
  chemically synthesized
tttacataagaaataatgcgga

SEQ ID NO: 976735 - DNA, 22 bp, Artificial Sequence
  chemically synthesized
gctatgcaatataatccgcatt

SEQ ID NO: 976736 - DNA, 22 bp, Artificial Sequence
  chemically synthesized
acataagaaataatgcggatta

SEQ ID NO: 976737 - DNA, 22 bp, Artificial Sequence
  chemically synthesized
cataagaaataatgcggattat

SEQ ID NO: 976738 - DNA, 22 bp, Artificial Sequence
  chemically synthesized
gggtacatactagctatgcaat

SEQ ID NO: 976739 - DNA, 22 bp, Artificial Sequence
  chemically synthesized
ggggtacatactagctatgcaa

SEQ ID NO: 976740 - DNA, 22 bp, Artificial Sequence
  chemically synthesized
gtttggggtacatactagctat

SEQ ID NO: 976741 - DNA, 22 bp, Artificial Sequence
  chemically synthesized
ttggtttggggtacatactagc

SEQ ID NO: 976742 - DNA, 22 bp, Artificial Sequence
  chemically synthesized
gttggtttggggtacatactag

SEQ ID NO: 976743 - DNA, 22 bp, Artificial Sequence
  chemically synthesized
tattgcatagctagtatgtacc

SEQ ID NO: 976744 - DNA, 22 bp, Artificial Sequence
  chemically synthesized
catagctagtatgtaccccaaa

SEQ ID NO: 976745 - DNA, 22 bp, Artificial Sequence
  chemically synthesized
aaatatatttgttggtttgggg

SEQ ID NO: 976746 - DNA, 22 bp, Artificial Sequence
  chemically synthesized
aaaatatatttgttggtttggg

SEQ ID NO: 976747 - DNA, 22 bp, Artificial Sequence
  chemically synthesized
taaaatatatttgttggtttgg

SEQ ID NO: 976748 - DNA, 22 bp, Artificial Sequence
  chemically synthesized
gtatgtaccccaaaccaacaaa

SEQ ID NO: 976749 - DNA, 22 bp, Artificial Sequence
  chemically synthesized
atggacctttaaaatatatttg

SEQ ID NO: 976750 - DNA, 22 bp, Artificial Sequence
  chemically synthesized
gatggacctttaaaatatattt

SEQ ID NO: 976751 - DNA, 22 bp, Artificial Sequence
  chemically synthesized
tttgatggacctttaaaatata

SEQ ID NO: 976752 - DNA, 22 bp, Artificial Sequence
  chemically synthesized
ggctgtttgatggacctttaaa

SEQ ID NO: 976753 - DNA, 22 bp, Artificial Sequence
  chemically synthesized
ttgggctgtttgatggaccttt

SEQ ID NO: 976754 - DNA, 22 bp, Artificial Sequence
  chemically synthesized
attgggctgtttgatggacctt

SEQ ID NO: 976755 - DNA, 22 bp, Artificial Sequence
  chemically synthesized
taaaggtccatcaaacagccca

SEQ ID NO: 976756 - DNA, 22 bp, Artificial Sequence
  chemically synthesized
aaaggtccatcaaacagcccaa

SEQ ID NO: 976757 - DNA, 22 bp, Artificial Sequence
  chemically synthesized
aaggtccatcaaacagcccaat

SEQ ID NO: 976758 - DNA, 22 bp, Artificial Sequence
  chemically synthesized
catgcgtatgtgaaaatggaac

SEQ ID NO: 976759 - DNA, 22 bp, Artificial Sequence
  chemically synthesized
taaaatgctgcatgcgtatgtg

SEQ ID NO: 976760 - DNA, 22 bp, Artificial Sequence
  chemically synthesized
ttataaaatgctgcatgcgtat

SEQ ID NO: 976761 - DNA, 22 bp, Artificial Sequence
  chemically synthesized
cattttcacatacgcatgcagc

SEQ ID NO: 976762 - DNA, 22 bp, Artificial Sequence
  chemically synthesized
ggactgttataaaatgctgcat

SEQ ID NO: 976763 - DNA, 22 bp, Artificial Sequence
  chemically synthesized
tcacatacgcatgcagcatttt

SEQ ID NO: 976764 - DNA, 22 bp, Artificial Sequence
  chemically synthesized
cacatacgcatgcagcatttta

SEQ ID NO: 976765 - DNA, 22 bp, Artificial Sequence
  chemically synthesized
acatacgcatgcagcattttat

SEQ ID NO: 976766 - DNA, 22 bp, Artificial Sequence
  chemically synthesized
tatatacacatatcctaggact

SEQ ID NO: 976767 - DNA, 22 bp, Artificial Sequence
  chemically synthesized
tgtatatacacatatcctagga

SEQ ID NO: 976768 - DNA, 22 bp, Artificial Sequence
  chemically synthesized
tataacagtcctaggatatgtg

SEQ ID NO: 976769 - DNA, 22 bp, Artificial Sequence
  chemically synthesized
ataacagtcctaggatatgtgt

SEQ ID NO: 976770 - DNA, 22 bp, Artificial Sequence
  chemically synthesized
taacagtcctaggatatgtgta

SEQ ID NO: 976771 - DNA, 22 bp, Artificial Sequence
  chemically synthesized
catccctctgtatatacacata

SEQ ID NO: 976772 - DNA, 22 bp, Artificial Sequence
  chemically synthesized
ccatccctctgtatatacacat

SEQ ID NO: 976773 - DNA, 22 bp, Artificial Sequence
  chemically synthesized
tccatccctctgtatatacaca

SEQ ID NO: 976774 - DNA, 22 bp, Artificial Sequence
  chemically synthesized
ttccatccctctgtatatacac

SEQ ID NO: 976775 - DNA, 22 bp, Artificial Sequence
  chemically synthesized
tttccatccctctgtatataca

SEQ ID NO: 976776 - DNA, 22 bp, Artificial Sequence
  chemically synthesized
ggatatgtgtatatacagaggg

SEQ ID NO: 976777 - DNA, 22 bp, Artificial Sequence
  chemically synthesized
tattttttccatccctctgtat

SEQ ID NO: 976778 - DNA, 22 bp, Artificial Sequence
  chemically synthesized
aaactgtattttttccatccct

SEQ ID NO: 976779 - DNA, 22 bp, Artificial Sequence
  chemically synthesized
aaaactgtattttttccatccc

SEQ ID NO: 976780 - DNA, 22 bp, Artificial Sequence
  chemically synthesized
taaaactgtattttttccatcc

SEQ ID NO: 976781 - DNA, 22 bp, Artificial Sequence
  chemically synthesized
ttaaaactgtattttttccatc

SEQ ID NO: 976782 - DNA, 22 bp, Artificial Sequence
  chemically synthesized
tcttttaaaactgtattttttc

SEQ ID NO: 976783 - DNA, 22 bp, Artificial Sequence
  chemically synthesized
tgtcttttaaaactgtattttt

SEQ ID NO: 976784 - DNA, 22 bp, Artificial Sequence
  chemically synthesized
ctgtcttttaaaactgtatttt

SEQ ID NO: 976785 - DNA, 22 bp, Artificial Sequence
  chemically synthesized
taaaagacagaaatttacccta

SEQ ID NO: 976786 - DNA, 22 bp, Artificial Sequence
  chemically synthesized
aaaagacagaaatttaccctac

SEQ ID NO: 976787 - DNA, 22 bp, Artificial Sequence
  chemically synthesized
aaagacagaaatttaccctaca

SEQ ID NO: 976788 - DNA, 22 bp, Artificial Sequence
  chemically synthesized
cccagatggcaataaaatgtag

SEQ ID NO: 976789 - DNA, 22 bp, Artificial Sequence
  chemically synthesized
tgcccagatggcaataaaatgt

SEQ ID NO: 976790 - DNA, 22 bp, Artificial Sequence
  chemically synthesized
ctgcccagatggcaataaaatg

SEQ ID NO: 976791 - DNA, 22 bp, Artificial Sequence
  chemically synthesized
accctacattttattgccatct

SEQ ID NO: 976792 - DNA, 22 bp, Artificial Sequence
  chemically synthesized
ccctacattttattgccatctg

SEQ ID NO: 976793 - DNA, 22 bp, Artificial Sequence
  chemically synthesized
cattttattgccatctgggcag

SEQ ID NO: 976794 - DNA, 22 bp, Artificial Sequence
  chemically synthesized
tattgccatctgggcagaaaca

SEQ ID NO: 976795 - DNA, 22 bp, Artificial Sequence
  chemically synthesized
attgccatctgggcagaaacac

SEQ ID NO: 976796 - DNA, 22 bp, Artificial Sequence
  chemically synthesized
ttgccatctgggcagaaacaca

SEQ ID NO: 976797 - DNA, 22 bp, Artificial Sequence
  chemically synthesized
ccatctgggcagaaacacacgt

SEQ ID NO: 976798 - DNA, 22 bp, Artificial Sequence
  chemically synthesized
ggcagaaacacacgttccattc

SEQ ID NO: 976799 - DNA, 22 bp, Artificial Sequence
  chemically synthesized
ggagaagccacggagaaacgaa

SEQ ID NO: 976800 - DNA, 22 bp, Artificial Sequence
  chemically synthesized
gggagaagccacggagaaacga

SEQ ID NO: 976801 - DNA, 22 bp, Artificial Sequence
  chemically synthesized
tgggagaagccacggagaaacg

SEQ ID NO: 976802 - DNA, 22 bp, Artificial Sequence
  chemically synthesized
tttgggagaagccacggagaaa

SEQ ID NO: 976803 - DNA, 22 bp, Artificial Sequence
  chemically synthesized
cattcttttcgtttctccgtgg

SEQ ID NO: 976804 - DNA, 22 bp, Artificial Sequence
  chemically synthesized
tctttgggagaagccacggaga

SEQ ID NO: 976805 - DNA, 22 bp, Artificial Sequence
  chemically synthesized
ctctttgggagaagccacggag

SEQ ID NO: 976806 - DNA, 22 bp, Artificial Sequence
  chemically synthesized
ttttcgtttctccgtggcttct

SEQ ID NO: 976807 - DNA, 22 bp, Artificial Sequence
  chemically synthesized
tttctctttgggagaagccacg

SEQ ID NO: 976808 - DNA, 22 bp, Artificial Sequence
  chemically synthesized
ttcgtttctccgtggcttctcc

SEQ ID NO: 976809 - DNA, 22 bp, Artificial Sequence
  chemically synthesized
tcgtttctccgtggcttctccc

SEQ ID NO: 976810 - DNA, 22 bp, Artificial Sequence
  chemically synthesized
cgtttctccgtggcttctccca

SEQ ID NO: 976811 - DNA, 22 bp, Artificial Sequence
  chemically synthesized
gtttctccgtggcttctcccaa

SEQ ID NO: 976812 - DNA, 22 bp, Artificial Sequence
  chemically synthesized
ctccgtggcttctcccaaagag

SEQ ID NO: 976813 - DNA, 22 bp, Artificial Sequence
  chemically synthesized
tccgtggcttctcccaaagaga

SEQ ID NO: 976814 - DNA, 22 bp, Artificial Sequence
  chemically synthesized
cgtggcttctcccaaagagaaa

SEQ ID NO: 976815 - DNA, 22 bp, Artificial Sequence
  chemically synthesized
aagaaacaggcctatttctctt

SEQ ID NO: 976816 - DNA, 22 bp, Artificial Sequence
  chemically synthesized
aaagaaacaggcctatttctct

SEQ ID NO: 976817 - DNA, 22 bp, Artificial Sequence
  chemically synthesized
tttaaagaaacaggcctatttc

SEQ ID NO: 976818 - DNA, 22 bp, Artificial Sequence
  chemically synthesized
ctcccaaagagaaataggcctg

SEQ ID NO: 976819 - DNA, 22 bp, Artificial Sequence
  chemically synthesized
tcccaaagagaaataggcctgt

SEQ ID NO: 976820 - DNA, 22 bp, Artificial Sequence
  chemically synthesized
ccaaagagaaataggcctgttt

SEQ ID NO: 976821 - DNA, 22 bp, Artificial Sequence
  chemically synthesized
taaaaaaattgtttaaagaaac

SEQ ID NO: 976822 - DNA, 22 bp, Artificial Sequence
  chemically synthesized
ataaaaaaattgtttaaagaaa

SEQ ID NO: 976823 - DNA, 22 bp, Artificial Sequence
  chemically synthesized
tttctttaaacaatttttttat

SEQ ID NO: 976824 - DNA, 22 bp, Artificial Sequence
  chemically synthesized
ctttaaacaatttttttataag

SEQ ID NO: 976825 - DNA, 22 bp, Artificial Sequence
  chemically synthesized
tttaaacaatttttttataagc

SEQ ID NO: 976826 - DNA, 22 bp, Artificial Sequence
  chemically synthesized
aagaagggatagcgcttataaa

SEQ ID NO: 976827 - DNA, 22 bp, Artificial Sequence
  chemically synthesized
taaacaatttttttataagcgc

SEQ ID NO: 976828 - DNA, 22 bp, Artificial Sequence
  chemically synthesized
caagaagggatagcgcttataa

SEQ ID NO: 976829 - DNA, 22 bp, Artificial Sequence
  chemically synthesized
aaacaatttttttataagcgct

SEQ ID NO: 976830 - DNA, 22 bp, Artificial Sequence
  chemically synthesized
aacaatttttttataagcgcta

SEQ ID NO: 976831 - DNA, 22 bp, Artificial Sequence
  chemically synthesized
aacttcaagaagggatagcgct

SEQ ID NO: 976832 - DNA, 22 bp, Artificial Sequence
  chemically synthesized
ttttataagcgctatcccttct

SEQ ID NO: 976833 - DNA, 22 bp, Artificial Sequence
  chemically synthesized
tactcaacttcaagaagggata

SEQ ID NO: 976834 - DNA, 22 bp, Artificial Sequence
  chemically synthesized
tttataagcgctatcccttctt

SEQ ID NO: 976835 - DNA, 22 bp, Artificial Sequence
  chemically synthesized
ttataagcgctatcccttcttg

SEQ ID NO: 976836 - DNA, 22 bp, Artificial Sequence
  chemically synthesized
tataagcgctatcccttcttga

SEQ ID NO: 976837 - DNA, 22 bp, Artificial Sequence
  chemically synthesized
ataagcgctatcccttcttgaa

SEQ ID NO: 976838 - DNA, 22 bp, Artificial Sequence
  chemically synthesized
taagcgctatcccttcttgaag

SEQ ID NO: 976839 - DNA, 22 bp, Artificial Sequence
  chemically synthesized
tgctatactcaacttcaagaag

SEQ ID NO: 976840 - DNA, 22 bp, Artificial Sequence
  chemically synthesized
ttatgctatactcaacttcaag

SEQ ID NO: 976841 - DNA, 22 bp, Artificial Sequence
  chemically synthesized
gttatgctatactcaacttcaa

SEQ ID NO: 976842 - DNA, 22 bp, Artificial Sequence
  chemically synthesized
tcccttcttgaagttgagtata

SEQ ID NO: 976843 - DNA, 22 bp, Artificial Sequence
  chemically synthesized
gtaaatttgttatgctatactc

SEQ ID NO: 976844 - DNA, 22 bp, Artificial Sequence
  chemically synthesized
agtaaatttgttatgctatact

SEQ ID NO: 976845 - DNA, 22 bp, Artificial Sequence
  chemically synthesized
tagtaaatttgttatgctatac

SEQ ID NO: 976846 - DNA, 22 bp, Artificial Sequence
  chemically synthesized
cttgaagttgagtatagcataa

SEQ ID NO: 976847 - DNA, 22 bp, Artificial Sequence
  chemically synthesized
ttgaagttgagtatagcataac

SEQ ID NO: 976848 - DNA, 22 bp, Artificial Sequence
  chemically synthesized
gaagttgagtatagcataacaa

SEQ ID NO: 976849 - DNA, 22 bp, Artificial Sequence
  chemically synthesized
aagttgagtatagcataacaaa

SEQ ID NO: 976850 - DNA, 22 bp, Artificial Sequence
  chemically synthesized
agtatagcataacaaatttact

SEQ ID NO: 976851 - DNA, 22 bp, Artificial Sequence
  chemically synthesized
agaaaaaaattttagtaaattt

SEQ ID NO: 976852 - DNA, 22 bp, Artificial Sequence
  chemically synthesized
aagaaaaaaattttagtaaatt

SEQ ID NO: 976853 - DNA, 22 bp, Artificial Sequence
  chemically synthesized
tccttaagaaaaaaattttagt

SEQ ID NO: 976854 - DNA, 22 bp, Artificial Sequence
  chemically synthesized
ttatccttaagaaaaaaatttt

SEQ ID NO: 976855 - DNA, 22 bp, Artificial Sequence
  chemically synthesized
ctgttatccttaagaaaaaaat

SEQ ID NO: 976856 - DNA, 22 bp, Artificial Sequence
  chemically synthesized
tactgttatccttaagaaaaaa

SEQ ID NO: 976857 - DNA, 22 bp, Artificial Sequence
  chemically synthesized
ttctactgttatccttaagaaa

SEQ ID NO: 976858 - DNA, 22 bp, Artificial Sequence
  chemically synthesized
actaaaatttttttcttaagga

SEQ ID NO: 976859 - DNA, 22 bp, Artificial Sequence
  chemically synthesized
attctactgttatccttaagaa

SEQ ID NO: 976860 - DNA, 22 bp, Artificial Sequence
  chemically synthesized
ctaaaatttttttcttaaggat

SEQ ID NO: 976861 - DNA, 22 bp, Artificial Sequence
  chemically synthesized
tattctactgttatccttaaga

SEQ ID NO: 976862 - DNA, 22 bp, Artificial Sequence
  chemically synthesized
tttattctactgttatccttaa

SEQ ID NO: 976863 - DNA, 22 bp, Artificial Sequence
  chemically synthesized
aaatttttttcttaaggataac

SEQ ID NO: 976864 - DNA, 22 bp, Artificial Sequence
  chemically synthesized
ttctttattctactgttatcct

SEQ ID NO: 976865 - DNA, 22 bp, Artificial Sequence
  chemically synthesized
ttttcttaaggataacagtaga

SEQ ID NO: 976866 - DNA, 22 bp, Artificial Sequence
  chemically synthesized
attgttctttattctactgtta

SEQ ID NO: 976867 - DNA, 22 bp, Artificial Sequence
  chemically synthesized
tttcttaaggataacagtagaa

SEQ ID NO: 976868 - DNA, 22 bp, Artificial Sequence
  chemically synthesized
ttcttaaggataacagtagaat

SEQ ID NO: 976869 - DNA, 22 bp, Artificial Sequence
  chemically synthesized
tcttaaggataacagtagaata

SEQ ID NO: 976870 - DNA, 22 bp, Artificial Sequence
  chemically synthesized
cttaaggataacagtagaataa

SEQ ID NO: 976871 - DNA, 22 bp, Artificial Sequence
  chemically synthesized
ttaaggataacagtagaataaa

SEQ ID NO: 976872 - DNA, 22 bp, Artificial Sequence
  chemically synthesized
aaggataacagtagaataaaga

SEQ ID NO: 976873 - DNA, 22 bp, Artificial Sequence
  chemically synthesized
aggataacagtagaataaagaa

SEQ ID NO: 976874 - DNA, 22 bp, Artificial Sequence
  chemically synthesized
taacaaagtggctcattgttct

SEQ ID NO: 976875 - DNA, 22 bp, Artificial Sequence
  chemically synthesized
tgtaacaaagtggctcattgtt

SEQ ID NO: 976876 - DNA, 22 bp, Artificial Sequence
  chemically synthesized
tctctgtaacaaagtggctcat

SEQ ID NO: 976877 - DNA, 22 bp, Artificial Sequence
  chemically synthesized
atctctgtaacaaagtggctca

SEQ ID NO: 976878 - DNA, 22 bp, Artificial Sequence
  chemically synthesized
tgttacagagataagccatgtc

SEQ ID NO: 976879 - DNA, 22 bp, Artificial Sequence
  chemically synthesized
gttacagagataagccatgtca

SEQ ID NO: 976880 - DNA, 22 bp, Artificial Sequence
  chemically synthesized
ttacagagataagccatgtcat

SEQ ID NO: 976881 - DNA, 22 bp, Artificial Sequence
  chemically synthesized
taaaccaaaagaatgacatggc

SEQ ID NO: 976882 - DNA, 22 bp, Artificial Sequence
  chemically synthesized
cagagataagccatgtcattct

SEQ ID NO: 976883 - DNA, 22 bp, Artificial Sequence
  chemically synthesized
ggcaaatacattataaaccaaa

SEQ ID NO: 976884 - DNA, 22 bp, Artificial Sequence
  chemically synthesized
gggcaaatacattataaaccaa

SEQ ID NO: 976885 - DNA, 22 bp, Artificial Sequence
  chemically synthesized
tgggcaaatacattataaacca

SEQ ID NO: 976886 - DNA, 22 bp, Artificial Sequence
  chemically synthesized
ttgggcaaatacattataaacc

SEQ ID NO: 976887 - DNA, 22 bp, Artificial Sequence
  chemically synthesized
ttttggtttataatgtatttgc

SEQ ID NO: 976888 - DNA, 22 bp, Artificial Sequence
  chemically synthesized
ttggtttataatgtatttgccc

SEQ ID NO: 976889 - DNA, 22 bp, Artificial Sequence
  chemically synthesized
tggtttataatgtatttgccca

SEQ ID NO: 976890 - DNA, 22 bp, Artificial Sequence
  chemically synthesized
ggtttataatgtatttgcccaa

SEQ ID NO: 976891 - DNA, 22 bp, Artificial Sequence
  chemically synthesized
gtttataatgtatttgcccaaa

SEQ ID NO: 976892 - DNA, 22 bp, Artificial Sequence
  chemically synthesized
gccacataatacttttgggcaa

SEQ ID NO: 976893 - DNA, 22 bp, Artificial Sequence
  chemically synthesized
ataatgtatttgcccaaaagta

SEQ ID NO: 976894 - DNA, 22 bp, Artificial Sequence
  chemically synthesized
taatgtatttgcccaaaagtat

SEQ ID NO: 976895 - DNA, 22 bp, Artificial Sequence
  chemically synthesized
tcagctagccacataatacttt

SEQ ID NO: 976896 - DNA, 22 bp, Artificial Sequence
  chemically synthesized
gcccaaaagtattatgtggcta

SEQ ID NO: 976897 - DNA, 22 bp, Artificial Sequence
  chemically synthesized
cccaaaagtattatgtggctag

SEQ ID NO: 976898 - DNA, 22 bp, Artificial Sequence
  chemically synthesized
tgcagctatcagctagccacat

SEQ ID NO: 976899 - DNA, 22 bp, Artificial Sequence
  chemically synthesized
gtctatgcagctatcagctagc

SEQ ID NO: 976900 - DNA, 22 bp, Artificial Sequence
  chemically synthesized
tagttagtctatgcagctatca

SEQ ID NO: 976901 - DNA, 22 bp, Artificial Sequence
  chemically synthesized
tgtggctagctgatagctgcat

SEQ ID NO: 976902 - DNA, 22 bp, Artificial Sequence
  chemically synthesized
gctgatagctgcatagactaac

SEQ ID NO: 976903 - DNA, 22 bp, Artificial Sequence
  chemically synthesized
atagctgcatagactaactaca

SEQ ID NO: 976904 - DNA, 22 bp, Artificial Sequence
  chemically synthesized
catagactaactacagcttttt

SEQ ID NO: 976905 - DNA, 22 bp, Artificial Sequence
  chemically synthesized
gtgtatcacaaatagtaaaaag

SEQ ID NO: 976906 - DNA, 22 bp, Artificial Sequence
  chemically synthesized
actacagctttttactatttgt

SEQ ID NO: 976907 - DNA, 22 bp, Artificial Sequence
  chemically synthesized
cagctttttactatttgtgata

SEQ ID NO: 976908 - DNA, 22 bp, Artificial Sequence
  chemically synthesized
aagggaacctggtgtatcacaa

SEQ ID NO: 976909 - DNA, 22 bp, Artificial Sequence
  chemically synthesized
tttactatttgtgatacaccag

SEQ ID NO: 976910 - DNA, 22 bp, Artificial Sequence
  chemically synthesized
attaaagggaacctggtgtatc

SEQ ID NO: 976911 - DNA, 22 bp, Artificial Sequence
  chemically synthesized
ttactatttgtgatacaccagg

SEQ ID NO: 976912 - DNA, 22 bp, Artificial Sequence
  chemically synthesized
gattaaagggaacctggtgtat

SEQ ID NO: 976913 - DNA, 22 bp, Artificial Sequence
  chemically synthesized
tactatttgtgatacaccaggt

SEQ ID NO: 976914 - DNA, 22 bp, Artificial Sequence
  chemically synthesized
actatttgtgatacaccaggtt

SEQ ID NO: 976915 - DNA, 22 bp, Artificial Sequence
  chemically synthesized
ctatttgtgatacaccaggttc

SEQ ID NO: 976916 - DNA, 22 bp, Artificial Sequence
  chemically synthesized
tttgtgatacaccaggttccct

SEQ ID NO: 976917 - DNA, 22 bp, Artificial Sequence
  chemically synthesized
aagtttgattaaagggaacctg

SEQ ID NO: 976918 - DNA, 22 bp, Artificial Sequence
  chemically synthesized
gtgatacaccaggttcccttta

SEQ ID NO: 976919 - DNA, 22 bp, Artificial Sequence
  chemically synthesized
tgatacaccaggttccctttaa

SEQ ID NO: 976920 - DNA, 22 bp, Artificial Sequence
  chemically synthesized
cctttaatcaaacttcagttat

SEQ ID NO: 976921 - DNA, 22 bp, Artificial Sequence
  chemically synthesized
taatcaaacttcagttatctgt

SEQ ID NO: 976922 - DNA, 22 bp, Artificial Sequence
  chemically synthesized
aatcaaacttcagttatctgta

SEQ ID NO: 976923 - DNA, 22 bp, Artificial Sequence
  chemically synthesized
atcaaacttcagttatctgtat

SEQ ID NO: 976924 - DNA, 22 bp, Artificial Sequence
  chemically synthesized
aggagaatatagatacagataa

SEQ ID NO: 976925 - DNA, 22 bp, Artificial Sequence
  chemically synthesized
tcctaaggagaatatagataca

SEQ ID NO: 976926 - DNA, 22 bp, Artificial Sequence
  chemically synthesized
atcctaaggagaatatagatac

SEQ ID NO: 976927 - DNA, 22 bp, Artificial Sequence
  chemically synthesized
cagttatctgtatctatattct

SEQ ID NO: 976928 - DNA, 22 bp, Artificial Sequence
  chemically synthesized
agttatctgtatctatattctc

SEQ ID NO: 976929 - DNA, 22 bp, Artificial Sequence
  chemically synthesized
ggcttatcctaaggagaatata

SEQ ID NO: 976930 - DNA, 22 bp, Artificial Sequence
  chemically synthesized
tctgtatctatattctccttag

SEQ ID NO: 976931 - DNA, 22 bp, Artificial Sequence
  chemically synthesized
tatctatattctccttaggata

SEQ ID NO: 976932 - DNA, 22 bp, Artificial Sequence
  chemically synthesized
gacaatctaggcttatcctaag

SEQ ID NO: 976933 - DNA, 22 bp, Artificial Sequence
  chemically synthesized
agacaatctaggcttatcctaa

SEQ ID NO: 976934 - DNA, 22 bp, Artificial Sequence
  chemically synthesized
tattctccttaggataagccta

SEQ ID NO: 976935 - DNA, 22 bp, Artificial Sequence
  chemically synthesized
aatttagacaatctaggcttat

SEQ ID NO: 976936 - DNA, 22 bp, Artificial Sequence
  chemically synthesized
taaatttagacaatctaggctt

SEQ ID NO: 976937 - DNA, 22 bp, Artificial Sequence
  chemically synthesized
tccttaggataagcctagattg

SEQ ID NO: 976938 - DNA, 22 bp, Artificial Sequence
  chemically synthesized
cttaggataagcctagattgtc

SEQ ID NO: 976939 - DNA, 22 bp, Artificial Sequence
  chemically synthesized
aggataagcctagattgtctaa

SEQ ID NO: 976940 - DNA, 22 bp, Artificial Sequence
  chemically synthesized
ggataagcctagattgtctaaa

SEQ ID NO: 976941 - DNA, 22 bp, Artificial Sequence
  chemically synthesized
gggtggtagcaagctctaaatt

SEQ ID NO: 976942 - DNA, 22 bp, Artificial Sequence
  chemically synthesized
gattgtctaaatttagagcttg

SEQ ID NO: 976943 - DNA, 22 bp, Artificial Sequence
  chemically synthesized
tctaaatttagagcttgctacc

SEQ ID NO: 976944 - DNA, 22 bp, Artificial Sequence
  chemically synthesized
aatttagagcttgctaccaccc

SEQ ID NO: 976945 - DNA, 22 bp, Artificial Sequence
  chemically synthesized
agagcttgctaccaccccagac

SEQ ID NO: 976946 - DNA, 22 bp, Artificial Sequence
  chemically synthesized
gagcttgctaccaccccagaca

SEQ ID NO: 976947 - DNA, 22 bp, Artificial Sequence
  chemically synthesized
gctaccaccccagacattcttt

SEQ ID NO: 976948 - DNA, 22 bp, Artificial Sequence
  chemically synthesized
ctaccaccccagacattctttc

SEQ ID NO: 976949 - DNA, 22 bp, Artificial Sequence
  chemically synthesized
ccaccccagacattctttcttt

SEQ ID NO: 976950 - DNA, 22 bp, Artificial Sequence
  chemically synthesized
atatgataaccaaaaagaaaga

SEQ ID NO: 976951 - DNA, 22 bp, Artificial Sequence
  chemically synthesized
gatatgataaccaaaaagaaag

SEQ ID NO: 976952 - DNA, 22 bp, Artificial Sequence
  chemically synthesized
ggacttgatatgataaccaaaa

SEQ ID NO: 976953 - DNA, 22 bp, Artificial Sequence
  chemically synthesized
tttctttttggttatcatatca

SEQ ID NO: 976954 - DNA, 22 bp, Artificial Sequence
  chemically synthesized
cacagttgggacttgatatgat

SEQ ID NO: 976955 - DNA, 22 bp, Artificial Sequence
  chemically synthesized
tctttttggttatcatatcaag

SEQ ID NO: 976956 - DNA, 22 bp, Artificial Sequence
  chemically synthesized
ctttttggttatcatatcaagt

SEQ ID NO: 976957 - DNA, 22 bp, Artificial Sequence
  chemically synthesized
tttttggttatcatatcaagtc

SEQ ID NO: 976958 - DNA, 22 bp, Artificial Sequence
  chemically synthesized
tttggttatcatatcaagtccc

SEQ ID NO: 976959 - DNA, 22 bp, Artificial Sequence
  chemically synthesized
ttggttatcatatcaagtccca

SEQ ID NO: 976960 - DNA, 22 bp, Artificial Sequence
  chemically synthesized
tggttatcatatcaagtcccaa

SEQ ID NO: 976961 - DNA, 22 bp, Artificial Sequence
  chemically synthesized
caggctgcacagttgggacttg

SEQ ID NO: 976962 - DNA, 22 bp, Artificial Sequence
  chemically synthesized
ggttatcatatcaagtcccaac

SEQ ID NO: 976963 - DNA, 22 bp, Artificial Sequence
  chemically synthesized
gttatcatatcaagtcccaact

SEQ ID NO: 976964 - DNA, 22 bp, Artificial Sequence
  chemically synthesized
aattccaggctgcacagttggg

SEQ ID NO: 976965 - DNA, 22 bp, Artificial Sequence
  chemically synthesized
tcatatcaagtcccaactgtgc

SEQ ID NO: 976966 - DNA, 22 bp, Artificial Sequence
  chemically synthesized
acattgaattccaggctgcaca

SEQ ID NO: 976967 - DNA, 22 bp, Artificial Sequence
  chemically synthesized
tgcagcctggaattcaatgtca

SEQ ID NO: 976968 - DNA, 22 bp, Artificial Sequence
  chemically synthesized
tgtgaggtatggaaagtggttg

SEQ ID NO: 976969 - DNA, 22 bp, Artificial Sequence
  chemically synthesized
gaattcaatgtcaaccactttc

SEQ ID NO: 976970 - DNA, 22 bp, Artificial Sequence
  chemically synthesized
aatgtcaaccactttccatacc

SEQ ID NO: 976971 - DNA, 22 bp, Artificial Sequence
  chemically synthesized
atggaatcacagggattgtgtg

SEQ ID NO: 976972 - DNA, 22 bp, Artificial Sequence
  chemically synthesized
tccatacctcacacaatccctg

SEQ ID NO: 976973 - DNA, 22 bp, Artificial Sequence
  chemically synthesized
ccatacctcacacaatccctgt

SEQ ID NO: 976974 - DNA, 22 bp, Artificial Sequence
  chemically synthesized
catacctcacacaatccctgtg

SEQ ID NO: 976975 - DNA, 22 bp, Artificial Sequence
  chemically synthesized
ggtcagagctgatggaatcaca

SEQ ID NO: 976976 - DNA, 22 bp, Artificial Sequence
  chemically synthesized
acacaatccctgtgattccatc

SEQ ID NO: 976977 - DNA, 22 bp, Artificial Sequence
  chemically synthesized
tgattcggtcagagctgatgga

SEQ ID NO: 976978 - DNA, 22 bp, Artificial Sequence
  chemically synthesized
ttatgattcggtcagagctgat

SEQ ID NO: 976979 - DNA, 22 bp, Artificial Sequence
  chemically synthesized
attatgattcggtcagagctga

SEQ ID NO: 976980 - DNA, 22 bp, Artificial Sequence
  chemically synthesized
tttattatgattcggtcagagc

SEQ ID NO: 976981 - DNA, 22 bp, Artificial Sequence
  chemically synthesized
tgattccatcagctctgaccga

SEQ ID NO: 976982 - DNA, 22 bp, Artificial Sequence
  chemically synthesized
ttgtttattatgattcggtcag

SEQ ID NO: 976983 - DNA, 22 bp, Artificial Sequence
  chemically synthesized
catcagctctgaccgaatcata

SEQ ID NO: 976984 - DNA, 22 bp, Artificial Sequence
  chemically synthesized
tgaccgaatcataataaacaac

SEQ ID NO: 976985 - DNA, 22 bp, Artificial Sequence
  chemically synthesized
accgaatcataataaacaacag

SEQ ID NO: 976986 - DNA, 22 bp, Artificial Sequence
  chemically synthesized
aagcatcataataaactgttgt

SEQ ID NO: 976987 - DNA, 22 bp, Artificial Sequence
  chemically synthesized
gaagcatcataataaactgttg

SEQ ID NO: 976988 - DNA, 22 bp, Artificial Sequence
  chemically synthesized
cagagatgggacttgaagcatc

SEQ ID NO: 976989 - DNA, 22 bp, Artificial Sequence
  chemically synthesized
ctgcagagatgggacttgaagc

SEQ ID NO: 976990 - DNA, 22 bp, Artificial Sequence
  chemically synthesized
gctgcagagatgggacttgaag

SEQ ID NO: 976991 - DNA, 22 bp, Artificial Sequence
  chemically synthesized
attatgatgcttcaagtcccat

SEQ ID NO: 976992 - DNA, 22 bp, Artificial Sequence
  chemically synthesized
ttatgatgcttcaagtcccatc

SEQ ID NO: 976993 - DNA, 22 bp, Artificial Sequence
  chemically synthesized
tgatgcttcaagtcccatctct

SEQ ID NO: 976994 - DNA, 22 bp, Artificial Sequence
  chemically synthesized
gagaagcacttgctgcagagat

SEQ ID NO: 976995 - DNA, 22 bp, Artificial Sequence
  chemically synthesized
caagtcccatctctgcagcaag

SEQ ID NO: 976996 - DNA, 22 bp, Artificial Sequence
  chemically synthesized
aagtcccatctctgcagcaagt

SEQ ID NO: 976997 - DNA, 22 bp, Artificial Sequence
  chemically synthesized
aatcacctggagaagcacttgc

SEQ ID NO: 976998 - DNA, 22 bp, Artificial Sequence
  chemically synthesized
gtaattaaatcacctggagaag

SEQ ID NO: 976999 - DNA, 22 bp, Artificial Sequence
  chemically synthesized
tgcagcaagtgcttctccaggt

SEQ ID NO: 977000 - DNA, 22 bp, Artificial Sequence
  chemically synthesized
cagcaagtgcttctccaggtga

SEQ ID NO: 977001 - DNA, 22 bp, Artificial Sequence
  chemically synthesized
ttggtaattaaatcacctggag

SEQ ID NO: 977002 - DNA, 22 bp, Artificial Sequence
  chemically synthesized
aaaagattattggtaattaaat

SEQ ID NO: 977003 - DNA, 22 bp, Artificial Sequence
  chemically synthesized
aaaaagattattggtaattaaa

SEQ ID NO: 977004 - DNA, 22 bp, Artificial Sequence
  chemically synthesized
taaaaagattattggtaattaa

SEQ ID NO: 977005 - DNA, 22 bp, Artificial Sequence
  chemically synthesized
ctccaggtgatttaattaccaa

SEQ ID NO: 977006 - DNA, 22 bp, Artificial Sequence
  chemically synthesized
tccaggtgatttaattaccaat

SEQ ID NO: 977007 - DNA, 22 bp, Artificial Sequence
  chemically synthesized
caggtgatttaattaccaataa

SEQ ID NO: 977008 - DNA, 22 bp, Artificial Sequence
  chemically synthesized
agattttaaaaagattattggt

SEQ ID NO: 977009 - DNA, 22 bp, Artificial Sequence
  chemically synthesized
cagattttaaaaagattattgg

SEQ ID NO: 977010 - DNA, 22 bp, Artificial Sequence
  chemically synthesized
gggtttcagattttaaaaagat

SEQ ID NO: 977011 - DNA, 22 bp, Artificial Sequence
  chemically synthesized
aattaccaataatctttttaaa

SEQ ID NO: 977012 - DNA, 22 bp, Artificial Sequence
  chemically synthesized
attaccaataatctttttaaaa

SEQ ID NO: 977013 - DNA, 22 bp, Artificial Sequence
  chemically synthesized
ccaataatctttttaaaatctg

SEQ ID NO: 977014 - DNA, 22 bp, Artificial Sequence
  chemically synthesized
tttaaaatctgaaaccccagtc

SEQ ID NO: 977015 - DNA, 22 bp, Artificial Sequence
  chemically synthesized
ttaaaatctgaaaccccagtcc

SEQ ID NO: 977016 - DNA, 22 bp, Artificial Sequence
  chemically synthesized
taaaatctgaaaccccagtccc

SEQ ID NO: 977017 - DNA, 22 bp, Artificial Sequence
  chemically synthesized
aaaatctgaaaccccagtcccg

SEQ ID NO: 977018 - DNA, 22 bp, Artificial Sequence
  chemically synthesized
aatgggcaaaaacgggactggg

SEQ ID NO: 977019 - DNA, 22 bp, Artificial Sequence
  chemically synthesized
aaatctgaaaccccagtcccgt

SEQ ID NO: 977020 - DNA, 22 bp, Artificial Sequence
  chemically synthesized
ctcaatgggcaaaaacgggact

SEQ ID NO: 977021 - DNA, 22 bp, Artificial Sequence
  chemically synthesized
tgctcaatgggcaaaaacggga

SEQ ID NO: 977022 - DNA, 22 bp, Artificial Sequence
  chemically synthesized
aaaccccagtcccgtttttgcc

SEQ ID NO: 977023 - DNA, 22 bp, Artificial Sequence
  chemically synthesized
gcctctgctcaatgggcaaaaa

SEQ ID NO: 977024 - DNA, 22 bp, Artificial Sequence
  chemically synthesized
tataataaatcctagcctctgc

SEQ ID NO: 977025 - DNA, 22 bp, Artificial Sequence
  chemically synthesized
ttgcccattgagcagaggctag

SEQ ID NO: 977026 - DNA, 22 bp, Artificial Sequence
  chemically synthesized
tgcccattgagcagaggctagg

SEQ ID NO: 977027 - DNA, 22 bp, Artificial Sequence
  chemically synthesized
tgtataataaatcctagcctct

SEQ ID NO: 977028 - DNA, 22 bp, Artificial Sequence
  chemically synthesized
gcccattgagcagaggctagga

SEQ ID NO: 977029 - DNA, 22 bp, Artificial Sequence
  chemically synthesized
cccattgagcagaggctaggat

SEQ ID NO: 977030 - DNA, 22 bp, Artificial Sequence
  chemically synthesized
agcagaggctaggatttattat

SEQ ID NO: 977031 - DNA, 22 bp, Artificial Sequence
  chemically synthesized
ggatttattatacagaggatat

SEQ ID NO: 977032 - DNA, 22 bp, Artificial Sequence
  chemically synthesized
ccatagataataaaacaatatc

SEQ ID NO: 977033 - DNA, 22 bp, Artificial Sequence
  chemically synthesized
attatacagaggatattgtttt

SEQ ID NO: 977034 - DNA, 22 bp, Artificial Sequence
  chemically synthesized
ttatacagaggatattgtttta

SEQ ID NO: 977035 - DNA, 22 bp, Artificial Sequence
  chemically synthesized
ttgccatagataataaaacaat

SEQ ID NO: 977036 - DNA, 22 bp, Artificial Sequence
  chemically synthesized
attgccatagataataaaacaa

SEQ ID NO: 977037 - DNA, 22 bp, Artificial Sequence
  chemically synthesized
tacagaggatattgttttatta

SEQ ID NO: 977038 - DNA, 22 bp, Artificial Sequence
  chemically synthesized
ttttattatctatggcaataaa

SEQ ID NO: 977039 - DNA, 22 bp, Artificial Sequence
  chemically synthesized
tattatctatggcaataaatta

SEQ ID NO: 977040 - DNA, 22 bp, Artificial Sequence
  chemically synthesized
attatctatggcaataaattat

SEQ ID NO: 977041 - DNA, 22 bp, Artificial Sequence
  chemically synthesized
ttatctatggcaataaattatt

SEQ ID NO: 977042 - DNA, 22 bp, Artificial Sequence
  chemically synthesized
tagagtaacaagagaataattt

SEQ ID NO: 977043 - DNA, 22 bp, Artificial Sequence
  chemically synthesized
tctatggcaataaattattctc

SEQ ID NO: 977044 - DNA, 22 bp, Artificial Sequence
  chemically synthesized
tggcaataaattattctcttgt

SEQ ID NO: 977045 - DNA, 22 bp, Artificial Sequence
  chemically synthesized
ttctcttgttactctatagtta

SEQ ID NO: 977046 - DNA, 22 bp, Artificial Sequence
  chemically synthesized
cagaatgtaatatataactata

SEQ ID NO: 977047 - DNA, 22 bp, Artificial Sequence
  chemically synthesized
tcttgttactctatagttatat

SEQ ID NO: 977048 - DNA, 22 bp, Artificial Sequence
  chemically synthesized
gcagaatgtaatatataactat

SEQ ID NO: 977049 - DNA, 22 bp, Artificial Sequence
  chemically synthesized
ttgttactctatagttatatat

SEQ ID NO: 977050 - DNA, 22 bp, Artificial Sequence
  chemically synthesized
tttgcagaatgtaatatataac

SEQ ID NO: 977051 - DNA, 22 bp, Artificial Sequence
  chemically synthesized
gttactctatagttatatatta

SEQ ID NO: 977052 - DNA, 22 bp, Artificial Sequence
  chemically synthesized
gtttgcagaatgtaatatataa

SEQ ID NO: 977053 - DNA, 22 bp, Artificial Sequence
  chemically synthesized
ttactctatagttatatattac

SEQ ID NO: 977054 - DNA, 22 bp, Artificial Sequence
  chemically synthesized
ctctatagttatatattacatt

SEQ ID NO: 977055 - DNA, 22 bp, Artificial Sequence
  chemically synthesized
aaatttgtttgcagaatgtaat

SEQ ID NO: 977056 - DNA, 22 bp, Artificial Sequence
  chemically synthesized
tatagttatatattacattctg

SEQ ID NO: 977057 - DNA, 22 bp, Artificial Sequence
  chemically synthesized
tagttatatattacattctgca

SEQ ID NO: 977058 - DNA, 22 bp, Artificial Sequence
  chemically synthesized
tatattacattctgcaaacaaa

SEQ ID NO: 977059 - DNA, 22 bp, Artificial Sequence
  chemically synthesized
aggtatctgaaatttgtttgca

SEQ ID NO: 977060 - DNA, 22 bp, Artificial Sequence
  chemically synthesized
gaggtatctgaaatttgtttgc

SEQ ID NO: 977061 - DNA, 22 bp, Artificial Sequence
  chemically synthesized
cattctgcaaacaaatttcaga

SEQ ID NO: 977062 - DNA, 22 bp, Artificial Sequence
  chemically synthesized
atgcccttgaggtatctgaaat

SEQ ID NO: 977063 - DNA, 22 bp, Artificial Sequence
  chemically synthesized
tgcaaacaaatttcagatacct

SEQ ID NO: 977064 - DNA, 22 bp, Artificial Sequence
  chemically synthesized
ttcatgcccttgaggtatctga

SEQ ID NO: 977065 - DNA, 22 bp, Artificial Sequence
  chemically synthesized
caaacaaatttcagatacctca

SEQ ID NO: 977066 - DNA, 22 bp, Artificial Sequence
  chemically synthesized
cagatacctcaagggcatgaat

SEQ ID NO: 977067 - DNA, 22 bp, Artificial Sequence
  chemically synthesized
atcaaatatattattcatgccc

SEQ ID NO: 977068 - DNA, 22 bp, Artificial Sequence
  chemically synthesized
agatacctcaagggcatgaata

SEQ ID NO: 977069 - DNA, 22 bp, Artificial Sequence
  chemically synthesized
aagggcatgaataatatatttg

SEQ ID NO: 977070 - DNA, 22 bp, Artificial Sequence
  chemically synthesized
tgccaataaatcagctaatcaa

SEQ ID NO: 977071 - DNA, 22 bp, Artificial Sequence
  chemically synthesized
tatgccaataaatcagctaatc

SEQ ID NO: 977072 - DNA, 22 bp, Artificial Sequence
  chemically synthesized
gattagctgatttattggcata

SEQ ID NO: 977073 - DNA, 22 bp, Artificial Sequence
  chemically synthesized
attagctgatttattggcatag

SEQ ID NO: 977074 - DNA, 22 bp, Artificial Sequence
  chemically synthesized
gataaatgcattctatgccaat

SEQ ID NO: 977075 - DNA, 22 bp, Artificial Sequence
  chemically synthesized
gctgatttattggcatagaatg

SEQ ID NO: 977076 - DNA, 22 bp, Artificial Sequence
  chemically synthesized
aagctcgataaatgcattctat

SEQ ID NO: 977077 - DNA, 22 bp, Artificial Sequence
  chemically synthesized
atttattggcatagaatgcatt

SEQ ID NO: 977078 - DNA, 22 bp, Artificial Sequence
  chemically synthesized
attggcatagaatgcatttatc

SEQ ID NO: 977079 - DNA, 22 bp, Artificial Sequence
  chemically synthesized
ttggcatagaatgcatttatcg

SEQ ID NO: 977080 - DNA, 22 bp, Artificial Sequence
  chemically synthesized
gcatagaatgcatttatcgagc

SEQ ID NO: 977081 - DNA, 22 bp, Artificial Sequence
  chemically synthesized
gcccataattaaagctcgataa

SEQ ID NO: 977082 - DNA, 22 bp, Artificial Sequence
  chemically synthesized
ggcccataattaaagctcgata

SEQ ID NO: 977083 - DNA, 22 bp, Artificial Sequence
  chemically synthesized
tggcccataattaaagctcgat

SEQ ID NO: 977084 - DNA, 22 bp, Artificial Sequence
  chemically synthesized
ttggcccataattaaagctcga

SEQ ID NO: 977085 - DNA, 22 bp, Artificial Sequence
  chemically synthesized
tttggcccataattaaagctcg

SEQ ID NO: 977086 - DNA, 22 bp, Artificial Sequence
  chemically synthesized
atcgagctttaattatgggcca

SEQ ID NO: 977087 - DNA, 22 bp, Artificial Sequence
  chemically synthesized
tcgagctttaattatgggccaa

SEQ ID NO: 977088 - DNA, 22 bp, Artificial Sequence
  chemically synthesized
agggcgtagtacactttttggc

SEQ ID NO: 977089 - DNA, 22 bp, Artificial Sequence
  chemically synthesized
cagggcgtagtacactttttgg

SEQ ID NO: 977090 - DNA, 22 bp, Artificial Sequence
  chemically synthesized
taattatgggccaaaaagtgta

SEQ ID NO: 977091 - DNA, 22 bp, Artificial Sequence
  chemically synthesized
aattatgggccaaaaagtgtac

SEQ ID NO: 977092 - DNA, 22 bp, Artificial Sequence
  chemically synthesized
attatgggccaaaaagtgtact

SEQ ID NO: 977093 - DNA, 22 bp, Artificial Sequence
  chemically synthesized
acttcagggcgtagtacacttt

SEQ ID NO: 977094 - DNA, 22 bp, Artificial Sequence
  chemically synthesized
tgacttcagggcgtagtacact

SEQ ID NO: 977095 - DNA, 22 bp, Artificial Sequence
  chemically synthesized
ctgacttcagggcgtagtacac

SEQ ID NO: 977096 - DNA, 22 bp, Artificial Sequence
  chemically synthesized
tgggccaaaaagtgtactacgc

SEQ ID NO: 977097 - DNA, 22 bp, Artificial Sequence
  chemically synthesized
tctgacttcagggcgtagtaca

SEQ ID NO: 977098 - DNA, 22 bp, Artificial Sequence
  chemically synthesized
tcatctttctgacttcagggcg

SEQ ID NO: 977099 - DNA, 22 bp, Artificial Sequence
  chemically synthesized
gtcatctttctgacttcagggc

SEQ ID NO: 977100 - DNA, 22 bp, Artificial Sequence
  chemically synthesized
tgtcatctttctgacttcaggg

SEQ ID NO: 977101 - DNA, 22 bp, Artificial Sequence
  chemically synthesized
tttgtcatctttctgacttcag

SEQ ID NO: 977102 - DNA, 22 bp, Artificial Sequence
  chemically synthesized
ctttgtcatctttctgacttca

SEQ ID NO: 977103 - DNA, 22 bp, Artificial Sequence
  chemically synthesized
cgccctgaagtcagaaagatga

SEQ ID NO: 977104 - DNA, 22 bp, Artificial Sequence
  chemically synthesized
aagtcagaaagatgacaaagaa

SEQ ID NO: 977105 - DNA, 22 bp, Artificial Sequence
  chemically synthesized
aaagccaagaacatttctttgt

SEQ ID NO: 977106 - DNA, 22 bp, Artificial Sequence
  chemically synthesized
gaaagccaagaacatttctttg

SEQ ID NO: 977107 - DNA, 22 bp, Artificial Sequence
  chemically synthesized
cttgaaagccaagaacatttct

SEQ ID NO: 977108 - DNA, 22 bp, Artificial Sequence
  chemically synthesized
gagggacgggatctccttgaaa

SEQ ID NO: 977109 - DNA, 22 bp, Artificial Sequence
  chemically synthesized
ttggctttcaaggagatcccgt

SEQ ID NO: 977110 - DNA, 22 bp, Artificial Sequence
  chemically synthesized
ggctttcaaggagatcccgtcc

SEQ ID NO: 977111 - DNA, 22 bp, Artificial Sequence
  chemically synthesized
gctttcaaggagatcccgtccc

SEQ ID NO: 977112 - DNA, 22 bp, Artificial Sequence
  chemically synthesized
gaatgaattcgagggacgggat

SEQ ID NO: 977113 - DNA, 22 bp, Artificial Sequence
  chemically synthesized
ttagaatgaattcgagggacgg

SEQ ID NO: 977114 - DNA, 22 bp, Artificial Sequence
  chemically synthesized
tcaaggagatcccgtccctcga

SEQ ID NO: 977115 - DNA, 22 bp, Artificial Sequence
  chemically synthesized
caaggagatcccgtccctcgaa

SEQ ID NO: 977116 - DNA, 22 bp, Artificial Sequence
  chemically synthesized
aaggagatcccgtccctcgaat

SEQ ID NO: 977117 - DNA, 22 bp, Artificial Sequence
  chemically synthesized
aaaattattagaatgaattcga

SEQ ID NO: 977118 - DNA, 22 bp, Artificial Sequence
  chemically synthesized
taaaaattattagaatgaattc

SEQ ID NO: 977119 - DNA, 22 bp, Artificial Sequence
  chemically synthesized
ctaaaaattattagaatgaatt

SEQ ID NO: 977120 - DNA, 22 bp, Artificial Sequence
  chemically synthesized
ttctaaaaattattagaatgaa

SEQ ID NO: 977121 - DNA, 22 bp, Artificial Sequence
  chemically synthesized
tcttctaaaaattattagaatg

SEQ ID NO: 977122 - DNA, 22 bp, Artificial Sequence
  chemically synthesized
actctcttctaaaaattattag

SEQ ID NO: 977123 - DNA, 22 bp, Artificial Sequence
  chemically synthesized
aactctcttctaaaaattatta

SEQ ID NO: 977124 - DNA, 22 bp, Artificial Sequence
  chemically synthesized
taactctcttctaaaaattatt

SEQ ID NO: 977125 - DNA, 22 bp, Artificial Sequence
  chemically synthesized
gaattcattctaataattttta

SEQ ID NO: 977126 - DNA, 22 bp, Artificial Sequence
  chemically synthesized
tttaactctcttctaaaaatta

SEQ ID NO: 977127 - DNA, 22 bp, Artificial Sequence
  chemically synthesized
ctttaactctcttctaaaaatt

SEQ ID NO: 977128 - DNA, 22 bp, Artificial Sequence
  chemically synthesized
ttctttaactctcttctaaaaa

SEQ ID NO: 977129 - DNA, 22 bp, Artificial Sequence
  chemically synthesized
attctaataatttttagaagag

SEQ ID NO: 977130 - DNA, 22 bp, Artificial Sequence
  chemically synthesized
taataatttttagaagagagtt

SEQ ID NO: 977131 - DNA, 22 bp, Artificial Sequence
  chemically synthesized
ataatttttagaagagagttaa

SEQ ID NO: 977132 - DNA, 22 bp, Artificial Sequence
  chemically synthesized
gagcattcttctttaactctct

SEQ ID NO: 977133 - DNA, 22 bp, Artificial Sequence
  chemically synthesized
gtctagagcattcttctttaac

SEQ ID NO: 977134 - DNA, 22 bp, Artificial Sequence
  chemically synthesized
ttagaagagagttaaagaagaa

SEQ ID NO: 977135 - DNA, 22 bp, Artificial Sequence
  chemically synthesized
tagaagagagttaaagaagaat

SEQ ID NO: 977136 - DNA, 22 bp, Artificial Sequence
  chemically synthesized
agaagagagttaaagaagaatg

SEQ ID NO: 977137 - DNA, 22 bp, Artificial Sequence
  chemically synthesized
gaagagagttaaagaagaatgc

SEQ ID NO: 977138 - DNA, 22 bp, Artificial Sequence
  chemically synthesized
agaaccactggtctagagcatt

SEQ ID NO: 977139 - DNA, 22 bp, Artificial Sequence
  chemically synthesized
gagaaccactggtctagagcat

SEQ ID NO: 977140 - DNA, 22 bp, Artificial Sequence
  chemically synthesized
aagaagaatgctctagaccagt

SEQ ID NO: 977141 - DNA, 22 bp, Artificial Sequence
  chemically synthesized
aagtttgagaaccactggtcta

SEQ ID NO: 977142 - DNA, 22 bp, Artificial Sequence
  chemically synthesized
atgcacactaaagtttgagaac

SEQ ID NO: 977143 - DNA, 22 bp, Artificial Sequence
  chemically synthesized
gatgcacactaaagtttgagaa

SEQ ID NO: 977144 - DNA, 22 bp, Artificial Sequence
  chemically synthesized
tagaccagtggttctcaaactt

SEQ ID NO: 977145 - DNA, 22 bp, Artificial Sequence
  chemically synthesized
gaccagtggttctcaaacttta

SEQ ID NO: 977146 - DNA, 22 bp, Artificial Sequence
  chemically synthesized
ggtaatttgatgcacactaaag

SEQ ID NO: 977147 - DNA, 22 bp, Artificial Sequence
  chemically synthesized
taggtaatttgatgcacactaa

SEQ ID NO: 977148 - DNA, 22 bp, Artificial Sequence
  chemically synthesized
tcaaactttagtgtgcatcaaa

SEQ ID NO: 977149 - DNA, 22 bp, Artificial Sequence
  chemically synthesized
aaactttagtgtgcatcaaatt

SEQ ID NO: 977150 - DNA, 22 bp, Artificial Sequence
  chemically synthesized
tcagccctctaggtaatttgat

SEQ ID NO: 977151 - DNA, 22 bp, Artificial Sequence
  chemically synthesized
atcagccctctaggtaatttga

SEQ ID NO: 977152 - DNA, 22 bp, Artificial Sequence
  chemically synthesized
tatcagccctctaggtaatttg

SEQ ID NO: 977153 - DNA, 22 bp, Artificial Sequence
  chemically synthesized
ttatcagccctctaggtaattt

SEQ ID NO: 977154 - DNA, 22 bp, Artificial Sequence
  chemically synthesized
tagtgtgcatcaaattacctag

SEQ ID NO: 977155 - DNA, 22 bp, Artificial Sequence
  chemically synthesized
agtgtgcatcaaattacctaga

SEQ ID NO: 977156 - DNA, 22 bp, Artificial Sequence
  chemically synthesized
gtgtgcatcaaattacctagag

SEQ ID NO: 977157 - DNA, 22 bp, Artificial Sequence
  chemically synthesized
tatttttatcagccctctaggt

SEQ ID NO: 977158 - DNA, 22 bp, Artificial Sequence
  chemically synthesized
cctagagggctgataaaaatac

SEQ ID NO: 977159 - DNA, 22 bp, Artificial Sequence
  chemically synthesized
gagggctgataaaaatacaggc

SEQ ID NO: 977160 - DNA, 22 bp, Artificial Sequence
  chemically synthesized
gagagtggagatgagcagcctg

SEQ ID NO: 977161 - DNA, 22 bp, Artificial Sequence
  chemically synthesized
ataaaaatacaggctgctcatc

SEQ ID NO: 977162 - DNA, 22 bp, Artificial Sequence
  chemically synthesized
atcagaaacattggagagtgga

SEQ ID NO: 977163 - DNA, 22 bp, Artificial Sequence
  chemically synthesized
gatcagaaacattggagagtgg

SEQ ID NO: 977164 - DNA, 22 bp, Artificial Sequence
  chemically synthesized
cttgatcagaaacattggagag

SEQ ID NO: 977165 - DNA, 22 bp, Artificial Sequence
  chemically synthesized
ctcatctccactctccaatgtt

SEQ ID NO: 977166 - DNA, 22 bp, Artificial Sequence
  chemically synthesized
atctccactctccaatgtttct

SEQ ID NO: 977167 - DNA, 22 bp, Artificial Sequence
  chemically synthesized
agacctgcttgatcagaaacat

SEQ ID NO: 977168 - DNA, 22 bp, Artificial Sequence
  chemically synthesized
cactctccaatgtttctgatca

SEQ ID NO: 977169 - DNA, 22 bp, Artificial Sequence
  chemically synthesized
atctcagacctgcttgatcaga

SEQ ID NO: 977170 - DNA, 22 bp, Artificial Sequence
  chemically synthesized
tccaatgtttctgatcaagcag

SEQ ID NO: 977171 - DNA, 22 bp, Artificial Sequence
  chemically synthesized
caatgtttctgatcaagcaggt

SEQ ID NO: 977172 - DNA, 22 bp, Artificial Sequence
  chemically synthesized
aggcctcatctcagacctgctt

SEQ ID NO: 977173 - DNA, 22 bp, Artificial Sequence
  chemically synthesized
ctgatcaagcaggtctgagatg

SEQ ID NO: 977174 - DNA, 22 bp, Artificial Sequence
  chemically synthesized
tgatcaagcaggtctgagatga

SEQ ID NO: 977175 - DNA, 22 bp, Artificial Sequence
  chemically synthesized
atcaagcaggtctgagatgagg

SEQ ID NO: 977176 - DNA, 22 bp, Artificial Sequence
  chemically synthesized
gaaatatagatcctcaggcctc

SEQ ID NO: 977177 - DNA, 22 bp, Artificial Sequence
  chemically synthesized
attagaaatatagatcctcagg

SEQ ID NO: 977178 - DNA, 22 bp, Artificial Sequence
  chemically synthesized
agatgaggcctgaggatctata

SEQ ID NO: 977179 - DNA, 22 bp, Artificial Sequence
  chemically synthesized
ggaattcattagaaatatagat

SEQ ID NO: 977180 - DNA, 22 bp, Artificial Sequence
  chemically synthesized
aggatctatatttctaatgaat

SEQ ID NO: 977181 - DNA, 22 bp, Artificial Sequence
  chemically synthesized
tatttctaatgaattcccagat

SEQ ID NO: 977182 - DNA, 22 bp, Artificial Sequence
  chemically synthesized
ctaatgaattcccagatggtgc

SEQ ID NO: 977183 - DNA, 22 bp, Artificial Sequence
  chemically synthesized
taatgaattcccagatggtgct

SEQ ID NO: 977184 - DNA, 22 bp, Artificial Sequence
  chemically synthesized
gaccagcaacatcagcaccatc

SEQ ID NO: 977185 - DNA, 22 bp, Artificial Sequence
  chemically synthesized
atgaattcccagatggtgctga

SEQ ID NO: 977186 - DNA, 22 bp, Artificial Sequence
  chemically synthesized
gctggaccagcaacatcagcac

SEQ ID NO: 977187 - DNA, 22 bp, Artificial Sequence
  chemically synthesized
cgctggaccagcaacatcagca

SEQ ID NO: 977188 - DNA, 22 bp, Artificial Sequence
  chemically synthesized
tcgctggaccagcaacatcagc

SEQ ID NO: 977189 - DNA, 22 bp, Artificial Sequence
  chemically synthesized
tttcgctggaccagcaacatca

SEQ ID NO: 977190 - DNA, 22 bp, Artificial Sequence
  chemically synthesized
ccagatggtgctgatgttgctg

SEQ ID NO: 977191 - DNA, 22 bp, Artificial Sequence
  chemically synthesized
aatcactctttcgctggaccag

SEQ ID NO: 977192 - DNA, 22 bp, Artificial Sequence
  chemically synthesized
taaatcactctttcgctggacc

SEQ ID NO: 977193 - DNA, 22 bp, Artificial Sequence
  chemically synthesized
tctaaatcactctttcgctgga

SEQ ID NO: 977194 - DNA, 22 bp, Artificial Sequence
  chemically synthesized
atgttgctggtccagcgaaaga

SEQ ID NO: 977195 - DNA, 22 bp, Artificial Sequence
  chemically synthesized
cattctctaaatcactctttcg

SEQ ID NO: 977196 - DNA, 22 bp, Artificial Sequence
  chemically synthesized
ccattctctaaatcactctttc

SEQ ID NO: 977197 - DNA, 22 bp, Artificial Sequence
  chemically synthesized
tccattctctaaatcactcttt

SEQ ID NO: 977198 - DNA, 22 bp, Artificial Sequence
  chemically synthesized
ctggtccagcgaaagagtgatt

SEQ ID NO: 977199 - DNA, 22 bp, Artificial Sequence
  chemically synthesized
gtccagcgaaagagtgatttag

SEQ ID NO: 977200 - DNA, 22 bp, Artificial Sequence
  chemically synthesized
cctttccattctctaaatcact

SEQ ID NO: 977201 - DNA, 22 bp, Artificial Sequence
  chemically synthesized
attgcctttccattctctaaat

SEQ ID NO: 977202 - DNA, 22 bp, Artificial Sequence
  chemically synthesized
aattgcctttccattctctaaa

SEQ ID NO: 977203 - DNA, 22 bp, Artificial Sequence
  chemically synthesized
tttaattgcctttccattctct

SEQ ID NO: 977204 - DNA, 22 bp, Artificial Sequence
  chemically synthesized
cctatttaattgcctttccatt

SEQ ID NO: 977205 - DNA, 22 bp, Artificial Sequence
  chemically synthesized
cattgcctatttaattgccttt

SEQ ID NO: 977206 - DNA, 22 bp, Artificial Sequence
  chemically synthesized
gcattgcctatttaattgcctt

SEQ ID NO: 977207 - DNA, 22 bp, Artificial Sequence
  chemically synthesized
tgcattgcctatttaattgcct

SEQ ID NO: 977208 - DNA, 22 bp, Artificial Sequence
  chemically synthesized
agagaatggaaaggcaattaaa

SEQ ID NO: 977209 - DNA, 22 bp, Artificial Sequence
  chemically synthesized
gagaatggaaaggcaattaaat

SEQ ID NO: 977210 - DNA, 22 bp, Artificial Sequence
  chemically synthesized
tgtctttgcattgcctatttaa

SEQ ID NO: 977211 - DNA, 22 bp, Artificial Sequence
  chemically synthesized
gttgtgtctttgcattgcctat

SEQ ID NO: 977212 - DNA, 22 bp, Artificial Sequence
  chemically synthesized
cctcgttgtgtctttgcattgc

SEQ ID NO: 977213 - DNA, 22 bp, Artificial Sequence
  chemically synthesized
tacctcgttgtgtctttgcatt

SEQ ID NO: 977214 - DNA, 22 bp, Artificial Sequence
  chemically synthesized
aataggcaatgcaaagacacaa

SEQ ID NO: 977215 - DNA, 22 bp, Artificial Sequence
  chemically synthesized
gccctctacctcgttgtgtctt

SEQ ID NO: 977216 - DNA, 22 bp, Artificial Sequence
  chemically synthesized
aatacagttggccctctacctc

SEQ ID NO: 977217 - DNA, 22 bp, Artificial Sequence
  chemically synthesized
gaatacagttggccctctacct

SEQ ID NO: 977218 - DNA, 22 bp, Artificial Sequence
  chemically synthesized
cttgaatacagttggccctcta

SEQ ID NO: 977219 - DNA, 22 bp, Artificial Sequence
  chemically synthesized
ctacttgaatacagttggccct

SEQ ID NO: 977220 - DNA, 22 bp, Artificial Sequence
  chemically synthesized
ccgctgctacttgaatacagtt

SEQ ID NO: 977221 - DNA, 22 bp, Artificial Sequence
  chemically synthesized
cccgctgctacttgaatacagt

SEQ ID NO: 977222 - DNA, 22 bp, Artificial Sequence
  chemically synthesized
tattcaagtagcagcgggaagg

SEQ ID NO: 977223 - DNA, 22 bp, Artificial Sequence
  chemically synthesized
aacccaccatatgaccttcccg

SEQ ID NO: 977224 - DNA, 22 bp, Artificial Sequence
  chemically synthesized
taaacccaccatatgaccttcc

SEQ ID NO: 977225 - DNA, 22 bp, Artificial Sequence
  chemically synthesized
aagtagcagcgggaaggtcata

SEQ ID NO: 977226 - DNA, 22 bp, Artificial Sequence
  chemically synthesized
tgcaccctctaaacccaccata

SEQ ID NO: 977227 - DNA, 22 bp, Artificial Sequence
  chemically synthesized
tggtcaccctatgcaccctcta

SEQ ID NO: 977228 - DNA, 22 bp, Artificial Sequence
  chemically synthesized
agagggtgcatagggtgaccac

SEQ ID NO: 977229 - DNA, 22 bp, Artificial Sequence
  chemically synthesized
gagggtgcatagggtgaccaca

SEQ ID NO: 977230 - DNA, 22 bp, Artificial Sequence
  chemically synthesized
caagtgccatgttgtggtcacc

SEQ ID NO: 977231 - DNA, 22 bp, Artificial Sequence
  chemically synthesized
gtctccaagtgccatgttgtgg

SEQ ID NO: 977232 - DNA, 22 bp, Artificial Sequence
  chemically synthesized
ttcgtctccaagtgccatgttg

SEQ ID NO: 977233 - DNA, 22 bp, Artificial Sequence
  chemically synthesized
taatctattcgtctccaagtgc

SEQ ID NO: 977234 - DNA, 22 bp, Artificial Sequence
  chemically synthesized
ttataatctattcgtctccaag

SEQ ID NO: 977235 - DNA, 22 bp, Artificial Sequence
  chemically synthesized
ggagacgaatagattataatag

SEQ ID NO: 977236 - DNA, 22 bp, Artificial Sequence
  chemically synthesized
gagacgaatagattataatagg

SEQ ID NO: 977237 - DNA, 22 bp, Artificial Sequence
  chemically synthesized
ccatgatgtccaaaacctatta

SEQ ID NO: 977238 - DNA, 22 bp, Artificial Sequence
  chemically synthesized
ccattaccatgatgtccaaaac

SEQ ID NO: 977239 - DNA, 22 bp, Artificial Sequence
  chemically synthesized
accattaccatgatgtccaaaa

SEQ ID NO: 977240 - DNA, 22 bp, Artificial Sequence
  chemically synthesized
cttaccattaccatgatgtcca

SEQ ID NO: 977241 - DNA, 22 bp, Artificial Sequence
  chemically synthesized
taataggttttggacatcatgg

SEQ ID NO: 977242 - DNA, 22 bp, Artificial Sequence
  chemically synthesized
cattccttaccattaccatgat

SEQ ID NO: 977243 - DNA, 22 bp, Artificial Sequence
  chemically synthesized
tggacatcatggtaatggtaag

SEQ ID NO: 977244 - DNA, 22 bp, Artificial Sequence
  chemically synthesized
atatctacattccttaccatta

SEQ ID NO: 977245 - DNA, 22 bp, Artificial Sequence
  chemically synthesized
ggacatcatggtaatggtaagg

SEQ ID NO: 977246 - DNA, 22 bp, Artificial Sequence
  chemically synthesized
gacatcatggtaatggtaagga

SEQ ID NO: 977247 - DNA, 22 bp, Artificial Sequence
  chemically synthesized
taatatctacattccttaccat

SEQ ID NO: 977248 - DNA, 22 bp, Artificial Sequence
  chemically synthesized
ctaatatctacattccttacca

SEQ ID NO: 977249 - DNA, 22 bp, Artificial Sequence
  chemically synthesized
ttctaatatctacattccttac

SEQ ID NO: 977250 - DNA, 22 bp, Artificial Sequence
  chemically synthesized
atgatgatgattcttctaatat

SEQ ID NO: 977251 - DNA, 22 bp, Artificial Sequence
  chemically synthesized
tgatgatgatgattcttctaat

SEQ ID NO: 977252 - DNA, 22 bp, Artificial Sequence
  chemically synthesized
ctgatgatgatgattcttctaa

SEQ ID NO: 977253 - DNA, 22 bp, Artificial Sequence
  chemically synthesized
caaatttctgatgatgatgatt

SEQ ID NO: 977254 - DNA, 22 bp, Artificial Sequence
  chemically synthesized
acaaatttctgatgatgatgat

SEQ ID NO: 977255 - DNA, 22 bp, Artificial Sequence
  chemically synthesized
tttacaaatttctgatgatgat

SEQ ID NO: 977256 - DNA, 22 bp, Artificial Sequence
  chemically synthesized
gaagaatcatcatcatcagaaa

SEQ ID NO: 977257 - DNA, 22 bp, Artificial Sequence
  chemically synthesized
cgttatttacaaatttctgatg

SEQ ID NO: 977258 - DNA, 22 bp, Artificial Sequence
  chemically synthesized
gtaaataacggagggatgtgat

SEQ ID NO: 977259 - DNA, 22 bp, Artificial Sequence
  chemically synthesized
taaataacggagggatgtgatc

SEQ ID NO: 977260 - DNA, 22 bp, Artificial Sequence
  chemically synthesized
aagcccaggtgtgatcacatcc

SEQ ID NO: 977261 - DNA, 22 bp, Artificial Sequence
  chemically synthesized
aaagctaaagcccaggtgtgat

SEQ ID NO: 977262 - DNA, 22 bp, Artificial Sequence
  chemically synthesized
taaaagctaaagcccaggtgtg

SEQ ID NO: 977263 - DNA, 22 bp, Artificial Sequence
  chemically synthesized
ctaaaagctaaagcccaggtgt

SEQ ID NO: 977264 - DNA, 22 bp, Artificial Sequence
  chemically synthesized
tctaaaagctaaagcccaggtg

SEQ ID NO: 977265 - DNA, 22 bp, Artificial Sequence
  chemically synthesized
tttctaaaagctaaagcccagg

SEQ ID NO: 977266 - DNA, 22 bp, Artificial Sequence
  chemically synthesized
ctttctaaaagctaaagcccag

SEQ ID NO: 977267 - DNA, 22 bp, Artificial Sequence
  chemically synthesized
tctttctaaaagctaaagccca

SEQ ID NO: 977268 - DNA, 22 bp, Artificial Sequence
  chemically synthesized
ttttctttctaaaagctaaagc

SEQ ID NO: 977269 - DNA, 22 bp, Artificial Sequence
  chemically synthesized
ttgttttctttctaaaagctaa

SEQ ID NO: 977270 - DNA, 22 bp, Artificial Sequence
  chemically synthesized
ccctattgttttctttctaaaa

SEQ ID NO: 977271 - DNA, 22 bp, Artificial Sequence
  chemically synthesized
tgccctattgttttctttctaa

SEQ ID NO: 977272 - DNA, 22 bp, Artificial Sequence
  chemically synthesized
ggctttagcttttagaaagaaa

SEQ ID NO: 977273 - DNA, 22 bp, Artificial Sequence
  chemically synthesized
tagcttttagaaagaaaacaat

SEQ ID NO: 977274 - DNA, 22 bp, Artificial Sequence
  chemically synthesized
agcttttagaaagaaaacaata

SEQ ID NO: 977275 - DNA, 22 bp, Artificial Sequence
  chemically synthesized
gcttttagaaagaaaacaatag

SEQ ID NO: 977276 - DNA, 22 bp, Artificial Sequence
  chemically synthesized
ttagaaagaaaacaatagggca

SEQ ID NO: 977277 - DNA, 22 bp, Artificial Sequence
  chemically synthesized
tagaaagaaaacaatagggcag

SEQ ID NO: 977278 - DNA, 22 bp, Artificial Sequence
  chemically synthesized
agaaagaaaacaatagggcaga

SEQ ID NO: 977279 - DNA, 22 bp, Artificial Sequence
  chemically synthesized
gaaagaaaacaatagggcagag

SEQ ID NO: 977280 - DNA, 22 bp, Artificial Sequence
  chemically synthesized
tgtagacatatcctctgcccta

SEQ ID NO: 977281 - DNA, 22 bp, Artificial Sequence
  chemically synthesized
tgtgtagacatatcctctgccc

SEQ ID NO: 977282 - DNA, 22 bp, Artificial Sequence
  chemically synthesized
aatatcagtatgatacaatcct

SEQ ID NO: 977283 - DNA, 22 bp, Artificial Sequence
  chemically synthesized
cacagaggattgtatcatactg

SEQ ID NO: 977284 - DNA, 22 bp, Artificial Sequence
  chemically synthesized
tggtctaaatatcagtatgata

SEQ ID NO: 977285 - DNA, 22 bp, Artificial Sequence
  chemically synthesized
gtggtctaaatatcagtatgat

SEQ ID NO: 977286 - DNA, 22 bp, Artificial Sequence
  chemically synthesized
tgtggtctaaatatcagtatga

SEQ ID NO: 977287 - DNA, 22 bp, Artificial Sequence
  chemically synthesized
atctttgtggtctaaatatcag

SEQ ID NO: 977288 - DNA, 22 bp, Artificial Sequence
  chemically synthesized
tatcatactgatatttagacca

SEQ ID NO: 977289 - DNA, 22 bp, Artificial Sequence
  chemically synthesized
atatttagaccacaaagatgag

SEQ ID NO: 977290 - DNA, 22 bp, Artificial Sequence
  chemically synthesized
aaagaaaatcaaatctcatctt

SEQ ID NO: 977291 - DNA, 22 bp, Artificial Sequence
  chemically synthesized
agaccacaaagatgagatttga

SEQ ID NO: 977292 - DNA, 22 bp, Artificial Sequence
  chemically synthesized
gaccacaaagatgagatttgat

SEQ ID NO: 977293 - DNA, 22 bp, Artificial Sequence
  chemically synthesized
agtgttgaaagaaaatcaaatc

SEQ ID NO: 977294 - DNA, 22 bp, Artificial Sequence
  chemically synthesized
gccctcagtgttgaaagaaaat

SEQ ID NO: 977295 - DNA, 22 bp, Artificial Sequence
  chemically synthesized
gattttctttcaacactgaggg

SEQ ID NO: 977296 - DNA, 22 bp, Artificial Sequence
  chemically synthesized
attttctttcaacactgagggc

SEQ ID NO: 977297 - DNA, 22 bp, Artificial Sequence
  chemically synthesized
tctttcaacactgagggctagg

SEQ ID NO: 977298 - DNA, 22 bp, Artificial Sequence
  chemically synthesized
ctttcaacactgagggctaggt

SEQ ID NO: 977299 - DNA, 22 bp, Artificial Sequence
  chemically synthesized
tttcaacactgagggctaggta

SEQ ID NO: 977300 - DNA, 22 bp, Artificial Sequence
  chemically synthesized
tcaacactgagggctaggtatc

SEQ ID NO: 977301 - DNA, 22 bp, Artificial Sequence
  chemically synthesized
caacactgagggctaggtatca

SEQ ID NO: 977302 - DNA, 22 bp, Artificial Sequence
  chemically synthesized
aacactgagggctaggtatcat

SEQ ID NO: 977303 - DNA, 22 bp, Artificial Sequence
  chemically synthesized
agggctaggtatcatgcttcat

SEQ ID NO: 977304 - DNA, 22 bp, Artificial Sequence
  chemically synthesized
agacagaccataaatatgaagc

SEQ ID NO: 977305 - DNA, 22 bp, Artificial Sequence
  chemically synthesized
ggtatcatgcttcatatttatg

SEQ ID NO: 977306 - DNA, 22 bp, Artificial Sequence
  chemically synthesized
catatttatggtctgtctcagc

SEQ ID NO: 977307 - DNA, 22 bp, Artificial Sequence
  chemically synthesized
atatttatggtctgtctcagct

SEQ ID NO: 977308 - DNA, 22 bp, Artificial Sequence
  chemically synthesized
gccaggtgaggaaagctgagac

SEQ ID NO: 977309 - DNA, 22 bp, Artificial Sequence
  chemically synthesized
atggtctgtctcagctttcctc

SEQ ID NO: 977310 - DNA, 22 bp, Artificial Sequence
  chemically synthesized
tggtctgtctcagctttcctca

SEQ ID NO: 977311 - DNA, 22 bp, Artificial Sequence
  chemically synthesized
aaattggccaggtgaggaaagc

SEQ ID NO: 977312 - DNA, 22 bp, Artificial Sequence
  chemically synthesized
ttaaaattggccaggtgaggaa

SEQ ID NO: 977313 - DNA, 22 bp, Artificial Sequence
  chemically synthesized
tctcagctttcctcacctggcc

SEQ ID NO: 977314 - DNA, 22 bp, Artificial Sequence
  chemically synthesized
agctttcctcacctggccaatt

SEQ ID NO: 977315 - DNA, 22 bp, Artificial Sequence
  chemically synthesized
ggaggttgttaaaattggccag

SEQ ID NO: 977316 - DNA, 22 bp, Artificial Sequence
  chemically synthesized
cctaggaggttgttaaaattgg

SEQ ID NO: 977317 - DNA, 22 bp, Artificial Sequence
  chemically synthesized
tcctcacctggccaattttaac

SEQ ID NO: 977318 - DNA, 22 bp, Artificial Sequence
  chemically synthesized
ccctaggaggttgttaaaattg

SEQ ID NO: 977319 - DNA, 22 bp, Artificial Sequence
  chemically synthesized
cctcacctggccaattttaaca

SEQ ID NO: 977320 - DNA, 22 bp, Artificial Sequence
  chemically synthesized
ctcacctggccaattttaacaa

SEQ ID NO: 977321 - DNA, 22 bp, Artificial Sequence
  chemically synthesized
acctggccaattttaacaacct

SEQ ID NO: 977322 - DNA, 22 bp, Artificial Sequence
  chemically synthesized
tgatttccctaggaggttgtta

SEQ ID NO: 977323 - DNA, 22 bp, Artificial Sequence
  chemically synthesized
gccaattttaacaacctcctag

SEQ ID NO: 977324 - DNA, 22 bp, Artificial Sequence
  chemically synthesized
gaggctgtgatttccctaggag

SEQ ID NO: 977325 - DNA, 22 bp, Artificial Sequence
  chemically synthesized
taacaacctcctagggaaatca

SEQ ID NO: 977326 - DNA, 22 bp, Artificial Sequence
  chemically synthesized
aacaacctcctagggaaatcac

SEQ ID NO: 977327 - DNA, 22 bp, Artificial Sequence
  chemically synthesized
acaacctcctagggaaatcaca

SEQ ID NO: 977328 - DNA, 22 bp, Artificial Sequence
  chemically synthesized
ctagggaaatcacagcctccag

SEQ ID NO: 977329 - DNA, 22 bp, Artificial Sequence
  chemically synthesized
gggaaatcacagcctccagtcc

SEQ ID NO: 977330 - DNA, 22 bp, Artificial Sequence
  chemically synthesized
tgggagggagagaggaggtgga

SEQ ID NO: 977331 - DNA, 22 bp, Artificial Sequence
  chemically synthesized
ccattatgggagggagagagga

SEQ ID NO: 977332 - DNA, 22 bp, Artificial Sequence
  chemically synthesized
gccattatgggagggagagagg

SEQ ID NO: 977333 - DNA, 22 bp, Artificial Sequence
  chemically synthesized
cagtccacctcctctctccctc

SEQ ID NO: 977334 - DNA, 22 bp, Artificial Sequence
  chemically synthesized
cttgccattatgggagggagag

SEQ ID NO: 977335 - DNA, 22 bp, Artificial Sequence
  chemically synthesized
ctctctccctcccataatggca

SEQ ID NO: 977336 - DNA, 22 bp, Artificial Sequence
  chemically synthesized
cagatatctacttgccattatg

SEQ ID NO: 977337 - DNA, 22 bp, Artificial Sequence
  chemically synthesized
tctccctcccataatggcaagt

SEQ ID NO: 977338 - DNA, 22 bp, Artificial Sequence
  chemically synthesized
tccctcccataatggcaagtag

SEQ ID NO: 977339 - DNA, 22 bp, Artificial Sequence
  chemically synthesized
cctcccataatggcaagtagat

SEQ ID NO: 977340 - DNA, 22 bp, Artificial Sequence
  chemically synthesized
ccataatggcaagtagatatct

SEQ ID NO: 977341 - DNA, 22 bp, Artificial Sequence
  chemically synthesized
atagcgggattccagatatcta

SEQ ID NO: 977342 - DNA, 22 bp, Artificial Sequence
  chemically synthesized
aatagcgggattccagatatct

SEQ ID NO: 977343 - DNA, 22 bp, Artificial Sequence
  chemically synthesized
tttaatagcgggattccagata

SEQ ID NO: 977344 - DNA, 22 bp, Artificial Sequence
  chemically synthesized
atgctatttaatagcgggattc

SEQ ID NO: 977345 - DNA, 22 bp, Artificial Sequence
  chemically synthesized
agatgttgatgctatttaatag

SEQ ID NO: 977346 - DNA, 22 bp, Artificial Sequence
  chemically synthesized
gaatcccgctattaaatagcat

SEQ ID NO: 977347 - DNA, 22 bp, Artificial Sequence
  chemically synthesized
ttaaatagcatcaacatctgaa

SEQ ID NO: 977348 - DNA, 22 bp, Artificial Sequence
  chemically synthesized
aatagcatcaacatctgaattc

SEQ ID NO: 977349 - DNA, 22 bp, Artificial Sequence
  chemically synthesized
agaaatcggtgaaacacatgaa

SEQ ID NO: 977350 - DNA, 22 bp, Artificial Sequence
  chemically synthesized
aattcatgtgtttcaccgattt

SEQ ID NO: 977351 - DNA, 22 bp, Artificial Sequence
  chemically synthesized
taatagcctgagaaatcggtga

SEQ ID NO: 977352 - DNA, 22 bp, Artificial Sequence
  chemically synthesized
ctataatagcctgagaaatcgg

SEQ ID NO: 977353 - DNA, 22 bp, Artificial Sequence
  chemically synthesized
atgtgtttcaccgatttctcag

SEQ ID NO: 977354 - DNA, 22 bp, Artificial Sequence
  chemically synthesized
ctgctataatagcctgagaaat

SEQ ID NO: 977355 - DNA, 22 bp, Artificial Sequence
  chemically synthesized
tcctgctataatagcctgagaa

SEQ ID NO: 977356 - DNA, 22 bp, Artificial Sequence
  chemically synthesized
ctcctgctataatagcctgaga

SEQ ID NO: 977357 - DNA, 22 bp, Artificial Sequence
  chemically synthesized
caccgatttctcaggctattat

SEQ ID NO: 977358 - DNA, 22 bp, Artificial Sequence
  chemically synthesized
accgatttctcaggctattata

SEQ ID NO: 977359 - DNA, 22 bp, Artificial Sequence
  chemically synthesized
caacatgagtttctcctgctat

SEQ ID NO: 977360 - DNA, 22 bp, Artificial Sequence
  chemically synthesized
ctcaggctattatagcaggaga

SEQ ID NO: 977361 - DNA, 22 bp, Artificial Sequence
  chemically synthesized
tcaggctattatagcaggagaa

SEQ ID NO: 977362 - DNA, 22 bp, Artificial Sequence
  chemically synthesized
aggctattatagcaggagaaac

SEQ ID NO: 977363 - DNA, 22 bp, Artificial Sequence
  chemically synthesized
ttatagcaggagaaactcatgt

SEQ ID NO: 977364 - DNA, 22 bp, Artificial Sequence
  chemically synthesized
tagcaggagaaactcatgttgt

SEQ ID NO: 977365 - DNA, 22 bp, Artificial Sequence
  chemically synthesized
ataagtaaaattacaacatgag

SEQ ID NO: 977366 - DNA, 22 bp, Artificial Sequence
  chemically synthesized
ctgataagtaaaattacaacat

SEQ ID NO: 977367 - DNA, 22 bp, Artificial Sequence
  chemically synthesized
aaattcctgataagtaaaatta

SEQ ID NO: 977368 - DNA, 22 bp, Artificial Sequence
  chemically synthesized
caaattcctgataagtaaaatt

SEQ ID NO: 977369 - DNA, 22 bp, Artificial Sequence
  chemically synthesized
tcaaattcctgataagtaaaat

SEQ ID NO: 977370 - DNA, 22 bp, Artificial Sequence
  chemically synthesized
atgttgtaattttacttatcag

SEQ ID NO: 977371 - DNA, 22 bp, Artificial Sequence
  chemically synthesized
gctttcaaattcctgataagta

SEQ ID NO: 977372 - DNA, 22 bp, Artificial Sequence
  chemically synthesized
ggctttcaaattcctgataagt

SEQ ID NO: 977373 - DNA, 22 bp, Artificial Sequence
  chemically synthesized
atttggctttcaaattcctgat

SEQ ID NO: 977374 - DNA, 22 bp, Artificial Sequence
  chemically synthesized
taattttacttatcaggaattt

SEQ ID NO: 977375 - DNA, 22 bp, Artificial Sequence
  chemically synthesized
actaatttggctttcaaattcc

SEQ ID NO: 977376 - DNA, 22 bp, Artificial Sequence
  chemically synthesized
aactaatttggctttcaaattc

SEQ ID NO: 977377 - DNA, 22 bp, Artificial Sequence
  chemically synthesized
tacttatcaggaatttgaaagc

SEQ ID NO: 977378 - DNA, 22 bp, Artificial Sequence
  chemically synthesized
acttatcaggaatttgaaagcc

SEQ ID NO: 977379 - DNA, 22 bp, Artificial Sequence
  chemically synthesized
cttaactaatttggctttcaaa

SEQ ID NO: 977380 - DNA, 22 bp, Artificial Sequence
  chemically synthesized
cttatcaggaatttgaaagcca

SEQ ID NO: 977381 - DNA, 22 bp, Artificial Sequence
  chemically synthesized
acttaactaatttggctttcaa

SEQ ID NO: 977382 - DNA, 22 bp, Artificial Sequence
  chemically synthesized
atcaggaatttgaaagccaaat

SEQ ID NO: 977383 - DNA, 22 bp, Artificial Sequence
  chemically synthesized
tcaggaatttgaaagccaaatt

SEQ ID NO: 977384 - DNA, 22 bp, Artificial Sequence
  chemically synthesized
atttacttaactaatttggctt

SEQ ID NO: 977385 - DNA, 22 bp, Artificial Sequence
  chemically synthesized
aatttacttaactaatttggct

SEQ ID NO: 977386 - DNA, 22 bp, Artificial Sequence
  chemically synthesized
taatttacttaactaatttggc

SEQ ID NO: 977387 - DNA, 22 bp, Artificial Sequence
  chemically synthesized
ctttaatttacttaactaattt

SEQ ID NO: 977388 - DNA, 22 bp, Artificial Sequence
  chemically synthesized
gaaagccaaattagttaagtaa

SEQ ID NO: 977389 - DNA, 22 bp, Artificial Sequence
  chemically synthesized
cgttactttaatttacttaact

SEQ ID NO: 977390 - DNA, 22 bp, Artificial Sequence
  chemically synthesized
aaagccaaattagttaagtaaa

SEQ ID NO: 977391 - DNA, 22 bp, Artificial Sequence
  chemically synthesized
gctgcgttactttaatttactt

SEQ ID NO: 977392 - DNA, 22 bp, Artificial Sequence
  chemically synthesized
actagctgcgttactttaattt

SEQ ID NO: 977393 - DNA, 22 bp, Artificial Sequence
  chemically synthesized
ttaactagctgcgttactttaa

SEQ ID NO: 977394 - DNA, 22 bp, Artificial Sequence
  chemically synthesized
gttaagtaaattaaagtaacgc

SEQ ID NO: 977395 - DNA, 22 bp, Artificial Sequence
  chemically synthesized
ctgttaactagctgcgttactt

SEQ ID NO: 977396 - DNA, 22 bp, Artificial Sequence
  chemically synthesized
tgctgttaactagctgcgttac

SEQ ID NO: 977397 - DNA, 22 bp, Artificial Sequence
  chemically synthesized
agtaaattaaagtaacgcagct

SEQ ID NO: 977398 - DNA, 22 bp, Artificial Sequence
  chemically synthesized
actctgctgttaactagctgcg

SEQ ID NO: 977399 - DNA, 22 bp, Artificial Sequence
  chemically synthesized
gactctgctgttaactagctgc

SEQ ID NO: 977400 - DNA, 22 bp, Artificial Sequence
  chemically synthesized
tgactctgctgttaactagctg

SEQ ID NO: 977401 - DNA, 22 bp, Artificial Sequence
  chemically synthesized
aagtaacgcagctagttaacag

SEQ ID NO: 977402 - DNA, 22 bp, Artificial Sequence
  chemically synthesized
gttttgactctgctgttaacta

SEQ ID NO: 977403 - DNA, 22 bp, Artificial Sequence
  chemically synthesized
tagttttgactctgctgttaac

SEQ ID NO: 977404 - DNA, 22 bp, Artificial Sequence
  chemically synthesized
agctctagttttgactctgctg

SEQ ID NO: 977405 - DNA, 22 bp, Artificial Sequence
  chemically synthesized
gttaacagcagagtcaaaacta

SEQ ID NO: 977406 - DNA, 22 bp, Artificial Sequence
  chemically synthesized
agatagttgagctctagttttg

SEQ ID NO: 977407 - DNA, 22 bp, Artificial Sequence
  chemically synthesized
acagcagagtcaaaactagagc

SEQ ID NO: 977408 - DNA, 22 bp, Artificial Sequence
  chemically synthesized
ataaacacaatattgagatagt

SEQ ID NO: 977409 - DNA, 22 bp, Artificial Sequence
  chemically synthesized
gagctcaactatctcaatattg

SEQ ID NO: 977410 - DNA, 22 bp, Artificial Sequence
  chemically synthesized
tactaataaacacaatattgag

SEQ ID NO: 977411 - DNA, 22 bp, Artificial Sequence
  chemically synthesized
ttatactaataaacacaatatt

SEQ ID NO: 977412 - DNA, 22 bp, Artificial Sequence
  chemically synthesized
attatactaataaacacaatat

SEQ ID NO: 977413 - DNA, 22 bp, Artificial Sequence
  chemically synthesized
aactatctcaatattgtgttta

SEQ ID NO: 977414 - DNA, 22 bp, Artificial Sequence
  chemically synthesized
tctcaatattgtgtttattagt

SEQ ID NO: 977415 - DNA, 22 bp, Artificial Sequence
  chemically synthesized
tatgcgtttattatactaataa

SEQ ID NO: 977416 - DNA, 22 bp, Artificial Sequence
  chemically synthesized
atatgcgtttattatactaata

SEQ ID NO: 977417 - DNA, 22 bp, Artificial Sequence
  chemically synthesized
aatattgtgtttattagtataa

SEQ ID NO: 977418 - DNA, 22 bp, Artificial Sequence
  chemically synthesized
tttatatgcgtttattatacta

SEQ ID NO: 977419 - DNA, 22 bp, Artificial Sequence
  chemically synthesized
atttatatgcgtttattatact

SEQ ID NO: 977420 - DNA, 22 bp, Artificial Sequence
  chemically synthesized
tgtttattagtataataaacgc

SEQ ID NO: 977421 - DNA, 22 bp, Artificial Sequence
  chemically synthesized
catttatttatatgcgtttatt

SEQ ID NO: 977422 - DNA, 22 bp, Artificial Sequence
  chemically synthesized
attagtataataaacgcatata

SEQ ID NO: 977423 - DNA, 22 bp, Artificial Sequence
  chemically synthesized
ttagtataataaacgcatataa

SEQ ID NO: 977424 - DNA, 22 bp, Artificial Sequence
  chemically synthesized
gtataataaacgcatataaata

SEQ ID NO: 977425 - DNA, 22 bp, Artificial Sequence
  chemically synthesized
aatagttacatttatttatatg

SEQ ID NO: 977426 - DNA, 22 bp, Artificial Sequence
  chemically synthesized
attaaatagttacatttattta

SEQ ID NO: 977427 - DNA, 22 bp, Artificial Sequence
  chemically synthesized
tcaattaattaaatagttacat

SEQ ID NO: 977428 - DNA, 22 bp, Artificial Sequence
  chemically synthesized
ttgtcaattaattaaatagtta

SEQ ID NO: 977429 - DNA, 22 bp, Artificial Sequence
  chemically synthesized
atattgttgtcaattaattaaa

SEQ ID NO: 977430 - DNA, 22 bp, Artificial Sequence
  chemically synthesized
ttcatattgttgtcaattaatt

SEQ ID NO: 977431 - DNA, 22 bp, Artificial Sequence
  chemically synthesized
tttaattaattgacaacaatat

SEQ ID NO: 977432 - DNA, 22 bp, Artificial Sequence
  chemically synthesized
aattaattgacaacaatatgaa

SEQ ID NO: 977433 - DNA, 22 bp, Artificial Sequence
  chemically synthesized
attaattgacaacaatatgaat

SEQ ID NO: 977434 - DNA, 22 bp, Artificial Sequence
  chemically synthesized
attgacaacaatatgaatagtt

SEQ ID NO: 977435 - DNA, 22 bp, Artificial Sequence
  chemically synthesized
tgcaggtgcaaacgtaactatt

SEQ ID NO: 977436 - DNA, 22 bp, Artificial Sequence
  chemically synthesized
acaacaatatgaatagttacgt

SEQ ID NO: 977437 - DNA, 22 bp, Artificial Sequence
  chemically synthesized
cctgtgcaggtgcaaacgtaac

SEQ ID NO: 977438 - DNA, 22 bp, Artificial Sequence
  chemically synthesized
ttgcctgtgcaggtgcaaacgt

SEQ ID NO: 977439 - DNA, 22 bp, Artificial Sequence
  chemically synthesized
ttattgcctgtgcaggtgcaaa

SEQ ID NO: 977440 - DNA, 22 bp, Artificial Sequence
  chemically synthesized
gttattattgcctgtgcaggtg

SEQ ID NO: 977441 - DNA, 22 bp, Artificial Sequence
  chemically synthesized
cgtttgcacctgcacaggcaat

SEQ ID NO: 977442 - DNA, 22 bp, Artificial Sequence
  chemically synthesized
tgcattagttattattgcctgt

SEQ ID NO: 977443 - DNA, 22 bp, Artificial Sequence
  chemically synthesized
gcacctgcacaggcaataataa

SEQ ID NO: 977444 - DNA, 22 bp, Artificial Sequence
  chemically synthesized
cacctgcacaggcaataataac

SEQ ID NO: 977445 - DNA, 22 bp, Artificial Sequence
  chemically synthesized
cacaggcaataataactaatgc

SEQ ID NO: 977446 - DNA, 22 bp, Artificial Sequence
  chemically synthesized
ataggtgatggtgtcacagctg

SEQ ID NO: 977447 - DNA, 22 bp, Artificial Sequence
  chemically synthesized
atgcacagctgtgacaccatca

SEQ ID NO: 977448 - DNA, 22 bp, Artificial Sequence
  chemically synthesized
aaaacagatacgtctcataggt

SEQ ID NO: 977449 - DNA, 22 bp, Artificial Sequence
  chemically synthesized
tgacaccatcacctatgagacg

SEQ ID NO: 977450 - DNA, 22 bp, Artificial Sequence
  chemically synthesized
tgaaaacagatacgtctcatag

SEQ ID NO: 977451 - DNA, 22 bp, Artificial Sequence
  chemically synthesized
ctgaaaacagatacgtctcata

SEQ ID NO: 977452 - DNA, 22 bp, Artificial Sequence
  chemically synthesized
atatttctgaaaacagatacgt

SEQ ID NO: 977453 - DNA, 22 bp, Artificial Sequence
  chemically synthesized
aatatttctgaaaacagatacg

SEQ ID NO: 977454 - DNA, 22 bp, Artificial Sequence
  chemically synthesized
taatatttctgaaaacagatac

SEQ ID NO: 977455 - DNA, 22 bp, Artificial Sequence
  chemically synthesized
ttaatatttctgaaaacagata

SEQ ID NO: 977456 - DNA, 22 bp, Artificial Sequence
  chemically synthesized
tttttaatatttctgaaaacag

SEQ ID NO: 977457 - DNA, 22 bp, Artificial Sequence
  chemically synthesized
gtttttaatatttctgaaaaca

SEQ ID NO: 977458 - DNA, 22 bp, Artificial Sequence
  chemically synthesized
tgagacgtatctgttttcagaa

SEQ ID NO: 977459 - DNA, 22 bp, Artificial Sequence
  chemically synthesized
gatgcaccttgtttttaatatt

SEQ ID NO: 977460 - DNA, 22 bp, Artificial Sequence
  chemically synthesized
ctggatgcaccttgtttttaat

SEQ ID NO: 977461 - DNA, 22 bp, Artificial Sequence
  chemically synthesized
ttttcagaaatattaaaaacaa

SEQ ID NO: 977462 - DNA, 22 bp, Artificial Sequence
  chemically synthesized
tcagaaatattaaaaacaaggt

SEQ ID NO: 977463 - DNA, 22 bp, Artificial Sequence
  chemically synthesized
cagaaatattaaaaacaaggtg

SEQ ID NO: 977464 - DNA, 22 bp, Artificial Sequence
  chemically synthesized
agaaatattaaaaacaaggtgc

SEQ ID NO: 977465 - DNA, 22 bp, Artificial Sequence
  chemically synthesized
tagtcaccctactggatgcacc

SEQ ID NO: 977466 - DNA, 22 bp, Artificial Sequence
  chemically synthesized
actatagtcaccctactggatg

SEQ ID NO: 977467 - DNA, 22 bp, Artificial Sequence
  chemically synthesized
aaaacaaggtgcatccagtagg

SEQ ID NO: 977468 - DNA, 22 bp, Artificial Sequence
  chemically synthesized
tcattaactatagtcaccctac

SEQ ID NO: 977469 - DNA, 22 bp, Artificial Sequence
  chemically synthesized
aaatacaaaatagattgtcatt

SEQ ID NO: 977470 - DNA, 22 bp, Artificial Sequence
  chemically synthesized
gaaatacaaaatagattgtcat

SEQ ID NO: 977471 - DNA, 22 bp, Artificial Sequence
  chemically synthesized
tgaaatacaaaatagattgtca

SEQ ID NO: 977472 - DNA, 22 bp, Artificial Sequence
  chemically synthesized
ttttgaaatacaaaatagattg

SEQ ID NO: 977473 - DNA, 22 bp, Artificial Sequence
  chemically synthesized
tagttaatgacaatctattttg

SEQ ID NO: 977474 - DNA, 22 bp, Artificial Sequence
  chemically synthesized
tagctattttgaaatacaaaat

SEQ ID NO: 977475 - DNA, 22 bp, Artificial Sequence
  chemically synthesized
atgacaatctattttgtatttc

SEQ ID NO: 977476 - DNA, 22 bp, Artificial Sequence
  chemically synthesized
ttatagctattttgaaatacaa

SEQ ID NO: 977477 - DNA, 22 bp, Artificial Sequence
  chemically synthesized
attatagctattttgaaataca

SEQ ID NO: 977478 - DNA, 22 bp, Artificial Sequence
  chemically synthesized
tattatagctattttgaaatac

SEQ ID NO: 977479 - DNA, 22 bp, Artificial Sequence
  chemically synthesized
ttttgtatttcaaaatagctat

SEQ ID NO: 977480 - DNA, 22 bp, Artificial Sequence
  chemically synthesized
acgtattttattatagctattt

SEQ ID NO: 977481 - DNA, 22 bp, Artificial Sequence
  chemically synthesized
cacgtattttattatagctatt

SEQ ID NO: 977482 - DNA, 22 bp, Artificial Sequence
  chemically synthesized
tgtatttcaaaatagctataat

SEQ ID NO: 977483 - DNA, 22 bp, Artificial Sequence
  chemically synthesized
gtatttcaaaatagctataata

SEQ ID NO: 977484 - DNA, 22 bp, Artificial Sequence
  chemically synthesized
tatttcaaaatagctataataa

SEQ ID NO: 977485 - DNA, 22 bp, Artificial Sequence
  chemically synthesized
caaaatagctataataaaatac

SEQ ID NO: 977486 - DNA, 22 bp, Artificial Sequence
  chemically synthesized
ggaacatttcacgtattttatt

SEQ ID NO: 977487 - DNA, 22 bp, Artificial Sequence
  chemically synthesized
aaaatagctataataaaatacg

SEQ ID NO: 977488 - DNA, 22 bp, Artificial Sequence
  chemically synthesized
tgttgggaacatttcacgtatt

SEQ ID NO: 977489 - DNA, 22 bp, Artificial Sequence
  chemically synthesized
gtgttgggaacatttcacgtat

SEQ ID NO: 977490 - DNA, 22 bp, Artificial Sequence
  chemically synthesized
tgtgttgggaacatttcacgta

SEQ ID NO: 977491 - DNA, 22 bp, Artificial Sequence
  chemically synthesized
ctttgtgttgggaacatttcac

SEQ ID NO: 977492 - DNA, 22 bp, Artificial Sequence
  chemically synthesized
taataaaatacgtgaaatgttc

SEQ ID NO: 977493 - DNA, 22 bp, Artificial Sequence
  chemically synthesized
ccattgctttgtgttgggaaca

SEQ ID NO: 977494 - DNA, 22 bp, Artificial Sequence
  chemically synthesized
accattgctttgtgttgggaac

SEQ ID NO: 977495 - DNA, 22 bp, Artificial Sequence
  chemically synthesized
aaacatttaccattgctttgtg

SEQ ID NO: 977496 - DNA, 22 bp, Artificial Sequence
  chemically synthesized
ccaacacaaagcaatggtaaat

SEQ ID NO: 977497 - DNA, 22 bp, Artificial Sequence
  chemically synthesized
tatccgtcacctcaaacattta

SEQ ID NO: 977498 - DNA, 22 bp, Artificial Sequence
  chemically synthesized
tgtatccgtcacctcaaacatt

SEQ ID NO: 977499 - DNA, 22 bp, Artificial Sequence
  chemically synthesized
ctgtatccgtcacctcaaacat

SEQ ID NO: 977500 - DNA, 22 bp, Artificial Sequence
  chemically synthesized
tcaaataaggatatttctgtat

SEQ ID NO: 977501 - DNA, 22 bp, Artificial Sequence
  chemically synthesized
gaggtgacggatacagaaatat

SEQ ID NO: 977502 - DNA, 22 bp, Artificial Sequence
  chemically synthesized
aggtgacggatacagaaatatc

SEQ ID NO: 977503 - DNA, 22 bp, Artificial Sequence
  chemically synthesized
atgcatgcataccatgtgtaat

SEQ ID NO: 977504 - DNA, 22 bp, Artificial Sequence
  chemically synthesized
gatgcatgcataccatgtgtaa

SEQ ID NO: 977505 - DNA, 22 bp, Artificial Sequence
  chemically synthesized
tgatgcatgcataccatgtgta

SEQ ID NO: 977506 - DNA, 22 bp, Artificial Sequence
  chemically synthesized
atttgataattacacatggtat

SEQ ID NO: 977507 - DNA, 22 bp, Artificial Sequence
  chemically synthesized
tttgataattacacatggtatg

SEQ ID NO: 977508 - DNA, 22 bp, Artificial Sequence
  chemically synthesized
gataattacacatggtatgcat

SEQ ID NO: 977509 - DNA, 22 bp, Artificial Sequence
  chemically synthesized
ataattacacatggtatgcatg

SEQ ID NO: 977510 - DNA, 22 bp, Artificial Sequence
  chemically synthesized
cacatggtatgcatgcatcaaa

SEQ ID NO: 977511 - DNA, 22 bp, Artificial Sequence
  chemically synthesized
tgggatacatgtgatattttga

SEQ ID NO: 977512 - DNA, 22 bp, Artificial Sequence
  chemically synthesized
gtgggatacatgtgatattttg

SEQ ID NO: 977513 - DNA, 22 bp, Artificial Sequence
  chemically synthesized
tacatatttgtgggatacatgt

SEQ ID NO: 977514 - DNA, 22 bp, Artificial Sequence
  chemically synthesized
atacataataattgtacatatt

SEQ ID NO: 977515 - DNA, 22 bp, Artificial Sequence
  chemically synthesized
aattgatacataataattgtac

SEQ ID NO: 977516 - DNA, 22 bp, Artificial Sequence
  chemically synthesized
aaattgatacataataattgta

SEQ ID NO: 977517 - DNA, 22 bp, Artificial Sequence
  chemically synthesized
taaattgatacataataattgt

SEQ ID NO: 977518 - DNA, 22 bp, Artificial Sequence
  chemically synthesized
ttaaattgatacataataattg

SEQ ID NO: 977519 - DNA, 22 bp, Artificial Sequence
  chemically synthesized
agatgtgcatttttaaattgat

SEQ ID NO: 977520 - DNA, 22 bp, Artificial Sequence
  chemically synthesized
ttatgtatcaatttaaaaatgc

SEQ ID NO: 977521 - DNA, 22 bp, Artificial Sequence
  chemically synthesized
caactaagatgtgcatttttaa

SEQ ID NO: 977522 - DNA, 22 bp, Artificial Sequence
  chemically synthesized
tgtatcaatttaaaaatgcaca

SEQ ID NO: 977523 - DNA, 22 bp, Artificial Sequence
  chemically synthesized
ttgcaactaagatgtgcatttt

SEQ ID NO: 977524 - DNA, 22 bp, Artificial Sequence
  chemically synthesized
attgcaactaagatgtgcattt

SEQ ID NO: 977525 - DNA, 22 bp, Artificial Sequence
  chemically synthesized
tattgcaactaagatgtgcatt

SEQ ID NO: 977526 - DNA, 22 bp, Artificial Sequence
  chemically synthesized
tattttattgcaactaagatgt

SEQ ID NO: 977527 - DNA, 22 bp, Artificial Sequence
  chemically synthesized
ctgtattttattgcaactaaga

SEQ ID NO: 977528 - DNA, 22 bp, Artificial Sequence
  chemically synthesized
aaaaatgcacatcttagttgca

SEQ ID NO: 977529 - DNA, 22 bp, Artificial Sequence
  chemically synthesized
gctgtattttattgcaactaag

SEQ ID NO: 977530 - DNA, 22 bp, Artificial Sequence
  chemically synthesized
aaaatgcacatcttagttgcaa

SEQ ID NO: 977531 - DNA, 22 bp, Artificial Sequence
  chemically synthesized
tgtttgctgtattttattgcaa

SEQ ID NO: 977532 - DNA, 22 bp, Artificial Sequence
  chemically synthesized
agttgcaataaaatacagcaaa

SEQ ID NO: 977533 - DNA, 22 bp, Artificial Sequence
  chemically synthesized
gttgcaataaaatacagcaaac

SEQ ID NO: 977534 - DNA, 22 bp, Artificial Sequence
  chemically synthesized
aaaagtcacctgtgtttgctgt

SEQ ID NO: 977535 - DNA, 22 bp, Artificial Sequence
  chemically synthesized
caataaaatacagcaaacacag

SEQ ID NO: 977536 - DNA, 22 bp, Artificial Sequence
  chemically synthesized
ccatgaacgaaatcgaggccct

SEQ ID NO: 977537 - DNA, 22 bp, Artificial Sequence
  chemically synthesized
cccatgaacgaaatcgaggccc

SEQ ID NO: 977538 - DNA, 22 bp, Artificial Sequence
  chemically synthesized
ttcccatgaacgaaatcgaggc

SEQ ID NO: 977539 - DNA, 22 bp, Artificial Sequence
  chemically synthesized
attcttcccatgaacgaaatcg

SEQ ID NO: 977540 - DNA, 22 bp, Artificial Sequence
  chemically synthesized
cattcttcccatgaacgaaatc

SEQ ID NO: 977541 - DNA, 22 bp, Artificial Sequence
  chemically synthesized
ttcagggcctcgatttcgttca

SEQ ID NO: 977542 - DNA, 22 bp, Artificial Sequence
  chemically synthesized
tcattcttcccatgaacgaaat

SEQ ID NO: 977543 - DNA, 22 bp, Artificial Sequence
  chemically synthesized
tcagggcctcgatttcgttcat

SEQ ID NO: 977544 - DNA, 22 bp, Artificial Sequence
  chemically synthesized
cagggcctcgatttcgttcatg

SEQ ID NO: 977545 - DNA, 22 bp, Artificial Sequence
  chemically synthesized
agggcctcgatttcgttcatgg

SEQ ID NO: 977546 - DNA, 22 bp, Artificial Sequence
  chemically synthesized
gatttcgttcatgggaagaatg

SEQ ID NO: 977547 - DNA, 22 bp, Artificial Sequence
  chemically synthesized
cgttcatgggaagaatgaaaga

SEQ ID NO: 977548 - DNA, 22 bp, Artificial Sequence
  chemically synthesized
gttcatgggaagaatgaaagat

SEQ ID NO: 977549 - DNA, 22 bp, Artificial Sequence
  chemically synthesized
atgggaagaatgaaagatgaca

SEQ ID NO: 977550 - DNA, 22 bp, Artificial Sequence
  chemically synthesized
gaaatagggcatggaaaaagtc

SEQ ID NO: 977551 - DNA, 22 bp, Artificial Sequence
  chemically synthesized
cctggaaatagggcatggaaaa

SEQ ID NO: 977552 - DNA, 22 bp, Artificial Sequence
  chemically synthesized
ttgcctggaaatagggcatgga

SEQ ID NO: 977553 - DNA, 22 bp, Artificial Sequence
  chemically synthesized
tgatgactttttccatgcccta

SEQ ID NO: 977554 - DNA, 22 bp, Artificial Sequence
  chemically synthesized
tgttgcctggaaatagggcatg

SEQ ID NO: 977555 - DNA, 22 bp, Artificial Sequence
  chemically synthesized
atgactttttccatgccctatt

SEQ ID NO: 977556 - DNA, 22 bp, Artificial Sequence
  chemically synthesized
tttccatgccctatttccaggc

SEQ ID NO: 977557 - DNA, 22 bp, Artificial Sequence
  chemically synthesized
ttccatgccctatttccaggca

SEQ ID NO: 977558 - DNA, 22 bp, Artificial Sequence
  chemically synthesized
tccatgccctatttccaggcaa

SEQ ID NO: 977559 - DNA, 22 bp, Artificial Sequence
  chemically synthesized
ccatgccctatttccaggcaac

SEQ ID NO: 977560 - DNA, 22 bp, Artificial Sequence
  chemically synthesized
gaaggacactctgttgcctgga

SEQ ID NO: 977561 - DNA, 22 bp, Artificial Sequence
  chemically synthesized
catgccctatttccaggcaaca

SEQ ID NO: 977562 - DNA, 22 bp, Artificial Sequence
  chemically synthesized
agaaggacactctgttgcctgg

SEQ ID NO: 977563 - DNA, 22 bp, Artificial Sequence
  chemically synthesized
gtttagaaggacactctgttgc

SEQ ID NO: 977564 - DNA, 22 bp, Artificial Sequence
  chemically synthesized
tggtttagaaggacactctgtt

SEQ ID NO: 977565 - DNA, 22 bp, Artificial Sequence
  chemically synthesized
ctggtttagaaggacactctgt

SEQ ID NO: 977566 - DNA, 22 bp, Artificial Sequence
  chemically synthesized
tttccaggcaacagagtgtcct

SEQ ID NO: 977567 - DNA, 22 bp, Artificial Sequence
  chemically synthesized
ttctggtttagaaggacactct

SEQ ID NO: 977568 - DNA, 22 bp, Artificial Sequence
  chemically synthesized
ccaggcaacagagtgtccttct

SEQ ID NO: 977569 - DNA, 22 bp, Artificial Sequence
  chemically synthesized
caggcaacagagtgtccttcta

SEQ ID NO: 977570 - DNA, 22 bp, Artificial Sequence
  chemically synthesized
aactcttctggtttagaaggac

SEQ ID NO: 977571 - DNA, 22 bp, Artificial Sequence
  chemically synthesized
gagctgaactcttctggtttag

SEQ ID NO: 977572 - DNA, 22 bp, Artificial Sequence
  chemically synthesized
tgttagagctgaactcttctgg

SEQ ID NO: 977573 - DNA, 22 bp, Artificial Sequence
  chemically synthesized
tgtgttagagctgaactcttct

SEQ ID NO: 977574 - DNA, 22 bp, Artificial Sequence
  chemically synthesized
ctgtgttagagctgaactcttc

SEQ ID NO: 977575 - DNA, 22 bp, Artificial Sequence
  chemically synthesized
ctaaaccagaagagttcagctc

SEQ ID NO: 977576 - DNA, 22 bp, Artificial Sequence
  chemically synthesized
taaaccagaagagttcagctct

SEQ ID NO: 977577 - DNA, 22 bp, Artificial Sequence
  chemically synthesized
aaccagaagagttcagctctaa

SEQ ID NO: 977578 - DNA, 22 bp, Artificial Sequence
  chemically synthesized
taatagtcttctgtgttagagc

SEQ ID NO: 977579 - DNA, 22 bp, Artificial Sequence
  chemically synthesized
ataatagtcttctgtgttagag

SEQ ID NO: 977580 - DNA, 22 bp, Artificial Sequence
  chemically synthesized
tataatagtcttctgtgttaga

SEQ ID NO: 977581 - DNA, 22 bp, Artificial Sequence
  chemically synthesized
ttataatagtcttctgtgttag

SEQ ID NO: 977582 - DNA, 22 bp, Artificial Sequence
  chemically synthesized
acttttataatagtcttctgtg

SEQ ID NO: 977583 - DNA, 22 bp, Artificial Sequence
  chemically synthesized
agctctaacacagaagactatt

SEQ ID NO: 977584 - DNA, 22 bp, Artificial Sequence
  chemically synthesized
taacacagaagactattataaa

SEQ ID NO: 977585 - DNA, 22 bp, Artificial Sequence
  chemically synthesized
acacagaagactattataaaag

SEQ ID NO: 977586 - DNA, 22 bp, Artificial Sequence
  chemically synthesized
aaaggagtctaacttttataat

SEQ ID NO: 977587 - DNA, 22 bp, Artificial Sequence
  chemically synthesized
tcaaaggagtctaacttttata

SEQ ID NO: 977588 - DNA, 22 bp, Artificial Sequence
  chemically synthesized
ttataaaagttagactcctttg

SEQ ID NO: 977589 - DNA, 22 bp, Artificial Sequence
  chemically synthesized
taaaagttagactcctttgaga

SEQ ID NO: 977590 - DNA, 22 bp, Artificial Sequence
  chemically synthesized
gactcctttgagagcattggct

SEQ ID NO: 977591 - DNA, 22 bp, Artificial Sequence
  chemically synthesized
ctttgagagcattggctgttct

SEQ ID NO: 977592 - DNA, 22 bp, Artificial Sequence
  chemically synthesized
tgagagcattggctgttcttta

SEQ ID NO: 977593 - DNA, 22 bp, Artificial Sequence
  chemically synthesized
gagagcattggctgttctttat

SEQ ID NO: 977594 - DNA, 22 bp, Artificial Sequence
  chemically synthesized
agagcattggctgttctttatt

SEQ ID NO: 977595 - DNA, 22 bp, Artificial Sequence
  chemically synthesized
gctgttctttatttttgtgtat

SEQ ID NO: 977596 - DNA, 22 bp, Artificial Sequence
  chemically synthesized
ttctttatttttgtgtatatcc

SEQ ID NO: 977597 - DNA, 22 bp, Artificial Sequence
  chemically synthesized
tttatttttgtgtatatccttt

SEQ ID NO: 977598 - DNA, 22 bp, Artificial Sequence
  chemically synthesized
tatttttgtgtatatcctttcc

SEQ ID NO: 977599 - DNA, 22 bp, Artificial Sequence
  chemically synthesized
atttttgtgtatatcctttcct

SEQ ID NO: 977600 - DNA, 22 bp, Artificial Sequence
  chemically synthesized
tgaaatcgagaaaggaaaggat

SEQ ID NO: 977601 - DNA, 22 bp, Artificial Sequence
  chemically synthesized
tttttgtgtatatcctttcctt

SEQ ID NO: 977602 - DNA, 22 bp, Artificial Sequence
  chemically synthesized
gtgaaatcgagaaaggaaagga

SEQ ID NO: 977603 - DNA, 22 bp, Artificial Sequence
  chemically synthesized
ttgtgtatatcctttcctttct

SEQ ID NO: 977604 - DNA, 22 bp, Artificial Sequence
  chemically synthesized
cttgtgaaatcgagaaaggaaa

SEQ ID NO: 977605 - DNA, 22 bp, Artificial Sequence
  chemically synthesized
tgtgtatatcctttcctttctc

SEQ ID NO: 977606 - DNA, 22 bp, Artificial Sequence
  chemically synthesized
gtgtatatcctttcctttctcg

SEQ ID NO: 977607 - DNA, 22 bp, Artificial Sequence
  chemically synthesized
tgtatatcctttcctttctcga

SEQ ID NO: 977608 - DNA, 22 bp, Artificial Sequence
  chemically synthesized
tcctttctcgatttcacaagca

SEQ ID NO: 977609 - DNA, 22 bp, Artificial Sequence
  chemically synthesized
cctttctcgatttcacaagcaa

SEQ ID NO: 977610 - DNA, 22 bp, Artificial Sequence
  chemically synthesized
ctttctcgatttcacaagcaac

SEQ ID NO: 977611 - DNA, 22 bp, Artificial Sequence
  chemically synthesized
gaatcgtcaggagttgcttgtg

SEQ ID NO: 977612 - DNA, 22 bp, Artificial Sequence
  chemically synthesized
tctcgatttcacaagcaactcc

SEQ ID NO: 977613 - DNA, 22 bp, Artificial Sequence
  chemically synthesized
ctagaatcgtcaggagttgctt

SEQ ID NO: 977614 - DNA, 22 bp, Artificial Sequence
  chemically synthesized
ctcgatttcacaagcaactcct

SEQ ID NO: 977615 - DNA, 22 bp, Artificial Sequence
  chemically synthesized
tcgatttcacaagcaactcctg

SEQ ID NO: 977616 - DNA, 22 bp, Artificial Sequence
  chemically synthesized
gatttcacaagcaactcctgac

SEQ ID NO: 977617 - DNA, 22 bp, Artificial Sequence
  chemically synthesized
cacaagcaactcctgacgattc

SEQ ID NO: 977618 - DNA, 22 bp, Artificial Sequence
  chemically synthesized
acaagcaactcctgacgattct

SEQ ID NO: 977619 - DNA, 22 bp, Artificial Sequence
  chemically synthesized
gacaataaattcctagaatcgt

SEQ ID NO: 977620 - DNA, 22 bp, Artificial Sequence
  chemically synthesized
aaattggacaataaattcctag

SEQ ID NO: 977621 - DNA, 22 bp, Artificial Sequence
  chemically synthesized
ctgacgattctaggaatttatt

SEQ ID NO: 977622 - DNA, 22 bp, Artificial Sequence
  chemically synthesized
acgattctaggaatttattgtc

SEQ ID NO: 977623 - DNA, 22 bp, Artificial Sequence
  chemically synthesized
taggaatttattgtccaatttt

SEQ ID NO: 977624 - DNA, 22 bp, Artificial Sequence
  chemically synthesized
tgatcaggaaattaaaattgga

SEQ ID NO: 977625 - DNA, 22 bp, Artificial Sequence
  chemically synthesized
ggaatttattgtccaattttaa

SEQ ID NO: 977626 - DNA, 22 bp, Artificial Sequence
  chemically synthesized
taactatgatcaggaaattaaa

SEQ ID NO: 977627 - DNA, 22 bp, Artificial Sequence
  chemically synthesized
attgtccaattttaatttcctg

SEQ ID NO: 977628 - DNA, 22 bp, Artificial Sequence
  chemically synthesized
ttgtccaattttaatttcctga

SEQ ID NO: 977629 - DNA, 22 bp, Artificial Sequence
  chemically synthesized
tccaattttaatttcctgatca

SEQ ID NO: 977630 - DNA, 22 bp, Artificial Sequence
  chemically synthesized
aaagctataactatgatcagga

SEQ ID NO: 977631 - DNA, 22 bp, Artificial Sequence
  chemically synthesized
caaagctataactatgatcagg

SEQ ID NO: 977632 - DNA, 22 bp, Artificial Sequence
  chemically synthesized
taatttcctgatcatagttata

SEQ ID NO: 977633 - DNA, 22 bp, Artificial Sequence
  chemically synthesized
aatttcctgatcatagttatag

SEQ ID NO: 977634 - DNA, 22 bp, Artificial Sequence
  chemically synthesized
atttcctgatcatagttatagc

SEQ ID NO: 977635 - DNA, 22 bp, Artificial Sequence
  chemically synthesized
ataatgaacttcaaagctataa

SEQ ID NO: 977636 - DNA, 22 bp, Artificial Sequence
  chemically synthesized
cctgatcatagttatagctttg

SEQ ID NO: 977637 - DNA, 22 bp, Artificial Sequence
  chemically synthesized
gataatgaacttcaaagctata

SEQ ID NO: 977638 - DNA, 22 bp, Artificial Sequence
  chemically synthesized
ctgatcatagttatagctttga

SEQ ID NO: 977639 - DNA, 22 bp, Artificial Sequence
  chemically synthesized
atcatagttatagctttgaagt

SEQ ID NO: 977640 - DNA, 22 bp, Artificial Sequence
  chemically synthesized
tagctttgaagttcattatcaa

SEQ ID NO: 977641 - DNA, 22 bp, Artificial Sequence
  chemically synthesized
tgaagttcattatcaaactttg

SEQ ID NO: 977642 - DNA, 22 bp, Artificial Sequence
  chemically synthesized
gaagttcattatcaaactttga

SEQ ID NO: 977643 - DNA, 22 bp, Artificial Sequence
  chemically synthesized
aagttcattatcaaactttgac

SEQ ID NO: 977644 - DNA, 22 bp, Artificial Sequence
  chemically synthesized
attatcaaactttgacctcatg

SEQ ID NO: 977645 - DNA, 22 bp, Artificial Sequence
  chemically synthesized
tcaaactttgacctcatgccct

SEQ ID NO: 977646 - DNA, 22 bp, Artificial Sequence
  chemically synthesized
agaggtaggaatgagggcatga

SEQ ID NO: 977647 - DNA, 22 bp, Artificial Sequence
  chemically synthesized
tgtctgagaggtaggaatgagg

SEQ ID NO: 977648 - DNA, 22 bp, Artificial Sequence
  chemically synthesized
tgacctcatgccctcattccta

SEQ ID NO: 977649 - DNA, 22 bp, Artificial Sequence
  chemically synthesized
gtgtctgagaggtaggaatgag

SEQ ID NO: 977650 - DNA, 22 bp, Artificial Sequence
  chemically synthesized
gacctcatgccctcattcctac

SEQ ID NO: 977651 - DNA, 22 bp, Artificial Sequence
  chemically synthesized
acctcatgccctcattcctacc

SEQ ID NO: 977652 - DNA, 22 bp, Artificial Sequence
  chemically synthesized
atgccctcattcctacctctca

SEQ ID NO: 977653 - DNA, 22 bp, Artificial Sequence
  chemically synthesized
taataatataatttgtgtctga

SEQ ID NO: 977654 - DNA, 22 bp, Artificial Sequence
  chemically synthesized
attcctacctctcagacacaaa

SEQ ID NO: 977655 - DNA, 22 bp, Artificial Sequence
  chemically synthesized
ctacctctcagacacaaattat

SEQ ID NO: 977656 - DNA, 22 bp, Artificial Sequence
  chemically synthesized
cctctcagacacaaattatatt

SEQ ID NO: 977657 - DNA, 22 bp, Artificial Sequence
  chemically synthesized
tcagacacaaattatattatta

SEQ ID NO: 977658 - DNA, 22 bp, Artificial Sequence
  chemically synthesized
atatatatccctgtaataatat

SEQ ID NO: 977659 - DNA, 22 bp, Artificial Sequence
  chemically synthesized
agacacaaattatattattaca

SEQ ID NO: 977660 - DNA, 22 bp, Artificial Sequence
  chemically synthesized
aaatattaatatatatccctgt

SEQ ID NO: 977661 - DNA, 22 bp, Artificial Sequence
  chemically synthesized
tattattacagggatatatatt

SEQ ID NO: 977662 - DNA, 22 bp, Artificial Sequence
  chemically synthesized
ttacagggatatatattaatat

SEQ ID NO: 977663 - DNA, 22 bp, Artificial Sequence
  chemically synthesized
cagggatatatattaatatttc

SEQ ID NO: 977664 - DNA, 22 bp, Artificial Sequence
  chemically synthesized
ggaaaggcagaaatgttgaaat

SEQ ID NO: 977665 - DNA, 22 bp, Artificial Sequence
  chemically synthesized
aggaaaggcagaaatgttgaaa

SEQ ID NO: 977666 - DNA, 22 bp, Artificial Sequence
  chemically synthesized
gatttaggaaaggcagaaatgt

SEQ ID NO: 977667 - DNA, 22 bp, Artificial Sequence
  chemically synthesized
ggatttaggaaaggcagaaatg

SEQ ID NO: 977668 - DNA, 22 bp, Artificial Sequence
  chemically synthesized
atatttcaacatttctgccttt

SEQ ID NO: 977669 - DNA, 22 bp, Artificial Sequence
  chemically synthesized
tttggatttaggaaaggcagaa

SEQ ID NO: 977670 - DNA, 22 bp, Artificial Sequence
  chemically synthesized
atttggatttaggaaaggcaga

SEQ ID NO: 977671 - DNA, 22 bp, Artificial Sequence
  chemically synthesized
tatttggatttaggaaaggcag

SEQ ID NO: 977672 - DNA, 22 bp, Artificial Sequence
  chemically synthesized
ttttatttggatttaggaaagg

SEQ ID NO: 977673 - DNA, 22 bp, Artificial Sequence
  chemically synthesized
caacatttctgcctttcctaaa

SEQ ID NO: 977674 - DNA, 22 bp, Artificial Sequence
  chemically synthesized
aacatttctgcctttcctaaat

SEQ ID NO: 977675 - DNA, 22 bp, Artificial Sequence
  chemically synthesized
ttgttttatttggatttaggaa

SEQ ID NO: 977676 - DNA, 22 bp, Artificial Sequence
  chemically synthesized
tattgttttatttggatttagg

SEQ ID NO: 977677 - DNA, 22 bp, Artificial Sequence
  chemically synthesized
ctgcctttcctaaatccaaata

SEQ ID NO: 977678 - DNA, 22 bp, Artificial Sequence
  chemically synthesized
tgcctttcctaaatccaaataa

SEQ ID NO: 977679 - DNA, 22 bp, Artificial Sequence
  chemically synthesized
cctttcctaaatccaaataaaa

SEQ ID NO: 977680 - DNA, 22 bp, Artificial Sequence
  chemically synthesized
agtattctattgttttatttgg

SEQ ID NO: 977681 - DNA, 22 bp, Artificial Sequence
  chemically synthesized
tcctaaatccaaataaaacaat

SEQ ID NO: 977682 - DNA, 22 bp, Artificial Sequence
  chemically synthesized
attcagtattctattgttttat

SEQ ID NO: 977683 - DNA, 22 bp, Artificial Sequence
  chemically synthesized
cctaaatccaaataaaacaata

SEQ ID NO: 977684 - DNA, 22 bp, Artificial Sequence
  chemically synthesized
aattcagtattctattgtttta

SEQ ID NO: 977685 - DNA, 22 bp, Artificial Sequence
  chemically synthesized
ctaaatccaaataaaacaatag

SEQ ID NO: 977686 - DNA, 22 bp, Artificial Sequence
  chemically synthesized
aatccaaataaaacaatagaat

SEQ ID NO: 977687 - DNA, 22 bp, Artificial Sequence
  chemically synthesized
tcgtagtaatttaattcagtat

SEQ ID NO: 977688 - DNA, 22 bp, Artificial Sequence
  chemically synthesized
gaaacaatgataaattatcgta

SEQ ID NO: 977689 - DNA, 22 bp, Artificial Sequence
  chemically synthesized
aattaaattactacgataattt

SEQ ID NO: 977690 - DNA, 22 bp, Artificial Sequence
  chemically synthesized
aattactacgataatttatcat

SEQ ID NO: 977691 - DNA, 22 bp, Artificial Sequence
  chemically synthesized
ctacgataatttatcattgttt

SEQ ID NO: 977692 - DNA, 22 bp, Artificial Sequence
  chemically synthesized
cgataatttatcattgtttcta

SEQ ID NO: 977693 - DNA, 22 bp, Artificial Sequence
  chemically synthesized
atcattgtttctaatattttct

SEQ ID NO: 977694 - DNA, 22 bp, Artificial Sequence
  chemically synthesized
agaaaaaaaacaagaaaatatt

SEQ ID NO: 977695 - DNA, 22 bp, Artificial Sequence
  chemically synthesized
tcattgtttctaatattttctt

SEQ ID NO: 977696 - DNA, 22 bp, Artificial Sequence
  chemically synthesized
tcagaaaaaaaacaagaaaata

SEQ ID NO: 977697 - DNA, 22 bp, Artificial Sequence
  chemically synthesized
tttctaatattttcttgttttt

SEQ ID NO: 977698 - DNA, 22 bp, Artificial Sequence
  chemically synthesized
ctaatattttcttgtttttttt

SEQ ID NO: 977699 - DNA, 22 bp, Artificial Sequence
  chemically synthesized
taatattttcttgttttttttc

SEQ ID NO: 977700 - DNA, 22 bp, Artificial Sequence
  chemically synthesized
atattttcttgttttttttctg

SEQ ID NO: 977701 - DNA, 22 bp, Artificial Sequence
  chemically synthesized
aataaccacattctcagaaaaa

SEQ ID NO: 977702 - DNA, 22 bp, Artificial Sequence
  chemically synthesized
ttcaataaccacattctcagaa

SEQ ID NO: 977703 - DNA, 22 bp, Artificial Sequence
  chemically synthesized
tcttgttttttttctgagaatg

SEQ ID NO: 977704 - DNA, 22 bp, Artificial Sequence
  chemically synthesized
cttgttttttttctgagaatgt

SEQ ID NO: 977705 - DNA, 22 bp, Artificial Sequence
  chemically synthesized
ttgttttttttctgagaatgtg

SEQ ID NO: 977706 - DNA, 22 bp, Artificial Sequence
  chemically synthesized
gttttttttctgagaatgtggt

SEQ ID NO: 977707 - DNA, 22 bp, Artificial Sequence
  chemically synthesized
ttttttttctgagaatgtggtt

SEQ ID NO: 977708 - DNA, 22 bp, Artificial Sequence
  chemically synthesized
tttttctgagaatgtggttatt

SEQ ID NO: 977709 - DNA, 22 bp, Artificial Sequence
  chemically synthesized
ttttctgagaatgtggttattg

SEQ ID NO: 977710 - DNA, 22 bp, Artificial Sequence
  chemically synthesized
tttctgagaatgtggttattga

SEQ ID NO: 977711 - DNA, 22 bp, Artificial Sequence
  chemically synthesized
ttctgagaatgtggttattgaa

SEQ ID NO: 977712 - DNA, 22 bp, Artificial Sequence
  chemically synthesized
tctgagaatgtggttattgaat

SEQ ID NO: 977713 - DNA, 22 bp, Artificial Sequence
  chemically synthesized
ctgagaatgtggttattgaata

SEQ ID NO: 977714 - DNA, 22 bp, Artificial Sequence
  chemically synthesized
tgagaatgtggttattgaatag

SEQ ID NO: 977715 - DNA, 22 bp, Artificial Sequence
  chemically synthesized
agaatgtggttattgaatagac

SEQ ID NO: 977716 - DNA, 22 bp, Artificial Sequence
  chemically synthesized
cataatcaaaaaagtagtctat

SEQ ID NO: 977717 - DNA, 22 bp, Artificial Sequence
  chemically synthesized
gcataatcaaaaaagtagtcta

SEQ ID NO: 977718 - DNA, 22 bp, Artificial Sequence
  chemically synthesized
agccttgcataatcaaaaaagt

SEQ ID NO: 977719 - DNA, 22 bp, Artificial Sequence
  chemically synthesized
ttgaatagactacttttttgat

SEQ ID NO: 977720 - DNA, 22 bp, Artificial Sequence
  chemically synthesized
aatagactacttttttgattat

SEQ ID NO: 977721 - DNA, 22 bp, Artificial Sequence
  chemically synthesized
acattgagccttgcataatcaa

SEQ ID NO: 977722 - DNA, 22 bp, Artificial Sequence
  chemically synthesized
cttttttgattatgcaaggctc

SEQ ID NO: 977723 - DNA, 22 bp, Artificial Sequence
  chemically synthesized
ttttgattatgcaaggctcaat

SEQ ID NO: 977724 - DNA, 22 bp, Artificial Sequence
  chemically synthesized
tttgattatgcaaggctcaatg

SEQ ID NO: 977725 - DNA, 22 bp, Artificial Sequence
  chemically synthesized
ttgattatgcaaggctcaatgt

SEQ ID NO: 977726 - DNA, 22 bp, Artificial Sequence
  chemically synthesized
tgattatgcaaggctcaatgtc

SEQ ID NO: 977727 - DNA, 22 bp, Artificial Sequence
  chemically synthesized
gattatgcaaggctcaatgtca

SEQ ID NO: 977728 - DNA, 22 bp, Artificial Sequence
  chemically synthesized
gcaacaaaatgttgacattgag

SEQ ID NO: 977729 - DNA, 22 bp, Artificial Sequence
  chemically synthesized
attatgcaaggctcaatgtcaa

SEQ ID NO: 977730 - DNA, 22 bp, Artificial Sequence
  chemically synthesized
agcaacaaaatgttgacattga

SEQ ID NO: 977731 - DNA, 22 bp, Artificial Sequence
  chemically synthesized
tgcaaggctcaatgtcaacatt

SEQ ID NO: 977732 - DNA, 22 bp, Artificial Sequence
  chemically synthesized
taatttagcaacaaaatgttga

SEQ ID NO: 977733 - DNA, 22 bp, Artificial Sequence
  chemically synthesized
atgttataatttagcaacaaaa

SEQ ID NO: 977734 - DNA, 22 bp, Artificial Sequence
  chemically synthesized
aatgttataatttagcaacaaa

SEQ ID NO: 977735 - DNA, 22 bp, Artificial Sequence
  chemically synthesized
aatgtcaacattttgttgctaa

SEQ ID NO: 977736 - DNA, 22 bp, Artificial Sequence
  chemically synthesized
cttaatgttataatttagcaac

SEQ ID NO: 977737 - DNA, 22 bp, Artificial Sequence
  chemically synthesized
gattacttaatgttataattta

SEQ ID NO: 977738 - DNA, 22 bp, Artificial Sequence
  chemically synthesized
tgttgctaaattataacattaa

SEQ ID NO: 977739 - DNA, 22 bp, Artificial Sequence
  chemically synthesized
gttgctaaattataacattaag

SEQ ID NO: 977740 - DNA, 22 bp, Artificial Sequence
  chemically synthesized
ttgctaaattataacattaagt

SEQ ID NO: 977741 - DNA, 22 bp, Artificial Sequence
  chemically synthesized
tgtgatctggattacttaatgt

SEQ ID NO: 977742 - DNA, 22 bp, Artificial Sequence
  chemically synthesized
ctaaattataacattaagtaat

SEQ ID NO: 977743 - DNA, 22 bp, Artificial Sequence
  chemically synthesized
aattataacattaagtaatcca

SEQ ID NO: 977744 - DNA, 22 bp, Artificial Sequence
  chemically synthesized
taacattaagtaatccagatca

SEQ ID NO: 977745 - DNA, 22 bp, Artificial Sequence
  chemically synthesized
aagaaaaatattgtgtgatctg

SEQ ID NO: 977746 - DNA, 22 bp, Artificial Sequence
  chemically synthesized
gctaaagaaaaatattgtgtga

SEQ ID NO: 977747 - DNA, 22 bp, Artificial Sequence
  chemically synthesized
agtaatccagatcacacaatat

SEQ ID NO: 977748 - DNA, 22 bp, Artificial Sequence
  chemically synthesized
agctaaagaaaaatattgtgtg

SEQ ID NO: 977749 - DNA, 22 bp, Artificial Sequence
  chemically synthesized
ttagctaaagaaaaatattgtg

SEQ ID NO: 977750 - DNA, 22 bp, Artificial Sequence
  chemically synthesized
cttagctaaagaaaaatattgt

SEQ ID NO: 977751 - DNA, 22 bp, Artificial Sequence
  chemically synthesized
aacatgtttcttagctaaagaa

SEQ ID NO: 977752 - DNA, 22 bp, Artificial Sequence
  chemically synthesized
gaagttaaacatgtttcttagc

SEQ ID NO: 977753 - DNA, 22 bp, Artificial Sequence
  chemically synthesized
ttctttagctaagaaacatgtt

SEQ ID NO: 977754 - DNA, 22 bp, Artificial Sequence
  chemically synthesized
tctttagctaagaaacatgttt

SEQ ID NO: 977755 - DNA, 22 bp, Artificial Sequence
  chemically synthesized
tagctggaagttaaacatgttt

SEQ ID NO: 977756 - DNA, 22 bp, Artificial Sequence
  chemically synthesized
ctttagctaagaaacatgttta

SEQ ID NO: 977757 - DNA, 22 bp, Artificial Sequence
  chemically synthesized
tttagctaagaaacatgtttaa

SEQ ID NO: 977758 - DNA, 22 bp, Artificial Sequence
  chemically synthesized
tagctaagaaacatgtttaact

SEQ ID NO: 977759 - DNA, 22 bp, Artificial Sequence
  chemically synthesized
agctaagaaacatgtttaactt

SEQ ID NO: 977760 - DNA, 22 bp, Artificial Sequence
  chemically synthesized
gctaagaaacatgtttaacttc

SEQ ID NO: 977761 - DNA, 22 bp, Artificial Sequence
  chemically synthesized
agaaacatgtttaacttccagc

SEQ ID NO: 977762 - DNA, 22 bp, Artificial Sequence
  chemically synthesized
tgagaaaatgttgtagctggaa

SEQ ID NO: 977763 - DNA, 22 bp, Artificial Sequence
  chemically synthesized
tgtgagaaaatgttgtagctgg

SEQ ID NO: 977764 - DNA, 22 bp, Artificial Sequence
  chemically synthesized
ttctgtgagaaaatgttgtagc

SEQ ID NO: 977765 - DNA, 22 bp, Artificial Sequence
  chemically synthesized
attctgtgagaaaatgttgtag

SEQ ID NO: 977766 - DNA, 22 bp, Artificial Sequence
  chemically synthesized
ttattctgtgagaaaatgttgt

SEQ ID NO: 977767 - DNA, 22 bp, Artificial Sequence
  chemically synthesized
aacttccagctacaacattttc

SEQ ID NO: 977768 - DNA, 22 bp, Artificial Sequence
  chemically synthesized
acttccagctacaacattttct

SEQ ID NO: 977769 - DNA, 22 bp, Artificial Sequence
  chemically synthesized
ccagctacaacattttctcaca

SEQ ID NO: 977770 - DNA, 22 bp, Artificial Sequence
  chemically synthesized
cagctacaacattttctcacag

SEQ ID NO: 977771 - DNA, 22 bp, Artificial Sequence
  chemically synthesized
caacattttctcacagaataag

SEQ ID NO: 977772 - DNA, 22 bp, Artificial Sequence
  chemically synthesized
tctcacagaataagaattacat

SEQ ID NO: 977773 - DNA, 22 bp, Artificial Sequence
  chemically synthesized
ctcacagaataagaattacatt

SEQ ID NO: 977774 - DNA, 22 bp, Artificial Sequence
  chemically synthesized
tcacagaataagaattacattg

SEQ ID NO: 977775 - DNA, 22 bp, Artificial Sequence
  chemically synthesized
acagaataagaattacattgtt

SEQ ID NO: 977776 - DNA, 22 bp, Artificial Sequence
  chemically synthesized
aagataaatacaaacaatgtaa

SEQ ID NO: 977777 - DNA, 22 bp, Artificial Sequence
  chemically synthesized
aagctaaagataaatacaaaca

SEQ ID NO: 977778 - DNA, 22 bp, Artificial Sequence
  chemically synthesized
cattgtttgtatttatctttag

SEQ ID NO: 977779 - DNA, 22 bp, Artificial Sequence
  chemically synthesized
caataagtgctgaagctaaaga

SEQ ID NO: 977780 - DNA, 22 bp, Artificial Sequence
  chemically synthesized
tttgtatttatctttagcttca

SEQ ID NO: 977781 - DNA, 22 bp, Artificial Sequence
  chemically synthesized
gtatttatctttagcttcagca

SEQ ID NO: 977782 - DNA, 22 bp, Artificial Sequence
  chemically synthesized
tatttatctttagcttcagcac

SEQ ID NO: 977783 - DNA, 22 bp, Artificial Sequence
  chemically synthesized
taactgcaataagtgctgaagc

SEQ ID NO: 977784 - DNA, 22 bp, Artificial Sequence
  chemically synthesized
ataactgcaataagtgctgaag

SEQ ID NO: 977785 - DNA, 22 bp, Artificial Sequence
  chemically synthesized
tataactgcaataagtgctgaa

SEQ ID NO: 977786 - DNA, 22 bp, Artificial Sequence
  chemically synthesized
atctttagcttcagcacttatt

SEQ ID NO: 977787 - DNA, 22 bp, Artificial Sequence
  chemically synthesized
tctttagcttcagcacttattg

SEQ ID NO: 977788 - DNA, 22 bp, Artificial Sequence
  chemically synthesized
tagcttcagcacttattgcagt

SEQ ID NO: 977789 - DNA, 22 bp, Artificial Sequence
  chemically synthesized
acatattttataactgcaataa

SEQ ID NO: 977790 - DNA, 22 bp, Artificial Sequence
  chemically synthesized
agcttcagcacttattgcagtt

SEQ ID NO: 977791 - DNA, 22 bp, Artificial Sequence
  chemically synthesized
gcttcagcacttattgcagtta

SEQ ID NO: 977792 - DNA, 22 bp, Artificial Sequence
  chemically synthesized
cagcacttattgcagttataaa

SEQ ID NO: 977793 - DNA, 22 bp, Artificial Sequence
  chemically synthesized
agcacttattgcagttataaaa

SEQ ID NO: 977794 - DNA, 22 bp, Artificial Sequence
  chemically synthesized
attgcagttataaaatatgtta

SEQ ID NO: 977795 - DNA, 22 bp, Artificial Sequence
  chemically synthesized
tgcccatgatattaacatattt

SEQ ID NO: 977796 - DNA, 22 bp, Artificial Sequence
  chemically synthesized
ttgcagttataaaatatgttaa

SEQ ID NO: 977797 - DNA, 22 bp, Artificial Sequence
  chemically synthesized
ttatgcccatgatattaacata

SEQ ID NO: 977798 - DNA, 22 bp, Artificial Sequence
  chemically synthesized
cagttataaaatatgttaatat

SEQ ID NO: 977799 - DNA, 22 bp, Artificial Sequence
  chemically synthesized
agttgttatgcccatgatatta

SEQ ID NO: 977800 - DNA, 22 bp, Artificial Sequence
  chemically synthesized
cagttgttatgcccatgatatt

SEQ ID NO: 977801 - DNA, 22 bp, Artificial Sequence
  chemically synthesized
taaaatatgttaatatcatggg

SEQ ID NO: 977802 - DNA, 22 bp, Artificial Sequence
  chemically synthesized
tcagttgttatgcccatgatat

SEQ ID NO: 977803 - DNA, 22 bp, Artificial Sequence
  chemically synthesized
agtacgctttcagttgttatgc

SEQ ID NO: 977804 - DNA, 22 bp, Artificial Sequence
  chemically synthesized
atatcatgggcataacaactga

SEQ ID NO: 977805 - DNA, 22 bp, Artificial Sequence
  chemically synthesized
aacaattaagtacgctttcagt

SEQ ID NO: 977806 - DNA, 22 bp, Artificial Sequence
  chemically synthesized
aaagcgtacttaattgttcaac

SEQ ID NO: 977807 - DNA, 22 bp, Artificial Sequence
  chemically synthesized
tgtggtccccaaggttgaacaa

SEQ ID NO: 977808 - DNA, 22 bp, Artificial Sequence
  chemically synthesized
aattgttcaaccttggggacca

SEQ ID NO: 977809 - DNA, 22 bp, Artificial Sequence
  chemically synthesized
atgtagattatgtggtccccaa

SEQ ID NO: 977810 - DNA, 22 bp, Artificial Sequence
  chemically synthesized
attgttcaaccttggggaccac

SEQ ID NO: 977811 - DNA, 22 bp, Artificial Sequence
  chemically synthesized
ttcaaccttggggaccacataa

SEQ ID NO: 977812 - DNA, 22 bp, Artificial Sequence
  chemically synthesized
aaccttggggaccacataatct

SEQ ID NO: 977813 - DNA, 22 bp, Artificial Sequence
  chemically synthesized
ggggaccacataatctacatca

SEQ ID NO: 977814 - DNA, 22 bp, Artificial Sequence
  chemically synthesized
gggaccacataatctacatcag

SEQ ID NO: 977815 - DNA, 22 bp, Artificial Sequence
  chemically synthesized
catcagatttctatgggttttt

SEQ ID NO: 977816 - DNA, 22 bp, Artificial Sequence
  chemically synthesized
ctatgggtttttcatgtctctg

SEQ ID NO: 977817 - DNA, 22 bp, Artificial Sequence
  chemically synthesized
tatgggtttttcatgtctctgg

SEQ ID NO: 977818 - DNA, 22 bp, Artificial Sequence
  chemically synthesized
tgggtttttcatgtctctggtt

SEQ ID NO: 977819 - DNA, 22 bp, Artificial Sequence
  chemically synthesized
gaaaggtgcaatcataaccaga

SEQ ID NO: 977820 - DNA, 22 bp, Artificial Sequence
  chemically synthesized
ttcatgtctctggttatgattg

SEQ ID NO: 977821 - DNA, 22 bp, Artificial Sequence
  chemically synthesized
tcatgtctctggttatgattgc

SEQ ID NO: 977822 - DNA, 22 bp, Artificial Sequence
  chemically synthesized
catgtctctggttatgattgca

SEQ ID NO: 977823 - DNA, 22 bp, Artificial Sequence
  chemically synthesized
atgtctctggttatgattgcac

SEQ ID NO: 977824 - DNA, 22 bp, Artificial Sequence
  chemically synthesized
tggttatgattgcacctttcca

SEQ ID NO: 977825 - DNA, 22 bp, Artificial Sequence
  chemically synthesized
gttatgattgcacctttccaat

SEQ ID NO: 977826 - DNA, 22 bp, Artificial Sequence
  chemically synthesized
aggcacagagacaaattggaaa

SEQ ID NO: 977827 - DNA, 22 bp, Artificial Sequence
  chemically synthesized
tgattgcacctttccaatttgt

SEQ ID NO: 977828 - DNA, 22 bp, Artificial Sequence
  chemically synthesized
cacctttccaatttgtctctgt

SEQ ID NO: 977829 - DNA, 22 bp, Artificial Sequence
  chemically synthesized
tccaatttgtctctgtgcctca

SEQ ID NO: 977830 - DNA, 22 bp, Artificial Sequence
  chemically synthesized
ccaatttgtctctgtgcctcaa

SEQ ID NO: 977831 - DNA, 22 bp, Artificial Sequence
  chemically synthesized
caatttgtctctgtgcctcaac

SEQ ID NO: 977832 - DNA, 22 bp, Artificial Sequence
  chemically synthesized
gtctctgtgcctcaactctctc

SEQ ID NO: 977833 - DNA, 22 bp, Artificial Sequence
  chemically synthesized
tctctgtgcctcaactctctct

SEQ ID NO: 977834 - DNA, 22 bp, Artificial Sequence
  chemically synthesized
tgtgcctcaactctctctctcc

SEQ ID NO: 977835 - DNA, 22 bp, Artificial Sequence
  chemically synthesized
tgcctcaactctctctctcccc

SEQ ID NO: 977836 - DNA, 22 bp, Artificial Sequence
  chemically synthesized
cacaggatggataaggggagag

SEQ ID NO: 977837 - DNA, 22 bp, Artificial Sequence
  chemically synthesized
aactctctctctccccttatcc

SEQ ID NO: 977838 - DNA, 22 bp, Artificial Sequence
  chemically synthesized
tctctctccccttatccatcct

SEQ ID NO: 977839 - DNA, 22 bp, Artificial Sequence
  chemically synthesized
gaagggctacacaggatggata

SEQ ID NO: 977840 - DNA, 22 bp, Artificial Sequence
  chemically synthesized
agaagggctacacaggatggat

SEQ ID NO: 977841 - DNA, 22 bp, Artificial Sequence
  chemically synthesized
tctctccccttatccatcctgt

SEQ ID NO: 977842 - DNA, 22 bp, Artificial Sequence
  chemically synthesized
tagaagggctacacaggatgga

SEQ ID NO: 977843 - DNA, 22 bp, Artificial Sequence
  chemically synthesized
ttagaagggctacacaggatgg

SEQ ID NO: 977844 - DNA, 22 bp, Artificial Sequence
  chemically synthesized
tctccccttatccatcctgtgt

SEQ ID NO: 977845 - DNA, 22 bp, Artificial Sequence
  chemically synthesized
tttagaagggctacacaggatg

SEQ ID NO: 977846 - DNA, 22 bp, Artificial Sequence
  chemically synthesized
tccccttatccatcctgtgtag

SEQ ID NO: 977847 - DNA, 22 bp, Artificial Sequence
  chemically synthesized
tttttagaagggctacacagga

SEQ ID NO: 977848 - DNA, 22 bp, Artificial Sequence
  chemically synthesized
cccttatccatcctgtgtagcc

SEQ ID NO: 977849 - DNA, 22 bp, Artificial Sequence
  chemically synthesized
atccatcctgtgtagcccttct

SEQ ID NO: 977850 - DNA, 22 bp, Artificial Sequence
  chemically synthesized
tccatcctgtgtagcccttcta

SEQ ID NO: 977851 - DNA, 22 bp, Artificial Sequence
  chemically synthesized
aaagattctttttagaagggct

SEQ ID NO: 977852 - DNA, 22 bp, Artificial Sequence
  chemically synthesized
tgtagcccttctaaaaagaatc

SEQ ID NO: 977853 - DNA, 22 bp, Artificial Sequence
  chemically synthesized
ctaaaaagaatctttgaatata

SEQ ID NO: 977854 - DNA, 22 bp, Artificial Sequence
  chemically synthesized
taaaaagaatctttgaatatat

SEQ ID NO: 977855 - DNA, 22 bp, Artificial Sequence
  chemically synthesized
aaaagaatctttgaatatatac

SEQ ID NO: 977856 - DNA, 22 bp, Artificial Sequence
  chemically synthesized
tgaatatatacttttactcatt

SEQ ID NO: 977857 - DNA, 22 bp, Artificial Sequence
  chemically synthesized
gaatatatacttttactcattt

SEQ ID NO: 977858 - DNA, 22 bp, Artificial Sequence
  chemically synthesized
aatatatacttttactcatttt

SEQ ID NO: 977859 - DNA, 22 bp, Artificial Sequence
  chemically synthesized
gaggaacaggcgatcataaaat

SEQ ID NO: 977860 - DNA, 22 bp, Artificial Sequence
  chemically synthesized
gctggaggaacaggcgatcata

SEQ ID NO: 977861 - DNA, 22 bp, Artificial Sequence
  chemically synthesized
ttactcattttatgatcgcctg

SEQ ID NO: 977862 - DNA, 22 bp, Artificial Sequence
  chemically synthesized
tactcattttatgatcgcctgt

SEQ ID NO: 977863 - DNA, 22 bp, Artificial Sequence
  chemically synthesized
actcattttatgatcgcctgtt

SEQ ID NO: 977864 - DNA, 22 bp, Artificial Sequence
  chemically synthesized
ctcattttatgatcgcctgttc

SEQ ID NO: 977865 - DNA, 22 bp, Artificial Sequence
  chemically synthesized
attttatgatcgcctgttcctc

SEQ ID NO: 977866 - DNA, 22 bp, Artificial Sequence
  chemically synthesized
tatgatcgcctgttcctccagc

SEQ ID NO: 977867 - DNA, 22 bp, Artificial Sequence
  chemically synthesized
atgatcgcctgttcctccagct

SEQ ID NO: 977868 - DNA, 22 bp, Artificial Sequence
  chemically synthesized
tgatcgcctgttcctccagcta

SEQ ID NO: 977869 - DNA, 22 bp, Artificial Sequence
  chemically synthesized
ttcctccagctagcttctcttt

SEQ ID NO: 977870 - DNA, 22 bp, Artificial Sequence
  chemically synthesized
agtcaatgaggtcaaagagaag

SEQ ID NO: 977871 - DNA, 22 bp, Artificial Sequence
  chemically synthesized
ctccagctagcttctctttgac

SEQ ID NO: 977872 - DNA, 22 bp, Artificial Sequence
  chemically synthesized
cagctagcttctctttgacctc

SEQ ID NO: 977873 - DNA, 22 bp, Artificial Sequence
  chemically synthesized
gcttctctttgacctcattgac

SEQ ID NO: 977874 - DNA, 22 bp, Artificial Sequence
  chemically synthesized
ctctttgacctcattgactcaa

SEQ ID NO: 977875 - DNA, 22 bp, Artificial Sequence
  chemically synthesized
tctttgacctcattgactcaat

SEQ ID NO: 977876 - DNA, 22 bp, Artificial Sequence
  chemically synthesized
tttgacctcattgactcaattc

SEQ ID NO: 977877 - DNA, 22 bp, Artificial Sequence
  chemically synthesized
tgacctcattgactcaattcac

SEQ ID NO: 977878 - DNA, 22 bp, Artificial Sequence
  chemically synthesized
gacctcattgactcaattcacc

SEQ ID NO: 977879 - DNA, 22 bp, Artificial Sequence
  chemically synthesized
acctcattgactcaattcacct

SEQ ID NO: 977880 - DNA, 22 bp, Artificial Sequence
  chemically synthesized
ggggaaaggcataaggtgaatt

SEQ ID NO: 977881 - DNA, 22 bp, Artificial Sequence
  chemically synthesized
attgactcaattcaccttatgc

SEQ ID NO: 977882 - DNA, 22 bp, Artificial Sequence
  chemically synthesized
actcaattcaccttatgccttt

SEQ ID NO: 977883 - DNA, 22 bp, Artificial Sequence
  chemically synthesized
aattcaccttatgcctttcccc

SEQ ID NO: 977884 - DNA, 22 bp, Artificial Sequence
  chemically synthesized
gacacaagatattaggggaaag

SEQ ID NO: 977885 - DNA, 22 bp, Artificial Sequence
  chemically synthesized
accttatgcctttcccctaata

SEQ ID NO: 977886 - DNA, 22 bp, Artificial Sequence
  chemically synthesized
atgcctttcccctaatatcttg

SEQ ID NO: 977887 - DNA, 22 bp, Artificial Sequence
  chemically synthesized
tgcctttcccctaatatcttgt

SEQ ID NO: 977888 - DNA, 22 bp, Artificial Sequence
  chemically synthesized
acatgattagacacaagatatt

SEQ ID NO: 977889 - DNA, 22 bp, Artificial Sequence
  chemically synthesized
tcccctaatatcttgtgtctaa

SEQ ID NO: 977890 - DNA, 22 bp, Artificial Sequence
  chemically synthesized
cccctaatatcttgtgtctaat

SEQ ID NO: 977891 - DNA, 22 bp, Artificial Sequence
  chemically synthesized
ccctaatatcttgtgtctaatc

SEQ ID NO: 977892 - DNA, 22 bp, Artificial Sequence
  chemically synthesized
agaagtctcacatgattagaca

SEQ ID NO: 977893 - DNA, 22 bp, Artificial Sequence
  chemically synthesized
atatcttgtgtctaatcatgtg

SEQ ID NO: 977894 - DNA, 22 bp, Artificial Sequence
  chemically synthesized
gaaatattaagaagtctcacat

SEQ ID NO: 977895 - DNA, 22 bp, Artificial Sequence
  chemically synthesized
gtgtctaatcatgtgagacttc

SEQ ID NO: 977896 - DNA, 22 bp, Artificial Sequence
  chemically synthesized
tgtctaatcatgtgagacttct

SEQ ID NO: 977897 - DNA, 22 bp, Artificial Sequence
  chemically synthesized
ccctggaaatattaagaagtct

SEQ ID NO: 977898 - DNA, 22 bp, Artificial Sequence
  chemically synthesized
atcatgtgagacttcttaatat

SEQ ID NO: 977899 - DNA, 22 bp, Artificial Sequence
  chemically synthesized
cttaatatttccagggcagacc

SEQ ID NO: 977900 - DNA, 22 bp, Artificial Sequence
  chemically synthesized
ttaatatttccagggcagaccg

SEQ ID NO: 977901 - DNA, 22 bp, Artificial Sequence
  chemically synthesized
aatatttccagggcagaccgtc

SEQ ID NO: 977902 - DNA, 22 bp, Artificial Sequence
  chemically synthesized
atatttccagggcagaccgtcc

SEQ ID NO: 977903 - DNA, 22 bp, Artificial Sequence
  chemically synthesized
aaaggacaaaagaggacggtct

SEQ ID NO: 977904 - DNA, 22 bp, Artificial Sequence
  chemically synthesized
gaaaggacaaaagaggacggtc

SEQ ID NO: 977905 - DNA, 22 bp, Artificial Sequence
  chemically synthesized
ccagggcagaccgtcctctttt

SEQ ID NO: 977906 - DNA, 22 bp, Artificial Sequence
  chemically synthesized
cagggcagaccgtcctcttttg

SEQ ID NO: 977907 - DNA, 22 bp, Artificial Sequence
  chemically synthesized
aataaccttgaaaggacaaaag

SEQ ID NO: 977908 - DNA, 22 bp, Artificial Sequence
  chemically synthesized
gaataaccttgaaaggacaaaa

SEQ ID NO: 977909 - DNA, 22 bp, Artificial Sequence
  chemically synthesized
ttttgtcctttcaaggttattc

SEQ ID NO: 977910 - DNA, 22 bp, Artificial Sequence
  chemically synthesized
ttgtcctttcaaggttattcaa

SEQ ID NO: 977911 - DNA, 22 bp, Artificial Sequence
  chemically synthesized
tgtcctttcaaggttattcaag

SEQ ID NO: 977912 - DNA, 22 bp, Artificial Sequence
  chemically synthesized
gtcctttcaaggttattcaagc

SEQ ID NO: 977913 - DNA, 22 bp, Artificial Sequence
  chemically synthesized
tcctttcaaggttattcaagct

SEQ ID NO: 977914 - DNA, 22 bp, Artificial Sequence
  chemically synthesized
tcaaggttattcaagctgttgt

SEQ ID NO: 977915 - DNA, 22 bp, Artificial Sequence
  chemically synthesized
caaggttattcaagctgttgtc

SEQ ID NO: 977916 - DNA, 22 bp, Artificial Sequence
  chemically synthesized
aaggttattcaagctgttgtcc

SEQ ID NO: 977917 - DNA, 22 bp, Artificial Sequence
  chemically synthesized
ttcaagctgttgtccacacttc

SEQ ID NO: 977918 - DNA, 22 bp, Artificial Sequence
  chemically synthesized
aagctgttgtccacacttctga

SEQ ID NO: 977919 - DNA, 22 bp, Artificial Sequence
  chemically synthesized
tagagggagaacatcagaagtg

SEQ ID NO: 977920 - DNA, 22 bp, Artificial Sequence
  chemically synthesized
ttgtccacacttctgatgttct

SEQ ID NO: 977921 - DNA, 22 bp, Artificial Sequence
  chemically synthesized
tcattatagagggagaacatca

SEQ ID NO: 977922 - DNA, 22 bp, Artificial Sequence
  chemically synthesized
gtcattatagagggagaacatc

SEQ ID NO: 977923 - DNA, 22 bp, Artificial Sequence
  chemically synthesized
tccacacttctgatgttctccc

SEQ ID NO: 977924 - DNA, 22 bp, Artificial Sequence
  chemically synthesized
ctgatgttctccctctataatg

SEQ ID NO: 977925 - DNA, 22 bp, Artificial Sequence
  chemically synthesized
tgatgttctccctctataatga

SEQ ID NO: 977926 - DNA, 22 bp, Artificial Sequence
  chemically synthesized
agtagaagcttgtcattataga

SEQ ID NO: 977927 - DNA, 22 bp, Artificial Sequence
  chemically synthesized
atgttctccctctataatgaca

SEQ ID NO: 977928 - DNA, 22 bp, Artificial Sequence
  chemically synthesized
tccctctataatgacaagcttc

SEQ ID NO: 977929 - DNA, 22 bp, Artificial Sequence
  chemically synthesized
ggaggctgagtagaagcttgtc

SEQ ID NO: 977930 - DNA, 22 bp, Artificial Sequence
  chemically synthesized
cctctataatgacaagcttcta

SEQ ID NO: 977931 - DNA, 22 bp, Artificial Sequence
  chemically synthesized
atctgggaggctgagtagaagc

SEQ ID NO: 977932 - DNA, 22 bp, Artificial Sequence
  chemically synthesized
tataatgacaagcttctactca

SEQ ID NO: 977933 - DNA, 22 bp, Artificial Sequence
  chemically synthesized
taatgacaagcttctactcagc

SEQ ID NO: 977934 - DNA, 22 bp, Artificial Sequence
  chemically synthesized
gctcatctgggaggctgagtag

SEQ ID NO: 977935 - DNA, 22 bp, Artificial Sequence
  chemically synthesized
ctactcagcctcccagatgagc

SEQ ID NO: 977936 - DNA, 22 bp, Artificial Sequence
  chemically synthesized
tactcagcctcccagatgagct

SEQ ID NO: 977937 - DNA, 22 bp, Artificial Sequence
  chemically synthesized
ctcagcctcccagatgagctaa

SEQ ID NO: 977938 - DNA, 22 bp, Artificial Sequence
  chemically synthesized
agcctcccagatgagctaatct

SEQ ID NO: 977939 - DNA, 22 bp, Artificial Sequence
  chemically synthesized
acggagaaggtggtagattagc

SEQ ID NO: 977940 - DNA, 22 bp, Artificial Sequence
  chemically synthesized
cacggagaaggtggtagattag

SEQ ID NO: 977941 - DNA, 22 bp, Artificial Sequence
  chemically synthesized
ccagatgagctaatctaccacc

SEQ ID NO: 977942 - DNA, 22 bp, Artificial Sequence
  chemically synthesized
atctaccaccttctccgtgaag

SEQ ID NO: 977943 - DNA, 22 bp, Artificial Sequence
  chemically synthesized
ccaccttctccgtgaagctggg

SEQ ID NO: 977944 - DNA, 22 bp, Artificial Sequence
  chemically synthesized
caacagagcgtaagacccagct

SEQ ID NO: 977945 - DNA, 22 bp, Artificial Sequence
  chemically synthesized
tccaacagagcgtaagacccag

SEQ ID NO: 977946 - DNA, 22 bp, Artificial Sequence
  chemically synthesized
ctccaacagagcgtaagaccca

SEQ ID NO: 977947 - DNA, 22 bp, Artificial Sequence
  chemically synthesized
ctccgtgaagctgggtcttacg

SEQ ID NO: 977948 - DNA, 22 bp, Artificial Sequence
  chemically synthesized
tccgtgaagctgggtcttacgc

SEQ ID NO: 977949 - DNA, 22 bp, Artificial Sequence
  chemically synthesized
ttctccaacagagcgtaagacc

SEQ ID NO: 977950 - DNA, 22 bp, Artificial Sequence
  chemically synthesized
cgtgaagctgggtcttacgctc

SEQ ID NO: 977951 - DNA, 22 bp, Artificial Sequence
  chemically synthesized
ggtcttacgctctgttggagaa

SEQ ID NO: 977952 - DNA, 22 bp, Artificial Sequence
  chemically synthesized
acgctctgttggagaagagact

SEQ ID NO: 977953 - DNA, 22 bp, Artificial Sequence
  chemically synthesized
cgctctgttggagaagagacta

SEQ ID NO: 977954 - DNA, 22 bp, Artificial Sequence
  chemically synthesized
tgaaggaatcagagtagtctct

SEQ ID NO: 977955 - DNA, 22 bp, Artificial Sequence
  chemically synthesized
tgttggagaagagactactctg

SEQ ID NO: 977956 - DNA, 22 bp, Artificial Sequence
  chemically synthesized
ttggagaagagactactctgat

SEQ ID NO: 977957 - DNA, 22 bp, Artificial Sequence
  chemically synthesized
gagaagagactactctgattcc

SEQ ID NO: 977958 - DNA, 22 bp, Artificial Sequence
  chemically synthesized
ctctgattccttcacagatttt

SEQ ID NO: 977959 - DNA, 22 bp, Artificial Sequence
  chemically synthesized
tgattccttcacagattttact

SEQ ID NO: 977960 - DNA, 22 bp, Artificial Sequence
  chemically synthesized
attccttcacagattttactgt

SEQ ID NO: 977961 - DNA, 22 bp, Artificial Sequence
  chemically synthesized
cttcacagattttactgtacct

SEQ ID NO: 977962 - DNA, 22 bp, Artificial Sequence
  chemically synthesized
tagtatcccaagataggtacag

SEQ ID NO: 977963 - DNA, 22 bp, Artificial Sequence
  chemically synthesized
cacagattttactgtacctatc

SEQ ID NO: 977964 - DNA, 22 bp, Artificial Sequence
  chemically synthesized
acagattttactgtacctatct

SEQ ID NO: 977965 - DNA, 22 bp, Artificial Sequence
  chemically synthesized
tactgtacctatcttgggatac

SEQ ID NO: 977966 - DNA, 22 bp, Artificial Sequence
  chemically synthesized
actgtacctatcttgggatact

SEQ ID NO: 977967 - DNA, 22 bp, Artificial Sequence
  chemically synthesized
ctgtacctatcttgggatacta

SEQ ID NO: 977968 - DNA, 22 bp, Artificial Sequence
  chemically synthesized
tacctatcttgggatactataa

SEQ ID NO: 977969 - DNA, 22 bp, Artificial Sequence
  chemically synthesized
tcttgggatactataatgattt

SEQ ID NO: 977970 - DNA, 22 bp, Artificial Sequence
  chemically synthesized
gggatactataatgattttgat

SEQ ID NO: 977971 - DNA, 22 bp, Artificial Sequence
  chemically synthesized
ggatactataatgattttgatg

SEQ ID NO: 977972 - DNA, 22 bp, Artificial Sequence
  chemically synthesized
gtcaggtagaacagcatcaaaa

SEQ ID NO: 977973 - DNA, 22 bp, Artificial Sequence
  chemically synthesized
agtcaggtagaacagcatcaaa

SEQ ID NO: 977974 - DNA, 22 bp, Artificial Sequence
  chemically synthesized
taatgattttgatgctgttcta

SEQ ID NO: 977975 - DNA, 22 bp, Artificial Sequence
  chemically synthesized
ggtttagtcaggtagaacagca

SEQ ID NO: 977976 - DNA, 22 bp, Artificial Sequence
  chemically synthesized
tgatgctgttctacctgactaa

SEQ ID NO: 977977 - DNA, 22 bp, Artificial Sequence
  chemically synthesized
gatgctgttctacctgactaaa

SEQ ID NO: 977978 - DNA, 22 bp, Artificial Sequence
  chemically synthesized
atgctgttctacctgactaaac

SEQ ID NO: 977979 - DNA, 22 bp, Artificial Sequence
  chemically synthesized
aatagtaacagctgggtttagt

SEQ ID NO: 977980 - DNA, 22 bp, Artificial Sequence
  chemically synthesized
ttctacctgactaaacccagct

SEQ ID NO: 977981 - DNA, 22 bp, Artificial Sequence
  chemically synthesized
ctaaatagtaacagctgggttt

SEQ ID NO: 977982 - DNA, 22 bp, Artificial Sequence
  chemically synthesized
tacctgactaaacccagctgtt

SEQ ID NO: 977983 - DNA, 22 bp, Artificial Sequence
  chemically synthesized
cctgactaaacccagctgttac

SEQ ID NO: 977984 - DNA, 22 bp, Artificial Sequence
  chemically synthesized
actaaacccagctgttactatt

SEQ ID NO: 977985 - DNA, 22 bp, Artificial Sequence
  chemically synthesized
tatccattgctaaatagtaaca

SEQ ID NO: 977986 - DNA, 22 bp, Artificial Sequence
  chemically synthesized
aacccagctgttactatttagc

SEQ ID NO: 977987 - DNA, 22 bp, Artificial Sequence
  chemically synthesized
tgttgtatccattgctaaatag

SEQ ID NO: 977988 - DNA, 22 bp, Artificial Sequence
  chemically synthesized
ctatgttgtatccattgctaaa

SEQ ID NO: 977989 - DNA, 22 bp, Artificial Sequence
  chemically synthesized
ttactatttagcaatggataca

SEQ ID NO: 977990 - DNA, 22 bp, Artificial Sequence
  chemically synthesized
agtatctactatgttgtatcca

SEQ ID NO: 977991 - DNA, 22 bp, Artificial Sequence
  chemically synthesized
ctatttagcaatggatacaaca

SEQ ID NO: 977992 - DNA, 22 bp, Artificial Sequence
  chemically synthesized
ttgagtatctactatgttgtat

SEQ ID NO: 977993 - DNA, 22 bp, Artificial Sequence
  chemically synthesized
tttagcaatggatacaacatag

SEQ ID NO: 977994 - DNA, 22 bp, Artificial Sequence
  chemically synthesized
gttgagtatctactatgttgta

SEQ ID NO: 977995 - DNA, 22 bp, Artificial Sequence
  chemically synthesized
agcaatggatacaacatagtag

SEQ ID NO: 977996 - DNA, 22 bp, Artificial Sequence
  chemically synthesized
gcaatggatacaacatagtaga

SEQ ID NO: 977997 - DNA, 22 bp, Artificial Sequence
  chemically synthesized
aaagacatttgttgagtatcta

SEQ ID NO: 977998 - DNA, 22 bp, Artificial Sequence
  chemically synthesized
attaaaagacatttgttgagta

SEQ ID NO: 977999 - DNA, 22 bp, Artificial Sequence
  chemically synthesized
atgcactaattaaaagacattt

SEQ ID NO: 978000 - DNA, 22 bp, Artificial Sequence
  chemically synthesized
ctcatgcactaattaaaagaca

SEQ ID NO: 978001 - DNA, 22 bp, Artificial Sequence
  chemically synthesized
ctgctcatgcactaattaaaag

SEQ ID NO: 978002 - DNA, 22 bp, Artificial Sequence
  chemically synthesized
aacaaatgtcttttaattagtg

SEQ ID NO: 978003 - DNA, 22 bp, Artificial Sequence
  chemically synthesized
tgcagatactgctgctcatgca

SEQ ID NO: 978004 - DNA, 22 bp, Artificial Sequence
  chemically synthesized
ttaattagtgcatgagcagcag

SEQ ID NO: 978005 - DNA, 22 bp, Artificial Sequence
  chemically synthesized
actgtgcagatactgctgctca

SEQ ID NO: 978006 - DNA, 22 bp, Artificial Sequence
  chemically synthesized
taattagtgcatgagcagcagt

SEQ ID NO: 978007 - DNA, 22 bp, Artificial Sequence
  chemically synthesized
cactgtgcagatactgctgctc

SEQ ID NO: 978008 - DNA, 22 bp, Artificial Sequence
  chemically synthesized
aattagtgcatgagcagcagta

SEQ ID NO: 978009 - DNA, 22 bp, Artificial Sequence
  chemically synthesized
tcactgtgcagatactgctgct

SEQ ID NO: 978010 - DNA, 22 bp, Artificial Sequence
  chemically synthesized
attagtgcatgagcagcagtat

SEQ ID NO: 978011 - DNA, 22 bp, Artificial Sequence
  chemically synthesized
gtgcatgagcagcagtatctgc

SEQ ID NO: 978012 - DNA, 22 bp, Artificial Sequence
  chemically synthesized
cacagtgaaagccactgtctgt

SEQ ID NO: 978013 - DNA, 22 bp, Artificial Sequence
  chemically synthesized
aaatgtagtaggaggtgaggat

SEQ ID NO: 978014 - DNA, 22 bp, Artificial Sequence
  chemically synthesized
tctgtatatcctcacctcctac

SEQ ID NO: 978015 - DNA, 22 bp, Artificial Sequence
  chemically synthesized
tatatcctcacctcctactaca

SEQ ID NO: 978016 - DNA, 22 bp, Artificial Sequence
  chemically synthesized
tggtaggttaaaatgtagtagg

SEQ ID NO: 978017 - DNA, 22 bp, Artificial Sequence
  chemically synthesized
gtggtaggttaaaatgtagtag

SEQ ID NO: 978018 - DNA, 22 bp, Artificial Sequence
  chemically synthesized
tttgtggtaggttaaaatgtag

SEQ ID NO: 978019 - DNA, 22 bp, Artificial Sequence
  chemically synthesized
acctcctactacattttaacct

SEQ ID NO: 978020 - DNA, 22 bp, Artificial Sequence
  chemically synthesized
ctactacattttaacctaccac

SEQ ID NO: 978021 - DNA, 22 bp, Artificial Sequence
  chemically synthesized
ctacattttaacctaccacaaa

SEQ ID NO: 978022 - DNA, 22 bp, Artificial Sequence
  chemically synthesized
cattttaacctaccacaaatag

SEQ ID NO: 978023 - DNA, 22 bp, Artificial Sequence
  chemically synthesized
taacctaccacaaatagttttt

SEQ ID NO: 978024 - DNA, 22 bp, Artificial Sequence
  chemically synthesized
aacctaccacaaatagtttttt

SEQ ID NO: 978025 - DNA, 22 bp, Artificial Sequence
  chemically synthesized
gaagcatgcatcaaaaaactat

SEQ ID NO: 978026 - DNA, 22 bp, Artificial Sequence
  chemically synthesized
acctaccacaaatagttttttg

SEQ ID NO: 978027 - DNA, 22 bp, Artificial Sequence
  chemically synthesized
actggaagcatgcatcaaaaaa

SEQ ID NO: 978028 - DNA, 22 bp, Artificial Sequence
  chemically synthesized
cactggaagcatgcatcaaaaa

SEQ ID NO: 978029 - DNA, 22 bp, Artificial Sequence
  chemically synthesized
ccacaaatagttttttgatgca

SEQ ID NO: 978030 - DNA, 22 bp, Artificial Sequence
  chemically synthesized
tcactggaagcatgcatcaaaa

SEQ ID NO: 978031 - DNA, 22 bp, Artificial Sequence
  chemically synthesized
tttgatgcatgcttccagtgaa

SEQ ID NO: 978032 - DNA, 22 bp, Artificial Sequence
  chemically synthesized
ataaaagacattttcactggaa

SEQ ID NO: 978033 - DNA, 22 bp, Artificial Sequence
  chemically synthesized
ttgatgcatgcttccagtgaaa

SEQ ID NO: 978034 - DNA, 22 bp, Artificial Sequence
  chemically synthesized
gataaaagacattttcactgga

SEQ ID NO: 978035 - DNA, 22 bp, Artificial Sequence
  chemically synthesized
tgatgcatgcttccagtgaaaa

SEQ ID NO: 978036 - DNA, 22 bp, Artificial Sequence
  chemically synthesized
gatgcatgcttccagtgaaaat

SEQ ID NO: 978037 - DNA, 22 bp, Artificial Sequence
  chemically synthesized
atgcatgcttccagtgaaaatg

SEQ ID NO: 978038 - DNA, 22 bp, Artificial Sequence
  chemically synthesized
accttgataaaagacattttca

SEQ ID NO: 978039 - DNA, 22 bp, Artificial Sequence
  chemically synthesized
gaccttgataaaagacattttc

SEQ ID NO: 978040 - DNA, 22 bp, Artificial Sequence
  chemically synthesized
atacttgaccttgataaaagac

SEQ ID NO: 978041 - DNA, 22 bp, Artificial Sequence
  chemically synthesized
ccagtgaaaatgtcttttatca

SEQ ID NO: 978042 - DNA, 22 bp, Artificial Sequence
  chemically synthesized
cagtgaaaatgtcttttatcaa

SEQ ID NO: 978043 - DNA, 22 bp, Artificial Sequence
  chemically synthesized
caatatggagctcatacttgac

SEQ ID NO: 978044 - DNA, 22 bp, Artificial Sequence
  chemically synthesized
gcaatatggagctcatacttga

SEQ ID NO: 978045 - DNA, 22 bp, Artificial Sequence
  chemically synthesized
tgcaatatggagctcatacttg

SEQ ID NO: 978046 - DNA, 22 bp, Artificial Sequence
  chemically synthesized
ttatcaaggtcaagtatgagct

SEQ ID NO: 978047 - DNA, 22 bp, Artificial Sequence
  chemically synthesized
tatcaaggtcaagtatgagctc

SEQ ID NO: 978048 - DNA, 22 bp, Artificial Sequence
  chemically synthesized
atcaaggtcaagtatgagctcc

SEQ ID NO: 978049 - DNA, 22 bp, Artificial Sequence
  chemically synthesized
tcaaggtcaagtatgagctcca

SEQ ID NO: 978050 - DNA, 22 bp, Artificial Sequence
  chemically synthesized
ggttttgcaatatggagctcat

SEQ ID NO: 978051 - DNA, 22 bp, Artificial Sequence
  chemically synthesized
catattgcaaaacccaatggtc

SEQ ID NO: 978052 - DNA, 22 bp, Artificial Sequence
  chemically synthesized
gacaaacacaaaagaatagacc

SEQ ID NO: 978053 - DNA, 22 bp, Artificial Sequence
  chemically synthesized
caaaacccaatggtctattctt

SEQ ID NO: 978054 - DNA, 22 bp, Artificial Sequence
  chemically synthesized
aaaatacaattagacaaacaca

SEQ ID NO: 978055 - DNA, 22 bp, Artificial Sequence
  chemically synthesized
ttcttttgtgtttgtctaattg

SEQ ID NO: 978056 - DNA, 22 bp, Artificial Sequence
  chemically synthesized
ttttgtgtttgtctaattgtat

SEQ ID NO: 978057 - DNA, 22 bp, Artificial Sequence
  chemically synthesized
ttgtgtttgtctaattgtattt

SEQ ID NO: 978058 - DNA, 22 bp, Artificial Sequence
  chemically synthesized
tgtgtttgtctaattgtatttt

SEQ ID NO: 978059 - DNA, 22 bp, Artificial Sequence
  chemically synthesized
gtgtttgtctaattgtattttc

SEQ ID NO: 978060 - DNA, 22 bp, Artificial Sequence
  chemically synthesized
tgtttgtctaattgtattttca

SEQ ID NO: 978061 - DNA, 22 bp, Artificial Sequence
  chemically synthesized
gtctaattgtattttcaacatt

SEQ ID NO: 978062 - DNA, 22 bp, Artificial Sequence
  chemically synthesized
tctaattgtattttcaacattt

SEQ ID NO: 978063 - DNA, 22 bp, Artificial Sequence
  chemically synthesized
attgtattttcaacatttgaca

SEQ ID NO: 978064 - DNA, 22 bp, Artificial Sequence
  chemically synthesized
tattttcaacatttgacactgt

SEQ ID NO: 978065 - DNA, 22 bp, Artificial Sequence
  chemically synthesized
atgatagaatcaaaaacagtgt

SEQ ID NO: 978066 - DNA, 22 bp, Artificial Sequence
  chemically synthesized
catgatagaatcaaaaacagtg

SEQ ID NO: 978067 - DNA, 22 bp, Artificial Sequence
  chemically synthesized
tcaacatttgacactgtttttg

SEQ ID NO: 978068 - DNA, 22 bp, Artificial Sequence
  chemically synthesized
caacatttgacactgtttttga

SEQ ID NO: 978069 - DNA, 22 bp, Artificial Sequence
  chemically synthesized
aacatttgacactgtttttgat

SEQ ID NO: 978070 - DNA, 22 bp, Artificial Sequence
  chemically synthesized
gacactgtttttgattctatca

SEQ ID NO: 978071 - DNA, 22 bp, Artificial Sequence
  chemically synthesized
acactgtttttgattctatcat

SEQ ID NO: 978072 - DNA, 22 bp, Artificial Sequence
  chemically synthesized
tttttgattctatcatgaagga

SEQ ID NO: 978073 - DNA, 22 bp, Artificial Sequence
  chemically synthesized
ttgattctatcatgaaggactt

SEQ ID NO: 978074 - DNA, 22 bp, Artificial Sequence
  chemically synthesized
tgattctatcatgaaggacttt

SEQ ID NO: 978075 - DNA, 22 bp, Artificial Sequence
  chemically synthesized
gattctatcatgaaggactttc

SEQ ID NO: 978076 - DNA, 22 bp, Artificial Sequence
  chemically synthesized
attctatcatgaaggactttct

SEQ ID NO: 978077 - DNA, 22 bp, Artificial Sequence
  chemically synthesized
tatcatgaaggactttcttcat

SEQ ID NO: 978078 - DNA, 22 bp, Artificial Sequence
  chemically synthesized
tcatgaaggactttcttcatcc

SEQ ID NO: 978079 - DNA, 22 bp, Artificial Sequence
  chemically synthesized
tagagaaaaccaggcaagtggg

SEQ ID NO: 978080 - DNA, 22 bp, Artificial Sequence
  chemically synthesized
atagagaaaaccaggcaagtgg

SEQ ID NO: 978081 - DNA, 22 bp, Artificial Sequence
  chemically synthesized
tcttcatcccacttgcctggtt

SEQ ID NO: 978082 - DNA, 22 bp, Artificial Sequence
  chemically synthesized
cttcatcccacttgcctggttt

SEQ ID NO: 978083 - DNA, 22 bp, Artificial Sequence
  chemically synthesized
ttcatcccacttgcctggtttt

SEQ ID NO: 978084 - DNA, 22 bp, Artificial Sequence
  chemically synthesized
tgatttatagagaaaaccaggc

SEQ ID NO: 978085 - DNA, 22 bp, Artificial Sequence
  chemically synthesized
catcccacttgcctggttttct

SEQ ID NO: 978086 - DNA, 22 bp, Artificial Sequence
  chemically synthesized
tgtgatttatagagaaaaccag

SEQ ID NO: 978087 - DNA, 22 bp, Artificial Sequence
  chemically synthesized
atcccacttgcctggttttctc

SEQ ID NO: 978088 - DNA, 22 bp, Artificial Sequence
  chemically synthesized
ctgtgatttatagagaaaacca

SEQ ID NO: 978089 - DNA, 22 bp, Artificial Sequence
  chemically synthesized
gcctggttttctctataaatca

SEQ ID NO: 978090 - DNA, 22 bp, Artificial Sequence
  chemically synthesized
cctggttttctctataaatcac

SEQ ID NO: 978091 - DNA, 22 bp, Artificial Sequence
  chemically synthesized
gttttctctataaatcacagaa

SEQ ID NO: 978092 - DNA, 22 bp, Artificial Sequence
  chemically synthesized
tctctataaatcacagaagttg

SEQ ID NO: 978093 - DNA, 22 bp, Artificial Sequence
  chemically synthesized
ctctataaatcacagaagttgc

SEQ ID NO: 978094 - DNA, 22 bp, Artificial Sequence
  chemically synthesized
tctataaatcacagaagttgct

SEQ ID NO: 978095 - DNA, 22 bp, Artificial Sequence
  chemically synthesized
aaaggagacaaaagcaacttct

SEQ ID NO: 978096 - DNA, 22 bp, Artificial Sequence
  chemically synthesized
tataaatcacagaagttgcttt

SEQ ID NO: 978097 - DNA, 22 bp, Artificial Sequence
  chemically synthesized
taaatcacagaagttgcttttg

SEQ ID NO: 978098 - DNA, 22 bp, Artificial Sequence
  chemically synthesized
cttttgtctcctttgagtattt

SEQ ID NO: 978099 - DNA, 22 bp, Artificial Sequence
  chemically synthesized
ttgtctcctttgagtatttttt

SEQ ID NO: 978100 - DNA, 22 bp, Artificial Sequence
  chemically synthesized
tgtctcctttgagtattttttt

SEQ ID NO: 978101 - DNA, 22 bp, Artificial Sequence
  chemically synthesized
gtctcctttgagtatttttttt

SEQ ID NO: 978102 - DNA, 22 bp, Artificial Sequence
  chemically synthesized
tctcctttgagtattttttttc

SEQ ID NO: 978103 - DNA, 22 bp, Artificial Sequence
  chemically synthesized
aaaacaggaggaagaaaaaaaa

SEQ ID NO: 978104 - DNA, 22 bp, Artificial Sequence
  chemically synthesized
caaaacaggaggaagaaaaaaa

SEQ ID NO: 978105 - DNA, 22 bp, Artificial Sequence
  chemically synthesized
tcaaaacaggaggaagaaaaaa

SEQ ID NO: 978106 - DNA, 22 bp, Artificial Sequence
  chemically synthesized
ctttgagtattttttttcttcc

SEQ ID NO: 978107 - DNA, 22 bp, Artificial Sequence
  chemically synthesized
tgagtattttttttcttcctcc

SEQ ID NO: 978108 - DNA, 22 bp, Artificial Sequence
  chemically synthesized
gagtattttttttcttcctcct

SEQ ID NO: 978109 - DNA, 22 bp, Artificial Sequence
  chemically synthesized
agtattttttttcttcctcctg

SEQ ID NO: 978110 - DNA, 22 bp, Artificial Sequence
  chemically synthesized
cacctttcaaaacaggaggaag

SEQ ID NO: 978111 - DNA, 22 bp, Artificial Sequence
  chemically synthesized
actgcacctttcaaaacaggag

SEQ ID NO: 978112 - DNA, 22 bp, Artificial Sequence
  chemically synthesized
tttttcttcctcctgttttgaa

SEQ ID NO: 978113 - DNA, 22 bp, Artificial Sequence
  chemically synthesized
ttttcttcctcctgttttgaaa

SEQ ID NO: 978114 - DNA, 22 bp, Artificial Sequence
  chemically synthesized
tttcttcctcctgttttgaaag

SEQ ID NO: 978115 - DNA, 22 bp, Artificial Sequence
  chemically synthesized
ttcttcctcctgttttgaaagg

SEQ ID NO: 978116 - DNA, 22 bp, Artificial Sequence
  chemically synthesized
tcttcctcctgttttgaaaggt

SEQ ID NO: 978117 - DNA, 22 bp, Artificial Sequence
  chemically synthesized
cttcctcctgttttgaaaggtg

SEQ ID NO: 978118 - DNA, 22 bp, Artificial Sequence
  chemically synthesized
ttcctcctgttttgaaaggtgc

SEQ ID NO: 978119 - DNA, 22 bp, Artificial Sequence
  chemically synthesized
cctcctgttttgaaaggtgcag

SEQ ID NO: 978120 - DNA, 22 bp, Artificial Sequence
  chemically synthesized
ctcctgttttgaaaggtgcagt

SEQ ID NO: 978121 - DNA, 22 bp, Artificial Sequence
  chemically synthesized
ctgttttgaaaggtgcagtcaa

SEQ ID NO: 978122 - DNA, 22 bp, Artificial Sequence
  chemically synthesized
ttttgaaaggtgcagtcaattc

SEQ ID NO: 978123 - DNA, 22 bp, Artificial Sequence
  chemically synthesized
ggaaaagagcccgagaattgac

SEQ ID NO: 978124 - DNA, 22 bp, Artificial Sequence
  chemically synthesized
tgaaaggtgcagtcaattctcg

SEQ ID NO: 978125 - DNA, 22 bp, Artificial Sequence
  chemically synthesized
gggaaaagagcccgagaattga

SEQ ID NO: 978126 - DNA, 22 bp, Artificial Sequence
  chemically synthesized
gaaaggtgcagtcaattctcgg

SEQ ID NO: 978127 - DNA, 22 bp, Artificial Sequence
  chemically synthesized
aaaggtgcagtcaattctcggg

SEQ ID NO: 978128 - DNA, 22 bp, Artificial Sequence
  chemically synthesized
ggaggagagtttgggaaaagag

SEQ ID NO: 978129 - DNA, 22 bp, Artificial Sequence
  chemically synthesized
taggaggagagtttgggaaaag

SEQ ID NO: 978130 - DNA, 22 bp, Artificial Sequence
  chemically synthesized
ctaggaggagagtttgggaaaa

SEQ ID NO: 978131 - DNA, 22 bp, Artificial Sequence
  chemically synthesized
tcgggctcttttcccaaactct

SEQ ID NO: 978132 - DNA, 22 bp, Artificial Sequence
  chemically synthesized
gggctcttttcccaaactctcc

SEQ ID NO: 978133 - DNA, 22 bp, Artificial Sequence
  chemically synthesized
gatgaagtcttctaggaggaga

SEQ ID NO: 978134 - DNA, 22 bp, Artificial Sequence
  chemically synthesized
ttttcccaaactctcctcctag

SEQ ID NO: 978135 - DNA, 22 bp, Artificial Sequence
  chemically synthesized
ttcccaaactctcctcctagaa

SEQ ID NO: 978136 - DNA, 22 bp, Artificial Sequence
  chemically synthesized
tcccaaactctcctcctagaag

SEQ ID NO: 978137 - DNA, 22 bp, Artificial Sequence
  chemically synthesized
cccaaactctcctcctagaaga

SEQ ID NO: 978138 - DNA, 22 bp, Artificial Sequence
  chemically synthesized
ccaaactctcctcctagaagac

SEQ ID NO: 978139 - DNA, 22 bp, Artificial Sequence
  chemically synthesized
tcctcctagaagacttcatcca

SEQ ID NO: 978140 - DNA, 22 bp, Artificial Sequence
  chemically synthesized
aagacatgggactggatgaagt

SEQ ID NO: 978141 - DNA, 22 bp, Artificial Sequence
  chemically synthesized
aaagacatgggactggatgaag

SEQ ID NO: 978142 - DNA, 22 bp, Artificial Sequence
  chemically synthesized
ctcctagaagacttcatccagt

SEQ ID NO: 978143 - DNA, 22 bp, Artificial Sequence
  chemically synthesized
taaagacatgggactggatgaa

SEQ ID NO: 978144 - DNA, 22 bp, Artificial Sequence
  chemically synthesized
ttaaagacatgggactggatga

SEQ ID NO: 978145 - DNA, 22 bp, Artificial Sequence
  chemically synthesized
ctagaagacttcatccagtccc

SEQ ID NO: 978146 - DNA, 22 bp, Artificial Sequence
  chemically synthesized
gaagacttcatccagtcccatg

SEQ ID NO: 978147 - DNA, 22 bp, Artificial Sequence
  chemically synthesized
gatggtttttaaagacatggga

SEQ ID NO: 978148 - DNA, 22 bp, Artificial Sequence
  chemically synthesized
agatggtttttaaagacatggg

SEQ ID NO: 978149 - DNA, 22 bp, Artificial Sequence
  chemically synthesized
catccagtcccatgtctttaaa

SEQ ID NO: 978150 - DNA, 22 bp, Artificial Sequence
  chemically synthesized
atccagtcccatgtctttaaaa

SEQ ID NO: 978151 - DNA, 22 bp, Artificial Sequence
  chemically synthesized
taaaaaccatctaagggcctat

SEQ ID NO: 978152 - DNA, 22 bp, Artificial Sequence
  chemically synthesized
aaaaaccatctaagggcctatg

SEQ ID NO: 978153 - DNA, 22 bp, Artificial Sequence
  chemically synthesized
aaaaccatctaagggcctatga

SEQ ID NO: 978154 - DNA, 22 bp, Artificial Sequence
  chemically synthesized
agggcctatgactgccacatta

SEQ ID NO: 978155 - DNA, 22 bp, Artificial Sequence
  chemically synthesized
aaaataaataaataaataatgt

SEQ ID NO: 978156 - DNA, 22 bp, Artificial Sequence
  chemically synthesized
tgactgccacattatttattta

SEQ ID NO: 978157 - DNA, 22 bp, Artificial Sequence
  chemically synthesized
tctcaaaataaataaataaata

SEQ ID NO: 978158 - DNA, 22 bp, Artificial Sequence
  chemically synthesized
ccacattatttatttatttatt

SEQ ID NO: 978159 - DNA, 22 bp, Artificial Sequence
  chemically synthesized
tttatttatttattttgagaca

SEQ ID NO: 978160 - DNA, 22 bp, Artificial Sequence
  chemically synthesized
atttatttattttgagacaggg

SEQ ID NO: 978161 - DNA, 22 bp, Artificial Sequence
  chemically synthesized
tttatttattttgagacagggt

SEQ ID NO: 978162 - DNA, 22 bp, Artificial Sequence
  chemically synthesized
ggcaacagagtgagaccctgtc

SEQ ID NO: 978163 - DNA, 22 bp, Artificial Sequence
  chemically synthesized
atttattttgagacagggtctc

SEQ ID NO: 978164 - DNA, 22 bp, Artificial Sequence
  chemically synthesized
tttattttgagacagggtctca

SEQ ID NO: 978165 - DNA, 22 bp, Artificial Sequence
  chemically synthesized
attttgagacagggtctcactc

SEQ ID NO: 978166 - DNA, 22 bp, Artificial Sequence
  chemically synthesized
ttttgagacagggtctcactct

SEQ ID NO: 978167 - DNA, 22 bp, Artificial Sequence
  chemically synthesized
cagcctgggcaacagagtgaga

SEQ ID NO: 978168 - DNA, 22 bp, Artificial Sequence
  chemically synthesized
tgagacagggtctcactctgtt

SEQ ID NO: 978169 - DNA, 22 bp, Artificial Sequence
  chemically synthesized
gagacagggtctcactctgttg

SEQ ID NO: 978170 - DNA, 22 bp, Artificial Sequence
  chemically synthesized
agacagggtctcactctgttgc

SEQ ID NO: 978171 - DNA, 22 bp, Artificial Sequence
  chemically synthesized
cactccagcctgggcaacagag

SEQ ID NO: 978172 - DNA, 22 bp, Artificial Sequence
  chemically synthesized
actctgttgcccaggctggagt

SEQ ID NO: 978173 - DNA, 22 bp, Artificial Sequence
  chemically synthesized
tgttgcccaggctggagtgcag

SEQ ID NO: 978174 - DNA, 22 bp, Artificial Sequence
  chemically synthesized
ttgcccaggctggagtgcagcg

SEQ ID NO: 978175 - DNA, 22 bp, Artificial Sequence
  chemically synthesized
cccaggctggagtgcagcggtg

SEQ ID NO: 978176 - DNA, 22 bp, Artificial Sequence
  chemically synthesized
cagtgagccgtgatcacaccgc

SEQ ID NO: 978177 - DNA, 22 bp, Artificial Sequence
  chemically synthesized
gagtgcagcggtgtgatcacgg

SEQ ID NO: 978178 - DNA, 22 bp, Artificial Sequence
  chemically synthesized
ggaagtcaaggctgcagtgagc

SEQ ID NO: 978179 - DNA, 22 bp, Artificial Sequence
  chemically synthesized
agcctgggaagtcaaggctgca

SEQ ID NO: 978180 - DNA, 22 bp, Artificial Sequence
  chemically synthesized
gagcctgggaagtcaaggctgc

SEQ ID NO: 978181 - DNA, 22 bp, Artificial Sequence
  chemically synthesized
actgcagccttgacttcccagg

SEQ ID NO: 978182 - DNA, 22 bp, Artificial Sequence
  chemically synthesized
aaggatcacttgagcctgggaa

SEQ ID NO: 978183 - DNA, 22 bp, Artificial Sequence
  chemically synthesized
cagccttgacttcccaggctca

SEQ ID NO: 978184 - DNA, 22 bp, Artificial Sequence
  chemically synthesized
gacttcccaggctcaagtgatc

SEQ ID NO: 978185 - DNA, 22 bp, Artificial Sequence
  chemically synthesized
acttcccaggctcaagtgatcc

SEQ ID NO: 978186 - DNA, 22 bp, Artificial Sequence
  chemically synthesized
cccaggctcaagtgatccttca

SEQ ID NO: 978187 - DNA, 22 bp, Artificial Sequence
  chemically synthesized
ccaggctcaagtgatccttcag

SEQ ID NO: 978188 - DNA, 22 bp, Artificial Sequence
  chemically synthesized
aggaggccgaggctgaaggatc

SEQ ID NO: 978189 - DNA, 22 bp, Artificial Sequence
  chemically synthesized
aagtgatccttcagcctcggcc

SEQ ID NO: 978190 - DNA, 22 bp, Artificial Sequence
  chemically synthesized
tagtcccagatactcaggaggc

SEQ ID NO: 978191 - DNA, 22 bp, Artificial Sequence
  chemically synthesized
cagcctcggcctcctgagtatc

SEQ ID NO: 978192 - DNA, 22 bp, Artificial Sequence
  chemically synthesized
agcctcggcctcctgagtatct

SEQ ID NO: 978193 - DNA, 22 bp, Artificial Sequence
  chemically synthesized
ggcctcctgagtatctgggact

SEQ ID NO: 978194 - DNA, 22 bp, Artificial Sequence
  chemically synthesized
ctgagtatctgggactacaggc

SEQ ID NO: 978195 - DNA, 22 bp, Artificial Sequence
  chemically synthesized
agtatctgggactacaggcatg

SEQ ID NO: 978196 - DNA, 22 bp, Artificial Sequence
  chemically synthesized
atcgggtgtggtggcacatgcc

SEQ ID NO: 978197 - DNA, 22 bp, Artificial Sequence
  chemically synthesized
ggactacaggcatgtgccacca

SEQ ID NO: 978198 - DNA, 22 bp, Artificial Sequence
  chemically synthesized
caggcatgtgccaccacacccg

SEQ ID NO: 978199 - DNA, 22 bp, Artificial Sequence
  chemically synthesized
cacacacacacgcgcgcaaaaa

SEQ ID NO: 978200 - DNA, 22 bp, Artificial Sequence
  chemically synthesized
tacacacacacacgcgcgcaaa

SEQ ID NO: 978201 - DNA, 22 bp, Artificial Sequence
  chemically synthesized
gcctctacacacacacacgcgc

SEQ ID NO: 978202 - DNA, 22 bp, Artificial Sequence
  chemically synthesized
atttttgcgcgcgtgtgtgtgt

SEQ ID NO: 978203 - DNA, 22 bp, Artificial Sequence
  chemically synthesized
ttgcgcgcgtgtgtgtgtgtag

SEQ ID NO: 978204 - DNA, 22 bp, Artificial Sequence
  chemically synthesized
tgcgcgcgtgtgtgtgtgtaga

SEQ ID NO: 978205 - DNA, 22 bp, Artificial Sequence
  chemically synthesized
gcgcgcgtgtgtgtgtgtagag

SEQ ID NO: 978206 - DNA, 22 bp, Artificial Sequence
  chemically synthesized
cgcgcgtgtgtgtgtgtagagg

SEQ ID NO: 978207 - DNA, 22 bp, Artificial Sequence
  chemically synthesized
ggtaacacagcgagacctcgcc

SEQ ID NO: 978208 - DNA, 22 bp, Artificial Sequence
  chemically synthesized
gctgtgttacccaggctggtct

SEQ ID NO: 978209 - DNA, 22 bp, Artificial Sequence
  chemically synthesized
agcccaggagtccaagaccagc

SEQ ID NO: 978210 - DNA, 22 bp, Artificial Sequence
  chemically synthesized
gagcccaggagtccaagaccag

SEQ ID NO: 978211 - DNA, 22 bp, Artificial Sequence
  chemically synthesized
tgttacccaggctggtcttgga

SEQ ID NO: 978212 - DNA, 22 bp, Artificial Sequence
  chemically synthesized
cttgagcccaggagtccaagac

SEQ ID NO: 978213 - DNA, 22 bp, Artificial Sequence
  chemically synthesized
cccaggctggtcttggactcct

SEQ ID NO: 978214 - DNA, 22 bp, Artificial Sequence
  chemically synthesized
gtcttggactcctgggctcaag

SEQ ID NO: 978215 - DNA, 22 bp, Artificial Sequence
  chemically synthesized
ggactcctgggctcaagtaatt

SEQ ID NO: 978216 - DNA, 22 bp, Artificial Sequence
  chemically synthesized
gactcctgggctcaagtaattc

SEQ ID NO: 978217 - DNA, 22 bp, Artificial Sequence
  chemically synthesized
ggaggccaggataggagaatta

SEQ ID NO: 978218 - DNA, 22 bp, Artificial Sequence
  chemically synthesized
ctgggctcaagtaattctccta

SEQ ID NO: 978219 - DNA, 22 bp, Artificial Sequence
  chemically synthesized
gggaggccaggataggagaatt

SEQ ID NO: 978220 - DNA, 22 bp, Artificial Sequence
  chemically synthesized
tgggaggccaggataggagaat

SEQ ID NO: 978221 - DNA, 22 bp, Artificial Sequence
  chemically synthesized
ggctcaagtaattctcctatcc

SEQ ID NO: 978222 - DNA, 22 bp, Artificial Sequence
  chemically synthesized
aagtaattctcctatcctggcc

SEQ ID NO: 978223 - DNA, 22 bp, Artificial Sequence
  chemically synthesized
taatcccagcactttgggaggc

SEQ ID NO: 978224 - DNA, 22 bp, Artificial Sequence
  chemically synthesized
tcctatcctggcctcccaaagt

SEQ ID NO: 978225 - DNA, 22 bp, Artificial Sequence
  chemically synthesized
ctataatcccagcactttggga

SEQ ID NO: 978226 - DNA, 22 bp, Artificial Sequence
  chemically synthesized
ctatcctggcctcccaaagtgc

SEQ ID NO: 978227 - DNA, 22 bp, Artificial Sequence
  chemically synthesized
tcctggcctcccaaagtgctgg

SEQ ID NO: 978228 - DNA, 22 bp, Artificial Sequence
  chemically synthesized
actcctataatcccagcacttt

SEQ ID NO: 978229 - DNA, 22 bp, Artificial Sequence
  chemically synthesized
gcctcccaaagtgctgggatta

SEQ ID NO: 978230 - DNA, 22 bp, Artificial Sequence
  chemically synthesized
ccaaagtgctgggattatagga

SEQ ID NO: 978231 - DNA, 22 bp, Artificial Sequence
  chemically synthesized
gccggacacagtggctcactcc

SEQ ID NO: 978232 - DNA, 22 bp, Artificial Sequence
  chemically synthesized
ggattataggagtgagccactg

SEQ ID NO: 978233 - DNA, 22 bp, Artificial Sequence
  chemically synthesized
taggagtgagccactgtgtccg

SEQ ID NO: 978234 - DNA, 22 bp, Artificial Sequence
  chemically synthesized
gaataataacgtaagagttggc

SEQ ID NO: 978235 - DNA, 22 bp, Artificial Sequence
  chemically synthesized
tgtccggccaactcttacgtta

SEQ ID NO: 978236 - DNA, 22 bp, Artificial Sequence
  chemically synthesized
tgactggaataataacgtaaga

SEQ ID NO: 978237 - DNA, 22 bp, Artificial Sequence
  chemically synthesized
aagacagatactgtgactggaa

SEQ ID NO: 978238 - DNA, 22 bp, Artificial Sequence
  chemically synthesized
ttacgttattattccagtcaca

SEQ ID NO: 978239 - DNA, 22 bp, Artificial Sequence
  chemically synthesized
acgttattattccagtcacagt

SEQ ID NO: 978240 - DNA, 22 bp, Artificial Sequence
  chemically synthesized
cgttattattccagtcacagta

SEQ ID NO: 978241 - DNA, 22 bp, Artificial Sequence
  chemically synthesized
aagctgaagacagatactgtga

SEQ ID NO: 978242 - DNA, 22 bp, Artificial Sequence
  chemically synthesized
ttattccagtcacagtatctgt

SEQ ID NO: 978243 - DNA, 22 bp, Artificial Sequence
  chemically synthesized
ttccagtcacagtatctgtctt

SEQ ID NO: 978244 - DNA, 22 bp, Artificial Sequence
  chemically synthesized
cagtcacagtatctgtcttcag

SEQ ID NO: 978245 - DNA, 22 bp, Artificial Sequence
  chemically synthesized
ggtagatcagtctgaagctgaa

SEQ ID NO: 978246 - DNA, 22 bp, Artificial Sequence
  chemically synthesized
tcttcagcttcagactgatcta

SEQ ID NO: 978247 - DNA, 22 bp, Artificial Sequence
  chemically synthesized
gaaagaaagttgggtagatcag

SEQ ID NO: 978248 - DNA, 22 bp, Artificial Sequence
  chemically synthesized
cagcttcagactgatctaccca

SEQ ID NO: 978249 - DNA, 22 bp, Artificial Sequence
  chemically synthesized
agcttcagactgatctacccaa

SEQ ID NO: 978250 - DNA, 22 bp, Artificial Sequence
  chemically synthesized
cagactgatctacccaactttc

SEQ ID NO: 978251 - DNA, 22 bp, Artificial Sequence
  chemically synthesized
agactgatctacccaactttct

SEQ ID NO: 978252 - DNA, 22 bp, Artificial Sequence
  chemically synthesized
atctacccaactttctttccag

SEQ ID NO: 978253 - DNA, 22 bp, Artificial Sequence
  chemically synthesized
cccaactttctttccagcattt

SEQ ID NO: 978254 - DNA, 22 bp, Artificial Sequence
  chemically synthesized
gatatccaagtggaaatgctgg

SEQ ID NO: 978255 - DNA, 22 bp, Artificial Sequence
  chemically synthesized
attagatatccaagtggaaatg

SEQ ID NO: 978256 - DNA, 22 bp, Artificial Sequence
  chemically synthesized
tctttccagcatttccacttgg

SEQ ID NO: 978257 - DNA, 22 bp, Artificial Sequence
  chemically synthesized
ctttccagcatttccacttgga

SEQ ID NO: 978258 - DNA, 22 bp, Artificial Sequence
  chemically synthesized
tttccagcatttccacttggat

SEQ ID NO: 978259 - DNA, 22 bp, Artificial Sequence
  chemically synthesized
tccagcatttccacttggatat

SEQ ID NO: 978260 - DNA, 22 bp, Artificial Sequence
  chemically synthesized
ccagcatttccacttggatatc

SEQ ID NO: 978261 - DNA, 22 bp, Artificial Sequence
  chemically synthesized
cagcatttccacttggatatct

SEQ ID NO: 978262 - DNA, 22 bp, Artificial Sequence
  chemically synthesized
tcagagtctcattagatatcca

SEQ ID NO: 978263 - DNA, 22 bp, Artificial Sequence
  chemically synthesized
ttatcagagtctcattagatat

SEQ ID NO: 978264 - DNA, 22 bp, Artificial Sequence
  chemically synthesized
attatcagagtctcattagata

SEQ ID NO: 978265 - DNA, 22 bp, Artificial Sequence
  chemically synthesized
ttattatcagagtctcattaga

SEQ ID NO: 978266 - DNA, 22 bp, Artificial Sequence
  chemically synthesized
ccacttggatatctaatgagac

SEQ ID NO: 978267 - DNA, 22 bp, Artificial Sequence
  chemically synthesized
cacttggatatctaatgagact

SEQ ID NO: 978268 - DNA, 22 bp, Artificial Sequence
  chemically synthesized
tcttattatcagagtctcatta

SEQ ID NO: 978269 - DNA, 22 bp, Artificial Sequence
  chemically synthesized
ggatatctaatgagactctgat

SEQ ID NO: 978270 - DNA, 22 bp, Artificial Sequence
  chemically synthesized
gatatctaatgagactctgata

SEQ ID NO: 978271 - DNA, 22 bp, Artificial Sequence
  chemically synthesized
atgagactctgataataagaga

SEQ ID NO: 978272 - DNA, 22 bp, Artificial Sequence
  chemically synthesized
tgataataagagagactcttga

SEQ ID NO: 978273 - DNA, 22 bp, Artificial Sequence
  chemically synthesized
ataataagagagactcttgatt

SEQ ID NO: 978274 - DNA, 22 bp, Artificial Sequence
  chemically synthesized
gggtacaaggtgtgatgaaatc

SEQ ID NO: 978275 - DNA, 22 bp, Artificial Sequence
  chemically synthesized
ttgatttcatcacaccttgtac

SEQ ID NO: 978276 - DNA, 22 bp, Artificial Sequence
  chemically synthesized
gatttcatcacaccttgtaccc

SEQ ID NO: 978277 - DNA, 22 bp, Artificial Sequence
  chemically synthesized
atttcatcacaccttgtaccct

SEQ ID NO: 978278 - DNA, 22 bp, Artificial Sequence
  chemically synthesized
catcacaccttgtaccctaact

SEQ ID NO: 978279 - DNA, 22 bp, Artificial Sequence
  chemically synthesized
atcacaccttgtaccctaactt

SEQ ID NO: 978280 - DNA, 22 bp, Artificial Sequence
  chemically synthesized
gggaaaagtggaggaggaaaaa

SEQ ID NO: 978281 - DNA, 22 bp, Artificial Sequence
  chemically synthesized
gtaccctaactttttcctcctc

SEQ ID NO: 978282 - DNA, 22 bp, Artificial Sequence
  chemically synthesized
taccctaactttttcctcctcc

SEQ ID NO: 978283 - DNA, 22 bp, Artificial Sequence
  chemically synthesized
ctggggaaaagtggaggaggaa

SEQ ID NO: 978284 - DNA, 22 bp, Artificial Sequence
  chemically synthesized
gctggggaaaagtggaggagga

SEQ ID NO: 978285 - DNA, 22 bp, Artificial Sequence
  chemically synthesized
tgctggggaaaagtggaggagg

SEQ ID NO: 978286 - DNA, 22 bp, Artificial Sequence
  chemically synthesized
tttgctggggaaaagtggagga

SEQ ID NO: 978287 - DNA, 22 bp, Artificial Sequence
  chemically synthesized
actttttcctcctccacttttc

SEQ ID NO: 978288 - DNA, 22 bp, Artificial Sequence
  chemically synthesized
agttctttgctggggaaaagtg

SEQ ID NO: 978289 - DNA, 22 bp, Artificial Sequence
  chemically synthesized
tttcctcctccacttttcccca

SEQ ID NO: 978290 - DNA, 22 bp, Artificial Sequence
  chemically synthesized
taagttctttgctggggaaaag

SEQ ID NO: 978291 - DNA, 22 bp, Artificial Sequence
  chemically synthesized
ttcctcctccacttttccccag

SEQ ID NO: 978292 - DNA, 22 bp, Artificial Sequence
  chemically synthesized
ctaagttctttgctggggaaaa

SEQ ID NO: 978293 - DNA, 22 bp, Artificial Sequence
  chemically synthesized
tcctcctccacttttccccagc

SEQ ID NO: 978294 - DNA, 22 bp, Artificial Sequence
  chemically synthesized
cctcctccacttttccccagca

SEQ ID NO: 978295 - DNA, 22 bp, Artificial Sequence
  chemically synthesized
ctcctccacttttccccagcaa

SEQ ID NO: 978296 - DNA, 22 bp, Artificial Sequence
  chemically synthesized
tttctaagttctttgctgggga

SEQ ID NO: 978297 - DNA, 22 bp, Artificial Sequence
  chemically synthesized
ctccacttttccccagcaaaga

SEQ ID NO: 978298 - DNA, 22 bp, Artificial Sequence
  chemically synthesized
cacttttccccagcaaagaact

SEQ ID NO: 978299 - DNA, 22 bp, Artificial Sequence
  chemically synthesized
agaattatttctaagttctttg

SEQ ID NO: 978300 - DNA, 22 bp, Artificial Sequence
  chemically synthesized
ttccccagcaaagaacttagaa

SEQ ID NO: 978301 - DNA, 22 bp, Artificial Sequence
  chemically synthesized
tccccagcaaagaacttagaaa

SEQ ID NO: 978302 - DNA, 22 bp, Artificial Sequence
  chemically synthesized
ccccagcaaagaacttagaaat

SEQ ID NO: 978303 - DNA, 22 bp, Artificial Sequence
  chemically synthesized
cccagcaaagaacttagaaata

SEQ ID NO: 978304 - DNA, 22 bp, Artificial Sequence
  chemically synthesized
agaaataattctcaattattct

SEQ ID NO: 978305 - DNA, 22 bp, Artificial Sequence
  chemically synthesized
gaaataattctcaattattctc

SEQ ID NO: 978306 - DNA, 22 bp, Artificial Sequence
  chemically synthesized
gatgtaaagtatgagaataatt

SEQ ID NO: 978307 - DNA, 22 bp, Artificial Sequence
  chemically synthesized
tcaattattctcatactttaca

SEQ ID NO: 978308 - DNA, 22 bp, Artificial Sequence
  chemically synthesized
tgatgaattagatgtaaagtat

SEQ ID NO: 978309 - DNA, 22 bp, Artificial Sequence
  chemically synthesized
aattattctcatactttacatc

SEQ ID NO: 978310 - DNA, 22 bp, Artificial Sequence
  chemically synthesized
ctgtgatgaattagatgtaaag

SEQ ID NO: 978311 - DNA, 22 bp, Artificial Sequence
  chemically synthesized
gctgtgatgaattagatgtaaa

SEQ ID NO: 978312 - DNA, 22 bp, Artificial Sequence
  chemically synthesized
ttctcatactttacatctaatt

SEQ ID NO: 978313 - DNA, 22 bp, Artificial Sequence
  chemically synthesized
tcatactttacatctaattcat

SEQ ID NO: 978314 - DNA, 22 bp, Artificial Sequence
  chemically synthesized
atactttacatctaattcatca

SEQ ID NO: 978315 - DNA, 22 bp, Artificial Sequence
  chemically synthesized
acaggatttgctgtgatgaatt

SEQ ID NO: 978316 - DNA, 22 bp, Artificial Sequence
  chemically synthesized
tacatctaattcatcacagcaa

SEQ ID NO: 978317 - DNA, 22 bp, Artificial Sequence
  chemically synthesized
acatctaattcatcacagcaaa

SEQ ID NO: 978318 - DNA, 22 bp, Artificial Sequence
  chemically synthesized
catctaattcatcacagcaaat

SEQ ID NO: 978319 - DNA, 22 bp, Artificial Sequence
  chemically synthesized
aagacaaagctgacaggatttg

SEQ ID NO: 978320 - DNA, 22 bp, Artificial Sequence
  chemically synthesized
attcatcacagcaaatcctgtc

SEQ ID NO: 978321 - DNA, 22 bp, Artificial Sequence
  chemically synthesized
aaagacaaagctgacaggattt

SEQ ID NO: 978322 - DNA, 22 bp, Artificial Sequence
  chemically synthesized
taaagacaaagctgacaggatt

SEQ ID NO: 978323 - DNA, 22 bp, Artificial Sequence
  chemically synthesized
atcacagcaaatcctgtcagct

SEQ ID NO: 978324 - DNA, 22 bp, Artificial Sequence
  chemically synthesized
ggatacattttaaagacaaagc

SEQ ID NO: 978325 - DNA, 22 bp, Artificial Sequence
  chemically synthesized
aggatacattttaaagacaaag

SEQ ID NO: 978326 - DNA, 22 bp, Artificial Sequence
  chemically synthesized
gtatttaggatacattttaaag

SEQ ID NO: 978327 - DNA, 22 bp, Artificial Sequence
  chemically synthesized
tcagctttgtctttaaaatgta

SEQ ID NO: 978328 - DNA, 22 bp, Artificial Sequence
  chemically synthesized
gagagctggtatttaggataca

SEQ ID NO: 978329 - DNA, 22 bp, Artificial Sequence
  chemically synthesized
tgtctttaaaatgtatcctaaa

SEQ ID NO: 978330 - DNA, 22 bp, Artificial Sequence
  chemically synthesized
gtctttaaaatgtatcctaaat

SEQ ID NO: 978331 - DNA, 22 bp, Artificial Sequence
  chemically synthesized
tctttaaaatgtatcctaaata

SEQ ID NO: 978332 - DNA, 22 bp, Artificial Sequence
  chemically synthesized
taaaatgtatcctaaataccag

SEQ ID NO: 978333 - DNA, 22 bp, Artificial Sequence
  chemically synthesized
aaaatgtatcctaaataccagc

SEQ ID NO: 978334 - DNA, 22 bp, Artificial Sequence
  chemically synthesized
aaatgtatcctaaataccagct

SEQ ID NO: 978335 - DNA, 22 bp, Artificial Sequence
  chemically synthesized
aataccagctctctaactgacc

SEQ ID NO: 978336 - DNA, 22 bp, Artificial Sequence
  chemically synthesized
gggtggagtggtggggtcagtt

SEQ ID NO: 978337 - DNA, 22 bp, Artificial Sequence
  chemically synthesized
agactagggtggagtggtgggg

SEQ ID NO: 978338 - DNA, 22 bp, Artificial Sequence
  chemically synthesized
tctaactgaccccaccactcca

SEQ ID NO: 978339 - DNA, 22 bp, Artificial Sequence
  chemically synthesized
taactgaccccaccactccacc

SEQ ID NO: 978340 - DNA, 22 bp, Artificial Sequence
  chemically synthesized
actgaccccaccactccaccct

SEQ ID NO: 978341 - DNA, 22 bp, Artificial Sequence
  chemically synthesized
accccaccactccaccctagtc

SEQ ID NO: 978342 - DNA, 22 bp, Artificial Sequence
  chemically synthesized
gtccacatcagaggtggttcag

SEQ ID NO: 978343 - DNA, 22 bp, Artificial Sequence
  chemically synthesized
caccctagtctgaaccacctct

SEQ ID NO: 978344 - DNA, 22 bp, Artificial Sequence
  chemically synthesized
ctagtccacatcagaggtggtt

SEQ ID NO: 978345 - DNA, 22 bp, Artificial Sequence
  chemically synthesized
gtctgaaccacctctgatgtgg

SEQ ID NO: 978346 - DNA, 22 bp, Artificial Sequence
  chemically synthesized
aaccacctctgatgtggactag

SEQ ID NO: 978347 - DNA, 22 bp, Artificial Sequence
  chemically synthesized
tgatgtggactagtaacgtggc

SEQ ID NO: 978348 - DNA, 22 bp, Artificial Sequence
  chemically synthesized
atgtggactagtaacgtggctt

SEQ ID NO: 978349 - DNA, 22 bp, Artificial Sequence
  chemically synthesized
gtaacgtggcttcctgtgctat

SEQ ID NO: 978350 - DNA, 22 bp, Artificial Sequence
  chemically synthesized
cctgtgctatctccctgtattc

SEQ ID NO: 978351 - DNA, 22 bp, Artificial Sequence
  chemically synthesized
ctgtgctatctccctgtattca

SEQ ID NO: 978352 - DNA, 22 bp, Artificial Sequence
  chemically synthesized
tgctatctccctgtattcacta

SEQ ID NO: 978353 - DNA, 22 bp, Artificial Sequence
  chemically synthesized
aaatggaagcaatagtgaatac

SEQ ID NO: 978354 - DNA, 22 bp, Artificial Sequence
  chemically synthesized
tctccctgtattcactattgct

SEQ ID NO: 978355 - DNA, 22 bp, Artificial Sequence
  chemically synthesized
gactgaaatggaagcaatagtg

SEQ ID NO: 978356 - DNA, 22 bp, Artificial Sequence
  chemically synthesized
cctgtattcactattgcttcca

SEQ ID NO: 978357 - DNA, 22 bp, Artificial Sequence
  chemically synthesized
tattcactattgcttccatttc

SEQ ID NO: 978358 - DNA, 22 bp, Artificial Sequence
  chemically synthesized
agtagaggttagactgaaatgg

SEQ ID NO: 978359 - DNA, 22 bp, Artificial Sequence
  chemically synthesized
actattgcttccatttcagtct

SEQ ID NO: 978360 - DNA, 22 bp, Artificial Sequence
  chemically synthesized
ctgagtagaggttagactgaaa

SEQ ID NO: 978361 - DNA, 22 bp, Artificial Sequence
  chemically synthesized
ttgcttccatttcagtctaacc

SEQ ID NO: 978362 - DNA, 22 bp, Artificial Sequence
  chemically synthesized
cttccatttcagtctaacctct

SEQ ID NO: 978363 - DNA, 22 bp, Artificial Sequence
  chemically synthesized
atcattgctgagtagaggttag

SEQ ID NO: 978364 - DNA, 22 bp, Artificial Sequence
  chemically synthesized
ccatttcagtctaacctctact

SEQ ID NO: 978365 - DNA, 22 bp, Artificial Sequence
  chemically synthesized
catttcagtctaacctctactc

SEQ ID NO: 978366 - DNA, 22 bp, Artificial Sequence
  chemically synthesized
attcatcattgctgagtagagg

SEQ ID NO: 978367 - DNA, 22 bp, Artificial Sequence
  chemically synthesized
cagtctaacctctactcagcaa

SEQ ID NO: 978368 - DNA, 22 bp, Artificial Sequence
  chemically synthesized
agtctaacctctactcagcaat

SEQ ID NO: 978369 - DNA, 22 bp, Artificial Sequence
  chemically synthesized
aaagagttcattcatcattgct

SEQ ID NO: 978370 - DNA, 22 bp, Artificial Sequence
  chemically synthesized
caaagagttcattcatcattgc

SEQ ID NO: 978371 - DNA, 22 bp, Artificial Sequence
  chemically synthesized
acctctactcagcaatgatgaa

SEQ ID NO: 978372 - DNA, 22 bp, Artificial Sequence
  chemically synthesized
ttcaaagagttcattcatcatt

SEQ ID NO: 978373 - DNA, 22 bp, Artificial Sequence
  chemically synthesized
cttcaaagagttcattcatcat

SEQ ID NO: 978374 - DNA, 22 bp, Artificial Sequence
  chemically synthesized
tcttcaaagagttcattcatca

SEQ ID NO: 978375 - DNA, 22 bp, Artificial Sequence
  chemically synthesized
tactcagcaatgatgaatgaac

SEQ ID NO: 978376 - DNA, 22 bp, Artificial Sequence
  chemically synthesized
ctttcttcaaagagttcattca

SEQ ID NO: 978377 - DNA, 22 bp, Artificial Sequence
  chemically synthesized
ctcagcaatgatgaatgaactc

SEQ ID NO: 978378 - DNA, 22 bp, Artificial Sequence
  chemically synthesized
agcaatgatgaatgaactcttt

SEQ ID NO: 978379 - DNA, 22 bp, Artificial Sequence
  chemically synthesized
atctgctttcttcaaagagttc

SEQ ID NO: 978380 - DNA, 22 bp, Artificial Sequence
  chemically synthesized
tttgaagaaagcagatcaggta

SEQ ID NO: 978381 - DNA, 22 bp, Artificial Sequence
  chemically synthesized
tgaagaaagcagatcaggtatc

SEQ ID NO: 978382 - DNA, 22 bp, Artificial Sequence
  chemically synthesized
gaagaaagcagatcaggtatct

SEQ ID NO: 978383 - DNA, 22 bp, Artificial Sequence
  chemically synthesized
aagaaagcagatcaggtatctc

SEQ ID NO: 978384 - DNA, 22 bp, Artificial Sequence
  chemically synthesized
gaaaaatagagtggagatacct

SEQ ID NO: 978385 - DNA, 22 bp, Artificial Sequence
  chemically synthesized
agaaaaatagagtggagatacc

SEQ ID NO: 978386 - DNA, 22 bp, Artificial Sequence
  chemically synthesized
aagaatttagaaaaatagagtg

SEQ ID NO: 978387 - DNA, 22 bp, Artificial Sequence
  chemically synthesized
cactctatttttctaaattctt

SEQ ID NO: 978388 - DNA, 22 bp, Artificial Sequence
  chemically synthesized
acaggacatcattgaagaattt

SEQ ID NO: 978389 - DNA, 22 bp, Artificial Sequence
  chemically synthesized
gacaggacatcattgaagaatt

SEQ ID NO: 978390 - DNA, 22 bp, Artificial Sequence
  chemically synthesized
tgacaggacatcattgaagaat

SEQ ID NO: 978391 - DNA, 22 bp, Artificial Sequence
  chemically synthesized
tatttttctaaattcttcaatg

SEQ ID NO: 978392 - DNA, 22 bp, Artificial Sequence
  chemically synthesized
tttttctaaattcttcaatgat

SEQ ID NO: 978393 - DNA, 22 bp, Artificial Sequence
  chemically synthesized
ttctaaattcttcaatgatgtc

SEQ ID NO: 978394 - DNA, 22 bp, Artificial Sequence
  chemically synthesized
tctaaattcttcaatgatgtcc

SEQ ID NO: 978395 - DNA, 22 bp, Artificial Sequence
  chemically synthesized
ataattttgacaggacatcatt

SEQ ID NO: 978396 - DNA, 22 bp, Artificial Sequence
  chemically synthesized
ctaaattcttcaatgatgtcct

SEQ ID NO: 978397 - DNA, 22 bp, Artificial Sequence
  chemically synthesized
cataattttgacaggacatcat

SEQ ID NO: 978398 - DNA, 22 bp, Artificial Sequence
  chemically synthesized
taaattcttcaatgatgtcctg

SEQ ID NO: 978399 - DNA, 22 bp, Artificial Sequence
  chemically synthesized
tcataattttgacaggacatca

SEQ ID NO: 978400 - DNA, 22 bp, Artificial Sequence
  chemically synthesized
aattcttcaatgatgtcctgtc

SEQ ID NO: 978401 - DNA, 22 bp, Artificial Sequence
  chemically synthesized
tttcataattttgacaggacat

SEQ ID NO: 978402 - DNA, 22 bp, Artificial Sequence
  chemically synthesized
actctttcataattttgacagg

SEQ ID NO: 978403 - DNA, 22 bp, Artificial Sequence
  chemically synthesized
ttcaatgatgtcctgtcaaaat

SEQ ID NO: 978404 - DNA, 22 bp, Artificial Sequence
  chemically synthesized
aactctttcataattttgacag

SEQ ID NO: 978405 - DNA, 22 bp, Artificial Sequence
  chemically synthesized
caatgatgtcctgtcaaaatta

SEQ ID NO: 978406 - DNA, 22 bp, Artificial Sequence
  chemically synthesized
aatgatgtcctgtcaaaattat

SEQ ID NO: 978407 - DNA, 22 bp, Artificial Sequence
  chemically synthesized
tcaaaattatgaaagagttaaa

SEQ ID NO: 978408 - DNA, 22 bp, Artificial Sequence
  chemically synthesized
caggccgtgataaaagaattta

SEQ ID NO: 978409 - DNA, 22 bp, Artificial Sequence
  chemically synthesized
gcaggccgtgataaaagaattt

SEQ ID NO: 978410 - DNA, 22 bp, Artificial Sequence
  chemically synthesized
tgaaagagttaaattcttttat

SEQ ID NO: 978411 - DNA, 22 bp, Artificial Sequence
  chemically synthesized
aattcttttatcacggcctgca

SEQ ID NO: 978412 - DNA, 22 bp, Artificial Sequence
  chemically synthesized
ttttatcacggcctgcaagatc

SEQ ID NO: 978413 - DNA, 22 bp, Artificial Sequence
  chemically synthesized
ttatcacggcctgcaagatccc

SEQ ID NO: 978414 - DNA, 22 bp, Artificial Sequence
  chemically synthesized
tatcacggcctgcaagatcccg

SEQ ID NO: 978415 - DNA, 22 bp, Artificial Sequence
  chemically synthesized
atcacggcctgcaagatcccgt

SEQ ID NO: 978416 - DNA, 22 bp, Artificial Sequence
  chemically synthesized
tcacggcctgcaagatcccgtg

SEQ ID NO: 978417 - DNA, 22 bp, Artificial Sequence
  chemically synthesized
caagatcccgtgtgatcttgcc

SEQ ID NO: 978418 - DNA, 22 bp, Artificial Sequence
  chemically synthesized
gcccttgcctatacttgcacct

SEQ ID NO: 978419 - DNA, 22 bp, Artificial Sequence
  chemically synthesized
cccttgcctatacttgcacctc

SEQ ID NO: 978420 - DNA, 22 bp, Artificial Sequence
  chemically synthesized
gcctatacttgcacctccttcc

SEQ ID NO: 978421 - DNA, 22 bp, Artificial Sequence
  chemically synthesized
cctatacttgcacctccttcct

SEQ ID NO: 978422 - DNA, 22 bp, Artificial Sequence
  chemically synthesized
tacttgcacctccttccttccc

SEQ ID NO: 978423 - DNA, 22 bp, Artificial Sequence
  chemically synthesized
gcacctccttccttccccacct

SEQ ID NO: 978424 - DNA, 22 bp, Artificial Sequence
  chemically synthesized
cagtgtaagagaaggtggggaa

SEQ ID NO: 978425 - DNA, 22 bp, Artificial Sequence
  chemically synthesized
cacctccttccttccccacctt

SEQ ID NO: 978426 - DNA, 22 bp, Artificial Sequence
  chemically synthesized
cttccttccccaccttctctta

SEQ ID NO: 978427 - DNA, 22 bp, Artificial Sequence
  chemically synthesized
ccttccccaccttctcttacac

SEQ ID NO: 978428 - DNA, 22 bp, Artificial Sequence
  chemically synthesized
cttccccaccttctcttacact

SEQ ID NO: 978429 - DNA, 22 bp, Artificial Sequence
  chemically synthesized
ccccaccttctcttacactgga

SEQ ID NO: 978430 - DNA, 22 bp, Artificial Sequence
  chemically synthesized
cccaccttctcttacactggaa

SEQ ID NO: 978431 - DNA, 22 bp, Artificial Sequence
  chemically synthesized
gccaacaaatagcaaggattcc

SEQ ID NO: 978432 - DNA, 22 bp, Artificial Sequence
  chemically synthesized
ctcttacactggaatccttgct

SEQ ID NO: 978433 - DNA, 22 bp, Artificial Sequence
  chemically synthesized
tcttacactggaatccttgcta

SEQ ID NO: 978434 - DNA, 22 bp, Artificial Sequence
  chemically synthesized
ttacactggaatccttgctatt

SEQ ID NO: 978435 - DNA, 22 bp, Artificial Sequence
  chemically synthesized
acctagccaacaaatagcaagg

SEQ ID NO: 978436 - DNA, 22 bp, Artificial Sequence
  chemically synthesized
gacctagccaacaaatagcaag

SEQ ID NO: 978437 - DNA, 22 bp, Artificial Sequence
  chemically synthesized
acactggaatccttgctatttg

SEQ ID NO: 978438 - DNA, 22 bp, Artificial Sequence
  chemically synthesized
cactggaatccttgctatttgt

SEQ ID NO: 978439 - DNA, 22 bp, Artificial Sequence
  chemically synthesized
gaatccttgctatttgttggct

SEQ ID NO: 978440 - DNA, 22 bp, Artificial Sequence
  chemically synthesized
aaaagagacttgacctagccaa

SEQ ID NO: 978441 - DNA, 22 bp, Artificial Sequence
  chemically synthesized
gctatttgttggctaggtcaag

SEQ ID NO: 978442 - DNA, 22 bp, Artificial Sequence
  chemically synthesized
ctatttgttggctaggtcaagt

SEQ ID NO: 978443 - DNA, 22 bp, Artificial Sequence
  chemically synthesized
agttcaaaagagacttgaccta

SEQ ID NO: 978444 - DNA, 22 bp, Artificial Sequence
  chemically synthesized
tttgttggctaggtcaagtctc

SEQ ID NO: 978445 - DNA, 22 bp, Artificial Sequence
  chemically synthesized
gttggctaggtcaagtctcttt

SEQ ID NO: 978446 - DNA, 22 bp, Artificial Sequence
  chemically synthesized
ttggctaggtcaagtctctttt

SEQ ID NO: 978447 - DNA, 22 bp, Artificial Sequence
  chemically synthesized
gctaggtcaagtctcttttgaa

SEQ ID NO: 978448 - DNA, 22 bp, Artificial Sequence
  chemically synthesized
ggtcaagtctcttttgaactca

SEQ ID NO: 978449 - DNA, 22 bp, Artificial Sequence
  chemically synthesized
ttttgaactcagtgcccttgcc

SEQ ID NO: 978450 - DNA, 22 bp, Artificial Sequence
  chemically synthesized
ttgaactcagtgcccttgccct

SEQ ID NO: 978451 - DNA, 22 bp, Artificial Sequence
  chemically synthesized
tgaactcagtgcccttgccctt

SEQ ID NO: 978452 - DNA, 22 bp, Artificial Sequence
  chemically synthesized
gaactcagtgcccttgcccttg

SEQ ID NO: 978453 - DNA, 22 bp, Artificial Sequence
  chemically synthesized
aactcagtgcccttgcccttgt

SEQ ID NO: 978454 - DNA, 22 bp, Artificial Sequence
  chemically synthesized
caggcagaggaaacaagggcaa

SEQ ID NO: 978455 - DNA, 22 bp, Artificial Sequence
  chemically synthesized
agtgcccttgcccttgtttcct

SEQ ID NO: 978456 - DNA, 22 bp, Artificial Sequence
  chemically synthesized
ggcaaaaacattccaggcagag

SEQ ID NO: 978457 - DNA, 22 bp, Artificial Sequence
  chemically synthesized
gcccttgtttcctctgcctgga

SEQ ID NO: 978458 - DNA, 22 bp, Artificial Sequence
  chemically synthesized
gggcaaaaacattccaggcaga

SEQ ID NO: 978459 - DNA, 22 bp, Artificial Sequence
  chemically synthesized
cccttgtttcctctgcctggaa

SEQ ID NO: 978460 - DNA, 22 bp, Artificial Sequence
  chemically synthesized
gtttcctctgcctggaatgttt

SEQ ID NO: 978461 - DNA, 22 bp, Artificial Sequence
  chemically synthesized
caatttgggcaaaaacattcca

SEQ ID NO: 978462 - DNA, 22 bp, Artificial Sequence
  chemically synthesized
tttcctctgcctggaatgtttt

SEQ ID NO: 978463 - DNA, 22 bp, Artificial Sequence
  chemically synthesized
tccaatttgggcaaaaacattc

SEQ ID NO: 978464 - DNA, 22 bp, Artificial Sequence
  chemically synthesized
cctctgcctggaatgtttttgc

SEQ ID NO: 978465 - DNA, 22 bp, Artificial Sequence
  chemically synthesized
ctctgcctggaatgtttttgcc

SEQ ID NO: 978466 - DNA, 22 bp, Artificial Sequence
  chemically synthesized
tgcctggaatgtttttgcccaa

SEQ ID NO: 978467 - DNA, 22 bp, Artificial Sequence
  chemically synthesized
cctggaatgtttttgcccaaat

SEQ ID NO: 978468 - DNA, 22 bp, Artificial Sequence
  chemically synthesized
gaatgtttttgcccaaattgga

SEQ ID NO: 978469 - DNA, 22 bp, Artificial Sequence
  chemically synthesized
ttgcccaaattggagaatatct

SEQ ID NO: 978470 - DNA, 22 bp, Artificial Sequence
  chemically synthesized
tgcccaaattggagaatatctg

SEQ ID NO: 978471 - DNA, 22 bp, Artificial Sequence
  chemically synthesized
gcccaaattggagaatatctgc

SEQ ID NO: 978472 - DNA, 22 bp, Artificial Sequence
  chemically synthesized
cccaaattggagaatatctgct

SEQ ID NO: 978473 - DNA, 22 bp, Artificial Sequence
  chemically synthesized
agcagatatgagagcagatatt

SEQ ID NO: 978474 - DNA, 22 bp, Artificial Sequence
  chemically synthesized
gagcagatatgagagcagatat

SEQ ID NO: 978475 - DNA, 22 bp, Artificial Sequence
  chemically synthesized
gagaatatctgctctcatatct

SEQ ID NO: 978476 - DNA, 22 bp, Artificial Sequence
  chemically synthesized
gggggcagtatttgagcagata

SEQ ID NO: 978477 - DNA, 22 bp, Artificial Sequence
  chemically synthesized
tagggggcagtatttgagcaga

SEQ ID NO: 978478 - DNA, 22 bp, Artificial Sequence
  chemically synthesized
tctagggggcagtatttgagca

SEQ ID NO: 978479 - DNA, 22 bp, Artificial Sequence
  chemically synthesized
ctctagggggcagtatttgagc

SEQ ID NO: 978480 - DNA, 22 bp, Artificial Sequence
  chemically synthesized
ctctcatatctgctcaaatact

SEQ ID NO: 978481 - DNA, 22 bp, Artificial Sequence
  chemically synthesized
tcatatctgctcaaatactgcc

SEQ ID NO: 978482 - DNA, 22 bp, Artificial Sequence
  chemically synthesized
atatctgctcaaatactgcccc

SEQ ID NO: 978483 - DNA, 22 bp, Artificial Sequence
  chemically synthesized
gcatggcttctctagggggcag

SEQ ID NO: 978484 - DNA, 22 bp, Artificial Sequence
  chemically synthesized
ctcaaatactgccccctagaga

SEQ ID NO: 978485 - DNA, 22 bp, Artificial Sequence
  chemically synthesized
aaatactgccccctagagaagc

SEQ ID NO: 978486 - DNA, 22 bp, Artificial Sequence
  chemically synthesized
ggtggattggcatggcttctct

SEQ ID NO: 978487 - DNA, 22 bp, Artificial Sequence
  chemically synthesized
gattgggtggattggcatggct

SEQ ID NO: 978488 - DNA, 22 bp, Artificial Sequence
  chemically synthesized
ccccctagagaagccatgccaa

SEQ ID NO: 978489 - DNA, 22 bp, Artificial Sequence
  chemically synthesized
agattgggtggattggcatggc

SEQ ID NO: 978490 - DNA, 22 bp, Artificial Sequence
  chemically synthesized
tttagattgggtggattggcat

SEQ ID NO: 978491 - DNA, 22 bp, Artificial Sequence
  chemically synthesized
gtttagattgggtggattggca

SEQ ID NO: 978492 - DNA, 22 bp, Artificial Sequence
  chemically synthesized
gagaagccatgccaatccaccc

SEQ ID NO: 978493 - DNA, 22 bp, Artificial Sequence
  chemically synthesized
aaggtggacttgtttagattgg

SEQ ID NO: 978494 - DNA, 22 bp, Artificial Sequence
  chemically synthesized
aacaagtccaccttcaatatca

SEQ ID NO: 978495 - DNA, 22 bp, Artificial Sequence
  chemically synthesized
agggaatagaaaatgatattga

SEQ ID NO: 978496 - DNA, 22 bp, Artificial Sequence
  chemically synthesized
gttaagggaatagaaaatgata

SEQ ID NO: 978497 - DNA, 22 bp, Artificial Sequence
  chemically synthesized
caatatcattttctattccctt

SEQ ID NO: 978498 - DNA, 22 bp, Artificial Sequence
  chemically synthesized
aatatcattttctattccctta

SEQ ID NO: 978499 - DNA, 22 bp, Artificial Sequence
  chemically synthesized
gaaataaagctggttaagggaa

SEQ ID NO: 978500 - DNA, 22 bp, Artificial Sequence
  chemically synthesized
tctattcccttaaccagcttta

SEQ ID NO: 978501 - DNA, 22 bp, Artificial Sequence
  chemically synthesized
ctattcccttaaccagctttat

SEQ ID NO: 978502 - DNA, 22 bp, Artificial Sequence
  chemically synthesized
tattcccttaaccagctttatt

SEQ ID NO: 978503 - DNA, 22 bp, Artificial Sequence
  chemically synthesized
ttcccttaaccagctttatttc

SEQ ID NO: 978504 - DNA, 22 bp, Artificial Sequence
  chemically synthesized
ccttaaccagctttatttccaa

SEQ ID NO: 978505 - DNA, 22 bp, Artificial Sequence
  chemically synthesized
agatagtgatccatattggaaa

SEQ ID NO: 978506 - DNA, 22 bp, Artificial Sequence
  chemically synthesized
aaccagctttatttccaatatg

SEQ ID NO: 978507 - DNA, 22 bp, Artificial Sequence
  chemically synthesized
cagatagtgatccatattggaa

SEQ ID NO: 978508 - DNA, 22 bp, Artificial Sequence
  chemically synthesized
accagctttatttccaatatgg

SEQ ID NO: 978509 - DNA, 22 bp, Artificial Sequence
  chemically synthesized
tatttccaatatggatcactat

SEQ ID NO: 978510 - DNA, 22 bp, Artificial Sequence
  chemically synthesized
atttccaatatggatcactatc

SEQ ID NO: 978511 - DNA, 22 bp, Artificial Sequence
  chemically synthesized
tttccaatatggatcactatct

SEQ ID NO: 978512 - DNA, 22 bp, Artificial Sequence
  chemically synthesized
ccaatatggatcactatctgaa

SEQ ID NO: 978513 - DNA, 22 bp, Artificial Sequence
  chemically synthesized
caatatggatcactatctgaaa

SEQ ID NO: 978514 - DNA, 22 bp, Artificial Sequence
  chemically synthesized
tatgcatacacatatgatttca

SEQ ID NO: 978515 - DNA, 22 bp, Artificial Sequence
  chemically synthesized
ttatatgcatacacatatgatt

SEQ ID NO: 978516 - DNA, 22 bp, Artificial Sequence
  chemically synthesized
attatatgcatacacatatgat

SEQ ID NO: 978517 - DNA, 22 bp, Artificial Sequence
  chemically synthesized
tttattatatgcatacacatat

SEQ ID NO: 978518 - DNA, 22 bp, Artificial Sequence
  chemically synthesized
tctgaaatcatatgtgtatgca

SEQ ID NO: 978519 - DNA, 22 bp, Artificial Sequence
  chemically synthesized
aaatcatatgtgtatgcatata

SEQ ID NO: 978520 - DNA, 22 bp, Artificial Sequence
  chemically synthesized
gagaataaatgatattatttat

SEQ ID NO: 978521 - DNA, 22 bp, Artificial Sequence
  chemically synthesized
gtagtgagctagagaataaatg

SEQ ID NO: 978522 - DNA, 22 bp, Artificial Sequence
  chemically synthesized
tagtagtgagctagagaataaa

SEQ ID NO: 978523 - DNA, 22 bp, Artificial Sequence
  chemically synthesized
cactctagtagtgagctagaga

SEQ ID NO: 978524 - DNA, 22 bp, Artificial Sequence
  chemically synthesized
acactctagtagtgagctagag

SEQ ID NO: 978525 - DNA, 22 bp, Artificial Sequence
  chemically synthesized
attctctagctcactactagag

SEQ ID NO: 978526 - DNA, 22 bp, Artificial Sequence
  chemically synthesized
gtagaacttacactctagtagt

SEQ ID NO: 978527 - DNA, 22 bp, Artificial Sequence
  chemically synthesized
ttctctagctcactactagagt

SEQ ID NO: 978528 - DNA, 22 bp, Artificial Sequence
  chemically synthesized
tctagctcactactagagtgta

SEQ ID NO: 978529 - DNA, 22 bp, Artificial Sequence
  chemically synthesized
gtctcgtagaacttacactcta

SEQ ID NO: 978530 - DNA, 22 bp, Artificial Sequence
  chemically synthesized
tagctcactactagagtgtaag

SEQ ID NO: 978531 - DNA, 22 bp, Artificial Sequence
  chemically synthesized
gctcactactagagtgtaagtt

SEQ ID NO: 978532 - DNA, 22 bp, Artificial Sequence
  chemically synthesized
actactagagtgtaagttctac

SEQ ID NO: 978533 - DNA, 22 bp, Artificial Sequence
  chemically synthesized
ctagagtgtaagttctacgaga

SEQ ID NO: 978534 - DNA, 22 bp, Artificial Sequence
  chemically synthesized
gagtgtaagttctacgagacta

SEQ ID NO: 978535 - DNA, 22 bp, Artificial Sequence
  chemically synthesized
tacgagactagggacatactta

SEQ ID NO: 978536 - DNA, 22 bp, Artificial Sequence
  chemically synthesized
cgagactagggacatacttatg

SEQ ID NO: 978537 - DNA, 22 bp, Artificial Sequence
  chemically synthesized
ggatacaagaatacataagtat

SEQ ID NO: 978538 - DNA, 22 bp, Artificial Sequence
  chemically synthesized
gggatacaagaatacataagta

SEQ ID NO: 978539 - DNA, 22 bp, Artificial Sequence
  chemically synthesized
gggacatacttatgtattcttg

SEQ ID NO: 978540 - DNA, 22 bp, Artificial Sequence
  chemically synthesized
atgtattcttgtatcccaagta

SEQ ID NO: 978541 - DNA, 22 bp, Artificial Sequence
  chemically synthesized
tgtattcttgtatcccaagtac

SEQ ID NO: 978542 - DNA, 22 bp, Artificial Sequence
  chemically synthesized
ttgtatcccaagtacctggcat

SEQ ID NO: 978543 - DNA, 22 bp, Artificial Sequence
  chemically synthesized
gtatcccaagtacctggcatat

SEQ ID NO: 978544 - DNA, 22 bp, Artificial Sequence
  chemically synthesized
tatcccaagtacctggcatata

SEQ ID NO: 978545 - DNA, 22 bp, Artificial Sequence
  chemically synthesized
tgaagtacatgatatatgccag

SEQ ID NO: 978546 - DNA, 22 bp, Artificial Sequence
  chemically synthesized
gtgaagtacatgatatatgcca

SEQ ID NO: 978547 - DNA, 22 bp, Artificial Sequence
  chemically synthesized
cacagatatttgtgaagtacat

SEQ ID NO: 978548 - DNA, 22 bp, Artificial Sequence
  chemically synthesized
gcatatatcatgtacttcacaa

SEQ ID NO: 978549 - DNA, 22 bp, Artificial Sequence
  chemically synthesized
ttccacagatatttgtgaagta

SEQ ID NO: 978550 - DNA, 22 bp, Artificial Sequence
  chemically synthesized
attccacagatatttgtgaagt

SEQ ID NO: 978551 - DNA, 22 bp, Artificial Sequence
  chemically synthesized
atttattccacagatatttgtg

SEQ ID NO: 978552 - DNA, 22 bp, Artificial Sequence
  chemically synthesized
aatgtgttcatttattccacag

SEQ ID NO: 978553 - DNA, 22 bp, Artificial Sequence
  chemically synthesized
caatgtgttcatttattccaca

SEQ ID NO: 978554 - DNA, 22 bp, Artificial Sequence
  chemically synthesized
cacaaatatctgtggaataaat

SEQ ID NO: 978555 - DNA, 22 bp, Artificial Sequence
  chemically synthesized
ttcaatgtgttcatttattcca

SEQ ID NO: 978556 - DNA, 22 bp, Artificial Sequence
  chemically synthesized
acaaatatctgtggaataaatg

SEQ ID NO: 978557 - DNA, 22 bp, Artificial Sequence
  chemically synthesized
tggaataaatgaacacattgaa

SEQ ID NO: 978558 - DNA, 22 bp, Artificial Sequence
  chemically synthesized
catcacgatggcataatgtaga

SEQ ID NO: 978559 - DNA, 22 bp, Artificial Sequence
  chemically synthesized
acatcacgatggcataatgtag

SEQ ID NO: 978560 - DNA, 22 bp, Artificial Sequence
  chemically synthesized
tacatcacgatggcataatgta

SEQ ID NO: 978561 - DNA, 22 bp, Artificial Sequence
  chemically synthesized
ttacatcacgatggcataatgt

SEQ ID NO: 978562 - DNA, 22 bp, Artificial Sequence
  chemically synthesized
aagagatctacattatgccatc

SEQ ID NO: 978563 - DNA, 22 bp, Artificial Sequence
  chemically synthesized
aaaacaatttttacatcacgat

SEQ ID NO: 978564 - DNA, 22 bp, Artificial Sequence
  chemically synthesized
cattatgccatcgtgatgtaaa

SEQ ID NO: 978565 - DNA, 22 bp, Artificial Sequence
  chemically synthesized
gctcaaaacaatttttacatca

SEQ ID NO: 978566 - DNA, 22 bp, Artificial Sequence
  chemically synthesized
agctcaaaacaatttttacatc

SEQ ID NO: 978567 - DNA, 22 bp, Artificial Sequence
  chemically synthesized
tagctcaaaacaatttttacat

SEQ ID NO: 978568 - DNA, 22 bp, Artificial Sequence
  chemically synthesized
tgccatcgtgatgtaaaaattg

SEQ ID NO: 978569 - DNA, 22 bp, Artificial Sequence
  chemically synthesized
aaatggctttagctcaaaacaa

SEQ ID NO: 978570 - DNA, 22 bp, Artificial Sequence
  chemically synthesized
atcctcaaatggctttagctca

SEQ ID NO: 978571 - DNA, 22 bp, Artificial Sequence
  chemically synthesized
ttgatcctcaaatggctttagc

SEQ ID NO: 978572 - DNA, 22 bp, Artificial Sequence
  chemically synthesized
ttttgagctaaagccatttgag

SEQ ID NO: 978573 - DNA, 22 bp, Artificial Sequence
  chemically synthesized
tgagctaaagccatttgaggat

SEQ ID NO: 978574 - DNA, 22 bp, Artificial Sequence
  chemically synthesized
ccgtatctgttgatcctcaaat

SEQ ID NO: 978575 - DNA, 22 bp, Artificial Sequence
  chemically synthesized
gagctaaagccatttgaggatc

SEQ ID NO: 978576 - DNA, 22 bp, Artificial Sequence
  chemically synthesized
cccgtatctgttgatcctcaaa

SEQ ID NO: 978577 - DNA, 22 bp, Artificial Sequence
  chemically synthesized
agctaaagccatttgaggatca

SEQ ID NO: 978578 - DNA, 22 bp, Artificial Sequence
  chemically synthesized
aagccatttgaggatcaacaga

SEQ ID NO: 978579 - DNA, 22 bp, Artificial Sequence
  chemically synthesized
gaggatcaacagatacgggaag

SEQ ID NO: 978580 - DNA, 22 bp, Artificial Sequence
  chemically synthesized
aggatcaacagatacgggaagg

SEQ ID NO: 978581 - DNA, 22 bp, Artificial Sequence
  chemically synthesized
ggcagatagggggagtacagaa

SEQ ID NO: 978582 - DNA, 22 bp, Artificial Sequence
  chemically synthesized
aggcagatagggggagtacaga

SEQ ID NO: 978583 - DNA, 22 bp, Artificial Sequence
  chemically synthesized
taggcagatagggggagtacag

SEQ ID NO: 978584 - DNA, 22 bp, Artificial Sequence
  chemically synthesized
ttaggcagatagggggagtaca

SEQ ID NO: 978585 - DNA, 22 bp, Artificial Sequence
  chemically synthesized
cttttaggcagatagggggagt

SEQ ID NO: 978586 - DNA, 22 bp, Artificial Sequence
  chemically synthesized
gcttttaggcagatagggggag

SEQ ID NO: 978587 - DNA, 22 bp, Artificial Sequence
  chemically synthesized
tgcttttaggcagataggggga

SEQ ID NO: 978588 - DNA, 22 bp, Artificial Sequence
  chemically synthesized
tttctgtactccccctatctgc

SEQ ID NO: 978589 - DNA, 22 bp, Artificial Sequence
  chemically synthesized
ttctgtactccccctatctgcc

SEQ ID NO: 978590 - DNA, 22 bp, Artificial Sequence
  chemically synthesized
tctgtactccccctatctgcct

SEQ ID NO: 978591 - DNA, 22 bp, Artificial Sequence
  chemically synthesized
ctgtactccccctatctgccta

SEQ ID NO: 978592 - DNA, 22 bp, Artificial Sequence
  chemically synthesized
tgtactccccctatctgcctaa

SEQ ID NO: 978593 - DNA, 22 bp, Artificial Sequence
  chemically synthesized
tactccccctatctgcctaaaa

SEQ ID NO: 978594 - DNA, 22 bp, Artificial Sequence
  chemically synthesized
agaaatctttgcttttaggcag

SEQ ID NO: 978595 - DNA, 22 bp, Artificial Sequence
  chemically synthesized
cagaaatctttgcttttaggca

SEQ ID NO: 978596 - DNA, 22 bp, Artificial Sequence
  chemically synthesized
tttcagaaatctttgcttttag

SEQ ID NO: 978597 - DNA, 22 bp, Artificial Sequence
  chemically synthesized
cccctatctgcctaaaagcaaa

SEQ ID NO: 978598 - DNA, 22 bp, Artificial Sequence
  chemically synthesized
aattatttcagaaatctttgct

SEQ ID NO: 978599 - DNA, 22 bp, Artificial Sequence
  chemically synthesized
tctgcctaaaagcaaagatttc

SEQ ID NO: 978600 - DNA, 22 bp, Artificial Sequence
  chemically synthesized
cctaaaagcaaagatttctgaa

SEQ ID NO: 978601 - DNA, 22 bp, Artificial Sequence
  chemically synthesized
aaacagttgaattatttcagaa

SEQ ID NO: 978602 - DNA, 22 bp, Artificial Sequence
  chemically synthesized
aaagcaaagatttctgaaataa

SEQ ID NO: 978603 - DNA, 22 bp, Artificial Sequence
  chemically synthesized
aaaacagttgaattatttcaga

SEQ ID NO: 978604 - DNA, 22 bp, Artificial Sequence
  chemically synthesized
aaggaggatttaaaacagttga

SEQ ID NO: 978605 - DNA, 22 bp, Artificial Sequence
  chemically synthesized
aaaggaggatttaaaacagttg

SEQ ID NO: 978606 - DNA, 22 bp, Artificial Sequence
  chemically synthesized
ctgaaataattcaactgtttta

SEQ ID NO: 978607 - DNA, 22 bp, Artificial Sequence
  chemically synthesized
tgaaataattcaactgttttaa

SEQ ID NO: 978608 - DNA, 22 bp, Artificial Sequence
  chemically synthesized
cttaaaggaggatttaaaacag

SEQ ID NO: 978609 - DNA, 22 bp, Artificial Sequence
  chemically synthesized
aaataattcaactgttttaaat

SEQ ID NO: 978610 - DNA, 22 bp, Artificial Sequence
  chemically synthesized
ccttaaaggaggatttaaaaca

SEQ ID NO: 978611 - DNA, 22 bp, Artificial Sequence
  chemically synthesized
tccttaaaggaggatttaaaac

SEQ ID NO: 978612 - DNA, 22 bp, Artificial Sequence
  chemically synthesized
aactgttttaaatcctccttta

SEQ ID NO: 978613 - DNA, 22 bp, Artificial Sequence
  chemically synthesized
ttttaaatcctcctttaaggaa

SEQ ID NO: 978614 - DNA, 22 bp, Artificial Sequence
  chemically synthesized
gtgcaagaaactttccttaaag

SEQ ID NO: 978615 - DNA, 22 bp, Artificial Sequence
  chemically synthesized
taaatcctcctttaaggaaagt

SEQ ID NO: 978616 - DNA, 22 bp, Artificial Sequence
  chemically synthesized
aaatcctcctttaaggaaagtt

SEQ ID NO: 978617 - DNA, 22 bp, Artificial Sequence
  chemically synthesized
aatcctcctttaaggaaagttt

SEQ ID NO: 978618 - DNA, 22 bp, Artificial Sequence
  chemically synthesized
cccctggtgcaagaaactttcc

SEQ ID NO: 978619 - DNA, 22 bp, Artificial Sequence
  chemically synthesized
acccctggtgcaagaaactttc

SEQ ID NO: 978620 - DNA, 22 bp, Artificial Sequence
  chemically synthesized
tacccctggtgcaagaaacttt

SEQ ID NO: 978621 - DNA, 22 bp, Artificial Sequence
  chemically synthesized
tttacccctggtgcaagaaact

SEQ ID NO: 978622 - DNA, 22 bp, Artificial Sequence
  chemically synthesized
ctttaaggaaagtttcttgcac

SEQ ID NO: 978623 - DNA, 22 bp, Artificial Sequence
  chemically synthesized
taaggaaagtttcttgcaccag

SEQ ID NO: 978624 - DNA, 22 bp, Artificial Sequence
  chemically synthesized
aaggaaagtttcttgcaccagg

SEQ ID NO: 978625 - DNA, 22 bp, Artificial Sequence
  chemically synthesized
aggaaagtttcttgcaccaggg

SEQ ID NO: 978626 - DNA, 22 bp, Artificial Sequence
  chemically synthesized
gtgacaggagtcactctttacc

SEQ ID NO: 978627 - DNA, 22 bp, Artificial Sequence
  chemically synthesized
cttgcaccaggggtaaagagtg

SEQ ID NO: 978628 - DNA, 22 bp, Artificial Sequence
  chemically synthesized
ttgcaccaggggtaaagagtga

SEQ ID NO: 978629 - DNA, 22 bp, Artificial Sequence
  chemically synthesized
tggtgacaggagtcactcttta

SEQ ID NO: 978630 - DNA, 22 bp, Artificial Sequence
  chemically synthesized
gcaccaggggtaaagagtgact

SEQ ID NO: 978631 - DNA, 22 bp, Artificial Sequence
  chemically synthesized
caccaggggtaaagagtgactc

SEQ ID NO: 978632 - DNA, 22 bp, Artificial Sequence
  chemically synthesized
atctctggtgacaggagtcact

SEQ ID NO: 978633 - DNA, 22 bp, Artificial Sequence
  chemically synthesized
tcatctctggtgacaggagtca

SEQ ID NO: 978634 - DNA, 22 bp, Artificial Sequence
  chemically synthesized
ctcatctctggtgacaggagtc

SEQ ID NO: 978635 - DNA, 22 bp, Artificial Sequence
  chemically synthesized
ccagcgacaacttctcatctct

SEQ ID NO: 978636 - DNA, 22 bp, Artificial Sequence
  chemically synthesized
cccagcgacaacttctcatctc

SEQ ID NO: 978637 - DNA, 22 bp, Artificial Sequence
  chemically synthesized
tcccagcgacaacttctcatct

SEQ ID NO: 978638 - DNA, 22 bp, Artificial Sequence
  chemically synthesized
ttcccagcgacaacttctcatc

SEQ ID NO: 978639 - DNA, 22 bp, Artificial Sequence
  chemically synthesized
ctgtcaccagagatgagaagtt

SEQ ID NO: 978640 - DNA, 22 bp, Artificial Sequence
  chemically synthesized
ttttcccagcgacaacttctca

SEQ ID NO: 978641 - DNA, 22 bp, Artificial Sequence
  chemically synthesized
cttttcccagcgacaacttctc

SEQ ID NO: 978642 - DNA, 22 bp, Artificial Sequence
  chemically synthesized
tcaccagagatgagaagttgtc

SEQ ID NO: 978643 - DNA, 22 bp, Artificial Sequence
  chemically synthesized
tcttttcccagcgacaacttct

SEQ ID NO: 978644 - DNA, 22 bp, Artificial Sequence
  chemically synthesized
tgtaattttcttttcccagcga

SEQ ID NO: 978645 - DNA, 22 bp, Artificial Sequence
  chemically synthesized
atgtaattttcttttcccagcg

SEQ ID NO: 978646 - DNA, 22 bp, Artificial Sequence
  chemically synthesized
tttatgtaattttcttttccca

SEQ ID NO: 978647 - DNA, 22 bp, Artificial Sequence
  chemically synthesized
tcgctgggaaaagaaaattaca

SEQ ID NO: 978648 - DNA, 22 bp, Artificial Sequence
  chemically synthesized
gtaaagtctgtttatgtaattt

SEQ ID NO: 978649 - DNA, 22 bp, Artificial Sequence
  chemically synthesized
agtaaagtctgtttatgtaatt

SEQ ID NO: 978650 - DNA, 22 bp, Artificial Sequence
  chemically synthesized
tagtaaagtctgtttatgtaat

SEQ ID NO: 978651 - DNA, 22 bp, Artificial Sequence
  chemically synthesized
ggaaaagaaaattacataaaca

SEQ ID NO: 978652 - DNA, 22 bp, Artificial Sequence
  chemically synthesized
ttttagtaaagtctgtttatgt

SEQ ID NO: 978653 - DNA, 22 bp, Artificial Sequence
  chemically synthesized
gttttagtaaagtctgtttatg

SEQ ID NO: 978654 - DNA, 22 bp, Artificial Sequence
  chemically synthesized
cataaacagactttactaaaac

SEQ ID NO: 978655 - DNA, 22 bp, Artificial Sequence
  chemically synthesized
atgaaaggtaatgtttgtttta

SEQ ID NO: 978656 - DNA, 22 bp, Artificial Sequence
  chemically synthesized
tactaaaacaaacattaccttt

SEQ ID NO: 978657 - DNA, 22 bp, Artificial Sequence
  chemically synthesized
actaaaacaaacattacctttc

SEQ ID NO: 978658 - DNA, 22 bp, Artificial Sequence
  chemically synthesized
ctaaaacaaacattacctttca

SEQ ID NO: 978659 - DNA, 22 bp, Artificial Sequence
  chemically synthesized
aaacaaacattacctttcatta

SEQ ID NO: 978660 - DNA, 22 bp, Artificial Sequence
  chemically synthesized
gtgggaaatatgaaagaaacta

SEQ ID NO: 978661 - DNA, 22 bp, Artificial Sequence
  chemically synthesized
cctttcattagtttctttcata

SEQ ID NO: 978662 - DNA, 22 bp, Artificial Sequence
  chemically synthesized
tcattagtttctttcatatttc

SEQ ID NO: 978663 - DNA, 22 bp, Artificial Sequence
  chemically synthesized
cattagtttctttcatatttcc

SEQ ID NO: 978664 - DNA, 22 bp, Artificial Sequence
  chemically synthesized
attagtttctttcatatttccc

SEQ ID NO: 978665 - DNA, 22 bp, Artificial Sequence
  chemically synthesized
gtttctttcatatttcccacca

SEQ ID NO: 978666 - DNA, 22 bp, Artificial Sequence
  chemically synthesized
aagccacaaagttggtgggaaa

SEQ ID NO: 978667 - DNA, 22 bp, Artificial Sequence
  chemically synthesized
caagccacaaagttggtgggaa

SEQ ID NO: 978668 - DNA, 22 bp, Artificial Sequence
  chemically synthesized
ctttcatatttcccaccaactt

SEQ ID NO: 978669 - DNA, 22 bp, Artificial Sequence
  chemically synthesized
tttcatatttcccaccaacttt

SEQ ID NO: 978670 - DNA, 22 bp, Artificial Sequence
  chemically synthesized
tcatatttcccaccaactttgt

SEQ ID NO: 978671 - DNA, 22 bp, Artificial Sequence
  chemically synthesized
gaatttcaagccacaaagttgg

SEQ ID NO: 978672 - DNA, 22 bp, Artificial Sequence
  chemically synthesized
catatttcccaccaactttgtg

SEQ ID NO: 978673 - DNA, 22 bp, Artificial Sequence
  chemically synthesized
atatttcccaccaactttgtgg

SEQ ID NO: 978674 - DNA, 22 bp, Artificial Sequence
  chemically synthesized
cccaccaactttgtggcttgaa

SEQ ID NO: 978675 - DNA, 22 bp, Artificial Sequence
  chemically synthesized
ccaccaactttgtggcttgaaa

SEQ ID NO: 978676 - DNA, 22 bp, Artificial Sequence
  chemically synthesized
aaaagaagagtgttagaatttc

SEQ ID NO: 978677 - DNA, 22 bp, Artificial Sequence
  chemically synthesized
gaaaagaagagtgttagaattt

SEQ ID NO: 978678 - DNA, 22 bp, Artificial Sequence
  chemically synthesized
tgaaaagaagagtgttagaatt

SEQ ID NO: 978679 - DNA, 22 bp, Artificial Sequence
  chemically synthesized
tgtggcttgaaattctaacact

SEQ ID NO: 978680 - DNA, 22 bp, Artificial Sequence
  chemically synthesized
gtggcttgaaattctaacactc

SEQ ID NO: 978681 - DNA, 22 bp, Artificial Sequence
  chemically synthesized
tggcttgaaattctaacactct

SEQ ID NO: 978682 - DNA, 22 bp, Artificial Sequence
  chemically synthesized
gaaattctaacactcttctttt

SEQ ID NO: 978683 - DNA, 22 bp, Artificial Sequence
  chemically synthesized
acaagggttttgaaaagaagag

SEQ ID NO: 978684 - DNA, 22 bp, Artificial Sequence
  chemically synthesized
aaattctaacactcttcttttc

SEQ ID NO: 978685 - DNA, 22 bp, Artificial Sequence
  chemically synthesized
aacaagggttttgaaaagaaga

SEQ ID NO: 978686 - DNA, 22 bp, Artificial Sequence
  chemically synthesized
taacaagggttttgaaaagaag

SEQ ID NO: 978687 - DNA, 22 bp, Artificial Sequence
  chemically synthesized
ttttaacaagggttttgaaaag

SEQ ID NO: 978688 - DNA, 22 bp, Artificial Sequence
  chemically synthesized
taacactcttcttttcaaaacc

SEQ ID NO: 978689 - DNA, 22 bp, Artificial Sequence
  chemically synthesized
acactcttcttttcaaaaccct

SEQ ID NO: 978690 - DNA, 22 bp, Artificial Sequence
  chemically synthesized
tgtactattttaacaagggttt

SEQ ID NO: 978691 - DNA, 22 bp, Artificial Sequence
  chemically synthesized
atgtactattttaacaagggtt

SEQ ID NO: 978692 - DNA, 22 bp, Artificial Sequence
  chemically synthesized
ttcttttcaaaacccttgttaa

SEQ ID NO: 978693 - DNA, 22 bp, Artificial Sequence
  chemically synthesized
cttttcaaaacccttgttaaaa

SEQ ID NO: 978694 - DNA, 22 bp, Artificial Sequence
  chemically synthesized
ttttcaaaacccttgttaaaat

SEQ ID NO: 978695 - DNA, 22 bp, Artificial Sequence
  chemically synthesized
gggcttatgtactattttaaca

SEQ ID NO: 978696 - DNA, 22 bp, Artificial Sequence
  chemically synthesized
ttcaaaacccttgttaaaatag

SEQ ID NO: 978697 - DNA, 22 bp, Artificial Sequence
  chemically synthesized
ggggcttatgtactattttaac

SEQ ID NO: 978698 - DNA, 22 bp, Artificial Sequence
  chemically synthesized
tcaaaacccttgttaaaatagt

SEQ ID NO: 978699 - DNA, 22 bp, Artificial Sequence
  chemically synthesized
caaaacccttgttaaaatagta

SEQ ID NO: 978700 - DNA, 22 bp, Artificial Sequence
  chemically synthesized
aaaacccttgttaaaatagtac

SEQ ID NO: 978701 - DNA, 22 bp, Artificial Sequence
  chemically synthesized
gaatttggggcttatgtactat

SEQ ID NO: 978702 - DNA, 22 bp, Artificial Sequence
  chemically synthesized
gttaaaatagtacataagcccc

SEQ ID NO: 978703 - DNA, 22 bp, Artificial Sequence
  chemically synthesized
ttaaaatagtacataagcccca

SEQ ID NO: 978704 - DNA, 22 bp, Artificial Sequence
  chemically synthesized
aaatagtacataagccccaaat

SEQ ID NO: 978705 - DNA, 22 bp, Artificial Sequence
  chemically synthesized
aatgaagttagaatttggggct

SEQ ID NO: 978706 - DNA, 22 bp, Artificial Sequence
  chemically synthesized
acagaaaacatagctcaatgaa

SEQ ID NO: 978707 - DNA, 22 bp, Artificial Sequence
  chemically synthesized
taacttcattgagctatgtttt

SEQ ID NO: 978708 - DNA, 22 bp, Artificial Sequence
  chemically synthesized
acttcattgagctatgttttct

SEQ ID NO: 978709 - DNA, 22 bp, Artificial Sequence
  chemically synthesized
cattgagctatgttttctgtga

SEQ ID NO: 978710 - DNA, 22 bp, Artificial Sequence
  chemically synthesized
attgagctatgttttctgtgag

SEQ ID NO: 978711 - DNA, 22 bp, Artificial Sequence
  chemically synthesized
agctatgttttctgtgagctcc

SEQ ID NO: 978712 - DNA, 22 bp, Artificial Sequence
  chemically synthesized
agagaagtatgtgggagctcac

SEQ ID NO: 978713 - DNA, 22 bp, Artificial Sequence
  chemically synthesized
ttcagagaagtatgtgggagct

SEQ ID NO: 978714 - DNA, 22 bp, Artificial Sequence
  chemically synthesized
tgttttctgtgagctcccacat

SEQ ID NO: 978715 - DNA, 22 bp, Artificial Sequence
  chemically synthesized
attcagagaagtatgtgggagc

SEQ ID NO: 978716 - DNA, 22 bp, Artificial Sequence
  chemically synthesized
tctgtgagctcccacatacttc

SEQ ID NO: 978717 - DNA, 22 bp, Artificial Sequence
  chemically synthesized
ctgtgagctcccacatacttct

SEQ ID NO: 978718 - DNA, 22 bp, Artificial Sequence
  chemically synthesized
tgtgagctcccacatacttctc

SEQ ID NO: 978719 - DNA, 22 bp, Artificial Sequence
  chemically synthesized
tgagctcccacatacttctctg

SEQ ID NO: 978720 - DNA, 22 bp, Artificial Sequence
  chemically synthesized
ccacatacttctctgaataaac

SEQ ID NO: 978721 - DNA, 22 bp, Artificial Sequence
  chemically synthesized
gcaatagaaaagacaaagttta

SEQ ID NO: 978722 - DNA, 22 bp, Artificial Sequence
  chemically synthesized
ctctgaataaactttgtctttt

SEQ ID NO: 978723 - DNA, 22 bp, Artificial Sequence
  chemically synthesized
tctgaataaactttgtcttttc

SEQ ID NO: 978724 - DNA, 22 bp, Artificial Sequence
  chemically synthesized
tgaataaactttgtcttttcta

SEQ ID NO: 978725 - DNA, 22 bp, Artificial Sequence
  chemically synthesized
aataaactttgtcttttctatt

SEQ ID NO: 978726 - DNA, 22 bp, Artificial Sequence
  chemically synthesized
acgacagatagattggcaatag

SEQ ID NO: 978727 - DNA, 22 bp, Artificial Sequence
  chemically synthesized
tgtcttttctattgccaatcta

SEQ ID NO: 978728 - DNA, 22 bp, Artificial Sequence
  chemically synthesized
gtcttttctattgccaatctat

SEQ ID NO: 978729 - DNA, 22 bp, Artificial Sequence
  chemically synthesized
aactgacgacagatagattggc

SEQ ID NO: 978730 - DNA, 22 bp, Artificial Sequence
  chemically synthesized
tcttttctattgccaatctatc

SEQ ID NO: 978731 - DNA, 22 bp, Artificial Sequence
  chemically synthesized
ttctattgccaatctatctgtc

SEQ ID NO: 978732 - DNA, 22 bp, Artificial Sequence
  chemically synthesized
tctattgccaatctatctgtcg

SEQ ID NO: 978733 - DNA, 22 bp, Artificial Sequence
  chemically synthesized
ctattgccaatctatctgtcgt

SEQ ID NO: 978734 - DNA, 22 bp, Artificial Sequence
  chemically synthesized
caaattaaactgacgacagata

SEQ ID NO: 978735 - DNA, 22 bp, Artificial Sequence
  chemically synthesized
tattgccaatctatctgtcgtc

SEQ ID NO: 978736 - DNA, 22 bp, Artificial Sequence
  chemically synthesized
ttgccaatctatctgtcgtcag

SEQ ID NO: 978737 - DNA, 22 bp, Artificial Sequence
  chemically synthesized
ccaatctatctgtcgtcagttt

SEQ ID NO: 978738 - DNA, 22 bp, Artificial Sequence
  chemically synthesized
gggggctgcaaattaaactgac

SEQ ID NO: 978739 - DNA, 22 bp, Artificial Sequence
  chemically synthesized
ggggggctgcaaattaaactga

SEQ ID NO: 978740 - DNA, 22 bp, Artificial Sequence
  chemically synthesized
cttggggggctgcaaattaaac

SEQ ID NO: 978741 - DNA, 22 bp, Artificial Sequence
  chemically synthesized
tctgtcgtcagtttaatttgca

SEQ ID NO: 978742 - DNA, 22 bp, Artificial Sequence
  chemically synthesized
attacttggggggctgcaaatt

SEQ ID NO: 978743 - DNA, 22 bp, Artificial Sequence
  chemically synthesized
tcgtcagtttaatttgcagccc

SEQ ID NO: 978744 - DNA, 22 bp, Artificial Sequence
  chemically synthesized
ggttcattacttggggggctgc

SEQ ID NO: 978745 - DNA, 22 bp, Artificial Sequence
  chemically synthesized
aggttcattacttggggggctg

SEQ ID NO: 978746 - DNA, 22 bp, Artificial Sequence
  chemically synthesized
ttaggttcattacttggggggc

SEQ ID NO: 978747 - DNA, 22 bp, Artificial Sequence
  chemically synthesized
aatttgcagccccccaagtaat

SEQ ID NO: 978748 - DNA, 22 bp, Artificial Sequence
  chemically synthesized
atttgcagccccccaagtaatg

SEQ ID NO: 978749 - DNA, 22 bp, Artificial Sequence
  chemically synthesized
ccctcttaggttcattacttgg

SEQ ID NO: 978750 - DNA, 22 bp, Artificial Sequence
  chemically synthesized
gcagccccccaagtaatgaacc

SEQ ID NO: 978751 - DNA, 22 bp, Artificial Sequence
  chemically synthesized
actcccctcttaggttcattac

SEQ ID NO: 978752 - DNA, 22 bp, Artificial Sequence
  chemically synthesized
cagccccccaagtaatgaacct

SEQ ID NO: 978753 - DNA, 22 bp, Artificial Sequence
  chemically synthesized
cactcccctcttaggttcatta

SEQ ID NO: 978754 - DNA, 22 bp, Artificial Sequence
  chemically synthesized
tcactcccctcttaggttcatt

SEQ ID NO: 978755 - DNA, 22 bp, Artificial Sequence
  chemically synthesized
ttcactcccctcttaggttcat

SEQ ID NO: 978756 - DNA, 22 bp, Artificial Sequence
  chemically synthesized
tttcactcccctcttaggttca

SEQ ID NO: 978757 - DNA, 22 bp, Artificial Sequence
  chemically synthesized
tcagggaagaaaaactttttca

SEQ ID NO: 978758 - DNA, 22 bp, Artificial Sequence
  chemically synthesized
agaggggagtgaaaaagttttt

SEQ ID NO: 978759 - DNA, 22 bp, Artificial Sequence
  chemically synthesized
tgttgtcagggaagaaaaactt

SEQ ID NO: 978760 - DNA, 22 bp, Artificial Sequence
  chemically synthesized
gtgttgtcagggaagaaaaact

SEQ ID NO: 978761 - DNA, 22 bp, Artificial Sequence
  chemically synthesized
atgtgtccatttgtgttgtcag

SEQ ID NO: 978762 - DNA, 22 bp, Artificial Sequence
  chemically synthesized
ttgatgtgtccatttgtgttgt

SEQ ID NO: 978763 - DNA, 22 bp, Artificial Sequence
  chemically synthesized
attgatgtgtccatttgtgttg

SEQ ID NO: 978764 - DNA, 22 bp, Artificial Sequence
  chemically synthesized
ttcttccctgacaacacaaatg

SEQ ID NO: 978765 - DNA, 22 bp, Artificial Sequence
  chemically synthesized
tcttccctgacaacacaaatgg

SEQ ID NO: 978766 - DNA, 22 bp, Artificial Sequence
  chemically synthesized
cttccctgacaacacaaatgga

SEQ ID NO: 978767 - DNA, 22 bp, Artificial Sequence
  chemically synthesized
ttccctgacaacacaaatggac

SEQ ID NO: 978768 - DNA, 22 bp, Artificial Sequence
  chemically synthesized
ccctgacaacacaaatggacac

SEQ ID NO: 978769 - DNA, 22 bp, Artificial Sequence
  chemically synthesized
cctgacaacacaaatggacaca

SEQ ID NO: 978770 - DNA, 22 bp, Artificial Sequence
  chemically synthesized
tccatttattgatgtgtccatt

SEQ ID NO: 978771 - DNA, 22 bp, Artificial Sequence
  chemically synthesized
acaacacaaatggacacatcaa

SEQ ID NO: 978772 - DNA, 22 bp, Artificial Sequence
  chemically synthesized
aagctatccatttattgatgtg

SEQ ID NO: 978773 - DNA, 22 bp, Artificial Sequence
  chemically synthesized
ctcaagctatccatttattgat

SEQ ID NO: 978774 - DNA, 22 bp, Artificial Sequence
  chemically synthesized
actcaagctatccatttattga

SEQ ID NO: 978775 - DNA, 22 bp, Artificial Sequence
  chemically synthesized
gaaacatgaggaaatttactca

SEQ ID NO: 978776 - DNA, 22 bp, Artificial Sequence
  chemically synthesized
agaaacatgaggaaatttactc

SEQ ID NO: 978777 - DNA, 22 bp, Artificial Sequence
  chemically synthesized
gagtaaatttcctcatgtttct

SEQ ID NO: 978778 - DNA, 22 bp, Artificial Sequence
  chemically synthesized
agtaaatttcctcatgtttcta

SEQ ID NO: 978779 - DNA, 22 bp, Artificial Sequence
  chemically synthesized
cctcatgtttctaagcctcact

SEQ ID NO: 978780 - DNA, 22 bp, Artificial Sequence
  chemically synthesized
ctcatgtttctaagcctcactc

SEQ ID NO: 978781 - DNA, 22 bp, Artificial Sequence
  chemically synthesized
atgtttctaagcctcactccat

SEQ ID NO: 978782 - DNA, 22 bp, Artificial Sequence
  chemically synthesized
tgatcaataaaaatgtaatgga

SEQ ID NO: 978783 - DNA, 22 bp, Artificial Sequence
  chemically synthesized
ctaagcctcactccattacatt

SEQ ID NO: 978784 - DNA, 22 bp, Artificial Sequence
  chemically synthesized
taagcctcactccattacattt

SEQ ID NO: 978785 - DNA, 22 bp, Artificial Sequence
  chemically synthesized
agcctcactccattacattttt

SEQ ID NO: 978786 - DNA, 22 bp, Artificial Sequence
  chemically synthesized
gtgctgtgatcaataaaaatgt

SEQ ID NO: 978787 - DNA, 22 bp, Artificial Sequence
  chemically synthesized
actccattacatttttattgat

SEQ ID NO: 978788 - DNA, 22 bp, Artificial Sequence
  chemically synthesized
gcactggtgctgtgatcaataa

SEQ ID NO: 978789 - DNA, 22 bp, Artificial Sequence
  chemically synthesized
cattacatttttattgatcaca

SEQ ID NO: 978790 - DNA, 22 bp, Artificial Sequence
  chemically synthesized
catttttattgatcacagcacc

SEQ ID NO: 978791 - DNA, 22 bp, Artificial Sequence
  chemically synthesized
tcgtctggcactggtgctgtga

SEQ ID NO: 978792 - DNA, 22 bp, Artificial Sequence
  chemically synthesized
gtcgtctggcactggtgctgtg

SEQ ID NO: 978793 - DNA, 22 bp, Artificial Sequence
  chemically synthesized
ttattgatcacagcaccagtgc

SEQ ID NO: 978794 - DNA, 22 bp, Artificial Sequence
  chemically synthesized
tattgatcacagcaccagtgcc

SEQ ID NO: 978795 - DNA, 22 bp, Artificial Sequence
  chemically synthesized
attgatcacagcaccagtgcca

SEQ ID NO: 978796 - DNA, 22 bp, Artificial Sequence
  chemically synthesized
ccatttgtcgtctggcactggt

SEQ ID NO: 978797 - DNA, 22 bp, Artificial Sequence
  chemically synthesized
ttgatcacagcaccagtgccag

SEQ ID NO: 978798 - DNA, 22 bp, Artificial Sequence
  chemically synthesized
atcacagcaccagtgccagacg

SEQ ID NO: 978799 - DNA, 22 bp, Artificial Sequence
  chemically synthesized
agaattcccatttgtcgtctgg

SEQ ID NO: 978800 - DNA, 22 bp, Artificial Sequence
  chemically synthesized
aagaattcccatttgtcgtctg

SEQ ID NO: 978801 - DNA, 22 bp, Artificial Sequence
  chemically synthesized
ttaagaattcccatttgtcgtc

SEQ ID NO: 978802 - DNA, 22 bp, Artificial Sequence
  chemically synthesized
tcttaagaattcccatttgtcg

SEQ ID NO: 978803 - DNA, 22 bp, Artificial Sequence
  chemically synthesized
ctcttaagaattcccatttgtc

SEQ ID NO: 978804 - DNA, 22 bp, Artificial Sequence
  chemically synthesized
tctcttaagaattcccatttgt

SEQ ID NO: 978805 - DNA, 22 bp, Artificial Sequence
  chemically synthesized
atgccctttctcttaagaattc

SEQ ID NO: 978806 - DNA, 22 bp, Artificial Sequence
  chemically synthesized
taatgccctttctcttaagaat

SEQ ID NO: 978807 - DNA, 22 bp, Artificial Sequence
  chemically synthesized
ctaatgccctttctcttaagaa

SEQ ID NO: 978808 - DNA, 22 bp, Artificial Sequence
  chemically synthesized
acacttctaatgccctttctct

SEQ ID NO: 978809 - DNA, 22 bp, Artificial Sequence
  chemically synthesized
aacacttctaatgccctttctc

SEQ ID NO: 978810 - DNA, 22 bp, Artificial Sequence
  chemically synthesized
taacacttctaatgccctttct

SEQ ID NO: 978811 - DNA, 22 bp, Artificial Sequence
  chemically synthesized
ttaacacttctaatgccctttc

SEQ ID NO: 978812 - DNA, 22 bp, Artificial Sequence
  chemically synthesized
ccttttaacacttctaatgccc

SEQ ID NO: 978813 - DNA, 22 bp, Artificial Sequence
  chemically synthesized
ttaagagaaagggcattagaag

SEQ ID NO: 978814 - DNA, 22 bp, Artificial Sequence
  chemically synthesized
aagagaaagggcattagaagtg

SEQ ID NO: 978815 - DNA, 22 bp, Artificial Sequence
  chemically synthesized
agagaaagggcattagaagtgt

SEQ ID NO: 978816 - DNA, 22 bp, Artificial Sequence
  chemically synthesized
tggttgccttttaacacttcta

SEQ ID NO: 978817 - DNA, 22 bp, Artificial Sequence
  chemically synthesized
tgtggttgccttttaacacttc

SEQ ID NO: 978818 - DNA, 22 bp, Artificial Sequence
  chemically synthesized
tctgtggttgccttttaacact

SEQ ID NO: 978819 - DNA, 22 bp, Artificial Sequence
  chemically synthesized
gaagtgttaaaaggcaaccaca

SEQ ID NO: 978820 - DNA, 22 bp, Artificial Sequence
  chemically synthesized
catgtgacagctctctgtggtt

SEQ ID NO: 978821 - DNA, 22 bp, Artificial Sequence
  chemically synthesized
tccatgtgacagctctctgtgg

SEQ ID NO: 978822 - DNA, 22 bp, Artificial Sequence
  chemically synthesized
ctccatgtgacagctctctgtg

SEQ ID NO: 978823 - DNA, 22 bp, Artificial Sequence
  chemically synthesized
aaaggcaaccacagagagctgt

SEQ ID NO: 978824 - DNA, 22 bp, Artificial Sequence
  chemically synthesized
tcacatggagaaatggtccatg

SEQ ID NO: 978825 - DNA, 22 bp, Artificial Sequence
  chemically synthesized
ggagtgagatcaaatgaagatg

SEQ ID NO: 978826 - DNA, 22 bp, Artificial Sequence
  chemically synthesized
ccaactaggagtgagatcaaat

SEQ ID NO: 978827 - DNA, 22 bp, Artificial Sequence
  chemically synthesized
atgactcccaactaggagtgag

SEQ ID NO: 978828 - DNA, 22 bp, Artificial Sequence
  chemically synthesized
tgatgactcccaactaggagtg

SEQ ID NO: 978829 - DNA, 22 bp, Artificial Sequence
  chemically synthesized
catttgatctcactcctagttg

SEQ ID NO: 978830 - DNA, 22 bp, Artificial Sequence
  chemically synthesized
atttgatctcactcctagttgg

SEQ ID NO: 978831 - DNA, 22 bp, Artificial Sequence
  chemically synthesized
gatctcactcctagttgggagt

SEQ ID NO: 978832 - DNA, 22 bp, Artificial Sequence
  chemically synthesized
cccattctgatgactcccaact

SEQ ID NO: 978833 - DNA, 22 bp, Artificial Sequence
  chemically synthesized
atctcactcctagttgggagtc

SEQ ID NO: 978834 - DNA, 22 bp, Artificial Sequence
  chemically synthesized
cgttccccattctgatgactcc

SEQ ID NO: 978835 - DNA, 22 bp, Artificial Sequence
  chemically synthesized
actcctagttgggagtcatcag

SEQ ID NO: 978836 - DNA, 22 bp, Artificial Sequence
  chemically synthesized
ctagttgggagtcatcagaatg

SEQ ID NO: 978837 - DNA, 22 bp, Artificial Sequence
  chemically synthesized
gttgggagtcatcagaatgggg

SEQ ID NO: 978838 - DNA, 22 bp, Artificial Sequence
  chemically synthesized
aaagatatctccgttccccatt

SEQ ID NO: 978839 - DNA, 22 bp, Artificial Sequence
  chemically synthesized
ggagtcatcagaatggggaacg

SEQ ID NO: 978840 - DNA, 22 bp, Artificial Sequence
  chemically synthesized
ctgaaagatatctccgttcccc

SEQ ID NO: 978841 - DNA, 22 bp, Artificial Sequence
  chemically synthesized
gctgaaagatatctccgttccc

SEQ ID NO: 978842 - DNA, 22 bp, Artificial Sequence
  chemically synthesized
cttgctgaaagatatctccgtt

SEQ ID NO: 978843 - DNA, 22 bp, Artificial Sequence
  chemically synthesized
ggacctccttgctgaaagatat

SEQ ID NO: 978844 - DNA, 22 bp, Artificial Sequence
  chemically synthesized
atcatatcactgggacctcctt

SEQ ID NO: 978845 - DNA, 22 bp, Artificial Sequence
  chemically synthesized
ttaatcatatcactgggacctc

SEQ ID NO: 978846 - DNA, 22 bp, Artificial Sequence
  chemically synthesized
attaatcatatcactgggacct

SEQ ID NO: 978847 - DNA, 22 bp, Artificial Sequence
  chemically synthesized
tattaatcatatcactgggacc

SEQ ID NO: 978848 - DNA, 22 bp, Artificial Sequence
  chemically synthesized
ttattaatcatatcactgggac

SEQ ID NO: 978849 - DNA, 22 bp, Artificial Sequence
  chemically synthesized
tcagcaaggaggtcccagtgat

SEQ ID NO: 978850 - DNA, 22 bp, Artificial Sequence
  chemically synthesized
cagcaaggaggtcccagtgata

SEQ ID NO: 978851 - DNA, 22 bp, Artificial Sequence
  chemically synthesized
agcaaggaggtcccagtgatat

SEQ ID NO: 978852 - DNA, 22 bp, Artificial Sequence
  chemically synthesized
acatatttttattaatcatatc

SEQ ID NO: 978853 - DNA, 22 bp, Artificial Sequence
  chemically synthesized
gacatatttttattaatcatat

SEQ ID NO: 978854 - DNA, 22 bp, Artificial Sequence
  chemically synthesized
tgacatatttttattaatcata

SEQ ID NO: 978855 - DNA, 22 bp, Artificial Sequence
  chemically synthesized
ttgacatatttttattaatcat

SEQ ID NO: 978856 - DNA, 22 bp, Artificial Sequence
  chemically synthesized
atgtgtcttttgacatattttt

SEQ ID NO: 978857 - DNA, 22 bp, Artificial Sequence
  chemically synthesized
tcatgtgtcttttgacatattt

SEQ ID NO: 978858 - DNA, 22 bp, Artificial Sequence
  chemically synthesized
ttctcatgtgtcttttgacata

SEQ ID NO: 978859 - DNA, 22 bp, Artificial Sequence
  chemically synthesized
tattctcatgtgtcttttgaca

SEQ ID NO: 978860 - DNA, 22 bp, Artificial Sequence
  chemically synthesized
ctattctcatgtgtcttttgac

SEQ ID NO: 978861 - DNA, 22 bp, Artificial Sequence
  chemically synthesized
ataaaaatatgtcaaaagacac

SEQ ID NO: 978862 - DNA, 22 bp, Artificial Sequence
  chemically synthesized
tatcaaatgaacttctattctc

SEQ ID NO: 978863 - DNA, 22 bp, Artificial Sequence
  chemically synthesized
gtatcaaatgaacttctattct

SEQ ID NO: 978864 - DNA, 22 bp, Artificial Sequence
  chemically synthesized
cttgtatcaaatgaacttctat

SEQ ID NO: 978865 - DNA, 22 bp, Artificial Sequence
  chemically synthesized
gcttgtatcaaatgaacttcta

SEQ ID NO: 978866 - DNA, 22 bp, Artificial Sequence
  chemically synthesized
tgcttgtatcaaatgaacttct

SEQ ID NO: 978867 - DNA, 22 bp, Artificial Sequence
  chemically synthesized
atttgatacaagcaaaggttat

SEQ ID NO: 978868 - DNA, 22 bp, Artificial Sequence
  chemically synthesized
gtagaataaacaataacctttg

SEQ ID NO: 978869 - DNA, 22 bp, Artificial Sequence
  chemically synthesized
gatacaagcaaaggttattgtt

SEQ ID NO: 978870 - DNA, 22 bp, Artificial Sequence
  chemically synthesized
atacaagcaaaggttattgttt

SEQ ID NO: 978871 - DNA, 22 bp, Artificial Sequence
  chemically synthesized
tggaaccgtattagtagaataa

SEQ ID NO: 978872 - DNA, 22 bp, Artificial Sequence
  chemically synthesized
tgtggaaccgtattagtagaat

SEQ ID NO: 978873 - DNA, 22 bp, Artificial Sequence
  chemically synthesized
gattctgtggaaccgtattagt

SEQ ID NO: 978874 - DNA, 22 bp, Artificial Sequence
  chemically synthesized
ttgtttattctactaatacggt

SEQ ID NO: 978875 - DNA, 22 bp, Artificial Sequence
  chemically synthesized
tttattctactaatacggttcc

SEQ ID NO: 978876 - DNA, 22 bp, Artificial Sequence
  chemically synthesized
attctactaatacggttccaca

SEQ ID NO: 978877 - DNA, 22 bp, Artificial Sequence
  chemically synthesized
ggacctggattctgtggaaccg

SEQ ID NO: 978878 - DNA, 22 bp, Artificial Sequence
  chemically synthesized
ttctactaatacggttccacag

SEQ ID NO: 978879 - DNA, 22 bp, Artificial Sequence
  chemically synthesized
ctgggacctggattctgtggaa

SEQ ID NO: 978880 - DNA, 22 bp, Artificial Sequence
  chemically synthesized
tactaatacggttccacagaat

SEQ ID NO: 978881 - DNA, 22 bp, Artificial Sequence
  chemically synthesized
ctaatacggttccacagaatcc

SEQ ID NO: 978882 - DNA, 22 bp, Artificial Sequence
  chemically synthesized
atacggttccacagaatccagg

SEQ ID NO: 978883 - DNA, 22 bp, Artificial Sequence
  chemically synthesized
agagggggcactgctgggacct

SEQ ID NO: 978884 - DNA, 22 bp, Artificial Sequence
  chemically synthesized
cacagaatccaggtcccagcag

SEQ ID NO: 978885 - DNA, 22 bp, Artificial Sequence
  chemically synthesized
taagagggggcactgctgggac

SEQ ID NO: 978886 - DNA, 22 bp, Artificial Sequence
  chemically synthesized
ctaagagggggcactgctggga

SEQ ID NO: 978887 - DNA, 22 bp, Artificial Sequence
  chemically synthesized
tccttctaagagggggcactgc

SEQ ID NO: 978888 - DNA, 22 bp, Artificial Sequence
  chemically synthesized
gtccttctaagagggggcactg

SEQ ID NO: 978889 - DNA, 22 bp, Artificial Sequence
  chemically synthesized
gggaggcttgtccttctaagag

SEQ ID NO: 978890 - DNA, 22 bp, Artificial Sequence
  chemically synthesized
aaaactagggaggcttgtcctt

SEQ ID NO: 978891 - DNA, 22 bp, Artificial Sequence
  chemically synthesized
gaaaactagggaggcttgtcct

SEQ ID NO: 978892 - DNA, 22 bp, Artificial Sequence
  chemically synthesized
ttagaaggacaagcctccctag

SEQ ID NO: 978893 - DNA, 22 bp, Artificial Sequence
  chemically synthesized
agaaggacaagcctccctagtt

SEQ ID NO: 978894 - DNA, 22 bp, Artificial Sequence
  chemically synthesized
tgaagacttgaaaactagggag

SEQ ID NO: 978895 - DNA, 22 bp, Artificial Sequence
  chemically synthesized
gaaggacaagcctccctagttt

SEQ ID NO: 978896 - DNA, 22 bp, Artificial Sequence
  chemically synthesized
gtgaagacttgaaaactaggga

SEQ ID NO: 978897 - DNA, 22 bp, Artificial Sequence
  chemically synthesized
gccacatttgtgaagacttgaa

SEQ ID NO: 978898 - DNA, 22 bp, Artificial Sequence
  chemically synthesized
cctagttttcaagtcttcacaa

SEQ ID NO: 978899 - DNA, 22 bp, Artificial Sequence
  chemically synthesized
tcagctagccacatttgtgaag

SEQ ID NO: 978900 - DNA, 22 bp, Artificial Sequence
  chemically synthesized
gtcagctagccacatttgtgaa

SEQ ID NO: 978901 - DNA, 22 bp, Artificial Sequence
  chemically synthesized
gttttcaagtcttcacaaatgt

SEQ ID NO: 978902 - DNA, 22 bp, Artificial Sequence
  chemically synthesized
tgtcagctagccacatttgtga

SEQ ID NO: 978903 - DNA, 22 bp, Artificial Sequence
  chemically synthesized
tcaagtcttcacaaatgtggct

SEQ ID NO: 978904 - DNA, 22 bp, Artificial Sequence
  chemically synthesized
caagtcttcacaaatgtggcta

SEQ ID NO: 978905 - DNA, 22 bp, Artificial Sequence
  chemically synthesized
aagtcttcacaaatgtggctag

SEQ ID NO: 978906 - DNA, 22 bp, Artificial Sequence
  chemically synthesized
cacaaatgtggctagctgacaa

SEQ ID NO: 978907 - DNA, 22 bp, Artificial Sequence
  chemically synthesized
acaaatgtggctagctgacaaa

SEQ ID NO: 978908 - DNA, 22 bp, Artificial Sequence
  chemically synthesized
atcagatggtattttgtcagct

SEQ ID NO: 978909 - DNA, 22 bp, Artificial Sequence
  chemically synthesized
gatcagatggtattttgtcagc

SEQ ID NO: 978910 - DNA, 22 bp, Artificial Sequence
  chemically synthesized
tgacttgatcagatggtatttt

SEQ ID NO: 978911 - DNA, 22 bp, Artificial Sequence
  chemically synthesized
gctgacaaaataccatctgatc

SEQ ID NO: 978912 - DNA, 22 bp, Artificial Sequence
  chemically synthesized
agaagattatgacttgatcaga

SEQ ID NO: 978913 - DNA, 22 bp, Artificial Sequence
  chemically synthesized
acaaaataccatctgatcaagt

SEQ ID NO: 978914 - DNA, 22 bp, Artificial Sequence
  chemically synthesized
tgaaggatctgagaagattatg

SEQ ID NO: 978915 - DNA, 22 bp, Artificial Sequence
  chemically synthesized
atgaaggatctgagaagattat

SEQ ID NO: 978916 - DNA, 22 bp, Artificial Sequence
  chemically synthesized
atcaagtcataatcttctcaga

SEQ ID NO: 978917 - DNA, 22 bp, Artificial Sequence
  chemically synthesized
ctcagatccttcataaatcttc

SEQ ID NO: 978918 - DNA, 22 bp, Artificial Sequence
  chemically synthesized
tcagatccttcataaatcttct

SEQ ID NO: 978919 - DNA, 22 bp, Artificial Sequence
  chemically synthesized
agatccttcataaatcttctta

SEQ ID NO: 978920 - DNA, 22 bp, Artificial Sequence
  chemically synthesized
aaaacatgagcatggcagtaag

SEQ ID NO: 978921 - DNA, 22 bp, Artificial Sequence
  chemically synthesized
cataaatcttcttactgccatg

SEQ ID NO: 978922 - DNA, 22 bp, Artificial Sequence
  chemically synthesized
ataaatcttcttactgccatgc

SEQ ID NO: 978923 - DNA, 22 bp, Artificial Sequence
  chemically synthesized
gaaggggttaaaaacatgagca

SEQ ID NO: 978924 - DNA, 22 bp, Artificial Sequence
  chemically synthesized
cttactgccatgctcatgtttt

SEQ ID NO: 978925 - DNA, 22 bp, Artificial Sequence
  chemically synthesized
ttactgccatgctcatgttttt

SEQ ID NO: 978926 - DNA, 22 bp, Artificial Sequence
  chemically synthesized
actgccatgctcatgtttttaa

SEQ ID NO: 978927 - DNA, 22 bp, Artificial Sequence
  chemically synthesized
ctgccatgctcatgtttttaac

SEQ ID NO: 978928 - DNA, 22 bp, Artificial Sequence
  chemically synthesized
ccatgctcatgtttttaacccc

SEQ ID NO: 978929 - DNA, 22 bp, Artificial Sequence
  chemically synthesized
gaagaggttggaaggggttaaa

SEQ ID NO: 978930 - DNA, 22 bp, Artificial Sequence
  chemically synthesized
atgtttttaaccccttccaacc

SEQ ID NO: 978931 - DNA, 22 bp, Artificial Sequence
  chemically synthesized
atgtcagctcgaagaggttgga

SEQ ID NO: 978932 - DNA, 22 bp, Artificial Sequence
  chemically synthesized
aatgtcagctcgaagaggttgg

SEQ ID NO: 978933 - DNA, 22 bp, Artificial Sequence
  chemically synthesized
ttaaccccttccaacctcttcg

SEQ ID NO: 978934 - DNA, 22 bp, Artificial Sequence
  chemically synthesized
taaccccttccaacctcttcga

SEQ ID NO: 978935 - DNA, 22 bp, Artificial Sequence
  chemically synthesized
cttaatgtcagctcgaagaggt

SEQ ID NO: 978936 - DNA, 22 bp, Artificial Sequence
  chemically synthesized
aaccccttccaacctcttcgag

SEQ ID NO: 978937 - DNA, 22 bp, Artificial Sequence
  chemically synthesized
accccttccaacctcttcgagc

SEQ ID NO: 978938 - DNA, 22 bp, Artificial Sequence
  chemically synthesized
ccaacctcttcgagctgacatt

SEQ ID NO: 978939 - DNA, 22 bp, Artificial Sequence
  chemically synthesized
caacctcttcgagctgacatta

SEQ ID NO: 978940 - DNA, 22 bp, Artificial Sequence
  chemically synthesized
aaagaagctacttaatgtcagc

SEQ ID NO: 978941 - DNA, 22 bp, Artificial Sequence
  chemically synthesized
aaaagaagctacttaatgtcag

SEQ ID NO: 978942 - DNA, 22 bp, Artificial Sequence
  chemically synthesized
taaaagaagctacttaatgtca

SEQ ID NO: 978943 - DNA, 22 bp, Artificial Sequence
  chemically synthesized
ttaaaagaagctacttaatgtc

SEQ ID NO: 978944 - DNA, 22 bp, Artificial Sequence
  chemically synthesized
ttcgagctgacattaagtagct

SEQ ID NO: 978945 - DNA, 22 bp, Artificial Sequence
  chemically synthesized
gtttttaaaagaagctacttaa

SEQ ID NO: 978946 - DNA, 22 bp, Artificial Sequence
  chemically synthesized
cgagctgacattaagtagcttc

SEQ ID NO: 978947 - DNA, 22 bp, Artificial Sequence
  chemically synthesized
gagctgacattaagtagcttct

SEQ ID NO: 978948 - DNA, 22 bp, Artificial Sequence
  chemically synthesized
ctggtttttaaaagaagctact

SEQ ID NO: 978949 - DNA, 22 bp, Artificial Sequence
  chemically synthesized
tgctggtttttaaaagaagcta

SEQ ID NO: 978950 - DNA, 22 bp, Artificial Sequence
  chemically synthesized
ctgctggtttttaaaagaagct

SEQ ID NO: 978951 - DNA, 22 bp, Artificial Sequence
  chemically synthesized
acattaagtagcttcttttaaa

SEQ ID NO: 978952 - DNA, 22 bp, Artificial Sequence
  chemically synthesized
agtagcttcttttaaaaaccag

SEQ ID NO: 978953 - DNA, 22 bp, Artificial Sequence
  chemically synthesized
atgaaccttctgctggttttta

SEQ ID NO: 978954 - DNA, 22 bp, Artificial Sequence
  chemically synthesized
cttttaaaaaccagcagaaggt

SEQ ID NO: 978955 - DNA, 22 bp, Artificial Sequence
  chemically synthesized
ttttaaaaaccagcagaaggtt

SEQ ID NO: 978956 - DNA, 22 bp, Artificial Sequence
  chemically synthesized
ttaaaaaccagcagaaggttca

SEQ ID NO: 978957 - DNA, 22 bp, Artificial Sequence
  chemically synthesized
taaaaaccagcagaaggttcat

SEQ ID NO: 978958 - DNA, 22 bp, Artificial Sequence
  chemically synthesized
ccatatgcattcatgaaccttc

SEQ ID NO: 978959 - DNA, 22 bp, Artificial Sequence
  chemically synthesized
aaaaaccagcagaaggttcatg

SEQ ID NO: 978960 - DNA, 22 bp, Artificial Sequence
  chemically synthesized
aaaaccagcagaaggttcatga

SEQ ID NO: 978961 - DNA, 22 bp, Artificial Sequence
  chemically synthesized
tcccatatgcattcatgaacct

SEQ ID NO: 978962 - DNA, 22 bp, Artificial Sequence
  chemically synthesized
ctcccatatgcattcatgaacc

SEQ ID NO: 978963 - DNA, 22 bp, Artificial Sequence
  chemically synthesized
ttctcccatatgcattcatgaa

SEQ ID NO: 978964 - DNA, 22 bp, Artificial Sequence
  chemically synthesized
actcttctcccatatgcattca

SEQ ID NO: 978965 - DNA, 22 bp, Artificial Sequence
  chemically synthesized
aaattcactcttctcccatatg

SEQ ID NO: 978966 - DNA, 22 bp, Artificial Sequence
  chemically synthesized
atgaatgcatatgggagaagag

SEQ ID NO: 978967 - DNA, 22 bp, Artificial Sequence
  chemically synthesized
acctaaaattcactcttctccc

SEQ ID NO: 978968 - DNA, 22 bp, Artificial Sequence
  chemically synthesized
gacctaaaattcactcttctcc

SEQ ID NO: 978969 - DNA, 22 bp, Artificial Sequence
  chemically synthesized
ggaatttgacctaaaattcact

SEQ ID NO: 978970 - DNA, 22 bp, Artificial Sequence
  chemically synthesized
aatcatagcctgggaatttgac

SEQ ID NO: 978971 - DNA, 22 bp, Artificial Sequence
  chemically synthesized
taggtcaaattcccaggctatg

SEQ ID NO: 978972 - DNA, 22 bp, Artificial Sequence
  chemically synthesized
aggtcaaattcccaggctatga

SEQ ID NO: 978973 - DNA, 22 bp, Artificial Sequence
  chemically synthesized
ggtcaaattcccaggctatgat

SEQ ID NO: 978974 - DNA, 22 bp, Artificial Sequence
  chemically synthesized
cgacaaggttaaatcatagcct

SEQ ID NO: 978975 - DNA, 22 bp, Artificial Sequence
  chemically synthesized
ccaggctatgatttaaccttgt

SEQ ID NO: 978976 - DNA, 22 bp, Artificial Sequence
  chemically synthesized
ggagagtacaaattgcgacaag

SEQ ID NO: 978977 - DNA, 22 bp, Artificial Sequence
  chemically synthesized
gggagagtacaaattgcgacaa

SEQ ID NO: 978978 - DNA, 22 bp, Artificial Sequence
  chemically synthesized
tgatttaaccttgtcgcaattt

SEQ ID NO: 978979 - DNA, 22 bp, Artificial Sequence
  chemically synthesized
atttgggagagtacaaattgcg

SEQ ID NO: 978980 - DNA, 22 bp, Artificial Sequence
  chemically synthesized
tgatttgggagagtacaaattg

SEQ ID NO: 978981 - DNA, 22 bp, Artificial Sequence
  chemically synthesized
aaccttgtcgcaatttgtactc

SEQ ID NO: 978982 - DNA, 22 bp, Artificial Sequence
  chemically synthesized
tctgatttgggagagtacaaat

SEQ ID NO: 978983 - DNA, 22 bp, Artificial Sequence
  chemically synthesized
accttgtcgcaatttgtactct

SEQ ID NO: 978984 - DNA, 22 bp, Artificial Sequence
  chemically synthesized
ctctctgatttgggagagtaca

SEQ ID NO: 978985 - DNA, 22 bp, Artificial Sequence
  chemically synthesized
cctctctgatttgggagagtac

SEQ ID NO: 978986 - DNA, 22 bp, Artificial Sequence
  chemically synthesized
gtcgcaatttgtactctcccaa

SEQ ID NO: 978987 - DNA, 22 bp, Artificial Sequence
  chemically synthesized
tcgcaatttgtactctcccaaa

SEQ ID NO: 978988 - DNA, 22 bp, Artificial Sequence
  chemically synthesized
taggcaggcttcctctctgatt

SEQ ID NO: 978989 - DNA, 22 bp, Artificial Sequence
  chemically synthesized
gtactctcccaaatcagagagg

SEQ ID NO: 978990 - DNA, 22 bp, Artificial Sequence
  chemically synthesized
tactctcccaaatcagagagga

SEQ ID NO: 978991 - DNA, 22 bp, Artificial Sequence
  chemically synthesized
tcccaaatcagagaggaagcct

SEQ ID NO: 978992 - DNA, 22 bp, Artificial Sequence
  chemically synthesized
ccaaatcagagaggaagcctgc

SEQ ID NO: 978993 - DNA, 22 bp, Artificial Sequence
  chemically synthesized
agtgccctgtaggcaggcttcc

SEQ ID NO: 978994 - DNA, 22 bp, Artificial Sequence
  chemically synthesized
taagtgccctgtaggcaggctt

SEQ ID NO: 978995 - DNA, 22 bp, Artificial Sequence
  chemically synthesized
gattctaagtgccctgtaggca

SEQ ID NO: 978996 - DNA, 22 bp, Artificial Sequence
  chemically synthesized
agattctaagtgccctgtaggc

SEQ ID NO: 978997 - DNA, 22 bp, Artificial Sequence
  chemically synthesized
ttagattctaagtgccctgtag

SEQ ID NO: 978998 - DNA, 22 bp, Artificial Sequence
  chemically synthesized
cttagattctaagtgccctgta

SEQ ID NO: 978999 - DNA, 22 bp, Artificial Sequence
  chemically synthesized
tcttagattctaagtgccctgt

SEQ ID NO: 979000 - DNA, 22 bp, Artificial Sequence
  chemically synthesized
cctacagggcacttagaatcta

SEQ ID NO: 979001 - DNA, 22 bp, Artificial Sequence
  chemically synthesized
cagggcacttagaatctaagaa

SEQ ID NO: 979002 - DNA, 22 bp, Artificial Sequence
  chemically synthesized
caccgaaggcactttcttagat

SEQ ID NO: 979003 - DNA, 22 bp, Artificial Sequence
  chemically synthesized
tccaccgaaggcactttcttag

SEQ ID NO: 979004 - DNA, 22 bp, Artificial Sequence
  chemically synthesized
ctccaccgaaggcactttctta

SEQ ID NO: 979005 - DNA, 22 bp, Artificial Sequence
  chemically synthesized
tctccaccgaaggcactttctt

SEQ ID NO: 979006 - DNA, 22 bp, Artificial Sequence
  chemically synthesized
agaatctaagaaagtgccttcg

SEQ ID NO: 979007 - DNA, 22 bp, Artificial Sequence
  chemically synthesized
gaatctaagaaagtgccttcgg

SEQ ID NO: 979008 - DNA, 22 bp, Artificial Sequence
  chemically synthesized
aatattttctccaccgaaggca

SEQ ID NO: 979009 - DNA, 22 bp, Artificial Sequence
  chemically synthesized
gttaaatattttctccaccgaa

SEQ ID NO: 979010 - DNA, 22 bp, Artificial Sequence
  chemically synthesized
agaaagtgccttcggtggagaa

SEQ ID NO: 979011 - DNA, 22 bp, Artificial Sequence
  chemically synthesized
ttggttaaatattttctccacc

SEQ ID NO: 979012 - DNA, 22 bp, Artificial Sequence
  chemically synthesized
cggtggagaaaatatttaacca

SEQ ID NO: 979013 - DNA, 22 bp, Artificial Sequence
  chemically synthesized
ggtggagaaaatatttaaccaa

SEQ ID NO: 979014 - DNA, 22 bp, Artificial Sequence
  chemically synthesized
tccaaaccatcccccaaacaaa

SEQ ID NO: 979015 - DNA, 22 bp, Artificial Sequence
  chemically synthesized
aaccaataggtttgtttggggg

SEQ ID NO: 979016 - DNA, 22 bp, Artificial Sequence
  chemically synthesized
accaataggtttgtttggggga

SEQ ID NO: 979017 - DNA, 22 bp, Artificial Sequence
  chemically synthesized
gtttgggggatggtttggatag

SEQ ID NO: 979018 - DNA, 22 bp, Artificial Sequence
  chemically synthesized
tttgggggatggtttggatagg

SEQ ID NO: 979019 - DNA, 22 bp, Artificial Sequence
  chemically synthesized
gggggatggtttggatagggat

SEQ ID NO: 979020 - DNA, 22 bp, Artificial Sequence
  chemically synthesized
ggggatggtttggatagggatc

SEQ ID NO: 979021 - DNA, 22 bp, Artificial Sequence
  chemically synthesized
ggtccatatagaagatccctat

SEQ ID NO: 979022 - DNA, 22 bp, Artificial Sequence
  chemically synthesized
taggtccatatagaagatccct

SEQ ID NO: 979023 - DNA, 22 bp, Artificial Sequence
  chemically synthesized
ctaggtccatatagaagatccc

SEQ ID NO: 979024 - DNA, 22 bp, Artificial Sequence
  chemically synthesized
ggatagggatcttctatatgga

SEQ ID NO: 979025 - DNA, 22 bp, Artificial Sequence
  chemically synthesized
gatagggatcttctatatggac

SEQ ID NO: 979026 - DNA, 22 bp, Artificial Sequence
  chemically synthesized
atgataatccttctaggtccat

SEQ ID NO: 979027 - DNA, 22 bp, Artificial Sequence
  chemically synthesized
tgatgataatccttctaggtcc

SEQ ID NO: 979028 - DNA, 22 bp, Artificial Sequence
  chemically synthesized
tctctgatgataatccttctag

SEQ ID NO: 979029 - DNA, 22 bp, Artificial Sequence
  chemically synthesized
gtctctgatgataatccttcta

SEQ ID NO: 979030 - DNA, 22 bp, Artificial Sequence
  chemically synthesized
ctatatggacctagaaggatta

SEQ ID NO: 979031 - DNA, 22 bp, Artificial Sequence
  chemically synthesized
tgtctctgatgataatccttct

SEQ ID NO: 979032 - DNA, 22 bp, Artificial Sequence
  chemically synthesized
tatatggacctagaaggattat

SEQ ID NO: 979033 - DNA, 22 bp, Artificial Sequence
  chemically synthesized
tttgtctctgatgataatcctt

SEQ ID NO: 979034 - DNA, 22 bp, Artificial Sequence
  chemically synthesized
tatggacctagaaggattatca

SEQ ID NO: 979035 - DNA, 22 bp, Artificial Sequence
  chemically synthesized
acatactctttgtctctgatga

SEQ ID NO: 979036 - DNA, 22 bp, Artificial Sequence
  chemically synthesized
gaaggattatcatcagagacaa

SEQ ID NO: 979037 - DNA, 22 bp, Artificial Sequence
  chemically synthesized
acagaaagttcacatactcttt

SEQ ID NO: 979038 - DNA, 22 bp, Artificial Sequence
  chemically synthesized
tcatcagagacaaagagtatgt

SEQ ID NO: 979039 - DNA, 22 bp, Artificial Sequence
  chemically synthesized
ggcattaacagaaagttcacat

SEQ ID NO: 979040 - DNA, 22 bp, Artificial Sequence
  chemically synthesized
tgggcattaacagaaagttcac

SEQ ID NO: 979041 - DNA, 22 bp, Artificial Sequence
  chemically synthesized
tcacatctctgggcattaacag

SEQ ID NO: 979042 - DNA, 22 bp, Artificial Sequence
  chemically synthesized
gttgtcacatctctgggcatta

SEQ ID NO: 979043 - DNA, 22 bp, Artificial Sequence
  chemically synthesized
tggttgtcacatctctgggcat

SEQ ID NO: 979044 - DNA, 22 bp, Artificial Sequence
  chemically synthesized
tctggttgtcacatctctgggc

SEQ ID NO: 979045 - DNA, 22 bp, Artificial Sequence
  chemically synthesized
tctgttaatgcccagagatgtg

SEQ ID NO: 979046 - DNA, 22 bp, Artificial Sequence
  chemically synthesized
ctgttaatgcccagagatgtga

SEQ ID NO: 979047 - DNA, 22 bp, Artificial Sequence
  chemically synthesized
tgttaatgcccagagatgtgac

SEQ ID NO: 979048 - DNA, 22 bp, Artificial Sequence
  chemically synthesized
ttaatgcccagagatgtgacaa

SEQ ID NO: 979049 - DNA, 22 bp, Artificial Sequence
  chemically synthesized
cccagcctctctggttgtcaca

SEQ ID NO: 979050 - DNA, 22 bp, Artificial Sequence
  chemically synthesized
atgcccagagatgtgacaacca

SEQ ID NO: 979051 - DNA, 22 bp, Artificial Sequence
  chemically synthesized
tgcccagcctctctggttgtca

SEQ ID NO: 979052 - DNA, 22 bp, Artificial Sequence
  chemically synthesized
ttctgcccagcctctctggttg

SEQ ID NO: 979053 - DNA, 22 bp, Artificial Sequence
  chemically synthesized
tgttctgcccagcctctctggt

SEQ ID NO: 979054 - DNA, 22 bp, Artificial Sequence
  chemically synthesized
agattctgttctgcccagcctc

SEQ ID NO: 979055 - DNA, 22 bp, Artificial Sequence
  chemically synthesized
tgagattctgttctgcccagcc

SEQ ID NO: 979056 - DNA, 22 bp, Artificial Sequence
  chemically synthesized
cacatgccctctgagattctgt

SEQ ID NO: 979057 - DNA, 22 bp, Artificial Sequence
  chemically synthesized
ctccacatgccctctgagattc

SEQ ID NO: 979058 - DNA, 22 bp, Artificial Sequence
  chemically synthesized
ggcagaacagaatctcagaggg

SEQ ID NO: 979059 - DNA, 22 bp, Artificial Sequence
  chemically synthesized
agttgctccacatgccctctga

SEQ ID NO: 979060 - DNA, 22 bp, Artificial Sequence
  chemically synthesized
tcagttgctccacatgccctct

SEQ ID NO: 979061 - DNA, 22 bp, Artificial Sequence
  chemically synthesized
ctcagttgctccacatgccctc

SEQ ID NO: 979062 - DNA, 22 bp, Artificial Sequence
  chemically synthesized
tagtcttctcagttgctccaca

SEQ ID NO: 979063 - DNA, 22 bp, Artificial Sequence
  chemically synthesized
atagtcttctcagttgctccac

SEQ ID NO: 979064 - DNA, 22 bp, Artificial Sequence
  chemically synthesized
tatagtcttctcagttgctcca

SEQ ID NO: 979065 - DNA, 22 bp, Artificial Sequence
  chemically synthesized
agagggcatgtggagcaactga

SEQ ID NO: 979066 - DNA, 22 bp, Artificial Sequence
  chemically synthesized
aggtaagaaaacacaatgcctt

SEQ ID NO: 979067 - DNA, 22 bp, Artificial Sequence
  chemically synthesized
agaagactataaaggcattgtg

SEQ ID NO: 979068 - DNA, 22 bp, Artificial Sequence
  chemically synthesized
gaggtaagaaaacacaatgcct

SEQ ID NO: 979069 - DNA, 22 bp, Artificial Sequence
  chemically synthesized
taaaggcattgtgttttcttac

SEQ ID NO: 979070 - DNA, 22 bp, Artificial Sequence
  chemically synthesized
cgtgaacttgaggtaagaaaac

SEQ ID NO: 979071 - DNA, 22 bp, Artificial Sequence
  chemically synthesized
acgtgaacttgaggtaagaaaa

SEQ ID NO: 979072 - DNA, 22 bp, Artificial Sequence
  chemically synthesized
taagccttacgtgaacttgagg

SEQ ID NO: 979073 - DNA, 22 bp, Artificial Sequence
  chemically synthesized
tgttttcttacctcaagttcac

SEQ ID NO: 979074 - DNA, 22 bp, Artificial Sequence
  chemically synthesized
cagttataagccttacgtgaac

SEQ ID NO: 979075 - DNA, 22 bp, Artificial Sequence
  chemically synthesized
tcttacctcaagttcacgtaag

SEQ ID NO: 979076 - DNA, 22 bp, Artificial Sequence
  chemically synthesized
acagttataagccttacgtgaa

SEQ ID NO: 979077 - DNA, 22 bp, Artificial Sequence
  chemically synthesized
cttacctcaagttcacgtaagg

SEQ ID NO: 979078 - DNA, 22 bp, Artificial Sequence
  chemically synthesized
tacagttataagccttacgtga

SEQ ID NO: 979079 - DNA, 22 bp, Artificial Sequence
  chemically synthesized
ttacctcaagttcacgtaaggc

SEQ ID NO: 979080 - DNA, 22 bp, Artificial Sequence
  chemically synthesized
acctcaagttcacgtaaggctt

SEQ ID NO: 979081 - DNA, 22 bp, Artificial Sequence
  chemically synthesized
cctcaagttcacgtaaggctta

SEQ ID NO: 979082 - DNA, 22 bp, Artificial Sequence
  chemically synthesized
aagttcacgtaaggcttataac

SEQ ID NO: 979083 - DNA, 22 bp, Artificial Sequence
  chemically synthesized
acgtaaggcttataactgtaaa

SEQ ID NO: 979084 - DNA, 22 bp, Artificial Sequence
  chemically synthesized
ataactgtaaaatcatctattt

SEQ ID NO: 979085 - DNA, 22 bp, Artificial Sequence
  chemically synthesized
taactgtaaaatcatctatttt

SEQ ID NO: 979086 - DNA, 22 bp, Artificial Sequence
  chemically synthesized
atggataatccaaaaatagatg

SEQ ID NO: 979087 - DNA, 22 bp, Artificial Sequence
  chemically synthesized
catggataatccaaaaatagat

SEQ ID NO: 979088 - DNA, 22 bp, Artificial Sequence
  chemically synthesized
taaaatcatctatttttggatt

SEQ ID NO: 979089 - DNA, 22 bp, Artificial Sequence
  chemically synthesized
agaatttcatggataatccaaa

SEQ ID NO: 979090 - DNA, 22 bp, Artificial Sequence
  chemically synthesized
ggattgagaatttcatggataa

SEQ ID NO: 979091 - DNA, 22 bp, Artificial Sequence
  chemically synthesized
tttttggattatccatgaaatt

SEQ ID NO: 979092 - DNA, 22 bp, Artificial Sequence
  chemically synthesized
gcctaggattgagaatttcatg

SEQ ID NO: 979093 - DNA, 22 bp, Artificial Sequence
  chemically synthesized
ttggattatccatgaaattctc

SEQ ID NO: 979094 - DNA, 22 bp, Artificial Sequence
  chemically synthesized
tggattatccatgaaattctca

SEQ ID NO: 979095 - DNA, 22 bp, Artificial Sequence
  chemically synthesized
ctagcctaggattgagaatttc

SEQ ID NO: 979096 - DNA, 22 bp, Artificial Sequence
  chemically synthesized
ggattatccatgaaattctcaa

SEQ ID NO: 979097 - DNA, 22 bp, Artificial Sequence
  chemically synthesized
gattatccatgaaattctcaat

SEQ ID NO: 979098 - DNA, 22 bp, Artificial Sequence
  chemically synthesized
tccatgaaattctcaatcctag

SEQ ID NO: 979099 - DNA, 22 bp, Artificial Sequence
  chemically synthesized
cagaaaactgctagcctaggat

SEQ ID NO: 979100 - DNA, 22 bp, Artificial Sequence
  chemically synthesized
taagttgcagaaaactgctagc

SEQ ID NO: 979101 - DNA, 22 bp, Artificial Sequence
  chemically synthesized
gtaagttgcagaaaactgctag

SEQ ID NO: 979102 - DNA, 22 bp, Artificial Sequence
  chemically synthesized
tcaatcctaggctagcagtttt

SEQ ID NO: 979103 - DNA, 22 bp, Artificial Sequence
  chemically synthesized
aatcctaggctagcagttttct

SEQ ID NO: 979104 - DNA, 22 bp, Artificial Sequence
  chemically synthesized
ggctagcagttttctgcaactt

SEQ ID NO: 979105 - DNA, 22 bp, Artificial Sequence
  chemically synthesized
gcagttttctgcaacttacaag

SEQ ID NO: 979106 - DNA, 22 bp, Artificial Sequence
  chemically synthesized
tctgcaacttacaagcccatgc

SEQ ID NO: 979107 - DNA, 22 bp, Artificial Sequence
  chemically synthesized
aatgtaggagaggcatgggctt

SEQ ID NO: 979108 - DNA, 22 bp, Artificial Sequence
  chemically synthesized
ctgcaacttacaagcccatgcc

SEQ ID NO: 979109 - DNA, 22 bp, Artificial Sequence
  chemically synthesized
gaatgtaggagaggcatgggct

SEQ ID NO: 979110 - DNA, 22 bp, Artificial Sequence
  chemically synthesized
tgcaacttacaagcccatgcct

SEQ ID NO: 979111 - DNA, 22 bp, Artificial Sequence
  chemically synthesized
tgaatgtaggagaggcatgggc

SEQ ID NO: 979112 - DNA, 22 bp, Artificial Sequence
  chemically synthesized
caacttacaagcccatgcctct

SEQ ID NO: 979113 - DNA, 22 bp, Artificial Sequence
  chemically synthesized
acaagcccatgcctctcctaca

SEQ ID NO: 979114 - DNA, 22 bp, Artificial Sequence
  chemically synthesized
gaaacctttgaatgtaggagag

SEQ ID NO: 979115 - DNA, 22 bp, Artificial Sequence
  chemically synthesized
caagcccatgcctctcctacat

SEQ ID NO: 979116 - DNA, 22 bp, Artificial Sequence
  chemically synthesized
ttggaaacctttgaatgtagga

SEQ ID NO: 979117 - DNA, 22 bp, Artificial Sequence
  chemically synthesized
tcctacattcaaaggtttccaa

SEQ ID NO: 979118 - DNA, 22 bp, Artificial Sequence
  chemically synthesized
ggtgtaatgttattggaaacct

SEQ ID NO: 979119 - DNA, 22 bp, Artificial Sequence
  chemically synthesized
ctacattcaaaggtttccaata

SEQ ID NO: 979120 - DNA, 22 bp, Artificial Sequence
  chemically synthesized
cattcaaaggtttccaataaca

SEQ ID NO: 979121 - DNA, 22 bp, Artificial Sequence
  chemically synthesized
tccctgggtgtaatgttattgg

SEQ ID NO: 979122 - DNA, 22 bp, Artificial Sequence
  chemically synthesized
gtccctgggtgtaatgttattg

SEQ ID NO: 979123 - DNA, 22 bp, Artificial Sequence
  chemically synthesized
ttgtccctgggtgtaatgttat

SEQ ID NO: 979124 - DNA, 22 bp, Artificial Sequence
  chemically synthesized
aaaggtttccaataacattaca

SEQ ID NO: 979125 - DNA, 22 bp, Artificial Sequence
  chemically synthesized
cttgtccctgggtgtaatgtta

SEQ ID NO: 979126 - DNA, 22 bp, Artificial Sequence
  chemically synthesized
ccaataacattacacccaggga

SEQ ID NO: 979127 - DNA, 22 bp, Artificial Sequence
  chemically synthesized
caataacattacacccagggac

SEQ ID NO: 979128 - DNA, 22 bp, Artificial Sequence
  chemically synthesized
cacccagggacaagaagtatat

SEQ ID NO: 979129 - DNA, 22 bp, Artificial Sequence
  chemically synthesized
acaggccaataaaataatatac

SEQ ID NO: 979130 - DNA, 22 bp, Artificial Sequence
  chemically synthesized
ccccacctcacaggccaataaa

SEQ ID NO: 979131 - DNA, 22 bp, Artificial Sequence
  chemically synthesized
cccccacctcacaggccaataa

SEQ ID NO: 979132 - DNA, 22 bp, Artificial Sequence
  chemically synthesized
tccccttcccccacctcacagg

SEQ ID NO: 979133 - DNA, 22 bp, Artificial Sequence
  chemically synthesized
gtccccttcccccacctcacag

SEQ ID NO: 979134 - DNA, 22 bp, Artificial Sequence
  chemically synthesized
tgtccccttcccccacctcaca

SEQ ID NO: 979135 - DNA, 22 bp, Artificial Sequence
  chemically synthesized
ttttattggcctgtgaggtggg

SEQ ID NO: 979136 - DNA, 22 bp, Artificial Sequence
  chemically synthesized
tattggcctgtgaggtggggga

SEQ ID NO: 979137 - DNA, 22 bp, Artificial Sequence
  chemically synthesized
attggcctgtgaggtgggggaa

SEQ ID NO: 979138 - DNA, 22 bp, Artificial Sequence
  chemically synthesized
ttggcctgtgaggtgggggaag

SEQ ID NO: 979139 - DNA, 22 bp, Artificial Sequence
  chemically synthesized
gcctgtgaggtgggggaagggg

SEQ ID NO: 979140 - DNA, 22 bp, Artificial Sequence
  chemically synthesized
tataaattttgtccccttcccc

SEQ ID NO: 979141 - DNA, 22 bp, Artificial Sequence
  chemically synthesized
ttatataaattttgtccccttc

SEQ ID NO: 979142 - DNA, 22 bp, Artificial Sequence
  chemically synthesized
attatataaattttgtcccctt

SEQ ID NO: 979143 - DNA, 22 bp, Artificial Sequence
  chemically synthesized
tgaggtgggggaaggggacaaa

SEQ ID NO: 979144 - DNA, 22 bp, Artificial Sequence
  chemically synthesized
tattatataaattttgtcccct

SEQ ID NO: 979145 - DNA, 22 bp, Artificial Sequence
  chemically synthesized
tgtaaaataggatactttatta

SEQ ID NO: 979146 - DNA, 22 bp, Artificial Sequence
  chemically synthesized
ctgtgtaaaataggatacttta

SEQ ID NO: 979147 - DNA, 22 bp, Artificial Sequence
  chemically synthesized
actgtgtaaaataggatacttt

SEQ ID NO: 979148 - DNA, 22 bp, Artificial Sequence
  chemically synthesized
tactgtgtaaaataggatactt

SEQ ID NO: 979149 - DNA, 22 bp, Artificial Sequence
  chemically synthesized
atataataaagtatcctatttt

SEQ ID NO: 979150 - DNA, 22 bp, Artificial Sequence
  chemically synthesized
tataataaagtatcctatttta

SEQ ID NO: 979151 - DNA, 22 bp, Artificial Sequence
  chemically synthesized
ataaagtaaagcaataaacttt

SEQ ID NO: 979152 - DNA, 22 bp, Artificial Sequence
  chemically synthesized
ttttacacagtaaagtttattg

SEQ ID NO: 979153 - DNA, 22 bp, Artificial Sequence
  chemically synthesized
aataaagtaaagcaataaactt

SEQ ID NO: 979154 - DNA, 22 bp, Artificial Sequence
  chemically synthesized
tacacagtaaagtttattgctt

SEQ ID NO: 979155 - DNA, 22 bp, Artificial Sequence
  chemically synthesized
acacagtaaagtttattgcttt

SEQ ID NO: 979156 - DNA, 22 bp, Artificial Sequence
  chemically synthesized
cacagtaaagtttattgcttta

SEQ ID NO: 979157 - DNA, 22 bp, Artificial Sequence
  chemically synthesized
attgctttactttattaaacac

SEQ ID NO: 979158 - DNA, 22 bp, Artificial Sequence
  chemically synthesized
ttgctttactttattaaacact

SEQ ID NO: 979159 - DNA, 22 bp, Artificial Sequence
  chemically synthesized
ctttactttattaaacactgat

SEQ ID NO: 979160 - DNA, 22 bp, Artificial Sequence
  chemically synthesized
tactttattaaacactgatcac

SEQ ID NO: 979161 - DNA, 22 bp, Artificial Sequence
  chemically synthesized
actttattaaacactgatcact

SEQ ID NO: 979162 - DNA, 22 bp, Artificial Sequence
  chemically synthesized
ctttattaaacactgatcactg

SEQ ID NO: 979163 - DNA, 22 bp, Artificial Sequence
  chemically synthesized
tagaacagatcatcagtgatca

SEQ ID NO: 979164 - DNA, 22 bp, Artificial Sequence
  chemically synthesized
tattaaacactgatcactgatg

SEQ ID NO: 979165 - DNA, 22 bp, Artificial Sequence
  chemically synthesized
attaaacactgatcactgatga

SEQ ID NO: 979166 - DNA, 22 bp, Artificial Sequence
  chemically synthesized
ttaaacactgatcactgatgat

SEQ ID NO: 979167 - DNA, 22 bp, Artificial Sequence
  chemically synthesized
aacactgatcactgatgatctg

SEQ ID NO: 979168 - DNA, 22 bp, Artificial Sequence
  chemically synthesized
ggaaagctatagaacagatcat

SEQ ID NO: 979169 - DNA, 22 bp, Artificial Sequence
  chemically synthesized
gggaaagctatagaacagatca

SEQ ID NO: 979170 - DNA, 22 bp, Artificial Sequence
  chemically synthesized
tgggaaagctatagaacagatc

SEQ ID NO: 979171 - DNA, 22 bp, Artificial Sequence
  chemically synthesized
atcactgatgatctgttctata

SEQ ID NO: 979172 - DNA, 22 bp, Artificial Sequence
  chemically synthesized
atgatctgttctatagctttcc

SEQ ID NO: 979173 - DNA, 22 bp, Artificial Sequence
  chemically synthesized
ttctatagctttcccaaaaccc

SEQ ID NO: 979174 - DNA, 22 bp, Artificial Sequence
  chemically synthesized
tatagctttcccaaaaccctgt

SEQ ID NO: 979175 - DNA, 22 bp, Artificial Sequence
  chemically synthesized
aaaatccagaaacacagggttt

SEQ ID NO: 979176 - DNA, 22 bp, Artificial Sequence
  chemically synthesized
tagctttcccaaaaccctgtgt

SEQ ID NO: 979177 - DNA, 22 bp, Artificial Sequence
  chemically synthesized
tcccaaaaccctgtgtttctgg

SEQ ID NO: 979178 - DNA, 22 bp, Artificial Sequence
  chemically synthesized
cccaaaaccctgtgtttctgga

SEQ ID NO: 979179 - DNA, 22 bp, Artificial Sequence
  chemically synthesized
cataattgaaaatccagaaaca

SEQ ID NO: 979180 - DNA, 22 bp, Artificial Sequence
  chemically synthesized
ccaaaaccctgtgtttctggat

SEQ ID NO: 979181 - DNA, 22 bp, Artificial Sequence
  chemically synthesized
tgcataattgaaaatccagaaa

SEQ ID NO: 979182 - DNA, 22 bp, Artificial Sequence
  chemically synthesized
tctgcataattgaaaatccaga

SEQ ID NO: 979183 - DNA, 22 bp, Artificial Sequence
  chemically synthesized
ctctgcataattgaaaatccag

SEQ ID NO: 979184 - DNA, 22 bp, Artificial Sequence
  chemically synthesized
tctctgcataattgaaaatcca

SEQ ID NO: 979185 - DNA, 22 bp, Artificial Sequence
  chemically synthesized
ttctctgcataattgaaaatcc

SEQ ID NO: 979186 - DNA, 22 bp, Artificial Sequence
  chemically synthesized
tttctctgcataattgaaaatc

SEQ ID NO: 979187 - DNA, 22 bp, Artificial Sequence
  chemically synthesized
ttttctctgcataattgaaaat

SEQ ID NO: 979188 - DNA, 22 bp, Artificial Sequence
  chemically synthesized
tgtttctggattttcaattatg

SEQ ID NO: 979189 - DNA, 22 bp, Artificial Sequence
  chemically synthesized
acttttttctctgcataattga

SEQ ID NO: 979190 - DNA, 22 bp, Artificial Sequence
  chemically synthesized
cacttttttctctgcataattg

SEQ ID NO: 979191 - DNA, 22 bp, Artificial Sequence
  chemically synthesized
ctggattttcaattatgcagag

SEQ ID NO: 979192 - DNA, 22 bp, Artificial Sequence
  chemically synthesized
tggattttcaattatgcagaga

SEQ ID NO: 979193 - DNA, 22 bp, Artificial Sequence
  chemically synthesized
gattttcaattatgcagagaaa

SEQ ID NO: 979194 - DNA, 22 bp, Artificial Sequence
  chemically synthesized
aggagatttcacttttttctct

SEQ ID NO: 979195 - DNA, 22 bp, Artificial Sequence
  chemically synthesized
tcaattatgcagagaaaaaagt

SEQ ID NO: 979196 - DNA, 22 bp, Artificial Sequence
  chemically synthesized
caattatgcagagaaaaaagtg

SEQ ID NO: 979197 - DNA, 22 bp, Artificial Sequence
  chemically synthesized
aattatgcagagaaaaaagtga

SEQ ID NO: 979198 - DNA, 22 bp, Artificial Sequence
  chemically synthesized
ccagctcaggagatttcacttt

SEQ ID NO: 979199 - DNA, 22 bp, Artificial Sequence
  chemically synthesized
tgcagagaaaaaagtgaaatct

SEQ ID NO: 979200 - DNA, 22 bp, Artificial Sequence
  chemically synthesized
tgatggaggggaagagctgcca

SEQ ID NO: 979201 - DNA, 22 bp, Artificial Sequence
  chemically synthesized
aactatgatggaggggaagagc

SEQ ID NO: 979202 - DNA, 22 bp, Artificial Sequence
  chemically synthesized
ctgagctggcagctcttcccct

SEQ ID NO: 979203 - DNA, 22 bp, Artificial Sequence
  chemically synthesized
gaactatgatggaggggaagag

SEQ ID NO: 979204 - DNA, 22 bp, Artificial Sequence
  chemically synthesized
tgaactatgatggaggggaaga

SEQ ID NO: 979205 - DNA, 22 bp, Artificial Sequence
  chemically synthesized
ttgaactatgatggaggggaag

SEQ ID NO: 979206 - DNA, 22 bp, Artificial Sequence
  chemically synthesized
agctggcagctcttcccctcca

SEQ ID NO: 979207 - DNA, 22 bp, Artificial Sequence
  chemically synthesized
gcagctcttcccctccatcata

SEQ ID NO: 979208 - DNA, 22 bp, Artificial Sequence
  chemically synthesized
tcaccttttgaactatgatgga

SEQ ID NO: 979209 - DNA, 22 bp, Artificial Sequence
  chemically synthesized
cctgtcaccttttgaactatga

SEQ ID NO: 979210 - DNA, 22 bp, Artificial Sequence
  chemically synthesized
ttcccctccatcatagttcaaa

SEQ ID NO: 979211 - DNA, 22 bp, Artificial Sequence
  chemically synthesized
ttccctgtcaccttttgaacta

SEQ ID NO: 979212 - DNA, 22 bp, Artificial Sequence
  chemically synthesized
cccctccatcatagttcaaaag

SEQ ID NO: 979213 - DNA, 22 bp, Artificial Sequence
  chemically synthesized
ccctccatcatagttcaaaagg

SEQ ID NO: 979214 - DNA, 22 bp, Artificial Sequence
  chemically synthesized
ctattccctgtcaccttttgaa

SEQ ID NO: 979215 - DNA, 22 bp, Artificial Sequence
  chemically synthesized
catcatagttcaaaaggtgaca

SEQ ID NO: 979216 - DNA, 22 bp, Artificial Sequence
  chemically synthesized
taggctgctattccctgtcacc

SEQ ID NO: 979217 - DNA, 22 bp, Artificial Sequence
  chemically synthesized
tgtaggctgctattccctgtca

SEQ ID NO: 979218 - DNA, 22 bp, Artificial Sequence
  chemically synthesized
actctgtaggctgctattccct

SEQ ID NO: 979219 - DNA, 22 bp, Artificial Sequence
  chemically synthesized
aaaaggtgacagggaatagcag

SEQ ID NO: 979220 - DNA, 22 bp, Artificial Sequence
  chemically synthesized
ttcactctgtaggctgctattc

SEQ ID NO: 979221 - DNA, 22 bp, Artificial Sequence
  chemically synthesized
tgttcactctgtaggctgctat

SEQ ID NO: 979222 - DNA, 22 bp, Artificial Sequence
  chemically synthesized
tgttctgttcactctgtaggct

SEQ ID NO: 979223 - DNA, 22 bp, Artificial Sequence
  chemically synthesized
agagagttatgttctgttcact

SEQ ID NO: 979224 - DNA, 22 bp, Artificial Sequence
  chemically synthesized
cagagtgaacagaacataactc

SEQ ID NO: 979225 - DNA, 22 bp, Artificial Sequence
  chemically synthesized
accatggctcagagagttatgt

SEQ ID NO: 979226 - DNA, 22 bp, Artificial Sequence
  chemically synthesized
aaccatggctcagagagttatg

SEQ ID NO: 979227 - DNA, 22 bp, Artificial Sequence
  chemically synthesized
gagcttaaccatggctcagaga

SEQ ID NO: 979228 - DNA, 22 bp, Artificial Sequence
  chemically synthesized
ctggagcttaaccatggctcag

SEQ ID NO: 979229 - DNA, 22 bp, Artificial Sequence
  chemically synthesized
tctgagccatggttaagctcca

SEQ ID NO: 979230 - DNA, 22 bp, Artificial Sequence
  chemically synthesized
tgagccatggttaagctccagc

SEQ ID NO: 979231 - DNA, 22 bp, Artificial Sequence
  chemically synthesized
agccatggttaagctccagcaa

SEQ ID NO: 979232 - DNA, 22 bp, Artificial Sequence
  chemically synthesized
cgaccaccaaaattgctggagc

SEQ ID NO: 979233 - DNA, 22 bp, Artificial Sequence
  chemically synthesized
ctgcgaccaccaaaattgctgg

SEQ ID NO: 979234 - DNA, 22 bp, Artificial Sequence
  chemically synthesized
actgcgaccaccaaaattgctg

SEQ ID NO: 979235 - DNA, 22 bp, Artificial Sequence
  chemically synthesized
agctccagcaattttggtggtc

SEQ ID NO: 979236 - DNA, 22 bp, Artificial Sequence
  chemically synthesized
gcccagtgtttactgcgaccac

SEQ ID NO: 979237 - DNA, 22 bp, Artificial Sequence
  chemically synthesized
cagcaattttggtggtcgcagt

SEQ ID NO: 979238 - DNA, 22 bp, Artificial Sequence
  chemically synthesized
agcccagtgtttactgcgacca

SEQ ID NO: 979239 - DNA, 22 bp, Artificial Sequence
  chemically synthesized
ggtttagcccagtgtttactgc

SEQ ID NO: 979240 - DNA, 22 bp, Artificial Sequence
  chemically synthesized
gggtttagcccagtgtttactg

SEQ ID NO: 979241 - DNA, 22 bp, Artificial Sequence
  chemically synthesized
tggtggtcgcagtaaacactgg

SEQ ID NO: 979242 - DNA, 22 bp, Artificial Sequence
  chemically synthesized
cttgggtttagcccagtgttta

SEQ ID NO: 979243 - DNA, 22 bp, Artificial Sequence
  chemically synthesized
ggtggtcgcagtaaacactggg

SEQ ID NO: 979244 - DNA, 22 bp, Artificial Sequence
  chemically synthesized
gtggtcgcagtaaacactgggc

SEQ ID NO: 979245 - DNA, 22 bp, Artificial Sequence
  chemically synthesized
ggctaaacccaaggaacttctc

SEQ ID NO: 979246 - DNA, 22 bp, Artificial Sequence
  chemically synthesized
aacccaaggaacttctccccct

SEQ ID NO: 979247 - DNA, 22 bp, Artificial Sequence
  chemically synthesized
tcaatatataaccaaagccaca

SEQ ID NO: 979248 - DNA, 22 bp, Artificial Sequence
  chemically synthesized
ctccccctctatgtggctttgg

SEQ ID NO: 979249 - DNA, 22 bp, Artificial Sequence
  chemically synthesized
tccccctctatgtggctttggt

SEQ ID NO: 979250 - DNA, 22 bp, Artificial Sequence
  chemically synthesized
cccctctatgtggctttggtta

SEQ ID NO: 979251 - DNA, 22 bp, Artificial Sequence
  chemically synthesized
gttatcaatatataaccaaagc

SEQ ID NO: 979252 - DNA, 22 bp, Artificial Sequence
  chemically synthesized
ggttatcaatatataaccaaag

SEQ ID NO: 979253 - DNA, 22 bp, Artificial Sequence
  chemically synthesized
tggttatcaatatataaccaaa

SEQ ID NO: 979254 - DNA, 22 bp, Artificial Sequence
  chemically synthesized
tatgtggctttggttatatatt

SEQ ID NO: 979255 - DNA, 22 bp, Artificial Sequence
  chemically synthesized
tgtggctttggttatatattga

SEQ ID NO: 979256 - DNA, 22 bp, Artificial Sequence
  chemically synthesized
tggttatatattgataaccaaa

SEQ ID NO: 979257 - DNA, 22 bp, Artificial Sequence
  chemically synthesized
ggttatatattgataaccaaag

SEQ ID NO: 979258 - DNA, 22 bp, Artificial Sequence
  chemically synthesized
gttatatattgataaccaaagc

SEQ ID NO: 979259 - DNA, 22 bp, Artificial Sequence
  chemically synthesized
tatattgataaccaaagctgat

SEQ ID NO: 979260 - DNA, 22 bp, Artificial Sequence
  chemically synthesized
ataaccaaagcaatatcagctt

SEQ ID NO: 979261 - DNA, 22 bp, Artificial Sequence
  chemically synthesized
gataaccaaagcaatatcagct

SEQ ID NO: 979262 - DNA, 22 bp, Artificial Sequence
  chemically synthesized
tgataaccaaagcaatatcagc

SEQ ID NO: 979263 - DNA, 22 bp, Artificial Sequence
  chemically synthesized
ataaccaaagctgatattgctt

SEQ ID NO: 979264 - DNA, 22 bp, Artificial Sequence
  chemically synthesized
ctttgataaccaaagcaatatc

SEQ ID NO: 979265 - DNA, 22 bp, Artificial Sequence
  chemically synthesized
atattgctttgataaccaaagc

SEQ ID NO: 979266 - DNA, 22 bp, Artificial Sequence
  chemically synthesized
atattgctttggttatcaaagc

SEQ ID NO: 979267 - DNA, 22 bp, Artificial Sequence
  chemically synthesized
ctttggttatcaaagcaatatc

SEQ ID NO: 979268 - DNA, 22 bp, Artificial Sequence
  chemically synthesized
ccaggtcatgctgatattgctt

SEQ ID NO: 979269 - DNA, 22 bp, Artificial Sequence
  chemically synthesized
tggttatcaaagcaatatcagc

SEQ ID NO: 979270 - DNA, 22 bp, Artificial Sequence
  chemically synthesized
ggttatcaaagcaatatcagca

SEQ ID NO: 979271 - DNA, 22 bp, Artificial Sequence
  chemically synthesized
gttatcaaagcaatatcagcat

SEQ ID NO: 979272 - DNA, 22 bp, Artificial Sequence
  chemically synthesized
ataagttcccaggtcatgctga

SEQ ID NO: 979273 - DNA, 22 bp, Artificial Sequence
  chemically synthesized
tcaaagcaatatcagcatgacc

SEQ ID NO: 979274 - DNA, 22 bp, Artificial Sequence
  chemically synthesized
taataagttcccaggtcatgct

SEQ ID NO: 979275 - DNA, 22 bp, Artificial Sequence
  chemically synthesized
ctaataagttcccaggtcatgc

SEQ ID NO: 979276 - DNA, 22 bp, Artificial Sequence
  chemically synthesized
tctaataagttcccaggtcatg

SEQ ID NO: 979277 - DNA, 22 bp, Artificial Sequence
  chemically synthesized
ttctaataagttcccaggtcat

SEQ ID NO: 979278 - DNA, 22 bp, Artificial Sequence
  chemically synthesized
cttttctaataagttcccaggt

SEQ ID NO: 979279 - DNA, 22 bp, Artificial Sequence
  chemically synthesized
acttttctaataagttcccagg

SEQ ID NO: 979280 - DNA, 22 bp, Artificial Sequence
  chemically synthesized
agaatttacttttctaataagt

SEQ ID NO: 979281 - DNA, 22 bp, Artificial Sequence
  chemically synthesized
ggaacttattagaaaagtaaat

SEQ ID NO: 979282 - DNA, 22 bp, Artificial Sequence
  chemically synthesized
tggggtgagacctgagaattta

SEQ ID NO: 979283 - DNA, 22 bp, Artificial Sequence
  chemically synthesized
attagaaaagtaaattctcagg

SEQ ID NO: 979284 - DNA, 22 bp, Artificial Sequence
  chemically synthesized
ttagaaaagtaaattctcaggt

SEQ ID NO: 979285 - DNA, 22 bp, Artificial Sequence
  chemically synthesized
gaaaagtaaattctcaggtctc

SEQ ID NO: 979286 - DNA, 22 bp, Artificial Sequence
  chemically synthesized
ataaggtagctgtggggtgaga

SEQ ID NO: 979287 - DNA, 22 bp, Artificial Sequence
  chemically synthesized
tgataaggtagctgtggggtga

SEQ ID NO: 979288 - DNA, 22 bp, Artificial Sequence
  chemically synthesized
tcaggtctcaccccacagctac

SEQ ID NO: 979289 - DNA, 22 bp, Artificial Sequence
  chemically synthesized
aggtctcaccccacagctacct

SEQ ID NO: 979290 - DNA, 22 bp, Artificial Sequence
  chemically synthesized
gtaggagttctgataaggtagc

SEQ ID NO: 979291 - DNA, 22 bp, Artificial Sequence
  chemically synthesized
accccacagctaccttatcaga

SEQ ID NO: 979292 - DNA, 22 bp, Artificial Sequence
  chemically synthesized
tgccccactcgtaggagttctg

SEQ ID NO: 979293 - DNA, 22 bp, Artificial Sequence
  chemically synthesized
ctgtgccccactcgtaggagtt

SEQ ID NO: 979294 - DNA, 22 bp, Artificial Sequence
  chemically synthesized
ccttatcagaactcctacgagt

SEQ ID NO: 979295 - DNA, 22 bp, Artificial Sequence
  chemically synthesized
attgctgtgccccactcgtagg

SEQ ID NO: 979296 - DNA, 22 bp, Artificial Sequence
  chemically synthesized
atcagaactcctacgagtgggg

SEQ ID NO: 979297 - DNA, 22 bp, Artificial Sequence
  chemically synthesized
tcagaactcctacgagtggggc

SEQ ID NO: 979298 - DNA, 22 bp, Artificial Sequence
  chemically synthesized
aaatactgattgctgtgcccca

SEQ ID NO: 979299 - DNA, 22 bp, Artificial Sequence
  chemically synthesized
attaaaatactgattgctgtgc

SEQ ID NO: 979300 - DNA, 22 bp, Artificial Sequence
  chemically synthesized
ctacgagtggggcacagcaatc

SEQ ID NO: 979301 - DNA, 22 bp, Artificial Sequence
  chemically synthesized
cgagtggggcacagcaatcagt

SEQ ID NO: 979302 - DNA, 22 bp, Artificial Sequence
  chemically synthesized
caggtgactcattaaaatactg

SEQ ID NO: 979303 - DNA, 22 bp, Artificial Sequence
  chemically synthesized
ccaggtgactcattaaaatact

SEQ ID NO: 979304 - DNA, 22 bp, Artificial Sequence
  chemically synthesized
catcaaaatttccaggtgactc

SEQ ID NO: 979305 - DNA, 22 bp, Artificial Sequence
  chemically synthesized
atcctgcatcaaaatttccagg

SEQ ID NO: 979306 - DNA, 22 bp, Artificial Sequence
  chemically synthesized
gatcctgcatcaaaatttccag

SEQ ID NO: 979307 - DNA, 22 bp, Artificial Sequence
  chemically synthesized
taatgagtcacctggaaatttt

SEQ ID NO: 979308 - DNA, 22 bp, Artificial Sequence
  chemically synthesized
aatgagtcacctggaaattttg

SEQ ID NO: 979309 - DNA, 22 bp, Artificial Sequence
  chemically synthesized
atgagtcacctggaaattttga

SEQ ID NO: 979310 - DNA, 22 bp, Artificial Sequence
  chemically synthesized
acatttgatcctgcatcaaaat

SEQ ID NO: 979311 - DNA, 22 bp, Artificial Sequence
  chemically synthesized
cacatttgatcctgcatcaaaa

SEQ ID NO: 979312 - DNA, 22 bp, Artificial Sequence
  chemically synthesized
tcacatttgatcctgcatcaaa

SEQ ID NO: 979313 - DNA, 22 bp, Artificial Sequence
  chemically synthesized
gaaattttgatgcaggatcaaa

SEQ ID NO: 979314 - DNA, 22 bp, Artificial Sequence
  chemically synthesized
tgatgcaggatcaaatgtgaaa

SEQ ID NO: 979315 - DNA, 22 bp, Artificial Sequence
  chemically synthesized
tagggcgatggttttcacattt

SEQ ID NO: 979316 - DNA, 22 bp, Artificial Sequence
  chemically synthesized
gatgcaggatcaaatgtgaaaa

SEQ ID NO: 979317 - DNA, 22 bp, Artificial Sequence
  chemically synthesized
atgcaggatcaaatgtgaaaac

SEQ ID NO: 979318 - DNA, 22 bp, Artificial Sequence
  chemically synthesized
ctatagggcgatggttttcaca

SEQ ID NO: 979319 - DNA, 22 bp, Artificial Sequence
  chemically synthesized
ctgctatagggcgatggttttc

SEQ ID NO: 979320 - DNA, 22 bp, Artificial Sequence
  chemically synthesized
gggattgctgctatagggcgat

SEQ ID NO: 979321 - DNA, 22 bp, Artificial Sequence
  chemically synthesized
gtgccgaaaaggttggggattg

SEQ ID NO: 979322 - DNA, 22 bp, Artificial Sequence
  chemically synthesized
tggtgccgaaaaggttggggat

SEQ ID NO: 979323 - DNA, 22 bp, Artificial Sequence
  chemically synthesized
tagcagcaatccccaacctttt

SEQ ID NO: 979324 - DNA, 22 bp, Artificial Sequence
  chemically synthesized
aaccagtctctggtgccgaaaa

SEQ ID NO: 979325 - DNA, 22 bp, Artificial Sequence
  chemically synthesized
taaaccagtctctggtgccgaa

SEQ ID NO: 979326 - DNA, 22 bp, Artificial Sequence
  chemically synthesized
ctctaaaccagtctctggtgcc

SEQ ID NO: 979327 - DNA, 22 bp, Artificial Sequence
  chemically synthesized
cctctaaaccagtctctggtgc

SEQ ID NO: 979328 - DNA, 22 bp, Artificial Sequence
  chemically synthesized
tcttcctctaaaccagtctctg

SEQ ID NO: 979329 - DNA, 22 bp, Artificial Sequence
  chemically synthesized
ttcggcaccagagactggttta

SEQ ID NO: 979330 - DNA, 22 bp, Artificial Sequence
  chemically synthesized
tcggcaccagagactggtttag

SEQ ID NO: 979331 - DNA, 22 bp, Artificial Sequence
  chemically synthesized
cggcaccagagactggtttaga

SEQ ID NO: 979332 - DNA, 22 bp, Artificial Sequence
  chemically synthesized
ggcaccagagactggtttagag

SEQ ID NO: 979333 - DNA, 22 bp, Artificial Sequence
  chemically synthesized
atccatggaaaaattgtcttcc

SEQ ID NO: 979334 - DNA, 22 bp, Artificial Sequence
  chemically synthesized
gtttagaggaagacaatttttc

SEQ ID NO: 979335 - DNA, 22 bp, Artificial Sequence
  chemically synthesized
agaggaagacaatttttccatg

SEQ ID NO: 979336 - DNA, 22 bp, Artificial Sequence
  chemically synthesized
gaggaagacaatttttccatgg

SEQ ID NO: 979337 - DNA, 22 bp, Artificial Sequence
  chemically synthesized
cccacaaccccacccgcccctg

SEQ ID NO: 979338 - DNA, 22 bp, Artificial Sequence
  chemically synthesized
ttccatggatcaggggcgggtg

SEQ ID NO: 979339 - DNA, 22 bp, Artificial Sequence
  chemically synthesized
tccccacaaccccacccgcccc

SEQ ID NO: 979340 - DNA, 22 bp, Artificial Sequence
  chemically synthesized
tccatggatcaggggcgggtgg

SEQ ID NO: 979341 - DNA, 22 bp, Artificial Sequence
  chemically synthesized
ccatggatcaggggcgggtggg

SEQ ID NO: 979342 - DNA, 22 bp, Artificial Sequence
  chemically synthesized
catggatcaggggcgggtgggg

SEQ ID NO: 979343 - DNA, 22 bp, Artificial Sequence
  chemically synthesized
ccacgcacctctccccacaacc

SEQ ID NO: 979344 - DNA, 22 bp, Artificial Sequence
  chemically synthesized
tggggagaggtgcgtgggaggc

SEQ ID NO: 979345 - DNA, 22 bp, Artificial Sequence
  chemically synthesized
tccccaaaccatcgcctcccac

SEQ ID NO: 979346 - DNA, 22 bp, Artificial Sequence
  chemically synthesized
atccccaaaccatcgcctccca

SEQ ID NO: 979347 - DNA, 22 bp, Artificial Sequence
  chemically synthesized
tatccccaaaccatcgcctccc

SEQ ID NO: 979348 - DNA, 22 bp, Artificial Sequence
  chemically synthesized
aggtgcaacagttttatcccca

SEQ ID NO: 979349 - DNA, 22 bp, Artificial Sequence
  chemically synthesized
aagatctgaggtgcaacagttt

SEQ ID NO: 979350 - DNA, 22 bp, Artificial Sequence
  chemically synthesized
ggggataaaactgttgcacctc

SEQ ID NO: 979351 - DNA, 22 bp, Artificial Sequence
  chemically synthesized
gggataaaactgttgcacctca

SEQ ID NO: 979352 - DNA, 22 bp, Artificial Sequence
  chemically synthesized
atgcctgaagatctgaggtgca

SEQ ID NO: 979353 - DNA, 22 bp, Artificial Sequence
  chemically synthesized
tgagaatctaatgcctgaagat

SEQ ID NO: 979354 - DNA, 22 bp, Artificial Sequence
  chemically synthesized
ttgcacctcagatcttcaggca

SEQ ID NO: 979355 - DNA, 22 bp, Artificial Sequence
  chemically synthesized
atgagaatctaatgcctgaaga

SEQ ID NO: 979356 - DNA, 22 bp, Artificial Sequence
  chemically synthesized
cacctcagatcttcaggcatta

SEQ ID NO: 979357 - DNA, 22 bp, Artificial Sequence
  chemically synthesized
cttatgagaatctaatgcctga

SEQ ID NO: 979358 - DNA, 22 bp, Artificial Sequence
  chemically synthesized
agatcttcaggcattagattct

SEQ ID NO: 979359 - DNA, 22 bp, Artificial Sequence
  chemically synthesized
tgtgctccttatgagaatctaa

SEQ ID NO: 979360 - DNA, 22 bp, Artificial Sequence
  chemically synthesized
ggttgtgtgctccttatgagaa

SEQ ID NO: 979361 - DNA, 22 bp, Artificial Sequence
  chemically synthesized
caggcattagattctcataagg

SEQ ID NO: 979362 - DNA, 22 bp, Artificial Sequence
  chemically synthesized
aggcattagattctcataagga

SEQ ID NO: 979363 - DNA, 22 bp, Artificial Sequence
  chemically synthesized
gattctcataaggagcacacaa

SEQ ID NO: 979364 - DNA, 22 bp, Artificial Sequence
  chemically synthesized
tcataaggagcacacaacctag

SEQ ID NO: 979365 - DNA, 22 bp, Artificial Sequence
  chemically synthesized
ataaggagcacacaacctagat

SEQ ID NO: 979366 - DNA, 22 bp, Artificial Sequence
  chemically synthesized
tccacacgagggatctaggttg

SEQ ID NO: 979367 - DNA, 22 bp, Artificial Sequence
  chemically synthesized
tgaactgtccacacgagggatc

SEQ ID NO: 979368 - DNA, 22 bp, Artificial Sequence
  chemically synthesized
ttgtgaactgtccacacgaggg

SEQ ID NO: 979369 - DNA, 22 bp, Artificial Sequence
  chemically synthesized
gatccctcgtgtggacagttca

SEQ ID NO: 979370 - DNA, 22 bp, Artificial Sequence
  chemically synthesized
gtgtggacagttcacaataggg

SEQ ID NO: 979371 - DNA, 22 bp, Artificial Sequence
  chemically synthesized
ataggatcacgaaccctattgt

SEQ ID NO: 979372 - DNA, 22 bp, Artificial Sequence
  chemically synthesized
tcataggatcacgaaccctatt

SEQ ID NO: 979373 - DNA, 22 bp, Artificial Sequence
  chemically synthesized
gattctcataggatcacgaacc

SEQ ID NO: 979374 - DNA, 22 bp, Artificial Sequence
  chemically synthesized
acaatagggttcgtgatcctat

SEQ ID NO: 979375 - DNA, 22 bp, Artificial Sequence
  chemically synthesized
agcagcggtattagattctcat

SEQ ID NO: 979376 - DNA, 22 bp, Artificial Sequence
  chemically synthesized
gtgatcctatgagaatctaata

SEQ ID NO: 979377 - DNA, 22 bp, Artificial Sequence
  chemically synthesized
tcagctcagcagcggtattaga

SEQ ID NO: 979378 - DNA, 22 bp, Artificial Sequence
  chemically synthesized
tatcagctcagcagcggtatta

SEQ ID NO: 979379 - DNA, 22 bp, Artificial Sequence
  chemically synthesized
ctatcagctcagcagcggtatt

SEQ ID NO: 979380 - DNA, 22 bp, Artificial Sequence
  chemically synthesized
tgagaatctaataccgctgctg

SEQ ID NO: 979381 - DNA, 22 bp, Artificial Sequence
  chemically synthesized
caccttctatcagctcagcagc

SEQ ID NO: 979382 - DNA, 22 bp, Artificial Sequence
  chemically synthesized
agctccaccttctatcagctca

SEQ ID NO: 979383 - DNA, 22 bp, Artificial Sequence
  chemically synthesized
gagctccaccttctatcagctc

SEQ ID NO: 979384 - DNA, 22 bp, Artificial Sequence
  chemically synthesized
ataccgctgctgagctgataga

SEQ ID NO: 979385 - DNA, 22 bp, Artificial Sequence
  chemically synthesized
ccacttgagctccaccttctat

SEQ ID NO: 979386 - DNA, 22 bp, Artificial Sequence
  chemically synthesized
ctgagctgatagaaggtggagc

SEQ ID NO: 979387 - DNA, 22 bp, Artificial Sequence
  chemically synthesized
agctgatagaaggtggagctca

SEQ ID NO: 979388 - DNA, 22 bp, Artificial Sequence
  chemically synthesized
atagaaggtggagctcaagtgg

SEQ ID NO: 979389 - DNA, 22 bp, Artificial Sequence
  chemically synthesized
cagggccgccagcattaccact

SEQ ID NO: 979390 - DNA, 22 bp, Artificial Sequence
  chemically synthesized
aagtggtaatgctggcggccct

SEQ ID NO: 979391 - DNA, 22 bp, Artificial Sequence
  chemically synthesized
gcggccctgcagctcacctcct

SEQ ID NO: 979392 - DNA, 22 bp, Artificial Sequence
  chemically synthesized
ggaaccggggccccacatcagg

SEQ ID NO: 979393 - DNA, 22 bp, Artificial Sequence
  chemically synthesized
cagctcacctcctgatgtgggg

SEQ ID NO: 979394 - DNA, 22 bp, Artificial Sequence
  chemically synthesized
ttaggaaccggggccccacatc

SEQ ID NO: 979395 - DNA, 22 bp, Artificial Sequence
  chemically synthesized
acctcctgatgtggggccccgg

SEQ ID NO: 979396 - DNA, 22 bp, Artificial Sequence
  chemically synthesized
ctgatgtggggccccggttcct

SEQ ID NO: 979397 - DNA, 22 bp, Artificial Sequence
  chemically synthesized
atgtggggccccggttcctaac

SEQ ID NO: 979398 - DNA, 22 bp, Artificial Sequence
  chemically synthesized
ctaacaggtcactgacctgtac

SEQ ID NO: 979399 - DNA, 22 bp, Artificial Sequence
  chemically synthesized
gggccacagaccagtacaggtc

SEQ ID NO: 979400 - DNA, 22 bp, Artificial Sequence
  chemically synthesized
acaggtcactgacctgtactgg

SEQ ID NO: 979401 - DNA, 22 bp, Artificial Sequence
  chemically synthesized
acctgtactggtctgtggcccc

SEQ ID NO: 979402 - DNA, 22 bp, Artificial Sequence
  chemically synthesized
tactggtctgtggccccagggc

SEQ ID NO: 979403 - DNA, 22 bp, Artificial Sequence
  chemically synthesized
gtctgtggccccagggctgggg

SEQ ID NO: 979404 - DNA, 22 bp, Artificial Sequence
  chemically synthesized
tagagcaagggtccccagccct

SEQ ID NO: 979405 - DNA, 22 bp, Artificial Sequence
  chemically synthesized
tggccccagggctggggaccct

SEQ ID NO: 979406 - DNA, 22 bp, Artificial Sequence
  chemically synthesized
acactatagagcaagggtcccc

SEQ ID NO: 979407 - DNA, 22 bp, Artificial Sequence
  chemically synthesized
aacactatagagcaagggtccc

SEQ ID NO: 979408 - DNA, 22 bp, Artificial Sequence
  chemically synthesized
taacactatagagcaagggtcc

SEQ ID NO: 979409 - DNA, 22 bp, Artificial Sequence
  chemically synthesized
ttaacactatagagcaagggtc

SEQ ID NO: 979410 - DNA, 22 bp, Artificial Sequence
  chemically synthesized
gcttttaacactatagagcaag

SEQ ID NO: 979411 - DNA, 22 bp, Artificial Sequence
  chemically synthesized
ggcttttaacactatagagcaa

SEQ ID NO: 979412 - DNA, 22 bp, Artificial Sequence
  chemically synthesized
tggcttttaacactatagagca

SEQ ID NO: 979413 - DNA, 22 bp, Artificial Sequence
  chemically synthesized
ctttggcttttaacactataga

SEQ ID NO: 979414 - DNA, 22 bp, Artificial Sequence
  chemically synthesized
gggacccttgctctatagtgtt

SEQ ID NO: 979415 - DNA, 22 bp, Artificial Sequence
  chemically synthesized
cctttggcttttaacactatag

SEQ ID NO: 979416 - DNA, 22 bp, Artificial Sequence
  chemically synthesized
tcctttggcttttaacactata

SEQ ID NO: 979417 - DNA, 22 bp, Artificial Sequence
  chemically synthesized
cccgctttcctttggcttttaa

SEQ ID NO: 979418 - DNA, 22 bp, Artificial Sequence
  chemically synthesized
gctctatagtgttaaaagccaa

SEQ ID NO: 979419 - DNA, 22 bp, Artificial Sequence
  chemically synthesized
ctctatagtgttaaaagccaaa

SEQ ID NO: 979420 - DNA, 22 bp, Artificial Sequence
  chemically synthesized
tatagtgttaaaagccaaagga

SEQ ID NO: 979421 - DNA, 22 bp, Artificial Sequence
  chemically synthesized
tagtgttaaaagccaaaggaaa

SEQ ID NO: 979422 - DNA, 22 bp, Artificial Sequence
  chemically synthesized
aagtgatctgcccgctttcctt

SEQ ID NO: 979423 - DNA, 22 bp, Artificial Sequence
  chemically synthesized
aaagccaaaggaaagcgggcag

SEQ ID NO: 979424 - DNA, 22 bp, Artificial Sequence
  chemically synthesized
acctcaagtgatctgcccgctt

SEQ ID NO: 979425 - DNA, 22 bp, Artificial Sequence
  chemically synthesized
aaacgcctgacctcaagtgatc

SEQ ID NO: 979426 - DNA, 22 bp, Artificial Sequence
  chemically synthesized
atctcaaacgcctgacctcaag

SEQ ID NO: 979427 - DNA, 22 bp, Artificial Sequence
  chemically synthesized
cccagactgatctcaaacgcct

SEQ ID NO: 979428 - DNA, 22 bp, Artificial Sequence
  chemically synthesized
gaggtcaggcgtttgagatcag

SEQ ID NO: 979429 - DNA, 22 bp, Artificial Sequence
  chemically synthesized
aggtcaggcgtttgagatcagt

SEQ ID NO: 979430 - DNA, 22 bp, Artificial Sequence
  chemically synthesized
accatgttgcccagactgatct

SEQ ID NO: 979431 - DNA, 22 bp, Artificial Sequence
  chemically synthesized
caccatgttgcccagactgatc

SEQ ID NO: 979432 - DNA, 22 bp, Artificial Sequence
  chemically synthesized
gagatcagtctgggcaacatgg

SEQ ID NO: 979433 - DNA, 22 bp, Artificial Sequence
  chemically synthesized
agatcagtctgggcaacatggt

SEQ ID NO: 979434 - DNA, 22 bp, Artificial Sequence
  chemically synthesized
gtagagacagggtttcaccatg

SEQ ID NO: 979435 - DNA, 22 bp, Artificial Sequence
  chemically synthesized
agtagagacagggtttcaccat

SEQ ID NO: 979436 - DNA, 22 bp, Artificial Sequence
  chemically synthesized
tagtagagacagggtttcacca

SEQ ID NO: 979437 - DNA, 22 bp, Artificial Sequence
  chemically synthesized
ttagtagagacagggtttcacc

SEQ ID NO: 979438 - DNA, 22 bp, Artificial Sequence
  chemically synthesized
ggcaacatggtgaaaccctgtc

SEQ ID NO: 979439 - DNA, 22 bp, Artificial Sequence
  chemically synthesized
catttttagtagagacagggtt

SEQ ID NO: 979440 - DNA, 22 bp, Artificial Sequence
  chemically synthesized
gcatttttagtagagacagggt

SEQ ID NO: 979441 - DNA, 22 bp, Artificial Sequence
  chemically synthesized
tgcatttttagtagagacaggg

SEQ ID NO: 979442 - DNA, 22 bp, Artificial Sequence
  chemically synthesized
agttttgcatttttagtagaga

SEQ ID NO: 979443 - DNA, 22 bp, Artificial Sequence
  chemically synthesized
ctaagttttgcatttttagtag

SEQ ID NO: 979444 - DNA, 22 bp, Artificial Sequence
  chemically synthesized
tctctactaaaaatgcaaaact

SEQ ID NO: 979445 - DNA, 22 bp, Artificial Sequence
  chemically synthesized
tactaaaaatgcaaaacttagc

SEQ ID NO: 979446 - DNA, 22 bp, Artificial Sequence
  chemically synthesized
ctaaaaatgcaaaacttagcag

SEQ ID NO: 979447 - DNA, 22 bp, Artificial Sequence
  chemically synthesized
gcgccaccaggccctgctaagt

SEQ ID NO: 979448 - DNA, 22 bp, Artificial Sequence
  chemically synthesized
aaaatgcaaaacttagcagggc

SEQ ID NO: 979449 - DNA, 22 bp, Artificial Sequence
  chemically synthesized
tggcgccaccaggccctgctaa

SEQ ID NO: 979450 - DNA, 22 bp, Artificial Sequence
  chemically synthesized
caggtgctctggcgccaccagg

SEQ ID NO: 979451 - DNA, 22 bp, Artificial Sequence
  chemically synthesized
agcagggcctggtggcgccaga

SEQ ID NO: 979452 - DNA, 22 bp, Artificial Sequence
  chemically synthesized
gcagggcctggtggcgccagag

SEQ ID NO: 979453 - DNA, 22 bp, Artificial Sequence
  chemically synthesized
ggattacaggtgctctggcgcc

SEQ ID NO: 979454 - DNA, 22 bp, Artificial Sequence
  chemically synthesized
gtggcgccagagcacctgtaat

SEQ ID NO: 979455 - DNA, 22 bp, Artificial Sequence
  chemically synthesized
ccaagtagctgggattacaggt

SEQ ID NO: 979456 - DNA, 22 bp, Artificial Sequence
  chemically synthesized
atgccacagcctcccaagtagc

SEQ ID NO: 979457 - DNA, 22 bp, Artificial Sequence
  chemically synthesized
tcatgccacagcctcccaagta

SEQ ID NO: 979458 - DNA, 22 bp, Artificial Sequence
  chemically synthesized
taatcccagctacttgggaggc

SEQ ID NO: 979459 - DNA, 22 bp, Artificial Sequence
  chemically synthesized
aggtgattctcatgccacagcc

SEQ ID NO: 979460 - DNA, 22 bp, Artificial Sequence
  chemically synthesized
cttgggaggctgtggcatgaga

SEQ ID NO: 979461 - DNA, 22 bp, Artificial Sequence
  chemically synthesized
gggaggctgtggcatgagaatc

SEQ ID NO: 979462 - DNA, 22 bp, Artificial Sequence
  chemically synthesized
ggaggctgtggcatgagaatca

SEQ ID NO: 979463 - DNA, 22 bp, Artificial Sequence
  chemically synthesized
cgcgtcccaggttcaggtgatt

SEQ ID NO: 979464 - DNA, 22 bp, Artificial Sequence
  chemically synthesized
tggcatgagaatcacctgaacc

SEQ ID NO: 979465 - DNA, 22 bp, Artificial Sequence
  chemically synthesized
aaacctccgcgtcccaggttca

SEQ ID NO: 979466 - DNA, 22 bp, Artificial Sequence
  chemically synthesized
actgaaacctccgcgtcccagg

SEQ ID NO: 979467 - DNA, 22 bp, Artificial Sequence
  chemically synthesized
agctcactgaaacctccgcgtc

SEQ ID NO: 979468 - DNA, 22 bp, Artificial Sequence
  chemically synthesized
aacctgggacgcggaggtttca

SEQ ID NO: 979469 - DNA, 22 bp, Artificial Sequence
  chemically synthesized
ggatgatctaagctcactgaaa

SEQ ID NO: 979470 - DNA, 22 bp, Artificial Sequence
  chemically synthesized
ggacgcggaggtttcagtgagc

SEQ ID NO: 979471 - DNA, 22 bp, Artificial Sequence
  chemically synthesized
cagtgagcttagatcatcccag

SEQ ID NO: 979472 - DNA, 22 bp, Artificial Sequence
  chemically synthesized
agtgagcttagatcatcccagg

SEQ ID NO: 979473 - DNA, 22 bp, Artificial Sequence
  chemically synthesized
tcatccaggtgaagtgccctgg

SEQ ID NO: 979474 - DNA, 22 bp, Artificial Sequence
  chemically synthesized
tgtcatccaggtgaagtgccct

SEQ ID NO: 979475 - DNA, 22 bp, Artificial Sequence
  chemically synthesized
agatcatcccagggcacttcac

SEQ ID NO: 979476 - DNA, 22 bp, Artificial Sequence
  chemically synthesized
gatcatcccagggcacttcacc

SEQ ID NO: 979477 - DNA, 22 bp, Artificial Sequence
  chemically synthesized
actctgtcatccaggtgaagtg

SEQ ID NO: 979478 - DNA, 22 bp, Artificial Sequence
  chemically synthesized
tctcactctgtcatccaggtga

SEQ ID NO: 979479 - DNA, 22 bp, Artificial Sequence
  chemically synthesized
actgtctcactctgtcatccag

SEQ ID NO: 979480 - DNA, 22 bp, Artificial Sequence
  chemically synthesized
aactgtctcactctgtcatcca

SEQ ID NO: 979481 - DNA, 22 bp, Artificial Sequence
  chemically synthesized
taactgtctcactctgtcatcc

SEQ ID NO: 979482 - DNA, 22 bp, Artificial Sequence
  chemically synthesized
ttaactgtctcactctgtcatc

SEQ ID NO: 979483 - DNA, 22 bp, Artificial Sequence
  chemically synthesized
tttaactgtctcactctgtcat

SEQ ID NO: 979484 - DNA, 22 bp, Artificial Sequence
  chemically synthesized
ttttaactgtctcactctgtca

SEQ ID NO: 979485 - DNA, 22 bp, Artificial Sequence
  chemically synthesized
tttttaactgtctcactctgtc

SEQ ID NO: 979486 - DNA, 22 bp, Artificial Sequence
  chemically synthesized
ttttttaactgtctcactctgt

SEQ ID NO: 979487 - DNA, 22 bp, Artificial Sequence
  chemically synthesized
tttttttaactgtctcactctg

SEQ ID NO: 979488 - DNA, 22 bp, Artificial Sequence
  chemically synthesized
cacctggatgacagagtgagac

SEQ ID NO: 979489 - DNA, 22 bp, Artificial Sequence
  chemically synthesized
ttttttttaactgtctcactct

SEQ ID NO: 979490 - DNA, 22 bp, Artificial Sequence
  chemically synthesized
acctggatgacagagtgagaca

SEQ ID NO: 979491 - DNA, 22 bp, Artificial Sequence
  chemically synthesized
tttttttttaactgtctcactc

SEQ ID NO: 979492 - DNA, 22 bp, Artificial Sequence
  chemically synthesized
ttttttttttaactgtctcact

SEQ ID NO: 979493 - DNA, 22 bp, Artificial Sequence
  chemically synthesized
tttttttttttaactgtctcac

SEQ ID NO: 979494 - DNA, 22 bp, Artificial Sequence
  chemically synthesized
ttttttttttttaactgtctca

SEQ ID NO: 979495 - DNA, 22 bp, Artificial Sequence
  chemically synthesized
tttttttttttttaactgtctc

SEQ ID NO: 979496 - DNA, 22 bp, Artificial Sequence
  chemically synthesized
gatgacagagtgagacagttaa

SEQ ID NO: 979497 - DNA, 22 bp, Artificial Sequence
  chemically synthesized
ttttttttttttttaactgtct

SEQ ID NO: 979498 - DNA, 22 bp, Artificial Sequence
  chemically synthesized
tttttttttttttttaactgtc

SEQ ID NO: 979499 - DNA, 22 bp, Artificial Sequence
  chemically synthesized
ttttttttttttttttaactgt

SEQ ID NO: 979500 - DNA, 22 bp, Artificial Sequence
  chemically synthesized
gcttttttttttttttttttaa

SEQ ID NO: 979501 - DNA, 22 bp, Artificial Sequence
  chemically synthesized
ggctttttttttttttttttta

SEQ ID NO: 979502 - DNA, 22 bp, Artificial Sequence
  chemically synthesized
tggctttttttttttttttttt

SEQ ID NO: 979503 - DNA, 22 bp, Artificial Sequence
  chemically synthesized
ttggcttttttttttttttttt

SEQ ID NO: 979504 - DNA, 22 bp, Artificial Sequence
  chemically synthesized
atccttttggcttttttttttt

SEQ ID NO: 979505 - DNA, 22 bp, Artificial Sequence
  chemically synthesized
taatccttttggcttttttttt

SEQ ID NO: 979506 - DNA, 22 bp, Artificial Sequence
  chemically synthesized
aaaaaaaaaaaaaaaaagccaa

SEQ ID NO: 979507 - DNA, 22 bp, Artificial Sequence
  chemically synthesized
tgctctaatccttttggctttt

SEQ ID NO: 979508 - DNA, 22 bp, Artificial Sequence
  chemically synthesized
tgtgctctaatccttttggctt

SEQ ID NO: 979509 - DNA, 22 bp, Artificial Sequence
  chemically synthesized
ccaatcctctgtgctctaatcc

SEQ ID NO: 979510 - DNA, 22 bp, Artificial Sequence
  chemically synthesized
aagactgccaatcctctgtgct

SEQ ID NO: 979511 - DNA, 22 bp, Artificial Sequence
  chemically synthesized
tcaagactgccaatcctctgtg

SEQ ID NO: 979512 - DNA, 22 bp, Artificial Sequence
  chemically synthesized
gttctcaagactgccaatcctc

SEQ ID NO: 979513 - DNA, 22 bp, Artificial Sequence
  chemically synthesized
gagcacagaggattggcagtct

SEQ ID NO: 979514 - DNA, 22 bp, Artificial Sequence
  chemically synthesized
cgttagttctcaagactgccaa

SEQ ID NO: 979515 - DNA, 22 bp, Artificial Sequence
  chemically synthesized
caaatagggttacgttagttct

SEQ ID NO: 979516 - DNA, 22 bp, Artificial Sequence
  chemically synthesized
gcaaatagggttacgttagttc

SEQ ID NO: 979517 - DNA, 22 bp, Artificial Sequence
  chemically synthesized
gcagtcttgagaactaacgtaa

SEQ ID NO: 979518 - DNA, 22 bp, Artificial Sequence
  chemically synthesized
tcaccttgcaaatagggttacg

SEQ ID NO: 979519 - DNA, 22 bp, Artificial Sequence
  chemically synthesized
gagaactaacgtaaccctattt

SEQ ID NO: 979520 - DNA, 22 bp, Artificial Sequence
  chemically synthesized
agaactaacgtaaccctatttg

SEQ ID NO: 979521 - DNA, 22 bp, Artificial Sequence
  chemically synthesized
acgtaaccctatttgcaaggtg

SEQ ID NO: 979522 - DNA, 22 bp, Artificial Sequence
  chemically synthesized
aatatacatactgtcaccttgc

SEQ ID NO: 979523 - DNA, 22 bp, Artificial Sequence
  chemically synthesized
tttgcaaggtgacagtatgtat

SEQ ID NO: 979524 - DNA, 22 bp, Artificial Sequence
  chemically synthesized
atacagttcaatatacatactg

SEQ ID NO: 979525 - DNA, 22 bp, Artificial Sequence
  chemically synthesized
gcaaggtgacagtatgtatatt

SEQ ID NO: 979526 - DNA, 22 bp, Artificial Sequence
  chemically synthesized
caaggtgacagtatgtatattg

SEQ ID NO: 979527 - DNA, 22 bp, Artificial Sequence
  chemically synthesized
cggacctgatacagttcaatat

SEQ ID NO: 979528 - DNA, 22 bp, Artificial Sequence
  chemically synthesized
cattgcggacctgatacagttc

SEQ ID NO: 979529 - DNA, 22 bp, Artificial Sequence
  chemically synthesized
tacgaaaggctgcattgcggac

SEQ ID NO: 979530 - DNA, 22 bp, Artificial Sequence
  chemically synthesized
aactgtatcaggtccgcaatgc

SEQ ID NO: 979531 - DNA, 22 bp, Artificial Sequence
  chemically synthesized
gttatacgaaaggctgcattgc

SEQ ID NO: 979532 - DNA, 22 bp, Artificial Sequence
  chemically synthesized
tatcaggtccgcaatgcagcct

SEQ ID NO: 979533 - DNA, 22 bp, Artificial Sequence
  chemically synthesized
ggagcctagttatacgaaaggc

SEQ ID NO: 979534 - DNA, 22 bp, Artificial Sequence
  chemically synthesized
gcatacaaccgcactaggagcc

SEQ ID NO: 979535 - DNA, 22 bp, Artificial Sequence
  chemically synthesized
tcgtataactaggctcctagtg

SEQ ID NO: 979536 - DNA, 22 bp, Artificial Sequence
  chemically synthesized
cgtataactaggctcctagtgc

SEQ ID NO: 979537 - DNA, 22 bp, Artificial Sequence
  chemically synthesized
gtataactaggctcctagtgcg

SEQ ID NO: 979538 - DNA, 22 bp, Artificial Sequence
  chemically synthesized
ggattagcatacaaccgcacta

SEQ ID NO: 979539 - DNA, 22 bp, Artificial Sequence
  chemically synthesized
ggctcctagtgcggttgtatgc

SEQ ID NO: 979540 - DNA, 22 bp, Artificial Sequence
  chemically synthesized
ggactaggattagcatacaacc

SEQ ID NO: 979541 - DNA, 22 bp, Artificial Sequence
  chemically synthesized
aggactaggattagcatacaac

SEQ ID NO: 979542 - DNA, 22 bp, Artificial Sequence
  chemically synthesized
taggactaggattagcatacaa

SEQ ID NO: 979543 - DNA, 22 bp, Artificial Sequence
  chemically synthesized
ctagtgcggttgtatgctaatc

SEQ ID NO: 979544 - DNA, 22 bp, Artificial Sequence
  chemically synthesized
gttttaggactaggattagcat

SEQ ID NO: 979545 - DNA, 22 bp, Artificial Sequence
  chemically synthesized
ggttttaggactaggattagca

SEQ ID NO: 979546 - DNA, 22 bp, Artificial Sequence
  chemically synthesized
gtgcggttgtatgctaatccta

SEQ ID NO: 979547 - DNA, 22 bp, Artificial Sequence
  chemically synthesized
atcttggttttaggactaggat

SEQ ID NO: 979548 - DNA, 22 bp, Artificial Sequence
  chemically synthesized
cctaatcttggttttaggacta

SEQ ID NO: 979549 - DNA, 22 bp, Artificial Sequence
  chemically synthesized
tatgctaatcctagtcctaaaa

SEQ ID NO: 979550 - DNA, 22 bp, Artificial Sequence
  chemically synthesized
gcctaatcttggttttaggact

SEQ ID NO: 979551 - DNA, 22 bp, Artificial Sequence
  chemically synthesized
tgcctaatcttggttttaggac

SEQ ID NO: 979552 - DNA, 22 bp, Artificial Sequence
  chemically synthesized
ttgcctaatcttggttttagga

SEQ ID NO: 979553 - DNA, 22 bp, Artificial Sequence
  chemically synthesized
tttttgcctaatcttggtttta

SEQ ID NO: 979554 - DNA, 22 bp, Artificial Sequence
  chemically synthesized
atcctagtcctaaaaccaagat

SEQ ID NO: 979555 - DNA, 22 bp, Artificial Sequence
  chemically synthesized
aagtctgtttttgcctaatctt

SEQ ID NO: 979556 - DNA, 22 bp, Artificial Sequence
  chemically synthesized
gtcctaaaaccaagattaggca

SEQ ID NO: 979557 - DNA, 22 bp, Artificial Sequence
  chemically synthesized
aaaccaagattaggcaaaaaca

SEQ ID NO: 979558 - DNA, 22 bp, Artificial Sequence
  chemically synthesized
aaatgaatctcaagtctgtttt

SEQ ID NO: 979559 - DNA, 22 bp, Artificial Sequence
  chemically synthesized
actcaaatgaatctcaagtctg

SEQ ID NO: 979560 - DNA, 22 bp, Artificial Sequence
  chemically synthesized
gactcaaatgaatctcaagtct

SEQ ID NO: 979561 - DNA, 22 bp, Artificial Sequence
  chemically synthesized
ggcaaaaacagacttgagattc

SEQ ID NO: 979562 - DNA, 22 bp, Artificial Sequence
  chemically synthesized
agtaatgggaccttgactcaaa

SEQ ID NO: 979563 - DNA, 22 bp, Artificial Sequence
  chemically synthesized
ctgagtaatgggaccttgactc

SEQ ID NO: 979564 - DNA, 22 bp, Artificial Sequence
  chemically synthesized
gagattcatttgagtcaaggtc

SEQ ID NO: 979565 - DNA, 22 bp, Artificial Sequence
  chemically synthesized
agattcatttgagtcaaggtcc

SEQ ID NO: 979566 - DNA, 22 bp, Artificial Sequence
  chemically synthesized
atttgagtcaaggtcccattac

SEQ ID NO: 979567 - DNA, 22 bp, Artificial Sequence
  chemically synthesized
aggagttactgagtaatgggac

SEQ ID NO: 979568 - DNA, 22 bp, Artificial Sequence
  chemically synthesized
gagtcaaggtcccattactcag

SEQ ID NO: 979569 - DNA, 22 bp, Artificial Sequence
  chemically synthesized
agtcaaggtcccattactcagt

SEQ ID NO: 979570 - DNA, 22 bp, Artificial Sequence
  chemically synthesized
atctcaggagttactgagtaat

SEQ ID NO: 979571 - DNA, 22 bp, Artificial Sequence
  chemically synthesized
tgttcatctcaggagttactga

SEQ ID NO: 979572 - DNA, 22 bp, Artificial Sequence
  chemically synthesized
ctcagtaactcctgagatgaac

SEQ ID NO: 979573 - DNA, 22 bp, Artificial Sequence
  chemically synthesized
tatatgggcattgtgttcatct

SEQ ID NO: 979574 - DNA, 22 bp, Artificial Sequence
  chemically synthesized
agtaactcctgagatgaacaca

SEQ ID NO: 979575 - DNA, 22 bp, Artificial Sequence
  chemically synthesized
gttatatatgggcattgtgttc

SEQ ID NO: 979576 - DNA, 22 bp, Artificial Sequence
  chemically synthesized
ctgagatgaacacaatgcccat

SEQ ID NO: 979577 - DNA, 22 bp, Artificial Sequence
  chemically synthesized
agatgaacacaatgcccatata

SEQ ID NO: 979578 - DNA, 22 bp, Artificial Sequence
  chemically synthesized
ggatctccggtgtaccctcatc

SEQ ID NO: 979579 - DNA, 22 bp, Artificial Sequence
  chemically synthesized
cggtgtaccctcatcttctgat

SEQ ID NO: 979580 - DNA, 22 bp, Artificial Sequence
  chemically synthesized
atcttctgatactgcctccttc

SEQ ID NO: 979581 - DNA, 22 bp, Artificial Sequence
  chemically synthesized
ctgatactgcctccttctcatt

SEQ ID NO: 979582 - DNA, 22 bp, Artificial Sequence
  chemically synthesized
tgatactgcctccttctcattt

SEQ ID NO: 979583 - DNA, 22 bp, Artificial Sequence
  chemically synthesized
atactgcctccttctcatttgc

SEQ ID NO: 979584 - DNA, 22 bp, Artificial Sequence
  chemically synthesized
cctccttctcatttgccttgtc

SEQ ID NO: 979585 - DNA, 22 bp, Artificial Sequence
  chemically synthesized
cttctcatttgccttgtccact

SEQ ID NO: 979586 - DNA, 22 bp, Artificial Sequence
  chemically synthesized
ctcatttgccttgtccactgtg

SEQ ID NO: 979587 - DNA, 22 bp, Artificial Sequence
  chemically synthesized
tcatttgccttgtccactgtga

SEQ ID NO: 979588 - DNA, 22 bp, Artificial Sequence
  chemically synthesized
atttgccttgtccactgtgatg

SEQ ID NO: 979589 - DNA, 22 bp, Artificial Sequence
  chemically synthesized
gccttgtccactgtgatgtggc

SEQ ID NO: 979590 - DNA, 22 bp, Artificial Sequence
  chemically synthesized
ccttgtccactgtgatgtggcc

SEQ ID NO: 979591 - DNA, 22 bp, Artificial Sequence
  chemically synthesized
gtccactgtgatgtggcccttt

SEQ ID NO: 979592 - DNA, 22 bp, Artificial Sequence
  chemically synthesized
catggaagacagaaagggccac

SEQ ID NO: 979593 - DNA, 22 bp, Artificial Sequence
  chemically synthesized
tccactgtgatgtggccctttc

SEQ ID NO: 979594 - DNA, 22 bp, Artificial Sequence
  chemically synthesized
tgatgtggccctttctgtcttc

SEQ ID NO: 979595 - DNA, 22 bp, Artificial Sequence
  chemically synthesized
tgcatctacatggaagacagaa

SEQ ID NO: 979596 - DNA, 22 bp, Artificial Sequence
  chemically synthesized
atgcatctacatggaagacaga

SEQ ID NO: 979597 - DNA, 22 bp, Artificial Sequence
  chemically synthesized
tatgcatctacatggaagacag

SEQ ID NO: 979598 - DNA, 22 bp, Artificial Sequence
  chemically synthesized
tctgtcttccatgtagatgcat

SEQ ID NO: 979599 - DNA, 22 bp, Artificial Sequence
  chemically synthesized
gtatagggctttatgcatctac

SEQ ID NO: 979600 - DNA, 22 bp, Artificial Sequence
  chemically synthesized
ctgtcttccatgtagatgcata

SEQ ID NO: 979601 - DNA, 22 bp, Artificial Sequence
  chemically synthesized
ggtatagggctttatgcatcta

SEQ ID NO: 979602 - DNA, 22 bp, Artificial Sequence
  chemically synthesized
tgtcttccatgtagatgcataa

SEQ ID NO: 979603 - DNA, 22 bp, Artificial Sequence
  chemically synthesized
tcttccatgtagatgcataaag

SEQ ID NO: 979604 - DNA, 22 bp, Artificial Sequence
  chemically synthesized
ccatgtagatgcataaagccct

SEQ ID NO: 979605 - DNA, 22 bp, Artificial Sequence
  chemically synthesized
catgtagatgcataaagcccta

SEQ ID NO: 979606 - DNA, 22 bp, Artificial Sequence
  chemically synthesized
cagtgcttggtatagggcttta

SEQ ID NO: 979607 - DNA, 22 bp, Artificial Sequence
  chemically synthesized
gcagtgcttggtatagggcttt

SEQ ID NO: 979608 - DNA, 22 bp, Artificial Sequence
  chemically synthesized
tatgtttgcagtgcttggtata

SEQ ID NO: 979609 - DNA, 22 bp, Artificial Sequence
  chemically synthesized
agctatatgtttgcagtgcttg

SEQ ID NO: 979610 - DNA, 22 bp, Artificial Sequence
  chemically synthesized
tcagctatatgtttgcagtgct

SEQ ID NO: 979611 - DNA, 22 bp, Artificial Sequence
  chemically synthesized
ctcagctatatgtttgcagtgc

SEQ ID NO: 979612 - DNA, 22 bp, Artificial Sequence
  chemically synthesized
taccaagcactgcaaacatata

SEQ ID NO: 979613 - DNA, 22 bp, Artificial Sequence
  chemically synthesized
aggaccttctcagctatatgtt

SEQ ID NO: 979614 - DNA, 22 bp, Artificial Sequence
  chemically synthesized
gaggctgaggaccttctcagct

SEQ ID NO: 979615 - DNA, 22 bp, Artificial Sequence
  chemically synthesized
tggaggctgaggaccttctcag

SEQ ID NO: 979616 - DNA, 22 bp, Artificial Sequence
  chemically synthesized
caaacatatagctgagaaggtc

SEQ ID NO: 979617 - DNA, 22 bp, Artificial Sequence
  chemically synthesized
ctggaggctgaggaccttctca

SEQ ID NO: 979618 - DNA, 22 bp, Artificial Sequence
  chemically synthesized
agaaggtcctcagcctccagaa

SEQ ID NO: 979619 - DNA, 22 bp, Artificial Sequence
  chemically synthesized
agacaaaagtaagtttctggag

SEQ ID NO: 979620 - DNA, 22 bp, Artificial Sequence
  chemically synthesized
agcctccagaaacttacttttg

SEQ ID NO: 979621 - DNA, 22 bp, Artificial Sequence
  chemically synthesized
cagaaacttacttttgtcttaa

SEQ ID NO: 979622 - DNA, 22 bp, Artificial Sequence
  chemically synthesized
acttttgtcttaaccacatctg

SEQ ID NO: 979623 - DNA, 22 bp, Artificial Sequence
  chemically synthesized
cttttgtcttaaccacatctga

SEQ ID NO: 979624 - DNA, 22 bp, Artificial Sequence
  chemically synthesized
ttgtcttaaccacatctgattg

SEQ ID NO: 979625 - DNA, 22 bp, Artificial Sequence
  chemically synthesized
tgtcttaaccacatctgattga

SEQ ID NO: 979626 - DNA, 22 bp, Artificial Sequence
  chemically synthesized
gtcttaaccacatctgattgat

SEQ ID NO: 979627 - DNA, 22 bp, Artificial Sequence
  chemically synthesized
tcttaaccacatctgattgatg

SEQ ID NO: 979628 - DNA, 22 bp, Artificial Sequence
  chemically synthesized
aaccacatctgattgatgttta

SEQ ID NO: 979629 - DNA, 22 bp, Artificial Sequence
  chemically synthesized
accacatctgattgatgtttat

SEQ ID NO: 979630 - DNA, 22 bp, Artificial Sequence
  chemically synthesized
gcataaagacccatagataaac

SEQ ID NO: 979631 - DNA, 22 bp, Artificial Sequence
  chemically synthesized
attgatgtttatctatgggtct

SEQ ID NO: 979632 - DNA, 22 bp, Artificial Sequence
  chemically synthesized
atgtttatctatgggtctttat

SEQ ID NO: 979633 - DNA, 22 bp, Artificial Sequence
  chemically synthesized
atctatgggtctttatgcgaac

SEQ ID NO: 979634 - DNA, 22 bp, Artificial Sequence
  chemically synthesized
tctatgggtctttatgcgaact

SEQ ID NO: 979635 - DNA, 22 bp, Artificial Sequence
  chemically synthesized
agaaagaagaaacagttcgcat

SEQ ID NO: 979636 - DNA, 22 bp, Artificial Sequence
  chemically synthesized
tgggtctttatgcgaactgttt

SEQ ID NO: 979637 - DNA, 22 bp, Artificial Sequence
  chemically synthesized
tatgcgaactgtttcttctttc

SEQ ID NO: 979638 - DNA, 22 bp, Artificial Sequence
  chemically synthesized
atgcgaactgtttcttctttct

SEQ ID NO: 979639 - DNA, 22 bp, Artificial Sequence
  chemically synthesized
tgcgaactgtttcttctttctg

SEQ ID NO: 979640 - DNA, 22 bp, Artificial Sequence
  chemically synthesized
tttcttctttctgaattaccct

SEQ ID NO: 979641 - DNA, 22 bp, Artificial Sequence
  chemically synthesized
cttctttctgaattacccttcc

SEQ ID NO: 979642 - DNA, 22 bp, Artificial Sequence
  chemically synthesized
ttctttctgaattacccttccc

SEQ ID NO: 979643 - DNA, 22 bp, Artificial Sequence
  chemically synthesized
ctttctgaattacccttccctg

SEQ ID NO: 979644 - DNA, 22 bp, Artificial Sequence
  chemically synthesized
tttctgaattacccttccctgc

SEQ ID NO: 979645 - DNA, 22 bp, Artificial Sequence
  chemically synthesized
tctgaattacccttccctgctt

SEQ ID NO: 979646 - DNA, 22 bp, Artificial Sequence
  chemically synthesized
ctgaattacccttccctgcttt

SEQ ID NO: 979647 - DNA, 22 bp, Artificial Sequence
  chemically synthesized
tgaattacccttccctgctttc

SEQ ID NO: 979648 - DNA, 22 bp, Artificial Sequence
  chemically synthesized
aattacccttccctgctttcat

SEQ ID NO: 979649 - DNA, 22 bp, Artificial Sequence
  chemically synthesized
cccttccctgctttcattcttc

SEQ ID NO: 979650 - DNA, 22 bp, Artificial Sequence
  chemically synthesized
ccctgctttcattcttcatttt

SEQ ID NO: 979651 - DNA, 22 bp, Artificial Sequence
  chemically synthesized
cctgctttcattcttcattttg

SEQ ID NO: 979652 - DNA, 22 bp, Artificial Sequence
  chemically synthesized
tggaatcagtcccaaaatgaag

SEQ ID NO: 979653 - DNA, 22 bp, Artificial Sequence
  chemically synthesized
ctttcattcttcattttgggac

SEQ ID NO: 979654 - DNA, 22 bp, Artificial Sequence
  chemically synthesized
tcattcttcattttgggactga

SEQ ID NO: 979655 - DNA, 22 bp, Artificial Sequence
  chemically synthesized
cattcttcattttgggactgat

SEQ ID NO: 979656 - DNA, 22 bp, Artificial Sequence
  chemically synthesized
attcttcattttgggactgatt

SEQ ID NO: 979657 - DNA, 22 bp, Artificial Sequence
  chemically synthesized
ttcattttgggactgattccac

SEQ ID NO: 979658 - DNA, 22 bp, Artificial Sequence
  chemically synthesized
cattttgggactgattccacag

SEQ ID NO: 979659 - DNA, 22 bp, Artificial Sequence
  chemically synthesized
attttgggactgattccacagc

SEQ ID NO: 979660 - DNA, 22 bp, Artificial Sequence
  chemically synthesized
tgggactgattccacagccctg

SEQ ID NO: 979661 - DNA, 22 bp, Artificial Sequence
  chemically synthesized
gggactgattccacagccctgg

SEQ ID NO: 979662 - DNA, 22 bp, Artificial Sequence
  chemically synthesized
ggactgattccacagccctggg

SEQ ID NO: 979663 - DNA, 22 bp, Artificial Sequence
  chemically synthesized
attccacagccctgggtggcca

SEQ ID NO: 979664 - DNA, 22 bp, Artificial Sequence
  chemically synthesized
cacagccctgggtggccatcac

SEQ ID NO: 979665 - DNA, 22 bp, Artificial Sequence
  chemically synthesized
aaaagggtgaccacagggtgtg

SEQ ID NO: 979666 - DNA, 22 bp, Artificial Sequence
  chemically synthesized
ggtggccatcacaccctgtggt

SEQ ID NO: 979667 - DNA, 22 bp, Artificial Sequence
  chemically synthesized
tgcactgaaaagggtgaccaca

SEQ ID NO: 979668 - DNA, 22 bp, Artificial Sequence
  chemically synthesized
caagactgtgcactgaaaaggg

SEQ ID NO: 979669 - DNA, 22 bp, Artificial Sequence
  chemically synthesized
tggtcacccttttcagtgcaca

SEQ ID NO: 979670 - DNA, 22 bp, Artificial Sequence
  chemically synthesized
tataatcaagtaattgcaagac

SEQ ID NO: 979671 - DNA, 22 bp, Artificial Sequence
  chemically synthesized
ttcagtgcacagtcttgcaatt

SEQ ID NO: 979672 - DNA, 22 bp, Artificial Sequence
  chemically synthesized
tcagtgcacagtcttgcaatta

SEQ ID NO: 979673 - DNA, 22 bp, Artificial Sequence
  chemically synthesized
cagtgcacagtcttgcaattac

SEQ ID NO: 979674 - DNA, 22 bp, Artificial Sequence
  chemically synthesized
agtgcacagtcttgcaattact

SEQ ID NO: 979675 - DNA, 22 bp, Artificial Sequence
  chemically synthesized
gcaattacttgattatacagct

SEQ ID NO: 979676 - DNA, 22 bp, Artificial Sequence
  chemically synthesized
aggtggcaagtcagctgtataa

SEQ ID NO: 979677 - DNA, 22 bp, Artificial Sequence
  chemically synthesized
caattacttgattatacagctg

SEQ ID NO: 979678 - DNA, 22 bp, Artificial Sequence
  chemically synthesized
gttgaggtggcaagtcagctgt

SEQ ID NO: 979679 - DNA, 22 bp, Artificial Sequence
  chemically synthesized
cttgattatacagctgacttgc

SEQ ID NO: 979680 - DNA, 22 bp, Artificial Sequence
  chemically synthesized
ctagttgaggtggcaagtcagc

SEQ ID NO: 979681 - DNA, 22 bp, Artificial Sequence
  chemically synthesized
gattatacagctgacttgccac

SEQ ID NO: 979682 - DNA, 22 bp, Artificial Sequence
  chemically synthesized
attatacagctgacttgccacc

SEQ ID NO: 979683 - DNA, 22 bp, Artificial Sequence
  chemically synthesized
tacagctgacttgccacctcaa

SEQ ID NO: 979684 - DNA, 22 bp, Artificial Sequence
  chemically synthesized
aaccagctcctagttgaggtgg

SEQ ID NO: 979685 - DNA, 22 bp, Artificial Sequence
  chemically synthesized
caaccagctcctagttgaggtg

SEQ ID NO: 979686 - DNA, 22 bp, Artificial Sequence
  chemically synthesized
ccttcaaccagctcctagttga

SEQ ID NO: 979687 - DNA, 22 bp, Artificial Sequence
  chemically synthesized
acttgccacctcaactaggagc

SEQ ID NO: 979688 - DNA, 22 bp, Artificial Sequence
  chemically synthesized
gccacctcaactaggagctggt

SEQ ID NO: 979689 - DNA, 22 bp, Artificial Sequence
  chemically synthesized
ccacctcaactaggagctggtt

SEQ ID NO: 979690 - DNA, 22 bp, Artificial Sequence
  chemically synthesized
aactaggagctggttgaaggga

SEQ ID NO: 979691 - DNA, 22 bp, Artificial Sequence
  chemically synthesized
ggagctggttgaagggaggggc

SEQ ID NO: 979692 - DNA, 22 bp, Artificial Sequence
  chemically synthesized
gttgaagggaggggctgtgtct

SEQ ID NO: 979693 - DNA, 22 bp, Artificial Sequence
  chemically synthesized
aagggaggggctgtgtctttca

SEQ ID NO: 979694 - DNA, 22 bp, Artificial Sequence
  chemically synthesized
gtgataaagagatgaaagacac

SEQ ID NO: 979695 - DNA, 22 bp, Artificial Sequence
  chemically synthesized
tgcaatatgctggtgataaaga

SEQ ID NO: 979696 - DNA, 22 bp, Artificial Sequence
  chemically synthesized
tgtctttcatctctttatcacc

SEQ ID NO: 979697 - DNA, 22 bp, Artificial Sequence
  chemically synthesized
tcatctctttatcaccagcata

SEQ ID NO: 979698 - DNA, 22 bp, Artificial Sequence
  chemically synthesized
catctctttatcaccagcatat

SEQ ID NO: 979699 - DNA, 22 bp, Artificial Sequence
  chemically synthesized
atctctttatcaccagcatatt

SEQ ID NO: 979700 - DNA, 22 bp, Artificial Sequence
  chemically synthesized
taggtaggaactgtgcaatatg

SEQ ID NO: 979701 - DNA, 22 bp, Artificial Sequence
  chemically synthesized
tttatcaccagcatattgcaca

SEQ ID NO: 979702 - DNA, 22 bp, Artificial Sequence
  chemically synthesized
tatcaccagcatattgcacagt

SEQ ID NO: 979703 - DNA, 22 bp, Artificial Sequence
  chemically synthesized
atcaccagcatattgcacagtt

SEQ ID NO: 979704 - DNA, 22 bp, Artificial Sequence
  chemically synthesized
tcaccagcatattgcacagttc

SEQ ID NO: 979705 - DNA, 22 bp, Artificial Sequence
  chemically synthesized
tcaactataggtaggaactgtg

SEQ ID NO: 979706 - DNA, 22 bp, Artificial Sequence
  chemically synthesized
tcaactatcaactataggtagg

SEQ ID NO: 979707 - DNA, 22 bp, Artificial Sequence
  chemically synthesized
cacagttcctacctatagttga

SEQ ID NO: 979708 - DNA, 22 bp, Artificial Sequence
  chemically synthesized
atcaaaagttatcaactatcaa

SEQ ID NO: 979709 - DNA, 22 bp, Artificial Sequence
  chemically synthesized
ctacctatagttgatagttgat

SEQ ID NO: 979710 - DNA, 22 bp, Artificial Sequence
  chemically synthesized
attcatcaaaagttatcaacta

SEQ ID NO: 979711 - DNA, 22 bp, Artificial Sequence
  chemically synthesized
cctatagttgatagttgataac

SEQ ID NO: 979712 - DNA, 22 bp, Artificial Sequence
  chemically synthesized
attcattcatcaaaagttatca

SEQ ID NO: 979713 - DNA, 22 bp, Artificial Sequence
  chemically synthesized
tagttgatagttgataactttt

SEQ ID NO: 979714 - DNA, 22 bp, Artificial Sequence
  chemically synthesized
gttcattcattcatcaaaagtt

SEQ ID NO: 979715 - DNA, 22 bp, Artificial Sequence
  chemically synthesized
tcgttcattcattcatcaaaag

SEQ ID NO: 979716 - DNA, 22 bp, Artificial Sequence
  chemically synthesized
atagttgataacttttgatgaa

SEQ ID NO: 979717 - DNA, 22 bp, Artificial Sequence
  chemically synthesized
attctcgttcattcattcatca

SEQ ID NO: 979718 - DNA, 22 bp, Artificial Sequence
  chemically synthesized
ataacttttgatgaatgaatga

SEQ ID NO: 979719 - DNA, 22 bp, Artificial Sequence
  chemically synthesized
atgtctgattctcgttcattca

SEQ ID NO: 979720 - DNA, 22 bp, Artificial Sequence
  chemically synthesized
aatgtctgattctcgttcattc

SEQ ID NO: 979721 - DNA, 22 bp, Artificial Sequence
  chemically synthesized
ttgatgaatgaatgaacgagaa

SEQ ID NO: 979722 - DNA, 22 bp, Artificial Sequence
  chemically synthesized
tgatgaatgaatgaacgagaat

SEQ ID NO: 979723 - DNA, 22 bp, Artificial Sequence
  chemically synthesized
gatgaatgaatgaacgagaatc

SEQ ID NO: 979724 - DNA, 22 bp, Artificial Sequence
  chemically synthesized
atgaatgaatgaacgagaatca

SEQ ID NO: 979725 - DNA, 22 bp, Artificial Sequence
  chemically synthesized
aaaatttaatgtctgattctcg

SEQ ID NO: 979726 - DNA, 22 bp, Artificial Sequence
  chemically synthesized
tgaaaatttaatgtctgattct

SEQ ID NO: 979727 - DNA, 22 bp, Artificial Sequence
  chemically synthesized
ctgaaaatttaatgtctgattc

SEQ ID NO: 979728 - DNA, 22 bp, Artificial Sequence
  chemically synthesized
cttctgaaaatttaatgtctga

SEQ ID NO: 979729 - DNA, 22 bp, Artificial Sequence
  chemically synthesized
ccttctgaaaatttaatgtctg

SEQ ID NO: 979730 - DNA, 22 bp, Artificial Sequence
  chemically synthesized
tccttctgaaaatttaatgtct

SEQ ID NO: 979731 - DNA, 22 bp, Artificial Sequence
  chemically synthesized
ttccttctgaaaatttaatgtc

SEQ ID NO: 979732 - DNA, 22 bp, Artificial Sequence
  chemically synthesized
tttccttctgaaaatttaatgt

SEQ ID NO: 979733 - DNA, 22 bp, Artificial Sequence
  chemically synthesized
ttttttccttctgaaaatttaa

SEQ ID NO: 979734 - DNA, 22 bp, Artificial Sequence
  chemically synthesized
aggataaactgttttttccttc

SEQ ID NO: 979735 - DNA, 22 bp, Artificial Sequence
  chemically synthesized
aaggataaactgttttttcctt

SEQ ID NO: 979736 - DNA, 22 bp, Artificial Sequence
  chemically synthesized
aattttcagaaggaaaaaacag

SEQ ID NO: 979737 - DNA, 22 bp, Artificial Sequence
  chemically synthesized
tttaaggataaactgttttttc

SEQ ID NO: 979738 - DNA, 22 bp, Artificial Sequence
  chemically synthesized
gtttaaggataaactgtttttt

SEQ ID NO: 979739 - DNA, 22 bp, Artificial Sequence
  chemically synthesized
tcagaaggaaaaaacagtttat

SEQ ID NO: 979740 - DNA, 22 bp, Artificial Sequence
  chemically synthesized
cagaaggaaaaaacagtttatc

SEQ ID NO: 979741 - DNA, 22 bp, Artificial Sequence
  chemically synthesized
agaaggaaaaaacagtttatcc

SEQ ID NO: 979742 - DNA, 22 bp, Artificial Sequence
  chemically synthesized
aatccagacacatttgtttaag

SEQ ID NO: 979743 - DNA, 22 bp, Artificial Sequence
  chemically synthesized
tgaatccagacacatttgttta

SEQ ID NO: 979744 - DNA, 22 bp, Artificial Sequence
  chemically synthesized
ctgaatccagacacatttgttt

SEQ ID NO: 979745 - DNA, 22 bp, Artificial Sequence
  chemically synthesized
ttctgaatccagacacatttgt

SEQ ID NO: 979746 - DNA, 22 bp, Artificial Sequence
  chemically synthesized
atccttaaacaaatgtgtctgg

SEQ ID NO: 979747 - DNA, 22 bp, Artificial Sequence
  chemically synthesized
tccttaaacaaatgtgtctgga

SEQ ID NO: 979748 - DNA, 22 bp, Artificial Sequence
  chemically synthesized
aaacaaatgtgtctggattcag

SEQ ID NO: 979749 - DNA, 22 bp, Artificial Sequence
  chemically synthesized
aacaaatgtgtctggattcaga

SEQ ID NO: 979750 - DNA, 22 bp, Artificial Sequence
  chemically synthesized
gattcagaagaatcattttccc

SEQ ID NO: 979751 - DNA, 22 bp, Artificial Sequence
  chemically synthesized
tgagcataaagtcgaagggaaa

SEQ ID NO: 979752 - DNA, 22 bp, Artificial Sequence
  chemically synthesized
agaagaatcattttcccttcga

SEQ ID NO: 979753 - DNA, 22 bp, Artificial Sequence
  chemically synthesized
gtgagcataaagtcgaagggaa

SEQ ID NO: 979754 - DNA, 22 bp, Artificial Sequence
  chemically synthesized
tcccttcgactttatgctcaca

SEQ ID NO: 979755 - DNA, 22 bp, Artificial Sequence
  chemically synthesized
cccttcgactttatgctcacaa

SEQ ID NO: 979756 - DNA, 22 bp, Artificial Sequence
  chemically synthesized
ccttcgactttatgctcacaaa

SEQ ID NO: 979757 - DNA, 22 bp, Artificial Sequence
  chemically synthesized
aatcccaacacatttgtgagca

SEQ ID NO: 979758 - DNA, 22 bp, Artificial Sequence
  chemically synthesized
tgaatcccaacacatttgtgag

SEQ ID NO: 979759 - DNA, 22 bp, Artificial Sequence
  chemically synthesized
ctgaatcccaacacatttgtga

SEQ ID NO: 979760 - DNA, 22 bp, Artificial Sequence
  chemically synthesized
cgactttatgctcacaaatgtg

SEQ ID NO: 979761 - DNA, 22 bp, Artificial Sequence
  chemically synthesized
gactttatgctcacaaatgtgt

SEQ ID NO: 979762 - DNA, 22 bp, Artificial Sequence
  chemically synthesized
ttctgaatcccaacacatttgt

SEQ ID NO: 979763 - DNA, 22 bp, Artificial Sequence
  chemically synthesized
tatgctcacaaatgtgttggga

SEQ ID NO: 979764 - DNA, 22 bp, Artificial Sequence
  chemically synthesized
atgctcacaaatgtgttgggat

SEQ ID NO: 979765 - DNA, 22 bp, Artificial Sequence
  chemically synthesized
gaattcttctgaatcccaacac

SEQ ID NO: 979766 - DNA, 22 bp, Artificial Sequence
  chemically synthesized
tgctcacaaatgtgttgggatt

SEQ ID NO: 979767 - DNA, 22 bp, Artificial Sequence
  chemically synthesized
acaaatgtgttgggattcagaa

SEQ ID NO: 979768 - DNA, 22 bp, Artificial Sequence
  chemically synthesized
ggattcagaagaattccaacct

SEQ ID NO: 979769 - DNA, 22 bp, Artificial Sequence
  chemically synthesized
agaagaattccaaccttttcat

SEQ ID NO: 979770 - DNA, 22 bp, Artificial Sequence
  chemically synthesized
caaccttttcatttgccttgtc

SEQ ID NO: 979771 - DNA, 22 bp, Artificial Sequence
  chemically synthesized
ttcatttgccttgtccatgtta

SEQ ID NO: 979772 - DNA, 22 bp, Artificial Sequence
  chemically synthesized
taagaaaccatataacatggac

SEQ ID NO: 979773 - DNA, 22 bp, Artificial Sequence
  chemically synthesized
tcatttgccttgtccatgttat

SEQ ID NO: 979774 - DNA, 22 bp, Artificial Sequence
  chemically synthesized
catttgccttgtccatgttata

SEQ ID NO: 979775 - DNA, 22 bp, Artificial Sequence
  chemically synthesized
atttgccttgtccatgttatat

SEQ ID NO: 979776 - DNA, 22 bp, Artificial Sequence
  chemically synthesized
ggctataagaaaccatataaca

SEQ ID NO: 979777 - DNA, 22 bp, Artificial Sequence
  chemically synthesized
gccttgtccatgttatatggtt

SEQ ID NO: 979778 - DNA, 22 bp, Artificial Sequence
  chemically synthesized
ccttgtccatgttatatggttt

SEQ ID NO: 979779 - DNA, 22 bp, Artificial Sequence
  chemically synthesized
gctaggctataagaaaccatat

SEQ ID NO: 979780 - DNA, 22 bp, Artificial Sequence
  chemically synthesized
agctaggctataagaaaccata

SEQ ID NO: 979781 - DNA, 22 bp, Artificial Sequence
  chemically synthesized
tagctaggctataagaaaccat

SEQ ID NO: 979782 - DNA, 22 bp, Artificial Sequence
  chemically synthesized
gtccatgttatatggtttctta

SEQ ID NO: 979783 - DNA, 22 bp, Artificial Sequence
  chemically synthesized
tccatgttatatggtttcttat

SEQ ID NO: 979784 - DNA, 22 bp, Artificial Sequence
  chemically synthesized
ctttagctaggctataagaaac

SEQ ID NO: 979785 - DNA, 22 bp, Artificial Sequence
  chemically synthesized
tatggtttcttatagcctagct

SEQ ID NO: 979786 - DNA, 22 bp, Artificial Sequence
  chemically synthesized
tgaaaaccactgctttagctag

SEQ ID NO: 979787 - DNA, 22 bp, Artificial Sequence
  chemically synthesized
cttatagcctagctaaagcagt

SEQ ID NO: 979788 - DNA, 22 bp, Artificial Sequence
  chemically synthesized
ttatagcctagctaaagcagtg

SEQ ID NO: 979789 - DNA, 22 bp, Artificial Sequence
  chemically synthesized
atagcctagctaaagcagtggt

SEQ ID NO: 979790 - DNA, 22 bp, Artificial Sequence
  chemically synthesized
tagcctagctaaagcagtggtt

SEQ ID NO: 979791 - DNA, 22 bp, Artificial Sequence
  chemically synthesized
atcatgctgtgaaaaccactgc

SEQ ID NO: 979792 - DNA, 22 bp, Artificial Sequence
  chemically synthesized
gatcatgctgtgaaaaccactg

SEQ ID NO: 979793 - DNA, 22 bp, Artificial Sequence
  chemically synthesized
gctaaagcagtggttttcacag

SEQ ID NO: 979794 - DNA, 22 bp, Artificial Sequence
  chemically synthesized
gccttgatcatgctgtgaaaac

SEQ ID NO: 979795 - DNA, 22 bp, Artificial Sequence
  chemically synthesized
ctggccttgatcatgctgtgaa

SEQ ID NO: 979796 - DNA, 22 bp, Artificial Sequence
  chemically synthesized
aagcagtggttttcacagcatg

SEQ ID NO: 979797 - DNA, 22 bp, Artificial Sequence
  chemically synthesized
atgctgctggccttgatcatgc

SEQ ID NO: 979798 - DNA, 22 bp, Artificial Sequence
  chemically synthesized
tcacagcatgatcaaggccagc

SEQ ID NO: 979799 - DNA, 22 bp, Artificial Sequence
  chemically synthesized
cacagcatgatcaaggccagca

SEQ ID NO: 979800 - DNA, 22 bp, Artificial Sequence
  chemically synthesized
acagcatgatcaaggccagcag

SEQ ID NO: 979801 - DNA, 22 bp, Artificial Sequence
  chemically synthesized
ccaggtgatgctgatgctgctg

SEQ ID NO: 979802 - DNA, 22 bp, Artificial Sequence
  chemically synthesized
gcaagttaccaggtgatgctga

SEQ ID NO: 979803 - DNA, 22 bp, Artificial Sequence
  chemically synthesized
tagcaagttaccaggtgatgct

SEQ ID NO: 979804 - DNA, 22 bp, Artificial Sequence
  chemically synthesized
ctagcaagttaccaggtgatgc

SEQ ID NO: 979805 - DNA, 22 bp, Artificial Sequence
  chemically synthesized
catttctagcaagttaccaggt

SEQ ID NO: 979806 - DNA, 22 bp, Artificial Sequence
  chemically synthesized
gcatttctagcaagttaccagg

SEQ ID NO: 979807 - DNA, 22 bp, Artificial Sequence
  chemically synthesized
gtaacttgctagaaatgcaaat

SEQ ID NO: 979808 - DNA, 22 bp, Artificial Sequence
  chemically synthesized
gtgcaggtccagaatttgcatt

SEQ ID NO: 979809 - DNA, 22 bp, Artificial Sequence
  chemically synthesized
ggtgcaggtccagaatttgcat

SEQ ID NO: 979810 - DNA, 22 bp, Artificial Sequence
  chemically synthesized
tggtgcaggtccagaatttgca

SEQ ID NO: 979811 - DNA, 22 bp, Artificial Sequence
  chemically synthesized
gctagaaatgcaaattctggac

SEQ ID NO: 979812 - DNA, 22 bp, Artificial Sequence
  chemically synthesized
ctagaaatgcaaattctggacc

SEQ ID NO: 979813 - DNA, 22 bp, Artificial Sequence
  chemically synthesized
gaaatgcaaattctggacctgc

SEQ ID NO: 979814 - DNA, 22 bp, Artificial Sequence
  chemically synthesized
gtccagtaactttggtgcaggt

SEQ ID NO: 979815 - DNA, 22 bp, Artificial Sequence
  chemically synthesized
ctggtccagtaactttggtgca

SEQ ID NO: 979816 - DNA, 22 bp, Artificial Sequence
  chemically synthesized
tggacctgcaccaaagttactg

SEQ ID NO: 979817 - DNA, 22 bp, Artificial Sequence
  chemically synthesized
aaagttgctggtccagtaactt

SEQ ID NO: 979818 - DNA, 22 bp, Artificial Sequence
  chemically synthesized
gacctgcaccaaagttactgga

SEQ ID NO: 979819 - DNA, 22 bp, Artificial Sequence
  chemically synthesized
caaagttgctggtccagtaact

SEQ ID NO: 979820 - DNA, 22 bp, Artificial Sequence
  chemically synthesized
gccttcaaagttgctggtccag

SEQ ID NO: 979821 - DNA, 22 bp, Artificial Sequence
  chemically synthesized
caccaaagttactggaccagca

SEQ ID NO: 979822 - DNA, 22 bp, Artificial Sequence
  chemically synthesized
ggctagccttcaaagttgctgg

SEQ ID NO: 979823 - DNA, 22 bp, Artificial Sequence
  chemically synthesized
ctaggctagccttcaaagttgc

SEQ ID NO: 979824 - DNA, 22 bp, Artificial Sequence
  chemically synthesized
ctggaccagcaactttgaaggc

SEQ ID NO: 979825 - DNA, 22 bp, Artificial Sequence
  chemically synthesized
gaccagcaactttgaaggctag

SEQ ID NO: 979826 - DNA, 22 bp, Artificial Sequence
  chemically synthesized
taccacagattgctaggctagc

SEQ ID NO: 979827 - DNA, 22 bp, Artificial Sequence
  chemically synthesized
ctataccacagattgctaggct

SEQ ID NO: 979828 - DNA, 22 bp, Artificial Sequence
  chemically synthesized
gctataccacagattgctaggc

SEQ ID NO: 979829 - DNA, 22 bp, Artificial Sequence
  chemically synthesized
tgaaggctagcctagcaatctg

SEQ ID NO: 979830 - DNA, 22 bp, Artificial Sequence
  chemically synthesized
gaaggctagcctagcaatctgt

SEQ ID NO: 979831 - DNA, 22 bp, Artificial Sequence
  chemically synthesized
aaggctagcctagcaatctgtg

SEQ ID NO: 979832 - DNA, 22 bp, Artificial Sequence
  chemically synthesized
gagggtttgctataccacagat

SEQ ID NO: 979833 - DNA, 22 bp, Artificial Sequence
  chemically synthesized
gcctagcaatctgtggtatagc

SEQ ID NO: 979834 - DNA, 22 bp, Artificial Sequence
  chemically synthesized
gcaatctgtggtatagcaaacc

SEQ ID NO: 979835 - DNA, 22 bp, Artificial Sequence
  chemically synthesized
acgtcagaatcagctggagggt

SEQ ID NO: 979836 - DNA, 22 bp, Artificial Sequence
  chemically synthesized
tggtatagcaaaccctccagct

SEQ ID NO: 979837 - DNA, 22 bp, Artificial Sequence
  chemically synthesized
ggccagtagtactcacgtcaga

SEQ ID NO: 979838 - DNA, 22 bp, Artificial Sequence
  chemically synthesized
taggccagtagtactcacgtca

SEQ ID NO: 979839 - DNA, 22 bp, Artificial Sequence
  chemically synthesized
cagctgattctgacgtgagtac

SEQ ID NO: 979840 - DNA, 22 bp, Artificial Sequence
  chemically synthesized
attctgacgtgagtactactgg

SEQ ID NO: 979841 - DNA, 22 bp, Artificial Sequence
  chemically synthesized
gaagcaactctaggccagtagt

SEQ ID NO: 979842 - DNA, 22 bp, Artificial Sequence
  chemically synthesized
agaagcaactctaggccagtag

SEQ ID NO: 979843 - DNA, 22 bp, Artificial Sequence
  chemically synthesized
tgacgtgagtactactggccta

SEQ ID NO: 979844 - DNA, 22 bp, Artificial Sequence
  chemically synthesized
acgtgagtactactggcctaga

SEQ ID NO: 979845 - DNA, 22 bp, Artificial Sequence
  chemically synthesized
taccaaagtcttagaagcaact

SEQ ID NO: 979846 - DNA, 22 bp, Artificial Sequence
  chemically synthesized
ctggcctagagttgcttctaag

SEQ ID NO: 979847 - DNA, 22 bp, Artificial Sequence
  chemically synthesized
gcctagagttgcttctaagact

SEQ ID NO: 979848 - DNA, 22 bp, Artificial Sequence
  chemically synthesized
gtagttataccaaagtcttaga

SEQ ID NO: 979849 - DNA, 22 bp, Artificial Sequence
  chemically synthesized
gagttgcttctaagactttggt

SEQ ID NO: 979850 - DNA, 22 bp, Artificial Sequence
  chemically synthesized
actggtagttataccaaagtct

SEQ ID NO: 979851 - DNA, 22 bp, Artificial Sequence
  chemically synthesized
tgactggtagttataccaaagt

SEQ ID NO: 979852 - DNA, 22 bp, Artificial Sequence
  chemically synthesized
cttctaagactttggtataact

SEQ ID NO: 979853 - DNA, 22 bp, Artificial Sequence
  chemically synthesized
gattctgactggtagttatacc

SEQ ID NO: 979854 - DNA, 22 bp, Artificial Sequence
  chemically synthesized
ctaagactttggtataactacc

SEQ ID NO: 979855 - DNA, 22 bp, Artificial Sequence
  chemically synthesized
taagactttggtataactacca

SEQ ID NO: 979856 - DNA, 22 bp, Artificial Sequence
  chemically synthesized
agactttggtataactaccagt

SEQ ID NO: 979857 - DNA, 22 bp, Artificial Sequence
  chemically synthesized
tggtataactaccagtcagaat

SEQ ID NO: 979858 - DNA, 22 bp, Artificial Sequence
  chemically synthesized
ggtataactaccagtcagaatc

SEQ ID NO: 979859 - DNA, 22 bp, Artificial Sequence
  chemically synthesized
gtataactaccagtcagaatct

SEQ ID NO: 979860 - DNA, 22 bp, Artificial Sequence
  chemically synthesized
tgtgtgaagacctagattctga

SEQ ID NO: 979861 - DNA, 22 bp, Artificial Sequence
  chemically synthesized
ccagtcagaatctaggtcttca

SEQ ID NO: 979862 - DNA, 22 bp, Artificial Sequence
  chemically synthesized
aatcagtgtctgtgtgtgaaga

SEQ ID NO: 979863 - DNA, 22 bp, Artificial Sequence
  chemically synthesized
ctgaatcagtgtctgtgtgtga

SEQ ID NO: 979864 - DNA, 22 bp, Artificial Sequence
  chemically synthesized
ggtcttcacacacagacactga

SEQ ID NO: 979865 - DNA, 22 bp, Artificial Sequence
  chemically synthesized
atcccaaacctactgaatcagt

SEQ ID NO: 979866 - DNA, 22 bp, Artificial Sequence
  chemically synthesized
cacacacagacactgattcagt

SEQ ID NO: 979867 - DNA, 22 bp, Artificial Sequence
  chemically synthesized
catcccaaacctactgaatcag

SEQ ID NO: 979868 - DNA, 22 bp, Artificial Sequence
  chemically synthesized
acacacagacactgattcagta

SEQ ID NO: 979869 - DNA, 22 bp, Artificial Sequence
  chemically synthesized
cccttcatcccaaacctactga

SEQ ID NO: 979870 - DNA, 22 bp, Artificial Sequence
  chemically synthesized
cctgcccttcatcccaaaccta

SEQ ID NO: 979871 - DNA, 22 bp, Artificial Sequence
  chemically synthesized
attcagtaggtttgggatgaag

SEQ ID NO: 979872 - DNA, 22 bp, Artificial Sequence
  chemically synthesized
tagactgcctgcccttcatccc

SEQ ID NO: 979873 - DNA, 22 bp, Artificial Sequence
  chemically synthesized
agtaggtttgggatgaagggca

SEQ ID NO: 979874 - DNA, 22 bp, Artificial Sequence
  chemically synthesized
ataaaggctgtagactgcctgc

SEQ ID NO: 979875 - DNA, 22 bp, Artificial Sequence
  chemically synthesized
gataaaggctgtagactgcctg

SEQ ID NO: 979876 - DNA, 22 bp, Artificial Sequence
  chemically synthesized
gggatgaagggcaggcagtcta

SEQ ID NO: 979877 - DNA, 22 bp, Artificial Sequence
  chemically synthesized
ggatgaagggcaggcagtctac

SEQ ID NO: 979878 - DNA, 22 bp, Artificial Sequence
  chemically synthesized
ggcagcttgataaaggctgtag

SEQ ID NO: 979879 - DNA, 22 bp, Artificial Sequence
  chemically synthesized
agcatcatctgggcagcttgat

SEQ ID NO: 979880 - DNA, 22 bp, Artificial Sequence
  chemically synthesized
cagcatcatctgggcagcttga

SEQ ID NO: 979881 - DNA, 22 bp, Artificial Sequence
  chemically synthesized
tcagcatcatctgggcagcttg

SEQ ID NO: 979882 - DNA, 22 bp, Artificial Sequence
  chemically synthesized
cagcctttatcaagctgcccag

SEQ ID NO: 979883 - DNA, 22 bp, Artificial Sequence
  chemically synthesized
tatcaagctgcccagatgatgc

SEQ ID NO: 979884 - DNA, 22 bp, Artificial Sequence
  chemically synthesized
atcaagctgcccagatgatgct

SEQ ID NO: 979885 - DNA, 22 bp, Artificial Sequence
  chemically synthesized
tcaagctgcccagatgatgctg

SEQ ID NO: 979886 - DNA, 22 bp, Artificial Sequence
  chemically synthesized
aatccataaaacacctttcagc

SEQ ID NO: 979887 - DNA, 22 bp, Artificial Sequence
  chemically synthesized
cccagatgatgctgaaaggtgt

SEQ ID NO: 979888 - DNA, 22 bp, Artificial Sequence
  chemically synthesized
tgaatccataaaacacctttca

SEQ ID NO: 979889 - DNA, 22 bp, Artificial Sequence
  chemically synthesized
ctgaatccataaaacacctttc

SEQ ID NO: 979890 - DNA, 22 bp, Artificial Sequence
  chemically synthesized
ttctgaatccataaaacacctt

SEQ ID NO: 979891 - DNA, 22 bp, Artificial Sequence
  chemically synthesized
agactcttctgaatccataaaa

SEQ ID NO: 979892 - DNA, 22 bp, Artificial Sequence
  chemically synthesized
aaaggtgttttatggattcaga

SEQ ID NO: 979893 - DNA, 22 bp, Artificial Sequence
  chemically synthesized
acgaatgtgttgagactcttct

SEQ ID NO: 979894 - DNA, 22 bp, Artificial Sequence
  chemically synthesized
tatggattcagaagagtctcaa

SEQ ID NO: 979895 - DNA, 22 bp, Artificial Sequence
  chemically synthesized
atggattcagaagagtctcaac

SEQ ID NO: 979896 - DNA, 22 bp, Artificial Sequence
  chemically synthesized
tggattcagaagagtctcaaca

SEQ ID NO: 979897 - DNA, 22 bp, Artificial Sequence
  chemically synthesized
tgctcacgaatgtgttgagact

SEQ ID NO: 979898 - DNA, 22 bp, Artificial Sequence
  chemically synthesized
atgctcacgaatgtgttgagac

SEQ ID NO: 979899 - DNA, 22 bp, Artificial Sequence
  chemically synthesized
tatgctcacgaatgtgttgaga

SEQ ID NO: 979900 - DNA, 22 bp, Artificial Sequence
  chemically synthesized
agaagagtctcaacacattcgt

SEQ ID NO: 979901 - DNA, 22 bp, Artificial Sequence
  chemically synthesized
aactttatgctcacgaatgtgt

SEQ ID NO: 979902 - DNA, 22 bp, Artificial Sequence
  chemically synthesized
caactttatgctcacgaatgtg

SEQ ID NO: 979903 - DNA, 22 bp, Artificial Sequence
  chemically synthesized
ccttcaactttatgctcacgaa

SEQ ID NO: 979904 - DNA, 22 bp, Artificial Sequence
  chemically synthesized
cccttcaactttatgctcacga

SEQ ID NO: 979905 - DNA, 22 bp, Artificial Sequence
  chemically synthesized
tcccttcaactttatgctcacg

SEQ ID NO: 979906 - DNA, 22 bp, Artificial Sequence
  chemically synthesized
ttcccttcaactttatgctcac

SEQ ID NO: 979907 - DNA, 22 bp, Artificial Sequence
  chemically synthesized
tttcccttcaactttatgctca

SEQ ID NO: 979908 - DNA, 22 bp, Artificial Sequence
  chemically synthesized
aacacattcgtgagcataaagt

SEQ ID NO: 979909 - DNA, 22 bp, Artificial Sequence
  chemically synthesized
aacattttttcccttcaacttt

SEQ ID NO: 979910 - DNA, 22 bp, Artificial Sequence
  chemically synthesized
gtgagcataaagttgaagggaa

SEQ ID NO: 979911 - DNA, 22 bp, Artificial Sequence
  chemically synthesized
attaaacattttttcccttcaa

SEQ ID NO: 979912 - DNA, 22 bp, Artificial Sequence
  chemically synthesized
aagggaaaaaatgtttaatgaa

SEQ ID NO: 979913 - DNA, 22 bp, Artificial Sequence
  chemically synthesized
aatgaatttgcctggggttttg

SEQ ID NO: 979914 - DNA, 22 bp, Artificial Sequence
  chemically synthesized
atgaatttgcctggggttttgt

SEQ ID NO: 979915 - DNA, 22 bp, Artificial Sequence
  chemically synthesized
ggagtggaagaagtaacaaaac

SEQ ID NO: 979916 - DNA, 22 bp, Artificial Sequence
  chemically synthesized
gcctggggttttgttacttctt

SEQ ID NO: 979917 - DNA, 22 bp, Artificial Sequence
  chemically synthesized
cctggggttttgttacttcttc

SEQ ID NO: 979918 - DNA, 22 bp, Artificial Sequence
  chemically synthesized
gggttttgttacttcttccact

SEQ ID NO: 979919 - DNA, 22 bp, Artificial Sequence
  chemically synthesized
taaatgaagttaggagtggaag

SEQ ID NO: 979920 - DNA, 22 bp, Artificial Sequence
  chemically synthesized
tgttacttcttccactcctaac

SEQ ID NO: 979921 - DNA, 22 bp, Artificial Sequence
  chemically synthesized
attataaatgaagttaggagtg

SEQ ID NO: 979922 - DNA, 22 bp, Artificial Sequence
  chemically synthesized
gttacttcttccactcctaact

SEQ ID NO: 979923 - DNA, 22 bp, Artificial Sequence
  chemically synthesized
gattataaatgaagttaggagt

SEQ ID NO: 979924 - DNA, 22 bp, Artificial Sequence
  chemically synthesized
ttacttcttccactcctaactt

SEQ ID NO: 979925 - DNA, 22 bp, Artificial Sequence
  chemically synthesized
cttcttccactcctaacttcat

SEQ ID NO: 979926 - DNA, 22 bp, Artificial Sequence
  chemically synthesized
cttccactcctaacttcattta

SEQ ID NO: 979927 - DNA, 22 bp, Artificial Sequence
  chemically synthesized
gggccttgattataaatgaagt

SEQ ID NO: 979928 - DNA, 22 bp, Artificial Sequence
  chemically synthesized
ttccactcctaacttcatttat

SEQ ID NO: 979929 - DNA, 22 bp, Artificial Sequence
  chemically synthesized
agggccttgattataaatgaag

SEQ ID NO: 979930 - DNA, 22 bp, Artificial Sequence
  chemically synthesized
ccactcctaacttcatttataa

SEQ ID NO: 979931 - DNA, 22 bp, Artificial Sequence
  chemically synthesized
cactcctaacttcatttataat

SEQ ID NO: 979932 - DNA, 22 bp, Artificial Sequence
  chemically synthesized
cttagggccttgattataaatg

SEQ ID NO: 979933 - DNA, 22 bp, Artificial Sequence
  chemically synthesized
ctaacttcatttataatcaagg

SEQ ID NO: 979934 - DNA, 22 bp, Artificial Sequence
  chemically synthesized
acttcatttataatcaaggccc

SEQ ID NO: 979935 - DNA, 22 bp, Artificial Sequence
  chemically synthesized
catttataatcaaggccctaag

SEQ ID NO: 979936 - DNA, 22 bp, Artificial Sequence
  chemically synthesized
atttataatcaaggccctaagc

SEQ ID NO: 979937 - DNA, 22 bp, Artificial Sequence
  chemically synthesized
agtggaaaccagctgcttaggg

SEQ ID NO: 979938 - DNA, 22 bp, Artificial Sequence
  chemically synthesized
ataatcaaggccctaagcagct

SEQ ID NO: 979939 - DNA, 22 bp, Artificial Sequence
  chemically synthesized
taatcaaggccctaagcagctg

SEQ ID NO: 979940 - DNA, 22 bp, Artificial Sequence
  chemically synthesized
gtaaggttaagtggaaaccagc

SEQ ID NO: 979941 - DNA, 22 bp, Artificial Sequence
  chemically synthesized
ggtaaggttaagtggaaaccag

SEQ ID NO: 979942 - DNA, 22 bp, Artificial Sequence
  chemically synthesized
agcagctggtttccacttaacc

SEQ ID NO: 979943 - DNA, 22 bp, Artificial Sequence
  chemically synthesized
tatgagtttggtaaggttaagt

SEQ ID NO: 979944 - DNA, 22 bp, Artificial Sequence
  chemically synthesized
gtatgagtttggtaaggttaag

SEQ ID NO: 979945 - DNA, 22 bp, Artificial Sequence
  chemically synthesized
gtttccacttaaccttaccaaa

SEQ ID NO: 979946 - DNA, 22 bp, Artificial Sequence
  chemically synthesized
aatttgtatgagtttggtaagg

SEQ ID NO: 979947 - DNA, 22 bp, Artificial Sequence
  chemically synthesized
ccacttaaccttaccaaactca

SEQ ID NO: 979948 - DNA, 22 bp, Artificial Sequence
  chemically synthesized
cacttaaccttaccaaactcat

SEQ ID NO: 979949 - DNA, 22 bp, Artificial Sequence
  chemically synthesized
aaccttaccaaactcatacaaa

SEQ ID NO: 979950 - DNA, 22 bp, Artificial Sequence
  chemically synthesized
accttaccaaactcatacaaat

SEQ ID NO: 979951 - DNA, 22 bp, Artificial Sequence
  chemically synthesized
accaaactcatacaaattcagt

SEQ ID NO: 979952 - DNA, 22 bp, Artificial Sequence
  chemically synthesized
taaataatcccaactgaatttg

SEQ ID NO: 979953 - DNA, 22 bp, Artificial Sequence
  chemically synthesized
ccaaactcatacaaattcagtt

SEQ ID NO: 979954 - DNA, 22 bp, Artificial Sequence
  chemically synthesized
gaagttgtaaataatcccaact

SEQ ID NO: 979955 - DNA, 22 bp, Artificial Sequence
  chemically synthesized
atacaaattcagttgggattat

SEQ ID NO: 979956 - DNA, 22 bp, Artificial Sequence
  chemically synthesized
agttgggattatttacaacttc

SEQ ID NO: 979957 - DNA, 22 bp, Artificial Sequence
  chemically synthesized
caagtaaccctggaagttgtaa

SEQ ID NO: 979958 - DNA, 22 bp, Artificial Sequence
  chemically synthesized
ggattatttacaacttccaggg

SEQ ID NO: 979959 - DNA, 22 bp, Artificial Sequence
  chemically synthesized
tttacaacttccagggttactt

SEQ ID NO: 979960 - DNA, 22 bp, Artificial Sequence
  chemically synthesized
agtatacaattgcaagtaaccc

SEQ ID NO: 979961 - DNA, 22 bp, Artificial Sequence
  chemically synthesized
acaacttccagggttacttgca

SEQ ID NO: 979962 - DNA, 22 bp, Artificial Sequence
  chemically synthesized
caacttccagggttacttgcaa

SEQ ID NO: 979963 - DNA, 22 bp, Artificial Sequence
  chemically synthesized
gagactcagtatacaattgcaa

SEQ ID NO: 979964 - DNA, 22 bp, Artificial Sequence
  chemically synthesized
ggagactcagtatacaattgca

SEQ ID NO: 979965 - DNA, 22 bp, Artificial Sequence
  chemically synthesized
ccagggttacttgcaattgtat

SEQ ID NO: 979966 - DNA, 22 bp, Artificial Sequence
  chemically synthesized
cagggttacttgcaattgtata

SEQ ID NO: 979967 - DNA, 22 bp, Artificial Sequence
  chemically synthesized
accaccttggagactcagtata

SEQ ID NO: 979968 - DNA, 22 bp, Artificial Sequence
  chemically synthesized
cttgcaattgtatactgagtct

SEQ ID NO: 979969 - DNA, 22 bp, Artificial Sequence
  chemically synthesized
attaaccaccttggagactcag

SEQ ID NO: 979970 - DNA, 22 bp, Artificial Sequence
  chemically synthesized
gcaattgtatactgagtctcca

SEQ ID NO: 979971 - DNA, 22 bp, Artificial Sequence
  chemically synthesized
caattgtatactgagtctccaa

SEQ ID NO: 979972 - DNA, 22 bp, Artificial Sequence
  chemically synthesized
tatactgagtctccaaggtggt

SEQ ID NO: 979973 - DNA, 22 bp, Artificial Sequence
  chemically synthesized
agtctccaaggtggttaatgag

SEQ ID NO: 979974 - DNA, 22 bp, Artificial Sequence
  chemically synthesized
tcatccaaagtggctcattaac

SEQ ID NO: 979975 - DNA, 22 bp, Artificial Sequence
  chemically synthesized
ttatcatccaaagtggctcatt

SEQ ID NO: 979976 - DNA, 22 bp, Artificial Sequence
  chemically synthesized
caaggtggttaatgagccactt

SEQ ID NO: 979977 - DNA, 22 bp, Artificial Sequence
  chemically synthesized
atgagccactttggatgataac

SEQ ID NO: 979978 - DNA, 22 bp, Artificial Sequence
  chemically synthesized
tcagccaaggtggttgttatca

SEQ ID NO: 979979 - DNA, 22 bp, Artificial Sequence
  chemically synthesized
gttatcagccaaggtggttgtt

SEQ ID NO: 979980 - DNA, 22 bp, Artificial Sequence
  chemically synthesized
agttatcagccaaggtggttgt

SEQ ID NO: 979981 - DNA, 22 bp, Artificial Sequence
  chemically synthesized
tggatgataacaaccaccttgg

SEQ ID NO: 979982 - DNA, 22 bp, Artificial Sequence
  chemically synthesized
ggatgataacaaccaccttggc

SEQ ID NO: 979983 - DNA, 22 bp, Artificial Sequence
  chemically synthesized
gatgataacaaccaccttggct

SEQ ID NO: 979984 - DNA, 22 bp, Artificial Sequence
  chemically synthesized
tcaatttagttatcagccaagg

SEQ ID NO: 979985 - DNA, 22 bp, Artificial Sequence
  chemically synthesized
cctatcaatttagttatcagcc

SEQ ID NO: 979986 - DNA, 22 bp, Artificial Sequence
  chemically synthesized
acctatcaatttagttatcagc

SEQ ID NO: 979987 - DNA, 22 bp, Artificial Sequence
  chemically synthesized
cttacctatcaatttagttatc

SEQ ID NO: 979988 - DNA, 22 bp, Artificial Sequence
  chemically synthesized
ggctgataactaaattgatagg

SEQ ID NO: 979989 - DNA, 22 bp, Artificial Sequence
  chemically synthesized
gctgataactaaattgataggt

SEQ ID NO: 979990 - DNA, 22 bp, Artificial Sequence
  chemically synthesized
taatacattgcttacctatcaa

SEQ ID NO: 979991 - DNA, 22 bp, Artificial Sequence
  chemically synthesized
ataactaaattgataggtaagc

SEQ ID NO: 979992 - DNA, 22 bp, Artificial Sequence
  chemically synthesized
ttataatacattgcttacctat

SEQ ID NO: 979993 - DNA, 22 bp, Artificial Sequence
  chemically synthesized
ctattataatacattgcttacc

SEQ ID NO: 979994 - DNA, 22 bp, Artificial Sequence
  chemically synthesized
aattgataggtaagcaatgtat

SEQ ID NO: 979995 - DNA, 22 bp, Artificial Sequence
  chemically synthesized
gttgctattataatacattgct

SEQ ID NO: 979996 - DNA, 22 bp, Artificial Sequence
  chemically synthesized
ggttgctattataatacattgc

SEQ ID NO: 979997 - DNA, 22 bp, Artificial Sequence
  chemically synthesized
ataggtaagcaatgtattataa

SEQ ID NO: 979998 - DNA, 22 bp, Artificial Sequence
  chemically synthesized
taatagcaaccaaacccttgct

SEQ ID NO: 979999 - DNA, 22 bp, Artificial Sequence
  chemically synthesized
tgacaggtcagtaaatcagaga

SEQ ID NO: 980000 - DNA, 22 bp, Artificial Sequence
  chemically synthesized
gcttctctgatttactgacctg

SEQ ID NO: 980001 - DNA, 22 bp, Artificial Sequence
  chemically synthesized
cttctctgatttactgacctgt

SEQ ID NO: 980002 - DNA, 22 bp, Artificial Sequence
  chemically synthesized
gtccatatctgtgacaggtcag

SEQ ID NO: 980003 - DNA, 22 bp, Artificial Sequence
  chemically synthesized
ggtccatatctgtgacaggtca

SEQ ID NO: 980004 - DNA, 22 bp, Artificial Sequence
  chemically synthesized
ctctgatttactgacctgtcac

SEQ ID NO: 980005 - DNA, 22 bp, Artificial Sequence
  chemically synthesized
tctgatttactgacctgtcaca

SEQ ID NO: 980006 - DNA, 22 bp, Artificial Sequence
  chemically synthesized
tgatttactgacctgtcacaga

SEQ ID NO: 980007 - DNA, 22 bp, Artificial Sequence
  chemically synthesized
gtttggtccatatctgtgacag

SEQ ID NO: 980008 - DNA, 22 bp, Artificial Sequence
  chemically synthesized
ggtttggtccatatctgtgaca

SEQ ID NO: 980009 - DNA, 22 bp, Artificial Sequence
  chemically synthesized
atttactgacctgtcacagata

SEQ ID NO: 980010 - DNA, 22 bp, Artificial Sequence
  chemically synthesized
actgacctgtcacagatatgga

SEQ ID NO: 980011 - DNA, 22 bp, Artificial Sequence
  chemically synthesized
ctgacctgtcacagatatggac

SEQ ID NO: 980012 - DNA, 22 bp, Artificial Sequence
  chemically synthesized
agaaatttggtttggtccatat

SEQ ID NO: 980013 - DNA, 22 bp, Artificial Sequence
  chemically synthesized
acctgtcacagatatggaccaa

SEQ ID NO: 980014 - DNA, 22 bp, Artificial Sequence
  chemically synthesized
cagaaatttggtttggtccata

SEQ ID NO: 980015 - DNA, 22 bp, Artificial Sequence
  chemically synthesized
tcacagatatggaccaaaccaa

SEQ ID NO: 980016 - DNA, 22 bp, Artificial Sequence
  chemically synthesized
agcagccagaatttcagaaatt

SEQ ID NO: 980017 - DNA, 22 bp, Artificial Sequence
  chemically synthesized
gagcagccagaatttcagaaat

SEQ ID NO: 980018 - DNA, 22 bp, Artificial Sequence
  chemically synthesized
ggatttgagcagccagaatttc

SEQ ID NO: 980019 - DNA, 22 bp, Artificial Sequence
  chemically synthesized
caattgggatttgagcagccag

SEQ ID NO: 980020 - DNA, 22 bp, Artificial Sequence
  chemically synthesized
ctgaaattctggctgctcaaat

SEQ ID NO: 980021 - DNA, 22 bp, Artificial Sequence
  chemically synthesized
tgaaattctggctgctcaaatc

SEQ ID NO: 980022 - DNA, 22 bp, Artificial Sequence
  chemically synthesized
aaattctggctgctcaaatccc

SEQ ID NO: 980023 - DNA, 22 bp, Artificial Sequence
  chemically synthesized
aatcaggttgcaattgggattt

SEQ ID NO: 980024 - DNA, 22 bp, Artificial Sequence
  chemically synthesized
tggctgctcaaatcccaattgc

SEQ ID NO: 980025 - DNA, 22 bp, Artificial Sequence
  chemically synthesized
gctgctcaaatcccaattgcaa

SEQ ID NO: 980026 - DNA, 22 bp, Artificial Sequence
  chemically synthesized
ctcaaatcccaattgcaacctg

SEQ ID NO: 980027 - DNA, 22 bp, Artificial Sequence
  chemically synthesized
ataatgcctcaatcaggttgca

SEQ ID NO: 980028 - DNA, 22 bp, Artificial Sequence
  chemically synthesized
aaatcccaattgcaacctgatt

SEQ ID NO: 980029 - DNA, 22 bp, Artificial Sequence
  chemically synthesized
caatactaataatgcctcaatc

SEQ ID NO: 980030 - DNA, 22 bp, Artificial Sequence
  chemically synthesized
caacctgattgaggcattatta

SEQ ID NO: 980031 - DNA, 22 bp, Artificial Sequence
  chemically synthesized
aaactccaatactaataatgcc

SEQ ID NO: 980032 - DNA, 22 bp, Artificial Sequence
  chemically synthesized
caaactccaatactaataatgc

SEQ ID NO: 980033 - DNA, 22 bp, Artificial Sequence
  chemically synthesized
cttcaaactccaatactaataa

SEQ ID NO: 980034 - DNA, 22 bp, Artificial Sequence
  chemically synthesized
acttcaaactccaatactaata

SEQ ID NO: 980035 - DNA, 22 bp, Artificial Sequence
  chemically synthesized
attgaggcattattagtattgg

SEQ ID NO: 980036 - DNA, 22 bp, Artificial Sequence
  chemically synthesized
tttacttcaaactccaatacta

SEQ ID NO: 980037 - DNA, 22 bp, Artificial Sequence
  chemically synthesized
aggcattattagtattggagtt

SEQ ID NO: 980038 - DNA, 22 bp, Artificial Sequence
  chemically synthesized
tattatttacttcaaactccaa

SEQ ID NO: 980039 - DNA, 22 bp, Artificial Sequence
  chemically synthesized
gtattatttacttcaaactcca

SEQ ID NO: 980040 - DNA, 22 bp, Artificial Sequence
  chemically synthesized
ttagtattggagtttgaagtaa

SEQ ID NO: 980041 - DNA, 22 bp, Artificial Sequence
  chemically synthesized
gtattggagtttgaagtaaata

SEQ ID NO: 980042 - DNA, 22 bp, Artificial Sequence
  chemically synthesized
agtcgatgcatttgtattattt

SEQ ID NO: 980043 - DNA, 22 bp, Artificial Sequence
  chemically synthesized
gagtttgaagtaaataatacaa

SEQ ID NO: 980044 - DNA, 22 bp, Artificial Sequence
  chemically synthesized
cagtcgatgcatttgtattatt

SEQ ID NO: 980045 - DNA, 22 bp, Artificial Sequence
  chemically synthesized
tttcagtcgatgcatttgtatt

SEQ ID NO: 980046 - DNA, 22 bp, Artificial Sequence
  chemically synthesized
gaagtaaataatacaaatgcat

SEQ ID NO: 980047 - DNA, 22 bp, Artificial Sequence
  chemically synthesized
aagtaaataatacaaatgcatc

SEQ ID NO: 980048 - DNA, 22 bp, Artificial Sequence
  chemically synthesized
cctatttcagtcgatgcatttg

SEQ ID NO: 980049 - DNA, 22 bp, Artificial Sequence
  chemically synthesized
tacctatttcagtcgatgcatt

SEQ ID NO: 980050 - DNA, 22 bp, Artificial Sequence
  chemically synthesized
tctacctatttcagtcgatgca

SEQ ID NO: 980051 - DNA, 22 bp, Artificial Sequence
  chemically synthesized
ttctctacctatttcagtcgat

SEQ ID NO: 980052 - DNA, 22 bp, Artificial Sequence
  chemically synthesized
gttctctacctatttcagtcga

SEQ ID NO: 980053 - DNA, 22 bp, Artificial Sequence
  chemically synthesized
cgggcttgttctctacctattt

SEQ ID NO: 980054 - DNA, 22 bp, Artificial Sequence
  chemically synthesized
ccgggcttgttctctacctatt

SEQ ID NO: 980055 - DNA, 22 bp, Artificial Sequence
  chemically synthesized
cacttccgggcttgttctctac

SEQ ID NO: 980056 - DNA, 22 bp, Artificial Sequence
  chemically synthesized
gcacttccgggcttgttctcta

SEQ ID NO: 980057 - DNA, 22 bp, Artificial Sequence
  chemically synthesized
aaataggtagagaacaagcccg

SEQ ID NO: 980058 - DNA, 22 bp, Artificial Sequence
  chemically synthesized
acgaacgtttgcacttccgggc

SEQ ID NO: 980059 - DNA, 22 bp, Artificial Sequence
  chemically synthesized
taacgaacgtttgcacttccgg

SEQ ID NO: 980060 - DNA, 22 bp, Artificial Sequence
  chemically synthesized
ctaacgaacgtttgcacttccg

SEQ ID NO: 980061 - DNA, 22 bp, Artificial Sequence
  chemically synthesized
cacaaatcagtaacttctaacg

SEQ ID NO: 980062 - DNA, 22 bp, Artificial Sequence
  chemically synthesized
tgcacaaatcagtaacttctaa

SEQ ID NO: 980063 - DNA, 22 bp, Artificial Sequence
  chemically synthesized
gttagaagttactgatttgtgc

SEQ ID NO: 980064 - DNA, 22 bp, Artificial Sequence
  chemically synthesized
gaagttactgatttgtgcagaa

SEQ ID NO: 980065 - DNA, 22 bp, Artificial Sequence
  chemically synthesized
cccaagccacacagagttctgc

SEQ ID NO: 980066 - DNA, 22 bp, Artificial Sequence
  chemically synthesized
ctgatttgtgcagaactctgtg

SEQ ID NO: 980067 - DNA, 22 bp, Artificial Sequence
  chemically synthesized
atttgtgcagaactctgtgtgg

SEQ ID NO: 980068 - DNA, 22 bp, Artificial Sequence
  chemically synthesized
gtgcagaactctgtgtggcttg

SEQ ID NO: 980069 - DNA, 22 bp, Artificial Sequence
  chemically synthesized
tgcagaactctgtgtggcttgg

SEQ ID NO: 980070 - DNA, 22 bp, Artificial Sequence
  chemically synthesized
acaaagagaagtgactgcccaa

SEQ ID NO: 980071 - DNA, 22 bp, Artificial Sequence
  chemically synthesized
gacaaagagaagtgactgccca

SEQ ID NO: 980072 - DNA, 22 bp, Artificial Sequence
  chemically synthesized
tgtgtggcttgggcagtcactt

SEQ ID NO: 980073 - DNA, 22 bp, Artificial Sequence
  chemically synthesized
cttgacaaagagaagtgactgc

SEQ ID NO: 980074 - DNA, 22 bp, Artificial Sequence
  chemically synthesized
acttgacaaagagaagtgactg

SEQ ID NO: 980075 - DNA, 22 bp, Artificial Sequence
  chemically synthesized
tgtggcttgggcagtcacttct

SEQ ID NO: 980076 - DNA, 22 bp, Artificial Sequence
  chemically synthesized
tatgtttacttgacaaagagaa

SEQ ID NO: 980077 - DNA, 22 bp, Artificial Sequence
  chemically synthesized
gtatgtttacttgacaaagaga

SEQ ID NO: 980078 - DNA, 22 bp, Artificial Sequence
  chemically synthesized
gggcagtcacttctctttgtca

SEQ ID NO: 980079 - DNA, 22 bp, Artificial Sequence
  chemically synthesized
tgtatgtttacttgacaaagag

SEQ ID NO: 980080 - DNA, 22 bp, Artificial Sequence
  chemically synthesized
ggcagtcacttctctttgtcaa

SEQ ID NO: 980081 - DNA, 22 bp, Artificial Sequence
  chemically synthesized
ctctttgtcaagtaaacataca

SEQ ID NO: 980082 - DNA, 22 bp, Artificial Sequence
  chemically synthesized
tctttgtcaagtaaacatacaa

SEQ ID NO: 980083 - DNA, 22 bp, Artificial Sequence
  chemically synthesized
tttgtcaagtaaacatacaaaa

SEQ ID NO: 980084 - DNA, 22 bp, Artificial Sequence
  chemically synthesized
gaaggagcaaacgttttgtatg

SEQ ID NO: 980085 - DNA, 22 bp, Artificial Sequence
  chemically synthesized
tgtcaagtaaacatacaaaacg

SEQ ID NO: 980086 - DNA, 22 bp, Artificial Sequence
  chemically synthesized
gtcaagtaaacatacaaaacgt

SEQ ID NO: 980087 - DNA, 22 bp, Artificial Sequence
  chemically synthesized
tcaagtaaacatacaaaacgtt

SEQ ID NO: 980088 - DNA, 22 bp, Artificial Sequence
  chemically synthesized
caattggaaggagcaaacgttt

SEQ ID NO: 980089 - DNA, 22 bp, Artificial Sequence
  chemically synthesized
ccatggataccattgcaattgg

SEQ ID NO: 980090 - DNA, 22 bp, Artificial Sequence
  chemically synthesized
gctccttccaattgcaatggta

SEQ ID NO: 980091 - DNA, 22 bp, Artificial Sequence
  chemically synthesized
ctccttccaattgcaatggtat

SEQ ID NO: 980092 - DNA, 22 bp, Artificial Sequence
  chemically synthesized
cttccaattgcaatggtatcca

SEQ ID NO: 980093 - DNA, 22 bp, Artificial Sequence
  chemically synthesized
cacgtatctaccatggatacca

SEQ ID NO: 980094 - DNA, 22 bp, Artificial Sequence
  chemically synthesized
ccaattgcaatggtatccatgg

SEQ ID NO: 980095 - DNA, 22 bp, Artificial Sequence
  chemically synthesized
caattgcaatggtatccatggt

SEQ ID NO: 980096 - DNA, 22 bp, Artificial Sequence
  chemically synthesized
caatggtatccatggtagatac

SEQ ID NO: 980097 - DNA, 22 bp, Artificial Sequence
  chemically synthesized
aaatgcattgcacgtatctacc

SEQ ID NO: 980098 - DNA, 22 bp, Artificial Sequence
  chemically synthesized
caaatgcattgcacgtatctac

SEQ ID NO: 980099 - DNA, 22 bp, Artificial Sequence
  chemically synthesized
tcaaatgcattgcacgtatcta

SEQ ID NO: 980100 - DNA, 22 bp, Artificial Sequence
  chemically synthesized
ttttcaaatgcattgcacgtat

SEQ ID NO: 980101 - DNA, 22 bp, Artificial Sequence
  chemically synthesized
ttattttcaaatgcattgcacg

SEQ ID NO: 980102 - DNA, 22 bp, Artificial Sequence
  chemically synthesized
aagttattattttcaaatgcat

SEQ ID NO: 980103 - DNA, 22 bp, Artificial Sequence
  chemically synthesized
gatctcaagttattattttcaa

SEQ ID NO: 980104 - DNA, 22 bp, Artificial Sequence
  chemically synthesized
cgatctcaagttattattttca

SEQ ID NO: 980105 - DNA, 22 bp, Artificial Sequence
  chemically synthesized
tcgatctcaagttattattttc

SEQ ID NO: 980106 - DNA, 22 bp, Artificial Sequence
  chemically synthesized
tctttcgatctcaagttattat

SEQ ID NO: 980107 - DNA, 22 bp, Artificial Sequence
  chemically synthesized
gtctttcgatctcaagttatta

SEQ ID NO: 980108 - DNA, 22 bp, Artificial Sequence
  chemically synthesized
tgtctttcgatctcaagttatt

SEQ ID NO: 980109 - DNA, 22 bp, Artificial Sequence
  chemically synthesized
ttgtctttcgatctcaagttat

SEQ ID NO: 980110 - DNA, 22 bp, Artificial Sequence
  chemically synthesized
tttgtctttcgatctcaagtta

SEQ ID NO: 980111 - DNA, 22 bp, Artificial Sequence
  chemically synthesized
gaaaataataacttgagatcga

SEQ ID NO: 980112 - DNA, 22 bp, Artificial Sequence
  chemically synthesized
attttttgtctttcgatctcaa

SEQ ID NO: 980113 - DNA, 22 bp, Artificial Sequence
  chemically synthesized
aaaataataacttgagatcgaa

SEQ ID NO: 980114 - DNA, 22 bp, Artificial Sequence
  chemically synthesized
gcgtattcattttttgtctttc

SEQ ID NO: 980115 - DNA, 22 bp, Artificial Sequence
  chemically synthesized
agcgtattcattttttgtcttt

SEQ ID NO: 980116 - DNA, 22 bp, Artificial Sequence
  chemically synthesized
cttagcgtattcattttttgtc

SEQ ID NO: 980117 - DNA, 22 bp, Artificial Sequence
  chemically synthesized
ccttagcgtattcattttttgt

SEQ ID NO: 980118 - DNA, 22 bp, Artificial Sequence
  chemically synthesized
gagatcgaaagacaaaaaatga

SEQ ID NO: 980119 - DNA, 22 bp, Artificial Sequence
  chemically synthesized
agatcgaaagacaaaaaatgaa

SEQ ID NO: 980120 - DNA, 22 bp, Artificial Sequence
  chemically synthesized
ccacacttccttagcgtattca

SEQ ID NO: 980121 - DNA, 22 bp, Artificial Sequence
  chemically synthesized
tgactgccacacttccttagcg

SEQ ID NO: 980122 - DNA, 22 bp, Artificial Sequence
  chemically synthesized
gtgactgccacacttccttagc

SEQ ID NO: 980123 - DNA, 22 bp, Artificial Sequence
  chemically synthesized
tgtgactgccacacttccttag

SEQ ID NO: 980124 - DNA, 22 bp, Artificial Sequence
  chemically synthesized
tttgtgactgccacacttcctt

SEQ ID NO: 980125 - DNA, 22 bp, Artificial Sequence
  chemically synthesized
ctctttgtgactgccacacttc

SEQ ID NO: 980126 - DNA, 22 bp, Artificial Sequence
  chemically synthesized
gatacattcctctttgtgactg

SEQ ID NO: 980127 - DNA, 22 bp, Artificial Sequence
  chemically synthesized
aggaagtgtggcagtcacaaag

SEQ ID NO: 980128 - DNA, 22 bp, Artificial Sequence
  chemically synthesized
agaactagatacattcctcttt

SEQ ID NO: 980129 - DNA, 22 bp, Artificial Sequence
  chemically synthesized
attaagaactagatacattcct

SEQ ID NO: 980130 - DNA, 22 bp, Artificial Sequence
  chemically synthesized
ccctgattaagaactagataca

SEQ ID NO: 980131 - DNA, 22 bp, Artificial Sequence
  chemically synthesized
aggtctgccctgattaagaact

SEQ ID NO: 980132 - DNA, 22 bp, Artificial Sequence
  chemically synthesized
gttcttaatcagggcagacctc

SEQ ID NO: 980133 - DNA, 22 bp, Artificial Sequence
  chemically synthesized
aaaatgtgaatattgaggtctg

SEQ ID NO: 980134 - DNA, 22 bp, Artificial Sequence
  chemically synthesized
ttaatcagggcagacctcaata

SEQ ID NO: 980135 - DNA, 22 bp, Artificial Sequence
  chemically synthesized
aatcagggcagacctcaatatt

SEQ ID NO: 980136 - DNA, 22 bp, Artificial Sequence
  chemically synthesized
atcagggcagacctcaatattc

SEQ ID NO: 980137 - DNA, 22 bp, Artificial Sequence
  chemically synthesized
tgctaaaaatgtgaatattgag

SEQ ID NO: 980138 - DNA, 22 bp, Artificial Sequence
  chemically synthesized
gtgctaaaaatgtgaatattga

SEQ ID NO: 980139 - DNA, 22 bp, Artificial Sequence
  chemically synthesized
tgtgctaaaaatgtgaatattg

SEQ ID NO: 980140 - DNA, 22 bp, Artificial Sequence
  chemically synthesized
ttgtgctaaaaatgtgaatatt

SEQ ID NO: 980141 - DNA, 22 bp, Artificial Sequence
  chemically synthesized
gcttttgtgctaaaaatgtgaa

SEQ ID NO: 980142 - DNA, 22 bp, Artificial Sequence
  chemically synthesized
ggcttttgtgctaaaaatgtga

SEQ ID NO: 980143 - DNA, 22 bp, Artificial Sequence
  chemically synthesized
tggcttttgtgctaaaaatgtg

SEQ ID NO: 980144 - DNA, 22 bp, Artificial Sequence
  chemically synthesized
ttggcttttgtgctaaaaatgt

SEQ ID NO: 980145 - DNA, 22 bp, Artificial Sequence
  chemically synthesized
ccttttggcttttgtgctaaaa

SEQ ID NO: 980146 - DNA, 22 bp, Artificial Sequence
  chemically synthesized
aatattcacatttttagcacaa

SEQ ID NO: 980147 - DNA, 22 bp, Artificial Sequence
  chemically synthesized
aaccctcccttttggcttttgt

SEQ ID NO: 980148 - DNA, 22 bp, Artificial Sequence
  chemically synthesized
acatttttagcacaaaagccaa

SEQ ID NO: 980149 - DNA, 22 bp, Artificial Sequence
  chemically synthesized
caaccctcccttttggcttttg

SEQ ID NO: 980150 - DNA, 22 bp, Artificial Sequence
  chemically synthesized
ttagcacaaaagccaaaaggga

SEQ ID NO: 980151 - DNA, 22 bp, Artificial Sequence
  chemically synthesized
tagcacaaaagccaaaagggag

SEQ ID NO: 980152 - DNA, 22 bp, Artificial Sequence
  chemically synthesized
taaatttcaaccctcccttttg

SEQ ID NO: 980153 - DNA, 22 bp, Artificial Sequence
  chemically synthesized
agcacaaaagccaaaagggagg

SEQ ID NO: 980154 - DNA, 22 bp, Artificial Sequence
  chemically synthesized
gtaaatttcaaccctccctttt

SEQ ID NO: 980155 - DNA, 22 bp, Artificial Sequence
  chemically synthesized
gcacaaaagccaaaagggaggg

SEQ ID NO: 980156 - DNA, 22 bp, Artificial Sequence
  chemically synthesized
accaagatgaagggacttgtaa

SEQ ID NO: 980157 - DNA, 22 bp, Artificial Sequence
  chemically synthesized
aaatttacaagtcccttcatct

SEQ ID NO: 980158 - DNA, 22 bp, Artificial Sequence
  chemically synthesized
cccacagagcctaaccaagatg

SEQ ID NO: 980159 - DNA, 22 bp, Artificial Sequence
  chemically synthesized
acaagtcccttcatcttggtta

SEQ ID NO: 980160 - DNA, 22 bp, Artificial Sequence
  chemically synthesized
caagtcccttcatcttggttag

SEQ ID NO: 980161 - DNA, 22 bp, Artificial Sequence
  chemically synthesized
catcttggttaggctctgtggg

SEQ ID NO: 980162 - DNA, 22 bp, Artificial Sequence
  chemically synthesized
cagggagaactccccacagagc

SEQ ID NO: 980163 - DNA, 22 bp, Artificial Sequence
  chemically synthesized
atcttggttaggctctgtgggg

SEQ ID NO: 980164 - DNA, 22 bp, Artificial Sequence
  chemically synthesized
ggttaggctctgtggggagttc

SEQ ID NO: 980165 - DNA, 22 bp, Artificial Sequence
  chemically synthesized
gttaggctctgtggggagttct

SEQ ID NO: 980166 - DNA, 22 bp, Artificial Sequence
  chemically synthesized
ggctctgtggggagttctccct

SEQ ID NO: 980167 - DNA, 22 bp, Artificial Sequence
  chemically synthesized
tgtggggagttctccctgcagc

SEQ ID NO: 980168 - DNA, 22 bp, Artificial Sequence
  chemically synthesized
tggggagttctccctgcagctg

SEQ ID NO: 980169 - DNA, 22 bp, Artificial Sequence
  chemically synthesized
tccctgcagctggtgggctgct

SEQ ID NO: 980170 - DNA, 22 bp, Artificial Sequence
  chemically synthesized
cctgcagctggtgggctgcttc

SEQ ID NO: 980171 - DNA, 22 bp, Artificial Sequence
  chemically synthesized
cagctggtgggctgcttcctgc

SEQ ID NO: 980172 - DNA, 22 bp, Artificial Sequence
  chemically synthesized
gtgggctgcttcctgcttctga

SEQ ID NO: 980173 - DNA, 22 bp, Artificial Sequence
  chemically synthesized
caggtggagacatcagaagcag

SEQ ID NO: 980174 - DNA, 22 bp, Artificial Sequence
  chemically synthesized
cttcctgcttctgatgtctcca

SEQ ID NO: 980175 - DNA, 22 bp, Artificial Sequence
  chemically synthesized
cctgcttctgatgtctccacct

SEQ ID NO: 980176 - DNA, 22 bp, Artificial Sequence
  chemically synthesized
ctgcttctgatgtctccacctg

SEQ ID NO: 980177 - DNA, 22 bp, Artificial Sequence
  chemically synthesized
cttctgatgtctccacctgcag

SEQ ID NO: 980178 - DNA, 22 bp, Artificial Sequence
  chemically synthesized
ctgatgtctccacctgcaggtg

SEQ ID NO: 980179 - DNA, 22 bp, Artificial Sequence
  chemically synthesized
tgatgtctccacctgcaggtgg

SEQ ID NO: 980180 - DNA, 22 bp, Artificial Sequence
  chemically synthesized
atgtctccacctgcaggtggtg

SEQ ID NO: 980181 - DNA, 22 bp, Artificial Sequence
  chemically synthesized
cacctgcaggtggtggcactgg

SEQ ID NO: 980182 - DNA, 22 bp, Artificial Sequence
  chemically synthesized
aggaggtcaggggccagtgcca

SEQ ID NO: 980183 - DNA, 22 bp, Artificial Sequence
  chemically synthesized
caggaggtcaggggccagtgcc

SEQ ID NO: 980184 - DNA, 22 bp, Artificial Sequence
  chemically synthesized
tttcaggaggtcaggggccagt

SEQ ID NO: 980185 - DNA, 22 bp, Artificial Sequence
  chemically synthesized
caggtggtggcactggcccctg

SEQ ID NO: 980186 - DNA, 22 bp, Artificial Sequence
  chemically synthesized
atttcaggaggtcaggggccag

SEQ ID NO: 980187 - DNA, 22 bp, Artificial Sequence
  chemically synthesized
gcccctgacctcctgaaataag

SEQ ID NO: 980188 - DNA, 22 bp, Artificial Sequence
  chemically synthesized
acctcctgaaataagcctgttg

SEQ ID NO: 980189 - DNA, 22 bp, Artificial Sequence
  chemically synthesized
ctgaaataagcctgttgatctt

SEQ ID NO: 980190 - DNA, 22 bp, Artificial Sequence
  chemically synthesized
aaataagcctgttgatcttctc

SEQ ID NO: 980191 - DNA, 22 bp, Artificial Sequence
  chemically synthesized
ttgatcttctcccacattattc

SEQ ID NO: 980192 - DNA, 22 bp, Artificial Sequence
  chemically synthesized
atcttctcccacattattcctg

SEQ ID NO: 980193 - DNA, 22 bp, Artificial Sequence
  chemically synthesized
ctcccacattattcctgctgcc

SEQ ID NO: 980194 - DNA, 22 bp, Artificial Sequence
  chemically synthesized
tcccacattattcctgctgcct

SEQ ID NO: 980195 - DNA, 22 bp, Artificial Sequence
  chemically synthesized
tcagcagtccacaggcagcagg

SEQ ID NO: 980196 - DNA, 22 bp, Artificial Sequence
  chemically synthesized
ccacattattcctgctgcctgt

SEQ ID NO: 980197 - DNA, 22 bp, Artificial Sequence
  chemically synthesized
ctgtcagcagtccacaggcagc

SEQ ID NO: 980198 - DNA, 22 bp, Artificial Sequence
  chemically synthesized
cctgtcagcagtccacaggcag

SEQ ID NO: 980199 - DNA, 22 bp, Artificial Sequence
  chemically synthesized
acttcctgtcagcagtccacag

SEQ ID NO: 980200 - DNA, 22 bp, Artificial Sequence
  chemically synthesized
ttcctgctgcctgtggactgct

SEQ ID NO: 980201 - DNA, 22 bp, Artificial Sequence
  chemically synthesized
ctgctgcctgtggactgctgac

SEQ ID NO: 980202 - DNA, 22 bp, Artificial Sequence
  chemically synthesized
ctgcctgtggactgctgacagg

SEQ ID NO: 980203 - DNA, 22 bp, Artificial Sequence
  chemically synthesized
tcgtcccctaacttcctgtcag

SEQ ID NO: 980204 - DNA, 22 bp, Artificial Sequence
  chemically synthesized
cctgtggactgctgacaggaag

SEQ ID NO: 980205 - DNA, 22 bp, Artificial Sequence
  chemically synthesized
gtcgtcccctaacttcctgtca

SEQ ID NO: 980206 - DNA, 22 bp, Artificial Sequence
  chemically synthesized
tgtcgtcccctaacttcctgtc

SEQ ID NO: 980207 - DNA, 22 bp, Artificial Sequence
  chemically synthesized
ttgtcgtcccctaacttcctgt

SEQ ID NO: 980208 - DNA, 22 bp, Artificial Sequence
  chemically synthesized
tttgtcgtcccctaacttcctg

SEQ ID NO: 980209 - DNA, 22 bp, Artificial Sequence
  chemically synthesized
tggactgctgacaggaagttag

SEQ ID NO: 980210 - DNA, 22 bp, Artificial Sequence
  chemically synthesized
ctgacaggaagttaggggacga

SEQ ID NO: 980211 - DNA, 22 bp, Artificial Sequence
  chemically synthesized
agggactttttgtcgtccccta

SEQ ID NO: 980212 - DNA, 22 bp, Artificial Sequence
  chemically synthesized
acaggaagttaggggacgacaa

SEQ ID NO: 980213 - DNA, 22 bp, Artificial Sequence
  chemically synthesized
ctgagggactttttgtcgtccc

SEQ ID NO: 980214 - DNA, 22 bp, Artificial Sequence
  chemically synthesized
actgagggactttttgtcgtcc

SEQ ID NO: 980215 - DNA, 22 bp, Artificial Sequence
  chemically synthesized
tactgagggactttttgtcgtc

SEQ ID NO: 980216 - DNA, 22 bp, Artificial Sequence
  chemically synthesized
ttactgagggactttttgtcgt

SEQ ID NO: 980217 - DNA, 22 bp, Artificial Sequence
  chemically synthesized
ggggacgacaaaaagtccctca

SEQ ID NO: 980218 - DNA, 22 bp, Artificial Sequence
  chemically synthesized
atcgagtcttttactgagggac

SEQ ID NO: 980219 - DNA, 22 bp, Artificial Sequence
  chemically synthesized
aatcgagtcttttactgaggga

SEQ ID NO: 980220 - DNA, 22 bp, Artificial Sequence
  chemically synthesized
gccacttaatcgagtcttttac

SEQ ID NO: 980221 - DNA, 22 bp, Artificial Sequence
  chemically synthesized
agccacttaatcgagtctttta

SEQ ID NO: 980222 - DNA, 22 bp, Artificial Sequence
  chemically synthesized
tttagccacttaatcgagtctt

SEQ ID NO: 980223 - DNA, 22 bp, Artificial Sequence
  chemically synthesized
agtaaaagactcgattaagtgg

SEQ ID NO: 980224 - DNA, 22 bp, Artificial Sequence
  chemically synthesized
ggaggaaacgttatttagccac

SEQ ID NO: 980225 - DNA, 22 bp, Artificial Sequence
  chemically synthesized
cggaggaaacgttatttagcca

SEQ ID NO: 980226 - DNA, 22 bp, Artificial Sequence
  chemically synthesized
tcggaggaaacgttatttagcc

SEQ ID NO: 980227 - DNA, 22 bp, Artificial Sequence
  chemically synthesized
gattaagtggctaaataacgtt

SEQ ID NO: 980228 - DNA, 22 bp, Artificial Sequence
  chemically synthesized
agtggctaaataacgtttcctc

SEQ ID NO: 980229 - DNA, 22 bp, Artificial Sequence
  chemically synthesized
aaaagaaagctttcggaggaaa

SEQ ID NO: 980230 - DNA, 22 bp, Artificial Sequence
  chemically synthesized
gaaaagaaagctttcggaggaa

SEQ ID NO: 980231 - DNA, 22 bp, Artificial Sequence
  chemically synthesized
tttgaaaagaaagctttcggag

SEQ ID NO: 980232 - DNA, 22 bp, Artificial Sequence
  chemically synthesized
aataacgtttcctccgaaagct

SEQ ID NO: 980233 - DNA, 22 bp, Artificial Sequence
  chemically synthesized
atttgaaaagaaagctttcgga

SEQ ID NO: 980234 - DNA, 22 bp, Artificial Sequence
  chemically synthesized
aaaaccttatttgaaaagaaag

SEQ ID NO: 980235 - DNA, 22 bp, Artificial Sequence
  chemically synthesized
gaaaaccttatttgaaaagaaa

SEQ ID NO: 980236 - DNA, 22 bp, Artificial Sequence
  chemically synthesized
cctccgaaagctttcttttcaa

SEQ ID NO: 980237 - DNA, 22 bp, Artificial Sequence
  chemically synthesized
tgaaaaccttatttgaaaagaa

SEQ ID NO: 980238 - DNA, 22 bp, Artificial Sequence
  chemically synthesized
ctccgaaagctttcttttcaaa

SEQ ID NO: 980239 - DNA, 22 bp, Artificial Sequence
  chemically synthesized
cgaaagctttcttttcaaataa

SEQ ID NO: 980240 - DNA, 22 bp, Artificial Sequence
  chemically synthesized
tcttttcaaataaggttttcaa

SEQ ID NO: 980241 - DNA, 22 bp, Artificial Sequence
  chemically synthesized
cttttcaaataaggttttcaaa

SEQ ID NO: 980242 - DNA, 22 bp, Artificial Sequence
  chemically synthesized
ttttcaaataaggttttcaaaa

SEQ ID NO: 980243 - DNA, 22 bp, Artificial Sequence
  chemically synthesized
ttcaaataaggttttcaaaata

SEQ ID NO: 980244 - DNA, 22 bp, Artificial Sequence
  chemically synthesized
tcaaataaggttttcaaaatat

SEQ ID NO: 980245 - DNA, 22 bp, Artificial Sequence
  chemically synthesized
caaataaggttttcaaaatatg

SEQ ID NO: 980246 - DNA, 22 bp, Artificial Sequence
  chemically synthesized
aaataaggttttcaaaatatgt

SEQ ID NO: 980247 - DNA, 22 bp, Artificial Sequence
  chemically synthesized
tcaaaatatgtgtgcatatata

SEQ ID NO: 980248 - DNA, 22 bp, Artificial Sequence
  chemically synthesized
caaaatatgtgtgcatatatat

SEQ ID NO: 980249 - DNA, 22 bp, Artificial Sequence
  chemically synthesized
aaaatatgtgtgcatatatata

SEQ ID NO: 980250 - DNA, 22 bp, Artificial Sequence
  chemically synthesized
aataaaaccgaatacatatata

SEQ ID NO: 980251 - DNA, 22 bp, Artificial Sequence
  chemically synthesized
tgaataaaaccgaatacatata

SEQ ID NO: 980252 - DNA, 22 bp, Artificial Sequence
  chemically synthesized
cattctgaataaaaccgaatac

SEQ ID NO: 980253 - DNA, 22 bp, Artificial Sequence
  chemically synthesized
tgcattctgaataaaaccgaat

SEQ ID NO: 980254 - DNA, 22 bp, Artificial Sequence
  chemically synthesized
ctgcattctgaataaaaccgaa

SEQ ID NO: 980255 - DNA, 22 bp, Artificial Sequence
  chemically synthesized
cgcagatacacttctgcattct

SEQ ID NO: 980256 - DNA, 22 bp, Artificial Sequence
  chemically synthesized
ggttttattcagaatgcagaag

SEQ ID NO: 980257 - DNA, 22 bp, Artificial Sequence
  chemically synthesized
tccgcagatacacttctgcatt

SEQ ID NO: 980258 - DNA, 22 bp, Artificial Sequence
  chemically synthesized
ctctccgcagatacacttctgc

SEQ ID NO: 980259 - DNA, 22 bp, Artificial Sequence
  chemically synthesized
tattcagaatgcagaagtgtat

SEQ ID NO: 980260 - DNA, 22 bp, Artificial Sequence
  chemically synthesized
tgctctccgcagatacacttct

SEQ ID NO: 980261 - DNA, 22 bp, Artificial Sequence
  chemically synthesized
attcagaatgcagaagtgtatc

SEQ ID NO: 980262 - DNA, 22 bp, Artificial Sequence
  chemically synthesized
ctgctctccgcagatacacttc

SEQ ID NO: 980263 - DNA, 22 bp, Artificial Sequence
  chemically synthesized
ttcagaatgcagaagtgtatct

SEQ ID NO: 980264 - DNA, 22 bp, Artificial Sequence
  chemically synthesized
agaatgcagaagtgtatctgcg

SEQ ID NO: 980265 - DNA, 22 bp, Artificial Sequence
  chemically synthesized
caatgcccttctgctctccgca

SEQ ID NO: 980266 - DNA, 22 bp, Artificial Sequence
  chemically synthesized
ccaatgcccttctgctctccgc

SEQ ID NO: 980267 - DNA, 22 bp, Artificial Sequence
  chemically synthesized
cttccaatgcccttctgctctc

SEQ ID NO: 980268 - DNA, 22 bp, Artificial Sequence
  chemically synthesized
actccttccaatgcccttctgc

SEQ ID NO: 980269 - DNA, 22 bp, Artificial Sequence
  chemically synthesized
gactccttccaatgcccttctg

SEQ ID NO: 980270 - DNA, 22 bp, Artificial Sequence
  chemically synthesized
tgactccttccaatgcccttct

SEQ ID NO: 980271 - DNA, 22 bp, Artificial Sequence
  chemically synthesized
ttgactccttccaatgcccttc

SEQ ID NO: 980272 - DNA, 22 bp, Artificial Sequence
  chemically synthesized
tttgactccttccaatgccctt

SEQ ID NO: 980273 - DNA, 22 bp, Artificial Sequence
  chemically synthesized
ttttgactccttccaatgccct

SEQ ID NO: 980274 - DNA, 22 bp, Artificial Sequence
  chemically synthesized
cggagagcagaagggcattgga

SEQ ID NO: 980275 - DNA, 22 bp, Artificial Sequence
  chemically synthesized
tttttgactccttccaatgccc

SEQ ID NO: 980276 - DNA, 22 bp, Artificial Sequence
  chemically synthesized
gaaggagtcaaaaaaaatgtgt

SEQ ID NO: 980277 - DNA, 22 bp, Artificial Sequence
  chemically synthesized
gcatatagtgagtgtgtgtata

SEQ ID NO: 980278 - DNA, 22 bp, Artificial Sequence
  chemically synthesized
ggcatatagtgagtgtgtgtat

SEQ ID NO: 980279 - DNA, 22 bp, Artificial Sequence
  chemically synthesized
tggcatatagtgagtgtgtgta

SEQ ID NO: 980280 - DNA, 22 bp, Artificial Sequence
  chemically synthesized
ttggcatatagtgagtgtgtgt

SEQ ID NO: 980281 - DNA, 22 bp, Artificial Sequence
  chemically synthesized
cttttggcatatagtgagtgtg

SEQ ID NO: 980282 - DNA, 22 bp, Artificial Sequence
  chemically synthesized
ccttttggcatatagtgagtgt

SEQ ID NO: 980283 - DNA, 22 bp, Artificial Sequence
  chemically synthesized
tccttttggcatatagtgagtg

SEQ ID NO: 980284 - DNA, 22 bp, Artificial Sequence
  chemically synthesized
ttccttttggcatatagtgagt

SEQ ID NO: 980285 - DNA, 22 bp, Artificial Sequence
  chemically synthesized
cttttccttttggcatatagtg

SEQ ID NO: 980286 - DNA, 22 bp, Artificial Sequence
  chemically synthesized
gcttttccttttggcatatagt

SEQ ID NO: 980287 - DNA, 22 bp, Artificial Sequence
  chemically synthesized
tttgcttttccttttggcatat

SEQ ID NO: 980288 - DNA, 22 bp, Artificial Sequence
  chemically synthesized
ctgtttgcttttccttttggca

SEQ ID NO: 980289 - DNA, 22 bp, Artificial Sequence
  chemically synthesized
tcctgtttgcttttccttttgg

SEQ ID NO: 980290 - DNA, 22 bp, Artificial Sequence
  chemically synthesized
ctcctgtttgcttttccttttg

SEQ ID NO: 980291 - DNA, 22 bp, Artificial Sequence
  chemically synthesized
tctcctgtttgcttttcctttt

SEQ ID NO: 980292 - DNA, 22 bp, Artificial Sequence
  chemically synthesized
ttctcctgtttgcttttccttt

SEQ ID NO: 980293 - DNA, 22 bp, Artificial Sequence
  chemically synthesized
actatatgccaaaaggaaaagc

SEQ ID NO: 980294 - DNA, 22 bp, Artificial Sequence
  chemically synthesized
tttctcctgtttgcttttcctt

SEQ ID NO: 980295 - DNA, 22 bp, Artificial Sequence
  chemically synthesized
tatgccaaaaggaaaagcaaac

SEQ ID NO: 980296 - DNA, 22 bp, Artificial Sequence
  chemically synthesized
aacacatctttttctcctgttt

SEQ ID NO: 980297 - DNA, 22 bp, Artificial Sequence
  chemically synthesized
caacacatctttttctcctgtt

SEQ ID NO: 980298 - DNA, 22 bp, Artificial Sequence
  chemically synthesized
tcaagatttcaacacatctttt

SEQ ID NO: 980299 - DNA, 22 bp, Artificial Sequence
  chemically synthesized
tgtcaagatttcaacacatctt

SEQ ID NO: 980300 - DNA, 22 bp, Artificial Sequence
  chemically synthesized
tgctctgtcaagatttcaacac

SEQ ID NO: 980301 - DNA, 22 bp, Artificial Sequence
  chemically synthesized
tctgtgctctgtcaagatttca

SEQ ID NO: 980302 - DNA, 22 bp, Artificial Sequence
  chemically synthesized
ttgtctgtgctctgtcaagatt

SEQ ID NO: 980303 - DNA, 22 bp, Artificial Sequence
  chemically synthesized
aaatcttgacagagcacagaca

SEQ ID NO: 980304 - DNA, 22 bp, Artificial Sequence
  chemically synthesized
aaatatgccactgttgtctgtg

SEQ ID NO: 980305 - DNA, 22 bp, Artificial Sequence
  chemically synthesized
actcaaatatgccactgttgtc

SEQ ID NO: 980306 - DNA, 22 bp, Artificial Sequence
  chemically synthesized
gacagagcacagacaacagtgg

SEQ ID NO: 980307 - DNA, 22 bp, Artificial Sequence
  chemically synthesized
acagagcacagacaacagtggc

SEQ ID NO: 980308 - DNA, 22 bp, Artificial Sequence
  chemically synthesized
taactcaaatatgccactgttg

SEQ ID NO: 980309 - DNA, 22 bp, Artificial Sequence
  chemically synthesized
ctaactcaaatatgccactgtt

SEQ ID NO: 980310 - DNA, 22 bp, Artificial Sequence
  chemically synthesized
tctaactcaaatatgccactgt

SEQ ID NO: 980311 - DNA, 22 bp, Artificial Sequence
  chemically synthesized
ttttctaactcaaatatgccac

SEQ ID NO: 980312 - DNA, 22 bp, Artificial Sequence
  chemically synthesized
attttctaactcaaatatgcca

SEQ ID NO: 980313 - DNA, 22 bp, Artificial Sequence
  chemically synthesized
tttattttctaactcaaatatg

SEQ ID NO: 980314 - DNA, 22 bp, Artificial Sequence
  chemically synthesized
gtttattttctaactcaaatat

SEQ ID NO: 980315 - DNA, 22 bp, Artificial Sequence
  chemically synthesized
aaatgcacacccttgtttattt

SEQ ID NO: 980316 - DNA, 22 bp, Artificial Sequence
  chemically synthesized
taaaatgcacacccttgtttat

SEQ ID NO: 980317 - DNA, 22 bp, Artificial Sequence
  chemically synthesized
gagttagaaaataaacaagggt

SEQ ID NO: 980318 - DNA, 22 bp, Artificial Sequence
  chemically synthesized
agttagaaaataaacaagggtg

SEQ ID NO: 980319 - DNA, 22 bp, Artificial Sequence
  chemically synthesized
agaattctaaaatgcacaccct

SEQ ID NO: 980320 - DNA, 22 bp, Artificial Sequence
  chemically synthesized
gaaaataaacaagggtgtgcat

SEQ ID NO: 980321 - DNA, 22 bp, Artificial Sequence
  chemically synthesized
gacaaaaatcaaataaatctga

SEQ ID NO: 980322 - DNA, 22 bp, Artificial Sequence
  chemically synthesized
tagaattctcagatttatttga

SEQ ID NO: 980323 - DNA, 22 bp, Artificial Sequence
  chemically synthesized
agaattctcagatttatttgat

SEQ ID NO: 980324 - DNA, 22 bp, Artificial Sequence
  chemically synthesized
gaattctcagatttatttgatt

SEQ ID NO: 980325 - DNA, 22 bp, Artificial Sequence
  chemically synthesized
tagtggttggacaaaaatcaaa

SEQ ID NO: 980326 - DNA, 22 bp, Artificial Sequence
  chemically synthesized
gtagtggttggacaaaaatcaa

SEQ ID NO: 980327 - DNA, 22 bp, Artificial Sequence
  chemically synthesized
tgtagtggttggacaaaaatca

SEQ ID NO: 980328 - DNA, 22 bp, Artificial Sequence
  chemically synthesized
tcagatttatttgatttttgtc

SEQ ID NO: 980329 - DNA, 22 bp, Artificial Sequence
  chemically synthesized
agatttatttgatttttgtcca

SEQ ID NO: 980330 - DNA, 22 bp, Artificial Sequence
  chemically synthesized
ctttgtagtggttggacaaaaa

SEQ ID NO: 980331 - DNA, 22 bp, Artificial Sequence
  chemically synthesized
actttgtagtggttggacaaaa

SEQ ID NO: 980332 - DNA, 22 bp, Artificial Sequence
  chemically synthesized
cttactttgtagtggttggaca

SEQ ID NO: 980333 - DNA, 22 bp, Artificial Sequence
  chemically synthesized
atttgatttttgtccaaccact

SEQ ID NO: 980334 - DNA, 22 bp, Artificial Sequence
  chemically synthesized
tttgatttttgtccaaccacta

SEQ ID NO: 980335 - DNA, 22 bp, Artificial Sequence
  chemically synthesized
ctccttactttgtagtggttgg

SEQ ID NO: 980336 - DNA, 22 bp, Artificial Sequence
  chemically synthesized
actccttactttgtagtggttg

SEQ ID NO: 980337 - DNA, 22 bp, Artificial Sequence
  chemically synthesized
gatttttgtccaaccactacaa

SEQ ID NO: 980338 - DNA, 22 bp, Artificial Sequence
  chemically synthesized
atttttgtccaaccactacaaa

SEQ ID NO: 980339 - DNA, 22 bp, Artificial Sequence
  chemically synthesized
acgtttactccttactttgtag

SEQ ID NO: 980340 - DNA, 22 bp, Artificial Sequence
  chemically synthesized
ttgtccaaccactacaaagtaa

SEQ ID NO: 980341 - DNA, 22 bp, Artificial Sequence
  chemically synthesized
tgtccaaccactacaaagtaag

SEQ ID NO: 980342 - DNA, 22 bp, Artificial Sequence
  chemically synthesized
gtccaaccactacaaagtaagg

SEQ ID NO: 980343 - DNA, 22 bp, Artificial Sequence
  chemically synthesized
tccaaccactacaaagtaagga

SEQ ID NO: 980344 - DNA, 22 bp, Artificial Sequence
  chemically synthesized
atattcacgtttactccttact

SEQ ID NO: 980345 - DNA, 22 bp, Artificial Sequence
  chemically synthesized
ccccctcatattcacgtttact

SEQ ID NO: 980346 - DNA, 22 bp, Artificial Sequence
  chemically synthesized
accccctcatattcacgtttac

SEQ ID NO: 980347 - DNA, 22 bp, Artificial Sequence
  chemically synthesized
caaagtaaggagtaaacgtgaa

SEQ ID NO: 980348 - DNA, 22 bp, Artificial Sequence
  chemically synthesized
ttaccccctcatattcacgttt

SEQ ID NO: 980349 - DNA, 22 bp, Artificial Sequence
  chemically synthesized
tcttaccccctcatattcacgt

SEQ ID NO: 980350 - DNA, 22 bp, Artificial Sequence
  chemically synthesized
ctcttaccccctcatattcacg

SEQ ID NO: 980351 - DNA, 22 bp, Artificial Sequence
  chemically synthesized
tctcttaccccctcatattcac

SEQ ID NO: 980352 - DNA, 22 bp, Artificial Sequence
  chemically synthesized
ttttctcttaccccctcatatt

SEQ ID NO: 980353 - DNA, 22 bp, Artificial Sequence
  chemically synthesized
attttctcttaccccctcatat

SEQ ID NO: 980354 - DNA, 22 bp, Artificial Sequence
  chemically synthesized
aatcaacttattttctcttacc

SEQ ID NO: 980355 - DNA, 22 bp, Artificial Sequence
  chemically synthesized
accattaaatcaacttattttc

SEQ ID NO: 980356 - DNA, 22 bp, Artificial Sequence
  chemically synthesized
gttcaccattaaatcaacttat

SEQ ID NO: 980357 - DNA, 22 bp, Artificial Sequence
  chemically synthesized
tccctagttcaccattaaatca

SEQ ID NO: 980358 - DNA, 22 bp, Artificial Sequence
  chemically synthesized
gtccctagttcaccattaaatc

SEQ ID NO: 980359 - DNA, 22 bp, Artificial Sequence
  chemically synthesized
tgtccctagttcaccattaaat

SEQ ID NO: 980360 - DNA, 22 bp, Artificial Sequence
  chemically synthesized
ggactttgtccctagttcacca

SEQ ID NO: 980361 - DNA, 22 bp, Artificial Sequence
  chemically synthesized
atttaatggtgaactagggaca

SEQ ID NO: 980362 - DNA, 22 bp, Artificial Sequence
  chemically synthesized
aatggtgaactagggacaaagt

SEQ ID NO: 980363 - DNA, 22 bp, Artificial Sequence
  chemically synthesized
atggtgaactagggacaaagtc

SEQ ID NO: 980364 - DNA, 22 bp, Artificial Sequence
  chemically synthesized
gggacaaagtcctagtgttttg

SEQ ID NO: 980365 - DNA, 22 bp, Artificial Sequence
  chemically synthesized
ggtcacagagcaaatgcaaaac

SEQ ID NO: 980366 - DNA, 22 bp, Artificial Sequence
  chemically synthesized
aagacctgggtcacagagcaaa

SEQ ID NO: 980367 - DNA, 22 bp, Artificial Sequence
  chemically synthesized
gtgttttgcatttgctctgtga

SEQ ID NO: 980368 - DNA, 22 bp, Artificial Sequence
  chemically synthesized
tgcatttgctctgtgacccagg

SEQ ID NO: 980369 - DNA, 22 bp, Artificial Sequence
  chemically synthesized
gcatttgctctgtgacccaggt

SEQ ID NO: 980370 - DNA, 22 bp, Artificial Sequence
  chemically synthesized
catttgctctgtgacccaggtc

SEQ ID NO: 980371 - DNA, 22 bp, Artificial Sequence
  chemically synthesized
gctctgtgacccaggtcttcag

SEQ ID NO: 980372 - DNA, 22 bp, Artificial Sequence
  chemically synthesized
ctctgtgacccaggtcttcagc

SEQ ID NO: 980373 - DNA, 22 bp, Artificial Sequence
  chemically synthesized
ccaaggaaaggtgctgaagacc

SEQ ID NO: 980374 - DNA, 22 bp, Artificial Sequence
  chemically synthesized
gccaaggaaaggtgctgaagac

SEQ ID NO: 980375 - DNA, 22 bp, Artificial Sequence
  chemically synthesized
tgtgacccaggtcttcagcacc

SEQ ID NO: 980376 - DNA, 22 bp, Artificial Sequence
  chemically synthesized
tgacccaggtcttcagcacctt

SEQ ID NO: 980377 - DNA, 22 bp, Artificial Sequence
  chemically synthesized
acttgccaaggaaaggtgctga

SEQ ID NO: 980378 - DNA, 22 bp, Artificial Sequence
  chemically synthesized
aaaatcatcctgacttgccaag

SEQ ID NO: 980379 - DNA, 22 bp, Artificial Sequence
  chemically synthesized
cagcacctttccttggcaagtc

SEQ ID NO: 980380 - DNA, 22 bp, Artificial Sequence
  chemically synthesized
agcacctttccttggcaagtca

SEQ ID NO: 980381 - DNA, 22 bp, Artificial Sequence
  chemically synthesized
gttaaaaatcatcctgacttgc

SEQ ID NO: 980382 - DNA, 22 bp, Artificial Sequence
  chemically synthesized
tccttggcaagtcaggatgatt

SEQ ID NO: 980383 - DNA, 22 bp, Artificial Sequence
  chemically synthesized
ccttggcaagtcaggatgattt

SEQ ID NO: 980384 - DNA, 22 bp, Artificial Sequence
  chemically synthesized
ggagctagttaaaaatcatcct

SEQ ID NO: 980385 - DNA, 22 bp, Artificial Sequence
  chemically synthesized
cttggcaagtcaggatgatttt

SEQ ID NO: 980386 - DNA, 22 bp, Artificial Sequence
  chemically synthesized
ggcaagtcaggatgatttttaa

SEQ ID NO: 980387 - DNA, 22 bp, Artificial Sequence
  chemically synthesized
gttaggagctagttaaaaatca

SEQ ID NO: 980388 - DNA, 22 bp, Artificial Sequence
  chemically synthesized
gcaagtcaggatgatttttaac

SEQ ID NO: 980389 - DNA, 22 bp, Artificial Sequence
  chemically synthesized
acacaagaaagctagttaggag

SEQ ID NO: 980390 - DNA, 22 bp, Artificial Sequence
  chemically synthesized
ttaactagctcctaactagctt

SEQ ID NO: 980391 - DNA, 22 bp, Artificial Sequence
  chemically synthesized
taactagctcctaactagcttt

SEQ ID NO: 980392 - DNA, 22 bp, Artificial Sequence
  chemically synthesized
aactagctcctaactagctttc

SEQ ID NO: 980393 - DNA, 22 bp, Artificial Sequence
  chemically synthesized
actagctcctaactagctttct

SEQ ID NO: 980394 - DNA, 22 bp, Artificial Sequence
  chemically synthesized
gctcctaactagctttcttgtg

SEQ ID NO: 980395 - DNA, 22 bp, Artificial Sequence
  chemically synthesized
ctaactagctttcttgtgttag

SEQ ID NO: 980396 - DNA, 22 bp, Artificial Sequence
  chemically synthesized
gaaggaaacagaactaacacaa

SEQ ID NO: 980397 - DNA, 22 bp, Artificial Sequence
  chemically synthesized
actagctttcttgtgttagttc

SEQ ID NO: 980398 - DNA, 22 bp, Artificial Sequence
  chemically synthesized
gctttcttgtgttagttctgtt

SEQ ID NO: 980399 - DNA, 22 bp, Artificial Sequence
  chemically synthesized
tagattcgaaggaaacagaact

SEQ ID NO: 980400 - DNA, 22 bp, Artificial Sequence
  chemically synthesized
tcttgtgttagttctgtttcct

SEQ ID NO: 980401 - DNA, 22 bp, Artificial Sequence
  chemically synthesized
cttgtgttagttctgtttcctt

SEQ ID NO: 980402 - DNA, 22 bp, Artificial Sequence
  chemically synthesized
ttgtgttagttctgtttccttc

SEQ ID NO: 980403 - DNA, 22 bp, Artificial Sequence
  chemically synthesized
gcctatagattcgaaggaaaca

SEQ ID NO: 980404 - DNA, 22 bp, Artificial Sequence
  chemically synthesized
ggcctatagattcgaaggaaac

SEQ ID NO: 980405 - DNA, 22 bp, Artificial Sequence
  chemically synthesized
gtgttagttctgtttccttcga

SEQ ID NO: 980406 - DNA, 22 bp, Artificial Sequence
  chemically synthesized
tgttagttctgtttccttcgaa

SEQ ID NO: 980407 - DNA, 22 bp, Artificial Sequence
  chemically synthesized
cagcttggcctatagattcgaa

SEQ ID NO: 980408 - DNA, 22 bp, Artificial Sequence
  chemically synthesized
gttctgtttccttcgaatctat

SEQ ID NO: 980409 - DNA, 22 bp, Artificial Sequence
  chemically synthesized
tgcagcttggcctatagattcg

SEQ ID NO: 980410 - DNA, 22 bp, Artificial Sequence
  chemically synthesized
ctgcagcttggcctatagattc

SEQ ID NO: 980411 - DNA, 22 bp, Artificial Sequence
  chemically synthesized
tgtttccttcgaatctataggc

SEQ ID NO: 980412 - DNA, 22 bp, Artificial Sequence
  chemically synthesized
tttccttcgaatctataggcca

SEQ ID NO: 980413 - DNA, 22 bp, Artificial Sequence
  chemically synthesized
ccttcgaatctataggccaagc

SEQ ID NO: 980414 - DNA, 22 bp, Artificial Sequence
  chemically synthesized
cttcgaatctataggccaagct

SEQ ID NO: 980415 - DNA, 22 bp, Artificial Sequence
  chemically synthesized
cgaatctataggccaagctgca

SEQ ID NO: 980416 - DNA, 22 bp, Artificial Sequence
  chemically synthesized
gaatctataggccaagctgcag

SEQ ID NO: 980417 - DNA, 22 bp, Artificial Sequence
  chemically synthesized
gaaagcccccttctgcagcttg

SEQ ID NO: 980418 - DNA, 22 bp, Artificial Sequence
  chemically synthesized
agaaagcccccttctgcagctt

SEQ ID NO: 980419 - DNA, 22 bp, Artificial Sequence
  chemically synthesized
tagaaagcccccttctgcagct

SEQ ID NO: 980420 - DNA, 22 bp, Artificial Sequence
  chemically synthesized
taggccaagctgcagaaggggg

SEQ ID NO: 980421 - DNA, 22 bp, Artificial Sequence
  chemically synthesized
aattttagaaagcccccttctg

SEQ ID NO: 980422 - DNA, 22 bp, Artificial Sequence
  chemically synthesized
acaggcctgaattttagaaagc

SEQ ID NO: 980423 - DNA, 22 bp, Artificial Sequence
  chemically synthesized
cacaggcctgaattttagaaag

SEQ ID NO: 980424 - DNA, 22 bp, Artificial Sequence
  chemically synthesized
cagaagggggctttctaaaatt

SEQ ID NO: 980425 - DNA, 22 bp, Artificial Sequence
  chemically synthesized
gccaatgacttcacaggcctga

SEQ ID NO: 980426 - DNA, 22 bp, Artificial Sequence
  chemically synthesized
tctaaaattcaggcctgtgaag

SEQ ID NO: 980427 - DNA, 22 bp, Artificial Sequence
  chemically synthesized
ctaaaattcaggcctgtgaagt

SEQ ID NO: 980428 - DNA, 22 bp, Artificial Sequence
  chemically synthesized
tactggccaatgacttcacagg

SEQ ID NO: 980429 - DNA, 22 bp, Artificial Sequence
  chemically synthesized
taaaattcaggcctgtgaagtc

SEQ ID NO: 980430 - DNA, 22 bp, Artificial Sequence
  chemically synthesized
atactggccaatgacttcacag

SEQ ID NO: 980431 - DNA, 22 bp, Artificial Sequence
  chemically synthesized
tatactggccaatgacttcaca

SEQ ID NO: 980432 - DNA, 22 bp, Artificial Sequence
  chemically synthesized
aaattcaggcctgtgaagtcat

SEQ ID NO: 980433 - DNA, 22 bp, Artificial Sequence
  chemically synthesized
ttatactggccaatgacttcac

SEQ ID NO: 980434 - DNA, 22 bp, Artificial Sequence
  chemically synthesized
aggcctgtgaagtcattggcca

SEQ ID NO: 980435 - DNA, 22 bp, Artificial Sequence
  chemically synthesized
tgaagtcattggccagtataaa

SEQ ID NO: 980436 - DNA, 22 bp, Artificial Sequence
  chemically synthesized
taggaaaaaccatataaggctt

SEQ ID NO: 980437 - DNA, 22 bp, Artificial Sequence
  chemically synthesized
gccagtataaaagccttatatg

SEQ ID NO: 980438 - DNA, 22 bp, Artificial Sequence
  chemically synthesized
cgctataggaaaaaccatataa

SEQ ID NO: 980439 - DNA, 22 bp, Artificial Sequence
  chemically synthesized
gctacgctataggaaaaaccat

SEQ ID NO: 980440 - DNA, 22 bp, Artificial Sequence
  chemically synthesized
agctacgctataggaaaaacca

SEQ ID NO: 980441 - DNA, 22 bp, Artificial Sequence
  chemically synthesized
tagctacgctataggaaaaacc

SEQ ID NO: 980442 - DNA, 22 bp, Artificial Sequence
  chemically synthesized
ctttagctacgctataggaaaa

SEQ ID NO: 980443 - DNA, 22 bp, Artificial Sequence
  chemically synthesized
atatggtttttcctatagcgta

SEQ ID NO: 980444 - DNA, 22 bp, Artificial Sequence
  chemically synthesized
tatggtttttcctatagcgtag

SEQ ID NO: 980445 - DNA, 22 bp, Artificial Sequence
  chemically synthesized
aaaaccactgctttagctacgc

SEQ ID NO: 980446 - DNA, 22 bp, Artificial Sequence
  chemically synthesized
gaaaaccactgctttagctacg

SEQ ID NO: 980447 - DNA, 22 bp, Artificial Sequence
  chemically synthesized
tgaaaaccactgctttagctac

SEQ ID NO: 980448 - DNA, 22 bp, Artificial Sequence
  chemically synthesized
ttcctatagcgtagctaaagca

SEQ ID NO: 980449 - DNA, 22 bp, Artificial Sequence
  chemically synthesized
tcctatagcgtagctaaagcag

SEQ ID NO: 980450 - DNA, 22 bp, Artificial Sequence
  chemically synthesized
cctatagcgtagctaaagcagt

SEQ ID NO: 980451 - DNA, 22 bp, Artificial Sequence
  chemically synthesized
ctatagcgtagctaaagcagtg

SEQ ID NO: 980452 - DNA, 22 bp, Artificial Sequence
  chemically synthesized
tagcgtagctaaagcagtggtt

SEQ ID NO: 980453 - DNA, 22 bp, Artificial Sequence
  chemically synthesized
atcgtgctttgaaaaccactgc

SEQ ID NO: 980454 - DNA, 22 bp, Artificial Sequence
  chemically synthesized
gatcgtgctttgaaaaccactg

SEQ ID NO: 980455 - DNA, 22 bp, Artificial Sequence
  chemically synthesized
gccttgatcgtgctttgaaaac

SEQ ID NO: 980456 - DNA, 22 bp, Artificial Sequence
  chemically synthesized
ctggccttgatcgtgctttgaa

SEQ ID NO: 980457 - DNA, 22 bp, Artificial Sequence
  chemically synthesized
aagcagtggttttcaaagcacg

SEQ ID NO: 980458 - DNA, 22 bp, Artificial Sequence
  chemically synthesized
atgctgctggccttgatcgtgc

SEQ ID NO: 980459 - DNA, 22 bp, Artificial Sequence
  chemically synthesized
tcaaagcacgatcaaggccagc

SEQ ID NO: 980460 - DNA, 22 bp, Artificial Sequence
  chemically synthesized
caaagcacgatcaaggccagca

SEQ ID NO: 980461 - DNA, 22 bp, Artificial Sequence
  chemically synthesized
aaagcacgatcaaggccagcag

SEQ ID NO: 980462 - DNA, 22 bp, Artificial Sequence
  chemically synthesized
ccaggtgatactgatgctgctg

SEQ ID NO: 980463 - DNA, 22 bp, Artificial Sequence
  chemically synthesized
cagcaagttaccaggtgatact

SEQ ID NO: 980464 - DNA, 22 bp, Artificial Sequence
  chemically synthesized
ccagcaagttaccaggtgatac

SEQ ID NO: 980465 - DNA, 22 bp, Artificial Sequence
  chemically synthesized
catttccagcaagttaccaggt

SEQ ID NO: 980466 - DNA, 22 bp, Artificial Sequence
  chemically synthesized
gcatttccagcaagttaccagg

SEQ ID NO: 980467 - DNA, 22 bp, Artificial Sequence
  chemically synthesized
tgcatttccagcaagttaccag

SEQ ID NO: 980468 - DNA, 22 bp, Artificial Sequence
  chemically synthesized
gtaacttgctggaaatgcaaaa

SEQ ID NO: 980469 - DNA, 22 bp, Artificial Sequence
  chemically synthesized
gtgcaggtccagattttgcatt

SEQ ID NO: 980470 - DNA, 22 bp, Artificial Sequence
  chemically synthesized
ggtgcaggtccagattttgcat

SEQ ID NO: 980471 - DNA, 22 bp, Artificial Sequence
  chemically synthesized
tggtgcaggtccagattttgca

SEQ ID NO: 980472 - DNA, 22 bp, Artificial Sequence
  chemically synthesized
gctggaaatgcaaaatctggac

SEQ ID NO: 980473 - DNA, 22 bp, Artificial Sequence
  chemically synthesized
ctggaaatgcaaaatctggacc

SEQ ID NO: 980474 - DNA, 22 bp, Artificial Sequence
  chemically synthesized
gaaatgcaaaatctggacctgc

SEQ ID NO: 980475 - DNA, 22 bp, Artificial Sequence
  chemically synthesized
gtccagtaactttggtgcaggt

SEQ ID NO: 980476 - DNA, 22 bp, Artificial Sequence
  chemically synthesized
ctggtccagtaactttggtgca

SEQ ID NO: 980477 - DNA, 22 bp, Artificial Sequence
  chemically synthesized
agagttgctggtccagtaactt

SEQ ID NO: 980478 - DNA, 22 bp, Artificial Sequence
  chemically synthesized
gacctgcaccaaagttactgga

SEQ ID NO: 980479 - DNA, 22 bp, Artificial Sequence
  chemically synthesized
cagagttgctggtccagtaact

SEQ ID NO: 980480 - DNA, 22 bp, Artificial Sequence
  chemically synthesized
gccttcagagttgctggtccag

SEQ ID NO: 980481 - DNA, 22 bp, Artificial Sequence
  chemically synthesized
caccaaagttactggaccagca

SEQ ID NO: 980482 - DNA, 22 bp, Artificial Sequence
  chemically synthesized
ggttagccttcagagttgctgg

SEQ ID NO: 980483 - DNA, 22 bp, Artificial Sequence
  chemically synthesized
ctaggttagccttcagagttgc

SEQ ID NO: 980484 - DNA, 22 bp, Artificial Sequence
  chemically synthesized
ctggaccagcaactctgaaggc

SEQ ID NO: 980485 - DNA, 22 bp, Artificial Sequence
  chemically synthesized
gaccagcaactctgaaggctaa

SEQ ID NO: 980486 - DNA, 22 bp, Artificial Sequence
  chemically synthesized
taccacagattgctaggttagc

SEQ ID NO: 980487 - DNA, 22 bp, Artificial Sequence
  chemically synthesized
ctataccacagattgctaggtt

SEQ ID NO: 980488 - DNA, 22 bp, Artificial Sequence
  chemically synthesized
gctataccacagattgctaggt

SEQ ID NO: 980489 - DNA, 22 bp, Artificial Sequence
  chemically synthesized
tgaaggctaacctagcaatctg

SEQ ID NO: 980490 - DNA, 22 bp, Artificial Sequence
  chemically synthesized
aaggctaacctagcaatctgtg

SEQ ID NO: 980491 - DNA, 22 bp, Artificial Sequence
  chemically synthesized
gagggtttgctataccacagat

SEQ ID NO: 980492 - DNA, 22 bp, Artificial Sequence
  chemically synthesized
acctagcaatctgtggtatagc

SEQ ID NO: 980493 - DNA, 22 bp, Artificial Sequence
  chemically synthesized
gcaatctgtggtatagcaaacc

SEQ ID NO: 980494 - DNA, 22 bp, Artificial Sequence
  chemically synthesized
acatcagaatcagctggagggt

SEQ ID NO: 980495 - DNA, 22 bp, Artificial Sequence
  chemically synthesized
tggtatagcaaaccctccagct

SEQ ID NO: 980496 - DNA, 22 bp, Artificial Sequence
  chemically synthesized
ggccagtaatactcacatcaga

SEQ ID NO: 980497 - DNA, 22 bp, Artificial Sequence
  chemically synthesized
taggccagtaatactcacatca

SEQ ID NO: 980498 - DNA, 22 bp, Artificial Sequence
  chemically synthesized
cagctgattctgatgtgagtat

SEQ ID NO: 980499 - DNA, 22 bp, Artificial Sequence
  chemically synthesized
attctgatgtgagtattactgg

SEQ ID NO: 980500 - DNA, 22 bp, Artificial Sequence
  chemically synthesized
gaagcaactctaggccagtaat

SEQ ID NO: 980501 - DNA, 22 bp, Artificial Sequence
  chemically synthesized
agaagcaactctaggccagtaa

SEQ ID NO: 980502 - DNA, 22 bp, Artificial Sequence
  chemically synthesized
tgatgtgagtattactggccta

SEQ ID NO: 980503 - DNA, 22 bp, Artificial Sequence
  chemically synthesized
atgtgagtattactggcctaga

SEQ ID NO: 980504 - DNA, 22 bp, Artificial Sequence
  chemically synthesized
taccaaagtcttagaagcaact

SEQ ID NO: 980505 - DNA, 22 bp, Artificial Sequence
  chemically synthesized
ctggcctagagttgcttctaag

SEQ ID NO: 980506 - DNA, 22 bp, Artificial Sequence
  chemically synthesized
gcctagagttgcttctaagact

SEQ ID NO: 980507 - DNA, 22 bp, Artificial Sequence
  chemically synthesized
gtaattataccaaagtcttaga

SEQ ID NO: 980508 - DNA, 22 bp, Artificial Sequence
  chemically synthesized
gagttgcttctaagactttggt

SEQ ID NO: 980509 - DNA, 22 bp, Artificial Sequence
  chemically synthesized
tgactggtaattataccaaagt

SEQ ID NO: 980510 - DNA, 22 bp, Artificial Sequence
  chemically synthesized
cttctaagactttggtataatt

SEQ ID NO: 980511 - DNA, 22 bp, Artificial Sequence
  chemically synthesized
gattgtgactggtaattatacc

SEQ ID NO: 980512 - DNA, 22 bp, Artificial Sequence
  chemically synthesized
ctaagactttggtataattacc

SEQ ID NO: 980513 - DNA, 22 bp, Artificial Sequence
  chemically synthesized
taagactttggtataattacca

SEQ ID NO: 980514 - DNA, 22 bp, Artificial Sequence
  chemically synthesized
agactttggtataattaccagt

SEQ ID NO: 980515 - DNA, 22 bp, Artificial Sequence
  chemically synthesized
tggtataattaccagtcacaat

SEQ ID NO: 980516 - DNA, 22 bp, Artificial Sequence
  chemically synthesized
ggtataattaccagtcacaatc

SEQ ID NO: 980517 - DNA, 22 bp, Artificial Sequence
  chemically synthesized
gtataattaccagtcacaatct

SEQ ID NO: 980518 - DNA, 22 bp, Artificial Sequence
  chemically synthesized
tgtgtgaagacctagattgtga

SEQ ID NO: 980519 - DNA, 22 bp, Artificial Sequence
  chemically synthesized
ccagtcacaatctaggtcttca

SEQ ID NO: 980520 - DNA, 22 bp, Artificial Sequence
  chemically synthesized
aatcagtgtctgtgtgtgaaga

SEQ ID NO: 980521 - DNA, 22 bp, Artificial Sequence
  chemically synthesized
ttgaatcagtgtctgtgtgtga

SEQ ID NO: 980522 - DNA, 22 bp, Artificial Sequence
  chemically synthesized
ggtcttcacacacagacactga

SEQ ID NO: 980523 - DNA, 22 bp, Artificial Sequence
  chemically synthesized
atcccaaacctattgaatcagt

SEQ ID NO: 980524 - DNA, 22 bp, Artificial Sequence
  chemically synthesized
cacacacagacactgattcaat

SEQ ID NO: 980525 - DNA, 22 bp, Artificial Sequence
  chemically synthesized
catcccaaacctattgaatcag

SEQ ID NO: 980526 - DNA, 22 bp, Artificial Sequence
  chemically synthesized
acacacagacactgattcaata

SEQ ID NO: 980527 - DNA, 22 bp, Artificial Sequence
  chemically synthesized
cccttcatcccaaacctattga

SEQ ID NO: 980528 - DNA, 22 bp, Artificial Sequence
  chemically synthesized
ctacccttcatcccaaacctat

SEQ ID NO: 980529 - DNA, 22 bp, Artificial Sequence
  chemically synthesized
attcaataggtttgggatgaag

SEQ ID NO: 980530 - DNA, 22 bp, Artificial Sequence
  chemically synthesized
tagactcctacccttcatccca

SEQ ID NO: 980531 - DNA, 22 bp, Artificial Sequence
  chemically synthesized
aataggtttgggatgaagggta

SEQ ID NO: 980532 - DNA, 22 bp, Artificial Sequence
  chemically synthesized
ataaaagctgtagactcctacc

SEQ ID NO: 980533 - DNA, 22 bp, Artificial Sequence
  chemically synthesized
gataaaagctgtagactcctac

SEQ ID NO: 980534 - DNA, 22 bp, Artificial Sequence
  chemically synthesized
gggatgaagggtaggagtctac

SEQ ID NO: 980535 - DNA, 22 bp, Artificial Sequence
  chemically synthesized
ggatgaagggtaggagtctaca

SEQ ID NO: 980536 - DNA, 22 bp, Artificial Sequence
  chemically synthesized
ggcagcttgataaaagctgtag

SEQ ID NO: 980537 - DNA, 22 bp, Artificial Sequence
  chemically synthesized
cagaatcatctgggcagcttga

SEQ ID NO: 980538 - DNA, 22 bp, Artificial Sequence
  chemically synthesized
acagaatcatctgggcagcttg

SEQ ID NO: 980539 - DNA, 22 bp, Artificial Sequence
  chemically synthesized
cagcttttatcaagctgcccag

SEQ ID NO: 980540 - DNA, 22 bp, Artificial Sequence
  chemically synthesized
ttatcaagctgcccagatgatt

SEQ ID NO: 980541 - DNA, 22 bp, Artificial Sequence
  chemically synthesized
tatcaagctgcccagatgattc

SEQ ID NO: 980542 - DNA, 22 bp, Artificial Sequence
  chemically synthesized
atcaagctgcccagatgattct

SEQ ID NO: 980543 - DNA, 22 bp, Artificial Sequence
  chemically synthesized
tcaagctgcccagatgattctg

SEQ ID NO: 980544 - DNA, 22 bp, Artificial Sequence
  chemically synthesized
cccagatgattctgtaaggtgt

SEQ ID NO: 980545 - DNA, 22 bp, Artificial Sequence
  chemically synthesized
aatgcaatccagataacacctt

SEQ ID NO: 980546 - DNA, 22 bp, Artificial Sequence
  chemically synthesized
taaatgcaatccagataacacc

SEQ ID NO: 980547 - DNA, 22 bp, Artificial Sequence
  chemically synthesized
tctaaatgcaatccagataaca

SEQ ID NO: 980548 - DNA, 22 bp, Artificial Sequence
  chemically synthesized
ctctaaatgcaatccagataac

SEQ ID NO: 980549 - DNA, 22 bp, Artificial Sequence
  chemically synthesized
tgtaaggtgttatctggattgc

SEQ ID NO: 980550 - DNA, 22 bp, Artificial Sequence
  chemically synthesized
taaggtgttatctggattgcat

SEQ ID NO: 980551 - DNA, 22 bp, Artificial Sequence
  chemically synthesized
tggccagcatttctctaaatgc

SEQ ID NO: 980552 - DNA, 22 bp, Artificial Sequence
  chemically synthesized
tctggattgcatttagagaaat

SEQ ID NO: 980553 - DNA, 22 bp, Artificial Sequence
  chemically synthesized
gactgtggccagcatttctcta

SEQ ID NO: 980554 - DNA, 22 bp, Artificial Sequence
  chemically synthesized
agactgtggccagcatttctct

SEQ ID NO: 980555 - DNA, 22 bp, Artificial Sequence
  chemically synthesized
gattgcatttagagaaatgctg

SEQ ID NO: 980556 - DNA, 22 bp, Artificial Sequence
  chemically synthesized
tttagactgtggccagcatttc

SEQ ID NO: 980557 - DNA, 22 bp, Artificial Sequence
  chemically synthesized
catttagagaaatgctggccac

SEQ ID NO: 980558 - DNA, 22 bp, Artificial Sequence
  chemically synthesized
agatactatttagactgtggcc

SEQ ID NO: 980559 - DNA, 22 bp, Artificial Sequence
  chemically synthesized
agagaaatgctggccacagtct

SEQ ID NO: 980560 - DNA, 22 bp, Artificial Sequence
  chemically synthesized
gagaaatgctggccacagtcta

SEQ ID NO: 980561 - DNA, 22 bp, Artificial Sequence
  chemically synthesized
gtggttcagatactatttagac

SEQ ID NO: 980562 - DNA, 22 bp, Artificial Sequence
  chemically synthesized
agtggttcagatactatttaga

SEQ ID NO: 980563 - DNA, 22 bp, Artificial Sequence
  chemically synthesized
gccacagtctaaatagtatctg

SEQ ID NO: 980564 - DNA, 22 bp, Artificial Sequence
  chemically synthesized
aatagtatctgaaccactaaat

SEQ ID NO: 980565 - DNA, 22 bp, Artificial Sequence
  chemically synthesized
aaccactaaatacatctctctg

SEQ ID NO: 980566 - DNA, 22 bp, Artificial Sequence
  chemically synthesized
aatacatctctctgtgccccct

SEQ ID NO: 980567 - DNA, 22 bp, Artificial Sequence
  chemically synthesized
acagatggggtgggcagggggc

SEQ ID NO: 980568 - DNA, 22 bp, Artificial Sequence
  chemically synthesized
cacagatggggtgggcaggggg

SEQ ID NO: 980569 - DNA, 22 bp, Artificial Sequence
  chemically synthesized
tctgtgccccctgcccacccca

SEQ ID NO: 980570 - DNA, 22 bp, Artificial Sequence
  chemically synthesized
tgtgccccctgcccaccccatc

SEQ ID NO: 980571 - DNA, 22 bp, Artificial Sequence
  chemically synthesized
aaaaaatttcacagatggggtg

SEQ ID NO: 980572 - DNA, 22 bp, Artificial Sequence
  chemically synthesized
tgccccctgcccaccccatctg

SEQ ID NO: 980573 - DNA, 22 bp, Artificial Sequence
  chemically synthesized
cccaccccatctgtgaaatttt

SEQ ID NO: 980574 - DNA, 22 bp, Artificial Sequence
  chemically synthesized
aagatgatctcaaaaaatttca

SEQ ID NO: 980575 - DNA, 22 bp, Artificial Sequence
  chemically synthesized
tgaaattttttgagatcatctt

SEQ ID NO: 980576 - DNA, 22 bp, Artificial Sequence
  chemically synthesized
tgacggggagctcaagatgatc

SEQ ID NO: 980577 - DNA, 22 bp, Artificial Sequence
  chemically synthesized
tgctgtgacggggagctcaaga

SEQ ID NO: 980578 - DNA, 22 bp, Artificial Sequence
  chemically synthesized
tttgagatcatcttgagctccc

SEQ ID NO: 980579 - DNA, 22 bp, Artificial Sequence
  chemically synthesized
ttgagatcatcttgagctcccc

SEQ ID NO: 980580 - DNA, 22 bp, Artificial Sequence
  chemically synthesized
tgagatcatcttgagctccccg

SEQ ID NO: 980581 - DNA, 22 bp, Artificial Sequence
  chemically synthesized
gagatcatcttgagctccccgt

SEQ ID NO: 980582 - DNA, 22 bp, Artificial Sequence
  chemically synthesized
agatcatcttgagctccccgtc

SEQ ID NO: 980583 - DNA, 22 bp, Artificial Sequence
  chemically synthesized
caggcactgtgctgtgacgggg

SEQ ID NO: 980584 - DNA, 22 bp, Artificial Sequence
  chemically synthesized
ttgcaggcactgtgctgtgacg

SEQ ID NO: 980585 - DNA, 22 bp, Artificial Sequence
  chemically synthesized
tgttgcaggcactgtgctgtga

SEQ ID NO: 980586 - DNA, 22 bp, Artificial Sequence
  chemically synthesized
gagctccccgtcacagcacagt

SEQ ID NO: 980587 - DNA, 22 bp, Artificial Sequence
  chemically synthesized
agctccccgtcacagcacagtg

SEQ ID NO: 980588 - DNA, 22 bp, Artificial Sequence
  chemically synthesized
cccgtcacagcacagtgcctgc

SEQ ID NO: 980589 - DNA, 22 bp, Artificial Sequence
  chemically synthesized
gagaggaatgtgtcagttctgt

SEQ ID NO: 980590 - DNA, 22 bp, Artificial Sequence
  chemically synthesized
agagaggaatgtgtcagttctg

SEQ ID NO: 980591 - DNA, 22 bp, Artificial Sequence
  chemically synthesized
caacagaactgacacattcctc

SEQ ID NO: 980592 - DNA, 22 bp, Artificial Sequence
  chemically synthesized
agaaacatttagagaggaatgt

SEQ ID NO: 980593 - DNA, 22 bp, Artificial Sequence
  chemically synthesized
ttcagaaacatttagagaggaa

SEQ ID NO: 980594 - DNA, 22 bp, Artificial Sequence
  chemically synthesized
attcagaaacatttagagagga

SEQ ID NO: 980595 - DNA, 22 bp, Artificial Sequence
  chemically synthesized
tttattcagaaacatttagaga

SEQ ID NO: 980596 - DNA, 22 bp, Artificial Sequence
  chemically synthesized
atttattcagaaacatttagag

SEQ ID NO: 980597 - DNA, 22 bp, Artificial Sequence
  chemically synthesized
acacattcctctctaaatgttt

SEQ ID NO: 980598 - DNA, 22 bp, Artificial Sequence
  chemically synthesized
ctctctaaatgtttctgaataa

SEQ ID NO: 980599 - DNA, 22 bp, Artificial Sequence
  chemically synthesized
tctaaatgtttctgaataaata

SEQ ID NO: 980600 - DNA, 22 bp, Artificial Sequence
  chemically synthesized
ccaaagtgcagtttatttattc

SEQ ID NO: 980601 - DNA, 22 bp, Artificial Sequence
  chemically synthesized
taaatgtttctgaataaataaa

SEQ ID NO: 980602 - DNA, 22 bp, Artificial Sequence
  chemically synthesized
aatgtttctgaataaataaact

SEQ ID NO: 980603 - DNA, 22 bp, Artificial Sequence
  chemically synthesized
tctgccaaagtgcagtttattt

SEQ ID NO: 980604 - DNA, 22 bp, Artificial Sequence
  chemically synthesized
gtctgccaaagtgcagtttatt

SEQ ID NO: 980605 - DNA, 22 bp, Artificial Sequence
  chemically synthesized
ctgaataaataaactgcacttt

SEQ ID NO: 980606 - DNA, 22 bp, Artificial Sequence
  chemically synthesized
tgaataaataaactgcactttg

SEQ ID NO: 980607 - DNA, 22 bp, Artificial Sequence
  chemically synthesized
caatttgtctgccaaagtgcag

SEQ ID NO: 980608 - DNA, 22 bp, Artificial Sequence
  chemically synthesized
aataaataaactgcactttggc

SEQ ID NO: 980609 - DNA, 22 bp, Artificial Sequence
  chemically synthesized
gggattgcaatttgtctgccaa

SEQ ID NO: 980610 - DNA, 22 bp, Artificial Sequence
  chemically synthesized
acattagggattgcaatttgtc

SEQ ID NO: 980611 - DNA, 22 bp, Artificial Sequence
  chemically synthesized
cactttggcagacaaattgcaa

SEQ ID NO: 980612 - DNA, 22 bp, Artificial Sequence
  chemically synthesized
tggcagacaaattgcaatccct

SEQ ID NO: 980613 - DNA, 22 bp, Artificial Sequence
  chemically synthesized
ggcagacaaattgcaatcccta

SEQ ID NO: 980614 - DNA, 22 bp, Artificial Sequence
  chemically synthesized
gcagacaaattgcaatccctaa

SEQ ID NO: 980615 - DNA, 22 bp, Artificial Sequence
  chemically synthesized
gataagagaaaaaaggttcaca

SEQ ID NO: 980616 - DNA, 22 bp, Artificial Sequence
  chemically synthesized
caatccctaatgtgaacctttt

SEQ ID NO: 980617 - DNA, 22 bp, Artificial Sequence
  chemically synthesized
tctagataagagaaaaaaggtt

SEQ ID NO: 980618 - DNA, 22 bp, Artificial Sequence
  chemically synthesized
gtctagataagagaaaaaaggt

SEQ ID NO: 980619 - DNA, 22 bp, Artificial Sequence
  chemically synthesized
atttgtctagataagagaaaaa

SEQ ID NO: 980620 - DNA, 22 bp, Artificial Sequence
  chemically synthesized
atgtgaaccttttttctcttat

SEQ ID NO: 980621 - DNA, 22 bp, Artificial Sequence
  chemically synthesized
cctcatttgtctagataagaga

SEQ ID NO: 980622 - DNA, 22 bp, Artificial Sequence
  chemically synthesized
gcctcatttgtctagataagag

SEQ ID NO: 980623 - DNA, 22 bp, Artificial Sequence
  chemically synthesized
tgcctcatttgtctagataaga

SEQ ID NO: 980624 - DNA, 22 bp, Artificial Sequence
  chemically synthesized
ttttctcttatctagacaaatg

SEQ ID NO: 980625 - DNA, 22 bp, Artificial Sequence
  chemically synthesized
tttctcttatctagacaaatga

SEQ ID NO: 980626 - DNA, 22 bp, Artificial Sequence
  chemically synthesized
ttctcttatctagacaaatgag

SEQ ID NO: 980627 - DNA, 22 bp, Artificial Sequence
  chemically synthesized
tctcttatctagacaaatgagg

SEQ ID NO: 980628 - DNA, 22 bp, Artificial Sequence
  chemically synthesized
ctcttatctagacaaatgaggc

SEQ ID NO: 980629 - DNA, 22 bp, Artificial Sequence
  chemically synthesized
tcttatctagacaaatgaggca

SEQ ID NO: 980630 - DNA, 22 bp, Artificial Sequence
  chemically synthesized
tcagagtagttttgcctcattt

SEQ ID NO: 980631 - DNA, 22 bp, Artificial Sequence
  chemically synthesized
ttatctagacaaatgaggcaaa

SEQ ID NO: 980632 - DNA, 22 bp, Artificial Sequence
  chemically synthesized
atctagacaaatgaggcaaaac

SEQ ID NO: 980633 - DNA, 22 bp, Artificial Sequence
  chemically synthesized
tctagacaaatgaggcaaaact

SEQ ID NO: 980634 - DNA, 22 bp, Artificial Sequence
  chemically synthesized
aagtctgtcagagtagttttgc

SEQ ID NO: 980635 - DNA, 22 bp, Artificial Sequence
  chemically synthesized
gacaaatgaggcaaaactactc

SEQ ID NO: 980636 - DNA, 22 bp, Artificial Sequence
  chemically synthesized
ccactgaagtctgtcagagtag

SEQ ID NO: 980637 - DNA, 22 bp, Artificial Sequence
  chemically synthesized
aaaactaccactgaagtctgtc

SEQ ID NO: 980638 - DNA, 22 bp, Artificial Sequence
  chemically synthesized
aaaaactaccactgaagtctgt

SEQ ID NO: 980639 - DNA, 22 bp, Artificial Sequence
  chemically synthesized
ctctgacagacttcagtggtag

SEQ ID NO: 980640 - DNA, 22 bp, Artificial Sequence
  chemically synthesized
tgacagacttcagtggtagttt

SEQ ID NO: 980641 - DNA, 22 bp, Artificial Sequence
  chemically synthesized
acagacttcagtggtagttttt

SEQ ID NO: 980642 - DNA, 22 bp, Artificial Sequence
  chemically synthesized
aataacaacaatttaaaaacta

SEQ ID NO: 980643 - DNA, 22 bp, Artificial Sequence
  chemically synthesized
aaataacaacaatttaaaaact

SEQ ID NO: 980644 - DNA, 22 bp, Artificial Sequence
  chemically synthesized
cttaaataacaacaatttaaaa

SEQ ID NO: 980645 - DNA, 22 bp, Artificial Sequence
  chemically synthesized
cagtggtagtttttaaattgtt

SEQ ID NO: 980646 - DNA, 22 bp, Artificial Sequence
  chemically synthesized
agtggtagtttttaaattgttg

SEQ ID NO: 980647 - DNA, 22 bp, Artificial Sequence
  chemically synthesized
ttaaattgttgttatttaagga

SEQ ID NO: 980648 - DNA, 22 bp, Artificial Sequence
  chemically synthesized
tgagtagtgtattccttaaata

SEQ ID NO: 980649 - DNA, 22 bp, Artificial Sequence
  chemically synthesized
taaattgttgttatttaaggaa

SEQ ID NO: 980650 - DNA, 22 bp, Artificial Sequence
  chemically synthesized
atgagtagtgtattccttaaat

SEQ ID NO: 980651 - DNA, 22 bp, Artificial Sequence
  chemically synthesized
aaattgttgttatttaaggaat

SEQ ID NO: 980652 - DNA, 22 bp, Artificial Sequence
  chemically synthesized
aattgttgttatttaaggaata

SEQ ID NO: 980653 - DNA, 22 bp, Artificial Sequence
  chemically synthesized
ttgttatttaaggaatacacta

SEQ ID NO: 980654 - DNA, 22 bp, Artificial Sequence
  chemically synthesized
ttatttaaggaatacactactc

SEQ ID NO: 980655 - DNA, 22 bp, Artificial Sequence
  chemically synthesized
tttaaggaatacactactcata

SEQ ID NO: 980656 - DNA, 22 bp, Artificial Sequence
  chemically synthesized
aaggaatacactactcataagg

SEQ ID NO: 980657 - DNA, 22 bp, Artificial Sequence
  chemically synthesized
aggaatacactactcataagga

SEQ ID NO: 980658 - DNA, 22 bp, Artificial Sequence
  chemically synthesized
aatgtgagaagaaaagtcctta

SEQ ID NO: 980659 - DNA, 22 bp, Artificial Sequence
  chemically synthesized
ctcataaggacttttcttctca

SEQ ID NO: 980660 - DNA, 22 bp, Artificial Sequence
  chemically synthesized
taatgttcaatgtgagaagaaa

SEQ ID NO: 980661 - DNA, 22 bp, Artificial Sequence
  chemically synthesized
gtaatgttcaatgtgagaagaa

SEQ ID NO: 980662 - DNA, 22 bp, Artificial Sequence
  chemically synthesized
ataaggacttttcttctcacat

SEQ ID NO: 980663 - DNA, 22 bp, Artificial Sequence
  chemically synthesized
tcttgtaatgttcaatgtgaga

SEQ ID NO: 980664 - DNA, 22 bp, Artificial Sequence
  chemically synthesized
atcttgtaatgttcaatgtgag

SEQ ID NO: 980665 - DNA, 22 bp, Artificial Sequence
  chemically synthesized
atttatcttgtaatgttcaatg

SEQ ID NO: 980666 - DNA, 22 bp, Artificial Sequence
  chemically synthesized
aatttatcttgtaatgttcaat

SEQ ID NO: 980667 - DNA, 22 bp, Artificial Sequence
  chemically synthesized
taatttatcttgtaatgttcaa

SEQ ID NO: 980668 - DNA, 22 bp, Artificial Sequence
  chemically synthesized
ttcttctcacattgaacattac

SEQ ID NO: 980669 - DNA, 22 bp, Artificial Sequence
  chemically synthesized
tcttctcacattgaacattaca

SEQ ID NO: 980670 - DNA, 22 bp, Artificial Sequence
  chemically synthesized
cttctcacattgaacattacaa

SEQ ID NO: 980671 - DNA, 22 bp, Artificial Sequence
  chemically synthesized
ttttaatttatcttgtaatgtt

SEQ ID NO: 980672 - DNA, 22 bp, Artificial Sequence
  chemically synthesized
ttctcacattgaacattacaag

SEQ ID NO: 980673 - DNA, 22 bp, Artificial Sequence
  chemically synthesized
ctcacattgaacattacaagat

SEQ ID NO: 980674 - DNA, 22 bp, Artificial Sequence
  chemically synthesized
tcacattgaacattacaagata

SEQ ID NO: 980675 - DNA, 22 bp, Artificial Sequence
  chemically synthesized
acattgaacattacaagataaa

SEQ ID NO: 980676 - DNA, 22 bp, Artificial Sequence
  chemically synthesized
gataaaattattttaatttatc

SEQ ID NO: 980677 - DNA, 22 bp, Artificial Sequence
  chemically synthesized
agataaaattattttaatttat

SEQ ID NO: 980678 - DNA, 22 bp, Artificial Sequence
  chemically synthesized
aacattacaagataaattaaaa

SEQ ID NO: 980679 - DNA, 22 bp, Artificial Sequence
  chemically synthesized
cttagataaaattattttaatt

SEQ ID NO: 980680 - DNA, 22 bp, Artificial Sequence
  chemically synthesized
acttagataaaattattttaat

SEQ ID NO: 980681 - DNA, 22 bp, Artificial Sequence
  chemically synthesized
caagataaattaaaataatttt

SEQ ID NO: 980682 - DNA, 22 bp, Artificial Sequence
  chemically synthesized
gtgtcaggacatttacttagat

SEQ ID NO: 980683 - DNA, 22 bp, Artificial Sequence
  chemically synthesized
agtgtcaggacatttacttaga

SEQ ID NO: 980684 - DNA, 22 bp, Artificial Sequence
  chemically synthesized
aaataattttatctaagtaaat

SEQ ID NO: 980685 - DNA, 22 bp, Artificial Sequence
  chemically synthesized
aacttagtgtcaggacatttac

SEQ ID NO: 980686 - DNA, 22 bp, Artificial Sequence
  chemically synthesized
gctaaacttagtgtcaggacat

SEQ ID NO: 980687 - DNA, 22 bp, Artificial Sequence
  chemically synthesized
tatctaagtaaatgtcctgaca

SEQ ID NO: 980688 - DNA, 22 bp, Artificial Sequence
  chemically synthesized
atctaagtaaatgtcctgacac

SEQ ID NO: 980689 - DNA, 22 bp, Artificial Sequence
  chemically synthesized
tctaagtaaatgtcctgacact

SEQ ID NO: 980690 - DNA, 22 bp, Artificial Sequence
  chemically synthesized
agtaaatgtcctgacactaagt

SEQ ID NO: 980691 - DNA, 22 bp, Artificial Sequence
  chemically synthesized
aggggtgaagtctggctaaact

SEQ ID NO: 980692 - DNA, 22 bp, Artificial Sequence
  chemically synthesized
acactaagtttagccagacttc

SEQ ID NO: 980693 - DNA, 22 bp, Artificial Sequence
  chemically synthesized
agtttagccagacttcacccct

SEQ ID NO: 980694 - DNA, 22 bp, Artificial Sequence
  chemically synthesized
gaaaaccgattaaggggtgaag

SEQ ID NO: 980695 - DNA, 22 bp, Artificial Sequence
  chemically synthesized
agaaaaccgattaaggggtgaa

SEQ ID NO: 980696 - DNA, 22 bp, Artificial Sequence
  chemically synthesized
tagaaaaccgattaaggggtga

SEQ ID NO: 980697 - DNA, 22 bp, Artificial Sequence
  chemically synthesized
agccagacttcaccccttaatc

SEQ ID NO: 980698 - DNA, 22 bp, Artificial Sequence
  chemically synthesized
gccagacttcaccccttaatcg

SEQ ID NO: 980699 - DNA, 22 bp, Artificial Sequence
  chemically synthesized
tgttttagaaaaccgattaagg

SEQ ID NO: 980700 - DNA, 22 bp, Artificial Sequence
  chemically synthesized
gtgttttagaaaaccgattaag

SEQ ID NO: 980701 - DNA, 22 bp, Artificial Sequence
  chemically synthesized
tgtgttttagaaaaccgattaa

SEQ ID NO: 980702 - DNA, 22 bp, Artificial Sequence
  chemically synthesized
ttgtgttttagaaaaccgatta

SEQ ID NO: 980703 - DNA, 22 bp, Artificial Sequence
  chemically synthesized
tttgtgttttagaaaaccgatt

SEQ ID NO: 980704 - DNA, 22 bp, Artificial Sequence
  chemically synthesized
tttttgtgttttagaaaaccga

SEQ ID NO: 980705 - DNA, 22 bp, Artificial Sequence
  chemically synthesized
ctttttgtgttttagaaaaccg

SEQ ID NO: 980706 - DNA, 22 bp, Artificial Sequence
  chemically synthesized
caccccttaatcggttttctaa

SEQ ID NO: 980707 - DNA, 22 bp, Artificial Sequence
  chemically synthesized
tctttttgtgttttagaaaacc

SEQ ID NO: 980708 - DNA, 22 bp, Artificial Sequence
  chemically synthesized
accccttaatcggttttctaaa

SEQ ID NO: 980709 - DNA, 22 bp, Artificial Sequence
  chemically synthesized
ttttctttttgtgttttagaaa

SEQ ID NO: 980710 - DNA, 22 bp, Artificial Sequence
  chemically synthesized
gttttctttttgtgttttagaa

SEQ ID NO: 980711 - DNA, 22 bp, Artificial Sequence
  chemically synthesized
aatcggttttctaaaacacaaa

SEQ ID NO: 980712 - DNA, 22 bp, Artificial Sequence
  chemically synthesized
atcggttttctaaaacacaaaa

SEQ ID NO: 980713 - DNA, 22 bp, Artificial Sequence
  chemically synthesized
tctaaaacacaaaaagaaaaca

SEQ ID NO: 980714 - DNA, 22 bp, Artificial Sequence
  chemically synthesized
ctaaaacacaaaaagaaaacaa

SEQ ID NO: 980715 - DNA, 22 bp, Artificial Sequence
  chemically synthesized
taaaacacaaaaagaaaacaaa

SEQ ID NO: 980716 - DNA, 22 bp, Artificial Sequence
  chemically synthesized
catgtaggtgtcatttgttttc

SEQ ID NO: 980717 - DNA, 22 bp, Artificial Sequence
  chemically synthesized
aaacacaaaaagaaaacaaatg

SEQ ID NO: 980718 - DNA, 22 bp, Artificial Sequence
  chemically synthesized
ccatgtaggtgtcatttgtttt

SEQ ID NO: 980719 - DNA, 22 bp, Artificial Sequence
  chemically synthesized
aaaagtaaaatttccatgtagg

SEQ ID NO: 980720 - DNA, 22 bp, Artificial Sequence
  chemically synthesized
caaaagtaaaatttccatgtag

SEQ ID NO: 980721 - DNA, 22 bp, Artificial Sequence
  chemically synthesized
tcaaaagtaaaatttccatgta

SEQ ID NO: 980722 - DNA, 22 bp, Artificial Sequence
  chemically synthesized
ttcaaaagtaaaatttccatgt

SEQ ID NO: 980723 - DNA, 22 bp, Artificial Sequence
  chemically synthesized
cttttcaaaagtaaaatttcca

SEQ ID NO: 980724 - DNA, 22 bp, Artificial Sequence
  chemically synthesized
actgcttttcaaaagtaaaatt

SEQ ID NO: 980725 - DNA, 22 bp, Artificial Sequence
  chemically synthesized
cactgcttttcaaaagtaaaat

SEQ ID NO: 980726 - DNA, 22 bp, Artificial Sequence
  chemically synthesized
tcactgcttttcaaaagtaaaa

SEQ ID NO: 980727 - DNA, 22 bp, Artificial Sequence
  chemically synthesized
tttcactgcttttcaaaagtaa

SEQ ID NO: 980728 - DNA, 22 bp, Artificial Sequence
  chemically synthesized
ctttcactgcttttcaaaagta

SEQ ID NO: 980729 - DNA, 22 bp, Artificial Sequence
  chemically synthesized
catggaaattttacttttgaaa

SEQ ID NO: 980730 - DNA, 22 bp, Artificial Sequence
  chemically synthesized
tctttcactgcttttcaaaagt

SEQ ID NO: 980731 - DNA, 22 bp, Artificial Sequence
  chemically synthesized
ctttctttcactgcttttcaaa

SEQ ID NO: 980732 - DNA, 22 bp, Artificial Sequence
  chemically synthesized
actgctttctttcactgctttt

SEQ ID NO: 980733 - DNA, 22 bp, Artificial Sequence
  chemically synthesized
cactgctttctttcactgcttt

SEQ ID NO: 980734 - DNA, 22 bp, Artificial Sequence
  chemically synthesized
tacttttgaaaagcagtgaaag

SEQ ID NO: 980735 - DNA, 22 bp, Artificial Sequence
  chemically synthesized
acttttgaaaagcagtgaaaga

SEQ ID NO: 980736 - DNA, 22 bp, Artificial Sequence
  chemically synthesized
cttttgaaaagcagtgaaagaa

SEQ ID NO: 980737 - DNA, 22 bp, Artificial Sequence
  chemically synthesized
ttgaaaagcagtgaaagaaagc

SEQ ID NO: 980738 - DNA, 22 bp, Artificial Sequence
  chemically synthesized
tgaaaagcagtgaaagaaagca

SEQ ID NO: 980739 - DNA, 22 bp, Artificial Sequence
  chemically synthesized
gaaaagcagtgaaagaaagcag

SEQ ID NO: 980740 - DNA, 22 bp, Artificial Sequence
  chemically synthesized
aaaagcagtgaaagaaagcagt

SEQ ID NO: 980741 - DNA, 22 bp, Artificial Sequence
  chemically synthesized
aaggtcaaagcgtcttcactgc

SEQ ID NO: 980742 - DNA, 22 bp, Artificial Sequence
  chemically synthesized
ctcaaggtcaaagcgtcttcac

SEQ ID NO: 980743 - DNA, 22 bp, Artificial Sequence
  chemically synthesized
actcaaggtcaaagcgtcttca

SEQ ID NO: 980744 - DNA, 22 bp, Artificial Sequence
  chemically synthesized
taatcttactcaaggtcaaagc

SEQ ID NO: 980745 - DNA, 22 bp, Artificial Sequence
  chemically synthesized
gggaccagaggctgtaatctta

SEQ ID NO: 980746 - DNA, 22 bp, Artificial Sequence
  chemically synthesized
ggggaccagaggctgtaatctt

SEQ ID NO: 980747 - DNA, 22 bp, Artificial Sequence
  chemically synthesized
tgaccttgagtaagattacagc

SEQ ID NO: 980748 - DNA, 22 bp, Artificial Sequence
  chemically synthesized
gaccttgagtaagattacagcc

SEQ ID NO: 980749 - DNA, 22 bp, Artificial Sequence
  chemically synthesized
accttgagtaagattacagcct

SEQ ID NO: 980750 - DNA, 22 bp, Artificial Sequence
  chemically synthesized
atttggggaccagaggctgtaa

SEQ ID NO: 980751 - DNA, 22 bp, Artificial Sequence
  chemically synthesized
gagtaagattacagcctctggt

SEQ ID NO: 980752 - DNA, 22 bp, Artificial Sequence
  chemically synthesized
agtaagattacagcctctggtc

SEQ ID NO: 980753 - DNA, 22 bp, Artificial Sequence
  chemically synthesized
cacatgtctcatttggggacca

SEQ ID NO: 980754 - DNA, 22 bp, Artificial Sequence
  chemically synthesized
cagcctctggtccccaaatgag

SEQ ID NO: 980755 - DNA, 22 bp, Artificial Sequence
  chemically synthesized
tggtccccaaatgagacatgtg

SEQ ID NO: 980756 - DNA, 22 bp, Artificial Sequence
  chemically synthesized
gtccccaaatgagacatgtgta

SEQ ID NO: 980757 - DNA, 22 bp, Artificial Sequence
  chemically synthesized
agacaaggtaagactacacatg

SEQ ID NO: 980758 - DNA, 22 bp, Artificial Sequence
  chemically synthesized
cctgagacaaggtaagactaca

SEQ ID NO: 980759 - DNA, 22 bp, Artificial Sequence
  chemically synthesized
acctgagacaaggtaagactac

SEQ ID NO: 980760 - DNA, 22 bp, Artificial Sequence
  chemically synthesized
accttgtctcaggtaaatgtgt

SEQ ID NO: 980761 - DNA, 22 bp, Artificial Sequence
  chemically synthesized
ccttgtctcaggtaaatgtgtg

SEQ ID NO: 980762 - DNA, 22 bp, Artificial Sequence
  chemically synthesized
gtctcaggtaaatgtgtgttca

SEQ ID NO: 980763 - DNA, 22 bp, Artificial Sequence
  chemically synthesized
tctcaggtaaatgtgtgttcat

SEQ ID NO: 980764 - DNA, 22 bp, Artificial Sequence
  chemically synthesized
aggtaaatgtgtgttcatcttg

SEQ ID NO: 980765 - DNA, 22 bp, Artificial Sequence
  chemically synthesized
atgtggtatgtatgtatacaag

SEQ ID NO: 980766 - DNA, 22 bp, Artificial Sequence
  chemically synthesized
tattcatgtggtatgtatgtat

SEQ ID NO: 980767 - DNA, 22 bp, Artificial Sequence
  chemically synthesized
ctgtattcatgtggtatgtatg

SEQ ID NO: 980768 - DNA, 22 bp, Artificial Sequence
  chemically synthesized
cctgtattcatgtggtatgtat

SEQ ID NO: 980769 - DNA, 22 bp, Artificial Sequence
  chemically synthesized
atcttgtatacatacataccac

SEQ ID NO: 980770 - DNA, 22 bp, Artificial Sequence
  chemically synthesized
cccttcctgtattcatgtggta

SEQ ID NO: 980771 - DNA, 22 bp, Artificial Sequence
  chemically synthesized
gtatacatacataccacatgaa

SEQ ID NO: 980772 - DNA, 22 bp, Artificial Sequence
  chemically synthesized
tatacatacataccacatgaat

SEQ ID NO: 980773 - DNA, 22 bp, Artificial Sequence
  chemically synthesized
gtattccccttcctgtattcat

SEQ ID NO: 980774 - DNA, 22 bp, Artificial Sequence
  chemically synthesized
agtattccccttcctgtattca

SEQ ID NO: 980775 - DNA, 22 bp, Artificial Sequence
  chemically synthesized
tagtattccccttcctgtattc

SEQ ID NO: 980776 - DNA, 22 bp, Artificial Sequence
  chemically synthesized
ggttttagtattccccttcctg

SEQ ID NO: 980777 - DNA, 22 bp, Artificial Sequence
  chemically synthesized
ctaggttttagtattccccttc

SEQ ID NO: 980778 - DNA, 22 bp, Artificial Sequence
  chemically synthesized
actaggttttagtattcccctt

SEQ ID NO: 980779 - DNA, 22 bp, Artificial Sequence
  chemically synthesized
accttactaggttttagtattc

SEQ ID NO: 980780 - DNA, 22 bp, Artificial Sequence
  chemically synthesized
acaaaaccattcaccttactag

SEQ ID NO: 980781 - DNA, 22 bp, Artificial Sequence
  chemically synthesized
aaacctagtaaggtgaatggtt

SEQ ID NO: 980782 - DNA, 22 bp, Artificial Sequence
  chemically synthesized
gtaaggtgaatggttttgtgag

SEQ ID NO: 980783 - DNA, 22 bp, Artificial Sequence
  chemically synthesized
tgtgagcatgcatatatatata

SEQ ID NO: 980784 - DNA, 22 bp, Artificial Sequence
  chemically synthesized
gtgagcatgcatatatatatat

SEQ ID NO: 980785 - DNA, 22 bp, Artificial Sequence
  chemically synthesized
tgagcatgcatatatatatata

SEQ ID NO: 980786 - DNA, 22 bp, Artificial Sequence
  chemically synthesized
tatatatatatatatatatata

SEQ ID NO: 980787 - DNA, 22 bp, Artificial Sequence
  chemically synthesized
atatatatatatatatatatat

SEQ ID NO: 980788 - DNA, 22 bp, Artificial Sequence
  chemically synthesized
atcatttatatatatatatata

SEQ ID NO: 980789 - DNA, 22 bp, Artificial Sequence
  chemically synthesized
gatcatttatatatatatatat

SEQ ID NO: 980790 - DNA, 22 bp, Artificial Sequence
  chemically synthesized
tgatcatttatatatatatata

SEQ ID NO: 980791 - DNA, 22 bp, Artificial Sequence
  chemically synthesized
gcatcaattttgatcatttata

SEQ ID NO: 980792 - DNA, 22 bp, Artificial Sequence
  chemically synthesized
attagcatcaattttgatcatt

SEQ ID NO: 980793 - DNA, 22 bp, Artificial Sequence
  chemically synthesized
cattagcatcaattttgatcat

SEQ ID NO: 980794 - DNA, 22 bp, Artificial Sequence
  chemically synthesized
tcattagcatcaattttgatca

SEQ ID NO: 980795 - DNA, 22 bp, Artificial Sequence
  chemically synthesized
ttcattagcatcaattttgatc

SEQ ID NO: 980796 - DNA, 22 bp, Artificial Sequence
  chemically synthesized
tttcattagcatcaattttgat

SEQ ID NO: 980797 - DNA, 22 bp, Artificial Sequence
  chemically synthesized
ttttcattagcatcaattttga

SEQ ID NO: 980798 - DNA, 22 bp, Artificial Sequence
  chemically synthesized
taacaagacagatttttttcat

SEQ ID NO: 980799 - DNA, 22 bp, Artificial Sequence
  chemically synthesized
atgctaatgaaaaaaatctgtc

SEQ ID NO: 980800 - DNA, 22 bp, Artificial Sequence
  chemically synthesized
atgaaaaaaatctgtcttgtta

SEQ ID NO: 980801 - DNA, 22 bp, Artificial Sequence
  chemically synthesized
tcttgttacaggatggaccttt

SEQ ID NO: 980802 - DNA, 22 bp, Artificial Sequence
  chemically synthesized
aagaaccacgggaagaaaggtc

SEQ ID NO: 980803 - DNA, 22 bp, Artificial Sequence
  chemically synthesized
gttacaggatggacctttcttc

SEQ ID NO: 980804 - DNA, 22 bp, Artificial Sequence
  chemically synthesized
ttacaggatggacctttcttcc

SEQ ID NO: 980805 - DNA, 22 bp, Artificial Sequence
  chemically synthesized
caggatggacctttcttcccgt

SEQ ID NO: 980806 - DNA, 22 bp, Artificial Sequence
  chemically synthesized
aagttaaagaaccacgggaaga

SEQ ID NO: 980807 - DNA, 22 bp, Artificial Sequence
  chemically synthesized
acgcacactcaagttaaagaac

SEQ ID NO: 980808 - DNA, 22 bp, Artificial Sequence
  chemically synthesized
tcttcccgtggttctttaactt

SEQ ID NO: 980809 - DNA, 22 bp, Artificial Sequence
  chemically synthesized
taacgcacactcaagttaaaga

SEQ ID NO: 980810 - DNA, 22 bp, Artificial Sequence
  chemically synthesized
cttcccgtggttctttaacttg

SEQ ID NO: 980811 - DNA, 22 bp, Artificial Sequence
  chemically synthesized
ttcccgtggttctttaacttga

SEQ ID NO: 980812 - DNA, 22 bp, Artificial Sequence
  chemically synthesized
cccgtggttctttaacttgagt

SEQ ID NO: 980813 - DNA, 22 bp, Artificial Sequence
  chemically synthesized
ccgtggttctttaacttgagtg

SEQ ID NO: 980814 - DNA, 22 bp, Artificial Sequence
  chemically synthesized
taggcaattctaacgcacactc

SEQ ID NO: 980815 - DNA, 22 bp, Artificial Sequence
  chemically synthesized
tttaacttgagtgtgcgttaga

SEQ ID NO: 980816 - DNA, 22 bp, Artificial Sequence
  chemically synthesized
taacttgagtgtgcgttagaat

SEQ ID NO: 980817 - DNA, 22 bp, Artificial Sequence
  chemically synthesized
aacttgagtgtgcgttagaatt

SEQ ID NO: 980818 - DNA, 22 bp, Artificial Sequence
  chemically synthesized
acttgagtgtgcgttagaattg

SEQ ID NO: 980819 - DNA, 22 bp, Artificial Sequence
  chemically synthesized
gagtgtgcgttagaattgccta

SEQ ID NO: 980820 - DNA, 22 bp, Artificial Sequence
  chemically synthesized
agtgtgcgttagaattgcctac

SEQ ID NO: 980821 - DNA, 22 bp, Artificial Sequence
  chemically synthesized
tgatcaagccctgtaggcaatt

SEQ ID NO: 980822 - DNA, 22 bp, Artificial Sequence
  chemically synthesized
gaattgcctacagggcttgatc

SEQ ID NO: 980823 - DNA, 22 bp, Artificial Sequence
  chemically synthesized
cctacagggcttgatcacagat

SEQ ID NO: 980824 - DNA, 22 bp, Artificial Sequence
  chemically synthesized
cagggcttgatcacagatctgc

SEQ ID NO: 980825 - DNA, 22 bp, Artificial Sequence
  chemically synthesized
gagagtggagcccgcagatctg

SEQ ID NO: 980826 - DNA, 22 bp, Artificial Sequence
  chemically synthesized
ggagagtggagcccgcagatct

SEQ ID NO: 980827 - DNA, 22 bp, Artificial Sequence
  chemically synthesized
ttggagagtggagcccgcagat

SEQ ID NO: 980828 - DNA, 22 bp, Artificial Sequence
  chemically synthesized
gatcacagatctgcgggctcca

SEQ ID NO: 980829 - DNA, 22 bp, Artificial Sequence
  chemically synthesized
atcacagatctgcgggctccac

SEQ ID NO: 980830 - DNA, 22 bp, Artificial Sequence
  chemically synthesized
aaacagaaattcttggagagtg

SEQ ID NO: 980831 - DNA, 22 bp, Artificial Sequence
  chemically synthesized
ctgaaacagaaattcttggaga

SEQ ID NO: 980832 - DNA, 22 bp, Artificial Sequence
  chemically synthesized
cgggctccactctccaagaatt

SEQ ID NO: 980833 - DNA, 22 bp, Artificial Sequence
  chemically synthesized
cactctccaagaatttctgttt

SEQ ID NO: 980834 - DNA, 22 bp, Artificial Sequence
  chemically synthesized
acaacagacctactgaaacaga

SEQ ID NO: 980835 - DNA, 22 bp, Artificial Sequence
  chemically synthesized
tccaagaatttctgtttcagta

SEQ ID NO: 980836 - DNA, 22 bp, Artificial Sequence
  chemically synthesized
caagaatttctgtttcagtagg

SEQ ID NO: 980837 - DNA, 22 bp, Artificial Sequence
  chemically synthesized
agcctcacaacagacctactga

SEQ ID NO: 980838 - DNA, 22 bp, Artificial Sequence
  chemically synthesized
gagcctcacaacagacctactg

SEQ ID NO: 980839 - DNA, 22 bp, Artificial Sequence
  chemically synthesized
ttgagcctcacaacagacctac

SEQ ID NO: 980840 - DNA, 22 bp, Artificial Sequence
  chemically synthesized
ctgtttcagtaggtctgttgtg

SEQ ID NO: 980841 - DNA, 22 bp, Artificial Sequence
  chemically synthesized
tgtttcagtaggtctgttgtga

SEQ ID NO: 980842 - DNA, 22 bp, Artificial Sequence
  chemically synthesized
tttcagtaggtctgttgtgagg

SEQ ID NO: 980843 - DNA, 22 bp, Artificial Sequence
  chemically synthesized
cagtaggtctgttgtgaggctc

SEQ ID NO: 980844 - DNA, 22 bp, Artificial Sequence
  chemically synthesized
agtaggtctgttgtgaggctca

SEQ ID NO: 980845 - DNA, 22 bp, Artificial Sequence
  chemically synthesized
gaaatgcccattcttgagcctc

SEQ ID NO: 980846 - DNA, 22 bp, Artificial Sequence
  chemically synthesized
ttgtgaggctcaagaatgggca

SEQ ID NO: 980847 - DNA, 22 bp, Artificial Sequence
  chemically synthesized
tgaggctcaagaatgggcattt

SEQ ID NO: 980848 - DNA, 22 bp, Artificial Sequence
  chemically synthesized
aagaatgggcatttctaaccat

SEQ ID NO: 980849 - DNA, 22 bp, Artificial Sequence
  chemically synthesized
ctaaccatccccgtgatgctga

SEQ ID NO: 980850 - DNA, 22 bp, Artificial Sequence
  chemically synthesized
taaccatccccgtgatgctgat

SEQ ID NO: 980851 - DNA, 22 bp, Artificial Sequence
  chemically synthesized
accatccccgtgatgctgatct

SEQ ID NO: 980852 - DNA, 22 bp, Artificial Sequence
  chemically synthesized
aaagtgtgggtcccagatcagc

SEQ ID NO: 980853 - DNA, 22 bp, Artificial Sequence
  chemically synthesized
caaagtgtgggtcccagatcag

SEQ ID NO: 980854 - DNA, 22 bp, Artificial Sequence
  chemically synthesized
tcaaagtgtgggtcccagatca

SEQ ID NO: 980855 - DNA, 22 bp, Artificial Sequence
  chemically synthesized
ttttcaaagtgtgggtcccaga

SEQ ID NO: 980856 - DNA, 22 bp, Artificial Sequence
  chemically synthesized
atctgggacccacactttgaaa

SEQ ID NO: 980857 - DNA, 22 bp, Artificial Sequence
  chemically synthesized
ggacccacactttgaaaacaac

SEQ ID NO: 980858 - DNA, 22 bp, Artificial Sequence
  chemically synthesized
tggagtagagcagttgttttca

SEQ ID NO: 980859 - DNA, 22 bp, Artificial Sequence
  chemically synthesized
cccctatggagtagagcagttg

SEQ ID NO: 980860 - DNA, 22 bp, Artificial Sequence
  chemically synthesized
ccccctatggagtagagcagtt

SEQ ID NO: 980861 - DNA, 22 bp, Artificial Sequence
  chemically synthesized
atttccccctatggagtagagc

SEQ ID NO: 980862 - DNA, 22 bp, Artificial Sequence
  chemically synthesized
tgaaaacaactgctctactcca

SEQ ID NO: 980863 - DNA, 22 bp, Artificial Sequence
  chemically synthesized
gaaaacaactgctctactccat

SEQ ID NO: 980864 - DNA, 22 bp, Artificial Sequence
  chemically synthesized
aaaacaactgctctactccata

SEQ ID NO: 980865 - DNA, 22 bp, Artificial Sequence
  chemically synthesized
acacattcatttccccctatgg

SEQ ID NO: 980866 - DNA, 22 bp, Artificial Sequence
  chemically synthesized
ctgacacattcatttcccccta

SEQ ID NO: 980867 - DNA, 22 bp, Artificial Sequence
  chemically synthesized
cctgacacattcatttccccct

SEQ ID NO: 980868 - DNA, 22 bp, Artificial Sequence
  chemically synthesized
ctctactccatagggggaaatg

SEQ ID NO: 980869 - DNA, 22 bp, Artificial Sequence
  chemically synthesized
tcctgacacattcatttccccc

SEQ ID NO: 980870 - DNA, 22 bp, Artificial Sequence
  chemically synthesized
ttcctgacacattcatttcccc

SEQ ID NO: 980871 - DNA, 22 bp, Artificial Sequence
  chemically synthesized
tttcctgacacattcatttccc

SEQ ID NO: 980872 - DNA, 22 bp, Artificial Sequence
  chemically synthesized
tactccatagggggaaatgaat

SEQ ID NO: 980873 - DNA, 22 bp, Artificial Sequence
  chemically synthesized
ctccatagggggaaatgaatgt

SEQ ID NO: 980874 - DNA, 22 bp, Artificial Sequence
  chemically synthesized
catagggggaaatgaatgtgtc

SEQ ID NO: 980875 - DNA, 22 bp, Artificial Sequence
  chemically synthesized
agaaacagagcacctttttcct

SEQ ID NO: 980876 - DNA, 22 bp, Artificial Sequence
  chemically synthesized
cagaaacagagcacctttttcc

SEQ ID NO: 980877 - DNA, 22 bp, Artificial Sequence
  chemically synthesized
ttcagaaacagagcaccttttt

SEQ ID NO: 980878 - DNA, 22 bp, Artificial Sequence
  chemically synthesized
cttcagaaacagagcacctttt

SEQ ID NO: 980879 - DNA, 22 bp, Artificial Sequence
  chemically synthesized
tcttcagaaacagagcaccttt

SEQ ID NO: 980880 - DNA, 22 bp, Artificial Sequence
  chemically synthesized
tttcttcagaaacagagcacct

SEQ ID NO: 980881 - DNA, 22 bp, Artificial Sequence
  chemically synthesized
tctttcttcagaaacagagcac

SEQ ID NO: 980882 - DNA, 22 bp, Artificial Sequence
  chemically synthesized
ctctttcttcagaaacagagca

SEQ ID NO: 980883 - DNA, 22 bp, Artificial Sequence
  chemically synthesized
atgtttctctttcttcagaaac

SEQ ID NO: 980884 - DNA, 22 bp, Artificial Sequence
  chemically synthesized
catgtttctctttcttcagaaa

SEQ ID NO: 980885 - DNA, 22 bp, Artificial Sequence
  chemically synthesized
tcatgtttctctttcttcagaa

SEQ ID NO: 980886 - DNA, 22 bp, Artificial Sequence
  chemically synthesized
acctttcatgtttctctttctt

SEQ ID NO: 980887 - DNA, 22 bp, Artificial Sequence
  chemically synthesized
tgtttctgaagaaagagaaaca

SEQ ID NO: 980888 - DNA, 22 bp, Artificial Sequence
  chemically synthesized
tctaacctttcatgtttctctt

SEQ ID NO: 980889 - DNA, 22 bp, Artificial Sequence
  chemically synthesized
gtctaacctttcatgtttctct

SEQ ID NO: 980890 - DNA, 22 bp, Artificial Sequence
  chemically synthesized
tttctgaagaaagagaaacatg

SEQ ID NO: 980891 - DNA, 22 bp, Artificial Sequence
  chemically synthesized
tgtctaacctttcatgtttctc

SEQ ID NO: 980892 - DNA, 22 bp, Artificial Sequence
  chemically synthesized
tttgtctaacctttcatgtttc

SEQ ID NO: 980893 - DNA, 22 bp, Artificial Sequence
  chemically synthesized
ctgaagaaagagaaacatgaaa

SEQ ID NO: 980894 - DNA, 22 bp, Artificial Sequence
  chemically synthesized
tgaagaaagagaaacatgaaag

SEQ ID NO: 980895 - DNA, 22 bp, Artificial Sequence
  chemically synthesized
aagaaagagaaacatgaaaggt

SEQ ID NO: 980896 - DNA, 22 bp, Artificial Sequence
  chemically synthesized
tattctttgtctaacctttcat

SEQ ID NO: 980897 - DNA, 22 bp, Artificial Sequence
  chemically synthesized
atattctttgtctaacctttca

SEQ ID NO: 980898 - DNA, 22 bp, Artificial Sequence
  chemically synthesized
tatattctttgtctaacctttc

SEQ ID NO: 980899 - DNA, 22 bp, Artificial Sequence
  chemically synthesized
cctttatattctttgtctaacc

SEQ ID NO: 980900 - DNA, 22 bp, Artificial Sequence
  chemically synthesized
agttacctttatattctttgtc

SEQ ID NO: 980901 - DNA, 22 bp, Artificial Sequence
  chemically synthesized
cagttacctttatattctttgt

SEQ ID NO: 980902 - DNA, 22 bp, Artificial Sequence
  chemically synthesized
gaggatttcagttacctttata

SEQ ID NO: 980903 - DNA, 22 bp, Artificial Sequence
  chemically synthesized
cgaggatttcagttacctttat

SEQ ID NO: 980904 - DNA, 22 bp, Artificial Sequence
  chemically synthesized
gacaaagaatataaaggtaact

SEQ ID NO: 980905 - DNA, 22 bp, Artificial Sequence
  chemically synthesized
cttcgaggatttcagttacctt

SEQ ID NO: 980906 - DNA, 22 bp, Artificial Sequence
  chemically synthesized
acttcgaggatttcagttacct

SEQ ID NO: 980907 - DNA, 22 bp, Artificial Sequence
  chemically synthesized
tacttcgaggatttcagttacc

SEQ ID NO: 980908 - DNA, 22 bp, Artificial Sequence
  chemically synthesized
ttttacttcgaggatttcagtt

SEQ ID NO: 980909 - DNA, 22 bp, Artificial Sequence
  chemically synthesized
attttacttcgaggatttcagt

SEQ ID NO: 980910 - DNA, 22 bp, Artificial Sequence
  chemically synthesized
agaggtggaatttattttactt

SEQ ID NO: 980911 - DNA, 22 bp, Artificial Sequence
  chemically synthesized
aaatcctcgaagtaaaataaat

SEQ ID NO: 980912 - DNA, 22 bp, Artificial Sequence
  chemically synthesized
gaagtaaaataaattccacctc

SEQ ID NO: 980913 - DNA, 22 bp, Artificial Sequence
  chemically synthesized
taggtatagttaagaggtggaa

SEQ ID NO: 980914 - DNA, 22 bp, Artificial Sequence
  chemically synthesized
cacctcttaactatacctataa

SEQ ID NO: 980915 - DNA, 22 bp, Artificial Sequence
  chemically synthesized
tgaaacaaaggattataggtat

SEQ ID NO: 980916 - DNA, 22 bp, Artificial Sequence
  chemically synthesized
gcctgtgaaacaaaggattata

SEQ ID NO: 980917 - DNA, 22 bp, Artificial Sequence
  chemically synthesized
ttaactatacctataatccttt

SEQ ID NO: 980918 - DNA, 22 bp, Artificial Sequence
  chemically synthesized
aactatacctataatcctttgt

SEQ ID NO: 980919 - DNA, 22 bp, Artificial Sequence
  chemically synthesized
actatacctataatcctttgtt

SEQ ID NO: 980920 - DNA, 22 bp, Artificial Sequence
  chemically synthesized
ggctggcctgtgaaacaaagga

SEQ ID NO: 980921 - DNA, 22 bp, Artificial Sequence
  chemically synthesized
aggctggcctgtgaaacaaagg

SEQ ID NO: 980922 - DNA, 22 bp, Artificial Sequence
  chemically synthesized
tacctataatcctttgtttcac

SEQ ID NO: 980923 - DNA, 22 bp, Artificial Sequence
  chemically synthesized
taatcctttgtttcacaggcca

SEQ ID NO: 980924 - DNA, 22 bp, Artificial Sequence
  chemically synthesized
tgtttcacaggccagcctaaat

SEQ ID NO: 980925 - DNA, 22 bp, Artificial Sequence
  chemically synthesized
gtttcacaggccagcctaaatt

SEQ ID NO: 980926 - DNA, 22 bp, Artificial Sequence
  chemically synthesized
tttcacaggccagcctaaattt

SEQ ID NO: 980927 - DNA, 22 bp, Artificial Sequence
  chemically synthesized
taagataaagtggtaaatttag

SEQ ID NO: 980928 - DNA, 22 bp, Artificial Sequence
  chemically synthesized
cacaggccagcctaaatttacc

SEQ ID NO: 980929 - DNA, 22 bp, Artificial Sequence
  chemically synthesized
acaggccagcctaaatttacca

SEQ ID NO: 980930 - DNA, 22 bp, Artificial Sequence
  chemically synthesized
tataagataaagtggtaaattt

SEQ ID NO: 980931 - DNA, 22 bp, Artificial Sequence
  chemically synthesized
aatttaccactttatcttatag

SEQ ID NO: 980932 - DNA, 22 bp, Artificial Sequence
  chemically synthesized
acacagacaactctataagata

SEQ ID NO: 980933 - DNA, 22 bp, Artificial Sequence
  chemically synthesized
accactttatcttatagagttg

SEQ ID NO: 980934 - DNA, 22 bp, Artificial Sequence
  chemically synthesized
ccactttatcttatagagttgt

SEQ ID NO: 980935 - DNA, 22 bp, Artificial Sequence
  chemically synthesized
tatcttatagagttgtctgtgt

SEQ ID NO: 980936 - DNA, 22 bp, Artificial Sequence
  chemically synthesized
atcttatagagttgtctgtgtg

SEQ ID NO: 980937 - DNA, 22 bp, Artificial Sequence
  chemically synthesized
tcttatagagttgtctgtgtga

SEQ ID NO: 980938 - DNA, 22 bp, Artificial Sequence
  chemically synthesized
atagagttgtctgtgtgaatcc

SEQ ID NO: 980939 - DNA, 22 bp, Artificial Sequence
  chemically synthesized
tagagttgtctgtgtgaatccg

SEQ ID NO: 980940 - DNA, 22 bp, Artificial Sequence
  chemically synthesized
tatcataagaaagcggattcac

SEQ ID NO: 980941 - DNA, 22 bp, Artificial Sequence
  chemically synthesized
actatatcataagaaagcggat

SEQ ID NO: 980942 - DNA, 22 bp, Artificial Sequence
  chemically synthesized
tctgtgtgaatccgctttctta

SEQ ID NO: 980943 - DNA, 22 bp, Artificial Sequence
  chemically synthesized
tgtgaatccgctttcttatgat

SEQ ID NO: 980944 - DNA, 22 bp, Artificial Sequence
  chemically synthesized
aaggagctcactatatcataag

SEQ ID NO: 980945 - DNA, 22 bp, Artificial Sequence
  chemically synthesized
aaaggagctcactatatcataa

SEQ ID NO: 980946 - DNA, 22 bp, Artificial Sequence
  chemically synthesized
tcttatgatatagtgagctcct

SEQ ID NO: 980947 - DNA, 22 bp, Artificial Sequence
  chemically synthesized
cttatgatatagtgagctcctt

SEQ ID NO: 980948 - DNA, 22 bp, Artificial Sequence
  chemically synthesized
ttatgatatagtgagctccttt

SEQ ID NO: 980949 - DNA, 22 bp, Artificial Sequence
  chemically synthesized
atgatatagtgagctcctttaa

SEQ ID NO: 980950 - DNA, 22 bp, Artificial Sequence
  chemically synthesized
tgatatagtgagctcctttaaa

SEQ ID NO: 980951 - DNA, 22 bp, Artificial Sequence
  chemically synthesized
ctttaaacattgtggcatgctt

SEQ ID NO: 980952 - DNA, 22 bp, Artificial Sequence
  chemically synthesized
taaacattgtggcatgctttat

SEQ ID NO: 980953 - DNA, 22 bp, Artificial Sequence
  chemically synthesized
aaacattgtggcatgctttatt

SEQ ID NO: 980954 - DNA, 22 bp, Artificial Sequence
  chemically synthesized
aacattgtggcatgctttattc

SEQ ID NO: 980955 - DNA, 22 bp, Artificial Sequence
  chemically synthesized
tgacagacataaagatgaataa

SEQ ID NO: 980956 - DNA, 22 bp, Artificial Sequence
  chemically synthesized
tggcatgctttattcatcttta

SEQ ID NO: 980957 - DNA, 22 bp, Artificial Sequence
  chemically synthesized
atctatgacagacataaagatg

SEQ ID NO: 980958 - DNA, 22 bp, Artificial Sequence
  chemically synthesized
taatctatgacagacataaaga

SEQ ID NO: 980959 - DNA, 22 bp, Artificial Sequence
  chemically synthesized
ctaatctatgacagacataaag

SEQ ID NO: 980960 - DNA, 22 bp, Artificial Sequence
  chemically synthesized
cttctaatctatgacagacata

SEQ ID NO: 980961 - DNA, 22 bp, Artificial Sequence
  chemically synthesized
tattcatctttatgtctgtcat

SEQ ID NO: 980962 - DNA, 22 bp, Artificial Sequence
  chemically synthesized
attcatctttatgtctgtcata

SEQ ID NO: 980963 - DNA, 22 bp, Artificial Sequence
  chemically synthesized
ctacttctaatctatgacagac

SEQ ID NO: 980964 - DNA, 22 bp, Artificial Sequence
  chemically synthesized
ttcatctttatgtctgtcatag

SEQ ID NO: 980965 - DNA, 22 bp, Artificial Sequence
  chemically synthesized
actacttctaatctatgacaga

SEQ ID NO: 980966 - DNA, 22 bp, Artificial Sequence
  chemically synthesized
atctttatgtctgtcatagatt

SEQ ID NO: 980967 - DNA, 22 bp, Artificial Sequence
  chemically synthesized
aacacttactacttctaatcta

SEQ ID NO: 980968 - DNA, 22 bp, Artificial Sequence
  chemically synthesized
tatgtctgtcatagattagaag

SEQ ID NO: 980969 - DNA, 22 bp, Artificial Sequence
  chemically synthesized
atgtctgtcatagattagaagt

SEQ ID NO: 980970 - DNA, 22 bp, Artificial Sequence
  chemically synthesized
tgtctgtcatagattagaagta

SEQ ID NO: 980971 - DNA, 22 bp, Artificial Sequence
  chemically synthesized
ttgaacacttactacttctaat

SEQ ID NO: 980972 - DNA, 22 bp, Artificial Sequence
  chemically synthesized
attgaacacttactacttctaa

SEQ ID NO: 980973 - DNA, 22 bp, Artificial Sequence
  chemically synthesized
tcatagattagaagtagtaagt

SEQ ID NO: 980974 - DNA, 22 bp, Artificial Sequence
  chemically synthesized
gaagtagtaagtgttcaataaa

SEQ ID NO: 980975 - DNA, 22 bp, Artificial Sequence
  chemically synthesized
acgcaacaaatgtttattgaac

SEQ ID NO: 980976 - DNA, 22 bp, Artificial Sequence
  chemically synthesized
aacgcaacaaatgtttattgaa

SEQ ID NO: 980977 - DNA, 22 bp, Artificial Sequence
  chemically synthesized
taacgcaacaaatgtttattga

SEQ ID NO: 980978 - DNA, 22 bp, Artificial Sequence
  chemically synthesized
ttaacgcaacaaatgtttattg

SEQ ID NO: 980979 - DNA, 22 bp, Artificial Sequence
  chemically synthesized
atacttttaacgcaacaaatgt

SEQ ID NO: 980980 - DNA, 22 bp, Artificial Sequence
  chemically synthesized
taatacttttaacgcaacaaat

SEQ ID NO: 980981 - DNA, 22 bp, Artificial Sequence
  chemically synthesized
ctaatacttttaacgcaacaaa

SEQ ID NO: 980982 - DNA, 22 bp, Artificial Sequence
  chemically synthesized
tctaatacttttaacgcaacaa

SEQ ID NO: 980983 - DNA, 22 bp, Artificial Sequence
  chemically synthesized
aataaacatttgttgcgttaaa

SEQ ID NO: 980984 - DNA, 22 bp, Artificial Sequence
  chemically synthesized
ctttctaatacttttaacgcaa

SEQ ID NO: 980985 - DNA, 22 bp, Artificial Sequence
  chemically synthesized
cctttctaatacttttaacgca

SEQ ID NO: 980986 - DNA, 22 bp, Artificial Sequence
  chemically synthesized
tttcctttctaatacttttaac

SEQ ID NO: 980987 - DNA, 22 bp, Artificial Sequence
  chemically synthesized
gttgcgttaaaagtattagaaa

SEQ ID NO: 980988 - DNA, 22 bp, Artificial Sequence
  chemically synthesized
ttgcgttaaaagtattagaaag

SEQ ID NO: 980989 - DNA, 22 bp, Artificial Sequence
  chemically synthesized
cgttaaaagtattagaaaggaa

SEQ ID NO: 980990 - DNA, 22 bp, Artificial Sequence
  chemically synthesized
aaagtattagaaaggaaataga

SEQ ID NO: 980991 - DNA, 22 bp, Artificial Sequence
  chemically synthesized
gaaaggaaatagactgtacact

SEQ ID NO: 980992 - DNA, 22 bp, Artificial Sequence
  chemically synthesized
ccaatcgagaataaagtgtaca

SEQ ID NO: 980993 - DNA, 22 bp, Artificial Sequence
  chemically synthesized
taccaatcgagaataaagtgta

SEQ ID NO: 980994 - DNA, 22 bp, Artificial Sequence
  chemically synthesized
ctaccaatcgagaataaagtgt

SEQ ID NO: 980995 - DNA, 22 bp, Artificial Sequence
  chemically synthesized
tacactttattctcgattggta

SEQ ID NO: 980996 - DNA, 22 bp, Artificial Sequence
  chemically synthesized
caccataaaatttctaccaatc

SEQ ID NO: 980997 - DNA, 22 bp, Artificial Sequence
  chemically synthesized
tattctcgattggtagaaattt

SEQ ID NO: 980998 - DNA, 22 bp, Artificial Sequence
  chemically synthesized
attctcgattggtagaaatttt

SEQ ID NO: 980999 - DNA, 22 bp, Artificial Sequence
  chemically synthesized
ggattacaccataaaatttcta

SEQ ID NO: 981000 - DNA, 22 bp, Artificial Sequence
  chemically synthesized
ttctcgattggtagaaatttta

SEQ ID NO: 981001 - DNA, 22 bp, Artificial Sequence
  chemically synthesized
aggattacaccataaaatttct

SEQ ID NO: 981002 - DNA, 22 bp, Artificial Sequence
  chemically synthesized
tcgattggtagaaattttatgg

SEQ ID NO: 981003 - DNA, 22 bp, Artificial Sequence
  chemically synthesized
ccttaggattacaccataaaat

SEQ ID NO: 981004 - DNA, 22 bp, Artificial Sequence
  chemically synthesized
gattggtagaaattttatggtg

SEQ ID NO: 981005 - DNA, 22 bp, Artificial Sequence
  chemically synthesized
accttaggattacaccataaaa

SEQ ID NO: 981006 - DNA, 22 bp, Artificial Sequence
  chemically synthesized
gtagaaattttatggtgtaatc

SEQ ID NO: 981007 - DNA, 22 bp, Artificial Sequence
  chemically synthesized
tatggtgtaatcctaaggtaag

SEQ ID NO: 981008 - DNA, 22 bp, Artificial Sequence
  chemically synthesized
atggtgtaatcctaaggtaagg

SEQ ID NO: 981009 - DNA, 22 bp, Artificial Sequence
  chemically synthesized
tggtgtaatcctaaggtaaggt

SEQ ID NO: 981010 - DNA, 22 bp, Artificial Sequence
  chemically synthesized
aaatcaatagtgtaccttacct

SEQ ID NO: 981011 - DNA, 22 bp, Artificial Sequence
  chemically synthesized
aaacattgaaatcaatagtgta

SEQ ID NO: 981012 - DNA, 22 bp, Artificial Sequence
  chemically synthesized
aggtaaggtacactattgattt

SEQ ID NO: 981013 - DNA, 22 bp, Artificial Sequence
  chemically synthesized
ttgatttcaatgtttgaatttt

SEQ ID NO: 981014 - DNA, 22 bp, Artificial Sequence
  chemically synthesized
atttcaatgtttgaatttttta

SEQ ID NO: 981015 - DNA, 22 bp, Artificial Sequence
  chemically synthesized
gatagaaaataaaataaaaaat

SEQ ID NO: 981016 - DNA, 22 bp, Artificial Sequence
  chemically synthesized
agatagaaaataaaataaaaaa

SEQ ID NO: 981017 - DNA, 22 bp, Artificial Sequence
  chemically synthesized
caatgtttgaattttttatttt

SEQ ID NO: 981018 - DNA, 22 bp, Artificial Sequence
  chemically synthesized
tagatagaaaataaaataaaaa

SEQ ID NO: 981019 - DNA, 22 bp, Artificial Sequence
  chemically synthesized
aatgtttgaattttttatttta

SEQ ID NO: 981020 - DNA, 22 bp, Artificial Sequence
  chemically synthesized
ttttagatagaaaataaaataa

SEQ ID NO: 981021 - DNA, 22 bp, Artificial Sequence
  chemically synthesized
gaattttttattttattttcta

SEQ ID NO: 981022 - DNA, 22 bp, Artificial Sequence
  chemically synthesized
aattttttattttattttctat

SEQ ID NO: 981023 - DNA, 22 bp, Artificial Sequence
  chemically synthesized
tttattttattttctatctaaa

SEQ ID NO: 981024 - DNA, 22 bp, Artificial Sequence
  chemically synthesized
ttattttattttctatctaaaa

SEQ ID NO: 981025 - DNA, 22 bp, Artificial Sequence
  chemically synthesized
tattttattttctatctaaaac

SEQ ID NO: 981026 - DNA, 22 bp, Artificial Sequence
  chemically synthesized
cacatgtgaattgttttagata

SEQ ID NO: 981027 - DNA, 22 bp, Artificial Sequence
  chemically synthesized
attttattttctatctaaaaca

SEQ ID NO: 981028 - DNA, 22 bp, Artificial Sequence
  chemically synthesized
ttttattttctatctaaaacaa

SEQ ID NO: 981029 - DNA, 22 bp, Artificial Sequence
  chemically synthesized
attacacatgtgaattgtttta

SEQ ID NO: 981030 - DNA, 22 bp, Artificial Sequence
  chemically synthesized
tattttctatctaaaacaattc

SEQ ID NO: 981031 - DNA, 22 bp, Artificial Sequence
  chemically synthesized
attttctatctaaaacaattca

SEQ ID NO: 981032 - DNA, 22 bp, Artificial Sequence
  chemically synthesized
ttttctatctaaaacaattcac

SEQ ID NO: 981033 - DNA, 22 bp, Artificial Sequence
  chemically synthesized
attcattacacatgtgaattgt

SEQ ID NO: 981034 - DNA, 22 bp, Artificial Sequence
  chemically synthesized
aattcattacacatgtgaattg

SEQ ID NO: 981035 - DNA, 22 bp, Artificial Sequence
  chemically synthesized
tctatctaaaacaattcacatg

SEQ ID NO: 981036 - DNA, 22 bp, Artificial Sequence
  chemically synthesized
ctatctaaaacaattcacatgt

SEQ ID NO: 981037 - DNA, 22 bp, Artificial Sequence
  chemically synthesized
tatctaaaacaattcacatgtg

SEQ ID NO: 981038 - DNA, 22 bp, Artificial Sequence
  chemically synthesized
tctaaaacaattcacatgtgta

SEQ ID NO: 981039 - DNA, 22 bp, Artificial Sequence
  chemically synthesized
aaacaattcacatgtgtaatga

SEQ ID NO: 981040 - DNA, 22 bp, Artificial Sequence
  chemically synthesized
acaaaagacagatgtttaattc

SEQ ID NO: 981041 - DNA, 22 bp, Artificial Sequence
  chemically synthesized
acatgtgtaatgaattaaacat

SEQ ID NO: 981042 - DNA, 22 bp, Artificial Sequence
  chemically synthesized
agtatcacctcacaaaagacag

SEQ ID NO: 981043 - DNA, 22 bp, Artificial Sequence
  chemically synthesized
aagtatcacctcacaaaagaca

SEQ ID NO: 981044 - DNA, 22 bp, Artificial Sequence
  chemically synthesized
taagtatcacctcacaaaagac

SEQ ID NO: 981045 - DNA, 22 bp, Artificial Sequence
  chemically synthesized
ttaagtatcacctcacaaaaga

SEQ ID NO: 981046 - DNA, 22 bp, Artificial Sequence
  chemically synthesized
tttaagtatcacctcacaaaag

SEQ ID NO: 981047 - DNA, 22 bp, Artificial Sequence
  chemically synthesized
aacatctgtcttttgtgaggtg

SEQ ID NO: 981048 - DNA, 22 bp, Artificial Sequence
  chemically synthesized
agtattttttaagtatcacctc

SEQ ID NO: 981049 - DNA, 22 bp, Artificial Sequence
  chemically synthesized
taagtattttttaagtatcacc

SEQ ID NO: 981050 - DNA, 22 bp, Artificial Sequence
  chemically synthesized
tcttttgtgaggtgatacttaa

SEQ ID NO: 981051 - DNA, 22 bp, Artificial Sequence
  chemically synthesized
ttgtgaggtgatacttaaaaaa

SEQ ID NO: 981052 - DNA, 22 bp, Artificial Sequence
  chemically synthesized
tgtgaggtgatacttaaaaaat

SEQ ID NO: 981053 - DNA, 22 bp, Artificial Sequence
  chemically synthesized
gtgaggtgatacttaaaaaata

SEQ ID NO: 981054 - DNA, 22 bp, Artificial Sequence
  chemically synthesized
agtgtctctaagtattttttaa

SEQ ID NO: 981055 - DNA, 22 bp, Artificial Sequence
  chemically synthesized
tgaggtgatacttaaaaaatac

SEQ ID NO: 981056 - DNA, 22 bp, Artificial Sequence
  chemically synthesized
aagtgtctctaagtatttttta

SEQ ID NO: 981057 - DNA, 22 bp, Artificial Sequence
  chemically synthesized
tttaagtgtctctaagtatttt

SEQ ID NO: 981058 - DNA, 22 bp, Artificial Sequence
  chemically synthesized
atttaagtgtctctaagtattt

SEQ ID NO: 981059 - DNA, 22 bp, Artificial Sequence
  chemically synthesized
cttatttaagtgtctctaagta

SEQ ID NO: 981060 - DNA, 22 bp, Artificial Sequence
  chemically synthesized
tgctccttatttaagtgtctct

SEQ ID NO: 981061 - DNA, 22 bp, Artificial Sequence
  chemically synthesized
aaaaaatacttagagacactta

SEQ ID NO: 981062 - DNA, 22 bp, Artificial Sequence
  chemically synthesized
aaaaatacttagagacacttaa

SEQ ID NO: 981063 - DNA, 22 bp, Artificial Sequence
  chemically synthesized
cagcattatgctccttatttaa

SEQ ID NO: 981064 - DNA, 22 bp, Artificial Sequence
  chemically synthesized
tacagcattatgctccttattt

SEQ ID NO: 981065 - DNA, 22 bp, Artificial Sequence
  chemically synthesized
ctacagcattatgctccttatt

SEQ ID NO: 981066 - DNA, 22 bp, Artificial Sequence
  chemically synthesized
agagacacttaaataaggagca

SEQ ID NO: 981067 - DNA, 22 bp, Artificial Sequence
  chemically synthesized
gagacacttaaataaggagcat

SEQ ID NO: 981068 - DNA, 22 bp, Artificial Sequence
  chemically synthesized
aaataaggagcataatgctgta

SEQ ID NO: 981069 - DNA, 22 bp, Artificial Sequence
  chemically synthesized
aataaggagcataatgctgtag

SEQ ID NO: 981070 - DNA, 22 bp, Artificial Sequence
  chemically synthesized
catatatggtatttctacagca

SEQ ID NO: 981071 - DNA, 22 bp, Artificial Sequence
  chemically synthesized
aatagattccatatatggtatt

SEQ ID NO: 981072 - DNA, 22 bp, Artificial Sequence
  chemically synthesized
aattgaatagattccatatatg

SEQ ID NO: 981073 - DNA, 22 bp, Artificial Sequence
  chemically synthesized
tagaaataccatatatggaatc

SEQ ID NO: 981074 - DNA, 22 bp, Artificial Sequence
  chemically synthesized
ttaaattgaatagattccatat

SEQ ID NO: 981075 - DNA, 22 bp, Artificial Sequence
  chemically synthesized
gttaaattgaatagattccata

SEQ ID NO: 981076 - DNA, 22 bp, Artificial Sequence
  chemically synthesized
tgttaaattgaatagattccat

SEQ ID NO: 981077 - DNA, 22 bp, Artificial Sequence
  chemically synthesized
aatataaagttttgttaaattg

SEQ ID NO: 981078 - DNA, 22 bp, Artificial Sequence
  chemically synthesized
ttcaatttaacaaaactttata

SEQ ID NO: 981079 - DNA, 22 bp, Artificial Sequence
  chemically synthesized
aatttaacaaaactttatattg

SEQ ID NO: 981080 - DNA, 22 bp, Artificial Sequence
  chemically synthesized
aacaaaactttatattgagctt

SEQ ID NO: 981081 - DNA, 22 bp, Artificial Sequence
  chemically synthesized
acaaaactttatattgagcttc

SEQ ID NO: 981082 - DNA, 22 bp, Artificial Sequence
  chemically synthesized
tcaggcatgtggtagaagctca

SEQ ID NO: 981083 - DNA, 22 bp, Artificial Sequence
  chemically synthesized
tatattgagcttctaccacatg

SEQ ID NO: 981084 - DNA, 22 bp, Artificial Sequence
  chemically synthesized
atattgagcttctaccacatgc

SEQ ID NO: 981085 - DNA, 22 bp, Artificial Sequence
  chemically synthesized
tattgagcttctaccacatgcc

SEQ ID NO: 981086 - DNA, 22 bp, Artificial Sequence
  chemically synthesized
agtatactatcaggcatgtggt

SEQ ID NO: 981087 - DNA, 22 bp, Artificial Sequence
  chemically synthesized
agcttctaccacatgcctgata

SEQ ID NO: 981088 - DNA, 22 bp, Artificial Sequence
  chemically synthesized
cagcattgagtatactatcagg

SEQ ID NO: 981089 - DNA, 22 bp, Artificial Sequence
  chemically synthesized
ccagcattgagtatactatcag

SEQ ID NO: 981090 - DNA, 22 bp, Artificial Sequence
  chemically synthesized
ctaccacatgcctgatagtata

SEQ ID NO: 981091 - DNA, 22 bp, Artificial Sequence
  chemically synthesized
taccacatgcctgatagtatac

SEQ ID NO: 981092 - DNA, 22 bp, Artificial Sequence
  chemically synthesized
ccacatgcctgatagtatactc

SEQ ID NO: 981093 - DNA, 22 bp, Artificial Sequence
  chemically synthesized
gatatttccagcattgagtata

SEQ ID NO: 981094 - DNA, 22 bp, Artificial Sequence
  chemically synthesized
tattagatatttccagcattga

SEQ ID NO: 981095 - DNA, 22 bp, Artificial Sequence
  chemically synthesized
atagtatactcaatgctggaaa

SEQ ID NO: 981096 - DNA, 22 bp, Artificial Sequence
  chemically synthesized
acatcattatattagatatttc

SEQ ID NO: 981097 - DNA, 22 bp, Artificial Sequence
  chemically synthesized
aacatcattatattagatattt

SEQ ID NO: 981098 - DNA, 22 bp, Artificial Sequence
  chemically synthesized
ttaacatcattatattagatat

SEQ ID NO: 981099 - DNA, 22 bp, Artificial Sequence
  chemically synthesized
aatgctggaaatatctaatata

SEQ ID NO: 981100 - DNA, 22 bp, Artificial Sequence
  chemically synthesized
aagctcttaacatcattatatt

SEQ ID NO: 981101 - DNA, 22 bp, Artificial Sequence
  chemically synthesized
gaaatatctaatataatgatgt

SEQ ID NO: 981102 - DNA, 22 bp, Artificial Sequence
  chemically synthesized
atcaataaattgaagctcttaa

SEQ ID NO: 981103 - DNA, 22 bp, Artificial Sequence
  chemically synthesized
atataatgatgttaagagcttc

SEQ ID NO: 981104 - DNA, 22 bp, Artificial Sequence
  chemically synthesized
actaatcaataaattgaagctc

SEQ ID NO: 981105 - DNA, 22 bp, Artificial Sequence
  chemically synthesized
tatgctaactaatcaataaatt

SEQ ID NO: 981106 - DNA, 22 bp, Artificial Sequence
  chemically synthesized
ttgtatgctaactaatcaataa

SEQ ID NO: 981107 - DNA, 22 bp, Artificial Sequence
  chemically synthesized
agagcttcaatttattgattag

SEQ ID NO: 981108 - DNA, 22 bp, Artificial Sequence
  chemically synthesized
cctgttgtatgctaactaatca

SEQ ID NO: 981109 - DNA, 22 bp, Artificial Sequence
  chemically synthesized
caatttattgattagttagcat

SEQ ID NO: 981110 - DNA, 22 bp, Artificial Sequence
  chemically synthesized
aatttattgattagttagcata

SEQ ID NO: 981111 - DNA, 22 bp, Artificial Sequence
  chemically synthesized
cagattgcctgttgtatgctaa

SEQ ID NO: 981112 - DNA, 22 bp, Artificial Sequence
  chemically synthesized
gcagattgcctgttgtatgcta

SEQ ID NO: 981113 - DNA, 22 bp, Artificial Sequence
  chemically synthesized
attgattagttagcatacaaca

SEQ ID NO: 981114 - DNA, 22 bp, Artificial Sequence
  chemically synthesized
ttgattagttagcatacaacag

SEQ ID NO: 981115 - DNA, 22 bp, Artificial Sequence
  chemically synthesized
attagttagcatacaacaggca

SEQ ID NO: 981116 - DNA, 22 bp, Artificial Sequence
  chemically synthesized
gttagcatacaacaggcaatct

SEQ ID NO: 981117 - DNA, 22 bp, Artificial Sequence
  chemically synthesized
taaacaccttgcagattgcctg

SEQ ID NO: 981118 - DNA, 22 bp, Artificial Sequence
  chemically synthesized
ctgtaaacaccttgcagattgc

SEQ ID NO: 981119 - DNA, 22 bp, Artificial Sequence
  chemically synthesized
gcatacaacaggcaatctgcaa

SEQ ID NO: 981120 - DNA, 22 bp, Artificial Sequence
  chemically synthesized
gctgtaaacaccttgcagattg

SEQ ID NO: 981121 - DNA, 22 bp, Artificial Sequence
  chemically synthesized
caaggtgtttacagcaaattat

SEQ ID NO: 981122 - DNA, 22 bp, Artificial Sequence
  chemically synthesized
cgatgagtaaataagcataatt

SEQ ID NO: 981123 - DNA, 22 bp, Artificial Sequence
  chemically synthesized
acagcaaattatgcttatttac

SEQ ID NO: 981124 - DNA, 22 bp, Artificial Sequence
  chemically synthesized
cagcaaattatgcttatttact

SEQ ID NO: 981125 - DNA, 22 bp, Artificial Sequence
  chemically synthesized
gtagaggtattgcgatgagtaa

SEQ ID NO: 981126 - DNA, 22 bp, Artificial Sequence
  chemically synthesized
cgtagaggtattgcgatgagta

SEQ ID NO: 981127 - DNA, 22 bp, Artificial Sequence
  chemically synthesized
tgcttatttactcatcgcaata

SEQ ID NO: 981128 - DNA, 22 bp, Artificial Sequence
  chemically synthesized
atttactcatcgcaatacctct

SEQ ID NO: 981129 - DNA, 22 bp, Artificial Sequence
  chemically synthesized
tttactcatcgcaatacctcta

SEQ ID NO: 981130 - DNA, 22 bp, Artificial Sequence
  chemically synthesized
actcatcgcaatacctctacga

SEQ ID NO: 981131 - DNA, 22 bp, Artificial Sequence
  chemically synthesized
ataaagccaacttcgtagaggt

SEQ ID NO: 981132 - DNA, 22 bp, Artificial Sequence
  chemically synthesized
ctcatcgcaatacctctacgaa

SEQ ID NO: 981133 - DNA, 22 bp, Artificial Sequence
  chemically synthesized
atcgcaatacctctacgaagtt

SEQ ID NO: 981134 - DNA, 22 bp, Artificial Sequence
  chemically synthesized
gagatgctaataaagccaactt

SEQ ID NO: 981135 - DNA, 22 bp, Artificial Sequence
  chemically synthesized
atctggagatgctaataaagcc

SEQ ID NO: 981136 - DNA, 22 bp, Artificial Sequence
  chemically synthesized
aatctggagatgctaataaagc

SEQ ID NO: 981137 - DNA, 22 bp, Artificial Sequence
  chemically synthesized
tacgaagttggctttattagca

SEQ ID NO: 981138 - DNA, 22 bp, Artificial Sequence
  chemically synthesized
cttaatctggagatgctaataa

SEQ ID NO: 981139 - DNA, 22 bp, Artificial Sequence
  chemically synthesized
cgaagttggctttattagcatc

SEQ ID NO: 981140 - DNA, 22 bp, Artificial Sequence
  chemically synthesized
ccttaatctggagatgctaata

SEQ ID NO: 981141 - DNA, 22 bp, Artificial Sequence
  chemically synthesized
ttccttaatctggagatgctaa

SEQ ID NO: 981142 - DNA, 22 bp, Artificial Sequence
  chemically synthesized
ctcttccttaatctggagatgc

SEQ ID NO: 981143 - DNA, 22 bp, Artificial Sequence
  chemically synthesized
cctcttccttaatctggagatg

SEQ ID NO: 981144 - DNA, 22 bp, Artificial Sequence
  chemically synthesized
gctttattagcatctccagatt

SEQ ID NO: 981145 - DNA, 22 bp, Artificial Sequence
  chemically synthesized
atttcctcttccttaatctgga

SEQ ID NO: 981146 - DNA, 22 bp, Artificial Sequence
  chemically synthesized
gatttcctcttccttaatctgg

SEQ ID NO: 981147 - DNA, 22 bp, Artificial Sequence
  chemically synthesized
tattagcatctccagattaagg

SEQ ID NO: 981148 - DNA, 22 bp, Artificial Sequence
  chemically synthesized
tgatttcctcttccttaatctg

SEQ ID NO: 981149 - DNA, 22 bp, Artificial Sequence
  chemically synthesized
attagcatctccagattaagga

SEQ ID NO: 981150 - DNA, 22 bp, Artificial Sequence
  chemically synthesized
ttagcatctccagattaaggaa

SEQ ID NO: 981151 - DNA, 22 bp, Artificial Sequence
  chemically synthesized
gcatctccagattaaggaagag

SEQ ID NO: 981152 - DNA, 22 bp, Artificial Sequence
  chemically synthesized
aagctttgatttcctcttcctt

SEQ ID NO: 981153 - DNA, 22 bp, Artificial Sequence
  chemically synthesized
aaagctttgatttcctcttcct

SEQ ID NO: 981154 - DNA, 22 bp, Artificial Sequence
  chemically synthesized
taaagctttgatttcctcttcc

SEQ ID NO: 981155 - DNA, 22 bp, Artificial Sequence
  chemically synthesized
cagattaaggaagaggaaatca

SEQ ID NO: 981156 - DNA, 22 bp, Artificial Sequence
  chemically synthesized
atgttttaaagctttgatttcc

SEQ ID NO: 981157 - DNA, 22 bp, Artificial Sequence
  chemically synthesized
aggaagaggaaatcaaagcttt

SEQ ID NO: 981158 - DNA, 22 bp, Artificial Sequence
  chemically synthesized
gaataaattaatgttttaaagc

SEQ ID NO: 981159 - DNA, 22 bp, Artificial Sequence
  chemically synthesized
agaataaattaatgttttaaag

SEQ ID NO: 981160 - DNA, 22 bp, Artificial Sequence
  chemically synthesized
tgtgatttagaataaattaatg

SEQ ID NO: 981161 - DNA, 22 bp, Artificial Sequence
  chemically synthesized
gctgtgtgatttagaataaatt

SEQ ID NO: 981162 - DNA, 22 bp, Artificial Sequence
  chemically synthesized
agctgtgtgatttagaataaat

SEQ ID NO: 981163 - DNA, 22 bp, Artificial Sequence
  chemically synthesized
taaaacattaatttattctaaa

SEQ ID NO: 981164 - DNA, 22 bp, Artificial Sequence
  chemically synthesized
ttagctgtgtgatttagaataa

SEQ ID NO: 981165 - DNA, 22 bp, Artificial Sequence
  chemically synthesized
aaaacattaatttattctaaat

SEQ ID NO: 981166 - DNA, 22 bp, Artificial Sequence
  chemically synthesized
cttagctgtgtgatttagaata

SEQ ID NO: 981167 - DNA, 22 bp, Artificial Sequence
  chemically synthesized
aaacattaatttattctaaatc

SEQ ID NO: 981168 - DNA, 22 bp, Artificial Sequence
  chemically synthesized
cgtcatttcttagctgtgtgat

SEQ ID NO: 981169 - DNA, 22 bp, Artificial Sequence
  chemically synthesized
atttattctaaatcacacagct

SEQ ID NO: 981170 - DNA, 22 bp, Artificial Sequence
  chemically synthesized
attctaaatcacacagctaaga

SEQ ID NO: 981171 - DNA, 22 bp, Artificial Sequence
  chemically synthesized
ttctaaatcacacagctaagaa

SEQ ID NO: 981172 - DNA, 22 bp, Artificial Sequence
  chemically synthesized
taaatcacacagctaagaaatg

SEQ ID NO: 981173 - DNA, 22 bp, Artificial Sequence
  chemically synthesized
aatcacacagctaagaaatgac

SEQ ID NO: 981174 - DNA, 22 bp, Artificial Sequence
  chemically synthesized
gtccgaatcatggttccgtcat

SEQ ID NO: 981175 - DNA, 22 bp, Artificial Sequence
  chemically synthesized
agaaatgacggaaccatgattc

SEQ ID NO: 981176 - DNA, 22 bp, Artificial Sequence
  chemically synthesized
ggacaacgttggtccgaatcat

SEQ ID NO: 981177 - DNA, 22 bp, Artificial Sequence
  chemically synthesized
cggacaacgttggtccgaatca

SEQ ID NO: 981178 - DNA, 22 bp, Artificial Sequence
  chemically synthesized
gcttcggacaacgttggtccga

SEQ ID NO: 981179 - DNA, 22 bp, Artificial Sequence
  chemically synthesized
tagcttcggacaacgttggtcc

SEQ ID NO: 981180 - DNA, 22 bp, Artificial Sequence
  chemically synthesized
aaagcagactctagcttcggac

SEQ ID NO: 981181 - DNA, 22 bp, Artificial Sequence
  chemically synthesized
ggaccaacgttgtccgaagcta

SEQ ID NO: 981182 - DNA, 22 bp, Artificial Sequence
  chemically synthesized
ttgaaagcagactctagcttcg

SEQ ID NO: 981183 - DNA, 22 bp, Artificial Sequence
  chemically synthesized
tccgaagctagagtctgctttc

SEQ ID NO: 981184 - DNA, 22 bp, Artificial Sequence
  chemically synthesized
gagtctgctttcaacagctctg

SEQ ID NO: 981185 - DNA, 22 bp, Artificial Sequence
  chemically synthesized
ggaatgagtcaatacagcagag

SEQ ID NO: 981186 - DNA, 22 bp, Artificial Sequence
  chemically synthesized
cggaatgagtcaatacagcaga

SEQ ID NO: 981187 - DNA, 22 bp, Artificial Sequence
  chemically synthesized
ctttcaacagctctgctgtatt

SEQ ID NO: 981188 - DNA, 22 bp, Artificial Sequence
  chemically synthesized
tcaacagctctgctgtattgac

SEQ ID NO: 981189 - DNA, 22 bp, Artificial Sequence
  chemically synthesized
tcttcggaatgagtcaatacag

SEQ ID NO: 981190 - DNA, 22 bp, Artificial Sequence
  chemically synthesized
caacagctctgctgtattgact

SEQ ID NO: 981191 - DNA, 22 bp, Artificial Sequence
  chemically synthesized
aacagctctgctgtattgactc

SEQ ID NO: 981192 - DNA, 22 bp, Artificial Sequence
  chemically synthesized
accctgtcttcggaatgagtca

SEQ ID NO: 981193 - DNA, 22 bp, Artificial Sequence
  chemically synthesized
tgctgtattgactcattccgaa

SEQ ID NO: 981194 - DNA, 22 bp, Artificial Sequence
  chemically synthesized
ctgtattgactcattccgaaga

SEQ ID NO: 981195 - DNA, 22 bp, Artificial Sequence
  chemically synthesized
agggctaaccctgtcttcggaa

SEQ ID NO: 981196 - DNA, 22 bp, Artificial Sequence
  chemically synthesized
tattgactcattccgaagacag

SEQ ID NO: 981197 - DNA, 22 bp, Artificial Sequence
  chemically synthesized
ctaagggctaaccctgtcttcg

SEQ ID NO: 981198 - DNA, 22 bp, Artificial Sequence
  chemically synthesized
cctaagggctaaccctgtcttc

SEQ ID NO: 981199 - DNA, 22 bp, Artificial Sequence
  chemically synthesized
tcctaagggctaaccctgtctt

SEQ ID NO: 981200 - DNA, 22 bp, Artificial Sequence
  chemically synthesized
actcattccgaagacagggtta

SEQ ID NO: 981201 - DNA, 22 bp, Artificial Sequence
  chemically synthesized
attccgaagacagggttagccc

SEQ ID NO: 981202 - DNA, 22 bp, Artificial Sequence
  chemically synthesized
cgaagacagggttagcccttag

SEQ ID NO: 981203 - DNA, 22 bp, Artificial Sequence
  chemically synthesized
catgtggctttcctaagggcta

SEQ ID NO: 981204 - DNA, 22 bp, Artificial Sequence
  chemically synthesized
gcatgtggctttcctaagggct

SEQ ID NO: 981205 - DNA, 22 bp, Artificial Sequence
  chemically synthesized
tgcatgtggctttcctaagggc

SEQ ID NO: 981206 - DNA, 22 bp, Artificial Sequence
  chemically synthesized
ttgcatgtggctttcctaaggg

SEQ ID NO: 981207 - DNA, 22 bp, Artificial Sequence
  chemically synthesized
ttttgcatgtggctttcctaag

SEQ ID NO: 981208 - DNA, 22 bp, Artificial Sequence
  chemically synthesized
ggtctcttttgcatgtggcttt

SEQ ID NO: 981209 - DNA, 22 bp, Artificial Sequence
  chemically synthesized
gcccttaggaaagccacatgca

SEQ ID NO: 981210 - DNA, 22 bp, Artificial Sequence
  chemically synthesized
aggaaagccacatgcaaaagag

SEQ ID NO: 981211 - DNA, 22 bp, Artificial Sequence
  chemically synthesized
ggaaagccacatgcaaaagaga

SEQ ID NO: 981212 - DNA, 22 bp, Artificial Sequence
  chemically synthesized
aacagtagaaagtaattgggtc

SEQ ID NO: 981213 - DNA, 22 bp, Artificial Sequence
  chemically synthesized
aaacagtagaaagtaattgggt

SEQ ID NO: 981214 - DNA, 22 bp, Artificial Sequence
  chemically synthesized
aggtttaaacagtagaaagtaa

SEQ ID NO: 981215 - DNA, 22 bp, Artificial Sequence
  chemically synthesized
gctcaggtttaaacagtagaaa

SEQ ID NO: 981216 - DNA, 22 bp, Artificial Sequence
  chemically synthesized
cgctcaggtttaaacagtagaa

SEQ ID NO: 981217 - DNA, 22 bp, Artificial Sequence
  chemically synthesized
gtttcgctcaggtttaaacagt

SEQ ID NO: 981218 - DNA, 22 bp, Artificial Sequence
  chemically synthesized
ctttctactgtttaaacctgag

SEQ ID NO: 981219 - DNA, 22 bp, Artificial Sequence
  chemically synthesized
tctactgtttaaacctgagcga

SEQ ID NO: 981220 - DNA, 22 bp, Artificial Sequence
  chemically synthesized
ctactgtttaaacctgagcgaa

SEQ ID NO: 981221 - DNA, 22 bp, Artificial Sequence
  chemically synthesized
tactgtttaaacctgagcgaaa

SEQ ID NO: 981222 - DNA, 22 bp, Artificial Sequence
  chemically synthesized
ctgtttaaacctgagcgaaact

SEQ ID NO: 981223 - DNA, 22 bp, Artificial Sequence
  chemically synthesized
tttaaacctgagcgaaactagg

SEQ ID NO: 981224 - DNA, 22 bp, Artificial Sequence
  chemically synthesized
ggtaaacgtaaccctagtttcg

SEQ ID NO: 981225 - DNA, 22 bp, Artificial Sequence
  chemically synthesized
aaacctgagcgaaactagggtt

SEQ ID NO: 981226 - DNA, 22 bp, Artificial Sequence
  chemically synthesized
aacctgagcgaaactagggtta

SEQ ID NO: 981227 - DNA, 22 bp, Artificial Sequence
  chemically synthesized
gacctaggtaaacgtaacccta

SEQ ID NO: 981228 - DNA, 22 bp, Artificial Sequence
  chemically synthesized
ggacctaggtaaacgtaaccct

SEQ ID NO: 981229 - DNA, 22 bp, Artificial Sequence
  chemically synthesized
tggacctaggtaaacgtaaccc

SEQ ID NO: 981230 - DNA, 22 bp, Artificial Sequence
  chemically synthesized
agcgaaactagggttacgttta

SEQ ID NO: 981231 - DNA, 22 bp, Artificial Sequence
  chemically synthesized
ggactttggacctaggtaaacg

SEQ ID NO: 981232 - DNA, 22 bp, Artificial Sequence
  chemically synthesized
ttaggactttggacctaggtaa

SEQ ID NO: 981233 - DNA, 22 bp, Artificial Sequence
  chemically synthesized
gggttacgtttacctaggtcca

SEQ ID NO: 981234 - DNA, 22 bp, Artificial Sequence
  chemically synthesized
gggtctattaggactttggacc

SEQ ID NO: 981235 - DNA, 22 bp, Artificial Sequence
  chemically synthesized
ggggtctattaggactttggac

SEQ ID NO: 981236 - DNA, 22 bp, Artificial Sequence
  chemically synthesized
cgtttacctaggtccaaagtcc

SEQ ID NO: 981237 - DNA, 22 bp, Artificial Sequence
  chemically synthesized
tggggtctattaggactttgga

SEQ ID NO: 981238 - DNA, 22 bp, Artificial Sequence
  chemically synthesized
acctaggtccaaagtcctaata

SEQ ID NO: 981239 - DNA, 22 bp, Artificial Sequence
  chemically synthesized
ccctttggggtctattaggact

SEQ ID NO: 981240 - DNA, 22 bp, Artificial Sequence
  chemically synthesized
cctaggtccaaagtcctaatag

SEQ ID NO: 981241 - DNA, 22 bp, Artificial Sequence
  chemically synthesized
ggtccaaagtcctaatagaccc

SEQ ID NO: 981242 - DNA, 22 bp, Artificial Sequence
  chemically synthesized
atagaccccaaaggggagctct

SEQ ID NO: 981243 - DNA, 22 bp, Artificial Sequence
  chemically synthesized
acatgtatccaaaaaagagctc

SEQ ID NO: 981244 - DNA, 22 bp, Artificial Sequence
  chemically synthesized
ctgacatgtatccaaaaaagag

SEQ ID NO: 981245 - DNA, 22 bp, Artificial Sequence
  chemically synthesized
acatgttcctgacatgtatcca

SEQ ID NO: 981246 - DNA, 22 bp, Artificial Sequence
  chemically synthesized
aacatgttcctgacatgtatcc

SEQ ID NO: 981247 - DNA, 22 bp, Artificial Sequence
  chemically synthesized
ttttttggatacatgtcaggaa

SEQ ID NO: 981248 - DNA, 22 bp, Artificial Sequence
  chemically synthesized
taccttaacatgttcctgacat

SEQ ID NO: 981249 - DNA, 22 bp, Artificial Sequence
  chemically synthesized
ttttggatacatgtcaggaaca

SEQ ID NO: 981250 - DNA, 22 bp, Artificial Sequence
  chemically synthesized
tttggatacatgtcaggaacat

SEQ ID NO: 981251 - DNA, 22 bp, Artificial Sequence
  chemically synthesized
ttggatacatgtcaggaacatg

SEQ ID NO: 981252 - DNA, 22 bp, Artificial Sequence
  chemically synthesized
tggatacatgtcaggaacatgt

SEQ ID NO: 981253 - DNA, 22 bp, Artificial Sequence
  chemically synthesized
ggatacatgtcaggaacatgtt

SEQ ID NO: 981254 - DNA, 22 bp, Artificial Sequence
  chemically synthesized
gatacatgtcaggaacatgtta

SEQ ID NO: 981255 - DNA, 22 bp, Artificial Sequence
  chemically synthesized
atgaatgaaaagttgtacctta

SEQ ID NO: 981256 - DNA, 22 bp, Artificial Sequence
  chemically synthesized
aattgatgaatgaaaagttgta

SEQ ID NO: 981257 - DNA, 22 bp, Artificial Sequence
  chemically synthesized
ttgaattgatgaatgaaaagtt

SEQ ID NO: 981258 - DNA, 22 bp, Artificial Sequence
  chemically synthesized
attgaattgatgaatgaaaagt

SEQ ID NO: 981259 - DNA, 22 bp, Artificial Sequence
  chemically synthesized
aggtacaacttttcattcatca

SEQ ID NO: 981260 - DNA, 22 bp, Artificial Sequence
  chemically synthesized
aagagaaatttattgaattgat

SEQ ID NO: 981261 - DNA, 22 bp, Artificial Sequence
  chemically synthesized
ttcattcatcaattcaataaat

SEQ ID NO: 981262 - DNA, 22 bp, Artificial Sequence
  chemically synthesized
tcattcatcaattcaataaatt

SEQ ID NO: 981263 - DNA, 22 bp, Artificial Sequence
  chemically synthesized
cattcatcaattcaataaattt

SEQ ID NO: 981264 - DNA, 22 bp, Artificial Sequence
  chemically synthesized
attcatcaattcaataaatttc

SEQ ID NO: 981265 - DNA, 22 bp, Artificial Sequence
  chemically synthesized
atcaattcaataaatttctctt

SEQ ID NO: 981266 - DNA, 22 bp, Artificial Sequence
  chemically synthesized
tacacaacaaatattcaagaga

SEQ ID NO: 981267 - DNA, 22 bp, Artificial Sequence
  chemically synthesized
aataaatttctcttgaatattt

SEQ ID NO: 981268 - DNA, 22 bp, Artificial Sequence
  chemically synthesized
ctcttgaatatttgttgtgtac

SEQ ID NO: 981269 - DNA, 22 bp, Artificial Sequence
  chemically synthesized
tcttgaatatttgttgtgtaca

SEQ ID NO: 981270 - DNA, 22 bp, Artificial Sequence
  chemically synthesized
ttgaatatttgttgtgtacaat

SEQ ID NO: 981271 - DNA, 22 bp, Artificial Sequence
  chemically synthesized
gaatatttgttgtgtacaatta

SEQ ID NO: 981272 - DNA, 22 bp, Artificial Sequence
  chemically synthesized
atagaaccacagtaattgtaca

SEQ ID NO: 981273 - DNA, 22 bp, Artificial Sequence
  chemically synthesized
aatatttgttgtgtacaattac

SEQ ID NO: 981274 - DNA, 22 bp, Artificial Sequence
  chemically synthesized
aattcatagaaccacagtaatt

SEQ ID NO: 981275 - DNA, 22 bp, Artificial Sequence
  chemically synthesized
gttgtgtacaattactgtggtt

SEQ ID NO: 981276 - DNA, 22 bp, Artificial Sequence
  chemically synthesized
ttgtgtacaattactgtggttc

SEQ ID NO: 981277 - DNA, 22 bp, Artificial Sequence
  chemically synthesized
tgtacaattactgtggttctat

SEQ ID NO: 981278 - DNA, 22 bp, Artificial Sequence
  chemically synthesized
accactgaattcatagaaccac

SEQ ID NO: 981279 - DNA, 22 bp, Artificial Sequence
  chemically synthesized
ctcaccactgaattcatagaac

SEQ ID NO: 981280 - DNA, 22 bp, Artificial Sequence
  chemically synthesized
actcaccactgaattcatagaa

SEQ ID NO: 981281 - DNA, 22 bp, Artificial Sequence
  chemically synthesized
cttactcaccactgaattcata

SEQ ID NO: 981282 - DNA, 22 bp, Artificial Sequence
  chemically synthesized
acttactcaccactgaattcat

SEQ ID NO: 981283 - DNA, 22 bp, Artificial Sequence
  chemically synthesized
tacttactcaccactgaattca

SEQ ID NO: 981284 - DNA, 22 bp, Artificial Sequence
  chemically synthesized
ctgtggttctatgaattcagtg

SEQ ID NO: 981285 - DNA, 22 bp, Artificial Sequence
  chemically synthesized
tttacttactcaccactgaatt

SEQ ID NO: 981286 - DNA, 22 bp, Artificial Sequence
  chemically synthesized
tggttctatgaattcagtggtg

SEQ ID NO: 981287 - DNA, 22 bp, Artificial Sequence
  chemically synthesized
ggcattctttacttactcacca

SEQ ID NO: 981288 - DNA, 22 bp, Artificial Sequence
  chemically synthesized
tatgaattcagtggtgagtaag

SEQ ID NO: 981289 - DNA, 22 bp, Artificial Sequence
  chemically synthesized
tgaattcagtggtgagtaagta

SEQ ID NO: 981290 - DNA, 22 bp, Artificial Sequence
  chemically synthesized
gatattgggcattctttactta

SEQ ID NO: 981291 - DNA, 22 bp, Artificial Sequence
  chemically synthesized
agtggtgagtaagtaaagaatg

SEQ ID NO: 981292 - DNA, 22 bp, Artificial Sequence
  chemically synthesized
tgtcacccactagatattgggc

SEQ ID NO: 981293 - DNA, 22 bp, Artificial Sequence
  chemically synthesized
tctgtgtcacccactagatatt

SEQ ID NO: 981294 - DNA, 22 bp, Artificial Sequence
  chemically synthesized
ttatctgtgtcacccactagat

SEQ ID NO: 981295 - DNA, 22 bp, Artificial Sequence
  chemically synthesized
attattatctgtgtcacccact

SEQ ID NO: 981296 - DNA, 22 bp, Artificial Sequence
  chemically synthesized
gattattatctgtgtcacccac

SEQ ID NO: 981297 - DNA, 22 bp, Artificial Sequence
  chemically synthesized
tgtgaggatttgattattatct

SEQ ID NO: 981298 - DNA, 22 bp, Artificial Sequence
  chemically synthesized
gtgggtgacacagataataatc

SEQ ID NO: 981299 - DNA, 22 bp, Artificial Sequence
  chemically synthesized
gtgtgaggatttgattattatc

SEQ ID NO: 981300 - DNA, 22 bp, Artificial Sequence
  chemically synthesized
tttgtgtgaggatttgattatt

SEQ ID NO: 981301 - DNA, 22 bp, Artificial Sequence
  chemically synthesized
catgttatttgtgtgaggattt

SEQ ID NO: 981302 - DNA, 22 bp, Artificial Sequence
  chemically synthesized
taattacatgttatttgtgtga

SEQ ID NO: 981303 - DNA, 22 bp, Artificial Sequence
  chemically synthesized
gtaattacatgttatttgtgtg

SEQ ID NO: 981304 - DNA, 22 bp, Artificial Sequence
  chemically synthesized
agtttgtaattacatgttattt

SEQ ID NO: 981305 - DNA, 22 bp, Artificial Sequence
  chemically synthesized
attcagtttgtaattacatgtt

SEQ ID NO: 981306 - DNA, 22 bp, Artificial Sequence
  chemically synthesized
aattcagtttgtaattacatgt

SEQ ID NO: 981307 - DNA, 22 bp, Artificial Sequence
  chemically synthesized
acacaaataacatgtaattaca

SEQ ID NO: 981308 - DNA, 22 bp, Artificial Sequence
  chemically synthesized
atccttaattcagtttgtaatt

SEQ ID NO: 981309 - DNA, 22 bp, Artificial Sequence
  chemically synthesized
ctcatccttaattcagtttgta

SEQ ID NO: 981310 - DNA, 22 bp, Artificial Sequence
  chemically synthesized
tcctcatccttaattcagtttg

SEQ ID NO: 981311 - DNA, 22 bp, Artificial Sequence
  chemically synthesized
ctctcctcatccttaattcagt

SEQ ID NO: 981312 - DNA, 22 bp, Artificial Sequence
  chemically synthesized
cctctcctcatccttaattcag

SEQ ID NO: 981313 - DNA, 22 bp, Artificial Sequence
  chemically synthesized
tcctctcctcatccttaattca

SEQ ID NO: 981314 - DNA, 22 bp, Artificial Sequence
  chemically synthesized
ttttcctctcctcatccttaat

SEQ ID NO: 981315 - DNA, 22 bp, Artificial Sequence
  chemically synthesized
attttcctctcctcatccttaa

SEQ ID NO: 981316 - DNA, 22 bp, Artificial Sequence
  chemically synthesized
tattttcctctcctcatcctta

SEQ ID NO: 981317 - DNA, 22 bp, Artificial Sequence
  chemically synthesized
caaactgaattaaggatgagga

SEQ ID NO: 981318 - DNA, 22 bp, Artificial Sequence
  chemically synthesized
tttattttcctctcctcatcct

SEQ ID NO: 981319 - DNA, 22 bp, Artificial Sequence
  chemically synthesized
gtgctctttattttcctctcct

SEQ ID NO: 981320 - DNA, 22 bp, Artificial Sequence
  chemically synthesized
aattaaggatgaggagaggaaa

SEQ ID NO: 981321 - DNA, 22 bp, Artificial Sequence
  chemically synthesized
tcctagtgctctttattttcct

SEQ ID NO: 981322 - DNA, 22 bp, Artificial Sequence
  chemically synthesized
aggatgaggagaggaaaataaa

SEQ ID NO: 981323 - DNA, 22 bp, Artificial Sequence
  chemically synthesized
catgctgtcctagtgctcttta

SEQ ID NO: 981324 - DNA, 22 bp, Artificial Sequence
  chemically synthesized
ctgcatgctgtcctagtgctct

SEQ ID NO: 981325 - DNA, 22 bp, Artificial Sequence
  chemically synthesized
gctgcatgctgtcctagtgctc

SEQ ID NO: 981326 - DNA, 22 bp, Artificial Sequence
  chemically synthesized
ttgctgcatgctgtcctagtgc

SEQ ID NO: 981327 - DNA, 22 bp, Artificial Sequence
  chemically synthesized
agtcctcttgctgcatgctgtc

SEQ ID NO: 981328 - DNA, 22 bp, Artificial Sequence
  chemically synthesized
aattaagtcctcttgctgcatg

SEQ ID NO: 981329 - DNA, 22 bp, Artificial Sequence
  chemically synthesized
ggacagcatgcagcaagaggac

SEQ ID NO: 981330 - DNA, 22 bp, Artificial Sequence
  chemically synthesized
cacaaattgaattaagtcctct

SEQ ID NO: 981331 - DNA, 22 bp, Artificial Sequence
  chemically synthesized
gtcaccccctccacaaattgaa

SEQ ID NO: 981332 - DNA, 22 bp, Artificial Sequence
  chemically synthesized
cctggtcaccccctccacaaat

SEQ ID NO: 981333 - DNA, 22 bp, Artificial Sequence
  chemically synthesized
ccctggtcaccccctccacaaa

SEQ ID NO: 981334 - DNA, 22 bp, Artificial Sequence
  chemically synthesized
aattcaatttgtggagggggtg

SEQ ID NO: 981335 - DNA, 22 bp, Artificial Sequence
  chemically synthesized
attcaatttgtggagggggtga

SEQ ID NO: 981336 - DNA, 22 bp, Artificial Sequence
  chemically synthesized
aatttgtggagggggtgaccag

SEQ ID NO: 981337 - DNA, 22 bp, Artificial Sequence
  chemically synthesized
aggaaggtttccctggtcaccc

SEQ ID NO: 981338 - DNA, 22 bp, Artificial Sequence
  chemically synthesized
ctcaggaaggtttccctggtca

SEQ ID NO: 981339 - DNA, 22 bp, Artificial Sequence
  chemically synthesized
gctcaggaaggtttccctggtc

SEQ ID NO: 981340 - DNA, 22 bp, Artificial Sequence
  chemically synthesized
gtggagggggtgaccagggaaa

SEQ ID NO: 981341 - DNA, 22 bp, Artificial Sequence
  chemically synthesized
tggagggggtgaccagggaaac

SEQ ID NO: 981342 - DNA, 22 bp, Artificial Sequence
  chemically synthesized
tcacttgctcaggaaggtttcc

SEQ ID NO: 981343 - DNA, 22 bp, Artificial Sequence
  chemically synthesized
atcggttgtcacttgctcagga

SEQ ID NO: 981344 - DNA, 22 bp, Artificial Sequence
  chemically synthesized
gatcggttgtcacttgctcagg

SEQ ID NO: 981345 - DNA, 22 bp, Artificial Sequence
  chemically synthesized
ccggtcttgatcggttgtcact

SEQ ID NO: 981346 - DNA, 22 bp, Artificial Sequence
  chemically synthesized
accggtcttgatcggttgtcac

SEQ ID NO: 981347 - DNA, 22 bp, Artificial Sequence
  chemically synthesized
cctgagcaagtgacaaccgatc

SEQ ID NO: 981348 - DNA, 22 bp, Artificial Sequence
  chemically synthesized
ctgagcaagtgacaaccgatca

SEQ ID NO: 981349 - DNA, 22 bp, Artificial Sequence
  chemically synthesized
agcaagtgacaaccgatcaaga

SEQ ID NO: 981350 - DNA, 22 bp, Artificial Sequence
  chemically synthesized
cccgtcttaccggtcttgatcg

SEQ ID NO: 981351 - DNA, 22 bp, Artificial Sequence
  chemically synthesized
ctgcccgtcttaccggtcttga

SEQ ID NO: 981352 - DNA, 22 bp, Artificial Sequence
  chemically synthesized
cctgcccgtcttaccggtcttg

SEQ ID NO: 981353 - DNA, 22 bp, Artificial Sequence
  chemically synthesized
tcctgcccgtcttaccggtctt

SEQ ID NO: 981354 - DNA, 22 bp, Artificial Sequence
  chemically synthesized
acgttttcctgcccgtcttacc

SEQ ID NO: 981355 - DNA, 22 bp, Artificial Sequence
  chemically synthesized
cacacactcacgttttcctgcc

SEQ ID NO: 981356 - DNA, 22 bp, Artificial Sequence
  chemically synthesized
cacccactccacacactcacgt

SEQ ID NO: 981357 - DNA, 22 bp, Artificial Sequence
  chemically synthesized
tctccacccactccacacactc

SEQ ID NO: 981358 - DNA, 22 bp, Artificial Sequence
  chemically synthesized
actgtctccacccactccacac

SEQ ID NO: 981359 - DNA, 22 bp, Artificial Sequence
  chemically synthesized
ctcactgtctccacccactcca

SEQ ID NO: 981360 - DNA, 22 bp, Artificial Sequence
  chemically synthesized
tcagggaatctgctcactgtct

SEQ ID NO: 981361 - DNA, 22 bp, Artificial Sequence
  chemically synthesized
gtcagggaatctgctcactgtc

SEQ ID NO: 981362 - DNA, 22 bp, Artificial Sequence
  chemically synthesized
cgtttgtcagggaatctgctca

SEQ ID NO: 981363 - DNA, 22 bp, Artificial Sequence
  chemically synthesized
ttccgtttgtcagggaatctgc

SEQ ID NO: 981364 - DNA, 22 bp, Artificial Sequence
  chemically synthesized
cacgtactattccgtttgtcag

SEQ ID NO: 981365 - DNA, 22 bp, Artificial Sequence
  chemically synthesized
gcacgtactattccgtttgtca

SEQ ID NO: 981366 - DNA, 22 bp, Artificial Sequence
  chemically synthesized
tgcacgtactattccgtttgtc

SEQ ID NO: 981367 - DNA, 22 bp, Artificial Sequence
  chemically synthesized
ctttgcacgtactattccgttt

SEQ ID NO: 981368 - DNA, 22 bp, Artificial Sequence
  chemically synthesized
cctttgcacgtactattccgtt

SEQ ID NO: 981369 - DNA, 22 bp, Artificial Sequence
  chemically synthesized
tcctttgcacgtactattccgt

SEQ ID NO: 981370 - DNA, 22 bp, Artificial Sequence
  chemically synthesized
ttcctttgcacgtactattccg

SEQ ID NO: 981371 - DNA, 22 bp, Artificial Sequence
  chemically synthesized
tttcctttgcacgtactattcc

SEQ ID NO: 981372 - DNA, 22 bp, Artificial Sequence
  chemically synthesized
cctgacaaacggaatagtacgt

SEQ ID NO: 981373 - DNA, 22 bp, Artificial Sequence
  chemically synthesized
tttttcctttgcacgtactatt

SEQ ID NO: 981374 - DNA, 22 bp, Artificial Sequence
  chemically synthesized
acaaacggaatagtacgtgcaa

SEQ ID NO: 981375 - DNA, 22 bp, Artificial Sequence
  chemically synthesized
taatctctttttcctttgcacg

SEQ ID NO: 981376 - DNA, 22 bp, Artificial Sequence
  chemically synthesized
cagtgctgtaatctctttttcc

SEQ ID NO: 981377 - DNA, 22 bp, Artificial Sequence
  chemically synthesized
actacagtgctgtaatctcttt

SEQ ID NO: 981378 - DNA, 22 bp, Artificial Sequence
  chemically synthesized
taactacagtgctgtaatctct

SEQ ID NO: 981379 - DNA, 22 bp, Artificial Sequence
  chemically synthesized
tctaactacagtgctgtaatct

SEQ ID NO: 981380 - DNA, 22 bp, Artificial Sequence
  chemically synthesized
ctctaactacagtgctgtaatc

SEQ ID NO: 981381 - DNA, 22 bp, Artificial Sequence
  chemically synthesized
gatttctctaactacagtgctg

SEQ ID NO: 981382 - DNA, 22 bp, Artificial Sequence
  chemically synthesized
agatttctctaactacagtgct

SEQ ID NO: 981383 - DNA, 22 bp, Artificial Sequence
  chemically synthesized
tagatttctctaactacagtgc

SEQ ID NO: 981384 - DNA, 22 bp, Artificial Sequence
  chemically synthesized
ttagatttctctaactacagtg

SEQ ID NO: 981385 - DNA, 22 bp, Artificial Sequence
  chemically synthesized
tttagatttctctaactacagt

SEQ ID NO: 981386 - DNA, 22 bp, Artificial Sequence
  chemically synthesized
ttttagatttctctaactacag

SEQ ID NO: 981387 - DNA, 22 bp, Artificial Sequence
  chemically synthesized
tttttagatttctctaactaca

SEQ ID NO: 981388 - DNA, 22 bp, Artificial Sequence
  chemically synthesized
ttttttagatttctctaactac

SEQ ID NO: 981389 - DNA, 22 bp, Artificial Sequence
  chemically synthesized
tttttttagatttctctaacta

SEQ ID NO: 981390 - DNA, 22 bp, Artificial Sequence
  chemically synthesized
ttttttttagatttctctaact

SEQ ID NO: 981391 - DNA, 22 bp, Artificial Sequence
  chemically synthesized
tttttttttagatttctctaac

SEQ ID NO: 981392 - DNA, 22 bp, Artificial Sequence
  chemically synthesized
ttttttttttagatttctctaa

SEQ ID NO: 981393 - DNA, 22 bp, Artificial Sequence
  chemically synthesized
cagcactgtagttagagaaatc

SEQ ID NO: 981394 - DNA, 22 bp, Artificial Sequence
  chemically synthesized
tttttttttttagatttctcta

SEQ ID NO: 981395 - DNA, 22 bp, Artificial Sequence
  chemically synthesized
ttttttttttttagatttctct

SEQ ID NO: 981396 - DNA, 22 bp, Artificial Sequence
  chemically synthesized
tttttttttttttttagatttc

SEQ ID NO: 981397 - DNA, 22 bp, Artificial Sequence
  chemically synthesized
gtttttttttttttttagattt

SEQ ID NO: 981398 - DNA, 22 bp, Artificial Sequence
  chemically synthesized
tgtttttttttttttttagatt

SEQ ID NO: 981399 - DNA, 22 bp, Artificial Sequence
  chemically synthesized
tagttagagaaatctaaaaaaa

SEQ ID NO: 981400 - DNA, 22 bp, Artificial Sequence
  chemically synthesized
actttgttttttttttttttta

SEQ ID NO: 981401 - DNA, 22 bp, Artificial Sequence
  chemically synthesized
gagaaatctaaaaaaaaaaaaa

SEQ ID NO: 981402 - DNA, 22 bp, Artificial Sequence
  chemically synthesized
cactaactttgttttttttttt

SEQ ID NO: 981403 - DNA, 22 bp, Artificial Sequence
  chemically synthesized
caactacactaactttgttttt

SEQ ID NO: 981404 - DNA, 22 bp, Artificial Sequence
  chemically synthesized
aaaaaaaaaaaaaacaaagtta

SEQ ID NO: 981405 - DNA, 22 bp, Artificial Sequence
  chemically synthesized
tactccaactacactaactttg

SEQ ID NO: 981406 - DNA, 22 bp, Artificial Sequence
  chemically synthesized
tgtactccaactacactaactt

SEQ ID NO: 981407 - DNA, 22 bp, Artificial Sequence
  chemically synthesized
tctgtactccaactacactaac

SEQ ID NO: 981408 - DNA, 22 bp, Artificial Sequence
  chemically synthesized
attctctgtactccaactacac

SEQ ID NO: 981409 - DNA, 22 bp, Artificial Sequence
  chemically synthesized
ctcattctctgtactccaacta

SEQ ID NO: 981410 - DNA, 22 bp, Artificial Sequence
  chemically synthesized
atctgctcattctctgtactcc

SEQ ID NO: 981411 - DNA, 22 bp, Artificial Sequence
  chemically synthesized
tcatctgctcattctctgtact

SEQ ID NO: 981412 - DNA, 22 bp, Artificial Sequence
  chemically synthesized
gtgtagttggagtacagagaat

SEQ ID NO: 981413 - DNA, 22 bp, Artificial Sequence
  chemically synthesized
tccctctcatctgctcattctc

SEQ ID NO: 981414 - DNA, 22 bp, Artificial Sequence
  chemically synthesized
ctatccctctcatctgctcatt

SEQ ID NO: 981415 - DNA, 22 bp, Artificial Sequence
  chemically synthesized
actatccctctcatctgctcat

SEQ ID NO: 981416 - DNA, 22 bp, Artificial Sequence
  chemically synthesized
gagtacagagaatgagcagatg

SEQ ID NO: 981417 - DNA, 22 bp, Artificial Sequence
  chemically synthesized
tactatccctctcatctgctca

SEQ ID NO: 981418 - DNA, 22 bp, Artificial Sequence
  chemically synthesized
ttactatccctctcatctgctc

SEQ ID NO: 981419 - DNA, 22 bp, Artificial Sequence
  chemically synthesized
tttactatccctctcatctgct

SEQ ID NO: 981420 - DNA, 22 bp, Artificial Sequence
  chemically synthesized
gcagtattttttactatccctc

SEQ ID NO: 981421 - DNA, 22 bp, Artificial Sequence
  chemically synthesized
tgttggcagtattttttactat

SEQ ID NO: 981422 - DNA, 22 bp, Artificial Sequence
  chemically synthesized
ctatgttggcagtattttttac

SEQ ID NO: 981423 - DNA, 22 bp, Artificial Sequence
  chemically synthesized
gctatgttggcagtatttttta

SEQ ID NO: 981424 - DNA, 22 bp, Artificial Sequence
  chemically synthesized
tgctatgttggcagtatttttt

SEQ ID NO: 981425 - DNA, 22 bp, Artificial Sequence
  chemically synthesized
tcctttgctatgttggcagtat

SEQ ID NO: 981426 - DNA, 22 bp, Artificial Sequence
  chemically synthesized
catagtctgtcctttgctatgt

SEQ ID NO: 981427 - DNA, 22 bp, Artificial Sequence
  chemically synthesized
gcatagtctgtcctttgctatg

SEQ ID NO: 981428 - DNA, 22 bp, Artificial Sequence
  chemically synthesized
tgcatagtctgtcctttgctat

SEQ ID NO: 981429 - DNA, 22 bp, Artificial Sequence
  chemically synthesized
ccaacatagcaaaggacagact

SEQ ID NO: 981430 - DNA, 22 bp, Artificial Sequence
  chemically synthesized
aaatggtgtgcaaagctttgca

SEQ ID NO: 981431 - DNA, 22 bp, Artificial Sequence
  chemically synthesized
aaaatggtgtgcaaagctttgc

SEQ ID NO: 981432 - DNA, 22 bp, Artificial Sequence
  chemically synthesized
gccttaaaatggtgtgcaaagc

SEQ ID NO: 981433 - DNA, 22 bp, Artificial Sequence
  chemically synthesized
agccttaaaatggtgtgcaaag

SEQ ID NO: 981434 - DNA, 22 bp, Artificial Sequence
  chemically synthesized
tagccttaaaatggtgtgcaaa

SEQ ID NO: 981435 - DNA, 22 bp, Artificial Sequence
  chemically synthesized
tgcaaagctttgcacaccattt

SEQ ID NO: 981436 - DNA, 22 bp, Artificial Sequence
  chemically synthesized
attttagccttaaaatggtgtg

SEQ ID NO: 981437 - DNA, 22 bp, Artificial Sequence
  chemically synthesized
acattaattttagccttaaaat

SEQ ID NO: 981438 - DNA, 22 bp, Artificial Sequence
  chemically synthesized
tgcacaccattttaaggctaaa

SEQ ID NO: 981439 - DNA, 22 bp, Artificial Sequence
  chemically synthesized
gcacaccattttaaggctaaaa

SEQ ID NO: 981440 - DNA, 22 bp, Artificial Sequence
  chemically synthesized
cacaccattttaaggctaaaat

SEQ ID NO: 981441 - DNA, 22 bp, Artificial Sequence
  chemically synthesized
aaaaggttcacattaattttag

SEQ ID NO: 981442 - DNA, 22 bp, Artificial Sequence
  chemically synthesized
caaaaggttcacattaatttta

SEQ ID NO: 981443 - DNA, 22 bp, Artificial Sequence
  chemically synthesized
cttcaaaaggttcacattaatt

SEQ ID NO: 981444 - DNA, 22 bp, Artificial Sequence
  chemically synthesized
tccttcaaaaggttcacattaa

SEQ ID NO: 981445 - DNA, 22 bp, Artificial Sequence
  chemically synthesized
taaggctaaaattaatgtgaac

SEQ ID NO: 981446 - DNA, 22 bp, Artificial Sequence
  chemically synthesized
ctccttcaaaaggttcacatta

SEQ ID NO: 981447 - DNA, 22 bp, Artificial Sequence
  chemically synthesized
aaggctaaaattaatgtgaacc

SEQ ID NO: 981448 - DNA, 22 bp, Artificial Sequence
  chemically synthesized
aggctaaaattaatgtgaacct

SEQ ID NO: 981449 - DNA, 22 bp, Artificial Sequence
  chemically synthesized
gatttctccttcaaaaggttca

SEQ ID NO: 981450 - DNA, 22 bp, Artificial Sequence
  chemically synthesized
aaattaatgtgaaccttttgaa

SEQ ID NO: 981451 - DNA, 22 bp, Artificial Sequence
  chemically synthesized
gctagatttctccttcaaaagg

SEQ ID NO: 981452 - DNA, 22 bp, Artificial Sequence
  chemically synthesized
ggctagatttctccttcaaaag

SEQ ID NO: 981453 - DNA, 22 bp, Artificial Sequence
  chemically synthesized
atgtgaaccttttgaaggagaa

SEQ ID NO: 981454 - DNA, 22 bp, Artificial Sequence
  chemically synthesized
gccttggctagatttctccttc

SEQ ID NO: 981455 - DNA, 22 bp, Artificial Sequence
  chemically synthesized
ttgaaggagaaatctagccaag

SEQ ID NO: 981456 - DNA, 22 bp, Artificial Sequence
  chemically synthesized
tgaaggagaaatctagccaagg

SEQ ID NO: 981457 - DNA, 22 bp, Artificial Sequence
  chemically synthesized
gaaggagaaatctagccaaggc

SEQ ID NO: 981458 - DNA, 22 bp, Artificial Sequence
  chemically synthesized
aaggagaaatctagccaaggct

SEQ ID NO: 981459 - DNA, 22 bp, Artificial Sequence
  chemically synthesized
ataaatataaatctagccttgg

SEQ ID NO: 981460 - DNA, 22 bp, Artificial Sequence
  chemically synthesized
aataaatataaatctagccttg

SEQ ID NO: 981461 - DNA, 22 bp, Artificial Sequence
  chemically synthesized
gccaaggctagatttatattta

SEQ ID NO: 981462 - DNA, 22 bp, Artificial Sequence
  chemically synthesized
cagatagtgtgatatttaataa

SEQ ID NO: 981463 - DNA, 22 bp, Artificial Sequence
  chemically synthesized
gatttatatttattaaatatca

SEQ ID NO: 981464 - DNA, 22 bp, Artificial Sequence
  chemically synthesized
cctacagatagtgtgatattta

SEQ ID NO: 981465 - DNA, 22 bp, Artificial Sequence
  chemically synthesized
tgcctacagatagtgtgatatt

SEQ ID NO: 981466 - DNA, 22 bp, Artificial Sequence
  chemically synthesized
atatttattaaatatcacacta

SEQ ID NO: 981467 - DNA, 22 bp, Artificial Sequence
  chemically synthesized
tatttattaaatatcacactat

SEQ ID NO: 981468 - DNA, 22 bp, Artificial Sequence
  chemically synthesized
ttctgcctacagatagtgtgat

SEQ ID NO: 981469 - DNA, 22 bp, Artificial Sequence
  chemically synthesized
attaaatatcacactatctgta

SEQ ID NO: 981470 - DNA, 22 bp, Artificial Sequence
  chemically synthesized
ttaaatatcacactatctgtag

SEQ ID NO: 981471 - DNA, 22 bp, Artificial Sequence
  chemically synthesized
aatatcacactatctgtaggca

SEQ ID NO: 981472 - DNA, 22 bp, Artificial Sequence
  chemically synthesized
cccaccagactgttctgcctac

SEQ ID NO: 981473 - DNA, 22 bp, Artificial Sequence
  chemically synthesized
tctgtaggcagaacagtctggt

SEQ ID NO: 981474 - DNA, 22 bp, Artificial Sequence
  chemically synthesized
taggcagaacagtctggtgggt

SEQ ID NO: 981475 - DNA, 22 bp, Artificial Sequence
  chemically synthesized
acacagtaacccccctacccac

SEQ ID NO: 981476 - DNA, 22 bp, Artificial Sequence
  chemically synthesized
gaattaacacagtaacccccct

SEQ ID NO: 981477 - DNA, 22 bp, Artificial Sequence
  chemically synthesized
attggaattaacacagtaaccc

SEQ ID NO: 981478 - DNA, 22 bp, Artificial Sequence
  chemically synthesized
gtgggtaggggggttactgtgt

SEQ ID NO: 981479 - DNA, 22 bp, Artificial Sequence
  chemically synthesized
tcattggaattaacacagtaac

SEQ ID NO: 981480 - DNA, 22 bp, Artificial Sequence
  chemically synthesized
ccatcgtctctcattggaatta

SEQ ID NO: 981481 - DNA, 22 bp, Artificial Sequence
  chemically synthesized
ctgtgttaattccaatgagaga

SEQ ID NO: 981482 - DNA, 22 bp, Artificial Sequence
  chemically synthesized
tgttaattccaatgagagacga

SEQ ID NO: 981483 - DNA, 22 bp, Artificial Sequence
  chemically synthesized
gtgcaagctaccatcgtctctc

SEQ ID NO: 981484 - DNA, 22 bp, Artificial Sequence
  chemically synthesized
attccaatgagagacgatggta

SEQ ID NO: 981485 - DNA, 22 bp, Artificial Sequence
  chemically synthesized
caatgagagacgatggtagctt

SEQ ID NO: 981486 - DNA, 22 bp, Artificial Sequence
  chemically synthesized
gtatcctagtgcaagctaccat

SEQ ID NO: 981487 - DNA, 22 bp, Artificial Sequence
  chemically synthesized
tgcccattagtatcctagtgca

SEQ ID NO: 981488 - DNA, 22 bp, Artificial Sequence
  chemically synthesized
atgcccattagtatcctagtgc

SEQ ID NO: 981489 - DNA, 22 bp, Artificial Sequence
  chemically synthesized
tatgcccattagtatcctagtg

SEQ ID NO: 981490 - DNA, 22 bp, Artificial Sequence
  chemically synthesized
tttatgcccattagtatcctag

SEQ ID NO: 981491 - DNA, 22 bp, Artificial Sequence
  chemically synthesized
ctttatgcccattagtatccta

SEQ ID NO: 981492 - DNA, 22 bp, Artificial Sequence
  chemically synthesized
tctttatgcccattagtatcct

SEQ ID NO: 981493 - DNA, 22 bp, Artificial Sequence
  chemically synthesized
ttctttatgcccattagtatcc

SEQ ID NO: 981494 - DNA, 22 bp, Artificial Sequence
  chemically synthesized
gcactaggatactaatgggcat

SEQ ID NO: 981495 - DNA, 22 bp, Artificial Sequence
  chemically synthesized
cagtttttctttatgcccatta

SEQ ID NO: 981496 - DNA, 22 bp, Artificial Sequence
  chemically synthesized
cactaggatactaatgggcata

SEQ ID NO: 981497 - DNA, 22 bp, Artificial Sequence
  chemically synthesized
tacagtttttctttatgcccat

SEQ ID NO: 981498 - DNA, 22 bp, Artificial Sequence
  chemically synthesized
ggatactaatgggcataaagaa

SEQ ID NO: 981499 - DNA, 22 bp, Artificial Sequence
  chemically synthesized
aatatctctacagtttttcttt

SEQ ID NO: 981500 - DNA, 22 bp, Artificial Sequence
  chemically synthesized
tcaatatctctacagtttttct

SEQ ID NO: 981501 - DNA, 22 bp, Artificial Sequence
  chemically synthesized
ctcaatatctctacagtttttc

SEQ ID NO: 981502 - DNA, 22 bp, Artificial Sequence
  chemically synthesized
atgggcataaagaaaaactgta

SEQ ID NO: 981503 - DNA, 22 bp, Artificial Sequence
  chemically synthesized
accttctcaatatctctacagt

SEQ ID NO: 981504 - DNA, 22 bp, Artificial Sequence
  chemically synthesized
aaccttctcaatatctctacag

SEQ ID NO: 981505 - DNA, 22 bp, Artificial Sequence
  chemically synthesized
atttaaccttctcaatatctct

SEQ ID NO: 981506 - DNA, 22 bp, Artificial Sequence
  chemically synthesized
ctgatttaaccttctcaatatc

SEQ ID NO: 981507 - DNA, 22 bp, Artificial Sequence
  chemically synthesized
gtcctactgatttaaccttctc

SEQ ID NO: 981508 - DNA, 22 bp, Artificial Sequence
  chemically synthesized
tagagatattgagaaggttaaa

SEQ ID NO: 981509 - DNA, 22 bp, Artificial Sequence
  chemically synthesized
tcacctggtcctactgatttaa

SEQ ID NO: 981510 - DNA, 22 bp, Artificial Sequence
  chemically synthesized
agaaggttaaatcagtaggacc

SEQ ID NO: 981511 - DNA, 22 bp, Artificial Sequence
  chemically synthesized
aatctgtcacctggtcctactg

SEQ ID NO: 981512 - DNA, 22 bp, Artificial Sequence
  chemically synthesized
ttaaatctgtcacctggtccta

SEQ ID NO: 981513 - DNA, 22 bp, Artificial Sequence
  chemically synthesized
aatcagtaggaccaggtgacag

SEQ ID NO: 981514 - DNA, 22 bp, Artificial Sequence
  chemically synthesized
ccattattaaatctgtcacctg

SEQ ID NO: 981515 - DNA, 22 bp, Artificial Sequence
  chemically synthesized
tccgtcaactaccattattaaa

SEQ ID NO: 981516 - DNA, 22 bp, Artificial Sequence
  chemically synthesized
actgtccgtcaactaccattat

SEQ ID NO: 981517 - DNA, 22 bp, Artificial Sequence
  chemically synthesized
ctcactgtccgtcaactaccat

SEQ ID NO: 981518 - DNA, 22 bp, Artificial Sequence
  chemically synthesized
cctcactgtccgtcaactacca

SEQ ID NO: 981519 - DNA, 22 bp, Artificial Sequence
  chemically synthesized
ttcctcactgtccgtcaactac

SEQ ID NO: 981520 - DNA, 22 bp, Artificial Sequence
  chemically synthesized
actcttcctcactgtccgtcaa

SEQ ID NO: 981521 - DNA, 22 bp, Artificial Sequence
  chemically synthesized
aataatggtagttgacggacag

SEQ ID NO: 981522 - DNA, 22 bp, Artificial Sequence
  chemically synthesized
ataatggtagttgacggacagt

SEQ ID NO: 981523 - DNA, 22 bp, Artificial Sequence
  chemically synthesized
ctcactcttcctcactgtccgt

SEQ ID NO: 981524 - DNA, 22 bp, Artificial Sequence
  chemically synthesized
cctcactcttcctcactgtccg

SEQ ID NO: 981525 - DNA, 22 bp, Artificial Sequence
  chemically synthesized
tcctcactcttcctcactgtcc

SEQ ID NO: 981526 - DNA, 22 bp, Artificial Sequence
  chemically synthesized
ttcctcactcttcctcactgtc

SEQ ID NO: 981527 - DNA, 22 bp, Artificial Sequence
  chemically synthesized
tttcctcactcttcctcactgt

SEQ ID NO: 981528 - DNA, 22 bp, Artificial Sequence
  chemically synthesized
ttttcctcactcttcctcactg

SEQ ID NO: 981529 - DNA, 22 bp, Artificial Sequence
  chemically synthesized
tttttcctcactcttcctcact

SEQ ID NO: 981530 - DNA, 22 bp, Artificial Sequence
  chemically synthesized
gattttttttcctcactcttcc

SEQ ID NO: 981531 - DNA, 22 bp, Artificial Sequence
  chemically synthesized
acggacagtgaggaagagtgag

SEQ ID NO: 981532 - DNA, 22 bp, Artificial Sequence
  chemically synthesized
agcaagccaaaagtctggattt

SEQ ID NO: 981533 - DNA, 22 bp, Artificial Sequence
  chemically synthesized
tccagttaagcaagccaaaagt

SEQ ID NO: 981534 - DNA, 22 bp, Artificial Sequence
  chemically synthesized
ttggcttgcttaactggatagt

SEQ ID NO: 981535 - DNA, 22 bp, Artificial Sequence
  chemically synthesized
tggcttgcttaactggatagtg

SEQ ID NO: 981536 - DNA, 22 bp, Artificial Sequence
  chemically synthesized
ggcttgcttaactggatagtgt

SEQ ID NO: 981537 - DNA, 22 bp, Artificial Sequence
  chemically synthesized
gcttgcttaactggatagtgtc

SEQ ID NO: 981538 - DNA, 22 bp, Artificial Sequence
  chemically synthesized
catcccagtgaatgacactatc

SEQ ID NO: 981539 - DNA, 22 bp, Artificial Sequence
  chemically synthesized
gcttaactggatagtgtcattc

SEQ ID NO: 981540 - DNA, 22 bp, Artificial Sequence
  chemically synthesized
ctccatcccagtgaatgacact

SEQ ID NO: 981541 - DNA, 22 bp, Artificial Sequence
  chemically synthesized
cttaactggatagtgtcattca

SEQ ID NO: 981542 - DNA, 22 bp, Artificial Sequence
  chemically synthesized
aactggatagtgtcattcactg

SEQ ID NO: 981543 - DNA, 22 bp, Artificial Sequence
  chemically synthesized
actggatagtgtcattcactgg

SEQ ID NO: 981544 - DNA, 22 bp, Artificial Sequence
  chemically synthesized
gatagtgtcattcactgggatg

SEQ ID NO: 981545 - DNA, 22 bp, Artificial Sequence
  chemically synthesized
actgggatggaggaacctggat

SEQ ID NO: 981546 - DNA, 22 bp, Artificial Sequence
  chemically synthesized
aaacccgatacacatccaggtt

SEQ ID NO: 981547 - DNA, 22 bp, Artificial Sequence
  chemically synthesized
caaacccgatacacatccaggt

SEQ ID NO: 981548 - DNA, 22 bp, Artificial Sequence
  chemically synthesized
ggatggaggaacctggatgtgt

SEQ ID NO: 981549 - DNA, 22 bp, Artificial Sequence
  chemically synthesized
tccttcaaacccgatacacatc

SEQ ID NO: 981550 - DNA, 22 bp, Artificial Sequence
  chemically synthesized
gtccttcaaacccgatacacat

SEQ ID NO: 981551 - DNA, 22 bp, Artificial Sequence
  chemically synthesized
gaccttgtccttcaaacccgat

SEQ ID NO: 981552 - DNA, 22 bp, Artificial Sequence
  chemically synthesized
gatgtgtatcgggtttgaagga

SEQ ID NO: 981553 - DNA, 22 bp, Artificial Sequence
  chemically synthesized
aatgttcgaccttgtccttcaa

SEQ ID NO: 981554 - DNA, 22 bp, Artificial Sequence
  chemically synthesized
gaaggacaaggtcgaacattca

SEQ ID NO: 981555 - DNA, 22 bp, Artificial Sequence
  chemically synthesized
aaggacaaggtcgaacattcag

SEQ ID NO: 981556 - DNA, 22 bp, Artificial Sequence
  chemically synthesized
aacaaggaccaaactgaatgtt

SEQ ID NO: 981557 - DNA, 22 bp, Artificial Sequence
  chemically synthesized
agactcaacaaggaccaaactg

SEQ ID NO: 981558 - DNA, 22 bp, Artificial Sequence
  chemically synthesized
agtttggtccttgttgagtctg

SEQ ID NO: 981559 - DNA, 22 bp, Artificial Sequence
  chemically synthesized
ggtccttgttgagtctgagttg

SEQ ID NO: 981560 - DNA, 22 bp, Artificial Sequence
  chemically synthesized
gtccttgttgagtctgagttgc

SEQ ID NO: 981561 - DNA, 22 bp, Artificial Sequence
  chemically synthesized
aatgtatcagaggcaactcaga

SEQ ID NO: 981562 - DNA, 22 bp, Artificial Sequence
  chemically synthesized
aaatgtatcagaggcaactcag

SEQ ID NO: 981563 - DNA, 22 bp, Artificial Sequence
  chemically synthesized
gttgagtctgagttgcctctga

SEQ ID NO: 981564 - DNA, 22 bp, Artificial Sequence
  chemically synthesized
cacttaaatgtatcagaggcaa

SEQ ID NO: 981565 - DNA, 22 bp, Artificial Sequence
  chemically synthesized
ttgagtctgagttgcctctgat

SEQ ID NO: 981566 - DNA, 22 bp, Artificial Sequence
  chemically synthesized
agtctgagttgcctctgataca

SEQ ID NO: 981567 - DNA, 22 bp, Artificial Sequence
  chemically synthesized
acatctccacttaaatgtatca

SEQ ID NO: 981568 - DNA, 22 bp, Artificial Sequence
  chemically synthesized
agttgcctctgatacatttaag

SEQ ID NO: 981569 - DNA, 22 bp, Artificial Sequence
  chemically synthesized
attgacatctccacttaaatgt

SEQ ID NO: 981570 - DNA, 22 bp, Artificial Sequence
  chemically synthesized
cctctgatacatttaagtggag

SEQ ID NO: 981571 - DNA, 22 bp, Artificial Sequence
  chemically synthesized
cctaattgacatctccacttaa

SEQ ID NO: 981572 - DNA, 22 bp, Artificial Sequence
  chemically synthesized
tgatacatttaagtggagatgt

SEQ ID NO: 981573 - DNA, 22 bp, Artificial Sequence
  chemically synthesized
atacatttaagtggagatgtca

SEQ ID NO: 981574 - DNA, 22 bp, Artificial Sequence
  chemically synthesized
aagtggagatgtcaattaggca

SEQ ID NO: 981575 - DNA, 22 bp, Artificial Sequence
  chemically synthesized
agtggagatgtcaattaggcag

SEQ ID NO: 981576 - DNA, 22 bp, Artificial Sequence
  chemically synthesized
tatacatacccccctgcctaat

SEQ ID NO: 981577 - DNA, 22 bp, Artificial Sequence
  chemically synthesized
atatacatacccccctgcctaa

SEQ ID NO: 981578 - DNA, 22 bp, Artificial Sequence
  chemically synthesized
gtcttatatacatacccccctg

SEQ ID NO: 981579 - DNA, 22 bp, Artificial Sequence
  chemically synthesized
aatgctagtcttatatacatac

SEQ ID NO: 981580 - DNA, 22 bp, Artificial Sequence
  chemically synthesized
gaatgctagtcttatatacata

SEQ ID NO: 981581 - DNA, 22 bp, Artificial Sequence
  chemically synthesized
ggcaggggggtatgtatataag

SEQ ID NO: 981582 - DNA, 22 bp, Artificial Sequence
  chemically synthesized
atttgaatgctagtcttatata

SEQ ID NO: 981583 - DNA, 22 bp, Artificial Sequence
  chemically synthesized
tcatttgaatgctagtcttata

SEQ ID NO: 981584 - DNA, 22 bp, Artificial Sequence
  chemically synthesized
aaactctcatttgaatgctagt

SEQ ID NO: 981585 - DNA, 22 bp, Artificial Sequence
  chemically synthesized
cagccctgaaactctcatttga

SEQ ID NO: 981586 - DNA, 22 bp, Artificial Sequence
  chemically synthesized
catctccagccctgaaactctc

SEQ ID NO: 981587 - DNA, 22 bp, Artificial Sequence
  chemically synthesized
acatctccagccctgaaactct

SEQ ID NO: 981588 - DNA, 22 bp, Artificial Sequence
  chemically synthesized
gcattcaaatgagagtttcagg

SEQ ID NO: 981589 - DNA, 22 bp, Artificial Sequence
  chemically synthesized
atatttacatctccagccctga

SEQ ID NO: 981590 - DNA, 22 bp, Artificial Sequence
  chemically synthesized
aaatgagagtttcagggctgga

SEQ ID NO: 981591 - DNA, 22 bp, Artificial Sequence
  chemically synthesized
taatatttacatctccagccct

SEQ ID NO: 981592 - DNA, 22 bp, Artificial Sequence
  chemically synthesized
ctaatatttacatctccagccc

SEQ ID NO: 981593 - DNA, 22 bp, Artificial Sequence
  chemically synthesized
caaagcttctaatatttacatc

SEQ ID NO: 981594 - DNA, 22 bp, Artificial Sequence
  chemically synthesized
cagggctggagatgtaaatatt

SEQ ID NO: 981595 - DNA, 22 bp, Artificial Sequence
  chemically synthesized
tgcaaagcttctaatatttaca

SEQ ID NO: 981596 - DNA, 22 bp, Artificial Sequence
  chemically synthesized
agggctggagatgtaaatatta

SEQ ID NO: 981597 - DNA, 22 bp, Artificial Sequence
  chemically synthesized
ctgcaaagcttctaatatttac

SEQ ID NO: 981598 - DNA, 22 bp, Artificial Sequence
  chemically synthesized
atgtttctgcaaagcttctaat

SEQ ID NO: 981599 - DNA, 22 bp, Artificial Sequence
  chemically synthesized
gagatgtaaatattagaagctt

SEQ ID NO: 981600 - DNA, 22 bp, Artificial Sequence
  chemically synthesized
actaatgtttctgcaaagcttc

SEQ ID NO: 981601 - DNA, 22 bp, Artificial Sequence
  chemically synthesized
acctaactaatgtttctgcaaa

SEQ ID NO: 981602 - DNA, 22 bp, Artificial Sequence
  chemically synthesized
aacctaactaatgtttctgcaa

SEQ ID NO: 981603 - DNA, 22 bp, Artificial Sequence
  chemically synthesized
atttaacctaactaatgtttct

SEQ ID NO: 981604 - DNA, 22 bp, Artificial Sequence
  chemically synthesized
gaagctttgcagaaacattagt

SEQ ID NO: 981605 - DNA, 22 bp, Artificial Sequence
  chemically synthesized
ctgatttaacctaactaatgtt

SEQ ID NO: 981606 - DNA, 22 bp, Artificial Sequence
  chemically synthesized
tgttcctgatttaacctaacta

SEQ ID NO: 981607 - DNA, 22 bp, Artificial Sequence
  chemically synthesized
tgcagaaacattagttaggtta

SEQ ID NO: 981608 - DNA, 22 bp, Artificial Sequence
  chemically synthesized
gcagaaacattagttaggttaa

SEQ ID NO: 981609 - DNA, 22 bp, Artificial Sequence
  chemically synthesized
cagaaacattagttaggttaaa

SEQ ID NO: 981610 - DNA, 22 bp, Artificial Sequence
  chemically synthesized
tctatgttcctgatttaaccta

SEQ ID NO: 981611 - DNA, 22 bp, Artificial Sequence
  chemically synthesized
atctatgttcctgatttaacct

SEQ ID NO: 981612 - DNA, 22 bp, Artificial Sequence
  chemically synthesized
gttaggttaaatcaggaacata

SEQ ID NO: 981613 - DNA, 22 bp, Artificial Sequence
  chemically synthesized
ggtaatcttatctatgttcctg

SEQ ID NO: 981614 - DNA, 22 bp, Artificial Sequence
  chemically synthesized
ggttaaatcaggaacatagata

SEQ ID NO: 981615 - DNA, 22 bp, Artificial Sequence
  chemically synthesized
tccctaggtaatcttatctatg

SEQ ID NO: 981616 - DNA, 22 bp, Artificial Sequence
  chemically synthesized
tgtccctaggtaatcttatcta

SEQ ID NO: 981617 - DNA, 22 bp, Artificial Sequence
  chemically synthesized
aatcaggaacatagataagatt

SEQ ID NO: 981618 - DNA, 22 bp, Artificial Sequence
  chemically synthesized
ctgtccctaggtaatcttatct

SEQ ID NO: 981619 - DNA, 22 bp, Artificial Sequence
  chemically synthesized
tcttctgtccctaggtaatctt

SEQ ID NO: 981620 - DNA, 22 bp, Artificial Sequence
  chemically synthesized
gtcttctgtccctaggtaatct

SEQ ID NO: 981621 - DNA, 22 bp, Artificial Sequence
  chemically synthesized
tgtcttctgtccctaggtaatc

SEQ ID NO: 981622 - DNA, 22 bp, Artificial Sequence
  chemically synthesized
actttgtcttctgtccctaggt

SEQ ID NO: 981623 - DNA, 22 bp, Artificial Sequence
  chemically synthesized
cactttgtcttctgtccctagg

SEQ ID NO: 981624 - DNA, 22 bp, Artificial Sequence
  chemically synthesized
ttcactttgtcttctgtcccta

SEQ ID NO: 981625 - DNA, 22 bp, Artificial Sequence
  chemically synthesized
cttcactttgtcttctgtccct

SEQ ID NO: 981626 - DNA, 22 bp, Artificial Sequence
  chemically synthesized
atttcttcactttgtcttctgt

SEQ ID NO: 981627 - DNA, 22 bp, Artificial Sequence
  chemically synthesized
catttcttcactttgtcttctg

SEQ ID NO: 981628 - DNA, 22 bp, Artificial Sequence
  chemically synthesized
tcatttcttcactttgtcttct

SEQ ID NO: 981629 - DNA, 22 bp, Artificial Sequence
  chemically synthesized
cctagggacagaagacaaagtg

SEQ ID NO: 981630 - DNA, 22 bp, Artificial Sequence
  chemically synthesized
ctttcatttcttcactttgtct

SEQ ID NO: 981631 - DNA, 22 bp, Artificial Sequence
  chemically synthesized
gggacagaagacaaagtgaaga

SEQ ID NO: 981632 - DNA, 22 bp, Artificial Sequence
  chemically synthesized
caaagaaggaatgatatctcct

SEQ ID NO: 981633 - DNA, 22 bp, Artificial Sequence
  chemically synthesized
cacaaggttccaaagaaggaat

SEQ ID NO: 981634 - DNA, 22 bp, Artificial Sequence
  chemically synthesized
actacacaaggttccaaagaag

SEQ ID NO: 981635 - DNA, 22 bp, Artificial Sequence
  chemically synthesized
attcactacacaaggttccaaa

SEQ ID NO: 981636 - DNA, 22 bp, Artificial Sequence
  chemically synthesized
tgattcactacacaaggttcca

SEQ ID NO: 981637 - DNA, 22 bp, Artificial Sequence
  chemically synthesized
attctgattcactacacaaggt

SEQ ID NO: 981638 - DNA, 22 bp, Artificial Sequence
  chemically synthesized
gattctgattcactacacaagg

SEQ ID NO: 981639 - DNA, 22 bp, Artificial Sequence
  chemically synthesized
cttctttggaaccttgtgtagt

SEQ ID NO: 981640 - DNA, 22 bp, Artificial Sequence
  chemically synthesized
ctttggaaccttgtgtagtgaa

SEQ ID NO: 981641 - DNA, 22 bp, Artificial Sequence
  chemically synthesized
tttggaaccttgtgtagtgaat

SEQ ID NO: 981642 - DNA, 22 bp, Artificial Sequence
  chemically synthesized
tggaaccttgtgtagtgaatca

SEQ ID NO: 981643 - DNA, 22 bp, Artificial Sequence
  chemically synthesized
ggaaccttgtgtagtgaatcag

SEQ ID NO: 981644 - DNA, 22 bp, Artificial Sequence
  chemically synthesized
gaaccttgtgtagtgaatcaga

SEQ ID NO: 981645 - DNA, 22 bp, Artificial Sequence
  chemically synthesized
aacagggtttgattctgattca

SEQ ID NO: 981646 - DNA, 22 bp, Artificial Sequence
  chemically synthesized
gtgtagtgaatcagaatcaaac

SEQ ID NO: 981647 - DNA, 22 bp, Artificial Sequence
  chemically synthesized
aaattaaacagggtttgattct

SEQ ID NO: 981648 - DNA, 22 bp, Artificial Sequence
  chemically synthesized
tgtagtgaatcagaatcaaacc

SEQ ID NO: 981649 - DNA, 22 bp, Artificial Sequence
  chemically synthesized
aaaattaaacagggtttgattc

SEQ ID NO: 981650 - DNA, 22 bp, Artificial Sequence
  chemically synthesized
taatttaaaattaaacagggtt

SEQ ID NO: 981651 - DNA, 22 bp, Artificial Sequence
  chemically synthesized
gtaatttaaaattaaacagggt

SEQ ID NO: 981652 - DNA, 22 bp, Artificial Sequence
  chemically synthesized
tgtaatttaaaattaaacaggg

SEQ ID NO: 981653 - DNA, 22 bp, Artificial Sequence
  chemically synthesized
gctttgtaatttaaaattaaac

SEQ ID NO: 981654 - DNA, 22 bp, Artificial Sequence
  chemically synthesized
gattggctttgtaatttaaaat

SEQ ID NO: 981655 - DNA, 22 bp, Artificial Sequence
  chemically synthesized
tttaattttaaattacaaagcc

SEQ ID NO: 981656 - DNA, 22 bp, Artificial Sequence
  chemically synthesized
aattttaaattacaaagccaat

SEQ ID NO: 981657 - DNA, 22 bp, Artificial Sequence
  chemically synthesized
attttaaattacaaagccaatc

SEQ ID NO: 981658 - DNA, 22 bp, Artificial Sequence
  chemically synthesized
cacagtgagtggttagattggc

SEQ ID NO: 981659 - DNA, 22 bp, Artificial Sequence
  chemically synthesized
taaattacaaagccaatctaac

SEQ ID NO: 981660 - DNA, 22 bp, Artificial Sequence
  chemically synthesized
aaattacaaagccaatctaacc

SEQ ID NO: 981661 - DNA, 22 bp, Artificial Sequence
  chemically synthesized
aattacaaagccaatctaacca

SEQ ID NO: 981662 - DNA, 22 bp, Artificial Sequence
  chemically synthesized
atctacacagtgagtggttaga

SEQ ID NO: 981663 - DNA, 22 bp, Artificial Sequence
  chemically synthesized
catctacacagtgagtggttag

SEQ ID NO: 981664 - DNA, 22 bp, Artificial Sequence
  chemically synthesized
caaagccaatctaaccactcac

SEQ ID NO: 981665 - DNA, 22 bp, Artificial Sequence
  chemically synthesized
ttcatctacacagtgagtggtt

SEQ ID NO: 981666 - DNA, 22 bp, Artificial Sequence
  chemically synthesized
tcttcatctacacagtgagtgg

SEQ ID NO: 981667 - DNA, 22 bp, Artificial Sequence
  chemically synthesized
agttctcttcatctacacagtg

SEQ ID NO: 981668 - DNA, 22 bp, Artificial Sequence
  chemically synthesized
cagttctcttcatctacacagt

SEQ ID NO: 981669 - DNA, 22 bp, Artificial Sequence
  chemically synthesized
accactcactgtgtagatgaag

SEQ ID NO: 981670 - DNA, 22 bp, Artificial Sequence
  chemically synthesized
gcaggacttcagttctcttcat

SEQ ID NO: 981671 - DNA, 22 bp, Artificial Sequence
  chemically synthesized
actgtgtagatgaagagaactg

SEQ ID NO: 981672 - DNA, 22 bp, Artificial Sequence
  chemically synthesized
tgtagatgaagagaactgaagt

SEQ ID NO: 981673 - DNA, 22 bp, Artificial Sequence
  chemically synthesized
gcaaatggataaaactcgcagg

SEQ ID NO: 981674 - DNA, 22 bp, Artificial Sequence
  chemically synthesized
caatctagcaaatggataaaac

SEQ ID NO: 981675 - DNA, 22 bp, Artificial Sequence
  chemically synthesized
aagtcctgcgagttttatccat

SEQ ID NO: 981676 - DNA, 22 bp, Artificial Sequence
  chemically synthesized
acaatctagcaaatggataaaa

SEQ ID NO: 981677 - DNA, 22 bp, Artificial Sequence
  chemically synthesized
tacaatctagcaaatggataaa

SEQ ID NO: 981678 - DNA, 22 bp, Artificial Sequence
  chemically synthesized
ttacaatctagcaaatggataa

SEQ ID NO: 981679 - DNA, 22 bp, Artificial Sequence
  chemically synthesized
acttttacaatctagcaaatgg

SEQ ID NO: 981680 - DNA, 22 bp, Artificial Sequence
  chemically synthesized
gacttttacaatctagcaaatg

SEQ ID NO: 981681 - DNA, 22 bp, Artificial Sequence
  chemically synthesized
cgagttttatccatttgctaga

SEQ ID NO: 981682 - DNA, 22 bp, Artificial Sequence
  chemically synthesized
tatccatttgctagattgtaaa

SEQ ID NO: 981683 - DNA, 22 bp, Artificial Sequence
  chemically synthesized
atccatttgctagattgtaaaa

SEQ ID NO: 981684 - DNA, 22 bp, Artificial Sequence
  chemically synthesized
ccccagcttgacttttacaatc

SEQ ID NO: 981685 - DNA, 22 bp, Artificial Sequence
  chemically synthesized
tccatttgctagattgtaaaag

SEQ ID NO: 981686 - DNA, 22 bp, Artificial Sequence
  chemically synthesized
gccccagcttgacttttacaat

SEQ ID NO: 981687 - DNA, 22 bp, Artificial Sequence
  chemically synthesized
ttgccccagcttgacttttaca

SEQ ID NO: 981688 - DNA, 22 bp, Artificial Sequence
  chemically synthesized
gctagattgtaaaagtcaagct

SEQ ID NO: 981689 - DNA, 22 bp, Artificial Sequence
  chemically synthesized
agttcttgccccagcttgactt

SEQ ID NO: 981690 - DNA, 22 bp, Artificial Sequence
  chemically synthesized
ctagattgtaaaagtcaagctg

SEQ ID NO: 981691 - DNA, 22 bp, Artificial Sequence
  chemically synthesized
gattgtaaaagtcaagctgggg

SEQ ID NO: 981692 - DNA, 22 bp, Artificial Sequence
  chemically synthesized
taaaagtcaagctggggcaaga

SEQ ID NO: 981693 - DNA, 22 bp, Artificial Sequence
  chemically synthesized
agaagacctgagttcttgcccc

SEQ ID NO: 981694 - DNA, 22 bp, Artificial Sequence
  chemically synthesized
cagctcagaagacctgagttct

SEQ ID NO: 981695 - DNA, 22 bp, Artificial Sequence
  chemically synthesized
aactgcagctcagaagacctga

SEQ ID NO: 981696 - DNA, 22 bp, Artificial Sequence
  chemically synthesized
gggcaagaactcaggtcttctg

SEQ ID NO: 981697 - DNA, 22 bp, Artificial Sequence
  chemically synthesized
aggtcttctgagctgcagttta

SEQ ID NO: 981698 - DNA, 22 bp, Artificial Sequence
  chemically synthesized
ctgagctgcagtttaattctcc

SEQ ID NO: 981699 - DNA, 22 bp, Artificial Sequence
  chemically synthesized
tgagctgcagtttaattctcca

SEQ ID NO: 981700 - DNA, 22 bp, Artificial Sequence
  chemically synthesized
agctgcagtttaattctccacc

SEQ ID NO: 981701 - DNA, 22 bp, Artificial Sequence
  chemically synthesized
agaaatatcgataaaggtggag

SEQ ID NO: 981702 - DNA, 22 bp, Artificial Sequence
  chemically synthesized
aagaaatatcgataaaggtgga

SEQ ID NO: 981703 - DNA, 22 bp, Artificial Sequence
  chemically synthesized
cagtttaattctccacctttat

SEQ ID NO: 981704 - DNA, 22 bp, Artificial Sequence
  chemically synthesized
taagaaatatcgataaaggtgg

SEQ ID NO: 981705 - DNA, 22 bp, Artificial Sequence
  chemically synthesized
aattctccacctttatcgatat

SEQ ID NO: 981706 - DNA, 22 bp, Artificial Sequence
  chemically synthesized
attctccacctttatcgatatt

SEQ ID NO: 981707 - DNA, 22 bp, Artificial Sequence
  chemically synthesized
tccacctttatcgatatttctt

SEQ ID NO: 981708 - DNA, 22 bp, Artificial Sequence
  chemically synthesized
cacctttatcgatatttcttaa

SEQ ID NO: 981709 - DNA, 22 bp, Artificial Sequence
  chemically synthesized
caggaccacattttaagaaata

SEQ ID NO: 981710 - DNA, 22 bp, Artificial Sequence
  chemically synthesized
gttccaggaccacattttaaga

SEQ ID NO: 981711 - DNA, 22 bp, Artificial Sequence
  chemically synthesized
tatcgatatttcttaaaatgtg

SEQ ID NO: 981712 - DNA, 22 bp, Artificial Sequence
  chemically synthesized
atcgatatttcttaaaatgtgg

SEQ ID NO: 981713 - DNA, 22 bp, Artificial Sequence
  chemically synthesized
ctggttccaggaccacatttta

SEQ ID NO: 981714 - DNA, 22 bp, Artificial Sequence
  chemically synthesized
tcgatatttcttaaaatgtggt

SEQ ID NO: 981715 - DNA, 22 bp, Artificial Sequence
  chemically synthesized
atgctgctggttccaggaccac

SEQ ID NO: 981716 - DNA, 22 bp, Artificial Sequence
  chemically synthesized
cttaaaatgtggtcctggaacc

SEQ ID NO: 981717 - DNA, 22 bp, Artificial Sequence
  chemically synthesized
ttaaaatgtggtcctggaacca

SEQ ID NO: 981718 - DNA, 22 bp, Artificial Sequence
  chemically synthesized
aaaatgtggtcctggaaccagc

SEQ ID NO: 981719 - DNA, 22 bp, Artificial Sequence
  chemically synthesized
aaatgtggtcctggaaccagca

SEQ ID NO: 981720 - DNA, 22 bp, Artificial Sequence
  chemically synthesized
agtgtataagtgatgctgatgc

SEQ ID NO: 981721 - DNA, 22 bp, Artificial Sequence
  chemically synthesized
aagtgtataagtgatgctgatg

SEQ ID NO: 981722 - DNA, 22 bp, Artificial Sequence
  chemically synthesized
taagtgtataagtgatgctgat

SEQ ID NO: 981723 - DNA, 22 bp, Artificial Sequence
  chemically synthesized
gaaccagcagcatcagcatcac

SEQ ID NO: 981724 - DNA, 22 bp, Artificial Sequence
  chemically synthesized
ttaagtgtataagtgatgctga

SEQ ID NO: 981725 - DNA, 22 bp, Artificial Sequence
  chemically synthesized
catttttaagtgtataagtgat

SEQ ID NO: 981726 - DNA, 22 bp, Artificial Sequence
  chemically synthesized
gcatttttaagtgtataagtga

SEQ ID NO: 981727 - DNA, 22 bp, Artificial Sequence
  chemically synthesized
aatatttgcatttttaagtgta

SEQ ID NO: 981728 - DNA, 22 bp, Artificial Sequence
  chemically synthesized
atacacttaaaaatgcaaatat

SEQ ID NO: 981729 - DNA, 22 bp, Artificial Sequence
  chemically synthesized
tacacttaaaaatgcaaatatt

SEQ ID NO: 981730 - DNA, 22 bp, Artificial Sequence
  chemically synthesized
ggatggggcctaaatatttgca

SEQ ID NO: 981731 - DNA, 22 bp, Artificial Sequence
  chemically synthesized
aaaaatgcaaatatttaggccc

SEQ ID NO: 981732 - DNA, 22 bp, Artificial Sequence
  chemically synthesized
aaaatgcaaatatttaggcccc

SEQ ID NO: 981733 - DNA, 22 bp, Artificial Sequence
  chemically synthesized
agtagatctgggatggggccta

SEQ ID NO: 981734 - DNA, 22 bp, Artificial Sequence
  chemically synthesized
attcagtagatctgggatgggg

SEQ ID NO: 981735 - DNA, 22 bp, Artificial Sequence
  chemically synthesized
tgattcagtagatctgggatgg

SEQ ID NO: 981736 - DNA, 22 bp, Artificial Sequence
  chemically synthesized
ctgattcagtagatctgggatg

SEQ ID NO: 981737 - DNA, 22 bp, Artificial Sequence
  chemically synthesized
aggccccatcccagatctactg

SEQ ID NO: 981738 - DNA, 22 bp, Artificial Sequence
  chemically synthesized
ggccccatcccagatctactga

SEQ ID NO: 981739 - DNA, 22 bp, Artificial Sequence
  chemically synthesized
gccatagagcttctgattcagt

SEQ ID NO: 981740 - DNA, 22 bp, Artificial Sequence
  chemically synthesized
agccctagccatagagcttctg

SEQ ID NO: 981741 - DNA, 22 bp, Artificial Sequence
  chemically synthesized
ctgaatcagaagctctatggct

SEQ ID NO: 981742 - DNA, 22 bp, Artificial Sequence
  chemically synthesized
aatcagaagctctatggctagg

SEQ ID NO: 981743 - DNA, 22 bp, Artificial Sequence
  chemically synthesized
aatatgcatctgagccctagcc

SEQ ID NO: 981744 - DNA, 22 bp, Artificial Sequence
  chemically synthesized
acctgaatatgcatctgagccc

SEQ ID NO: 981745 - DNA, 22 bp, Artificial Sequence
  chemically synthesized
tgacctgaatatgcatctgagc

SEQ ID NO: 981746 - DNA, 22 bp, Artificial Sequence
  chemically synthesized
tatggctagggctcagatgcat

SEQ ID NO: 981747 - DNA, 22 bp, Artificial Sequence
  chemically synthesized
tggctagggctcagatgcatat

SEQ ID NO: 981748 - DNA, 22 bp, Artificial Sequence
  chemically synthesized
gggctcagatgcatattcaggt

SEQ ID NO: 981749 - DNA, 22 bp, Artificial Sequence
  chemically synthesized
agatgcatattcaggtcagagg

SEQ ID NO: 981750 - DNA, 22 bp, Artificial Sequence
  chemically synthesized
cacaaaatagagcaggagccct

SEQ ID NO: 981751 - DNA, 22 bp, Artificial Sequence
  chemically synthesized
aggtcagagggctcctgctcta

SEQ ID NO: 981752 - DNA, 22 bp, Artificial Sequence
  chemically synthesized
aggaaggggattacacaaaata

SEQ ID NO: 981753 - DNA, 22 bp, Artificial Sequence
  chemically synthesized
ctgctctattttgtgtaatccc

SEQ ID NO: 981754 - DNA, 22 bp, Artificial Sequence
  chemically synthesized
acactcaggaaggggattacac

SEQ ID NO: 981755 - DNA, 22 bp, Artificial Sequence
  chemically synthesized
ctctattttgtgtaatcccctt

SEQ ID NO: 981756 - DNA, 22 bp, Artificial Sequence
  chemically synthesized
ctaacactcaggaaggggatta

SEQ ID NO: 981757 - DNA, 22 bp, Artificial Sequence
  chemically synthesized
gctaacactcaggaaggggatt

SEQ ID NO: 981758 - DNA, 22 bp, Artificial Sequence
  chemically synthesized
tgctaacactcaggaaggggat

SEQ ID NO: 981759 - DNA, 22 bp, Artificial Sequence
  chemically synthesized
tattttgtgtaatccccttcct

SEQ ID NO: 981760 - DNA, 22 bp, Artificial Sequence
  chemically synthesized
ttttgtgtaatccccttcctga

SEQ ID NO: 981761 - DNA, 22 bp, Artificial Sequence
  chemically synthesized
tgtgtaatccccttcctgagtg

SEQ ID NO: 981762 - DNA, 22 bp, Artificial Sequence
  chemically synthesized
gtgtaatccccttcctgagtgt

SEQ ID NO: 981763 - DNA, 22 bp, Artificial Sequence
  chemically synthesized
tgtaatccccttcctgagtgtt

SEQ ID NO: 981764 - DNA, 22 bp, Artificial Sequence
  chemically synthesized
cctgagtgttagcaaagtgatg

SEQ ID NO: 981765 - DNA, 22 bp, Artificial Sequence
  chemically synthesized
ctgagtgttagcaaagtgatgg

SEQ ID NO: 981766 - DNA, 22 bp, Artificial Sequence
  chemically synthesized
agtgttagcaaagtgatgggtt

SEQ ID NO: 981767 - DNA, 22 bp, Artificial Sequence
  chemically synthesized
cccgtaagtgtgaacccatcac

SEQ ID NO: 981768 - DNA, 22 bp, Artificial Sequence
  chemically synthesized
tacccgtaagtgtgaacccatc

SEQ ID NO: 981769 - DNA, 22 bp, Artificial Sequence
  chemically synthesized
tctacccgtaagtgtgaaccca

SEQ ID NO: 981770 - DNA, 22 bp, Artificial Sequence
  chemically synthesized
gcaaagtgatgggttcacactt

SEQ ID NO: 981771 - DNA, 22 bp, Artificial Sequence
  chemically synthesized
cctctctacccgtaagtgtgaa

SEQ ID NO: 981772 - DNA, 22 bp, Artificial Sequence
  chemically synthesized
ctacctctctacccgtaagtgt

SEQ ID NO: 981773 - DNA, 22 bp, Artificial Sequence
  chemically synthesized
ctgctacctctctacccgtaag

SEQ ID NO: 981774 - DNA, 22 bp, Artificial Sequence
  chemically synthesized
ctcctgctacctctctacccgt

SEQ ID NO: 981775 - DNA, 22 bp, Artificial Sequence
  chemically synthesized
cctcctgctacctctctacccg

SEQ ID NO: 981776 - DNA, 22 bp, Artificial Sequence
  chemically synthesized
tcctcctgctacctctctaccc

SEQ ID NO: 981777 - DNA, 22 bp, Artificial Sequence
  chemically synthesized
acacttacgggtagagaggtag

SEQ ID NO: 981778 - DNA, 22 bp, Artificial Sequence
  chemically synthesized
actttcctcctgctacctctct

SEQ ID NO: 981779 - DNA, 22 bp, Artificial Sequence
  chemically synthesized
cactttcctcctgctacctctc

SEQ ID NO: 981780 - DNA, 22 bp, Artificial Sequence
  chemically synthesized
acgggtagagaggtagcaggag

SEQ ID NO: 981781 - DNA, 22 bp, Artificial Sequence
  chemically synthesized
cgggtagagaggtagcaggagg

SEQ ID NO: 981782 - DNA, 22 bp, Artificial Sequence
  chemically synthesized
gcacagagtcaagaacagcttc

SEQ ID NO: 981783 - DNA, 22 bp, Artificial Sequence
  chemically synthesized
tggcacagagtcaagaacagct

SEQ ID NO: 981784 - DNA, 22 bp, Artificial Sequence
  chemically synthesized
ctggcacagagtcaagaacagc

SEQ ID NO: 981785 - DNA, 22 bp, Artificial Sequence
  chemically synthesized
ttctggcacagagtcaagaaca

SEQ ID NO: 981786 - DNA, 22 bp, Artificial Sequence
  chemically synthesized
taatctcttctggcacagagtc

SEQ ID NO: 981787 - DNA, 22 bp, Artificial Sequence
  chemically synthesized
tgtaatctcttctggcacagag

SEQ ID NO: 981788 - DNA, 22 bp, Artificial Sequence
  chemically synthesized
ctgtaatctcttctggcacaga

SEQ ID NO: 981789 - DNA, 22 bp, Artificial Sequence
  chemically synthesized
ttcttgactctgtgccagaaga

SEQ ID NO: 981790 - DNA, 22 bp, Artificial Sequence
  chemically synthesized
ttgactctgtgccagaagagat

SEQ ID NO: 981791 - DNA, 22 bp, Artificial Sequence
  chemically synthesized
gactctgtgccagaagagatta

SEQ ID NO: 981792 - DNA, 22 bp, Artificial Sequence
  chemically synthesized
actctgtgccagaagagattac

SEQ ID NO: 981793 - DNA, 22 bp, Artificial Sequence
  chemically synthesized
tgtgccagaagagattacagaa

SEQ ID NO: 981794 - DNA, 22 bp, Artificial Sequence
  chemically synthesized
gagagggtcagtttctgtaatc

SEQ ID NO: 981795 - DNA, 22 bp, Artificial Sequence
  chemically synthesized
tgccagaagagattacagaaac

SEQ ID NO: 981796 - DNA, 22 bp, Artificial Sequence
  chemically synthesized
agttcgagagggtcagtttctg

SEQ ID NO: 981797 - DNA, 22 bp, Artificial Sequence
  chemically synthesized
ttgagttcgagagggtcagttt

SEQ ID NO: 981798 - DNA, 22 bp, Artificial Sequence
  chemically synthesized
tgttgagttcgagagggtcagt

SEQ ID NO: 981799 - DNA, 22 bp, Artificial Sequence
  chemically synthesized
ctgttgagttcgagagggtcag

SEQ ID NO: 981800 - DNA, 22 bp, Artificial Sequence
  chemically synthesized
cagaaactgaccctctcgaact

SEQ ID NO: 981801 - DNA, 22 bp, Artificial Sequence
  chemically synthesized
cagcttctgttgagttcgagag

SEQ ID NO: 981802 - DNA, 22 bp, Artificial Sequence
  chemically synthesized
accctctcgaactcaacagaag

SEQ ID NO: 981803 - DNA, 22 bp, Artificial Sequence
  chemically synthesized
tcgaactcaacagaagctgtag

SEQ ID NO: 981804 - DNA, 22 bp, Artificial Sequence
  chemically synthesized
gaactcaacagaagctgtagac

SEQ ID NO: 981805 - DNA, 22 bp, Artificial Sequence
  chemically synthesized
aacagaagctgtagaccacatt

SEQ ID NO: 981806 - DNA, 22 bp, Artificial Sequence
  chemically synthesized
taaaacacatgtaccaatgtgg

SEQ ID NO: 981807 - DNA, 22 bp, Artificial Sequence
  chemically synthesized
ataaaacacatgtaccaatgtg

SEQ ID NO: 981808 - DNA, 22 bp, Artificial Sequence
  chemically synthesized
tagtttataaaacacatgtacc

SEQ ID NO: 981809 - DNA, 22 bp, Artificial Sequence
  chemically synthesized
tagaccacattggtacatgtgt

SEQ ID NO: 981810 - DNA, 22 bp, Artificial Sequence
  chemically synthesized
gtacatgtgttttataaactac

SEQ ID NO: 981811 - DNA, 22 bp, Artificial Sequence
  chemically synthesized
tataaactacaatcatgcatgc

SEQ ID NO: 981812 - DNA, 22 bp, Artificial Sequence
  chemically synthesized
ataaactacaatcatgcatgcc

SEQ ID NO: 981813 - DNA, 22 bp, Artificial Sequence
  chemically synthesized
taaactacaatcatgcatgccg

SEQ ID NO: 981814 - DNA, 22 bp, Artificial Sequence
  chemically synthesized
caaagcacagaaacggcatgca

SEQ ID NO: 981815 - DNA, 22 bp, Artificial Sequence
  chemically synthesized
gcaaagcacagaaacggcatgc

SEQ ID NO: 981816 - DNA, 22 bp, Artificial Sequence
  chemically synthesized
tgcaaagcacagaaacggcatg

SEQ ID NO: 981817 - DNA, 22 bp, Artificial Sequence
  chemically synthesized
ttgcaaagcacagaaacggcat

SEQ ID NO: 981818 - DNA, 22 bp, Artificial Sequence
  chemically synthesized
ttttgcaaagcacagaaacggc

SEQ ID NO: 981819 - DNA, 22 bp, Artificial Sequence
  chemically synthesized
caatcatgcatgccgtttctgt

SEQ ID NO: 981820 - DNA, 22 bp, Artificial Sequence
  chemically synthesized
tctcttttgcaaagcacagaaa

SEQ ID NO: 981821 - DNA, 22 bp, Artificial Sequence
  chemically synthesized
tctgtctcttttgcaaagcaca

SEQ ID NO: 981822 - DNA, 22 bp, Artificial Sequence
  chemically synthesized
gcaccactatctgtctcttttg

SEQ ID NO: 981823 - DNA, 22 bp, Artificial Sequence
  chemically synthesized
ctgtgctttgcaaaagagacag

SEQ ID NO: 981824 - DNA, 22 bp, Artificial Sequence
  chemically synthesized
tgtgctttgcaaaagagacaga

SEQ ID NO: 981825 - DNA, 22 bp, Artificial Sequence
  chemically synthesized
tgctttgcaaaagagacagata

SEQ ID NO: 981826 - DNA, 22 bp, Artificial Sequence
  chemically synthesized
ccctggcaccactatctgtctc

SEQ ID NO: 981827 - DNA, 22 bp, Artificial Sequence
  chemically synthesized
cccctggcaccactatctgtct

SEQ ID NO: 981828 - DNA, 22 bp, Artificial Sequence
  chemically synthesized
tcccctggcaccactatctgtc

SEQ ID NO: 981829 - DNA, 22 bp, Artificial Sequence
  chemically synthesized
tgcaaaagagacagatagtggt

SEQ ID NO: 981830 - DNA, 22 bp, Artificial Sequence
  chemically synthesized
gcaaaagagacagatagtggtg

SEQ ID NO: 981831 - DNA, 22 bp, Artificial Sequence
  chemically synthesized
caaaagagacagatagtggtgc

SEQ ID NO: 981832 - DNA, 22 bp, Artificial Sequence
  chemically synthesized
atgtcctttcccctggcaccac

SEQ ID NO: 981833 - DNA, 22 bp, Artificial Sequence
  chemically synthesized
ctaatgtcctttcccctggcac

SEQ ID NO: 981834 - DNA, 22 bp, Artificial Sequence
  chemically synthesized
gactgctaatgtcctttcccct

SEQ ID NO: 981835 - DNA, 22 bp, Artificial Sequence
  chemically synthesized
ggactgctaatgtcctttcccc

SEQ ID NO: 981836 - DNA, 22 bp, Artificial Sequence
  chemically synthesized
atcaacttggactgctaatgtc

SEQ ID NO: 981837 - DNA, 22 bp, Artificial Sequence
  chemically synthesized
cctaatcaacttggactgctaa

SEQ ID NO: 981838 - DNA, 22 bp, Artificial Sequence
  chemically synthesized
acctaatcaacttggactgcta

SEQ ID NO: 981839 - DNA, 22 bp, Artificial Sequence
  chemically synthesized
tacctaatcaacttggactgct

SEQ ID NO: 981840 - DNA, 22 bp, Artificial Sequence
  chemically synthesized
gcagtccaagttgattaggtaa

SEQ ID NO: 981841 - DNA, 22 bp, Artificial Sequence
  chemically synthesized
tgtcagaccattttacctaatc

SEQ ID NO: 981842 - DNA, 22 bp, Artificial Sequence
  chemically synthesized
actgtgtcagaccattttacct

SEQ ID NO: 981843 - DNA, 22 bp, Artificial Sequence
  chemically synthesized
cctcactgtgtcagaccatttt

SEQ ID NO: 981844 - DNA, 22 bp, Artificial Sequence
  chemically synthesized
gcctcactgtgtcagaccattt

SEQ ID NO: 981845 - DNA, 22 bp, Artificial Sequence
  chemically synthesized
tgcctcactgtgtcagaccatt

SEQ ID NO: 981846 - DNA, 22 bp, Artificial Sequence
  chemically synthesized
ttgcctcactgtgtcagaccat

SEQ ID NO: 981847 - DNA, 22 bp, Artificial Sequence
  chemically synthesized
attaggtaaaatggtctgacac

SEQ ID NO: 981848 - DNA, 22 bp, Artificial Sequence
  chemically synthesized
ggtaaaatggtctgacacagtg

SEQ ID NO: 981849 - DNA, 22 bp, Artificial Sequence
  chemically synthesized
ccaaatcaacttttgcctcact

SEQ ID NO: 981850 - DNA, 22 bp, Artificial Sequence
  chemically synthesized
accaaatcaacttttgcctcac

SEQ ID NO: 981851 - DNA, 22 bp, Artificial Sequence
  chemically synthesized
taccaaatcaacttttgcctca

SEQ ID NO: 981852 - DNA, 22 bp, Artificial Sequence
  chemically synthesized
ttaccaaatcaacttttgcctc

SEQ ID NO: 981853 - DNA, 22 bp, Artificial Sequence
  chemically synthesized
acacagtgaggcaaaagttgat

SEQ ID NO: 981854 - DNA, 22 bp, Artificial Sequence
  chemically synthesized
tgtcaagtttttaccaaatcaa

SEQ ID NO: 981855 - DNA, 22 bp, Artificial Sequence
  chemically synthesized
aaagtgccgtctatgtcaagtt

SEQ ID NO: 981856 - DNA, 22 bp, Artificial Sequence
  chemically synthesized
atttggtaaaaacttgacatag

SEQ ID NO: 981857 - DNA, 22 bp, Artificial Sequence
  chemically synthesized
ggtaaaaacttgacatagacgg

SEQ ID NO: 981858 - DNA, 22 bp, Artificial Sequence
  chemically synthesized
gtaaaaacttgacatagacggc

SEQ ID NO: 981859 - DNA, 22 bp, Artificial Sequence
  chemically synthesized
gacatagacggcactttcaacc

SEQ ID NO: 981860 - DNA, 22 bp, Artificial Sequence
  chemically synthesized
acatagacggcactttcaacca

SEQ ID NO: 981861 - DNA, 22 bp, Artificial Sequence
  chemically synthesized
agtggataccgatggttgaaag

SEQ ID NO: 981862 - DNA, 22 bp, Artificial Sequence
  chemically synthesized
ttaagtggataccgatggttga

SEQ ID NO: 981863 - DNA, 22 bp, Artificial Sequence
  chemically synthesized
catctattaagtggataccgat

SEQ ID NO: 981864 - DNA, 22 bp, Artificial Sequence
  chemically synthesized
acatctattaagtggataccga

SEQ ID NO: 981865 - DNA, 22 bp, Artificial Sequence
  chemically synthesized
tttacatctattaagtggatac

SEQ ID NO: 981866 - DNA, 22 bp, Artificial Sequence
  chemically synthesized
tcaaccatcggtatccacttaa

SEQ ID NO: 981867 - DNA, 22 bp, Artificial Sequence
  chemically synthesized
caaccatcggtatccacttaat

SEQ ID NO: 981868 - DNA, 22 bp, Artificial Sequence
  chemically synthesized
aaccatcggtatccacttaata

SEQ ID NO: 981869 - DNA, 22 bp, Artificial Sequence
  chemically synthesized
tgtcgtgaaaatagctgtttac

SEQ ID NO: 981870 - DNA, 22 bp, Artificial Sequence
  chemically synthesized
gtgtcgtgaaaatagctgttta

SEQ ID NO: 981871 - DNA, 22 bp, Artificial Sequence
  chemically synthesized
aatagatgtaaacagctatttt

SEQ ID NO: 981872 - DNA, 22 bp, Artificial Sequence
  chemically synthesized
atagatgtaaacagctattttc

SEQ ID NO: 981873 - DNA, 22 bp, Artificial Sequence
  chemically synthesized
aagatgtaagtgtgggtgtttg

SEQ ID NO: 981874 - DNA, 22 bp, Artificial Sequence
  chemically synthesized
ttttcacgacacaaacacccac

SEQ ID NO: 981875 - DNA, 22 bp, Artificial Sequence
  chemically synthesized
taaagatgtaagtgtgggtgtt

SEQ ID NO: 981876 - DNA, 22 bp, Artificial Sequence
  chemically synthesized
tcacgacacaaacacccacact

SEQ ID NO: 981877 - DNA, 22 bp, Artificial Sequence
  chemically synthesized
cacgacacaaacacccacactt

SEQ ID NO: 981878 - DNA, 22 bp, Artificial Sequence
  chemically synthesized
ttctaaagatgtaagtgtgggt

SEQ ID NO: 981879 - DNA, 22 bp, Artificial Sequence
  chemically synthesized
acgacacaaacacccacactta

SEQ ID NO: 981880 - DNA, 22 bp, Artificial Sequence
  chemically synthesized
agactgttctaaagatgtaagt

SEQ ID NO: 981881 - DNA, 22 bp, Artificial Sequence
  chemically synthesized
ctgagactgttctaaagatgta

SEQ ID NO: 981882 - DNA, 22 bp, Artificial Sequence
  chemically synthesized
acatctttagaacagtctcagc

SEQ ID NO: 981883 - DNA, 22 bp, Artificial Sequence
  chemically synthesized
catctttagaacagtctcagca

SEQ ID NO: 981884 - DNA, 22 bp, Artificial Sequence
  chemically synthesized
gcaagcatacagaattgctgag

SEQ ID NO: 981885 - DNA, 22 bp, Artificial Sequence
  chemically synthesized
tagaacagtctcagcaattctg

SEQ ID NO: 981886 - DNA, 22 bp, Artificial Sequence
  chemically synthesized
agaacagtctcagcaattctgt

SEQ ID NO: 981887 - DNA, 22 bp, Artificial Sequence
  chemically synthesized
tctggcaagcatacagaattgc

SEQ ID NO: 981888 - DNA, 22 bp, Artificial Sequence
  chemically synthesized
gaacagtctcagcaattctgta

SEQ ID NO: 981889 - DNA, 22 bp, Artificial Sequence
  chemically synthesized
atctggcaagcatacagaattg

SEQ ID NO: 981890 - DNA, 22 bp, Artificial Sequence
  chemically synthesized
agcaattctgtatgcttgccag

SEQ ID NO: 981891 - DNA, 22 bp, Artificial Sequence
  chemically synthesized
cagcagagatttatctggcaag

SEQ ID NO: 981892 - DNA, 22 bp, Artificial Sequence
  chemically synthesized
gcagcagagatttatctggcaa

SEQ ID NO: 981893 - DNA, 22 bp, Artificial Sequence
  chemically synthesized
tgtatgcttgccagataaatct

SEQ ID NO: 981894 - DNA, 22 bp, Artificial Sequence
  chemically synthesized
tatgcttgccagataaatctct

SEQ ID NO: 981895 - DNA, 22 bp, Artificial Sequence
  chemically synthesized
gaggataatttgcagcagagat

SEQ ID NO: 981896 - DNA, 22 bp, Artificial Sequence
  chemically synthesized
gccagataaatctctgctgcaa

SEQ ID NO: 981897 - DNA, 22 bp, Artificial Sequence
  chemically synthesized
ccagataaatctctgctgcaaa

SEQ ID NO: 981898 - DNA, 22 bp, Artificial Sequence
  chemically synthesized
atggctggaggataatttgcag

SEQ ID NO: 981899 - DNA, 22 bp, Artificial Sequence
  chemically synthesized
aatctcatggctggaggataat

SEQ ID NO: 981900 - DNA, 22 bp, Artificial Sequence
  chemically synthesized
aaatctcatggctggaggataa

SEQ ID NO: 981901 - DNA, 22 bp, Artificial Sequence
  chemically synthesized
taaatctcatggctggaggata

SEQ ID NO: 981902 - DNA, 22 bp, Artificial Sequence
  chemically synthesized
tgctgcaaattatcctccagcc

SEQ ID NO: 981903 - DNA, 22 bp, Artificial Sequence
  chemically synthesized
ctgcaaattatcctccagccat

SEQ ID NO: 981904 - DNA, 22 bp, Artificial Sequence
  chemically synthesized
gttttaaatctcatggctggag

SEQ ID NO: 981905 - DNA, 22 bp, Artificial Sequence
  chemically synthesized
ggttttaaatctcatggctgga

SEQ ID NO: 981906 - DNA, 22 bp, Artificial Sequence
  chemically synthesized
caaattatcctccagccatgag

SEQ ID NO: 981907 - DNA, 22 bp, Artificial Sequence
  chemically synthesized
ttggttttaaatctcatggctg

SEQ ID NO: 981908 - DNA, 22 bp, Artificial Sequence
  chemically synthesized
tcctccagccatgagatttaaa

SEQ ID NO: 981909 - DNA, 22 bp, Artificial Sequence
  chemically synthesized
gaaactcttggttttaaatctc

SEQ ID NO: 981910 - DNA, 22 bp, Artificial Sequence
  chemically synthesized
cagccatgagatttaaaaccaa

SEQ ID NO: 981911 - DNA, 22 bp, Artificial Sequence
  chemically synthesized
aaaggaacaaaacactagaaac

SEQ ID NO: 981912 - DNA, 22 bp, Artificial Sequence
  chemically synthesized
caaaggaacaaaacactagaaa

SEQ ID NO: 981913 - DNA, 22 bp, Artificial Sequence
  chemically synthesized
aaaaccaagagtttctagtgtt

SEQ ID NO: 981914 - DNA, 22 bp, Artificial Sequence
  chemically synthesized
aaaccaagagtttctagtgttt

SEQ ID NO: 981915 - DNA, 22 bp, Artificial Sequence
  chemically synthesized
catatttcaaaggaacaaaaca

SEQ ID NO: 981916 - DNA, 22 bp, Artificial Sequence
  chemically synthesized
aggttacatatttcaaaggaac

SEQ ID NO: 981917 - DNA, 22 bp, Artificial Sequence
  chemically synthesized
ctagtgttttgttcctttgaaa

SEQ ID NO: 981918 - DNA, 22 bp, Artificial Sequence
  chemically synthesized
tagtgttttgttcctttgaaat

SEQ ID NO: 981919 - DNA, 22 bp, Artificial Sequence
  chemically synthesized
gttaaggttacatatttcaaag

SEQ ID NO: 981920 - DNA, 22 bp, Artificial Sequence
  chemically synthesized
gtgttttgttcctttgaaatat

SEQ ID NO: 981921 - DNA, 22 bp, Artificial Sequence
  chemically synthesized
tgttcctttgaaatatgtaacc

SEQ ID NO: 981922 - DNA, 22 bp, Artificial Sequence
  chemically synthesized
gttcctttgaaatatgtaacct

SEQ ID NO: 981923 - DNA, 22 bp, Artificial Sequence
  chemically synthesized
ttcctttgaaatatgtaacctt

SEQ ID NO: 981924 - DNA, 22 bp, Artificial Sequence
  chemically synthesized
ctttgaaatatgtaaccttaac

SEQ ID NO: 981925 - DNA, 22 bp, Artificial Sequence
  chemically synthesized
tgaaatatgtaaccttaaccag

SEQ ID NO: 981926 - DNA, 22 bp, Artificial Sequence
  chemically synthesized
gaaatatgtaaccttaaccaga

SEQ ID NO: 981927 - DNA, 22 bp, Artificial Sequence
  chemically synthesized
aaatatgtaaccttaaccagat

SEQ ID NO: 981928 - DNA, 22 bp, Artificial Sequence
  chemically synthesized
tgacccagggtataaacatctg

SEQ ID NO: 981929 - DNA, 22 bp, Artificial Sequence
  chemically synthesized
gtgacccagggtataaacatct

SEQ ID NO: 981930 - DNA, 22 bp, Artificial Sequence
  chemically synthesized
tgtgacccagggtataaacatc

SEQ ID NO: 981931 - DNA, 22 bp, Artificial Sequence
  chemically synthesized
ttgtgacccagggtataaacat

SEQ ID NO: 981932 - DNA, 22 bp, Artificial Sequence
  chemically synthesized
gatttttgtgacccagggtata

SEQ ID NO: 981933 - DNA, 22 bp, Artificial Sequence
  chemically synthesized
aaccagatgtttataccctggg

SEQ ID NO: 981934 - DNA, 22 bp, Artificial Sequence
  chemically synthesized
accagatgtttataccctgggt

SEQ ID NO: 981935 - DNA, 22 bp, Artificial Sequence
  chemically synthesized
aattagatttttgtgacccagg

SEQ ID NO: 981936 - DNA, 22 bp, Artificial Sequence
  chemically synthesized
ttcaattagatttttgtgaccc

SEQ ID NO: 981937 - DNA, 22 bp, Artificial Sequence
  chemically synthesized
ataccctgggtcacaaaaatct

SEQ ID NO: 981938 - DNA, 22 bp, Artificial Sequence
  chemically synthesized
taccctgggtcacaaaaatcta

SEQ ID NO: 981939 - DNA, 22 bp, Artificial Sequence
  chemically synthesized
ggtcacaaaaatctaattgaat

SEQ ID NO: 981940 - DNA, 22 bp, Artificial Sequence
  chemically synthesized
tgcgaacacatcaagtgaacta

SEQ ID NO: 981941 - DNA, 22 bp, Artificial Sequence
  chemically synthesized
attgtgcgaacacatcaagtga

SEQ ID NO: 981942 - DNA, 22 bp, Artificial Sequence
  chemically synthesized
aattgtgcgaacacatcaagtg

SEQ ID NO: 981943 - DNA, 22 bp, Artificial Sequence
  chemically synthesized
attgaatagttcacttgatgtg

SEQ ID NO: 981944 - DNA, 22 bp, Artificial Sequence
  chemically synthesized
ttaattgtgcgaacacatcaag

SEQ ID NO: 981945 - DNA, 22 bp, Artificial Sequence
  chemically synthesized
cttaattgtgcgaacacatcaa

SEQ ID NO: 981946 - DNA, 22 bp, Artificial Sequence
  chemically synthesized
aatagttcacttgatgtgttcg

SEQ ID NO: 981947 - DNA, 22 bp, Artificial Sequence
  chemically synthesized
acttgatgtgttcgcacaatta

SEQ ID NO: 981948 - DNA, 22 bp, Artificial Sequence
  chemically synthesized
gatgtgttcgcacaattaagaa

SEQ ID NO: 981949 - DNA, 22 bp, Artificial Sequence
  chemically synthesized
aggaagaagagtttcttaattg

SEQ ID NO: 981950 - DNA, 22 bp, Artificial Sequence
  chemically synthesized
atgtgttcgcacaattaagaaa

SEQ ID NO: 981951 - DNA, 22 bp, Artificial Sequence
  chemically synthesized
ttaaggaagaagagtttcttaa

SEQ ID NO: 981952 - DNA, 22 bp, Artificial Sequence
  chemically synthesized
ccctattaaggaagaagagttt

SEQ ID NO: 981953 - DNA, 22 bp, Artificial Sequence
  chemically synthesized
gcacaattaagaaactcttctt

SEQ ID NO: 981954 - DNA, 22 bp, Artificial Sequence
  chemically synthesized
cccctattaaggaagaagagtt

SEQ ID NO: 981955 - DNA, 22 bp, Artificial Sequence
  chemically synthesized
ttcccctattaaggaagaagag

SEQ ID NO: 981956 - DNA, 22 bp, Artificial Sequence
  chemically synthesized
cccctcttcccctattaaggaa

SEQ ID NO: 981957 - DNA, 22 bp, Artificial Sequence
  chemically synthesized
agaaactcttcttccttaatag

SEQ ID NO: 981958 - DNA, 22 bp, Artificial Sequence
  chemically synthesized
gcccctcttcccctattaagga

SEQ ID NO: 981959 - DNA, 22 bp, Artificial Sequence
  chemically synthesized
ttcttccttaataggggaagag

SEQ ID NO: 981960 - DNA, 22 bp, Artificial Sequence
  chemically synthesized
cttccttaataggggaagaggg

SEQ ID NO: 981961 - DNA, 22 bp, Artificial Sequence
  chemically synthesized
ttccttaataggggaagagggg

SEQ ID NO: 981962 - DNA, 22 bp, Artificial Sequence
  chemically synthesized
ccttaataggggaagaggggca

SEQ ID NO: 981963 - DNA, 22 bp, Artificial Sequence
  chemically synthesized
aacatatgaatttgcccctctt

SEQ ID NO: 981964 - DNA, 22 bp, Artificial Sequence
  chemically synthesized
cttaataggggaagaggggcaa

SEQ ID NO: 981965 - DNA, 22 bp, Artificial Sequence
  chemically synthesized
aataggggaagaggggcaaatt

SEQ ID NO: 981966 - DNA, 22 bp, Artificial Sequence
  chemically synthesized
ataggggaagaggggcaaattc

SEQ ID NO: 981967 - DNA, 22 bp, Artificial Sequence
  chemically synthesized
aaaattaaacatatgaatttgc

SEQ ID NO: 981968 - DNA, 22 bp, Artificial Sequence
  chemically synthesized
gaaaattaaacatatgaatttg

SEQ ID NO: 981969 - DNA, 22 bp, Artificial Sequence
  chemically synthesized
tgaaaattaaacatatgaattt

SEQ ID NO: 981970 - DNA, 22 bp, Artificial Sequence
  chemically synthesized
ttgaaaattaaacatatgaatt

SEQ ID NO: 981971 - DNA, 22 bp, Artificial Sequence
  chemically synthesized
tgtttttgaaaattaaacatat

SEQ ID NO: 981972 - DNA, 22 bp, Artificial Sequence
  chemically synthesized
tgtgtttttgaaaattaaacat

SEQ ID NO: 981973 - DNA, 22 bp, Artificial Sequence
  chemically synthesized
atatgtttaattttcaaaaaca

SEQ ID NO: 981974 - DNA, 22 bp, Artificial Sequence
  chemically synthesized
tagagcagagaacgctctgtgt

SEQ ID NO: 981975 - DNA, 22 bp, Artificial Sequence
  chemically synthesized
aattttcaaaaacacagagcgt

SEQ ID NO: 981976 - DNA, 22 bp, Artificial Sequence
  chemically synthesized
attttcaaaaacacagagcgtt

SEQ ID NO: 981977 - DNA, 22 bp, Artificial Sequence
  chemically synthesized
ttgtagagcagagaacgctctg

SEQ ID NO: 981978 - DNA, 22 bp, Artificial Sequence
  chemically synthesized
tcaaaaacacagagcgttctct

SEQ ID NO: 981979 - DNA, 22 bp, Artificial Sequence
  chemically synthesized
caaaaacacagagcgttctctg

SEQ ID NO: 981980 - DNA, 22 bp, Artificial Sequence
  chemically synthesized
aaaaacacagagcgttctctgc

SEQ ID NO: 981981 - DNA, 22 bp, Artificial Sequence
  chemically synthesized
atagactgttgtagagcagaga

SEQ ID NO: 981982 - DNA, 22 bp, Artificial Sequence
  chemically synthesized
gctgatagactgttgtagagca

SEQ ID NO: 981983 - DNA, 22 bp, Artificial Sequence
  chemically synthesized
tagctgatagactgttgtagag

SEQ ID NO: 981984 - DNA, 22 bp, Artificial Sequence
  chemically synthesized
ctagctgatagactgttgtaga

SEQ ID NO: 981985 - DNA, 22 bp, Artificial Sequence
  chemically synthesized
tctgctctacaacagtctatca

SEQ ID NO: 981986 - DNA, 22 bp, Artificial Sequence
  chemically synthesized
tgctctacaacagtctatcagc

SEQ ID NO: 981987 - DNA, 22 bp, Artificial Sequence
  chemically synthesized
atagacatttctagctgataga

SEQ ID NO: 981988 - DNA, 22 bp, Artificial Sequence
  chemically synthesized
ctctacaacagtctatcagcta

SEQ ID NO: 981989 - DNA, 22 bp, Artificial Sequence
  chemically synthesized
tacaacagtctatcagctagaa

SEQ ID NO: 981990 - DNA, 22 bp, Artificial Sequence
  chemically synthesized
caacagtctatcagctagaaat

SEQ ID NO: 981991 - DNA, 22 bp, Artificial Sequence
  chemically synthesized
tcagctagaaatgtctattaac

SEQ ID NO: 981992 - DNA, 22 bp, Artificial Sequence
  chemically synthesized
gaaatgtctattaactgtctct

SEQ ID NO: 981993 - DNA, 22 bp, Artificial Sequence
  chemically synthesized
atgaagtagagaagagacagtt

SEQ ID NO: 981994 - DNA, 22 bp, Artificial Sequence
  chemically synthesized
tgctcatgaagtagagaagaga

SEQ ID NO: 981995 - DNA, 22 bp, Artificial Sequence
  chemically synthesized
gtgctcatgaagtagagaagag

SEQ ID NO: 981996 - DNA, 22 bp, Artificial Sequence
  chemically synthesized
tgtgctcatgaagtagagaaga

SEQ ID NO: 981997 - DNA, 22 bp, Artificial Sequence
  chemically synthesized
ttaactgtctcttctctacttc

SEQ ID NO: 981998 - DNA, 22 bp, Artificial Sequence
  chemically synthesized
tctttgtgctcatgaagtagag

SEQ ID NO: 981999 - DNA, 22 bp, Artificial Sequence
  chemically synthesized
atctttgtgctcatgaagtaga

SEQ ID NO: 982000 - DNA, 22 bp, Artificial Sequence
  chemically synthesized
actgtctcttctctacttcatg

SEQ ID NO: 982001 - DNA, 22 bp, Artificial Sequence
  chemically synthesized
tctcttctctacttcatgagca

SEQ ID NO: 982002 - DNA, 22 bp, Artificial Sequence
  chemically synthesized
ttctctacttcatgagcacaaa

SEQ ID NO: 982003 - DNA, 22 bp, Artificial Sequence
  chemically synthesized
ctctacttcatgagcacaaaga

SEQ ID NO: 982004 - DNA, 22 bp, Artificial Sequence
  chemically synthesized
tctacttcatgagcacaaagat

SEQ ID NO: 982005 - DNA, 22 bp, Artificial Sequence
  chemically synthesized
aaaccacaacttatctttgtgc

SEQ ID NO: 982006 - DNA, 22 bp, Artificial Sequence
  chemically synthesized
tacttcatgagcacaaagataa

SEQ ID NO: 982007 - DNA, 22 bp, Artificial Sequence
  chemically synthesized
cttcatgagcacaaagataagt

SEQ ID NO: 982008 - DNA, 22 bp, Artificial Sequence
  chemically synthesized
catgagcacaaagataagttgt

SEQ ID NO: 982009 - DNA, 22 bp, Artificial Sequence
  chemically synthesized
atgagcacaaagataagttgtg

SEQ ID NO: 982010 - DNA, 22 bp, Artificial Sequence
  chemically synthesized
atatcccccaaagggtccctaa

SEQ ID NO: 982011 - DNA, 22 bp, Artificial Sequence
  chemically synthesized
aatatcccccaaagggtcccta

SEQ ID NO: 982012 - DNA, 22 bp, Artificial Sequence
  chemically synthesized
ttaatatcccccaaagggtccc

SEQ ID NO: 982013 - DNA, 22 bp, Artificial Sequence
  chemically synthesized
tggttttagggaccctttgggg

SEQ ID NO: 982014 - DNA, 22 bp, Artificial Sequence
  chemically synthesized
aagatctcttaatatcccccaa

SEQ ID NO: 982015 - DNA, 22 bp, Artificial Sequence
  chemically synthesized
tagggaccctttgggggatatt

SEQ ID NO: 982016 - DNA, 22 bp, Artificial Sequence
  chemically synthesized
agggaccctttgggggatatta

SEQ ID NO: 982017 - DNA, 22 bp, Artificial Sequence
  chemically synthesized
gggaccctttgggggatattaa

SEQ ID NO: 982018 - DNA, 22 bp, Artificial Sequence
  chemically synthesized
cctcaagatctcttaatatccc

SEQ ID NO: 982019 - DNA, 22 bp, Artificial Sequence
  chemically synthesized
acctcaagatctcttaatatcc

SEQ ID NO: 982020 - DNA, 22 bp, Artificial Sequence
  chemically synthesized
gcatttacctcaagatctctta

SEQ ID NO: 982021 - DNA, 22 bp, Artificial Sequence
  chemically synthesized
agcatttacctcaagatctctt

SEQ ID NO: 982022 - DNA, 22 bp, Artificial Sequence
  chemically synthesized
tgggggatattaagagatcttg

SEQ ID NO: 982023 - DNA, 22 bp, Artificial Sequence
  chemically synthesized
gggggatattaagagatcttga

SEQ ID NO: 982024 - DNA, 22 bp, Artificial Sequence
  chemically synthesized
ggggatattaagagatcttgag

SEQ ID NO: 982025 - DNA, 22 bp, Artificial Sequence
  chemically synthesized
gtttagcatttacctcaagatc

SEQ ID NO: 982026 - DNA, 22 bp, Artificial Sequence
  chemically synthesized
ggtttagcatttacctcaagat

SEQ ID NO: 982027 - DNA, 22 bp, Artificial Sequence
  chemically synthesized
tttggtttagcatttacctcaa

SEQ ID NO: 982028 - DNA, 22 bp, Artificial Sequence
  chemically synthesized
agagatcttgaggtaaatgcta

SEQ ID NO: 982029 - DNA, 22 bp, Artificial Sequence
  chemically synthesized
aactgtttggtttagcatttac

SEQ ID NO: 982030 - DNA, 22 bp, Artificial Sequence
  chemically synthesized
gaggtaaatgctaaaccaaaca

SEQ ID NO: 982031 - DNA, 22 bp, Artificial Sequence
  chemically synthesized
aggtaaatgctaaaccaaacag

SEQ ID NO: 982032 - DNA, 22 bp, Artificial Sequence
  chemically synthesized
aatacaaactaaactgtttggt

SEQ ID NO: 982033 - DNA, 22 bp, Artificial Sequence
  chemically synthesized
tcctgaatacaaactaaactgt

SEQ ID NO: 982034 - DNA, 22 bp, Artificial Sequence
  chemically synthesized
ctgtcctgaatacaaactaaac

SEQ ID NO: 982035 - DNA, 22 bp, Artificial Sequence
  chemically synthesized
aaccaaacagtttagtttgtat

SEQ ID NO: 982036 - DNA, 22 bp, Artificial Sequence
  chemically synthesized
agtttgtattcaggacagtaga

SEQ ID NO: 982037 - DNA, 22 bp, Artificial Sequence
  chemically synthesized
gtttgtattcaggacagtagac

SEQ ID NO: 982038 - DNA, 22 bp, Artificial Sequence
  chemically synthesized
gtattcaggacagtagacacgt

SEQ ID NO: 982039 - DNA, 22 bp, Artificial Sequence
  chemically synthesized
tattcaggacagtagacacgtt

SEQ ID NO: 982040 - DNA, 22 bp, Artificial Sequence
  chemically synthesized
aggacagtagacacgttttata

SEQ ID NO: 982041 - DNA, 22 bp, Artificial Sequence
  chemically synthesized
aagtaggatgatagtatataaa

SEQ ID NO: 982042 - DNA, 22 bp, Artificial Sequence
  chemically synthesized
atgttaaagtaggatgatagta

SEQ ID NO: 982043 - DNA, 22 bp, Artificial Sequence
  chemically synthesized
tatatactatcatcctacttta

SEQ ID NO: 982044 - DNA, 22 bp, Artificial Sequence
  chemically synthesized
atatactatcatcctactttaa

SEQ ID NO: 982045 - DNA, 22 bp, Artificial Sequence
  chemically synthesized
atataattaatgttaaagtagg

SEQ ID NO: 982046 - DNA, 22 bp, Artificial Sequence
  chemically synthesized
tatactatcatcctactttaac

SEQ ID NO: 982047 - DNA, 22 bp, Artificial Sequence
  chemically synthesized
aatataattaatgttaaagtag

SEQ ID NO: 982048 - DNA, 22 bp, Artificial Sequence
  chemically synthesized
taatataattaatgttaaagta

SEQ ID NO: 982049 - DNA, 22 bp, Artificial Sequence
  chemically synthesized
ttaatataattaatgttaaagt

SEQ ID NO: 982050 - DNA, 22 bp, Artificial Sequence
  chemically synthesized
tttaatataattaatgttaaag

SEQ ID NO: 982051 - DNA, 22 bp, Artificial Sequence
  chemically synthesized
tcatcctactttaacattaatt

SEQ ID NO: 982052 - DNA, 22 bp, Artificial Sequence
  chemically synthesized
ctttaacattaattatattaaa

SEQ ID NO: 982053 - DNA, 22 bp, Artificial Sequence
  chemically synthesized
aaagaagaattttttaatataa

SEQ ID NO: 982054 - DNA, 22 bp, Artificial Sequence
  chemically synthesized
taacattaattatattaaaaaa

SEQ ID NO: 982055 - DNA, 22 bp, Artificial Sequence
  chemically synthesized
aacattaattatattaaaaaat

SEQ ID NO: 982056 - DNA, 22 bp, Artificial Sequence
  chemically synthesized
acattaattatattaaaaaatt

SEQ ID NO: 982057 - DNA, 22 bp, Artificial Sequence
  chemically synthesized
attatattaaaaaattcttctt

SEQ ID NO: 982058 - DNA, 22 bp, Artificial Sequence
  chemically synthesized
gatagcccagttaaaagaagaa

SEQ ID NO: 982059 - DNA, 22 bp, Artificial Sequence
  chemically synthesized
tattaaaaaattcttcttttaa

SEQ ID NO: 982060 - DNA, 22 bp, Artificial Sequence
  chemically synthesized
attagatagcccagttaaaaga

SEQ ID NO: 982061 - DNA, 22 bp, Artificial Sequence
  chemically synthesized
aaaaattcttcttttaactggg

SEQ ID NO: 982062 - DNA, 22 bp, Artificial Sequence
  chemically synthesized
ttaattagatagcccagttaaa

SEQ ID NO: 982063 - DNA, 22 bp, Artificial Sequence
  chemically synthesized
attaattagatagcccagttaa

SEQ ID NO: 982064 - DNA, 22 bp, Artificial Sequence
  chemically synthesized
gccttattaattagatagccca

SEQ ID NO: 982065 - DNA, 22 bp, Artificial Sequence
  chemically synthesized
ttcttttaactgggctatctaa

SEQ ID NO: 982066 - DNA, 22 bp, Artificial Sequence
  chemically synthesized
ctggccttattaattagatagc

SEQ ID NO: 982067 - DNA, 22 bp, Artificial Sequence
  chemically synthesized
cttttaactgggctatctaatt

SEQ ID NO: 982068 - DNA, 22 bp, Artificial Sequence
  chemically synthesized
ttttaactgggctatctaatta

SEQ ID NO: 982069 - DNA, 22 bp, Artificial Sequence
  chemically synthesized
ttaactgggctatctaattaat

SEQ ID NO: 982070 - DNA, 22 bp, Artificial Sequence
  chemically synthesized
taactgggctatctaattaata

SEQ ID NO: 982071 - DNA, 22 bp, Artificial Sequence
  chemically synthesized
aactgggctatctaattaataa

SEQ ID NO: 982072 - DNA, 22 bp, Artificial Sequence
  chemically synthesized
actgggctatctaattaataag

SEQ ID NO: 982073 - DNA, 22 bp, Artificial Sequence
  chemically synthesized
ggctatctaattaataaggcca

SEQ ID NO: 982074 - DNA, 22 bp, Artificial Sequence
  chemically synthesized
gtcaaggaatgttgctggcctt

SEQ ID NO: 982075 - DNA, 22 bp, Artificial Sequence
  chemically synthesized
tctaattaataaggccagcaac

SEQ ID NO: 982076 - DNA, 22 bp, Artificial Sequence
  chemically synthesized
attaataaggccagcaacattc

SEQ ID NO: 982077 - DNA, 22 bp, Artificial Sequence
  chemically synthesized
ataaggccagcaacattccttg

SEQ ID NO: 982078 - DNA, 22 bp, Artificial Sequence
  chemically synthesized
tacaagcatattggtcaaggaa

SEQ ID NO: 982079 - DNA, 22 bp, Artificial Sequence
  chemically synthesized
atacaagcatattggtcaagga

SEQ ID NO: 982080 - DNA, 22 bp, Artificial Sequence
  chemically synthesized
agcttatacaagcatattggtc

SEQ ID NO: 982081 - DNA, 22 bp, Artificial Sequence
  chemically synthesized
cttgaccaatatgcttgtataa

SEQ ID NO: 982082 - DNA, 22 bp, Artificial Sequence
  chemically synthesized
gaccaatatgcttgtataagct

SEQ ID NO: 982083 - DNA, 22 bp, Artificial Sequence
  chemically synthesized
accaatatgcttgtataagctt

SEQ ID NO: 982084 - DNA, 22 bp, Artificial Sequence
  chemically synthesized
tacacaaaaataaactaagctt

SEQ ID NO: 982085 - DNA, 22 bp, Artificial Sequence
  chemically synthesized
gtataagcttagtttatttttg

SEQ ID NO: 982086 - DNA, 22 bp, Artificial Sequence
  chemically synthesized
tataagcttagtttatttttgt

SEQ ID NO: 982087 - DNA, 22 bp, Artificial Sequence
  chemically synthesized
aatatataaatcctatacacaa

SEQ ID NO: 982088 - DNA, 22 bp, Artificial Sequence
  chemically synthesized
agtttatttttgtgtataggat

SEQ ID NO: 982089 - DNA, 22 bp, Artificial Sequence
  chemically synthesized
gtttatttttgtgtataggatt

SEQ ID NO: 982090 - DNA, 22 bp, Artificial Sequence
  chemically synthesized
atttttgtgtataggatttata

SEQ ID NO: 982091 - DNA, 22 bp, Artificial Sequence
  chemically synthesized
tttttgtgtataggatttatat

SEQ ID NO: 982092 - DNA, 22 bp, Artificial Sequence
  chemically synthesized
ttgtgtataggatttatatatt

SEQ ID NO: 982093 - DNA, 22 bp, Artificial Sequence
  chemically synthesized
tgtgtataggatttatatattc

SEQ ID NO: 982094 - DNA, 22 bp, Artificial Sequence
  chemically synthesized
atcagtacaattgaatatataa

SEQ ID NO: 982095 - DNA, 22 bp, Artificial Sequence
  chemically synthesized
gtgtataggatttatatattca

SEQ ID NO: 982096 - DNA, 22 bp, Artificial Sequence
  chemically synthesized
catcagtacaattgaatatata

SEQ ID NO: 982097 - DNA, 22 bp, Artificial Sequence
  chemically synthesized
tgtataggatttatatattcaa

SEQ ID NO: 982098 - DNA, 22 bp, Artificial Sequence
  chemically synthesized
tcatcagtacaattgaatatat

SEQ ID NO: 982099 - DNA, 22 bp, Artificial Sequence
  chemically synthesized
ttcatcagtacaattgaatata

SEQ ID NO: 982100 - DNA, 22 bp, Artificial Sequence
  chemically synthesized
tttcatcagtacaattgaatat

SEQ ID NO: 982101 - DNA, 22 bp, Artificial Sequence
  chemically synthesized
ttttcatcagtacaattgaata

SEQ ID NO: 982102 - DNA, 22 bp, Artificial Sequence
  chemically synthesized
atacttttttcatcagtacaat

SEQ ID NO: 982103 - DNA, 22 bp, Artificial Sequence
  chemically synthesized
atatattcaattgtactgatga

SEQ ID NO: 982104 - DNA, 22 bp, Artificial Sequence
  chemically synthesized
ctgatacttttttcatcagtac

SEQ ID NO: 982105 - DNA, 22 bp, Artificial Sequence
  chemically synthesized
tatattcaattgtactgatgaa

SEQ ID NO: 982106 - DNA, 22 bp, Artificial Sequence
  chemically synthesized
aattgtactgatgaaaaaagta

SEQ ID NO: 982107 - DNA, 22 bp, Artificial Sequence
  chemically synthesized
tactgatgaaaaaagtatcagg

SEQ ID NO: 982108 - DNA, 22 bp, Artificial Sequence
  chemically synthesized
atgaaaaaagtatcaggagctt

SEQ ID NO: 982109 - DNA, 22 bp, Artificial Sequence
  chemically synthesized
tcacaaaggaagatcagaagct

SEQ ID NO: 982110 - DNA, 22 bp, Artificial Sequence
  chemically synthesized
actgtcacaaaggaagatcaga

SEQ ID NO: 982111 - DNA, 22 bp, Artificial Sequence
  chemically synthesized
tcactgtcacaaaggaagatca

SEQ ID NO: 982112 - DNA, 22 bp, Artificial Sequence
  chemically synthesized
ctcactgtcacaaaggaagatc

SEQ ID NO: 982113 - DNA, 22 bp, Artificial Sequence
  chemically synthesized
tatttctcactgtcacaaagga

SEQ ID NO: 982114 - DNA, 22 bp, Artificial Sequence
  chemically synthesized
tgtatttctcactgtcacaaag

SEQ ID NO: 982115 - DNA, 22 bp, Artificial Sequence
  chemically synthesized
ctgatcttcctttgtgacagtg

SEQ ID NO: 982116 - DNA, 22 bp, Artificial Sequence
  chemically synthesized
tgatcttcctttgtgacagtga

SEQ ID NO: 982117 - DNA, 22 bp, Artificial Sequence
  chemically synthesized
atcttcctttgtgacagtgaga

SEQ ID NO: 982118 - DNA, 22 bp, Artificial Sequence
  chemically synthesized
agagttctgtatttctcactgt

SEQ ID NO: 982119 - DNA, 22 bp, Artificial Sequence
  chemically synthesized
cctttgtgacagtgagaaatac

SEQ ID NO: 982120 - DNA, 22 bp, Artificial Sequence
  chemically synthesized
ctttgtgacagtgagaaataca

SEQ ID NO: 982121 - DNA, 22 bp, Artificial Sequence
  chemically synthesized
agtgctgagagttctgtatttc

SEQ ID NO: 982122 - DNA, 22 bp, Artificial Sequence
  chemically synthesized
tgtgacagtgagaaatacagaa

SEQ ID NO: 982123 - DNA, 22 bp, Artificial Sequence
  chemically synthesized
gtgacagtgagaaatacagaac

SEQ ID NO: 982124 - DNA, 22 bp, Artificial Sequence
  chemically synthesized
tgacagtgagaaatacagaact

SEQ ID NO: 982125 - DNA, 22 bp, Artificial Sequence
  chemically synthesized
ttaagtgctgagagttctgtat

SEQ ID NO: 982126 - DNA, 22 bp, Artificial Sequence
  chemically synthesized
gacagagttgttaagtgctgag

SEQ ID NO: 982127 - DNA, 22 bp, Artificial Sequence
  chemically synthesized
ggacagagttgttaagtgctga

SEQ ID NO: 982128 - DNA, 22 bp, Artificial Sequence
  chemically synthesized
tcagcacttaacaactctgtcc

SEQ ID NO: 982129 - DNA, 22 bp, Artificial Sequence
  chemically synthesized
gtgcaagggtttggacagagtt

SEQ ID NO: 982130 - DNA, 22 bp, Artificial Sequence
  chemically synthesized
agtgcaagggtttggacagagt

SEQ ID NO: 982131 - DNA, 22 bp, Artificial Sequence
  chemically synthesized
agcacttaacaactctgtccaa

SEQ ID NO: 982132 - DNA, 22 bp, Artificial Sequence
  chemically synthesized
aacaactctgtccaaacccttg

SEQ ID NO: 982133 - DNA, 22 bp, Artificial Sequence
  chemically synthesized
acaactctgtccaaacccttgc

SEQ ID NO: 982134 - DNA, 22 bp, Artificial Sequence
  chemically synthesized
gtcaagtcttagtgcaagggtt

SEQ ID NO: 982135 - DNA, 22 bp, Artificial Sequence
  chemically synthesized
agtcaagtcttagtgcaagggt

SEQ ID NO: 982136 - DNA, 22 bp, Artificial Sequence
  chemically synthesized
tgtccaaacccttgcactaaga

SEQ ID NO: 982137 - DNA, 22 bp, Artificial Sequence
  chemically synthesized
gagtttagtcaagtcttagtgc

SEQ ID NO: 982138 - DNA, 22 bp, Artificial Sequence
  chemically synthesized
tccaaacccttgcactaagact

SEQ ID NO: 982139 - DNA, 22 bp, Artificial Sequence
  chemically synthesized
gcactaagacttgactaaactc

SEQ ID NO: 982140 - DNA, 22 bp, Artificial Sequence
  chemically synthesized
gaaaccatactagagtttagtc

SEQ ID NO: 982141 - DNA, 22 bp, Artificial Sequence
  chemically synthesized
cactaagacttgactaaactct

SEQ ID NO: 982142 - DNA, 22 bp, Artificial Sequence
  chemically synthesized
agacttgactaaactctagtat

SEQ ID NO: 982143 - DNA, 22 bp, Artificial Sequence
  chemically synthesized
gggctagaaaccatactagagt

SEQ ID NO: 982144 - DNA, 22 bp, Artificial Sequence
  chemically synthesized
tggggctagaaaccatactaga

SEQ ID NO: 982145 - DNA, 22 bp, Artificial Sequence
  chemically synthesized
ctggggctagaaaccatactag

SEQ ID NO: 982146 - DNA, 22 bp, Artificial Sequence
  chemically synthesized
gactaaactctagtatggtttc

SEQ ID NO: 982147 - DNA, 22 bp, Artificial Sequence
  chemically synthesized
actaaactctagtatggtttct

SEQ ID NO: 982148 - DNA, 22 bp, Artificial Sequence
  chemically synthesized
aactctagtatggtttctagcc

SEQ ID NO: 982149 - DNA, 22 bp, Artificial Sequence
  chemically synthesized
tagtatggtttctagccccaga

SEQ ID NO: 982150 - DNA, 22 bp, Artificial Sequence
  chemically synthesized
gggacatggccttctggggcta

SEQ ID NO: 982151 - DNA, 22 bp, Artificial Sequence
  chemically synthesized
gtatggtttctagccccagaag

SEQ ID NO: 982152 - DNA, 22 bp, Artificial Sequence
  chemically synthesized
ctagccccagaaggccatgtcc

SEQ ID NO: 982153 - DNA, 22 bp, Artificial Sequence
  chemically synthesized
gggtcatcctagggacatggcc

SEQ ID NO: 982154 - DNA, 22 bp, Artificial Sequence
  chemically synthesized
tagccccagaaggccatgtccc

SEQ ID NO: 982155 - DNA, 22 bp, Artificial Sequence
  chemically synthesized
gccccagaaggccatgtcccta

SEQ ID NO: 982156 - DNA, 22 bp, Artificial Sequence
  chemically synthesized
agggaaggctagggtcatccta

SEQ ID NO: 982157 - DNA, 22 bp, Artificial Sequence
  chemically synthesized
aagggaaggctagggtcatcct

SEQ ID NO: 982158 - DNA, 22 bp, Artificial Sequence
  chemically synthesized
aagcaggcacttaagggaaggc

SEQ ID NO: 982159 - DNA, 22 bp, Artificial Sequence
  chemically synthesized
ggatgaccctagccttccctta

SEQ ID NO: 982160 - DNA, 22 bp, Artificial Sequence
  chemically synthesized
tcaagcaggcacttaagggaag

SEQ ID NO: 982161 - DNA, 22 bp, Artificial Sequence
  chemically synthesized
ctcaagcaggcacttaagggaa

SEQ ID NO: 982162 - DNA, 22 bp, Artificial Sequence
  chemically synthesized
tctcaagcaggcacttaaggga

SEQ ID NO: 982163 - DNA, 22 bp, Artificial Sequence
  chemically synthesized
agctttctcaagcaggcactta

SEQ ID NO: 982164 - DNA, 22 bp, Artificial Sequence
  chemically synthesized
gccttcccttaagtgcctgctt

SEQ ID NO: 982165 - DNA, 22 bp, Artificial Sequence
  chemically synthesized
cccttaagtgcctgcttgagaa

SEQ ID NO: 982166 - DNA, 22 bp, Artificial Sequence
  chemically synthesized
ccttaagtgcctgcttgagaaa

SEQ ID NO: 982167 - DNA, 22 bp, Artificial Sequence
  chemically synthesized
gcagcactgagctttctcaagc

SEQ ID NO: 982168 - DNA, 22 bp, Artificial Sequence
  chemically synthesized
ctggcagcactgagctttctca

SEQ ID NO: 982169 - DNA, 22 bp, Artificial Sequence
  chemically synthesized
aagtgcctgcttgagaaagctc

SEQ ID NO: 982170 - DNA, 22 bp, Artificial Sequence
  chemically synthesized
cctggcagcactgagctttctc

SEQ ID NO: 982171 - DNA, 22 bp, Artificial Sequence
  chemically synthesized
agtgcctgcttgagaaagctca

SEQ ID NO: 982172 - DNA, 22 bp, Artificial Sequence
  chemically synthesized
tcctggcagcactgagctttct

SEQ ID NO: 982173 - DNA, 22 bp, Artificial Sequence
  chemically synthesized
aattttcctggcagcactgagc

SEQ ID NO: 982174 - DNA, 22 bp, Artificial Sequence
  chemically synthesized
cttgagaaagctcagtgctgcc

SEQ ID NO: 982175 - DNA, 22 bp, Artificial Sequence
  chemically synthesized
gagaaagctcagtgctgccagg

SEQ ID NO: 982176 - DNA, 22 bp, Artificial Sequence
  chemically synthesized
agaaagctcagtgctgccagga

SEQ ID NO: 982177 - DNA, 22 bp, Artificial Sequence
  chemically synthesized
gaacaaacattaaattttcctg

SEQ ID NO: 982178 - DNA, 22 bp, Artificial Sequence
  chemically synthesized
agtgctgccaggaaaatttaat

SEQ ID NO: 982179 - DNA, 22 bp, Artificial Sequence
  chemically synthesized
gctagaacaaacattaaatttt

SEQ ID NO: 982180 - DNA, 22 bp, Artificial Sequence
  chemically synthesized
ccaggaaaatttaatgtttgtt

SEQ ID NO: 982181 - DNA, 22 bp, Artificial Sequence
  chemically synthesized
tcaacagatgtgtgttggctag

SEQ ID NO: 982182 - DNA, 22 bp, Artificial Sequence
  chemically synthesized
aatgtttgttctagccaacaca

SEQ ID NO: 982183 - DNA, 22 bp, Artificial Sequence
  chemically synthesized
atgtttgttctagccaacacac

SEQ ID NO: 982184 - DNA, 22 bp, Artificial Sequence
  chemically synthesized
gttctagccaacacacatctgt

SEQ ID NO: 982185 - DNA, 22 bp, Artificial Sequence
  chemically synthesized
ttctagccaacacacatctgtt

SEQ ID NO: 982186 - DNA, 22 bp, Artificial Sequence
  chemically synthesized
tagccaacacacatctgttgat

SEQ ID NO: 982187 - DNA, 22 bp, Artificial Sequence
  chemically synthesized
gccaacacacatctgttgatag

SEQ ID NO: 982188 - DNA, 22 bp, Artificial Sequence
  chemically synthesized
agaaacggaggtaagagtccta

SEQ ID NO: 982189 - DNA, 22 bp, Artificial Sequence
  chemically synthesized
taagaaacggaggtaagagtcc

SEQ ID NO: 982190 - DNA, 22 bp, Artificial Sequence
  chemically synthesized
ttgataggactcttacctccgt

SEQ ID NO: 982191 - DNA, 22 bp, Artificial Sequence
  chemically synthesized
ataggactcttacctccgtttc

SEQ ID NO: 982192 - DNA, 22 bp, Artificial Sequence
  chemically synthesized
agtaaatgttctaagaaacgga

SEQ ID NO: 982193 - DNA, 22 bp, Artificial Sequence
  chemically synthesized
gagtaaatgttctaagaaacgg

SEQ ID NO: 982194 - DNA, 22 bp, Artificial Sequence
  chemically synthesized
tgagtaaatgttctaagaaacg

SEQ ID NO: 982195 - DNA, 22 bp, Artificial Sequence
  chemically synthesized
ttgagtaaatgttctaagaaac

SEQ ID NO: 982196 - DNA, 22 bp, Artificial Sequence
  chemically synthesized
ttacctccgtttcttagaacat

SEQ ID NO: 982197 - DNA, 22 bp, Artificial Sequence
  chemically synthesized
acctccgtttcttagaacattt

SEQ ID NO: 982198 - DNA, 22 bp, Artificial Sequence
  chemically synthesized
cctccgtttcttagaacattta

SEQ ID NO: 982199 - DNA, 22 bp, Artificial Sequence
  chemically synthesized
taagcccttttgagtaaatgtt

SEQ ID NO: 982200 - DNA, 22 bp, Artificial Sequence
  chemically synthesized
cgtttcttagaacatttactca

SEQ ID NO: 982201 - DNA, 22 bp, Artificial Sequence
  chemically synthesized
cttagaacatttactcaaaagg

SEQ ID NO: 982202 - DNA, 22 bp, Artificial Sequence
  chemically synthesized
acaattgtaagcccttttgagt

SEQ ID NO: 982203 - DNA, 22 bp, Artificial Sequence
  chemically synthesized
ttagaacatttactcaaaaggg

SEQ ID NO: 982204 - DNA, 22 bp, Artificial Sequence
  chemically synthesized
agaacatttactcaaaagggct

SEQ ID NO: 982205 - DNA, 22 bp, Artificial Sequence
  chemically synthesized
gaacatttactcaaaagggctt

SEQ ID NO: 982206 - DNA, 22 bp, Artificial Sequence
  chemically synthesized
catgttcacaattgtaagccct

SEQ ID NO: 982207 - DNA, 22 bp, Artificial Sequence
  chemically synthesized
actcaaaagggcttacaattgt

SEQ ID NO: 982208 - DNA, 22 bp, Artificial Sequence
  chemically synthesized
ctcaaaagggcttacaattgtg

SEQ ID NO: 982209 - DNA, 22 bp, Artificial Sequence
  chemically synthesized
aaaagggcttacaattgtgaac

SEQ ID NO: 982210 - DNA, 22 bp, Artificial Sequence
  chemically synthesized
caagagctacatgttcacaatt

SEQ ID NO: 982211 - DNA, 22 bp, Artificial Sequence
  chemically synthesized
ccaagagctacatgttcacaat

SEQ ID NO: 982212 - DNA, 22 bp, Artificial Sequence
  chemically synthesized
atttccaagagctacatgttca

SEQ ID NO: 982213 - DNA, 22 bp, Artificial Sequence
  chemically synthesized
tgatttccaagagctacatgtt

SEQ ID NO: 982214 - DNA, 22 bp, Artificial Sequence
  chemically synthesized
ctgatttccaagagctacatgt

SEQ ID NO: 982215 - DNA, 22 bp, Artificial Sequence
  chemically synthesized
acaattgtgaacatgtagctct

SEQ ID NO: 982216 - DNA, 22 bp, Artificial Sequence
  chemically synthesized
caattgtgaacatgtagctctt

SEQ ID NO: 982217 - DNA, 22 bp, Artificial Sequence
  chemically synthesized
tgaacatgtagctcttggaaat

SEQ ID NO: 982218 - DNA, 22 bp, Artificial Sequence
  chemically synthesized
agtgagagacacttctgatttc

SEQ ID NO: 982219 - DNA, 22 bp, Artificial Sequence
  chemically synthesized
gagtgagagacacttctgattt

SEQ ID NO: 982220 - DNA, 22 bp, Artificial Sequence
  chemically synthesized
ttggaaatcagaagtgtctctc

SEQ ID NO: 982221 - DNA, 22 bp, Artificial Sequence
  chemically synthesized
aggtccttgagtgagagacact

SEQ ID NO: 982222 - DNA, 22 bp, Artificial Sequence
  chemically synthesized
caggtccttgagtgagagacac

SEQ ID NO: 982223 - DNA, 22 bp, Artificial Sequence
  chemically synthesized
ggaaatcagaagtgtctctcac

SEQ ID NO: 982224 - DNA, 22 bp, Artificial Sequence
  chemically synthesized
tcaggtccttgagtgagagaca

SEQ ID NO: 982225 - DNA, 22 bp, Artificial Sequence
  chemically synthesized
gaaatcagaagtgtctctcact

SEQ ID NO: 982226 - DNA, 22 bp, Artificial Sequence
  chemically synthesized
aaaagaatggctttcaggtcct

SEQ ID NO: 982227 - DNA, 22 bp, Artificial Sequence
  chemically synthesized
gaaaagaatggctttcaggtcc

SEQ ID NO: 982228 - DNA, 22 bp, Artificial Sequence
  chemically synthesized
tcactcaaggacctgaaagcca

SEQ ID NO: 982229 - DNA, 22 bp, Artificial Sequence
  chemically synthesized
actcaaggacctgaaagccatt

SEQ ID NO: 982230 - DNA, 22 bp, Artificial Sequence
  chemically synthesized
aaggacctgaaagccattcttt

SEQ ID NO: 982231 - DNA, 22 bp, Artificial Sequence
  chemically synthesized
atgatgtcatttgaaaagaatg

SEQ ID NO: 982232 - DNA, 22 bp, Artificial Sequence
  chemically synthesized
gatgatgtcatttgaaaagaat

SEQ ID NO: 982233 - DNA, 22 bp, Artificial Sequence
  chemically synthesized
ttgatgatgtcatttgaaaaga

SEQ ID NO: 982234 - DNA, 22 bp, Artificial Sequence
  chemically synthesized
cttgatgatgtcatttgaaaag

SEQ ID NO: 982235 - DNA, 22 bp, Artificial Sequence
  chemically synthesized
aaagccattcttttcaaatgac

SEQ ID NO: 982236 - DNA, 22 bp, Artificial Sequence
  chemically synthesized
tccttcttgatgatgtcatttg

SEQ ID NO: 982237 - DNA, 22 bp, Artificial Sequence
  chemically synthesized
atccttcttgatgatgtcattt

SEQ ID NO: 982238 - DNA, 22 bp, Artificial Sequence
  chemically synthesized
ttttcaaatgacatcatcaaga

SEQ ID NO: 982239 - DNA, 22 bp, Artificial Sequence
  chemically synthesized
ttcaaatgacatcatcaagaag

SEQ ID NO: 982240 - DNA, 22 bp, Artificial Sequence
  chemically synthesized
tcaaatgacatcatcaagaagg

SEQ ID NO: 982241 - DNA, 22 bp, Artificial Sequence
  chemically synthesized
caaatgacatcatcaagaagga

SEQ ID NO: 982242 - DNA, 22 bp, Artificial Sequence
  chemically synthesized
aaatgacatcatcaagaaggat

SEQ ID NO: 982243 - DNA, 22 bp, Artificial Sequence
  chemically synthesized
ccacagagaacaggagacagag

SEQ ID NO: 982244 - DNA, 22 bp, Artificial Sequence
  chemically synthesized
cccacagagaacaggagacaga

SEQ ID NO: 982245 - DNA, 22 bp, Artificial Sequence
  chemically synthesized
tcttcccacagagaacaggaga

SEQ ID NO: 982246 - DNA, 22 bp, Artificial Sequence
  chemically synthesized
tatcttcccacagagaacagga

SEQ ID NO: 982247 - DNA, 22 bp, Artificial Sequence
  chemically synthesized
ggattctatcttcccacagaga

SEQ ID NO: 982248 - DNA, 22 bp, Artificial Sequence
  chemically synthesized
tgtctcctgttctctgtgggaa

SEQ ID NO: 982249 - DNA, 22 bp, Artificial Sequence
  chemically synthesized
tctcctgttctctgtgggaaga

SEQ ID NO: 982250 - DNA, 22 bp, Artificial Sequence
  chemically synthesized
aagttaggattctatcttccca

SEQ ID NO: 982251 - DNA, 22 bp, Artificial Sequence
  chemically synthesized
ctgttctctgtgggaagataga

SEQ ID NO: 982252 - DNA, 22 bp, Artificial Sequence
  chemically synthesized
ttgaagttaggattctatcttc

SEQ ID NO: 982253 - DNA, 22 bp, Artificial Sequence
  chemically synthesized
ttctctgtgggaagatagaatc

SEQ ID NO: 982254 - DNA, 22 bp, Artificial Sequence
  chemically synthesized
tctgtgggaagatagaatccta

SEQ ID NO: 982255 - DNA, 22 bp, Artificial Sequence
  chemically synthesized
tgtgggaagatagaatcctaac

SEQ ID NO: 982256 - DNA, 22 bp, Artificial Sequence
  chemically synthesized
gaagttattgaagttaggattc

SEQ ID NO: 982257 - DNA, 22 bp, Artificial Sequence
  chemically synthesized
tgggaagatagaatcctaactt

SEQ ID NO: 982258 - DNA, 22 bp, Artificial Sequence
  chemically synthesized
gctggaagttattgaagttagg

SEQ ID NO: 982259 - DNA, 22 bp, Artificial Sequence
  chemically synthesized
tgttagctggaagttattgaag

SEQ ID NO: 982260 - DNA, 22 bp, Artificial Sequence
  chemically synthesized
ggccagctgtgttagctggaag

SEQ ID NO: 982261 - DNA, 22 bp, Artificial Sequence
  chemically synthesized
acttcaataacttccagctaac

SEQ ID NO: 982262 - DNA, 22 bp, Artificial Sequence
  chemically synthesized
caataacttccagctaacacag

SEQ ID NO: 982263 - DNA, 22 bp, Artificial Sequence
  chemically synthesized
aataacttccagctaacacagc

SEQ ID NO: 982264 - DNA, 22 bp, Artificial Sequence
  chemically synthesized
ccagctaacacagctggcctaa

SEQ ID NO: 982265 - DNA, 22 bp, Artificial Sequence
  chemically synthesized
cagctaacacagctggcctaat

SEQ ID NO: 982266 - DNA, 22 bp, Artificial Sequence
  chemically synthesized
gacagtgtaaatgtgattaggc

SEQ ID NO: 982267 - DNA, 22 bp, Artificial Sequence
  chemically synthesized
acacagctggcctaatcacatt

SEQ ID NO: 982268 - DNA, 22 bp, Artificial Sequence
  chemically synthesized
gcctaatcacatttacactgtc

SEQ ID NO: 982269 - DNA, 22 bp, Artificial Sequence
  chemically synthesized
atcacatttacactgtccagcc

SEQ ID NO: 982270 - DNA, 22 bp, Artificial Sequence
  chemically synthesized
acactgtccagccctttgtact

SEQ ID NO: 982271 - DNA, 22 bp, Artificial Sequence
  chemically synthesized
gagaagtaaaaaagtacaaagg

SEQ ID NO: 982272 - DNA, 22 bp, Artificial Sequence
  chemically synthesized
cactgtccagccctttgtactt

SEQ ID NO: 982273 - DNA, 22 bp, Artificial Sequence
  chemically synthesized
tccagccctttgtactttttta

SEQ ID NO: 982274 - DNA, 22 bp, Artificial Sequence
  chemically synthesized
gagttagagaagtaaaaaagta

SEQ ID NO: 982275 - DNA, 22 bp, Artificial Sequence
  chemically synthesized
attcgagttagagaagtaaaaa

SEQ ID NO: 982276 - DNA, 22 bp, Artificial Sequence
  chemically synthesized
tgtacttttttacttctctaac

SEQ ID NO: 982277 - DNA, 22 bp, Artificial Sequence
  chemically synthesized
gtacttttttacttctctaact

SEQ ID NO: 982278 - DNA, 22 bp, Artificial Sequence
  chemically synthesized
tacttttttacttctctaactc

SEQ ID NO: 982279 - DNA, 22 bp, Artificial Sequence
  chemically synthesized
ttttacttctctaactcgaatg

SEQ ID NO: 982280 - DNA, 22 bp, Artificial Sequence
  chemically synthesized
tttacttctctaactcgaatga

SEQ ID NO: 982281 - DNA, 22 bp, Artificial Sequence
  chemically synthesized
ttacttctctaactcgaatgaa

SEQ ID NO: 982282 - DNA, 22 bp, Artificial Sequence
  chemically synthesized
tacttctctaactcgaatgaac

SEQ ID NO: 982283 - DNA, 22 bp, Artificial Sequence
  chemically synthesized
acttctctaactcgaatgaacc

SEQ ID NO: 982284 - DNA, 22 bp, Artificial Sequence
  chemically synthesized
cttctctaactcgaatgaaccc

SEQ ID NO: 982285 - DNA, 22 bp, Artificial Sequence
  chemically synthesized
ctctaactcgaatgaaccccca

SEQ ID NO: 982286 - DNA, 22 bp, Artificial Sequence
  chemically synthesized
tctaactcgaatgaacccccac

SEQ ID NO: 982287 - DNA, 22 bp, Artificial Sequence
  chemically synthesized
taactcgaatgaacccccactc

SEQ ID NO: 982288 - DNA, 22 bp, Artificial Sequence
  chemically synthesized
actcgaatgaacccccactcct

SEQ ID NO: 982289 - DNA, 22 bp, Artificial Sequence
  chemically synthesized
gaatgaacccccactccttctc

SEQ ID NO: 982290 - DNA, 22 bp, Artificial Sequence
  chemically synthesized
aggcaagaaggagggagaagga

SEQ ID NO: 982291 - DNA, 22 bp, Artificial Sequence
  chemically synthesized
aaggcaagaaggagggagaagg

SEQ ID NO: 982292 - DNA, 22 bp, Artificial Sequence
  chemically synthesized
taaggcaagaaggagggagaag

SEQ ID NO: 982293 - DNA, 22 bp, Artificial Sequence
  chemically synthesized
ttttaaggcaagaaggagggag

SEQ ID NO: 982294 - DNA, 22 bp, Artificial Sequence
  chemically synthesized
gttgttttaaggcaagaaggag

SEQ ID NO: 982295 - DNA, 22 bp, Artificial Sequence
  chemically synthesized
ggttgttttaaggcaagaagga

SEQ ID NO: 982296 - DNA, 22 bp, Artificial Sequence
  chemically synthesized
cttctccctccttcttgcctta

SEQ ID NO: 982297 - DNA, 22 bp, Artificial Sequence
  chemically synthesized
ctccctccttcttgccttaaaa

SEQ ID NO: 982298 - DNA, 22 bp, Artificial Sequence
  chemically synthesized
tccctccttcttgccttaaaac

SEQ ID NO: 982299 - DNA, 22 bp, Artificial Sequence
  chemically synthesized
cctccttcttgccttaaaacaa

SEQ ID NO: 982300 - DNA, 22 bp, Artificial Sequence
  chemically synthesized
cttcttgccttaaaacaaccaa

SEQ ID NO: 982301 - DNA, 22 bp, Artificial Sequence
  chemically synthesized
tgcagaggcgacttggttgttt

SEQ ID NO: 982302 - DNA, 22 bp, Artificial Sequence
  chemically synthesized
gtgcagaggcgacttggttgtt

SEQ ID NO: 982303 - DNA, 22 bp, Artificial Sequence
  chemically synthesized
cttgccttaaaacaaccaagtc

SEQ ID NO: 982304 - DNA, 22 bp, Artificial Sequence
  chemically synthesized
ttgccttaaaacaaccaagtcg

SEQ ID NO: 982305 - DNA, 22 bp, Artificial Sequence
  chemically synthesized
atttgtgcagaggcgacttggt

SEQ ID NO: 982306 - DNA, 22 bp, Artificial Sequence
  chemically synthesized
gccttaaaacaaccaagtcgcc

SEQ ID NO: 982307 - DNA, 22 bp, Artificial Sequence
  chemically synthesized
ccttaaaacaaccaagtcgcct

SEQ ID NO: 982308 - DNA, 22 bp, Artificial Sequence
  chemically synthesized
taatttgtgcagaggcgacttg

SEQ ID NO: 982309 - DNA, 22 bp, Artificial Sequence
  chemically synthesized
aaaacaaccaagtcgcctctgc

SEQ ID NO: 982310 - DNA, 22 bp, Artificial Sequence
  chemically synthesized
aaacaaccaagtcgcctctgca

SEQ ID NO: 982311 - DNA, 22 bp, Artificial Sequence
  chemically synthesized
agatccattctaatttgtgcag

SEQ ID NO: 982312 - DNA, 22 bp, Artificial Sequence
  chemically synthesized
ggggagagctgagatccattct

SEQ ID NO: 982313 - DNA, 22 bp, Artificial Sequence
  chemically synthesized
tgcacaaattagaatggatctc

SEQ ID NO: 982314 - DNA, 22 bp, Artificial Sequence
  chemically synthesized
cacaaattagaatggatctcag

SEQ ID NO: 982315 - DNA, 22 bp, Artificial Sequence
  chemically synthesized
gtgaaattaggggagagctgag

SEQ ID NO: 982316 - DNA, 22 bp, Artificial Sequence
  chemically synthesized
gaatggatctcagctctcccct

SEQ ID NO: 982317 - DNA, 22 bp, Artificial Sequence
  chemically synthesized
aatacctcgtgaaattagggga

SEQ ID NO: 982318 - DNA, 22 bp, Artificial Sequence
  chemically synthesized
ttcaatacctcgtgaaattagg

SEQ ID NO: 982319 - DNA, 22 bp, Artificial Sequence
  chemically synthesized
attcaatacctcgtgaaattag

SEQ ID NO: 982320 - DNA, 22 bp, Artificial Sequence
  chemically synthesized
tattcaatacctcgtgaaatta

SEQ ID NO: 982321 - DNA, 22 bp, Artificial Sequence
  chemically synthesized
agctctcccctaatttcacgag

SEQ ID NO: 982322 - DNA, 22 bp, Artificial Sequence
  chemically synthesized
tcccctaatttcacgaggtatt

SEQ ID NO: 982323 - DNA, 22 bp, Artificial Sequence
  chemically synthesized
ccctaatttcacgaggtattga

SEQ ID NO: 982324 - DNA, 22 bp, Artificial Sequence
  chemically synthesized
atttcacgaggtattgaataaa

SEQ ID NO: 982325 - DNA, 22 bp, Artificial Sequence
  chemically synthesized
cacgaggtattgaataaaatct

SEQ ID NO: 982326 - DNA, 22 bp, Artificial Sequence
  chemically synthesized
acgaggtattgaataaaatctg

SEQ ID NO: 982327 - DNA, 22 bp, Artificial Sequence
  chemically synthesized
aagaggtaaaaacagattttat

SEQ ID NO: 982328 - DNA, 22 bp, Artificial Sequence
  chemically synthesized
gatattaaagaggtaaaaacag

SEQ ID NO: 982329 - DNA, 22 bp, Artificial Sequence
  chemically synthesized
aataaaatctgtttttacctct

SEQ ID NO: 982330 - DNA, 22 bp, Artificial Sequence
  chemically synthesized
tttttacctctttaatatccag

SEQ ID NO: 982331 - DNA, 22 bp, Artificial Sequence
  chemically synthesized
ttacctctttaatatccagctg

SEQ ID NO: 982332 - DNA, 22 bp, Artificial Sequence
  chemically synthesized
tacctctttaatatccagctgt

SEQ ID NO: 982333 - DNA, 22 bp, Artificial Sequence
  chemically synthesized
tcagagataaacacagctggat

SEQ ID NO: 982334 - DNA, 22 bp, Artificial Sequence
  chemically synthesized
acctctttaatatccagctgtg

SEQ ID NO: 982335 - DNA, 22 bp, Artificial Sequence
  chemically synthesized
cctctttaatatccagctgtgt

SEQ ID NO: 982336 - DNA, 22 bp, Artificial Sequence
  chemically synthesized
tttaatatccagctgtgtttat

SEQ ID NO: 982337 - DNA, 22 bp, Artificial Sequence
  chemically synthesized
taatatccagctgtgtttatct

SEQ ID NO: 982338 - DNA, 22 bp, Artificial Sequence
  chemically synthesized
aatatccagctgtgtttatctc

SEQ ID NO: 982339 - DNA, 22 bp, Artificial Sequence
  chemically synthesized
atatccagctgtgtttatctct

SEQ ID NO: 982340 - DNA, 22 bp, Artificial Sequence
  chemically synthesized
agagcatatatattgtcagaga

SEQ ID NO: 982341 - DNA, 22 bp, Artificial Sequence
  chemically synthesized
gagagcatatatattgtcagag

SEQ ID NO: 982342 - DNA, 22 bp, Artificial Sequence
  chemically synthesized
tgagagcatatatattgtcaga

SEQ ID NO: 982343 - DNA, 22 bp, Artificial Sequence
  chemically synthesized
ttgagagcatatatattgtcag

SEQ ID NO: 982344 - DNA, 22 bp, Artificial Sequence
  chemically synthesized
tgtttatctctgacaatatata

SEQ ID NO: 982345 - DNA, 22 bp, Artificial Sequence
  chemically synthesized
atctctgacaatatatatgctc

SEQ ID NO: 982346 - DNA, 22 bp, Artificial Sequence
  chemically synthesized
tctctgacaatatatatgctct

SEQ ID NO: 982347 - DNA, 22 bp, Artificial Sequence
  chemically synthesized
tcggaatgcttttgagagcata

SEQ ID NO: 982348 - DNA, 22 bp, Artificial Sequence
  chemically synthesized
atcggaatgcttttgagagcat

SEQ ID NO: 982349 - DNA, 22 bp, Artificial Sequence
  chemically synthesized
tgacaatatatatgctctcaaa

SEQ ID NO: 982350 - DNA, 22 bp, Artificial Sequence
  chemically synthesized
acaatatatatgctctcaaaag

SEQ ID NO: 982351 - DNA, 22 bp, Artificial Sequence
  chemically synthesized
tttatcggaatgcttttgagag

SEQ ID NO: 982352 - DNA, 22 bp, Artificial Sequence
  chemically synthesized
atttatcggaatgcttttgaga

SEQ ID NO: 982353 - DNA, 22 bp, Artificial Sequence
  chemically synthesized
aggaaaatttatttatcggaat

SEQ ID NO: 982354 - DNA, 22 bp, Artificial Sequence
  chemically synthesized
tcaaaagcattccgataaataa

SEQ ID NO: 982355 - DNA, 22 bp, Artificial Sequence
  chemically synthesized
aaaagcattccgataaataaat

SEQ ID NO: 982356 - DNA, 22 bp, Artificial Sequence
  chemically synthesized
atcattgaggaaaatttattta

SEQ ID NO: 982357 - DNA, 22 bp, Artificial Sequence
  chemically synthesized
gatcattgaggaaaatttattt

SEQ ID NO: 982358 - DNA, 22 bp, Artificial Sequence
  chemically synthesized
tgcttgatcattgaggaaaatt

SEQ ID NO: 982359 - DNA, 22 bp, Artificial Sequence
  chemically synthesized
cgataaataaattttcctcaat

SEQ ID NO: 982360 - DNA, 22 bp, Artificial Sequence
  chemically synthesized
ttatgcttgatcattgaggaaa

SEQ ID NO: 982361 - DNA, 22 bp, Artificial Sequence
  chemically synthesized
attatgcttgatcattgaggaa

SEQ ID NO: 982362 - DNA, 22 bp, Artificial Sequence
  chemically synthesized
tattatgcttgatcattgagga

SEQ ID NO: 982363 - DNA, 22 bp, Artificial Sequence
  chemically synthesized
atgtattttattatgcttgatc

SEQ ID NO: 982364 - DNA, 22 bp, Artificial Sequence
  chemically synthesized
tcctcaatgatcaagcataata

SEQ ID NO: 982365 - DNA, 22 bp, Artificial Sequence
  chemically synthesized
cctcaatgatcaagcataataa

SEQ ID NO: 982366 - DNA, 22 bp, Artificial Sequence
  chemically synthesized
ctcaatgatcaagcataataaa

SEQ ID NO: 982367 - DNA, 22 bp, Artificial Sequence
  chemically synthesized
aatgatcaagcataataaaata

SEQ ID NO: 982368 - DNA, 22 bp, Artificial Sequence
  chemically synthesized
acaaagctgatgtattttatta

SEQ ID NO: 982369 - DNA, 22 bp, Artificial Sequence
  chemically synthesized
aacaaagctgatgtattttatt

SEQ ID NO: 982370 - DNA, 22 bp, Artificial Sequence
  chemically synthesized
ggtgatttaacaaagctgatgt

SEQ ID NO: 982371 - DNA, 22 bp, Artificial Sequence
  chemically synthesized
aggtgatttaacaaagctgatg

SEQ ID NO: 982372 - DNA, 22 bp, Artificial Sequence
  chemically synthesized
agtatttaggtgatttaacaaa

SEQ ID NO: 982373 - DNA, 22 bp, Artificial Sequence
  chemically synthesized
gagtatttaggtgatttaacaa

SEQ ID NO: 982374 - DNA, 22 bp, Artificial Sequence
  chemically synthesized
tttgagtatttaggtgatttaa

SEQ ID NO: 982375 - DNA, 22 bp, Artificial Sequence
  chemically synthesized
tgttaaatcacctaaatactca

SEQ ID NO: 982376 - DNA, 22 bp, Artificial Sequence
  chemically synthesized
gttaaatcacctaaatactcaa

SEQ ID NO: 982377 - DNA, 22 bp, Artificial Sequence
  chemically synthesized
ttaaatcacctaaatactcaaa

SEQ ID NO: 982378 - DNA, 22 bp, Artificial Sequence
  chemically synthesized
atggtagagttgtttgagtatt

SEQ ID NO: 982379 - DNA, 22 bp, Artificial Sequence
  chemically synthesized
aatcacctaaatactcaaacaa

SEQ ID NO: 982380 - DNA, 22 bp, Artificial Sequence
  chemically synthesized
acatactaatggtagagttgtt

SEQ ID NO: 982381 - DNA, 22 bp, Artificial Sequence
  chemically synthesized
aatactcaaacaactctaccat

SEQ ID NO: 982382 - DNA, 22 bp, Artificial Sequence
  chemically synthesized
cctcacatactaatggtagagt

SEQ ID NO: 982383 - DNA, 22 bp, Artificial Sequence
  chemically synthesized
aaacaactctaccattagtatg

SEQ ID NO: 982384 - DNA, 22 bp, Artificial Sequence
  chemically synthesized
aaagctacctcacatactaatg

SEQ ID NO: 982385 - DNA, 22 bp, Artificial Sequence
  chemically synthesized
caaagctacctcacatactaat

SEQ ID NO: 982386 - DNA, 22 bp, Artificial Sequence
  chemically synthesized
tcaaagctacctcacatactaa

SEQ ID NO: 982387 - DNA, 22 bp, Artificial Sequence
  chemically synthesized
taccattagtatgtgaggtagc

SEQ ID NO: 982388 - DNA, 22 bp, Artificial Sequence
  chemically synthesized
ccattagtatgtgaggtagctt

SEQ ID NO: 982389 - DNA, 22 bp, Artificial Sequence
  chemically synthesized
gaaatactttcaaagctacctc

SEQ ID NO: 982390 - DNA, 22 bp, Artificial Sequence
  chemically synthesized
gtatgtgaggtagctttgaaag

SEQ ID NO: 982391 - DNA, 22 bp, Artificial Sequence
  chemically synthesized
aagagaaagaaaaattagaaat

SEQ ID NO: 982392 - DNA, 22 bp, Artificial Sequence
  chemically synthesized
tgaaagtatttctaatttttct

SEQ ID NO: 982393 - DNA, 22 bp, Artificial Sequence
  chemically synthesized
gaaagtatttctaatttttctt

SEQ ID NO: 982394 - DNA, 22 bp, Artificial Sequence
  chemically synthesized
aaagtatttctaatttttcttt

SEQ ID NO: 982395 - DNA, 22 bp, Artificial Sequence
  chemically synthesized
tggcatattaaagagaaagaaa

SEQ ID NO: 982396 - DNA, 22 bp, Artificial Sequence
  chemically synthesized
ctgtggcatattaaagagaaag

SEQ ID NO: 982397 - DNA, 22 bp, Artificial Sequence
  chemically synthesized
cctgtggcatattaaagagaaa

SEQ ID NO: 982398 - DNA, 22 bp, Artificial Sequence
  chemically synthesized
ctaatttttctttctctttaat

SEQ ID NO: 982399 - DNA, 22 bp, Artificial Sequence
  chemically synthesized
taatttttctttctctttaata

SEQ ID NO: 982400 - DNA, 22 bp, Artificial Sequence
  chemically synthesized
atttttctttctctttaatatg

SEQ ID NO: 982401 - DNA, 22 bp, Artificial Sequence
  chemically synthesized
gtcccttcctgtggcatattaa

SEQ ID NO: 982402 - DNA, 22 bp, Artificial Sequence
  chemically synthesized
ttctttctctttaatatgccac

SEQ ID NO: 982403 - DNA, 22 bp, Artificial Sequence
  chemically synthesized
tctttctctttaatatgccaca

SEQ ID NO: 982404 - DNA, 22 bp, Artificial Sequence
  chemically synthesized
ctttctctttaatatgccacag

SEQ ID NO: 982405 - DNA, 22 bp, Artificial Sequence
  chemically synthesized
tttctctttaatatgccacagg

SEQ ID NO: 982406 - DNA, 22 bp, Artificial Sequence
  chemically synthesized
tctctttaatatgccacaggaa

SEQ ID NO: 982407 - DNA, 22 bp, Artificial Sequence
  chemically synthesized
ctctttaatatgccacaggaag

SEQ ID NO: 982408 - DNA, 22 bp, Artificial Sequence
  chemically synthesized
tctttaatatgccacaggaagg

SEQ ID NO: 982409 - DNA, 22 bp, Artificial Sequence
  chemically synthesized
tttaatatgccacaggaaggga

SEQ ID NO: 982410 - DNA, 22 bp, Artificial Sequence
  chemically synthesized
taatatgccacaggaagggacg

SEQ ID NO: 982411 - DNA, 22 bp, Artificial Sequence
  chemically synthesized
aaataaatgcctcgtcccttcc

SEQ ID NO: 982412 - DNA, 22 bp, Artificial Sequence
  chemically synthesized
aatatgccacaggaagggacga

SEQ ID NO: 982413 - DNA, 22 bp, Artificial Sequence
  chemically synthesized
atatgccacaggaagggacgag

SEQ ID NO: 982414 - DNA, 22 bp, Artificial Sequence
  chemically synthesized
aaggttcaaataaatgcctcgt

SEQ ID NO: 982415 - DNA, 22 bp, Artificial Sequence
  chemically synthesized
tgatagcatataattgaaggtt

SEQ ID NO: 982416 - DNA, 22 bp, Artificial Sequence
  chemically synthesized
ctatgatagcatataattgaag

SEQ ID NO: 982417 - DNA, 22 bp, Artificial Sequence
  chemically synthesized
actatgatagcatataattgaa

SEQ ID NO: 982418 - DNA, 22 bp, Artificial Sequence
  chemically synthesized
ttactatgatagcatataattg

SEQ ID NO: 982419 - DNA, 22 bp, Artificial Sequence
  chemically synthesized
atttgaaccttcaattatatgc

SEQ ID NO: 982420 - DNA, 22 bp, Artificial Sequence
  chemically synthesized
cttactatgatagcatataatt

SEQ ID NO: 982421 - DNA, 22 bp, Artificial Sequence
  chemically synthesized
tttgaaccttcaattatatgct

SEQ ID NO: 982422 - DNA, 22 bp, Artificial Sequence
  chemically synthesized
gaaccttcaattatatgctatc

SEQ ID NO: 982423 - DNA, 22 bp, Artificial Sequence
  chemically synthesized
aaccttcaattatatgctatca

SEQ ID NO: 982424 - DNA, 22 bp, Artificial Sequence
  chemically synthesized
caattatatgctatcatagtaa

SEQ ID NO: 982425 - DNA, 22 bp, Artificial Sequence
  chemically synthesized
aattatatgctatcatagtaag

SEQ ID NO: 982426 - DNA, 22 bp, Artificial Sequence
  chemically synthesized
tggtccaatcatcttcttacta

SEQ ID NO: 982427 - DNA, 22 bp, Artificial Sequence
  chemically synthesized
atggtccaatcatcttcttact

SEQ ID NO: 982428 - DNA, 22 bp, Artificial Sequence
  chemically synthesized
tatgctatcatagtaagaagat

SEQ ID NO: 982429 - DNA, 22 bp, Artificial Sequence
  chemically synthesized
catttatggtccaatcatcttc

SEQ ID NO: 982430 - DNA, 22 bp, Artificial Sequence
  chemically synthesized
gcatttatggtccaatcatctt

SEQ ID NO: 982431 - DNA, 22 bp, Artificial Sequence
  chemically synthesized
tgcatttatggtccaatcatct

SEQ ID NO: 982432 - DNA, 22 bp, Artificial Sequence
  chemically synthesized
tcatagtaagaagatgattgga

SEQ ID NO: 982433 - DNA, 22 bp, Artificial Sequence
  chemically synthesized
caaatacatgtctttgcattta

SEQ ID NO: 982434 - DNA, 22 bp, Artificial Sequence
  chemically synthesized
gaccataaatgcaaagacatgt

SEQ ID NO: 982435 - DNA, 22 bp, Artificial Sequence
  chemically synthesized
agcaatgcaattgcaaatacat

SEQ ID NO: 982436 - DNA, 22 bp, Artificial Sequence
  chemically synthesized
gagcaatgcaattgcaaataca

SEQ ID NO: 982437 - DNA, 22 bp, Artificial Sequence
  chemically synthesized
ttgagcaatgcaattgcaaata

SEQ ID NO: 982438 - DNA, 22 bp, Artificial Sequence
  chemically synthesized
gcattcttgagcaatgcaattg

SEQ ID NO: 982439 - DNA, 22 bp, Artificial Sequence
  chemically synthesized
gcaattgcattgctcaagaatg

SEQ ID NO: 982440 - DNA, 22 bp, Artificial Sequence
  chemically synthesized
caattgcattgctcaagaatgc

SEQ ID NO: 982441 - DNA, 22 bp, Artificial Sequence
  chemically synthesized
cattgctcaagaatgccagtta

SEQ ID NO: 982442 - DNA, 22 bp, Artificial Sequence
  chemically synthesized
ctcaagaatgccagttatgtcc

SEQ ID NO: 982443 - DNA, 22 bp, Artificial Sequence
  chemically synthesized
aagggatggataatggacataa

SEQ ID NO: 982444 - DNA, 22 bp, Artificial Sequence
  chemically synthesized
aagaatgccagttatgtccatt

SEQ ID NO: 982445 - DNA, 22 bp, Artificial Sequence
  chemically synthesized
attgaagggatggataatggac

SEQ ID NO: 982446 - DNA, 22 bp, Artificial Sequence
  chemically synthesized
cattgaagggatggataatgga

SEQ ID NO: 982447 - DNA, 22 bp, Artificial Sequence
  chemically synthesized
tttcattgaagggatggataat

SEQ ID NO: 982448 - DNA, 22 bp, Artificial Sequence
  chemically synthesized
gtttcattgaagggatggataa

SEQ ID NO: 982449 - DNA, 22 bp, Artificial Sequence
  chemically synthesized
tgtttcattgaagggatggata

SEQ ID NO: 982450 - DNA, 22 bp, Artificial Sequence
  chemically synthesized
tgtccattatccatcccttcaa

SEQ ID NO: 982451 - DNA, 22 bp, Artificial Sequence
  chemically synthesized
tccatcccttcaatgaaacaaa

SEQ ID NO: 982452 - DNA, 22 bp, Artificial Sequence
  chemically synthesized
aaagaaaatggatggtctttgt

SEQ ID NO: 982453 - DNA, 22 bp, Artificial Sequence
  chemically synthesized
taaaagaaaatggatggtcttt

SEQ ID NO: 982454 - DNA, 22 bp, Artificial Sequence
  chemically synthesized
caatgaaacaaagaccatccat

SEQ ID NO: 982455 - DNA, 22 bp, Artificial Sequence
  chemically synthesized
aatgaaacaaagaccatccatt

SEQ ID NO: 982456 - DNA, 22 bp, Artificial Sequence
  chemically synthesized
cctctaaaagaaaatggatggt

SEQ ID NO: 982457 - DNA, 22 bp, Artificial Sequence
  chemically synthesized
gacagtagtgattacctctaaa

SEQ ID NO: 982458 - DNA, 22 bp, Artificial Sequence
  chemically synthesized
cattggacagtagtgattacct

SEQ ID NO: 982459 - DNA, 22 bp, Artificial Sequence
  chemically synthesized
gcattggacagtagtgattacc

SEQ ID NO: 982460 - DNA, 22 bp, Artificial Sequence
  chemically synthesized
tcttttagaggtaatcactact

SEQ ID NO: 982461 - DNA, 22 bp, Artificial Sequence
  chemically synthesized
cttttagaggtaatcactactg

SEQ ID NO: 982462 - DNA, 22 bp, Artificial Sequence
  chemically synthesized
ttttagaggtaatcactactgt

SEQ ID NO: 982463 - DNA, 22 bp, Artificial Sequence
  chemically synthesized
tgtcttgcattggacagtagtg

SEQ ID NO: 982464 - DNA, 22 bp, Artificial Sequence
  chemically synthesized
ttagaggtaatcactactgtcc

SEQ ID NO: 982465 - DNA, 22 bp, Artificial Sequence
  chemically synthesized
tagaggtaatcactactgtcca

SEQ ID NO: 982466 - DNA, 22 bp, Artificial Sequence
  chemically synthesized
tgtgtcttgcattggacagtag

SEQ ID NO: 982467 - DNA, 22 bp, Artificial Sequence
  chemically synthesized
agaggtaatcactactgtccaa

SEQ ID NO: 982468 - DNA, 22 bp, Artificial Sequence
  chemically synthesized
ctgtgtcttgcattggacagta

SEQ ID NO: 982469 - DNA, 22 bp, Artificial Sequence
  chemically synthesized
gaggtaatcactactgtccaat

SEQ ID NO: 982470 - DNA, 22 bp, Artificial Sequence
  chemically synthesized
tctgtgtcttgcattggacagt

SEQ ID NO: 982471 - DNA, 22 bp, Artificial Sequence
  chemically synthesized
ttttctgtgtcttgcattggac

SEQ ID NO: 982472 - DNA, 22 bp, Artificial Sequence
  chemically synthesized
cctattttctgtgtcttgcatt

SEQ ID NO: 982473 - DNA, 22 bp, Artificial Sequence
  chemically synthesized
ctgtccaatgcaagacacagaa

SEQ ID NO: 982474 - DNA, 22 bp, Artificial Sequence
  chemically synthesized
caaattgcctattttctgtgtc

SEQ ID NO: 982475 - DNA, 22 bp, Artificial Sequence
  chemically synthesized
ccaaattgcctattttctgtgt

SEQ ID NO: 982476 - DNA, 22 bp, Artificial Sequence
  chemically synthesized
tccaatgcaagacacagaaaat

SEQ ID NO: 982477 - DNA, 22 bp, Artificial Sequence
  chemically synthesized
tacttccaaattgcctattttc

SEQ ID NO: 982478 - DNA, 22 bp, Artificial Sequence
  chemically synthesized
ctatacttccaaattgcctatt

SEQ ID NO: 982479 - DNA, 22 bp, Artificial Sequence
  chemically synthesized
gttactatacttccaaattgcc

SEQ ID NO: 982480 - DNA, 22 bp, Artificial Sequence
  chemically synthesized
actagttactatacttccaaat

SEQ ID NO: 982481 - DNA, 22 bp, Artificial Sequence
  chemically synthesized
ctaactagttactatacttcca

SEQ ID NO: 982482 - DNA, 22 bp, Artificial Sequence
  chemically synthesized
aaagaatattgctaactagtta

SEQ ID NO: 982483 - DNA, 22 bp, Artificial Sequence
  chemically synthesized
ggaagtatagtaactagttagc

SEQ ID NO: 982484 - DNA, 22 bp, Artificial Sequence
  chemically synthesized
gaagtatagtaactagttagca

SEQ ID NO: 982485 - DNA, 22 bp, Artificial Sequence
  chemically synthesized
tatagaaagttaaaagaatatt

SEQ ID NO: 982486 - DNA, 22 bp, Artificial Sequence
  chemically synthesized
gttagcaatattcttttaactt

SEQ ID NO: 982487 - DNA, 22 bp, Artificial Sequence
  chemically synthesized
gcaatattcttttaactttcta

SEQ ID NO: 982488 - DNA, 22 bp, Artificial Sequence
  chemically synthesized
ttttaactttctatataggtat

SEQ ID NO: 982489 - DNA, 22 bp, Artificial Sequence
  chemically synthesized
ttaactttctatataggtatac

SEQ ID NO: 982490 - DNA, 22 bp, Artificial Sequence
  chemically synthesized
taactttctatataggtatact

SEQ ID NO: 982491 - DNA, 22 bp, Artificial Sequence
  chemically synthesized
atgcatgtaaaaagtataccta

SEQ ID NO: 982492 - DNA, 22 bp, Artificial Sequence
  chemically synthesized
aactttctatataggtatactt

SEQ ID NO: 982493 - DNA, 22 bp, Artificial Sequence
  chemically synthesized
actttctatataggtatacttt

SEQ ID NO: 982494 - DNA, 22 bp, Artificial Sequence
  chemically synthesized
tctatataggtatactttttac

SEQ ID NO: 982495 - DNA, 22 bp, Artificial Sequence
  chemically synthesized
ctatataggtatactttttaca

SEQ ID NO: 982496 - DNA, 22 bp, Artificial Sequence
  chemically synthesized
tatataggtatactttttacat

SEQ ID NO: 982497 - DNA, 22 bp, Artificial Sequence
  chemically synthesized
tataggtatactttttacatgc

SEQ ID NO: 982498 - DNA, 22 bp, Artificial Sequence
  chemically synthesized
cagtgaaattaatgcatgtaaa

SEQ ID NO: 982499 - DNA, 22 bp, Artificial Sequence
  chemically synthesized
acagtgaaattaatgcatgtaa

SEQ ID NO: 982500 - DNA, 22 bp, Artificial Sequence
  chemically synthesized
tacagtgaaattaatgcatgta

SEQ ID NO: 982501 - DNA, 22 bp, Artificial Sequence
  chemically synthesized
ttttacagtgaaattaatgcat

SEQ ID NO: 982502 - DNA, 22 bp, Artificial Sequence
  chemically synthesized
gttttacagtgaaattaatgca

SEQ ID NO: 982503 - DNA, 22 bp, Artificial Sequence
  chemically synthesized
cttgttttacagtgaaattaat

SEQ ID NO: 982504 - DNA, 22 bp, Artificial Sequence
  chemically synthesized
acttgttttacagtgaaattaa

SEQ ID NO: 982505 - DNA, 22 bp, Artificial Sequence
  chemically synthesized
tacttgttttacagtgaaatta

SEQ ID NO: 982506 - DNA, 22 bp, Artificial Sequence
  chemically synthesized
tttacatgcattaatttcactg

SEQ ID NO: 982507 - DNA, 22 bp, Artificial Sequence
  chemically synthesized
ttacatgcattaatttcactgt

SEQ ID NO: 982508 - DNA, 22 bp, Artificial Sequence
  chemically synthesized
tacatgcattaatttcactgta

SEQ ID NO: 982509 - DNA, 22 bp, Artificial Sequence
  chemically synthesized
acatgcattaatttcactgtaa

SEQ ID NO: 982510 - DNA, 22 bp, Artificial Sequence
  chemically synthesized
catgcattaatttcactgtaaa

SEQ ID NO: 982511 - DNA, 22 bp, Artificial Sequence
  chemically synthesized
atcatataattttacttgtttt

SEQ ID NO: 982512 - DNA, 22 bp, Artificial Sequence
  chemically synthesized
aatcatataattttacttgttt

SEQ ID NO: 982513 - DNA, 22 bp, Artificial Sequence
  chemically synthesized
atttcactgtaaaacaagtaaa

SEQ ID NO: 982514 - DNA, 22 bp, Artificial Sequence
  chemically synthesized
taatcatataattttacttgtt

SEQ ID NO: 982515 - DNA, 22 bp, Artificial Sequence
  chemically synthesized
ttaatcatataattttacttgt

SEQ ID NO: 982516 - DNA, 22 bp, Artificial Sequence
  chemically synthesized
tttaatcatataattttacttg

SEQ ID NO: 982517 - DNA, 22 bp, Artificial Sequence
  chemically synthesized
cactgtaaaacaagtaaaatta

SEQ ID NO: 982518 - DNA, 22 bp, Artificial Sequence
  chemically synthesized
tttttaatcatataattttact

SEQ ID NO: 982519 - DNA, 22 bp, Artificial Sequence
  chemically synthesized
actgtaaaacaagtaaaattat

SEQ ID NO: 982520 - DNA, 22 bp, Artificial Sequence
  chemically synthesized
ctttttaatcatataattttac

SEQ ID NO: 982521 - DNA, 22 bp, Artificial Sequence
  chemically synthesized
tctttttaatcatataatttta

SEQ ID NO: 982522 - DNA, 22 bp, Artificial Sequence
  chemically synthesized
taaaacaagtaaaattatatga

SEQ ID NO: 982523 - DNA, 22 bp, Artificial Sequence
  chemically synthesized
gttttctttttaatcatataat

SEQ ID NO: 982524 - DNA, 22 bp, Artificial Sequence
  chemically synthesized
gaagctggttttctttttaatc

SEQ ID NO: 982525 - DNA, 22 bp, Artificial Sequence
  chemically synthesized
agaagctggttttctttttaat

SEQ ID NO: 982526 - DNA, 22 bp, Artificial Sequence
  chemically synthesized
tatgattaaaaagaaaaccagc

SEQ ID NO: 982527 - DNA, 22 bp, Artificial Sequence
  chemically synthesized
aaaatcttagaagctggttttc

SEQ ID NO: 982528 - DNA, 22 bp, Artificial Sequence
  chemically synthesized
tcaaaatcttagaagctggttt

SEQ ID NO: 982529 - DNA, 22 bp, Artificial Sequence
  chemically synthesized
aaaagaaaaccagcttctaaga

SEQ ID NO: 982530 - DNA, 22 bp, Artificial Sequence
  chemically synthesized
tatgcaatgcattctcaaaatc

SEQ ID NO: 982531 - DNA, 22 bp, Artificial Sequence
  chemically synthesized
accattgtatgcaatgcattct

SEQ ID NO: 982532 - DNA, 22 bp, Artificial Sequence
  chemically synthesized
ctaagattttgagaatgcattg

SEQ ID NO: 982533 - DNA, 22 bp, Artificial Sequence
  chemically synthesized
taagattttgagaatgcattgc

SEQ ID NO: 982534 - DNA, 22 bp, Artificial Sequence
  chemically synthesized
agattttgagaatgcattgcat

SEQ ID NO: 982535 - DNA, 22 bp, Artificial Sequence
  chemically synthesized
acattgaccattgtatgcaatg

SEQ ID NO: 982536 - DNA, 22 bp, Artificial Sequence
  chemically synthesized
tgagaatgcattgcatacaatg

SEQ ID NO: 982537 - DNA, 22 bp, Artificial Sequence
  chemically synthesized
gagaatgcattgcatacaatgg

SEQ ID NO: 982538 - DNA, 22 bp, Artificial Sequence
  chemically synthesized
gattaacattgaccattgtatg

SEQ ID NO: 982539 - DNA, 22 bp, Artificial Sequence
  chemically synthesized
agaatgcattgcatacaatggt

SEQ ID NO: 982540 - DNA, 22 bp, Artificial Sequence
  chemically synthesized
actagattaacattgaccattg

SEQ ID NO: 982541 - DNA, 22 bp, Artificial Sequence
  chemically synthesized
ttgactagattaacattgacca

SEQ ID NO: 982542 - DNA, 22 bp, Artificial Sequence
  chemically synthesized
gttgactagattaacattgacc

SEQ ID NO: 982543 - DNA, 22 bp, Artificial Sequence
  chemically synthesized
tgttgactagattaacattgac

SEQ ID NO: 982544 - DNA, 22 bp, Artificial Sequence
  chemically synthesized
tttgttgactagattaacattg

SEQ ID NO: 982545 - DNA, 22 bp, Artificial Sequence
  chemically synthesized
catacaatggtcaatgttaatc

SEQ ID NO: 982546 - DNA, 22 bp, Artificial Sequence
  chemically synthesized
aacagttctttgttgactagat

SEQ ID NO: 982547 - DNA, 22 bp, Artificial Sequence
  chemically synthesized
ttgaacagttctttgttgacta

SEQ ID NO: 982548 - DNA, 22 bp, Artificial Sequence
  chemically synthesized
attgaacagttctttgttgact

SEQ ID NO: 982549 - DNA, 22 bp, Artificial Sequence
  chemically synthesized
tattgaacagttctttgttgac

SEQ ID NO: 982550 - DNA, 22 bp, Artificial Sequence
  chemically synthesized
atctagtcaacaaagaactgtt

SEQ ID NO: 982551 - DNA, 22 bp, Artificial Sequence
  chemically synthesized
gtcaacaaagaactgttcaata

SEQ ID NO: 982552 - DNA, 22 bp, Artificial Sequence
  chemically synthesized
taaacaaacatgttttattgaa

SEQ ID NO: 982553 - DNA, 22 bp, Artificial Sequence
  chemically synthesized
gtaaacaaacatgttttattga

SEQ ID NO: 982554 - DNA, 22 bp, Artificial Sequence
  chemically synthesized
tgtaaacaaacatgttttattg

SEQ ID NO: 982555 - DNA, 22 bp, Artificial Sequence
  chemically synthesized
attttgtaaacaaacatgtttt

SEQ ID NO: 982556 - DNA, 22 bp, Artificial Sequence
  chemically synthesized
cactgattttgtaaacaaacat

SEQ ID NO: 982557 - DNA, 22 bp, Artificial Sequence
  chemically synthesized
ttcaataaaacatgtttgttta

SEQ ID NO: 982558 - DNA, 22 bp, Artificial Sequence
  chemically synthesized
ccactgattttgtaaacaaaca

SEQ ID NO: 982559 - DNA, 22 bp, Artificial Sequence
  chemically synthesized
aataaaacatgtttgtttacaa

SEQ ID NO: 982560 - DNA, 22 bp, Artificial Sequence
  chemically synthesized
aggaagtcttccactgattttg

SEQ ID NO: 982561 - DNA, 22 bp, Artificial Sequence
  chemically synthesized
tgaggaagtcttccactgattt

SEQ ID NO: 982562 - DNA, 22 bp, Artificial Sequence
  chemically synthesized
ctgaggaagtcttccactgatt

SEQ ID NO: 982563 - DNA, 22 bp, Artificial Sequence
  chemically synthesized
gtttacaaaatcagtggaagac

SEQ ID NO: 982564 - DNA, 22 bp, Artificial Sequence
  chemically synthesized
tttacaaaatcagtggaagact

SEQ ID NO: 982565 - DNA, 22 bp, Artificial Sequence
  chemically synthesized
acaaaatcagtggaagacttcc

SEQ ID NO: 982566 - DNA, 22 bp, Artificial Sequence
  chemically synthesized
caaaatcagtggaagacttcct

SEQ ID NO: 982567 - DNA, 22 bp, Artificial Sequence
  chemically synthesized
cataaaatatttctgaggaagt

SEQ ID NO: 982568 - DNA, 22 bp, Artificial Sequence
  chemically synthesized
ttacataaaatatttctgagga

SEQ ID NO: 982569 - DNA, 22 bp, Artificial Sequence
  chemically synthesized
gttacataaaatatttctgagg

SEQ ID NO: 982570 - DNA, 22 bp, Artificial Sequence
  chemically synthesized
ggcatttgttacataaaatatt

SEQ ID NO: 982571 - DNA, 22 bp, Artificial Sequence
  chemically synthesized
cctcagaaatattttatgtaac

SEQ ID NO: 982572 - DNA, 22 bp, Artificial Sequence
  chemically synthesized
ctcagaaatattttatgtaaca

SEQ ID NO: 982573 - DNA, 22 bp, Artificial Sequence
  chemically synthesized
agaaatattttatgtaacaaat

SEQ ID NO: 982574 - DNA, 22 bp, Artificial Sequence
  chemically synthesized
agcccaccctaggcatttgtta

SEQ ID NO: 982575 - DNA, 22 bp, Artificial Sequence
  chemically synthesized
cagcccaccctaggcatttgtt

SEQ ID NO: 982576 - DNA, 22 bp, Artificial Sequence
  chemically synthesized
ttcagcccaccctaggcatttg

SEQ ID NO: 982577 - DNA, 22 bp, Artificial Sequence
  chemically synthesized
tcttcagcccaccctaggcatt

SEQ ID NO: 982578 - DNA, 22 bp, Artificial Sequence
  chemically synthesized
ctcttcagcccaccctaggcat

SEQ ID NO: 982579 - DNA, 22 bp, Artificial Sequence
  chemically synthesized
tctcttcagcccaccctaggca

SEQ ID NO: 982580 - DNA, 22 bp, Artificial Sequence
  chemically synthesized
tatgtaacaaatgcctagggtg

SEQ ID NO: 982581 - DNA, 22 bp, Artificial Sequence
  chemically synthesized
ttctcttcagcccaccctaggc

SEQ ID NO: 982582 - DNA, 22 bp, Artificial Sequence
  chemically synthesized
atgtaacaaatgcctagggtgg

SEQ ID NO: 982583 - DNA, 22 bp, Artificial Sequence
  chemically synthesized
tgtaacaaatgcctagggtggg

SEQ ID NO: 982584 - DNA, 22 bp, Artificial Sequence
  chemically synthesized
gatttttctcttcagcccaccc

SEQ ID NO: 982585 - DNA, 22 bp, Artificial Sequence
  chemically synthesized
ctggatttttctcttcagccca

SEQ ID NO: 982586 - DNA, 22 bp, Artificial Sequence
  chemically synthesized
actggatttttctcttcagccc

SEQ ID NO: 982587 - DNA, 22 bp, Artificial Sequence
  chemically synthesized
tactggatttttctcttcagcc

SEQ ID NO: 982588 - DNA, 22 bp, Artificial Sequence
  chemically synthesized
gggtgggctgaagagaaaaatc

SEQ ID NO: 982589 - DNA, 22 bp, Artificial Sequence
  chemically synthesized
aaatgccattttactggatttt

SEQ ID NO: 982590 - DNA, 22 bp, Artificial Sequence
  chemically synthesized
gaaatgccattttactggattt

SEQ ID NO: 982591 - DNA, 22 bp, Artificial Sequence
  chemically synthesized
tgaaatgccattttactggatt

SEQ ID NO: 982592 - DNA, 22 bp, Artificial Sequence
  chemically synthesized
aagagaaaaatccagtaaaatg

SEQ ID NO: 982593 - DNA, 22 bp, Artificial Sequence
  chemically synthesized
gaggcatgtaaaggaaaatata

SEQ ID NO: 982594 - DNA, 22 bp, Artificial Sequence
  chemically synthesized
caaaatttatattttcctttac

SEQ ID NO: 982595 - DNA, 22 bp, Artificial Sequence
  chemically synthesized
aattagaggcatgtaaaggaaa

SEQ ID NO: 982596 - DNA, 22 bp, Artificial Sequence
  chemically synthesized
aaaatttatattttcctttaca

SEQ ID NO: 982597 - DNA, 22 bp, Artificial Sequence
  chemically synthesized
aaattagaggcatgtaaaggaa

SEQ ID NO: 982598 - DNA, 22 bp, Artificial Sequence
  chemically synthesized
taaattagaggcatgtaaagga

SEQ ID NO: 982599 - DNA, 22 bp, Artificial Sequence
  chemically synthesized
ttttaaattagaggcatgtaaa

SEQ ID NO: 982600 - DNA, 22 bp, Artificial Sequence
  chemically synthesized
attttaaattagaggcatgtaa

SEQ ID NO: 982601 - DNA, 22 bp, Artificial Sequence
  chemically synthesized
atattttcctttacatgcctct

SEQ ID NO: 982602 - DNA, 22 bp, Artificial Sequence
  chemically synthesized
tattttcctttacatgcctcta

SEQ ID NO: 982603 - DNA, 22 bp, Artificial Sequence
  chemically synthesized
tcctttacatgcctctaattta

SEQ ID NO: 982604 - DNA, 22 bp, Artificial Sequence
  chemically synthesized
cctttacatgcctctaatttaa

SEQ ID NO: 982605 - DNA, 22 bp, Artificial Sequence
  chemically synthesized
ctttacatgcctctaatttaaa

SEQ ID NO: 982606 - DNA, 22 bp, Artificial Sequence
  chemically synthesized
tacatgcctctaatttaaaata

SEQ ID NO: 982607 - DNA, 22 bp, Artificial Sequence
  chemically synthesized
acatgcctctaatttaaaataa

SEQ ID NO: 982608 - DNA, 22 bp, Artificial Sequence
  chemically synthesized
catgcctctaatttaaaataaa

SEQ ID NO: 982609 - DNA, 22 bp, Artificial Sequence
  chemically synthesized
tgaaaaatatcagatatttatt

SEQ ID NO: 982610 - DNA, 22 bp, Artificial Sequence
  chemically synthesized
taatttaaaataaatatctgat

SEQ ID NO: 982611 - DNA, 22 bp, Artificial Sequence
  chemically synthesized
atttaaaataaatatctgatat

SEQ ID NO: 982612 - DNA, 22 bp, Artificial Sequence
  chemically synthesized
aatctatgaaaaatatcagata

SEQ ID NO: 982613 - DNA, 22 bp, Artificial Sequence
  chemically synthesized
aaaataaatatctgatattttt

SEQ ID NO: 982614 - DNA, 22 bp, Artificial Sequence
  chemically synthesized
aaataaatatctgatatttttc

SEQ ID NO: 982615 - DNA, 22 bp, Artificial Sequence
  chemically synthesized
caaactaaatctatgaaaaata

SEQ ID NO: 982616 - DNA, 22 bp, Artificial Sequence
  chemically synthesized
tactacaaactaaatctatgaa

SEQ ID NO: 982617 - DNA, 22 bp, Artificial Sequence
  chemically synthesized
gtactacaaactaaatctatga

SEQ ID NO: 982618 - DNA, 22 bp, Artificial Sequence
  chemically synthesized
tgtactacaaactaaatctatg

SEQ ID NO: 982619 - DNA, 22 bp, Artificial Sequence
  chemically synthesized
atatttttcatagatttagttt

SEQ ID NO: 982620 - DNA, 22 bp, Artificial Sequence
  chemically synthesized
atgattttgtactacaaactaa

SEQ ID NO: 982621 - DNA, 22 bp, Artificial Sequence
  chemically synthesized
ttcatagatttagtttgtagta

SEQ ID NO: 982622 - DNA, 22 bp, Artificial Sequence
  chemically synthesized
tcatagatttagtttgtagtac

SEQ ID NO: 982623 - DNA, 22 bp, Artificial Sequence
  chemically synthesized
attcatgattttgtactacaaa

SEQ ID NO: 982624 - DNA, 22 bp, Artificial Sequence
  chemically synthesized
catagatttagtttgtagtaca

SEQ ID NO: 982625 - DNA, 22 bp, Artificial Sequence
  chemically synthesized
aattcatgattttgtactacaa

SEQ ID NO: 982626 - DNA, 22 bp, Artificial Sequence
  chemically synthesized
atagatttagtttgtagtacaa

SEQ ID NO: 982627 - DNA, 22 bp, Artificial Sequence
  chemically synthesized
ggatttaattcatgattttgta

SEQ ID NO: 982628 - DNA, 22 bp, Artificial Sequence
  chemically synthesized
agtttgtagtacaaaatcatga

SEQ ID NO: 982629 - DNA, 22 bp, Artificial Sequence
  chemically synthesized
gtttgtagtacaaaatcatgaa

SEQ ID NO: 982630 - DNA, 22 bp, Artificial Sequence
  chemically synthesized
gtagtacaaaatcatgaattaa

SEQ ID NO: 982631 - DNA, 22 bp, Artificial Sequence
  chemically synthesized
tagtacaaaatcatgaattaaa

SEQ ID NO: 982632 - DNA, 22 bp, Artificial Sequence
  chemically synthesized
aaatcattaggatttaattcat

SEQ ID NO: 982633 - DNA, 22 bp, Artificial Sequence
  chemically synthesized
tagttcaaatcattaggattta

SEQ ID NO: 982634 - DNA, 22 bp, Artificial Sequence
  chemically synthesized
aattatagttcaaatcattagg

SEQ ID NO: 982635 - DNA, 22 bp, Artificial Sequence
  chemically synthesized
aaattatagttcaaatcattag

SEQ ID NO: 982636 - DNA, 22 bp, Artificial Sequence
  chemically synthesized
taaattatagttcaaatcatta

SEQ ID NO: 982637 - DNA, 22 bp, Artificial Sequence
  chemically synthesized
ttaaattatagttcaaatcatt

SEQ ID NO: 982638 - DNA, 22 bp, Artificial Sequence
  chemically synthesized
tttaaattatagttcaaatcat

SEQ ID NO: 982639 - DNA, 22 bp, Artificial Sequence
  chemically synthesized
aatcctaatgatttgaactata

SEQ ID NO: 982640 - DNA, 22 bp, Artificial Sequence
  chemically synthesized
gaatataattttttaaattata

SEQ ID NO: 982641 - DNA, 22 bp, Artificial Sequence
  chemically synthesized
atgatttgaactataatttaaa

SEQ ID NO: 982642 - DNA, 22 bp, Artificial Sequence
  chemically synthesized
ggaatataattttttaaattat

SEQ ID NO: 982643 - DNA, 22 bp, Artificial Sequence
  chemically synthesized
tttggaatataattttttaaat

SEQ ID NO: 982644 - DNA, 22 bp, Artificial Sequence
  chemically synthesized
ctatttggaatataatttttta

SEQ ID NO: 982645 - DNA, 22 bp, Artificial Sequence
  chemically synthesized
gaactataatttaaaaaattat

SEQ ID NO: 982646 - DNA, 22 bp, Artificial Sequence
  chemically synthesized
gctatttggaatataatttttt

SEQ ID NO: 982647 - DNA, 22 bp, Artificial Sequence
  chemically synthesized
aactataatttaaaaaattata

SEQ ID NO: 982648 - DNA, 22 bp, Artificial Sequence
  chemically synthesized
gcttgctatttggaatataatt

SEQ ID NO: 982649 - DNA, 22 bp, Artificial Sequence
  chemically synthesized
taatttaaaaaattatattcca

SEQ ID NO: 982650 - DNA, 22 bp, Artificial Sequence
  chemically synthesized
aaaaaattatattccaaatagc

SEQ ID NO: 982651 - DNA, 22 bp, Artificial Sequence
  chemically synthesized
aaaaattatattccaaatagca

SEQ ID NO: 982652 - DNA, 22 bp, Artificial Sequence
  chemically synthesized
tattccaaatagcaagccaatc

SEQ ID NO: 982653 - DNA, 22 bp, Artificial Sequence
  chemically synthesized
taaatgtcaatcgattggcttg

SEQ ID NO: 982654 - DNA, 22 bp, Artificial Sequence
  chemically synthesized
caaatagcaagccaatcgattg

SEQ ID NO: 982655 - DNA, 22 bp, Artificial Sequence
  chemically synthesized
tcagaagattgtaaatgtcaat

SEQ ID NO: 982656 - DNA, 22 bp, Artificial Sequence
  chemically synthesized
atcagaagattgtaaatgtcaa

SEQ ID NO: 982657 - DNA, 22 bp, Artificial Sequence
  chemically synthesized
catttatcagaagattgtaaat

SEQ ID NO: 982658 - DNA, 22 bp, Artificial Sequence
  chemically synthesized
gcatttatcagaagattgtaaa

SEQ ID NO: 982659 - DNA, 22 bp, Artificial Sequence
  chemically synthesized
tgcatttatcagaagattgtaa

SEQ ID NO: 982660 - DNA, 22 bp, Artificial Sequence
  chemically synthesized
gtactttgcatttatcagaaga

SEQ ID NO: 982661 - DNA, 22 bp, Artificial Sequence
  chemically synthesized
acatttacaatcttctgataaa

SEQ ID NO: 982662 - DNA, 22 bp, Artificial Sequence
  chemically synthesized
acaatcttctgataaatgcaaa

SEQ ID NO: 982663 - DNA, 22 bp, Artificial Sequence
  chemically synthesized
gggaattggtactttgcattta

SEQ ID NO: 982664 - DNA, 22 bp, Artificial Sequence
  chemically synthesized
caatcttctgataaatgcaaag

SEQ ID NO: 982665 - DNA, 22 bp, Artificial Sequence
  chemically synthesized
agggaattggtactttgcattt

SEQ ID NO: 982666 - DNA, 22 bp, Artificial Sequence
  chemically synthesized
tgtttagggaattggtactttg

SEQ ID NO: 982667 - DNA, 22 bp, Artificial Sequence
  chemically synthesized
ctgataaatgcaaagtaccaat

SEQ ID NO: 982668 - DNA, 22 bp, Artificial Sequence
  chemically synthesized
tgataaatgcaaagtaccaatt

SEQ ID NO: 982669 - DNA, 22 bp, Artificial Sequence
  chemically synthesized
ataaatgcaaagtaccaattcc

SEQ ID NO: 982670 - DNA, 22 bp, Artificial Sequence
  chemically synthesized
aaaaagtcaccataaaacgcta

SEQ ID NO: 982671 - DNA, 22 bp, Artificial Sequence
  chemically synthesized
gaaaaagtcaccataaaacgct

SEQ ID NO: 982672 - DNA, 22 bp, Artificial Sequence
  chemically synthesized
tgaaaaagtcaccataaaacgc

SEQ ID NO: 982673 - DNA, 22 bp, Artificial Sequence
  chemically synthesized
cctaaacatagcgttttatggt

SEQ ID NO: 982674 - DNA, 22 bp, Artificial Sequence
  chemically synthesized
ttttgaaaaagtcaccataaaa

SEQ ID NO: 982675 - DNA, 22 bp, Artificial Sequence
  chemically synthesized
aacatagcgttttatggtgact

SEQ ID NO: 982676 - DNA, 22 bp, Artificial Sequence
  chemically synthesized
aatgatgtagttattttgaaaa

SEQ ID NO: 982677 - DNA, 22 bp, Artificial Sequence
  chemically synthesized
gaatgatgtagttattttgaaa

SEQ ID NO: 982678 - DNA, 22 bp, Artificial Sequence
  chemically synthesized
tatggtgactttttcaaaataa

SEQ ID NO: 982679 - DNA, 22 bp, Artificial Sequence
  chemically synthesized
tgaatgatgtagttattttgaa

SEQ ID NO: 982680 - DNA, 22 bp, Artificial Sequence
  chemically synthesized
atggtgactttttcaaaataac

SEQ ID NO: 982681 - DNA, 22 bp, Artificial Sequence
  chemically synthesized
tggtgactttttcaaaataact

SEQ ID NO: 982682 - DNA, 22 bp, Artificial Sequence
  chemically synthesized
aatagttttgaatgatgtagtt

SEQ ID NO: 982683 - DNA, 22 bp, Artificial Sequence
  chemically synthesized
tttcaaaataactacatcattc

SEQ ID NO: 982684 - DNA, 22 bp, Artificial Sequence
  chemically synthesized
ttcaaaataactacatcattca

SEQ ID NO: 982685 - DNA, 22 bp, Artificial Sequence
  chemically synthesized
tcaaaataactacatcattcaa

SEQ ID NO: 982686 - DNA, 22 bp, Artificial Sequence
  chemically synthesized
caaaataactacatcattcaaa

SEQ ID NO: 982687 - DNA, 22 bp, Artificial Sequence
  chemically synthesized
aaaataactacatcattcaaaa

SEQ ID NO: 982688 - DNA, 22 bp, Artificial Sequence
  chemically synthesized
caggcaactcaatagttttgaa

SEQ ID NO: 982689 - DNA, 22 bp, Artificial Sequence
  chemically synthesized
acaggcaactcaatagttttga

SEQ ID NO: 982690 - DNA, 22 bp, Artificial Sequence
  chemically synthesized
tacaggcaactcaatagttttg

SEQ ID NO: 982691 - DNA, 22 bp, Artificial Sequence
  chemically synthesized
catcattcaaaactattgagtt

SEQ ID NO: 982692 - DNA, 22 bp, Artificial Sequence
  chemically synthesized
ggttttacaggcaactcaatag

SEQ ID NO: 982693 - DNA, 22 bp, Artificial Sequence
  chemically synthesized
aggttttacaggcaactcaata

SEQ ID NO: 982694 - DNA, 22 bp, Artificial Sequence
  chemically synthesized
aaaactattgagttgcctgtaa

SEQ ID NO: 982695 - DNA, 22 bp, Artificial Sequence
  chemically synthesized
aagcaatttaggttttacaggc

SEQ ID NO: 982696 - DNA, 22 bp, Artificial Sequence
  chemically synthesized
ttgagttgcctgtaaaacctaa

SEQ ID NO: 982697 - DNA, 22 bp, Artificial Sequence
  chemically synthesized
atgttcaagcaatttaggtttt

SEQ ID NO: 982698 - DNA, 22 bp, Artificial Sequence
  chemically synthesized
agttgcctgtaaaacctaaatt

SEQ ID NO: 982699 - DNA, 22 bp, Artificial Sequence
  chemically synthesized
cctgtaaaacctaaattgcttg

SEQ ID NO: 982700 - DNA, 22 bp, Artificial Sequence
  chemically synthesized
cagaactaatgttcaagcaatt

SEQ ID NO: 982701 - DNA, 22 bp, Artificial Sequence
  chemically synthesized
tccagaactaatgttcaagcaa

SEQ ID NO: 982702 - DNA, 22 bp, Artificial Sequence
  chemically synthesized
taaaacctaaattgcttgaaca

SEQ ID NO: 982703 - DNA, 22 bp, Artificial Sequence
  chemically synthesized
ctccagaactaatgttcaagca

SEQ ID NO: 982704 - DNA, 22 bp, Artificial Sequence
  chemically synthesized
aattgcttgaacattagttctg

SEQ ID NO: 982705 - DNA, 22 bp, Artificial Sequence
  chemically synthesized
cttgaacattagttctggagaa

SEQ ID NO: 982706 - DNA, 22 bp, Artificial Sequence
  chemically synthesized
gaacattagttctggagaaatt

SEQ ID NO: 982707 - DNA, 22 bp, Artificial Sequence
  chemically synthesized
aacattagttctggagaaattt

SEQ ID NO: 982708 - DNA, 22 bp, Artificial Sequence
  chemically synthesized
aaggcatcatgaaaatttctcc

SEQ ID NO: 982709 - DNA, 22 bp, Artificial Sequence
  chemically synthesized
aaaggcatcatgaaaatttctc

SEQ ID NO: 982710 - DNA, 22 bp, Artificial Sequence
  chemically synthesized
gttctggagaaattttcatgat

SEQ ID NO: 982711 - DNA, 22 bp, Artificial Sequence
  chemically synthesized
agagtttaaaggcatcatgaaa

SEQ ID NO: 982712 - DNA, 22 bp, Artificial Sequence
  chemically synthesized
tggagaaattttcatgatgcct

SEQ ID NO: 982713 - DNA, 22 bp, Artificial Sequence
  chemically synthesized
gagaaattttcatgatgccttt

SEQ ID NO: 982714 - DNA, 22 bp, Artificial Sequence
  chemically synthesized
acactgagagtttaaaggcatc

SEQ ID NO: 982715 - DNA, 22 bp, Artificial Sequence
  chemically synthesized
gacactgagagtttaaaggcat

SEQ ID NO: 982716 - DNA, 22 bp, Artificial Sequence
  chemically synthesized
aatttgacactgagagtttaaa

SEQ ID NO: 982717 - DNA, 22 bp, Artificial Sequence
  chemically synthesized
tcatgatgcctttaaactctca

SEQ ID NO: 982718 - DNA, 22 bp, Artificial Sequence
  chemically synthesized
catgatgcctttaaactctcag

SEQ ID NO: 982719 - DNA, 22 bp, Artificial Sequence
  chemically synthesized
atgatgcctttaaactctcagt

SEQ ID NO: 982720 - DNA, 22 bp, Artificial Sequence
  chemically synthesized
aatgttgaatttgacactgaga

SEQ ID NO: 982721 - DNA, 22 bp, Artificial Sequence
  chemically synthesized
taaactctcagtgtcaaattca

SEQ ID NO: 982722 - DNA, 22 bp, Artificial Sequence
  chemically synthesized
aagcctaaatgttgaatttgac

SEQ ID NO: 982723 - DNA, 22 bp, Artificial Sequence
  chemically synthesized
aaactctcagtgtcaaattcaa

SEQ ID NO: 982724 - DNA, 22 bp, Artificial Sequence
  chemically synthesized
aaagcctaaatgttgaatttga

SEQ ID NO: 982725 - DNA, 22 bp, Artificial Sequence
  chemically synthesized
aactctcagtgtcaaattcaac

SEQ ID NO: 982726 - DNA, 22 bp, Artificial Sequence
  chemically synthesized
taaagcctaaatgttgaatttg

SEQ ID NO: 982727 - DNA, 22 bp, Artificial Sequence
  chemically synthesized
tcagtgtcaaattcaacattta

SEQ ID NO: 982728 - DNA, 22 bp, Artificial Sequence
  chemically synthesized
agtgtcaaattcaacatttagg

SEQ ID NO: 982729 - DNA, 22 bp, Artificial Sequence
  chemically synthesized
aacatttaggctttaaagccta

SEQ ID NO: 982730 - DNA, 22 bp, Artificial Sequence
  chemically synthesized
aggctttaaagcctatgggtgg

SEQ ID NO: 982731 - DNA, 22 bp, Artificial Sequence
  chemically synthesized
ggctttaaagcctatgggtggt

SEQ ID NO: 982732 - DNA, 22 bp, Artificial Sequence
  chemically synthesized
aatggtgataaataccacccat

SEQ ID NO: 982733 - DNA, 22 bp, Artificial Sequence
  chemically synthesized
taaagcctatgggtggtattta

SEQ ID NO: 982734 - DNA, 22 bp, Artificial Sequence
  chemically synthesized
aaagcctatgggtggtatttat

SEQ ID NO: 982735 - DNA, 22 bp, Artificial Sequence
  chemically synthesized
aagcctatgggtggtatttatc

SEQ ID NO: 982736 - DNA, 22 bp, Artificial Sequence
  chemically synthesized
tgggtggtatttatcaccattc

SEQ ID NO: 982737 - DNA, 22 bp, Artificial Sequence
  chemically synthesized
tgtgataaatgcgagtgttgaa

SEQ ID NO: 982738 - DNA, 22 bp, Artificial Sequence
  chemically synthesized
atgtgataaatgcgagtgttga

SEQ ID NO: 982739 - DNA, 22 bp, Artificial Sequence
  chemically synthesized
cttatgtgataaatgcgagtgt

SEQ ID NO: 982740 - DNA, 22 bp, Artificial Sequence
  chemically synthesized
atcaccattcaacactcgcatt

SEQ ID NO: 982741 - DNA, 22 bp, Artificial Sequence
  chemically synthesized
ccttatgtgataaatgcgagtg

SEQ ID NO: 982742 - DNA, 22 bp, Artificial Sequence
  chemically synthesized
tcaccattcaacactcgcattt

SEQ ID NO: 982743 - DNA, 22 bp, Artificial Sequence
  chemically synthesized
tccttatgtgataaatgcgagt

SEQ ID NO: 982744 - DNA, 22 bp, Artificial Sequence
  chemically synthesized
aacactcgcatttatcacataa

SEQ ID NO: 982745 - DNA, 22 bp, Artificial Sequence
  chemically synthesized
aacatattttccttatgtgata

SEQ ID NO: 982746 - DNA, 22 bp, Artificial Sequence
  chemically synthesized
aaacatattttccttatgtgat

SEQ ID NO: 982747 - DNA, 22 bp, Artificial Sequence
  chemically synthesized
ttaaacatattttccttatgtg

SEQ ID NO: 982748 - DNA, 22 bp, Artificial Sequence
  chemically synthesized
cttaaacatattttccttatgt

SEQ ID NO: 982749 - DNA, 22 bp, Artificial Sequence
  chemically synthesized
tcttaaacatattttccttatg

SEQ ID NO: 982750 - DNA, 22 bp, Artificial Sequence
  chemically synthesized
gcatttatcacataaggaaaat

SEQ ID NO: 982751 - DNA, 22 bp, Artificial Sequence
  chemically synthesized
ctttcttaaacatattttcctt

SEQ ID NO: 982752 - DNA, 22 bp, Artificial Sequence
  chemically synthesized
gctttcttaaacatattttcct

SEQ ID NO: 982753 - DNA, 22 bp, Artificial Sequence
  chemically synthesized
tgctttcttaaacatattttcc

SEQ ID NO: 982754 - DNA, 22 bp, Artificial Sequence
  chemically synthesized
atcacataaggaaaatatgttt

SEQ ID NO: 982755 - DNA, 22 bp, Artificial Sequence
  chemically synthesized
tcacataaggaaaatatgttta

SEQ ID NO: 982756 - DNA, 22 bp, Artificial Sequence
  chemically synthesized
agttttgctttcttaaacatat

SEQ ID NO: 982757 - DNA, 22 bp, Artificial Sequence
  chemically synthesized
cagttttgctttcttaaacata

SEQ ID NO: 982758 - DNA, 22 bp, Artificial Sequence
  chemically synthesized
tttcagttttgctttcttaaac

SEQ ID NO: 982759 - DNA, 22 bp, Artificial Sequence
  chemically synthesized
ctatttcagttttgctttctta

SEQ ID NO: 982760 - DNA, 22 bp, Artificial Sequence
  chemically synthesized
agttcctatttcagttttgctt

SEQ ID NO: 982761 - DNA, 22 bp, Artificial Sequence
  chemically synthesized
aaccctgagttcctatttcagt

SEQ ID NO: 982762 - DNA, 22 bp, Artificial Sequence
  chemically synthesized
aagaaagcaaaactgaaatagg

SEQ ID NO: 982763 - DNA, 22 bp, Artificial Sequence
  chemically synthesized
aaaccctgagttcctatttcag

SEQ ID NO: 982764 - DNA, 22 bp, Artificial Sequence
  chemically synthesized
agaaagcaaaactgaaatagga

SEQ ID NO: 982765 - DNA, 22 bp, Artificial Sequence
  chemically synthesized
taaaccctgagttcctatttca

SEQ ID NO: 982766 - DNA, 22 bp, Artificial Sequence
  chemically synthesized
aaataggaactcagggtttaaa

SEQ ID NO: 982767 - DNA, 22 bp, Artificial Sequence
  chemically synthesized
taagtagaagtgttttaaaccc

SEQ ID NO: 982768 - DNA, 22 bp, Artificial Sequence
  chemically synthesized
agggtttaaaacacttctactt

SEQ ID NO: 982769 - DNA, 22 bp, Artificial Sequence
  chemically synthesized
aaaacacttctacttataacct

SEQ ID NO: 982770 - DNA, 22 bp, Artificial Sequence
  chemically synthesized
aaacacttctacttataacctg

SEQ ID NO: 982771 - DNA, 22 bp, Artificial Sequence
  chemically synthesized
cacaaagaggaacgacacaggt

SEQ ID NO: 982772 - DNA, 22 bp, Artificial Sequence
  chemically synthesized
acacaaagaggaacgacacagg

SEQ ID NO: 982773 - DNA, 22 bp, Artificial Sequence
  chemically synthesized
tacacaaagaggaacgacacag

SEQ ID NO: 982774 - DNA, 22 bp, Artificial Sequence
  chemically synthesized
ctacttataacctgtgtcgttc

SEQ ID NO: 982775 - DNA, 22 bp, Artificial Sequence
  chemically synthesized
tacttataacctgtgtcgttcc

SEQ ID NO: 982776 - DNA, 22 bp, Artificial Sequence
  chemically synthesized
cttataacctgtgtcgttcctc

SEQ ID NO: 982777 - DNA, 22 bp, Artificial Sequence
  chemically synthesized
ataacctgtgtcgttcctcttt

SEQ ID NO: 982778 - DNA, 22 bp, Artificial Sequence
  chemically synthesized
taacctgtgtcgttcctctttg

SEQ ID NO: 982779 - DNA, 22 bp, Artificial Sequence
  chemically synthesized
tgtcgttcctctttgtgtaaag

SEQ ID NO: 982780 - DNA, 22 bp, Artificial Sequence
  chemically synthesized
caaacagcaggtcatagacttt

SEQ ID NO: 982781 - DNA, 22 bp, Artificial Sequence
  chemically synthesized
ccaaacagcaggtcatagactt

SEQ ID NO: 982782 - DNA, 22 bp, Artificial Sequence
  chemically synthesized
ctctttgtgtaaagtctatgac

SEQ ID NO: 982783 - DNA, 22 bp, Artificial Sequence
  chemically synthesized
tccaaacagcaggtcatagact

SEQ ID NO: 982784 - DNA, 22 bp, Artificial Sequence
  chemically synthesized
tttgtgtaaagtctatgacctg

SEQ ID NO: 982785 - DNA, 22 bp, Artificial Sequence
  chemically synthesized
tgtgtaaagtctatgacctgct

SEQ ID NO: 982786 - DNA, 22 bp, Artificial Sequence
  chemically synthesized
gtgtaaagtctatgacctgctg

SEQ ID NO: 982787 - DNA, 22 bp, Artificial Sequence
  chemically synthesized
tgtaaagtctatgacctgctgt

SEQ ID NO: 982788 - DNA, 22 bp, Artificial Sequence
  chemically synthesized
gtgtctttccaaacagcaggtc

SEQ ID NO: 982789 - DNA, 22 bp, Artificial Sequence
  chemically synthesized
catatctggtgtctttccaaac

SEQ ID NO: 982790 - DNA, 22 bp, Artificial Sequence
  chemically synthesized
tccatatctggtgtctttccaa

SEQ ID NO: 982791 - DNA, 22 bp, Artificial Sequence
  chemically synthesized
tgacctgctgtttggaaagaca

SEQ ID NO: 982792 - DNA, 22 bp, Artificial Sequence
  chemically synthesized
ctccatatctggtgtctttcca

SEQ ID NO: 982793 - DNA, 22 bp, Artificial Sequence
  chemically synthesized
ctgtttggaaagacaccagata

SEQ ID NO: 982794 - DNA, 22 bp, Artificial Sequence
  chemically synthesized
aaaatcttctccatatctggtg

SEQ ID NO: 982795 - DNA, 22 bp, Artificial Sequence
  chemically synthesized
caaaatcttctccatatctggt

SEQ ID NO: 982796 - DNA, 22 bp, Artificial Sequence
  chemically synthesized
tttggaaagacaccagatatgg

SEQ ID NO: 982797 - DNA, 22 bp, Artificial Sequence
  chemically synthesized
ggaaagacaccagatatggaga

SEQ ID NO: 982798 - DNA, 22 bp, Artificial Sequence
  chemically synthesized
gaaagacaccagatatggagaa

SEQ ID NO: 982799 - DNA, 22 bp, Artificial Sequence
  chemically synthesized
ggcatttcaaaatcttctccat

SEQ ID NO: 982800 - DNA, 22 bp, Artificial Sequence
  chemically synthesized
gggcatttcaaaatcttctcca

SEQ ID NO: 982801 - DNA, 22 bp, Artificial Sequence
  chemically synthesized
taaagatttgggcatttcaaaa

SEQ ID NO: 982802 - DNA, 22 bp, Artificial Sequence
  chemically synthesized
ttataaagatttgggcatttca

SEQ ID NO: 982803 - DNA, 22 bp, Artificial Sequence
  chemically synthesized
gttataaagatttgggcatttc

SEQ ID NO: 982804 - DNA, 22 bp, Artificial Sequence
  chemically synthesized
tgttataaagatttgggcattt

SEQ ID NO: 982805 - DNA, 22 bp, Artificial Sequence
  chemically synthesized
gatgctttgttataaagatttg

SEQ ID NO: 982806 - DNA, 22 bp, Artificial Sequence
  chemically synthesized
tgaaatgcccaaatctttataa

SEQ ID NO: 982807 - DNA, 22 bp, Artificial Sequence
  chemically synthesized
ttcgatgctttgttataaagat

SEQ ID NO: 982808 - DNA, 22 bp, Artificial Sequence
  chemically synthesized
gaaatgcccaaatctttataac

SEQ ID NO: 982809 - DNA, 22 bp, Artificial Sequence
  chemically synthesized
aaatgcccaaatctttataaca

SEQ ID NO: 982810 - DNA, 22 bp, Artificial Sequence
  chemically synthesized
tgttcgatgctttgttataaag

SEQ ID NO: 982811 - DNA, 22 bp, Artificial Sequence
  chemically synthesized
agatcctctgttcgatgctttg

SEQ ID NO: 982812 - DNA, 22 bp, Artificial Sequence
  chemically synthesized
cagatcctctgttcgatgcttt

SEQ ID NO: 982813 - DNA, 22 bp, Artificial Sequence
  chemically synthesized
tcagatcctctgttcgatgctt

SEQ ID NO: 982814 - DNA, 22 bp, Artificial Sequence
  chemically synthesized
tttcagatcctctgttcgatgc

SEQ ID NO: 982815 - DNA, 22 bp, Artificial Sequence
  chemically synthesized
ctttcagatcctctgttcgatg

SEQ ID NO: 982816 - DNA, 22 bp, Artificial Sequence
  chemically synthesized
tctttcagatcctctgttcgat

SEQ ID NO: 982817 - DNA, 22 bp, Artificial Sequence
  chemically synthesized
tataacaaagcatcgaacagag

SEQ ID NO: 982818 - DNA, 22 bp, Artificial Sequence
  chemically synthesized
ataacaaagcatcgaacagagg

SEQ ID NO: 982819 - DNA, 22 bp, Artificial Sequence
  chemically synthesized
tttctttcagatcctctgttcg

SEQ ID NO: 982820 - DNA, 22 bp, Artificial Sequence
  chemically synthesized
taacaaagcatcgaacagagga

SEQ ID NO: 982821 - DNA, 22 bp, Artificial Sequence
  chemically synthesized
tgctctttctttcagatcctct

SEQ ID NO: 982822 - DNA, 22 bp, Artificial Sequence
  chemically synthesized
ttgtgctctttctttcagatcc

SEQ ID NO: 982823 - DNA, 22 bp, Artificial Sequence
  chemically synthesized
tgttgtgctctttctttcagat

SEQ ID NO: 982824 - DNA, 22 bp, Artificial Sequence
  chemically synthesized
ctgttgtgctctttctttcaga

SEQ ID NO: 982825 - DNA, 22 bp, Artificial Sequence
  chemically synthesized
agtttctgttgtgctctttctt

SEQ ID NO: 982826 - DNA, 22 bp, Artificial Sequence
  chemically synthesized
attgagtttctgttgtgctctt

SEQ ID NO: 982827 - DNA, 22 bp, Artificial Sequence
  chemically synthesized
cattgagtttctgttgtgctct

SEQ ID NO: 982828 - DNA, 22 bp, Artificial Sequence
  chemically synthesized
aaagaaagagcacaacagaaac

SEQ ID NO: 982829 - DNA, 22 bp, Artificial Sequence
  chemically synthesized
gatatttcattgagtttctgtt

SEQ ID NO: 982830 - DNA, 22 bp, Artificial Sequence
  chemically synthesized
ataagctagatatttcattgag

SEQ ID NO: 982831 - DNA, 22 bp, Artificial Sequence
  chemically synthesized
tcagactgataagctagatatt

SEQ ID NO: 982832 - DNA, 22 bp, Artificial Sequence
  chemically synthesized
attgtcagactgataagctaga

SEQ ID NO: 982833 - DNA, 22 bp, Artificial Sequence
  chemically synthesized
aatgaaatatctagcttatcag

SEQ ID NO: 982834 - DNA, 22 bp, Artificial Sequence
  chemically synthesized
gatatgattaattgtcagactg

SEQ ID NO: 982835 - DNA, 22 bp, Artificial Sequence
  chemically synthesized
agatatgattaattgtcagact

SEQ ID NO: 982836 - DNA, 22 bp, Artificial Sequence
  chemically synthesized
gcttatcagtctgacaattaat

SEQ ID NO: 982837 - DNA, 22 bp, Artificial Sequence
  chemically synthesized
atcagtctgacaattaatcata

SEQ ID NO: 982838 - DNA, 22 bp, Artificial Sequence
  chemically synthesized
tcagtctgacaattaatcatat

SEQ ID NO: 982839 - DNA, 22 bp, Artificial Sequence
  chemically synthesized
gaggtggggccttagatatgat

SEQ ID NO: 982840 - DNA, 22 bp, Artificial Sequence
  chemically synthesized
acaattaatcatatctaaggcc

SEQ ID NO: 982841 - DNA, 22 bp, Artificial Sequence
  chemically synthesized
agattagaggtggggccttaga

SEQ ID NO: 982842 - DNA, 22 bp, Artificial Sequence
  chemically synthesized
atcatatctaaggccccacctc

SEQ ID NO: 982843 - DNA, 22 bp, Artificial Sequence
  chemically synthesized
aggtactgagattagaggtggg

SEQ ID NO: 982844 - DNA, 22 bp, Artificial Sequence
  chemically synthesized
gctaaggtactgagattagagg

SEQ ID NO: 982845 - DNA, 22 bp, Artificial Sequence
  chemically synthesized
ggctaaggtactgagattagag

SEQ ID NO: 982846 - DNA, 22 bp, Artificial Sequence
  chemically synthesized
tggctaaggtactgagattaga

SEQ ID NO: 982847 - DNA, 22 bp, Artificial Sequence
  chemically synthesized
ttggctaaggtactgagattag

SEQ ID NO: 982848 - DNA, 22 bp, Artificial Sequence
  chemically synthesized
aggccccacctctaatctcagt

SEQ ID NO: 982849 - DNA, 22 bp, Artificial Sequence
  chemically synthesized
atttttggctaaggtactgaga

SEQ ID NO: 982850 - DNA, 22 bp, Artificial Sequence
  chemically synthesized
aatttttggctaaggtactgag

SEQ ID NO: 982851 - DNA, 22 bp, Artificial Sequence
  chemically synthesized
gtatttaatttttggctaaggt

SEQ ID NO: 982852 - DNA, 22 bp, Artificial Sequence
  chemically synthesized
ggtatttaatttttggctaagg

SEQ ID NO: 982853 - DNA, 22 bp, Artificial Sequence
  chemically synthesized
taatctcagtaccttagccaaa

SEQ ID NO: 982854 - DNA, 22 bp, Artificial Sequence
  chemically synthesized
atctcagtaccttagccaaaaa

SEQ ID NO: 982855 - DNA, 22 bp, Artificial Sequence
  chemically synthesized
tccttggtatttaatttttggc

SEQ ID NO: 982856 - DNA, 22 bp, Artificial Sequence
  chemically synthesized
agtaccttagccaaaaattaaa

SEQ ID NO: 982857 - DNA, 22 bp, Artificial Sequence
  chemically synthesized
taactgtccttggtatttaatt

SEQ ID NO: 982858 - DNA, 22 bp, Artificial Sequence
  chemically synthesized
agccaaaaattaaataccaagg

SEQ ID NO: 982859 - DNA, 22 bp, Artificial Sequence
  chemically synthesized
gccaaaaattaaataccaagga

SEQ ID NO: 982860 - DNA, 22 bp, Artificial Sequence
  chemically synthesized
gagcaaactgtaactgtccttg

SEQ ID NO: 982861 - DNA, 22 bp, Artificial Sequence
  chemically synthesized
aataccaaggacagttacagtt

SEQ ID NO: 982862 - DNA, 22 bp, Artificial Sequence
  chemically synthesized
ggtatctagagcaaactgtaac

SEQ ID NO: 982863 - DNA, 22 bp, Artificial Sequence
  chemically synthesized
taggtatctagagcaaactgta

SEQ ID NO: 982864 - DNA, 22 bp, Artificial Sequence
  chemically synthesized
ctctaggtatctagagcaaact

SEQ ID NO: 982865 - DNA, 22 bp, Artificial Sequence
  chemically synthesized
cctctaggtatctagagcaaac

SEQ ID NO: 982866 - DNA, 22 bp, Artificial Sequence
  chemically synthesized
tcctctaggtatctagagcaaa

SEQ ID NO: 982867 - DNA, 22 bp, Artificial Sequence
  chemically synthesized
tttcctctaggtatctagagca

SEQ ID NO: 982868 - DNA, 22 bp, Artificial Sequence
  chemically synthesized
tctttcctctaggtatctagag

SEQ ID NO: 982869 - DNA, 22 bp, Artificial Sequence
  chemically synthesized
cagtttgctctagatacctaga

SEQ ID NO: 982870 - DNA, 22 bp, Artificial Sequence
  chemically synthesized
gctctagatacctagaggaaag

SEQ ID NO: 982871 - DNA, 22 bp, Artificial Sequence
  chemically synthesized
ctctagatacctagaggaaaga

SEQ ID NO: 982872 - DNA, 22 bp, Artificial Sequence
  chemically synthesized
tagatacctagaggaaagagaa

SEQ ID NO: 982873 - DNA, 22 bp, Artificial Sequence
  chemically synthesized
gatacctagaggaaagagaacc

SEQ ID NO: 982874 - DNA, 22 bp, Artificial Sequence
  chemically synthesized
gaggaaagagaacctccttttc

SEQ ID NO: 982875 - DNA, 22 bp, Artificial Sequence
  chemically synthesized
gtatggaaaagatgaggaaaag

SEQ ID NO: 982876 - DNA, 22 bp, Artificial Sequence
  chemically synthesized
agtatggaaaagatgaggaaaa

SEQ ID NO: 982877 - DNA, 22 bp, Artificial Sequence
  chemically synthesized
tagtatggaaaagatgaggaaa

SEQ ID NO: 982878 - DNA, 22 bp, Artificial Sequence
  chemically synthesized
ttagtatggaaaagatgaggaa

SEQ ID NO: 982879 - DNA, 22 bp, Artificial Sequence
  chemically synthesized
cttttcctcatcttttccatac

SEQ ID NO: 982880 - DNA, 22 bp, Artificial Sequence
  chemically synthesized
ttcctcatcttttccatactaa

SEQ ID NO: 982881 - DNA, 22 bp, Artificial Sequence
  chemically synthesized
tcctcatcttttccatactaaa

SEQ ID NO: 982882 - DNA, 22 bp, Artificial Sequence
  chemically synthesized
cctcatcttttccatactaaaa

SEQ ID NO: 982883 - DNA, 22 bp, Artificial Sequence
  chemically synthesized
ctcatcttttccatactaaaaa

SEQ ID NO: 982884 - DNA, 22 bp, Artificial Sequence
  chemically synthesized
atcttttccatactaaaaatgt

SEQ ID NO: 982885 - DNA, 22 bp, Artificial Sequence
  chemically synthesized
aaagatacagtatacattttta

SEQ ID NO: 982886 - DNA, 22 bp, Artificial Sequence
  chemically synthesized
ttccatactaaaaatgtatact

SEQ ID NO: 982887 - DNA, 22 bp, Artificial Sequence
  chemically synthesized
tccatactaaaaatgtatactg

SEQ ID NO: 982888 - DNA, 22 bp, Artificial Sequence
  chemically synthesized
atctgaaagatacagtatacat

SEQ ID NO: 982889 - DNA, 22 bp, Artificial Sequence
  chemically synthesized
ccatactaaaaatgtatactgt

SEQ ID NO: 982890 - DNA, 22 bp, Artificial Sequence
  chemically synthesized
catactaaaaatgtatactgta

SEQ ID NO: 982891 - DNA, 22 bp, Artificial Sequence
  chemically synthesized
atatattaatctgaaagataca

SEQ ID NO: 982892 - DNA, 22 bp, Artificial Sequence
  chemically synthesized
aaaatgtatactgtatctttca

SEQ ID NO: 982893 - DNA, 22 bp, Artificial Sequence
  chemically synthesized
gctgatatattaatctgaaaga

SEQ ID NO: 982894 - DNA, 22 bp, Artificial Sequence
  chemically synthesized
agctgatatattaatctgaaag

SEQ ID NO: 982895 - DNA, 22 bp, Artificial Sequence
  chemically synthesized
tagctgatatattaatctgaaa

SEQ ID NO: 982896 - DNA, 22 bp, Artificial Sequence
  chemically synthesized
tatctttcagattaatatatca

SEQ ID NO: 982897 - DNA, 22 bp, Artificial Sequence
  chemically synthesized
tcagattaatatatcagctaaa

SEQ ID NO: 982898 - DNA, 22 bp, Artificial Sequence
  chemically synthesized
aagtaacaaaattttagctgat

SEQ ID NO: 982899 - DNA, 22 bp, Artificial Sequence
  chemically synthesized
cagattaatatatcagctaaaa

SEQ ID NO: 982900 - DNA, 22 bp, Artificial Sequence
  chemically synthesized
agattaatatatcagctaaaat

SEQ ID NO: 982901 - DNA, 22 bp, Artificial Sequence
  chemically synthesized
ttgaagtaacaaaattttagct

SEQ ID NO: 982902 - DNA, 22 bp, Artificial Sequence
  chemically synthesized
attgaagtaacaaaattttagc

SEQ ID NO: 982903 - DNA, 22 bp, Artificial Sequence
  chemically synthesized
atatatcagctaaaattttgtt

SEQ ID NO: 982904 - DNA, 22 bp, Artificial Sequence
  chemically synthesized
caaaaatggtttattgaagtaa

SEQ ID NO: 982905 - DNA, 22 bp, Artificial Sequence
  chemically synthesized
aaattttgttacttcaataaac

SEQ ID NO: 982906 - DNA, 22 bp, Artificial Sequence
  chemically synthesized
tgctgcaaaaatggtttattga

SEQ ID NO: 982907 - DNA, 22 bp, Artificial Sequence
  chemically synthesized
tgttacttcaataaaccatttt

SEQ ID NO: 982908 - DNA, 22 bp, Artificial Sequence
  chemically synthesized
gttacttcaataaaccattttt

SEQ ID NO: 982909 - DNA, 22 bp, Artificial Sequence
  chemically synthesized
ttacttcaataaaccatttttg

SEQ ID NO: 982910 - DNA, 22 bp, Artificial Sequence
  chemically synthesized
cttcaataaaccatttttgcag

SEQ ID NO: 982911 - DNA, 22 bp, Artificial Sequence
  chemically synthesized
caataaaccatttttgcagcat

SEQ ID NO: 982912 - DNA, 22 bp, Artificial Sequence
  chemically synthesized
cagtcaagagttatgctgcaaa

SEQ ID NO: 982913 - DNA, 22 bp, Artificial Sequence
  chemically synthesized
aataaaccatttttgcagcata

SEQ ID NO: 982914 - DNA, 22 bp, Artificial Sequence
  chemically synthesized
gcagtcaagagttatgctgcaa

SEQ ID NO: 982915 - DNA, 22 bp, Artificial Sequence
  chemically synthesized
tttgcagtcaagagttatgctg

SEQ ID NO: 982916 - DNA, 22 bp, Artificial Sequence
  chemically synthesized
atttgcagtcaagagttatgct

SEQ ID NO: 982917 - DNA, 22 bp, Artificial Sequence
  chemically synthesized
tatttgcagtcaagagttatgc

SEQ ID NO: 982918 - DNA, 22 bp, Artificial Sequence
  chemically synthesized
ttatttgcagtcaagagttatg

SEQ ID NO: 982919 - DNA, 22 bp, Artificial Sequence
  chemically synthesized
ttgcagcataactcttgactgc

SEQ ID NO: 982920 - DNA, 22 bp, Artificial Sequence
  chemically synthesized
tgcagcataactcttgactgca

SEQ ID NO: 982921 - DNA, 22 bp, Artificial Sequence
  chemically synthesized
gcagcataactcttgactgcaa

SEQ ID NO: 982922 - DNA, 22 bp, Artificial Sequence
  chemically synthesized
cagcataactcttgactgcaaa

SEQ ID NO: 982923 - DNA, 22 bp, Artificial Sequence
  chemically synthesized
tcagtatatatacttttatttg

SEQ ID NO: 982924 - DNA, 22 bp, Artificial Sequence
  chemically synthesized
ttgactgcaaataaaagtatat

SEQ ID NO: 982925 - DNA, 22 bp, Artificial Sequence
  chemically synthesized
gactgcaaataaaagtatatat

SEQ ID NO: 982926 - DNA, 22 bp, Artificial Sequence
  chemically synthesized
aggattgtcagtatatatactt

SEQ ID NO: 982927 - DNA, 22 bp, Artificial Sequence
  chemically synthesized
actgcaaataaaagtatatata

SEQ ID NO: 982928 - DNA, 22 bp, Artificial Sequence
  chemically synthesized
gaggattgtcagtatatatact

SEQ ID NO: 982929 - DNA, 22 bp, Artificial Sequence
  chemically synthesized
caaataaaagtatatatactga

SEQ ID NO: 982930 - DNA, 22 bp, Artificial Sequence
  chemically synthesized
aaaaacaaaatttgaggattgt

SEQ ID NO: 982931 - DNA, 22 bp, Artificial Sequence
  chemically synthesized
acaatcctcaaattttgttttt

SEQ ID NO: 982932 - DNA, 22 bp, Artificial Sequence
  chemically synthesized
atgaagcaaagctgaaaaacaa

SEQ ID NO: 982933 - DNA, 22 bp, Artificial Sequence
  chemically synthesized
aaattttgtttttcagctttgc

SEQ ID NO: 982934 - DNA, 22 bp, Artificial Sequence
  chemically synthesized
gtaatctgatgaagcaaagctg

SEQ ID NO: 982935 - DNA, 22 bp, Artificial Sequence
  chemically synthesized
tagtaatctgatgaagcaaagc

SEQ ID NO: 982936 - DNA, 22 bp, Artificial Sequence
  chemically synthesized
tgtttttcagctttgcttcatc

SEQ ID NO: 982937 - DNA, 22 bp, Artificial Sequence
  chemically synthesized
gtttttcagctttgcttcatca

SEQ ID NO: 982938 - DNA, 22 bp, Artificial Sequence
  chemically synthesized
attctagtaatctgatgaagca

SEQ ID NO: 982939 - DNA, 22 bp, Artificial Sequence
  chemically synthesized
tttttcagctttgcttcatcag

SEQ ID NO: 982940 - DNA, 22 bp, Artificial Sequence
  chemically synthesized
ttcagctttgcttcatcagatt

SEQ ID NO: 982941 - DNA, 22 bp, Artificial Sequence
  chemically synthesized
cctcattctagtaatctgatga

SEQ ID NO: 982942 - DNA, 22 bp, Artificial Sequence
  chemically synthesized
tcagctttgcttcatcagatta

SEQ ID NO: 982943 - DNA, 22 bp, Artificial Sequence
  chemically synthesized
cagctttgcttcatcagattac

SEQ ID NO: 982944 - DNA, 22 bp, Artificial Sequence
  chemically synthesized
agctttgcttcatcagattact

SEQ ID NO: 982945 - DNA, 22 bp, Artificial Sequence
  chemically synthesized
tgcttcatcagattactagaat

SEQ ID NO: 982946 - DNA, 22 bp, Artificial Sequence
  chemically synthesized
gcttcatcagattactagaatg

SEQ ID NO: 982947 - DNA, 22 bp, Artificial Sequence
  chemically synthesized
cttcatcagattactagaatga

SEQ ID NO: 982948 - DNA, 22 bp, Artificial Sequence
  chemically synthesized
catcagattactagaatgaggc

SEQ ID NO: 982949 - DNA, 22 bp, Artificial Sequence
  chemically synthesized
atcagattactagaatgaggca

SEQ ID NO: 982950 - DNA, 22 bp, Artificial Sequence
  chemically synthesized
aatcaatgcatgacactgcctc

SEQ ID NO: 982951 - DNA, 22 bp, Artificial Sequence
  chemically synthesized
ttgaatcaatgcatgacactgc

SEQ ID NO: 982952 - DNA, 22 bp, Artificial Sequence
  chemically synthesized
attgaatcaatgcatgacactg

SEQ ID NO: 982953 - DNA, 22 bp, Artificial Sequence
  chemically synthesized
ctagaatgaggcagtgtcatgc

SEQ ID NO: 982954 - DNA, 22 bp, Artificial Sequence
  chemically synthesized
tattgaatcaatgcatgacact

SEQ ID NO: 982955 - DNA, 22 bp, Artificial Sequence
  chemically synthesized
gaatgaggcagtgtcatgcatt

SEQ ID NO: 982956 - DNA, 22 bp, Artificial Sequence
  chemically synthesized
gaaattttattgaatcaatgca

SEQ ID NO: 982957 - DNA, 22 bp, Artificial Sequence
  chemically synthesized
ggaaattttattgaatcaatgc

SEQ ID NO: 982958 - DNA, 22 bp, Artificial Sequence
  chemically synthesized
tggaaattttattgaatcaatg

SEQ ID NO: 982959 - DNA, 22 bp, Artificial Sequence
  chemically synthesized
ggtgactttggaaattttattg

SEQ ID NO: 982960 - DNA, 22 bp, Artificial Sequence
  chemically synthesized
ttaggtgactttggaaatttta

SEQ ID NO: 982961 - DNA, 22 bp, Artificial Sequence
  chemically synthesized
attaggtgactttggaaatttt

SEQ ID NO: 982962 - DNA, 22 bp, Artificial Sequence
  chemically synthesized
tattaggtgactttggaaattt

SEQ ID NO: 982963 - DNA, 22 bp, Artificial Sequence
  chemically synthesized
ttattaggtgactttggaaatt

SEQ ID NO: 982964 - DNA, 22 bp, Artificial Sequence
  chemically synthesized
attcaataaaatttccaaagtc

SEQ ID NO: 982965 - DNA, 22 bp, Artificial Sequence
  chemically synthesized
aataaaatttccaaagtcacct

SEQ ID NO: 982966 - DNA, 22 bp, Artificial Sequence
  chemically synthesized
atcataaaatgtacttttatta

SEQ ID NO: 982967 - DNA, 22 bp, Artificial Sequence
  chemically synthesized
ccaaagtcacctaataaaagta

SEQ ID NO: 982968 - DNA, 22 bp, Artificial Sequence
  chemically synthesized
caaagtcacctaataaaagtac

SEQ ID NO: 982969 - DNA, 22 bp, Artificial Sequence
  chemically synthesized
tcatcataaaatgtacttttat

SEQ ID NO: 982970 - DNA, 22 bp, Artificial Sequence
  chemically synthesized
ctcatcataaaatgtactttta

SEQ ID NO: 982971 - DNA, 22 bp, Artificial Sequence
  chemically synthesized
tctcatcataaaatgtactttt

SEQ ID NO: 982972 - DNA, 22 bp, Artificial Sequence
  chemically synthesized
ttttctcatcataaaatgtact

SEQ ID NO: 982973 - DNA, 22 bp, Artificial Sequence
  chemically synthesized
gtgttgttttctcatcataaaa

SEQ ID NO: 982974 - DNA, 22 bp, Artificial Sequence
  chemically synthesized
ataaaagtacattttatgatga

SEQ ID NO: 982975 - DNA, 22 bp, Artificial Sequence
  chemically synthesized
ggtgttgttttctcatcataaa

SEQ ID NO: 982976 - DNA, 22 bp, Artificial Sequence
  chemically synthesized
tggtgttgttttctcatcataa

SEQ ID NO: 982977 - DNA, 22 bp, Artificial Sequence
  chemically synthesized
ttggtgttgttttctcatcata

SEQ ID NO: 982978 - DNA, 22 bp, Artificial Sequence
  chemically synthesized
tttggtgttgttttctcatcat

SEQ ID NO: 982979 - DNA, 22 bp, Artificial Sequence
  chemically synthesized
ttttttggtgttgttttctcat

SEQ ID NO: 982980 - DNA, 22 bp, Artificial Sequence
  chemically synthesized
gtaactattttttggtgttgtt

SEQ ID NO: 982981 - DNA, 22 bp, Artificial Sequence
  chemically synthesized
tatgatgagaaaacaacaccaa

SEQ ID NO: 982982 - DNA, 22 bp, Artificial Sequence
  chemically synthesized
atgatgagaaaacaacaccaaa

SEQ ID NO: 982983 - DNA, 22 bp, Artificial Sequence
  chemically synthesized
tgatgagaaaacaacaccaaaa

SEQ ID NO: 982984 - DNA, 22 bp, Artificial Sequence
  chemically synthesized
aagaggtatcaagcattggtaa

SEQ ID NO: 982985 - DNA, 22 bp, Artificial Sequence
  chemically synthesized
ccaatgcttgatacctcttgag

SEQ ID NO: 982986 - DNA, 22 bp, Artificial Sequence
  chemically synthesized
agaggtccacatctcaagaggt

SEQ ID NO: 982987 - DNA, 22 bp, Artificial Sequence
  chemically synthesized
taagaggtccacatctcaagag

SEQ ID NO: 982988 - DNA, 22 bp, Artificial Sequence
  chemically synthesized
gcctctaagaggtccacatctc

SEQ ID NO: 982989 - DNA, 22 bp, Artificial Sequence
  chemically synthesized
gatacctcttgagatgtggacc

SEQ ID NO: 982990 - DNA, 22 bp, Artificial Sequence
  chemically synthesized
atacctcttgagatgtggacct

SEQ ID NO: 982991 - DNA, 22 bp, Artificial Sequence
  chemically synthesized
tcaaattggcctctaagaggtc

SEQ ID NO: 982992 - DNA, 22 bp, Artificial Sequence
  chemically synthesized
ttgagatgtggacctcttagag

SEQ ID NO: 982993 - DNA, 22 bp, Artificial Sequence
  chemically synthesized
gagatgtggacctcttagaggc

SEQ ID NO: 982994 - DNA, 22 bp, Artificial Sequence
  chemically synthesized
actgtcaaattggcctctaaga

SEQ ID NO: 982995 - DNA, 22 bp, Artificial Sequence
  chemically synthesized
agatgtggacctcttagaggcc

SEQ ID NO: 982996 - DNA, 22 bp, Artificial Sequence
  chemically synthesized
tgactgtcaaattggcctctaa

SEQ ID NO: 982997 - DNA, 22 bp, Artificial Sequence
  chemically synthesized
ctgactgtcaaattggcctcta

SEQ ID NO: 982998 - DNA, 22 bp, Artificial Sequence
  chemically synthesized
ttctgactgtcaaattggcctc

SEQ ID NO: 982999 - DNA, 22 bp, Artificial Sequence
  chemically synthesized
atactcttctgactgtcaaatt

SEQ ID NO: 983000 - DNA, 22 bp, Artificial Sequence
  chemically synthesized
ttagaggccaatttgacagtca

SEQ ID NO: 983001 - DNA, 22 bp, Artificial Sequence
  chemically synthesized
ctcatactcttctgactgtcaa

SEQ ID NO: 983002 - DNA, 22 bp, Artificial Sequence
  chemically synthesized
agaggccaatttgacagtcaga

SEQ ID NO: 983003 - DNA, 22 bp, Artificial Sequence
  chemically synthesized
gaggccaatttgacagtcagaa

SEQ ID NO: 983004 - DNA, 22 bp, Artificial Sequence
  chemically synthesized
aaaaacattactcatactcttc

SEQ ID NO: 983005 - DNA, 22 bp, Artificial Sequence
  chemically synthesized
gaaaaacattactcatactctt

SEQ ID NO: 983006 - DNA, 22 bp, Artificial Sequence
  chemically synthesized
tgaaaaacattactcatactct

SEQ ID NO: 983007 - DNA, 22 bp, Artificial Sequence
  chemically synthesized
ttgaaaaacattactcatactc

SEQ ID NO: 983008 - DNA, 22 bp, Artificial Sequence
  chemically synthesized
gacagtcagaagagtatgagta

SEQ ID NO: 983009 - DNA, 22 bp, Artificial Sequence
  chemically synthesized
acagtcagaagagtatgagtaa

SEQ ID NO: 983010 - DNA, 22 bp, Artificial Sequence
  chemically synthesized
atgaaacttttgaaaaacatta

SEQ ID NO: 983011 - DNA, 22 bp, Artificial Sequence
  chemically synthesized
tactcatgaaacttttgaaaaa

SEQ ID NO: 983012 - DNA, 22 bp, Artificial Sequence
  chemically synthesized
gtactcatgaaacttttgaaaa

SEQ ID NO: 983013 - DNA, 22 bp, Artificial Sequence
  chemically synthesized
tgtactcatgaaacttttgaaa

SEQ ID NO: 983014 - DNA, 22 bp, Artificial Sequence
  chemically synthesized
attttgtactcatgaaactttt

SEQ ID NO: 983015 - DNA, 22 bp, Artificial Sequence
  chemically synthesized
aattttgtactcatgaaacttt

SEQ ID NO: 983016 - DNA, 22 bp, Artificial Sequence
  chemically synthesized
taattttgtactcatgaaactt

SEQ ID NO: 983017 - DNA, 22 bp, Artificial Sequence
  chemically synthesized
ttcaaaagtttcatgagtacaa

SEQ ID NO: 983018 - DNA, 22 bp, Artificial Sequence
  chemically synthesized
tcaaaagtttcatgagtacaaa

SEQ ID NO: 983019 - DNA, 22 bp, Artificial Sequence
  chemically synthesized
taggattttaattttgtactca

SEQ ID NO: 983020 - DNA, 22 bp, Artificial Sequence
  chemically synthesized
caaaagtttcatgagtacaaaa

SEQ ID NO: 983021 - DNA, 22 bp, Artificial Sequence
  chemically synthesized
aaaagtttcatgagtacaaaat

SEQ ID NO: 983022 - DNA, 22 bp, Artificial Sequence
  chemically synthesized
cattgtaggattttaattttgt

SEQ ID NO: 983023 - DNA, 22 bp, Artificial Sequence
  chemically synthesized
catgagtacaaaattaaaatcc

SEQ ID NO: 983024 - DNA, 22 bp, Artificial Sequence
  chemically synthesized
atgagtacaaaattaaaatcct

SEQ ID NO: 983025 - DNA, 22 bp, Artificial Sequence
  chemically synthesized
gtattacattgtaggattttaa

SEQ ID NO: 983026 - DNA, 22 bp, Artificial Sequence
  chemically synthesized
aaatcctacaatgtaataccag

SEQ ID NO: 983027 - DNA, 22 bp, Artificial Sequence
  chemically synthesized
agtaggaagagaagctggtatt

SEQ ID NO: 983028 - DNA, 22 bp, Artificial Sequence
  chemically synthesized
aagtaggaagagaagctggtat

SEQ ID NO: 983029 - DNA, 22 bp, Artificial Sequence
  chemically synthesized
taagtaggaagagaagctggta

SEQ ID NO: 983030 - DNA, 22 bp, Artificial Sequence
  chemically synthesized
ctttaagtaggaagagaagctg

SEQ ID NO: 983031 - DNA, 22 bp, Artificial Sequence
  chemically synthesized
caatgtaataccagcttctctt

SEQ ID NO: 983032 - DNA, 22 bp, Artificial Sequence
  chemically synthesized
tgatctcctttaagtaggaaga

SEQ ID NO: 983033 - DNA, 22 bp, Artificial Sequence
  chemically synthesized
aatcgttatgatctcctttaag

SEQ ID NO: 983034 - DNA, 22 bp, Artificial Sequence
  chemically synthesized
ctcttcctacttaaaggagatc

SEQ ID NO: 983035 - DNA, 22 bp, Artificial Sequence
  chemically synthesized
tcttcctacttaaaggagatca

SEQ ID NO: 983036 - DNA, 22 bp, Artificial Sequence
  chemically synthesized
attcaatcgttatgatctcctt

SEQ ID NO: 983037 - DNA, 22 bp, Artificial Sequence
  chemically synthesized
ttcctacttaaaggagatcata

SEQ ID NO: 983038 - DNA, 22 bp, Artificial Sequence
  chemically synthesized
cctacttaaaggagatcataac

SEQ ID NO: 983039 - DNA, 22 bp, Artificial Sequence
  chemically synthesized
ctacttaaaggagatcataacg

SEQ ID NO: 983040 - DNA, 22 bp, Artificial Sequence
  chemically synthesized
cttaaaggagatcataacgatt

SEQ ID NO: 983041 - DNA, 22 bp, Artificial Sequence
  chemically synthesized
aaaggagatcataacgattgaa

SEQ ID NO: 983042 - DNA, 22 bp, Artificial Sequence
  chemically synthesized
aaggagatcataacgattgaat

SEQ ID NO: 983043 - DNA, 22 bp, Artificial Sequence
  chemically synthesized
aatgtaatcctgattcaatcgt

SEQ ID NO: 983044 - DNA, 22 bp, Artificial Sequence
  chemically synthesized
gaatgtaatcctgattcaatcg

SEQ ID NO: 983045 - DNA, 22 bp, Artificial Sequence
  chemically synthesized
tttgaatgtaatcctgattcaa

SEQ ID NO: 983046 - DNA, 22 bp, Artificial Sequence
  chemically synthesized
atttgaatgtaatcctgattca

SEQ ID NO: 983047 - DNA, 22 bp, Artificial Sequence
  chemically synthesized
gcttatttgaatgtaatcctga

SEQ ID NO: 983048 - DNA, 22 bp, Artificial Sequence
  chemically synthesized
tcattggcttatttgaatgtaa

SEQ ID NO: 983049 - DNA, 22 bp, Artificial Sequence
  chemically synthesized
gtcattggcttatttgaatgta

SEQ ID NO: 983050 - DNA, 22 bp, Artificial Sequence
  chemically synthesized
aatcaggattacattcaaataa

SEQ ID NO: 983051 - DNA, 22 bp, Artificial Sequence
  chemically synthesized
acatttgtcattggcttatttg

SEQ ID NO: 983052 - DNA, 22 bp, Artificial Sequence
  chemically synthesized
cacatttgtcattggcttattt

SEQ ID NO: 983053 - DNA, 22 bp, Artificial Sequence
  chemically synthesized
atttcacatttgtcattggctt

SEQ ID NO: 983054 - DNA, 22 bp, Artificial Sequence
  chemically synthesized
catttcacatttgtcattggct

SEQ ID NO: 983055 - DNA, 22 bp, Artificial Sequence
  chemically synthesized
tcatttcacatttgtcattggc

SEQ ID NO: 983056 - DNA, 22 bp, Artificial Sequence
  chemically synthesized
cattcaaataagccaatgacaa

SEQ ID NO: 983057 - DNA, 22 bp, Artificial Sequence
  chemically synthesized
tttcatttcacatttgtcattg

SEQ ID NO: 983058 - DNA, 22 bp, Artificial Sequence
  chemically synthesized
aaataagccaatgacaaatgtg

SEQ ID NO: 983059 - DNA, 22 bp, Artificial Sequence
  chemically synthesized
gtgagaataactctttcatttc

SEQ ID NO: 983060 - DNA, 22 bp, Artificial Sequence
  chemically synthesized
ttggtgagaataactctttcat

SEQ ID NO: 983061 - DNA, 22 bp, Artificial Sequence
  chemically synthesized
ggatgcaatgattattggtgag

SEQ ID NO: 983062 - DNA, 22 bp, Artificial Sequence
  chemically synthesized
aggatgcaatgattattggtga

SEQ ID NO: 983063 - DNA, 22 bp, Artificial Sequence
  chemically synthesized
taggatgcaatgattattggtg

SEQ ID NO: 983064 - DNA, 22 bp, Artificial Sequence
  chemically synthesized
ttaggatgcaatgattattggt

SEQ ID NO: 983065 - DNA, 22 bp, Artificial Sequence
  chemically synthesized
gcttttaggatgcaatgattat

SEQ ID NO: 983066 - DNA, 22 bp, Artificial Sequence
  chemically synthesized
ggcttttaggatgcaatgatta

SEQ ID NO: 983067 - DNA, 22 bp, Artificial Sequence
  chemically synthesized
tggcttttaggatgcaatgatt

SEQ ID NO: 983068 - DNA, 22 bp, Artificial Sequence
  chemically synthesized
ttctcaccaataatcattgcat

SEQ ID NO: 983069 - DNA, 22 bp, Artificial Sequence
  chemically synthesized
tttggcttttaggatgcaatga

SEQ ID NO: 983070 - DNA, 22 bp, Artificial Sequence
  chemically synthesized
ctttggcttttaggatgcaatg

SEQ ID NO: 983071 - DNA, 22 bp, Artificial Sequence
  chemically synthesized
tcaccaataatcattgcatcct

SEQ ID NO: 983072 - DNA, 22 bp, Artificial Sequence
  chemically synthesized
tctttggcttttaggatgcaat

SEQ ID NO: 983073 - DNA, 22 bp, Artificial Sequence
  chemically synthesized
ttctttggcttttaggatgcaa

SEQ ID NO: 983074 - DNA, 22 bp, Artificial Sequence
  chemically synthesized
accaataatcattgcatcctaa

SEQ ID NO: 983075 - DNA, 22 bp, Artificial Sequence
  chemically synthesized
tagcagtttttctttggctttt

SEQ ID NO: 983076 - DNA, 22 bp, Artificial Sequence
  chemically synthesized
atagcagtttttctttggcttt

SEQ ID NO: 983077 - DNA, 22 bp, Artificial Sequence
  chemically synthesized
catcctaaaagccaaagaaaaa

SEQ ID NO: 983078 - DNA, 22 bp, Artificial Sequence
  chemically synthesized
agaagtcccttatagcagtttt

SEQ ID NO: 983079 - DNA, 22 bp, Artificial Sequence
  chemically synthesized
aaagccaaagaaaaactgctat

SEQ ID NO: 983080 - DNA, 22 bp, Artificial Sequence
  chemically synthesized
attgagaagtcccttatagcag

SEQ ID NO: 983081 - DNA, 22 bp, Artificial Sequence
  chemically synthesized
tagggactgattgagaagtccc

SEQ ID NO: 983082 - DNA, 22 bp, Artificial Sequence
  chemically synthesized
tctatagggactgattgagaag

SEQ ID NO: 983083 - DNA, 22 bp, Artificial Sequence
  chemically synthesized
ctataagggacttctcaatcag

SEQ ID NO: 983084 - DNA, 22 bp, Artificial Sequence
  chemically synthesized
ctatctatagggactgattgag

SEQ ID NO: 983085 - DNA, 22 bp, Artificial Sequence
  chemically synthesized
taagggacttctcaatcagtcc

SEQ ID NO: 983086 - DNA, 22 bp, Artificial Sequence
  chemically synthesized
ccaattcctatctatagggact

SEQ ID NO: 983087 - DNA, 22 bp, Artificial Sequence
  chemically synthesized
ctcaatcagtccctatagatag

SEQ ID NO: 983088 - DNA, 22 bp, Artificial Sequence
  chemically synthesized
tcaatcagtccctatagatagg

SEQ ID NO: 983089 - DNA, 22 bp, Artificial Sequence
  chemically synthesized
aatcagtccctatagataggaa

SEQ ID NO: 983090 - DNA, 22 bp, Artificial Sequence
  chemically synthesized
taggaactaccaattcctatct

SEQ ID NO: 983091 - DNA, 22 bp, Artificial Sequence
  chemically synthesized
tgtaggaactaccaattcctat

SEQ ID NO: 983092 - DNA, 22 bp, Artificial Sequence
  chemically synthesized
ctgtaggaactaccaattccta

SEQ ID NO: 983093 - DNA, 22 bp, Artificial Sequence
  chemically synthesized
tctgtaggaactaccaattcct

SEQ ID NO: 983094 - DNA, 22 bp, Artificial Sequence
  chemically synthesized
ttctgtaggaactaccaattcc

SEQ ID NO: 983095 - DNA, 22 bp, Artificial Sequence
  chemically synthesized
tttctgtaggaactaccaattc

SEQ ID NO: 983096 - DNA, 22 bp, Artificial Sequence
  chemically synthesized
tagataggaattggtagttcct

SEQ ID NO: 983097 - DNA, 22 bp, Artificial Sequence
  chemically synthesized
gtagttcctacagaaaaaatat

SEQ ID NO: 983098 - DNA, 22 bp, Artificial Sequence
  chemically synthesized
ctacagaaaaaatatatataca

SEQ ID NO: 983099 - DNA, 22 bp, Artificial Sequence
  chemically synthesized
tatatatatagatgtatatata

SEQ ID NO: 983100 - DNA, 22 bp, Artificial Sequence
  chemically synthesized
cagaaaaaatatatatacatct

SEQ ID NO: 983101 - DNA, 22 bp, Artificial Sequence
  chemically synthesized
catatctatatatatatagatg

SEQ ID NO: 983102 - DNA, 22 bp, Artificial Sequence
  chemically synthesized
tccatatctatatatatataga

SEQ ID NO: 983103 - DNA, 22 bp, Artificial Sequence
  chemically synthesized
tctccatatctatatatatata

SEQ ID NO: 983104 - DNA, 22 bp, Artificial Sequence
  chemically synthesized
tctctccatatctatatatata

SEQ ID NO: 983105 - DNA, 22 bp, Artificial Sequence
  chemically synthesized
tctctctccatatctatatata

SEQ ID NO: 983106 - DNA, 22 bp, Artificial Sequence
  chemically synthesized
tctctctctccatatctatata

SEQ ID NO: 983107 - DNA, 22 bp, Artificial Sequence
  chemically synthesized
tctctctctctccatatctata

SEQ ID NO: 983108 - DNA, 22 bp, Artificial Sequence
  chemically synthesized
tctctctctctctccatatcta

SEQ ID NO: 983109 - DNA, 22 bp, Artificial Sequence
  chemically synthesized
tatatatatagatatggagaga

SEQ ID NO: 983110 - DNA, 22 bp, Artificial Sequence
  chemically synthesized
cctctctctctctctctccata

SEQ ID NO: 983111 - DNA, 22 bp, Artificial Sequence
  chemically synthesized
cctccctctctctctctctctc

SEQ ID NO: 983112 - DNA, 22 bp, Artificial Sequence
  chemically synthesized
tccctccctctctctctctctc

SEQ ID NO: 983113 - DNA, 22 bp, Artificial Sequence
  chemically synthesized
tctccctccctctctctctctc

SEQ ID NO: 983114 - DNA, 22 bp, Artificial Sequence
  chemically synthesized
tctctccctccctctctctctc

SEQ ID NO: 983115 - DNA, 22 bp, Artificial Sequence
  chemically synthesized
tctctctccctccctctctctc

SEQ ID NO: 983116 - DNA, 22 bp, Artificial Sequence
  chemically synthesized
tctctctctccctccctctctc

SEQ ID NO: 983117 - DNA, 22 bp, Artificial Sequence
  chemically synthesized
tctctctctctccctccctctc

SEQ ID NO: 983118 - DNA, 22 bp, Artificial Sequence
  chemically synthesized
tctctctctctctccctccctc

SEQ ID NO: 983119 - DNA, 22 bp, Artificial Sequence
  chemically synthesized
tctctctctctctctccctccc

SEQ ID NO: 983120 - DNA, 22 bp, Artificial Sequence
  chemically synthesized
tctctctctctctctctccctc

SEQ ID NO: 983121 - DNA, 22 bp, Artificial Sequence
  chemically synthesized
tctctctctctctctctctccc

SEQ ID NO: 983122 - DNA, 22 bp, Artificial Sequence
  chemically synthesized
tctctctctctctctctctctc

SEQ ID NO: 983123 - DNA, 22 bp, Artificial Sequence
  chemically synthesized
tctctctctctctctctctctc

SEQ ID NO: 983124 - DNA, 22 bp, Artificial Sequence
  chemically synthesized
tctctctctctctctctctctc

SEQ ID NO: 983125 - DNA, 22 bp, Artificial Sequence
  chemically synthesized
ctctctctctctctctctctct

SEQ ID NO: 983126 - DNA, 22 bp, Artificial Sequence
  chemically synthesized
tctctctctctctctctctctc

SEQ ID NO: 983127 - DNA, 22 bp, Artificial Sequence
  chemically synthesized
ccaattttctctctctctctct

SEQ ID NO: 983128 - DNA, 22 bp, Artificial Sequence
  chemically synthesized
tagaattaccaattttctctct

SEQ ID NO: 983129 - DNA, 22 bp, Artificial Sequence
  chemically synthesized
tgtagaattaccaattttctct

SEQ ID NO: 983130 - DNA, 22 bp, Artificial Sequence
  chemically synthesized
ctgtagaattaccaattttctc

SEQ ID NO: 983131 - DNA, 22 bp, Artificial Sequence
  chemically synthesized
tctgtagaattaccaattttct

SEQ ID NO: 983132 - DNA, 22 bp, Artificial Sequence
  chemically synthesized
gacataatgttttctgtagaat

SEQ ID NO: 983133 - DNA, 22 bp, Artificial Sequence
  chemically synthesized
ggacataatgttttctgtagaa

SEQ ID NO: 983134 - DNA, 22 bp, Artificial Sequence
  chemically synthesized
gtaattctacagaaaacattat

SEQ ID NO: 983135 - DNA, 22 bp, Artificial Sequence
  chemically synthesized
tacagaaaacattatgtccaag

SEQ ID NO: 983136 - DNA, 22 bp, Artificial Sequence
  chemically synthesized
cagaaaacattatgtccaagat

SEQ ID NO: 983137 - DNA, 22 bp, Artificial Sequence
  chemically synthesized
gaaatcagaagccaaggaaaaa

SEQ ID NO: 983138 - DNA, 22 bp, Artificial Sequence
  chemically synthesized
tgtccaagattttttccttggc

SEQ ID NO: 983139 - DNA, 22 bp, Artificial Sequence
  chemically synthesized
gcctcgaaatcagaagccaagg

SEQ ID NO: 983140 - DNA, 22 bp, Artificial Sequence
  chemically synthesized
gttggcctcgaaatcagaagcc

SEQ ID NO: 983141 - DNA, 22 bp, Artificial Sequence
  chemically synthesized
tttccttggcttctgatttcga

SEQ ID NO: 983142 - DNA, 22 bp, Artificial Sequence
  chemically synthesized
ttccttggcttctgatttcgag

SEQ ID NO: 983143 - DNA, 22 bp, Artificial Sequence
  chemically synthesized
tccttggcttctgatttcgagg

SEQ ID NO: 983144 - DNA, 22 bp, Artificial Sequence
  chemically synthesized
ccttggcttctgatttcgaggc

SEQ ID NO: 983145 - DNA, 22 bp, Artificial Sequence
  chemically synthesized
cttggcttctgatttcgaggcc

SEQ ID NO: 983146 - DNA, 22 bp, Artificial Sequence
  chemically synthesized
ggcttctgatttcgaggccaac

SEQ ID NO: 983147 - DNA, 22 bp, Artificial Sequence
  chemically synthesized
gcttctgatttcgaggccaacg

SEQ ID NO: 983148 - DNA, 22 bp, Artificial Sequence
  chemically synthesized
aaatgacccaaactcgttggcc

SEQ ID NO: 983149 - DNA, 22 bp, Artificial Sequence
  chemically synthesized
aaaatgacccaaactcgttggc

SEQ ID NO: 983150 - DNA, 22 bp, Artificial Sequence
  chemically synthesized
ctgatttcgaggccaacgagtt

SEQ ID NO: 983151 - DNA, 22 bp, Artificial Sequence
  chemically synthesized
taaaatgacccaaactcgttgg

SEQ ID NO: 983152 - DNA, 22 bp, Artificial Sequence
  chemically synthesized
tgatttcgaggccaacgagttt

SEQ ID NO: 983153 - DNA, 22 bp, Artificial Sequence
  chemically synthesized
atttcgaggccaacgagtttgg

SEQ ID NO: 983154 - DNA, 22 bp, Artificial Sequence
  chemically synthesized
ccctttaaaatgacccaaactc

SEQ ID NO: 983155 - DNA, 22 bp, Artificial Sequence
  chemically synthesized
cgaggccaacgagtttgggtca

SEQ ID NO: 983156 - DNA, 22 bp, Artificial Sequence
  chemically synthesized
gaggccaacgagtttgggtcat

SEQ ID NO: 983157 - DNA, 22 bp, Artificial Sequence
  chemically synthesized
atgtctgccctttaaaatgacc

SEQ ID NO: 983158 - DNA, 22 bp, Artificial Sequence
  chemically synthesized
ctgatgtctgccctttaaaatg

SEQ ID NO: 983159 - DNA, 22 bp, Artificial Sequence
  chemically synthesized
gctgatgtctgccctttaaaat

SEQ ID NO: 983160 - DNA, 22 bp, Artificial Sequence
  chemically synthesized
gggtcattttaaagggcagaca

SEQ ID NO: 983161 - DNA, 22 bp, Artificial Sequence
  chemically synthesized
ggtcattttaaagggcagacat

SEQ ID NO: 983162 - DNA, 22 bp, Artificial Sequence
  chemically synthesized
caggcacttgctgatgtctgcc

SEQ ID NO: 983163 - DNA, 22 bp, Artificial Sequence
  chemically synthesized
tcactgcaggcacttgctgatg

SEQ ID NO: 983164 - DNA, 22 bp, Artificial Sequence
  chemically synthesized
taaagggcagacatcagcaagt

SEQ ID NO: 983165 - DNA, 22 bp, Artificial Sequence
  chemically synthesized
gtcactgcaggcacttgctgat

SEQ ID NO: 983166 - DNA, 22 bp, Artificial Sequence
  chemically synthesized
aaagggcagacatcagcaagtg

SEQ ID NO: 983167 - DNA, 22 bp, Artificial Sequence
  chemically synthesized
aagggcagacatcagcaagtgc

SEQ ID NO: 983168 - DNA, 22 bp, Artificial Sequence
  chemically synthesized
tttgtcactgcaggcacttgct

SEQ ID NO: 983169 - DNA, 22 bp, Artificial Sequence
  chemically synthesized
ataactatttgtcactgcaggc

SEQ ID NO: 983170 - DNA, 22 bp, Artificial Sequence
  chemically synthesized
cagctaataactatttgtcact

SEQ ID NO: 983171 - DNA, 22 bp, Artificial Sequence
  chemically synthesized
tgttgcagctaataactatttg

SEQ ID NO: 983172 - DNA, 22 bp, Artificial Sequence
  chemically synthesized
cagtgacaaatagttattagct

SEQ ID NO: 983173 - DNA, 22 bp, Artificial Sequence
  chemically synthesized
gaaataaaaagtattgtgttgc

SEQ ID NO: 983174 - DNA, 22 bp, Artificial Sequence
  chemically synthesized
ggaaataaaaagtattgtgttg

SEQ ID NO: 983175 - DNA, 22 bp, Artificial Sequence
  chemically synthesized
tggaaataaaaagtattgtgtt

SEQ ID NO: 983176 - DNA, 22 bp, Artificial Sequence
  chemically synthesized
ttagctgcaacacaatactttt

SEQ ID NO: 983177 - DNA, 22 bp, Artificial Sequence
  chemically synthesized
gctgcaacacaatactttttat

SEQ ID NO: 983178 - DNA, 22 bp, Artificial Sequence
  chemically synthesized
gccaacctttggaaataaaaag

SEQ ID NO: 983179 - DNA, 22 bp, Artificial Sequence
  chemically synthesized
caacacaatactttttatttcc

SEQ ID NO: 983180 - DNA, 22 bp, Artificial Sequence
  chemically synthesized
gtcaatctggccaacctttgga

SEQ ID NO: 983181 - DNA, 22 bp, Artificial Sequence
  chemically synthesized
ggtcaatctggccaacctttgg

SEQ ID NO: 983182 - DNA, 22 bp, Artificial Sequence
  chemically synthesized
tggtcaatctggccaacctttg

SEQ ID NO: 983183 - DNA, 22 bp, Artificial Sequence
  chemically synthesized
ctttggtcaatctggccaacct

SEQ ID NO: 983184 - DNA, 22 bp, Artificial Sequence
  chemically synthesized
tttatttccaaaggttggccag

SEQ ID NO: 983185 - DNA, 22 bp, Artificial Sequence
  chemically synthesized
ttatttccaaaggttggccaga

SEQ ID NO: 983186 - DNA, 22 bp, Artificial Sequence
  chemically synthesized
tcctttggtcaatctggccaac

SEQ ID NO: 983187 - DNA, 22 bp, Artificial Sequence
  chemically synthesized
tatttccaaaggttggccagat

SEQ ID NO: 983188 - DNA, 22 bp, Artificial Sequence
  chemically synthesized
atttccaaaggttggccagatt

SEQ ID NO: 983189 - DNA, 22 bp, Artificial Sequence
  chemically synthesized
tttccaaaggttggccagattg

SEQ ID NO: 983190 - DNA, 22 bp, Artificial Sequence
  chemically synthesized
ccaaaggttggccagattgacc

SEQ ID NO: 983191 - DNA, 22 bp, Artificial Sequence
  chemically synthesized
caaaggttggccagattgacca

SEQ ID NO: 983192 - DNA, 22 bp, Artificial Sequence
  chemically synthesized
gccagattgaccaaaggagaat

SEQ ID NO: 983193 - DNA, 22 bp, Artificial Sequence
  chemically synthesized
accaaaggagaatcttttcttc

SEQ ID NO: 983194 - DNA, 22 bp, Artificial Sequence
  chemically synthesized
aaaaatgagaaaggaaggatag

SEQ ID NO: 983195 - DNA, 22 bp, Artificial Sequence
  chemically synthesized
gaaaaatgagaaaggaaggata

SEQ ID NO: 983196 - DNA, 22 bp, Artificial Sequence
  chemically synthesized
tgaaaaatgagaaaggaaggat

SEQ ID NO: 983197 - DNA, 22 bp, Artificial Sequence
  chemically synthesized
ttcttctatccttcctttctca

SEQ ID NO: 983198 - DNA, 22 bp, Artificial Sequence
  chemically synthesized
tcttctatccttcctttctcat

SEQ ID NO: 983199 - DNA, 22 bp, Artificial Sequence
  chemically synthesized
cttctatccttcctttctcatt

SEQ ID NO: 983200 - DNA, 22 bp, Artificial Sequence
  chemically synthesized
ttctatccttcctttctcattt

SEQ ID NO: 983201 - DNA, 22 bp, Artificial Sequence
  chemically synthesized
ctatccttcctttctcattttt

SEQ ID NO: 983202 - DNA, 22 bp, Artificial Sequence
  chemically synthesized
tatccttcctttctcatttttc

SEQ ID NO: 983203 - DNA, 22 bp, Artificial Sequence
  chemically synthesized
tccttcctttctcatttttcaa

SEQ ID NO: 983204 - DNA, 22 bp, Artificial Sequence
  chemically synthesized
cctttctcatttttcaaagact

SEQ ID NO: 983205 - DNA, 22 bp, Artificial Sequence
  chemically synthesized
ctttctcatttttcaaagactt

SEQ ID NO: 983206 - DNA, 22 bp, Artificial Sequence
  chemically synthesized
tctcatttttcaaagacttttt

SEQ ID NO: 983207 - DNA, 22 bp, Artificial Sequence
  chemically synthesized
ctcatttttcaaagactttttt

SEQ ID NO: 983208 - DNA, 22 bp, Artificial Sequence
  chemically synthesized
tcatttttcaaagacttttttt

SEQ ID NO: 983209 - DNA, 22 bp, Artificial Sequence
  chemically synthesized
atttttcaaagacttttttttt

SEQ ID NO: 983210 - DNA, 22 bp, Artificial Sequence
  chemically synthesized
ggaccaaaaaaaaaaaaaaaaa

SEQ ID NO: 983211 - DNA, 22 bp, Artificial Sequence
  chemically synthesized
tgggaccaaaaaaaaaaaaaaa

SEQ ID NO: 983212 - DNA, 22 bp, Artificial Sequence
  chemically synthesized
ttcaaagacttttttttttttt

SEQ ID NO: 983213 - DNA, 22 bp, Artificial Sequence
  chemically synthesized
ctgggaccaaaaaaaaaaaaaa

SEQ ID NO: 983214 - DNA, 22 bp, Artificial Sequence
  chemically synthesized
tcaaagactttttttttttttt

SEQ ID NO: 983215 - DNA, 22 bp, Artificial Sequence
  chemically synthesized
caaagacttttttttttttttt

SEQ ID NO: 983216 - DNA, 22 bp, Artificial Sequence
  chemically synthesized
aaagactttttttttttttttt

SEQ ID NO: 983217 - DNA, 22 bp, Artificial Sequence
  chemically synthesized
aaggtttctgggaccaaaaaaa

SEQ ID NO: 983218 - DNA, 22 bp, Artificial Sequence
  chemically synthesized
aaaggtttctgggaccaaaaaa

SEQ ID NO: 983219 - DNA, 22 bp, Artificial Sequence
  chemically synthesized
tttttttttttttttggtccca

SEQ ID NO: 983220 - DNA, 22 bp, Artificial Sequence
  chemically synthesized
ttttttttttttttggtcccag

SEQ ID NO: 983221 - DNA, 22 bp, Artificial Sequence
  chemically synthesized
tttttttttttttggtcccaga

SEQ ID NO: 983222 - DNA, 22 bp, Artificial Sequence
  chemically synthesized
ttttttttttttggtcccagaa

SEQ ID NO: 983223 - DNA, 22 bp, Artificial Sequence
  chemically synthesized
tttttttttttggtcccagaaa

SEQ ID NO: 983224 - DNA, 22 bp, Artificial Sequence
  chemically synthesized
ttttttttttggtcccagaaac

SEQ ID NO: 983225 - DNA, 22 bp, Artificial Sequence
  chemically synthesized
tttttttttggtcccagaaacc

SEQ ID NO: 983226 - DNA, 22 bp, Artificial Sequence
  chemically synthesized
aaaagacttaaaggtttctggg

SEQ ID NO: 983227 - DNA, 22 bp, Artificial Sequence
  chemically synthesized
ttttttttggtcccagaaacct

SEQ ID NO: 983228 - DNA, 22 bp, Artificial Sequence
  chemically synthesized
aaaaagacttaaaggtttctgg

SEQ ID NO: 983229 - DNA, 22 bp, Artificial Sequence
  chemically synthesized
tttttttggtcccagaaacctt

SEQ ID NO: 983230 - DNA, 22 bp, Artificial Sequence
  chemically synthesized
ttttttggtcccagaaaccttt

SEQ ID NO: 983231 - DNA, 22 bp, Artificial Sequence
  chemically synthesized
tttttggtcccagaaaccttta

SEQ ID NO: 983232 - DNA, 22 bp, Artificial Sequence
  chemically synthesized
ttttggtcccagaaacctttaa

SEQ ID NO: 983233 - DNA, 22 bp, Artificial Sequence
  chemically synthesized
tttggtcccagaaacctttaag

SEQ ID NO: 983234 - DNA, 22 bp, Artificial Sequence
  chemically synthesized
ttggtcccagaaacctttaagt

SEQ ID NO: 983235 - DNA, 22 bp, Artificial Sequence
  chemically synthesized
tggtcccagaaacctttaagtc

SEQ ID NO: 983236 - DNA, 22 bp, Artificial Sequence
  chemically synthesized
ggtcccagaaacctttaagtct

SEQ ID NO: 983237 - DNA, 22 bp, Artificial Sequence
  chemically synthesized
gtcccagaaacctttaagtctt

SEQ ID NO: 983238 - DNA, 22 bp, Artificial Sequence
  chemically synthesized
taagtctttttaagctggcttt

SEQ ID NO: 983239 - DNA, 22 bp, Artificial Sequence
  chemically synthesized
aagtctttttaagctggctttt

SEQ ID NO: 983240 - DNA, 22 bp, Artificial Sequence
  chemically synthesized
agtctttttaagctggcttttt

SEQ ID NO: 983241 - DNA, 22 bp, Artificial Sequence
  chemically synthesized
aagcgtaagggggaaaaaagcc

SEQ ID NO: 983242 - DNA, 22 bp, Artificial Sequence
  chemically synthesized
tttaagctggcttttttccccc

SEQ ID NO: 983243 - DNA, 22 bp, Artificial Sequence
  chemically synthesized
ttaagctggcttttttccccct

SEQ ID NO: 983244 - DNA, 22 bp, Artificial Sequence
  chemically synthesized
taagctggcttttttccccctt

SEQ ID NO: 983245 - DNA, 22 bp, Artificial Sequence
  chemically synthesized
aagctggcttttttccccctta

SEQ ID NO: 983246 - DNA, 22 bp, Artificial Sequence
  chemically synthesized
agctggcttttttcccccttac

SEQ ID NO: 983247 - DNA, 22 bp, Artificial Sequence
  chemically synthesized
gcttttttcccccttacgcttt

SEQ ID NO: 983248 - DNA, 22 bp, Artificial Sequence
  chemically synthesized
ttttcccccttacgctttagct

SEQ ID NO: 983249 - DNA, 22 bp, Artificial Sequence
  chemically synthesized
tttcccccttacgctttagctt

SEQ ID NO: 983250 - DNA, 22 bp, Artificial Sequence
  chemically synthesized
ttcccccttacgctttagcttt

SEQ ID NO: 983251 - DNA, 22 bp, Artificial Sequence
  chemically synthesized
aaagaaaagagcaaagctaaag

SEQ ID NO: 983252 - DNA, 22 bp, Artificial Sequence
  chemically synthesized
tcccccttacgctttagctttg

SEQ ID NO: 983253 - DNA, 22 bp, Artificial Sequence
  chemically synthesized
cccccttacgctttagctttgc

SEQ ID NO: 983254 - DNA, 22 bp, Artificial Sequence
  chemically synthesized
ccccttacgctttagctttgct

SEQ ID NO: 983255 - DNA, 22 bp, Artificial Sequence
  chemically synthesized
agacctcaaagaaaagagcaaa

SEQ ID NO: 983256 - DNA, 22 bp, Artificial Sequence
  chemically synthesized
acgctttagctttgctcttttc

SEQ ID NO: 983257 - DNA, 22 bp, Artificial Sequence
  chemically synthesized
cgctttagctttgctcttttct

SEQ ID NO: 983258 - DNA, 22 bp, Artificial Sequence
  chemically synthesized
tagctttgctcttttctttgag

SEQ ID NO: 983259 - DNA, 22 bp, Artificial Sequence
  chemically synthesized
agctttgctcttttctttgagg

SEQ ID NO: 983260 - DNA, 22 bp, Artificial Sequence
  chemically synthesized
gctttgctcttttctttgaggt

SEQ ID NO: 983261 - DNA, 22 bp, Artificial Sequence
  chemically synthesized
tatgtcactgagacctcaaaga

SEQ ID NO: 983262 - DNA, 22 bp, Artificial Sequence
  chemically synthesized
tgctcttttctttgaggtctca

SEQ ID NO: 983263 - DNA, 22 bp, Artificial Sequence
  chemically synthesized
gctcttttctttgaggtctcag

SEQ ID NO: 983264 - DNA, 22 bp, Artificial Sequence
  chemically synthesized
acctatatgtcactgagacctc

SEQ ID NO: 983265 - DNA, 22 bp, Artificial Sequence
  chemically synthesized
ctcttttctttgaggtctcagt

SEQ ID NO: 983266 - DNA, 22 bp, Artificial Sequence
  chemically synthesized
ttttctttgaggtctcagtgac

SEQ ID NO: 983267 - DNA, 22 bp, Artificial Sequence
  chemically synthesized
ttctttgaggtctcagtgacat

SEQ ID NO: 983268 - DNA, 22 bp, Artificial Sequence
  chemically synthesized
tctttgaggtctcagtgacata

SEQ ID NO: 983269 - DNA, 22 bp, Artificial Sequence
  chemically synthesized
ctttgaggtctcagtgacatat

SEQ ID NO: 983270 - DNA, 22 bp, Artificial Sequence
  chemically synthesized
tttgaggtctcagtgacatata

SEQ ID NO: 983271 - DNA, 22 bp, Artificial Sequence
  chemically synthesized
tgaggtctcagtgacatatagg

SEQ ID NO: 983272 - DNA, 22 bp, Artificial Sequence
  chemically synthesized
gaggtctcagtgacatataggt

SEQ ID NO: 983273 - DNA, 22 bp, Artificial Sequence
  chemically synthesized
aggtctcagtgacatataggtc

SEQ ID NO: 983274 - DNA, 22 bp, Artificial Sequence
  chemically synthesized
gtaaagacgtccctgacctata

SEQ ID NO: 983275 - DNA, 22 bp, Artificial Sequence
  chemically synthesized
agtgacatataggtcagggacg

SEQ ID NO: 983276 - DNA, 22 bp, Artificial Sequence
  chemically synthesized
cattggtaaagacgtccctgac

SEQ ID NO: 983277 - DNA, 22 bp, Artificial Sequence
  chemically synthesized
atattacattggtaaagacgtc

SEQ ID NO: 983278 - DNA, 22 bp, Artificial Sequence
  chemically synthesized
cactaatattacattggtaaag

SEQ ID NO: 983279 - DNA, 22 bp, Artificial Sequence
  chemically synthesized
tccactaatattacattggtaa

SEQ ID NO: 983280 - DNA, 22 bp, Artificial Sequence
  chemically synthesized
taactctccactaatattacat

SEQ ID NO: 983281 - DNA, 22 bp, Artificial Sequence
  chemically synthesized
ttataactctccactaatatta

SEQ ID NO: 983282 - DNA, 22 bp, Artificial Sequence
  chemically synthesized
gttataactctccactaatatt

SEQ ID NO: 983283 - DNA, 22 bp, Artificial Sequence
  chemically synthesized
taccaatgtaatattagtggag

SEQ ID NO: 983284 - DNA, 22 bp, Artificial Sequence
  chemically synthesized
accaatgtaatattagtggaga

SEQ ID NO: 983285 - DNA, 22 bp, Artificial Sequence
  chemically synthesized
ccaatgtaatattagtggagag

SEQ ID NO: 983286 - DNA, 22 bp, Artificial Sequence
  chemically synthesized
acccccttgttataactctcca

SEQ ID NO: 983287 - DNA, 22 bp, Artificial Sequence
  chemically synthesized
agtgtcctcacccccttgttat

SEQ ID NO: 983288 - DNA, 22 bp, Artificial Sequence
  chemically synthesized
cagtgtcctcacccccttgtta

SEQ ID NO: 983289 - DNA, 22 bp, Artificial Sequence
  chemically synthesized
gtggagagttataacaaggggg

SEQ ID NO: 983290 - DNA, 22 bp, Artificial Sequence
  chemically synthesized
tgtaagccttcagtgtcctcac

SEQ ID NO: 983291 - DNA, 22 bp, Artificial Sequence
  chemically synthesized
taacaagggggtgaggacactg

SEQ ID NO: 983292 - DNA, 22 bp, Artificial Sequence
  chemically synthesized
aggcacctgtgtaagccttcag

SEQ ID NO: 983293 - DNA, 22 bp, Artificial Sequence
  chemically synthesized
ttcaggcacctgtgtaagcctt

SEQ ID NO: 983294 - DNA, 22 bp, Artificial Sequence
  chemically synthesized
aaggcttacacaggtgcctgaa

SEQ ID NO: 983295 - DNA, 22 bp, Artificial Sequence
  chemically synthesized
acacaggtgcctgaataatttg

SEQ ID NO: 983296 - DNA, 22 bp, Artificial Sequence
  chemically synthesized
cacaggtgcctgaataatttgc

SEQ ID NO: 983297 - DNA, 22 bp, Artificial Sequence
  chemically synthesized
caccagtgtggagtgataaggc

SEQ ID NO: 983298 - DNA, 22 bp, Artificial Sequence
  chemically synthesized
gcaccagtgtggagtgataagg

SEQ ID NO: 983299 - DNA, 22 bp, Artificial Sequence
  chemically synthesized
aataatttgccttatcactcca

SEQ ID NO: 983300 - DNA, 22 bp, Artificial Sequence
  chemically synthesized
caccacttgcaccagtgtggag

SEQ ID NO: 983301 - DNA, 22 bp, Artificial Sequence
  chemically synthesized
tgcaccacttgcaccagtgtgg

SEQ ID NO: 983302 - DNA, 22 bp, Artificial Sequence
  chemically synthesized
gccttatcactccacactggtg

SEQ ID NO: 983303 - DNA, 22 bp, Artificial Sequence
  chemically synthesized
ctgcaccacttgcaccagtgtg

SEQ ID NO: 983304 - DNA, 22 bp, Artificial Sequence
  chemically synthesized
ccttatcactccacactggtgc

SEQ ID NO: 983305 - DNA, 22 bp, Artificial Sequence
  chemically synthesized
tttctgcaccacttgcaccagt

SEQ ID NO: 983306 - DNA, 22 bp, Artificial Sequence
  chemically synthesized
atttctgcaccacttgcaccag

SEQ ID NO: 983307 - DNA, 22 bp, Artificial Sequence
  chemically synthesized
atcactccacactggtgcaagt

SEQ ID NO: 983308 - DNA, 22 bp, Artificial Sequence
  chemically synthesized
tcactccacactggtgcaagtg

SEQ ID NO: 983309 - DNA, 22 bp, Artificial Sequence
  chemically synthesized
ttatttctgcaccacttgcacc

SEQ ID NO: 983310 - DNA, 22 bp, Artificial Sequence
  chemically synthesized
ctcttatttctgcaccacttgc

SEQ ID NO: 983311 - DNA, 22 bp, Artificial Sequence
  chemically synthesized
cacactggtgcaagtggtgcag

SEQ ID NO: 983312 - DNA, 22 bp, Artificial Sequence
  chemically synthesized
gtgcaagtggtgcagaaataag

SEQ ID NO: 983313 - DNA, 22 bp, Artificial Sequence
  chemically synthesized
taaatccaaaagtatatgtagc

SEQ ID NO: 983314 - DNA, 22 bp, Artificial Sequence
  chemically synthesized
tggcttttgctacatatacttt

SEQ ID NO: 983315 - DNA, 22 bp, Artificial Sequence
  chemically synthesized
atctgtaaatccaaaagtatat

SEQ ID NO: 983316 - DNA, 22 bp, Artificial Sequence
  chemically synthesized
gatctgtaaatccaaaagtata

SEQ ID NO: 983317 - DNA, 22 bp, Artificial Sequence
  chemically synthesized
ttgctacatatacttttggatt

SEQ ID NO: 983318 - DNA, 22 bp, Artificial Sequence
  chemically synthesized
tgctacatatacttttggattt

SEQ ID NO: 983319 - DNA, 22 bp, Artificial Sequence
  chemically synthesized
cacttgatctgtaaatccaaaa

SEQ ID NO: 983320 - DNA, 22 bp, Artificial Sequence
  chemically synthesized
gctacatatacttttggattta

SEQ ID NO: 983321 - DNA, 22 bp, Artificial Sequence
  chemically synthesized
ctacatatacttttggatttac

SEQ ID NO: 983322 - DNA, 22 bp, Artificial Sequence
  chemically synthesized
catatacttttggatttacaga

SEQ ID NO: 983323 - DNA, 22 bp, Artificial Sequence
  chemically synthesized
aaaacctacacttgatctgtaa

SEQ ID NO: 983324 - DNA, 22 bp, Artificial Sequence
  chemically synthesized
tgaaaacctacacttgatctgt

SEQ ID NO: 983325 - DNA, 22 bp, Artificial Sequence
  chemically synthesized
ctgaaaacctacacttgatctg

SEQ ID NO: 983326 - DNA, 22 bp, Artificial Sequence
  chemically synthesized
tctgaaaacctacacttgatct

SEQ ID NO: 983327 - DNA, 22 bp, Artificial Sequence
  chemically synthesized
ttggatttacagatcaagtgta

SEQ ID NO: 983328 - DNA, 22 bp, Artificial Sequence
  chemically synthesized
tggatttacagatcaagtgtag

SEQ ID NO: 983329 - DNA, 22 bp, Artificial Sequence
  chemically synthesized
ggatttacagatcaagtgtagg

SEQ ID NO: 983330 - DNA, 22 bp, Artificial Sequence
  chemically synthesized
gatttacagatcaagtgtaggt

SEQ ID NO: 983331 - DNA, 22 bp, Artificial Sequence
  chemically synthesized
aaactttctgaaaacctacact

SEQ ID NO: 983332 - DNA, 22 bp, Artificial Sequence
  chemically synthesized
acagatcaagtgtaggttttca

SEQ ID NO: 983333 - DNA, 22 bp, Artificial Sequence
  chemically synthesized
cagatcaagtgtaggttttcag

SEQ ID NO: 983334 - DNA, 22 bp, Artificial Sequence
  chemically synthesized
tgtgtaacactcaaactttctg

SEQ ID NO: 983335 - DNA, 22 bp, Artificial Sequence
  chemically synthesized
tcagaaagtttgagtgttacac

SEQ ID NO: 983336 - DNA, 22 bp, Artificial Sequence
  chemically synthesized
cagaaagtttgagtgttacaca

SEQ ID NO: 983337 - DNA, 22 bp, Artificial Sequence
  chemically synthesized
agaaagtttgagtgttacacac

SEQ ID NO: 983338 - DNA, 22 bp, Artificial Sequence
  chemically synthesized
gagtgttacacacaattattac

SEQ ID NO: 983339 - DNA, 22 bp, Artificial Sequence
  chemically synthesized
agtgttacacacaattattacc

SEQ ID NO: 983340 - DNA, 22 bp, Artificial Sequence
  chemically synthesized
atagtagtgggtatggtggtaa

SEQ ID NO: 983341 - DNA, 22 bp, Artificial Sequence
  chemically synthesized
cacacaattattaccaccatac

SEQ ID NO: 983342 - DNA, 22 bp, Artificial Sequence
  chemically synthesized
gcattgatagtagtgggtatgg

SEQ ID NO: 983343 - DNA, 22 bp, Artificial Sequence
  chemically synthesized
tggcattgatagtagtgggtat

SEQ ID NO: 983344 - DNA, 22 bp, Artificial Sequence
  chemically synthesized
ttaccaccatacccactactat

SEQ ID NO: 983345 - DNA, 22 bp, Artificial Sequence
  chemically synthesized
ccaccatacccactactatcaa

SEQ ID NO: 983346 - DNA, 22 bp, Artificial Sequence
  chemically synthesized
ataattctggcattgatagtag

SEQ ID NO: 983347 - DNA, 22 bp, Artificial Sequence
  chemically synthesized
tccattgataattctggcattg

SEQ ID NO: 983348 - DNA, 22 bp, Artificial Sequence
  chemically synthesized
atccattgataattctggcatt

SEQ ID NO: 983349 - DNA, 22 bp, Artificial Sequence
  chemically synthesized
tatccattgataattctggcat

SEQ ID NO: 983350 - DNA, 22 bp, Artificial Sequence
  chemically synthesized
ctatcaatgccagaattatcaa

SEQ ID NO: 983351 - DNA, 22 bp, Artificial Sequence
  chemically synthesized
tcaatgccagaattatcaatgg

SEQ ID NO: 983352 - DNA, 22 bp, Artificial Sequence
  chemically synthesized
tcaatggataaaatttgttttt

SEQ ID NO: 983353 - DNA, 22 bp, Artificial Sequence
  chemically synthesized
agtgtcaatagaaaataataaa

SEQ ID NO: 983354 - DNA, 22 bp, Artificial Sequence
  chemically synthesized
gtttttattattttctattgac

SEQ ID NO: 983355 - DNA, 22 bp, Artificial Sequence
  chemically synthesized
tttttattattttctattgaca

SEQ ID NO: 983356 - DNA, 22 bp, Artificial Sequence
  chemically synthesized
ttattattttctattgacactg

SEQ ID NO: 983357 - DNA, 22 bp, Artificial Sequence
  chemically synthesized
tattattttctattgacactga

SEQ ID NO: 983358 - DNA, 22 bp, Artificial Sequence
  chemically synthesized
attattttctattgacactgag

SEQ ID NO: 983359 - DNA, 22 bp, Artificial Sequence
  chemically synthesized
ttattttctattgacactgagt

SEQ ID NO: 983360 - DNA, 22 bp, Artificial Sequence
  chemically synthesized
ttttctattgacactgagtttt

SEQ ID NO: 983361 - DNA, 22 bp, Artificial Sequence
  chemically synthesized
tctattgacactgagttttata

SEQ ID NO: 983362 - DNA, 22 bp, Artificial Sequence
  chemically synthesized
ctattgacactgagttttatat

SEQ ID NO: 983363 - DNA, 22 bp, Artificial Sequence
  chemically synthesized
acatatatatatatataaaact

SEQ ID NO: 983364 - DNA, 22 bp, Artificial Sequence
  chemically synthesized
tattgacactgagttttatata

SEQ ID NO: 983365 - DNA, 22 bp, Artificial Sequence
  chemically synthesized
cacatatatatatatataaaac

SEQ ID NO: 983366 - DNA, 22 bp, Artificial Sequence
  chemically synthesized
ttgacactgagttttatatata

SEQ ID NO: 983367 - DNA, 22 bp, Artificial Sequence
  chemically synthesized
acactgagttttatatatatat

SEQ ID NO: 983368 - DNA, 22 bp, Artificial Sequence
  chemically synthesized
agttttatatatatatatatgt

SEQ ID NO: 983369 - DNA, 22 bp, Artificial Sequence
  chemically synthesized
tatatatatatatatgtgaaat

SEQ ID NO: 983370 - DNA, 22 bp, Artificial Sequence
  chemically synthesized
tacagaaacaagatttcacata

SEQ ID NO: 983371 - DNA, 22 bp, Artificial Sequence
  chemically synthesized
atatatatatatatgtgaaatc

SEQ ID NO: 983372 - DNA, 22 bp, Artificial Sequence
  chemically synthesized
atacagaaacaagatttcacat

SEQ ID NO: 983373 - DNA, 22 bp, Artificial Sequence
  chemically synthesized
tatatatatatatgtgaaatct

SEQ ID NO: 983374 - DNA, 22 bp, Artificial Sequence
  chemically synthesized
tgggaatttatacagaaacaag

SEQ ID NO: 983375 - DNA, 22 bp, Artificial Sequence
  chemically synthesized
gtttctgtataaattcccataa

SEQ ID NO: 983376 - DNA, 22 bp, Artificial Sequence
  chemically synthesized
tttctgtataaattcccataat

SEQ ID NO: 983377 - DNA, 22 bp, Artificial Sequence
  chemically synthesized
gatggagtgtgcattatgggaa

SEQ ID NO: 983378 - DNA, 22 bp, Artificial Sequence
  chemically synthesized
ggatggagtgtgcattatggga

SEQ ID NO: 983379 - DNA, 22 bp, Artificial Sequence
  chemically synthesized
ctgtataaattcccataatgca

SEQ ID NO: 983380 - DNA, 22 bp, Artificial Sequence
  chemically synthesized
ttggatggagtgtgcattatgg

SEQ ID NO: 983381 - DNA, 22 bp, Artificial Sequence
  chemically synthesized
tgtataaattcccataatgcac

SEQ ID NO: 983382 - DNA, 22 bp, Artificial Sequence
  chemically synthesized
tataaattcccataatgcacac

SEQ ID NO: 983383 - DNA, 22 bp, Artificial Sequence
  chemically synthesized
ttcttggatggagtgtgcatta

SEQ ID NO: 983384 - DNA, 22 bp, Artificial Sequence
  chemically synthesized
gttcttggatggagtgtgcatt

SEQ ID NO: 983385 - DNA, 22 bp, Artificial Sequence
  chemically synthesized
tgtttgttcttggatggagtgt

SEQ ID NO: 983386 - DNA, 22 bp, Artificial Sequence
  chemically synthesized
ccataatgcacactccatccaa

SEQ ID NO: 983387 - DNA, 22 bp, Artificial Sequence
  chemically synthesized
aattatgtttgttcttggatgg

SEQ ID NO: 983388 - DNA, 22 bp, Artificial Sequence
  chemically synthesized
tagttaaattatgtttgttctt

SEQ ID NO: 983389 - DNA, 22 bp, Artificial Sequence
  chemically synthesized
catccaagaacaaacataattt

SEQ ID NO: 983390 - DNA, 22 bp, Artificial Sequence
  chemically synthesized
tgtgatatgatctatagttaaa

SEQ ID NO: 983391 - DNA, 22 bp, Artificial Sequence
  chemically synthesized
accagaggagttatgtgatatg

SEQ ID NO: 983392 - DNA, 22 bp, Artificial Sequence
  chemically synthesized
aaccagaggagttatgtgatat

SEQ ID NO: 983393 - DNA, 22 bp, Artificial Sequence
  chemically synthesized
aactatagatcatatcacataa

SEQ ID NO: 983394 - DNA, 22 bp, Artificial Sequence
  chemically synthesized
taaccagaggagttatgtgata

SEQ ID NO: 983395 - DNA, 22 bp, Artificial Sequence
  chemically synthesized
actatagatcatatcacataac

SEQ ID NO: 983396 - DNA, 22 bp, Artificial Sequence
  chemically synthesized
ttaaccagaggagttatgtgat

SEQ ID NO: 983397 - DNA, 22 bp, Artificial Sequence
  chemically synthesized
tagatcatatcacataactcct

SEQ ID NO: 983398 - DNA, 22 bp, Artificial Sequence
  chemically synthesized
gggtttttaaccagaggagtta

SEQ ID NO: 983399 - DNA, 22 bp, Artificial Sequence
  chemically synthesized
agccattggggtttttaaccag

SEQ ID NO: 983400 - DNA, 22 bp, Artificial Sequence
  chemically synthesized
aatgttaagccattggggtttt

SEQ ID NO: 983401 - DNA, 22 bp, Artificial Sequence
  chemically synthesized
ctctggttaaaaaccccaatgg

SEQ ID NO: 983402 - DNA, 22 bp, Artificial Sequence
  chemically synthesized
tggttaaaaaccccaatggctt

SEQ ID NO: 983403 - DNA, 22 bp, Artificial Sequence
  chemically synthesized
taaattaaatgttaagccattg

SEQ ID NO: 983404 - DNA, 22 bp, Artificial Sequence
  chemically synthesized
gttaaaaaccccaatggcttaa

SEQ ID NO: 983405 - DNA, 22 bp, Artificial Sequence
  chemically synthesized
ataaattaaatgttaagccatt

SEQ ID NO: 983406 - DNA, 22 bp, Artificial Sequence
  chemically synthesized
tttataaattaaatgttaagcc

SEQ ID NO: 983407 - DNA, 22 bp, Artificial Sequence
  chemically synthesized
aaaaccccaatggcttaacatt

SEQ ID NO: 983408 - DNA, 22 bp, Artificial Sequence
  chemically synthesized
gtttataaattaaatgttaagc

SEQ ID NO: 983409 - DNA, 22 bp, Artificial Sequence
  chemically synthesized
tgtttataaattaaatgttaag

SEQ ID NO: 983410 - DNA, 22 bp, Artificial Sequence
  chemically synthesized
ttgtttataaattaaatgttaa

SEQ ID NO: 983411 - DNA, 22 bp, Artificial Sequence
  chemically synthesized
tttgtttataaattaaatgtta

SEQ ID NO: 983412 - DNA, 22 bp, Artificial Sequence
  chemically synthesized
ttttgtttataaattaaatgtt

SEQ ID NO: 983413 - DNA, 22 bp, Artificial Sequence
  chemically synthesized
tttttgtttataaattaaatgt

SEQ ID NO: 983414 - DNA, 22 bp, Artificial Sequence
  chemically synthesized
ggctttttttgtttataaatta

SEQ ID NO: 983415 - DNA, 22 bp, Artificial Sequence
  chemically synthesized
aacatttaatttataaacaaaa

SEQ ID NO: 983416 - DNA, 22 bp, Artificial Sequence
  chemically synthesized
acatttaatttataaacaaaaa

SEQ ID NO: 983417 - DNA, 22 bp, Artificial Sequence
  chemically synthesized
taaagagttgggctttttttgt

SEQ ID NO: 983418 - DNA, 22 bp, Artificial Sequence
  chemically synthesized
aatttataaacaaaaaaagccc

SEQ ID NO: 983419 - DNA, 22 bp, Artificial Sequence
  chemically synthesized
atttataaacaaaaaaagccca

SEQ ID NO: 983420 - DNA, 22 bp, Artificial Sequence
  chemically synthesized
ataaacaaaaaaagcccaactc

SEQ ID NO: 983421 - DNA, 22 bp, Artificial Sequence
  chemically synthesized
taaacaaaaaaagcccaactct

SEQ ID NO: 983422 - DNA, 22 bp, Artificial Sequence
  chemically synthesized
cgggacgttgtaaagagttggg

SEQ ID NO: 983423 - DNA, 22 bp, Artificial Sequence
  chemically synthesized
ccgggacgttgtaaagagttgg

SEQ ID NO: 983424 - DNA, 22 bp, Artificial Sequence
  chemically synthesized
tttacaacgtcccggaagactg

SEQ ID NO: 983425 - DNA, 22 bp, Artificial Sequence
  chemically synthesized
tacaacgtcccggaagactgca

SEQ ID NO: 983426 - DNA, 22 bp, Artificial Sequence
  chemically synthesized
acaacgtcccggaagactgcac

SEQ ID NO: 983427 - DNA, 22 bp, Artificial Sequence
  chemically synthesized
caacgtcccggaagactgcaca

SEQ ID NO: 983428 - DNA, 22 bp, Artificial Sequence
  chemically synthesized
gcatgcatcagatgatgtgcag

SEQ ID NO: 983429 - DNA, 22 bp, Artificial Sequence
  chemically synthesized
cacatcatctgatgcatgccag

SEQ ID NO: 983430 - DNA, 22 bp, Artificial Sequence
  chemically synthesized
atgcatgccagatctctccctt

SEQ ID NO: 983431 - DNA, 22 bp, Artificial Sequence
  chemically synthesized
tcccttcatctcctggcactta

SEQ ID NO: 983432 - DNA, 22 bp, Artificial Sequence
  chemically synthesized
gtgatggagaggtaagtgccag

SEQ ID NO: 983433 - DNA, 22 bp, Artificial Sequence
  chemically synthesized
ggtgatggagaggtaagtgcca

SEQ ID NO: 983434 - DNA, 22 bp, Artificial Sequence
  chemically synthesized
ccttcatctcctggcacttacc

SEQ ID NO: 983435 - DNA, 22 bp, Artificial Sequence
  chemically synthesized
tggtgatggagaggtaagtgcc

SEQ ID NO: 983436 - DNA, 22 bp, Artificial Sequence
  chemically synthesized
catctcctggcacttacctctc

SEQ ID NO: 983437 - DNA, 22 bp, Artificial Sequence
  chemically synthesized
atctcctggcacttacctctcc

SEQ ID NO: 983438 - DNA, 22 bp, Artificial Sequence
  chemically synthesized
ctggcacttacctctccatcac

SEQ ID NO: 983439 - DNA, 22 bp, Artificial Sequence
  chemically synthesized
gcacttacctctccatcaccaa

SEQ ID NO: 983440 - DNA, 22 bp, Artificial Sequence
  chemically synthesized
acctctccatcaccaaaatcca

SEQ ID NO: 983441 - DNA, 22 bp, Artificial Sequence
  chemically synthesized
cctctccatcaccaaaatccac

SEQ ID NO: 983442 - DNA, 22 bp, Artificial Sequence
  chemically synthesized
aggaaaagtgtgagtggatttt

SEQ ID NO: 983443 - DNA, 22 bp, Artificial Sequence
  chemically synthesized
gaggaaaagtgtgagtggattt

SEQ ID NO: 983444 - DNA, 22 bp, Artificial Sequence
  chemically synthesized
tccatcaccaaaatccactcac

SEQ ID NO: 983445 - DNA, 22 bp, Artificial Sequence
  chemically synthesized
cttgaggaaaagtgtgagtgga

SEQ ID NO: 983446 - DNA, 22 bp, Artificial Sequence
  chemically synthesized
catcaccaaaatccactcacac

SEQ ID NO: 983447 - DNA, 22 bp, Artificial Sequence
  chemically synthesized
gcctacttgaggaaaagtgtga

SEQ ID NO: 983448 - DNA, 22 bp, Artificial Sequence
  chemically synthesized
agcctacttgaggaaaagtgtg

SEQ ID NO: 983449 - DNA, 22 bp, Artificial Sequence
  chemically synthesized
catagtcaacttagcctacttg

SEQ ID NO: 983450 - DNA, 22 bp, Artificial Sequence
  chemically synthesized
acacttttcctcaagtaggcta

SEQ ID NO: 983451 - DNA, 22 bp, Artificial Sequence
  chemically synthesized
ttcctcaagtaggctaagttga

SEQ ID NO: 983452 - DNA, 22 bp, Artificial Sequence
  chemically synthesized
tcctcaagtaggctaagttgac

SEQ ID NO: 983453 - DNA, 22 bp, Artificial Sequence
  chemically synthesized
cctcaagtaggctaagttgact

SEQ ID NO: 983454 - DNA, 22 bp, Artificial Sequence
  chemically synthesized
ctcaagtaggctaagttgacta

SEQ ID NO: 983455 - DNA, 22 bp, Artificial Sequence
  chemically synthesized
aagtaggctaagttgactatgc

SEQ ID NO: 983456 - DNA, 22 bp, Artificial Sequence
  chemically synthesized
agttgactatgcaattgcacgc

SEQ ID NO: 983457 - DNA, 22 bp, Artificial Sequence
  chemically synthesized
actatgcaattgcacgcttttt

SEQ ID NO: 983458 - DNA, 22 bp, Artificial Sequence
  chemically synthesized
cagacaaaggaaacaaaaagcg

SEQ ID NO: 983459 - DNA, 22 bp, Artificial Sequence
  chemically synthesized
tgcaattgcacgctttttgttt

SEQ ID NO: 983460 - DNA, 22 bp, Artificial Sequence
  chemically synthesized
cacgctttttgtttcctttgtc

SEQ ID NO: 983461 - DNA, 22 bp, Artificial Sequence
  chemically synthesized
aagaatatgttccagacaaagg

SEQ ID NO: 983462 - DNA, 22 bp, Artificial Sequence
  chemically synthesized
tttgtttcctttgtctggaaca

SEQ ID NO: 983463 - DNA, 22 bp, Artificial Sequence
  chemically synthesized
ttgtttcctttgtctggaacat

SEQ ID NO: 983464 - DNA, 22 bp, Artificial Sequence
  chemically synthesized
tgtttcctttgtctggaacata

SEQ ID NO: 983465 - DNA, 22 bp, Artificial Sequence
  chemically synthesized
gtttcctttgtctggaacatat

SEQ ID NO: 983466 - DNA, 22 bp, Artificial Sequence
  chemically synthesized
tttcctttgtctggaacatatt

SEQ ID NO: 983467 - DNA, 22 bp, Artificial Sequence
  chemically synthesized
cctttgtctggaacatattctt

SEQ ID NO: 983468 - DNA, 22 bp, Artificial Sequence
  chemically synthesized
ctttgtctggaacatattcttt

SEQ ID NO: 983469 - DNA, 22 bp, Artificial Sequence
  chemically synthesized
tgtctggaacatattctttagg

SEQ ID NO: 983470 - DNA, 22 bp, Artificial Sequence
  chemically synthesized
gtctggaacatattctttaggt

SEQ ID NO: 983471 - DNA, 22 bp, Artificial Sequence
  chemically synthesized
tctggaacatattctttaggta

SEQ ID NO: 983472 - DNA, 22 bp, Artificial Sequence
  chemically synthesized
gaacatattctttaggtatctg

SEQ ID NO: 983473 - DNA, 22 bp, Artificial Sequence
  chemically synthesized
aatagtgacagaggcagatacc

SEQ ID NO: 983474 - DNA, 22 bp, Artificial Sequence
  chemically synthesized
tttaggtatctgcctctgtcac

SEQ ID NO: 983475 - DNA, 22 bp, Artificial Sequence
  chemically synthesized
taggtatctgcctctgtcacta

SEQ ID NO: 983476 - DNA, 22 bp, Artificial Sequence
  chemically synthesized
aggtatctgcctctgtcactat

SEQ ID NO: 983477 - DNA, 22 bp, Artificial Sequence
  chemically synthesized
ggtatctgcctctgtcactatt

SEQ ID NO: 983478 - DNA, 22 bp, Artificial Sequence
  chemically synthesized
aaaaggaacctgaatagtgaca

SEQ ID NO: 983479 - DNA, 22 bp, Artificial Sequence
  chemically synthesized
gaaaaggaacctgaatagtgac

SEQ ID NO: 983480 - DNA, 22 bp, Artificial Sequence
  chemically synthesized
cctctgtcactattcaggttcc

SEQ ID NO: 983481 - DNA, 22 bp, Artificial Sequence
  chemically synthesized
tgtcactattcaggttcctttt

SEQ ID NO: 983482 - DNA, 22 bp, Artificial Sequence
  chemically synthesized
tcactattcaggttccttttca

SEQ ID NO: 983483 - DNA, 22 bp, Artificial Sequence
  chemically synthesized
aggaaatgacatttgaaaagga

SEQ ID NO: 983484 - DNA, 22 bp, Artificial Sequence
  chemically synthesized
gaggaaatgacatttgaaaagg

SEQ ID NO: 983485 - DNA, 22 bp, Artificial Sequence
  chemically synthesized
tttgaggaaatgacatttgaaa

SEQ ID NO: 983486 - DNA, 22 bp, Artificial Sequence
  chemically synthesized
ttcaggttccttttcaaatgtc

SEQ ID NO: 983487 - DNA, 22 bp, Artificial Sequence
  chemically synthesized
gtttgaggaaatgacatttgaa

SEQ ID NO: 983488 - DNA, 22 bp, Artificial Sequence
  chemically synthesized
tgtttgaggaaatgacatttga

SEQ ID NO: 983489 - DNA, 22 bp, Artificial Sequence
  chemically synthesized
ttgtttgaggaaatgacatttg

SEQ ID NO: 983490 - DNA, 22 bp, Artificial Sequence
  chemically synthesized
aggttccttttcaaatgtcatt

SEQ ID NO: 983491 - DNA, 22 bp, Artificial Sequence
  chemically synthesized
cttttcaaatgtcatttcctca

SEQ ID NO: 983492 - DNA, 22 bp, Artificial Sequence
  chemically synthesized
ttcaaatgtcatttcctcaaac

SEQ ID NO: 983493 - DNA, 22 bp, Artificial Sequence
  chemically synthesized
tcaaatgtcatttcctcaaaca

SEQ ID NO: 983494 - DNA, 22 bp, Artificial Sequence
  chemically synthesized
caaatgtcatttcctcaaacaa

SEQ ID NO: 983495 - DNA, 22 bp, Artificial Sequence
  chemically synthesized
aaatgtcatttcctcaaacaaa

SEQ ID NO: 983496 - DNA, 22 bp, Artificial Sequence
  chemically synthesized
cctcaaacaaaagtccttctct

SEQ ID NO: 983497 - DNA, 22 bp, Artificial Sequence
  chemically synthesized
ctcaaacaaaagtccttctctg

SEQ ID NO: 983498 - DNA, 22 bp, Artificial Sequence
  chemically synthesized
aaacaaaagtccttctctggct

SEQ ID NO: 983499 - DNA, 22 bp, Artificial Sequence
  chemically synthesized
agacataacaccagacagagaa

SEQ ID NO: 983500 - DNA, 22 bp, Artificial Sequence
  chemically synthesized
ctctggcttctctgtctggtgt

SEQ ID NO: 983501 - DNA, 22 bp, Artificial Sequence
  chemically synthesized
tctggcttctctgtctggtgtt

SEQ ID NO: 983502 - DNA, 22 bp, Artificial Sequence
  chemically synthesized
tggcttctctgtctggtgttat

SEQ ID NO: 983503 - DNA, 22 bp, Artificial Sequence
  chemically synthesized
gcttctctgtctggtgttatgt

SEQ ID NO: 983504 - DNA, 22 bp, Artificial Sequence
  chemically synthesized
gaatgtgagttgagacataaca

SEQ ID NO: 983505 - DNA, 22 bp, Artificial Sequence
  chemically synthesized
ctctgtctggtgttatgtctca

SEQ ID NO: 983506 - DNA, 22 bp, Artificial Sequence
  chemically synthesized
tctgtctggtgttatgtctcaa

SEQ ID NO: 983507 - DNA, 22 bp, Artificial Sequence
  chemically synthesized
tgtctggtgttatgtctcaact

SEQ ID NO: 983508 - DNA, 22 bp, Artificial Sequence
  chemically synthesized
tctggtgttatgtctcaactca

SEQ ID NO: 983509 - DNA, 22 bp, Artificial Sequence
  chemically synthesized
gtgttatgtctcaactcacatt

SEQ ID NO: 983510 - DNA, 22 bp, Artificial Sequence
  chemically synthesized
tgtctcaactcacattccagtt

SEQ ID NO: 983511 - DNA, 22 bp, Artificial Sequence
  chemically synthesized
aactcacattccagttacactc

SEQ ID NO: 983512 - DNA, 22 bp, Artificial Sequence
  chemically synthesized
acattccagttacactctacca

SEQ ID NO: 983513 - DNA, 22 bp, Artificial Sequence
  chemically synthesized
cagttacactctaccacactgc

SEQ ID NO: 983514 - DNA, 22 bp, Artificial Sequence
  chemically synthesized
tacagaaaagtgagcagtgtgg

SEQ ID NO: 983515 - DNA, 22 bp, Artificial Sequence
  chemically synthesized
atacagaaaagtgagcagtgtg

SEQ ID NO: 983516 - DNA, 22 bp, Artificial Sequence
  chemically synthesized
cactctaccacactgctcactt

SEQ ID NO: 983517 - DNA, 22 bp, Artificial Sequence
  chemically synthesized
taccacactgctcacttttctg

SEQ ID NO: 983518 - DNA, 22 bp, Artificial Sequence
  chemically synthesized
ccacactgctcacttttctgta

SEQ ID NO: 983519 - DNA, 22 bp, Artificial Sequence
  chemically synthesized
aatatcaatatgtcttatacag

SEQ ID NO: 983520 - DNA, 22 bp, Artificial Sequence
  chemically synthesized
aaatatcaatatgtcttataca

SEQ ID NO: 983521 - DNA, 22 bp, Artificial Sequence
  chemically synthesized
taaatatcaatatgtcttatac

SEQ ID NO: 983522 - DNA, 22 bp, Artificial Sequence
  chemically synthesized
ctcacttttctgtataagacat

SEQ ID NO: 983523 - DNA, 22 bp, Artificial Sequence
  chemically synthesized
ttaaatatcaatatgtcttata

SEQ ID NO: 983524 - DNA, 22 bp, Artificial Sequence
  chemically synthesized
acttttctgtataagacatatt

SEQ ID NO: 983525 - DNA, 22 bp, Artificial Sequence
  chemically synthesized
ttctgtataagacatattgata

SEQ ID NO: 983526 - DNA, 22 bp, Artificial Sequence
  chemically synthesized
tctgtataagacatattgatat

SEQ ID NO: 983527 - DNA, 22 bp, Artificial Sequence
  chemically synthesized
ctgtataagacatattgatatt

SEQ ID NO: 983528 - DNA, 22 bp, Artificial Sequence
  chemically synthesized
tgtataagacatattgatattt

SEQ ID NO: 983529 - DNA, 22 bp, Artificial Sequence
  chemically synthesized
tataagacatattgatatttaa

SEQ ID NO: 983530 - DNA, 22 bp, Artificial Sequence
  chemically synthesized
aaaagtaataacaatttttaaa

SEQ ID NO: 983531 - DNA, 22 bp, Artificial Sequence
  chemically synthesized
gcattaaaaagtaataacaatt

SEQ ID NO: 983532 - DNA, 22 bp, Artificial Sequence
  chemically synthesized
atatttaaaaattgttattact

SEQ ID NO: 983533 - DNA, 22 bp, Artificial Sequence
  chemically synthesized
aaaaattgttattactttttaa

SEQ ID NO: 983534 - DNA, 22 bp, Artificial Sequence
  chemically synthesized
aaaattgttattactttttaat

SEQ ID NO: 983535 - DNA, 22 bp, Artificial Sequence
  chemically synthesized
ttattactttttaatgccaggt

SEQ ID NO: 983536 - DNA, 22 bp, Artificial Sequence
  chemically synthesized
ttactttttaatgccaggtgcg

SEQ ID NO: 983537 - DNA, 22 bp, Artificial Sequence
  chemically synthesized
cgggcatgagccagcgcacctg

SEQ ID NO: 983538 - DNA, 22 bp, Artificial Sequence
  chemically synthesized
ctttttaatgccaggtgcgctg

SEQ ID NO: 983539 - DNA, 22 bp, Artificial Sequence
  chemically synthesized
tttaatgccaggtgcgctggct

SEQ ID NO: 983540 - DNA, 22 bp, Artificial Sequence
  chemically synthesized
ttaatgccaggtgcgctggctc

SEQ ID NO: 983541 - DNA, 22 bp, Artificial Sequence
  chemically synthesized
taatgccaggtgcgctggctca

SEQ ID NO: 983542 - DNA, 22 bp, Artificial Sequence
  chemically synthesized
ggattacgggcatgagccagcg

SEQ ID NO: 983543 - DNA, 22 bp, Artificial Sequence
  chemically synthesized
aatgccaggtgcgctggctcat

SEQ ID NO: 983544 - DNA, 22 bp, Artificial Sequence
  chemically synthesized
atgccaggtgcgctggctcatg

SEQ ID NO: 983545 - DNA, 22 bp, Artificial Sequence
  chemically synthesized
ccaaagtgctgggattacgggc

SEQ ID NO: 983546 - DNA, 22 bp, Artificial Sequence
  chemically synthesized
gctcatgcccgtaatcccagca

SEQ ID NO: 983547 - DNA, 22 bp, Artificial Sequence
  chemically synthesized
cacggcctcccaaagtgctggg

SEQ ID NO: 983548 - DNA, 22 bp, Artificial Sequence
  chemically synthesized
atgcccgtaatcccagcacttt

SEQ ID NO: 983549 - DNA, 22 bp, Artificial Sequence
  chemically synthesized
ccctccacggcctcccaaagtg

SEQ ID NO: 983550 - DNA, 22 bp, Artificial Sequence
  chemically synthesized
aggtgatctgccctccacggcc

SEQ ID NO: 983551 - DNA, 22 bp, Artificial Sequence
  chemically synthesized
acctcaggtgatctgccctcca

SEQ ID NO: 983552 - DNA, 22 bp, Artificial Sequence
  chemically synthesized
tgggaggccgtggagggcagat

SEQ ID NO: 983553 - DNA, 22 bp, Artificial Sequence
  chemically synthesized
gggaggccgtggagggcagatc

SEQ ID NO: 983554 - DNA, 22 bp, Artificial Sequence
  chemically synthesized
ctgacctcaggtgatctgccct

SEQ ID NO: 983555 - DNA, 22 bp, Artificial Sequence
  chemically synthesized
ggaggccgtggagggcagatca

SEQ ID NO: 983556 - DNA, 22 bp, Artificial Sequence
  chemically synthesized
gagctcctgacctcaggtgatc

SEQ ID NO: 983557 - DNA, 22 bp, Artificial Sequence
  chemically synthesized
tcgagctcctgacctcaggtga

SEQ ID NO: 983558 - DNA, 22 bp, Artificial Sequence
  chemically synthesized
ttctcgagctcctgacctcagg

SEQ ID NO: 983559 - DNA, 22 bp, Artificial Sequence
  chemically synthesized
gccaggctgttctcgagctcct

SEQ ID NO: 983560 - DNA, 22 bp, Artificial Sequence
  chemically synthesized
aggtcaggagctcgagaacagc

SEQ ID NO: 983561 - DNA, 22 bp, Artificial Sequence
  chemically synthesized
accatattggccaggctgttct

SEQ ID NO: 983562 - DNA, 22 bp, Artificial Sequence
  chemically synthesized
caccatattggccaggctgttc

SEQ ID NO: 983563 - DNA, 22 bp, Artificial Sequence
  chemically synthesized
gagaacagcctggccaatatgg

SEQ ID NO: 983564 - DNA, 22 bp, Artificial Sequence
  chemically synthesized
gtagagatggggtttcaccata

SEQ ID NO: 983565 - DNA, 22 bp, Artificial Sequence
  chemically synthesized
agtagagatggggtttcaccat

SEQ ID NO: 983566 - DNA, 22 bp, Artificial Sequence
  chemically synthesized
tagtagagatggggtttcacca

SEQ ID NO: 983567 - DNA, 22 bp, Artificial Sequence
  chemically synthesized
ttagtagagatggggtttcacc

SEQ ID NO: 983568 - DNA, 22 bp, Artificial Sequence
  chemically synthesized
gccaatatggtgaaaccccatc

SEQ ID NO: 983569 - DNA, 22 bp, Artificial Sequence
  chemically synthesized
tatttttagtagagatggggtt

SEQ ID NO: 983570 - DNA, 22 bp, Artificial Sequence
  chemically synthesized
gtatttttagtagagatggggt

SEQ ID NO: 983571 - DNA, 22 bp, Artificial Sequence
  chemically synthesized
tgtatttttagtagagatgggg

SEQ ID NO: 983572 - DNA, 22 bp, Artificial Sequence
  chemically synthesized
ttgtatttttagtagagatggg

SEQ ID NO: 983573 - DNA, 22 bp, Artificial Sequence
  chemically synthesized
atttttgtatttttagtagaga

SEQ ID NO: 983574 - DNA, 22 bp, Artificial Sequence
  chemically synthesized
gctaatttttgtatttttagta

SEQ ID NO: 983575 - DNA, 22 bp, Artificial Sequence
  chemically synthesized
tactaaaaatacaaaaattagc

SEQ ID NO: 983576 - DNA, 22 bp, Artificial Sequence
  chemically synthesized
ctaaaaatacaaaaattagcca

SEQ ID NO: 983577 - DNA, 22 bp, Artificial Sequence
  chemically synthesized
aaaatacaaaaattagccaggc

SEQ ID NO: 983578 - DNA, 22 bp, Artificial Sequence
  chemically synthesized
caggcatgcgccaccatgcctg

SEQ ID NO: 983579 - DNA, 22 bp, Artificial Sequence
  chemically synthesized
ggattacaggcatgcgccacca

SEQ ID NO: 983580 - DNA, 22 bp, Artificial Sequence
  chemically synthesized
gccaggcatggtggcgcatgcc

SEQ ID NO: 983581 - DNA, 22 bp, Artificial Sequence
  chemically synthesized
ccgagtagctgggattacaggc

SEQ ID NO: 983582 - DNA, 22 bp, Artificial Sequence
  chemically synthesized
agcctaccgagtagctgggatt

SEQ ID NO: 983583 - DNA, 22 bp, Artificial Sequence
  chemically synthesized
cctcagcctaccgagtagctgg

SEQ ID NO: 983584 - DNA, 22 bp, Artificial Sequence
  chemically synthesized
ctgcctcagcctaccgagtagc

SEQ ID NO: 983585 - DNA, 22 bp, Artificial Sequence
  chemically synthesized
tcctgcctcagcctaccgagta

SEQ ID NO: 983586 - DNA, 22 bp, Artificial Sequence
  chemically synthesized
taatcccagctactcggtaggc

SEQ ID NO: 983587 - DNA, 22 bp, Artificial Sequence
  chemically synthesized
aaatgattctcctgcctcagcc

SEQ ID NO: 983588 - DNA, 22 bp, Artificial Sequence
  chemically synthesized
ctcggtaggctgaggcaggaga

SEQ ID NO: 983589 - DNA, 22 bp, Artificial Sequence
  chemically synthesized
ggtaggctgaggcaggagaatc

SEQ ID NO: 983590 - DNA, 22 bp, Artificial Sequence
  chemically synthesized
ccgggttcaaatgattctcctg

SEQ ID NO: 983591 - DNA, 22 bp, Artificial Sequence
  chemically synthesized
cctcccgggttcaaatgattct

SEQ ID NO: 983592 - DNA, 22 bp, Artificial Sequence
  chemically synthesized
tgcctcccgggttcaaatgatt

SEQ ID NO: 983593 - DNA, 22 bp, Artificial Sequence
  chemically synthesized
aggcaggagaatcatttgaacc

SEQ ID NO: 983594 - DNA, 22 bp, Artificial Sequence
  chemically synthesized
caacctctgcctcccgggttca

SEQ ID NO: 983595 - DNA, 22 bp, Artificial Sequence
  chemically synthesized
actgcaacctctgcctcccggg

SEQ ID NO: 983596 - DNA, 22 bp, Artificial Sequence
  chemically synthesized
ctcactgcaacctctgcctccc

SEQ ID NO: 983597 - DNA, 22 bp, Artificial Sequence
  chemically synthesized
tgctcactgcaacctctgcctc

SEQ ID NO: 983598 - DNA, 22 bp, Artificial Sequence
  chemically synthesized
gaacccgggaggcagaggttgc

SEQ ID NO: 983599 - DNA, 22 bp, Artificial Sequence
  chemically synthesized
aacccgggaggcagaggttgca

SEQ ID NO: 983600 - DNA, 22 bp, Artificial Sequence
  chemically synthesized
gagtgcagtggcacagtctctg

SEQ ID NO: 983601 - DNA, 22 bp, Artificial Sequence
  chemically synthesized
cagtgagcagagactgtgccac

SEQ ID NO: 983602 - DNA, 22 bp, Artificial Sequence
  chemically synthesized
tcacccaggctggagtgcagtg

SEQ ID NO: 983603 - DNA, 22 bp, Artificial Sequence
  chemically synthesized
tgtcacccaggctggagtgcag

SEQ ID NO: 983604 - DNA, 22 bp, Artificial Sequence
  chemically synthesized
actctgtcacccaggctggagt

SEQ ID NO: 983605 - DNA, 22 bp, Artificial Sequence
  chemically synthesized
tgccactgcactccagcctggg

SEQ ID NO: 983606 - DNA, 22 bp, Artificial Sequence
  chemically synthesized
cactccagcctgggtgacagag

SEQ ID NO: 983607 - DNA, 22 bp, Artificial Sequence
  chemically synthesized
agacagagtctcactctgtcac

SEQ ID NO: 983608 - DNA, 22 bp, Artificial Sequence
  chemically synthesized
ttgagacagagtctcactctgt

SEQ ID NO: 983609 - DNA, 22 bp, Artificial Sequence
  chemically synthesized
cagcctgggtgacagagtgaga

SEQ ID NO: 983610 - DNA, 22 bp, Artificial Sequence
  chemically synthesized
gttgagacagagtctcactctg

SEQ ID NO: 983611 - DNA, 22 bp, Artificial Sequence
  chemically synthesized
tgttgagacagagtctcactct

SEQ ID NO: 983612 - DNA, 22 bp, Artificial Sequence
  chemically synthesized
ttttgttgagacagagtctcac

SEQ ID NO: 983613 - DNA, 22 bp, Artificial Sequence
  chemically synthesized
attttgttgagacagagtctca

SEQ ID NO: 983614 - DNA, 22 bp, Artificial Sequence
  chemically synthesized
tattttgttgagacagagtctc

SEQ ID NO: 983615 - DNA, 22 bp, Artificial Sequence
  chemically synthesized
ggtgacagagtgagactctgtc

SEQ ID NO: 983616 - DNA, 22 bp, Artificial Sequence
  chemically synthesized
ttttattttgttgagacagagt

SEQ ID NO: 983617 - DNA, 22 bp, Artificial Sequence
  chemically synthesized
attttattttgttgagacagag

SEQ ID NO: 983618 - DNA, 22 bp, Artificial Sequence
  chemically synthesized
tattttattttgttgagacaga

SEQ ID NO: 983619 - DNA, 22 bp, Artificial Sequence
  chemically synthesized
ttttattttattttgttgagac

SEQ ID NO: 983620 - DNA, 22 bp, Artificial Sequence
  chemically synthesized
attttattttattttgttgaga

SEQ ID NO: 983621 - DNA, 22 bp, Artificial Sequence
  chemically synthesized
tattttattttattttgttgag

SEQ ID NO: 983622 - DNA, 22 bp, Artificial Sequence
  chemically synthesized
attttattttattttattttgt

SEQ ID NO: 983623 - DNA, 22 bp, Artificial Sequence
  chemically synthesized
cattttattttattttattttg

SEQ ID NO: 983624 - DNA, 22 bp, Artificial Sequence
  chemically synthesized
tttcattttattttattttatt

SEQ ID NO: 983625 - DNA, 22 bp, Artificial Sequence
  chemically synthesized
tgtctcaacaaaataaaataaa

SEQ ID NO: 983626 - DNA, 22 bp, Artificial Sequence
  chemically synthesized
gtttcattttattttattttat

SEQ ID NO: 983627 - DNA, 22 bp, Artificial Sequence
  chemically synthesized
tgtttcattttattttatttta

SEQ ID NO: 983628 - DNA, 22 bp, Artificial Sequence
  chemically synthesized
tctcaacaaaataaaataaaat

SEQ ID NO: 983629 - DNA, 22 bp, Artificial Sequence
  chemically synthesized
ttgtttcattttattttatttt

SEQ ID NO: 983630 - DNA, 22 bp, Artificial Sequence
  chemically synthesized
aacaaaataaaataaaataaaa

SEQ ID NO: 983631 - DNA, 22 bp, Artificial Sequence
  chemically synthesized
aaaaataacaatttttgtttca

SEQ ID NO: 983632 - DNA, 22 bp, Artificial Sequence
  chemically synthesized
atgaaatagatgttaaaaaata

SEQ ID NO: 983633 - DNA, 22 bp, Artificial Sequence
  chemically synthesized
tatgctaatgaaatagatgtta

SEQ ID NO: 983634 - DNA, 22 bp, Artificial Sequence
  chemically synthesized
atatgctaatgaaatagatgtt

SEQ ID NO: 983635 - DNA, 22 bp, Artificial Sequence
  chemically synthesized
ttattttttaacatctatttca

SEQ ID NO: 983636 - DNA, 22 bp, Artificial Sequence
  chemically synthesized
ttttttaacatctatttcatta

SEQ ID NO: 983637 - DNA, 22 bp, Artificial Sequence
  chemically synthesized
tttaacatctatttcattagca

SEQ ID NO: 983638 - DNA, 22 bp, Artificial Sequence
  chemically synthesized
aaggatcttatatgctaatgaa

SEQ ID NO: 983639 - DNA, 22 bp, Artificial Sequence
  chemically synthesized
ttaacatctatttcattagcat

SEQ ID NO: 983640 - DNA, 22 bp, Artificial Sequence
  chemically synthesized
taacatctatttcattagcata

SEQ ID NO: 983641 - DNA, 22 bp, Artificial Sequence
  chemically synthesized
tcaaggatcttatatgctaatg

SEQ ID NO: 983642 - DNA, 22 bp, Artificial Sequence
  chemically synthesized
aacatctatttcattagcatat

SEQ ID NO: 983643 - DNA, 22 bp, Artificial Sequence
  chemically synthesized
acatctatttcattagcatata

SEQ ID NO: 983644 - DNA, 22 bp, Artificial Sequence
  chemically synthesized
ctctcaaggatcttatatgcta

SEQ ID NO: 983645 - DNA, 22 bp, Artificial Sequence
  chemically synthesized
actctcaaggatcttatatgct

SEQ ID NO: 983646 - DNA, 22 bp, Artificial Sequence
  chemically synthesized
ttactctcaaggatcttatatg

SEQ ID NO: 983647 - DNA, 22 bp, Artificial Sequence
  chemically synthesized
tttcattagcatataagatcct

SEQ ID NO: 983648 - DNA, 22 bp, Artificial Sequence
  chemically synthesized
cattagcatataagatccttga

SEQ ID NO: 983649 - DNA, 22 bp, Artificial Sequence
  chemically synthesized
attagcatataagatccttgag

SEQ ID NO: 983650 - DNA, 22 bp, Artificial Sequence
  chemically synthesized
gcatataagatccttgagagta

SEQ ID NO: 983651 - DNA, 22 bp, Artificial Sequence
  chemically synthesized
gagagtaagaactttttgcttc

SEQ ID NO: 983652 - DNA, 22 bp, Artificial Sequence
  chemically synthesized
agagtaagaactttttgcttct

SEQ ID NO: 983653 - DNA, 22 bp, Artificial Sequence
  chemically synthesized
caggaatgaatcagaagcaaaa

SEQ ID NO: 983654 - DNA, 22 bp, Artificial Sequence
  chemically synthesized
aattacaggaatgaatcagaag

SEQ ID NO: 983655 - DNA, 22 bp, Artificial Sequence
  chemically synthesized
ggtgctgaattacaggaatgaa

SEQ ID NO: 983656 - DNA, 22 bp, Artificial Sequence
  chemically synthesized
tttgcttctgattcattcctgt

SEQ ID NO: 983657 - DNA, 22 bp, Artificial Sequence
  chemically synthesized
ttgcttctgattcattcctgta

SEQ ID NO: 983658 - DNA, 22 bp, Artificial Sequence
  chemically synthesized
taggtgctgaattacaggaatg

SEQ ID NO: 983659 - DNA, 22 bp, Artificial Sequence
  chemically synthesized
tgcttctgattcattcctgtaa

SEQ ID NO: 983660 - DNA, 22 bp, Artificial Sequence
  chemically synthesized
ctaggtgctgaattacaggaat

SEQ ID NO: 983661 - DNA, 22 bp, Artificial Sequence
  chemically synthesized
gcttctgattcattcctgtaat

SEQ ID NO: 983662 - DNA, 22 bp, Artificial Sequence
  chemically synthesized
tctaggtgctgaattacaggaa

SEQ ID NO: 983663 - DNA, 22 bp, Artificial Sequence
  chemically synthesized
cttctgattcattcctgtaatt

SEQ ID NO: 983664 - DNA, 22 bp, Artificial Sequence
  chemically synthesized
ttctaggtgctgaattacagga

SEQ ID NO: 983665 - DNA, 22 bp, Artificial Sequence
  chemically synthesized
ctgattcattcctgtaattcag

SEQ ID NO: 983666 - DNA, 22 bp, Artificial Sequence
  chemically synthesized
tgattcattcctgtaattcagc

SEQ ID NO: 983667 - DNA, 22 bp, Artificial Sequence
  chemically synthesized
attcattcctgtaattcagcac

SEQ ID NO: 983668 - DNA, 22 bp, Artificial Sequence
  chemically synthesized
attcctgtaattcagcacctag

SEQ ID NO: 983669 - DNA, 22 bp, Artificial Sequence
  chemically synthesized
ctgtaattcagcacctagaaaa

SEQ ID NO: 983670 - DNA, 22 bp, Artificial Sequence
  chemically synthesized
tatgccaaatgtttttctaggt

SEQ ID NO: 983671 - DNA, 22 bp, Artificial Sequence
  chemically synthesized
tatatgccaaatgtttttctag

SEQ ID NO: 983672 - DNA, 22 bp, Artificial Sequence
  chemically synthesized
taattcagcacctagaaaaaca

SEQ ID NO: 983673 - DNA, 22 bp, Artificial Sequence
  chemically synthesized
ctatatgccaaatgtttttcta

SEQ ID NO: 983674 - DNA, 22 bp, Artificial Sequence
  chemically synthesized
tcttctatatgccaaatgtttt

SEQ ID NO: 983675 - DNA, 22 bp, Artificial Sequence
  chemically synthesized
agcacctagaaaaacatttggc

SEQ ID NO: 983676 - DNA, 22 bp, Artificial Sequence
  chemically synthesized
attatcttctatatgccaaatg

SEQ ID NO: 983677 - DNA, 22 bp, Artificial Sequence
  chemically synthesized
gaaaaacatttggcatatagaa

SEQ ID NO: 983678 - DNA, 22 bp, Artificial Sequence
  chemically synthesized
tccattgattatcttctatatg

SEQ ID NO: 983679 - DNA, 22 bp, Artificial Sequence
  chemically synthesized
aatcacctatccattgattatc

SEQ ID NO: 983680 - DNA, 22 bp, Artificial Sequence
  chemically synthesized
ggcatatagaagataatcaatg

SEQ ID NO: 983681 - DNA, 22 bp, Artificial Sequence
  chemically synthesized
gcatatagaagataatcaatgg

SEQ ID NO: 983682 - DNA, 22 bp, Artificial Sequence
  chemically synthesized
ttcaatcacctatccattgatt

SEQ ID NO: 983683 - DNA, 22 bp, Artificial Sequence
  chemically synthesized
gttcaatcacctatccattgat

SEQ ID NO: 983684 - DNA, 22 bp, Artificial Sequence
  chemically synthesized
tttgttcaatcacctatccatt

SEQ ID NO: 983685 - DNA, 22 bp, Artificial Sequence
  chemically synthesized
aaagagctgtttgttcaatcac

SEQ ID NO: 983686 - DNA, 22 bp, Artificial Sequence
  chemically synthesized
caaagagctgtttgttcaatca

SEQ ID NO: 983687 - DNA, 22 bp, Artificial Sequence
  chemically synthesized
tttcaaagagctgtttgttcaa

SEQ ID NO: 983688 - DNA, 22 bp, Artificial Sequence
  chemically synthesized
gtacctgtttcaaagagctgtt

SEQ ID NO: 983689 - DNA, 22 bp, Artificial Sequence
  chemically synthesized
aacaaacagctctttgaaacag

SEQ ID NO: 983690 - DNA, 22 bp, Artificial Sequence
  chemically synthesized
agataacaagaaaactcgtacc

SEQ ID NO: 983691 - DNA, 22 bp, Artificial Sequence
  chemically synthesized
aagataacaagaaaactcgtac

SEQ ID NO: 983692 - DNA, 22 bp, Artificial Sequence
  chemically synthesized
tttgaaacaggtacgagttttc

SEQ ID NO: 983693 - DNA, 22 bp, Artificial Sequence
  chemically synthesized
tgaaacaggtacgagttttctt

SEQ ID NO: 983694 - DNA, 22 bp, Artificial Sequence
  chemically synthesized
gaaacaggtacgagttttcttg

SEQ ID NO: 983695 - DNA, 22 bp, Artificial Sequence
  chemically synthesized
tccttaagataacaagaaaact

SEQ ID NO: 983696 - DNA, 22 bp, Artificial Sequence
  chemically synthesized
aaacaggtacgagttttcttgt

SEQ ID NO: 983697 - DNA, 22 bp, Artificial Sequence
  chemically synthesized
atccttaagataacaagaaaac

SEQ ID NO: 983698 - DNA, 22 bp, Artificial Sequence
  chemically synthesized
tatccttaagataacaagaaaa

SEQ ID NO: 983699 - DNA, 22 bp, Artificial Sequence
  chemically synthesized
ttatccttaagataacaagaaa

SEQ ID NO: 983700 - DNA, 22 bp, Artificial Sequence
  chemically synthesized
tttatccttaagataacaagaa

SEQ ID NO: 983701 - DNA, 22 bp, Artificial Sequence
  chemically synthesized
aggaattttttatccttaagat

SEQ ID NO: 983702 - DNA, 22 bp, Artificial Sequence
  chemically synthesized
caggaattttttatccttaaga

SEQ ID NO: 983703 - DNA, 22 bp, Artificial Sequence
  chemically synthesized
tcttgttatcttaaggataaaa

SEQ ID NO: 983704 - DNA, 22 bp, Artificial Sequence
  chemically synthesized
cttgttatcttaaggataaaaa

SEQ ID NO: 983705 - DNA, 22 bp, Artificial Sequence
  chemically synthesized
aacttcaggaattttttatcct

SEQ ID NO: 983706 - DNA, 22 bp, Artificial Sequence
  chemically synthesized
ttgttatcttaaggataaaaaa

SEQ ID NO: 983707 - DNA, 22 bp, Artificial Sequence
  chemically synthesized
taaacttcaggaattttttatc

SEQ ID NO: 983708 - DNA, 22 bp, Artificial Sequence
  chemically synthesized
gttatcttaaggataaaaaatt

SEQ ID NO: 983709 - DNA, 22 bp, Artificial Sequence
  chemically synthesized
ctaaacttcaggaattttttat

SEQ ID NO: 983710 - DNA, 22 bp, Artificial Sequence
  chemically synthesized
ttatcttaaggataaaaaattc

SEQ ID NO: 983711 - DNA, 22 bp, Artificial Sequence
  chemically synthesized
tcttaaggataaaaaattcctg

SEQ ID NO: 983712 - DNA, 22 bp, Artificial Sequence
  chemically synthesized
ccccttctaaacttcaggaatt

SEQ ID NO: 983713 - DNA, 22 bp, Artificial Sequence
  chemically synthesized
accccttctaaacttcaggaat

SEQ ID NO: 983714 - DNA, 22 bp, Artificial Sequence
  chemically synthesized
aaggataaaaaattcctgaagt

SEQ ID NO: 983715 - DNA, 22 bp, Artificial Sequence
  chemically synthesized
aggataaaaaattcctgaagtt

SEQ ID NO: 983716 - DNA, 22 bp, Artificial Sequence
  chemically synthesized
tcacttaccccttctaaacttc

SEQ ID NO: 983717 - DNA, 22 bp, Artificial Sequence
  chemically synthesized
gaacctgtcacttaccccttct

SEQ ID NO: 983718 - DNA, 22 bp, Artificial Sequence
  chemically synthesized
ctgaagtttagaaggggtaagt

SEQ ID NO: 983719 - DNA, 22 bp, Artificial Sequence
  chemically synthesized
aagtttagaaggggtaagtgac

SEQ ID NO: 983720 - DNA, 22 bp, Artificial Sequence
  chemically synthesized
tgtgatctagaacctgtcactt

SEQ ID NO: 983721 - DNA, 22 bp, Artificial Sequence
  chemically synthesized
agaaggggtaagtgacaggttc

SEQ ID NO: 983722 - DNA, 22 bp, Artificial Sequence
  chemically synthesized
gaaggggtaagtgacaggttct

SEQ ID NO: 983723 - DNA, 22 bp, Artificial Sequence
  chemically synthesized
gatgctatgtgatctagaacct

SEQ ID NO: 983724 - DNA, 22 bp, Artificial Sequence
  chemically synthesized
ctggatgctatgtgatctagaa

SEQ ID NO: 983725 - DNA, 22 bp, Artificial Sequence
  chemically synthesized
tgctggatgctatgtgatctag

SEQ ID NO: 983726 - DNA, 22 bp, Artificial Sequence
  chemically synthesized
gctctgctggatgctatgtgat

SEQ ID NO: 983727 - DNA, 22 bp, Artificial Sequence
  chemically synthesized
aatggttggctctgctggatgc

SEQ ID NO: 983728 - DNA, 22 bp, Artificial Sequence
  chemically synthesized
tagatcacatagcatccagcag

SEQ ID NO: 983729 - DNA, 22 bp, Artificial Sequence
  chemically synthesized
caatggttggctctgctggatg

SEQ ID NO: 983730 - DNA, 22 bp, Artificial Sequence
  chemically synthesized
tcaatggttggctctgctggat

SEQ ID NO: 983731 - DNA, 22 bp, Artificial Sequence
  chemically synthesized
gatcacatagcatccagcagag

SEQ ID NO: 983732 - DNA, 22 bp, Artificial Sequence
  chemically synthesized
ctttcaatggttggctctgctg

SEQ ID NO: 983733 - DNA, 22 bp, Artificial Sequence
  chemically synthesized
actttcaatggttggctctgct

SEQ ID NO: 983734 - DNA, 22 bp, Artificial Sequence
  chemically synthesized
gacaggcatgtagtcttacttt

SEQ ID NO: 983735 - DNA, 22 bp, Artificial Sequence
  chemically synthesized
gctagacaggcatgtagtctta

SEQ ID NO: 983736 - DNA, 22 bp, Artificial Sequence
  chemically synthesized
ggctagacaggcatgtagtctt

SEQ ID NO: 983737 - DNA, 22 bp, Artificial Sequence
  chemically synthesized
tttggctagacaggcatgtagt

SEQ ID NO: 983738 - DNA, 22 bp, Artificial Sequence
  chemically synthesized
atttggctagacaggcatgtag

SEQ ID NO: 983739 - DNA, 22 bp, Artificial Sequence
  chemically synthesized
tatttggctagacaggcatgta

SEQ ID NO: 983740 - DNA, 22 bp, Artificial Sequence
  chemically synthesized
aaagtaagactacatgcctgtc

SEQ ID NO: 983741 - DNA, 22 bp, Artificial Sequence
  chemically synthesized
attttatttggctagacaggca

SEQ ID NO: 983742 - DNA, 22 bp, Artificial Sequence
  chemically synthesized
catgcctgtctagccaaataaa

SEQ ID NO: 983743 - DNA, 22 bp, Artificial Sequence
  chemically synthesized
tctagccaaataaaatgaattt

SEQ ID NO: 983744 - DNA, 22 bp, Artificial Sequence
  chemically synthesized
catcacaatgtgtccaaattca

SEQ ID NO: 983745 - DNA, 22 bp, Artificial Sequence
  chemically synthesized
gccaaataaaatgaatttggac

SEQ ID NO: 983746 - DNA, 22 bp, Artificial Sequence
  chemically synthesized
gctccatcacaatgtgtccaaa

SEQ ID NO: 983747 - DNA, 22 bp, Artificial Sequence
  chemically synthesized
acaatccctagctccatcacaa

SEQ ID NO: 983748 - DNA, 22 bp, Artificial Sequence
  chemically synthesized
gacaatccctagctccatcaca

SEQ ID NO: 983749 - DNA, 22 bp, Artificial Sequence
  chemically synthesized
ggacacattgtgatggagctag

SEQ ID NO: 983750 - DNA, 22 bp, Artificial Sequence
  chemically synthesized
gacacattgtgatggagctagg

SEQ ID NO: 983751 - DNA, 22 bp, Artificial Sequence
  chemically synthesized
tacatgatcttgacaatcccta

SEQ ID NO: 983752 - DNA, 22 bp, Artificial Sequence
  chemically synthesized
tgatggagctagggattgtcaa

SEQ ID NO: 983753 - DNA, 22 bp, Artificial Sequence
  chemically synthesized
ggatgtctatacatgatcttga

SEQ ID NO: 983754 - DNA, 22 bp, Artificial Sequence
  chemically synthesized
gggattgtcaagatcatgtata

SEQ ID NO: 983755 - DNA, 22 bp, Artificial Sequence
  chemically synthesized
tcaagatcatgtatagacatcc

SEQ ID NO: 983756 - DNA, 22 bp, Artificial Sequence
  chemically synthesized
caatgcgacaagaatgttagga

SEQ ID NO: 983757 - DNA, 22 bp, Artificial Sequence
  chemically synthesized
ccaatgcgacaagaatgttagg

SEQ ID NO: 983758 - DNA, 22 bp, Artificial Sequence
  chemically synthesized
tccaatgcgacaagaatgttag

SEQ ID NO: 983759 - DNA, 22 bp, Artificial Sequence
  chemically synthesized
cgttttccaatgcgacaagaat

SEQ ID NO: 983760 - DNA, 22 bp, Artificial Sequence
  chemically synthesized
acattcttgtcgcattggaaaa

SEQ ID NO: 983761 - DNA, 22 bp, Artificial Sequence
  chemically synthesized
ttgtcgcattggaaaacgcaga

SEQ ID NO: 983762 - DNA, 22 bp, Artificial Sequence
  chemically synthesized
gtcgcattggaaaacgcagata

SEQ ID NO: 983763 - DNA, 22 bp, Artificial Sequence
  chemically synthesized
tcgcattggaaaacgcagatat

SEQ ID NO: 983764 - DNA, 22 bp, Artificial Sequence
  chemically synthesized
ataatacatgataatatctgcg

SEQ ID NO: 983765 - DNA, 22 bp, Artificial Sequence
  chemically synthesized
tcataatacatgataatatctg

SEQ ID NO: 983766 - DNA, 22 bp, Artificial Sequence
  chemically synthesized
ttctcataatacatgataatat

SEQ ID NO: 983767 - DNA, 22 bp, Artificial Sequence
  chemically synthesized
gaaaacgcagatattatcatgt

SEQ ID NO: 983768 - DNA, 22 bp, Artificial Sequence
  chemically synthesized
agaaattattctcataatacat

SEQ ID NO: 983769 - DNA, 22 bp, Artificial Sequence
  chemically synthesized
actaagaaattattctcataat

SEQ ID NO: 983770 - DNA, 22 bp, Artificial Sequence
  chemically synthesized
tcatgtattatgagaataattt

SEQ ID NO: 983771 - DNA, 22 bp, Artificial Sequence
  chemically synthesized
atgaccatccctgactaagaaa

SEQ ID NO: 983772 - DNA, 22 bp, Artificial Sequence
  chemically synthesized
tgagaataatttcttagtcagg

SEQ ID NO: 983773 - DNA, 22 bp, Artificial Sequence
  chemically synthesized
atcactaatgaccatccctgac

SEQ ID NO: 983774 - DNA, 22 bp, Artificial Sequence
  chemically synthesized
catcactaatgaccatccctga

SEQ ID NO: 983775 - DNA, 22 bp, Artificial Sequence
  chemically synthesized
ttcatcactaatgaccatccct

SEQ ID NO: 983776 - DNA, 22 bp, Artificial Sequence
  chemically synthesized
cttcatcactaatgaccatccc

SEQ ID NO: 983777 - DNA, 22 bp, Artificial Sequence
  chemically synthesized
tcttcatcactaatgaccatcc

SEQ ID NO: 983778 - DNA, 22 bp, Artificial Sequence
  chemically synthesized
ttcttcatcactaatgaccatc

SEQ ID NO: 983779 - DNA, 22 bp, Artificial Sequence
  chemically synthesized
tttcttcatcactaatgaccat

SEQ ID NO: 983780 - DNA, 22 bp, Artificial Sequence
  chemically synthesized
cttagtcagggatggtcattag

SEQ ID NO: 983781 - DNA, 22 bp, Artificial Sequence
  chemically synthesized
ttagtcagggatggtcattagt

SEQ ID NO: 983782 - DNA, 22 bp, Artificial Sequence
  chemically synthesized
agtcagggatggtcattagtga

SEQ ID NO: 983783 - DNA, 22 bp, Artificial Sequence
  chemically synthesized
gtcagggatggtcattagtgat

SEQ ID NO: 983784 - DNA, 22 bp, Artificial Sequence
  chemically synthesized
aagggttttttcttcatcacta

SEQ ID NO: 983785 - DNA, 22 bp, Artificial Sequence
  chemically synthesized
aaagggttttttcttcatcact

SEQ ID NO: 983786 - DNA, 22 bp, Artificial Sequence
  chemically synthesized
taaagggttttttcttcatcac

SEQ ID NO: 983787 - DNA, 22 bp, Artificial Sequence
  chemically synthesized
gttttaaagggttttttcttca

SEQ ID NO: 983788 - DNA, 22 bp, Artificial Sequence
  chemically synthesized
agttttaaagggttttttcttc

SEQ ID NO: 983789 - DNA, 22 bp, Artificial Sequence
  chemically synthesized
tcttagttttaaagggtttttt

SEQ ID NO: 983790 - DNA, 22 bp, Artificial Sequence
  chemically synthesized
gtgatgaagaaaaaacccttta

SEQ ID NO: 983791 - DNA, 22 bp, Artificial Sequence
  chemically synthesized
aagttatcttagttttaaaggg

SEQ ID NO: 983792 - DNA, 22 bp, Artificial Sequence
  chemically synthesized
gaagttatcttagttttaaagg

SEQ ID NO: 983793 - DNA, 22 bp, Artificial Sequence
  chemically synthesized
ttgaagttatcttagttttaaa

SEQ ID NO: 983794 - DNA, 22 bp, Artificial Sequence
  chemically synthesized
cttgaagttatcttagttttaa

SEQ ID NO: 983795 - DNA, 22 bp, Artificial Sequence
  chemically synthesized
tcttgaagttatcttagtttta

SEQ ID NO: 983796 - DNA, 22 bp, Artificial Sequence
  chemically synthesized
taaaactaagataacttcaaga

SEQ ID NO: 983797 - DNA, 22 bp, Artificial Sequence
  chemically synthesized
aatgacccattttcttgaagtt

SEQ ID NO: 983798 - DNA, 22 bp, Artificial Sequence
  chemically synthesized
aaaactaagataacttcaagaa

SEQ ID NO: 983799 - DNA, 22 bp, Artificial Sequence
  chemically synthesized
aaactaagataacttcaagaaa

SEQ ID NO: 983800 - DNA, 22 bp, Artificial Sequence
  chemically synthesized
agataacttcaagaaaatgggt

SEQ ID NO: 983801 - DNA, 22 bp, Artificial Sequence
  chemically synthesized
caagaaaatgggtcatttaatc

SEQ ID NO: 983802 - DNA, 22 bp, Artificial Sequence
  chemically synthesized
aagaaaatgggtcatttaatcc

SEQ ID NO: 983803 - DNA, 22 bp, Artificial Sequence
  chemically synthesized
aatcctctgttctactgctgct

SEQ ID NO: 983804 - DNA, 22 bp, Artificial Sequence
  chemically synthesized
atcctctgttctactgctgctg

SEQ ID NO: 983805 - DNA, 22 bp, Artificial Sequence
  chemically synthesized
tgttctactgctgctgttttac

SEQ ID NO: 983806 - DNA, 22 bp, Artificial Sequence
  chemically synthesized
ttctactgctgctgttttacac

SEQ ID NO: 983807 - DNA, 22 bp, Artificial Sequence
  chemically synthesized
gaggagaatgtcgtgtaaaaca

SEQ ID NO: 983808 - DNA, 22 bp, Artificial Sequence
  chemically synthesized
tactgctgctgttttacacgac

SEQ ID NO: 983809 - DNA, 22 bp, Artificial Sequence
  chemically synthesized
ctgctgctgttttacacgacat

SEQ ID NO: 983810 - DNA, 22 bp, Artificial Sequence
  chemically synthesized
ctgctgttttacacgacattct

SEQ ID NO: 983811 - DNA, 22 bp, Artificial Sequence
  chemically synthesized
ctgttttacacgacattctcct

SEQ ID NO: 983812 - DNA, 22 bp, Artificial Sequence
  chemically synthesized
ttttacacgacattctcctcta

SEQ ID NO: 983813 - DNA, 22 bp, Artificial Sequence
  chemically synthesized
aatacgtaatacctagaggaga

SEQ ID NO: 983814 - DNA, 22 bp, Artificial Sequence
  chemically synthesized
tacacgacattctcctctaggt

SEQ ID NO: 983815 - DNA, 22 bp, Artificial Sequence
  chemically synthesized
acacgacattctcctctaggta

SEQ ID NO: 983816 - DNA, 22 bp, Artificial Sequence
  chemically synthesized
cacgacattctcctctaggtat

SEQ ID NO: 983817 - DNA, 22 bp, Artificial Sequence
  chemically synthesized
cactgaatacgtaatacctaga

SEQ ID NO: 983818 - DNA, 22 bp, Artificial Sequence
  chemically synthesized
ccactgaatacgtaatacctag

SEQ ID NO: 983819 - DNA, 22 bp, Artificial Sequence
  chemically synthesized
tccactgaatacgtaataccta

SEQ ID NO: 983820 - DNA, 22 bp, Artificial Sequence
  chemically synthesized
tcctctaggtattacgtattca

SEQ ID NO: 983821 - DNA, 22 bp, Artificial Sequence
  chemically synthesized
aatattttccactgaatacgta

SEQ ID NO: 983822 - DNA, 22 bp, Artificial Sequence
  chemically synthesized
ctctaggtattacgtattcagt

SEQ ID NO: 983823 - DNA, 22 bp, Artificial Sequence
  chemically synthesized
taggtattacgtattcagtgga

SEQ ID NO: 983824 - DNA, 22 bp, Artificial Sequence
  chemically synthesized
ggtattacgtattcagtggaaa

SEQ ID NO: 983825 - DNA, 22 bp, Artificial Sequence
  chemically synthesized
caagcactaaatattttccact

SEQ ID NO: 983826 - DNA, 22 bp, Artificial Sequence
  chemically synthesized
ttacaagcactaaatattttcc

SEQ ID NO: 983827 - DNA, 22 bp, Artificial Sequence
  chemically synthesized
attacaagcactaaatattttc

SEQ ID NO: 983828 - DNA, 22 bp, Artificial Sequence
  chemically synthesized
cgtattcagtggaaaatattta

SEQ ID NO: 983829 - DNA, 22 bp, Artificial Sequence
  chemically synthesized
tattacaagcactaaatatttt

SEQ ID NO: 983830 - DNA, 22 bp, Artificial Sequence
  chemically synthesized
ctttattacaagcactaaatat

SEQ ID NO: 983831 - DNA, 22 bp, Artificial Sequence
  chemically synthesized
actttattacaagcactaaata

SEQ ID NO: 983832 - DNA, 22 bp, Artificial Sequence
  chemically synthesized
agtggaaaatatttagtgcttg

SEQ ID NO: 983833 - DNA, 22 bp, Artificial Sequence
  chemically synthesized
gcttactttattacaagcacta

SEQ ID NO: 983834 - DNA, 22 bp, Artificial Sequence
  chemically synthesized
agtgcttgtaataaagtaagcc

SEQ ID NO: 983835 - DNA, 22 bp, Artificial Sequence
  chemically synthesized
gtgcttgtaataaagtaagcca

SEQ ID NO: 983836 - DNA, 22 bp, Artificial Sequence
  chemically synthesized
acaatatggccattggcttact

SEQ ID NO: 983837 - DNA, 22 bp, Artificial Sequence
  chemically synthesized
cacaatatggccattggcttac

SEQ ID NO: 983838 - DNA, 22 bp, Artificial Sequence
  chemically synthesized
gtaataaagtaagccaatggcc

SEQ ID NO: 983839 - DNA, 22 bp, Artificial Sequence
  chemically synthesized
taataaagtaagccaatggcca

SEQ ID NO: 983840 - DNA, 22 bp, Artificial Sequence
  chemically synthesized
tacttcacaatatggccattgg

SEQ ID NO: 983841 - DNA, 22 bp, Artificial Sequence
  chemically synthesized
acatccagtgtagagcactata

SEQ ID NO: 983842 - DNA, 22 bp, Artificial Sequence
  chemically synthesized
tgacatccagtgtagagcacta

SEQ ID NO: 983843 - DNA, 22 bp, Artificial Sequence
  chemically synthesized
ctgacatccagtgtagagcact

SEQ ID NO: 983844 - DNA, 22 bp, Artificial Sequence
  chemically synthesized
tgaagtatagtgctctacactg

SEQ ID NO: 983845 - DNA, 22 bp, Artificial Sequence
  chemically synthesized
aggtcttctgacatccagtgta

SEQ ID NO: 983846 - DNA, 22 bp, Artificial Sequence
  chemically synthesized
gcactgaggtcttctgacatcc

SEQ ID NO: 983847 - DNA, 22 bp, Artificial Sequence
  chemically synthesized
tacactggatgtcagaagacct

SEQ ID NO: 983848 - DNA, 22 bp, Artificial Sequence
  chemically synthesized
cactggatgtcagaagacctca

SEQ ID NO: 983849 - DNA, 22 bp, Artificial Sequence
  chemically synthesized
gatgtcagaagacctcagtgcc

SEQ ID NO: 983850 - DNA, 22 bp, Artificial Sequence
  chemically synthesized
tgtgaagaagcagggtctggca

SEQ ID NO: 983851 - DNA, 22 bp, Artificial Sequence
  chemically synthesized
ctgtgtgaagaagcagggtctg

SEQ ID NO: 983852 - DNA, 22 bp, Artificial Sequence
  chemically synthesized
caactactgtgtgaagaagcag

SEQ ID NO: 983853 - DNA, 22 bp, Artificial Sequence
  chemically synthesized
agtgccagaccctgcttcttca

SEQ ID NO: 983854 - DNA, 22 bp, Artificial Sequence
  chemically synthesized
ccctccaactactgtgtgaaga

SEQ ID NO: 983855 - DNA, 22 bp, Artificial Sequence
  chemically synthesized
accctccaactactgtgtgaag

SEQ ID NO: 983856 - DNA, 22 bp, Artificial Sequence
  chemically synthesized
taccctccaactactgtgtgaa

SEQ ID NO: 983857 - DNA, 22 bp, Artificial Sequence
  chemically synthesized
cttcttcacacagtagttggag

SEQ ID NO: 983858 - DNA, 22 bp, Artificial Sequence
  chemically synthesized
agatgactttaccctccaacta

SEQ ID NO: 983859 - DNA, 22 bp, Artificial Sequence
  chemically synthesized
cttcacacagtagttggagggt

SEQ ID NO: 983860 - DNA, 22 bp, Artificial Sequence
  chemically synthesized
ttcacacagtagttggagggta

SEQ ID NO: 983861 - DNA, 22 bp, Artificial Sequence
  chemically synthesized
cacacagtagttggagggtaaa

SEQ ID NO: 983862 - DNA, 22 bp, Artificial Sequence
  chemically synthesized
acacagtagttggagggtaaag

SEQ ID NO: 983863 - DNA, 22 bp, Artificial Sequence
  chemically synthesized
acagtctcagatgactttaccc

SEQ ID NO: 983864 - DNA, 22 bp, Artificial Sequence
  chemically synthesized
cggaactgacagtctcagatga

SEQ ID NO: 983865 - DNA, 22 bp, Artificial Sequence
  chemically synthesized
gagggtaaagtcatctgagact

SEQ ID NO: 983866 - DNA, 22 bp, Artificial Sequence
  chemically synthesized
aaattacggaactgacagtctc

SEQ ID NO: 983867 - DNA, 22 bp, Artificial Sequence
  chemically synthesized
aaaattacggaactgacagtct

SEQ ID NO: 983868 - DNA, 22 bp, Artificial Sequence
  chemically synthesized
taaaattacggaactgacagtc

SEQ ID NO: 983869 - DNA, 22 bp, Artificial Sequence
  chemically synthesized
cattttaaaattacggaactga

SEQ ID NO: 983870 - DNA, 22 bp, Artificial Sequence
  chemically synthesized
ccattttaaaattacggaactg

SEQ ID NO: 983871 - DNA, 22 bp, Artificial Sequence
  chemically synthesized
tccattttaaaattacggaact

SEQ ID NO: 983872 - DNA, 22 bp, Artificial Sequence
  chemically synthesized
ttccattttaaaattacggaac

SEQ ID NO: 983873 - DNA, 22 bp, Artificial Sequence
  chemically synthesized
tttccattttaaaattacggaa

SEQ ID NO: 983874 - DNA, 22 bp, Artificial Sequence
  chemically synthesized
agactgtcagttccgtaatttt

SEQ ID NO: 983875 - DNA, 22 bp, Artificial Sequence
  chemically synthesized
tcagttccgtaattttaaaatg

SEQ ID NO: 983876 - DNA, 22 bp, Artificial Sequence
  chemically synthesized
cgtaattttaaaatggaaaaag

SEQ ID NO: 983877 - DNA, 22 bp, Artificial Sequence
  chemically synthesized
atatgacagatatgctttttcc

SEQ ID NO: 983878 - DNA, 22 bp, Artificial Sequence
  chemically synthesized
taaaatggaaaaagcatatctg

SEQ ID NO: 983879 - DNA, 22 bp, Artificial Sequence
  chemically synthesized
aggttgatatgacagatatgct

SEQ ID NO: 983880 - DNA, 22 bp, Artificial Sequence
  chemically synthesized
aaaatggaaaaagcatatctgt

SEQ ID NO: 983881 - DNA, 22 bp, Artificial Sequence
  chemically synthesized
gaggttgatatgacagatatgc

SEQ ID NO: 983882 - DNA, 22 bp, Artificial Sequence
  chemically synthesized
aaatggaaaaagcatatctgtc

SEQ ID NO: 983883 - DNA, 22 bp, Artificial Sequence
  chemically synthesized
agtcccttgaggttgatatgac

SEQ ID NO: 983884 - DNA, 22 bp, Artificial Sequence
  chemically synthesized
tcagtcccttgaggttgatatg

SEQ ID NO: 983885 - DNA, 22 bp, Artificial Sequence
  chemically synthesized
atctctcagtcccttgaggttg

SEQ ID NO: 983886 - DNA, 22 bp, Artificial Sequence
  chemically synthesized
cattgatctctcagtcccttga

SEQ ID NO: 983887 - DNA, 22 bp, Artificial Sequence
  chemically synthesized
tcatatcaacctcaagggactg

SEQ ID NO: 983888 - DNA, 22 bp, Artificial Sequence
  chemically synthesized
tagccatcatctccattgatct

SEQ ID NO: 983889 - DNA, 22 bp, Artificial Sequence
  chemically synthesized
aagggactgagagatcaatgga

SEQ ID NO: 983890 - DNA, 22 bp, Artificial Sequence
  chemically synthesized
atagccatcatctccattgatc

SEQ ID NO: 983891 - DNA, 22 bp, Artificial Sequence
  chemically synthesized
tatagccatcatctccattgat

SEQ ID NO: 983892 - DNA, 22 bp, Artificial Sequence
  chemically synthesized
ttatagccatcatctccattga

SEQ ID NO: 983893 - DNA, 22 bp, Artificial Sequence
  chemically synthesized
agagatcaatggagatgatggc

SEQ ID NO: 983894 - DNA, 22 bp, Artificial Sequence
  chemically synthesized
aaatgtgcttttatagccatca

SEQ ID NO: 983895 - DNA, 22 bp, Artificial Sequence
  chemically synthesized
aaaatgtgcttttatagccatc

SEQ ID NO: 983896 - DNA, 22 bp, Artificial Sequence
  chemically synthesized
gcatttaaaatgtgcttttata

SEQ ID NO: 983897 - DNA, 22 bp, Artificial Sequence
  chemically synthesized
tggcatttaaaatgtgctttta

SEQ ID NO: 983898 - DNA, 22 bp, Artificial Sequence
  chemically synthesized
tatccctctggcatttaaaatg

SEQ ID NO: 983899 - DNA, 22 bp, Artificial Sequence
  chemically synthesized
atatccctctggcatttaaaat

SEQ ID NO: 983900 - DNA, 22 bp, Artificial Sequence
  chemically synthesized
tatatccctctggcatttaaaa

SEQ ID NO: 983901 - DNA, 22 bp, Artificial Sequence
  chemically synthesized
ttatatccctctggcatttaaa

SEQ ID NO: 983902 - DNA, 22 bp, Artificial Sequence
  chemically synthesized
taaaagcacattttaaatgcca

SEQ ID NO: 983903 - DNA, 22 bp, Artificial Sequence
  chemically synthesized
catttttatatccctctggcat

SEQ ID NO: 983904 - DNA, 22 bp, Artificial Sequence
  chemically synthesized
ccatttttatatccctctggca

SEQ ID NO: 983905 - DNA, 22 bp, Artificial Sequence
  chemically synthesized
taaatgccagagggatataaaa

SEQ ID NO: 983906 - DNA, 22 bp, Artificial Sequence
  chemically synthesized
aaatgccagagggatataaaaa

SEQ ID NO: 983907 - DNA, 22 bp, Artificial Sequence
  chemically synthesized
aatgccagagggatataaaaat

SEQ ID NO: 983908 - DNA, 22 bp, Artificial Sequence
  chemically synthesized
aataacaatgatgggaccttcc

SEQ ID NO: 983909 - DNA, 22 bp, Artificial Sequence
  chemically synthesized
atccctaaataacaatgatggg

SEQ ID NO: 983910 - DNA, 22 bp, Artificial Sequence
  chemically synthesized
catccctaaataacaatgatgg

SEQ ID NO: 983911 - DNA, 22 bp, Artificial Sequence
  chemically synthesized
aaaagccttcatccctaaataa

SEQ ID NO: 983912 - DNA, 22 bp, Artificial Sequence
  chemically synthesized
ttatttagggatgaaggctttt

SEQ ID NO: 983913 - DNA, 22 bp, Artificial Sequence
  chemically synthesized
tttagggatgaaggctttttaa

SEQ ID NO: 983914 - DNA, 22 bp, Artificial Sequence
  chemically synthesized
aacacatatagattaaaaagcc

SEQ ID NO: 983915 - DNA, 22 bp, Artificial Sequence
  chemically synthesized
agggatgaaggctttttaatct

SEQ ID NO: 983916 - DNA, 22 bp, Artificial Sequence
  chemically synthesized
ctgaacacatatagattaaaaa

SEQ ID NO: 983917 - DNA, 22 bp, Artificial Sequence
  chemically synthesized
gggatgaaggctttttaatcta

SEQ ID NO: 983918 - DNA, 22 bp, Artificial Sequence
  chemically synthesized
tttaatctatatgtgttcagta

SEQ ID NO: 983919 - DNA, 22 bp, Artificial Sequence
  chemically synthesized
ttaatctatatgtgttcagtaa

SEQ ID NO: 983920 - DNA, 22 bp, Artificial Sequence
  chemically synthesized
atgcaatatatgttactgaaca

SEQ ID NO: 983921 - DNA, 22 bp, Artificial Sequence
  chemically synthesized
taatctatatgtgttcagtaac

SEQ ID NO: 983922 - DNA, 22 bp, Artificial Sequence
  chemically synthesized
aatctatatgtgttcagtaaca

SEQ ID NO: 983923 - DNA, 22 bp, Artificial Sequence
  chemically synthesized
tcatgcaatatatgttactgaa

SEQ ID NO: 983924 - DNA, 22 bp, Artificial Sequence
  chemically synthesized
atctatatgtgttcagtaacat

SEQ ID NO: 983925 - DNA, 22 bp, Artificial Sequence
  chemically synthesized
ctcatgcaatatatgttactga

SEQ ID NO: 983926 - DNA, 22 bp, Artificial Sequence
  chemically synthesized
tctcatgcaatatatgttactg

SEQ ID NO: 983927 - DNA, 22 bp, Artificial Sequence
  chemically synthesized
ttttctcatgcaatatatgtta

SEQ ID NO: 983928 - DNA, 22 bp, Artificial Sequence
  chemically synthesized
tatgtgttcagtaacatatatt

SEQ ID NO: 983929 - DNA, 22 bp, Artificial Sequence
  chemically synthesized
acctattttctcatgcaatata

SEQ ID NO: 983930 - DNA, 22 bp, Artificial Sequence
  chemically synthesized
agtaacatatattgcatgagaa

SEQ ID NO: 983931 - DNA, 22 bp, Artificial Sequence
  chemically synthesized
atcattcacctattttctcatg

SEQ ID NO: 983932 - DNA, 22 bp, Artificial Sequence
  chemically synthesized
taatattcatcattcacctatt

SEQ ID NO: 983933 - DNA, 22 bp, Artificial Sequence
  chemically synthesized
ataatattcatcattcacctat

SEQ ID NO: 983934 - DNA, 22 bp, Artificial Sequence
  chemically synthesized
tataatattcatcattcaccta

SEQ ID NO: 983935 - DNA, 22 bp, Artificial Sequence
  chemically synthesized
catgagaaaataggtgaatgat

SEQ ID NO: 983936 - DNA, 22 bp, Artificial Sequence
  chemically synthesized
ttttataatattcatcattcac

SEQ ID NO: 983937 - DNA, 22 bp, Artificial Sequence
  chemically synthesized
tattattttataatattcatca

SEQ ID NO: 983938 - DNA, 22 bp, Artificial Sequence
  chemically synthesized
gtattattttataatattcatc

SEQ ID NO: 983939 - DNA, 22 bp, Artificial Sequence
  chemically synthesized
tgtattattttataatattcat

SEQ ID NO: 983940 - DNA, 22 bp, Artificial Sequence
  chemically synthesized
ttgtattattttataatattca

SEQ ID NO: 983941 - DNA, 22 bp, Artificial Sequence
  chemically synthesized
tatttttgtattattttataat

SEQ ID NO: 983942 - DNA, 22 bp, Artificial Sequence
  chemically synthesized
atattgtatttttgtattattt

SEQ ID NO: 983943 - DNA, 22 bp, Artificial Sequence
  chemically synthesized
ttaatattgtatttttgtatta

SEQ ID NO: 983944 - DNA, 22 bp, Artificial Sequence
  chemically synthesized
tatctattaatattgtattttt

SEQ ID NO: 983945 - DNA, 22 bp, Artificial Sequence
  chemically synthesized
taaaataatacaaaaatacaat

SEQ ID NO: 983946 - DNA, 22 bp, Artificial Sequence
  chemically synthesized
taggtaagcattatatctatta

SEQ ID NO: 983947 - DNA, 22 bp, Artificial Sequence
  chemically synthesized
ataggtaagcattatatctatt

SEQ ID NO: 983948 - DNA, 22 bp, Artificial Sequence
  chemically synthesized
accttataggtaagcattatat

SEQ ID NO: 983949 - DNA, 22 bp, Artificial Sequence
  chemically synthesized
atagatataatgcttacctata

SEQ ID NO: 983950 - DNA, 22 bp, Artificial Sequence
  chemically synthesized
ggtcaaaacaaattgaccttat

SEQ ID NO: 983951 - DNA, 22 bp, Artificial Sequence
  chemically synthesized
aggtcaaaacaaattgacctta

SEQ ID NO: 983952 - DNA, 22 bp, Artificial Sequence
  chemically synthesized
aatttaggtcaaaacaaattga

SEQ ID NO: 983953 - DNA, 22 bp, Artificial Sequence
  chemically synthesized
acctataaggtcaatttgtttt

SEQ ID NO: 983954 - DNA, 22 bp, Artificial Sequence
  chemically synthesized
cctataaggtcaatttgttttg

SEQ ID NO: 983955 - DNA, 22 bp, Artificial Sequence
  chemically synthesized
atctaaatttaggtcaaaacaa

SEQ ID NO: 983956 - DNA, 22 bp, Artificial Sequence
  chemically synthesized
taaggtcaatttgttttgacct

SEQ ID NO: 983957 - DNA, 22 bp, Artificial Sequence
  chemically synthesized
cctaatctaaatttaggtcaaa

SEQ ID NO: 983958 - DNA, 22 bp, Artificial Sequence
  chemically synthesized
gttttgacctaaatttagatta

SEQ ID NO: 983959 - DNA, 22 bp, Artificial Sequence
  chemically synthesized
ttttgacctaaatttagattag

SEQ ID NO: 983960 - DNA, 22 bp, Artificial Sequence
  chemically synthesized
tgcaacatgttgcctaatctaa

SEQ ID NO: 983961 - DNA, 22 bp, Artificial Sequence
  chemically synthesized
atgcaacatgttgcctaatcta

SEQ ID NO: 983962 - DNA, 22 bp, Artificial Sequence
  chemically synthesized
tgacctaaatttagattaggca

SEQ ID NO: 983963 - DNA, 22 bp, Artificial Sequence
  chemically synthesized
gacctaaatttagattaggcaa

SEQ ID NO: 983964 - DNA, 22 bp, Artificial Sequence
  chemically synthesized
acctaaatttagattaggcaac

SEQ ID NO: 983965 - DNA, 22 bp, Artificial Sequence
  chemically synthesized
aatttagattaggcaacatgtt

SEQ ID NO: 983966 - DNA, 22 bp, Artificial Sequence
  chemically synthesized
acccacccatttatgcaacatg

SEQ ID NO: 983967 - DNA, 22 bp, Artificial Sequence
  chemically synthesized
agattaggcaacatgttgcata

SEQ ID NO: 983968 - DNA, 22 bp, Artificial Sequence
  chemically synthesized
gattaggcaacatgttgcataa

SEQ ID NO: 983969 - DNA, 22 bp, Artificial Sequence
  chemically synthesized
ctgacccacccatttatgcaac

SEQ ID NO: 983970 - DNA, 22 bp, Artificial Sequence
  chemically synthesized
ggcaacatgttgcataaatggg

SEQ ID NO: 983971 - DNA, 22 bp, Artificial Sequence
  chemically synthesized
cgttactgacccacccatttat

SEQ ID NO: 983972 - DNA, 22 bp, Artificial Sequence
  chemically synthesized
ccgttactgacccacccattta

SEQ ID NO: 983973 - DNA, 22 bp, Artificial Sequence
  chemically synthesized
cataaatgggtgggtcagtaac

SEQ ID NO: 983974 - DNA, 22 bp, Artificial Sequence
  chemically synthesized
gagtgacatttccgttactgac

SEQ ID NO: 983975 - DNA, 22 bp, Artificial Sequence
  chemically synthesized
agagtgacatttccgttactga

SEQ ID NO: 983976 - DNA, 22 bp, Artificial Sequence
  chemically synthesized
tagagtgacatttccgttactg

SEQ ID NO: 983977 - DNA, 22 bp, Artificial Sequence
  chemically synthesized
ttagagtgacatttccgttact

SEQ ID NO: 983978 - DNA, 22 bp, Artificial Sequence
  chemically synthesized
tttagagtgacatttccgttac

SEQ ID NO: 983979 - DNA, 22 bp, Artificial Sequence
  chemically synthesized
cacattttttagagtgacattt

SEQ ID NO: 983980 - DNA, 22 bp, Artificial Sequence
  chemically synthesized
gcacattttttagagtgacatt

SEQ ID NO: 983981 - DNA, 22 bp, Artificial Sequence
  chemically synthesized
cttgcacattttttagagtgac

SEQ ID NO: 983982 - DNA, 22 bp, Artificial Sequence
  chemically synthesized
ccttgcacattttttagagtga

SEQ ID NO: 983983 - DNA, 22 bp, Artificial Sequence
  chemically synthesized
cttccttgcacattttttagag

SEQ ID NO: 983984 - DNA, 22 bp, Artificial Sequence
  chemically synthesized
taaaaaatgtgcaaggaagcaa

SEQ ID NO: 983985 - DNA, 22 bp, Artificial Sequence
  chemically synthesized
aaaaatgtgcaaggaagcaact

SEQ ID NO: 983986 - DNA, 22 bp, Artificial Sequence
  chemically synthesized
accatgatggacagttgcttcc

SEQ ID NO: 983987 - DNA, 22 bp, Artificial Sequence
  chemically synthesized
gaccatgatggacagttgcttc

SEQ ID NO: 983988 - DNA, 22 bp, Artificial Sequence
  chemically synthesized
aagtaatttgaccatgatggac

SEQ ID NO: 983989 - DNA, 22 bp, Artificial Sequence
  chemically synthesized
aaggcatctgaagtaatttgac

SEQ ID NO: 983990 - DNA, 22 bp, Artificial Sequence
  chemically synthesized
tccatcatggtcaaattacttc

SEQ ID NO: 983991 - DNA, 22 bp, Artificial Sequence
  chemically synthesized
atgaattcaaggcatctgaagt

SEQ ID NO: 983992 - DNA, 22 bp, Artificial Sequence
  chemically synthesized
ttcatgaattcaaggcatctga

SEQ ID NO: 983993 - DNA, 22 bp, Artificial Sequence
  chemically synthesized
attcatgaattcaaggcatctg

SEQ ID NO: 983994 - DNA, 22 bp, Artificial Sequence
  chemically synthesized
tattcatgaattcaaggcatct

SEQ ID NO: 983995 - DNA, 22 bp, Artificial Sequence
  chemically synthesized
cttcagatgccttgaattcatg

SEQ ID NO: 983996 - DNA, 22 bp, Artificial Sequence
  chemically synthesized
cagatgccttgaattcatgaat

SEQ ID NO: 983997 - DNA, 22 bp, Artificial Sequence
  chemically synthesized
atggagtgttttattcatgaat

SEQ ID NO: 983998 - DNA, 22 bp, Artificial Sequence
  chemically synthesized
agatgccttgaattcatgaata

SEQ ID NO: 983999 - DNA, 22 bp, Artificial Sequence
  chemically synthesized
gatggagtgttttattcatgaa

SEQ ID NO: 984000 - DNA, 22 bp, Artificial Sequence
  chemically synthesized
gaattcatgaataaaacactcc

SEQ ID NO: 984001 - DNA, 22 bp, Artificial Sequence
  chemically synthesized
aattcatgaataaaacactcca

SEQ ID NO: 984002 - DNA, 22 bp, Artificial Sequence
  chemically synthesized
atgaataaaacactccatcaaa

SEQ ID NO: 984003 - DNA, 22 bp, Artificial Sequence
  chemically synthesized
agatgcataaaatttgatggag

SEQ ID NO: 984004 - DNA, 22 bp, Artificial Sequence
  chemically synthesized
gagatgcataaaatttgatgga

SEQ ID NO: 984005 - DNA, 22 bp, Artificial Sequence
  chemically synthesized
catcaaattttatgcatctcaa

SEQ ID NO: 984006 - DNA, 22 bp, Artificial Sequence
  chemically synthesized
aatgtgtgagaagtgcttgaga

SEQ ID NO: 984007 - DNA, 22 bp, Artificial Sequence
  chemically synthesized
aaatgtgtgagaagtgcttgag

SEQ ID NO: 984008 - DNA, 22 bp, Artificial Sequence
  chemically synthesized
tatgcatctcaagcacttctca

SEQ ID NO: 984009 - DNA, 22 bp, Artificial Sequence
  chemically synthesized
atgcatctcaagcacttctcac

SEQ ID NO: 984010 - DNA, 22 bp, Artificial Sequence
  chemically synthesized
tgcatctcaagcacttctcaca

SEQ ID NO: 984011 - DNA, 22 bp, Artificial Sequence
  chemically synthesized
tggatttaaatgtgtgagaagt

SEQ ID NO: 984012 - DNA, 22 bp, Artificial Sequence
  chemically synthesized
aagcacttctcacacatttaaa

SEQ ID NO: 984013 - DNA, 22 bp, Artificial Sequence
  chemically synthesized
ggatgttgtggatttaaatgtg

SEQ ID NO: 984014 - DNA, 22 bp, Artificial Sequence
  chemically synthesized
actaggatgttgtggatttaaa

SEQ ID NO: 984015 - DNA, 22 bp, Artificial Sequence
  chemically synthesized
ctcacacatttaaatccacaac

SEQ ID NO: 984016 - DNA, 22 bp, Artificial Sequence
  chemically synthesized
cctcactaggatgttgtggatt

SEQ ID NO: 984017 - DNA, 22 bp, Artificial Sequence
  chemically synthesized
tcacacatttaaatccacaaca

SEQ ID NO: 984018 - DNA, 22 bp, Artificial Sequence
  chemically synthesized
acacatttaaatccacaacatc

SEQ ID NO: 984019 - DNA, 22 bp, Artificial Sequence
  chemically synthesized
cctacctcactaggatgttgtg

SEQ ID NO: 984020 - DNA, 22 bp, Artificial Sequence
  chemically synthesized
ccctacctcactaggatgttgt

SEQ ID NO: 984021 - DNA, 22 bp, Artificial Sequence
  chemically synthesized
cttccctacctcactaggatgt

SEQ ID NO: 984022 - DNA, 22 bp, Artificial Sequence
  chemically synthesized
aaatccacaacatcctagtgag

SEQ ID NO: 984023 - DNA, 22 bp, Artificial Sequence
  chemically synthesized
ctccttccctacctcactagga

SEQ ID NO: 984024 - DNA, 22 bp, Artificial Sequence
  chemically synthesized
aatccacaacatcctagtgagg

SEQ ID NO: 984025 - DNA, 22 bp, Artificial Sequence
  chemically synthesized
gtgaggtagggaaggaggaata

SEQ ID NO: 984026 - DNA, 22 bp, Artificial Sequence
  chemically synthesized
accaaataagaaaaatgaaata

SEQ ID NO: 984027 - DNA, 22 bp, Artificial Sequence
  chemically synthesized
caccaaataagaaaaatgaaat

SEQ ID NO: 984028 - DNA, 22 bp, Artificial Sequence
  chemically synthesized
atttcaccaaataagaaaaatg

SEQ ID NO: 984029 - DNA, 22 bp, Artificial Sequence
  chemically synthesized
tcctcatttcaccaaataagaa

SEQ ID NO: 984030 - DNA, 22 bp, Artificial Sequence
  chemically synthesized
attatcctcatttcaccaaata

SEQ ID NO: 984031 - DNA, 22 bp, Artificial Sequence
  chemically synthesized
catttttcttatttggtgaaat

SEQ ID NO: 984032 - DNA, 22 bp, Artificial Sequence
  chemically synthesized
atttttcttatttggtgaaatg

SEQ ID NO: 984033 - DNA, 22 bp, Artificial Sequence
  chemically synthesized
tgcctcattatcctcatttcac

SEQ ID NO: 984034 - DNA, 22 bp, Artificial Sequence
  chemically synthesized
gtgcctcattatcctcatttca

SEQ ID NO: 984035 - DNA, 22 bp, Artificial Sequence
  chemically synthesized
ttcttatttggtgaaatgagga

SEQ ID NO: 984036 - DNA, 22 bp, Artificial Sequence
  chemically synthesized
tcttatttggtgaaatgaggat

SEQ ID NO: 984037 - DNA, 22 bp, Artificial Sequence
  chemically synthesized
cttatttggtgaaatgaggata

SEQ ID NO: 984038 - DNA, 22 bp, Artificial Sequence
  chemically synthesized
cttgtgcctcattatcctcatt

SEQ ID NO: 984039 - DNA, 22 bp, Artificial Sequence
  chemically synthesized
ttatttggtgaaatgaggataa

SEQ ID NO: 984040 - DNA, 22 bp, Artificial Sequence
  chemically synthesized
atttggtgaaatgaggataatg

SEQ ID NO: 984041 - DNA, 22 bp, Artificial Sequence
  chemically synthesized
tttggtgaaatgaggataatga

SEQ ID NO: 984042 - DNA, 22 bp, Artificial Sequence
  chemically synthesized
acctccttgtgcctcattatcc

SEQ ID NO: 984043 - DNA, 22 bp, Artificial Sequence
  chemically synthesized
ggtgaaatgaggataatgaggc

SEQ ID NO: 984044 - DNA, 22 bp, Artificial Sequence
  chemically synthesized
gtgaaatgaggataatgaggca

SEQ ID NO: 984045 - DNA, 22 bp, Artificial Sequence
  chemically synthesized
tcattaacctccttgtgcctca

SEQ ID NO: 984046 - DNA, 22 bp, Artificial Sequence
  chemically synthesized
aaatctatcattaacctccttg

SEQ ID NO: 984047 - DNA, 22 bp, Artificial Sequence
  chemically synthesized
caaatctatcattaacctcctt

SEQ ID NO: 984048 - DNA, 22 bp, Artificial Sequence
  chemically synthesized
acttcaaatctatcattaacct

SEQ ID NO: 984049 - DNA, 22 bp, Artificial Sequence
  chemically synthesized
cattcacttcaaatctatcatt

SEQ ID NO: 984050 - DNA, 22 bp, Artificial Sequence
  chemically synthesized
attgcattcacttcaaatctat

SEQ ID NO: 984051 - DNA, 22 bp, Artificial Sequence
  chemically synthesized
actgattgcattcacttcaaat

SEQ ID NO: 984052 - DNA, 22 bp, Artificial Sequence
  chemically synthesized
ctgactgattgcattcacttca

SEQ ID NO: 984053 - DNA, 22 bp, Artificial Sequence
  chemically synthesized
atgatagatttgaagtgaatgc

SEQ ID NO: 984054 - DNA, 22 bp, Artificial Sequence
  chemically synthesized
ctgctgactgattgcattcact

SEQ ID NO: 984055 - DNA, 22 bp, Artificial Sequence
  chemically synthesized
gctgctgactgattgcattcac

SEQ ID NO: 984056 - DNA, 22 bp, Artificial Sequence
  chemically synthesized
tgctgctgactgattgcattca

SEQ ID NO: 984057 - DNA, 22 bp, Artificial Sequence
  chemically synthesized
gaagtgaatgcaatcagtcagc

SEQ ID NO: 984058 - DNA, 22 bp, Artificial Sequence
  chemically synthesized
aagtgaatgcaatcagtcagca

SEQ ID NO: 984059 - DNA, 22 bp, Artificial Sequence
  chemically synthesized
caaccatggttttgctgctgac

SEQ ID NO: 984060 - DNA, 22 bp, Artificial Sequence
  chemically synthesized
aattccaaccatggttttgctg

SEQ ID NO: 984061 - DNA, 22 bp, Artificial Sequence
  chemically synthesized
agggaacctaaattccaaccat

SEQ ID NO: 984062 - DNA, 22 bp, Artificial Sequence
  chemically synthesized
agtggaattcagggaacctaaa

SEQ ID NO: 984063 - DNA, 22 bp, Artificial Sequence
  chemically synthesized
gaatttaggttccctgaattcc

SEQ ID NO: 984064 - DNA, 22 bp, Artificial Sequence
  chemically synthesized
gaaaagaaccctaagtggaatt

SEQ ID NO: 984065 - DNA, 22 bp, Artificial Sequence
  chemically synthesized
aggttccctgaattccacttag

SEQ ID NO: 984066 - DNA, 22 bp, Artificial Sequence
  chemically synthesized
ggttccctgaattccacttagg

SEQ ID NO: 984067 - DNA, 22 bp, Artificial Sequence
  chemically synthesized
cctgaattccacttagggttct

SEQ ID NO: 984068 - DNA, 22 bp, Artificial Sequence
  chemically synthesized
aattccacttagggttcttttc

SEQ ID NO: 984069 - DNA, 22 bp, Artificial Sequence
  chemically synthesized
acgtagtatctcgaaaagaacc

SEQ ID NO: 984070 - DNA, 22 bp, Artificial Sequence
  chemically synthesized
cacttagggttcttttcgagat

SEQ ID NO: 984071 - DNA, 22 bp, Artificial Sequence
  chemically synthesized
agggttcttttcgagatactac

SEQ ID NO: 984072 - DNA, 22 bp, Artificial Sequence
  chemically synthesized
gggttcttttcgagatactacg

SEQ ID NO: 984073 - DNA, 22 bp, Artificial Sequence
  chemically synthesized
ttttcgagatactacgttaact

SEQ ID NO: 984074 - DNA, 22 bp, Artificial Sequence
  chemically synthesized
ttcgagatactacgttaactac

SEQ ID NO: 984075 - DNA, 22 bp, Artificial Sequence
  chemically synthesized
caacaatgaaatgtagttaacg

SEQ ID NO: 984076 - DNA, 22 bp, Artificial Sequence
  chemically synthesized
tcgagatactacgttaactaca

SEQ ID NO: 984077 - DNA, 22 bp, Artificial Sequence
  chemically synthesized
cgagatactacgttaactacat

SEQ ID NO: 984078 - DNA, 22 bp, Artificial Sequence
  chemically synthesized
gagatactacgttaactacatt

SEQ ID NO: 984079 - DNA, 22 bp, Artificial Sequence
  chemically synthesized
ctccaacaatgaaatgtagtta

SEQ ID NO: 984080 - DNA, 22 bp, Artificial Sequence
  chemically synthesized
aattcctccaacaatgaaatgt

SEQ ID NO: 984081 - DNA, 22 bp, Artificial Sequence
  chemically synthesized
cgttaactacatttcattgttg

SEQ ID NO: 984082 - DNA, 22 bp, Artificial Sequence
  chemically synthesized
aattaaattcctccaacaatga

SEQ ID NO: 984083 - DNA, 22 bp, Artificial Sequence
  chemically synthesized
actacatttcattgttggagga

SEQ ID NO: 984084 - DNA, 22 bp, Artificial Sequence
  chemically synthesized
catttcattgttggaggaattt

SEQ ID NO: 984085 - DNA, 22 bp, Artificial Sequence
  chemically synthesized
catgactgaattaaattcctcc

SEQ ID NO: 984086 - DNA, 22 bp, Artificial Sequence
  chemically synthesized
cattgttggaggaatttaattc

SEQ ID NO: 984087 - DNA, 22 bp, Artificial Sequence
  chemically synthesized
attgttggaggaatttaattca

SEQ ID NO: 984088 - DNA, 22 bp, Artificial Sequence
  chemically synthesized
tatctacatgactgaattaaat

SEQ ID NO: 984089 - DNA, 22 bp, Artificial Sequence
  chemically synthesized
ttggaggaatttaattcagtca

SEQ ID NO: 984090 - DNA, 22 bp, Artificial Sequence
  chemically synthesized
gaggaatttaattcagtcatgt

SEQ ID NO: 984091 - DNA, 22 bp, Artificial Sequence
  chemically synthesized
tgagcatctgtatctacatgac

SEQ ID NO: 984092 - DNA, 22 bp, Artificial Sequence
  chemically synthesized
aattcagtcatgtagatacaga

SEQ ID NO: 984093 - DNA, 22 bp, Artificial Sequence
  chemically synthesized
attcagtcatgtagatacagat

SEQ ID NO: 984094 - DNA, 22 bp, Artificial Sequence
  chemically synthesized
agtcatgtagatacagatgctc

SEQ ID NO: 984095 - DNA, 22 bp, Artificial Sequence
  chemically synthesized
gtaggatgaaaaaagatgttgt

SEQ ID NO: 984096 - DNA, 22 bp, Artificial Sequence
  chemically synthesized
agtaggatgaaaaaagatgttg

SEQ ID NO: 984097 - DNA, 22 bp, Artificial Sequence
  chemically synthesized
cttagtaggatgaaaaaagatg

SEQ ID NO: 984098 - DNA, 22 bp, Artificial Sequence
  chemically synthesized
acaacatcttttttcatcctac

SEQ ID NO: 984099 - DNA, 22 bp, Artificial Sequence
  chemically synthesized
gcagcaagattccttagtagga

SEQ ID NO: 984100 - DNA, 22 bp, Artificial Sequence
  chemically synthesized
aattagcagcaagattccttag

SEQ ID NO: 984101 - DNA, 22 bp, Artificial Sequence
  chemically synthesized
ttttcatcctactaaggaatct

SEQ ID NO: 984102 - DNA, 22 bp, Artificial Sequence
  chemically synthesized
tttcatcctactaaggaatctt

SEQ ID NO: 984103 - DNA, 22 bp, Artificial Sequence
  chemically synthesized
ttcatcctactaaggaatcttg

SEQ ID NO: 984104 - DNA, 22 bp, Artificial Sequence
  chemically synthesized
tcatcctactaaggaatcttgc

SEQ ID NO: 984105 - DNA, 22 bp, Artificial Sequence
  chemically synthesized
catcctactaaggaatcttgct

SEQ ID NO: 984106 - DNA, 22 bp, Artificial Sequence
  chemically synthesized
atcctactaaggaatcttgctg

SEQ ID NO: 984107 - DNA, 22 bp, Artificial Sequence
  chemically synthesized
agtggttgaattagcagcaaga

SEQ ID NO: 984108 - DNA, 22 bp, Artificial Sequence
  chemically synthesized
ctaaggaatcttgctgctaatt

SEQ ID NO: 984109 - DNA, 22 bp, Artificial Sequence
  chemically synthesized
tctcagtggttgaattagcagc

SEQ ID NO: 984110 - DNA, 22 bp, Artificial Sequence
  chemically synthesized
gtctcagtggttgaattagcag

SEQ ID NO: 984111 - DNA, 22 bp, Artificial Sequence
  chemically synthesized
aggaatcttgctgctaattcaa

SEQ ID NO: 984112 - DNA, 22 bp, Artificial Sequence
  chemically synthesized
tttgtctcagtggttgaattag

SEQ ID NO: 984113 - DNA, 22 bp, Artificial Sequence
  chemically synthesized
gctgctaattcaaccactgaga

SEQ ID NO: 984114 - DNA, 22 bp, Artificial Sequence
  chemically synthesized
ctgctaattcaaccactgagac

SEQ ID NO: 984115 - DNA, 22 bp, Artificial Sequence
  chemically synthesized
ctaattcaaccactgagacaaa

SEQ ID NO: 984116 - DNA, 22 bp, Artificial Sequence
  chemically synthesized
attcaaccactgagacaaataa

SEQ ID NO: 984117 - DNA, 22 bp, Artificial Sequence
  chemically synthesized
aaccactgagacaaataatacg

SEQ ID NO: 984118 - DNA, 22 bp, Artificial Sequence
  chemically synthesized
cagcgcaggtccacgtattatt

SEQ ID NO: 984119 - DNA, 22 bp, Artificial Sequence
  chemically synthesized
agacaaataatacgtggacctg

SEQ ID NO: 984120 - DNA, 22 bp, Artificial Sequence
  chemically synthesized
aatgaacaccgaagccaaatct

SEQ ID NO: 984121 - DNA, 22 bp, Artificial Sequence
  chemically synthesized
gaatgaacaccgaagccaaatc

SEQ ID NO: 984122 - DNA, 22 bp, Artificial Sequence
  chemically synthesized
cgctggagatttggcttcggtg

SEQ ID NO: 984123 - DNA, 22 bp, Artificial Sequence
  chemically synthesized
gagatttggcttcggtgttcat

SEQ ID NO: 984124 - DNA, 22 bp, Artificial Sequence
  chemically synthesized
aggaaatgacttgaatgaacac

SEQ ID NO: 984125 - DNA, 22 bp, Artificial Sequence
  chemically synthesized
gctcaggaaatgacttgaatga

SEQ ID NO: 984126 - DNA, 22 bp, Artificial Sequence
  chemically synthesized
ggcttcggtgttcattcaagtc

SEQ ID NO: 984127 - DNA, 22 bp, Artificial Sequence
  chemically synthesized
gcttcggtgttcattcaagtca

SEQ ID NO: 984128 - DNA, 22 bp, Artificial Sequence
  chemically synthesized
cggtgttcattcaagtcatttc

SEQ ID NO: 984129 - DNA, 22 bp, Artificial Sequence
  chemically synthesized
ggtgttcattcaagtcatttcc

SEQ ID NO: 984130 - DNA, 22 bp, Artificial Sequence
  chemically synthesized
attcaagtcatttcctgagcta

SEQ ID NO: 984131 - DNA, 22 bp, Artificial Sequence
  chemically synthesized
aagtcatttcctgagctaactt

SEQ ID NO: 984132 - DNA, 22 bp, Artificial Sequence
  chemically synthesized
ataggaaaaggaacagaagtta

SEQ ID NO: 984133 - DNA, 22 bp, Artificial Sequence
  chemically synthesized
cctgagctaacttctgttcctt

SEQ ID NO: 984134 - DNA, 22 bp, Artificial Sequence
  chemically synthesized
ctgagctaacttctgttccttt

SEQ ID NO: 984135 - DNA, 22 bp, Artificial Sequence
  chemically synthesized
agctaacttctgttccttttcc

SEQ ID NO: 984136 - DNA, 22 bp, Artificial Sequence
  chemically synthesized
acttctgttccttttcctatga

SEQ ID NO: 984137 - DNA, 22 bp, Artificial Sequence
  chemically synthesized
ctgttccttttcctatgaatac

SEQ ID NO: 984138 - DNA, 22 bp, Artificial Sequence
  chemically synthesized
tgttccttttcctatgaatact

SEQ ID NO: 984139 - DNA, 22 bp, Artificial Sequence
  chemically synthesized
ttccttttcctatgaatactat

SEQ ID NO: 984140 - DNA, 22 bp, Artificial Sequence
  chemically synthesized
cttttcctatgaatactatatt

SEQ ID NO: 984141 - DNA, 22 bp, Artificial Sequence
  chemically synthesized
ttcctatgaatactatattttt

SEQ ID NO: 984142 - DNA, 22 bp, Artificial Sequence
  chemically synthesized
tcctatgaatactatatttttt

SEQ ID NO: 984143 - DNA, 22 bp, Artificial Sequence
  chemically synthesized
cctatgaatactatattttttc

SEQ ID NO: 984144 - DNA, 22 bp, Artificial Sequence
  chemically synthesized
ctatgaatactatattttttca

SEQ ID NO: 984145 - DNA, 22 bp, Artificial Sequence
  chemically synthesized
agtggtataatgtgaaaaaata

SEQ ID NO: 984146 - DNA, 22 bp, Artificial Sequence
  chemically synthesized
tgaatactatattttttcacat

SEQ ID NO: 984147 - DNA, 22 bp, Artificial Sequence
  chemically synthesized
aataattcagtggtataatgtg

SEQ ID NO: 984148 - DNA, 22 bp, Artificial Sequence
  chemically synthesized
tattttttcacattataccact

SEQ ID NO: 984149 - DNA, 22 bp, Artificial Sequence
  chemically synthesized
tttcacattataccactgaatt

SEQ ID NO: 984150 - DNA, 22 bp, Artificial Sequence
  chemically synthesized
ttcacattataccactgaatta

SEQ ID NO: 984151 - DNA, 22 bp, Artificial Sequence
  chemically synthesized
aatgaatctgaataattcagtg

SEQ ID NO: 984152 - DNA, 22 bp, Artificial Sequence
  chemically synthesized
tcacattataccactgaattat

SEQ ID NO: 984153 - DNA, 22 bp, Artificial Sequence
  chemically synthesized
cacattataccactgaattatt

SEQ ID NO: 984154 - DNA, 22 bp, Artificial Sequence
  chemically synthesized
acattataccactgaattattc

SEQ ID NO: 984155 - DNA, 22 bp, Artificial Sequence
  chemically synthesized
taccactgaattattcagattc

SEQ ID NO: 984156 - DNA, 22 bp, Artificial Sequence
  chemically synthesized
agggtattcaatgaatctgaat

SEQ ID NO: 984157 - DNA, 22 bp, Artificial Sequence
  chemically synthesized
taagggtattcaatgaatctga

SEQ ID NO: 984158 - DNA, 22 bp, Artificial Sequence
  chemically synthesized
aattattcagattcattgaata

SEQ ID NO: 984159 - DNA, 22 bp, Artificial Sequence
  chemically synthesized
ataactctaagggtattcaatg

SEQ ID NO: 984160 - DNA, 22 bp, Artificial Sequence
  chemically synthesized
ttcagattcattgaataccctt

SEQ ID NO: 984161 - DNA, 22 bp, Artificial Sequence
  chemically synthesized
agattcattgaatacccttaga

SEQ ID NO: 984162 - DNA, 22 bp, Artificial Sequence
  chemically synthesized
attgaatacccttagagttatt

SEQ ID NO: 984163 - DNA, 22 bp, Artificial Sequence
  chemically synthesized
gatataacatgttaataactct

SEQ ID NO: 984164 - DNA, 22 bp, Artificial Sequence
  chemically synthesized
agatataacatgttaataactc

SEQ ID NO: 984165 - DNA, 22 bp, Artificial Sequence
  chemically synthesized
tagatataacatgttaataact

SEQ ID NO: 984166 - DNA, 22 bp, Artificial Sequence
  chemically synthesized
aatacccttagagttattaaca

SEQ ID NO: 984167 - DNA, 22 bp, Artificial Sequence
  chemically synthesized
ttagatataacatgttaataac

SEQ ID NO: 984168 - DNA, 22 bp, Artificial Sequence
  chemically synthesized
tttagatataacatgttaataa

SEQ ID NO: 984169 - DNA, 22 bp, Artificial Sequence
  chemically synthesized
ttttagatataacatgttaata

SEQ ID NO: 984170 - DNA, 22 bp, Artificial Sequence
  chemically synthesized
agagttattaacatgttatatc

SEQ ID NO: 984171 - DNA, 22 bp, Artificial Sequence
  chemically synthesized
gagttattaacatgttatatct

SEQ ID NO: 984172 - DNA, 22 bp, Artificial Sequence
  chemically synthesized
ttaacatgttatatctaaaaaa

SEQ ID NO: 984173 - DNA, 22 bp, Artificial Sequence
  chemically synthesized
acatgttatatctaaaaaaatt

SEQ ID NO: 984174 - DNA, 22 bp, Artificial Sequence
  chemically synthesized
tatctaaaaaaattactgcttt

SEQ ID NO: 984175 - DNA, 22 bp, Artificial Sequence
  chemically synthesized
tataaccaaaaggagaaagcag

SEQ ID NO: 984176 - DNA, 22 bp, Artificial Sequence
  chemically synthesized
aaaaaattactgctttctcctt

SEQ ID NO: 984177 - DNA, 22 bp, Artificial Sequence
  chemically synthesized
gctatataaccaaaaggagaaa

SEQ ID NO: 984178 - DNA, 22 bp, Artificial Sequence
  chemically synthesized
tagctatataaccaaaaggaga

SEQ ID NO: 984179 - DNA, 22 bp, Artificial Sequence
  chemically synthesized
ctagctatataaccaaaaggag

SEQ ID NO: 984180 - DNA, 22 bp, Artificial Sequence
  chemically synthesized
tctagctatataaccaaaagga

SEQ ID NO: 984181 - DNA, 22 bp, Artificial Sequence
  chemically synthesized
ctgctttctccttttggttata

SEQ ID NO: 984182 - DNA, 22 bp, Artificial Sequence
  chemically synthesized
actttctagctatataaccaaa

SEQ ID NO: 984183 - DNA, 22 bp, Artificial Sequence
  chemically synthesized
ctttctccttttggttatatag

SEQ ID NO: 984184 - DNA, 22 bp, Artificial Sequence
  chemically synthesized
tctccttttggttatatagcta

SEQ ID NO: 984185 - DNA, 22 bp, Artificial Sequence
  chemically synthesized
ctccttttggttatatagctag

SEQ ID NO: 984186 - DNA, 22 bp, Artificial Sequence
  chemically synthesized
tatcctgactttctagctatat

SEQ ID NO: 984187 - DNA, 22 bp, Artificial Sequence
  chemically synthesized
tccttttggttatatagctaga

SEQ ID NO: 984188 - DNA, 22 bp, Artificial Sequence
  chemically synthesized
cttttggttatatagctagaaa

SEQ ID NO: 984189 - DNA, 22 bp, Artificial Sequence
  chemically synthesized
ctatatcctgactttctagcta

SEQ ID NO: 984190 - DNA, 22 bp, Artificial Sequence
  chemically synthesized
actatatcctgactttctagct

SEQ ID NO: 984191 - DNA, 22 bp, Artificial Sequence
  chemically synthesized
tactatatcctgactttctagc

SEQ ID NO: 984192 - DNA, 22 bp, Artificial Sequence
  chemically synthesized
ttggttatatagctagaaagtc

SEQ ID NO: 984193 - DNA, 22 bp, Artificial Sequence
  chemically synthesized
ttactatatcctgactttctag

SEQ ID NO: 984194 - DNA, 22 bp, Artificial Sequence
  chemically synthesized
tggttatatagctagaaagtca

SEQ ID NO: 984195 - DNA, 22 bp, Artificial Sequence
  chemically synthesized
ggttatatagctagaaagtcag

SEQ ID NO: 984196 - DNA, 22 bp, Artificial Sequence
  chemically synthesized
gttatatagctagaaagtcagg

SEQ ID NO: 984197 - DNA, 22 bp, Artificial Sequence
  chemically synthesized
cttttactatatcctgactttc

SEQ ID NO: 984198 - DNA, 22 bp, Artificial Sequence
  chemically synthesized
tatagctagaaagtcaggatat

SEQ ID NO: 984199 - DNA, 22 bp, Artificial Sequence
  chemically synthesized
ggtctccttttactatatcctg

SEQ ID NO: 984200 - DNA, 22 bp, Artificial Sequence
  chemically synthesized
gggtctccttttactatatcct

SEQ ID NO: 984201 - DNA, 22 bp, Artificial Sequence
  chemically synthesized
tgggtctccttttactatatcc

SEQ ID NO: 984202 - DNA, 22 bp, Artificial Sequence
  chemically synthesized
gaaagtcaggatatagtaaaag

SEQ ID NO: 984203 - DNA, 22 bp, Artificial Sequence
  chemically synthesized
cattttgggtctccttttacta

SEQ ID NO: 984204 - DNA, 22 bp, Artificial Sequence
  chemically synthesized
aaaacctacattttgggtctcc

SEQ ID NO: 984205 - DNA, 22 bp, Artificial Sequence
  chemically synthesized
caaaacctacattttgggtctc

SEQ ID NO: 984206 - DNA, 22 bp, Artificial Sequence
  chemically synthesized
tcaaaacctacattttgggtct

SEQ ID NO: 984207 - DNA, 22 bp, Artificial Sequence
  chemically synthesized
ttttcaaaacctacattttggg

SEQ ID NO: 984208 - DNA, 22 bp, Artificial Sequence
  chemically synthesized
tattttcaaaacctacattttg

SEQ ID NO: 984209 - DNA, 22 bp, Artificial Sequence
  chemically synthesized
acgttctattttcaaaacctac

SEQ ID NO: 984210 - DNA, 22 bp, Artificial Sequence
  chemically synthesized
aaaaactgacgttctattttca

SEQ ID NO: 984211 - DNA, 22 bp, Artificial Sequence
  chemically synthesized
tgaaaatagaacgtcagttttt

SEQ ID NO: 984212 - DNA, 22 bp, Artificial Sequence
  chemically synthesized
gaaaatagaacgtcagtttttg

SEQ ID NO: 984213 - DNA, 22 bp, Artificial Sequence
  chemically synthesized
aaaatagaacgtcagtttttga

SEQ ID NO: 984214 - DNA, 22 bp, Artificial Sequence
  chemically synthesized
ttgaggacaccacacacttttg

SEQ ID NO: 984215 - DNA, 22 bp, Artificial Sequence
  chemically synthesized
tgaggacaccacacacttttgt

SEQ ID NO: 984216 - DNA, 22 bp, Artificial Sequence
  chemically synthesized
gaggacaccacacacttttgtt

SEQ ID NO: 984217 - DNA, 22 bp, Artificial Sequence
  chemically synthesized
aggacaccacacacttttgttt

SEQ ID NO: 984218 - DNA, 22 bp, Artificial Sequence
  chemically synthesized
ttgtttttcttcccatctcatt

SEQ ID NO: 984219 - DNA, 22 bp, Artificial Sequence
  chemically synthesized
tgtttttcttcccatctcattg

SEQ ID NO: 984220 - DNA, 22 bp, Artificial Sequence
  chemically synthesized
gtttttcttcccatctcattga

SEQ ID NO: 984221 - DNA, 22 bp, Artificial Sequence
  chemically synthesized
tttttcttcccatctcattgat

SEQ ID NO: 984222 - DNA, 22 bp, Artificial Sequence
  chemically synthesized
ttcttcccatctcattgatcac

SEQ ID NO: 984223 - DNA, 22 bp, Artificial Sequence
  chemically synthesized
tcttcccatctcattgatcact

SEQ ID NO: 984224 - DNA, 22 bp, Artificial Sequence
  chemically synthesized
cttcccatctcattgatcactc

SEQ ID NO: 984225 - DNA, 22 bp, Artificial Sequence
  chemically synthesized
ttcccatctcattgatcactcc

SEQ ID NO: 984226 - DNA, 22 bp, Artificial Sequence
  chemically synthesized
cccatctcattgatcactcctt

SEQ ID NO: 984227 - DNA, 22 bp, Artificial Sequence
  chemically synthesized
ccatctcattgatcactccttt

SEQ ID NO: 984228 - DNA, 22 bp, Artificial Sequence
  chemically synthesized
attgatcactccttttcttttc

SEQ ID NO: 984229 - DNA, 22 bp, Artificial Sequence
  chemically synthesized
atcactccttttcttttctttt

SEQ ID NO: 984230 - DNA, 22 bp, Artificial Sequence
  chemically synthesized
cttttcttttcttttttttttt

SEQ ID NO: 984231 - DNA, 22 bp, Artificial Sequence
  chemically synthesized
ttcttttctttttttttttttt

SEQ ID NO: 984232 - DNA, 22 bp, Artificial Sequence
  chemically synthesized
tcttttcttttttttttttttt

SEQ ID NO: 984233 - DNA, 22 bp, Artificial Sequence
  chemically synthesized
cttttctttttttttttttttt

SEQ ID NO: 984234 - DNA, 22 bp, Artificial Sequence
  chemically synthesized
ttttcttttttttttttttttt

SEQ ID NO: 984235 - DNA, 22 bp, Artificial Sequence
  chemically synthesized
ttcttttttttttttttttttt

SEQ ID NO: 984236 - DNA, 22 bp, Artificial Sequence
  chemically synthesized
aaaaaaaaaaaaaaaaaaaaaa

SEQ ID NO: 984237 - DNA, 22 bp, Artificial Sequence
  chemically synthesized
tctttttttttttttttttttt

SEQ ID NO: 984238 - DNA, 22 bp, Artificial Sequence
  chemically synthesized
cttttttttttttttttttttt

SEQ ID NO: 984239 - DNA, 22 bp, Artificial Sequence
  chemically synthesized
tttttttttttttttttttttt

SEQ ID NO: 984240 - DNA, 22 bp, Artificial Sequence
  chemically synthesized
tttttttttttttttttttttt

SEQ ID NO: 984241 - DNA, 22 bp, Artificial Sequence
  chemically synthesized
atctaaaaaaaaaaaaaaaaaa

SEQ ID NO: 984242 - DNA, 22 bp, Artificial Sequence
  chemically synthesized
tttttttttttttttttttttt

SEQ ID NO: 984243 - DNA, 22 bp, Artificial Sequence
  chemically synthesized
catctaaaaaaaaaaaaaaaaa

SEQ ID NO: 984244 - DNA, 22 bp, Artificial Sequence
  chemically synthesized
tttttttttttttttttttttt

SEQ ID NO: 984245 - DNA, 22 bp, Artificial Sequence
  chemically synthesized
tttttttttttttttttttttt

SEQ ID NO: 984246 - DNA, 22 bp, Artificial Sequence
  chemically synthesized
tttttttttttttttttttttt

SEQ ID NO: 984247 - DNA, 22 bp, Artificial Sequence
  chemically synthesized
tttttttttttttttttttttt

SEQ ID NO: 984248 - DNA, 22 bp, Artificial Sequence
  chemically synthesized
tttttttttttttttttttttt

SEQ ID NO: 984249 - DNA, 22 bp, Artificial Sequence
  chemically synthesized
tttttttttttttttttttttt

SEQ ID NO: 984250 - DNA, 22 bp, Artificial Sequence
  chemically synthesized
tttttttttttttttttttttt

SEQ ID NO: 984251 - DNA, 22 bp, Artificial Sequence
  chemically synthesized
ttttttttttttttttttttta

SEQ ID NO: 984252 - DNA, 22 bp, Artificial Sequence
  chemically synthesized
ttttttttttttttttttttag

SEQ ID NO: 984253 - DNA, 22 bp, Artificial Sequence
  chemically synthesized
tttttttttttttttttttaga

SEQ ID NO: 984254 - DNA, 22 bp, Artificial Sequence
  chemically synthesized
ttttttttttttttttttagat

SEQ ID NO: 984255 - DNA, 22 bp, Artificial Sequence
  chemically synthesized
tttttttttttttttttagatg

SEQ ID NO: 984256 - DNA, 22 bp, Artificial Sequence
  chemically synthesized
ttttttttttttttttagatga

SEQ ID NO: 984257 - DNA, 22 bp, Artificial Sequence
  chemically synthesized
tttttttttttttttagatgaa

SEQ ID NO: 984258 - DNA, 22 bp, Artificial Sequence
  chemically synthesized
ttttttttttttttagatgaag

SEQ ID NO: 984259 - DNA, 22 bp, Artificial Sequence
  chemically synthesized
tttttttttttttagatgaagt

SEQ ID NO: 984260 - DNA, 22 bp, Artificial Sequence
  chemically synthesized
ttttttttttttagatgaagtc

SEQ ID NO: 984261 - DNA, 22 bp, Artificial Sequence
  chemically synthesized
tttttttttttagatgaagtct

SEQ ID NO: 984262 - DNA, 22 bp, Artificial Sequence
  chemically synthesized
ggcgatggagcgagacttcatc

SEQ ID NO: 984263 - DNA, 22 bp, Artificial Sequence
  chemically synthesized
ttttttttttagatgaagtctc

SEQ ID NO: 984264 - DNA, 22 bp, Artificial Sequence
  chemically synthesized
tttttttttagatgaagtctcg

SEQ ID NO: 984265 - DNA, 22 bp, Artificial Sequence
  chemically synthesized
ttttttttagatgaagtctcgc

SEQ ID NO: 984266 - DNA, 22 bp, Artificial Sequence
  chemically synthesized
tttttttagatgaagtctcgct

SEQ ID NO: 984267 - DNA, 22 bp, Artificial Sequence
  chemically synthesized
ttttttagatgaagtctcgctc

SEQ ID NO: 984268 - DNA, 22 bp, Artificial Sequence
  chemically synthesized
tttttagatgaagtctcgctcc

SEQ ID NO: 984269 - DNA, 22 bp, Artificial Sequence
  chemically synthesized
ttttagatgaagtctcgctcca

SEQ ID NO: 984270 - DNA, 22 bp, Artificial Sequence
  chemically synthesized
caacctgggcgatggagcgaga

SEQ ID NO: 984271 - DNA, 22 bp, Artificial Sequence
  chemically synthesized
tttagatgaagtctcgctccat

SEQ ID NO: 984272 - DNA, 22 bp, Artificial Sequence
  chemically synthesized
ttagatgaagtctcgctccatc

SEQ ID NO: 984273 - DNA, 22 bp, Artificial Sequence
  chemically synthesized
tagatgaagtctcgctccatcg

SEQ ID NO: 984274 - DNA, 22 bp, Artificial Sequence
  chemically synthesized
agatgaagtctcgctccatcgc

SEQ ID NO: 984275 - DNA, 22 bp, Artificial Sequence
  chemically synthesized
gatgaagtctcgctccatcgcc

SEQ ID NO: 984276 - DNA, 22 bp, Artificial Sequence
  chemically synthesized
cgctccaacctgggcgatggag

SEQ ID NO: 984277 - DNA, 22 bp, Artificial Sequence
  chemically synthesized
tgccactgcgctccaacctggg

SEQ ID NO: 984278 - DNA, 22 bp, Artificial Sequence
  chemically synthesized
gctccatcgcccaggttggagc

SEQ ID NO: 984279 - DNA, 22 bp, Artificial Sequence
  chemically synthesized
catcgcccaggttggagcgcag

SEQ ID NO: 984280 - DNA, 22 bp, Artificial Sequence
  chemically synthesized
cagtgagccaaaagattgtgcc

SEQ ID NO: 984281 - DNA, 22 bp, Artificial Sequence
  chemically synthesized
gagcgcagtggcacaatctttt

SEQ ID NO: 984282 - DNA, 22 bp, Artificial Sequence
  chemically synthesized
ggagacagaggttgcagtgagc

SEQ ID NO: 984283 - DNA, 22 bp, Artificial Sequence
  chemically synthesized
tacctaggagacagaggttgca

SEQ ID NO: 984284 - DNA, 22 bp, Artificial Sequence
  chemically synthesized
gtacctaggagacagaggttgc

SEQ ID NO: 984285 - DNA, 22 bp, Artificial Sequence
  chemically synthesized
ttggctcactgcaacctctgtc

SEQ ID NO: 984286 - DNA, 22 bp, Artificial Sequence
  chemically synthesized
tggctcactgcaacctctgtct

SEQ ID NO: 984287 - DNA, 22 bp, Artificial Sequence
  chemically synthesized
cttgtacctaggagacagaggt

SEQ ID NO: 984288 - DNA, 22 bp, Artificial Sequence
  chemically synthesized
ggctcactgcaacctctgtctc

SEQ ID NO: 984289 - DNA, 22 bp, Artificial Sequence
  chemically synthesized
gctcactgcaacctctgtctcc

SEQ ID NO: 984290 - DNA, 22 bp, Artificial Sequence
  chemically synthesized
actgcaacctctgtctcctagg

SEQ ID NO: 984291 - DNA, 22 bp, Artificial Sequence
  chemically synthesized
caacctctgtctcctaggtaca

SEQ ID NO: 984292 - DNA, 22 bp, Artificial Sequence
  chemically synthesized
aggcagaagaattgcttgtacc

SEQ ID NO: 984293 - DNA, 22 bp, Artificial Sequence
  chemically synthesized
tgtctcctaggtacaagcaatt

SEQ ID NO: 984294 - DNA, 22 bp, Artificial Sequence
  chemically synthesized
tctcctaggtacaagcaattct

SEQ ID NO: 984295 - DNA, 22 bp, Artificial Sequence
  chemically synthesized
gaggctgaggcagaagaattgc

SEQ ID NO: 984296 - DNA, 22 bp, Artificial Sequence
  chemically synthesized
ctaggtacaagcaattcttctg

SEQ ID NO: 984297 - DNA, 22 bp, Artificial Sequence
  chemically synthesized
tggaggctgaggcagaagaatt

SEQ ID NO: 984298 - DNA, 22 bp, Artificial Sequence
  chemically synthesized
ggtacaagcaattcttctgcct

SEQ ID NO: 984299 - DNA, 22 bp, Artificial Sequence
  chemically synthesized
ctctggaggctgaggcagaaga

SEQ ID NO: 984300 - DNA, 22 bp, Artificial Sequence
  chemically synthesized
tagtcccagctgctctggaggc

SEQ ID NO: 984301 - DNA, 22 bp, Artificial Sequence
  chemically synthesized
ttctgcctcagcctccagagca

SEQ ID NO: 984302 - DNA, 22 bp, Artificial Sequence
  chemically synthesized
ctgcctcagcctccagagcagc

SEQ ID NO: 984303 - DNA, 22 bp, Artificial Sequence
  chemically synthesized
tgcctcagcctccagagcagct

SEQ ID NO: 984304 - DNA, 22 bp, Artificial Sequence
  chemically synthesized
cctcagcctccagagcagctgg

SEQ ID NO: 984305 - DNA, 22 bp, Artificial Sequence
  chemically synthesized
agcctccagagcagctgggact

SEQ ID NO: 984306 - DNA, 22 bp, Artificial Sequence
  chemically synthesized
cagagcagctgggactacaggt

SEQ ID NO: 984307 - DNA, 22 bp, Artificial Sequence
  chemically synthesized
ggtgtggtggcacacacctgta

SEQ ID NO: 984308 - DNA, 22 bp, Artificial Sequence
  chemically synthesized
gctgggtgtggtggcacacacc

SEQ ID NO: 984309 - DNA, 22 bp, Artificial Sequence
  chemically synthesized
ggactacaggtgtgtgccacca

SEQ ID NO: 984310 - DNA, 22 bp, Artificial Sequence
  chemically synthesized
caggtgtgtgccaccacaccca

SEQ ID NO: 984311 - DNA, 22 bp, Artificial Sequence
  chemically synthesized
aaaatacaaaattagctgggtg

SEQ ID NO: 984312 - DNA, 22 bp, Artificial Sequence
  chemically synthesized
ctaaaaatacaaaattagctgg

SEQ ID NO: 984313 - DNA, 22 bp, Artificial Sequence
  chemically synthesized
tactaaaaatacaaaattagct

SEQ ID NO: 984314 - DNA, 22 bp, Artificial Sequence
  chemically synthesized
attttgtatttttagtagagat

SEQ ID NO: 984315 - DNA, 22 bp, Artificial Sequence
  chemically synthesized
tgtatttttagtagagatgggg

SEQ ID NO: 984316 - DNA, 22 bp, Artificial Sequence
  chemically synthesized
gtatttttagtagagatggggt

SEQ ID NO: 984317 - DNA, 22 bp, Artificial Sequence
  chemically synthesized
tatttttagtagagatggggtt

SEQ ID NO: 984318 - DNA, 22 bp, Artificial Sequence
  chemically synthesized
gccaacatggtgaaaccccatc

SEQ ID NO: 984319 - DNA, 22 bp, Artificial Sequence
  chemically synthesized
ttagtagagatggggtttcacc

SEQ ID NO: 984320 - DNA, 22 bp, Artificial Sequence
  chemically synthesized
tagtagagatggggtttcacca

SEQ ID NO: 984321 - DNA, 22 bp, Artificial Sequence
  chemically synthesized
agtagagatggggtttcaccat

SEQ ID NO: 984322 - DNA, 22 bp, Artificial Sequence
  chemically synthesized
gtagagatggggtttcaccatg

SEQ ID NO: 984323 - DNA, 22 bp, Artificial Sequence
  chemically synthesized
gagaccagcctggccaacatgg

SEQ ID NO: 984324 - DNA, 22 bp, Artificial Sequence
  chemically synthesized
caccatgttggccaggctggtc

SEQ ID NO: 984325 - DNA, 22 bp, Artificial Sequence
  chemically synthesized
accatgttggccaggctggtct

SEQ ID NO: 984326 - DNA, 22 bp, Artificial Sequence
  chemically synthesized
gccaggctggtctccaactcct

SEQ ID NO: 984327 - DNA, 22 bp, Artificial Sequence
  chemically synthesized
gtctccaactcctgacctcgtg

SEQ ID NO: 984328 - DNA, 22 bp, Artificial Sequence
  chemically synthesized
caactcctgacctcgtgatctg

SEQ ID NO: 984329 - DNA, 22 bp, Artificial Sequence
  chemically synthesized
ggaggccgaggcgggcagatca

SEQ ID NO: 984330 - DNA, 22 bp, Artificial Sequence
  chemically synthesized
gggaggccgaggcgggcagatc

SEQ ID NO: 984331 - DNA, 22 bp, Artificial Sequence
  chemically synthesized
tgggaggccgaggcgggcagat

SEQ ID NO: 984332 - DNA, 22 bp, Artificial Sequence
  chemically synthesized
ctgacctcgtgatctgcccgcc

SEQ ID NO: 984333 - DNA, 22 bp, Artificial Sequence
  chemically synthesized
acctcgtgatctgcccgcctcg

SEQ ID NO: 984334 - DNA, 22 bp, Artificial Sequence
  chemically synthesized
gtactttgggaggccgaggcgg

SEQ ID NO: 984335 - DNA, 22 bp, Artificial Sequence
  chemically synthesized
gtgatctgcccgcctcggcctc

SEQ ID NO: 984336 - DNA, 22 bp, Artificial Sequence
  chemically synthesized
taatcctagtactttgggaggc

SEQ ID NO: 984337 - DNA, 22 bp, Artificial Sequence
  chemically synthesized
cccgcctcggcctcccaaagta

SEQ ID NO: 984338 - DNA, 22 bp, Artificial Sequence
  chemically synthesized
acacctgtaatcctagtacttt

SEQ ID NO: 984339 - DNA, 22 bp, Artificial Sequence
  chemically synthesized
ggcctcccaaagtactaggatt

SEQ ID NO: 984340 - DNA, 22 bp, Artificial Sequence
  chemically synthesized
ccaaagtactaggattacaggt

SEQ ID NO: 984341 - DNA, 22 bp, Artificial Sequence
  chemically synthesized
ggattacaggtgtgagccacca

SEQ ID NO: 984342 - DNA, 22 bp, Artificial Sequence
  chemically synthesized
caggtgtgagccaccatgcctg

SEQ ID NO: 984343 - DNA, 22 bp, Artificial Sequence
  chemically synthesized
gctgatcattccttttcattat

SEQ ID NO: 984344 - DNA, 22 bp, Artificial Sequence
  chemically synthesized
atcattccttttcattatcctg

SEQ ID NO: 984345 - DNA, 22 bp, Artificial Sequence
  chemically synthesized
acaaaggagaaaacagcacagg

SEQ ID NO: 984346 - DNA, 22 bp, Artificial Sequence
  chemically synthesized
cttttcattatcctgtgctgtt

SEQ ID NO: 984347 - DNA, 22 bp, Artificial Sequence
  chemically synthesized
ttcattatcctgtgctgttttc

SEQ ID NO: 984348 - DNA, 22 bp, Artificial Sequence
  chemically synthesized
tcattatcctgtgctgttttct

SEQ ID NO: 984349 - DNA, 22 bp, Artificial Sequence
  chemically synthesized
cattatcctgtgctgttttctc

SEQ ID NO: 984350 - DNA, 22 bp, Artificial Sequence
  chemically synthesized
attatcctgtgctgttttctcc

SEQ ID NO: 984351 - DNA, 22 bp, Artificial Sequence
  chemically synthesized
tcctgtgctgttttctcctttg

SEQ ID NO: 984352 - DNA, 22 bp, Artificial Sequence
  chemically synthesized
agaggtggattgacaaaggaga

SEQ ID NO: 984353 - DNA, 22 bp, Artificial Sequence
  chemically synthesized
tgctgttttctcctttgtcaat

SEQ ID NO: 984354 - DNA, 22 bp, Artificial Sequence
  chemically synthesized
acattaagaggtggattgacaa

SEQ ID NO: 984355 - DNA, 22 bp, Artificial Sequence
  chemically synthesized
taacattaagaggtggattgac

SEQ ID NO: 984356 - DNA, 22 bp, Artificial Sequence
  chemically synthesized
ttttctcctttgtcaatccacc

SEQ ID NO: 984357 - DNA, 22 bp, Artificial Sequence
  chemically synthesized
tctcctttgtcaatccacctct

SEQ ID NO: 984358 - DNA, 22 bp, Artificial Sequence
  chemically synthesized
ctcctttgtcaatccacctctt

SEQ ID NO: 984359 - DNA, 22 bp, Artificial Sequence
  chemically synthesized
tcctttgtcaatccacctctta

SEQ ID NO: 984360 - DNA, 22 bp, Artificial Sequence
  chemically synthesized
aggactctaacattaagaggtg

SEQ ID NO: 984361 - DNA, 22 bp, Artificial Sequence
  chemically synthesized
ctttgtcaatccacctcttaat

SEQ ID NO: 984362 - DNA, 22 bp, Artificial Sequence
  chemically synthesized
tgtcaatccacctcttaatgtt

SEQ ID NO: 984363 - DNA, 22 bp, Artificial Sequence
  chemically synthesized
gtcaatccacctcttaatgtta

SEQ ID NO: 984364 - DNA, 22 bp, Artificial Sequence
  chemically synthesized
tcaatccacctcttaatgttag

SEQ ID NO: 984365 - DNA, 22 bp, Artificial Sequence
  chemically synthesized
ttaatgttagagtccttagtca

SEQ ID NO: 984366 - DNA, 22 bp, Artificial Sequence
  chemically synthesized
aatgttagagtccttagtcacg

SEQ ID NO: 984367 - DNA, 22 bp, Artificial Sequence
  chemically synthesized
atgttagagtccttagtcacgt

SEQ ID NO: 984368 - DNA, 22 bp, Artificial Sequence
  chemically synthesized
gagtccttagtcacgttgtcat

SEQ ID NO: 984369 - DNA, 22 bp, Artificial Sequence
  chemically synthesized
aggaagaatatagatagaaatg

SEQ ID NO: 984370 - DNA, 22 bp, Artificial Sequence
  chemically synthesized
agtcacgttgtcatttctatct

SEQ ID NO: 984371 - DNA, 22 bp, Artificial Sequence
  chemically synthesized
gtcacgttgtcatttctatcta

SEQ ID NO: 984372 - DNA, 22 bp, Artificial Sequence
  chemically synthesized
tatcactaaggaagaatataga

SEQ ID NO: 984373 - DNA, 22 bp, Artificial Sequence
  chemically synthesized
tcatttctatctatattcttcc

SEQ ID NO: 984374 - DNA, 22 bp, Artificial Sequence
  chemically synthesized
ctatctatattcttccttagtg

SEQ ID NO: 984375 - DNA, 22 bp, Artificial Sequence
  chemically synthesized
tatctatattcttccttagtga

SEQ ID NO: 984376 - DNA, 22 bp, Artificial Sequence
  chemically synthesized
tctatattcttccttagtgata

SEQ ID NO: 984377 - DNA, 22 bp, Artificial Sequence
  chemically synthesized
tgatatcagattgtatcactaa

SEQ ID NO: 984378 - DNA, 22 bp, Artificial Sequence
  chemically synthesized
tattcttccttagtgatacaat

SEQ ID NO: 984379 - DNA, 22 bp, Artificial Sequence
  chemically synthesized
aagctgtgatatcagattgtat

SEQ ID NO: 984380 - DNA, 22 bp, Artificial Sequence
  chemically synthesized
aaagctgtgatatcagattgta

SEQ ID NO: 984381 - DNA, 22 bp, Artificial Sequence
  chemically synthesized
ttccttagtgatacaatctgat

SEQ ID NO: 984382 - DNA, 22 bp, Artificial Sequence
  chemically synthesized
ccttagtgatacaatctgatat

SEQ ID NO: 984383 - DNA, 22 bp, Artificial Sequence
  chemically synthesized
cttagtgatacaatctgatatc

SEQ ID NO: 984384 - DNA, 22 bp, Artificial Sequence
  chemically synthesized
agtgatacaatctgatatcaca

SEQ ID NO: 984385 - DNA, 22 bp, Artificial Sequence
  chemically synthesized
gtgatacaatctgatatcacag

SEQ ID NO: 984386 - DNA, 22 bp, Artificial Sequence
  chemically synthesized
tataagataacatttaaagctg

SEQ ID NO: 984387 - DNA, 22 bp, Artificial Sequence
  chemically synthesized
gtataagataacatttaaagct

SEQ ID NO: 984388 - DNA, 22 bp, Artificial Sequence
  chemically synthesized
atatcacagctttaaatgttat

SEQ ID NO: 984389 - DNA, 22 bp, Artificial Sequence
  chemically synthesized
ggaggtgtttgtataagataac

SEQ ID NO: 984390 - DNA, 22 bp, Artificial Sequence
  chemically synthesized
cggaggtgtttgtataagataa

SEQ ID NO: 984391 - DNA, 22 bp, Artificial Sequence
  chemically synthesized
aatttcggaggtgtttgtataa

SEQ ID NO: 984392 - DNA, 22 bp, Artificial Sequence
  chemically synthesized
taaatgttatcttatacaaaca

SEQ ID NO: 984393 - DNA, 22 bp, Artificial Sequence
  chemically synthesized
aaatttcggaggtgtttgtata

SEQ ID NO: 984394 - DNA, 22 bp, Artificial Sequence
  chemically synthesized
aaatgttatcttatacaaacac

SEQ ID NO: 984395 - DNA, 22 bp, Artificial Sequence
  chemically synthesized
aatgttatcttatacaaacacc

SEQ ID NO: 984396 - DNA, 22 bp, Artificial Sequence
  chemically synthesized
gacgtttaaatttcggaggtgt

SEQ ID NO: 984397 - DNA, 22 bp, Artificial Sequence
  chemically synthesized
tcttatacaaacacctccgaaa

SEQ ID NO: 984398 - DNA, 22 bp, Artificial Sequence
  chemically synthesized
atacaaacacctccgaaattta

SEQ ID NO: 984399 - DNA, 22 bp, Artificial Sequence
  chemically synthesized
tacaaacacctccgaaatttaa

SEQ ID NO: 984400 - DNA, 22 bp, Artificial Sequence
  chemically synthesized
cgaaatttaaacgtccaacctg

SEQ ID NO: 984401 - DNA, 22 bp, Artificial Sequence
  chemically synthesized
agcaaaaaaggtccaggttgga

SEQ ID NO: 984402 - DNA, 22 bp, Artificial Sequence
  chemically synthesized
gagttcagcaaaaaaggtccag

SEQ ID NO: 984403 - DNA, 22 bp, Artificial Sequence
  chemically synthesized
aaacgtccaacctggacctttt

SEQ ID NO: 984404 - DNA, 22 bp, Artificial Sequence
  chemically synthesized
agagttcagcaaaaaaggtcca

SEQ ID NO: 984405 - DNA, 22 bp, Artificial Sequence
  chemically synthesized
aacgtccaacctggaccttttt

SEQ ID NO: 984406 - DNA, 22 bp, Artificial Sequence
  chemically synthesized
tagagttcagcaaaaaaggtcc

SEQ ID NO: 984407 - DNA, 22 bp, Artificial Sequence
  chemically synthesized
aataaatacctttagagttcag

SEQ ID NO: 984408 - DNA, 22 bp, Artificial Sequence
  chemically synthesized
gaccttttttgctgaactctaa

SEQ ID NO: 984409 - DNA, 22 bp, Artificial Sequence
  chemically synthesized
ttttgctgaactctaaaggtat

SEQ ID NO: 984410 - DNA, 22 bp, Artificial Sequence
  chemically synthesized
tttgctgaactctaaaggtatt

SEQ ID NO: 984411 - DNA, 22 bp, Artificial Sequence
  chemically synthesized
ttgctgaactctaaaggtattt

SEQ ID NO: 984412 - DNA, 22 bp, Artificial Sequence
  chemically synthesized
tgctgaactctaaaggtattta

SEQ ID NO: 984413 - DNA, 22 bp, Artificial Sequence
  chemically synthesized
gctgaactctaaaggtatttat

SEQ ID NO: 984414 - DNA, 22 bp, Artificial Sequence
  chemically synthesized
ctgaactctaaaggtatttatt

SEQ ID NO: 984415 - DNA, 22 bp, Artificial Sequence
  chemically synthesized
aataggcaattgaataaatacc

SEQ ID NO: 984416 - DNA, 22 bp, Artificial Sequence
  chemically synthesized
aactctaaaggtatttattcaa

SEQ ID NO: 984417 - DNA, 22 bp, Artificial Sequence
  chemically synthesized
taaaggtatttattcaattgcc

SEQ ID NO: 984418 - DNA, 22 bp, Artificial Sequence
  chemically synthesized
aaggtatttattcaattgccta

SEQ ID NO: 984419 - DNA, 22 bp, Artificial Sequence
  chemically synthesized
attcaattgcctattcaatata

SEQ ID NO: 984420 - DNA, 22 bp, Artificial Sequence
  chemically synthesized
ttcaattgcctattcaatatat

SEQ ID NO: 984421 - DNA, 22 bp, Artificial Sequence
  chemically synthesized
gacatatcaccagatatattga

SEQ ID NO: 984422 - DNA, 22 bp, Artificial Sequence
  chemically synthesized
aattgcctattcaatatatctg

SEQ ID NO: 984423 - DNA, 22 bp, Artificial Sequence
  chemically synthesized
ttagacatatcaccagatatat

SEQ ID NO: 984424 - DNA, 22 bp, Artificial Sequence
  chemically synthesized
cctattcaatatatctggtgat

SEQ ID NO: 984425 - DNA, 22 bp, Artificial Sequence
  chemically synthesized
ttcaatatatctggtgatatgt

SEQ ID NO: 984426 - DNA, 22 bp, Artificial Sequence
  chemically synthesized
gatatctgttagacatatcacc

SEQ ID NO: 984427 - DNA, 22 bp, Artificial Sequence
  chemically synthesized
ggatatctgttagacatatcac

SEQ ID NO: 984428 - DNA, 22 bp, Artificial Sequence
  chemically synthesized
aatatatctggtgatatgtcta

SEQ ID NO: 984429 - DNA, 22 bp, Artificial Sequence
  chemically synthesized
aatttggatatctgttagacat

SEQ ID NO: 984430 - DNA, 22 bp, Artificial Sequence
  chemically synthesized
gtgatatgtctaacagatatcc

SEQ ID NO: 984431 - DNA, 22 bp, Artificial Sequence
  chemically synthesized
gggaggcattaaatttggatat

SEQ ID NO: 984432 - DNA, 22 bp, Artificial Sequence
  chemically synthesized
acagatatccaaatttaatgcc

SEQ ID NO: 984433 - DNA, 22 bp, Artificial Sequence
  chemically synthesized
tagatagaatggggcgattagg

SEQ ID NO: 984434 - DNA, 22 bp, Artificial Sequence
  chemically synthesized
aatgcctccctaatcgccccat

SEQ ID NO: 984435 - DNA, 22 bp, Artificial Sequence
  chemically synthesized
atgcctccctaatcgccccatt

SEQ ID NO: 984436 - DNA, 22 bp, Artificial Sequence
  chemically synthesized
cctaatcgccccattctatcta

SEQ ID NO: 984437 - DNA, 22 bp, Artificial Sequence
  chemically synthesized
aaataataaagactatagatag

SEQ ID NO: 984438 - DNA, 22 bp, Artificial Sequence
  chemically synthesized
atcgccccattctatctatagt

SEQ ID NO: 984439 - DNA, 22 bp, Artificial Sequence
  chemically synthesized
aactgaaataataaagactata

SEQ ID NO: 984440 - DNA, 22 bp, Artificial Sequence
  chemically synthesized
ccctaaactgaaataataaaga

SEQ ID NO: 984441 - DNA, 22 bp, Artificial Sequence
  chemically synthesized
tatctatagtctttattatttc

SEQ ID NO: 984442 - DNA, 22 bp, Artificial Sequence
  chemically synthesized
tctatagtctttattatttcag

SEQ ID NO: 984443 - DNA, 22 bp, Artificial Sequence
  chemically synthesized
tagtctttattatttcagttta

SEQ ID NO: 984444 - DNA, 22 bp, Artificial Sequence
  chemically synthesized
gaagggataaagttgccctaaa

SEQ ID NO: 984445 - DNA, 22 bp, Artificial Sequence
  chemically synthesized
tattatttcagtttagggcaac

SEQ ID NO: 984446 - DNA, 22 bp, Artificial Sequence
  chemically synthesized
attatttcagtttagggcaact

SEQ ID NO: 984447 - DNA, 22 bp, Artificial Sequence
  chemically synthesized
ttatttcagtttagggcaactt

SEQ ID NO: 984448 - DNA, 22 bp, Artificial Sequence
  chemically synthesized
actggaagggataaagttgccc

SEQ ID NO: 984449 - DNA, 22 bp, Artificial Sequence
  chemically synthesized
tttcagtttagggcaactttat

SEQ ID NO: 984450 - DNA, 22 bp, Artificial Sequence
  chemically synthesized
attaactggaagggataaagtt

SEQ ID NO: 984451 - DNA, 22 bp, Artificial Sequence
  chemically synthesized
cagtttagggcaactttatccc

SEQ ID NO: 984452 - DNA, 22 bp, Artificial Sequence
  chemically synthesized
agtttagggcaactttatccct

SEQ ID NO: 984453 - DNA, 22 bp, Artificial Sequence
  chemically synthesized
tgattaactggaagggataaag

SEQ ID NO: 984454 - DNA, 22 bp, Artificial Sequence
  chemically synthesized
ctctgattaactggaagggata

SEQ ID NO: 984455 - DNA, 22 bp, Artificial Sequence
  chemically synthesized
gctctgattaactggaagggat

SEQ ID NO: 984456 - DNA, 22 bp, Artificial Sequence
  chemically synthesized
agggcaactttatcccttccag

SEQ ID NO: 984457 - DNA, 22 bp, Artificial Sequence
  chemically synthesized
tgctctgattaactggaaggga

SEQ ID NO: 984458 - DNA, 22 bp, Artificial Sequence
  chemically synthesized
gggcaactttatcccttccagt

SEQ ID NO: 984459 - DNA, 22 bp, Artificial Sequence
  chemically synthesized
ttgctctgattaactggaaggg

SEQ ID NO: 984460 - DNA, 22 bp, Artificial Sequence
  chemically synthesized
caacgtttttgctctgattaac

SEQ ID NO: 984461 - DNA, 22 bp, Artificial Sequence
  chemically synthesized
tatcccttccagttaatcagag

SEQ ID NO: 984462 - DNA, 22 bp, Artificial Sequence
  chemically synthesized
atcccttccagttaatcagagc

SEQ ID NO: 984463 - DNA, 22 bp, Artificial Sequence
  chemically synthesized
tcccttccagttaatcagagca

SEQ ID NO: 984464 - DNA, 22 bp, Artificial Sequence
  chemically synthesized
ccagttaatcagagcaaaaacg

SEQ ID NO: 984465 - DNA, 22 bp, Artificial Sequence
  chemically synthesized
cagttaatcagagcaaaaacgt

SEQ ID NO: 984466 - DNA, 22 bp, Artificial Sequence
  chemically synthesized
atcagagcaaaaacgttggagc

SEQ ID NO: 984467 - DNA, 22 bp, Artificial Sequence
  chemically synthesized
gagccattcatgactccatttt

SEQ ID NO: 984468 - DNA, 22 bp, Artificial Sequence
  chemically synthesized
gataaggggcatgggagaaaaa

SEQ ID NO: 984469 - DNA, 22 bp, Artificial Sequence
  chemically synthesized
atgactccatttttctcccatg

SEQ ID NO: 984470 - DNA, 22 bp, Artificial Sequence
  chemically synthesized
gatgaattggataaggggcatg

SEQ ID NO: 984471 - DNA, 22 bp, Artificial Sequence
  chemically synthesized
catttttctcccatgcccctta

SEQ ID NO: 984472 - DNA, 22 bp, Artificial Sequence
  chemically synthesized
tggatgaattggataaggggca

SEQ ID NO: 984473 - DNA, 22 bp, Artificial Sequence
  chemically synthesized
ctggatgaattggataaggggc

SEQ ID NO: 984474 - DNA, 22 bp, Artificial Sequence
  chemically synthesized
ttctcccatgccccttatccaa

SEQ ID NO: 984475 - DNA, 22 bp, Artificial Sequence
  chemically synthesized
tctcccatgccccttatccaat

SEQ ID NO: 984476 - DNA, 22 bp, Artificial Sequence
  chemically synthesized
ctcccatgccccttatccaatt

SEQ ID NO: 984477 - DNA, 22 bp, Artificial Sequence
  chemically synthesized
tcccatgccccttatccaattc

SEQ ID NO: 984478 - DNA, 22 bp, Artificial Sequence
  chemically synthesized
ccatgccccttatccaattcat

SEQ ID NO: 984479 - DNA, 22 bp, Artificial Sequence
  chemically synthesized
atccaattcatccagaaatcct

SEQ ID NO: 984480 - DNA, 22 bp, Artificial Sequence
  chemically synthesized
tccaattcatccagaaatcctt

SEQ ID NO: 984481 - DNA, 22 bp, Artificial Sequence
  chemically synthesized
gaagtggggccaacaaggattt

SEQ ID NO: 984482 - DNA, 22 bp, Artificial Sequence
  chemically synthesized
ggaagtggggccaacaaggatt

SEQ ID NO: 984483 - DNA, 22 bp, Artificial Sequence
  chemically synthesized
atccagaaatccttgttggccc

SEQ ID NO: 984484 - DNA, 22 bp, Artificial Sequence
  chemically synthesized
aacgtgtttggaagtggggcca

SEQ ID NO: 984485 - DNA, 22 bp, Artificial Sequence
  chemically synthesized
tgaacgtgtttggaagtggggc

SEQ ID NO: 984486 - DNA, 22 bp, Artificial Sequence
  chemically synthesized
gttggccccacttccaaacacg

SEQ ID NO: 984487 - DNA, 22 bp, Artificial Sequence
  chemically synthesized
ttggccccacttccaaacacgt

SEQ ID NO: 984488 - DNA, 22 bp, Artificial Sequence
  chemically synthesized
gccccacttccaaacacgttca

SEQ ID NO: 984489 - DNA, 22 bp, Artificial Sequence
  chemically synthesized
ccaaacacgttcagaatatgac

SEQ ID NO: 984490 - DNA, 22 bp, Artificial Sequence
  chemically synthesized
caaacacgttcagaatatgact

SEQ ID NO: 984491 - DNA, 22 bp, Artificial Sequence
  chemically synthesized
agaccagggtgataagaaatag

SEQ ID NO: 984492 - DNA, 22 bp, Artificial Sequence
  chemically synthesized
agaatatgactatttcttatca

SEQ ID NO: 984493 - DNA, 22 bp, Artificial Sequence
  chemically synthesized
actgagaccagggtgataagaa

SEQ ID NO: 984494 - DNA, 22 bp, Artificial Sequence
  chemically synthesized
tttcttatcaccctggtctcag

SEQ ID NO: 984495 - DNA, 22 bp, Artificial Sequence
  chemically synthesized
cttatcaccctggtctcagtca

SEQ ID NO: 984496 - DNA, 22 bp, Artificial Sequence
  chemically synthesized
ttatcaccctggtctcagtcag

SEQ ID NO: 984497 - DNA, 22 bp, Artificial Sequence
  chemically synthesized
atcaccctggtctcagtcagca

SEQ ID NO: 984498 - DNA, 22 bp, Artificial Sequence
  chemically synthesized
tcaccctggtctcagtcagcat

SEQ ID NO: 984499 - DNA, 22 bp, Artificial Sequence
  chemically synthesized
agtgtgagaagatgatgctgac

SEQ ID NO: 984500 - DNA, 22 bp, Artificial Sequence
  chemically synthesized
taagtgtgagaagatgatgctg

SEQ ID NO: 984501 - DNA, 22 bp, Artificial Sequence
  chemically synthesized
ctaagtgtgagaagatgatgct

SEQ ID NO: 984502 - DNA, 22 bp, Artificial Sequence
  chemically synthesized
tctaagtgtgagaagatgatgc

SEQ ID NO: 984503 - DNA, 22 bp, Artificial Sequence
  chemically synthesized
gtctcagtcagcatcatcttct

SEQ ID NO: 984504 - DNA, 22 bp, Artificial Sequence
  chemically synthesized
tttctaagtgtgagaagatgat

SEQ ID NO: 984505 - DNA, 22 bp, Artificial Sequence
  chemically synthesized
tctttctaagtgtgagaagatg

SEQ ID NO: 984506 - DNA, 22 bp, Artificial Sequence
  chemically synthesized
ctctttctaagtgtgagaagat

SEQ ID NO: 984507 - DNA, 22 bp, Artificial Sequence
  chemically synthesized
tctctttctaagtgtgagaaga

SEQ ID NO: 984508 - DNA, 22 bp, Artificial Sequence
  chemically synthesized
agtcagcatcatcttctcacac

SEQ ID NO: 984509 - DNA, 22 bp, Artificial Sequence
  chemically synthesized
ttctctttctaagtgtgagaag

SEQ ID NO: 984510 - DNA, 22 bp, Artificial Sequence
  chemically synthesized
taaggacgtttttctctttcta

SEQ ID NO: 984511 - DNA, 22 bp, Artificial Sequence
  chemically synthesized
ctcacacttagaaagagaaaaa

SEQ ID NO: 984512 - DNA, 22 bp, Artificial Sequence
  chemically synthesized
tcacacttagaaagagaaaaac

SEQ ID NO: 984513 - DNA, 22 bp, Artificial Sequence
  chemically synthesized
acacttagaaagagaaaaacgt

SEQ ID NO: 984514 - DNA, 22 bp, Artificial Sequence
  chemically synthesized
aagccattgtaaggacgttttt

SEQ ID NO: 984515 - DNA, 22 bp, Artificial Sequence
  chemically synthesized
gaagccattgtaaggacgtttt

SEQ ID NO: 984516 - DNA, 22 bp, Artificial Sequence
  chemically synthesized
tgaagccattgtaaggacgttt

SEQ ID NO: 984517 - DNA, 22 bp, Artificial Sequence
  chemically synthesized
agaaagagaaaaacgtccttac

SEQ ID NO: 984518 - DNA, 22 bp, Artificial Sequence
  chemically synthesized
gaaagagaaaaacgtccttaca

SEQ ID NO: 984519 - DNA, 22 bp, Artificial Sequence
  chemically synthesized
gtgaggtgagggtggacctttg

SEQ ID NO: 984520 - DNA, 22 bp, Artificial Sequence
  chemically synthesized
acaatggcttcaaaggtccacc

SEQ ID NO: 984521 - DNA, 22 bp, Artificial Sequence
  chemically synthesized
caatggcttcaaaggtccaccc

SEQ ID NO: 984522 - DNA, 22 bp, Artificial Sequence
  chemically synthesized
caaaggtccaccctcacctcac

SEQ ID NO: 984523 - DNA, 22 bp, Artificial Sequence
  chemically synthesized
aaaggtccaccctcacctcact

SEQ ID NO: 984524 - DNA, 22 bp, Artificial Sequence
  chemically synthesized
ggagagaatgttagtgaggtga

SEQ ID NO: 984525 - DNA, 22 bp, Artificial Sequence
  chemically synthesized
aggagagaatgttagtgaggtg

SEQ ID NO: 984526 - DNA, 22 bp, Artificial Sequence
  chemically synthesized
acctcactaacattctctccta

SEQ ID NO: 984527 - DNA, 22 bp, Artificial Sequence
  chemically synthesized
actaacattctctcctaaacct

SEQ ID NO: 984528 - DNA, 22 bp, Artificial Sequence
  chemically synthesized
acattctctcctaaacctctct

SEQ ID NO: 984529 - DNA, 22 bp, Artificial Sequence
  chemically synthesized
gagtgaagtaagtgagagaggt

SEQ ID NO: 984530 - DNA, 22 bp, Artificial Sequence
  chemically synthesized
tctcctaaacctctctcactta

SEQ ID NO: 984531 - DNA, 22 bp, Artificial Sequence
  chemically synthesized
tcctaaacctctctcacttact

SEQ ID NO: 984532 - DNA, 22 bp, Artificial Sequence
  chemically synthesized
ctaaacctctctcacttacttc

SEQ ID NO: 984533 - DNA, 22 bp, Artificial Sequence
  chemically synthesized
aacctctctcacttacttcact

SEQ ID NO: 984534 - DNA, 22 bp, Artificial Sequence
  chemically synthesized
cagtgtggctagagtgaagtaa

SEQ ID NO: 984535 - DNA, 22 bp, Artificial Sequence
  chemically synthesized
tctgcagtgtggctagagtgaa

SEQ ID NO: 984536 - DNA, 22 bp, Artificial Sequence
  chemically synthesized
tctcacttacttcactctagcc

SEQ ID NO: 984537 - DNA, 22 bp, Artificial Sequence
  chemically synthesized
tcacttacttcactctagccac

SEQ ID NO: 984538 - DNA, 22 bp, Artificial Sequence
  chemically synthesized
gttatctgcagtgtggctagag

SEQ ID NO: 984539 - DNA, 22 bp, Artificial Sequence
  chemically synthesized
acttacttcactctagccacac

SEQ ID NO: 984540 - DNA, 22 bp, Artificial Sequence
  chemically synthesized
acttcactctagccacactgca

SEQ ID NO: 984541 - DNA, 22 bp, Artificial Sequence
  chemically synthesized
gggctggttatctgcagtgtgg

SEQ ID NO: 984542 - DNA, 22 bp, Artificial Sequence
  chemically synthesized
cttcactctagccacactgcag

SEQ ID NO: 984543 - DNA, 22 bp, Artificial Sequence
  chemically synthesized
ggggctggttatctgcagtgtg

SEQ ID NO: 984544 - DNA, 22 bp, Artificial Sequence
  chemically synthesized
cactctagccacactgcagata

SEQ ID NO: 984545 - DNA, 22 bp, Artificial Sequence
  chemically synthesized
tttggggctggttatctgcagt

SEQ ID NO: 984546 - DNA, 22 bp, Artificial Sequence
  chemically synthesized
actctagccacactgcagataa

SEQ ID NO: 984547 - DNA, 22 bp, Artificial Sequence
  chemically synthesized
ctgtttggggctggttatctgc

SEQ ID NO: 984548 - DNA, 22 bp, Artificial Sequence
  chemically synthesized
tagccacactgcagataaccag

SEQ ID NO: 984549 - DNA, 22 bp, Artificial Sequence
  chemically synthesized
gccacactgcagataaccagcc

SEQ ID NO: 984550 - DNA, 22 bp, Artificial Sequence
  chemically synthesized
tctgctgtttggggctggttat

SEQ ID NO: 984551 - DNA, 22 bp, Artificial Sequence
  chemically synthesized
atctgctgtttggggctggtta

SEQ ID NO: 984552 - DNA, 22 bp, Artificial Sequence
  chemically synthesized
cagataaccagccccaaacagc

SEQ ID NO: 984553 - DNA, 22 bp, Artificial Sequence
  chemically synthesized
agccatcggtttatctgctgtt

SEQ ID NO: 984554 - DNA, 22 bp, Artificial Sequence
  chemically synthesized
ctaagccatcggtttatctgct

SEQ ID NO: 984555 - DNA, 22 bp, Artificial Sequence
  chemically synthesized
agtaaacagtcaatgcagaatt

SEQ ID NO: 984556 - DNA, 22 bp, Artificial Sequence
  chemically synthesized
ggttcagtaaacagtcaatgca

SEQ ID NO: 984557 - DNA, 22 bp, Artificial Sequence
  chemically synthesized
gggttcagtaaacagtcaatgc

SEQ ID NO: 984558 - DNA, 22 bp, Artificial Sequence
  chemically synthesized
tgggttcagtaaacagtcaatg

SEQ ID NO: 984559 - DNA, 22 bp, Artificial Sequence
  chemically synthesized
aggaattctgcattgactgttt

SEQ ID NO: 984560 - DNA, 22 bp, Artificial Sequence
  chemically synthesized
ggaattctgcattgactgttta

SEQ ID NO: 984561 - DNA, 22 bp, Artificial Sequence
  chemically synthesized
attttgggttcagtaaacagtc

SEQ ID NO: 984562 - DNA, 22 bp, Artificial Sequence
  chemically synthesized
tgcattgactgtttactgaacc

SEQ ID NO: 984563 - DNA, 22 bp, Artificial Sequence
  chemically synthesized
cattgactgtttactgaaccca

SEQ ID NO: 984564 - DNA, 22 bp, Artificial Sequence
  chemically synthesized
actgtttactgaacccaaaatg

SEQ ID NO: 984565 - DNA, 22 bp, Artificial Sequence
  chemically synthesized
tttactgaacccaaaatgagtt

SEQ ID NO: 984566 - DNA, 22 bp, Artificial Sequence
  chemically synthesized
actgaacccaaaatgagtttac

SEQ ID NO: 984567 - DNA, 22 bp, Artificial Sequence
  chemically synthesized
ctgaacccaaaatgagtttact

SEQ ID NO: 984568 - DNA, 22 bp, Artificial Sequence
  chemically synthesized
aacccaaaatgagtttactgct

SEQ ID NO: 984569 - DNA, 22 bp, Artificial Sequence
  chemically synthesized
aatcatgtagatatcagcagta

SEQ ID NO: 984570 - DNA, 22 bp, Artificial Sequence
  chemically synthesized
actgctgatatctacatgattc

SEQ ID NO: 984571 - DNA, 22 bp, Artificial Sequence
  chemically synthesized
ctgctgatatctacatgattca

SEQ ID NO: 984572 - DNA, 22 bp, Artificial Sequence
  chemically synthesized
ctgatatctacatgattcaacc

SEQ ID NO: 984573 - DNA, 22 bp, Artificial Sequence
  chemically synthesized
atatctacatgattcaacccca

SEQ ID NO: 984574 - DNA, 22 bp, Artificial Sequence
  chemically synthesized
aaagaatgaggcatggggttga

SEQ ID NO: 984575 - DNA, 22 bp, Artificial Sequence
  chemically synthesized
catgattcaaccccatgcctca

SEQ ID NO: 984576 - DNA, 22 bp, Artificial Sequence
  chemically synthesized
agcaaagatctcaaagaatgag

SEQ ID NO: 984577 - DNA, 22 bp, Artificial Sequence
  chemically synthesized
gagcaaagatctcaaagaatga

SEQ ID NO: 984578 - DNA, 22 bp, Artificial Sequence
  chemically synthesized
aaccccatgcctcattctttga

SEQ ID NO: 984579 - DNA, 22 bp, Artificial Sequence
  chemically synthesized
attctttgagatctttgctcaa

SEQ ID NO: 984580 - DNA, 22 bp, Artificial Sequence
  chemically synthesized
agaaggtgacatttgagcaaag

SEQ ID NO: 984581 - DNA, 22 bp, Artificial Sequence
  chemically synthesized
tttgagatctttgctcaaatgt

SEQ ID NO: 984582 - DNA, 22 bp, Artificial Sequence
  chemically synthesized
attgagaaggtgacatttgagc

SEQ ID NO: 984583 - DNA, 22 bp, Artificial Sequence
  chemically synthesized
cattgagaaggtgacatttgag

SEQ ID NO: 984584 - DNA, 22 bp, Artificial Sequence
  chemically synthesized
tgagatctttgctcaaatgtca

SEQ ID NO: 984585 - DNA, 22 bp, Artificial Sequence
  chemically synthesized
gagatctttgctcaaatgtcac

SEQ ID NO: 984586 - DNA, 22 bp, Artificial Sequence
  chemically synthesized
ttcattgagaaggtgacatttg

SEQ ID NO: 984587 - DNA, 22 bp, Artificial Sequence
  chemically synthesized
agatctttgctcaaatgtcacc

SEQ ID NO: 984588 - DNA, 22 bp, Artificial Sequence
  chemically synthesized
tgctcaaatgtcaccttctcaa

SEQ ID NO: 984589 - DNA, 22 bp, Artificial Sequence
  chemically synthesized
gctcaaatgtcaccttctcaat

SEQ ID NO: 984590 - DNA, 22 bp, Artificial Sequence
  chemically synthesized
ctcaaatgtcaccttctcaatg

SEQ ID NO: 984591 - DNA, 22 bp, Artificial Sequence
  chemically synthesized
aaatgtcaccttctcaatgaag

SEQ ID NO: 984592 - DNA, 22 bp, Artificial Sequence
  chemically synthesized
aatagggtatcatggtattctt

SEQ ID NO: 984593 - DNA, 22 bp, Artificial Sequence
  chemically synthesized
aaatagggtatcatggtattct

SEQ ID NO: 984594 - DNA, 22 bp, Artificial Sequence
  chemically synthesized
taaatagggtatcatggtattc

SEQ ID NO: 984595 - DNA, 22 bp, Artificial Sequence
  chemically synthesized
ctcaatgaagaataccatgata

SEQ ID NO: 984596 - DNA, 22 bp, Artificial Sequence
  chemically synthesized
tcaatgaagaataccatgatac

SEQ ID NO: 984597 - DNA, 22 bp, Artificial Sequence
  chemically synthesized
aatgaagaataccatgataccc

SEQ ID NO: 984598 - DNA, 22 bp, Artificial Sequence
  chemically synthesized
caattttaaatagggtatcatg

SEQ ID NO: 984599 - DNA, 22 bp, Artificial Sequence
  chemically synthesized
gagtacattccaattttaaata

SEQ ID NO: 984600 - DNA, 22 bp, Artificial Sequence
  chemically synthesized
atgctggagtacattccaattt

SEQ ID NO: 984601 - DNA, 22 bp, Artificial Sequence
  chemically synthesized
tttaaaattggaatgtactcca

SEQ ID NO: 984602 - DNA, 22 bp, Artificial Sequence
  chemically synthesized
aaaattggaatgtactccagca

SEQ ID NO: 984603 - DNA, 22 bp, Artificial Sequence
  chemically synthesized
aaattggaatgtactccagcat

SEQ ID NO: 984604 - DNA, 22 bp, Artificial Sequence
  chemically synthesized
gaatgtactccagcatgagcca

SEQ ID NO: 984605 - DNA, 22 bp, Artificial Sequence
  chemically synthesized
cagcatgagccatctcttattt

SEQ ID NO: 984606 - DNA, 22 bp, Artificial Sequence
  chemically synthesized
tgaaaaaaaagaagaagggtaa

SEQ ID NO: 984607 - DNA, 22 bp, Artificial Sequence
  chemically synthesized
ttattttacccttcttcttttt

SEQ ID NO: 984608 - DNA, 22 bp, Artificial Sequence
  chemically synthesized
attttacccttcttcttttttt

SEQ ID NO: 984609 - DNA, 22 bp, Artificial Sequence
  chemically synthesized
ttttacccttcttctttttttt

SEQ ID NO: 984610 - DNA, 22 bp, Artificial Sequence
  chemically synthesized
tacccttcttcttttttttcac

SEQ ID NO: 984611 - DNA, 22 bp, Artificial Sequence
  chemically synthesized
acccttcttcttttttttcaca

SEQ ID NO: 984612 - DNA, 22 bp, Artificial Sequence
  chemically synthesized
cccttcttcttttttttcacag

SEQ ID NO: 984613 - DNA, 22 bp, Artificial Sequence
  chemically synthesized
aaaagtgataagtgctgtgaaa

SEQ ID NO: 984614 - DNA, 22 bp, Artificial Sequence
  chemically synthesized
cttcttttttttcacagcactt

SEQ ID NO: 984615 - DNA, 22 bp, Artificial Sequence
  chemically synthesized
ttcttttttttcacagcactta

SEQ ID NO: 984616 - DNA, 22 bp, Artificial Sequence
  chemically synthesized
cttttttttcacagcacttatc

SEQ ID NO: 984617 - DNA, 22 bp, Artificial Sequence
  chemically synthesized
ttttttttcacagcacttatca

SEQ ID NO: 984618 - DNA, 22 bp, Artificial Sequence
  chemically synthesized
ttttttcacagcacttatcact

SEQ ID NO: 984619 - DNA, 22 bp, Artificial Sequence
  chemically synthesized
tttttcacagcacttatcactt

SEQ ID NO: 984620 - DNA, 22 bp, Artificial Sequence
  chemically synthesized
ttttcacagcacttatcacttt

SEQ ID NO: 984621 - DNA, 22 bp, Artificial Sequence
  chemically synthesized
tttcacagcacttatcactttt

SEQ ID NO: 984622 - DNA, 22 bp, Artificial Sequence
  chemically synthesized
tatagtatgttcaaaagtgata

SEQ ID NO: 984623 - DNA, 22 bp, Artificial Sequence
  chemically synthesized
ttcacagcacttatcacttttg

SEQ ID NO: 984624 - DNA, 22 bp, Artificial Sequence
  chemically synthesized
tcacagcacttatcacttttga

SEQ ID NO: 984625 - DNA, 22 bp, Artificial Sequence
  chemically synthesized
cacagcacttatcacttttgaa

SEQ ID NO: 984626 - DNA, 22 bp, Artificial Sequence
  chemically synthesized
acagcacttatcacttttgaac

SEQ ID NO: 984627 - DNA, 22 bp, Artificial Sequence
  chemically synthesized
atcacttttgaacatactatac

SEQ ID NO: 984628 - DNA, 22 bp, Artificial Sequence
  chemically synthesized
tcacttttgaacatactataca

SEQ ID NO: 984629 - DNA, 22 bp, Artificial Sequence
  chemically synthesized
ttgaacatactatacaatatac

SEQ ID NO: 984630 - DNA, 22 bp, Artificial Sequence
  chemically synthesized
tgaacatactatacaatatact

SEQ ID NO: 984631 - DNA, 22 bp, Artificial Sequence
  chemically synthesized
gaacatactatacaatatactt

SEQ ID NO: 984632 - DNA, 22 bp, Artificial Sequence
  chemically synthesized
aacatactatacaatatactta

SEQ ID NO: 984633 - DNA, 22 bp, Artificial Sequence
  chemically synthesized
tacaatatacttatcgtatctg

SEQ ID NO: 984634 - DNA, 22 bp, Artificial Sequence
  chemically synthesized
aaatagtgaaagacagatacga

SEQ ID NO: 984635 - DNA, 22 bp, Artificial Sequence
  chemically synthesized
ggggtctcaaatagtgaaagac

SEQ ID NO: 984636 - DNA, 22 bp, Artificial Sequence
  chemically synthesized
gggggtctcaaatagtgaaaga

SEQ ID NO: 984637 - DNA, 22 bp, Artificial Sequence
  chemically synthesized
atcgtatctgtctttcactatt

SEQ ID NO: 984638 - DNA, 22 bp, Artificial Sequence
  chemically synthesized
ttgggggtctcaaatagtgaaa

SEQ ID NO: 984639 - DNA, 22 bp, Artificial Sequence
  chemically synthesized
tcgtatctgtctttcactattt

SEQ ID NO: 984640 - DNA, 22 bp, Artificial Sequence
  chemically synthesized
gattcttgggggtctcaaatag

SEQ ID NO: 984641 - DNA, 22 bp, Artificial Sequence
  chemically synthesized
tggattcttgggggtctcaaat

SEQ ID NO: 984642 - DNA, 22 bp, Artificial Sequence
  chemically synthesized
tctttcactatttgagaccccc

SEQ ID NO: 984643 - DNA, 22 bp, Artificial Sequence
  chemically synthesized
tcactatttgagacccccaaga

SEQ ID NO: 984644 - DNA, 22 bp, Artificial Sequence
  chemically synthesized
cactatttgagacccccaagaa

SEQ ID NO: 984645 - DNA, 22 bp, Artificial Sequence
  chemically synthesized
actatttgagacccccaagaat

SEQ ID NO: 984646 - DNA, 22 bp, Artificial Sequence
  chemically synthesized
tttgagacccccaagaatccag

SEQ ID NO: 984647 - DNA, 22 bp, Artificial Sequence
  chemically synthesized
gagacccccaagaatccagagg

SEQ ID NO: 984648 - DNA, 22 bp, Artificial Sequence
  chemically synthesized
agacccccaagaatccagaggg

SEQ ID NO: 984649 - DNA, 22 bp, Artificial Sequence
  chemically synthesized
aatgtgtcagtgaacaaagcag

SEQ ID NO: 984650 - DNA, 22 bp, Artificial Sequence
  chemically synthesized
gaatgtgtcagtgaacaaagca

SEQ ID NO: 984651 - DNA, 22 bp, Artificial Sequence
  chemically synthesized
tgaatgtgtcagtgaacaaagc

SEQ ID NO: 984652 - DNA, 22 bp, Artificial Sequence
  chemically synthesized
ttctgctttgttcactgacaca

SEQ ID NO: 984653 - DNA, 22 bp, Artificial Sequence
  chemically synthesized
tctgctttgttcactgacacat

SEQ ID NO: 984654 - DNA, 22 bp, Artificial Sequence
  chemically synthesized
tagatgttttgaatgtgtcagt

SEQ ID NO: 984655 - DNA, 22 bp, Artificial Sequence
  chemically synthesized
ctgctttgttcactgacacatt

SEQ ID NO: 984656 - DNA, 22 bp, Artificial Sequence
  chemically synthesized
tgctttgttcactgacacattc

SEQ ID NO: 984657 - DNA, 22 bp, Artificial Sequence
  chemically synthesized
ctgtagatgttttgaatgtgtc

SEQ ID NO: 984658 - DNA, 22 bp, Artificial Sequence
  chemically synthesized
ctttgttcactgacacattcaa

SEQ ID NO: 984659 - DNA, 22 bp, Artificial Sequence
  chemically synthesized
tgttcactgacacattcaaaac

SEQ ID NO: 984660 - DNA, 22 bp, Artificial Sequence
  chemically synthesized
gttcactgacacattcaaaaca

SEQ ID NO: 984661 - DNA, 22 bp, Artificial Sequence
  chemically synthesized
ttcactgacacattcaaaacat

SEQ ID NO: 984662 - DNA, 22 bp, Artificial Sequence
  chemically synthesized
actgacacattcaaaacatcta

SEQ ID NO: 984663 - DNA, 22 bp, Artificial Sequence
  chemically synthesized
acacattcaaaacatctacagt

SEQ ID NO: 984664 - DNA, 22 bp, Artificial Sequence
  chemically synthesized
aaaacatctacagtagtggctg

SEQ ID NO: 984665 - DNA, 22 bp, Artificial Sequence
  chemically synthesized
agccaccaccatatgtcagcca

SEQ ID NO: 984666 - DNA, 22 bp, Artificial Sequence
  chemically synthesized
ttgagccaccaccatatgtcag

SEQ ID NO: 984667 - DNA, 22 bp, Artificial Sequence
  chemically synthesized
attgagccaccaccatatgtca

SEQ ID NO: 984668 - DNA, 22 bp, Artificial Sequence
  chemically synthesized
cagtagtggctgacatatggtg

SEQ ID NO: 984669 - DNA, 22 bp, Artificial Sequence
  chemically synthesized
aaaaatacttattgagccacca

SEQ ID NO: 984670 - DNA, 22 bp, Artificial Sequence
  chemically synthesized
gaaaaatacttattgagccacc

SEQ ID NO: 984671 - DNA, 22 bp, Artificial Sequence
  chemically synthesized
acatatggtggtggctcaataa

SEQ ID NO: 984672 - DNA, 22 bp, Artificial Sequence
  chemically synthesized
atttgaaaaatacttattgagc

SEQ ID NO: 984673 - DNA, 22 bp, Artificial Sequence
  chemically synthesized
gcatcaggttaatttgaaaaat

SEQ ID NO: 984674 - DNA, 22 bp, Artificial Sequence
  chemically synthesized
agcatcaggttaatttgaaaaa

SEQ ID NO: 984675 - DNA, 22 bp, Artificial Sequence
  chemically synthesized
aataagtatttttcaaattaac

SEQ ID NO: 984676 - DNA, 22 bp, Artificial Sequence
  chemically synthesized
gacttagcatcaggttaatttg

SEQ ID NO: 984677 - DNA, 22 bp, Artificial Sequence
  chemically synthesized
tggacttagcatcaggttaatt

SEQ ID NO: 984678 - DNA, 22 bp, Artificial Sequence
  chemically synthesized
aaagttctggacttagcatcag

SEQ ID NO: 984679 - DNA, 22 bp, Artificial Sequence
  chemically synthesized
ttcaaattaacctgatgctaag

SEQ ID NO: 984680 - DNA, 22 bp, Artificial Sequence
  chemically synthesized
tcaaattaacctgatgctaagt

SEQ ID NO: 984681 - DNA, 22 bp, Artificial Sequence
  chemically synthesized
caaattaacctgatgctaagtc

SEQ ID NO: 984682 - DNA, 22 bp, Artificial Sequence
  chemically synthesized
aaattaacctgatgctaagtcc

SEQ ID NO: 984683 - DNA, 22 bp, Artificial Sequence
  chemically synthesized
ggcagttgaaagttctggactt

SEQ ID NO: 984684 - DNA, 22 bp, Artificial Sequence
  chemically synthesized
acctgatgctaagtccagaact

SEQ ID NO: 984685 - DNA, 22 bp, Artificial Sequence
  chemically synthesized
tgactgggcagttgaaagttct

SEQ ID NO: 984686 - DNA, 22 bp, Artificial Sequence
  chemically synthesized
atgctaagtccagaactttcaa

SEQ ID NO: 984687 - DNA, 22 bp, Artificial Sequence
  chemically synthesized
tgtgactgggcagttgaaagtt

SEQ ID NO: 984688 - DNA, 22 bp, Artificial Sequence
  chemically synthesized
gctctgtgactgggcagttgaa

SEQ ID NO: 984689 - DNA, 22 bp, Artificial Sequence
  chemically synthesized
agtccagaactttcaactgccc

SEQ ID NO: 984690 - DNA, 22 bp, Artificial Sequence
  chemically synthesized
aagctagctctgtgactgggca

SEQ ID NO: 984691 - DNA, 22 bp, Artificial Sequence
  chemically synthesized
tcaactgcccagtcacagagct

SEQ ID NO: 984692 - DNA, 22 bp, Artificial Sequence
  chemically synthesized
caactgcccagtcacagagcta

SEQ ID NO: 984693 - DNA, 22 bp, Artificial Sequence
  chemically synthesized
aactgcccagtcacagagctag

SEQ ID NO: 984694 - DNA, 22 bp, Artificial Sequence
  chemically synthesized
aatgccctgaagctagctctgt

SEQ ID NO: 984695 - DNA, 22 bp, Artificial Sequence
  chemically synthesized
aaatgccctgaagctagctctg

SEQ ID NO: 984696 - DNA, 22 bp, Artificial Sequence
  chemically synthesized
taaatgccctgaagctagctct

SEQ ID NO: 984697 - DNA, 22 bp, Artificial Sequence
  chemically synthesized
tttaaatgccctgaagctagct

SEQ ID NO: 984698 - DNA, 22 bp, Artificial Sequence
  chemically synthesized
cccagtcacagagctagcttca

SEQ ID NO: 984699 - DNA, 22 bp, Artificial Sequence
  chemically synthesized
agttctttaaatgccctgaagc

SEQ ID NO: 984700 - DNA, 22 bp, Artificial Sequence
  chemically synthesized
ttcagttctttaaatgccctga

SEQ ID NO: 984701 - DNA, 22 bp, Artificial Sequence
  chemically synthesized
gttcagttctttaaatgccctg

SEQ ID NO: 984702 - DNA, 22 bp, Artificial Sequence
  chemically synthesized
tttgttcagttctttaaatgcc

SEQ ID NO: 984703 - DNA, 22 bp, Artificial Sequence
  chemically synthesized
tctgtttgttcagttctttaaa

SEQ ID NO: 984704 - DNA, 22 bp, Artificial Sequence
  chemically synthesized
gcttcagggcatttaaagaact

SEQ ID NO: 984705 - DNA, 22 bp, Artificial Sequence
  chemically synthesized
cagggcatttaaagaactgaac

SEQ ID NO: 984706 - DNA, 22 bp, Artificial Sequence
  chemically synthesized
cattatctgtttgttcagttct

SEQ ID NO: 984707 - DNA, 22 bp, Artificial Sequence
  chemically synthesized
agggcatttaaagaactgaaca

SEQ ID NO: 984708 - DNA, 22 bp, Artificial Sequence
  chemically synthesized
ccattatctgtttgttcagttc

SEQ ID NO: 984709 - DNA, 22 bp, Artificial Sequence
  chemically synthesized
aaagaactgaacaaacagataa

SEQ ID NO: 984710 - DNA, 22 bp, Artificial Sequence
  chemically synthesized
aagaactgaacaaacagataat

SEQ ID NO: 984711 - DNA, 22 bp, Artificial Sequence
  chemically synthesized
catgaacccacttccattatct

SEQ ID NO: 984712 - DNA, 22 bp, Artificial Sequence
  chemically synthesized
tctacatgaacccacttccatt

SEQ ID NO: 984713 - DNA, 22 bp, Artificial Sequence
  chemically synthesized
aacaaacagataatggaagtgg

SEQ ID NO: 984714 - DNA, 22 bp, Artificial Sequence
  chemically synthesized
tatctacatgaacccacttcca

SEQ ID NO: 984715 - DNA, 22 bp, Artificial Sequence
  chemically synthesized
tctatctacatgaacccacttc

SEQ ID NO: 984716 - DNA, 22 bp, Artificial Sequence
  chemically synthesized
ctctatctacatgaacccactt

SEQ ID NO: 984717 - DNA, 22 bp, Artificial Sequence
  chemically synthesized
ttctctatctacatgaacccac

SEQ ID NO: 984718 - DNA, 22 bp, Artificial Sequence
  chemically synthesized
cttctctatctacatgaaccca

SEQ ID NO: 984719 - DNA, 22 bp, Artificial Sequence
  chemically synthesized
atttcttctctatctacatgaa

SEQ ID NO: 984720 - DNA, 22 bp, Artificial Sequence
  chemically synthesized
aatttcttctctatctacatga

SEQ ID NO: 984721 - DNA, 22 bp, Artificial Sequence
  chemically synthesized
taatttcttctctatctacatg

SEQ ID NO: 984722 - DNA, 22 bp, Artificial Sequence
  chemically synthesized
ttaatttcttctctatctacat

SEQ ID NO: 984723 - DNA, 22 bp, Artificial Sequence
  chemically synthesized
ttttaatttcttctctatctac

SEQ ID NO: 984724 - DNA, 22 bp, Artificial Sequence
  chemically synthesized
atgtagatagagaagaaattaa

SEQ ID NO: 984725 - DNA, 22 bp, Artificial Sequence
  chemically synthesized
catgagaatgagaattctttta

SEQ ID NO: 984726 - DNA, 22 bp, Artificial Sequence
  chemically synthesized
tacatgagaatgagaattcttt

SEQ ID NO: 984727 - DNA, 22 bp, Artificial Sequence
  chemically synthesized
attctacatgagaatgagaatt

SEQ ID NO: 984728 - DNA, 22 bp, Artificial Sequence
  chemically synthesized
tcattctacatgagaatgagaa

SEQ ID NO: 984729 - DNA, 22 bp, Artificial Sequence
  chemically synthesized
ctcattctacatgagaatgaga

SEQ ID NO: 984730 - DNA, 22 bp, Artificial Sequence
  chemically synthesized
tcttctcattctacatgagaat

SEQ ID NO: 984731 - DNA, 22 bp, Artificial Sequence
  chemically synthesized
aaagaattctcattctcatgta

SEQ ID NO: 984732 - DNA, 22 bp, Artificial Sequence
  chemically synthesized
cccattgtcttctcattctaca

SEQ ID NO: 984733 - DNA, 22 bp, Artificial Sequence
  chemically synthesized
tcattctcatgtagaatgagaa

SEQ ID NO: 984734 - DNA, 22 bp, Artificial Sequence
  chemically synthesized
ttccccattgtcttctcattct

SEQ ID NO: 984735 - DNA, 22 bp, Artificial Sequence
  chemically synthesized
attctcatgtagaatgagaaga

SEQ ID NO: 984736 - DNA, 22 bp, Artificial Sequence
  chemically synthesized
tcatgtagaatgagaagacaat

SEQ ID NO: 984737 - DNA, 22 bp, Artificial Sequence
  chemically synthesized
atgtagaatgagaagacaatgg

SEQ ID NO: 984738 - DNA, 22 bp, Artificial Sequence
  chemically synthesized
cagtagaaaaaaaaaggacatg

SEQ ID NO: 984739 - DNA, 22 bp, Artificial Sequence
  chemically synthesized
cctgcagtagaaaaaaaaagga

SEQ ID NO: 984740 - DNA, 22 bp, Artificial Sequence
  chemically synthesized
gcctgcagtagaaaaaaaaagg

SEQ ID NO: 984741 - DNA, 22 bp, Artificial Sequence
  chemically synthesized
tgccttgcctgcagtagaaaaa

SEQ ID NO: 984742 - DNA, 22 bp, Artificial Sequence
  chemically synthesized
tgtgccttgcctgcagtagaaa

SEQ ID NO: 984743 - DNA, 22 bp, Artificial Sequence
  chemically synthesized
ctgtgccttgcctgcagtagaa

SEQ ID NO: 984744 - DNA, 22 bp, Artificial Sequence
  chemically synthesized
tttttttctactgcaggcaagg

SEQ ID NO: 984745 - DNA, 22 bp, Artificial Sequence
  chemically synthesized
ttttttctactgcaggcaaggc

SEQ ID NO: 984746 - DNA, 22 bp, Artificial Sequence
  chemically synthesized
tttttctactgcaggcaaggca

SEQ ID NO: 984747 - DNA, 22 bp, Artificial Sequence
  chemically synthesized
ttttctactgcaggcaaggcac

SEQ ID NO: 984748 - DNA, 22 bp, Artificial Sequence
  chemically synthesized
tttctactgcaggcaaggcaca

SEQ ID NO: 984749 - DNA, 22 bp, Artificial Sequence
  chemically synthesized
catccccgcttctgtgccttgc

SEQ ID NO: 984750 - DNA, 22 bp, Artificial Sequence
  chemically synthesized
ttctactgcaggcaaggcacag

SEQ ID NO: 984751 - DNA, 22 bp, Artificial Sequence
  chemically synthesized
acatccccgcttctgtgccttg

SEQ ID NO: 984752 - DNA, 22 bp, Artificial Sequence
  chemically synthesized
tctactgcaggcaaggcacaga

SEQ ID NO: 984753 - DNA, 22 bp, Artificial Sequence
  chemically synthesized
ctactgcaggcaaggcacagaa

SEQ ID NO: 984754 - DNA, 22 bp, Artificial Sequence
  chemically synthesized
tactgcaggcaaggcacagaag

SEQ ID NO: 984755 - DNA, 22 bp, Artificial Sequence
  chemically synthesized
tttacatccccgcttctgtgcc

SEQ ID NO: 984756 - DNA, 22 bp, Artificial Sequence
  chemically synthesized
gtttacatccccgcttctgtgc

SEQ ID NO: 984757 - DNA, 22 bp, Artificial Sequence
  chemically synthesized
ctgcaggcaaggcacagaagcg

SEQ ID NO: 984758 - DNA, 22 bp, Artificial Sequence
  chemically synthesized
tgtttacatccccgcttctgtg

SEQ ID NO: 984759 - DNA, 22 bp, Artificial Sequence
  chemically synthesized
caggcaaggcacagaagcgggg

SEQ ID NO: 984760 - DNA, 22 bp, Artificial Sequence
  chemically synthesized
ctttgtttacatccccgcttct

SEQ ID NO: 984761 - DNA, 22 bp, Artificial Sequence
  chemically synthesized
acggatgtctcctttgtttaca

SEQ ID NO: 984762 - DNA, 22 bp, Artificial Sequence
  chemically synthesized
cacggatgtctcctttgtttac

SEQ ID NO: 984763 - DNA, 22 bp, Artificial Sequence
  chemically synthesized
gcatcttcacggatgtctcctt

SEQ ID NO: 984764 - DNA, 22 bp, Artificial Sequence
  chemically synthesized
tattagcatcttcacggatgtc

SEQ ID NO: 984765 - DNA, 22 bp, Artificial Sequence
  chemically synthesized
tgaaaacctatattagcatctt

SEQ ID NO: 984766 - DNA, 22 bp, Artificial Sequence
  chemically synthesized
gaattgtgaaaacctatattag

SEQ ID NO: 984767 - DNA, 22 bp, Artificial Sequence
  chemically synthesized
agaattgtgaaaacctatatta

SEQ ID NO: 984768 - DNA, 22 bp, Artificial Sequence
  chemically synthesized
tagaattgtgaaaacctatatt

SEQ ID NO: 984769 - DNA, 22 bp, Artificial Sequence
  chemically synthesized
ttagaattgtgaaaacctatat

SEQ ID NO: 984770 - DNA, 22 bp, Artificial Sequence
  chemically synthesized
tttagaattgtgaaaacctata

SEQ ID NO: 984771 - DNA, 22 bp, Artificial Sequence
  chemically synthesized
ttttagaattgtgaaaacctat

SEQ ID NO: 984772 - DNA, 22 bp, Artificial Sequence
  chemically synthesized
tttttagaattgtgaaaaccta

SEQ ID NO: 984773 - DNA, 22 bp, Artificial Sequence
  chemically synthesized
ttttttagaattgtgaaaacct

SEQ ID NO: 984774 - DNA, 22 bp, Artificial Sequence
  chemically synthesized
tcttttttttagaattgtgaaa

SEQ ID NO: 984775 - DNA, 22 bp, Artificial Sequence
  chemically synthesized
atcttttttttagaattgtgaa

SEQ ID NO: 984776 - DNA, 22 bp, Artificial Sequence
  chemically synthesized
tatcttttttttagaattgtga

SEQ ID NO: 984777 - DNA, 22 bp, Artificial Sequence
  chemically synthesized
atataggttttcacaattctaa

SEQ ID NO: 984778 - DNA, 22 bp, Artificial Sequence
  chemically synthesized
ttttatcttttttttagaattg

SEQ ID NO: 984779 - DNA, 22 bp, Artificial Sequence
  chemically synthesized
attttatcttttttttagaatt

SEQ ID NO: 984780 - DNA, 22 bp, Artificial Sequence
  chemically synthesized
tcacaattctaaaaaaaagata

SEQ ID NO: 984781 - DNA, 22 bp, Artificial Sequence
  chemically synthesized
cacaattctaaaaaaaagataa

SEQ ID NO: 984782 - DNA, 22 bp, Artificial Sequence
  chemically synthesized
acaattctaaaaaaaagataaa

SEQ ID NO: 984783 - DNA, 22 bp, Artificial Sequence
  chemically synthesized
aacacatagtttattttatctt

SEQ ID NO: 984784 - DNA, 22 bp, Artificial Sequence
  chemically synthesized
taaaaaaaagataaaataaact

SEQ ID NO: 984785 - DNA, 22 bp, Artificial Sequence
  chemically synthesized
aaaaaaagataaaataaactat

SEQ ID NO: 984786 - DNA, 22 bp, Artificial Sequence
  chemically synthesized
aaaccatgtcaccgttaaacac

SEQ ID NO: 984787 - DNA, 22 bp, Artificial Sequence
  chemically synthesized
aaaaccatgtcaccgttaaaca

SEQ ID NO: 984788 - DNA, 22 bp, Artificial Sequence
  chemically synthesized
taaaaccatgtcaccgttaaac

SEQ ID NO: 984789 - DNA, 22 bp, Artificial Sequence
  chemically synthesized
tttaaaaccatgtcaccgttaa

SEQ ID NO: 984790 - DNA, 22 bp, Artificial Sequence
  chemically synthesized
tgtgtttaacggtgacatggtt

SEQ ID NO: 984791 - DNA, 22 bp, Artificial Sequence
  chemically synthesized
agcaactctttaaaaccatgtc

SEQ ID NO: 984792 - DNA, 22 bp, Artificial Sequence
  chemically synthesized
aacggtgacatggttttaaaga

SEQ ID NO: 984793 - DNA, 22 bp, Artificial Sequence
  chemically synthesized
acggtgacatggttttaaagag

SEQ ID NO: 984794 - DNA, 22 bp, Artificial Sequence
  chemically synthesized
atcattcagcaactctttaaaa

SEQ ID NO: 984795 - DNA, 22 bp, Artificial Sequence
  chemically synthesized
taaagagttgctgaatgatcag

SEQ ID NO: 984796 - DNA, 22 bp, Artificial Sequence
  chemically synthesized
aaagagttgctgaatgatcagt

SEQ ID NO: 984797 - DNA, 22 bp, Artificial Sequence
  chemically synthesized
aagagttgctgaatgatcagtc

SEQ ID NO: 984798 - DNA, 22 bp, Artificial Sequence
  chemically synthesized
ctgaatgatcagtctccctttc

SEQ ID NO: 984799 - DNA, 22 bp, Artificial Sequence
  chemically synthesized
gaagaaagaaaaggaaagggag

SEQ ID NO: 984800 - DNA, 22 bp, Artificial Sequence
  chemically synthesized
aatgatcagtctccctttcctt

SEQ ID NO: 984801 - DNA, 22 bp, Artificial Sequence
  chemically synthesized
cctttccttttctttcttccag

SEQ ID NO: 984802 - DNA, 22 bp, Artificial Sequence
  chemically synthesized
aaataatatagcgctggaagaa

SEQ ID NO: 984803 - DNA, 22 bp, Artificial Sequence
  chemically synthesized
gaaataatatagcgctggaaga

SEQ ID NO: 984804 - DNA, 22 bp, Artificial Sequence
  chemically synthesized
tgaaataatatagcgctggaag

SEQ ID NO: 984805 - DNA, 22 bp, Artificial Sequence
  chemically synthesized
tccttttctttcttccagcgct

SEQ ID NO: 984806 - DNA, 22 bp, Artificial Sequence
  chemically synthesized
ccttttctttcttccagcgcta

SEQ ID NO: 984807 - DNA, 22 bp, Artificial Sequence
  chemically synthesized
cttttctttcttccagcgctat

SEQ ID NO: 984808 - DNA, 22 bp, Artificial Sequence
  chemically synthesized
ttctttcttccagcgctatatt

SEQ ID NO: 984809 - DNA, 22 bp, Artificial Sequence
  chemically synthesized
tctttcttccagcgctatatta

SEQ ID NO: 984810 - DNA, 22 bp, Artificial Sequence
  chemically synthesized
ctttcttccagcgctatattat

SEQ ID NO: 984811 - DNA, 22 bp, Artificial Sequence
  chemically synthesized
tttcttccagcgctatattatt

SEQ ID NO: 984812 - DNA, 22 bp, Artificial Sequence
  chemically synthesized
tcttccagcgctatattatttc

SEQ ID NO: 984813 - DNA, 22 bp, Artificial Sequence
  chemically synthesized
cttccagcgctatattatttca

SEQ ID NO: 984814 - DNA, 22 bp, Artificial Sequence
  chemically synthesized
ttccagcgctatattatttcaa

SEQ ID NO: 984815 - DNA, 22 bp, Artificial Sequence
  chemically synthesized
ccagcgctatattatttcaaag

SEQ ID NO: 984816 - DNA, 22 bp, Artificial Sequence
  chemically synthesized
cagcgctatattatttcaaagg

SEQ ID NO: 984817 - DNA, 22 bp, Artificial Sequence
  chemically synthesized
ccatgaagtaaccagtgaccct

SEQ ID NO: 984818 - DNA, 22 bp, Artificial Sequence
  chemically synthesized
tattatttcaaagggtcactgg

SEQ ID NO: 984819 - DNA, 22 bp, Artificial Sequence
  chemically synthesized
gttcccatgaagtaaccagtga

SEQ ID NO: 984820 - DNA, 22 bp, Artificial Sequence
  chemically synthesized
tttcaaagggtcactggttact

SEQ ID NO: 984821 - DNA, 22 bp, Artificial Sequence
  chemically synthesized
caaagggtcactggttacttca

SEQ ID NO: 984822 - DNA, 22 bp, Artificial Sequence
  chemically synthesized
aaagggtcactggttacttcat

SEQ ID NO: 984823 - DNA, 22 bp, Artificial Sequence
  chemically synthesized
gttacttcatgggaaccagacg

SEQ ID NO: 984824 - DNA, 22 bp, Artificial Sequence
  chemically synthesized
cttcatgggaaccagacgttgt

SEQ ID NO: 984825 - DNA, 22 bp, Artificial Sequence
  chemically synthesized
tacaagtggcaataacaacgtc

SEQ ID NO: 984826 - DNA, 22 bp, Artificial Sequence
  chemically synthesized
catgggaaccagacgttgttat

SEQ ID NO: 984827 - DNA, 22 bp, Artificial Sequence
  chemically synthesized
atacaagtggcaataacaacgt

SEQ ID NO: 984828 - DNA, 22 bp, Artificial Sequence
  chemically synthesized
atgggaaccagacgttgttatt

SEQ ID NO: 984829 - DNA, 22 bp, Artificial Sequence
  chemically synthesized
acttatacaagtggcaataaca

SEQ ID NO: 984830 - DNA, 22 bp, Artificial Sequence
  chemically synthesized
atctgacttatacaagtggcaa

SEQ ID NO: 984831 - DNA, 22 bp, Artificial Sequence
  chemically synthesized
ttcatctgacttatacaagtgg

SEQ ID NO: 984832 - DNA, 22 bp, Artificial Sequence
  chemically synthesized
attcatctgacttatacaagtg

SEQ ID NO: 984833 - DNA, 22 bp, Artificial Sequence
  chemically synthesized
tattcatctgacttatacaagt

SEQ ID NO: 984834 - DNA, 22 bp, Artificial Sequence
  chemically synthesized
tttattcatctgacttatacaa

SEQ ID NO: 984835 - DNA, 22 bp, Artificial Sequence
  chemically synthesized
ttattgccacttgtataagtca

SEQ ID NO: 984836 - DNA, 22 bp, Artificial Sequence
  chemically synthesized
tctttattcatctgacttatac

SEQ ID NO: 984837 - DNA, 22 bp, Artificial Sequence
  chemically synthesized
ctctttattcatctgacttata

SEQ ID NO: 984838 - DNA, 22 bp, Artificial Sequence
  chemically synthesized
ttgccacttgtataagtcagat

SEQ ID NO: 984839 - DNA, 22 bp, Artificial Sequence
  chemically synthesized
ccacttgtataagtcagatgaa

SEQ ID NO: 984840 - DNA, 22 bp, Artificial Sequence
  chemically synthesized
tcaagaatttctctttattcat

SEQ ID NO: 984841 - DNA, 22 bp, Artificial Sequence
  chemically synthesized
gtataagtcagatgaataaaga

SEQ ID NO: 984842 - DNA, 22 bp, Artificial Sequence
  chemically synthesized
atcaagaatttctctttattca

SEQ ID NO: 984843 - DNA, 22 bp, Artificial Sequence
  chemically synthesized
tataagtcagatgaataaagag

SEQ ID NO: 984844 - DNA, 22 bp, Artificial Sequence
  chemically synthesized
atttatcaagaatttctcttta

SEQ ID NO: 984845 - DNA, 22 bp, Artificial Sequence
  chemically synthesized
aaagtatacctcatttatcaag

SEQ ID NO: 984846 - DNA, 22 bp, Artificial Sequence
  chemically synthesized
caaagtatacctcatttatcaa

SEQ ID NO: 984847 - DNA, 22 bp, Artificial Sequence
  chemically synthesized
ccttcaaagtatacctcattta

SEQ ID NO: 984848 - DNA, 22 bp, Artificial Sequence
  chemically synthesized
gccttcaaagtatacctcattt

SEQ ID NO: 984849 - DNA, 22 bp, Artificial Sequence
  chemically synthesized
tgccttcaaagtatacctcatt

SEQ ID NO: 984850 - DNA, 22 bp, Artificial Sequence
  chemically synthesized
ttgataaatgaggtatactttg

SEQ ID NO: 984851 - DNA, 22 bp, Artificial Sequence
  chemically synthesized
aacattttgccttcaaagtata

SEQ ID NO: 984852 - DNA, 22 bp, Artificial Sequence
  chemically synthesized
gataaatgaggtatactttgaa

SEQ ID NO: 984853 - DNA, 22 bp, Artificial Sequence
  chemically synthesized
ataaatgaggtatactttgaag

SEQ ID NO: 984854 - DNA, 22 bp, Artificial Sequence
  chemically synthesized
tgaacattttgccttcaaagta

SEQ ID NO: 984855 - DNA, 22 bp, Artificial Sequence
  chemically synthesized
ctgaacattttgccttcaaagt

SEQ ID NO: 984856 - DNA, 22 bp, Artificial Sequence
  chemically synthesized
tctgaacattttgccttcaaag

SEQ ID NO: 984857 - DNA, 22 bp, Artificial Sequence
  chemically synthesized
ttttctgaacattttgccttca

SEQ ID NO: 984858 - DNA, 22 bp, Artificial Sequence
  chemically synthesized
tgaaggcaaaatgttcagaaaa

SEQ ID NO: 984859 - DNA, 22 bp, Artificial Sequence
  chemically synthesized
acatataccctattttctgaac

SEQ ID NO: 984860 - DNA, 22 bp, Artificial Sequence
  chemically synthesized
gaaggcaaaatgttcagaaaat

SEQ ID NO: 984861 - DNA, 22 bp, Artificial Sequence
  chemically synthesized
aaggcaaaatgttcagaaaata

SEQ ID NO: 984862 - DNA, 22 bp, Artificial Sequence
  chemically synthesized
atctcacatataccctattttc

SEQ ID NO: 984863 - DNA, 22 bp, Artificial Sequence
  chemically synthesized
catctcacatataccctatttt

SEQ ID NO: 984864 - DNA, 22 bp, Artificial Sequence
  chemically synthesized
tcatctcacatataccctattt

SEQ ID NO: 984865 - DNA, 22 bp, Artificial Sequence
  chemically synthesized
ttcatctcacatataccctatt

SEQ ID NO: 984866 - DNA, 22 bp, Artificial Sequence
  chemically synthesized
tttcatctcacatataccctat

SEQ ID NO: 984867 - DNA, 22 bp, Artificial Sequence
  chemically synthesized
agaaaatagggtatatgtgaga

SEQ ID NO: 984868 - DNA, 22 bp, Artificial Sequence
  chemically synthesized
aggatactttttcatctcacat

SEQ ID NO: 984869 - DNA, 22 bp, Artificial Sequence
  chemically synthesized
tgaggatactttttcatctcac

SEQ ID NO: 984870 - DNA, 22 bp, Artificial Sequence
  chemically synthesized
atctctgaggatactttttcat

SEQ ID NO: 984871 - DNA, 22 bp, Artificial Sequence
  chemically synthesized
catctctgaggatactttttca

SEQ ID NO: 984872 - DNA, 22 bp, Artificial Sequence
  chemically synthesized
tcatctctgaggatactttttc

SEQ ID NO: 984873 - DNA, 22 bp, Artificial Sequence
  chemically synthesized
gcaaatcctttcatctctgagg

SEQ ID NO: 984874 - DNA, 22 bp, Artificial Sequence
  chemically synthesized
ggcaaatcctttcatctctgag

SEQ ID NO: 984875 - DNA, 22 bp, Artificial Sequence
  chemically synthesized
tggcaaatcctttcatctctga

SEQ ID NO: 984876 - DNA, 22 bp, Artificial Sequence
  chemically synthesized
ttggcaaatcctttcatctctg

SEQ ID NO: 984877 - DNA, 22 bp, Artificial Sequence
  chemically synthesized
tatcagtttttggcaaatcctt

SEQ ID NO: 984878 - DNA, 22 bp, Artificial Sequence
  chemically synthesized
atatcagtttttggcaaatcct

SEQ ID NO: 984879 - DNA, 22 bp, Artificial Sequence
  chemically synthesized
agagatgaaaggatttgccaaa

SEQ ID NO: 984880 - DNA, 22 bp, Artificial Sequence
  chemically synthesized
cacccatggaatttatatcagt

SEQ ID NO: 984881 - DNA, 22 bp, Artificial Sequence
  chemically synthesized
gcacccatggaatttatatcag

SEQ ID NO: 984882 - DNA, 22 bp, Artificial Sequence
  chemically synthesized
tttgcacccatggaatttatat

SEQ ID NO: 984883 - DNA, 22 bp, Artificial Sequence
  chemically synthesized
gccaaaaactgatataaattcc

SEQ ID NO: 984884 - DNA, 22 bp, Artificial Sequence
  chemically synthesized
ccaaaaactgatataaattcca

SEQ ID NO: 984885 - DNA, 22 bp, Artificial Sequence
  chemically synthesized
tgtttgcacccatggaatttat

SEQ ID NO: 984886 - DNA, 22 bp, Artificial Sequence
  chemically synthesized
gaactctgtttgcacccatgga

SEQ ID NO: 984887 - DNA, 22 bp, Artificial Sequence
  chemically synthesized
agaactctgtttgcacccatgg

SEQ ID NO: 984888 - DNA, 22 bp, Artificial Sequence
  chemically synthesized
atataaattccatgggtgcaaa

SEQ ID NO: 984889 - DNA, 22 bp, Artificial Sequence
  chemically synthesized
cagtaggcttagaactctgttt

SEQ ID NO: 984890 - DNA, 22 bp, Artificial Sequence
  chemically synthesized
catgggtgcaaacagagttcta

SEQ ID NO: 984891 - DNA, 22 bp, Artificial Sequence
  chemically synthesized
ttgcagtaggcttagaactctg

SEQ ID NO: 984892 - DNA, 22 bp, Artificial Sequence
  chemically synthesized
attgcagtaggcttagaactct

SEQ ID NO: 984893 - DNA, 22 bp, Artificial Sequence
  chemically synthesized
taagcctactgcaataagattt

SEQ ID NO: 984894 - DNA, 22 bp, Artificial Sequence
  chemically synthesized
agcctactgcaataagatttga

SEQ ID NO: 984895 - DNA, 22 bp, Artificial Sequence
  chemically synthesized
ctgcaataagatttgactttat

SEQ ID NO: 984896 - DNA, 22 bp, Artificial Sequence
  chemically synthesized
atagataatccaataaagtcaa

SEQ ID NO: 984897 - DNA, 22 bp, Artificial Sequence
  chemically synthesized
catagataatccaataaagtca

SEQ ID NO: 984898 - DNA, 22 bp, Artificial Sequence
  chemically synthesized
caataagatttgactttattgg

SEQ ID NO: 984899 - DNA, 22 bp, Artificial Sequence
  chemically synthesized
gactttattggattatctatga

SEQ ID NO: 984900 - DNA, 22 bp, Artificial Sequence
  chemically synthesized
caataatatatttcatagataa

SEQ ID NO: 984901 - DNA, 22 bp, Artificial Sequence
  chemically synthesized
actttattggattatctatgaa

SEQ ID NO: 984902 - DNA, 22 bp, Artificial Sequence
  chemically synthesized
ctacaataatatatttcataga

SEQ ID NO: 984903 - DNA, 22 bp, Artificial Sequence
  chemically synthesized
tattggattatctatgaaatat

SEQ ID NO: 984904 - DNA, 22 bp, Artificial Sequence
  chemically synthesized
attggattatctatgaaatata

SEQ ID NO: 984905 - DNA, 22 bp, Artificial Sequence
  chemically synthesized
ttggattatctatgaaatatat

SEQ ID NO: 984906 - DNA, 22 bp, Artificial Sequence
  chemically synthesized
gattatctatgaaatatattat

SEQ ID NO: 984907 - DNA, 22 bp, Artificial Sequence
  chemically synthesized
tctatgaaatatattattgtag

SEQ ID NO: 984908 - DNA, 22 bp, Artificial Sequence
  chemically synthesized
tgaaatatattattgtagtagg

SEQ ID NO: 984909 - DNA, 22 bp, Artificial Sequence
  chemically synthesized
ttgtagtaggggtctattttta

SEQ ID NO: 984910 - DNA, 22 bp, Artificial Sequence
  chemically synthesized
tagtaggggtctatttttatgg

SEQ ID NO: 984911 - DNA, 22 bp, Artificial Sequence
  chemically synthesized
gaccagatgtggccataaaaat

SEQ ID NO: 984912 - DNA, 22 bp, Artificial Sequence
  chemically synthesized
tgaagtctagaccagatgtggc

SEQ ID NO: 984913 - DNA, 22 bp, Artificial Sequence
  chemically synthesized
gtgaagtctagaccagatgtgg

SEQ ID NO: 984914 - DNA, 22 bp, Artificial Sequence
  chemically synthesized
tgtgaagtctagaccagatgtg

SEQ ID NO: 984915 - DNA, 22 bp, Artificial Sequence
  chemically synthesized
ttgtgaagtctagaccagatgt

SEQ ID NO: 984916 - DNA, 22 bp, Artificial Sequence
  chemically synthesized
tttttatggccacatctggtct

SEQ ID NO: 984917 - DNA, 22 bp, Artificial Sequence
  chemically synthesized
ttttgtgaagtctagaccagat

SEQ ID NO: 984918 - DNA, 22 bp, Artificial Sequence
  chemically synthesized
ttatggccacatctggtctaga

SEQ ID NO: 984919 - DNA, 22 bp, Artificial Sequence
  chemically synthesized
tatggccacatctggtctagac

SEQ ID NO: 984920 - DNA, 22 bp, Artificial Sequence
  chemically synthesized
atggccacatctggtctagact

SEQ ID NO: 984921 - DNA, 22 bp, Artificial Sequence
  chemically synthesized
tggccacatctggtctagactt

SEQ ID NO: 984922 - DNA, 22 bp, Artificial Sequence
  chemically synthesized
taattcttttgtgaagtctaga

SEQ ID NO: 984923 - DNA, 22 bp, Artificial Sequence
  chemically synthesized
ccattgtaattcttttgtgaag

SEQ ID NO: 984924 - DNA, 22 bp, Artificial Sequence
  chemically synthesized
gtctagacttcacaaaagaatt

SEQ ID NO: 984925 - DNA, 22 bp, Artificial Sequence
  chemically synthesized
gacttcacaaaagaattacaat

SEQ ID NO: 984926 - DNA, 22 bp, Artificial Sequence
  chemically synthesized
gtagagtatattcccattgtaa

SEQ ID NO: 984927 - DNA, 22 bp, Artificial Sequence
  chemically synthesized
ggtagagtatattcccattgta

SEQ ID NO: 984928 - DNA, 22 bp, Artificial Sequence
  chemically synthesized
cacaaaagaattacaatgggaa

SEQ ID NO: 984929 - DNA, 22 bp, Artificial Sequence
  chemically synthesized
acaaaagaattacaatgggaat

SEQ ID NO: 984930 - DNA, 22 bp, Artificial Sequence
  chemically synthesized
gcatcttggtagagtatattcc

SEQ ID NO: 984931 - DNA, 22 bp, Artificial Sequence
  chemically synthesized
ggcatcttggtagagtatattc

SEQ ID NO: 984932 - DNA, 22 bp, Artificial Sequence
  chemically synthesized
tggcatcttggtagagtatatt

SEQ ID NO: 984933 - DNA, 22 bp, Artificial Sequence
  chemically synthesized
ttggcatcttggtagagtatat

SEQ ID NO: 984934 - DNA, 22 bp, Artificial Sequence
  chemically synthesized
tttggcatcttggtagagtata

SEQ ID NO: 984935 - DNA, 22 bp, Artificial Sequence
  chemically synthesized
caatgggaatatactctaccaa

SEQ ID NO: 984936 - DNA, 22 bp, Artificial Sequence
  chemically synthesized
taccaagatgccaaaaaacaca

SEQ ID NO: 984937 - DNA, 22 bp, Artificial Sequence
  chemically synthesized
ccaagatgccaaaaaacacata

SEQ ID NO: 984938 - DNA, 22 bp, Artificial Sequence
  chemically synthesized
aggaatgaagagatatgtgttt

SEQ ID NO: 984939 - DNA, 22 bp, Artificial Sequence
  chemically synthesized
caggaatgaagagatatgtgtt

SEQ ID NO: 984940 - DNA, 22 bp, Artificial Sequence
  chemically synthesized
tcaggaatgaagagatatgtgt

SEQ ID NO: 984941 - DNA, 22 bp, Artificial Sequence
  chemically synthesized
ggcaatatctttcaggaatgaa

SEQ ID NO: 984942 - DNA, 22 bp, Artificial Sequence
  chemically synthesized
gacagtctaggcaatatctttc

SEQ ID NO: 984943 - DNA, 22 bp, Artificial Sequence
  chemically synthesized
agacagtctaggcaatatcttt

SEQ ID NO: 984944 - DNA, 22 bp, Artificial Sequence
  chemically synthesized
ttcattcctgaaagatattgcc

SEQ ID NO: 984945 - DNA, 22 bp, Artificial Sequence
  chemically synthesized
cattcctgaaagatattgccta

SEQ ID NO: 984946 - DNA, 22 bp, Artificial Sequence
  chemically synthesized
attcctgaaagatattgcctag

SEQ ID NO: 984947 - DNA, 22 bp, Artificial Sequence
  chemically synthesized
agatttagacagtctaggcaat

SEQ ID NO: 984948 - DNA, 22 bp, Artificial Sequence
  chemically synthesized
cagatttagacagtctaggcaa

SEQ ID NO: 984949 - DNA, 22 bp, Artificial Sequence
  chemically synthesized
tcagatttagacagtctaggca

SEQ ID NO: 984950 - DNA, 22 bp, Artificial Sequence
  chemically synthesized
ctgaaagatattgcctagactg

SEQ ID NO: 984951 - DNA, 22 bp, Artificial Sequence
  chemically synthesized
aaagatattgcctagactgtct

SEQ ID NO: 984952 - DNA, 22 bp, Artificial Sequence
  chemically synthesized
attttcagatttagacagtcta

SEQ ID NO: 984953 - DNA, 22 bp, Artificial Sequence
  chemically synthesized
ttaattttcagatttagacagt

SEQ ID NO: 984954 - DNA, 22 bp, Artificial Sequence
  chemically synthesized
gttaattttcagatttagacag

SEQ ID NO: 984955 - DNA, 22 bp, Artificial Sequence
  chemically synthesized
cctagactgtctaaatctgaaa

SEQ ID NO: 984956 - DNA, 22 bp, Artificial Sequence
  chemically synthesized
gactgtctaaatctgaaaatta

SEQ ID NO: 984957 - DNA, 22 bp, Artificial Sequence
  chemically synthesized
cagaatccttgttaattttcag

SEQ ID NO: 984958 - DNA, 22 bp, Artificial Sequence
  chemically synthesized
tctaaatctgaaaattaacaag

SEQ ID NO: 984959 - DNA, 22 bp, Artificial Sequence
  chemically synthesized
aatctgaaaattaacaaggatt

SEQ ID NO: 984960 - DNA, 22 bp, Artificial Sequence
  chemically synthesized
aaaattaacaaggattctgtaa

SEQ ID NO: 984961 - DNA, 22 bp, Artificial Sequence
  chemically synthesized
acaaggattctgtaattacttc

SEQ ID NO: 984962 - DNA, 22 bp, Artificial Sequence
  chemically synthesized
gggaaatgtagatgaaaatgaa

SEQ ID NO: 984963 - DNA, 22 bp, Artificial Sequence
  chemically synthesized
ggggaaatgtagatgaaaatga

SEQ ID NO: 984964 - DNA, 22 bp, Artificial Sequence
  chemically synthesized
tgtaattacttcattttcatct

SEQ ID NO: 984965 - DNA, 22 bp, Artificial Sequence
  chemically synthesized
taattacttcattttcatctac

SEQ ID NO: 984966 - DNA, 22 bp, Artificial Sequence
  chemically synthesized
gtttggggaaatgtagatgaaa

SEQ ID NO: 984967 - DNA, 22 bp, Artificial Sequence
  chemically synthesized
agtttggggaaatgtagatgaa

SEQ ID NO: 984968 - DNA, 22 bp, Artificial Sequence
  chemically synthesized
tagtttggggaaatgtagatga

SEQ ID NO: 984969 - DNA, 22 bp, Artificial Sequence
  chemically synthesized
ttagtttggggaaatgtagatg

SEQ ID NO: 984970 - DNA, 22 bp, Artificial Sequence
  chemically synthesized
cttcattttcatctacatttcc

SEQ ID NO: 984971 - DNA, 22 bp, Artificial Sequence
  chemically synthesized
cattttcatctacatttcccca

SEQ ID NO: 984972 - DNA, 22 bp, Artificial Sequence
  chemically synthesized
attttcatctacatttccccaa

SEQ ID NO: 984973 - DNA, 22 bp, Artificial Sequence
  chemically synthesized
ggataccttttagtttggggaa

SEQ ID NO: 984974 - DNA, 22 bp, Artificial Sequence
  chemically synthesized
tcatctacatttccccaaacta

SEQ ID NO: 984975 - DNA, 22 bp, Artificial Sequence
  chemically synthesized
catctacatttccccaaactaa

SEQ ID NO: 984976 - DNA, 22 bp, Artificial Sequence
  chemically synthesized
atctacatttccccaaactaaa

SEQ ID NO: 984977 - DNA, 22 bp, Artificial Sequence
  chemically synthesized
catttccccaaactaaaaggta

SEQ ID NO: 984978 - DNA, 22 bp, Artificial Sequence
  chemically synthesized
aaataatctaggatacctttta

SEQ ID NO: 984979 - DNA, 22 bp, Artificial Sequence
  chemically synthesized
ccccaaactaaaaggtatccta

SEQ ID NO: 984980 - DNA, 22 bp, Artificial Sequence
  chemically synthesized
cccaaactaaaaggtatcctag

SEQ ID NO: 984981 - DNA, 22 bp, Artificial Sequence
  chemically synthesized
tagctcaaataatctaggatac

SEQ ID NO: 984982 - DNA, 22 bp, Artificial Sequence
  chemically synthesized
aaaggtatcctagattatttga

SEQ ID NO: 984983 - DNA, 22 bp, Artificial Sequence
  chemically synthesized
tacataaaaacacatctatagc

SEQ ID NO: 984984 - DNA, 22 bp, Artificial Sequence
  chemically synthesized
gattatttgagctatagatgtg

SEQ ID NO: 984985 - DNA, 22 bp, Artificial Sequence
  chemically synthesized
tttgagctatagatgtgttttt

SEQ ID NO: 984986 - DNA, 22 bp, Artificial Sequence
  chemically synthesized
aaaagctgtacataaaaacaca

SEQ ID NO: 984987 - DNA, 22 bp, Artificial Sequence
  chemically synthesized
aaaaagctgtacataaaaacac

SEQ ID NO: 984988 - DNA, 22 bp, Artificial Sequence
  chemically synthesized
gagctatagatgtgtttttatg

SEQ ID NO: 984989 - DNA, 22 bp, Artificial Sequence
  chemically synthesized
agctatagatgtgtttttatgt

SEQ ID NO: 984990 - DNA, 22 bp, Artificial Sequence
  chemically synthesized
atttaaaaagctgtacataaaa

SEQ ID NO: 984991 - DNA, 22 bp, Artificial Sequence
  chemically synthesized
tagatgtgtttttatgtacagc

SEQ ID NO: 984992 - DNA, 22 bp, Artificial Sequence
  chemically synthesized
ttaatttaaaaagctgtacata

SEQ ID NO: 984993 - DNA, 22 bp, Artificial Sequence
  chemically synthesized
gtggactattaatttaaaaagc

SEQ ID NO: 984994 - DNA, 22 bp, Artificial Sequence
  chemically synthesized
ttatgtacagctttttaaatta

SEQ ID NO: 984995 - DNA, 22 bp, Artificial Sequence
  chemically synthesized
tatgtacagctttttaaattaa

SEQ ID NO: 984996 - DNA, 22 bp, Artificial Sequence
  chemically synthesized
atgtacagctttttaaattaat

SEQ ID NO: 984997 - DNA, 22 bp, Artificial Sequence
  chemically synthesized
tgtacagctttttaaattaata

SEQ ID NO: 984998 - DNA, 22 bp, Artificial Sequence
  chemically synthesized
taaccgatagagctagtggact

SEQ ID NO: 984999 - DNA, 22 bp, Artificial Sequence
  chemically synthesized
tttaaattaatagtccactagc

SEQ ID NO: 985000 - DNA, 22 bp, Artificial Sequence
  chemically synthesized
ttaaattaatagtccactagct

SEQ ID NO: 985001 - DNA, 22 bp, Artificial Sequence
  chemically synthesized
taaattaatagtccactagctc

SEQ ID NO: 985002 - DNA, 22 bp, Artificial Sequence
  chemically synthesized
ctgtaaccgatagagctagtgg

SEQ ID NO: 985003 - DNA, 22 bp, Artificial Sequence
  chemically synthesized
aaattaatagtccactagctct

SEQ ID NO: 985004 - DNA, 22 bp, Artificial Sequence
  chemically synthesized
aattaatagtccactagctcta

SEQ ID NO: 985005 - DNA, 22 bp, Artificial Sequence
  chemically synthesized
ctgctgtaaccgatagagctag

SEQ ID NO: 985006 - DNA, 22 bp, Artificial Sequence
  chemically synthesized
ttactgctgtaaccgatagagc

SEQ ID NO: 985007 - DNA, 22 bp, Artificial Sequence
  chemically synthesized
atagtccactagctctatcggt

SEQ ID NO: 985008 - DNA, 22 bp, Artificial Sequence
  chemically synthesized
attactgctgtaaccgatagag

SEQ ID NO: 985009 - DNA, 22 bp, Artificial Sequence
  chemically synthesized
tattactgctgtaaccgataga

SEQ ID NO: 985010 - DNA, 22 bp, Artificial Sequence
  chemically synthesized
ttattactgctgtaaccgatag

SEQ ID NO: 985011 - DNA, 22 bp, Artificial Sequence
  chemically synthesized
tttattactgctgtaaccgata

SEQ ID NO: 985012 - DNA, 22 bp, Artificial Sequence
  chemically synthesized
ttttattactgctgtaaccgat

SEQ ID NO: 985013 - DNA, 22 bp, Artificial Sequence
  chemically synthesized
gctctatcggttacagcagtaa

SEQ ID NO: 985014 - DNA, 22 bp, Artificial Sequence
  chemically synthesized
tatcggttacagcagtaataaa

SEQ ID NO: 985015 - DNA, 22 bp, Artificial Sequence
  chemically synthesized
cataaaagtttttttattactg

SEQ ID NO: 985016 - DNA, 22 bp, Artificial Sequence
  chemically synthesized
ccataaaagtttttttattact

SEQ ID NO: 985017 - DNA, 22 bp, Artificial Sequence
  chemically synthesized
tcggttacagcagtaataaaaa

SEQ ID NO: 985018 - DNA, 22 bp, Artificial Sequence
  chemically synthesized
tccataaaagtttttttattac

SEQ ID NO: 985019 - DNA, 22 bp, Artificial Sequence
  chemically synthesized
cagcagtaataaaaaaactttt

SEQ ID NO: 985020 - DNA, 22 bp, Artificial Sequence
  chemically synthesized
agagaactttccataaaagttt

SEQ ID NO: 985021 - DNA, 22 bp, Artificial Sequence
  chemically synthesized
gtctcagagaactttccataaa

SEQ ID NO: 985022 - DNA, 22 bp, Artificial Sequence
  chemically synthesized
agtctcagagaactttccataa

SEQ ID NO: 985023 - DNA, 22 bp, Artificial Sequence
  chemically synthesized
tagtctcagagaactttccata

SEQ ID NO: 985024 - DNA, 22 bp, Artificial Sequence
  chemically synthesized
ttagtctcagagaactttccat

SEQ ID NO: 985025 - DNA, 22 bp, Artificial Sequence
  chemically synthesized
ttatggaaagttctctgagact

SEQ ID NO: 985026 - DNA, 22 bp, Artificial Sequence
  chemically synthesized
tatggaaagttctctgagacta

SEQ ID NO: 985027 - DNA, 22 bp, Artificial Sequence
  chemically synthesized
atggaaagttctctgagactaa

SEQ ID NO: 985028 - DNA, 22 bp, Artificial Sequence
  chemically synthesized
tggaaagttctctgagactaaa

SEQ ID NO: 985029 - DNA, 22 bp, Artificial Sequence
  chemically synthesized
catgtaaatcacttttagtctc

SEQ ID NO: 985030 - DNA, 22 bp, Artificial Sequence
  chemically synthesized
gcatgtaaatcacttttagtct

SEQ ID NO: 985031 - DNA, 22 bp, Artificial Sequence
  chemically synthesized
tctgagactaaaagtgatttac

SEQ ID NO: 985032 - DNA, 22 bp, Artificial Sequence
  chemically synthesized
catatatttgcatgtaaatcac

SEQ ID NO: 985033 - DNA, 22 bp, Artificial Sequence
  chemically synthesized
tgagactaaaagtgatttacat

SEQ ID NO: 985034 - DNA, 22 bp, Artificial Sequence
  chemically synthesized
ccatatatttgcatgtaaatca

SEQ ID NO: 985035 - DNA, 22 bp, Artificial Sequence
  chemically synthesized
agactaaaagtgatttacatgc

SEQ ID NO: 985036 - DNA, 22 bp, Artificial Sequence
  chemically synthesized
aaagtgatttacatgcaaatat

SEQ ID NO: 985037 - DNA, 22 bp, Artificial Sequence
  chemically synthesized
agaagggaatcatttccatata

SEQ ID NO: 985038 - DNA, 22 bp, Artificial Sequence
  chemically synthesized
aagaagggaatcatttccatat

SEQ ID NO: 985039 - DNA, 22 bp, Artificial Sequence
  chemically synthesized
taagaagggaatcatttccata

SEQ ID NO: 985040 - DNA, 22 bp, Artificial Sequence
  chemically synthesized
acatgcaaatatatggaaatga

SEQ ID NO: 985041 - DNA, 22 bp, Artificial Sequence
  chemically synthesized
catgcaaatatatggaaatgat

SEQ ID NO: 985042 - DNA, 22 bp, Artificial Sequence
  chemically synthesized
ttttaagaagggaatcatttcc

SEQ ID NO: 985043 - DNA, 22 bp, Artificial Sequence
  chemically synthesized
ctgttttaagaagggaatcatt

SEQ ID NO: 985044 - DNA, 22 bp, Artificial Sequence
  chemically synthesized
ttactgttttaagaagggaatc

SEQ ID NO: 985045 - DNA, 22 bp, Artificial Sequence
  chemically synthesized
gttactgttttaagaagggaat

SEQ ID NO: 985046 - DNA, 22 bp, Artificial Sequence
  chemically synthesized
tgttactgttttaagaagggaa

SEQ ID NO: 985047 - DNA, 22 bp, Artificial Sequence
  chemically synthesized
ttgttactgttttaagaaggga

SEQ ID NO: 985048 - DNA, 22 bp, Artificial Sequence
  chemically synthesized
aaacacaccttttgttactgtt

SEQ ID NO: 985049 - DNA, 22 bp, Artificial Sequence
  chemically synthesized
caaacacaccttttgttactgt

SEQ ID NO: 985050 - DNA, 22 bp, Artificial Sequence
  chemically synthesized
tcaaacacaccttttgttactg

SEQ ID NO: 985051 - DNA, 22 bp, Artificial Sequence
  chemically synthesized
ccttcttaaaacagtaacaaaa

SEQ ID NO: 985052 - DNA, 22 bp, Artificial Sequence
  chemically synthesized
cttaaaacagtaacaaaaggtg

SEQ ID NO: 985053 - DNA, 22 bp, Artificial Sequence
  chemically synthesized
ttaaaacagtaacaaaaggtgt

SEQ ID NO: 985054 - DNA, 22 bp, Artificial Sequence
  chemically synthesized
aaaacagtaacaaaaggtgtgt

SEQ ID NO: 985055 - DNA, 22 bp, Artificial Sequence
  chemically synthesized
aaacagtaacaaaaggtgtgtt

SEQ ID NO: 985056 - DNA, 22 bp, Artificial Sequence
  chemically synthesized
caaagcatgaattttcaaacac

SEQ ID NO: 985057 - DNA, 22 bp, Artificial Sequence
  chemically synthesized
ccaaagcatgaattttcaaaca

SEQ ID NO: 985058 - DNA, 22 bp, Artificial Sequence
  chemically synthesized
ttccaaagcatgaattttcaaa

SEQ ID NO: 985059 - DNA, 22 bp, Artificial Sequence
  chemically synthesized
ttcttccaaagcatgaattttc

SEQ ID NO: 985060 - DNA, 22 bp, Artificial Sequence
  chemically synthesized
attcttccaaagcatgaatttt

SEQ ID NO: 985061 - DNA, 22 bp, Artificial Sequence
  chemically synthesized
gaaaattcatgctttggaagaa

SEQ ID NO: 985062 - DNA, 22 bp, Artificial Sequence
  chemically synthesized
aaaattcatgctttggaagaat

SEQ ID NO: 985063 - DNA, 22 bp, Artificial Sequence
  chemically synthesized
tgtgaaaatcatttattcttcc

SEQ ID NO: 985064 - DNA, 22 bp, Artificial Sequence
  chemically synthesized
atgctttggaagaataaatgat

SEQ ID NO: 985065 - DNA, 22 bp, Artificial Sequence
  chemically synthesized
gaatgattatgtgaaaatcatt

SEQ ID NO: 985066 - DNA, 22 bp, Artificial Sequence
  chemically synthesized
tggaagaataaatgattttcac

SEQ ID NO: 985067 - DNA, 22 bp, Artificial Sequence
  chemically synthesized
ggaagaataaatgattttcaca

SEQ ID NO: 985068 - DNA, 22 bp, Artificial Sequence
  chemically synthesized
ctagaatgattatgtgaaaatc

SEQ ID NO: 985069 - DNA, 22 bp, Artificial Sequence
  chemically synthesized
gaagaataaatgattttcacat

SEQ ID NO: 985070 - DNA, 22 bp, Artificial Sequence
  chemically synthesized
actagaatgattatgtgaaaat

SEQ ID NO: 985071 - DNA, 22 bp, Artificial Sequence
  chemically synthesized
tcacataatcattctagtaagt

SEQ ID NO: 985072 - DNA, 22 bp, Artificial Sequence
  chemically synthesized
cacataatcattctagtaagtt

SEQ ID NO: 985073 - DNA, 22 bp, Artificial Sequence
  chemically synthesized
acataatcattctagtaagttg

SEQ ID NO: 985074 - DNA, 22 bp, Artificial Sequence
  chemically synthesized
tagtaagttgtttatttttatt

SEQ ID NO: 985075 - DNA, 22 bp, Artificial Sequence
  chemically synthesized
gtaagttgtttatttttattga

SEQ ID NO: 985076 - DNA, 22 bp, Artificial Sequence
  chemically synthesized
ataaaagatgcatgtcaataaa

SEQ ID NO: 985077 - DNA, 22 bp, Artificial Sequence
  chemically synthesized
tttatttttattgacatgcatc

SEQ ID NO: 985078 - DNA, 22 bp, Artificial Sequence
  chemically synthesized
aatagctaataaaagatgcatg

SEQ ID NO: 985079 - DNA, 22 bp, Artificial Sequence
  chemically synthesized
atttttattgacatgcatcttt

SEQ ID NO: 985080 - DNA, 22 bp, Artificial Sequence
  chemically synthesized
tttttattgacatgcatctttt

SEQ ID NO: 985081 - DNA, 22 bp, Artificial Sequence
  chemically synthesized
ttattgacatgcatcttttatt

SEQ ID NO: 985082 - DNA, 22 bp, Artificial Sequence
  chemically synthesized
tattgacatgcatcttttatta

SEQ ID NO: 985083 - DNA, 22 bp, Artificial Sequence
  chemically synthesized
attgacatgcatcttttattag

SEQ ID NO: 985084 - DNA, 22 bp, Artificial Sequence
  chemically synthesized
ttgacatgcatcttttattagc

SEQ ID NO: 985085 - DNA, 22 bp, Artificial Sequence
  chemically synthesized
acatgcatcttttattagctat

SEQ ID NO: 985086 - DNA, 22 bp, Artificial Sequence
  chemically synthesized
tgaaccaccattaaatagctaa

SEQ ID NO: 985087 - DNA, 22 bp, Artificial Sequence
  chemically synthesized
acccctgtgaaccaccattaaa

SEQ ID NO: 985088 - DNA, 22 bp, Artificial Sequence
  chemically synthesized
ttattagctatttaatggtggt

SEQ ID NO: 985089 - DNA, 22 bp, Artificial Sequence
  chemically synthesized
tattagctatttaatggtggtt

SEQ ID NO: 985090 - DNA, 22 bp, Artificial Sequence
  chemically synthesized
attagctatttaatggtggttc

SEQ ID NO: 985091 - DNA, 22 bp, Artificial Sequence
  chemically synthesized
ttagctatttaatggtggttca

SEQ ID NO: 985092 - DNA, 22 bp, Artificial Sequence
  chemically synthesized
gctatttaatggtggttcacag

SEQ ID NO: 985093 - DNA, 22 bp, Artificial Sequence
  chemically synthesized
tttaatggtggttcacaggggt

SEQ ID NO: 985094 - DNA, 22 bp, Artificial Sequence
  chemically synthesized
aatggtggttcacaggggtgag

SEQ ID NO: 985095 - DNA, 22 bp, Artificial Sequence
  chemically synthesized
atggtggttcacaggggtgagt

SEQ ID NO: 985096 - DNA, 22 bp, Artificial Sequence
  chemically synthesized
caggcgtgatccagtgcactca

SEQ ID NO: 985097 - DNA, 22 bp, Artificial Sequence
  chemically synthesized
acaggggtgagtgcactggatc

SEQ ID NO: 985098 - DNA, 22 bp, Artificial Sequence
  chemically synthesized
ccaaaatgccgagattacaggc

SEQ ID NO: 985099 - DNA, 22 bp, Artificial Sequence
  chemically synthesized
gcctcccaaaatgccgagatta

SEQ ID NO: 985100 - DNA, 22 bp, Artificial Sequence
  chemically synthesized
gatcacgcctgtaatctcggca

SEQ ID NO: 985101 - DNA, 22 bp, Artificial Sequence
  chemically synthesized
ggcctcccaaaatgccgagatt

SEQ ID NO: 985102 - DNA, 22 bp, Artificial Sequence
  chemically synthesized
cccaccttggcctcccaaaatg

SEQ ID NO: 985103 - DNA, 22 bp, Artificial Sequence
  chemically synthesized
taatctcggcattttgggaggc

SEQ ID NO: 985104 - DNA, 22 bp, Artificial Sequence
  chemically synthesized
ggcattttgggaggccaaggtg

SEQ ID NO: 985105 - DNA, 22 bp, Artificial Sequence
  chemically synthesized
aagcaatctgcccaccttggcc

SEQ ID NO: 985106 - DNA, 22 bp, Artificial Sequence
  chemically synthesized
agctcaagcaatctgcccacct

SEQ ID NO: 985107 - DNA, 22 bp, Artificial Sequence
  chemically synthesized
tgggaggccaaggtgggcagat

SEQ ID NO: 985108 - DNA, 22 bp, Artificial Sequence
  chemically synthesized
gggaggccaaggtgggcagatt

SEQ ID NO: 985109 - DNA, 22 bp, Artificial Sequence
  chemically synthesized
ctgagctcaagcaatctgccca

SEQ ID NO: 985110 - DNA, 22 bp, Artificial Sequence
  chemically synthesized
ggaggccaaggtgggcagattg

SEQ ID NO: 985111 - DNA, 22 bp, Artificial Sequence
  chemically synthesized
aaactcctgagctcaagcaatc

SEQ ID NO: 985112 - DNA, 22 bp, Artificial Sequence
  chemically synthesized
gtctcaaactcctgagctcaag

SEQ ID NO: 985113 - DNA, 22 bp, Artificial Sequence
  chemically synthesized
accatctggtctcaaactcctg

SEQ ID NO: 985114 - DNA, 22 bp, Artificial Sequence
  chemically synthesized
caccatctggtctcaaactcct

SEQ ID NO: 985115 - DNA, 22 bp, Artificial Sequence
  chemically synthesized
cttgagctcaggagtttgagac

SEQ ID NO: 985116 - DNA, 22 bp, Artificial Sequence
  chemically synthesized
gagctcaggagtttgagaccag

SEQ ID NO: 985117 - DNA, 22 bp, Artificial Sequence
  chemically synthesized
agctcaggagtttgagaccaga

SEQ ID NO: 985118 - DNA, 22 bp, Artificial Sequence
  chemically synthesized
aggagtttgagaccagatggtg

SEQ ID NO: 985119 - DNA, 22 bp, Artificial Sequence
  chemically synthesized
gagatggtgtttcaccatctgg

SEQ ID NO: 985120 - DNA, 22 bp, Artificial Sequence
  chemically synthesized
agagatggtgtttcaccatctg

SEQ ID NO: 985121 - DNA, 22 bp, Artificial Sequence
  chemically synthesized
tagagatggtgtttcaccatct

SEQ ID NO: 985122 - DNA, 22 bp, Artificial Sequence
  chemically synthesized
ttagagatggtgtttcaccatc

SEQ ID NO: 985123 - DNA, 22 bp, Artificial Sequence
  chemically synthesized
tttagagatggtgtttcaccat

SEQ ID NO: 985124 - DNA, 22 bp, Artificial Sequence
  chemically synthesized
ttttagagatggtgtttcacca

SEQ ID NO: 985125 - DNA, 22 bp, Artificial Sequence
  chemically synthesized
tttttagagatggtgtttcacc

SEQ ID NO: 985126 - DNA, 22 bp, Artificial Sequence
  chemically synthesized
ttttttagagatggtgtttcac

SEQ ID NO: 985127 - DNA, 22 bp, Artificial Sequence
  chemically synthesized
gagaccagatggtgaaacacca

SEQ ID NO: 985128 - DNA, 22 bp, Artificial Sequence
  chemically synthesized
agaccagatggtgaaacaccat

SEQ ID NO: 985129 - DNA, 22 bp, Artificial Sequence
  chemically synthesized
tatttttttttagagatggtgt

SEQ ID NO: 985130 - DNA, 22 bp, Artificial Sequence
  chemically synthesized
gtatttttttttagagatggtg

SEQ ID NO: 985131 - DNA, 22 bp, Artificial Sequence
  chemically synthesized
tgtatttttttttagagatggt

SEQ ID NO: 985132 - DNA, 22 bp, Artificial Sequence
  chemically synthesized
ttgtatttttttttagagatgg

SEQ ID NO: 985133 - DNA, 22 bp, Artificial Sequence
  chemically synthesized
tttgtatttttttttagagatg

SEQ ID NO: 985134 - DNA, 22 bp, Artificial Sequence
  chemically synthesized
attttttgtatttttttttaga

SEQ ID NO: 985135 - DNA, 22 bp, Artificial Sequence
  chemically synthesized
taaaaaaaaatacaaaaaatta

SEQ ID NO: 985136 - DNA, 22 bp, Artificial Sequence
  chemically synthesized
aaaaaaaatacaaaaaattagc

SEQ ID NO: 985137 - DNA, 22 bp, Artificial Sequence
  chemically synthesized
gcgcacgccaccatgcccagct

SEQ ID NO: 985138 - DNA, 22 bp, Artificial Sequence
  chemically synthesized
ctggcgcacgccaccatgccca

SEQ ID NO: 985139 - DNA, 22 bp, Artificial Sequence
  chemically synthesized
aggctactggcgcacgccacca

SEQ ID NO: 985140 - DNA, 22 bp, Artificial Sequence
  chemically synthesized
gctgggcatggtggcgtgcgcc

SEQ ID NO: 985141 - DNA, 22 bp, Artificial Sequence
  chemically synthesized
ggcatggtggcgtgcgccagta

SEQ ID NO: 985142 - DNA, 22 bp, Artificial Sequence
  chemically synthesized
ccgggtagctgaggctactggc

SEQ ID NO: 985143 - DNA, 22 bp, Artificial Sequence
  chemically synthesized
agcctcccgggtagctgaggct

SEQ ID NO: 985144 - DNA, 22 bp, Artificial Sequence
  chemically synthesized
ccacctcagcctcccgggtagc

SEQ ID NO: 985145 - DNA, 22 bp, Artificial Sequence
  chemically synthesized
agctacccgggaggctgaggtg

SEQ ID NO: 985146 - DNA, 22 bp, Artificial Sequence
  chemically synthesized
aggtgatcctcccacctcagcc

SEQ ID NO: 985147 - DNA, 22 bp, Artificial Sequence
  chemically synthesized
cccgggaggctgaggtgggagg

SEQ ID NO: 985148 - DNA, 22 bp, Artificial Sequence
  chemically synthesized
aaccatccaggctcaggtgatc

SEQ ID NO: 985149 - DNA, 22 bp, Artificial Sequence
  chemically synthesized
aggtgggaggatcacctgagcc

SEQ ID NO: 985150 - DNA, 22 bp, Artificial Sequence
  chemically synthesized
cctcaaccatccaggctcaggt

SEQ ID NO: 985151 - DNA, 22 bp, Artificial Sequence
  chemically synthesized
actgcctcaaccatccaggctc

SEQ ID NO: 985152 - DNA, 22 bp, Artificial Sequence
  chemically synthesized
atggctcactgcctcaaccatc

SEQ ID NO: 985153 - DNA, 22 bp, Artificial Sequence
  chemically synthesized
agcctggatggttgaggcagtg

SEQ ID NO: 985154 - DNA, 22 bp, Artificial Sequence
  chemically synthesized
gatggttgaggcagtgagccat

SEQ ID NO: 985155 - DNA, 22 bp, Artificial Sequence
  chemically synthesized
agtgcagtggtgcattcatggc

SEQ ID NO: 985156 - DNA, 22 bp, Artificial Sequence
  chemically synthesized
gagtgcagtggtgcattcatgg

SEQ ID NO: 985157 - DNA, 22 bp, Artificial Sequence
  chemically synthesized
aggcagtgagccatgaatgcac

SEQ ID NO: 985158 - DNA, 22 bp, Artificial Sequence
  chemically synthesized
cccaggcttgagtgcagtggtg

SEQ ID NO: 985159 - DNA, 22 bp, Artificial Sequence
  chemically synthesized
ctgcccaggcttgagtgcagtg

SEQ ID NO: 985160 - DNA, 22 bp, Artificial Sequence
  chemically synthesized
tgctgcccaggcttgagtgcag

SEQ ID NO: 985161 - DNA, 22 bp, Artificial Sequence
  chemically synthesized
ctctgctgcccaggcttgagtg

SEQ ID NO: 985162 - DNA, 22 bp, Artificial Sequence
  chemically synthesized
gctctgctgcccaggcttgagt

SEQ ID NO: 985163 - DNA, 22 bp, Artificial Sequence
  chemically synthesized
cactcaagcctgggcagcagag

SEQ ID NO: 985164 - DNA, 22 bp, Artificial Sequence
  chemically synthesized
agacaaagtcttgctctgctgc

SEQ ID NO: 985165 - DNA, 22 bp, Artificial Sequence
  chemically synthesized
gagacaaagtcttgctctgctg

SEQ ID NO: 985166 - DNA, 22 bp, Artificial Sequence
  chemically synthesized
tgagacaaagtcttgctctgct

SEQ ID NO: 985167 - DNA, 22 bp, Artificial Sequence
  chemically synthesized
ttgagacaaagtcttgctctgc

SEQ ID NO: 985168 - DNA, 22 bp, Artificial Sequence
  chemically synthesized
aagcctgggcagcagagcaaga

SEQ ID NO: 985169 - DNA, 22 bp, Artificial Sequence
  chemically synthesized
tttgagacaaagtcttgctctg

SEQ ID NO: 985170 - DNA, 22 bp, Artificial Sequence
  chemically synthesized
ttttgagacaaagtcttgctct

SEQ ID NO: 985171 - DNA, 22 bp, Artificial Sequence
  chemically synthesized
ggcagcagagcaagactttgtc

SEQ ID NO: 985172 - DNA, 22 bp, Artificial Sequence
  chemically synthesized
tggatcacatttttttgagaca

SEQ ID NO: 985173 - DNA, 22 bp, Artificial Sequence
  chemically synthesized
gtggatcacatttttttgagac

SEQ ID NO: 985174 - DNA, 22 bp, Artificial Sequence
  chemically synthesized
tgtggatcacatttttttgaga

SEQ ID NO: 985175 - DNA, 22 bp, Artificial Sequence
  chemically synthesized
ttgtggatcacatttttttgag

SEQ ID NO: 985176 - DNA, 22 bp, Artificial Sequence
  chemically synthesized
tttgtggatcacatttttttga

SEQ ID NO: 985177 - DNA, 22 bp, Artificial Sequence
  chemically synthesized
ttttttgtggatcacatttttt

SEQ ID NO: 985178 - DNA, 22 bp, Artificial Sequence
  chemically synthesized
gttttttgtggatcacattttt

SEQ ID NO: 985179 - DNA, 22 bp, Artificial Sequence
  chemically synthesized
tgtctcaaaaaaatgtgatcca

SEQ ID NO: 985180 - DNA, 22 bp, Artificial Sequence
  chemically synthesized
gtctcaaaaaaatgtgatccac

SEQ ID NO: 985181 - DNA, 22 bp, Artificial Sequence
  chemically synthesized
aatttgttttttgtggatcaca

SEQ ID NO: 985182 - DNA, 22 bp, Artificial Sequence
  chemically synthesized
tctcaaaaaaatgtgatccaca

SEQ ID NO: 985183 - DNA, 22 bp, Artificial Sequence
  chemically synthesized
aaatttgttttttgtggatcac

SEQ ID NO: 985184 - DNA, 22 bp, Artificial Sequence
  chemically synthesized
aaaaaaatgtgatccacaaaaa

SEQ ID NO: 985185 - DNA, 22 bp, Artificial Sequence
  chemically synthesized
aacaacttaaatttgttttttg

SEQ ID NO: 985186 - DNA, 22 bp, Artificial Sequence
  chemically synthesized
aaatattcaacaacttaaattt

SEQ ID NO: 985187 - DNA, 22 bp, Artificial Sequence
  chemically synthesized
gcctaaaatattcaacaactta

SEQ ID NO: 985188 - DNA, 22 bp, Artificial Sequence
  chemically synthesized
agctagcctaaaatattcaaca

SEQ ID NO: 985189 - DNA, 22 bp, Artificial Sequence
  chemically synthesized
gagctagcctaaaatattcaac

SEQ ID NO: 985190 - DNA, 22 bp, Artificial Sequence
  chemically synthesized
aagttgttgaatattttaggct

SEQ ID NO: 985191 - DNA, 22 bp, Artificial Sequence
  chemically synthesized
agtatttgagctagcctaaaat

SEQ ID NO: 985192 - DNA, 22 bp, Artificial Sequence
  chemically synthesized
agttgttgaatattttaggcta

SEQ ID NO: 985193 - DNA, 22 bp, Artificial Sequence
  chemically synthesized
ttgaatattttaggctagctca

SEQ ID NO: 985194 - DNA, 22 bp, Artificial Sequence
  chemically synthesized
aagttaagtatttgagctagcc

SEQ ID NO: 985195 - DNA, 22 bp, Artificial Sequence
  chemically synthesized
aatattttaggctagctcaaat

SEQ ID NO: 985196 - DNA, 22 bp, Artificial Sequence
  chemically synthesized
taggctagctcaaatacttaac

SEQ ID NO: 985197 - DNA, 22 bp, Artificial Sequence
  chemically synthesized
aggctagctcaaatacttaact

SEQ ID NO: 985198 - DNA, 22 bp, Artificial Sequence
  chemically synthesized
atagaaaattaaagttaagtat

SEQ ID NO: 985199 - DNA, 22 bp, Artificial Sequence
  chemically synthesized
ggctagctcaaatacttaactt

SEQ ID NO: 985200 - DNA, 22 bp, Artificial Sequence
  chemically synthesized
aatagaaaattaaagttaagta

SEQ ID NO: 985201 - DNA, 22 bp, Artificial Sequence
  chemically synthesized
taatagaaaattaaagttaagt

SEQ ID NO: 985202 - DNA, 22 bp, Artificial Sequence
  chemically synthesized
gctcaaatacttaactttaatt

SEQ ID NO: 985203 - DNA, 22 bp, Artificial Sequence
  chemically synthesized
aaatacttaactttaattttct

SEQ ID NO: 985204 - DNA, 22 bp, Artificial Sequence
  chemically synthesized
aactttaattttctattaaaat

SEQ ID NO: 985205 - DNA, 22 bp, Artificial Sequence
  chemically synthesized
aataaggtatatattttaatag

SEQ ID NO: 985206 - DNA, 22 bp, Artificial Sequence
  chemically synthesized
actttaattttctattaaaata

SEQ ID NO: 985207 - DNA, 22 bp, Artificial Sequence
  chemically synthesized
taattttctattaaaatatata

SEQ ID NO: 985208 - DNA, 22 bp, Artificial Sequence
  chemically synthesized
aattttctattaaaatatatac

SEQ ID NO: 985209 - DNA, 22 bp, Artificial Sequence
  chemically synthesized
gcattaaataaggtatatattt

SEQ ID NO: 985210 - DNA, 22 bp, Artificial Sequence
  chemically synthesized
attttctattaaaatatatacc

SEQ ID NO: 985211 - DNA, 22 bp, Artificial Sequence
  chemically synthesized
tctattaaaatatataccttat

SEQ ID NO: 985212 - DNA, 22 bp, Artificial Sequence
  chemically synthesized
ctattaaaatatataccttatt

SEQ ID NO: 985213 - DNA, 22 bp, Artificial Sequence
  chemically synthesized
tattaaaatatataccttattt

SEQ ID NO: 985214 - DNA, 22 bp, Artificial Sequence
  chemically synthesized
ttaaaatatataccttatttaa

SEQ ID NO: 985215 - DNA, 22 bp, Artificial Sequence
  chemically synthesized
gataccattagcattaaataag

SEQ ID NO: 985216 - DNA, 22 bp, Artificial Sequence
  chemically synthesized
aaatatataccttatttaatgc

SEQ ID NO: 985217 - DNA, 22 bp, Artificial Sequence
  chemically synthesized
caaattagataccattagcatt

SEQ ID NO: 985218 - DNA, 22 bp, Artificial Sequence
  chemically synthesized
atttaatgctaatggtatctaa

SEQ ID NO: 985219 - DNA, 22 bp, Artificial Sequence
  chemically synthesized
tttaatgctaatggtatctaat

SEQ ID NO: 985220 - DNA, 22 bp, Artificial Sequence
  chemically synthesized
aatgctaatggtatctaatttg

SEQ ID NO: 985221 - DNA, 22 bp, Artificial Sequence
  chemically synthesized
atgctaatggtatctaatttgc

SEQ ID NO: 985222 - DNA, 22 bp, Artificial Sequence
  chemically synthesized
atggtatctaatttgcagctat

SEQ ID NO: 985223 - DNA, 22 bp, Artificial Sequence
  chemically synthesized
tgtgtatagtaacgatagctgc

SEQ ID NO: 985224 - DNA, 22 bp, Artificial Sequence
  chemically synthesized
atgtgtatagtaacgatagctg

SEQ ID NO: 985225 - DNA, 22 bp, Artificial Sequence
  chemically synthesized
atttgcagctatcgttactata

SEQ ID NO: 985226 - DNA, 22 bp, Artificial Sequence
  chemically synthesized
tgcagtttatgtgtatagtaac

SEQ ID NO: 985227 - DNA, 22 bp, Artificial Sequence
  chemically synthesized
gtgcagtttatgtgtatagtaa

SEQ ID NO: 985228 - DNA, 22 bp, Artificial Sequence
  chemically synthesized
gcagctatcgttactatacaca

SEQ ID NO: 985229 - DNA, 22 bp, Artificial Sequence
  chemically synthesized
cagctatcgttactatacacat

SEQ ID NO: 985230 - DNA, 22 bp, Artificial Sequence
  chemically synthesized
atttgtgcagtttatgtgtata

SEQ ID NO: 985231 - DNA, 22 bp, Artificial Sequence
  chemically synthesized
gatttgtgcagtttatgtgtat

SEQ ID NO: 985232 - DNA, 22 bp, Artificial Sequence
  chemically synthesized
tgatttgtgcagtttatgtgta

SEQ ID NO: 985233 - DNA, 22 bp, Artificial Sequence
  chemically synthesized
tcgttactatacacataaactg

SEQ ID NO: 985234 - DNA, 22 bp, Artificial Sequence
  chemically synthesized
ttttgatttgtgcagtttatgt

SEQ ID NO: 985235 - DNA, 22 bp, Artificial Sequence
  chemically synthesized
attttgatttgtgcagtttatg

SEQ ID NO: 985236 - DNA, 22 bp, Artificial Sequence
  chemically synthesized
tttattttgatttgtgcagttt

SEQ ID NO: 985237 - DNA, 22 bp, Artificial Sequence
  chemically synthesized
ctatacacataaactgcacaaa

SEQ ID NO: 985238 - DNA, 22 bp, Artificial Sequence
  chemically synthesized
tatttattttgatttgtgcagt

SEQ ID NO: 985239 - DNA, 22 bp, Artificial Sequence
  chemically synthesized
ctatttattttgatttgtgcag

SEQ ID NO: 985240 - DNA, 22 bp, Artificial Sequence
  chemically synthesized
tctatttattttgatttgtgca

SEQ ID NO: 985241 - DNA, 22 bp, Artificial Sequence
  chemically synthesized
tacacataaactgcacaaatca

SEQ ID NO: 985242 - DNA, 22 bp, Artificial Sequence
  chemically synthesized
ttttctatttattttgatttgt

SEQ ID NO: 985243 - DNA, 22 bp, Artificial Sequence
  chemically synthesized
gttttctatttattttgatttg

SEQ ID NO: 985244 - DNA, 22 bp, Artificial Sequence
  chemically synthesized
atatttgttttctatttatttt

SEQ ID NO: 985245 - DNA, 22 bp, Artificial Sequence
  chemically synthesized
ttaatatttgttttctatttat

SEQ ID NO: 985246 - DNA, 22 bp, Artificial Sequence
  chemically synthesized
cacaaatcaaaataaatagaaa

SEQ ID NO: 985247 - DNA, 22 bp, Artificial Sequence
  chemically synthesized
attaatatttgttttctattta

SEQ ID NO: 985248 - DNA, 22 bp, Artificial Sequence
  chemically synthesized
tattaatatttgttttctattt

SEQ ID NO: 985249 - DNA, 22 bp, Artificial Sequence
  chemically synthesized
aattttattaatatttgttttc

SEQ ID NO: 985250 - DNA, 22 bp, Artificial Sequence
  chemically synthesized
atgactaaattttattaatatt

SEQ ID NO: 985251 - DNA, 22 bp, Artificial Sequence
  chemically synthesized
ataaaatttagtcattaaccct

SEQ ID NO: 985252 - DNA, 22 bp, Artificial Sequence
  chemically synthesized
taacatgtcatccagaagggtt

SEQ ID NO: 985253 - DNA, 22 bp, Artificial Sequence
  chemically synthesized
attataacatgtcatccagaag

SEQ ID NO: 985254 - DNA, 22 bp, Artificial Sequence
  chemically synthesized
agtcattaacccttctggatga

SEQ ID NO: 985255 - DNA, 22 bp, Artificial Sequence
  chemically synthesized
gtcattaacccttctggatgac

SEQ ID NO: 985256 - DNA, 22 bp, Artificial Sequence
  chemically synthesized
atatcctaattataacatgtca

SEQ ID NO: 985257 - DNA, 22 bp, Artificial Sequence
  chemically synthesized
acccttctggatgacatgttat

SEQ ID NO: 985258 - DNA, 22 bp, Artificial Sequence
  chemically synthesized
caattaatatcctaattataac

SEQ ID NO: 985259 - DNA, 22 bp, Artificial Sequence
  chemically synthesized
ctggatgacatgttataattag

SEQ ID NO: 985260 - DNA, 22 bp, Artificial Sequence
  chemically synthesized
tggatgacatgttataattagg

SEQ ID NO: 985261 - DNA, 22 bp, Artificial Sequence
  chemically synthesized
gatgacatgttataattaggat

SEQ ID NO: 985262 - DNA, 22 bp, Artificial Sequence
  chemically synthesized
taatgccaattccaattaatat

SEQ ID NO: 985263 - DNA, 22 bp, Artificial Sequence
  chemically synthesized
ataatgccaattccaattaata

SEQ ID NO: 985264 - DNA, 22 bp, Artificial Sequence
  chemically synthesized
tataatgccaattccaattaat

SEQ ID NO: 985265 - DNA, 22 bp, Artificial Sequence
  chemically synthesized
taattaggatattaattggaat

SEQ ID NO: 985266 - DNA, 22 bp, Artificial Sequence
  chemically synthesized
ggatattaattggaattggcat

SEQ ID NO: 985267 - DNA, 22 bp, Artificial Sequence
  chemically synthesized
aatggttttataatgccaattc

SEQ ID NO: 985268 - DNA, 22 bp, Artificial Sequence
  chemically synthesized
taaatggttttataatgccaat

SEQ ID NO: 985269 - DNA, 22 bp, Artificial Sequence
  chemically synthesized
attggaattggcattataaaac

SEQ ID NO: 985270 - DNA, 22 bp, Artificial Sequence
  chemically synthesized
gaattggcattataaaaccatt

SEQ ID NO: 985271 - DNA, 22 bp, Artificial Sequence
  chemically synthesized
atacaacgaattctaaatggtt

SEQ ID NO: 985272 - DNA, 22 bp, Artificial Sequence
  chemically synthesized
aatacaacgaattctaaatggt

SEQ ID NO: 985273 - DNA, 22 bp, Artificial Sequence
  chemically synthesized
taatacaacgaattctaaatgg

SEQ ID NO: 985274 - DNA, 22 bp, Artificial Sequence
  chemically synthesized
gcattataaaaccatttagaat

SEQ ID NO: 985275 - DNA, 22 bp, Artificial Sequence
  chemically synthesized
ttaatacaacgaattctaaatg

SEQ ID NO: 985276 - DNA, 22 bp, Artificial Sequence
  chemically synthesized
tttaatacaacgaattctaaat

SEQ ID NO: 985277 - DNA, 22 bp, Artificial Sequence
  chemically synthesized
ttttaatacaacgaattctaaa

SEQ ID NO: 985278 - DNA, 22 bp, Artificial Sequence
  chemically synthesized
taaaaccatttagaattcgttg

SEQ ID NO: 985279 - DNA, 22 bp, Artificial Sequence
  chemically synthesized
tggaatcagatttttttaatac

SEQ ID NO: 985280 - DNA, 22 bp, Artificial Sequence
  chemically synthesized
atggaatcagatttttttaata

SEQ ID NO: 985281 - DNA, 22 bp, Artificial Sequence
  chemically synthesized
agaattcgttgtattaaaaaaa

SEQ ID NO: 985282 - DNA, 22 bp, Artificial Sequence
  chemically synthesized
gaattcgttgtattaaaaaaat

SEQ ID NO: 985283 - DNA, 22 bp, Artificial Sequence
  chemically synthesized
gttgtattaaaaaaatctgatt

SEQ ID NO: 985284 - DNA, 22 bp, Artificial Sequence
  chemically synthesized
cccatgatttatggaatcagat

SEQ ID NO: 985285 - DNA, 22 bp, Artificial Sequence
  chemically synthesized
tattaaaaaaatctgattccat

SEQ ID NO: 985286 - DNA, 22 bp, Artificial Sequence
  chemically synthesized
aaaaaatctgattccataaatc

SEQ ID NO: 985287 - DNA, 22 bp, Artificial Sequence
  chemically synthesized
aaataaaaaattccccatgatt

SEQ ID NO: 985288 - DNA, 22 bp, Artificial Sequence
  chemically synthesized
attccataaatcatggggaatt

SEQ ID NO: 985289 - DNA, 22 bp, Artificial Sequence
  chemically synthesized
cataaatcatggggaatttttt

SEQ ID NO: 985290 - DNA, 22 bp, Artificial Sequence
  chemically synthesized
atacatgggtcattaaaataaa

SEQ ID NO: 985291 - DNA, 22 bp, Artificial Sequence
  chemically synthesized
taagtctaatacatgggtcatt

SEQ ID NO: 985292 - DNA, 22 bp, Artificial Sequence
  chemically synthesized
tgtaagtctaatacatgggtca

SEQ ID NO: 985293 - DNA, 22 bp, Artificial Sequence
  chemically synthesized
ctgtaagtctaatacatgggtc

SEQ ID NO: 985294 - DNA, 22 bp, Artificial Sequence
  chemically synthesized
tttattttaatgacccatgtat

SEQ ID NO: 985295 - DNA, 22 bp, Artificial Sequence
  chemically synthesized
tctgtaagtctaatacatgggt

SEQ ID NO: 985296 - DNA, 22 bp, Artificial Sequence
  chemically synthesized
ttattttaatgacccatgtatt

SEQ ID NO: 985297 - DNA, 22 bp, Artificial Sequence
  chemically synthesized
tattttaatgacccatgtatta

SEQ ID NO: 985298 - DNA, 22 bp, Artificial Sequence
  chemically synthesized
attttaatgacccatgtattag

SEQ ID NO: 985299 - DNA, 22 bp, Artificial Sequence
  chemically synthesized
ttttaatgacccatgtattaga

SEQ ID NO: 985300 - DNA, 22 bp, Artificial Sequence
  chemically synthesized
taatgacccatgtattagactt

SEQ ID NO: 985301 - DNA, 22 bp, Artificial Sequence
  chemically synthesized
aatgacccatgtattagactta

SEQ ID NO: 985302 - DNA, 22 bp, Artificial Sequence
  chemically synthesized
atgacccatgtattagacttac

SEQ ID NO: 985303 - DNA, 22 bp, Artificial Sequence
  chemically synthesized
aggtccacaattttctgtaagt

SEQ ID NO: 985304 - DNA, 22 bp, Artificial Sequence
  chemically synthesized
aaggtccacaattttctgtaag

SEQ ID NO: 985305 - DNA, 22 bp, Artificial Sequence
  chemically synthesized
cttaaggtccacaattttctgt

SEQ ID NO: 985306 - DNA, 22 bp, Artificial Sequence
  chemically synthesized
gacttacagaaaattgtggacc

SEQ ID NO: 985307 - DNA, 22 bp, Artificial Sequence
  chemically synthesized
ataaaacattacttaaggtcca

SEQ ID NO: 985308 - DNA, 22 bp, Artificial Sequence
  chemically synthesized
acagaaaattgtggaccttaag

SEQ ID NO: 985309 - DNA, 22 bp, Artificial Sequence
  chemically synthesized
aataaaacattacttaaggtcc

SEQ ID NO: 985310 - DNA, 22 bp, Artificial Sequence
  chemically synthesized
cagaaaattgtggaccttaagt

SEQ ID NO: 985311 - DNA, 22 bp, Artificial Sequence
  chemically synthesized
taataaaacattacttaaggtc

SEQ ID NO: 985312 - DNA, 22 bp, Artificial Sequence
  chemically synthesized
tggaccttaagtaatgttttat

SEQ ID NO: 985313 - DNA, 22 bp, Artificial Sequence
  chemically synthesized
aatagcagaacattttaataaa

SEQ ID NO: 985314 - DNA, 22 bp, Artificial Sequence
  chemically synthesized
aagtaatgttttattaaaatgt

SEQ ID NO: 985315 - DNA, 22 bp, Artificial Sequence
  chemically synthesized
agtaatgttttattaaaatgtt

SEQ ID NO: 985316 - DNA, 22 bp, Artificial Sequence
  chemically synthesized
tattaaaatgttctgctattta

SEQ ID NO: 985317 - DNA, 22 bp, Artificial Sequence
  chemically synthesized
aatatgacaaattaaatagcag

SEQ ID NO: 985318 - DNA, 22 bp, Artificial Sequence
  chemically synthesized
attaaaatgttctgctatttaa

SEQ ID NO: 985319 - DNA, 22 bp, Artificial Sequence
  chemically synthesized
aaatatgacaaattaaatagca

SEQ ID NO: 985320 - DNA, 22 bp, Artificial Sequence
  chemically synthesized
ttaaaatgttctgctatttaat

SEQ ID NO: 985321 - DNA, 22 bp, Artificial Sequence
  chemically synthesized
taaatatgacaaattaaatagc

SEQ ID NO: 985322 - DNA, 22 bp, Artificial Sequence
  chemically synthesized
ttaaatatgacaaattaaatag

SEQ ID NO: 985323 - DNA, 22 bp, Artificial Sequence
  chemically synthesized
aaatgttctgctatttaatttg

SEQ ID NO: 985324 - DNA, 22 bp, Artificial Sequence
  chemically synthesized
tttttaaatatgacaaattaaa

SEQ ID NO: 985325 - DNA, 22 bp, Artificial Sequence
  chemically synthesized
gctatttttaaatatgacaaat

SEQ ID NO: 985326 - DNA, 22 bp, Artificial Sequence
  chemically synthesized
agctatttttaaatatgacaaa

SEQ ID NO: 985327 - DNA, 22 bp, Artificial Sequence
  chemically synthesized
tagctatttttaaatatgacaa

SEQ ID NO: 985328 - DNA, 22 bp, Artificial Sequence
  chemically synthesized
tgctatttaatttgtcatattt

SEQ ID NO: 985329 - DNA, 22 bp, Artificial Sequence
  chemically synthesized
ctatttaatttgtcatatttaa

SEQ ID NO: 985330 - DNA, 22 bp, Artificial Sequence
  chemically synthesized
tttaatttgtcatatttaaaaa

SEQ ID NO: 985331 - DNA, 22 bp, Artificial Sequence
  chemically synthesized
tgattttagctatttttaaata

SEQ ID NO: 985332 - DNA, 22 bp, Artificial Sequence
  chemically synthesized
aatttgtcatatttaaaaatag

SEQ ID NO: 985333 - DNA, 22 bp, Artificial Sequence
  chemically synthesized
atttgtcatatttaaaaatagc

SEQ ID NO: 985334 - DNA, 22 bp, Artificial Sequence
  chemically synthesized
aaactatgattttagctatttt

SEQ ID NO: 985335 - DNA, 22 bp, Artificial Sequence
  chemically synthesized
gtcatatttaaaaatagctaaa

SEQ ID NO: 985336 - DNA, 22 bp, Artificial Sequence
  chemically synthesized
tcatatttaaaaatagctaaaa

SEQ ID NO: 985337 - DNA, 22 bp, Artificial Sequence
  chemically synthesized
aaattaaaactatgattttagc

SEQ ID NO: 985338 - DNA, 22 bp, Artificial Sequence
  chemically synthesized
ctaaaattaaaactatgatttt

SEQ ID NO: 985339 - DNA, 22 bp, Artificial Sequence
  chemically synthesized
aaaaatagctaaaatcatagtt

SEQ ID NO: 985340 - DNA, 22 bp, Artificial Sequence
  chemically synthesized
aaaatagctaaaatcatagttt

SEQ ID NO: 985341 - DNA, 22 bp, Artificial Sequence
  chemically synthesized
aaatcatagttttaattttagt

SEQ ID NO: 985342 - DNA, 22 bp, Artificial Sequence
  chemically synthesized
gaacacaatgaaaaatattact

SEQ ID NO: 985343 - DNA, 22 bp, Artificial Sequence
  chemically synthesized
agaacacaatgaaaaatattac

SEQ ID NO: 985344 - DNA, 22 bp, Artificial Sequence
  chemically synthesized
cttagaacacaatgaaaaatat

SEQ ID NO: 985345 - DNA, 22 bp, Artificial Sequence
  chemically synthesized
taattttagtaatatttttcat

SEQ ID NO: 985346 - DNA, 22 bp, Artificial Sequence
  chemically synthesized
acttagaacacaatgaaaaata

SEQ ID NO: 985347 - DNA, 22 bp, Artificial Sequence
  chemically synthesized
aattttagtaatatttttcatt

SEQ ID NO: 985348 - DNA, 22 bp, Artificial Sequence
  chemically synthesized
attttagtaatatttttcattg

SEQ ID NO: 985349 - DNA, 22 bp, Artificial Sequence
  chemically synthesized
gcttacttagaacacaatgaaa

SEQ ID NO: 985350 - DNA, 22 bp, Artificial Sequence
  chemically synthesized
tagtaatatttttcattgtgtt

SEQ ID NO: 985351 - DNA, 22 bp, Artificial Sequence
  chemically synthesized
agtaatatttttcattgtgttc

SEQ ID NO: 985352 - DNA, 22 bp, Artificial Sequence
  chemically synthesized
gtaatatttttcattgtgttct

SEQ ID NO: 985353 - DNA, 22 bp, Artificial Sequence
  chemically synthesized
agggttggcttacttagaacac

SEQ ID NO: 985354 - DNA, 22 bp, Artificial Sequence
  chemically synthesized
aagggttggcttacttagaaca

SEQ ID NO: 985355 - DNA, 22 bp, Artificial Sequence
  chemically synthesized
ttcattgtgttctaagtaagcc

SEQ ID NO: 985356 - DNA, 22 bp, Artificial Sequence
  chemically synthesized
tcattgtgttctaagtaagcca

SEQ ID NO: 985357 - DNA, 22 bp, Artificial Sequence
  chemically synthesized
atgtttaagggttggcttactt

SEQ ID NO: 985358 - DNA, 22 bp, Artificial Sequence
  chemically synthesized
cattgtgttctaagtaagccaa

SEQ ID NO: 985359 - DNA, 22 bp, Artificial Sequence
  chemically synthesized
gatgtttaagggttggcttact

SEQ ID NO: 985360 - DNA, 22 bp, Artificial Sequence
  chemically synthesized
attgtgttctaagtaagccaac

SEQ ID NO: 985361 - DNA, 22 bp, Artificial Sequence
  chemically synthesized
tgttctaagtaagccaaccctt

SEQ ID NO: 985362 - DNA, 22 bp, Artificial Sequence
  chemically synthesized
taagtaagccaacccttaaaca

SEQ ID NO: 985363 - DNA, 22 bp, Artificial Sequence
  chemically synthesized
agtaagccaacccttaaacatc

SEQ ID NO: 985364 - DNA, 22 bp, Artificial Sequence
  chemically synthesized
aaacatcaaatgctttcttttg

SEQ ID NO: 985365 - DNA, 22 bp, Artificial Sequence
  chemically synthesized
aacatcaaatgctttcttttgg

SEQ ID NO: 985366 - DNA, 22 bp, Artificial Sequence
  chemically synthesized
aaaagacatatcccaaaagaaa

SEQ ID NO: 985367 - DNA, 22 bp, Artificial Sequence
  chemically synthesized
tcttttgggatatgtcttttca

SEQ ID NO: 985368 - DNA, 22 bp, Artificial Sequence
  chemically synthesized
cttttgggatatgtcttttcaa

SEQ ID NO: 985369 - DNA, 22 bp, Artificial Sequence
  chemically synthesized
ttttgggatatgtcttttcaac

SEQ ID NO: 985370 - DNA, 22 bp, Artificial Sequence
  chemically synthesized
agggaaccagaagttgaaaaga

SEQ ID NO: 985371 - DNA, 22 bp, Artificial Sequence
  chemically synthesized
ttgggatatgtcttttcaactt

SEQ ID NO: 985372 - DNA, 22 bp, Artificial Sequence
  chemically synthesized
tgggatatgtcttttcaacttc

SEQ ID NO: 985373 - DNA, 22 bp, Artificial Sequence
  chemically synthesized
gggatatgtcttttcaacttct

SEQ ID NO: 985374 - DNA, 22 bp, Artificial Sequence
  chemically synthesized
ggatatgtcttttcaacttctg

SEQ ID NO: 985375 - DNA, 22 bp, Artificial Sequence
  chemically synthesized
ttcaacttctggttccctcagg

SEQ ID NO: 985376 - DNA, 22 bp, Artificial Sequence
  chemically synthesized
tcaacttctggttccctcaggt

SEQ ID NO: 985377 - DNA, 22 bp, Artificial Sequence
  chemically synthesized
caacttctggttccctcaggtt

SEQ ID NO: 985378 - DNA, 22 bp, Artificial Sequence
  chemically synthesized
aacttctggttccctcaggttt

SEQ ID NO: 985379 - DNA, 22 bp, Artificial Sequence
  chemically synthesized
gaatgtcaatggatcaaacctg

SEQ ID NO: 985380 - DNA, 22 bp, Artificial Sequence
  chemically synthesized
ctggttccctcaggtttgatcc

SEQ ID NO: 985381 - DNA, 22 bp, Artificial Sequence
  chemically synthesized
tggttccctcaggtttgatcca

SEQ ID NO: 985382 - DNA, 22 bp, Artificial Sequence
  chemically synthesized
gttccctcaggtttgatccatt

SEQ ID NO: 985383 - DNA, 22 bp, Artificial Sequence
  chemically synthesized
cctcaggtttgatccattgaca

SEQ ID NO: 985384 - DNA, 22 bp, Artificial Sequence
  chemically synthesized
aggtttgatccattgacattct

SEQ ID NO: 985385 - DNA, 22 bp, Artificial Sequence
  chemically synthesized
gatccattgacattctaggcac

SEQ ID NO: 985386 - DNA, 22 bp, Artificial Sequence
  chemically synthesized
atccattgacattctaggcact

SEQ ID NO: 985387 - DNA, 22 bp, Artificial Sequence
  chemically synthesized
ggtgggacacaccaacagtgcc

SEQ ID NO: 985388 - DNA, 22 bp, Artificial Sequence
  chemically synthesized
acattctaggcactgttggtgt

SEQ ID NO: 985389 - DNA, 22 bp, Artificial Sequence
  chemically synthesized
taggcactgttggtgtgtccca

SEQ ID NO: 985390 - DNA, 22 bp, Artificial Sequence
  chemically synthesized
gtatatactaggtgggacacac

SEQ ID NO: 985391 - DNA, 22 bp, Artificial Sequence
  chemically synthesized
ggcactgttggtgtgtcccacc

SEQ ID NO: 985392 - DNA, 22 bp, Artificial Sequence
  chemically synthesized
gctggtatatactaggtgggac

SEQ ID NO: 985393 - DNA, 22 bp, Artificial Sequence
  chemically synthesized
ttggtgtgtcccacctagtata

SEQ ID NO: 985394 - DNA, 22 bp, Artificial Sequence
  chemically synthesized
gtgtgtcccacctagtatatac

SEQ ID NO: 985395 - DNA, 22 bp, Artificial Sequence
  chemically synthesized
gtatataccagccaggccttct

SEQ ID NO: 985396 - DNA, 22 bp, Artificial Sequence
  chemically synthesized
cccagggggcatgataaagaag

SEQ ID NO: 985397 - DNA, 22 bp, Artificial Sequence
  chemically synthesized
gcccagggggcatgataaagaa

SEQ ID NO: 985398 - DNA, 22 bp, Artificial Sequence
  chemically synthesized
tgcccagggggcatgataaaga

SEQ ID NO: 985399 - DNA, 22 bp, Artificial Sequence
  chemically synthesized
tttgcccagggggcatgataaa

SEQ ID NO: 985400 - DNA, 22 bp, Artificial Sequence
  chemically synthesized
ctttgcccagggggcatgataa

SEQ ID NO: 985401 - DNA, 22 bp, Artificial Sequence
  chemically synthesized
tctttgcccagggggcatgata

SEQ ID NO: 985402 - DNA, 22 bp, Artificial Sequence
  chemically synthesized
ttctttgcccagggggcatgat

SEQ ID NO: 985403 - DNA, 22 bp, Artificial Sequence
  chemically synthesized
ctttatcatgccccctgggcaa

SEQ ID NO: 985404 - DNA, 22 bp, Artificial Sequence
  chemically synthesized
tttatcatgccccctgggcaaa

SEQ ID NO: 985405 - DNA, 22 bp, Artificial Sequence
  chemically synthesized
tatcatgccccctgggcaaaga

SEQ ID NO: 985406 - DNA, 22 bp, Artificial Sequence
  chemically synthesized
atcatgccccctgggcaaagaa

SEQ ID NO: 985407 - DNA, 22 bp, Artificial Sequence
  chemically synthesized
tcatgccccctgggcaaagaaa

SEQ ID NO: 985408 - DNA, 22 bp, Artificial Sequence
  chemically synthesized
gtataaatggaatcagtttttc

SEQ ID NO: 985409 - DNA, 22 bp, Artificial Sequence
  chemically synthesized
tagtataaatggaatcagtttt

SEQ ID NO: 985410 - DNA, 22 bp, Artificial Sequence
  chemically synthesized
ttctagtataaatggaatcagt

SEQ ID NO: 985411 - DNA, 22 bp, Artificial Sequence
  chemically synthesized
ggcaaagaaaaactgattccat

SEQ ID NO: 985412 - DNA, 22 bp, Artificial Sequence
  chemically synthesized
attccatttatactagaataat

SEQ ID NO: 985413 - DNA, 22 bp, Artificial Sequence
  chemically synthesized
catttatactagaataatatca

SEQ ID NO: 985414 - DNA, 22 bp, Artificial Sequence
  chemically synthesized
atactagaataatatcattgtt

SEQ ID NO: 985415 - DNA, 22 bp, Artificial Sequence
  chemically synthesized
tactagaataatatcattgttg

SEQ ID NO: 985416 - DNA, 22 bp, Artificial Sequence
  chemically synthesized
ggtaataagtagtgacaacaat

SEQ ID NO: 985417 - DNA, 22 bp, Artificial Sequence
  chemically synthesized
gaataatatcattgttgtcact

SEQ ID NO: 985418 - DNA, 22 bp, Artificial Sequence
  chemically synthesized
cctaggtaataagtagtgacaa

SEQ ID NO: 985419 - DNA, 22 bp, Artificial Sequence
  chemically synthesized
ttgtcactacttattacctagg

SEQ ID NO: 985420 - DNA, 22 bp, Artificial Sequence
  chemically synthesized
tcactacttattacctaggcaa

SEQ ID NO: 985421 - DNA, 22 bp, Artificial Sequence
  chemically synthesized
cttattacctaggcaattggtc

SEQ ID NO: 985422 - DNA, 22 bp, Artificial Sequence
  chemically synthesized
attacctaggcaattggtcaca

SEQ ID NO: 985423 - DNA, 22 bp, Artificial Sequence
  chemically synthesized
ttacctaggcaattggtcacac

SEQ ID NO: 985424 - DNA, 22 bp, Artificial Sequence
  chemically synthesized
cctaggcaattggtcacactct

SEQ ID NO: 985425 - DNA, 22 bp, Artificial Sequence
  chemically synthesized
ggcaattggtcacactctactc

SEQ ID NO: 985426 - DNA, 22 bp, Artificial Sequence
  chemically synthesized
gtcacactctactcccttctta

SEQ ID NO: 985427 - DNA, 22 bp, Artificial Sequence
  chemically synthesized
atgaaagtaccataagaaggga

SEQ ID NO: 985428 - DNA, 22 bp, Artificial Sequence
  chemically synthesized
aatgaaagtaccataagaaggg

SEQ ID NO: 985429 - DNA, 22 bp, Artificial Sequence
  chemically synthesized
tactcccttcttatggtacttt

SEQ ID NO: 985430 - DNA, 22 bp, Artificial Sequence
  chemically synthesized
ctcccttcttatggtactttca

SEQ ID NO: 985431 - DNA, 22 bp, Artificial Sequence
  chemically synthesized
ccttcttatggtactttcatta

SEQ ID NO: 985432 - DNA, 22 bp, Artificial Sequence
  chemically synthesized
cttatggtactttcattaaggc

SEQ ID NO: 985433 - DNA, 22 bp, Artificial Sequence
  chemically synthesized
ttatggtactttcattaaggca

SEQ ID NO: 985434 - DNA, 22 bp, Artificial Sequence
  chemically synthesized
ataaaggaacatatgccttaat

SEQ ID NO: 985435 - DNA, 22 bp, Artificial Sequence
  chemically synthesized
atggtactttcattaaggcata

SEQ ID NO: 985436 - DNA, 22 bp, Artificial Sequence
  chemically synthesized
cataaaggaacatatgccttaa

SEQ ID NO: 985437 - DNA, 22 bp, Artificial Sequence
  chemically synthesized
tggtactttcattaaggcatat

SEQ ID NO: 985438 - DNA, 22 bp, Artificial Sequence
  chemically synthesized
tcataaaggaacatatgcctta

SEQ ID NO: 985439 - DNA, 22 bp, Artificial Sequence
  chemically synthesized
ttcataaaggaacatatgcctt

SEQ ID NO: 985440 - DNA, 22 bp, Artificial Sequence
  chemically synthesized
tcattaaggcatatgttccttt

SEQ ID NO: 985441 - DNA, 22 bp, Artificial Sequence
  chemically synthesized
cattaaggcatatgttccttta

SEQ ID NO: 985442 - DNA, 22 bp, Artificial Sequence
  chemically synthesized
attaaggcatatgttcctttat

SEQ ID NO: 985443 - DNA, 22 bp, Artificial Sequence
  chemically synthesized
aggcatatgttcctttatgaaa

SEQ ID NO: 985444 - DNA, 22 bp, Artificial Sequence
  chemically synthesized
ccaggaatggaatgtttttcat

SEQ ID NO: 985445 - DNA, 22 bp, Artificial Sequence
  chemically synthesized
ggctgccaggaatggaatgttt

SEQ ID NO: 985446 - DNA, 22 bp, Artificial Sequence
  chemically synthesized
cggctgccaggaatggaatgtt

SEQ ID NO: 985447 - DNA, 22 bp, Artificial Sequence
  chemically synthesized
ctttatgaaaaacattccattc

SEQ ID NO: 985448 - DNA, 22 bp, Artificial Sequence
  chemically synthesized
acttcggctgccaggaatggaa

SEQ ID NO: 985449 - DNA, 22 bp, Artificial Sequence
  chemically synthesized
tatgaaaaacattccattcctg

SEQ ID NO: 985450 - DNA, 22 bp, Artificial Sequence
  chemically synthesized
atgaaaaacattccattcctgg

SEQ ID NO: 985451 - DNA, 22 bp, Artificial Sequence
  chemically synthesized
tgaaaaacattccattcctggc

SEQ ID NO: 985452 - DNA, 22 bp, Artificial Sequence
  chemically synthesized
tagattgacttcggctgccagg

SEQ ID NO: 985453 - DNA, 22 bp, Artificial Sequence
  chemically synthesized
gtagattgacttcggctgccag

SEQ ID NO: 985454 - DNA, 22 bp, Artificial Sequence
  chemically synthesized
tttgtagattgacttcggctgc

SEQ ID NO: 985455 - DNA, 22 bp, Artificial Sequence
  chemically synthesized
cattcctggcagccgaagtcaa

SEQ ID NO: 985456 - DNA, 22 bp, Artificial Sequence
  chemically synthesized
gctatttgtagattgacttcgg

SEQ ID NO: 985457 - DNA, 22 bp, Artificial Sequence
  chemically synthesized
cctggctatttgtagattgact

SEQ ID NO: 985458 - DNA, 22 bp, Artificial Sequence
  chemically synthesized
ctggcagccgaagtcaatctac

SEQ ID NO: 985459 - DNA, 22 bp, Artificial Sequence
  chemically synthesized
ctacctggctatttgtagattg

SEQ ID NO: 985460 - DNA, 22 bp, Artificial Sequence
  chemically synthesized
gcagccgaagtcaatctacaaa

SEQ ID NO: 985461 - DNA, 22 bp, Artificial Sequence
  chemically synthesized
gctacctggctatttgtagatt

SEQ ID NO: 985462 - DNA, 22 bp, Artificial Sequence
  chemically synthesized
atttgctacctggctatttgta

SEQ ID NO: 985463 - DNA, 22 bp, Artificial Sequence
  chemically synthesized
cattgatttgctacctggctat

SEQ ID NO: 985464 - DNA, 22 bp, Artificial Sequence
  chemically synthesized
taatctgcattgatttgctacc

SEQ ID NO: 985465 - DNA, 22 bp, Artificial Sequence
  chemically synthesized
gtaatctgcattgatttgctac

SEQ ID NO: 985466 - DNA, 22 bp, Artificial Sequence
  chemically synthesized
caaatagccaggtagcaaatca

SEQ ID NO: 985467 - DNA, 22 bp, Artificial Sequence
  chemically synthesized
ttgtaatctgcattgatttgct

SEQ ID NO: 985468 - DNA, 22 bp, Artificial Sequence
  chemically synthesized
tcttgtaatctgcattgatttg

SEQ ID NO: 985469 - DNA, 22 bp, Artificial Sequence
  chemically synthesized
ctcttgtaatctgcattgattt

SEQ ID NO: 985470 - DNA, 22 bp, Artificial Sequence
  chemically synthesized
tctcttgtaatctgcattgatt

SEQ ID NO: 985471 - DNA, 22 bp, Artificial Sequence
  chemically synthesized
actttctcttgtaatctgcatt

SEQ ID NO: 985472 - DNA, 22 bp, Artificial Sequence
  chemically synthesized
ttcactttctcttgtaatctgc

SEQ ID NO: 985473 - DNA, 22 bp, Artificial Sequence
  chemically synthesized
gttcactttctcttgtaatctg

SEQ ID NO: 985474 - DNA, 22 bp, Artificial Sequence
  chemically synthesized
cttgttcactttctcttgtaat

SEQ ID NO: 985475 - DNA, 22 bp, Artificial Sequence
  chemically synthesized
ttgcttgttcactttctcttgt

SEQ ID NO: 985476 - DNA, 22 bp, Artificial Sequence
  chemically synthesized
tgttgcttgttcactttctctt

SEQ ID NO: 985477 - DNA, 22 bp, Artificial Sequence
  chemically synthesized
atctctgttgcttgttcacttt

SEQ ID NO: 985478 - DNA, 22 bp, Artificial Sequence
  chemically synthesized
aatctctgttgcttgttcactt

SEQ ID NO: 985479 - DNA, 22 bp, Artificial Sequence
  chemically synthesized
tttaatctctgttgcttgttca

SEQ ID NO: 985480 - DNA, 22 bp, Artificial Sequence
  chemically synthesized
gtttaatctctgttgcttgttc

SEQ ID NO: 985481 - DNA, 22 bp, Artificial Sequence
  chemically synthesized
caagagaaagtgaacaagcaac

SEQ ID NO: 985482 - DNA, 22 bp, Artificial Sequence
  chemically synthesized
tgtttaatctctgttgcttgtt

SEQ ID NO: 985483 - DNA, 22 bp, Artificial Sequence
  chemically synthesized
ttttgtttaatctctgttgctt

SEQ ID NO: 985484 - DNA, 22 bp, Artificial Sequence
  chemically synthesized
gttttgtttaatctctgttgct

SEQ ID NO: 985485 - DNA, 22 bp, Artificial Sequence
  chemically synthesized
tgttttgtttaatctctgttgc

SEQ ID NO: 985486 - DNA, 22 bp, Artificial Sequence
  chemically synthesized
ttttgttttgtttaatctctgt

SEQ ID NO: 985487 - DNA, 22 bp, Artificial Sequence
  chemically synthesized
gttttgttttgtttaatctctg

SEQ ID NO: 985488 - DNA, 22 bp, Artificial Sequence
  chemically synthesized
tgttttgttttgtttaatctct

SEQ ID NO: 985489 - DNA, 22 bp, Artificial Sequence
  chemically synthesized
ttttgttttgttttgtttaatc

SEQ ID NO: 985490 - DNA, 22 bp, Artificial Sequence
  chemically synthesized
gttttgttttgttttgtttaat

SEQ ID NO: 985491 - DNA, 22 bp, Artificial Sequence
  chemically synthesized
tgttttgttttgttttgtttaa

SEQ ID NO: 985492 - DNA, 22 bp, Artificial Sequence
  chemically synthesized
ttttgttttgttttgttttgtt

SEQ ID NO: 985493 - DNA, 22 bp, Artificial Sequence
  chemically synthesized
gttttgttttgttttgttttgt

SEQ ID NO: 985494 - DNA, 22 bp, Artificial Sequence
  chemically synthesized
tgttttgttttgttttgttttg

SEQ ID NO: 985495 - DNA, 22 bp, Artificial Sequence
  chemically synthesized
ttttgttttgttttgttttgtt

SEQ ID NO: 985496 - DNA, 22 bp, Artificial Sequence
  chemically synthesized
gttttgttttgttttgttttgt

SEQ ID NO: 985497 - DNA, 22 bp, Artificial Sequence
  chemically synthesized
tgttttgttttgttttgttttg

SEQ ID NO: 985498 - DNA, 22 bp, Artificial Sequence
  chemically synthesized
ttttgttttgttttgttttgtt

SEQ ID NO: 985499 - DNA, 22 bp, Artificial Sequence
  chemically synthesized
gttttgttttgttttgttttgt

SEQ ID NO: 985500 - DNA, 22 bp, Artificial Sequence
  chemically synthesized
aacaaaacaaaacaaaacaaaa

SEQ ID NO: 985501 - DNA, 22 bp, Artificial Sequence
  chemically synthesized
tgttttgttttgttttgttttg

SEQ ID NO: 985502 - DNA, 22 bp, Artificial Sequence
  chemically synthesized
ttttgttttgttttgttttgtt

SEQ ID NO: 985503 - DNA, 22 bp, Artificial Sequence
  chemically synthesized
gttttgttttgttttgttttgt

SEQ ID NO: 985504 - DNA, 22 bp, Artificial Sequence
  chemically synthesized
tgttttgttttgttttgttttg

SEQ ID NO: 985505 - DNA, 22 bp, Artificial Sequence
  chemically synthesized
ttttgttttgttttgttttgtt

SEQ ID NO: 985506 - DNA, 22 bp, Artificial Sequence
  chemically synthesized
gttttgttttgttttgttttgt

SEQ ID NO: 985507 - DNA, 22 bp, Artificial Sequence
  chemically synthesized
acatttgttttgttttgttttg

SEQ ID NO: 985508 - DNA, 22 bp, Artificial Sequence
  chemically synthesized
taacatttgttttgttttgttt

SEQ ID NO: 985509 - DNA, 22 bp, Artificial Sequence
  chemically synthesized
aagtcacaatctctaacatttg

SEQ ID NO: 985510 - DNA, 22 bp, Artificial Sequence
  chemically synthesized
tgccacgttcaagtcacaatct

SEQ ID NO: 985511 - DNA, 22 bp, Artificial Sequence
  chemically synthesized
ggctgtgccacgttcaagtcac

SEQ ID NO: 985512 - DNA, 22 bp, Artificial Sequence
  chemically synthesized
gagattgtgacttgaacgtggc

SEQ ID NO: 985513 - DNA, 22 bp, Artificial Sequence
  chemically synthesized
tgacttgaacgtggcacagcct

SEQ ID NO: 985514 - DNA, 22 bp, Artificial Sequence
  chemically synthesized
gaacgtggcacagcctagttcc

SEQ ID NO: 985515 - DNA, 22 bp, Artificial Sequence
  chemically synthesized
aacgtggcacagcctagttcct

SEQ ID NO: 985516 - DNA, 22 bp, Artificial Sequence
  chemically synthesized
aaggacaaggcagaacaaggaa

SEQ ID NO: 985517 - DNA, 22 bp, Artificial Sequence
  chemically synthesized
gaaggacaaggcagaacaagga

SEQ ID NO: 985518 - DNA, 22 bp, Artificial Sequence
  chemically synthesized
tgaaggacaaggcagaacaagg

SEQ ID NO: 985519 - DNA, 22 bp, Artificial Sequence
  chemically synthesized
ttgaaggacaaggcagaacaag

SEQ ID NO: 985520 - DNA, 22 bp, Artificial Sequence
  chemically synthesized
tttgaaggacaaggcagaacaa

SEQ ID NO: 985521 - DNA, 22 bp, Artificial Sequence
  chemically synthesized
ttttttgaaggacaaggcagaa

SEQ ID NO: 985522 - DNA, 22 bp, Artificial Sequence
  chemically synthesized
gttccttgttctgccttgtcct

SEQ ID NO: 985523 - DNA, 22 bp, Artificial Sequence
  chemically synthesized
cttgttctgccttgtccttcaa

SEQ ID NO: 985524 - DNA, 22 bp, Artificial Sequence
  chemically synthesized
gttctgccttgtccttcaaaaa

SEQ ID NO: 985525 - DNA, 22 bp, Artificial Sequence
  chemically synthesized
ttctgccttgtccttcaaaaaa

SEQ ID NO: 985526 - DNA, 22 bp, Artificial Sequence
  chemically synthesized
tgccttgtccttcaaaaaacag

SEQ ID NO: 985527 - DNA, 22 bp, Artificial Sequence
  chemically synthesized
ccttgtccttcaaaaaacaggg

SEQ ID NO: 985528 - DNA, 22 bp, Artificial Sequence
  chemically synthesized
acaaaataatgaccctgttttt

SEQ ID NO: 985529 - DNA, 22 bp, Artificial Sequence
  chemically synthesized
gtccttcaaaaaacagggtcat

SEQ ID NO: 985530 - DNA, 22 bp, Artificial Sequence
  chemically synthesized
tccttcaaaaaacagggtcatt

SEQ ID NO: 985531 - DNA, 22 bp, Artificial Sequence
  chemically synthesized
aatctcacaaaataatgaccct

SEQ ID NO: 985532 - DNA, 22 bp, Artificial Sequence
  chemically synthesized
gaatctcacaaaataatgaccc

SEQ ID NO: 985533 - DNA, 22 bp, Artificial Sequence
  chemically synthesized
caaaaaacagggtcattatttt

SEQ ID NO: 985534 - DNA, 22 bp, Artificial Sequence
  chemically synthesized
aaaaaacagggtcattattttg

SEQ ID NO: 985535 - DNA, 22 bp, Artificial Sequence
  chemically synthesized
aaaaccagtttgaatctcacaa

SEQ ID NO: 985536 - DNA, 22 bp, Artificial Sequence
  chemically synthesized
caaaaccagtttgaatctcaca

SEQ ID NO: 985537 - DNA, 22 bp, Artificial Sequence
  chemically synthesized
tcaaaaccagtttgaatctcac

SEQ ID NO: 985538 - DNA, 22 bp, Artificial Sequence
  chemically synthesized
attttcaaaaccagtttgaatc

SEQ ID NO: 985539 - DNA, 22 bp, Artificial Sequence
  chemically synthesized
ttttgtgagattcaaactggtt

SEQ ID NO: 985540 - DNA, 22 bp, Artificial Sequence
  chemically synthesized
tgtgagattcaaactggttttg

SEQ ID NO: 985541 - DNA, 22 bp, Artificial Sequence
  chemically synthesized
gtgagattcaaactggttttga

SEQ ID NO: 985542 - DNA, 22 bp, Artificial Sequence
  chemically synthesized
tgagattcaaactggttttgaa

SEQ ID NO: 985543 - DNA, 22 bp, Artificial Sequence
  chemically synthesized
aaactggttttgaaaattaatc

SEQ ID NO: 985544 - DNA, 22 bp, Artificial Sequence
  chemically synthesized
tataccatgagatgattaattt

SEQ ID NO: 985545 - DNA, 22 bp, Artificial Sequence
  chemically synthesized
gtataccatgagatgattaatt

SEQ ID NO: 985546 - DNA, 22 bp, Artificial Sequence
  chemically synthesized
gttttgaaaattaatcatctca

SEQ ID NO: 985547 - DNA, 22 bp, Artificial Sequence
  chemically synthesized
gaatttgtataccatgagatga

SEQ ID NO: 985548 - DNA, 22 bp, Artificial Sequence
  chemically synthesized
tgaaaattaatcatctcatggt

SEQ ID NO: 985549 - DNA, 22 bp, Artificial Sequence
  chemically synthesized
gaaaattaatcatctcatggta

SEQ ID NO: 985550 - DNA, 22 bp, Artificial Sequence
  chemically synthesized
aaaattaatcatctcatggtat

SEQ ID NO: 985551 - DNA, 22 bp, Artificial Sequence
  chemically synthesized
atcatctcatggtatacaaatt

SEQ ID NO: 985552 - DNA, 22 bp, Artificial Sequence
  chemically synthesized
atccatcggtggattagaattt

SEQ ID NO: 985553 - DNA, 22 bp, Artificial Sequence
  chemically synthesized
catccatcggtggattagaatt

SEQ ID NO: 985554 - DNA, 22 bp, Artificial Sequence
  chemically synthesized
atggtatacaaattctaatcca

SEQ ID NO: 985555 - DNA, 22 bp, Artificial Sequence
  chemically synthesized
cttcatccatcggtggattaga

SEQ ID NO: 985556 - DNA, 22 bp, Artificial Sequence
  chemically synthesized
tacttcatccatcggtggatta

SEQ ID NO: 985557 - DNA, 22 bp, Artificial Sequence
  chemically synthesized
taatccaccgatggatgaagta

SEQ ID NO: 985558 - DNA, 22 bp, Artificial Sequence
  chemically synthesized
atccaccgatggatgaagtaga

SEQ ID NO: 985559 - DNA, 22 bp, Artificial Sequence
  chemically synthesized
agtggcagtggaagaaacatgg

SEQ ID NO: 985560 - DNA, 22 bp, Artificial Sequence
  chemically synthesized
taagtggcagtggaagaaacat

SEQ ID NO: 985561 - DNA, 22 bp, Artificial Sequence
  chemically synthesized
ctaagtggcagtggaagaaaca

SEQ ID NO: 985562 - DNA, 22 bp, Artificial Sequence
  chemically synthesized
tctaagtggcagtggaagaaac

SEQ ID NO: 985563 - DNA, 22 bp, Artificial Sequence
  chemically synthesized
ttttctaagtggcagtggaaga

SEQ ID NO: 985564 - DNA, 22 bp, Artificial Sequence
  chemically synthesized
tccatgtttcttccactgccac

SEQ ID NO: 985565 - DNA, 22 bp, Artificial Sequence
  chemically synthesized
ccatgtttcttccactgccact

SEQ ID NO: 985566 - DNA, 22 bp, Artificial Sequence
  chemically synthesized
catgtttcttccactgccactt

SEQ ID NO: 985567 - DNA, 22 bp, Artificial Sequence
  chemically synthesized
ccaatattattttctaagtggc

SEQ ID NO: 985568 - DNA, 22 bp, Artificial Sequence
  chemically synthesized
cttccactgccacttagaaaat

SEQ ID NO: 985569 - DNA, 22 bp, Artificial Sequence
  chemically synthesized
ttccactgccacttagaaaata

SEQ ID NO: 985570 - DNA, 22 bp, Artificial Sequence
  chemically synthesized
aattcccaatattattttctaa

SEQ ID NO: 985571 - DNA, 22 bp, Artificial Sequence
  chemically synthesized
ccactgccacttagaaaataat

SEQ ID NO: 985572 - DNA, 22 bp, Artificial Sequence
  chemically synthesized
cactgccacttagaaaataata

SEQ ID NO: 985573 - DNA, 22 bp, Artificial Sequence
  chemically synthesized
ttcaattcccaatattattttc

SEQ ID NO: 985574 - DNA, 22 bp, Artificial Sequence
  chemically synthesized
attgttcaattcccaatattat

SEQ ID NO: 985575 - DNA, 22 bp, Artificial Sequence
  chemically synthesized
ccacttagaaaataatattggg

SEQ ID NO: 985576 - DNA, 22 bp, Artificial Sequence
  chemically synthesized
tcattgttcaattcccaatatt

SEQ ID NO: 985577 - DNA, 22 bp, Artificial Sequence
  chemically synthesized
agaaaataatattgggaattga

SEQ ID NO: 985578 - DNA, 22 bp, Artificial Sequence
  chemically synthesized
gaaaataatattgggaattgaa

SEQ ID NO: 985579 - DNA, 22 bp, Artificial Sequence
  chemically synthesized
tgtccatgtgttctcattgttc

SEQ ID NO: 985580 - DNA, 22 bp, Artificial Sequence
  chemically synthesized
ctgtgtccatgtgttctcattg

SEQ ID NO: 985581 - DNA, 22 bp, Artificial Sequence
  chemically synthesized
cctgtgtccatgtgttctcatt

SEQ ID NO: 985582 - DNA, 22 bp, Artificial Sequence
  chemically synthesized
ggaattgaacaatgagaacaca

SEQ ID NO: 985583 - DNA, 22 bp, Artificial Sequence
  chemically synthesized
cccttcctgtgtccatgtgttc

SEQ ID NO: 985584 - DNA, 22 bp, Artificial Sequence
  chemically synthesized
aacaatgagaacacatggacac

SEQ ID NO: 985585 - DNA, 22 bp, Artificial Sequence
  chemically synthesized
cccccaccccacagcagtcccc

SEQ ID NO: 985586 - DNA, 22 bp, Artificial Sequence
  chemically synthesized
ccccccaccccacagcagtccc

SEQ ID NO: 985587 - DNA, 22 bp, Artificial Sequence
  chemically synthesized
ccccttccccccaccccacagc

SEQ ID NO: 985588 - DNA, 22 bp, Artificial Sequence
  chemically synthesized
tggggactgctgtggggtgggg

SEQ ID NO: 985589 - DNA, 22 bp, Artificial Sequence
  chemically synthesized
gggactgctgtggggtgggggg

SEQ ID NO: 985590 - DNA, 22 bp, Artificial Sequence
  chemically synthesized
tccctcccccttccccccaccc

SEQ ID NO: 985591 - DNA, 22 bp, Artificial Sequence
  chemically synthesized
ctgtggggtggggggaaggggg

SEQ ID NO: 985592 - DNA, 22 bp, Artificial Sequence
  chemically synthesized
ccaatgctatccctcccccttc

SEQ ID NO: 985593 - DNA, 22 bp, Artificial Sequence
  chemically synthesized
tggggtggggggaagggggagg

SEQ ID NO: 985594 - DNA, 22 bp, Artificial Sequence
  chemically synthesized
aggtaaatctcccaatgctatc

SEQ ID NO: 985595 - DNA, 22 bp, Artificial Sequence
  chemically synthesized
aaggtaaatctcccaatgctat

SEQ ID NO: 985596 - DNA, 22 bp, Artificial Sequence
  chemically synthesized
gcttaaggtaaatctcccaatg

SEQ ID NO: 985597 - DNA, 22 bp, Artificial Sequence
  chemically synthesized
gtcatctagcttaaggtaaatc

SEQ ID NO: 985598 - DNA, 22 bp, Artificial Sequence
  chemically synthesized
actcgtcatctagcttaaggta

SEQ ID NO: 985599 - DNA, 22 bp, Artificial Sequence
  chemically synthesized
ggagatttaccttaagctagat

SEQ ID NO: 985600 - DNA, 22 bp, Artificial Sequence
  chemically synthesized
cacccactaactcgtcatctag

SEQ ID NO: 985601 - DNA, 22 bp, Artificial Sequence
  chemically synthesized
accttaagctagatgacgagtt

SEQ ID NO: 985602 - DNA, 22 bp, Artificial Sequence
  chemically synthesized
ccttaagctagatgacgagtta

SEQ ID NO: 985603 - DNA, 22 bp, Artificial Sequence
  chemically synthesized
gtgcgctgcacccactaactcg

SEQ ID NO: 985604 - DNA, 22 bp, Artificial Sequence
  chemically synthesized
aagctagatgacgagttagtgg

SEQ ID NO: 985605 - DNA, 22 bp, Artificial Sequence
  chemically synthesized
agctagatgacgagttagtggg

SEQ ID NO: 985606 - DNA, 22 bp, Artificial Sequence
  chemically synthesized
gatgacgagttagtgggtgcag

SEQ ID NO: 985607 - DNA, 22 bp, Artificial Sequence
  chemically synthesized
gtgggtgcagcgcaccagcatg

SEQ ID NO: 985608 - DNA, 22 bp, Artificial Sequence
  chemically synthesized
catatgtatacatgtgccatgc

SEQ ID NO: 985609 - DNA, 22 bp, Artificial Sequence
  chemically synthesized
gttacatatgtatacatgtgcc

SEQ ID NO: 985610 - DNA, 22 bp, Artificial Sequence
  chemically synthesized
gggcacatgtgcacaatgtgca

SEQ ID NO: 985611 - DNA, 22 bp, Artificial Sequence
  chemically synthesized
agggcacatgtgcacaatgtgc

SEQ ID NO: 985612 - DNA, 22 bp, Artificial Sequence
  chemically synthesized
tagggcacatgtgcacaatgtg

SEQ ID NO: 985613 - DNA, 22 bp, Artificial Sequence
  chemically synthesized
agttttagggcacatgtgcaca

SEQ ID NO: 985614 - DNA, 22 bp, Artificial Sequence
  chemically synthesized
aagttttagggcacatgtgcac

SEQ ID NO: 985615 - DNA, 22 bp, Artificial Sequence
  chemically synthesized
acctgcacattgtgcacatgtg

SEQ ID NO: 985616 - DNA, 22 bp, Artificial Sequence
  chemically synthesized
taagttttagggcacatgtgca

SEQ ID NO: 985617 - DNA, 22 bp, Artificial Sequence
  chemically synthesized
cacattgtgcacatgtgcccta

SEQ ID NO: 985618 - DNA, 22 bp, Artificial Sequence
  chemically synthesized
tactttaagttttagggcacat

SEQ ID NO: 985619 - DNA, 22 bp, Artificial Sequence
  chemically synthesized
ttatactttaagttttagggca

SEQ ID NO: 985620 - DNA, 22 bp, Artificial Sequence
  chemically synthesized
ttattatactttaagttttagg

SEQ ID NO: 985621 - DNA, 22 bp, Artificial Sequence
  chemically synthesized
tgcacatgtgccctaaaactta

SEQ ID NO: 985622 - DNA, 22 bp, Artificial Sequence
  chemically synthesized
attattatactttaagttttag

SEQ ID NO: 985623 - DNA, 22 bp, Artificial Sequence
  chemically synthesized
aatttattattatactttaagt

SEQ ID NO: 985624 - DNA, 22 bp, Artificial Sequence
  chemically synthesized
aaatttattattatactttaag

SEQ ID NO: 985625 - DNA, 22 bp, Artificial Sequence
  chemically synthesized
taaatttattattatactttaa

SEQ ID NO: 985626 - DNA, 22 bp, Artificial Sequence
  chemically synthesized
ttaaatttattattatacttta

SEQ ID NO: 985627 - DNA, 22 bp, Artificial Sequence
  chemically synthesized
tttaaatttattattatacttt

SEQ ID NO: 985628 - DNA, 22 bp, Artificial Sequence
  chemically synthesized
ttttaaatttattattatactt

SEQ ID NO: 985629 - DNA, 22 bp, Artificial Sequence
  chemically synthesized
tttttaaatttattattatact

SEQ ID NO: 985630 - DNA, 22 bp, Artificial Sequence
  chemically synthesized
ttttttaaatttattattatac

SEQ ID NO: 985631 - DNA, 22 bp, Artificial Sequence
  chemically synthesized
ttttttttaaatttattattat

SEQ ID NO: 985632 - DNA, 22 bp, Artificial Sequence
  chemically synthesized
aaacttaaagtataataataaa

SEQ ID NO: 985633 - DNA, 22 bp, Artificial Sequence
  chemically synthesized
cttttttttaaatttattatta

SEQ ID NO: 985634 - DNA, 22 bp, Artificial Sequence
  chemically synthesized
tcttttttttaaatttattatt

SEQ ID NO: 985635 - DNA, 22 bp, Artificial Sequence
  chemically synthesized
ttttcttttttttaaatttatt

SEQ ID NO: 985636 - DNA, 22 bp, Artificial Sequence
  chemically synthesized
aaagtataataataaatttaaa

SEQ ID NO: 985637 - DNA, 22 bp, Artificial Sequence
  chemically synthesized
aagtataataataaatttaaaa

SEQ ID NO: 985638 - DNA, 22 bp, Artificial Sequence
  chemically synthesized
tacataataaaatattattttc

SEQ ID NO: 985639 - DNA, 22 bp, Artificial Sequence
  chemically synthesized
aaaaaaaagaaaataatatttt

SEQ ID NO: 985640 - DNA, 22 bp, Artificial Sequence
  chemically synthesized
aaaaaaagaaaataatatttta

SEQ ID NO: 985641 - DNA, 22 bp, Artificial Sequence
  chemically synthesized
ataatgcacgctgtacataata

SEQ ID NO: 985642 - DNA, 22 bp, Artificial Sequence
  chemically synthesized
tgctgataatgcacgctgtaca

SEQ ID NO: 985643 - DNA, 22 bp, Artificial Sequence
  chemically synthesized
tctgtgctgataatgcacgctg

SEQ ID NO: 985644 - DNA, 22 bp, Artificial Sequence
  chemically synthesized
tattatgtacagcgtgcattat

SEQ ID NO: 985645 - DNA, 22 bp, Artificial Sequence
  chemically synthesized
attatgtacagcgtgcattatc

SEQ ID NO: 985646 - DNA, 22 bp, Artificial Sequence
  chemically synthesized
ttatgtacagcgtgcattatca

SEQ ID NO: 985647 - DNA, 22 bp, Artificial Sequence
  chemically synthesized
tgttatctgtgctgataatgca

SEQ ID NO: 985648 - DNA, 22 bp, Artificial Sequence
  chemically synthesized
atgttatctgtgctgataatgc

SEQ ID NO: 985649 - DNA, 22 bp, Artificial Sequence
  chemically synthesized
tatgttatctgtgctgataatg

SEQ ID NO: 985650 - DNA, 22 bp, Artificial Sequence
  chemically synthesized
tgtacagcgtgcattatcagca

SEQ ID NO: 985651 - DNA, 22 bp, Artificial Sequence
  chemically synthesized
aaaaaagttttatgttatctgt

SEQ ID NO: 985652 - DNA, 22 bp, Artificial Sequence
  chemically synthesized
aaaaaaagttttatgttatctg

SEQ ID NO: 985653 - DNA, 22 bp, Artificial Sequence
  chemically synthesized
taaaaaaagttttatgttatct

SEQ ID NO: 985654 - DNA, 22 bp, Artificial Sequence
  chemically synthesized
ttaaaaaaagttttatgttatc

SEQ ID NO: 985655 - DNA, 22 bp, Artificial Sequence
  chemically synthesized
tcagcacagataacataaaact

SEQ ID NO: 985656 - DNA, 22 bp, Artificial Sequence
  chemically synthesized
gaataaacccacatttttaaaa

SEQ ID NO: 985657 - DNA, 22 bp, Artificial Sequence
  chemically synthesized
aaaatctagaataaacccacat

SEQ ID NO: 985658 - DNA, 22 bp, Artificial Sequence
  chemically synthesized
aaaaatctagaataaacccaca

SEQ ID NO: 985659 - DNA, 22 bp, Artificial Sequence
  chemically synthesized
tttttaaaaatgtgggtttatt

SEQ ID NO: 985660 - DNA, 22 bp, Artificial Sequence
  chemically synthesized
ttttaaaaatgtgggtttattc

SEQ ID NO: 985661 - DNA, 22 bp, Artificial Sequence
  chemically synthesized
tttaaaaatgtgggtttattct

SEQ ID NO: 985662 - DNA, 22 bp, Artificial Sequence
  chemically synthesized
ttaaaaatgtgggtttattcta

SEQ ID NO: 985663 - DNA, 22 bp, Artificial Sequence
  chemically synthesized
taaaaatgtgggtttattctag

SEQ ID NO: 985664 - DNA, 22 bp, Artificial Sequence
  chemically synthesized
aaaaatgtgggtttattctaga

SEQ ID NO: 985665 - DNA, 22 bp, Artificial Sequence
  chemically synthesized
aaaatgtgggtttattctagat

SEQ ID NO: 985666 - DNA, 22 bp, Artificial Sequence
  chemically synthesized
atagatttaaaaatctagaata

SEQ ID NO: 985667 - DNA, 22 bp, Artificial Sequence
  chemically synthesized
aataagcctcatagatttaaaa

SEQ ID NO: 985668 - DNA, 22 bp, Artificial Sequence
  chemically synthesized
taaataagcctcatagatttaa

SEQ ID NO: 985669 - DNA, 22 bp, Artificial Sequence
  chemically synthesized
attctagatttttaaatctatg

SEQ ID NO: 985670 - DNA, 22 bp, Artificial Sequence
  chemically synthesized
ttctagatttttaaatctatga

SEQ ID NO: 985671 - DNA, 22 bp, Artificial Sequence
  chemically synthesized
tagatttttaaatctatgaggc

SEQ ID NO: 985672 - DNA, 22 bp, Artificial Sequence
  chemically synthesized
gatttttaaatctatgaggctt

SEQ ID NO: 985673 - DNA, 22 bp, Artificial Sequence
  chemically synthesized
agcattctaaataagcctcata

SEQ ID NO: 985674 - DNA, 22 bp, Artificial Sequence
  chemically synthesized
attcagcattctaaataagcct

SEQ ID NO: 985675 - DNA, 22 bp, Artificial Sequence
  chemically synthesized
ttaaatctatgaggcttattta

SEQ ID NO: 985676 - DNA, 22 bp, Artificial Sequence
  chemically synthesized
aattcagcattctaaataagcc

SEQ ID NO: 985677 - DNA, 22 bp, Artificial Sequence
  chemically synthesized
taaatctatgaggcttatttag

SEQ ID NO: 985678 - DNA, 22 bp, Artificial Sequence
  chemically synthesized
aaatctatgaggcttatttaga

SEQ ID NO: 985679 - DNA, 22 bp, Artificial Sequence
  chemically synthesized
aatctatgaggcttatttagaa

SEQ ID NO: 985680 - DNA, 22 bp, Artificial Sequence
  chemically synthesized
tatagtttaattcagcattcta

SEQ ID NO: 985681 - DNA, 22 bp, Artificial Sequence
  chemically synthesized
tgaggcttatttagaatgctga

SEQ ID NO: 985682 - DNA, 22 bp, Artificial Sequence
  chemically synthesized
gtatagtttaattcagcattct

SEQ ID NO: 985683 - DNA, 22 bp, Artificial Sequence
  chemically synthesized
acttgtatagtttaattcagca

SEQ ID NO: 985684 - DNA, 22 bp, Artificial Sequence
  chemically synthesized
atttagaatgctgaattaaact

SEQ ID NO: 985685 - DNA, 22 bp, Artificial Sequence
  chemically synthesized
tttagaatgctgaattaaacta

SEQ ID NO: 985686 - DNA, 22 bp, Artificial Sequence
  chemically synthesized
aagattaacttgtatagtttaa

SEQ ID NO: 985687 - DNA, 22 bp, Artificial Sequence
  chemically synthesized
agaatgctgaattaaactatac

SEQ ID NO: 985688 - DNA, 22 bp, Artificial Sequence
  chemically synthesized
caagattaacttgtatagttta

SEQ ID NO: 985689 - DNA, 22 bp, Artificial Sequence
  chemically synthesized
gaatgctgaattaaactataca

SEQ ID NO: 985690 - DNA, 22 bp, Artificial Sequence
  chemically synthesized
ttcaagattaacttgtatagtt

SEQ ID NO: 985691 - DNA, 22 bp, Artificial Sequence
  chemically synthesized
gttcttcaagattaacttgtat

SEQ ID NO: 985692 - DNA, 22 bp, Artificial Sequence
  chemically synthesized
aattaaactatacaagttaatc

SEQ ID NO: 985693 - DNA, 22 bp, Artificial Sequence
  chemically synthesized
aactatacaagttaatcttgaa

SEQ ID NO: 985694 - DNA, 22 bp, Artificial Sequence
  chemically synthesized
caatatctggttcttcaagatt

SEQ ID NO: 985695 - DNA, 22 bp, Artificial Sequence
  chemically synthesized
tacaagttaatcttgaagaacc

SEQ ID NO: 985696 - DNA, 22 bp, Artificial Sequence
  chemically synthesized
atcttgaagaaccagatattgg

SEQ ID NO: 985697 - DNA, 22 bp, Artificial Sequence
  chemically synthesized
atgagagcagcaattccaatat

SEQ ID NO: 985698 - DNA, 22 bp, Artificial Sequence
  chemically synthesized
gaagaaccagatattggaattg

SEQ ID NO: 985699 - DNA, 22 bp, Artificial Sequence
  chemically synthesized
aagaaccagatattggaattgc

SEQ ID NO: 985700 - DNA, 22 bp, Artificial Sequence
  chemically synthesized
gaattgctgctctcattaattc

SEQ ID NO: 985701 - DNA, 22 bp, Artificial Sequence
  chemically synthesized
ctgctctcattaattcctccca

SEQ ID NO: 985702 - DNA, 22 bp, Artificial Sequence
  chemically synthesized
ctctcattaattcctcccacct

SEQ ID NO: 985703 - DNA, 22 bp, Artificial Sequence
  chemically synthesized
tcattaattcctcccacctgat

SEQ ID NO: 985704 - DNA, 22 bp, Artificial Sequence
  chemically synthesized
attaattcctcccacctgattt

SEQ ID NO: 985705 - DNA, 22 bp, Artificial Sequence
  chemically synthesized
gcgatggcatacacaaatcagg

SEQ ID NO: 985706 - DNA, 22 bp, Artificial Sequence
  chemically synthesized
attcctcccacctgatttgtgt

SEQ ID NO: 985707 - DNA, 22 bp, Artificial Sequence
  chemically synthesized
ctggcgatggcatacacaaatc

SEQ ID NO: 985708 - DNA, 22 bp, Artificial Sequence
  chemically synthesized
gctggcgatggcatacacaaat

SEQ ID NO: 985709 - DNA, 22 bp, Artificial Sequence
  chemically synthesized
ctcccacctgatttgtgtatgc

SEQ ID NO: 985710 - DNA, 22 bp, Artificial Sequence
  chemically synthesized
ccacctgatttgtgtatgccat

SEQ ID NO: 985711 - DNA, 22 bp, Artificial Sequence
  chemically synthesized
tgtggtttgctggcgatggcat

SEQ ID NO: 985712 - DNA, 22 bp, Artificial Sequence
  chemically synthesized
atttgtgtatgccatcgccagc

SEQ ID NO: 985713 - DNA, 22 bp, Artificial Sequence
  chemically synthesized
gtgtatgccatcgccagcaaac

SEQ ID NO: 985714 - DNA, 22 bp, Artificial Sequence
  chemically synthesized
tgtatgccatcgccagcaaacc

SEQ ID NO: 985715 - DNA, 22 bp, Artificial Sequence
  chemically synthesized
taaaggaggcaccaactatgtg

SEQ ID NO: 985716 - DNA, 22 bp, Artificial Sequence
  chemically synthesized
gtaaaggaggcaccaactatgt

SEQ ID NO: 985717 - DNA, 22 bp, Artificial Sequence
  chemically synthesized
tgtaaaggaggcaccaactatg

SEQ ID NO: 985718 - DNA, 22 bp, Artificial Sequence
  chemically synthesized
ttgtaaaggaggcaccaactat

SEQ ID NO: 985719 - DNA, 22 bp, Artificial Sequence
  chemically synthesized
tttgtaaaggaggcaccaacta

SEQ ID NO: 985720 - DNA, 22 bp, Artificial Sequence
  chemically synthesized
ttttgtaaaggaggcaccaact

SEQ ID NO: 985721 - DNA, 22 bp, Artificial Sequence
  chemically synthesized
tttttgtaaaggaggcaccaac

SEQ ID NO: 985722 - DNA, 22 bp, Artificial Sequence
  chemically synthesized
ttttttgtaaaggaggcaccaa

SEQ ID NO: 985723 - DNA, 22 bp, Artificial Sequence
  chemically synthesized
gcacaacttttttttgtaaagg

SEQ ID NO: 985724 - DNA, 22 bp, Artificial Sequence
  chemically synthesized
ctagcacaacttttttttgtaa

SEQ ID NO: 985725 - DNA, 22 bp, Artificial Sequence
  chemically synthesized
gtgcctcctttacaaaaaaaag

SEQ ID NO: 985726 - DNA, 22 bp, Artificial Sequence
  chemically synthesized
tctcctagcacaactttttttt

SEQ ID NO: 985727 - DNA, 22 bp, Artificial Sequence
  chemically synthesized
gtctcctagcacaacttttttt

SEQ ID NO: 985728 - DNA, 22 bp, Artificial Sequence
  chemically synthesized
ctttacaaaaaaaagttgtgct

SEQ ID NO: 985729 - DNA, 22 bp, Artificial Sequence
  chemically synthesized
tgcttgtctcctagcacaactt

SEQ ID NO: 985730 - DNA, 22 bp, Artificial Sequence
  chemically synthesized
atgcttgtctcctagcacaact

SEQ ID NO: 985731 - DNA, 22 bp, Artificial Sequence
  chemically synthesized
tacaaaaaaaagttgtgctagg

SEQ ID NO: 985732 - DNA, 22 bp, Artificial Sequence
  chemically synthesized
acaaaaaaaagttgtgctagga

SEQ ID NO: 985733 - DNA, 22 bp, Artificial Sequence
  chemically synthesized
caaaaaaaagttgtgctaggag

SEQ ID NO: 985734 - DNA, 22 bp, Artificial Sequence
  chemically synthesized
taatttatgcttgtctcctagc

SEQ ID NO: 985735 - DNA, 22 bp, Artificial Sequence
  chemically synthesized
gtaatttatgcttgtctcctag

SEQ ID NO: 985736 - DNA, 22 bp, Artificial Sequence
  chemically synthesized
accttgtaatttatgcttgtct

SEQ ID NO: 985737 - DNA, 22 bp, Artificial Sequence
  chemically synthesized
tgaccttgtaatttatgcttgt

SEQ ID NO: 985738 - DNA, 22 bp, Artificial Sequence
  chemically synthesized
tgctaggagacaagcataaatt

SEQ ID NO: 985739 - DNA, 22 bp, Artificial Sequence
  chemically synthesized
ctctgaccttgtaatttatgct

SEQ ID NO: 985740 - DNA, 22 bp, Artificial Sequence
  chemically synthesized
ggagacaagcataaattacaag

SEQ ID NO: 985741 - DNA, 22 bp, Artificial Sequence
  chemically synthesized
aaggtattcctctgaccttgta

SEQ ID NO: 985742 - DNA, 22 bp, Artificial Sequence
  chemically synthesized
gaaggtattcctctgaccttgt

SEQ ID NO: 985743 - DNA, 22 bp, Artificial Sequence
  chemically synthesized
ttgaaggtattcctctgacctt

SEQ ID NO: 985744 - DNA, 22 bp, Artificial Sequence
  chemically synthesized
agattcttgaaggtattcctct

SEQ ID NO: 985745 - DNA, 22 bp, Artificial Sequence
  chemically synthesized
aagattcttgaaggtattcctc

SEQ ID NO: 985746 - DNA, 22 bp, Artificial Sequence
  chemically synthesized
caaggtcagaggaataccttca

SEQ ID NO: 985747 - DNA, 22 bp, Artificial Sequence
  chemically synthesized
aaatgggtttaagattcttgaa

SEQ ID NO: 985748 - DNA, 22 bp, Artificial Sequence
  chemically synthesized
ttcaaatgggtttaagattctt

SEQ ID NO: 985749 - DNA, 22 bp, Artificial Sequence
  chemically synthesized
tactgttcaaatgggtttaaga

SEQ ID NO: 985750 - DNA, 22 bp, Artificial Sequence
  chemically synthesized
tatactgttcaaatgggtttaa

SEQ ID NO: 985751 - DNA, 22 bp, Artificial Sequence
  chemically synthesized
ctatactgttcaaatgggttta

SEQ ID NO: 985752 - DNA, 22 bp, Artificial Sequence
  chemically synthesized
caagaatcttaaacccatttga

SEQ ID NO: 985753 - DNA, 22 bp, Artificial Sequence
  chemically synthesized
aagaatcttaaacccatttgaa

SEQ ID NO: 985754 - DNA, 22 bp, Artificial Sequence
  chemically synthesized
ggtttctatactgttcaaatgg

SEQ ID NO: 985755 - DNA, 22 bp, Artificial Sequence
  chemically synthesized
aaacccatttgaacagtataga

SEQ ID NO: 985756 - DNA, 22 bp, Artificial Sequence
  chemically synthesized
catccctaggtttctatactgt

SEQ ID NO: 985757 - DNA, 22 bp, Artificial Sequence
  chemically synthesized
aacccatttgaacagtatagaa

SEQ ID NO: 985758 - DNA, 22 bp, Artificial Sequence
  chemically synthesized
ccatccctaggtttctatactg

SEQ ID NO: 985759 - DNA, 22 bp, Artificial Sequence
  chemically synthesized
tccatccctaggtttctatact

SEQ ID NO: 985760 - DNA, 22 bp, Artificial Sequence
  chemically synthesized
ttccatccctaggtttctatac

SEQ ID NO: 985761 - DNA, 22 bp, Artificial Sequence
  chemically synthesized
tttccatccctaggtttctata

SEQ ID NO: 985762 - DNA, 22 bp, Artificial Sequence
  chemically synthesized
gaacagtatagaaacctaggga

SEQ ID NO: 985763 - DNA, 22 bp, Artificial Sequence
  chemically synthesized
gagttttttccatccctaggtt

SEQ ID NO: 985764 - DNA, 22 bp, Artificial Sequence
  chemically synthesized
aacagtatagaaacctagggat

SEQ ID NO: 985765 - DNA, 22 bp, Artificial Sequence
  chemically synthesized
ttagagttttttccatccctag

SEQ ID NO: 985766 - DNA, 22 bp, Artificial Sequence
  chemically synthesized
tattagagttttttccatccct

SEQ ID NO: 985767 - DNA, 22 bp, Artificial Sequence
  chemically synthesized
ctattagagttttttccatccc

SEQ ID NO: 985768 - DNA, 22 bp, Artificial Sequence
  chemically synthesized
ttctattagagttttttccatc

SEQ ID NO: 985769 - DNA, 22 bp, Artificial Sequence
  chemically synthesized
cttctattagagttttttccat

SEQ ID NO: 985770 - DNA, 22 bp, Artificial Sequence
  chemically synthesized
tcttctattagagttttttcca

SEQ ID NO: 985771 - DNA, 22 bp, Artificial Sequence
  chemically synthesized
tagttttcttctattagagttt

SEQ ID NO: 985772 - DNA, 22 bp, Artificial Sequence
  chemically synthesized
gtagttttcttctattagagtt

SEQ ID NO: 985773 - DNA, 22 bp, Artificial Sequence
  chemically synthesized
gggatggaaaaaactctaatag

SEQ ID NO: 985774 - DNA, 22 bp, Artificial Sequence
  chemically synthesized
ttgtagttttcttctattagag

SEQ ID NO: 985775 - DNA, 22 bp, Artificial Sequence
  chemically synthesized
gttcttgtagttttcttctatt

SEQ ID NO: 985776 - DNA, 22 bp, Artificial Sequence
  chemically synthesized
ggttcttgtagttttcttctat

SEQ ID NO: 985777 - DNA, 22 bp, Artificial Sequence
  chemically synthesized
tggttcttgtagttttcttcta

SEQ ID NO: 985778 - DNA, 22 bp, Artificial Sequence
  chemically synthesized
cccctttggttcttgtagtttt

SEQ ID NO: 985779 - DNA, 22 bp, Artificial Sequence
  chemically synthesized
acccctttggttcttgtagttt

SEQ ID NO: 985780 - DNA, 22 bp, Artificial Sequence
  chemically synthesized
taatagaagaaaactacaagaa

SEQ ID NO: 985781 - DNA, 22 bp, Artificial Sequence
  chemically synthesized
atagaagaaaactacaagaacc

SEQ ID NO: 985782 - DNA, 22 bp, Artificial Sequence
  chemically synthesized
gcttacccctttggttcttgta

SEQ ID NO: 985783 - DNA, 22 bp, Artificial Sequence
  chemically synthesized
tactggcttacccctttggttc

SEQ ID NO: 985784 - DNA, 22 bp, Artificial Sequence
  chemically synthesized
caagaaccaaaggggtaagcca

SEQ ID NO: 985785 - DNA, 22 bp, Artificial Sequence
  chemically synthesized
cagaggttgtactggcttaccc

SEQ ID NO: 985786 - DNA, 22 bp, Artificial Sequence
  chemically synthesized
gcagaggttgtactggcttacc

SEQ ID NO: 985787 - DNA, 22 bp, Artificial Sequence
  chemically synthesized
tgcagaggttgtactggcttac

SEQ ID NO: 985788 - DNA, 22 bp, Artificial Sequence
  chemically synthesized
cctttgcagaggttgtactggc

SEQ ID NO: 985789 - DNA, 22 bp, Artificial Sequence
  chemically synthesized
gtggatggagtaagattacctt

SEQ ID NO: 985790 - DNA, 22 bp, Artificial Sequence
  chemically synthesized
agtggatggagtaagattacct

SEQ ID NO: 985791 - DNA, 22 bp, Artificial Sequence
  chemically synthesized
tgtttagtggatggagtaagat

SEQ ID NO: 985792 - DNA, 22 bp, Artificial Sequence
  chemically synthesized
tgcaaaggtaatcttactccat

SEQ ID NO: 985793 - DNA, 22 bp, Artificial Sequence
  chemically synthesized
caaaggtaatcttactccatcc

SEQ ID NO: 985794 - DNA, 22 bp, Artificial Sequence
  chemically synthesized
aacatataatgctatgtttagt

SEQ ID NO: 985795 - DNA, 22 bp, Artificial Sequence
  chemically synthesized
actccatccactaaacatagca

SEQ ID NO: 985796 - DNA, 22 bp, Artificial Sequence
  chemically synthesized
ctccatccactaaacatagcat

SEQ ID NO: 985797 - DNA, 22 bp, Artificial Sequence
  chemically synthesized
catccactaaacatagcattat

SEQ ID NO: 985798 - DNA, 22 bp, Artificial Sequence
  chemically synthesized
tgtgtgagtgactaaacatata

SEQ ID NO: 985799 - DNA, 22 bp, Artificial Sequence
  chemically synthesized
gtgtgtgagtgactaaacatat

SEQ ID NO: 985800 - DNA, 22 bp, Artificial Sequence
  chemically synthesized
aacatagcattatatgtttagt

SEQ ID NO: 985801 - DNA, 22 bp, Artificial Sequence
  chemically synthesized
tgtgtgtgagtgactaaacata

SEQ ID NO: 985802 - DNA, 22 bp, Artificial Sequence
  chemically synthesized
tctttgtgtgtgagtgactaaa

SEQ ID NO: 985803 - DNA, 22 bp, Artificial Sequence
  chemically synthesized
actatctttgtgtgtgagtgac

SEQ ID NO: 985804 - DNA, 22 bp, Artificial Sequence
  chemically synthesized
tatgtttagtcactcacacaca

SEQ ID NO: 985805 - DNA, 22 bp, Artificial Sequence
  chemically synthesized
tcagtcattcactatctttgtg

SEQ ID NO: 985806 - DNA, 22 bp, Artificial Sequence
  chemically synthesized
agtcactcacacacaaagatag

SEQ ID NO: 985807 - DNA, 22 bp, Artificial Sequence
  chemically synthesized
atcagtcattcactatctttgt

SEQ ID NO: 985808 - DNA, 22 bp, Artificial Sequence
  chemically synthesized
gtcactcacacacaaagatagt

SEQ ID NO: 985809 - DNA, 22 bp, Artificial Sequence
  chemically synthesized
cttatcagtcattcactatctt

SEQ ID NO: 985810 - DNA, 22 bp, Artificial Sequence
  chemically synthesized
tccttatcagtcattcactatc

SEQ ID NO: 985811 - DNA, 22 bp, Artificial Sequence
  chemically synthesized
acacacaaagatagtgaatgac

SEQ ID NO: 985812 - DNA, 22 bp, Artificial Sequence
  chemically synthesized
gccaggttctccttatcagtca

SEQ ID NO: 985813 - DNA, 22 bp, Artificial Sequence
  chemically synthesized
atgcctggccaggttctcctta

SEQ ID NO: 985814 - DNA, 22 bp, Artificial Sequence
  chemically synthesized
ttaatgcctggccaggttctcc

SEQ ID NO: 985815 - DNA, 22 bp, Artificial Sequence
  chemically synthesized
ataaggagaacctggccaggca

SEQ ID NO: 985816 - DNA, 22 bp, Artificial Sequence
  chemically synthesized
aatgaaaggccatcccctgtta

SEQ ID NO: 985817 - DNA, 22 bp, Artificial Sequence
  chemically synthesized
gccaggcattaacaggggatgg

SEQ ID NO: 985818 - DNA, 22 bp, Artificial Sequence
  chemically synthesized
ctcaatgaaaggccatcccctg

SEQ ID NO: 985819 - DNA, 22 bp, Artificial Sequence
  chemically synthesized
actcaatgaaaggccatcccct

SEQ ID NO: 985820 - DNA, 22 bp, Artificial Sequence
  chemically synthesized
tactcaatgaaaggccatcccc

SEQ ID NO: 985821 - DNA, 22 bp, Artificial Sequence
  chemically synthesized
ttactcaatgaaaggccatccc

SEQ ID NO: 985822 - DNA, 22 bp, Artificial Sequence
  chemically synthesized
acaggggatggcctttcattga

SEQ ID NO: 985823 - DNA, 22 bp, Artificial Sequence
  chemically synthesized
gaaggaatatcttttactcaat

SEQ ID NO: 985824 - DNA, 22 bp, Artificial Sequence
  chemically synthesized
tggaaggaatatcttttactca

SEQ ID NO: 985825 - DNA, 22 bp, Artificial Sequence
  chemically synthesized
ctctggaaggaatatcttttac

SEQ ID NO: 985826 - DNA, 22 bp, Artificial Sequence
  chemically synthesized
tactctggaaggaatatctttt

SEQ ID NO: 985827 - DNA, 22 bp, Artificial Sequence
  chemically synthesized
tcattgagtaaaagatattcct

SEQ ID NO: 985828 - DNA, 22 bp, Artificial Sequence
  chemically synthesized
cattgagtaaaagatattcctt

SEQ ID NO: 985829 - DNA, 22 bp, Artificial Sequence
  chemically synthesized
attgagtaaaagatattccttc

SEQ ID NO: 985830 - DNA, 22 bp, Artificial Sequence
  chemically synthesized
ccagctctactctggaaggaat

SEQ ID NO: 985831 - DNA, 22 bp, Artificial Sequence
  chemically synthesized
accagctctactctggaaggaa

SEQ ID NO: 985832 - DNA, 22 bp, Artificial Sequence
  chemically synthesized
agtaaaagatattccttccaga

SEQ ID NO: 985833 - DNA, 22 bp, Artificial Sequence
  chemically synthesized
taccagctctactctggaagga

SEQ ID NO: 985834 - DNA, 22 bp, Artificial Sequence
  chemically synthesized
ggctttaccagctctactctgg

SEQ ID NO: 985835 - DNA, 22 bp, Artificial Sequence
  chemically synthesized
cggctttaccagctctactctg

SEQ ID NO: 985836 - DNA, 22 bp, Artificial Sequence
  chemically synthesized
ttcggctttaccagctctactc

SEQ ID NO: 985837 - DNA, 22 bp, Artificial Sequence
  chemically synthesized
tcttcggctttaccagctctac

SEQ ID NO: 985838 - DNA, 22 bp, Artificial Sequence
  chemically synthesized
cttccagagtagagctggtaaa

SEQ ID NO: 985839 - DNA, 22 bp, Artificial Sequence
  chemically synthesized
ccagagtagagctggtaaagcc

SEQ ID NO: 985840 - DNA, 22 bp, Artificial Sequence
  chemically synthesized
cagagtagagctggtaaagccg

SEQ ID NO: 985841 - DNA, 22 bp, Artificial Sequence
  chemically synthesized
aatacagttctcttcggcttta

SEQ ID NO: 985842 - DNA, 22 bp, Artificial Sequence
  chemically synthesized
gaatacagttctcttcggcttt

SEQ ID NO: 985843 - DNA, 22 bp, Artificial Sequence
  chemically synthesized
atttgaatacagttctcttcgg

SEQ ID NO: 985844 - DNA, 22 bp, Artificial Sequence
  chemically synthesized
catttgaatacagttctcttcg

SEQ ID NO: 985845 - DNA, 22 bp, Artificial Sequence
  chemically synthesized
tcatttgaatacagttctcttc

SEQ ID NO: 985846 - DNA, 22 bp, Artificial Sequence
  chemically synthesized
gtaaagccgaagagaactgtat

SEQ ID NO: 985847 - DNA, 22 bp, Artificial Sequence
  chemically synthesized
tactttcatttgaatacagttc

SEQ ID NO: 985848 - DNA, 22 bp, Artificial Sequence
  chemically synthesized
aaaaaaaaaactatactttcat

SEQ ID NO: 985849 - DNA, 22 bp, Artificial Sequence
  chemically synthesized
tattcaaatgaaagtatagttt

SEQ ID NO: 985850 - DNA, 22 bp, Artificial Sequence
  chemically synthesized
aagttgaaaaaaaaaactatac

SEQ ID NO: 985851 - DNA, 22 bp, Artificial Sequence
  chemically synthesized
aaatgaaagtatagtttttttt

SEQ ID NO: 985852 - DNA, 22 bp, Artificial Sequence
  chemically synthesized
gtccaaaattaaagttgaaaaa

SEQ ID NO: 985853 - DNA, 22 bp, Artificial Sequence
  chemically synthesized
cctagtccaaaattaaagttga

SEQ ID NO: 985854 - DNA, 22 bp, Artificial Sequence
  chemically synthesized
tttttttcaactttaattttgg

SEQ ID NO: 985855 - DNA, 22 bp, Artificial Sequence
  chemically synthesized
ttttttcaactttaattttgga

SEQ ID NO: 985856 - DNA, 22 bp, Artificial Sequence
  chemically synthesized
tttttcaactttaattttggac

SEQ ID NO: 985857 - DNA, 22 bp, Artificial Sequence
  chemically synthesized
ttttcaactttaattttggact

SEQ ID NO: 985858 - DNA, 22 bp, Artificial Sequence
  chemically synthesized
tttcaactttaattttggacta

SEQ ID NO: 985859 - DNA, 22 bp, Artificial Sequence
  chemically synthesized
ttcaactttaattttggactag

SEQ ID NO: 985860 - DNA, 22 bp, Artificial Sequence
  chemically synthesized
cataggtactccctagtccaaa

SEQ ID NO: 985861 - DNA, 22 bp, Artificial Sequence
  chemically synthesized
tcaactttaattttggactagg

SEQ ID NO: 985862 - DNA, 22 bp, Artificial Sequence
  chemically synthesized
caactttaattttggactaggg

SEQ ID NO: 985863 - DNA, 22 bp, Artificial Sequence
  chemically synthesized
aactttaattttggactaggga

SEQ ID NO: 985864 - DNA, 22 bp, Artificial Sequence
  chemically synthesized
taattttggactagggagtacc

SEQ ID NO: 985865 - DNA, 22 bp, Artificial Sequence
  chemically synthesized
aattttggactagggagtacct

SEQ ID NO: 985866 - DNA, 22 bp, Artificial Sequence
  chemically synthesized
attttggactagggagtaccta

SEQ ID NO: 985867 - DNA, 22 bp, Artificial Sequence
  chemically synthesized
tggactagggagtacctatgca

SEQ ID NO: 985868 - DNA, 22 bp, Artificial Sequence
  chemically synthesized
ggactagggagtacctatgcag

SEQ ID NO: 985869 - DNA, 22 bp, Artificial Sequence
  chemically synthesized
gactagggagtacctatgcagg

SEQ ID NO: 985870 - DNA, 22 bp, Artificial Sequence
  chemically synthesized
gggagtacctatgcaggattgt

SEQ ID NO: 985871 - DNA, 22 bp, Artificial Sequence
  chemically synthesized
atcatgcaacatacccatgtaa

SEQ ID NO: 985872 - DNA, 22 bp, Artificial Sequence
  chemically synthesized
catcatgcaacatacccatgta

SEQ ID NO: 985873 - DNA, 22 bp, Artificial Sequence
  chemically synthesized
tgcaggattgttacatgggtat

SEQ ID NO: 985874 - DNA, 22 bp, Artificial Sequence
  chemically synthesized
tcatcatgcaacatacccatgt

SEQ ID NO: 985875 - DNA, 22 bp, Artificial Sequence
  chemically synthesized
ttcatcatgcaacatacccatg

SEQ ID NO: 985876 - DNA, 22 bp, Artificial Sequence
  chemically synthesized
cttttcatcatgcaacataccc

SEQ ID NO: 985877 - DNA, 22 bp, Artificial Sequence
  chemically synthesized
gcttttcatcatgcaacatacc

SEQ ID NO: 985878 - DNA, 22 bp, Artificial Sequence
  chemically synthesized
tgcttttcatcatgcaacatac

SEQ ID NO: 985879 - DNA, 22 bp, Artificial Sequence
  chemically synthesized
ttacatgggtatgttgcatgat

SEQ ID NO: 985880 - DNA, 22 bp, Artificial Sequence
  chemically synthesized
catgggtatgttgcatgatgaa

SEQ ID NO: 985881 - DNA, 22 bp, Artificial Sequence
  chemically synthesized
aaatcaaaaactttgcttttca

SEQ ID NO: 985882 - DNA, 22 bp, Artificial Sequence
  chemically synthesized
catgatgaaaagcaaagttttt

SEQ ID NO: 985883 - DNA, 22 bp, Artificial Sequence
  chemically synthesized
caaaaacctgaaatcaaaaact

SEQ ID NO: 985884 - DNA, 22 bp, Artificial Sequence
  chemically synthesized
tccaaaaacctgaaatcaaaaa

SEQ ID NO: 985885 - DNA, 22 bp, Artificial Sequence
  chemically synthesized
ctccaaaaacctgaaatcaaaa

SEQ ID NO: 985886 - DNA, 22 bp, Artificial Sequence
  chemically synthesized
tttctccaaaaacctgaaatca

SEQ ID NO: 985887 - DNA, 22 bp, Artificial Sequence
  chemically synthesized
gtttctccaaaaacctgaaatc

SEQ ID NO: 985888 - DNA, 22 bp, Artificial Sequence
  chemically synthesized
ttgtttctccaaaaacctgaaa

SEQ ID NO: 985889 - DNA, 22 bp, Artificial Sequence
  chemically synthesized
ttgatttcaggtttttggagaa

SEQ ID NO: 985890 - DNA, 22 bp, Artificial Sequence
  chemically synthesized
tgatttcaggtttttggagaaa

SEQ ID NO: 985891 - DNA, 22 bp, Artificial Sequence
  chemically synthesized
gatttcaggtttttggagaaac

SEQ ID NO: 985892 - DNA, 22 bp, Artificial Sequence
  chemically synthesized
cgaggcactcttgtttctccaa

SEQ ID NO: 985893 - DNA, 22 bp, Artificial Sequence
  chemically synthesized
atttcaggtttttggagaaaca

SEQ ID NO: 985894 - DNA, 22 bp, Artificial Sequence
  chemically synthesized
caggtttttggagaaacaagag

SEQ ID NO: 985895 - DNA, 22 bp, Artificial Sequence
  chemically synthesized
aggtttttggagaaacaagagt

SEQ ID NO: 985896 - DNA, 22 bp, Artificial Sequence
  chemically synthesized
ttggagaaacaagagtgcctcg

SEQ ID NO: 985897 - DNA, 22 bp, Artificial Sequence
  chemically synthesized
tggagaaacaagagtgcctcgg

SEQ ID NO: 985898 - DNA, 22 bp, Artificial Sequence
  chemically synthesized
ggagaaacaagagtgcctcgga

SEQ ID NO: 985899 - DNA, 22 bp, Artificial Sequence
  chemically synthesized
gagaaacaagagtgcctcggag

SEQ ID NO: 985900 - DNA, 22 bp, Artificial Sequence
  chemically synthesized
atgcagcaccatggacagctcc

SEQ ID NO: 985901 - DNA, 22 bp, Artificial Sequence
  chemically synthesized
gtctcatgcagcaccatggaca

SEQ ID NO: 985902 - DNA, 22 bp, Artificial Sequence
  chemically synthesized
ggagctgtccatggtgctgcat

SEQ ID NO: 985903 - DNA, 22 bp, Artificial Sequence
  chemically synthesized
tccatggtgctgcatgagacca

SEQ ID NO: 985904 - DNA, 22 bp, Artificial Sequence
  chemically synthesized
cagaatgaaggcctggtctcat

SEQ ID NO: 985905 - DNA, 22 bp, Artificial Sequence
  chemically synthesized
tgcagaatgaaggcctggtctc

SEQ ID NO: 985906 - DNA, 22 bp, Artificial Sequence
  chemically synthesized
catgagaccaggccttcattct

SEQ ID NO: 985907 - DNA, 22 bp, Artificial Sequence
  chemically synthesized
aagaggcaggaattctgcagaa

SEQ ID NO: 985908 - DNA, 22 bp, Artificial Sequence
  chemically synthesized
caagaggcaggaattctgcaga

SEQ ID NO: 985909 - DNA, 22 bp, Artificial Sequence
  chemically synthesized
tcaagaggcaggaattctgcag

SEQ ID NO: 985910 - DNA, 22 bp, Artificial Sequence
  chemically synthesized
cattctgcagaattcctgcctc

SEQ ID NO: 985911 - DNA, 22 bp, Artificial Sequence
  chemically synthesized
gagaattttcaagaggcaggaa

SEQ ID NO: 985912 - DNA, 22 bp, Artificial Sequence
  chemically synthesized
attctgcagaattcctgcctct

SEQ ID NO: 985913 - DNA, 22 bp, Artificial Sequence
  chemically synthesized
tgcagaattcctgcctcttgaa

SEQ ID NO: 985914 - DNA, 22 bp, Artificial Sequence
  chemically synthesized
cagaattcctgcctcttgaaaa

SEQ ID NO: 985915 - DNA, 22 bp, Artificial Sequence
  chemically synthesized
taagtcagggcctagagaattt

SEQ ID NO: 985916 - DNA, 22 bp, Artificial Sequence
  chemically synthesized
ctgcctcttgaaaattctctag

SEQ ID NO: 985917 - DNA, 22 bp, Artificial Sequence
  chemically synthesized
cctcttgaaaattctctaggcc

SEQ ID NO: 985918 - DNA, 22 bp, Artificial Sequence
  chemically synthesized
ttgaaaattctctaggccctga

SEQ ID NO: 985919 - DNA, 22 bp, Artificial Sequence
  chemically synthesized
gaaaattctctaggccctgact

SEQ ID NO: 985920 - DNA, 22 bp, Artificial Sequence
  chemically synthesized
aaaattctctaggccctgactt

SEQ ID NO: 985921 - DNA, 22 bp, Artificial Sequence
  chemically synthesized
tctaggccctgacttacaaccc

SEQ ID NO: 985922 - DNA, 22 bp, Artificial Sequence
  chemically synthesized
taggccctgacttacaaccctg

SEQ ID NO: 985923 - DNA, 22 bp, Artificial Sequence
  chemically synthesized
accatacagcaaacagggttgt

SEQ ID NO: 985924 - DNA, 22 bp, Artificial Sequence
  chemically synthesized
ggccctgacttacaaccctgtt

SEQ ID NO: 985925 - DNA, 22 bp, Artificial Sequence
  chemically synthesized
acttacaaccctgtttgctgta

SEQ ID NO: 985926 - DNA, 22 bp, Artificial Sequence
  chemically synthesized
gcaggttaaccatacagcaaac

SEQ ID NO: 985927 - DNA, 22 bp, Artificial Sequence
  chemically synthesized
acaaccctgtttgctgtatggt

SEQ ID NO: 985928 - DNA, 22 bp, Artificial Sequence
  chemically synthesized
caaccctgtttgctgtatggtt

SEQ ID NO: 985929 - DNA, 22 bp, Artificial Sequence
  chemically synthesized
tttgctgtatggttaacctgcc

SEQ ID NO: 985930 - DNA, 22 bp, Artificial Sequence
  chemically synthesized
gctgtatggttaacctgccaac

SEQ ID NO: 985931 - DNA, 22 bp, Artificial Sequence
  chemically synthesized
ctgtatggttaacctgccaacc

SEQ ID NO: 985932 - DNA, 22 bp, Artificial Sequence
  chemically synthesized
tatggttaacctgccaaccctg

SEQ ID NO: 985933 - DNA, 22 bp, Artificial Sequence
  chemically synthesized
taggggacatagcagggttggc

SEQ ID NO: 985934 - DNA, 22 bp, Artificial Sequence
  chemically synthesized
ataggggacatagcagggttgg

SEQ ID NO: 985935 - DNA, 22 bp, Artificial Sequence
  chemically synthesized
acctgccaaccctgctatgtcc

SEQ ID NO: 985936 - DNA, 22 bp, Artificial Sequence
  chemically synthesized
aataatcacttataggggacat

SEQ ID NO: 985937 - DNA, 22 bp, Artificial Sequence
  chemically synthesized
ccaaccctgctatgtcccctat

SEQ ID NO: 985938 - DNA, 22 bp, Artificial Sequence
  chemically synthesized
tgttaaataatcacttataggg

SEQ ID NO: 985939 - DNA, 22 bp, Artificial Sequence
  chemically synthesized
ctatgtcccctataagtgatta

SEQ ID NO: 985940 - DNA, 22 bp, Artificial Sequence
  chemically synthesized
tagattatgttaaataatcact

SEQ ID NO: 985941 - DNA, 22 bp, Artificial Sequence
  chemically synthesized
tgtcccctataagtgattattt

SEQ ID NO: 985942 - DNA, 22 bp, Artificial Sequence
  chemically synthesized
aaattatagattatgttaaata

SEQ ID NO: 985943 - DNA, 22 bp, Artificial Sequence
  chemically synthesized
taagtgattatttaacataatc

SEQ ID NO: 985944 - DNA, 22 bp, Artificial Sequence
  chemically synthesized
gtactgaaattatagattatgt

SEQ ID NO: 985945 - DNA, 22 bp, Artificial Sequence
  chemically synthesized
agtactgaaattatagattatg

SEQ ID NO: 985946 - DNA, 22 bp, Artificial Sequence
  chemically synthesized
tttaacataatctataatttca

SEQ ID NO: 985947 - DNA, 22 bp, Artificial Sequence
  chemically synthesized
aacataatctataatttcagta

SEQ ID NO: 985948 - DNA, 22 bp, Artificial Sequence
  chemically synthesized
acataatctataatttcagtac

SEQ ID NO: 985949 - DNA, 22 bp, Artificial Sequence
  chemically synthesized
gtcatgaaatatttagtactga

SEQ ID NO: 985950 - DNA, 22 bp, Artificial Sequence
  chemically synthesized
taattagtcatgaaatatttag

SEQ ID NO: 985951 - DNA, 22 bp, Artificial Sequence
  chemically synthesized
taatttcagtactaaatatttc

SEQ ID NO: 985952 - DNA, 22 bp, Artificial Sequence
  chemically synthesized
ttataattagtcatgaaatatt

SEQ ID NO: 985953 - DNA, 22 bp, Artificial Sequence
  chemically synthesized
cagtactaaatatttcatgact

SEQ ID NO: 985954 - DNA, 22 bp, Artificial Sequence
  chemically synthesized
agtactaaatatttcatgacta

SEQ ID NO: 985955 - DNA, 22 bp, Artificial Sequence
  chemically synthesized
aatatttcatgactaattataa

SEQ ID NO: 985956 - DNA, 22 bp, Artificial Sequence
  chemically synthesized
catgactaattataacagctct

SEQ ID NO: 985957 - DNA, 22 bp, Artificial Sequence
  chemically synthesized
atgactaattataacagctctc

SEQ ID NO: 985958 - DNA, 22 bp, Artificial Sequence
  chemically synthesized
attataacagctctctatgttt

SEQ ID NO: 985959 - DNA, 22 bp, Artificial Sequence
  chemically synthesized
taacagctctctatgtttccct

SEQ ID NO: 985960 - DNA, 22 bp, Artificial Sequence
  chemically synthesized
tctatgtttccctgggtgatat

SEQ ID NO: 985961 - DNA, 22 bp, Artificial Sequence
  chemically synthesized
gaatgtgtggtgatatcaccca

SEQ ID NO: 985962 - DNA, 22 bp, Artificial Sequence
  chemically synthesized
tatgtttccctgggtgatatca

SEQ ID NO: 985963 - DNA, 22 bp, Artificial Sequence
  chemically synthesized
tgtttccctgggtgatatcacc

SEQ ID NO: 985964 - DNA, 22 bp, Artificial Sequence
  chemically synthesized
ccaaattggaatgtgtggtgat

SEQ ID NO: 985965 - DNA, 22 bp, Artificial Sequence
  chemically synthesized
ccctgggtgatatcaccacaca

SEQ ID NO: 985966 - DNA, 22 bp, Artificial Sequence
  chemically synthesized
cctgggtgatatcaccacacat

SEQ ID NO: 985967 - DNA, 22 bp, Artificial Sequence
  chemically synthesized
ggtgatatcaccacacattcca

SEQ ID NO: 985968 - DNA, 22 bp, Artificial Sequence
  chemically synthesized
ggcccaccgagatctgccaaat

SEQ ID NO: 985969 - DNA, 22 bp, Artificial Sequence
  chemically synthesized
ctgggcccaccgagatctgcca

SEQ ID NO: 985970 - DNA, 22 bp, Artificial Sequence
  chemically synthesized
caatttggcagatctcggtggg

SEQ ID NO: 985971 - DNA, 22 bp, Artificial Sequence
  chemically synthesized
catacaaattcctgggcccacc

SEQ ID NO: 985972 - DNA, 22 bp, Artificial Sequence
  chemically synthesized
gcatacaaattcctgggcccac

SEQ ID NO: 985973 - DNA, 22 bp, Artificial Sequence
  chemically synthesized
ggcagatctcggtgggcccagg

SEQ ID NO: 985974 - DNA, 22 bp, Artificial Sequence
  chemically synthesized
gcagatctcggtgggcccagga

SEQ ID NO: 985975 - DNA, 22 bp, Artificial Sequence
  chemically synthesized
ggtgggcccaggaatttgtatg

SEQ ID NO: 985976 - DNA, 22 bp, Artificial Sequence
  chemically synthesized
tatgaggatgtatatttgcata

SEQ ID NO: 985977 - DNA, 22 bp, Artificial Sequence
  chemically synthesized
ataagaattatatgaggatgta

SEQ ID NO: 985978 - DNA, 22 bp, Artificial Sequence
  chemically synthesized
gtatgcaaatatacatcctcat

SEQ ID NO: 985979 - DNA, 22 bp, Artificial Sequence
  chemically synthesized
tatgcaaatatacatcctcata

SEQ ID NO: 985980 - DNA, 22 bp, Artificial Sequence
  chemically synthesized
gtccctcataagaattatatga

SEQ ID NO: 985981 - DNA, 22 bp, Artificial Sequence
  chemically synthesized
agtccctcataagaattatatg

SEQ ID NO: 985982 - DNA, 22 bp, Artificial Sequence
  chemically synthesized
tagtccctcataagaattatat

SEQ ID NO: 985983 - DNA, 22 bp, Artificial Sequence
  chemically synthesized
agcaggactttagtccctcata

SEQ ID NO: 985984 - DNA, 22 bp, Artificial Sequence
  chemically synthesized
atataattcttatgagggacta

SEQ ID NO: 985985 - DNA, 22 bp, Artificial Sequence
  chemically synthesized
gagtctaagcaggactttagtc

SEQ ID NO: 985986 - DNA, 22 bp, Artificial Sequence
  chemically synthesized
ttatgagggactaaagtcctgc

SEQ ID NO: 985987 - DNA, 22 bp, Artificial Sequence
  chemically synthesized
atgagggactaaagtcctgctt

SEQ ID NO: 985988 - DNA, 22 bp, Artificial Sequence
  chemically synthesized
tgagggactaaagtcctgctta

SEQ ID NO: 985989 - DNA, 22 bp, Artificial Sequence
  chemically synthesized
ggaagactagagtctaagcagg

SEQ ID NO: 985990 - DNA, 22 bp, Artificial Sequence
  chemically synthesized
gggaagactagagtctaagcag

SEQ ID NO: 985991 - DNA, 22 bp, Artificial Sequence
  chemically synthesized
aagtcctgcttagactctagtc

SEQ ID NO: 985992 - DNA, 22 bp, Artificial Sequence
  chemically synthesized
aggtgggcgaccttgggaagac

SEQ ID NO: 985993 - DNA, 22 bp, Artificial Sequence
  chemically synthesized
cttagactctagtcttcccaag

SEQ ID NO: 985994 - DNA, 22 bp, Artificial Sequence
  chemically synthesized
agactctagtcttcccaaggtc

SEQ ID NO: 985995 - DNA, 22 bp, Artificial Sequence
  chemically synthesized
gactctagtcttcccaaggtcg

SEQ ID NO: 985996 - DNA, 22 bp, Artificial Sequence
  chemically synthesized
gggattaaggtgggcgaccttg

SEQ ID NO: 985997 - DNA, 22 bp, Artificial Sequence
  chemically synthesized
tagtcttcccaaggtcgcccac

SEQ ID NO: 985998 - DNA, 22 bp, Artificial Sequence
  chemically synthesized
gctcgggattaaggtgggcgac

SEQ ID NO: 985999 - DNA, 22 bp, Artificial Sequence
  chemically synthesized
gtcttcccaaggtcgcccacct

SEQ ID NO: 986000 - DNA, 22 bp, Artificial Sequence
  chemically synthesized
cccaaggtcgcccaccttaatc

SEQ ID NO: 986001 - DNA, 22 bp, Artificial Sequence
  chemically synthesized
ccaaggtcgcccaccttaatcc

SEQ ID NO: 986002 - DNA, 22 bp, Artificial Sequence
  chemically synthesized
gggacgagttggctcgggatta

SEQ ID NO: 986003 - DNA, 22 bp, Artificial Sequence
  chemically synthesized
caactggggacgagttggctcg

SEQ ID NO: 986004 - DNA, 22 bp, Artificial Sequence
  chemically synthesized
tctccaactggggacgagttgg

SEQ ID NO: 986005 - DNA, 22 bp, Artificial Sequence
  chemically synthesized
gtctccaactggggacgagttg

SEQ ID NO: 986006 - DNA, 22 bp, Artificial Sequence
  chemically synthesized
aatcccgagccaactcgtcccc

SEQ ID NO: 986007 - DNA, 22 bp, Artificial Sequence
  chemically synthesized
ttgtctccaactggggacgagt

SEQ ID NO: 986008 - DNA, 22 bp, Artificial Sequence
  chemically synthesized
atcccgagccaactcgtcccca

SEQ ID NO: 986009 - DNA, 22 bp, Artificial Sequence
  chemically synthesized
ctcttgtctccaactggggacg

SEQ ID NO: 986010 - DNA, 22 bp, Artificial Sequence
  chemically synthesized
tgctcttgtctccaactgggga

SEQ ID NO: 986011 - DNA, 22 bp, Artificial Sequence
  chemically synthesized
ctgctcttgtctccaactgggg

SEQ ID NO: 986012 - DNA, 22 bp, Artificial Sequence
  chemically synthesized
gtccccagttggagacaagagc

SEQ ID NO: 986013 - DNA, 22 bp, Artificial Sequence
  chemically synthesized
tggaatcaaaatttctgctctt

SEQ ID NO: 986014 - DNA, 22 bp, Artificial Sequence
  chemically synthesized
gtggaatcaaaatttctgctct

SEQ ID NO: 986015 - DNA, 22 bp, Artificial Sequence
  chemically synthesized
tgtggaatcaaaatttctgctc

SEQ ID NO: 986016 - DNA, 22 bp, Artificial Sequence
  chemically synthesized
gagacaagagcagaaattttga

SEQ ID NO: 986017 - DNA, 22 bp, Artificial Sequence
  chemically synthesized
atcaaacagctttgtggaatca

SEQ ID NO: 986018 - DNA, 22 bp, Artificial Sequence
  chemically synthesized
tgattccacaaagctgtttgat

SEQ ID NO: 986019 - DNA, 22 bp, Artificial Sequence
  chemically synthesized
gattccacaaagctgtttgatt

SEQ ID NO: 986020 - DNA, 22 bp, Artificial Sequence
  chemically synthesized
attccacaaagctgtttgatta

SEQ ID NO: 986021 - DNA, 22 bp, Artificial Sequence
  chemically synthesized
cacaaagctgtttgattaggcc

SEQ ID NO: 986022 - DNA, 22 bp, Artificial Sequence
  chemically synthesized
cagatgatgtatgtgaggccta

SEQ ID NO: 986023 - DNA, 22 bp, Artificial Sequence
  chemically synthesized
tttgattaggcctcacatacat

SEQ ID NO: 986024 - DNA, 22 bp, Artificial Sequence
  chemically synthesized
tgtgattccagatgatgtatgt

SEQ ID NO: 986025 - DNA, 22 bp, Artificial Sequence
  chemically synthesized
gattaggcctcacatacatcat

SEQ ID NO: 986026 - DNA, 22 bp, Artificial Sequence
  chemically synthesized
attaggcctcacatacatcatc

SEQ ID NO: 986027 - DNA, 22 bp, Artificial Sequence
  chemically synthesized
agttgtgtgattccagatgatg

SEQ ID NO: 986028 - DNA, 22 bp, Artificial Sequence
  chemically synthesized
ggcctcacatacatcatctgga

SEQ ID NO: 986029 - DNA, 22 bp, Artificial Sequence
  chemically synthesized
cagttgtgtgattccagatgat

SEQ ID NO: 986030 - DNA, 22 bp, Artificial Sequence
  chemically synthesized
acatacatcatctggaatcaca

SEQ ID NO: 986031 - DNA, 22 bp, Artificial Sequence
  chemically synthesized
gaatcacacaactgaagcttca

SEQ ID NO: 986032 - DNA, 22 bp, Artificial Sequence
  chemically synthesized
tagcagtgtcataaatgaagct

SEQ ID NO: 986033 - DNA, 22 bp, Artificial Sequence
  chemically synthesized
gtacactgtagcagtgtcataa

SEQ ID NO: 986034 - DNA, 22 bp, Artificial Sequence
  chemically synthesized
aagcttcatttatgacactgct

SEQ ID NO: 986035 - DNA, 22 bp, Artificial Sequence
  chemically synthesized
catttatgacactgctacagtg

SEQ ID NO: 986036 - DNA, 22 bp, Artificial Sequence
  chemically synthesized
atttatgacactgctacagtgt

SEQ ID NO: 986037 - DNA, 22 bp, Artificial Sequence
  chemically synthesized
atgacactgctacagtgtacca

SEQ ID NO: 986038 - DNA, 22 bp, Artificial Sequence
  chemically synthesized
tgacactgctacagtgtaccaa

SEQ ID NO: 986039 - DNA, 22 bp, Artificial Sequence
  chemically synthesized
ctacagtgtaccaattcctttc

SEQ ID NO: 986040 - DNA, 22 bp, Artificial Sequence
  chemically synthesized
cagtgtaccaattcctttccct

SEQ ID NO: 986041 - DNA, 22 bp, Artificial Sequence
  chemically synthesized
aaaaaaagaaaaaatatatagg

SEQ ID NO: 986042 - DNA, 22 bp, Artificial Sequence
  chemically synthesized
gaaaaaaagaaaaaatatatag

SEQ ID NO: 986043 - DNA, 22 bp, Artificial Sequence
  chemically synthesized
ctttccctatatattttttctt

SEQ ID NO: 986044 - DNA, 22 bp, Artificial Sequence
  chemically synthesized
tccctatatattttttcttttt

SEQ ID NO: 986045 - DNA, 22 bp, Artificial Sequence
  chemically synthesized
ccctatatattttttctttttt

SEQ ID NO: 986046 - DNA, 22 bp, Artificial Sequence
  chemically synthesized
cctatatattttttcttttttt

SEQ ID NO: 986047 - DNA, 22 bp, Artificial Sequence
  chemically synthesized
tatattttttctttttttcaaa

SEQ ID NO: 986048 - DNA, 22 bp, Artificial Sequence
  chemically synthesized
aagtaggataaataggatttga

SEQ ID NO: 986049 - DNA, 22 bp, Artificial Sequence
  chemically synthesized
gaagtaggataaataggatttg

SEQ ID NO: 986050 - DNA, 22 bp, Artificial Sequence
  chemically synthesized
tttctttttttcaaatcctatt

SEQ ID NO: 986051 - DNA, 22 bp, Artificial Sequence
  chemically synthesized
ttctttttttcaaatcctattt

SEQ ID NO: 986052 - DNA, 22 bp, Artificial Sequence
  chemically synthesized
tctttttttcaaatcctattta

SEQ ID NO: 986053 - DNA, 22 bp, Artificial Sequence
  chemically synthesized
ctttttttcaaatcctatttat

SEQ ID NO: 986054 - DNA, 22 bp, Artificial Sequence
  chemically synthesized
tttttttcaaatcctatttatc

SEQ ID NO: 986055 - DNA, 22 bp, Artificial Sequence
  chemically synthesized
tttttcaaatcctatttatcct

SEQ ID NO: 986056 - DNA, 22 bp, Artificial Sequence
  chemically synthesized
ttttcaaatcctatttatccta

SEQ ID NO: 986057 - DNA, 22 bp, Artificial Sequence
  chemically synthesized
tttcaaatcctatttatcctac

SEQ ID NO: 986058 - DNA, 22 bp, Artificial Sequence
  chemically synthesized
tagagatttgaagtaggataaa

SEQ ID NO: 986059 - DNA, 22 bp, Artificial Sequence
  chemically synthesized
ttcaaatcctatttatcctact

SEQ ID NO: 986060 - DNA, 22 bp, Artificial Sequence
  chemically synthesized
tcaaatcctatttatcctactt

SEQ ID NO: 986061 - DNA, 22 bp, Artificial Sequence
  chemically synthesized
caaatcctatttatcctacttc

SEQ ID NO: 986062 - DNA, 22 bp, Artificial Sequence
  chemically synthesized
aaatcctatttatcctacttca

SEQ ID NO: 986063 - DNA, 22 bp, Artificial Sequence
  chemically synthesized
tttatcctacttcaaatctcta

SEQ ID NO: 986064 - DNA, 22 bp, Artificial Sequence
  chemically synthesized
aatatggtgctatagagatttg

SEQ ID NO: 986065 - DNA, 22 bp, Artificial Sequence
  chemically synthesized
taaatatggtgctatagagatt

SEQ ID NO: 986066 - DNA, 22 bp, Artificial Sequence
  chemically synthesized
atcctacttcaaatctctatag

SEQ ID NO: 986067 - DNA, 22 bp, Artificial Sequence
  chemically synthesized
tcctacttcaaatctctatagc

SEQ ID NO: 986068 - DNA, 22 bp, Artificial Sequence
  chemically synthesized
cttcaaatctctatagcaccat

SEQ ID NO: 986069 - DNA, 22 bp, Artificial Sequence
  chemically synthesized
aatgactctaaatatggtgcta

SEQ ID NO: 986070 - DNA, 22 bp, Artificial Sequence
  chemically synthesized
caaatctctatagcaccatatt

SEQ ID NO: 986071 - DNA, 22 bp, Artificial Sequence
  chemically synthesized
aaatctctatagcaccatattt

SEQ ID NO: 986072 - DNA, 22 bp, Artificial Sequence
  chemically synthesized
tatagcaccatatttagagtca

SEQ ID NO: 986073 - DNA, 22 bp, Artificial Sequence
  chemically synthesized
tagcaccatatttagagtcatt

SEQ ID NO: 986074 - DNA, 22 bp, Artificial Sequence
  chemically synthesized
aaatcaagatctgaatgactct

SEQ ID NO: 986075 - DNA, 22 bp, Artificial Sequence
  chemically synthesized
attcaaatcaagatctgaatga

SEQ ID NO: 986076 - DNA, 22 bp, Artificial Sequence
  chemically synthesized
ttgattcaaatcaagatctgaa

SEQ ID NO: 986077 - DNA, 22 bp, Artificial Sequence
  chemically synthesized
agagtcattcagatcttgattt

SEQ ID NO: 986078 - DNA, 22 bp, Artificial Sequence
  chemically synthesized
gagtcattcagatcttgatttg

SEQ ID NO: 986079 - DNA, 22 bp, Artificial Sequence
  chemically synthesized
aatgtagttattgattcaaatc

SEQ ID NO: 986080 - DNA, 22 bp, Artificial Sequence
  chemically synthesized
caatgtagttattgattcaaat

SEQ ID NO: 986081 - DNA, 22 bp, Artificial Sequence
  chemically synthesized
tttcaatgtagttattgattca

SEQ ID NO: 986082 - DNA, 22 bp, Artificial Sequence
  chemically synthesized
agatcttgatttgaatcaataa

SEQ ID NO: 986083 - DNA, 22 bp, Artificial Sequence
  chemically synthesized
gatttgaatcaataactacatt

SEQ ID NO: 986084 - DNA, 22 bp, Artificial Sequence
  chemically synthesized
atttgaatcaataactacattg

SEQ ID NO: 986085 - DNA, 22 bp, Artificial Sequence
  chemically synthesized
agtgagttgtttcaatgtagtt

SEQ ID NO: 986086 - DNA, 22 bp, Artificial Sequence
  chemically synthesized
gaatcaataactacattgaaac

SEQ ID NO: 986087 - DNA, 22 bp, Artificial Sequence
  chemically synthesized
aatcaataactacattgaaaca

SEQ ID NO: 986088 - DNA, 22 bp, Artificial Sequence
  chemically synthesized
aatatagggttaagtgagttgt

SEQ ID NO: 986089 - DNA, 22 bp, Artificial Sequence
  chemically synthesized
gaatatagggttaagtgagttg

SEQ ID NO: 986090 - DNA, 22 bp, Artificial Sequence
  chemically synthesized
cattgaaacaactcacttaacc

SEQ ID NO: 986091 - DNA, 22 bp, Artificial Sequence
  chemically synthesized
aaacaactcacttaaccctata

SEQ ID NO: 986092 - DNA, 22 bp, Artificial Sequence
  chemically synthesized
atgaaggcttgaatatagggtt

SEQ ID NO: 986093 - DNA, 22 bp, Artificial Sequence
  chemically synthesized
acttaaccctatattcaagcct

SEQ ID NO: 986094 - DNA, 22 bp, Artificial Sequence
  chemically synthesized
aaccctatattcaagccttcat

SEQ ID NO: 986095 - DNA, 22 bp, Artificial Sequence
  chemically synthesized
acaggtgaattcatgaaggctt

SEQ ID NO: 986096 - DNA, 22 bp, Artificial Sequence
  chemically synthesized
accctatattcaagccttcatg

SEQ ID NO: 986097 - DNA, 22 bp, Artificial Sequence
  chemically synthesized
gacaggtgaattcatgaaggct

SEQ ID NO: 986098 - DNA, 22 bp, Artificial Sequence
  chemically synthesized
atttgacaggtgaattcatgaa

SEQ ID NO: 986099 - DNA, 22 bp, Artificial Sequence
  chemically synthesized
catttgacaggtgaattcatga

SEQ ID NO: 986100 - DNA, 22 bp, Artificial Sequence
  chemically synthesized
tattcaagccttcatgaattca

SEQ ID NO: 986101 - DNA, 22 bp, Artificial Sequence
  chemically synthesized
tcatttgacaggtgaattcatg

SEQ ID NO: 986102 - DNA, 22 bp, Artificial Sequence
  chemically synthesized
ttcatttgacaggtgaattcat

SEQ ID NO: 986103 - DNA, 22 bp, Artificial Sequence
  chemically synthesized
tttcatttgacaggtgaattca

SEQ ID NO: 986104 - DNA, 22 bp, Artificial Sequence
  chemically synthesized
ttttcatttgacaggtgaattc

SEQ ID NO: 986105 - DNA, 22 bp, Artificial Sequence
  chemically synthesized
aagccttcatgaattcacctgt

SEQ ID NO: 986106 - DNA, 22 bp, Artificial Sequence
  chemically synthesized
tttttttcatttgacaggtgaa

SEQ ID NO: 986107 - DNA, 22 bp, Artificial Sequence
  chemically synthesized
catgaattcacctgtcaaatga

SEQ ID NO: 986108 - DNA, 22 bp, Artificial Sequence
  chemically synthesized
atgaattcacctgtcaaatgaa

SEQ ID NO: 986109 - DNA, 22 bp, Artificial Sequence
  chemically synthesized
taggtgttatttttttcatttg

SEQ ID NO: 986110 - DNA, 22 bp, Artificial Sequence
  chemically synthesized
acctgtcaaatgaaaaaaataa

SEQ ID NO: 986111 - DNA, 22 bp, Artificial Sequence
  chemically synthesized
caaagctgtaggtgttattttt

SEQ ID NO: 986112 - DNA, 22 bp, Artificial Sequence
  chemically synthesized
tgcaaagctgtaggtgttattt

SEQ ID NO: 986113 - DNA, 22 bp, Artificial Sequence
  chemically synthesized
tcaaatgaaaaaaataacacct

SEQ ID NO: 986114 - DNA, 22 bp, Artificial Sequence
  chemically synthesized
aaaataattctgcaaagctgta

SEQ ID NO: 986115 - DNA, 22 bp, Artificial Sequence
  chemically synthesized
ccctgaaaataattctgcaaag

SEQ ID NO: 986116 - DNA, 22 bp, Artificial Sequence
  chemically synthesized
atattaccctgaaaataattct

SEQ ID NO: 986117 - DNA, 22 bp, Artificial Sequence
  chemically synthesized
cagctttgcagaattattttca

SEQ ID NO: 986118 - DNA, 22 bp, Artificial Sequence
  chemically synthesized
tgcagaattattttcagggtaa

SEQ ID NO: 986119 - DNA, 22 bp, Artificial Sequence
  chemically synthesized
gcagaattattttcagggtaat

SEQ ID NO: 986120 - DNA, 22 bp, Artificial Sequence
  chemically synthesized
cagaattattttcagggtaata

SEQ ID NO: 986121 - DNA, 22 bp, Artificial Sequence
  chemically synthesized
gaaaccatgtctcatattaccc

SEQ ID NO: 986122 - DNA, 22 bp, Artificial Sequence
  chemically synthesized
agttagaaaccatgtctcatat

SEQ ID NO: 986123 - DNA, 22 bp, Artificial Sequence
  chemically synthesized
ttttcagggtaatatgagacat

SEQ ID NO: 986124 - DNA, 22 bp, Artificial Sequence
  chemically synthesized
tcagggtaatatgagacatggt

SEQ ID NO: 986125 - DNA, 22 bp, Artificial Sequence
  chemically synthesized
gctgagttagaaaccatgtctc

SEQ ID NO: 986126 - DNA, 22 bp, Artificial Sequence
  chemically synthesized
cagggtaatatgagacatggtt

SEQ ID NO: 986127 - DNA, 22 bp, Artificial Sequence
  chemically synthesized
agggtaatatgagacatggttt

SEQ ID NO: 986128 - DNA, 22 bp, Artificial Sequence
  chemically synthesized
tgtatcagataatgtgctagct

SEQ ID NO: 986129 - DNA, 22 bp, Artificial Sequence
  chemically synthesized
ctaactcagctagcacattatc

SEQ ID NO: 986130 - DNA, 22 bp, Artificial Sequence
  chemically synthesized
taactcagctagcacattatct

SEQ ID NO: 986131 - DNA, 22 bp, Artificial Sequence
  chemically synthesized
actcagctagcacattatctga

SEQ ID NO: 986132 - DNA, 22 bp, Artificial Sequence
  chemically synthesized
agctagcacattatctgataca

SEQ ID NO: 986133 - DNA, 22 bp, Artificial Sequence
  chemically synthesized
gcacattatctgatacacagtt

SEQ ID NO: 986134 - DNA, 22 bp, Artificial Sequence
  chemically synthesized
acatgcaagtagagcaactgtg

SEQ ID NO: 986135 - DNA, 22 bp, Artificial Sequence
  chemically synthesized
tctgatacacagttgctctact

SEQ ID NO: 986136 - DNA, 22 bp, Artificial Sequence
  chemically synthesized
atacacagttgctctacttgca

SEQ ID NO: 986137 - DNA, 22 bp, Artificial Sequence
  chemically synthesized
ctctacttgcatgtgagttctg

SEQ ID NO: 986138 - DNA, 22 bp, Artificial Sequence
  chemically synthesized
tacttgcatgtgagttctgttc

SEQ ID NO: 986139 - DNA, 22 bp, Artificial Sequence
  chemically synthesized
gagaaggaaagggaacagaact

SEQ ID NO: 986140 - DNA, 22 bp, Artificial Sequence
  chemically synthesized
agagaaggaaagggaacagaac

SEQ ID NO: 986141 - DNA, 22 bp, Artificial Sequence
  chemically synthesized
cttgcatgtgagttctgttccc

SEQ ID NO: 986142 - DNA, 22 bp, Artificial Sequence
  chemically synthesized
gcatgtgagttctgttcccttt

SEQ ID NO: 986143 - DNA, 22 bp, Artificial Sequence
  chemically synthesized
catgtgagttctgttccctttc

SEQ ID NO: 986144 - DNA, 22 bp, Artificial Sequence
  chemically synthesized
aaaaagatttagagaaggaaag

SEQ ID NO: 986145 - DNA, 22 bp, Artificial Sequence
  chemically synthesized
aaaaaagatttagagaaggaaa

SEQ ID NO: 986146 - DNA, 22 bp, Artificial Sequence
  chemically synthesized
tgttccctttccttctctaaat

SEQ ID NO: 986147 - DNA, 22 bp, Artificial Sequence
  chemically synthesized
ttccctttccttctctaaatct

SEQ ID NO: 986148 - DNA, 22 bp, Artificial Sequence
  chemically synthesized
cctttccttctctaaatctttt

SEQ ID NO: 986149 - DNA, 22 bp, Artificial Sequence
  chemically synthesized
tccttctctaaatcttttttaa

SEQ ID NO: 986150 - DNA, 22 bp, Artificial Sequence
  chemically synthesized
ccttctctaaatcttttttaaa

SEQ ID NO: 986151 - DNA, 22 bp, Artificial Sequence
  chemically synthesized
cttctctaaatcttttttaaat

SEQ ID NO: 986152 - DNA, 22 bp, Artificial Sequence
  chemically synthesized
ctctaaatcttttttaaattct

SEQ ID NO: 986153 - DNA, 22 bp, Artificial Sequence
  chemically synthesized
tctaaatcttttttaaattctt

SEQ ID NO: 986154 - DNA, 22 bp, Artificial Sequence
  chemically synthesized
taaatcttttttaaattcttgc

SEQ ID NO: 986155 - DNA, 22 bp, Artificial Sequence
  chemically synthesized
aatcttttttaaattcttgcat

SEQ ID NO: 986156 - DNA, 22 bp, Artificial Sequence
  chemically synthesized
ttttaaattcttgcatcattta

SEQ ID NO: 986157 - DNA, 22 bp, Artificial Sequence
  chemically synthesized
tttaaattcttgcatcatttat

SEQ ID NO: 986158 - DNA, 22 bp, Artificial Sequence
  chemically synthesized
ttaaattcttgcatcatttatt

SEQ ID NO: 986159 - DNA, 22 bp, Artificial Sequence
  chemically synthesized
taaattcttgcatcatttatta

SEQ ID NO: 986160 - DNA, 22 bp, Artificial Sequence
  chemically synthesized
gatgaaataaagtaataaatga

SEQ ID NO: 986161 - DNA, 22 bp, Artificial Sequence
  chemically synthesized
aaattcttgcatcatttattac

SEQ ID NO: 986162 - DNA, 22 bp, Artificial Sequence
  chemically synthesized
aattcttgcatcatttattact

SEQ ID NO: 986163 - DNA, 22 bp, Artificial Sequence
  chemically synthesized
attagatgaaataaagtaataa

SEQ ID NO: 986164 - DNA, 22 bp, Artificial Sequence
  chemically synthesized
ttgcatcatttattactttatt

SEQ ID NO: 986165 - DNA, 22 bp, Artificial Sequence
  chemically synthesized
gcatcatttattactttatttc

SEQ ID NO: 986166 - DNA, 22 bp, Artificial Sequence
  chemically synthesized
catcatttattactttatttca

SEQ ID NO: 986167 - DNA, 22 bp, Artificial Sequence
  chemically synthesized
attactttatttcatctaatga

SEQ ID NO: 986168 - DNA, 22 bp, Artificial Sequence
  chemically synthesized
ttactttatttcatctaatgaa

SEQ ID NO: 986169 - DNA, 22 bp, Artificial Sequence
  chemically synthesized
ctttatttcatctaatgaactc

SEQ ID NO: 986170 - DNA, 22 bp, Artificial Sequence
  chemically synthesized
tatttcatctaatgaactcttg

SEQ ID NO: 986171 - DNA, 22 bp, Artificial Sequence
  chemically synthesized
atttcatctaatgaactcttgt

SEQ ID NO: 986172 - DNA, 22 bp, Artificial Sequence
  chemically synthesized
tttcatctaatgaactcttgtt

SEQ ID NO: 986173 - DNA, 22 bp, Artificial Sequence
  chemically synthesized
catctaatgaactcttgtttct

SEQ ID NO: 986174 - DNA, 22 bp, Artificial Sequence
  chemically synthesized
atctaatgaactcttgtttcta

SEQ ID NO: 986175 - DNA, 22 bp, Artificial Sequence
  chemically synthesized
atgagacaaatgatagaaacaa

SEQ ID NO: 986176 - DNA, 22 bp, Artificial Sequence
  chemically synthesized
atgaactcttgtttctatcatt

SEQ ID NO: 986177 - DNA, 22 bp, Artificial Sequence
  chemically synthesized
gttgatgagacaaatgatagaa

SEQ ID NO: 986178 - DNA, 22 bp, Artificial Sequence
  chemically synthesized
ttgtttctatcatttgtctcat

SEQ ID NO: 986179 - DNA, 22 bp, Artificial Sequence
  chemically synthesized
gaaagctagttgatgagacaaa

SEQ ID NO: 986180 - DNA, 22 bp, Artificial Sequence
  chemically synthesized
gtttctatcatttgtctcatca

SEQ ID NO: 986181 - DNA, 22 bp, Artificial Sequence
  chemically synthesized
tttctatcatttgtctcatcaa

SEQ ID NO: 986182 - DNA, 22 bp, Artificial Sequence
  chemically synthesized
ctatcatttgtctcatcaacta

SEQ ID NO: 986183 - DNA, 22 bp, Artificial Sequence
  chemically synthesized
tatcatttgtctcatcaactag

SEQ ID NO: 986184 - DNA, 22 bp, Artificial Sequence
  chemically synthesized
tcatttgtctcatcaactagct

SEQ ID NO: 986185 - DNA, 22 bp, Artificial Sequence
  chemically synthesized
gtcaaggatctggaaagctagt

SEQ ID NO: 986186 - DNA, 22 bp, Artificial Sequence
  chemically synthesized
gtctcatcaactagctttccag

SEQ ID NO: 986187 - DNA, 22 bp, Artificial Sequence
  chemically synthesized
ttagtcaaggatctggaaagct

SEQ ID NO: 986188 - DNA, 22 bp, Artificial Sequence
  chemically synthesized
tctcatcaactagctttccaga

SEQ ID NO: 986189 - DNA, 22 bp, Artificial Sequence
  chemically synthesized
attagtcaaggatctggaaagc

SEQ ID NO: 986190 - DNA, 22 bp, Artificial Sequence
  chemically synthesized
tattagtcaaggatctggaaag

SEQ ID NO: 986191 - DNA, 22 bp, Artificial Sequence
  chemically synthesized
atcaactagctttccagatcct

SEQ ID NO: 986192 - DNA, 22 bp, Artificial Sequence
  chemically synthesized
tctttattagtcaaggatctgg

SEQ ID NO: 986193 - DNA, 22 bp, Artificial Sequence
  chemically synthesized
gctttccagatccttgactaat

SEQ ID NO: 986194 - DNA, 22 bp, Artificial Sequence
  chemically synthesized
tccagatccttgactaataaag

SEQ ID NO: 986195 - DNA, 22 bp, Artificial Sequence
  chemically synthesized
ccagatccttgactaataaaga

SEQ ID NO: 986196 - DNA, 22 bp, Artificial Sequence
  chemically synthesized
cagatccttgactaataaagat

SEQ ID NO: 986197 - DNA, 22 bp, Artificial Sequence
  chemically synthesized
gtatgcaatatctatctttatt

SEQ ID NO: 986198 - DNA, 22 bp, Artificial Sequence
  chemically synthesized
agtatgcaatatctatctttat

SEQ ID NO: 986199 - DNA, 22 bp, Artificial Sequence
  chemically synthesized
gactaataaagatagatattgc

SEQ ID NO: 986200 - DNA, 22 bp, Artificial Sequence
  chemically synthesized
actaataaagatagatattgca

SEQ ID NO: 986201 - DNA, 22 bp, Artificial Sequence
  chemically synthesized
ataaagatagatattgcatact

SEQ ID NO: 986202 - DNA, 22 bp, Artificial Sequence
  chemically synthesized
gcaaccatccaccacacactta

SEQ ID NO: 986203 - DNA, 22 bp, Artificial Sequence
  chemically synthesized
ggcaaccatccaccacacactt

SEQ ID NO: 986204 - DNA, 22 bp, Artificial Sequence
  chemically synthesized
catactaagtgtgtggtggatg

SEQ ID NO: 986205 - DNA, 22 bp, Artificial Sequence
  chemically synthesized
tgcaggtcttggcaaccatcca

SEQ ID NO: 986206 - DNA, 22 bp, Artificial Sequence
  chemically synthesized
tgtgcaggtcttggcaaccatc

SEQ ID NO: 986207 - DNA, 22 bp, Artificial Sequence
  chemically synthesized
agtgtgtggtggatggttgcca

SEQ ID NO: 986208 - DNA, 22 bp, Artificial Sequence
  chemically synthesized
ccaagacctgcacagagcactt

SEQ ID NO: 986209 - DNA, 22 bp, Artificial Sequence
  chemically synthesized
atggccaagatatgtaaagtgc

SEQ ID NO: 986210 - DNA, 22 bp, Artificial Sequence
  chemically synthesized
cacagagcactttacatatctt

SEQ ID NO: 986211 - DNA, 22 bp, Artificial Sequence
  chemically synthesized
agtcctcatggccaagatatgt

SEQ ID NO: 986212 - DNA, 22 bp, Artificial Sequence
  chemically synthesized
gagtcctcatggccaagatatg

SEQ ID NO: 986213 - DNA, 22 bp, Artificial Sequence
  chemically synthesized
aatatttgagtcctcatggcca

SEQ ID NO: 986214 - DNA, 22 bp, Artificial Sequence
  chemically synthesized
tcaatatttgagtcctcatggc

SEQ ID NO: 986215 - DNA, 22 bp, Artificial Sequence
  chemically synthesized
tacatatcttggccatgaggac

SEQ ID NO: 986216 - DNA, 22 bp, Artificial Sequence
  chemically synthesized
acatatcttggccatgaggact

SEQ ID NO: 986217 - DNA, 22 bp, Artificial Sequence
  chemically synthesized
catatcttggccatgaggactc

SEQ ID NO: 986218 - DNA, 22 bp, Artificial Sequence
  chemically synthesized
cctctcaatatttgagtcctca

SEQ ID NO: 986219 - DNA, 22 bp, Artificial Sequence
  chemically synthesized
tgcctctcaatatttgagtcct

SEQ ID NO: 986220 - DNA, 22 bp, Artificial Sequence
  chemically synthesized
ggccatgaggactcaaatattg

SEQ ID NO: 986221 - DNA, 22 bp, Artificial Sequence
  chemically synthesized
gccatgaggactcaaatattga

SEQ ID NO: 986222 - DNA, 22 bp, Artificial Sequence
  chemically synthesized
caactctgcctctcaatatttg

SEQ ID NO: 986223 - DNA, 22 bp, Artificial Sequence
  chemically synthesized
agaattccaactctgcctctca

SEQ ID NO: 986224 - DNA, 22 bp, Artificial Sequence
  chemically synthesized
aaatattgagaggcagagttgg

SEQ ID NO: 986225 - DNA, 22 bp, Artificial Sequence
  chemically synthesized
agattcagaattccaactctgc

SEQ ID NO: 986226 - DNA, 22 bp, Artificial Sequence
  chemically synthesized
gagattcagaattccaactctg

SEQ ID NO: 986227 - DNA, 22 bp, Artificial Sequence
  chemically synthesized
tagcttgagattcagaattcca

SEQ ID NO: 986228 - DNA, 22 bp, Artificial Sequence
  chemically synthesized
agaggcagagttggaattctga

SEQ ID NO: 986229 - DNA, 22 bp, Artificial Sequence
  chemically synthesized
gaattctgaatctcaagctaca

SEQ ID NO: 986230 - DNA, 22 bp, Artificial Sequence
  chemically synthesized
tgaatctcaagctacagctcct

SEQ ID NO: 986231 - DNA, 22 bp, Artificial Sequence
  chemically synthesized
aatctcaagctacagctcctgt

SEQ ID NO: 986232 - DNA, 22 bp, Artificial Sequence
  chemically synthesized
tagtatggcatgacaggagctg

SEQ ID NO: 986233 - DNA, 22 bp, Artificial Sequence
  chemically synthesized
aagctacagctcctgtcatgcc

SEQ ID NO: 986234 - DNA, 22 bp, Artificial Sequence
  chemically synthesized
cagctcctgtcatgccatacta

SEQ ID NO: 986235 - DNA, 22 bp, Artificial Sequence
  chemically synthesized
ctgtcatgccatactacagtct

SEQ ID NO: 986236 - DNA, 22 bp, Artificial Sequence
  chemically synthesized
tcatgccatactacagtctatt

SEQ ID NO: 986237 - DNA, 22 bp, Artificial Sequence
  chemically synthesized
gaggaaatggaatggtaataga

SEQ ID NO: 986238 - DNA, 22 bp, Artificial Sequence
  chemically synthesized
cagtctattaccattccatttc

SEQ ID NO: 986239 - DNA, 22 bp, Artificial Sequence
  chemically synthesized
ggcacagttggaggaaatggaa

SEQ ID NO: 986240 - DNA, 22 bp, Artificial Sequence
  chemically synthesized
aggcacagttggaggaaatgga

SEQ ID NO: 986241 - DNA, 22 bp, Artificial Sequence
  chemically synthesized
gcttaggcacagttggaggaaa

SEQ ID NO: 986242 - DNA, 22 bp, Artificial Sequence
  chemically synthesized
ttaccattccatttcctccaac

SEQ ID NO: 986243 - DNA, 22 bp, Artificial Sequence
  chemically synthesized
agcttaggcacagttggaggaa

SEQ ID NO: 986244 - DNA, 22 bp, Artificial Sequence
  chemically synthesized
ccattccatttcctccaactgt

SEQ ID NO: 986245 - DNA, 22 bp, Artificial Sequence
  chemically synthesized
catttcctccaactgtgcctaa

SEQ ID NO: 986246 - DNA, 22 bp, Artificial Sequence
  chemically synthesized
cctccaactgtgcctaagctaa

SEQ ID NO: 986247 - DNA, 22 bp, Artificial Sequence
  chemically synthesized
ctccaactgtgcctaagctaag

SEQ ID NO: 986248 - DNA, 22 bp, Artificial Sequence
  chemically synthesized
caactgtgcctaagctaagtgc

SEQ ID NO: 986249 - DNA, 22 bp, Artificial Sequence
  chemically synthesized
atccacataccaggcacttagc

SEQ ID NO: 986250 - DNA, 22 bp, Artificial Sequence
  chemically synthesized
tgcctaagctaagtgcctggta

SEQ ID NO: 986251 - DNA, 22 bp, Artificial Sequence
  chemically synthesized
atagcagttaatccacatacca

SEQ ID NO: 986252 - DNA, 22 bp, Artificial Sequence
  chemically synthesized
agctaagtgcctggtatgtgga

SEQ ID NO: 986253 - DNA, 22 bp, Artificial Sequence
  chemically synthesized
tgatagcagttaatccacatac

SEQ ID NO: 986254 - DNA, 22 bp, Artificial Sequence
  chemically synthesized
agtgcctggtatgtggattaac

SEQ ID NO: 986255 - DNA, 22 bp, Artificial Sequence
  chemically synthesized
gtatgtggattaactgctatca

SEQ ID NO: 986256 - DNA, 22 bp, Artificial Sequence
  chemically synthesized
cagtaaaaaagactctgatagc

SEQ ID NO: 986257 - DNA, 22 bp, Artificial Sequence
  chemically synthesized
cattacagtaaaaaagactctg

SEQ ID NO: 986258 - DNA, 22 bp, Artificial Sequence
  chemically synthesized
ctccattacagtaaaaaagact

SEQ ID NO: 986259 - DNA, 22 bp, Artificial Sequence
  chemically synthesized
actgctatcagagtctttttta

SEQ ID NO: 986260 - DNA, 22 bp, Artificial Sequence
  chemically synthesized
ctatcagagtcttttttactgt

SEQ ID NO: 986261 - DNA, 22 bp, Artificial Sequence
  chemically synthesized
tcagagtcttttttactgtaat

SEQ ID NO: 986262 - DNA, 22 bp, Artificial Sequence
  chemically synthesized
ttttactgtaatggagtagatg

SEQ ID NO: 986263 - DNA, 22 bp, Artificial Sequence
  chemically synthesized
tttactgtaatggagtagatgc

SEQ ID NO: 986264 - DNA, 22 bp, Artificial Sequence
  chemically synthesized
ttactgtaatggagtagatgca

SEQ ID NO: 986265 - DNA, 22 bp, Artificial Sequence
  chemically synthesized
tactgtaatggagtagatgcat

SEQ ID NO: 986266 - DNA, 22 bp, Artificial Sequence
  chemically synthesized
actgtaatggagtagatgcatt

SEQ ID NO: 986267 - DNA, 22 bp, Artificial Sequence
  chemically synthesized
ctgtaatggagtagatgcattg

SEQ ID NO: 986268 - DNA, 22 bp, Artificial Sequence
  chemically synthesized
taatggagtagatgcattgtct

SEQ ID NO: 986269 - DNA, 22 bp, Artificial Sequence
  chemically synthesized
tgtggatgcagcaaataggata

SEQ ID NO: 986270 - DNA, 22 bp, Artificial Sequence
  chemically synthesized
ataattatgtggatgcagcaaa

SEQ ID NO: 986271 - DNA, 22 bp, Artificial Sequence
  chemically synthesized
tctatatcctatttgctgcatc

SEQ ID NO: 986272 - DNA, 22 bp, Artificial Sequence
  chemically synthesized
tatcctatttgctgcatccaca

SEQ ID NO: 986273 - DNA, 22 bp, Artificial Sequence
  chemically synthesized
aacggactgataattatgtgga

SEQ ID NO: 986274 - DNA, 22 bp, Artificial Sequence
  chemically synthesized
gaacggactgataattatgtgg

SEQ ID NO: 986275 - DNA, 22 bp, Artificial Sequence
  chemically synthesized
tgaacggactgataattatgtg

SEQ ID NO: 986276 - DNA, 22 bp, Artificial Sequence
  chemically synthesized
tttgctgcatccacataattat

SEQ ID NO: 986277 - DNA, 22 bp, Artificial Sequence
  chemically synthesized
ttgaacggactgataattatgt

SEQ ID NO: 986278 - DNA, 22 bp, Artificial Sequence
  chemically synthesized
tttgaacggactgataattatg

SEQ ID NO: 986279 - DNA, 22 bp, Artificial Sequence
  chemically synthesized
gctgcatccacataattatcag

SEQ ID NO: 986280 - DNA, 22 bp, Artificial Sequence
  chemically synthesized
ctgcatccacataattatcagt

SEQ ID NO: 986281 - DNA, 22 bp, Artificial Sequence
  chemically synthesized
tgctttttgaacggactgataa

SEQ ID NO: 986282 - DNA, 22 bp, Artificial Sequence
  chemically synthesized
catccacataattatcagtccg

SEQ ID NO: 986283 - DNA, 22 bp, Artificial Sequence
  chemically synthesized
gctatgctttttgaacggactg

SEQ ID NO: 986284 - DNA, 22 bp, Artificial Sequence
  chemically synthesized
tcagtccgttcaaaaagcatag

SEQ ID NO: 986285 - DNA, 22 bp, Artificial Sequence
  chemically synthesized
agtgatagagcaattggctatg

SEQ ID NO: 986286 - DNA, 22 bp, Artificial Sequence
  chemically synthesized
ctaagtgatagagcaattggct

SEQ ID NO: 986287 - DNA, 22 bp, Artificial Sequence
  chemically synthesized
actaagtgatagagcaattggc

SEQ ID NO: 986288 - DNA, 22 bp, Artificial Sequence
  chemically synthesized
aaaaagcatagccaattgctct

SEQ ID NO: 986289 - DNA, 22 bp, Artificial Sequence
  chemically synthesized
gtcgtttactaagtgatagagc

SEQ ID NO: 986290 - DNA, 22 bp, Artificial Sequence
  chemically synthesized
agttagtcgtttactaagtgat

SEQ ID NO: 986291 - DNA, 22 bp, Artificial Sequence
  chemically synthesized
ctctatcacttagtaaacgact

SEQ ID NO: 986292 - DNA, 22 bp, Artificial Sequence
  chemically synthesized
tatcacttagtaaacgactaac

SEQ ID NO: 986293 - DNA, 22 bp, Artificial Sequence
  chemically synthesized
tcacttagtaaacgactaactt

SEQ ID NO: 986294 - DNA, 22 bp, Artificial Sequence
  chemically synthesized
cgtccagtggtctaagttagtc

SEQ ID NO: 986295 - DNA, 22 bp, Artificial Sequence
  chemically synthesized
agtaaacgactaacttagacca

SEQ ID NO: 986296 - DNA, 22 bp, Artificial Sequence
  chemically synthesized
gtaaacgactaacttagaccac

SEQ ID NO: 986297 - DNA, 22 bp, Artificial Sequence
  chemically synthesized
caaaaaaagttccgtccagtgg

SEQ ID NO: 986298 - DNA, 22 bp, Artificial Sequence
  chemically synthesized
ccaaaaaaagttccgtccagtg

SEQ ID NO: 986299 - DNA, 22 bp, Artificial Sequence
  chemically synthesized
acttagaccactggacggaact

SEQ ID NO: 986300 - DNA, 22 bp, Artificial Sequence
  chemically synthesized
gtttccaaaaaaagttccgtcc

SEQ ID NO: 986301 - DNA, 22 bp, Artificial Sequence
  chemically synthesized
ggtttccaaaaaaagttccgtc

SEQ ID NO: 986302 - DNA, 22 bp, Artificial Sequence
  chemically synthesized
tggtttccaaaaaaagttccgt

SEQ ID NO: 986303 - DNA, 22 bp, Artificial Sequence
  chemically synthesized
ttggtttccaaaaaaagttccg

SEQ ID NO: 986304 - DNA, 22 bp, Artificial Sequence
  chemically synthesized
agaccactggacggaacttttt

SEQ ID NO: 986305 - DNA, 22 bp, Artificial Sequence
  chemically synthesized
gaccactggacggaactttttt

SEQ ID NO: 986306 - DNA, 22 bp, Artificial Sequence
  chemically synthesized
ttttggtttccaaaaaaagttc

SEQ ID NO: 986307 - DNA, 22 bp, Artificial Sequence
  chemically synthesized
cttttggtttccaaaaaaagtt

SEQ ID NO: 986308 - DNA, 22 bp, Artificial Sequence
  chemically synthesized
tcttttggtttccaaaaaaagt

SEQ ID NO: 986309 - DNA, 22 bp, Artificial Sequence
  chemically synthesized
ttttcttttggtttccaaaaaa

SEQ ID NO: 986310 - DNA, 22 bp, Artificial Sequence
  chemically synthesized
gacggaactttttttggaaacc

SEQ ID NO: 986311 - DNA, 22 bp, Artificial Sequence
  chemically synthesized
ggagctgttttcttttggtttc

SEQ ID NO: 986312 - DNA, 22 bp, Artificial Sequence
  chemically synthesized
aggagctgttttcttttggttt

SEQ ID NO: 986313 - DNA, 22 bp, Artificial Sequence
  chemically synthesized
tttttggaaaccaaaagaaaac

SEQ ID NO: 986314 - DNA, 22 bp, Artificial Sequence
  chemically synthesized
ttttggaaaccaaaagaaaaca

SEQ ID NO: 986315 - DNA, 22 bp, Artificial Sequence
  chemically synthesized
tttggaaaccaaaagaaaacag

SEQ ID NO: 986316 - DNA, 22 bp, Artificial Sequence
  chemically synthesized
ttggaaaccaaaagaaaacagc

SEQ ID NO: 986317 - DNA, 22 bp, Artificial Sequence
  chemically synthesized
tggaaaccaaaagaaaacagct

SEQ ID NO: 986318 - DNA, 22 bp, Artificial Sequence
  chemically synthesized
ggaaaccaaaagaaaacagctc

SEQ ID NO: 986319 - DNA, 22 bp, Artificial Sequence
  chemically synthesized
gaaaccaaaagaaaacagctcc

SEQ ID NO: 986320 - DNA, 22 bp, Artificial Sequence
  chemically synthesized
aggagagcaggtacagcaattt

SEQ ID NO: 986321 - DNA, 22 bp, Artificial Sequence
  chemically synthesized
ctaaattgctgtacctgctctc

SEQ ID NO: 986322 - DNA, 22 bp, Artificial Sequence
  chemically synthesized
aattgctgtacctgctctcctc

SEQ ID NO: 986323 - DNA, 22 bp, Artificial Sequence
  chemically synthesized
cagcacataataatctgaggag

SEQ ID NO: 986324 - DNA, 22 bp, Artificial Sequence
  chemically synthesized
ctgtacctgctctcctcagatt

SEQ ID NO: 986325 - DNA, 22 bp, Artificial Sequence
  chemically synthesized
ccagcacataataatctgagga

SEQ ID NO: 986326 - DNA, 22 bp, Artificial Sequence
  chemically synthesized
tccagcacataataatctgagg

SEQ ID NO: 986327 - DNA, 22 bp, Artificial Sequence
  chemically synthesized
tacctgctctcctcagattatt

SEQ ID NO: 986328 - DNA, 22 bp, Artificial Sequence
  chemically synthesized
cgattttccagcacataataat

SEQ ID NO: 986329 - DNA, 22 bp, Artificial Sequence
  chemically synthesized
ctctcctcagattattatgtgc

SEQ ID NO: 986330 - DNA, 22 bp, Artificial Sequence
  chemically synthesized
tcctcagattattatgtgctgg

SEQ ID NO: 986331 - DNA, 22 bp, Artificial Sequence
  chemically synthesized
ctcagattattatgtgctggaa

SEQ ID NO: 986332 - DNA, 22 bp, Artificial Sequence
  chemically synthesized
agattattatgtgctggaaaat

SEQ ID NO: 986333 - DNA, 22 bp, Artificial Sequence
  chemically synthesized
ttatgtgctggaaaatcggaga

SEQ ID NO: 986334 - DNA, 22 bp, Artificial Sequence
  chemically synthesized
tgtgctggaaaatcggagacga

SEQ ID NO: 986335 - DNA, 22 bp, Artificial Sequence
  chemically synthesized
gaaaatcggagacgattattca

SEQ ID NO: 986336 - DNA, 22 bp, Artificial Sequence
  chemically synthesized
gaaaatgtgaagtgtatgagaa

SEQ ID NO: 986337 - DNA, 22 bp, Artificial Sequence
  chemically synthesized
tggaaaatgtgaagtgtatgag

SEQ ID NO: 986338 - DNA, 22 bp, Artificial Sequence
  chemically synthesized
cattctggaaaatgtgaagtgt

SEQ ID NO: 986339 - DNA, 22 bp, Artificial Sequence
  chemically synthesized
ttcattctcatacacttcacat

SEQ ID NO: 986340 - DNA, 22 bp, Artificial Sequence
  chemically synthesized
ccattctggaaaatgtgaagtg

SEQ ID NO: 986341 - DNA, 22 bp, Artificial Sequence
  chemically synthesized
tccattctggaaaatgtgaagt

SEQ ID NO: 986342 - DNA, 22 bp, Artificial Sequence
  chemically synthesized
attctcatacacttcacatttt

SEQ ID NO: 986343 - DNA, 22 bp, Artificial Sequence
  chemically synthesized
attttccattctggaaaatgtg

SEQ ID NO: 986344 - DNA, 22 bp, Artificial Sequence
  chemically synthesized
aattttccattctggaaaatgt

SEQ ID NO: 986345 - DNA, 22 bp, Artificial Sequence
  chemically synthesized
tcatacacttcacattttccag

SEQ ID NO: 986346 - DNA, 22 bp, Artificial Sequence
  chemically synthesized
atacacttcacattttccagaa

SEQ ID NO: 986347 - DNA, 22 bp, Artificial Sequence
  chemically synthesized
cttaattttccattctggaaaa

SEQ ID NO: 986348 - DNA, 22 bp, Artificial Sequence
  chemically synthesized
ctacttaattttccattctgga

SEQ ID NO: 986349 - DNA, 22 bp, Artificial Sequence
  chemically synthesized
gctacttaattttccattctgg

SEQ ID NO: 986350 - DNA, 22 bp, Artificial Sequence
  chemically synthesized
tgctacttaattttccattctg

SEQ ID NO: 986351 - DNA, 22 bp, Artificial Sequence
  chemically synthesized
cacattttccagaatggaaaat

SEQ ID NO: 986352 - DNA, 22 bp, Artificial Sequence
  chemically synthesized
acattttccagaatggaaaatt

SEQ ID NO: 986353 - DNA, 22 bp, Artificial Sequence
  chemically synthesized
cctttgctacttaattttccat

SEQ ID NO: 986354 - DNA, 22 bp, Artificial Sequence
  chemically synthesized
tccagaatggaaaattaagtag

SEQ ID NO: 986355 - DNA, 22 bp, Artificial Sequence
  chemically synthesized
ccagaatggaaaattaagtagc

SEQ ID NO: 986356 - DNA, 22 bp, Artificial Sequence
  chemically synthesized
cagaatggaaaattaagtagca

SEQ ID NO: 986357 - DNA, 22 bp, Artificial Sequence
  chemically synthesized
ccccaacaggggacatctgcct

SEQ ID NO: 986358 - DNA, 22 bp, Artificial Sequence
  chemically synthesized
agtagcaaaggcagatgtcccc

SEQ ID NO: 986359 - DNA, 22 bp, Artificial Sequence
  chemically synthesized
aatcgttgccccaacaggggac

SEQ ID NO: 986360 - DNA, 22 bp, Artificial Sequence
  chemically synthesized
tatccagctcaatcgttgcccc

SEQ ID NO: 986361 - DNA, 22 bp, Artificial Sequence
  chemically synthesized
tatatccagctcaatcgttgcc

SEQ ID NO: 986362 - DNA, 22 bp, Artificial Sequence
  chemically synthesized
ctatatccagctcaatcgttgc

SEQ ID NO: 986363 - DNA, 22 bp, Artificial Sequence
  chemically synthesized
ttggggcaacgattgagctgga

SEQ ID NO: 986364 - DNA, 22 bp, Artificial Sequence
  chemically synthesized
gggcaacgattgagctggatat

SEQ ID NO: 986365 - DNA, 22 bp, Artificial Sequence
  chemically synthesized
gcaaacaggatatgagtcttct

SEQ ID NO: 986366 - DNA, 22 bp, Artificial Sequence
  chemically synthesized
agcaaacaggatatgagtcttc

SEQ ID NO: 986367 - DNA, 22 bp, Artificial Sequence
  chemically synthesized
agctggatatagaagactcata

SEQ ID NO: 986368 - DNA, 22 bp, Artificial Sequence
  chemically synthesized
gatatagaagactcatatcctg

SEQ ID NO: 986369 - DNA, 22 bp, Artificial Sequence
  chemically synthesized
atatcctgtttgctaaactggg

SEQ ID NO: 986370 - DNA, 22 bp, Artificial Sequence
  chemically synthesized
agaatagtaagaacagcccagt

SEQ ID NO: 986371 - DNA, 22 bp, Artificial Sequence
  chemically synthesized
tttgctaaactgggctgttctt

SEQ ID NO: 986372 - DNA, 22 bp, Artificial Sequence
  chemically synthesized
gctaaactgggctgttcttact

SEQ ID NO: 986373 - DNA, 22 bp, Artificial Sequence
  chemically synthesized
ctaaactgggctgttcttacta

SEQ ID NO: 986374 - DNA, 22 bp, Artificial Sequence
  chemically synthesized
aactgggctgttcttactattc

SEQ ID NO: 986375 - DNA, 22 bp, Artificial Sequence
  chemically synthesized
ggctgttcttactattctcaac

SEQ ID NO: 986376 - DNA, 22 bp, Artificial Sequence
  chemically synthesized
tgatgatgtgaacatgttgaga

SEQ ID NO: 986377 - DNA, 22 bp, Artificial Sequence
  chemically synthesized
ttcttactattctcaacatgtt

SEQ ID NO: 986378 - DNA, 22 bp, Artificial Sequence
  chemically synthesized
ttatgatgatgtgaacatgttg

SEQ ID NO: 986379 - DNA, 22 bp, Artificial Sequence
  chemically synthesized
attatgatgatgtgaacatgtt

SEQ ID NO: 986380 - DNA, 22 bp, Artificial Sequence
  chemically synthesized
ttactattctcaacatgttcac

SEQ ID NO: 986381 - DNA, 22 bp, Artificial Sequence
  chemically synthesized
tattatgatgatgtgaacatgt

SEQ ID NO: 986382 - DNA, 22 bp, Artificial Sequence
  chemically synthesized
actattctcaacatgttcacat

SEQ ID NO: 986383 - DNA, 22 bp, Artificial Sequence
  chemically synthesized
ctattctcaacatgttcacatc

SEQ ID NO: 986384 - DNA, 22 bp, Artificial Sequence
  chemically synthesized
ttttattatgatgatgtgaaca

SEQ ID NO: 986385 - DNA, 22 bp, Artificial Sequence
  chemically synthesized
gttttattatgatgatgtgaac

SEQ ID NO: 986386 - DNA, 22 bp, Artificial Sequence
  chemically synthesized
ttctcaacatgttcacatcatc

SEQ ID NO: 986387 - DNA, 22 bp, Artificial Sequence
  chemically synthesized
tcaacatgttcacatcatcata

SEQ ID NO: 986388 - DNA, 22 bp, Artificial Sequence
  chemically synthesized
aacatgttcacatcatcataat

SEQ ID NO: 986389 - DNA, 22 bp, Artificial Sequence
  chemically synthesized
aggggcgcttgttttattatga

SEQ ID NO: 986390 - DNA, 22 bp, Artificial Sequence
  chemically synthesized
aaggggcgcttgttttattatg

SEQ ID NO: 986391 - DNA, 22 bp, Artificial Sequence
  chemically synthesized
acatcatcataataaaacaagc

SEQ ID NO: 986392 - DNA, 22 bp, Artificial Sequence
  chemically synthesized
tggtgtcttaaggggcgcttgt

SEQ ID NO: 986393 - DNA, 22 bp, Artificial Sequence
  chemically synthesized
atggtgtcttaaggggcgcttg

SEQ ID NO: 986394 - DNA, 22 bp, Artificial Sequence
  chemically synthesized
taatatttatggtgtcttaagg

SEQ ID NO: 986395 - DNA, 22 bp, Artificial Sequence
  chemically synthesized
agattgtaatatttatggtgtc

SEQ ID NO: 986396 - DNA, 22 bp, Artificial Sequence
  chemically synthesized
actgagattgtaatatttatgg

SEQ ID NO: 986397 - DNA, 22 bp, Artificial Sequence
  chemically synthesized
aagacaccataaatattacaat

SEQ ID NO: 986398 - DNA, 22 bp, Artificial Sequence
  chemically synthesized
agacaccataaatattacaatc

SEQ ID NO: 986399 - DNA, 22 bp, Artificial Sequence
  chemically synthesized
taaatatattgactgagattgt

SEQ ID NO: 986400 - DNA, 22 bp, Artificial Sequence
  chemically synthesized
tataaatatattgactgagatt

SEQ ID NO: 986401 - DNA, 22 bp, Artificial Sequence
  chemically synthesized
actctataaatatattgactga

SEQ ID NO: 986402 - DNA, 22 bp, Artificial Sequence
  chemically synthesized
ctgactctataaatatattgac

SEQ ID NO: 986403 - DNA, 22 bp, Artificial Sequence
  chemically synthesized
cctgactctataaatatattga

SEQ ID NO: 986404 - DNA, 22 bp, Artificial Sequence
  chemically synthesized
ttcctgactctataaatatatt

SEQ ID NO: 986405 - DNA, 22 bp, Artificial Sequence
  chemically synthesized
caatctcagtcaatatatttat

SEQ ID NO: 986406 - DNA, 22 bp, Artificial Sequence
  chemically synthesized
agtcaatatatttatagagtca

SEQ ID NO: 986407 - DNA, 22 bp, Artificial Sequence
  chemically synthesized
atagagtcaggaagagttggat

SEQ ID NO: 986408 - DNA, 22 bp, Artificial Sequence
  chemically synthesized
tagagtcaggaagagttggata

SEQ ID NO: 986409 - DNA, 22 bp, Artificial Sequence
  chemically synthesized
atgaatatgagaatatccaact

SEQ ID NO: 986410 - DNA, 22 bp, Artificial Sequence
  chemically synthesized
cagttgatgaatatgagaatat

SEQ ID NO: 986411 - DNA, 22 bp, Artificial Sequence
  chemically synthesized
atgaattacagttgatgaatat

SEQ ID NO: 986412 - DNA, 22 bp, Artificial Sequence
  chemically synthesized
gatattctcatattcatcaact

SEQ ID NO: 986413 - DNA, 22 bp, Artificial Sequence
  chemically synthesized
tcatattcatcaactgtaattc

SEQ ID NO: 986414 - DNA, 22 bp, Artificial Sequence
  chemically synthesized
taataatcctgatgaattacag

SEQ ID NO: 986415 - DNA, 22 bp, Artificial Sequence
  chemically synthesized
atattcatcaactgtaattcat

SEQ ID NO: 986416 - DNA, 22 bp, Artificial Sequence
  chemically synthesized
actataataatcctgatgaatt

SEQ ID NO: 986417 - DNA, 22 bp, Artificial Sequence
  chemically synthesized
atcaactgtaattcatcaggat

SEQ ID NO: 986418 - DNA, 22 bp, Artificial Sequence
  chemically synthesized
cctaactataataatcctgatg

SEQ ID NO: 986419 - DNA, 22 bp, Artificial Sequence
  chemically synthesized
cctccctaactataataatcct

SEQ ID NO: 986420 - DNA, 22 bp, Artificial Sequence
  chemically synthesized
ccctccctaactataataatcc

SEQ ID NO: 986421 - DNA, 22 bp, Artificial Sequence
  chemically synthesized
taattcatcaggattattatag

SEQ ID NO: 986422 - DNA, 22 bp, Artificial Sequence
  chemically synthesized
ggtttccctccctaactataat

SEQ ID NO: 986423 - DNA, 22 bp, Artificial Sequence
  chemically synthesized
gggtttccctccctaactataa

SEQ ID NO: 986424 - DNA, 22 bp, Artificial Sequence
  chemically synthesized
tgggtttccctccctaactata

SEQ ID NO: 986425 - DNA, 22 bp, Artificial Sequence
  chemically synthesized
atcaggattattatagttaggg

SEQ ID NO: 986426 - DNA, 22 bp, Artificial Sequence
  chemically synthesized
ttatagttagggagggaaaccc

SEQ ID NO: 986427 - DNA, 22 bp, Artificial Sequence
  chemically synthesized
agtgtcataactttgggtttcc

SEQ ID NO: 986428 - DNA, 22 bp, Artificial Sequence
  chemically synthesized
tagttagggagggaaacccaaa

SEQ ID NO: 986429 - DNA, 22 bp, Artificial Sequence
  chemically synthesized
cagtgtcataactttgggtttc

SEQ ID NO: 986430 - DNA, 22 bp, Artificial Sequence
  chemically synthesized
tcagtgtcataactttgggttt

SEQ ID NO: 986431 - DNA, 22 bp, Artificial Sequence
  chemically synthesized
gggagggaaacccaaagttatg

SEQ ID NO: 986432 - DNA, 22 bp, Artificial Sequence
  chemically synthesized
atcatgtctttcagtgtcataa

SEQ ID NO: 986433 - DNA, 22 bp, Artificial Sequence
  chemically synthesized
actgatcatgtctttcagtgtc

SEQ ID NO: 986434 - DNA, 22 bp, Artificial Sequence
  chemically synthesized
aaactcactgatcatgtctttc

SEQ ID NO: 986435 - DNA, 22 bp, Artificial Sequence
  chemically synthesized
ttaaaactcactgatcatgtct

SEQ ID NO: 986436 - DNA, 22 bp, Artificial Sequence
  chemically synthesized
tgacactgaaagacatgatcag

SEQ ID NO: 986437 - DNA, 22 bp, Artificial Sequence
  chemically synthesized
agttattaaaactcactgatca

SEQ ID NO: 986438 - DNA, 22 bp, Artificial Sequence
  chemically synthesized
gagttattaaaactcactgatc

SEQ ID NO: 986439 - DNA, 22 bp, Artificial Sequence
  chemically synthesized
tgagttattaaaactcactgat

SEQ ID NO: 986440 - DNA, 22 bp, Artificial Sequence
  chemically synthesized
aaagacatgatcagtgagtttt

SEQ ID NO: 986441 - DNA, 22 bp, Artificial Sequence
  chemically synthesized
tatagcaagtatgttttgagtt

SEQ ID NO: 986442 - DNA, 22 bp, Artificial Sequence
  chemically synthesized
tgttatatagcaagtatgtttt

SEQ ID NO: 986443 - DNA, 22 bp, Artificial Sequence
  chemically synthesized
taataactcaaaacatacttgc

SEQ ID NO: 986444 - DNA, 22 bp, Artificial Sequence
  chemically synthesized
ctgtgttatatagcaagtatgt

SEQ ID NO: 986445 - DNA, 22 bp, Artificial Sequence
  chemically synthesized
aataactcaaaacatacttgct

SEQ ID NO: 986446 - DNA, 22 bp, Artificial Sequence
  chemically synthesized
ataactcaaaacatacttgcta

SEQ ID NO: 986447 - DNA, 22 bp, Artificial Sequence
  chemically synthesized
aaaacatacttgctatataaca

SEQ ID NO: 986448 - DNA, 22 bp, Artificial Sequence
  chemically synthesized
gctatataacacaggaatggct

SEQ ID NO: 986449 - DNA, 22 bp, Artificial Sequence
  chemically synthesized
ctatataacacaggaatggctt

SEQ ID NO: 986450 - DNA, 22 bp, Artificial Sequence
  chemically synthesized
tataacacaggaatggcttttg

SEQ ID NO: 986451 - DNA, 22 bp, Artificial Sequence
  chemically synthesized
taaagtaatgacaaatgtgtca

SEQ ID NO: 986452 - DNA, 22 bp, Artificial Sequence
  chemically synthesized
ataaagtaatgacaaatgtgtc

SEQ ID NO: 986453 - DNA, 22 bp, Artificial Sequence
  chemically synthesized
tataaagtaatgacaaatgtgt

SEQ ID NO: 986454 - DNA, 22 bp, Artificial Sequence
  chemically synthesized
ttataaagtaatgacaaatgtg

SEQ ID NO: 986455 - DNA, 22 bp, Artificial Sequence
  chemically synthesized
tttttataaagtaatgacaaat

SEQ ID NO: 986456 - DNA, 22 bp, Artificial Sequence
  chemically synthesized
ttgacacatttgtcattacttt

SEQ ID NO: 986457 - DNA, 22 bp, Artificial Sequence
  chemically synthesized
tgacacatttgtcattacttta

SEQ ID NO: 986458 - DNA, 22 bp, Artificial Sequence
  chemically synthesized
gacacatttgtcattactttat

SEQ ID NO: 986459 - DNA, 22 bp, Artificial Sequence
  chemically synthesized
acacatttgtcattactttata

SEQ ID NO: 986460 - DNA, 22 bp, Artificial Sequence
  chemically synthesized
aaggattatttttataaagtaa

SEQ ID NO: 986461 - DNA, 22 bp, Artificial Sequence
  chemically synthesized
aaaggattatttttataaagta

SEQ ID NO: 986462 - DNA, 22 bp, Artificial Sequence
  chemically synthesized
gtcattactttataaaaataat

SEQ ID NO: 986463 - DNA, 22 bp, Artificial Sequence
  chemically synthesized
tcattactttataaaaataatc

SEQ ID NO: 986464 - DNA, 22 bp, Artificial Sequence
  chemically synthesized
ctttataaaaataatcctttaa

SEQ ID NO: 986465 - DNA, 22 bp, Artificial Sequence
  chemically synthesized
tataaaaataatcctttaagtt

SEQ ID NO: 986466 - DNA, 22 bp, Artificial Sequence
  chemically synthesized
ataaaaataatcctttaagtta

SEQ ID NO: 986467 - DNA, 22 bp, Artificial Sequence
  chemically synthesized
atcaccacaaagtaacttaaag

SEQ ID NO: 986468 - DNA, 22 bp, Artificial Sequence
  chemically synthesized
taaaaataatcctttaagttac

SEQ ID NO: 986469 - DNA, 22 bp, Artificial Sequence
  chemically synthesized
catcaccacaaagtaacttaaa

SEQ ID NO: 986470 - DNA, 22 bp, Artificial Sequence
  chemically synthesized
taagttactttgtggtgatgaa

SEQ ID NO: 986471 - DNA, 22 bp, Artificial Sequence
  chemically synthesized
aagttactttgtggtgatgaaa

SEQ ID NO: 986472 - DNA, 22 bp, Artificial Sequence
  chemically synthesized
agttactttgtggtgatgaaac

SEQ ID NO: 986473 - DNA, 22 bp, Artificial Sequence
  chemically synthesized
tcaagataaagaagtgtttcat

SEQ ID NO: 986474 - DNA, 22 bp, Artificial Sequence
  chemically synthesized
ctttgtggtgatgaaacacttc

SEQ ID NO: 986475 - DNA, 22 bp, Artificial Sequence
  chemically synthesized
tgtggtgatgaaacacttcttt

SEQ ID NO: 986476 - DNA, 22 bp, Artificial Sequence
  chemically synthesized
gtggtgatgaaacacttcttta

SEQ ID NO: 986477 - DNA, 22 bp, Artificial Sequence
  chemically synthesized
ccactatcaagataaagaagtg

SEQ ID NO: 986478 - DNA, 22 bp, Artificial Sequence
  chemically synthesized
tggtgatgaaacacttctttat

SEQ ID NO: 986479 - DNA, 22 bp, Artificial Sequence
  chemically synthesized
ctaccactatcaagataaagaa

SEQ ID NO: 986480 - DNA, 22 bp, Artificial Sequence
  chemically synthesized
tatagttactaccactatcaag

SEQ ID NO: 986481 - DNA, 22 bp, Artificial Sequence
  chemically synthesized
atatagttactaccactatcaa

SEQ ID NO: 986482 - DNA, 22 bp, Artificial Sequence
  chemically synthesized
ctttatcttgatagtggtagta

SEQ ID NO: 986483 - DNA, 22 bp, Artificial Sequence
  chemically synthesized
tttatcttgatagtggtagtaa

SEQ ID NO: 986484 - DNA, 22 bp, Artificial Sequence
  chemically synthesized
tagatttatatagttactacca

SEQ ID NO: 986485 - DNA, 22 bp, Artificial Sequence
  chemically synthesized
tatcttgatagtggtagtaact

SEQ ID NO: 986486 - DNA, 22 bp, Artificial Sequence
  chemically synthesized
atcttgatagtggtagtaacta

SEQ ID NO: 986487 - DNA, 22 bp, Artificial Sequence
  chemically synthesized
tcttgatagtggtagtaactat

SEQ ID NO: 986488 - DNA, 22 bp, Artificial Sequence
  chemically synthesized
gatagtggtagtaactatataa

SEQ ID NO: 986489 - DNA, 22 bp, Artificial Sequence
  chemically synthesized
atagtggtagtaactatataaa

SEQ ID NO: 986490 - DNA, 22 bp, Artificial Sequence
  chemically synthesized
accatgtctatagatttatata

SEQ ID NO: 986491 - DNA, 22 bp, Artificial Sequence
  chemically synthesized
tgacattaaccatgtctataga

SEQ ID NO: 986492 - DNA, 22 bp, Artificial Sequence
  chemically synthesized
tatgacattaaccatgtctata

SEQ ID NO: 986493 - DNA, 22 bp, Artificial Sequence
  chemically synthesized
ttctatgacattaaccatgtct

SEQ ID NO: 986494 - DNA, 22 bp, Artificial Sequence
  chemically synthesized
tataaatctatagacatggtta

SEQ ID NO: 986495 - DNA, 22 bp, Artificial Sequence
  chemically synthesized
ttattctatgacattaaccatg

SEQ ID NO: 986496 - DNA, 22 bp, Artificial Sequence
  chemically synthesized
tctgttattctatgacattaac

SEQ ID NO: 986497 - DNA, 22 bp, Artificial Sequence
  chemically synthesized
tagacatggttaatgtcataga

SEQ ID NO: 986498 - DNA, 22 bp, Artificial Sequence
  chemically synthesized
tgagtcattatctgttattcta

SEQ ID NO: 986499 - DNA, 22 bp, Artificial Sequence
  chemically synthesized
ctgtgagtcattatctgttatt

SEQ ID NO: 986500 - DNA, 22 bp, Artificial Sequence
  chemically synthesized
actgtgagtcattatctgttat

SEQ ID NO: 986501 - DNA, 22 bp, Artificial Sequence
  chemically synthesized
tactgtgagtcattatctgtta

SEQ ID NO: 986502 - DNA, 22 bp, Artificial Sequence
  chemically synthesized
atgtcatagaataacagataat

SEQ ID NO: 986503 - DNA, 22 bp, Artificial Sequence
  chemically synthesized
ttactgtgagtcattatctgtt

SEQ ID NO: 986504 - DNA, 22 bp, Artificial Sequence
  chemically synthesized
ttttactgtgagtcattatctg

SEQ ID NO: 986505 - DNA, 22 bp, Artificial Sequence
  chemically synthesized
cacatgctcttttactgtgagt

SEQ ID NO: 986506 - DNA, 22 bp, Artificial Sequence
  chemically synthesized
gcacatgctcttttactgtgag

SEQ ID NO: 986507 - DNA, 22 bp, Artificial Sequence
  chemically synthesized
tgcacatgctcttttactgtga

SEQ ID NO: 986508 - DNA, 22 bp, Artificial Sequence
  chemically synthesized
ttgcacatgctcttttactgtg

SEQ ID NO: 986509 - DNA, 22 bp, Artificial Sequence
  chemically synthesized
tttttgcacatgctcttttact

SEQ ID NO: 986510 - DNA, 22 bp, Artificial Sequence
  chemically synthesized
acctgtttttgcacatgctctt

SEQ ID NO: 986511 - DNA, 22 bp, Artificial Sequence
  chemically synthesized
cacctgtttttgcacatgctct

SEQ ID NO: 986512 - DNA, 22 bp, Artificial Sequence
  chemically synthesized
acagtaaaagagcatgtgcaaa

SEQ ID NO: 986513 - DNA, 22 bp, Artificial Sequence
  chemically synthesized
gatttcacctgtttttgcacat

SEQ ID NO: 986514 - DNA, 22 bp, Artificial Sequence
  chemically synthesized
ggatttcacctgtttttgcaca

SEQ ID NO: 986515 - DNA, 22 bp, Artificial Sequence
  chemically synthesized
cttggatttcacctgtttttgc

SEQ ID NO: 986516 - DNA, 22 bp, Artificial Sequence
  chemically synthesized
acttggatttcacctgtttttg

SEQ ID NO: 986517 - DNA, 22 bp, Artificial Sequence
  chemically synthesized
tagaccttacttggatttcacc

SEQ ID NO: 986518 - DNA, 22 bp, Artificial Sequence
  chemically synthesized
gactgtagaccttacttggatt

SEQ ID NO: 986519 - DNA, 22 bp, Artificial Sequence
  chemically synthesized
gcacagtgcaatcaactagact

SEQ ID NO: 986520 - DNA, 22 bp, Artificial Sequence
  chemically synthesized
acattggcacagtgcaatcaac

SEQ ID NO: 986521 - DNA, 22 bp, Artificial Sequence
  chemically synthesized
cagtctagttgattgcactgtg

SEQ ID NO: 986522 - DNA, 22 bp, Artificial Sequence
  chemically synthesized
gttgattgcactgtgccaatgt

SEQ ID NO: 986523 - DNA, 22 bp, Artificial Sequence
  chemically synthesized
attgcactgtgccaatgtcagt

SEQ ID NO: 986524 - DNA, 22 bp, Artificial Sequence
  chemically synthesized
ccaaacccaataaactgacatt

SEQ ID NO: 986525 - DNA, 22 bp, Artificial Sequence
  chemically synthesized
cactgtgccaatgtcagtttat

SEQ ID NO: 986526 - DNA, 22 bp, Artificial Sequence
  chemically synthesized
tgccaatgtcagtttattgggt

SEQ ID NO: 986527 - DNA, 22 bp, Artificial Sequence
  chemically synthesized
accaaatacagtatattaccaa

SEQ ID NO: 986528 - DNA, 22 bp, Artificial Sequence
  chemically synthesized
attgggtttggtaatatactgt

SEQ ID NO: 986529 - DNA, 22 bp, Artificial Sequence
  chemically synthesized
ttgggtttggtaatatactgta

SEQ ID NO: 986530 - DNA, 22 bp, Artificial Sequence
  chemically synthesized
catattaaccaaatacagtata

SEQ ID NO: 986531 - DNA, 22 bp, Artificial Sequence
  chemically synthesized
ggtttggtaatatactgtattt

SEQ ID NO: 986532 - DNA, 22 bp, Artificial Sequence
  chemically synthesized
ggtaatatactgtatttggtta

SEQ ID NO: 986533 - DNA, 22 bp, Artificial Sequence
  chemically synthesized
gtaatatactgtatttggttaa

SEQ ID NO: 986534 - DNA, 22 bp, Artificial Sequence
  chemically synthesized
cccagttacatattaaccaaat

SEQ ID NO: 986535 - DNA, 22 bp, Artificial Sequence
  chemically synthesized
ccccagttacatattaaccaaa

SEQ ID NO: 986536 - DNA, 22 bp, Artificial Sequence
  chemically synthesized
tccccagttacatattaaccaa

SEQ ID NO: 986537 - DNA, 22 bp, Artificial Sequence
  chemically synthesized
tatttggttaatatgtaactgg

SEQ ID NO: 986538 - DNA, 22 bp, Artificial Sequence
  chemically synthesized
ggttaatatgtaactggggaaa

SEQ ID NO: 986539 - DNA, 22 bp, Artificial Sequence
  chemically synthesized
gttaatatgtaactggggaaag

SEQ ID NO: 986540 - DNA, 22 bp, Artificial Sequence
  chemically synthesized
atatgtaactggggaaagttgg

SEQ ID NO: 986541 - DNA, 22 bp, Artificial Sequence
  chemically synthesized
tgtatacataacccaactttcc

SEQ ID NO: 986542 - DNA, 22 bp, Artificial Sequence
  chemically synthesized
ctgtgtatacataacccaactt

SEQ ID NO: 986543 - DNA, 22 bp, Artificial Sequence
  chemically synthesized
cctgtgtatacataacccaact

SEQ ID NO: 986544 - DNA, 22 bp, Artificial Sequence
  chemically synthesized
gggaaagttgggttatgtatac

SEQ ID NO: 986545 - DNA, 22 bp, Artificial Sequence
  chemically synthesized
ggttatgtatacacaggaaatc

SEQ ID NO: 986546 - DNA, 22 bp, Artificial Sequence
  chemically synthesized
caaaaacagtacagagatttcc

SEQ ID NO: 986547 - DNA, 22 bp, Artificial Sequence
  chemically synthesized
tgtatacacaggaaatctctgt

SEQ ID NO: 986548 - DNA, 22 bp, Artificial Sequence
  chemically synthesized
acaaggagttgcaaaaacagta

SEQ ID NO: 986549 - DNA, 22 bp, Artificial Sequence
  chemically synthesized
atagactcacaaggagttgcaa

SEQ ID NO: 986550 - DNA, 22 bp, Artificial Sequence
  chemically synthesized
tgtactgtttttgcaactcctt

SEQ ID NO: 986551 - DNA, 22 bp, Artificial Sequence
  chemically synthesized
tactgtttttgcaactccttgt

SEQ ID NO: 986552 - DNA, 22 bp, Artificial Sequence
  chemically synthesized
tttttgcaactccttgtgagtc

SEQ ID NO: 986553 - DNA, 22 bp, Artificial Sequence
  chemically synthesized
tgaaatattcatagactcacaa

SEQ ID NO: 986554 - DNA, 22 bp, Artificial Sequence
  chemically synthesized
ttgcaactccttgtgagtctat

SEQ ID NO: 986555 - DNA, 22 bp, Artificial Sequence
  chemically synthesized
tgcaactccttgtgagtctatg

SEQ ID NO: 986556 - DNA, 22 bp, Artificial Sequence
  chemically synthesized
ttgtgaaatattcatagactca

SEQ ID NO: 986557 - DNA, 22 bp, Artificial Sequence
  chemically synthesized
gcaactccttgtgagtctatga

SEQ ID NO: 986558 - DNA, 22 bp, Artificial Sequence
  chemically synthesized
attgtgaaatattcatagactc

SEQ ID NO: 986559 - DNA, 22 bp, Artificial Sequence
  chemically synthesized
caactccttgtgagtctatgaa

SEQ ID NO: 986560 - DNA, 22 bp, Artificial Sequence
  chemically synthesized
tattgtgaaatattcatagact

SEQ ID NO: 986561 - DNA, 22 bp, Artificial Sequence
  chemically synthesized
ttattgtgaaatattcatagac

SEQ ID NO: 986562 - DNA, 22 bp, Artificial Sequence
  chemically synthesized
tttattgtgaaatattcataga

SEQ ID NO: 986563 - DNA, 22 bp, Artificial Sequence
  chemically synthesized
ttttattgtgaaatattcatag

SEQ ID NO: 986564 - DNA, 22 bp, Artificial Sequence
  chemically synthesized
cttgtgagtctatgaatatttc

SEQ ID NO: 986565 - DNA, 22 bp, Artificial Sequence
  chemically synthesized
gtgagtctatgaatatttcaca

SEQ ID NO: 986566 - DNA, 22 bp, Artificial Sequence
  chemically synthesized
agatttttttattgtgaaatat

SEQ ID NO: 986567 - DNA, 22 bp, Artificial Sequence
  chemically synthesized
tgagtctatgaatatttcacaa

SEQ ID NO: 986568 - DNA, 22 bp, Artificial Sequence
  chemically synthesized
aagatttttttattgtgaaata

SEQ ID NO: 986569 - DNA, 22 bp, Artificial Sequence
  chemically synthesized
taagatttttttattgtgaaat

SEQ ID NO: 986570 - DNA, 22 bp, Artificial Sequence
  chemically synthesized
tgaatatttcacaataaaaaaa

SEQ ID NO: 986571 - DNA, 22 bp, Artificial Sequence
  chemically synthesized
agaatgttttaagattttttta

SEQ ID NO: 986572 - DNA, 22 bp, Artificial Sequence
  chemically synthesized
aagaatgttttaagattttttt

SEQ ID NO: 986573 - DNA, 22 bp, Artificial Sequence
  chemically synthesized
taagaatgttttaagatttttt

SEQ ID NO: 986574 - DNA, 22 bp, Artificial Sequence
  chemically synthesized
cacaataaaaaaatcttaaaac

SEQ ID NO: 986575 - DNA, 22 bp, Artificial Sequence
  chemically synthesized
acaataaaaaaatcttaaaaca

SEQ ID NO: 986576 - DNA, 22 bp, Artificial Sequence
  chemically synthesized
taaagttttaagaatgttttaa

SEQ ID NO: 986577 - DNA, 22 bp, Artificial Sequence
  chemically synthesized
tataaagttttaagaatgtttt

SEQ ID NO: 986578 - DNA, 22 bp, Artificial Sequence
  chemically synthesized
ctataaagttttaagaatgttt

SEQ ID NO: 986579 - DNA, 22 bp, Artificial Sequence
  chemically synthesized
aaaacattcttaaaactttata

SEQ ID NO: 986580 - DNA, 22 bp, Artificial Sequence
  chemically synthesized
aaacattcttaaaactttatag

SEQ ID NO: 986581 - DNA, 22 bp, Artificial Sequence
  chemically synthesized
aaggcaggcaaaatttctataa

SEQ ID NO: 986582 - DNA, 22 bp, Artificial Sequence
  chemically synthesized
gaaggcaggcaaaatttctata

SEQ ID NO: 986583 - DNA, 22 bp, Artificial Sequence
  chemically synthesized
tgaaggcaggcaaaatttctat

SEQ ID NO: 986584 - DNA, 22 bp, Artificial Sequence
  chemically synthesized
ttaaaactttatagaaattttg

SEQ ID NO: 986585 - DNA, 22 bp, Artificial Sequence
  chemically synthesized
tttgaaggcaggcaaaatttct

SEQ ID NO: 986586 - DNA, 22 bp, Artificial Sequence
  chemically synthesized
aaaactttatagaaattttgcc

SEQ ID NO: 986587 - DNA, 22 bp, Artificial Sequence
  chemically synthesized
aaactttatagaaattttgcct

SEQ ID NO: 986588 - DNA, 22 bp, Artificial Sequence
  chemically synthesized
cagtctctttgaaggcaggcaa

SEQ ID NO: 986589 - DNA, 22 bp, Artificial Sequence
  chemically synthesized
acagtctctttgaaggcaggca

SEQ ID NO: 986590 - DNA, 22 bp, Artificial Sequence
  chemically synthesized
tatagaaattttgcctgccttc

SEQ ID NO: 986591 - DNA, 22 bp, Artificial Sequence
  chemically synthesized
atagaaattttgcctgccttca

SEQ ID NO: 986592 - DNA, 22 bp, Artificial Sequence
  chemically synthesized
tagaaattttgcctgccttcaa

SEQ ID NO: 986593 - DNA, 22 bp, Artificial Sequence
  chemically synthesized
ccttacagtctctttgaaggca

SEQ ID NO: 986594 - DNA, 22 bp, Artificial Sequence
  chemically synthesized
cccttacagtctctttgaaggc

SEQ ID NO: 986595 - DNA, 22 bp, Artificial Sequence
  chemically synthesized
tcccttacagtctctttgaagg

SEQ ID NO: 986596 - DNA, 22 bp, Artificial Sequence
  chemically synthesized
ttttcccttacagtctctttga

SEQ ID NO: 986597 - DNA, 22 bp, Artificial Sequence
  chemically synthesized
tattttcccttacagtctcttt

SEQ ID NO: 986598 - DNA, 22 bp, Artificial Sequence
  chemically synthesized
tgcctgccttcaaagagactgt

SEQ ID NO: 986599 - DNA, 22 bp, Artificial Sequence
  chemically synthesized
gcctgccttcaaagagactgta

SEQ ID NO: 986600 - DNA, 22 bp, Artificial Sequence
  chemically synthesized
tctattttcccttacagtctct

SEQ ID NO: 986601 - DNA, 22 bp, Artificial Sequence
  chemically synthesized
cctgccttcaaagagactgtaa

SEQ ID NO: 986602 - DNA, 22 bp, Artificial Sequence
  chemically synthesized
ctctattttcccttacagtctc

SEQ ID NO: 986603 - DNA, 22 bp, Artificial Sequence
  chemically synthesized
tctctattttcccttacagtct

SEQ ID NO: 986604 - DNA, 22 bp, Artificial Sequence
  chemically synthesized
tttctctattttcccttacagt

SEQ ID NO: 986605 - DNA, 22 bp, Artificial Sequence
  chemically synthesized
ccttcaaagagactgtaaggga

SEQ ID NO: 986606 - DNA, 22 bp, Artificial Sequence
  chemically synthesized
ctttctctattttcccttacag

SEQ ID NO: 986607 - DNA, 22 bp, Artificial Sequence
  chemically synthesized
ttctttctctattttcccttac

SEQ ID NO: 986608 - DNA, 22 bp, Artificial Sequence
  chemically synthesized
caaagagactgtaagggaaaat

SEQ ID NO: 986609 - DNA, 22 bp, Artificial Sequence
  chemically synthesized
tcttctttctctattttccctt

SEQ ID NO: 986610 - DNA, 22 bp, Artificial Sequence
  chemically synthesized
aaagagactgtaagggaaaata

SEQ ID NO: 986611 - DNA, 22 bp, Artificial Sequence
  chemically synthesized
tctcttctttctctattttccc

SEQ ID NO: 986612 - DNA, 22 bp, Artificial Sequence
  chemically synthesized
ctctcttctttctctattttcc

SEQ ID NO: 986613 - DNA, 22 bp, Artificial Sequence
  chemically synthesized
tctctcttctttctctattttc

SEQ ID NO: 986614 - DNA, 22 bp, Artificial Sequence
  chemically synthesized
attttctctcttctttctctat

SEQ ID NO: 986615 - DNA, 22 bp, Artificial Sequence
  chemically synthesized
aattttctctcttctttctcta

SEQ ID NO: 986616 - DNA, 22 bp, Artificial Sequence
  chemically synthesized
taattttctctcttctttctct

SEQ ID NO: 986617 - DNA, 22 bp, Artificial Sequence
  chemically synthesized
taagggaaaatagagaaagaag

SEQ ID NO: 986618 - DNA, 22 bp, Artificial Sequence
  chemically synthesized
gccagacattttaattttctct

SEQ ID NO: 986619 - DNA, 22 bp, Artificial Sequence
  chemically synthesized
ggaattagccagacattttaat

SEQ ID NO: 986620 - DNA, 22 bp, Artificial Sequence
  chemically synthesized
ttaggaattagccagacatttt

SEQ ID NO: 986621 - DNA, 22 bp, Artificial Sequence
  chemically synthesized
ctattaggaattagccagacat

SEQ ID NO: 986622 - DNA, 22 bp, Artificial Sequence
  chemically synthesized
cctattaggaattagccagaca

SEQ ID NO: 986623 - DNA, 22 bp, Artificial Sequence
  chemically synthesized
aaatgtctggctaattcctaat

SEQ ID NO: 986624 - DNA, 22 bp, Artificial Sequence
  chemically synthesized
gctaattcctaataggaagttt

SEQ ID NO: 986625 - DNA, 22 bp, Artificial Sequence
  chemically synthesized
tataaaaataaagaaaacttcc

SEQ ID NO: 986626 - DNA, 22 bp, Artificial Sequence
  chemically synthesized
gtataaaaataaagaaaacttc

SEQ ID NO: 986627 - DNA, 22 bp, Artificial Sequence
  chemically synthesized
attcctaataggaagttttctt

SEQ ID NO: 986628 - DNA, 22 bp, Artificial Sequence
  chemically synthesized
ttgtataaaaataaagaaaact

SEQ ID NO: 986629 - DNA, 22 bp, Artificial Sequence
  chemically synthesized
cttgtataaaaataaagaaaac

SEQ ID NO: 986630 - DNA, 22 bp, Artificial Sequence
  chemically synthesized
ctaataggaagttttctttatt

SEQ ID NO: 986631 - DNA, 22 bp, Artificial Sequence
  chemically synthesized
ataggaagttttctttattttt

SEQ ID NO: 986632 - DNA, 22 bp, Artificial Sequence
  chemically synthesized
cgtttcttgtataaaaataaag

SEQ ID NO: 986633 - DNA, 22 bp, Artificial Sequence
  chemically synthesized
ccgtttcttgtataaaaataaa

SEQ ID NO: 986634 - DNA, 22 bp, Artificial Sequence
  chemically synthesized
tccgtttcttgtataaaaataa

SEQ ID NO: 986635 - DNA, 22 bp, Artificial Sequence
  chemically synthesized
tgttttccgtttcttgtataaa

SEQ ID NO: 986636 - DNA, 22 bp, Artificial Sequence
  chemically synthesized
tctttatttttatacaagaaac

SEQ ID NO: 986637 - DNA, 22 bp, Artificial Sequence
  chemically synthesized
ctttatttttatacaagaaacg

SEQ ID NO: 986638 - DNA, 22 bp, Artificial Sequence
  chemically synthesized
tttatttttatacaagaaacgg

SEQ ID NO: 986639 - DNA, 22 bp, Artificial Sequence
  chemically synthesized
tatttttatacaagaaacggaa

SEQ ID NO: 986640 - DNA, 22 bp, Artificial Sequence
  chemically synthesized
atttttatacaagaaacggaaa

SEQ ID NO: 986641 - DNA, 22 bp, Artificial Sequence
  chemically synthesized
tttttatacaagaaacggaaaa

SEQ ID NO: 986642 - DNA, 22 bp, Artificial Sequence
  chemically synthesized
atatagcaactatgttttccgt

SEQ ID NO: 986643 - DNA, 22 bp, Artificial Sequence
  chemically synthesized
ttatacaagaaacggaaaacat

SEQ ID NO: 986644 - DNA, 22 bp, Artificial Sequence
  chemically synthesized
tatacaagaaacggaaaacata

SEQ ID NO: 986645 - DNA, 22 bp, Artificial Sequence
  chemically synthesized
atacaagaaacggaaaacatag

SEQ ID NO: 986646 - DNA, 22 bp, Artificial Sequence
  chemically synthesized
ttgatatagcaactatgttttc

SEQ ID NO: 986647 - DNA, 22 bp, Artificial Sequence
  chemically synthesized
tacaagaaacggaaaacatagt

SEQ ID NO: 986648 - DNA, 22 bp, Artificial Sequence
  chemically synthesized
aaatcctgttgatatagcaact

SEQ ID NO: 986649 - DNA, 22 bp, Artificial Sequence
  chemically synthesized
tgaagaaaatagactaaaatcc

SEQ ID NO: 986650 - DNA, 22 bp, Artificial Sequence
  chemically synthesized
ctatatcaacaggattttagtc

SEQ ID NO: 986651 - DNA, 22 bp, Artificial Sequence
  chemically synthesized
gtgaagaaaatagactaaaatc

SEQ ID NO: 986652 - DNA, 22 bp, Artificial Sequence
  chemically synthesized
tgtgaagaaaatagactaaaat

SEQ ID NO: 986653 - DNA, 22 bp, Artificial Sequence
  chemically synthesized
tatcaacaggattttagtctat

SEQ ID NO: 986654 - DNA, 22 bp, Artificial Sequence
  chemically synthesized
agctttgtgaagaaaatagact

SEQ ID NO: 986655 - DNA, 22 bp, Artificial Sequence
  chemically synthesized
cagctttgtgaagaaaatagac

SEQ ID NO: 986656 - DNA, 22 bp, Artificial Sequence
  chemically synthesized
ttcagctttgtgaagaaaatag

SEQ ID NO: 986657 - DNA, 22 bp, Artificial Sequence
  chemically synthesized
cttcagctttgtgaagaaaata

SEQ ID NO: 986658 - DNA, 22 bp, Artificial Sequence
  chemically synthesized
tagtctattttcttcacaaagc

SEQ ID NO: 986659 - DNA, 22 bp, Artificial Sequence
  chemically synthesized
acaccttcttcagctttgtgaa

SEQ ID NO: 986660 - DNA, 22 bp, Artificial Sequence
  chemically synthesized
agtctattttcttcacaaagct

SEQ ID NO: 986661 - DNA, 22 bp, Artificial Sequence
  chemically synthesized
gtctattttcttcacaaagctg

SEQ ID NO: 986662 - DNA, 22 bp, Artificial Sequence
  chemically synthesized
ttttcttcacaaagctgaagaa

SEQ ID NO: 986663 - DNA, 22 bp, Artificial Sequence
  chemically synthesized
tcttcacaaagctgaagaaggt

SEQ ID NO: 986664 - DNA, 22 bp, Artificial Sequence
  chemically synthesized
cttcacaaagctgaagaaggtg

SEQ ID NO: 986665 - DNA, 22 bp, Artificial Sequence
  chemically synthesized
ttcacaaagctgaagaaggtgt

SEQ ID NO: 986666 - DNA, 22 bp, Artificial Sequence
  chemically synthesized
cacaaagctgaagaaggtgtga

SEQ ID NO: 986667 - DNA, 22 bp, Artificial Sequence
  chemically synthesized
acaaagctgaagaaggtgtgaa

SEQ ID NO: 986668 - DNA, 22 bp, Artificial Sequence
  chemically synthesized
cacagagaaaagtcattcacac

SEQ ID NO: 986669 - DNA, 22 bp, Artificial Sequence
  chemically synthesized
gcacagagaaaagtcattcaca

SEQ ID NO: 986670 - DNA, 22 bp, Artificial Sequence
  chemically synthesized
acttgcacagagaaaagtcatt

SEQ ID NO: 986671 - DNA, 22 bp, Artificial Sequence
  chemically synthesized
aagaaggtgtgaatgacttttc

SEQ ID NO: 986672 - DNA, 22 bp, Artificial Sequence
  chemically synthesized
ttcacttgcacagagaaaagtc

SEQ ID NO: 986673 - DNA, 22 bp, Artificial Sequence
  chemically synthesized
gtatattattcacttgcacaga

SEQ ID NO: 986674 - DNA, 22 bp, Artificial Sequence
  chemically synthesized
agtatattattcacttgcacag

SEQ ID NO: 986675 - DNA, 22 bp, Artificial Sequence
  chemically synthesized
tagtatattattcacttgcaca

SEQ ID NO: 986676 - DNA, 22 bp, Artificial Sequence
  chemically synthesized
ttctctgtgcaagtgaataata

SEQ ID NO: 986677 - DNA, 22 bp, Artificial Sequence
  chemically synthesized
tctctgtgcaagtgaataatat

SEQ ID NO: 986678 - DNA, 22 bp, Artificial Sequence
  chemically synthesized
ctctgtgcaagtgaataatata

SEQ ID NO: 986679 - DNA, 22 bp, Artificial Sequence
  chemically synthesized
tctgtgcaagtgaataatatac

SEQ ID NO: 986680 - DNA, 22 bp, Artificial Sequence
  chemically synthesized
tgtgcaagtgaataatatacta

SEQ ID NO: 986681 - DNA, 22 bp, Artificial Sequence
  chemically synthesized
tgcaagtgaataatatactaaa

SEQ ID NO: 986682 - DNA, 22 bp, Artificial Sequence
  chemically synthesized
aaattacttgttccacccttgt

SEQ ID NO: 986683 - DNA, 22 bp, Artificial Sequence
  chemically synthesized
cttgttccacccttgtttttgt

SEQ ID NO: 986684 - DNA, 22 bp, Artificial Sequence
  chemically synthesized
gttccacccttgtttttgtctt

SEQ ID NO: 986685 - DNA, 22 bp, Artificial Sequence
  chemically synthesized
ttccacccttgtttttgtcttg

SEQ ID NO: 986686 - DNA, 22 bp, Artificial Sequence
  chemically synthesized
cacccttgtttttgtcttgttt

SEQ ID NO: 986687 - DNA, 22 bp, Artificial Sequence
  chemically synthesized
tggaagtaggatgtaaacaaga

SEQ ID NO: 986688 - DNA, 22 bp, Artificial Sequence
  chemically synthesized
atggaagtaggatgtaaacaag

SEQ ID NO: 986689 - DNA, 22 bp, Artificial Sequence
  chemically synthesized
gtttttgtcttgtttacatcct

SEQ ID NO: 986690 - DNA, 22 bp, Artificial Sequence
  chemically synthesized
tttttgtcttgtttacatccta

SEQ ID NO: 986691 - DNA, 22 bp, Artificial Sequence
  chemically synthesized
ttgtcttgtttacatcctactt

SEQ ID NO: 986692 - DNA, 22 bp, Artificial Sequence
  chemically synthesized
gcaggtttatggaagtaggatg

SEQ ID NO: 986693 - DNA, 22 bp, Artificial Sequence
  chemically synthesized
tgtcttgtttacatcctacttc

SEQ ID NO: 986694 - DNA, 22 bp, Artificial Sequence
  chemically synthesized
gtcttgtttacatcctacttcc

SEQ ID NO: 986695 - DNA, 22 bp, Artificial Sequence
  chemically synthesized
tcttgtttacatcctacttcca

SEQ ID NO: 986696 - DNA, 22 bp, Artificial Sequence
  chemically synthesized
gtttacatcctacttccataaa

SEQ ID NO: 986697 - DNA, 22 bp, Artificial Sequence
  chemically synthesized
aatattggcaggtttatggaag

SEQ ID NO: 986698 - DNA, 22 bp, Artificial Sequence
  chemically synthesized
tttacatcctacttccataaac

SEQ ID NO: 986699 - DNA, 22 bp, Artificial Sequence
  chemically synthesized
acatcctacttccataaacctg

SEQ ID NO: 986700 - DNA, 22 bp, Artificial Sequence
  chemically synthesized
catcctacttccataaacctgc

SEQ ID NO: 986701 - DNA, 22 bp, Artificial Sequence
  chemically synthesized
gtgactaaatattggcaggttt

SEQ ID NO: 986702 - DNA, 22 bp, Artificial Sequence
  chemically synthesized
cttccataaacctgccaatatt

SEQ ID NO: 986703 - DNA, 22 bp, Artificial Sequence
  chemically synthesized
agattagtgactaaatattggc

SEQ ID NO: 986704 - DNA, 22 bp, Artificial Sequence
  chemically synthesized
aagattagtgactaaatattgg

SEQ ID NO: 986705 - DNA, 22 bp, Artificial Sequence
  chemically synthesized
ccataaacctgccaatatttag

SEQ ID NO: 986706 - DNA, 22 bp, Artificial Sequence
  chemically synthesized
cataaacctgccaatatttagt

SEQ ID NO: 986707 - DNA, 22 bp, Artificial Sequence
  chemically synthesized
tcatagcttaagattagtgact

SEQ ID NO: 986708 - DNA, 22 bp, Artificial Sequence
  chemically synthesized
tgtcatagcttaagattagtga

SEQ ID NO: 986709 - DNA, 22 bp, Artificial Sequence
  chemically synthesized
ccaatatttagtcactaatctt

SEQ ID NO: 986710 - DNA, 22 bp, Artificial Sequence
  chemically synthesized
aattctgtcatagcttaagatt

SEQ ID NO: 986711 - DNA, 22 bp, Artificial Sequence
  chemically synthesized
aaattctgtcatagcttaagat

SEQ ID NO: 986712 - DNA, 22 bp, Artificial Sequence
  chemically synthesized
taaattctgtcatagcttaaga

SEQ ID NO: 986713 - DNA, 22 bp, Artificial Sequence
  chemically synthesized
agtcactaatcttaagctatga

SEQ ID NO: 986714 - DNA, 22 bp, Artificial Sequence
  chemically synthesized
ttttaaattctgtcatagctta

SEQ ID NO: 986715 - DNA, 22 bp, Artificial Sequence
  chemically synthesized
gtcactaatcttaagctatgac

SEQ ID NO: 986716 - DNA, 22 bp, Artificial Sequence
  chemically synthesized
aatctgttttaaattctgtcat

SEQ ID NO: 986717 - DNA, 22 bp, Artificial Sequence
  chemically synthesized
atcttaagctatgacagaattt

SEQ ID NO: 986718 - DNA, 22 bp, Artificial Sequence
  chemically synthesized
aagctatgacagaatttaaaac

SEQ ID NO: 986719 - DNA, 22 bp, Artificial Sequence
  chemically synthesized
agctatgacagaatttaaaaca

SEQ ID NO: 986720 - DNA, 22 bp, Artificial Sequence
  chemically synthesized
tgacagaatttaaaacagattc

SEQ ID NO: 986721 - DNA, 22 bp, Artificial Sequence
  chemically synthesized
aaatcatatcattgaatctgtt

SEQ ID NO: 986722 - DNA, 22 bp, Artificial Sequence
  chemically synthesized
aaaacagattcaatgatatgat

SEQ ID NO: 986723 - DNA, 22 bp, Artificial Sequence
  chemically synthesized
aaacagattcaatgatatgatt

SEQ ID NO: 986724 - DNA, 22 bp, Artificial Sequence
  chemically synthesized
cataaggtgaattcaaatcata

SEQ ID NO: 986725 - DNA, 22 bp, Artificial Sequence
  chemically synthesized
acataaggtgaattcaaatcat

SEQ ID NO: 986726 - DNA, 22 bp, Artificial Sequence
  chemically synthesized
aatgatatgatttgaattcacc

SEQ ID NO: 986727 - DNA, 22 bp, Artificial Sequence
  chemically synthesized
caatatcttacataaggtgaat

SEQ ID NO: 986728 - DNA, 22 bp, Artificial Sequence
  chemically synthesized
acaatatcttacataaggtgaa

SEQ ID NO: 986729 - DNA, 22 bp, Artificial Sequence
  chemically synthesized
tacaatatcttacataaggtga

SEQ ID NO: 986730 - DNA, 22 bp, Artificial Sequence
  chemically synthesized
ctttacaatatcttacataagg

SEQ ID NO: 986731 - DNA, 22 bp, Artificial Sequence
  chemically synthesized
gaattcaccttatgtaagatat

SEQ ID NO: 986732 - DNA, 22 bp, Artificial Sequence
  chemically synthesized
aattcaccttatgtaagatatt

SEQ ID NO: 986733 - DNA, 22 bp, Artificial Sequence
  chemically synthesized
accttatgtaagatattgtaaa

SEQ ID NO: 986734 - DNA, 22 bp, Artificial Sequence
  chemically synthesized
tggcatcatattgctttacaat

SEQ ID NO: 986735 - DNA, 22 bp, Artificial Sequence
  chemically synthesized
atgtaagatattgtaaagcaat

SEQ ID NO: 986736 - DNA, 22 bp, Artificial Sequence
  chemically synthesized
tgtaagatattgtaaagcaata

SEQ ID NO: 986737 - DNA, 22 bp, Artificial Sequence
  chemically synthesized
gatgtgtgttgtggcatcatat

SEQ ID NO: 986738 - DNA, 22 bp, Artificial Sequence
  chemically synthesized
tagatgtgtgttgtggcatcat

SEQ ID NO: 986739 - DNA, 22 bp, Artificial Sequence
  chemically synthesized
ctagatgtgtgttgtggcatca

SEQ ID NO: 986740 - DNA, 22 bp, Artificial Sequence
  chemically synthesized
tctagatgtgtgttgtggcatc

SEQ ID NO: 986741 - DNA, 22 bp, Artificial Sequence
  chemically synthesized
taaagcaatatgatgccacaac

SEQ ID NO: 986742 - DNA, 22 bp, Artificial Sequence
  chemically synthesized
agagaagacacagttttctaga

SEQ ID NO: 986743 - DNA, 22 bp, Artificial Sequence
  chemically synthesized
gagagaagacacagttttctag

SEQ ID NO: 986744 - DNA, 22 bp, Artificial Sequence
  chemically synthesized
catttgagagaagacacagttt

SEQ ID NO: 986745 - DNA, 22 bp, Artificial Sequence
  chemically synthesized
agttccatttgagagaagacac

SEQ ID NO: 986746 - DNA, 22 bp, Artificial Sequence
  chemically synthesized
gaaaactgtgtcttctctcaaa

SEQ ID NO: 986747 - DNA, 22 bp, Artificial Sequence
  chemically synthesized
ggaacaactcagttccatttga

SEQ ID NO: 986748 - DNA, 22 bp, Artificial Sequence
  chemically synthesized
aggaacaactcagttccatttg

SEQ ID NO: 986749 - DNA, 22 bp, Artificial Sequence
  chemically synthesized
tgtcttctctcaaatggaactg

SEQ ID NO: 986750 - DNA, 22 bp, Artificial Sequence
  chemically synthesized
ctctcaaatggaactgagttgt

SEQ ID NO: 986751 - DNA, 22 bp, Artificial Sequence
  chemically synthesized
aacatcttaggaacaactcagt

SEQ ID NO: 986752 - DNA, 22 bp, Artificial Sequence
  chemically synthesized
tctcaaatggaactgagttgtt

SEQ ID NO: 986753 - DNA, 22 bp, Artificial Sequence
  chemically synthesized
tcaaatggaactgagttgttcc

SEQ ID NO: 986754 - DNA, 22 bp, Artificial Sequence
  chemically synthesized
gttaaacatcttaggaacaact

SEQ ID NO: 986755 - DNA, 22 bp, Artificial Sequence
  chemically synthesized
aaatggaactgagttgttccta

SEQ ID NO: 986756 - DNA, 22 bp, Artificial Sequence
  chemically synthesized
agttaaacatcttaggaacaac

SEQ ID NO: 986757 - DNA, 22 bp, Artificial Sequence
  chemically synthesized
tagttaaacatcttaggaacaa

SEQ ID NO: 986758 - DNA, 22 bp, Artificial Sequence
  chemically synthesized
atcactttagttaaacatctta

SEQ ID NO: 986759 - DNA, 22 bp, Artificial Sequence
  chemically synthesized
aatcactttagttaaacatctt

SEQ ID NO: 986760 - DNA, 22 bp, Artificial Sequence
  chemically synthesized
agttgttcctaagatgtttaac

SEQ ID NO: 986761 - DNA, 22 bp, Artificial Sequence
  chemically synthesized
ttcctaagatgtttaactaaag

SEQ ID NO: 986762 - DNA, 22 bp, Artificial Sequence
  chemically synthesized
agcccatttaatcactttagtt

SEQ ID NO: 986763 - DNA, 22 bp, Artificial Sequence
  chemically synthesized
ctaagatgtttaactaaagtga

SEQ ID NO: 986764 - DNA, 22 bp, Artificial Sequence
  chemically synthesized
agatgtttaactaaagtgatta

SEQ ID NO: 986765 - DNA, 22 bp, Artificial Sequence
  chemically synthesized
taattcagcccatttaatcact

SEQ ID NO: 986766 - DNA, 22 bp, Artificial Sequence
  chemically synthesized
aactaaagtgattaaatgggct

SEQ ID NO: 986767 - DNA, 22 bp, Artificial Sequence
  chemically synthesized
actaaagtgattaaatgggctg

SEQ ID NO: 986768 - DNA, 22 bp, Artificial Sequence
  chemically synthesized
aagtgattaaatgggctgaatt

SEQ ID NO: 986769 - DNA, 22 bp, Artificial Sequence
  chemically synthesized
aaaatcaatatgttataattca

SEQ ID NO: 986770 - DNA, 22 bp, Artificial Sequence
  chemically synthesized
aaaaatcaatatgttataattc

SEQ ID NO: 986771 - DNA, 22 bp, Artificial Sequence
  chemically synthesized
aatgggctgaattataacatat

SEQ ID NO: 986772 - DNA, 22 bp, Artificial Sequence
  chemically synthesized
gaccatttaaaaatcaatatgt

SEQ ID NO: 986773 - DNA, 22 bp, Artificial Sequence
  chemically synthesized
aattataacatattgattttta

SEQ ID NO: 986774 - DNA, 22 bp, Artificial Sequence
  chemically synthesized
taacatattgatttttaaatgg

SEQ ID NO: 986775 - DNA, 22 bp, Artificial Sequence
  chemically synthesized
acaatgcaaatgtggctagacc

SEQ ID NO: 986776 - DNA, 22 bp, Artificial Sequence
  chemically synthesized
atttttaaatggtctagccaca

SEQ ID NO: 986777 - DNA, 22 bp, Artificial Sequence
  chemically synthesized
ttaaatggtctagccacatttg

SEQ ID NO: 986778 - DNA, 22 bp, Artificial Sequence
  chemically synthesized
taaatggtctagccacatttgc

SEQ ID NO: 986779 - DNA, 22 bp, Artificial Sequence
  chemically synthesized
aaatggtctagccacatttgca

SEQ ID NO: 986780 - DNA, 22 bp, Artificial Sequence
  chemically synthesized
aatggtctagccacatttgcat

SEQ ID NO: 986781 - DNA, 22 bp, Artificial Sequence
  chemically synthesized
taaaaaattaacaatgcaaatg

SEQ ID NO: 986782 - DNA, 22 bp, Artificial Sequence
  chemically synthesized
gtaaaaaattaacaatgcaaat

SEQ ID NO: 986783 - DNA, 22 bp, Artificial Sequence
  chemically synthesized
gccacatttgcattgttaattt

SEQ ID NO: 986784 - DNA, 22 bp, Artificial Sequence
  chemically synthesized
tggtgcaatcttgtaaaaaatt

SEQ ID NO: 986785 - DNA, 22 bp, Artificial Sequence
  chemically synthesized
gcattgttaattttttacaaga

SEQ ID NO: 986786 - DNA, 22 bp, Artificial Sequence
  chemically synthesized
cattgttaattttttacaagat

SEQ ID NO: 986787 - DNA, 22 bp, Artificial Sequence
  chemically synthesized
tatctatggtgcaatcttgtaa

SEQ ID NO: 986788 - DNA, 22 bp, Artificial Sequence
  chemically synthesized
atatctatggtgcaatcttgta

SEQ ID NO: 986789 - DNA, 22 bp, Artificial Sequence
  chemically synthesized
ttaattttttacaagattgcac

SEQ ID NO: 986790 - DNA, 22 bp, Artificial Sequence
  chemically synthesized
attttttacaagattgcaccat

SEQ ID NO: 986791 - DNA, 22 bp, Artificial Sequence
  chemically synthesized
tttacaagattgcaccatagat

SEQ ID NO: 986792 - DNA, 22 bp, Artificial Sequence
  chemically synthesized
tcagtgatttatatctatggtg

SEQ ID NO: 986793 - DNA, 22 bp, Artificial Sequence
  chemically synthesized
ttacaagattgcaccatagata

SEQ ID NO: 986794 - DNA, 22 bp, Artificial Sequence
  chemically synthesized
gtcagtgatttatatctatggt

SEQ ID NO: 986795 - DNA, 22 bp, Artificial Sequence
  chemically synthesized
tacaagattgcaccatagatat

SEQ ID NO: 986796 - DNA, 22 bp, Artificial Sequence
  chemically synthesized
tgtcagtgatttatatctatgg

SEQ ID NO: 986797 - DNA, 22 bp, Artificial Sequence
  chemically synthesized
acaagattgcaccatagatata

SEQ ID NO: 986798 - DNA, 22 bp, Artificial Sequence
  chemically synthesized
caagattgcaccatagatataa

SEQ ID NO: 986799 - DNA, 22 bp, Artificial Sequence
  chemically synthesized
aaatattttgtcagtgatttat

SEQ ID NO: 986800 - DNA, 22 bp, Artificial Sequence
  chemically synthesized
aaaatattttgtcagtgattta

SEQ ID NO: 986801 - DNA, 22 bp, Artificial Sequence
  chemically synthesized
caccatagatataaatcactga

SEQ ID NO: 986802 - DNA, 22 bp, Artificial Sequence
  chemically synthesized
taaaatattttgtcagtgattt

SEQ ID NO: 986803 - DNA, 22 bp, Artificial Sequence
  chemically synthesized
ttaaaatattttgtcagtgatt

SEQ ID NO: 986804 - DNA, 22 bp, Artificial Sequence
  chemically synthesized
cttttaaaatattttgtcagtg

SEQ ID NO: 986805 - DNA, 22 bp, Artificial Sequence
  chemically synthesized
tatgctacttttaaaatatttt

SEQ ID NO: 986806 - DNA, 22 bp, Artificial Sequence
  chemically synthesized
gtatgctacttttaaaatattt

SEQ ID NO: 986807 - DNA, 22 bp, Artificial Sequence
  chemically synthesized
tgtatgctacttttaaaatatt

SEQ ID NO: 986808 - DNA, 22 bp, Artificial Sequence
  chemically synthesized
ttgtatgctacttttaaaatat

SEQ ID NO: 986809 - DNA, 22 bp, Artificial Sequence
  chemically synthesized
acaaaatattttaaaagtagca

SEQ ID NO: 986810 - DNA, 22 bp, Artificial Sequence
  chemically synthesized
acgatttttgtatgctactttt

SEQ ID NO: 986811 - DNA, 22 bp, Artificial Sequence
  chemically synthesized
taaaagtagcatacaaaaatcg

SEQ ID NO: 986812 - DNA, 22 bp, Artificial Sequence
  chemically synthesized
tcccagtgttgacgatttttgt

SEQ ID NO: 986813 - DNA, 22 bp, Artificial Sequence
  chemically synthesized
aaaagtagcatacaaaaatcgt

SEQ ID NO: 986814 - DNA, 22 bp, Artificial Sequence
  chemically synthesized
atcccagtgttgacgatttttg

SEQ ID NO: 986815 - DNA, 22 bp, Artificial Sequence
  chemically synthesized
aaagtagcatacaaaaatcgtc

SEQ ID NO: 986816 - DNA, 22 bp, Artificial Sequence
  chemically synthesized
tatcccagtgttgacgattttt

SEQ ID NO: 986817 - DNA, 22 bp, Artificial Sequence
  chemically synthesized
aattttatcccagtgttgacga

SEQ ID NO: 986818 - DNA, 22 bp, Artificial Sequence
  chemically synthesized
aaagttaaattttatcccagtg

SEQ ID NO: 986819 - DNA, 22 bp, Artificial Sequence
  chemically synthesized
gaaagttaaattttatcccagt

SEQ ID NO: 986820 - DNA, 22 bp, Artificial Sequence
  chemically synthesized
tgaaagttaaattttatcccag

SEQ ID NO: 986821 - DNA, 22 bp, Artificial Sequence
  chemically synthesized
attttgaaagttaaattttatc

SEQ ID NO: 986822 - DNA, 22 bp, Artificial Sequence
  chemically synthesized
aattttgaaagttaaattttat

SEQ ID NO: 986823 - DNA, 22 bp, Artificial Sequence
  chemically synthesized
taattttgaaagttaaatttta

SEQ ID NO: 986824 - DNA, 22 bp, Artificial Sequence
  chemically synthesized
ttttaattttgaaagttaaatt

SEQ ID NO: 986825 - DNA, 22 bp, Artificial Sequence
  chemically synthesized
ggataaaatttaactttcaaaa

SEQ ID NO: 986826 - DNA, 22 bp, Artificial Sequence
  chemically synthesized
agattattttaattttgaaagt

SEQ ID NO: 986827 - DNA, 22 bp, Artificial Sequence
  chemically synthesized
taagattattttaattttgaaa

SEQ ID NO: 986828 - DNA, 22 bp, Artificial Sequence
  chemically synthesized
ctaagattattttaattttgaa

SEQ ID NO: 986829 - DNA, 22 bp, Artificial Sequence
  chemically synthesized
tctaagattattttaattttga

SEQ ID NO: 986830 - DNA, 22 bp, Artificial Sequence
  chemically synthesized
aattttctaagattattttaat

SEQ ID NO: 986831 - DNA, 22 bp, Artificial Sequence
  chemically synthesized
aactttcaaaattaaaataatc

SEQ ID NO: 986832 - DNA, 22 bp, Artificial Sequence
  chemically synthesized
actttcaaaattaaaataatct

SEQ ID NO: 986833 - DNA, 22 bp, Artificial Sequence
  chemically synthesized
tcaaaattaaaataatcttaga

SEQ ID NO: 986834 - DNA, 22 bp, Artificial Sequence
  chemically synthesized
caaaattaaaataatcttagaa

SEQ ID NO: 986835 - DNA, 22 bp, Artificial Sequence
  chemically synthesized
gataactgaattttctaagatt

SEQ ID NO: 986836 - DNA, 22 bp, Artificial Sequence
  chemically synthesized
aaaattaaaataatcttagaaa

SEQ ID NO: 986837 - DNA, 22 bp, Artificial Sequence
  chemically synthesized
ggataactgaattttctaagat

SEQ ID NO: 986838 - DNA, 22 bp, Artificial Sequence
  chemically synthesized
tggataactgaattttctaaga

SEQ ID NO: 986839 - DNA, 22 bp, Artificial Sequence
  chemically synthesized
aaataatcttagaaaattcagt

SEQ ID NO: 986840 - DNA, 22 bp, Artificial Sequence
  chemically synthesized
atgcctttggataactgaattt

SEQ ID NO: 986841 - DNA, 22 bp, Artificial Sequence
  chemically synthesized
aatgcctttggataactgaatt

SEQ ID NO: 986842 - DNA, 22 bp, Artificial Sequence
  chemically synthesized
cttaatgcctttggataactga

SEQ ID NO: 986843 - DNA, 22 bp, Artificial Sequence
  chemically synthesized
agaaaattcagttatccaaagg

SEQ ID NO: 986844 - DNA, 22 bp, Artificial Sequence
  chemically synthesized
gaaaattcagttatccaaaggc

SEQ ID NO: 986845 - DNA, 22 bp, Artificial Sequence
  chemically synthesized
aaaagtcattgcttaatgcctt

SEQ ID NO: 986846 - DNA, 22 bp, Artificial Sequence
  chemically synthesized
gaaaagtcattgcttaatgcct

SEQ ID NO: 986847 - DNA, 22 bp, Artificial Sequence
  chemically synthesized
tgaaaagtcattgcttaatgcc

SEQ ID NO: 986848 - DNA, 22 bp, Artificial Sequence
  chemically synthesized
agttatccaaaggcattaagca

SEQ ID NO: 986849 - DNA, 22 bp, Artificial Sequence
  chemically synthesized
tccaaaggcattaagcaatgac

SEQ ID NO: 986850 - DNA, 22 bp, Artificial Sequence
  chemically synthesized
tcaactttgaaaagtcattgct

SEQ ID NO: 986851 - DNA, 22 bp, Artificial Sequence
  chemically synthesized
atcaactttgaaaagtcattgc

SEQ ID NO: 986852 - DNA, 22 bp, Artificial Sequence
  chemically synthesized
tatccttatcaactttgaaaag

SEQ ID NO: 986853 - DNA, 22 bp, Artificial Sequence
  chemically synthesized
agcaatgacttttcaaagttga

SEQ ID NO: 986854 - DNA, 22 bp, Artificial Sequence
  chemically synthesized
acaatagaaactatatccttat

SEQ ID NO: 986855 - DNA, 22 bp, Artificial Sequence
  chemically synthesized
cacaatagaaactatatcctta

SEQ ID NO: 986856 - DNA, 22 bp, Artificial Sequence
  chemically synthesized
ttcaaagttgataaggatatag

SEQ ID NO: 986857 - DNA, 22 bp, Artificial Sequence
  chemically synthesized
tcacaatagaaactatatcctt

SEQ ID NO: 986858 - DNA, 22 bp, Artificial Sequence
  chemically synthesized
tcaaagttgataaggatatagt

SEQ ID NO: 986859 - DNA, 22 bp, Artificial Sequence
  chemically synthesized
caaagttgataaggatatagtt

SEQ ID NO: 986860 - DNA, 22 bp, Artificial Sequence
  chemically synthesized
aaagttgataaggatatagttt

SEQ ID NO: 986861 - DNA, 22 bp, Artificial Sequence
  chemically synthesized
atagactttcacaatagaaact

SEQ ID NO: 986862 - DNA, 22 bp, Artificial Sequence
  chemically synthesized
ataaggatatagtttctattgt

SEQ ID NO: 986863 - DNA, 22 bp, Artificial Sequence
  chemically synthesized
tctaatagactttcacaataga

SEQ ID NO: 986864 - DNA, 22 bp, Artificial Sequence
  chemically synthesized
gtctaatagactttcacaatag

SEQ ID NO: 986865 - DNA, 22 bp, Artificial Sequence
  chemically synthesized
aaaagtacttgtctaatagact

SEQ ID NO: 986866 - DNA, 22 bp, Artificial Sequence
  chemically synthesized
gaaaagtacttgtctaatagac

SEQ ID NO: 986867 - DNA, 22 bp, Artificial Sequence
  chemically synthesized
ctattgtgaaagtctattagac

SEQ ID NO: 986868 - DNA, 22 bp, Artificial Sequence
  chemically synthesized
tgaaaagtacttgtctaataga

SEQ ID NO: 986869 - DNA, 22 bp, Artificial Sequence
  chemically synthesized
tattgtgaaagtctattagaca

SEQ ID NO: 986870 - DNA, 22 bp, Artificial Sequence
  chemically synthesized
ttgtgaaagtctattagacaag

SEQ ID NO: 986871 - DNA, 22 bp, Artificial Sequence
  chemically synthesized
tgaaagtctattagacaagtac

SEQ ID NO: 986872 - DNA, 22 bp, Artificial Sequence
  chemically synthesized
tataattttgaaaagtacttgt

SEQ ID NO: 986873 - DNA, 22 bp, Artificial Sequence
  chemically synthesized
ttagacaagtacttttcaaaat

SEQ ID NO: 986874 - DNA, 22 bp, Artificial Sequence
  chemically synthesized
gacaagtacttttcaaaattat

SEQ ID NO: 986875 - DNA, 22 bp, Artificial Sequence
  chemically synthesized
atacaataacctatataatttt

SEQ ID NO: 986876 - DNA, 22 bp, Artificial Sequence
  chemically synthesized
ttcaaaattatataggttattg

SEQ ID NO: 986877 - DNA, 22 bp, Artificial Sequence
  chemically synthesized
tcaaaattatataggttattgt

SEQ ID NO: 986878 - DNA, 22 bp, Artificial Sequence
  chemically synthesized
caaaattatataggttattgta

SEQ ID NO: 986879 - DNA, 22 bp, Artificial Sequence
  chemically synthesized
aaaattatataggttattgtat

SEQ ID NO: 986880 - DNA, 22 bp, Artificial Sequence
  chemically synthesized
tataggttattgtattagtccg

SEQ ID NO: 986881 - DNA, 22 bp, Artificial Sequence
  chemically synthesized
tcacagcatgaaaacggactaa

SEQ ID NO: 986882 - DNA, 22 bp, Artificial Sequence
  chemically synthesized
atcacagcatgaaaacggacta

SEQ ID NO: 986883 - DNA, 22 bp, Artificial Sequence
  chemically synthesized
tatcacagcatgaaaacggact

SEQ ID NO: 986884 - DNA, 22 bp, Artificial Sequence
  chemically synthesized
ttgtattagtccgttttcatgc

SEQ ID NO: 986885 - DNA, 22 bp, Artificial Sequence
  chemically synthesized
tattagtccgttttcatgctgt

SEQ ID NO: 986886 - DNA, 22 bp, Artificial Sequence
  chemically synthesized
aagtatgtctttatcacagcat

SEQ ID NO: 986887 - DNA, 22 bp, Artificial Sequence
  chemically synthesized
gtccgttttcatgctgtgataa

SEQ ID NO: 986888 - DNA, 22 bp, Artificial Sequence
  chemically synthesized
ccagtctcaagtatgtctttat

SEQ ID NO: 986889 - DNA, 22 bp, Artificial Sequence
  chemically synthesized
cccagtctcaagtatgtcttta

SEQ ID NO: 986890 - DNA, 22 bp, Artificial Sequence
  chemically synthesized
tcatgctgtgataaagacatac

SEQ ID NO: 986891 - DNA, 22 bp, Artificial Sequence
  chemically synthesized
catgctgtgataaagacatact

SEQ ID NO: 986892 - DNA, 22 bp, Artificial Sequence
  chemically synthesized
ttcccagtctcaagtatgtctt

SEQ ID NO: 986893 - DNA, 22 bp, Artificial Sequence
  chemically synthesized
atgctgtgataaagacatactt

SEQ ID NO: 986894 - DNA, 22 bp, Artificial Sequence
  chemically synthesized
cttcccagtctcaagtatgtct

SEQ ID NO: 986895 - DNA, 22 bp, Artificial Sequence
  chemically synthesized
tcttcccagtctcaagtatgtc

SEQ ID NO: 986896 - DNA, 22 bp, Artificial Sequence
  chemically synthesized
ttcttcccagtctcaagtatgt

SEQ ID NO: 986897 - DNA, 22 bp, Artificial Sequence
  chemically synthesized
tttcttcccagtctcaagtatg

SEQ ID NO: 986898 - DNA, 22 bp, Artificial Sequence
  chemically synthesized
tgataaagacatacttgagact

SEQ ID NO: 986899 - DNA, 22 bp, Artificial Sequence
  chemically synthesized
ctttttcttcccagtctcaagt

SEQ ID NO: 986900 - DNA, 22 bp, Artificial Sequence
  chemically synthesized
aactactttttcttcccagtct

SEQ ID NO: 986901 - DNA, 22 bp, Artificial Sequence
  chemically synthesized
aattaaactactttttcttccc

SEQ ID NO: 986902 - DNA, 22 bp, Artificial Sequence
  chemically synthesized
gagactgggaagaaaaagtagt

SEQ ID NO: 986903 - DNA, 22 bp, Artificial Sequence
  chemically synthesized
agactgggaagaaaaagtagtt

SEQ ID NO: 986904 - DNA, 22 bp, Artificial Sequence
  chemically synthesized
taagttcaattaaactactttt

SEQ ID NO: 986905 - DNA, 22 bp, Artificial Sequence
  chemically synthesized
ggaagaaaaagtagtttaattg

SEQ ID NO: 986906 - DNA, 22 bp, Artificial Sequence
  chemically synthesized
cccagtcatgtggaactataag

SEQ ID NO: 986907 - DNA, 22 bp, Artificial Sequence
  chemically synthesized
aattgaacttatagttccacat

SEQ ID NO: 986908 - DNA, 22 bp, Artificial Sequence
  chemically synthesized
attgaacttatagttccacatg

SEQ ID NO: 986909 - DNA, 22 bp, Artificial Sequence
  chemically synthesized
aggcctccccagtcatgtggaa

SEQ ID NO: 986910 - DNA, 22 bp, Artificial Sequence
  chemically synthesized
tgaggcctccccagtcatgtgg

SEQ ID NO: 986911 - DNA, 22 bp, Artificial Sequence
  chemically synthesized
aacttatagttccacatgactg

SEQ ID NO: 986912 - DNA, 22 bp, Artificial Sequence
  chemically synthesized
atagttccacatgactggggag

SEQ ID NO: 986913 - DNA, 22 bp, Artificial Sequence
  chemically synthesized
tagttccacatgactggggagg

SEQ ID NO: 986914 - DNA, 22 bp, Artificial Sequence
  chemically synthesized
ccaccatgattctgaggcctcc

SEQ ID NO: 986915 - DNA, 22 bp, Artificial Sequence
  chemically synthesized
cacatgactggggaggcctcag

SEQ ID NO: 986916 - DNA, 22 bp, Artificial Sequence
  chemically synthesized
acctcccaccatgattctgagg

SEQ ID NO: 986917 - DNA, 22 bp, Artificial Sequence
  chemically synthesized
cacctcccaccatgattctgag

SEQ ID NO: 986918 - DNA, 22 bp, Artificial Sequence
  chemically synthesized
tcacctcccaccatgattctga

SEQ ID NO: 986919 - DNA, 22 bp, Artificial Sequence
  chemically synthesized
gggaggcctcagaatcatggtg

SEQ ID NO: 986920 - DNA, 22 bp, Artificial Sequence
  chemically synthesized
agaatcatggtgggaggtgaaa

SEQ ID NO: 986921 - DNA, 22 bp, Artificial Sequence
  chemically synthesized
catgtaagaagtgcctttcacc

SEQ ID NO: 986922 - DNA, 22 bp, Artificial Sequence
  chemically synthesized
ccatgtaagaagtgcctttcac

SEQ ID NO: 986923 - DNA, 22 bp, Artificial Sequence
  chemically synthesized
cttccatgtaagaagtgccttt

SEQ ID NO: 986924 - DNA, 22 bp, Artificial Sequence
  chemically synthesized
tgcttccatgtaagaagtgcct

SEQ ID NO: 986925 - DNA, 22 bp, Artificial Sequence
  chemically synthesized
ctgcttccatgtaagaagtgcc

SEQ ID NO: 986926 - DNA, 22 bp, Artificial Sequence
  chemically synthesized
ttctgcttccatgtaagaagtg

SEQ ID NO: 986927 - DNA, 22 bp, Artificial Sequence
  chemically synthesized
tcttctgcttccatgtaagaag

SEQ ID NO: 986928 - DNA, 22 bp, Artificial Sequence
  chemically synthesized
ctcttctgcttccatgtaagaa

SEQ ID NO: 986929 - DNA, 22 bp, Artificial Sequence
  chemically synthesized
tctcttctgcttccatgtaaga

SEQ ID NO: 986930 - DNA, 22 bp, Artificial Sequence
  chemically synthesized
cacattttctcttctgcttcca

SEQ ID NO: 986931 - DNA, 22 bp, Artificial Sequence
  chemically synthesized
cttacatggaagcagaagagaa

SEQ ID NO: 986932 - DNA, 22 bp, Artificial Sequence
  chemically synthesized
cgtctccacattttctcttctg

SEQ ID NO: 986933 - DNA, 22 bp, Artificial Sequence
  chemically synthesized
ttacatggaagcagaagagaaa

SEQ ID NO: 986934 - DNA, 22 bp, Artificial Sequence
  chemically synthesized
gcgtctccacattttctcttct

SEQ ID NO: 986935 - DNA, 22 bp, Artificial Sequence
  chemically synthesized
acatggaagcagaagagaaaat

SEQ ID NO: 986936 - DNA, 22 bp, Artificial Sequence
  chemically synthesized
ttgcgtctccacattttctctt

SEQ ID NO: 986937 - DNA, 22 bp, Artificial Sequence
  chemically synthesized
catggaagcagaagagaaaatg

SEQ ID NO: 986938 - DNA, 22 bp, Artificial Sequence
  chemically synthesized
ctcttgcgtctccacattttct

SEQ ID NO: 986939 - DNA, 22 bp, Artificial Sequence
  chemically synthesized
tgctcttgcgtctccacatttt

SEQ ID NO: 986940 - DNA, 22 bp, Artificial Sequence
  chemically synthesized
ctgctcttgcgtctccacattt

SEQ ID NO: 986941 - DNA, 22 bp, Artificial Sequence
  chemically synthesized
tcaggggtttctgctcttgcgt

SEQ ID NO: 986942 - DNA, 22 bp, Artificial Sequence
  chemically synthesized
atcaggggtttctgctcttgcg

SEQ ID NO: 986943 - DNA, 22 bp, Artificial Sequence
  chemically synthesized
tatcaggggtttctgctcttgc

SEQ ID NO: 986944 - DNA, 22 bp, Artificial Sequence
  chemically synthesized
gttttatcaggggtttctgctc

SEQ ID NO: 986945 - DNA, 22 bp, Artificial Sequence
  chemically synthesized
ttggttttatcaggggtttctg

SEQ ID NO: 986946 - DNA, 22 bp, Artificial Sequence
  chemically synthesized
acgagatctgttggttttatca

SEQ ID NO: 986947 - DNA, 22 bp, Artificial Sequence
  chemically synthesized
aataagtctcacgagatctgtt

SEQ ID NO: 986948 - DNA, 22 bp, Artificial Sequence
  chemically synthesized
ataaaaccaacagatctcgtga

SEQ ID NO: 986949 - DNA, 22 bp, Artificial Sequence
  chemically synthesized
atggtactgaataagtctcacg

SEQ ID NO: 986950 - DNA, 22 bp, Artificial Sequence
  chemically synthesized
tcatggtactgaataagtctca

SEQ ID NO: 986951 - DNA, 22 bp, Artificial Sequence
  chemically synthesized
ttctcatggtactgaataagtc

SEQ ID NO: 986952 - DNA, 22 bp, Artificial Sequence
  chemically synthesized
gtgagacttattcagtaccatg

SEQ ID NO: 986953 - DNA, 22 bp, Artificial Sequence
  chemically synthesized
ccccatactgttctcatggtac

SEQ ID NO: 986954 - DNA, 22 bp, Artificial Sequence
  chemically synthesized
cccccatactgttctcatggta

SEQ ID NO: 986955 - DNA, 22 bp, Artificial Sequence
  chemically synthesized
attcagtaccatgagaacagta

SEQ ID NO: 986956 - DNA, 22 bp, Artificial Sequence
  chemically synthesized
ttcagtaccatgagaacagtat

SEQ ID NO: 986957 - DNA, 22 bp, Artificial Sequence
  chemically synthesized
agtaccatgagaacagtatggg

SEQ ID NO: 986958 - DNA, 22 bp, Artificial Sequence
  chemically synthesized
aatcatgggggcggtttccccc

SEQ ID NO: 986959 - DNA, 22 bp, Artificial Sequence
  chemically synthesized
gaatcatgggggcggtttcccc

SEQ ID NO: 986960 - DNA, 22 bp, Artificial Sequence
  chemically synthesized
tgggagggatccagtgggaggt

SEQ ID NO: 986961 - DNA, 22 bp, Artificial Sequence
  chemically synthesized
ttgtgggagggatccagtggga

SEQ ID NO: 986962 - DNA, 22 bp, Artificial Sequence
  chemically synthesized
gttgtgggagggatccagtggg

SEQ ID NO: 986963 - DNA, 22 bp, Artificial Sequence
  chemically synthesized
aaatgacctcccactggatccc

SEQ ID NO: 986964 - DNA, 22 bp, Artificial Sequence
  chemically synthesized
cttgttgtgggagggatccagt

SEQ ID NO: 986965 - DNA, 22 bp, Artificial Sequence
  chemically synthesized
ctacttgttgtgggagggatcc

SEQ ID NO: 986966 - DNA, 22 bp, Artificial Sequence
  chemically synthesized
ccactggatccctcccacaaca

SEQ ID NO: 986967 - DNA, 22 bp, Artificial Sequence
  chemically synthesized
ccataattcctacttgttgtgg

SEQ ID NO: 986968 - DNA, 22 bp, Artificial Sequence
  chemically synthesized
ctcccataattcctacttgttg

SEQ ID NO: 986969 - DNA, 22 bp, Artificial Sequence
  chemically synthesized
gatccctcccacaacaagtagg

SEQ ID NO: 986970 - DNA, 22 bp, Artificial Sequence
  chemically synthesized
tactcccataattcctacttgt

SEQ ID NO: 986971 - DNA, 22 bp, Artificial Sequence
  chemically synthesized
aattctactcccataattccta

SEQ ID NO: 986972 - DNA, 22 bp, Artificial Sequence
  chemically synthesized
gaattctactcccataattcct

SEQ ID NO: 986973 - DNA, 22 bp, Artificial Sequence
  chemically synthesized
ccacaacaagtaggaattatgg

SEQ ID NO: 986974 - DNA, 22 bp, Artificial Sequence
  chemically synthesized
atcttgaattctactcccataa

SEQ ID NO: 986975 - DNA, 22 bp, Artificial Sequence
  chemically synthesized
tgggagtagaattcaagatgag

SEQ ID NO: 986976 - DNA, 22 bp, Artificial Sequence
  chemically synthesized
tgtccccacccaaatctcatct

SEQ ID NO: 986977 - DNA, 22 bp, Artificial Sequence
  chemically synthesized
gctgtgtccccacccaaatctc

SEQ ID NO: 986978 - DNA, 22 bp, Artificial Sequence
  chemically synthesized
ggctgtgtccccacccaaatct

SEQ ID NO: 986979 - DNA, 22 bp, Artificial Sequence
  chemically synthesized
aagatgagatttgggtggggac

SEQ ID NO: 986980 - DNA, 22 bp, Artificial Sequence
  chemically synthesized
atatggtttggctgtgtcccca

SEQ ID NO: 986981 - DNA, 22 bp, Artificial Sequence
  chemically synthesized
aataactgatatggtttggctg

SEQ ID NO: 986982 - DNA, 22 bp, Artificial Sequence
  chemically synthesized
gggtggggacacagccaaacca

SEQ ID NO: 986983 - DNA, 22 bp, Artificial Sequence
  chemically synthesized
caataactgatatggtttggct

SEQ ID NO: 986984 - DNA, 22 bp, Artificial Sequence
  chemically synthesized
ggtggggacacagccaaaccat

SEQ ID NO: 986985 - DNA, 22 bp, Artificial Sequence
  chemically synthesized
cttcaataactgatatggtttg

SEQ ID NO: 986986 - DNA, 22 bp, Artificial Sequence
  chemically synthesized
ccttcaataactgatatggttt

SEQ ID NO: 986987 - DNA, 22 bp, Artificial Sequence
  chemically synthesized
tccttcaataactgatatggtt

SEQ ID NO: 986988 - DNA, 22 bp, Artificial Sequence
  chemically synthesized
ttccttcaataactgatatggt

SEQ ID NO: 986989 - DNA, 22 bp, Artificial Sequence
  chemically synthesized
catttttccttcaataactgat

SEQ ID NO: 986990 - DNA, 22 bp, Artificial Sequence
  chemically synthesized
ccatttttccttcaataactga

SEQ ID NO: 986991 - DNA, 22 bp, Artificial Sequence
  chemically synthesized
cttccatttttccttcaataac

SEQ ID NO: 986992 - DNA, 22 bp, Artificial Sequence
  chemically synthesized
gcttccatttttccttcaataa

SEQ ID NO: 986993 - DNA, 22 bp, Artificial Sequence
  chemically synthesized
ttgaaggaaaaatggaagcaag

SEQ ID NO: 986994 - DNA, 22 bp, Artificial Sequence
  chemically synthesized
gtggtgaaaatgccttgcttcc

SEQ ID NO: 986995 - DNA, 22 bp, Artificial Sequence
  chemically synthesized
ggtggtgaaaatgccttgcttc

SEQ ID NO: 986996 - DNA, 22 bp, Artificial Sequence
  chemically synthesized
aaggaaaaatggaagcaaggca

SEQ ID NO: 986997 - DNA, 22 bp, Artificial Sequence
  chemically synthesized
agcaaaatttggtggtgaaaat

SEQ ID NO: 986998 - DNA, 22 bp, Artificial Sequence
  chemically synthesized
gagcaaaatttggtggtgaaaa

SEQ ID NO: 986999 - DNA, 22 bp, Artificial Sequence
  chemically synthesized
tttgagcaaaatttggtggtga

SEQ ID NO: 987000 - DNA, 22 bp, Artificial Sequence
  chemically synthesized
gtttgagcaaaatttggtggtg

SEQ ID NO: 987001 - DNA, 22 bp, Artificial Sequence
  chemically synthesized
ccttgtttgagcaaaatttggt

SEQ ID NO: 987002 - DNA, 22 bp, Artificial Sequence
  chemically synthesized
tatctgccttgtttgagcaaaa

SEQ ID NO: 987003 - DNA, 22 bp, Artificial Sequence
  chemically synthesized
tcaccaccaaattttgctcaaa

SEQ ID NO: 987004 - DNA, 22 bp, Artificial Sequence
  chemically synthesized
caccaccaaattttgctcaaac

SEQ ID NO: 987005 - DNA, 22 bp, Artificial Sequence
  chemically synthesized
accaccaaattttgctcaaaca

SEQ ID NO: 987006 - DNA, 22 bp, Artificial Sequence
  chemically synthesized
caggttatatctgccttgtttg

SEQ ID NO: 987007 - DNA, 22 bp, Artificial Sequence
  chemically synthesized
cagctgcaggttatatctgcct

SEQ ID NO: 987008 - DNA, 22 bp, Artificial Sequence
  chemically synthesized
tgctcaaacaaggcagatataa

SEQ ID NO: 987009 - DNA, 22 bp, Artificial Sequence
  chemically synthesized
tgcagctgcaggttatatctgc

SEQ ID NO: 987010 - DNA, 22 bp, Artificial Sequence
  chemically synthesized
gctcaaacaaggcagatataac

SEQ ID NO: 987011 - DNA, 22 bp, Artificial Sequence
  chemically synthesized
ctcaaacaaggcagatataacc

SEQ ID NO: 987012 - DNA, 22 bp, Artificial Sequence
  chemically synthesized
ttctgcagctgcaggttatatc

SEQ ID NO: 987013 - DNA, 22 bp, Artificial Sequence
  chemically synthesized
aaacaaggcagatataacctgc

SEQ ID NO: 987014 - DNA, 22 bp, Artificial Sequence
  chemically synthesized
attgttctgcagctgcaggtta

SEQ ID NO: 987015 - DNA, 22 bp, Artificial Sequence
  chemically synthesized
aaaaacataaacctaattgttc

SEQ ID NO: 987016 - DNA, 22 bp, Artificial Sequence
  chemically synthesized
tcaaaaacataaacctaattgt

SEQ ID NO: 987017 - DNA, 22 bp, Artificial Sequence
  chemically synthesized
ctcaaaaacataaacctaattg

SEQ ID NO: 987018 - DNA, 22 bp, Artificial Sequence
  chemically synthesized
cagctgcagaacaattaggttt

SEQ ID NO: 987019 - DNA, 22 bp, Artificial Sequence
  chemically synthesized
cagaacaattaggtttatgttt

SEQ ID NO: 987020 - DNA, 22 bp, Artificial Sequence
  chemically synthesized
taaacttctcaaaaacataaac

SEQ ID NO: 987021 - DNA, 22 bp, Artificial Sequence
  chemically synthesized
actataaacttctcaaaaacat

SEQ ID NO: 987022 - DNA, 22 bp, Artificial Sequence
  chemically synthesized
aactataaacttctcaaaaaca

SEQ ID NO: 987023 - DNA, 22 bp, Artificial Sequence
  chemically synthesized
taactataaacttctcaaaaac

SEQ ID NO: 987024 - DNA, 22 bp, Artificial Sequence
  chemically synthesized
ttaactataaacttctcaaaaa

SEQ ID NO: 987025 - DNA, 22 bp, Artificial Sequence
  chemically synthesized
ggtttatgtttttgagaagttt

SEQ ID NO: 987026 - DNA, 22 bp, Artificial Sequence
  chemically synthesized
atgtttttgagaagtttatagt

SEQ ID NO: 987027 - DNA, 22 bp, Artificial Sequence
  chemically synthesized
tgtttttgagaagtttatagtt

SEQ ID NO: 987028 - DNA, 22 bp, Artificial Sequence
  chemically synthesized
ttgagaagtttatagttaaaaa

SEQ ID NO: 987029 - DNA, 22 bp, Artificial Sequence
  chemically synthesized
tgagaagtttatagttaaaaac

SEQ ID NO: 987030 - DNA, 22 bp, Artificial Sequence
  chemically synthesized
gagaagtttatagttaaaaaca

SEQ ID NO: 987031 - DNA, 22 bp, Artificial Sequence
  chemically synthesized
agaagtttatagttaaaaacat

SEQ ID NO: 987032 - DNA, 22 bp, Artificial Sequence
  chemically synthesized
atagttaaaaacatttgataca

SEQ ID NO: 987033 - DNA, 22 bp, Artificial Sequence
  chemically synthesized
tagttaaaaacatttgatacat

SEQ ID NO: 987034 - DNA, 22 bp, Artificial Sequence
  chemically synthesized
tgtaccatgcagagcaatgtat

SEQ ID NO: 987035 - DNA, 22 bp, Artificial Sequence
  chemically synthesized
aaaacatttgatacattgctct

SEQ ID NO: 987036 - DNA, 22 bp, Artificial Sequence
  chemically synthesized
ctatgtaccatgcagagcaatg

SEQ ID NO: 987037 - DNA, 22 bp, Artificial Sequence
  chemically synthesized
gatacattgctctgcatggtac

SEQ ID NO: 987038 - DNA, 22 bp, Artificial Sequence
  chemically synthesized
atacattgctctgcatggtaca

SEQ ID NO: 987039 - DNA, 22 bp, Artificial Sequence
  chemically synthesized
ctctgcatggtacataggagtt

SEQ ID NO: 987040 - DNA, 22 bp, Artificial Sequence
  chemically synthesized
tgcatggtacataggagttttg

SEQ ID NO: 987041 - DNA, 22 bp, Artificial Sequence
  chemically synthesized
acaatgaggtgaccaaaactcc

SEQ ID NO: 987042 - DNA, 22 bp, Artificial Sequence
  chemically synthesized
catggtacataggagttttggt

SEQ ID NO: 987043 - DNA, 22 bp, Artificial Sequence
  chemically synthesized
aacaatgaggtgaccaaaactc

SEQ ID NO: 987044 - DNA, 22 bp, Artificial Sequence
  chemically synthesized
tggtcacctcattgttaagccc

SEQ ID NO: 987045 - DNA, 22 bp, Artificial Sequence
  chemically synthesized
ggtcacctcattgttaagccca

SEQ ID NO: 987046 - DNA, 22 bp, Artificial Sequence
  chemically synthesized
catagggagtaatgggcttaac

SEQ ID NO: 987047 - DNA, 22 bp, Artificial Sequence
  chemically synthesized
gtcacctcattgttaagcccat

SEQ ID NO: 987048 - DNA, 22 bp, Artificial Sequence
  chemically synthesized
ctgcatagggagtaatgggctt

SEQ ID NO: 987049 - DNA, 22 bp, Artificial Sequence
  chemically synthesized
attgttaagcccattactccct

SEQ ID NO: 987050 - DNA, 22 bp, Artificial Sequence
  chemically synthesized
aatgttactgcatagggagtaa

SEQ ID NO: 987051 - DNA, 22 bp, Artificial Sequence
  chemically synthesized
ttaagcccattactccctatgc

SEQ ID NO: 987052 - DNA, 22 bp, Artificial Sequence
  chemically synthesized
agcccattactccctatgcagt

SEQ ID NO: 987053 - DNA, 22 bp, Artificial Sequence
  chemically synthesized
aaaatattaaatgttactgcat

SEQ ID NO: 987054 - DNA, 22 bp, Artificial Sequence
  chemically synthesized
aaaaatattaaatgttactgca

SEQ ID NO: 987055 - DNA, 22 bp, Artificial Sequence
  chemically synthesized
atttaaaaatattaaatgttac

SEQ ID NO: 987056 - DNA, 22 bp, Artificial Sequence
  chemically synthesized
ctccctatgcagtaacatttaa

SEQ ID NO: 987057 - DNA, 22 bp, Artificial Sequence
  chemically synthesized
ttcatttaaaaatattaaatgt

SEQ ID NO: 987058 - DNA, 22 bp, Artificial Sequence
  chemically synthesized
cctatgcagtaacatttaatat

SEQ ID NO: 987059 - DNA, 22 bp, Artificial Sequence
  chemically synthesized
attcatttaaaaatattaaatg

SEQ ID NO: 987060 - DNA, 22 bp, Artificial Sequence
  chemically synthesized
tattcatttaaaaatattaaat

SEQ ID NO: 987061 - DNA, 22 bp, Artificial Sequence
  chemically synthesized
ttattcatttaaaaatattaaa

SEQ ID NO: 987062 - DNA, 22 bp, Artificial Sequence
  chemically synthesized
tgcagtaacatttaatattttt

SEQ ID NO: 987063 - DNA, 22 bp, Artificial Sequence
  chemically synthesized
tttttattcatttaaaaatatt

SEQ ID NO: 987064 - DNA, 22 bp, Artificial Sequence
  chemically synthesized
atttttattcatttaaaaatat

SEQ ID NO: 987065 - DNA, 22 bp, Artificial Sequence
  chemically synthesized
accttatttttattcatttaaa

SEQ ID NO: 987066 - DNA, 22 bp, Artificial Sequence
  chemically synthesized
aatatttttaaatgaataaaaa

SEQ ID NO: 987067 - DNA, 22 bp, Artificial Sequence
  chemically synthesized
cacctgaccttatttttattca

SEQ ID NO: 987068 - DNA, 22 bp, Artificial Sequence
  chemically synthesized
atatttttaaatgaataaaaat

SEQ ID NO: 987069 - DNA, 22 bp, Artificial Sequence
  chemically synthesized
ttaaatgaataaaaataaggtc

SEQ ID NO: 987070 - DNA, 22 bp, Artificial Sequence
  chemically synthesized
taaatgaataaaaataaggtca

SEQ ID NO: 987071 - DNA, 22 bp, Artificial Sequence
  chemically synthesized
aaatgaataaaaataaggtcag

SEQ ID NO: 987072 - DNA, 22 bp, Artificial Sequence
  chemically synthesized
aatgaataaaaataaggtcagg

SEQ ID NO: 987073 - DNA, 22 bp, Artificial Sequence
  chemically synthesized
taggtgtgatccactgcacctg

SEQ ID NO: 987074 - DNA, 22 bp, Artificial Sequence
  chemically synthesized
ggattataggtgtgatccactg

SEQ ID NO: 987075 - DNA, 22 bp, Artificial Sequence
  chemically synthesized
ccaaagtgttgggattataggt

SEQ ID NO: 987076 - DNA, 22 bp, Artificial Sequence
  chemically synthesized
agcctcccaaagtgttgggatt

SEQ ID NO: 987077 - DNA, 22 bp, Artificial Sequence
  chemically synthesized
taatcccaacactttgggaggc

SEQ ID NO: 987078 - DNA, 22 bp, Artificial Sequence
  chemically synthesized
aagtcatccacccgactcagcc

SEQ ID NO: 987079 - DNA, 22 bp, Artificial Sequence
  chemically synthesized
gcctcaagtcatccacccgact

SEQ ID NO: 987080 - DNA, 22 bp, Artificial Sequence
  chemically synthesized
tgggaggctgagtcgggtggat

SEQ ID NO: 987081 - DNA, 22 bp, Artificial Sequence
  chemically synthesized
gggaggctgagtcgggtggatg

SEQ ID NO: 987082 - DNA, 22 bp, Artificial Sequence
  chemically synthesized
ctagcctcaagtcatccacccg

SEQ ID NO: 987083 - DNA, 22 bp, Artificial Sequence
  chemically synthesized
ggaggctgagtcgggtggatga

SEQ ID NO: 987084 - DNA, 22 bp, Artificial Sequence
  chemically synthesized
gaactcctagcctcaagtcatc

SEQ ID NO: 987085 - DNA, 22 bp, Artificial Sequence
  chemically synthesized
agtcgggtggatgacttgaggc

SEQ ID NO: 987086 - DNA, 22 bp, Artificial Sequence
  chemically synthesized
gtctcgaactcctagcctcaag

SEQ ID NO: 987087 - DNA, 22 bp, Artificial Sequence
  chemically synthesized
gccaggctggtctcgaactcct

SEQ ID NO: 987088 - DNA, 22 bp, Artificial Sequence
  chemically synthesized
gaggctaggagttcgagaccag

SEQ ID NO: 987089 - DNA, 22 bp, Artificial Sequence
  chemically synthesized
aggctaggagttcgagaccagc

SEQ ID NO: 987090 - DNA, 22 bp, Artificial Sequence
  chemically synthesized
accatgttggccaggctggtct

SEQ ID NO: 987091 - DNA, 22 bp, Artificial Sequence
  chemically synthesized
caccatgttggccaggctggtc

SEQ ID NO: 987092 - DNA, 22 bp, Artificial Sequence
  chemically synthesized
ggagttcgagaccagcctggcc

SEQ ID NO: 987093 - DNA, 22 bp, Artificial Sequence
  chemically synthesized
gagaccagcctggccaacatgg

SEQ ID NO: 987094 - DNA, 22 bp, Artificial Sequence
  chemically synthesized
gtagagacggggtttcaccatg

SEQ ID NO: 987095 - DNA, 22 bp, Artificial Sequence
  chemically synthesized
agtagagacggggtttcaccat

SEQ ID NO: 987096 - DNA, 22 bp, Artificial Sequence
  chemically synthesized
tagtagagacggggtttcacca

SEQ ID NO: 987097 - DNA, 22 bp, Artificial Sequence
  chemically synthesized
ttagtagagacggggtttcacc

SEQ ID NO: 987098 - DNA, 22 bp, Artificial Sequence
  chemically synthesized
gccaacatggtgaaaccccgtc

SEQ ID NO: 987099 - DNA, 22 bp, Artificial Sequence
  chemically synthesized
tatttttagtagagacggggtt

SEQ ID NO: 987100 - DNA, 22 bp, Artificial Sequence
  chemically synthesized
gtatttttagtagagacggggt

SEQ ID NO: 987101 - DNA, 22 bp, Artificial Sequence
  chemically synthesized
tgtatttttagtagagacgggg

SEQ ID NO: 987102 - DNA, 22 bp, Artificial Sequence
  chemically synthesized
ttgtatttttagtagagacggg

SEQ ID NO: 987103 - DNA, 22 bp, Artificial Sequence
  chemically synthesized
tttgtatttttagtagagacgg

SEQ ID NO: 987104 - DNA, 22 bp, Artificial Sequence
  chemically synthesized
ttttgtatttttagtagagacg

SEQ ID NO: 987105 - DNA, 22 bp, Artificial Sequence
  chemically synthesized
tttttgtatttttagtagagac

SEQ ID NO: 987106 - DNA, 22 bp, Artificial Sequence
  chemically synthesized
ttttttgtatttttagtagaga

SEQ ID NO: 987107 - DNA, 22 bp, Artificial Sequence
  chemically synthesized
tttttttgtatttttagtagag

SEQ ID NO: 987108 - DNA, 22 bp, Artificial Sequence
  chemically synthesized
ttttttttgtatttttagtaga

SEQ ID NO: 987109 - DNA, 22 bp, Artificial Sequence
  chemically synthesized
tttttttttgtatttttagtag

SEQ ID NO: 987110 - DNA, 22 bp, Artificial Sequence
  chemically synthesized
ttttttttttttgtatttttag

SEQ ID NO: 987111 - DNA, 22 bp, Artificial Sequence
  chemically synthesized
gttttttttttttgtattttta

SEQ ID NO: 987112 - DNA, 22 bp, Artificial Sequence
  chemically synthesized
tttgttttttttttttgtattt

SEQ ID NO: 987113 - DNA, 22 bp, Artificial Sequence
  chemically synthesized
tactaaaaatacaaaaaaaaaa

SEQ ID NO: 987114 - DNA, 22 bp, Artificial Sequence
  chemically synthesized
ctaaaaatacaaaaaaaaaaaa

SEQ ID NO: 987115 - DNA, 22 bp, Artificial Sequence
  chemically synthesized
aaaatacaaaaaaaaaaaacaa

SEQ ID NO: 987116 - DNA, 22 bp, Artificial Sequence
  chemically synthesized
gaggcgcccacaaccacgccag

SEQ ID NO: 987117 - DNA, 22 bp, Artificial Sequence
  chemically synthesized
ggattagaggcgcccacaacca

SEQ ID NO: 987118 - DNA, 22 bp, Artificial Sequence
  chemically synthesized
gcgtggttgtgggcgcctctaa

SEQ ID NO: 987119 - DNA, 22 bp, Artificial Sequence
  chemically synthesized
ccaagcagctgggattagaggc

SEQ ID NO: 987120 - DNA, 22 bp, Artificial Sequence
  chemically synthesized
ggcctcccaagcagctgggatt

SEQ ID NO: 987121 - DNA, 22 bp, Artificial Sequence
  chemically synthesized
tgggcgcctctaatcccagctg

SEQ ID NO: 987122 - DNA, 22 bp, Artificial Sequence
  chemically synthesized
tgcctcggcctcccaagcagct

SEQ ID NO: 987123 - DNA, 22 bp, Artificial Sequence
  chemically synthesized
gtgcctcggcctcccaagcagc

SEQ ID NO: 987124 - DNA, 22 bp, Artificial Sequence
  chemically synthesized
ttgtgcctcggcctcccaagca

SEQ ID NO: 987125 - DNA, 22 bp, Artificial Sequence
  chemically synthesized
taatcccagctgcttgggaggc

SEQ ID NO: 987126 - DNA, 22 bp, Artificial Sequence
  chemically synthesized
atcccagctgcttgggaggccg

SEQ ID NO: 987127 - DNA, 22 bp, Artificial Sequence
  chemically synthesized
aagtgattcttgtgcctcggcc

SEQ ID NO: 987128 - DNA, 22 bp, Artificial Sequence
  chemically synthesized
cttgggaggccgaggcacaaga

SEQ ID NO: 987129 - DNA, 22 bp, Artificial Sequence
  chemically synthesized
gggaggccgaggcacaagaatc

SEQ ID NO: 987130 - DNA, 22 bp, Artificial Sequence
  chemically synthesized
ccgggttcaagtgattcttgtg

SEQ ID NO: 987131 - DNA, 22 bp, Artificial Sequence
  chemically synthesized
ggaggccgaggcacaagaatca

SEQ ID NO: 987132 - DNA, 22 bp, Artificial Sequence
  chemically synthesized
cacctcccgggttcaagtgatt

SEQ ID NO: 987133 - DNA, 22 bp, Artificial Sequence
  chemically synthesized
caacctccacctcccgggttca

SEQ ID NO: 987134 - DNA, 22 bp, Artificial Sequence
  chemically synthesized
actgcaacctccacctcccggg

SEQ ID NO: 987135 - DNA, 22 bp, Artificial Sequence
  chemically synthesized
ggctcactgcaacctccacctc

SEQ ID NO: 987136 - DNA, 22 bp, Artificial Sequence
  chemically synthesized
gaacccgggaggtggaggttgc

SEQ ID NO: 987137 - DNA, 22 bp, Artificial Sequence
  chemically synthesized
aacccgggaggtggaggttgca

SEQ ID NO: 987138 - DNA, 22 bp, Artificial Sequence
  chemically synthesized
aagtgcagtggtatgatctcgg

SEQ ID NO: 987139 - DNA, 22 bp, Artificial Sequence
  chemically synthesized
cagtgagccgagatcataccac

SEQ ID NO: 987140 - DNA, 22 bp, Artificial Sequence
  chemically synthesized
tcacccaggctgaagtgcagtg

SEQ ID NO: 987141 - DNA, 22 bp, Artificial Sequence
  chemically synthesized
tgtcacccaggctgaagtgcag

SEQ ID NO: 987142 - DNA, 22 bp, Artificial Sequence
  chemically synthesized
gctctgtcacccaggctgaagt

SEQ ID NO: 987143 - DNA, 22 bp, Artificial Sequence
  chemically synthesized
cacttcagcctgggtgacagag

SEQ ID NO: 987144 - DNA, 22 bp, Artificial Sequence
  chemically synthesized
agacggagtctcgctctgtcac

SEQ ID NO: 987145 - DNA, 22 bp, Artificial Sequence
  chemically synthesized
gagacggagtctcgctctgtca

SEQ ID NO: 987146 - DNA, 22 bp, Artificial Sequence
  chemically synthesized
tgagacggagtctcgctctgtc

SEQ ID NO: 987147 - DNA, 22 bp, Artificial Sequence
  chemically synthesized
cagcctgggtgacagagcgaga

SEQ ID NO: 987148 - DNA, 22 bp, Artificial Sequence
  chemically synthesized
agcctgggtgacagagcgagac

SEQ ID NO: 987149 - DNA, 22 bp, Artificial Sequence
  chemically synthesized
ttttgagacggagtctcgctct

SEQ ID NO: 987150 - DNA, 22 bp, Artificial Sequence
  chemically synthesized
gttttgagacggagtctcgctc

SEQ ID NO: 987151 - DNA, 22 bp, Artificial Sequence
  chemically synthesized
tgttttgagacggagtctcgct

SEQ ID NO: 987152 - DNA, 22 bp, Artificial Sequence
  chemically synthesized
ttgttttgagacggagtctcgc

SEQ ID NO: 987153 - DNA, 22 bp, Artificial Sequence
  chemically synthesized
ggtgacagagcgagactccgtc

SEQ ID NO: 987154 - DNA, 22 bp, Artificial Sequence
  chemically synthesized
tttttgttttgagacggagtct

SEQ ID NO: 987155 - DNA, 22 bp, Artificial Sequence
  chemically synthesized
gtttttgttttgagacggagtc

SEQ ID NO: 987156 - DNA, 22 bp, Artificial Sequence
  chemically synthesized
tgtttttgttttgagacggagt

SEQ ID NO: 987157 - DNA, 22 bp, Artificial Sequence
  chemically synthesized
ttgtttttgttttgagacggag

SEQ ID NO: 987158 - DNA, 22 bp, Artificial Sequence
  chemically synthesized
tttttgtttttgttttgagacg

SEQ ID NO: 987159 - DNA, 22 bp, Artificial Sequence
  chemically synthesized
gtttttgtttttgttttgagac

SEQ ID NO: 987160 - DNA, 22 bp, Artificial Sequence
  chemically synthesized
tgtttttgtttttgttttgaga

SEQ ID NO: 987161 - DNA, 22 bp, Artificial Sequence
  chemically synthesized
ttgtttttgtttttgttttgag

SEQ ID NO: 987162 - DNA, 22 bp, Artificial Sequence
  chemically synthesized
tttttgtttttgtttttgtttt

SEQ ID NO: 987163 - DNA, 22 bp, Artificial Sequence
  chemically synthesized
gtttttgtttttgtttttgttt

SEQ ID NO: 987164 - DNA, 22 bp, Artificial Sequence
  chemically synthesized
tgtttttgtttttgtttttgtt

SEQ ID NO: 987165 - DNA, 22 bp, Artificial Sequence
  chemically synthesized
ttgtttttgtttttgtttttgt

SEQ ID NO: 987166 - DNA, 22 bp, Artificial Sequence
  chemically synthesized
cgtctcaaaacaaaaacaaaaa

SEQ ID NO: 987167 - DNA, 22 bp, Artificial Sequence
  chemically synthesized
tttttgtttttgtttttgtttt

SEQ ID NO: 987168 - DNA, 22 bp, Artificial Sequence
  chemically synthesized
gtttttgtttttgtttttgttt

SEQ ID NO: 987169 - DNA, 22 bp, Artificial Sequence
  chemically synthesized
tgtttttgtttttgtttttgtt

SEQ ID NO: 987170 - DNA, 22 bp, Artificial Sequence
  chemically synthesized
ttgtttttgtttttgtttttgt

SEQ ID NO: 987171 - DNA, 22 bp, Artificial Sequence
  chemically synthesized
aaaacaaaaacaaaaacaaaaa

SEQ ID NO: 987172 - DNA, 22 bp, Artificial Sequence
  chemically synthesized
tttttgtttttgtttttgtttt

SEQ ID NO: 987173 - DNA, 22 bp, Artificial Sequence
  chemically synthesized
gtttttgtttttgtttttgttt

SEQ ID NO: 987174 - DNA, 22 bp, Artificial Sequence
  chemically synthesized
tgtttttgtttttgtttttgtt

SEQ ID NO: 987175 - DNA, 22 bp, Artificial Sequence
  chemically synthesized
ttgtttttgtttttgtttttgt

SEQ ID NO: 987176 - DNA, 22 bp, Artificial Sequence
  chemically synthesized
tttttgtttttgtttttgtttt

SEQ ID NO: 987177 - DNA, 22 bp, Artificial Sequence
  chemically synthesized
gtttttgtttttgtttttgttt

SEQ ID NO: 987178 - DNA, 22 bp, Artificial Sequence
  chemically synthesized
tgtttttgtttttgtttttgtt

SEQ ID NO: 987179 - DNA, 22 bp, Artificial Sequence
  chemically synthesized
acgtgttttgtttttgtttttg

SEQ ID NO: 987180 - DNA, 22 bp, Artificial Sequence
  chemically synthesized
gaagagaattaacgtgttttgt

SEQ ID NO: 987181 - DNA, 22 bp, Artificial Sequence
  chemically synthesized
agaagagaattaacgtgttttg

SEQ ID NO: 987182 - DNA, 22 bp, Artificial Sequence
  chemically synthesized
aggccatttagaagagaattaa

SEQ ID NO: 987183 - DNA, 22 bp, Artificial Sequence
  chemically synthesized
attctcttctaaatggcctcag

SEQ ID NO: 987184 - DNA, 22 bp, Artificial Sequence
  chemically synthesized
agtaaagagagcacactgaggc

SEQ ID NO: 987185 - DNA, 22 bp, Artificial Sequence
  chemically synthesized
tcttctaaatggcctcagtgtg

SEQ ID NO: 987186 - DNA, 22 bp, Artificial Sequence
  chemically synthesized
ttctaaatggcctcagtgtgct

SEQ ID NO: 987187 - DNA, 22 bp, Artificial Sequence
  chemically synthesized
ctaaatggcctcagtgtgctct

SEQ ID NO: 987188 - DNA, 22 bp, Artificial Sequence
  chemically synthesized
taaatggcctcagtgtgctctc

SEQ ID NO: 987189 - DNA, 22 bp, Artificial Sequence
  chemically synthesized
ccattgagtaaagagagcacac

SEQ ID NO: 987190 - DNA, 22 bp, Artificial Sequence
  chemically synthesized
aatggcctcagtgtgctctctt

SEQ ID NO: 987191 - DNA, 22 bp, Artificial Sequence
  chemically synthesized
attgccattgagtaaagagagc

SEQ ID NO: 987192 - DNA, 22 bp, Artificial Sequence
  chemically synthesized
agtgtgctctctttactcaatg

SEQ ID NO: 987193 - DNA, 22 bp, Artificial Sequence
  chemically synthesized
tgcatactaattgccattgagt

SEQ ID NO: 987194 - DNA, 22 bp, Artificial Sequence
  chemically synthesized
gggttgtgcatactaattgcca

SEQ ID NO: 987195 - DNA, 22 bp, Artificial Sequence
  chemically synthesized
tctttactcaatggcaattagt

SEQ ID NO: 987196 - DNA, 22 bp, Artificial Sequence
  chemically synthesized
ggggttgtgcatactaattgcc

SEQ ID NO: 987197 - DNA, 22 bp, Artificial Sequence
  chemically synthesized
tttactcaatggcaattagtat

SEQ ID NO: 987198 - DNA, 22 bp, Artificial Sequence
  chemically synthesized
tactcaatggcaattagtatgc

SEQ ID NO: 987199 - DNA, 22 bp, Artificial Sequence
  chemically synthesized
actcaatggcaattagtatgca

SEQ ID NO: 987200 - DNA, 22 bp, Artificial Sequence
  chemically synthesized
ctcaatggcaattagtatgcac

SEQ ID NO: 987201 - DNA, 22 bp, Artificial Sequence
  chemically synthesized
caggtttggggttgtgcatact

SEQ ID NO: 987202 - DNA, 22 bp, Artificial Sequence
  chemically synthesized
aatggcaattagtatgcacaac

SEQ ID NO: 987203 - DNA, 22 bp, Artificial Sequence
  chemically synthesized
gtatgcacaaccccaaacctgc

SEQ ID NO: 987204 - DNA, 22 bp, Artificial Sequence
  chemically synthesized
ggaggcacagagagcaaaggag

SEQ ID NO: 987205 - DNA, 22 bp, Artificial Sequence
  chemically synthesized
caatttttattctcctttgctc

SEQ ID NO: 987206 - DNA, 22 bp, Artificial Sequence
  chemically synthesized
aggaggcacagagagcaaagga

SEQ ID NO: 987207 - DNA, 22 bp, Artificial Sequence
  chemically synthesized
taggaggcacagagagcaaagg

SEQ ID NO: 987208 - DNA, 22 bp, Artificial Sequence
  chemically synthesized
ttattctcctttgctctctgtg

SEQ ID NO: 987209 - DNA, 22 bp, Artificial Sequence
  chemically synthesized
tattctcctttgctctctgtgc

SEQ ID NO: 987210 - DNA, 22 bp, Artificial Sequence
  chemically synthesized
attctcctttgctctctgtgcc

SEQ ID NO: 987211 - DNA, 22 bp, Artificial Sequence
  chemically synthesized
ttctcctttgctctctgtgcct

SEQ ID NO: 987212 - DNA, 22 bp, Artificial Sequence
  chemically synthesized
tcctttgctctctgtgcctcct

SEQ ID NO: 987213 - DNA, 22 bp, Artificial Sequence
  chemically synthesized
ctttgctctctgtgcctcctaa

SEQ ID NO: 987214 - DNA, 22 bp, Artificial Sequence
  chemically synthesized
tgctctctgtgcctcctaaaac

SEQ ID NO: 987215 - DNA, 22 bp, Artificial Sequence
  chemically synthesized
gctctctgtgcctcctaaaaca

SEQ ID NO: 987216 - DNA, 22 bp, Artificial Sequence
  chemically synthesized
ctctctgtgcctcctaaaacat

SEQ ID NO: 987217 - DNA, 22 bp, Artificial Sequence
  chemically synthesized
aaaataggaataagatgtttta

SEQ ID NO: 987218 - DNA, 22 bp, Artificial Sequence
  chemically synthesized
tctgtgcctcctaaaacatctt

SEQ ID NO: 987219 - DNA, 22 bp, Artificial Sequence
  chemically synthesized
aaaaataggaataagatgtttt

SEQ ID NO: 987220 - DNA, 22 bp, Artificial Sequence
  chemically synthesized
taaaaataggaataagatgttt

SEQ ID NO: 987221 - DNA, 22 bp, Artificial Sequence
  chemically synthesized
tgtgcctcctaaaacatcttat

SEQ ID NO: 987222 - DNA, 22 bp, Artificial Sequence
  chemically synthesized
tttaaaaataggaataagatgt

SEQ ID NO: 987223 - DNA, 22 bp, Artificial Sequence
  chemically synthesized
tgcctcctaaaacatcttattc

SEQ ID NO: 987224 - DNA, 22 bp, Artificial Sequence
  chemically synthesized
ctaaaacatcttattcctattt

SEQ ID NO: 987225 - DNA, 22 bp, Artificial Sequence
  chemically synthesized
aaacatcttattcctattttta

SEQ ID NO: 987226 - DNA, 22 bp, Artificial Sequence
  chemically synthesized
aaaatagttctttaaaaatagg

SEQ ID NO: 987227 - DNA, 22 bp, Artificial Sequence
  chemically synthesized
aaaaatagttctttaaaaatag

SEQ ID NO: 987228 - DNA, 22 bp, Artificial Sequence
  chemically synthesized
taaaaatagttctttaaaaata

SEQ ID NO: 987229 - DNA, 22 bp, Artificial Sequence
  chemically synthesized
attcctatttttaaagaactat

SEQ ID NO: 987230 - DNA, 22 bp, Artificial Sequence
  chemically synthesized
ttcctatttttaaagaactatt

SEQ ID NO: 987231 - DNA, 22 bp, Artificial Sequence
  chemically synthesized
ctatttttaaagaactattttt

SEQ ID NO: 987232 - DNA, 22 bp, Artificial Sequence
  chemically synthesized
taaataaaattttaaaaatagt

SEQ ID NO: 987233 - DNA, 22 bp, Artificial Sequence
  chemically synthesized
ataaataaaattttaaaaatag

SEQ ID NO: 987234 - DNA, 22 bp, Artificial Sequence
  chemically synthesized
tttttaaagaactatttttaaa

SEQ ID NO: 987235 - DNA, 22 bp, Artificial Sequence
  chemically synthesized
ttataaataaaattttaaaaat

SEQ ID NO: 987236 - DNA, 22 bp, Artificial Sequence
  chemically synthesized
cttataaataaaattttaaaaa

SEQ ID NO: 987237 - DNA, 22 bp, Artificial Sequence
  chemically synthesized
ttaaagaactatttttaaaatt

SEQ ID NO: 987238 - DNA, 22 bp, Artificial Sequence
  chemically synthesized
tcttataaataaaattttaaaa

SEQ ID NO: 987239 - DNA, 22 bp, Artificial Sequence
  chemically synthesized
taaagaactatttttaaaattt

SEQ ID NO: 987240 - DNA, 22 bp, Artificial Sequence
  chemically synthesized
ttcttataaataaaattttaaa

SEQ ID NO: 987241 - DNA, 22 bp, Artificial Sequence
  chemically synthesized
aaagaactatttttaaaatttt

SEQ ID NO: 987242 - DNA, 22 bp, Artificial Sequence
  chemically synthesized
tttcttataaataaaattttaa

SEQ ID NO: 987243 - DNA, 22 bp, Artificial Sequence
  chemically synthesized
aagaactatttttaaaatttta

SEQ ID NO: 987244 - DNA, 22 bp, Artificial Sequence
  chemically synthesized
gattttttcttataaataaaat

SEQ ID NO: 987245 - DNA, 22 bp, Artificial Sequence
  chemically synthesized
tggattttttcttataaataaa

SEQ ID NO: 987246 - DNA, 22 bp, Artificial Sequence
  chemically synthesized
tttttaaaattttatttataag

SEQ ID NO: 987247 - DNA, 22 bp, Artificial Sequence
  chemically synthesized
ttaaaattttatttataagaaa

SEQ ID NO: 987248 - DNA, 22 bp, Artificial Sequence
  chemically synthesized
aattctggattttttcttataa

SEQ ID NO: 987249 - DNA, 22 bp, Artificial Sequence
  chemically synthesized
taaaattttatttataagaaaa

SEQ ID NO: 987250 - DNA, 22 bp, Artificial Sequence
  chemically synthesized
aaaattttatttataagaaaaa

SEQ ID NO: 987251 - DNA, 22 bp, Artificial Sequence
  chemically synthesized
aaattttatttataagaaaaaa

SEQ ID NO: 987252 - DNA, 22 bp, Artificial Sequence
  chemically synthesized
tattgaattctggattttttct

SEQ ID NO: 987253 - DNA, 22 bp, Artificial Sequence
  chemically synthesized
tatttataagaaaaaatccaga

SEQ ID NO: 987254 - DNA, 22 bp, Artificial Sequence
  chemically synthesized
atttataagaaaaaatccagaa

SEQ ID NO: 987255 - DNA, 22 bp, Artificial Sequence
  chemically synthesized
tattatattgaattctggattt

SEQ ID NO: 987256 - DNA, 22 bp, Artificial Sequence
  chemically synthesized
tttataagaaaaaatccagaat

SEQ ID NO: 987257 - DNA, 22 bp, Artificial Sequence
  chemically synthesized
tatattatattgaattctggat

SEQ ID NO: 987258 - DNA, 22 bp, Artificial Sequence
  chemically synthesized
ataagaaaaaatccagaattca

SEQ ID NO: 987259 - DNA, 22 bp, Artificial Sequence
  chemically synthesized
taagaaaaaatccagaattcaa

SEQ ID NO: 987260 - DNA, 22 bp, Artificial Sequence
  chemically synthesized
cactctatattatattgaattc

SEQ ID NO: 987261 - DNA, 22 bp, Artificial Sequence
  chemically synthesized
aatataatatagagtgcaacac

SEQ ID NO: 987262 - DNA, 22 bp, Artificial Sequence
  chemically synthesized
agaaaccatgcaagatcgtgtg

SEQ ID NO: 987263 - DNA, 22 bp, Artificial Sequence
  chemically synthesized
gagaaaccatgcaagatcgtgt

SEQ ID NO: 987264 - DNA, 22 bp, Artificial Sequence
  chemically synthesized
tttgagaaaccatgcaagatcg

SEQ ID NO: 987265 - DNA, 22 bp, Artificial Sequence
  chemically synthesized
ttatttgagaaaccatgcaaga

SEQ ID NO: 987266 - DNA, 22 bp, Artificial Sequence
  chemically synthesized
catgagtgtctattatttgaga

SEQ ID NO: 987267 - DNA, 22 bp, Artificial Sequence
  chemically synthesized
tacatgagtgtctattatttga

SEQ ID NO: 987268 - DNA, 22 bp, Artificial Sequence
  chemically synthesized
ctacatgagtgtctattatttg

SEQ ID NO: 987269 - DNA, 22 bp, Artificial Sequence
  chemically synthesized
gcatggtttctcaaataataga

SEQ ID NO: 987270 - DNA, 22 bp, Artificial Sequence
  chemically synthesized
tctacatgagtgtctattattt

SEQ ID NO: 987271 - DNA, 22 bp, Artificial Sequence
  chemically synthesized
catggtttctcaaataatagac

SEQ ID NO: 987272 - DNA, 22 bp, Artificial Sequence
  chemically synthesized
aggctttctacatgagtgtcta

SEQ ID NO: 987273 - DNA, 22 bp, Artificial Sequence
  chemically synthesized
ctcaaataatagacactcatgt

SEQ ID NO: 987274 - DNA, 22 bp, Artificial Sequence
  chemically synthesized
tcaaataatagacactcatgta

SEQ ID NO: 987275 - DNA, 22 bp, Artificial Sequence
  chemically synthesized
aaataatagacactcatgtaga

SEQ ID NO: 987276 - DNA, 22 bp, Artificial Sequence
  chemically synthesized
aaattaaggctttctacatgag

SEQ ID NO: 987277 - DNA, 22 bp, Artificial Sequence
  chemically synthesized
aattaaaattaaggctttctac

SEQ ID NO: 987278 - DNA, 22 bp, Artificial Sequence
  chemically synthesized
aaattaaaattaaggctttcta

SEQ ID NO: 987279 - DNA, 22 bp, Artificial Sequence
  chemically synthesized
taaattaaaattaaggctttct

SEQ ID NO: 987280 - DNA, 22 bp, Artificial Sequence
  chemically synthesized
ttaaattaaaattaaggctttc

SEQ ID NO: 987281 - DNA, 22 bp, Artificial Sequence
  chemically synthesized
atttttaaattaaaattaaggc

SEQ ID NO: 987282 - DNA, 22 bp, Artificial Sequence
  chemically synthesized
atgtagaaagccttaattttaa

SEQ ID NO: 987283 - DNA, 22 bp, Artificial Sequence
  chemically synthesized
cagagtgttaatttttaaatta

SEQ ID NO: 987284 - DNA, 22 bp, Artificial Sequence
  chemically synthesized
ccagagtgttaatttttaaatt

SEQ ID NO: 987285 - DNA, 22 bp, Artificial Sequence
  chemically synthesized
aattttaatttaaaaattaaca

SEQ ID NO: 987286 - DNA, 22 bp, Artificial Sequence
  chemically synthesized
attttaatttaaaaattaacac

SEQ ID NO: 987287 - DNA, 22 bp, Artificial Sequence
  chemically synthesized
tgtaacttccagagtgttaatt

SEQ ID NO: 987288 - DNA, 22 bp, Artificial Sequence
  chemically synthesized
gtgtaacttccagagtgttaat

SEQ ID NO: 987289 - DNA, 22 bp, Artificial Sequence
  chemically synthesized
taatttaaaaattaacactctg

SEQ ID NO: 987290 - DNA, 22 bp, Artificial Sequence
  chemically synthesized
ttgtgtaacttccagagtgtta

SEQ ID NO: 987291 - DNA, 22 bp, Artificial Sequence
  chemically synthesized
aatttaaaaattaacactctgg

SEQ ID NO: 987292 - DNA, 22 bp, Artificial Sequence
  chemically synthesized
cttgtgtaacttccagagtgtt

SEQ ID NO: 987293 - DNA, 22 bp, Artificial Sequence
  chemically synthesized
atttaaaaattaacactctgga

SEQ ID NO: 987294 - DNA, 22 bp, Artificial Sequence
  chemically synthesized
aaaaattaacactctggaagtt

SEQ ID NO: 987295 - DNA, 22 bp, Artificial Sequence
  chemically synthesized
aaaattaacactctggaagtta

SEQ ID NO: 987296 - DNA, 22 bp, Artificial Sequence
  chemically synthesized
acactctggaagttacacaaga

SEQ ID NO: 987297 - DNA, 22 bp, Artificial Sequence
  chemically synthesized
tggaagttacacaagaaatgat

SEQ ID NO: 987298 - DNA, 22 bp, Artificial Sequence
  chemically synthesized
gaagttacacaagaaatgatgg

SEQ ID NO: 987299 - DNA, 22 bp, Artificial Sequence
  chemically synthesized
acaaaaggccccaaggcccatc

SEQ ID NO: 987300 - DNA, 22 bp, Artificial Sequence
  chemically synthesized
cacaaaaggccccaaggcccat

SEQ ID NO: 987301 - DNA, 22 bp, Artificial Sequence
  chemically synthesized
cacaagaaatgatgggccttgg

SEQ ID NO: 987302 - DNA, 22 bp, Artificial Sequence
  chemically synthesized
tcacaaaaggccccaaggccca

SEQ ID NO: 987303 - DNA, 22 bp, Artificial Sequence
  chemically synthesized
ccattttcacaaaaggccccaa

SEQ ID NO: 987304 - DNA, 22 bp, Artificial Sequence
  chemically synthesized
gccattttcacaaaaggcccca

SEQ ID NO: 987305 - DNA, 22 bp, Artificial Sequence
  chemically synthesized
tcttgccattttcacaaaaggc

SEQ ID NO: 987306 - DNA, 22 bp, Artificial Sequence
  chemically synthesized
ttatcttgccattttcacaaaa

SEQ ID NO: 987307 - DNA, 22 bp, Artificial Sequence
  chemically synthesized
gttatcttgccattttcacaaa

SEQ ID NO: 987308 - DNA, 22 bp, Artificial Sequence
  chemically synthesized
ccttgttatcttgccattttca

SEQ ID NO: 987309 - DNA, 22 bp, Artificial Sequence
  chemically synthesized
ggggccttttgtgaaaatggca

SEQ ID NO: 987310 - DNA, 22 bp, Artificial Sequence
  chemically synthesized
gggccttttgtgaaaatggcaa

SEQ ID NO: 987311 - DNA, 22 bp, Artificial Sequence
  chemically synthesized
tcctgccttgttatcttgccat

SEQ ID NO: 987312 - DNA, 22 bp, Artificial Sequence
  chemically synthesized
gtcctgccttgttatcttgcca

SEQ ID NO: 987313 - DNA, 22 bp, Artificial Sequence
  chemically synthesized
ttgtcctgccttgttatcttgc

SEQ ID NO: 987314 - DNA, 22 bp, Artificial Sequence
  chemically synthesized
ttgtgaaaatggcaagataaca

SEQ ID NO: 987315 - DNA, 22 bp, Artificial Sequence
  chemically synthesized
tgtgaaaatggcaagataacaa

SEQ ID NO: 987316 - DNA, 22 bp, Artificial Sequence
  chemically synthesized
tcttgtcctgccttgttatctt

SEQ ID NO: 987317 - DNA, 22 bp, Artificial Sequence
  chemically synthesized
gtgaaaatggcaagataacaag

SEQ ID NO: 987318 - DNA, 22 bp, Artificial Sequence
  chemically synthesized
tgaaaatggcaagataacaagg

SEQ ID NO: 987319 - DNA, 22 bp, Artificial Sequence
  chemically synthesized
catctctcttgtcctgccttgt

SEQ ID NO: 987320 - DNA, 22 bp, Artificial Sequence
  chemically synthesized
tctccatctctcttgtcctgcc

SEQ ID NO: 987321 - DNA, 22 bp, Artificial Sequence
  chemically synthesized
ttatctccatctctcttgtcct

SEQ ID NO: 987322 - DNA, 22 bp, Artificial Sequence
  chemically synthesized
tgtctgttatctccatctctct

SEQ ID NO: 987323 - DNA, 22 bp, Artificial Sequence
  chemically synthesized
attgtgtctgttatctccatct

SEQ ID NO: 987324 - DNA, 22 bp, Artificial Sequence
  chemically synthesized
atacatattcattgtgtctgtt

SEQ ID NO: 987325 - DNA, 22 bp, Artificial Sequence
  chemically synthesized
tagaaaaaagaatgaacgtatc

SEQ ID NO: 987326 - DNA, 22 bp, Artificial Sequence
  chemically synthesized
gtagaaaaaagaatgaacgtat

SEQ ID NO: 987327 - DNA, 22 bp, Artificial Sequence
  chemically synthesized
tttgtagaaaaaagaatgaacg

SEQ ID NO: 987328 - DNA, 22 bp, Artificial Sequence
  chemically synthesized
cgttgatacgttcattcttttt

SEQ ID NO: 987329 - DNA, 22 bp, Artificial Sequence
  chemically synthesized
gttgatacgttcattctttttt

SEQ ID NO: 987330 - DNA, 22 bp, Artificial Sequence
  chemically synthesized
aatgtctatttgtagaaaaaag

SEQ ID NO: 987331 - DNA, 22 bp, Artificial Sequence
  chemically synthesized
atacgttcattcttttttctac

SEQ ID NO: 987332 - DNA, 22 bp, Artificial Sequence
  chemically synthesized
attcttttttctacaaatagac

SEQ ID NO: 987333 - DNA, 22 bp, Artificial Sequence
  chemically synthesized
ttttttctacaaatagacattg

SEQ ID NO: 987334 - DNA, 22 bp, Artificial Sequence
  chemically synthesized
ttttctacaaatagacattgag

SEQ ID NO: 987335 - DNA, 22 bp, Artificial Sequence
  chemically synthesized
tttctacaaatagacattgagg

SEQ ID NO: 987336 - DNA, 22 bp, Artificial Sequence
  chemically synthesized
ttctacaaatagacattgaggg

SEQ ID NO: 987337 - DNA, 22 bp, Artificial Sequence
  chemically synthesized
tctacaaatagacattgagggc

SEQ ID NO: 987338 - DNA, 22 bp, Artificial Sequence
  chemically synthesized
ctacaaatagacattgagggct

SEQ ID NO: 987339 - DNA, 22 bp, Artificial Sequence
  chemically synthesized
tacaaatagacattgagggctc

SEQ ID NO: 987340 - DNA, 22 bp, Artificial Sequence
  chemically synthesized
caaatagacattgagggctcac

SEQ ID NO: 987341 - DNA, 22 bp, Artificial Sequence
  chemically synthesized
agggctcactatatcccttgcg

SEQ ID NO: 987342 - DNA, 22 bp, Artificial Sequence
  chemically synthesized
actatatcccttgcgctgctac

SEQ ID NO: 987343 - DNA, 22 bp, Artificial Sequence
  chemically synthesized
tatcccttgcgctgctacacac

SEQ ID NO: 987344 - DNA, 22 bp, Artificial Sequence
  chemically synthesized
catcagcatatcccccgtgtgt

SEQ ID NO: 987345 - DNA, 22 bp, Artificial Sequence
  chemically synthesized
gcatcagcatatcccccgtgtg

SEQ ID NO: 987346 - DNA, 22 bp, Artificial Sequence
  chemically synthesized
gcgctgctacacacgggggata

SEQ ID NO: 987347 - DNA, 22 bp, Artificial Sequence
  chemically synthesized
cgctgctacacacgggggatat

SEQ ID NO: 987348 - DNA, 22 bp, Artificial Sequence
  chemically synthesized
ctacacacgggggatatgctga

SEQ ID NO: 987349 - DNA, 22 bp, Artificial Sequence
  chemically synthesized
ccagtgtttgcatcagcatatc

SEQ ID NO: 987350 - DNA, 22 bp, Artificial Sequence
  chemically synthesized
cacacgggggatatgctgatgc

SEQ ID NO: 987351 - DNA, 22 bp, Artificial Sequence
  chemically synthesized
atgcaaacactggcaacatacc

SEQ ID NO: 987352 - DNA, 22 bp, Artificial Sequence
  chemically synthesized
tgatgtaagcaccatgaaggaa

SEQ ID NO: 987353 - DNA, 22 bp, Artificial Sequence
  chemically synthesized
gcaacataccttccttcatggt

SEQ ID NO: 987354 - DNA, 22 bp, Artificial Sequence
  chemically synthesized
caattatgatgtaagcaccatg

SEQ ID NO: 987355 - DNA, 22 bp, Artificial Sequence
  chemically synthesized
agtctgcaattatgatgtaagc

SEQ ID NO: 987356 - DNA, 22 bp, Artificial Sequence
  chemically synthesized
ccttcatggtgcttacatcata

SEQ ID NO: 987357 - DNA, 22 bp, Artificial Sequence
  chemically synthesized
cttcatggtgcttacatcataa

SEQ ID NO: 987358 - DNA, 22 bp, Artificial Sequence
  chemically synthesized
tctgagtctgcaattatgatgt

SEQ ID NO: 987359 - DNA, 22 bp, Artificial Sequence
  chemically synthesized
gtctgagtctgcaattatgatg

SEQ ID NO: 987360 - DNA, 22 bp, Artificial Sequence
  chemically synthesized
catggtgcttacatcataattg

SEQ ID NO: 987361 - DNA, 22 bp, Artificial Sequence
  chemically synthesized
tgtctgagtctgcaattatgat

SEQ ID NO: 987362 - DNA, 22 bp, Artificial Sequence
  chemically synthesized
atggtgcttacatcataattgc

SEQ ID NO: 987363 - DNA, 22 bp, Artificial Sequence
  chemically synthesized
ttgtctgagtctgcaattatga

SEQ ID NO: 987364 - DNA, 22 bp, Artificial Sequence
  chemically synthesized
tttttgtctgagtctgcaatta

SEQ ID NO: 987365 - DNA, 22 bp, Artificial Sequence
  chemically synthesized
gtttttgtctgagtctgcaatt

SEQ ID NO: 987366 - DNA, 22 bp, Artificial Sequence
  chemically synthesized
ccttgtttttgtctgagtctgc

SEQ ID NO: 987367 - DNA, 22 bp, Artificial Sequence
  chemically synthesized
acatcataattgcagactcaga

SEQ ID NO: 987368 - DNA, 22 bp, Artificial Sequence
  chemically synthesized
catcataattgcagactcagac

SEQ ID NO: 987369 - DNA, 22 bp, Artificial Sequence
  chemically synthesized
ctgccttgtttttgtctgagtc

SEQ ID NO: 987370 - DNA, 22 bp, Artificial Sequence
  chemically synthesized
cctgccttgtttttgtctgagt

SEQ ID NO: 987371 - DNA, 22 bp, Artificial Sequence
  chemically synthesized
tttcctgccttgtttttgtctg

SEQ ID NO: 987372 - DNA, 22 bp, Artificial Sequence
  chemically synthesized
tgtttcctgccttgtttttgtc

SEQ ID NO: 987373 - DNA, 22 bp, Artificial Sequence
  chemically synthesized
ctgtttcctgccttgtttttgt

SEQ ID NO: 987374 - DNA, 22 bp, Artificial Sequence
  chemically synthesized
cagactcagacaaaaacaaggc

SEQ ID NO: 987375 - DNA, 22 bp, Artificial Sequence
  chemically synthesized
tttctgtttcctgccttgtttt

SEQ ID NO: 987376 - DNA, 22 bp, Artificial Sequence
  chemically synthesized
gtttctgtttcctgccttgttt

SEQ ID NO: 987377 - DNA, 22 bp, Artificial Sequence
  chemically synthesized
cttgtttctgtttcctgccttg

SEQ ID NO: 987378 - DNA, 22 bp, Artificial Sequence
  chemically synthesized
agacaaaaacaaggcaggaaac

SEQ ID NO: 987379 - DNA, 22 bp, Artificial Sequence
  chemically synthesized
agctccttgtttctgtttcctg

SEQ ID NO: 987380 - DNA, 22 bp, Artificial Sequence
  chemically synthesized
tagctcagctccttgtttctgt

SEQ ID NO: 987381 - DNA, 22 bp, Artificial Sequence
  chemically synthesized
tatagctcagctccttgtttct

SEQ ID NO: 987382 - DNA, 22 bp, Artificial Sequence
  chemically synthesized
ttctatagctcagctccttgtt

SEQ ID NO: 987383 - DNA, 22 bp, Artificial Sequence
  chemically synthesized
acattattctatagctcagctc

SEQ ID NO: 987384 - DNA, 22 bp, Artificial Sequence
  chemically synthesized
taacattattctatagctcagc

SEQ ID NO: 987385 - DNA, 22 bp, Artificial Sequence
  chemically synthesized
caccatcctctaacattattct

SEQ ID NO: 987386 - DNA, 22 bp, Artificial Sequence
  chemically synthesized
gcaccatcctctaacattattc

SEQ ID NO: 987387 - DNA, 22 bp, Artificial Sequence
  chemically synthesized
agctatagaataatgttagagg

SEQ ID NO: 987388 - DNA, 22 bp, Artificial Sequence
  chemically synthesized
ccccccttgcaccatcctctaa

SEQ ID NO: 987389 - DNA, 22 bp, Artificial Sequence
  chemically synthesized
tagaataatgttagaggatggt

SEQ ID NO: 987390 - DNA, 22 bp, Artificial Sequence
  chemically synthesized
tctaccccccttgcaccatcct

SEQ ID NO: 987391 - DNA, 22 bp, Artificial Sequence
  chemically synthesized
gagagggctgtctacccccctt

SEQ ID NO: 987392 - DNA, 22 bp, Artificial Sequence
  chemically synthesized
gaggatggtgcaaggggggtag

SEQ ID NO: 987393 - DNA, 22 bp, Artificial Sequence
  chemically synthesized
caaggagagtcctggagagggc

SEQ ID NO: 987394 - DNA, 22 bp, Artificial Sequence
  chemically synthesized
tccaaggagagtcctggagagg

SEQ ID NO: 987395 - DNA, 22 bp, Artificial Sequence
  chemically synthesized
ggtaggtaatcctctccaagga

SEQ ID NO: 987396 - DNA, 22 bp, Artificial Sequence
  chemically synthesized
gggtaggtaatcctctccaagg

SEQ ID NO: 987397 - DNA, 22 bp, Artificial Sequence
  chemically synthesized
tccaggactctccttggagagg

SEQ ID NO: 987398 - DNA, 22 bp, Artificial Sequence
  chemically synthesized
tgggtaggtaatcctctccaag

SEQ ID NO: 987399 - DNA, 22 bp, Artificial Sequence
  chemically synthesized
caggactctccttggagaggat

SEQ ID NO: 987400 - DNA, 22 bp, Artificial Sequence
  chemically synthesized
agggctttgggtaggtaatcct

SEQ ID NO: 987401 - DNA, 22 bp, Artificial Sequence
  chemically synthesized
tccttggagaggattacctacc

SEQ ID NO: 987402 - DNA, 22 bp, Artificial Sequence
  chemically synthesized
cttggagaggattacctaccca

SEQ ID NO: 987403 - DNA, 22 bp, Artificial Sequence
  chemically synthesized
ggagaggattacctacccaaag

SEQ ID NO: 987404 - DNA, 22 bp, Artificial Sequence
  chemically synthesized
gagaggattacctacccaaagc

SEQ ID NO: 987405 - DNA, 22 bp, Artificial Sequence
  chemically synthesized
tatagcctcagggctttgggta

SEQ ID NO: 987406 - DNA, 22 bp, Artificial Sequence
  chemically synthesized
tatatagcctcagggctttggg

SEQ ID NO: 987407 - DNA, 22 bp, Artificial Sequence
  chemically synthesized
ctatatagcctcagggctttgg

SEQ ID NO: 987408 - DNA, 22 bp, Artificial Sequence
  chemically synthesized
cctacccaaagccctgaggcta

SEQ ID NO: 987409 - DNA, 22 bp, Artificial Sequence
  chemically synthesized
cccaaagccctgaggctatata

SEQ ID NO: 987410 - DNA, 22 bp, Artificial Sequence
  chemically synthesized
caatcgtgtcttctatatagcc

SEQ ID NO: 987411 - DNA, 22 bp, Artificial Sequence
  chemically synthesized
tgcaatcgtgtcttctatatag

SEQ ID NO: 987412 - DNA, 22 bp, Artificial Sequence
  chemically synthesized
ctctgcaatcgtgtcttctata

SEQ ID NO: 987413 - DNA, 22 bp, Artificial Sequence
  chemically synthesized
aggctatatagaagacacgatt

SEQ ID NO: 987414 - DNA, 22 bp, Artificial Sequence
  chemically synthesized
tatagaagacacgattgcagag

SEQ ID NO: 987415 - DNA, 22 bp, Artificial Sequence
  chemically synthesized
gagtagacatcctcctctgcaa

SEQ ID NO: 987416 - DNA, 22 bp, Artificial Sequence
  chemically synthesized
tggagtagacatcctcctctgc

SEQ ID NO: 987417 - DNA, 22 bp, Artificial Sequence
  chemically synthesized
tctggagtagacatcctcctct

SEQ ID NO: 987418 - DNA, 22 bp, Artificial Sequence
  chemically synthesized
cagaggaggatgtctactccag

SEQ ID NO: 987419 - DNA, 22 bp, Artificial Sequence
  chemically synthesized
cagagtgtctctctggagtaga

SEQ ID NO: 987420 - DNA, 22 bp, Artificial Sequence
  chemically synthesized
gcagagtgtctctctggagtag

SEQ ID NO: 987421 - DNA, 22 bp, Artificial Sequence
  chemically synthesized
atacaatttgcagagtgtctct

SEQ ID NO: 987422 - DNA, 22 bp, Artificial Sequence
  chemically synthesized
aatacaatttgcagagtgtctc

SEQ ID NO: 987423 - DNA, 22 bp, Artificial Sequence
  chemically synthesized
taatacaatttgcagagtgtct

SEQ ID NO: 987424 - DNA, 22 bp, Artificial Sequence
  chemically synthesized
ctccagagagacactctgcaaa

SEQ ID NO: 987425 - DNA, 22 bp, Artificial Sequence
  chemically synthesized
cagagagacactctgcaaattg

SEQ ID NO: 987426 - DNA, 22 bp, Artificial Sequence
  chemically synthesized
atgtgggaagttttaatacaat

SEQ ID NO: 987427 - DNA, 22 bp, Artificial Sequence
  chemically synthesized
gatgtgggaagttttaatacaa

SEQ ID NO: 987428 - DNA, 22 bp, Artificial Sequence
  chemically synthesized
tgcaaattgtattaaaacttcc

SEQ ID NO: 987429 - DNA, 22 bp, Artificial Sequence
  chemically synthesized
caaattgtattaaaacttccca

SEQ ID NO: 987430 - DNA, 22 bp, Artificial Sequence
  chemically synthesized
tattaaaacttcccacatcaag

SEQ ID NO: 987431 - DNA, 22 bp, Artificial Sequence
  chemically synthesized
aaacttcccacatcaaggggga

SEQ ID NO: 987432 - DNA, 22 bp, Artificial Sequence
  chemically synthesized
cccacatcaagggggatttgct

SEQ ID NO: 987433 - DNA, 22 bp, Artificial Sequence
  chemically synthesized
ccacatcaagggggatttgctg

SEQ ID NO: 987434 - DNA, 22 bp, Artificial Sequence
  chemically synthesized
aaacaaaaggagagtcagcaaa

SEQ ID NO: 987435 - DNA, 22 bp, Artificial Sequence
  chemically synthesized
acaatattcaaacaaaaggaga

SEQ ID NO: 987436 - DNA, 22 bp, Artificial Sequence
  chemically synthesized
tgacaatattcaaacaaaagga

SEQ ID NO: 987437 - DNA, 22 bp, Artificial Sequence
  chemically synthesized
ctgacaatattcaaacaaaagg

SEQ ID NO: 987438 - DNA, 22 bp, Artificial Sequence
  chemically synthesized
gctgactctccttttgtttgaa

SEQ ID NO: 987439 - DNA, 22 bp, Artificial Sequence
  chemically synthesized
ctgactctccttttgtttgaat

SEQ ID NO: 987440 - DNA, 22 bp, Artificial Sequence
  chemically synthesized
actctccttttgtttgaatatt

SEQ ID NO: 987441 - DNA, 22 bp, Artificial Sequence
  chemically synthesized
tgtagtcttctgacaatattca

SEQ ID NO: 987442 - DNA, 22 bp, Artificial Sequence
  chemically synthesized
tccttttgtttgaatattgtca

SEQ ID NO: 987443 - DNA, 22 bp, Artificial Sequence
  chemically synthesized
ctatgtagtcttctgacaatat

SEQ ID NO: 987444 - DNA, 22 bp, Artificial Sequence
  chemically synthesized
cttttgtttgaatattgtcaga

SEQ ID NO: 987445 - DNA, 22 bp, Artificial Sequence
  chemically synthesized
cctatgtagtcttctgacaata

SEQ ID NO: 987446 - DNA, 22 bp, Artificial Sequence
  chemically synthesized
ttgtttgaatattgtcagaaga

SEQ ID NO: 987447 - DNA, 22 bp, Artificial Sequence
  chemically synthesized
tgtttgaatattgtcagaagac

SEQ ID NO: 987448 - DNA, 22 bp, Artificial Sequence
  chemically synthesized
gtttgaatattgtcagaagact

SEQ ID NO: 987449 - DNA, 22 bp, Artificial Sequence
  chemically synthesized
tttgaatattgtcagaagacta

SEQ ID NO: 987450 - DNA, 22 bp, Artificial Sequence
  chemically synthesized
gaatattgtcagaagactacat

SEQ ID NO: 987451 - DNA, 22 bp, Artificial Sequence
  chemically synthesized
aatattgtcagaagactacata

SEQ ID NO: 987452 - DNA, 22 bp, Artificial Sequence
  chemically synthesized
tcagaagactacataggaaatg

SEQ ID NO: 987453 - DNA, 22 bp, Artificial Sequence
  chemically synthesized
gtgaggaaggatggaccatttc

SEQ ID NO: 987454 - DNA, 22 bp, Artificial Sequence
  chemically synthesized
cataggaaatggtccatccttc

SEQ ID NO: 987455 - DNA, 22 bp, Artificial Sequence
  chemically synthesized
agaggatggaagggccgtaaag

SEQ ID NO: 987456 - DNA, 22 bp, Artificial Sequence
  chemically synthesized
cctcaccaacctttacggccct

SEQ ID NO: 987457 - DNA, 22 bp, Artificial Sequence
  chemically synthesized
tcagaggatggaagggccgtaa

SEQ ID NO: 987458 - DNA, 22 bp, Artificial Sequence
  chemically synthesized
ctcaccaacctttacggccctt

SEQ ID NO: 987459 - DNA, 22 bp, Artificial Sequence
  chemically synthesized
ctcagaggatggaagggccgta

SEQ ID NO: 987460 - DNA, 22 bp, Artificial Sequence
  chemically synthesized
tctcagaggatggaagggccgt

SEQ ID NO: 987461 - DNA, 22 bp, Artificial Sequence
  chemically synthesized
ttctcagaggatggaagggccg

SEQ ID NO: 987462 - DNA, 22 bp, Artificial Sequence
  chemically synthesized
accaacctttacggcccttcca

SEQ ID NO: 987463 - DNA, 22 bp, Artificial Sequence
  chemically synthesized
tttctcagaggatggaagggcc

SEQ ID NO: 987464 - DNA, 22 bp, Artificial Sequence
  chemically synthesized
tttttctcagaggatggaaggg

SEQ ID NO: 987465 - DNA, 22 bp, Artificial Sequence
  chemically synthesized
tctttttctcagaggatggaag

SEQ ID NO: 987466 - DNA, 22 bp, Artificial Sequence
  chemically synthesized
tacggcccttccatcctctgag

SEQ ID NO: 987467 - DNA, 22 bp, Artificial Sequence
  chemically synthesized
acggcccttccatcctctgaga

SEQ ID NO: 987468 - DNA, 22 bp, Artificial Sequence
  chemically synthesized
cggcccttccatcctctgagaa

SEQ ID NO: 987469 - DNA, 22 bp, Artificial Sequence
  chemically synthesized
tcaaaacctctctttttctcag

SEQ ID NO: 987470 - DNA, 22 bp, Artificial Sequence
  chemically synthesized
gtcaaaacctctctttttctca

SEQ ID NO: 987471 - DNA, 22 bp, Artificial Sequence
  chemically synthesized
tgtcaaaacctctctttttctc

SEQ ID NO: 987472 - DNA, 22 bp, Artificial Sequence
  chemically synthesized
ccatcctctgagaaaaagagag

SEQ ID NO: 987473 - DNA, 22 bp, Artificial Sequence
  chemically synthesized
catcctctgagaaaaagagagg

SEQ ID NO: 987474 - DNA, 22 bp, Artificial Sequence
  chemically synthesized
aagccctttgtcaaaacctctc

SEQ ID NO: 987475 - DNA, 22 bp, Artificial Sequence
  chemically synthesized
aaagccctttgtcaaaacctct

SEQ ID NO: 987476 - DNA, 22 bp, Artificial Sequence
  chemically synthesized
taaagccctttgtcaaaacctc

SEQ ID NO: 987477 - DNA, 22 bp, Artificial Sequence
  chemically synthesized
tgagaaaaagagaggttttgac

SEQ ID NO: 987478 - DNA, 22 bp, Artificial Sequence
  chemically synthesized
agaaaaagagaggttttgacaa

SEQ ID NO: 987479 - DNA, 22 bp, Artificial Sequence
  chemically synthesized
tgacaaagggctttaaagtttc

SEQ ID NO: 987480 - DNA, 22 bp, Artificial Sequence
  chemically synthesized
gacaaagggctttaaagtttca

SEQ ID NO: 987481 - DNA, 22 bp, Artificial Sequence
  chemically synthesized
acaaagggctttaaagtttcat

SEQ ID NO: 987482 - DNA, 22 bp, Artificial Sequence
  chemically synthesized
agcaagtgcaagtaaaacaatg

SEQ ID NO: 987483 - DNA, 22 bp, Artificial Sequence
  chemically synthesized
taaagtttcattgttttacttg

SEQ ID NO: 987484 - DNA, 22 bp, Artificial Sequence
  chemically synthesized
aaagtttcattgttttacttgc

SEQ ID NO: 987485 - DNA, 22 bp, Artificial Sequence
  chemically synthesized
aagtttcattgttttacttgca

SEQ ID NO: 987486 - DNA, 22 bp, Artificial Sequence
  chemically synthesized
cattgttttacttgcacttgct

SEQ ID NO: 987487 - DNA, 22 bp, Artificial Sequence
  chemically synthesized
attgttttacttgcacttgctg

SEQ ID NO: 987488 - DNA, 22 bp, Artificial Sequence
  chemically synthesized
ttttacttgcacttgctgagtc

SEQ ID NO: 987489 - DNA, 22 bp, Artificial Sequence
  chemically synthesized
tacttgcacttgctgagtcccc

SEQ ID NO: 987490 - DNA, 22 bp, Artificial Sequence
  chemically synthesized
acttgcacttgctgagtcccct

SEQ ID NO: 987491 - DNA, 22 bp, Artificial Sequence
  chemically synthesized
cttgcacttgctgagtcccctt

SEQ ID NO: 987492 - DNA, 22 bp, Artificial Sequence
  chemically synthesized
gcacttgctgagtccccttggg

SEQ ID NO: 987493 - DNA, 22 bp, Artificial Sequence
  chemically synthesized
cacttgctgagtccccttgggg

SEQ ID NO: 987494 - DNA, 22 bp, Artificial Sequence
  chemically synthesized
gctgagtccccttggggatttt

SEQ ID NO: 987495 - DNA, 22 bp, Artificial Sequence
  chemically synthesized
ctgagtccccttggggatttta

SEQ ID NO: 987496 - DNA, 22 bp, Artificial Sequence
  chemically synthesized
agtccccttggggattttatct

SEQ ID NO: 987497 - DNA, 22 bp, Artificial Sequence
  chemically synthesized
tgagatggatagtgtagataaa

SEQ ID NO: 987498 - DNA, 22 bp, Artificial Sequence
  chemically synthesized
tgtgagatggatagtgtagata

SEQ ID NO: 987499 - DNA, 22 bp, Artificial Sequence
  chemically synthesized
ctgtgagatggatagtgtagat

SEQ ID NO: 987500 - DNA, 22 bp, Artificial Sequence
  chemically synthesized
tctgtgagatggatagtgtaga

SEQ ID NO: 987501 - DNA, 22 bp, Artificial Sequence
  chemically synthesized
ttctgtgagatggatagtgtag

SEQ ID NO: 987502 - DNA, 22 bp, Artificial Sequence
  chemically synthesized
ggggattttatctacactatcc

SEQ ID NO: 987503 - DNA, 22 bp, Artificial Sequence
  chemically synthesized
gggattttatctacactatcca

SEQ ID NO: 987504 - DNA, 22 bp, Artificial Sequence
  chemically synthesized
gacttttctgtgagatggatag

SEQ ID NO: 987505 - DNA, 22 bp, Artificial Sequence
  chemically synthesized
tcgacttttctgtgagatggat

SEQ ID NO: 987506 - DNA, 22 bp, Artificial Sequence
  chemically synthesized
tatctacactatccatctcaca

SEQ ID NO: 987507 - DNA, 22 bp, Artificial Sequence
  chemically synthesized
atctacactatccatctcacag

SEQ ID NO: 987508 - DNA, 22 bp, Artificial Sequence
  chemically synthesized
tctacactatccatctcacaga

SEQ ID NO: 987509 - DNA, 22 bp, Artificial Sequence
  chemically synthesized
atgctctcgacttttctgtgag

SEQ ID NO: 987510 - DNA, 22 bp, Artificial Sequence
  chemically synthesized
aatgctctcgacttttctgtga

SEQ ID NO: 987511 - DNA, 22 bp, Artificial Sequence
  chemically synthesized
cactatccatctcacagaaaag

SEQ ID NO: 987512 - DNA, 22 bp, Artificial Sequence
  chemically synthesized
cttaatgctctcgacttttctg

SEQ ID NO: 987513 - DNA, 22 bp, Artificial Sequence
  chemically synthesized
gcttaatgctctcgacttttct

SEQ ID NO: 987514 - DNA, 22 bp, Artificial Sequence
  chemically synthesized
tgcttaatgctctcgacttttc

SEQ ID NO: 987515 - DNA, 22 bp, Artificial Sequence
  chemically synthesized
tccatctcacagaaaagtcgag

SEQ ID NO: 987516 - DNA, 22 bp, Artificial Sequence
  chemically synthesized
ctttgcttaatgctctcgactt

SEQ ID NO: 987517 - DNA, 22 bp, Artificial Sequence
  chemically synthesized
acagaaaagtcgagagcattaa

SEQ ID NO: 987518 - DNA, 22 bp, Artificial Sequence
  chemically synthesized
accgttactttgcttaatgctc

SEQ ID NO: 987519 - DNA, 22 bp, Artificial Sequence
  chemically synthesized
aaccgttactttgcttaatgct

SEQ ID NO: 987520 - DNA, 22 bp, Artificial Sequence
  chemically synthesized
ttaaccgttactttgcttaatg

SEQ ID NO: 987521 - DNA, 22 bp, Artificial Sequence
  chemically synthesized
agtgcatattcttaaccgttac

SEQ ID NO: 987522 - DNA, 22 bp, Artificial Sequence
  chemically synthesized
agcaaagtaacggttaagaata

SEQ ID NO: 987523 - DNA, 22 bp, Artificial Sequence
  chemically synthesized
atgaagaagggatgatattcag

SEQ ID NO: 987524 - DNA, 22 bp, Artificial Sequence
  chemically synthesized
agaatatgcactgaatatcatc

SEQ ID NO: 987525 - DNA, 22 bp, Artificial Sequence
  chemically synthesized
tgttaatgaagaagggatgata

SEQ ID NO: 987526 - DNA, 22 bp, Artificial Sequence
  chemically synthesized
aatatcatcccttcttcattaa

SEQ ID NO: 987527 - DNA, 22 bp, Artificial Sequence
  chemically synthesized
taatgtcctgtgttaatgaaga

SEQ ID NO: 987528 - DNA, 22 bp, Artificial Sequence
  chemically synthesized
aaattataatgtcctgtgttaa

SEQ ID NO: 987529 - DNA, 22 bp, Artificial Sequence
  chemically synthesized
aaaattataatgtcctgtgtta

SEQ ID NO: 987530 - DNA, 22 bp, Artificial Sequence
  chemically synthesized
taaaattataatgtcctgtgtt

SEQ ID NO: 987531 - DNA, 22 bp, Artificial Sequence
  chemically synthesized
cttcattaacacaggacattat

SEQ ID NO: 987532 - DNA, 22 bp, Artificial Sequence
  chemically synthesized
ttcattaacacaggacattata

SEQ ID NO: 987533 - DNA, 22 bp, Artificial Sequence
  chemically synthesized
cattaacacaggacattataat

SEQ ID NO: 987534 - DNA, 22 bp, Artificial Sequence
  chemically synthesized
attaacacaggacattataatt

SEQ ID NO: 987535 - DNA, 22 bp, Artificial Sequence
  chemically synthesized
gtcagatgttttaaaattataa

SEQ ID NO: 987536 - DNA, 22 bp, Artificial Sequence
  chemically synthesized
agtcagatgttttaaaattata

SEQ ID NO: 987537 - DNA, 22 bp, Artificial Sequence
  chemically synthesized
acacaggacattataattttaa

SEQ ID NO: 987538 - DNA, 22 bp, Artificial Sequence
  chemically synthesized
tcatggacttagtcagatgttt

SEQ ID NO: 987539 - DNA, 22 bp, Artificial Sequence
  chemically synthesized
taattttaaaacatctgactaa

SEQ ID NO: 987540 - DNA, 22 bp, Artificial Sequence
  chemically synthesized
catattatcatggacttagtca

SEQ ID NO: 987541 - DNA, 22 bp, Artificial Sequence
  chemically synthesized
taaaacatctgactaagtccat

SEQ ID NO: 987542 - DNA, 22 bp, Artificial Sequence
  chemically synthesized
aaaacatctgactaagtccatg

SEQ ID NO: 987543 - DNA, 22 bp, Artificial Sequence
  chemically synthesized
aaacatctgactaagtccatga

SEQ ID NO: 987544 - DNA, 22 bp, Artificial Sequence
  chemically synthesized
actaagtccatgataatatgga

SEQ ID NO: 987545 - DNA, 22 bp, Artificial Sequence
  chemically synthesized
agtccatgataatatggaacca

SEQ ID NO: 987546 - DNA, 22 bp, Artificial Sequence
  chemically synthesized
tgcagagaaggataggaatggt

SEQ ID NO: 987547 - DNA, 22 bp, Artificial Sequence
  chemically synthesized
gtgcagagaaggataggaatgg

SEQ ID NO: 987548 - DNA, 22 bp, Artificial Sequence
  chemically synthesized
tgtgcagagaaggataggaatg

SEQ ID NO: 987549 - DNA, 22 bp, Artificial Sequence
  chemically synthesized
ctttgtgcagagaaggatagga

SEQ ID NO: 987550 - DNA, 22 bp, Artificial Sequence
  chemically synthesized
ctcctttgtgcagagaaggata

SEQ ID NO: 987551 - DNA, 22 bp, Artificial Sequence
  chemically synthesized
tcctcctttgtgcagagaagga

SEQ ID NO: 987552 - DNA, 22 bp, Artificial Sequence
  chemically synthesized
ctcctcctttgtgcagagaagg

SEQ ID NO: 987553 - DNA, 22 bp, Artificial Sequence
  chemically synthesized
ctatccttctctgcacaaagga

SEQ ID NO: 987554 - DNA, 22 bp, Artificial Sequence
  chemically synthesized
tccttctctgcacaaaggagga

SEQ ID NO: 987555 - DNA, 22 bp, Artificial Sequence
  chemically synthesized
tacagatatttctcctcctttg

SEQ ID NO: 987556 - DNA, 22 bp, Artificial Sequence
  chemically synthesized
ctctgcacaaaggaggagaaat

SEQ ID NO: 987557 - DNA, 22 bp, Artificial Sequence
  chemically synthesized
tctgcacaaaggaggagaaata

SEQ ID NO: 987558 - DNA, 22 bp, Artificial Sequence
  chemically synthesized
tgcacaaaggaggagaaatatc

SEQ ID NO: 987559 - DNA, 22 bp, Artificial Sequence
  chemically synthesized
aaagactgtacagatatttctc

SEQ ID NO: 987560 - DNA, 22 bp, Artificial Sequence
  chemically synthesized
cacaaaggaggagaaatatctg

SEQ ID NO: 987561 - DNA, 22 bp, Artificial Sequence
  chemically synthesized
agttcaaagactgtacagatat

SEQ ID NO: 987562 - DNA, 22 bp, Artificial Sequence
  chemically synthesized
actaagttcaaagactgtacag

SEQ ID NO: 987563 - DNA, 22 bp, Artificial Sequence
  chemically synthesized
agacccatatctaactaagttc

SEQ ID NO: 987564 - DNA, 22 bp, Artificial Sequence
  chemically synthesized
tacagtctttgaacttagttag

SEQ ID NO: 987565 - DNA, 22 bp, Artificial Sequence
  chemically synthesized
aaattcagacccatatctaact

SEQ ID NO: 987566 - DNA, 22 bp, Artificial Sequence
  chemically synthesized
tgaacttagttagatatgggtc

SEQ ID NO: 987567 - DNA, 22 bp, Artificial Sequence
  chemically synthesized
gaacttagttagatatgggtct

SEQ ID NO: 987568 - DNA, 22 bp, Artificial Sequence
  chemically synthesized
aacttagttagatatgggtctg

SEQ ID NO: 987569 - DNA, 22 bp, Artificial Sequence
  chemically synthesized
agttagatatgggtctgaattt

SEQ ID NO: 987570 - DNA, 22 bp, Artificial Sequence
  chemically synthesized
gttagatatgggtctgaatttc

SEQ ID NO: 987571 - DNA, 22 bp, Artificial Sequence
  chemically synthesized
gatatgggtctgaatttcagat

SEQ ID NO: 987572 - DNA, 22 bp, Artificial Sequence
  chemically synthesized
aatttcagatattttactccat

SEQ ID NO: 987573 - DNA, 22 bp, Artificial Sequence
  chemically synthesized
caaggtcgtagcatggagtaaa

SEQ ID NO: 987574 - DNA, 22 bp, Artificial Sequence
  chemically synthesized
gcaaggtcgtagcatggagtaa

SEQ ID NO: 987575 - DNA, 22 bp, Artificial Sequence
  chemically synthesized
tgcaaggtcgtagcatggagta

SEQ ID NO: 987576 - DNA, 22 bp, Artificial Sequence
  chemically synthesized
cagatattttactccatgctac

SEQ ID NO: 987577 - DNA, 22 bp, Artificial Sequence
  chemically synthesized
agatattttactccatgctacg

SEQ ID NO: 987578 - DNA, 22 bp, Artificial Sequence
  chemically synthesized
ggtaagctttgcaaggtcgtag

SEQ ID NO: 987579 - DNA, 22 bp, Artificial Sequence
  chemically synthesized
aggtaagctttgcaaggtcgta

SEQ ID NO: 987580 - DNA, 22 bp, Artificial Sequence
  chemically synthesized
tactccatgctacgaccttgca

SEQ ID NO: 987581 - DNA, 22 bp, Artificial Sequence
  chemically synthesized
actccatgctacgaccttgcaa

SEQ ID NO: 987582 - DNA, 22 bp, Artificial Sequence
  chemically synthesized
ctccatgctacgaccttgcaaa

SEQ ID NO: 987583 - DNA, 22 bp, Artificial Sequence
  chemically synthesized
catgctacgaccttgcaaagct

SEQ ID NO: 987584 - DNA, 22 bp, Artificial Sequence
  chemically synthesized
agaatttaggtaagctttgcaa

SEQ ID NO: 987585 - DNA, 22 bp, Artificial Sequence
  chemically synthesized
gggttcagaatttaggtaagct

SEQ ID NO: 987586 - DNA, 22 bp, Artificial Sequence
  chemically synthesized
cgaccttgcaaagcttacctaa

SEQ ID NO: 987587 - DNA, 22 bp, Artificial Sequence
  chemically synthesized
ttggggttcagaatttaggtaa

SEQ ID NO: 987588 - DNA, 22 bp, Artificial Sequence
  chemically synthesized
attggggttcagaatttaggta

SEQ ID NO: 987589 - DNA, 22 bp, Artificial Sequence
  chemically synthesized
gcaaagcttacctaaattctga

SEQ ID NO: 987590 - DNA, 22 bp, Artificial Sequence
  chemically synthesized
caaagcttacctaaattctgaa

SEQ ID NO: 987591 - DNA, 22 bp, Artificial Sequence
  chemically synthesized
acctaaattctgaaccccaata

SEQ ID NO: 987592 - DNA, 22 bp, Artificial Sequence
  chemically synthesized
cctaaattctgaaccccaataa

SEQ ID NO: 987593 - DNA, 22 bp, Artificial Sequence
  chemically synthesized
atgtatccatgagtttattggg

SEQ ID NO: 987594 - DNA, 22 bp, Artificial Sequence
  chemically synthesized
aatgtatccatgagtttattgg

SEQ ID NO: 987595 - DNA, 22 bp, Artificial Sequence
  chemically synthesized
aattctgaaccccaataaactc

SEQ ID NO: 987596 - DNA, 22 bp, Artificial Sequence
  chemically synthesized
taatgtatccatgagtttattg

SEQ ID NO: 987597 - DNA, 22 bp, Artificial Sequence
  chemically synthesized
ctttaatgtatccatgagttta

SEQ ID NO: 987598 - DNA, 22 bp, Artificial Sequence
  chemically synthesized
actttaatgtatccatgagttt

SEQ ID NO: 987599 - DNA, 22 bp, Artificial Sequence
  chemically synthesized
tgaaccccaataaactcatgga

SEQ ID NO: 987600 - DNA, 22 bp, Artificial Sequence
  chemically synthesized
tactttaatgtatccatgagtt

SEQ ID NO: 987601 - DNA, 22 bp, Artificial Sequence
  chemically synthesized
ttactttaatgtatccatgagt

SEQ ID NO: 987602 - DNA, 22 bp, Artificial Sequence
  chemically synthesized
aaccccaataaactcatggata

SEQ ID NO: 987603 - DNA, 22 bp, Artificial Sequence
  chemically synthesized
atggatacattaaagtaaaagc

SEQ ID NO: 987604 - DNA, 22 bp, Artificial Sequence
  chemically synthesized
acaagcatgcacagagctttta

SEQ ID NO: 987605 - DNA, 22 bp, Artificial Sequence
  chemically synthesized
taacaagcatgcacagagcttt

SEQ ID NO: 987606 - DNA, 22 bp, Artificial Sequence
  chemically synthesized
ttctaacaagcatgcacagagc

SEQ ID NO: 987607 - DNA, 22 bp, Artificial Sequence
  chemically synthesized
aagtaaaagctctgtgcatgct

SEQ ID NO: 987608 - DNA, 22 bp, Artificial Sequence
  chemically synthesized
tgtgcatgcttgttagaatagc

SEQ ID NO: 987609 - DNA, 22 bp, Artificial Sequence
  chemically synthesized
tgcatgcttgttagaatagcac

SEQ ID NO: 987610 - DNA, 22 bp, Artificial Sequence
  chemically synthesized
gtaaatgtatagtgtgctattc

SEQ ID NO: 987611 - DNA, 22 bp, Artificial Sequence
  chemically synthesized
ggtaaatgtatagtgtgctatt

SEQ ID NO: 987612 - DNA, 22 bp, Artificial Sequence
  chemically synthesized
ccatttggtaaatgtatagtgt

SEQ ID NO: 987613 - DNA, 22 bp, Artificial Sequence
  chemically synthesized
gttagaatagcacactatacat

SEQ ID NO: 987614 - DNA, 22 bp, Artificial Sequence
  chemically synthesized
gccatttggtaaatgtatagtg

SEQ ID NO: 987615 - DNA, 22 bp, Artificial Sequence
  chemically synthesized
ttagaatagcacactatacatt

SEQ ID NO: 987616 - DNA, 22 bp, Artificial Sequence
  chemically synthesized
tgccatttggtaaatgtatagt

SEQ ID NO: 987617 - DNA, 22 bp, Artificial Sequence
  chemically synthesized
gaatagcacactatacatttac

SEQ ID NO: 987618 - DNA, 22 bp, Artificial Sequence
  chemically synthesized
catgccaggcactttgccattt

SEQ ID NO: 987619 - DNA, 22 bp, Artificial Sequence
  chemically synthesized
tacatttaccaaatggcaaagt

SEQ ID NO: 987620 - DNA, 22 bp, Artificial Sequence
  chemically synthesized
tccatgccaggcactttgccat

SEQ ID NO: 987621 - DNA, 22 bp, Artificial Sequence
  chemically synthesized
tcattctccatgccaggcactt

SEQ ID NO: 987622 - DNA, 22 bp, Artificial Sequence
  chemically synthesized
accaaatggcaaagtgcctggc

SEQ ID NO: 987623 - DNA, 22 bp, Artificial Sequence
  chemically synthesized
ccaaatggcaaagtgcctggca

SEQ ID NO: 987624 - DNA, 22 bp, Artificial Sequence
  chemically synthesized
taactatcattctccatgccag

SEQ ID NO: 987625 - DNA, 22 bp, Artificial Sequence
  chemically synthesized
tgactataactatcattctcca

SEQ ID NO: 987626 - DNA, 22 bp, Artificial Sequence
  chemically synthesized
atgactataactatcattctcc

SEQ ID NO: 987627 - DNA, 22 bp, Artificial Sequence
  chemically synthesized
gtgtttatgactataactatca

SEQ ID NO: 987628 - DNA, 22 bp, Artificial Sequence
  chemically synthesized
gcatggagaatgatagttatag

SEQ ID NO: 987629 - DNA, 22 bp, Artificial Sequence
  chemically synthesized
tgacgatgctagtgtttatgac

SEQ ID NO: 987630 - DNA, 22 bp, Artificial Sequence
  chemically synthesized
aattatgacgatgctagtgttt

SEQ ID NO: 987631 - DNA, 22 bp, Artificial Sequence
  chemically synthesized
caattatgacgatgctagtgtt

SEQ ID NO: 987632 - DNA, 22 bp, Artificial Sequence
  chemically synthesized
ttcaattatgacgatgctagtg

SEQ ID NO: 987633 - DNA, 22 bp, Artificial Sequence
  chemically synthesized
cttcaattatgacgatgctagt

SEQ ID NO: 987634 - DNA, 22 bp, Artificial Sequence
  chemically synthesized
tagtcataaacactagcatcgt

SEQ ID NO: 987635 - DNA, 22 bp, Artificial Sequence
  chemically synthesized
gcatcgtcataattgaagaaat

SEQ ID NO: 987636 - DNA, 22 bp, Artificial Sequence
  chemically synthesized
gatcccatggacagtaatttct

SEQ ID NO: 987637 - DNA, 22 bp, Artificial Sequence
  chemically synthesized
actagatcccatggacagtaat

SEQ ID NO: 987638 - DNA, 22 bp, Artificial Sequence
  chemically synthesized
aagaaattactgtccatgggat

SEQ ID NO: 987639 - DNA, 22 bp, Artificial Sequence
  chemically synthesized
aatgattgactagatcccatgg

SEQ ID NO: 987640 - DNA, 22 bp, Artificial Sequence
  chemically synthesized
ctgtccatgggatctagtcaat

SEQ ID NO: 987641 - DNA, 22 bp, Artificial Sequence
  chemically synthesized
tccatgggatctagtcaatcat

SEQ ID NO: 987642 - DNA, 22 bp, Artificial Sequence
  chemically synthesized
agtgaatactcaatgattgact

SEQ ID NO: 987643 - DNA, 22 bp, Artificial Sequence
  chemically synthesized
aatgctgagtgaatactcaatg

SEQ ID NO: 987644 - DNA, 22 bp, Artificial Sequence
  chemically synthesized
gaatgctgagtgaatactcaat

SEQ ID NO: 987645 - DNA, 22 bp, Artificial Sequence
  chemically synthesized
gtcaatcattgagtattcactc

SEQ ID NO: 987646 - DNA, 22 bp, Artificial Sequence
  chemically synthesized
agtattcactcagcattcaaga

SEQ ID NO: 987647 - DNA, 22 bp, Artificial Sequence
  chemically synthesized
agataaaatatcagtcttgaat

SEQ ID NO: 987648 - DNA, 22 bp, Artificial Sequence
  chemically synthesized
actcagcattcaagactgatat

SEQ ID NO: 987649 - DNA, 22 bp, Artificial Sequence
  chemically synthesized
tggaattcagataaaatatcag

SEQ ID NO: 987650 - DNA, 22 bp, Artificial Sequence
  chemically synthesized
agcattcaagactgatatttta

SEQ ID NO: 987651 - DNA, 22 bp, Artificial Sequence
  chemically synthesized
gtggaattcagataaaatatca

SEQ ID NO: 987652 - DNA, 22 bp, Artificial Sequence
  chemically synthesized
aagactgatattttatctgaat

SEQ ID NO: 987653 - DNA, 22 bp, Artificial Sequence
  chemically synthesized
atattttatctgaattccacaa

SEQ ID NO: 987654 - DNA, 22 bp, Artificial Sequence
  chemically synthesized
agtgaagggtgatttgtggaat

SEQ ID NO: 987655 - DNA, 22 bp, Artificial Sequence
  chemically synthesized
tatctgaattccacaaatcacc

SEQ ID NO: 987656 - DNA, 22 bp, Artificial Sequence
  chemically synthesized
atctgaattccacaaatcaccc

SEQ ID NO: 987657 - DNA, 22 bp, Artificial Sequence
  chemically synthesized
tctgaattccacaaatcaccct

SEQ ID NO: 987658 - DNA, 22 bp, Artificial Sequence
  chemically synthesized
aattccacaaatcacccttcac

SEQ ID NO: 987659 - DNA, 22 bp, Artificial Sequence
  chemically synthesized
cacaaatcacccttcactcaac

SEQ ID NO: 987660 - DNA, 22 bp, Artificial Sequence
  chemically synthesized
aaggatgatgataagaaaaccg

SEQ ID NO: 987661 - DNA, 22 bp, Artificial Sequence
  chemically synthesized
cactcaacacggttttcttatc

SEQ ID NO: 987662 - DNA, 22 bp, Artificial Sequence
  chemically synthesized
actcaacacggttttcttatca

SEQ ID NO: 987663 - DNA, 22 bp, Artificial Sequence
  chemically synthesized
cctgaaggatgatgataagaaa

SEQ ID NO: 987664 - DNA, 22 bp, Artificial Sequence
  chemically synthesized
tacctgaaggatgatgataaga

SEQ ID NO: 987665 - DNA, 22 bp, Artificial Sequence
  chemically synthesized
aacacggttttcttatcatcat

SEQ ID NO: 987666 - DNA, 22 bp, Artificial Sequence
  chemically synthesized
tcttatcatcatccttcaggta

SEQ ID NO: 987667 - DNA, 22 bp, Artificial Sequence
  chemically synthesized
cttatcatcatccttcaggtag

SEQ ID NO: 987668 - DNA, 22 bp, Artificial Sequence
  chemically synthesized
ttatcatcatccttcaggtaga

SEQ ID NO: 987669 - DNA, 22 bp, Artificial Sequence
  chemically synthesized
atcatcatccttcaggtagagc

SEQ ID NO: 987670 - DNA, 22 bp, Artificial Sequence
  chemically synthesized
tcatcatccttcaggtagagcc

SEQ ID NO: 987671 - DNA, 22 bp, Artificial Sequence
  chemically synthesized
caggtagagcccctccatccta

SEQ ID NO: 987672 - DNA, 22 bp, Artificial Sequence
  chemically synthesized
aggtagagcccctccatcctat

SEQ ID NO: 987673 - DNA, 22 bp, Artificial Sequence
  chemically synthesized
caaacagtgtatgcaaatccag

SEQ ID NO: 987674 - DNA, 22 bp, Artificial Sequence
  chemically synthesized
catcctatctctggatttgcat

SEQ ID NO: 987675 - DNA, 22 bp, Artificial Sequence
  chemically synthesized
tctctggatttgcatacactgt

SEQ ID NO: 987676 - DNA, 22 bp, Artificial Sequence
  chemically synthesized
tggatttgcatacactgtttgg

SEQ ID NO: 987677 - DNA, 22 bp, Artificial Sequence
  chemically synthesized
gatttgcatacactgtttggaa

SEQ ID NO: 987678 - DNA, 22 bp, Artificial Sequence
  chemically synthesized
gcatacactgtttggaatatct

SEQ ID NO: 987679 - DNA, 22 bp, Artificial Sequence
  chemically synthesized
catacactgtttggaatatctt

SEQ ID NO: 987680 - DNA, 22 bp, Artificial Sequence
  chemically synthesized
atgaaaagaaaatggtaaagat

SEQ ID NO: 987681 - DNA, 22 bp, Artificial Sequence
  chemically synthesized
tttggaatatctttaccatttt

SEQ ID NO: 987682 - DNA, 22 bp, Artificial Sequence
  chemically synthesized
ggaatatctttaccattttctt

SEQ ID NO: 987683 - DNA, 22 bp, Artificial Sequence
  chemically synthesized
gaatatctttaccattttcttt

SEQ ID NO: 987684 - DNA, 22 bp, Artificial Sequence
  chemically synthesized
tcgatatctgatgaaaagaaaa

SEQ ID NO: 987685 - DNA, 22 bp, Artificial Sequence
  chemically synthesized
taccattttcttttcatcagat

SEQ ID NO: 987686 - DNA, 22 bp, Artificial Sequence
  chemically synthesized
accattttcttttcatcagata

SEQ ID NO: 987687 - DNA, 22 bp, Artificial Sequence
  chemically synthesized
ccattttcttttcatcagatat

SEQ ID NO: 987688 - DNA, 22 bp, Artificial Sequence
  chemically synthesized
taaaagttgtcgatatctgatg

SEQ ID NO: 987689 - DNA, 22 bp, Artificial Sequence
  chemically synthesized
tcttttcatcagatatcgacaa

SEQ ID NO: 987690 - DNA, 22 bp, Artificial Sequence
  chemically synthesized
cttttcatcagatatcgacaac

SEQ ID NO: 987691 - DNA, 22 bp, Artificial Sequence
  chemically synthesized
ttttcatcagatatcgacaact

SEQ ID NO: 987692 - DNA, 22 bp, Artificial Sequence
  chemically synthesized
gtagacctataaaagttgtcga

SEQ ID NO: 987693 - DNA, 22 bp, Artificial Sequence
  chemically synthesized
ttcatcagatatcgacaacttt

SEQ ID NO: 987694 - DNA, 22 bp, Artificial Sequence
  chemically synthesized
tcatcagatatcgacaactttt

SEQ ID NO: 987695 - DNA, 22 bp, Artificial Sequence
  chemically synthesized
catcagatatcgacaactttta

SEQ ID NO: 987696 - DNA, 22 bp, Artificial Sequence
  chemically synthesized
atcagatatcgacaacttttat

SEQ ID NO: 987697 - DNA, 22 bp, Artificial Sequence
  chemically synthesized
atgatctagtagacctataaaa

SEQ ID NO: 987698 - DNA, 22 bp, Artificial Sequence
  chemically synthesized
catgatctagtagacctataaa

SEQ ID NO: 987699 - DNA, 22 bp, Artificial Sequence
  chemically synthesized
atttcatgatctagtagaccta

SEQ ID NO: 987700 - DNA, 22 bp, Artificial Sequence
  chemically synthesized
gatttcatgatctagtagacct

SEQ ID NO: 987701 - DNA, 22 bp, Artificial Sequence
  chemically synthesized
ttataggtctactagatcatga

SEQ ID NO: 987702 - DNA, 22 bp, Artificial Sequence
  chemically synthesized
tataggtctactagatcatgaa

SEQ ID NO: 987703 - DNA, 22 bp, Artificial Sequence
  chemically synthesized
ataggtctactagatcatgaaa

SEQ ID NO: 987704 - DNA, 22 bp, Artificial Sequence
  chemically synthesized
taggtctactagatcatgaaat

SEQ ID NO: 987705 - DNA, 22 bp, Artificial Sequence
  chemically synthesized
ctagatcatgaaatcaagggtt

SEQ ID NO: 987706 - DNA, 22 bp, Artificial Sequence
  chemically synthesized
gatcatgaaatcaagggttatg

SEQ ID NO: 987707 - DNA, 22 bp, Artificial Sequence
  chemically synthesized
aggacagaacaaaaaccaagta

SEQ ID NO: 987708 - DNA, 22 bp, Artificial Sequence
  chemically synthesized
tgttcatgtattacttggtttt

SEQ ID NO: 987709 - DNA, 22 bp, Artificial Sequence
  chemically synthesized
atgtattacttggtttttgttc

SEQ ID NO: 987710 - DNA, 22 bp, Artificial Sequence
  chemically synthesized
tggtgggtgctgaggacagaac

SEQ ID NO: 987711 - DNA, 22 bp, Artificial Sequence
  chemically synthesized
gtggtgggtgctgaggacagaa

SEQ ID NO: 987712 - DNA, 22 bp, Artificial Sequence
  chemically synthesized
cttggtttttgttctgtcctca

SEQ ID NO: 987713 - DNA, 22 bp, Artificial Sequence
  chemically synthesized
ggtttttgttctgtcctcagca

SEQ ID NO: 987714 - DNA, 22 bp, Artificial Sequence
  chemically synthesized
gtttttgttctgtcctcagcac

SEQ ID NO: 987715 - DNA, 22 bp, Artificial Sequence
  chemically synthesized
ttgttctgtcctcagcacccac

SEQ ID NO: 987716 - DNA, 22 bp, Artificial Sequence
  chemically synthesized
tgttctgtcctcagcacccacc

SEQ ID NO: 987717 - DNA, 22 bp, Artificial Sequence
  chemically synthesized
gttctgtcctcagcacccacca

SEQ ID NO: 987718 - DNA, 22 bp, Artificial Sequence
  chemically synthesized
ttctgtcctcagcacccaccac

SEQ ID NO: 987719 - DNA, 22 bp, Artificial Sequence
  chemically synthesized
tgtcctcagcacccaccacaag

SEQ ID NO: 987720 - DNA, 22 bp, Artificial Sequence
  chemically synthesized
aaaatacagggccttgtggtgg

SEQ ID NO: 987721 - DNA, 22 bp, Artificial Sequence
  chemically synthesized
aaaaatacagggccttgtggtg

SEQ ID NO: 987722 - DNA, 22 bp, Artificial Sequence
  chemically synthesized
tcctcagcacccaccacaaggc

SEQ ID NO: 987723 - DNA, 22 bp, Artificial Sequence
  chemically synthesized
taaaaatacagggccttgtggt

SEQ ID NO: 987724 - DNA, 22 bp, Artificial Sequence
  chemically synthesized
ctttaaaaatacagggccttgt

SEQ ID NO: 987725 - DNA, 22 bp, Artificial Sequence
  chemically synthesized
agcacccaccacaaggccctgt

SEQ ID NO: 987726 - DNA, 22 bp, Artificial Sequence
  chemically synthesized
agctcctttaaaaatacagggc

SEQ ID NO: 987727 - DNA, 22 bp, Artificial Sequence
  chemically synthesized
tattgagctcctttaaaaatac

SEQ ID NO: 987728 - DNA, 22 bp, Artificial Sequence
  chemically synthesized
atattgagctcctttaaaaata

SEQ ID NO: 987729 - DNA, 22 bp, Artificial Sequence
  chemically synthesized
aatatatttatattgagctcct

SEQ ID NO: 987730 - DNA, 22 bp, Artificial Sequence
  chemically synthesized
tatttttaaaggagctcaatat

SEQ ID NO: 987731 - DNA, 22 bp, Artificial Sequence
  chemically synthesized
cattcaatatatttatattgag

SEQ ID NO: 987732 - DNA, 22 bp, Artificial Sequence
  chemically synthesized
ttaaaggagctcaatataaata

SEQ ID NO: 987733 - DNA, 22 bp, Artificial Sequence
  chemically synthesized
taaaggagctcaatataaatat

SEQ ID NO: 987734 - DNA, 22 bp, Artificial Sequence
  chemically synthesized
attccattcaatatatttatat

SEQ ID NO: 987735 - DNA, 22 bp, Artificial Sequence
  chemically synthesized
aaaggagctcaatataaatata

SEQ ID NO: 987736 - DNA, 22 bp, Artificial Sequence
  chemically synthesized
aattccattcaatatatttata

SEQ ID NO: 987737 - DNA, 22 bp, Artificial Sequence
  chemically synthesized
aaggagctcaatataaatatat

SEQ ID NO: 987738 - DNA, 22 bp, Artificial Sequence
  chemically synthesized
aatataaatatattgaatggaa

SEQ ID NO: 987739 - DNA, 22 bp, Artificial Sequence
  chemically synthesized
gcaatggcatttaattccattc

SEQ ID NO: 987740 - DNA, 22 bp, Artificial Sequence
  chemically synthesized
agcaatggcatttaattccatt

SEQ ID NO: 987741 - DNA, 22 bp, Artificial Sequence
  chemically synthesized
tagcaatggcatttaattccat

SEQ ID NO: 987742 - DNA, 22 bp, Artificial Sequence
  chemically synthesized
aatggaattaaatgccattgct

SEQ ID NO: 987743 - DNA, 22 bp, Artificial Sequence
  chemically synthesized
acatgaggaggaaaactttagc

SEQ ID NO: 987744 - DNA, 22 bp, Artificial Sequence
  chemically synthesized
aatgccattgctaaagttttcc

SEQ ID NO: 987745 - DNA, 22 bp, Artificial Sequence
  chemically synthesized
ctaaagttttcctcctcatgtt

SEQ ID NO: 987746 - DNA, 22 bp, Artificial Sequence
  chemically synthesized
cacgggtaaagattaacatgag

SEQ ID NO: 987747 - DNA, 22 bp, Artificial Sequence
  chemically synthesized
aagttttcctcctcatgttaat

SEQ ID NO: 987748 - DNA, 22 bp, Artificial Sequence
  chemically synthesized
acacgggtaaagattaacatga

SEQ ID NO: 987749 - DNA, 22 bp, Artificial Sequence
  chemically synthesized
tacacgggtaaagattaacatg

SEQ ID NO: 987750 - DNA, 22 bp, Artificial Sequence
  chemically synthesized
ttacacgggtaaagattaacat

SEQ ID NO: 987751 - DNA, 22 bp, Artificial Sequence
  chemically synthesized
ttttacacgggtaaagattaac

SEQ ID NO: 987752 - DNA, 22 bp, Artificial Sequence
  chemically synthesized
cttttacacgggtaaagattaa

SEQ ID NO: 987753 - DNA, 22 bp, Artificial Sequence
  chemically synthesized
tcctcctcatgttaatctttac

SEQ ID NO: 987754 - DNA, 22 bp, Artificial Sequence
  chemically synthesized
cctcctcatgttaatctttacc

SEQ ID NO: 987755 - DNA, 22 bp, Artificial Sequence
  chemically synthesized
ctcctcatgttaatctttaccc

SEQ ID NO: 987756 - DNA, 22 bp, Artificial Sequence
  chemically synthesized
ctcatgttaatctttacccgtg

SEQ ID NO: 987757 - DNA, 22 bp, Artificial Sequence
  chemically synthesized
atgttaatctttacccgtgtaa

SEQ ID NO: 987758 - DNA, 22 bp, Artificial Sequence
  chemically synthesized
atctttacccgtgtaaaagaaa

SEQ ID NO: 987759 - DNA, 22 bp, Artificial Sequence
  chemically synthesized
ggtaaaggatagtttcttttac

SEQ ID NO: 987760 - DNA, 22 bp, Artificial Sequence
  chemically synthesized
tacccgtgtaaaagaaactatc

SEQ ID NO: 987761 - DNA, 22 bp, Artificial Sequence
  chemically synthesized
acccgtgtaaaagaaactatcc

SEQ ID NO: 987762 - DNA, 22 bp, Artificial Sequence
  chemically synthesized
cccgtgtaaaagaaactatcct

SEQ ID NO: 987763 - DNA, 22 bp, Artificial Sequence
  chemically synthesized
tgtaactaggtaaaggatagtt

SEQ ID NO: 987764 - DNA, 22 bp, Artificial Sequence
  chemically synthesized
tgaagttgtgtaactaggtaaa

SEQ ID NO: 987765 - DNA, 22 bp, Artificial Sequence
  chemically synthesized
ttatgaagttgtgtaactaggt

SEQ ID NO: 987766 - DNA, 22 bp, Artificial Sequence
  chemically synthesized
tcctttacctagttacacaact

SEQ ID NO: 987767 - DNA, 22 bp, Artificial Sequence
  chemically synthesized
tacctagttacacaacttcata

SEQ ID NO: 987768 - DNA, 22 bp, Artificial Sequence
  chemically synthesized
acctagttacacaacttcataa

SEQ ID NO: 987769 - DNA, 22 bp, Artificial Sequence
  chemically synthesized
cctagttacacaacttcataat

SEQ ID NO: 987770 - DNA, 22 bp, Artificial Sequence
  chemically synthesized
agagtaataaattattatgaag

SEQ ID NO: 987771 - DNA, 22 bp, Artificial Sequence
  chemically synthesized
gttacacaacttcataataatt

SEQ ID NO: 987772 - DNA, 22 bp, Artificial Sequence
  chemically synthesized
cacaacttcataataatttatt

SEQ ID NO: 987773 - DNA, 22 bp, Artificial Sequence
  chemically synthesized
tgaaaattcagagtaataaatt

SEQ ID NO: 987774 - DNA, 22 bp, Artificial Sequence
  chemically synthesized
gtgaaaattcagagtaataaat

SEQ ID NO: 987775 - DNA, 22 bp, Artificial Sequence
  chemically synthesized
ttgtgaaaattcagagtaataa

SEQ ID NO: 987776 - DNA, 22 bp, Artificial Sequence
  chemically synthesized
cataataatttattactctgaa

SEQ ID NO: 987777 - DNA, 22 bp, Artificial Sequence
  chemically synthesized
ataataatttattactctgaat

SEQ ID NO: 987778 - DNA, 22 bp, Artificial Sequence
  chemically synthesized
agtcaaaagttcttgtgaaaat

SEQ ID NO: 987779 - DNA, 22 bp, Artificial Sequence
  chemically synthesized
attactctgaattttcacaaga

SEQ ID NO: 987780 - DNA, 22 bp, Artificial Sequence
  chemically synthesized
ttactctgaattttcacaagaa

SEQ ID NO: 987781 - DNA, 22 bp, Artificial Sequence
  chemically synthesized
ctctgaattttcacaagaactt

SEQ ID NO: 987782 - DNA, 22 bp, Artificial Sequence
  chemically synthesized
tgaattttcacaagaacttttg

SEQ ID NO: 987783 - DNA, 22 bp, Artificial Sequence
  chemically synthesized
aattttcacaagaacttttgac

SEQ ID NO: 987784 - DNA, 22 bp, Artificial Sequence
  chemically synthesized
aatgagtggttaagtcaaaagt

SEQ ID NO: 987785 - DNA, 22 bp, Artificial Sequence
  chemically synthesized
aaatgagtggttaagtcaaaag

SEQ ID NO: 987786 - DNA, 22 bp, Artificial Sequence
  chemically synthesized
taaatgagtggttaagtcaaaa

SEQ ID NO: 987787 - DNA, 22 bp, Artificial Sequence
  chemically synthesized
ttaaatgagtggttaagtcaaa

SEQ ID NO: 987788 - DNA, 22 bp, Artificial Sequence
  chemically synthesized
tcacaagaacttttgacttaac

SEQ ID NO: 987789 - DNA, 22 bp, Artificial Sequence
  chemically synthesized
tttaaatgagtggttaagtcaa

SEQ ID NO: 987790 - DNA, 22 bp, Artificial Sequence
  chemically synthesized
cacaagaacttttgacttaacc

SEQ ID NO: 987791 - DNA, 22 bp, Artificial Sequence
  chemically synthesized
ttttaaatgagtggttaagtca

SEQ ID NO: 987792 - DNA, 22 bp, Artificial Sequence
  chemically synthesized
acaagaacttttgacttaacca

SEQ ID NO: 987793 - DNA, 22 bp, Artificial Sequence
  chemically synthesized
tttttaaatgagtggttaagtc

SEQ ID NO: 987794 - DNA, 22 bp, Artificial Sequence
  chemically synthesized
cagattttttttaaatgagtgg

SEQ ID NO: 987795 - DNA, 22 bp, Artificial Sequence
  chemically synthesized
ttgacttaaccactcatttaaa

SEQ ID NO: 987796 - DNA, 22 bp, Artificial Sequence
  chemically synthesized
tgacttaaccactcatttaaaa

SEQ ID NO: 987797 - DNA, 22 bp, Artificial Sequence
  chemically synthesized
tctgcagattttttttaaatga

SEQ ID NO: 987798 - DNA, 22 bp, Artificial Sequence
  chemically synthesized
gacttaaccactcatttaaaaa

SEQ ID NO: 987799 - DNA, 22 bp, Artificial Sequence
  chemically synthesized
acttaaccactcatttaaaaaa

SEQ ID NO: 987800 - DNA, 22 bp, Artificial Sequence
  chemically synthesized
aaccactcatttaaaaaaaatc

SEQ ID NO: 987801 - DNA, 22 bp, Artificial Sequence
  chemically synthesized
accactcatttaaaaaaaatct

SEQ ID NO: 987802 - DNA, 22 bp, Artificial Sequence
  chemically synthesized
caggattatctgcagatttttt

SEQ ID NO: 987803 - DNA, 22 bp, Artificial Sequence
  chemically synthesized
atttaaaaaaaatctgcagata

SEQ ID NO: 987804 - DNA, 22 bp, Artificial Sequence
  chemically synthesized
aaaaaaaatctgcagataatcc

SEQ ID NO: 987805 - DNA, 22 bp, Artificial Sequence
  chemically synthesized
aaaaaaatctgcagataatcct

SEQ ID NO: 987806 - DNA, 22 bp, Artificial Sequence
  chemically synthesized
gagaaatatattacaggattat

SEQ ID NO: 987807 - DNA, 22 bp, Artificial Sequence
  chemically synthesized
tgctggagaaatatattacagg

SEQ ID NO: 987808 - DNA, 22 bp, Artificial Sequence
  chemically synthesized
cagataatcctgtaatatattt

SEQ ID NO: 987809 - DNA, 22 bp, Artificial Sequence
  chemically synthesized
atgagggtgaactgtgctggag

SEQ ID NO: 987810 - DNA, 22 bp, Artificial Sequence
  chemically synthesized
catgagggtgaactgtgctgga

SEQ ID NO: 987811 - DNA, 22 bp, Artificial Sequence
  chemically synthesized
taatatatttctccagcacagt

SEQ ID NO: 987812 - DNA, 22 bp, Artificial Sequence
  chemically synthesized
cttcatgagggtgaactgtgct

SEQ ID NO: 987813 - DNA, 22 bp, Artificial Sequence
  chemically synthesized
cctgcttcatgagggtgaactg

SEQ ID NO: 987814 - DNA, 22 bp, Artificial Sequence
  chemically synthesized
ctccagcacagttcaccctcat

SEQ ID NO: 987815 - DNA, 22 bp, Artificial Sequence
  chemically synthesized
tccagcacagttcaccctcatg

SEQ ID NO: 987816 - DNA, 22 bp, Artificial Sequence
  chemically synthesized
cagcacagttcaccctcatgaa

SEQ ID NO: 987817 - DNA, 22 bp, Artificial Sequence
  chemically synthesized
aatactgcctgcttcatgaggg

SEQ ID NO: 987818 - DNA, 22 bp, Artificial Sequence
  chemically synthesized
ctcaatactgcctgcttcatga

SEQ ID NO: 987819 - DNA, 22 bp, Artificial Sequence
  chemically synthesized
gctcaatactgcctgcttcatg

SEQ ID NO: 987820 - DNA, 22 bp, Artificial Sequence
  chemically synthesized
ttgctcaatactgcctgcttca

SEQ ID NO: 987821 - DNA, 22 bp, Artificial Sequence
  chemically synthesized
accctcatgaagcaggcagtat

SEQ ID NO: 987822 - DNA, 22 bp, Artificial Sequence
  chemically synthesized
gcctcttgctcaatactgcctg

SEQ ID NO: 987823 - DNA, 22 bp, Artificial Sequence
  chemically synthesized
atgaagcaggcagtattgagca

SEQ ID NO: 987824 - DNA, 22 bp, Artificial Sequence
  chemically synthesized
accagtgagcctagcctcttgc

SEQ ID NO: 987825 - DNA, 22 bp, Artificial Sequence
  chemically synthesized
tctaaccagtgagcctagcctc

SEQ ID NO: 987826 - DNA, 22 bp, Artificial Sequence
  chemically synthesized
gtctaaccagtgagcctagcct

SEQ ID NO: 987827 - DNA, 22 bp, Artificial Sequence
  chemically synthesized
cttgtctaaccagtgagcctag

SEQ ID NO: 987828 - DNA, 22 bp, Artificial Sequence
  chemically synthesized
agcaagaggctaggctcactgg

SEQ ID NO: 987829 - DNA, 22 bp, Artificial Sequence
  chemically synthesized
ggctcactggttagacaagtaa

SEQ ID NO: 987830 - DNA, 22 bp, Artificial Sequence
  chemically synthesized
atgtgaggggtcaattacttgt

SEQ ID NO: 987831 - DNA, 22 bp, Artificial Sequence
  chemically synthesized
aatgtgaggggtcaattacttg

SEQ ID NO: 987832 - DNA, 22 bp, Artificial Sequence
  chemically synthesized
actggttagacaagtaattgac

SEQ ID NO: 987833 - DNA, 22 bp, Artificial Sequence
  chemically synthesized
gttagacaagtaattgacccct

SEQ ID NO: 987834 - DNA, 22 bp, Artificial Sequence
  chemically synthesized
catggatttaatgtgaggggtc

SEQ ID NO: 987835 - DNA, 22 bp, Artificial Sequence
  chemically synthesized
gacaagtaattgacccctcaca

SEQ ID NO: 987836 - DNA, 22 bp, Artificial Sequence
  chemically synthesized
gattgcatggatttaatgtgag

SEQ ID NO: 987837 - DNA, 22 bp, Artificial Sequence
  chemically synthesized
agattgcatggatttaatgtga

SEQ ID NO: 987838 - DNA, 22 bp, Artificial Sequence
  chemically synthesized
tttagattgcatggatttaatg

SEQ ID NO: 987839 - DNA, 22 bp, Artificial Sequence
  chemically synthesized
acccctcacattaaatccatgc

SEQ ID NO: 987840 - DNA, 22 bp, Artificial Sequence
  chemically synthesized
attatttagattgcatggattt

SEQ ID NO: 987841 - DNA, 22 bp, Artificial Sequence
  chemically synthesized
gtgttcattatttagattgcat

SEQ ID NO: 987842 - DNA, 22 bp, Artificial Sequence
  chemically synthesized
acattaaatccatgcaatctaa

SEQ ID NO: 987843 - DNA, 22 bp, Artificial Sequence
  chemically synthesized
aatccatgcaatctaaataatg

SEQ ID NO: 987844 - DNA, 22 bp, Artificial Sequence
  chemically synthesized
cagcatacaattagtgttcatt

SEQ ID NO: 987845 - DNA, 22 bp, Artificial Sequence
  chemically synthesized
gcagcctacagcatacaattag

SEQ ID NO: 987846 - DNA, 22 bp, Artificial Sequence
  chemically synthesized
aataatgaacactaattgtatg

SEQ ID NO: 987847 - DNA, 22 bp, Artificial Sequence
  chemically synthesized
attgtatgctgtaggctgccag

SEQ ID NO: 987848 - DNA, 22 bp, Artificial Sequence
  chemically synthesized
cagcgagagaccctggcagcct

SEQ ID NO: 987849 - DNA, 22 bp, Artificial Sequence
  chemically synthesized
tatgctgtaggctgccagggtc

SEQ ID NO: 987850 - DNA, 22 bp, Artificial Sequence
  chemically synthesized
actacagcgagagaccctggca

SEQ ID NO: 987851 - DNA, 22 bp, Artificial Sequence
  chemically synthesized
aactacagcgagagaccctggc

SEQ ID NO: 987852 - DNA, 22 bp, Artificial Sequence
  chemically synthesized
taactacagcgagagaccctgg

SEQ ID NO: 987853 - DNA, 22 bp, Artificial Sequence
  chemically synthesized
ttaactacagcgagagaccctg

SEQ ID NO: 987854 - DNA, 22 bp, Artificial Sequence
  chemically synthesized
cttttaactacagcgagagacc

SEQ ID NO: 987855 - DNA, 22 bp, Artificial Sequence
  chemically synthesized
taggctgccagggtctctcgct

SEQ ID NO: 987856 - DNA, 22 bp, Artificial Sequence
  chemically synthesized
acttttaactacagcgagagac

SEQ ID NO: 987857 - DNA, 22 bp, Artificial Sequence
  chemically synthesized
tacttttaactacagcgagaga

SEQ ID NO: 987858 - DNA, 22 bp, Artificial Sequence
  chemically synthesized
ttacttttaactacagcgagag

SEQ ID NO: 987859 - DNA, 22 bp, Artificial Sequence
  chemically synthesized
ccagggtctctcgctgtagtta

SEQ ID NO: 987860 - DNA, 22 bp, Artificial Sequence
  chemically synthesized
tcgctgtagttaaaagtaaaaa

SEQ ID NO: 987861 - DNA, 22 bp, Artificial Sequence
  chemically synthesized
gctgtagttaaaagtaaaaata

SEQ ID NO: 987862 - DNA, 22 bp, Artificial Sequence
  chemically synthesized
tagttaaaagtaaaaatacatt

SEQ ID NO: 987863 - DNA, 22 bp, Artificial Sequence
  chemically synthesized
aaagtaaaaatacatttttttt

SEQ ID NO: 987864 - DNA, 22 bp, Artificial Sequence
  chemically synthesized
aaaaagaaaaaaaaaaaaaatg

SEQ ID NO: 987865 - DNA, 22 bp, Artificial Sequence
  chemically synthesized
catctcaaaaagaaaaaaaaaa

SEQ ID NO: 987866 - DNA, 22 bp, Artificial Sequence
  chemically synthesized
tttttttttttctttttgagat

SEQ ID NO: 987867 - DNA, 22 bp, Artificial Sequence
  chemically synthesized
ttttttttttctttttgagatg

SEQ ID NO: 987868 - DNA, 22 bp, Artificial Sequence
  chemically synthesized
tttttttttctttttgagatgg

SEQ ID NO: 987869 - DNA, 22 bp, Artificial Sequence
  chemically synthesized
ttttttttctttttgagatgga

SEQ ID NO: 987870 - DNA, 22 bp, Artificial Sequence
  chemically synthesized
tttttttctttttgagatggag

SEQ ID NO: 987871 - DNA, 22 bp, Artificial Sequence
  chemically synthesized
ttttttctttttgagatggagt

SEQ ID NO: 987872 - DNA, 22 bp, Artificial Sequence
  chemically synthesized
tttttctttttgagatggagtc

SEQ ID NO: 987873 - DNA, 22 bp, Artificial Sequence
  chemically synthesized
ttttctttttgagatggagtct

SEQ ID NO: 987874 - DNA, 22 bp, Artificial Sequence
  chemically synthesized
ggcgacagagggagactccatc

SEQ ID NO: 987875 - DNA, 22 bp, Artificial Sequence
  chemically synthesized
tttctttttgagatggagtctc

SEQ ID NO: 987876 - DNA, 22 bp, Artificial Sequence
  chemically synthesized
ttctttttgagatggagtctcc

SEQ ID NO: 987877 - DNA, 22 bp, Artificial Sequence
  chemically synthesized
tctttttgagatggagtctccc

SEQ ID NO: 987878 - DNA, 22 bp, Artificial Sequence
  chemically synthesized
ctttttgagatggagtctccct

SEQ ID NO: 987879 - DNA, 22 bp, Artificial Sequence
  chemically synthesized
tttttgagatggagtctccctc

SEQ ID NO: 987880 - DNA, 22 bp, Artificial Sequence
  chemically synthesized
tttgagatggagtctccctctg

SEQ ID NO: 987881 - DNA, 22 bp, Artificial Sequence
  chemically synthesized
cagcctgggcgacagagggaga

SEQ ID NO: 987882 - DNA, 22 bp, Artificial Sequence
  chemically synthesized
ttgagatggagtctccctctgt

SEQ ID NO: 987883 - DNA, 22 bp, Artificial Sequence
  chemically synthesized
tgagatggagtctccctctgtc

SEQ ID NO: 987884 - DNA, 22 bp, Artificial Sequence
  chemically synthesized
gagatggagtctccctctgtcg

SEQ ID NO: 987885 - DNA, 22 bp, Artificial Sequence
  chemically synthesized
agatggagtctccctctgtcgc

SEQ ID NO: 987886 - DNA, 22 bp, Artificial Sequence
  chemically synthesized
cactccagcctgggcgacagag

SEQ ID NO: 987887 - DNA, 22 bp, Artificial Sequence
  chemically synthesized
cctctgtcgcccaggctggagt

SEQ ID NO: 987888 - DNA, 22 bp, Artificial Sequence
  chemically synthesized
tgtcgcccaggctggagtgcag

SEQ ID NO: 987889 - DNA, 22 bp, Artificial Sequence
  chemically synthesized
tcgcccaggctggagtgcagtg

SEQ ID NO: 987890 - DNA, 22 bp, Artificial Sequence
  chemically synthesized
cagtgagcagaggtcaggccac

SEQ ID NO: 987891 - DNA, 22 bp, Artificial Sequence
  chemically synthesized
gcagtgagcagaggtcaggcca

SEQ ID NO: 987892 - DNA, 22 bp, Artificial Sequence
  chemically synthesized
gagtgcagtggcctgacctctg

SEQ ID NO: 987893 - DNA, 22 bp, Artificial Sequence
  chemically synthesized
acctctgctcactgcaagctcc

SEQ ID NO: 987894 - DNA, 22 bp, Artificial Sequence
  chemically synthesized
tgctcactgcaagctccgcctc

SEQ ID NO: 987895 - DNA, 22 bp, Artificial Sequence
  chemically synthesized
ctcactgcaagctccgcctccc

SEQ ID NO: 987896 - DNA, 22 bp, Artificial Sequence
  chemically synthesized
actgcaagctccgcctcccggg

SEQ ID NO: 987897 - DNA, 22 bp, Artificial Sequence
  chemically synthesized
caagctccgcctcccgggttca

SEQ ID NO: 987898 - DNA, 22 bp, Artificial Sequence
  chemically synthesized
aggcaggagaatggcgtgaacc

SEQ ID NO: 987899 - DNA, 22 bp, Artificial Sequence
  chemically synthesized
cgcctcccgggttcacgccatt

SEQ ID NO: 987900 - DNA, 22 bp, Artificial Sequence
  chemically synthesized
ccgggttcacgccattctcctg

SEQ ID NO: 987901 - DNA, 22 bp, Artificial Sequence
  chemically synthesized
gggaggttaaggcaggagaatg

SEQ ID NO: 987902 - DNA, 22 bp, Artificial Sequence
  chemically synthesized
ctcgggaggttaaggcaggaga

SEQ ID NO: 987903 - DNA, 22 bp, Artificial Sequence
  chemically synthesized
acgccattctcctgccttaacc

SEQ ID NO: 987904 - DNA, 22 bp, Artificial Sequence
  chemically synthesized
tggtcccagctactcgggaggt

SEQ ID NO: 987905 - DNA, 22 bp, Artificial Sequence
  chemically synthesized
tcctgccttaacctcccgagta

SEQ ID NO: 987906 - DNA, 22 bp, Artificial Sequence
  chemically synthesized
ctgccttaacctcccgagtagc

SEQ ID NO: 987907 - DNA, 22 bp, Artificial Sequence
  chemically synthesized
ccttaacctcccgagtagctgg

SEQ ID NO: 987908 - DNA, 22 bp, Artificial Sequence
  chemically synthesized
aacctcccgagtagctgggacc

SEQ ID NO: 987909 - DNA, 22 bp, Artificial Sequence
  chemically synthesized
acctcccgagtagctgggacca

SEQ ID NO: 987910 - DNA, 22 bp, Artificial Sequence
  chemically synthesized
ccgagtagctgggaccacaggc

SEQ ID NO: 987911 - DNA, 22 bp, Artificial Sequence
  chemically synthesized
gccatgcgtggtggcgggcgcc

SEQ ID NO: 987912 - DNA, 22 bp, Artificial Sequence
  chemically synthesized
ggaccacaggcgcccgccacca

SEQ ID NO: 987913 - DNA, 22 bp, Artificial Sequence
  chemically synthesized
aaaaatacaaaaaaaaaaaaat

SEQ ID NO: 987914 - DNA, 22 bp, Artificial Sequence
  chemically synthesized
ctaaaaaatacaaaaaaaaaaa

SEQ ID NO: 987915 - DNA, 22 bp, Artificial Sequence
  chemically synthesized
tactaaaaaatacaaaaaaaaa

SEQ ID NO: 987916 - DNA, 22 bp, Artificial Sequence
  chemically synthesized
gtctctactaaaaaatacaaaa

SEQ ID NO: 987917 - DNA, 22 bp, Artificial Sequence
  chemically synthesized
atttttttttttttgtattttt

SEQ ID NO: 987918 - DNA, 22 bp, Artificial Sequence
  chemically synthesized
ttttttttttgtattttttagt

SEQ ID NO: 987919 - DNA, 22 bp, Artificial Sequence
  chemically synthesized
tttttttttgtattttttagta

SEQ ID NO: 987920 - DNA, 22 bp, Artificial Sequence
  chemically synthesized
ttttttttgtattttttagtag

SEQ ID NO: 987921 - DNA, 22 bp, Artificial Sequence
  chemically synthesized
tttttttgtattttttagtaga

SEQ ID NO: 987922 - DNA, 22 bp, Artificial Sequence
  chemically synthesized
ttttttgtattttttagtagag

SEQ ID NO: 987923 - DNA, 22 bp, Artificial Sequence
  chemically synthesized
tttttgtattttttagtagaga

SEQ ID NO: 987924 - DNA, 22 bp, Artificial Sequence
  chemically synthesized
ttttgtattttttagtagagac

SEQ ID NO: 987925 - DNA, 22 bp, Artificial Sequence
  chemically synthesized
tttgtattttttagtagagacg

SEQ ID NO: 987926 - DNA, 22 bp, Artificial Sequence
  chemically synthesized
ttgtattttttagtagagacga

SEQ ID NO: 987927 - DNA, 22 bp, Artificial Sequence
  chemically synthesized
tgtattttttagtagagacgag

SEQ ID NO: 987928 - DNA, 22 bp, Artificial Sequence
  chemically synthesized
acacggtgaaacctcgtctcta

SEQ ID NO: 987929 - DNA, 22 bp, Artificial Sequence
  chemically synthesized
gtattttttagtagagacgagg

SEQ ID NO: 987930 - DNA, 22 bp, Artificial Sequence
  chemically synthesized
tattttttagtagagacgaggt

SEQ ID NO: 987931 - DNA, 22 bp, Artificial Sequence
  chemically synthesized
gctaacacggtgaaacctcgtc

SEQ ID NO: 987932 - DNA, 22 bp, Artificial Sequence
  chemically synthesized
tttagtagagacgaggtttcac

SEQ ID NO: 987933 - DNA, 22 bp, Artificial Sequence
  chemically synthesized
ttagtagagacgaggtttcacc

SEQ ID NO: 987934 - DNA, 22 bp, Artificial Sequence
  chemically synthesized
tagtagagacgaggtttcaccg

SEQ ID NO: 987935 - DNA, 22 bp, Artificial Sequence
  chemically synthesized
agtagagacgaggtttcaccgt

SEQ ID NO: 987936 - DNA, 22 bp, Artificial Sequence
  chemically synthesized
gtagagacgaggtttcaccgtg

SEQ ID NO: 987937 - DNA, 22 bp, Artificial Sequence
  chemically synthesized
caccgtgttagccaggatggtc

SEQ ID NO: 987938 - DNA, 22 bp, Artificial Sequence
  chemically synthesized
accgtgttagccaggatggtct

SEQ ID NO: 987939 - DNA, 22 bp, Artificial Sequence
  chemically synthesized
gccaggatggtctcggtctcct

SEQ ID NO: 987940 - DNA, 22 bp, Artificial Sequence
  chemically synthesized
ggtctcctgacctcgtgatccg

SEQ ID NO: 987941 - DNA, 22 bp, Artificial Sequence
  chemically synthesized
ggaggccgaggcgggcggatca

SEQ ID NO: 987942 - DNA, 22 bp, Artificial Sequence
  chemically synthesized
gggaggccgaggcgggcggatc

SEQ ID NO: 987943 - DNA, 22 bp, Artificial Sequence
  chemically synthesized
tgggaggccgaggcgggcggat

SEQ ID NO: 987944 - DNA, 22 bp, Artificial Sequence
  chemically synthesized
ctgacctcgtgatccgcccgcc

SEQ ID NO: 987945 - DNA, 22 bp, Artificial Sequence
  chemically synthesized
acctcgtgatccgcccgcctcg

SEQ ID NO: 987946 - DNA, 22 bp, Artificial Sequence
  chemically synthesized
gtgatccgcccgcctcggcctc

SEQ ID NO: 987947 - DNA, 22 bp, Artificial Sequence
  chemically synthesized
taatcccagcactttgggaggc

SEQ ID NO: 987948 - DNA, 22 bp, Artificial Sequence
  chemically synthesized
acgcctgtaatcccagcacttt

SEQ ID NO: 987949 - DNA, 22 bp, Artificial Sequence
  chemically synthesized
ggcctcccaaagtgctgggatt

SEQ ID NO: 987950 - DNA, 22 bp, Artificial Sequence
  chemically synthesized
ccaaagtgctgggattacaggc

SEQ ID NO: 987951 - DNA, 22 bp, Artificial Sequence
  chemically synthesized
tggccgggcacggtggctcacg

SEQ ID NO: 987952 - DNA, 22 bp, Artificial Sequence
  chemically synthesized
gtggccgggcacggtggctcac

SEQ ID NO: 987953 - DNA, 22 bp, Artificial Sequence
  chemically synthesized
ggattacaggcgtgagccaccg

SEQ ID NO: 987954 - DNA, 22 bp, Artificial Sequence
  chemically synthesized
caggcgtgagccaccgtgcccg

SEQ ID NO: 987955 - DNA, 22 bp, Artificial Sequence
  chemically synthesized
gtagacagtaaacatataaaga

SEQ ID NO: 987956 - DNA, 22 bp, Artificial Sequence
  chemically synthesized
agtatctagtagacagtaaaca

SEQ ID NO: 987957 - DNA, 22 bp, Artificial Sequence
  chemically synthesized
cagtatctagtagacagtaaac

SEQ ID NO: 987958 - DNA, 22 bp, Artificial Sequence
  chemically synthesized
tatatgtttactgtctactaga

SEQ ID NO: 987959 - DNA, 22 bp, Artificial Sequence
  chemically synthesized
atatgtttactgtctactagat

SEQ ID NO: 987960 - DNA, 22 bp, Artificial Sequence
  chemically synthesized
tatgtttactgtctactagata

SEQ ID NO: 987961 - DNA, 22 bp, Artificial Sequence
  chemically synthesized
gtgaatgacagtcttcagtatc

SEQ ID NO: 987962 - DNA, 22 bp, Artificial Sequence
  chemically synthesized
actgtctactagatactgaaga

SEQ ID NO: 987963 - DNA, 22 bp, Artificial Sequence
  chemically synthesized
ctgtctactagatactgaagac

SEQ ID NO: 987964 - DNA, 22 bp, Artificial Sequence
  chemically synthesized
tctactagatactgaagactgt

SEQ ID NO: 987965 - DNA, 22 bp, Artificial Sequence
  chemically synthesized
ctagatactgaagactgtcatt

SEQ ID NO: 987966 - DNA, 22 bp, Artificial Sequence
  chemically synthesized
gatactgaagactgtcattcac

SEQ ID NO: 987967 - DNA, 22 bp, Artificial Sequence
  chemically synthesized
tacacagtgaccagttagtgaa

SEQ ID NO: 987968 - DNA, 22 bp, Artificial Sequence
  chemically synthesized
aagactgtcattcactaactgg

SEQ ID NO: 987969 - DNA, 22 bp, Artificial Sequence
  chemically synthesized
gttatacacagtgaccagttag

SEQ ID NO: 987970 - DNA, 22 bp, Artificial Sequence
  chemically synthesized
agttatacacagtgaccagtta

SEQ ID NO: 987971 - DNA, 22 bp, Artificial Sequence
  chemically synthesized
tcattcactaactggtcactgt

SEQ ID NO: 987972 - DNA, 22 bp, Artificial Sequence
  chemically synthesized
actaactggtcactgtgtataa

SEQ ID NO: 987973 - DNA, 22 bp, Artificial Sequence
  chemically synthesized
actggtcactgtgtataactaa

SEQ ID NO: 987974 - DNA, 22 bp, Artificial Sequence
  chemically synthesized
aaatacaaggatttagttatac

SEQ ID NO: 987975 - DNA, 22 bp, Artificial Sequence
  chemically synthesized
gtcactgtgtataactaaatcc

SEQ ID NO: 987976 - DNA, 22 bp, Artificial Sequence
  chemically synthesized
tgtataactaaatccttgtatt

SEQ ID NO: 987977 - DNA, 22 bp, Artificial Sequence
  chemically synthesized
ataatcacattgaaatacaagg

SEQ ID NO: 987978 - DNA, 22 bp, Artificial Sequence
  chemically synthesized
ggcctcataatcacattgaaat

SEQ ID NO: 987979 - DNA, 22 bp, Artificial Sequence
  chemically synthesized
gggcctcataatcacattgaaa

SEQ ID NO: 987980 - DNA, 22 bp, Artificial Sequence
  chemically synthesized
aatccttgtatttcaatgtgat

SEQ ID NO: 987981 - DNA, 22 bp, Artificial Sequence
  chemically synthesized
ttgggcctcataatcacattga

SEQ ID NO: 987982 - DNA, 22 bp, Artificial Sequence
  chemically synthesized
cttgggcctcataatcacattg

SEQ ID NO: 987983 - DNA, 22 bp, Artificial Sequence
  chemically synthesized
tcttgggcctcataatcacatt

SEQ ID NO: 987984 - DNA, 22 bp, Artificial Sequence
  chemically synthesized
gtatttcaatgtgattatgagg

SEQ ID NO: 987985 - DNA, 22 bp, Artificial Sequence
  chemically synthesized
tatttcaatgtgattatgaggc

SEQ ID NO: 987986 - DNA, 22 bp, Artificial Sequence
  chemically synthesized
caatgtgattatgaggcccaag

SEQ ID NO: 987987 - DNA, 22 bp, Artificial Sequence
  chemically synthesized
aatgtgattatgaggcccaaga

SEQ ID NO: 987988 - DNA, 22 bp, Artificial Sequence
  chemically synthesized
tgaggcccaagaaaatatgttt

SEQ ID NO: 987989 - DNA, 22 bp, Artificial Sequence
  chemically synthesized
ggtacccagaacgaaacatatt

SEQ ID NO: 987990 - DNA, 22 bp, Artificial Sequence
  chemically synthesized
ttaggtacccagaacgaaacat

SEQ ID NO: 987991 - DNA, 22 bp, Artificial Sequence
  chemically synthesized
attaggtacccagaacgaaaca

SEQ ID NO: 987992 - DNA, 22 bp, Artificial Sequence
  chemically synthesized
agagtttattaggtacccagaa

SEQ ID NO: 987993 - DNA, 22 bp, Artificial Sequence
  chemically synthesized
aagagtttattaggtacccaga

SEQ ID NO: 987994 - DNA, 22 bp, Artificial Sequence
  chemically synthesized
cgttctgggtacctaataaact

SEQ ID NO: 987995 - DNA, 22 bp, Artificial Sequence
  chemically synthesized
gttctgggtacctaataaactc

SEQ ID NO: 987996 - DNA, 22 bp, Artificial Sequence
  chemically synthesized
tgggtacctaataaactcttaa

SEQ ID NO: 987997 - DNA, 22 bp, Artificial Sequence
  chemically synthesized
ggtacctaataaactcttaaga

SEQ ID NO: 987998 - DNA, 22 bp, Artificial Sequence
  chemically synthesized
tgggagatgggcaagtcttaag

SEQ ID NO: 987999 - DNA, 22 bp, Artificial Sequence
  chemically synthesized
gtgggagatgggcaagtcttaa

SEQ ID NO: 988000 - DNA, 22 bp, Artificial Sequence
  chemically synthesized
ataaactcttaagacttgccca

SEQ ID NO: 988001 - DNA, 22 bp, Artificial Sequence
  chemically synthesized
cagtttgtgggagatgggcaag

SEQ ID NO: 988002 - DNA, 22 bp, Artificial Sequence
  chemically synthesized
cctacagtttgtgggagatggg

SEQ ID NO: 988003 - DNA, 22 bp, Artificial Sequence
  chemically synthesized
gcctacagtttgtgggagatgg

SEQ ID NO: 988004 - DNA, 22 bp, Artificial Sequence
  chemically synthesized
ttaagacttgcccatctcccac

SEQ ID NO: 988005 - DNA, 22 bp, Artificial Sequence
  chemically synthesized
aagacttgcccatctcccacaa

SEQ ID NO: 988006 - DNA, 22 bp, Artificial Sequence
  chemically synthesized
tttgcctacagtttgtgggaga

SEQ ID NO: 988007 - DNA, 22 bp, Artificial Sequence
  chemically synthesized
agacttgcccatctcccacaaa

SEQ ID NO: 988008 - DNA, 22 bp, Artificial Sequence
  chemically synthesized
gcccatctcccacaaactgtag

SEQ ID NO: 988009 - DNA, 22 bp, Artificial Sequence
  chemically synthesized
cccatctcccacaaactgtagg

SEQ ID NO: 988010 - DNA, 22 bp, Artificial Sequence
  chemically synthesized
gaagaattatttgcctacagtt

SEQ ID NO: 988011 - DNA, 22 bp, Artificial Sequence
  chemically synthesized
ccacaaactgtaggcaaataat

SEQ ID NO: 988012 - DNA, 22 bp, Artificial Sequence
  chemically synthesized
taggcaaataattcttctaatc

SEQ ID NO: 988013 - DNA, 22 bp, Artificial Sequence
  chemically synthesized
ataaagaaataaaagcagatta

SEQ ID NO: 988014 - DNA, 22 bp, Artificial Sequence
  chemically synthesized
aataaagaaataaaagcagatt

SEQ ID NO: 988015 - DNA, 22 bp, Artificial Sequence
  chemically synthesized
tcttaataaagaaataaaagca

SEQ ID NO: 988016 - DNA, 22 bp, Artificial Sequence
  chemically synthesized
atcttaataaagaaataaaagc

SEQ ID NO: 988017 - DNA, 22 bp, Artificial Sequence
  chemically synthesized
tatcttaataaagaaataaaag

SEQ ID NO: 988018 - DNA, 22 bp, Artificial Sequence
  chemically synthesized
ttctaatctgcttttatttctt

SEQ ID NO: 988019 - DNA, 22 bp, Artificial Sequence
  chemically synthesized
ctaatctgcttttatttcttta

SEQ ID NO: 988020 - DNA, 22 bp, Artificial Sequence
  chemically synthesized
taatctgcttttatttctttat

SEQ ID NO: 988021 - DNA, 22 bp, Artificial Sequence
  chemically synthesized
atctgcttttatttctttatta

SEQ ID NO: 988022 - DNA, 22 bp, Artificial Sequence
  chemically synthesized
aaatgctttatcttaataaaga

SEQ ID NO: 988023 - DNA, 22 bp, Artificial Sequence
  chemically synthesized
cttttatttctttattaagata

SEQ ID NO: 988024 - DNA, 22 bp, Artificial Sequence
  chemically synthesized
ttatttctttattaagataaag

SEQ ID NO: 988025 - DNA, 22 bp, Artificial Sequence
  chemically synthesized
tgacctcaaatgctttatctta

SEQ ID NO: 988026 - DNA, 22 bp, Artificial Sequence
  chemically synthesized
tatttctttattaagataaagc

SEQ ID NO: 988027 - DNA, 22 bp, Artificial Sequence
  chemically synthesized
atttctttattaagataaagca

SEQ ID NO: 988028 - DNA, 22 bp, Artificial Sequence
  chemically synthesized
tttctttattaagataaagcat

SEQ ID NO: 988029 - DNA, 22 bp, Artificial Sequence
  chemically synthesized
ctttattaagataaagcatttg

SEQ ID NO: 988030 - DNA, 22 bp, Artificial Sequence
  chemically synthesized
tttattaagataaagcatttga

SEQ ID NO: 988031 - DNA, 22 bp, Artificial Sequence
  chemically synthesized
tattaagataaagcatttgagg

SEQ ID NO: 988032 - DNA, 22 bp, Artificial Sequence
  chemically synthesized
attaagataaagcatttgaggt

SEQ ID NO: 988033 - DNA, 22 bp, Artificial Sequence
  chemically synthesized
ttaagataaagcatttgaggtc

SEQ ID NO: 988034 - DNA, 22 bp, Artificial Sequence
  chemically synthesized
catagaacattgtgacctcaaa

SEQ ID NO: 988035 - DNA, 22 bp, Artificial Sequence
  chemically synthesized
ccatagaacattgtgacctcaa

SEQ ID NO: 988036 - DNA, 22 bp, Artificial Sequence
  chemically synthesized
agataaagcatttgaggtcaca

SEQ ID NO: 988037 - DNA, 22 bp, Artificial Sequence
  chemically synthesized
gatttccatagaacattgtgac

SEQ ID NO: 988038 - DNA, 22 bp, Artificial Sequence
  chemically synthesized
tagatttccatagaacattgtg

SEQ ID NO: 988039 - DNA, 22 bp, Artificial Sequence
  chemically synthesized
ctagatttccatagaacattgt

SEQ ID NO: 988040 - DNA, 22 bp, Artificial Sequence
  chemically synthesized
gaggtcacaatgttctatggaa

SEQ ID NO: 988041 - DNA, 22 bp, Artificial Sequence
  chemically synthesized
aggtcacaatgttctatggaaa

SEQ ID NO: 988042 - DNA, 22 bp, Artificial Sequence
  chemically synthesized
ggaatttctagatttccataga

SEQ ID NO: 988043 - DNA, 22 bp, Artificial Sequence
  chemically synthesized
aggaatttctagatttccatag

SEQ ID NO: 988044 - DNA, 22 bp, Artificial Sequence
  chemically synthesized
ccttaggaatttctagatttcc

SEQ ID NO: 988045 - DNA, 22 bp, Artificial Sequence
  chemically synthesized
gccttaggaatttctagatttc

SEQ ID NO: 988046 - DNA, 22 bp, Artificial Sequence
  chemically synthesized
tgccttaggaatttctagattt

SEQ ID NO: 988047 - DNA, 22 bp, Artificial Sequence
  chemically synthesized
gattttgccttaggaatttcta

SEQ ID NO: 988048 - DNA, 22 bp, Artificial Sequence
  chemically synthesized
tatggaaatctagaaattccta

SEQ ID NO: 988049 - DNA, 22 bp, Artificial Sequence
  chemically synthesized
tggaaatctagaaattcctaag

SEQ ID NO: 988050 - DNA, 22 bp, Artificial Sequence
  chemically synthesized
tgtcacctagattttgccttag

SEQ ID NO: 988051 - DNA, 22 bp, Artificial Sequence
  chemically synthesized
gaaattcctaaggcaaaatcta

SEQ ID NO: 988052 - DNA, 22 bp, Artificial Sequence
  chemically synthesized
taattgtgtcacctagattttg

SEQ ID NO: 988053 - DNA, 22 bp, Artificial Sequence
  chemically synthesized
tataattgtgtcacctagattt

SEQ ID NO: 988054 - DNA, 22 bp, Artificial Sequence
  chemically synthesized
ctataattgtgtcacctagatt

SEQ ID NO: 988055 - DNA, 22 bp, Artificial Sequence
  chemically synthesized
ctaaggcaaaatctaggtgaca

SEQ ID NO: 988056 - DNA, 22 bp, Artificial Sequence
  chemically synthesized
aggcaaaatctaggtgacacaa

SEQ ID NO: 988057 - DNA, 22 bp, Artificial Sequence
  chemically synthesized
cggcatcttctataattgtgtc

SEQ ID NO: 988058 - DNA, 22 bp, Artificial Sequence
  chemically synthesized
ggtgacacaattatagaagatg

SEQ ID NO: 988059 - DNA, 22 bp, Artificial Sequence
  chemically synthesized
agggaaatcagttgcggcatct

SEQ ID NO: 988060 - DNA, 22 bp, Artificial Sequence
  chemically synthesized
gagggaaatcagttgcggcatc

SEQ ID NO: 988061 - DNA, 22 bp, Artificial Sequence
  chemically synthesized
tagaagatgccgcaactgattt

SEQ ID NO: 988062 - DNA, 22 bp, Artificial Sequence
  chemically synthesized
tggcaacagaaatgtgcttgag

SEQ ID NO: 988063 - DNA, 22 bp, Artificial Sequence
  chemically synthesized
tatggcaacagaaatgtgcttg

SEQ ID NO: 988064 - DNA, 22 bp, Artificial Sequence
  chemically synthesized
atttccctcaagcacatttctg

SEQ ID NO: 988065 - DNA, 22 bp, Artificial Sequence
  chemically synthesized
ccctcaagcacatttctgttgc

SEQ ID NO: 988066 - DNA, 22 bp, Artificial Sequence
  chemically synthesized
cctcaagcacatttctgttgcc

SEQ ID NO: 988067 - DNA, 22 bp, Artificial Sequence
  chemically synthesized
agatgattctatggcaacagaa

SEQ ID NO: 988068 - DNA, 22 bp, Artificial Sequence
  chemically synthesized
gagatgattctatggcaacaga

SEQ ID NO: 988069 - DNA, 22 bp, Artificial Sequence
  chemically synthesized
aagcacatttctgttgccatag

SEQ ID NO: 988070 - DNA, 22 bp, Artificial Sequence
  chemically synthesized
gcagatttgagatgattctatg

SEQ ID NO: 988071 - DNA, 22 bp, Artificial Sequence
  chemically synthesized
ctgttgccatagaatcatctca

SEQ ID NO: 988072 - DNA, 22 bp, Artificial Sequence
  chemically synthesized
tgttgccatagaatcatctcaa

SEQ ID NO: 988073 - DNA, 22 bp, Artificial Sequence
  chemically synthesized
aaagttggcagatttgagatga

SEQ ID NO: 988074 - DNA, 22 bp, Artificial Sequence
  chemically synthesized
ttgccatagaatcatctcaaat

SEQ ID NO: 988075 - DNA, 22 bp, Artificial Sequence
  chemically synthesized
caaagttggcagatttgagatg

SEQ ID NO: 988076 - DNA, 22 bp, Artificial Sequence
  chemically synthesized
ccatagaatcatctcaaatctg

SEQ ID NO: 988077 - DNA, 22 bp, Artificial Sequence
  chemically synthesized
agcttcaaagttggcagatttg

SEQ ID NO: 988078 - DNA, 22 bp, Artificial Sequence
  chemically synthesized
aaatctgccaactttgaagctg

SEQ ID NO: 988079 - DNA, 22 bp, Artificial Sequence
  chemically synthesized
ccaactttgaagctgaactcct

SEQ ID NO: 988080 - DNA, 22 bp, Artificial Sequence
  chemically synthesized
tgaagctgaactcctctccatt

SEQ ID NO: 988081 - DNA, 22 bp, Artificial Sequence
  chemically synthesized
gaagctgaactcctctccattc

SEQ ID NO: 988082 - DNA, 22 bp, Artificial Sequence
  chemically synthesized
aagctgaactcctctccattcc

SEQ ID NO: 988083 - DNA, 22 bp, Artificial Sequence
  chemically synthesized
aactcctctccattccactcat

SEQ ID NO: 988084 - DNA, 22 bp, Artificial Sequence
  chemically synthesized
ctctccattccactcatatgga

SEQ ID NO: 988085 - DNA, 22 bp, Artificial Sequence
  chemically synthesized
tccattccactcatatggattc

SEQ ID NO: 988086 - DNA, 22 bp, Artificial Sequence
  chemically synthesized
aaacccatgtgagaatccatat

SEQ ID NO: 988087 - DNA, 22 bp, Artificial Sequence
  chemically synthesized
cattccactcatatggattctc

SEQ ID NO: 988088 - DNA, 22 bp, Artificial Sequence
  chemically synthesized
ctaaaacccatgtgagaatcca

SEQ ID NO: 988089 - DNA, 22 bp, Artificial Sequence
  chemically synthesized
tactaaaacccatgtgagaatc

SEQ ID NO: 988090 - DNA, 22 bp, Artificial Sequence
  chemically synthesized
ctactaaaacccatgtgagaat

SEQ ID NO: 988091 - DNA, 22 bp, Artificial Sequence
  chemically synthesized
cactcatatggattctcacatg

SEQ ID NO: 988092 - DNA, 22 bp, Artificial Sequence
  chemically synthesized
tctactaaaacccatgtgagaa

SEQ ID NO: 988093 - DNA, 22 bp, Artificial Sequence
  chemically synthesized
ttctactaaaacccatgtgaga

SEQ ID NO: 988094 - DNA, 22 bp, Artificial Sequence
  chemically synthesized
atatggattctcacatgggttt

SEQ ID NO: 988095 - DNA, 22 bp, Artificial Sequence
  chemically synthesized
aatttttctactaaaacccatg

SEQ ID NO: 988096 - DNA, 22 bp, Artificial Sequence
  chemically synthesized
aaatttttctactaaaacccat

SEQ ID NO: 988097 - DNA, 22 bp, Artificial Sequence
  chemically synthesized
atagtttaaatttttctactaa

SEQ ID NO: 988098 - DNA, 22 bp, Artificial Sequence
  chemically synthesized
tcacatgggttttagtagaaaa

SEQ ID NO: 988099 - DNA, 22 bp, Artificial Sequence
  chemically synthesized
taatagtttaaatttttctact

SEQ ID NO: 988100 - DNA, 22 bp, Artificial Sequence
  chemically synthesized
acatgggttttagtagaaaaat

SEQ ID NO: 988101 - DNA, 22 bp, Artificial Sequence
  chemically synthesized
tagtagaaaaatttaaactatt

SEQ ID NO: 988102 - DNA, 22 bp, Artificial Sequence
  chemically synthesized
agtagaaaaatttaaactatta

SEQ ID NO: 988103 - DNA, 22 bp, Artificial Sequence
  chemically synthesized
gtagaaaaatttaaactattag

SEQ ID NO: 988104 - DNA, 22 bp, Artificial Sequence
  chemically synthesized
aaactattagaacatggactga

SEQ ID NO: 988105 - DNA, 22 bp, Artificial Sequence
  chemically synthesized
aactattagaacatggactgat

SEQ ID NO: 988106 - DNA, 22 bp, Artificial Sequence
  chemically synthesized
ataatccagagaaaaatcagtc

SEQ ID NO: 988107 - DNA, 22 bp, Artificial Sequence
  chemically synthesized
aataatccagagaaaaatcagt

SEQ ID NO: 988108 - DNA, 22 bp, Artificial Sequence
  chemically synthesized
ttagaacatggactgatttttc

SEQ ID NO: 988109 - DNA, 22 bp, Artificial Sequence
  chemically synthesized
gaacatggactgatttttctct

SEQ ID NO: 988110 - DNA, 22 bp, Artificial Sequence
  chemically synthesized
atttaataatccagagaaaaat

SEQ ID NO: 988111 - DNA, 22 bp, Artificial Sequence
  chemically synthesized
tcatttaataatccagagaaaa

SEQ ID NO: 988112 - DNA, 22 bp, Artificial Sequence
  chemically synthesized
ctcatttaataatccagagaaa

SEQ ID NO: 988113 - DNA, 22 bp, Artificial Sequence
  chemically synthesized
atttttctctggattattaaat

SEQ ID NO: 988114 - DNA, 22 bp, Artificial Sequence
  chemically synthesized
ttctctggattattaaatgaga

SEQ ID NO: 988115 - DNA, 22 bp, Artificial Sequence
  chemically synthesized
tctctggattattaaatgagaa

SEQ ID NO: 988116 - DNA, 22 bp, Artificial Sequence
  chemically synthesized
ctctggattattaaatgagaag

SEQ ID NO: 988117 - DNA, 22 bp, Artificial Sequence
  chemically synthesized
tctggattattaaatgagaagg

SEQ ID NO: 988118 - DNA, 22 bp, Artificial Sequence
  chemically synthesized
tggattattaaatgagaagggt

SEQ ID NO: 988119 - DNA, 22 bp, Artificial Sequence
  chemically synthesized
gattattaaatgagaagggtct

SEQ ID NO: 988120 - DNA, 22 bp, Artificial Sequence
  chemically synthesized
ttaaatgagaagggtctggatt

SEQ ID NO: 988121 - DNA, 22 bp, Artificial Sequence
  chemically synthesized
gaaaagtaatggggaatccaga

SEQ ID NO: 988122 - DNA, 22 bp, Artificial Sequence
  chemically synthesized
aatgagaagggtctggattccc

SEQ ID NO: 988123 - DNA, 22 bp, Artificial Sequence
  chemically synthesized
attagaaaagtaatggggaatc

SEQ ID NO: 988124 - DNA, 22 bp, Artificial Sequence
  chemically synthesized
aattagaaaagtaatggggaat

SEQ ID NO: 988125 - DNA, 22 bp, Artificial Sequence
  chemically synthesized
taattagaaaagtaatggggaa

SEQ ID NO: 988126 - DNA, 22 bp, Artificial Sequence
  chemically synthesized
ttttaattagaaaagtaatggg

SEQ ID NO: 988127 - DNA, 22 bp, Artificial Sequence
  chemically synthesized
atactattttaattagaaaagt

SEQ ID NO: 988128 - DNA, 22 bp, Artificial Sequence
  chemically synthesized
gattccccattacttttctaat

SEQ ID NO: 988129 - DNA, 22 bp, Artificial Sequence
  chemically synthesized
gatactattttaattagaaaag

SEQ ID NO: 988130 - DNA, 22 bp, Artificial Sequence
  chemically synthesized
tgatactattttaattagaaaa

SEQ ID NO: 988131 - DNA, 22 bp, Artificial Sequence
  chemically synthesized
ttgatactattttaattagaaa

SEQ ID NO: 988132 - DNA, 22 bp, Artificial Sequence
  chemically synthesized
cccattacttttctaattaaaa

SEQ ID NO: 988133 - DNA, 22 bp, Artificial Sequence
  chemically synthesized
cttttgatactattttaattag

SEQ ID NO: 988134 - DNA, 22 bp, Artificial Sequence
  chemically synthesized
gcttttgatactattttaatta

SEQ ID NO: 988135 - DNA, 22 bp, Artificial Sequence
  chemically synthesized
tgcttttgatactattttaatt

SEQ ID NO: 988136 - DNA, 22 bp, Artificial Sequence
  chemically synthesized
tctttgcttttgatactatttt

SEQ ID NO: 988137 - DNA, 22 bp, Artificial Sequence
  chemically synthesized
cttttctaattaaaatagtatc

SEQ ID NO: 988138 - DNA, 22 bp, Artificial Sequence
  chemically synthesized
gtctttgcttttgatactattt

SEQ ID NO: 988139 - DNA, 22 bp, Artificial Sequence
  chemically synthesized
ttctaattaaaatagtatcaaa

SEQ ID NO: 988140 - DNA, 22 bp, Artificial Sequence
  chemically synthesized
tctaattaaaatagtatcaaaa

SEQ ID NO: 988141 - DNA, 22 bp, Artificial Sequence
  chemically synthesized
gtttgtctttgcttttgatact

SEQ ID NO: 988142 - DNA, 22 bp, Artificial Sequence
  chemically synthesized
ctaattaaaatagtatcaaaag

SEQ ID NO: 988143 - DNA, 22 bp, Artificial Sequence
  chemically synthesized
taattaaaatagtatcaaaagc

SEQ ID NO: 988144 - DNA, 22 bp, Artificial Sequence
  chemically synthesized
attaaaatagtatcaaaagcaa

SEQ ID NO: 988145 - DNA, 22 bp, Artificial Sequence
  chemically synthesized
aggattggtttgtctttgcttt

SEQ ID NO: 988146 - DNA, 22 bp, Artificial Sequence
  chemically synthesized
aaatagtatcaaaagcaaagac

SEQ ID NO: 988147 - DNA, 22 bp, Artificial Sequence
  chemically synthesized
taatatacatgctgaggattgg

SEQ ID NO: 988148 - DNA, 22 bp, Artificial Sequence
  chemically synthesized
tgtaatatacatgctgaggatt

SEQ ID NO: 988149 - DNA, 22 bp, Artificial Sequence
  chemically synthesized
tctgtaatatacatgctgagga

SEQ ID NO: 988150 - DNA, 22 bp, Artificial Sequence
  chemically synthesized
taacaggttctctgtaatatac

SEQ ID NO: 988151 - DNA, 22 bp, Artificial Sequence
  chemically synthesized
tgtaacaggttctctgtaatat

SEQ ID NO: 988152 - DNA, 22 bp, Artificial Sequence
  chemically synthesized
agcatgtatattacagagaacc

SEQ ID NO: 988153 - DNA, 22 bp, Artificial Sequence
  chemically synthesized
ataatgtctctgtaacaggttc

SEQ ID NO: 988154 - DNA, 22 bp, Artificial Sequence
  chemically synthesized
gataatgtctctgtaacaggtt

SEQ ID NO: 988155 - DNA, 22 bp, Artificial Sequence
  chemically synthesized
cagagaacctgttacagagaca

SEQ ID NO: 988156 - DNA, 22 bp, Artificial Sequence
  chemically synthesized
ccaaaaatatggccttgataat

SEQ ID NO: 988157 - DNA, 22 bp, Artificial Sequence
  chemically synthesized
accaaaaatatggccttgataa

SEQ ID NO: 988158 - DNA, 22 bp, Artificial Sequence
  chemically synthesized
ttacagagacattatcaaggcc

SEQ ID NO: 988159 - DNA, 22 bp, Artificial Sequence
  chemically synthesized
taccaaaaatatggccttgata

SEQ ID NO: 988160 - DNA, 22 bp, Artificial Sequence
  chemically synthesized
cagagacattatcaaggccata

SEQ ID NO: 988161 - DNA, 22 bp, Artificial Sequence
  chemically synthesized
agtaattttaccaaaaatatgg

SEQ ID NO: 988162 - DNA, 22 bp, Artificial Sequence
  chemically synthesized
aagtaattttaccaaaaatatg

SEQ ID NO: 988163 - DNA, 22 bp, Artificial Sequence
  chemically synthesized
taagtaattttaccaaaaatat

SEQ ID NO: 988164 - DNA, 22 bp, Artificial Sequence
  chemically synthesized
tcaaggccatatttttggtaaa

SEQ ID NO: 988165 - DNA, 22 bp, Artificial Sequence
  chemically synthesized
aatcagattttaagtaatttta

SEQ ID NO: 988166 - DNA, 22 bp, Artificial Sequence
  chemically synthesized
ttcaatcagattttaagtaatt

SEQ ID NO: 988167 - DNA, 22 bp, Artificial Sequence
  chemically synthesized
attcaatcagattttaagtaat

SEQ ID NO: 988168 - DNA, 22 bp, Artificial Sequence
  chemically synthesized
tattcaatcagattttaagtaa

SEQ ID NO: 988169 - DNA, 22 bp, Artificial Sequence
  chemically synthesized
ttattcaatcagattttaagta

SEQ ID NO: 988170 - DNA, 22 bp, Artificial Sequence
  chemically synthesized
ttggtaaaattacttaaaatct

SEQ ID NO: 988171 - DNA, 22 bp, Artificial Sequence
  chemically synthesized
tggtaaaattacttaaaatctg

SEQ ID NO: 988172 - DNA, 22 bp, Artificial Sequence
  chemically synthesized
ggtaaaattacttaaaatctga

SEQ ID NO: 988173 - DNA, 22 bp, Artificial Sequence
  chemically synthesized
gtaaaattacttaaaatctgat

SEQ ID NO: 988174 - DNA, 22 bp, Artificial Sequence
  chemically synthesized
gaggcaacttttattcaatcag

SEQ ID NO: 988175 - DNA, 22 bp, Artificial Sequence
  chemically synthesized
cttaaaatctgattgaataaaa

SEQ ID NO: 988176 - DNA, 22 bp, Artificial Sequence
  chemically synthesized
aaaatctgattgaataaaagtt

SEQ ID NO: 988177 - DNA, 22 bp, Artificial Sequence
  chemically synthesized
aaatctgattgaataaaagttg

SEQ ID NO: 988178 - DNA, 22 bp, Artificial Sequence
  chemically synthesized
atataaacgaattagaggcaac

SEQ ID NO: 988179 - DNA, 22 bp, Artificial Sequence
  chemically synthesized
attgaataaaagttgcctctaa

SEQ ID NO: 988180 - DNA, 22 bp, Artificial Sequence
  chemically synthesized
ttaatataaacgaattagaggc

SEQ ID NO: 988181 - DNA, 22 bp, Artificial Sequence
  chemically synthesized
aataaaagttgcctctaattcg

SEQ ID NO: 988182 - DNA, 22 bp, Artificial Sequence
  chemically synthesized
aagtgctattaatataaacgaa

SEQ ID NO: 988183 - DNA, 22 bp, Artificial Sequence
  chemically synthesized
aaagtgctattaatataaacga

SEQ ID NO: 988184 - DNA, 22 bp, Artificial Sequence
  chemically synthesized
taaagtgctattaatataaacg

SEQ ID NO: 988185 - DNA, 22 bp, Artificial Sequence
  chemically synthesized
cctctaattcgtttatattaat

SEQ ID NO: 988186 - DNA, 22 bp, Artificial Sequence
  chemically synthesized
ctttaaagtgctattaatataa

SEQ ID NO: 988187 - DNA, 22 bp, Artificial Sequence
  chemically synthesized
taattcgtttatattaatagca

SEQ ID NO: 988188 - DNA, 22 bp, Artificial Sequence
  chemically synthesized
attcgtttatattaatagcact

SEQ ID NO: 988189 - DNA, 22 bp, Artificial Sequence
  chemically synthesized
gtttatattaatagcactttaa

SEQ ID NO: 988190 - DNA, 22 bp, Artificial Sequence
  chemically synthesized
atattaatagcactttaaagta

SEQ ID NO: 988191 - DNA, 22 bp, Artificial Sequence
  chemically synthesized
tattaatagcactttaaagtaa

SEQ ID NO: 988192 - DNA, 22 bp, Artificial Sequence
  chemically synthesized
tatccgtatgtattactttaaa

SEQ ID NO: 988193 - DNA, 22 bp, Artificial Sequence
  chemically synthesized
atagcactttaaagtaatacat

SEQ ID NO: 988194 - DNA, 22 bp, Artificial Sequence
  chemically synthesized
aagttgtatccgtatgtattac

SEQ ID NO: 988195 - DNA, 22 bp, Artificial Sequence
  chemically synthesized
aaagttgtatccgtatgtatta

SEQ ID NO: 988196 - DNA, 22 bp, Artificial Sequence
  chemically synthesized
taaagttgtatccgtatgtatt

SEQ ID NO: 988197 - DNA, 22 bp, Artificial Sequence
  chemically synthesized
ttaaagttgtatccgtatgtat

SEQ ID NO: 988198 - DNA, 22 bp, Artificial Sequence
  chemically synthesized
tttaaagttgtatccgtatgta

SEQ ID NO: 988199 - DNA, 22 bp, Artificial Sequence
  chemically synthesized
taaagtaatacatacggataca

SEQ ID NO: 988200 - DNA, 22 bp, Artificial Sequence
  chemically synthesized
aaagtaatacatacggatacaa

SEQ ID NO: 988201 - DNA, 22 bp, Artificial Sequence
  chemically synthesized
aagtaatacatacggatacaac

SEQ ID NO: 988202 - DNA, 22 bp, Artificial Sequence
  chemically synthesized
taaaaagttgggatttatctta

SEQ ID NO: 988203 - DNA, 22 bp, Artificial Sequence
  chemically synthesized
aaaaagttgggatttatcttat

SEQ ID NO: 988204 - DNA, 22 bp, Artificial Sequence
  chemically synthesized
aaaagttgggatttatcttatt

SEQ ID NO: 988205 - DNA, 22 bp, Artificial Sequence
  chemically synthesized
acaggacataataataagataa

SEQ ID NO: 988206 - DNA, 22 bp, Artificial Sequence
  chemically synthesized
aacaggacataataataagata

SEQ ID NO: 988207 - DNA, 22 bp, Artificial Sequence
  chemically synthesized
taacaggacataataataagat

SEQ ID NO: 988208 - DNA, 22 bp, Artificial Sequence
  chemically synthesized
ggatttatcttattattatgtc

SEQ ID NO: 988209 - DNA, 22 bp, Artificial Sequence
  chemically synthesized
taagcgtattttaacaggacat

SEQ ID NO: 988210 - DNA, 22 bp, Artificial Sequence
  chemically synthesized
atcttattattatgtcctgtta

SEQ ID NO: 988211 - DNA, 22 bp, Artificial Sequence
  chemically synthesized
ataagcgtattttaacaggaca

SEQ ID NO: 988212 - DNA, 22 bp, Artificial Sequence
  chemically synthesized
tcttattattatgtcctgttaa

SEQ ID NO: 988213 - DNA, 22 bp, Artificial Sequence
  chemically synthesized
cttataagcgtattttaacagg

SEQ ID NO: 988214 - DNA, 22 bp, Artificial Sequence
  chemically synthesized
ccttataagcgtattttaacag

SEQ ID NO: 988215 - DNA, 22 bp, Artificial Sequence
  chemically synthesized
attattatgtcctgttaaaata

SEQ ID NO: 988216 - DNA, 22 bp, Artificial Sequence
  chemically synthesized
ttattatgtcctgttaaaatac

SEQ ID NO: 988217 - DNA, 22 bp, Artificial Sequence
  chemically synthesized
ttatgtcctgttaaaatacgct

SEQ ID NO: 988218 - DNA, 22 bp, Artificial Sequence
  chemically synthesized
gtcttccttataagcgtatttt

SEQ ID NO: 988219 - DNA, 22 bp, Artificial Sequence
  chemically synthesized
ggtcttccttataagcgtattt

SEQ ID NO: 988220 - DNA, 22 bp, Artificial Sequence
  chemically synthesized
tggtcttccttataagcgtatt

SEQ ID NO: 988221 - DNA, 22 bp, Artificial Sequence
  chemically synthesized
tgtcctgttaaaatacgcttat

SEQ ID NO: 988222 - DNA, 22 bp, Artificial Sequence
  chemically synthesized
ttggtcttccttataagcgtat

SEQ ID NO: 988223 - DNA, 22 bp, Artificial Sequence
  chemically synthesized
tttggtcttccttataagcgta

SEQ ID NO: 988224 - DNA, 22 bp, Artificial Sequence
  chemically synthesized
tttttggtcttccttataagcg

SEQ ID NO: 988225 - DNA, 22 bp, Artificial Sequence
  chemically synthesized
ttaaaatacgcttataaggaag

SEQ ID NO: 988226 - DNA, 22 bp, Artificial Sequence
  chemically synthesized
aaatacgcttataaggaagacc

SEQ ID NO: 988227 - DNA, 22 bp, Artificial Sequence
  chemically synthesized
atcagtgtactctttttggtct

SEQ ID NO: 988228 - DNA, 22 bp, Artificial Sequence
  chemically synthesized
ataaggaagaccaaaaagagta

SEQ ID NO: 988229 - DNA, 22 bp, Artificial Sequence
  chemically synthesized
taaggaagaccaaaaagagtac

SEQ ID NO: 988230 - DNA, 22 bp, Artificial Sequence
  chemically synthesized
aaagatcctcatcagtgtactc

SEQ ID NO: 988231 - DNA, 22 bp, Artificial Sequence
  chemically synthesized
tcaaagatcctcatcagtgtac

SEQ ID NO: 988232 - DNA, 22 bp, Artificial Sequence
  chemically synthesized
ctcaaagatcctcatcagtgta

SEQ ID NO: 988233 - DNA, 22 bp, Artificial Sequence
  chemically synthesized
tctcaaagatcctcatcagtgt

SEQ ID NO: 988234 - DNA, 22 bp, Artificial Sequence
  chemically synthesized
attttctcaaagatcctcatca

SEQ ID NO: 988235 - DNA, 22 bp, Artificial Sequence
  chemically synthesized
aattttctcaaagatcctcatc

SEQ ID NO: 988236 - DNA, 22 bp, Artificial Sequence
  chemically synthesized
taattttctcaaagatcctcat

SEQ ID NO: 988237 - DNA, 22 bp, Artificial Sequence
  chemically synthesized
ttaattttctcaaagatcctca

SEQ ID NO: 988238 - DNA, 22 bp, Artificial Sequence
  chemically synthesized
atttttaattttctcaaagatc

SEQ ID NO: 988239 - DNA, 22 bp, Artificial Sequence
  chemically synthesized
catttttaattttctcaaagat

SEQ ID NO: 988240 - DNA, 22 bp, Artificial Sequence
  chemically synthesized
tcatttttaattttctcaaaga

SEQ ID NO: 988241 - DNA, 22 bp, Artificial Sequence
  chemically synthesized
ttttcatttttaattttctcaa

SEQ ID NO: 988242 - DNA, 22 bp, Artificial Sequence
  chemically synthesized
atgaggatctttgagaaaatta

SEQ ID NO: 988243 - DNA, 22 bp, Artificial Sequence
  chemically synthesized
ttgttttcatttttaattttct

SEQ ID NO: 988244 - DNA, 22 bp, Artificial Sequence
  chemically synthesized
ttattgttttcatttttaattt

SEQ ID NO: 988245 - DNA, 22 bp, Artificial Sequence
  chemically synthesized
attattgttttcatttttaatt

SEQ ID NO: 988246 - DNA, 22 bp, Artificial Sequence
  chemically synthesized
tttattattgttttcattttta

SEQ ID NO: 988247 - DNA, 22 bp, Artificial Sequence
  chemically synthesized
atttattattgttttcattttt

SEQ ID NO: 988248 - DNA, 22 bp, Artificial Sequence
  chemically synthesized
tatttattattgttttcatttt

SEQ ID NO: 988249 - DNA, 22 bp, Artificial Sequence
  chemically synthesized
tgagaaaattaaaaatgaaaac

SEQ ID NO: 988250 - DNA, 22 bp, Artificial Sequence
  chemically synthesized
gagaaaattaaaaatgaaaaca

SEQ ID NO: 988251 - DNA, 22 bp, Artificial Sequence
  chemically synthesized
agaaaattaaaaatgaaaacaa

SEQ ID NO: 988252 - DNA, 22 bp, Artificial Sequence
  chemically synthesized
aaaatgaaaacaataataaata

SEQ ID NO: 988253 - DNA, 22 bp, Artificial Sequence
  chemically synthesized
gccatgacaattttatttatta

SEQ ID NO: 988254 - DNA, 22 bp, Artificial Sequence
  chemically synthesized
agccatgacaattttatttatt

SEQ ID NO: 988255 - DNA, 22 bp, Artificial Sequence
  chemically synthesized
tagccatgacaattttatttat

SEQ ID NO: 988256 - DNA, 22 bp, Artificial Sequence
  chemically synthesized
ttagccatgacaattttattta

SEQ ID NO: 988257 - DNA, 22 bp, Artificial Sequence
  chemically synthesized
tttagccatgacaattttattt

SEQ ID NO: 988258 - DNA, 22 bp, Artificial Sequence
  chemically synthesized
aatatgctttttagccatgaca

SEQ ID NO: 988259 - DNA, 22 bp, Artificial Sequence
  chemically synthesized
tcatggctaaaaagcatattta

SEQ ID NO: 988260 - DNA, 22 bp, Artificial Sequence
  chemically synthesized
acatcatgaagactaaatatgc

SEQ ID NO: 988261 - DNA, 22 bp, Artificial Sequence
  chemically synthesized
aacatcatgaagactaaatatg

SEQ ID NO: 988262 - DNA, 22 bp, Artificial Sequence
  chemically synthesized
aaaagcatatttagtcttcatg

SEQ ID NO: 988263 - DNA, 22 bp, Artificial Sequence
  chemically synthesized
cataatagtttaacatcatgaa

SEQ ID NO: 988264 - DNA, 22 bp, Artificial Sequence
  chemically synthesized
attgcataatagtttaacatca

SEQ ID NO: 988265 - DNA, 22 bp, Artificial Sequence
  chemically synthesized
agtcttcatgatgttaaactat

SEQ ID NO: 988266 - DNA, 22 bp, Artificial Sequence
  chemically synthesized
cctaattgcataatagtttaac

SEQ ID NO: 988267 - DNA, 22 bp, Artificial Sequence
  chemically synthesized
gtcttcatgatgttaaactatt

SEQ ID NO: 988268 - DNA, 22 bp, Artificial Sequence
  chemically synthesized
gcctaattgcataatagtttaa

SEQ ID NO: 988269 - DNA, 22 bp, Artificial Sequence
  chemically synthesized
catgatgttaaactattatgca

SEQ ID NO: 988270 - DNA, 22 bp, Artificial Sequence
  chemically synthesized
atgatgttaaactattatgcaa

SEQ ID NO: 988271 - DNA, 22 bp, Artificial Sequence
  chemically synthesized
aactattatgcaattaggcaag

SEQ ID NO: 988272 - DNA, 22 bp, Artificial Sequence
  chemically synthesized
aaagacaagaatgtccttgcct

SEQ ID NO: 988273 - DNA, 22 bp, Artificial Sequence
  chemically synthesized
gaaagacaagaatgtccttgcc

SEQ ID NO: 988274 - DNA, 22 bp, Artificial Sequence
  chemically synthesized
ttatgcaattaggcaaggacat

SEQ ID NO: 988275 - DNA, 22 bp, Artificial Sequence
  chemically synthesized
tgaaagacaagaatgtccttgc

SEQ ID NO: 988276 - DNA, 22 bp, Artificial Sequence
  chemically synthesized
ttgaaagacaagaatgtccttg

SEQ ID NO: 988277 - DNA, 22 bp, Artificial Sequence
  chemically synthesized
tgcaattaggcaaggacattct

SEQ ID NO: 988278 - DNA, 22 bp, Artificial Sequence
  chemically synthesized
tttttgaaagacaagaatgtcc

SEQ ID NO: 988279 - DNA, 22 bp, Artificial Sequence
  chemically synthesized
atttttgaaagacaagaatgtc

SEQ ID NO: 988280 - DNA, 22 bp, Artificial Sequence
  chemically synthesized
tatttttgaaagacaagaatgt

SEQ ID NO: 988281 - DNA, 22 bp, Artificial Sequence
  chemically synthesized
ggcaaggacattcttgtctttc

SEQ ID NO: 988282 - DNA, 22 bp, Artificial Sequence
  chemically synthesized
ttgtctttcaaaaataaaattc

SEQ ID NO: 988283 - DNA, 22 bp, Artificial Sequence
  chemically synthesized
gtctttcaaaaataaaattcac

SEQ ID NO: 988284 - DNA, 22 bp, Artificial Sequence
  chemically synthesized
tctttcaaaaataaaattcacg

SEQ ID NO: 988285 - DNA, 22 bp, Artificial Sequence
  chemically synthesized
tcaaaaataaaattcacgggct

SEQ ID NO: 988286 - DNA, 22 bp, Artificial Sequence
  chemically synthesized
caaaaataaaattcacgggctg

SEQ ID NO: 988287 - DNA, 22 bp, Artificial Sequence
  chemically synthesized
aaaaataaaattcacgggctgg

SEQ ID NO: 988288 - DNA, 22 bp, Artificial Sequence
  chemically synthesized
cagacgtgagccaccgcgccca

SEQ ID NO: 988289 - DNA, 22 bp, Artificial Sequence
  chemically synthesized
acgggctgggcgcggtggctca

SEQ ID NO: 988290 - DNA, 22 bp, Artificial Sequence
  chemically synthesized
gaattccagacgtgagccaccg

SEQ ID NO: 988291 - DNA, 22 bp, Artificial Sequence
  chemically synthesized
ggcgcggtggctcacgtctgga

SEQ ID NO: 988292 - DNA, 22 bp, Artificial Sequence
  chemically synthesized
ccaaagcactggaattccagac

SEQ ID NO: 988293 - DNA, 22 bp, Artificial Sequence
  chemically synthesized
cccaaagcactggaattccaga

SEQ ID NO: 988294 - DNA, 22 bp, Artificial Sequence
  chemically synthesized
agcttcccaaagcactggaatt

SEQ ID NO: 988295 - DNA, 22 bp, Artificial Sequence
  chemically synthesized
ctcagcttcccaaagcactgga

SEQ ID NO: 988296 - DNA, 22 bp, Artificial Sequence
  chemically synthesized
acgtctggaattccagtgcttt

SEQ ID NO: 988297 - DNA, 22 bp, Artificial Sequence
  chemically synthesized
gaattccagtgctttgggaagc

SEQ ID NO: 988298 - DNA, 22 bp, Artificial Sequence
  chemically synthesized
cagtgctttgggaagctgagga

SEQ ID NO: 988299 - DNA, 22 bp, Artificial Sequence
  chemically synthesized
aggtgatccaccctcctcagct

SEQ ID NO: 988300 - DNA, 22 bp, Artificial Sequence
  chemically synthesized
acctcaggtgatccaccctcct

SEQ ID NO: 988301 - DNA, 22 bp, Artificial Sequence
  chemically synthesized
tgggaagctgaggagggtggat

SEQ ID NO: 988302 - DNA, 22 bp, Artificial Sequence
  chemically synthesized
gggaagctgaggagggtggatc

SEQ ID NO: 988303 - DNA, 22 bp, Artificial Sequence
  chemically synthesized
ctgacctcaggtgatccaccct

SEQ ID NO: 988304 - DNA, 22 bp, Artificial Sequence
  chemically synthesized
ggaagctgaggagggtggatca

SEQ ID NO: 988305 - DNA, 22 bp, Artificial Sequence
  chemically synthesized
gaactcctgacctcaggtgatc

SEQ ID NO: 988306 - DNA, 22 bp, Artificial Sequence
  chemically synthesized
aggagggtggatcacctgaggt

SEQ ID NO: 988307 - DNA, 22 bp, Artificial Sequence
  chemically synthesized
gtctcgaactcctgacctcagg

SEQ ID NO: 988308 - DNA, 22 bp, Artificial Sequence
  chemically synthesized
gccaggctggtctcgaactcct

SEQ ID NO: 988309 - DNA, 22 bp, Artificial Sequence
  chemically synthesized
aggtcaggagttcgagaccagc

SEQ ID NO: 988310 - DNA, 22 bp, Artificial Sequence
  chemically synthesized
accatgttggccaggctggtct

SEQ ID NO: 988311 - DNA, 22 bp, Artificial Sequence
  chemically synthesized
gagaccagcctggccaacatgg

SEQ ID NO: 988312 - DNA, 22 bp, Artificial Sequence
  chemically synthesized
gtagagacaggggttcaccatg

SEQ ID NO: 988313 - DNA, 22 bp, Artificial Sequence
  chemically synthesized
agtagagacaggggttcaccat

SEQ ID NO: 988314 - DNA, 22 bp, Artificial Sequence
  chemically synthesized
tagtagagacaggggttcacca

SEQ ID NO: 988315 - DNA, 22 bp, Artificial Sequence
  chemically synthesized
ttagtagagacaggggttcacc

SEQ ID NO: 988316 - DNA, 22 bp, Artificial Sequence
  chemically synthesized
gccaacatggtgaacccctgtc

SEQ ID NO: 988317 - DNA, 22 bp, Artificial Sequence
  chemically synthesized
tatttttagtagagacaggggt

SEQ ID NO: 988318 - DNA, 22 bp, Artificial Sequence
  chemically synthesized
gtatttttagtagagacagggg

SEQ ID NO: 988319 - DNA, 22 bp, Artificial Sequence
  chemically synthesized
tgtatttttagtagagacaggg

SEQ ID NO: 988320 - DNA, 22 bp, Artificial Sequence
  chemically synthesized
ttgtatttttagtagagacagg

SEQ ID NO: 988321 - DNA, 22 bp, Artificial Sequence
  chemically synthesized
tttgtatttttagtagagacag

SEQ ID NO: 988322 - DNA, 22 bp, Artificial Sequence
  chemically synthesized
attttttgtatttttagtagag

SEQ ID NO: 988323 - DNA, 22 bp, Artificial Sequence
  chemically synthesized
gctaattttttgtatttttagt

SEQ ID NO: 988324 - DNA, 22 bp, Artificial Sequence
  chemically synthesized
tctctactaaaaatacaaaaaa

SEQ ID NO: 988325 - DNA, 22 bp, Artificial Sequence
  chemically synthesized
tactaaaaatacaaaaaattag

SEQ ID NO: 988326 - DNA, 22 bp, Artificial Sequence
  chemically synthesized
ctaaaaatacaaaaaattagcc

SEQ ID NO: 988327 - DNA, 22 bp, Artificial Sequence
  chemically synthesized
aaaatacaaaaaattagccagg

SEQ ID NO: 988328 - DNA, 22 bp, Artificial Sequence
  chemically synthesized
cagatgtgcaccaccacgcctg

SEQ ID NO: 988329 - DNA, 22 bp, Artificial Sequence
  chemically synthesized
ggattacagatgtgcaccacca

SEQ ID NO: 988330 - DNA, 22 bp, Artificial Sequence
  chemically synthesized
gccaggcgtggtggtgcacatc

SEQ ID NO: 988331 - DNA, 22 bp, Artificial Sequence
  chemically synthesized
gtagctgggattacagatgtgc

SEQ ID NO: 988332 - DNA, 22 bp, Artificial Sequence
  chemically synthesized
cctagtagctgggattacagat

SEQ ID NO: 988333 - DNA, 22 bp, Artificial Sequence
  chemically synthesized
agcctccctagtagctgggatt

SEQ ID NO: 988334 - DNA, 22 bp, Artificial Sequence
  chemically synthesized
cctcagcctccctagtagctgg

SEQ ID NO: 988335 - DNA, 22 bp, Artificial Sequence
  chemically synthesized
ctgcctcagcctccctagtagc

SEQ ID NO: 988336 - DNA, 22 bp, Artificial Sequence
  chemically synthesized
tcctgcctcagcctccctagta

SEQ ID NO: 988337 - DNA, 22 bp, Artificial Sequence
  chemically synthesized
taatcccagctactagggaggc

SEQ ID NO: 988338 - DNA, 22 bp, Artificial Sequence
  chemically synthesized
aagcgattctcctgcctcagcc

SEQ ID NO: 988339 - DNA, 22 bp, Artificial Sequence
  chemically synthesized
ctagggaggctgaggcaggaga

SEQ ID NO: 988340 - DNA, 22 bp, Artificial Sequence
  chemically synthesized
gggaggctgaggcaggagaatc

SEQ ID NO: 988341 - DNA, 22 bp, Artificial Sequence
  chemically synthesized
ccacccaggttcaagcgattct

SEQ ID NO: 988342 - DNA, 22 bp, Artificial Sequence
  chemically synthesized
taccacccaggttcaagcgatt

SEQ ID NO: 988343 - DNA, 22 bp, Artificial Sequence
  chemically synthesized
aggcaggagaatcgcttgaacc

SEQ ID NO: 988344 - DNA, 22 bp, Artificial Sequence
  chemically synthesized
accacaacctctaccacccagg

SEQ ID NO: 988345 - DNA, 22 bp, Artificial Sequence
  chemically synthesized
ggctcaccacaacctctaccac

SEQ ID NO: 988346 - DNA, 22 bp, Artificial Sequence
  chemically synthesized
gaacctgggtggtagaggttgt

SEQ ID NO: 988347 - DNA, 22 bp, Artificial Sequence
  chemically synthesized
aacctgggtggtagaggttgtg

SEQ ID NO: 988348 - DNA, 22 bp, Artificial Sequence
  chemically synthesized
ggtggtagaggttgtggtgagc

SEQ ID NO: 988349 - DNA, 22 bp, Artificial Sequence
  chemically synthesized
gggtgcaatggtgcgatctcgg

SEQ ID NO: 988350 - DNA, 22 bp, Artificial Sequence
  chemically synthesized
tggtgagccgagatcgcaccat

SEQ ID NO: 988351 - DNA, 22 bp, Artificial Sequence
  chemically synthesized
cccaggctggggtgcaatggtg

SEQ ID NO: 988352 - DNA, 22 bp, Artificial Sequence
  chemically synthesized
ttgcccaggctggggtgcaatg

SEQ ID NO: 988353 - DNA, 22 bp, Artificial Sequence
  chemically synthesized
gttgcccaggctggggtgcaat

SEQ ID NO: 988354 - DNA, 22 bp, Artificial Sequence
  chemically synthesized
ttgttgcccaggctggggtgca

SEQ ID NO: 988355 - DNA, 22 bp, Artificial Sequence
  chemically synthesized
actcttgttgcccaggctgggg

SEQ ID NO: 988356 - DNA, 22 bp, Artificial Sequence
  chemically synthesized
cactcttgttgcccaggctggg

SEQ ID NO: 988357 - DNA, 22 bp, Artificial Sequence
  chemically synthesized
caccccagcctgggcaacaaga

SEQ ID NO: 988358 - DNA, 22 bp, Artificial Sequence
  chemically synthesized
agacggtgtttcactcttgttg

SEQ ID NO: 988359 - DNA, 22 bp, Artificial Sequence
  chemically synthesized
attgagacggtgtttcactctt

SEQ ID NO: 988360 - DNA, 22 bp, Artificial Sequence
  chemically synthesized
attcattgagacggtgtttcac

SEQ ID NO: 988361 - DNA, 22 bp, Artificial Sequence
  chemically synthesized
ggcaacaagagtgaaacaccgt

SEQ ID NO: 988362 - DNA, 22 bp, Artificial Sequence
  chemically synthesized
actgattcattgagacggtgtt

SEQ ID NO: 988363 - DNA, 22 bp, Artificial Sequence
  chemically synthesized
attgactgattcattgagacgg

SEQ ID NO: 988364 - DNA, 22 bp, Artificial Sequence
  chemically synthesized
attgattgactgattcattgag

SEQ ID NO: 988365 - DNA, 22 bp, Artificial Sequence
  chemically synthesized
attgattgattgactgattcat

SEQ ID NO: 988366 - DNA, 22 bp, Artificial Sequence
  chemically synthesized
gattgattgattgactgattca

SEQ ID NO: 988367 - DNA, 22 bp, Artificial Sequence
  chemically synthesized
aatgaatcagtcaatcaatcaa

SEQ ID NO: 988368 - DNA, 22 bp, Artificial Sequence
  chemically synthesized
aaagtgtgaatttgattgattg

SEQ ID NO: 988369 - DNA, 22 bp, Artificial Sequence
  chemically synthesized
caaagtgtgaatttgattgatt

SEQ ID NO: 988370 - DNA, 22 bp, Artificial Sequence
  chemically synthesized
aaaaaatagatttcaaagtgtg

SEQ ID NO: 988371 - DNA, 22 bp, Artificial Sequence
  chemically synthesized
caaaaaatagatttcaaagtgt

SEQ ID NO: 988372 - DNA, 22 bp, Artificial Sequence
  chemically synthesized
tcaaaaaatagatttcaaagtg

SEQ ID NO: 988373 - DNA, 22 bp, Artificial Sequence
  chemically synthesized
tatactttcaaaaaatagattt

SEQ ID NO: 988374 - DNA, 22 bp, Artificial Sequence
  chemically synthesized
acactttgaaatctattttttg

SEQ ID NO: 988375 - DNA, 22 bp, Artificial Sequence
  chemically synthesized
tgattatatactttcaaaaaat

SEQ ID NO: 988376 - DNA, 22 bp, Artificial Sequence
  chemically synthesized
atgattatatactttcaaaaaa

SEQ ID NO: 988377 - DNA, 22 bp, Artificial Sequence
  chemically synthesized
tgaaatctattttttgaaagta

SEQ ID NO: 988378 - DNA, 22 bp, Artificial Sequence
  chemically synthesized
gaaatctattttttgaaagtat

SEQ ID NO: 988379 - DNA, 22 bp, Artificial Sequence
  chemically synthesized
atttatgattatatactttcaa

SEQ ID NO: 988380 - DNA, 22 bp, Artificial Sequence
  chemically synthesized
aaatctattttttgaaagtata

SEQ ID NO: 988381 - DNA, 22 bp, Artificial Sequence
  chemically synthesized
catttatgattatatactttca

SEQ ID NO: 988382 - DNA, 22 bp, Artificial Sequence
  chemically synthesized
tcatttatgattatatactttc

SEQ ID NO: 988383 - DNA, 22 bp, Artificial Sequence
  chemically synthesized
gttttcatttatgattatatac

SEQ ID NO: 988384 - DNA, 22 bp, Artificial Sequence
  chemically synthesized
ggttttcatttatgattatata

SEQ ID NO: 988385 - DNA, 22 bp, Artificial Sequence
  chemically synthesized
ttttttgaaagtatataatcat

SEQ ID NO: 988386 - DNA, 22 bp, Artificial Sequence
  chemically synthesized
tttggttttcatttatgattat

SEQ ID NO: 988387 - DNA, 22 bp, Artificial Sequence
  chemically synthesized
tttgaaagtatataatcataaa

SEQ ID NO: 988388 - DNA, 22 bp, Artificial Sequence
  chemically synthesized
gtttggttttcatttatgatta

SEQ ID NO: 988389 - DNA, 22 bp, Artificial Sequence
  chemically synthesized
ttgaaagtatataatcataaat

SEQ ID NO: 988390 - DNA, 22 bp, Artificial Sequence
  chemically synthesized
tgtttggttttcatttatgatt

SEQ ID NO: 988391 - DNA, 22 bp, Artificial Sequence
  chemically synthesized
tgaaagtatataatcataaatg

SEQ ID NO: 988392 - DNA, 22 bp, Artificial Sequence
  chemically synthesized
gaaagtatataatcataaatga

SEQ ID NO: 988393 - DNA, 22 bp, Artificial Sequence
  chemically synthesized
aaagtatataatcataaatgaa

SEQ ID NO: 988394 - DNA, 22 bp, Artificial Sequence
  chemically synthesized
gccagtgagggttttgtttggt

SEQ ID NO: 988395 - DNA, 22 bp, Artificial Sequence
  chemically synthesized
agccagtgagggttttgtttgg

SEQ ID NO: 988396 - DNA, 22 bp, Artificial Sequence
  chemically synthesized
tagccagtgagggttttgtttg

SEQ ID NO: 988397 - DNA, 22 bp, Artificial Sequence
  chemically synthesized
ttttagccagtgagggttttgt

SEQ ID NO: 988398 - DNA, 22 bp, Artificial Sequence
  chemically synthesized
catcatgttgttttagccagtg

SEQ ID NO: 988399 - DNA, 22 bp, Artificial Sequence
  chemically synthesized
ccatcatgttgttttagccagt

SEQ ID NO: 988400 - DNA, 22 bp, Artificial Sequence
  chemically synthesized
tgtttccatcatgttgttttag

SEQ ID NO: 988401 - DNA, 22 bp, Artificial Sequence
  chemically synthesized
atgtttccatcatgttgtttta

SEQ ID NO: 988402 - DNA, 22 bp, Artificial Sequence
  chemically synthesized
tatgtttccatcatgttgtttt

SEQ ID NO: 988403 - DNA, 22 bp, Artificial Sequence
  chemically synthesized
ttatgtttccatcatgttgttt

SEQ ID NO: 988404 - DNA, 22 bp, Artificial Sequence
  chemically synthesized
actggctaaaacaacatgatgg

SEQ ID NO: 988405 - DNA, 22 bp, Artificial Sequence
  chemically synthesized
tcacttttatgtttccatcatg

SEQ ID NO: 988406 - DNA, 22 bp, Artificial Sequence
  chemically synthesized
gtcacttttatgtttccatcat

SEQ ID NO: 988407 - DNA, 22 bp, Artificial Sequence
  chemically synthesized
gctaaaacaacatgatggaaac

SEQ ID NO: 988408 - DNA, 22 bp, Artificial Sequence
  chemically synthesized
tgtcacttttatgtttccatca

SEQ ID NO: 988409 - DNA, 22 bp, Artificial Sequence
  chemically synthesized
aaacaacatgatggaaacataa

SEQ ID NO: 988410 - DNA, 22 bp, Artificial Sequence
  chemically synthesized
aactttgtcacttttatgtttc

SEQ ID NO: 988411 - DNA, 22 bp, Artificial Sequence
  chemically synthesized
aaactttgtcacttttatgttt

SEQ ID NO: 988412 - DNA, 22 bp, Artificial Sequence
  chemically synthesized
catacatgtgtcatgggtctta

SEQ ID NO: 988413 - DNA, 22 bp, Artificial Sequence
  chemically synthesized
acatacatgtgtcatgggtctt

SEQ ID NO: 988414 - DNA, 22 bp, Artificial Sequence
  chemically synthesized
aaataacttacatacatgtgtc

SEQ ID NO: 988415 - DNA, 22 bp, Artificial Sequence
  chemically synthesized
gaaataacttacatacatgtgt

SEQ ID NO: 988416 - DNA, 22 bp, Artificial Sequence
  chemically synthesized
tgaaataacttacatacatgtg

SEQ ID NO: 988417 - DNA, 22 bp, Artificial Sequence
  chemically synthesized
aagacccatgacacatgtatgt

SEQ ID NO: 988418 - DNA, 22 bp, Artificial Sequence
  chemically synthesized
ttgaaataacttacatacatgt

SEQ ID NO: 988419 - DNA, 22 bp, Artificial Sequence
  chemically synthesized
agacccatgacacatgtatgta

SEQ ID NO: 988420 - DNA, 22 bp, Artificial Sequence
  chemically synthesized
ttttgaaataacttacatacat

SEQ ID NO: 988421 - DNA, 22 bp, Artificial Sequence
  chemically synthesized
acagtgatctcttttgaaataa

SEQ ID NO: 988422 - DNA, 22 bp, Artificial Sequence
  chemically synthesized
taacagtgatctcttttgaaat

SEQ ID NO: 988423 - DNA, 22 bp, Artificial Sequence
  chemically synthesized
ctaacagtgatctcttttgaaa

SEQ ID NO: 988424 - DNA, 22 bp, Artificial Sequence
  chemically synthesized
cagcaaatttctaacagtgatc

SEQ ID NO: 988425 - DNA, 22 bp, Artificial Sequence
  chemically synthesized
ccagcaaatttctaacagtgat

SEQ ID NO: 988426 - DNA, 22 bp, Artificial Sequence
  chemically synthesized
tttcaaaagagatcactgttag

SEQ ID NO: 988427 - DNA, 22 bp, Artificial Sequence
  chemically synthesized
caaaagagatcactgttagaaa

SEQ ID NO: 988428 - DNA, 22 bp, Artificial Sequence
  chemically synthesized
aaaagagatcactgttagaaat

SEQ ID NO: 988429 - DNA, 22 bp, Artificial Sequence
  chemically synthesized
acagtaacaaaaacacttccag

SEQ ID NO: 988430 - DNA, 22 bp, Artificial Sequence
  chemically synthesized
ttagaaatttgctggaagtgtt

SEQ ID NO: 988431 - DNA, 22 bp, Artificial Sequence
  chemically synthesized
ttcacagtaacaaaaacacttc

SEQ ID NO: 988432 - DNA, 22 bp, Artificial Sequence
  chemically synthesized
gaaatttgctggaagtgttttt

SEQ ID NO: 988433 - DNA, 22 bp, Artificial Sequence
  chemically synthesized
ttattcacagtaacaaaaacac

SEQ ID NO: 988434 - DNA, 22 bp, Artificial Sequence
  chemically synthesized
gctggaagtgtttttgttactg

SEQ ID NO: 988435 - DNA, 22 bp, Artificial Sequence
  chemically synthesized
tgttattattcacagtaacaaa

SEQ ID NO: 988436 - DNA, 22 bp, Artificial Sequence
  chemically synthesized
ctggaagtgtttttgttactgt

SEQ ID NO: 988437 - DNA, 22 bp, Artificial Sequence
  chemically synthesized
gaagtgtttttgttactgtgaa

SEQ ID NO: 988438 - DNA, 22 bp, Artificial Sequence
  chemically synthesized
caaaaattgtgttattattcac

SEQ ID NO: 988439 - DNA, 22 bp, Artificial Sequence
  chemically synthesized
ttgttactgtgaataataacac

SEQ ID NO: 988440 - DNA, 22 bp, Artificial Sequence
  chemically synthesized
tgttactgtgaataataacaca

SEQ ID NO: 988441 - DNA, 22 bp, Artificial Sequence
  chemically synthesized
gttactgtgaataataacacaa

SEQ ID NO: 988442 - DNA, 22 bp, Artificial Sequence
  chemically synthesized
ttactgtgaataataacacaat

SEQ ID NO: 988443 - DNA, 22 bp, Artificial Sequence
  chemically synthesized
caaattacaaaaattgtgttat

SEQ ID NO: 988444 - DNA, 22 bp, Artificial Sequence
  chemically synthesized
ctgtgaataataacacaatttt

SEQ ID NO: 988445 - DNA, 22 bp, Artificial Sequence
  chemically synthesized
tgaataataacacaatttttgt

SEQ ID NO: 988446 - DNA, 22 bp, Artificial Sequence
  chemically synthesized
tgatgtattgcaaattacaaaa

SEQ ID NO: 988447 - DNA, 22 bp, Artificial Sequence
  chemically synthesized
tctatgatgtattgcaaattac

SEQ ID NO: 988448 - DNA, 22 bp, Artificial Sequence
  chemically synthesized
atctatgatgtattgcaaatta

SEQ ID NO: 988449 - DNA, 22 bp, Artificial Sequence
  chemically synthesized
ttgtaatttgcaatacatcata

SEQ ID NO: 988450 - DNA, 22 bp, Artificial Sequence
  chemically synthesized
tgtaatttgcaatacatcatag

SEQ ID NO: 988451 - DNA, 22 bp, Artificial Sequence
  chemically synthesized
gtaatttgcaatacatcataga

SEQ ID NO: 988452 - DNA, 22 bp, Artificial Sequence
  chemically synthesized
taatttgcaatacatcatagat

SEQ ID NO: 988453 - DNA, 22 bp, Artificial Sequence
  chemically synthesized
tgtgtgtatatgccttatctat

SEQ ID NO: 988454 - DNA, 22 bp, Artificial Sequence
  chemically synthesized
atgtgtgtatatgccttatcta

SEQ ID NO: 988455 - DNA, 22 bp, Artificial Sequence
  chemically synthesized
gcaatacatcatagataaggca

SEQ ID NO: 988456 - DNA, 22 bp, Artificial Sequence
  chemically synthesized
caatacatcatagataaggcat

SEQ ID NO: 988457 - DNA, 22 bp, Artificial Sequence
  chemically synthesized
acaatgtttatgtgtgtatatg

SEQ ID NO: 988458 - DNA, 22 bp, Artificial Sequence
  chemically synthesized
ttcacaatgtttatgtgtgtat

SEQ ID NO: 988459 - DNA, 22 bp, Artificial Sequence
  chemically synthesized
ccactattcacaatgtttatgt

SEQ ID NO: 988460 - DNA, 22 bp, Artificial Sequence
  chemically synthesized
aatgtgttaccactattcacaa

SEQ ID NO: 988461 - DNA, 22 bp, Artificial Sequence
  chemically synthesized
tgaatagtggtaacacattcag

SEQ ID NO: 988462 - DNA, 22 bp, Artificial Sequence
  chemically synthesized
tagtgaaagccccaataactga

SEQ ID NO: 988463 - DNA, 22 bp, Artificial Sequence
  chemically synthesized
agttattggggctttcactata

SEQ ID NO: 988464 - DNA, 22 bp, Artificial Sequence
  chemically synthesized
ttggggctttcactataatatg

SEQ ID NO: 988465 - DNA, 22 bp, Artificial Sequence
  chemically synthesized
gaggcacacccaggcatattat

SEQ ID NO: 988466 - DNA, 22 bp, Artificial Sequence
  chemically synthesized
gggctttcactataatatgcct

SEQ ID NO: 988467 - DNA, 22 bp, Artificial Sequence
  chemically synthesized
tcactataatatgcctgggtgt

SEQ ID NO: 988468 - DNA, 22 bp, Artificial Sequence
  chemically synthesized
cactataatatgcctgggtgtg

SEQ ID NO: 988469 - DNA, 22 bp, Artificial Sequence
  chemically synthesized
actataatatgcctgggtgtgc

SEQ ID NO: 988470 - DNA, 22 bp, Artificial Sequence
  chemically synthesized
gcatccgttggaggcacaccca

SEQ ID NO: 988471 - DNA, 22 bp, Artificial Sequence
  chemically synthesized
agcatccgttggaggcacaccc

SEQ ID NO: 988472 - DNA, 22 bp, Artificial Sequence
  chemically synthesized
taatatgcctgggtgtgcctcc

SEQ ID NO: 988473 - DNA, 22 bp, Artificial Sequence
  chemically synthesized
aatttagcatccgttggaggca

SEQ ID NO: 988474 - DNA, 22 bp, Artificial Sequence
  chemically synthesized
ggtgtgcctccaacggatgcta

SEQ ID NO: 988475 - DNA, 22 bp, Artificial Sequence
  chemically synthesized
aaatgcactaaatttagcatcc

SEQ ID NO: 988476 - DNA, 22 bp, Artificial Sequence
  chemically synthesized
caaatgcactaaatttagcatc

SEQ ID NO: 988477 - DNA, 22 bp, Artificial Sequence
  chemically synthesized
caacggatgctaaatttagtgc

SEQ ID NO: 988478 - DNA, 22 bp, Artificial Sequence
  chemically synthesized
caagagacttcaaatgcactaa

SEQ ID NO: 988479 - DNA, 22 bp, Artificial Sequence
  chemically synthesized
ccaagagacttcaaatgcacta

SEQ ID NO: 988480 - DNA, 22 bp, Artificial Sequence
  chemically synthesized
tccaagagacttcaaatgcact

SEQ ID NO: 988481 - DNA, 22 bp, Artificial Sequence
  chemically synthesized
ttccaagagacttcaaatgcac

SEQ ID NO: 988482 - DNA, 22 bp, Artificial Sequence
  chemically synthesized
tttccaagagacttcaaatgca

SEQ ID NO: 988483 - DNA, 22 bp, Artificial Sequence
  chemically synthesized
ttttccaagagacttcaaatgc

SEQ ID NO: 988484 - DNA, 22 bp, Artificial Sequence
  chemically synthesized
tttttttccaagagacttcaaa

SEQ ID NO: 988485 - DNA, 22 bp, Artificial Sequence
  chemically synthesized
aatttagtgcatttgaagtctc

SEQ ID NO: 988486 - DNA, 22 bp, Artificial Sequence
  chemically synthesized
agtgcatttgaagtctcttgga

SEQ ID NO: 988487 - DNA, 22 bp, Artificial Sequence
  chemically synthesized
ggactgtttttttccaagagac

SEQ ID NO: 988488 - DNA, 22 bp, Artificial Sequence
  chemically synthesized
gtgcatttgaagtctcttggaa

SEQ ID NO: 988489 - DNA, 22 bp, Artificial Sequence
  chemically synthesized
gggactgtttttttccaagaga

SEQ ID NO: 988490 - DNA, 22 bp, Artificial Sequence
  chemically synthesized
cttgggactgtttttttccaag

SEQ ID NO: 988491 - DNA, 22 bp, Artificial Sequence
  chemically synthesized
gaagtctcttggaaaaaaacag

SEQ ID NO: 988492 - DNA, 22 bp, Artificial Sequence
  chemically synthesized
aagtctcttggaaaaaaacagt

SEQ ID NO: 988493 - DNA, 22 bp, Artificial Sequence
  chemically synthesized
aaactccttgggactgtttttt

SEQ ID NO: 988494 - DNA, 22 bp, Artificial Sequence
  chemically synthesized
caaactccttgggactgttttt

SEQ ID NO: 988495 - DNA, 22 bp, Artificial Sequence
  chemically synthesized
tcaaactccttgggactgtttt

SEQ ID NO: 988496 - DNA, 22 bp, Artificial Sequence
  chemically synthesized
cctttcaaactccttgggactg

SEQ ID NO: 988497 - DNA, 22 bp, Artificial Sequence
  chemically synthesized
ttggaaaaaaacagtcccaagg

SEQ ID NO: 988498 - DNA, 22 bp, Artificial Sequence
  chemically synthesized
ccctttcaaactccttgggact

SEQ ID NO: 988499 - DNA, 22 bp, Artificial Sequence
  chemically synthesized
ggaaaaaaacagtcccaaggag

SEQ ID NO: 988500 - DNA, 22 bp, Artificial Sequence
  chemically synthesized
gaaaaaaacagtcccaaggagt

SEQ ID NO: 988501 - DNA, 22 bp, Artificial Sequence
  chemically synthesized
aaacaccttccctttcaaactc

SEQ ID NO: 988502 - DNA, 22 bp, Artificial Sequence
  chemically synthesized
aaaacaccttccctttcaaact

SEQ ID NO: 988503 - DNA, 22 bp, Artificial Sequence
  chemically synthesized
aacttaaaacaccttccctttc

SEQ ID NO: 988504 - DNA, 22 bp, Artificial Sequence
  chemically synthesized
tgctgaacttaaaacaccttcc

SEQ ID NO: 988505 - DNA, 22 bp, Artificial Sequence
  chemically synthesized
gaaagggaaggtgttttaagtt

SEQ ID NO: 988506 - DNA, 22 bp, Artificial Sequence
  chemically synthesized
aaagggaaggtgttttaagttc

SEQ ID NO: 988507 - DNA, 22 bp, Artificial Sequence
  chemically synthesized
caaggagcatgctgtgctgaac

SEQ ID NO: 988508 - DNA, 22 bp, Artificial Sequence
  chemically synthesized
ctgcaaggagcatgctgtgctg

SEQ ID NO: 988509 - DNA, 22 bp, Artificial Sequence
  chemically synthesized
ctgctgcaaggagcatgctgtg

SEQ ID NO: 988510 - DNA, 22 bp, Artificial Sequence
  chemically synthesized
gctgctgcaaggagcatgctgt

SEQ ID NO: 988511 - DNA, 22 bp, Artificial Sequence
  chemically synthesized
taagttcagcacagcatgctcc

SEQ ID NO: 988512 - DNA, 22 bp, Artificial Sequence
  chemically synthesized
aagttcagcacagcatgctcct

SEQ ID NO: 988513 - DNA, 22 bp, Artificial Sequence
  chemically synthesized
agttcagcacagcatgctcctt

SEQ ID NO: 988514 - DNA, 22 bp, Artificial Sequence
  chemically synthesized
agcacagcatgctccttgcagc

SEQ ID NO: 988515 - DNA, 22 bp, Artificial Sequence
  chemically synthesized
agacacatttgctgctgcaagg

SEQ ID NO: 988516 - DNA, 22 bp, Artificial Sequence
  chemically synthesized
cagacacatttgctgctgcaag

SEQ ID NO: 988517 - DNA, 22 bp, Artificial Sequence
  chemically synthesized
tcagacacatttgctgctgcaa

SEQ ID NO: 988518 - DNA, 22 bp, Artificial Sequence
  chemically synthesized
cttgcagcagcaaatgtgtctg

SEQ ID NO: 988519 - DNA, 22 bp, Artificial Sequence
  chemically synthesized
gcagcagcaaatgtgtctgaaa

SEQ ID NO: 988520 - DNA, 22 bp, Artificial Sequence
  chemically synthesized
cagcagcaaatgtgtctgaaag

SEQ ID NO: 988521 - DNA, 22 bp, Artificial Sequence
  chemically synthesized
acagtgcaacagagcaagaagc

SEQ ID NO: 988522 - DNA, 22 bp, Artificial Sequence
  chemically synthesized
tcacagtgcaacagagcaagaa

SEQ ID NO: 988523 - DNA, 22 bp, Artificial Sequence
  chemically synthesized
tctcacagtgcaacagagcaag

SEQ ID NO: 988524 - DNA, 22 bp, Artificial Sequence
  chemically synthesized
aaagcttcttgctctgttgcac

SEQ ID NO: 988525 - DNA, 22 bp, Artificial Sequence
  chemically synthesized
atatagttctctcacagtgcaa

SEQ ID NO: 988526 - DNA, 22 bp, Artificial Sequence
  chemically synthesized
aatatagttctctcacagtgca

SEQ ID NO: 988527 - DNA, 22 bp, Artificial Sequence
  chemically synthesized
taatatagttctctcacagtgc

SEQ ID NO: 988528 - DNA, 22 bp, Artificial Sequence
  chemically synthesized
cttgctctgttgcactgtgaga

SEQ ID NO: 988529 - DNA, 22 bp, Artificial Sequence
  chemically synthesized
ttgctctgttgcactgtgagag

SEQ ID NO: 988530 - DNA, 22 bp, Artificial Sequence
  chemically synthesized
gctctgttgcactgtgagagaa

SEQ ID NO: 988531 - DNA, 22 bp, Artificial Sequence
  chemically synthesized
ctctgttgcactgtgagagaac

SEQ ID NO: 988532 - DNA, 22 bp, Artificial Sequence
  chemically synthesized
tgttgcactgtgagagaactat

SEQ ID NO: 988533 - DNA, 22 bp, Artificial Sequence
  chemically synthesized
acacattttaatatagttctct

SEQ ID NO: 988534 - DNA, 22 bp, Artificial Sequence
  chemically synthesized
ttgcactgtgagagaactatat

SEQ ID NO: 988535 - DNA, 22 bp, Artificial Sequence
  chemically synthesized
ttaacacattttaatatagttc

SEQ ID NO: 988536 - DNA, 22 bp, Artificial Sequence
  chemically synthesized
cactgtgagagaactatattaa

SEQ ID NO: 988537 - DNA, 22 bp, Artificial Sequence
  chemically synthesized
ctattaacacattttaatatag

SEQ ID NO: 988538 - DNA, 22 bp, Artificial Sequence
  chemically synthesized
tactattaacacattttaatat

SEQ ID NO: 988539 - DNA, 22 bp, Artificial Sequence
  chemically synthesized
ctactattaacacattttaata

SEQ ID NO: 988540 - DNA, 22 bp, Artificial Sequence
  chemically synthesized
tgagagaactatattaaaatgt

SEQ ID NO: 988541 - DNA, 22 bp, Artificial Sequence
  chemically synthesized
tctactattaacacattttaat

SEQ ID NO: 988542 - DNA, 22 bp, Artificial Sequence
  chemically synthesized
tttctactattaacacatttta

SEQ ID NO: 988543 - DNA, 22 bp, Artificial Sequence
  chemically synthesized
ttctttctactattaacacatt

SEQ ID NO: 988544 - DNA, 22 bp, Artificial Sequence
  chemically synthesized
attctttctactattaacacat

SEQ ID NO: 988545 - DNA, 22 bp, Artificial Sequence
  chemically synthesized
tattaaaatgtgttaatagtag

SEQ ID NO: 988546 - DNA, 22 bp, Artificial Sequence
  chemically synthesized
aaatgtgttaatagtagaaaga

SEQ ID NO: 988547 - DNA, 22 bp, Artificial Sequence
  chemically synthesized
aggtgaacttattctttctact

SEQ ID NO: 988548 - DNA, 22 bp, Artificial Sequence
  chemically synthesized
gaggtgaacttattctttctac

SEQ ID NO: 988549 - DNA, 22 bp, Artificial Sequence
  chemically synthesized
atagtagaaagaataagttcac

SEQ ID NO: 988550 - DNA, 22 bp, Artificial Sequence
  chemically synthesized
aaaaatcaaggaaatatagtat

SEQ ID NO: 988551 - DNA, 22 bp, Artificial Sequence
  chemically synthesized
tctcaaaaatcaaggaaatata

SEQ ID NO: 988552 - DNA, 22 bp, Artificial Sequence
  chemically synthesized
acctcaaatactatatttcctt

SEQ ID NO: 988553 - DNA, 22 bp, Artificial Sequence
  chemically synthesized
ttgtctcaaaaatcaaggaaat

SEQ ID NO: 988554 - DNA, 22 bp, Artificial Sequence
  chemically synthesized
aaatactatatttccttgattt

SEQ ID NO: 988555 - DNA, 22 bp, Artificial Sequence
  chemically synthesized
tatttccttgatttttgagaca

SEQ ID NO: 988556 - DNA, 22 bp, Artificial Sequence
  chemically synthesized
ccttgatttttgagacaacagt

SEQ ID NO: 988557 - DNA, 22 bp, Artificial Sequence
  chemically synthesized
cttgatttttgagacaacagtg

SEQ ID NO: 988558 - DNA, 22 bp, Artificial Sequence
  chemically synthesized
acatacaggaaatcactgttgt

SEQ ID NO: 988559 - DNA, 22 bp, Artificial Sequence
  chemically synthesized
aacatacaggaaatcactgttg

SEQ ID NO: 988560 - DNA, 22 bp, Artificial Sequence
  chemically synthesized
gatttttgagacaacagtgatt

SEQ ID NO: 988561 - DNA, 22 bp, Artificial Sequence
  chemically synthesized
taacatacaggaaatcactgtt

SEQ ID NO: 988562 - DNA, 22 bp, Artificial Sequence
  chemically synthesized
atttttgagacaacagtgattt

SEQ ID NO: 988563 - DNA, 22 bp, Artificial Sequence
  chemically synthesized
ttaacatacaggaaatcactgt

SEQ ID NO: 988564 - DNA, 22 bp, Artificial Sequence
  chemically synthesized
ttgagacaacagtgatttcctg

SEQ ID NO: 988565 - DNA, 22 bp, Artificial Sequence
  chemically synthesized
tgagacaacagtgatttcctgt

SEQ ID NO: 988566 - DNA, 22 bp, Artificial Sequence
  chemically synthesized
gagacaacagtgatttcctgta

SEQ ID NO: 988567 - DNA, 22 bp, Artificial Sequence
  chemically synthesized
taatttttaacatacaggaaat

SEQ ID NO: 988568 - DNA, 22 bp, Artificial Sequence
  chemically synthesized
agacaacagtgatttcctgtat

SEQ ID NO: 988569 - DNA, 22 bp, Artificial Sequence
  chemically synthesized
tataatttttaacatacaggaa

SEQ ID NO: 988570 - DNA, 22 bp, Artificial Sequence
  chemically synthesized
tctataatttttaacatacagg

SEQ ID NO: 988571 - DNA, 22 bp, Artificial Sequence
  chemically synthesized
ctctctataatttttaacatac

SEQ ID NO: 988572 - DNA, 22 bp, Artificial Sequence
  chemically synthesized
gctctctataatttttaacata

SEQ ID NO: 988573 - DNA, 22 bp, Artificial Sequence
  chemically synthesized
tgctctctataatttttaacat

SEQ ID NO: 988574 - DNA, 22 bp, Artificial Sequence
  chemically synthesized
tattttgctctctataattttt

SEQ ID NO: 988575 - DNA, 22 bp, Artificial Sequence
  chemically synthesized
cctgtatgttaaaaattataga

SEQ ID NO: 988576 - DNA, 22 bp, Artificial Sequence
  chemically synthesized
ctgtatgttaaaaattatagag

SEQ ID NO: 988577 - DNA, 22 bp, Artificial Sequence
  chemically synthesized
tatgttaaaaattatagagagc

SEQ ID NO: 988578 - DNA, 22 bp, Artificial Sequence
  chemically synthesized
aaaattatagagagcaaaatac

SEQ ID NO: 988579 - DNA, 22 bp, Artificial Sequence
  chemically synthesized
gcgtgaaatggctgtattttgc

SEQ ID NO: 988580 - DNA, 22 bp, Artificial Sequence
  chemically synthesized
tagagagcaaaatacagccatt

SEQ ID NO: 988581 - DNA, 22 bp, Artificial Sequence
  chemically synthesized
acatggagataataaattagcg

SEQ ID NO: 988582 - DNA, 22 bp, Artificial Sequence
  chemically synthesized
cacgctaatttattatctccat

SEQ ID NO: 988583 - DNA, 22 bp, Artificial Sequence
  chemically synthesized
acgctaatttattatctccatg

SEQ ID NO: 988584 - DNA, 22 bp, Artificial Sequence
  chemically synthesized
atttattatctccatgtgaatg

SEQ ID NO: 988585 - DNA, 22 bp, Artificial Sequence
  chemically synthesized
aaatgtaaatgcacattcacat

SEQ ID NO: 988586 - DNA, 22 bp, Artificial Sequence
  chemically synthesized
attatctccatgtgaatgtgca

SEQ ID NO: 988587 - DNA, 22 bp, Artificial Sequence
  chemically synthesized
ttatctccatgtgaatgtgcat

SEQ ID NO: 988588 - DNA, 22 bp, Artificial Sequence
  chemically synthesized
tctaaaatgtaaatgcacattc

SEQ ID NO: 988589 - DNA, 22 bp, Artificial Sequence
  chemically synthesized
tctccatgtgaatgtgcattta

SEQ ID NO: 988590 - DNA, 22 bp, Artificial Sequence
  chemically synthesized
catgtgaatgtgcatttacatt

SEQ ID NO: 988591 - DNA, 22 bp, Artificial Sequence
  chemically synthesized
tatattatctaaaatgtaaatg

SEQ ID NO: 988592 - DNA, 22 bp, Artificial Sequence
  chemically synthesized
acaagtaatctatatattatct

SEQ ID NO: 988593 - DNA, 22 bp, Artificial Sequence
  chemically synthesized
acattttagataatatatagat

SEQ ID NO: 988594 - DNA, 22 bp, Artificial Sequence
  chemically synthesized
cattttagataatatatagatt

SEQ ID NO: 988595 - DNA, 22 bp, Artificial Sequence
  chemically synthesized
taattcacaagtaatctatata

SEQ ID NO: 988596 - DNA, 22 bp, Artificial Sequence
  chemically synthesized
ataattcacaagtaatctatat

SEQ ID NO: 988597 - DNA, 22 bp, Artificial Sequence
  chemically synthesized
tagataatatatagattacttg

SEQ ID NO: 988598 - DNA, 22 bp, Artificial Sequence
  chemically synthesized
agataatatatagattacttgt

SEQ ID NO: 988599 - DNA, 22 bp, Artificial Sequence
  chemically synthesized
gataatatatagattacttgtg

SEQ ID NO: 988600 - DNA, 22 bp, Artificial Sequence
  chemically synthesized
aggcttataattcacaagtaat

SEQ ID NO: 988601 - DNA, 22 bp, Artificial Sequence
  chemically synthesized
aaggcttataattcacaagtaa

SEQ ID NO: 988602 - DNA, 22 bp, Artificial Sequence
  chemically synthesized
taaggcttataattcacaagta

SEQ ID NO: 988603 - DNA, 22 bp, Artificial Sequence
  chemically synthesized
attttaaggcttataattcaca

SEQ ID NO: 988604 - DNA, 22 bp, Artificial Sequence
  chemically synthesized
aattcattttaaggcttataat

SEQ ID NO: 988605 - DNA, 22 bp, Artificial Sequence
  chemically synthesized
gaattcattttaaggcttataa

SEQ ID NO: 988606 - DNA, 22 bp, Artificial Sequence
  chemically synthesized
cttgtgaattataagccttaaa

SEQ ID NO: 988607 - DNA, 22 bp, Artificial Sequence
  chemically synthesized
gtgaattataagccttaaaatg

SEQ ID NO: 988608 - DNA, 22 bp, Artificial Sequence
  chemically synthesized
tgaattataagccttaaaatga

SEQ ID NO: 988609 - DNA, 22 bp, Artificial Sequence
  chemically synthesized
acatgtttgaattcattttaag

SEQ ID NO: 988610 - DNA, 22 bp, Artificial Sequence
  chemically synthesized
ctgacatgtttgaattcatttt

SEQ ID NO: 988611 - DNA, 22 bp, Artificial Sequence
  chemically synthesized
ctactgacatgtttgaattcat

SEQ ID NO: 988612 - DNA, 22 bp, Artificial Sequence
  chemically synthesized
taagccttaaaatgaattcaaa

SEQ ID NO: 988613 - DNA, 22 bp, Artificial Sequence
  chemically synthesized
cctactgacatgtttgaattca

SEQ ID NO: 988614 - DNA, 22 bp, Artificial Sequence
  chemically synthesized
ttcctactgacatgtttgaatt

SEQ ID NO: 988615 - DNA, 22 bp, Artificial Sequence
  chemically synthesized
cttcctactgacatgtttgaat

SEQ ID NO: 988616 - DNA, 22 bp, Artificial Sequence
  chemically synthesized
aaaatgaattcaaacatgtcag

SEQ ID NO: 988617 - DNA, 22 bp, Artificial Sequence
  chemically synthesized
aaatgaattcaaacatgtcagt

SEQ ID NO: 988618 - DNA, 22 bp, Artificial Sequence
  chemically synthesized
taatatggtagcttcttcctac

SEQ ID NO: 988619 - DNA, 22 bp, Artificial Sequence
  chemically synthesized
aaacatgtcagtaggaagaagc

SEQ ID NO: 988620 - DNA, 22 bp, Artificial Sequence
  chemically synthesized
aagaatctgtaatatggtagct

SEQ ID NO: 988621 - DNA, 22 bp, Artificial Sequence
  chemically synthesized
caagaatctgtaatatggtagc

SEQ ID NO: 988622 - DNA, 22 bp, Artificial Sequence
  chemically synthesized
tcaagaatctgtaatatggtag

SEQ ID NO: 988623 - DNA, 22 bp, Artificial Sequence
  chemically synthesized
tgattttcaagaatctgtaata

SEQ ID NO: 988624 - DNA, 22 bp, Artificial Sequence
  chemically synthesized
gtgattttcaagaatctgtaat

SEQ ID NO: 988625 - DNA, 22 bp, Artificial Sequence
  chemically synthesized
aatttgtgattttcaagaatct

SEQ ID NO: 988626 - DNA, 22 bp, Artificial Sequence
  chemically synthesized
caatttgtgattttcaagaatc

SEQ ID NO: 988627 - DNA, 22 bp, Artificial Sequence
  chemically synthesized
ccatattacagattcttgaaaa

SEQ ID NO: 988628 - DNA, 22 bp, Artificial Sequence
  chemically synthesized
ggtaatttcaatttgtgatttt

SEQ ID NO: 988629 - DNA, 22 bp, Artificial Sequence
  chemically synthesized
cagattcttgaaaatcacaaat

SEQ ID NO: 988630 - DNA, 22 bp, Artificial Sequence
  chemically synthesized
ttgaaaatcacaaattgaaatt

SEQ ID NO: 988631 - DNA, 22 bp, Artificial Sequence
  chemically synthesized
gaaaatcacaaattgaaattac

SEQ ID NO: 988632 - DNA, 22 bp, Artificial Sequence
  chemically synthesized
aaaatcacaaattgaaattacc

SEQ ID NO: 988633 - DNA, 22 bp, Artificial Sequence
  chemically synthesized
taatcatatcattaggtaattt

SEQ ID NO: 988634 - DNA, 22 bp, Artificial Sequence
  chemically synthesized
aattataatcatatcattaggt

SEQ ID NO: 988635 - DNA, 22 bp, Artificial Sequence
  chemically synthesized
gtattaaattataatcatatca

SEQ ID NO: 988636 - DNA, 22 bp, Artificial Sequence
  chemically synthesized
aaattacctaatgatatgatta

SEQ ID NO: 988637 - DNA, 22 bp, Artificial Sequence
  chemically synthesized
atactagtattaaattataatc

SEQ ID NO: 988638 - DNA, 22 bp, Artificial Sequence
  chemically synthesized
cctaatgatatgattataattt

SEQ ID NO: 988639 - DNA, 22 bp, Artificial Sequence
  chemically synthesized
gatactagtattaaattataat

SEQ ID NO: 988640 - DNA, 22 bp, Artificial Sequence
  chemically synthesized
tgatactagtattaaattataa

SEQ ID NO: 988641 - DNA, 22 bp, Artificial Sequence
  chemically synthesized
atgatatgattataatttaata

SEQ ID NO: 988642 - DNA, 22 bp, Artificial Sequence
  chemically synthesized
taatttaatactagtatcaaag

SEQ ID NO: 988643 - DNA, 22 bp, Artificial Sequence
  chemically synthesized
aatactagtatcaaaggtattt

SEQ ID NO: 988644 - DNA, 22 bp, Artificial Sequence
  chemically synthesized
atactagtatcaaaggtatttt

SEQ ID NO: 988645 - DNA, 22 bp, Artificial Sequence
  chemically synthesized
gtatcaaaggtatttttcctat

SEQ ID NO: 988646 - DNA, 22 bp, Artificial Sequence
  chemically synthesized
gtaaaataaaataataggaaaa

SEQ ID NO: 988647 - DNA, 22 bp, Artificial Sequence
  chemically synthesized
cagtaattagtaaaataaaata

SEQ ID NO: 988648 - DNA, 22 bp, Artificial Sequence
  chemically synthesized
acagtaattagtaaaataaaat

SEQ ID NO: 988649 - DNA, 22 bp, Artificial Sequence
  chemically synthesized
ttcctattattttattttacta

SEQ ID NO: 988650 - DNA, 22 bp, Artificial Sequence
  chemically synthesized
tcctattattttattttactaa

SEQ ID NO: 988651 - DNA, 22 bp, Artificial Sequence
  chemically synthesized
cctattattttattttactaat

SEQ ID NO: 988652 - DNA, 22 bp, Artificial Sequence
  chemically synthesized
ctattattttattttactaatt

SEQ ID NO: 988653 - DNA, 22 bp, Artificial Sequence
  chemically synthesized
ttattttattttactaattact

SEQ ID NO: 988654 - DNA, 22 bp, Artificial Sequence
  chemically synthesized
ccgatagtttacagtaattagt

SEQ ID NO: 988655 - DNA, 22 bp, Artificial Sequence
  chemically synthesized
ttttattttactaattactgta

SEQ ID NO: 988656 - DNA, 22 bp, Artificial Sequence
  chemically synthesized
tattttactaattactgtaaac

SEQ ID NO: 988657 - DNA, 22 bp, Artificial Sequence
  chemically synthesized
attttactaattactgtaaact

SEQ ID NO: 988658 - DNA, 22 bp, Artificial Sequence
  chemically synthesized
ttttactaattactgtaaacta

SEQ ID NO: 988659 - DNA, 22 bp, Artificial Sequence
  chemically synthesized
taatcctaccgatagtttacag

SEQ ID NO: 988660 - DNA, 22 bp, Artificial Sequence
  chemically synthesized
tactaattactgtaaactatcg

SEQ ID NO: 988661 - DNA, 22 bp, Artificial Sequence
  chemically synthesized
ctataatcctaccgatagttta

SEQ ID NO: 988662 - DNA, 22 bp, Artificial Sequence
  chemically synthesized
actaattactgtaaactatcgg

SEQ ID NO: 988663 - DNA, 22 bp, Artificial Sequence
  chemically synthesized
ctaattactgtaaactatcggt

SEQ ID NO: 988664 - DNA, 22 bp, Artificial Sequence
  chemically synthesized
ctcctataatcctaccgatagt

SEQ ID NO: 988665 - DNA, 22 bp, Artificial Sequence
  chemically synthesized
gctcctataatcctaccgatag

SEQ ID NO: 988666 - DNA, 22 bp, Artificial Sequence
  chemically synthesized
attactgtaaactatcggtagg

SEQ ID NO: 988667 - DNA, 22 bp, Artificial Sequence
  chemically synthesized
ctgtaaactatcggtaggatta

SEQ ID NO: 988668 - DNA, 22 bp, Artificial Sequence
  chemically synthesized
acgtcttgctcctataatccta

SEQ ID NO: 988669 - DNA, 22 bp, Artificial Sequence
  chemically synthesized
taaactatcggtaggattatag

SEQ ID NO: 988670 - DNA, 22 bp, Artificial Sequence
  chemically synthesized
gacgtcttgctcctataatcct

SEQ ID NO: 988671 - DNA, 22 bp, Artificial Sequence
  chemically synthesized
tcggtaggattataggagcaag

SEQ ID NO: 988672 - DNA, 22 bp, Artificial Sequence
  chemically synthesized
ataaatatcttgacgtcttgct

SEQ ID NO: 988673 - DNA, 22 bp, Artificial Sequence
  chemically synthesized
taggagcaagacgtcaagatat

SEQ ID NO: 988674 - DNA, 22 bp, Artificial Sequence
  chemically synthesized
gtatggttaataaatatcttga

SEQ ID NO: 988675 - DNA, 22 bp, Artificial Sequence
  chemically synthesized
caataaaaaattagtatggtta

SEQ ID NO: 988676 - DNA, 22 bp, Artificial Sequence
  chemically synthesized
ccaataaaaaattagtatggtt

SEQ ID NO: 988677 - DNA, 22 bp, Artificial Sequence
  chemically synthesized
attaaccatactaattttttat

SEQ ID NO: 988678 - DNA, 22 bp, Artificial Sequence
  chemically synthesized
atatggcttccaataaaaaatt

SEQ ID NO: 988679 - DNA, 22 bp, Artificial Sequence
  chemically synthesized
ttaaccatactaattttttatt

SEQ ID NO: 988680 - DNA, 22 bp, Artificial Sequence
  chemically synthesized
aatatggcttccaataaaaaat

SEQ ID NO: 988681 - DNA, 22 bp, Artificial Sequence
  chemically synthesized
accatactaattttttattgga

SEQ ID NO: 988682 - DNA, 22 bp, Artificial Sequence
  chemically synthesized
aatttaatatggcttccaataa

SEQ ID NO: 988683 - DNA, 22 bp, Artificial Sequence
  chemically synthesized
attttttattggaagccatatt

SEQ ID NO: 988684 - DNA, 22 bp, Artificial Sequence
  chemically synthesized
caggttaaatttaatatggctt

SEQ ID NO: 988685 - DNA, 22 bp, Artificial Sequence
  chemically synthesized
acaggttaaatttaatatggct

SEQ ID NO: 988686 - DNA, 22 bp, Artificial Sequence
  chemically synthesized
tacaggttaaatttaatatggc

SEQ ID NO: 988687 - DNA, 22 bp, Artificial Sequence
  chemically synthesized
tttattggaagccatattaaat

SEQ ID NO: 988688 - DNA, 22 bp, Artificial Sequence
  chemically synthesized
ttattggaagccatattaaatt

SEQ ID NO: 988689 - DNA, 22 bp, Artificial Sequence
  chemically synthesized
tattggaagccatattaaattt

SEQ ID NO: 988690 - DNA, 22 bp, Artificial Sequence
  chemically synthesized
attttacaggttaaatttaata

SEQ ID NO: 988691 - DNA, 22 bp, Artificial Sequence
  chemically synthesized
attggaagccatattaaattta

SEQ ID NO: 988692 - DNA, 22 bp, Artificial Sequence
  chemically synthesized
ttggaagccatattaaatttaa

SEQ ID NO: 988693 - DNA, 22 bp, Artificial Sequence
  chemically synthesized
tcattttacaggttaaatttaa

SEQ ID NO: 988694 - DNA, 22 bp, Artificial Sequence
  chemically synthesized
ctcattttacaggttaaattta

SEQ ID NO: 988695 - DNA, 22 bp, Artificial Sequence
  chemically synthesized
tctcattttacaggttaaattt

SEQ ID NO: 988696 - DNA, 22 bp, Artificial Sequence
  chemically synthesized
gaagccatattaaatttaacct

SEQ ID NO: 988697 - DNA, 22 bp, Artificial Sequence
  chemically synthesized
ttctcattttacaggttaaatt

SEQ ID NO: 988698 - DNA, 22 bp, Artificial Sequence
  chemically synthesized
tttttctcattttacaggttaa

SEQ ID NO: 988699 - DNA, 22 bp, Artificial Sequence
  chemically synthesized
atttttctcattttacaggtta

SEQ ID NO: 988700 - DNA, 22 bp, Artificial Sequence
  chemically synthesized
tatttttctcattttacaggtt

SEQ ID NO: 988701 - DNA, 22 bp, Artificial Sequence
  chemically synthesized
ttatttttctcattttacaggt

SEQ ID NO: 988702 - DNA, 22 bp, Artificial Sequence
  chemically synthesized
tttttatttttctcattttaca

SEQ ID NO: 988703 - DNA, 22 bp, Artificial Sequence
  chemically synthesized
aatttaacctgtaaaatgagaa

SEQ ID NO: 988704 - DNA, 22 bp, Artificial Sequence
  chemically synthesized
ctatttttatttttctcatttt

SEQ ID NO: 988705 - DNA, 22 bp, Artificial Sequence
  chemically synthesized
aacctgtaaaatgagaaaaata

SEQ ID NO: 988706 - DNA, 22 bp, Artificial Sequence
  chemically synthesized
acctgtaaaatgagaaaaataa

SEQ ID NO: 988707 - DNA, 22 bp, Artificial Sequence
  chemically synthesized
tgaggttactatttttattttt

SEQ ID NO: 988708 - DNA, 22 bp, Artificial Sequence
  chemically synthesized
taaaatgagaaaaataaaaata

SEQ ID NO: 988709 - DNA, 22 bp, Artificial Sequence
  chemically synthesized
ccacaatctatgaggttactat

SEQ ID NO: 988710 - DNA, 22 bp, Artificial Sequence
  chemically synthesized
accacaatctatgaggttacta

SEQ ID NO: 988711 - DNA, 22 bp, Artificial Sequence
  chemically synthesized
ttaccacaatctatgaggttac

SEQ ID NO: 988712 - DNA, 22 bp, Artificial Sequence
  chemically synthesized
actcttaccacaatctatgagg

SEQ ID NO: 988713 - DNA, 22 bp, Artificial Sequence
  chemically synthesized
gactcttaccacaatctatgag

SEQ ID NO: 988714 - DNA, 22 bp, Artificial Sequence
  chemically synthesized
atttgactcttaccacaatcta

SEQ ID NO: 988715 - DNA, 22 bp, Artificial Sequence
  chemically synthesized
catttgactcttaccacaatct

SEQ ID NO: 988716 - DNA, 22 bp, Artificial Sequence
  chemically synthesized
tttcatttgactcttaccacaa

SEQ ID NO: 988717 - DNA, 22 bp, Artificial Sequence
  chemically synthesized
atagattgtggtaagagtcaaa

SEQ ID NO: 988718 - DNA, 22 bp, Artificial Sequence
  chemically synthesized
atgtaagttatttcatttgact

SEQ ID NO: 988719 - DNA, 22 bp, Artificial Sequence
  chemically synthesized
catgtaagttatttcatttgac

SEQ ID NO: 988720 - DNA, 22 bp, Artificial Sequence
  chemically synthesized
tggtaagagtcaaatgaaataa

SEQ ID NO: 988721 - DNA, 22 bp, Artificial Sequence
  chemically synthesized
caaagcaatttcatgtaagtta

SEQ ID NO: 988722 - DNA, 22 bp, Artificial Sequence
  chemically synthesized
acaaagcaatttcatgtaagtt

SEQ ID NO: 988723 - DNA, 22 bp, Artificial Sequence
  chemically synthesized
taaaacttacaaagcaatttca

SEQ ID NO: 988724 - DNA, 22 bp, Artificial Sequence
  chemically synthesized
acatgaaattgctttgtaagtt

SEQ ID NO: 988725 - DNA, 22 bp, Artificial Sequence
  chemically synthesized
catgaaattgctttgtaagttt

SEQ ID NO: 988726 - DNA, 22 bp, Artificial Sequence
  chemically synthesized
ctttgtaagttttatagggctg

SEQ ID NO: 988727 - DNA, 22 bp, Artificial Sequence
  chemically synthesized
tgtaagttttatagggctgcca

SEQ ID NO: 988728 - DNA, 22 bp, Artificial Sequence
  chemically synthesized
gtaagttttatagggctgccat

SEQ ID NO: 988729 - DNA, 22 bp, Artificial Sequence
  chemically synthesized
taagttttatagggctgccatg

SEQ ID NO: 988730 - DNA, 22 bp, Artificial Sequence
  chemically synthesized
tatagggctgccatgttttgat

SEQ ID NO: 988731 - DNA, 22 bp, Artificial Sequence
  chemically synthesized
atagggctgccatgttttgatt

SEQ ID NO: 988732 - DNA, 22 bp, Artificial Sequence
  chemically synthesized
tagggctgccatgttttgattg

SEQ ID NO: 988733 - DNA, 22 bp, Artificial Sequence
  chemically synthesized
ccatgttttgattgtatgatac

SEQ ID NO: 988734 - DNA, 22 bp, Artificial Sequence
  chemically synthesized
aacagtagggatacatagtatc

SEQ ID NO: 988735 - DNA, 22 bp, Artificial Sequence
  chemically synthesized
tgattgtatgatactatgtatc

SEQ ID NO: 988736 - DNA, 22 bp, Artificial Sequence
  chemically synthesized
gattgtatgatactatgtatcc

SEQ ID NO: 988737 - DNA, 22 bp, Artificial Sequence
  chemically synthesized
attgtatgatactatgtatccc

SEQ ID NO: 988738 - DNA, 22 bp, Artificial Sequence
  chemically synthesized
tatgatactatgtatccctact

SEQ ID NO: 988739 - DNA, 22 bp, Artificial Sequence
  chemically synthesized
tgtatccctactgtttaggaca

SEQ ID NO: 988740 - DNA, 22 bp, Artificial Sequence
  chemically synthesized
aacaggaagagatgtcctaaac

SEQ ID NO: 988741 - DNA, 22 bp, Artificial Sequence
  chemically synthesized
ctgtttaggacatctcttcctg

SEQ ID NO: 988742 - DNA, 22 bp, Artificial Sequence
  chemically synthesized
tttaggacatctcttcctgttt

SEQ ID NO: 988743 - DNA, 22 bp, Artificial Sequence
  chemically synthesized
aggacatctcttcctgtttagg

SEQ ID NO: 988744 - DNA, 22 bp, Artificial Sequence
  chemically synthesized
ggacatctcttcctgtttagga

SEQ ID NO: 988745 - DNA, 22 bp, Artificial Sequence
  chemically synthesized
cacatatgaaagagatgtccta

SEQ ID NO: 988746 - DNA, 22 bp, Artificial Sequence
  chemically synthesized
tgcacatatgaaagagatgtcc

SEQ ID NO: 988747 - DNA, 22 bp, Artificial Sequence
  chemically synthesized
ttcctgtttaggacatctcttt

SEQ ID NO: 988748 - DNA, 22 bp, Artificial Sequence
  chemically synthesized
cctgtttaggacatctctttca

SEQ ID NO: 988749 - DNA, 22 bp, Artificial Sequence
  chemically synthesized
ctgtttaggacatctctttcat

SEQ ID NO: 988750 - DNA, 22 bp, Artificial Sequence
  chemically synthesized
tttaggacatctctttcatatg

SEQ ID NO: 988751 - DNA, 22 bp, Artificial Sequence
  chemically synthesized
aggacatctctttcatatgtgc

SEQ ID NO: 988752 - DNA, 22 bp, Artificial Sequence
  chemically synthesized
ggacatctctttcatatgtgca

SEQ ID NO: 988753 - DNA, 22 bp, Artificial Sequence
  chemically synthesized
tttcatatgtgcagagacctgt

SEQ ID NO: 988754 - DNA, 22 bp, Artificial Sequence
  chemically synthesized
tcatatgtgcagagacctgtgt

SEQ ID NO: 988755 - DNA, 22 bp, Artificial Sequence
  chemically synthesized
catatgtgcagagacctgtgtt

SEQ ID NO: 988756 - DNA, 22 bp, Artificial Sequence
  chemically synthesized
atatgtgcagagacctgtgttt

SEQ ID NO: 988757 - DNA, 22 bp, Artificial Sequence
  chemically synthesized
tgaataaaaaaagcagtaaaca

SEQ ID NO: 988758 - DNA, 22 bp, Artificial Sequence
  chemically synthesized
tgtttactgctttttttattca

SEQ ID NO: 988759 - DNA, 22 bp, Artificial Sequence
  chemically synthesized
actgctttttttattcacaatg

SEQ ID NO: 988760 - DNA, 22 bp, Artificial Sequence
  chemically synthesized
ctgctttttttattcacaatgt

SEQ ID NO: 988761 - DNA, 22 bp, Artificial Sequence
  chemically synthesized
ctttttttattcacaatgtggt

SEQ ID NO: 988762 - DNA, 22 bp, Artificial Sequence
  chemically synthesized
tggtaacaaaagaccacattgt

SEQ ID NO: 988763 - DNA, 22 bp, Artificial Sequence
  chemically synthesized
atggtaacaaaagaccacattg

SEQ ID NO: 988764 - DNA, 22 bp, Artificial Sequence
  chemically synthesized
tttttattcacaatgtggtctt

SEQ ID NO: 988765 - DNA, 22 bp, Artificial Sequence
  chemically synthesized
ttttattcacaatgtggtcttt

SEQ ID NO: 988766 - DNA, 22 bp, Artificial Sequence
  chemically synthesized
tttattcacaatgtggtctttt

SEQ ID NO: 988767 - DNA, 22 bp, Artificial Sequence
  chemically synthesized
acttatggtaacaaaagaccac

SEQ ID NO: 988768 - DNA, 22 bp, Artificial Sequence
  chemically synthesized
ttattcacaatgtggtcttttg

SEQ ID NO: 988769 - DNA, 22 bp, Artificial Sequence
  chemically synthesized
tattcacaatgtggtcttttgt

SEQ ID NO: 988770 - DNA, 22 bp, Artificial Sequence
  chemically synthesized
attcacaatgtggtcttttgtt

SEQ ID NO: 988771 - DNA, 22 bp, Artificial Sequence
  chemically synthesized
ttcacaatgtggtcttttgtta

SEQ ID NO: 988772 - DNA, 22 bp, Artificial Sequence
  chemically synthesized
attaacttatggtaacaaaaga

SEQ ID NO: 988773 - DNA, 22 bp, Artificial Sequence
  chemically synthesized
cattaacttatggtaacaaaag

SEQ ID NO: 988774 - DNA, 22 bp, Artificial Sequence
  chemically synthesized
tcattaacttatggtaacaaaa

SEQ ID NO: 988775 - DNA, 22 bp, Artificial Sequence
  chemically synthesized
acaatgtggtcttttgttacca

SEQ ID NO: 988776 - DNA, 22 bp, Artificial Sequence
  chemically synthesized
aaaaatgttttcattaacttat

SEQ ID NO: 988777 - DNA, 22 bp, Artificial Sequence
  chemically synthesized
ttgttaccataagttaatgaaa

SEQ ID NO: 988778 - DNA, 22 bp, Artificial Sequence
  chemically synthesized
tgttaccataagttaatgaaaa

SEQ ID NO: 988779 - DNA, 22 bp, Artificial Sequence
  chemically synthesized
gttaccataagttaatgaaaac

SEQ ID NO: 988780 - DNA, 22 bp, Artificial Sequence
  chemically synthesized
ttaccataagttaatgaaaaca

SEQ ID NO: 988781 - DNA, 22 bp, Artificial Sequence
  chemically synthesized
caagactgaaaaatgttttcat

SEQ ID NO: 988782 - DNA, 22 bp, Artificial Sequence
  chemically synthesized
ccataagttaatgaaaacattt

SEQ ID NO: 988783 - DNA, 22 bp, Artificial Sequence
  chemically synthesized
taaattacaagactgaaaaatg

SEQ ID NO: 988784 - DNA, 22 bp, Artificial Sequence
  chemically synthesized
ataaattacaagactgaaaaat

SEQ ID NO: 988785 - DNA, 22 bp, Artificial Sequence
  chemically synthesized
tataaattacaagactgaaaaa

SEQ ID NO: 988786 - DNA, 22 bp, Artificial Sequence
  chemically synthesized
atgaaaacatttttcagtcttg

SEQ ID NO: 988787 - DNA, 22 bp, Artificial Sequence
  chemically synthesized
acattttataaattacaagact

SEQ ID NO: 988788 - DNA, 22 bp, Artificial Sequence
  chemically synthesized
ttcagtcttgtaatttataaaa

SEQ ID NO: 988789 - DNA, 22 bp, Artificial Sequence
  chemically synthesized
ataacactaacattttataaat

SEQ ID NO: 988790 - DNA, 22 bp, Artificial Sequence
  chemically synthesized
tcagtcttgtaatttataaaat

SEQ ID NO: 988791 - DNA, 22 bp, Artificial Sequence
  chemically synthesized
cagtcttgtaatttataaaatg

SEQ ID NO: 988792 - DNA, 22 bp, Artificial Sequence
  chemically synthesized
agtcttgtaatttataaaatgt

SEQ ID NO: 988793 - DNA, 22 bp, Artificial Sequence
  chemically synthesized
ttaataacactaacattttata

SEQ ID NO: 988794 - DNA, 22 bp, Artificial Sequence
  chemically synthesized
gtaatttataaaatgttagtgt

SEQ ID NO: 988795 - DNA, 22 bp, Artificial Sequence
  chemically synthesized
taatttataaaatgttagtgtt

SEQ ID NO: 988796 - DNA, 22 bp, Artificial Sequence
  chemically synthesized
tgtatagttgttaataacacta

SEQ ID NO: 988797 - DNA, 22 bp, Artificial Sequence
  chemically synthesized
ataaaatgttagtgttattaac

SEQ ID NO: 988798 - DNA, 22 bp, Artificial Sequence
  chemically synthesized
taaaatgttagtgttattaaca

SEQ ID NO: 988799 - DNA, 22 bp, Artificial Sequence
  chemically synthesized
tcatctatgtatagttgttaat

SEQ ID NO: 988800 - DNA, 22 bp, Artificial Sequence
  chemically synthesized
tatcatctatgtatagttgtta

SEQ ID NO: 988801 - DNA, 22 bp, Artificial Sequence
  chemically synthesized
tctctatcatctatgtatagtt

SEQ ID NO: 988802 - DNA, 22 bp, Artificial Sequence
  chemically synthesized
gtgttattaacaactatacata

SEQ ID NO: 988803 - DNA, 22 bp, Artificial Sequence
  chemically synthesized
tctatctctatcatctatgtat

SEQ ID NO: 988804 - DNA, 22 bp, Artificial Sequence
  chemically synthesized
ttaacaactatacatagatgat

SEQ ID NO: 988805 - DNA, 22 bp, Artificial Sequence
  chemically synthesized
acaactatacatagatgataga

SEQ ID NO: 988806 - DNA, 22 bp, Artificial Sequence
  chemically synthesized
tcatctatctatctctatcatc

SEQ ID NO: 988807 - DNA, 22 bp, Artificial Sequence
  chemically synthesized
tctatcatctatctatctctat

SEQ ID NO: 988808 - DNA, 22 bp, Artificial Sequence
  chemically synthesized
atctatcatctatctatctcta

SEQ ID NO: 988809 - DNA, 22 bp, Artificial Sequence
  chemically synthesized
tacatagatgatagagatagat

SEQ ID NO: 988810 - DNA, 22 bp, Artificial Sequence
  chemically synthesized
tcgatggatcggtttatctatc

SEQ ID NO: 988811 - DNA, 22 bp, Artificial Sequence
  chemically synthesized
tctatcgatggatcggtttatc

SEQ ID NO: 988812 - DNA, 22 bp, Artificial Sequence
  chemically synthesized
tctatctatcgatggatcggtt

SEQ ID NO: 988813 - DNA, 22 bp, Artificial Sequence
  chemically synthesized
atctatctatcgatggatcggt

SEQ ID NO: 988814 - DNA, 22 bp, Artificial Sequence
  chemically synthesized
cttatctatctatcgatggatc

SEQ ID NO: 988815 - DNA, 22 bp, Artificial Sequence
  chemically synthesized
acttatctatctatcgatggat

SEQ ID NO: 988816 - DNA, 22 bp, Artificial Sequence
  chemically synthesized
tacttatctatctatcgatgga

SEQ ID NO: 988817 - DNA, 22 bp, Artificial Sequence
  chemically synthesized
ctttacttatctatctatcgat

SEQ ID NO: 988818 - DNA, 22 bp, Artificial Sequence
  chemically synthesized
tcctttacttatctatctatcg

SEQ ID NO: 988819 - DNA, 22 bp, Artificial Sequence
  chemically synthesized
tcactctcctttacttatctat

SEQ ID NO: 988820 - DNA, 22 bp, Artificial Sequence
  chemically synthesized
tgtcactctcctttacttatct

SEQ ID NO: 988821 - DNA, 22 bp, Artificial Sequence
  chemically synthesized
tctctgtcactctcctttactt

SEQ ID NO: 988822 - DNA, 22 bp, Artificial Sequence
  chemically synthesized
cctgtctctgtcactctccttt

SEQ ID NO: 988823 - DNA, 22 bp, Artificial Sequence
  chemically synthesized
tccctgtctctgtcactctcct

SEQ ID NO: 988824 - DNA, 22 bp, Artificial Sequence
  chemically synthesized
cctctccctgtctctgtcactc

SEQ ID NO: 988825 - DNA, 22 bp, Artificial Sequence
  chemically synthesized
tccctctccctgtctctgtcac

SEQ ID NO: 988826 - DNA, 22 bp, Artificial Sequence
  chemically synthesized
cctctccctctccctgtctctg

SEQ ID NO: 988827 - DNA, 22 bp, Artificial Sequence
  chemically synthesized
ccctctccctctccctgtctct

SEQ ID NO: 988828 - DNA, 22 bp, Artificial Sequence
  chemically synthesized
tccctctccctctccctgtctc

SEQ ID NO: 988829 - DNA, 22 bp, Artificial Sequence
  chemically synthesized
cctttccctctccctctccctg

SEQ ID NO: 988830 - DNA, 22 bp, Artificial Sequence
  chemically synthesized
ccctttccctctccctctccct

SEQ ID NO: 988831 - DNA, 22 bp, Artificial Sequence
  chemically synthesized
tccctttccctctccctctccc

SEQ ID NO: 988832 - DNA, 22 bp, Artificial Sequence
  chemically synthesized
ccaccatccctttccctttccc

SEQ ID NO: 988833 - DNA, 22 bp, Artificial Sequence
  chemically synthesized
tcccaccatccctttccctttc

SEQ ID NO: 988834 - DNA, 22 bp, Artificial Sequence
  chemically synthesized
tctcccaccatccctttccctt

SEQ ID NO: 988835 - DNA, 22 bp, Artificial Sequence
  chemically synthesized
tctctcccaccatccctttccc

SEQ ID NO: 988836 - DNA, 22 bp, Artificial Sequence
  chemically synthesized
tctctctcccaccatccctttc

SEQ ID NO: 988837 - DNA, 22 bp, Artificial Sequence
  chemically synthesized
ctctctctcccaccatcccttt

SEQ ID NO: 988838 - DNA, 22 bp, Artificial Sequence
  chemically synthesized
cttctctctctcccaccatccc

SEQ ID NO: 988839 - DNA, 22 bp, Artificial Sequence
  chemically synthesized
agttacttctctctctcccacc

SEQ ID NO: 988840 - DNA, 22 bp, Artificial Sequence
  chemically synthesized
cccatccatccactcagttact

SEQ ID NO: 988841 - DNA, 22 bp, Artificial Sequence
  chemically synthesized
atctacccatccatccactcag

SEQ ID NO: 988842 - DNA, 22 bp, Artificial Sequence
  chemically synthesized
ttcatctacccatccatccact

SEQ ID NO: 988843 - DNA, 22 bp, Artificial Sequence
  chemically synthesized
attcatctacccatccatccac

SEQ ID NO: 988844 - DNA, 22 bp, Artificial Sequence
  chemically synthesized
agtggatggatgggtagatgaa

SEQ ID NO: 988845 - DNA, 22 bp, Artificial Sequence
  chemically synthesized
catccatccatccacttattca

SEQ ID NO: 988846 - DNA, 22 bp, Artificial Sequence
  chemically synthesized
ccatccatccatccacttattc

SEQ ID NO: 988847 - DNA, 22 bp, Artificial Sequence
  chemically synthesized
cttccatccatccatccactta

SEQ ID NO: 988848 - DNA, 22 bp, Artificial Sequence
  chemically synthesized
tctccttccatccatccatcca

SEQ ID NO: 988849 - DNA, 22 bp, Artificial Sequence
  chemically synthesized
cctgtctccttccatccatcca

SEQ ID NO: 988850 - DNA, 22 bp, Artificial Sequence
  chemically synthesized
tctacctgtctccttccatcca

SEQ ID NO: 988851 - DNA, 22 bp, Artificial Sequence
  chemically synthesized
gctgtctacctgtctccttcca

SEQ ID NO: 988852 - DNA, 22 bp, Artificial Sequence
  chemically synthesized
tccatatatacccatctggctg

SEQ ID NO: 988853 - DNA, 22 bp, Artificial Sequence
  chemically synthesized
tctatccatatatacccatctg

SEQ ID NO: 988854 - DNA, 22 bp, Artificial Sequence
  chemically synthesized
aataataggacaaagatcatac

SEQ ID NO: 988855 - DNA, 22 bp, Artificial Sequence
  chemically synthesized
aagcaagggaagttaaataata

SEQ ID NO: 988856 - DNA, 22 bp, Artificial Sequence
  chemically synthesized
aaattgaagcaagggaagttaa

SEQ ID NO: 988857 - DNA, 22 bp, Artificial Sequence
  chemically synthesized
tgtcctattatttaacttccct

SEQ ID NO: 988858 - DNA, 22 bp, Artificial Sequence
  chemically synthesized
gtcctattatttaacttccctt

SEQ ID NO: 988859 - DNA, 22 bp, Artificial Sequence
  chemically synthesized
taaaattgaagcaagggaagtt

SEQ ID NO: 988860 - DNA, 22 bp, Artificial Sequence
  chemically synthesized
tcctattatttaacttcccttg

SEQ ID NO: 988861 - DNA, 22 bp, Artificial Sequence
  chemically synthesized
ctaaaattgaagcaagggaagt

SEQ ID NO: 988862 - DNA, 22 bp, Artificial Sequence
  chemically synthesized
ttatttaacttcccttgcttca

SEQ ID NO: 988863 - DNA, 22 bp, Artificial Sequence
  chemically synthesized
tatcttctaaaattgaagcaag

SEQ ID NO: 988864 - DNA, 22 bp, Artificial Sequence
  chemically synthesized
atatcttctaaaattgaagcaa

SEQ ID NO: 988865 - DNA, 22 bp, Artificial Sequence
  chemically synthesized
tttaacttcccttgcttcaatt

SEQ ID NO: 988866 - DNA, 22 bp, Artificial Sequence
  chemically synthesized
tatatcttctaaaattgaagca

SEQ ID NO: 988867 - DNA, 22 bp, Artificial Sequence
  chemically synthesized
aacttcccttgcttcaatttta

SEQ ID NO: 988868 - DNA, 22 bp, Artificial Sequence
  chemically synthesized
ttttatatcttctaaaattgaa

SEQ ID NO: 988869 - DNA, 22 bp, Artificial Sequence
  chemically synthesized
acttcccttgcttcaattttag

SEQ ID NO: 988870 - DNA, 22 bp, Artificial Sequence
  chemically synthesized
cccttgcttcaattttagaaga

SEQ ID NO: 988871 - DNA, 22 bp, Artificial Sequence
  chemically synthesized
tcctattttatatcttctaaaa

SEQ ID NO: 988872 - DNA, 22 bp, Artificial Sequence
  chemically synthesized
ccttgcttcaattttagaagat

SEQ ID NO: 988873 - DNA, 22 bp, Artificial Sequence
  chemically synthesized
ttatcctattttatatcttcta

SEQ ID NO: 988874 - DNA, 22 bp, Artificial Sequence
  chemically synthesized
gttatcctattttatatcttct

SEQ ID NO: 988875 - DNA, 22 bp, Artificial Sequence
  chemically synthesized
gcttcaattttagaagatataa

SEQ ID NO: 988876 - DNA, 22 bp, Artificial Sequence
  chemically synthesized
cttcaattttagaagatataaa

SEQ ID NO: 988877 - DNA, 22 bp, Artificial Sequence
  chemically synthesized
ttgttatcctattttatatctt

SEQ ID NO: 988878 - DNA, 22 bp, Artificial Sequence
  chemically synthesized
caattttagaagatataaaata

SEQ ID NO: 988879 - DNA, 22 bp, Artificial Sequence
  chemically synthesized
aattttagaagatataaaatag

SEQ ID NO: 988880 - DNA, 22 bp, Artificial Sequence
  chemically synthesized
tagaagatataaaataggataa

SEQ ID NO: 988881 - DNA, 22 bp, Artificial Sequence
  chemically synthesized
agaagatataaaataggataac

SEQ ID NO: 988882 - DNA, 22 bp, Artificial Sequence
  chemically synthesized
gaagatataaaataggataaca

SEQ ID NO: 988883 - DNA, 22 bp, Artificial Sequence
  chemically synthesized
taagataggtactcttgttatc

SEQ ID NO: 988884 - DNA, 22 bp, Artificial Sequence
  chemically synthesized
atagcaatcctataagataggt

SEQ ID NO: 988885 - DNA, 22 bp, Artificial Sequence
  chemically synthesized
atgctcatagcaatcctataag

SEQ ID NO: 988886 - DNA, 22 bp, Artificial Sequence
  chemically synthesized
aatgctcatagcaatcctataa

SEQ ID NO: 988887 - DNA, 22 bp, Artificial Sequence
  chemically synthesized
ccttaatgctcatagcaatcct

SEQ ID NO: 988888 - DNA, 22 bp, Artificial Sequence
  chemically synthesized
actaccttaatgctcatagcaa

SEQ ID NO: 988889 - DNA, 22 bp, Artificial Sequence
  chemically synthesized
aactaccttaatgctcatagca

SEQ ID NO: 988890 - DNA, 22 bp, Artificial Sequence
  chemically synthesized
tcttataggattgctatgagca

SEQ ID NO: 988891 - DNA, 22 bp, Artificial Sequence
  chemically synthesized
ataggattgctatgagcattaa

SEQ ID NO: 988892 - DNA, 22 bp, Artificial Sequence
  chemically synthesized
taggattgctatgagcattaag

SEQ ID NO: 988893 - DNA, 22 bp, Artificial Sequence
  chemically synthesized
ctatgagcattaaggtagttaa

SEQ ID NO: 988894 - DNA, 22 bp, Artificial Sequence
  chemically synthesized
gtatgtgtcaggcttaactacc

SEQ ID NO: 988895 - DNA, 22 bp, Artificial Sequence
  chemically synthesized
agtatgtgtcaggcttaactac

SEQ ID NO: 988896 - DNA, 22 bp, Artificial Sequence
  chemically synthesized
tgagcattaaggtagttaagcc

SEQ ID NO: 988897 - DNA, 22 bp, Artificial Sequence
  chemically synthesized
ttagtatgtgtcaggcttaact

SEQ ID NO: 988898 - DNA, 22 bp, Artificial Sequence
  chemically synthesized
agctcttagtatgtgtcaggct

SEQ ID NO: 988899 - DNA, 22 bp, Artificial Sequence
  chemically synthesized
aggtagttaagcctgacacata

SEQ ID NO: 988900 - DNA, 22 bp, Artificial Sequence
  chemically synthesized
ctgagctcttagtatgtgtcag

SEQ ID NO: 988901 - DNA, 22 bp, Artificial Sequence
  chemically synthesized
gctgagctcttagtatgtgtca

SEQ ID NO: 988902 - DNA, 22 bp, Artificial Sequence
  chemically synthesized
acacttgctgagctcttagtat

SEQ ID NO: 988903 - DNA, 22 bp, Artificial Sequence
  chemically synthesized
aacacttgctgagctcttagta

SEQ ID NO: 988904 - DNA, 22 bp, Artificial Sequence
  chemically synthesized
agcctgacacatactaagagct

SEQ ID NO: 988905 - DNA, 22 bp, Artificial Sequence
  chemically synthesized
acacatactaagagctcagcaa

SEQ ID NO: 988906 - DNA, 22 bp, Artificial Sequence
  chemically synthesized
cagtgaaaaatacttaacactt

SEQ ID NO: 988907 - DNA, 22 bp, Artificial Sequence
  chemically synthesized
agagctcagcaagtgttaagta

SEQ ID NO: 988908 - DNA, 22 bp, Artificial Sequence
  chemically synthesized
agcaagtgttaagtatttttca

SEQ ID NO: 988909 - DNA, 22 bp, Artificial Sequence
  chemically synthesized
agagccaaataccaactacagt

SEQ ID NO: 988910 - DNA, 22 bp, Artificial Sequence
  chemically synthesized
aagagccaaataccaactacag

SEQ ID NO: 988911 - DNA, 22 bp, Artificial Sequence
  chemically synthesized
agtatttttcactgtagttggt

SEQ ID NO: 988912 - DNA, 22 bp, Artificial Sequence
  chemically synthesized
taagagccaaataccaactaca

SEQ ID NO: 988913 - DNA, 22 bp, Artificial Sequence
  chemically synthesized
tttaagagccaaataccaacta

SEQ ID NO: 988914 - DNA, 22 bp, Artificial Sequence
  chemically synthesized
ttcactgtagttggtatttggc

SEQ ID NO: 988915 - DNA, 22 bp, Artificial Sequence
  chemically synthesized
tcactgtagttggtatttggct

SEQ ID NO: 988916 - DNA, 22 bp, Artificial Sequence
  chemically synthesized
cactgtagttggtatttggctc

SEQ ID NO: 988917 - DNA, 22 bp, Artificial Sequence
  chemically synthesized
actgtagttggtatttggctct

SEQ ID NO: 988918 - DNA, 22 bp, Artificial Sequence
  chemically synthesized
tagttggtatttggctcttaaa

SEQ ID NO: 988919 - DNA, 22 bp, Artificial Sequence
  chemically synthesized
gtatttggctcttaaagaatct

SEQ ID NO: 988920 - DNA, 22 bp, Artificial Sequence
  chemically synthesized
tatagaaatatgtgacagattc

SEQ ID NO: 988921 - DNA, 22 bp, Artificial Sequence
  chemically synthesized
ggctcttaaagaatctgtcaca

SEQ ID NO: 988922 - DNA, 22 bp, Artificial Sequence
  chemically synthesized
gctcttaaagaatctgtcacat

SEQ ID NO: 988923 - DNA, 22 bp, Artificial Sequence
  chemically synthesized
ttaaagaatctgtcacatattt

SEQ ID NO: 988924 - DNA, 22 bp, Artificial Sequence
  chemically synthesized
aaaactgtatagaaatatgtga

SEQ ID NO: 988925 - DNA, 22 bp, Artificial Sequence
  chemically synthesized
aaaaactgtatagaaatatgtg

SEQ ID NO: 988926 - DNA, 22 bp, Artificial Sequence
  chemically synthesized
aaagaatctgtcacatatttct

SEQ ID NO: 988927 - DNA, 22 bp, Artificial Sequence
  chemically synthesized
aagaatctgtcacatatttcta

SEQ ID NO: 988928 - DNA, 22 bp, Artificial Sequence
  chemically synthesized
tgaatttaaaaactgtatagaa

SEQ ID NO: 988929 - DNA, 22 bp, Artificial Sequence
  chemically synthesized
tcacatatttctatacagtttt

SEQ ID NO: 988930 - DNA, 22 bp, Artificial Sequence
  chemically synthesized
atctatgaatttaaaaactgta

SEQ ID NO: 988931 - DNA, 22 bp, Artificial Sequence
  chemically synthesized
catctaatctatgaatttaaaa

SEQ ID NO: 988932 - DNA, 22 bp, Artificial Sequence
  chemically synthesized
ctatacagtttttaaattcata

SEQ ID NO: 988933 - DNA, 22 bp, Artificial Sequence
  chemically synthesized
tatacagtttttaaattcatag

SEQ ID NO: 988934 - DNA, 22 bp, Artificial Sequence
  chemically synthesized
ggctacatctaatctatgaatt

SEQ ID NO: 988935 - DNA, 22 bp, Artificial Sequence
  chemically synthesized
tacagtttttaaattcatagat

SEQ ID NO: 988936 - DNA, 22 bp, Artificial Sequence
  chemically synthesized
ttaggctacatctaatctatga

SEQ ID NO: 988937 - DNA, 22 bp, Artificial Sequence
  chemically synthesized
attattaggctacatctaatct

SEQ ID NO: 988938 - DNA, 22 bp, Artificial Sequence
  chemically synthesized
ttaaattcatagattagatgta

SEQ ID NO: 988939 - DNA, 22 bp, Artificial Sequence
  chemically synthesized
tcattattaggctacatctaat

SEQ ID NO: 988940 - DNA, 22 bp, Artificial Sequence
  chemically synthesized
taaattcatagattagatgtag

SEQ ID NO: 988941 - DNA, 22 bp, Artificial Sequence
  chemically synthesized
aaattcatagattagatgtagc

SEQ ID NO: 988942 - DNA, 22 bp, Artificial Sequence
  chemically synthesized
aattcatagattagatgtagcc

SEQ ID NO: 988943 - DNA, 22 bp, Artificial Sequence
  chemically synthesized
ctctcattattaggctacatct

SEQ ID NO: 988944 - DNA, 22 bp, Artificial Sequence
  chemically synthesized
atagattagatgtagcctaata

SEQ ID NO: 988945 - DNA, 22 bp, Artificial Sequence
  chemically synthesized
atggatgattgctctcattatt

SEQ ID NO: 988946 - DNA, 22 bp, Artificial Sequence
  chemically synthesized
aatggatgattgctctcattat

SEQ ID NO: 988947 - DNA, 22 bp, Artificial Sequence
  chemically synthesized
gatgtagcctaataatgagagc

SEQ ID NO: 988948 - DNA, 22 bp, Artificial Sequence
  chemically synthesized
ataatgagagcaatcatccatt

SEQ ID NO: 988949 - DNA, 22 bp, Artificial Sequence
  chemically synthesized
gacacatagagggtgcttaatg

SEQ ID NO: 988950 - DNA, 22 bp, Artificial Sequence
  chemically synthesized
agacacatagagggtgcttaat

SEQ ID NO: 988951 - DNA, 22 bp, Artificial Sequence
  chemically synthesized
cgtttagacacatagagggtgc

SEQ ID NO: 988952 - DNA, 22 bp, Artificial Sequence
  chemically synthesized
agcaccctctatgtgtctaaac

SEQ ID NO: 988953 - DNA, 22 bp, Artificial Sequence
  chemically synthesized
cggtatgtaaaacatctgcgtt

SEQ ID NO: 988954 - DNA, 22 bp, Artificial Sequence
  chemically synthesized
acggtatgtaaaacatctgcgt

SEQ ID NO: 988955 - DNA, 22 bp, Artificial Sequence
  chemically synthesized
tatgtgtctaaacgcagatgtt

SEQ ID NO: 988956 - DNA, 22 bp, Artificial Sequence
  chemically synthesized
tgtgtctaaacgcagatgtttt

SEQ ID NO: 988957 - DNA, 22 bp, Artificial Sequence
  chemically synthesized
tatgacttacggtatgtaaaac

SEQ ID NO: 988958 - DNA, 22 bp, Artificial Sequence
  chemically synthesized
aacgcagatgttttacataccg

SEQ ID NO: 988959 - DNA, 22 bp, Artificial Sequence
  chemically synthesized
atgttatatgacttacggtatg

SEQ ID NO: 988960 - DNA, 22 bp, Artificial Sequence
  chemically synthesized
tcatgttatatgacttacggta

SEQ ID NO: 988961 - DNA, 22 bp, Artificial Sequence
  chemically synthesized
ttctcatgttatatgacttacg

SEQ ID NO: 988962 - DNA, 22 bp, Artificial Sequence
  chemically synthesized
attctcatgttatatgacttac

SEQ ID NO: 988963 - DNA, 22 bp, Artificial Sequence
  chemically synthesized
tacataccgtaagtcatataac

SEQ ID NO: 988964 - DNA, 22 bp, Artificial Sequence
  chemically synthesized
acataccgtaagtcatataaca

SEQ ID NO: 988965 - DNA, 22 bp, Artificial Sequence
  chemically synthesized
cataccgtaagtcatataacat

SEQ ID NO: 988966 - DNA, 22 bp, Artificial Sequence
  chemically synthesized
aaggtttattctcatgttatat

SEQ ID NO: 988967 - DNA, 22 bp, Artificial Sequence
  chemically synthesized
aaaggtttattctcatgttata

SEQ ID NO: 988968 - DNA, 22 bp, Artificial Sequence
  chemically synthesized
taaaatggggagagcagtaagt

SEQ ID NO: 988969 - DNA, 22 bp, Artificial Sequence
  chemically synthesized
atctgtaaaatggggagagcag

SEQ ID NO: 988970 - DNA, 22 bp, Artificial Sequence
  chemically synthesized
taagacacttactgctctcccc

SEQ ID NO: 988971 - DNA, 22 bp, Artificial Sequence
  chemically synthesized
aagacacttactgctctcccca

SEQ ID NO: 988972 - DNA, 22 bp, Artificial Sequence
  chemically synthesized
agacacttactgctctccccat

SEQ ID NO: 988973 - DNA, 22 bp, Artificial Sequence
  chemically synthesized
tctcatctgtaaaatggggaga

SEQ ID NO: 988974 - DNA, 22 bp, Artificial Sequence
  chemically synthesized
gttgtctcatctgtaaaatggg

SEQ ID NO: 988975 - DNA, 22 bp, Artificial Sequence
  chemically synthesized
ggttgtctcatctgtaaaatgg

SEQ ID NO: 988976 - DNA, 22 bp, Artificial Sequence
  chemically synthesized
actgctctccccattttacaga

SEQ ID NO: 988977 - DNA, 22 bp, Artificial Sequence
  chemically synthesized
ctgctctccccattttacagat

SEQ ID NO: 988978 - DNA, 22 bp, Artificial Sequence
  chemically synthesized
ctctccccattttacagatgag

SEQ ID NO: 988979 - DNA, 22 bp, Artificial Sequence
  chemically synthesized
agtcttggttgtctcatctgta

SEQ ID NO: 988980 - DNA, 22 bp, Artificial Sequence
  chemically synthesized
aagtcttggttgtctcatctgt

SEQ ID NO: 988981 - DNA, 22 bp, Artificial Sequence
  chemically synthesized
taagtcttggttgtctcatctg

SEQ ID NO: 988982 - DNA, 22 bp, Artificial Sequence
  chemically synthesized
tccccattttacagatgagaca

SEQ ID NO: 988983 - DNA, 22 bp, Artificial Sequence
  chemically synthesized
cccattttacagatgagacaac

SEQ ID NO: 988984 - DNA, 22 bp, Artificial Sequence
  chemically synthesized
tacagatgagacaaccaagact

SEQ ID NO: 988985 - DNA, 22 bp, Artificial Sequence
  chemically synthesized
ggcaatactttaagtcttggtt

SEQ ID NO: 988986 - DNA, 22 bp, Artificial Sequence
  chemically synthesized
acagatgagacaaccaagactt

SEQ ID NO: 988987 - DNA, 22 bp, Artificial Sequence
  chemically synthesized
gggcaatactttaagtcttggt

SEQ ID NO: 988988 - DNA, 22 bp, Artificial Sequence
  chemically synthesized
cagatgagacaaccaagactta

SEQ ID NO: 988989 - DNA, 22 bp, Artificial Sequence
  chemically synthesized
agaccttgggcaatactttaag

SEQ ID NO: 988990 - DNA, 22 bp, Artificial Sequence
  chemically synthesized
taagaccttgggcaatacttta

SEQ ID NO: 988991 - DNA, 22 bp, Artificial Sequence
  chemically synthesized
ccaactctaagaccttgggcaa

SEQ ID NO: 988992 - DNA, 22 bp, Artificial Sequence
  chemically synthesized
aaagtattgcccaaggtcttag

SEQ ID NO: 988993 - DNA, 22 bp, Artificial Sequence
  chemically synthesized
aagtattgcccaaggtcttaga

SEQ ID NO: 988994 - DNA, 22 bp, Artificial Sequence
  chemically synthesized
caagttaccaactctaagacct

SEQ ID NO: 988995 - DNA, 22 bp, Artificial Sequence
  chemically synthesized
gcaagttaccaactctaagacc

SEQ ID NO: 988996 - DNA, 22 bp, Artificial Sequence
  chemically synthesized
tgcaagttaccaactctaagac

SEQ ID NO: 988997 - DNA, 22 bp, Artificial Sequence
  chemically synthesized
cctttgcaagttaccaactcta

SEQ ID NO: 988998 - DNA, 22 bp, Artificial Sequence
  chemically synthesized
gcctttgcaagttaccaactct

SEQ ID NO: 988999 - DNA, 22 bp, Artificial Sequence
  chemically synthesized
cccaaggtcttagagttggtaa

SEQ ID NO: 989000 - DNA, 22 bp, Artificial Sequence
  chemically synthesized
ttgcctttgcaagttaccaact

SEQ ID NO: 989001 - DNA, 22 bp, Artificial Sequence
  chemically synthesized
ttcttgcctttgcaagttacca

SEQ ID NO: 989002 - DNA, 22 bp, Artificial Sequence
  chemically synthesized
agagttggtaacttgcaaaggc

SEQ ID NO: 989003 - DNA, 22 bp, Artificial Sequence
  chemically synthesized
gagttggtaacttgcaaaggca

SEQ ID NO: 989004 - DNA, 22 bp, Artificial Sequence
  chemically synthesized
tggtcattgttcttgcctttgc

SEQ ID NO: 989005 - DNA, 22 bp, Artificial Sequence
  chemically synthesized
gtggtcattgttcttgcctttg

SEQ ID NO: 989006 - DNA, 22 bp, Artificial Sequence
  chemically synthesized
tgtggtcattgttcttgccttt

SEQ ID NO: 989007 - DNA, 22 bp, Artificial Sequence
  chemically synthesized
gtaacttgcaaaggcaagaaca

SEQ ID NO: 989008 - DNA, 22 bp, Artificial Sequence
  chemically synthesized
gttttgtggtcattgttcttgc

SEQ ID NO: 989009 - DNA, 22 bp, Artificial Sequence
  chemically synthesized
tggttttgtggtcattgttctt

SEQ ID NO: 989010 - DNA, 22 bp, Artificial Sequence
  chemically synthesized
ttctggttttgtggtcattgtt

SEQ ID NO: 989011 - DNA, 22 bp, Artificial Sequence
  chemically synthesized
gcaaaggcaagaacaatgacca

SEQ ID NO: 989012 - DNA, 22 bp, Artificial Sequence
  chemically synthesized
caaaggcaagaacaatgaccac

SEQ ID NO: 989013 - DNA, 22 bp, Artificial Sequence
  chemically synthesized
tcagttgttctggttttgtggt

SEQ ID NO: 989014 - DNA, 22 bp, Artificial Sequence
  chemically synthesized
ctgtcagttgttctggttttgt

SEQ ID NO: 989015 - DNA, 22 bp, Artificial Sequence
  chemically synthesized
tgctgtcagttgttctggtttt

SEQ ID NO: 989016 - DNA, 22 bp, Artificial Sequence
  chemically synthesized
gaacagatactctgctgtcagt

SEQ ID NO: 989017 - DNA, 22 bp, Artificial Sequence
  chemically synthesized
gagctggaacagatactctgct

SEQ ID NO: 989018 - DNA, 22 bp, Artificial Sequence
  chemically synthesized
ttggagctggaacagatactct

SEQ ID NO: 989019 - DNA, 22 bp, Artificial Sequence
  chemically synthesized
acagcagagtatctgttccagc

SEQ ID NO: 989020 - DNA, 22 bp, Artificial Sequence
  chemically synthesized
atgtagccagtaattattggag

SEQ ID NO: 989021 - DNA, 22 bp, Artificial Sequence
  chemically synthesized
ttccagctccaataattactgg

SEQ ID NO: 989022 - DNA, 22 bp, Artificial Sequence
  chemically synthesized
cagctccaataattactggcta

SEQ ID NO: 989023 - DNA, 22 bp, Artificial Sequence
  chemically synthesized
caataattactggctacatcag

SEQ ID NO: 989024 - DNA, 22 bp, Artificial Sequence
  chemically synthesized
ctggctacatcagttctgtggg

SEQ ID NO: 989025 - DNA, 22 bp, Artificial Sequence
  chemically synthesized
gctacatcagttctgtgggtcc

SEQ ID NO: 989026 - DNA, 22 bp, Artificial Sequence
  chemically synthesized
catcagttctgtgggtcccttc

SEQ ID NO: 989027 - DNA, 22 bp, Artificial Sequence
  chemically synthesized
gaggtataggtaccatcatgaa

SEQ ID NO: 989028 - DNA, 22 bp, Artificial Sequence
  chemically synthesized
tgtgggtcccttcatgatggta

SEQ ID NO: 989029 - DNA, 22 bp, Artificial Sequence
  chemically synthesized
tagaggtataggtaccatcatg

SEQ ID NO: 989030 - DNA, 22 bp, Artificial Sequence
  chemically synthesized
tgggtcccttcatgatggtacc

SEQ ID NO: 989031 - DNA, 22 bp, Artificial Sequence
  chemically synthesized
aactctagaggtataggtacca

SEQ ID NO: 989032 - DNA, 22 bp, Artificial Sequence
  chemically synthesized
aaactctagaggtataggtacc

SEQ ID NO: 989033 - DNA, 22 bp, Artificial Sequence
  chemically synthesized
taaactctagaggtataggtac

SEQ ID NO: 989034 - DNA, 22 bp, Artificial Sequence
  chemically synthesized
ttaaactctagaggtataggta

SEQ ID NO: 989035 - DNA, 22 bp, Artificial Sequence
  chemically synthesized
tttttaaactctagaggtatag

SEQ ID NO: 989036 - DNA, 22 bp, Artificial Sequence
  chemically synthesized
catgatggtacctatacctcta

SEQ ID NO: 989037 - DNA, 22 bp, Artificial Sequence
  chemically synthesized
atttttaaactctagaggtata

SEQ ID NO: 989038 - DNA, 22 bp, Artificial Sequence
  chemically synthesized
atgatggtacctatacctctag

SEQ ID NO: 989039 - DNA, 22 bp, Artificial Sequence
  chemically synthesized
aacgataatttatttttaaact

SEQ ID NO: 989040 - DNA, 22 bp, Artificial Sequence
  chemically synthesized
tacctctagagtttaaaaataa

SEQ ID NO: 989041 - DNA, 22 bp, Artificial Sequence
  chemically synthesized
tagagtttaaaaataaattatc

SEQ ID NO: 989042 - DNA, 22 bp, Artificial Sequence
  chemically synthesized
gagtttaaaaataaattatcgt

SEQ ID NO: 989043 - DNA, 22 bp, Artificial Sequence
  chemically synthesized
tgcaaaaattaaacgataattt

SEQ ID NO: 989044 - DNA, 22 bp, Artificial Sequence
  chemically synthesized
atgcaaaaattaaacgataatt

SEQ ID NO: 989045 - DNA, 22 bp, Artificial Sequence
  chemically synthesized
aaaaataaattatcgtttaatt

SEQ ID NO: 989046 - DNA, 22 bp, Artificial Sequence
  chemically synthesized
aaaataaattatcgtttaattt

SEQ ID NO: 989047 - DNA, 22 bp, Artificial Sequence
  chemically synthesized
catcatagagtttatgcaaaaa

SEQ ID NO: 989048 - DNA, 22 bp, Artificial Sequence
  chemically synthesized
acatcatagagtttatgcaaaa

SEQ ID NO: 989049 - DNA, 22 bp, Artificial Sequence
  chemically synthesized
tcgtttaatttttgcataaact

SEQ ID NO: 989050 - DNA, 22 bp, Artificial Sequence
  chemically synthesized
acttacatcatagagtttatgc

SEQ ID NO: 989051 - DNA, 22 bp, Artificial Sequence
  chemically synthesized
ttgacttacatcatagagttta

SEQ ID NO: 989052 - DNA, 22 bp, Artificial Sequence
  chemically synthesized
aatttttgcataaactctatga

SEQ ID NO: 989053 - DNA, 22 bp, Artificial Sequence
  chemically synthesized
atttttgcataaactctatgat

SEQ ID NO: 989054 - DNA, 22 bp, Artificial Sequence
  chemically synthesized
ttattgacttacatcatagagt

SEQ ID NO: 989055 - DNA, 22 bp, Artificial Sequence
  chemically synthesized
ttgcataaactctatgatgtaa

SEQ ID NO: 989056 - DNA, 22 bp, Artificial Sequence
  chemically synthesized
tgcataaactctatgatgtaag

SEQ ID NO: 989057 - DNA, 22 bp, Artificial Sequence
  chemically synthesized
gcataaactctatgatgtaagt

SEQ ID NO: 989058 - DNA, 22 bp, Artificial Sequence
  chemically synthesized
cataaactctatgatgtaagtc

SEQ ID NO: 989059 - DNA, 22 bp, Artificial Sequence
  chemically synthesized
tatgatgtaagtcaataataat

SEQ ID NO: 989060 - DNA, 22 bp, Artificial Sequence
  chemically synthesized
agaaagaagaggaattattatt

SEQ ID NO: 989061 - DNA, 22 bp, Artificial Sequence
  chemically synthesized
tgatgtaagtcaataataattc

SEQ ID NO: 989062 - DNA, 22 bp, Artificial Sequence
  chemically synthesized
gtgagttaagaaagaagaggaa

SEQ ID NO: 989063 - DNA, 22 bp, Artificial Sequence
  chemically synthesized
cagtatgctagtgagttaagaa

SEQ ID NO: 989064 - DNA, 22 bp, Artificial Sequence
  chemically synthesized
ttacagtatgctagtgagttaa

SEQ ID NO: 989065 - DNA, 22 bp, Artificial Sequence
  chemically synthesized
attacagtatgctagtgagtta

SEQ ID NO: 989066 - DNA, 22 bp, Artificial Sequence
  chemically synthesized
ctcttctttcttaactcactag

SEQ ID NO: 989067 - DNA, 22 bp, Artificial Sequence
  chemically synthesized
ttctttcttaactcactagcat

SEQ ID NO: 989068 - DNA, 22 bp, Artificial Sequence
  chemically synthesized
ctttcttaactcactagcatac

SEQ ID NO: 989069 - DNA, 22 bp, Artificial Sequence
  chemically synthesized
tttcttaactcactagcatact

SEQ ID NO: 989070 - DNA, 22 bp, Artificial Sequence
  chemically synthesized
tcttaactcactagcatactgt

SEQ ID NO: 989071 - DNA, 22 bp, Artificial Sequence
  chemically synthesized
cttaactcactagcatactgta

SEQ ID NO: 989072 - DNA, 22 bp, Artificial Sequence
  chemically synthesized
ttaactcactagcatactgtaa

SEQ ID NO: 989073 - DNA, 22 bp, Artificial Sequence
  chemically synthesized
aactcactagcatactgtaata

SEQ ID NO: 989074 - DNA, 22 bp, Artificial Sequence
  chemically synthesized
actcactagcatactgtaataa

SEQ ID NO: 989075 - DNA, 22 bp, Artificial Sequence
  chemically synthesized
actagcatactgtaataaacat

SEQ ID NO: 989076 - DNA, 22 bp, Artificial Sequence
  chemically synthesized
gcatactgtaataaacatccat

SEQ ID NO: 989077 - DNA, 22 bp, Artificial Sequence
  chemically synthesized
catggtgggtatatggatgttt

SEQ ID NO: 989078 - DNA, 22 bp, Artificial Sequence
  chemically synthesized
ggatctgcatggtgggtatatg

SEQ ID NO: 989079 - DNA, 22 bp, Artificial Sequence
  chemically synthesized
taataaacatccatatacccac

SEQ ID NO: 989080 - DNA, 22 bp, Artificial Sequence
  chemically synthesized
ctgggatctgcatggtgggtat

SEQ ID NO: 989081 - DNA, 22 bp, Artificial Sequence
  chemically synthesized
taattgctgggatctgcatggt

SEQ ID NO: 989082 - DNA, 22 bp, Artificial Sequence
  chemically synthesized
ataattgctgggatctgcatgg

SEQ ID NO: 989083 - DNA, 22 bp, Artificial Sequence
  chemically synthesized
agtttataattgctgggatctg

SEQ ID NO: 989084 - DNA, 22 bp, Artificial Sequence
  chemically synthesized
gagtttataattgctgggatct

SEQ ID NO: 989085 - DNA, 22 bp, Artificial Sequence
  chemically synthesized
taaactcaagggcccatatggt

SEQ ID NO: 989086 - DNA, 22 bp, Artificial Sequence
  chemically synthesized
gtgggatgtagatgaaaccata

SEQ ID NO: 989087 - DNA, 22 bp, Artificial Sequence
  chemically synthesized
ggtgggatgtagatgaaaccat

SEQ ID NO: 989088 - DNA, 22 bp, Artificial Sequence
  chemically synthesized
aagggcccatatggtttcatct

SEQ ID NO: 989089 - DNA, 22 bp, Artificial Sequence
  chemically synthesized
cgcttggtgggatgtagatgaa

SEQ ID NO: 989090 - DNA, 22 bp, Artificial Sequence
  chemically synthesized
ggggtgggttgcgcttggtggg

SEQ ID NO: 989091 - DNA, 22 bp, Artificial Sequence
  chemically synthesized
aggggtgggttgcgcttggtgg

SEQ ID NO: 989092 - DNA, 22 bp, Artificial Sequence
  chemically synthesized
catctacatcccaccaagcgca

SEQ ID NO: 989093 - DNA, 22 bp, Artificial Sequence
  chemically synthesized
atctacatcccaccaagcgcaa

SEQ ID NO: 989094 - DNA, 22 bp, Artificial Sequence
  chemically synthesized
ggtttaggggtgggttgcgctt

SEQ ID NO: 989095 - DNA, 22 bp, Artificial Sequence
  chemically synthesized
catcccaccaagcgcaacccac

SEQ ID NO: 989096 - DNA, 22 bp, Artificial Sequence
  chemically synthesized
caaaataatacaaagctaggtt

SEQ ID NO: 989097 - DNA, 22 bp, Artificial Sequence
  chemically synthesized
gcaaaataatacaaagctaggt

SEQ ID NO: 989098 - DNA, 22 bp, Artificial Sequence
  chemically synthesized
ggtcacttgcaaaataatacaa

SEQ ID NO: 989099 - DNA, 22 bp, Artificial Sequence
  chemically synthesized
aggtcacttgcaaaataataca

SEQ ID NO: 989100 - DNA, 22 bp, Artificial Sequence
  chemically synthesized
aacctagctttgtattattttg

SEQ ID NO: 989101 - DNA, 22 bp, Artificial Sequence
  chemically synthesized
gctttgtattattttgcaagtg

SEQ ID NO: 989102 - DNA, 22 bp, Artificial Sequence
  chemically synthesized
tgtattattttgcaagtgacct

SEQ ID NO: 989103 - DNA, 22 bp, Artificial Sequence
  chemically synthesized
gtattattttgcaagtgaccta

SEQ ID NO: 989104 - DNA, 22 bp, Artificial Sequence
  chemically synthesized
tattattttgcaagtgacctaa

SEQ ID NO: 989105 - DNA, 22 bp, Artificial Sequence
  chemically synthesized
ttttgcaagtgacctaagtgat

SEQ ID NO: 989106 - DNA, 22 bp, Artificial Sequence
  chemically synthesized
tgcaagtgacctaagtgatcct

SEQ ID NO: 989107 - DNA, 22 bp, Artificial Sequence
  chemically synthesized
gcaagtgacctaagtgatcctt

SEQ ID NO: 989108 - DNA, 22 bp, Artificial Sequence
  chemically synthesized
caagtgacctaagtgatccttc

SEQ ID NO: 989109 - DNA, 22 bp, Artificial Sequence
  chemically synthesized
caagcagcaaaagaaggatcac

SEQ ID NO: 989110 - DNA, 22 bp, Artificial Sequence
  chemically synthesized
gtattccaagcagcaaaagaag

SEQ ID NO: 989111 - DNA, 22 bp, Artificial Sequence
  chemically synthesized
ggtattccaagcagcaaaagaa

SEQ ID NO: 989112 - DNA, 22 bp, Artificial Sequence
  chemically synthesized
agtgatccttcttttgctgctt

SEQ ID NO: 989113 - DNA, 22 bp, Artificial Sequence
  chemically synthesized
acttggtattccaagcagcaaa

SEQ ID NO: 989114 - DNA, 22 bp, Artificial Sequence
  chemically synthesized
attaacttggtattccaagcag

SEQ ID NO: 989115 - DNA, 22 bp, Artificial Sequence
  chemically synthesized
cttttgctgcttggaataccaa

SEQ ID NO: 989116 - DNA, 22 bp, Artificial Sequence
  chemically synthesized
ttttgctgcttggaataccaag

SEQ ID NO: 989117 - DNA, 22 bp, Artificial Sequence
  chemically synthesized
ttgctgcttggaataccaagtt

SEQ ID NO: 989118 - DNA, 22 bp, Artificial Sequence
  chemically synthesized
tgctgcttggaataccaagtta

SEQ ID NO: 989119 - DNA, 22 bp, Artificial Sequence
  chemically synthesized
gctgcttggaataccaagttaa

SEQ ID NO: 989120 - DNA, 22 bp, Artificial Sequence
  chemically synthesized
ctgcttggaataccaagttaat

SEQ ID NO: 989121 - DNA, 22 bp, Artificial Sequence
  chemically synthesized
acatgaaataactcattaactt

SEQ ID NO: 989122 - DNA, 22 bp, Artificial Sequence
  chemically synthesized
cttggaataccaagttaatgag

SEQ ID NO: 989123 - DNA, 22 bp, Artificial Sequence
  chemically synthesized
ggaataccaagttaatgagtta

SEQ ID NO: 989124 - DNA, 22 bp, Artificial Sequence
  chemically synthesized
tctcacatgaaataactcatta

SEQ ID NO: 989125 - DNA, 22 bp, Artificial Sequence
  chemically synthesized
gaataccaagttaatgagttat

SEQ ID NO: 989126 - DNA, 22 bp, Artificial Sequence
  chemically synthesized
gctatctcacatgaaataactc

SEQ ID NO: 989127 - DNA, 22 bp, Artificial Sequence
  chemically synthesized
ttagctatctcacatgaaataa

SEQ ID NO: 989128 - DNA, 22 bp, Artificial Sequence
  chemically synthesized
attagctatctcacatgaaata

SEQ ID NO: 989129 - DNA, 22 bp, Artificial Sequence
  chemically synthesized
atgagttatttcatgtgagata

SEQ ID NO: 989130 - DNA, 22 bp, Artificial Sequence
  chemically synthesized
tgatttattagctatctcacat

SEQ ID NO: 989131 - DNA, 22 bp, Artificial Sequence
  chemically synthesized
gtgatttattagctatctcaca

SEQ ID NO: 989132 - DNA, 22 bp, Artificial Sequence
  chemically synthesized
tgtgatttattagctatctcac

SEQ ID NO: 989133 - DNA, 22 bp, Artificial Sequence
  chemically synthesized
tttcatgtgagatagctaataa

SEQ ID NO: 989134 - DNA, 22 bp, Artificial Sequence
  chemically synthesized
catgtgagatagctaataaatc

SEQ ID NO: 989135 - DNA, 22 bp, Artificial Sequence
  chemically synthesized
atgtgagatagctaataaatca

SEQ ID NO: 989136 - DNA, 22 bp, Artificial Sequence
  chemically synthesized
aagcaacagctttgtgatttat

SEQ ID NO: 989137 - DNA, 22 bp, Artificial Sequence
  chemically synthesized
tcaagcaacagctttgtgattt

SEQ ID NO: 989138 - DNA, 22 bp, Artificial Sequence
  chemically synthesized
ttctcaagcaacagctttgtga

SEQ ID NO: 989139 - DNA, 22 bp, Artificial Sequence
  chemically synthesized
ataaatcacaaagctgttgctt

SEQ ID NO: 989140 - DNA, 22 bp, Artificial Sequence
  chemically synthesized
ggacacctattctcaagcaaca

SEQ ID NO: 989141 - DNA, 22 bp, Artificial Sequence
  chemically synthesized
ttgcttgagaataggtgtccca

SEQ ID NO: 989142 - DNA, 22 bp, Artificial Sequence
  chemically synthesized
cttgagaataggtgtcccaata

SEQ ID NO: 989143 - DNA, 22 bp, Artificial Sequence
  chemically synthesized
gagaataggtgtcccaatattg

SEQ ID NO: 989144 - DNA, 22 bp, Artificial Sequence
  chemically synthesized
agaataggtgtcccaatattgc

SEQ ID NO: 989145 - DNA, 22 bp, Artificial Sequence
  chemically synthesized
tcatagaatgaaaatgaaacac

SEQ ID NO: 989146 - DNA, 22 bp, Artificial Sequence
  chemically synthesized
cctatcatagaatgaaaatgaa

SEQ ID NO: 989147 - DNA, 22 bp, Artificial Sequence
  chemically synthesized
ctgtgtttcattttcattctat

SEQ ID NO: 989148 - DNA, 22 bp, Artificial Sequence
  chemically synthesized
tgtttcattttcattctatgat

SEQ ID NO: 989149 - DNA, 22 bp, Artificial Sequence
  chemically synthesized
cattttcattctatgataggta

SEQ ID NO: 989150 - DNA, 22 bp, Artificial Sequence
  chemically synthesized
attttcattctatgataggtag

SEQ ID NO: 989151 - DNA, 22 bp, Artificial Sequence
  chemically synthesized
tcattctatgataggtagcgtt

SEQ ID NO: 989152 - DNA, 22 bp, Artificial Sequence
  chemically synthesized
cattctatgataggtagcgttt

SEQ ID NO: 989153 - DNA, 22 bp, Artificial Sequence
  chemically synthesized
attctatgataggtagcgtttt

SEQ ID NO: 989154 - DNA, 22 bp, Artificial Sequence
  chemically synthesized
tatgataggtagcgtttttatg

SEQ ID NO: 989155 - DNA, 22 bp, Artificial Sequence
  chemically synthesized
tgataggtagcgtttttatgat

SEQ ID NO: 989156 - DNA, 22 bp, Artificial Sequence
  chemically synthesized
ccaatgacatatatcataaaaa

SEQ ID NO: 989157 - DNA, 22 bp, Artificial Sequence
  chemically synthesized
ctgccaatgacatatatcataa

SEQ ID NO: 989158 - DNA, 22 bp, Artificial Sequence
  chemically synthesized
gctgccaatgacatatatcata

SEQ ID NO: 989159 - DNA, 22 bp, Artificial Sequence
  chemically synthesized
tgctgccaatgacatatatcat

SEQ ID NO: 989160 - DNA, 22 bp, Artificial Sequence
  chemically synthesized
ttgctgccaatgacatatatca

SEQ ID NO: 989161 - DNA, 22 bp, Artificial Sequence
  chemically synthesized
tttgctgccaatgacatatatc

SEQ ID NO: 989162 - DNA, 22 bp, Artificial Sequence
  chemically synthesized
ttatgatatatgtcattggcag

SEQ ID NO: 989163 - DNA, 22 bp, Artificial Sequence
  chemically synthesized
tatgatatatgtcattggcagc

SEQ ID NO: 989164 - DNA, 22 bp, Artificial Sequence
  chemically synthesized
atgatatatgtcattggcagca

SEQ ID NO: 989165 - DNA, 22 bp, Artificial Sequence
  chemically synthesized
tgatatatgtcattggcagcaa

SEQ ID NO: 989166 - DNA, 22 bp, Artificial Sequence
  chemically synthesized
gcagcaaaaaattatatacttt

SEQ ID NO: 989167 - DNA, 22 bp, Artificial Sequence
  chemically synthesized
accagaagtcatatgtcaatca

SEQ ID NO: 989168 - DNA, 22 bp, Artificial Sequence
  chemically synthesized
tatactttactgattgacatat

SEQ ID NO: 989169 - DNA, 22 bp, Artificial Sequence
  chemically synthesized
agcgttcaccagaagtcatatg

SEQ ID NO: 989170 - DNA, 22 bp, Artificial Sequence
  chemically synthesized
aagcgttcaccagaagtcatat

SEQ ID NO: 989171 - DNA, 22 bp, Artificial Sequence
  chemically synthesized
tactgattgacatatgacttct

SEQ ID NO: 989172 - DNA, 22 bp, Artificial Sequence
  chemically synthesized
taagcgttcaccagaagtcata

SEQ ID NO: 989173 - DNA, 22 bp, Artificial Sequence
  chemically synthesized
actgattgacatatgacttctg

SEQ ID NO: 989174 - DNA, 22 bp, Artificial Sequence
  chemically synthesized
ctgattgacatatgacttctgg

SEQ ID NO: 989175 - DNA, 22 bp, Artificial Sequence
  chemically synthesized
attgacatatgacttctggtga

SEQ ID NO: 989176 - DNA, 22 bp, Artificial Sequence
  chemically synthesized
acatatgacttctggtgaacgc

SEQ ID NO: 989177 - DNA, 22 bp, Artificial Sequence
  chemically synthesized
ctggtgaacgcttaaaatactt

SEQ ID NO: 989178 - DNA, 22 bp, Artificial Sequence
  chemically synthesized
tggtgaacgcttaaaatacttg

SEQ ID NO: 989179 - DNA, 22 bp, Artificial Sequence
  chemically synthesized
gtgaacgcttaaaatacttgat

SEQ ID NO: 989180 - DNA, 22 bp, Artificial Sequence
  chemically synthesized
aaaatacttgattttgttttta

SEQ ID NO: 989181 - DNA, 22 bp, Artificial Sequence
  chemically synthesized
aaatacttgattttgtttttat

SEQ ID NO: 989182 - DNA, 22 bp, Artificial Sequence
  chemically synthesized
tacatacatacatatgtatata

SEQ ID NO: 989183 - DNA, 22 bp, Artificial Sequence
  chemically synthesized
gattttgtttttatatacatat

SEQ ID NO: 989184 - DNA, 22 bp, Artificial Sequence
  chemically synthesized
atacatacatacatatgtatat

SEQ ID NO: 989185 - DNA, 22 bp, Artificial Sequence
  chemically synthesized
attttgtttttatatacatatg

SEQ ID NO: 989186 - DNA, 22 bp, Artificial Sequence
  chemically synthesized
cttatacatacatacatatgta

SEQ ID NO: 989187 - DNA, 22 bp, Artificial Sequence
  chemically synthesized
gcttatacatacatacatatgt

SEQ ID NO: 989188 - DNA, 22 bp, Artificial Sequence
  chemically synthesized
tgtttttatatacatatgtatg

SEQ ID NO: 989189 - DNA, 22 bp, Artificial Sequence
  chemically synthesized
tgcttatacatacatacatatg

SEQ ID NO: 989190 - DNA, 22 bp, Artificial Sequence
  chemically synthesized
gtttttatatacatatgtatgt

SEQ ID NO: 989191 - DNA, 22 bp, Artificial Sequence
  chemically synthesized
tttttatatacatatgtatgta

SEQ ID NO: 989192 - DNA, 22 bp, Artificial Sequence
  chemically synthesized
ttatatacatatgtatgtatgt

SEQ ID NO: 989193 - DNA, 22 bp, Artificial Sequence
  chemically synthesized
tatatacatatgtatgtatgta

SEQ ID NO: 989194 - DNA, 22 bp, Artificial Sequence
  chemically synthesized
atatacatatgtatgtatgtat

SEQ ID NO: 989195 - DNA, 22 bp, Artificial Sequence
  chemically synthesized
tatacatatgtatgtatgtata

SEQ ID NO: 989196 - DNA, 22 bp, Artificial Sequence
  chemically synthesized
ataggaatatgggatgatcttt

SEQ ID NO: 989197 - DNA, 22 bp, Artificial Sequence
  chemically synthesized
aataggaatatgggatgatctt

SEQ ID NO: 989198 - DNA, 22 bp, Artificial Sequence
  chemically synthesized
tttaataggaatatgggatgat

SEQ ID NO: 989199 - DNA, 22 bp, Artificial Sequence
  chemically synthesized
tctatttaataggaatatggga

SEQ ID NO: 989200 - DNA, 22 bp, Artificial Sequence
  chemically synthesized
atctatttaataggaatatggg

SEQ ID NO: 989201 - DNA, 22 bp, Artificial Sequence
  chemically synthesized
tcaaatatcaacttatctattt

SEQ ID NO: 989202 - DNA, 22 bp, Artificial Sequence
  chemically synthesized
gtcaaatatcaacttatctatt

SEQ ID NO: 989203 - DNA, 22 bp, Artificial Sequence
  chemically synthesized
ctattaaatagataagttgata

SEQ ID NO: 989204 - DNA, 22 bp, Artificial Sequence
  chemically synthesized
ttaaatagataagttgatattt

SEQ ID NO: 989205 - DNA, 22 bp, Artificial Sequence
  chemically synthesized
aatagataagttgatatttgac

SEQ ID NO: 989206 - DNA, 22 bp, Artificial Sequence
  chemically synthesized
aagtcagtgtatttgtcaaata

SEQ ID NO: 989207 - DNA, 22 bp, Artificial Sequence
  chemically synthesized
taaagtcagtgtatttgtcaaa

SEQ ID NO: 989208 - DNA, 22 bp, Artificial Sequence
  chemically synthesized
ctaaagtcagtgtatttgtcaa

SEQ ID NO: 989209 - DNA, 22 bp, Artificial Sequence
  chemically synthesized
tctaaagtcagtgtatttgtca

SEQ ID NO: 989210 - DNA, 22 bp, Artificial Sequence
  chemically synthesized
ttctaaagtcagtgtatttgtc

SEQ ID NO: 989211 - DNA, 22 bp, Artificial Sequence
  chemically synthesized
tttctaaagtcagtgtatttgt

SEQ ID NO: 989212 - DNA, 22 bp, Artificial Sequence
  chemically synthesized
atatttgacaaatacactgact

SEQ ID NO: 989213 - DNA, 22 bp, Artificial Sequence
  chemically synthesized
atattttttctaaagtcagtgt

SEQ ID NO: 989214 - DNA, 22 bp, Artificial Sequence
  chemically synthesized
catattttttctaaagtcagtg

SEQ ID NO: 989215 - DNA, 22 bp, Artificial Sequence
  chemically synthesized
gacaaatacactgactttagaa

SEQ ID NO: 989216 - DNA, 22 bp, Artificial Sequence
  chemically synthesized
atttcatattttttctaaagtc

SEQ ID NO: 989217 - DNA, 22 bp, Artificial Sequence
  chemically synthesized
acaaatacactgactttagaaa

SEQ ID NO: 989218 - DNA, 22 bp, Artificial Sequence
  chemically synthesized
gatttcatattttttctaaagt

SEQ ID NO: 989219 - DNA, 22 bp, Artificial Sequence
  chemically synthesized
tatttgatttcatattttttct

SEQ ID NO: 989220 - DNA, 22 bp, Artificial Sequence
  chemically synthesized
atatttgatttcatattttttc

SEQ ID NO: 989221 - DNA, 22 bp, Artificial Sequence
  chemically synthesized
tatatttgatttcatatttttt

SEQ ID NO: 989222 - DNA, 22 bp, Artificial Sequence
  chemically synthesized
ttttatatttgatttcatattt

SEQ ID NO: 989223 - DNA, 22 bp, Artificial Sequence
  chemically synthesized
actttagaaaaaatatgaaatc

SEQ ID NO: 989224 - DNA, 22 bp, Artificial Sequence
  chemically synthesized
tattattttatatttgatttca

SEQ ID NO: 989225 - DNA, 22 bp, Artificial Sequence
  chemically synthesized
tagaaaaaatatgaaatcaaat

SEQ ID NO: 989226 - DNA, 22 bp, Artificial Sequence
  chemically synthesized
agaaaaaatatgaaatcaaata

SEQ ID NO: 989227 - DNA, 22 bp, Artificial Sequence
  chemically synthesized
gaaaaaatatgaaatcaaatat

SEQ ID NO: 989228 - DNA, 22 bp, Artificial Sequence
  chemically synthesized
acatcacaatgtaccgtacaca

SEQ ID NO: 989229 - DNA, 22 bp, Artificial Sequence
  chemically synthesized
tgttaacatcacaatgtaccgt

SEQ ID NO: 989230 - DNA, 22 bp, Artificial Sequence
  chemically synthesized
atgttaacatcacaatgtaccg

SEQ ID NO: 989231 - DNA, 22 bp, Artificial Sequence
  chemically synthesized
tatgttaacatcacaatgtacc

SEQ ID NO: 989232 - DNA, 22 bp, Artificial Sequence
  chemically synthesized
ttatgttaacatcacaatgtac

SEQ ID NO: 989233 - DNA, 22 bp, Artificial Sequence
  chemically synthesized
ttttatgttaacatcacaatgt

SEQ ID NO: 989234 - DNA, 22 bp, Artificial Sequence
  chemically synthesized
cttttatgttaacatcacaatg

SEQ ID NO: 989235 - DNA, 22 bp, Artificial Sequence
  chemically synthesized
tgtacggtacattgtgatgtta

SEQ ID NO: 989236 - DNA, 22 bp, Artificial Sequence
  chemically synthesized
cttcttttatgttaacatcaca

SEQ ID NO: 989237 - DNA, 22 bp, Artificial Sequence
  chemically synthesized
actacttcttttatgttaacat

SEQ ID NO: 989238 - DNA, 22 bp, Artificial Sequence
  chemically synthesized
ttcactacttcttttatgttaa

SEQ ID NO: 989239 - DNA, 22 bp, Artificial Sequence
  chemically synthesized
ctgttcactacttcttttatgt

SEQ ID NO: 989240 - DNA, 22 bp, Artificial Sequence
  chemically synthesized
tgatgttaacataaaagaagta

SEQ ID NO: 989241 - DNA, 22 bp, Artificial Sequence
  chemically synthesized
acataaaagaagtagtgaacag

SEQ ID NO: 989242 - DNA, 22 bp, Artificial Sequence
  chemically synthesized
gtgtatgtgtgtatttttgtat

SEQ ID NO: 989243 - DNA, 22 bp, Artificial Sequence
  chemically synthesized
tgtatgtgtgtatttttgtatg

SEQ ID NO: 989244 - DNA, 22 bp, Artificial Sequence
  chemically synthesized
acaaacatatatgacatacaaa

SEQ ID NO: 989245 - DNA, 22 bp, Artificial Sequence
  chemically synthesized
tgctaacaaacatatatgacat

SEQ ID NO: 989246 - DNA, 22 bp, Artificial Sequence
  chemically synthesized
tatgctaacaaacatatatgac

SEQ ID NO: 989247 - DNA, 22 bp, Artificial Sequence
  chemically synthesized
ctatgctaacaaacatatatga

SEQ ID NO: 989248 - DNA, 22 bp, Artificial Sequence
  chemically synthesized
tctatgctaacaaacatatatg

SEQ ID NO: 989249 - DNA, 22 bp, Artificial Sequence
  chemically synthesized
ttctatgctaacaaacatatat

SEQ ID NO: 989250 - DNA, 22 bp, Artificial Sequence
  chemically synthesized
tttctatgctaacaaacatata

SEQ ID NO: 989251 - DNA, 22 bp, Artificial Sequence
  chemically synthesized
ttgtatgtcatatatgtttgtt

SEQ ID NO: 989252 - DNA, 22 bp, Artificial Sequence
  chemically synthesized
tgtatgtcatatatgtttgtta

SEQ ID NO: 989253 - DNA, 22 bp, Artificial Sequence
  chemically synthesized
ctttttctatgctaacaaacat

SEQ ID NO: 989254 - DNA, 22 bp, Artificial Sequence
  chemically synthesized
gtatgtcatatatgtttgttag

SEQ ID NO: 989255 - DNA, 22 bp, Artificial Sequence
  chemically synthesized
tatgtcatatatgtttgttagc

SEQ ID NO: 989256 - DNA, 22 bp, Artificial Sequence
  chemically synthesized
gctgctttttctatgctaacaa

SEQ ID NO: 989257 - DNA, 22 bp, Artificial Sequence
  chemically synthesized
tggctgctttttctatgctaac

SEQ ID NO: 989258 - DNA, 22 bp, Artificial Sequence
  chemically synthesized
ctggctgctttttctatgctaa

SEQ ID NO: 989259 - DNA, 22 bp, Artificial Sequence
  chemically synthesized
tctggctgctttttctatgcta

SEQ ID NO: 989260 - DNA, 22 bp, Artificial Sequence
  chemically synthesized
gttagcatagaaaaagcagcca

SEQ ID NO: 989261 - DNA, 22 bp, Artificial Sequence
  chemically synthesized
ttagcatagaaaaagcagccag

SEQ ID NO: 989262 - DNA, 22 bp, Artificial Sequence
  chemically synthesized
gtgtgtaactttctggctgctt

SEQ ID NO: 989263 - DNA, 22 bp, Artificial Sequence
  chemically synthesized
ggtgtgtaactttctggctgct

SEQ ID NO: 989264 - DNA, 22 bp, Artificial Sequence
  chemically synthesized
tggtgtgtaactttctggctgc

SEQ ID NO: 989265 - DNA, 22 bp, Artificial Sequence
  chemically synthesized
gcatagaaaaagcagccagaaa

SEQ ID NO: 989266 - DNA, 22 bp, Artificial Sequence
  chemically synthesized
acattttggtgtgtaactttct

SEQ ID NO: 989267 - DNA, 22 bp, Artificial Sequence
  chemically synthesized
gaaaccagaattaacattttgg

SEQ ID NO: 989268 - DNA, 22 bp, Artificial Sequence
  chemically synthesized
cacaccaaaatgttaattctgg

SEQ ID NO: 989269 - DNA, 22 bp, Artificial Sequence
  chemically synthesized
agtgccagttggaaaccagaat

SEQ ID NO: 989270 - DNA, 22 bp, Artificial Sequence
  chemically synthesized
gaaaatctaagtgccagttgga

SEQ ID NO: 989271 - DNA, 22 bp, Artificial Sequence
  chemically synthesized
attctggtttccaactggcact

SEQ ID NO: 989272 - DNA, 22 bp, Artificial Sequence
  chemically synthesized
tggtttccaactggcacttaga

SEQ ID NO: 989273 - DNA, 22 bp, Artificial Sequence
  chemically synthesized
gtttccaactggcacttagatt

SEQ ID NO: 989274 - DNA, 22 bp, Artificial Sequence
  chemically synthesized
agcatactagaaaatctaagtg

SEQ ID NO: 989275 - DNA, 22 bp, Artificial Sequence
  chemically synthesized
ccaactggcacttagattttct

SEQ ID NO: 989276 - DNA, 22 bp, Artificial Sequence
  chemically synthesized
caactggcacttagattttcta

SEQ ID NO: 989277 - DNA, 22 bp, Artificial Sequence
  chemically synthesized
gcacttagattttctagtatgc

SEQ ID NO: 989278 - DNA, 22 bp, Artificial Sequence
  chemically synthesized
atatgaaaacctaagcatacta

SEQ ID NO: 989279 - DNA, 22 bp, Artificial Sequence
  chemically synthesized
agattttctagtatgcttaggt

SEQ ID NO: 989280 - DNA, 22 bp, Artificial Sequence
  chemically synthesized
gattttctagtatgcttaggtt

SEQ ID NO: 989281 - DNA, 22 bp, Artificial Sequence
  chemically synthesized
tctagtatgcttaggttttcat

SEQ ID NO: 989282 - DNA, 22 bp, Artificial Sequence
  chemically synthesized
ctagtatgcttaggttttcata

SEQ ID NO: 989283 - DNA, 22 bp, Artificial Sequence
  chemically synthesized
tcagtatgctaatatgaaaacc

SEQ ID NO: 989284 - DNA, 22 bp, Artificial Sequence
  chemically synthesized
tagtatgcttaggttttcatat

SEQ ID NO: 989285 - DNA, 22 bp, Artificial Sequence
  chemically synthesized
atcagtatgctaatatgaaaac

SEQ ID NO: 989286 - DNA, 22 bp, Artificial Sequence
  chemically synthesized
gtatgcttaggttttcatatta

SEQ ID NO: 989287 - DNA, 22 bp, Artificial Sequence
  chemically synthesized
ttatcagtatgctaatatgaaa

SEQ ID NO: 989288 - DNA, 22 bp, Artificial Sequence
  chemically synthesized
cttatcagtatgctaatatgaa

SEQ ID NO: 989289 - DNA, 22 bp, Artificial Sequence
  chemically synthesized
tcttatcagtatgctaatatga

SEQ ID NO: 989290 - DNA, 22 bp, Artificial Sequence
  chemically synthesized
aggttttcatattagcatactg

SEQ ID NO: 989291 - DNA, 22 bp, Artificial Sequence
  chemically synthesized
ggttttcatattagcatactga

SEQ ID NO: 989292 - DNA, 22 bp, Artificial Sequence
  chemically synthesized
aaggatacctttcttatcagta

SEQ ID NO: 989293 - DNA, 22 bp, Artificial Sequence
  chemically synthesized
tcatattagcatactgataaga

SEQ ID NO: 989294 - DNA, 22 bp, Artificial Sequence
  chemically synthesized
catattagcatactgataagaa

SEQ ID NO: 989295 - DNA, 22 bp, Artificial Sequence
  chemically synthesized
atattagcatactgataagaaa

SEQ ID NO: 989296 - DNA, 22 bp, Artificial Sequence
  chemically synthesized
gcatactgataagaaaggtatc

SEQ ID NO: 989297 - DNA, 22 bp, Artificial Sequence
  chemically synthesized
ataagaaaggtatccttgagtc

SEQ ID NO: 989298 - DNA, 22 bp, Artificial Sequence
  chemically synthesized
agacccaaacagtaagactcaa

SEQ ID NO: 989299 - DNA, 22 bp, Artificial Sequence
  chemically synthesized
gagtcttactgtttgggtctga

SEQ ID NO: 989300 - DNA, 22 bp, Artificial Sequence
  chemically synthesized
agtcttactgtttgggtctgaa

SEQ ID NO: 989301 - DNA, 22 bp, Artificial Sequence
  chemically synthesized
actgtttgggtctgaattccca

SEQ ID NO: 989302 - DNA, 22 bp, Artificial Sequence
  chemically synthesized
ctgtttgggtctgaattcccat

SEQ ID NO: 989303 - DNA, 22 bp, Artificial Sequence
  chemically synthesized
gaaaatggcaaaatgggaattc

SEQ ID NO: 989304 - DNA, 22 bp, Artificial Sequence
  chemically synthesized
tttgggtctgaattcccatttt

SEQ ID NO: 989305 - DNA, 22 bp, Artificial Sequence
  chemically synthesized
gggtctgaattcccattttgcc

SEQ ID NO: 989306 - DNA, 22 bp, Artificial Sequence
  chemically synthesized
ggtctgaattcccattttgcca

SEQ ID NO: 989307 - DNA, 22 bp, Artificial Sequence
  chemically synthesized
aattcccattttgccattttct

SEQ ID NO: 989308 - DNA, 22 bp, Artificial Sequence
  chemically synthesized
agtgtatacagttagaaaatgg

SEQ ID NO: 989309 - DNA, 22 bp, Artificial Sequence
  chemically synthesized
gagtgtatacagttagaaaatg

SEQ ID NO: 989310 - DNA, 22 bp, Artificial Sequence
  chemically synthesized
tgagtgtatacagttagaaaat

SEQ ID NO: 989311 - DNA, 22 bp, Artificial Sequence
  chemically synthesized
ttgagtgtatacagttagaaaa

SEQ ID NO: 989312 - DNA, 22 bp, Artificial Sequence
  chemically synthesized
ccattttgccattttctaactg

SEQ ID NO: 989313 - DNA, 22 bp, Artificial Sequence
  chemically synthesized
tttgagtgtatacagttagaaa

SEQ ID NO: 989314 - DNA, 22 bp, Artificial Sequence
  chemically synthesized
ttttgagtgtatacagttagaa

SEQ ID NO: 989315 - DNA, 22 bp, Artificial Sequence
  chemically synthesized
tgccattttctaactgtataca

SEQ ID NO: 989316 - DNA, 22 bp, Artificial Sequence
  chemically synthesized
gccattttctaactgtatacac

SEQ ID NO: 989317 - DNA, 22 bp, Artificial Sequence
  chemically synthesized
ccattttctaactgtatacact

SEQ ID NO: 989318 - DNA, 22 bp, Artificial Sequence
  chemically synthesized
tctaactgtatacactcaaaaa

SEQ ID NO: 989319 - DNA, 22 bp, Artificial Sequence
  chemically synthesized
ctaactgtatacactcaaaaaa

SEQ ID NO: 989320 - DNA, 22 bp, Artificial Sequence
  chemically synthesized
taactgtatacactcaaaaaaa

SEQ ID NO: 989321 - DNA, 22 bp, Artificial Sequence
  chemically synthesized
actgtatacactcaaaaaaatt

SEQ ID NO: 989322 - DNA, 22 bp, Artificial Sequence
  chemically synthesized
tatacactcaaaaaaatttctt

SEQ ID NO: 989323 - DNA, 22 bp, Artificial Sequence
  chemically synthesized
aaaaaaaaaaaaaaaaaagaag

SEQ ID NO: 989324 - DNA, 22 bp, Artificial Sequence
  chemically synthesized
aaaaaaatttcttctttttttt

SEQ ID NO: 989325 - DNA, 22 bp, Artificial Sequence
  chemically synthesized
catctcaaaaaaaaaaaaaaaa

SEQ ID NO: 989326 - DNA, 22 bp, Artificial Sequence
  chemically synthesized
cttctttttttttttttttttt

SEQ ID NO: 989327 - DNA, 22 bp, Artificial Sequence
  chemically synthesized
ttcttttttttttttttttttg

SEQ ID NO: 989328 - DNA, 22 bp, Artificial Sequence
  chemically synthesized
cttttttttttttttttttgag

SEQ ID NO: 989329 - DNA, 22 bp, Artificial Sequence
  chemically synthesized
ttttttttttttttttttgaga

SEQ ID NO: 989330 - DNA, 22 bp, Artificial Sequence
  chemically synthesized
ttttttttttttttttgagatg

SEQ ID NO: 989331 - DNA, 22 bp, Artificial Sequence
  chemically synthesized
tttttttttttttttgagatgg

SEQ ID NO: 989332 - DNA, 22 bp, Artificial Sequence
  chemically synthesized
ttttttttttttttgagatgga

SEQ ID NO: 989333 - DNA, 22 bp, Artificial Sequence
  chemically synthesized
tttttttttttttgagatggag

SEQ ID NO: 989334 - DNA, 22 bp, Artificial Sequence
  chemically synthesized
ttttttttttttgagatggagt

SEQ ID NO: 989335 - DNA, 22 bp, Artificial Sequence
  chemically synthesized
tttttttttttgagatggagtc

SEQ ID NO: 989336 - DNA, 22 bp, Artificial Sequence
  chemically synthesized
ttttttttttgagatggagtct

SEQ ID NO: 989337 - DNA, 22 bp, Artificial Sequence
  chemically synthesized
ggtgacagagcgagactccatc

SEQ ID NO: 989338 - DNA, 22 bp, Artificial Sequence
  chemically synthesized
tttttttttgagatggagtctc

SEQ ID NO: 989339 - DNA, 22 bp, Artificial Sequence
  chemically synthesized
ttttttttgagatggagtctcg

SEQ ID NO: 989340 - DNA, 22 bp, Artificial Sequence
  chemically synthesized
tttttttgagatggagtctcgc

SEQ ID NO: 989341 - DNA, 22 bp, Artificial Sequence
  chemically synthesized
ttttttgagatggagtctcgct

SEQ ID NO: 989342 - DNA, 22 bp, Artificial Sequence
  chemically synthesized
tttttgagatggagtctcgctc

SEQ ID NO: 989343 - DNA, 22 bp, Artificial Sequence
  chemically synthesized
ttttgagatggagtctcgctct

SEQ ID NO: 989344 - DNA, 22 bp, Artificial Sequence
  chemically synthesized
tttgagatggagtctcgctctg

SEQ ID NO: 989345 - DNA, 22 bp, Artificial Sequence
  chemically synthesized
cagcctgggtgacagagcgaga

SEQ ID NO: 989346 - DNA, 22 bp, Artificial Sequence
  chemically synthesized
ttgagatggagtctcgctctgt

SEQ ID NO: 989347 - DNA, 22 bp, Artificial Sequence
  chemically synthesized
tgagatggagtctcgctctgtc

SEQ ID NO: 989348 - DNA, 22 bp, Artificial Sequence
  chemically synthesized
gagatggagtctcgctctgtca

SEQ ID NO: 989349 - DNA, 22 bp, Artificial Sequence
  chemically synthesized
agatggagtctcgctctgtcac

SEQ ID NO: 989350 - DNA, 22 bp, Artificial Sequence
  chemically synthesized
cactccagcctgggtgacagag

SEQ ID NO: 989351 - DNA, 22 bp, Artificial Sequence
  chemically synthesized
gctctgtcacccaggctggagt

SEQ ID NO: 989352 - DNA, 22 bp, Artificial Sequence
  chemically synthesized
tgtcacccaggctggagtgcag

SEQ ID NO: 989353 - DNA, 22 bp, Artificial Sequence
  chemically synthesized
tcacccaggctggagtgcagtg

SEQ ID NO: 989354 - DNA, 22 bp, Artificial Sequence
  chemically synthesized
cagtgagccgagatcgcgccac

SEQ ID NO: 989355 - DNA, 22 bp, Artificial Sequence
  chemically synthesized
gagtgcagtggcgcgatctcgg

SEQ ID NO: 989356 - DNA, 22 bp, Artificial Sequence
  chemically synthesized
ggctcactgcaacctccacctc

SEQ ID NO: 989357 - DNA, 22 bp, Artificial Sequence
  chemically synthesized
actgcaacctccacctcccggg

SEQ ID NO: 989358 - DNA, 22 bp, Artificial Sequence
  chemically synthesized
caacctccacctcccgggttca

SEQ ID NO: 989359 - DNA, 22 bp, Artificial Sequence
  chemically synthesized
aggcaggagaatggcgtgaacc

SEQ ID NO: 989360 - DNA, 22 bp, Artificial Sequence
  chemically synthesized
cacctcccgggttcacgccatt

SEQ ID NO: 989361 - DNA, 22 bp, Artificial Sequence
  chemically synthesized
ccgggttcacgccattctcctg

SEQ ID NO: 989362 - DNA, 22 bp, Artificial Sequence
  chemically synthesized
gggaggctgaggcaggagaatg

SEQ ID NO: 989363 - DNA, 22 bp, Artificial Sequence
  chemically synthesized
ctcgggaggctgaggcaggaga

SEQ ID NO: 989364 - DNA, 22 bp, Artificial Sequence
  chemically synthesized
acgccattctcctgcctcagcc

SEQ ID NO: 989365 - DNA, 22 bp, Artificial Sequence
  chemically synthesized
tagtcccagctactcgggaggc

SEQ ID NO: 989366 - DNA, 22 bp, Artificial Sequence
  chemically synthesized
tcctgcctcagcctcccgagta

SEQ ID NO: 989367 - DNA, 22 bp, Artificial Sequence
  chemically synthesized
ctgcctcagcctcccgagtagc

SEQ ID NO: 989368 - DNA, 22 bp, Artificial Sequence
  chemically synthesized
cctcagcctcccgagtagctgg

SEQ ID NO: 989369 - DNA, 22 bp, Artificial Sequence
  chemically synthesized
agcctcccgagtagctgggact

SEQ ID NO: 989370 - DNA, 22 bp, Artificial Sequence
  chemically synthesized
ccgagtagctgggactacaggc

SEQ ID NO: 989371 - DNA, 22 bp, Artificial Sequence
  chemically synthesized
gcgtggtagtgggtgcctgtag

SEQ ID NO: 989372 - DNA, 22 bp, Artificial Sequence
  chemically synthesized
gcctggcgtggtagtgggtgcc

SEQ ID NO: 989373 - DNA, 22 bp, Artificial Sequence
  chemically synthesized
ggactacaggcacccactacca

SEQ ID NO: 989374 - DNA, 22 bp, Artificial Sequence
  chemically synthesized
caggcacccactaccacgccag

SEQ ID NO: 989375 - DNA, 22 bp, Artificial Sequence
  chemically synthesized
aaaatataaaaaattagcctgg

SEQ ID NO: 989376 - DNA, 22 bp, Artificial Sequence
  chemically synthesized
ctaaaaatataaaaaattagcc

SEQ ID NO: 989377 - DNA, 22 bp, Artificial Sequence
  chemically synthesized
tactaaaaatataaaaaattag

SEQ ID NO: 989378 - DNA, 22 bp, Artificial Sequence
  chemically synthesized
ccacgccaggctaattttttat

SEQ ID NO: 989379 - DNA, 22 bp, Artificial Sequence
  chemically synthesized
attttttatatttttagtagag

SEQ ID NO: 989380 - DNA, 22 bp, Artificial Sequence
  chemically synthesized
tttatatttttagtagagacgg

SEQ ID NO: 989381 - DNA, 22 bp, Artificial Sequence
  chemically synthesized
ttatatttttagtagagacggg

SEQ ID NO: 989382 - DNA, 22 bp, Artificial Sequence
  chemically synthesized
tatatttttagtagagacgggg

SEQ ID NO: 989383 - DNA, 22 bp, Artificial Sequence
  chemically synthesized
atatttttagtagagacggggt

SEQ ID NO: 989384 - DNA, 22 bp, Artificial Sequence
  chemically synthesized
tatttttagtagagacggggtt

SEQ ID NO: 989385 - DNA, 22 bp, Artificial Sequence
  chemically synthesized
gcgaacacggtgaaaccccgtc

SEQ ID NO: 989386 - DNA, 22 bp, Artificial Sequence
  chemically synthesized
ttagtagagacggggtttcacc

SEQ ID NO: 989387 - DNA, 22 bp, Artificial Sequence
  chemically synthesized
tagtagagacggggtttcaccg

SEQ ID NO: 989388 - DNA, 22 bp, Artificial Sequence
  chemically synthesized
agtagagacggggtttcaccgt

SEQ ID NO: 989389 - DNA, 22 bp, Artificial Sequence
  chemically synthesized
gtagagacggggtttcaccgtg

SEQ ID NO: 989390 - DNA, 22 bp, Artificial Sequence
  chemically synthesized
caccgtgttcgccaggatggtc

SEQ ID NO: 989391 - DNA, 22 bp, Artificial Sequence
  chemically synthesized
accgtgttcgccaggatggtct

SEQ ID NO: 989392 - DNA, 22 bp, Artificial Sequence
  chemically synthesized
atcacgaggtcaggagatcgag

SEQ ID NO: 989393 - DNA, 22 bp, Artificial Sequence
  chemically synthesized
gccaggatggtctcgatctcct

SEQ ID NO: 989394 - DNA, 22 bp, Artificial Sequence
  chemically synthesized
gatctcctgacctcgtgatcag

SEQ ID NO: 989395 - DNA, 22 bp, Artificial Sequence
  chemically synthesized
ggaggccgaggcgggctgatca

SEQ ID NO: 989396 - DNA, 22 bp, Artificial Sequence
  chemically synthesized
gggaggccgaggcgggctgatc

SEQ ID NO: 989397 - DNA, 22 bp, Artificial Sequence
  chemically synthesized
tgggaggccgaggcgggctgat

SEQ ID NO: 989398 - DNA, 22 bp, Artificial Sequence
  chemically synthesized
ctgacctcgtgatcagcccgcc

SEQ ID NO: 989399 - DNA, 22 bp, Artificial Sequence
  chemically synthesized
acctcgtgatcagcccgcctcg

SEQ ID NO: 989400 - DNA, 22 bp, Artificial Sequence
  chemically synthesized
gtgatcagcccgcctcggcctc

SEQ ID NO: 989401 - DNA, 22 bp, Artificial Sequence
  chemically synthesized
taatcccagcactttgggaggc

SEQ ID NO: 989402 - DNA, 22 bp, Artificial Sequence
  chemically synthesized
acgcctgtaatcccagcacttt

SEQ ID NO: 989403 - DNA, 22 bp, Artificial Sequence
  chemically synthesized
ggcctcccaaagtgctgggatt

SEQ ID NO: 989404 - DNA, 22 bp, Artificial Sequence
  chemically synthesized
ccaaagtgctgggattacaggc

SEQ ID NO: 989405 - DNA, 22 bp, Artificial Sequence
  chemically synthesized
gccgggtgcggtggctcacgcc

SEQ ID NO: 989406 - DNA, 22 bp, Artificial Sequence
  chemically synthesized
ggccgggtgcggtggctcacgc

SEQ ID NO: 989407 - DNA, 22 bp, Artificial Sequence
  chemically synthesized
tggccgggtgcggtggctcacg

SEQ ID NO: 989408 - DNA, 22 bp, Artificial Sequence
  chemically synthesized
ttggccgggtgcggtggctcac

SEQ ID NO: 989409 - DNA, 22 bp, Artificial Sequence
  chemically synthesized
ggattacaggcgtgagccaccg

SEQ ID NO: 989410 - DNA, 22 bp, Artificial Sequence
  chemically synthesized
tttggccgggtgcggtggctca

SEQ ID NO: 989411 - DNA, 22 bp, Artificial Sequence
  chemically synthesized
caggcgtgagccaccgcacccg

SEQ ID NO: 989412 - DNA, 22 bp, Artificial Sequence
  chemically synthesized
tatgagaaatgaggaagtagag

SEQ ID NO: 989413 - DNA, 22 bp, Artificial Sequence
  chemically synthesized
cttatttatacctctacttcct

SEQ ID NO: 989414 - DNA, 22 bp, Artificial Sequence
  chemically synthesized
ttatttatacctctacttcctc

SEQ ID NO: 989415 - DNA, 22 bp, Artificial Sequence
  chemically synthesized
tatatgagaaatgaggaagtag

SEQ ID NO: 989416 - DNA, 22 bp, Artificial Sequence
  chemically synthesized
ctatatgagaaatgaggaagta

SEQ ID NO: 989417 - DNA, 22 bp, Artificial Sequence
  chemically synthesized
atttatacctctacttcctcat

SEQ ID NO: 989418 - DNA, 22 bp, Artificial Sequence
  chemically synthesized
tttatacctctacttcctcatt

SEQ ID NO: 989419 - DNA, 22 bp, Artificial Sequence
  chemically synthesized
cttctatatgagaaatgaggaa

SEQ ID NO: 989420 - DNA, 22 bp, Artificial Sequence
  chemically synthesized
atacctctacttcctcatttct

SEQ ID NO: 989421 - DNA, 22 bp, Artificial Sequence
  chemically synthesized
tacctctacttcctcatttctc

SEQ ID NO: 989422 - DNA, 22 bp, Artificial Sequence
  chemically synthesized
ttacttctatatgagaaatgag

SEQ ID NO: 989423 - DNA, 22 bp, Artificial Sequence
  chemically synthesized
tacttcctcatttctcatatag

SEQ ID NO: 989424 - DNA, 22 bp, Artificial Sequence
  chemically synthesized
cttcctcatttctcatatagaa

SEQ ID NO: 989425 - DNA, 22 bp, Artificial Sequence
  chemically synthesized
cctcatttctcatatagaagta

SEQ ID NO: 989426 - DNA, 22 bp, Artificial Sequence
  chemically synthesized
ctcatttctcatatagaagtaa

SEQ ID NO: 989427 - DNA, 22 bp, Artificial Sequence
  chemically synthesized
atttctcatatagaagtaatag

SEQ ID NO: 989428 - DNA, 22 bp, Artificial Sequence
  chemically synthesized
ctcatatagaagtaatagtgcc

SEQ ID NO: 989429 - DNA, 22 bp, Artificial Sequence
  chemically synthesized
tcatatagaagtaatagtgcca

SEQ ID NO: 989430 - DNA, 22 bp, Artificial Sequence
  chemically synthesized
atatagaagtaatagtgccatc

SEQ ID NO: 989431 - DNA, 22 bp, Artificial Sequence
  chemically synthesized
aatagtaaggtagatggcacta

SEQ ID NO: 989432 - DNA, 22 bp, Artificial Sequence
  chemically synthesized
taaatagtaaggtagatggcac

SEQ ID NO: 989433 - DNA, 22 bp, Artificial Sequence
  chemically synthesized
ctaaatagtaaggtagatggca

SEQ ID NO: 989434 - DNA, 22 bp, Artificial Sequence
  chemically synthesized
agtcttctaaatagtaaggtag

SEQ ID NO: 989435 - DNA, 22 bp, Artificial Sequence
  chemically synthesized
attgagtcttctaaatagtaag

SEQ ID NO: 989436 - DNA, 22 bp, Artificial Sequence
  chemically synthesized
catggattaattgagtcttcta

SEQ ID NO: 989437 - DNA, 22 bp, Artificial Sequence
  chemically synthesized
acatggattaattgagtcttct

SEQ ID NO: 989438 - DNA, 22 bp, Artificial Sequence
  chemically synthesized
ccttactatttagaagactcaa

SEQ ID NO: 989439 - DNA, 22 bp, Artificial Sequence
  chemically synthesized
actatttagaagactcaattaa

SEQ ID NO: 989440 - DNA, 22 bp, Artificial Sequence
  chemically synthesized
ctatttagaagactcaattaat

SEQ ID NO: 989441 - DNA, 22 bp, Artificial Sequence
  chemically synthesized
agtaacttacatggattaattg

SEQ ID NO: 989442 - DNA, 22 bp, Artificial Sequence
  chemically synthesized
tttagaagactcaattaatcca

SEQ ID NO: 989443 - DNA, 22 bp, Artificial Sequence
  chemically synthesized
agaagactcaattaatccatgt

SEQ ID NO: 989444 - DNA, 22 bp, Artificial Sequence
  chemically synthesized
gaagactcaattaatccatgta

SEQ ID NO: 989445 - DNA, 22 bp, Artificial Sequence
  chemically synthesized
aattaatccatgtaagttactt

SEQ ID NO: 989446 - DNA, 22 bp, Artificial Sequence
  chemically synthesized
aaatgacaggtctaagtaactt

SEQ ID NO: 989447 - DNA, 22 bp, Artificial Sequence
  chemically synthesized
atccatgtaagttacttagacc

SEQ ID NO: 989448 - DNA, 22 bp, Artificial Sequence
  chemically synthesized
cttagacctgtcattttagata

SEQ ID NO: 989449 - DNA, 22 bp, Artificial Sequence
  chemically synthesized
agacctgtcattttagatatta

SEQ ID NO: 989450 - DNA, 22 bp, Artificial Sequence
  chemically synthesized
atgtagtcataataatatctaa

SEQ ID NO: 989451 - DNA, 22 bp, Artificial Sequence
  chemically synthesized
gacctgtcattttagatattat

SEQ ID NO: 989452 - DNA, 22 bp, Artificial Sequence
  chemically synthesized
tgatgtagtcataataatatct

SEQ ID NO: 989453 - DNA, 22 bp, Artificial Sequence
  chemically synthesized
ctgatgtagtcataataatatc

SEQ ID NO: 989454 - DNA, 22 bp, Artificial Sequence
  chemically synthesized
tcattttagatattattatgac

SEQ ID NO: 989455 - DNA, 22 bp, Artificial Sequence
  chemically synthesized
tagatattattatgactacatc

SEQ ID NO: 989456 - DNA, 22 bp, Artificial Sequence
  chemically synthesized
agatattattatgactacatca

SEQ ID NO: 989457 - DNA, 22 bp, Artificial Sequence
  chemically synthesized
gatattattatgactacatcag

SEQ ID NO: 989458 - DNA, 22 bp, Artificial Sequence
  chemically synthesized
acataatatcttctgatgtagt

SEQ ID NO: 989459 - DNA, 22 bp, Artificial Sequence
  chemically synthesized
ctaacataatatcttctgatgt

SEQ ID NO: 989460 - DNA, 22 bp, Artificial Sequence
  chemically synthesized
ttactaacataatatcttctga

SEQ ID NO: 989461 - DNA, 22 bp, Artificial Sequence
  chemically synthesized
ttatgactacatcagaagatat

SEQ ID NO: 989462 - DNA, 22 bp, Artificial Sequence
  chemically synthesized
attactaacataatatcttctg

SEQ ID NO: 989463 - DNA, 22 bp, Artificial Sequence
  chemically synthesized
ttattactaacataatatcttc

SEQ ID NO: 989464 - DNA, 22 bp, Artificial Sequence
  chemically synthesized
tgactacatcagaagatattat

SEQ ID NO: 989465 - DNA, 22 bp, Artificial Sequence
  chemically synthesized
cttattactaacataatatctt

SEQ ID NO: 989466 - DNA, 22 bp, Artificial Sequence
  chemically synthesized
tcttattactaacataatatct

SEQ ID NO: 989467 - DNA, 22 bp, Artificial Sequence
  chemically synthesized
ttcttattactaacataatatc

SEQ ID NO: 989468 - DNA, 22 bp, Artificial Sequence
  chemically synthesized
catcagaagatattatgttagt

SEQ ID NO: 989469 - DNA, 22 bp, Artificial Sequence
  chemically synthesized
acaatgtttttcttattactaa

SEQ ID NO: 989470 - DNA, 22 bp, Artificial Sequence
  chemically synthesized
aacaatgtttttcttattacta

SEQ ID NO: 989471 - DNA, 22 bp, Artificial Sequence
  chemically synthesized
taacaatgtttttcttattact

SEQ ID NO: 989472 - DNA, 22 bp, Artificial Sequence
  chemically synthesized
tttaacaatgtttttcttatta

SEQ ID NO: 989473 - DNA, 22 bp, Artificial Sequence
  chemically synthesized
tgttagtaataagaaaaacatt

SEQ ID NO: 989474 - DNA, 22 bp, Artificial Sequence
  chemically synthesized
aaattctttaacaatgtttttc

SEQ ID NO: 989475 - DNA, 22 bp, Artificial Sequence
  chemically synthesized
caaattctttaacaatgttttt

SEQ ID NO: 989476 - DNA, 22 bp, Artificial Sequence
  chemically synthesized
tcaaattctttaacaatgtttt

SEQ ID NO: 989477 - DNA, 22 bp, Artificial Sequence
  chemically synthesized
gtaataagaaaaacattgttaa

SEQ ID NO: 989478 - DNA, 22 bp, Artificial Sequence
  chemically synthesized
ttttcaaattctttaacaatgt

SEQ ID NO: 989479 - DNA, 22 bp, Artificial Sequence
  chemically synthesized
attttcaaattctttaacaatg

SEQ ID NO: 989480 - DNA, 22 bp, Artificial Sequence
  chemically synthesized
cttattttcaaattctttaaca

SEQ ID NO: 989481 - DNA, 22 bp, Artificial Sequence
  chemically synthesized
tccttattttcaaattctttaa

SEQ ID NO: 989482 - DNA, 22 bp, Artificial Sequence
  chemically synthesized
ttctccttattttcaaattctt

SEQ ID NO: 989483 - DNA, 22 bp, Artificial Sequence
  chemically synthesized
attctccttattttcaaattct

SEQ ID NO: 989484 - DNA, 22 bp, Artificial Sequence
  chemically synthesized
ttaaagaatttgaaaataagga

SEQ ID NO: 989485 - DNA, 22 bp, Artificial Sequence
  chemically synthesized
acaaatcttattctccttattt

SEQ ID NO: 989486 - DNA, 22 bp, Artificial Sequence
  chemically synthesized
aacaaatcttattctccttatt

SEQ ID NO: 989487 - DNA, 22 bp, Artificial Sequence
  chemically synthesized
aagaatttgaaaataaggagaa

SEQ ID NO: 989488 - DNA, 22 bp, Artificial Sequence
  chemically synthesized
gaaaataaggagaataagattt

SEQ ID NO: 989489 - DNA, 22 bp, Artificial Sequence
  chemically synthesized
aaaataaggagaataagatttg

SEQ ID NO: 989490 - DNA, 22 bp, Artificial Sequence
  chemically synthesized
aaaataccttaacaaatcttat

SEQ ID NO: 989491 - DNA, 22 bp, Artificial Sequence
  chemically synthesized
caaaataccttaacaaatctta

SEQ ID NO: 989492 - DNA, 22 bp, Artificial Sequence
  chemically synthesized
tcaaaataccttaacaaatctt

SEQ ID NO: 989493 - DNA, 22 bp, Artificial Sequence
  chemically synthesized
attttcaaaataccttaacaaa

SEQ ID NO: 989494 - DNA, 22 bp, Artificial Sequence
  chemically synthesized
aaattaattttcaaaatacctt

SEQ ID NO: 989495 - DNA, 22 bp, Artificial Sequence
  chemically synthesized
aaaattaattttcaaaatacct

SEQ ID NO: 989496 - DNA, 22 bp, Artificial Sequence
  chemically synthesized
gttaaggtattttgaaaattaa

SEQ ID NO: 989497 - DNA, 22 bp, Artificial Sequence
  chemically synthesized
ttaaggtattttgaaaattaat

SEQ ID NO: 989498 - DNA, 22 bp, Artificial Sequence
  chemically synthesized
aggtattttgaaaattaatttt

SEQ ID NO: 989499 - DNA, 22 bp, Artificial Sequence
  chemically synthesized
acaaaacaacaatttaaaatta

SEQ ID NO: 989500 - DNA, 22 bp, Artificial Sequence
  chemically synthesized
actaacaaaacaacaatttaaa

SEQ ID NO: 989501 - DNA, 22 bp, Artificial Sequence
  chemically synthesized
tgaaaattaattttaaattgtt

SEQ ID NO: 989502 - DNA, 22 bp, Artificial Sequence
  chemically synthesized
gaaaattaattttaaattgttg

SEQ ID NO: 989503 - DNA, 22 bp, Artificial Sequence
  chemically synthesized
aaaattaattttaaattgttgt

SEQ ID NO: 989504 - DNA, 22 bp, Artificial Sequence
  chemically synthesized
ctaactaacaaaacaacaattt

SEQ ID NO: 989505 - DNA, 22 bp, Artificial Sequence
  chemically synthesized
attttaaattgttgttttgtta

SEQ ID NO: 989506 - DNA, 22 bp, Artificial Sequence
  chemically synthesized
agaccctactaactaacaaaac

SEQ ID NO: 989507 - DNA, 22 bp, Artificial Sequence
  chemically synthesized
aagaccctactaactaacaaaa

SEQ ID NO: 989508 - DNA, 22 bp, Artificial Sequence
  chemically synthesized
taagaccctactaactaacaaa

SEQ ID NO: 989509 - DNA, 22 bp, Artificial Sequence
  chemically synthesized
taaattgttgttttgttagtta

SEQ ID NO: 989510 - DNA, 22 bp, Artificial Sequence
  chemically synthesized
aaattgttgttttgttagttag

SEQ ID NO: 989511 - DNA, 22 bp, Artificial Sequence
  chemically synthesized
aattgttgttttgttagttagt

SEQ ID NO: 989512 - DNA, 22 bp, Artificial Sequence
  chemically synthesized
ttgttttgttagttagtagggt

SEQ ID NO: 989513 - DNA, 22 bp, Artificial Sequence
  chemically synthesized
ttttgttagttagtagggtctt

SEQ ID NO: 989514 - DNA, 22 bp, Artificial Sequence
  chemically synthesized
tgttagttagtagggtcttaaa

SEQ ID NO: 989515 - DNA, 22 bp, Artificial Sequence
  chemically synthesized
gttagttagtagggtcttaaaa

SEQ ID NO: 989516 - DNA, 22 bp, Artificial Sequence
  chemically synthesized
ttagttagtagggtcttaaaat

SEQ ID NO: 989517 - DNA, 22 bp, Artificial Sequence
  chemically synthesized
gttagtagggtcttaaaatcct

SEQ ID NO: 989518 - DNA, 22 bp, Artificial Sequence
  chemically synthesized
gaggtgatatgaaggattttaa

SEQ ID NO: 989519 - DNA, 22 bp, Artificial Sequence
  chemically synthesized
ttggaggtgatatgaaggattt

SEQ ID NO: 989520 - DNA, 22 bp, Artificial Sequence
  chemically synthesized
gtagggtcttaaaatccttcat

SEQ ID NO: 989521 - DNA, 22 bp, Artificial Sequence
  chemically synthesized
attggaggtgatatgaaggatt

SEQ ID NO: 989522 - DNA, 22 bp, Artificial Sequence
  chemically synthesized
agaagcttattggaggtgatat

SEQ ID NO: 989523 - DNA, 22 bp, Artificial Sequence
  chemically synthesized
aaaatccttcatatcacctcca

SEQ ID NO: 989524 - DNA, 22 bp, Artificial Sequence
  chemically synthesized
tcagaagcttattggaggtgat

SEQ ID NO: 989525 - DNA, 22 bp, Artificial Sequence
  chemically synthesized
aaatccttcatatcacctccaa

SEQ ID NO: 989526 - DNA, 22 bp, Artificial Sequence
  chemically synthesized
ctcagaagcttattggaggtga

SEQ ID NO: 989527 - DNA, 22 bp, Artificial Sequence
  chemically synthesized
tttctcagaagcttattggagg

SEQ ID NO: 989528 - DNA, 22 bp, Artificial Sequence
  chemically synthesized
atttctcagaagcttattggag

SEQ ID NO: 989529 - DNA, 22 bp, Artificial Sequence
  chemically synthesized
tttatttctcagaagcttattg

SEQ ID NO: 989530 - DNA, 22 bp, Artificial Sequence
  chemically synthesized
catatcacctccaataagcttc

SEQ ID NO: 989531 - DNA, 22 bp, Artificial Sequence
  chemically synthesized
atttatttctcagaagcttatt

SEQ ID NO: 989532 - DNA, 22 bp, Artificial Sequence
  chemically synthesized
atatcacctccaataagcttct

SEQ ID NO: 989533 - DNA, 22 bp, Artificial Sequence
  chemically synthesized
tatttatttatttctcagaagc

SEQ ID NO: 989534 - DNA, 22 bp, Artificial Sequence
  chemically synthesized
atatttatttatttctcagaag

SEQ ID NO: 989535 - DNA, 22 bp, Artificial Sequence
  chemically synthesized
caataagcttctgagaaataaa

SEQ ID NO: 989536 - DNA, 22 bp, Artificial Sequence
  chemically synthesized
ctgagaaataaataaatataag

SEQ ID NO: 989537 - DNA, 22 bp, Artificial Sequence
  chemically synthesized
tgagaaataaataaatataaga

SEQ ID NO: 989538 - DNA, 22 bp, Artificial Sequence
  chemically synthesized
agaaataaataaatataagact

SEQ ID NO: 989539 - DNA, 22 bp, Artificial Sequence
  chemically synthesized
aaatgggatatgtagagtctta

SEQ ID NO: 989540 - DNA, 22 bp, Artificial Sequence
  chemically synthesized
taagtcatccctgaaatgggat

SEQ ID NO: 989541 - DNA, 22 bp, Artificial Sequence
  chemically synthesized
tgtaagtcatccctgaaatggg

SEQ ID NO: 989542 - DNA, 22 bp, Artificial Sequence
  chemically synthesized
tacatatcccatttcagggatg

SEQ ID NO: 989543 - DNA, 22 bp, Artificial Sequence
  chemically synthesized
catatcccatttcagggatgac

SEQ ID NO: 989544 - DNA, 22 bp, Artificial Sequence
  chemically synthesized
agtccctctgtaagtcatccct

SEQ ID NO: 989545 - DNA, 22 bp, Artificial Sequence
  chemically synthesized
ttaagtccctctgtaagtcatc

SEQ ID NO: 989546 - DNA, 22 bp, Artificial Sequence
  chemically synthesized
attaagtccctctgtaagtcat

SEQ ID NO: 989547 - DNA, 22 bp, Artificial Sequence
  chemically synthesized
tattaagtccctctgtaagtca

SEQ ID NO: 989548 - DNA, 22 bp, Artificial Sequence
  chemically synthesized
ttattaagtccctctgtaagtc

SEQ ID NO: 989549 - DNA, 22 bp, Artificial Sequence
  chemically synthesized
cagggatgacttacagagggac

SEQ ID NO: 989550 - DNA, 22 bp, Artificial Sequence
  chemically synthesized
catttttattaagtccctctgt

SEQ ID NO: 989551 - DNA, 22 bp, Artificial Sequence
  chemically synthesized
agggatgacttacagagggact

SEQ ID NO: 989552 - DNA, 22 bp, Artificial Sequence
  chemically synthesized
tgcatttttattaagtccctct

SEQ ID NO: 989553 - DNA, 22 bp, Artificial Sequence
  chemically synthesized
ttctgcatttttattaagtccc

SEQ ID NO: 989554 - DNA, 22 bp, Artificial Sequence
  chemically synthesized
attctgcatttttattaagtcc

SEQ ID NO: 989555 - DNA, 22 bp, Artificial Sequence
  chemically synthesized
acagagggacttaataaaaatg

SEQ ID NO: 989556 - DNA, 22 bp, Artificial Sequence
  chemically synthesized
cagagggacttaataaaaatgc

SEQ ID NO: 989557 - DNA, 22 bp, Artificial Sequence
  chemically synthesized
aataaaaatgcagaataaacta

SEQ ID NO: 989558 - DNA, 22 bp, Artificial Sequence
  chemically synthesized
ataaaaatgcagaataaactat

SEQ ID NO: 989559 - DNA, 22 bp, Artificial Sequence
  chemically synthesized
gtaaaacaaaacaaaacaaaaa

SEQ ID NO: 989560 - DNA, 22 bp, Artificial Sequence
  chemically synthesized
tggtaaaacaaaacaaaacaaa

SEQ ID NO: 989561 - DNA, 22 bp, Artificial Sequence
  chemically synthesized
ttgtttttgttttgttttgttt

SEQ ID NO: 989562 - DNA, 22 bp, Artificial Sequence
  chemically synthesized
tttttgttttgttttgttttac

SEQ ID NO: 989563 - DNA, 22 bp, Artificial Sequence
  chemically synthesized
ttgttttgttttgttttaccag

SEQ ID NO: 989564 - DNA, 22 bp, Artificial Sequence
  chemically synthesized
tgttttgttttgttttaccaga

SEQ ID NO: 989565 - DNA, 22 bp, Artificial Sequence
  chemically synthesized
gttttgttttgttttaccagaa

SEQ ID NO: 989566 - DNA, 22 bp, Artificial Sequence
  chemically synthesized
ttttgttttgttttaccagaat

SEQ ID NO: 989567 - DNA, 22 bp, Artificial Sequence
  chemically synthesized
atcaaaggggagatattctggt

SEQ ID NO: 989568 - DNA, 22 bp, Artificial Sequence
  chemically synthesized
tgttttgttttaccagaatatc

SEQ ID NO: 989569 - DNA, 22 bp, Artificial Sequence
  chemically synthesized
aatcaaaggggagatattctgg

SEQ ID NO: 989570 - DNA, 22 bp, Artificial Sequence
  chemically synthesized
gttttgttttaccagaatatct

SEQ ID NO: 989571 - DNA, 22 bp, Artificial Sequence
  chemically synthesized
taatcaaaggggagatattctg

SEQ ID NO: 989572 - DNA, 22 bp, Artificial Sequence
  chemically synthesized
ttttgttttaccagaatatctc

SEQ ID NO: 989573 - DNA, 22 bp, Artificial Sequence
  chemically synthesized
ttaatcaaaggggagatattct

SEQ ID NO: 989574 - DNA, 22 bp, Artificial Sequence
  chemically synthesized
tttaatcaaaggggagatattc

SEQ ID NO: 989575 - DNA, 22 bp, Artificial Sequence
  chemically synthesized
ttttaatcaaaggggagatatt

SEQ ID NO: 989576 - DNA, 22 bp, Artificial Sequence
  chemically synthesized
tgttttaccagaatatctcccc

SEQ ID NO: 989577 - DNA, 22 bp, Artificial Sequence
  chemically synthesized
tttttaatcaaaggggagatat

SEQ ID NO: 989578 - DNA, 22 bp, Artificial Sequence
  chemically synthesized
gttttaccagaatatctcccct

SEQ ID NO: 989579 - DNA, 22 bp, Artificial Sequence
  chemically synthesized
ttttttaatcaaaggggagata

SEQ ID NO: 989580 - DNA, 22 bp, Artificial Sequence
  chemically synthesized
ttttaccagaatatctcccctt

SEQ ID NO: 989581 - DNA, 22 bp, Artificial Sequence
  chemically synthesized
tttttttaatcaaaggggagat

SEQ ID NO: 989582 - DNA, 22 bp, Artificial Sequence
  chemically synthesized
ttttttttaatcaaaggggaga

SEQ ID NO: 989583 - DNA, 22 bp, Artificial Sequence
  chemically synthesized
tttttttttaatcaaaggggag

SEQ ID NO: 989584 - DNA, 22 bp, Artificial Sequence
  chemically synthesized
taccagaatatctcccctttga

SEQ ID NO: 989585 - DNA, 22 bp, Artificial Sequence
  chemically synthesized
accagaatatctcccctttgat

SEQ ID NO: 989586 - DNA, 22 bp, Artificial Sequence
  chemically synthesized
ccagaatatctcccctttgatt

SEQ ID NO: 989587 - DNA, 22 bp, Artificial Sequence
  chemically synthesized
caataatctttttttttttaat

SEQ ID NO: 989588 - DNA, 22 bp, Artificial Sequence
  chemically synthesized
acaataatctttttttttttaa

SEQ ID NO: 989589 - DNA, 22 bp, Artificial Sequence
  chemically synthesized
tacaataatcttttttttttta

SEQ ID NO: 989590 - DNA, 22 bp, Artificial Sequence
  chemically synthesized
ttacaataatcttttttttttt

SEQ ID NO: 989591 - DNA, 22 bp, Artificial Sequence
  chemically synthesized
ccctttgattaaaaaaaaaaag

SEQ ID NO: 989592 - DNA, 22 bp, Artificial Sequence
  chemically synthesized
tgattaaaaaaaaaaagattat

SEQ ID NO: 989593 - DNA, 22 bp, Artificial Sequence
  chemically synthesized
gattaaaaaaaaaaagattatt

SEQ ID NO: 989594 - DNA, 22 bp, Artificial Sequence
  chemically synthesized
attaaaaaaaaaaagattattg

SEQ ID NO: 989595 - DNA, 22 bp, Artificial Sequence
  chemically synthesized
gagcatcatcttttacaataat

SEQ ID NO: 989596 - DNA, 22 bp, Artificial Sequence
  chemically synthesized
aaaaaaaaaagattattgtaaa

SEQ ID NO: 989597 - DNA, 22 bp, Artificial Sequence
  chemically synthesized
agagcatcatcttttacaataa

SEQ ID NO: 989598 - DNA, 22 bp, Artificial Sequence
  chemically synthesized
ttgtaaaagatgatgctctaag

SEQ ID NO: 989599 - DNA, 22 bp, Artificial Sequence
  chemically synthesized
taaaagatgatgctctaagtct

SEQ ID NO: 989600 - DNA, 22 bp, Artificial Sequence
  chemically synthesized
ccagtgtaaagcagacttagag

SEQ ID NO: 989601 - DNA, 22 bp, Artificial Sequence
  chemically synthesized
tggcctgccagtgtaaagcaga

SEQ ID NO: 989602 - DNA, 22 bp, Artificial Sequence
  chemically synthesized
taagtctgctttacactggcag

SEQ ID NO: 989603 - DNA, 22 bp, Artificial Sequence
  chemically synthesized
agtctgctttacactggcaggc

SEQ ID NO: 989604 - DNA, 22 bp, Artificial Sequence
  chemically synthesized
tgaatgtctatggcctgccagt

SEQ ID NO: 989605 - DNA, 22 bp, Artificial Sequence
  chemically synthesized
atgaatgtctatggcctgccag

SEQ ID NO: 989606 - DNA, 22 bp, Artificial Sequence
  chemically synthesized
tttatgaatgtctatggcctgc

SEQ ID NO: 989607 - DNA, 22 bp, Artificial Sequence
  chemically synthesized
atttatgaatgtctatggcctg

SEQ ID NO: 989608 - DNA, 22 bp, Artificial Sequence
  chemically synthesized
ctttacactggcaggccataga

SEQ ID NO: 989609 - DNA, 22 bp, Artificial Sequence
  chemically synthesized
tacactggcaggccatagacat

SEQ ID NO: 989610 - DNA, 22 bp, Artificial Sequence
  chemically synthesized
acactggcaggccatagacatt

SEQ ID NO: 989611 - DNA, 22 bp, Artificial Sequence
  chemically synthesized
cactggcaggccatagacattc

SEQ ID NO: 989612 - DNA, 22 bp, Artificial Sequence
  chemically synthesized
taggaatttatttatgaatgtc

SEQ ID NO: 989613 - DNA, 22 bp, Artificial Sequence
  chemically synthesized
gtaggaatttatttatgaatgt

SEQ ID NO: 989614 - DNA, 22 bp, Artificial Sequence
  chemically synthesized
gcaggccatagacattcataaa

SEQ ID NO: 989615 - DNA, 22 bp, Artificial Sequence
  chemically synthesized
tgtaggaatttatttatgaatg

SEQ ID NO: 989616 - DNA, 22 bp, Artificial Sequence
  chemically synthesized
attttgtaggaatttatttatg

SEQ ID NO: 989617 - DNA, 22 bp, Artificial Sequence
  chemically synthesized
cattttgtaggaatttatttat

SEQ ID NO: 989618 - DNA, 22 bp, Artificial Sequence
  chemically synthesized
tttcattttgtaggaatttatt

SEQ ID NO: 989619 - DNA, 22 bp, Artificial Sequence
  chemically synthesized
ctatttcattttgtaggaattt

SEQ ID NO: 989620 - DNA, 22 bp, Artificial Sequence
  chemically synthesized
attcctatttcattttgtagga

SEQ ID NO: 989621 - DNA, 22 bp, Artificial Sequence
  chemically synthesized
ataaataaattcctacaaaatg

SEQ ID NO: 989622 - DNA, 22 bp, Artificial Sequence
  chemically synthesized
tacaaggattaattcctatttc

SEQ ID NO: 989623 - DNA, 22 bp, Artificial Sequence
  chemically synthesized
gtacaaggattaattcctattt

SEQ ID NO: 989624 - DNA, 22 bp, Artificial Sequence
  chemically synthesized
ctacaaaatgaaataggaatta

SEQ ID NO: 989625 - DNA, 22 bp, Artificial Sequence
  chemically synthesized
caaaatgaaataggaattaatc

SEQ ID NO: 989626 - DNA, 22 bp, Artificial Sequence
  chemically synthesized
tagtatttgtacaaggattaat

SEQ ID NO: 989627 - DNA, 22 bp, Artificial Sequence
  chemically synthesized
gctatagtatttgtacaaggat

SEQ ID NO: 989628 - DNA, 22 bp, Artificial Sequence
  chemically synthesized
gttagctatagtatttgtacaa

SEQ ID NO: 989629 - DNA, 22 bp, Artificial Sequence
  chemically synthesized
agttagctatagtatttgtaca

SEQ ID NO: 989630 - DNA, 22 bp, Artificial Sequence
  chemically synthesized
tacttagttagctatagtattt

SEQ ID NO: 989631 - DNA, 22 bp, Artificial Sequence
  chemically synthesized
atccttgtacaaatactatagc

SEQ ID NO: 989632 - DNA, 22 bp, Artificial Sequence
  chemically synthesized
gaaactgtacttagttagctat

SEQ ID NO: 989633 - DNA, 22 bp, Artificial Sequence
  chemically synthesized
gtacaaatactatagctaacta

SEQ ID NO: 989634 - DNA, 22 bp, Artificial Sequence
  chemically synthesized
tacaaatactatagctaactaa

SEQ ID NO: 989635 - DNA, 22 bp, Artificial Sequence
  chemically synthesized
tagaaactgtacttagttagct

SEQ ID NO: 989636 - DNA, 22 bp, Artificial Sequence
  chemically synthesized
ctagaaactgtacttagttagc

SEQ ID NO: 989637 - DNA, 22 bp, Artificial Sequence
  chemically synthesized
tagctaactaagtacagtttct

SEQ ID NO: 989638 - DNA, 22 bp, Artificial Sequence
  chemically synthesized
aaaatatacttctagaaactgt

SEQ ID NO: 989639 - DNA, 22 bp, Artificial Sequence
  chemically synthesized
caaaatatacttctagaaactg

SEQ ID NO: 989640 - DNA, 22 bp, Artificial Sequence
  chemically synthesized
actaagtacagtttctagaagt

SEQ ID NO: 989641 - DNA, 22 bp, Artificial Sequence
  chemically synthesized
atttcaaaatatacttctagaa

SEQ ID NO: 989642 - DNA, 22 bp, Artificial Sequence
  chemically synthesized
catttcaaaatatacttctaga

SEQ ID NO: 989643 - DNA, 22 bp, Artificial Sequence
  chemically synthesized
agtacagtttctagaagtatat

SEQ ID NO: 989644 - DNA, 22 bp, Artificial Sequence
  chemically synthesized
ctagaagtatattttgaaatga

SEQ ID NO: 989645 - DNA, 22 bp, Artificial Sequence
  chemically synthesized
tagaagtatattttgaaatgaa

SEQ ID NO: 989646 - DNA, 22 bp, Artificial Sequence
  chemically synthesized
gaagtatattttgaaatgaaat

SEQ ID NO: 989647 - DNA, 22 bp, Artificial Sequence
  chemically synthesized
tcaccagtgatatacataaatt

SEQ ID NO: 989648 - DNA, 22 bp, Artificial Sequence
  chemically synthesized
tgaaatgaaatttatgtatatc

SEQ ID NO: 989649 - DNA, 22 bp, Artificial Sequence
  chemically synthesized
gaaatgaaatttatgtatatca

SEQ ID NO: 989650 - DNA, 22 bp, Artificial Sequence
  chemically synthesized
aaatgaaatttatgtatatcac

SEQ ID NO: 989651 - DNA, 22 bp, Artificial Sequence
  chemically synthesized
aatgagtacaagttatcaccag

SEQ ID NO: 989652 - DNA, 22 bp, Artificial Sequence
  chemically synthesized
aaatgagtacaagttatcacca

SEQ ID NO: 989653 - DNA, 22 bp, Artificial Sequence
  chemically synthesized
atgtatatcactggtgataact

SEQ ID NO: 989654 - DNA, 22 bp, Artificial Sequence
  chemically synthesized
tgtatatcactggtgataactt

SEQ ID NO: 989655 - DNA, 22 bp, Artificial Sequence
  chemically synthesized
agaagcatttaaatgagtacaa

SEQ ID NO: 989656 - DNA, 22 bp, Artificial Sequence
  chemically synthesized
cagaagcatttaaatgagtaca

SEQ ID NO: 989657 - DNA, 22 bp, Artificial Sequence
  chemically synthesized
gtgataacttgtactcatttaa

SEQ ID NO: 989658 - DNA, 22 bp, Artificial Sequence
  chemically synthesized
aagagaatgcttcagaagcatt

SEQ ID NO: 989659 - DNA, 22 bp, Artificial Sequence
  chemically synthesized
gtactcatttaaatgcttctga

SEQ ID NO: 989660 - DNA, 22 bp, Artificial Sequence
  chemically synthesized
tactcatttaaatgcttctgaa

SEQ ID NO: 989661 - DNA, 22 bp, Artificial Sequence
  chemically synthesized
tgaagagaatgcttcagaagca

SEQ ID NO: 989662 - DNA, 22 bp, Artificial Sequence
  chemically synthesized
ctgaagagaatgcttcagaagc

SEQ ID NO: 989663 - DNA, 22 bp, Artificial Sequence
  chemically synthesized
atttaaatgcttctgaagcatt

SEQ ID NO: 989664 - DNA, 22 bp, Artificial Sequence
  chemically synthesized
acttctgaagagaatgcttcag

SEQ ID NO: 989665 - DNA, 22 bp, Artificial Sequence
  chemically synthesized
ttaacttctgaagagaatgctt

SEQ ID NO: 989666 - DNA, 22 bp, Artificial Sequence
  chemically synthesized
aaatgcttctgaagcattctct

SEQ ID NO: 989667 - DNA, 22 bp, Artificial Sequence
  chemically synthesized
aatgcttctgaagcattctctt

SEQ ID NO: 989668 - DNA, 22 bp, Artificial Sequence
  chemically synthesized
ctgaagcattctcttcagaagt

SEQ ID NO: 989669 - DNA, 22 bp, Artificial Sequence
  chemically synthesized
gaaaagttattaacttctgaag

SEQ ID NO: 989670 - DNA, 22 bp, Artificial Sequence
  chemically synthesized
tgaagcattctcttcagaagtt

SEQ ID NO: 989671 - DNA, 22 bp, Artificial Sequence
  chemically synthesized
agaaaagttattaacttctgaa

SEQ ID NO: 989672 - DNA, 22 bp, Artificial Sequence
  chemically synthesized
tagaaaagttattaacttctga

SEQ ID NO: 989673 - DNA, 22 bp, Artificial Sequence
  chemically synthesized
aagcattctcttcagaagttaa

SEQ ID NO: 989674 - DNA, 22 bp, Artificial Sequence
  chemically synthesized
ttttagaaaagttattaacttc

SEQ ID NO: 989675 - DNA, 22 bp, Artificial Sequence
  chemically synthesized
attttagaaaagttattaactt

SEQ ID NO: 989676 - DNA, 22 bp, Artificial Sequence
  chemically synthesized
acttattttagaaaagttatta

SEQ ID NO: 989677 - DNA, 22 bp, Artificial Sequence
  chemically synthesized
tcttcagaagttaataactttt

SEQ ID NO: 989678 - DNA, 22 bp, Artificial Sequence
  chemically synthesized
gacttattttagaaaagttatt

SEQ ID NO: 989679 - DNA, 22 bp, Artificial Sequence
  chemically synthesized
ttcagaagttaataacttttct

SEQ ID NO: 989680 - DNA, 22 bp, Artificial Sequence
  chemically synthesized
cagaagttaataacttttctaa

SEQ ID NO: 989681 - DNA, 22 bp, Artificial Sequence
  chemically synthesized
agaagttaataacttttctaaa

SEQ ID NO: 989682 - DNA, 22 bp, Artificial Sequence
  chemically synthesized
catgatttgacttattttagaa

SEQ ID NO: 989683 - DNA, 22 bp, Artificial Sequence
  chemically synthesized
ataacttttctaaaataagtca

SEQ ID NO: 989684 - DNA, 22 bp, Artificial Sequence
  chemically synthesized
gtcaaattgcatgatttgactt

SEQ ID NO: 989685 - DNA, 22 bp, Artificial Sequence
  chemically synthesized
ttctaaaataagtcaaatcatg

SEQ ID NO: 989686 - DNA, 22 bp, Artificial Sequence
  chemically synthesized
tctaaaataagtcaaatcatgc

SEQ ID NO: 989687 - DNA, 22 bp, Artificial Sequence
  chemically synthesized
ctaaaataagtcaaatcatgca

SEQ ID NO: 989688 - DNA, 22 bp, Artificial Sequence
  chemically synthesized
tattcgtcaaattgcatgattt

SEQ ID NO: 989689 - DNA, 22 bp, Artificial Sequence
  chemically synthesized
taaaataagtcaaatcatgcaa

SEQ ID NO: 989690 - DNA, 22 bp, Artificial Sequence
  chemically synthesized
atattcgtcaaattgcatgatt

SEQ ID NO: 989691 - DNA, 22 bp, Artificial Sequence
  chemically synthesized
aaataagtcaaatcatgcaatt

SEQ ID NO: 989692 - DNA, 22 bp, Artificial Sequence
  chemically synthesized
caatttatattcgtcaaattgc

SEQ ID NO: 989693 - DNA, 22 bp, Artificial Sequence
  chemically synthesized
ctgcaatttatattcgtcaaat

SEQ ID NO: 989694 - DNA, 22 bp, Artificial Sequence
  chemically synthesized
gcaatggtaaaattgctgcaat

SEQ ID NO: 989695 - DNA, 22 bp, Artificial Sequence
  chemically synthesized
gacgaatataaattgcagcaat

SEQ ID NO: 989696 - DNA, 22 bp, Artificial Sequence
  chemically synthesized
agcaatggtaaaattgctgcaa

SEQ ID NO: 989697 - DNA, 22 bp, Artificial Sequence
  chemically synthesized
acgaatataaattgcagcaatt

SEQ ID NO: 989698 - DNA, 22 bp, Artificial Sequence
  chemically synthesized
tagcaatggtaaaattgctgca

SEQ ID NO: 989699 - DNA, 22 bp, Artificial Sequence
  chemically synthesized
ggaaaccattttagcaatggta

SEQ ID NO: 989700 - DNA, 22 bp, Artificial Sequence
  chemically synthesized
cagcaattttaccattgctaaa

SEQ ID NO: 989701 - DNA, 22 bp, Artificial Sequence
  chemically synthesized
taatgctcggaaaccattttag

SEQ ID NO: 989702 - DNA, 22 bp, Artificial Sequence
  chemically synthesized
gtaatgctcggaaaccatttta

SEQ ID NO: 989703 - DNA, 22 bp, Artificial Sequence
  chemically synthesized
ttgtaatgctcggaaaccattt

SEQ ID NO: 989704 - DNA, 22 bp, Artificial Sequence
  chemically synthesized
taccattgctaaaatggtttcc

SEQ ID NO: 989705 - DNA, 22 bp, Artificial Sequence
  chemically synthesized
cttgtaatgctcggaaaccatt

SEQ ID NO: 989706 - DNA, 22 bp, Artificial Sequence
  chemically synthesized
accattgctaaaatggtttccg

SEQ ID NO: 989707 - DNA, 22 bp, Artificial Sequence
  chemically synthesized
ccattgctaaaatggtttccga

SEQ ID NO: 989708 - DNA, 22 bp, Artificial Sequence
  chemically synthesized
ttcttgtaatgctcggaaacca

SEQ ID NO: 989709 - DNA, 22 bp, Artificial Sequence
  chemically synthesized
ctaaaatggtttccgagcatta

SEQ ID NO: 989710 - DNA, 22 bp, Artificial Sequence
  chemically synthesized
aaatggtttccgagcattacaa

SEQ ID NO: 989711 - DNA, 22 bp, Artificial Sequence
  chemically synthesized
ccgagcattacaagaagagttc

SEQ ID NO: 989712 - DNA, 22 bp, Artificial Sequence
  chemically synthesized
cgagcattacaagaagagttca

SEQ ID NO: 989713 - DNA, 22 bp, Artificial Sequence
  chemically synthesized
caagaagagttcacttggctac

SEQ ID NO: 989714 - DNA, 22 bp, Artificial Sequence
  chemically synthesized
agtgtaaagacagtagccaagt

SEQ ID NO: 989715 - DNA, 22 bp, Artificial Sequence
  chemically synthesized
acttggctactgtctttacact

SEQ ID NO: 989716 - DNA, 22 bp, Artificial Sequence
  chemically synthesized
atcaaagtattcagtgtaaaga

SEQ ID NO: 989717 - DNA, 22 bp, Artificial Sequence
  chemically synthesized
ggctactgtctttacactgaat

SEQ ID NO: 989718 - DNA, 22 bp, Artificial Sequence
  chemically synthesized
gctactgtctttacactgaata

SEQ ID NO: 989719 - DNA, 22 bp, Artificial Sequence
  chemically synthesized
taacctcatcaaagtattcagt

SEQ ID NO: 989720 - DNA, 22 bp, Artificial Sequence
  chemically synthesized
ctgtctttacactgaatacttt

SEQ ID NO: 989721 - DNA, 22 bp, Artificial Sequence
  chemically synthesized
ttgtaacctcatcaaagtattc

SEQ ID NO: 989722 - DNA, 22 bp, Artificial Sequence
  chemically synthesized
tctttacactgaatactttgat

SEQ ID NO: 989723 - DNA, 22 bp, Artificial Sequence
  chemically synthesized
ttattgtaacctcatcaaagta

SEQ ID NO: 989724 - DNA, 22 bp, Artificial Sequence
  chemically synthesized
attattgtaacctcatcaaagt

SEQ ID NO: 989725 - DNA, 22 bp, Artificial Sequence
  chemically synthesized
tattattgtaacctcatcaaag

SEQ ID NO: 989726 - DNA, 22 bp, Artificial Sequence
  chemically synthesized
tacactgaatactttgatgagg

SEQ ID NO: 989727 - DNA, 22 bp, Artificial Sequence
  chemically synthesized
acactgaatactttgatgaggt

SEQ ID NO: 989728 - DNA, 22 bp, Artificial Sequence
  chemically synthesized
cactgaatactttgatgaggtt

SEQ ID NO: 989729 - DNA, 22 bp, Artificial Sequence
  chemically synthesized
tcactttattattgtaacctca

SEQ ID NO: 989730 - DNA, 22 bp, Artificial Sequence
  chemically synthesized
gtcactttattattgtaacctc

SEQ ID NO: 989731 - DNA, 22 bp, Artificial Sequence
  chemically synthesized
aatactttgatgaggttacaat

SEQ ID NO: 989732 - DNA, 22 bp, Artificial Sequence
  chemically synthesized
tgtcactttattattgtaacct

SEQ ID NO: 989733 - DNA, 22 bp, Artificial Sequence
  chemically synthesized
tgatgaggttacaataataaag

SEQ ID NO: 989734 - DNA, 22 bp, Artificial Sequence
  chemically synthesized
gatgaggttacaataataaagt

SEQ ID NO: 989735 - DNA, 22 bp, Artificial Sequence
  chemically synthesized
atgaggttacaataataaagtg

SEQ ID NO: 989736 - DNA, 22 bp, Artificial Sequence
  chemically synthesized
caataataaagtgacaaagtga

SEQ ID NO: 989737 - DNA, 22 bp, Artificial Sequence
  chemically synthesized
aagaaaatggtataaaagaaaa

SEQ ID NO: 989738 - DNA, 22 bp, Artificial Sequence
  chemically synthesized
aaagaaaatggtataaaagaaa

SEQ ID NO: 989739 - DNA, 22 bp, Artificial Sequence
  chemically synthesized
taaagaaaatggtataaaagaa

SEQ ID NO: 989740 - DNA, 22 bp, Artificial Sequence
  chemically synthesized
ttaaagaaaatggtataaaaga

SEQ ID NO: 989741 - DNA, 22 bp, Artificial Sequence
  chemically synthesized
tttaaagaaaatggtataaaag

SEQ ID NO: 989742 - DNA, 22 bp, Artificial Sequence
  chemically synthesized
ttttaaagaaaatggtataaaa

SEQ ID NO: 989743 - DNA, 22 bp, Artificial Sequence
  chemically synthesized
tttttaaagaaaatggtataaa

SEQ ID NO: 989744 - DNA, 22 bp, Artificial Sequence
  chemically synthesized
ctttttttaaagaaaatggtat

SEQ ID NO: 989745 - DNA, 22 bp, Artificial Sequence
  chemically synthesized
tcttttataccattttctttaa

SEQ ID NO: 989746 - DNA, 22 bp, Artificial Sequence
  chemically synthesized
cttttataccattttctttaaa

SEQ ID NO: 989747 - DNA, 22 bp, Artificial Sequence
  chemically synthesized
aggactcctttttttaaagaaa

SEQ ID NO: 989748 - DNA, 22 bp, Artificial Sequence
  chemically synthesized
ttttataccattttctttaaaa

SEQ ID NO: 989749 - DNA, 22 bp, Artificial Sequence
  chemically synthesized
ttataccattttctttaaaaaa

SEQ ID NO: 989750 - DNA, 22 bp, Artificial Sequence
  chemically synthesized
tataccattttctttaaaaaaa

SEQ ID NO: 989751 - DNA, 22 bp, Artificial Sequence
  chemically synthesized
ataccattttctttaaaaaaag

SEQ ID NO: 989752 - DNA, 22 bp, Artificial Sequence
  chemically synthesized
taccattttctttaaaaaaagg

SEQ ID NO: 989753 - DNA, 22 bp, Artificial Sequence
  chemically synthesized
gaaaaaattaaggactcctttt

SEQ ID NO: 989754 - DNA, 22 bp, Artificial Sequence
  chemically synthesized
agaaaaaattaaggactccttt

SEQ ID NO: 989755 - DNA, 22 bp, Artificial Sequence
  chemically synthesized
ttagaaaaaattaaggactcct

SEQ ID NO: 989756 - DNA, 22 bp, Artificial Sequence
  chemically synthesized
tctttaaaaaaaggagtcctta

SEQ ID NO: 989757 - DNA, 22 bp, Artificial Sequence
  chemically synthesized
ctttaaaaaaaggagtccttaa

SEQ ID NO: 989758 - DNA, 22 bp, Artificial Sequence
  chemically synthesized
tttaaaaaaaggagtccttaat

SEQ ID NO: 989759 - DNA, 22 bp, Artificial Sequence
  chemically synthesized
taaaaaaaggagtccttaattt

SEQ ID NO: 989760 - DNA, 22 bp, Artificial Sequence
  chemically synthesized
aaaaaaaggagtccttaatttt

SEQ ID NO: 989761 - DNA, 22 bp, Artificial Sequence
  chemically synthesized
gagttcttagaaaaaattaagg

SEQ ID NO: 989762 - DNA, 22 bp, Artificial Sequence
  chemically synthesized
aaaaaaggagtccttaattttt

SEQ ID NO: 989763 - DNA, 22 bp, Artificial Sequence
  chemically synthesized
ggagttcttagaaaaaattaag

SEQ ID NO: 989764 - DNA, 22 bp, Artificial Sequence
  chemically synthesized
tggagttcttagaaaaaattaa

SEQ ID NO: 989765 - DNA, 22 bp, Artificial Sequence
  chemically synthesized
atattttggagttcttagaaaa

SEQ ID NO: 989766 - DNA, 22 bp, Artificial Sequence
  chemically synthesized
catattttggagttcttagaaa

SEQ ID NO: 989767 - DNA, 22 bp, Artificial Sequence
  chemically synthesized
tcatattttggagttcttagaa

SEQ ID NO: 989768 - DNA, 22 bp, Artificial Sequence
  chemically synthesized
ctttcatattttggagttctta

SEQ ID NO: 989769 - DNA, 22 bp, Artificial Sequence
  chemically synthesized
tactttcatattttggagttct

SEQ ID NO: 989770 - DNA, 22 bp, Artificial Sequence
  chemically synthesized
aattttttctaagaactccaaa

SEQ ID NO: 989771 - DNA, 22 bp, Artificial Sequence
  chemically synthesized
ctactttcatattttggagttc

SEQ ID NO: 989772 - DNA, 22 bp, Artificial Sequence
  chemically synthesized
attttttctaagaactccaaaa

SEQ ID NO: 989773 - DNA, 22 bp, Artificial Sequence
  chemically synthesized
tctactttcatattttggagtt

SEQ ID NO: 989774 - DNA, 22 bp, Artificial Sequence
  chemically synthesized
ttctactttcatattttggagt

SEQ ID NO: 989775 - DNA, 22 bp, Artificial Sequence
  chemically synthesized
tttctactttcatattttggag

SEQ ID NO: 989776 - DNA, 22 bp, Artificial Sequence
  chemically synthesized
tttctaagaactccaaaatatg

SEQ ID NO: 989777 - DNA, 22 bp, Artificial Sequence
  chemically synthesized
ttctaagaactccaaaatatga

SEQ ID NO: 989778 - DNA, 22 bp, Artificial Sequence
  chemically synthesized
tctaagaactccaaaatatgaa

SEQ ID NO: 989779 - DNA, 22 bp, Artificial Sequence
  chemically synthesized
cctttttctactttcatatttt

SEQ ID NO: 989780 - DNA, 22 bp, Artificial Sequence
  chemically synthesized
ctaagaactccaaaatatgaaa

SEQ ID NO: 989781 - DNA, 22 bp, Artificial Sequence
  chemically synthesized
taagaactccaaaatatgaaag

SEQ ID NO: 989782 - DNA, 22 bp, Artificial Sequence
  chemically synthesized
agaactccaaaatatgaaagta

SEQ ID NO: 989783 - DNA, 22 bp, Artificial Sequence
  chemically synthesized
caaaatatgaaagtagaaaaag

SEQ ID NO: 989784 - DNA, 22 bp, Artificial Sequence
  chemically synthesized
agtcatagctgcctttttctac

SEQ ID NO: 989785 - DNA, 22 bp, Artificial Sequence
  chemically synthesized
aaatgtattcagtcatagctgc

SEQ ID NO: 989786 - DNA, 22 bp, Artificial Sequence
  chemically synthesized
gaaatgtattcagtcatagctg

SEQ ID NO: 989787 - DNA, 22 bp, Artificial Sequence
  chemically synthesized
ttgaaatgtattcagtcatagc

SEQ ID NO: 989788 - DNA, 22 bp, Artificial Sequence
  chemically synthesized
cttgaaatgtattcagtcatag

SEQ ID NO: 989789 - DNA, 22 bp, Artificial Sequence
  chemically synthesized
tcttgaaatgtattcagtcata

SEQ ID NO: 989790 - DNA, 22 bp, Artificial Sequence
  chemically synthesized
ttcttgaaatgtattcagtcat

SEQ ID NO: 989791 - DNA, 22 bp, Artificial Sequence
  chemically synthesized
tgactgaatacatttcaagaaa

SEQ ID NO: 989792 - DNA, 22 bp, Artificial Sequence
  chemically synthesized
aatacatttcaagaaaaatgtc

SEQ ID NO: 989793 - DNA, 22 bp, Artificial Sequence
  chemically synthesized
agaaagatgaatgacatttttc

SEQ ID NO: 989794 - DNA, 22 bp, Artificial Sequence
  chemically synthesized
aagaaagatgaatgacattttt

SEQ ID NO: 989795 - DNA, 22 bp, Artificial Sequence
  chemically synthesized
caagaaaaatgtcattcatctt

SEQ ID NO: 989796 - DNA, 22 bp, Artificial Sequence
  chemically synthesized
aagaaaaatgtcattcatcttt

SEQ ID NO: 989797 - DNA, 22 bp, Artificial Sequence
  chemically synthesized
agcagatcaatttaagaaagat

SEQ ID NO: 989798 - DNA, 22 bp, Artificial Sequence
  chemically synthesized
gactcagcagatcaatttaaga

SEQ ID NO: 989799 - DNA, 22 bp, Artificial Sequence
  chemically synthesized
ctggactcagcagatcaattta

SEQ ID NO: 989800 - DNA, 22 bp, Artificial Sequence
  chemically synthesized
tgctggactcagcagatcaatt

SEQ ID NO: 989801 - DNA, 22 bp, Artificial Sequence
  chemically synthesized
ctgctggactcagcagatcaat

SEQ ID NO: 989802 - DNA, 22 bp, Artificial Sequence
  chemically synthesized
atctttcttaaattgatctgct

SEQ ID NO: 989803 - DNA, 22 bp, Artificial Sequence
  chemically synthesized
tcttaaattgatctgctgagtc

SEQ ID NO: 989804 - DNA, 22 bp, Artificial Sequence
  chemically synthesized
cttaaattgatctgctgagtcc

SEQ ID NO: 989805 - DNA, 22 bp, Artificial Sequence
  chemically synthesized
ttaaattgatctgctgagtcca

SEQ ID NO: 989806 - DNA, 22 bp, Artificial Sequence
  chemically synthesized
gagacatttctgctggactcag

SEQ ID NO: 989807 - DNA, 22 bp, Artificial Sequence
  chemically synthesized
aaattgatctgctgagtccagc

SEQ ID NO: 989808 - DNA, 22 bp, Artificial Sequence
  chemically synthesized
ggagacatttctgctggactca

SEQ ID NO: 989809 - DNA, 22 bp, Artificial Sequence
  chemically synthesized
aattgatctgctgagtccagca

SEQ ID NO: 989810 - DNA, 22 bp, Artificial Sequence
  chemically synthesized
atctgctgagtccagcagaaat

SEQ ID NO: 989811 - DNA, 22 bp, Artificial Sequence
  chemically synthesized
ctgagtccagcagaaatgtctc

SEQ ID NO: 989812 - DNA, 22 bp, Artificial Sequence
  chemically synthesized
agtccagcagaaatgtctccaa

SEQ ID NO: 989813 - DNA, 22 bp, Artificial Sequence
  chemically synthesized
gtcacgagaaaaccttggagac

SEQ ID NO: 989814 - DNA, 22 bp, Artificial Sequence
  chemically synthesized
gctcgtcacgagaaaaccttgg

SEQ ID NO: 989815 - DNA, 22 bp, Artificial Sequence
  chemically synthesized
ggctcgtcacgagaaaaccttg

SEQ ID NO: 989816 - DNA, 22 bp, Artificial Sequence
  chemically synthesized
gccttggctcgtcacgagaaaa

SEQ ID NO: 989817 - DNA, 22 bp, Artificial Sequence
  chemically synthesized
agccttggctcgtcacgagaaa

SEQ ID NO: 989818 - DNA, 22 bp, Artificial Sequence
  chemically synthesized
tagccttggctcgtcacgagaa

SEQ ID NO: 989819 - DNA, 22 bp, Artificial Sequence
  chemically synthesized
caaggttttctcgtgacgagcc

SEQ ID NO: 989820 - DNA, 22 bp, Artificial Sequence
  chemically synthesized
cgtgtatccctttagccttggc

SEQ ID NO: 989821 - DNA, 22 bp, Artificial Sequence
  chemically synthesized
tctcgtgacgagccaaggctaa

SEQ ID NO: 989822 - DNA, 22 bp, Artificial Sequence
  chemically synthesized
ctcgtgacgagccaaggctaaa

SEQ ID NO: 989823 - DNA, 22 bp, Artificial Sequence
  chemically synthesized
tcgtgacgagccaaggctaaag

SEQ ID NO: 989824 - DNA, 22 bp, Artificial Sequence
  chemically synthesized
gctccgtgtatccctttagcct

SEQ ID NO: 989825 - DNA, 22 bp, Artificial Sequence
  chemically synthesized
gtgacgagccaaggctaaaggg

SEQ ID NO: 989826 - DNA, 22 bp, Artificial Sequence
  chemically synthesized
ctggctccgtgtatccctttag

SEQ ID NO: 989827 - DNA, 22 bp, Artificial Sequence
  chemically synthesized
actgctggctccgtgtatccct

SEQ ID NO: 989828 - DNA, 22 bp, Artificial Sequence
  chemically synthesized
taactgctggctccgtgtatcc

SEQ ID NO: 989829 - DNA, 22 bp, Artificial Sequence
  chemically synthesized
gatgcctctaactgctggctcc

SEQ ID NO: 989830 - DNA, 22 bp, Artificial Sequence
  chemically synthesized
aagggatacacggagccagcag

SEQ ID NO: 989831 - DNA, 22 bp, Artificial Sequence
  chemically synthesized
accggtgccccactagatgcct

SEQ ID NO: 989832 - DNA, 22 bp, Artificial Sequence
  chemically synthesized
attaaccggtgccccactagat

SEQ ID NO: 989833 - DNA, 22 bp, Artificial Sequence
  chemically synthesized
gaggcatctagtggggcaccgg

SEQ ID NO: 989834 - DNA, 22 bp, Artificial Sequence
  chemically synthesized
gtggggcaccggttaattaact

SEQ ID NO: 989835 - DNA, 22 bp, Artificial Sequence
  chemically synthesized
aagcatagaagaaaaagttaat

SEQ ID NO: 989836 - DNA, 22 bp, Artificial Sequence
  chemically synthesized
gaagcatagaagaaaaagttaa

SEQ ID NO: 989837 - DNA, 22 bp, Artificial Sequence
  chemically synthesized
aaacttgaagcatagaagaaaa

SEQ ID NO: 989838 - DNA, 22 bp, Artificial Sequence
  chemically synthesized
attaactttttcttctatgctt

SEQ ID NO: 989839 - DNA, 22 bp, Artificial Sequence
  chemically synthesized
actttttcttctatgcttcaag

SEQ ID NO: 989840 - DNA, 22 bp, Artificial Sequence
  chemically synthesized
gtataggcattgaaacttgaag

SEQ ID NO: 989841 - DNA, 22 bp, Artificial Sequence
  chemically synthesized
tttcttctatgcttcaagtttc

SEQ ID NO: 989842 - DNA, 22 bp, Artificial Sequence
  chemically synthesized
ttcttctatgcttcaagtttca

SEQ ID NO: 989843 - DNA, 22 bp, Artificial Sequence
  chemically synthesized
tcttctatgcttcaagtttcaa

SEQ ID NO: 989844 - DNA, 22 bp, Artificial Sequence
  chemically synthesized
cttctatgcttcaagtttcaat

SEQ ID NO: 989845 - DNA, 22 bp, Artificial Sequence
  chemically synthesized
ttctatgcttcaagtttcaatg

SEQ ID NO: 989846 - DNA, 22 bp, Artificial Sequence
  chemically synthesized
ctatgcttcaagtttcaatgcc

SEQ ID NO: 989847 - DNA, 22 bp, Artificial Sequence
  chemically synthesized
tatgcttcaagtttcaatgcct

SEQ ID NO: 989848 - DNA, 22 bp, Artificial Sequence
  chemically synthesized
tgcttcaagtttcaatgcctat

SEQ ID NO: 989849 - DNA, 22 bp, Artificial Sequence
  chemically synthesized
caagtttcaatgcctataccaa

SEQ ID NO: 989850 - DNA, 22 bp, Artificial Sequence
  chemically synthesized
aagtttcaatgcctataccaat

SEQ ID NO: 989851 - DNA, 22 bp, Artificial Sequence
  chemically synthesized
tgcaaagaacaaaaggtattgg

SEQ ID NO: 989852 - DNA, 22 bp, Artificial Sequence
  chemically synthesized
caatgcctataccaataccttt

SEQ ID NO: 989853 - DNA, 22 bp, Artificial Sequence
  chemically synthesized
aatgcctataccaatacctttt

SEQ ID NO: 989854 - DNA, 22 bp, Artificial Sequence
  chemically synthesized
taccaataccttttgttctttg

SEQ ID NO: 989855 - DNA, 22 bp, Artificial Sequence
  chemically synthesized
ggtgcataatatcctatgcaaa

SEQ ID NO: 989856 - DNA, 22 bp, Artificial Sequence
  chemically synthesized
cggtgcataatatcctatgcaa

SEQ ID NO: 989857 - DNA, 22 bp, Artificial Sequence
  chemically synthesized
tcggtgcataatatcctatgca

SEQ ID NO: 989858 - DNA, 22 bp, Artificial Sequence
  chemically synthesized
ttgttctttgcataggatatta

SEQ ID NO: 989859 - DNA, 22 bp, Artificial Sequence
  chemically synthesized
attttcggtgcataatatccta

SEQ ID NO: 989860 - DNA, 22 bp, Artificial Sequence
  chemically synthesized
tgttctttgcataggatattat

SEQ ID NO: 989861 - DNA, 22 bp, Artificial Sequence
  chemically synthesized
cattttcggtgcataatatcct

SEQ ID NO: 989862 - DNA, 22 bp, Artificial Sequence
  chemically synthesized
gttctttgcataggatattatg

SEQ ID NO: 989863 - DNA, 22 bp, Artificial Sequence
  chemically synthesized
ttctttgcataggatattatgc

SEQ ID NO: 989864 - DNA, 22 bp, Artificial Sequence
  chemically synthesized
tttcattttcggtgcataatat

SEQ ID NO: 989865 - DNA, 22 bp, Artificial Sequence
  chemically synthesized
tttgcataggatattatgcacc

SEQ ID NO: 989866 - DNA, 22 bp, Artificial Sequence
  chemically synthesized
tgcataggatattatgcaccga

SEQ ID NO: 989867 - DNA, 22 bp, Artificial Sequence
  chemically synthesized
gcataggatattatgcaccgaa

SEQ ID NO: 989868 - DNA, 22 bp, Artificial Sequence
  chemically synthesized
cataggatattatgcaccgaaa

SEQ ID NO: 989869 - DNA, 22 bp, Artificial Sequence
  chemically synthesized
tgagtattgtttcattttcggt

SEQ ID NO: 989870 - DNA, 22 bp, Artificial Sequence
  chemically synthesized
atgagtattgtttcattttcgg

SEQ ID NO: 989871 - DNA, 22 bp, Artificial Sequence
  chemically synthesized
tatgagtattgtttcattttcg

SEQ ID NO: 989872 - DNA, 22 bp, Artificial Sequence
  chemically synthesized
ttatgagtattgtttcattttc

SEQ ID NO: 989873 - DNA, 22 bp, Artificial Sequence
  chemically synthesized
tttttatgagtattgtttcatt

SEQ ID NO: 989874 - DNA, 22 bp, Artificial Sequence
  chemically synthesized
tgcaccgaaaatgaaacaatac

SEQ ID NO: 989875 - DNA, 22 bp, Artificial Sequence
  chemically synthesized
gctgtttttatgagtattgttt

SEQ ID NO: 989876 - DNA, 22 bp, Artificial Sequence
  chemically synthesized
aatattagctgtttttatgagt

SEQ ID NO: 989877 - DNA, 22 bp, Artificial Sequence
  chemically synthesized
attaaatattagctgtttttat

SEQ ID NO: 989878 - DNA, 22 bp, Artificial Sequence
  chemically synthesized
atgctcattaaatattagctgt

SEQ ID NO: 989879 - DNA, 22 bp, Artificial Sequence
  chemically synthesized
ctcatgctcattaaatattagc

SEQ ID NO: 989880 - DNA, 22 bp, Artificial Sequence
  chemically synthesized
ataaaaacagctaatatttaat

SEQ ID NO: 989881 - DNA, 22 bp, Artificial Sequence
  chemically synthesized
gcaattactcatgctcattaaa

SEQ ID NO: 989882 - DNA, 22 bp, Artificial Sequence
  chemically synthesized
atatttaatgagcatgagtaat

SEQ ID NO: 989883 - DNA, 22 bp, Artificial Sequence
  chemically synthesized
agaatcacaattggcaattact

SEQ ID NO: 989884 - DNA, 22 bp, Artificial Sequence
  chemically synthesized
aatgagcatgagtaattgccaa

SEQ ID NO: 989885 - DNA, 22 bp, Artificial Sequence
  chemically synthesized
atgagcatgagtaattgccaat

SEQ ID NO: 989886 - DNA, 22 bp, Artificial Sequence
  chemically synthesized
ccaattgtgattctcaacactt

SEQ ID NO: 989887 - DNA, 22 bp, Artificial Sequence
  chemically synthesized
tgattctcaacacttggcatat

SEQ ID NO: 989888 - DNA, 22 bp, Artificial Sequence
  chemically synthesized
aaaacgaatgaaatgatatatg

SEQ ID NO: 989889 - DNA, 22 bp, Artificial Sequence
  chemically synthesized
tcaacacttggcatatatcatt

SEQ ID NO: 989890 - DNA, 22 bp, Artificial Sequence
  chemically synthesized
aaaaacgaatgaaatgatatat

SEQ ID NO: 989891 - DNA, 22 bp, Artificial Sequence
  chemically synthesized
aacacttggcatatatcatttc

SEQ ID NO: 989892 - DNA, 22 bp, Artificial Sequence
  chemically synthesized
ggcatatatcatttcattcgtt

SEQ ID NO: 989893 - DNA, 22 bp, Artificial Sequence
  chemically synthesized
gcatatatcatttcattcgttt

SEQ ID NO: 989894 - DNA, 22 bp, Artificial Sequence
  chemically synthesized
atagagtagacttaaaaacgaa

SEQ ID NO: 989895 - DNA, 22 bp, Artificial Sequence
  chemically synthesized
tctcatagagtagacttaaaaa

SEQ ID NO: 989896 - DNA, 22 bp, Artificial Sequence
  chemically synthesized
atctcatagagtagacttaaaa

SEQ ID NO: 989897 - DNA, 22 bp, Artificial Sequence
  chemically synthesized
cttatctcatagagtagactta

SEQ ID NO: 989898 - DNA, 22 bp, Artificial Sequence
  chemically synthesized
cattcgtttttaagtctactct

SEQ ID NO: 989899 - DNA, 22 bp, Artificial Sequence
  chemically synthesized
attcgtttttaagtctactcta

SEQ ID NO: 989900 - DNA, 22 bp, Artificial Sequence
  chemically synthesized
gtttttaagtctactctatgag

SEQ ID NO: 989901 - DNA, 22 bp, Artificial Sequence
  chemically synthesized
ttaagtctactctatgagataa

SEQ ID NO: 989902 - DNA, 22 bp, Artificial Sequence
  chemically synthesized
taagtctactctatgagataag

SEQ ID NO: 989903 - DNA, 22 bp, Artificial Sequence
  chemically synthesized
aagtctactctatgagataagt

SEQ ID NO: 989904 - DNA, 22 bp, Artificial Sequence
  chemically synthesized
agtctactctatgagataagta

SEQ ID NO: 989905 - DNA, 22 bp, Artificial Sequence
  chemically synthesized
ctctatgagataagtagcatta

SEQ ID NO: 989906 - DNA, 22 bp, Artificial Sequence
  chemically synthesized
taaaatcagcacaataatgcta

SEQ ID NO: 989907 - DNA, 22 bp, Artificial Sequence
  chemically synthesized
tatgagataagtagcattattg

SEQ ID NO: 989908 - DNA, 22 bp, Artificial Sequence
  chemically synthesized
tgagataagtagcattattgtg

SEQ ID NO: 989909 - DNA, 22 bp, Artificial Sequence
  chemically synthesized
catctgtaaaatcagcacaata

SEQ ID NO: 989910 - DNA, 22 bp, Artificial Sequence
  chemically synthesized
gcatctgtaaaatcagcacaat

SEQ ID NO: 989911 - DNA, 22 bp, Artificial Sequence
  chemically synthesized
tgcatctgtaaaatcagcacaa

SEQ ID NO: 989912 - DNA, 22 bp, Artificial Sequence
  chemically synthesized
ggccacagttttgcatctgtaa

SEQ ID NO: 989913 - DNA, 22 bp, Artificial Sequence
  chemically synthesized
ttgtgctgattttacagatgca

SEQ ID NO: 989914 - DNA, 22 bp, Artificial Sequence
  chemically synthesized
tgggccacagttttgcatctgt

SEQ ID NO: 989915 - DNA, 22 bp, Artificial Sequence
  chemically synthesized
tgctgattttacagatgcaaaa

SEQ ID NO: 989916 - DNA, 22 bp, Artificial Sequence
  chemically synthesized
tctgggccacagttttgcatct

SEQ ID NO: 989917 - DNA, 22 bp, Artificial Sequence
  chemically synthesized
attttacagatgcaaaactgtg

SEQ ID NO: 989918 - DNA, 22 bp, Artificial Sequence
  chemically synthesized
acctctctgggccacagttttg

SEQ ID NO: 989919 - DNA, 22 bp, Artificial Sequence
  chemically synthesized
ttgacctctctgggccacagtt

SEQ ID NO: 989920 - DNA, 22 bp, Artificial Sequence
  chemically synthesized
tacagatgcaaaactgtggccc

SEQ ID NO: 989921 - DNA, 22 bp, Artificial Sequence
  chemically synthesized
acagatgcaaaactgtggccca

SEQ ID NO: 989922 - DNA, 22 bp, Artificial Sequence
  chemically synthesized
tattgacctctctgggccacag

SEQ ID NO: 989923 - DNA, 22 bp, Artificial Sequence
  chemically synthesized
cagatgcaaaactgtggcccag

SEQ ID NO: 989924 - DNA, 22 bp, Artificial Sequence
  chemically synthesized
aaattctattgacctctctggg

SEQ ID NO: 989925 - DNA, 22 bp, Artificial Sequence
  chemically synthesized
tacacctgaaattctattgacc

SEQ ID NO: 989926 - DNA, 22 bp, Artificial Sequence
  chemically synthesized
tggcccagagaggtcaatagaa

SEQ ID NO: 989927 - DNA, 22 bp, Artificial Sequence
  chemically synthesized
tatctgtacacctgaaattcta

SEQ ID NO: 989928 - DNA, 22 bp, Artificial Sequence
  chemically synthesized
atatctgtacacctgaaattct

SEQ ID NO: 989929 - DNA, 22 bp, Artificial Sequence
  chemically synthesized
tatatctgtacacctgaaattc

SEQ ID NO: 989930 - DNA, 22 bp, Artificial Sequence
  chemically synthesized
atgaatattttatatctgtaca

SEQ ID NO: 989931 - DNA, 22 bp, Artificial Sequence
  chemically synthesized
tggttcatgaatattttatatc

SEQ ID NO: 989932 - DNA, 22 bp, Artificial Sequence
  chemically synthesized
caggtgtacagatataaaatat

SEQ ID NO: 989933 - DNA, 22 bp, Artificial Sequence
  chemically synthesized
aggtgtacagatataaaatatt

SEQ ID NO: 989934 - DNA, 22 bp, Artificial Sequence
  chemically synthesized
ggatattatggttcatgaatat

SEQ ID NO: 989935 - DNA, 22 bp, Artificial Sequence
  chemically synthesized
taccatagttaggatattatgg

SEQ ID NO: 989936 - DNA, 22 bp, Artificial Sequence
  chemically synthesized
ataccatagttaggatattatg

SEQ ID NO: 989937 - DNA, 22 bp, Artificial Sequence
  chemically synthesized
tatttataccatagttaggata

SEQ ID NO: 989938 - DNA, 22 bp, Artificial Sequence
  chemically synthesized
atgaaccataatatcctaacta

SEQ ID NO: 989939 - DNA, 22 bp, Artificial Sequence
  chemically synthesized
tggcatattatatttataccat

SEQ ID NO: 989940 - DNA, 22 bp, Artificial Sequence
  chemically synthesized
atggcatattatatttatacca

SEQ ID NO: 989941 - DNA, 22 bp, Artificial Sequence
  chemically synthesized
tatggcatattatatttatacc

SEQ ID NO: 989942 - DNA, 22 bp, Artificial Sequence
  chemically synthesized
ttttatggcatattatatttat

SEQ ID NO: 989943 - DNA, 22 bp, Artificial Sequence
  chemically synthesized
actatggtataaatataatatg

SEQ ID NO: 989944 - DNA, 22 bp, Artificial Sequence
  chemically synthesized
tggtataaatataatatgccat

SEQ ID NO: 989945 - DNA, 22 bp, Artificial Sequence
  chemically synthesized
ccacgtgcctattttatggcat

SEQ ID NO: 989946 - DNA, 22 bp, Artificial Sequence
  chemically synthesized
accacgtgcctattttatggca

SEQ ID NO: 989947 - DNA, 22 bp, Artificial Sequence
  chemically synthesized
gtcagcaaacacttaccacgtg

SEQ ID NO: 989948 - DNA, 22 bp, Artificial Sequence
  chemically synthesized
agtcagcaaacacttaccacgt

SEQ ID NO: 989949 - DNA, 22 bp, Artificial Sequence
  chemically synthesized
tagtcagcaaacacttaccacg

SEQ ID NO: 989950 - DNA, 22 bp, Artificial Sequence
  chemically synthesized
aatctttagtcagcaaacactt

SEQ ID NO: 989951 - DNA, 22 bp, Artificial Sequence
  chemically synthesized
caatctttagtcagcaaacact

SEQ ID NO: 989952 - DNA, 22 bp, Artificial Sequence
  chemically synthesized
ttcaatctttagtcagcaaaca

SEQ ID NO: 989953 - DNA, 22 bp, Artificial Sequence
  chemically synthesized
caacacattcttcaatctttag

SEQ ID NO: 989954 - DNA, 22 bp, Artificial Sequence
  chemically synthesized
cattacaacacattcttcaatc

SEQ ID NO: 989955 - DNA, 22 bp, Artificial Sequence
  chemically synthesized
gctgactaaagattgaagaatg

SEQ ID NO: 989956 - DNA, 22 bp, Artificial Sequence
  chemically synthesized
ctgactaaagattgaagaatgt

SEQ ID NO: 989957 - DNA, 22 bp, Artificial Sequence
  chemically synthesized
actaaagattgaagaatgtgtt

SEQ ID NO: 989958 - DNA, 22 bp, Artificial Sequence
  chemically synthesized
atagactccattacaacacatt

SEQ ID NO: 989959 - DNA, 22 bp, Artificial Sequence
  chemically synthesized
aagattgaagaatgtgttgtaa

SEQ ID NO: 989960 - DNA, 22 bp, Artificial Sequence
  chemically synthesized
attaatagactccattacaaca

SEQ ID NO: 989961 - DNA, 22 bp, Artificial Sequence
  chemically synthesized
aattaatagactccattacaac

SEQ ID NO: 989962 - DNA, 22 bp, Artificial Sequence
  chemically synthesized
taattaatagactccattacaa

SEQ ID NO: 989963 - DNA, 22 bp, Artificial Sequence
  chemically synthesized
aagaatgtgttgtaatggagtc

SEQ ID NO: 989964 - DNA, 22 bp, Artificial Sequence
  chemically synthesized
tctttaattaatagactccatt

SEQ ID NO: 989965 - DNA, 22 bp, Artificial Sequence
  chemically synthesized
cctgtctttaattaatagactc

SEQ ID NO: 989966 - DNA, 22 bp, Artificial Sequence
  chemically synthesized
taatggagtctattaattaaag

SEQ ID NO: 989967 - DNA, 22 bp, Artificial Sequence
  chemically synthesized
ggtccaaattccctgtctttaa

SEQ ID NO: 989968 - DNA, 22 bp, Artificial Sequence
  chemically synthesized
tgggtccaaattccctgtcttt

SEQ ID NO: 989969 - DNA, 22 bp, Artificial Sequence
  chemically synthesized
ctgggtccaaattccctgtctt

SEQ ID NO: 989970 - DNA, 22 bp, Artificial Sequence
  chemically synthesized
tctgggtccaaattccctgtct

SEQ ID NO: 989971 - DNA, 22 bp, Artificial Sequence
  chemically synthesized
ttaattaaagacagggaatttg

SEQ ID NO: 989972 - DNA, 22 bp, Artificial Sequence
  chemically synthesized
attaaagacagggaatttggac

SEQ ID NO: 989973 - DNA, 22 bp, Artificial Sequence
  chemically synthesized
aagacagggaatttggacccag

SEQ ID NO: 989974 - DNA, 22 bp, Artificial Sequence
  chemically synthesized
ggacccagaaagatttggcttg

SEQ ID NO: 989975 - DNA, 22 bp, Artificial Sequence
  chemically synthesized
gacccagaaagatttggcttgg

SEQ ID NO: 989976 - DNA, 22 bp, Artificial Sequence
  chemically synthesized
gtagatggccaatataagacca

SEQ ID NO: 989977 - DNA, 22 bp, Artificial Sequence
  chemically synthesized
agtagatggccaatataagacc

SEQ ID NO: 989978 - DNA, 22 bp, Artificial Sequence
  chemically synthesized
tcttagtagatggccaatataa

SEQ ID NO: 989979 - DNA, 22 bp, Artificial Sequence
  chemically synthesized
ggcttggtcttatattggccat

SEQ ID NO: 989980 - DNA, 22 bp, Artificial Sequence
  chemically synthesized
gcttggtcttatattggccatc

SEQ ID NO: 989981 - DNA, 22 bp, Artificial Sequence
  chemically synthesized
caaactgtcttagtagatggcc

SEQ ID NO: 989982 - DNA, 22 bp, Artificial Sequence
  chemically synthesized
ggtcttatattggccatctact

SEQ ID NO: 989983 - DNA, 22 bp, Artificial Sequence
  chemically synthesized
ccaaactgtcttagtagatggc

SEQ ID NO: 989984 - DNA, 22 bp, Artificial Sequence
  chemically synthesized
gtcttatattggccatctacta

SEQ ID NO: 989985 - DNA, 22 bp, Artificial Sequence
  chemically synthesized
atattggccatctactaagaca

SEQ ID NO: 989986 - DNA, 22 bp, Artificial Sequence
  chemically synthesized
tattggccatctactaagacag

SEQ ID NO: 989987 - DNA, 22 bp, Artificial Sequence
  chemically synthesized
ataaagtttccaaactgtctta

SEQ ID NO: 989988 - DNA, 22 bp, Artificial Sequence
  chemically synthesized
gccatctactaagacagtttgg

SEQ ID NO: 989989 - DNA, 22 bp, Artificial Sequence
  chemically synthesized
ttgataaagtttccaaactgtc

SEQ ID NO: 989990 - DNA, 22 bp, Artificial Sequence
  chemically synthesized
attgataaagtttccaaactgt

SEQ ID NO: 989991 - DNA, 22 bp, Artificial Sequence
  chemically synthesized
tattgataaagtttccaaactg

SEQ ID NO: 989992 - DNA, 22 bp, Artificial Sequence
  chemically synthesized
ctaagacagtttggaaacttta

SEQ ID NO: 989993 - DNA, 22 bp, Artificial Sequence
  chemically synthesized
agacagtttggaaactttatca

SEQ ID NO: 989994 - DNA, 22 bp, Artificial Sequence
  chemically synthesized
aaatagaaactttattgataaa

SEQ ID NO: 989995 - DNA, 22 bp, Artificial Sequence
  chemically synthesized
taaaatagaaactttattgata

SEQ ID NO: 989996 - DNA, 22 bp, Artificial Sequence
  chemically synthesized
tctaaaatagaaactttattga

SEQ ID NO: 989997 - DNA, 22 bp, Artificial Sequence
  chemically synthesized
ggaaactttatcaataaagttt

SEQ ID NO: 989998 - DNA, 22 bp, Artificial Sequence
  chemically synthesized
gaaactttatcaataaagtttc

SEQ ID NO: 989999 - DNA, 22 bp, Artificial Sequence
  chemically synthesized
agatattctctaaaatagaaac

SEQ ID NO: 990000 - DNA, 22 bp, Artificial Sequence
  chemically synthesized
tatcaataaagtttctatttta

SEQ ID NO: 990001 - DNA, 22 bp, Artificial Sequence
  chemically synthesized
atcaataaagtttctattttag

SEQ ID NO: 990002 - DNA, 22 bp, Artificial Sequence
  chemically synthesized
tcaataaagtttctattttaga

SEQ ID NO: 990003 - DNA, 22 bp, Artificial Sequence
  chemically synthesized
gggaacccaaactaagatattc

SEQ ID NO: 990004 - DNA, 22 bp, Artificial Sequence
  chemically synthesized
agggaacccaaactaagatatt

SEQ ID NO: 990005 - DNA, 22 bp, Artificial Sequence
  chemically synthesized
ctattttagagaatatcttagt

SEQ ID NO: 990006 - DNA, 22 bp, Artificial Sequence
  chemically synthesized
tattttagagaatatcttagtt

SEQ ID NO: 990007 - DNA, 22 bp, Artificial Sequence
  chemically synthesized
ttttagagaatatcttagtttg

SEQ ID NO: 990008 - DNA, 22 bp, Artificial Sequence
  chemically synthesized
catttagggaacccaaactaag

SEQ ID NO: 990009 - DNA, 22 bp, Artificial Sequence
  chemically synthesized
tagagaatatcttagtttgggt

SEQ ID NO: 990010 - DNA, 22 bp, Artificial Sequence
  chemically synthesized
agagaatatcttagtttgggtt

SEQ ID NO: 990011 - DNA, 22 bp, Artificial Sequence
  chemically synthesized
gagaatatcttagtttgggttc

SEQ ID NO: 990012 - DNA, 22 bp, Artificial Sequence
  chemically synthesized
agaacctccatttagggaaccc

SEQ ID NO: 990013 - DNA, 22 bp, Artificial Sequence
  chemically synthesized
atctcagaacctccatttaggg

SEQ ID NO: 990014 - DNA, 22 bp, Artificial Sequence
  chemically synthesized
catctcagaacctccatttagg

SEQ ID NO: 990015 - DNA, 22 bp, Artificial Sequence
  chemically synthesized
agtttgggttccctaaatggag

SEQ ID NO: 990016 - DNA, 22 bp, Artificial Sequence
  chemically synthesized
gtttgggttccctaaatggagg

SEQ ID NO: 990017 - DNA, 22 bp, Artificial Sequence
  chemically synthesized
gggttccctaaatggaggttct

SEQ ID NO: 990018 - DNA, 22 bp, Artificial Sequence
  chemically synthesized
ggttccctaaatggaggttctg

SEQ ID NO: 990019 - DNA, 22 bp, Artificial Sequence
  chemically synthesized
catgaagcttcatctcagaacc

SEQ ID NO: 990020 - DNA, 22 bp, Artificial Sequence
  chemically synthesized
gcatgaagcttcatctcagaac

SEQ ID NO: 990021 - DNA, 22 bp, Artificial Sequence
  chemically synthesized
cctaaatggaggttctgagatg

SEQ ID NO: 990022 - DNA, 22 bp, Artificial Sequence
  chemically synthesized
tgcatgaagcttcatctcagaa

SEQ ID NO: 990023 - DNA, 22 bp, Artificial Sequence
  chemically synthesized
ttgcatgaagcttcatctcaga

SEQ ID NO: 990024 - DNA, 22 bp, Artificial Sequence
  chemically synthesized
aatggaggttctgagatgaagc

SEQ ID NO: 990025 - DNA, 22 bp, Artificial Sequence
  chemically synthesized
gatcatttttgcatgaagcttc

SEQ ID NO: 990026 - DNA, 22 bp, Artificial Sequence
  chemically synthesized
tgagatgaagcttcatgcaaaa

SEQ ID NO: 990027 - DNA, 22 bp, Artificial Sequence
  chemically synthesized
agatgaagcttcatgcaaaaat

SEQ ID NO: 990028 - DNA, 22 bp, Artificial Sequence
  chemically synthesized
aaaacacatcccattagatcat

SEQ ID NO: 990029 - DNA, 22 bp, Artificial Sequence
  chemically synthesized
gaaaacacatcccattagatca

SEQ ID NO: 990030 - DNA, 22 bp, Artificial Sequence
  chemically synthesized
catgcaaaaatgatctaatggg

SEQ ID NO: 990031 - DNA, 22 bp, Artificial Sequence
  chemically synthesized
ttgaaaacacatcccattagat

SEQ ID NO: 990032 - DNA, 22 bp, Artificial Sequence
  chemically synthesized
atgcaaaaatgatctaatggga

SEQ ID NO: 990033 - DNA, 22 bp, Artificial Sequence
  chemically synthesized
cttgaaaacacatcccattaga

SEQ ID NO: 990034 - DNA, 22 bp, Artificial Sequence
  chemically synthesized
ccagtgtttcttgaaaacacat

SEQ ID NO: 990035 - DNA, 22 bp, Artificial Sequence
  chemically synthesized
accagtgtttcttgaaaacaca

SEQ ID NO: 990036 - DNA, 22 bp, Artificial Sequence
  chemically synthesized
ccttaccagtgtttcttgaaaa

SEQ ID NO: 990037 - DNA, 22 bp, Artificial Sequence
  chemically synthesized
cccttaccagtgtttcttgaaa

SEQ ID NO: 990038 - DNA, 22 bp, Artificial Sequence
  chemically synthesized
atgggatgtgttttcaagaaac

SEQ ID NO: 990039 - DNA, 22 bp, Artificial Sequence
  chemically synthesized
tcccttaccagtgtttcttgaa

SEQ ID NO: 990040 - DNA, 22 bp, Artificial Sequence
  chemically synthesized
attttcccttaccagtgtttct

SEQ ID NO: 990041 - DNA, 22 bp, Artificial Sequence
  chemically synthesized
cattttcccttaccagtgtttc

SEQ ID NO: 990042 - DNA, 22 bp, Artificial Sequence
  chemically synthesized
acttcattttcccttaccagtg

SEQ ID NO: 990043 - DNA, 22 bp, Artificial Sequence
  chemically synthesized
tcaagaaacactggtaagggaa

SEQ ID NO: 990044 - DNA, 22 bp, Artificial Sequence
  chemically synthesized
caagaaacactggtaagggaaa

SEQ ID NO: 990045 - DNA, 22 bp, Artificial Sequence
  chemically synthesized
aagaaacactggtaagggaaaa

SEQ ID NO: 990046 - DNA, 22 bp, Artificial Sequence
  chemically synthesized
ccaatctcacttcattttccct

SEQ ID NO: 990047 - DNA, 22 bp, Artificial Sequence
  chemically synthesized
cccaatctcacttcattttccc

SEQ ID NO: 990048 - DNA, 22 bp, Artificial Sequence
  chemically synthesized
ccttcccaatctcacttcattt

SEQ ID NO: 990049 - DNA, 22 bp, Artificial Sequence
  chemically synthesized
cccttcccaatctcacttcatt

SEQ ID NO: 990050 - DNA, 22 bp, Artificial Sequence
  chemically synthesized
gtaagggaaaatgaagtgagat

SEQ ID NO: 990051 - DNA, 22 bp, Artificial Sequence
  chemically synthesized
tttcccttcccaatctcacttc

SEQ ID NO: 990052 - DNA, 22 bp, Artificial Sequence
  chemically synthesized
gtctgtttcccttcccaatctc

SEQ ID NO: 990053 - DNA, 22 bp, Artificial Sequence
  chemically synthesized
ggtctgtttcccttcccaatct

SEQ ID NO: 990054 - DNA, 22 bp, Artificial Sequence
  chemically synthesized
tgccatatatgtgtttggtctg

SEQ ID NO: 990055 - DNA, 22 bp, Artificial Sequence
  chemically synthesized
atgccatatatgtgtttggtct

SEQ ID NO: 990056 - DNA, 22 bp, Artificial Sequence
  chemically synthesized
ggaagggaaacagaccaaacac

SEQ ID NO: 990057 - DNA, 22 bp, Artificial Sequence
  chemically synthesized
tatgccatatatgtgtttggtc

SEQ ID NO: 990058 - DNA, 22 bp, Artificial Sequence
  chemically synthesized
ttatgccatatatgtgtttggt

SEQ ID NO: 990059 - DNA, 22 bp, Artificial Sequence
  chemically synthesized
ggcttttatgccatatatgtgt

SEQ ID NO: 990060 - DNA, 22 bp, Artificial Sequence
  chemically synthesized
ccaccctgggcttttatgccat

SEQ ID NO: 990061 - DNA, 22 bp, Artificial Sequence
  chemically synthesized
agaagtgtgaatggcactgcca

SEQ ID NO: 990062 - DNA, 22 bp, Artificial Sequence
  chemically synthesized
agaaattcagaagtgtgaatgg

SEQ ID NO: 990063 - DNA, 22 bp, Artificial Sequence
  chemically synthesized
ccaactgagaaattcagaagtg

SEQ ID NO: 990064 - DNA, 22 bp, Artificial Sequence
  chemically synthesized
ttcccaactgagaaattcagaa

SEQ ID NO: 990065 - DNA, 22 bp, Artificial Sequence
  chemically synthesized
gttcccaactgagaaattcaga

SEQ ID NO: 990066 - DNA, 22 bp, Artificial Sequence
  chemically synthesized
ttgttcccaactgagaaattca

SEQ ID NO: 990067 - DNA, 22 bp, Artificial Sequence
  chemically synthesized
cttgttcccaactgagaaattc

SEQ ID NO: 990068 - DNA, 22 bp, Artificial Sequence
  chemically synthesized
tcttgttcccaactgagaaatt

SEQ ID NO: 990069 - DNA, 22 bp, Artificial Sequence
  chemically synthesized
acacttctgaatttctcagttg

SEQ ID NO: 990070 - DNA, 22 bp, Artificial Sequence
  chemically synthesized
ctgaatttctcagttgggaaca

SEQ ID NO: 990071 - DNA, 22 bp, Artificial Sequence
  chemically synthesized
tgaatttctcagttgggaacaa

SEQ ID NO: 990072 - DNA, 22 bp, Artificial Sequence
  chemically synthesized
aatttctcagttgggaacaaga

SEQ ID NO: 990073 - DNA, 22 bp, Artificial Sequence
  chemically synthesized
ctcagttgggaacaagaaagct

SEQ ID NO: 990074 - DNA, 22 bp, Artificial Sequence
  chemically synthesized
tcagttgggaacaagaaagctc

SEQ ID NO: 990075 - DNA, 22 bp, Artificial Sequence
  chemically synthesized
agttgggaacaagaaagctcac

SEQ ID NO: 990076 - DNA, 22 bp, Artificial Sequence
  chemically synthesized
cagacacataaatacgtgagct

SEQ ID NO: 990077 - DNA, 22 bp, Artificial Sequence
  chemically synthesized
ggaacaagaaagctcacgtatt

SEQ ID NO: 990078 - DNA, 22 bp, Artificial Sequence
  chemically synthesized
gttgcagacacataaatacgtg

SEQ ID NO: 990079 - DNA, 22 bp, Artificial Sequence
  chemically synthesized
ctggttgcagacacataaatac

SEQ ID NO: 990080 - DNA, 22 bp, Artificial Sequence
  chemically synthesized
acgtatttatgtgtctgcaacc

SEQ ID NO: 990081 - DNA, 22 bp, Artificial Sequence
  chemically synthesized
atcaatgactgctggttgcaga

SEQ ID NO: 990082 - DNA, 22 bp, Artificial Sequence
  chemically synthesized
aatcaatgactgctggttgcag

SEQ ID NO: 990083 - DNA, 22 bp, Artificial Sequence
  chemically synthesized
atgtgtctgcaaccagcagtca

SEQ ID NO: 990084 - DNA, 22 bp, Artificial Sequence
  chemically synthesized
tgtgtctgcaaccagcagtcat

SEQ ID NO: 990085 - DNA, 22 bp, Artificial Sequence
  chemically synthesized
caaccagcagtcattgattaag

SEQ ID NO: 990086 - DNA, 22 bp, Artificial Sequence
  chemically synthesized
tgtgtgggaagcccttaatcaa

SEQ ID NO: 990087 - DNA, 22 bp, Artificial Sequence
  chemically synthesized
tgtccctgtgtgtgggaagccc

SEQ ID NO: 990088 - DNA, 22 bp, Artificial Sequence
  chemically synthesized
atgtccctgtgtgtgggaagcc

SEQ ID NO: 990089 - DNA, 22 bp, Artificial Sequence
  chemically synthesized
attaagggcttcccacacacag

SEQ ID NO: 990090 - DNA, 22 bp, Artificial Sequence
  chemically synthesized
gaatttatgtccctgtgtgtgg

SEQ ID NO: 990091 - DNA, 22 bp, Artificial Sequence
  chemically synthesized
agggcttcccacacacagggac

SEQ ID NO: 990092 - DNA, 22 bp, Artificial Sequence
  chemically synthesized
tcctggaatttatgtccctgtg

SEQ ID NO: 990093 - DNA, 22 bp, Artificial Sequence
  chemically synthesized
cccacacacagggacataaatt

SEQ ID NO: 990094 - DNA, 22 bp, Artificial Sequence
  chemically synthesized
ccacacacagggacataaattc

SEQ ID NO: 990095 - DNA, 22 bp, Artificial Sequence
  chemically synthesized
tgtaaagagagagatggatcta

SEQ ID NO: 990096 - DNA, 22 bp, Artificial Sequence
  chemically synthesized
gtctgtgtaaagagagagatgg

SEQ ID NO: 990097 - DNA, 22 bp, Artificial Sequence
  chemically synthesized
ggtctgtgtaaagagagagatg

SEQ ID NO: 990098 - DNA, 22 bp, Artificial Sequence
  chemically synthesized
caggatagatccatctctctct

SEQ ID NO: 990099 - DNA, 22 bp, Artificial Sequence
  chemically synthesized
tttggtctgtgtaaagagagag

SEQ ID NO: 990100 - DNA, 22 bp, Artificial Sequence
  chemically synthesized
ccagagcctatttggtctgtgt

SEQ ID NO: 990101 - DNA, 22 bp, Artificial Sequence
  chemically synthesized
tctctttacacagaccaaatag

SEQ ID NO: 990102 - DNA, 22 bp, Artificial Sequence
  chemically synthesized
aggctgccagagcctatttggt

SEQ ID NO: 990103 - DNA, 22 bp, Artificial Sequence
  chemically synthesized
tctttacacagaccaaataggc

SEQ ID NO: 990104 - DNA, 22 bp, Artificial Sequence
  chemically synthesized
gaggctgccagagcctatttgg

SEQ ID NO: 990105 - DNA, 22 bp, Artificial Sequence
  chemically synthesized
tttacacagaccaaataggctc

SEQ ID NO: 990106 - DNA, 22 bp, Artificial Sequence
  chemically synthesized
tacacagaccaaataggctctg

SEQ ID NO: 990107 - DNA, 22 bp, Artificial Sequence
  chemically synthesized
acacagaccaaataggctctgg

SEQ ID NO: 990108 - DNA, 22 bp, Artificial Sequence
  chemically synthesized
cacagaccaaataggctctggc

SEQ ID NO: 990109 - DNA, 22 bp, Artificial Sequence
  chemically synthesized
gagggtggccttgaggctgcca

SEQ ID NO: 990110 - DNA, 22 bp, Artificial Sequence
  chemically synthesized
ttggagggtggccttgaggctg

SEQ ID NO: 990111 - DNA, 22 bp, Artificial Sequence
  chemically synthesized
tgttggagggtggccttgaggc

SEQ ID NO: 990112 - DNA, 22 bp, Artificial Sequence
  chemically synthesized
tggcagcctcaaggccaccctc

SEQ ID NO: 990113 - DNA, 22 bp, Artificial Sequence
  chemically synthesized
atcgctctgttggagggtggcc

SEQ ID NO: 990114 - DNA, 22 bp, Artificial Sequence
  chemically synthesized
gcagcctcaaggccaccctcca

SEQ ID NO: 990115 - DNA, 22 bp, Artificial Sequence
  chemically synthesized
cctaatcgctctgttggagggt

SEQ ID NO: 990116 - DNA, 22 bp, Artificial Sequence
  chemically synthesized
gctccctaatcgctctgttgga

SEQ ID NO: 990117 - DNA, 22 bp, Artificial Sequence
  chemically synthesized
aaggccaccctccaacagagcg

SEQ ID NO: 990118 - DNA, 22 bp, Artificial Sequence
  chemically synthesized
ccaacaactagctccctaatcg

SEQ ID NO: 990119 - DNA, 22 bp, Artificial Sequence
  chemically synthesized
ctcccaacaactagctccctaa

SEQ ID NO: 990120 - DNA, 22 bp, Artificial Sequence
  chemically synthesized
caacagagcgattagggagcta

SEQ ID NO: 990121 - DNA, 22 bp, Artificial Sequence
  chemically synthesized
actcccaacaactagctcccta

SEQ ID NO: 990122 - DNA, 22 bp, Artificial Sequence
  chemically synthesized
tactcccaacaactagctccct

SEQ ID NO: 990123 - DNA, 22 bp, Artificial Sequence
  chemically synthesized
ttactcccaacaactagctccc

SEQ ID NO: 990124 - DNA, 22 bp, Artificial Sequence
  chemically synthesized
tgcttttactcccaacaactag

SEQ ID NO: 990125 - DNA, 22 bp, Artificial Sequence
  chemically synthesized
ctgtgcttttactcccaacaac

SEQ ID NO: 990126 - DNA, 22 bp, Artificial Sequence
  chemically synthesized
gggagctagttgttgggagtaa

SEQ ID NO: 990127 - DNA, 22 bp, Artificial Sequence
  chemically synthesized
cctgctgtgcttttactcccaa

SEQ ID NO: 990128 - DNA, 22 bp, Artificial Sequence
  chemically synthesized
ccctgctgtgcttttactccca

SEQ ID NO: 990129 - DNA, 22 bp, Artificial Sequence
  chemically synthesized
tccctgctgtgcttttactccc

SEQ ID NO: 990130 - DNA, 22 bp, Artificial Sequence
  chemically synthesized
gttgttgggagtaaaagcacag

SEQ ID NO: 990131 - DNA, 22 bp, Artificial Sequence
  chemically synthesized
acattttccctgctgtgctttt

SEQ ID NO: 990132 - DNA, 22 bp, Artificial Sequence
  chemically synthesized
aacattttccctgctgtgcttt

SEQ ID NO: 990133 - DNA, 22 bp, Artificial Sequence
  chemically synthesized
ttgggagtaaaagcacagcagg

SEQ ID NO: 990134 - DNA, 22 bp, Artificial Sequence
  chemically synthesized
ggagtaaaagcacagcagggaa

SEQ ID NO: 990135 - DNA, 22 bp, Artificial Sequence
  chemically synthesized
acatccgtttaacattttccct

SEQ ID NO: 990136 - DNA, 22 bp, Artificial Sequence
  chemically synthesized
cacatccgtttaacattttccc

SEQ ID NO: 990137 - DNA, 22 bp, Artificial Sequence
  chemically synthesized
tcacatccgtttaacattttcc

SEQ ID NO: 990138 - DNA, 22 bp, Artificial Sequence
  chemically synthesized
atatcctttcacatccgtttaa

SEQ ID NO: 990139 - DNA, 22 bp, Artificial Sequence
  chemically synthesized
atccactcatatcctttcacat

SEQ ID NO: 990140 - DNA, 22 bp, Artificial Sequence
  chemically synthesized
tcattgatccactcatatcctt

SEQ ID NO: 990141 - DNA, 22 bp, Artificial Sequence
  chemically synthesized
aacggatgtgaaaggatatgag

SEQ ID NO: 990142 - DNA, 22 bp, Artificial Sequence
  chemically synthesized
tagagatgctgtcattgatcca

SEQ ID NO: 990143 - DNA, 22 bp, Artificial Sequence
  chemically synthesized
tgtagagatgctgtcattgatc

SEQ ID NO: 990144 - DNA, 22 bp, Artificial Sequence
  chemically synthesized
tctgtagagatgctgtcattga

SEQ ID NO: 990145 - DNA, 22 bp, Artificial Sequence
  chemically synthesized
aatgaagaaacaagttctctgt

SEQ ID NO: 990146 - DNA, 22 bp, Artificial Sequence
  chemically synthesized
ctgaatgaagaaacaagttctc

SEQ ID NO: 990147 - DNA, 22 bp, Artificial Sequence
  chemically synthesized
ttcctgaatgaagaaacaagtt

SEQ ID NO: 990148 - DNA, 22 bp, Artificial Sequence
  chemically synthesized
attcctgaatgaagaaacaagt

SEQ ID NO: 990149 - DNA, 22 bp, Artificial Sequence
  chemically synthesized
tattcctgaatgaagaaacaag

SEQ ID NO: 990150 - DNA, 22 bp, Artificial Sequence
  chemically synthesized
ttattcctgaatgaagaaacaa

SEQ ID NO: 990151 - DNA, 22 bp, Artificial Sequence
  chemically synthesized
tacagagaacttgtttcttcat

SEQ ID NO: 990152 - DNA, 22 bp, Artificial Sequence
  chemically synthesized
tttttattcctgaatgaagaaa

SEQ ID NO: 990153 - DNA, 22 bp, Artificial Sequence
  chemically synthesized
cagagaacttgtttcttcattc

SEQ ID NO: 990154 - DNA, 22 bp, Artificial Sequence
  chemically synthesized
cacgttatttttattcctgaat

SEQ ID NO: 990155 - DNA, 22 bp, Artificial Sequence
  chemically synthesized
ccacgttatttttattcctgaa

SEQ ID NO: 990156 - DNA, 22 bp, Artificial Sequence
  chemically synthesized
tccacgttatttttattcctga

SEQ ID NO: 990157 - DNA, 22 bp, Artificial Sequence
  chemically synthesized
gtttcttcattcaggaataaaa

SEQ ID NO: 990158 - DNA, 22 bp, Artificial Sequence
  chemically synthesized
tttcttcattcaggaataaaaa

SEQ ID NO: 990159 - DNA, 22 bp, Artificial Sequence
  chemically synthesized
cttcattcaggaataaaaataa

SEQ ID NO: 990160 - DNA, 22 bp, Artificial Sequence
  chemically synthesized
ttcattcaggaataaaaataac

SEQ ID NO: 990161 - DNA, 22 bp, Artificial Sequence
  chemically synthesized
ataactttccacgttattttta

SEQ ID NO: 990162 - DNA, 22 bp, Artificial Sequence
  chemically synthesized
cattcaggaataaaaataacgt

SEQ ID NO: 990163 - DNA, 22 bp, Artificial Sequence
  chemically synthesized
attcaggaataaaaataacgtg

SEQ ID NO: 990164 - DNA, 22 bp, Artificial Sequence
  chemically synthesized
tcctcataactttccacgttat

SEQ ID NO: 990165 - DNA, 22 bp, Artificial Sequence
  chemically synthesized
atcctcataactttccacgtta

SEQ ID NO: 990166 - DNA, 22 bp, Artificial Sequence
  chemically synthesized
aggaataaaaataacgtggaaa

SEQ ID NO: 990167 - DNA, 22 bp, Artificial Sequence
  chemically synthesized
tatcctcataactttccacgtt

SEQ ID NO: 990168 - DNA, 22 bp, Artificial Sequence
  chemically synthesized
ttttatcctcataactttccac

SEQ ID NO: 990169 - DNA, 22 bp, Artificial Sequence
  chemically synthesized
ccctgttttatcctcataactt

SEQ ID NO: 990170 - DNA, 22 bp, Artificial Sequence
  chemically synthesized
aacacattaccctgttttatcc

SEQ ID NO: 990171 - DNA, 22 bp, Artificial Sequence
  chemically synthesized
gaacacattaccctgttttatc

SEQ ID NO: 990172 - DNA, 22 bp, Artificial Sequence
  chemically synthesized
tgaacacattaccctgttttat

SEQ ID NO: 990173 - DNA, 22 bp, Artificial Sequence
  chemically synthesized
tgaggataaaacagggtaatgt

SEQ ID NO: 990174 - DNA, 22 bp, Artificial Sequence
  chemically synthesized
agggctttgaacacattaccct

SEQ ID NO: 990175 - DNA, 22 bp, Artificial Sequence
  chemically synthesized
tgtgccagtgcccaggctaagg

SEQ ID NO: 990176 - DNA, 22 bp, Artificial Sequence
  chemically synthesized
ctgtgtgccagtgcccaggcta

SEQ ID NO: 990177 - DNA, 22 bp, Artificial Sequence
  chemically synthesized
aaagcccttagcctgggcactg

SEQ ID NO: 990178 - DNA, 22 bp, Artificial Sequence
  chemically synthesized
agcctgggcactggcacacagc

SEQ ID NO: 990179 - DNA, 22 bp, Artificial Sequence
  chemically synthesized
gcctgggcactggcacacagca

SEQ ID NO: 990180 - DNA, 22 bp, Artificial Sequence
  chemically synthesized
ggcactggcacacagcaacact

SEQ ID NO: 990181 - DNA, 22 bp, Artificial Sequence
  chemically synthesized
gcacacagcaacactcactggc

SEQ ID NO: 990182 - DNA, 22 bp, Artificial Sequence
  chemically synthesized
acaacaagagagtgccagtgag

SEQ ID NO: 990183 - DNA, 22 bp, Artificial Sequence
  chemically synthesized
catcctcacaacaagagagtgc

SEQ ID NO: 990184 - DNA, 22 bp, Artificial Sequence
  chemically synthesized
cattccatcctcacaacaagag

SEQ ID NO: 990185 - DNA, 22 bp, Artificial Sequence
  chemically synthesized
actggcactctcttgttgtgag

SEQ ID NO: 990186 - DNA, 22 bp, Artificial Sequence
  chemically synthesized
gcactctcttgttgtgaggatg

SEQ ID NO: 990187 - DNA, 22 bp, Artificial Sequence
  chemically synthesized
acagtattacattccatcctca

SEQ ID NO: 990188 - DNA, 22 bp, Artificial Sequence
  chemically synthesized
cacagtattacattccatcctc

SEQ ID NO: 990189 - DNA, 22 bp, Artificial Sequence
  chemically synthesized
ttcacagtattacattccatcc

SEQ ID NO: 990190 - DNA, 22 bp, Artificial Sequence
  chemically synthesized
tcttgttgtgaggatggaatgt

SEQ ID NO: 990191 - DNA, 22 bp, Artificial Sequence
  chemically synthesized
ttgttgtgaggatggaatgtaa

SEQ ID NO: 990192 - DNA, 22 bp, Artificial Sequence
  chemically synthesized
gttgtgaggatggaatgtaata

SEQ ID NO: 990193 - DNA, 22 bp, Artificial Sequence
  chemically synthesized
ttgtgaggatggaatgtaatac

SEQ ID NO: 990194 - DNA, 22 bp, Artificial Sequence
  chemically synthesized
tcagttcttcacagtattacat

SEQ ID NO: 990195 - DNA, 22 bp, Artificial Sequence
  chemically synthesized
tgaggatggaatgtaatactgt

SEQ ID NO: 990196 - DNA, 22 bp, Artificial Sequence
  chemically synthesized
atgtgccaggtgctgtcagttc

SEQ ID NO: 990197 - DNA, 22 bp, Artificial Sequence
  chemically synthesized
catgtgccaggtgctgtcagtt

SEQ ID NO: 990198 - DNA, 22 bp, Artificial Sequence
  chemically synthesized
tcatgtgccaggtgctgtcagt

SEQ ID NO: 990199 - DNA, 22 bp, Artificial Sequence
  chemically synthesized
tgaagaactgacagcacctggc

SEQ ID NO: 990200 - DNA, 22 bp, Artificial Sequence
  chemically synthesized
atgttttcatgtgccaggtgct

SEQ ID NO: 990201 - DNA, 22 bp, Artificial Sequence
  chemically synthesized
tctgatgttttcatgtgccagg

SEQ ID NO: 990202 - DNA, 22 bp, Artificial Sequence
  chemically synthesized
acagcacctggcacatgaaaac

SEQ ID NO: 990203 - DNA, 22 bp, Artificial Sequence
  chemically synthesized
gcaatgccagctatctgatgtt

SEQ ID NO: 990204 - DNA, 22 bp, Artificial Sequence
  chemically synthesized
gcacatgaaaacatcagatagc

SEQ ID NO: 990205 - DNA, 22 bp, Artificial Sequence
  chemically synthesized
caataggaaaaatgattggcaa

SEQ ID NO: 990206 - DNA, 22 bp, Artificial Sequence
  chemically synthesized
gcattgccaatcatttttccta

SEQ ID NO: 990207 - DNA, 22 bp, Artificial Sequence
  chemically synthesized
ccaatcatttttcctattgcag

SEQ ID NO: 990208 - DNA, 22 bp, Artificial Sequence
  chemically synthesized
ttcctattgcagttgccggtgc

SEQ ID NO: 990209 - DNA, 22 bp, Artificial Sequence
  chemically synthesized
tcctattgcagttgccggtgcc

SEQ ID NO: 990210 - DNA, 22 bp, Artificial Sequence
  chemically synthesized
cctattgcagttgccggtgccg

SEQ ID NO: 990211 - DNA, 22 bp, Artificial Sequence
  chemically synthesized
ctattgcagttgccggtgccgc

SEQ ID NO: 990212 - DNA, 22 bp, Artificial Sequence
  chemically synthesized
ttgcagttgccggtgccgctgg

SEQ ID NO: 990213 - DNA, 22 bp, Artificial Sequence
  chemically synthesized
ggtatgccaccaccagcggcac

SEQ ID NO: 990214 - DNA, 22 bp, Artificial Sequence
  chemically synthesized
aggtatgccaccaccagcggca

SEQ ID NO: 990215 - DNA, 22 bp, Artificial Sequence
  chemically synthesized
cagttgccggtgccgctggtgg

SEQ ID NO: 990216 - DNA, 22 bp, Artificial Sequence
  chemically synthesized
atttaggtatgccaccaccagc

SEQ ID NO: 990217 - DNA, 22 bp, Artificial Sequence
  chemically synthesized
taatttaggtatgccaccacca

SEQ ID NO: 990218 - DNA, 22 bp, Artificial Sequence
  chemically synthesized
ccggtgccgctggtggtggcat

SEQ ID NO: 990219 - DNA, 22 bp, Artificial Sequence
  chemically synthesized
ttctaatttaggtatgccacca

SEQ ID NO: 990220 - DNA, 22 bp, Artificial Sequence
  chemically synthesized
gtggtggcatacctaaattaga

SEQ ID NO: 990221 - DNA, 22 bp, Artificial Sequence
  chemically synthesized
aatatagcagtgttattctaat

SEQ ID NO: 990222 - DNA, 22 bp, Artificial Sequence
  chemically synthesized
gagttaaatatagcagtgttat

SEQ ID NO: 990223 - DNA, 22 bp, Artificial Sequence
  chemically synthesized
ggagttaaatatagcagtgtta

SEQ ID NO: 990224 - DNA, 22 bp, Artificial Sequence
  chemically synthesized
tggagttaaatatagcagtgtt

SEQ ID NO: 990225 - DNA, 22 bp, Artificial Sequence
  chemically synthesized
aattagaataacactgctatat

SEQ ID NO: 990226 - DNA, 22 bp, Artificial Sequence
  chemically synthesized
cagactttggagttaaatatag

SEQ ID NO: 990227 - DNA, 22 bp, Artificial Sequence
  chemically synthesized
gaataacactgctatatttaac

SEQ ID NO: 990228 - DNA, 22 bp, Artificial Sequence
  chemically synthesized
acagactttggagttaaatata

SEQ ID NO: 990229 - DNA, 22 bp, Artificial Sequence
  chemically synthesized
tacagactttggagttaaatat

SEQ ID NO: 990230 - DNA, 22 bp, Artificial Sequence
  chemically synthesized
aagcattttacagactttggag

SEQ ID NO: 990231 - DNA, 22 bp, Artificial Sequence
  chemically synthesized
ctatatttaactccaaagtctg

SEQ ID NO: 990232 - DNA, 22 bp, Artificial Sequence
  chemically synthesized
tatttaactccaaagtctgtaa

SEQ ID NO: 990233 - DNA, 22 bp, Artificial Sequence
  chemically synthesized
aactccaaagtctgtaaaatgc

SEQ ID NO: 990234 - DNA, 22 bp, Artificial Sequence
  chemically synthesized
actccaaagtctgtaaaatgct

SEQ ID NO: 990235 - DNA, 22 bp, Artificial Sequence
  chemically synthesized
caaagtctgtaaaatgcttgaa

SEQ ID NO: 990236 - DNA, 22 bp, Artificial Sequence
  chemically synthesized
cacagacggtggcaggtattca

SEQ ID NO: 990237 - DNA, 22 bp, Artificial Sequence
  chemically synthesized
taaaatgcttgaatacctgcca

SEQ ID NO: 990238 - DNA, 22 bp, Artificial Sequence
  chemically synthesized
acctccacagacggtggcaggt

SEQ ID NO: 990239 - DNA, 22 bp, Artificial Sequence
  chemically synthesized
gaatacctgccaccgtctgtgg

SEQ ID NO: 990240 - DNA, 22 bp, Artificial Sequence
  chemically synthesized
aatacctgccaccgtctgtgga

SEQ ID NO: 990241 - DNA, 22 bp, Artificial Sequence
  chemically synthesized
aacgagcaccctcacctccaca

SEQ ID NO: 990242 - DNA, 22 bp, Artificial Sequence
  chemically synthesized
ccaccgtctgtggaggtgaggg

SEQ ID NO: 990243 - DNA, 22 bp, Artificial Sequence
  chemically synthesized
aggtcctgaacgagcaccctca

SEQ ID NO: 990244 - DNA, 22 bp, Artificial Sequence
  chemically synthesized
tggaggtgagggtgctcgttca

SEQ ID NO: 990245 - DNA, 22 bp, Artificial Sequence
  chemically synthesized
tggtgttcaggtcctgaacgag

SEQ ID NO: 990246 - DNA, 22 bp, Artificial Sequence
  chemically synthesized
tatggtgttcaggtcctgaacg

SEQ ID NO: 990247 - DNA, 22 bp, Artificial Sequence
  chemically synthesized
ctatggtgttcaggtcctgaac

SEQ ID NO: 990248 - DNA, 22 bp, Artificial Sequence
  chemically synthesized
ttctatggtgttcaggtcctga

SEQ ID NO: 990249 - DNA, 22 bp, Artificial Sequence
  chemically synthesized
cttctatggtgttcaggtcctg

SEQ ID NO: 990250 - DNA, 22 bp, Artificial Sequence
  chemically synthesized
cttcttctatggtgttcaggtc

SEQ ID NO: 990251 - DNA, 22 bp, Artificial Sequence
  chemically synthesized
gttcaggacctgaacaccatag

SEQ ID NO: 990252 - DNA, 22 bp, Artificial Sequence
  chemically synthesized
aggacctgaacaccatagaaga

SEQ ID NO: 990253 - DNA, 22 bp, Artificial Sequence
  chemically synthesized
aacaccatagaagaagcaattt

SEQ ID NO: 990254 - DNA, 22 bp, Artificial Sequence
  chemically synthesized
ataccatggtagcaataaagat

SEQ ID NO: 990255 - DNA, 22 bp, Artificial Sequence
  chemically synthesized
cctaataccatggtagcaataa

SEQ ID NO: 990256 - DNA, 22 bp, Artificial Sequence
  chemically synthesized
tctcaccatctttattgctacc

SEQ ID NO: 990257 - DNA, 22 bp, Artificial Sequence
  chemically synthesized
acctaataccatggtagcaata

SEQ ID NO: 990258 - DNA, 22 bp, Artificial Sequence
  chemically synthesized
ctcaccatctttattgctacca

SEQ ID NO: 990259 - DNA, 22 bp, Artificial Sequence
  chemically synthesized
tcaccatctttattgctaccat

SEQ ID NO: 990260 - DNA, 22 bp, Artificial Sequence
  chemically synthesized
ttacctaataccatggtagcaa

SEQ ID NO: 990261 - DNA, 22 bp, Artificial Sequence
  chemically synthesized
accatctttattgctaccatgg

SEQ ID NO: 990262 - DNA, 22 bp, Artificial Sequence
  chemically synthesized
aggttcttacctaataccatgg

SEQ ID NO: 990263 - DNA, 22 bp, Artificial Sequence
  chemically synthesized
tattgctaccatggtattaggt

SEQ ID NO: 990264 - DNA, 22 bp, Artificial Sequence
  chemically synthesized
attgctaccatggtattaggta

SEQ ID NO: 990265 - DNA, 22 bp, Artificial Sequence
  chemically synthesized
ttgctaccatggtattaggtaa

SEQ ID NO: 990266 - DNA, 22 bp, Artificial Sequence
  chemically synthesized
catcctgaggttcttacctaat

SEQ ID NO: 990267 - DNA, 22 bp, Artificial Sequence
  chemically synthesized
gcatcctgaggttcttacctaa

SEQ ID NO: 990268 - DNA, 22 bp, Artificial Sequence
  chemically synthesized
ctaccatggtattaggtaagaa

SEQ ID NO: 990269 - DNA, 22 bp, Artificial Sequence
  chemically synthesized
ttgcatcctgaggttcttacct

SEQ ID NO: 990270 - DNA, 22 bp, Artificial Sequence
  chemically synthesized
ccatggtattaggtaagaacct

SEQ ID NO: 990271 - DNA, 22 bp, Artificial Sequence
  chemically synthesized
ttcttgcatcctgaggttctta

SEQ ID NO: 990272 - DNA, 22 bp, Artificial Sequence
  chemically synthesized
gttcttgcatcctgaggttctt

SEQ ID NO: 990273 - DNA, 22 bp, Artificial Sequence
  chemically synthesized
tgttcttgcatcctgaggttct

SEQ ID NO: 990274 - DNA, 22 bp, Artificial Sequence
  chemically synthesized
ttgttcttgcatcctgaggttc

SEQ ID NO: 990275 - DNA, 22 bp, Artificial Sequence
  chemically synthesized
ccttttgttcttgcatcctgag

SEQ ID NO: 990276 - DNA, 22 bp, Artificial Sequence
  chemically synthesized
ggtaagaacctcaggatgcaag

SEQ ID NO: 990277 - DNA, 22 bp, Artificial Sequence
  chemically synthesized
aggatgcaagaacaaaaggcag

SEQ ID NO: 990278 - DNA, 22 bp, Artificial Sequence
  chemically synthesized
atatgtgatagcaaaaaaggtg

SEQ ID NO: 990279 - DNA, 22 bp, Artificial Sequence
  chemically synthesized
agcatctcatatgtgatagcaa

SEQ ID NO: 990280 - DNA, 22 bp, Artificial Sequence
  chemically synthesized
ttttgctatcacatatgagatg

SEQ ID NO: 990281 - DNA, 22 bp, Artificial Sequence
  chemically synthesized
tttgctatcacatatgagatgc

SEQ ID NO: 990282 - DNA, 22 bp, Artificial Sequence
  chemically synthesized
tcaataaattcagcatctcata

SEQ ID NO: 990283 - DNA, 22 bp, Artificial Sequence
  chemically synthesized
ttgctatcacatatgagatgct

SEQ ID NO: 990284 - DNA, 22 bp, Artificial Sequence
  chemically synthesized
tgctatcacatatgagatgctg

SEQ ID NO: 990285 - DNA, 22 bp, Artificial Sequence
  chemically synthesized
gctatcacatatgagatgctga

SEQ ID NO: 990286 - DNA, 22 bp, Artificial Sequence
  chemically synthesized
ttatcaataaattcagcatctc

SEQ ID NO: 990287 - DNA, 22 bp, Artificial Sequence
  chemically synthesized
ctatcacatatgagatgctgaa

SEQ ID NO: 990288 - DNA, 22 bp, Artificial Sequence
  chemically synthesized
tcacatatgagatgctgaattt

SEQ ID NO: 990289 - DNA, 22 bp, Artificial Sequence
  chemically synthesized
atactgttatcaataaattcag

SEQ ID NO: 990290 - DNA, 22 bp, Artificial Sequence
  chemically synthesized
aatactgttatcaataaattca

SEQ ID NO: 990291 - DNA, 22 bp, Artificial Sequence
  chemically synthesized
cttaatactgttatcaataaat

SEQ ID NO: 990292 - DNA, 22 bp, Artificial Sequence
  chemically synthesized
tccttaatactgttatcaataa

SEQ ID NO: 990293 - DNA, 22 bp, Artificial Sequence
  chemically synthesized
ccattctccttaatactgttat

SEQ ID NO: 990294 - DNA, 22 bp, Artificial Sequence
  chemically synthesized
aatttattgataacagtattaa

SEQ ID NO: 990295 - DNA, 22 bp, Artificial Sequence
  chemically synthesized
agctgccattctccttaatact

SEQ ID NO: 990296 - DNA, 22 bp, Artificial Sequence
  chemically synthesized
cagctgccattctccttaatac

SEQ ID NO: 990297 - DNA, 22 bp, Artificial Sequence
  chemically synthesized
tcagctgccattctccttaata

SEQ ID NO: 990298 - DNA, 22 bp, Artificial Sequence
  chemically synthesized
attgataacagtattaaggaga

SEQ ID NO: 990299 - DNA, 22 bp, Artificial Sequence
  chemically synthesized
ttgataacagtattaaggagaa

SEQ ID NO: 990300 - DNA, 22 bp, Artificial Sequence
  chemically synthesized
ctttcagctgccattctcctta

SEQ ID NO: 990301 - DNA, 22 bp, Artificial Sequence
  chemically synthesized
cctttcagctgccattctcctt

SEQ ID NO: 990302 - DNA, 22 bp, Artificial Sequence
  chemically synthesized
ataacagtattaaggagaatgg

SEQ ID NO: 990303 - DNA, 22 bp, Artificial Sequence
  chemically synthesized
aggagaatggcagctgaaagga

SEQ ID NO: 990304 - DNA, 22 bp, Artificial Sequence
  chemically synthesized
aaaggaaatttctgatatttct

SEQ ID NO: 990305 - DNA, 22 bp, Artificial Sequence
  chemically synthesized
ggaggatcatgaaagaaatatc

SEQ ID NO: 990306 - DNA, 22 bp, Artificial Sequence
  chemically synthesized
ctgatatttctttcatgatcct

SEQ ID NO: 990307 - DNA, 22 bp, Artificial Sequence
  chemically synthesized
tgatatttctttcatgatcctc

SEQ ID NO: 990308 - DNA, 22 bp, Artificial Sequence
  chemically synthesized
atatttctttcatgatcctccc

SEQ ID NO: 990309 - DNA, 22 bp, Artificial Sequence
  chemically synthesized
ctttcatgatcctcccagattt

SEQ ID NO: 990310 - DNA, 22 bp, Artificial Sequence
  chemically synthesized
aaaggaatgtcaaaatctggga

SEQ ID NO: 990311 - DNA, 22 bp, Artificial Sequence
  chemically synthesized
tttcatgatcctcccagatttt

SEQ ID NO: 990312 - DNA, 22 bp, Artificial Sequence
  chemically synthesized
gaaaggaatgtcaaaatctggg

SEQ ID NO: 990313 - DNA, 22 bp, Artificial Sequence
  chemically synthesized
tgaaaggaatgtcaaaatctgg

SEQ ID NO: 990314 - DNA, 22 bp, Artificial Sequence
  chemically synthesized
tcatgatcctcccagattttga

SEQ ID NO: 990315 - DNA, 22 bp, Artificial Sequence
  chemically synthesized
catgatcctcccagattttgac

SEQ ID NO: 990316 - DNA, 22 bp, Artificial Sequence
  chemically synthesized
atgatcctcccagattttgaca

SEQ ID NO: 990317 - DNA, 22 bp, Artificial Sequence
  chemically synthesized
ataattttgaaaggaatgtcaa

SEQ ID NO: 990318 - DNA, 22 bp, Artificial Sequence
  chemically synthesized
actaataattttgaaaggaatg

SEQ ID NO: 990319 - DNA, 22 bp, Artificial Sequence
  chemically synthesized
ccagattttgacattcctttca

SEQ ID NO: 990320 - DNA, 22 bp, Artificial Sequence
  chemically synthesized
tcactaataattttgaaaggaa

SEQ ID NO: 990321 - DNA, 22 bp, Artificial Sequence
  chemically synthesized
ctctcactaataattttgaaag

SEQ ID NO: 990322 - DNA, 22 bp, Artificial Sequence
  chemically synthesized
tgacattcctttcaaaattatt

SEQ ID NO: 990323 - DNA, 22 bp, Artificial Sequence
  chemically synthesized
attgctctcactaataattttg

SEQ ID NO: 990324 - DNA, 22 bp, Artificial Sequence
  chemically synthesized
gacattcctttcaaaattatta

SEQ ID NO: 990325 - DNA, 22 bp, Artificial Sequence
  chemically synthesized
acattcctttcaaaattattag

SEQ ID NO: 990326 - DNA, 22 bp, Artificial Sequence
  chemically synthesized
ctgattgctctcactaataatt

SEQ ID NO: 990327 - DNA, 22 bp, Artificial Sequence
  chemically synthesized
actgattgctctcactaataat

SEQ ID NO: 990328 - DNA, 22 bp, Artificial Sequence
  chemically synthesized
ctttcaaaattattagtgagag

SEQ ID NO: 990329 - DNA, 22 bp, Artificial Sequence
  chemically synthesized
tcaaaattattagtgagagcaa

SEQ ID NO: 990330 - DNA, 22 bp, Artificial Sequence
  chemically synthesized
caaaattattagtgagagcaat

SEQ ID NO: 990331 - DNA, 22 bp, Artificial Sequence
  chemically synthesized
aaaattattagtgagagcaatc

SEQ ID NO: 990332 - DNA, 22 bp, Artificial Sequence
  chemically synthesized
ttagtgagagcaatcagtaagt

SEQ ID NO: 990333 - DNA, 22 bp, Artificial Sequence
  chemically synthesized
gtagcagaagacacttactgat

SEQ ID NO: 990334 - DNA, 22 bp, Artificial Sequence
  chemically synthesized
ggtagcagaagacacttactga

SEQ ID NO: 990335 - DNA, 22 bp, Artificial Sequence
  chemically synthesized
tggtagcagaagacacttactg

SEQ ID NO: 990336 - DNA, 22 bp, Artificial Sequence
  chemically synthesized
gtgagagcaatcagtaagtgtc

SEQ ID NO: 990337 - DNA, 22 bp, Artificial Sequence
  chemically synthesized
ttggtagcagaagacacttact

SEQ ID NO: 990338 - DNA, 22 bp, Artificial Sequence
  chemically synthesized
acatttttggtagcagaagaca

SEQ ID NO: 990339 - DNA, 22 bp, Artificial Sequence
  chemically synthesized
aagcaagggctcacatttttgg

SEQ ID NO: 990340 - DNA, 22 bp, Artificial Sequence
  chemically synthesized
caagcaagggctcacatttttg

SEQ ID NO: 990341 - DNA, 22 bp, Artificial Sequence
  chemically synthesized
ctgctaccaaaaatgtgagccc

SEQ ID NO: 990342 - DNA, 22 bp, Artificial Sequence
  chemically synthesized
tgctaccaaaaatgtgagccct

SEQ ID NO: 990343 - DNA, 22 bp, Artificial Sequence
  chemically synthesized
ctaccaaaaatgtgagcccttg

SEQ ID NO: 990344 - DNA, 22 bp, Artificial Sequence
  chemically synthesized
aagatgtttcaagcaagggctc

SEQ ID NO: 990345 - DNA, 22 bp, Artificial Sequence
  chemically synthesized
ccaaaaatgtgagcccttgctt

SEQ ID NO: 990346 - DNA, 22 bp, Artificial Sequence
  chemically synthesized
cctaaagatgtttcaagcaagg

SEQ ID NO: 990347 - DNA, 22 bp, Artificial Sequence
  chemically synthesized
acctaaagatgtttcaagcaag

SEQ ID NO: 990348 - DNA, 22 bp, Artificial Sequence
  chemically synthesized
cttacctaaagatgtttcaagc

SEQ ID NO: 990349 - DNA, 22 bp, Artificial Sequence
  chemically synthesized
acttacctaaagatgtttcaag

SEQ ID NO: 990350 - DNA, 22 bp, Artificial Sequence
  chemically synthesized
tacttacctaaagatgtttcaa

SEQ ID NO: 990351 - DNA, 22 bp, Artificial Sequence
  chemically synthesized
actttacttacctaaagatgtt

SEQ ID NO: 990352 - DNA, 22 bp, Artificial Sequence
  chemically synthesized
gcttgaaacatctttaggtaag

SEQ ID NO: 990353 - DNA, 22 bp, Artificial Sequence
  chemically synthesized
cttgaaacatctttaggtaagt

SEQ ID NO: 990354 - DNA, 22 bp, Artificial Sequence
  chemically synthesized
ggggctgactttacttacctaa

SEQ ID NO: 990355 - DNA, 22 bp, Artificial Sequence
  chemically synthesized
gaaacatctttaggtaagtaaa

SEQ ID NO: 990356 - DNA, 22 bp, Artificial Sequence
  chemically synthesized
ctaggggctgactttacttacc

SEQ ID NO: 990357 - DNA, 22 bp, Artificial Sequence
  chemically synthesized
aaacatctttaggtaagtaaag

SEQ ID NO: 990358 - DNA, 22 bp, Artificial Sequence
  chemically synthesized
cctaggggctgactttacttac

SEQ ID NO: 990359 - DNA, 22 bp, Artificial Sequence
  chemically synthesized
tcctaggggctgactttactta

SEQ ID NO: 990360 - DNA, 22 bp, Artificial Sequence
  chemically synthesized
agtgctttcctaggggctgact

SEQ ID NO: 990361 - DNA, 22 bp, Artificial Sequence
  chemically synthesized
taggtaagtaaagtcagcccct

SEQ ID NO: 990362 - DNA, 22 bp, Artificial Sequence
  chemically synthesized
aagtgctttcctaggggctgac

SEQ ID NO: 990363 - DNA, 22 bp, Artificial Sequence
  chemically synthesized
aggtaagtaaagtcagccccta

SEQ ID NO: 990364 - DNA, 22 bp, Artificial Sequence
  chemically synthesized
ggtaagtaaagtcagcccctag

SEQ ID NO: 990365 - DNA, 22 bp, Artificial Sequence
  chemically synthesized
cttaagtgctttcctaggggct

SEQ ID NO: 990366 - DNA, 22 bp, Artificial Sequence
  chemically synthesized
gcttaagtgctttcctaggggc

SEQ ID NO: 990367 - DNA, 22 bp, Artificial Sequence
  chemically synthesized
tgcttaagtgctttcctagggg

SEQ ID NO: 990368 - DNA, 22 bp, Artificial Sequence
  chemically synthesized
ttgcttaagtgctttcctaggg

SEQ ID NO: 990369 - DNA, 22 bp, Artificial Sequence
  chemically synthesized
gccttttgcttaagtgctttcc

SEQ ID NO: 990370 - DNA, 22 bp, Artificial Sequence
  chemically synthesized
cctagccttttgcttaagtgct

SEQ ID NO: 990371 - DNA, 22 bp, Artificial Sequence
  chemically synthesized
ccctagccttttgcttaagtgc

SEQ ID NO: 990372 - DNA, 22 bp, Artificial Sequence
  chemically synthesized
tccctagccttttgcttaagtg

SEQ ID NO: 990373 - DNA, 22 bp, Artificial Sequence
  chemically synthesized
tttccctagccttttgcttaag

SEQ ID NO: 990374 - DNA, 22 bp, Artificial Sequence
  chemically synthesized
tctttccctagccttttgctta

SEQ ID NO: 990375 - DNA, 22 bp, Artificial Sequence
  chemically synthesized
ggaaagcacttaagcaaaaggc

SEQ ID NO: 990376 - DNA, 22 bp, Artificial Sequence
  chemically synthesized
atatagctctctttccctagcc

SEQ ID NO: 990377 - DNA, 22 bp, Artificial Sequence
  chemically synthesized
aagcaaaaggctagggaaagag

SEQ ID NO: 990378 - DNA, 22 bp, Artificial Sequence
  chemically synthesized
agcaaaaggctagggaaagaga

SEQ ID NO: 990379 - DNA, 22 bp, Artificial Sequence
  chemically synthesized
gacctgatatagctctctttcc

SEQ ID NO: 990380 - DNA, 22 bp, Artificial Sequence
  chemically synthesized
ggacctgatatagctctctttc

SEQ ID NO: 990381 - DNA, 22 bp, Artificial Sequence
  chemically synthesized
gggaaagagagctatatcaggt

SEQ ID NO: 990382 - DNA, 22 bp, Artificial Sequence
  chemically synthesized
tatcaggtccaaactaccgtgc

SEQ ID NO: 990383 - DNA, 22 bp, Artificial Sequence
  chemically synthesized
caagagtgaggagtagcagcac

SEQ ID NO: 990384 - DNA, 22 bp, Artificial Sequence
  chemically synthesized
ccaagagtgaggagtagcagca

SEQ ID NO: 990385 - DNA, 22 bp, Artificial Sequence
  chemically synthesized
ttccaagagtgaggagtagcag

SEQ ID NO: 990386 - DNA, 22 bp, Artificial Sequence
  chemically synthesized
cttccaagagtgaggagtagca

SEQ ID NO: 990387 - DNA, 22 bp, Artificial Sequence
  chemically synthesized
tcttccaagagtgaggagtagc

SEQ ID NO: 990388 - DNA, 22 bp, Artificial Sequence
  chemically synthesized
ccgtgctgctactcctcactct

SEQ ID NO: 990389 - DNA, 22 bp, Artificial Sequence
  chemically synthesized
aattttcttccaagagtgagga

SEQ ID NO: 990390 - DNA, 22 bp, Artificial Sequence
  chemically synthesized
ctactcctcactcttggaagaa

SEQ ID NO: 990391 - DNA, 22 bp, Artificial Sequence
  chemically synthesized
caaaggcctaaattttcttcca

SEQ ID NO: 990392 - DNA, 22 bp, Artificial Sequence
  chemically synthesized
ctcctcactcttggaagaaaat

SEQ ID NO: 990393 - DNA, 22 bp, Artificial Sequence
  chemically synthesized
ctcactcttggaagaaaattta

SEQ ID NO: 990394 - DNA, 22 bp, Artificial Sequence
  chemically synthesized
attgcaaaggcctaaattttct

SEQ ID NO: 990395 - DNA, 22 bp, Artificial Sequence
  chemically synthesized
cattgcaaaggcctaaattttc

SEQ ID NO: 990396 - DNA, 22 bp, Artificial Sequence
  chemically synthesized
tcattgcaaaggcctaaatttt

SEQ ID NO: 990397 - DNA, 22 bp, Artificial Sequence
  chemically synthesized
actcttggaagaaaatttaggc

SEQ ID NO: 990398 - DNA, 22 bp, Artificial Sequence
  chemically synthesized
attttcattgcaaaggcctaaa

SEQ ID NO: 990399 - DNA, 22 bp, Artificial Sequence
  chemically synthesized
ttggaagaaaatttaggccttt

SEQ ID NO: 990400 - DNA, 22 bp, Artificial Sequence
  chemically synthesized
ggaagaaaatttaggcctttgc

SEQ ID NO: 990401 - DNA, 22 bp, Artificial Sequence
  chemically synthesized
gaagaaaatttaggcctttgca

SEQ ID NO: 990402 - DNA, 22 bp, Artificial Sequence
  chemically synthesized
cattaattttcattgcaaaggc

SEQ ID NO: 990403 - DNA, 22 bp, Artificial Sequence
  chemically synthesized
tccattaattttcattgcaaag

SEQ ID NO: 990404 - DNA, 22 bp, Artificial Sequence
  chemically synthesized
ctccattaattttcattgcaaa

SEQ ID NO: 990405 - DNA, 22 bp, Artificial Sequence
  chemically synthesized
aggcctttgcaatgaaaattaa

SEQ ID NO: 990406 - DNA, 22 bp, Artificial Sequence
  chemically synthesized
ggcctttgcaatgaaaattaat

SEQ ID NO: 990407 - DNA, 22 bp, Artificial Sequence
  chemically synthesized
tgcaatgaaaattaatggagaa

SEQ ID NO: 990408 - DNA, 22 bp, Artificial Sequence
  chemically synthesized
ggtgtcatgtgcttctccatta

SEQ ID NO: 990409 - DNA, 22 bp, Artificial Sequence
  chemically synthesized
gcaatgaaaattaatggagaag

SEQ ID NO: 990410 - DNA, 22 bp, Artificial Sequence
  chemically synthesized
aggtgtcatgtgcttctccatt

SEQ ID NO: 990411 - DNA, 22 bp, Artificial Sequence
  chemically synthesized
caatgaaaattaatggagaagc

SEQ ID NO: 990412 - DNA, 22 bp, Artificial Sequence
  chemically synthesized
acatttaggtgtcatgtgcttc

SEQ ID NO: 990413 - DNA, 22 bp, Artificial Sequence
  chemically synthesized
atattaacatttaggtgtcatg

SEQ ID NO: 990414 - DNA, 22 bp, Artificial Sequence
  chemically synthesized
atggagaagcacatgacaccta

SEQ ID NO: 990415 - DNA, 22 bp, Artificial Sequence
  chemically synthesized
aatattaacatttaggtgtcat

SEQ ID NO: 990416 - DNA, 22 bp, Artificial Sequence
  chemically synthesized
ccttaatattaacatttaggtg

SEQ ID NO: 990417 - DNA, 22 bp, Artificial Sequence
  chemically synthesized
tcccctcccttaatattaacat

SEQ ID NO: 990418 - DNA, 22 bp, Artificial Sequence
  chemically synthesized
cctatcccctcccttaatatta

SEQ ID NO: 990419 - DNA, 22 bp, Artificial Sequence
  chemically synthesized
tccctatcccctcccttaatat

SEQ ID NO: 990420 - DNA, 22 bp, Artificial Sequence
  chemically synthesized
aatgttaatattaagggagggg

SEQ ID NO: 990421 - DNA, 22 bp, Artificial Sequence
  chemically synthesized
atattaagggaggggataggga

SEQ ID NO: 990422 - DNA, 22 bp, Artificial Sequence
  chemically synthesized
agggaggggatagggagaatat

SEQ ID NO: 990423 - DNA, 22 bp, Artificial Sequence
  chemically synthesized
gaacaaatgaaacaggatggag

SEQ ID NO: 990424 - DNA, 22 bp, Artificial Sequence
  chemically synthesized
ctctatgtgactccatcctgtt

SEQ ID NO: 990425 - DNA, 22 bp, Artificial Sequence
  chemically synthesized
tctatgtgactccatcctgttt

SEQ ID NO: 990426 - DNA, 22 bp, Artificial Sequence
  chemically synthesized
actagaacaaatgaaacaggat

SEQ ID NO: 990427 - DNA, 22 bp, Artificial Sequence
  chemically synthesized
tatgtgactccatcctgtttca

SEQ ID NO: 990428 - DNA, 22 bp, Artificial Sequence
  chemically synthesized
tgtgactccatcctgtttcatt

SEQ ID NO: 990429 - DNA, 22 bp, Artificial Sequence
  chemically synthesized
catcctgtttcatttgttctag

SEQ ID NO: 990430 - DNA, 22 bp, Artificial Sequence
  chemically synthesized
tttcatttgttctagtgagtac

SEQ ID NO: 990431 - DNA, 22 bp, Artificial Sequence
  chemically synthesized
catttgttctagtgagtacata

SEQ ID NO: 990432 - DNA, 22 bp, Artificial Sequence
  chemically synthesized
atttgttctagtgagtacatat

SEQ ID NO: 990433 - DNA, 22 bp, Artificial Sequence
  chemically synthesized
gttctagtgagtacatattact

SEQ ID NO: 990434 - DNA, 22 bp, Artificial Sequence
  chemically synthesized
ttctagtgagtacatattacta

SEQ ID NO: 990435 - DNA, 22 bp, Artificial Sequence
  chemically synthesized
cacacaaagtataatagtaata

SEQ ID NO: 990436 - DNA, 22 bp, Artificial Sequence
  chemically synthesized
tagtgagtacatattactatta

SEQ ID NO: 990437 - DNA, 22 bp, Artificial Sequence
  chemically synthesized
acacacaaagtataatagtaat

SEQ ID NO: 990438 - DNA, 22 bp, Artificial Sequence
  chemically synthesized
gtgagtacatattactattata

SEQ ID NO: 990439 - DNA, 22 bp, Artificial Sequence
  chemically synthesized
tcttacacacaaagtataatag

SEQ ID NO: 990440 - DNA, 22 bp, Artificial Sequence
  chemically synthesized
atcttacacacaaagtataata

SEQ ID NO: 990441 - DNA, 22 bp, Artificial Sequence
  chemically synthesized
tatcttacacacaaagtataat

SEQ ID NO: 990442 - DNA, 22 bp, Artificial Sequence
  chemically synthesized
ttatcttacacacaaagtataa

SEQ ID NO: 990443 - DNA, 22 bp, Artificial Sequence
  chemically synthesized
ttttatcttacacacaaagtat

SEQ ID NO: 990444 - DNA, 22 bp, Artificial Sequence
  chemically synthesized
cttttatcttacacacaaagta

SEQ ID NO: 990445 - DNA, 22 bp, Artificial Sequence
  chemically synthesized
tcttttatcttacacacaaagt

SEQ ID NO: 990446 - DNA, 22 bp, Artificial Sequence
  chemically synthesized
ctattatactttgtgtgtaaga

SEQ ID NO: 990447 - DNA, 22 bp, Artificial Sequence
  chemically synthesized
aactttcttttatcttacacac

SEQ ID NO: 990448 - DNA, 22 bp, Artificial Sequence
  chemically synthesized
aaactttcttttatcttacaca

SEQ ID NO: 990449 - DNA, 22 bp, Artificial Sequence
  chemically synthesized
taaactttcttttatcttacac

SEQ ID NO: 990450 - DNA, 22 bp, Artificial Sequence
  chemically synthesized
ttatactttgtgtgtaagataa

SEQ ID NO: 990451 - DNA, 22 bp, Artificial Sequence
  chemically synthesized
ttaaactttcttttatcttaca

SEQ ID NO: 990452 - DNA, 22 bp, Artificial Sequence
  chemically synthesized
tttaaactttcttttatcttac

SEQ ID NO: 990453 - DNA, 22 bp, Artificial Sequence
  chemically synthesized
ttttaaactttcttttatctta

SEQ ID NO: 990454 - DNA, 22 bp, Artificial Sequence
  chemically synthesized
tactttgtgtgtaagataaaag

SEQ ID NO: 990455 - DNA, 22 bp, Artificial Sequence
  chemically synthesized
tttttaaactttcttttatctt

SEQ ID NO: 990456 - DNA, 22 bp, Artificial Sequence
  chemically synthesized
tttttttaaactttcttttatc

SEQ ID NO: 990457 - DNA, 22 bp, Artificial Sequence
  chemically synthesized
ctttttttaaactttcttttat

SEQ ID NO: 990458 - DNA, 22 bp, Artificial Sequence
  chemically synthesized
tctttttttaaactttctttta

SEQ ID NO: 990459 - DNA, 22 bp, Artificial Sequence
  chemically synthesized
tgtgtgtaagataaaagaaagt

SEQ ID NO: 990460 - DNA, 22 bp, Artificial Sequence
  chemically synthesized
ttctttttttaaactttctttt

SEQ ID NO: 990461 - DNA, 22 bp, Artificial Sequence
  chemically synthesized
gtgtgtaagataaaagaaagtt

SEQ ID NO: 990462 - DNA, 22 bp, Artificial Sequence
  chemically synthesized
tgtgtaagataaaagaaagttt

SEQ ID NO: 990463 - DNA, 22 bp, Artificial Sequence
  chemically synthesized
aatttttctttttttaaacttt

SEQ ID NO: 990464 - DNA, 22 bp, Artificial Sequence
  chemically synthesized
caatttttctttttttaaactt

SEQ ID NO: 990465 - DNA, 22 bp, Artificial Sequence
  chemically synthesized
aaataacttcaatttttctttt

SEQ ID NO: 990466 - DNA, 22 bp, Artificial Sequence
  chemically synthesized
taaaataacttcaatttttctt

SEQ ID NO: 990467 - DNA, 22 bp, Artificial Sequence
  chemically synthesized
ttctaaaataacttcaattttt

SEQ ID NO: 990468 - DNA, 22 bp, Artificial Sequence
  chemically synthesized
aaaaaaagaaaaattgaagtta

SEQ ID NO: 990469 - DNA, 22 bp, Artificial Sequence
  chemically synthesized
aaaaaagaaaaattgaagttat

SEQ ID NO: 990470 - DNA, 22 bp, Artificial Sequence
  chemically synthesized
atctgttctaaaataacttcaa

SEQ ID NO: 990471 - DNA, 22 bp, Artificial Sequence
  chemically synthesized
gatctgttctaaaataacttca

SEQ ID NO: 990472 - DNA, 22 bp, Artificial Sequence
  chemically synthesized
ataagcagtttgatctgttcta

SEQ ID NO: 990473 - DNA, 22 bp, Artificial Sequence
  chemically synthesized
tcataagcagtttgatctgttc

SEQ ID NO: 990474 - DNA, 22 bp, Artificial Sequence
  chemically synthesized
aagttattttagaacagatcaa

SEQ ID NO: 990475 - DNA, 22 bp, Artificial Sequence
  chemically synthesized
ttttagaacagatcaaactgct

SEQ ID NO: 990476 - DNA, 22 bp, Artificial Sequence
  chemically synthesized
tagaacagatcaaactgcttat

SEQ ID NO: 990477 - DNA, 22 bp, Artificial Sequence
  chemically synthesized
agaacagatcaaactgcttatg

SEQ ID NO: 990478 - DNA, 22 bp, Artificial Sequence
  chemically synthesized
gaacagatcaaactgcttatga

SEQ ID NO: 990479 - DNA, 22 bp, Artificial Sequence
  chemically synthesized
aaaggtagtaagcctctcataa

SEQ ID NO: 990480 - DNA, 22 bp, Artificial Sequence
  chemically synthesized
aaaaggtagtaagcctctcata

SEQ ID NO: 990481 - DNA, 22 bp, Artificial Sequence
  chemically synthesized
taaaaggtagtaagcctctcat

SEQ ID NO: 990482 - DNA, 22 bp, Artificial Sequence
  chemically synthesized
cttatgagaggcttactacctt

SEQ ID NO: 990483 - DNA, 22 bp, Artificial Sequence
  chemically synthesized
atgagaggcttactacctttta

SEQ ID NO: 990484 - DNA, 22 bp, Artificial Sequence
  chemically synthesized
tgagaggcttactaccttttaa

SEQ ID NO: 990485 - DNA, 22 bp, Artificial Sequence
  chemically synthesized
atcaaaataatattttaaaagg

SEQ ID NO: 990486 - DNA, 22 bp, Artificial Sequence
  chemically synthesized
aatcaaaataatattttaaaag

SEQ ID NO: 990487 - DNA, 22 bp, Artificial Sequence
  chemically synthesized
gtttaatcaaaataatatttta

SEQ ID NO: 990488 - DNA, 22 bp, Artificial Sequence
  chemically synthesized
agtttaatcaaaataatatttt

SEQ ID NO: 990489 - DNA, 22 bp, Artificial Sequence
  chemically synthesized
tagtttaatcaaaataatattt

SEQ ID NO: 990490 - DNA, 22 bp, Artificial Sequence
  chemically synthesized
actaccttttaaaatattattt

SEQ ID NO: 990491 - DNA, 22 bp, Artificial Sequence
  chemically synthesized
ttagtttaatcaaaataatatt

SEQ ID NO: 990492 - DNA, 22 bp, Artificial Sequence
  chemically synthesized
ctaccttttaaaatattatttt

SEQ ID NO: 990493 - DNA, 22 bp, Artificial Sequence
  chemically synthesized
tttttagtttaatcaaaataat

SEQ ID NO: 990494 - DNA, 22 bp, Artificial Sequence
  chemically synthesized
ccttttaaaatattattttgat

SEQ ID NO: 990495 - DNA, 22 bp, Artificial Sequence
  chemically synthesized
atttttagtttaatcaaaataa

SEQ ID NO: 990496 - DNA, 22 bp, Artificial Sequence
  chemically synthesized
ttaaaatattattttgattaaa

SEQ ID NO: 990497 - DNA, 22 bp, Artificial Sequence
  chemically synthesized
taaaatattattttgattaaac

SEQ ID NO: 990498 - DNA, 22 bp, Artificial Sequence
  chemically synthesized
aaaatattattttgattaaact

SEQ ID NO: 990499 - DNA, 22 bp, Artificial Sequence
  chemically synthesized
aaatattattttgattaaacta

SEQ ID NO: 990500 - DNA, 22 bp, Artificial Sequence
  chemically synthesized
agaatttatttttagtttaatc

SEQ ID NO: 990501 - DNA, 22 bp, Artificial Sequence
  chemically synthesized
aagaatttatttttagtttaat

SEQ ID NO: 990502 - DNA, 22 bp, Artificial Sequence
  chemically synthesized
taagaatttatttttagtttaa

SEQ ID NO: 990503 - DNA, 22 bp, Artificial Sequence
  chemically synthesized
ttaagaatttatttttagttta

SEQ ID NO: 990504 - DNA, 22 bp, Artificial Sequence
  chemically synthesized
ttttgattaaactaaaaataaa

SEQ ID NO: 990505 - DNA, 22 bp, Artificial Sequence
  chemically synthesized
ggtttttaagaatttattttta

SEQ ID NO: 990506 - DNA, 22 bp, Artificial Sequence
  chemically synthesized
tgattaaactaaaaataaattc

SEQ ID NO: 990507 - DNA, 22 bp, Artificial Sequence
  chemically synthesized
gattaaactaaaaataaattct

SEQ ID NO: 990508 - DNA, 22 bp, Artificial Sequence
  chemically synthesized
gctgggtttttaagaatttatt

SEQ ID NO: 990509 - DNA, 22 bp, Artificial Sequence
  chemically synthesized
attaaactaaaaataaattctt

SEQ ID NO: 990510 - DNA, 22 bp, Artificial Sequence
  chemically synthesized
ggctgggtttttaagaatttat

SEQ ID NO: 990511 - DNA, 22 bp, Artificial Sequence
  chemically synthesized
aactaaaaataaattcttaaaa

SEQ ID NO: 990512 - DNA, 22 bp, Artificial Sequence
  chemically synthesized
ccttggctgggtttttaagaat

SEQ ID NO: 990513 - DNA, 22 bp, Artificial Sequence
  chemically synthesized
accttggctgggtttttaagaa

SEQ ID NO: 990514 - DNA, 22 bp, Artificial Sequence
  chemically synthesized
ttaccttggctgggtttttaag

SEQ ID NO: 990515 - DNA, 22 bp, Artificial Sequence
  chemically synthesized
cttaccttggctgggtttttaa

SEQ ID NO: 990516 - DNA, 22 bp, Artificial Sequence
  chemically synthesized
aaaataaattcttaaaaaccca

SEQ ID NO: 990517 - DNA, 22 bp, Artificial Sequence
  chemically synthesized
tcttaccttggctgggttttta

SEQ ID NO: 990518 - DNA, 22 bp, Artificial Sequence
  chemically synthesized
ttcttaccttggctgggttttt

SEQ ID NO: 990519 - DNA, 22 bp, Artificial Sequence
  chemically synthesized
ttttcttaccttggctgggttt

SEQ ID NO: 990520 - DNA, 22 bp, Artificial Sequence
  chemically synthesized
cttttcttaccttggctgggtt

SEQ ID NO: 990521 - DNA, 22 bp, Artificial Sequence
  chemically synthesized
tcttttcttaccttggctgggt

SEQ ID NO: 990522 - DNA, 22 bp, Artificial Sequence
  chemically synthesized
ttttcttttcttaccttggctg

SEQ ID NO: 990523 - DNA, 22 bp, Artificial Sequence
  chemically synthesized
ttaaaaacccagccaaggtaag

SEQ ID NO: 990524 - DNA, 22 bp, Artificial Sequence
  chemically synthesized
aaaaacccagccaaggtaagaa

SEQ ID NO: 990525 - DNA, 22 bp, Artificial Sequence
  chemically synthesized
aaaacccagccaaggtaagaaa

SEQ ID NO: 990526 - DNA, 22 bp, Artificial Sequence
  chemically synthesized
agagcatgagaaggaaaactat

SEQ ID NO: 990527 - DNA, 22 bp, Artificial Sequence
  chemically synthesized
gagagcatgagaaggaaaacta

SEQ ID NO: 990528 - DNA, 22 bp, Artificial Sequence
  chemically synthesized
gtttgagagcatgagaaggaaa

SEQ ID NO: 990529 - DNA, 22 bp, Artificial Sequence
  chemically synthesized
agtttgagagcatgagaaggaa

SEQ ID NO: 990530 - DNA, 22 bp, Artificial Sequence
  chemically synthesized
ttagtttgagagcatgagaagg

SEQ ID NO: 990531 - DNA, 22 bp, Artificial Sequence
  chemically synthesized
tgtatactcttagtttgagagc

SEQ ID NO: 990532 - DNA, 22 bp, Artificial Sequence
  chemically synthesized
atgtatactcttagtttgagag

SEQ ID NO: 990533 - DNA, 22 bp, Artificial Sequence
  chemically synthesized
tccttctcatgctctcaaacta

SEQ ID NO: 990534 - DNA, 22 bp, Artificial Sequence
  chemically synthesized
ccttctcatgctctcaaactaa

SEQ ID NO: 990535 - DNA, 22 bp, Artificial Sequence
  chemically synthesized
cttctcatgctctcaaactaag

SEQ ID NO: 990536 - DNA, 22 bp, Artificial Sequence
  chemically synthesized
ctcatgctctcaaactaagagt

SEQ ID NO: 990537 - DNA, 22 bp, Artificial Sequence
  chemically synthesized
tcatgctctcaaactaagagta

SEQ ID NO: 990538 - DNA, 22 bp, Artificial Sequence
  chemically synthesized
gccaatttatgtatactcttag

SEQ ID NO: 990539 - DNA, 22 bp, Artificial Sequence
  chemically synthesized
atgctctcaaactaagagtata

SEQ ID NO: 990540 - DNA, 22 bp, Artificial Sequence
  chemically synthesized
agccaatttatgtatactctta

SEQ ID NO: 990541 - DNA, 22 bp, Artificial Sequence
  chemically synthesized
ttagccaatttatgtatactct

SEQ ID NO: 990542 - DNA, 22 bp, Artificial Sequence
  chemically synthesized
cttagccaatttatgtatactc

SEQ ID NO: 990543 - DNA, 22 bp, Artificial Sequence
  chemically synthesized
tcaaactaagagtatacataaa

SEQ ID NO: 990544 - DNA, 22 bp, Artificial Sequence
  chemically synthesized
aaactaagagtatacataaatt

SEQ ID NO: 990545 - DNA, 22 bp, Artificial Sequence
  chemically synthesized
tccgtttcttagccaatttatg

SEQ ID NO: 990546 - DNA, 22 bp, Artificial Sequence
  chemically synthesized
agagtatacataaattggctaa

SEQ ID NO: 990547 - DNA, 22 bp, Artificial Sequence
  chemically synthesized
gaaaaaggggagtcatcctatc

SEQ ID NO: 990548 - DNA, 22 bp, Artificial Sequence
  chemically synthesized
gctaagaaacggataggatgac

SEQ ID NO: 990549 - DNA, 22 bp, Artificial Sequence
  chemically synthesized
agaaacggataggatgactccc

SEQ ID NO: 990550 - DNA, 22 bp, Artificial Sequence
  chemically synthesized
tccctggaaaaaggggagtcat

SEQ ID NO: 990551 - DNA, 22 bp, Artificial Sequence
  chemically synthesized
gtccctggaaaaaggggagtca

SEQ ID NO: 990552 - DNA, 22 bp, Artificial Sequence
  chemically synthesized
ttgtccctggaaaaaggggagt

SEQ ID NO: 990553 - DNA, 22 bp, Artificial Sequence
  chemically synthesized
aacccactcttgtccctggaaa

SEQ ID NO: 990554 - DNA, 22 bp, Artificial Sequence
  chemically synthesized
ctaaacccactcttgtccctgg

SEQ ID NO: 990555 - DNA, 22 bp, Artificial Sequence
  chemically synthesized
ccctttttccagggacaagagt

SEQ ID NO: 990556 - DNA, 22 bp, Artificial Sequence
  chemically synthesized
tctcctaaacccactcttgtcc

SEQ ID NO: 990557 - DNA, 22 bp, Artificial Sequence
  chemically synthesized
tttccagggacaagagtgggtt

SEQ ID NO: 990558 - DNA, 22 bp, Artificial Sequence
  chemically synthesized
gattatctcctaaacccactct

SEQ ID NO: 990559 - DNA, 22 bp, Artificial Sequence
  chemically synthesized
ttccagggacaagagtgggttt

SEQ ID NO: 990560 - DNA, 22 bp, Artificial Sequence
  chemically synthesized
tccagggacaagagtgggttta

SEQ ID NO: 990561 - DNA, 22 bp, Artificial Sequence
  chemically synthesized
ccagggacaagagtgggtttag

SEQ ID NO: 990562 - DNA, 22 bp, Artificial Sequence
  chemically synthesized
cagggacaagagtgggtttagg

SEQ ID NO: 990563 - DNA, 22 bp, Artificial Sequence
  chemically synthesized
gagaactggattatctcctaaa

SEQ ID NO: 990564 - DNA, 22 bp, Artificial Sequence
  chemically synthesized
aggagataatccagttctctag

SEQ ID NO: 990565 - DNA, 22 bp, Artificial Sequence
  chemically synthesized
ggagataatccagttctctagt

SEQ ID NO: 990566 - DNA, 22 bp, Artificial Sequence
  chemically synthesized
aacaagtatataactagagaac

SEQ ID NO: 990567 - DNA, 22 bp, Artificial Sequence
  chemically synthesized
aaacaagtatataactagagaa

SEQ ID NO: 990568 - DNA, 22 bp, Artificial Sequence
  chemically synthesized
taaacaagtatataactagaga

SEQ ID NO: 990569 - DNA, 22 bp, Artificial Sequence
  chemically synthesized
ttaaacaagtatataactagag

SEQ ID NO: 990570 - DNA, 22 bp, Artificial Sequence
  chemically synthesized
gtttttaaacaagtatataact

SEQ ID NO: 990571 - DNA, 22 bp, Artificial Sequence
  chemically synthesized
atctggtttttaaacaagtata

SEQ ID NO: 990572 - DNA, 22 bp, Artificial Sequence
  chemically synthesized
ctcatctggtttttaaacaagt

SEQ ID NO: 990573 - DNA, 22 bp, Artificial Sequence
  chemically synthesized
tctagttatatacttgtttaaa

SEQ ID NO: 990574 - DNA, 22 bp, Artificial Sequence
  chemically synthesized
tagttatatacttgtttaaaaa

SEQ ID NO: 990575 - DNA, 22 bp, Artificial Sequence
  chemically synthesized
gttatatacttgtttaaaaacc

SEQ ID NO: 990576 - DNA, 22 bp, Artificial Sequence
  chemically synthesized
tatacttgtttaaaaaccagat

SEQ ID NO: 990577 - DNA, 22 bp, Artificial Sequence
  chemically synthesized
gtttaaaaaccagatgaggaga

SEQ ID NO: 990578 - DNA, 22 bp, Artificial Sequence
  chemically synthesized
tttaaaaaccagatgaggagat

SEQ ID NO: 990579 - DNA, 22 bp, Artificial Sequence
  chemically synthesized
aaaaaccagatgaggagatcac

SEQ ID NO: 990580 - DNA, 22 bp, Artificial Sequence
  chemically synthesized
aaaaccagatgaggagatcact

SEQ ID NO: 990581 - DNA, 22 bp, Artificial Sequence
  chemically synthesized
cagaggcaaaagacgggtgagg

SEQ ID NO: 990582 - DNA, 22 bp, Artificial Sequence
  chemically synthesized
cctccagaggcaaaagacgggt

SEQ ID NO: 990583 - DNA, 22 bp, Artificial Sequence
  chemically synthesized
gcctccagaggcaaaagacggg

SEQ ID NO: 990584 - DNA, 22 bp, Artificial Sequence
  chemically synthesized
tgcctccagaggcaaaagacgg

SEQ ID NO: 990585 - DNA, 22 bp, Artificial Sequence
  chemically synthesized
ttgcctccagaggcaaaagacg

SEQ ID NO: 990586 - DNA, 22 bp, Artificial Sequence
  chemically synthesized
cctcacccgtcttttgcctctg

SEQ ID NO: 990587 - DNA, 22 bp, Artificial Sequence
  chemically synthesized
ctcacccgtcttttgcctctgg

SEQ ID NO: 990588 - DNA, 22 bp, Artificial Sequence
  chemically synthesized
acccgtcttttgcctctggagg

SEQ ID NO: 990589 - DNA, 22 bp, Artificial Sequence
  chemically synthesized
accataccttttgcctccagag

SEQ ID NO: 990590 - DNA, 22 bp, Artificial Sequence
  chemically synthesized
tgaccataccttttgcctccag

SEQ ID NO: 990591 - DNA, 22 bp, Artificial Sequence
  chemically synthesized
aactctgaccataccttttgcc

SEQ ID NO: 990592 - DNA, 22 bp, Artificial Sequence
  chemically synthesized
ttgcctctggaggcaaaaggta

SEQ ID NO: 990593 - DNA, 22 bp, Artificial Sequence
  chemically synthesized
tgcctctggaggcaaaaggtat

SEQ ID NO: 990594 - DNA, 22 bp, Artificial Sequence
  chemically synthesized
gcctctggaggcaaaaggtatg

SEQ ID NO: 990595 - DNA, 22 bp, Artificial Sequence
  chemically synthesized
cctctggaggcaaaaggtatgg

SEQ ID NO: 990596 - DNA, 22 bp, Artificial Sequence
  chemically synthesized
tcactgaactctgaccatacct

SEQ ID NO: 990597 - DNA, 22 bp, Artificial Sequence
  chemically synthesized
gtcactgaactctgaccatacc

SEQ ID NO: 990598 - DNA, 22 bp, Artificial Sequence
  chemically synthesized
tggaggcaaaaggtatggtcag

SEQ ID NO: 990599 - DNA, 22 bp, Artificial Sequence
  chemically synthesized
tgtcactgaactctgaccatac

SEQ ID NO: 990600 - DNA, 22 bp, Artificial Sequence
  chemically synthesized
gaggcaaaaggtatggtcagag

SEQ ID NO: 990601 - DNA, 22 bp, Artificial Sequence
  chemically synthesized
tcactttgtcactgaactctga

SEQ ID NO: 990602 - DNA, 22 bp, Artificial Sequence
  chemically synthesized
atgattgtcactttgtcactga

SEQ ID NO: 990603 - DNA, 22 bp, Artificial Sequence
  chemically synthesized
gatgattgtcactttgtcactg

SEQ ID NO: 990604 - DNA, 22 bp, Artificial Sequence
  chemically synthesized
ccttgatgattgtcactttgtc

SEQ ID NO: 990605 - DNA, 22 bp, Artificial Sequence
  chemically synthesized
aactcccttgatgattgtcact

SEQ ID NO: 990606 - DNA, 22 bp, Artificial Sequence
  chemically synthesized
agtgacaaagtgacaatcatca

SEQ ID NO: 990607 - DNA, 22 bp, Artificial Sequence
  chemically synthesized
actaaactcccttgatgattgt

SEQ ID NO: 990608 - DNA, 22 bp, Artificial Sequence
  chemically synthesized
agctgactaaactcccttgatg

SEQ ID NO: 990609 - DNA, 22 bp, Artificial Sequence
  chemically synthesized
gagaaacataacctcagctgac

SEQ ID NO: 990610 - DNA, 22 bp, Artificial Sequence
  chemically synthesized
agtcagctgaggttatgtttct

SEQ ID NO: 990611 - DNA, 22 bp, Artificial Sequence
  chemically synthesized
gtcagctgaggttatgtttctc

SEQ ID NO: 990612 - DNA, 22 bp, Artificial Sequence
  chemically synthesized
tataagaatgcctagagaaaca

SEQ ID NO: 990613 - DNA, 22 bp, Artificial Sequence
  chemically synthesized
actgtataagaatgcctagaga

SEQ ID NO: 990614 - DNA, 22 bp, Artificial Sequence
  chemically synthesized
aggttatgtttctctaggcatt

SEQ ID NO: 990615 - DNA, 22 bp, Artificial Sequence
  chemically synthesized
tgtttctctaggcattcttata

SEQ ID NO: 990616 - DNA, 22 bp, Artificial Sequence
  chemically synthesized
atggtctgactgtataagaatg

SEQ ID NO: 990617 - DNA, 22 bp, Artificial Sequence
  chemically synthesized
catggtctgactgtataagaat

SEQ ID NO: 990618 - DNA, 22 bp, Artificial Sequence
  chemically synthesized
tttcatggtctgactgtataag

SEQ ID NO: 990619 - DNA, 22 bp, Artificial Sequence
  chemically synthesized
ctctaggcattcttatacagtc

SEQ ID NO: 990620 - DNA, 22 bp, Artificial Sequence
  chemically synthesized
gtttcatggtctgactgtataa

SEQ ID NO: 990621 - DNA, 22 bp, Artificial Sequence
  chemically synthesized
tctaggcattcttatacagtca

SEQ ID NO: 990622 - DNA, 22 bp, Artificial Sequence
  chemically synthesized
taggcattcttatacagtcaga

SEQ ID NO: 990623 - DNA, 22 bp, Artificial Sequence
  chemically synthesized
ggcattcttatacagtcagacc

SEQ ID NO: 990624 - DNA, 22 bp, Artificial Sequence
  chemically synthesized
ttatacagtcagaccatgaaac

SEQ ID NO: 990625 - DNA, 22 bp, Artificial Sequence
  chemically synthesized
atacagtcagaccatgaaacaa

SEQ ID NO: 990626 - DNA, 22 bp, Artificial Sequence
  chemically synthesized
gaagcagtagtcttgtttcatg

SEQ ID NO: 990627 - DNA, 22 bp, Artificial Sequence
  chemically synthesized
tacagtcagaccatgaaacaag

SEQ ID NO: 990628 - DNA, 22 bp, Artificial Sequence
  chemically synthesized
ctggaagcagtagtcttgtttc

SEQ ID NO: 990629 - DNA, 22 bp, Artificial Sequence
  chemically synthesized
cctggaagcagtagtcttgttt

SEQ ID NO: 990630 - DNA, 22 bp, Artificial Sequence
  chemically synthesized
tggcatttcctggaagcagtag

SEQ ID NO: 990631 - DNA, 22 bp, Artificial Sequence
  chemically synthesized
ctgcttccaggaaatgccacaa

SEQ ID NO: 990632 - DNA, 22 bp, Artificial Sequence
  chemically synthesized
cttccaggaaatgccacaatac

SEQ ID NO: 990633 - DNA, 22 bp, Artificial Sequence
  chemically synthesized
ccaggaaatgccacaatacctc

SEQ ID NO: 990634 - DNA, 22 bp, Artificial Sequence
  chemically synthesized
caggaaatgccacaatacctcc

SEQ ID NO: 990635 - DNA, 22 bp, Artificial Sequence
  chemically synthesized
cagaaatgtaaataataaggag

SEQ ID NO: 990636 - DNA, 22 bp, Artificial Sequence
  chemically synthesized
ccagaaatgtaaataataagga

SEQ ID NO: 990637 - DNA, 22 bp, Artificial Sequence
  chemically synthesized
cttccagaaatgtaaataataa

SEQ ID NO: 990638 - DNA, 22 bp, Artificial Sequence
  chemically synthesized
gcttccagaaatgtaaataata

SEQ ID NO: 990639 - DNA, 22 bp, Artificial Sequence
  chemically synthesized
tgcttccagaaatgtaaataat

SEQ ID NO: 990640 - DNA, 22 bp, Artificial Sequence
  chemically synthesized
cctttgcttccagaaatgtaaa

SEQ ID NO: 990641 - DNA, 22 bp, Artificial Sequence
  chemically synthesized
ctgcctttgcttccagaaatgt

SEQ ID NO: 990642 - DNA, 22 bp, Artificial Sequence
  chemically synthesized
cttattatttacatttctggaa

SEQ ID NO: 990643 - DNA, 22 bp, Artificial Sequence
  chemically synthesized
tgctgcctttgcttccagaaat

SEQ ID NO: 990644 - DNA, 22 bp, Artificial Sequence
  chemically synthesized
attatttacatttctggaagca

SEQ ID NO: 990645 - DNA, 22 bp, Artificial Sequence
  chemically synthesized
ttatttacatttctggaagcaa

SEQ ID NO: 990646 - DNA, 22 bp, Artificial Sequence
  chemically synthesized
aattctgctgcctttgcttcca

SEQ ID NO: 990647 - DNA, 22 bp, Artificial Sequence
  chemically synthesized
tttacatttctggaagcaaagg

SEQ ID NO: 990648 - DNA, 22 bp, Artificial Sequence
  chemically synthesized
acatttctggaagcaaaggcag

SEQ ID NO: 990649 - DNA, 22 bp, Artificial Sequence
  chemically synthesized
catttctggaagcaaaggcagc

SEQ ID NO: 990650 - DNA, 22 bp, Artificial Sequence
  chemically synthesized
cagtggctaaattctgctgcct

SEQ ID NO: 990651 - DNA, 22 bp, Artificial Sequence
  chemically synthesized
ctggaagcaaaggcagcagaat

SEQ ID NO: 990652 - DNA, 22 bp, Artificial Sequence
  chemically synthesized
tggaagcaaaggcagcagaatt

SEQ ID NO: 990653 - DNA, 22 bp, Artificial Sequence
  chemically synthesized
gaagcaaaggcagcagaattta

SEQ ID NO: 990654 - DNA, 22 bp, Artificial Sequence
  chemically synthesized
gagaagacagtggagaggactc

SEQ ID NO: 990655 - DNA, 22 bp, Artificial Sequence
  chemically synthesized
agccactggagtcctctccact

SEQ ID NO: 990656 - DNA, 22 bp, Artificial Sequence
  chemically synthesized
gccactggagtcctctccactg

SEQ ID NO: 990657 - DNA, 22 bp, Artificial Sequence
  chemically synthesized
tactagagaagacagtggagag

SEQ ID NO: 990658 - DNA, 22 bp, Artificial Sequence
  chemically synthesized
cctgtactagagaagacagtgg

SEQ ID NO: 990659 - DNA, 22 bp, Artificial Sequence
  chemically synthesized
gagtcctctccactgtcttctc

SEQ ID NO: 990660 - DNA, 22 bp, Artificial Sequence
  chemically synthesized
aggaactacctgtactagagaa

SEQ ID NO: 990661 - DNA, 22 bp, Artificial Sequence
  chemically synthesized
tccactgtcttctctagtacag

SEQ ID NO: 990662 - DNA, 22 bp, Artificial Sequence
  chemically synthesized
cactgtcttctctagtacaggt

SEQ ID NO: 990663 - DNA, 22 bp, Artificial Sequence
  chemically synthesized
tcttctctagtacaggtagttc

SEQ ID NO: 990664 - DNA, 22 bp, Artificial Sequence
  chemically synthesized
gagtaatgttcaggaactacct

SEQ ID NO: 990665 - DNA, 22 bp, Artificial Sequence
  chemically synthesized
ggagtaatgttcaggaactacc

SEQ ID NO: 990666 - DNA, 22 bp, Artificial Sequence
  chemically synthesized
ctctagtacaggtagttcctga

SEQ ID NO: 990667 - DNA, 22 bp, Artificial Sequence
  chemically synthesized
tctagtacaggtagttcctgaa

SEQ ID NO: 990668 - DNA, 22 bp, Artificial Sequence
  chemically synthesized
tagtacaggtagttcctgaaca

SEQ ID NO: 990669 - DNA, 22 bp, Artificial Sequence
  chemically synthesized
gtacaggtagttcctgaacatt

SEQ ID NO: 990670 - DNA, 22 bp, Artificial Sequence
  chemically synthesized
tagatttggagtaatgttcagg

SEQ ID NO: 990671 - DNA, 22 bp, Artificial Sequence
  chemically synthesized
tgtagatttggagtaatgttca

SEQ ID NO: 990672 - DNA, 22 bp, Artificial Sequence
  chemically synthesized
ctgaacattactccaaatctac

SEQ ID NO: 990673 - DNA, 22 bp, Artificial Sequence
  chemically synthesized
aacattactccaaatctacaga

SEQ ID NO: 990674 - DNA, 22 bp, Artificial Sequence
  chemically synthesized
tcaataagggtctctgtagatt

SEQ ID NO: 990675 - DNA, 22 bp, Artificial Sequence
  chemically synthesized
ctccaaatctacagagaccctt

SEQ ID NO: 990676 - DNA, 22 bp, Artificial Sequence
  chemically synthesized
taatatctgtcaataagggtct

SEQ ID NO: 990677 - DNA, 22 bp, Artificial Sequence
  chemically synthesized
caaatctacagagacccttatt

SEQ ID NO: 990678 - DNA, 22 bp, Artificial Sequence
  chemically synthesized
tgtaatatctgtcaataagggt

SEQ ID NO: 990679 - DNA, 22 bp, Artificial Sequence
  chemically synthesized
cagagacccttattgacagata

SEQ ID NO: 990680 - DNA, 22 bp, Artificial Sequence
  chemically synthesized
gtgagtatctctgtaatatctg

SEQ ID NO: 990681 - DNA, 22 bp, Artificial Sequence
  chemically synthesized
attgacagatattacagagata

SEQ ID NO: 990682 - DNA, 22 bp, Artificial Sequence
  chemically synthesized
ttgacagatattacagagatac

SEQ ID NO: 990683 - DNA, 22 bp, Artificial Sequence
  chemically synthesized
gcatgttggtgagtatctctgt

SEQ ID NO: 990684 - DNA, 22 bp, Artificial Sequence
  chemically synthesized
acagatattacagagatactca

SEQ ID NO: 990685 - DNA, 22 bp, Artificial Sequence
  chemically synthesized
gctggcatgttggtgagtatct

SEQ ID NO: 990686 - DNA, 22 bp, Artificial Sequence
  chemically synthesized
cgctggcatgttggtgagtatc

SEQ ID NO: 990687 - DNA, 22 bp, Artificial Sequence
  chemically synthesized
cagagatactcaccaacatgcc

SEQ ID NO: 990688 - DNA, 22 bp, Artificial Sequence
  chemically synthesized
accaacatgccagcgaaacatg

SEQ ID NO: 990689 - DNA, 22 bp, Artificial Sequence
  chemically synthesized
caatagccaataaaaaacaaaa

SEQ ID NO: 990690 - DNA, 22 bp, Artificial Sequence
  chemically synthesized
attgttttttgttttttattgg

SEQ ID NO: 990691 - DNA, 22 bp, Artificial Sequence
  chemically synthesized
ttgttttttgttttttattggc

SEQ ID NO: 990692 - DNA, 22 bp, Artificial Sequence
  chemically synthesized
ttttttgttttttattggctat

SEQ ID NO: 990693 - DNA, 22 bp, Artificial Sequence
  chemically synthesized
tttgttttttattggctattgt

SEQ ID NO: 990694 - DNA, 22 bp, Artificial Sequence
  chemically synthesized
ttgttttttattggctattgta

SEQ ID NO: 990695 - DNA, 22 bp, Artificial Sequence
  chemically synthesized
tgttttttattggctattgtag

SEQ ID NO: 990696 - DNA, 22 bp, Artificial Sequence
  chemically synthesized
gttttttattggctattgtagt

SEQ ID NO: 990697 - DNA, 22 bp, Artificial Sequence
  chemically synthesized
ttttttattggctattgtagtt

SEQ ID NO: 990698 - DNA, 22 bp, Artificial Sequence
  chemically synthesized
tttattggctattgtagtttta

SEQ ID NO: 990699 - DNA, 22 bp, Artificial Sequence
  chemically synthesized
ttattggctattgtagttttac

SEQ ID NO: 990700 - DNA, 22 bp, Artificial Sequence
  chemically synthesized
tattggctattgtagttttact

SEQ ID NO: 990701 - DNA, 22 bp, Artificial Sequence
  chemically synthesized
attggctattgtagttttactt

SEQ ID NO: 990702 - DNA, 22 bp, Artificial Sequence
  chemically synthesized
ttggctattgtagttttactta

SEQ ID NO: 990703 - DNA, 22 bp, Artificial Sequence
  chemically synthesized
gctattgtagttttacttatcc

SEQ ID NO: 990704 - DNA, 22 bp, Artificial Sequence
  chemically synthesized
ataaaatagatgaggataagta

SEQ ID NO: 990705 - DNA, 22 bp, Artificial Sequence
  chemically synthesized
ttgtagttttacttatcctcat

SEQ ID NO: 990706 - DNA, 22 bp, Artificial Sequence
  chemically synthesized
tagttttacttatcctcatcta

SEQ ID NO: 990707 - DNA, 22 bp, Artificial Sequence
  chemically synthesized
tacttatcctcatctattttat

SEQ ID NO: 990708 - DNA, 22 bp, Artificial Sequence
  chemically synthesized
aacaagaccctaataaaataga

SEQ ID NO: 990709 - DNA, 22 bp, Artificial Sequence
  chemically synthesized
acttatcctcatctattttatt

SEQ ID NO: 990710 - DNA, 22 bp, Artificial Sequence
  chemically synthesized
cttatcctcatctattttatta

SEQ ID NO: 990711 - DNA, 22 bp, Artificial Sequence
  chemically synthesized
atcctcatctattttattaggg

SEQ ID NO: 990712 - DNA, 22 bp, Artificial Sequence
  chemically synthesized
tcctcatctattttattagggt

SEQ ID NO: 990713 - DNA, 22 bp, Artificial Sequence
  chemically synthesized
atctattttattagggtcttgt

SEQ ID NO: 990714 - DNA, 22 bp, Artificial Sequence
  chemically synthesized
ttttattagggtcttgttgagt

SEQ ID NO: 990715 - DNA, 22 bp, Artificial Sequence
  chemically synthesized
acgatagtgaagactcaacaag

SEQ ID NO: 990716 - DNA, 22 bp, Artificial Sequence
  chemically synthesized
tattagggtcttgttgagtctt

SEQ ID NO: 990717 - DNA, 22 bp, Artificial Sequence
  chemically synthesized
attagggtcttgttgagtcttc

SEQ ID NO: 990718 - DNA, 22 bp, Artificial Sequence
  chemically synthesized
ttagggtcttgttgagtcttca

SEQ ID NO: 990719 - DNA, 22 bp, Artificial Sequence
  chemically synthesized
gggtcttgttgagtcttcacta

SEQ ID NO: 990720 - DNA, 22 bp, Artificial Sequence
  chemically synthesized
aggtgctcacgatagtgaagac

SEQ ID NO: 990721 - DNA, 22 bp, Artificial Sequence
  chemically synthesized
gttgagtcttcactatcgtgag

SEQ ID NO: 990722 - DNA, 22 bp, Artificial Sequence
  chemically synthesized
ttgagtcttcactatcgtgagc

SEQ ID NO: 990723 - DNA, 22 bp, Artificial Sequence
  chemically synthesized
agtcttcactatcgtgagcacc

SEQ ID NO: 990724 - DNA, 22 bp, Artificial Sequence
  chemically synthesized
gagacaaggaatactgaggtgc

SEQ ID NO: 990725 - DNA, 22 bp, Artificial Sequence
  chemically synthesized
cactatcgtgagcacctcagta

SEQ ID NO: 990726 - DNA, 22 bp, Artificial Sequence
  chemically synthesized
actatcgtgagcacctcagtat

SEQ ID NO: 990727 - DNA, 22 bp, Artificial Sequence
  chemically synthesized
tggagacaaggaatactgaggt

SEQ ID NO: 990728 - DNA, 22 bp, Artificial Sequence
  chemically synthesized
ctggagacaaggaatactgagg

SEQ ID NO: 990729 - DNA, 22 bp, Artificial Sequence
  chemically synthesized
tctggagacaaggaatactgag

SEQ ID NO: 990730 - DNA, 22 bp, Artificial Sequence
  chemically synthesized
tcgtgagcacctcagtattcct

SEQ ID NO: 990731 - DNA, 22 bp, Artificial Sequence
  chemically synthesized
tttctggagacaaggaatactg

SEQ ID NO: 990732 - DNA, 22 bp, Artificial Sequence
  chemically synthesized
ctttctggagacaaggaatact

SEQ ID NO: 990733 - DNA, 22 bp, Artificial Sequence
  chemically synthesized
tctttctggagacaaggaatac

SEQ ID NO: 990734 - DNA, 22 bp, Artificial Sequence
  chemically synthesized
aagacattttctttctggagac

SEQ ID NO: 990735 - DNA, 22 bp, Artificial Sequence
  chemically synthesized
agtattccttgtctccagaaag

SEQ ID NO: 990736 - DNA, 22 bp, Artificial Sequence
  chemically synthesized
acctcaagacattttctttctg

SEQ ID NO: 990737 - DNA, 22 bp, Artificial Sequence
  chemically synthesized
taacctcaagacattttctttc

SEQ ID NO: 990738 - DNA, 22 bp, Artificial Sequence
  chemically synthesized
ctaacctcaagacattttcttt

SEQ ID NO: 990739 - DNA, 22 bp, Artificial Sequence
  chemically synthesized
cttgtctccagaaagaaaatgt

SEQ ID NO: 990740 - DNA, 22 bp, Artificial Sequence
  chemically synthesized
gtctccagaaagaaaatgtctt

SEQ ID NO: 990741 - DNA, 22 bp, Artificial Sequence
  chemically synthesized
tctccagaaagaaaatgtcttg

SEQ ID NO: 990742 - DNA, 22 bp, Artificial Sequence
  chemically synthesized
cagaaagaaaatgtcttgaggt

SEQ ID NO: 990743 - DNA, 22 bp, Artificial Sequence
  chemically synthesized
catacaatttctaacctcaaga

SEQ ID NO: 990744 - DNA, 22 bp, Artificial Sequence
  chemically synthesized
attacatacaatttctaacctc

SEQ ID NO: 990745 - DNA, 22 bp, Artificial Sequence
  chemically synthesized
attaattacatacaatttctaa

SEQ ID NO: 990746 - DNA, 22 bp, Artificial Sequence
  chemically synthesized
gaggttagaaattgtatgtaat

SEQ ID NO: 990747 - DNA, 22 bp, Artificial Sequence
  chemically synthesized
aggttagaaattgtatgtaatt

SEQ ID NO: 990748 - DNA, 22 bp, Artificial Sequence
  chemically synthesized
gaaattgtatgtaattaattaa

SEQ ID NO: 990749 - DNA, 22 bp, Artificial Sequence
  chemically synthesized
agatggaagagaaaattaatta

SEQ ID NO: 990750 - DNA, 22 bp, Artificial Sequence
  chemically synthesized
aagatggaagagaaaattaatt

SEQ ID NO: 990751 - DNA, 22 bp, Artificial Sequence
  chemically synthesized
taagatggaagagaaaattaat

SEQ ID NO: 990752 - DNA, 22 bp, Artificial Sequence
  chemically synthesized
ttaagatggaagagaaaattaa

SEQ ID NO: 990753 - DNA, 22 bp, Artificial Sequence
  chemically synthesized
tatgtaattaattaattttctc

SEQ ID NO: 990754 - DNA, 22 bp, Artificial Sequence
  chemically synthesized
tttaagatggaagagaaaatta

SEQ ID NO: 990755 - DNA, 22 bp, Artificial Sequence
  chemically synthesized
ttttaagatggaagagaaaatt

SEQ ID NO: 990756 - DNA, 22 bp, Artificial Sequence
  chemically synthesized
attaattttctcttccatctta

SEQ ID NO: 990757 - DNA, 22 bp, Artificial Sequence
  chemically synthesized
acagccatcttttttaagatgg

SEQ ID NO: 990758 - DNA, 22 bp, Artificial Sequence
  chemically synthesized
attttctcttccatcttaaaaa

SEQ ID NO: 990759 - DNA, 22 bp, Artificial Sequence
  chemically synthesized
tctcttccatcttaaaaaagat

SEQ ID NO: 990760 - DNA, 22 bp, Artificial Sequence
  chemically synthesized
ctcttccatcttaaaaaagatg

SEQ ID NO: 990761 - DNA, 22 bp, Artificial Sequence
  chemically synthesized
tcttccatcttaaaaaagatgg

SEQ ID NO: 990762 - DNA, 22 bp, Artificial Sequence
  chemically synthesized
ttccatcttaaaaaagatggct

SEQ ID NO: 990763 - DNA, 22 bp, Artificial Sequence
  chemically synthesized
ccatcttaaaaaagatggctgt

SEQ ID NO: 990764 - DNA, 22 bp, Artificial Sequence
  chemically synthesized
catcttaaaaaagatggctgtt

SEQ ID NO: 990765 - DNA, 22 bp, Artificial Sequence
  chemically synthesized
tgtcagtatagaattaacagcc

SEQ ID NO: 990766 - DNA, 22 bp, Artificial Sequence
  chemically synthesized
aaaaaagatggctgttaattct

SEQ ID NO: 990767 - DNA, 22 bp, Artificial Sequence
  chemically synthesized
aaaaagatggctgttaattcta

SEQ ID NO: 990768 - DNA, 22 bp, Artificial Sequence
  chemically synthesized
gatactatgtcagtatagaatt

SEQ ID NO: 990769 - DNA, 22 bp, Artificial Sequence
  chemically synthesized
ttagatactatgtcagtataga

SEQ ID NO: 990770 - DNA, 22 bp, Artificial Sequence
  chemically synthesized
ttaattctatactgacatagta

SEQ ID NO: 990771 - DNA, 22 bp, Artificial Sequence
  chemically synthesized
attctatactgacatagtatct

SEQ ID NO: 990772 - DNA, 22 bp, Artificial Sequence
  chemically synthesized
tatactgacatagtatctaata

SEQ ID NO: 990773 - DNA, 22 bp, Artificial Sequence
  chemically synthesized
tactgacatagtatctaataac

SEQ ID NO: 990774 - DNA, 22 bp, Artificial Sequence
  chemically synthesized
acatagtatctaataactgctt

SEQ ID NO: 990775 - DNA, 22 bp, Artificial Sequence
  chemically synthesized
caagatataaagaagcagttat

SEQ ID NO: 990776 - DNA, 22 bp, Artificial Sequence
  chemically synthesized
ataactgcttctttatatcttg

SEQ ID NO: 990777 - DNA, 22 bp, Artificial Sequence
  chemically synthesized
cttctttatatcttggagattt

SEQ ID NO: 990778 - DNA, 22 bp, Artificial Sequence
  chemically synthesized
aatatgccagggaaaatctcca

SEQ ID NO: 990779 - DNA, 22 bp, Artificial Sequence
  chemically synthesized
gaatatgccagggaaaatctcc

SEQ ID NO: 990780 - DNA, 22 bp, Artificial Sequence
  chemically synthesized
ctttatatcttggagattttcc

SEQ ID NO: 990781 - DNA, 22 bp, Artificial Sequence
  chemically synthesized
tttatatcttggagattttccc

SEQ ID NO: 990782 - DNA, 22 bp, Artificial Sequence
  chemically synthesized
tttgaatatgccagggaaaatc

SEQ ID NO: 990783 - DNA, 22 bp, Artificial Sequence
  chemically synthesized
tatatcttggagattttccctg

SEQ ID NO: 990784 - DNA, 22 bp, Artificial Sequence
  chemically synthesized
atttgaatatgccagggaaaat

SEQ ID NO: 990785 - DNA, 22 bp, Artificial Sequence
  chemically synthesized
atatcttggagattttccctgg

SEQ ID NO: 990786 - DNA, 22 bp, Artificial Sequence
  chemically synthesized
tatcttggagattttccctggc

SEQ ID NO: 990787 - DNA, 22 bp, Artificial Sequence
  chemically synthesized
tttatttgaatatgccagggaa

SEQ ID NO: 990788 - DNA, 22 bp, Artificial Sequence
  chemically synthesized
ggagattttccctggcatattc

SEQ ID NO: 990789 - DNA, 22 bp, Artificial Sequence
  chemically synthesized
gagattttccctggcatattca

SEQ ID NO: 990790 - DNA, 22 bp, Artificial Sequence
  chemically synthesized
aacagctatttatttgaatatg

SEQ ID NO: 990791 - DNA, 22 bp, Artificial Sequence
  chemically synthesized
aaacagctatttatttgaatat

SEQ ID NO: 990792 - DNA, 22 bp, Artificial Sequence
  chemically synthesized
tttaaacagctatttatttgaa

SEQ ID NO: 990793 - DNA, 22 bp, Artificial Sequence
  chemically synthesized
tccctggcatattcaaataaat

SEQ ID NO: 990794 - DNA, 22 bp, Artificial Sequence
  chemically synthesized
ccctggcatattcaaataaata

SEQ ID NO: 990795 - DNA, 22 bp, Artificial Sequence
  chemically synthesized
cctggcatattcaaataaatag

SEQ ID NO: 990796 - DNA, 22 bp, Artificial Sequence
  chemically synthesized
gcatattcaaataaatagctgt

SEQ ID NO: 990797 - DNA, 22 bp, Artificial Sequence
  chemically synthesized
acaggtcagggctatttaaaca

SEQ ID NO: 990798 - DNA, 22 bp, Artificial Sequence
  chemically synthesized
aaataaatagctgtttaaatag

SEQ ID NO: 990799 - DNA, 22 bp, Artificial Sequence
  chemically synthesized
tttaaatagccctgacctgtga

SEQ ID NO: 990800 - DNA, 22 bp, Artificial Sequence
  chemically synthesized
aaatagccctgacctgtgagta

SEQ ID NO: 990801 - DNA, 22 bp, Artificial Sequence
  chemically synthesized
aatagccctgacctgtgagtat

SEQ ID NO: 990802 - DNA, 22 bp, Artificial Sequence
  chemically synthesized
atgtgtacaagggcatatatac

SEQ ID NO: 990803 - DNA, 22 bp, Artificial Sequence
  chemically synthesized
acctgtgagtatatatgccctt

SEQ ID NO: 990804 - DNA, 22 bp, Artificial Sequence
  chemically synthesized
tgagtatatatgcccttgtaca

SEQ ID NO: 990805 - DNA, 22 bp, Artificial Sequence
  chemically synthesized
catatacattcatgtgtacaag

SEQ ID NO: 990806 - DNA, 22 bp, Artificial Sequence
  chemically synthesized
acatatacattcatgtgtacaa

SEQ ID NO: 990807 - DNA, 22 bp, Artificial Sequence
  chemically synthesized
catatttacatatacattcatg

SEQ ID NO: 990808 - DNA, 22 bp, Artificial Sequence
  chemically synthesized
gcatatttacatatacattcat

SEQ ID NO: 990809 - DNA, 22 bp, Artificial Sequence
  chemically synthesized
tgcatatttacatatacattca

SEQ ID NO: 990810 - DNA, 22 bp, Artificial Sequence
  chemically synthesized
gtacacatgaatgtatatgtaa

SEQ ID NO: 990811 - DNA, 22 bp, Artificial Sequence
  chemically synthesized
tacacatgaatgtatatgtaaa

SEQ ID NO: 990812 - DNA, 22 bp, Artificial Sequence
  chemically synthesized
tatctttgcatatttacatata

SEQ ID NO: 990813 - DNA, 22 bp, Artificial Sequence
  chemically synthesized
gtatctttgcatatttacatat

SEQ ID NO: 990814 - DNA, 22 bp, Artificial Sequence
  chemically synthesized
tgtatctttgcatatttacata

SEQ ID NO: 990815 - DNA, 22 bp, Artificial Sequence
  chemically synthesized
tcattttgtatctttgcatatt

SEQ ID NO: 990816 - DNA, 22 bp, Artificial Sequence
  chemically synthesized
atcattttgtatctttgcatat

SEQ ID NO: 990817 - DNA, 22 bp, Artificial Sequence
  chemically synthesized
tatttatcattttgtatctttg

SEQ ID NO: 990818 - DNA, 22 bp, Artificial Sequence
  chemically synthesized
gtatttatcattttgtatcttt

SEQ ID NO: 990819 - DNA, 22 bp, Artificial Sequence
  chemically synthesized
tgtatttatcattttgtatctt

SEQ ID NO: 990820 - DNA, 22 bp, Artificial Sequence
  chemically synthesized
actttgtatttatcattttgta

SEQ ID NO: 990821 - DNA, 22 bp, Artificial Sequence
  chemically synthesized
cactttgtatttatcattttgt

SEQ ID NO: 990822 - DNA, 22 bp, Artificial Sequence
  chemically synthesized
tcactttgtatttatcattttg

SEQ ID NO: 990823 - DNA, 22 bp, Artificial Sequence
  chemically synthesized
cctttcactttgtatttatcat

SEQ ID NO: 990824 - DNA, 22 bp, Artificial Sequence
  chemically synthesized
gcctttcactttgtatttatca

SEQ ID NO: 990825 - DNA, 22 bp, Artificial Sequence
  chemically synthesized
acaatttgcctttcactttgta

SEQ ID NO: 990826 - DNA, 22 bp, Artificial Sequence
  chemically synthesized
aaatatattaacaatttgcctt

SEQ ID NO: 990827 - DNA, 22 bp, Artificial Sequence
  chemically synthesized
aatgagttaaaatatattaaca

SEQ ID NO: 990828 - DNA, 22 bp, Artificial Sequence
  chemically synthesized
ttgaatgagttaaaatatatta

SEQ ID NO: 990829 - DNA, 22 bp, Artificial Sequence
  chemically synthesized
tgttgaatgagttaaaatatat

SEQ ID NO: 990830 - DNA, 22 bp, Artificial Sequence
  chemically synthesized
ctgttgaatgagttaaaatata

SEQ ID NO: 990831 - DNA, 22 bp, Artificial Sequence
  chemically synthesized
ttctgttgaatgagttaaaata

SEQ ID NO: 990832 - DNA, 22 bp, Artificial Sequence
  chemically synthesized
cttctgttgaatgagttaaaat

SEQ ID NO: 990833 - DNA, 22 bp, Artificial Sequence
  chemically synthesized
tcttctgttgaatgagttaaaa

SEQ ID NO: 990834 - DNA, 22 bp, Artificial Sequence
  chemically synthesized
tttcttctgttgaatgagttaa

SEQ ID NO: 990835 - DNA, 22 bp, Artificial Sequence
  chemically synthesized
ctttcttctgttgaatgagtta

SEQ ID NO: 990836 - DNA, 22 bp, Artificial Sequence
  chemically synthesized
ttaatatattttaactcattca

SEQ ID NO: 990837 - DNA, 22 bp, Artificial Sequence
  chemically synthesized
atatattttaactcattcaaca

SEQ ID NO: 990838 - DNA, 22 bp, Artificial Sequence
  chemically synthesized
ccttctttcttctgttgaatga

SEQ ID NO: 990839 - DNA, 22 bp, Artificial Sequence
  chemically synthesized
tcctgccttctttcttctgttg

SEQ ID NO: 990840 - DNA, 22 bp, Artificial Sequence
  chemically synthesized
taactcattcaacagaagaaag

SEQ ID NO: 990841 - DNA, 22 bp, Artificial Sequence
  chemically synthesized
aactcattcaacagaagaaaga

SEQ ID NO: 990842 - DNA, 22 bp, Artificial Sequence
  chemically synthesized
actcattcaacagaagaaagaa

SEQ ID NO: 990843 - DNA, 22 bp, Artificial Sequence
  chemically synthesized
attcaacagaagaaagaaggca

SEQ ID NO: 990844 - DNA, 22 bp, Artificial Sequence
  chemically synthesized
tagaggaagttatcctgccttc

SEQ ID NO: 990845 - DNA, 22 bp, Artificial Sequence
  chemically synthesized
aacagaagaaagaaggcaggat

SEQ ID NO: 990846 - DNA, 22 bp, Artificial Sequence
  chemically synthesized
aaattatagaggaagttatcct

SEQ ID NO: 990847 - DNA, 22 bp, Artificial Sequence
  chemically synthesized
aagaaaacctgaaattatagag

SEQ ID NO: 990848 - DNA, 22 bp, Artificial Sequence
  chemically synthesized
cctctataatttcaggttttct

SEQ ID NO: 990849 - DNA, 22 bp, Artificial Sequence
  chemically synthesized
ctctataatttcaggttttctt

SEQ ID NO: 990850 - DNA, 22 bp, Artificial Sequence
  chemically synthesized
tataatttcaggttttcttcag

SEQ ID NO: 990851 - DNA, 22 bp, Artificial Sequence
  chemically synthesized
taatttcaggttttcttcagga

SEQ ID NO: 990852 - DNA, 22 bp, Artificial Sequence
  chemically synthesized
caggttttcttcaggatgcata

SEQ ID NO: 990853 - DNA, 22 bp, Artificial Sequence
  chemically synthesized
aggttttcttcaggatgcatac

SEQ ID NO: 990854 - DNA, 22 bp, Artificial Sequence
  chemically synthesized
tcttcaggatgcataccacata

SEQ ID NO: 990855 - DNA, 22 bp, Artificial Sequence
  chemically synthesized
taatgtagcccatatgtggtat

SEQ ID NO: 990856 - DNA, 22 bp, Artificial Sequence
  chemically synthesized
cttcaggatgcataccacatat

SEQ ID NO: 990857 - DNA, 22 bp, Artificial Sequence
  chemically synthesized
ttcaggatgcataccacatatg

SEQ ID NO: 990858 - DNA, 22 bp, Artificial Sequence
  chemically synthesized
caggatgcataccacatatggg

SEQ ID NO: 990859 - DNA, 22 bp, Artificial Sequence
  chemically synthesized
aggatgcataccacatatgggc

SEQ ID NO: 990860 - DNA, 22 bp, Artificial Sequence
  chemically synthesized
gagggaacattgtaatgtagcc

SEQ ID NO: 990861 - DNA, 22 bp, Artificial Sequence
  chemically synthesized
cctggagggaacattgtaatgt

SEQ ID NO: 990862 - DNA, 22 bp, Artificial Sequence
  chemically synthesized
ctacctggagggaacattgtaa

SEQ ID NO: 990863 - DNA, 22 bp, Artificial Sequence
  chemically synthesized
gctacctggagggaacattgta

SEQ ID NO: 990864 - DNA, 22 bp, Artificial Sequence
  chemically synthesized
cattacaatgttccctccaggt

SEQ ID NO: 990865 - DNA, 22 bp, Artificial Sequence
  chemically synthesized
aacatatttgctacctggaggg

SEQ ID NO: 990866 - DNA, 22 bp, Artificial Sequence
  chemically synthesized
caatgttccctccaggtagcaa

SEQ ID NO: 990867 - DNA, 22 bp, Artificial Sequence
  chemically synthesized
aaattgaacatatttgctacct

SEQ ID NO: 990868 - DNA, 22 bp, Artificial Sequence
  chemically synthesized
aaaattgaacatatttgctacc

SEQ ID NO: 990869 - DNA, 22 bp, Artificial Sequence
  chemically synthesized
taaaattgaacatatttgctac

SEQ ID NO: 990870 - DNA, 22 bp, Artificial Sequence
  chemically synthesized
ctttaaaattgaacatatttgc

SEQ ID NO: 990871 - DNA, 22 bp, Artificial Sequence
  chemically synthesized
cctccaggtagcaaatatgttc

SEQ ID NO: 990872 - DNA, 22 bp, Artificial Sequence
  chemically synthesized
tctactttaaaattgaacatat

SEQ ID NO: 990873 - DNA, 22 bp, Artificial Sequence
  chemically synthesized
caggtagcaaatatgttcaatt

SEQ ID NO: 990874 - DNA, 22 bp, Artificial Sequence
  chemically synthesized
cgacagttgtctactttaaaat

SEQ ID NO: 990875 - DNA, 22 bp, Artificial Sequence
  chemically synthesized
ccgacagttgtctactttaaaa

SEQ ID NO: 990876 - DNA, 22 bp, Artificial Sequence
  chemically synthesized
aattttaaagtagacaactgtc

SEQ ID NO: 990877 - DNA, 22 bp, Artificial Sequence
  chemically synthesized
aaaaatcaatttccgacagttg

SEQ ID NO: 990878 - DNA, 22 bp, Artificial Sequence
  chemically synthesized
aaaaaatcaatttccgacagtt

SEQ ID NO: 990879 - DNA, 22 bp, Artificial Sequence
  chemically synthesized
taaaaaatcaatttccgacagt

SEQ ID NO: 990880 - DNA, 22 bp, Artificial Sequence
  chemically synthesized
taaagtagacaactgtcggaaa

SEQ ID NO: 990881 - DNA, 22 bp, Artificial Sequence
  chemically synthesized
aaagtagacaactgtcggaaat

SEQ ID NO: 990882 - DNA, 22 bp, Artificial Sequence
  chemically synthesized
aagtagacaactgtcggaaatt

SEQ ID NO: 990883 - DNA, 22 bp, Artificial Sequence
  chemically synthesized
tcggaaattgattttttaaaga

SEQ ID NO: 990884 - DNA, 22 bp, Artificial Sequence
  chemically synthesized
aacgcccaccccccatctttaa

SEQ ID NO: 990885 - DNA, 22 bp, Artificial Sequence
  chemically synthesized
ctcaacgcccaccccccatctt

SEQ ID NO: 990886 - DNA, 22 bp, Artificial Sequence
  chemically synthesized
actcaacgcccaccccccatct

SEQ ID NO: 990887 - DNA, 22 bp, Artificial Sequence
  chemically synthesized
attttttaaagatggggggtgg

SEQ ID NO: 990888 - DNA, 22 bp, Artificial Sequence
  chemically synthesized
tttaaagatggggggtgggcgt

SEQ ID NO: 990889 - DNA, 22 bp, Artificial Sequence
  chemically synthesized
ttaaagatggggggtgggcgtt

SEQ ID NO: 990890 - DNA, 22 bp, Artificial Sequence
  chemically synthesized
taaagatggggggtgggcgttg

SEQ ID NO: 990891 - DNA, 22 bp, Artificial Sequence
  chemically synthesized
aaagatggggggtgggcgttga

SEQ ID NO: 990892 - DNA, 22 bp, Artificial Sequence
  chemically synthesized
aagatggggggtgggcgttgag

SEQ ID NO: 990893 - DNA, 22 bp, Artificial Sequence
  chemically synthesized
caatatacaagcataatagatt

SEQ ID NO: 990894 - DNA, 22 bp, Artificial Sequence
  chemically synthesized
gcaatatacaagcataatagat

SEQ ID NO: 990895 - DNA, 22 bp, Artificial Sequence
  chemically synthesized
agtaaatctattatgcttgtat

SEQ ID NO: 990896 - DNA, 22 bp, Artificial Sequence
  chemically synthesized
cagcatttgcaatatacaagca

SEQ ID NO: 990897 - DNA, 22 bp, Artificial Sequence
  chemically synthesized
ttatgcttgtatattgcaaatg

SEQ ID NO: 990898 - DNA, 22 bp, Artificial Sequence
  chemically synthesized
tgcttgtatattgcaaatgctg

SEQ ID NO: 990899 - DNA, 22 bp, Artificial Sequence
  chemically synthesized
aaaaaataatagttacagcatt

SEQ ID NO: 990900 - DNA, 22 bp, Artificial Sequence
  chemically synthesized
aaaaaaataatagttacagcat

SEQ ID NO: 990901 - DNA, 22 bp, Artificial Sequence
  chemically synthesized
gtatattgcaaatgctgtaact

SEQ ID NO: 990902 - DNA, 22 bp, Artificial Sequence
  chemically synthesized
taaaaaaataatagttacagca

SEQ ID NO: 990903 - DNA, 22 bp, Artificial Sequence
  chemically synthesized
tatattgcaaatgctgtaacta

SEQ ID NO: 990904 - DNA, 22 bp, Artificial Sequence
  chemically synthesized
ttaaaaaaataatagttacagc

SEQ ID NO: 990905 - DNA, 22 bp, Artificial Sequence
  chemically synthesized
caaatgctgtaactattatttt

SEQ ID NO: 990906 - DNA, 22 bp, Artificial Sequence
  chemically synthesized
taactattatttttttaaaaga

SEQ ID NO: 990907 - DNA, 22 bp, Artificial Sequence
  chemically synthesized
gtgaaagtcaagtcttttaaaa

SEQ ID NO: 990908 - DNA, 22 bp, Artificial Sequence
  chemically synthesized
ttagtgaaagtcaagtctttta

SEQ ID NO: 990909 - DNA, 22 bp, Artificial Sequence
  chemically synthesized
ttatttttttaaaagacttgac

SEQ ID NO: 990910 - DNA, 22 bp, Artificial Sequence
  chemically synthesized
ttgttagtgaaagtcaagtctt

SEQ ID NO: 990911 - DNA, 22 bp, Artificial Sequence
  chemically synthesized
gttgttagtgaaagtcaagtct

SEQ ID NO: 990912 - DNA, 22 bp, Artificial Sequence
  chemically synthesized
tttttttaaaagacttgacttt

SEQ ID NO: 990913 - DNA, 22 bp, Artificial Sequence
  chemically synthesized
ttttaaaagacttgactttcac

SEQ ID NO: 990914 - DNA, 22 bp, Artificial Sequence
  chemically synthesized
tttaaaagacttgactttcact

SEQ ID NO: 990915 - DNA, 22 bp, Artificial Sequence
  chemically synthesized
ttaaaagacttgactttcacta

SEQ ID NO: 990916 - DNA, 22 bp, Artificial Sequence
  chemically synthesized
taaaagacttgactttcactaa

SEQ ID NO: 990917 - DNA, 22 bp, Artificial Sequence
  chemically synthesized
aaaagacttgactttcactaac

SEQ ID NO: 990918 - DNA, 22 bp, Artificial Sequence
  chemically synthesized
aaagacttgactttcactaaca

SEQ ID NO: 990919 - DNA, 22 bp, Artificial Sequence
  chemically synthesized
gactttcactaacaacaaattt

SEQ ID NO: 990920 - DNA, 22 bp, Artificial Sequence
  chemically synthesized
atataaagaagaaaatttgttg

SEQ ID NO: 990921 - DNA, 22 bp, Artificial Sequence
  chemically synthesized
actttcactaacaacaaatttt

SEQ ID NO: 990922 - DNA, 22 bp, Artificial Sequence
  chemically synthesized
tcactaacaacaaattttcttc

SEQ ID NO: 990923 - DNA, 22 bp, Artificial Sequence
  chemically synthesized
cactaacaacaaattttcttct

SEQ ID NO: 990924 - DNA, 22 bp, Artificial Sequence
  chemically synthesized
actaacaacaaattttcttctt

SEQ ID NO: 990925 - DNA, 22 bp, Artificial Sequence
  chemically synthesized
acaacaaattttcttctttata

SEQ ID NO: 990926 - DNA, 22 bp, Artificial Sequence
  chemically synthesized
tcttctttatatgaatatactg

SEQ ID NO: 990927 - DNA, 22 bp, Artificial Sequence
  chemically synthesized
cttctttatatgaatatactga

SEQ ID NO: 990928 - DNA, 22 bp, Artificial Sequence
  chemically synthesized
ttctttatatgaatatactgat

SEQ ID NO: 990929 - DNA, 22 bp, Artificial Sequence
  chemically synthesized
ctttatatgaatatactgatct

SEQ ID NO: 990930 - DNA, 22 bp, Artificial Sequence
  chemically synthesized
tgatccgatgggagatcagtat

SEQ ID NO: 990931 - DNA, 22 bp, Artificial Sequence
  chemically synthesized
tttatatgaatatactgatctc

SEQ ID NO: 990932 - DNA, 22 bp, Artificial Sequence
  chemically synthesized
tatatgaatatactgatctccc

SEQ ID NO: 990933 - DNA, 22 bp, Artificial Sequence
  chemically synthesized
atatgaatatactgatctccca

SEQ ID NO: 990934 - DNA, 22 bp, Artificial Sequence
  chemically synthesized
tatgaatatactgatctcccat

SEQ ID NO: 990935 - DNA, 22 bp, Artificial Sequence
  chemically synthesized
tccaacactatgatccgatggg

SEQ ID NO: 990936 - DNA, 22 bp, Artificial Sequence
  chemically synthesized
ggaactgtccaacactatgatc

SEQ ID NO: 990937 - DNA, 22 bp, Artificial Sequence
  chemically synthesized
atctcccatcggatcatagtgt

SEQ ID NO: 990938 - DNA, 22 bp, Artificial Sequence
  chemically synthesized
ccatcggatcatagtgttggac

SEQ ID NO: 990939 - DNA, 22 bp, Artificial Sequence
  chemically synthesized
aaggtacattaggaactgtcca

SEQ ID NO: 990940 - DNA, 22 bp, Artificial Sequence
  chemically synthesized
tctcaaggtacattaggaactg

SEQ ID NO: 990941 - DNA, 22 bp, Artificial Sequence
  chemically synthesized
atctcaaggtacattaggaact

SEQ ID NO: 990942 - DNA, 22 bp, Artificial Sequence
  chemically synthesized
ttatctcaaggtacattaggaa

SEQ ID NO: 990943 - DNA, 22 bp, Artificial Sequence
  chemically synthesized
gacagttcctaatgtaccttga

SEQ ID NO: 990944 - DNA, 22 bp, Artificial Sequence
  chemically synthesized
agcatctcttatctcaaggtac

SEQ ID NO: 990945 - DNA, 22 bp, Artificial Sequence
  chemically synthesized
gagcatctcttatctcaaggta

SEQ ID NO: 990946 - DNA, 22 bp, Artificial Sequence
  chemically synthesized
ctaatgtaccttgagataagag

SEQ ID NO: 990947 - DNA, 22 bp, Artificial Sequence
  chemically synthesized
atgtaccttgagataagagatg

SEQ ID NO: 990948 - DNA, 22 bp, Artificial Sequence
  chemically synthesized
atgaaacccttgagcatctctt

SEQ ID NO: 990949 - DNA, 22 bp, Artificial Sequence
  chemically synthesized
gagataagagatgctcaagggt

SEQ ID NO: 990950 - DNA, 22 bp, Artificial Sequence
  chemically synthesized
agataagagatgctcaagggtt

SEQ ID NO: 990951 - DNA, 22 bp, Artificial Sequence
  chemically synthesized
aaaatctaatgaaacccttgag

SEQ ID NO: 990952 - DNA, 22 bp, Artificial Sequence
  chemically synthesized
taaaaatctaatgaaacccttg

SEQ ID NO: 990953 - DNA, 22 bp, Artificial Sequence
  chemically synthesized
tctaaaaatctaatgaaaccct

SEQ ID NO: 990954 - DNA, 22 bp, Artificial Sequence
  chemically synthesized
tctctaaaaatctaatgaaacc

SEQ ID NO: 990955 - DNA, 22 bp, Artificial Sequence
  chemically synthesized
ctctctctaaaaatctaatgaa

SEQ ID NO: 990956 - DNA, 22 bp, Artificial Sequence
  chemically synthesized
actctctctaaaaatctaatga

SEQ ID NO: 990957 - DNA, 22 bp, Artificial Sequence
  chemically synthesized
tactctctctaaaaatctaatg

SEQ ID NO: 990958 - DNA, 22 bp, Artificial Sequence
  chemically synthesized
ttactctctctaaaaatctaat

SEQ ID NO: 990959 - DNA, 22 bp, Artificial Sequence
  chemically synthesized
aagggtttcattagatttttag

SEQ ID NO: 990960 - DNA, 22 bp, Artificial Sequence
  chemically synthesized
gcttttactctctctaaaaatc

SEQ ID NO: 990961 - DNA, 22 bp, Artificial Sequence
  chemically synthesized
agcctggcttttactctctcta

SEQ ID NO: 990962 - DNA, 22 bp, Artificial Sequence
  chemically synthesized
cattagatttttagagagagta

SEQ ID NO: 990963 - DNA, 22 bp, Artificial Sequence
  chemically synthesized
cagcctggcttttactctctct

SEQ ID NO: 990964 - DNA, 22 bp, Artificial Sequence
  chemically synthesized
attagatttttagagagagtaa

SEQ ID NO: 990965 - DNA, 22 bp, Artificial Sequence
  chemically synthesized
tcagcctggcttttactctctc

SEQ ID NO: 990966 - DNA, 22 bp, Artificial Sequence
  chemically synthesized
gatttttagagagagtaaaagc

SEQ ID NO: 990967 - DNA, 22 bp, Artificial Sequence
  chemically synthesized
ttagagagagtaaaagccaggc

SEQ ID NO: 990968 - DNA, 22 bp, Artificial Sequence
  chemically synthesized
tagagagagtaaaagccaggct

SEQ ID NO: 990969 - DNA, 22 bp, Artificial Sequence
  chemically synthesized
agagagagtaaaagccaggctg

SEQ ID NO: 990970 - DNA, 22 bp, Artificial Sequence
  chemically synthesized
gagagagtaaaagccaggctga

SEQ ID NO: 990971 - DNA, 22 bp, Artificial Sequence
  chemically synthesized
aaaatgttcctggattctatat

SEQ ID NO: 990972 - DNA, 22 bp, Artificial Sequence
  chemically synthesized
ctggattctatatttgtctctt

SEQ ID NO: 990973 - DNA, 22 bp, Artificial Sequence
  chemically synthesized
aaaagataagtgaagagacaaa

SEQ ID NO: 990974 - DNA, 22 bp, Artificial Sequence
  chemically synthesized
gattctatatttgtctcttcac

SEQ ID NO: 990975 - DNA, 22 bp, Artificial Sequence
  chemically synthesized
ttaaaaagataagtgaagagac

SEQ ID NO: 990976 - DNA, 22 bp, Artificial Sequence
  chemically synthesized
tatatttgtctcttcacttatc

SEQ ID NO: 990977 - DNA, 22 bp, Artificial Sequence
  chemically synthesized
tatttgtctcttcacttatctt

SEQ ID NO: 990978 - DNA, 22 bp, Artificial Sequence
  chemically synthesized
gtctcttcacttatctttttaa

SEQ ID NO: 990979 - DNA, 22 bp, Artificial Sequence
  chemically synthesized
tctcttcacttatctttttaat

SEQ ID NO: 990980 - DNA, 22 bp, Artificial Sequence
  chemically synthesized
tgtgtgagtgttattaaaaaga

SEQ ID NO: 990981 - DNA, 22 bp, Artificial Sequence
  chemically synthesized
ttcacttatctttttaataaca

SEQ ID NO: 990982 - DNA, 22 bp, Artificial Sequence
  chemically synthesized
cacttatctttttaataacact

SEQ ID NO: 990983 - DNA, 22 bp, Artificial Sequence
  chemically synthesized
acttatctttttaataacactc

SEQ ID NO: 990984 - DNA, 22 bp, Artificial Sequence
  chemically synthesized
atctttttaataacactcacac

SEQ ID NO: 990985 - DNA, 22 bp, Artificial Sequence
  chemically synthesized
tctttttaataacactcacaca

SEQ ID NO: 990986 - DNA, 22 bp, Artificial Sequence
  chemically synthesized
tttaataacactcacacacaga

SEQ ID NO: 990987 - DNA, 22 bp, Artificial Sequence
  chemically synthesized
ttaataacactcacacacagac

SEQ ID NO: 990988 - DNA, 22 bp, Artificial Sequence
  chemically synthesized
taataacactcacacacagaca

SEQ ID NO: 990989 - DNA, 22 bp, Artificial Sequence
  chemically synthesized
agtataaaaatgtgtctgtgtg

SEQ ID NO: 990990 - DNA, 22 bp, Artificial Sequence
  chemically synthesized
aataacactcacacacagacac

SEQ ID NO: 990991 - DNA, 22 bp, Artificial Sequence
  chemically synthesized
ataacactcacacacagacaca

SEQ ID NO: 990992 - DNA, 22 bp, Artificial Sequence
  chemically synthesized
aagttgagtataaaaatgtgtc

SEQ ID NO: 990993 - DNA, 22 bp, Artificial Sequence
  chemically synthesized
gaagttgagtataaaaatgtgt

SEQ ID NO: 990994 - DNA, 22 bp, Artificial Sequence
  chemically synthesized
tttgaagttgagtataaaaatg

SEQ ID NO: 990995 - DNA, 22 bp, Artificial Sequence
  chemically synthesized
acacacagacacatttttatac

SEQ ID NO: 990996 - DNA, 22 bp, Artificial Sequence
  chemically synthesized
atttgaagttgagtataaaaat

SEQ ID NO: 990997 - DNA, 22 bp, Artificial Sequence
  chemically synthesized
tatttgaagttgagtataaaaa

SEQ ID NO: 990998 - DNA, 22 bp, Artificial Sequence
  chemically synthesized
ttatttgaagttgagtataaaa

SEQ ID NO: 990999 - DNA, 22 bp, Artificial Sequence
  chemically synthesized
ttatactcaacttcaaataaaa

SEQ ID NO: 991000 - DNA, 22 bp, Artificial Sequence
  chemically synthesized
tatactcaacttcaaataaaag

SEQ ID NO: 991001 - DNA, 22 bp, Artificial Sequence
  chemically synthesized
atactcaacttcaaataaaagt

SEQ ID NO: 991002 - DNA, 22 bp, Artificial Sequence
  chemically synthesized
tactcaacttcaaataaaagta

SEQ ID NO: 991003 - DNA, 22 bp, Artificial Sequence
  chemically synthesized
aacttcaaataaaagtatgccc

SEQ ID NO: 991004 - DNA, 22 bp, Artificial Sequence
  chemically synthesized
caaataaaagtatgccctgccc

SEQ ID NO: 991005 - DNA, 22 bp, Artificial Sequence
  chemically synthesized
aaataaaagtatgccctgccct

SEQ ID NO: 991006 - DNA, 22 bp, Artificial Sequence
  chemically synthesized
tcagcaaaagaaagggcagggc

SEQ ID NO: 991007 - DNA, 22 bp, Artificial Sequence
  chemically synthesized
ttatcagcaaaagaaagggcag

SEQ ID NO: 991008 - DNA, 22 bp, Artificial Sequence
  chemically synthesized
attatcagcaaaagaaagggca

SEQ ID NO: 991009 - DNA, 22 bp, Artificial Sequence
  chemically synthesized
ccctttcttttgctgataataa

SEQ ID NO: 991010 - DNA, 22 bp, Artificial Sequence
  chemically synthesized
taccatccacatatttattatc

SEQ ID NO: 991011 - DNA, 22 bp, Artificial Sequence
  chemically synthesized
tcttttgctgataataaatatg

SEQ ID NO: 991012 - DNA, 22 bp, Artificial Sequence
  chemically synthesized
cttttgctgataataaatatgt

SEQ ID NO: 991013 - DNA, 22 bp, Artificial Sequence
  chemically synthesized
ttttgctgataataaatatgtg

SEQ ID NO: 991014 - DNA, 22 bp, Artificial Sequence
  chemically synthesized
ttgctgataataaatatgtgga

SEQ ID NO: 991015 - DNA, 22 bp, Artificial Sequence
  chemically synthesized
gagactataccatccacatatt

SEQ ID NO: 991016 - DNA, 22 bp, Artificial Sequence
  chemically synthesized
tgctgataataaatatgtggat

SEQ ID NO: 991017 - DNA, 22 bp, Artificial Sequence
  chemically synthesized
gctgataataaatatgtggatg

SEQ ID NO: 991018 - DNA, 22 bp, Artificial Sequence
  chemically synthesized
tggagactataccatccacata

SEQ ID NO: 991019 - DNA, 22 bp, Artificial Sequence
  chemically synthesized
ctgataataaatatgtggatgg

SEQ ID NO: 991020 - DNA, 22 bp, Artificial Sequence
  chemically synthesized
tctggagactataccatccaca

SEQ ID NO: 991021 - DNA, 22 bp, Artificial Sequence
  chemically synthesized
ataataaatatgtggatggtat

SEQ ID NO: 991022 - DNA, 22 bp, Artificial Sequence
  chemically synthesized
gctctctggagactataccatc

SEQ ID NO: 991023 - DNA, 22 bp, Artificial Sequence
  chemically synthesized
cgctctctggagactataccat

SEQ ID NO: 991024 - DNA, 22 bp, Artificial Sequence
  chemically synthesized
tcgctctctggagactatacca

SEQ ID NO: 991025 - DNA, 22 bp, Artificial Sequence
  chemically synthesized
agggcactttcgctctctggag

SEQ ID NO: 991026 - DNA, 22 bp, Artificial Sequence
  chemically synthesized
aagggcactttcgctctctgga

SEQ ID NO: 991027 - DNA, 22 bp, Artificial Sequence
  chemically synthesized
aaacaaatgtttaagggcactt

SEQ ID NO: 991028 - DNA, 22 bp, Artificial Sequence
  chemically synthesized
aaaacaaatgtttaagggcact

SEQ ID NO: 991029 - DNA, 22 bp, Artificial Sequence
  chemically synthesized
cagagagcgaaagtgcccttaa

SEQ ID NO: 991030 - DNA, 22 bp, Artificial Sequence
  chemically synthesized
tgatcttaaaacaaatgtttaa

SEQ ID NO: 991031 - DNA, 22 bp, Artificial Sequence
  chemically synthesized
atgatcttaaaacaaatgttta

SEQ ID NO: 991032 - DNA, 22 bp, Artificial Sequence
  chemically synthesized
tatgatcttaaaacaaatgttt

SEQ ID NO: 991033 - DNA, 22 bp, Artificial Sequence
  chemically synthesized
ttatgatcttaaaacaaatgtt

SEQ ID NO: 991034 - DNA, 22 bp, Artificial Sequence
  chemically synthesized
aaacatttgttttaagatcata

SEQ ID NO: 991035 - DNA, 22 bp, Artificial Sequence
  chemically synthesized
aacatttgttttaagatcataa

SEQ ID NO: 991036 - DNA, 22 bp, Artificial Sequence
  chemically synthesized
aaaataacagtagtttttatga

SEQ ID NO: 991037 - DNA, 22 bp, Artificial Sequence
  chemically synthesized
aaaaataacagtagtttttatg

SEQ ID NO: 991038 - DNA, 22 bp, Artificial Sequence
  chemically synthesized
taaaaataacagtagtttttat

SEQ ID NO: 991039 - DNA, 22 bp, Artificial Sequence
  chemically synthesized
gttttaagatcataaaaactac

SEQ ID NO: 991040 - DNA, 22 bp, Artificial Sequence
  chemically synthesized
ttttaagatcataaaaactact

SEQ ID NO: 991041 - DNA, 22 bp, Artificial Sequence
  chemically synthesized
ctttaaaaataacagtagtttt

SEQ ID NO: 991042 - DNA, 22 bp, Artificial Sequence
  chemically synthesized
taagatcataaaaactactgtt

SEQ ID NO: 991043 - DNA, 22 bp, Artificial Sequence
  chemically synthesized
tactttaaaaataacagtagtt

SEQ ID NO: 991044 - DNA, 22 bp, Artificial Sequence
  chemically synthesized
aagatcataaaaactactgtta

SEQ ID NO: 991045 - DNA, 22 bp, Artificial Sequence
  chemically synthesized
ctactttaaaaataacagtagt

SEQ ID NO: 991046 - DNA, 22 bp, Artificial Sequence
  chemically synthesized
agatcataaaaactactgttat

SEQ ID NO: 991047 - DNA, 22 bp, Artificial Sequence
  chemically synthesized
tctactttaaaaataacagtag

SEQ ID NO: 991048 - DNA, 22 bp, Artificial Sequence
  chemically synthesized
ttctactttaaaaataacagta

SEQ ID NO: 991049 - DNA, 22 bp, Artificial Sequence
  chemically synthesized
atggatttttctactttaaaaa

SEQ ID NO: 991050 - DNA, 22 bp, Artificial Sequence
  chemically synthesized
ctgttatttttaaagtagaaaa

SEQ ID NO: 991051 - DNA, 22 bp, Artificial Sequence
  chemically synthesized
aatattcatggatttttctact

SEQ ID NO: 991052 - DNA, 22 bp, Artificial Sequence
  chemically synthesized
caatattcatggatttttctac

SEQ ID NO: 991053 - DNA, 22 bp, Artificial Sequence
  chemically synthesized
ttatttttaaagtagaaaaatc

SEQ ID NO: 991054 - DNA, 22 bp, Artificial Sequence
  chemically synthesized
tttttaaagtagaaaaatccat

SEQ ID NO: 991055 - DNA, 22 bp, Artificial Sequence
  chemically synthesized
caatttcaatattcatggattt

SEQ ID NO: 991056 - DNA, 22 bp, Artificial Sequence
  chemically synthesized
ttaaagtagaaaaatccatgaa

SEQ ID NO: 991057 - DNA, 22 bp, Artificial Sequence
  chemically synthesized
acaatttcaatattcatggatt

SEQ ID NO: 991058 - DNA, 22 bp, Artificial Sequence
  chemically synthesized
taaagtagaaaaatccatgaat

SEQ ID NO: 991059 - DNA, 22 bp, Artificial Sequence
  chemically synthesized
tacaatttcaatattcatggat

SEQ ID NO: 991060 - DNA, 22 bp, Artificial Sequence
  chemically synthesized
aaagtagaaaaatccatgaata

SEQ ID NO: 991061 - DNA, 22 bp, Artificial Sequence
  chemically synthesized
aagtagaaaaatccatgaatat

SEQ ID NO: 991062 - DNA, 22 bp, Artificial Sequence
  chemically synthesized
attttacaatttcaatattcat

SEQ ID NO: 991063 - DNA, 22 bp, Artificial Sequence
  chemically synthesized
gattttacaatttcaatattca

SEQ ID NO: 991064 - DNA, 22 bp, Artificial Sequence
  chemically synthesized
ccttgattttacaatttcaata

SEQ ID NO: 991065 - DNA, 22 bp, Artificial Sequence
  chemically synthesized
cccttgattttacaatttcaat

SEQ ID NO: 991066 - DNA, 22 bp, Artificial Sequence
  chemically synthesized
tcccttgattttacaatttcaa

SEQ ID NO: 991067 - DNA, 22 bp, Artificial Sequence
  chemically synthesized
ttcccttgattttacaatttca

SEQ ID NO: 991068 - DNA, 22 bp, Artificial Sequence
  chemically synthesized
ttttcccttgattttacaattt

SEQ ID NO: 991069 - DNA, 22 bp, Artificial Sequence
  chemically synthesized
cttttcccttgattttacaatt
